United States Patent 10,706,955 (BIOINFORMATIC PROCESSES FOR DETERMINATION OF PEPTIDE BINDING) - sequence listing, part 43

SEQ ID NO: 1649171 - protein, 23 aa, Staphylococcus aureus
LREVRKRQLIELIDDALVNKDEA

SEQ ID NO: 1649172 - protein, 26 aa, Staphylococcus aureus
LRNELTVCGSWNCLSSNFPGKEWTAT

SEQ ID NO: 1649173 - protein, 20 aa, Staphylococcus aureus
LRYYEKVGVIPPVNRDENGY

SEQ ID NO: 1649174 - protein, 19 aa, Staphylococcus aureus
LSKREIEVLREMVKGKTNK

SEQ ID NO: 1649175 - protein, 18 aa, Staphylococcus aureus
LVGYNISPVLWKKVKKGL

SEQ ID NO: 1649176 - protein, 18 aa, Staphylococcus aureus
LVVWAIKEGRGVAKAVDQ

SEQ ID NO: 1649177 - protein, 26 aa, Staphylococcus aureus
MATLFPNRVDLGLGRAPGTDMMTASA

SEQ ID NO: 1649178 - protein, 24 aa, Staphylococcus aureus
MDYVKRGAANLALISEDPDLMDGI

SEQ ID NO: 1649179 - protein, 17 aa, Staphylococcus aureus
MEDELGDLPQWISDLDG

SEQ ID NO: 1649180 - protein, 17 aa, Staphylococcus aureus
MEGKAVLFKSFAGINGV

SEQ ID NO: 1649181 - protein, 21 aa, Staphylococcus aureus
MKHLHFKDIIEYFRPGDTLVL

SEQ ID NO: 1649182 - protein, 25 aa, Staphylococcus aureus
MLRLIKPKYFLPIHGEYRMLKAHGE

SEQ ID NO: 1649183 - protein, 17 aa, Staphylococcus aureus
MNLKEQFLVKLQERAIP

SEQ ID NO: 1649184 - protein, 21 aa, Staphylococcus aureus
MPKTDFPMRGGLPNKEPQIQE

SEQ ID NO: 1649185 - protein, 18 aa, Staphylococcus aureus
MSARMHKGTEQMLGMFAN

SEQ ID NO: 1649186 - protein, 19 aa, Staphylococcus aureus
MTERVLRSETDMLKKQDLI

SEQ ID NO: 1649187 - protein, 21 aa, Staphylococcus aureus
MTTIRVARAYTKRNKIIKFAG

SEQ ID NO: 1649188 - protein, 18 aa, Staphylococcus aureus
MVAKHLISPELIKQPAAA

SEQ ID NO: 1649189 - protein, 18 aa, Staphylococcus aureus
MVIDCAKGIEPQTLKLFK

SEQ ID NO: 1649190 - protein, 22 aa, Staphylococcus aureus
NAFVPSVVGLICASYVVNDVLK

SEQ ID NO: 1649191 - protein, 22 aa, Staphylococcus aureus
NDMGRLRGKIFYQSGERPRIVS

SEQ ID NO: 1649192 - protein, 18 aa, Staphylococcus aureus
NEEGLAFYDRIFDELIAQ

SEQ ID NO: 1649193 - protein, 24 aa, Staphylococcus aureus
NFEPEHLEALLAQVSIKPVINQVE

SEQ ID NO: 1649194 - protein, 17 aa, Staphylococcus aureus
NGYYADTGISFVVGESD

SEQ ID NO: 1649195 - protein, 17 aa, Staphylococcus aureus
NIGHRFNINVGIVGDSK

SEQ ID NO: 1649196 - protein, 22 aa, Staphylococcus aureus
NKKDIRTIIHFHLSTSPSNYIQ

SEQ ID NO: 1649197 - protein, 23 aa, Staphylococcus aureus
NLIPNSKCKLISATGHTIHVEDS

SEQ ID NO: 1649198 - protein, 20 aa, Staphylococcus aureus
NPDELMAFLKNKRKNILENA

SEQ ID NO: 1649199 - protein, 24 aa, Staphylococcus aureus
NTPARLKYIKSLYTELGKITDIVN

SEQ ID NO: 1649200 - protein, 19 aa, Staphylococcus aureus
NVNLIMGFVRVFGKGDKER

SEQ ID NO: 1649201 - protein, 25 aa, Staphylococcus aureus
PARIKCATLAWKALEKGTVAKEGKA

SEQ ID NO: 1649202 - protein, 21 aa, Staphylococcus aureus
PETFNDYEFYAMEGHQYHPSY

SEQ ID NO: 1649203 - protein, 23 aa, Staphylococcus aureus
PIRLEPMNTFPVIRDLQVDRSRM

SEQ ID NO: 1649204 - protein, 22 aa, Staphylococcus aureus
PKGVPMKVMLEGLEKKTGFTNA

SEQ ID NO: 1649205 - protein, 20 aa, Staphylococcus aureus
PKQFDVIVCENLFGDILSDE

SEQ ID NO: 1649206 - protein, 22 aa, Staphylococcus aureus
PLMRPIEACYARADEQQIAIIE

SEQ ID NO: 1649207 - protein, 18 aa, Staphylococcus aureus
PLSPYEIETLNQWIDVDK

SEQ ID NO: 1649208 - protein, 23 aa, Staphylococcus aureus
PNVTGKLHLGHAWDTTLQDIITR

SEQ ID NO: 1649209 - protein, 19 aa, Staphylococcus aureus
PNYYDNFAIWSTQTNAMHQ

SEQ ID NO: 1649210 - protein, 23 aa, Staphylococcus aureus
PSDIRAAGGVARMANPKIVEEVM

SEQ ID NO: 1649211 - protein, 23 aa, Staphylococcus aureus
PSIKEIRGRGLFIGIELNTDAAP

SEQ ID NO: 1649212 - protein, 19 aa, Staphylococcus aureus
PTAAFVAARAGAMAKHTDH

SEQ ID NO: 1649213 - protein, 18 aa, Staphylococcus aureus
PVGRLDYDTSGLLLLTND

SEQ ID NO: 1649214 - protein, 18 aa, Staphylococcus aureus
PVILEPMMKVTIEMPEEY

SEQ ID NO: 1649215 - protein, 22 aa, Staphylococcus aureus
PVPGGVGPLTITMVLNNTLLAE

SEQ ID NO: 1649216 - protein, 19 aa, Staphylococcus aureus
PYVIVCLNTIVAENDDEAQ

SEQ ID NO: 1649217 - protein, 18 aa, Staphylococcus aureus
QAISEVIEYCYREKLIDH

SEQ ID NO: 1649218 - protein, 22 aa, Staphylococcus aureus
QALKEIGYICAKVRNTMQAATK

SEQ ID NO: 1649219 - protein, 27 aa, Staphylococcus aureus
QCLYVKLDPYWLYHLYDKDIVPFEGRE

SEQ ID NO: 1649220 - protein, 19 aa, Staphylococcus aureus
QDIPFETFLGFKGDKVPDI

SEQ ID NO: 1649221 - protein, 17 aa, Staphylococcus aureus
QILTLLLQVMDDGNLTD

SEQ ID NO: 1649222 - protein, 20 aa, Staphylococcus aureus
QINNVLAFPGIFRGALEVEA

SEQ ID NO: 1649223 - protein, 17 aa, Staphylococcus aureus
QKIKVLLAQSLFGEPDV

SEQ ID NO: 1649224 - protein, 19 aa, Staphylococcus aureus
QLEFYSTQCDLELYFTSLS

SEQ ID NO: 1649225 - protein, 18 aa, Staphylococcus aureus
QLEKMIAPFYRKWDHQVF

SEQ ID NO: 1649226 - protein, 19 aa, Staphylococcus aureus
QNHVQIMAWSPFAGGKIFD

SEQ ID NO: 1649227 - protein, 23 aa, Staphylococcus aureus
QPFGATIPYYFTGHEGPDSCCID

SEQ ID NO: 1649228 - protein, 25 aa, Staphylococcus aureus
QPSPFHWRLLDKITLSTLYEVVLPI

SEQ ID NO: 1649229 - protein, 17 aa, Staphylococcus aureus
QQIEAIIVTGTRAEELQ

SEQ ID NO: 1649230 - protein, 27 aa, Staphylococcus aureus
QSCLTTGFCLWCQLAFSTYLENATQPH

SEQ ID NO: 1649231 - protein, 23 aa, Staphylococcus aureus
QTKISMVTAYDFPSAKQVEAAGI

SEQ ID NO: 1649232 - protein, 19 aa, Staphylococcus aureus
RAAAGGDEAAIFAGDLMRM

SEQ ID NO: 1649233 - protein, 19 aa, Staphylococcus aureus
RAYEMLDVVMHYKAREMAL

SEQ ID NO: 1649234 - protein, 20 aa, Staphylococcus aureus
RCPYGPRPGEQVKQYTVEIA

SEQ ID NO: 1649235 - protein, 22 aa, Staphylococcus aureus
RDILINECIYFASKNKKLVRLN

SEQ ID NO: 1649236 - protein, 18 aa, Staphylococcus aureus
RETYEIMTPQLVGVSTTE

SEQ ID NO: 1649237 - protein, 20 aa, Staphylococcus aureus
RFLIVFSDGEPSAFNYSQDG

SEQ ID NO: 1649238 - protein, 22 aa, Staphylococcus aureus
RGGFTTVCPMPNTRPVPDSVEH

SEQ ID NO: 1649239 - protein, 18 aa, Staphylococcus aureus
RGLANVRPALPVSDEYLA

SEQ ID NO: 1649240 - protein, 22 aa, Staphylococcus aureus
RHGQTLFNFKGLIQGFGDSPLT

SEQ ID NO: 1649241 - protein, 17 aa, Staphylococcus aureus
RIRNLEFQYVIASDLAS

SEQ ID NO: 1649242 - protein, 24 aa, Staphylococcus aureus
RITHGEINAVIALEPFTVEFEKIK

SEQ ID NO: 1649243 - protein, 21 aa, Staphylococcus aureus
RKIDMRLAAYIIGIKRTAEAA

SEQ ID NO: 1649244 - protein, 17 aa, Staphylococcus aureus
RLGAKRADGQFVTGGSI

SEQ ID NO: 1649245 - protein, 18 aa, Staphylococcus aureus
RLMLGFKNKPLQEAPQKY

SEQ ID NO: 1649246 - protein, 21 aa, Staphylococcus aureus
RMFRMEHNPLFEYIYQQKEDI

SEQ ID NO: 1649247 - protein, 23 aa, Staphylococcus aureus
RMKRAQKLFGQKIHVFDIRKHEM

SEQ ID NO: 1649248 - protein, 17 aa, Staphylococcus aureus
RMNELFGNVEVVNKDKG

SEQ ID NO: 1649249 - protein, 23 aa, Staphylococcus aureus
RNFKEVTNVTGIVLTKLDGTAKG

SEQ ID NO: 1649250 - protein, 19 aa, Staphylococcus aureus
RNKGIKILPFDANNIKEDM

SEQ ID NO: 1649251 - protein, 29 aa, Staphylococcus aureus
RNPENLPWKELDIDIAIDATGKFNHGDKA

SEQ ID NO: 1649252 - protein, 18 aa, Staphylococcus aureus
RPKGQRVSNMMIQGHAVD

SEQ ID NO: 1649253 - protein, 18 aa, Staphylococcus aureus
RPLLTYDKEEIIIKSKEI

SEQ ID NO: 1649254 - protein, 18 aa, Staphylococcus aureus
RPVVIRRELLDHYSDLGL

SEQ ID NO: 1649255 - protein, 27 aa, Staphylococcus aureus
RQKLKKLGIRKGIPVVFSDESPIVIRE

SEQ ID NO: 1649256 - protein, 18 aa, Staphylococcus aureus
RSLQWGNDAYTMILDRMN

SEQ ID NO: 1649257 - protein, 25 aa, Staphylococcus aureus
RTAPWLRRLGFENVKEVLLDPERQN

SEQ ID NO: 1649258 - protein, 20 aa, Staphylococcus aureus
RTRIIDCLETAHTRLQLLSK

SEQ ID NO: 1649259 - protein, 32 aa, Staphylococcus aureus
RTVGLELLEKGIARTGYEVMDLDGNIIGEVTS

SEQ ID NO: 1649260 - protein, 20 aa, Staphylococcus aureus
RVMNGEKMIHPKAQDVFETV

SEQ ID NO: 1649261 - protein, 31 aa, Staphylococcus aureus
RVQGVGFRYFTQRIAMNYNIVGTVQNVDDYV

SEQ ID NO: 1649262 - protein, 20 aa, Staphylococcus aureus
RYDPNQCILCGRCVEACQDI

SEQ ID NO: 1649263 - protein, 19 aa, Staphylococcus aureus
RYYIQRFLARAFGFEVDDI

SEQ ID NO: 1649264 - protein, 18 aa, Staphylococcus aureus
SDKTAFFLNGYVNEYDDT

SEQ ID NO: 1649265 - protein, 17 aa, Staphylococcus aureus
SDLKEIIIRTAEVLGTG

SEQ ID NO: 1649266 - protein, 20 aa, Staphylococcus aureus
SEGVIKVMAKMGISTVQSYQ

SEQ ID NO: 1649267 - protein, 31 aa, Staphylococcus aureus
SESGTGAGVRRIEALTGKAAFLYLEDIQEKF

SEQ ID NO: 1649268 - protein, 23 aa, Staphylococcus aureus
SEVKRLKSDPSFYGDFLEDSHRC

SEQ ID NO: 1649269 - protein, 18 aa, Staphylococcus aureus
SGAPRLQSNLFHIVKEFV

SEQ ID NO: 1649270 - protein, 18 aa, Staphylococcus aureus
SGQKAVLIPGDIRDEQFN

SEQ ID NO: 1649271 - protein, 28 aa, Staphylococcus aureus
SGVDIKEVFLKLPIIGTEVYDESNEIDF

SEQ ID NO: 1649272 - protein, 24 aa, Staphylococcus aureus
SHKKEHMIRAALEGVLYNLYTVYL

SEQ ID NO: 1649273 - protein, 24 aa, Staphylococcus aureus
SIRALLDLCDLITVMPVERAIKRT

SEQ ID NO: 1649274 - protein, 21 aa, Staphylococcus aureus
SKDGIKALLDHEQFNVDIQTG

SEQ ID NO: 1649275 - protein, 17 aa, Staphylococcus aureus
SKQFWAYLVKTGQLDNP

SEQ ID NO: 1649276 - protein, 24 aa, Staphylococcus aureus
SKSIFPSCRVAYMVLPYSIMKKYH

SEQ ID NO: 1649277 - protein, 26 aa, Staphylococcus aureus
SKVGRIINFFSLFSKFVINIPKMLKY

SEQ ID NO: 1649278 - protein, 19 aa, Staphylococcus aureus
SLFNQGLDLLQEIIWNPLI

SEQ ID NO: 1649279 - protein, 20 aa, Staphylococcus aureus
SLGSHDGVGMVFGKPIAGKK

SEQ ID NO: 1649280 - protein, 19 aa, Staphylococcus aureus
SLQYQRFIRHVQFLIRRLR

SEQ ID NO: 1649281 - protein, 20 aa, Staphylococcus aureus
SMIEDFKVTIWYTAPTALRM

SEQ ID NO: 1649282 - protein, 19 aa, Staphylococcus aureus
SNYAELRLSVDTSNIEAQV

SEQ ID NO: 1649283 - protein, 22 aa, Staphylococcus aureus
SPSIKPWILPNFTALVNHEKID

SEQ ID NO: 1649284 - protein, 25 aa, Staphylococcus aureus
SQHPQLKICACLGLTNDEQAKKLKS

SEQ ID NO: 1649285 - protein, 32 aa, Staphylococcus aureus
SRPESEVNYIMNLPVNFLKTFLPELIEKNVKV

SEQ ID NO: 1649286 - protein, 21 aa, Staphylococcus aureus
SRPNLSGNFKYVYDELLRQKV

SEQ ID NO: 1649287 - protein, 24 aa, Staphylococcus aureus
SSPRGIYCGAIGLLLPTEDDKMIF

SEQ ID NO: 1649288 - protein, 17 aa, Staphylococcus aureus
STGKRLQIGDLLQKPTV

SEQ ID NO: 1649289 - protein, 17 aa, Staphylococcus aureus
SVPQKSASRYTTTSEER

SEQ ID NO: 1649290 - protein, 35 aa, Staphylococcus aureus
TADHCHYIKDGSCWCVKAFNQRRLMKASNIVNCSR

SEQ ID NO: 1649291 - protein, 24 aa, Staphylococcus aureus
TAGWTGDVKYHLGGIKTTDSYGTM

SEQ ID NO: 1649292 - protein, 34 aa, Staphylococcus aureus
TATFMILGAVCTRACRFCAVKTGLPNELDLNEPE

SEQ ID NO: 1649293 - protein, 17 aa, Staphylococcus aureus
TAVQYDLPLTVFVLNNK

SEQ ID NO: 1649294 - protein, 22 aa, Staphylococcus aureus
TDKGRRLNVFYATQVAIEPPTF

SEQ ID NO: 1649295 - protein, 21 aa, Staphylococcus aureus
TDPHEIIGIIAGGQHAMTMAV

SEQ ID NO: 1649296 - protein, 23 aa, Staphylococcus aureus
TEKYSVLRALKAIERSNVVLVVI

SEQ ID NO: 1649297 - protein, 22 aa, Staphylococcus aureus
TELPMNPAISLFVTVKDTIEME

SEQ ID NO: 1649298 - protein, 20 aa, Staphylococcus aureus
TFEIKPKYDLNIMKSGQTLS

SEQ ID NO: 1649299 - protein, 26 aa, Staphylococcus aureus
TGEVIKAVPGFNVIAAINEGYVGTLP

SEQ ID NO: 1649300 - protein, 26 aa, Staphylococcus aureus
TIAIMSGNFVMRGEPAIYNKFTRAKM

SEQ ID NO: 1649301 - protein, 21 aa, Staphylococcus aureus
TIDLTELIVAYQRVKNRVELN

SEQ ID NO: 1649302 - protein, 26 aa, Staphylococcus aureus
TITEGFARCIPMIFLNPAPGQELENA

SEQ ID NO: 1649303 - protein, 20 aa, Staphylococcus aureus
TKLKNGRKFLTKGDKCKVSI

SEQ ID NO: 1649304 - protein, 26 aa, Staphylococcus aureus
TKLYFEGVSVFDMLDIVENITLDSIN

SEQ ID NO: 1649305 - protein, 18 aa, Staphylococcus aureus
TLRIKWVEKGNIESYDDF

SEQ ID NO: 1649306 - protein, 17 aa, Staphylococcus aureus
TMRARGAQVTDITILVV

SEQ ID NO: 1649307 - protein, 25 aa, Staphylococcus aureus
TQRIIKENIEVAAKYGAVDTVIEAI

SEQ ID NO: 1649308 - protein, 25 aa, Staphylococcus aureus
TRNIKKRMVKNICQSMITFDKEGMP

SEQ ID NO: 1649309 - protein, 18 aa, Staphylococcus aureus
TRQRKRAYEMLDVVMHYK

SEQ ID NO: 1649310 - protein, 24 aa, Staphylococcus aureus
TSEGKLLFNEALRIIEHLDSTIEQ

SEQ ID NO: 1649311 - protein, 18 aa, Staphylococcus aureus
TVIIPGIMEHIERAGVHS

SEQ ID NO: 1649312 - protein, 17 aa, Staphylococcus aureus
TVIRFAPPLIITKEELD

SEQ ID NO: 1649313 - protein, 18 aa, Staphylococcus aureus
TVTLKTLGLIIVMAQSGL

SEQ ID NO: 1649314 - protein, 18 aa, Staphylococcus aureus
TVTRFEPHQALFADNHGY

SEQ ID NO: 1649315 - protein, 43 aa, Staphylococcus aureus
TYVTQLICYDLRFPELLRYPARSGAKIAFYVAQWPMSRLQHWH

SEQ ID NO: 1649316 - protein, 20 aa, Staphylococcus aureus
VDRYLLNRLREFTASTINNY

SEQ ID NO: 1649317 - protein, 26 aa, Staphylococcus aureus
VEALRTLRLVIDMSKEPDLYLQISAI

SEQ ID NO: 1649318 - protein, 22 aa, Staphylococcus aureus
VEGIKIELEDKIYILFHKPTQV

SEQ ID NO: 1649319 - protein, 20 aa, Staphylococcus aureus
VFDRGGYLYHGRVKALAEAA

SEQ ID NO: 1649320 - protein, 22 aa, Staphylococcus aureus
VGYREVMGLNVAMLEIDVHLTK

SEQ ID NO: 1649321 - protein, 19 aa, Staphylococcus aureus
VHVAFKLAASRRGKLTSVD

SEQ ID NO: 1649322 - protein, 26 aa, Staphylococcus aureus
VIGAGRIGLGVAKRAQSFGMKILAFD

SEQ ID NO: 1649323 - protein, 18 aa, Staphylococcus aureus
VIGDYVAGPSHVLPTNRT

SEQ ID NO: 1649324 - protein, 25 aa, Staphylococcus aureus
VLDEAHCLSEWGYDFRPHYALIGKV

SEQ ID NO: 1649325 - protein, 17 aa, Staphylococcus aureus
VLLCGSGIGTSQLLKSK

SEQ ID NO: 1649326 - protein, 18 aa, Staphylococcus aureus
VMAKMGISTVQSYQGAQI

SEQ ID NO: 1649327 - protein, 19 aa, Staphylococcus aureus
VMPGFDFYFVPTVLNSTDV

SEQ ID NO: 1649328 - protein, 17 aa, Staphylococcus aureus
VPAGGALAVDRHDFSGY

SEQ ID NO: 1649329 - protein, 26 aa, Staphylococcus aureus
VQETEVINVFPIRFIVDKENEVSDPK

SEQ ID NO: 1649330 - protein, 17 aa, Staphylococcus aureus
VQPELGKTFQILREQGF

SEQ ID NO: 1649331 - protein, 21 aa, Staphylococcus aureus
VQVIHELPFDKGLSRVCTNIR

SEQ ID NO: 1649332 - protein, 23 aa, Staphylococcus aureus
VRFLERDEFNLFLDLYRETEERA

SEQ ID NO: 1649333 - protein, 26 aa, Staphylococcus aureus
VRFRPSQEIIQVWHAVGAFKTVGFSR

SEQ ID NO: 1649334 - protein, 18 aa, Staphylococcus aureus
VRPALPVSDEYLAVQDAM

SEQ ID NO: 1649335 - protein, 22 aa, Staphylococcus aureus
VSNRGHDSIAIFKVLDNGQHLE

SEQ ID NO: 1649336 - protein, 27 aa, Staphylococcus aureus
VSNVKPGQWLGVFGIGGLGNLALQYAK

SEQ ID NO: 1649337 - protein, 18 aa, Staphylococcus aureus
VSPTGQRAITHILTSKMI

SEQ ID NO: 1649338 - protein, 18 aa, Staphylococcus aureus
VSTLSKRPFNVVMTPSDK

SEQ ID NO: 1649339 - protein, 26 aa, Staphylococcus aureus
VTIPPWNFPFAIMAGTTLAPVVAGNT

SEQ ID NO: 1649340 - protein, 26 aa, Staphylococcus aureus
VVKIDRFPIFIPQALINEQIEYKIIK

SEQ ID NO: 1649341 - protein, 18 aa, Staphylococcus aureus
WHLAHNRIIIPKSQTPKR

SEQ ID NO: 1649342 - protein, 18 aa, Staphylococcus aureus
WIHPDERSAAFFAVGLIK

SEQ ID NO: 1649343 - protein, 17 aa, Staphylococcus aureus
WKAASRVIDAAVEKAYN

SEQ ID NO: 1649344 - protein, 17 aa, Staphylococcus aureus
WWEEVEKAYQFLVNEGY

SEQ ID NO: 1649345 - protein, 18 aa, Staphylococcus aureus
YALENNIGYFVIDSLEEI

SEQ ID NO: 1649346 - protein, 18 aa, Staphylococcus aureus
YDEVMRFGKYHPDYKKVM

SEQ ID NO: 1649347 - protein, 17 aa, Staphylococcus aureus
YDITSLYTFKQPVSPHL

SEQ ID NO: 1649348 - protein, 17 aa, Staphylococcus aureus
YEGGIAFASKPLIDADF

SEQ ID NO: 1649349 - protein, 18 aa, Staphylococcus aureus
YEKLAIATLGVRNGATFI

SEQ ID NO: 1649350 - protein, 17 aa, Staphylococcus aureus
YFKKTVNPFDHKAVPGG

SEQ ID NO: 1649351 - protein, 21 aa, Staphylococcus aureus
YGGEFQLKQGFSPAFTVEPKE

SEQ ID NO: 1649352 - protein, 24 aa, Staphylococcus aureus
YINCNHNLDFALAIRTMMIDEQYI

SEQ ID NO: 1649353 - protein, 17 aa, Staphylococcus aureus
YIVTWALGHLVTNATPE

SEQ ID NO: 1649354 - protein, 17 aa, Staphylococcus aureus
YKEAMRRYGSDKPDTRF

SEQ ID NO: 1649355 - protein, 23 aa, Staphylococcus aureus
YKKTPKFILGFGGIDDDALKPHV

SEQ ID NO: 1649356 - protein, 17 aa, Staphylococcus aureus
YKNIEWLIKEGYGKLTL

SEQ ID NO: 1649357 - protein, 19 aa, Staphylococcus aureus
YKTMQGFYAPYVPGWDTHG

SEQ ID NO: 1649358 - protein, 18 aa, Staphylococcus aureus
YLHQYPELSFEEFQTHDY

SEQ ID NO: 1649359 - protein, 33 aa, Staphylococcus aureus
YLKPFVKTKIKAWVRQLLWMSIYQYVYLDKVPN

SEQ ID NO: 1649360 - protein, 20 aa, Staphylococcus aureus
YMSKICSYAQGFAQMRKASE

SEQ ID NO: 1649361 - protein, 21 aa, Staphylococcus aureus
YPGRRYYGGCEFVDVTESIAI

SEQ ID NO: 1649362 - protein, 23 aa, Staphylococcus aureus
YPHKRGVYSGGVGYINCNHNLDF

SEQ ID NO: 1649363 - protein, 17 aa, Staphylococcus aureus
YPLNELISIGQMIKNAG

SEQ ID NO: 1649364 - protein, 18 aa, Staphylococcus aureus
YQPWPTYDEALLVDDEVE

SEQ ID NO: 1649365 - protein, 18 aa, Staphylococcus aureus
YRLGEALIEVSEIREPCW

SEQ ID NO: 1649366 - protein, 17 aa, Staphylococcus aureus
YRTPIGVFGGAFKDVPA

SEQ ID NO: 1649367 - protein, 17 aa, Staphylococcus aureus
YYADTGISFVVGESDDP

SEQ ID NO: 1649368 - protein, 20 aa, Staphylococcus aureus
ACQYPQLAHHNFFFTENAYL

SEQ ID NO: 1649369 - protein, 18 aa, Staphylococcus aureus
ADGNGFQCGIWYEGTLVG

SEQ ID NO: 1649370 - protein, 21 aa, Staphylococcus aureus
ADLSPKFVVGYVETKDKHPDA

SEQ ID NO: 1649371 - protein, 20 aa, Staphylococcus aureus
AEINTLPIVEQFQTSQYEAN

SEQ ID NO: 1649372 - protein, 19 aa, Staphylococcus aureus
AELEGEFAEMNGWNAEADA

SEQ ID NO: 1649373 - protein, 24 aa, Staphylococcus aureus
AGGKRIRPVLLLLTLDSLNTEYEL

SEQ ID NO: 1649374 - protein, 25 aa, Staphylococcus aureus
AIRLSCKGLQQFSHAKTKQIVLSID

SEQ ID NO: 1649375 - protein, 21 aa, Staphylococcus aureus
AKKEGQGCISLKSIAEENNLS

SEQ ID NO: 1649376 - protein, 19 aa, Staphylococcus aureus
ALEAVWDYSYDKVGYLGTN

SEQ ID NO: 1649377 - protein, 25 aa, Staphylococcus aureus
ALVKALQAWDIDHLYGIPGDSIDAV

SEQ ID NO: 1649378 - protein, 18 aa, Staphylococcus aureus
AMTDCLNYGSPEKKEIYQ

SEQ ID NO: 1649379 - protein, 19 aa, Staphylococcus aureus
ARHYAIRNALRSALKALDL

SEQ ID NO: 1649380 - protein, 17 aa, Staphylococcus aureus
ASALFIYNEHEVYYLSS

SEQ ID NO: 1649381 - protein, 19 aa, Staphylococcus aureus
AVVLPHGVLFRGAAEGVIR

SEQ ID NO: 1649382 - protein, 22 aa, Staphylococcus aureus
DAANLLSGLGIDPTLHDKKMAE

SEQ ID NO: 1649383 - protein, 17 aa, Staphylococcus aureus
DALDIRLEPKFTSDIVP

SEQ ID NO: 1649384 - protein, 20 aa, Staphylococcus aureus
DDRRGPHFISPKSEKADELI

SEQ ID NO: 1649385 - protein, 17 aa, Staphylococcus aureus
DEQVTYEKLAIATLGVR

SEQ ID NO: 1649386 - protein, 25 aa, Staphylococcus aureus
DGTIKFLFELQDGYTIETVLMRHDY

SEQ ID NO: 1649387 - protein, 24 aa, Staphylococcus aureus
DGYRIGYGGGYYDRFLANYQTKTI

SEQ ID NO: 1649388 - protein, 28 aa, Staphylococcus aureus
DIIKEGIPAKARRKGGHPAKRVFQALRI

SEQ ID NO: 1649389 - protein, 29 aa, Staphylococcus aureus
DIYSRPRGKFRFPMSVAYENENVEQSADT

SEQ ID NO: 1649390 - protein, 18 aa, Staphylococcus aureus
DLKGRSLLKESDFTKAEF

SEQ ID NO: 1649391 - protein, 17 aa, Staphylococcus aureus
DMQVFRFNFRHQIDKKI

SEQ ID NO: 1649392 - protein, 17 aa, Staphylococcus aureus
DNLKNVTGYIRGGCSPV

SEQ ID NO: 1649393 - protein, 17 aa, Staphylococcus aureus
DPNVRLPLWDNAEDLRQ

SEQ ID NO: 1649394 - protein, 18 aa, Staphylococcus aureus
DRFDIAKLVYMVWDDMEL

SEQ ID NO: 1649395 - protein, 18 aa, Staphylococcus aureus
DRLKLRKQTRQLAAIYLA

SEQ ID NO: 1649396 - protein, 23 aa, Staphylococcus aureus
DSKSISFGLGYQIQHLVELVKEG

SEQ ID NO: 1649397 - protein, 31 aa, Staphylococcus aureus
DTIMYKVHLMKECLDRGIKVISSMGAANKTD

SEQ ID NO: 1649398 - protein, 23 aa, Staphylococcus aureus
DVSEELRQGMKIIEIAEQENIQH

SEQ ID NO: 1649399 - protein, 20 aa, Staphylococcus aureus
DVYECRFLTIATGYYGQHNT

SEQ ID NO: 1649400 - protein, 24 aa, Staphylococcus aureus
EAKPEDYDALLIPGGFSPDHLRGD

SEQ ID NO: 1649401 - protein, 25 aa, Staphylococcus aureus
EALIKIIPSYHALIVRSQTTVTENI

SEQ ID NO: 1649402 - protein, 22 aa, Staphylococcus aureus
EDFQNLILLFLESWYLKASFSQ

SEQ ID NO: 1649403 - protein, 21 aa, Staphylococcus aureus
EDGYFWFQGRVDDVIMTAGER

SEQ ID NO: 1649404 - protein, 24 aa, Staphylococcus aureus
EDQNLKLLGEDEMDDDDDIPAQTD

SEQ ID NO: 1649405 - protein, 19 aa, Staphylococcus aureus
EKAERAFLKHLMRDKDTFL

SEQ ID NO: 1649406 - protein, 21 aa, Staphylococcus aureus
EKGKKSIAIRLNYLDTEETLT

SEQ ID NO: 1649407 - protein, 18 aa, Staphylococcus aureus
ELAIELQVGVPTLEDIIK

SEQ ID NO: 1649408 - protein, 20 aa, Staphylococcus aureus
ELCKVCKQYQLPLFMDGARL

SEQ ID NO: 1649409 - protein, 21 aa, Staphylococcus aureus
ELSDSLIRRTMEPTRQAMKDA

SEQ ID NO: 1649410 - protein, 23 aa, Staphylococcus aureus
ELTAYEIVNNWSYEALVKIFYRY

SEQ ID NO: 1649411 - protein, 22 aa, Staphylococcus aureus
EMDLMNAFYLLDAVNIPIGIVR

SEQ ID NO: 1649412 - protein, 18 aa, Staphylococcus aureus
ENLDICIFAESLGGTETL

SEQ ID NO: 1649413 - protein, 19 aa, Staphylococcus aureus
ENYPGISFDTIYRNLHLFK

SEQ ID NO: 1649414 - protein, 24 aa, Staphylococcus aureus
EPLRKMEAPMFKKILKKHQLLDDA

SEQ ID NO: 1649415 - protein, 17 aa, Staphylococcus aureus
EQLESVIQPGVRVIVPF

SEQ ID NO: 1649416 - protein, 20 aa, Staphylococcus aureus
EQYDKILLYSGNMGQLQDME

SEQ ID NO: 1649417 - protein, 18 aa, Staphylococcus aureus
ERMYEFLDKLISVSLPRV

SEQ ID NO: 1649418 - protein, 23 aa, Staphylococcus aureus
ESHKRFGGVVPEVASRHHVEGIT

SEQ ID NO: 1649419 - protein, 30 aa, Staphylococcus aureus
ETMNLYDIIDEFRALGDYEYEEIENRVVQF

SEQ ID NO: 1649420 - protein, 18 aa, Staphylococcus aureus
ETPIGRNGIKATFKGLGT

SEQ ID NO: 1649421 - protein, 17 aa, Staphylococcus aureus
EVMTLPSIKVVEHPDLF

SEQ ID NO: 1649422 - protein, 18 aa, Staphylococcus aureus
EVRNAFTPKTVAEMIDAF

SEQ ID NO: 1649423 - protein, 19 aa, Staphylococcus aureus
FDRDTNWLSVLPIYHISGL

SEQ ID NO: 1649424 - protein, 19 aa, Staphylococcus aureus
FDTTGEWLPQETLDTIKEY

SEQ ID NO: 1649425 - protein, 20 aa, Staphylococcus aureus
FEKDGPRIMALEPQDDNRDG

SEQ ID NO: 1649426 - protein, 18 aa, Staphylococcus aureus
FEMLRQMLGKHFISQDIV

SEQ ID NO: 1649427 - protein, 18 aa, Staphylococcus aureus
FGTGYALEFTGETIKNLS

SEQ ID NO: 1649428 - protein, 24 aa, Staphylococcus aureus
FIRKLTSNITLMFDGDFAGSEATL

SEQ ID NO: 1649429 - protein, 19 aa, Staphylococcus aureus
FKQSLMGGGFQIDNPNAIA

SEQ ID NO: 1649430 - protein, 17 aa, Staphylococcus aureus
FNGSDFGGFSGFGGGGF

SEQ ID NO: 1649431 - protein, 29 aa, Staphylococcus aureus
FNLDRAAIEFGKMDFNTHLDLKAYSDNIK

SEQ ID NO: 1649432 - protein, 20 aa, Staphylococcus aureus
FTPEREIGNDLLIVQNLSKT

SEQ ID NO: 1649433 - protein, 17 aa, Staphylococcus aureus
FVQAAFEKLDFMVVQDE

SEQ ID NO: 1649434 - protein, 20 aa, Staphylococcus aureus
FVYKVAAMDFIFKDDPAELR

SEQ ID NO: 1649435 - protein, 24 aa, Staphylococcus aureus
FYEGKPMLSYVYDYPHKKLYKAIR

SEQ ID NO: 1649436 - protein, 19 aa, Staphylococcus aureus
FYYSDIIGCTVFDDQETPI

SEQ ID NO: 1649437 - protein, 23 aa, Staphylococcus aureus
GALGRKTKQGFYKKDKETKARLV

SEQ ID NO: 1649438 - protein, 17 aa, Staphylococcus aureus
GEVIEENGLRMHATNLG

SEQ ID NO: 1649439 - protein, 27 aa, Staphylococcus aureus
GFDDGNRPIGSFLFVGPTGVGKTELAK

SEQ ID NO: 1649440 - protein, 23 aa, Staphylococcus aureus
GGANRLIKAGAFDKYPIEAVFGI

SEQ ID NO: 1649441 - protein, 17 aa, Staphylococcus aureus
GGIMLPNHAPLIVAEQF

SEQ ID NO: 1649442 - protein, 17 aa, Staphylococcus aureus
GKQILGVDPAFRTGCKL

SEQ ID NO: 1649443 - protein, 20 aa, Staphylococcus aureus
GLEPSMAFKIMESVRKGKGL

SEQ ID NO: 1649444 - protein, 23 aa, Staphylococcus aureus
GLKQYGIDIAERIEVIVPETVHN

SEQ ID NO: 1649445 - protein, 28 aa, Staphylococcus aureus
GNSGVILSQLFRGFCKNIESESEINSKL

SEQ ID NO: 1649446 - protein, 17 aa, Staphylococcus aureus
GPKVIEFNARFGDPEAQ

SEQ ID NO: 1649447 - protein, 20 aa, Staphylococcus aureus
GQALHAGLIGFEHPVTGEYI

SEQ ID NO: 1649448 - protein, 18 aa, Staphylococcus aureus
GQDIPLVINGEKIFKDDK

SEQ ID NO: 1649449 - protein, 19 aa, Staphylococcus aureus
GRTMPNFAIVERDYTKIYD

SEQ ID NO: 1649450 - protein, 23 aa, Staphylococcus aureus
GVHPYRVKLALGQVRHYQLDELL

SEQ ID NO: 1649451 - protein, 17 aa, Staphylococcus aureus
GYLKIKVNGGGCTGLTY

SEQ ID NO: 1649452 - protein, 18 aa, Staphylococcus aureus
HAIKLGKVTHIFITHMHG

SEQ ID NO: 1649453 - protein, 25 aa, Staphylococcus aureus
HDDYKAGQIIGEWIGQQGYQQVEVF

SEQ ID NO: 1649454 - protein, 18 aa, Staphylococcus aureus
HEALLCLDATTGQNALSQ

SEQ ID NO: 1649455 - protein, 26 aa, Staphylococcus aureus
HKGAYKDGKWKVLMIAAEERYVLLEN

SEQ ID NO: 1649456 - protein, 26 aa, Staphylococcus aureus
HLLNHGIPSYGYRVMAPETTGTINVE

SEQ ID NO: 1649457 - protein, 20 aa, Staphylococcus aureus
HNFASGLSYHVLTMLRIAKS

SEQ ID NO: 1649458 - protein, 25 aa, Staphylococcus aureus
HVSELKNRIPLVLEVKSDQYQSSTR

SEQ ID NO: 1649459 - protein, 24 aa, Staphylococcus aureus
IAEKLKLPMNYVRSSNKSHGKQNQ

SEQ ID NO: 1649460 - protein, 18 aa, Staphylococcus aureus
IDHLYGIPGDSIDAVVDS

SEQ ID NO: 1649461 - protein, 21 aa, Staphylococcus aureus
IDKLICSWLKQIDNVIPQLIM

SEQ ID NO: 1649462 - protein, 22 aa, Staphylococcus aureus
IDNGKVCGFLTEMVANNDGIEA

SEQ ID NO: 1649463 - protein, 19 aa, Staphylococcus aureus
IDRYNFYGVSGKFTEDAED

SEQ ID NO: 1649464 - protein, 31 aa, Staphylococcus aureus
IEPQTLKLFKVCKMRGIPIFTFINKLDRVGK

SEQ ID NO: 1649465 - protein, 19 aa, Staphylococcus aureus
IESAERLGLPEARIPLSQA

SEQ ID NO: 1649466 - protein, 17 aa, Staphylococcus aureus
IGIAGFFGLPIQKDAVD

SEQ ID NO: 1649467 - protein, 26 aa, Staphylococcus aureus
IGYHPDYEFLKSVGIQINTNEFGTAP

SEQ ID NO: 1649468 - protein, 23 aa, Staphylococcus aureus
IIASCSFAKHMLEKEDSYQDVYL

SEQ ID NO: 1649469 - protein, 23 aa, Staphylococcus aureus
IILHELCHYHLHIAGKGYQHKDQ

SEQ ID NO: 1649470 - protein, 22 aa, Staphylococcus aureus
IKGKDATPFLLGKIVEKTNGKS

SEQ ID NO: 1649471 - protein, 22 aa, Staphylococcus aureus
IKKHFDCAMIFISHDLTVINKI

SEQ ID NO: 1649472 - protein, 17 aa, Staphylococcus aureus
IKVEEGQEIFVEKLDVN

SEQ ID NO: 1649473 - protein, 22 aa, Staphylococcus aureus
IPEMLTENFIPRTELRETTMNI

SEQ ID NO: 1649474 - protein, 18 aa, Staphylococcus aureus
IPHDLFTPIFAVSRSAGW

SEQ ID NO: 1649475 - protein, 28 aa, Staphylococcus aureus
IRNFKPEEYWTIEGEFRYKKSKFNAKFL

SEQ ID NO: 1649476 - protein, 25 aa, Staphylococcus aureus
ISAMMFKGSASKLNFEPKEGDEVLL

SEQ ID NO: 1649477 - protein, 23 aa, Staphylococcus aureus
ITKEKYPRLLVTRTVKQGTGKYF

SEQ ID NO: 1649478 - protein, 18 aa, Staphylococcus aureus
IYNDIAITAQYLAKEYNQ

SEQ ID NO: 1649479 - protein, 22 aa, Staphylococcus aureus
IYYERCGGCQLQHLSYEAQLEM

SEQ ID NO: 1649480 - protein, 24 aa, Staphylococcus aureus
KAAKRSGTTIGFIPTMGALHDGHL

SEQ ID NO: 1649481 - protein, 24 aa, Staphylococcus aureus
KDGDPRAKYLREMSRQITKDAGRE

SEQ ID NO: 1649482 - protein, 20 aa, Staphylococcus aureus
KDKISRITIGYTRDRKPVTV

SEQ ID NO: 1649483 - protein, 18 aa, Staphylococcus aureus
KDSGLKYNISYASKAFTC

SEQ ID NO: 1649484 - protein, 19 aa, Staphylococcus aureus
KESVISAMMFKGSASKLNF

SEQ ID NO: 1649485 - protein, 19 aa, Staphylococcus aureus
KFLKYFTFLGKEEIDRLEQ

SEQ ID NO: 1649486 - protein, 28 aa, Staphylococcus aureus
KGVEINGAFPRMTYKEAMRRYGSDKPDT

SEQ ID NO: 1649487 - protein, 17 aa, Staphylococcus aureus
KGVLSPWSKREAEDYYE

SEQ ID NO: 1649488 - protein, 21 aa, Staphylococcus aureus
KHDLAALSYLTFVALDDEGKP

SEQ ID NO: 1649489 - protein, 19 aa, Staphylococcus aureus
KIMTEHLNIFVGLTDEAQN

SEQ ID NO: 1649490 - protein, 20 aa, Staphylococcus aureus
KKPMILFGHMSPYMIVGMIG

SEQ ID NO: 1649491 - protein, 26 aa, Staphylococcus aureus
KKSRLTGRLSGNIGYVASKVAQEVKP

SEQ ID NO: 1649492 - protein, 22 aa, Staphylococcus aureus
KKYVAKLKGYLMREEVKALEKG

SEQ ID NO: 1649493 - protein, 18 aa, Staphylococcus aureus
KLLSTAGAYWRGDSNNKM

SEQ ID NO: 1649494 - protein, 26 aa, Staphylococcus aureus
KLVEIFWPGPLNIILKNKTSYNYMLN

SEQ ID NO: 1649495 - protein, 30 aa, Staphylococcus aureus
KMSREEILILLTLWQKGSMTLKEMDRFVEV

SEQ ID NO: 1649496 - protein, 18 aa, Staphylococcus aureus
KNFMLNKAILEGYHTLLT

SEQ ID NO: 1649497 - protein, 25 aa, Staphylococcus aureus
KQSIYSLRFDEMQNWLVEQGQQKFR

SEQ ID NO: 1649498 - protein, 25 aa, Staphylococcus aureus
KSAIALEMIHTYSLIHDDLPAMDND

SEQ ID NO: 1649499 - protein, 17 aa, Staphylococcus aureus
KSLLQMLLLHAIPTPVI

SEQ ID NO: 1649500 - protein, 21 aa, Staphylococcus aureus
KSPFDFCGLVLDYNEDTKIAT

SEQ ID NO: 1649501 - protein, 23 aa, Staphylococcus aureus
KTLQRKLGKTFIFVTHDMDEAIK

SEQ ID NO: 1649502 - protein, 19 aa, Staphylococcus aureus
KVISRAQVILSEFEASAGK

SEQ ID NO: 1649503 - protein, 18 aa, Staphylococcus aureus
KVIYEKAKAINISSFTDL

SEQ ID NO: 1649504 - protein, 26 aa, Staphylococcus aureus
KYYVSHQWFPLGAVHGLKYWYNYTSD

SEQ ID NO: 1649505 - protein, 23 aa, Staphylococcus aureus
LAQPRVLICDEITSNLDVIAEQN

SEQ ID NO: 1649506 - protein, 26 aa, Staphylococcus aureus
LCNMRCSHCAVGYTLQTVDPEPLDMD

SEQ ID NO: 1649507 - protein, 23 aa, Staphylococcus aureus
LDGELFRKNFVGVHDGSTNKYIH

SEQ ID NO: 1649508 - protein, 19 aa, Staphylococcus aureus
LDKEFDFILIEGAGGIAVP

SEQ ID NO: 1649509 - protein, 23 aa, Staphylococcus aureus
LDPEVAGVLPVCIGNATRVSDYV

SEQ ID NO: 1649510 - protein, 23 aa, Staphylococcus aureus
LEKHNIYYGQWLILRDIAKHQPT

SEQ ID NO: 1649511 - protein, 17 aa, Staphylococcus aureus
LGDNLFVLLCLANSMGI

SEQ ID NO: 1649512 - protein, 21 aa, Staphylococcus aureus
LHPYGSWQEYWAFESRFITLN

SEQ ID NO: 1649513 - protein, 19 aa, Staphylococcus aureus
LIPEYQHLNIFPVGRLDKD

SEQ ID NO: 1649514 - protein, 19 aa, Staphylococcus aureus
LKEDETWMRDMIRSQDPIN

SEQ ID NO: 1649515 - protein, 24 aa, Staphylococcus aureus
LKFYKEQFDTLSYFQLKVLIVGFE

SEQ ID NO: 1649516 - protein, 18 aa, Staphylococcus aureus
LLDTPGILWPKFEDEEVG

SEQ ID NO: 1649517 - protein, 18 aa, Staphylococcus aureus
LLEKACERKGIPFEPKEI

SEQ ID NO: 1649518 - protein, 17 aa, Staphylococcus aureus
LNGRDGYKKVNRLFIDC

SEQ ID NO: 1649519 - protein, 26 aa, Staphylococcus aureus
LPENNKVLVFFVRYGGEFQLKQGFSP

SEQ ID NO: 1649520 - protein, 23 aa, Staphylococcus aureus
LPKKDRVVVEGVNIMKKHQKPTQ

SEQ ID NO: 1649521 - protein, 19 aa, Staphylococcus aureus
LPNKNLIYFESFHGKQYSD

SEQ ID NO: 1649522 - protein, 18 aa, Staphylococcus aureus
LQVNNCVTVEPGVYIEGL

SEQ ID NO: 1649523 - protein, 19 aa, Staphylococcus aureus
LRHEPLDHVLLFGPPGLGK

SEQ ID NO: 1649524 - protein, 17 aa, Staphylococcus aureus
LRTGAIQEKTFRAGEKV

SEQ ID NO: 1649525 - protein, 27 aa, Staphylococcus aureus
LRVTQELRKKGVVGKFVEFFGPGVQHL

SEQ ID NO: 1649526 - protein, 22 aa, Staphylococcus aureus
LSLKLSELAQWELVEKQIISTS

SEQ ID NO: 1649527 - protein, 18 aa, Staphylococcus aureus
LSSFQLLGIEKYKPHIAI

SEQ ID NO: 1649528 - protein, 25 aa, Staphylococcus aureus
LSSGGKRVRPAFVILSSQFGKDEQT

SEQ ID NO: 1649529 - protein, 20 aa, Staphylococcus aureus
LSYLKDLKFTGSIRSMQEGE

SEQ ID NO: 1649530 - protein, 17 aa, Staphylococcus aureus
LTPNVARVIKRLINETF

SEQ ID NO: 1649531 - protein, 23 aa, Staphylococcus aureus
LTRAKEQLYLIGRVKNDKSLLEL

SEQ ID NO: 1649532 - protein, 23 aa, Staphylococcus aureus
LVSKRLKKDYGLTFSPCNTKGLA

SEQ ID NO: 1649533 - protein, 18 aa, Staphylococcus aureus
MHRLGDILVQYGIQHDTG

SEQ ID NO: 1649534 - protein, 23 aa, Staphylococcus aureus
MIKRDEFEMGRELLVQVRKRQLK

SEQ ID NO: 1649535 - protein, 22 aa, Staphylococcus aureus
MKSLSIPLQYLVAAALEVTDVN

SEQ ID NO: 1649536 - protein, 26 aa, Staphylococcus aureus
MQEGELCFGNEPLLRVEAPLIQAQLI

SEQ ID NO: 1649537 - protein, 23 aa, Staphylococcus aureus
MRDQCSVCHAVLPQIEDLMQSYP

SEQ ID NO: 1649538 - protein, 24 aa, Staphylococcus aureus
NAFKEASEQLATWVQEGKIQSQVT

SEQ ID NO: 1649539 - protein, 28 aa, Staphylococcus aureus
NESSCVSCGQCATVCPCNAMMEVNMEGN

SEQ ID NO: 1649540 - protein, 17 aa, Staphylococcus aureus
NFHELKQQVRLHIIQMN

SEQ ID NO: 1649541 - protein, 24 aa, Staphylococcus aureus
NFMAKEARGLICAPVSKDIAQRLD

SEQ ID NO: 1649542 - protein, 26 aa, Staphylococcus aureus
NFTETGIFSVMWSEHCSYKHSKPFLK

SEQ ID NO: 1649543 - protein, 17 aa, Staphylococcus aureus
NGAVLVRYGDTVVLSTA

SEQ ID NO: 1649544 - protein, 18 aa, Staphylococcus aureus
NHLGELILTISKASNDSN

SEQ ID NO: 1649545 - protein, 20 aa, Staphylococcus aureus
NKHYISIFINGRYIKNFMLN

SEQ ID NO: 1649546 - protein, 20 aa, Staphylococcus aureus
NMNDIGCYFLDIQLSTDING

SEQ ID NO: 1649547 - protein, 20 aa, Staphylococcus aureus
NNYGVGLGMPSFESAVNPLH

SEQ ID NO: 1649548 - protein, 23 aa, Staphylococcus aureus
NPDLDFEFIHWLVSGVKDHEPVL

SEQ ID NO: 1649549 - protein, 46 aa, Staphylococcus aureus
NPLTDMIKFKYPRLFENVRLALNDCWPDLIFPESEIAFIVLHFGGS

SEQ ID NO: 1649550 - protein, 19 aa, Staphylococcus aureus
NPTGSFKDRGMVMAVTKAK

SEQ ID NO: 1649551 - protein, 29 aa, Staphylococcus aureus
NPYVRHIAHPTGRIIGRRDGYKPNIEQLM

SEQ ID NO: 1649552 - protein, 26 aa, Staphylococcus aureus
NQGSPKCIVFGCYENETLIATAALEQ

SEQ ID NO: 1649553 - protein, 26 aa, Staphylococcus aureus
NRMAMSHPDIRIALISDGKTMLSTNG

SEQ ID NO: 1649554 - protein, 27 aa, Staphylococcus aureus
NSHLLQFKNGRIIRGKSTLLSFSDLEI

SEQ ID NO: 1649555 - protein, 18 aa, Staphylococcus aureus
NSTMCQRISALAEQLKIQ

SEQ ID NO: 1649556 - protein, 24 aa, Staphylococcus aureus
PAQFGGPHCGYFATTKKLMRKVPG

SEQ ID NO: 1649557 - protein, 21 aa, Staphylococcus aureus
PDFIEKYRFFDMLQASLHPYG

SEQ ID NO: 1649558 - protein, 17 aa, Staphylococcus aureus
PDILQEYLLYVRYTAIL

SEQ ID NO: 1649559 - protein, 19 aa, Staphylococcus aureus
PDPELYLSAVQQLNYMPTQ

SEQ ID NO: 1649560 - protein, 20 aa, Staphylococcus aureus
PESEIAFIVLHFGGSIKNQG

SEQ ID NO: 1649561 - protein, 22 aa, Staphylococcus aureus
PEVHYLKQFIKHKIEQLLDEGL

SEQ ID NO: 1649562 - protein, 19 aa, Staphylococcus aureus
PFGACHFAVAAKPETTNYR

SEQ ID NO: 1649563 - protein, 18 aa, Staphylococcus aureus
PKRRIPYMEIVGQVHGTY

SEQ ID NO: 1649564 - protein, 19 aa, Staphylococcus aureus
PNLTYFCSYQLAKRTVDSY

SEQ ID NO: 1649565 - protein, 19 aa, Staphylococcus aureus
PQFTPEIFMKVSAKNVMKQ

SEQ ID NO: 1649566 - protein, 24 aa, Staphylococcus aureus
PQKIVRWRAAMFIFDEGNAEQLPA

SEQ ID NO: 1649567 - protein, 22 aa, Staphylococcus aureus
PRSYYTGLFIQCHFAENESRVL

SEQ ID NO: 1649568 - protein, 18 aa, Staphylococcus aureus
PSGAYYGGETLKPTKIYV

SEQ ID NO: 1649569 - protein, 17 aa, Staphylococcus aureus
PSTPSRQAVAMPASDVI

SEQ ID NO: 1649570 - protein, 20 aa, Staphylococcus aureus
QAAFEKLDFMVVQDEFLTFT

SEQ ID NO: 1649571 - protein, 20 aa, Staphylococcus aureus
QAKVASLVTAFARVRQDKEP

SEQ ID NO: 1649572 - protein, 29 aa, Staphylococcus aureus
QARAKVKHLRKSPCYNFELEVIAKNENND

SEQ ID NO: 1649573 - protein, 18 aa, Staphylococcus aureus
QASSLAMAIYFQDMNDDE

SEQ ID NO: 1649574 - protein, 17 aa, Staphylococcus aureus
QEVEFLLTLSEDLKRAK

SEQ ID NO: 1649575 - protein, 17 aa, Staphylococcus aureus
QEYKAMGKIDFQLTPMN

SEQ ID NO: 1649576 - protein, 24 aa, Staphylococcus aureus
QFAKREVYSHYALSDIPLPKKTKF

SEQ ID NO: 1649577 - protein, 24 aa, Staphylococcus aureus
QGTLIKKQVMMRGFLVSEFANAFK

SEQ ID NO: 1649578 - protein, 23 aa, Staphylococcus aureus
QKVKVHLKPSVQLIANVVQTKTL

SEQ ID NO: 1649579 - protein, 19 aa, Staphylococcus aureus
QSEFVKEAIVVPVYKNDKV

SEQ ID NO: 1649580 - protein, 17 aa, Staphylococcus aureus
RAFKSVDTPAIFMDHGK

SEQ ID NO: 1649581 - protein, 17 aa, Staphylococcus aureus
REEEIDYAIKHNIPVSI

SEQ ID NO: 1649582 - protein, 21 aa, Staphylococcus aureus
RFESAVGFVHLGLGYAIIPRF

SEQ ID NO: 1649583 - protein, 25 aa, Staphylococcus aureus
RFLEAYCERHHIDLHIKKLDLSHSL

SEQ ID NO: 1649584 - protein, 36 aa, Staphylococcus aureus
RISRETLEIYAPLAHRLGINTIKWELEDTALRYIDN

SEQ ID NO: 1649585 - protein, 21 aa, Staphylococcus aureus
RKIIEGFKHLTPNTNHYRTVM

SEQ ID NO: 1649586 - protein, 20 aa, Staphylococcus aureus
RKKYEMPIIMLTAKDSEIDK

SEQ ID NO: 1649587 - protein, 20 aa, Staphylococcus aureus
RRDGYKPNIEQLMALAEETN

SEQ ID NO: 1649588 - protein, 19 aa, Staphylococcus aureus
RRILLSSLPGAAVKYIEIE

SEQ ID NO: 1649589 - protein, 20 aa, Staphylococcus aureus
RRSLQIYGFSPCHEISIMLA

SEQ ID NO: 1649590 - protein, 22 aa, Staphylococcus aureus
RYKTDASFWKAVYNSILNKLEN

SEQ ID NO: 1649591 - protein, 19 aa, Staphylococcus aureus
SFTTYTITTVWGLGYKFER

SEQ ID NO: 1649592 - protein, 21 aa, Staphylococcus aureus
SGYAAFVVFNMMFGGDPSSVL

SEQ ID NO: 1649593 - protein, 17 aa, Staphylococcus aureus
SIEEARFLEAYCERHHI

SEQ ID NO: 1649594 - protein, 22 aa, Staphylococcus aureus
SIGVKCPKCNDGDVVERKSKKN

SEQ ID NO: 1649595 - protein, 25 aa, Staphylococcus aureus
SLLSKLLVRATKKWPTDKSFNNHLA

SEQ ID NO: 1649596 - protein, 28 aa, Staphylococcus aureus
SNINATVIKPSFFMDNFLRIAKVEDERI

SEQ ID NO: 1649597 - protein, 24 aa, Staphylococcus aureus
SNSFNISTTVAFVVASAGVKVIKH

SEQ ID NO: 1649598 - protein, 18 aa, Staphylococcus aureus
SQHPRLILQSNIQTENLR

SEQ ID NO: 1649599 - protein, 26 aa, Staphylococcus aureus
SQNAVLFFDEIHQIIGSGATGSDSGS

SEQ ID NO: 1649600 - protein, 20 aa, Staphylococcus aureus
SVKCCFDYLNNIIMMNQNKS

SEQ ID NO: 1649601 - protein, 23 aa, Staphylococcus aureus
TDAIRILVDRVWPRGISKRTANL

SEQ ID NO: 1649602 - protein, 26 aa, Staphylococcus aureus
TFVPSICYNESMGPIQTCDTCTVEID

SEQ ID NO: 1649603 - protein, 25 aa, Staphylococcus aureus
TIDNFRWAGVPFYIRTGKRMKSKTI

SEQ ID NO: 1649604 - protein, 17 aa, Staphylococcus aureus
TIIKPGLQASVVRVEGT

SEQ ID NO: 1649605 - protein, 19 aa, Staphylococcus aureus
TKFGIPSYYVIASSEASSN

SEQ ID NO: 1649606 - protein, 26 aa, Staphylococcus aureus
TKKPVIFRATPQWFASISKVRQDILD

SEQ ID NO: 1649607 - protein, 17 aa, Staphylococcus aureus
TLINLLIEQDILPSSPV

SEQ ID NO: 1649608 - protein, 25 aa, Staphylococcus aureus
TLKFMLKVFLDLKFVTQEDGLIRIN

SEQ ID NO: 1649609 - protein, 19 aa, Staphylococcus aureus
TNEPTRVGYKFVDGKKVRI

SEQ ID NO: 1649610 - protein, 32 aa, Staphylococcus aureus
TPFPRISYDDAIEFLKAEGFDDIEWGEDFGAP

SEQ ID NO: 1649611 - protein, 18 aa, Staphylococcus aureus
TRSGKIMRRVLKAWELNL

SEQ ID NO: 1649612 - protein, 20 aa, Staphylococcus aureus
TRVGYKFVDGKKVRIAKKSG

SEQ ID NO: 1649613 - protein, 23 aa, Staphylococcus aureus
TSARLHPWLLKIYEKRGYEIYSE

SEQ ID NO: 1649614 - protein, 32 aa, Staphylococcus aureus
TSDLISRYAGIRVPRNKAIVGQNAFSHESGIH

SEQ ID NO: 1649615 - protein, 30 aa, Staphylococcus aureus
TVASCAHMMIWEGIELIPVVSSNKKTVGVI

SEQ ID NO: 1649616 - protein, 19 aa, Staphylococcus aureus
TVFCYGLMVNYCLQAADIL

SEQ ID NO: 1649617 - protein, 26 aa, Staphylococcus aureus
TVKAEGFNHVIARHYAIRNALRSALK

SEQ ID NO: 1649618 - protein, 21 aa, Staphylococcus aureus
TVNRNDIFGVIGYSGAGKSTL

SEQ ID NO: 1649619 - protein, 23 aa, Staphylococcus aureus
VASEIMAILCLSRSIKDLKDKIS

SEQ ID NO: 1649620 - protein, 17 aa, Staphylococcus aureus
VATKAWFNTYLNIYAAT

SEQ ID NO: 1649621 - protein, 17 aa, Staphylococcus aureus
VDTPAIFMDHGKGSKIY

SEQ ID NO: 1649622 - protein, 24 aa, Staphylococcus aureus
VEIKWQIPEIEPQYVLEYQESKQD

SEQ ID NO: 1649623 - protein, 23 aa, Staphylococcus aureus
VELLNLGGGFGIKYVEGDESFPI

SEQ ID NO: 1649624 - protein, 20 aa, Staphylococcus aureus
VIQPGVRVIVPFGPRTIQGY

SEQ ID NO: 1649625 - protein, 18 aa, Staphylococcus aureus
VKEGSLYPLSYYDGDWYG

SEQ ID NO: 1649626 - protein, 21 aa, Staphylococcus aureus
VKELNRLLGKVIHAFDETKEK

SEQ ID NO: 1649627 - protein, 25 aa, Staphylococcus aureus
VKYAESFGAKGLRVTNQEELEAAIK

SEQ ID NO: 1649628 - protein, 22 aa, Staphylococcus aureus
VLASRLGGYAVDLLMQGETAKG

SEQ ID NO: 1649629 - protein, 29 aa, Staphylococcus aureus
VLKENVTTVLGFKSIRQGESITEMQQPFS

SEQ ID NO: 1649630 - protein, 25 aa, Staphylococcus aureus
VLMAVRIAYFKVHHPLYYYASYFTI

SEQ ID NO: 1649631 - protein, 20 aa, Staphylococcus aureus
VPEFGTGFVRQMLEDTKPTT

SEQ ID NO: 1649632 - protein, 17 aa, Staphylococcus aureus
VPGRTMPNFAIVERDYT

SEQ ID NO: 1649633 - protein, 21 aa, Staphylococcus aureus
VPMEPGCYLMKDRNDQVIYVG

SEQ ID NO: 1649634 - protein, 23 aa, Staphylococcus aureus
VPSIQAFHVNKCRFANRCNKKLD

SEQ ID NO: 1649635 - protein, 26 aa, Staphylococcus aureus
VRFRRSQEVIQVWHAVGAFKTVGFSR

SEQ ID NO: 1649636 - protein, 24 aa, Staphylococcus aureus
VRGVPLRLVDTAGIRETEDIVEKI

SEQ ID NO: 1649637 - protein, 17 aa, Staphylococcus aureus
VRYGGEFQLKQGFSPAF

SEQ ID NO: 1649638 - protein, 19 aa, Staphylococcus aureus
VSDEELEFITGIHDENEAI

SEQ ID NO: 1649639 - protein, 22 aa, Staphylococcus aureus
VVVLKPFRLGGIDKVQTAIDTL

SEQ ID NO: 1649640 - protein, 30 aa, Staphylococcus aureus
WEHNPRAQAFYKRHGFKVVGEHHFQTGDVT

SEQ ID NO: 1649641 - protein, 22 aa, Staphylococcus aureus
WLEVYNRNGVVTARAVISHRMP

SEQ ID NO: 1649642 - protein, 22 aa, Staphylococcus aureus
WVGTLLKMKPVLKFEDGKIIPE

SEQ ID NO: 1649643 - protein, 17 aa, Staphylococcus aureus
YDVMALVHECREAGYPC

SEQ ID NO: 1649644 - protein, 22 aa, Staphylococcus aureus
YEALVKIFYRYGEEKFSKQIAR

SEQ ID NO: 1649645 - protein, 21 aa, Staphylococcus aureus
YEWLQQSTFNFPGKEELKRMF

SEQ ID NO: 1649646 - protein, 27 aa, Staphylococcus aureus
YHTLLTIGRFPICYINIEMDPILVDVN

SEQ ID NO: 1649647 - protein, 17 aa, Staphylococcus aureus
YKAPAIFVIQNNNYAIS

SEQ ID NO: 1649648 - protein, 17 aa, Staphylococcus aureus
YLYKGLRDKSPAVRRTA

SEQ ID NO: 1649649 - protein, 26 aa, Staphylococcus aureus
YPTDNEGWAHCLTIPRVLNVENGQLK

SEQ ID NO: 1649650 - protein, 24 aa, Staphylococcus aureus
YPYFKEGLVLFTYLHLANEEKLTQ

SEQ ID NO: 1649651 - protein, 17 aa, Staphylococcus aureus
YRFFDMLQASLHPYGSW

SEQ ID NO: 1649652 - protein, 20 aa, Staphylococcus aureus
YRTAEGFEGYYMMKRMNAPF

SEQ ID NO: 1649653 - protein, 17 aa, Staphylococcus aureus
YTLLDYFGDDWLVMIDE

SEQ ID NO: 1649654 - protein, 24 aa, Staphylococcus aureus
YWDSEARGAIFGLTRGTEKEHFIR

SEQ ID NO: 1649655 - protein, 18 aa, Staphylococcus aureus
YYYNIFVQKVFLKAIDSC

SEQ ID NO: 1649656 - protein, 23 aa, Staphylococcus aureus
AAGDVKGGLQFTYISLDDYRIIK

SEQ ID NO: 1649657 - protein, 19 aa, Staphylococcus aureus
ADGAAVYLKNGINHYHSGY

SEQ ID NO: 1649658 - protein, 18 aa, Staphylococcus aureus
ADKNFPMDTYELQRELGG

SEQ ID NO: 1649659 - protein, 18 aa, Staphylococcus aureus
AGIKQLWAKLEISNDDFI

SEQ ID NO: 1649660 - protein, 31 aa, Staphylococcus aureus
AHYRSAYHILDMVFWFGNLQILAAHQYPTTA

SEQ ID NO: 1649661 - protein, 20 aa, Staphylococcus aureus
AKLGFKRVIIPKNNIGGWTY

SEQ ID NO: 1649662 - protein, 20 aa, Staphylococcus aureus
AKLVCYFFKELSKFIYKNRG

SEQ ID NO: 1649663 - protein, 19 aa, Staphylococcus aureus
ALLKLDFITHSYPHDWRTK

SEQ ID NO: 1649664 - protein, 18 aa, Staphylococcus aureus
ALSEFVVLGIDTTIPFHI

SEQ ID NO: 1649665 - protein, 24 aa, Staphylococcus aureus
ALSLNYLPSLKFDYAQNEAARLEE

SEQ ID NO: 1649666 - protein, 20 aa, Staphylococcus aureus
ANAIKRAFNPDGLNIIQNNG

SEQ ID NO: 1649667 - protein, 18 aa, Staphylococcus aureus
AQIKVIFKTVLKSADDHF

SEQ ID NO: 1649668 - protein, 22 aa, Staphylococcus aureus
ARKFMRMFFSGAVEVELDKQGR

SEQ ID NO: 1649669 - protein, 20 aa, Staphylococcus aureus
ARQTHLIGAIIPRMNSYAVD

SEQ ID NO: 1649670 - protein, 18 aa, Staphylococcus aureus
ASERICFGKFTNAGQTCV

SEQ ID NO: 1649671 - protein, 23 aa, Staphylococcus aureus
ASNRPASDLPNVFVSSKNDGDKL

SEQ ID NO: 1649672 - protein, 23 aa, Staphylococcus aureus
CMTGCPYKKVYFNWKTNKAEKCT

SEQ ID NO: 1649673 - protein, 21 aa, Staphylococcus aureus
CSTPLEYGDIFNYFVKKYSNI

SEQ ID NO: 1649674 - protein, 31 aa, Staphylococcus aureus
DEDLELLESVAFQLGSAIKRIYLTDREKEAA

SEQ ID NO: 1649675 - protein, 17 aa, Staphylococcus aureus
DNGLEVIKTEGEAFDPN

SEQ ID NO: 1649676 - protein, 26 aa, Staphylococcus aureus
DPKKRMAIEYSMPKWIIDHWATHYGL

SEQ ID NO: 1649677 - protein, 22 aa, Staphylococcus aureus
DQQEIFQLAEIVSGKNNKNLTL

SEQ ID NO: 1649678 - protein, 18 aa, Staphylococcus aureus
DRIILRMATYEILHSDTP

SEQ ID NO: 1649679 - protein, 22 aa, Staphylococcus aureus
DSDLTINEAISFIKDDNPDLDF

SEQ ID NO: 1649680 - protein, 25 aa, Staphylococcus aureus
DSEVLVCTVIGFPLGASTTATKAFE

SEQ ID NO: 1649681 - protein, 24 aa, Staphylococcus aureus
DSNAQLWLAEFAWHDTSSAHYRSA

SEQ ID NO: 1649682 - protein, 21 aa, Staphylococcus aureus
DYGTASGRVFLINTTNGQVVS

SEQ ID NO: 1649683 - protein, 27 aa, Staphylococcus aureus
DYIVSSYPVWFPKDEVEEIIKDMIELI

SEQ ID NO: 1649684 - protein, 28 aa, Staphylococcus aureus
DYKKGDVVVGMLPWRIINHVQADQITKV

SEQ ID NO: 1649685 - protein, 24 aa, Staphylococcus aureus
EAALKAGITLFQFREKGESALKGN

SEQ ID NO: 1649686 - protein, 19 aa, Staphylococcus aureus
EENDKIYGFIVVDQDQAEW

SEQ ID NO: 1649687 - protein, 19 aa, Staphylococcus aureus
EFRRKSFKSFSDGIRKYQH

SEQ ID NO: 1649688 - protein, 23 aa, Staphylococcus aureus
EKKPHIMPVWSIKNRALKVRDED

SEQ ID NO: 1649689 - protein, 17 aa, Staphylococcus aureus
EKVEAVAISGSLPKGLN

SEQ ID NO: 1649690 - protein, 18 aa, Staphylococcus aureus
ENGEALEISQLLKESSSG

SEQ ID NO: 1649691 - protein, 20 aa, Staphylococcus aureus
ENKGKVVLVTAMSPTPAGEG

SEQ ID NO: 1649692 - protein, 19 aa, Staphylococcus aureus
EPLTFPLIALIVSGGHTEL

SEQ ID NO: 1649693 - protein, 24 aa, Staphylococcus aureus
ESDILCPFHYFGVTDYVHQGIKED

SEQ ID NO: 1649694 - protein, 24 aa, Staphylococcus aureus
EVLLEARVSVFERRGNYQIYVNKM

SEQ ID NO: 1649695 - protein, 18 aa, Staphylococcus aureus
EVLSERFVNYFKHHQMEV

SEQ ID NO: 1649696 - protein, 18 aa, Staphylococcus aureus
FAIYYPVESALIIETDTP

SEQ ID NO: 1649697 - protein, 19 aa, Staphylococcus aureus
FARVFRKHLEGGIIESIKQ

SEQ ID NO: 1649698 - protein, 20 aa, Staphylococcus aureus
FDGYSDFKSYLKFESNKTHQ

SEQ ID NO: 1649699 - protein, 31 aa, Staphylococcus aureus
FEPESSQALGFGYRTGFLGMLHMEIIQERIE

SEQ ID NO: 1649700 - protein, 25 aa, Staphylococcus aureus
FHWYVKGPNFFSLHVKFEELYNEAS

SEQ ID NO: 1649701 - protein, 22 aa, Staphylococcus aureus
FINERIIPIIPQQGSLGASGDL

SEQ ID NO: 1649702 - protein, 17 aa, Staphylococcus aureus
FLQKLNGGMGILLGGVP

SEQ ID NO: 1649703 - protein, 17 aa, Staphylococcus aureus
FMFFMSVVMTLLSRYAR

SEQ ID NO: 1649704 - protein, 19 aa, Staphylococcus aureus
FNQPIKLKIVLIHSKLSRT

SEQ ID NO: 1649705 - protein, 26 aa, Staphylococcus aureus
FRAKQIFEWLYQKRVDSIDEMTNLSK

SEQ ID NO: 1649706 - protein, 18 aa, Staphylococcus aureus
GDGSYRGAQRISEECKEI

SEQ ID NO: 1649707 - protein, 17 aa, Staphylococcus aureus
GDRRVLCAMSGGVDSSV

SEQ ID NO: 1649708 - protein, 20 aa, Staphylococcus aureus
GDYCGYSFAFEVTKNNTKLA

SEQ ID NO: 1649709 - protein, 20 aa, Staphylococcus aureus
GEAIKAYLTIAPKNTVLITD

SEQ ID NO: 1649710 - protein, 26 aa, Staphylococcus aureus
GFQTHLKWGAQKEVIKLIPGLENVDI

SEQ ID NO: 1649711 - protein, 17 aa, Staphylococcus aureus
GLDEAGYYNIPIMSYGV

SEQ ID NO: 1649712 - protein, 24 aa, Staphylococcus aureus
GLGQMLLKYGINYASHTCDVMSLE

SEQ ID NO: 1649713 - protein, 27 aa, Staphylococcus aureus
GNTEAMIKYLLPKATVVTPNLFEAGQL

SEQ ID NO: 1649714 - protein, 19 aa, Staphylococcus aureus
GSFLLSESGYKIFVHESER

SEQ ID NO: 1649715 - protein, 19 aa, Staphylococcus aureus
GTESIDFIQEIKKKYSSIK

SEQ ID NO: 1649716 - protein, 20 aa, Staphylococcus aureus
HGDTELAVWSQANVAGISVY

SEQ ID NO: 1649717 - protein, 21 aa, Staphylococcus aureus
HGKEAFKQAIVDFYQRQYNVT

SEQ ID NO: 1649718 - protein, 21 aa, Staphylococcus aureus
HILEGLRIALDHIDEIISTIR

SEQ ID NO: 1649719 - protein, 26 aa, Staphylococcus aureus
HSYRELPIRIAELGTMHRYEASGAVS

SEQ ID NO: 1649720 - protein, 17 aa, Staphylococcus aureus
IAACLLTEARIFKFYKY

SEQ ID NO: 1649721 - protein, 21 aa, Staphylococcus aureus
IEDIYQLPGHVFIFGGQTLFE

SEQ ID NO: 1649722 - protein, 18 aa, Staphylococcus aureus
IGEHGDTELAVWSQANVA

SEQ ID NO: 1649723 - protein, 22 aa, Staphylococcus aureus
IGNMIIDAFILRDPGNYKDVID

SEQ ID NO: 1649724 - protein, 26 aa, Staphylococcus aureus
INPDIILRLPHGMPEEVKKMFQKEFK

SEQ ID NO: 1649725 - protein, 26 aa, Staphylococcus aureus
IPVPGSTLPSVIGWRTIDDTEQMMNI

SEQ ID NO: 1649726 - protein, 24 aa, Staphylococcus aureus
ISQRELAEAIGLSRPSVANIISGL

SEQ ID NO: 1649727 - protein, 32 aa, Staphylococcus aureus
IVAEGPGSYTGLRIGVTVAKTLAYALDVKLYG

SEQ ID NO: 1649728 - protein, 25 aa, Staphylococcus aureus
IVVGNTYGRIRAMVNDLGQRIKTAG

SEQ ID NO: 1649729 - protein, 24 aa, Staphylococcus aureus
IYIKDGFIVYKGVRIINTEDLVLP

SEQ ID NO: 1649730 - protein, 20 aa, Staphylococcus aureus
KDEVEEIIKDMIELILEEKK

SEQ ID NO: 1649731 - protein, 24 aa, Staphylococcus aureus
KDLESRIAKALPNVDRYDIVSKSI

SEQ ID NO: 1649732 - protein, 17 aa, Staphylococcus aureus
KELKRLGINATIRREQG

SEQ ID NO: 1649733 - protein, 20 aa, Staphylococcus aureus
KERLSHLDVDFKFNREEETL

SEQ ID NO: 1649734 - protein, 25 aa, Staphylococcus aureus
KGDKCKVSIRFRGRAITHKEIGQRV

SEQ ID NO: 1649735 - protein, 23 aa, Staphylococcus aureus
KGTFSYLACRQYFSENEATFQPK

SEQ ID NO: 1649736 - protein, 26 aa, Staphylococcus aureus
KLRKLNLKWYAVPIISNMDLKIGGIV

SEQ ID NO: 1649737 - protein, 18 aa, Staphylococcus aureus
KLWLHIKLDTGMGRLGIK

SEQ ID NO: 1649738 - protein, 24 aa, Staphylococcus aureus
KNGKKRISHQMDMLFTHFGISGPA

SEQ ID NO: 1649739 - protein, 18 aa, Staphylococcus aureus
KPGVGYPKRWEDQEHYKG

SEQ ID NO: 1649740 - protein, 19 aa, Staphylococcus aureus
KPNFSRIAQIASYVNPNYA

SEQ ID NO: 1649741 - protein, 24 aa, Staphylococcus aureus
KQNDIWKHFKAVKNNHVYDLEEVP

SEQ ID NO: 1649742 - protein, 21 aa, Staphylococcus aureus
KRAQSFGMKILAFDPYLTDEK

SEQ ID NO: 1649743 - protein, 26 aa, Staphylococcus aureus
KRMQGYNVLHPMGWDAFGLPAEQYAL

SEQ ID NO: 1649744 - protein, 21 aa, Staphylococcus aureus
KRSIDSSKVYQLRQQRMDVEK

SEQ ID NO: 1649745 - protein, 18 aa, Staphylococcus aureus
KSSMFVAHIMNVDRHDHV

SEQ ID NO: 1649746 - protein, 17 aa, Staphylococcus aureus
LADKICIMSEGKVVQFD

SEQ ID NO: 1649747 - protein, 19 aa, Staphylococcus aureus
LDGAPAYFSNLPVKAMTQS

SEQ ID NO: 1649748 - protein, 22 aa, Staphylococcus aureus
LDIQSGEFIAFIGTSGSGKTTA

SEQ ID NO: 1649749 - protein, 17 aa, Staphylococcus aureus
LDYDMINDLGFEIDYDT

SEQ ID NO: 1649750 - protein, 21 aa, Staphylococcus aureus
LGCRKLIDYEGIFAGGSTGSI

SEQ ID NO: 1649751 - protein, 18 aa, Staphylococcus aureus
LGKYWASLGDVFVNDAFG

SEQ ID NO: 1649752 - protein, 27 aa, Staphylococcus aureus
LKFGPDFVPNVKLQWLAIDKDKVETTV

SEQ ID NO: 1649753 - protein, 18 aa, Staphylococcus aureus
LKGGDPAIFGRVQEEVDT

SEQ ID NO: 1649754 - protein, 22 aa, Staphylococcus aureus
LKLKMKEAFVEKAVAINDISDE

SEQ ID NO: 1649755 - protein, 18 aa, Staphylococcus aureus
LKSLRQEIQMIFQDPFAS

SEQ ID NO: 1649756 - protein, 22 aa, Staphylococcus aureus
LLIKGHNAYGYLKAEKGVHRLV

SEQ ID NO: 1649757 - protein, 17 aa, Staphylococcus aureus
LNAPFTYDAEISNIFYD

SEQ ID NO: 1649758 - protein, 20 aa, Staphylococcus aureus
LNERFIITRGLDKCLFGYTL

SEQ ID NO: 1649759 - protein, 19 aa, Staphylococcus aureus
LPLEIYVELVYSIQQEMVY

SEQ ID NO: 1649760 - protein, 22 aa, Staphylococcus aureus
LQQYTCSFVGHFSAGKSTLINL

SEQ ID NO: 1649761 - protein, 27 aa, Staphylococcus aureus
LRDKTWSVHVPRRIKEIGPRIKKVSDE

SEQ ID NO: 1649762 - protein, 19 aa, Staphylococcus aureus
LRDLWQQKMLRDNPELSID

SEQ ID NO: 1649763 - protein, 17 aa, Staphylococcus aureus
LTHHIVRKSLTYLEEHI

SEQ ID NO: 1649764 - protein, 17 aa, Staphylococcus aureus
LTTHIDLIRGGNTHHEI

SEQ ID NO: 1649765 - protein, 26 aa, Staphylococcus aureus
LVKKEGLKGGGYYVEYRTDDARLTIE

SEQ ID NO: 1649766 - protein, 27 aa, Staphylococcus aureus
LVWATAAPGWQKWVWSPFLSVLGSGAT

SEQ ID NO: 1649767 - protein, 21 aa, Staphylococcus aureus
LYIAALKLGVAIIPCSEMLRT

SEQ ID NO: 1649768 - protein, 17 aa, Staphylococcus aureus
MCGWPYEYSNHKQVSKT

SEQ ID NO: 1649769 - protein, 17 aa, Staphylococcus aureus
MEGLLQLVNPKIISQSN

SEQ ID NO: 1649770 - protein, 19 aa, Staphylococcus aureus
MFDYSACKYPIGVVEDEIY

SEQ ID NO: 1649771 - protein, 19 aa, Staphylococcus aureus
MHIGHIKSIMELLKQNHIE

SEQ ID NO: 1649772 - protein, 17 aa, Staphylococcus aureus
MINDLGFEIDYDTCENK

SEQ ID NO: 1649773 - protein, 20 aa, Staphylococcus aureus
MIPVHPWQFEHVIQVDLAEE

SEQ ID NO: 1649774 - protein, 19 aa, Staphylococcus aureus
MSFDTMVLFGDHAASPHGT

SEQ ID NO: 1649775 - protein, 24 aa, Staphylococcus aureus
NDLKGAGFELGIATGRPYTETVVP

SEQ ID NO: 1649776 - protein, 21 aa, Staphylococcus aureus
NDSRDSFPLLTKVLDANDKLS

SEQ ID NO: 1649777 - protein, 18 aa, Staphylococcus aureus
NETIRIDWDREHPRVIWD

SEQ ID NO: 1649778 - protein, 35 aa, Staphylococcus aureus
NETNAMPGFTAFSMYPKLWENMGLSYPELITKLIE

SEQ ID NO: 1649779 - protein, 19 aa, Staphylococcus aureus
NFIGHTFAVYDGRKHVPVY

SEQ ID NO: 1649780 - protein, 23 aa, Staphylococcus aureus
NGQFKHMHRHSATIVGGALTLAD

SEQ ID NO: 1649781 - protein, 26 aa, Staphylococcus aureus
NIWFEREAKDLLPEGFTHPGSPNGTF

SEQ ID NO: 1649782 - protein, 23 aa, Staphylococcus aureus
NLDKGVAFGAMFSDSEDLMHQKN

SEQ ID NO: 1649783 - protein, 24 aa, Staphylococcus aureus
NLFSAVKIYGTFKHMHVRMMPAQQ

SEQ ID NO: 1649784 - protein, 24 aa, Staphylococcus aureus
NNISPCSGVICGMGESNQDIVDMA

SEQ ID NO: 1649785 - protein, 26 aa, Staphylococcus aureus
NVNKSLKGLDGFVVKGKRDRMYIELE

SEQ ID NO: 1649786 - protein, 19 aa, Staphylococcus aureus
PETLPVLNGVLDYRRQITN

SEQ ID NO: 1649787 - protein, 18 aa, Staphylococcus aureus
PTKLYVKPVLALKKEVSI

SEQ ID NO: 1649788 - protein, 21 aa, Staphylococcus aureus
PYIMKKLNAPFTYDAEISNIF

SEQ ID NO: 1649789 - protein, 18 aa, Staphylococcus aureus
PYNLKWSKGAYFNAKIDG

SEQ ID NO: 1649790 - protein, 21 aa, Staphylococcus aureus
QADGHTGVIAFEVKNTESAKQ

SEQ ID NO: 1649791 - protein, 17 aa, Staphylococcus aureus
QIHAGGRGKAGGVKIAK

SEQ ID NO: 1649792 - protein, 24 aa, Staphylococcus aureus
QKKHPKVLILMGVPGSYLVATDKS

SEQ ID NO: 1649793 - protein, 21 aa, Staphylococcus aureus
QLDFLLPERFDLTYIGQDGEH

SEQ ID NO: 1649794 - protein, 24 aa, Staphylococcus aureus
QNHIECFIHIDLIKGLSHDEFASE

SEQ ID NO: 1649795 - protein, 24 aa, Staphylococcus aureus
QYEANQLLKMFVSTMETRLNDHNK

SEQ ID NO: 1649796 - protein, 18 aa, Staphylococcus aureus
RDLDIFITHFKQIKDDYH

SEQ ID NO: 1649797 - protein, 18 aa, Staphylococcus aureus
RIHLKPTQLVGGYAQISY

SEQ ID NO: 1649798 - protein, 22 aa, Staphylococcus aureus
RKLYPESKIYVFGKTDYKLSHF

SEQ ID NO: 1649799 - protein, 25 aa, Staphylococcus aureus
RLNYKSEAYVGVWTEESVAVSFLTS

SEQ ID NO: 1649800 - protein, 20 aa, Staphylococcus aureus
RNQHQRFLIVFSDGEPSAFN

SEQ ID NO: 1649801 - protein, 20 aa, Staphylococcus aureus
RRVTFEYGLFGGVNDQLEHA

SEQ ID NO: 1649802 - protein, 21 aa, Staphylococcus aureus
RSRLMPINRAYNVEKLIEAIQ

SEQ ID NO: 1649803 - protein, 25 aa, Staphylococcus aureus
SAASSCYIISLAATLERAKFTDISI

SEQ ID NO: 1649804 - protein, 24 aa, Staphylococcus aureus
SEPIKRIANHRVLAVNRGEKEKVL

SEQ ID NO: 1649805 - protein, 18 aa, Staphylococcus aureus
SGATAFVFNGRFSPETYL

SEQ ID NO: 1649806 - protein, 18 aa, Staphylococcus aureus
SGKTMIFDAMTYALFGKA

SEQ ID NO: 1649807 - protein, 18 aa, Staphylococcus aureus
SGYRSYHVIIEYPIETLQ

SEQ ID NO: 1649808 - protein, 19 aa, Staphylococcus aureus
SHAFLLPLMQLIDSEIKEP

SEQ ID NO: 1649809 - protein, 17 aa, Staphylococcus aureus
SIVKYDVAFGLENHAVP

SEQ ID NO: 1649810 - protein, 21 aa, Staphylococcus aureus
SKCVYVKWNPYSYTYAKQHQI

SEQ ID NO: 1649811 - protein, 24 aa, Staphylococcus aureus
SKFIYKNRGVFILVDPYLIENLRD

SEQ ID NO: 1649812 - protein, 28 aa, Staphylococcus aureus
SKGYNMSGFRVGFAVGNKDMIQALKKYQ

SEQ ID NO: 1649813 - protein, 18 aa, Staphylococcus aureus
SLSARGVKFYEGIKLSEN

SEQ ID NO: 1649814 - protein, 25 aa, Staphylococcus aureus
SQGLLEGFKNLGFDTYFAVPKTPEE

SEQ ID NO: 1649815 - protein, 19 aa, Staphylococcus aureus
SRGSFPQDVNFYINKETGI

SEQ ID NO: 1649816 - protein, 23 aa, Staphylococcus aureus
SSILKFPGVLIRTSTERPEVLDK

SEQ ID NO: 1649817 - protein, 17 aa, Staphylococcus aureus
TDYKMCVLLDMHIGHIK

SEQ ID NO: 1649818 - protein, 26 aa, Staphylococcus aureus
TIHGKELESIFGLSRRQLGYRIQKIN

SEQ ID NO: 1649819 - protein, 29 aa, Staphylococcus aureus
TKFKHEVQCVICLPAALLNENSDAIRLSC

SEQ ID NO: 1649820 - protein, 20 aa, Staphylococcus aureus
TKLPPTPIFHKNHETGKEDF

SEQ ID NO: 1649821 - protein, 24 aa, Staphylococcus aureus
TNSTRAIHVLKHFDRIEDVVVKVI

SEQ ID NO: 1649822 - protein, 27 aa, Staphylococcus aureus
TRAEWLMLDVFQWTRTDFVVHMHDDMP

SEQ ID NO: 1649823 - protein, 20 aa, Staphylococcus aureus
TRPLSATKRFRLVEIVEESV

SEQ ID NO: 1649824 - protein, 24 aa, Staphylococcus aureus
TSRLLSTRLEQVFSEIERITQASV

SEQ ID NO: 1649825 - protein, 21 aa, Staphylococcus aureus
TYKLEAFRGKVILVVNTATEC

SEQ ID NO: 1649826 - protein, 18 aa, Staphylococcus aureus
VDELTSALISKGYKAEGL

SEQ ID NO: 1649827 - protein, 18 aa, Staphylococcus aureus
VDYIYWLLEIRMWGNAKD

SEQ ID NO: 1649828 - protein, 22 aa, Staphylococcus aureus
VEERSAVSIGRRVQDPLSELVK

SEQ ID NO: 1649829 - protein, 18 aa, Staphylococcus aureus
VENAKCISIGVATDNALV

SEQ ID NO: 1649830 - protein, 24 aa, Staphylococcus aureus
VFNYFKPKFMLGMTATPERSDELS

SEQ ID NO: 1649831 - protein, 23 aa, Staphylococcus aureus
VLAEALINEGFRIVSGGTDNHLV

SEQ ID NO: 1649832 - protein, 28 aa, Staphylococcus aureus
VNAKGRLPDCLVEWSAKRLKEQGANAVK

SEQ ID NO: 1649833 - protein, 19 aa, Staphylococcus aureus
VQEAAKLGFKRVIIPKNNI

SEQ ID NO: 1649834 - protein, 20 aa, Staphylococcus aureus
VSPRPIPGVKGGIHHITGVE

SEQ ID NO: 1649835 - protein, 25 aa, Staphylococcus aureus
VSTLNRITSAFVRLQYNIDTLHVTH

SEQ ID NO: 1649836 - protein, 23 aa, Staphylococcus aureus
VVMKEGHGAYLYDVDGNKFIDYL

SEQ ID NO: 1649837 - protein, 21 aa, Staphylococcus aureus
VYELPLAEVVFDFFDQLKSNT

SEQ ID NO: 1649838 - protein, 19 aa, Staphylococcus aureus
YDLDLAKKHNIVISNVPSY

SEQ ID NO: 1649839 - protein, 25 aa, Staphylococcus aureus
YDVMQRLKFHYYFIDIENSKTATHL

SEQ ID NO: 1649840 - protein, 24 aa, Staphylococcus aureus
YEQGFKNICLRTNDIEAVKNKLQS

SEQ ID NO: 1649841 - protein, 18 aa, Staphylococcus aureus
YGNYLGEVNLTFEAHKVV

SEQ ID NO: 1649842 - protein, 31 aa, Staphylococcus aureus
YKLAIEYKLAFPLHPEFRTMPMVWYCPPLSP

SEQ ID NO: 1649843 - protein, 17 aa, Staphylococcus aureus
YKNFEDEIEIDFTDSNH

SEQ ID NO: 1649844 - protein, 19 aa, Staphylococcus aureus
YKSEPGLLQAIQFLDDYYH

SEQ ID NO: 1649845 - protein, 17 aa, Staphylococcus aureus
YLHPHLEPILKNTYGVI

SEQ ID NO: 1649846 - protein, 21 aa, Staphylococcus aureus
YMDFTEIVPISALEGLNVDHF

SEQ ID NO: 1649847 - protein, 18 aa, Staphylococcus aureus
YNQYMGAYHLQWHMIKYA

SEQ ID NO: 1649848 - protein, 17 aa, Staphylococcus aureus
YRVKSLTTIASKKDDLI

SEQ ID NO: 1649849 - protein, 26 aa, Staphylococcus aureus
YSDFERWSFHLQIYFLAERFKEQKRM

SEQ ID NO: 1649850 - protein, 24 aa, Staphylococcus aureus
YSMGGRVALYYAINGHIPISNLIL

SEQ ID NO: 1649851 - protein, 17 aa, Staphylococcus aureus
AALTRRFNEVLVNEPSA

SEQ ID NO: 1649852 - protein, 17 aa, Staphylococcus aureus
ADTGISFVVGESDDPMK

SEQ ID NO: 1649853 - protein, 21 aa, Staphylococcus aureus
AERAGLGFVGRNGFVINPKLG

SEQ ID NO: 1649854 - protein, 26 aa, Staphylococcus aureus
AGIRHFGENRLEGFFQKKEALPSDAV

SEQ ID NO: 1649855 - protein, 18 aa, Staphylococcus aureus
AIFKAFSRALGIALTATD

SEQ ID NO: 1649856 - protein, 26 aa, Staphylococcus aureus
AIKKGWPSMMYRIWKNPEKYKSYFIG

SEQ ID NO: 1649857 - protein, 17 aa, Staphylococcus aureus
AKIKVVLNGAGAAGIAI

SEQ ID NO: 1649858 - protein, 17 aa, Staphylococcus aureus
ALNNPFLSPTRRDKLQK

SEQ ID NO: 1649859 - protein, 18 aa, Staphylococcus aureus
ALTFSYLTSHDVLGSIIV

SEQ ID NO: 1649860 - protein, 17 aa, Staphylococcus aureus
APIAPHIGEELWSKLGH

SEQ ID NO: 1649861 - protein, 23 aa, Staphylococcus aureus
AQHGIKAIIQPGGSIKDQDSIDM

SEQ ID NO: 1649862 - protein, 26 aa, Staphylococcus aureus
DASAALKICNYCFEHGVVIIAVAGNV

SEQ ID NO: 1649863 - protein, 19 aa, Staphylococcus aureus
DGIICYIQFQMKYLADKFD

SEQ ID NO: 1649864 - protein, 21 aa, Staphylococcus aureus
DLKPIKGDNIFVWQGDITTLK

SEQ ID NO: 1649865 - protein, 17 aa, Staphylococcus aureus
EFVDEAVDRACYLLQTY

SEQ ID NO: 1649866 - protein, 17 aa, Staphylococcus aureus
EGLKQLVQCGANIVGLN

SEQ ID NO: 1649867 - protein, 26 aa, Staphylococcus aureus
EIDAALWGARAAYIGGFDSTSNVRAG

SEQ ID NO: 1649868 - protein, 18 aa, Staphylococcus aureus
EIEDQFLNQEINGVTIDS

SEQ ID NO: 1649869 - protein, 18 aa, Staphylococcus aureus
EKNFKTFLSQYLPAQPGD

SEQ ID NO: 1649870 - protein, 19 aa, Staphylococcus aureus
EMNYSKVLVITEDWCGDAM

SEQ ID NO: 1649871 - protein, 24 aa, Staphylococcus aureus
ENINIPAQIFVEFDAASQGLGILL

SEQ ID NO: 1649872 - protein, 23 aa, Staphylococcus aureus
ENLKKYKHYVFFGNDKVFKNGKG

SEQ ID NO: 1649873 - protein, 19 aa, Staphylococcus aureus
EPDLHFTIIDFNQELLCIY

SEQ ID NO: 1649874 - protein, 19 aa, Staphylococcus aureus
EPFMYKLVDIVADIMEPYY

SEQ ID NO: 1649875 - protein, 22 aa, Staphylococcus aureus
EQKGVAVVICPNDLLTEKIKDT

SEQ ID NO: 1649876 - protein, 22 aa, Staphylococcus aureus
ERPESLFNYFKQLFAQVTNPPI

SEQ ID NO: 1649877 - protein, 19 aa, Staphylococcus aureus
ETGFSNYLEVELSNDSDSV

SEQ ID NO: 1649878 - protein, 19 aa, Staphylococcus aureus
FDFSAVPFKQVYKNEQDVV

SEQ ID NO: 1649879 - protein, 29 aa, Staphylococcus aureus
FGEVGRALYNFIWDDFCDWYIEMSKIPMN

SEQ ID NO: 1649880 - protein, 22 aa, Staphylococcus aureus
FIEMAKIPVIHSLPAKTILPDD

SEQ ID NO: 1649881 - protein, 20 aa, Staphylococcus aureus
FIENRMGGFFGVKKSKNPNA

SEQ ID NO: 1649882 - protein, 25 aa, Staphylococcus aureus
FKDRIWGGHALKAFNYDIPNETTGE

SEQ ID NO: 1649883 - protein, 21 aa, Staphylococcus aureus
FKLVATELLWFIKGDTNIQYL

SEQ ID NO: 1649884 - protein, 19 aa, Staphylococcus aureus
FKQLFRVLEDTFARPLSPY

SEQ ID NO: 1649885 - protein, 27 aa, Staphylococcus aureus
FNGLKRVIDFIEHFGFSESDLEYLKSI

SEQ ID NO: 1649886 - protein, 17 aa, Staphylococcus aureus
FNTLFEAIDKLAIDTDI

SEQ ID NO: 1649887 - protein, 21 aa, Staphylococcus aureus
FRKHLEGGIIESIKQIGNDRR

SEQ ID NO: 1649888 - protein, 17 aa, Staphylococcus aureus
FRTMPMVWYCPPLSPIM

SEQ ID NO: 1649889 - protein, 26 aa, Staphylococcus aureus
GESGCGKSTLASLVLGLFKPVKGEIY

SEQ ID NO: 1649890 - protein, 20 aa, Staphylococcus aureus
GIESVRWTGRIEQVHDKPLI

SEQ ID NO: 1649891 - protein, 38 aa, Staphylococcus aureus
GIFDRYPKLNMIIGHWGEFIPFFLERMDEALFAEHLNH

SEQ ID NO: 1649892 - protein, 27 aa, Staphylococcus aureus
GIKQSKHIGGFPVSGLFLRCTNQEVID

SEQ ID NO: 1649893 - protein, 18 aa, Staphylococcus aureus
GKTLAKYAASTGQHVAVI

SEQ ID NO: 1649894 - protein, 24 aa, Staphylococcus aureus
GRERKGVCSVHFAERIKPGDIVPI

SEQ ID NO: 1649895 - protein, 24 aa, Staphylococcus aureus
GYSGEILQGLIFVSSKKEAYDLAD

SEQ ID NO: 1649896 - protein, 18 aa, Staphylococcus aureus
GYTATDIISRYKRMQGYN

SEQ ID NO: 1649897 - protein, 22 aa, Staphylococcus aureus
HLANPKLPFGGVGASGMGRYHG

SEQ ID NO: 1649898 - protein, 26 aa, Staphylococcus aureus
HTIMRKRLDMLAAFIESKVPDVEIKS

SEQ ID NO: 1649899 - protein, 18 aa, Staphylococcus aureus
IANTVAFLASDKAKYITG

SEQ ID NO: 1649900 - protein, 29 aa, Staphylococcus aureus
IAQTCYQFNVPFVVVRAVSDLANGEAEMS

SEQ ID NO: 1649901 - protein, 30 aa, Staphylococcus aureus
IEREKMSFGVINILLQFVMLKEDMKLPKAY

SEQ ID NO: 1649902 - protein, 25 aa, Staphylococcus aureus
IERKGLKLVGGKLMQVPMELAETHY

SEQ ID NO: 1649903 - protein, 19 aa, Staphylococcus aureus
IFCEADDWKPFYEAYGSQF

SEQ ID NO: 1649904 - protein, 18 aa, Staphylococcus aureus
IIIDAIGQLIGMRASSDF

SEQ ID NO: 1649905 - protein, 19 aa, Staphylococcus aureus
IIKFARSFADVNVGEPLVY

SEQ ID NO: 1649906 - protein, 25 aa, Staphylococcus aureus
IKNGKAELLAPMSAIAGQRSAIMGA

SEQ ID NO: 1649907 - protein, 19 aa, Staphylococcus aureus
ILVNMFLYLPNFFQNQNSE

SEQ ID NO: 1649908 - protein, 18 aa, Staphylococcus aureus
IMMPRSIATYELYIAALK

SEQ ID NO: 1649909 - protein, 18 aa, Staphylococcus aureus
IQVPGAFPKFGTTDGTIT

SEQ ID NO: 1649910 - protein, 23 aa, Staphylococcus aureus
IQYIVGFASFYGRTFDVNSNCLI

SEQ ID NO: 1649911 - protein, 26 aa, Staphylococcus aureus
KATKPTRIKLKWTPQIMHQIRVLREL

SEQ ID NO: 1649912 - protein, 18 aa, Staphylococcus aureus
KEITSLKMGNIEDQVEEI

SEQ ID NO: 1649913 - protein, 20 aa, Staphylococcus aureus
KKETVDFYLAKGVVDRVSEK

SEQ ID NO: 1649914 - protein, 29 aa, Staphylococcus aureus
KKFFRPEFLNRFNGIVEFLHLDKDALQDI

SEQ ID NO: 1649915 - protein, 22 aa, Staphylococcus aureus
KKFYALDMFPYPSGAGLHVGHP

SEQ ID NO: 1649916 - protein, 19 aa, Staphylococcus aureus
KLFKGNAIVNGRKSPYTLY

SEQ ID NO: 1649917 - protein, 19 aa, Staphylococcus aureus
KLTDCADLVLLTTDQSRNT

SEQ ID NO: 1649918 - protein, 35 aa, Staphylococcus aureus
KNQFPWVVAAFPSKAWAKRVYPELSVEEAYIKFID

SEQ ID NO: 1649919 - protein, 17 aa, Staphylococcus aureus
KNQLPMVGTISLVPQIV

SEQ ID NO: 1649920 - protein, 25 aa, Staphylococcus aureus
KRWTPEYKQTLMLSRIQSTQALYEL

SEQ ID NO: 1649921 - protein, 18 aa, Staphylococcus aureus
KWANGLPLTDKRISPING

SEQ ID NO: 1649922 - protein, 20 aa, Staphylococcus aureus
LENGLRLFIIPKPGFQKTFV

SEQ ID NO: 1649923 - protein, 23 aa, Staphylococcus aureus
LIDKALKLISEFNLLKENGIIVC

SEQ ID NO: 1649924 - protein, 19 aa, Staphylococcus aureus
LKSLEIVHGNNLVVTIYHQ

SEQ ID NO: 1649925 - protein, 25 aa, Staphylococcus aureus
LPDAVTRFRQGLGRLIRNENDRGII

SEQ ID NO: 1649926 - protein, 18 aa, Staphylococcus aureus
LQESTGLEAMTIHRLIGW

SEQ ID NO: 1649927 - protein, 20 aa, Staphylococcus aureus
LYNMVRVLVAFLIEVGKGRH

SEQ ID NO: 1649928 - protein, 23 aa, Staphylococcus aureus
MDQFSFKVAQSLINNDGPAIEYT

SEQ ID NO: 1649929 - protein, 23 aa, Staphylococcus aureus
MGGLQERIWNPLQILNDFGTDVF

SEQ ID NO: 1649930 - protein, 19 aa, Staphylococcus aureus
MIISGLWTHFGYADEFDVS

SEQ ID NO: 1649931 - protein, 22 aa, Staphylococcus aureus
MLSTSKMEGFGLAILESLSVGT

SEQ ID NO: 1649932 - protein, 31 aa, Staphylococcus aureus
MMGAMLGRFKKCVIGLPGGCPLGPRPIDQHI

SEQ ID NO: 1649933 - protein, 19 aa, Staphylococcus aureus
NDIPMWLRECITSVNEEYQ

SEQ ID NO: 1649934 - protein, 26 aa, Staphylococcus aureus
NEDIPFSGAFSIEFRLSKQTITCTDY

SEQ ID NO: 1649935 - protein, 34 aa, Staphylococcus aureus
NKLKSLGLNSNWDMLFIVFSIHLIDILKKLSHDE

SEQ ID NO: 1649936 - protein, 23 aa, Staphylococcus aureus
NMAEKILPLPHIIDIPKRVFAKL

SEQ ID NO: 1649937 - protein, 23 aa, Staphylococcus aureus
NNRIKRYIAKYTINPAITHGISE

SEQ ID NO: 1649938 - protein, 17 aa, Staphylococcus aureus
NRPEVRNAFTPKTVAEM

SEQ ID NO: 1649939 - protein, 22 aa, Staphylococcus aureus
NRPKWMHHALKMYQIAPRFFER

SEQ ID NO: 1649940 - protein, 23 aa, Staphylococcus aureus
PAKLRWDNYYGCTHFIRPKYKSE

SEQ ID NO: 1649941 - protein, 23 aa, Staphylococcus aureus
PEKWKEFEVIKRQKAIEIANAML

SEQ ID NO: 1649942 - protein, 23 aa, Staphylococcus aureus
PEVEFKRTYVCEDMSKCICLYNA

SEQ ID NO: 1649943 - protein, 22 aa, Staphylococcus aureus
PKAVTHCHGWGFAHLQMAPKHW

SEQ ID NO: 1649944 - protein, 22 aa, Staphylococcus aureus
PKNPLCLFCPVQENCEAFDKGT

SEQ ID NO: 1649945 - protein, 25 aa, Staphylococcus aureus
PTTKFKTTTIVFKFMAPLEYDTITA

SEQ ID NO: 1649946 - protein, 21 aa, Staphylococcus aureus
PYANEIMIYQSMLDAVQLYPK

SEQ ID NO: 1649947 - protein, 20 aa, Staphylococcus aureus
PYMNSRKFELLIANIEQLSV

SEQ ID NO: 1649948 - protein, 38 aa, Staphylococcus aureus
QDELFDDVCAFMVNEGHISTSLIQRHFQIGYNRAARII

SEQ ID NO: 1649949 - protein, 18 aa, Staphylococcus aureus
QEIILRPVDEVKVLLNDL

SEQ ID NO: 1649950 - protein, 17 aa, Staphylococcus aureus
QQDEWHEFIAPNIRSKS

SEQ ID NO: 1649951 - protein, 21 aa, Staphylococcus aureus
QRTAAARAFVHKPQIIFADEP

SEQ ID NO: 1649952 - protein, 20 aa, Staphylococcus aureus
QSWIPCEIEDQFLNQEINGV

SEQ ID NO: 1649953 - protein, 21 aa, Staphylococcus aureus
QTKEGLKTGFVDIVVGTHKLL

SEQ ID NO: 1649954 - protein, 17 aa, Staphylococcus aureus
QYVESLIYGTILDAKAS

SEQ ID NO: 1649955 - protein, 18 aa, Staphylococcus aureus
RDTLLPAIGQGALGIECR

SEQ ID NO: 1649956 - protein, 19 aa, Staphylococcus aureus
RGSGKICLNGAASRLVEVG

SEQ ID NO: 1649957 - protein, 20 aa, Staphylococcus aureus
RKLGKYPPYYYLINFTISHK

SEQ ID NO: 1649958 - protein, 19 aa, Staphylococcus aureus
RNMAVFSMSVVSKLTDLTP

SEQ ID NO: 1649959 - protein, 18 aa, Staphylococcus aureus
RNPYSVILLDEVEKAHTD

SEQ ID NO: 1649960 - protein, 24 aa, Staphylococcus aureus
RRNRSKVRLALKRGTTVERSDREG

SEQ ID NO: 1649961 - protein, 25 aa, Staphylococcus aureus
RTADGEPVVYCLDKIAKKELTCTEY

SEQ ID NO: 1649962 - protein, 31 aa, Staphylococcus aureus
RVGAAKIALERAIEINDHVALVSDGFFPMGD

SEQ ID NO: 1649963 - protein, 17 aa, Staphylococcus aureus
RVIGFENQLPWHLPNDL

SEQ ID NO: 1649964 - protein, 26 aa, Staphylococcus aureus
SEVADELYHLFVLMHALGVDFSEIEA

SEQ ID NO: 1649965 - protein, 19 aa, Staphylococcus aureus
SIATYELYIAALKLGVAII

SEQ ID NO: 1649966 - protein, 28 aa, Staphylococcus aureus
SNIVYIRWFEDLRTAFINQHMNYSTMIN

SEQ ID NO: 1649967 - protein, 19 aa, Staphylococcus aureus
SPEQWYSMIEDFKVTIWYT

SEQ ID NO: 1649968 - protein, 24 aa, Staphylococcus aureus
SYQPKHLVIVGGGYIALEFASMFA

SEQ ID NO: 1649969 - protein, 25 aa, Staphylococcus aureus
THDPVAASFAERVIMLKDGQIHTQL

SEQ ID NO: 1649970 - protein, 24 aa, Staphylococcus aureus
TMILHEFLPFIEIKQVPSSSANYD

SEQ ID NO: 1649971 - protein, 18 aa, Staphylococcus aureus
TSHLNKSLVHKITNVLKD

SEQ ID NO: 1649972 - protein, 22 aa, Staphylococcus aureus
TVSELYAPISGKVVEVNEELED

SEQ ID NO: 1649973 - protein, 18 aa, Staphylococcus aureus
VAEIRRGLDEAGYYNIPI

SEQ ID NO: 1649974 - protein, 19 aa, Staphylococcus aureus
VFEIIDGWCRIYWNNHNEW

SEQ ID NO: 1649975 - protein, 25 aa, Staphylococcus aureus
VKVAQEAFESWSLTSKSERAQMLRD

SEQ ID NO: 1649976 - protein, 18 aa, Staphylococcus aureus
VMATITFQNLFKLFESFS

SEQ ID NO: 1649977 - protein, 21 aa, Staphylococcus aureus
VTEIPHAWMMIEVDATNLVNT

SEQ ID NO: 1649978 - protein, 27 aa, Staphylococcus aureus
VTEKPKPWDVYAFPYYYVYNDFSDHYP

SEQ ID NO: 1649979 - protein, 26 aa, Staphylococcus aureus
VVLIHGFKNYVALLFHKGAILEDKYH

SEQ ID NO: 1649980 - protein, 22 aa, Staphylococcus aureus
WTKQFLAVAIRPMIHMLYYHGI

SEQ ID NO: 1649981 - protein, 22 aa, Staphylococcus aureus
WVIKGSKEYLIPYIADVVKEVD

SEQ ID NO: 1649982 - protein, 17 aa, Staphylococcus aureus
WYAEKDFASLLHEDLKI

SEQ ID NO: 1649983 - protein, 18 aa, Staphylococcus aureus
YAEYCFKEFPEVKYWTTF

SEQ ID NO: 1649984 - protein, 28 aa, Staphylococcus aureus
YIVITTEYYWHWDLKNSKLDVFDYKKLM

SEQ ID NO: 1649985 - protein, 18 aa, Staphylococcus aureus
YKYLRALIFNETELEEAY

SEQ ID NO: 1649986 - protein, 18 aa, Staphylococcus aureus
YYGGEVIKGDKVMHGKVD

SEQ ID NO: 1649987 - protein, 21 aa, Staphylococcus aureus
ADPAIDIGMLLYNYVPQQQWS

SEQ ID NO: 1649988 - protein, 17 aa, Staphylococcus aureus
ALNIPIEDFHLIKEIIS

SEQ ID NO: 1649989 - protein, 23 aa, Staphylococcus aureus
APGDFEKRVTFGLTGSDANDGII

SEQ ID NO: 1649990 - protein, 35 aa, Staphylococcus aureus
AREASWRVLGMYPKEVQLIGAIVLHEGNIAEMQTG

SEQ ID NO: 1649991 - protein, 20 aa, Staphylococcus aureus
AYGIMKGVRAVRVHNVELNA

SEQ ID NO: 1649992 - protein, 19 aa, Staphylococcus aureus
CPLENGLEIFVGVPSERYP

SEQ ID NO: 1649993 - protein, 17 aa, Staphylococcus aureus
CTIQRRMQKLVEEAPSP

SEQ ID NO: 1649994 - protein, 22 aa, Staphylococcus aureus
DALRKKVKLMKMSIDELGPVNL

SEQ ID NO: 1649995 - protein, 24 aa, Staphylococcus aureus
DEKYKEALEIIATKFGLTVNEDLQ

SEQ ID NO: 1649996 - protein, 25 aa, Staphylococcus aureus
DLVNMFKGFVFKVNGTLPIDKAFVT

SEQ ID NO: 1649997 - protein, 17 aa, Staphylococcus aureus
DPLEIVQTISRNHCAYP

SEQ ID NO: 1649998 - protein, 24 aa, Staphylococcus aureus
DRDYEFAKKFDLPIIEVIEGGNVE

SEQ ID NO: 1649999 - protein, 23 aa, Staphylococcus aureus
DVVIGIRPGRSFDKAKEDGFDVF

SEQ ID NO: 1650000 - protein, 18 aa, Staphylococcus aureus
EAKLNKRGIFTIGDLAKY

SEQ ID NO: 1650001 - protein, 19 aa, Staphylococcus aureus
EAVKKLKPTHVLSVSTIKD

SEQ ID NO: 1650002 - protein, 18 aa, Staphylococcus aureus
EFMFNGKHVLIVYDDLTK

SEQ ID NO: 1650003 - protein, 20 aa, Staphylococcus aureus
EFNKVLKNVCIKIMHNDIKN

SEQ ID NO: 1650004 - protein, 19 aa, Staphylococcus aureus
EPPDNAWDFFEFLEDDNAP

SEQ ID NO: 1650005 - protein, 17 aa, Staphylococcus aureus
ESDLLPNQFVLIATGSS

SEQ ID NO: 1650006 - protein, 22 aa, Staphylococcus aureus
ESKRTAFDFRFEDLFSKEEWLS

SEQ ID NO: 1650007 - protein, 19 aa, Staphylococcus aureus
EVKTLRILHFVSGDGGKLK

SEQ ID NO: 1650008 - protein, 17 aa, Staphylococcus aureus
EVRAWTFKQGMTAPQCA

SEQ ID NO: 1650009 - protein, 19 aa, Staphylococcus aureus
FKIDFERLARYCEKNNAVV

SEQ ID NO: 1650010 - protein, 20 aa, Staphylococcus aureus
FPYYYVYNDFSDHYPIKAYS

SEQ ID NO: 1650011 - protein, 17 aa, Staphylococcus aureus
FQFCDSQFPTGAFSHSF

SEQ ID NO: 1650012 - protein, 18 aa, Staphylococcus aureus
GGIRCEKFSGWLLKEGFE

SEQ ID NO: 1650013 - protein, 19 aa, Staphylococcus aureus
GGVDRGALILLKHQIIPFF

SEQ ID NO: 1650014 - protein, 23 aa, Staphylococcus aureus
GIIDRVDHRYVYVNLGRIEAVLS

SEQ ID NO: 1650015 - protein, 20 aa, Staphylococcus aureus
GKTTLLDSIRHTKVTAGEAG

SEQ ID NO: 1650016 - protein, 18 aa, Staphylococcus aureus
GMLDAAVCGEVFTSPTPD

SEQ ID NO: 1650017 - protein, 29 aa, Staphylococcus aureus
GVVSINAFKGVSFGEGFKAAEKPGSEIQD

SEQ ID NO: 1650018 - protein, 20 aa, Staphylococcus aureus
HGADTLRLYEMFMGPLDAAI

SEQ ID NO: 1650019 - protein, 17 aa, Staphylococcus aureus
IASCCGKSREFYFQNDA

SEQ ID NO: 1650020 - protein, 20 aa, Staphylococcus aureus
IASGGELSRIMLALKSIFVK

SEQ ID NO: 1650021 - protein, 17 aa, Staphylococcus aureus
IDIPEVNQVVMLRPTES

SEQ ID NO: 1650022 - protein, 26 aa, Staphylococcus aureus
IEIGYLPGRLKWLVADLLTKQGLKVV

SEQ ID NO: 1650023 - protein, 21 aa, Staphylococcus aureus
IKEDLPLLSCIEPNDTFDFQK

SEQ ID NO: 1650024 - protein, 17 aa, Staphylococcus aureus
INKLMALIERTTTVNDI

SEQ ID NO: 1650025 - protein, 21 aa, Staphylococcus aureus
IPYHKGFYRAFSKLHTTTFKY

SEQ ID NO: 1650026 - protein, 24 aa, Staphylococcus aureus
ISKELRDKYEWNPSLLSKIDNYLK

SEQ ID NO: 1650027 - protein, 19 aa, Staphylococcus aureus
KALEHLGFGALELGGITPK

SEQ ID NO: 1650028 - protein, 20 aa, Staphylococcus aureus
KESLGFDRDTNWLSVLPIYH

SEQ ID NO: 1650029 - protein, 20 aa, Staphylococcus aureus
KMVRSLREMRIRGVKTNIPF

SEQ ID NO: 1650030 - protein, 18 aa, Staphylococcus aureus
KYDDLGKMYQIVRQYELG

SEQ ID NO: 1650031 - protein, 24 aa, Staphylococcus aureus
LAAMIEGCYVLRAIEMVEEGYEPQ

SEQ ID NO: 1650032 - protein, 29 aa, Staphylococcus aureus
LDNNIPMGRGMIKWAPFATLPEQFETIQQ

SEQ ID NO: 1650033 - protein, 17 aa, Staphylococcus aureus
LEIVQTISRNHCAYPNH

SEQ ID NO: 1650034 - protein, 17 aa, Staphylococcus aureus
LEPEIEFKAKVKMPTDF

SEQ ID NO: 1650035 - protein, 26 aa, Staphylococcus aureus
LGYASAEALKALGYKVYIGSRNDVRG

SEQ ID NO: 1650036 - protein, 17 aa, Staphylococcus aureus
LKGNDKLVLAKELQHLC

SEQ ID NO: 1650037 - protein, 17 aa, Staphylococcus aureus
LLKQSGIFRENEHVDER

SEQ ID NO: 1650038 - protein, 20 aa, Staphylococcus aureus
LLQASWKIAPALATGCSLVM

SEQ ID NO: 1650039 - protein, 25 aa, Staphylococcus aureus
LMNEKDIRAVLGRFLFVQDDVKKII

SEQ ID NO: 1650040 - protein, 30 aa, Staphylococcus aureus
LNEKVINMFSFFIAYHFNKLDIGIERIFIQ

SEQ ID NO: 1650041 - protein, 20 aa, Staphylococcus aureus
LRKPDWLKIKLNTNENYTGL

SEQ ID NO: 1650042 - protein, 23 aa, Staphylococcus aureus
LTEGCICCAMKADVSEQLHQLYL

SEQ ID NO: 1650043 - protein, 19 aa, Staphylococcus aureus
LVYYREVVKHHQLKVNAFE

SEQ ID NO: 1650044 - protein, 17 aa, Staphylococcus aureus
LYYTRNKLLSVEECTSC

SEQ ID NO: 1650045 - protein, 22 aa, Staphylococcus aureus
MFENLSRYRAIIVSTEQQKLDV

SEQ ID NO: 1650046 - protein, 24 aa, Staphylococcus aureus
MIGVLKAGGAYVPIDPNYPSDRQE

SEQ ID NO: 1650047 - protein, 33 aa, Staphylococcus aureus
MNRAMPLLKTFRLENELKVFPSHFSKGMKQKVM

SEQ ID NO: 1650048 - protein, 22 aa, Staphylococcus aureus
MPKWIIDHWATHYGLEETETIL

SEQ ID NO: 1650049 - protein, 18 aa, Staphylococcus aureus
MYMVKKLDAGNIISQQAI

SEQ ID NO: 1650050 - protein, 19 aa, Staphylococcus aureus
NEIMSFLIELNRQGKTIIM

SEQ ID NO: 1650051 - protein, 19 aa, Staphylococcus aureus
NKKVLLVMGGSLGSKKLNS

SEQ ID NO: 1650052 - protein, 19 aa, Staphylococcus aureus
NLDPSILLAPWNVIEERLK

SEQ ID NO: 1650053 - protein, 25 aa, Staphylococcus aureus
NTFDWKDVEQAFSWSETGKMNMAYE

SEQ ID NO: 1650054 - protein, 23 aa, Staphylococcus aureus
PAVEAGESLGFLPGDLKEKVDPY

SEQ ID NO: 1650055 - protein, 19 aa, Staphylococcus aureus
PKEEMKVVTEVAPTDEQWE

SEQ ID NO: 1650056 - protein, 20 aa, Staphylococcus aureus
QAEVRQTFKVSKVGTIAGCY

SEQ ID NO: 1650057 - protein, 26 aa, Staphylococcus aureus
QVNMTFKPLHIFSDLSSKMFTWNNGE

SEQ ID NO: 1650058 - protein, 24 aa, Staphylococcus aureus
RDMNRLRPFGTDFSRPIFEMDDLS

SEQ ID NO: 1650059 - protein, 20 aa, Staphylococcus aureus
REDAVWDLTQVFADFAEGDF

SEQ ID NO: 1650060 - protein, 22 aa, Staphylococcus aureus
RIQKINLWLEQEGYPKLERTSQ

SEQ ID NO: 1650061 - protein, 20 aa, Staphylococcus aureus
RKINWKSLYEKALNHDFAEV

SEQ ID NO: 1650062 - protein, 17 aa, Staphylococcus aureus
RKNEHVEIAMAQSDAMH

SEQ ID NO: 1650063 - protein, 18 aa, Staphylococcus aureus
RLGINATIRREQGSDIDA

SEQ ID NO: 1650064 - protein, 19 aa, Staphylococcus aureus
RLTNNITWADNRAAKYATV

SEQ ID NO: 1650065 - protein, 18 aa, Staphylococcus aureus
RRKDLIISGGENIYPYQI

SEQ ID NO: 1650066 - protein, 17 aa, Staphylococcus aureus
SCAGMFTANSMNCLMEV

SEQ ID NO: 1650067 - protein, 27 aa, Staphylococcus aureus
SDMERLIRLPGKFKYFEHNVAAHSFKV

SEQ ID NO: 1650068 - protein, 21 aa, Staphylococcus aureus
SGKARSQMALDVFASKIHKYI

SEQ ID NO: 1650069 - protein, 23 aa, Staphylococcus aureus
SLAGFKYNLARQMLNIGSTLTIS

SEQ ID NO: 1650070 - protein, 23 aa, Staphylococcus aureus
SSLGLEPWKFVVIQDQALRDELK

SEQ ID NO: 1650071 - protein, 24 aa, Staphylococcus aureus
TCGDRIRLTFDIEDGIIKDAKFEG

SEQ ID NO: 1650072 - protein, 30 aa, Staphylococcus aureus
TDDVKRRHIRHCYKADPEYGKGVAKALGID

SEQ ID NO: 1650073 - protein, 27 aa, Staphylococcus aureus
TEFEIITAMMFLYFGEIHPVDFVIVEA

SEQ ID NO: 1650074 - protein, 26 aa, Staphylococcus aureus
TFVDAFNFVCTFLAKAIARDGEGATK

SEQ ID NO: 1650075 - protein, 19 aa, Staphylococcus aureus
TKLNFLWVTDWPLLEYDED

SEQ ID NO: 1650076 - protein, 26 aa, Staphylococcus aureus
TRIDNKLIKIGVFGTFSAGKSSLINA

SEQ ID NO: 1650077 - protein, 25 aa, Staphylococcus aureus
VDYLNRYRILQSLQLLDRHYKHYEI

SEQ ID NO: 1650078 - protein, 17 aa, Staphylococcus aureus
VEELGGLAVIGTERHES

SEQ ID NO: 1650079 - protein, 20 aa, Staphylococcus aureus
VFFGSALANFGVQNFLNAYV

SEQ ID NO: 1650080 - protein, 19 aa, Staphylococcus aureus
VKHQYGHAFYDSASDQDIF

SEQ ID NO: 1650081 - protein, 21 aa, Staphylococcus aureus
VRRLYEGKVLAGFAGSVADAF

SEQ ID NO: 1650082 - protein, 18 aa, Staphylococcus aureus
VTIASVLVLNPEIIILDE

SEQ ID NO: 1650083 - protein, 26 aa, Staphylococcus aureus
VYMRLRRVGNKFSIKTWKFDHIKDPD

SEQ ID NO: 1650084 - protein, 34 aa, Staphylococcus aureus
WIHERTKFGIKPGVKRMEWMLAQFNNPQNNIKGI

SEQ ID NO: 1650085 - protein, 19 aa, Staphylococcus aureus
YGVDFGTGYALEFTGETIK

SEQ ID NO: 1650086 - protein, 21 aa, Staphylococcus aureus
YNLTYPQFLVLTILWDESPVN

SEQ ID NO: 1650087 - protein, 19 aa, Staphylococcus aureus
YVGLKTGRDGIHGATFASE

SEQ ID NO: 1650088 - protein, 21 aa, Staphylococcus aureus
AEQHYAPVLTHFLDPRGQYIL

SEQ ID NO: 1650089 - protein, 17 aa, Staphylococcus aureus
AETGMHFTITVKNGLTL

SEQ ID NO: 1650090 - protein, 17 aa, Staphylococcus aureus
AEVVIEVNIFDFEDNIY

SEQ ID NO: 1650091 - protein, 30 aa, Staphylococcus aureus
AKEQTALRKAYLESFRKGFKQQIENTKVID

SEQ ID NO: 1650092 - protein, 18 aa, Staphylococcus aureus
AKPPKLVTREMVKSMKKG

SEQ ID NO: 1650093 - protein, 25 aa, Staphylococcus aureus
AMGRDCGDLALWAGLSVGAETIVVP

SEQ ID NO: 1650094 - protein, 25 aa, Staphylococcus aureus
ASITNFKASKTFPLQQLSQDDVFAQ

SEQ ID NO: 1650095 - protein, 20 aa, Staphylococcus aureus
CEEDLQIFYSFIVLQNNEVY

SEQ ID NO: 1650096 - protein, 21 aa, Staphylococcus aureus
CYHYRRNNLKGAYKSFNKSKE

SEQ ID NO: 1650097 - protein, 26 aa, Staphylococcus aureus
DDQFRMIIKQLYFFSVANPNPTNWLD

SEQ ID NO: 1650098 - protein, 17 aa, Staphylococcus aureus
DEWHEFIAPNIRSKSTY

SEQ ID NO: 1650099 - protein, 30 aa, Staphylococcus aureus
DFSSYINQFEWRDAKFPVVQNVNAQGETDK

SEQ ID NO: 1650100 - protein, 21 aa, Staphylococcus aureus
DNIMRMLHPFMPFVTEKIWQS

SEQ ID NO: 1650101 - protein, 24 aa, Staphylococcus aureus
DQRREMIRQAAFKLVENIKNDLKP

SEQ ID NO: 1650102 - protein, 22 aa, Staphylococcus aureus
ECMACGYQSPKWMGKCPNCGAW

SEQ ID NO: 1650103 - protein, 24 aa, Staphylococcus aureus
EDVKRYGLNITEFAVLELLYNKGP

SEQ ID NO: 1650104 - protein, 17 aa, Staphylococcus aureus
EEFKAHLPVNENTPKLT

SEQ ID NO: 1650105 - protein, 24 aa, Staphylococcus aureus
EGKLKVSFDYIDWINTEFDQLGRE

SEQ ID NO: 1650106 - protein, 18 aa, Staphylococcus aureus
EKEMALNWGKKNNVEVTT

SEQ ID NO: 1650107 - protein, 26 aa, Staphylococcus aureus
EKSAQFYKALGFKINRNPQMLDKMVG

SEQ ID NO: 1650108 - protein, 18 aa, Staphylococcus aureus
ELEGKLHGMALRVPTKNV

SEQ ID NO: 1650109 - protein, 17 aa, Staphylococcus aureus
ESGCGKSTLGKVIIRLE

SEQ ID NO: 1650110 - protein, 20 aa, Staphylococcus aureus
EVACLNKHLHFHGTTDEFKS

SEQ ID NO: 1650111 - protein, 25 aa, Staphylococcus aureus
EVVRKSALERYEFTGDITYLNKGET

SEQ ID NO: 1650112 - protein, 18 aa, Staphylococcus aureus
FENQLPWHLPNDLKHVKK

SEQ ID NO: 1650113 - protein, 23 aa, Staphylococcus aureus
FETNKWINAYECYFKNMLGLKCE

SEQ ID NO: 1650114 - protein, 21 aa, Staphylococcus aureus
FIKSNRLKGLSLKDVELSVLK

SEQ ID NO: 1650115 - protein, 17 aa, Staphylococcus aureus
FSGLKSAVINQLHNQRQ

SEQ ID NO: 1650116 - protein, 19 aa, Staphylococcus aureus
FSRQRYWGEPIPVIHWEDG

SEQ ID NO: 1650117 - protein, 23 aa, Staphylococcus aureus
GIALSTDEKVLWVTETTANRLHR

SEQ ID NO: 1650118 - protein, 24 aa, Staphylococcus aureus
GKFYQRPASIIAIYSAKYNGYKWM

SEQ ID NO: 1650119 - protein, 17 aa, Staphylococcus aureus
GLESVQYACRMIQAGAG

SEQ ID NO: 1650120 - protein, 17 aa, Staphylococcus aureus
GNTYFDEHWLFYDLINK

SEQ ID NO: 1650121 - protein, 22 aa, Staphylococcus aureus
GYPMPSVGLGVYKISDEDMTKV

SEQ ID NO: 1650122 - protein, 24 aa, Staphylococcus aureus
GYSQHFPSVFALIGSHSEYDLHHP

SEQ ID NO: 1650123 - protein, 24 aa, Staphylococcus aureus
IDALYQFLFEFIFDIEERYIRMYV

SEQ ID NO: 1650124 - protein, 17 aa, Staphylococcus aureus
IEDVKRQLREVIERKVS

SEQ ID NO: 1650125 - protein, 17 aa, Staphylococcus aureus
IELNRQGKTIIMITHDM

SEQ ID NO: 1650126 - protein, 20 aa, Staphylococcus aureus
IGGWTYPEGIQVIGVTTVHE

SEQ ID NO: 1650127 - protein, 26 aa, Staphylococcus aureus
IKDAELRGVASSGMICSMKELNLPNA

SEQ ID NO: 1650128 - protein, 26 aa, Staphylococcus aureus
INKRRVKEWLKRTARKYGLEADDVVL

SEQ ID NO: 1650129 - protein, 18 aa, Staphylococcus aureus
IQAGLGRSGKLFATDWDN

SEQ ID NO: 1650130 - protein, 19 aa, Staphylococcus aureus
IQQQISYWLERFDITENRK

SEQ ID NO: 1650131 - protein, 20 aa, Staphylococcus aureus
IWKKEIWEDGSKWQGHQKGN

SEQ ID NO: 1650132 - protein, 18 aa, Staphylococcus aureus
IYGGPLALGLIRNKLEEH

SEQ ID NO: 1650133 - protein, 23 aa, Staphylococcus aureus
KDIPRNEIHFSYTHIAFTIDDSE

SEQ ID NO: 1650134 - protein, 22 aa, Staphylococcus aureus
KKKAAEKIGMISEIVHLEETAT

SEQ ID NO: 1650135 - protein, 17 aa, Staphylococcus aureus
KTGALLGKYNINIASMT

SEQ ID NO: 1650136 - protein, 21 aa, Staphylococcus aureus
KVDEAYNFLKQVSEDGGQVLF

SEQ ID NO: 1650137 - protein, 20 aa, Staphylococcus aureus
LAKGRPLFEAVHKAKKFISM

SEQ ID NO: 1650138 - protein, 17 aa, Staphylococcus aureus
LEKGFNIKGIKQIIYDS

SEQ ID NO: 1650139 - protein, 18 aa, Staphylococcus aureus
LELIDAIPEDENVTLYSQ

SEQ ID NO: 1650140 - protein, 18 aa, Staphylococcus aureus
LGGILIHRTPILILDEPL

SEQ ID NO: 1650141 - protein, 20 aa, Staphylococcus aureus
LRDWLFSRQRYWGEPIPVIH

SEQ ID NO: 1650142 - protein, 20 aa, Staphylococcus aureus
MFPYPSGAGLHVGHPEGYTA

SEQ ID NO: 1650143 - protein, 22 aa, Staphylococcus aureus
MGKCPNCGAWNQMEEIVEKAAN

SEQ ID NO: 1650144 - protein, 21 aa, Staphylococcus aureus
NDSIKAIILSFAYDKNKFKVI

SEQ ID NO: 1650145 - protein, 20 aa, Staphylococcus aureus
NEAQTLFFGGLARIDYVSGG

SEQ ID NO: 1650146 - protein, 17 aa, Staphylococcus aureus
NLTRVDLAFSRDQEHKE

SEQ ID NO: 1650147 - protein, 23 aa, Staphylococcus aureus
NQRSALYIKHLTAFIDQLISLEV

SEQ ID NO: 1650148 - protein, 22 aa, Staphylococcus aureus
NRNELGIALGKGERVNVGITDP

SEQ ID NO: 1650149 - protein, 22 aa, Staphylococcus aureus
NVPDYFKALVAIGTIADLVSLT

SEQ ID NO: 1650150 - protein, 24 aa, Staphylococcus aureus
PFSPREVVLRVKALLRRTQSTTVE

SEQ ID NO: 1650151 - protein, 25 aa, Staphylococcus aureus
PNFKFPMKQDIPVIMIGPGTGIAPF

SEQ ID NO: 1650152 - protein, 20 aa, Staphylococcus aureus
PQAYQILGIGPVELRVRNAA

SEQ ID NO: 1650153 - protein, 23 aa, Staphylococcus aureus
PTTSQPAIGEWITKYEMLRDQGY

SEQ ID NO: 1650154 - protein, 19 aa, Staphylococcus aureus
PTVSQGFYGAMFKDLDGHH

SEQ ID NO: 1650155 - protein, 18 aa, Staphylococcus aureus
QGILRTLFDSEKFEAIRE

SEQ ID NO: 1650156 - protein, 28 aa, Staphylococcus aureus
QHDIDYCIVVNFSSRFANVSVEDFVENY

SEQ ID NO: 1650157 - protein, 20 aa, Staphylococcus aureus
QLHSIFLEVIIAPKFTDEAL

SEQ ID NO: 1650158 - protein, 17 aa, Staphylococcus aureus
QPPMKGKQILGVDPAFR

SEQ ID NO: 1650159 - protein, 19 aa, Staphylococcus aureus
QVQFVGFVGEHSRYDLMLV

SEQ ID NO: 1650160 - protein, 20 aa, Staphylococcus aureus
QYCKHEFVLSGVRQKEFGVR

SEQ ID NO: 1650161 - protein, 17 aa, Staphylococcus aureus
RAFDMDVLYTGPNRKEE

SEQ ID NO: 1650162 - protein, 18 aa, Staphylococcus aureus
RCQDGIVLFWPIDGEIEL

SEQ ID NO: 1650163 - protein, 24 aa, Staphylococcus aureus
RDNHSAYAFIKRLIKQFGKPQKVI

SEQ ID NO: 1650164 - protein, 19 aa, Staphylococcus aureus
RIFCMTLGTGIGGAYKNNQ

SEQ ID NO: 1650165 - protein, 18 aa, Staphylococcus aureus
RIIFATFASNIYRVQQAV

SEQ ID NO: 1650166 - protein, 21 aa, Staphylococcus aureus
RLVKKGGIDQIVIESTGISEP

SEQ ID NO: 1650167 - protein, 18 aa, Staphylococcus aureus
RMICSSGNVDSNRLRTGT

SEQ ID NO: 1650168 - protein, 24 aa, Staphylococcus aureus
RNVHKSVLHALDISQQEGHFIETH

SEQ ID NO: 1650169 - protein, 20 aa, Staphylococcus aureus
RQGYGEVHHVSFRVKDHDAI

SEQ ID NO: 1650170 - protein, 23 aa, Staphylococcus aureus
RSAFYKYRETIFPVDDKMLDHRE

SEQ ID NO: 1650171 - protein, 25 aa, Staphylococcus aureus
RTVGIAISDIMGWTAQGLDTLRINE

SEQ ID NO: 1650172 - protein, 22 aa, Staphylococcus aureus
SIPLYEESYILLAPKETFKNQN

SEQ ID NO: 1650173 - protein, 25 aa, Staphylococcus aureus
SREKLKEYMEIISKYQVRTVTFADT

SEQ ID NO: 1650174 - protein, 25 aa, Staphylococcus aureus
TCGCAAGLARPAAVAVATQNEHRPT

SEQ ID NO: 1650175 - protein, 18 aa, Staphylococcus aureus
TDAIESPGVFSIKENDSI

SEQ ID NO: 1650176 - protein, 28 aa, Staphylococcus aureus
TDEVKIKVLQRLSIASGHVGMVGGQMLD

SEQ ID NO: 1650177 - protein, 25 aa, Staphylococcus aureus
TELNKRKSAVMSYEITSTDLEVTYP

SEQ ID NO: 1650178 - protein, 21 aa, Staphylococcus aureus
TLRMNYLFDFYQSLLTNKQRN

SEQ ID NO: 1650179 - protein, 19 aa, Staphylococcus aureus
TNAKFDVFEMVDGKYEIRE

SEQ ID NO: 1650180 - protein, 31 aa, Staphylococcus aureus
TYEAVEMSRKFGIEVFNVFLSQDPITEDVEQ

SEQ ID NO: 1650181 - protein, 25 aa, Staphylococcus aureus
VDVGQRGFVPASLISTDFIEDFSVF

SEQ ID NO: 1650182 - protein, 19 aa, Staphylococcus aureus
VHLVKAKRQGQSMIYSLDD

SEQ ID NO: 1650183 - protein, 18 aa, Staphylococcus aureus
VLKALNLTFEDIAYQKDK

SEQ ID NO: 1650184 - protein, 19 aa, Staphylococcus aureus
VNWHHFLRPEIKFDGIDPL

SEQ ID NO: 1650185 - protein, 20 aa, Staphylococcus aureus
VPSTISGTITEILVEAGQTV

SEQ ID NO: 1650186 - protein, 23 aa, Staphylococcus aureus
VSNERAKTLLGWEPIATQEEAIL

SEQ ID NO: 1650187 - protein, 28 aa, Staphylococcus aureus
VSRSHPGLLKRLFEQEVPEIYDGTVIVK

SEQ ID NO: 1650188 - protein, 19 aa, Staphylococcus aureus
YAKELNLKSKEIIDELKSM

SEQ ID NO: 1650189 - protein, 18 aa, Staphylococcus aureus
YALLFALSSGRTFIGQTT

SEQ ID NO: 1650190 - protein, 25 aa, Staphylococcus aureus
YNEARWILIDLADVVVHVFHKDERN

SEQ ID NO: 1650191 - protein, 25 aa, Staphylococcus aureus
YNEIHMWDYKALPAVFGGKNVEIHD

SEQ ID NO: 1650192 - protein, 24 aa, Staphylococcus aureus
AERIKPGDIVPIYLKKNPNFKFPM

SEQ ID NO: 1650193 - protein, 17 aa, Staphylococcus aureus
AGDRFVVFSDEKQARRI

SEQ ID NO: 1650194 - protein, 22 aa, Staphylococcus aureus
AGGCFWCMTKPFDTFDGIEKVT

SEQ ID NO: 1650195 - protein, 21 aa, Staphylococcus aureus
AKIMALMGLELITNQDVYQDI

SEQ ID NO: 1650196 - protein, 26 aa, Staphylococcus aureus
AKYNGYKWMEMNGLGSFNTEILPKPK

SEQ ID NO: 1650197 - protein, 17 aa, Staphylococcus aureus
ASGGVRNLEDFNKMVEA

SEQ ID NO: 1650198 - protein, 26 aa, Staphylococcus aureus
CLLTEARIFKFYKYFYSHRGPLLDYF

SEQ ID NO: 1650199 - protein, 17 aa, Staphylococcus aureus
CLNFYELIQSLIKEQEF

SEQ ID NO: 1650200 - protein, 26 aa, Staphylococcus aureus
CNEKFKKELLSAGIIDDAWLAEIEAE

SEQ ID NO: 1650201 - protein, 23 aa, Staphylococcus aureus
DAVQIVPLIIKYASELKLYGKTL

SEQ ID NO: 1650202 - protein, 19 aa, Staphylococcus aureus
DIIEYFRPGDTLVLNDTRV

SEQ ID NO: 1650203 - protein, 25 aa, Staphylococcus aureus
DNITICGMGGPLIAKILKDGQDKLS

SEQ ID NO: 1650204 - protein, 23 aa, Staphylococcus aureus
EALKKKLTEEGCFDKANKKSIPK

SEQ ID NO: 1650205 - protein, 17 aa, Staphylococcus aureus
EALSLLDKVGLKEKADV

SEQ ID NO: 1650206 - protein, 17 aa, Staphylococcus aureus
EEFFWSMMDEINEEEDF

SEQ ID NO: 1650207 - protein, 23 aa, Staphylococcus aureus
EEVWLADKRVELVTRHIINNHDK

SEQ ID NO: 1650208 - protein, 19 aa, Staphylococcus aureus
EQLVGFAFVNTTPFQRIKH

SEQ ID NO: 1650209 - protein, 17 aa, Staphylococcus aureus
FFVLIGPSGCGKTTTLK

SEQ ID NO: 1650210 - protein, 25 aa, Staphylococcus aureus
FGNTKTIWVWTGFLYEYLANDCTER

SEQ ID NO: 1650211 - protein, 17 aa, Staphylococcus aureus
FLLALYNVFIEKDCSIV

SEQ ID NO: 1650212 - protein, 20 aa, Staphylococcus aureus
FVGEHSRYDLMLVHTNRHYG

SEQ ID NO: 1650213 - protein, 17 aa, Staphylococcus aureus
FVHKPQIIFADEPTGAL

SEQ ID NO: 1650214 - protein, 25 aa, Staphylococcus aureus
GAERICKRVDCDIDYEEDAEKWMAD

SEQ ID NO: 1650215 - protein, 17 aa, Staphylococcus aureus
GALRATLDYVTERKQFG

SEQ ID NO: 1650216 - protein, 17 aa, Staphylococcus aureus
GHMGKISPFDILSVVSA

SEQ ID NO: 1650217 - protein, 20 aa, Staphylococcus aureus
GKSLAYLLAALMYNIETGKH

SEQ ID NO: 1650218 - protein, 20 aa, Staphylococcus aureus
GKSTLLKALSRLLAVKEGEV

SEQ ID NO: 1650219 - protein, 17 aa, Staphylococcus aureus
GPWHIHRMLEAAEGLPI

SEQ ID NO: 1650220 - protein, 17 aa, Staphylococcus aureus
GRKCIYVQPHSYTIENQ

SEQ ID NO: 1650221 - protein, 20 aa, Staphylococcus aureus
GYQQCPFKHYASHGLKLNER

SEQ ID NO: 1650222 - protein, 28 aa, Staphylococcus aureus
HIHRMLEAAEGLPINVGFTGKGQATNPT

SEQ ID NO: 1650223 - protein, 18 aa, Staphylococcus aureus
IDETKLNFLWVTDWPLLE

SEQ ID NO: 1650224 - protein, 21 aa, Staphylococcus aureus
IEENKYVFVLKHSETCPISAN

SEQ ID NO: 1650225 - protein, 17 aa, Staphylococcus aureus
IGNVTINGFPNVEKRPK

SEQ ID NO: 1650226 - protein, 23 aa, Staphylococcus aureus
IKVHYAGICGTDIHTYEGHYKVN

SEQ ID NO: 1650227 - protein, 19 aa, Staphylococcus aureus
IMFPLEIAGVPRRRAKQKA

SEQ ID NO: 1650228 - protein, 17 aa, Staphylococcus aureus
INLALRAQYLFESNVDY

SEQ ID NO: 1650229 - protein, 19 aa, Staphylococcus aureus
IPSVILGVGYEKIHTTNER

SEQ ID NO: 1650230 - protein, 20 aa, Staphylococcus aureus
IRVLFDEGFIALRPSGTEPK

SEQ ID NO: 1650231 - protein, 20 aa, Staphylococcus aureus
KDELREFIEMAKIPVIHSLP

SEQ ID NO: 1650232 - protein, 32 aa, Staphylococcus aureus
KEMGRPAQCVFLSWNRYLYRNAQNYITSSDYI

SEQ ID NO: 1650233 - protein, 22 aa, Staphylococcus aureus
KHLDIPAGAAVRFEPGDKKEVQ

SEQ ID NO: 1650234 - protein, 18 aa, Staphylococcus aureus
KIDFERLARYCEKHNAVV

SEQ ID NO: 1650235 - protein, 17 aa, Staphylococcus aureus
KIYAHYGKNGGYQIQQA

SEQ ID NO: 1650236 - protein, 18 aa, Staphylococcus aureus
KKAETLLTREEYAQCEDM

SEQ ID NO: 1650237 - protein, 26 aa, Staphylococcus aureus
KNNVKEVIAGFDFTFGKFGKGNMTVL

SEQ ID NO: 1650238 - protein, 24 aa, Staphylococcus aureus
KNSLFKGKEIEYGKDLVGLTRKID

SEQ ID NO: 1650239 - protein, 19 aa, Staphylococcus aureus
KSMSESKCYKNRQVFPQDT

SEQ ID NO: 1650240 - protein, 24 aa, Staphylococcus aureus
KYRFNRLKLTTIHNGIADVPAVKQ

SEQ ID NO: 1650241 - protein, 21 aa, Staphylococcus aureus
LALRAQYLFESNVDYFVYNGD

SEQ ID NO: 1650242 - protein, 21 aa, Staphylococcus aureus
LEAYPSIEIVMWDERLSTMAA

SEQ ID NO: 1650243 - protein, 27 aa, Staphylococcus aureus
LGYPFIVKTRFGGYDGKGQVLINNEKD

SEQ ID NO: 1650244 - protein, 19 aa, Staphylococcus aureus
LKSGEGIKALLKPLDLDEN

SEQ ID NO: 1650245 - protein, 19 aa, Staphylococcus aureus
LMVNYCLQAADILAADGIN

SEQ ID NO: 1650246 - protein, 24 aa, Staphylococcus aureus
LPNRTKLLGVGLWLVPKPVRNFGY

SEQ ID NO: 1650247 - protein, 18 aa, Staphylococcus aureus
LRQEIQMIFQDPFASINP

SEQ ID NO: 1650248 - protein, 19 aa, Staphylococcus aureus
LRRYNDVSPFELFVISCPL

SEQ ID NO: 1650249 - protein, 20 aa, Staphylococcus aureus
MHNRMRMVVSQFLTKDLFID

SEQ ID NO: 1650250 - protein, 19 aa, Staphylococcus aureus
MKSKTIQVVVEFKEVPMNL

SEQ ID NO: 1650251 - protein, 17 aa, Staphylococcus aureus
MREMLRSYLESMSQDFN

SEQ ID NO: 1650252 - protein, 17 aa, Staphylococcus aureus
MSRRKKTAAKKLLEVSN

SEQ ID NO: 1650253 - protein, 17 aa, Staphylococcus aureus
MVQDLGVDVIVTDHHEI

SEQ ID NO: 1650254 - protein, 18 aa, Staphylococcus aureus
NEWKMTAKELNYFINELV

SEQ ID NO: 1650255 - protein, 18 aa, Staphylococcus aureus
NMALEAFKATDCSGLVRA

SEQ ID NO: 1650256 - protein, 18 aa, Staphylococcus aureus
PIAGRRILLKEVRDSIFR

SEQ ID NO: 1650257 - protein, 24 aa, Staphylococcus aureus
PKQQLPYFISFLSFHQYSIFQVLS

SEQ ID NO: 1650258 - protein, 19 aa, Staphylococcus aureus
PLMRRDLDVLIAKLNQIDG

SEQ ID NO: 1650259 - protein, 21 aa, Staphylococcus aureus
PLPNRRNVVLTSDTSFNVEGV

SEQ ID NO: 1650260 - protein, 19 aa, Staphylococcus aureus
PLTDKRISPINGTIEGLPP

SEQ ID NO: 1650261 - protein, 21 aa, Staphylococcus aureus
PMLDILKKLDVHNACVVVTRY

SEQ ID NO: 1650262 - protein, 25 aa, Staphylococcus aureus
PYYQLCKAKGLLSIIDNTFLTPYLS

SEQ ID NO: 1650263 - protein, 17 aa, Staphylococcus aureus
QQQRTAAARAFVHKPQI

SEQ ID NO: 1650264 - protein, 25 aa, Staphylococcus aureus
QYITEDVAMAFGFFDGMHKGHDKVF

SEQ ID NO: 1650265 - protein, 23 aa, Staphylococcus aureus
RCNFRCDYCMPKEVFGDDFVFLP

SEQ ID NO: 1650266 - protein, 22 aa, Staphylococcus aureus
RDVSKRVLSHILGVELPNPSMI

SEQ ID NO: 1650267 - protein, 18 aa, Staphylococcus aureus
RKEVMKYINKESADIDKE

SEQ ID NO: 1650268 - protein, 20 aa, Staphylococcus aureus
RRPVHLHLPIDVAISEIEIP

SEQ ID NO: 1650269 - protein, 17 aa, Staphylococcus aureus
RVCPAPCESACVMKINR

SEQ ID NO: 1650270 - protein, 19 aa, Staphylococcus aureus
SESGYKIFVHESERKAEPR

SEQ ID NO: 1650271 - protein, 21 aa, Staphylococcus aureus
SIPKFPKKIAVLTASTGAAIR

SEQ ID NO: 1650272 - protein, 19 aa, Staphylococcus aureus
SKEILPYLYKGLRDKSPAV

SEQ ID NO: 1650273 - protein, 18 aa, Staphylococcus aureus
TALMLFVQRCKDMQDAGQ

SEQ ID NO: 1650274 - protein, 32 aa, Staphylococcus aureus
TDIEYKFPFGWGELWGIASRTDFDLRKHAEHS

SEQ ID NO: 1650275 - protein, 22 aa, Staphylococcus aureus
THFLDPRGQYILEVICGSYEDL

SEQ ID NO: 1650276 - protein, 23 aa, Staphylococcus aureus
TQDRVFRSLGILQNCRMITMEEA

SEQ ID NO: 1650277 - protein, 22 aa, Staphylococcus aureus
TRKLLEALILVGAFDAFGKTRS

SEQ ID NO: 1650278 - protein, 17 aa, Staphylococcus aureus
VDLAFSRDQEHKEYVQH

SEQ ID NO: 1650279 - protein, 17 aa, Staphylococcus aureus
VEKARRLAFQTEDMKRQ

SEQ ID NO: 1650280 - protein, 17 aa, Staphylococcus aureus
VYRGMGSLGAMEKGSND

SEQ ID NO: 1650281 - protein, 17 aa, Staphylococcus aureus
YKAIQLFKNNSKNKQSI

SEQ ID NO: 1650282 - protein, 21 aa, Staphylococcus aureus
YKESFEYRSLEKLAEVEQTQM

SEQ ID NO: 1650283 - protein, 19 aa, Staphylococcus aureus
YKVSWLLNDVDYCHNKVKF

SEQ ID NO: 1650284 - protein, 18 aa, Staphylococcus aureus
YKYFYSHRGPLLDYFDAK

SEQ ID NO: 1650285 - protein, 18 aa, Staphylococcus aureus
YLIEKSMDNKEVKRWEDK

SEQ ID NO: 1650286 - protein, 25 aa, Staphylococcus aureus
YQYFKKNQIIWGFLHLASSKEIVEK

SEQ ID NO: 1650287 - protein, 25 aa, Staphylococcus aureus
YYLFYLKNWNYAYAYSLKLIDAYAS

SEQ ID NO: 1650288 - protein, 19 aa, Staphylococcus aureus
YYRYLSRRIGAIVETTLSA

SEQ ID NO: 1650289 - protein, 24 aa, Staphylococcus aureus
AGQPVELCGTYVLLASEESSYTTG

SEQ ID NO: 1650290 - protein, 25 aa, Staphylococcus aureus
ALEVIPGKMSLVIADIMDETTTKDK

SEQ ID NO: 1650291 - protein, 27 aa, Staphylococcus aureus
ALPFNSRKLILRRAAQFLTYGDTISIG

SEQ ID NO: 1650292 - protein, 29 aa, Staphylococcus aureus
AQQHIAGFWQRCYQEGVIADLQLKNNGDL

SEQ ID NO: 1650293 - protein, 25 aa, Staphylococcus aureus
ASFESRSFLFKAIFNITKLLHIKRS

SEQ ID NO: 1650294 - protein, 19 aa, Staphylococcus aureus
AYQHLKSGEGIKALLKPLD

SEQ ID NO: 1650295 - protein, 17 aa, Staphylococcus aureus
CRFGTQYTTRLGIRLEK

SEQ ID NO: 1650296 - protein, 23 aa, Staphylococcus aureus
DDQNSAWMTTHFDFHSIHDNVLK

SEQ ID NO: 1650297 - protein, 23 aa, Staphylococcus aureus
DDYMKHIQNMIGYIPKSDLQVVF

SEQ ID NO: 1650298 - protein, 18 aa, Staphylococcus aureus
DGWYSLHLFYAVDWASLR

SEQ ID NO: 1650299 - protein, 23 aa, Staphylococcus aureus
DGYKFAQDLGHTITELFPTEVPI

SEQ ID NO: 1650300 - protein, 24 aa, Staphylococcus aureus
DPASLHKPKAFFGAARNIEAGGSL

SEQ ID NO: 1650301 - protein, 22 aa, Staphylococcus aureus
DSLIEGFIHWIKDEKIDWPGED

SEQ ID NO: 1650302 - protein, 18 aa, Staphylococcus aureus
EALYPPSYSSYIDFLYTC

SEQ ID NO: 1650303 - protein, 24 aa, Staphylococcus aureus
EHARDMLKRERLFFDKMQAHIGEV

SEQ ID NO: 1650304 - protein, 19 aa, Staphylococcus aureus
EINAYIPGIGHNLQEHSVV

SEQ ID NO: 1650305 - protein, 17 aa, Staphylococcus aureus
ENEAAYFTNDWTNKDID

SEQ ID NO: 1650306 - protein, 17 aa, Staphylococcus aureus
FNSLASFNTNINIIPME

SEQ ID NO: 1650307 - protein, 20 aa, Staphylococcus aureus
GEIKRVIAHLPNFESDTDTF

SEQ ID NO: 1650308 - protein, 21 aa, Staphylococcus aureus
GLKKMGYKVSWLLNDVDYCHN

SEQ ID NO: 1650309 - protein, 22 aa, Staphylococcus aureus
GSDRRSIACLTYSGHYIITPDN

SEQ ID NO: 1650310 - protein, 24 aa, Staphylococcus aureus
GSEAAYQLAERGIKVNLIEMRPVK

SEQ ID NO: 1650311 - protein, 20 aa, Staphylococcus aureus
HKEGKWTGMCGEMAGDETAI

SEQ ID NO: 1650312 - protein, 25 aa, Staphylococcus aureus
HVLIFRTKDVFPWRQHDVKLVFFLA

SEQ ID NO: 1650313 - protein, 18 aa, Staphylococcus aureus
ILLCDEATSALDPATTAS

SEQ ID NO: 1650314 - protein, 18 aa, Staphylococcus aureus
IRGLSPWPVAYTTMDDTN

SEQ ID NO: 1650315 - protein, 20 aa, Staphylococcus aureus
KIAISFREDDELIAVRLTSG

SEQ ID NO: 1650316 - protein, 18 aa, Staphylococcus aureus
KPHIVFMMTFPEDIKPII

SEQ ID NO: 1650317 - protein, 40 aa, Staphylococcus aureus
KRQSKVFRSRFRMLVEAQLDLLKNEDWDYLLNYDLDAEQV

SEQ ID NO: 1650318 - protein, 19 aa, Staphylococcus aureus
KVAELLLERAKRLVEIGED

SEQ ID NO: 1650319 - protein, 22 aa, Staphylococcus aureus
LDYRSKRKSLPFTENDENIVVL

SEQ ID NO: 1650320 - protein, 24 aa, Staphylococcus aureus
LETLARSKVDGIVLMATDITERHI

SEQ ID NO: 1650321 - protein, 22 aa, Staphylococcus aureus
LKRAGLDYWEFVNITYHDSIEA

SEQ ID NO: 1650322 - protein, 19 aa, Staphylococcus aureus
LNAFNLYGALSMANSGPNT

SEQ ID NO: 1650323 - protein, 19 aa, Staphylococcus aureus
LYDTLLMNYNFVIIDTPPV

SEQ ID NO: 1650324 - protein, 26 aa, Staphylococcus aureus
LYLSSDWFAELGFTFFNYHYTAKLIK

SEQ ID NO: 1650325 - protein, 28 aa, Staphylococcus aureus
NAKMPSQLFQFFMSYLLARFDISLATLL

SEQ ID NO: 1650326 - protein, 20 aa, Staphylococcus aureus
NCIYCYNYVIWLIQHDLPRN

SEQ ID NO: 1650327 - protein, 34 aa, Staphylococcus aureus
NHDVDMLRMCRYPWKTKQRILGDMGHVSNEDAGH

SEQ ID NO: 1650328 - protein, 28 aa, Staphylococcus aureus
NLPAEESYFLFYINRPSIIVGKNQNTIE

SEQ ID NO: 1650329 - protein, 23 aa, Staphylococcus aureus
NSMNCLMEVLGLALPYNGTALAV

SEQ ID NO: 1650330 - protein, 19 aa, Staphylococcus aureus
PHEIISIGDTVRVKHRDFN

SEQ ID NO: 1650331 - protein, 19 aa, Staphylococcus aureus
PHGVLFRGAAEGVIRRYLI

SEQ ID NO: 1650332 - protein, 28 aa, Staphylococcus aureus
PRFKVIDVIKRPLIIHGKVKDNDDIIKT

SEQ ID NO: 1650333 - protein, 23 aa, Staphylococcus aureus
QHKVWRKRVMKDMGVRKGTKALD

SEQ ID NO: 1650334 - protein, 24 aa, Staphylococcus aureus
QHLPFKKERISEVELHQYIDGLID

SEQ ID NO: 1650335 - protein, 24 aa, Staphylococcus aureus
QYRFNIMLEDIKAYLPKEKIWDVF

SEQ ID NO: 1650336 - protein, 26 aa, Staphylococcus aureus
RCAEEGIKFIGPHLEHLDMFGDKVKA

SEQ ID NO: 1650337 - protein, 18 aa, Staphylococcus aureus
RLRTGTMTEEDWSRFTIA

SEQ ID NO: 1650338 - protein, 20 aa, Staphylococcus aureus
RRFEIKRGDKVTGKVRKPKD

SEQ ID NO: 1650339 - protein, 18 aa, Staphylococcus aureus
RSWNGLIINYLSRCNDCS

SEQ ID NO: 1650340 - protein, 21 aa, Staphylococcus aureus
RTALIEKCWESENFIDDNTLA

SEQ ID NO: 1650341 - protein, 27 aa, Staphylococcus aureus
RVYLAVGGGFELDAWLGSNSTDFNVKI

SEQ ID NO: 1650342 - protein, 23 aa, Staphylococcus aureus
SDDDIFMINRFVSAVEREIGYRL

SEQ ID NO: 1650343 - protein, 18 aa, Staphylococcus aureus
SIIDGCRLSKAKIIRVNH

SEQ ID NO: 1650344 - protein, 19 aa, Staphylococcus aureus
SRYDLMLVHTNRHYGKTLV

SEQ ID NO: 1650345 - protein, 18 aa, Staphylococcus aureus
SSICKHLSIQLSENEGDI

SEQ ID NO: 1650346 - protein, 17 aa, Staphylococcus aureus
TDFMFFMSVVMTLLSRY

SEQ ID NO: 1650347 - protein, 32 aa, Staphylococcus aureus
TFGTAGIRGKFGLGEGRLNKFTIEKLALGLAR

SEQ ID NO: 1650348 - protein, 27 aa, Staphylococcus aureus
TGTMTEEDWSRFTIAVGKLSRTKIFID

SEQ ID NO: 1650349 - protein, 24 aa, Staphylococcus aureus
TLKGIECIYALYKKNRRSLQIYGF

SEQ ID NO: 1650350 - protein, 22 aa, Staphylococcus aureus
TRTELPFLVKCVQTAVDAGATV

SEQ ID NO: 1650351 - protein, 22 aa, Staphylococcus aureus
TWNLKYKQLKNINIDIPVLEEQ

SEQ ID NO: 1650352 - protein, 17 aa, Staphylococcus aureus
VDAPSYWYKNINYQHDL

SEQ ID NO: 1650353 - protein, 19 aa, Staphylococcus aureus
VGDSIRLGDTNLFAQIEKD

SEQ ID NO: 1650354 - protein, 24 aa, Staphylococcus aureus
VGGTTCKLGIFTPELEQLHKWSIH

SEQ ID NO: 1650355 - protein, 18 aa, Staphylococcus aureus
VKDAWYKQIEDLLEFAKK

SEQ ID NO: 1650356 - protein, 19 aa, Staphylococcus aureus
YDFDILVVALGFVSETFGI

SEQ ID NO: 1650357 - protein, 19 aa, Staphylococcus aureus
YFLCHDILEDAWKAENNYS

SEQ ID NO: 1650358 - protein, 18 aa, Staphylococcus aureus
YINEHGGMIIYLPQEGRG

SEQ ID NO: 1650359 - protein, 21 aa, Staphylococcus aureus
AAVRAVVRTAIYNEIEVYGVY

SEQ ID NO: 1650360 - protein, 20 aa, Staphylococcus aureus
DELQFIFFKMQKFNPEYVKL

SEQ ID NO: 1650361 - protein, 29 aa, Staphylococcus aureus
DESAKKYLWRVLVTQLKKLELNYDVYLER

SEQ ID NO: 1650362 - protein, 21 aa, Staphylococcus aureus
DFQDALGLSSADSFRDLIKVL

SEQ ID NO: 1650363 - protein, 26 aa, Staphylococcus aureus
DQHMRSRLAGYKVPRMYVPVTHMPLN

SEQ ID NO: 1650364 - protein, 18 aa, Staphylococcus aureus
DSYLEWLNQGITKESITT

SEQ ID NO: 1650365 - protein, 18 aa, Staphylococcus aureus
EATEKGFKCPNCGNDNPK

SEQ ID NO: 1650366 - protein, 17 aa, Staphylococcus aureus
EFERCINDLGFKGALIM

SEQ ID NO: 1650367 - protein, 21 aa, Staphylococcus aureus
EINLTRLSIFIFIINILNQLR

SEQ ID NO: 1650368 - protein, 26 aa, Staphylococcus aureus
EIREPCWKIQAKYNIPDLVKRMSTSG

SEQ ID NO: 1650369 - protein, 19 aa, Staphylococcus aureus
EKGFKCPNCGNDNPKTVDV

SEQ ID NO: 1650370 - protein, 21 aa, Staphylococcus aureus
ETIEYATPVSHFVKDELWDKG

SEQ ID NO: 1650371 - protein, 22 aa, Staphylococcus aureus
FEEFRPRIKAQIGGRRNGALIS

SEQ ID NO: 1650372 - protein, 19 aa, Staphylococcus aureus
FLIAKARYSRSIKGTKPIF

SEQ ID NO: 1650373 - protein, 20 aa, Staphylococcus aureus
FLSSLPVGGLGLDFVHDNGY

SEQ ID NO: 1650374 - protein, 26 aa, Staphylococcus aureus
FNKYWPADIHLMAKEIVRFHSIIWPI

SEQ ID NO: 1650375 - protein, 21 aa, Staphylococcus aureus
FPESFSTQIAHYYKNQPTITW

SEQ ID NO: 1650376 - protein, 18 aa, Staphylococcus aureus
FPKLQSIQLEDHKQHDVR

SEQ ID NO: 1650377 - protein, 19 aa, Staphylococcus aureus
GGLGLDFVHDNGYNLKQIE

SEQ ID NO: 1650378 - protein, 18 aa, Staphylococcus aureus
GKTFSKGLLMGARGNSGV

SEQ ID NO: 1650379 - protein, 23 aa, Staphylococcus aureus
GTYDICKPLTIYGNTTLLLDNET

SEQ ID NO: 1650380 - protein, 19 aa, Staphylococcus aureus
GVYICNECIELCSEIVEEE

SEQ ID NO: 1650381 - protein, 27 aa, Staphylococcus aureus
GYLPEALFNFIALLGWSPEGEEEIFSK

SEQ ID NO: 1650382 - protein, 25 aa, Staphylococcus aureus
HDGVRFKREHLSEAASHLTLKPMPE

SEQ ID NO: 1650383 - protein, 19 aa, Staphylococcus aureus
INNEFRFQILVKYKSEPGL

SEQ ID NO: 1650384 - protein, 20 aa, Staphylococcus aureus
IPGNGKFLYSPFSIFDNESI

SEQ ID NO: 1650385 - protein, 18 aa, Staphylococcus aureus
IPLYLGKTLSNVKGTWIM

SEQ ID NO: 1650386 - protein, 19 aa, Staphylococcus aureus
IRLKYRYLDLRRQELAQTF

SEQ ID NO: 1650387 - protein, 22 aa, Staphylococcus aureus
KADGKMLVIDGGFSKAYQSTTG

SEQ ID NO: 1650388 - protein, 24 aa, Staphylococcus aureus
KAQFSINLTDKWIIQIAYGKLIIM

SEQ ID NO: 1650389 - protein, 24 aa, Staphylococcus aureus
KCRPIEGWSTVAFAKDWQGPPRLQ

SEQ ID NO: 1650390 - protein, 20 aa, Staphylococcus aureus
KEIFRSMGVAVPEGRVAFTA

SEQ ID NO: 1650391 - protein, 20 aa, Staphylococcus aureus
KGKKVILLTAHRRENIGEPM

SEQ ID NO: 1650392 - protein, 18 aa, Staphylococcus aureus
KHVEHLSSYYKFKQPTLL

SEQ ID NO: 1650393 - protein, 20 aa, Staphylococcus aureus
KLALELYNSPWIAWYHQQMQ

SEQ ID NO: 1650394 - protein, 24 aa, Staphylococcus aureus
KRMTRIAQTINRFGYTIRGIYGEG

SEQ ID NO: 1650395 - protein, 22 aa, Staphylococcus aureus
KYNIPVKSILGFGDSGNDEAYL

SEQ ID NO: 1650396 - protein, 23 aa, Staphylococcus aureus
LALKEEGYRVILVNSNPATIMTD

SEQ ID NO: 1650397 - protein, 24 aa, Staphylococcus aureus
LDGDTRGGAALSIRSVTQKPIKFV

SEQ ID NO: 1650398 - protein, 27 aa, Staphylococcus aureus
LFGLGIRHLGVKASQVLAEKYETIDRL

SEQ ID NO: 1650399 - protein, 24 aa, Staphylococcus aureus
LFIGYKFKTHRMIHKFKINSQGLT

SEQ ID NO: 1650400 - protein, 18 aa, Staphylococcus aureus
LGADAIMLITPYYNKTNQ

SEQ ID NO: 1650401 - protein, 17 aa, Staphylococcus aureus
LGFPRLGRKREWKKAIE

SEQ ID NO: 1650402 - protein, 20 aa, Staphylococcus aureus
LIGAIIPRMNSYAVDETIKG

SEQ ID NO: 1650403 - protein, 18 aa, Staphylococcus aureus
LLEMIGLVAEVQELKANP

SEQ ID NO: 1650404 - protein, 18 aa, Staphylococcus aureus
LLKEAKKPVVLAGAGINQ

SEQ ID NO: 1650405 - protein, 18 aa, Staphylococcus aureus
LLLPELSGPFLSLSTIVN

SEQ ID NO: 1650406 - protein, 20 aa, Staphylococcus aureus
LSSYYKFKQPTLLYDQQIQR

SEQ ID NO: 1650407 - protein, 23 aa, Staphylococcus aureus
LWSHIRRGLVLPAIIPNRKQIIK

SEQ ID NO: 1650408 - protein, 19 aa, Staphylococcus aureus
LYNSPWIAWYHQQMQDKKA

SEQ ID NO: 1650409 - protein, 19 aa, Staphylococcus aureus
NATIAIAVGHELGLTYNTI

SEQ ID NO: 1650410 - protein, 21 aa, Staphylococcus aureus
PESQLPVLVKHALEENHATNN

SEQ ID NO: 1650411 - protein, 19 aa, Staphylococcus aureus
PKAKPFAKRGFSQRTTSTK

SEQ ID NO: 1650412 - protein, 17 aa, Staphylococcus aureus
PKEAYAYLEKLRSIIQY

SEQ ID NO: 1650413 - protein, 18 aa, Staphylococcus aureus
PSILRLVKQVIEASHKEG

SEQ ID NO: 1650414 - protein, 19 aa, Staphylococcus aureus
PYLKDWTIARLLKTDRIIL

SEQ ID NO: 1650415 - protein, 17 aa, Staphylococcus aureus
PYSGVTMGEEFMFNGKH

SEQ ID NO: 1650416 - protein, 32 aa, Staphylococcus aureus
QDMLIPWEMIPRCPKCDAPMEVNKRKAEVGMV

SEQ ID NO: 1650417 - protein, 23 aa, Staphylococcus aureus
QNLYCEASLLAKRLKAYQQSRVG

SEQ ID NO: 1650418 - protein, 17 aa, Staphylococcus aureus
QVRWMGVLNLEGKTPET

SEQ ID NO: 1650419 - protein, 25 aa, Staphylococcus aureus
QYWEKSCRYTLKFVENSNDVRIYDE

SEQ ID NO: 1650420 - protein, 23 aa, Staphylococcus aureus
SDAPIAFQEFMILPVGATTFKES

SEQ ID NO: 1650421 - protein, 18 aa, Staphylococcus aureus
SKNILDFSDYEHFALQIL

SEQ ID NO: 1650422 - protein, 18 aa, Staphylococcus aureus
SLSDSYPTLAMIYVTHFI

SEQ ID NO: 1650423 - protein, 25 aa, Staphylococcus aureus
STPSFMEMCLLLPTLNEEQYGSLNE

SEQ ID NO: 1650424 - protein, 22 aa, Staphylococcus aureus
TGKDLSVVLVDFGKKQNIVREL

SEQ ID NO: 1650425 - protein, 17 aa, Staphylococcus aureus
TKHAVGIQSEDGVDIVI

SEQ ID NO: 1650426 - protein, 18 aa, Staphylococcus aureus
TTVTYLFDMCHKVRPDNP

SEQ ID NO: 1650427 - protein, 18 aa, Staphylococcus aureus
VECAIPMIQGILGKIPFF

SEQ ID NO: 1650428 - protein, 18 aa, Staphylococcus aureus
VNEAMKLFSEPRFNVDVL

SEQ ID NO: 1650429 - protein, 17 aa, Staphylococcus aureus
VRHKERIKTLKHNVDVL

SEQ ID NO: 1650430 - protein, 17 aa, Staphylococcus aureus
VRLEVRRAEQLKQGQEI

SEQ ID NO: 1650431 - protein, 22 aa, Staphylococcus aureus
WILHIPSCYLGIAQAARNYAVD

SEQ ID NO: 1650432 - protein, 30 aa, Staphylococcus aureus
YEASLSRLGLKYLDLYLVHWPGTNEAVMVD

SEQ ID NO: 1650433 - protein, 34 aa, Staphylococcus aureus
YFCPVCGKQVILKRGLKVISHFAHKHLAEQKCFN

SEQ ID NO: 1650434 - protein, 23 aa, Staphylococcus aureus
YKATNFPDAKGWVGAGTKRGLPK

SEQ ID NO: 1650435 - protein, 19 aa, Staphylococcus aureus
YLVGLMRSVIYQFKEDELA

SEQ ID NO: 1650436 - protein, 21 aa, Staphylococcus aureus
AEKDFFIFFRNFFTKKFQREI

SEQ ID NO: 1650437 - protein, 17 aa, Staphylococcus aureus
AERLVIHGFLDPVVREL

SEQ ID NO: 1650438 - protein, 20 aa, Staphylococcus aureus
ARFTNGLSVNDFLTRNTVIH

SEQ ID NO: 1650439 - protein, 19 aa, Staphylococcus aureus
ASDGVGLGHQFLRHVERTK

SEQ ID NO: 1650440 - protein, 17 aa, Staphylococcus aureus
ASYRLYQTVKYWPKGTV

SEQ ID NO: 1650441 - protein, 20 aa, Staphylococcus aureus
CGGVSKLIQSGFETLVEAGY

SEQ ID NO: 1650442 - protein, 17 aa, Staphylococcus aureus
DENISFYKLVNKFSPEV

SEQ ID NO: 1650443 - protein, 20 aa, Staphylococcus aureus
DILSPEKELVVLTRLNEKEI

SEQ ID NO: 1650444 - protein, 22 aa, Staphylococcus aureus
DTYCGIGTIGLYMAPHAKHVYG

SEQ ID NO: 1650445 - protein, 25 aa, Staphylococcus aureus
DYLKDLGIDVIWLSPMFKSPNDDNG

SEQ ID NO: 1650446 - protein, 28 aa, Staphylococcus aureus
DYLPEIYKAVKAEVLFNKVAMRPGSVTT

SEQ ID NO: 1650447 - protein, 19 aa, Staphylococcus aureus
EELGVKFADRGLLEVDKQS

SEQ ID NO: 1650448 - protein, 25 aa, Staphylococcus aureus
EGSMLPKIEAAIRFVESGENKKVII

SEQ ID NO: 1650449 - protein, 23 aa, Staphylococcus aureus
EKDMYLKYIDIFKEASIQYLKEK

SEQ ID NO: 1650450 - protein, 23 aa, Staphylococcus aureus
ENNVRIALTEVWEKGGKGGVDLA

SEQ ID NO: 1650451 - protein, 24 aa, Staphylococcus aureus
EQSYRLVIPSIQFESNLKLICDTI

SEQ ID NO: 1650452 - protein, 21 aa, Staphylococcus aureus
ERAHLKFLSSLPVGGLGLDFV

SEQ ID NO: 1650453 - protein, 18 aa, Staphylococcus aureus
FEVPHQWQHNAYSEIPQA

SEQ ID NO: 1650454 - protein, 23 aa, Staphylococcus aureus
FIKKWQRELEALYHIKSKLNTEQ

SEQ ID NO: 1650455 - protein, 25 aa, Staphylococcus aureus
FKNVIIIEFSKFIPSMVLKRHIYKQ

SEQ ID NO: 1650456 - protein, 18 aa, Staphylococcus aureus
FLVRRSGKMYFNIKDVLD

SEQ ID NO: 1650457 - protein, 33 aa, Staphylococcus aureus
GKERMPIEVVYGFAQLKRAAALANFDLGKLSEA

SEQ ID NO: 1650458 - protein, 18 aa, Staphylococcus aureus
GKWSYLYRAIDAEGHTLD

SEQ ID NO: 1650459 - protein, 25 aa, Staphylococcus aureus
HKTPAQVVLRWHLAHNRIIIPKSQT

SEQ ID NO: 1650460 - protein, 25 aa, Staphylococcus aureus
HRIKYDMLQPNPLRQEVMRRYPQII

SEQ ID NO: 1650461 - protein, 26 aa, Staphylococcus aureus
HTRSSIGGFKGRKLLANDVITVKINN

SEQ ID NO: 1650462 - protein, 21 aa, Staphylococcus aureus
HVERVSKRLGINRWKDNVRQV

SEQ ID NO: 1650463 - protein, 25 aa, Staphylococcus aureus
HYICPNCKTSEFFNDGSVGSGFDLP

SEQ ID NO: 1650464 - protein, 18 aa, Staphylococcus aureus
IDKLDYLKDLGIDVIWLS

SEQ ID NO: 1650465 - protein, 20 aa, Staphylococcus aureus
IDPKKCIALKISEEKLNRIR

SEQ ID NO: 1650466 - protein, 18 aa, Staphylococcus aureus
IEDFHLIKEIISKKELDG

SEQ ID NO: 1650467 - protein, 25 aa, Staphylococcus aureus
IEGTLTGRVKFIFQPAEELGHGAFK

SEQ ID NO: 1650468 - protein, 17 aa, Staphylococcus aureus
IELAHRMKLGQKIDITQ

SEQ ID NO: 1650469 - protein, 18 aa, Staphylococcus aureus
IGQKRRLSVATALSSKAD

SEQ ID NO: 1650470 - protein, 18 aa, Staphylococcus aureus
ILGKIPFFGICLGHQLFA

SEQ ID NO: 1650471 - protein, 24 aa, Staphylococcus aureus
INKEMFKRQGGYGRGRRMQIEKDT

SEQ ID NO: 1650472 - protein, 18 aa, Staphylococcus aureus
ITPFETRQSPNISSQLME

SEQ ID NO: 1650473 - protein, 23 aa, Staphylococcus aureus
KAILRCDPDVILIGEIRDKDVAK

SEQ ID NO: 1650474 - protein, 18 aa, Staphylococcus aureus
KDTRVVFTAHGWAFTEGV

SEQ ID NO: 1650475 - protein, 20 aa, Staphylococcus aureus
KEIISKKELDGFNITIPHKE

SEQ ID NO: 1650476 - protein, 34 aa, Staphylococcus aureus
KESDIKIRVENVLKICGLYAFRNWPIAALSYGQK

SEQ ID NO: 1650477 - protein, 27 aa, Staphylococcus aureus
KIPFFGICLGHQLFALSQGASSFKMKF

SEQ ID NO: 1650478 - protein, 21 aa, Staphylococcus aureus
KISFNDIEFLPPVTPPNNVIA

SEQ ID NO: 1650479 - protein, 18 aa, Staphylococcus aureus
KKELDGFNITIPHKERII

SEQ ID NO: 1650480 - protein, 25 aa, Staphylococcus aureus
KLIDRSVRIIQEICAITYDEAMALY

SEQ ID NO: 1650481 - protein, 19 aa, Staphylococcus aureus
KQKSGAWLVKVKDLETNET

SEQ ID NO: 1650482 - protein, 21 aa, Staphylococcus aureus
KRQGKSYLEILEMGGGILSTV

SEQ ID NO: 1650483 - protein, 18 aa, Staphylococcus aureus
KSRRLGISLSGTGKELEK

SEQ ID NO: 1650484 - protein, 18 aa, Staphylococcus aureus
LENLKVVLEEAGSDLNSV

SEQ ID NO: 1650485 - protein, 22 aa, Staphylococcus aureus
LIKYEGFTGHDIQNWFMNAHIY

SEQ ID NO: 1650486 - protein, 17 aa, Staphylococcus aureus
LLHIKRSKTILFTSDSR

SEQ ID NO: 1650487 - protein, 18 aa, Staphylococcus aureus
LNNIISFEQHKVWRKRVM

SEQ ID NO: 1650488 - protein, 24 aa, Staphylococcus aureus
LNSEKPEENWLFKLDDVDKEAFLA

SEQ ID NO: 1650489 - protein, 23 aa, Staphylococcus aureus
LSKIGGGVAINLSKLRARGEAIK

SEQ ID NO: 1650490 - protein, 17 aa, Staphylococcus aureus
MIADPAIDIGMLLYNYV

SEQ ID NO: 1650491 - protein, 25 aa, Staphylococcus aureus
NDFAYKHRIPWIYGGVVQSTYTEAA

SEQ ID NO: 1650492 - protein, 17 aa, Staphylococcus aureus
NGIQRRIDNGTLKVVDN

SEQ ID NO: 1650493 - protein, 18 aa, Staphylococcus aureus
NMQSAYYYNIFVQKVFLK

SEQ ID NO: 1650494 - protein, 23 aa, Staphylococcus aureus
NQEGRRVFVTEVVCDSVQFLEPK

SEQ ID NO: 1650495 - protein, 17 aa, Staphylococcus aureus
NTQLNIWGGALASGHPY

SEQ ID NO: 1650496 - protein, 20 aa, Staphylococcus aureus
PEDRIKMIINKVQPEFVFNT

SEQ ID NO: 1650497 - protein, 18 aa, Staphylococcus aureus
PLNNDILLKFDRVSVDYT

SEQ ID NO: 1650498 - protein, 17 aa, Staphylococcus aureus
PQRIGSMGKGIPGSSVT

SEQ ID NO: 1650499 - protein, 21 aa, Staphylococcus aureus
PTRQIILNFGHYRFTDLKESG

SEQ ID NO: 1650500 - protein, 20 aa, Staphylococcus aureus
QEIDSTFSYLERVDYQLLTE

SEQ ID NO: 1650501 - protein, 26 aa, Staphylococcus aureus
QFYKGEFKSASAFPLPNTEYTPLYLN

SEQ ID NO: 1650502 - protein, 24 aa, Staphylococcus aureus
QIDYAQCLVQLGIAKKAEHLFYDN

SEQ ID NO: 1650503 - protein, 18 aa, Staphylococcus aureus
QIGGAPCNVACTVQKLGQ

SEQ ID NO: 1650504 - protein, 24 aa, Staphylococcus aureus
QINRLKLFKQHGISSKCVYVKWNP

SEQ ID NO: 1650505 - protein, 23 aa, Staphylococcus aureus
QLEVPIPAIISAFEIAKAHGVTT

SEQ ID NO: 1650506 - protein, 19 aa, Staphylococcus aureus
RFDIVDGKLNIQFNEGEPY

SEQ ID NO: 1650507 - protein, 20 aa, Staphylococcus aureus
RGALILLKHQIIPFFSVGDF

SEQ ID NO: 1650508 - protein, 17 aa, Staphylococcus aureus
RKIESYADIKVERRVNE

SEQ ID NO: 1650509 - protein, 17 aa, Staphylococcus aureus
RLQEAFSNIKVGDPQDE

SEQ ID NO: 1650510 - protein, 20 aa, Staphylococcus aureus
RSEYHHCPVILGSATPCLES

SEQ ID NO: 1650511 - protein, 24 aa, Staphylococcus aureus
SEEIPHAIGVNVDRMVKESEDRVH

SEQ ID NO: 1650512 - protein, 27 aa, Staphylococcus aureus
SEKQAQAILDMRLRRLTGLERDKIEAE

SEQ ID NO: 1650513 - protein, 17 aa, Staphylococcus aureus
SELTPNVARVIKRLINE

SEQ ID NO: 1650514 - protein, 28 aa, Staphylococcus aureus
SKDLKQYGFKFLGPVTVFSFLEAAGLYD

SEQ ID NO: 1650515 - protein, 20 aa, Staphylococcus aureus
SLFVKVGMELFYQEGPQLIN

SEQ ID NO: 1650516 - protein, 27 aa, Staphylococcus aureus
SRAVKPPIIYGDVKWTAPLTVDETVYA

SEQ ID NO: 1650517 - protein, 18 aa, Staphylococcus aureus
TLQSFAESFMRPCQLAKM

SEQ ID NO: 1650518 - protein, 28 aa, Staphylococcus aureus
TNTHLHLIKPLGFRTDDKMLKRAGLDYW

SEQ ID NO: 1650519 - protein, 19 aa, Staphylococcus aureus
VAGSGVYICNECIELCSEI

SEQ ID NO: 1650520 - protein, 19 aa, Staphylococcus aureus
VFTAHGWAFTEGVKPAKKF

SEQ ID NO: 1650521 - protein, 26 aa, Staphylococcus aureus
VGASVFTGFGPRIVRINNFSVDLKPN

SEQ ID NO: 1650522 - protein, 25 aa, Staphylococcus aureus
VLHLLYARFWHKVLYDLGIVPTKEP

SEQ ID NO: 1650523 - protein, 17 aa, Staphylococcus aureus
WKKSRRLGISLSGTGKE

SEQ ID NO: 1650524 - protein, 27 aa, Staphylococcus aureus
YIYSRPRSGYFVSEIESLTILNNQPIP

SEQ ID NO: 1650525 - protein, 20 aa, Staphylococcus aureus
YKQPVCKVCGSQIETKIIAT

SEQ ID NO: 1650526 - protein, 23 aa, Staphylococcus aureus
YYAKERPSAFIYTGAAVEDGEIY

SEQ ID NO: 1650527 - protein, 19 aa, Staphylococcus aureus
AFEESYGFLSEPFVRDKDA

SEQ ID NO: 1650528 - protein, 17 aa, Staphylococcus aureus
AGFDYKLNADLSPKFVV

SEQ ID NO: 1650529 - protein, 17 aa, Staphylococcus aureus
AKETLEQIISEMDQEVT

SEQ ID NO: 1650530 - protein, 23 aa, Staphylococcus aureus
ASGVPDFRSMGGLFDEISKDGLS

SEQ ID NO: 1650531 - protein, 17 aa, Staphylococcus aureus
ATEEQMLYFGLPRINKY

SEQ ID NO: 1650532 - protein, 20 aa, Staphylococcus aureus
ATGLPTHLCSVAIPHTDVEH

SEQ ID NO: 1650533 - protein, 18 aa, Staphylococcus aureus
AVALELIHMATLVHDDVI

SEQ ID NO: 1650534 - protein, 17 aa, Staphylococcus aureus
AVCGEVFTSPTPDKILE

SEQ ID NO: 1650535 - protein, 28 aa, Staphylococcus aureus
CKVYLKREDLQWVRSFKLRGAYNAISVL

SEQ ID NO: 1650536 - protein, 20 aa, Staphylococcus aureus
DHKTRMALHPLKEFAKSKLI

SEQ ID NO: 1650537 - protein, 19 aa, Staphylococcus aureus
DPKNGVVFYNLANVYYNQQ

SEQ ID NO: 1650538 - protein, 22 aa, Staphylococcus aureus
EIPFAFFKQHVTDFDIPGEGEY

SEQ ID NO: 1650539 - protein, 23 aa, Staphylococcus aureus
EKFRGIRSNIMFANPDSAVQSIV

SEQ ID NO: 1650540 - protein, 22 aa, Staphylococcus aureus
EMRVIKDICNRVAVMEKGQVVE

SEQ ID NO: 1650541 - protein, 35 aa, Staphylococcus aureus
EVCGSPMVIKMGRYGKFMACSNFPDCRNTKAIVKS

SEQ ID NO: 1650542 - protein, 22 aa, Staphylococcus aureus
FAATIRPQFIAYQIPIGLGSIK

SEQ ID NO: 1650543 - protein, 18 aa, Staphylococcus aureus
FASLMIDLGVDVTVIEAG

SEQ ID NO: 1650544 - protein, 25 aa, Staphylococcus aureus
FKCNSEAKYYLNIIEGEWHPQDLND

SEQ ID NO: 1650545 - protein, 24 aa, Staphylococcus aureus
FKEKEIPLVDYIFCTYNTDLYYNT

SEQ ID NO: 1650546 - protein, 20 aa, Staphylococcus aureus
FRFQILVKYKSEPGLLQAIQ

SEQ ID NO: 1650547 - protein, 17 aa, Staphylococcus aureus
FRNWPIAALSYGQKKRV

SEQ ID NO: 1650548 - protein, 18 aa, Staphylococcus aureus
GEVKDCIDYALCVNEQGS

SEQ ID NO: 1650549 - protein, 20 aa, Staphylococcus aureus
GEVPKLYLTSHMDTVVPAIN

SEQ ID NO: 1650550 - protein, 25 aa, Staphylococcus aureus
GGQQQRVCIARCLAIEPEVILMDEP

SEQ ID NO: 1650551 - protein, 21 aa, Staphylococcus aureus
GHLLIQWYSKGIYKFKYAILE

SEQ ID NO: 1650552 - protein, 17 aa, Staphylococcus aureus
HGLKAFLSEYAKVDDGL

SEQ ID NO: 1650553 - protein, 24 aa, Staphylococcus aureus
IDSVNELGPYIVIAPEIAIAHARP

SEQ ID NO: 1650554 - protein, 23 aa, Staphylococcus aureus
IPIDLLPYLFFQFAKDGKRLYSD

SEQ ID NO: 1650555 - protein, 24 aa, Staphylococcus aureus
IRLKSKKGTLLWLMDETKTPMGAR

SEQ ID NO: 1650556 - protein, 18 aa, Staphylococcus aureus
IVTMAGLVNALRVVNKDI

SEQ ID NO: 1650557 - protein, 22 aa, Staphylococcus aureus
KIAKKVFPELAAKGGNAKQIME

SEQ ID NO: 1650558 - protein, 30 aa, Staphylococcus aureus
KLKEILMQWQRGIYDGGGWNAIFWCNHDQP

SEQ ID NO: 1650559 - protein, 19 aa, Staphylococcus aureus
KRNEVLNIVNVLKKYPIFI

SEQ ID NO: 1650560 - protein, 18 aa, Staphylococcus aureus
KYTIAKFYKLYIERSNNG

SEQ ID NO: 1650561 - protein, 18 aa, Staphylococcus aureus
LEGICLSRTIATEKQLVP

SEQ ID NO: 1650562 - protein, 20 aa, Staphylococcus aureus
LFAAFAEFERNLILERSSAG

SEQ ID NO: 1650563 - protein, 23 aa, Staphylococcus aureus
LGAQALTCYYGGEVIKGDKVMHG

SEQ ID NO: 1650564 - protein, 20 aa, Staphylococcus aureus
LHKANEVGYLLYRPTENTTF

SEQ ID NO: 1650565 - protein, 24 aa, Staphylococcus aureus
LHTKDIPGSHVVIFNDAPSDTTIK

SEQ ID NO: 1650566 - protein, 18 aa, Staphylococcus aureus
LQHLATKHGINFQEVAFK

SEQ ID NO: 1650567 - protein, 22 aa, Staphylococcus aureus
LSLQAIKLTFEYLKSSVEKGDK

SEQ ID NO: 1650568 - protein, 18 aa, Staphylococcus aureus
LSRKTIVYKGWLRSDQIK

SEQ ID NO: 1650569 - protein, 20 aa, Staphylococcus aureus
MSKGSFKRAIGHLYKQKIIN

SEQ ID NO: 1650570 - protein, 20 aa, Staphylococcus aureus
NSIMPRKSRASLQKIKQKWL

SEQ ID NO: 1650571 - protein, 25 aa, Staphylococcus aureus
PDEVWKERLELLKPYQVNKEMMDKT

SEQ ID NO: 1650572 - protein, 18 aa, Staphylococcus aureus
PETEIVKGRVRYEQNNKE

SEQ ID NO: 1650573 - protein, 24 aa, Staphylococcus aureus
PFDDSFSGFIFKIQANMDPKHRDR

SEQ ID NO: 1650574 - protein, 18 aa, Staphylococcus aureus
PGLPMGAAPMAYTLWTRH

SEQ ID NO: 1650575 - protein, 17 aa, Staphylococcus aureus
PMAYTLWTRHLNFNPQS

SEQ ID NO: 1650576 - protein, 21 aa, Staphylococcus aureus
QFRLHSLGLMHVINYLSTSET

SEQ ID NO: 1650577 - protein, 24 aa, Staphylococcus aureus
QQHSYWKANFIERNIYDHSLMVSS

SEQ ID NO: 1650578 - protein, 17 aa, Staphylococcus aureus
QYAELLVKVGMNVQPKQ

SEQ ID NO: 1650579 - protein, 19 aa, Staphylococcus aureus
REVLVPWEDLPKVKSLWPQ

SEQ ID NO: 1650580 - protein, 20 aa, Staphylococcus aureus
RKLYPEAKIYVFGKTDYKLS

SEQ ID NO: 1650581 - protein, 17 aa, Staphylococcus aureus
RKYYRPRKMNRFLKHVV

SEQ ID NO: 1650582 - protein, 26 aa, Staphylococcus aureus
SGGEKARLQLALLMLQRDNVLILDEP

SEQ ID NO: 1650583 - protein, 24 aa, Staphylococcus aureus
SNQTFKIFLEDLIELSKYNNEKYQ

SEQ ID NO: 1650584 - protein, 19 aa, Staphylococcus aureus
THLESIKASLKRLEDEIER

SEQ ID NO: 1650585 - protein, 35 aa, Staphylococcus aureus
TLDPRVEKLMQAFWPGPISFILPLKPGYLCRKVSG

SEQ ID NO: 1650586 - protein, 23 aa, Staphylococcus aureus
VGNLTSPYNGRWHMRNIKTNRFS

SEQ ID NO: 1650587 - protein, 32 aa, Staphylococcus aureus
VKPLLTKEIEGFGELFRYLSYVEDVGTRALLS

SEQ ID NO: 1650588 - protein, 23 aa, Staphylococcus aureus
VRYPEFTSSLMLVNPTSIEGELP

SEQ ID NO: 1650589 - protein, 25 aa, Staphylococcus aureus
VSPSEFKFGLSFLTRSIALARFPWL

SEQ ID NO: 1650590 - protein, 17 aa, Staphylococcus aureus
VVINIDIYQHFRQEEYE

SEQ ID NO: 1650591 - protein, 20 aa, Staphylococcus aureus
WSTGNLPYLIELGAIEVSIN

SEQ ID NO: 1650592 - protein, 17 aa, Staphylococcus aureus
YVACELYKEMAFNQHCK

SEQ ID NO: 1650593 - protein, 19 aa, Staphylococcus aureus
AFADGKYLFGLSGNPSACF

SEQ ID NO: 1650594 - protein, 21 aa, Staphylococcus aureus
AIRKGETLGIVGESGSGKSTL

SEQ ID NO: 1650595 - protein, 17 aa, Staphylococcus aureus
AKPSLQIINVARGGIID

SEQ ID NO: 1650596 - protein, 17 aa, Staphylococcus aureus
ALGGLAVIIHEHMENSR

SEQ ID NO: 1650597 - protein, 21 aa, Staphylococcus aureus
ARSLLSEAICNLDNNQIETLQ

SEQ ID NO: 1650598 - protein, 19 aa, Staphylococcus aureus
CKAYVEAHAKFAAENVEKV

SEQ ID NO: 1650599 - protein, 19 aa, Staphylococcus aureus
CKYPIGVVEDEIYYFNEEN

SEQ ID NO: 1650600 - protein, 19 aa, Staphylococcus aureus
DGNLGYITAILLRKLYPEA

SEQ ID NO: 1650601 - protein, 22 aa, Staphylococcus aureus
DLKIDHAFECVGGKGSQVALQQ

SEQ ID NO: 1650602 - protein, 24 aa, Staphylococcus aureus
DNERLKAALLYTLEEECIKQGHTY

SEQ ID NO: 1650603 - protein, 22 aa, Staphylococcus aureus
DSSIEAGLRRVLAETSQYITNE

SEQ ID NO: 1650604 - protein, 34 aa, Staphylococcus aureus
EDIRFGIKENVDFIAASFVRRPSDVLEIREILEE

SEQ ID NO: 1650605 - protein, 24 aa, Staphylococcus aureus
EDSSRPNVNISIIYFEDVSTETIL

SEQ ID NO: 1650606 - protein, 18 aa, Staphylococcus aureus
EGVLKDKLFIDGKYYDDY

SEQ ID NO: 1650607 - protein, 23 aa, Staphylococcus aureus
EIGRGRGPVNHFAYLKKEGLDDE

SEQ ID NO: 1650608 - protein, 17 aa, Staphylococcus aureus
ELISLKKDIGYLLLDVN

SEQ ID NO: 1650609 - protein, 18 aa, Staphylococcus aureus
ERNEPFDWLSYWTDECHY

SEQ ID NO: 1650610 - protein, 20 aa, Staphylococcus aureus
EVEVPIIVERDIYKATAKTM

SEQ ID NO: 1650611 - protein, 21 aa, Staphylococcus aureus
EVGQGLSCIAVRADIDALPIQ

SEQ ID NO: 1650612 - protein, 17 aa, Staphylococcus aureus
EYLGEGVADDVKEAVQN

SEQ ID NO: 1650613 - protein, 18 aa, Staphylococcus aureus
FDEACHVMNTIAPEHASI

SEQ ID NO: 1650614 - protein, 26 aa, Staphylococcus aureus
FIGKRISSAFLKIVIRDVAKRTAAKQ

SEQ ID NO: 1650615 - protein, 20 aa, Staphylococcus aureus
FKLAASRRGKLTSVDKENVL

SEQ ID NO: 1650616 - protein, 17 aa, Staphylococcus aureus
FSAQMHSLIAMDQQHQR

SEQ ID NO: 1650617 - protein, 19 aa, Staphylococcus aureus
FYRTPRIPRSLLDEYREGL

SEQ ID NO: 1650618 - protein, 25 aa, Staphylococcus aureus
GASGMGRYHGKYSFDTFTHEKSYIF

SEQ ID NO: 1650619 - protein, 19 aa, Staphylococcus aureus
GEAHFQVWEKVVASYSGCC

SEQ ID NO: 1650620 - protein, 24 aa, Staphylococcus aureus
GEVSEGRGIISYEMGSDGTGGKHL

SEQ ID NO: 1650621 - protein, 17 aa, Staphylococcus aureus
GGMVVCLETSQPTLPVF

SEQ ID NO: 1650622 - protein, 25 aa, Staphylococcus aureus
GKNPIKVILSKSGNIHFNQQIYQDE

SEQ ID NO: 1650623 - protein, 20 aa, Staphylococcus aureus
GKTGAFGIPLIEKVVGKQGV

SEQ ID NO: 1650624 - protein, 19 aa, Staphylococcus aureus
GKYLFGLSGNPSACFTGFE

SEQ ID NO: 1650625 - protein, 21 aa, Staphylococcus aureus
HFKYVFEVLHDFYAENDQYNI

SEQ ID NO: 1650626 - protein, 17 aa, Staphylococcus aureus
IANDVRWLASGPRAGLA

SEQ ID NO: 1650627 - protein, 17 aa, Staphylococcus aureus
IEQAPSLVFFSEDVHEE

SEQ ID NO: 1650628 - protein, 23 aa, Staphylococcus aureus
IHLPNGIKISNRFVLSPMTVNAS

SEQ ID NO: 1650629 - protein, 21 aa, Staphylococcus aureus
IKKDEVLAGFLYLTDLEEDMP

SEQ ID NO: 1650630 - protein, 17 aa, Staphylococcus aureus
IVERDIYKATAKTMDYK

SEQ ID NO: 1650631 - protein, 23 aa, Staphylococcus aureus
KAIMLPPGLAFVAYSHRAKERFK

SEQ ID NO: 1650632 - protein, 17 aa, Staphylococcus aureus
KEMKRYQTKWTELYDIW

SEQ ID NO: 1650633 - protein, 18 aa, Staphylococcus aureus
KGKFLSIQMYNALAYNYY

SEQ ID NO: 1650634 - protein, 24 aa, Staphylococcus aureus
KQPRVKFEKVFAEHFLNLYEKTKD

SEQ ID NO: 1650635 - protein, 35 aa, Staphylococcus aureus; identical to SEQ ID NO: 1580265

SEQ ID NO: 1650636 - protein, 41 aa, Staphylococcus aureus
LEAGRSDYFWDLFIQMPAALMFPSGNKFYDWIYSTDEEPHM

SEQ ID NO: 1650637 - protein, 21 aa, Staphylococcus aureus
LKPDLILMDLLMEDMDGVEAT

SEQ ID NO: 1650638 - protein, 19 aa, Staphylococcus aureus
LKVQGALAMILKDAIKPNL

SEQ ID NO: 1650639 - protein, 18 aa, Staphylococcus aureus
LLKSYGFLIYFKNPEDMY

SEQ ID NO: 1650640 - protein, 19 aa, Staphylococcus aureus
LQSSRHILFAGLGSSGLSA

SEQ ID NO: 1650641 - protein, 17 aa, Staphylococcus aureus
LSGEKVQIWIADYVLST

SEQ ID NO: 1650642 - protein, 20 aa, Staphylococcus aureus
LYILGVSDRIGRLFEITGLK

SEQ ID NO: 1650643 - protein, 17 aa, Staphylococcus aureus
NENNYGVGLGMPSFESA

SEQ ID NO: 1650644 - protein, 17 aa, Staphylococcus aureus
NPSQGFRAFKKAKVGDQ

SEQ ID NO: 1650645 - protein, 18 aa, Staphylococcus aureus
NVSFYGATGGKAFINGSA

SEQ ID NO: 1650646 - protein, 17 aa, Staphylococcus aureus
PKSVTPFDLHLISINPK

SEQ ID NO: 1650647 - protein, 21 aa, Staphylococcus aureus
PLKPGYLCRKVSGGLSSVAVR

SEQ ID NO: 1650648 - protein, 21 aa, Staphylococcus aureus
PNKLIPLTFFVKKFKQAKSSI

SEQ ID NO: 1650649 - protein, 18 aa, Staphylococcus aureus
PPWFKVSPTHFVKSWLLD

SEQ ID NO: 1650650 - protein, 18 aa, Staphylococcus aureus
QKVKEGKSYPRIISELLE

SEQ ID NO: 1650651 - protein, 19 aa, Staphylococcus aureus
QPEIRRALEQLGRGSFLKR

SEQ ID NO: 1650652 - protein, 21 aa, Staphylococcus aureus
REVVKHHQLKVNAFEEVLTVK

SEQ ID NO: 1650653 - protein, 18 aa, Staphylococcus aureus
RKEIKCYLEQATDESAFV

SEQ ID NO: 1650654 - protein, 25 aa, Staphylococcus aureus
RLQGDLEKRESLNLDTSALVRQLKD

SEQ ID NO: 1650655 - protein, 26 aa, Staphylococcus aureus
RTLKHCDNCGGAIRPDIVLYGEMLDQ

SEQ ID NO: 1650656 - protein, 19 aa, Staphylococcus aureus
RYLLIEFPSNEVPHYTDQL

SEQ ID NO: 1650657 - protein, 24 aa, Staphylococcus aureus
SEALKDVLSDTGWEVSEQTEYDGL

SEQ ID NO: 1650658 - protein, 20 aa, Staphylococcus aureus
SKEVQKILSHRAKGIKMYIF

SEQ ID NO: 1650659 - protein, 24 aa, Staphylococcus aureus
SKLFDIVIQWGVLALIVIFQPEIR

SEQ ID NO: 1650660 - protein, 18 aa, Staphylococcus aureus
SNSYMVMFEFKGHRIVAF

SEQ ID NO: 1650661 - protein, 19 aa, Staphylococcus aureus
SNTAEFGDYVSGPRVITPD

SEQ ID NO: 1650662 - protein, 21 aa, Staphylococcus aureus
SSLPSNCQMYYAMKANSERTI

SEQ ID NO: 1650663 - protein, 21 aa, Staphylococcus aureus
TESYPIMKYMQPVRKMIGKPT

SEQ ID NO: 1650664 - protein, 19 aa, Staphylococcus aureus
TFSRTQAFLNEFAESLSKA

SEQ ID NO: 1650665 - protein, 19 aa, Staphylococcus aureus
TLHPMGGLQERIWNPLQIL

SEQ ID NO: 1650666 - protein, 18 aa, Staphylococcus aureus
TSIPEDRIKMIINKVQPE

SEQ ID NO: 1650667 - protein, 22 aa, Staphylococcus aureus
VGEKGDVALFFGLSGTGKTTLS

SEQ ID NO: 1650668 - protein, 26 aa, Staphylococcus aureus
VRKKRTRSSLALFIMICTGCRVSGAR

SEQ ID NO: 1650669 - protein, 18 aa, Staphylococcus aureus
VSKGLHYQALQVLHTYAK

SEQ ID NO: 1650670 - protein, 19 aa, Staphylococcus aureus
WTQVKMKAVLHNEAIKNVL

SEQ ID NO: 1650671 - protein, 17 aa, Staphylococcus aureus
YDIPVIMLTARDALSDK

SEQ ID NO: 1650672 - protein, 18 aa, Staphylococcus aureus
YFAARSLLSEAICNLDNN

SEQ ID NO: 1650673 - protein, 25 aa, Staphylococcus aureus
YPVYEMRWDIGYVLQQIALFPHMTI

SEQ ID NO: 1650674 - protein, 29 aa, Staphylococcus aureus
ARFDVSRMTLRQAIKLLAEDGIVESTRGK

SEQ ID NO: 1650675 - protein, 31 aa, Staphylococcus aureus
ARLRWYQGRYIDFDGWYGYQCADLAVDYIYW

SEQ ID NO: 1650676 - protein, 21 aa, Staphylococcus aureus
AVLKEKWYVSIQAIAMRAYYL

SEQ ID NO: 1650677 - protein, 18 aa, Staphylococcus aureus
AWLEVEILACEAWSELGH

SEQ ID NO: 1650678 - protein, 29 aa, Staphylococcus aureus
AYLIEALQGYSHRIYCFIRADNEEIAWYK

SEQ ID NO: 1650679 - protein, 19 aa, Staphylococcus aureus
CGKSTLGKVIIRLEDATSG

SEQ ID NO: 1650680 - protein, 18 aa, Staphylococcus aureus
DAYENLLFDCLKGDATNF

SEQ ID NO: 1650681 - protein, 17 aa, Staphylococcus aureus
DEADRLQNITSFKDIAK

SEQ ID NO: 1650682 - protein, 19 aa, Staphylococcus aureus
DGSPAVTPRNYRWTSRTGT

SEQ ID NO: 1650683 - protein, 23 aa, Staphylococcus aureus
DIGDLRQGYEYSRTANPTRSSVE

SEQ ID NO: 1650684 - protein, 25 aa, Staphylococcus aureus
DKLNELRSGFNIDNYITLEEYFENW

SEQ ID NO: 1650685 - protein, 18 aa, Staphylococcus aureus
DPVNIVGIGIDFTSSTII

SEQ ID NO: 1650686 - protein, 17 aa, Staphylococcus aureus
DQFKLMFKDGEIIDFSA

SEQ ID NO: 1650687 - protein, 23 aa, Staphylococcus aureus
DYTHARFYTRAMTRKELDILTEK

SEQ ID NO: 1650688 - protein, 18 aa, Staphylococcus aureus
EKEREIGAKYVDLDTLLK

SEQ ID NO: 1650689 - protein, 23 aa, Staphylococcus aureus
EKQLPQHFIRISKSEIVNKYYIE

SEQ ID NO: 1650690 - protein, 18 aa, Staphylococcus aureus
ELGLGCMSLGTDLKKAEQ

SEQ ID NO: 1650691 - protein, 19 aa, Staphylococcus aureus
ELKDILFGPTITVKALLNM

SEQ ID NO: 1650692 - protein, 22 aa, Staphylococcus aureus
ELKEEIRLFVKEGLSAHAAPRE

SEQ ID NO: 1650693 - protein, 32 aa, Staphylococcus aureus
ENGDLLFGTIDTWLVWKLSGKAAHITDYSNAS

SEQ ID NO: 1650694 - protein, 22 aa, Staphylococcus aureus
EQFGLSVMVAFGYRQQDPPKNK

SEQ ID NO: 1650695 - protein, 18 aa, Staphylococcus aureus
EVSIKFRINDNLEQYEQI

SEQ ID NO: 1650696 - protein, 17 aa, Staphylococcus aureus
FAKDRIIKLLCHLCQTV

SEQ ID NO: 1650697 - protein, 20 aa, Staphylococcus aureus
FEVRKKLFLKLQRIKNNAFY

SEQ ID NO: 1650698 - protein, 17 aa, Staphylococcus aureus
FKAGHTVDIILTESDAA

SEQ ID NO: 1650699 - protein, 20 aa, Staphylococcus aureus
FKLMFKDGEIIDFSAEKGEA

SEQ ID NO: 1650700 - protein, 17 aa, Staphylococcus aureus
FNGLKGQGVLLVNHIQN

SEQ ID NO: 1650701 - protein, 31 aa, Staphylococcus aureus
GAHIRTLLLTFFYRFMRPLIEAGYVYIAQPP

SEQ ID NO: 1650702 - protein, 23 aa, Staphylococcus aureus
GEVSRIYLNFSDPWPKNRHAKRR

SEQ ID NO: 1650703 - protein, 18 aa, Staphylococcus aureus
GGCTFCSAAGSGDFAGNR

SEQ ID NO: 1650704 - protein, 24 aa, Staphylococcus aureus
GQASRRICEAIEYYFGLRSDKPDE

SEQ ID NO: 1650705 - protein, 18 aa, Staphylococcus aureus
HFIRATLESLCYQTRDVM

SEQ ID NO: 1650706 - protein, 22 aa, Staphylococcus aureus
IAGSYAERIPVIAITGAPTRAV

SEQ ID NO: 1650707 - protein, 21 aa, Staphylococcus aureus
IKMSDEILQQFEAVKDDKAKT

SEQ ID NO: 1650708 - protein, 20 aa, Staphylococcus aureus
ITHEMHVIRRICDEVAVMES

SEQ ID NO: 1650709 - protein, 20 aa, Staphylococcus aureus
KAYYKWRIDETYIKIKGKWS

SEQ ID NO: 1650710 - protein, 25 aa, Staphylococcus aureus
KGVSWDYFDIGLFEFDSGYVEAIEA

SEQ ID NO: 1650711 - protein, 26 aa, Staphylococcus aureus
KQLCTTYKMVLDFYIELSSNTVKGRY

SEQ ID NO: 1650712 - protein, 17 aa, Staphylococcus aureus
LITQLATLYGLTADGMK

SEQ ID NO: 1650713 - protein, 34 aa, Staphylococcus aureus
LKSRLPEYMIPRKFEWMEQLPLTSNGKIDRKKIA

SEQ ID NO: 1650714 - protein, 26 aa, Staphylococcus aureus
LNANYIKARLSEHFEIPYKQYCKHEF

SEQ ID NO: 1650715 - protein, 23 aa, Staphylococcus aureus
LYEEMNHLLYCSSAGHEPGYIYR

SEQ ID NO: 1650716 - protein, 21 aa, Staphylococcus aureus
MGAALLAFCETTLTKGIDVVF

SEQ ID NO: 1650717 - protein, 19 aa, Staphylococcus aureus
MTGKTWLFFGDQHRSSDFL

SEQ ID NO: 1650718 - protein, 17 aa, Staphylococcus aureus
NEKVRFARFRPFPFWKR

SEQ ID NO: 1650719 - protein, 17 aa, Staphylococcus aureus
NELPEFEDYVVLTQQQN

SEQ ID NO: 1650720 - protein, 26 aa, Staphylococcus aureus
NFVRRVCDCKGQWTMENFIEIEIEKI

SEQ ID NO: 1650721 - protein, 28 aa, Staphylococcus aureus
PLNPEVIKWAKKVYGLTVLDTWWMTETG

SEQ ID NO: 1650722 - protein, 17 aa, Staphylococcus aureus
PNGYFVTSNFGAYRETS

SEQ ID NO: 1650723 - protein, 19 aa, Staphylococcus aureus
QHALDVWLLGKLQFAEFEH

SEQ ID NO: 1650724 - protein, 23 aa, Staphylococcus aureus
QHDAANAWGSWNPDEFTVEDSAF

SEQ ID NO: 1650725 - protein, 17 aa, Staphylococcus aureus
QNIYPAHVERLLTQSSS

SEQ ID NO: 1650726 - protein, 18 aa, Staphylococcus aureus
QNKTEFDDMISLMGMHLE

SEQ ID NO: 1650727 - protein, 31 aa, Staphylococcus aureus
RATATYKFAGGKGINVSRVLKTLDVESTALG

SEQ ID NO: 1650728 - protein, 24 aa, Staphylococcus aureus
RIIKLLCHLCQTVGYDQDEFYEIK

SEQ ID NO: 1650729 - protein, 22 aa, Staphylococcus aureus
RKLDEIVLLEGFMDVIKSDTAG

SEQ ID NO: 1650730 - protein, 19 aa, Staphylococcus aureus
RLIERRLLRHFSKKGYITW

SEQ ID NO: 1650731 - protein, 19 aa, Staphylococcus aureus
RSQEMPIFITYDKHEDISD

SEQ ID NO: 1650732 - protein, 19 aa, Staphylococcus aureus
RYEGFGPSGSMLIVDALTN

SEQ ID NO: 1650733 - protein, 19 aa, Staphylococcus aureus
SIHLIDILKKLSHDEIEAF

SEQ ID NO: 1650734 - protein, 18 aa, Staphylococcus aureus
SNEALLFMLEKAGIVIYE

SEQ ID NO: 1650735 - protein, 17 aa, Staphylococcus aureus
TAYSEIYDYQWNEKLIP

SEQ ID NO: 1650736 - protein, 19 aa, Staphylococcus aureus
TDLLKCHYCGYQETPPNQC

SEQ ID NO: 1650737 - protein, 17 aa, Staphylococcus aureus
VNFSEPFPEINDINDQR

SEQ ID NO: 1650738 - protein, 18 aa, Staphylococcus aureus
VNNIPIITSHALRHTHCS

SEQ ID NO: 1650739 - protein, 18 aa, Staphylococcus aureus
YFGQSSINIADWAQNNNY

SEQ ID NO: 1650740 - protein, 18 aa, Staphylococcus aureus
YTLDFYLKPFVKTKIKAW

SEQ ID NO: 1650741 - protein, 21 aa, Staphylococcus aureus
AEGRLVLADAVYYANQYQPSV

SEQ ID NO: 1650742 - protein, 25 aa, Staphylococcus aureus
AEIYGMKVARDLVHISGDTSDYHIE

SEQ ID NO: 1650743 - protein, 23 aa, Staphylococcus aureus
AGAEVLGVVAIFTYGLKKADDTF

SEQ ID NO: 1650744 - protein, 17 aa, Staphylococcus aureus
AKLANIHFVDTKINHHE

SEQ ID NO: 1650745 - protein, 19 aa, Staphylococcus aureus
ALKSACRVNNIPIITSHAL

SEQ ID NO: 1650746 - protein, 17 aa, Staphylococcus aureus
ALNKAYDLFSMMDGVDK

SEQ ID NO: 1650747 - protein, 25 aa, Staphylococcus aureus
ANEVLKMPFHYVLSIYQNKNNDISE

SEQ ID NO: 1650748 - protein, 18 aa, Staphylococcus aureus
ARHEILRTQYIVVDDEVR

SEQ ID NO: 1650749 - protein, 25 aa, Staphylococcus aureus
ASRLANEKHIDWLVKAVIVAKRQVP

SEQ ID NO: 1650750 - protein, 27 aa, Staphylococcus aureus
ATEAKRKGLEPLAIWMKARKHEVSIEE

SEQ ID NO: 1650751 - protein, 17 aa, Staphylococcus aureus
DAIPELKKVATTDERPM

SEQ ID NO: 1650752 - protein, 24 aa, Staphylococcus aureus
DEGSFKWGVTTSLSYFPKDNSEFF

SEQ ID NO: 1650753 - protein, 22 aa, Staphylococcus aureus
DGDHGVNMVRGFSSLKDKLDDS

SEQ ID NO: 1650754 - protein, 19 aa, Staphylococcus aureus
DHLIDYFILPLRQIEQVSI

SEQ ID NO: 1650755 - protein, 17 aa, Staphylococcus aureus
DPMKFLPEDGSLQLTAG

SEQ ID NO: 1650756 - protein, 19 aa, Staphylococcus aureus
DTYSFPRVWLDKDSYDFSF

SEQ ID NO: 1650757 - protein, 18 aa, Staphylococcus aureus
EIRLRPSYFPFTEPSVEV

SEQ ID NO: 1650758 - protein, 26 aa, Staphylococcus aureus
ELLRFRYWDCPIGCYEWEDIAHYFGT

SEQ ID NO: 1650759 - protein, 24 aa, Staphylococcus aureus
EQMSQCFKQSLGATEEQMLYFGLP

SEQ ID NO: 1650760 - protein, 24 aa, Staphylococcus aureus
ESKIKTVLHGLNFSEEDFNKPIND

SEQ ID NO: 1650761 - protein, 20 aa, Staphylococcus aureus
ETLKTLSLDGYMVVIDTGVK

SEQ ID NO: 1650762 - protein, 21 aa, Staphylococcus aureus
EVSEAAVLNANYIKARLSEHF

SEQ ID NO: 1650763 - protein, 23 aa, Staphylococcus aureus
EYKDVVFIYPMHRNPKVRAIAEK

SEQ ID NO: 1650764 - protein, 19 aa, Staphylococcus aureus
EYYQLLLIKMWQLSQIYKP

SEQ ID NO: 1650765 - protein, 17 aa, Staphylococcus aureus
FDEWRYLPDGSDNPDFN

SEQ ID NO: 1650766 - protein, 17 aa, Staphylococcus aureus
FIICTAPLTKETHHKFN

SEQ ID NO: 1650767 - protein, 18 aa, Staphylococcus aureus
FNRQVFQQVVDYLNMNQS

SEQ ID NO: 1650768 - protein, 20 aa, Staphylococcus aureus
GDLTPVFFGSALANFGVQNF

SEQ ID NO: 1650769 - protein, 36 aa, Staphylococcus aureus
GGERALTAIALLFAILKVRSAPFVILDEVEAALDEA

SEQ ID NO: 1650770 - protein, 17 aa, Staphylococcus aureus
GQILLPHHTHARVGIAL

SEQ ID NO: 1650771 - protein, 23 aa, Staphylococcus aureus
HDIKSPMVGTFFLQDSKELTEPI

SEQ ID NO: 1650772 - protein, 20 aa, Staphylococcus aureus
IALALMRISKAILNNENNVL

SEQ ID NO: 1650773 - protein, 24 aa, Staphylococcus aureus
IFKEERTVYLPKAYHPLLNRETVV

SEQ ID NO: 1650774 - protein, 18 aa, Staphylococcus aureus
IIDESGLHFRVGPLETTV

SEQ ID NO: 1650775 - protein, 19 aa, Staphylococcus aureus
IITSHALRHTHCSYLLAKG

SEQ ID NO: 1650776 - protein, 17 aa, Staphylococcus aureus
IIVICLSSGISGSYQSS

SEQ ID NO: 1650777 - protein, 17 aa, Staphylococcus aureus
IRGSDAFIFESNHDVDM

SEQ ID NO: 1650778 - protein, 22 aa, Staphylococcus aureus
IRTNLEIPPFIQALTSIEENML

SEQ ID NO: 1650779 - protein, 18 aa, Staphylococcus aureus
ITSLKKRGAKNIRFMCLI

SEQ ID NO: 1650780 - protein, 23 aa, Staphylococcus aureus
KDGRRAPFSSIYFLLTDDNISHF

SEQ ID NO: 1650781 - protein, 26 aa, Staphylococcus aureus
KENAGPSWKYLKFIFNKDEEKNNIMF

SEQ ID NO: 1650782 - protein, 22 aa, Staphylococcus aureus
KENFRRNHCETLIEAVPGNLLK

SEQ ID NO: 1650783 - protein, 26 aa, Staphylococcus aureus
KIAPALATGCSLVMKPSEITPLTTIR

SEQ ID NO: 1650784 - protein, 22 aa, Staphylococcus aureus
KKFPDALFIFLAPPSLDHLRER

SEQ ID NO: 1650785 - protein, 24 aa, Staphylococcus aureus
KQLNDLYCSRILRYNEIAFKKFDS

SEQ ID NO: 1650786 - protein, 18 aa, Staphylococcus aureus
KRGQIVGLVGANGAGKTT

SEQ ID NO: 1650787 - protein, 23 aa, Staphylococcus aureus
KTTTIGKLAYRYKMEGKKVMLAA

SEQ ID NO: 1650788 - protein, 25 aa, Staphylococcus aureus
LEHIPFKNVCQAVVYISGQKKGDVV

SEQ ID NO: 1650789 - protein, 21 aa, Staphylococcus aureus
LELYKNYKGNITRFVAENDAL

SEQ ID NO: 1650790 - protein, 18 aa, Staphylococcus aureus
LKNRERQLLLSVDNIECI

SEQ ID NO: 1650791 - protein, 23 aa, Staphylococcus aureus
LLGYGDMLYLGSGMNKPIRVQGT

SEQ ID NO: 1650792 - protein, 26 aa, Staphylococcus aureus
LMPSGLPIHEWLMLKQFSKYKSAPSL

SEQ ID NO: 1650793 - protein, 18 aa, Staphylococcus aureus
LQQDGIICYIQFQMKYLA

SEQ ID NO: 1650794 - protein, 17 aa, Staphylococcus aureus
MDMLKKHQKQAVNFQNY

SEQ ID NO: 1650795 - protein, 26 aa, Staphylococcus aureus
MHIGLRANKKDFGWIYSSSLASSAAV

SEQ ID NO: 1650796 - protein, 17 aa, Staphylococcus aureus
MNNRIYGGYSLLLDVNY

SEQ ID NO: 1650797 - protein, 27 aa, Staphylococcus aureus
NFDLAHELGHLVLHRHIQFDLLSPEEY

SEQ ID NO: 1650798 - protein, 21 aa, Staphylococcus aureus
NSITRPSFRVPNDDALMYYEQ

SEQ ID NO: 1650799 - protein, 17 aa, Staphylococcus aureus
PEDAVTYHMPTHCPSCG

SEQ ID NO: 1650800 - protein, 17 aa, Staphylococcus aureus
PFYEDVLGLNIINETLT

SEQ ID NO: 1650801 - protein, 19 aa, Staphylococcus aureus
PGKLDRLTAAFKNNDNIDM

SEQ ID NO: 1650802 - protein, 23 aa, Staphylococcus aureus
PHTEFKAEVYVLSKDEGGRHTPF

SEQ ID NO: 1650803 - protein, 19 aa, Staphylococcus aureus
PKFFKQMLVDFMDKTNYTC

SEQ ID NO: 1650804 - protein, 20 aa, Staphylococcus aureus
PKFKDAMHLADFFDAPYEMF

SEQ ID NO: 1650805 - protein, 19 aa, Staphylococcus aureus
PKTTIAQNFVSTVIQTEPS

SEQ ID NO: 1650806 - protein, 23 aa, Staphylococcus aureus
PLDESLYPIIRDICQEVKVHGDK

SEQ ID NO: 1650807 - protein, 21 aa, Staphylococcus aureus
PRAEENIQLIIMIIEDGTYVM

SEQ ID NO: 1650808 - protein, 25 aa, Staphylococcus aureus
QTYNFKNAIIATGSRPIEIPNFKFG

SEQ ID NO: 1650809 - protein, 24 aa, Staphylococcus aureus
RINDSIDAYSFWSKDQTPFIILGT

SEQ ID NO: 1650810 - protein, 19 aa, Staphylococcus aureus
RKANEIGTLMHTVMQHLPF

SEQ ID NO: 1650811 - protein, 19 aa, Staphylococcus aureus
RPAIDVIIPGAKRAEQVIE

SEQ ID NO: 1650812 - protein, 22 aa, Staphylococcus aureus
RYPIRALMMSHMFVEVDGNVHA

SEQ ID NO: 1650813 - protein, 18 aa, Staphylococcus aureus
SKFDGIFLVATNPVDILA

SEQ ID NO: 1650814 - protein, 33 aa, Staphylococcus aureus
SQYSNCPIFTFGRSSGAYLSLLIARDRDIDGVI

SEQ ID NO: 1650815 - protein, 19 aa, Staphylococcus aureus
STQYRYFWASLNKKGYKSK

SEQ ID NO: 1650816 - protein, 20 aa, Staphylococcus aureus
STYYGIALALMRISKAILNN

SEQ ID NO: 1650817 - protein, 26 aa, Staphylococcus aureus
TAMKLRQRVWRRLAKDLKPENLHEIK

SEQ ID NO: 1650818 - protein, 17 aa, Staphylococcus aureus
TKVGIGPGRVCITKIKT

SEQ ID NO: 1650819 - protein, 26 aa, Staphylococcus aureus
VELDNGFDFYAPQTFLDEKGRRVLIG

SEQ ID NO: 1650820 - protein, 27 aa, Staphylococcus aureus
VGASTYRKQFCKLLLKSAKVSVIKGNA

SEQ ID NO: 1650821 - protein, 19 aa, Staphylococcus aureus
VLREPGFFRHLKVMPHAQE

SEQ ID NO: 1650822 - protein, 19 aa, Staphylococcus aureus
VNAGLKVKLLDIVVDKNDP

SEQ ID NO: 1650823 - protein, 18 aa, Staphylococcus aureus
VQYESVFDFEEMINRAVE

SEQ ID NO: 1650824 - protein, 25 aa, Staphylococcus aureus
VTAQYPPQLAFAIGNAIKYLSRAPL

SEQ ID NO: 1650825 - protein, 18 aa, Staphylococcus aureus
WVQEYAPILYQIWKKKHK

SEQ ID NO: 1650826 - protein, 19 aa, Staphylococcus aureus
YDCYFCIVDQHAITMPQDR

SEQ ID NO: 1650827 - protein, 25 aa, Staphylococcus aureus
YFNKLSVFRKLFGNLTYSNTLYENN

SEQ ID NO: 1650828 - protein, 17 aa, Staphylococcus aureus
YHQAGFNHVHYHTGPMS

SEQ ID NO: 1650829 - protein, 27 aa, Staphylococcus aureus
YKTSKKLVKFMLVFCSNSMTAEEIHLC

SEQ ID NO: 1650830 - protein, 18 aa, Staphylococcus aureus
YLASSYFRSSGYDGFMQD

SEQ ID NO: 1650831 - protein, 30 aa, Staphylococcus aureus
YPIKEKIQHVFKSGCGFDNDSNKGFVYTKI

SEQ ID NO: 1650832 - protein, 20 aa, Staphylococcus aureus
YSTSIFQHAFHVSRDKILET

SEQ ID NO: 1650833 - protein, 22 aa, Staphylococcus aureus
AALARSEADWIVGINATRALTT

SEQ ID NO: 1650834 - protein, 17 aa, Staphylococcus aureus
ADRLMDVLFEMRKVNIE

SEQ ID NO: 1650835 - protein, 20 aa, Staphylococcus aureus
AIREKLNIVNQGLLDPEKYK

SEQ ID NO: 1650836 - protein, 17 aa, Staphylococcus aureus
ANYGGVRAFTASAGPGL

SEQ ID NO: 1650837 - protein, 22 aa, Staphylococcus aureus
DEVAVGFGRTGKMFACNHEDVQ

SEQ ID NO: 1650838 - protein, 23 aa, Staphylococcus aureus
DGTAIHIIVPIAAVDKVTHLRAL

SEQ ID NO: 1650839 - protein, 18 aa, Staphylococcus aureus
DKGKRLELVVTDDEAQSQ

SEQ ID NO: 1650840 - protein, 18 aa, Staphylococcus aureus
DVFIGVSVANALSQDMVK

SEQ ID NO: 1650841 - protein, 21 aa, Staphylococcus aureus
EEDTCKFILKSVVQVEDNIER

SEQ ID NO: 1650842 - protein, 20 aa, Staphylococcus aureus
ELLRQKVDFDYDIKTVFKAN

SEQ ID NO: 1650843 - protein, 20 aa, Staphylococcus aureus
FDDFWKQRQVPLSQIKTPLL

SEQ ID NO: 1650844 - protein, 18 aa, Staphylococcus aureus
FEALRAWLDDEIVADSWL

SEQ ID NO: 1650845 - protein, 23 aa, Staphylococcus aureus
FKELKIKAFEAHASQTGPFLKQL

SEQ ID NO: 1650846 - protein, 19 aa, Staphylococcus aureus
FNAEKGFGFIEVEGENDVF

SEQ ID NO: 1650847 - protein, 17 aa, Staphylococcus aureus
FRPSYQNVISKVFTLPQ

SEQ ID NO: 1650848 - protein, 19 aa, Staphylococcus aureus
FTPNFNFNDYHIMIVHPWQ

SEQ ID NO: 1650849 - protein, 26 aa, Staphylococcus aureus
GCGSIGLLAIQWARIFGAAHIIAIDI

SEQ ID NO: 1650850 - protein, 25 aa, Staphylococcus aureus
GCVIFDEIHYFFGPEMVNVKRGGLG

SEQ ID NO: 1650851 - protein, 18 aa, Staphylococcus aureus
GKIPGGFKKREGRPGDDA

SEQ ID NO: 1650852 - protein, 23 aa, Staphylococcus aureus
GKTRLRPGGKEATDWLIQQGAFS

SEQ ID NO: 1650853 - protein, 24 aa, Staphylococcus aureus
GMDSTCPKDVLTQLEFSDEDVDII

SEQ ID NO: 1650854 - protein, 18 aa, Staphylococcus aureus
GVFGGALTYGCIGEPQAP

SEQ ID NO: 1650855 - protein, 17 aa, Staphylococcus aureus
HDFRPSYQNVISKVFTL

SEQ ID NO: 1650856 - protein, 26 aa, Staphylococcus aureus
HMHGDHIFGLPGLLSSRSFQGGEQKP

SEQ ID NO: 1650857 - protein, 24 aa, Staphylococcus aureus
HQVVIRCLMVYFNKVSREEAVDLK

SEQ ID NO: 1650858 - protein, 17 aa, Staphylococcus aureus
HRAAVGISEVSDAFTVI

SEQ ID NO: 1650859 - protein, 17 aa, Staphylococcus aureus
ICGDDTCLIICRSKEAS

SEQ ID NO: 1650860 - protein, 23 aa, Staphylococcus aureus
IEDLKEGMKLSGTVRNVVDFGAF

SEQ ID NO: 1650861 - protein, 24 aa, Staphylococcus aureus
IGDQCPICGNEIQDLGHHIDFDSI

SEQ ID NO: 1650862 - protein, 17 aa, Staphylococcus aureus
IKAGVHLNKLTEERSKR

SEQ ID NO: 1650863 - protein, 22 aa, Staphylococcus aureus
IKLEVLRNPKAIHGLLAPRIDT

SEQ ID NO: 1650864 - protein, 25 aa, Staphylococcus aureus
IKNAGLRLKFLKSETSGVAVWGKIY

SEQ ID NO: 1650865 - protein, 17 aa, Staphylococcus aureus
INRNGKIAISFREDDEL

SEQ ID NO: 1650866 - protein, 26 aa, Staphylococcus aureus
IPEWTNGKFLPKRKVVKIEQFENEIK

SEQ ID NO: 1650867 - protein, 23 aa, Staphylococcus aureus
ISPVLWKKVKKGLSAGRVQSVAL

SEQ ID NO: 1650868 - protein, 21 aa, Staphylococcus aureus
KAYNFKSVCVNPTHVKYAAER

SEQ ID NO: 1650869 - protein, 19 aa, Staphylococcus aureus
KHSKDMAKNHYFDHTNLKG

SEQ ID NO: 1650870 - protein, 18 aa, Staphylococcus aureus
KIWERWLHTQGYKDIHLD

SEQ ID NO: 1650871 - protein, 18 aa, Staphylococcus aureus
KMETARIQVMSDFSSRLY

SEQ ID NO: 1650872 - protein, 17 aa, Staphylococcus aureus
KSEVWRQMMSDIFDTEL

SEQ ID NO: 1650873 - protein, 24 aa, Staphylococcus aureus
LNFECGRFIVAHIGYYVTEVLDIK

SEQ ID NO: 1650874 - protein, 21 aa, Staphylococcus aureus
LSLLLRRPPGREAYPGDVFYL

SEQ ID NO: 1650875 - protein, 25 aa, Staphylococcus aureus
LVIEIKKLYPFVFNTLFEAIDKLAI

SEQ ID NO: 1650876 - protein, 25 aa, Staphylococcus aureus
LVMKQLFEHRGLPQLPYISFLRSEY

SEQ ID NO: 1650877 - protein, 17 aa, Staphylococcus aureus
LYFDRNILTPQKLLNYL

SEQ ID NO: 1650878 - protein, 30 aa, Staphylococcus aureus
MKIVKKDFTGISFLNLVDFDALYGHRRDKP

SEQ ID NO: 1650879 - protein, 18 aa, Staphylococcus aureus
NYTALTFSYVINRNKSKY

SEQ ID NO: 1650880 - protein, 18 aa, Staphylococcus aureus
PAAPAAVSLEGDFPETTE

SEQ ID NO: 1650881 - protein, 31 aa, Staphylococcus aureus
QKYVHLLSEYGVWHPRAWEFAPSRVDFPTTN

SEQ ID NO: 1650882 - protein, 18 aa, Staphylococcus aureus
RPMIRATAYWAIGQILGE

SEQ ID NO: 1650883 - protein, 17 aa, Staphylococcus aureus
RQMKTFKTELIKMNASY

SEQ ID NO: 1650884 - protein, 18 aa, Staphylococcus aureus
RVQQAIVEGETYQVNYTA

SEQ ID NO: 1650885 - protein, 22 aa, Staphylococcus aureus
SEDAYYKYAHEFSGGQRQRVGI

SEQ ID NO: 1650886 - protein, 20 aa, Staphylococcus aureus
SEIRCRLRSKGQLIINDIAQ

SEQ ID NO: 1650887 - protein, 18 aa, Staphylococcus aureus
SETSGVAVWGKIYGEIKG

SEQ ID NO: 1650888 - protein, 25 aa, Staphylococcus aureus
SNEDKWVYEMLGMDSTCPKDVLTQL

SEQ ID NO: 1650889 - protein, 25 aa, Staphylococcus aureus
SSYNLKCLLLKLTYRYLDNQPLNDA

SEQ ID NO: 1650890 - protein, 18 aa, Staphylococcus aureus
TAGFDMYDLDLAKKHNIV

SEQ ID NO: 1650891 - protein, 26 aa, Staphylococcus aureus
TGDALKPLIKEGIKLNGLISNPPYID

SEQ ID NO: 1650892 - protein, 21 aa, Staphylococcus aureus
VEEQKVIIIYALIQAKEPVKQ

SEQ ID NO: 1650893 - protein, 25 aa, Staphylococcus aureus
VKNSRLFAFYCKLDDPKEVDDRQTW

SEQ ID NO: 1650894 - protein, 17 aa, Staphylococcus aureus
WKETEIFFEKLTDLLDF

SEQ ID NO: 1650895 - protein, 17 aa, Staphylococcus aureus
YDLFSMMDGVDKHLAVI

SEQ ID NO: 1650896 - protein, 19 aa, Staphylococcus aureus
YDMTHVFHIQGEYILQQCS

SEQ ID NO: 1650897 - protein, 18 aa, Staphylococcus aureus
YKDYGIRKYGFHGTSHKF

SEQ ID NO: 1650898 - protein, 17 aa, Staphylococcus aureus
YPDIKVEVSEPLGTHPL

SEQ ID NO: 1650899 - protein, 28 aa, Staphylococcus aureus
AAGYKPGEEVFLGFDCASSEFYENGVYD

SEQ ID NO: 1650900 - protein, 22 aa, Staphylococcus aureus
ADIKGLKIWVFAVDEGSEIRCR

SEQ ID NO: 1650901 - protein, 18 aa, Staphylococcus aureus
AIKNNRKIVTFGRSMENN

SEQ ID NO: 1650902 - protein, 20 aa, Staphylococcus aureus
CSKYPECDFISWDKPIGRDC

SEQ ID NO: 1650903 - protein, 20 aa, Staphylococcus aureus
DGVWLRELEQAISNGTQNDI

SEQ ID NO: 1650904 - protein, 17 aa, Staphylococcus aureus
DLLNNFVRRVCDCKGQW

SEQ ID NO: 1650905 - protein, 18 aa, Staphylococcus aureus
DLTELVLTLGSQMVVLAN

SEQ ID NO: 1650906 - protein, 23 aa, Staphylococcus aureus
DTADFPYTIRIVSEVLESNGSSS

SEQ ID NO: 1650907 - protein, 20 aa, Staphylococcus aureus
EALLKKGIKTIMLGGQVKEN

SEQ ID NO: 1650908 - protein, 20 aa, Staphylococcus aureus
ECAYSYIVQIDVFVKYNDEY

SEQ ID NO: 1650909 - protein, 26 aa, Staphylococcus aureus
EKLLYSCWASIDGVWLRELEQAISNG

SEQ ID NO: 1650910 - protein, 19 aa, Staphylococcus aureus
ELSALIRMNGALSLSNQQF

SEQ ID NO: 1650911 - protein, 19 aa, Staphylococcus aureus
ETLMPAIIELKKAYKEAKA

SEQ ID NO: 1650912 - protein, 24 aa, Staphylococcus aureus
EVARLDYISKLGFSYADMEKQGII

SEQ ID NO: 1650913 - protein, 17 aa, Staphylococcus aureus
FNPPMFARVFRKHLEGG

SEQ ID NO: 1650914 - protein, 26 aa, Staphylococcus aureus
FTQKSPRWAIAYKFPAEEVVTKLLDI

SEQ ID NO: 1650915 - protein, 24 aa, Staphylococcus aureus
FVRYLSMNFKDYFTSIKLVNAINL

SEQ ID NO: 1650916 - protein, 19 aa, Staphylococcus aureus
GLGEPFSKEVALVMMILRL

SEQ ID NO: 1650917 - protein, 19 aa, Staphylococcus aureus
GMKQRVALCRAHVHKPNVI

SEQ ID NO: 1650918 - protein, 28 aa, Staphylococcus aureus
IKDTMFAPFIDYKCVTTMRLEDEAHHYT

SEQ ID NO: 1650919 - protein, 17 aa, Staphylococcus aureus
ILKIGAITKGARGYLTF

SEQ ID NO: 1650920 - protein, 22 aa, Staphylococcus aureus
IMICTGCRVSGARNIKIEHINQ

SEQ ID NO: 1650921 - protein, 17 aa, Staphylococcus aureus
INGCHYCVDIHKKELKE

SEQ ID NO: 1650922 - protein, 24 aa, Staphylococcus aureus
IQAARLRVMLDYMWEDIKEKGDYD

SEQ ID NO: 1650923 - protein, 17 aa, Staphylococcus aureus
IRNELHIPVKYVGLGEQ

SEQ ID NO: 1650924 - protein, 20 aa, Staphylococcus aureus
KAVHMGDIFPTTAHKNPLWV

SEQ ID NO: 1650925 - protein, 23 aa, Staphylococcus aureus
KELLDLLRLHLSLFNKYEKDEIR

SEQ ID NO: 1650926 - protein, 20 aa, Staphylococcus aureus
KLGAINVHASLLPKYRGGAP

SEQ ID NO: 1650927 - protein, 21 aa, Staphylococcus aureus
KLKVVDGLIIQAARLRVMLDY

SEQ ID NO: 1650928 - protein, 19 aa, Staphylococcus aureus
KTAQELADFLGRPVDEIVK

SEQ ID NO: 1650929 - protein, 20 aa, Staphylococcus aureus
KVFIHHVALHVSHRKDLKFN

SEQ ID NO: 1650930 - protein, 17 aa, Staphylococcus aureus
LAEEKGHEIVGVIENTP

SEQ ID NO: 1650931 - protein, 19 aa, Staphylococcus aureus
LFSLKGALWTLAQEVYQEW

SEQ ID NO: 1650932 - protein, 18 aa, Staphylococcus aureus
LFSQGRLKDAKNYVLHQP

SEQ ID NO: 1650933 - protein, 18 aa, Staphylococcus aureus
LPSSVKRGDYLAILSTGA

SEQ ID NO: 1650934 - protein, 17 aa, Staphylococcus aureus
LQVNLIRSHACGLGEPF

SEQ ID NO: 1650935 - protein, 21 aa, Staphylococcus aureus
LRPEIKFDGIDPLVKQMNDDK

SEQ ID NO: 1650936 - protein, 25 aa, Staphylococcus aureus
MDDGRCYLCPCLGYPRQWRSEDIYQ

SEQ ID NO: 1650937 - protein, 17 aa, Staphylococcus aureus
MEMEGLLQLVNPKIISQ

SEQ ID NO: 1650938 - protein, 23 aa, Staphylococcus aureus
NAIYEFQYAYGLPDYGIIGMQLP

SEQ ID NO: 1650939 - protein, 20 aa, Staphylococcus aureus
NCVAPGPFWSPLQISGGQPQ

SEQ ID NO: 1650940 - protein, 20 aa, Staphylococcus aureus
NECDLSYDITSLYTFKQPVS

SEQ ID NO: 1650941 - protein, 28 aa, Staphylococcus aureus
PKDLNDFGPAWIERFVRVQIEEAFAVAL

SEQ ID NO: 1650942 - protein, 28 aa, Staphylococcus aureus
PYVTKFSMKWFLAMPRAKAWMINTRTPD

SEQ ID NO: 1650943 - protein, 24 aa, Staphylococcus aureus
QSMYLKDTRIEIVGVNKKDPLQYA

SEQ ID NO: 1650944 - protein, 23 aa, Staphylococcus aureus
QYNGKRPVYFTALLFNKLTSNIL

SEQ ID NO: 1650945 - protein, 26 aa, Staphylococcus aureus
RDQAKKRKKACIIVTHDERLKAYCDR

SEQ ID NO: 1650946 - protein, 18 aa, Staphylococcus aureus
RESGGLLMYGIPNMKLDK

SEQ ID NO: 1650947 - protein, 18 aa, Staphylococcus aureus
RKKAKAFIDDYLASFPGV

SEQ ID NO: 1650948 - protein, 20 aa, Staphylococcus aureus
SDAQLIWGVKKGYEHIFQQH

SEQ ID NO: 1650949 - protein, 25 aa, Staphylococcus aureus
SFISEIKSAVKIGDQCPICGNEIQD

SEQ ID NO: 1650950 - protein, 23 aa, Staphylococcus aureus
SRGMRMKIALTIALSHDVKLLIL

SEQ ID NO: 1650951 - protein, 20 aa, Staphylococcus aureus
SRLESFIMLELQRIKGASVK

SEQ ID NO: 1650952 - protein, 25 aa, Staphylococcus aureus
SSGSFTRNEVRIMLGEEPSDNPELD

SEQ ID NO: 1650953 - protein, 17 aa, Staphylococcus aureus
TSAHGRTLLAIKDEQQM

SEQ ID NO: 1650954 - protein, 21 aa, Staphylococcus aureus
TVTTLCPCSKEISEYSAHNQR

SEQ ID NO: 1650955 - protein, 18 aa, Staphylococcus aureus
TWKDLFNDFEMHFYRYVF

SEQ ID NO: 1650956 - protein, 23 aa, Staphylococcus aureus
VFQGEALLFFLGLTNSMAGFEKL

SEQ ID NO: 1650957 - protein, 17 aa, Staphylococcus aureus
VILAEIFDKVGVPKGVF

SEQ ID NO: 1650958 - protein, 19 aa, Staphylococcus aureus
YIDAFKVFIHHVALHVSHR

SEQ ID NO: 1650959 - protein, 24 aa, Staphylococcus aureus
AAGYACGYHLVKYFLQKTNIPIEV

SEQ ID NO: 1650960 - protein, 18 aa, Staphylococcus aureus
AEELYKYPVQDIMTEEFS

SEQ ID NO: 1650961 - protein, 24 aa, Staphylococcus aureus
AIQLALNVVEPFASGIGGGGYLLY

SEQ ID NO: 1650962 - protein, 24 aa, Staphylococcus aureus
ARRVLAIECVIALQAAELKGVEGL

SEQ ID NO: 1650963 - protein, 20 aa, Staphylococcus aureus
CIEFVARAVAQSHFKVLEGN

SEQ ID NO: 1650964 - protein, 17 aa, Staphylococcus aureus
CNYLKDLFDKYDIKSEI

SEQ ID NO: 1650965 - protein, 18 aa, Staphylococcus aureus
DIENGLKGEEKVLIEQMA

SEQ ID NO: 1650966 - protein, 20 aa, Staphylococcus aureus
DIFLGIPYAEPPVHDNRFKH

SEQ ID NO: 1650967 - protein, 19 aa, Staphylococcus aureus
DKGLIYKGKKPVYWSPSSE

SEQ ID NO: 1650968 - protein, 17 aa, Staphylococcus aureus
DKSYPYISFIPMTDDVE

SEQ ID NO: 1650969 - protein, 20 aa, Staphylococcus aureus
DTIEMERLFNGLKDEGAILM

SEQ ID NO: 1650970 - protein, 25 aa, Staphylococcus aureus
DTMALPPCHTMFQFYVQDGKLSCQL

SEQ ID NO: 1650971 - protein, 18 aa, Staphylococcus aureus
DVGNLYLNRGCTSAVVGY

SEQ ID NO: 1650972 - protein, 20 aa, Staphylococcus aureus
EALMGKYRISGVPIVDNKED

SEQ ID NO: 1650973 - protein, 17 aa, Staphylococcus aureus
EDIAFADSRIRKETIAA

SEQ ID NO: 1650974 - protein, 23 aa, Staphylococcus aureus
EEFYKVAQALLINIGTLTAQNEQ

SEQ ID NO: 1650975 - protein, 20 aa, Staphylococcus aureus
EEVEKAYQFLVNEGYESISA

SEQ ID NO: 1650976 - protein, 25 aa, Staphylococcus aureus
EFYPHLNTGMSFIRGVGYPKQQFAN

SEQ ID NO: 1650977 - protein, 27 aa, Staphylococcus aureus
EGPERFWPADLVLLSIGFEGTEPTVPN

SEQ ID NO: 1650978 - protein, 19 aa, Staphylococcus aureus
EHYAIEAKPGICIIGEVVG

SEQ ID NO: 1650979 - protein, 24 aa, Staphylococcus aureus
EKHHLRVVGGFQFSSHKSDDEWRE

SEQ ID NO: 1650980 - protein, 18 aa, Staphylococcus aureus
ENRLPFILFSASGGARMQ

SEQ ID NO: 1650981 - protein, 26 aa, Staphylococcus aureus
ESLPVYKPTLPPMVFGNRDKKIKGGT

SEQ ID NO: 1650982 - protein, 18 aa, Staphylococcus aureus
FEERLKAVLKEVKESDGR

SEQ ID NO: 1650983 - protein, 18 aa, Staphylococcus aureus
FINPFEVVYYAGGTSNAF

SEQ ID NO: 1650984 - protein, 17 aa, Staphylococcus aureus
FNAKLLAMICNRPNVRQ

SEQ ID NO: 1650985 - protein, 20 aa, Staphylococcus aureus
FTPKYHKLAEAERNWINSQK

SEQ ID NO: 1650986 - protein, 18 aa, Staphylococcus aureus
GRDGFVMGEGAGILVIES

SEQ ID NO: 1650987 - protein, 17 aa, Staphylococcus aureus
GTASIGVFNNYQRNDAC

SEQ ID NO: 1650988 - protein, 27 aa, Staphylococcus aureus
GTYRALTKVFTRFGIEVDFVDTTHTDS

SEQ ID NO: 1650989 - protein, 19 aa, Staphylococcus aureus
GTYYPRTFIQQLFVDGYFG

SEQ ID NO: 1650990 - protein, 19 aa, Staphylococcus aureus
IAISDRFKLLQSQYTDEKY

SEQ ID NO: 1650991 - protein, 19 aa, Staphylococcus aureus
IDEGCLIEDGHCIRTIHAE

SEQ ID NO: 1650992 - protein, 22 aa, Staphylococcus aureus
IDKSNVRFVIHYNMPGDLESYY

SEQ ID NO: 1650993 - protein, 23 aa, Staphylococcus aureus
IHEKLYDLIMCHLQRYKNENDQI

SEQ ID NO: 1650994 - protein, 17 aa, Staphylococcus aureus
IIDRQGNVVNRFLPMED

SEQ ID NO: 1650995 - protein, 20 aa, Staphylococcus aureus
ILGICLGAQALTCYYGGEVI

SEQ ID NO: 1650996 - protein, 22 aa, Staphylococcus aureus
IMKEEKDRLSGEDTREGMTAII

SEQ ID NO: 1650997 - protein, 20 aa, Staphylococcus aureus
IRLLYARVGKPYCPNHNIEI

SEQ ID NO: 1650998 - protein, 19 aa, Staphylococcus aureus
KAQIYGFIVGSGLRGPLHK

SEQ ID NO: 1650999 - protein, 19 aa, Staphylococcus aureus
KEQLRTNVGMVFQQPNPFP

SEQ ID NO: 1651000 - protein, 17 aa, Staphylococcus aureus
KEVAPKLEIHLSTQQSL

SEQ ID NO: 1651001 - protein, 20 aa, Staphylococcus aureus
KGTVEAILFQNSDNFYTVLK

SEQ ID NO: 1651002 - protein, 21 aa, Staphylococcus aureus
KLEDDALCFYDIGSSEMNVDM

SEQ ID NO: 1651003 - protein, 25 aa, Staphylococcus aureus
KLILFEKHFEPVPGIKMQHSGGHSF

SEQ ID NO: 1651004 - protein, 18 aa, Staphylococcus aureus
KMGLQIRHYTVQSLKLLK

SEQ ID NO: 1651005 - protein, 19 aa, Staphylococcus aureus
LANFLYFVAQKNMGIGAGD

SEQ ID NO: 1651006 - protein, 21 aa, Staphylococcus aureus
LDTESLLGFKTIKTNAEGQQE

SEQ ID NO: 1651007 - protein, 23 aa, Staphylococcus aureus
LEKLQKILILKSFDFDIAKIKQY

SEQ ID NO: 1651008 - protein, 19 aa, Staphylococcus aureus
LEKTRKALEDYGIDYDQII

SEQ ID NO: 1651009 - protein, 21 aa, Staphylococcus aureus
LETFLFFSGFYYPLYLAGQGK

SEQ ID NO: 1651010 - protein, 17 aa, Staphylococcus aureus
LKAREKYGLEKVIADNY

SEQ ID NO: 1651011 - protein, 25 aa, Staphylococcus aureus
LKKRTHFNIAGAFNPNVRKLDGAVK

SEQ ID NO: 1651012 - protein, 25 aa, Staphylococcus aureus
LKNVFDLLPVNAFRDKVIGLVATAG

SEQ ID NO: 1651013 - protein, 26 aa, Staphylococcus aureus
LNGPKARLKLLVALSNNLDKAEIKSY

SEQ ID NO: 1651014 - protein, 17 aa, Staphylococcus aureus
LVVSGRMPAVSNIQEDH

SEQ ID NO: 1651015 - protein, 18 aa, Staphylococcus aureus
MGIIKMKLPIEDLEKKQK

SEQ ID NO: 1651016 - protein, 23 aa, Staphylococcus aureus
MPKEERPRLTLVAFSNDATEALG

SEQ ID NO: 1651017 - protein, 18 aa, Staphylococcus aureus
MYIIVSYGVKISEVANNV

SEQ ID NO: 1651018 - protein, 17 aa, Staphylococcus aureus
NEIKATHIYNAISGQQQ

SEQ ID NO: 1651019 - protein, 17 aa, Staphylococcus aureus
NEYQGAVVVFTGHVREW

SEQ ID NO: 1651020 - protein, 18 aa, Staphylococcus aureus
NSNEYPEIVFVGNHLSST

SEQ ID NO: 1651021 - protein, 24 aa, Staphylococcus aureus
NYYMYKKFGVIPEMEYEMEEVKEI

SEQ ID NO: 1651022 - protein, 24 aa, Staphylococcus aureus
PGAAVKYIEIEGVLHEFSAVDNVV

SEQ ID NO: 1651023 - protein, 19 aa, Staphylococcus aureus
PKLGQSTGFDYTRTKNPTR

SEQ ID NO: 1651024 - protein, 17 aa, Staphylococcus aureus
PTNLKIIKSYGANVEMV

SEQ ID NO: 1651025 - protein, 17 aa, Staphylococcus aureus
QEMEYRKLGKYPPYYYL

SEQ ID NO: 1651026 - protein, 19 aa, Staphylococcus aureus
QHAPGWGLDALKYLIEERR

SEQ ID NO: 1651027 - protein, 26 aa, Staphylococcus aureus
QHCEAFKANFKGAAQGDWVKSAMSEI

SEQ ID NO: 1651028 - protein, 18 aa, Staphylococcus aureus
QIEARLDIVDEFSAHFIE

SEQ ID NO: 1651029 - protein, 18 aa, Staphylococcus aureus
QLVPRLQEAFSNIKVGDP

SEQ ID NO: 1651030 - protein, 24 aa, Staphylococcus aureus
QVANCPKQYLAHVLSKHGFTCKKE

SEQ ID NO: 1651031 - protein, 18 aa, Staphylococcus aureus
RAYLKERNAIMTDIAQDI

SEQ ID NO: 1651032 - protein, 25 aa, Staphylococcus aureus
RESDGFKDIRDVLGQVYETAEELDQ

SEQ ID NO: 1651033 - protein, 23 aa, Staphylococcus aureus
RVGRSSRIGYAYFLHPANKVLTE

SEQ ID NO: 1651034 - protein, 24 aa, Staphylococcus aureus
SGNGFIGQSFIKYDDFETLIEGYP

SEQ ID NO: 1651035 - protein, 22 aa, Staphylococcus aureus
SHLVPYLKVIEQLTLVGQEAGM

SEQ ID NO: 1651036 - protein, 24 aa, Staphylococcus aureus
SIESKEHYRILCIDGGSTDQTIPM

SEQ ID NO: 1651037 - protein, 17 aa, Staphylococcus aureus
SITPYEGGIAFASKPLI

SEQ ID NO: 1651038 - protein, 19 aa, Staphylococcus aureus
SLISTDFIEDFSVFDGQTI

SEQ ID NO: 1651039 - protein, 18 aa, Staphylococcus aureus
SQQQLRYFFSHNHSLPSS

SEQ ID NO: 1651040 - protein, 18 aa, Staphylococcus aureus
SSVMFDFGVLKRPQIFYA

SEQ ID NO: 1651041 - protein, 18 aa, Staphylococcus aureus
TAVGFIRNGGFNIYSHPE

SEQ ID NO: 1651042 - protein, 19 aa, Staphylococcus aureus
TLMPGGVNSPVRAFKSVDT

SEQ ID NO: 1651043 - protein, 19 aa, Staphylococcus aureus
TNDVVKNFTANGLLSIGAS

SEQ ID NO: 1651044 - protein, 23 aa, Staphylococcus aureus
TPMIKYKVPRAFVEISPELAEDR

SEQ ID NO: 1651045 - protein, 26 aa, Staphylococcus aureus
VECHFKRTSRKLFIEKLKSVQYDLQN

SEQ ID NO: 1651046 - protein, 20 aa, Staphylococcus aureus
VQPNAKFPPSLRNMYKELAD

SEQ ID NO: 1651047 - protein, 25 aa, Staphylococcus aureus
WMAMFKDMNFELGIMELYAIESDAL

SEQ ID NO: 1651048 - protein, 19 aa, Staphylococcus aureus
YLDKDLETIVGVQTEKPFK

SEQ ID NO: 1651049 - protein, 17 aa, Staphylococcus aureus
YQGAVVVFTGHVREWTK

SEQ ID NO: 1651050 - protein, 19 aa, Staphylococcus aureus
YQLMFRMGKDSNIHEKLYD

SEQ ID NO: 1651051 - protein, 23 aa, Staphylococcus aureus
ADFADIFCETGVFTIEQSQHYMQ

SEQ ID NO: 1651052 - protein, 18 aa, Staphylococcus aureus
AEHGSNIWFEREAKDLLP

SEQ ID NO: 1651053 - protein, 23 aa, Staphylococcus aureus
AIQEYYPNFTLDYDVDPIRQGIA

SEQ ID NO: 1651054 - protein, 17 aa, Staphylococcus aureus
AIRIFRAAAELDISTVA

SEQ ID NO: 1651055 - protein, 24 aa, Staphylococcus aureus
AIRRRAVPTWGVFLDEEAQGGGPL

SEQ ID NO: 1651056 - protein, 23 aa, Staphylococcus aureus
AIVSVKFDINYSLKPLKLSNRQV

SEQ ID NO: 1651057 - protein, 25 aa, Staphylococcus aureus
AKKRALEILNLVGLPNAEKRFKAYP

SEQ ID NO: 1651058 - protein, 19 aa, Staphylococcus aureus
AKLSLLAEELLRDINKETV

SEQ ID NO: 1651059 - protein, 19 aa, Staphylococcus aureus
ARLDIVDEFSAHFIERDTL

SEQ ID NO: 1651060 - protein, 23 aa, Staphylococcus aureus
ASDLRAGACLIIAGLIAEGVTTI

SEQ ID NO: 1651061 - protein, 25 aa, Staphylococcus aureus
AVIAEKSIEMIIAMIGVLKAGGAYV

SEQ ID NO: 1651062 - protein, 21 aa, Staphylococcus aureus
DEKILKVDGFLNHQIDAKLMN

SEQ ID NO: 1651063 - protein, 22 aa, Staphylococcus aureus
DFEKHMYAIHILTSLYASTSNT

SEQ ID NO: 1651064 - protein, 22 aa, Staphylococcus aureus
DFGYMWECPDYFNVDNQDVILI

SEQ ID NO: 1651065 - protein, 22 aa, Staphylococcus aureus
DIVELLKYLYIEEVAFVCHEMG

SEQ ID NO: 1651066 - protein, 22 aa, Staphylococcus aureus
DKESKQLAAIKQWLPNPETNSA

SEQ ID NO: 1651067 - protein, 25 aa, Staphylococcus aureus
DRIRRLLKMYLERESFEIHEASNGQ

SEQ ID NO: 1651068 - protein, 20 aa, Staphylococcus aureus
DRPLIKPAAFASEIHGESGL

SEQ ID NO: 1651069 - protein, 23 aa, Staphylococcus aureus
DSKELLIADSFYREEYALYDDIF

SEQ ID NO: 1651070 - protein, 18 aa, Staphylococcus aureus
DSPVKYTKHIGGTHHFKY

SEQ ID NO: 1651071 - protein, 27 aa, Staphylococcus aureus
DVKLEPPIKEWEKMGLLTIVDDDVIEI

SEQ ID NO: 1651072 - protein, 19 aa, Staphylococcus aureus
EDKGCPWDKVQTHETLKRY

SEQ ID NO: 1651073 - protein, 19 aa, Staphylococcus aureus
EEEPDIIVIAGDLYDTTYP

SEQ ID NO: 1651074 - protein, 24 aa, Staphylococcus aureus
EENFKRLNNSLARLEMPQVDEAEL

SEQ ID NO: 1651075 - protein, 20 aa, Staphylococcus aureus
EFIHQYPLAVVHVMRDQCSV

SEQ ID NO: 1651076 - protein, 22 aa, Staphylococcus aureus
EFLNKPPSAWVILAKPNLGISS

SEQ ID NO: 1651077 - protein, 19 aa, Staphylococcus aureus
EFTKLTLPLLKNADIYFDN

SEQ ID NO: 1651078 - protein, 24 aa, Staphylococcus aureus
EGELKVSFDYIDWINTEFDQLGRQ

SEQ ID NO: 1651079 - protein, 19 aa, Staphylococcus aureus
EILEMGGGILSTVNATRET

SEQ ID NO: 1651080 - protein, 20 aa, Staphylococcus aureus
EKRDVMISGLGFITIGPGAK

SEQ ID NO: 1651081 - protein, 26 aa, Staphylococcus aureus
ELMLEFQKRGAVAFDYGNNIRQVAFN

SEQ ID NO: 1651082 - protein, 18 aa, Staphylococcus aureus
FAVSRSAGWIAHILEQYK

SEQ ID NO: 1651083 - protein, 17 aa, Staphylococcus aureus
FDHMWGYFKKCANEEER

SEQ ID NO: 1651084 - protein, 19 aa, Staphylococcus aureus
FDKQLALKYRFNRLKLTTI

SEQ ID NO: 1651085 - protein, 30 aa, Staphylococcus aureus
FLTKDLFIDWTWGEKFFRKHLIDYDAASNI

SEQ ID NO: 1651086 - protein, 19 aa, Staphylococcus aureus
GDVVFRKGDKVLQLVNRPN

SEQ ID NO: 1651087 - protein, 18 aa, Staphylococcus aureus
GEKKRAAITHLLNQEISV

SEQ ID NO: 1651088 - protein, 25 aa, Staphylococcus aureus
GGHAPDLIKSAAFSNILPSSTNPTL

SEQ ID NO: 1651089 - protein, 18 aa, Staphylococcus aureus
GKEIHFAHFFEFENHKKD

SEQ ID NO: 1651090 - protein, 23 aa, Staphylococcus aureus
GKFKDFFDFARRIPKRVKTRKLL

SEQ ID NO: 1651091 - protein, 19 aa, Staphylococcus aureus
GKQPMSVTFEFQLNHRIYK

SEQ ID NO: 1651092 - protein, 24 aa, Staphylococcus aureus
HDGKERLNYGASWFEHNQLFIRTD

SEQ ID NO: 1651093 - protein, 17 aa, Staphylococcus aureus
HVEELKRMGANIEVDEG

SEQ ID NO: 1651094 - protein, 32 aa, Staphylococcus aureus
IAIERAAKVLGSWRLEGCTLYVTLEPCVMCAG

SEQ ID NO: 1651095 - protein, 22 aa, Staphylococcus aureus
IDTSCSRGEWGFDPKYDLASMT

SEQ ID NO: 1651096 - protein, 24 aa, Staphylococcus aureus
IGSSEMNVDMAIEMYDGNHRVLKV

SEQ ID NO: 1651097 - protein, 24 aa, Staphylococcus aureus
IIDETLCTMWQGFNYEIDMNQEPG

SEQ ID NO: 1651098 - protein, 21 aa, Staphylococcus aureus
IITKEQLKMFVYDYDTNLIKN

SEQ ID NO: 1651099 - protein, 20 aa, Staphylococcus aureus
IKEHMASLVYKLEEMGVELD

SEQ ID NO: 1651100 - protein, 18 aa, Staphylococcus aureus
IKVVKAVKEATGLGLKDA

SEQ ID NO: 1651101 - protein, 18 aa, Staphylococcus aureus
ILFNYDRLSQYDLTMKIS

SEQ ID NO: 1651102 - protein, 22 aa, Staphylococcus aureus
ILTSICKKWYINSFKYFRNMYK

SEQ ID NO: 1651103 - protein, 24 aa, Staphylococcus aureus
IMEKDMAYELGFEHGLLFKDGVTV

SEQ ID NO: 1651104 - protein, 21 aa, Staphylococcus aureus
INFAAAYKAPAIFVIQNNNYA

SEQ ID NO: 1651105 - protein, 24 aa, Staphylococcus aureus
INQYLEYDVEAFKKRYRQLREEYY

SEQ ID NO: 1651106 - protein, 18 aa, Staphylococcus aureus
INRMFWRARRRESIFIQY

SEQ ID NO: 1651107 - protein, 19 aa, Staphylococcus aureus
IQFTPVIKCIAGDRTIVES

SEQ ID NO: 1651108 - protein, 23 aa, Staphylococcus aureus
IQKALDIISDVPLFKRTKQDIHE

SEQ ID NO: 1651109 - protein, 19 aa, Staphylococcus aureus
KAQAFDEILEGLPNAMQDA

SEQ ID NO: 1651110 - protein, 22 aa, Staphylococcus aureus
KAQNLRFAQDVTQARDEVGKSI

SEQ ID NO: 1651111 - protein, 21 aa, Staphylococcus aureus
KDAEIPFDMEKVIQKEITVVG

SEQ ID NO: 1651112 - protein, 17 aa, Staphylococcus aureus
KLYKAIRGEGAFCNGIK

SEQ ID NO: 1651113 - protein, 37 aa, Staphylococcus aureus
KNLIGAFYRPTAVIYDLDFLKTLPFEQILSGYAEVYK

SEQ ID NO: 1651114 - protein, 18 aa, Staphylococcus aureus
KSLIIKKEVLKQINKLNI

SEQ ID NO: 1651115 - protein, 19 aa, Staphylococcus aureus
KSYPMIPGIDLAGTIVESE

SEQ ID NO: 1651116 - protein, 29 aa, Staphylococcus aureus
KWYINSFKYFRNMYKGFYYSRPDKLDKCF

SEQ ID NO: 1651117 - protein, 19 aa, Staphylococcus aureus
LDGYASLWVNVHGHNNKYL

SEQ ID NO: 1651118 - protein, 18 aa, Staphylococcus aureus
LDVDFKFNREEETLRIYR

SEQ ID NO: 1651119 - protein, 18 aa, Staphylococcus aureus
LEDLAGEDFILFNKDFYL

SEQ ID NO: 1651120 - protein, 21 aa, Staphylococcus aureus
LGIKLAERGHEVHFITSNIPF

SEQ ID NO: 1651121 - protein, 17 aa, Staphylococcus aureus
LIKRLIQVQNQFKTFYN

SEQ ID NO: 1651122 - protein, 18 aa, Staphylococcus aureus
LKEKYTIIMVTHNMQQAA

SEQ ID NO: 1651123 - protein, 21 aa, Staphylococcus aureus
LKIDLHIAREMEIEQAPSLVF

SEQ ID NO: 1651124 - protein, 19 aa, Staphylococcus aureus
LKRRGIDINEAFNQVKRYR

SEQ ID NO: 1651125 - protein, 24 aa, Staphylococcus aureus
LLHRENEAVLQYCVDHQITFIPYF

SEQ ID NO: 1651126 - protein, 22 aa, Staphylococcus aureus
LLKRLEPHIDHFVFDANSNDAV

SEQ ID NO: 1651127 - protein, 19 aa, Staphylococcus aureus
LPQVDSFVNLMASFVEQPK

SEQ ID NO: 1651128 - protein, 17 aa, Staphylococcus aureus
LQPAAGAHGEWTALMIF

SEQ ID NO: 1651129 - protein, 17 aa, Staphylococcus aureus
LQYNLPIYNSFGMTETC

SEQ ID NO: 1651130 - protein, 17 aa, Staphylococcus aureus
LSGKAAHITDYSNASRT

SEQ ID NO: 1651131 - protein, 25 aa, Staphylococcus aureus
LSTGEPCLRYHQTFYTMTGKPFDSS

SEQ ID NO: 1651132 - protein, 17 aa, Staphylococcus aureus
LVGCEQMSQCFKQSLGA

SEQ ID NO: 1651133 - protein, 17 aa, Staphylococcus aureus
LVHCPERVLPGKILEEL

SEQ ID NO: 1651134 - protein, 23 aa, Staphylococcus aureus
LWNKVNPSFALKSMFGGYDELME

SEQ ID NO: 1651135 - protein, 19 aa, Staphylococcus aureus
LYPDLTIYLNVSAEVGRER

SEQ ID NO: 1651136 - protein, 18 aa, Staphylococcus aureus
MAIYPCLASGGTLNLVDK

SEQ ID NO: 1651137 - protein, 24 aa, Staphylococcus aureus
NIHEKMAVFDLYFRKMPFNSGYAV

SEQ ID NO: 1651138 - protein, 18 aa, Staphylococcus aureus
NQSAFSITVYTNLDYTAD

SEQ ID NO: 1651139 - protein, 24 aa, Staphylococcus aureus
NREVVDYFVHFARVVFERYKDKVT

SEQ ID NO: 1651140 - protein, 18 aa, Staphylococcus aureus
PDMYKRVMDLGVHCSVVG

SEQ ID NO: 1651141 - protein, 20 aa, Staphylococcus aureus
PEAIERPAVVTIMGHVDHGK

SEQ ID NO: 1651142 - protein, 27 aa, Staphylococcus aureus
PLVDFYNRMAFDFGTLGNHEFNYGLPY

SEQ ID NO: 1651143 - protein, 25 aa, Staphylococcus aureus
PRIYSSHPNRIEWEPQFSQSTILAL

SEQ ID NO: 1651144 - protein, 25 aa, Staphylococcus aureus
PTLKEILRHRGIDAGLPKRPFKPFN

SEQ ID NO: 1651145 - protein, 18 aa, Staphylococcus aureus
QAIKDTIKKASIASGVDI

SEQ ID NO: 1651146 - protein, 26 aa, Staphylococcus aureus
QAYVKRLAIDSCIEFVARAVAQSHFK

SEQ ID NO: 1651147 - protein, 34 aa, Staphylococcus aureus
QKVSMIFQHFNLLWSRTVLKNIMFPLEIAGVPRR

SEQ ID NO: 1651148 - protein, 21 aa, Staphylococcus aureus
QLCTPKDVFAREVQIDAISTG

SEQ ID NO: 1651149 - protein, 18 aa, Staphylococcus aureus
QLENKGWNALFIENHDQP

SEQ ID NO: 1651150 - protein, 20 aa, Staphylococcus aureus
QPEGAFYIFPSIKHITDDDF

SEQ ID NO: 1651151 - protein, 17 aa, Staphylococcus aureus
RAYNYHGEWKLKSADEF

SEQ ID NO: 1651152 - protein, 20 aa, Staphylococcus aureus
RDAIKNVALMIGIPPGLIYG

SEQ ID NO: 1651153 - protein, 20 aa, Staphylococcus aureus
REIPADLVVMAVGIRPYTEV

SEQ ID NO: 1651154 - protein, 21 aa, Staphylococcus aureus
RVIEGNSGLFVAMPSKRTPDG

SEQ ID NO: 1651155 - protein, 17 aa, Staphylococcus aureus
RVLLALINKGMVREEAY

SEQ ID NO: 1651156 - protein, 22 aa, Staphylococcus aureus
SDFDKMRFVHHSIPSINVNDID

SEQ ID NO: 1651157 - protein, 21 aa, Staphylococcus aureus
SENWFKQTVASWCYYSDMPSD

SEQ ID NO: 1651158 - protein, 24 aa, Staphylococcus aureus
SFSPDKILGAILFEQTMDREVEGK

SEQ ID NO: 1651159 - protein, 19 aa, Staphylococcus aureus
SGNRNWGLNFAKAGRTISE

SEQ ID NO: 1651160 - protein, 18 aa, Staphylococcus aureus
SHVLKYCQYIYVLKEGQI

SEQ ID NO: 1651161 - protein, 17 aa, Staphylococcus aureus
SKEIVALYDYLPSEMER

SEQ ID NO: 1651162 - protein, 19 aa, Staphylococcus aureus
SKPFFLEFMAKDVSKGNAI

SEQ ID NO: 1651163 - protein, 26 aa, Staphylococcus aureus
SKSLTIKTLLTWLARHHFNYQEINER

SEQ ID NO: 1651164 - protein, 23 aa, Staphylococcus aureus
SLLNSAQMNIVFGGHSDEDERYI

SEQ ID NO: 1651165 - protein, 23 aa, Staphylococcus aureus
SLTEIKSRVEALLPEIKSIGMAI

SEQ ID NO: 1651166 - protein, 25 aa, Staphylococcus aureus
SPYTRSKFYSELKVLEAVNNGLDGR

SEQ ID NO: 1651167 - protein, 22 aa, Staphylococcus aureus
SRYQMYWQIYFHPVSRGGEVLL

SEQ ID NO: 1651168 - protein, 22 aa, Staphylococcus aureus
SVPEIAEKYIAAFHEDVGALNV

SEQ ID NO: 1651169 - protein, 18 aa, Staphylococcus aureus
TAVVKFFNVFGPRQDPKS

SEQ ID NO: 1651170 - protein, 24 aa, Staphylococcus aureus
TEMKLVFLEGIFKTLLNKNSQVVF

SEQ ID NO: 1651171 - protein, 18 aa, Staphylococcus aureus
TGIFDLFGYDLKDYDELF

SEQ ID NO: 1651172 - protein, 20 aa, Staphylococcus aureus
TGNVRRFIKRTELENTLEIT

SEQ ID NO: 1651173 - protein, 29 aa, Staphylococcus aureus
TLVKRIFNEWQIPIIFVTHSNYEAEQMAH

SEQ ID NO: 1651174 - protein, 25 aa, Staphylococcus aureus
TLWKKAKPGEISWDSPFGEGRPGWH

SEQ ID NO: 1651175 - protein, 27 aa, Staphylococcus aureus
TMKQKALAKVRMSEIGFILQATNLVPF

SEQ ID NO: 1651176 - protein, 24 aa, Staphylococcus aureus
TNGEYFRGGIIIEQLLKLSSKVEG

SEQ ID NO: 1651177 - protein, 25 aa, Staphylococcus aureus
TNKGRYLFIPVHKLADIRWKELGQH

SEQ ID NO: 1651178 - protein, 17 aa, Staphylococcus aureus
TPITPVIIGDEKTTQEF

SEQ ID NO: 1651179 - protein, 21 aa, Staphylococcus aureus
TQTICRDLLDLIGHSSQPQEI

SEQ ID NO: 1651180 - protein, 27 aa, Staphylococcus aureus
TRKIDMSEIKTALIAVGPENDKGKRLE

SEQ ID NO: 1651181 - protein, 18 aa, Staphylococcus aureus
TTEIPRLINTAIAERRPV

SEQ ID NO: 1651182 - protein, 22 aa, Staphylococcus aureus
VAESRLDNIISIADQDLTYTLL

SEQ ID NO: 1651183 - protein, 27 aa, Staphylococcus aureus
VEEFFRAVVINARLTTHIDLIRGGNTH

SEQ ID NO: 1651184 - protein, 18 aa, Staphylococcus aureus
VGNADVTYGLAIDGDKVT

SEQ ID NO: 1651185 - protein, 21 aa, Staphylococcus aureus
VLDSARLQYLISQELGVAPSS

SEQ ID NO: 1651186 - protein, 25 aa, Staphylococcus aureus
VNPMLRLLKTDVLTASYLKSAYLVD

SEQ ID NO: 1651187 - protein, 23 aa, Staphylococcus aureus
VSQIKRLKFDSLIIDNANLSSPY

SEQ ID NO: 1651188 - protein, 19 aa, Staphylococcus aureus
VSRLSDILEEFLSADKYVF

SEQ ID NO: 1651189 - protein, 23 aa, Staphylococcus aureus
VTLEPCVMCAGTIVMSRIPRVVY

SEQ ID NO: 1651190 - protein, 23 aa, Staphylococcus aureus
VVECSGAVPAARQGLDILRKKGF

SEQ ID NO: 1651191 - protein, 17 aa, Staphylococcus aureus
VVETFQGAGVISRELEN

SEQ ID NO: 1651192 - protein, 17 aa, Staphylococcus aureus
WAPSLAMRLILGQMSTV

SEQ ID NO: 1651193 - protein, 18 aa, Staphylococcus aureus
YATLCGRDTVQYENASIT

SEQ ID NO: 1651194 - protein, 18 aa, Staphylococcus aureus
YDSTVFFDKRAQLIECLE

SEQ ID NO: 1651195 - protein, 26 aa, Staphylococcus aureus
YEAWTKKDLLKQWFMTSARTNKEIEA

SEQ ID NO: 1651196 - protein, 24 aa, Staphylococcus aureus
YLKHLKTAFPERQYITNINKSNAH

SEQ ID NO: 1651197 - protein, 25 aa, Staphylococcus aureus
YLVDRVIPMIPHRLSNGICSLNPHV

SEQ ID NO: 1651198 - protein, 18 aa, Staphylococcus aureus
YWYNYTSDDLINFKAEGP

SEQ ID NO: 1651199 - protein, 17 aa, Staphylococcus aureus
AAFASEIHGESGLDGPK

SEQ ID NO: 1651200 - protein, 17 aa, Staphylococcus aureus
ADAAGMDAVIMEKGTTD

SEQ ID NO: 1651201 - protein, 20 aa, Staphylococcus aureus
ADKHSLVLFDELGAGTDPSE

SEQ ID NO: 1651202 - protein, 25 aa, Staphylococcus aureus
ADVNFKVVKEFIKTVSERALGSDVM

SEQ ID NO: 1651203 - protein, 18 aa, Staphylococcus aureus
AFIHRADIGGVLNVSELN

SEQ ID NO: 1651204 - protein, 24 aa, Staphylococcus aureus
AILKAEGNMNIFIIEYDDVNKDIA

SEQ ID NO: 1651205 - protein, 19 aa, Staphylococcus aureus
ALSSGRTFIGQTTFHPEKL

SEQ ID NO: 1651206 - protein, 24 aa, Staphylococcus aureus
APVIWRGPMLGKMLTNFFTEVKWG

SEQ ID NO: 1651207 - protein, 18 aa, Staphylococcus aureus
AQEGVTFLISSHILSELV

SEQ ID NO: 1651208 - protein, 24 aa, Staphylococcus aureus
ASDKFGRQCICIAIDSYYDPERKA

SEQ ID NO: 1651209 - protein, 25 aa, Staphylococcus aureus
ASIPLQMCSVMEDFYIEKLITGGAT

SEQ ID NO: 1651210 - protein, 18 aa, Staphylococcus aureus
CSHFGSTPPCVNKIIDCK

SEQ ID NO: 1651211 - protein, 25 aa, Staphylococcus aureus
DAEKELAESVLPYHPLFIKPNKDEL

SEQ ID NO: 1651212 - protein, 25 aa, Staphylococcus aureus
DAVKIVRKRGQLMAQAFPTGVGSMA

SEQ ID NO: 1651213 - protein, 23 aa, Staphylococcus aureus
DDETKAVVMIGEIGGTAEEEAAE

SEQ ID NO: 1651214 - protein, 26 aa, Staphylococcus aureus
DGKVARLTQFGAFIDIGGVDGLVHVS

SEQ ID NO: 1651215 - protein, 18 aa, Staphylococcus aureus
DIRIAFSCVEKEDIPHVF

SEQ ID NO: 1651216 - protein, 23 aa, Staphylococcus aureus
DKDYATISFLNWFLDEQVEEESM

SEQ ID NO: 1651217 - protein, 21 aa, Staphylococcus aureus
DKITLAFDMNKCHFFDEKTGN

SEQ ID NO: 1651218 - protein, 20 aa, Staphylococcus aureus
DKRSASIYVAFDVKDDKGVV

SEQ ID NO: 1651219 - protein, 23 aa, Staphylococcus aureus
DQYMSIEALRAFLEDLNQPFIYI

SEQ ID NO: 1651220 - protein, 17 aa, Staphylococcus aureus
DVVACCLDVGEGKDLDI

SEQ ID NO: 1651221 - protein, 24 aa, Staphylococcus aureus
EAYDLGIRAIMFFGVPNSKDDIGT

SEQ ID NO: 1651222 - protein, 21 aa, Staphylococcus aureus
EDGLTGPIGRFFETENVETLL

SEQ ID NO: 1651223 - protein, 35 aa, Staphylococcus aureus
EEAQRFASDWSEVRPEWGLAKNASFIIGRRQLTKG

SEQ ID NO: 1651224 - protein, 19 aa, Staphylococcus aureus
EGTIAEWLKNVGDSVEKGE

SEQ ID NO: 1651225 - protein, 23 aa, Staphylococcus aureus
EKLSDRALGYGIHGEQVDGNDPL

SEQ ID NO: 1651226 - protein, 21 aa, Staphylococcus aureus
ELRVANILMPLVKNIRNKSAH

SEQ ID NO: 1651227 - protein, 27 aa, Staphylococcus aureus
ENPDELFDAVLMTIKYIMRESKVNQDD

SEQ ID NO: 1651228 - protein, 18 aa, Staphylococcus aureus
EQLLKPLFQHFKEKYPEV

SEQ ID NO: 1651229 - protein, 25 aa, Staphylococcus aureus
ETIGCPIGNYIPEWNDLVYHQDFKT

SEQ ID NO: 1651230 - protein, 25 aa, Staphylococcus aureus
FKQSFKRKQLGFFRMIGYCKLDQCR

SEQ ID NO: 1651231 - protein, 24 aa, Staphylococcus aureus
FQHREPGVFGAAWLNDALHTEMIV

SEQ ID NO: 1651232 - protein, 25 aa, Staphylococcus aureus
FVYGLFIYNQWRGMGTLNSVDVISQ

SEQ ID NO: 1651233 - protein, 22 aa, Staphylococcus aureus
GEIAKGLAFKPANHIIFGGPGK

SEQ ID NO: 1651234 - protein, 25 aa, Staphylococcus aureus
GICPENCGYCGQSRDIKQKQRYALI

SEQ ID NO: 1651235 - protein, 17 aa, Staphylococcus aureus
GIHPEWLYCAKANLVLE

SEQ ID NO: 1651236 - protein, 24 aa, Staphylococcus aureus
GKDLKVAIVVSRFNDFITGRLLEG

SEQ ID NO: 1651237 - protein, 18 aa, Staphylococcus aureus
GKSLELLEKVGLTHVKDQ

SEQ ID NO: 1651238 - protein, 21 aa, Staphylococcus aureus
GNAVMKRFLDSNIKEIRIFSR

SEQ ID NO: 1651239 - protein, 25 aa, Staphylococcus aureus
GRVVKGIQFKGLRDIGNPVDLAMYY

SEQ ID NO: 1651240 - protein, 21 aa, Staphylococcus aureus
GVDFRLIEPRAFYHTLQHFTG

SEQ ID NO: 1651241 - protein, 17 aa, Staphylococcus aureus
HLNGVMFYDHIDKDHPL

SEQ ID NO: 1651242 - protein, 19 aa, Staphylococcus aureus
HPFGGFKMSGTDAKTGSPD

SEQ ID NO: 1651243 - protein, 26 aa, Staphylococcus aureus
HYLIPEMHLKPILSYMKAHTMQTYVF

SEQ ID NO: 1651244 - protein, 26 aa, Staphylococcus aureus
IGTDIPFCIYNKTALCTGRGEKIEFL

SEQ ID NO: 1651245 - protein, 26 aa, Staphylococcus aureus
IGTICIKSNMMFSGYVSEQCINNDEW

SEQ ID NO: 1651246 - protein, 17 aa, Staphylococcus aureus
IHDSRLPFLKDGIDYLT

SEQ ID NO: 1651247 - protein, 18 aa, Staphylococcus aureus
IIDMEMEGLLQLVNPKII

SEQ ID NO: 1651248 - protein, 21 aa, Staphylococcus aureus
IKALADKGTKVIAVVDDAYYG

SEQ ID NO: 1651249 - protein, 19 aa, Staphylococcus aureus
IKATHIYNAISGQQQTDFN

SEQ ID NO: 1651250 - protein, 19 aa, Staphylococcus aureus
ILSVILPQYVESLIYGTIL

SEQ ID NO: 1651251 - protein, 23 aa, Staphylococcus aureus
INPDLIGGFRVKVGTTVLDGSVR

SEQ ID NO: 1651252 - protein, 20 aa, Staphylococcus aureus
IPENQKYGAFHGKEAFKQAI

SEQ ID NO: 1651253 - protein, 18 aa, Staphylococcus aureus
IRMYRSVQTFDFSGEQPF

SEQ ID NO: 1651254 - protein, 18 aa, Staphylococcus aureus
IRYIEQFGLSNSLKRKVH

SEQ ID NO: 1651255 - protein, 30 aa, Staphylococcus aureus
ISEKLVVLLPLKFGDYLSSSSMRSLIDIGA

SEQ ID NO: 1651256 - protein, 22 aa, Staphylococcus aureus
ISKSFDGEDIFTDVDFEVKTGE

SEQ ID NO: 1651257 - protein, 18 aa, Staphylococcus aureus
IYGGVSYTIHVGRPKGQR

SEQ ID NO: 1651258 - protein, 19 aa, Staphylococcus aureus
KAAELQGRVRAERFIHLMQ

SEQ ID NO: 1651259 - protein, 18 aa, Staphylococcus aureus
KAAPLIVTEDTLQKSKGK

SEQ ID NO: 1651260 - protein, 25 aa, Staphylococcus aureus
KDCKYVLSVASPVFFGKTDDAEVMA

SEQ ID NO: 1651261 - protein, 17 aa, Staphylococcus aureus
KELCARFDVSRMTLRQA

SEQ ID NO: 1651262 - protein, 23 aa, Staphylococcus aureus
KESLKPAVIMNEFGKMSVDGALV

SEQ ID NO: 1651263 - protein, 18 aa, Staphylococcus aureus
KGTNFKRLLKSLSPYVKV

SEQ ID NO: 1651264 - protein, 25 aa, Staphylococcus aureus
KHNIKCLRHSRFIFLSPEFLLQPSN

SEQ ID NO: 1651265 - protein, 25 aa, Staphylococcus aureus
KKGLMRHLVVRTGYHTDEMMIIFVT

SEQ ID NO: 1651266 - protein, 23 aa, Staphylococcus aureus
KNTLVFEKFCLTPLLKKIQNELN

SEQ ID NO: 1651267 - protein, 23 aa, Staphylococcus aureus
KPGIKGKEVIPVERHGVKVISMA

SEQ ID NO: 1651268 - protein, 20 aa, Staphylococcus aureus
KRGGTIYAHVMHTHLLINFV

SEQ ID NO: 1651269 - protein, 20 aa, Staphylococcus aureus
KRYQSAASLSDFESSAKSWI

SEQ ID NO: 1651270 - protein, 17 aa, Staphylococcus aureus
KRYTKRSQLRDFNVDVL

SEQ ID NO: 1651271 - protein, 18 aa, Staphylococcus aureus
KSAGTKVVPFISVKESTD

SEQ ID NO: 1651272 - protein, 20 aa, Staphylococcus aureus
KSLADLLPEHRIIINKQPLS

SEQ ID NO: 1651273 - protein, 17 aa, Staphylococcus aureus
KTLPSSIGIIGGGVIGM

SEQ ID NO: 1651274 - protein, 23 aa, Staphylococcus aureus
KVRRAKLYYLRSLRGKAARIQEI

SEQ ID NO: 1651275 - protein, 18 aa, Staphylococcus aureus
LADGREIPADLVVMAVGI

SEQ ID NO: 1651276 - protein, 17 aa, Staphylococcus aureus
LAGLRAIPNMNVIRPAD

SEQ ID NO: 1651277 - protein, 20 aa, Staphylococcus aureus
LEAVELLEAQALQIHVNSPQ

SEQ ID NO: 1651278 - protein, 21 aa, Staphylococcus aureus
LEKSQAFEFIIEGDTLIPPFI

SEQ ID NO: 1651279 - protein, 20 aa, Staphylococcus aureus
LEVIIAPKFTDEALDILKQK

SEQ ID NO: 1651280 - protein, 17 aa, Staphylococcus aureus
LLPEHRIIINKQPLSIE

SEQ ID NO: 1651281 - protein, 18 aa, Staphylococcus aureus
LNQSFPLMVAAVKKTHMI

SEQ ID NO: 1651282 - protein, 18 aa, Staphylococcus aureus
LPSSIGIIGGGVIGMEFA

SEQ ID NO: 1651283 - protein, 19 aa, Staphylococcus aureus
LQEGFKLIETSECVAEKYL

SEQ ID NO: 1651284 - protein, 26 aa, Staphylococcus aureus
LQPLLKRKYPNISFKYTYIDITKDND

SEQ ID NO: 1651285 - protein, 21 aa, Staphylococcus aureus
LREKTGAGMMDCKKALTETDG

SEQ ID NO: 1651286 - protein, 19 aa, Staphylococcus aureus
LTAPVRQIAENAGLEGSVI

SEQ ID NO: 1651287 - protein, 22 aa, Staphylococcus aureus
LVEGFKNADFEKVVVYRNEEEL

SEQ ID NO: 1651288 - protein, 20 aa, Staphylococcus aureus
LVNEEIWKGIDVNIQEMDIA

SEQ ID NO: 1651289 - protein, 32 aa, Staphylococcus aureus
MALAAKDIRIEAPIPGTSRVGIEVPNQNPTTV

SEQ ID NO: 1651290 - protein, 24 aa, Staphylococcus aureus
MAVHKRITLLIGDLSFYHDMNGLL

SEQ ID NO: 1651291 - protein, 17 aa, Staphylococcus aureus
MGFYRQRSHDIIDMESC

SEQ ID NO: 1651292 - protein, 17 aa, Staphylococcus aureus
MGYGIVFLGSLRNDVER

SEQ ID NO: 1651293 - protein, 25 aa, Staphylococcus aureus
MKDNANYFLSLGIKTVLITLGKQGT

SEQ ID NO: 1651294 - protein, 17 aa, Staphylococcus aureus
MNVKRIWESNTQCYQML

SEQ ID NO: 1651295 - protein, 21 aa, Staphylococcus aureus
MSAGLFIVGRIKGVARPALVV

SEQ ID NO: 1651296 - protein, 18 aa, Staphylococcus aureus
MTPYFPKPDVMIYLECNY

SEQ ID NO: 1651297 - protein, 17 aa, Staphylococcus aureus
MVQVCFLGQAPWGYKKV

SEQ ID NO: 1651298 - protein, 21 aa, Staphylococcus aureus
NGYLFVFVIDYYRHHLVDQHA

SEQ ID NO: 1651299 - protein, 25 aa, Staphylococcus aureus
NHVDARYNLGLALFMKNEDIDEAIT

SEQ ID NO: 1651300 - protein, 27 aa, Staphylococcus aureus
NKEPYRIGLKLSNGGWVYVQGLTHFEV

SEQ ID NO: 1651301 - protein, 18 aa, Staphylococcus aureus
NNLGQSFSFIKHLAEKYK

SEQ ID NO: 1651302 - protein, 21 aa, Staphylococcus aureus
NPEKYKSYFIGDWYVSGDSAY

SEQ ID NO: 1651303 - protein, 23 aa, Staphylococcus aureus
PEGTKYLAWSLIDYDAIPVCGFA

SEQ ID NO: 1651304 - protein, 25 aa, Staphylococcus aureus
PEVTAATFACFGYGWHIDVGIHAIH

SEQ ID NO: 1651305 - protein, 25 aa, Staphylococcus aureus
PHIDHFPEMWLLSSSATSAKIAAEL

SEQ ID NO: 1651306 - protein, 24 aa, Staphylococcus aureus
PMIERLQRELKHISLIQLQNASIA

SEQ ID NO: 1651307 - protein, 25 aa, Staphylococcus aureus
PVHTYKMKFIKSFEAIDLHHNIYEN

SEQ ID NO: 1651308 - protein, 19 aa, Staphylococcus aureus
PVSETWDLVDLFKDDQQYY

SEQ ID NO: 1651309 - protein, 23 aa, Staphylococcus aureus
PYTDKWKRVSVVLNKNTKQSQKE

SEQ ID NO: 1651310 - protein, 21 aa, Staphylococcus aureus
PYYASGGFIHYCEYPKLQHNL

SEQ ID NO: 1651311 - protein, 18 aa, Staphylococcus aureus
QDIVPSYRAVLIYFDEQA

SEQ ID NO: 1651312 - protein, 23 aa, Staphylococcus aureus
QIHQRLFLEQSLITERIKKYFNK

SEQ ID NO: 1651313 - protein, 24 aa, Staphylococcus aureus
QLIDFCKHRHFTLCIEEVFDTTVT

SEQ ID NO: 1651314 - protein, 18 aa, Staphylococcus aureus
QLLLAIRTVYKGETYVDM

SEQ ID NO: 1651315 - protein, 25 aa, Staphylococcus aureus
QSNYIDEFILYYAPKLIGGSGNYQF

SEQ ID NO: 1651316 - protein, 28 aa, Staphylococcus aureus
QVYHLNARLKLQLLDDVKSVFNSQMTQN

SEQ ID NO: 1651317 - protein, 22 aa, Staphylococcus aureus
RDINSYFLIITYRIDKESKQLA

SEQ ID NO: 1651318 - protein, 23 aa, Staphylococcus aureus
RDKPKIVFADAVATTKTSILVGE

SEQ ID NO: 1651319 - protein, 21 aa, Staphylococcus aureus
RKQLEDWLDYEITTLPYDMTI

SEQ ID NO: 1651320 - protein, 18 aa, Staphylococcus aureus
RLALLEADVNFKVVKEFI

SEQ ID NO: 1651321 - protein, 26 aa, Staphylococcus aureus
RLKYYKDRVLVPLAYINFDEYIKELN

SEQ ID NO: 1651322 - protein, 26 aa, Staphylococcus aureus
RQQLNVFRMELLGAKVVAVEDGQGTL

SEQ ID NO: 1651323 - protein, 17 aa, Staphylococcus aureus
RSFEMIAAMLATVKVGA

SEQ ID NO: 1651324 - protein, 18 aa, Staphylococcus aureus
RTEFKWKNESIVGVMLAS

SEQ ID NO: 1651325 - protein, 25 aa, Staphylococcus aureus
RVGRKLECPTGKVLFFHEGVSMNMI

SEQ ID NO: 1651326 - protein, 29 aa, Staphylococcus aureus
RYYFNEGFVPKFKSYFAIGEQTARTIKSY

SEQ ID NO: 1651327 - protein, 24 aa, Staphylococcus aureus
SEKSLKRTPSFSVNRPGEETGVTF

SEQ ID NO: 1651328 - protein, 17 aa, Staphylococcus aureus
SEVLKALNLTFEDIAYQ

SEQ ID NO: 1651329 - protein, 18 aa, Staphylococcus aureus
SMIKGTVEAILFQNSDNF

SEQ ID NO: 1651330 - protein, 18 aa, Staphylococcus aureus
SSRKLDAIKDFKEIDSTD

SEQ ID NO: 1651331 - protein, 21 aa, Staphylococcus aureus
STKAQIAFCIDVRSEPFRRHI

SEQ ID NO: 1651332 - protein, 23 aa, Staphylococcus aureus
STSGKTGFYFRVLKQGYVSPNDQ

SEQ ID NO: 1651333 - protein, 19 aa, Staphylococcus aureus
SVDISYPLTALKLDDVNRV

SEQ ID NO: 1651334 - protein, 18 aa, Staphylococcus aureus
SYFRSSGYDGFMQDYVVM

SEQ ID NO: 1651335 - protein, 18 aa, Staphylococcus aureus
TDKMGVIYHGNYATWFEV

SEQ ID NO: 1651336 - protein, 23 aa, Staphylococcus aureus
TDYAKSIPFNFASYMSASKFFKD

SEQ ID NO: 1651337 - protein, 20 aa, Staphylococcus aureus
TIEPSPIWMQARLIKAGIRP

SEQ ID NO: 1651338 - protein, 19 aa, Staphylococcus aureus
TLEPCSHFGSTPPCVNKII

SEQ ID NO: 1651339 - protein, 24 aa, Staphylococcus aureus
TNRIIKIPVQYGGTYGPDIEEVAK

SEQ ID NO: 1651340 - protein, 25 aa, Staphylococcus aureus
TPVIVKFEAGWCPDCRAMDLWIDPI

SEQ ID NO: 1651341 - protein, 21 aa, Staphylococcus aureus
TSPNPFHLIYSILSKHQSASI

SEQ ID NO: 1651342 - protein, 23 aa, Staphylococcus aureus
TTSFPTPKIFDWLQQQGNIDTNE

SEQ ID NO: 1651343 - protein, 20 aa, Staphylococcus aureus
TVLHLAEWLMEMQLDRKAGN

SEQ ID NO: 1651344 - protein, 18 aa, Staphylococcus aureus
TYGTGGFMLMNTGDKAVK

SEQ ID NO: 1651345 - protein, 22 aa, Staphylococcus aureus
VFHKNHIYTTVFYDKHRRNNVT

SEQ ID NO: 1651346 - protein, 25 aa, Staphylococcus aureus
VFHYFKEAHPYFDQDVVIIGGKNSA

SEQ ID NO: 1651347 - protein, 17 aa, Staphylococcus aureus
VGTAGTILSFFEIPNAG

SEQ ID NO: 1651348 - protein, 18 aa, Staphylococcus aureus
VHFVFDLSLMEIRTIYRM

SEQ ID NO: 1651349 - protein, 29 aa, Staphylococcus aureus
VIMFGGGGYNIWRVVPRAWSHVFLSLIDQ

SEQ ID NO: 1651350 - protein, 18 aa, Staphylococcus aureus
VSDVIPVFAVNKETGKPH

SEQ ID NO: 1651351 - protein, 20 aa, Staphylococcus aureus
VSPIAGRVDNVFPTKHAIGL

SEQ ID NO: 1651352 - protein, 22 aa, Staphylococcus aureus
VTAKFDLSFIIEEDRDDYTINI

SEQ ID NO: 1651353 - protein, 17 aa, Staphylococcus aureus
VVVGIAGKDGEHLDLLS

SEQ ID NO: 1651354 - protein, 25 aa, Staphylococcus aureus
WPRLKEIKVPTLILAGEYDEKFVQI

SEQ ID NO: 1651355 - protein, 17 aa, Staphylococcus aureus
YAALLVPFDENGQVNEQ

SEQ ID NO: 1651356 - protein, 17 aa, Staphylococcus aureus
YDKGGKGLSVIDVMTSG

SEQ ID NO: 1651357 - protein, 26 aa, Staphylococcus aureus
YGHFGRTDVLFPWEKLDKVEELKDAV

SEQ ID NO: 1651358 - protein, 19 aa, Staphylococcus aureus
YLLEHNHLPFSQSDIQFNG

SEQ ID NO: 1651359 - protein, 26 aa, Staphylococcus aureus
YNYHGEWKLKSADEFIKDNRIVTLTE

SEQ ID NO: 1651360 - protein, 26 aa, Staphylococcus aureus
YQRGMKLSAACDTTLKNAEKKVNDLI

SEQ ID NO: 1651361 - protein, 19 aa, Staphylococcus aureus
YRKAYAHFIHQYMKQAAPF

SEQ ID NO: 1651362 - protein, 25 aa, Staphylococcus aureus
YVSGGKRPLVCFFSNDLNIHRTKTE

SEQ ID NO: 1651363 - protein, 25 aa, Staphylococcus aureus
AEQRPRLNHPSLYVDLGDHVDLSAP

SEQ ID NO: 1651364 - protein, 20 aa, Staphylococcus aureus
AESVKLLFNVDCEVKFAEGY

SEQ ID NO: 1651365 - protein, 25 aa, Staphylococcus aureus
AFALKKRGKNAVAITYTGDGGSSQG

SEQ ID NO: 1651366 - protein, 25 aa, Staphylococcus aureus
AGGCFWCMVKPFTSYPGIKSVVSGY

SEQ ID NO: 1651367 - protein, 26 aa, Staphylococcus aureus
AISGKRLDSFGQRGIRATHFSFEDIN

SEQ ID NO: 1651368 - protein, 19 aa, Staphylococcus aureus
AKAKQLPQITVKVSASLDG

SEQ ID NO: 1651369 - protein, 21 aa, Staphylococcus aureus
AKIISELDCLQSFAEIAQKYN

SEQ ID NO: 1651370 - protein, 18 aa, Staphylococcus aureus
ALESAGNMTKFWEIFYER

SEQ ID NO: 1651371 - protein, 19 aa, Staphylococcus aureus
ANLGMAIGVLTGIATKEEL

SEQ ID NO: 1651372 - protein, 23 aa, Staphylococcus aureus
ATEHSLAMLLSMARNIPQAHQSL

SEQ ID NO: 1651373 - protein, 31 aa, Staphylococcus aureus
ATGHIVNLYFPFVEVETMLTLLDMAQIYVSS

SEQ ID NO: 1651374 - protein, 18 aa, Staphylococcus aureus
ATIVMALYQMFHVLPSFS

SEQ ID NO: 1651375 - protein, 26 aa, Staphylococcus aureus
CAGGIARPAASHALHYDVLPDRLVTV

SEQ ID NO: 1651376 - protein, 20 aa, Staphylococcus aureus
CDFYIKIPMVGHVNSLNASV

SEQ ID NO: 1651377 - protein, 24 aa, Staphylococcus aureus
DEAYCLDCKFLSAHFNLMEQLYCQ

SEQ ID NO: 1651378 - protein, 22 aa, Staphylococcus aureus
DIIFKITGIKVMSFHSDLSTVT

SEQ ID NO: 1651379 - protein, 19 aa, Staphylococcus aureus
DKEVTRMSSMRAERVGEQM

SEQ ID NO: 1651380 - protein, 20 aa, Staphylococcus aureus
DKKHFVRYGTMYIPMDETLA

SEQ ID NO: 1651381 - protein, 17 aa, Staphylococcus aureus
DNAELIASFSRALASDL

SEQ ID NO: 1651382 - protein, 22 aa, Staphylococcus aureus
DRLTLSCRMEIDASGRVVKHEI

SEQ ID NO: 1651383 - protein, 19 aa, Staphylococcus aureus
DTFIYCMSGQITLNLGKEI

SEQ ID NO: 1651384 - protein, 36 aa, Staphylococcus aureus
DVFVSGVSIDHLWLYETNKYYALAMELIHQRVKFSA

SEQ ID NO: 1651385 - protein, 26 aa, Staphylococcus aureus
EDLDPTFMWHLAFAYGQEERDKEAQH

SEQ ID NO: 1651386 - protein, 22 aa, Staphylococcus aureus
EDQEVKFEFALFDSDMDNLKHM

SEQ ID NO: 1651387 - protein, 22 aa, Staphylococcus aureus
EEALGYGKWAFRSITEDKHLDL

SEQ ID NO: 1651388 - protein, 23 aa, Staphylococcus aureus
EELESVGFFLVDRNLPGVEIADN

SEQ ID NO: 1651389 - protein, 30 aa, Staphylococcus aureus
EFYHSNPFKFGASIGRYSGRIDNAKFKLKG

SEQ ID NO: 1651390 - protein, 19 aa, Staphylococcus aureus
EHEDCLYLNIWKQHNDQTK

SEQ ID NO: 1651391 - protein, 24 aa, Staphylococcus aureus
EHFSKLDVPFIYRVHEQPKSDRLR

SEQ ID NO: 1651392 - protein, 25 aa, Staphylococcus aureus
ELPNGVELRNRFVLAPLTHISSNDD

SEQ ID NO: 1651393 - protein, 22 aa, Staphylococcus aureus
ENDEVLEYFGLKVLVDKKDAPV

SEQ ID NO: 1651394 - protein, 23 aa, Staphylococcus aureus
ENEGQLIAFIWGHFSNEKSMVNI

SEQ ID NO: 1651395 - protein, 25 aa, Staphylococcus aureus
ENMNAWLKPYRRALHLEEPVVKITE

SEQ ID NO: 1651396 - protein, 19 aa, Staphylococcus aureus
EQLKIRYIEQFGLSNSLKR

SEQ ID NO: 1651397 - protein, 23 aa, Staphylococcus aureus
ERKSIPLKTSFGIWGDGNLGYIT

SEQ ID NO: 1651398 - protein, 18 aa, Staphylococcus aureus
ETDVLFKYVENILNKDKD

SEQ ID NO: 1651399 - protein, 20 aa, Staphylococcus aureus
ETFHAIQGHFTAVFKQLFGG

SEQ ID NO: 1651400 - protein, 25 aa, Staphylococcus aureus
FDSLFKRIPVKPGDFYYVPAGTVHA

SEQ ID NO: 1651401 - protein, 19 aa, Staphylococcus aureus
FIGTFTVEFFIDSNNQLYV

SEQ ID NO: 1651402 - protein, 20 aa, Staphylococcus aureus
FIKDKVIDIMNMFQNHTDIT

SEQ ID NO: 1651403 - protein, 17 aa, Staphylococcus aureus
FISYHIFFETLVRKYNE

SEQ ID NO: 1651404 - protein, 17 aa, Staphylococcus aureus
FKSTIIMVTHDPVAASY

SEQ ID NO: 1651405 - protein, 18 aa, Staphylococcus aureus
FKVYEDDYVYAFLDISQV

SEQ ID NO: 1651406 - protein, 21 aa, Staphylococcus aureus
FKYSTEPILDILVGVENLHDI

SEQ ID NO: 1651407 - protein, 18 aa, Staphylococcus aureus
GAGTVKHFGLQDKIDFQI

SEQ ID NO: 1651408 - protein, 23 aa, Staphylococcus aureus
GASGPLYGFSFVKMSAVTKDDMD

SEQ ID NO: 1651409 - protein, 22 aa, Staphylococcus aureus
GCLGSMHGIEILKTGKEIHFAH

SEQ ID NO: 1651410 - protein, 17 aa, Staphylococcus aureus
GDIIALVGPSGSGKSTF

SEQ ID NO: 1651411 - protein, 18 aa, Staphylococcus aureus
GFNVKAFIRSGVTDEELK

SEQ ID NO: 1651412 - protein, 23 aa, Staphylococcus aureus
GIGTCWKSPLYIYDPKVRKTLGI

SEQ ID NO: 1651413 - protein, 17 aa, Staphylococcus aureus
GKEATDWLIQQGAFSQD

SEQ ID NO: 1651414 - protein, 17 aa, Staphylococcus aureus
GKSIQVLVPKSVENYIK

SEQ ID NO: 1651415 - protein, 18 aa, Staphylococcus aureus
GKYLGVSFHPELTDDYRV

SEQ ID NO: 1651416 - protein, 20 aa, Staphylococcus aureus
GQWFIQGRIDFQIKLNGYRM

SEQ ID NO: 1651417 - protein, 22 aa, Staphylococcus aureus
GRIGAATAKIYAGFGATITAYD

SEQ ID NO: 1651418 - protein, 19 aa, Staphylococcus aureus
GTEAAIAYQSGFNCNMAAI

SEQ ID NO: 1651419 - protein, 18 aa, Staphylococcus aureus
HDRGMKLILDLVVNHTSD

SEQ ID NO: 1651420 - protein, 26 aa, Staphylococcus aureus
HFGISGPAALRCSQFVYKEQKNQKTQ

SEQ ID NO: 1651421 - protein, 19 aa, Staphylococcus aureus
HKPKLIVAGASAYSRTIDF

SEQ ID NO: 1651422 - protein, 18 aa, Staphylococcus aureus
HPSAVIAMERYYQKKDNH

SEQ ID NO: 1651423 - protein, 24 aa, Staphylococcus aureus
HSGILKEGRLEFRPPLVDITQLQP

SEQ ID NO: 1651424 - protein, 34 aa, Staphylococcus aureus
HYLFNAELFKHFKKGAVFVNCARGSLVDTKALLD

SEQ ID NO: 1651425 - protein, 19 aa, Staphylococcus aureus
IASDTIVYYGMKAHAHEFE

SEQ ID NO: 1651426 - protein, 19 aa, Staphylococcus aureus
IDEDKCLVVIPLNKAISES

SEQ ID NO: 1651427 - protein, 17 aa, Staphylococcus aureus
IDMYIIVSYGVKISEVA

SEQ ID NO: 1651428 - protein, 18 aa, Staphylococcus aureus
IEADVPIYYYGFKDSDDI

SEQ ID NO: 1651429 - protein, 18 aa, Staphylococcus aureus
IEIPEGFEVIADSPSTDY

SEQ ID NO: 1651430 - protein, 24 aa, Staphylococcus aureus
IIAIPDWFWSYQMAMTLDEETCFE

SEQ ID NO: 1651431 - protein, 19 aa, Staphylococcus aureus
IICNDAIELNEYFKDGEVS

SEQ ID NO: 1651432 - protein, 25 aa, Staphylococcus aureus
IKLHREFIIEVPYMNSRKFELLIAN

SEQ ID NO: 1651433 - protein, 33 aa, Staphylococcus aureus
IKNLEGSFHFETFISLTCQKCPDVVQALNLMSV

SEQ ID NO: 1651434 - protein, 20 aa, Staphylococcus aureus
IKPGIPLKDIDHIARNIISE

SEQ ID NO: 1651435 - protein, 19 aa, Staphylococcus aureus
IKSKLNIPSVRFVGESNQK

SEQ ID NO: 1651436 - protein, 17 aa, Staphylococcus aureus
ILMISRAVLTPGDTIVT

SEQ ID NO: 1651437 - protein, 25 aa, Staphylococcus aureus
INEFIKPKISVPIHYDTFPLIEQDP

SEQ ID NO: 1651438 - protein, 26 aa, Staphylococcus aureus
INEITYRLSKIFGIKSISPVLKVEKT

SEQ ID NO: 1651439 - protein, 25 aa, Staphylococcus aureus
INPNIKFTMISSIDIAKIASYIFAH

SEQ ID NO: 1651440 - protein, 26 aa, Staphylococcus aureus
KDGRLFVCYLGDFKSTGGIFAATENG

SEQ ID NO: 1651441 - protein, 24 aa, Staphylococcus aureus
KELEREGFHILAIKDMAGLLKPKA

SEQ ID NO: 1651442 - protein, 25 aa, Staphylococcus aureus
KESLRKVKGGFTFAILTKDALYGAV

SEQ ID NO: 1651443 - protein, 24 aa, Staphylococcus aureus
KGFQKKIMYCFNKINAKAQKNHQK

SEQ ID NO: 1651444 - protein, 25 aa, Staphylococcus aureus
KKIVEAWPAGLIVLSGQSGVGKSTF

SEQ ID NO: 1651445 - protein, 18 aa, Staphylococcus aureus
KLLLHKREIIKLGDQTRE

SEQ ID NO: 1651446 - protein, 19 aa, Staphylococcus aureus
KLSGLEKVIYKHLDIADLE

SEQ ID NO: 1651447 - protein, 24 aa, Staphylococcus aureus
KNGFKTTLGLILEKFIEYVSKPKY

SEQ ID NO: 1651448 - protein, 24 aa, Staphylococcus aureus
KNVEQAGAVALVLEAIPNDLAEEI

SEQ ID NO: 1651449 - protein, 23 aa, Staphylococcus aureus
KPIRLDRYFPDWHEAYSKVQTLN

SEQ ID NO: 1651450 - protein, 36 aa, Staphylococcus aureus
KQYFRMLQRPILYTGLTRAKTSLVLLGDPEAFDIGL

SEQ ID NO: 1651451 - protein, 31 aa, Staphylococcus aureus
KRIKLFKPDYIFVGMGFPKQEEWIMTHENQF

SEQ ID NO: 1651452 - protein, 24 aa, Staphylococcus aureus
KRYQKLIVVPLFLYDGRLVNKVKQ

SEQ ID NO: 1651453 - protein, 17 aa, Staphylococcus aureus
KSMTHRAIMLASLAEGV

SEQ ID NO: 1651454 - protein, 23 aa, Staphylococcus aureus
KSSAIEAVIGFLYLEKREERLEA

SEQ ID NO: 1651455 - protein, 24 aa, Staphylococcus aureus
KTYLSWLAQVGFKHVETFTDFNID

SEQ ID NO: 1651456 - protein, 35 aa, Staphylococcus aureus
KVTGCPAIPCYQCEYCLKGEYARCEKLFVIGSYEP

SEQ ID NO: 1651457 - protein, 24 aa, Staphylococcus aureus
KWNIIRPPFNVTRISEYAAVAALE

SEQ ID NO: 1651458 - protein, 22 aa, Staphylococcus aureus
LARFDISLATLLGVHQGLGHNT

SEQ ID NO: 1651459 - protein, 18 aa, Staphylococcus aureus
LDSRLVEVFEQLKDIQGQ

SEQ ID NO: 1651460 - protein, 21 aa, Staphylococcus aureus
LESLTALTIAQSFSQLIDDEI

SEQ ID NO: 1651461 - protein, 24 aa, Staphylococcus aureus
LEVDLNHGLPILVVDGNMTKAQVN

SEQ ID NO: 1651462 - protein, 24 aa, Staphylococcus aureus
LIQICGREVKILFSSMSEIQGNTV

SEQ ID NO: 1651463 - protein, 22 aa, Staphylococcus aureus
LKEGIKEAFQFDRKLVIEQGVN

SEQ ID NO: 1651464 - protein, 24 aa, Staphylococcus aureus
LLEQHMKSCIMNKVNQGAQEEAME

SEQ ID NO: 1651465 - protein, 25 aa, Staphylococcus aureus
LLITLAKLSAHYGLGLKSSIDITNA

SEQ ID NO: 1651466 - protein, 19 aa, Staphylococcus aureus
LLMIKSKMLLPQSTSDMDV

SEQ ID NO: 1651467 - protein, 18 aa, Staphylococcus aureus
LNIEAIPSNVLLKNLSDG

SEQ ID NO: 1651468 - protein, 20 aa, Staphylococcus aureus
LNPHVDRLTLSCRMEIDASG

SEQ ID NO: 1651469 - protein, 22 aa, Staphylococcus aureus
LSNDKYRTWEWNYGRNPKYNFE

SEQ ID NO: 1651470 - protein, 20 aa, Staphylococcus aureus
LVREYISAIVNIRINDMYFA

SEQ ID NO: 1651471 - protein, 17 aa, Staphylococcus aureus
LVSEAIVAKAPHNISAN

SEQ ID NO: 1651472 - protein, 27 aa, Staphylococcus aureus
MFEFKGHRIVAFKGGRFLIHGMTRTSD

SEQ ID NO: 1651473 - protein, 19 aa, Staphylococcus aureus
MIAPFYRKWDHQVFEFYLE

SEQ ID NO: 1651474 - protein, 18 aa, Staphylococcus aureus
MLKIWGHLFQYIKSEHIE

SEQ ID NO: 1651475 - protein, 21 aa, Staphylococcus aureus
MVCDETAWWSYMGQDNDIFKD

SEQ ID NO: 1651476 - protein, 25 aa, Staphylococcus aureus
NAKSGPWLKDVLRQIEIAIVTGKVS

SEQ ID NO: 1651477 - protein, 19 aa, Staphylococcus aureus
NGYKVAICEQMEDPKQTKG

SEQ ID NO: 1651478 - protein, 18 aa, Staphylococcus aureus
NHVYVLPQLHTLLWSNKK

SEQ ID NO: 1651479 - protein, 19 aa, Staphylococcus aureus
NHYPKLRKLNLKWYAVPII

SEQ ID NO: 1651480 - protein, 23 aa, Staphylococcus aureus
NKDKLKGIFLTHGHEHAIGAVSY

SEQ ID NO: 1651481 - protein, 18 aa, Staphylococcus aureus
NREFVTWLDNIASIVSRV

SEQ ID NO: 1651482 - protein, 17 aa, Staphylococcus aureus
NSLGFGGHNAVLVFKKF

SEQ ID NO: 1651483 - protein, 23 aa, Staphylococcus aureus
NTFKVLAVSGAKLKEAIERSAEY

SEQ ID NO: 1651484 - protein, 25 aa, Staphylococcus aureus
NVKLGLNITCLFEKPSVFKSLVSQI

SEQ ID NO: 1651485 - protein, 24 aa, Staphylococcus aureus
NYACILLDLMLPEMDGIQVATKLR

SEQ ID NO: 1651486 - protein, 19 aa, Staphylococcus aureus
PAFEFKQFELFKQSELITQ

SEQ ID NO: 1651487 - protein, 19 aa, Staphylococcus aureus
PDKTVVCFVGDGGFQMTNQ

SEQ ID NO: 1651488 - protein, 20 aa, Staphylococcus aureus
PEWLYCAKANLVLEPAYTGE

SEQ ID NO: 1651489 - protein, 23 aa, Staphylococcus aureus
PKMLPFQGYVLQHFELMDDGFCQ

SEQ ID NO: 1651490 - protein, 27 aa, Staphylococcus aureus
PNLCIEMRSDIPLARGLGSSASALVGA

SEQ ID NO: 1651491 - protein, 23 aa, Staphylococcus aureus
PSSKEITHYMGIPIEESFLKLAD

SEQ ID NO: 1651492 - protein, 19 aa, Staphylococcus aureus
QARGMGGHVRSNWKDVTEI

SEQ ID NO: 1651493 - protein, 20 aa, Staphylococcus aureus
QEKIELFKKLEFKQLLADID

SEQ ID NO: 1651494 - protein, 19 aa, Staphylococcus aureus
QFLKKKVKRYEIPSMIHHV

SEQ ID NO: 1651495 - protein, 18 aa, Staphylococcus aureus
QHAREFDYIKSLRRLTTK

SEQ ID NO: 1651496 - protein, 26 aa, Staphylococcus aureus
QKQKLKLLSFLLEDHDLIILDEVTNA

SEQ ID NO: 1651497 - protein, 19 aa, Staphylococcus aureus
QQLCFPEKLTFHPKTFEET

SEQ ID NO: 1651498 - protein, 18 aa, Staphylococcus aureus
RAKRYNRWLQFDYVIHSA

SEQ ID NO: 1651499 - protein, 25 aa, Staphylococcus aureus
RDGRARVSVGARSSVFAPFKNLGLI

SEQ ID NO: 1651500 - protein, 18 aa, Staphylococcus aureus
RDTSWIYDADFEKLSKQQ

SEQ ID NO: 1651501 - protein, 19 aa, Staphylococcus aureus
RKHDIGFIFQEYNLLHTLT

SEQ ID NO: 1651502 - protein, 20 aa, Staphylococcus aureus
RKVLQKRRFKKALQQKREEH

SEQ ID NO: 1651503 - protein, 21 aa, Staphylococcus aureus
RSSVETLELTHLIVEEAYHCG

SEQ ID NO: 1651504 - protein, 21 aa, Staphylococcus aureus
SAGNMTKFWEIFYERIDVLHD

SEQ ID NO: 1651505 - protein, 27 aa, Staphylococcus aureus
SDLIPELQGRFPIRVELDSLSVEDFVR

SEQ ID NO: 1651506 - protein, 23 aa, Staphylococcus aureus
SEAGQAKGYRRVTINDGIINDVF

SEQ ID NO: 1651507 - protein, 25 aa, Staphylococcus aureus
SIKVYKLFFIEAYKTVFQMTSMVSG

SEQ ID NO: 1651508 - protein, 21 aa, Staphylococcus aureus
SLLALPKLGAINVHASLLPKY

SEQ ID NO: 1651509 - protein, 20 aa, Staphylococcus aureus
SLPYHYYKDYGIRKYGFHGT

SEQ ID NO: 1651510 - protein, 20 aa, Staphylococcus aureus
SLVNELDMRILISSHKLEDI

SEQ ID NO: 1651511 - protein, 26 aa, Staphylococcus aureus
SMNRIAKELGIGMGTLYRHFKDKSDL

SEQ ID NO: 1651512 - protein, 27 aa, Staphylococcus aureus
SNYILKYVFANGIAREIIYALLEEMDL

SEQ ID NO: 1651513 - protein, 17 aa, Staphylococcus aureus
SSEILIKAAKIGVGVIL

SEQ ID NO: 1651514 - protein, 22 aa, Staphylococcus aureus
TGKSHLAYAIAKAVKAKGHTVA

SEQ ID NO: 1651515 - protein, 18 aa, Staphylococcus aureus
TIHLLKKKHFELMKDEAL

SEQ ID NO: 1651516 - protein, 17 aa, Staphylococcus aureus
TKTQLNVVIACYYGLGV

SEQ ID NO: 1651517 - protein, 18 aa, Staphylococcus aureus
TLNQFKAAPLIVTEDTLQ

SEQ ID NO: 1651518 - protein, 18 aa, Staphylococcus aureus
TPLIKSMYLSQSITKGNV

SEQ ID NO: 1651519 - protein, 25 aa, Staphylococcus aureus
TTGEMKKRYGLIYVDRDNDGHGTME

SEQ ID NO: 1651520 - protein, 22 aa, Staphylococcus aureus
TYYRLLVEWNEKMNLTSITDEH

SEQ ID NO: 1651521 - protein, 20 aa, Staphylococcus aureus
VAHTCAYLYHPNARSVTGTI

SEQ ID NO: 1651522 - protein, 18 aa, Staphylococcus aureus
VDNALMISLGLNAVAHQK

SEQ ID NO: 1651523 - protein, 24 aa, Staphylococcus aureus
VEHKAKFVKQFADFSVGVDGLKQY

SEQ ID NO: 1651524 - protein, 20 aa, Staphylococcus aureus
VFSYGIDEEAQFMAKNIQES

SEQ ID NO: 1651525 - protein, 20 aa, Staphylococcus aureus
VGGSVNPGGGMPMVTLSGQQ

SEQ ID NO: 1651526 - protein, 17 aa, Staphylococcus aureus
VIYQCILRDGSEVTVDN

SEQ ID NO: 1651527 - protein, 17 aa, Staphylococcus aureus
VKQFLKKKVKRYEIPSM

SEQ ID NO: 1651528 - protein, 17 aa, Staphylococcus aureus
VKTKNGQMLVCQDPSCK

SEQ ID NO: 1651529 - protein, 25 aa, Staphylococcus aureus
VLCCTPTEYRMMAKLQNLNDYDLTH

SEQ ID NO: 1651530 - protein, 19 aa, Staphylococcus aureus
VLSELCLPLVKKGGQFVAL

SEQ ID NO: 1651531 - protein, 24 aa, Staphylococcus aureus
VMEELRLLARAVFVLDADNKVVYK

SEQ ID NO: 1651532 - protein, 24 aa, Staphylococcus aureus
VPEGLIPLLKIQGLGSKKIAKLYK

SEQ ID NO: 1651533 - protein, 19 aa, Staphylococcus aureus
VVGISMSKLGLISRTAQGV

SEQ ID NO: 1651534 - protein, 17 aa, Staphylococcus aureus
VVMHFADKLCNKQALYR

SEQ ID NO: 1651535 - protein, 17 aa, Staphylococcus aureus
WANERQYTGIDFLGVSY

SEQ ID NO: 1651536 - protein, 17 aa, Staphylococcus aureus
WLVKAVIVAKRQVPELT

SEQ ID NO: 1651537 - protein, 28 aa, Staphylococcus aureus
WLYSTKFMLPKWLYKIAKQRADNKQLQN

SEQ ID NO: 1651538 - protein, 18 aa, Staphylococcus aureus
WNSPEMIMQRALKIANNT

SEQ ID NO: 1651539 - protein, 21 aa, Staphylococcus aureus
YFSYEELTILGGSKLPLVNFE

SEQ ID NO: 1651540 - protein, 24 aa, Staphylococcus aureus
YGENGFGYDPIFYVPKLDKTMAQL

SEQ ID NO: 1651541 - protein, 19 aa, Staphylococcus aureus
YIQAAGVAFALKKRGKNAV

SEQ ID NO: 1651542 - protein, 29 aa, Staphylococcus aureus
YKMPKKMRRLALRSALSFKAQENGLTVVD

SEQ ID NO: 1651543 - protein, 20 aa, Staphylococcus aureus
YQDLNGRIDGIVQAEQSEEG

SEQ ID NO: 1651544 - protein, 17 aa, Staphylococcus aureus
YYEHSIEKIVFADDNGK

SEQ ID NO: 1651545 - protein, 22 aa, Staphylococcus aureus
AAGGHAVMLGSLLAGTEESPGA

SEQ ID NO: 1651546 - protein, 23 aa, Staphylococcus aureus
AANYRSAGTIEFLVTDTAHYFIE

SEQ ID NO: 1651547 - protein, 22 aa, Staphylococcus aureus
AEAAEYFSKVLFQMDIPNNLLI

SEQ ID NO: 1651548 - protein, 24 aa, Staphylococcus aureus
AEGIEVGQVFKLGTKYSESMNATF

SEQ ID NO: 1651549 - protein, 19 aa, Staphylococcus aureus
AFFEKCRDTGVYGLIIPDL

SEQ ID NO: 1651550 - protein, 20 aa, Staphylococcus aureus
AFFTEFAIFMGRGGGKNGLI

SEQ ID NO: 1651551 - protein, 21 aa, Staphylococcus aureus
AIENGCPKVIIASGNKPNIIE

SEQ ID NO: 1651552 - protein, 20 aa, Staphylococcus aureus
AKALVSRFPSATIYNTYGPT

SEQ ID NO: 1651553 - protein, 21 aa, Staphylococcus aureus
ALQRMAMMRSYMRSQVTQQPF

SEQ ID NO: 1651554 - protein, 22 aa, Staphylococcus aureus
ANQYKFPVAVIEEVLKAKEAYG

SEQ ID NO: 1651555 - protein, 21 aa, Staphylococcus aureus
ARRMAKVVGAPFIKVEATKFT

SEQ ID NO: 1651556 - protein, 19 aa, Staphylococcus aureus
ASDIGVKYLTLYAFSTENW

SEQ ID NO: 1651557 - protein, 21 aa, Staphylococcus aureus
ASKAFTCIQMVKLVAEEDLQL

SEQ ID NO: 1651558 - protein, 35 aa, Staphylococcus aureus
AYMGMPGDIFSFYSREGIDGMVIEALGQGNIPPSA

SEQ ID NO: 1651559 - protein, 25 aa, Staphylococcus aureus
CDYLFCKAFGKLASNIEKYTNQGTL

SEQ ID NO: 1651560 - protein, 17 aa, Staphylococcus aureus
CGLPKEMALELFKPFVM

SEQ ID NO: 1651561 - protein, 17 aa, Staphylococcus aureus
CPNCKKKLTLFGKGKEA

SEQ ID NO: 1651562 - protein, 19 aa, Staphylococcus aureus
DLEYLKYAKDYGFSDKTIA

SEQ ID NO: 1651563 - protein, 19 aa, Staphylococcus aureus
DVAKGFGIDEDVARRLASK

SEQ ID NO: 1651564 - protein, 20 aa, Staphylococcus aureus
DVAVLRRYWNGRWIEATPND

SEQ ID NO: 1651565 - protein, 23 aa, Staphylococcus aureus
DYYRTAMIQHIGKMLGIKTPMID

SEQ ID NO: 1651566 - protein, 25 aa, Staphylococcus aureus
EAVEAAIKIARKWGSEVKGITDGQV

SEQ ID NO: 1651567 - protein, 18 aa, Staphylococcus aureus
EDFKRYYPTNALVTGYDI

SEQ ID NO: 1651568 - protein, 23 aa, Staphylococcus aureus
EELESALLKADFVVHLAGVNRPE

SEQ ID NO: 1651569 - protein, 20 aa, Staphylococcus aureus
EEQMLYFGLPRINKYYTADR

SEQ ID NO: 1651570 - protein, 19 aa, Staphylococcus aureus
EKFRERHRVIIRDSNKQWR

SEQ ID NO: 1651571 - protein, 26 aa, Staphylococcus aureus
EKLYKFSPELVYEAWTKKDLLKQWFM

SEQ ID NO: 1651572 - protein, 20 aa, Staphylococcus aureus
ELRYAVSEGVQRIHVESMHE

SEQ ID NO: 1651573 - protein, 18 aa, Staphylococcus aureus
ESELIKFAEECAKAESVV

SEQ ID NO: 1651574 - protein, 20 aa, Staphylococcus aureus
ETYTDFKMGLQIRHYTVQSL

SEQ ID NO: 1651575 - protein, 27 aa, Staphylococcus aureus
EVYKMIKQRMVDAFILLYSKENDPIKQ

SEQ ID NO: 1651576 - protein, 18 aa, Staphylococcus aureus
FARCFEMKEACYAATPAI

SEQ ID NO: 1651577 - protein, 18 aa, Staphylococcus aureus
FATLKGEVGQQFFKQHPE

SEQ ID NO: 1651578 - protein, 22 aa, Staphylococcus aureus
FDIYKGETLGLVGESGCGKSTT

SEQ ID NO: 1651579 - protein, 22 aa, Staphylococcus aureus
FDLNDFIRLKVFSSYNNIHDKI

SEQ ID NO: 1651580 - protein, 18 aa, Staphylococcus aureus
FEEISVRGRVLGISSQTR

SEQ ID NO: 1651581 - protein, 21 aa, Staphylococcus aureus
FGLNKRQGRQLLAYLGAPKEL

SEQ ID NO: 1651582 - protein, 22 aa, Staphylococcus aureus
FKMRGNIFLEEGIEHIEMTKKL

SEQ ID NO: 1651583 - protein, 19 aa, Staphylococcus aureus
FKSNENVLILGYTKHMNEW

SEQ ID NO: 1651584 - protein, 20 aa, Staphylococcus aureus
FKVATLVREYISAIVNIRIN

SEQ ID NO: 1651585 - protein, 20 aa, Staphylococcus aureus
FLNHMLTLFTFHSGLSLNIE

SEQ ID NO: 1651586 - protein, 17 aa, Staphylococcus aureus
FNHYSRFIHLFKETYGN

SEQ ID NO: 1651587 - protein, 23 aa, Staphylococcus aureus
FSLFRKPSEVLRHIEEIANELNI

SEQ ID NO: 1651588 - protein, 22 aa, Staphylococcus aureus
GAIRGRQVIINKFAVELNKDIY

SEQ ID NO: 1651589 - protein, 17 aa, Staphylococcus aureus
GEVFNSKTSFRIEEKVE

SEQ ID NO: 1651590 - protein, 19 aa, Staphylococcus aureus
GINKARGIEQVRQFLNIDR

SEQ ID NO: 1651591 - protein, 20 aa, Staphylococcus aureus
GLSLLKLNQHVAFCDEDHYA

SEQ ID NO: 1651592 - protein, 19 aa, Staphylococcus aureus
GMNGIEITEYIKAHYPDIK

SEQ ID NO: 1651593 - protein, 19 aa, Staphylococcus aureus
GPRILRAETAPLYALSAIS

SEQ ID NO: 1651594 - protein, 19 aa, Staphylococcus aureus
GTKLTFLPYVVKALVSALK

SEQ ID NO: 1651595 - protein, 33 aa, Staphylococcus aureus
GVKNAFDFPGFVPAYIRPLFCEGKGPFRFAALS

SEQ ID NO: 1651596 - protein, 21 aa, Staphylococcus aureus
HFKDKSDLCYYVIQRDLDIFI

SEQ ID NO: 1651597 - protein, 17 aa, Staphylococcus aureus
HFTAVFKQLFGGGDAEL

SEQ ID NO: 1651598 - protein, 18 aa, Staphylococcus aureus
HNQLFIRTDFTSINSPIE

SEQ ID NO: 1651599 - protein, 32 aa, Staphylococcus aureus
HSSSGRSPSQLGFRYYVNRLLEQTSHQKTNKL

SEQ ID NO: 1651600 - protein, 18 aa, Staphylococcus aureus
HVRSNWKDVTEIIAAQLL

SEQ ID NO: 1651601 - protein, 20 aa, Staphylococcus aureus
HYFIEMNARIQVEHTVTEMR

SEQ ID NO: 1651602 - protein, 25 aa, Staphylococcus aureus
IALAKRLKLPIIIHNREATQDCIDI

SEQ ID NO: 1651603 - protein, 19 aa, Staphylococcus aureus
IAPIFGLNKRQGRQLLAYL

SEQ ID NO: 1651604 - protein, 29 aa, Staphylococcus aureus
IDAYLKVAYQFSLPFGKDYADAHEEMVRE

SEQ ID NO: 1651605 - protein, 17 aa, Staphylococcus aureus
IDQNIPYTVLRDNIYTH

SEQ ID NO: 1651606 - protein, 18 aa, Staphylococcus aureus
IEGFTVRIVDKFNAEQIL

SEQ ID NO: 1651607 - protein, 19 aa, Staphylococcus aureus
IELIKRLVSYVPKIELHMY

SEQ ID NO: 1651608 - protein, 24 aa, Staphylococcus aureus
IELVKVDGRISVITFHSLEDRLCK

SEQ ID NO: 1651609 - protein, 20 aa, Staphylococcus aureus
IENNRFPLVLGGDHSIAVGS

SEQ ID NO: 1651610 - protein, 25 aa, Staphylococcus aureus
IEQKKGPFAPDFIKVWKERYKKIRQ

SEQ ID NO: 1651611 - protein, 18 aa, Staphylococcus aureus
IESQCEVIALDATLQQRP

SEQ ID NO: 1651612 - protein, 28 aa, Staphylococcus aureus
IFKEEGYEPWTSCEFDFTKEGELKVSFD

SEQ ID NO: 1651613 - protein, 21 aa, Staphylococcus aureus
IGHYHCQCGFKREQAKYEISS

SEQ ID NO: 1651614 - protein, 20 aa, Staphylococcus aureus
IGYSFKFDGAISRQEASKDV

SEQ ID NO: 1651615 - protein, 23 aa, Staphylococcus aureus
IIEKGDMITLDFGAYYNGYCSDI

SEQ ID NO: 1651616 - protein, 18 aa, Staphylococcus aureus
IIPLEVVVRNIASGSITK

SEQ ID NO: 1651617 - protein, 17 aa, Staphylococcus aureus
IKDGRLYHEIYRGEESQ

SEQ ID NO: 1651618 - protein, 26 aa, Staphylococcus aureus
IPHGHAVMVGIIYQFIVANALFDSKH

SEQ ID NO: 1651619 - protein, 19 aa, Staphylococcus aureus
IREKFALKPFDKHQFQHST

SEQ ID NO: 1651620 - protein, 21 aa, Staphylococcus aureus
ITAFLKNEFPQSDILMSILSN

SEQ ID NO: 1651621 - protein, 17 aa, Staphylococcus aureus
ITEYIKAHYPDIKVLVL

SEQ ID NO: 1651622 - protein, 17 aa, Staphylococcus aureus
IVKEVLKHVNFDLKDLH

SEQ ID NO: 1651623 - protein, 17 aa, Staphylococcus aureus
IYCLAPFAETVKKQLRK

SEQ ID NO: 1651624 - protein, 21 aa, Staphylococcus aureus
KAKLNPAICFTMLGHHLGVDI

SEQ ID NO: 1651625 - protein, 18 aa, Staphylococcus aureus
KALFKLLALESQHAGLSW

SEQ ID NO: 1651626 - protein, 24 aa, Staphylococcus aureus
KASIKPFIRRTPLIKSMYLSQSIT

SEQ ID NO: 1651627 - protein, 22 aa, Staphylococcus aureus
KDRSQRAKVFVRFSNFNELFQF

SEQ ID NO: 1651628 - protein, 24 aa, Staphylococcus aureus
KDVCQRFTTDFNKCVLQNMSQLQC

SEQ ID NO: 1651629 - protein, 18 aa, Staphylococcus aureus
KEHLLSPLFKDWHKYNTD

SEQ ID NO: 1651630 - protein, 23 aa, Staphylococcus aureus
KEIKRLYIEEGCAIQKEYYVGFV

SEQ ID NO: 1651631 - protein, 21 aa, Staphylococcus aureus
KEKNHIISIARLVENKQIKHQ

SEQ ID NO: 1651632 - protein, 20 aa, Staphylococcus aureus
KKFAEQALQELISDSFKVAI

SEQ ID NO: 1651633 - protein, 28 aa, Staphylococcus aureus
KLQTYLTPHFISFEIVYEAMDLIDDIED

SEQ ID NO: 1651634 - protein, 26 aa, Staphylococcus aureus
KNGMATMKFDMCGAANVVGIIEAASR

SEQ ID NO: 1651635 - protein, 23 aa, Staphylococcus aureus
KPILIHTIEKFILVSEFNEIIIA

SEQ ID NO: 1651636 - protein, 18 aa, Staphylococcus aureus
KRLLELYKNYKGNITRFV

SEQ ID NO: 1651637 - protein, 19 aa, Staphylococcus aureus
KRYYPTNALVTGYDIIFFW

SEQ ID NO: 1651638 - protein, 27 aa, Staphylococcus aureus
KSPLAEISVKVFNEFNISEREASDIIN

SEQ ID NO: 1651639 - protein, 22 aa, Staphylococcus aureus
KVLYLEIGIGYTTPQFVKHPFQ

SEQ ID NO: 1651640 - protein, 25 aa, Staphylococcus aureus
KVNLKKIYTCLVYGKTHTSGIIEAN

SEQ ID NO: 1651641 - protein, 26 aa, Staphylococcus aureus
KWYFPTLPFQRFIIANIFLIDKNTDE

SEQ ID NO: 1651642 - protein, 20 aa, Staphylococcus aureus
KYSLCKVHLHTGRTHQIRVH

SEQ ID NO: 1651643 - protein, 17 aa, Staphylococcus aureus
LADQHSLNHVAFCCIST

SEQ ID NO: 1651644 - protein, 24 aa, Staphylococcus aureus
LAELNIRLHEALQYAQPVEVKFYN

SEQ ID NO: 1651645 - protein, 19 aa, Staphylococcus aureus
LDVLQEIVKGFGYSYRDYQ

SEQ ID NO: 1651646 - protein, 29 aa, Staphylococcus aureus
LEKWYQIEYLKEMVTFVVVNRDKNSQNVE

SEQ ID NO: 1651647 - protein, 18 aa, Staphylococcus aureus
LFPRELLVEKGILTTFEH

SEQ ID NO: 1651648 - protein, 24 aa, Staphylococcus aureus
LIELKDGIPDVCFVRDLEGICLSR

SEQ ID NO: 1651649 - protein, 25 aa, Staphylococcus aureus
LKIKSERDYLFFKLAIHSGLKVSEL

SEQ ID NO: 1651650 - protein, 20 aa, Staphylococcus aureus
LKLPEHHSYIISYNGSKTIN

SEQ ID NO: 1651651 - protein, 24 aa, Staphylococcus aureus
LKNVVNHFIAWMGYTKGTFVKTEK

SEQ ID NO: 1651652 - protein, 17 aa, Staphylococcus aureus
LLAPRIDTMFAKHNVIY

SEQ ID NO: 1651653 - protein, 18 aa, Staphylococcus aureus
LMPPHEYDAITVTLEVAG

SEQ ID NO: 1651654 - protein, 24 aa, Staphylococcus aureus
LMSRVRRYPLPLVLEISNIESVMP

SEQ ID NO: 1651655 - protein, 23 aa, Staphylococcus aureus
LNHIRLEHCLIDILTSKKPIEEI

SEQ ID NO: 1651656 - protein, 18 aa, Staphylococcus aureus
LNYFKLKKFIVALESKTA

SEQ ID NO: 1651657 - protein, 18 aa, Staphylococcus aureus
LPEDQRKAVWAIYAVCRK

SEQ ID NO: 1651658 - protein, 25 aa, Staphylococcus aureus
LPFVHAKGGIYVWLETPPGYDSEQF

SEQ ID NO: 1651659 - protein, 17 aa, Staphylococcus aureus
LREKLNRVSSEAAHMIQ

SEQ ID NO: 1651660 - protein, 23 aa, Staphylococcus aureus
LSYRLLPEVSLDCIIEDVYASFD

SEQ ID NO: 1651661 - protein, 23 aa, Staphylococcus aureus
LTKFPGIGKKTARQIVLDLKGKV

SEQ ID NO: 1651662 - protein, 21 aa, Staphylococcus aureus
MLPHYRPYKIAEHFRMMAALY

SEQ ID NO: 1651663 - protein, 17 aa, Staphylococcus aureus
MMREVRLALLEADVNFK

SEQ ID NO: 1651664 - protein, 22 aa, Staphylococcus aureus
MQRLMATGGLEIFATDDPEITS

SEQ ID NO: 1651665 - protein, 22 aa, Staphylococcus aureus
NDSLCVLNHLYINEGQEETFEQ

SEQ ID NO: 1651666 - protein, 18 aa, Staphylococcus aureus
NGHIPRLTYHTNRIKCSS

SEQ ID NO: 1651667 - protein, 25 aa, Staphylococcus aureus
NKTIPWLYVERGFEIPSFNYVLKTE

SEQ ID NO: 1651668 - protein, 22 aa, Staphylococcus aureus
NLMQAEALRSLKAIRDKAKDKA

SEQ ID NO: 1651669 - protein, 17 aa, Staphylococcus aureus
NNYPFPNTFKVLAVSGA

SEQ ID NO: 1651670 - protein, 25 aa, Staphylococcus aureus
NRYGCALAVEVLKRLKDENIGINLY

SEQ ID NO: 1651671 - protein, 20 aa, Staphylococcus aureus
NSELLDADFGYAIDASADVG

SEQ ID NO: 1651672 - protein, 20 aa, Staphylococcus aureus
PAVAFRLFKQLVEERYGKEE

SEQ ID NO: 1651673 - protein, 18 aa, Staphylococcus aureus
PDCRAMDLWIDPIVEQYN

SEQ ID NO: 1651674 - protein, 17 aa, Staphylococcus aureus
PDLIILDVMLPKKDGID

SEQ ID NO: 1651675 - protein, 19 aa, Staphylococcus aureus
PFQEGRDGFVMGEGAGILV

SEQ ID NO: 1651676 - protein, 19 aa, Staphylococcus aureus
PYLPELMNMHKLIYPAGDG

SEQ ID NO: 1651677 - protein, 24 aa, Staphylococcus aureus
QENFAISIGIYIDGKPYAGFVYDV

SEQ ID NO: 1651678 - protein, 21 aa, Staphylococcus aureus
QEVLEDLGIEEAEFEQAFLNS

SEQ ID NO: 1651679 - protein, 21 aa, Staphylococcus aureus
QGEALKSIILNKFPDKKIDII

SEQ ID NO: 1651680 - protein, 17 aa, Staphylococcus aureus
QGVSFDFVTPFGTYPVK

SEQ ID NO: 1651681 - protein, 20 aa, Staphylococcus aureus
QHILLRVNLAGPFPNATLHM

SEQ ID NO: 1651682 - protein, 17 aa, Staphylococcus aureus
QNGKFKDFFDFARRIPK

SEQ ID NO: 1651683 - protein, 22 aa, Staphylococcus aureus
QRLNLDYLDLVLIHQPYNDVYG

SEQ ID NO: 1651684 - protein, 21 aa, Staphylococcus aureus
QRVHGGAMLKENRMVEANLTE

SEQ ID NO: 1651685 - protein, 17 aa, Staphylococcus aureus
RARDGLNQTQLAKQAGV

SEQ ID NO: 1651686 - protein, 17 aa, Staphylococcus aureus
RDELKSVLIDDSKGFAH

SEQ ID NO: 1651687 - protein, 20 aa, Staphylococcus aureus
RELLLDYQFVEKIKDGREDE

SEQ ID NO: 1651688 - protein, 28 aa, Staphylococcus aureus
RKNDDYIWLGHSFVRQGFLDDVKLEPPI

SEQ ID NO: 1651689 - protein, 21 aa, Staphylococcus aureus
RLMKQAEKFNRPIFTFIDTKG

SEQ ID NO: 1651690 - protein, 25 aa, Staphylococcus aureus
RNNILKFSLFTGEKHIVINADDINN

SEQ ID NO: 1651691 - protein, 17 aa, Staphylococcus aureus
RQAVYTGIFQWQNGQLV

SEQ ID NO: 1651692 - protein, 24 aa, Staphylococcus aureus
RTWKGKRSTDDIFTRLKDGHLRFR

SEQ ID NO: 1651693 - protein, 27 aa, Staphylococcus aureus
RVDNVFPTKHAIGLKADNGLELLVHIG

SEQ ID NO: 1651694 - protein, 21 aa, Staphylococcus aureus
SFDFVTPFGTYPVKSPYVGKF

SEQ ID NO: 1651695 - protein, 18 aa, Staphylococcus aureus
SLFEDYGKIFGRMIGAQL

SEQ ID NO: 1651696 - protein, 18 aa, Staphylococcus aureus
SLLDIPTIFYVYDEGTYD

SEQ ID NO: 1651697 - protein, 18 aa, Staphylococcus aureus
SSAASFARTFKHFTHQTP

SEQ ID NO: 1651698 - protein, 19 aa, Staphylococcus aureus
STRNKLGFDELSKRKGYQI

SEQ ID NO: 1651699 - protein, 25 aa, Staphylococcus aureus
SYCGPGRRKTFTFVNNRPLAALTEE

SEQ ID NO: 1651700 - protein, 26 aa, Staphylococcus aureus
TGLPMKRVDDIKAYIQGDVPKVMGVD

SEQ ID NO: 1651701 - protein, 17 aa, Staphylococcus aureus
TKHQFVMIARFAYPKLP

SEQ ID NO: 1651702 - protein, 19 aa, Staphylococcus aureus
TMPQIGLGTFRVENDENCM

SEQ ID NO: 1651703 - protein, 23 aa, Staphylococcus aureus
TMRKEVIGGLGGFGATFDLSQLN

SEQ ID NO: 1651704 - protein, 22 aa, Staphylococcus aureus
VASTFRILIKYLIYSKIKQQSY

SEQ ID NO: 1651705 - protein, 23 aa, Staphylococcus aureus
VEAFKGMDTVVFIPSIIHPSFKR

SEQ ID NO: 1651706 - protein, 18 aa, Staphylococcus aureus
VERTNLPVVETFQGAGVI

SEQ ID NO: 1651707 - protein, 17 aa, Staphylococcus aureus
VFMKDGRMILTEQKDIL

SEQ ID NO: 1651708 - protein, 21 aa, Staphylococcus aureus
VKVTTPILVKAPIAGRRILLK

SEQ ID NO: 1651709 - protein, 19 aa, Staphylococcus aureus
VNAALHYLARLIEAGDLPT

SEQ ID NO: 1651710 - protein, 18 aa, Staphylococcus aureus
VPSSLNLKVVVFDDKDYD

SEQ ID NO: 1651711 - protein, 22 aa, Staphylococcus aureus
VQDLLIPLTFHFSKDEQLVIDQ

SEQ ID NO: 1651712 - protein, 28 aa, Staphylococcus aureus
VRLDGATKEFFAWGFRVGFMTFGTSDQT

SEQ ID NO: 1651713 - protein, 30 aa, Staphylococcus aureus
VSDTAVMIAWLVKIPHRIMPILGTSQLKRI

SEQ ID NO: 1651714 - protein, 18 aa, Staphylococcus aureus
VTGIGPKSALAILATSTP

SEQ ID NO: 1651715 - protein, 24 aa, Staphylococcus aureus
VVDISGRPYLSFNASLSKEKVGTF

SEQ ID NO: 1651716 - protein, 26 aa, Staphylococcus aureus
WAETKKLTGWYARRIAVGRDGEVQGV

SEQ ID NO: 1651717 - protein, 19 aa, Staphylococcus aureus
YAVCRKIDDSIDVYGDIQF

SEQ ID NO: 1651718 - protein, 17 aa, Staphylococcus aureus
YDEPVMKGYVRYSIATA

SEQ ID NO: 1651719 - protein, 23 aa, Staphylococcus aureus
YDKNKFKVIGPFVADNYVLSVDT

SEQ ID NO: 1651720 - protein, 21 aa, Staphylococcus aureus
YGFHIIIAGSFSDIFYMNCTK

SEQ ID NO: 1651721 - protein, 23 aa, Staphylococcus aureus
YKAIRGEGAFCNGIKMEEPPSLK

SEQ ID NO: 1651722 - protein, 19 aa, Staphylococcus aureus
YNISYASKAFTCIQMVKLV

SEQ ID NO: 1651723 - protein, 17 aa, Staphylococcus aureus
YQESFGYMAQQLCFPEK

SEQ ID NO: 1651724 - protein, 20 aa, Staphylococcus aureus
YQFDFKRFNSVSEFKNATLL

SEQ ID NO: 1651725 - protein, 30 aa, Staphylococcus aureus
YRKEVPPLMCASLWPKFDLFKKYANSELIL

SEQ ID NO: 1651726 - protein, 21 aa, Staphylococcus aureus
YSTQNLDLWYGENHALQNINL

SEQ ID NO: 1651727 - protein, 28 aa, Staphylococcus aureus
AAGDTFRAGAIDQLKVWGERVGVDVISQ

SEQ ID NO: 1651728 - protein, 17 aa, Staphylococcus aureus
AEFAALAFKVMTDPYVG

SEQ ID NO: 1651729 - protein, 19 aa, Staphylococcus aureus
AGLLKPKAAYELIGELKSA

SEQ ID NO: 1651730 - protein, 22 aa, Staphylococcus aureus
AIPVCGFAWIHWSVANVSVSGN

SEQ ID NO: 1651731 - protein, 30 aa, Staphylococcus aureus
AKLADRLGFKRIWFTEHHNVPAFACSSPEL

SEQ ID NO: 1651732 - protein, 22 aa, Staphylococcus aureus
AKRAQRGITLLKELKKNPHRIV

SEQ ID NO: 1651733 - protein, 23 aa, Staphylococcus aureus
AMNLKLVDFKIEFGKTETGQILL

SEQ ID NO: 1651734 - protein, 17 aa, Staphylococcus aureus
ATLELVRQLQFFINERI

SEQ ID NO: 1651735 - protein, 18 aa, Staphylococcus aureus
AYLQQKGFNPELMSATIH

SEQ ID NO: 1651736 - protein, 19 aa, Staphylococcus aureus
CFNCLVPQLPALNLTCDTV

SEQ ID NO: 1651737 - protein, 17 aa, Staphylococcus aureus
DDVHCLYFHLTDATTTK

SEQ ID NO: 1651738 - protein, 26 aa, Staphylococcus aureus
DELNEGVAPGVPWKNGPVPVDKAIYG

SEQ ID NO: 1651739 - protein, 18 aa, Staphylococcus aureus
DFFAKAKPSLQIINVARG

SEQ ID NO: 1651740 - protein, 23 aa, Staphylococcus aureus
DKRVDELLEMVGLEPEKYKNRKP

SEQ ID NO: 1651741 - protein, 20 aa, Staphylococcus aureus
DLVFEWKAFMNTIADFDDET

SEQ ID NO: 1651742 - protein, 18 aa, Staphylococcus aureus
DSLQYFIDCMPKSEWLKR

SEQ ID NO: 1651743 - protein, 17 aa, Staphylococcus aureus
DTLDHLWRVTSLNQAIA

SEQ ID NO: 1651744 - protein, 18 aa, Staphylococcus aureus
DYILPGYRDVPQIIWHGL

SEQ ID NO: 1651745 - protein, 23 aa, Staphylococcus aureus
EALKRGTAILITGGFKPSNKVIN

SEQ ID NO: 1651746 - protein, 22 aa, Staphylococcus aureus
EAQREIGLVLAPVSVDIHHQNK

SEQ ID NO: 1651747 - protein, 19 aa, Staphylococcus aureus
ECEYCKSKDYNLCNHRKGI

SEQ ID NO: 1651748 - protein, 21 aa, Staphylococcus aureus
EEFKVAIEGVIFDINLKELKS

SEQ ID NO: 1651749 - protein, 25 aa, Staphylococcus aureus
EHFARKVSNHWLRLMSVNEEGRFKS

SEQ ID NO: 1651750 - protein, 20 aa, Staphylococcus aureus
EKEPKLAIIAEIKSKSPTVN

SEQ ID NO: 1651751 - protein, 21 aa, Staphylococcus aureus
EKKIPRAVLIDAIEAALITAY

SEQ ID NO: 1651752 - protein, 24 aa, Staphylococcus aureus
EKTLIEYMDYLSLKDPKRILKSYP

SEQ ID NO: 1651753 - protein, 21 aa, Staphylococcus aureus
ELDVAPMFKSLIGKEISEEDA

SEQ ID NO: 1651754 - protein, 25 aa, Staphylococcus aureus
ENEIKNWEFPLVIKPGDDLPTAGGY

SEQ ID NO: 1651755 - protein, 17 aa, Staphylococcus aureus
ERGLLPGNGAITSVVSV

SEQ ID NO: 1651756 - protein, 23 aa, Staphylococcus aureus
ESYKEGVKAFAKMKGNLPDAILC

SEQ ID NO: 1651757 - protein, 20 aa, Staphylococcus aureus
ETVKTFLARHDFSKKTVSAI

SEQ ID NO: 1651758 - protein, 22 aa, Staphylococcus aureus
EVIKLCGALMQYYRETGIYAER

SEQ ID NO: 1651759 - protein, 20 aa, Staphylococcus aureus
EVNEDTSLVWLCNPNNPTGT

SEQ ID NO: 1651760 - protein, 23 aa, Staphylococcus aureus
FAEHLNHPVSYYFKNNFYITPSG

SEQ ID NO: 1651761 - protein, 21 aa, Staphylococcus aureus
FGDSRIVGLIGKNGVGKTTVM

SEQ ID NO: 1651762 - protein, 17 aa, Staphylococcus aureus
FIETAKIVLRWLKEQGI

SEQ ID NO: 1651763 - protein, 17 aa, Staphylococcus aureus
FLAGLAVGFWESKDDIA

SEQ ID NO: 1651764 - protein, 20 aa, Staphylococcus aureus
FNYFSTPSFVTNIYETDELY

SEQ ID NO: 1651765 - protein, 22 aa, Staphylococcus aureus
FPCLNCTKSIIQAGIKRIYYAE

SEQ ID NO: 1651766 - protein, 18 aa, Staphylococcus aureus
FTKANPFTRFIRAKATLT

SEQ ID NO: 1651767 - protein, 24 aa, Staphylococcus aureus
FVIDKRHFSAFVGTDLDLQLRRRG

SEQ ID NO: 1651768 - protein, 26 aa, Staphylococcus aureus
FYATEFDFPKALRKEEIVGSIENDEI

SEQ ID NO: 1651769 - protein, 18 aa, Staphylococcus aureus
GDFIFVGDIGRPDLLEKS

SEQ ID NO: 1651770 - protein, 21 aa, Staphylococcus aureus
GEFRYWSAMGHHMYHPEVWLI

SEQ ID NO: 1651771 - protein, 23 aa, Staphylococcus aureus
GHGAGSPCGKALGAIPISTIGYE

SEQ ID NO: 1651772 - protein, 21 aa, Staphylococcus aureus
GIKVGMIHGGLTPRERKQQMK

SEQ ID NO: 1651773 - protein, 19 aa, Staphylococcus aureus
GKQVFNYFSTPSFVTNIYE

SEQ ID NO: 1651774 - protein, 20 aa, Staphylococcus aureus
GKTPYVIGGLTFANTIGATT

SEQ ID NO: 1651775 - protein, 23 aa, Staphylococcus aureus
GMGDIGKAFARRLQGFNTNILYH

SEQ ID NO: 1651776 - protein, 21 aa, Staphylococcus aureus
GMPPTGGLGIGIDRLVMLLTD

SEQ ID NO: 1651777 - protein, 27 aa, Staphylococcus aureus
GMQTLGVALPWAISAALVRPNTQVVSV

SEQ ID NO: 1651778 - protein, 18 aa, Staphylococcus aureus
GPQIRRLPVSKMNQDLLA

SEQ ID NO: 1651779 - protein, 25 aa, Staphylococcus aureus
GTGTRVLGGLSYRESHFALELLHQS

SEQ ID NO: 1651780 - protein, 19 aa, Staphylococcus aureus
HPPMIAIAVQRAGGKRKDT

SEQ ID NO: 1651781 - protein, 24 aa, Staphylococcus aureus
HTLYDYPSHQLVTFGVTGTNGKTS

SEQ ID NO: 1651782 - protein, 18 aa, Staphylococcus aureus
IAGFKEIEYEVMRDKNDN

SEQ ID NO: 1651783 - protein, 23 aa, Staphylococcus aureus
IDVVKARGAEVILTDTFALNKPA

SEQ ID NO: 1651784 - protein, 25 aa, Staphylococcus aureus
IEFARSGDTIVVWRLDRLGRNMEDL

SEQ ID NO: 1651785 - protein, 25 aa, Staphylococcus aureus
IEIIYLKSCDLTTILHNLYKRGVGT

SEQ ID NO: 1651786 - protein, 22 aa, Staphylococcus aureus
IESKRGGGGYIRITKIENKDAT

SEQ ID NO: 1651787 - protein, 17 aa, Staphylococcus aureus
IFPEAYVPFLQKYNPNI

SEQ ID NO: 1651788 - protein, 23 aa, Staphylococcus aureus
ILSKRELEILPLIAKGYGNKEIA

SEQ ID NO: 1651789 - protein, 17 aa, Staphylococcus aureus
IMGMNFHLVCPKELNPT

SEQ ID NO: 1651790 - protein, 17 aa, Staphylococcus aureus
INDMYFAPFSYEKDEYI

SEQ ID NO: 1651791 - protein, 18 aa, Staphylococcus aureus
IPEGVLIRAIEPEEGLSA

SEQ ID NO: 1651792 - protein, 25 aa, Staphylococcus aureus
IQPILKEKFIALGLDVKEDEAAKHP

SEQ ID NO: 1651793 - protein, 18 aa, Staphylococcus aureus
ISKNMLFIPFKGENVDGH

SEQ ID NO: 1651794 - protein, 24 aa, Staphylococcus aureus
IYYIVCAGGVRSAKVVEYLEANGI

SEQ ID NO: 1651795 - protein, 22 aa, Staphylococcus aureus
KAEIMPTFKALGLDDYIEVVVG

SEQ ID NO: 1651796 - protein, 21 aa, Staphylococcus aureus
KAKHTLQLIGFDKVAGYRLPK

SEQ ID NO: 1651797 - protein, 18 aa, Staphylococcus aureus
KARKAIESFVAETTEKYG

SEQ ID NO: 1651798 - protein, 17 aa, Staphylococcus aureus
KDIPYLIAGGINSENIQ

SEQ ID NO: 1651799 - protein, 20 aa, Staphylococcus aureus
KEAYGNKDFIVGYRLSPEEA

SEQ ID NO: 1651800 - protein, 20 aa, Staphylococcus aureus
KETVDLPVIGIVKRDYDHSD

SEQ ID NO: 1651801 - protein, 39 aa, Staphylococcus aureus
KFDHPNVICTYDLLFRSGLDLNVDFVIRVGKPVISKKLN

SEQ ID NO: 1651802 - protein, 19 aa, Staphylococcus aureus
KKAAALVGEKKLQLMPLDN

SEQ ID NO: 1651803 - protein, 20 aa, Staphylococcus aureus
KKDVIDKILHFEKQMSQAET

SEQ ID NO: 1651804 - protein, 21 aa, Staphylococcus aureus
KKMLARKGYDVGWQEGDDSIL

SEQ ID NO: 1651805 - protein, 25 aa, Staphylococcus aureus
KLEQPLTIAGIFTFKPNEDDRDGEV

SEQ ID NO: 1651806 - protein, 19 aa, Staphylococcus aureus
KLLYRHMGPQNWWPADNDI

SEQ ID NO: 1651807 - protein, 22 aa, Staphylococcus aureus
KNLKEWRLEDLPIIPKYMKTVV

SEQ ID NO: 1651808 - protein, 18 aa, Staphylococcus aureus
KQIMLRLEKELSKLHEAF

SEQ ID NO: 1651809 - protein, 18 aa, Staphylococcus aureus
KRLFLARKQLEFYSTQCD

SEQ ID NO: 1651810 - protein, 17 aa, Staphylococcus aureus
KSGCGKSTLLNTIAGLE

SEQ ID NO: 1651811 - protein, 19 aa, Staphylococcus aureus
KSQGPKRLLAQFAPIEKKE

SEQ ID NO: 1651812 - protein, 17 aa, Staphylococcus aureus
KTIVYKGWLRSDQIKKL

SEQ ID NO: 1651813 - protein, 20 aa, Staphylococcus aureus
KVKPGEFYFIPAGTVHTISS

SEQ ID NO: 1651814 - protein, 17 aa, Staphylococcus aureus
KYRILDYVNHFDSQRRK

SEQ ID NO: 1651815 - protein, 18 aa, Staphylococcus aureus
LEVFKNECDLSYDITSLY

SEQ ID NO: 1651816 - protein, 19 aa, Staphylococcus aureus
LFGPTITVKALLNMRMENK

SEQ ID NO: 1651817 - protein, 23 aa, Staphylococcus aureus
LFSKEEWLSMSLAERQKAEKAFR

SEQ ID NO: 1651818 - protein, 25 aa, Staphylococcus aureus
LGLPYRRVILCTGDIGFSASKTYDL

SEQ ID NO: 1651819 - protein, 17 aa, Staphylococcus aureus
LHQSHLISSMDLVEVNP

SEQ ID NO: 1651820 - protein, 18 aa, Staphylococcus aureus
LIKYCFEELDLNRIEISA

SEQ ID NO: 1651821 - protein, 34 aa, Staphylococcus aureus
LITNPQAFNLLDWKKRRSLLFEIAKPINDEDVIK

SEQ ID NO: 1651822 - protein, 18 aa, Staphylococcus aureus
LKGVEGLSPKTRRKYDEF

SEQ ID NO: 1651823 - protein, 20 aa, Staphylococcus aureus
LKLQRERGITFLFIAHDLSM

SEQ ID NO: 1651824 - protein, 21 aa, Staphylococcus aureus
LKLYKFFIIIAKYIKHNEQFF

SEQ ID NO: 1651825 - protein, 19 aa, Staphylococcus aureus
LKMLAHKMNKAIVIVLHDI

SEQ ID NO: 1651826 - protein, 19 aa, Staphylococcus aureus
LKRLLDLGAPGIIVQNEKR

SEQ ID NO: 1651827 - protein, 18 aa, Staphylococcus aureus
LKSKALKINNVLKQLMDA

SEQ ID NO: 1651828 - protein, 20 aa, Staphylococcus aureus
LKTKRYTYTHIQRLLMNVLL

SEQ ID NO: 1651829 - protein, 18 aa, Staphylococcus aureus
LNNQITSIIFKYLQENGI

SEQ ID NO: 1651830 - protein, 26 aa, Staphylococcus aureus
LSGGQRQRAYIAMTIAQDTEYILLDE

SEQ ID NO: 1651831 - protein, 19 aa, Staphylococcus aureus
LSSEIKMNALEHVSFELLK

SEQ ID NO: 1651832 - protein, 21 aa, Staphylococcus aureus
LSSLPYVLCVIRRRIQSGHVM

SEQ ID NO: 1651833 - protein, 19 aa, Staphylococcus aureus
MMARETWLNADEAIEQGFA

SEQ ID NO: 1651834 - protein, 19 aa, Staphylococcus aureus
MNPQLPIVAIGGINTNNVA

SEQ ID NO: 1651835 - protein, 18 aa, Staphylococcus aureus
MRLPIEYLANIFTAGDTE

SEQ ID NO: 1651836 - protein, 26 aa, Staphylococcus aureus
MSQLQCAKSSLSLETIFHCYHHMMSC

SEQ ID NO: 1651837 - protein, 17 aa, Staphylococcus aureus
MYREVAFHGGIPDTGFY

SEQ ID NO: 1651838 - protein, 26 aa, Staphylococcus aureus
NEDKVEWIILAGYMRLIGPDLLASFE

SEQ ID NO: 1651839 - protein, 22 aa, Staphylococcus aureus
NEWISMLGVVPVIRALREKAMA

SEQ ID NO: 1651840 - protein, 26 aa, Staphylococcus aureus
NIYEATDFHHFVKLLKTKRYTYTHIQ

SEQ ID NO: 1651841 - protein, 20 aa, Staphylococcus aureus
NKLAAELAKSFQVVLIDLRG

SEQ ID NO: 1651842 - protein, 17 aa, Staphylococcus aureus
NKVEVIKEIIKKVRGGN

SEQ ID NO: 1651843 - protein, 18 aa, Staphylococcus aureus
NLEDGRLNVILMVGVNGV

SEQ ID NO: 1651844 - protein, 23 aa, Staphylococcus aureus
NQKIKRIAIIGGSGIGYEYQAVQ

SEQ ID NO: 1651845 - protein, 20 aa, Staphylococcus aureus
NRPNVRQGLKQSGVYIPETT

SEQ ID NO: 1651846 - protein, 19 aa, Staphylococcus aureus
NSKEALAYYEEVFGATDVK

SEQ ID NO: 1651847 - protein, 18 aa, Staphylococcus aureus
NYVQSHSFIKSLVLGISG

SEQ ID NO: 1651848 - protein, 17 aa, Staphylococcus aureus
PHVSTLYVDDGPDAVDY

SEQ ID NO: 1651849 - protein, 17 aa, Staphylococcus aureus
PKIKAKPAITQMKYSLD

SEQ ID NO: 1651850 - protein, 18 aa, Staphylococcus aureus
PSHLWWQGIDPIAAIRIL

SEQ ID NO: 1651851 - protein, 26 aa, Staphylococcus aureus
PSMGPRSVDYLHHLIQAMHLAYSDRA

SEQ ID NO: 1651852 - protein, 27 aa, Staphylococcus aureus
PSQMGIRKPEFSSAISTISSSIAFDEL

SEQ ID NO: 1651853 - protein, 18 aa, Staphylococcus aureus
PSYALFKGQDLVYFMPRE

SEQ ID NO: 1651854 - protein, 19 aa, Staphylococcus aureus
PVIASHVGGISELVADNGI

SEQ ID NO: 1651855 - protein, 20 aa, Staphylococcus aureus
QELVEMMARETWLNADEAIE

SEQ ID NO: 1651856 - protein, 18 aa, Staphylococcus aureus
QLFMPIRVAVTGQMHGPE

SEQ ID NO: 1651857 - protein, 18 aa, Staphylococcus aureus
QNIKLIACTMSMDVMGIQ

SEQ ID NO: 1651858 - protein, 21 aa, Staphylococcus aureus
QRIRQNLDRIVKSQANQKKLS

SEQ ID NO: 1651859 - protein, 18 aa, Staphylococcus aureus
QTSNIVIEGAIFDPVSIR

SEQ ID NO: 1651860 - protein, 24 aa, Staphylococcus aureus
QYMAKRRIGALIVFEKETGLQDYI

SEQ ID NO: 1651861 - protein, 20 aa, Staphylococcus aureus
RASGFCIYNDIAITAQYLAK

SEQ ID NO: 1651862 - protein, 20 aa, Staphylococcus aureus
RENYEALLIYYKNSIDNPIV

SEQ ID NO: 1651863 - protein, 17 aa, Staphylococcus aureus
RILRNFPEKLSKYVAKW

SEQ ID NO: 1651864 - protein, 17 aa, Staphylococcus aureus
RKIIGNEFVYVFDDEAS

SEQ ID NO: 1651865 - protein, 25 aa, Staphylococcus aureus
RMHKGTEQMLGMFANTLVYRGQPSP

SEQ ID NO: 1651866 - protein, 23 aa, Staphylococcus aureus
RNLMKQKLEMLGEDIDKNKESLQ

SEQ ID NO: 1651867 - protein, 19 aa, Staphylococcus aureus
RNLSKYNKCLMLKPEPLVG

SEQ ID NO: 1651868 - protein, 26 aa, Staphylococcus aureus
RPDKLDKCFYKYYGLNKLINLLIKEK

SEQ ID NO: 1651869 - protein, 24 aa, Staphylococcus aureus
RQMIKWTKLYIDQFLSSWTMPKRE

SEQ ID NO: 1651870 - protein, 20 aa, Staphylococcus aureus
SESKYKVYIIDEVHMLTTGA

SEQ ID NO: 1651871 - protein, 19 aa, Staphylococcus aureus
SHSFIKSLVLGISGGQDST

SEQ ID NO: 1651872 - protein, 18 aa, Staphylococcus aureus
SKDYNLCNHRKGIGTQVD

SEQ ID NO: 1651873 - protein, 18 aa, Staphylococcus aureus
SKISFIDKTRVLFNDINK

SEQ ID NO: 1651874 - protein, 21 aa, Staphylococcus aureus
SLETIFHCYHHMMSCCNDVIE

SEQ ID NO: 1651875 - protein, 21 aa, Staphylococcus aureus
SLKYSRKHGYEIVGDEFEVRR

SEQ ID NO: 1651876 - protein, 20 aa, Staphylococcus aureus
SLLKHYKIKLETFIELHSKA

SEQ ID NO: 1651877 - protein, 21 aa, Staphylococcus aureus
SLMSIEGIIVLVIYHGHSEGQ

SEQ ID NO: 1651878 - protein, 20 aa, Staphylococcus aureus
SRSVGTFAIKTGAITSAVDR

SEQ ID NO: 1651879 - protein, 18 aa, Staphylococcus aureus
STLTGRRILILGDVLELG

SEQ ID NO: 1651880 - protein, 19 aa, Staphylococcus aureus
SYFGYKAIQLFKNNSKNKQ

SEQ ID NO: 1651881 - protein, 19 aa, Staphylococcus aureus
SYKRTSCRLEVITKRGKSP

SEQ ID NO: 1651882 - protein, 19 aa, Staphylococcus aureus
TCTKHIAVSLKIDGKTVTI

SEQ ID NO: 1651883 - protein, 21 aa, Staphylococcus aureus
TEADISIQLVKEVRLVGKDLD

SEQ ID NO: 1651884 - protein, 19 aa, Staphylococcus aureus
TFKTELIKMNASYQTRLKN

SEQ ID NO: 1651885 - protein, 18 aa, Staphylococcus aureus
TIKTHVSHIFSKLQVSDR

SEQ ID NO: 1651886 - protein, 25 aa, Staphylococcus aureus
TKELLFKRRIDIGGVNNNFKGDFQE

SEQ ID NO: 1651887 - protein, 20 aa, Staphylococcus aureus
TKYKGDLLVLDKSEYFDTTD

SEQ ID NO: 1651888 - protein, 25 aa, Staphylococcus aureus
TLSKHFKVTAPIFIDNAESVTELIK

SEQ ID NO: 1651889 - protein, 24 aa, Staphylococcus aureus
TPGHTPESISFLLTDLGGGSSVPM

SEQ ID NO: 1651890 - protein, 29 aa, Staphylococcus aureus
TSDNPRFKRWVIGSILSRTYYHNMVTHLL

SEQ ID NO: 1651891 - protein, 17 aa, Staphylococcus aureus
TSYFKKTVNPFDHKAVP

SEQ ID NO: 1651892 - protein, 23 aa, Staphylococcus aureus
TTAELGFTLMLAIARRIVEAEKY

SEQ ID NO: 1651893 - protein, 25 aa, Staphylococcus aureus
TTEIQRKWIEKFKVIRDTFKAKAEY

SEQ ID NO: 1651894 - protein, 22 aa, Staphylococcus aureus
TTSWTSYQTRYEVLKQLCTTYK

SEQ ID NO: 1651895 - protein, 23 aa, Staphylococcus aureus
VEVVDLRTVYPLDKETIIDRAKH

SEQ ID NO: 1651896 - protein, 17 aa, Staphylococcus aureus
VGIGPGRVCITKIKTGF

SEQ ID NO: 1651897 - protein, 22 aa, Staphylococcus aureus
VIKPENIVLIGMRDLDKGERQF

SEQ ID NO: 1651898 - protein, 17 aa, Staphylococcus aureus
VNFGRFPYSKGRLTKED

SEQ ID NO: 1651899 - protein, 20 aa, Staphylococcus aureus
VNGRRARKIFDLARQGQIQE

SEQ ID NO: 1651900 - protein, 28 aa, Staphylococcus aureus
VPDEASLEFNVRPVPEYDNDFIESFFQN

SEQ ID NO: 1651901 - protein, 25 aa, Staphylococcus aureus
VPDTLRVASILAHTLYDYPSHQLVT

SEQ ID NO: 1651902 - protein, 21 aa, Staphylococcus aureus
WNIPEGITMDQYLARKKKNSV

SEQ ID NO: 1651903 - protein, 25 aa, Staphylococcus aureus
WRDKFRLPYLLGKADYIFVDDFHPL

SEQ ID NO: 1651904 - protein, 24 aa, Staphylococcus aureus
WRQHDVKLVFFLAISHKDKAFTKQ

SEQ ID NO: 1651905 - protein, 24 aa, Staphylococcus aureus
YAVTPEHLEHFIADKNMQTRTKNK

SEQ ID NO: 1651906 - protein, 18 aa, Staphylococcus aureus
YFLPSQTNFIFVKTKRVN

SEQ ID NO: 1651907 - protein, 23 aa, Staphylococcus aureus
YFNDRLNGCGGFIDITQSVNKII

SEQ ID NO: 1651908 - protein, 23 aa, Staphylococcus aureus
YLVKASKMKWVFQFEIVSAHGVH

SEQ ID NO: 1651909 - protein, 25 aa, Staphylococcus aureus
YTAAILKQFEQFGSYMVISPHIALI

SEQ ID NO: 1651910 - protein, 18 aa, Staphylococcus aureus
AAILSGKINNKWLEDKNV

SEQ ID NO: 1651911 - protein, 22 aa, Staphylococcus aureus
AANEAYKSWKTWSANDRAELML

SEQ ID NO: 1651912 - protein, 27 aa, Staphylococcus aureus
AEKGLELGCLFAFYGHTHVAKYEYING

SEQ ID NO: 1651913 - protein, 18 aa, Staphylococcus aureus
AGINYCIVGTKGIQDTDW

SEQ ID NO: 1651914 - protein, 18 aa, Staphylococcus aureus
AHQICSLNDFYQIWTQKE

SEQ ID NO: 1651915 - protein, 17 aa, Staphylococcus aureus
AHVDYLVTWNIPEGITM

SEQ ID NO: 1651916 - protein, 23 aa, Staphylococcus aureus
AIGLCGLDAQLFEITSFDQQYGY

SEQ ID NO: 1651917 - protein, 22 aa, Staphylococcus aureus
AMAPCPYIYAELAKRSQSDHKL

SEQ ID NO: 1651918 - protein, 23 aa, Staphylococcus aureus
ANVPVVAGFGIRTPQHVADIKEV

SEQ ID NO: 1651919 - protein, 27 aa, Staphylococcus aureus
AQSQFNLPMRYIWGIYEPQSDDQNMNE

SEQ ID NO: 1651920 - protein, 21 aa, Staphylococcus aureus
ARVAVGALCKVLLQQLDIDIY

SEQ ID NO: 1651921 - protein, 17 aa, Staphylococcus aureus
ATAIGIPVVAHLGLTPQ

SEQ ID NO: 1651922 - protein, 18 aa, Staphylococcus aureus
AVRDVRELIVQKAQEGVT

SEQ ID NO: 1651923 - protein, 18 aa, Staphylococcus aureus
CDTSIKKLLSNEVEVFTT

SEQ ID NO: 1651924 - protein, 18 aa, Staphylococcus aureus
CLQKGAFVSDKDGDMHYD

SEQ ID NO: 1651925 - protein, 24 aa, Staphylococcus aureus
CNARHGVCEKCYGKNLATGEKVEV

SEQ ID NO: 1651926 - protein, 26 aa, Staphylococcus aureus
DACIANNIKPIFGMTIYVTNGLNTVE

SEQ ID NO: 1651927 - protein, 17 aa, Staphylococcus aureus
DDFKELNNILGDHEIET

SEQ ID NO: 1651928 - protein, 22 aa, Staphylococcus aureus
DDYRKMFAHITVAQGYITPENA

SEQ ID NO: 1651929 - protein, 17 aa, Staphylococcus aureus
DGLNRATATYKFAGGKG

SEQ ID NO: 1651930 - protein, 18 aa, Staphylococcus aureus
DIEKMTAIVNIVKGDRDN

SEQ ID NO: 1651931 - protein, 23 aa, Staphylococcus aureus
DILNPYLCIIFCNSRDNANDLAR

SEQ ID NO: 1651932 - protein, 18 aa, Staphylococcus aureus
DKRFHFEIDETWKNKLVN

SEQ ID NO: 1651933 - protein, 19 aa, Staphylococcus aureus
DNCDLNFYLGQINHIVGKN

SEQ ID NO: 1651934 - protein, 19 aa, Staphylococcus aureus
DPHYIEVWGKFTPRGGISI

SEQ ID NO: 1651935 - protein, 19 aa, Staphylococcus aureus
DTVEVGQAIAIIGEGSGNA

SEQ ID NO: 1651936 - protein, 21 aa, Staphylococcus aureus
DVDGFHPINIGKLYIDEQTFV

SEQ ID NO: 1651937 - protein, 27 aa, Staphylococcus aureus
DVFAHGEIRLDINFALYGNGTDSISDI

SEQ ID NO: 1651938 - protein, 18 aa, Staphylococcus aureus
DVSFKLKRGQIVGLVGAN

SEQ ID NO: 1651939 - protein, 28 aa, Staphylococcus aureus
DYDAIILAAAGLRRMGWSDDIVTSYLDR

SEQ ID NO: 1651940 - protein, 18 aa, Staphylococcus aureus
EEIFINKLLNTMNNHISN

SEQ ID NO: 1651941 - protein, 21 aa, Staphylococcus aureus
EGELVARLILDKVGNKKPIRR

SEQ ID NO: 1651942 - protein, 19 aa, Staphylococcus aureus
EIRQKYLDFFVEKGHMVEP

SEQ ID NO: 1651943 - protein, 22 aa, Staphylococcus aureus
EKLRRHMSFLMRKGSLYLPYNG

SEQ ID NO: 1651944 - protein, 18 aa, Staphylococcus aureus
ELNNILGDHEIETKKKIL

SEQ ID NO: 1651945 - protein, 19 aa, Staphylococcus aureus
ERIKNLIIEVLRGHRKIKK

SEQ ID NO: 1651946 - protein, 19 aa, Staphylococcus aureus
ERILKTVIDLVDKRVPVIA

SEQ ID NO: 1651947 - protein, 20 aa, Staphylococcus aureus
ESELKLCRDLITEFETLSKY

SEQ ID NO: 1651948 - protein, 25 aa, Staphylococcus aureus
ETLEEARALLIEAINSGAALEKFKT

SEQ ID NO: 1651949 - protein, 26 aa, Staphylococcus aureus
EVLTFKAIQACKEYGVQRLIVAGGVA

SEQ ID NO: 1651950 - protein, 18 aa, Staphylococcus aureus
EVQQWFNYTYMVILTNGV

SEQ ID NO: 1651951 - protein, 20 aa, Staphylococcus aureus
FARLKLGDNIKFRPINENEL

SEQ ID NO: 1651952 - protein, 24 aa, Staphylococcus aureus
FCASPYFTHSYVFISWTGKMAEAF

SEQ ID NO: 1651953 - protein, 23 aa, Staphylococcus aureus
FDSKGGFYFTDFRGYSTNPLGGV

SEQ ID NO: 1651954 - protein, 24 aa, Staphylococcus aureus
FERSREGRYAYSLPKSDIKTNSVE

SEQ ID NO: 1651955 - protein, 19 aa, Staphylococcus aureus
FGHSLGHGIGLEIHEGPML

SEQ ID NO: 1651956 - protein, 17 aa, Staphylococcus aureus
FGKRAMTTFERYFIADK

SEQ ID NO: 1651957 - protein, 17 aa, Staphylococcus aureus
FKAPIATSASIWETIKT

SEQ ID NO: 1651958 - protein, 17 aa, Staphylococcus aureus
FLNGRAVTVIGQQRGKD

SEQ ID NO: 1651959 - protein, 23 aa, Staphylococcus aureus
FNQELLCIYIDFDSGLRHSNMAT

SEQ ID NO: 1651960 - protein, 28 aa, Staphylococcus aureus
FNQPIIWLCGGLDRGNEFDELIPYMENV

SEQ ID NO: 1651961 - protein, 19 aa, Staphylococcus aureus
FSEHHFYCAIFIPSTEDHA

SEQ ID NO: 1651962 - protein, 18 aa, Staphylococcus aureus
FSRGGLQGLLTFQDLPVT

SEQ ID NO: 1651963 - protein, 31 aa, Staphylococcus aureus
FSSKEDPELCVLRVVPQSIKLMNDKSLDTPI

SEQ ID NO: 1651964 - protein, 28 aa, Staphylococcus aureus
GALWTLAQEVYQEWYLGSKLYEDVEKKI

SEQ ID NO: 1651965 - protein, 19 aa, Staphylococcus aureus
GDLSIDGHVVFDFKAPIAT

SEQ ID NO: 1651966 - protein, 22 aa, Staphylococcus aureus
GELDEHFPLVVWQTGSGTQSNM

SEQ ID NO: 1651967 - protein, 17 aa, Staphylococcus aureus
GGSLTILATALVDTGSR

SEQ ID NO: 1651968 - protein, 21 aa, Staphylococcus aureus
GHLLALPGWAGMLYYRSQQHH

SEQ ID NO: 1651969 - protein, 21 aa, Staphylococcus aureus
GIEAIICGIGINLTQQLENFD

SEQ ID NO: 1651970 - protein, 20 aa, Staphylococcus aureus
GKAYAYLIFVQETWTMLHEN

SEQ ID NO: 1651971 - protein, 19 aa, Staphylococcus aureus
GLCIPELDGKMSYMIAVTG

SEQ ID NO: 1651972 - protein, 18 aa, Staphylococcus aureus
GQEIEFFGPEIETFTQVV

SEQ ID NO: 1651973 - protein, 17 aa, Staphylococcus aureus
GVVGAVVAWNFPMLLAA

SEQ ID NO: 1651974 - protein, 17 aa, Staphylococcus aureus
GYFKRYALTSNGVSPRP

SEQ ID NO: 1651975 - protein, 24 aa, Staphylococcus aureus
HLNIKVIIVTTFKRPGYFEKAVVN

SEQ ID NO: 1651976 - protein, 26 aa, Staphylococcus aureus
HPENELEVLSSYLISLDQHRETIEDY

SEQ ID NO: 1651977 - protein, 17 aa, Staphylococcus aureus
HSLIKIRLPETLSKELL

SEQ ID NO: 1651978 - protein, 25 aa, Staphylococcus aureus
IASSLKAPIYVLSNIAGVLINDVVI

SEQ ID NO: 1651979 - protein, 30 aa, Staphylococcus aureus
IDILDIRFGSLWTNIPLAFLKSLEIVHGNN

SEQ ID NO: 1651980 - protein, 19 aa, Staphylococcus aureus
IFELFDYNIAYEIRLQAAL

SEQ ID NO: 1651981 - protein, 18 aa, Staphylococcus aureus
ILFNNSLKYYMNEHPAVT

SEQ ID NO: 1651982 - protein, 26 aa, Staphylococcus aureus
IMKFTEGSFKQWGYDLALSEFGDQVF

SEQ ID NO: 1651983 - protein, 23 aa, Staphylococcus aureus
IQYLKKEIAEFIGDHEIKSIGVA

SEQ ID NO: 1651984 - protein, 34 aa, Staphylococcus aureus
IRDVFGYSVDKGWMCIQVFFIRQGNMIKRDTTMI

SEQ ID NO: 1651985 - protein, 18 aa, Staphylococcus aureus
ISEAKVLVNEDGIPTDVQ

SEQ ID NO: 1651986 - protein, 19 aa, Staphylococcus aureus
ITRRIREMGVYSELHDHEI

SEQ ID NO: 1651987 - protein, 19 aa, Staphylococcus aureus
KDTGAFCASPYFTHSYVFI

SEQ ID NO: 1651988 - protein, 21 aa, Staphylococcus aureus
KEAKFKTIIKLYEYQRTLENK

SEQ ID NO: 1651989 - protein, 20 aa, Staphylococcus aureus
KIKDDILYCYTEDSIKGLSE

SEQ ID NO: 1651990 - protein, 18 aa, Staphylococcus aureus
KIRPNLGRKIYINYHKKR

SEQ ID NO: 1651991 - protein, 22 aa, Staphylococcus aureus
KKGDLFLLLAKENWHEGVLGIV

SEQ ID NO: 1651992 - protein, 24 aa, Staphylococcus aureus
KLKHWLPVDLYIGGVEHAVLHLLY

SEQ ID NO: 1651993 - protein, 26 aa, Staphylococcus aureus
KMMRDIKKDIGMIFQHFNLLNSATVF

SEQ ID NO: 1651994 - protein, 22 aa, Staphylococcus aureus
KNNYFFKLAYFRKNFEKKNGGY

SEQ ID NO: 1651995 - protein, 39 aa, Staphylococcus aureus
KQVLEKFKSLIFISGTLKFNHSFEAFKQLFNKDVHFNTF

SEQ ID NO: 1651996 - protein, 23 aa, Staphylococcus aureus
KRFNSVSEFKNATLLSETSTIYE

SEQ ID NO: 1651997 - protein, 18 aa, Staphylococcus aureus
KSMNIEVSNHMQALEDDQ

SEQ ID NO: 1651998 - protein, 21 aa, Staphylococcus aureus
KTYIFYHLFDTYIIDYSMASA

SEQ ID NO: 1651999 - protein, 26 aa, Staphylococcus aureus
KTYSLGMKQKLGIAIAFLNEPQFIIL

SEQ ID NO: 1652000 - protein, 24 aa, Staphylococcus aureus
KVIDEMASRFVVVVDETKIVQYLG

SEQ ID NO: 1652001 - protein, 23 aa, Staphylococcus aureus
KVSKVGTIAGCYVTEGKITRNAG

SEQ ID NO: 1652002 - protein, 23 aa, Staphylococcus aureus
LFIDEIKRQLTYYDETIATNNAD

SEQ ID NO: 1652003 - protein, 23 aa, Staphylococcus aureus
LFSGELDKAVAALIIANGARAAG

SEQ ID NO: 1652004 - protein, 25 aa, Staphylococcus aureus
LGPTAIRYAGLISRLKQLDLDVYDK

SEQ ID NO: 1652005 - protein, 23 aa, Staphylococcus aureus
LLADLELPLAKILSEMEEIGIFT

SEQ ID NO: 1652006 - protein, 25 aa, Staphylococcus aureus
LMRKGSLYLPYNGNLLIHGCIPVDE

SEQ ID NO: 1652007 - protein, 17 aa, Staphylococcus aureus
LNHQSGHTIQWYIMTSD

SEQ ID NO: 1652008 - protein, 17 aa, Staphylococcus aureus
LNKGRIGAKEGPDAIKQ

SEQ ID NO: 1652009 - protein, 27 aa, Staphylococcus aureus
LNRYEKRLNPTYFIRIHRSYIINTKHI

SEQ ID NO: 1652010 - protein, 18 aa, Staphylococcus aureus
LPLATGLVAEVGQGLSCI

SEQ ID NO: 1652011 - protein, 17 aa, Staphylococcus aureus
LPSVSLLEEPQVIESDE

SEQ ID NO: 1652012 - protein, 38 aa, Staphylococcus aureus
LRSIIESPSFKNAESKLTVAMGYRINNEPLLMDIAKTP

SEQ ID NO: 1652013 - protein, 24 aa, Staphylococcus aureus
LTDEKYFGGSFERLQALTTKTTLP

SEQ ID NO: 1652014 - protein, 17 aa, Staphylococcus aureus
LTEVMGLPKDFKTHPHY

SEQ ID NO: 1652015 - protein, 19 aa, Staphylococcus aureus
LWWQGIDPIAAIRILGQAN

SEQ ID NO: 1652016 - protein, 25 aa, Staphylococcus aureus
LYHALKTRGHRVCIFKPFQTEERQD

SEQ ID NO: 1652017 - protein, 23 aa, Staphylococcus aureus
LYQDIPEQFSIMRYHSLISNPDN

SEQ ID NO: 1652018 - protein, 18 aa, Staphylococcus aureus
MCKAHFHSLIKIRLPETL

SEQ ID NO: 1652019 - protein, 17 aa, Staphylococcus aureus
MFANTLVYRGQPSPDKM

SEQ ID NO: 1652020 - protein, 23 aa, Staphylococcus aureus
MKLPYEYYIGGKLGSGQQWYSWI

SEQ ID NO: 1652021 - protein, 24 aa, Staphylococcus aureus
MKMFEFKQGVKLFGANVILSQSGY

SEQ ID NO: 1652022 - protein, 17 aa, Staphylococcus aureus
MMMEGKWQSTIHRQLIE

SEQ ID NO: 1652023 - protein, 24 aa, Staphylococcus aureus
MNPVELRRNIGYVIQQIGLMPHMT

SEQ ID NO: 1652024 - protein, 21 aa, Staphylococcus aureus
MQFTGSFKFRGASNKINHLTD

SEQ ID NO: 1652025 - protein, 20 aa, Staphylococcus aureus
MSRSEGFGKEVKRRIFLGTF

SEQ ID NO: 1652026 - protein, 20 aa, Staphylococcus aureus
NAHPEFGDKVAHYISENTGY

SEQ ID NO: 1652027 - protein, 23 aa, Staphylococcus aureus
NGDLAGILGLCIPELDGKMSYMI

SEQ ID NO: 1652028 - protein, 23 aa, Staphylococcus aureus
NGEAEMSFEAFLEKAAVSSSQTV

SEQ ID NO: 1652029 - protein, 17 aa, Staphylococcus aureus
NIFEISKDITIEEKGHI

SEQ ID NO: 1652030 - protein, 23 aa, Staphylococcus aureus
NKKPIRRLWISSVTKKAIQQGFK

SEQ ID NO: 1652031 - protein, 19 aa, Staphylococcus aureus
NKSQIRWISVLDLKDKDEN

SEQ ID NO: 1652032 - protein, 25 aa, Staphylococcus aureus
NNQSPKMHVCEDVIVRCHLYKNEYK

SEQ ID NO: 1652033 - protein, 27 aa, Staphylococcus aureus
NPIPIKALTSYLGFGNYELRLPLVSLE

SEQ ID NO: 1652034 - protein, 24 aa, Staphylococcus aureus
NRKNIPFDELVLFSSARSAGQEVE

SEQ ID NO: 1652035 - protein, 17 aa, Staphylococcus aureus
NSIRLVTEIVRSLNDES

SEQ ID NO: 1652036 - protein, 17 aa, Staphylococcus aureus
PDTGLSVDLVNKKNELI

SEQ ID NO: 1652037 - protein, 25 aa, Staphylococcus aureus
PGLPDLKGFGRRNIDISNDEIYNLM

SEQ ID NO: 1652038 - protein, 23 aa, Staphylococcus aureus
PKGTLIPHRGIVRLVHQNHYVPL

SEQ ID NO: 1652039 - protein, 19 aa, Staphylococcus aureus
PNKRQGAILEDAKVTAVMS

SEQ ID NO: 1652040 - protein, 25 aa, Staphylococcus aureus
PNMDIFKKCYKALITKQETNIQKEG

SEQ ID NO: 1652041 - protein, 25 aa, Staphylococcus aureus
PPSVREIGEAVGLASSSTVHGHLSR

SEQ ID NO: 1652042 - protein, 32 aa, Staphylococcus aureus
PYELSQRLKQQFSHYGVKIISLVAMTTDDKRI

SEQ ID NO: 1652043 - protein, 25 aa, Staphylococcus aureus
PYNKNFINQIGWYLDFEKDIDLIGD

SEQ ID NO: 1652044 - protein, 18 aa, Staphylococcus aureus
QCPLTIRAPFGGGVHGGL

SEQ ID NO: 1652045 - protein, 35 aa, Staphylococcus aureus
QDEQLKSLPFISGYVGTCSFDLVRHEFPKLQSIQL

SEQ ID NO: 1652046 - protein, 23 aa, Staphylococcus aureus
QEGRRFLFETVVKVNHPKYDITI

SEQ ID NO: 1652047 - protein, 19 aa, Staphylococcus aureus
QNGIAEWRYQDVPTKLWPI

SEQ ID NO: 1652048 - protein, 28 aa, Staphylococcus aureus
QPVSPHLAFKMTDQIFLNKQRVLDKVKV

SEQ ID NO: 1652049 - protein, 25 aa, Staphylococcus aureus
QQAVSRISPKMGMMKNSVLNQSRNF

SEQ ID NO: 1652050 - protein, 26 aa, Staphylococcus aureus
QQTKGRYSVVIFDIYGTLTLDNDVLS

SEQ ID NO: 1652051 - protein, 23 aa, Staphylococcus aureus
QQWSHKYKTVGMMLFDEQRQFLQ

SEQ ID NO: 1652052 - protein, 23 aa, Staphylococcus aureus
QSKHLKLKGVHCHIGSQIEGTEA

SEQ ID NO: 1652053 - protein, 17 aa, Staphylococcus aureus
QVVGSGFEGRVTKKDIM

SEQ ID NO: 1652054 - protein, 25 aa, Staphylococcus aureus
QYMSHVKHIGKLVLRASDVIEHHNF

SEQ ID NO: 1652055 - protein, 17 aa, Staphylococcus aureus
RAGAKARTTKQQARINR

SEQ ID NO: 1652056 - protein, 20 aa, Staphylococcus aureus
RAKMALSTADLVIELPATAS

SEQ ID NO: 1652057 - protein, 26 aa, Staphylococcus aureus
RFHKKSLPVPKYRYFKLNNNKIQKML

SEQ ID NO: 1652058 - protein, 17 aa, Staphylococcus aureus
RGSQLIELAEKIAQEHN

SEQ ID NO: 1652059 - protein, 20 aa, Staphylococcus aureus
RSKLRKALPKQYVYIIEELL

SEQ ID NO: 1652060 - protein, 23 aa, Staphylococcus aureus
RVAFDLRSKEAFHGGHTKGTINI

SEQ ID NO: 1652061 - protein, 19 aa, Staphylococcus aureus
RVVIGRFGIILSNEGGALQ

SEQ ID NO: 1652062 - protein, 17 aa, Staphylococcus aureus
SECWYIIDAEEDAEIVI

SEQ ID NO: 1652063 - protein, 24 aa, Staphylococcus aureus
SFNKRCVLKNISFDIEQGKCIALI

SEQ ID NO: 1652064 - protein, 21 aa, Staphylococcus aureus
SGTVTPQGFFAIIEKPHYDIS

SEQ ID NO: 1652065 - protein, 25 aa, Staphylococcus aureus
SKMIKEAVCQLEIKLDTGRTHQIRV

SEQ ID NO: 1652066 - protein, 27 aa, Staphylococcus aureus
SKVCLANLLRICARYDNLDIIEDAYGI

SEQ ID NO: 1652067 - protein, 24 aa, Staphylococcus aureus
SNMKLRIGFSDIFFNVDQLTSSEA

SEQ ID NO: 1652068 - protein, 17 aa, Staphylococcus aureus
SNVKRAIEHLGYEVVVS

SEQ ID NO: 1652069 - protein, 21 aa, Staphylococcus aureus
SYLVGCQRTGEAIIIDPVRDL

SEQ ID NO: 1652070 - protein, 20 aa, Staphylococcus aureus
TEHSRRYLLDEGFNKANIFV

SEQ ID NO: 1652071 - protein, 21 aa, Staphylococcus aureus
TFYHPSNMVLFVVGDVDPEAI

SEQ ID NO: 1652072 - protein, 19 aa, Staphylococcus aureus
TIEDGVVCFYSRSKQRLWT

SEQ ID NO: 1652073 - protein, 22 aa, Staphylococcus aureus
TIEHLIELIKYCSSKYTRSKLR

SEQ ID NO: 1652074 - protein, 22 aa, Staphylococcus aureus
TKARAYLPGILVEKLLIKIDDM

SEQ ID NO: 1652075 - protein, 17 aa, Staphylococcus aureus
TKFVPIINSIGFNNHDG

SEQ ID NO: 1652076 - protein, 27 aa, Staphylococcus aureus
TLYYTCEKFKLLVLQGNVLGVQIITNN

SEQ ID NO: 1652077 - protein, 18 aa, Staphylococcus aureus
TNMGALWPTLGAIPTSSF

SEQ ID NO: 1652078 - protein, 25 aa, Staphylococcus aureus
VDGEIIFKHGLSLAQVQQITNLAKR

SEQ ID NO: 1652079 - protein, 25 aa, Staphylococcus aureus
VDKVTHLRALLQLRDVAQDNDAIKR

SEQ ID NO: 1652080 - protein, 17 aa, Staphylococcus aureus
VEADAWQSWGPYLLSGK

SEQ ID NO: 1652081 - protein, 19 aa, Staphylococcus aureus
VFFLNGFQMKGVIEEYDKY

SEQ ID NO: 1652082 - protein, 22 aa, Staphylococcus aureus
VKKWLEEDIDVIITTGGTGIAQ

SEQ ID NO: 1652083 - protein, 17 aa, Staphylococcus aureus
VNGETFYSRVIKTLEST

SEQ ID NO: 1652084 - protein, 18 aa, Staphylococcus aureus
VPSMPFSPVLENEIMMNP

SEQ ID NO: 1652085 - protein, 28 aa, Staphylococcus aureus
VSGHAIDACGINGLYIKSCSFEGFIDYS

SEQ ID NO: 1652086 - protein, 21 aa, Staphylococcus aureus
VSIPQRKGEPIVVTKDEGVRE

SEQ ID NO: 1652087 - protein, 19 aa, Staphylococcus aureus
VVDISNYVLLEYGQPLHMF

SEQ ID NO: 1652088 - protein, 18 aa, Staphylococcus aureus
VVRYLEAHEGFKVKYVDV

SEQ ID NO: 1652089 - protein, 25 aa, Staphylococcus aureus
VVTRPLMEEWLFNTVAFVGGPSEIK

SEQ ID NO: 1652090 - protein, 24 aa, Staphylococcus aureus
WKDVTEIIAAQLLYTIKKYGPDRI

SEQ ID NO: 1652091 - protein, 19 aa, Staphylococcus aureus
YFNRDRFVLSAGHGSALLY

SEQ ID NO: 1652092 - protein, 23 aa, Staphylococcus aureus
YGINLRPLLTLAEKYYDADNPAF

SEQ ID NO: 1652093 - protein, 19 aa, Staphylococcus aureus
YLLPYSKFEVFWKRYKDNI

SEQ ID NO: 1652094 - protein, 27 aa, Staphylococcus aureus
YNDSDLNWIYLVKNLRNAGVSIESLIE

SEQ ID NO: 1652095 - protein, 26 aa, Staphylococcus aureus
YPDKGVRLKAYFNEMTYDDKLRQQIK

SEQ ID NO: 1652096 - protein, 26 aa, Staphylococcus aureus
YPHQPCYEGAMCVCGTGGDKSNSFNI

SEQ ID NO: 1652097 - protein, 38 aa, Staphylococcus aureus
YPLAKGASYRLEFYRLYLLMVHLLKFGEMYRDSVAHSM

SEQ ID NO: 1652098 - protein, 18 aa, Staphylococcus aureus
YRLLRPAKGTTYKIYFGF

SEQ ID NO: 1652099 - protein, 17 aa, Staphylococcus aureus
YVANLKYQFDINQKEKN

SEQ ID NO: 1652100 - protein, 21 aa, Staphylococcus aureus
YYKNVHIYDVTWGEAVDVKDF

SEQ ID NO: 1652101 - protein, 26 aa, Staphylococcus aureus
AAYLKEFTNLYALLIPKMNSMNDVKF

SEQ ID NO: 1652102 - protein, 23 aa, Staphylococcus aureus
ADQAICIGEANALDSYLNIDRII

SEQ ID NO: 1652103 - protein, 18 aa, Staphylococcus aureus
AETDYKLKSSYMDKQLIL

SEQ ID NO: 1652104 - protein, 17 aa, Staphylococcus aureus
AKAKKGTDILVESLFYN

SEQ ID NO: 1652105 - protein, 24 aa, Staphylococcus aureus
AKGSQLPKMFGFQAEGASPIVQNK

SEQ ID NO: 1652106 - protein, 22 aa, Staphylococcus aureus
AMIQFKLEIPIIKRRPNFEMEE

SEQ ID NO: 1652107 - protein, 26 aa, Staphylococcus aureus
ARHIVPYPPGIPIIFKGETITENMIE

SEQ ID NO: 1652108 - protein, 19 aa, Staphylococcus aureus
ARQNLKALMTKVNDDSDMV

SEQ ID NO: 1652109 - protein, 25 aa, Staphylococcus aureus
ATGIDHNRLSLLMAVLEKKENYLLQ

SEQ ID NO: 1652110 - protein, 34 aa, Staphylococcus aureus
ATPIKLGQEISGWRYMLDRCETMLSESKKHILNL

SEQ ID NO: 1652111 - protein, 18 aa, Staphylococcus aureus
AYDAKVFRKGGVSQHTVY

SEQ ID NO: 1652112 - protein, 21 aa, Staphylococcus aureus
CINDLGFKGALIMGRAQDGFL

SEQ ID NO: 1652113 - protein, 17 aa, Staphylococcus aureus
DAYQLNYNQFFVTDMMS

SEQ ID NO: 1652114 - protein, 20 aa, Staphylococcus aureus
DKKYKNWDWNYGKSPKYEYN

SEQ ID NO: 1652115 - protein, 25 aa, Staphylococcus aureus
DLIEEVARIYGYDDIPSTLPVFDKV

SEQ ID NO: 1652116 - protein, 20 aa, Staphylococcus aureus
DRTTAIFPKLVFSIKKGTNF

SEQ ID NO: 1652117 - protein, 22 aa, Staphylococcus aureus
DSMSQIRWLSVLDLKDKTEDQL

SEQ ID NO: 1652118 - protein, 18 aa, Staphylococcus aureus
EAEFKPKQIEDFNSNIEY

SEQ ID NO: 1652119 - protein, 19 aa, Staphylococcus aureus
EELRKHLIEKYSIGVIALN

SEQ ID NO: 1652120 - protein, 23 aa, Staphylococcus aureus
EQYKRTMFWSEFEIRQYTHSDIT

SEQ ID NO: 1652121 - protein, 24 aa, Staphylococcus aureus
ESDDRKLRESAFRNVYKAYGAHNN

SEQ ID NO: 1652122 - protein, 24 aa, Staphylococcus aureus
EVAEACLKLGVDMINDQWAGLYDH

SEQ ID NO: 1652123 - protein, 20 aa, Staphylococcus aureus
FDRKRAKQLIKDVGLGHYQL

SEQ ID NO: 1652124 - protein, 24 aa, Staphylococcus aureus
FIGPNCGFYTATHPLNFHHRNEGF

SEQ ID NO: 1652125 - protein, 18 aa, Staphylococcus aureus
FKAHLPVNENTPKLTLNE

SEQ ID NO: 1652126 - protein, 19 aa, Staphylococcus aureus
FKGALIMGRAQDGFLDQDK

SEQ ID NO: 1652127 - protein, 19 aa, Staphylococcus aureus
FVNKVEMISGMTFADLDTL

SEQ ID NO: 1652128 - protein, 17 aa, Staphylococcus aureus
GCLWGVEAFFATIPGII

SEQ ID NO: 1652129 - protein, 19 aa, Staphylococcus aureus
GGTIKIKGIHINGLEVDLN

SEQ ID NO: 1652130 - protein, 21 aa, Staphylococcus aureus
GKSLIAKALLEYLPFDLSCTY

SEQ ID NO: 1652131 - protein, 20 aa, Staphylococcus aureus
GLEAMTIHRLIGWNQDTKPE

SEQ ID NO: 1652132 - protein, 17 aa, Staphylococcus aureus
GLRYCINSAAIQFIPYE

SEQ ID NO: 1652133 - protein, 24 aa, Staphylococcus aureus
GNNYIDRWCKIRNSHIGEYSYIGF

SEQ ID NO: 1652134 - protein, 18 aa, Staphylococcus aureus
GSHYIWMARNFRSYNPRH

SEQ ID NO: 1652135 - protein, 19 aa, Staphylococcus aureus
GTQYRGAFEENIQKLIEGV

SEQ ID NO: 1652136 - protein, 24 aa, Staphylococcus aureus
GTYMCIAAACGENVILNNIVPKHV

SEQ ID NO: 1652137 - protein, 17 aa, Staphylococcus aureus
GVFTDKYGVRWMLHGQD

SEQ ID NO: 1652138 - protein, 31 aa, Staphylococcus aureus
GYVAGTKELIDWLKAQSRPFLFSTSLAPGDT

SEQ ID NO: 1652139 - protein, 20 aa, Staphylococcus aureus
HASLVVSINDVFYVTDVGFG

SEQ ID NO: 1652140 - protein, 17 aa, Staphylococcus aureus
HIHILKPKDVVLDVDSI

SEQ ID NO: 1652141 - protein, 20 aa, Staphylococcus aureus
HRKDLKFNLYVTTLHTSLIE

SEQ ID NO: 1652142 - protein, 21 aa, Staphylococcus aureus
HSELTYLTFVYKVAAMDFIFK

SEQ ID NO: 1652143 - protein, 17 aa, Staphylococcus aureus
HVIRRICDEVAVMESGK

SEQ ID NO: 1652144 - protein, 17 aa, Staphylococcus aureus
IDEYTDLALVYPMHKNP

SEQ ID NO: 1652145 - protein, 17 aa, Staphylococcus aureus
IELPFADQFWGGKMGVF

SEQ ID NO: 1652146 - protein, 27 aa, Staphylococcus aureus
IEMIDYFKALFPNGGLYIHLDQATERH

SEQ ID NO: 1652147 - protein, 25 aa, Staphylococcus aureus
IFEKEDRKIATFCVATHRNYKDENG

SEQ ID NO: 1652148 - protein, 18 aa, Staphylococcus aureus
IHAGLPVILSPVKEHIYL

SEQ ID NO: 1652149 - protein, 26 aa, Staphylococcus aureus
IPHENIIKLPARFHKKSLPVPKYRYF

SEQ ID NO: 1652150 - protein, 27 aa, Staphylococcus aureus
IQQWCQKFNIALTIKKKQGIVVDGTDN

SEQ ID NO: 1652151 - protein, 24 aa, Staphylococcus aureus
IRHLEKKRVVIFAAGIGNPYFSTD

SEQ ID NO: 1652152 - protein, 20 aa, Staphylococcus aureus
IRPMIHMLYYHGIAFESHAQ

SEQ ID NO: 1652153 - protein, 17 aa, Staphylococcus aureus
ISCSPKLLIADEPTTAL

SEQ ID NO: 1652154 - protein, 17 aa, Staphylococcus aureus
ISKRIKDAFLNEDIDIL

SEQ ID NO: 1652155 - protein, 19 aa, Staphylococcus aureus
KARRCSRCLKHLNQDEAYC

SEQ ID NO: 1652156 - protein, 18 aa, Staphylococcus aureus
KDKYGITNKLVLYVPTYR

SEQ ID NO: 1652157 - protein, 19 aa, Staphylococcus aureus
KEELKRMFEEAGFINVRVR

SEQ ID NO: 1652158 - protein, 18 aa, Staphylococcus aureus
KEFYKLREEQHGHQIEKV

SEQ ID NO: 1652159 - protein, 18 aa, Staphylococcus aureus
KINNKWLEDKNVVALVSG

SEQ ID NO: 1652160 - protein, 19 aa, Staphylococcus aureus
KKIDCEYTYAMPIAILIRH

SEQ ID NO: 1652161 - protein, 32 aa, Staphylococcus aureus
KKLASAVPNHIDKVCVMVNPDLTTIEHVLSNT

SEQ ID NO: 1652162 - protein, 24 aa, Staphylococcus aureus
KLSSKVEGIGYWLNYDLHVSHCKN

SEQ ID NO: 1652163 - protein, 17 aa, Staphylococcus aureus
KSKELKRSLTAKFKSNE

SEQ ID NO: 1652164 - protein, 18 aa, Staphylococcus aureus
KTPDKLKGFSVEYLNKKD

SEQ ID NO: 1652165 - protein, 18 aa, Staphylococcus aureus
KYDIDFITGHSLGGRDAV

SEQ ID NO: 1652166 - protein, 23 aa, Staphylococcus aureus
KYNNNIWNEWAFENYIKSDEYKG

SEQ ID NO: 1652167 - protein, 23 aa, Staphylococcus aureus
KYPHAFIHMVGFSRGGLQGLLTF

SEQ ID NO: 1652168 - protein, 22 aa, Staphylococcus aureus
LDKEDEVCILYGTKNGLVAVPT

SEQ ID NO: 1652169 - protein, 23 aa, Staphylococcus aureus
LDMAKRLLDFGVHPPTIYFPLNV

SEQ ID NO: 1652170 - protein, 18 aa, Staphylococcus aureus
LECPSIISQVKFYHVPDG

SEQ ID NO: 1652171 - protein, 19 aa, Staphylococcus aureus
LECVKRKEIELVSDESFNE

SEQ ID NO: 1652172 - protein, 22 aa, Staphylococcus aureus
LKFNKPHAYCLVTIIDGTGTLT

SEQ ID NO: 1652173 - protein, 19 aa, Staphylococcus aureus
LKVIARAGVGVDNINIDAA

SEQ ID NO: 1652174 - protein, 24 aa, Staphylococcus aureus
LNLKDLFESIRFMYPQIVRSVNRL

SEQ ID NO: 1652175 - protein, 18 aa, Staphylococcus aureus
LSDELEVLDYIRTKTLTC

SEQ ID NO: 1652176 - protein, 24 aa, Staphylococcus aureus
LYHSLPLLKYPSFELFLEKINEFN

SEQ ID NO: 1652177 - protein, 28 aa, Staphylococcus aureus
MRTDVYDFYSLGFGEPYPISGSHGLGLG

SEQ ID NO: 1652178 - protein, 23 aa, Staphylococcus aureus
MSEIKRLNLNAILAKNTDKKMIG

SEQ ID NO: 1652179 - protein, 19 aa, Staphylococcus aureus
MTNIKRVQQAIVEGETYQV

SEQ ID NO: 1652180 - protein, 21 aa, Staphylococcus aureus
NDALIAPAVKVWIETYGGKHD

SEQ ID NO: 1652181 - protein, 23 aa, Staphylococcus aureus
NDDFTHWRKIMGAAPISEEEREN

SEQ ID NO: 1652182 - protein, 21 aa, Staphylococcus aureus
NKIFECIHAGLPVILSPVKEH

SEQ ID NO: 1652183 - protein, 20 aa, Staphylococcus aureus
NKNGFKEFYKLREEQHGHQI

SEQ ID NO: 1652184 - protein, 17 aa, Staphylococcus aureus
NPMTACYFVTDDRRGPH

SEQ ID NO: 1652185 - protein, 20 aa, Staphylococcus aureus
NSNAILPVRLDGATKEFFAW

SEQ ID NO: 1652186 - protein, 24 aa, Staphylococcus aureus
NVGCITRPFPTGVRITIGFKEQND

SEQ ID NO: 1652187 - protein, 26 aa, Staphylococcus aureus
NVHLIRANPNLVIMVIVFSSGHVEHV

SEQ ID NO: 1652188 - protein, 19 aa, Staphylococcus aureus
NYVLMTYYNIICHYGEQAF

SEQ ID NO: 1652189 - protein, 26 aa, Staphylococcus aureus
PFQGHPACVHIPIGKGVCGTAVSERR

SEQ ID NO: 1652190 - protein, 21 aa, Staphylococcus aureus
PHKLASCIDVANIDTPIKIIL

SEQ ID NO: 1652191 - protein, 21 aa, Staphylococcus aureus
PHVPVIIDEAYFEFVTAEDYP

SEQ ID NO: 1652192 - protein, 22 aa, Staphylococcus aureus
PMDRVLRPLKLMDANIEGIEDN

SEQ ID NO: 1652193 - protein, 26 aa, Staphylococcus aureus
PQMVLRFKRRFGDDVAVLHSGLSNGE

SEQ ID NO: 1652194 - protein, 20 aa, Staphylococcus aureus
PQSKRQVMRLLKSLQTDENK

SEQ ID NO: 1652195 - protein, 23 aa, Staphylococcus aureus
PTEKKGPSVLGIIEYQVQGENEF

SEQ ID NO: 1652196 - protein, 18 aa, Staphylococcus aureus
PVVACATILNSNHNYLGL

SEQ ID NO: 1652197 - protein, 19 aa, Staphylococcus aureus
PYIKGMPFGHEFSGVVDAI

SEQ ID NO: 1652198 - protein, 20 aa, Staphylococcus aureus
QAENWLRNNIKDINFQLYHY

SEQ ID NO: 1652199 - protein, 26 aa, Staphylococcus aureus
QPGTETIYRFSLLVPNQAALHYFEKR

SEQ ID NO: 1652200 - protein, 19 aa, Staphylococcus aureus
QSKVIFCEADDWKPFYEAY

SEQ ID NO: 1652201 - protein, 18 aa, Staphylococcus aureus
RAIEHLGYEVVVSNTSKI

SEQ ID NO: 1652202 - protein, 17 aa, Staphylococcus aureus
RDNLEMFNDLDVAVYGI

SEQ ID NO: 1652203 - protein, 23 aa, Staphylococcus aureus
REKFRHYCEHEVLSSIINGSYII

SEQ ID NO: 1652204 - protein, 18 aa, Staphylococcus aureus
RFAKEVSNNIVFIHEGMI

SEQ ID NO: 1652205 - protein, 19 aa, Staphylococcus aureus
RINNEPLLMDIAKTPHALI

SEQ ID NO: 1652206 - protein, 17 aa, Staphylococcus aureus
RTHQKYSPFPEELNRVM

SEQ ID NO: 1652207 - protein, 20 aa, Staphylococcus aureus
SCSFEGFIDYSGERFYSEAI

SEQ ID NO: 1652208 - protein, 26 aa, Staphylococcus aureus
SFVYKRRLPFHAKRFNDWLESMPNNV

SEQ ID NO: 1652209 - protein, 20 aa, Staphylococcus aureus
SIETRRYYLMLMLFSKENAM

SEQ ID NO: 1652210 - protein, 17 aa, Staphylococcus aureus
SPLFKVKLFQFADAAYI

SEQ ID NO: 1652211 - protein, 23 aa, Staphylococcus aureus
STLAKAICGFLDITGNIQFCNRG

SEQ ID NO: 1652212 - protein, 17 aa, Staphylococcus aureus
SVKTRLGYYEIDEWKDW

SEQ ID NO: 1652213 - protein, 17 aa, Staphylococcus aureus
SVSNYIMRVRLSINEIV

SEQ ID NO: 1652214 - protein, 24 aa, Staphylococcus aureus
SYDRLEGFNSLQWPVQPDGTDEPI

SEQ ID NO: 1652215 - protein, 24 aa, Staphylococcus aureus
TAKIVLRWLKEQGIQVELLNLGGG

SEQ ID NO: 1652216 - protein, 21 aa, Staphylococcus aureus
TDIKYELLSSYSEREIQQQEL

SEQ ID NO: 1652217 - protein, 17 aa, Staphylococcus aureus
TFMKSNMPYTMVGGQKF

SEQ ID NO: 1652218 - protein, 17 aa, Staphylococcus aureus
TGPHFEVLAKIENRLME

SEQ ID NO: 1652219 - protein, 19 aa, Staphylococcus aureus
TIFFTFWGLNALKKVQTVN

SEQ ID NO: 1652220 - protein, 18 aa, Staphylococcus aureus
VALMIGIPPGLIYGETAD

SEQ ID NO: 1652221 - protein, 19 aa, Staphylococcus aureus
VNGTISIGCSSLIGQTLLP

SEQ ID NO: 1652222 - protein, 20 aa, Staphylococcus aureus
VPSYRAVLIYFDEQAITSSK

SEQ ID NO: 1652223 - protein, 20 aa, Staphylococcus aureus
VSALLGRMPSAVGYQPTLAT

SEQ ID NO: 1652224 - protein, 17 aa, Staphylococcus aureus
VSRTALIEKCWESENFI

SEQ ID NO: 1652225 - protein, 18 aa, Staphylococcus aureus
VTDELKSRFEAENLIEQH

SEQ ID NO: 1652226 - protein, 22 aa, Staphylococcus aureus
VVKPLLKYAHHRGIYTQMNSNL

SEQ ID NO: 1652227 - protein, 22 aa, Staphylococcus aureus
WEESGRWGAYGPELMRLQDRHG

SEQ ID NO: 1652228 - protein, 24 aa, Staphylococcus aureus
YDGYAECVKLHFDDRMLTITDIMN

SEQ ID NO: 1652229 - protein, 24 aa, Staphylococcus aureus
YERYLKELSHDISLMKSSILQQKA

SEQ ID NO: 1652230 - protein, 20 aa, Staphylococcus aureus
YLRRINRKTALLIQISTEVG

SEQ ID NO: 1652231 - protein, 24 aa, Staphylococcus aureus
YNATLILDVSHSFGIENYSNYQGV

SEQ ID NO: 1652232 - protein, 18 aa, Staphylococcus aureus
YRNVTAMVRWIREKEILE

SEQ ID NO: 1652233 - protein, 18 aa, Staphylococcus aureus
YRPRKMNRFLKHVVDTNE

SEQ ID NO: 1652234 - protein, 17 aa, Staphylococcus aureus
YVSYAIKGNLMYENAYP

SEQ ID NO: 1652235 - protein, 25 aa, Staphylococcus aureus
AIKELICQFKYLSAFEKDVMYLMCE

SEQ ID NO: 1652236 - protein, 20 aa, Staphylococcus aureus
AKPAGICGCTDLTRDQIVTQ

SEQ ID NO: 1652237 - protein, 18 aa, Staphylococcus aureus
AKQKFKQREYKRAAEYFE

SEQ ID NO: 1652238 - protein, 22 aa, Staphylococcus aureus
AKQLRKGAVKRIVLTRPAVEAG

SEQ ID NO: 1652239 - protein, 17 aa, Staphylococcus aureus
AQHALDLLGLATLSLLD

SEQ ID NO: 1652240 - protein, 18 aa, Staphylococcus aureus
ARASFYIYNTKEDVDQLI

SEQ ID NO: 1652241 - protein, 24 aa, Staphylococcus aureus
ATAIRIGNPASWDKATNALKESNG

SEQ ID NO: 1652242 - protein, 19 aa, Staphylococcus aureus
AYVPCKEAVLPIFDQIFTR

SEQ ID NO: 1652243 - protein, 31 aa, Staphylococcus aureus
DDPEGFINFCHKRLLFVDTMPNIVHDWIAKL

SEQ ID NO: 1652244 - protein, 18 aa, Staphylococcus aureus
DELIGYSLDPVWNMSDLK

SEQ ID NO: 1652245 - protein, 22 aa, Staphylococcus aureus
DEVLQKSGYREMLERENTLESR

SEQ ID NO: 1652246 - protein, 24 aa, Staphylococcus aureus
DKLPYRAKRHYSIVSGEKNHLTFG

SEQ ID NO: 1652247 - protein, 23 aa, Staphylococcus aureus
DNDRAMFEFGHYTVAMKNARPEI

SEQ ID NO: 1652248 - protein, 23 aa, Staphylococcus aureus
DRHDIKVTAWMPLMRNRGLLDDP

SEQ ID NO: 1652249 - protein, 30 aa, Staphylococcus aureus
EAIEIAALAGMVVLSCINPVAGAVAIGAYS

SEQ ID NO: 1652250 - protein, 24 aa, Staphylococcus aureus
EDIWRHLSKIWYTDRQLLINNLIS

SEQ ID NO: 1652251 - protein, 26 aa, Staphylococcus aureus
EDTYKLDRYVGLIAEEVENLGLKEFV

SEQ ID NO: 1652252 - protein, 19 aa, Staphylococcus aureus
EERFIEMIQYFKEKITEGD

SEQ ID NO: 1652253 - protein, 22 aa, Staphylococcus aureus
EGEVPFKPSRVILQDFTGVPAV

SEQ ID NO: 1652254 - protein, 20 aa, Staphylococcus aureus
EGKGFKCFVKQNDHVEAGQT

SEQ ID NO: 1652255 - protein, 17 aa, Staphylococcus aureus
EKADELINSARVVIVEN

SEQ ID NO: 1652256 - protein, 17 aa, Staphylococcus aureus
ELFDFYYDLFKSDDDTY

SEQ ID NO: 1652257 - protein, 23 aa, Staphylococcus aureus
ELNGFRALTKIDWENVTINNEIT

SEQ ID NO: 1652258 - protein, 19 aa, Staphylococcus aureus
ERDTLRTYLNQVYDIERLV

SEQ ID NO: 1652259 - protein, 19 aa, Staphylococcus aureus
ERLYYLGQEGVVFKDEDDL

SEQ ID NO: 1652260 - protein, 24 aa, Staphylococcus aureus
ETALPEFYERASFAPEMSDPSMIQ

SEQ ID NO: 1652261 - protein, 22 aa, Staphylococcus aureus
EVENLGLKEFVTYDDKGEIEGI

SEQ ID NO: 1652262 - protein, 21 aa, Staphylococcus aureus
EYELKKGKMNTLIDEYSAVHY

SEQ ID NO: 1652263 - protein, 19 aa, Staphylococcus aureus
FEHIRFPVFGVQYHPESIL

SEQ ID NO: 1652264 - protein, 33 aa, Staphylococcus aureus
FKDIAHWEVPSGGYFVWLVFKIDIDIKYLFYEL

SEQ ID NO: 1652265 - protein, 20 aa, Staphylococcus aureus
FKGLKEWHFGIFEGESVYLF

SEQ ID NO: 1652266 - protein, 28 aa, Staphylococcus aureus
FNMTPYKVQIMGGIAIHKGDIAEMRTGE

SEQ ID NO: 1652267 - protein, 23 aa, Staphylococcus aureus
FRDDVICRRCFRLKNYNEVQDVG

SEQ ID NO: 1652268 - protein, 21 aa, Staphylococcus aureus
GATFPNCLKITAKNDEAIIMA

SEQ ID NO: 1652269 - protein, 19 aa, Staphylococcus aureus
GDEGSHCQIARNIATTMSH

SEQ ID NO: 1652270 - protein, 18 aa, Staphylococcus aureus
GEDIVECITTFADDQDLT

SEQ ID NO: 1652271 - protein, 26 aa, Staphylococcus aureus
GGINAGIATCWFNFRGFDHNPGIIPD

SEQ ID NO: 1652272 - protein, 18 aa, Staphylococcus aureus
GGQSYTYDTIKAFKEQHK

SEQ ID NO: 1652273 - protein, 19 aa, Staphylococcus aureus
GHLHHPFSIEDDKIKYSGS

SEQ ID NO: 1652274 - protein, 20 aa, Staphylococcus aureus
GKDFYMFAPHTVKEEYGVTL

SEQ ID NO: 1652275 - protein, 17 aa, Staphylococcus aureus
GKPEHLDYIFTDKDHKQ

SEQ ID NO: 1652276 - protein, 21 aa, Staphylococcus aureus
GNSKYLFTYFVKHNPMTACYF

SEQ ID NO: 1652277 - protein, 25 aa, Staphylococcus aureus
GSEKWPIFLERRLVDGIFTIKDQDA

SEQ ID NO: 1652278 - protein, 25 aa, Staphylococcus aureus
GTEPKIKLYVSLKCPDFDDVAQKIN

SEQ ID NO: 1652279 - protein, 25 aa, Staphylococcus aureus
GTGIKEMIAHFGIHQEETLVIGDSD

SEQ ID NO: 1652280 - protein, 18 aa, Staphylococcus aureus
HDQPRVVSRFGDDTSEEM

SEQ ID NO: 1652281 - protein, 27 aa, Staphylococcus aureus
HLIPETRRSTILSSKKLGDKVHLETDV

SEQ ID NO: 1652282 - protein, 21 aa, Staphylococcus aureus
HPANCLMARIGKNITLEQQQA

SEQ ID NO: 1652283 - protein, 26 aa, Staphylococcus aureus
IAKDRNKVTWGYAKSILNTWLNANLK

SEQ ID NO: 1652284 - protein, 17 aa, Staphylococcus aureus
IDNVFPLMGQTITTNDF

SEQ ID NO: 1652285 - protein, 27 aa, Staphylococcus aureus
IFREKMVGEGLAIKAHEESKVIAPFNG

SEQ ID NO: 1652286 - protein, 17 aa, Staphylococcus aureus
IKAKYKKAFKMKDDIEL

SEQ ID NO: 1652287 - protein, 23 aa, Staphylococcus aureus
IKLFPGQEIRITDSILKGLDNGS

SEQ ID NO: 1652288 - protein, 20 aa, Staphylococcus aureus
ILSEYGYRQVELFLSKVGDY

SEQ ID NO: 1652289 - protein, 17 aa, Staphylococcus aureus
INIGCIPSKTLVHDGLE

SEQ ID NO: 1652290 - protein, 23 aa, Staphylococcus aureus
KAKGLKPRAIRAMIVGIPNVGKS

SEQ ID NO: 1652291 - protein, 19 aa, Staphylococcus aureus
KALAKDVFEMFVNEEKVLT

SEQ ID NO: 1652292 - protein, 23 aa, Staphylococcus aureus
KDVEIPKHLIIASRLSKGKYQIL

SEQ ID NO: 1652293 - protein, 22 aa, Staphylococcus aureus
KKKFSPVVGDIVEFEVQNINEG

SEQ ID NO: 1652294 - protein, 19 aa, Staphylococcus aureus
KKKLADWHIGLPEIVQLQY

SEQ ID NO: 1652295 - protein, 20 aa, Staphylococcus aureus
KRMFEEAGFINVRVRSFTGG

SEQ ID NO: 1652296 - protein, 21 aa, Staphylococcus aureus
KRTLHYYDEIGLLVPDKNDKN

SEQ ID NO: 1652297 - protein, 23 aa, Staphylococcus aureus
KSYQSAHVFKRRRTPIVKGVSFE

SEQ ID NO: 1652298 - protein, 17 aa, Staphylococcus aureus
KYGEEAFEVVIEAIKGD

SEQ ID NO: 1652299 - protein, 25 aa, Staphylococcus aureus
LAELTCLNPVQLRRVTTQLVDLKMI

SEQ ID NO: 1652300 - protein, 25 aa, Staphylococcus aureus
LEDMYGVTCTLEYNDDYPALYNDPE

SEQ ID NO: 1652301 - protein, 29 aa, Staphylococcus aureus
LETKKSVSKEVKYQKTIELLKHQSELSSL

SEQ ID NO: 1652302 - protein, 24 aa, Staphylococcus aureus
LGDAYEFLIGRFAATAGKKAGEFY

SEQ ID NO: 1652303 - protein, 22 aa, Staphylococcus aureus
LIGELKSAVDLPIHLHTHDTSG

SEQ ID NO: 1652304 - protein, 18 aa, Staphylococcus aureus
LLEYLPFDLSCTYDSYQF

SEQ ID NO: 1652305 - protein, 17 aa, Staphylococcus aureus
LNGGMGILLGGVPGVPK

SEQ ID NO: 1652306 - protein, 17 aa, Staphylococcus aureus
LNKSLVHKITNVLKDAG

SEQ ID NO: 1652307 - protein, 19 aa, Staphylococcus aureus
LNNLFKDIAHWEVPSGGYF

SEQ ID NO: 1652308 - protein, 26 aa, Staphylococcus aureus
LPSSELARPLLLAALSKDNEVVKIDL

SEQ ID NO: 1652309 - protein, 26 aa, Staphylococcus aureus
LRKYLKKYFCLTLDNYLVLAYLDVFK

SEQ ID NO: 1652310 - protein, 17 aa, Staphylococcus aureus
LVTPIGLGQRGLIVAPP

SEQ ID NO: 1652311 - protein, 17 aa, Staphylococcus aureus
MIEAGILDGDKVIVRSQ

SEQ ID NO: 1652312 - protein, 17 aa, Staphylococcus aureus
MNALEHVSFELLKRFSN

SEQ ID NO: 1652313 - protein, 21 aa, Staphylococcus aureus
MPSMLNKYFNKLSVFRKLFGN

SEQ ID NO: 1652314 - protein, 27 aa, Staphylococcus aureus
MQLMCKGDMKRHCNIIIPDKNEYETML

SEQ ID NO: 1652315 - protein, 17 aa, Staphylococcus aureus
MVKDGRLTSAHGRTLLA

SEQ ID NO: 1652316 - protein, 18 aa, Staphylococcus aureus
NIEKGRMMVEAEIKEQGF

SEQ ID NO: 1652317 - protein, 21 aa, Staphylococcus aureus
NTLMTDWNIQTHIYKFNQIVT

SEQ ID NO: 1652318 - protein, 21 aa, Staphylococcus aureus
NTPLIHCENMSKILGIDLYVK

SEQ ID NO: 1652319 - protein, 24 aa, Staphylococcus aureus
NVSKSWLYKEHDIRQRIESLRERQ

SEQ ID NO: 1652320 - protein, 20 aa, Staphylococcus aureus
PRGASFSWYEYSPLRIKYPY

SEQ ID NO: 1652321 - protein, 26 aa, Staphylococcus aureus
PRLQPWDFAGGLVILYEVNGQASNLL

SEQ ID NO: 1652322 - protein, 17 aa, Staphylococcus aureus
PSELMAFGDANNDKDML

SEQ ID NO: 1652323 - protein, 24 aa, Staphylococcus aureus
QIKKGYCLLVGIGQNSTEQDADVI

SEQ ID NO: 1652324 - protein, 17 aa, Staphylococcus aureus
QKLNGGMGILLGGVPGV

SEQ ID NO: 1652325 - protein, 18 aa, Staphylococcus aureus
QQYRKVYQATDFYLVGCE

SEQ ID NO: 1652326 - protein, 20 aa, Staphylococcus aureus
RAQVILSEFEASAGKKSSIS

SEQ ID NO: 1652327 - protein, 19 aa, Staphylococcus aureus
REVNPNKFLFIVHNEGILN

SEQ ID NO: 1652328 - protein, 24 aa, Staphylococcus aureus
RLFIDCKVPQWVRDQMPIVLDKQQ

SEQ ID NO: 1652329 - protein, 24 aa, Staphylococcus aureus
RTEEIKYYLAEAIKAEKAGKKVEM

SEQ ID NO: 1652330 - protein, 22 aa, Staphylococcus aureus
RTTIKNDVWIGANVIIMDGLTI

SEQ ID NO: 1652331 - protein, 20 aa, Staphylococcus aureus
SEHCSYKHSKPFLKQFPTSG

SEQ ID NO: 1652332 - protein, 25 aa, Staphylococcus aureus
SGKYRPELRNMKIFPRPIDNILPIW

SEQ ID NO: 1652333 - protein, 19 aa, Staphylococcus aureus
SIERIVIELTKLMRGINVE

SEQ ID NO: 1652334 - protein, 17 aa, Staphylococcus aureus
SILNTWLNANLKSIEQV

SEQ ID NO: 1652335 - protein, 18 aa, Staphylococcus aureus
SISLDLMYHLPKQTIEDF

SEQ ID NO: 1652336 - protein, 20 aa, Staphylococcus aureus
SRQDALAGKIDWVTKFPEGE

SEQ ID NO: 1652337 - protein, 23 aa, Staphylococcus aureus
TELSKRGGLTIVDDIMVQSATAI

SEQ ID NO: 1652338 - protein, 20 aa, Staphylococcus aureus
TFSPELVDFSIYIIDVAQGE

SEQ ID NO: 1652339 - protein, 23 aa, Staphylococcus aureus
TIAPAIRIGWIVASEKIIEQLAD

SEQ ID NO: 1652340 - protein, 25 aa, Staphylococcus aureus
TIEYLIIKGLIKYAKSVTIILTTDG

SEQ ID NO: 1652341 - protein, 21 aa, Staphylococcus aureus
TLHQFPIDNVFPLMGQTITTN

SEQ ID NO: 1652342 - protein, 24 aa, Staphylococcus aureus
TNEKSLFVIDEFYDVAIAIYYLDG

SEQ ID NO: 1652343 - protein, 17 aa, Staphylococcus aureus
TNLADCFNLNEQLPLQF

SEQ ID NO: 1652344 - protein, 23 aa, Staphylococcus aureus
TRPEAIKMAPLVKALEQEKMLEP

SEQ ID NO: 1652345 - protein, 17 aa, Staphylococcus aureus
TTYAGLHAVWSHLIAHK

SEQ ID NO: 1652346 - protein, 19 aa, Staphylococcus aureus
TVHIALMHDWLKGKIIVDS

SEQ ID NO: 1652347 - protein, 25 aa, Staphylococcus aureus
VAIARAICINPKYILFDEAISSLDM

SEQ ID NO: 1652348 - protein, 19 aa, Staphylococcus aureus
VELREAVPCIVTLNYDQTG

SEQ ID NO: 1652349 - protein, 24 aa, Staphylococcus aureus
VEYKEVLTGFKFIAQEIRQLDDHQ

SEQ ID NO: 1652350 - protein, 18 aa, Staphylococcus aureus
VGNSVIYVGLKTGRDGIH

SEQ ID NO: 1652351 - protein, 27 aa, Staphylococcus aureus
VKISGLFKKMHVRMMPAQEPPYTRLID

SEQ ID NO: 1652352 - protein, 25 aa, Staphylococcus aureus
VNKKEFKNNLALCVYYLEKLIKDSK

SEQ ID NO: 1652353 - protein, 21 aa, Staphylococcus aureus
VVANLPYYITTPILLNLMQQD

SEQ ID NO: 1652354 - protein, 18 aa, Staphylococcus aureus
YDRFRNRIMFPLKNAQGR

SEQ ID NO: 1652355 - protein, 18 aa, Staphylococcus aureus
YGSEAWTKQFLAVAIRPM

SEQ ID NO: 1652356 - protein, 18 aa, Staphylococcus aureus
YRLKIVLNAESKFETIVS

SEQ ID NO: 1652357 - protein, 24 aa, Staphylococcus aureus
YRTVMPGFNYEAPPTQHKINPYDI

SEQ ID NO: 1652358 - protein, 18 aa, Staphylococcus aureus
AEITYRFVDNNEINIDHT

SEQ ID NO: 1652359 - protein, 21 aa, Staphylococcus aureus
AITLKAAFELGERMGRRAENN

SEQ ID NO: 1652360 - protein, 19 aa, Staphylococcus aureus
AKGDVTFSYSLMGSSGDDK

SEQ ID NO: 1652361 - protein, 18 aa, Staphylococcus aureus
ALMGTGIKDSTARSIGFW

SEQ ID NO: 1652362 - protein, 20 aa, Staphylococcus aureus
ANQLANWGVDGIFTDNADKM

SEQ ID NO: 1652363 - protein, 24 aa, Staphylococcus aureus
AQANLRLATMSDNRYQLIRREAVS

SEQ ID NO: 1652364 - protein, 25 aa, Staphylococcus aureus
DKFAKAVPLSAVFEAQNLMDLEWND

SEQ ID NO: 1652365 - protein, 25 aa, Staphylococcus aureus
DKHYPHLRFGFIHVPYIPEQVIGKP

SEQ ID NO: 1652366 - protein, 18 aa, Staphylococcus aureus
DNSIIGFVMRPLINYDAI

SEQ ID NO: 1652367 - protein, 22 aa, Staphylococcus aureus
DRRTKMYNVFEYFKQISNNKHF

SEQ ID NO: 1652368 - protein, 22 aa, Staphylococcus aureus
DTLAKNVVKGFVEGKYDGGRHQ

SEQ ID NO: 1652369 - protein, 23 aa, Staphylococcus aureus
EAMISKRPVVAFDIKYGPSDFIE

SEQ ID NO: 1652370 - protein, 17 aa, Staphylococcus aureus
EDEIGFIALHIASNTED

SEQ ID NO: 1652371 - protein, 19 aa, Staphylococcus aureus
EDNRTILYTSHYIEEVERM

SEQ ID NO: 1652372 - protein, 19 aa, Staphylococcus aureus
EDTLFLGMGGMHGSYASNM

SEQ ID NO: 1652373 - protein, 22 aa, Staphylococcus aureus
EEFSYKCSIKDIKYKKLLKAIS

SEQ ID NO: 1652374 - protein, 30 aa, Staphylococcus aureus
EESVECYEIYHPLESVGIYVPGGKASYPST

SEQ ID NO: 1652375 - protein, 18 aa, Staphylococcus aureus
EGKFEINRLYKDVKNVKG

SEQ ID NO: 1652376 - protein, 18 aa, Staphylococcus aureus
EHEVVFKKYFEGEGLSIL

SEQ ID NO: 1652377 - protein, 30 aa, Staphylococcus aureus
EIYLSFLDTKSWCKNKFQVTNQVSVEDTYK

SEQ ID NO: 1652378 - protein, 30 aa, Staphylococcus aureus
EKDKRAKELIKLVDLPESFLERYPAELSGG

SEQ ID NO: 1652379 - protein, 18 aa, Staphylococcus aureus
EMIALLIKYHGQYITIHD

SEQ ID NO: 1652380 - protein, 24 aa, Staphylococcus aureus
ENPQSGKVQLVYNEHVELIEVPIK

SEQ ID NO: 1652381 - protein, 18 aa, Staphylococcus aureus
ERILGSEHEVVFKKYFEG

SEQ ID NO: 1652382 - protein, 24 aa, Staphylococcus aureus
EVNVGDPLVRFNLEYINNNAKSVI

SEQ ID NO: 1652383 - protein, 18 aa, Staphylococcus aureus
EYYTHFTSPIRRYPDLTV

SEQ ID NO: 1652384 - protein, 26 aa, Staphylococcus aureus
FCDEMAEAGIYKWHIDIQAGTCTYID

SEQ ID NO: 1652385 - protein, 23 aa, Staphylococcus aureus
FDEEARIPFIKHMQNSGLFASIS

SEQ ID NO: 1652386 - protein, 19 aa, Staphylococcus aureus
FDLKDLHVVIGPSTSSSYE

SEQ ID NO: 1652387 - protein, 23 aa, Staphylococcus aureus
FICPNNKRIGFKRYAYRNDRYGF

SEQ ID NO: 1652388 - protein, 19 aa, Staphylococcus aureus
FKDEHLPTFDDVVKIANEY

SEQ ID NO: 1652389 - protein, 23 aa, Staphylococcus aureus
FKIVSASLVKYFYRTPRIPRSLL

SEQ ID NO: 1652390 - protein, 17 aa, Staphylococcus aureus
FKPFDKVIFSVGSGGNT

SEQ ID NO: 1652391 - protein, 17 aa, Staphylococcus aureus
FNGLISMIVPTKHAVGI

SEQ ID NO: 1652392 - protein, 18 aa, Staphylococcus aureus
FNYMPYFEHLDMNQINVT

SEQ ID NO: 1652393 - protein, 19 aa, Staphylococcus aureus
FREDWRTLLDYCNAKIVNT

SEQ ID NO: 1652394 - protein, 18 aa, Staphylococcus aureus
FSSNLEKITAFRDELKQN

SEQ ID NO: 1652395 - protein, 18 aa, Staphylococcus aureus
FYMNCTKNAMLPIVLEKS

SEQ ID NO: 1652396 - protein, 17 aa, Staphylococcus aureus
GETFKTKSLHITEEEII

SEQ ID NO: 1652397 - protein, 17 aa, Staphylococcus aureus
GKMNTLIDEYSAVHYQC

SEQ ID NO: 1652398 - protein, 19 aa, Staphylococcus aureus
GMHTLSISFKLWVEEGKYG

SEQ ID NO: 1652399 - protein, 25 aa, Staphylococcus aureus
GTKKRIRYYSCSNFRNKGSKVCSAN

SEQ ID NO: 1652400 - protein, 18 aa, Staphylococcus aureus
ICVSDFDKQLALKYRFNR

SEQ ID NO: 1652401 - protein, 22 aa, Staphylococcus aureus
IDKEAPDNFILGFRATPEETRG

SEQ ID NO: 1652402 - protein, 18 aa, Staphylococcus aureus
IFLHCLPAFHDTNTLYGQ

SEQ ID NO: 1652403 - protein, 18 aa, Staphylococcus aureus
IHACWLANIEIAMINTRL

SEQ ID NO: 1652404 - protein, 21 aa, Staphylococcus aureus
IKDASAGSWFGEKFKDEHLPT

SEQ ID NO: 1652405 - protein, 19 aa, Staphylococcus aureus
IMQESCNMLDYFEIPYEKQ

SEQ ID NO: 1652406 - protein, 29 aa, Staphylococcus aureus
INEAFLRRCPNLKWIAWFATGVNTLPLDY

SEQ ID NO: 1652407 - protein, 20 aa, Staphylococcus aureus
INTGVGFLNHMLTLFTFHSG

SEQ ID NO: 1652408 - protein, 25 aa, Staphylococcus aureus
IPGEGEYAVGLFFSKERILGSEHEV

SEQ ID NO: 1652409 - protein, 17 aa, Staphylococcus aureus
ISDEIICVFDAYDQSGV

SEQ ID NO: 1652410 - protein, 28 aa, Staphylococcus aureus
ISDLQLIRRSVCEFIKGLSLIDTSILNK

SEQ ID NO: 1652411 - protein, 21 aa, Staphylococcus aureus
IVLEHGQTLFIITHNLSHVLK

SEQ ID NO: 1652412 - protein, 19 aa, Staphylococcus aureus
IYIEPRFNNPTGRSLTNEQ

SEQ ID NO: 1652413 - protein, 21 aa, Staphylococcus aureus
KDLIRQCNKLGKPVITATQML

SEQ ID NO: 1652414 - protein, 21 aa, Staphylococcus aureus
KGTELYHKTLGVIGAGRIGLG

SEQ ID NO: 1652415 - protein, 21 aa, Staphylococcus aureus
KHAFSEKLKALGYDIDKEAQI

SEQ ID NO: 1652416 - protein, 19 aa, Staphylococcus aureus
KKKHFELMKDEALFINIGR

SEQ ID NO: 1652417 - protein, 20 aa, Staphylococcus aureus
KKTSEKLTRIIAEHDYQPNQ

SEQ ID NO: 1652418 - protein, 18 aa, Staphylococcus aureus
KNAMLPIVLEKSAREHLA

SEQ ID NO: 1652419 - protein, 19 aa, Staphylococcus aureus
KPHSGFTLETQFLPNDINL

SEQ ID NO: 1652420 - protein, 19 aa, Staphylococcus aureus
KTFYGAFCSAIEVIRKNNP

SEQ ID NO: 1652421 - protein, 24 aa, Staphylococcus aureus
KTLKEANLDFGVEMCEPQPPSEDF

SEQ ID NO: 1652422 - protein, 25 aa, Staphylococcus aureus
KYFEGEGLSILGYRNVPVNKDAIAK

SEQ ID NO: 1652423 - protein, 21 aa, Staphylococcus aureus
LAPSKFEAWFLTTEHTEEDIK

SEQ ID NO: 1652424 - protein, 18 aa, Staphylococcus aureus
LDMITDLDFETLYQYMLS

SEQ ID NO: 1652425 - protein, 23 aa, Staphylococcus aureus
LEEAYKWMHPCYTLNNKNVVLIH

SEQ ID NO: 1652426 - protein, 19 aa, Staphylococcus aureus
LESIYTLALAKSHRTSNDK

SEQ ID NO: 1652427 - protein, 21 aa, Staphylococcus aureus
LFEVMCQCDGQPKEVMEVQAI

SEQ ID NO: 1652428 - protein, 17 aa, Staphylococcus aureus
LKKKYLDLLSQNFDTPE

SEQ ID NO: 1652429 - protein, 19 aa, Staphylococcus aureus
LNKFKGFETSYIINENQVS

SEQ ID NO: 1652430 - protein, 25 aa, Staphylococcus aureus
LNKLSYLNLDAFQKRDILAAHYIAK

SEQ ID NO: 1652431 - protein, 23 aa, Staphylococcus aureus
LNLKNGFYLNEFLKEVNQHKIDQ

SEQ ID NO: 1652432 - protein, 27 aa, Staphylococcus aureus
LNNDWSRNQIQDWIKAGLVVANDKVVK

SEQ ID NO: 1652433 - protein, 17 aa, Staphylococcus aureus
LPNELLSLIDIIVPNET

SEQ ID NO: 1652434 - protein, 18 aa, Staphylococcus aureus
LRHTHCSYLLAKGVSIHY

SEQ ID NO: 1652435 - protein, 17 aa, Staphylococcus aureus
LSEPFLFEDIEDILRHI

SEQ ID NO: 1652436 - protein, 24 aa, Staphylococcus aureus
MFPDQLKVIEIINLYQSFYENPLP

SEQ ID NO: 1652437 - protein, 20 aa, Staphylococcus aureus
MFQKTMFPDQLKVIEIINLY

SEQ ID NO: 1652438 - protein, 26 aa, Staphylococcus aureus
MHQIRVLRELDFHFQLVIDANESLDR

SEQ ID NO: 1652439 - protein, 34 aa, Staphylococcus aureus
NECNYPVISEKLEWIPNLFVAGCFADLELGPFGR

SEQ ID NO: 1652440 - protein, 23 aa, Staphylococcus aureus
NKSKHNLLQCLIFVNDMYLLSNP

SEQ ID NO: 1652441 - protein, 24 aa, Staphylococcus aureus
PGYRVKESPVHFECEYVQTIRIPT

SEQ ID NO: 1652442 - protein, 17 aa, Staphylococcus aureus
PNIFTGCGNFHGPYEYA

SEQ ID NO: 1652443 - protein, 18 aa, Staphylococcus aureus
PNRMGNLAIKKGWPSMMY

SEQ ID NO: 1652444 - protein, 21 aa, Staphylococcus aureus
PVKRTDGFITKFNRLIERRLL

SEQ ID NO: 1652445 - protein, 17 aa, Staphylococcus aureus
QAKHVFDSTGLLNISYQ

SEQ ID NO: 1652446 - protein, 18 aa, Staphylococcus aureus
QQRLLDFVLSLIGQPQLI

SEQ ID NO: 1652447 - protein, 23 aa, Staphylococcus aureus
QTNAMHQFAIWTALATKGIGASL

SEQ ID NO: 1652448 - protein, 23 aa, Staphylococcus aureus
RFGDADISPGTRLQFIQVPSEQL

SEQ ID NO: 1652449 - protein, 24 aa, Staphylococcus aureus
RNGPTGTVKLHFMKQYNKFTDIDY

SEQ ID NO: 1652450 - protein, 17 aa, Staphylococcus aureus
RPNFEMEERLVLEKVNY

SEQ ID NO: 1652451 - protein, 20 aa, Staphylococcus aureus
RQLHEIRPNHFVFSTEEEAA

SEQ ID NO: 1652452 - protein, 20 aa, Staphylococcus aureus
RVILELLYATGIRVSELVNI

SEQ ID NO: 1652453 - protein, 18 aa, Staphylococcus aureus
RWNQDFRLEDFKKVIDIK

SEQ ID NO: 1652454 - protein, 19 aa, Staphylococcus aureus
SLKELLILAYFYYKNEHSI

SEQ ID NO: 1652455 - protein, 17 aa, Staphylococcus aureus
SNFNPENFRAMDYIIQG

SEQ ID NO: 1652456 - protein, 24 aa, Staphylococcus aureus
STFANCINGLIPFKTKGNITGELY

SEQ ID NO: 1652457 - protein, 39 aa, Staphylococcus aureus
TDKPSMLKRIFSRAKSSINEIFSRMQSVSAQVDRITIQL

SEQ ID NO: 1652458 - protein, 17 aa, Staphylococcus aureus
TDLYKGDYETLVDSIQD

SEQ ID NO: 1652459 - protein, 18 aa, Staphylococcus aureus
TEEKMIKEVEDVYNGKST

SEQ ID NO: 1652460 - protein, 18 aa, Staphylococcus aureus
TEHLQVFNVIKNTSNKYI

SEQ ID NO: 1652461 - protein, 20 aa, Staphylococcus aureus
TGRMLPGTKLQAGLHQAIEA

SEQ ID NO: 1652462 - protein, 18 aa, Staphylococcus aureus
TIPNYKGTNFKRLLKSLS

SEQ ID NO: 1652463 - protein, 19 aa, Staphylococcus aureus
TSIIFKYLQENGIESHFIK

SEQ ID NO: 1652464 - protein, 18 aa, Staphylococcus aureus
TTLPVLCKDFIIDPLQID

SEQ ID NO: 1652465 - protein, 20 aa, Staphylococcus aureus
TYHLPTEHLQVFNVIKNTSN

SEQ ID NO: 1652466 - protein, 17 aa, Staphylococcus aureus
VIEIVKLGINKARGIEQ

SEQ ID NO: 1652467 - protein, 24 aa, Staphylococcus aureus
VLKEREHFAIFPASHFVTREEKLK

SEQ ID NO: 1652468 - protein, 25 aa, Staphylococcus aureus
VNVASFTLAVNRTFTNAQGEREADF

SEQ ID NO: 1652469 - protein, 19 aa, Staphylococcus aureus
VRTILKRNVRNVPVVDDQQ

SEQ ID NO: 1652470 - protein, 17 aa, Staphylococcus aureus
VTYPCAIKRFDVENNYL

SEQ ID NO: 1652471 - protein, 22 aa, Staphylococcus aureus
VVFRIKHEYKELLTSTERGKIE

SEQ ID NO: 1652472 - protein, 28 aa, Staphylococcus aureus
YHKESFKTSEVPSAIFGTMKPKKLENGR

SEQ ID NO: 1652473 - protein, 18 aa, Staphylococcus aureus
YKIYFGFADRHAYEDFKQ

SEQ ID NO: 1652474 - protein, 23 aa, Staphylococcus aureus
YLNEKYKFGIVLKEVTPLEIEKA

SEQ ID NO: 1652475 - protein, 26 aa, Staphylococcus aureus
YSSSLPIYNLYFIKRNIEKLINADDR

SEQ ID NO: 1652476 - protein, 18 aa, Staphylococcus aureus
AFNVEGLDARMEALNEYI

SEQ ID NO: 1652477 - protein, 19 aa, Staphylococcus aureus
AIILRDLVDALLFEDIAGI

SEQ ID NO: 1652478 - protein, 17 aa, Staphylococcus aureus
AKQPIIITGHEINSFHL

SEQ ID NO: 1652479 - protein, 19 aa, Staphylococcus aureus
ALKQVPSCEFFPVEAVKTN

SEQ ID NO: 1652480 - protein, 22 aa, Staphylococcus aureus
ANSAHVTGCRLLKKPHIKQYIQ

SEQ ID NO: 1652481 - protein, 17 aa, Staphylococcus aureus
APPEIIDFKSWLDGQDL

SEQ ID NO: 1652482 - protein, 21 aa, Staphylococcus aureus
APQPFKIMASHYLFEYIHPFY

SEQ ID NO: 1652483 - protein, 22 aa, Staphylococcus aureus
AQEDYYRLILLSRHQNDIPMWL

SEQ ID NO: 1652484 - protein, 20 aa, Staphylococcus aureus
DDALNYYLFYLKNWNYAYAY

SEQ ID NO: 1652485 - protein, 21 aa, Staphylococcus aureus
DDILRKMVASMQKQVVQSTKL

SEQ ID NO: 1652486 - protein, 25 aa, Staphylococcus aureus
DFPLPREWRDAGWFLEVKPPQTGGD

SEQ ID NO: 1652487 - protein, 19 aa, Staphylococcus aureus
DKRIYDLQLSRQIALQTAP

SEQ ID NO: 1652488 - protein, 24 aa, Staphylococcus aureus
DVAAEWAIPLLPKEHVTLLDIARK

SEQ ID NO: 1652489 - protein, 29 aa, Staphylococcus aureus
EAMVRLSQDWKLRHVLIEMHGNNGSIDND

SEQ ID NO: 1652490 - protein, 21 aa, Staphylococcus aureus
EIIRLIQELAHDFPTGTHERQ

SEQ ID NO: 1652491 - protein, 19 aa, Staphylococcus aureus
EINELLKIYENIGYETEFI

SEQ ID NO: 1652492 - protein, 18 aa, Staphylococcus aureus
EKGIKNVHGYGYGDLYVD

SEQ ID NO: 1652493 - protein, 24 aa, Staphylococcus aureus
EQFKEAYAKFYGLSPEQIIAGNGS

SEQ ID NO: 1652494 - protein, 27 aa, Staphylococcus aureus
ERSLLYEEMKHYFILNFPQRPGALREF

SEQ ID NO: 1652495 - protein, 18 aa, Staphylococcus aureus
ERTVAWISGVEHVRETAP

SEQ ID NO: 1652496 - protein, 21 aa, Staphylococcus aureus
EVARLTPLYAGVSYDRLEGFN

SEQ ID NO: 1652497 - protein, 18 aa, Staphylococcus aureus
FDDMISLMGMHLENDLDY

SEQ ID NO: 1652498 - protein, 17 aa, Staphylococcus aureus
FYGCLFATVDGFNVKAF

SEQ ID NO: 1652499 - protein, 30 aa, Staphylococcus aureus
GAIQEFLPHCFKFGIKNAIRIYNHNTSKSW

SEQ ID NO: 1652500 - protein, 19 aa, Staphylococcus aureus
GHNEIKMVQDLGVDVIVTD

SEQ ID NO: 1652501 - protein, 18 aa, Staphylococcus aureus
GKEVQKDIAIYAPLTGEY

SEQ ID NO: 1652502 - protein, 20 aa, Staphylococcus aureus
GLNNASRINVGLDIINTLSK

SEQ ID NO: 1652503 - protein, 20 aa, Staphylococcus aureus
HFDTELNIPMSQWQYAMNRT

SEQ ID NO: 1652504 - protein, 19 aa, Staphylococcus aureus
HSRGVPFIMSDTGGRVKPL

SEQ ID NO: 1652505 - protein, 26 aa, Staphylococcus aureus
IARGKKRIDYRLSYNFYTTYYDNVEI

SEQ ID NO: 1652506 - protein, 29 aa, Staphylococcus aureus
IEAIMAQGLKCCLNASIISRELLTSLHQQ

SEQ ID NO: 1652507 - protein, 24 aa, Staphylococcus aureus
IEKTLVASKRWIRYIHEVEEPDFL

SEQ ID NO: 1652508 - protein, 18 aa, Staphylococcus aureus
IENVYIMLNKPKGYISAT

SEQ ID NO: 1652509 - protein, 18 aa, Staphylococcus aureus
IGDFFKKMDILISKQKMK

SEQ ID NO: 1652510 - protein, 25 aa, Staphylococcus aureus
IGEVLSLRLEDIVTWDNQIHLTPRD

SEQ ID NO: 1652511 - protein, 25 aa, Staphylococcus aureus
IKAYCYHLKLLYEFMEQRGVILNDI

SEQ ID NO: 1652512 - protein, 17 aa, Staphylococcus aureus
IKMVQDLGVDVIVTDHH

SEQ ID NO: 1652513 - protein, 17 aa, Staphylococcus aureus
IMKNYNWEYFKAQINQK

SEQ ID NO: 1652514 - protein, 17 aa, Staphylococcus aureus
IMRVRLSINEIVDKDQV

SEQ ID NO: 1652515 - protein, 19 aa, Staphylococcus aureus
INDIREWEDLPPVEGGDKP

SEQ ID NO: 1652516 - protein, 23 aa, Staphylococcus aureus
INELRLKSIRKIVKRINTWSDEV

SEQ ID NO: 1652517 - protein, 17 aa, Staphylococcus aureus
INHRPRKSLGYRTPLEV

SEQ ID NO: 1652518 - protein, 19 aa, Staphylococcus aureus
IPKDLRHMHGFGSHTYSMY

SEQ ID NO: 1652519 - protein, 24 aa, Staphylococcus aureus
ISAVKHLLPDFALDALKERINELF

SEQ ID NO: 1652520 - protein, 21 aa, Staphylococcus aureus
ITNKWSEMMLWSSQQRSQYTV

SEQ ID NO: 1652521 - protein, 20 aa, Staphylococcus aureus
ITRGDIFVRGAIKEHMASLV

SEQ ID NO: 1652522 - protein, 25 aa, Staphylococcus aureus
KAIKKELKKLQGYAEENNKSFVKNS

SEQ ID NO: 1652523 - protein, 22 aa, Staphylococcus aureus
KAYFEKCLPGYTLINKLHPSIE

SEQ ID NO: 1652524 - protein, 19 aa, Staphylococcus aureus
KDFKAFNVEGLDARMEALN

SEQ ID NO: 1652525 - protein, 18 aa, Staphylococcus aureus
KENLVYCDLIEHLILHAI

SEQ ID NO: 1652526 - protein, 24 aa, Staphylococcus aureus
KFKKEFKPVMHLKGDAFNQQLQSL

SEQ ID NO: 1652527 - protein, 26 aa, Staphylococcus aureus
KGEIEGIAYDRLWIHLIPVIKEQQLR

SEQ ID NO: 1652528 - protein, 19 aa, Staphylococcus aureus
KHFLEKYFGLNVTINRIEK

SEQ ID NO: 1652529 - protein, 18 aa, Staphylococcus aureus
KHRVNAFVTVSHAAKEYY

SEQ ID NO: 1652530 - protein, 17 aa, Staphylococcus aureus
KIAQGVVSINAFKGVSF

SEQ ID NO: 1652531 - protein, 27 aa, Staphylococcus aureus
KKGRALDIGCGSGLLVEKLASYYDEVV

SEQ ID NO: 1652532 - protein, 22 aa, Staphylococcus aureus
KKLPDFILSLGAKFNHQAKEGK

SEQ ID NO: 1652533 - protein, 19 aa, Staphylococcus aureus
KLHQAKQPIIITGHEINSF

SEQ ID NO: 1652534 - protein, 22 aa, Staphylococcus aureus
KLIDLRLDTRISYTESQIKVYR

SEQ ID NO: 1652535 - protein, 18 aa, Staphylococcus aureus
KLLPGCQFHKMGWAMGVV

SEQ ID NO: 1652536 - protein, 17 aa, Staphylococcus aureus
KLNNLYVEEEFYHTYNE

SEQ ID NO: 1652537 - protein, 22 aa, Staphylococcus aureus
KPHDEILVSFDLYGGTFRLFEF

SEQ ID NO: 1652538 - protein, 21 aa, Staphylococcus aureus
KRKADTWLRNQFFATEEYKEA

SEQ ID NO: 1652539 - protein, 20 aa, Staphylococcus aureus
KRLNYVGFYRLHHKYTKKVM

SEQ ID NO: 1652540 - protein, 25 aa, Staphylococcus aureus
KRPEVVEKIKVARSFGDLSENSEYD

SEQ ID NO: 1652541 - protein, 20 aa, Staphylococcus aureus
KSITCKSIIGLNPERLGVTG

SEQ ID NO: 1652542 - protein, 18 aa, Staphylococcus aureus
KTEFEVVVVDDCSTDQTL

SEQ ID NO: 1652543 - protein, 18 aa, Staphylococcus aureus
LAAKERKDALAVSPKSGL

SEQ ID NO: 1652544 - protein, 20 aa, Staphylococcus aureus
LDLADLIPARHVKRMHHVEN

SEQ ID NO: 1652545 - protein, 17 aa, Staphylococcus aureus
LEIPRVSYTLDDDDFIT

SEQ ID NO: 1652546 - protein, 20 aa, Staphylococcus aureus
LELLRILFNYDRLSQYDLTM

SEQ ID NO: 1652547 - protein, 23 aa, Staphylococcus aureus
LIDKMYKRFSILTTISKNQPVGR

SEQ ID NO: 1652548 - protein, 18 aa, Staphylococcus aureus
LISHFKGDNLIIINKDRT

SEQ ID NO: 1652549 - protein, 20 aa, Staphylococcus aureus
LKDELKTVFLGEVLGQSYLN

SEQ ID NO: 1652550 - protein, 19 aa, Staphylococcus aureus
LKVWGERVGVDVISQSEGS

SEQ ID NO: 1652551 - protein, 25 aa, Staphylococcus aureus
LLIKEKPDLILLTFPTPVMSVLTEQ

SEQ ID NO: 1652552 - protein, 25 aa, Staphylococcus aureus
LNALLEMYQGFFLAPHVVSQSLKGA

SEQ ID NO: 1652553 - protein, 20 aa, Staphylococcus aureus
LPPFFYPLNELISIGQMIKN

SEQ ID NO: 1652554 - protein, 21 aa, Staphylococcus aureus
LRRPEMTYDIILEILEEEHQL

SEQ ID NO: 1652555 - protein, 17 aa, Staphylococcus aureus
LTTELLLNANLLSPEQI

SEQ ID NO: 1652556 - protein, 17 aa, Staphylococcus aureus
LVGKPFIVNEEWAIIGH

SEQ ID NO: 1652557 - protein, 25 aa, Staphylococcus aureus
LVRRIVKRTGIEFTSHMLRHTHATQ

SEQ ID NO: 1652558 - protein, 26 aa, Staphylococcus aureus
MKVIYMPHWLEFYSIAIHSDVTSNKK

SEQ ID NO: 1652559 - protein, 21 aa, Staphylococcus aureus
MPIAILIRHTMSFDNAHFFAQ

SEQ ID NO: 1652560 - protein, 17 aa, Staphylococcus aureus
MSDKIILIENGEIILND

SEQ ID NO: 1652561 - protein, 18 aa, Staphylococcus aureus
MYEAGEWIQFYAIDEQKF

SEQ ID NO: 1652562 - protein, 20 aa, Staphylococcus aureus
NEIISYAIIGGFEEGIDIEN

SEQ ID NO: 1652563 - protein, 33 aa, Staphylococcus aureus
NERWLRRVINSLVYDYGYPIGCSYKPSERGYYI

SEQ ID NO: 1652564 - protein, 17 aa, Staphylococcus aureus
NHYAFERIAQMLIESSV

SEQ ID NO: 1652565 - protein, 20 aa, Staphylococcus aureus
NINEGEFFVLIGPSGCGKTT

SEQ ID NO: 1652566 - protein, 18 aa, Staphylococcus aureus
NKLNEVLAAMGLSDKSIE

SEQ ID NO: 1652567 - protein, 30 aa, Staphylococcus aureus
NNVPIKFKEEFEPRKFVFTNGEIKYNSNFE

SEQ ID NO: 1652568 - protein, 23 aa, Staphylococcus aureus
NPRFKHDLKILINLNASGGFELV

SEQ ID NO: 1652569 - protein, 23 aa, Staphylococcus aureus
NVKKKEFLSLIPNVTCNYIKTKL

SEQ ID NO: 1652570 - protein, 25 aa, Staphylococcus aureus
PKHLTTIKVAPLFSEDDRHKIRHVV

SEQ ID NO: 1652571 - protein, 19 aa, Staphylococcus aureus
PLMRRLIEQRICDALAGDE

SEQ ID NO: 1652572 - protein, 18 aa, Staphylococcus aureus
PRKSLGYRTPLEVFMSFI

SEQ ID NO: 1652573 - protein, 20 aa, Staphylococcus aureus
PSYKQLISYCLLENEHGEIL

SEQ ID NO: 1652574 - protein, 21 aa, Staphylococcus aureus
QEVIWLYQYFSDISIAPTTYT

SEQ ID NO: 1652575 - protein, 18 aa, Staphylococcus aureus
QILKNEVATISWVTTDQL

SEQ ID NO: 1652576 - protein, 21 aa, Staphylococcus aureus
QLAAQHLIELGHNHMIIVAPY

SEQ ID NO: 1652577 - protein, 23 aa, Staphylococcus aureus
QLMKRIEQAEVRMEEIDVLMIEA

SEQ ID NO: 1652578 - protein, 24 aa, Staphylococcus aureus
QNYYKYRKFGILPETEYEINKVKE

SEQ ID NO: 1652579 - protein, 21 aa, Staphylococcus aureus
QRPSIPLDEIEKVITRLKNVH

SEQ ID NO: 1652580 - protein, 18 aa, Staphylococcus aureus
QVPELTFDIYGEGSEKTR

SEQ ID NO: 1652581 - protein, 17 aa, Staphylococcus aureus
QVQKKWERSDYVFPGNQ

SEQ ID NO: 1652582 - protein, 17 aa, Staphylococcus aureus
REKARLTNIKGLEIPRV

SEQ ID NO: 1652583 - protein, 20 aa, Staphylococcus aureus
RFYLITDAMRAKGMPEGEYD

SEQ ID NO: 1652584 - protein, 17 aa, Staphylococcus aureus
RLLHAIFGEKAREVRDT

SEQ ID NO: 1652585 - protein, 17 aa, Staphylococcus aureus
RNVILTLARMWQTVTTG

SEQ ID NO: 1652586 - protein, 21 aa, Staphylococcus aureus
RYIDDELWIYSFILNGNNENT

SEQ ID NO: 1652587 - protein, 24 aa, Staphylococcus aureus
SANGRIIVISSIWGETGASMETIY

SEQ ID NO: 1652588 - protein, 18 aa, Staphylococcus aureus
SEVKEGQVVIGLASSGIH

SEQ ID NO: 1652589 - protein, 28 aa, Staphylococcus aureus
SEVVPWQYPPKREFIYGEWLRGEFENGQ

SEQ ID NO: 1652590 - protein, 29 aa, Staphylococcus aureus
SFCSTCTRARLSSDGKFYGCLFATVDGFN

SEQ ID NO: 1652591 - protein, 19 aa, Staphylococcus aureus
SIELLEAEGFIYTKVGSGT

SEQ ID NO: 1652592 - protein, 26 aa, Staphylococcus aureus
SINYRPRKCLNWKFPYEVLCDELLHL

SEQ ID NO: 1652593 - protein, 25 aa, Staphylococcus aureus
SITQLLERFLFPSATHGKKVYKLSG

SEQ ID NO: 1652594 - protein, 21 aa, Staphylococcus aureus
SKAILNLPIRTWFDKAESEIL

SEQ ID NO: 1652595 - protein, 18 aa, Staphylococcus aureus
SLALPFSVLYNLPSKGSD

SEQ ID NO: 1652596 - protein, 19 aa, Staphylococcus aureus
SLWPQPGDHLLVTLRIDRE

SEQ ID NO: 1652597 - protein, 18 aa, Staphylococcus aureus
SNQDFKGLVPNINQNDNY

SEQ ID NO: 1652598 - protein, 18 aa, Staphylococcus aureus
SRDIPFDKVVKMDVDRFA

SEQ ID NO: 1652599 - protein, 24 aa, Staphylococcus aureus
SSDSFWQQVIYKLIYDNEVLIVVS

SEQ ID NO: 1652600 - protein, 21 aa, Staphylococcus aureus
SSEFKLQMVRLYKNGKLKNEI

SEQ ID NO: 1652601 - protein, 25 aa, Staphylococcus aureus
TDDYPGWWREIIDGGYIPIHDYQFL

SEQ ID NO: 1652602 - protein, 21 aa, Staphylococcus aureus
TTMRLKECGLILGIDLLDHII

SEQ ID NO: 1652603 - protein, 19 aa, Staphylococcus aureus
VDKGESIAIIGPSGSGKST

SEQ ID NO: 1652604 - protein, 17 aa, Staphylococcus aureus
VGFALTYFTEGIIFGSK

SEQ ID NO: 1652605 - protein, 17 aa, Staphylococcus aureus
VGVGSYVHYDRKLDGKI

SEQ ID NO: 1652606 - protein, 18 aa, Staphylococcus aureus
VIIKEINAIINLPQKISE

SEQ ID NO: 1652607 - protein, 20 aa, Staphylococcus aureus
VKSTFKDAVIDREKEFATGL

SEQ ID NO: 1652608 - protein, 23 aa, Staphylococcus aureus
VMQELTEYGLIPEDWGGETIFVP

SEQ ID NO: 1652609 - protein, 19 aa, Staphylococcus aureus
VNLLLKLQRERGITFLFIA

SEQ ID NO: 1652610 - protein, 17 aa, Staphylococcus aureus
VSPDFRTVTPIIQNISV

SEQ ID NO: 1652611 - protein, 26 aa, Staphylococcus aureus
VVKEGRIVGIGAHLRKGDKHAEVQAL

SEQ ID NO: 1652612 - protein, 18 aa, Staphylococcus aureus
VVVGGGYIGSELGTAFAN

SEQ ID NO: 1652613 - protein, 17 aa, Staphylococcus aureus
WQFPMFESEHARRKMTE

SEQ ID NO: 1652614 - protein, 19 aa, Staphylococcus aureus
WSEHRELFGDFPSKDFPLL

SEQ ID NO: 1652615 - protein, 25 aa, Staphylococcus aureus
YDLETGRKALLIGVTIGPGNNRHHS

SEQ ID NO: 1652616 - protein, 20 aa, Staphylococcus aureus
YFDGIPNMDIFKKCYKALIT

SEQ ID NO: 1652617 - protein, 23 aa, Staphylococcus aureus
YIEARTVFYQKFCSLEDGQASQR

SEQ ID NO: 1652618 - protein, 24 aa, Staphylococcus aureus
YIKLRKERTIHVSKELMSLYTDYL

SEQ ID NO: 1652619 - protein, 24 aa, Staphylococcus aureus
YRIERPRSQWELENSMNYIEIRSL

SEQ ID NO: 1652620 - protein, 23 aa, Staphylococcus aureus
YRPYLKLAEPILEKHNIYYGQWL

SEQ ID NO: 1652621 - protein, 18 aa, Staphylococcus aureus
YSEIPQAYQILGIGPVEL

SEQ ID NO: 1652622 - protein, 18 aa, Staphylococcus aureus
YSESVNWTDSEFLFDSNW

SEQ ID NO: 1652623 - protein, 18 aa, Staphylococcus aureus
YYFHGHIVPGWQGVKKTF

SEQ ID NO: 1652624 - protein, 21 aa, Staphylococcus aureus
ADLDMVICITEHIPVLDMVKV

SEQ ID NO: 1652625 - protein, 17 aa, Staphylococcus aureus
AEMKDSFTGKVVVIHQP

SEQ ID NO: 1652626 - protein, 17 aa, Staphylococcus aureus
AKYSYLIVEKGFAKRLQ

SEQ ID NO: 1652627 - protein, 17 aa, Staphylococcus aureus
ALIIGMGALGTHVAEGL

SEQ ID NO: 1652628 - protein, 25 aa, Staphylococcus aureus
ANKMKDGFKNKGYRLYFDSPTNQQF

SEQ ID NO: 1652629 - protein, 19 aa, Staphylococcus aureus
ANVIPKEFQALYDAQQSGL

SEQ ID NO: 1652630 - protein, 20 aa, Staphylococcus aureus
ARLTNIKGLEIPRVSYTLDD

SEQ ID NO: 1652631 - protein, 27 aa, Staphylococcus aureus
CYQLNVLQLIRLCRYFVDVLRQSANGR

SEQ ID NO: 1652632 - protein, 24 aa, Staphylococcus aureus
DDFERFMRKYSYHLSSSRLISGSS

SEQ ID NO: 1652633 - protein, 20 aa, Staphylococcus aureus
DDYQALAILPLWHHDDTYLF

SEQ ID NO: 1652634 - protein, 19 aa, Staphylococcus aureus
DEAPGIGMRFIQINDIKLA

SEQ ID NO: 1652635 - protein, 27 aa, Staphylococcus aureus
DFKVIFPDYHVIGISELIPDFDVEETG

SEQ ID NO: 1652636 - protein, 23 aa, Staphylococcus aureus
DFPTERKGVAGWNLYVEASNTGG

SEQ ID NO: 1652637 - protein, 26 aa, Staphylococcus aureus
DFSHYLKVRPGAFFLTGCGNESKGIT

SEQ ID NO: 1652638 - protein, 21 aa, Staphylococcus aureus
DMLHFKHIVASNMVQGISPID

SEQ ID NO: 1652639 - protein, 20 aa, Staphylococcus aureus
DPHFPKKLTLRDIVRANERG

SEQ ID NO: 1652640 - protein, 23 aa, Staphylococcus aureus
DPYFAGTKVKWILDNVEGAREKA

SEQ ID NO: 1652641 - protein, 25 aa, Staphylococcus aureus
DVKKGEYLFVLTAWYDQQRTLDSAF

SEQ ID NO: 1652642 - protein, 18 aa, Staphylococcus aureus
EALIDFIPNVTNANLKDV

SEQ ID NO: 1652643 - protein, 23 aa, Staphylococcus aureus
EKDFDLLFVKWIPREQNKEANQH

SEQ ID NO: 1652644 - protein, 19 aa, Staphylococcus aureus
EKNRYFKFNVKSYLRADSA

SEQ ID NO: 1652645 - protein, 28 aa, Staphylococcus aureus
ERVKNLWLRTELKYFYFYHLNNGIWNAK

SEQ ID NO: 1652646 - protein, 20 aa, Staphylococcus aureus
ESITLMGGGTFGNWTPTAEF

SEQ ID NO: 1652647 - protein, 19 aa, Staphylococcus aureus
ESLMRQFDFEAVDKQHITA

SEQ ID NO: 1652648 - protein, 22 aa, Staphylococcus aureus
ETSHAKTLFSTHYHELTTLDQA

SEQ ID NO: 1652649 - protein, 25 aa, Staphylococcus aureus
EWAACIYALEHARELNVQNALLYTD

SEQ ID NO: 1652650 - protein, 18 aa, Staphylococcus aureus
EYIKRFNSLASFNTNINI

SEQ ID NO: 1652651 - protein, 17 aa, Staphylococcus aureus
FDIPLVVRNDYLSHNGI

SEQ ID NO: 1652652 - protein, 22 aa, Staphylococcus aureus
FMLDAGLMFPEDEMLGIDIVIP

SEQ ID NO: 1652653 - protein, 24 aa, Staphylococcus aureus
GDAFIGAVISRILATDVLNLTQLF

SEQ ID NO: 1652654 - protein, 18 aa, Staphylococcus aureus
GDTVRPALQIIKTKPGVS

SEQ ID NO: 1652655 - protein, 25 aa, Staphylococcus aureus
GETIKFFGGKIIGGAVRKLGEFKNY

SEQ ID NO: 1652656 - protein, 20 aa, Staphylococcus aureus
GGAFESLAIEVGKDLTPMIR

SEQ ID NO: 1652657 - protein, 24 aa, Staphylococcus aureus
GGKLGSGQQWYSWIHINDLIQAIL

SEQ ID NO: 1652658 - protein, 17 aa, Staphylococcus aureus
GGSMLLLAKDLPTAKNI

SEQ ID NO: 1652659 - protein, 25 aa, Staphylococcus aureus
GNLKVSFDYIDWIKLGFGPSGKENY

SEQ ID NO: 1652660 - protein, 26 aa, Staphylococcus aureus
GRIGYEHIGFSGAGAMDQFSFKVAQS

SEQ ID NO: 1652661 - protein, 21 aa, Staphylococcus aureus
GSDKRMALVKGYINEYKLTTV

SEQ ID NO: 1652662 - protein, 18 aa, Staphylococcus aureus
GTDTKIVHDFAYGAFGFD

SEQ ID NO: 1652663 - protein, 21 aa, Staphylococcus aureus
HHMRSGLTLLDSVKIVSTEVK

SEQ ID NO: 1652664 - protein, 19 aa, Staphylococcus aureus
HPILTKKAQAVKTFDDSLK

SEQ ID NO: 1652665 - protein, 18 aa, Staphylococcus aureus
HPSAIELSKNPALRNRWV

SEQ ID NO: 1652666 - protein, 17 aa, Staphylococcus aureus
IAEMLKERVNQDEQLIV

SEQ ID NO: 1652667 - protein, 17 aa, Staphylococcus aureus
IAQRLKEFFNFLDMKFK

SEQ ID NO: 1652668 - protein, 17 aa, Staphylococcus aureus
IDTMFAKHNVIYGDNPL

SEQ ID NO: 1652669 - protein, 22 aa, Staphylococcus aureus
IIHCPQCGAPMAASNTTNTLKD

SEQ ID NO: 1652670 - protein, 22 aa, Staphylococcus aureus
IKTPLLTCASWSTQGLHNRGSF

SEQ ID NO: 1652671 - protein, 22 aa, Staphylococcus aureus
INKDIAWWSIVQSYPLLMRQEK

SEQ ID NO: 1652672 - protein, 20 aa, Staphylococcus aureus
IPDQAFCKGTVRTFDSDIQN

SEQ ID NO: 1652673 - protein, 17 aa, Staphylococcus aureus
IPFDKVVKMDVDRFATY

SEQ ID NO: 1652674 - protein, 18 aa, Staphylococcus aureus
IRKCPHPSAIELSKNPAL

SEQ ID NO: 1652675 - protein, 30 aa, Staphylococcus aureus
ISILEGLFSTLLRLEWDDVPSKILIYSEDY

SEQ ID NO: 1652676 - protein, 23 aa, Staphylococcus aureus
ITAEEFDLISGLGKGEIKIPRYF

SEQ ID NO: 1652677 - protein, 17 aa, Staphylococcus aureus
KAGEAINTVPSNGYLEG

SEQ ID NO: 1652678 - protein, 17 aa, Staphylococcus aureus
KAILTAVNIMHEKVLLE

SEQ ID NO: 1652679 - protein, 18 aa, Staphylococcus aureus
KGDIIGYVEAMKVLNEVT

SEQ ID NO: 1652680 - protein, 24 aa, Staphylococcus aureus
KISEFPRIVTLKDLNKIEVLDTLL

SEQ ID NO: 1652681 - protein, 19 aa, Staphylococcus aureus
KIYGSPIIECNERMIRLSD

SEQ ID NO: 1652682 - protein, 19 aa, Staphylococcus aureus
KLKNLGMLTEPGLYYLYTD

SEQ ID NO: 1652683 - protein, 17 aa, Staphylococcus aureus
KPINEMVKHLSLIAHTF

SEQ ID NO: 1652684 - protein, 19 aa, Staphylococcus aureus
KQIIQRLGVNPENLHIIVT

SEQ ID NO: 1652685 - protein, 19 aa, Staphylococcus aureus
KQILKNEVATISWVTTDQL

SEQ ID NO: 1652686 - protein, 17 aa, Staphylococcus aureus
KRYGKHVAVDNISFNIN

SEQ ID NO: 1652687 - protein, 23 aa, Staphylococcus aureus
KSKREALEMAERVDLDLVVVAPN

SEQ ID NO: 1652688 - protein, 21 aa, Staphylococcus aureus
KSTLLLQICASLSQKKKVLYI

SEQ ID NO: 1652689 - protein, 25 aa, Staphylococcus aureus
KVGPFAQLRPGAQLGADVKVGNFVE

SEQ ID NO: 1652690 - protein, 26 aa, Staphylococcus aureus
KVGPFAQLRPGAQLGADVKVGNFVEI

SEQ ID NO: 1652691 - protein, 24 aa, Staphylococcus aureus
LALESQHAGLSWLTILKKKEAYEE

SEQ ID NO: 1652692 - protein, 25 aa, Staphylococcus aureus
LASELKKWNYGVIVVEQFDDILSIF

SEQ ID NO: 1652693 - protein, 18 aa, Staphylococcus aureus
LASIELLRANMMTTNGGG

SEQ ID NO: 1652694 - protein, 20 aa, Staphylococcus aureus
LDDYRIIKSALYGNQSRTTD

SEQ ID NO: 1652695 - protein, 19 aa, Staphylococcus aureus
LFDSNWMFENGIPLDFTPK

SEQ ID NO: 1652696 - protein, 21 aa, Staphylococcus aureus
LHSKTSITFILKDVVIEEDNK

SEQ ID NO: 1652697 - protein, 17 aa, Staphylococcus aureus
LKHVNFDLKDLHVVIGP

SEQ ID NO: 1652698 - protein, 20 aa, Staphylococcus aureus
LKPTQLVGGYAQISYHFNYY

SEQ ID NO: 1652699 - protein, 17 aa, Staphylococcus aureus
LNERPESLFNYFKQLFA

SEQ ID NO: 1652700 - protein, 17 aa, Staphylococcus aureus
LNGYFVIDEAYLDYGTA

SEQ ID NO: 1652701 - protein, 17 aa, Staphylococcus aureus
LPLEEIIELTKFDSSQL

SEQ ID NO: 1652702 - protein, 24 aa, Staphylococcus aureus
LQPDEFYFLPSFMSPLKKHHDFID

SEQ ID NO: 1652703 - protein, 17 aa, Staphylococcus aureus
LQPLLIYITTAGYQLDG

SEQ ID NO: 1652704 - protein, 17 aa, Staphylococcus aureus
LRLAKRVVKEKWSVRYL

SEQ ID NO: 1652705 - protein, 28 aa, Staphylococcus aureus
LTEARTLKFFKYFYTHRGPVMDYTNQSL

SEQ ID NO: 1652706 - protein, 25 aa, Staphylococcus aureus
NAMLEKLRFSKMFFSSNAVNKGAVM

SEQ ID NO: 1652707 - protein, 20 aa, Staphylococcus aureus
NDVYGSWRALEELKENGKIK

SEQ ID NO: 1652708 - protein, 22 aa, Staphylococcus aureus
NIDKGKHVLEMIFLGEDPKNRI

SEQ ID NO: 1652709 - protein, 26 aa, Staphylococcus aureus
NKMLKRWNSSYVDRGFIFTTKKGNPL

SEQ ID NO: 1652710 - protein, 23 aa, Staphylococcus aureus
NLIDYDFGIDFAERAIKNEDIVN

SEQ ID NO: 1652711 - protein, 25 aa, Staphylococcus aureus
NSFVFDLLICENFIIYHGEKYTIKQ

SEQ ID NO: 1652712 - protein, 20 aa, Staphylococcus aureus
PAKGTTYKIYFGFADRHAYE

SEQ ID NO: 1652713 - protein, 18 aa, Staphylococcus aureus
PGLNRFAFTLSNADNAYS

SEQ ID NO: 1652714 - protein, 18 aa, Staphylococcus aureus
PKQIEDFNSNIEYNQTHP

SEQ ID NO: 1652715 - protein, 19 aa, Staphylococcus aureus
PKSGLEHMSFYNGSVKEVE

SEQ ID NO: 1652716 - protein, 18 aa, Staphylococcus aureus
PLSNMAPTIVMHHGKPIL

SEQ ID NO: 1652717 - protein, 20 aa, Staphylococcus aureus
PMRPDKLKNLGMLTEPGLYY

SEQ ID NO: 1652718 - protein, 17 aa, Staphylococcus aureus
PNFKDFRHSFSQKAPEG

SEQ ID NO: 1652719 - protein, 24 aa, Staphylococcus aureus
PNFSTQLLDRFLVIAHSYQLNARI

SEQ ID NO: 1652720 - protein, 19 aa, Staphylococcus aureus
PQQYFTLSLTVKGFDFQLE

SEQ ID NO: 1652721 - protein, 23 aa, Staphylococcus aureus
PRAKPRFIDEFVLEQLNSHLDKL

SEQ ID NO: 1652722 - protein, 23 aa, Staphylococcus aureus
QLKDVKEKIAFFNSDEVMGEQAF

SEQ ID NO: 1652723 - protein, 24 aa, Staphylococcus aureus
QLLKEIPHRSSFSYILMDKSLNHA

SEQ ID NO: 1652724 - protein, 23 aa, Staphylococcus aureus
QNLQRALGLLLMVEMDIKMLKKV

SEQ ID NO: 1652725 - protein, 23 aa, Staphylococcus aureus
QRLKEFFNFLDMKFKQVQRVHQL

SEQ ID NO: 1652726 - protein, 17 aa, Staphylococcus aureus
QSLGMIGQQLKNKNDEL

SEQ ID NO: 1652727 - protein, 25 aa, Staphylococcus aureus
QYTRPREFKGLTVPDVLLSGNHANI

SEQ ID NO: 1652728 - protein, 19 aa, Staphylococcus aureus
RGLQKIGVETGGELKTAYA

SEQ ID NO: 1652729 - protein, 19 aa, Staphylococcus aureus
RLYQTVKYWPKGTVFVSVV

SEQ ID NO: 1652730 - protein, 30 aa, Staphylococcus aureus
RPSIEALNYYATRFMLTVPFENIDVQNSKP

SEQ ID NO: 1652731 - protein, 17 aa, Staphylococcus aureus
RRYKDNQLRGIESNFED

SEQ ID NO: 1652732 - protein, 31 aa, Staphylococcus aureus
RTLSKAFGIAGLRLGVLISTAGTIKHIQKIE

SEQ ID NO: 1652733 - protein, 22 aa, Staphylococcus aureus
RVTLGYPLVRGAIRDGLINLIK

SEQ ID NO: 1652734 - protein, 25 aa, Staphylococcus aureus
RWNRSHHQLIFFGRYHCLARKPKCD

SEQ ID NO: 1652735 - protein, 18 aa, Staphylococcus aureus
SAEEQALFDKSVKTLEDT

SEQ ID NO: 1652736 - protein, 21 aa, Staphylococcus aureus
SELCTLKKGCLLEDKDGDFFL

SEQ ID NO: 1652737 - protein, 25 aa, Staphylococcus aureus
SIAYKVMLDIFYPELITIGSNSVIG

SEQ ID NO: 1652738 - protein, 34 aa, Staphylococcus aureus
SLESSFNIARKMGYFDIPKDLLIPITEVDNYPKN

SEQ ID NO: 1652739 - protein, 23 aa, Staphylococcus aureus
SLKANGYGLIIRKLIQHDINLIA

SEQ ID NO: 1652740 - protein, 17 aa, Staphylococcus aureus
SLRRGAQILSKYPNLEI

SEQ ID NO: 1652741 - protein, 23 aa, Staphylococcus aureus
SYQPSRCFALPVIQKGHIFIKRV

SEQ ID NO: 1652742 - protein, 25 aa, Staphylococcus aureus
TFHALLDEWLEYHIKTSGSKLTTLN

SEQ ID NO: 1652743 - protein, 17 aa, Staphylococcus aureus
TNKRSSGKIAFLQLRDG

SEQ ID NO: 1652744 - protein, 17 aa, Staphylococcus aureus
TYFKQLVKRYCKLRLNV

SEQ ID NO: 1652745 - protein, 24 aa, Staphylococcus aureus
VDHFKIVPLLIFSAMHYLKDIPNI

SEQ ID NO: 1652746 - protein, 26 aa, Staphylococcus aureus
VIDLNLFEHWFRSVFNRRHPYYVITS

SEQ ID NO: 1652747 - protein, 30 aa, Staphylococcus aureus
VLDACSAPGGKACHIAEVLMPEGQVDASDI

SEQ ID NO: 1652748 - protein, 18 aa, Staphylococcus aureus
VNMMLAKAMGLKNISIIN

SEQ ID NO: 1652749 - protein, 17 aa, Staphylococcus aureus
VTDALAIASCINAHPYV

SEQ ID NO: 1652750 - protein, 23 aa, Staphylococcus aureus
YAVKGGIADKVWTDYGGGNSIQI

SEQ ID NO: 1652751 - protein, 26 aa, Staphylococcus aureus
YKNTEKWWNGLKSWWSNFREDQKKKS

SEQ ID NO: 1652752 - protein, 19 aa, Staphylococcus aureus
YNISTDIVKRITFESQAKY

SEQ ID NO: 1652753 - protein, 18 aa, Staphylococcus aureus
YSLDPVWNMSDLKKKLKI

SEQ ID NO: 1652754 - protein, 18 aa, Staphylococcus aureus
YVQHPGKLVNKVMSGLNI

SEQ ID NO: 1652755 - protein, 24 aa, Staphylococcus aureus
AFDKYPIEAVFGIHVNPFADEGIA

SEQ ID NO: 1652756 - protein, 27 aa, Staphylococcus aureus
AGDKIKDGASWLGDKIGDVWDYVQHPG

SEQ ID NO: 1652757 - protein, 18 aa, Staphylococcus aureus
ALIIGMGALGTHVAEGLV

SEQ ID NO: 1652758 - protein, 20 aa, Staphylococcus aureus
ALKQVPSCEFFPVEAVKTNI

SEQ ID NO: 1652759 - protein, 21 aa, Staphylococcus aureus
ANSTGKWFGKAWQSVKSTTGS

SEQ ID NO: 1652760 - protein, 26 aa, Staphylococcus aureus
ARTVNVAKWFVGDYMTSLDMQGFSIT

SEQ ID NO: 1652761 - protein, 21 aa, Staphylococcus aureus
DCTFIAVKLPYGVQKDADEVE

SEQ ID NO: 1652762 - protein, 19 aa, Staphylococcus aureus
DCTHFCTSKQFLPQHEEQL

SEQ ID NO: 1652763 - protein, 25 aa, Staphylococcus aureus
DIQQGFGRTGTWSSVSHFNFTPDLI

SEQ ID NO: 1652764 - protein, 17 aa, Staphylococcus aureus
DSSILKEKQFFTIENLV

SEQ ID NO: 1652765 - protein, 18 aa, Staphylococcus aureus
DSSILKEKQFFTIENLVK

SEQ ID NO: 1652766 - protein, 23 aa, Staphylococcus aureus
EEKMKLYSCFCKIYNPSMKDREI

SEQ ID NO: 1652767 - protein, 18 aa, Staphylococcus aureus
EGKRRAGQVMNRSMLTLD

SEQ ID NO: 1652768 - protein, 22 aa, Staphylococcus aureus
ENIVFWSGWNKITMFALIELVK

SEQ ID NO: 1652769 - protein, 35 aa, Staphylococcus aureus
ENLPENFSQVFRPKAFKYSNGEIVFNEDYSEEKDD

SEQ ID NO: 1652770 - protein, 18 aa, Staphylococcus aureus
ERFKHVEELKRMGANIEV

SEQ ID NO: 1652771 - protein, 20 aa, Staphylococcus aureus
ETVEIQYDVALFSYNKLLEI

SEQ ID NO: 1652772 - protein, 29 aa, Staphylococcus aureus
EVIAACLLTAVPVMKVFKYFYSNRGPVID

SEQ ID NO: 1652773 - protein, 23 aa, Staphylococcus aureus
FDKYPIEAVFGIHVNPFADEGIA

SEQ ID NO: 1652774 - protein, 18 aa, Staphylococcus aureus
FEEGHSYSHYLLIEQAIN

SEQ ID NO: 1652775 - protein, 20 aa, Staphylococcus aureus
FIHAIDRIYINTSKGLFPES

SEQ ID NO: 1652776 - protein, 25 aa, Staphylococcus aureus
FKTRRDRFEAMLAKADLPFVHAKGG

SEQ ID NO: 1652777 - protein, 19 aa, Staphylococcus aureus
FLYERDMDGYYLIVQQERD

SEQ ID NO: 1652778 - protein, 25 aa, Staphylococcus aureus
FSHYLKVRPGAFFLTGCGNESKGIT

SEQ ID NO: 1652779 - protein, 24 aa, Staphylococcus aureus
GDMKGAIKYAVKFYNYPNEYLLTN

SEQ ID NO: 1652780 - protein, 34 aa, Staphylococcus aureus
GDSKPDWKIFQAIANRLGFDWNYKHPSEIMDEVA

SEQ ID NO: 1652781 - protein, 21 aa, Staphylococcus aureus
GRNQYKAIVDYVADSAKQFGI

SEQ ID NO: 1652782 - protein, 21 aa, Staphylococcus aureus
GSCSWKVFVKNGVITWENQQT

SEQ ID NO: 1652783 - protein, 17 aa, Staphylococcus aureus
HLMVSKVKGSFDQFDVA

SEQ ID NO: 1652784 - protein, 19 aa, Staphylococcus aureus
HVANFSFNIVDSGIESAVA

SEQ ID NO: 1652785 - protein, 30 aa, Staphylococcus aureus
IEAIMAQGLKCCLNASIISRELLTSLHQQL

SEQ ID NO: 1652786 - protein, 21 aa, Staphylococcus aureus
IGGMPFLKSFKDIPLDENNVP

SEQ ID NO: 1652787 - protein, 22 aa, Staphylococcus aureus
IKGGTDALVLRYLTPHGKWNIH

SEQ ID NO: 1652788 - protein, 23 aa, Staphylococcus aureus
IKYQWAPKYSKEFFILFMNIMYS

SEQ ID NO: 1652789 - protein, 17 aa, Staphylococcus aureus
INQDLWDKVQMRKKQVS

SEQ ID NO: 1652790 - protein, 23 aa, Staphylococcus aureus
ITMYPHLDGVLSLDLTTVLILNQ

SEQ ID NO: 1652791 - protein, 20 aa, Staphylococcus aureus
KAISKFSIEGKVINFNSIAK

SEQ ID NO: 1652792 - protein, 18 aa, Staphylococcus aureus
KCLEDFKLVVSTSQYEGQ

SEQ ID NO: 1652793 - protein, 21 aa, Staphylococcus aureus
KDELKTAFLGEVLGQSYLNTQ

SEQ ID NO: 1652794 - protein, 18 aa, Staphylococcus aureus
KEAVLPIFDQIFTRIGAA

SEQ ID NO: 1652795 - protein, 19 aa, Staphylococcus aureus
KEAVLPIFDQIFTRIGAAD

SEQ ID NO: 1652796 - protein, 23 aa, Staphylococcus aureus
KEGEAEFFKKVFVGYTDSEDHSE

SEQ ID NO: 1652797 - protein, 26 aa, Staphylococcus aureus
KELVDLFNKRYDIIIVDTPPVNTVTD

SEQ ID NO: 1652798 - protein, 17 aa, Staphylococcus aureus
KGKQLFMPIRVAVTGQM

SEQ ID NO: 1652799 - protein, 23 aa, Staphylococcus aureus
KGMVRREVVRIVTPGTVMEQGGV

SEQ ID NO: 1652800 - protein, 17 aa, Staphylococcus aureus
KGPFRFAALSGDPKDIE

SEQ ID NO: 1652801 - protein, 19 aa, Staphylococcus aureus
KGSFEIEGVSLFELQANQL

SEQ ID NO: 1652802 - protein, 27 aa, Staphylococcus aureus
KHREISPRLRLVIPLKRNVNADEYEAI

SEQ ID NO: 1652803 - protein, 21 aa, Staphylococcus aureus
KSRVATLKKSVLFEKMKLSQD

SEQ ID NO: 1652804 - protein, 23 aa, Staphylococcus aureus
KSSRTSLTISNDVYFDLGSQRGS

SEQ ID NO: 1652805 - protein, 17 aa, Staphylococcus aureus
KTLKRRVMELEKENKKL

SEQ ID NO: 1652806 - protein, 20 aa, Staphylococcus aureus
KVFKTAYDRVEWFRNGINGL

SEQ ID NO: 1652807 - protein, 19 aa, Staphylococcus aureus
KYGEKYYAIIGAQNNDQQG

SEQ ID NO: 1652808 - protein, 17 aa, Staphylococcus aureus
LAARTVNVAKWFVGDYM

SEQ ID NO: 1652809 - protein, 19 aa, Staphylococcus aureus
LESSFSRYRERYFKPTHQV

SEQ ID NO: 1652810 - protein, 23 aa, Staphylococcus aureus
LGKEAYSIISQGRVDEILNAKPI

SEQ ID NO: 1652811 - protein, 19 aa, Staphylococcus aureus
LHKVETLRANWIQTTGGSL

SEQ ID NO: 1652812 - protein, 21 aa, Staphylococcus aureus
LKKLGGAWFSDSLVSVTGKEA

SEQ ID NO: 1652813 - protein, 23 aa, Staphylococcus aureus
LLAKGRLTGIQFLELFTDNLYFN

SEQ ID NO: 1652814 - protein, 22 aa, Staphylococcus aureus
LMQADVIFIGFPIFQASIPGAL

SEQ ID NO: 1652815 - protein, 18 aa, Staphylococcus aureus
LNASGGFELVNYTTGDIF

SEQ ID NO: 1652816 - protein, 19 aa, Staphylococcus aureus
LNTFFKAYLQQKGFNPELM

SEQ ID NO: 1652817 - protein, 23 aa, Staphylococcus aureus
LRLAKRVVKEKWSVRYLENHVNE

SEQ ID NO: 1652818 - protein, 22 aa, Staphylococcus aureus
LRQRICDAAIQLMENIKYVNAG

SEQ ID NO: 1652819 - protein, 23 aa, Staphylococcus aureus
LVICGLKSAYILKHTSEAFKEDT

SEQ ID NO: 1652820 - protein, 20 aa, Staphylococcus aureus
MKTGNVYYRPGYVQTGRAFF

SEQ ID NO: 1652821 - protein, 19 aa, Staphylococcus aureus
MVSPFIIDAHASLLGIGSE

SEQ ID NO: 1652822 - protein, 19 aa, Staphylococcus aureus
NDSKDFFLHHGFTDVEAKN

SEQ ID NO: 1652823 - protein, 20 aa, Staphylococcus aureus
NDSKDFFLHHGFTDVEAKNI

SEQ ID NO: 1652824 - protein, 26 aa, Staphylococcus aureus
NLQQGGHIIVWFGLTWSLELYQQANA

SEQ ID NO: 1652825 - protein, 23 aa, Staphylococcus aureus
NLTEPYTNYSILLVSGTYPGGVI

SEQ ID NO: 1652826 - protein, 20 aa, Staphylococcus aureus
NPNYCGRVNNQYGQFDNMFP

SEQ ID NO: 1652827 - protein, 24 aa, Staphylococcus aureus
NRSRNSLREWLPWVDATEQPSDTR

SEQ ID NO: 1652828 - protein, 25 aa, Staphylococcus aureus
NSAKLAILPFKLLKNGLGLAAKSLF

SEQ ID NO: 1652829 - protein, 17 aa, Staphylococcus aureus
NWGNYKLVFNTRNGANL

SEQ ID NO: 1652830 - protein, 20 aa, Staphylococcus aureus
PEGEYSKIYLFSSNLEKITA

SEQ ID NO: 1652831 - protein, 18 aa, Staphylococcus aureus
PLLARVTGAGCLLGGVIA

SEQ ID NO: 1652832 - protein, 17 aa, Staphylococcus aureus
PMTALNPVFTIKNQLVE

SEQ ID NO: 1652833 - protein, 20 aa, Staphylococcus aureus
PNGYCRLPVVAGGCPHANAC

SEQ ID NO: 1652834 - protein, 19 aa, Staphylococcus aureus
PPQGCPFHTRCPIAQDMCK

SEQ ID NO: 1652835 - protein, 21 aa, Staphylococcus aureus
QASQKLGVHYVQLDVTSDYSV

SEQ ID NO: 1652836 - protein, 17 aa, Staphylococcus aureus
QGQPILLFYNFKHDKER

SEQ ID NO: 1652837 - protein, 22 aa, Staphylococcus aureus
QQRRIGYLFQDYQLFPNMTVYK

SEQ ID NO: 1652838 - protein, 17 aa, Staphylococcus aureus
REKLEIMISDYNKKFET

SEQ ID NO: 1652839 - protein, 17 aa, Staphylococcus aureus
RHTMSFDNAHFFAQLRH

SEQ ID NO: 1652840 - protein, 24 aa, Staphylococcus aureus
RINNELEDIFAIMLENSYPEHQRD

SEQ ID NO: 1652841 - protein, 18 aa, Staphylococcus aureus
RKAILTAVNIMHEKVLLE

SEQ ID NO: 1652842 - protein, 17 aa, Staphylococcus aureus
RLGEFKSIDVFKQAKGR

SEQ ID NO: 1652843 - protein, 17 aa, Staphylococcus aureus
RRIMMALQHVAQHKNIA

SEQ ID NO: 1652844 - protein, 18 aa, Staphylococcus aureus
SILNLVMLCGCQGVNGGG

SEQ ID NO: 1652845 - protein, 19 aa, Staphylococcus aureus
SITLMGGGTFGNWTPTAEF

SEQ ID NO: 1652846 - protein, 21 aa, Staphylococcus aureus
SQEIEKLILFLGDRPTINKQD

SEQ ID NO: 1652847 - protein, 20 aa, Staphylococcus aureus
SSLEFQIKHLMVSKVKGSFD

SEQ ID NO: 1652848 - protein, 17 aa, Staphylococcus aureus
TEGPGLIGALLIGVNAA

SEQ ID NO: 1652849 - protein, 20 aa, Staphylococcus aureus
TFEYRDARNYLSYLYSNHLK

SEQ ID NO: 1652850 - protein, 24 aa, Staphylococcus aureus
TKGMVRREVVRIVTPGTVMEQGGV

SEQ ID NO: 1652851 - protein, 17 aa, Staphylococcus aureus
TTYPKGTYQVAWEENGK

SEQ ID NO: 1652852 - protein, 30 aa, Staphylococcus aureus
VNGFDFKLFILKGHMGISIQVKDMNNVPIK

SEQ ID NO: 1652853 - protein, 18 aa, Staphylococcus aureus
VRAGKLFGIPVSGTHAHA

SEQ ID NO: 1652854 - protein, 20 aa, Staphylococcus aureus
WSKGEIEAVPGRTMPNFAIV

SEQ ID NO: 1652855 - protein, 18 aa, Staphylococcus aureus
WYPQPAPADHPWRTMPRN

SEQ ID NO: 1652856 - protein, 24 aa, Staphylococcus aureus
YIEARTVFYQKFCSLEDGHASQRI

SEQ ID NO: 1652857 - protein, 26 aa, Staphylococcus aureus
YKQIDYEFLYLLSMDKLFGNKRNRLT

SEQ ID NO: 1652858 - protein, 18 aa, Staphylococcus aureus
YLSEEYLIQIDVESSNNQ

SEQ ID NO: 1652859 - protein, 21 aa, Staphylococcus aureus
YYPEYNIAVSWQRLREGKTIK

SEQ ID NO: 1652860 - protein, 23 aa, Staphylococcus aureus
YYQWKMKKEHIVPISKEVALLIK

SEQ ID NO: 1652861 - protein, 17 aa, Staphylococcus aureus
ADIPAIVQFNNYIGIQF

SEQ ID NO: 1652862 - protein, 18 aa, Staphylococcus aureus
AEKARKARKKEVDKQYED

SEQ ID NO: 1652863 - protein, 24 aa, Staphylococcus aureus
ALLAKGRLTGIQFLELFTDNLYFN

SEQ ID NO: 1652864 - protein, 24 aa, Staphylococcus aureus
ANKMKDGFINKGYRLYFDSPTNQQ

SEQ ID NO: 1652865 - protein, 19 aa, Staphylococcus aureus
APHAFKNLFTGDNFGKQVI

SEQ ID NO: 1652866 - protein, 24 aa, Staphylococcus aureus
ASELKKWNYGVIVVEQFDDILSIF

SEQ ID NO: 1652867 - protein, 22 aa, Staphylococcus aureus
DADLDMVICITEHIPVLDMVKV

SEQ ID NO: 1652868 - protein, 22 aa, Staphylococcus aureus
DDDGGHLIARMFGGSKDIDNLV

SEQ ID NO: 1652869 - protein, 19 aa, Staphylococcus aureus
DIAEAFQIQCAREINNQEI

SEQ ID NO: 1652870 - protein, 27 aa, Staphylococcus aureus
DILCCYRLNRLHRNLKNALKLIKLCQT

SEQ ID NO: 1652871 - protein, 19 aa, Staphylococcus aureus
DKAMLKIACINLNEYQDKL

SEQ ID NO: 1652872 - protein, 20 aa, Staphylococcus aureus
DKLYAKFGFMPTEPDSGGMY

SEQ ID NO: 1652873 - protein, 18 aa, Staphylococcus aureus
DPNFKDFRHSFSQKAPEG

SEQ ID NO: 1652874 - protein, 22 aa, Staphylococcus aureus
DVLQRSNYALSFSKMTFPHQMM

SEQ ID NO: 1652875 - protein, 23 aa, Staphylococcus aureus
DVLQRSNYALSFSKMTFPHQMMR

SEQ ID NO: 1652876 - protein, 18 aa, Staphylococcus aureus
DVYWCTADPGWVTGTSYG

SEQ ID NO: 1652877 - protein, 18 aa, Staphylococcus aureus
DYIRASINLFPFNTNGNK

SEQ ID NO: 1652878 - protein, 18 aa, Staphylococcus aureus
EAFREFIHQYPLAVVHVM

SEQ ID NO: 1652879 - protein, 19 aa, Staphylococcus aureus
EAFREFIHQYPLAVVHVMR

SEQ ID NO: 1652880 - protein, 23 aa, Staphylococcus aureus
EAYEALQGVWLMEMAELAATRKA

SEQ ID NO: 1652881 - protein, 20 aa, Staphylococcus aureus
EEFDLISGLGKGEIKIPRYF

SEQ ID NO: 1652882 - protein, 24 aa, Staphylococcus aureus
EIENFKFFVQYGDFKDINDYKDGD

SEQ ID NO: 1652883 - protein, 19 aa, Staphylococcus aureus
EKYVNEIIMLLRTIPTSKL

SEQ ID NO: 1652884 - protein, 18 aa, Staphylococcus aureus
ELDGKMSYMIAVTGDNSA

SEQ ID NO: 1652885 - protein, 20 aa, Staphylococcus aureus
ELGPKGIRVNCVAPGPFWSP

SEQ ID NO: 1652886 - protein, 20 aa, Staphylococcus aureus
EPFFMSLNEMFAMKEYKQKY

SEQ ID NO: 1652887 - protein, 18 aa, Staphylococcus aureus
EPMTALNPVFTIKNQLVE

SEQ ID NO: 1652888 - protein, 19 aa, Staphylococcus aureus
ESISWLINYVKQYPHTVLF

SEQ ID NO: 1652889 - protein, 21 aa, Staphylococcus aureus
ETSHAKTLFSTHYHELTTLDQ

SEQ ID NO: 1652890 - protein, 20 aa, Staphylococcus aureus
EVPEYRRPASDRKISIRGAR

SEQ ID NO: 1652891 - protein, 24 aa, Staphylococcus aureus
EYPLFCTAIKYIIARDYESRGYSN

SEQ ID NO: 1652892 - protein, 26 aa, Staphylococcus aureus
FAMKEYKQKYLILRIFNVSGKEPQFY

SEQ ID NO: 1652893 - protein, 19 aa, Staphylococcus aureus
FDADPGWLGPKNMSSFLST

SEQ ID NO: 1652894 - protein, 17 aa, Staphylococcus aureus
FDLNCYLTLLDVLDSHN

SEQ ID NO: 1652895 - protein, 17 aa, Staphylococcus aureus
FGTGDVIIFSGGVLEII

SEQ ID NO: 1652896 - protein, 22 aa, Staphylococcus aureus
FVAYSHRAKERFKEVTTPKFYL

SEQ ID NO: 1652897 - protein, 19 aa, Staphylococcus aureus
FYLITDAMRAKGMPEGEYD

SEQ ID NO: 1652898 - protein, 17 aa, Staphylococcus aureus
GEAIAWHLSKILELEDS

SEQ ID NO: 1652899 - protein, 21 aa, Staphylococcus aureus
GEPMFSKKSIRNVVKPLLKYA

SEQ ID NO: 1652900 - protein, 19 aa, Staphylococcus aureus
GIDNHFQLLLYISENHCQL

SEQ ID NO: 1652901 - protein, 17 aa, Staphylococcus aureus
GKRKANEIGTLMHTVMQ

SEQ ID NO: 1652902 - protein, 27 aa, Staphylococcus aureus
GKSYFFPSKLAFVLFFIKQLEITEHHF

SEQ ID NO: 1652903 - protein, 23 aa, Staphylococcus aureus
GLGAALKTSADFEGQMSRVGAIA

SEQ ID NO: 1652904 - protein, 18 aa, Staphylococcus aureus
HELSELYFSLKYEGLTQF

SEQ ID NO: 1652905 - protein, 18 aa, Staphylococcus aureus
HHVLPGFIDIHIHGGYGQ

SEQ ID NO: 1652906 - protein, 23 aa, Staphylococcus aureus
HIMRQKRVDTIFVVDSNNHLLGF

SEQ ID NO: 1652907 - protein, 19 aa, Staphylococcus aureus
IDFITGHSLGGRDAVVLGM

SEQ ID NO: 1652908 - protein, 18 aa, Staphylococcus aureus
IEDLRIISCHIGNGASIA

SEQ ID NO: 1652909 - protein, 19 aa, Staphylococcus aureus
IEDLRIISCHIGNGASIAA

SEQ ID NO: 1652910 - protein, 26 aa, Staphylococcus aureus
IEKSRLKALYLSVIDRIDIKKDGNHK

SEQ ID NO: 1652911 - protein, 17 aa, Staphylococcus aureus
IGKKLLDKVIMTCKEQN

SEQ ID NO: 1652912 - protein, 21 aa, Staphylococcus aureus
IHEFKDYKLISVIKNSRAARL

SEQ ID NO: 1652913 - protein, 21 aa, Staphylococcus aureus
IMASHYLFEYIHPFYDGNGRV

SEQ ID NO: 1652914 - protein, 23 aa, Staphylococcus aureus
INKKIKMCEFQIESMYHMSASTT

SEQ ID NO: 1652915 - protein, 18 aa, Staphylococcus aureus
IPKDLRHMHGFGSHTYSM

SEQ ID NO: 1652916 - protein, 18 aa, Staphylococcus aureus
ITAEEFDLISGLGKGEIK

SEQ ID NO: 1652917 - protein, 27 aa, Staphylococcus aureus
KAADIFRSVGIDFCCGGQVSIEAASLE

SEQ ID NO: 1652918 - protein, 21 aa, Staphylococcus aureus
KGGTDALVLRYLTPHGKWNIH

SEQ ID NO: 1652919 - protein, 19 aa, Staphylococcus aureus
KKRMIDGGFTRSTHVPVLF

SEQ ID NO: 1652920 - protein, 24 aa, Staphylococcus aureus
KMVKEAGYELNVWTVNKPARANQL

SEQ ID NO: 1652921 - protein, 21 aa, Staphylococcus aureus
KPHDEILVSFDLYGGTFRLFE

SEQ ID NO: 1652922 - protein, 22 aa, Staphylococcus aureus
KPRGLFRKKKFSPVVGDIVEFE

SEQ ID NO: 1652923 - protein, 17 aa, Staphylococcus aureus
KTEFEVVVVDDCSTDQT

SEQ ID NO: 1652924 - protein, 28 aa, Staphylococcus aureus
LAARTVNVAKWFVGDYMTSLDMQGFSIT

SEQ ID NO: 1652925 - protein, 22 aa, Staphylococcus aureus
LEDLKKFLELFNELASKVTKTS

SEQ ID NO: 1652926 - protein, 17 aa, Staphylococcus aureus
LESIYTLALAKSHRTSN

SEQ ID NO: 1652927 - protein, 22 aa, Staphylococcus aureus
LGKEAYSIISQGRVDEILNAKP

SEQ ID NO: 1652928 - protein, 22 aa, Staphylococcus aureus
LKANGYGLIIRKLIQHDINLIA

SEQ ID NO: 1652929 - protein, 21 aa, Staphylococcus aureus
LKKKLVDKVKSWFEDFGGGGD

SEQ ID NO: 1652930 - protein, 18 aa, Staphylococcus aureus
LKSDTNVISIEGGKYDEN

SEQ ID NO: 1652931 - protein, 22 aa, Staphylococcus aureus
LNANLKSIEQVRAFEKQQLESK

SEQ ID NO: 1652932 - protein, 25 aa, Staphylococcus aureus
LRSYLESMSQDFNVGGFFNKKKKKL

SEQ ID NO: 1652933 - protein, 18 aa, Staphylococcus aureus
LSLYPTKNLEDFYDKEGF

SEQ ID NO: 1652934 - protein, 20 aa, Staphylococcus aureus
MEELAALGFNAKQTMEAMPG

SEQ ID NO: 1652935 - protein, 22 aa, Staphylococcus aureus
MNVSLKAIMKRVGHVDEKTTIR

SEQ ID NO: 1652936 - protein, 17 aa, Staphylococcus aureus
MQLIDAIANYNAVISDE

SEQ ID NO: 1652937 - protein, 24 aa, Staphylococcus aureus
NIAVPLDLPALFKGYYKEPERTAK

SEQ ID NO: 1652938 - protein, 17 aa, Staphylococcus aureus
NIIKLAIDQNIPYTVLR

SEQ ID NO: 1652939 - protein, 25 aa, Staphylococcus aureus
NIQVWKKPSSFVIKPLPKNKYPDSI

SEQ ID NO: 1652940 - protein, 19 aa, Staphylococcus aureus
NNGYGYIKLRDIIVERMSK

SEQ ID NO: 1652941 - protein, 23 aa, Staphylococcus aureus
NRVTLGYPLVRGAIRDGLINLIK

SEQ ID NO: 1652942 - protein, 17 aa, Staphylococcus aureus
NTNARIEPGAFIREQAI

SEQ ID NO: 1652943 - protein, 24 aa, Staphylococcus aureus
PGITLKIAVSVLIRAIFLKINAIT

SEQ ID NO: 1652944 - protein, 19 aa, Staphylococcus aureus
PLDLLLHLIQKFEIDIYDI

SEQ ID NO: 1652945 - protein, 24 aa, Staphylococcus aureus
PNFSTQLLDRFLVIAHSYQLNARV

SEQ ID NO: 1652946 - protein, 19 aa, Staphylococcus aureus
PQKLDIVVFPSKYGGGAGH

SEQ ID NO: 1652947 - protein, 21 aa, Staphylococcus aureus
QAVEKHYKLYVNMLENGEKHA

SEQ ID NO: 1652948 - protein, 19 aa, Staphylococcus aureus
QEINTAFFVKLFNTALAER

SEQ ID NO: 1652949 - protein, 23 aa, Staphylococcus aureus
QNRKLRRPDLTFATLDHNVPTID

SEQ ID NO: 1652950 - protein, 25 aa, Staphylococcus aureus
QRNGPTGTVKLHFMKQYNKFTDIDY

SEQ ID NO: 1652951 - protein, 20 aa, Staphylococcus aureus
RKDKQVKIRGFRIELSEVEH

SEQ ID NO: 1652952 - protein, 21 aa, Staphylococcus aureus
RKDKQVKIRGFRIELSEVEHA

SEQ ID NO: 1652953 - protein, 24 aa, Staphylococcus aureus
RWNSGDIKLLIAHPASAGHGLNLQ

SEQ ID NO: 1652954 - protein, 21 aa, Staphylococcus aureus
SEDAMIRMTRIIESFDRETNQ

SEQ ID NO: 1652955 - protein, 24 aa, Staphylococcus aureus
SELREEFNKRLNLIHQKLNDNISN

SEQ ID NO: 1652956 - protein, 17 aa, Staphylococcus aureus
SENFQIFDFELSDEQMT

SEQ ID NO: 1652957 - protein, 29 aa, Staphylococcus aureus
SEYQDCLLFFRLGDFYEMFYEDAKEASRV

SEQ ID NO: 1652958 - protein, 23 aa, Staphylococcus aureus
SGKIRFGKDYGVQIAYVRDESLE

SEQ ID NO: 1652959 - protein, 21 aa, Staphylococcus aureus
SLMIEYLRFANCTQELTIEKY

SEQ ID NO: 1652960 - protein, 19 aa, Staphylococcus aureus
SLNKLSFKYMDRILLNWKK

SEQ ID NO: 1652961 - protein, 18 aa, Staphylococcus aureus
SLYIKKGLVEPFIVFYNQ

SEQ ID NO: 1652962 - protein, 21 aa, Staphylococcus aureus
SMASLPLKMYEDYKVVNTEVS

SEQ ID NO: 1652963 - protein, 17 aa, Staphylococcus aureus
SNFNPENFKAMDYIIQG

SEQ ID NO: 1652964 - protein, 22 aa, Staphylococcus aureus
SQEIEKLILFLGDRPTINKQDV

SEQ ID NO: 1652965 - protein, 24 aa, Staphylococcus aureus
SRTVEIFKKIILENKMLKRWNSSY

SEQ ID NO: 1652966 - protein, 17 aa, Staphylococcus aureus
TDLPGQIARKVDTDILR

SEQ ID NO: 1652967 - protein, 22 aa, Staphylococcus aureus
TGSCSWKVFVKNGVITWENQQT

SEQ ID NO: 1652968 - protein, 23 aa, Staphylococcus aureus
TLRQRICDAAIQLMENIKYVNAG

SEQ ID NO: 1652969 - protein, 23 aa, Staphylococcus aureus
TMCYADCVPVYFYSTKHHFIALA

SEQ ID NO: 1652970 - protein, 17 aa, Staphylococcus aureus
TRQCPMSGTTIRRKDTD

SEQ ID NO: 1652971 - protein, 21 aa, Staphylococcus aureus
VKSTFKDAVIDREKEFATGLP

SEQ ID NO: 1652972 - protein, 20 aa, Staphylococcus aureus
VLNLFSYTGAFSVIAASEAS

SEQ ID NO: 1652973 - protein, 17 aa, Staphylococcus aureus
VVGGGYIGSELGTAFAN

SEQ ID NO: 1652974 - protein, 17 aa, Staphylococcus aureus
VWPKSVTPFDLHLISIN

SEQ ID NO: 1652975 - protein, 25 aa, Staphylococcus aureus
WRSQFNPRGGWSPSGPRRYANGGLI

SEQ ID NO: 1652976 - protein, 17 aa, Staphylococcus aureus
YHELSTDYLDVRDVDAP

SEQ ID NO: 1652977 - protein, 25 aa, Staphylococcus aureus
YIEDFPRQCIFIGTTNKVDFLRDET

SEQ ID NO: 1652978 - protein, 26 aa, Staphylococcus aureus
YPSGYSHGSIRFKYYDLNEGFTEEDM

SEQ ID NO: 1652979 - protein, 22 aa, Staphylococcus aureus
YQKDVIKRLVAYLNNEPIGVVD

SEQ ID NO: 1652980 - protein, 17 aa, Staphylococcus aureus
AEKGVYHLLSLPNRVNQ

SEQ ID NO: 1652981 - protein, 19 aa, Staphylococcus aureus
AGDIRRAAKRMGVNVTSGD

SEQ ID NO: 1652982 - protein, 20 aa, Staphylococcus aureus
ANVIPKEFQALYDAQQSGLD

SEQ ID NO: 1652983 - protein, 23 aa, Staphylococcus aureus
AQANLRLATMSDNRYQLIRREAV

SEQ ID NO: 1652984 - protein, 17 aa, Staphylococcus aureus
AVDLRIEYDGNVFQGEA

SEQ ID NO: 1652985 - protein, 19 aa, Staphylococcus aureus
CERCGSEYDLYKFAPTKKH

SEQ ID NO: 1652986 - protein, 22 aa, Staphylococcus aureus
CPFHTRCPIAQDMCKKSMPELK

SEQ ID NO: 1652987 - protein, 26 aa, Staphylococcus aureus
DIQQGFGRTGTWSSVSHFNFTPDLIT

SEQ ID NO: 1652988 - protein, 21 aa, Staphylococcus aureus
DKEAPDNFILGFRATPEETRG

SEQ ID NO: 1652989 - protein, 18 aa, Staphylococcus aureus
DKRIYDLQLSRQIALQTA

SEQ ID NO: 1652990 - protein, 17 aa, Staphylococcus aureus
DLCYYVIQRDLDIFITH

SEQ ID NO: 1652991 - protein, 17 aa, Staphylococcus aureus
DSIPINFLHPIKGTKFG

SEQ ID NO: 1652992 - protein, 17 aa, Staphylococcus aureus
EEKMIKEVEDVYNGKST

SEQ ID NO: 1652993 - protein, 19 aa, Staphylococcus aureus
EGEYSKIYLFSSNLEKITA

SEQ ID NO: 1652994 - protein, 18 aa, Staphylococcus aureus
ERRYKDNQLRGIESNFED

SEQ ID NO: 1652995 - protein, 27 aa, Staphylococcus aureus
EVMTGFRVGYHCAQGYFGVTPDLTCLG

SEQ ID NO: 1652996 - protein, 18 aa, Staphylococcus aureus
FDADPGWLGPKNMSSFLS

SEQ ID NO: 1652997 - protein, 17 aa, Staphylococcus aureus
FEEGHSYSHYLLIEQAI

SEQ ID NO: 1652998 - protein, 21 aa, Staphylococcus aureus
FIGAVISRILATDVLNLTQLF

SEQ ID NO: 1652999 - protein, 20 aa, Staphylococcus aureus
FTTNKFKVFAAISDTVIHGS

SEQ ID NO: 1653000 - protein, 18 aa, Staphylococcus aureus
GDAFIGAVISRILATDVL

SEQ ID NO: 1653001 - protein, 20 aa, Staphylococcus aureus
GEPMFSKKSIRNVVKPLLKY

SEQ ID NO: 1653002 - protein, 19 aa, Staphylococcus aureus
GRQHKGLGWVLTYDKAQEI

SEQ ID NO: 1653003 - protein, 22 aa, Staphylococcus aureus
GRRILLKEVRDSIFREKMVGEG

SEQ ID NO: 1653004 - protein, 18 aa, Staphylococcus aureus
GTFRTVLLPKVMFTNPKI

SEQ ID NO: 1653005 - protein, 26 aa, Staphylococcus aureus
GTTDMKGGLMALVITLIELKEQNQLP

SEQ ID NO: 1653006 - protein, 19 aa, Staphylococcus aureus
IATFRLREGMPIGAKVTLR

SEQ ID NO: 1653007 - protein, 17 aa, Staphylococcus aureus
IEAVPGRTMPNFAIVER

SEQ ID NO: 1653008 - protein, 19 aa, Staphylococcus aureus
IEKTLVASKRWIRYIHEVE

SEQ ID NO: 1653009 - protein, 17 aa, Staphylococcus aureus
IELDGFGVLEQFRHQGI

SEQ ID NO: 1653010 - protein, 20 aa, Staphylococcus aureus
IKEYCDFHHFEVKDIYADRG

SEQ ID NO: 1653011 - protein, 20 aa, Staphylococcus aureus
ITSIIFKYLQENGIESHFIK

SEQ ID NO: 1653012 - protein, 21 aa, Staphylococcus aureus
IVFMRKWLDLGNRYGNIEEVM

SEQ ID NO: 1653013 - protein, 17 aa, Staphylococcus aureus
IVYKGWLRSDQIKKLYT

SEQ ID NO: 1653014 - protein, 17 aa, Staphylococcus aureus
KDKLLAIADQRHKDEVR

SEQ ID NO: 1653015 - protein, 19 aa, Staphylococcus aureus
KLAKWFAENDYFYIMHRFD

SEQ ID NO: 1653016 - protein, 18 aa, Staphylococcus aureus
KLTTELLLNANLLSPEQI

SEQ ID NO: 1653017 - protein, 17 aa, Staphylococcus aureus
KRFNIPHAVETPSELFK

SEQ ID NO: 1653018 - protein, 22 aa, Staphylococcus aureus
KRKADTWLRNQFFATEEYKEAN

SEQ ID NO: 1653019 - protein, 17 aa, Staphylococcus aureus
KVVKEVVERSDLSPEVT

SEQ ID NO: 1653020 - protein, 17 aa, Staphylococcus aureus
LAAQHLIELGHNNMMIV

SEQ ID NO: 1653021 - protein, 21 aa, Staphylococcus aureus
LAKDDIYAVAYSFEKAESINS

SEQ ID NO: 1653022 - protein, 25 aa, Staphylococcus aureus
LEALYGVTCTLEYNDDYPALYNDPE

SEQ ID NO: 1653023 - protein, 24 aa, Staphylococcus aureus
LGTMGCGLPGAMASKIAYPNRQAI

SEQ ID NO: 1653024 - protein, 18 aa, Staphylococcus aureus
LKGKIAFNEFTKQIECLG

SEQ ID NO: 1653025 - protein, 20 aa, Staphylococcus aureus
LKKHNCLYVLVDPYLIENLR

SEQ ID NO: 1653026 - protein, 23 aa, Staphylococcus aureus
LKQFMEFYENFYFDGEEWDKDVW

SEQ ID NO: 1653027 - protein, 23 aa, Staphylococcus aureus
LLDEEFHLPLVVATTGEKEKLLN

SEQ ID NO: 1653028 - protein, 19 aa, Staphylococcus aureus
LLEVYRIIGELYGKSVEHE

SEQ ID NO: 1653029 - protein, 24 aa, Staphylococcus aureus
LNALLEMYQGFFLAPHVVSQSLKG

SEQ ID NO: 1653030 - protein, 17 aa, Staphylococcus aureus
LQGSPFCNYLIAHSGSS

SEQ ID NO: 1653031 - protein, 20 aa, Staphylococcus aureus
LVASKRWIRYIHEVEEPDFL

SEQ ID NO: 1653032 - protein, 24 aa, Staphylococcus aureus
LVICGLKSAYILKHTSEAFKEDTR

SEQ ID NO: 1653033 - protein, 17 aa, Staphylococcus aureus
MSVFPSNANFVLTKGSA

SEQ ID NO: 1653034 - protein, 26 aa, Staphylococcus aureus
NAMLEKLRFSKMFFSSNAVNKGAVMT

SEQ ID NO: 1653035 - protein, 17 aa, Staphylococcus aureus
NEARIKRYEWFDEMMNV

SEQ ID NO: 1653036 - protein, 23 aa, Staphylococcus aureus
NIAVPLDLPALFKGYYKEPERTA

SEQ ID NO: 1653037 - protein, 24 aa, Staphylococcus aureus
NKVAGELLCQYYFKRFGVDTRSVR

SEQ ID NO: 1653038 - protein, 22 aa, Staphylococcus aureus
PAKKFLYLVIEKLMSRITDSII

SEQ ID NO: 1653039 - protein, 20 aa, Staphylococcus aureus
PAPADHPWRTMPRNAMTVHY

SEQ ID NO: 1653040 - protein, 19 aa, Staphylococcus aureus
PFDWLSYWTDECHYTLKHV

SEQ ID NO: 1653041 - protein, 17 aa, Staphylococcus aureus
QNIPKIIISDSVFSTNG

SEQ ID NO: 1653042 - protein, 24 aa, Staphylococcus aureus
QNPPAWVCIEFMQLGQFVSFLNFY

SEQ ID NO: 1653043 - protein, 21 aa, Staphylococcus aureus
QRLVNRIIVLKDGMIVDDFAI

SEQ ID NO: 1653044 - protein, 21 aa, Staphylococcus aureus
QRRIGYLFQDYQLFPNMTVYK

SEQ ID NO: 1653045 - protein, 24 aa, Staphylococcus aureus
QYTRPREFKGLTVPDVLLSGNHAN

SEQ ID NO: 1653046 - protein, 18 aa, Staphylococcus aureus
RKEERKRVIAQNHMDVPT

SEQ ID NO: 1653047 - protein, 20 aa, Staphylococcus aureus
RKGYRGECDDKWEGLYSKVK

SEQ ID NO: 1653048 - protein, 20 aa, Staphylococcus aureus
RQLHEIRPQHFVFSTEEEAA

SEQ ID NO: 1653049 - protein, 24 aa, Staphylococcus aureus
RQTSLFEMAEYIGISEPQKLVQLF

SEQ ID NO: 1653050 - protein, 26 aa, Staphylococcus aureus
RSLLYEEMKHYFILNFPQRPGALREF

SEQ ID NO: 1653051 - protein, 29 aa, Staphylococcus aureus
SFAESFMRPCQLAKMISRYMIINETDRIL

SEQ ID NO: 1653052 - protein, 19 aa, Staphylococcus aureus
SILNLVMLCGCQGVNGGGW

SEQ ID NO: 1653053 - protein, 24 aa, Staphylococcus aureus
SITQLLERFLFPSATHGKKVYKLS

SEQ ID NO: 1653054 - protein, 18 aa, Staphylococcus aureus
SKEFFILFMNIMYSKDFL

SEQ ID NO: 1653055 - protein, 27 aa, Staphylococcus aureus
TGANEWNWYMHLSKQLARQGQRIKAGQ

SEQ ID NO: 1653056 - protein, 18 aa, Staphylococcus aureus
TNTNARIEPGAFIREQAI

SEQ ID NO: 1653057 - protein, 23 aa, Staphylococcus aureus
TSKRGYKMLPHFQIGMFEDQLFV

SEQ ID NO: 1653058 - protein, 17 aa, Staphylococcus aureus
VGVGSYVHYDRKLDGRI

SEQ ID NO: 1653059 - protein, 26 aa, Staphylococcus aureus
VKRPEVVEKIKVARSFGDLSENSEYD

SEQ ID NO: 1653060 - protein, 24 aa, Staphylococcus aureus
VSAIIAEHCLFDLDAPIMRLAAPD

SEQ ID NO: 1653061 - protein, 25 aa, Staphylococcus aureus
VSEPSYRDNIDWGEINQPIDEETFL

SEQ ID NO: 1653062 - protein, 23 aa, Staphylococcus aureus
VVANLPYYITTPILLNLMQQDIP

SEQ ID NO: 1653063 - protein, 17 aa, Staphylococcus aureus
WGGETIFVPLSALSGDG

SEQ ID NO: 1653064 - protein, 17 aa, Staphylococcus aureus
WNAKTVWIRKGTVINKM

SEQ ID NO: 1653065 - protein, 18 aa, Staphylococcus aureus
WRTMPRNAMTVHYSGMTL

SEQ ID NO: 1653066 - protein, 20 aa, Staphylococcus aureus
YDKEIDHLIDYFILPLRQIE

SEQ ID NO: 1653067 - protein, 21 aa, Staphylococcus aureus
YSLDEYLRYGFANQKTSVKMT

SEQ ID NO: 1653068 - protein, 33 aa, Staphylococcus aureus
AEVEAIKHFISKQVDRFRVAYGHYIEDFPRQCI

SEQ ID NO: 1653069 - protein, 31 aa, Staphylococcus aureus
AIEARVIAWYAKEQWRLDVFNTHGKIYEASA

SEQ ID NO: 1653070 - protein, 17 aa, Staphylococcus aureus
AIEMANKMKDGFINKGY

SEQ ID NO: 1653071 - protein, 17 aa, Staphylococcus aureus
AKYKSEQLILDERNFES

SEQ ID NO: 1653072 - protein, 25 aa, Staphylococcus aureus
APGYRVKESPVHFECEYVQTIRIPT

SEQ ID NO: 1653073 - protein, 17 aa, Staphylococcus aureus
ARFVNEYIRTLNVTQSA

SEQ ID NO: 1653074 - protein, 18 aa, Staphylococcus aureus
ATAIRIGNPASWDKATNA

SEQ ID NO: 1653075 - protein, 18 aa, Staphylococcus aureus
ATIGRLVDTQALFLEYRK

SEQ ID NO: 1653076 - protein, 18 aa, Staphylococcus aureus
CLVGKPFIVNEEWAIIGH

SEQ ID NO: 1653077 - protein, 17 aa, Staphylococcus aureus
CVSDFDKQLALKYRFNR

SEQ ID NO: 1653078 - protein, 27 aa, Staphylococcus aureus
CYQLNVLQLIRLCRYFVDVLRQSDNGR

SEQ ID NO: 1653079 - protein, 18 aa, Staphylococcus aureus
DFITGHSLGGRDAVVLGM

SEQ ID NO: 1653080 - protein, 19 aa, Staphylococcus aureus
DFLYTCRQKIKVLDITYNE

SEQ ID NO: 1653081 - protein, 27 aa, Staphylococcus aureus
DGYKIIDEFLCIDKSYSNSNFDTNSRT

SEQ ID NO: 1653082 - protein, 26 aa, Staphylococcus aureus
DKFAKAVPLSAVFEAQNLMDLEWNDF

SEQ ID NO: 1653083 - protein, 23 aa, Staphylococcus aureus
DKRGGFCYELNTFFKAYLQQKGF

SEQ ID NO: 1653084 - protein, 17 aa, Staphylococcus aureus
DKYIRPVRKRIGMVFQF

SEQ ID NO: 1653085 - protein, 20 aa, Staphylococcus aureus
DLIRQCNKLGKPVITATQML

SEQ ID NO: 1653086 - protein, 21 aa, Staphylococcus aureus
DRVILELLYATGIRVSELVNI

SEQ ID NO: 1653087 - protein, 26 aa, Staphylococcus aureus
DSGVLSSLYICFSIKSEMSKDFMEAY

SEQ ID NO: 1653088 - protein, 20 aa, Staphylococcus aureus
DSTHWYREVSGIAVEGARNH

SEQ ID NO: 1653089 - protein, 24 aa, Staphylococcus aureus
DTFDHCLAEALTYTSEHQMNFIDP

SEQ ID NO: 1653090 - protein, 21 aa, Staphylococcus aureus
DTLAKNVVKGFVEGKYDGGRH

SEQ ID NO: 1653091 - protein, 18 aa, Staphylococcus aureus
DTLFLGMGGMHGSYASNM

SEQ ID NO: 1653092 - protein, 19 aa, Staphylococcus aureus
DVYWCTADPGWVTGTSYGI

SEQ ID NO: 1653093 - protein, 17 aa, Staphylococcus aureus
EAGKRVYRTFVQGEMIE

SEQ ID NO: 1653094 - protein, 17 aa, Staphylococcus aureus
EKGIKNVHGYGYGDLYV

SEQ ID NO: 1653095 - protein, 17 aa, Staphylococcus aureus
EKVRFKDSEYSGGFVEG

SEQ ID NO: 1653096 - protein, 20 aa, Staphylococcus aureus
ELESGKMLGFLGRNGAGKTT

SEQ ID NO: 1653097 - protein, 28 aa, Staphylococcus aureus
ELNSDWSRNQIQDWIKAGLVVANDKVVK

SEQ ID NO: 1653098 - protein, 27 aa, Staphylococcus aureus
ERIEKAPNLKLAITAGVGSDHVDLAAA

SEQ ID NO: 1653099 - protein, 24 aa, Staphylococcus aureus
ERKGNHIYNGLDMFVYQGAESFKI

SEQ ID NO: 1653100 - protein, 23 aa, Staphylococcus aureus
ETALPEFYERASFAPEMSDPSMI

SEQ ID NO: 1653101 - protein, 21 aa, Staphylococcus aureus
ETSGMLAECVIFLNESFNISE

SEQ ID NO: 1653102 - protein, 18 aa, Staphylococcus aureus
FAAAKIGYHRLFDIKPVN

SEQ ID NO: 1653103 - protein, 19 aa, Staphylococcus aureus
FKGLKEWHFGLFEGESVYL

SEQ ID NO: 1653104 - protein, 17 aa, Staphylococcus aureus
FLHCLPAFHDTNTLYGQ

SEQ ID NO: 1653105 - protein, 21 aa, Staphylococcus aureus
FMLDAGLMFPEDEMLGIDIVI

SEQ ID NO: 1653106 - protein, 17 aa, Staphylococcus aureus
FNTLRAMYQQHPIRVDI

SEQ ID NO: 1653107 - protein, 18 aa, Staphylococcus aureus
FYAVDWASLRLVPKDERD

SEQ ID NO: 1653108 - protein, 18 aa, Staphylococcus aureus
FYMNCTKNAMLPIVLEKN

SEQ ID NO: 1653109 - protein, 18 aa, Staphylococcus aureus
GGRIIFVDDCIDLNHYIS

SEQ ID NO: 1653110 - protein, 19 aa, Staphylococcus aureus
GHHVLPGFIDIHIHGGYGQ

SEQ ID NO: 1653111 - protein, 19 aa, Staphylococcus aureus
GKDFYMFAPHTVKEEYGVT

SEQ ID NO: 1653112 - protein, 23 aa, Staphylococcus aureus
GKSPAQVVLRWNVQHGVVTIPKS

SEQ ID NO: 1653113 - protein, 17 aa, Staphylococcus aureus
GQLYSEFKEFFPENRVE

SEQ ID NO: 1653114 - protein, 19 aa, Staphylococcus aureus
GQMPNLWPRLKEIKVPTLI

SEQ ID NO: 1653115 - protein, 21 aa, Staphylococcus aureus
GRRILLKEVRDSIFREKMVGE

SEQ ID NO: 1653116 - protein, 24 aa, Staphylococcus aureus
GTQQFRLPVSWQHNHPFEIYRYKD

SEQ ID NO: 1653117 - protein, 26 aa, Staphylococcus aureus
GYTKIATVCKFDLPKLAQMKPQDTIQ

SEQ ID NO: 1653118 - protein, 32 aa, Staphylococcus aureus
GYVAGTKELIDWLKAQSRPFLFSTSLAPGDTK

SEQ ID NO: 1653119 - protein, 18 aa, Staphylococcus aureus
HAISGIKWIGSKHDNPSK

SEQ ID NO: 1653120 - protein, 20 aa, Staphylococcus aureus
HMRSGLTLLDSVKIVSTEVK

SEQ ID NO: 1653121 - protein, 18 aa, Staphylococcus aureus
IADCRIFGDFFGQGDIKD

SEQ ID NO: 1653122 - protein, 18 aa, Staphylococcus aureus
IAEMLKERVNQDEQLIVV

SEQ ID NO: 1653123 - protein, 23 aa, Staphylococcus aureus
IDNFKHSYGTILFYEDQDVVSGL

SEQ ID NO: 1653124 - protein, 21 aa, Staphylococcus aureus
IEHSLKCLVLKLITENNQEDG

SEQ ID NO: 1653125 - protein, 17 aa, Staphylococcus aureus
IHLLHLLKGTPMVKQYD

SEQ ID NO: 1653126 - protein, 18 aa, Staphylococcus aureus
IIDLKYGKGIEVSAIDNP

SEQ ID NO: 1653127 - protein, 27 aa, Staphylococcus aureus
INITLDMDGRIPINVWTGDSIARSGRG

SEQ ID NO: 1653128 - protein, 17 aa, Staphylococcus aureus
IPCKPTKVNGGRTRNLP

SEQ ID NO: 1653129 - protein, 21 aa, Staphylococcus aureus
IRIGNPASWDKATNALKESNG

SEQ ID NO: 1653130 - protein, 17 aa, Staphylococcus aureus
IYVPGVAGVRIEDDILV

SEQ ID NO: 1653131 - protein, 19 aa, Staphylococcus aureus
KKENLVYCDLIEHLILHAI

SEQ ID NO: 1653132 - protein, 22 aa, Staphylococcus aureus
KMVGEGLAIKAHEESKVIAPFN

SEQ ID NO: 1653133 - protein, 18 aa, Staphylococcus aureus
KNAMLPIVLEKNAREHLA

SEQ ID NO: 1653134 - protein, 19 aa, Staphylococcus aureus
KPTQLVGGYAQISYHFNYY

SEQ ID NO: 1653135 - protein, 20 aa, Staphylococcus aureus
KRLEKLFIKYLGVEDTEVNR

SEQ ID NO: 1653136 - protein, 23 aa, Staphylococcus aureus
KTAYFELAGLWIALNEEKDIPRN

SEQ ID NO: 1653137 - protein, 18 aa, Staphylococcus aureus
LDLLLHLIQKFEIDIYDI

SEQ ID NO: 1653138 - protein, 21 aa, Staphylococcus aureus
LFEVMCQCDGQPKDVMEVQAI

SEQ ID NO: 1653139 - protein, 18 aa, Staphylococcus aureus
LHHKYTKKVMMAKFNNFH

SEQ ID NO: 1653140 - protein, 18 aa, Staphylococcus aureus
LISNFKGDNLIIINKDRT

SEQ ID NO: 1653141 - protein, 20 aa, Staphylococcus aureus
LKVWGERVGVDVISQSEGSD

SEQ ID NO: 1653142 - protein, 24 aa, Staphylococcus aureus
LNLKNGFYLNEFLKEVNQHKIDQT

SEQ ID NO: 1653143 - protein, 17 aa, Staphylococcus aureus
LPVVPANMQTVMNEKLA

SEQ ID NO: 1653144 - protein, 17 aa, Staphylococcus aureus
LREAVPCIVTLNYDQTG

SEQ ID NO: 1653145 - protein, 18 aa, Staphylococcus aureus
LRHISAQYNVEFIPQRAF

SEQ ID NO: 1653146 - protein, 19 aa, Staphylococcus aureus
LTHRDCLFIELIDDKGNAY

SEQ ID NO: 1653147 - protein, 17 aa, Staphylococcus aureus
MGGGILSTVNATRETSE

SEQ ID NO: 1653148 - protein, 17 aa, Staphylococcus aureus
MKITLSFSKSNTTKTTV

SEQ ID NO: 1653149 - protein, 17 aa, Staphylococcus aureus
MQGYMPVKRIEKPVFQE

SEQ ID NO: 1653150 - protein, 17 aa, Staphylococcus aureus
NGRVGRFIIAKLLSDYY

SEQ ID NO: 1653151 - protein, 19 aa, Staphylococcus aureus
NKGDIIGYVEAMKVLNEVT

SEQ ID NO: 1653152 - protein, 26 aa, Staphylococcus aureus
NQDLLAKCYLSCLKLADQHSLNHVAF

SEQ ID NO: 1653153 - protein, 20 aa, Staphylococcus aureus
NVSSTARASFYIYNTKEDVD

SEQ ID NO: 1653154 - protein, 19 aa, Staphylococcus aureus
PHGVLFRGAAEGIIRRYLI

SEQ ID NO: 1653155 - protein, 24 aa, Staphylococcus aureus
QKANELYRVIGVYSKHKGKDTYVN

SEQ ID NO: 1653156 - protein, 22 aa, Staphylococcus aureus
QLMKRIEQAEVRMEEIDVLMIE

SEQ ID NO: 1653157 - protein, 25 aa, Staphylococcus aureus
QNDCPPCTFVKNYLNEHQIDFEERN

SEQ ID NO: 1653158 - protein, 17 aa, Staphylococcus aureus
QQYRKVYQATDFYLVGC

SEQ ID NO: 1653159 - protein, 17 aa, Staphylococcus aureus
QVPELTFDIYGEGSEKT

SEQ ID NO: 1653160 - protein, 19 aa, Staphylococcus aureus
QYPNRFVGFATLPINEPEA

SEQ ID NO: 1653161 - protein, 22 aa, Staphylococcus aureus
READFINIIVFKKQAENVNKYL

SEQ ID NO: 1653162 - protein, 24 aa, Staphylococcus aureus
RFGDADISPGTRLQFIQVPSEQLE

SEQ ID NO: 1653163 - protein, 25 aa, Staphylococcus aureus
RHIVPYPPGIPIIFKGETITENMIE

SEQ ID NO: 1653164 - protein, 19 aa, Staphylococcus aureus
RIVNHIKYYLNLITEKPSD

SEQ ID NO: 1653165 - protein, 18 aa, Staphylococcus aureus
RTDLYKGDYETLVDSIQD

SEQ ID NO: 1653166 - protein, 26 aa, Staphylococcus aureus
RWNRSHHQLIFFGRYHCLARKPKCDI

SEQ ID NO: 1653167 - protein, 23 aa, Staphylococcus aureus
SDERVRGLFQFYGAGTGRWAGRG

SEQ ID NO: 1653168 - protein, 24 aa, Staphylococcus aureus
SDNGRIIVISSIWGETGASMETIY

SEQ ID NO: 1653169 - protein, 19 aa, Staphylococcus aureus
SEMPRERLLSHGAKSLSNT

SEQ ID NO: 1653170 - protein, 22 aa, Staphylococcus aureus
SILSEYGYRQVELFLSKVGDYC

SEQ ID NO: 1653171 - protein, 17 aa, Staphylococcus aureus
SPFNIYKPHSGFTLETQ

SEQ ID NO: 1653172 - protein, 25 aa, Staphylococcus aureus
SSSLPIYNLYFIKRNIEKLINADDR

SEQ ID NO: 1653173 - protein, 22 aa, Staphylococcus aureus
TDPRLLPKAKRLDIVSYEEMME

SEQ ID NO: 1653174 - protein, 21 aa, Staphylococcus aureus
TKRFGKMTAVNDISLELESGK

SEQ ID NO: 1653175 - protein, 23 aa, Staphylococcus aureus
TRLKEVHPNILIFVDNCYGEFVE

SEQ ID NO: 1653176 - protein, 22 aa, Staphylococcus aureus
VDLRGMLRRMIGHPKKDRAAYE

SEQ ID NO: 1653177 - protein, 18 aa, Staphylococcus aureus
VLKHVNFDLKDLHVVIGP

SEQ ID NO: 1653178 - protein, 23 aa, Staphylococcus aureus
VLVETLPDFKFHIAAITEMSDKL

SEQ ID NO: 1653179 - protein, 22 aa, Staphylococcus aureus
VPELRFPGFEGEWEEKQLGDLT

SEQ ID NO: 1653180 - protein, 17 aa, Staphylococcus aureus
VRAGKLFGIPVSGTHAH

SEQ ID NO: 1653181 - protein, 17 aa, Staphylococcus aureus
WASLRLVPKDERDALVT

SEQ ID NO: 1653182 - protein, 21 aa, Staphylococcus aureus
WLINYVKQYPHTVLFVTHDRY

SEQ ID NO: 1653183 - protein, 22 aa, Staphylococcus aureus
WSKGEIEAVPGRTMPNFAIVER

SEQ ID NO: 1653184 - protein, 19 aa, Staphylococcus aureus
YELWRQTLIQVGINRPTYK

SEQ ID NO: 1653185 - protein, 22 aa, Staphylococcus aureus
YMYKKFGVIPEMEYEMEEVKEI

SEQ ID NO: 1653186 - protein, 21 aa, Staphylococcus aureus
YQKDVIKRLVAYLNNEPIGVV

SEQ ID NO: 1653187 - protein, 19 aa, Staphylococcus aureus
YREVSGIAVEGARNHGLLN

SEQ ID NO: 1653188 - protein, 24 aa, Staphylococcus aureus
AFDRIDVEGPFYIKDDITNTITRV

SEQ ID NO: 1653189 - protein, 26 aa, Staphylococcus aureus
AGKSTLLSAICRLIRFDNGEVKIDGQ

SEQ ID NO: 1653190 - protein, 24 aa, Staphylococcus aureus
AGSEVSALLGRMPSAVGYQPTLAT

SEQ ID NO: 1653191 - protein, 24 aa, Staphylococcus aureus
AIARAICINPKYILFDEAISSLDM

SEQ ID NO: 1653192 - protein, 23 aa, Staphylococcus aureus
AIGLCGLDAQLFEIKRFDQQYGY

SEQ ID NO: 1653193 - protein, 17 aa, Staphylococcus aureus
AKGADLLVHVVDSSHPE

SEQ ID NO: 1653194 - protein, 26 aa, Staphylococcus aureus
AKSSINEIFSRMQSVSAQVDRITIQL

SEQ ID NO: 1653195 - protein, 25 aa, Staphylococcus aureus
AKTLKEADLEFGVEICEPQPPSEDF

SEQ ID NO: 1653196 - protein, 17 aa, Staphylococcus aureus
ALTQGDKFAKAVPLSAV

SEQ ID NO: 1653197 - protein, 19 aa, Staphylococcus aureus
ARDLLQYKIDNYDNHIAKI

SEQ ID NO: 1653198 - protein, 20 aa, Staphylococcus aureus
ASQKLGVHYVQLDVTSDYSV

SEQ ID NO: 1653199 - protein, 19 aa, Staphylococcus aureus
AVVLPHGVLFRGAAEGIIR

SEQ ID NO: 1653200 - protein, 18 aa, Staphylococcus aureus
AYVPCKEAVLPIFDQIFT

SEQ ID NO: 1653201 - protein, 21 aa, Staphylococcus aureus
CPRGASFSWYEYSPLRIKYPY

SEQ ID NO: 1653202 - protein, 22 aa, Staphylococcus aureus
DAGLPKRPFKPFNEAHRQTLDQ

SEQ ID NO: 1653203 - protein, 23 aa, Staphylococcus aureus
DDNDINEIIAWRGEQEELEQKRD

SEQ ID NO: 1653204 - protein, 23 aa, Staphylococcus aureus
DEVLQKSGYREMLERENTLESRS

SEQ ID NO: 1653205 - protein, 17 aa, Staphylococcus aureus
DKVEIKAATIIDAEHVK

SEQ ID NO: 1653206 - protein, 21 aa, Staphylococcus aureus
DPSYKQLISYCLLENEHGEIL

SEQ ID NO: 1653207 - protein, 23 aa, Staphylococcus aureus
DRHDIKVTAWMPLMRNRGLLDNP

SEQ ID NO: 1653208 - protein, 26 aa, Staphylococcus aureus
DSDLKRFKGAHGLLYEQELGLQATIF

SEQ ID NO: 1653209 - protein, 19 aa, Staphylococcus aureus
DSPLFKFKLFQFADAAYIL

SEQ ID NO: 1653210 - protein, 17 aa, Staphylococcus aureus
EAICRIVKQHEDARNKV

SEQ ID NO: 1653211 - protein, 33 aa, Staphylococcus aureus
EAILKGYNFISVLGWPTYYANLGYQRASMYDIY

SEQ ID NO: 1653212 - protein, 19 aa, Staphylococcus aureus
EAKPGICIIGEVVGYTENV

SEQ ID NO: 1653213 - protein, 17 aa, Staphylococcus aureus
EALIDFIPNITNANLKD

SEQ ID NO: 1653214 - protein, 23 aa, Staphylococcus aureus
EDIWRHLSKIWYTDRQLLINNLI

SEQ ID NO: 1653215 - protein, 18 aa, Staphylococcus aureus
EFMDAYRELKMIVPTPHM

SEQ ID NO: 1653216 - protein, 23 aa, Staphylococcus aureus
EGEVPFKPSRVILQDFTGVPAVV

SEQ ID NO: 1653217 - protein, 17 aa, Staphylococcus aureus
ELGPFGRNVMGGRKAAE

SEQ ID NO: 1653218 - protein, 22 aa, Staphylococcus aureus
ELNGFRALTKIDWENVTINNEI

SEQ ID NO: 1653219 - protein, 17 aa, Staphylococcus aureus
ELVQVIGSMIVIYRESK

SEQ ID NO: 1653220 - protein, 22 aa, Staphylococcus aureus
EQKRLETIEGIVPSIQAFHVNK

SEQ ID NO: 1653221 - protein, 17 aa, Staphylococcus aureus
ERTVAWISGVEHVRETA

SEQ ID NO: 1653222 - protein, 25 aa, Staphylococcus aureus
EVLKEREHFAIFPASHFVTREEKLK

SEQ ID NO: 1653223 - protein, 17 aa, Staphylococcus aureus
EVQQWFNYTYMVILTNG

SEQ ID NO: 1653224 - protein, 18 aa, Staphylococcus aureus
EYVSYAIKGNLMYENAYP

SEQ ID NO: 1653225 - protein, 23 aa, Staphylococcus aureus
FDDYRKMFAHITVAQGYITPENA

SEQ ID NO: 1653226 - protein, 18 aa, Staphylococcus aureus
FHTRCPIAKDKCKENIPQ

SEQ ID NO: 1653227 - protein, 22 aa, Staphylococcus aureus
FKIVSASLVKYFYRTPRIPRSL

SEQ ID NO: 1653228 - protein, 34 aa, Staphylococcus aureus
FLKGAGKSLMKLGFKGGEKFAVKTGLQKTMQQAV

SEQ ID NO: 1653229 - protein, 21 aa, Staphylococcus aureus
FQFAGHFGEPMWTEHMSLDKI

SEQ ID NO: 1653230 - protein, 25 aa, Staphylococcus aureus
GEHLDLLSKIAITFSEEENVDRIVQ

SEQ ID NO: 1653231 - protein, 18 aa, Staphylococcus aureus
GHLHHPFSIEDDKIKYSG

SEQ ID NO: 1653232 - protein, 23 aa, Staphylococcus aureus
GKLGSGQQWYSWIHINDLIQAIL

SEQ ID NO: 1653233 - protein, 17 aa, Staphylococcus aureus
GPLTVCAAFVTKEHVPI

SEQ ID NO: 1653234 - protein, 19 aa, Staphylococcus aureus
GRNRIELIEPLDAIEFHNF

SEQ ID NO: 1653235 - protein, 18 aa, Staphylococcus aureus
GTELEDFAAFNLSIEDTV

SEQ ID NO: 1653236 - protein, 26 aa, Staphylococcus aureus
GYEKIEPRDSVFFVHELMGYNTELKV

SEQ ID NO: 1653237 - protein, 17 aa, Staphylococcus aureus
HDQPRVVSRFGDDTSEE

SEQ ID NO: 1653238 - protein, 25 aa, Staphylococcus aureus
IEANYKYARGVAVYGDIKNGANDHG

SEQ ID NO: 1653239 - protein, 22 aa, Staphylococcus aureus
IGNSKYLFTYFVKHNPMTACYF

SEQ ID NO: 1653240 - protein, 17 aa, Staphylococcus aureus
IHILTSLYASTSNTPHI

SEQ ID NO: 1653241 - protein, 17 aa, Staphylococcus aureus
IHLSEGYIYFKDKPISD

SEQ ID NO: 1653242 - protein, 17 aa, Staphylococcus aureus
INMVRVRLSGVKLKEII

SEQ ID NO: 1653243 - protein, 17 aa, Staphylococcus aureus
IPDASISFEVFADDLET

SEQ ID NO: 1653244 - protein, 17 aa, Staphylococcus aureus
IRIGFLLGPQYLIDKLT

SEQ ID NO: 1653245 - protein, 24 aa, Staphylococcus aureus
IRTLCRQLLLDGCRVAQAEGLNFS

SEQ ID NO: 1653246 - protein, 23 aa, Staphylococcus aureus
ISEIPKDFILLPIHPYQINVLRQ

SEQ ID NO: 1653247 - protein, 17 aa, Staphylococcus aureus
KAKSWSEKHRFPLKHIN

SEQ ID NO: 1653248 - protein, 22 aa, Staphylococcus aureus
KGTELYHKTLGVIGAGRIGLGV

SEQ ID NO: 1653249 - protein, 26 aa, Staphylococcus aureus
KHRFPLKHINLGGGIGVNYADLTSQF

SEQ ID NO: 1653250 - protein, 19 aa, Staphylococcus aureus
KMPSMKITLSFSKSNTTKT

SEQ ID NO: 1653251 - protein, 17 aa, Staphylococcus aureus
KNIMFPLEIAGVPRRRA

SEQ ID NO: 1653252 - protein, 22 aa, Staphylococcus aureus
KNYPGWKLVEGRSRRMITDTKA

SEQ ID NO: 1653253 - protein, 24 aa, Staphylococcus aureus
KSFRENYGTLGLAFIKQYESKKDV

SEQ ID NO: 1653254 - protein, 19 aa, Staphylococcus aureus
KSISLDLMYHLPKQTIEDF

SEQ ID NO: 1653255 - protein, 17 aa, Staphylococcus aureus
KSSPFVWFKDALDGYDY

SEQ ID NO: 1653256 - protein, 23 aa, Staphylococcus aureus
KVPANLKLPLRDGDTEREDDVNY

SEQ ID NO: 1653257 - protein, 25 aa, Staphylococcus aureus
KYKVGELYPAEGYNNPRVELLTNQI

SEQ ID NO: 1653258 - protein, 24 aa, Staphylococcus aureus
LAELTCLNPVQLRRVTTQLVDLKM

SEQ ID NO: 1653259 - protein, 24 aa, Staphylococcus aureus
LIDKMYKRFSILTTISKNQPVGRR

SEQ ID NO: 1653260 - protein, 24 aa, Staphylococcus aureus
LIKEKPDLILLTFPTPVMSVLTEQ

SEQ ID NO: 1653261 - protein, 30 aa, Staphylococcus aureus
LNSTDGEPCNECHICKGITQGTNSDVIEID

SEQ ID NO: 1653262 - protein, 19 aa, Staphylococcus aureus
LPLVKKGGQFVALKSSKGE

SEQ ID NO: 1653263 - protein, 17 aa, Staphylococcus aureus
LREETIVLLKTGIQQYD

SEQ ID NO: 1653264 - protein, 17 aa, Staphylococcus aureus
LSDELEVLDYIRTKTLT

SEQ ID NO: 1653265 - protein, 25 aa, Staphylococcus aureus
LSFGYKQGHLEPIFILGKNNKQKRD

SEQ ID NO: 1653266 - protein, 20 aa, Staphylococcus aureus
LSIRMYYALFLNKPIITTDD

SEQ ID NO: 1653267 - protein, 17 aa, Staphylococcus aureus
LSRKGKRKIFLAQSGGS

SEQ ID NO: 1653268 - protein, 18 aa, Staphylococcus aureus
MHIDGDLKGSSVGYKKLE

SEQ ID NO: 1653269 - protein, 26 aa, Staphylococcus aureus
NEIMQRLGRAFALLQVTGEVLNDIDG

SEQ ID NO: 1653270 - protein, 20 aa, Staphylococcus aureus
NEYFNWLKQNYIFKELDSST

SEQ ID NO: 1653271 - protein, 19 aa, Staphylococcus aureus
NKLLHEARLQRKVNKQWVL

SEQ ID NO: 1653272 - protein, 24 aa, Staphylococcus aureus
NKVCALEVFVECFGKDKGDSRGSM

SEQ ID NO: 1653273 - protein, 21 aa, Staphylococcus aureus
NTSLPFPADITVRMHNPNNIV

SEQ ID NO: 1653274 - protein, 19 aa, Staphylococcus aureus
PIDNTLPIWRAVGGPPASA

SEQ ID NO: 1653275 - protein, 28 aa, Staphylococcus aureus
PLNRYEKRLNPAYFIRIHRSYIINTKHI

SEQ ID NO: 1653276 - protein, 38 aa, Staphylococcus aureus
PPMIYGAHCPGNFQRLMQLSKRLPIIPNINNQRSALYI

SEQ ID NO: 1653277 - protein, 19 aa, Staphylococcus aureus
PPQGCPFHTRCPIAKDKCK

SEQ ID NO: 1653278 - protein, 17 aa, Staphylococcus aureus
PTLNGFHWCQEIRKTSN

SEQ ID NO: 1653279 - protein, 23 aa, Staphylococcus aureus
QIKDLPMVMVMLYASLGSVLLRE

SEQ ID NO: 1653280 - protein, 18 aa, Staphylococcus aureus
QPIAPGMKYKHYSPNTPL

SEQ ID NO: 1653281 - protein, 17 aa, Staphylococcus aureus
RAFKNLFTGDNFGKQVI

SEQ ID NO: 1653282 - protein, 17 aa, Staphylococcus aureus
RDIPFDKVVKMDVDRFA

SEQ ID NO: 1653283 - protein, 19 aa, Staphylococcus aureus
RFISEFKYSYNYQKKENLV

SEQ ID NO: 1653284 - protein, 17 aa, Staphylococcus aureus
RKGKRKIFLAQSGGSRE

SEQ ID NO: 1653285 - protein, 19 aa, Staphylococcus aureus
RPMIHMLYYHGIAFESHAQ

SEQ ID NO: 1653286 - protein, 25 aa, Staphylococcus aureus
RSVKSCVGKEFCRFGTQYTTRLGIR

SEQ ID NO: 1653287 - protein, 18 aa, Staphylococcus aureus
RTHQKYSPFPEELNRVMV

SEQ ID NO: 1653288 - protein, 18 aa, Staphylococcus aureus
SAKQFGIRYANTQTNEDI

SEQ ID NO: 1653289 - protein, 23 aa, Staphylococcus aureus
SDGNGGGIYECLLSKTSSTTLRI

SEQ ID NO: 1653290 - protein, 29 aa, Staphylococcus aureus
SFAPFSLVLRFGYDGIDVIDLNLFEHWFR

SEQ ID NO: 1653291 - protein, 17 aa, Staphylococcus aureus
SITEGTIAEWLKNVGDS

SEQ ID NO: 1653292 - protein, 24 aa, Staphylococcus aureus
SKSKRPGLDKAIEFARSGDTIVVW

SEQ ID NO: 1653293 - protein, 22 aa, Staphylococcus aureus
TARYGEFGSFFVGHLINTNEFD

SEQ ID NO: 1653294 - protein, 25 aa, Staphylococcus aureus
TCNARHGVCEKCYGKNLATGEKVEV

SEQ ID NO: 1653295 - protein, 18 aa, Staphylococcus aureus
TEGPGLIGALLIGVNAAK

SEQ ID NO: 1653296 - protein, 21 aa, Staphylococcus aureus
TGRMLPGTKLQAGLHQAIEAK

SEQ ID NO: 1653297 - protein, 25 aa, Staphylococcus aureus
TGVTFAFQGCEHINRAITIEKSQYN

SEQ ID NO: 1653298 - protein, 19 aa, Staphylococcus aureus
TSQLRHRLMIQSIVSSELT

SEQ ID NO: 1653299 - protein, 20 aa, Staphylococcus aureus
TYILANPFYIGKIQFAKYKD

SEQ ID NO: 1653300 - protein, 17 aa, Staphylococcus aureus
VCFYSRSKQRLWTKGET

SEQ ID NO: 1653301 - protein, 20 aa, Staphylococcus aureus
VGKKLVKAVVEHARENHLKI

SEQ ID NO: 1653302 - protein, 29 aa, Staphylococcus aureus
VLDACSAPGGKACHIAEVLMPEGQVDASD

SEQ ID NO: 1653303 - protein, 17 aa, Staphylococcus aureus
VLNKYFNKLSVFRKLFG

SEQ ID NO: 1653304 - protein, 18 aa, Staphylococcus aureus
VNGTISIGCSSLIGQTLL

SEQ ID NO: 1653305 - protein, 17 aa, Staphylococcus aureus
VNSEMKANLSAFDKSEK

SEQ ID NO: 1653306 - protein, 22 aa, Staphylococcus aureus
VPELRFPGFEGEWEEKKLGNLT

SEQ ID NO: 1653307 - protein, 22 aa, Staphylococcus aureus
VPNEHKSTVLFDGGANGVGTTI

SEQ ID NO: 1653308 - protein, 26 aa, Staphylococcus aureus
VRSTMKVVLPKGWTLKNVVNHFIAWM

SEQ ID NO: 1653309 - protein, 24 aa, Staphylococcus aureus
VSGAGLSLIRHWVEDPNRIDKVDL

SEQ ID NO: 1653310 - protein, 19 aa, Staphylococcus aureus
VVCFYSRSKQRLWTKGETS

SEQ ID NO: 1653311 - protein, 17 aa, Staphylococcus aureus
WLANIEIAMINTRLTPN

SEQ ID NO: 1653312 - protein, 24 aa, Staphylococcus aureus
YATDPRLLPKAKRLDIVSYEEMME

SEQ ID NO: 1653313 - protein, 18 aa, Staphylococcus aureus
YKESKLVSYIACGATGAG

SEQ ID NO: 1653314 - protein, 24 aa, Staphylococcus aureus
YLNESLDQFILLIFYGTFPGGDFT

SEQ ID NO: 1653315 - protein, 19 aa, Staphylococcus aureus
YYRPRKMNRFLKHVVDTNE

SEQ ID NO: 1653316 - protein, 24 aa, Staphylococcus aureus
AALENGKHGFAFSSGVAAISAVVM

SEQ ID NO: 1653317 - protein, 30 aa, Staphylococcus aureus
AFLANKPEIYICGGTKFLQSMIEALKSLNY

SEQ ID NO: 1653318 - protein, 23 aa, Staphylococcus aureus
AFLEDLNQPFIYIGKDTIKLQDE

SEQ ID NO: 1653319 - protein, 19 aa, Staphylococcus aureus
AFTVMYLLISKMFEDENVD

SEQ ID NO: 1653320 - protein, 25 aa, Staphylococcus aureus
AGLRFSKRSNKGLVQVVNGDYATGG

SEQ ID NO: 1653321 - protein, 23 aa, Staphylococcus aureus
AKGSQLPKMFGFQAEGASPIVQN

SEQ ID NO: 1653322 - protein, 25 aa, Staphylococcus aureus
AKKMLARKGYDFGWQEGDDSILQQG

SEQ ID NO: 1653323 - protein, 18 aa, Staphylococcus aureus
ALNKGRIGAKEGPDAIKQ

SEQ ID NO: 1653324 - protein, 20 aa, Staphylococcus aureus
ASRALKILAEQNVEAYQIGH

SEQ ID NO: 1653325 - protein, 18 aa, Staphylococcus aureus
ATGERLQGLYAYNIPFDN

SEQ ID NO: 1653326 - protein, 35 aa, Staphylococcus aureus
ATPIKLGQEISGWRYMLDRCEIMLSESKKHILNLA

SEQ ID NO: 1653327 - protein, 20 aa, Staphylococcus aureus
AYHFKSVCVNPTHVKYAAER

SEQ ID NO: 1653328 - protein, 21 aa, Staphylococcus aureus
DCTFIAVKLPYGVQKDADEVD

SEQ ID NO: 1653329 - protein, 24 aa, Staphylococcus aureus
DKLPYRAKRHYSIVSGDKNHLTFG

SEQ ID NO: 1653330 - protein, 25 aa, Staphylococcus aureus
DLIEEVARIYGYDDIPSTLPVFEKV

SEQ ID NO: 1653331 - protein, 24 aa, Staphylococcus aureus
DNAYSSDGYIMFGSDENYDYGAGI

SEQ ID NO: 1653332 - protein, 17 aa, Staphylococcus aureus
DNLYLICSLYNRKIDQI

SEQ ID NO: 1653333 - protein, 25 aa, Staphylococcus aureus
DTFDHCLAEALTYTSEHQMNFIDPF

SEQ ID NO: 1653334 - protein, 17 aa, Staphylococcus aureus
EAFEVVIEAIKGDKKAF

SEQ ID NO: 1653335 - protein, 28 aa, Staphylococcus aureus
EAFLQRCPNLKWIAWFATGVNTLPLDYI

SEQ ID NO: 1653336 - protein, 20 aa, Staphylococcus aureus
EEAFAVALETAFLKGTGKDQ

SEQ ID NO: 1653337 - protein, 17 aa, Staphylococcus aureus
EGIIRAYGISSIRPNVI

SEQ ID NO: 1653338 - protein, 25 aa, Staphylococcus aureus
EIEGIAYDRLWVHLIPIIKNQQSKI

SEQ ID NO: 1653339 - protein, 18 aa, Staphylococcus aureus
EIYFIEPDLHFTIIDFNQ

SEQ ID NO: 1653340 - protein, 20 aa, Staphylococcus aureus
ELIQKLMLIMPEGPALTLNP

SEQ ID NO: 1653341 - protein, 17 aa, Staphylococcus aureus
ENSCGSGTASIGVFNNY

SEQ ID NO: 1653342 - protein, 17 aa, Staphylococcus aureus
ERAVYKVYFKNGSSKYV

SEQ ID NO: 1653343 - protein, 26 aa, Staphylococcus aureus
ESISWLINYVKQYPHTVLFVTHDRYF

SEQ ID NO: 1653344 - protein, 18 aa, Staphylococcus aureus
ETFMKSNMPYTMVGGQKF

SEQ ID NO: 1653345 - protein, 18 aa, Staphylococcus aureus
FAESLGVGFQHFLNTTRI

SEQ ID NO: 1653346 - protein, 17 aa, Staphylococcus aureus
FDFKAPIATSASIWETI

SEQ ID NO: 1653347 - protein, 18 aa, Staphylococcus aureus
FKYLSAFEKDVMYLMCEQ

SEQ ID NO: 1653348 - protein, 18 aa, Staphylococcus aureus
FLEAAGLYDAHLKDCPSK

SEQ ID NO: 1653349 - protein, 17 aa, Staphylococcus aureus
FNKPVLVLRSVTERPEG

SEQ ID NO: 1653350 - protein, 19 aa, Staphylococcus aureus
FSDLDFKFYKKASEIPESD

SEQ ID NO: 1653351 - protein, 17 aa, Staphylococcus aureus
FVDKGYRNLKIGKKLLD

SEQ ID NO: 1653352 - protein, 18 aa, Staphylococcus aureus
GCFTDKRKAQSFNQTTLE

SEQ ID NO: 1653353 - protein, 22 aa, Staphylococcus aureus
GEIIRLIQELAHDFPTGTHERQ

SEQ ID NO: 1653354 - protein, 18 aa, Staphylococcus aureus
GGLRYCINSAAIQFIPYE

SEQ ID NO: 1653355 - protein, 19 aa, Staphylococcus aureus
GHVVFDFKAPIATSASIWE

SEQ ID NO: 1653356 - protein, 26 aa, Staphylococcus aureus
GIDEKLQWKWVKGIIEAYQEAFPELN

SEQ ID NO: 1653357 - protein, 23 aa, Staphylococcus aureus
GINRPTYKRFLIQLKGRKFAHRT

SEQ ID NO: 1653358 - protein, 23 aa, Staphylococcus aureus
GIRFSKERNKGLVQIVNGRYATG

SEQ ID NO: 1653359 - protein, 18 aa, Staphylococcus aureus
GKGRHEISDVPKLLESKN

SEQ ID NO: 1653360 - protein, 21 aa, Staphylococcus aureus
GLEAMTIHRLIGWNQDTKPED

SEQ ID NO: 1653361 - protein, 20 aa, Staphylococcus aureus
GMPPTGGLGIGIDRLVMLLT

SEQ ID NO: 1653362 - protein, 17 aa, Staphylococcus aureus
GNWRDKFFKEREGKYQV

SEQ ID NO: 1653363 - protein, 19 aa, Staphylococcus aureus
GRIKEVYVDNLSLKDGGRN

SEQ ID NO: 1653364 - protein, 21 aa, Staphylococcus aureus
GRRFLFETVVKVNHPKYDITI

SEQ ID NO: 1653365 - protein, 25 aa, Staphylococcus aureus
GSVLLKNKLVEWSLYLKDQRINPII

SEQ ID NO: 1653366 - protein, 19 aa, Staphylococcus aureus
GTNEVKSDMSIFNIPSDDL

SEQ ID NO: 1653367 - protein, 19 aa, Staphylococcus aureus
GYGKLTLPKAYGGEGATIE

SEQ ID NO: 1653368 - protein, 17 aa, Staphylococcus aureus
HEAVFKKYFEGEGLSIL

SEQ ID NO: 1653369 - protein, 24 aa, Staphylococcus aureus
HGLMIQRFGTTYVLTTKKEAATYI

SEQ ID NO: 1653370 - protein, 21 aa, Staphylococcus aureus
HIDSYFPIKHPFEQALYQTYL

SEQ ID NO: 1653371 - protein, 26 aa, Staphylococcus aureus
HLIPETRRSTILSSKKLGDKVHLETD

SEQ ID NO: 1653372 - protein, 24 aa, Staphylococcus aureus
HRHHLKRPLILLNWNTLTGDTFIT

SEQ ID NO: 1653373 - protein, 18 aa, Staphylococcus aureus
IDGLNRATATYKFAGGKG

SEQ ID NO: 1653374 - protein, 19 aa, Staphylococcus aureus
IDSYLPIKHPFEQALYQTY

SEQ ID NO: 1653375 - protein, 23 aa, Staphylococcus aureus
IESMASFLNSFPMFKDDTRNTHP

SEQ ID NO: 1653376 - protein, 17 aa, Staphylococcus aureus
IGVALSIGGPGLIHLLN

SEQ ID NO: 1653377 - protein, 33 aa, Staphylococcus aureus
IHPMSPLVKIFWMKHEWQDVFQRTAKFADIKTY

SEQ ID NO: 1653378 - protein, 20 aa, Staphylococcus aureus
IKMKTAKTFLNKLYGGDMKS

SEQ ID NO: 1653379 - protein, 21 aa, Staphylococcus aureus
IKTPLLTCASWSTQGLHNRGS

SEQ ID NO: 1653380 - protein, 17 aa, Staphylococcus aureus
INCEGGIRYLGVRDGKN

SEQ ID NO: 1653381 - protein, 23 aa, Staphylococcus aureus
INNELEDIFAIMLENSYPEHQRD

SEQ ID NO: 1653382 - protein, 25 aa, Staphylococcus aureus
IPGEGEYAVGLFFSKERILGSEHEA

SEQ ID NO: 1653383 - protein, 18 aa, Staphylococcus aureus
ITRRIREMGVYSELHDHE

SEQ ID NO: 1653384 - protein, 17 aa, Staphylococcus aureus
ITSYWSHHCGDLIPETI

SEQ ID NO: 1653385 - protein, 18 aa, Staphylococcus aureus
KADYELVDFSVVEKLDWK

SEQ ID NO: 1653386 - protein, 24 aa, Staphylococcus aureus
KAKGLKPRAIRAMIVGIPNVGKST

SEQ ID NO: 1653387 - protein, 17 aa, Staphylococcus aureus
KDVDILFILGGDGTVNE

SEQ ID NO: 1653388 - protein, 22 aa, Staphylococcus aureus
KEIYQFPLLLFYKGNIKLINNM

SEQ ID NO: 1653389 - protein, 21 aa, Staphylococcus aureus
KEMAFPSLASVAYKAVAEKEL

SEQ ID NO: 1653390 - protein, 17 aa, Staphylococcus aureus
KGVYHLLSLPNRVNQQA

SEQ ID NO: 1653391 - protein, 22 aa, Staphylococcus aureus
KHGRKSYQYDWFYHSKAWKKLR

SEQ ID NO: 1653392 - protein, 17 aa, Staphylococcus aureus
KKFAESLGVGFQHFLNT

SEQ ID NO: 1653393 - protein, 26 aa, Staphylococcus aureus
KKYFEGEGLSILGYRNVPVNKDAIAK

SEQ ID NO: 1653394 - protein, 19 aa, Staphylococcus aureus
KLKLLKHASYCLERSNNPE

SEQ ID NO: 1653395 - protein, 23 aa, Staphylococcus aureus
KNKPGLNRFAFTLSNADSAYETD

SEQ ID NO: 1653396 - protein, 33 aa, Staphylococcus aureus
KNTSTIIPMCHPLPLTGIDVHFSWDETNAPLYT

SEQ ID NO: 1653397 - protein, 19 aa, Staphylococcus aureus
KRLLDFGVHPPTIYFPLNV

SEQ ID NO: 1653398 - protein, 22 aa, Staphylococcus aureus
KSYQSAHVFKRRRTPIVKGVSF

SEQ ID NO: 1653399 - protein, 19 aa, Staphylococcus aureus
KYGEEAFEVVIEAIKGDKK

SEQ ID NO: 1653400 - protein, 23 aa, Staphylococcus aureus
KYNNNIWNEWAFENYIKSDEYNG

SEQ ID NO: 1653401 - protein, 21 aa, Staphylococcus aureus
KYRFPERNRIISGLSKGVLIT

SEQ ID NO: 1653402 - protein, 21 aa, Staphylococcus aureus
LAPSKFEAWFLTTEHTEEDIQ

SEQ ID NO: 1653403 - protein, 17 aa, Staphylococcus aureus
LDAICMSQTDAIMIGGT

SEQ ID NO: 1653404 - protein, 19 aa, Staphylococcus aureus
LDMAKRLLDFGVHPPTIYF

SEQ ID NO: 1653405 - protein, 24 aa, Staphylococcus aureus
LEDFKAAHIDTSYIIKTTEAKTGQ

SEQ ID NO: 1653406 - protein, 26 aa, Staphylococcus aureus
LETLTGQFAYWSAMGHHMYHPEVWLI

SEQ ID NO: 1653407 - protein, 26 aa, Staphylococcus aureus
LEVEAIQGFIYRRAREHNLDTPYLDT

SEQ ID NO: 1653408 - protein, 27 aa, Staphylococcus aureus
LGGINAGIATCWFNFRGFDHNPGIIPD

SEQ ID NO: 1653409 - protein, 19 aa, Staphylococcus aureus
LGGTVLKQIENVSVNVKRP

SEQ ID NO: 1653410 - protein, 22 aa, Staphylococcus aureus
LHSKTSITFILKDVVIEEDNKI

SEQ ID NO: 1653411 - protein, 22 aa, Staphylococcus aureus
LKFNKPHAYCLVTIIDGTGTLA

SEQ ID NO: 1653412 - protein, 18 aa, Staphylococcus aureus
LKGVEGLSPKTRRKYEEF

SEQ ID NO: 1653413 - protein, 17 aa, Staphylococcus aureus
LKRLLDLGAPGIIVQNE

SEQ ID NO: 1653414 - protein, 18 aa, Staphylococcus aureus
LLLFYKGNIKLINNMHHL

SEQ ID NO: 1653415 - protein, 20 aa, Staphylococcus aureus
LPEKHTEVFKTYKNGTPEEK

SEQ ID NO: 1653416 - protein, 19 aa, Staphylococcus aureus
LSENIYLLKDGCFTDKRKA

SEQ ID NO: 1653417 - protein, 22 aa, Staphylococcus aureus
LSLKYSRKHGYEIVGDEFEVRR

SEQ ID NO: 1653418 - protein, 21 aa, Staphylococcus aureus
LSSLPYVLCVIRRRIQSGHVI

SEQ ID NO: 1653419 - protein, 26 aa, Staphylococcus aureus
MQLMCKGDMKRHCNIIIPDKNEYETM

SEQ ID NO: 1653420 - protein, 17 aa, Staphylococcus aureus
MRIGELLAIKRVNINYE

SEQ ID NO: 1653421 - protein, 17 aa, Staphylococcus aureus
MYHLPKQTIEDFEQSLD

SEQ ID NO: 1653422 - protein, 20 aa, Staphylococcus aureus
NDVKEKIAFFNSDEVMGEQA

SEQ ID NO: 1653423 - protein, 26 aa, Staphylococcus aureus
NGDKNIRVLKDINIHINAGEFIAIMG

SEQ ID NO: 1653424 - protein, 23 aa, Staphylococcus aureus
NKNGFKEFYKLREEQHGHQIEKV

SEQ ID NO: 1653425 - protein, 27 aa, Staphylococcus aureus
NMTPYKVQIMGGIAIHKGDIAEMRTGE

SEQ ID NO: 1653426 - protein, 19 aa, Staphylococcus aureus
NNPGELLKYNVINIKVLDL

SEQ ID NO: 1653427 - protein, 27 aa, Staphylococcus aureus
NNVHLIRANPNLVIMVIVFSSGHVEHV

SEQ ID NO: 1653428 - protein, 24 aa, Staphylococcus aureus
NTLMTDWNIQTHIYKFNQIVTNEL

SEQ ID NO: 1653429 - protein, 18 aa, Staphylococcus aureus
NYSSHGLMIQRFGTTYVL

SEQ ID NO: 1653430 - protein, 22 aa, Staphylococcus aureus
PEMKRHADIIVVCYHGGFEKDL

SEQ ID NO: 1653431 - protein, 18 aa, Staphylococcus aureus
PIKSFPFEVTELPEGTKY

SEQ ID NO: 1653432 - protein, 22 aa, Staphylococcus aureus
PSHLWWQGIDPIAAIRILGQAN

SEQ ID NO: 1653433 - protein, 24 aa, Staphylococcus aureus
PSRNKLEPIMLIIVNDVDHPINER

SEQ ID NO: 1653434 - protein, 19 aa, Staphylococcus aureus
PVIASHVGGISELVTDNGI

SEQ ID NO: 1653435 - protein, 18 aa, Staphylococcus aureus
PYQQIMVATGFEQDFMSQ

SEQ ID NO: 1653436 - protein, 17 aa, Staphylococcus aureus
QEGRRFLFETVVKVNHP

SEQ ID NO: 1653437 - protein, 24 aa, Staphylococcus aureus
QNRFRPDSQFLYKSAQRGDLGDIY

SEQ ID NO: 1653438 - protein, 22 aa, Staphylococcus aureus
QNRKLRRPDLTFATLDHNVPTI

SEQ ID NO: 1653439 - protein, 19 aa, Staphylococcus aureus
QSKRQVMRLLKSLQTDENK

SEQ ID NO: 1653440 - protein, 19 aa, Staphylococcus aureus
RAKMALSTADLVIELPATA

SEQ ID NO: 1653441 - protein, 18 aa, Staphylococcus aureus
RDTLRTYLNQVYDIERLV

SEQ ID NO: 1653442 - protein, 17 aa, Staphylococcus aureus
REYFWSIIENLKEDNRT

SEQ ID NO: 1653443 - protein, 17 aa, Staphylococcus aureus
RLLDLGAPGIIVQNEKR

SEQ ID NO: 1653444 - protein, 17 aa, Staphylococcus aureus
RQLCDKHQILLIADEIQ

SEQ ID NO: 1653445 - protein, 20 aa, Staphylococcus aureus
RQMIKWTKLYIDQFLSSWTM

SEQ ID NO: 1653446 - protein, 23 aa, Staphylococcus aureus
RRDLAEVVAMKCVGATTVATTMI

SEQ ID NO: 1653447 - protein, 26 aa, Staphylococcus aureus
RSVKSCVGKEFCRFGTQYTTRLGIRL

SEQ ID NO: 1653448 - protein, 19 aa, Staphylococcus aureus
RTTAIFPKLVFSIKKGTNF

SEQ ID NO: 1653449 - protein, 21 aa, Staphylococcus aureus
SFKYMDRILLNWKKNNVKTID

SEQ ID NO: 1653450 - protein, 25 aa, Staphylococcus aureus
SGKYRPELRNMKIFPRPIDNTLPIW

SEQ ID NO: 1653451 - protein, 31 aa, Staphylococcus aureus
SGLAPEAWLECYLDRTLLPILKLFSNTGISL

SEQ ID NO: 1653452 - protein, 23 aa, Staphylococcus aureus
SHPILTKKAQAVIKFDDSLKRLL

SEQ ID NO: 1653453 - protein, 28 aa, Staphylococcus aureus
TDKPSMLKRIFSRAKSSINEIFSRMQSV

SEQ ID NO: 1653454 - protein, 17 aa, Staphylococcus aureus
TICYTNDVVKNFTANGL

SEQ ID NO: 1653455 - protein, 17 aa, Staphylococcus aureus
TIIRLSPPLVIDKEEIN

SEQ ID NO: 1653456 - protein, 17 aa, Staphylococcus aureus
TKANPFTRFIRAKATLT

SEQ ID NO: 1653457 - protein, 23 aa, Staphylococcus aureus
TLDKEDEVCILYGTKNGLVAVPT

SEQ ID NO: 1653458 - protein, 20 aa, Staphylococcus aureus
TNDLLTWLQDPFIKDMPGKR

SEQ ID NO: 1653459 - protein, 17 aa, Staphylococcus aureus
TNIKRVQQAIVEGETYQ

SEQ ID NO: 1653460 - protein, 20 aa, Staphylococcus aureus
TVHIALMHDWLKGKIIVDSL

SEQ ID NO: 1653461 - protein, 18 aa, Staphylococcus aureus
VATLRLLEIIKKYNSHIK

SEQ ID NO: 1653462 - protein, 18 aa, Staphylococcus aureus
VDIKEDWTFIKKAIAYYR

SEQ ID NO: 1653463 - protein, 18 aa, Staphylococcus aureus
VEADAWQSWGPYLLSGKD

SEQ ID NO: 1653464 - protein, 23 aa, Staphylococcus aureus
VHEPRIKFKSWSDIDEDKLEQDL

SEQ ID NO: 1653465 - protein, 20 aa, Staphylococcus aureus
VHYSHYGRMCPIETPEGPNI

SEQ ID NO: 1653466 - protein, 18 aa, Staphylococcus aureus
VIEIVKLGINKARGIEQV

SEQ ID NO: 1653467 - protein, 18 aa, Staphylococcus aureus
VKSDMSIFNIPSDDLNTV

SEQ ID NO: 1653468 - protein, 22 aa, Staphylococcus aureus
VMKEGLKTLLMNWFNTEKINID

SEQ ID NO: 1653469 - protein, 20 aa, Staphylococcus aureus
VNEVLAYDVMPYIMKKLNAP

SEQ ID NO: 1653470 - protein, 26 aa, Staphylococcus aureus
VNHMYRLPVMYIEYSGIYGDVSKVQA

SEQ ID NO: 1653471 - protein, 23 aa, Staphylococcus aureus
VSIACSKIICDVDLINENNDLKE

SEQ ID NO: 1653472 - protein, 23 aa, Staphylococcus aureus
VTLPKLHSVYFVHVMHTLTEQFV

SEQ ID NO: 1653473 - protein, 23 aa, Staphylococcus aureus
VTMGEAEKCYEYLELVNQENKKE

SEQ ID NO: 1653474 - protein, 19 aa, Staphylococcus aureus
VTPRNYRWTSRTGTTGQTQ

SEQ ID NO: 1653475 - protein, 18 aa, Staphylococcus aureus
VVDISNYVLLEYGQPLHM

SEQ ID NO: 1653476 - protein, 18 aa, Staphylococcus aureus
WESNTQCYQMLNLGKYQG

SEQ ID NO: 1653477 - protein, 19 aa, Staphylococcus aureus
WTKLYIDQFLSSWTMPKRE

SEQ ID NO: 1653478 - protein, 23 aa, Staphylococcus aureus
YDSMSQIRWLSVLDLKDKTEDQL

SEQ ID NO: 1653479 - protein, 26 aa, Staphylococcus aureus
YDYIPRLFWPIYYFIQAPMQKMMIHG

SEQ ID NO: 1653480 - protein, 20 aa, Staphylococcus aureus
YLFEIIDPYSVNRQGNDIGE

SEQ ID NO: 1653481 - protein, 20 aa, Staphylococcus aureus
YLRRINRKTALLIQLSTEVG

SEQ ID NO: 1653482 - protein, 34 aa, Staphylococcus aureus
YYDEFEGGHQWKDWKPLLSDILLYFLRKNTDDQH

SEQ ID NO: 1653483 - protein, 19 aa, Staphylococcus aureus
AENWLRNNIKDINFQLYHY

SEQ ID NO: 1653484 - protein, 17 aa, Staphylococcus aureus
AGGMHIGLRANKKDFGW

SEQ ID NO: 1653485 - protein, 18 aa, Staphylococcus aureus
AGINYCIVGTKGIQDTEW

SEQ ID NO: 1653486 - protein, 19 aa, Staphylococcus aureus
AGLLKPKAAYELIGELKAA

SEQ ID NO: 1653487 - protein, 21 aa, Staphylococcus aureus
AKPAGICGCTDLTRDQIVTQI

SEQ ID NO: 1653488 - protein, 18 aa, Staphylococcus aureus
ANFGRIITAIGYSGCEID

SEQ ID NO: 1653489 - protein, 17 aa, Staphylococcus aureus
AQEEIFGPVLTVIKVKD

SEQ ID NO: 1653490 - protein, 17 aa, Staphylococcus aureus
ARVAVGALCKVLLEQLD

SEQ ID NO: 1653491 - protein, 19 aa, Staphylococcus aureus
AVGYYLRYALSYRDISEIL

SEQ ID NO: 1653492 - protein, 24 aa, Staphylococcus aureus
AYGINLRPLLTLAEKYYDADNPAF

SEQ ID NO: 1653493 - protein, 23 aa, Staphylococcus aureus
CASPYFTHSYVFISWTGKMAEAF

SEQ ID NO: 1653494 - protein, 17 aa, Staphylococcus aureus
CDTSIKKLLSNEVEVFT

SEQ ID NO: 1653495 - protein, 25 aa, Staphylococcus aureus
CINDLGFKGALIMGRAQDGFLDQDK

SEQ ID NO: 1653496 - protein, 17 aa, Staphylococcus aureus
CKENGLMIRNLENVITF

SEQ ID NO: 1653497 - protein, 17 aa, Staphylococcus aureus
CNACHKSYTKSDVIDRT

SEQ ID NO: 1653498 - protein, 24 aa, Staphylococcus aureus
CTQATEAIPNWAAENGYPVTNYEQ

SEQ ID NO: 1653499 - protein, 20 aa, Staphylococcus aureus
DDKQRLVGLITRANVVDIVY

SEQ ID NO: 1653500 - protein, 26 aa, Staphylococcus aureus
DDPEGFINFCHKRLLFVDTKPNIVHD

SEQ ID NO: 1653501 - protein, 17 aa, Staphylococcus aureus
DFQSCGQLNVWYITTIE

SEQ ID NO: 1653502 - protein, 24 aa, Staphylococcus aureus
DIDFPKKRQGAILEDAKVTAVMSY

SEQ ID NO: 1653503 - protein, 20 aa, Staphylococcus aureus
DIERELGHDISFRERNGKIV

SEQ ID NO: 1653504 - protein, 20 aa, Staphylococcus aureus
DIERELGHEISFRERNGKIV

SEQ ID NO: 1653505 - protein, 25 aa, Staphylococcus aureus
DKKLLDWQLLIKNVYLDTEEDDNLF

SEQ ID NO: 1653506 - protein, 19 aa, Staphylococcus aureus
DLLAISIARLEASGFKIVG

SEQ ID NO: 1653507 - protein, 18 aa, Staphylococcus aureus
DQKVIDWLWETQDKSFFS

SEQ ID NO: 1653508 - protein, 19 aa, Staphylococcus aureus
DVSIPKERGFLPGNGAITS

SEQ ID NO: 1653509 - protein, 23 aa, Staphylococcus aureus
DYQRPRLKVLSDYYEGKTKNLVE

SEQ ID NO: 1653510 - protein, 18 aa, Staphylococcus aureus
EDEIGFIALHIASNTEDL

SEQ ID NO: 1653511 - protein, 24 aa, Staphylococcus aureus
EDLEFRGQELLAFIKEAAERYEFD

SEQ ID NO: 1653512 - protein, 31 aa, Staphylococcus aureus
EEKDKRAKELIKLVDLPESFLERYPAELSGG

SEQ ID NO: 1653513 - protein, 21 aa, Staphylococcus aureus
EGELVARLILDKVGNKKPLRR

SEQ ID NO: 1653514 - protein, 20 aa, Staphylococcus aureus
EHSNAFYLKSDIAVIHKKPT

SEQ ID NO: 1653515 - protein, 23 aa, Staphylococcus aureus
EIESKRGGGGYIRITKIENKDAT

SEQ ID NO: 1653516 - protein, 22 aa, Staphylococcus aureus
EKLRRHMSFLMRKGSLYLPCNG

SEQ ID NO: 1653517 - protein, 24 aa, Staphylococcus aureus
ELIGELKAAVDLPIHLHTHDTSGN

SEQ ID NO: 1653518 - protein, 23 aa, Staphylococcus aureus
EPEILRRHISYLMQQSDLFGETI

SEQ ID NO: 1653519 - protein, 34 aa, Staphylococcus aureus
EPLDDVIEMSRPVKMNSLLKLYFDRNILTPQKLL

SEQ ID NO: 1653520 - protein, 23 aa, Staphylococcus aureus
EQIKQAWMQSSMIKDEKALQNSK

SEQ ID NO: 1653521 - protein, 20 aa, Staphylococcus aureus
ERFDLNCYLTLLDVLDSHNI

SEQ ID NO: 1653522 - protein, 18 aa, Staphylococcus aureus
ERKQLGLEGLLPANVRTL

SEQ ID NO: 1653523 - protein, 23 aa, Staphylococcus aureus
ERKSRYYYCVLMPDRSSNSMETA

SEQ ID NO: 1653524 - protein, 21 aa, Staphylococcus aureus
ESGHHFDAILFLKEDTTLQNN

SEQ ID NO: 1653525 - protein, 17 aa, Staphylococcus aureus
ETDYKLKSSYMDKQLIL

SEQ ID NO: 1653526 - protein, 25 aa, Staphylococcus aureus
ETLEEARALLIEAIDSGAALEKFKT

SEQ ID NO: 1653527 - protein, 25 aa, Staphylococcus aureus
EVAEACLKLGVDIINDQWAGLYDHR

SEQ ID NO: 1653528 - protein, 17 aa, Staphylococcus aureus
EYYTHFTSPIRRYPDLT

SEQ ID NO: 1653529 - protein, 26 aa, Staphylococcus aureus
FATFGSFRPWPAYLYTIEHSIYVDAS

SEQ ID NO: 1653530 - protein, 19 aa, Staphylococcus aureus
FDDAHCLYFHLTDATTTKN

SEQ ID NO: 1653531 - protein, 25 aa, Staphylococcus aureus
FERSREGRYAYSLPISDIKTNSVES

SEQ ID NO: 1653532 - protein, 24 aa, Staphylococcus aureus
FFSSKEDPELCVLKVTPQSVKLMN

SEQ ID NO: 1653533 - protein, 17 aa, Staphylococcus aureus
FGEPMWTEHMSLDKIND

SEQ ID NO: 1653534 - protein, 17 aa, Staphylococcus aureus
FGFYRGYNGHSHIHIKG

SEQ ID NO: 1653535 - protein, 18 aa, Staphylococcus aureus
FIDREYHGEYLFEGSNYQ

SEQ ID NO: 1653536 - protein, 21 aa, Staphylococcus aureus
FKIYIKNKVRPLAVFKIEETA

SEQ ID NO: 1653537 - protein, 18 aa, Staphylococcus aureus
FLNGRAVTVIGQQRGKDT

SEQ ID NO: 1653538 - protein, 18 aa, Staphylococcus aureus
FNKPVLVLRSVTERPEGV

SEQ ID NO: 1653539 - protein, 19 aa, Staphylococcus aureus
FRHREETRVFLTMQRQLAE

SEQ ID NO: 1653540 - protein, 19 aa, Staphylococcus aureus
FSSNLEKITAFRDELKQNH

SEQ ID NO: 1653541 - protein, 26 aa, Staphylococcus aureus
GAITKGARGYLTFGHTINVPPIAESY

SEQ ID NO: 1653542 - protein, 17 aa, Staphylococcus aureus
GCLWGVEAFFTTIPGII

SEQ ID NO: 1653543 - protein, 21 aa, Staphylococcus aureus
GELDEHFPLVVWQTGSGTQSN

SEQ ID NO: 1653544 - protein, 18 aa, Staphylococcus aureus
GFNSLQWPVHPDGTDEPI

SEQ ID NO: 1653545 - protein, 17 aa, Staphylococcus aureus
GKKAIIYFYPRDNTPTC

SEQ ID NO: 1653546 - protein, 28 aa, Staphylococcus aureus
GKKYLLQNGKWGYFNREFFDLLNDHLNE

SEQ ID NO: 1653547 - protein, 18 aa, Staphylococcus aureus
GKPFSISSITYILANPFY

SEQ ID NO: 1653548 - protein, 17 aa, Staphylococcus aureus
GMKGLKRQLGVVNSEMK

SEQ ID NO: 1653549 - protein, 17 aa, Staphylococcus aureus
GTLKFNHSFDAFKQLFN

SEQ ID NO: 1653550 - protein, 20 aa, Staphylococcus aureus
HASLVVSINNVFYVTDVGFG

SEQ ID NO: 1653551 - protein, 25 aa, Staphylococcus aureus
HDKRGGFCYELNTFFKAYLQQKGFN

SEQ ID NO: 1653552 - protein, 21 aa, Staphylococcus aureus
HGVNMMLAKAMGLKNISIINN

SEQ ID NO: 1653553 - protein, 18 aa, Staphylococcus aureus
HNPMTACYFVTDDRRGPH

SEQ ID NO: 1653554 - protein, 24 aa, Staphylococcus aureus
HVHEPRIKFKSWADIDEDKLEQDL

SEQ ID NO: 1653555 - protein, 26 aa, Staphylococcus aureus
IALAKRLKLPIIIHNREATQDCIDIL

SEQ ID NO: 1653556 - protein, 17 aa, Staphylococcus aureus
IARALCQESEIILADEP

SEQ ID NO: 1653557 - protein, 18 aa, Staphylococcus aureus
IATFCYKIARNEEIQVND

SEQ ID NO: 1653558 - protein, 18 aa, Staphylococcus aureus
IATFCYKIARNEEIQVNN

SEQ ID NO: 1653559 - protein, 18 aa, Staphylococcus aureus
IDEYTDLALVYPMHKNPK

SEQ ID NO: 1653560 - protein, 17 aa, Staphylococcus aureus
IDGIKLSGLEKVIYKHL

SEQ ID NO: 1653561 - protein, 17 aa, Staphylococcus aureus
IELPFADQFWGGKMGIF

SEQ ID NO: 1653562 - protein, 24 aa, Staphylococcus aureus
IEYLIIKGLIKYAKSVTIILTTDG

SEQ ID NO: 1653563 - protein, 17 aa, Staphylococcus aureus
IGANYGGVRAFTASAGP

SEQ ID NO: 1653564 - protein, 18 aa, Staphylococcus aureus
IGVVGAVVAWNFPMLLAA

SEQ ID NO: 1653565 - protein, 31 aa, Staphylococcus aureus
ILRRCHSGPLLKNGHRFGFYRGYNGHSHIHI

SEQ ID NO: 1653566 - protein, 33 aa, Staphylococcus aureus
ILRRCHSGPLLKNGHRFGFYRGYNGHSHIHIKG

SEQ ID NO: 1653567 - protein, 26 aa, Staphylococcus aureus
IMKFTEGSFKQWGYDLALTEFGDQVF

SEQ ID NO: 1653568 - protein, 18 aa, Staphylococcus aureus
INELLKIYENIGYETEFI

SEQ ID NO: 1653569 - protein, 18 aa, Staphylococcus aureus
IPEGVLIRAIEPEDGLSA

SEQ ID NO: 1653570 - protein, 19 aa, Staphylococcus aureus
IPQRKGEPILVTKDEGVRE

SEQ ID NO: 1653571 - protein, 23 aa, Staphylococcus aureus
IQYLKKEIAEFIGDHEIKSVGVA

SEQ ID NO: 1653572 - protein, 18 aa, Staphylococcus aureus
IRQKYLDFFVEKGHMVEP

SEQ ID NO: 1653573 - protein, 19 aa, Staphylococcus aureus
IYFDGIPNMDVFKKCYKAL

SEQ ID NO: 1653574 - protein, 20 aa, Staphylococcus aureus
KDTGAFCASPYFTHSYVFIS

SEQ ID NO: 1653575 - protein, 23 aa, Staphylococcus aureus
KEDIKAQRIMKVIQSIADKYGVS

SEQ ID NO: 1653576 - protein, 18 aa, Staphylococcus aureus
KELFKNKWIGKFLTSLNA

SEQ ID NO: 1653577 - protein, 25 aa, Staphylococcus aureus
KENIIGAYCTIVFNDGRDNYIEVMT

SEQ ID NO: 1653578 - protein, 21 aa, Staphylococcus aureus
KETRGKFNIGRPISQRPKEIK

SEQ ID NO: 1653579 - protein, 17 aa, Staphylococcus aureus
KEYYYNFFGQYLLSRKG

SEQ ID NO: 1653580 - protein, 19 aa, Staphylococcus aureus
KGSLYLPCNGNLLIHGCIP

SEQ ID NO: 1653581 - protein, 20 aa, Staphylococcus aureus
KHMLDECGMIQSMSRVSKCI

SEQ ID NO: 1653582 - protein, 24 aa, Staphylococcus aureus
KILSKRELEILPLIAKGYGNKEIA

SEQ ID NO: 1653583 - protein, 29 aa, Staphylococcus aureus
KIVLKNGEGHAMSGILMSRTQAIILAELN

SEQ ID NO: 1653584 - protein, 19 aa, Staphylococcus aureus
KQIMLRLEKELSKLHEAFT

SEQ ID NO: 1653585 - protein, 28 aa, Staphylococcus aureus
KQVLEKFKSLIFISGTLKFNHSFDAFKQ

SEQ ID NO: 1653586 - protein, 20 aa, Staphylococcus aureus
KSIKKKLPLINRFIGLTGTP

SEQ ID NO: 1653587 - protein, 19 aa, Staphylococcus aureus
KVIAPFNGLISMIVPTKHA

SEQ ID NO: 1653588 - protein, 24 aa, Staphylococcus aureus
KVIDEMASRFVVVVDETKMVQYLG

SEQ ID NO: 1653589 - protein, 18 aa, Staphylococcus aureus
KVPEDWRGKVSVRQLDYF

SEQ ID NO: 1653590 - protein, 23 aa, Staphylococcus aureus
LEQPLTVAGIFTFKPNEDDRDGE

SEQ ID NO: 1653591 - protein, 24 aa, Staphylococcus aureus
LFIDEIKRQLTYYDEAIATNNADR

SEQ ID NO: 1653592 - protein, 18 aa, Staphylococcus aureus
LKFNHSFDAFKQLFNKDV

SEQ ID NO: 1653593 - protein, 20 aa, Staphylococcus aureus
LKKKHFELMKDEALFINIGR

SEQ ID NO: 1653594 - protein, 17 aa, Staphylococcus aureus
LKNIHFVGLAFNFMCFK

SEQ ID NO: 1653595 - protein, 19 aa, Staphylococcus aureus
LKVIARAGVGVDNININAA

SEQ ID NO: 1653596 - protein, 19 aa, Staphylococcus aureus
LKYEKAWELLDLPEEIKQY

SEQ ID NO: 1653597 - protein, 23 aa, Staphylococcus aureus
LLKEIPHRSSFSYILMDKSLNHA

SEQ ID NO: 1653598 - protein, 23 aa, Staphylococcus aureus
LNKIEVLDTLLLKKLSNSSTTEN

SEQ ID NO: 1653599 - protein, 22 aa, Staphylococcus aureus
LNLELRIPIIMISGNHDGKERL

SEQ ID NO: 1653600 - protein, 20 aa, Staphylococcus aureus
LNTFFKAYLQQKGFNPELMS

SEQ ID NO: 1653601 - protein, 33 aa, Staphylococcus aureus
LPFELSQRLKQQFSHYGVKIISLVAMTTDDKRI

SEQ ID NO: 1653602 - protein, 18 aa, Staphylococcus aureus
LPLINRFIGLTGTPSPNS

SEQ ID NO: 1653603 - protein, 17 aa, Staphylococcus aureus
LPSVSLLEEPQVIEPDE

SEQ ID NO: 1653604 - protein, 24 aa, Staphylococcus aureus
LQPDEFYFLPSFMSPLKKHNNFID

SEQ ID NO: 1653605 - protein, 23 aa, Staphylococcus aureus
LSQNMPVFFSANMSYGVHALTKI

SEQ ID NO: 1653606 - protein, 19 aa, Staphylococcus aureus
LVSYIACGATGAGIGEELY

SEQ ID NO: 1653607 - protein, 23 aa, Staphylococcus aureus
LYHSLPLLKYPSFELFLENITEF

SEQ ID NO: 1653608 - protein, 21 aa, Staphylococcus aureus
MCIAAACGENVILNNIVPKHV

SEQ ID NO: 1653609 - protein, 24 aa, Staphylococcus aureus
MDEIARLTPLYAGVSYERLEGFNS

SEQ ID NO: 1653610 - protein, 19 aa, Staphylococcus aureus
MNPQLPIVAIGGINTSNVA

SEQ ID NO: 1653611 - protein, 25 aa, Staphylococcus aureus
MQLQRSYHGNVMMLKRDAGAQDVVA

SEQ ID NO: 1653612 - protein, 21 aa, Staphylococcus aureus
MRHFQKRITIVDGKISKVEEL

SEQ ID NO: 1653613 - protein, 23 aa, Staphylococcus aureus
MRHFQKRITIVDGQISNTEELNQ

SEQ ID NO: 1653614 - protein, 19 aa, Staphylococcus aureus
MRSNGRYKPYNVIERLQVD

SEQ ID NO: 1653615 - protein, 23 aa, Staphylococcus aureus
MSEIKRLNLDAILAKNTDKKMIG

SEQ ID NO: 1653616 - protein, 19 aa, Staphylococcus aureus
MSRSEGFGKEVKRRIFLGT

SEQ ID NO: 1653617 - protein, 23 aa, Staphylococcus aureus
MTQARPGNHYMLSRLKPNGQFID

SEQ ID NO: 1653618 - protein, 24 aa, Staphylococcus aureus
NDDFTHWRKIMGAAPISDEERENM

SEQ ID NO: 1653619 - protein, 24 aa, Staphylococcus aureus
NEVKKRMVISDAYVYTKSNHIENQ

SEQ ID NO: 1653620 - protein, 31 aa, Staphylococcus aureus
NGINIGQRRLFEWLRQNGFLIKRKGVDYNMP

SEQ ID NO: 1653621 - protein, 17 aa, Staphylococcus aureus
NKLAAVIGVVGEVVTTM

SEQ ID NO: 1653622 - protein, 17 aa, Staphylococcus aureus
NLNHERIEFRHCSEKIE

SEQ ID NO: 1653623 - protein, 20 aa, Staphylococcus aureus
NVSSTARASFYIYNTKEDID

SEQ ID NO: 1653624 - protein, 22 aa, Staphylococcus aureus
NVSVESCELLPVIDDSTFTIDE

SEQ ID NO: 1653625 - protein, 24 aa, Staphylococcus aureus
PAKNQCYFIPYGNKMQLQRSYHGN

SEQ ID NO: 1653626 - protein, 25 aa, Staphylococcus aureus
PGLPDLKGFGRRNIDISNEEIYNLM

SEQ ID NO: 1653627 - protein, 18 aa, Staphylococcus aureus
PHSGFTLETQFLPNDINL

SEQ ID NO: 1653628 - protein, 23 aa, Staphylococcus aureus
PLAGPVVACATILNSNHNYLGLD

SEQ ID NO: 1653629 - protein, 27 aa, Staphylococcus aureus
PPISVKDGGLFKVGFNMQLDEYLEASK

SEQ ID NO: 1653630 - protein, 27 aa, Staphylococcus aureus
PQMVLRFKRRFGDDVAVLHSGLSNGER

SEQ ID NO: 1653631 - protein, 17 aa, Staphylococcus aureus
PSAVIAMERYYQKKDNH

SEQ ID NO: 1653632 - protein, 21 aa, Staphylococcus aureus
PYFAGTKVKWILDNVEGAREK

SEQ ID NO: 1653633 - protein, 21 aa, Staphylococcus aureus
QHILLRVNLAGPFPNATLHMA

SEQ ID NO: 1653634 - protein, 23 aa, Staphylococcus aureus
QLDLVYRGSFVMRYLLDGRVPNL

SEQ ID NO: 1653635 - protein, 19 aa, Staphylococcus aureus
QQIDLLWQEIESFDDDKIK

SEQ ID NO: 1653636 - protein, 20 aa, Staphylococcus aureus
QRERPGRGYIHHIAINTPQM

SEQ ID NO: 1653637 - protein, 22 aa, Staphylococcus aureus
QTNAMHQFAIWTALATKGIGAS

SEQ ID NO: 1653638 - protein, 19 aa, Staphylococcus aureus
QYGSEAWTKQFLAVAIRPM

SEQ ID NO: 1653639 - protein, 18 aa, Staphylococcus aureus
QYPNRFVGFATLPINEPE

SEQ ID NO: 1653640 - protein, 17 aa, Staphylococcus aureus
RARDGLNQTQLAKLAGV

SEQ ID NO: 1653641 - protein, 28 aa, Staphylococcus aureus
REMRLMWKEMMAILQAFRVPSVNLLQFM

SEQ ID NO: 1653642 - protein, 29 aa, Staphylococcus aureus
REMRLMWKEMMAILQAFRVPSVNLLQFMV

SEQ ID NO: 1653643 - protein, 20 aa, Staphylococcus aureus
RENYEALLIYYKNSIENPIV

SEQ ID NO: 1653644 - protein, 17 aa, Staphylococcus aureus
RGKSKGCIATFAERKSR

SEQ ID NO: 1653645 - protein, 23 aa, Staphylococcus aureus
RHLEKKRVVIFAAGIGNPYFSTD

SEQ ID NO: 1653646 - protein, 20 aa, Staphylococcus aureus
RIVRKCKENGLMIRNLENVI

SEQ ID NO: 1653647 - protein, 23 aa, Staphylococcus aureus
RKEAGSWSEWSELAINDYNTPFE

SEQ ID NO: 1653648 - protein, 19 aa, Staphylococcus aureus
RKRRLRPWLYDGTPQKHSR

SEQ ID NO: 1653649 - protein, 23 aa, Staphylococcus aureus
RLMQLSKRLPIIPNINNQRSALY

SEQ ID NO: 1653650 - protein, 19 aa, Staphylococcus aureus
RLNNQITSIIFKYLQENGI

SEQ ID NO: 1653651 - protein, 17 aa, Staphylococcus aureus
RVHMKYIGFPLVGDPKY

SEQ ID NO: 1653652 - protein, 20 aa, Staphylococcus aureus
SEERFIEMIQYFKEKITEGD

SEQ ID NO: 1653653 - protein, 20 aa, Staphylococcus aureus
SEFSCLGPNVLVKNMYYPNM

SEQ ID NO: 1653654 - protein, 18 aa, Staphylococcus aureus
SEHRELFGDFPSKDFPLL

SEQ ID NO: 1653655 - protein, 17 aa, Staphylococcus aureus
SEVKEGQVVIGLASSGI

SEQ ID NO: 1653656 - protein, 24 aa, Staphylococcus aureus
SFGYKQGHLEPIFILGKNNKQKRD

SEQ ID NO: 1653657 - protein, 29 aa, Staphylococcus aureus
SFNQPIIWLCGGLDRGNEFDELIPYMENV

SEQ ID NO: 1653658 - protein, 23 aa, Staphylococcus aureus
SGMKQKLNFASMLLVDSNVLLLD

SEQ ID NO: 1653659 - protein, 20 aa, Staphylococcus aureus
SKKYKNWDWNYGKSPKYEYN

SEQ ID NO: 1653660 - protein, 27 aa, Staphylococcus aureus
SKVCLANLLRICARYDNLDIVEDAYGI

SEQ ID NO: 1653661 - protein, 17 aa, Staphylococcus aureus
SLLDIPTIFYVYDEGTY

SEQ ID NO: 1653662 - protein, 17 aa, Staphylococcus aureus
SSAASFARTFKHFTHQT

SEQ ID NO: 1653663 - protein, 25 aa, Staphylococcus aureus
SYERYLKELSHDISLMKSSILQQKA

SEQ ID NO: 1653664 - protein, 24 aa, Staphylococcus aureus
SYFNDRLNGCGGFIDITQSVNKII

SEQ ID NO: 1653665 - protein, 22 aa, Staphylococcus aureus
TANRLIKIMTFAPEVEGAKEAL

SEQ ID NO: 1653666 - protein, 19 aa, Staphylococcus aureus
TAQDLLKWTNGKALIGTGI

SEQ ID NO: 1653667 - protein, 22 aa, Staphylococcus aureus
TDAEGILGIGDWGVDGVDIAIG

SEQ ID NO: 1653668 - protein, 25 aa, Staphylococcus aureus
TDFEKRLFLMAIFNRNRTLFYKLTS

SEQ ID NO: 1653669 - protein, 17 aa, Staphylococcus aureus
TDFHHFVKSLKTKRYTY

SEQ ID NO: 1653670 - protein, 21 aa, Staphylococcus aureus
TEIGDYLLKYDVNSINDVRIE

SEQ ID NO: 1653671 - protein, 21 aa, Staphylococcus aureus
TFYHPSNMVLFVVGDVNPEEI

SEQ ID NO: 1653672 - protein, 25 aa, Staphylococcus aureus
TGVTFAFQGCEHINRAITIEKSQFN

SEQ ID NO: 1653673 - protein, 18 aa, Staphylococcus aureus
TICYTNDVVKNFTANGLL

SEQ ID NO: 1653674 - protein, 22 aa, Staphylococcus aureus
TIEHLIQLIKYCSSKYTRSKLR

SEQ ID NO: 1653675 - protein, 25 aa, Staphylococcus aureus
TMILKPAFRDYLLKLVEAHDIEHQY

SEQ ID NO: 1653676 - protein, 22 aa, Staphylococcus aureus
TTAELGFTLMLATARRIVEAEK

SEQ ID NO: 1653677 - protein, 24 aa, Staphylococcus aureus
TYDKPRFEAIFTELRNRDITFIAA

SEQ ID NO: 1653678 - protein, 22 aa, Staphylococcus aureus
TYHTPKDLTFILANDIHSLGAA

SEQ ID NO: 1653679 - protein, 22 aa, Staphylococcus aureus
TYYKNVHIYDVTWGEAVDVKDF

SEQ ID NO: 1653680 - protein, 24 aa, Staphylococcus aureus
VEANANRYTFVWKKSIQNHESKLN

SEQ ID NO: 1653681 - protein, 22 aa, Staphylococcus aureus
VEKIHQCSRAIAKAVAQSVIDQ

SEQ ID NO: 1653682 - protein, 18 aa, Staphylococcus aureus
VFTNGEIKYNSNFEKEDV

SEQ ID NO: 1653683 - protein, 17 aa, Staphylococcus aureus
VGALCKVLLEQLDIEIY

SEQ ID NO: 1653684 - protein, 26 aa, Staphylococcus aureus
VKISGLFKKMHVRMMPAQEPPYTRLI

SEQ ID NO: 1653685 - protein, 18 aa, Staphylococcus aureus
VLNWIIKMNEHYVVEKIT

SEQ ID NO: 1653686 - protein, 19 aa, Staphylococcus aureus
VLTAIKIARIFNETVETVF

SEQ ID NO: 1653687 - protein, 24 aa, Staphylococcus aureus
VPQFKTNPILVSGVSFTPETKSIM

SEQ ID NO: 1653688 - protein, 18 aa, Staphylococcus aureus
VQMKGYPPSVREIGEAVG

SEQ ID NO: 1653689 - protein, 22 aa, Staphylococcus aureus
VSKVGTIAGCYVTEGKITRNAG

SEQ ID NO: 1653690 - protein, 24 aa, Staphylococcus aureus
VVTRPLMEEWLFNTVAFIGGPSEI

SEQ ID NO: 1653691 - protein, 23 aa, Staphylococcus aureus
VYVPDTLSALALDAYESLNDAMP

SEQ ID NO: 1653692 - protein, 21 aa, Staphylococcus aureus
WEESGRWGAYGPELMRLQDRH

SEQ ID NO: 1653693 - protein, 17 aa, Staphylococcus aureus
WLHGYWAGVPIGTDKTD

SEQ ID NO: 1653694 - protein, 18 aa, Staphylococcus aureus
YDQERQRLIGTIEVPMTL

SEQ ID NO: 1653695 - protein, 20 aa, Staphylococcus aureus
YERLEGFNSLQWPVHPDGTD

SEQ ID NO: 1653696 - protein, 18 aa, Staphylococcus aureus
YFMRDIISYIGIDQSRIV

SEQ ID NO: 1653697 - protein, 20 aa, Staphylococcus aureus
YFNRDRFVLSAGHGSALLYS

SEQ ID NO: 1653698 - protein, 17 aa, Staphylococcus aureus
YHGEYLFEGSNYQTQSD

SEQ ID NO: 1653699 - protein, 19 aa, Staphylococcus aureus
YLLPYSKFEIFWKRYKDNI

SEQ ID NO: 1653700 - protein, 24 aa, Staphylococcus aureus
YLNHIRLEHCLIDILTSKKPIEEI

SEQ ID NO: 1653701 - protein, 26 aa, Staphylococcus aureus
YPPSVREIGEAVGLASSSTVHGHLSR

SEQ ID NO: 1653702 - protein, 17 aa, Staphylococcus aureus
YRNVTAMVRWIREKEIL

SEQ ID NO: 1653703 - protein, 24 aa, Staphylococcus aureus
YRTVMPGFNYEAPPTQHKMNPYDI

SEQ ID NO: 1653704 - protein, 19 aa, Staphylococcus aureus
AAHFHKFYNAEKVLTDDIE

SEQ ID NO: 1653705 - protein, 17 aa, Staphylococcus aureus
AELIKFAEECAKAESVV

SEQ ID NO: 1653706 - protein, 26 aa, Staphylococcus aureus
AGKSTLLSAICRLIRFDEGEVKIDGQ

SEQ ID NO: 1653707 - protein, 18 aa, Staphylococcus aureus
AKPLKTLMLLHGLSSDET

SEQ ID NO: 1653708 - protein, 23 aa, Staphylococcus aureus
AMAPCPYIYAELAKRSQSDHKLN

SEQ ID NO: 1653709 - protein, 25 aa, Staphylococcus aureus
AMFDIPYSIMGHVHFRKSVMDDGRC

SEQ ID NO: 1653710 - protein, 22 aa, Staphylococcus aureus
ANVPVVAGFGIRSPQHVADIKE

SEQ ID NO: 1653711 - protein, 18 aa, Staphylococcus aureus
APLGIFSHQLQRFIHLVW

SEQ ID NO: 1653712 - protein, 21 aa, Staphylococcus aureus
AQREIGLVLAPVSVDIHHQNK

SEQ ID NO: 1653713 - protein, 19 aa, Staphylococcus aureus
AQVILSEFEASAGKKSSIS

SEQ ID NO: 1653714 - protein, 38 aa, Staphylococcus aureus
AYENPRFVEDLIRLIAADLVEFDWLDGFDIECRNEESI

SEQ ID NO: 1653715 - protein, 36 aa, Staphylococcus aureus
CGRPTRFTPELGNIIKYYLKCHWSPEQIVGRLLQNQ

SEQ ID NO: 1653716 - protein, 18 aa, Staphylococcus aureus
DEGSHCQIARNIATTMSH

SEQ ID NO: 1653717 - protein, 21 aa, Staphylococcus aureus
DFARLKLGDNIKFRPINENEL

SEQ ID NO: 1653718 - protein, 23 aa, Staphylococcus aureus
DGYAECVKLHFDDRMLTITDIMN

SEQ ID NO: 1653719 - protein, 17 aa, Staphylococcus aureus
DIDLKELVLPLIVLDFS

SEQ ID NO: 1653720 - protein, 22 aa, Staphylococcus aureus
DILNPYLCIVFCNSRDNANDLA

SEQ ID NO: 1653721 - protein, 25 aa, Staphylococcus aureus
DKHYPHLRFGFIHVPYIPEQVVGKP

SEQ ID NO: 1653722 - protein, 18 aa, Staphylococcus aureus
DKRAQLIECLEKKGFEML

SEQ ID NO: 1653723 - protein, 23 aa, Staphylococcus aureus
DKVLYLEIGIGYTTPQFVKHPFQ

SEQ ID NO: 1653724 - protein, 19 aa, Staphylococcus aureus
DLLKRLMKMNEEIKTTIIM

SEQ ID NO: 1653725 - protein, 22 aa, Staphylococcus aureus
DNAKELLLKGLEKLEYRGYDSA

SEQ ID NO: 1653726 - protein, 18 aa, Staphylococcus aureus
DNPLMRWFTNNVAVKVKP

SEQ ID NO: 1653727 - protein, 25 aa, Staphylococcus aureus
DSSNRIKENLYYFINHEITDQRDYE

SEQ ID NO: 1653728 - protein, 27 aa, Staphylococcus aureus
DVFAHGEIRLDINFALYGNGSNTISDI

SEQ ID NO: 1653729 - protein, 21 aa, Staphylococcus aureus
DVHYSHYGRMCPIETPEGPNI

SEQ ID NO: 1653730 - protein, 20 aa, Staphylococcus aureus
EAHQLLKLVGMSAKAQQYIG

SEQ ID NO: 1653731 - protein, 21 aa, Staphylococcus aureus
EELSYRTYFCLDNMLHGRITS

SEQ ID NO: 1653732 - protein, 29 aa, Staphylococcus aureus
EENKKVGLWSFDFNIDWHAGGDKRKYTFE

SEQ ID NO: 1653733 - protein, 20 aa, Staphylococcus aureus
EERGRKAIENELKRDKTKAE

SEQ ID NO: 1653734 - protein, 23 aa, Staphylococcus aureus
EGQKRLETIEGIVPSIQAFHVNK

SEQ ID NO: 1653735 - protein, 19 aa, Staphylococcus aureus
EIEDAVVDRVLYEAWEVES

SEQ ID NO: 1653736 - protein, 24 aa, Staphylococcus aureus
EIHEQPAVMRRIIQEYQDAEGNLK

SEQ ID NO: 1653737 - protein, 18 aa, Staphylococcus aureus
EKEINAFIVKYGDFAGVT

SEQ ID NO: 1653738 - protein, 22 aa, Staphylococcus aureus
EKKIPRAVLIDAIEAALITAYK

SEQ ID NO: 1653739 - protein, 19 aa, Staphylococcus aureus
ELLLDYQFVEKIKDGREDE

SEQ ID NO: 1653740 - protein, 21 aa, Staphylococcus aureus
ELRYAVSEGVQRIHVESMHEL

SEQ ID NO: 1653741 - protein, 24 aa, Staphylococcus aureus
EMPIGNSIADFILLNGKGVVYEIK

SEQ ID NO: 1653742 - protein, 24 aa, Staphylococcus aureus
ENEIKNWEFPFVIKPGDDLPTAGG

SEQ ID NO: 1653743 - protein, 24 aa, Staphylococcus aureus
EPIDLELLIAIVSVKFDINYSLKP

SEQ ID NO: 1653744 - protein, 17 aa, Staphylococcus aureus
EPPSLKLEDAIISFNAQ

SEQ ID NO: 1653745 - protein, 17 aa, Staphylococcus aureus
EPQDIAEAVLYALTQPK

SEQ ID NO: 1653746 - protein, 38 aa, Staphylococcus aureus
EQQFKCHIDTIIKKQVPVCCFTFGIPNESIIKRLKEAN

SEQ ID NO: 1653747 - protein, 20 aa, Staphylococcus aureus
ESHFSLEHAIGMLKANDLTR

SEQ ID NO: 1653748 - protein, 20 aa, Staphylococcus aureus
ESYTDFKMGLQIRHYTVQSL

SEQ ID NO: 1653749 - protein, 19 aa, Staphylococcus aureus
ETVKAFLARHDFSKKTVSA

SEQ ID NO: 1653750 - protein, 20 aa, Staphylococcus aureus
EVAVKRYNRIGAEGMTSEAV

SEQ ID NO: 1653751 - protein, 21 aa, Staphylococcus aureus
EVIKLCGALMQYYRETGIYAE

SEQ ID NO: 1653752 - protein, 20 aa, Staphylococcus aureus
EVLKQLREWHLGYLDRKPNN

SEQ ID NO: 1653753 - protein, 26 aa, Staphylococcus aureus
EVMTGFRVGYHCAQGHFGVTPDLTCL

SEQ ID NO: 1653754 - protein, 18 aa, Staphylococcus aureus
EYARVKSEWIIKLPDTLT

SEQ ID NO: 1653755 - protein, 27 aa, Staphylococcus aureus
FFEEMKPMIAEAFYKKFDEAGILNQGN

SEQ ID NO: 1653756 - protein, 17 aa, Staphylococcus aureus
FHMSPYFGYASRLLATS

SEQ ID NO: 1653757 - protein, 25 aa, Staphylococcus aureus
FLETTRNAFFIGRTIDYNVSLEGAL

SEQ ID NO: 1653758 - protein, 19 aa, Staphylococcus aureus
FLTEAGISIQLVKEVRLVG

SEQ ID NO: 1653759 - protein, 18 aa, Staphylococcus aureus
FLYERDMDGYYLIVQQER

SEQ ID NO: 1653760 - protein, 17 aa, Staphylococcus aureus
FNHYSRFIHLFKETYGD

SEQ ID NO: 1653761 - protein, 30 aa, Staphylococcus aureus
FQEDALRMIRCLRFQSQLSFDIATETFEAM

SEQ ID NO: 1653762 - protein, 26 aa, Staphylococcus aureus
FSALPSHIFKSITFDCGKEFSNWKTI

SEQ ID NO: 1653763 - protein, 17 aa, Staphylococcus aureus
FVIDKRQFSAFVGTDLD

SEQ ID NO: 1653764 - protein, 18 aa, Staphylococcus aureus
GADIVFHPAVEDMYPGEL

SEQ ID NO: 1653765 - protein, 19 aa, Staphylococcus aureus
GDLSIDGHVVFDFKAPLAT

SEQ ID NO: 1653766 - protein, 19 aa, Staphylococcus aureus
GDTVRPALQIIKTKPGVSR

SEQ ID NO: 1653767 - protein, 27 aa, Staphylococcus aureus
GFGNYELRLPLVSLEDTDTKVLREAYD

SEQ ID NO: 1653768 - protein, 19 aa, Staphylococcus aureus
GGQSYTYDTIKAFKEQHKD

SEQ ID NO: 1653769 - protein, 19 aa, Staphylococcus aureus
GHVVFDFKAPLATSASIWE

SEQ ID NO: 1653770 - protein, 20 aa, Staphylococcus aureus
GIKVGMIHGGLTPRERKQQM

SEQ ID NO: 1653771 - protein, 21 aa, Staphylococcus aureus
GKSLIAKALLEYLPFDLTCTY

SEQ ID NO: 1653772 - protein, 28 aa, Staphylococcus aureus
GMQTLGVALPWAISAALVRPNTQVVSVA

SEQ ID NO: 1653773 - protein, 20 aa, Staphylococcus aureus
GNINRPWLTIIMDDYSRAIA

SEQ ID NO: 1653774 - protein, 30 aa, Staphylococcus aureus
GQALKRLLDKWGMSSSELMAFGDANNDKDM

SEQ ID NO: 1653775 - protein, 24 aa, Staphylococcus aureus
GQARLTQLCTLLKNYFNSEDEEML

SEQ ID NO: 1653776 - protein, 25 aa, Staphylococcus aureus
GSEKWPIFLERSLVDGIFTIKDQDA

SEQ ID NO: 1653777 - protein, 20 aa, Staphylococcus aureus
GTKLTFLPYVVKALVSALKK

SEQ ID NO: 1653778 - protein, 21 aa, Staphylococcus aureus
GTKTGFYIGRIDKFIRSVSRE

SEQ ID NO: 1653779 - protein, 20 aa, Staphylococcus aureus
GTLCFDGRLIDQTIIDTLLQ

SEQ ID NO: 1653780 - protein, 21 aa, Staphylococcus aureus
HALTNYYLYFLVDSNIEIGIK

SEQ ID NO: 1653781 - protein, 25 aa, Staphylococcus aureus
HFKTEVHSSLPFLLTGDVPCNHAPK

SEQ ID NO: 1653782 - protein, 23 aa, Staphylococcus aureus
HFPCLNCTKSIIQAGIKRIYYAE

SEQ ID NO: 1653783 - protein, 18 aa, Staphylococcus aureus
HLTLDIEHSLKCLVLKLI

SEQ ID NO: 1653784 - protein, 17 aa, Staphylococcus aureus
HSLGHGIGLEIHEGPML

SEQ ID NO: 1653785 - protein, 26 aa, Staphylococcus aureus
HTHGLRFYMKKGFLMIELPSGRALAY

SEQ ID NO: 1653786 - protein, 17 aa, Staphylococcus aureus
HWSPEQIVGRLLQNQIC

SEQ ID NO: 1653787 - protein, 17 aa, Staphylococcus aureus
HYIRNAHKRELAYTRYT

SEQ ID NO: 1653788 - protein, 19 aa, Staphylococcus aureus
IDISRFLELSNMILLLDDM

SEQ ID NO: 1653789 - protein, 19 aa, Staphylococcus aureus
IDLEMRRNIEIEMVTKEEN

SEQ ID NO: 1653790 - protein, 17 aa, Staphylococcus aureus
IKAKYKKAFKMKDDIEV

SEQ ID NO: 1653791 - protein, 23 aa, Staphylococcus aureus
IKLFPGQEIRITDSILQGLDNGS

SEQ ID NO: 1653792 - protein, 29 aa, Staphylococcus aureus
IKYDGAYCINGYRWITYIANSGQRRYIAT

SEQ ID NO: 1653793 - protein, 36 aa, Staphylococcus aureus
INIANFKSGKSYVFKPKSLFVLYDILSNNSVYLHFF

SEQ ID NO: 1653794 - protein, 17 aa, Staphylococcus aureus
IQETTALGAAYLAGLAV

SEQ ID NO: 1653795 - protein, 19 aa, Staphylococcus aureus
IRQNLDRIVKSQANQKKLS

SEQ ID NO: 1653796 - protein, 19 aa, Staphylococcus aureus
ISNTYSLVGCMCQPAFEFK

SEQ ID NO: 1653797 - protein, 18 aa, Staphylococcus aureus
ISSEILIKAAKIGVGVIL

SEQ ID NO: 1653798 - protein, 17 aa, Staphylococcus aureus
IYTDYELFLSASTSEGF

SEQ ID NO: 1653799 - protein, 31 aa, Staphylococcus aureus
KAFLANKPEIYICGGTKFLQSMIEALKSLNY

SEQ ID NO: 1653800 - protein, 20 aa, Staphylococcus aureus
KDVCQRFTTDFNKSVLQNMS

SEQ ID NO: 1653801 - protein, 18 aa, Staphylococcus aureus
KELCARFDVSRMTLRQAI

SEQ ID NO: 1653802 - protein, 19 aa, Staphylococcus aureus
KGSFEIEGVSLFELQAKQL

SEQ ID NO: 1653803 - protein, 20 aa, Staphylococcus aureus
KIIPLEVVVRNIASGSITKR

SEQ ID NO: 1653804 - protein, 27 aa, Staphylococcus aureus
KIKAFVKKVEMISGMTFADLDTLVDGL

SEQ ID NO: 1653805 - protein, 19 aa, Staphylococcus aureus
KKFAEQALQELISDSFKVA

SEQ ID NO: 1653806 - protein, 22 aa, Staphylococcus aureus
KKKFSPVVGDIVEFDVQNINEG

SEQ ID NO: 1653807 - protein, 20 aa, Staphylococcus aureus
KLEIPVIKRRPNFEMDERLV

SEQ ID NO: 1653808 - protein, 17 aa, Staphylococcus aureus
KPLFVYISQSGETADSR

SEQ ID NO: 1653809 - protein, 21 aa, Staphylococcus aureus
KPTVTKSRIKVMVDNKNADIA

SEQ ID NO: 1653810 - protein, 18 aa, Staphylococcus aureus
KRKLCGRPTRFTPELGNI

SEQ ID NO: 1653811 - protein, 17 aa, Staphylococcus aureus
KSILVAPGKPFGENGNR

SEQ ID NO: 1653812 - protein, 19 aa, Staphylococcus aureus
KSKELKRSLIAKFKSNENV

SEQ ID NO: 1653813 - protein, 18 aa, Staphylococcus aureus
KSNENVLILGYTKHMNEW

SEQ ID NO: 1653814 - protein, 17 aa, Staphylococcus aureus
KSVVYQIYPKSFNDTTG

SEQ ID NO: 1653815 - protein, 19 aa, Staphylococcus aureus
KVKPGEFYFIPAGTVHTIS

SEQ ID NO: 1653816 - protein, 17 aa, Staphylococcus aureus
KYLGVSFHPELTDDYRV

SEQ ID NO: 1653817 - protein, 17 aa, Staphylococcus aureus
LAGGVAVIKVGAASETE

SEQ ID NO: 1653818 - protein, 19 aa, Staphylococcus aureus
LCTKFVPIINSIGFNNHDG

SEQ ID NO: 1653819 - protein, 26 aa, Staphylococcus aureus
LDLPFPIKINQMLGHQTSFLTYEGLV

SEQ ID NO: 1653820 - protein, 22 aa, Staphylococcus aureus
LEEAYKWMHPCYTLNNKNVVLI

SEQ ID NO: 1653821 - protein, 20 aa, Staphylococcus aureus
LEGKFEINRLYKDVKNVKGE

SEQ ID NO: 1653822 - protein, 18 aa, Staphylococcus aureus
LEHFKPIQSCNHDFLIVN

SEQ ID NO: 1653823 - protein, 21 aa, Staphylococcus aureus
LELESGKMLGFLGRNGAGKTT

SEQ ID NO: 1653824 - protein, 19 aa, Staphylococcus aureus
LETELHAVINAMSQNEGKS

SEQ ID NO: 1653825 - protein, 19 aa, Staphylococcus aureus
LETIFHCYHQMMSCCNDVI

SEQ ID NO: 1653826 - protein, 25 aa, Staphylococcus aureus
LEVEAIQGFIYRRAREHNLDTPYLD

SEQ ID NO: 1653827 - protein, 22 aa, Staphylococcus aureus
LFKTRGAVVEEVWVNGHEITET

SEQ ID NO: 1653828 - protein, 18 aa, Staphylococcus aureus
LGFGEPYPISGSHGLGLG

SEQ ID NO: 1653829 - protein, 25 aa, Staphylococcus aureus
LKARSDRDYLFFKLAIHSGMKITEL

SEQ ID NO: 1653830 - protein, 17 aa, Staphylococcus aureus
LKDIDHIARNIISEKGY

SEQ ID NO: 1653831 - protein, 22 aa, Staphylococcus aureus
LKLYKFFIIIAKYIKRNEQFFK

SEQ ID NO: 1653832 - protein, 19 aa, Staphylococcus aureus
LKNISSRLRSKIIGQDKAV

SEQ ID NO: 1653833 - protein, 26 aa, Staphylococcus aureus
LKSPNLYPGIECKLLAFLEEKKVDAT

SEQ ID NO: 1653834 - protein, 26 aa, Staphylococcus aureus
LKVIYMPHWLEFYSIAIHSDVTSNKK

SEQ ID NO: 1653835 - protein, 18 aa, Staphylococcus aureus
LLATSGIDYTYVRMAMYM

SEQ ID NO: 1653836 - protein, 19 aa, Staphylococcus aureus
LLKARGFMREGKLTVAGLL

SEQ ID NO: 1653837 - protein, 19 aa, Staphylococcus aureus
LNKFKGFETSYIINENQVF

SEQ ID NO: 1653838 - protein, 18 aa, Staphylococcus aureus
LNQSFPLMVAAVKKTQMI

SEQ ID NO: 1653839 - protein, 23 aa, Staphylococcus aureus
LNWICKAPKYTGKTWITYEELIK

SEQ ID NO: 1653840 - protein, 17 aa, Staphylococcus aureus
LPTHAMFGENLTFDYLD

SEQ ID NO: 1653841 - protein, 17 aa, Staphylococcus aureus
LQGLYAYNIPFDNKARI

SEQ ID NO: 1653842 - protein, 24 aa, Staphylococcus aureus
LQLKTFEYRDARNYLSYLYSNHLK

SEQ ID NO: 1653843 - protein, 26 aa, Staphylococcus aureus
LRSYLESMSQDFNVGGLFNKKKKKLQ

SEQ ID NO: 1653844 - protein, 23 aa, Staphylococcus aureus
LSGGQRQRAYIAMTIAQDTEYIL

SEQ ID NO: 1653845 - protein, 17 aa, Staphylococcus aureus
LSKACWDNKHKRIFEVA

SEQ ID NO: 1653846 - protein, 20 aa, Staphylococcus aureus
LSKGSLAGVDGRLQTRNYEN

SEQ ID NO: 1653847 - protein, 17 aa, Staphylococcus aureus
LTDEIIESLDFFMKYTN

SEQ ID NO: 1653848 - protein, 27 aa, Staphylococcus aureus
LTEARTLKFFKYFYTHRGPVMDYTNQS

SEQ ID NO: 1653849 - protein, 32 aa, Staphylococcus aureus
LTSILTLSDLFNWSRFKVKTFLDLLESDGMLE

SEQ ID NO: 1653850 - protein, 21 aa, Staphylococcus aureus
LWQLVAHRLMTWKKEYANNAV

SEQ ID NO: 1653851 - protein, 26 aa, Staphylococcus aureus
LYHALKTRGHRVCVFKPFQTEERQDG

SEQ ID NO: 1653852 - protein, 28 aa, Staphylococcus aureus
MFEFKGHRIVAFKGGRFLIHGMTRTSDA

SEQ ID NO: 1653853 - protein, 20 aa, Staphylococcus aureus
MGLGYLVNVYDAWKVEKVLD

SEQ ID NO: 1653854 - protein, 19 aa, Staphylococcus aureus
MKMNEEIKTTIIMVTHDPV

SEQ ID NO: 1653855 - protein, 26 aa, Staphylococcus aureus
MSQLQCAKSSLSLETIFHCYHQMMSC

SEQ ID NO: 1653856 - protein, 28 aa, Staphylococcus aureus
NDIQRSTNFSIVWILPISSIDNMPIKDM

SEQ ID NO: 1653857 - protein, 22 aa, Staphylococcus aureus
NDRAMFEFGHYTVAMKNARPEI

SEQ ID NO: 1653858 - protein, 20 aa, Staphylococcus aureus
NDVYGSWRALEELKETGKIK

SEQ ID NO: 1653859 - protein, 25 aa, Staphylococcus aureus
NFNKFCNALGINIANFKSGKSYVFK

SEQ ID NO: 1653860 - protein, 19 aa, Staphylococcus aureus
NGRRARKIFDLARQGQIQE

SEQ ID NO: 1653861 - protein, 25 aa, Staphylococcus aureus
NNQSPKMHVCEDVIVRCHLYQNEYK

SEQ ID NO: 1653862 - protein, 26 aa, Staphylococcus aureus
NPIELKNRIGFVYAENYFNERWTTKQ

SEQ ID NO: 1653863 - protein, 19 aa, Staphylococcus aureus
NTILELSENIYLLKDGCFT

SEQ ID NO: 1653864 - protein, 18 aa, Staphylococcus aureus
NWLKYYRKDNLGVENLYI

SEQ ID NO: 1653865 - protein, 19 aa, Staphylococcus aureus
PEEICRIVKQHEDARNKVN

SEQ ID NO: 1653866 - protein, 21 aa, Staphylococcus aureus
PFCVKITFEIDKNDNWLNALD

SEQ ID NO: 1653867 - protein, 18 aa, Staphylococcus aureus
PKNMLLSLILNSDLVSPK

SEQ ID NO: 1653868 - protein, 22 aa, Staphylococcus aureus
PLKHINLGGGIGVNYADLTSQF

SEQ ID NO: 1653869 - protein, 18 aa, Staphylococcus aureus
PNSRYMVFYNDGLTLYTK

SEQ ID NO: 1653870 - protein, 19 aa, Staphylococcus aureus
PREDVATVLKEIVTSNHFN

SEQ ID NO: 1653871 - protein, 29 aa, Staphylococcus aureus
QDLGRKGYEHIGFSGAGAMDQFSFKVAQS

SEQ ID NO: 1653872 - protein, 23 aa, Staphylococcus aureus
QDLPVNSYIIWGGVSDIDLMYEE

SEQ ID NO: 1653873 - protein, 22 aa, Staphylococcus aureus
QEQFKLSYLFIAHDLSVVKHIS

SEQ ID NO: 1653874 - protein, 22 aa, Staphylococcus aureus
QKIKRIAIIGGSGIGYEYQAVQ

SEQ ID NO: 1653875 - protein, 19 aa, Staphylococcus aureus
QKMGYKVAVLDPAEDCPCR

SEQ ID NO: 1653876 - protein, 23 aa, Staphylococcus aureus
QKRMNIDLFISVGKCFKSNEELS

SEQ ID NO: 1653877 - protein, 17 aa, Staphylococcus aureus
QLYRFKQHFDTIFIDEV

SEQ ID NO: 1653878 - protein, 26 aa, Staphylococcus aureus
QQTKGRYSIVIFDIYGTLTLDNDVLS

SEQ ID NO: 1653879 - protein, 24 aa, Staphylococcus aureus
QRGKFDVLIVLSHCGIFFDETLCQ

SEQ ID NO: 1653880 - protein, 17 aa, Staphylococcus aureus
QRIRQNLDRIVKSQANQ

SEQ ID NO: 1653881 - protein, 17 aa, Staphylococcus aureus
QTLDWALENDRFIVTLC

SEQ ID NO: 1653882 - protein, 33 aa, Staphylococcus aureus
QTPNSYRFQKHLDHEVLIRTSLIVREDAQLLYG

SEQ ID NO: 1653883 - protein, 17 aa, Staphylococcus aureus
QVVGSGFEGRVTKKDLM

SEQ ID NO: 1653884 - protein, 23 aa, Staphylococcus aureus
REKFKHYCEHEVLSSIINGAYII

SEQ ID NO: 1653885 - protein, 19 aa, Staphylococcus aureus
RGAHPCIISMEGLEKEGDT

SEQ ID NO: 1653886 - protein, 20 aa, Staphylococcus aureus
RIRLYIPLNERISADDYRKY

SEQ ID NO: 1653887 - protein, 20 aa, Staphylococcus aureus
RKHDIGFIFQEYNLLHTLTV

SEQ ID NO: 1653888 - protein, 19 aa, Staphylococcus aureus
RPQDAVFLSVDRQDQIEQE

SEQ ID NO: 1653889 - protein, 19 aa, Staphylococcus aureus
RRPNFEMDERLVLEKVNYD

SEQ ID NO: 1653890 - protein, 17 aa, Staphylococcus aureus
RVSEGKSIQVLVPKSVE

SEQ ID NO: 1653891 - protein, 18 aa, Staphylococcus aureus
SAEFAALAFKVMTDPYVG

SEQ ID NO: 1653892 - protein, 17 aa, Staphylococcus aureus
SEGKSIQVLVPKSVENY

SEQ ID NO: 1653893 - protein, 17 aa, Staphylococcus aureus
SEIPQAYQILGIGPVEL

SEQ ID NO: 1653894 - protein, 31 aa, Staphylococcus aureus
SGKTTLMRHIVSFLKSHGYTVATIKHHGHGK

SEQ ID NO: 1653895 - protein, 21 aa, Staphylococcus aureus
SGTVTPQGFFAIIEKPQYDIS

SEQ ID NO: 1653896 - protein, 19 aa, Staphylococcus aureus
SIAGFKEIEYEVMRDKNDN

SEQ ID NO: 1653897 - protein, 31 aa, Staphylococcus aureus
SLELSFGFKFLREIDNRLGLKVEQASIGQGV

SEQ ID NO: 1653898 - protein, 25 aa, Staphylococcus aureus
SNLKRGELITGDFDKLIYGIPQLIE

SEQ ID NO: 1653899 - protein, 20 aa, Staphylococcus aureus
SPKDFSINISDIVRYSILCM

SEQ ID NO: 1653900 - protein, 17 aa, Staphylococcus aureus
SPLLLGVGEGFNVIASD

SEQ ID NO: 1653901 - protein, 22 aa, Staphylococcus aureus
SQLTERISNMIGVHQVNINIID

SEQ ID NO: 1653902 - protein, 23 aa, Staphylococcus aureus
TIEAMSAAAIKFAQQFEENSTFK

SEQ ID NO: 1653903 - protein, 21 aa, Staphylococcus aureus
TKDFIKARWNQDFRLEDFKKV

SEQ ID NO: 1653904 - protein, 20 aa, Staphylococcus aureus
TKYKGDLLVLDKSEYFDTAD

SEQ ID NO: 1653905 - protein, 30 aa, Staphylococcus aureus
TLFYKLTSEHLVEFMPIIYDPVIAQSIEQY

SEQ ID NO: 1653906 - protein, 22 aa, Staphylococcus aureus
TMCYADCVPVYFYSTKHHFIAL

SEQ ID NO: 1653907 - protein, 22 aa, Staphylococcus aureus
TMRKEVIGGLGGFGATFDLSQL

SEQ ID NO: 1653908 - protein, 18 aa, Staphylococcus aureus
TPEFLIKRSHLLKKAKCI

SEQ ID NO: 1653909 - protein, 25 aa, Staphylococcus aureus
TRLNIVKDITFDKALPVAIREARAF

SEQ ID NO: 1653910 - protein, 18 aa, Staphylococcus aureus
TRSKLRRALPEQYVFIVE

SEQ ID NO: 1653911 - protein, 25 aa, Staphylococcus aureus
TTGEMKKRYGLIYVDRDNDGRGTME

SEQ ID NO: 1653912 - protein, 20 aa, Staphylococcus aureus
TVFFLNGFQMKGVIEEYDKY

SEQ ID NO: 1653913 - protein, 18 aa, Staphylococcus aureus
TYNFAVAIDDHYMQISDV

SEQ ID NO: 1653914 - protein, 20 aa, Staphylococcus aureus
VAIREARAFINTQLREYTFL

SEQ ID NO: 1653915 - protein, 23 aa, Staphylococcus aureus
VAKRAQRGITLLKELKKNPHRIV

SEQ ID NO: 1653916 - protein, 28 aa, Staphylococcus aureus
VATRLGHVKGYFIYPYQEVMKDSNVKLF

SEQ ID NO: 1653917 - protein, 25 aa, Staphylococcus aureus
VDGEIIFKHGLSLAQVQQIINLAKR

SEQ ID NO: 1653918 - protein, 28 aa, Staphylococcus aureus
VEKAKAQGLEAFDNIQIDSTEKQKAIEE

SEQ ID NO: 1653919 - protein, 23 aa, Staphylococcus aureus
VEVVDLRTVYPLDKETIIDRAKN

SEQ ID NO: 1653920 - protein, 24 aa, Staphylococcus aureus
VFDSKGGFYFTDFRGYSTNPLGGV

SEQ ID NO: 1653921 - protein, 23 aa, Staphylococcus aureus
VKDRLGKYLVEMAIQEGRVRAGQ

SEQ ID NO: 1653922 - protein, 18 aa, Staphylococcus aureus
VKPLLKYAHNRGIYTQMN

SEQ ID NO: 1653923 - protein, 19 aa, Staphylococcus aureus
VLTAIKIARIFNEKVETIF

SEQ ID NO: 1653924 - protein, 20 aa, Staphylococcus aureus
VPSYRAVLIYFDEQAITPSK

SEQ ID NO: 1653925 - protein, 19 aa, Staphylococcus aureus
VRTILKRNVRNVPVVDDKQ

SEQ ID NO: 1653926 - protein, 24 aa, Staphylococcus aureus
VSGESGLKYSIDYIVSETKSQPEK

SEQ ID NO: 1653927 - protein, 18 aa, Staphylococcus aureus
VSYVPKIELHMYGFGSES

SEQ ID NO: 1653928 - protein, 22 aa, Staphylococcus aureus
VTVCDETAWWSYMGQDNDIFKD

SEQ ID NO: 1653929 - protein, 17 aa, Staphylococcus aureus
VYEPFLIQKGFLERTPR

SEQ ID NO: 1653930 - protein, 17 aa, Staphylococcus aureus
WKSTSFKGYDVLIHTAA

SEQ ID NO: 1653931 - protein, 17 aa, Staphylococcus aureus
WLDGFDIECRNEESIHQ

SEQ ID NO: 1653932 - protein, 18 aa, Staphylococcus aureus
WRGKVSVRQLDYFNQESM

SEQ ID NO: 1653933 - protein, 21 aa, Staphylococcus aureus
WSEHCSYKHSKPFLKQFPTSG

SEQ ID NO: 1653934 - protein, 19 aa, Staphylococcus aureus
WVQEYAPILYQIWKKKHKK

SEQ ID NO: 1653935 - protein, 19 aa, Staphylococcus aureus
YAKEKKIDYVFADELLSHV

SEQ ID NO: 1653936 - protein, 17 aa, Staphylococcus aureus
YASRLLATSGIDYTYVR

SEQ ID NO: 1653937 - protein, 20 aa, Staphylococcus aureus
YDAIITLGCVIRGATSHYDY

SEQ ID NO: 1653938 - protein, 19 aa, Staphylococcus aureus
YDRFRNRIMFPLKNAQGRI

SEQ ID NO: 1653939 - protein, 24 aa, Staphylococcus aureus
YEELKGEYLQGVSFISETDTEVIV

SEQ ID NO: 1653940 - protein, 20 aa, Staphylococcus aureus
YIQAEGFAGGELKHGTIALI

SEQ ID NO: 1653941 - protein, 17 aa, Staphylococcus aureus
YLNQFFGSKRYLYQDNE

SEQ ID NO: 1653942 - protein, 17 aa, Staphylococcus aureus
YNRIGAEGMTSEAVDGR

SEQ ID NO: 1653943 - protein, 26 aa, Staphylococcus aureus
YSKDFLKYRFNLTFLDLSILYVISSR

SEQ ID NO: 1653944 - protein, 21 aa, Staphylococcus aureus
AANEAYKSWKTWSANDRAELM

SEQ ID NO: 1653945 - protein, 24 aa, Staphylococcus aureus
AAPTEIKFLLYFAKMTKKDKNKLY

SEQ ID NO: 1653946 - protein, 18 aa, Staphylococcus aureus
AFFEKCRDTGVYGLIIPD

SEQ ID NO: 1653947 - protein, 18 aa, Staphylococcus aureus
AGLKAIVVIPEGKIALGK

SEQ ID NO: 1653948 - protein, 18 aa, Staphylococcus aureus
AIDKAYFEKCLPGYTLIN

SEQ ID NO: 1653949 - protein, 25 aa, Staphylococcus aureus
AKELEREGFHILAIKDMAGLLKPKA

SEQ ID NO: 1653950 - protein, 25 aa, Staphylococcus aureus
AKRLMKRLKETQIYAVNPLADQLQL

SEQ ID NO: 1653951 - protein, 19 aa, Staphylococcus aureus
AKVTTPILVKAPIAGRRIL

SEQ ID NO: 1653952 - protein, 24 aa, Staphylococcus aureus
AMNLKLVDFKIEFGKTETGQILLA

SEQ ID NO: 1653953 - protein, 30 aa, Staphylococcus aureus
ANEISSMIPVEWEKVYTMAYIDDGGGEVFF

SEQ ID NO: 1653954 - protein, 19 aa, Staphylococcus aureus
ARFVNEYIRTLNVTQSAIK

SEQ ID NO: 1653955 - protein, 25 aa, Staphylococcus aureus
ASAVDLPEGLACEGRVVIQTGTVEN

SEQ ID NO: 1653956 - protein, 18 aa, Staphylococcus aureus
ASDIGVKYLTLYAFSTEN

SEQ ID NO: 1653957 - protein, 17 aa, Staphylococcus aureus
ASYQEYLTINGDCVLHE

SEQ ID NO: 1653958 - protein, 24 aa, Staphylococcus aureus
ATKFKAKYFQGFHNKFELKAEANG

SEQ ID NO: 1653959 - protein, 23 aa, Staphylococcus aureus
AVTPEHLESFIADKNMQTRTKNK

SEQ ID NO: 1653960 - protein, 20 aa, Staphylococcus aureus
AVTPRNYRWTSRTGTTGQTQ

SEQ ID NO: 1653961 - protein, 19 aa, Staphylococcus aureus
CDFYIKIPMVGHVNSLNAS

SEQ ID NO: 1653962 - protein, 20 aa, Staphylococcus aureus
CEIDPKCTYVQLNQIPVVDK

SEQ ID NO: 1653963 - protein, 18 aa, Staphylococcus aureus
CPNCKKKLTLFGKGKEAV

SEQ ID NO: 1653964 - protein, 27 aa, Staphylococcus aureus
DAAYLKEFTNLYALLIPKMNSMNDVKF

SEQ ID NO: 1653965 - protein, 25 aa, Staphylococcus aureus
DAEKGVYAHYMLKEIHEQPAVMRRI

SEQ ID NO: 1653966 - protein, 19 aa, Staphylococcus aureus
DDDKIKGLLEVATQQIDKV

SEQ ID NO: 1653967 - protein, 22 aa, Staphylococcus aureus
DDGGNFGCHFAFDEKDEREDIL

SEQ ID NO: 1653968 - protein, 26 aa, Staphylococcus aureus
DEAWHRLKYYVVVNHLGHLVSTIGKA

SEQ ID NO: 1653969 - protein, 17 aa, Staphylococcus aureus
DFAAFNLSIEDTVTVCL

SEQ ID NO: 1653970 - protein, 17 aa, Staphylococcus aureus
DGDTHCWLIIETLYAQT

SEQ ID NO: 1653971 - protein, 17 aa, Staphylococcus aureus
DGMDGFQLCNTLKNDYD

SEQ ID NO: 1653972 - protein, 28 aa, Staphylococcus aureus
DHHVPFRTAESWDNVGLLIGDEDVEVTG

SEQ ID NO: 1653973 - protein, 24 aa, Staphylococcus aureus
DKDGVPFIENWIKQYGSEAWTKQF

SEQ ID NO: 1653974 - protein, 24 aa, Staphylococcus aureus
DKEDIKAQRIMKVVQSIADKYGVS

SEQ ID NO: 1653975 - protein, 18 aa, Staphylococcus aureus
DKQLALKYRFNRLKLTTI

SEQ ID NO: 1653976 - protein, 25 aa, Staphylococcus aureus
DPHYIEVWGKFTPRGGISIDPYTNY

SEQ ID NO: 1653977 - protein, 24 aa, Staphylococcus aureus
DSIWRSMLEHVNWNMIDNGVPPKD

SEQ ID NO: 1653978 - protein, 18 aa, Staphylococcus aureus
DTEIGFYSPETFYQRSEK

SEQ ID NO: 1653979 - protein, 19 aa, Staphylococcus aureus
DTFIYCMSGQITLNLGKEV

SEQ ID NO: 1653980 - protein, 22 aa, Staphylococcus aureus
DVEIPKHLIIASRLSKGKYQIL

SEQ ID NO: 1653981 - protein, 36 aa, Staphylococcus aureus
DVIVSGVSIDHLWLYETNKYYALAMELIHQRVKFSA

SEQ ID NO: 1653982 - protein, 22 aa, Staphylococcus aureus
DYGFHIIIAGSFSDIFYMNCTK

SEQ ID NO: 1653983 - protein, 19 aa, Staphylococcus aureus
DYILPGYRDVPQIIWHGLP

SEQ ID NO: 1653984 - protein, 22 aa, Staphylococcus aureus
EDFKRYYPTNALVTGYDIIFFW

SEQ ID NO: 1653985 - protein, 24 aa, Staphylococcus aureus
EEIEAKLKLLQDITNLLNYIENRE

SEQ ID NO: 1653986 - protein, 17 aa, Staphylococcus aureus
EEISVRGRVLGISSQTR

SEQ ID NO: 1653987 - protein, 17 aa, Staphylococcus aureus
EGIDCTFIAVKLPYGVQ

SEQ ID NO: 1653988 - protein, 22 aa, Staphylococcus aureus
EILQSSPFVWFKDALDGYDYLV

SEQ ID NO: 1653989 - protein, 22 aa, Staphylococcus aureus
EIYELWRQTLIQVGINRPTYKR

SEQ ID NO: 1653990 - protein, 28 aa, Staphylococcus aureus
ELFKPDYIFVGMGFPKQEEWIMTHENQF

SEQ ID NO: 1653991 - protein, 26 aa, Staphylococcus aureus
ENIKSLFKDEVMQYFLSNRKIYPNIF

SEQ ID NO: 1653992 - protein, 21 aa, Staphylococcus aureus
ERLGIEMKDVMAIGDNLNDLS

SEQ ID NO: 1653993 - protein, 21 aa, Staphylococcus aureus
ERLGIEMKDVMAIGDNLNDVS

SEQ ID NO: 1653994 - protein, 27 aa, Staphylococcus aureus
ESMPDFKRLNGLMIGFVIKGEAHIYDE

SEQ ID NO: 1653995 - protein, 18 aa, Staphylococcus aureus
ETSYFKKTVNPFDHKAVP

SEQ ID NO: 1653996 - protein, 19 aa, Staphylococcus aureus
ETVEIQYDVALFSYNKLLE

SEQ ID NO: 1653997 - protein, 18 aa, Staphylococcus aureus
EVEEIIANVVIRGRHPNE

SEQ ID NO: 1653998 - protein, 21 aa, Staphylococcus aureus
EVHVASEFVYNMPLLSEKPLF

SEQ ID NO: 1653999 - protein, 25 aa, Staphylococcus aureus
EVVLWKLVAHRLMTWKKEYANNAVF

SEQ ID NO: 1654000 - protein, 24 aa, Staphylococcus aureus
EYCKEAVDLFGCIIYPNDTEIGFY

SEQ ID NO: 1654001 - protein, 25 aa, Staphylococcus aureus
FAEGIEVGQVFKLGTKYSESMNATF

SEQ ID NO: 1654002 - protein, 19 aa, Staphylococcus aureus
FARCFEMKEACYAATPAIQ

SEQ ID NO: 1654003 - protein, 17 aa, Staphylococcus aureus
FDFIIKLAKAIGIVGGV

SEQ ID NO: 1654004 - protein, 17 aa, Staphylococcus aureus
FKAHLPVNENTPKLTLN

SEQ ID NO: 1654005 - protein, 19 aa, Staphylococcus aureus
FLEAAGLYDAHLKDCPSKP

SEQ ID NO: 1654006 - protein, 19 aa, Staphylococcus aureus
FLESIKGYQDFHFEMYDHD

SEQ ID NO: 1654007 - protein, 19 aa, Staphylococcus aureus
FQLPNDVIKRDGSYQAQVS

SEQ ID NO: 1654008 - protein, 17 aa, Staphylococcus aureus
FSSNLIIIFKNVADEHR

SEQ ID NO: 1654009 - protein, 23 aa, Staphylococcus aureus
GASGPLYGFSFVKMSAVAKDDMD

SEQ ID NO: 1654010 - protein, 22 aa, Staphylococcus aureus
GEAEMSFEAFLEKAAVSSSQTV

SEQ ID NO: 1654011 - protein, 25 aa, Staphylococcus aureus
GEFKNYLGSIGKSFKEKFSKDMKDG

SEQ ID NO: 1654012 - protein, 20 aa, Staphylococcus aureus
GEIAKGLVFKPANHIIFGGP

SEQ ID NO: 1654013 - protein, 20 aa, Staphylococcus aureus
GESKFDILLFSSIGVIDGDY

SEQ ID NO: 1654014 - protein, 21 aa, Staphylococcus aureus
GIEAIICGIGINLTQQLEDFD

SEQ ID NO: 1654015 - protein, 28 aa, Staphylococcus aureus
GKGKSFLAKLLWIYTSFFKGQMLYWDPK

SEQ ID NO: 1654016 - protein, 17 aa, Staphylococcus aureus
GKSECWYIIDAEEDAEI

SEQ ID NO: 1654017 - protein, 19 aa, Staphylococcus aureus
GLVMEARSALAEIYGDIHA

SEQ ID NO: 1654018 - protein, 25 aa, Staphylococcus aureus
GNKKPLRRLWISSVTKKAIQQGFKN

SEQ ID NO: 1654019 - protein, 17 aa, Staphylococcus aureus
GNPKKSNAWGWANATRA

SEQ ID NO: 1654020 - protein, 17 aa, Staphylococcus aureus
GQGVLLVNHIQNIEPII

SEQ ID NO: 1654021 - protein, 25 aa, Staphylococcus aureus
GTGTRVLGGLTYRESHFALELLHQS

SEQ ID NO: 1654022 - protein, 17 aa, Staphylococcus aureus
GTIKIKGIHINGLEVDL

SEQ ID NO: 1654023 - protein, 17 aa, Staphylococcus aureus
GTNFKRLLKSLSPYVKV

SEQ ID NO: 1654024 - protein, 18 aa, Staphylococcus aureus
GVSTRPGHEMVTLEEELN

SEQ ID NO: 1654025 - protein, 25 aa, Staphylococcus aureus
GVTKACIEAGKYVYRTFVQGEMIET

SEQ ID NO: 1654026 - protein, 19 aa, Staphylococcus aureus
GYEKGGKGLSVIDVMTSGA

SEQ ID NO: 1654027 - protein, 28 aa, Staphylococcus aureus
HDEAWHRLKYYVVVNHLGHLVSTIGKAT

SEQ ID NO: 1654028 - protein, 17 aa, Staphylococcus aureus
HGYWAGVPIGTDKTDTK

SEQ ID NO: 1654029 - protein, 17 aa, Staphylococcus aureus
HIHILKPKDVVLDVDTI

SEQ ID NO: 1654030 - protein, 23 aa, Staphylococcus aureus
HIMRQKRVDTIFVVDRDNHLLGF

SEQ ID NO: 1654031 - protein, 17 aa, Staphylococcus aureus
HSEQNLFSRVKMISKNK

SEQ ID NO: 1654032 - protein, 30 aa, Staphylococcus aureus
HSGIHKRFYLFVALMTEFQALNGMRIGEML

SEQ ID NO: 1654033 - protein, 21 aa, Staphylococcus aureus
HSLGGRDAMILGMSNDIKHIV

SEQ ID NO: 1654034 - protein, 31 aa, Staphylococcus aureus
HSSSGRSPSQLGFRYYVNRLLEQTSHQKTNK

SEQ ID NO: 1654035 - protein, 18 aa, Staphylococcus aureus
IAPIFGLNKRQGRQLLAY

SEQ ID NO: 1654036 - protein, 20 aa, Staphylococcus aureus
IAQVFLKVTLSFMQYGALPE

SEQ ID NO: 1654037 - protein, 22 aa, Staphylococcus aureus
IARRMAKVVGAPFIKVEATKFT

SEQ ID NO: 1654038 - protein, 21 aa, Staphylococcus aureus
IDVAKRFNIPQAVETPSELFK

SEQ ID NO: 1654039 - protein, 18 aa, Staphylococcus aureus
IEAPFEHLYRIPKYTYEI

SEQ ID NO: 1654040 - protein, 24 aa, Staphylococcus aureus
IEDCIKFIEKWYFPTLPFQRFIIA

SEQ ID NO: 1654041 - protein, 28 aa, Staphylococcus aureus
IEKKLSRYPQLYSRIGFAHEFDNLSKDE

SEQ ID NO: 1654042 - protein, 22 aa, Staphylococcus aureus
IELKDGIPEVCYVRDLEGICLS

SEQ ID NO: 1654043 - protein, 24 aa, Staphylococcus aureus
IEQYKRTMFWSKFEIRQYTHSDIT

SEQ ID NO: 1654044 - protein, 26 aa, Staphylococcus aureus
IGTDIPFCIYNKTALCTGKGEKIEFL

SEQ ID NO: 1654045 - protein, 18 aa, Staphylococcus aureus
IIFQRELAGLGEYKYTAY

SEQ ID NO: 1654046 - protein, 17 aa, Staphylococcus aureus
IILRDLVDALLFEDIAG

SEQ ID NO: 1654047 - protein, 18 aa, Staphylococcus aureus
IITAIGYSGCEIDPKCTY

SEQ ID NO: 1654048 - protein, 17 aa, Staphylococcus aureus
IKGLLEVATQQIDKVIE

SEQ ID NO: 1654049 - protein, 25 aa, Staphylococcus aureus
IKLIEMNQGISFLPIYITTDSDYNI

SEQ ID NO: 1654050 - protein, 17 aa, Staphylococcus aureus
IKTHVSHIFSKLQVSDR

SEQ ID NO: 1654051 - protein, 24 aa, Staphylococcus aureus
INAIGKRWIVSHVEGENDKKEYVI

SEQ ID NO: 1654052 - protein, 27 aa, Staphylococcus aureus
INKIPLVRLKLNFSYDYKEKLKRELNQ

SEQ ID NO: 1654053 - protein, 26 aa, Staphylococcus aureus
IQLSYRLLPEVSLDCIIDDIFTSFDA

SEQ ID NO: 1654054 - protein, 24 aa, Staphylococcus aureus
ISFEIYKGETLGLVGESGCGKSTT

SEQ ID NO: 1654055 - protein, 20 aa, Staphylococcus aureus
ISNTYSLVGCMCQPAFEFKQ

SEQ ID NO: 1654056 - protein, 17 aa, Staphylococcus aureus
ITNKLALYVPTYREDKA

SEQ ID NO: 1654057 - protein, 17 aa, Staphylococcus aureus
KAKAWSEKHQFPLKHIN

SEQ ID NO: 1654058 - protein, 19 aa, Staphylococcus aureus
KALAMKAPLGIFSHQLQRF

SEQ ID NO: 1654059 - protein, 24 aa, Staphylococcus aureus
KDGQYRGIATWRYDQERQRLIGTI

SEQ ID NO: 1654060 - protein, 21 aa, Staphylococcus aureus
KDRSQRAKVFVRFSNFNELFQ

SEQ ID NO: 1654061 - protein, 30 aa, Staphylococcus aureus
KDTVYNVPFLWRLSSGLNVAQLQQAVQHLI

SEQ ID NO: 1654062 - protein, 17 aa, Staphylococcus aureus
KEDLKRIRNLTMKTEHD

SEQ ID NO: 1654063 - protein, 21 aa, Staphylococcus aureus
KELILKTVIDLVDKRVPVIAG

SEQ ID NO: 1654064 - protein, 17 aa, Staphylococcus aureus
KENGDWYKLEKLWEKAI

SEQ ID NO: 1654065 - protein, 26 aa, Staphylococcus aureus
KESLRKIKGGFTFAILTKDALYGAVD

SEQ ID NO: 1654066 - protein, 18 aa, Staphylococcus aureus
KHAEEIAHEIEVRSGYLR

SEQ ID NO: 1654067 - protein, 20 aa, Staphylococcus aureus
KKDVIDKILHFEKQMSQAAT

SEQ ID NO: 1654068 - protein, 18 aa, Staphylococcus aureus
KLEIIGSEGRGPGTRYYL

SEQ ID NO: 1654069 - protein, 23 aa, Staphylococcus aureus
KLNLELRIPIIMISGNHDGKERL

SEQ ID NO: 1654070 - protein, 21 aa, Staphylococcus aureus
KLQDLEFLKDITLNKRIKSYD

SEQ ID NO: 1654071 - protein, 25 aa, Staphylococcus aureus
KNGFKTTLGLILEKFIEYVSKPKYE

SEQ ID NO: 1654072 - protein, 17 aa, Staphylococcus aureus
KPLKTLMLLHGLSSDET

SEQ ID NO: 1654073 - protein, 26 aa, Staphylococcus aureus
KQYFPATHWKAINGIPYAGSSDIDGL

SEQ ID NO: 1654074 - protein, 18 aa, Staphylococcus aureus
KSALLKKLGGAWFSDSLV

SEQ ID NO: 1654075 - protein, 20 aa, Staphylococcus aureus
KSITCKSIVGLNPERLRVTG

SEQ ID NO: 1654076 - protein, 23 aa, Staphylococcus aureus
KSLNINGTIHWFHDESGGFGVKD

SEQ ID NO: 1654077 - protein, 20 aa, Staphylococcus aureus
KSTLLLQICASLSQKKKVLY

SEQ ID NO: 1654078 - protein, 25 aa, Staphylococcus aureus
KWNIIRPPFNVTRISEYAAVAALED

SEQ ID NO: 1654079 - protein, 19 aa, Staphylococcus aureus
KYGPGELITSDFNGYLITK

SEQ ID NO: 1654080 - protein, 19 aa, Staphylococcus aureus
KYSLCKVHLHTGRTHQIRV

SEQ ID NO: 1654081 - protein, 20 aa, Staphylococcus aureus
KYSTEPILDILVGVENLHDI

SEQ ID NO: 1654082 - protein, 31 aa, Staphylococcus aureus
LAKLADRLGFKRIWFTEHHNVPAFACSSPEL

SEQ ID NO: 1654083 - protein, 17 aa, Staphylococcus aureus
LDVLIHHAIDHLNDEYQ

SEQ ID NO: 1654084 - protein, 18 aa, Staphylococcus aureus
LDVLQEIVKGFGYSYRDY

SEQ ID NO: 1654085 - protein, 24 aa, Staphylococcus aureus
LEDFKAAHIDTSYIIKTAEAKTGQ

SEQ ID NO: 1654086 - protein, 18 aa, Staphylococcus aureus
LEGRPCTIGYDLSETEDF

SEQ ID NO: 1654087 - protein, 20 aa, Staphylococcus aureus
LEILDLLSCGELCACDLLEH

SEQ ID NO: 1654088 - protein, 23 aa, Staphylococcus aureus
LERELEKRFGIKEMVKVQDKALI

SEQ ID NO: 1654089 - protein, 17 aa, Staphylococcus aureus
LESKSGGKSGDFQRQSG

SEQ ID NO: 1654090 - protein, 18 aa, Staphylococcus aureus
LEYLKYAKDYGFSDKTIA

SEQ ID NO: 1654091 - protein, 24 aa, Staphylococcus aureus
LFKGQDLVYFMPREFIEGRDINDI

SEQ ID NO: 1654092 - protein, 23 aa, Staphylococcus aureus
LIDFCKHRHFTLCIEEVFDTTVT

SEQ ID NO: 1654093 - protein, 23 aa, Staphylococcus aureus
LLADLELPLAKILSEMEEIGIYT

SEQ ID NO: 1654094 - protein, 23 aa, Staphylococcus aureus
LLARFDISLATLLGVHQGLGHNT

SEQ ID NO: 1654095 - protein, 26 aa, Staphylococcus aureus
LLIEVLKSRVIRHAYLDVFENEPLKP

SEQ ID NO: 1654096 - protein, 20 aa, Staphylococcus aureus
LMIEYLRFANCTQELTIEKY

SEQ ID NO: 1654097 - protein, 20 aa, Staphylococcus aureus
LNGEYGYEVLKMYADNKTIN

SEQ ID NO: 1654098 - protein, 19 aa, Staphylococcus aureus
LNHAMPILLVSGYDDPLGD

SEQ ID NO: 1654099 - protein, 28 aa, Staphylococcus aureus
LRKAEQYKRLEFNLSIALDDVESTAKDV

SEQ ID NO: 1654100 - protein, 17 aa, Staphylococcus aureus
LRMSDQMSIQYLNNDFW

SEQ ID NO: 1654101 - protein, 17 aa, Staphylococcus aureus
LTIPEIFSKHGEQYFRN

SEQ ID NO: 1654102 - protein, 22 aa, Staphylococcus aureus
LTRERVANVFQLPSVFLNARSN

SEQ ID NO: 1654103 - protein, 33 aa, Staphylococcus aureus
MEMLKDLKKGQCIFSDFYGRVGKMVVHCPFEEM

SEQ ID NO: 1654104 - protein, 17 aa, Staphylococcus aureus
MGYGIVFLGSLRNDVAR

SEQ ID NO: 1654105 - protein, 18 aa, Staphylococcus aureus
MIYDRRKDLIISGGENIY

SEQ ID NO: 1654106 - protein, 24 aa, Staphylococcus aureus
MIYQLGALQGFCRIHQVKINHVKP

SEQ ID NO: 1654107 - protein, 19 aa, Staphylococcus aureus
MKQAEKFNRPIFTFIDTKG

SEQ ID NO: 1654108 - protein, 21 aa, Staphylococcus aureus
MQRLMATGGLEIFATDDPEIT

SEQ ID NO: 1654109 - protein, 19 aa, Staphylococcus aureus
MSGQITLNLGKEVYQAQEE

SEQ ID NO: 1654110 - protein, 17 aa, Staphylococcus aureus
MTPYFPKPDVMIYLECN

SEQ ID NO: 1654111 - protein, 18 aa, Staphylococcus aureus
MVFELPITATERASIKHS

SEQ ID NO: 1654112 - protein, 18 aa, Staphylococcus aureus
MVFELPITATERASINHS

SEQ ID NO: 1654113 - protein, 22 aa, Staphylococcus aureus
NDTLCVLNHLYINEGQEETFEQ

SEQ ID NO: 1654114 - protein, 35 aa, Staphylococcus aureus
NDTVASMIIEFVEWINTLEFFKNWKKQPGKPLDTQ

SEQ ID NO: 1654115 - protein, 17 aa, Staphylococcus aureus
NDYAKIIMSHNVTAQVR

SEQ ID NO: 1654116 - protein, 18 aa, Staphylococcus aureus
NHYAFERIAQMLIESSVD

SEQ ID NO: 1654117 - protein, 17 aa, Staphylococcus aureus
NIFEISKDITIEETGHI

SEQ ID NO: 1654118 - protein, 18 aa, Staphylococcus aureus
NKVEVIKEIIKKVRGGNH

SEQ ID NO: 1654119 - protein, 22 aa, Staphylococcus aureus
NQGEALKSIILNKFPDKKIDII

SEQ ID NO: 1654120 - protein, 24 aa, Staphylococcus aureus
NRKNIPFDELVLFSSARSAGKEVE

SEQ ID NO: 1654121 - protein, 20 aa, Staphylococcus aureus
NRPNVRQGLKQAGVYIPETT

SEQ ID NO: 1654122 - protein, 20 aa, Staphylococcus aureus
NTVRYVYNRNLPKSLIEELK

SEQ ID NO: 1654123 - protein, 17 aa, Staphylococcus aureus
NYGLPYLKDTLRRLNYP

SEQ ID NO: 1654124 - protein, 19 aa, Staphylococcus aureus
PAVAFRLFKQLVEERYGKE

SEQ ID NO: 1654125 - protein, 19 aa, Staphylococcus aureus
PGQEIEFFGPEIETFTQVV

SEQ ID NO: 1654126 - protein, 18 aa, Staphylococcus aureus
PKDLRMSDQMSIQYLNND

SEQ ID NO: 1654127 - protein, 22 aa, Staphylococcus aureus
PKLAAALTQYKWVRESNEGVGR

SEQ ID NO: 1654128 - protein, 28 aa, Staphylococcus aureus
PMIYGAHCPGNFQRLMQLSKRLPIIPNI

SEQ ID NO: 1654129 - protein, 18 aa, Staphylococcus aureus
PMMMEGKWQSTIHRQLIE

SEQ ID NO: 1654130 - protein, 26 aa, Staphylococcus aureus
PQPGDWGVWTGGWAGHVNIVVGPCTK

SEQ ID NO: 1654131 - protein, 17 aa, Staphylococcus aureus
PRIGIPNKGDWTHKSLR

SEQ ID NO: 1654132 - protein, 26 aa, Staphylococcus aureus
PSQMGIRKPEFSSAISTISSSIAFDE

SEQ ID NO: 1654133 - protein, 20 aa, Staphylococcus aureus
QDAKDCLQKGAFVSDKDGDM

SEQ ID NO: 1654134 - protein, 23 aa, Staphylococcus aureus
QDAKDCLQKGAFVSDKDGDMHYD

SEQ ID NO: 1654135 - protein, 20 aa, Staphylococcus aureus
QEVLEDLGIEEAEFEQAFLN

SEQ ID NO: 1654136 - protein, 23 aa, Staphylococcus aureus
QFNPDLFYGFQCYDYANMFFMIA

SEQ ID NO: 1654137 - protein, 23 aa, Staphylococcus aureus
QIKKGYCLLVGIGQDSTEQDADV

SEQ ID NO: 1654138 - protein, 21 aa, Staphylococcus aureus
QKGVFDIFDYVMLGHLHHPFS

SEQ ID NO: 1654139 - protein, 19 aa, Staphylococcus aureus
QKLNGGMGILLGGVPGVPK

SEQ ID NO: 1654140 - protein, 17 aa, Staphylococcus aureus
QNKGVPVILDCSGATLQ

SEQ ID NO: 1654141 - protein, 17 aa, Staphylococcus aureus
QNMPFPVECHVKAKIIN

SEQ ID NO: 1654142 - protein, 20 aa, Staphylococcus aureus
QPAFEFKQFELFKQSELITQ

SEQ ID NO: 1654143 - protein, 26 aa, Staphylococcus aureus
QPWQHFIIGSLFGWVHKETKLRRFKE

SEQ ID NO: 1654144 - protein, 20 aa, Staphylococcus aureus
QRERPGRGYIHHIAVNTPQM

SEQ ID NO: 1654145 - protein, 21 aa, Staphylococcus aureus
QRLNLDYIDLVLIHQPYNDVY

SEQ ID NO: 1654146 - protein, 28 aa, Staphylococcus aureus
QSRLKKSLKQSLSLDFLVLRESYPEADP

SEQ ID NO: 1654147 - protein, 19 aa, Staphylococcus aureus
QVNHRGWEDLASKTTDDIL

SEQ ID NO: 1654148 - protein, 19 aa, Staphylococcus aureus
QWFIQGRIDFQIKLNGYRM

SEQ ID NO: 1654149 - protein, 24 aa, Staphylococcus aureus
RAFIKRGLLQFADGNGFQCGIWYE

SEQ ID NO: 1654150 - protein, 21 aa, Staphylococcus aureus
RAVAKSVTFSTGHFKDSEENE

SEQ ID NO: 1654151 - protein, 18 aa, Staphylococcus aureus
REVNPNKFLFIVHNEGIL

SEQ ID NO: 1654152 - protein, 26 aa, Staphylococcus aureus
REVTGSGVFIEWVFMFVIKSDDYRDC

SEQ ID NO: 1654153 - protein, 20 aa, Staphylococcus aureus
RKLLLHKREIFKLGEQTREI

SEQ ID NO: 1654154 - protein, 17 aa, Staphylococcus aureus
RLMKQAEKFNRPIFTFI

SEQ ID NO: 1654155 - protein, 20 aa, Staphylococcus aureus
RSEAPFKKALLYAPLYPVEV

SEQ ID NO: 1654156 - protein, 36 aa, Staphylococcus aureus
RVDNVFPTKHAIGLKADNGLELLVHIGLDTVQLDGE

SEQ ID NO: 1654157 - protein, 17 aa, Staphylococcus aureus
RVGKMVVHCPFEEMTEA

SEQ ID NO: 1654158 - protein, 28 aa, Staphylococcus aureus
RVREILDLPDYVFPVFGMAVGEPADDEN

SEQ ID NO: 1654159 - protein, 23 aa, Staphylococcus aureus
SAIIAEHCLFDLDAPIMRLAAPD

SEQ ID NO: 1654160 - protein, 20 aa, Staphylococcus aureus
SELTYLTFVYKVAAMDFIFK

SEQ ID NO: 1654161 - protein, 23 aa, Staphylococcus aureus
SIGTACLNNGKFSMSKIVHHPHI

SEQ ID NO: 1654162 - protein, 36 aa, Staphylococcus aureus
SIQNHWLFKEKRTFSKFEAWIYLLMEANHSKAKVPI

SEQ ID NO: 1654163 - protein, 19 aa, Staphylococcus aureus
SKVQPCCFKLYNDPFDMAY

SEQ ID NO: 1654164 - protein, 18 aa, Staphylococcus aureus
SLYKRGGTIYAHVMHTHL

SEQ ID NO: 1654165 - protein, 20 aa, Staphylococcus aureus
SMAEWDVMNIIWGKKSVSAN

SEQ ID NO: 1654166 - protein, 17 aa, Staphylococcus aureus
SMLQLPQVDSFVNLMAS

SEQ ID NO: 1654167 - protein, 22 aa, Staphylococcus aureus
SYKEGVKAFAKMKGNLPDAILC

SEQ ID NO: 1654168 - protein, 24 aa, Staphylococcus aureus
TDAELFGYCYGVAGTVGEVLTPIL

SEQ ID NO: 1654169 - protein, 23 aa, Staphylococcus aureus
TDEKYFGGSFERLQALTTKTTLP

SEQ ID NO: 1654170 - protein, 23 aa, Staphylococcus aureus
TDIKYSNGFIKEGTYRTETIGSK

SEQ ID NO: 1654171 - protein, 18 aa, Staphylococcus aureus
TEAAIAYQSGFNCNMAAI

SEQ ID NO: 1654172 - protein, 21 aa, Staphylococcus aureus
TEHSRRYLLDEGFNKANIFVT

SEQ ID NO: 1654173 - protein, 17 aa, Staphylococcus aureus
TGIGPKSALAILATSTP

SEQ ID NO: 1654174 - protein, 18 aa, Staphylococcus aureus
TKDYWYGVDQNWYTNNAT

SEQ ID NO: 1654175 - protein, 22 aa, Staphylococcus aureus
TKFPGIGKKTARQIVLDLKGKV

SEQ ID NO: 1654176 - protein, 25 aa, Staphylococcus aureus
TKLRRFKEALIFMGRKNGKTTTISG

SEQ ID NO: 1654177 - protein, 17 aa, Staphylococcus aureus
TLMKVILGYSSFQSGNF

SEQ ID NO: 1654178 - protein, 23 aa, Staphylococcus aureus
TPTKAGYFVTCWTKDENNCNQPY

SEQ ID NO: 1654179 - protein, 17 aa, Staphylococcus aureus
TPYEGGIAFASKPLIDA

SEQ ID NO: 1654180 - protein, 25 aa, Staphylococcus aureus
VAIDLKINLMFSKVGVPRGRGKIER

SEQ ID NO: 1654181 - protein, 28 aa, Staphylococcus aureus
VAQSGRYSYHFNKIYFLRISTLPLSLGQ

SEQ ID NO: 1654182 - protein, 20 aa, Staphylococcus aureus
VDGFHPINIGKLYIDEQTFV

SEQ ID NO: 1654183 - protein, 17 aa, Staphylococcus aureus
VDIRKQFTYDYTALDIK

SEQ ID NO: 1654184 - protein, 22 aa, Staphylococcus aureus
VEPDVKMYVQMSGDFGTIAYSW

SEQ ID NO: 1654185 - protein, 19 aa, Staphylococcus aureus
VERTNLPVVETFQGAGVIS

SEQ ID NO: 1654186 - protein, 18 aa, Staphylococcus aureus
VFEYTRRIYKLQDLEFLK

SEQ ID NO: 1654187 - protein, 18 aa, Staphylococcus aureus
VGISMSKLGLISRTAQGV

SEQ ID NO: 1654188 - protein, 23 aa, Staphylococcus aureus
VKGTTYKIYFGFADRQTYEDFKN

SEQ ID NO: 1654189 - protein, 30 aa, Staphylococcus aureus
VSDTAVMIAWLVKIPHSIMPILGTSQLKRI

SEQ ID NO: 1654190 - protein, 25 aa, Staphylococcus aureus
VSGESGLKYSIDYIVSETKSQPEKL

SEQ ID NO: 1654191 - protein, 27 aa, Staphylococcus aureus
VSGHAIDACGINGLYIKNCSFEGFVDY

SEQ ID NO: 1654192 - protein, 18 aa, Staphylococcus aureus
VSMLGVVPVIRALREKAM

SEQ ID NO: 1654193 - protein, 18 aa, Staphylococcus aureus
VVHCPFEEMTEAFRTQED

SEQ ID NO: 1654194 - protein, 26 aa, Staphylococcus aureus
VYKMIKQRMVDAFILLYSKENDPIKQ

SEQ ID NO: 1654195 - protein, 26 aa, Staphylococcus aureus
WAETKKLTGWYARRIAVGRDGEIQGV

SEQ ID NO: 1654196 - protein, 20 aa, Staphylococcus aureus
WNIPEGITMDQYLARKKKNS

SEQ ID NO: 1654197 - protein, 17 aa, Staphylococcus aureus
WRLEDLPIIPKYMKTVV

SEQ ID NO: 1654198 - protein, 18 aa, Staphylococcus aureus
YAALLVPFDENGQVNEQG

SEQ ID NO: 1654199 - protein, 19 aa, Staphylococcus aureus
YADLKILYSPASDQNYRYA

SEQ ID NO: 1654200 - protein, 17 aa, Staphylococcus aureus
YANNAVFIDCVEDLYQT

SEQ ID NO: 1654201 - protein, 24 aa, Staphylococcus aureus
YAVLKSPVKEVGWDDVYLESEIIP

SEQ ID NO: 1654202 - protein, 17 aa, Staphylococcus aureus
YEVLKMYADNKTINRDK

SEQ ID NO: 1654203 - protein, 17 aa, Staphylococcus aureus
YGLVLWSSLGRVIDVPT

SEQ ID NO: 1654204 - protein, 19 aa, Staphylococcus aureus
YIIEIMKIRQRVMEMLLLP

SEQ ID NO: 1654205 - protein, 18 aa, Staphylococcus aureus
YIQGMPFGHEFSGVVDAI

SEQ ID NO: 1654206 - protein, 17 aa, Staphylococcus aureus
YIYHFIVEGNRRLEKPK

SEQ ID NO: 1654207 - protein, 17 aa, Staphylococcus aureus
YKLEIEMLKQQQFDPEL

SEQ ID NO: 1654208 - protein, 17 aa, Staphylococcus aureus
YKLTIPEIFSKHGEQYF

SEQ ID NO: 1654209 - protein, 17 aa, Staphylococcus aureus
YKQIEDLLEFAKKEEHI

SEQ ID NO: 1654210 - protein, 18 aa, Staphylococcus aureus
YRLLRPVKGTTYKIYFGF

SEQ ID NO: 1654211 - protein, 18 aa, Staphylococcus aureus
YSGCEIDPKCTYVQLNQI

SEQ ID NO: 1654212 - protein, 29 aa, Staphylococcus aureus
YSKEVPPLMCASLWSKFDLFKKYANSELI

SEQ ID NO: 1654213 - protein, 19 aa, Staphylococcus aureus
YTLNQFKAAPLIVTEDTLQ

SEQ ID NO: 1654214 - protein, 19 aa, Staphylococcus aureus
YTSFFKGQMLYWDPKSEFA

SEQ ID NO: 1654215 - protein, 17 aa, Staphylococcus aureus
AAILSGKIDKKWLEGKN

SEQ ID NO: 1654216 - protein, 17 aa, Staphylococcus aureus
ADNDIELMLGAILVQNT

SEQ ID NO: 1654217 - protein, 17 aa, Staphylococcus aureus
ADNDIEMMLGAILVQNT

SEQ ID NO: 1654218 - protein, 18 aa, Staphylococcus aureus
ADSSDFDGPVGIGHTRWA

SEQ ID NO: 1654219 - protein, 25 aa, Staphylococcus aureus
AEHFSKLNVPFIYRVHEQPKSDRLR

SEQ ID NO: 1654220 - protein, 17 aa, Staphylococcus aureus
AENLGVPIYLHPAPVNS

SEQ ID NO: 1654221 - protein, 22 aa, Staphylococcus aureus
AIDELPVIALLCTQAVGTSTIK

SEQ ID NO: 1654222 - protein, 23 aa, Staphylococcus aureus
AIDELPVIALLCTQAVGTSTIKD

SEQ ID NO: 1654223 - protein, 17 aa, Staphylococcus aureus
AIEMANKMKDGFKNKGY

SEQ ID NO: 1654224 - protein, 22 aa, Staphylococcus aureus
AIPVCGFAWIHWSVANVSITGD

SEQ ID NO: 1654225 - protein, 24 aa, Staphylococcus aureus
AIRRRAVPTWGVFLNEEAQGGGPL

SEQ ID NO: 1654226 - protein, 39 aa, Staphylococcus aureus
AKCTKAQFIKRLACLPTHIYRLKGFMTFEDTAHTYLIQF

SEQ ID NO: 1654227 - protein, 19 aa, Staphylococcus aureus
AKFDLSFIIEEDCDDYTIN

SEQ ID NO: 1654228 - protein, 18 aa, Staphylococcus aureus
AKNAVVIGRSHIVGQPVS

SEQ ID NO: 1654229 - protein, 26 aa, Staphylococcus aureus
AKNVEKAGAVALVLEAIPNDLAEEIS

SEQ ID NO: 1654230 - protein, 20 aa, Staphylococcus aureus
AKQGYVYQSFCYQILKEDIG

SEQ ID NO: 1654231 - protein, 22 aa, Staphylococcus aureus
AKYKSGKLILDERNFESLIRQF

SEQ ID NO: 1654232 - protein, 33 aa, Staphylococcus aureus
ALALNEEFDLLALRKSVIRWCELLLTNKPMALI

SEQ ID NO: 1654233 - protein, 24 aa, Staphylococcus aureus
ALESAGNMTKFWEIFYERIDVLHD

SEQ ID NO: 1654234 - protein, 23 aa, Staphylococcus aureus
ANIYYKSIIKITITVKVGTNLQT

SEQ ID NO: 1654235 - protein, 23 aa, Staphylococcus aureus
AQMKPKDTIQFKWISFQEAVDKN

SEQ ID NO: 1654236 - protein, 18 aa, Staphylococcus aureus
ASDKAWAHSKSIWRGTSK

SEQ ID NO: 1654237 - protein, 25 aa, Staphylococcus aureus
ASIPLQMCSIMEDFYIEKLITGGAT

SEQ ID NO: 1654238 - protein, 18 aa, Staphylococcus aureus
ATEIPRLINTAIAERRPV

SEQ ID NO: 1654239 - protein, 19 aa, Staphylococcus aureus
AVGNADVTYGLAIDGDKVT

SEQ ID NO: 1654240 - protein, 19 aa, Staphylococcus aureus
AYINITGLGFAKLTKEGAE

SEQ ID NO: 1654241 - protein, 25 aa, Staphylococcus aureus
CAGGIARPAASHALHYDVLPDRLVT

SEQ ID NO: 1654242 - protein, 18 aa, Staphylococcus aureus
CARQFLWSTAKGYQQYKD

SEQ ID NO: 1654243 - protein, 19 aa, Staphylococcus aureus
CGELCACDLLAHFQFSQPT

SEQ ID NO: 1654244 - protein, 21 aa, Staphylococcus aureus
CLSRMKMQGYMPVKRIEKPVF

SEQ ID NO: 1654245 - protein, 17 aa, Staphylococcus aureus
CPLTIRAPFGGGVHGGL

SEQ ID NO: 1654246 - protein, 18 aa, Staphylococcus aureus
DAEITFDMEKVIQKEITV

SEQ ID NO: 1654247 - protein, 26 aa, Staphylococcus aureus
DAEKELAESVLPFHPLFIKPNKDELE

SEQ ID NO: 1654248 - protein, 18 aa, Staphylococcus aureus
DALQYFIDCMPKSEWLKR

SEQ ID NO: 1654249 - protein, 19 aa, Staphylococcus aureus
DAYTTKALFEKWFHPKDAS

SEQ ID NO: 1654250 - protein, 26 aa, Staphylococcus aureus
DELNDGVAPGVPWKNGPVPVDKAIYG

SEQ ID NO: 1654251 - protein, 18 aa, Staphylococcus aureus
DFDSIFRRMMQDMQGSNQ

SEQ ID NO: 1654252 - protein, 22 aa, Staphylococcus aureus
DFLYTCRQKIKLLDITYNEKQQ

SEQ ID NO: 1654253 - protein, 19 aa, Staphylococcus aureus
DFNRYIIEIMKIRQRVMEM

SEQ ID NO: 1654254 - protein, 20 aa, Staphylococcus aureus
DKRQFSAFVGTDLDLQLRRR

SEQ ID NO: 1654255 - protein, 18 aa, Staphylococcus aureus
DKTVVCFVGDGGFQMTNQ

SEQ ID NO: 1654256 - protein, 21 aa, Staphylococcus aureus
DLNHGLPILVVDGNMTKAQVN

SEQ ID NO: 1654257 - protein, 18 aa, Staphylococcus aureus
DMVKDGRLTSAHGRTLLA

SEQ ID NO: 1654258 - protein, 30 aa, Staphylococcus aureus
DNASWRGPNKFKIQCVILICYYYDNLQNYM

SEQ ID NO: 1654259 - protein, 18 aa, Staphylococcus aureus
DNPLMRWFTNNVAVKIKP

SEQ ID NO: 1654260 - protein, 18 aa, Staphylococcus aureus
DQAKHVFDSTGLLNISYQ

SEQ ID NO: 1654261 - protein, 21 aa, Staphylococcus aureus
DRLKVQHLEQLRAIYDEHNLA

SEQ ID NO: 1654262 - protein, 19 aa, Staphylococcus aureus
DRYKFVLTPFANQKASYFI

SEQ ID NO: 1654263 - protein, 19 aa, Staphylococcus aureus
DVAKGKYYAGLSYEQDART

SEQ ID NO: 1654264 - protein, 22 aa, Staphylococcus aureus
DVQLIFCTLPLELRGFQIVSLD

SEQ ID NO: 1654265 - protein, 18 aa, Staphylococcus aureus
DVVACCLDVGEGKDLDIV

SEQ ID NO: 1654266 - protein, 22 aa, Staphylococcus aureus
DVVFRLKALAQFTMRTAKVQQQ

SEQ ID NO: 1654267 - protein, 28 aa, Staphylococcus aureus
EAMVRLSQDWKLRHVLIEMHGNNGSIDN

SEQ ID NO: 1654268 - protein, 25 aa, Staphylococcus aureus
EAVEAAIKIARKWGSDVKGITDGQV

SEQ ID NO: 1654269 - protein, 36 aa, Staphylococcus aureus
EEAQRFASDWSEVRPEWGLAKNASFIIGRRQLTKGI

SEQ ID NO: 1654270 - protein, 23 aa, Staphylococcus aureus
EELESALLKADFIVHLAGVNRPE

SEQ ID NO: 1654271 - protein, 28 aa, Staphylococcus aureus
EFCDACIKYQYIGICYGQPGVGKTLSSR

SEQ ID NO: 1654272 - protein, 17 aa, Staphylococcus aureus
EFIDAYRELKMIVPTPH

SEQ ID NO: 1654273 - protein, 28 aa, Staphylococcus aureus
EGLNFAGVHKLPFVCVIINNKYAISVPD

SEQ ID NO: 1654274 - protein, 29 aa, Staphylococcus aureus
EGLNFAGVHKLPFVCVIINNKYAISVPDS

SEQ ID NO: 1654275 - protein, 20 aa, Staphylococcus aureus
EGSKLFAKKIMKKYNIPTAD

SEQ ID NO: 1654276 - protein, 25 aa, Staphylococcus aureus
EITDYAKSISFNFASYMSASKFFKD

SEQ ID NO: 1654277 - protein, 19 aa, Staphylococcus aureus
EKEPKLAIIAEIKSKSPTV

SEQ ID NO: 1654278 - protein, 17 aa, Staphylococcus aureus
EKLRKDIGIVFQNPDNQ

SEQ ID NO: 1654279 - protein, 21 aa, Staphylococcus aureus
ELDVAPMFKSLIGKDISEEDA

SEQ ID NO: 1654280 - protein, 17 aa, Staphylococcus aureus
ELIKCIKIYQSRQRRFG

SEQ ID NO: 1654281 - protein, 19 aa, Staphylococcus aureus
ELTPLIGKKVIVKGKEIGL

SEQ ID NO: 1654282 - protein, 22 aa, Staphylococcus aureus
ENDEVLEYFGLKVLVDKEDAPV

SEQ ID NO: 1654283 - protein, 22 aa, Staphylococcus aureus
ENLDCNYRLLGSKVDPKNILSK

SEQ ID NO: 1654284 - protein, 25 aa, Staphylococcus aureus
ENMNAWLKPYRRALHLEEPVVKIIE

SEQ ID NO: 1654285 - protein, 26 aa, Staphylococcus aureus
EPPISVKDGGLFKVGFNTQLDEYLEA

SEQ ID NO: 1654286 - protein, 23 aa, Staphylococcus aureus
EQDFDLLFVKWIPREQNKEANQH

SEQ ID NO: 1654287 - protein, 19 aa, Staphylococcus aureus
EQLLLAIRTVYKGETYVDM

SEQ ID NO: 1654288 - protein, 19 aa, Staphylococcus aureus
ESKYKVYIIDEVHMLTTGA

SEQ ID NO: 1654289 - protein, 17 aa, Staphylococcus aureus
ESLIRQFDFEAVDKQNI

SEQ ID NO: 1654290 - protein, 22 aa, Staphylococcus aureus
ESLVGAKFVKLFTDIDLNDDEV

SEQ ID NO: 1654291 - protein, 17 aa, Staphylococcus aureus
ESNRLTVLLGDNGAGKS

SEQ ID NO: 1654292 - protein, 19 aa, Staphylococcus aureus
EVHFVFDLSLMEIRTIYRM

SEQ ID NO: 1654293 - protein, 24 aa, Staphylococcus aureus
EVKKRMVISDAYAFTKSNHIESQV

SEQ ID NO: 1654294 - protein, 19 aa, Staphylococcus aureus
EWLYCAKANLVLEPAYTGE

SEQ ID NO: 1654295 - protein, 18 aa, Staphylococcus aureus
EYKQLLLQNGYYQDKLNT

SEQ ID NO: 1654296 - protein, 28 aa, Staphylococcus aureus
FAESFMRPCQLAKMISRYMIINETDRIL

SEQ ID NO: 1654297 - protein, 24 aa, Staphylococcus aureus
FALKKRGKNAVAITYTGDGGSSQG

SEQ ID NO: 1654298 - protein, 26 aa, Staphylococcus aureus
FATFGSFRPWPAYQYTIEHSIYVDAS

SEQ ID NO: 1654299 - protein, 19 aa, Staphylococcus aureus
FDCLLKGIHDRGMKLILDL

SEQ ID NO: 1654300 - protein, 23 aa, Staphylococcus aureus
FDLLLRKIEDMILPKKSVSKVKQ

SEQ ID NO: 1654301 - protein, 26 aa, Staphylococcus aureus
FELKHQFTHLTWKIKVYAVSGTINIE

SEQ ID NO: 1654302 - protein, 26 aa, Staphylococcus aureus
FELLKRFSNNMIIIFKNVADEHRDIV

SEQ ID NO: 1654303 - protein, 17 aa, Staphylococcus aureus
FEPRTAAIKDFWEKVGL

SEQ ID NO: 1654304 - protein, 17 aa, Staphylococcus aureus
FESQAKYSYLIVEKGFA

SEQ ID NO: 1654305 - protein, 21 aa, Staphylococcus aureus
FGLNKRQGRQLLAYLGAPKQL

SEQ ID NO: 1654306 - protein, 18 aa, Staphylococcus aureus
FGPTITVKALLNMRMENK

SEQ ID NO: 1654307 - protein, 24 aa, Staphylococcus aureus
FHISHLGGALPFFMTRIKDNYEDW

SEQ ID NO: 1654308 - protein, 17 aa, Staphylococcus aureus
FHMSPYFGYASRLLSTS

SEQ ID NO: 1654309 - protein, 20 aa, Staphylococcus aureus
FIAASLEAPIYVLSNIAGVL

SEQ ID NO: 1654310 - protein, 17 aa, Staphylococcus aureus
FIFASSAAVYGDLPDLP

SEQ ID NO: 1654311 - protein, 19 aa, Staphylococcus aureus
FIKDKVIDIMNMFQNHTDI

SEQ ID NO: 1654312 - protein, 24 aa, Staphylococcus aureus
FKTEVQSSLPFKLTGDVSCNHAPK

SEQ ID NO: 1654313 - protein, 17 aa, Staphylococcus aureus
FKVYEDDYVYAFLDISQ

SEQ ID NO: 1654314 - protein, 17 aa, Staphylococcus aureus
FNFASYMSASKFFKDYA

SEQ ID NO: 1654315 - protein, 20 aa, Staphylococcus aureus
FNMYKKITIILGEDTESFVW

SEQ ID NO: 1654316 - protein, 26 aa, Staphylococcus aureus
FPNTFKVLAVSGFKLKQAIERSAEYF

SEQ ID NO: 1654317 - protein, 17 aa, Staphylococcus aureus
FREKMVGEGLAIKAHEE

SEQ ID NO: 1654318 - protein, 24 aa, Staphylococcus aureus
FSGGMKRRLSLAITLLAEPELIIL

SEQ ID NO: 1654319 - protein, 26 aa, Staphylococcus aureus
FYATEFDFPKALRKEEIVGSIENDDI

SEQ ID NO: 1654320 - protein, 22 aa, Staphylococcus aureus
GAVRGRQVIINKFAVELNKDIY

SEQ ID NO: 1654321 - protein, 17 aa, Staphylococcus aureus
GCGKSTLLKALSRLLAV

SEQ ID NO: 1654322 - protein, 17 aa, Staphylococcus aureus
GDIGCRFYTEDENTASI

SEQ ID NO: 1654323 - protein, 17 aa, Staphylococcus aureus
GDLPGMIDKLDYLKDLG

SEQ ID NO: 1654324 - protein, 17 aa, Staphylococcus aureus
GDNLIIINKDRTPYDSD

SEQ ID NO: 1654325 - protein, 19 aa, Staphylococcus aureus
GGDFTEFGSPFGGGKISLN

SEQ ID NO: 1654326 - protein, 18 aa, Staphylococcus aureus
GGELKHGTIALIEEGTPV

SEQ ID NO: 1654327 - protein, 24 aa, Staphylococcus aureus
GHPMLRKRHMAFTITEFERDAWLE

SEQ ID NO: 1654328 - protein, 24 aa, Staphylococcus aureus
GIGTCWKSPLYIYDPKVRKTLGIK

SEQ ID NO: 1654329 - protein, 20 aa, Staphylococcus aureus
GKAKLFPLSFDNYFKQDEIY

SEQ ID NO: 1654330 - protein, 19 aa, Staphylococcus aureus
GKGRHEVSDVPKLLESKNR

SEQ ID NO: 1654331 - protein, 20 aa, Staphylococcus aureus
GKIDKKWLEGKNVVALVSGG

SEQ ID NO: 1654332 - protein, 19 aa, Staphylococcus aureus
GKKKIESIMTHFRSNPPQE

SEQ ID NO: 1654333 - protein, 17 aa, Staphylococcus aureus
GKSTFQKLICNLISPTS

SEQ ID NO: 1654334 - protein, 19 aa, Staphylococcus aureus
GKWYFSIRYKDVYGNNKRK

SEQ ID NO: 1654335 - protein, 24 aa, Staphylococcus aureus
GKYHPHGDLSIYEAMVRMAQDFSY

SEQ ID NO: 1654336 - protein, 17 aa, Staphylococcus aureus
GLKAIVVIPEGKIALGK

SEQ ID NO: 1654337 - protein, 24 aa, Staphylococcus aureus
GMATMKYDMCGAANVVGIIEAASR

SEQ ID NO: 1654338 - protein, 19 aa, Staphylococcus aureus
GMNGIEITEYIKAHYPEIK

SEQ ID NO: 1654339 - protein, 25 aa, Staphylococcus aureus
GNMKEYKDEFLAAPTEIKFLLYFAK

SEQ ID NO: 1654340 - protein, 17 aa, Staphylococcus aureus
GPQIRRLPVSKLNQDLL

SEQ ID NO: 1654341 - protein, 23 aa, Staphylococcus aureus
GRIGAATAKIYAGFGATITAYDA

SEQ ID NO: 1654342 - protein, 17 aa, Staphylococcus aureus
GRTGDISDWNYVPKNSG

SEQ ID NO: 1654343 - protein, 26 aa, Staphylococcus aureus
GRVGRKLECPAGKVLFFHEGVSMNMI

SEQ ID NO: 1654344 - protein, 18 aa, Staphylococcus aureus
GTLTGRRILILGDVLELG

SEQ ID NO: 1654345 - protein, 25 aa, Staphylococcus aureus
GYTKIATVCKFDLPKLAQMKPKDTI

SEQ ID NO: 1654346 - protein, 17 aa, Staphylococcus aureus
HAVWQLVLQHAKEDALF

SEQ ID NO: 1654347 - protein, 20 aa, Staphylococcus aureus
HFKDKSDLCYYVIQRDLDIF

SEQ ID NO: 1654348 - protein, 21 aa, Staphylococcus aureus
HINTGVGFLNHMLTLFTFHSG

SEQ ID NO: 1654349 - protein, 28 aa, Staphylococcus aureus
HLKNVDGFKALRFLRPRTAGRHYIIITL

SEQ ID NO: 1654350 - protein, 32 aa, Staphylococcus aureus
HPMSPLAKIFWMKHEWQDVFQRTAKFADIKTY

SEQ ID NO: 1654351 - protein, 17 aa, Staphylococcus aureus
HSKPFLKQFPTSGEHVL

SEQ ID NO: 1654352 - protein, 18 aa, Staphylococcus aureus
HWHLSRKELNEFINSNDL

SEQ ID NO: 1654353 - protein, 21 aa, Staphylococcus aureus
HYPEIKVLVLTSYVDDEHVIS

SEQ ID NO: 1654354 - protein, 22 aa, Staphylococcus aureus
IAQVFLKVTLSFMQYGALPELH

SEQ ID NO: 1654355 - protein, 26 aa, Staphylococcus aureus
IARHKTSEELVRWQTYMETLSENLYK

SEQ ID NO: 1654356 - protein, 17 aa, Staphylococcus aureus
IARVMEPGCKFDYMLTL

SEQ ID NO: 1654357 - protein, 18 aa, Staphylococcus aureus
IASDTIVYYGMKAHAHEF

SEQ ID NO: 1654358 - protein, 18 aa, Staphylococcus aureus
IATFRLREGMPIGAKVTL

SEQ ID NO: 1654359 - protein, 20 aa, Staphylococcus aureus
ICLVHCPERVLPGKILEELV

SEQ ID NO: 1654360 - protein, 25 aa, Staphylococcus aureus
IDKNNAKNVLFDWNDVEIHRNKNFD

SEQ ID NO: 1654361 - protein, 23 aa, Staphylococcus aureus
IDLVKARGAEVILTDTFALNKPA

SEQ ID NO: 1654362 - protein, 17 aa, Staphylococcus aureus
IDVEHAFGISIDEDNDM

SEQ ID NO: 1654363 - protein, 20 aa, Staphylococcus aureus
IDVPEYRRPASDRKISIRGA

SEQ ID NO: 1654364 - protein, 23 aa, Staphylococcus aureus
IEFLNKPPSAWVILAKPNLGISS

SEQ ID NO: 1654365 - protein, 19 aa, Staphylococcus aureus
IEGFTVRIVDKFNAEQILT

SEQ ID NO: 1654366 - protein, 24 aa, Staphylococcus aureus
IEHKAKFVKQFADFSVGVDGLKQY

SEQ ID NO: 1654367 - protein, 18 aa, Staphylococcus aureus
IEKVFDAYTTKALFEKWF

SEQ ID NO: 1654368 - protein, 25 aa, Staphylococcus aureus
IEQKKGPFAPDFIKVWKDRYKKIRQ

SEQ ID NO: 1654369 - protein, 24 aa, Staphylococcus aureus
IFEKEDRKIATFCVATHRNYKDEN

SEQ ID NO: 1654370 - protein, 19 aa, Staphylococcus aureus
IFESMPYLYGDDINKLQGR

SEQ ID NO: 1654371 - protein, 20 aa, Staphylococcus aureus
IFSKFSNYYEFLVRYKKIDA

SEQ ID NO: 1654372 - protein, 19 aa, Staphylococcus aureus
IGGMPFLKSFKDIPLDENN

SEQ ID NO: 1654373 - protein, 18 aa, Staphylococcus aureus
IKATHIYNAISGQQQTDF

SEQ ID NO: 1654374 - protein, 21 aa, Staphylococcus aureus
IKIKNAVKMASEFARNNPFKK

SEQ ID NO: 1654375 - protein, 20 aa, Staphylococcus aureus
IKLSGLEKVIYKHLDIADLE

SEQ ID NO: 1654376 - protein, 21 aa, Staphylococcus aureus
IKRLYIEEGCAIQKEYYVGFV

SEQ ID NO: 1654377 - protein, 25 aa, Staphylococcus aureus
INPNIKFTMISSIDIAKIASYVFEH

SEQ ID NO: 1654378 - protein, 23 aa, Staphylococcus aureus
INQYLEYDVEGFKKRYRQLREEY

SEQ ID NO: 1654379 - protein, 25 aa, Staphylococcus aureus
IPFFERLKNLLIQQFENVHSIADLD

SEQ ID NO: 1654380 - protein, 17 aa, Staphylococcus aureus
IPLIKKLSADNVRLNVT

SEQ ID NO: 1654381 - protein, 26 aa, Staphylococcus aureus
IPLLQARSKEILAFVNESKETAIKEY

SEQ ID NO: 1654382 - protein, 21 aa, Staphylococcus aureus
IPREDVATVLKEIVTSNHFNH

SEQ ID NO: 1654383 - protein, 17 aa, Staphylococcus aureus
IQETTALGAAFLAGLAV

SEQ ID NO: 1654384 - protein, 22 aa, Staphylococcus aureus
IQEYYPDFKLEYDVDPIRQGIA

SEQ ID NO: 1654385 - protein, 26 aa, Staphylococcus aureus
IQGNTVCYMWLRFNIDQQFDDTAINQ

SEQ ID NO: 1654386 - protein, 34 aa, Staphylococcus aureus
IRDVFGYCVDKGWMCIQVFFIRQGNMIKRDTTMI

SEQ ID NO: 1654387 - protein, 18 aa, Staphylococcus aureus
IREKFALKPFDKHQFQHS

SEQ ID NO: 1654388 - protein, 18 aa, Staphylococcus aureus
IRHTMSFDNAHFFAQLRH

SEQ ID NO: 1654389 - protein, 23 aa, Staphylococcus aureus
IRILCRQLLLDGCRVAQAEGLNF

SEQ ID NO: 1654390 - protein, 17 aa, Staphylococcus aureus
ISAYDTFLSAFGKKDDV

SEQ ID NO: 1654391 - protein, 18 aa, Staphylococcus aureus
ISEAKVLVNEVGIPTDVQ

SEQ ID NO: 1654392 - protein, 23 aa, Staphylococcus aureus
ITHLRASVINFLLIQSLLSALKN

SEQ ID NO: 1654393 - protein, 18 aa, Staphylococcus aureus
ITKDAFALPYTIIKAKNQ

SEQ ID NO: 1654394 - protein, 30 aa, Staphylococcus aureus
ITLVKRIFNEWQIPIIFVTHSNYEAEQMAH

SEQ ID NO: 1654395 - protein, 17 aa, Staphylococcus aureus
IVDACAETDYKLKSSYM

SEQ ID NO: 1654396 - protein, 24 aa, Staphylococcus aureus
IVITCNYRLGALGYLDWSYFNKGF

SEQ ID NO: 1654397 - protein, 18 aa, Staphylococcus aureus
IVRISRSILNEALDINSN

SEQ ID NO: 1654398 - protein, 17 aa, Staphylococcus aureus
IVSNFGFDVNLDDKILD

SEQ ID NO: 1654399 - protein, 24 aa, Staphylococcus aureus
IYHLYDDRGLWLAFNNNEDYARYS

SEQ ID NO: 1654400 - protein, 25 aa, Staphylococcus aureus
IYMGVKRLGKIIAQIQQYTDIDYPI

SEQ ID NO: 1654401 - protein, 23 aa, Staphylococcus aureus
IYRLMKELNLKAVIRQKRKPYRR

SEQ ID NO: 1654402 - protein, 19 aa, Staphylococcus aureus
KAAVTEFKNTFVPQNIRET

SEQ ID NO: 1654403 - protein, 20 aa, Staphylococcus aureus
KAKAKQLPQITVKVSASLDG

SEQ ID NO: 1654404 - protein, 24 aa, Staphylococcus aureus
KASIKPFIRRTPLIKSMYLSQNIT

SEQ ID NO: 1654405 - protein, 19 aa, Staphylococcus aureus
KDGLPFIEKWIKQYGSEAW

SEQ ID NO: 1654406 - protein, 25 aa, Staphylococcus aureus
KDILPLRIILGSVNLYGILSTNHLL

SEQ ID NO: 1654407 - protein, 19 aa, Staphylococcus aureus
KDKYGITNKLALYVPTYRE

SEQ ID NO: 1654408 - protein, 17 aa, Staphylococcus aureus
KDLRMSDQMSIQYLNND

SEQ ID NO: 1654409 - protein, 22 aa, Staphylococcus aureus
KEFTIPVKFTIKVVLTDPYKYS

SEQ ID NO: 1654410 - protein, 17 aa, Staphylococcus aureus
KEIKRLYIEEGCAIQKE

SEQ ID NO: 1654411 - protein, 20 aa, Staphylococcus aureus
KEILHCRDVYAQKMIDFANG

SEQ ID NO: 1654412 - protein, 22 aa, Staphylococcus aureus
KEKHGPDALSFISSSKATNEES

SEQ ID NO: 1654413 - protein, 20 aa, Staphylococcus aureus
KELFKNKWIGKFLTSLNAFP

SEQ ID NO: 1654414 - protein, 19 aa, Staphylococcus aureus
KELKVFKSKWQALNKGMIN

SEQ ID NO: 1654415 - protein, 18 aa, Staphylococcus aureus
KELVEIASVAGLQVDEKQ

SEQ ID NO: 1654416 - protein, 21 aa, Staphylococcus aureus
KELVNLFNERYDIIIVDTPPV

SEQ ID NO: 1654417 - protein, 41 aa, Staphylococcus aureus
KFDHPNVICTYDLLFRSGLDLKVDFVIRVGKPVISKKLNQW

SEQ ID NO: 1654418 - protein, 19 aa, Staphylococcus aureus
KFSMSKIVHHPHIEIPSDQ

SEQ ID NO: 1654419 - protein, 20 aa, Staphylococcus aureus
KGKEIGLFLTESGTIHAIHN

SEQ ID NO: 1654420 - protein, 20 aa, Staphylococcus aureus
KITLAFDMNKCHFFDEKTGN

SEQ ID NO: 1654421 - protein, 18 aa, Staphylococcus aureus
KIVHHPHIQIPSDQIAQL

SEQ ID NO: 1654422 - protein, 25 aa, Staphylococcus aureus
KKSELRPVNCINILPEHHKYIDWIK

SEQ ID NO: 1654423 - protein, 21 aa, Staphylococcus aureus
KLIDLRLDTRVSYTESQIKVY

SEQ ID NO: 1654424 - protein, 18 aa, Staphylococcus aureus
KMASEFARNNPFKKGNLV

SEQ ID NO: 1654425 - protein, 23 aa, Staphylococcus aureus
KMSLPLMWEFPGGKVEKNETEKD

SEQ ID NO: 1654426 - protein, 24 aa, Staphylococcus aureus
KNAIKNGCPKVIIASGNKPNIIEA

SEQ ID NO: 1654427 - protein, 20 aa, Staphylococcus aureus
KNLKEWRLEDLPIIPKYMKT

SEQ ID NO: 1654428 - protein, 21 aa, Staphylococcus aureus
KNQLKRMSLVLNTDRGNIKIK

SEQ ID NO: 1654429 - protein, 26 aa, Staphylococcus aureus
KNRKRWPLYRPWALFIKDTEKLNLTT

SEQ ID NO: 1654430 - protein, 19 aa, Staphylococcus aureus
KQIIQRLGVNLENLHIIVT

SEQ ID NO: 1654431 - protein, 18 aa, Staphylococcus aureus
KQTFGVPSYQGYIDASET

SEQ ID NO: 1654432 - protein, 19 aa, Staphylococcus aureus
KRKDIYVKWQKYMNDELPG

SEQ ID NO: 1654433 - protein, 18 aa, Staphylococcus aureus
KRKIIGNEFVYVFDDEAS

SEQ ID NO: 1654434 - protein, 20 aa, Staphylococcus aureus
KRKLKPDKDDLVIQKNHNGT

SEQ ID NO: 1654435 - protein, 20 aa, Staphylococcus aureus
KRLNYVGFYRLHHKYNKKVM

SEQ ID NO: 1654436 - protein, 21 aa, Staphylococcus aureus
KRYYKSFSRGTVVYVKLGSNI

SEQ ID NO: 1654437 - protein, 19 aa, Staphylococcus aureus
KSLADLLPEHRIIINEQPL

SEQ ID NO: 1654438 - protein, 17 aa, Staphylococcus aureus
KSLELLEKVGLTHVKDQ

SEQ ID NO: 1654439 - protein, 20 aa, Staphylococcus aureus
KTRKDITYMLDLDMIEDLSQ

SEQ ID NO: 1654440 - protein, 22 aa, Staphylococcus aureus
KTTTIKCLLGMEKIDSGSAEIF

SEQ ID NO: 1654441 - protein, 18 aa, Staphylococcus aureus
KVIAPFNGLVSMIVPTKH

SEQ ID NO: 1654442 - protein, 21 aa, Staphylococcus aureus
KVVKKIERWQKIIKEAAEQSY

SEQ ID NO: 1654443 - protein, 23 aa, Staphylococcus aureus
KYLRPETLFGSKFEGYLNQKIQP

SEQ ID NO: 1654444 - protein, 19 aa, Staphylococcus aureus
KYQESFGYIAQQLCFPEKL

SEQ ID NO: 1654445 - protein, 17 aa, Staphylococcus aureus
LCFPEKLTFHPKTFEET

SEQ ID NO: 1654446 - protein, 19 aa, Staphylococcus aureus
LDDYRIIKSSLYGNQSRTT

SEQ ID NO: 1654447 - protein, 19 aa, Staphylococcus aureus
LEAPIYVLSNIAGVLINDV

SEQ ID NO: 1654448 - protein, 19 aa, Staphylococcus aureus
LEAVELLEAQALQIHVNSP

SEQ ID NO: 1654449 - protein, 17 aa, Staphylococcus aureus
LECPSIISQVKFYHVPD

SEQ ID NO: 1654450 - protein, 18 aa, Staphylococcus aureus
LEEIIELTKFDSSQLNQF

SEQ ID NO: 1654451 - protein, 23 aa, Staphylococcus aureus
LEPWTSCEFDFTREGNLKVSFDY

SEQ ID NO: 1654452 - protein, 17 aa, Staphylococcus aureus
LESKSGGKSGDFQRQLD

SEQ ID NO: 1654453 - protein, 23 aa, Staphylococcus aureus
LFSGELDKAVAAMIIANGAKAAG

SEQ ID NO: 1654454 - protein, 33 aa, Staphylococcus aureus
LFYQFIMKLPESVLRLKGYVSFRNQPNAIYEFQ

SEQ ID NO: 1654455 - protein, 25 aa, Staphylococcus aureus
LGLPYRRVILCTGDIGFSASKTYDI

SEQ ID NO: 1654456 - protein, 18 aa, Staphylococcus aureus
LGPKGIRVNCVAPGPFWS

SEQ ID NO: 1654457 - protein, 25 aa, Staphylococcus aureus
LGPTAIRYAGLIPRLKQLDLDVNDK

SEQ ID NO: 1654458 - protein, 25 aa, Staphylococcus aureus
LHLKHIFESMPFLYGDDINKLQGRS

SEQ ID NO: 1654459 - protein, 24 aa, Staphylococcus aureus
LINDCADCVISVLPSKLGAISDAI

SEQ ID NO: 1654460 - protein, 17 aa, Staphylococcus aureus
LKDITLNKRIKSYDEVK

SEQ ID NO: 1654461 - protein, 24 aa, Staphylococcus aureus
LKKIKHSYLKKSFLEIVETLKNDP

SEQ ID NO: 1654462 - protein, 23 aa, Staphylococcus aureus
LKKSIKNLCLMKKFEPYVTNENY

SEQ ID NO: 1654463 - protein, 17 aa, Staphylococcus aureus
LKKSYRNEYFYKNTMLN

SEQ ID NO: 1654464 - protein, 24 aa, Staphylococcus aureus
LKLGGKALKPLGFITAITDNIGKK

SEQ ID NO: 1654465 - protein, 21 aa, Staphylococcus aureus
LKLPEHHSYIISYNGSKTINM

SEQ ID NO: 1654466 - protein, 18 aa, Staphylococcus aureus
LKVIYKWMDLGRKIDERL

SEQ ID NO: 1654467 - protein, 19 aa, Staphylococcus aureus
LLEVYRIIGELYGKSVEHD

SEQ ID NO: 1654468 - protein, 28 aa, Staphylococcus aureus
LLNKDKVEWIILAGYMRLIGPDLLASFE

SEQ ID NO: 1654469 - protein, 34 aa, Staphylococcus aureus
LNNRFQLFDPFGIKSRFFDSIKIDSSILNRTSEN

SEQ ID NO: 1654470 - protein, 25 aa, Staphylococcus aureus
LNRAKEEFKKVLPIKNDSDFGLLTG

SEQ ID NO: 1654471 - protein, 20 aa, Staphylococcus aureus
LPHYRPYKIAEHFRMMAALY

SEQ ID NO: 1654472 - protein, 32 aa, Staphylococcus aureus
LQLVMAIAALKLKLSPSEVWNAVTVNAAKAID

SEQ ID NO: 1654473 - protein, 17 aa, Staphylococcus aureus
LRHRDIDAGLPKRPFKP

SEQ ID NO: 1654474 - protein, 19 aa, Staphylococcus aureus
LRKKLSEIGMDSAIETKVG

SEQ ID NO: 1654475 - protein, 27 aa, Staphylococcus aureus
LSFLDKKSWCKNKFQVTNQVSVEDTYK

SEQ ID NO: 1654476 - protein, 27 aa, Staphylococcus aureus
LSKLIKRIRFATGVIREIKAFKPDVIH

SEQ ID NO: 1654477 - protein, 23 aa, Staphylococcus aureus
LSTKVEGIGYWLNYDLHVSHCRN

SEQ ID NO: 1654478 - protein, 22 aa, Staphylococcus aureus
LTSPNPFHLIYSILSKHQSASI

SEQ ID NO: 1654479 - protein, 19 aa, Staphylococcus aureus
LVNELDMRILISSHKLEDI

SEQ ID NO: 1654480 - protein, 18 aa, Staphylococcus aureus
LVTLLNKDKVEWIILAGY

SEQ ID NO: 1654481 - protein, 18 aa, Staphylococcus aureus
LYLTSHMDTVVPAINVKP

SEQ ID NO: 1654482 - protein, 23 aa, Staphylococcus aureus
MAVHKRVTLLIGDLSFYHDMNGL

SEQ ID NO: 1654483 - protein, 17 aa, Staphylococcus aureus
MGISAYDTFLSAFGKKD

SEQ ID NO: 1654484 - protein, 19 aa, Staphylococcus aureus
MKPTKVILRDASYLHSKTS

SEQ ID NO: 1654485 - protein, 34 aa, Staphylococcus aureus
MKQGKTILKNISWQIAKGDKWILYGLNGAGKTTL

SEQ ID NO: 1654486 - protein, 19 aa, Staphylococcus aureus
MLKIWGHLFQYIKSEHIED

SEQ ID NO: 1654487 - protein, 19 aa, Staphylococcus aureus
MPLLSEKPLFVYISQSGET

SEQ ID NO: 1654488 - protein, 18 aa, Staphylococcus aureus
MREYFWSIIAKLKEENRT

SEQ ID NO: 1654489 - protein, 17 aa, Staphylococcus aureus
MTPETATIGRLVDTQAL

SEQ ID NO: 1654490 - protein, 17 aa, Staphylococcus aureus
MVRVRLSGVKLKEIITK

SEQ ID NO: 1654491 - protein, 19 aa, Staphylococcus aureus
NAGENYIDITWLARKKGYQ

SEQ ID NO: 1654492 - protein, 27 aa, Staphylococcus aureus
NANHFGGEMKKMWSGIKGIPSKLSSGW

SEQ ID NO: 1654493 - protein, 18 aa, Staphylococcus aureus
NEAKVVKKIERWQKIIKE

SEQ ID NO: 1654494 - protein, 22 aa, Staphylococcus aureus
NEGQLIAFIWGHFSNEKSMVNI

SEQ ID NO: 1654495 - protein, 26 aa, Staphylococcus aureus
NEHFARKVSNHWLRLMSVNEEGRFKS

SEQ ID NO: 1654496 - protein, 23 aa, Staphylococcus aureus
NEKRIKNHLNRAFNREQPMETLV

SEQ ID NO: 1654497 - protein, 21 aa, Staphylococcus aureus
NESELKLCRNLITEFETLSKY

SEQ ID NO: 1654498 - protein, 18 aa, Staphylococcus aureus
NEVIGFVNTGGLRNSLDV

SEQ ID NO: 1654499 - protein, 27 aa, Staphylococcus aureus
NGHCNYWKSSFLFRSSLSTSEMIEKLK

SEQ ID NO: 1654500 - protein, 26 aa, Staphylococcus aureus
NGNTKLKLNGYFIASIISPLNLNKLN

SEQ ID NO: 1654501 - protein, 20 aa, Staphylococcus aureus
NGYKVAICEQMEDPKQTKGM

SEQ ID NO: 1654502 - protein, 23 aa, Staphylococcus aureus
NHLKSLKAFNYMPYFEHLDMNQI

SEQ ID NO: 1654503 - protein, 23 aa, Staphylococcus aureus
NIPSRLKALHWHEDMFQIPQQAE

SEQ ID NO: 1654504 - protein, 24 aa, Staphylococcus aureus
NKVAGELLCQYYFTRFGVDTRSVR

SEQ ID NO: 1654505 - protein, 25 aa, Staphylococcus aureus
NLKNALKLIKLCQTYHVHILSVHDG

SEQ ID NO: 1654506 - protein, 17 aa, Staphylococcus aureus
NNYPFPNTFKVLAVSGF

SEQ ID NO: 1654507 - protein, 27 aa, Staphylococcus aureus
NQDLLAKCYLSCLKLADQQSLNHIAFC

SEQ ID NO: 1654508 - protein, 24 aa, Staphylococcus aureus
NREVVNYFVHFARVVFERYKDKVT

SEQ ID NO: 1654509 - protein, 25 aa, Staphylococcus aureus
NVKLGLNITCLFDKPSVFKSLVSQI

SEQ ID NO: 1654510 - protein, 17 aa, Staphylococcus aureus
NVLYGFPKFYDACIANN

SEQ ID NO: 1654511 - protein, 22 aa, Staphylococcus aureus
NVSVESCELLPVIDDPTFTIDE

SEQ ID NO: 1654512 - protein, 23 aa, Staphylococcus aureus
NVVKACGGTIILEDLANYDIQIK

SEQ ID NO: 1654513 - protein, 20 aa, Staphylococcus aureus
NYGCLDPIVFLDGIEANEML

SEQ ID NO: 1654514 - protein, 21 aa, Staphylococcus aureus
PAKKFLYLVIEKLMSCITDSI

SEQ ID NO: 1654515 - protein, 26 aa, Staphylococcus aureus
PDENFKRLNNSLARLEMPQVNEGELL

SEQ ID NO: 1654516 - protein, 18 aa, Staphylococcus aureus
PDRFLAYGAVSLPYVDQA

SEQ ID NO: 1654517 - protein, 30 aa, Staphylococcus aureus
PELNIKYIDCLEVGPTLSTKCFEEEEFERA

SEQ ID NO: 1654518 - protein, 17 aa, Staphylococcus aureus
PEMYYLDVASPGAERPI

SEQ ID NO: 1654519 - protein, 18 aa, Staphylococcus aureus
PERFSYMIKEVAVKRYNR

SEQ ID NO: 1654520 - protein, 24 aa, Staphylococcus aureus
PFFHAKGGIYVWLETPPGYDSEQF

SEQ ID NO: 1654521 - protein, 18 aa, Staphylococcus aureus
PIKSFPFEITELPKDTKY

SEQ ID NO: 1654522 - protein, 23 aa, Staphylococcus aureus
PKDTKYLAWSLIDYDAIPVCGFA

SEQ ID NO: 1654523 - protein, 19 aa, Staphylococcus aureus
PKSASGFSEADLEKYAPEC

SEQ ID NO: 1654524 - protein, 23 aa, Staphylococcus aureus
PLLDEAFHLPLVVATTGEKEKLL

SEQ ID NO: 1654525 - protein, 24 aa, Staphylococcus aureus
PLLKRLEPHINHFVFDANSNDAVD

SEQ ID NO: 1654526 - protein, 19 aa, Staphylococcus aureus
PNIFPEFKVEGKSKLIHSF

SEQ ID NO: 1654527 - protein, 24 aa, Staphylococcus aureus
PNLYPEIECKLLAFLEEKKVDATQ

SEQ ID NO: 1654528 - protein, 24 aa, Staphylococcus aureus
PQLRLYGLGAYELLSLMYDIHTVR

SEQ ID NO: 1654529 - protein, 27 aa, Staphylococcus aureus
PRTAAIKDFWEKVGLKTNVKLVEFGKY

SEQ ID NO: 1654530 - protein, 17 aa, Staphylococcus aureus
PYQQIMVATGFEQDFMS

SEQ ID NO: 1654531 - protein, 19 aa, Staphylococcus aureus
QARGMGGHVRSNWKDVTDI

SEQ ID NO: 1654532 - protein, 17 aa, Staphylococcus aureus
QEKYPLFINHLKTFKYV

SEQ ID NO: 1654533 - protein, 18 aa, Staphylococcus aureus
QELFYFYYDLFKSDDDIY

SEQ ID NO: 1654534 - protein, 21 aa, Staphylococcus aureus
QFDHIKRVFVYDQFSEACARF

SEQ ID NO: 1654535 - protein, 19 aa, Staphylococcus aureus
QFKHPLDQILLARVSMSSI

SEQ ID NO: 1654536 - protein, 23 aa, Staphylococcus aureus
QGVGKKLVKAVVEHARENHLKII

SEQ ID NO: 1654537 - protein, 19 aa, Staphylococcus aureus
QILACSELDVPVYDAYHTD

SEQ ID NO: 1654538 - protein, 20 aa, Staphylococcus aureus
QIVFSPEIMSWIEQRSLNIH

SEQ ID NO: 1654539 - protein, 18 aa, Staphylococcus aureus
QKYPNIKFHISHLGGALP

SEQ ID NO: 1654540 - protein, 22 aa, Staphylococcus aureus
QLCTPKDVFAREIQIEAISTGD

SEQ ID NO: 1654541 - protein, 25 aa, Staphylococcus aureus
QLFEIKRFDQQYGYVGVPTTLNIDS

SEQ ID NO: 1654542 - protein, 30 aa, Staphylococcus aureus
QNALDFPLPKAFRDAGWFFDVLPGHYNGAL

SEQ ID NO: 1654543 - protein, 24 aa, Staphylococcus aureus
QRGKFDVIIVLSHCGIFFDETLCQ

SEQ ID NO: 1654544 - protein, 21 aa, Staphylococcus aureus
QRLVNRIIVLKDGMIVDDFTI

SEQ ID NO: 1654545 - protein, 21 aa, Staphylococcus aureus
QRPTIFKVEYEINGKRNIRRI

SEQ ID NO: 1654546 - protein, 32 aa, Staphylococcus aureus
QSGLAPEAWLECYLDRTLLPILKLFSNTGISL

SEQ ID NO: 1654547 - protein, 26 aa, Staphylococcus aureus
QSPLVNDYQLEWVIGAPLESTFITLQ

SEQ ID NO: 1654548 - protein, 23 aa, Staphylococcus aureus
QSSKMYGGTCINIGCIPSKTLVH

SEQ ID NO: 1654549 - protein, 24 aa, Staphylococcus aureus
QTTIFIDEGWAFSASRQGKKVGKR

SEQ ID NO: 1654550 - protein, 18 aa, Staphylococcus aureus
QVDEVFDPILVIQVENDN

SEQ ID NO: 1654551 - protein, 22 aa, Staphylococcus aureus
QWNHKYKTVGMMLFDEQRQFLQ

SEQ ID NO: 1654552 - protein, 22 aa, Staphylococcus aureus
REFDYIKSLRRLTTKDIEVGGG

SEQ ID NO: 1654553 - protein, 24 aa, Staphylococcus aureus
REQMLKIQIEFLIAYATAQTELSM

SEQ ID NO: 1654554 - protein, 23 aa, Staphylococcus aureus
RGGCSPVGMKTLFPTVVDKSCEN

SEQ ID NO: 1654555 - protein, 17 aa, Staphylococcus aureus
RGKVSVRQLDYFNQESM

SEQ ID NO: 1654556 - protein, 21 aa, Staphylococcus aureus
RKQLEDWLDYEITTLPYDMMI

SEQ ID NO: 1654557 - protein, 26 aa, Staphylococcus aureus
RLEMFKKGLEHFGLEYKITYDKKKDR

SEQ ID NO: 1654558 - protein, 35 aa, Staphylococcus aureus
RSLESSFNIARKMGYFDIPKDLLIPITEVDNYPKN

SEQ ID NO: 1654559 - protein, 18 aa, Staphylococcus aureus
RTKTQLNVVIACYYGLGV

SEQ ID NO: 1654560 - protein, 21 aa, Staphylococcus aureus
RVMEPGCKFDYMLTLYGPQGV

SEQ ID NO: 1654561 - protein, 21 aa, Staphylococcus aureus
RYQMYWQIYFHPVSRGGEVLL

SEQ ID NO: 1654562 - protein, 17 aa, Staphylococcus aureus
SDEKILLDQMVSHFKNF

SEQ ID NO: 1654563 - protein, 17 aa, Staphylococcus aureus
SEATRIQYGGSVKPNNI

SEQ ID NO: 1654564 - protein, 24 aa, Staphylococcus aureus
SELFPDVYRHIGYIQSNFLSNQTN

SEQ ID NO: 1654565 - protein, 24 aa, Staphylococcus aureus
SENWFKQTVASLCYYSDMPSDVLL

SEQ ID NO: 1654566 - protein, 26 aa, Staphylococcus aureus
SFVYKRRLPFHAKRFNDWLESMSNNV

SEQ ID NO: 1654567 - protein, 25 aa, Staphylococcus aureus
SGFRNEYYYLTAIPYTLDEYKKYFQ

SEQ ID NO: 1654568 - protein, 28 aa, Staphylococcus aureus
SGKTTLMRHIVSFLKTHGYTVATIKHHG

SEQ ID NO: 1654569 - protein, 25 aa, Staphylococcus aureus
SGMGAQCWDLPNYLLDKYWGFRTWG

SEQ ID NO: 1654570 - protein, 20 aa, Staphylococcus aureus
SHVPVLIDEAYFEFVTAEDY

SEQ ID NO: 1654571 - protein, 17 aa, Staphylococcus aureus
SHYIWMARNFRSYNPRH

SEQ ID NO: 1654572 - protein, 24 aa, Staphylococcus aureus
SIERIVIELTKLMRGINVEKSFNH

SEQ ID NO: 1654573 - protein, 22 aa, Staphylococcus aureus
SIGTACLNNGKFSMSKIVHHPH

SEQ ID NO: 1654574 - protein, 23 aa, Staphylococcus aureus
SINKGELLGLIGPSGSGKTTTIK

SEQ ID NO: 1654575 - protein, 19 aa, Staphylococcus aureus
SKLIHSFEAVFPGEATEYV

SEQ ID NO: 1654576 - protein, 21 aa, Staphylococcus aureus
SKMIKETVCQLEIKLDTGRTH

SEQ ID NO: 1654577 - protein, 26 aa, Staphylococcus aureus
SKTLTIKTLLTWLARHHFNYQEINER

SEQ ID NO: 1654578 - protein, 21 aa, Staphylococcus aureus
SLPYHYYKDYGIRKYGFHGTS

SEQ ID NO: 1654579 - protein, 26 aa, Staphylococcus aureus
SLSSFLFMRLNFYLIDLFRQQKRLND

SEQ ID NO: 1654580 - protein, 23 aa, Staphylococcus aureus
SLYKRGGTIYAHVMHTHLLINFV

SEQ ID NO: 1654581 - protein, 25 aa, Staphylococcus aureus
SMGPRSVDYLHHLIQAMHLAYSDRA

SEQ ID NO: 1654582 - protein, 25 aa, Staphylococcus aureus
SMNRIAKELGIGMGTLYRHFKDKSD

SEQ ID NO: 1654583 - protein, 20 aa, Staphylococcus aureus
SPSNAMKQAWLQISQDNKLM

SEQ ID NO: 1654584 - protein, 27 aa, Staphylococcus aureus
SQHLKKMYHAMAHKFGDNWKKAQEVGN

SEQ ID NO: 1654585 - protein, 22 aa, Staphylococcus aureus
SVVGAKFVKLFTDIDLNDDEVI

SEQ ID NO: 1654586 - protein, 18 aa, Staphylococcus aureus
TADAAGMDAVIMEKGTTD

SEQ ID NO: 1654587 - protein, 21 aa, Staphylococcus aureus
TAHQRIKFSSIDNEEITYILD

SEQ ID NO: 1654588 - protein, 19 aa, Staphylococcus aureus
TAVVKFFNVFGPRQDPKSQ

SEQ ID NO: 1654589 - protein, 24 aa, Staphylococcus aureus
TDALKDVQAVLGFHNDPSRSVGTF

SEQ ID NO: 1654590 - protein, 27 aa, Staphylococcus aureus
TFEHKGKMAFRVYPKWCNQLNKTAGQT

SEQ ID NO: 1654591 - protein, 19 aa, Staphylococcus aureus
TFIGQPLWGSIGYTLPATL

SEQ ID NO: 1654592 - protein, 34 aa, Staphylococcus aureus
TFKSRVEKSIADWGIKLERTFYVSKFDHPENELE

SEQ ID NO: 1654593 - protein, 21 aa, Staphylococcus aureus
TFQFAGHFGEPMWTEQMSLDK

SEQ ID NO: 1654594 - protein, 20 aa, Staphylococcus aureus
THARNHLRLWSLQGHRDIPN

SEQ ID NO: 1654595 - protein, 30 aa, Staphylococcus aureus
TIKYDGAYCINGYRWITYIANSGQRRYIAT

SEQ ID NO: 1654596 - protein, 23 aa, Staphylococcus aureus
TKKLPDFILSLGAKFNHQAKEGK

SEQ ID NO: 1654597 - protein, 23 aa, Staphylococcus aureus
TLHQFPIDNVFPLMGQTITTNDL

SEQ ID NO: 1654598 - protein, 25 aa, Staphylococcus aureus
TLWKKAKPGEISWNSPFGEGRPGWH

SEQ ID NO: 1654599 - protein, 24 aa, Staphylococcus aureus
TNGEYFRGGIIIEQLLKLSTKVEG

SEQ ID NO: 1654600 - protein, 20 aa, Staphylococcus aureus
TNIIKEWLNLSVNVERISVN

SEQ ID NO: 1654601 - protein, 23 aa, Staphylococcus aureus
TPNEGVGYIGEWAKERGHEVYIY

SEQ ID NO: 1654602 - protein, 24 aa, Staphylococcus aureus
TSCNSEYFFTLSYFLKPGKATINF

SEQ ID NO: 1654603 - protein, 35 aa, Staphylococcus aureus
TTLSSEGFLKFLPKSEKYRIIYSYNMSIIRESNVT

SEQ ID NO: 1654604 - protein, 23 aa, Staphylococcus aureus
TTSFPTPKIFDWLQQQGNIETNE

SEQ ID NO: 1654605 - protein, 19 aa, Staphylococcus aureus
TVCQLEIKLDTGRTHQIRV

SEQ ID NO: 1654606 - protein, 30 aa, Staphylococcus aureus
TVKGRPKIYADLCLLCMSLSEAGHGRMLQV

SEQ ID NO: 1654607 - protein, 22 aa, Staphylococcus aureus
TVPEIAEKYIAAFHEDVGALNV

SEQ ID NO: 1654608 - protein, 25 aa, Staphylococcus aureus
TVSTLELRTAIKVFGKKYTAEEKKN

SEQ ID NO: 1654609 - protein, 24 aa, Staphylococcus aureus
TYYIVCAGGVRSAKVVEYLEANGI

SEQ ID NO: 1654610 - protein, 25 aa, Staphylococcus aureus
VAEHFNISYGQIYQWVHKYQAHGKN

SEQ ID NO: 1654611 - protein, 22 aa, Staphylococcus aureus
VASTFRILIKYLIYSKIKQQPY

SEQ ID NO: 1654612 - protein, 21 aa, Staphylococcus aureus
VDYFGGTAFEIYAQVDLDESE

SEQ ID NO: 1654613 - protein, 18 aa, Staphylococcus aureus
VENVYIMLNKPKGYISAT

SEQ ID NO: 1654614 - protein, 17 aa, Staphylococcus aureus
VGNGSALRGYKEYLKTR

SEQ ID NO: 1654615 - protein, 17 aa, Staphylococcus aureus
VGTAGTILSFFEIPHAG

SEQ ID NO: 1654616 - protein, 23 aa, Staphylococcus aureus
VIKPENIVLIGMRDLDKGERQFI

SEQ ID NO: 1654617 - protein, 17 aa, Staphylococcus aureus
VILYDRLVNPLILQYSK

SEQ ID NO: 1654618 - protein, 26 aa, Staphylococcus aureus
VKAKAEFYRHAILPNEFEKPSMEAQR

SEQ ID NO: 1654619 - protein, 18 aa, Staphylococcus aureus
VKDATALISLLSTNVDKD

SEQ ID NO: 1654620 - protein, 21 aa, Staphylococcus aureus
VKGKEVGLFLTESGTIHAIHN

SEQ ID NO: 1654621 - protein, 18 aa, Staphylococcus aureus
VKTKNGQMLVCQDPSCKT

SEQ ID NO: 1654622 - protein, 28 aa, Staphylococcus aureus
VKVAGTWHYICLFIDLFNREIVGYSAGK

SEQ ID NO: 1654623 - protein, 19 aa, Staphylococcus aureus
VLNLFSYTGAFSVIAASEA

SEQ ID NO: 1654624 - protein, 25 aa, Staphylococcus aureus
VNEGRIVGIGAHLRKGDKHAEVQAL

SEQ ID NO: 1654625 - protein, 17 aa, Staphylococcus aureus
VPEDAEIIAWFDAIGKK

SEQ ID NO: 1654626 - protein, 20 aa, Staphylococcus aureus
VPTKRIDLLIEVAELVVKKD

SEQ ID NO: 1654627 - protein, 17 aa, Staphylococcus aureus
VRMTIHMHHAIPSTANE

SEQ ID NO: 1654628 - protein, 25 aa, Staphylococcus aureus
VRRNPYSVILFDEIEKANPQILTLL

SEQ ID NO: 1654629 - protein, 22 aa, Staphylococcus aureus
VSIESLIEFCRLAQLPKNENIQ

SEQ ID NO: 1654630 - protein, 20 aa, Staphylococcus aureus
VSRRDLAEVVAMKRIGATTV

SEQ ID NO: 1654631 - protein, 17 aa, Staphylococcus aureus
VTAKFDLSFIIEEDCDD

SEQ ID NO: 1654632 - protein, 27 aa, Staphylococcus aureus
VTLPEYPEFAWFEGMINSIVHRRYDNQ

SEQ ID NO: 1654633 - protein, 31 aa, Staphylococcus aureus
VVAPLEILDPFKGILKFQLPNDVIKRDGSYQ

SEQ ID NO: 1654634 - protein, 23 aa, Staphylococcus aureus
VVECSGAVPAARQGLDIIRKKGF

SEQ ID NO: 1654635 - protein, 17 aa, Staphylococcus aureus
VYIKEPITDLSLENIQV

SEQ ID NO: 1654636 - protein, 17 aa, Staphylococcus aureus
VYIKEPITDLSLKDIQA

SEQ ID NO: 1654637 - protein, 23 aa, Staphylococcus aureus
VYVPDTLSALALDAYESLNDVMP

SEQ ID NO: 1654638 - protein, 17 aa, Staphylococcus aureus
WAKLEISNDDFIRTTEE

SEQ ID NO: 1654639 - protein, 17 aa, Staphylococcus aureus
WALYIAKNKIAIDVPGS

SEQ ID NO: 1654640 - protein, 28 aa, Staphylococcus aureus
WDSPFGEGRPGWHIECSVMAFHELGPTI

SEQ ID NO: 1654641 - protein, 25 aa, Staphylococcus aureus
WLGTMGCGLPGAMASKIAYPNRQAI

SEQ ID NO: 1654642 - protein, 28 aa, Staphylococcus aureus
WNSPFGEGRPGWHIECSVMAFHELGPTI

SEQ ID NO: 1654643 - protein, 20 aa, Staphylococcus aureus
WQEKLVGMGVDLSAIGASAA

SEQ ID NO: 1654644 - protein, 24 aa, Staphylococcus aureus
WRDKFRLPYLLGKADYIFVDDFHP

SEQ ID NO: 1654645 - protein, 18 aa, Staphylococcus aureus
WYVDMGVIDKEEYALITG

SEQ ID NO: 1654646 - protein, 19 aa, Staphylococcus aureus
YADDKFNKRYSVIFDGTAN

SEQ ID NO: 1654647 - protein, 18 aa, Staphylococcus aureus
YAKEKKIDYVFADELLSH

SEQ ID NO: 1654648 - protein, 22 aa, Staphylococcus aureus
YASKAFTCLQMVKLVAEEDLQL

SEQ ID NO: 1654649 - protein, 35 aa, Staphylococcus aureus
YEDKELRKAMLYAIDREKWIKAFFNGYASEINSFV

SEQ ID NO: 1654650 - protein, 26 aa, Staphylococcus aureus
YGENGFGYDPIFYVPKLDRTMAQLSK

SEQ ID NO: 1654651 - protein, 18 aa, Staphylococcus aureus
YGEQYARLRPKKLKANIE

SEQ ID NO: 1654652 - protein, 17 aa, Staphylococcus aureus
YKKAFKMKDDIEVPSTL

SEQ ID NO: 1654653 - protein, 21 aa, Staphylococcus aureus
YKNGKVIVIGIQLYKDREKMY

SEQ ID NO: 1654654 - protein, 21 aa, Staphylococcus aureus
YLLDKYWGFRTWGNADAMAQK

SEQ ID NO: 1654655 - protein, 25 aa, Staphylococcus aureus
YNATLILDVSHSFGIENYSNYQGID

SEQ ID NO: 1654656 - protein, 21 aa, Staphylococcus aureus
YNIRSSTQVKNWIKMYTVGKE

SEQ ID NO: 1654657 - protein, 19 aa, Staphylococcus aureus
YNISYASKAFTCLQMVKLV

SEQ ID NO: 1654658 - protein, 18 aa, Staphylococcus aureus
YNTLFILSSFLKSINIIE

SEQ ID NO: 1654659 - protein, 24 aa, Staphylococcus aureus
YPDKGVRLKAYFNELTYDDKLRQR

SEQ ID NO: 1654660 - protein, 17 aa, Staphylococcus aureus
YPKLRKLNLKWYAVPII

SEQ ID NO: 1654661 - protein, 38 aa, Staphylococcus aureus
YPLAKGASYRLEFYRLYLLMVHLLKFGEMYRDSVTHSM

SEQ ID NO: 1654662 - protein, 19 aa, Staphylococcus aureus
YRQMYGSNVYRVYFNDVQL

SEQ ID NO: 1654663 - protein, 17 aa, Staphylococcus aureus
YSGCEIDPNCTYVQLNQ

SEQ ID NO: 1654664 - protein, 22 aa, Staphylococcus aureus
YSTQNLDLWYGENHALQNINLD

SEQ ID NO: 1654665 - protein, 38 aa, Staphylococcus aureus
YTDIDYPIAIVFQASCFNEFVVKGRLSNIVGKLEHYAI

SEQ ID NO: 1654666 - protein, 30 aa, Staphylococcus aureus
YTEDASFLECFKLTVEPVVKSFKPDIILSV

SEQ ID NO: 1654667 - protein, 17 aa, Staphylococcus aureus
YVANLKYQFDINQKDKN

SEQ ID NO: 1654668 - protein, 17 aa, Staphylococcus aureus
YYAIKAVGNGSALRGYK

SEQ ID NO: 1654669 - protein, 23 aa, Staphylococcus aureus
AANYRSAGTIEFLVTDNAHYFIE

SEQ ID NO: 1654670 - protein, 19 aa, Staphylococcus aureus
ADGATHMKAYPLPYNIFDD

SEQ ID NO: 1654671 - protein, 19 aa, Staphylococcus aureus
ADKHSLVLFDELGAGTDPS

SEQ ID NO: 1654672 - protein, 23 aa, Staphylococcus aureus
AEAAEYFSKVFFQMDIPNNLLIA

SEQ ID NO: 1654673 - protein, 26 aa, Staphylococcus aureus
AEQARELGCVFAFYGHTHVAKYEYIN

SEQ ID NO: 1654674 - protein, 25 aa, Staphylococcus aureus
AFDRIDVEGPFYIKDNITNMITRVH

SEQ ID NO: 1654675 - protein, 19 aa, Staphylococcus aureus
AFIHRADIGGVLNVSELNL

SEQ ID NO: 1654676 - protein, 19 aa, Staphylococcus aureus
AFTVMYLLISKMFEDENFD

SEQ ID NO: 1654677 - protein, 24 aa, Staphylococcus aureus
AGDVFSASVFHYWLENYEVDNYLE

SEQ ID NO: 1654678 - protein, 24 aa, Staphylococcus aureus
AGGCFWCMVKPFTSYPGIKSVVSG

SEQ ID NO: 1654679 - protein, 23 aa, Staphylococcus aureus
AGLCQMIKPTVIDWYIGEYNPKP

SEQ ID NO: 1654680 - protein, 23 aa, Staphylococcus aureus
AGLCQMIKPTVIDWYISEYTPKP

SEQ ID NO: 1654681 - protein, 33 aa, Staphylococcus aureus
AGQERLPLIHKWINGRMPLIGIGSIFTADEALD

SEQ ID NO: 1654682 - protein, 26 aa, Staphylococcus aureus
AHENLEFYGRLSGLKGNILKDNIEKH

SEQ ID NO: 1654683 - protein, 33 aa, Staphylococcus aureus
AIALNEEFDLLALRKSVIRWCELLLTNKPMALI

SEQ ID NO: 1654684 - protein, 18 aa, Staphylococcus aureus
AIMGMNFHLVCPKELNPT

SEQ ID NO: 1654685 - protein, 26 aa, Staphylococcus aureus
AINEFIKPKISVPIHYDTFPLIEQDP

SEQ ID NO: 1654686 - protein, 18 aa, Staphylococcus aureus
AIRIFRAAAELDISTVAI

SEQ ID NO: 1654687 - protein, 17 aa, Staphylococcus aureus
AIYPCLASGGTLNLVDK

SEQ ID NO: 1654688 - protein, 20 aa, Staphylococcus aureus
AKAFWTEILEFVVVSETPLA

SEQ ID NO: 1654689 - protein, 18 aa, Staphylococcus aureus
AKDVDILFILGGDGTVNE

SEQ ID NO: 1654690 - protein, 25 aa, Staphylococcus aureus
AKKLALEILNLVGLPNAEKRFKAYP

SEQ ID NO: 1654691 - protein, 24 aa, Staphylococcus aureus
AKQLKELHRQTGHKIQWYIMTSDI

SEQ ID NO: 1654692 - protein, 21 aa, Staphylococcus aureus
AKQLRKGTVKRIVLTRPAVEA

SEQ ID NO: 1654693 - protein, 18 aa, Staphylococcus aureus
ALIKYCFDEIELNRIEIS

SEQ ID NO: 1654694 - protein, 19 aa, Staphylococcus aureus
ALSSGRTFIGQTTFHPERL

SEQ ID NO: 1654695 - protein, 28 aa, Staphylococcus aureus
ANEISGMIPVEWEQVFTIAYVTDQAGEV

SEQ ID NO: 1654696 - protein, 25 aa, Staphylococcus aureus
ANHIPAKLLSYSFFKNRNETVSDEE

SEQ ID NO: 1654697 - protein, 20 aa, Staphylococcus aureus
ANLGMAIGVLTGIATKEELH

SEQ ID NO: 1654698 - protein, 19 aa, Staphylococcus aureus
ANTLVYRGQPSLDKMWTQF

SEQ ID NO: 1654699 - protein, 24 aa, Staphylococcus aureus
APVIWRGPMLGKMLTNFFTEVRWG

SEQ ID NO: 1654700 - protein, 18 aa, Staphylococcus aureus
AQVLKYQFLNQRNHAPFI

SEQ ID NO: 1654701 - protein, 26 aa, Staphylococcus aureus
AQYAREFDYIKSLRRLTTKDIEVGGG

SEQ ID NO: 1654702 - protein, 19 aa, Staphylococcus aureus
ARQNLKALMTKVNDDSDIV

SEQ ID NO: 1654703 - protein, 29 aa, Staphylococcus aureus
ARVREILDLPDYVFPLFGMAVGEPAEDEN

SEQ ID NO: 1654704 - protein, 23 aa, Staphylococcus aureus
ASDKFGRQCICIAIDSYYDPERK

SEQ ID NO: 1654705 - protein, 26 aa, Staphylococcus aureus
ASEINSFVPSMHWIAADPKELNDYKY

SEQ ID NO: 1654706 - protein, 17 aa, Staphylococcus aureus
ASGTSIRTSIISQDDHW

SEQ ID NO: 1654707 - protein, 17 aa, Staphylococcus aureus
ASIELLRANMMTANGGG

SEQ ID NO: 1654708 - protein, 24 aa, Staphylococcus aureus
ASLENGKHGFAFSSGVAAISAVVM

SEQ ID NO: 1654709 - protein, 20 aa, Staphylococcus aureus
ASVLMLKPKLIIADEPVASL

SEQ ID NO: 1654710 - protein, 17 aa, Staphylococcus aureus
ASYYKWVHYQSSELELE

SEQ ID NO: 1654711 - protein, 26 aa, Staphylococcus aureus
ATGHIVNLYFPFVEVEMMLTLLDMAQ

SEQ ID NO: 1654712 - protein, 19 aa, Staphylococcus aureus
ATIVMALYQMFHVLLSFSV

SEQ ID NO: 1654713 - protein, 22 aa, Staphylococcus aureus
AVAKSVTFSTGYFKDSEENEVD

SEQ ID NO: 1654714 - protein, 18 aa, Staphylococcus aureus
AVCRKIDDSIDVYGDIQF

SEQ ID NO: 1654715 - protein, 17 aa, Staphylococcus aureus
AWRRYFHQFPELSDKEF

SEQ ID NO: 1654716 - protein, 18 aa, Staphylococcus aureus
AYIAMTIAQDTEYILLDE

SEQ ID NO: 1654717 - protein, 35 aa, Staphylococcus aureus
AYMGMPGDIFSFYSREGIDGMVIEALGQGNMPPSA

SEQ ID NO: 1654718 - protein, 18 aa, Staphylococcus aureus
CARQFLWSTAKGYQQYTA

SEQ ID NO: 1654719 - protein, 19 aa, Staphylococcus aureus
CAYIKSFRNDGRYIEIIGI

SEQ ID NO: 1654720 - protein, 17 aa, Staphylococcus aureus
CSFEGFVDYSGERFYSE

SEQ ID NO: 1654721 - protein, 17 aa, Staphylococcus aureus
CSIRRGKILEFKSAIER

SEQ ID NO: 1654722 - protein, 37 aa, Staphylococcus aureus
CTKAEFIKRLACLPSHIYRLKGFMTFEDTTHTYLIQF

SEQ ID NO: 1654723 - protein, 24 aa, Staphylococcus aureus
DANYRLNNELIEFEKLQLINFDNF

SEQ ID NO: 1654724 - protein, 22 aa, Staphylococcus aureus
DAPRALKILAEQNVEAYQIGHI

SEQ ID NO: 1654725 - protein, 18 aa, Staphylococcus aureus
DAVITLGCVIRGATSHFD

SEQ ID NO: 1654726 - protein, 25 aa, Staphylococcus aureus
DAVKIVRKRGQLMAQAFPSGVGSMA

SEQ ID NO: 1654727 - protein, 24 aa, Staphylococcus aureus
DEIEAKLKLLQDITNLLNYIENRE

SEQ ID NO: 1654728 - protein, 34 aa, Staphylococcus aureus
DEQLKPIPFISGYVGTCSFDLVRHEFPKLQSIQL

SEQ ID NO: 1654729 - protein, 22 aa, Staphylococcus aureus
DETKAVVMIGEIGGTAEEEAAE

SEQ ID NO: 1654730 - protein, 31 aa, Staphylococcus aureus
DFKVIFPDYHVIGISELILDFDVEETGSTFE

SEQ ID NO: 1654731 - protein, 17 aa, Staphylococcus aureus
DFTSFCQLNELTAVVMD

SEQ ID NO: 1654732 - protein, 18 aa, Staphylococcus aureus
DIEKMTAIVNIVKGDREN

SEQ ID NO: 1654733 - protein, 20 aa, Staphylococcus aureus
DINEGEFFVLIGPSGCGKTT

SEQ ID NO: 1654734 - protein, 18 aa, Staphylococcus aureus
DIRIAFSCVEKDDIPHVF

SEQ ID NO: 1654735 - protein, 17 aa, Staphylococcus aureus
DIVKDAKALGFVETLLH

SEQ ID NO: 1654736 - protein, 17 aa, Staphylococcus aureus
DKASVAMILKLLKKLKE

SEQ ID NO: 1654737 - protein, 23 aa, Staphylococcus aureus
DKDYATISFLNWFLDEQVEEEAM

SEQ ID NO: 1654738 - protein, 19 aa, Staphylococcus aureus
DKIIGFSISDLDEYAKSDL

SEQ ID NO: 1654739 - protein, 23 aa, Staphylococcus aureus
DLDRVKNEEIFKIENITDSTQTK

SEQ ID NO: 1654740 - protein, 25 aa, Staphylococcus aureus
DLINDCADCVISVLPSKLGAISDAV

SEQ ID NO: 1654741 - protein, 25 aa, Staphylococcus aureus
DLIQICGREVKILFSSMSEIQGNTV

SEQ ID NO: 1654742 - protein, 18 aa, Staphylococcus aureus
DNMSRPIVTNALTHGLSL

SEQ ID NO: 1654743 - protein, 17 aa, Staphylococcus aureus
DPQDIAEAVLYALTQPK

SEQ ID NO: 1654744 - protein, 22 aa, Staphylococcus aureus
DPSRPVGTFAIKTGAITSAVDR

SEQ ID NO: 1654745 - protein, 23 aa, Staphylococcus aureus
DSPVKYTKHIGGTNHFKYSTEPI

SEQ ID NO: 1654746 - protein, 26 aa, Staphylococcus aureus
DTCIANNIKPIFGMTIYVTNGLNNIE

SEQ ID NO: 1654747 - protein, 27 aa, Staphylococcus aureus
DTGFYRFWTQGIFARWTDNPNIEDLIQ

SEQ ID NO: 1654748 - protein, 18 aa, Staphylococcus aureus
DVNILKLTNHLGFVYQIN

SEQ ID NO: 1654749 - protein, 23 aa, Staphylococcus aureus
DVQLIFCTLPLELRGFQIVSLDD

SEQ ID NO: 1654750 - protein, 20 aa, Staphylococcus aureus
DVSIPKERGLLPGNGAITSV

SEQ ID NO: 1654751 - protein, 18 aa, Staphylococcus aureus
DVTDIIAAQLLYTIKKYG

SEQ ID NO: 1654752 - protein, 27 aa, Staphylococcus aureus
DYEFDLGHFRGAIRPDITRFRDLPDWI

SEQ ID NO: 1654753 - protein, 26 aa, Staphylococcus aureus
DYVSGGKRPLICFFSNDLNIHRTKTE

SEQ ID NO: 1654754 - protein, 27 aa, Staphylococcus aureus
EAGQAKGYRRLTINDGIINDVFIPLKP

SEQ ID NO: 1654755 - protein, 22 aa, Staphylococcus aureus
EAIKALANKGTKVIAVVDDAYY

SEQ ID NO: 1654756 - protein, 34 aa, Staphylococcus aureus
EAILKGYNFISVLGWPNYYANLGYQRASMYDIYP

SEQ ID NO: 1654757 - protein, 20 aa, Staphylococcus aureus
ECVKCKEIELVSDESFNEIL

SEQ ID NO: 1654758 - protein, 25 aa, Staphylococcus aureus
EDLDPTFIWHLAFAYGQEERDKEAQ

SEQ ID NO: 1654759 - protein, 22 aa, Staphylococcus aureus
EEALGYGKWAFRSITEDKYLDL

SEQ ID NO: 1654760 - protein, 20 aa, Staphylococcus aureus
EEEPDIIVIAGDLYDTTYPS

SEQ ID NO: 1654761 - protein, 21 aa, Staphylococcus aureus
EELEYLIKRILKDESVIKIDK

SEQ ID NO: 1654762 - protein, 18 aa, Staphylococcus aureus
EELIYYDRHHYLKSDQAI

SEQ ID NO: 1654763 - protein, 29 aa, Staphylococcus aureus
EESVECYEIYHPLESVGIYVPGGKASYPS

SEQ ID NO: 1654764 - protein, 24 aa, Staphylococcus aureus
EFYPHLNTGMSFIRGVGYPKQQFA

SEQ ID NO: 1654765 - protein, 23 aa, Staphylococcus aureus
EGLEPWTSCEFDFTRDGKLNVSF

SEQ ID NO: 1654766 - protein, 19 aa, Staphylococcus aureus
EHEDCLYLNIWKQHNDQSK

SEQ ID NO: 1654767 - protein, 18 aa, Staphylococcus aureus
EIERILNMMIKRIEKEIN

SEQ ID NO: 1654768 - protein, 18 aa, Staphylococcus aureus
EILDLLSCGELCACDLLA

SEQ ID NO: 1654769 - protein, 21 aa, Staphylococcus aureus
EILEMGGGILSTVNATRETSE

SEQ ID NO: 1654770 - protein, 19 aa, Staphylococcus aureus
EIMTPWIPTDTNIGGEFVP

SEQ ID NO: 1654771 - protein, 23 aa, Staphylococcus aureus
EIQDLLIPLTFHFSKDEQLVIDQ

SEQ ID NO: 1654772 - protein, 18 aa, Staphylococcus aureus
EITEYIKAHYPEIKVLVL

SEQ ID NO: 1654773 - protein, 25 aa, Staphylococcus aureus
EKLSNDKYRTWAWNYGRNPKYNFER

SEQ ID NO: 1654774 - protein, 37 aa, Staphylococcus aureus
EKLYKFSPELVYEAWTKKDLLKQWFMTSARTNKEIEA

SEQ ID NO: 1654775 - protein, 22 aa, Staphylococcus aureus
ELDGKMSYTIAVTGDNSADIEK

SEQ ID NO: 1654776 - protein, 21 aa, Staphylococcus aureus
ELKQERNALESKIKIDKSTYK

SEQ ID NO: 1654777 - protein, 17 aa, Staphylococcus aureus
EMIALLIKYHSQYITIH

SEQ ID NO: 1654778 - protein, 18 aa, Staphylococcus aureus
EMLEDCFYIRKKVFVEEQ

SEQ ID NO: 1654779 - protein, 23 aa, Staphylococcus aureus
ENGYLFVFVIDYYRHHLVDQHAE

SEQ ID NO: 1654780 - protein, 23 aa, Staphylococcus aureus
ENISRLSQYYGHTIGYISQNYAE

SEQ ID NO: 1654781 - protein, 24 aa, Staphylococcus aureus
ENKEKLKGIFLTHGHEHAIGAVSY

SEQ ID NO: 1654782 - protein, 25 aa, Staphylococcus aureus
ENKVAGWLWAWKAVPFKLLGINTSL

SEQ ID NO: 1654783 - protein, 18 aa, Staphylococcus aureus
ENRTILYTSHYIEEVERM

SEQ ID NO: 1654784 - protein, 24 aa, Staphylococcus aureus
ENVSRLSQYYGHTIGYIYQNYAES

SEQ ID NO: 1654785 - protein, 26 aa, Staphylococcus aureus
EPKGNLKLRIEIVKYMKRRGVDCNIN

SEQ ID NO: 1654786 - protein, 17 aa, Staphylococcus aureus
EQLLKPLFQHFKEKYPE

SEQ ID NO: 1654787 - protein, 23 aa, Staphylococcus aureus
ERIDVRLGDGLSVIHPEDVIDNI

SEQ ID NO: 1654788 - protein, 25 aa, Staphylococcus aureus
ESFKTSEVPSAIFGTMKPKKLENGR

SEQ ID NO: 1654789 - protein, 25 aa, Staphylococcus aureus
ESGNGFIGQSFIKYDDFETLIEGYP

SEQ ID NO: 1654790 - protein, 25 aa, Staphylococcus aureus
ETIGCPIGNYIPEWNDFVYHQDFKT

SEQ ID NO: 1654791 - protein, 17 aa, Staphylococcus aureus
EVFEFLYDREIRGLAQV

SEQ ID NO: 1654792 - protein, 28 aa, Staphylococcus aureus
EVKHYADFADIFCETGVFTIEQSQHYMQ

SEQ ID NO: 1654793 - protein, 26 aa, Staphylococcus aureus
EVLTFKAIQACKEYSVQRLIVAGGVA

SEQ ID NO: 1654794 - protein, 18 aa, Staphylococcus aureus
EVNTAFFVKLFNTALAER

SEQ ID NO: 1654795 - protein, 25 aa, Staphylococcus aureus
EVRNEAHHLLKLVGISAKAQQYIGY

SEQ ID NO: 1654796 - protein, 24 aa, Staphylococcus aureus
EVTQAPRVLGFDAIGTVEAIGPDV

SEQ ID NO: 1654797 - protein, 24 aa, Staphylococcus aureus
EVTQAPRVLGFDAIGTVEAIGPNV

SEQ ID NO: 1654798 - protein, 24 aa, Staphylococcus aureus
EVVRYLEEREGFKVKYVDVTKDGT

SEQ ID NO: 1654799 - protein, 25 aa, Staphylococcus aureus
EWAACIYALEHARELNVSNALLYTD

SEQ ID NO: 1654800 - protein, 17 aa, Staphylococcus aureus
FDHGLLFKDGVTVGVDS

SEQ ID NO: 1654801 - protein, 21 aa, Staphylococcus aureus
FDLNDFIRLKVFSSYNNIHDK

SEQ ID NO: 1654802 - protein, 19 aa, Staphylococcus aureus
FDLSCTYDSYQFDGENISR

SEQ ID NO: 1654803 - protein, 18 aa, Staphylococcus aureus
FDLTCTYDSYQFDGENVS

SEQ ID NO: 1654804 - protein, 25 aa, Staphylococcus aureus
FDTDKGGQCVLQLLQVDNVEVSDAH

SEQ ID NO: 1654805 - protein, 24 aa, Staphylococcus aureus
FEDQEIKFEFALFDSDMDNLKYIE

SEQ ID NO: 1654806 - protein, 26 aa, Staphylococcus aureus
FELKHQFTHLTWKIKVYAASGAINIE

SEQ ID NO: 1654807 - protein, 17 aa, Staphylococcus aureus
FHTDFSLISMFNKKEFL

SEQ ID NO: 1654808 - protein, 17 aa, Staphylococcus aureus
FIDISYLTGHEFGARLP

SEQ ID NO: 1654809 - protein, 17 aa, Staphylococcus aureus
FIGTFTVEFFIDSNNQL

SEQ ID NO: 1654810 - protein, 19 aa, Staphylococcus aureus
FIKMIDFKKGVSLQKKFNE

SEQ ID NO: 1654811 - protein, 19 aa, Staphylococcus aureus
FIQKADGATHMKAYPLPYN

SEQ ID NO: 1654812 - protein, 18 aa, Staphylococcus aureus
FIVPMPHRIFDFYNAFIG

SEQ ID NO: 1654813 - protein, 18 aa, Staphylococcus aureus
FKKNRVLKNISFDIEKGT

SEQ ID NO: 1654814 - protein, 17 aa, Staphylococcus aureus
FKKTKSKILPFISYSKY

SEQ ID NO: 1654815 - protein, 18 aa, Staphylococcus aureus
FKLSVPVNIKLLFNEAIK

SEQ ID NO: 1654816 - protein, 21 aa, Staphylococcus aureus
FKMRGNIFLEEGIEHIEMTKK

SEQ ID NO: 1654817 - protein, 18 aa, Staphylococcus aureus
FKTELIKMNASYQTRLKN

SEQ ID NO: 1654818 - protein, 21 aa, Staphylococcus aureus
FKYEVTLPQGVTYVNDSLTTT

SEQ ID NO: 1654819 - protein, 23 aa, Staphylococcus aureus
FLMIELPSGRALAYPKASVGENS

SEQ ID NO: 1654820 - protein, 25 aa, Staphylococcus aureus
FNEKLTYRTASDVVINNAQPEVTLT

SEQ ID NO: 1654821 - protein, 22 aa, Staphylococcus aureus
FNKKEAEAFWNVSLNTKSDYKK

SEQ ID NO: 1654822 - protein, 21 aa, Staphylococcus aureus
FNNVSEFKNATLLSETSTIYE

SEQ ID NO: 1654823 - protein, 23 aa, Staphylococcus aureus
FNQELLCIYIDFDSGLRHSNMVT

SEQ ID NO: 1654824 - protein, 30 aa, Staphylococcus aureus
FQEDALRMIRCLRFQSQLSFDIAMETFEAM

SEQ ID NO: 1654825 - protein, 25 aa, Staphylococcus aureus
FQGHPACVHIPIGKGVCGTAVSERR

SEQ ID NO: 1654826 - protein, 27 aa, Staphylococcus aureus
FQKTMFPDQLKVIGIIKLYQSFYENPL

SEQ ID NO: 1654827 - protein, 18 aa, Staphylococcus aureus
FQNMKSIDVFKYWYIYMV

SEQ ID NO: 1654828 - protein, 19 aa, Staphylococcus aureus
FRNDGRYIEIIGISIGGGT

SEQ ID NO: 1654829 - protein, 27 aa, Staphylococcus aureus
FSGFVLRGRPKSGIDLINNNFKRYVFF

SEQ ID NO: 1654830 - protein, 19 aa, Staphylococcus aureus
FSKFSNYYEFLLRYKKIDA

SEQ ID NO: 1654831 - protein, 18 aa, Staphylococcus aureus
FSPELVDFSIYIIDVAQG

SEQ ID NO: 1654832 - protein, 17 aa, Staphylococcus aureus
FSRGGLQGLLTFQDLPV

SEQ ID NO: 1654833 - protein, 20 aa, Staphylococcus aureus
FSTAESWDNVGLLIGDGDVE

SEQ ID NO: 1654834 - protein, 19 aa, Staphylococcus aureus
FTIGEDICLVHCPERVLPG

SEQ ID NO: 1654835 - protein, 20 aa, Staphylococcus aureus
FYRVNIPTINVLNPVGSGDS

SEQ ID NO: 1654836 - protein, 18 aa, Staphylococcus aureus
FYSPMMANMNEHELRAML

SEQ ID NO: 1654837 - protein, 24 aa, Staphylococcus aureus
GALMSVGLFIVGRIKGVARPALVV

SEQ ID NO: 1654838 - protein, 28 aa, Staphylococcus aureus
GALWTLAQEVYQEWYLGSKLYEEVEKKI

SEQ ID NO: 1654839 - protein, 22 aa, Staphylococcus aureus
GDLAGILGLCIPELDGKMSYTI

SEQ ID NO: 1654840 - protein, 32 aa, Staphylococcus aureus
GDSKPDWKIFQAIANKLSFDWNYKHPSEIMDE

SEQ ID NO: 1654841 - protein, 26 aa, Staphylococcus aureus
GEHLDLLSKIAITFSEEGNVDRIVQA

SEQ ID NO: 1654842 - protein, 17 aa, Staphylococcus aureus
GEKFKDEHLPTFDDVVK

SEQ ID NO: 1654843 - protein, 26 aa, Staphylococcus aureus
GGHAPDLIKSAAFPNILPSSTNPTLP

SEQ ID NO: 1654844 - protein, 21 aa, Staphylococcus aureus
GHNEIKMVQDLGVDVIVTDHH

SEQ ID NO: 1654845 - protein, 24 aa, Staphylococcus aureus
GICPENCGYCGQSREIKQKQRYAL

SEQ ID NO: 1654846 - protein, 18 aa, Staphylococcus aureus
GIDLKKANAELLNYYGVP

SEQ ID NO: 1654847 - protein, 21 aa, Staphylococcus aureus
GILLSDAELKTHINSRIYYYK

SEQ ID NO: 1654848 - protein, 19 aa, Staphylococcus aureus
GINKARGIEQVRQFLNIER

SEQ ID NO: 1654849 - protein, 17 aa, Staphylococcus aureus
GKISLQMHAFPKEIRKI

SEQ ID NO: 1654850 - protein, 19 aa, Staphylococcus aureus
GKQPMSVTFEFQLNNRIYK

SEQ ID NO: 1654851 - protein, 20 aa, Staphylococcus aureus
GKSNIPIGIIPASIKKVRNI

SEQ ID NO: 1654852 - protein, 24 aa, Staphylococcus aureus
GKSPAQVVLRWNVQHGVVIIPKSV

SEQ ID NO: 1654853 - protein, 19 aa, Staphylococcus aureus
GKTPYVIGGLTFANTIGAT

SEQ ID NO: 1654854 - protein, 19 aa, Staphylococcus aureus
GLSLLKLNQHVAFCDEDHY

SEQ ID NO: 1654855 - protein, 21 aa, Staphylococcus aureus
GMIPVEWEKVYTIAYVNDRGG

SEQ ID NO: 1654856 - protein, 25 aa, Staphylococcus aureus
GQARLTQLCTLLKNYFNSEDEDMLE

SEQ ID NO: 1654857 - protein, 18 aa, Staphylococcus aureus
GQHPNCAYIKSFRNDGRY

SEQ ID NO: 1654858 - protein, 19 aa, Staphylococcus aureus
GRQHKGLGWVLTYDKAQEV

SEQ ID NO: 1654859 - protein, 19 aa, Staphylococcus aureus
GSSIGHKNLEFTFVENKEE

SEQ ID NO: 1654860 - protein, 25 aa, Staphylococcus aureus
GTGIKEMIEHFGINQKETLVIGDSD

SEQ ID NO: 1654861 - protein, 19 aa, Staphylococcus aureus
GTQYRGAFEENIQKLVEGV

SEQ ID NO: 1654862 - protein, 35 aa, Staphylococcus aureus; identical to SEQ ID NO: 1575464

SEQ ID NO: 1654863 - protein, 26 aa, Staphylococcus aureus
GTTDMKGGLMALVIALIELKEQNQLP

SEQ ID NO: 1654864 - protein, 26 aa, Staphylococcus aureus
GTYRALTKVFTRFGVEVDFVDTTHTD

SEQ ID NO: 1654865 - protein, 20 aa, Staphylococcus aureus
GTYYPRTFIQQLFVDGYFGE

SEQ ID NO: 1654866 - protein, 24 aa, Staphylococcus aureus
GVDFRLIEPSAFYHTLQHFTGSKE

SEQ ID NO: 1654867 - protein, 17 aa, Staphylococcus aureus
GVFDLFGYDLKDYDELF

SEQ ID NO: 1654868 - protein, 17 aa, Staphylococcus aureus
GYSFKYDGAISRQEASK

SEQ ID NO: 1654869 - protein, 34 aa, Staphylococcus aureus
HAEELTRIGLDLPFPIKINQMLGHQTSFLTYEGL

SEQ ID NO: 1654870 - protein, 22 aa, Staphylococcus aureus
HAVEKHYNLYVSMLENGEKHAI

SEQ ID NO: 1654871 - protein, 24 aa, Staphylococcus aureus
HDGKERLNYGASWFENNQLFIRTD

SEQ ID NO: 1654872 - protein, 18 aa, Staphylococcus aureus
HGAFKIIETHALQDVQAV

SEQ ID NO: 1654873 - protein, 20 aa, Staphylococcus aureus
HGAGSPCGKALGSLPTTTLG

SEQ ID NO: 1654874 - protein, 18 aa, Staphylococcus aureus
HGDLWGGNYMFLKDGRPA

SEQ ID NO: 1654875 - protein, 24 aa, Staphylococcus aureus
HGLIIQRFGTTYVLTTKKEASMYI

SEQ ID NO: 1654876 - protein, 31 aa, Staphylococcus aureus
HHTNPLWRVYRLVKFSKVFKNVIIIEFSKFI

SEQ ID NO: 1654877 - protein, 24 aa, Staphylococcus aureus
HHYLKSDQAIKEFTSYLRKQINMK

SEQ ID NO: 1654878 - protein, 18 aa, Staphylococcus aureus
HKEGIPIVEDSIYSDLWF

SEQ ID NO: 1654879 - protein, 25 aa, Staphylococcus aureus
HLPEMKRYADIIVVCYHGGFEKDIE

SEQ ID NO: 1654880 - protein, 25 aa, Staphylococcus aureus
HNIKCLLHSRFIFLSPEFLLQPSNF

SEQ ID NO: 1654881 - protein, 26 aa, Staphylococcus aureus
HPVYTYKMKFIKSFEAIDLHHNIYEN

SEQ ID NO: 1654882 - protein, 17 aa, Staphylococcus aureus
HQICSLNDFYQIWTQKE

SEQ ID NO: 1654883 - protein, 18 aa, Staphylococcus aureus
HREFRKEILQTMQVSEAP

SEQ ID NO: 1654884 - protein, 21 aa, Staphylococcus aureus
HRKDLKFNLYVTTLHNSLIEM

SEQ ID NO: 1654885 - protein, 17 aa, Staphylococcus aureus
HSIFYCIPTLHNPTQNT

SEQ ID NO: 1654886 - protein, 24 aa, Staphylococcus aureus
HSKSIWRGTSKWFSNAYKSAKGWL

SEQ ID NO: 1654887 - protein, 24 aa, Staphylococcus aureus
HSLTEIKSRVEALLPEIKSIGMAI

SEQ ID NO: 1654888 - protein, 26 aa, Staphylococcus aureus
HTPGHPPESISFLLTDEGGGSSIPMG

SEQ ID NO: 1654889 - protein, 17 aa, Staphylococcus aureus
HVRSNWKDVTDIIAAQL

SEQ ID NO: 1654890 - protein, 28 aa, Staphylococcus aureus
HYLFNAELFKHFKKDAVFVNCARGSLVD

SEQ ID NO: 1654891 - protein, 25 aa, Staphylococcus aureus
IADCKRFLECLNDKNVETIEHSDWV

SEQ ID NO: 1654892 - protein, 25 aa, Staphylococcus aureus
IADCKRFLECLNDKNVKTIEHSDWV

SEQ ID NO: 1654893 - protein, 33 aa, Staphylococcus aureus
IAIERAAKVLGSWRLEDCTLYVTLEPCVMCAGT

SEQ ID NO: 1654894 - protein, 20 aa, Staphylococcus aureus
IAKLAHAIVMYFNNGPQAPH

SEQ ID NO: 1654895 - protein, 29 aa, Staphylococcus aureus
IANKISSMIPVEWEKVYTMAYIDDEGGEV

SEQ ID NO: 1654896 - protein, 19 aa, Staphylococcus aureus
IAPGLKRIDSIVLEELLKN

SEQ ID NO: 1654897 - protein, 29 aa, Staphylococcus aureus
IDAYLKVAYQFSLPFGRDYADAHEKMVRE

SEQ ID NO: 1654898 - protein, 21 aa, Staphylococcus aureus
IDIVEAFQIQCAREINNQEIE

SEQ ID NO: 1654899 - protein, 19 aa, Staphylococcus aureus
IDLHIAREMEIEQAPSLVF

SEQ ID NO: 1654900 - protein, 24 aa, Staphylococcus aureus
IDNFKHSYGTILFYENQDVVSGLQ

SEQ ID NO: 1654901 - protein, 17 aa, Staphylococcus aureus
IDQNIPYTILRDNIYTH

SEQ ID NO: 1654902 - protein, 22 aa, Staphylococcus aureus
IDTSCSRGEWGFDPKYDLVSMT

SEQ ID NO: 1654903 - protein, 18 aa, Staphylococcus aureus
IEADVPIYYYGFKESDDI

SEQ ID NO: 1654904 - protein, 17 aa, Staphylococcus aureus
IEATKMMYALSTIVQQH

SEQ ID NO: 1654905 - protein, 17 aa, Staphylococcus aureus
IEDGRLNVILMVGVNGV

SEQ ID NO: 1654906 - protein, 24 aa, Staphylococcus aureus
IEELKSVGFFLVDRNLPGVEIADN

SEQ ID NO: 1654907 - protein, 18 aa, Staphylococcus aureus
IEFYRKELQERSKLLENQ

SEQ ID NO: 1654908 - protein, 26 aa, Staphylococcus aureus
IEIIYLKSCDLTTILHNLYKRGVGTL

SEQ ID NO: 1654909 - protein, 23 aa, Staphylococcus aureus
IELVKVDGRISVITFHSLEDRLC

SEQ ID NO: 1654910 - protein, 22 aa, Staphylococcus aureus
IENNRFPLVLGGDHSIAIGSVS

SEQ ID NO: 1654911 - protein, 18 aa, Staphylococcus aureus
IEPSPIWMQVRLIKAGIR

SEQ ID NO: 1654912 - protein, 20 aa, Staphylococcus aureus
IEVWGKFTPRGGISIDPYTN

SEQ ID NO: 1654913 - protein, 17 aa, Staphylococcus aureus
IFASARPIRDLLPVLPS

SEQ ID NO: 1654914 - protein, 23 aa, Staphylococcus aureus
IFPRPIDNILPIWRAVGGPPASA

SEQ ID NO: 1654915 - protein, 21 aa, Staphylococcus aureus
IGHYHCQCGFKREQAKYEISR

SEQ ID NO: 1654916 - protein, 24 aa, Staphylococcus aureus
IGSSEMNLDMAIEMYDGNHHVLKV

SEQ ID NO: 1654917 - protein, 21 aa, Staphylococcus aureus
IGTICVKSNMMFSGYVSEQCI

SEQ ID NO: 1654918 - protein, 20 aa, Staphylococcus aureus
IHDRGMKLILDLVVNHTSDE

SEQ ID NO: 1654919 - protein, 19 aa, Staphylococcus aureus
IICNDAIELNEYFKNGEVS

SEQ ID NO: 1654920 - protein, 25 aa, Staphylococcus aureus
IIDETLCTMWQGFNYEIDMNLEPGQ

SEQ ID NO: 1654921 - protein, 24 aa, Staphylococcus aureus
IIEKGDMITLDFGAYFNGYCSDIT

SEQ ID NO: 1654922 - protein, 20 aa, Staphylococcus aureus
IKEHMASLVYKLEEMGVELE

SEQ ID NO: 1654923 - protein, 17 aa, Staphylococcus aureus
IKIPANILFGGKDEPSY

SEQ ID NO: 1654924 - protein, 25 aa, Staphylococcus aureus
IKLIEMNQGISFLPIYITKNSNYNI

SEQ ID NO: 1654925 - protein, 21 aa, Staphylococcus aureus
IKPGIPLKDIDHIARNIISEK

SEQ ID NO: 1654926 - protein, 19 aa, Staphylococcus aureus
IKTFYVWGCYKNEQIKWYV

SEQ ID NO: 1654927 - protein, 19 aa, Staphylococcus aureus
IKVVKAVKEATGLGLKDAK

SEQ ID NO: 1654928 - protein, 24 aa, Staphylococcus aureus
IKVYKLFFIEVYKTVFQMTSMVSG

SEQ ID NO: 1654929 - protein, 20 aa, Staphylococcus aureus
IKYLSLTQRKLFLFTKSTYS

SEQ ID NO: 1654930 - protein, 17 aa, Staphylococcus aureus
ILIGKVIDFDDKIDNFD

SEQ ID NO: 1654931 - protein, 18 aa, Staphylococcus aureus
ILMISRAVLTPGDTIVTS

SEQ ID NO: 1654932 - protein, 33 aa, Staphylococcus aureus
ILTSEYLRPEICKELREKLKQYHYVESELFPDV

SEQ ID NO: 1654933 - protein, 17 aa, Staphylococcus aureus
INMVRVRLSGVKLKEIL

SEQ ID NO: 1654934 - protein, 17 aa, Staphylococcus aureus
INVGCIPSKTLVHDGLE

SEQ ID NO: 1654935 - protein, 18 aa, Staphylococcus aureus
INVGLDIINTLSKHFKVT

SEQ ID NO: 1654936 - protein, 30 aa, Staphylococcus aureus
IPDTGFYRFWIQGIFARWTDNPNIEDMIQA

SEQ ID NO: 1654937 - protein, 18 aa, Staphylococcus aureus
IPTDLVVMAVGIRPYTEV

SEQ ID NO: 1654938 - protein, 26 aa, Staphylococcus aureus
IQGNTVCYMWLRFNMDQQFDGTAINQ

SEQ ID NO: 1654939 - protein, 17 aa, Staphylococcus aureus
IQGVILICYYYDNLQNY

SEQ ID NO: 1654940 - protein, 25 aa, Staphylococcus aureus
IQPILKEKFISLGLDVKEDEAAKHP

SEQ ID NO: 1654941 - protein, 27 aa, Staphylococcus aureus
IQTQARVKPAADREVDNAYNTRKQEIQ

SEQ ID NO: 1654942 - protein, 18 aa, Staphylococcus aureus
IRMYRSVQTFDFSAEQPF

SEQ ID NO: 1654943 - protein, 18 aa, Staphylococcus aureus
ISDLKRDVSLIYESTKEF

SEQ ID NO: 1654944 - protein, 25 aa, Staphylococcus aureus
ISGKRLDSFGHRGIRATHFSFEDIN

SEQ ID NO: 1654945 - protein, 19 aa, Staphylococcus aureus
ITAVGFIRNGGFNIYSHPE

SEQ ID NO: 1654946 - protein, 21 aa, Staphylococcus aureus
IVELLKYLYIEEVAFVCHEMG

SEQ ID NO: 1654947 - protein, 18 aa, Staphylococcus aureus
IVNHIKYYLNLITEKPSD

SEQ ID NO: 1654948 - protein, 18 aa, Staphylococcus aureus
IVYKGWLRSDQIKKFYTD

SEQ ID NO: 1654949 - protein, 26 aa, Staphylococcus aureus
KAADIFRSVGIDFCCGGQVSIEAASL

SEQ ID NO: 1654950 - protein, 21 aa, Staphylococcus aureus
KAIRGEGAFCNGFKMEEPPSL

SEQ ID NO: 1654951 - protein, 21 aa, Staphylococcus aureus
KANAELLNYYGVPKENIYTTA

SEQ ID NO: 1654952 - protein, 23 aa, Staphylococcus aureus
KDKSRPYVVTTLFSTKDNYTKDN

SEQ ID NO: 1654953 - protein, 17 aa, Staphylococcus aureus
KDLKVMLDIVINHTSTE

SEQ ID NO: 1654954 - protein, 18 aa, Staphylococcus aureus
KDWEKLKHNITFIHPQSE

SEQ ID NO: 1654955 - protein, 20 aa, Staphylococcus aureus
KEANAIALVLSFNHEVDTFS

SEQ ID NO: 1654956 - protein, 26 aa, Staphylococcus aureus
KEIYQFPLLLFYRGNIKLINNMHHLA

SEQ ID NO: 1654957 - protein, 25 aa, Staphylococcus aureus
KENRKQFDFRGLQCPGPIVNISKEI

SEQ ID NO: 1654958 - protein, 19 aa, Staphylococcus aureus
KERTDGLKAFKNVFKGFVD

SEQ ID NO: 1654959 - protein, 22 aa, Staphylococcus aureus
KESLKPAVIMNEFGKMSVDGAL

SEQ ID NO: 1654960 - protein, 24 aa, Staphylococcus aureus
KETFLTDMIEGMLIAHPELDLIAN

SEQ ID NO: 1654961 - protein, 24 aa, Staphylococcus aureus
KGFQKKIMYCFNKINAKAQKIHQK

SEQ ID NO: 1654962 - protein, 25 aa, Staphylococcus aureus
KGGIKEFKLDFANKNIIGKLGKLLK

SEQ ID NO: 1654963 - protein, 27 aa, Staphylococcus aureus
KGHGELMIKGANVMNGYLYPTDLTGTF

SEQ ID NO: 1654964 - protein, 23 aa, Staphylococcus aureus
KHAFSEKLKALGYNIDKEAQIDL

SEQ ID NO: 1654965 - protein, 27 aa, Staphylococcus aureus
KHYLIPEMHLKPILSYMKAHTMQTYVF

SEQ ID NO: 1654966 - protein, 26 aa, Staphylococcus aureus
KIAHGHAVMIGIIYQFIVANILFNSN

SEQ ID NO: 1654967 - protein, 30 aa, Staphylococcus aureus
KIIMFGGGGYNIWRVVPRAWSHVFLSLIDQ

SEQ ID NO: 1654968 - protein, 17 aa, Staphylococcus aureus
KIINRFSKEDIQVAPSY

SEQ ID NO: 1654969 - protein, 24 aa, Staphylococcus aureus
KKIVEAWSAGLIVLSGQSGVGKST

SEQ ID NO: 1654970 - protein, 26 aa, Staphylococcus aureus
KKTAYFKLAGLWIALNEEKDIPRNEI

SEQ ID NO: 1654971 - protein, 18 aa, Staphylococcus aureus
KLAKNIEATKMMYALSTI

SEQ ID NO: 1654972 - protein, 19 aa, Staphylococcus aureus
KLDSSITIADYVVSPTLIH

SEQ ID NO: 1654973 - protein, 18 aa, Staphylococcus aureus
KLGQSTGFDYTRTKNPTR

SEQ ID NO: 1654974 - protein, 27 aa, Staphylococcus aureus
KLKIELKLRKSIFIKSLKKHLSKFGYW

SEQ ID NO: 1654975 - protein, 20 aa, Staphylococcus aureus
KLPYSIRVLLESLLRQEDDF

SEQ ID NO: 1654976 - protein, 17 aa, Staphylococcus aureus
KLYKAIRGEGAFCNGFK

SEQ ID NO: 1654977 - protein, 20 aa, Staphylococcus aureus
KNNVALKFQTLNEIIETINN

SEQ ID NO: 1654978 - protein, 31 aa, Staphylococcus aureus
KNTSTIIPMCHPLPLTGIDVHFNWDETNAPL

SEQ ID NO: 1654979 - protein, 20 aa, Staphylococcus aureus
KPDALMLCEHLYDEGYGCLL

SEQ ID NO: 1654980 - protein, 19 aa, Staphylococcus aureus
KPKKIMLVAGHGYNDPGAV

SEQ ID NO: 1654981 - protein, 24 aa, Staphylococcus aureus
KPTASEVVEWALYIAKNKIAIDVP

SEQ ID NO: 1654982 - protein, 20 aa, Staphylococcus aureus
KQESRHETTIEFYRKELQER

SEQ ID NO: 1654983 - protein, 28 aa, Staphylococcus aureus
KQPGTETIYRFSLLVPNQAALHYFEKRL

SEQ ID NO: 1654984 - protein, 18 aa, Staphylococcus aureus
KQSNLYCRFYEKNYEQAF

SEQ ID NO: 1654985 - protein, 36 aa, Staphylococcus aureus
KQYFRMLQRPILYTGLTRAKTSLVLLGDSEAFDIGL

SEQ ID NO: 1654986 - protein, 19 aa, Staphylococcus aureus
KRGYPIGQILIPGRDEGHM

SEQ ID NO: 1654987 - protein, 20 aa, Staphylococcus aureus
KRIKDIVSYAEGFIYTVTMN

SEQ ID NO: 1654988 - protein, 20 aa, Staphylococcus aureus
KRTEFKWKNEAIVGVMLASK

SEQ ID NO: 1654989 - protein, 29 aa, Staphylococcus aureus
KSDNPRFKRWVIGSILSRTYYHNMVTHLL

SEQ ID NO: 1654990 - protein, 17 aa, Staphylococcus aureus
KSLPFTENDENIVVLIH

SEQ ID NO: 1654991 - protein, 18 aa, Staphylococcus aureus
KSRVATLKKNVLFEKMKL

SEQ ID NO: 1654992 - protein, 20 aa, Staphylococcus aureus
KSTRNKLGFDELSKRNGYQI

SEQ ID NO: 1654993 - protein, 26 aa, Staphylococcus aureus
KSYFFPSKLAFVLFFIKQLEITEHHF

SEQ ID NO: 1654994 - protein, 17 aa, Staphylococcus aureus
KTIVYKGWLRSDQIKKF

SEQ ID NO: 1654995 - protein, 26 aa, Staphylococcus aureus
KTQFIKSTKSRCLYEETTYHILTNGD

SEQ ID NO: 1654996 - protein, 25 aa, Staphylococcus aureus
KTTAFDFFQDNGFGFITSYNLDDLN

SEQ ID NO: 1654997 - protein, 25 aa, Staphylococcus aureus
KVNLKKIYTCLVYGKTHTFGIIEAN

SEQ ID NO: 1654998 - protein, 20 aa, Staphylococcus aureus
KYRFPERNRIISGLSKGVLI

SEQ ID NO: 1654999 - protein, 20 aa, Staphylococcus aureus
LAKDDIYAVAYSFENAESIN

SEQ ID NO: 1655000 - protein, 24 aa, Staphylococcus aureus
LATKAKEQKALIAQTADATTEEKE

SEQ ID NO: 1655001 - protein, 18 aa, Staphylococcus aureus
LDINVNRIGIKGGNNNRY

SEQ ID NO: 1655002 - protein, 22 aa, Staphylococcus aureus
LEKSCPYQHYIKQLIKQKPFQL

SEQ ID NO: 1655003 - protein, 23 aa, Staphylococcus aureus
LEQHMKSCIMNKVNQGAQEEAME

SEQ ID NO: 1655004 - protein, 18 aa, Staphylococcus aureus
LFITTKVWIENVNYEDTI

SEQ ID NO: 1655005 - protein, 21 aa, Staphylococcus aureus
LFTRLNYYLIDLFRQQNQLKD

SEQ ID NO: 1655006 - protein, 33 aa, Staphylococcus aureus
LFYQFIMKLPESVLRLKGYVSFRDQPNAIYEFQ

SEQ ID NO: 1655007 - protein, 17 aa, Staphylococcus aureus
LGIGKFIILSIGDLIEI

SEQ ID NO: 1655008 - protein, 18 aa, Staphylococcus aureus
LGVGEGFNVIASDALAML

SEQ ID NO: 1655009 - protein, 18 aa, Staphylococcus aureus
LIDSFIKLVIDFKYIPIN

SEQ ID NO: 1655010 - protein, 20 aa, Staphylococcus aureus
LKAYIDSGGKISQTTLMSLF

SEQ ID NO: 1655011 - protein, 23 aa, Staphylococcus aureus
LKEGIKEAFQFDRKLVIEQGVNA

SEQ ID NO: 1655012 - protein, 17 aa, Staphylococcus aureus
LKFDSLIIDNANLSSPY

SEQ ID NO: 1655013 - protein, 17 aa, Staphylococcus aureus
LKIDLHIAREMEIEQAP

SEQ ID NO: 1655014 - protein, 19 aa, Staphylococcus aureus
LKKAEAREKSLELLEKVGL

SEQ ID NO: 1655015 - protein, 21 aa, Staphylococcus aureus
LKVAHTLSLAQIVVVNMEAVN

SEQ ID NO: 1655016 - protein, 21 aa, Staphylococcus aureus
LKVLSAPSLDYGLIGFVSHDY

SEQ ID NO: 1655017 - protein, 17 aa, Staphylococcus aureus
LKYKDAFIINNKFINCE

SEQ ID NO: 1655018 - protein, 19 aa, Staphylococcus aureus
LKYKDAFIINNKFINCEGG

SEQ ID NO: 1655019 - protein, 29 aa, Staphylococcus aureus
LLGEDCRRTMDIFRLLGVEIKEDDEKLVV

SEQ ID NO: 1655020 - protein, 24 aa, Staphylococcus aureus
LLITLAKLSAHYGLGLKSLIDITN

SEQ ID NO: 1655021 - protein, 22 aa, Staphylococcus aureus
LLLKDFITYNVDDWWEEVEKAY

SEQ ID NO: 1655022 - protein, 19 aa, Staphylococcus aureus
LLMIKSKMLLPQSTSDIDV

SEQ ID NO: 1655023 - protein, 17 aa, Staphylococcus aureus
LLMPKKQMEALVYKFYK

SEQ ID NO: 1655024 - protein, 30 aa, Staphylococcus aureus
LLSEIPLENIIKLPARFHKKSLPVPKYRYF

SEQ ID NO: 1655025 - protein, 20 aa, Staphylococcus aureus
LLWQEIESFDDDKIKGLLEV

SEQ ID NO: 1655026 - protein, 25 aa, Staphylococcus aureus
LMLEFHKRGAVAFDYGNNIRQVAFN

SEQ ID NO: 1655027 - protein, 17 aa, Staphylococcus aureus
LMNYNFVIIDTPPVNTV

SEQ ID NO: 1655028 - protein, 21 aa, Staphylococcus aureus
LMSTEGIIVLVIYHGHSEGQL

SEQ ID NO: 1655029 - protein, 19 aa, Staphylococcus aureus
LNHSVSYYFKNSFYITPSG

SEQ ID NO: 1655030 - protein, 24 aa, Staphylococcus aureus
LNPIELKNSIGFVYSENYFNERWT

SEQ ID NO: 1655031 - protein, 17 aa, Staphylococcus aureus
LNYTYSQFFEEMKPMIA

SEQ ID NO: 1655032 - protein, 18 aa, Staphylococcus aureus
LPDDMIWFDLSDRDQYTF

SEQ ID NO: 1655033 - protein, 18 aa, Staphylococcus aureus
LPLIKKGGQFVALKSSKG

SEQ ID NO: 1655034 - protein, 24 aa, Staphylococcus aureus
LPNGVELRNRFVLAPLTHISSNDD

SEQ ID NO: 1655035 - protein, 18 aa, Staphylococcus aureus
LPQVDSFVNLMTSFVEEP

SEQ ID NO: 1655036 - protein, 28 aa, Staphylococcus aureus
LPYVELALGAGMAFLIRRFTKKDQQTEE

SEQ ID NO: 1655037 - protein, 32 aa, Staphylococcus aureus
LQLVMAIAALKLKLSPNEVWNAVTVNAAKAID

SEQ ID NO: 1655038 - protein, 33 aa, Staphylococcus aureus
LQVISSIKGIGSWTVQMFMLFQFPHVAFENIPV

SEQ ID NO: 1655039 - protein, 18 aa, Staphylococcus aureus
LREKLNRVSSEAAHMIQT

SEQ ID NO: 1655040 - protein, 20 aa, Staphylococcus aureus
LRFISEFKYSYNVQKKENLV

SEQ ID NO: 1655041 - protein, 19 aa, Staphylococcus aureus
LRGMLRRMIGHPKKDRAAY

SEQ ID NO: 1655042 - protein, 25 aa, Staphylococcus aureus
LSAGEPCLRYHQTFYTMTGKPFDSS

SEQ ID NO: 1655043 - protein, 25 aa, Staphylococcus aureus
LSEKSLKRTPSFSVNRPGEETGVTF

SEQ ID NO: 1655044 - protein, 23 aa, Staphylococcus aureus
LSKNMPVFFSANMSYGVHALTKI

SEQ ID NO: 1655045 - protein, 18 aa, Staphylococcus aureus
LSNEGMVLYLDRNTRTAK

SEQ ID NO: 1655046 - protein, 20 aa, Staphylococcus aureus
LSPKLIPNHIFKKILTNDIE

SEQ ID NO: 1655047 - protein, 18 aa, Staphylococcus aureus
LSVILPQYVESLIYGTIL

SEQ ID NO: 1655048 - protein, 24 aa, Staphylococcus aureus
LTAIYRKHYKSCKEEALSKIDKAL

SEQ ID NO: 1655049 - protein, 17 aa, Staphylococcus aureus
LTNHLGFVYQINEDEFF

SEQ ID NO: 1655050 - protein, 18 aa, Staphylococcus aureus
LTQVGFKHVETFTDFNID

SEQ ID NO: 1655051 - protein, 30 aa, Staphylococcus aureus
LVMAIAALKLKLSPNEVWNAVTVNAAKAID

SEQ ID NO: 1655052 - protein, 20 aa, Staphylococcus aureus
LVNEEIWKGIDVNIQEMDIV

SEQ ID NO: 1655053 - protein, 17 aa, Staphylococcus aureus
LVRAGIAKLIIVDRDYI

SEQ ID NO: 1655054 - protein, 17 aa, Staphylococcus aureus
LWTKLIELWEDQTVVIV

SEQ ID NO: 1655055 - protein, 18 aa, Staphylococcus aureus
LYDREIRGLAQVSVSGES

SEQ ID NO: 1655056 - protein, 23 aa, Staphylococcus aureus
LYPHQRYAIDLVIKENHKTYKNL

SEQ ID NO: 1655057 - protein, 22 aa, Staphylococcus aureus
LYQDVPEQFSIMRYHSLISNPD

SEQ ID NO: 1655058 - protein, 18 aa, Staphylococcus aureus
LYQMFHVLLSFSVAYGAT

SEQ ID NO: 1655059 - protein, 17 aa, Staphylococcus aureus
MASMVFLLGELNVSDLS

SEQ ID NO: 1655060 - protein, 17 aa, Staphylococcus aureus
MDKCYLGLHSHIDWETL

SEQ ID NO: 1655061 - protein, 18 aa, Staphylococcus aureus
MDRVLRPLKSMNANIEGI

SEQ ID NO: 1655062 - protein, 24 aa, Staphylococcus aureus
MFDIPYSIMGHVHFRKSVMDDGRC

SEQ ID NO: 1655063 - protein, 19 aa, Staphylococcus aureus
MFPELVPTTYVMKGMKERY

SEQ ID NO: 1655064 - protein, 24 aa, Staphylococcus aureus
MGDIGKAFARRLQGFNTKILYHNR

SEQ ID NO: 1655065 - protein, 27 aa, Staphylococcus aureus
MHQIRVLRELDFHFQLVIDANESLNRQ

SEQ ID NO: 1655066 - protein, 25 aa, Staphylococcus aureus
MIYQLGALQGFCRIHQLKINHVKPH

SEQ ID NO: 1655067 - protein, 20 aa, Staphylococcus aureus
MKLDCKDEFIMIDEDKCLVV

SEQ ID NO: 1655068 - protein, 22 aa, Staphylococcus aureus
MKLVFLEGLFKTLLNKNSQVVF

SEQ ID NO: 1655069 - protein, 24 aa, Staphylococcus aureus
MKQGKTILKNISWQINEGDKWILY

SEQ ID NO: 1655070 - protein, 25 aa, Staphylococcus aureus
MKVTQAPRVLGFDAIGTVEAIGPDV

SEQ ID NO: 1655071 - protein, 25 aa, Staphylococcus aureus
MLIGLHHRICYTTSASVLTEAVKQS

SEQ ID NO: 1655072 - protein, 17 aa, Staphylococcus aureus
MNDLKLSSEQELNIQHL

SEQ ID NO: 1655073 - protein, 24 aa, Staphylococcus aureus
MNPVELRRNIGYVIQQIGLMTHMT

SEQ ID NO: 1655074 - protein, 21 aa, Staphylococcus aureus
MPKKQMEALVYKFYKENNINL

SEQ ID NO: 1655075 - protein, 17 aa, Staphylococcus aureus
MPVEAAAMPMPQVQSTD

SEQ ID NO: 1655076 - protein, 18 aa, Staphylococcus aureus
MQRTACTTCGDVPSYPYL

SEQ ID NO: 1655077 - protein, 17 aa, Staphylococcus aureus
MVQVCFLGEAPWGYKKV

SEQ ID NO: 1655078 - protein, 17 aa, Staphylococcus aureus
MVRVRLSGVKLKEILAK

SEQ ID NO: 1655079 - protein, 27 aa, Staphylococcus aureus
NAKSGPWLKDLLRQIEIAIVTGKVSNE

SEQ ID NO: 1655080 - protein, 34 aa, Staphylococcus aureus
NAMALNEEFDLLALRKSVIRWCELLLTNKPMALI

SEQ ID NO: 1655081 - protein, 41 aa, Staphylococcus aureus
NAVKEGKAKINAVKTFSEYKKDALAKIADAYNAKVNEADNS

SEQ ID NO: 1655082 - protein, 17 aa, Staphylococcus aureus
NCLMARIGKNITLEQQQ

SEQ ID NO: 1655083 - protein, 20 aa, Staphylococcus aureus
NDALIAPAVKVWIETYDGKH

SEQ ID NO: 1655084 - protein, 23 aa, Staphylococcus aureus
NDELPGLPMFQGKSITIVNDKVR

SEQ ID NO: 1655085 - protein, 24 aa, Staphylococcus aureus
NDKGECLRDCLSLEMICDELWVFI

SEQ ID NO: 1655086 - protein, 38 aa, Staphylococcus aureus
NECNYPVISEKLEWIPNLYVAGCFADLELGPFGRNVMG

SEQ ID NO: 1655087 - protein, 25 aa, Staphylococcus aureus
NEITNRLSKIFGIKSISPVLKVEKS

SEQ ID NO: 1655088 - protein, 21 aa, Staphylococcus aureus
NEPQGSFYIWFKLSVPVNIKL

SEQ ID NO: 1655089 - protein, 18 aa, Staphylococcus aureus
NFDKVVQYESVFDFEEMI

SEQ ID NO: 1655090 - protein, 19 aa, Staphylococcus aureus
NGNVPIFINIGEWDGDDEE

SEQ ID NO: 1655091 - protein, 22 aa, Staphylococcus aureus
NHLKSLKAFNYMPYFEQLDMNQ

SEQ ID NO: 1655092 - protein, 17 aa, Staphylococcus aureus
NHTIPIVNIPVGYSETI

SEQ ID NO: 1655093 - protein, 24 aa, Staphylococcus aureus
NIISVPLPPIFKYTLALTNDKESL

SEQ ID NO: 1655094 - protein, 17 aa, Staphylococcus aureus
NIQRWILDNVLYRRQVH

SEQ ID NO: 1655095 - protein, 22 aa, Staphylococcus aureus
NIVFMRKWLDLGNRYGNIEEVM

SEQ ID NO: 1655096 - protein, 17 aa, Staphylococcus aureus
NKILIGKVIDFDDKIDN

SEQ ID NO: 1655097 - protein, 18 aa, Staphylococcus aureus
NLEILKWSNKSKIIETLT

SEQ ID NO: 1655098 - protein, 28 aa, Staphylococcus aureus
NLERALKIELDFYFPLLKSWSKKKKSEM

SEQ ID NO: 1655099 - protein, 25 aa, Staphylococcus aureus
NMGNHSWKAIEIIYETYVHYVIPVS

SEQ ID NO: 1655100 - protein, 17 aa, Staphylococcus aureus
NNLGQSFSFIKHLAEKY

SEQ ID NO: 1655101 - protein, 22 aa, Staphylococcus aureus
NRLKSYINEATDFHHFVKSLKT

SEQ ID NO: 1655102 - protein, 23 aa, Staphylococcus aureus
NSIIKIPVQYGGTYGPDIEEVAK

SEQ ID NO: 1655103 - protein, 18 aa, Staphylococcus aureus
NTTLFEFDILSSILESDA

SEQ ID NO: 1655104 - protein, 20 aa, Staphylococcus aureus
NVFKARRDRFEAMLTKADLP

SEQ ID NO: 1655105 - protein, 25 aa, Staphylococcus aureus
NVGCITRPFPTGVRITIGFKEQNGK

SEQ ID NO: 1655106 - protein, 25 aa, Staphylococcus aureus
NVYRHLADSGVFIFDVHTVYKMMTL

SEQ ID NO: 1655107 - protein, 18 aa, Staphylococcus aureus
NWGNYKLVFNTRNGANLQ

SEQ ID NO: 1655108 - protein, 26 aa, Staphylococcus aureus
NYEDVYKLLNWIKLIIIEYISNIVKK

SEQ ID NO: 1655109 - protein, 20 aa, Staphylococcus aureus
PDEAPGIGMRFIKINDIKLA

SEQ ID NO: 1655110 - protein, 18 aa, Staphylococcus aureus
PEWIKGKRTVTIRWRGPF

SEQ ID NO: 1655111 - protein, 17 aa, Staphylococcus aureus
PFFLEFMAKDVSKGNAI

SEQ ID NO: 1655112 - protein, 26 aa, Staphylococcus aureus
PGKATINFRECRYNYSLLRLNLNDGF

SEQ ID NO: 1655113 - protein, 23 aa, Staphylococcus aureus
PIPIKALTSYLEFGNYELRLPLV

SEQ ID NO: 1655114 - protein, 22 aa, Staphylococcus aureus
PIRLDRYFPDWHEAYSKVQALN

SEQ ID NO: 1655115 - protein, 23 aa, Staphylococcus aureus
PKDRIIKPLAYLYNKDLERTGLL

SEQ ID NO: 1655116 - protein, 18 aa, Staphylococcus aureus
PKIQLNIYGHGNGLSEYR

SEQ ID NO: 1655117 - protein, 21 aa, Staphylococcus aureus
PKKSNAWGWANATRAQTSSAM

SEQ ID NO: 1655118 - protein, 17 aa, Staphylococcus aureus
PKLIVAGASAYSRTIDF

SEQ ID NO: 1655119 - protein, 22 aa, Staphylococcus aureus
PKMLPFQGYVLQHFELMDDGFC

SEQ ID NO: 1655120 - protein, 18 aa, Staphylococcus aureus
PLAGPVVACATILNSNHN

SEQ ID NO: 1655121 - protein, 29 aa, Staphylococcus aureus
PLLGEDCRRTMDIFRLLGVDIKEDEDKLV

SEQ ID NO: 1655122 - protein, 25 aa, Staphylococcus aureus
PNMDVFKKCYKALITKQETNIQKEG

SEQ ID NO: 1655123 - protein, 19 aa, Staphylococcus aureus
PPNRMGNLAIKKGWPSMMY

SEQ ID NO: 1655124 - protein, 26 aa, Staphylococcus aureus
PRLQPWDFAGGLVILNEVDGLASNLL

SEQ ID NO: 1655125 - protein, 24 aa, Staphylococcus aureus
PSRNKLEPIMLIIVNDVYHPINER

SEQ ID NO: 1655126 - protein, 25 aa, Staphylococcus aureus
PSSELARPLLSAALSEDNEVVKIDL

SEQ ID NO: 1655127 - protein, 23 aa, Staphylococcus aureus
PTEKKGPSVLGIIEYQVQGANEF

SEQ ID NO: 1655128 - protein, 18 aa, Staphylococcus aureus
PVNIKLLFNEAIKENILI

SEQ ID NO: 1655129 - protein, 19 aa, Staphylococcus aureus
PVPYAMHVAPLCIKYLSLT

SEQ ID NO: 1655130 - protein, 26 aa, Staphylococcus aureus
PYKVFTSFYRKWRPYLRHRDVYHYDL

SEQ ID NO: 1655131 - protein, 18 aa, Staphylococcus aureus
QEGIKLIETSECVAEKYL

SEQ ID NO: 1655132 - protein, 20 aa, Staphylococcus aureus
QEKIELFKKLEFKQLLSDID

SEQ ID NO: 1655133 - protein, 17 aa, Staphylococcus aureus
QFLNQRNHAPFICAIEK

SEQ ID NO: 1655134 - protein, 20 aa, Staphylococcus aureus
QFTGSFKFRGASNKINHLSD

SEQ ID NO: 1655135 - protein, 18 aa, Staphylococcus aureus
QGDIKIRGYQDLLQPILK

SEQ ID NO: 1655136 - protein, 22 aa, Staphylococcus aureus
QHAPGWGLDALKCLIEERRVEA

SEQ ID NO: 1655137 - protein, 20 aa, Staphylococcus aureus
QHHKFASGTSIRTSIISQDD

SEQ ID NO: 1655138 - protein, 23 aa, Staphylococcus aureus
QIHQRLFLEQSLITERIKKYFKN

SEQ ID NO: 1655139 - protein, 25 aa, Staphylococcus aureus
QKYILKMDIENFFPSITFKQVRKIF

SEQ ID NO: 1655140 - protein, 18 aa, Staphylococcus aureus
QLERVYIASVLMLKPKLI

SEQ ID NO: 1655141 - protein, 34 aa, Staphylococcus aureus
QLFYQFIMKLSESVLRLKGYVSFRDQPNAIYEFQ

SEQ ID NO: 1655142 - protein, 35 aa, Staphylococcus aureus
QLNWPDSWLYSTKFMLPKWLYKIAKQRADNKQLQN

SEQ ID NO: 1655143 - protein, 18 aa, Staphylococcus aureus
QNLVELIMTAFFNNNHII

SEQ ID NO: 1655144 - protein, 17 aa, Staphylococcus aureus
QPIAPGMKYKHYSPNTP

SEQ ID NO: 1655145 - protein, 28 aa, Staphylococcus aureus
QPVSPHLAFKMANQIFLNKQCVLDKVKV

SEQ ID NO: 1655146 - protein, 24 aa, Staphylococcus aureus
QQIDLLWQEIESFDDDKIKGLLEL

SEQ ID NO: 1655147 - protein, 25 aa, Staphylococcus aureus
QQWCQKFNIVLTIKKKQGIVVDGTD

SEQ ID NO: 1655148 - protein, 21 aa, Staphylococcus aureus
QRVHGGAMLKENRMIEANLTE

SEQ ID NO: 1655149 - protein, 17 aa, Staphylococcus aureus
QSSKMYGGTCINVGCIP

SEQ ID NO: 1655150 - protein, 24 aa, Staphylococcus aureus
QTPMLKYKVPRAFVEISPELAEDR

SEQ ID NO: 1655151 - protein, 22 aa, Staphylococcus aureus
QVKEKYSGLVERFNENVNDYNE

SEQ ID NO: 1655152 - protein, 28 aa, Staphylococcus aureus
QVYHLNARLKLQLLDDIKSVFNSQMTQN

SEQ ID NO: 1655153 - protein, 18 aa, Staphylococcus aureus
QYLYLTGRQHDMLIIGGQ

SEQ ID NO: 1655154 - protein, 24 aa, Staphylococcus aureus
QYQKLIVVPLFLYDGRLVNKVKQQ

SEQ ID NO: 1655155 - protein, 23 aa, Staphylococcus aureus
RAEKDVYHLLSLPNRVNQQALPE

SEQ ID NO: 1655156 - protein, 17 aa, Staphylococcus aureus
RAFIKSGLLQFADGNGF

SEQ ID NO: 1655157 - protein, 17 aa, Staphylococcus aureus
RAKRYNRWLQFDYVIHS

SEQ ID NO: 1655158 - protein, 22 aa, Staphylococcus aureus
RARVSVGARSSVFAPFKNLGLI

SEQ ID NO: 1655159 - protein, 21 aa, Staphylococcus aureus
RASGFCIYNDIAITAQYLAKE

SEQ ID NO: 1655160 - protein, 19 aa, Staphylococcus aureus
RDTSWIYDADFEKLSKQQI

SEQ ID NO: 1655161 - protein, 19 aa, Staphylococcus aureus
RDYLAQGLQSIWDENKRFL

SEQ ID NO: 1655162 - protein, 24 aa, Staphylococcus aureus
RGNKRIDYRLSYNFYTTYYDNVEI

SEQ ID NO: 1655163 - protein, 24 aa, Staphylococcus aureus
RIPKEERPRLTLVAFSNDATEALG

SEQ ID NO: 1655164 - protein, 21 aa, Staphylococcus aureus
RKVLQKRRFKKALQQKREEHK

SEQ ID NO: 1655165 - protein, 27 aa, Staphylococcus aureus
RLDGATKEFFAWGFRVGFMTFGTSDQT

SEQ ID NO: 1655166 - protein, 25 aa, Staphylococcus aureus
RMHKGTEQMLGMFANTLVYRGQPSL

SEQ ID NO: 1655167 - protein, 17 aa, Staphylococcus aureus
RNHLRLWSLQGHRDIPN

SEQ ID NO: 1655168 - protein, 25 aa, Staphylococcus aureus
RNNILKFSLFTGEKHIVINADDIIN

SEQ ID NO: 1655169 - protein, 21 aa, Staphylococcus aureus
RPHSSLQYLTPVAFKNIHMKT

SEQ ID NO: 1655170 - protein, 17 aa, Staphylococcus aureus
RPMIFPLSNPTKLAEAT

SEQ ID NO: 1655171 - protein, 18 aa, Staphylococcus aureus
RPSIPLNEIEQVITRLKE

SEQ ID NO: 1655172 - protein, 26 aa, Staphylococcus aureus
RQQLNVFRMELLGAKVVAVEEGQGTL

SEQ ID NO: 1655173 - protein, 26 aa, Staphylococcus aureus
RQYLKHLKTVFPERQYITNINKSNAH

SEQ ID NO: 1655174 - protein, 22 aa, Staphylococcus aureus
RRDRFEAMLTKADLPFFHAKGG

SEQ ID NO: 1655175 - protein, 19 aa, Staphylococcus aureus
RSEAPFKKALLYAPLYPIE

SEQ ID NO: 1655176 - protein, 18 aa, Staphylococcus aureus
RTIIRLSPPLVIDKEEIH

SEQ ID NO: 1655177 - protein, 19 aa, Staphylococcus aureus
RVDDETYYTFVDKFVSAVR

SEQ ID NO: 1655178 - protein, 17 aa, Staphylococcus aureus
RVRLSGVKLKEIITKSN

SEQ ID NO: 1655179 - protein, 20 aa, Staphylococcus aureus
RYITEIMKIRQRVMEMLLLP

SEQ ID NO: 1655180 - protein, 29 aa, Staphylococcus aureus
RYYFNEGFVPKFKSYFAIGEQTARTIKTY

SEQ ID NO: 1655181 - protein, 17 aa, Staphylococcus aureus
SAVKISGLFKKMHVRMM

SEQ ID NO: 1655182 - protein, 17 aa, Staphylococcus aureus
SDIDGVLEYIEKWTSQR

SEQ ID NO: 1655183 - protein, 27 aa, Staphylococcus aureus
SDLIPELQGRFPIRVELDSLAVEDFVR

SEQ ID NO: 1655184 - protein, 22 aa, Staphylococcus aureus
SDLRAGACLIIAGLIAEGVTTI

SEQ ID NO: 1655185 - protein, 24 aa, Staphylococcus aureus
SDLSALPGKYFIFKDLQIEEYQSK

SEQ ID NO: 1655186 - protein, 29 aa, Staphylococcus aureus
SFCSTCTRARLSSDGKFYGCLFATADGFN

SEQ ID NO: 1655187 - protein, 20 aa, Staphylococcus aureus
SGNRNWGLNFAKAGRTISEE

SEQ ID NO: 1655188 - protein, 17 aa, Staphylococcus aureus
SGSIYKGRRLESYSFDI

SEQ ID NO: 1655189 - protein, 17 aa, Staphylococcus aureus
SHFYYYYDFEYDCLILP

SEQ ID NO: 1655190 - protein, 21 aa, Staphylococcus aureus
SHGVYRYLTSRTNGLKLTPRE

SEQ ID NO: 1655191 - protein, 34 aa, Staphylococcus aureus
SKEERIMEGLSLIPLPGMGFLKGAGKSLMKLGFK

SEQ ID NO: 1655192 - protein, 24 aa, Staphylococcus aureus
SKEMLEHALQHFEGTILFVSHDRY

SEQ ID NO: 1655193 - protein, 17 aa, Staphylococcus aureus
SKPFFLEFMAKDVSKGN

SEQ ID NO: 1655194 - protein, 18 aa, Staphylococcus aureus
SKVIFCEADDWKPFYEAY

SEQ ID NO: 1655195 - protein, 20 aa, Staphylococcus aureus
SLKKHLSKFGYWNEPQGSFY

SEQ ID NO: 1655196 - protein, 21 aa, Staphylococcus aureus
SLLKHYKIKLETFIELHSKTQ

SEQ ID NO: 1655197 - protein, 19 aa, Staphylococcus aureus
SLSSFLFTRLNYYLIDLFR

SEQ ID NO: 1655198 - protein, 17 aa, Staphylococcus aureus
SMLQLPQVDSFVNLMTS

SEQ ID NO: 1655199 - protein, 19 aa, Staphylococcus aureus
SNAILPIRLDGATKEFFAW

SEQ ID NO: 1655200 - protein, 20 aa, Staphylococcus aureus
SNKSQIRWISVLDLKDKDEN

SEQ ID NO: 1655201 - protein, 18 aa, Staphylococcus aureus
SPTNLKIIKSYGANVEMV

SEQ ID NO: 1655202 - protein, 17 aa, Staphylococcus aureus
SPYMIVGMIGAIKAGCG

SEQ ID NO: 1655203 - protein, 25 aa, Staphylococcus aureus
SPYTRSKFYSELKVLEAVKNGLDGR

SEQ ID NO: 1655204 - protein, 17 aa, Staphylococcus aureus
SREYLNFKKTKSKILPF

SEQ ID NO: 1655205 - protein, 26 aa, Staphylococcus aureus
SSFLECFKLTVEPVVKSFKPDIILSV

SEQ ID NO: 1655206 - protein, 23 aa, Staphylococcus aureus
SSNRKRFTIAHEIGHFLHNHKNK

SEQ ID NO: 1655207 - protein, 31 aa, Staphylococcus aureus
SSPSYALFKGRDLVYFMPREFIEGRDINDIA

SEQ ID NO: 1655208 - protein, 23 aa, Staphylococcus aureus
STLAKAICGFLDITGNIQFCNKG

SEQ ID NO: 1655209 - protein, 18 aa, Staphylococcus aureus
SVDISYPLTALKLDDVNR

SEQ ID NO: 1655210 - protein, 18 aa, Staphylococcus aureus
SVKTRLGYYEIDEWKDWL

SEQ ID NO: 1655211 - protein, 24 aa, Staphylococcus aureus
SVLYKDYLECVKLGSVKLTCNNFG

SEQ ID NO: 1655212 - protein, 18 aa, Staphylococcus aureus
SWDNVGLLIGDGDVEVTG

SEQ ID NO: 1655213 - protein, 17 aa, Staphylococcus aureus
SYISDFINGYFLGNPIQ

SEQ ID NO: 1655214 - protein, 22 aa, Staphylococcus aureus
TADPFSVAVEMNKDALQQQVNS

SEQ ID NO: 1655215 - protein, 22 aa, Staphylococcus aureus
TAHQRIKFSSIDNEEIIYILDY

SEQ ID NO: 1655216 - protein, 23 aa, Staphylococcus aureus
TAKGIGNSVIYVGLKTGRDGIHG

SEQ ID NO: 1655217 - protein, 18 aa, Staphylococcus aureus
TAMIQHIGEMLGIKTPMI

SEQ ID NO: 1655218 - protein, 22 aa, Staphylococcus aureus
TARYGEFGSFFVGHIINTNEFN

SEQ ID NO: 1655219 - protein, 17 aa, Staphylococcus aureus
TDVLFKYVENILNKDKD

SEQ ID NO: 1655220 - protein, 18 aa, Staphylococcus aureus
TFHAIQGHFTAMFKQLFG

SEQ ID NO: 1655221 - protein, 25 aa, Staphylococcus aureus
TGLPMKRVDDIKAYIQDDVPKVMGV

SEQ ID NO: 1655222 - protein, 19 aa, Staphylococcus aureus
TGQTYDWTILKNIKDIPYL

SEQ ID NO: 1655223 - protein, 18 aa, Staphylococcus aureus
TKLTLKIMDHISEKWPTI

SEQ ID NO: 1655224 - protein, 20 aa, Staphylococcus aureus
TKSKILPFISYSKYQYHKCS

SEQ ID NO: 1655225 - protein, 25 aa, Staphylococcus aureus
TKTKEGLFTKGLRRRAKLLETILKN

SEQ ID NO: 1655226 - protein, 22 aa, Staphylococcus aureus
TLEPCSHFGSTPPCVNKIIDCK

SEQ ID NO: 1655227 - protein, 24 aa, Staphylococcus aureus
TLKLQRMGVLPKFHGGTKKKDWLD

SEQ ID NO: 1655228 - protein, 21 aa, Staphylococcus aureus
TNGEPWFPVNLNYKTINVAQQ

SEQ ID NO: 1655229 - protein, 24 aa, Staphylococcus aureus
TQATEAIPNWAAENGYPITNYEQI

SEQ ID NO: 1655230 - protein, 17 aa, Staphylococcus aureus
TRKDISYMLDLDMIEDL

SEQ ID NO: 1655231 - protein, 20 aa, Staphylococcus aureus
TSIFPTPIVGMVGLIENVDY

SEQ ID NO: 1655232 - protein, 25 aa, Staphylococcus aureus
TVSPGLRIGWIIADEKVIHHLADLK

SEQ ID NO: 1655233 - protein, 17 aa, Staphylococcus aureus
TYGTGGFMLMNTGDKAV

SEQ ID NO: 1655234 - protein, 19 aa, Staphylococcus aureus
TYLSWLTQVGFKHVETFTD

SEQ ID NO: 1655235 - protein, 23 aa, Staphylococcus aureus
TYYRLLVEWNEKMNLTSITDEHD

SEQ ID NO: 1655236 - protein, 20 aa, Staphylococcus aureus
VAKLAHAIVMYFNNGPQTPH

SEQ ID NO: 1655237 - protein, 18 aa, Staphylococcus aureus
VALFRPDENFKRLNNSLA

SEQ ID NO: 1655238 - protein, 24 aa, Staphylococcus aureus
VESDWPLTHGQFFSILPIYDSGGY

SEQ ID NO: 1655239 - protein, 26 aa, Staphylococcus aureus
VFKKSFKRKQLGFFRMIGYCKLDQCR

SEQ ID NO: 1655240 - protein, 18 aa, Staphylococcus aureus
VGKALFKYQQRDDIVIGT

SEQ ID NO: 1655241 - protein, 23 aa, Staphylococcus aureus
VIAEKSIEMIVAMIGVLKAGGAY

SEQ ID NO: 1655242 - protein, 22 aa, Staphylococcus aureus
VKKWLEEDVDVIITTGGTGIAQ

SEQ ID NO: 1655243 - protein, 23 aa, Staphylococcus aureus
VKNGDLFLLLAKENWHEGVLGIV

SEQ ID NO: 1655244 - protein, 21 aa, Staphylococcus aureus
VKQAATARKAQNATVSNATDE

SEQ ID NO: 1655245 - protein, 22 aa, Staphylococcus aureus
VKQFLNKKVKRYEIPSMIHHVE

SEQ ID NO: 1655246 - protein, 25 aa, Staphylococcus aureus
VKQLKIVPLLLFSAMHYLKDIPNIV

SEQ ID NO: 1655247 - protein, 25 aa, Staphylococcus aureus
VKSKREALEMAERVDLDLVVVAPNA

SEQ ID NO: 1655248 - protein, 28 aa, Staphylococcus aureus
VKVGGTWHYICLFIDLFNREIVGYSAGK

SEQ ID NO: 1655249 - protein, 19 aa, Staphylococcus aureus
VLSELCLPLIKKGGQFVAL

SEQ ID NO: 1655250 - protein, 24 aa, Staphylococcus aureus
VMEELRLLARAVFVLDVDNKVVYK

SEQ ID NO: 1655251 - protein, 24 aa, Staphylococcus aureus
VMFMIREGIGLYPIDLSSNIYEDK

SEQ ID NO: 1655252 - protein, 23 aa, Staphylococcus aureus
VMKEGLKTLLMNWFNIEKINIDV

SEQ ID NO: 1655253 - protein, 18 aa, Staphylococcus aureus
VNAALHYLARLIEAGDLP

SEQ ID NO: 1655254 - protein, 19 aa, Staphylococcus aureus
VNDDTSLVWLCNPNNPTGT

SEQ ID NO: 1655255 - protein, 24 aa, Staphylococcus aureus
VNVAKTGTAHLFKVPTDADRLDLE

SEQ ID NO: 1655256 - protein, 22 aa, Staphylococcus aureus
VPELRFPGFEGEWEEKKVGELL

SEQ ID NO: 1655257 - protein, 25 aa, Staphylococcus aureus
VPTDADRLDLEFIPDNTAVADASRI

SEQ ID NO: 1655258 - protein, 32 aa, Staphylococcus aureus
VRNAFDFPGFVPAYIRPLFCEGKGPFRFAALS

SEQ ID NO: 1655259 - protein, 17 aa, Staphylococcus aureus
VSAFIHRADIGGVLNVS

SEQ ID NO: 1655260 - protein, 21 aa, Staphylococcus aureus
VSQIKRLKFDSLIIDNANLSS

SEQ ID NO: 1655261 - protein, 19 aa, Staphylococcus aureus
VSRLSDILEEFLSADKYVL

SEQ ID NO: 1655262 - protein, 28 aa, Staphylococcus aureus
VTDEFKKRWPINIGFIGNVRFNEINQKL

SEQ ID NO: 1655263 - protein, 28 aa, Staphylococcus aureus
VTGAGCLLGGIIAGFLFRETEPDIEALI

SEQ ID NO: 1655264 - protein, 26 aa, Staphylococcus aureus
VTGAGCLLGGVIAGFLFRETEPDIEA

SEQ ID NO: 1655265 - protein, 27 aa, Staphylococcus aureus
VTGAGCLLGGVIAGFLFRETEPDIEAL

SEQ ID NO: 1655266 - protein, 20 aa, Staphylococcus aureus
VTIFFTFWGLNALKKAQSTR

SEQ ID NO: 1655267 - protein, 24 aa, Staphylococcus aureus
VTKKEFIDFPVLFDDEGNFRKKQV

SEQ ID NO: 1655268 - protein, 24 aa, Staphylococcus aureus
VTTEKDNGIAVLEQDVITPTVKPQ

SEQ ID NO: 1655269 - protein, 17 aa, Staphylococcus aureus
VVIGGLYDNRLLVKATK

SEQ ID NO: 1655270 - protein, 17 aa, Staphylococcus aureus
VVKACGGTITLEDLANY

SEQ ID NO: 1655271 - protein, 25 aa, Staphylococcus aureus
VYGLFIYNKWRGMGTLNSVDVISQH

SEQ ID NO: 1655272 - protein, 28 aa, Staphylococcus aureus
WDSPFGEGRPGWHIECSVMAFHELGATI

SEQ ID NO: 1655273 - protein, 18 aa, Staphylococcus aureus
WILDNVLYRRQVHKCATG

SEQ ID NO: 1655274 - protein, 17 aa, Staphylococcus aureus
WLEGFDIECRNEESIHQ

SEQ ID NO: 1655275 - protein, 25 aa, Staphylococcus aureus
WMAIFKDMNFELGIMELYAIESDAL

SEQ ID NO: 1655276 - protein, 18 aa, Staphylococcus aureus
WNVQHGVVIIPKSVTPNR

SEQ ID NO: 1655277 - protein, 22 aa, Staphylococcus aureus
WQINEGDKWILYGLNGAGKTTL

SEQ ID NO: 1655278 - protein, 25 aa, Staphylococcus aureus
WRGPFERFRIVHLIENGHVEKKSGK

SEQ ID NO: 1655279 - protein, 34 aa, Staphylococcus aureus
YAGQERLPLIHKWINGRMPLIGIGSIFTADEALD

SEQ ID NO: 1655280 - protein, 30 aa, Staphylococcus aureus
YAQMVNHLYRLPVMYIEYSGIYGDVSKVQA

SEQ ID NO: 1655281 - protein, 18 aa, Staphylococcus aureus
YATLCGRDTVQYENTSIT

SEQ ID NO: 1655282 - protein, 25 aa, Staphylococcus aureus
YAVPTTDCYEVFWGGDNELYNYHYL

SEQ ID NO: 1655283 - protein, 23 aa, Staphylococcus aureus
YDKNKFKVIGPFVADNYVLSVET

SEQ ID NO: 1655284 - protein, 25 aa, Staphylococcus aureus
YEQFKEAYAKFYGLSPEQIIAGNGS

SEQ ID NO: 1655285 - protein, 23 aa, Staphylococcus aureus
YFNKRLRTTGGRYLLKSHDIEIN

SEQ ID NO: 1655286 - protein, 27 aa, Staphylococcus aureus
YGHFGRTDVLFPWEKLDKVEELKDAVK

SEQ ID NO: 1655287 - protein, 25 aa, Staphylococcus aureus
YIRGGCSPVGMKTLFPTVVDKSCEN

SEQ ID NO: 1655288 - protein, 23 aa, Staphylococcus aureus
YKAAELQGRLRAERFIHLMQNEI

SEQ ID NO: 1655289 - protein, 17 aa, Staphylococcus aureus
YKDAFIINNKFINCEGG

SEQ ID NO: 1655290 - protein, 19 aa, Staphylococcus aureus
YKLFSERYGKQNIAYATVH

SEQ ID NO: 1655291 - protein, 18 aa, Staphylococcus aureus
YKNKFILNIRDYFFENNK

SEQ ID NO: 1655292 - protein, 17 aa, Staphylococcus aureus
YKRTSCRMEVITKRGKS

SEQ ID NO: 1655293 - protein, 20 aa, Staphylococcus aureus
YLDKDLETIVGVQTEKPFKR

SEQ ID NO: 1655294 - protein, 20 aa, Staphylococcus aureus
YLFEIIDPYSVNQQGNDIGE

SEQ ID NO: 1655295 - protein, 18 aa, Staphylococcus aureus
YLPELMNMHKLIYPAGDG

SEQ ID NO: 1655296 - protein, 23 aa, Staphylococcus aureus
YMGVKRLEKIIAQIQQYTDIDYP

SEQ ID NO: 1655297 - protein, 17 aa, Staphylococcus aureus
YMIERKYHFMGYRQMKT

SEQ ID NO: 1655298 - protein, 18 aa, Staphylococcus aureus
YMSDLKLSNEQELNIQHL

SEQ ID NO: 1655299 - protein, 19 aa, Staphylococcus aureus
YMSDLKLSSEQELNIQHLA

SEQ ID NO: 1655300 - protein, 24 aa, Staphylococcus aureus
YMSHVKHIGKLVLRASDVIEHHKF

SEQ ID NO: 1655301 - protein, 17 aa, Staphylococcus aureus
YNIAYEIRLQAALESDI

SEQ ID NO: 1655302 - protein, 20 aa, Staphylococcus aureus
YQDLNARIDGIVQAEQSEEG

SEQ ID NO: 1655303 - protein, 25 aa, Staphylococcus aureus
YQRGMKLSAACDTTLKNAEKKVNDL

SEQ ID NO: 1655304 - protein, 18 aa, Staphylococcus aureus
YSDLWFSPNQQISMKALK

SEQ ID NO: 1655305 - protein, 18 aa, Staphylococcus aureus
YVLMTYYNIICHYGEQAF

SEQ ID NO: 1655306 - protein, 17 aa, Staphylococcus aureus
YYITTPILLNLMQQDIP

SEQ ID NO: 1655307 - protein, 19 aa, Staphylococcus aureus
YYTSGGFIHYCEYPKLQHN

SEQ ID NO: 1655308 - protein, 24 aa, Staphylococcus aureus
AAILKQLEQFGSYMVISPHIALIH

SEQ ID NO: 1655309 - protein, 20 aa, Staphylococcus aureus
AESVKLLFNVECEVKFAEGY

SEQ ID NO: 1655310 - protein, 23 aa, Staphylococcus aureus
AFLEDLNQPFIYIGKDTVKLQDD

SEQ ID NO: 1655311 - protein, 18 aa, Staphylococcus aureus
AGSEVSALLGRMPSAVGY

SEQ ID NO: 1655312 - protein, 24 aa, Staphylococcus aureus
AILKAEGNMNIFIIEYDDVNKDIS

SEQ ID NO: 1655313 - protein, 18 aa, Staphylococcus aureus
AKLSLLAEELLRDINKET

SEQ ID NO: 1655314 - protein, 25 aa, Staphylococcus aureus
AKQELRIGTWSILPFDIEHDANEPV

SEQ ID NO: 1655315 - protein, 19 aa, Staphylococcus aureus
ALMGKYRISGVPIVDNKED

SEQ ID NO: 1655316 - protein, 19 aa, Staphylococcus aureus
ALTSYLKKQNCLYVLVDPY

SEQ ID NO: 1655317 - protein, 25 aa, Staphylococcus aureus
ANKISSMIPVEWEKVYAMAYVNERS

SEQ ID NO: 1655318 - protein, 21 aa, Staphylococcus aureus
ARRVLAIECVIALQAAELKGV

SEQ ID NO: 1655319 - protein, 17 aa, Staphylococcus aureus
ATHPLNFYHRNEGYEKA

SEQ ID NO: 1655320 - protein, 24 aa, Staphylococcus aureus
AVPTTDCYEVFWGGDNELYNYHYL

SEQ ID NO: 1655321 - protein, 24 aa, Staphylococcus aureus
CKELLDLLRLHLSLFNKYEKDEIR

SEQ ID NO: 1655322 - protein, 21 aa, Staphylococcus aureus
CKERIKLIQFHQSYSYEDFIM

SEQ ID NO: 1655323 - protein, 24 aa, Staphylococcus aureus
DDGIFKFNLNLMIDVGIISKYYPV

SEQ ID NO: 1655324 - protein, 18 aa, Staphylococcus aureus
DDKIKGLLELATQQIDKL

SEQ ID NO: 1655325 - protein, 21 aa, Staphylococcus aureus
DELIQKLMLIMPEGPVLTLNP

SEQ ID NO: 1655326 - protein, 17 aa, Staphylococcus aureus
DEYSRILIKNDKTNTMK

SEQ ID NO: 1655327 - protein, 19 aa, Staphylococcus aureus
DGFNVKAFIRSGVTDEELK

SEQ ID NO: 1655328 - protein, 18 aa, Staphylococcus aureus
DGLVTKLQAALIDNQAAI

SEQ ID NO: 1655329 - protein, 20 aa, Staphylococcus aureus
DHIDKVCVVVNPDLTTIEHV

SEQ ID NO: 1655330 - protein, 18 aa, Staphylococcus aureus
DHQITFIPYFPLASGILA

SEQ ID NO: 1655331 - protein, 17 aa, Staphylococcus aureus
DIAPSTELRQWFQHDPK

SEQ ID NO: 1655332 - protein, 19 aa, Staphylococcus aureus
DIETLWTLFTAALNFANYP

SEQ ID NO: 1655333 - protein, 17 aa, Staphylococcus aureus
DIVPSYRAVLIYFDEQA

SEQ ID NO: 1655334 - protein, 18 aa, Staphylococcus aureus
DKFFKEREGKYQVEVKEA

SEQ ID NO: 1655335 - protein, 23 aa, Staphylococcus aureus
DNNDINEIIAWRGEQEELEQKRD

SEQ ID NO: 1655336 - protein, 25 aa, Staphylococcus aureus
DPFAKLAYMILCNNFSYRVNETAAR

SEQ ID NO: 1655337 - protein, 24 aa, Staphylococcus aureus
DQYMSIDALRAFLEDLNQPFIYIG

SEQ ID NO: 1655338 - protein, 22 aa, Staphylococcus aureus
DTDKGGQCVRQLLQADDVEVSD

SEQ ID NO: 1655339 - protein, 17 aa, Staphylococcus aureus
DTPSMPLEKIVAGLTAA

SEQ ID NO: 1655340 - protein, 27 aa, Staphylococcus aureus
DYEFDLGHFRGAIRPNITRFRDLPDWI

SEQ ID NO: 1655341 - protein, 26 aa, Staphylococcus aureus
DYIEVKIIRNVFDKMLTDSQFEDTKN

SEQ ID NO: 1655342 - protein, 19 aa, Staphylococcus aureus
EAIERPAVVTIMGHVDHGK

SEQ ID NO: 1655343 - protein, 17 aa, Staphylococcus aureus
EATLDWTFYNDIPLSYK

SEQ ID NO: 1655344 - protein, 17 aa, Staphylococcus aureus
EDLAGEDFILFNKDFYL

SEQ ID NO: 1655345 - protein, 20 aa, Staphylococcus aureus
EEVAEADAAVDAAQTEGLHD

SEQ ID NO: 1655346 - protein, 25 aa, Staphylococcus aureus
EFDSLFKRIPVKSGDFYYVPAGTVH

SEQ ID NO: 1655347 - protein, 20 aa, Staphylococcus aureus
EIVKEVYKKTGIKFPTLASD

SEQ ID NO: 1655348 - protein, 18 aa, Staphylococcus aureus
EKGILIYRDKSFHAILNF

SEQ ID NO: 1655349 - protein, 25 aa, Staphylococcus aureus
EKHHLRVVGGFQFSSHKSDDEWREF

SEQ ID NO: 1655350 - protein, 19 aa, Staphylococcus aureus
EKRDVMISGLGFITIGPGA

SEQ ID NO: 1655351 - protein, 21 aa, Staphylococcus aureus
EKVKIIMKILKAMSQAHSENK

SEQ ID NO: 1655352 - protein, 26 aa, Staphylococcus aureus
ELPISRLLQWGTDFVKPLARLAYNGE

SEQ ID NO: 1655353 - protein, 22 aa, Staphylococcus aureus
ELSKRGGLTIVDDIMVQSATAI

SEQ ID NO: 1655354 - protein, 22 aa, Staphylococcus aureus
ENFAISIGIYIDGKPYAGFVYD

SEQ ID NO: 1655355 - protein, 23 aa, Staphylococcus aureus
ENIFDLYSAILIKGISSQLNSGL

SEQ ID NO: 1655356 - protein, 19 aa, Staphylococcus aureus
ENKGCPWDKVQTHETLKRY

SEQ ID NO: 1655357 - protein, 21 aa, Staphylococcus aureus
ERFSVPRNIYIVGMMNTADRS

SEQ ID NO: 1655358 - protein, 20 aa, Staphylococcus aureus
ETFLFFSGFYYPLYLAGQGK

SEQ ID NO: 1655359 - protein, 28 aa, Staphylococcus aureus
EVLFPDKSLKLSYKVNVANIDTPKNIDF

SEQ ID NO: 1655360 - protein, 20 aa, Staphylococcus aureus
FETFCDEMAQAGIYKWHIDI

SEQ ID NO: 1655361 - protein, 25 aa, Staphylococcus aureus
FGNYELRLPLVSLEDTDTKVLREAY

SEQ ID NO: 1655362 - protein, 20 aa, Staphylococcus aureus
FKVLAKDVFEMFVNEEKVLT

SEQ ID NO: 1655363 - protein, 30 aa, Staphylococcus aureus
FNGKKEWKLFYLYKELIQTFEILYDDTSTT

SEQ ID NO: 1655364 - protein, 31 aa, Staphylococcus aureus
FPVISRKEMQQEIPYPFFVIKMPESNRSKYT

SEQ ID NO: 1655365 - protein, 18 aa, Staphylococcus aureus
FQKLICNLISPTSGTLYF

SEQ ID NO: 1655366 - protein, 27 aa, Staphylococcus aureus
FYTGLRIGEAMALVWTDYNKYKKEISI

SEQ ID NO: 1655367 - protein, 18 aa, Staphylococcus aureus
GADIVFHPAVEDIYPGEL

SEQ ID NO: 1655368 - protein, 20 aa, Staphylococcus aureus
GDVVFRKGDKVLQLVNRPND

SEQ ID NO: 1655369 - protein, 17 aa, Staphylococcus aureus
GIELGRHYPRQMVDHQE

SEQ ID NO: 1655370 - protein, 17 aa, Staphylococcus aureus
GLINRGVEPLIEEKLKD

SEQ ID NO: 1655371 - protein, 24 aa, Staphylococcus aureus
GLKADNGLELLVHIGLDTVQLDGE

SEQ ID NO: 1655372 - protein, 20 aa, Staphylococcus aureus
GLYPDLTIYLNVSAEVGRER

SEQ ID NO: 1655373 - protein, 23 aa, Staphylococcus aureus
GNSKITSGLYWIAPETFANFDSR

SEQ ID NO: 1655374 - protein, 17 aa, Staphylococcus aureus
GQLFLLDVFEGNIFKVN

SEQ ID NO: 1655375 - protein, 22 aa, Staphylococcus aureus
GQYRGIATWRYDQKRQRLIGTI

SEQ ID NO: 1655376 - protein, 25 aa, Staphylococcus aureus
GRVVKGIQFKGLRDIGNPVDLAIYY

SEQ ID NO: 1655377 - protein, 24 aa, Staphylococcus aureus
GTEFEIMLSGPIAFTDRFIDPATR

SEQ ID NO: 1655378 - protein, 18 aa, Staphylococcus aureus
GYQRLSPKGKTRFETKAS

SEQ ID NO: 1655379 - protein, 17 aa, Staphylococcus aureus
HAILNFIDENKFPNEYI

SEQ ID NO: 1655380 - protein, 25 aa, Staphylococcus aureus
HGELMIKGANVMNGYLYPTDLTGTF

SEQ ID NO: 1655381 - protein, 25 aa, Staphylococcus aureus
HGGKKLTNIKVYDWVQQVEQLGAGE

SEQ ID NO: 1655382 - protein, 24 aa, Staphylococcus aureus
HLNIKVIIVTTFKRPGYFEKAVAN

SEQ ID NO: 1655383 - protein, 29 aa, Staphylococcus aureus
HLQNVDGFKALRFLRPRTAGRHYIIITLW

SEQ ID NO: 1655384 - protein, 23 aa, Staphylococcus aureus
HLRLLYKNEVLDFYKDGKMAYYF

SEQ ID NO: 1655385 - protein, 18 aa, Staphylococcus aureus
HPHLKNNFYGLIDGKEFK

SEQ ID NO: 1655386 - protein, 17 aa, Staphylococcus aureus
HVYVLPQLHTLLWSNKK

SEQ ID NO: 1655387 - protein, 23 aa, Staphylococcus aureus
HYVNEYCCLNVHVIYNGADNTLK

SEQ ID NO: 1655388 - protein, 29 aa, Staphylococcus aureus
IDILDIRFGSLWTNIPLAFLKSLEIVHGN

SEQ ID NO: 1655389 - protein, 20 aa, Staphylococcus aureus
IDIPEGYILHSDQGSVYTSY

SEQ ID NO: 1655390 - protein, 18 aa, Staphylococcus aureus
IECVIALQAAELKGVEGL

SEQ ID NO: 1655391 - protein, 17 aa, Staphylococcus aureus
IEDGVVCFYSRSKQRLW

SEQ ID NO: 1655392 - protein, 19 aa, Staphylococcus aureus
IEGNSGLFVAMPSKRTPDG

SEQ ID NO: 1655393 - protein, 27 aa, Staphylococcus aureus
IEMIDYFKALFPNGGLYVHLDQATERH

SEQ ID NO: 1655394 - protein, 20 aa, Staphylococcus aureus
IEPQDLFSAMIHEIETQDFD

SEQ ID NO: 1655395 - protein, 20 aa, Staphylococcus aureus
IEYGGKRILIDPMLSDKGSF

SEQ ID NO: 1655396 - protein, 19 aa, Staphylococcus aureus
IGDFFKKMDILISKQKIKI

SEQ ID NO: 1655397 - protein, 25 aa, Staphylococcus aureus
IIAIPDWFWSYQMAMTLNEETCFEA

SEQ ID NO: 1655398 - protein, 18 aa, Staphylococcus aureus
IKHFGDIVVQHIDQTTLQ

SEQ ID NO: 1655399 - protein, 21 aa, Staphylococcus aureus
IKIDLDYADVLGLQSQGRDNV

SEQ ID NO: 1655400 - protein, 24 aa, Staphylococcus aureus
ILDYALRRRFAFYNMQPAFHTTKF

SEQ ID NO: 1655401 - protein, 18 aa, Staphylococcus aureus
ILIDPMLSDKGSFDPFPN

SEQ ID NO: 1655402 - protein, 18 aa, Staphylococcus aureus
INDVAPFFNVSPEQLANE

SEQ ID NO: 1655403 - protein, 18 aa, Staphylococcus aureus
INKMKVIYPVSAKEQRKI

SEQ ID NO: 1655404 - protein, 21 aa, Staphylococcus aureus
INPMLRLLKTDVLTTSYLKSA

SEQ ID NO: 1655405 - protein, 22 aa, Staphylococcus aureus
ISKSFDGEDIFNDVDFEVKTGE

SEQ ID NO: 1655406 - protein, 17 aa, Staphylococcus aureus
ITTILNNKLQAIQATPD

SEQ ID NO: 1655407 - protein, 30 aa, Staphylococcus aureus
ITTNKDGYKYYSFIDNVGLFSGSHLYVKNR

SEQ ID NO: 1655408 - protein, 19 aa, Staphylococcus aureus
IVDWFLKAREKYGLEKVIA

SEQ ID NO: 1655409 - protein, 24 aa, Staphylococcus aureus
IVITCNYRLGALGYLDWSYFNKDF

SEQ ID NO: 1655410 - protein, 18 aa, Staphylococcus aureus
IVLEHGQTLFIITHNLSH

SEQ ID NO: 1655411 - protein, 26 aa, Staphylococcus aureus
IWSIATFYYSRMMKIMNLAILKIKIG

SEQ ID NO: 1655412 - protein, 18 aa, Staphylococcus aureus
IYHELSTDYLDVRDVDAP

SEQ ID NO: 1655413 - protein, 17 aa, Staphylococcus aureus
KALFKLLALESQHAGLS

SEQ ID NO: 1655414 - protein, 20 aa, Staphylococcus aureus
KANERKAAIAQTQEITAEEI

SEQ ID NO: 1655415 - protein, 22 aa, Staphylococcus aureus
KATESKSGLTIIVRSSKTEYLP

SEQ ID NO: 1655416 - protein, 22 aa, Staphylococcus aureus
KDKAMLKIACIDLNEYQDKLKI

SEQ ID NO: 1655417 - protein, 23 aa, Staphylococcus aureus
KEALQRMAMMRSYMRSQVTQQPF

SEQ ID NO: 1655418 - protein, 19 aa, Staphylococcus aureus
KEANAIALVLSFNHEVDTF

SEQ ID NO: 1655419 - protein, 25 aa, Staphylococcus aureus
KEAYDLGIRAIMFFGVPNSKDDIGT

SEQ ID NO: 1655420 - protein, 28 aa, Staphylococcus aureus
KEEVHGNLSLELDVLFGVSSLVTAFLKY

SEQ ID NO: 1655421 - protein, 24 aa, Staphylococcus aureus
KFREKTRIGRFFNITNWYEEIHSA

SEQ ID NO: 1655422 - protein, 20 aa, Staphylococcus aureus
KGVFDIFDYVMLGHLHHPFS

SEQ ID NO: 1655423 - protein, 24 aa, Staphylococcus aureus
KINPDLIGGFRVKVGTTVLDGSVR

SEQ ID NO: 1655424 - protein, 22 aa, Staphylococcus aureus
KKLASAVPDHIDKVCVVVNPDL

SEQ ID NO: 1655425 - protein, 18 aa, Staphylococcus aureus
KKPACTVITMYPHLDGVL

SEQ ID NO: 1655426 - protein, 19 aa, Staphylococcus aureus
KLKPSGWYKTIPPKKDGGT

SEQ ID NO: 1655427 - protein, 17 aa, Staphylococcus aureus
KMLAHKMNKAIVIVLHD

SEQ ID NO: 1655428 - protein, 23 aa, Staphylococcus aureus
KMPSMKITLSFSEFNTTKTTVTS

SEQ ID NO: 1655429 - protein, 38 aa, Staphylococcus aureus
KNLIGAFYRPTAVIYDLDFLKTLPFEQILSGYAEVYKH

SEQ ID NO: 1655430 - protein, 20 aa, Staphylococcus aureus
KPDSELIINFTTMQTNSKQG

SEQ ID NO: 1655431 - protein, 24 aa, Staphylococcus aureus
KPILIHTIEKFILVSEFNEIIIAT

SEQ ID NO: 1655432 - protein, 19 aa, Staphylococcus aureus
KQGYVYQSFCYQILKEDIG

SEQ ID NO: 1655433 - protein, 18 aa, Staphylococcus aureus
KSASGFSEADLEKYAPEC

SEQ ID NO: 1655434 - protein, 24 aa, Staphylococcus aureus
KSGILKEGRLEFRPPLVDITQLQP

SEQ ID NO: 1655435 - protein, 27 aa, Staphylococcus aureus
KSPLAEISVKVFNEFNISEREASDIVN

SEQ ID NO: 1655436 - protein, 18 aa, Staphylococcus aureus
KTLEFKERIASGVDTLDT

SEQ ID NO: 1655437 - protein, 17 aa, Staphylococcus aureus
KYKTVAVKSTFGSRDFT

SEQ ID NO: 1655438 - protein, 20 aa, Staphylococcus aureus
KYYYGIEVCQSMGADNATFL

SEQ ID NO: 1655439 - protein, 22 aa, Staphylococcus aureus
LADKAMDTIVQFIAENLGKFSQ

SEQ ID NO: 1655440 - protein, 21 aa, Staphylococcus aureus
LEKSQAFEFIIEGETLIPPFI

SEQ ID NO: 1655441 - protein, 22 aa, Staphylococcus aureus
LELPVEIQHQIRLQRLSQSPQK

SEQ ID NO: 1655442 - protein, 17 aa, Staphylococcus aureus
LESQHAGLSWLTILKKK

SEQ ID NO: 1655443 - protein, 26 aa, Staphylococcus aureus
LEYKKIRPNLCRKIYINYHKKRKHSE

SEQ ID NO: 1655444 - protein, 26 aa, Staphylococcus aureus
LEYYKKEFPELVVTSSNIQWSLDNDD

SEQ ID NO: 1655445 - protein, 17 aa, Staphylococcus aureus
LFRKINWKVYDESTGVP

SEQ ID NO: 1655446 - protein, 21 aa, Staphylococcus aureus
LHGMWQFPMFKSEHARREMTE

SEQ ID NO: 1655447 - protein, 23 aa, Staphylococcus aureus
LHSNLAVGVAFEIIGESYHKNEI

SEQ ID NO: 1655448 - protein, 17 aa, Staphylococcus aureus
LIFVNRLNEGLYCILNQ

SEQ ID NO: 1655449 - protein, 19 aa, Staphylococcus aureus
LKADQFKYEVTLPQGVTYV

SEQ ID NO: 1655450 - protein, 17 aa, Staphylococcus aureus
LKEKYTIIMVTHNMQQA

SEQ ID NO: 1655451 - protein, 20 aa, Staphylococcus aureus
LKERINELFKGIKSFIEKVY

SEQ ID NO: 1655452 - protein, 19 aa, Staphylococcus aureus
LKKEYLDWYNQILEFSNLS

SEQ ID NO: 1655453 - protein, 28 aa, Staphylococcus aureus
LKLKDDLKELISLVGREEAVLIFVNRLN

SEQ ID NO: 1655454 - protein, 18 aa, Staphylococcus aureus
LNHRERLWLKLYLEGYKQ

SEQ ID NO: 1655455 - protein, 29 aa, Staphylococcus aureus
LNSTDGEPCNECHICKGITQGTNSDVIEI

SEQ ID NO: 1655456 - protein, 17 aa, Staphylococcus aureus
LQCPGPIVNISKEINNI

SEQ ID NO: 1655457 - protein, 17 aa, Staphylococcus aureus
LQMNLIRSHACGLGEPF

SEQ ID NO: 1655458 - protein, 18 aa, Staphylococcus aureus
LQYNLPIYNSFGMTETCS

SEQ ID NO: 1655459 - protein, 19 aa, Staphylococcus aureus
LRKDIGIVFQNPDNQFVGS

SEQ ID NO: 1655460 - protein, 24 aa, Staphylococcus aureus
LRKIKHSYLKKSFLEIVETLKNDP

SEQ ID NO: 1655461 - protein, 18 aa, Staphylococcus aureus
LRNMIGIKSDYFYKCLYV

SEQ ID NO: 1655462 - protein, 42 aa, Staphylococcus aureus
LRSIIESPSFKNAESKLTVAMGYRINNEPLLMDIAKTPHALI

SEQ ID NO: 1655463 - protein, 17 aa, Staphylococcus aureus
LSSGWNYNSKLVAGKNA

SEQ ID NO: 1655464 - protein, 18 aa, Staphylococcus aureus
LTAPVRQIAENAGLEGSV

SEQ ID NO: 1655465 - protein, 20 aa, Staphylococcus aureus
LTELSSYWVYQDINKDNDFT

SEQ ID NO: 1655466 - protein, 22 aa, Staphylococcus aureus
LVEGFKNADFEKVVVYRDEEEL

SEQ ID NO: 1655467 - protein, 17 aa, Staphylococcus aureus
MAEYIGISEPQKLIQLF

SEQ ID NO: 1655468 - protein, 18 aa, Staphylococcus aureus
MDIDPFTIFALFNKNSMR

SEQ ID NO: 1655469 - protein, 17 aa, Staphylococcus aureus
MENELPLIKGKKVILFA

SEQ ID NO: 1655470 - protein, 20 aa, Staphylococcus aureus
MGLGYLVNVYDTWKVEKVLD

SEQ ID NO: 1655471 - protein, 20 aa, Staphylococcus aureus
MIAPFYRKWDHQVFEFYLEK

SEQ ID NO: 1655472 - protein, 26 aa, Staphylococcus aureus
MKMFEFKQGVKLFGAIVILSQSGYTG

SEQ ID NO: 1655473 - protein, 26 aa, Staphylococcus aureus
MKQKALAKVRMSEIGFILQATNLVPF

SEQ ID NO: 1655474 - protein, 17 aa, Staphylococcus aureus
MKSTVYLINASRGPIVH

SEQ ID NO: 1655475 - protein, 18 aa, Staphylococcus aureus
MRLPIEYLANIFTAGDTK

SEQ ID NO: 1655476 - protein, 17 aa, Staphylococcus aureus
MYVGGGTPTALSINQLE

SEQ ID NO: 1655477 - protein, 18 aa, Staphylococcus aureus
NAEIAKIEAIQPATTTKD

SEQ ID NO: 1655478 - protein, 22 aa, Staphylococcus aureus
NANKFYKFAIYGKFGTGKTTFL

SEQ ID NO: 1655479 - protein, 17 aa, Staphylococcus aureus
NASEILALIDDTATMKG

SEQ ID NO: 1655480 - protein, 17 aa, Staphylococcus aureus
NDLDYRLIVLNHAPNLR

SEQ ID NO: 1655481 - protein, 20 aa, Staphylococcus aureus
NDSRILEALVRYANDQNYTA

SEQ ID NO: 1655482 - protein, 25 aa, Staphylococcus aureus
NEKYNIQQAKGWTQVKMKAVLHNEA

SEQ ID NO: 1655483 - protein, 21 aa, Staphylococcus aureus
NELYRVIGVYSKHKGKDTYVN

SEQ ID NO: 1655484 - protein, 18 aa, Staphylococcus aureus
NEQIKWYVDMGVIDKEEY

SEQ ID NO: 1655485 - protein, 21 aa, Staphylococcus aureus
NGHVLPIIAQFLLDNTNDVTS

SEQ ID NO: 1655486 - protein, 26 aa, Staphylococcus aureus
NIDELRARIRVALRMSRSTETIQSRF

SEQ ID NO: 1655487 - protein, 17 aa, Staphylococcus aureus
NIIKLAIDQNIPYTILR

SEQ ID NO: 1655488 - protein, 17 aa, Staphylococcus aureus
NLFELGIELGRHYPRQM

SEQ ID NO: 1655489 - protein, 24 aa, Staphylococcus aureus
NMGNHSWKALEIIYETYVHYVIPV

SEQ ID NO: 1655490 - protein, 21 aa, Staphylococcus aureus
NMVDKGVVIWKGKEFEPSDIV

SEQ ID NO: 1655491 - protein, 18 aa, Staphylococcus aureus
NNGVDIFVLQSLMRHAQI

SEQ ID NO: 1655492 - protein, 20 aa, Staphylococcus aureus
NNLNFFNPRIGKNITSMPHY

SEQ ID NO: 1655493 - protein, 19 aa, Staphylococcus aureus
NNYVAVWFRQERRDGTFRT

SEQ ID NO: 1655494 - protein, 23 aa, Staphylococcus aureus
NPLKSLDIGDDWLQNAKLMDNSN

SEQ ID NO: 1655495 - protein, 17 aa, Staphylococcus aureus
NPSACFTGFELFVKPAV

SEQ ID NO: 1655496 - protein, 17 aa, Staphylococcus aureus
NREFVTWLDNIASIVSR

SEQ ID NO: 1655497 - protein, 20 aa, Staphylococcus aureus
NRVSWLEKWQRIEKKGRKEI

SEQ ID NO: 1655498 - protein, 39 aa, Staphylococcus aureus
NSALEQLKAQRINPVVKKNALEAIREVVNKQIEIIENAD

SEQ ID NO: 1655499 - protein, 26 aa, Staphylococcus aureus
NVGLFSGSHLYVKNRDLAPKATNNKE

SEQ ID NO: 1655500 - protein, 25 aa, Staphylococcus aureus
PDKLDKCFYKYYGLNKLINLLIKEK

SEQ ID NO: 1655501 - protein, 19 aa, Staphylococcus aureus
PDQAFCKGTVRTFDSKIQE

SEQ ID NO: 1655502 - protein, 17 aa, Staphylococcus aureus
PESKSCIDIKLDHTELK

SEQ ID NO: 1655503 - protein, 24 aa, Staphylococcus aureus
PEVTAATFACFGYGWHIDVGIHAI

SEQ ID NO: 1655504 - protein, 18 aa, Staphylococcus aureus
PFGGFKMSGTDAKTGSPD

SEQ ID NO: 1655505 - protein, 22 aa, Staphylococcus aureus
PFQEGRDGFVMGEGAGILVIES

SEQ ID NO: 1655506 - protein, 18 aa, Staphylococcus aureus
PFTIFALFNKNSMRETNK

SEQ ID NO: 1655507 - protein, 23 aa, Staphylococcus aureus
PHIDHFPEMWLLSSSETSAKIAA

SEQ ID NO: 1655508 - protein, 26 aa, Staphylococcus aureus
PILCIEMRSDIPLARGLGSSASALVG

SEQ ID NO: 1655509 - protein, 19 aa, Staphylococcus aureus
PIPYAMHVAPLCIKYRFLT

SEQ ID NO: 1655510 - protein, 17 aa, Staphylococcus aureus
PKAMGGVNRAIRQGQNK

SEQ ID NO: 1655511 - protein, 25 aa, Staphylococcus aureus
PKHLSTIKVAPLFSEDDRHKIIHVV

SEQ ID NO: 1655512 - protein, 24 aa, Staphylococcus aureus
PKTRRKYDEFRSIVPSITYDRQFH

SEQ ID NO: 1655513 - protein, 20 aa, Staphylococcus aureus
PLKLFHPVYTYKMKFIKSFE

SEQ ID NO: 1655514 - protein, 20 aa, Staphylococcus aureus
PLKYKDAFIINNKFINCEGG

SEQ ID NO: 1655515 - protein, 18 aa, Staphylococcus aureus
PLLARVTGAGCLLGGIIA

SEQ ID NO: 1655516 - protein, 25 aa, Staphylococcus aureus
PLVNQFKLIFEFMNITNYRFLIGEG

SEQ ID NO: 1655517 - protein, 17 aa, Staphylococcus aureus
PRYHAREIAQWRSEYHH

SEQ ID NO: 1655518 - protein, 24 aa, Staphylococcus aureus
QFETRAGTLLRYYTGLLEHSKVQP

SEQ ID NO: 1655519 - protein, 17 aa, Staphylococcus aureus
QGVSFDFVTPFGTYQVK

SEQ ID NO: 1655520 - protein, 18 aa, Staphylococcus aureus
QKAFPHYNIHALRHSYAS

SEQ ID NO: 1655521 - protein, 17 aa, Staphylococcus aureus
QLENKGWNALFIENHDQ

SEQ ID NO: 1655522 - protein, 27 aa, Staphylococcus aureus
QLIELVTRLGIKLNLPSLDFDTNDLIG

SEQ ID NO: 1655523 - protein, 21 aa, Staphylococcus aureus
QNGFRAYVFAPVIKGKVDKSQ

SEQ ID NO: 1655524 - protein, 24 aa, Staphylococcus aureus
QNVTIPAIEAIVPQKDPNANDTNS

SEQ ID NO: 1655525 - protein, 18 aa, Staphylococcus aureus
QQQKKCYIQKIFSQELRF

SEQ ID NO: 1655526 - protein, 17 aa, Staphylococcus aureus
QQTYFKMMQNFLKPNDV

SEQ ID NO: 1655527 - protein, 18 aa, Staphylococcus aureus
QRVLLALINKGMVREEAY

SEQ ID NO: 1655528 - protein, 28 aa, Staphylococcus aureus
QTPNSYRFQKHLDHEVLIHTSLIVREDA

SEQ ID NO: 1655529 - protein, 17 aa, Staphylococcus aureus
RAYLKERNAIMTDIAQD

SEQ ID NO: 1655530 - protein, 17 aa, Staphylococcus aureus
RDLVDALLFEDIAGIVS

SEQ ID NO: 1655531 - protein, 18 aa, Staphylococcus aureus
RGYPIGQILIPGRDEGHM

SEQ ID NO: 1655532 - protein, 24 aa, Staphylococcus aureus
RKTFAESNIGYFILPKNHITYRSR

SEQ ID NO: 1655533 - protein, 19 aa, Staphylococcus aureus
RNSNEYPEIVFVGNHLSST

SEQ ID NO: 1655534 - protein, 22 aa, Staphylococcus aureus
RQTSLFEMAEYIGISEPQKLIQ

SEQ ID NO: 1655535 - protein, 19 aa, Staphylococcus aureus
RSITNGRLEQQWTVPNEHK

SEQ ID NO: 1655536 - protein, 24 aa, Staphylococcus aureus
RSSVETLELTHLIVEEAYRCGASD

SEQ ID NO: 1655537 - protein, 28 aa, Staphylococcus aureus
RTLSKAFGIAGLRLGVLMSTVETIQRIQ

SEQ ID NO: 1655538 - protein, 21 aa, Staphylococcus aureus
RVDKRIATKYCDIKTANLDEA

SEQ ID NO: 1655539 - protein, 20 aa, Staphylococcus aureus
RVGRSSRIGYAYFLHPANKV

SEQ ID NO: 1655540 - protein, 17 aa, Staphylococcus aureus
RVIEGNSGLFVAMPSKR

SEQ ID NO: 1655541 - protein, 20 aa, Staphylococcus aureus
RYDQKRQRLIGTIEVPMTLA

SEQ ID NO: 1655542 - protein, 18 aa, Staphylococcus aureus
SDHLKRQINMVTETITVR

SEQ ID NO: 1655543 - protein, 23 aa, Staphylococcus aureus
SDLSALPGKYFIFKDLQIEEYQS

SEQ ID NO: 1655544 - protein, 17 aa, Staphylococcus aureus
SEETEPKKGFWSRLFGS

SEQ ID NO: 1655545 - protein, 24 aa, Staphylococcus aureus
SELREEFNKRLNIIHQKLNDNISN

SEQ ID NO: 1655546 - protein, 23 aa, Staphylococcus aureus
SHLVPYLKVIEQLTLVGQEAGMT

SEQ ID NO: 1655547 - protein, 22 aa, Staphylococcus aureus
SIEQANKLFLLFINTYGEIFEL

SEQ ID NO: 1655548 - protein, 17 aa, Staphylococcus aureus
SIPEGYVGLLTSRSGVS

SEQ ID NO: 1655549 - protein, 18 aa, Staphylococcus aureus
SKEALAYYEEVFGATDVK

SEQ ID NO: 1655550 - protein, 28 aa, Staphylococcus aureus
SKSLAIAVASIISRYAFITYMDQISKNI

SEQ ID NO: 1655551 - protein, 25 aa, Staphylococcus aureus
SLPVYKPTLPPMVFGNRDKKIKGGT

SEQ ID NO: 1655552 - protein, 24 aa, Staphylococcus aureus
SNMKLRIGFSDIFFNVDKLTSSEA

SEQ ID NO: 1655553 - protein, 25 aa, Staphylococcus aureus
SQQTRLANMIQNFGILSLKDDYIEV

SEQ ID NO: 1655554 - protein, 23 aa, Staphylococcus aureus
SQRINCIYDEFSLNTYMNKILKT

SEQ ID NO: 1655555 - protein, 19 aa, Staphylococcus aureus
SRFKREFDLTKSFDTNPLF

SEQ ID NO: 1655556 - protein, 18 aa, Staphylococcus aureus
SRIGYAYFLHPANKVLTE

SEQ ID NO: 1655557 - protein, 20 aa, Staphylococcus aureus
SRLSTYWTNHNMAWSDFMQK

SEQ ID NO: 1655558 - protein, 19 aa, Staphylococcus aureus
SRQDALAGKIDWVTKFPEG

SEQ ID NO: 1655559 - protein, 19 aa, Staphylococcus aureus
SSLEFQIKHLMVSKVKGSF

SEQ ID NO: 1655560 - protein, 23 aa, Staphylococcus aureus
STFANCINGLIPFKTKGNVTGEL

SEQ ID NO: 1655561 - protein, 19 aa, Staphylococcus aureus
SYAASRLSTYWTNHNMAWS

SEQ ID NO: 1655562 - protein, 25 aa, Staphylococcus aureus
SYCGPGRRKTFAFVNNRPLAALTEE

SEQ ID NO: 1655563 - protein, 20 aa, Staphylococcus aureus
TCHSDFQVNEVLAYDVMPYI

SEQ ID NO: 1655564 - protein, 20 aa, Staphylococcus aureus
TCTKHIAVSLNIDGKTITIG

SEQ ID NO: 1655565 - protein, 20 aa, Staphylococcus aureus
TDDYPGWWREIIDGGYVPIH

SEQ ID NO: 1655566 - protein, 18 aa, Staphylococcus aureus
TDPTISIKPIPRVKPKPK

SEQ ID NO: 1655567 - protein, 29 aa, Staphylococcus aureus
TEDASFLECFKLTVEPVVKSFKPDIILSV

SEQ ID NO: 1655568 - protein, 23 aa, Staphylococcus aureus
TIHDARDLLKYKIDNYDNHIAKI

SEQ ID NO: 1655569 - protein, 19 aa, Staphylococcus aureus
TIHLLKKKHFELMKDEALF

SEQ ID NO: 1655570 - protein, 19 aa, Staphylococcus aureus
TINRMFWRARRRESIFIQY

SEQ ID NO: 1655571 - protein, 34 aa, Staphylococcus aureus
TKLVDGFTHLPGWVRKASVGLALFGAAIGPAVLA

SEQ ID NO: 1655572 - protein, 18 aa, Staphylococcus aureus
TKNLEDFYDKEGFRDEEF

SEQ ID NO: 1655573 - protein, 23 aa, Staphylococcus aureus
TKPRGLFRKKKFSPVVGDIVEFD

SEQ ID NO: 1655574 - protein, 21 aa, Staphylococcus aureus
TLKAHHPDIIVLNGGANQFFE

SEQ ID NO: 1655575 - protein, 18 aa, Staphylococcus aureus
TLKYAVPTTDCYEVFWGG

SEQ ID NO: 1655576 - protein, 18 aa, Staphylococcus aureus
TLQPAAGAHGEWTALMIF

SEQ ID NO: 1655577 - protein, 22 aa, Staphylococcus aureus
TLTDDGYTIFGLENNGVSINKF

SEQ ID NO: 1655578 - protein, 27 aa, Staphylococcus aureus
TLYYTCEKFKLLVLQGNVLGVQVITNN

SEQ ID NO: 1655579 - protein, 26 aa, Staphylococcus aureus
TMILKPVFRDYLLKLVEAHDIEHQYY

SEQ ID NO: 1655580 - protein, 23 aa, Staphylococcus aureus
TNSKQGATNLVIKDAKKNTELAT

SEQ ID NO: 1655581 - protein, 24 aa, Staphylococcus aureus
TPEALKLRIVQIQETFIVAEKNDE

SEQ ID NO: 1655582 - protein, 25 aa, Staphylococcus aureus
TQEFERYKLAFAIRDAAATKNVGTE

SEQ ID NO: 1655583 - protein, 25 aa, Staphylococcus aureus
TTAKAAALEEFDEVVQAQIDQAPLN

SEQ ID NO: 1655584 - protein, 25 aa, Staphylococcus aureus
TTEIQRKWIEKFKVIGDTFKAKAEY

SEQ ID NO: 1655585 - protein, 17 aa, Staphylococcus aureus
TWKDLFNDFEMHFYRYV

SEQ ID NO: 1655586 - protein, 18 aa, Staphylococcus aureus
VDMMAKYEIPLSIENLKV

SEQ ID NO: 1655587 - protein, 17 aa, Staphylococcus aureus
VDPRTKIIYMTQARPGN

SEQ ID NO: 1655588 - protein, 25 aa, Staphylococcus aureus
VDRLREFYRKFGFTEIKDHTSENNL

SEQ ID NO: 1655589 - protein, 18 aa, Staphylococcus aureus
VEAIKTKAINDINQTAPA

SEQ ID NO: 1655590 - protein, 19 aa, Staphylococcus aureus
VFVNCARGSLVDTKALLDA

SEQ ID NO: 1655591 - protein, 21 aa, Staphylococcus aureus
VGREEAVLIFVNRLNEGLYCI

SEQ ID NO: 1655592 - protein, 18 aa, Staphylococcus aureus
VHMASLRKKLNYTQDPNT

SEQ ID NO: 1655593 - protein, 19 aa, Staphylococcus aureus
VIEIPEGFEVIADSPSTDY

SEQ ID NO: 1655594 - protein, 25 aa, Staphylococcus aureus
VKELRKKTGAGMMDCKKALTETDGD

SEQ ID NO: 1655595 - protein, 20 aa, Staphylococcus aureus
VLDSARLQYLISQELGVAPS

SEQ ID NO: 1655596 - protein, 23 aa, Staphylococcus aureus
VNFKVVKEFIKTVSERALGSDVM

SEQ ID NO: 1655597 - protein, 22 aa, Staphylococcus aureus
VPELRFPGFEGEWEEKKLGDLI

SEQ ID NO: 1655598 - protein, 17 aa, Staphylococcus aureus
VPGEAVQLVKFDDYWQG

SEQ ID NO: 1655599 - protein, 25 aa, Staphylococcus aureus
VPIVPELLKSLNFNQFNLVEAQCKP

SEQ ID NO: 1655600 - protein, 21 aa, Staphylococcus aureus
VPKKNKVLYSFEQQKIEFEQR

SEQ ID NO: 1655601 - protein, 23 aa, Staphylococcus aureus
VQQLHANPVKKPAGKTELDQAAA

SEQ ID NO: 1655602 - protein, 19 aa, Staphylococcus aureus
VRLALFEADVNFKVVKEFI

SEQ ID NO: 1655603 - protein, 22 aa, Staphylococcus aureus
VRRAKLYYLRSLRGKAARIQEI

SEQ ID NO: 1655604 - protein, 19 aa, Staphylococcus aureus
VRYSILCMENLSSDKIEEN

SEQ ID NO: 1655605 - protein, 21 aa, Staphylococcus aureus
VSFDFVTPFGTYQVKSPYVGK

SEQ ID NO: 1655606 - protein, 20 aa, Staphylococcus aureus
VTTLCPCSKEISEYSAHNQR

SEQ ID NO: 1655607 - protein, 21 aa, Staphylococcus aureus
VTVLHLAEWLMEMQLDRKAGN

SEQ ID NO: 1655608 - protein, 17 aa, Staphylococcus aureus
VYKKTGIKFPTLASDNV

SEQ ID NO: 1655609 - protein, 19 aa, Staphylococcus aureus
VYTSYAYYQLCEEKGIIRS

SEQ ID NO: 1655610 - protein, 18 aa, Staphylococcus aureus
WIAPETFANFDSRSIWYI

SEQ ID NO: 1655611 - protein, 18 aa, Staphylococcus aureus
WKGKEFEPSDIVDAYLVI

SEQ ID NO: 1655612 - protein, 27 aa, Staphylococcus aureus
WLQPLLKRKYPNISFKYTYIDITKDND

SEQ ID NO: 1655613 - protein, 24 aa, Staphylococcus aureus
WRQHDVKLVFFLAISQKDTAFTKQ

SEQ ID NO: 1655614 - protein, 24 aa, Staphylococcus aureus
WSGFKVVINYAKKYFGLRTDPTIS

SEQ ID NO: 1655615 - protein, 17 aa, Staphylococcus aureus
WWREIIDGGYVPIHDYQ

SEQ ID NO: 1655616 - protein, 19 aa, Staphylococcus aureus
YCAPEQMYSLKQADKQSDV

SEQ ID NO: 1655617 - protein, 20 aa, Staphylococcus aureus
YDLYETKYWSVFDEIQGFSH

SEQ ID NO: 1655618 - protein, 24 aa, Staphylococcus aureus
YDYKTGNELVRFFNHYFNKGDIYQ

SEQ ID NO: 1655619 - protein, 20 aa, Staphylococcus aureus
YEAWEVESRIPGKNGDATKF

SEQ ID NO: 1655620 - protein, 20 aa, Staphylococcus aureus
YESDRGTGVLNFAVTKNNKP

SEQ ID NO: 1655621 - protein, 18 aa, Staphylococcus aureus
YGGLIAGFYNDVSKETSV

SEQ ID NO: 1655622 - protein, 18 aa, Staphylococcus aureus
YITEIMKIRQRVMEMLLL

SEQ ID NO: 1655623 - protein, 23 aa, Staphylococcus aureus
YKLMFNTLRAMYQRHPIRVDIAG

SEQ ID NO: 1655624 - protein, 24 aa, Staphylococcus aureus
YKMLISICYLIFQGVIQTESKGQN

SEQ ID NO: 1655625 - protein, 30 aa, Staphylococcus aureus
YKMPKKMRRLALRSALSFKVQENGLTVVDA

SEQ ID NO: 1655626 - protein, 17 aa, Staphylococcus aureus
YLHIDPYLPYQYLNHDG

SEQ ID NO: 1655627 - protein, 20 aa, Staphylococcus aureus
YLKKQNCLYVLVDPYLIENL

SEQ ID NO: 1655628 - protein, 21 aa, Staphylococcus aureus
YLPCNGNLLIHGCIPVDENGE

SEQ ID NO: 1655629 - protein, 25 aa, Staphylococcus aureus
YLVDRVIPMIPHRLSNGICSLNPNV

SEQ ID NO: 1655630 - protein, 23 aa, Staphylococcus aureus
YLVKASKMKWVFQFEIVSAHCVH

SEQ ID NO: 1655631 - protein, 18 aa, Staphylococcus aureus
YLYPVKFREKTRIGRFFN

SEQ ID NO: 1655632 - protein, 18 aa, Staphylococcus aureus
YNIAYEIRLQAALESDIL

SEQ ID NO: 1655633 - protein, 25 aa, Staphylococcus aureus
YPTISNDFLKLFGHVWLVERWMDDD

SEQ ID NO: 1655634 - protein, 27 aa, Staphylococcus aureus
YQAPFPSRWLYVVKHLQTLIQERKINQ

SEQ ID NO: 1655635 - protein, 29 aa, Staphylococcus aureus
YQDISFSTIEEFINWDLEKLKSHLNKNQL

SEQ ID NO: 1655636 - protein, 18 aa, Staphylococcus aureus
YRLKIVLHAESEFETIVS

SEQ ID NO: 1655637 - protein, 37 aa, Staphylococcus aureus
YTDIDYPIAIVFQASCFNEFVVKGRLSNIVGKLEHYA

SEQ ID NO: 1655638 - protein, 24 aa, Staphylococcus aureus
YVTLEPCVMCAGTIVMSRIPRVVY

SEQ ID NO: 1655639 - protein, 18 aa, Staphylococcus aureus
YWYNYTSDDLINFKPEGP

SEQ ID NO: 1655640 - protein, 33 aa, Staphylococcus aureus
YYDEFEGGHQWKDWKPLLSDILLYFFSNQSPDQ

SEQ ID NO: 1655641 - protein, 27 aa, Staphylococcus aureus
AAGYKPGEEVFLGFDCASSEFYENGVY

SEQ ID NO: 1655642 - protein, 25 aa, Staphylococcus aureus
AASEVEGINWLELDVAITKDEQLII

SEQ ID NO: 1655643 - protein, 24 aa, Staphylococcus aureus
ADCKRFLECLNDKNVETIEHSDWV

SEQ ID NO: 1655644 - protein, 17 aa, Staphylococcus aureus
AEELYKYPVQDIMTEEF

SEQ ID NO: 1655645 - protein, 17 aa, Staphylococcus aureus
AERGMFPSNLEYVDSYT

SEQ ID NO: 1655646 - protein, 26 aa, Staphylococcus aureus
AERKGNHIYNGLDMFVYQGAESFKIW

SEQ ID NO: 1655647 - protein, 25 aa, Staphylococcus aureus
AFIETAKIVLRWLKEQDIQVELLNL

SEQ ID NO: 1655648 - protein, 20 aa, Staphylococcus aureus
AGGHAVMLGSLLAGTEESPG

SEQ ID NO: 1655649 - protein, 22 aa, Staphylococcus aureus
AGIELLKKYGLEKITLSNILYE

SEQ ID NO: 1655650 - protein, 19 aa, Staphylococcus aureus
AGLKAIVVIPEGKIALGKL

SEQ ID NO: 1655651 - protein, 20 aa, Staphylococcus aureus
AIKKELKKLKGYAEENNKSF

SEQ ID NO: 1655652 - protein, 17 aa, Staphylococcus aureus
AKAKPSLQIINVARGGI

SEQ ID NO: 1655653 - protein, 20 aa, Staphylococcus aureus
AKLKLLQDITNLLNYIENRE

SEQ ID NO: 1655654 - protein, 20 aa, Staphylococcus aureus
AKRVVKEKWSVRYLENHVNE

SEQ ID NO: 1655655 - protein, 26 aa, Staphylococcus aureus
ANEISGMIPVEWEKVYTIAYVDDEGG

SEQ ID NO: 1655656 - protein, 17 aa, Staphylococcus aureus
APGLKRIDSLVLEELLK

SEQ ID NO: 1655657 - protein, 17 aa, Staphylococcus aureus
ARASFYIYNTKEDIDQL

SEQ ID NO: 1655658 - protein, 24 aa, Staphylococcus aureus
ASTDVKTNARAELLNEMQNKITEI

SEQ ID NO: 1655659 - protein, 40 aa, Staphylococcus aureus
AYENPRFVEDLIRLIAADLVEFDWLDGFDIECRNEESIHQ

SEQ ID NO: 1655660 - protein, 23 aa, Staphylococcus aureus
AYFNKRLRTTGGRYLLKSHDIEI

SEQ ID NO: 1655661 - protein, 17 aa, Staphylococcus aureus
CARQFLWSTAKGYQQYK

SEQ ID NO: 1655662 - protein, 25 aa, Staphylococcus aureus
CDYLFCKAFGKLASNIERYTNQGTL

SEQ ID NO: 1655663 - protein, 21 aa, Staphylococcus aureus
CSEFSCLGPNVLVKNMYYPNM

SEQ ID NO: 1655664 - protein, 18 aa, Staphylococcus aureus
DAYNEVKQAATARKAQNA

SEQ ID NO: 1655665 - protein, 19 aa, Staphylococcus aureus
DDVSFKLKRGQIVGLVGAN

SEQ ID NO: 1655666 - protein, 27 aa, Staphylococcus aureus
DEAWHRLKYYVVVNHLGHLVSTIGKAT

SEQ ID NO: 1655667 - protein, 18 aa, Staphylococcus aureus
DEMMVIFVTNGKNWPQKN

SEQ ID NO: 1655668 - protein, 25 aa, Staphylococcus aureus
DFGYMWECPDYFNLDNQDVILICPQ

SEQ ID NO: 1655669 - protein, 17 aa, Staphylococcus aureus
DIEHDANEPVAFLLQST

SEQ ID NO: 1655670 - protein, 22 aa, Staphylococcus aureus
DIKMKTAKTFLNKLYGGDMKSL

SEQ ID NO: 1655671 - protein, 36 aa, Staphylococcus aureus
DKVTGCPAIPCYQCEYCLKGEYARCEKLFVIGSYEP

SEQ ID NO: 1655672 - protein, 21 aa, Staphylococcus aureus
DLAFRGQELLTFIKEAAERYD

SEQ ID NO: 1655673 - protein, 22 aa, Staphylococcus aureus
DLKMSITKAPRFKNHSHVFDGD

SEQ ID NO: 1655674 - protein, 18 aa, Staphylococcus aureus
DPKYKLSVDEIIEKEHLD

SEQ ID NO: 1655675 - protein, 22 aa, Staphylococcus aureus
DSIELGGIVQRTWKGKRSTDDI

SEQ ID NO: 1655676 - protein, 25 aa, Staphylococcus aureus
DSIELGGIVQRTWRGKRSTDDIFTR

SEQ ID NO: 1655677 - protein, 24 aa, Staphylococcus aureus
DTMALPPCHTMFQFYVQDGKLSCQ

SEQ ID NO: 1655678 - protein, 17 aa, Staphylococcus aureus
DVDFKFNREEETLRIYR

SEQ ID NO: 1655679 - protein, 27 aa, Staphylococcus aureus
EDLEPWTSCEFDFTREGKLKVSFDYID

SEQ ID NO: 1655680 - protein, 23 aa, Staphylococcus aureus
EDLEPWTSCEFDFTSEGKLKVSL

SEQ ID NO: 1655681 - protein, 17 aa, Staphylococcus aureus
EDLKVELIDQVGYFIEP

SEQ ID NO: 1655682 - protein, 17 aa, Staphylococcus aureus
EEHLSAYGIKYNDKTHE

SEQ ID NO: 1655683 - protein, 24 aa, Staphylococcus aureus
EENYELIPTVFAEFEIDGKITTFK

SEQ ID NO: 1655684 - protein, 38 aa, Staphylococcus aureus
EEQQFKCHIDTIIKKQVPVCCFTFGIPNESIIERLKEA

SEQ ID NO: 1655685 - protein, 25 aa, Staphylococcus aureus
EFDLGHFRGAIRPNITRFRDLPDWI

SEQ ID NO: 1655686 - protein, 22 aa, Staphylococcus aureus
EGKLKVSLDYIDWINTEFDQLG

SEQ ID NO: 1655687 - protein, 27 aa, Staphylococcus aureus
EGLNFAGVHKLPFVCVIINNKYAISVP

SEQ ID NO: 1655688 - protein, 20 aa, Staphylococcus aureus
EGTIAEWLKNLGDSVEKGEA

SEQ ID NO: 1655689 - protein, 17 aa, Staphylococcus aureus
EKADELINSARVVLVEN

SEQ ID NO: 1655690 - protein, 24 aa, Staphylococcus aureus
EKLIPKDYWLSQAPKLNSKQLIDD

SEQ ID NO: 1655691 - protein, 26 aa, Staphylococcus aureus
ENLAIPRAAFKDIVKMMDYGEGLKKH

SEQ ID NO: 1655692 - protein, 18 aa, Staphylococcus aureus
ESNAKLYADDKFNKRYSV

SEQ ID NO: 1655693 - protein, 26 aa, Staphylococcus aureus
ETDAELFGYCYGVAGTVGEVLTPILS

SEQ ID NO: 1655694 - protein, 17 aa, Staphylococcus aureus
FDKVVQYESVFDFEEMI

SEQ ID NO: 1655695 - protein, 21 aa, Staphylococcus aureus
FGLGNMMMRYVMKKKNVDSLP

SEQ ID NO: 1655696 - protein, 17 aa, Staphylococcus aureus
FHKVVLLSGALRLDTLE

SEQ ID NO: 1655697 - protein, 19 aa, Staphylococcus aureus
FIHQYPLAVVHVMRDQCSV

SEQ ID NO: 1655698 - protein, 19 aa, Staphylococcus aureus
FINPFEVVYYAGGTSNAFR

SEQ ID NO: 1655699 - protein, 17 aa, Staphylococcus aureus
FLNHMLTLFTFHSGLSL

SEQ ID NO: 1655700 - protein, 24 aa, Staphylococcus aureus
FQECARLLKKWGLPANRNTIRLHN

SEQ ID NO: 1655701 - protein, 18 aa, Staphylococcus aureus
FQYAYGLPDYGIIGMQLP

SEQ ID NO: 1655702 - protein, 23 aa, Staphylococcus aureus
FSLFRKPSEVLRHIEEISNELNI

SEQ ID NO: 1655703 - protein, 20 aa, Staphylococcus aureus
FSTAESWDNVGLLIGDEDVE

SEQ ID NO: 1655704 - protein, 21 aa, Staphylococcus aureus
FTPKYHKLAEAERNWINSQKN

SEQ ID NO: 1655705 - protein, 21 aa, Staphylococcus aureus
FVKHLLITMPQSFGRATMSEN

SEQ ID NO: 1655706 - protein, 25 aa, Staphylococcus aureus
GAKATKAGEEFLAYSKKVLRDTETI

SEQ ID NO: 1655707 - protein, 27 aa, Staphylococcus aureus
GCGSIGLLAIQWARIFGAAHIIAIDID

SEQ ID NO: 1655708 - protein, 17 aa, Staphylococcus aureus
GDFIFVGDVGRPDLLEK

SEQ ID NO: 1655709 - protein, 21 aa, Staphylococcus aureus
GDHNLTFAIEFCSKTIANNTK

SEQ ID NO: 1655710 - protein, 18 aa, Staphylococcus aureus
GEDIVECITNFADDQDLT

SEQ ID NO: 1655711 - protein, 19 aa, Staphylococcus aureus
GFTCKKETPFLPNINNERL

SEQ ID NO: 1655712 - protein, 24 aa, Staphylococcus aureus
GFYDNVISSFGWQNINIGVIYSMN

SEQ ID NO: 1655713 - protein, 25 aa, Staphylococcus aureus
GGTQQFRLPVSWQHNHPFDIYRYKD

SEQ ID NO: 1655714 - protein, 17 aa, Staphylococcus aureus
GIEASGIDRSELFITTK

SEQ ID NO: 1655715 - protein, 21 aa, Staphylococcus aureus
GKAYAYLIFVQETWTMLHENT

SEQ ID NO: 1655716 - protein, 18 aa, Staphylococcus aureus
GKKKIESIMTHFRSNPPQ

SEQ ID NO: 1655717 - protein, 19 aa, Staphylococcus aureus
GKQVFNYFTTPSFVTNIYE

SEQ ID NO: 1655718 - protein, 22 aa, Staphylococcus aureus
GKTRLRPGGKEATDWLIQQGAF

SEQ ID NO: 1655719 - protein, 24 aa, Staphylococcus aureus
GKYFVRLSYVKVWNKDDEVVNKPE

SEQ ID NO: 1655720 - protein, 18 aa, Staphylococcus aureus
GLGEPFSKEVALVMMILR

SEQ ID NO: 1655721 - protein, 20 aa, Staphylococcus aureus
GNYSKVPWISIYDENITKET

SEQ ID NO: 1655722 - protein, 19 aa, Staphylococcus aureus
GYHTDEMMVIFVTNGKNWP

SEQ ID NO: 1655723 - protein, 27 aa, Staphylococcus aureus
HFGISGPAALRCSQFVYKEQKNQKTQH

SEQ ID NO: 1655724 - protein, 17 aa, Staphylococcus aureus
HGIDRYNFYGVSGKFTE

SEQ ID NO: 1655725 - protein, 26 aa, Staphylococcus aureus
HGKVARLTQFGAFIDIGGVDGLVHVS

SEQ ID NO: 1655726 - protein, 19 aa, Staphylococcus aureus
HLYRIPKYTYEIIEVKKRD

SEQ ID NO: 1655727 - protein, 24 aa, Staphylococcus aureus
HPLGHSLGAFLAQYNLIKHNLDNG

SEQ ID NO: 1655728 - protein, 17 aa, Staphylococcus aureus
HRAKERFKEVTTPKFYL

SEQ ID NO: 1655729 - protein, 22 aa, Staphylococcus aureus
HTLRYYVCPKNMNASRFVCDFK

SEQ ID NO: 1655730 - protein, 24 aa, Staphylococcus aureus
HVAESRLDNIISMADQDLTYTLLR

SEQ ID NO: 1655731 - protein, 17 aa, Staphylococcus aureus
HWQRHASQMIARLKEDG

SEQ ID NO: 1655732 - protein, 18 aa, Staphylococcus aureus
IAMDDLKNELEVINEGHQ

SEQ ID NO: 1655733 - protein, 31 aa, Staphylococcus aureus
IANEISNMIPVEWEKVYTMAYIDDGGGEVFF

SEQ ID NO: 1655734 - protein, 18 aa, Staphylococcus aureus
IDEGCLIEDGHCIRTIHA

SEQ ID NO: 1655735 - protein, 17 aa, Staphylococcus aureus
IEAKLKLLQDITNLLNY

SEQ ID NO: 1655736 - protein, 25 aa, Staphylococcus aureus
IELVKRLVPYVPKVELHMYGFGSES

SEQ ID NO: 1655737 - protein, 18 aa, Staphylococcus aureus
IENLMIFRREYKASERQA

SEQ ID NO: 1655738 - protein, 19 aa, Staphylococcus aureus
IFLGIPYAEPPVHDNRFKH

SEQ ID NO: 1655739 - protein, 19 aa, Staphylococcus aureus
IKARIAIRGKGVMVVAPLE

SEQ ID NO: 1655740 - protein, 21 aa, Staphylococcus aureus
IKNYKHFSAVIKMLPKIIEQL

SEQ ID NO: 1655741 - protein, 20 aa, Staphylococcus aureus
IKSIDRNGALKGIGKPEKLK

SEQ ID NO: 1655742 - protein, 17 aa, Staphylococcus aureus
ILNRAKEEFKKVLPTKN

SEQ ID NO: 1655743 - protein, 22 aa, Staphylococcus aureus
INELRLKSIRKIVKRINTWSDE

SEQ ID NO: 1655744 - protein, 21 aa, Staphylococcus aureus
INKIGTIVLKNKFNEEQGKYF

SEQ ID NO: 1655745 - protein, 19 aa, Staphylococcus aureus
INRNGKIAISFREDDELIA

SEQ ID NO: 1655746 - protein, 18 aa, Staphylococcus aureus
IQALDILKSYGILDTIEK

SEQ ID NO: 1655747 - protein, 25 aa, Staphylococcus aureus
ISNDFLKSFGHVWLVERWMDDNIEG

SEQ ID NO: 1655748 - protein, 20 aa, Staphylococcus aureus
ITNTYSPLYLWRSSEGMTEF

SEQ ID NO: 1655749 - protein, 19 aa, Staphylococcus aureus
ITRGDIFVRGAIKEHMASL

SEQ ID NO: 1655750 - protein, 19 aa, Staphylococcus aureus
IWAPRRAVFEVPNEPDYIV

SEQ ID NO: 1655751 - protein, 19 aa, Staphylococcus aureus
IYGGVSYTIHVGRPKGQRV

SEQ ID NO: 1655752 - protein, 24 aa, Staphylococcus aureus
KAIDELPVIALLCTQAVGTSTIKD

SEQ ID NO: 1655753 - protein, 22 aa, Staphylococcus aureus
KAKLNPAICFTMLGHYLGVDIE

SEQ ID NO: 1655754 - protein, 22 aa, Staphylococcus aureus
KDFKAFNVEGLDARMEALNEYI

SEQ ID NO: 1655755 - protein, 19 aa, Staphylococcus aureus
KDLTELVLTLGSQMVVLAN

SEQ ID NO: 1655756 - protein, 17 aa, Staphylococcus aureus
KEHLLSPLFKDWHKYNT

SEQ ID NO: 1655757 - protein, 17 aa, Staphylococcus aureus
KEKSIRLSFAFESNENI

SEQ ID NO: 1655758 - protein, 25 aa, Staphylococcus aureus
KEMAFPSLASVAYRAVAEKELVSEE

SEQ ID NO: 1655759 - protein, 35 aa, Staphylococcus aureus
KEPLDDVIEMSRPVKMNSLLKLYFDRNILTPQKLL

SEQ ID NO: 1655760 - protein, 18 aa, Staphylococcus aureus
KEQLRTNVGMVFQQPNPF

SEQ ID NO: 1655761 - protein, 23 aa, Staphylococcus aureus
KFKKEFKPVMHLKGDALNQQLQS

SEQ ID NO: 1655762 - protein, 19 aa, Staphylococcus aureus
KGVFDIFDYVMLGHLHHPF

SEQ ID NO: 1655763 - protein, 21 aa, Staphylococcus aureus
KIGEFFIKLDRQIELEEQKLE

SEQ ID NO: 1655764 - protein, 21 aa, Staphylococcus aureus
KIKDDILYCYTEDSIKGLSEV

SEQ ID NO: 1655765 - protein, 29 aa, Staphylococcus aureus
KIVKKDFTGISFLNLVDFDALYGHRRDKP

SEQ ID NO: 1655766 - protein, 17 aa, Staphylococcus aureus
KKFYRQCELGWDDEINF

SEQ ID NO: 1655767 - protein, 25 aa, Staphylococcus aureus
KKGLMRHLVVRTGYHTDEMMVIFVT

SEQ ID NO: 1655768 - protein, 17 aa, Staphylococcus aureus
KKVIDIKTAEWLNTDSD

SEQ ID NO: 1655769 - protein, 28 aa, Staphylococcus aureus
KQYIELLSRLGIKLNLPDLTFDTDQLIN

SEQ ID NO: 1655770 - protein, 20 aa, Staphylococcus aureus
KRYQSAASLSDFESSAKSWV

SEQ ID NO: 1655771 - protein, 20 aa, Staphylococcus aureus
KRYYKSYSRGTVVYVKLGSN

SEQ ID NO: 1655772 - protein, 20 aa, Staphylococcus aureus
KSRILQGGYLYNYRSRNRYT

SEQ ID NO: 1655773 - protein, 21 aa, Staphylococcus aureus
KTFLEERGHEFIILADNGEDL

SEQ ID NO: 1655774 - protein, 19 aa, Staphylococcus aureus
LCGEVLDIHGYTGGYNITS

SEQ ID NO: 1655775 - protein, 25 aa, Staphylococcus aureus
LDCIGVSLAEMPVDFSFVDTTARQI

SEQ ID NO: 1655776 - protein, 17 aa, Staphylococcus aureus
LDEYKKYFQPLIKEDDK

SEQ ID NO: 1655777 - protein, 23 aa, Staphylococcus aureus
LELLRILFNYDRLSQYDLTMKIS

SEQ ID NO: 1655778 - protein, 20 aa, Staphylococcus aureus
LEVIIAPKFTDEALNILKQK

SEQ ID NO: 1655779 - protein, 18 aa, Staphylococcus aureus
LFKSYTWQSDVHELKVCT

SEQ ID NO: 1655780 - protein, 17 aa, Staphylococcus aureus
LGLDWRTSINQAQQLGV

SEQ ID NO: 1655781 - protein, 18 aa, Staphylococcus aureus
LISTDFIEDFSVFDGQTI

SEQ ID NO: 1655782 - protein, 24 aa, Staphylococcus aureus
LKNVFDLLPVNAFHDKVIGLVATA

SEQ ID NO: 1655783 - protein, 28 aa, Staphylococcus aureus
LLGEDCRRTMDIFRLLGVDIKEDEDKLV

SEQ ID NO: 1655784 - protein, 26 aa, Staphylococcus aureus
LLLTKTGEVWAYYRVRSESISTANYD

SEQ ID NO: 1655785 - protein, 24 aa, Staphylococcus aureus
LNDKELTELMTLFRENYKETEAKH

SEQ ID NO: 1655786 - protein, 17 aa, Staphylococcus aureus
LSEPFLFEDIEDILHHI

SEQ ID NO: 1655787 - protein, 35 aa, Staphylococcus aureus
LSKEERIMEGLSLIPLPGMGFLKGAGKSLMKLGFK

SEQ ID NO: 1655788 - protein, 22 aa, Staphylococcus aureus
LTAEEKTAALATIKQITDQAKQ

SEQ ID NO: 1655789 - protein, 19 aa, Staphylococcus aureus
LTSAHGRTLLAIKDEQQML

SEQ ID NO: 1655790 - protein, 17 aa, Staphylococcus aureus
LYKRGGTIYAHVMHTHL

SEQ ID NO: 1655791 - protein, 25 aa, Staphylococcus aureus
MEAEPFMWPVYEVIRKSTVEELKAL

SEQ ID NO: 1655792 - protein, 23 aa, Staphylococcus aureus
MEEEMFLGLRLNEGVSSSRFKKK

SEQ ID NO: 1655793 - protein, 17 aa, Staphylococcus aureus
MGFYRQRSHDIIDMGSC

SEQ ID NO: 1655794 - protein, 17 aa, Staphylococcus aureus
MGLQIRHYTVQSLKLLK

SEQ ID NO: 1655795 - protein, 19 aa, Staphylococcus aureus
MIYDRRKDLIISGGENIYP

SEQ ID NO: 1655796 - protein, 26 aa, Staphylococcus aureus
MKDCKYVLSVASPVFFGKTDDAEVMA

SEQ ID NO: 1655797 - protein, 25 aa, Staphylococcus aureus
MLDFKRLNGLMIGFVIKGEAHIYDE

SEQ ID NO: 1655798 - protein, 19 aa, Staphylococcus aureus
MPGKRVNISDGVPRLDALI

SEQ ID NO: 1655799 - protein, 21 aa, Staphylococcus aureus
MQELTEYGLIPEDWGGETIFV

SEQ ID NO: 1655800 - protein, 18 aa, Staphylococcus aureus
MSAATIKFAQQFEENSTF

SEQ ID NO: 1655801 - protein, 20 aa, Staphylococcus aureus
NAIYEFQYAYGLPDYGIIGM

SEQ ID NO: 1655802 - protein, 19 aa, Staphylococcus aureus
NAYGVYFTPEIKKFIAENI

SEQ ID NO: 1655803 - protein, 25 aa, Staphylococcus aureus
NEEKGKDIEPVRAAYEEGLNNINAA

SEQ ID NO: 1655804 - protein, 20 aa, Staphylococcus aureus
NFAAAYKAPAIFVIQNNNYA

SEQ ID NO: 1655805 - protein, 17 aa, Staphylococcus aureus
NGHIPRITYHTNRIKCS

SEQ ID NO: 1655806 - protein, 24 aa, Staphylococcus aureus
NHLNHLKVSLVLGTPKERNDALNT

SEQ ID NO: 1655807 - protein, 18 aa, Staphylococcus aureus
NHMLTLFTFHSGLSLNIE

SEQ ID NO: 1655808 - protein, 25 aa, Staphylococcus aureus
NHVDARYNLGLALFMKNENIDEAIT

SEQ ID NO: 1655809 - protein, 24 aa, Staphylococcus aureus
NKALFGDLWAAKFAPTQMDESDAF

SEQ ID NO: 1655810 - protein, 17 aa, Staphylococcus aureus
NRAKEEFKKVLPTKNDS

SEQ ID NO: 1655811 - protein, 18 aa, Staphylococcus aureus
NVEFNDKILINWRIMQEK

SEQ ID NO: 1655812 - protein, 18 aa, Staphylococcus aureus
NYGLPYLKDTLRRLNYPV

SEQ ID NO: 1655813 - protein, 21 aa, Staphylococcus aureus
PCFNCLVPQLPALNLTCDTVG

SEQ ID NO: 1655814 - protein, 18 aa, Staphylococcus aureus
PFFYPLNELISIGQMIKN

SEQ ID NO: 1655815 - protein, 20 aa, Staphylococcus aureus
PFHMSPYFGYAARLLATSGI

SEQ ID NO: 1655816 - protein, 19 aa, Staphylococcus aureus
PIEKVFDAYTTKALFEKWF

SEQ ID NO: 1655817 - protein, 23 aa, Staphylococcus aureus
PKTRRKYDEFRSIVPSITHDRQF

SEQ ID NO: 1655818 - protein, 25 aa, Staphylococcus aureus
PLVDFYNQMAFDFGTLGNHEFNYGL

SEQ ID NO: 1655819 - protein, 21 aa, Staphylococcus aureus
PRMIFDYKSSEEMLKYHVSTQ

SEQ ID NO: 1655820 - protein, 17 aa, Staphylococcus aureus
PTCEDYCALRINAGMSP

SEQ ID NO: 1655821 - protein, 18 aa, Staphylococcus aureus
PVSETWDLTDLFKDDQQY

SEQ ID NO: 1655822 - protein, 18 aa, Staphylococcus aureus
PYKLEIEMLKQQQFDPEL

SEQ ID NO: 1655823 - protein, 18 aa, Staphylococcus aureus
QCKLAGPQHREFRKEILQ

SEQ ID NO: 1655824 - protein, 17 aa, Staphylococcus aureus
QGLMEAREIFLVVTGAN

SEQ ID NO: 1655825 - protein, 22 aa, Staphylococcus aureus
QIEARLDIVDEFSAHFIERDTL

SEQ ID NO: 1655826 - protein, 18 aa, Staphylococcus aureus
QINARPRMIFDYKSSEEM

SEQ ID NO: 1655827 - protein, 24 aa, Staphylococcus aureus
QKASERKTAIEAMNDSTTEEQQAA

SEQ ID NO: 1655828 - protein, 18 aa, Staphylococcus aureus
QLAGLRAIPNMNVIRPAD

SEQ ID NO: 1655829 - protein, 18 aa, Staphylococcus aureus
QLVVSGRMPAVSNIQEDH

SEQ ID NO: 1655830 - protein, 17 aa, Staphylococcus aureus
QRRKIFALVKDIEEHTG

SEQ ID NO: 1655831 - protein, 20 aa, Staphylococcus aureus
QSAGSMSIWTLLKIPDIEPY

SEQ ID NO: 1655832 - protein, 21 aa, Staphylococcus aureus
QVNEVLAYDVMPYIMKKLNAP

SEQ ID NO: 1655833 - protein, 24 aa, Staphylococcus aureus
QYNGKRPVYFTALLFNKLTSNILY

SEQ ID NO: 1655834 - protein, 20 aa, Staphylococcus aureus
RKSIPLKNSFGIWGDGNLGY

SEQ ID NO: 1655835 - protein, 19 aa, Staphylococcus aureus
RLLYARVGKPYCPNHNIEI

SEQ ID NO: 1655836 - protein, 18 aa, Staphylococcus aureus
RQEMEYRKLGKYPPYYYL

SEQ ID NO: 1655837 - protein, 17 aa, Staphylococcus aureus
RQQLELYVKQMAVEAES

SEQ ID NO: 1655838 - protein, 18 aa, Staphylococcus aureus
RRQAVYTGIFQWQNGQLV

SEQ ID NO: 1655839 - protein, 17 aa, Staphylococcus aureus
RTGEAIIIDPVRDLSKY

SEQ ID NO: 1655840 - protein, 30 aa, Staphylococcus aureus
RTNPLWHVYRLVKFSKVFKNVIIIEFSKFI

SEQ ID NO: 1655841 - protein, 20 aa, Staphylococcus aureus
SDAQLIWGVKKGYEHIFQQY

SEQ ID NO: 1655842 - protein, 18 aa, Staphylococcus aureus
SDIAAFIFNVAFETLSSS

SEQ ID NO: 1655843 - protein, 18 aa, Staphylococcus aureus
SDIVAFIFNVTFEALSSS

SEQ ID NO: 1655844 - protein, 19 aa, Staphylococcus aureus
SEFSCLGPNVLVKNMYYPN

SEQ ID NO: 1655845 - protein, 23 aa, Staphylococcus aureus
SGAGLSLIRHWVEDPNRIDKVDL

SEQ ID NO: 1655846 - protein, 18 aa, Staphylococcus aureus
SKELKLKVVNEYLNSNQS

SEQ ID NO: 1655847 - protein, 25 aa, Staphylococcus aureus
SKIAYVVEFFEWFNTLETFKNWKKK

SEQ ID NO: 1655848 - protein, 22 aa, Staphylococcus aureus
SKLLENQQVLALESNKKIQKLE

SEQ ID NO: 1655849 - protein, 20 aa, Staphylococcus aureus
SKPKWSKLINKLSVPIEANY

SEQ ID NO: 1655850 - protein, 26 aa, Staphylococcus aureus
SLNKLSFKYMDRILLNWKKNNVKTID

SEQ ID NO: 1655851 - protein, 23 aa, Staphylococcus aureus
SMIKGTVEAILFQNSDNFYTVLK

SEQ ID NO: 1655852 - protein, 27 aa, Staphylococcus aureus
SPLYLWRSSEGMTEFIFNGFYDNVISS

SEQ ID NO: 1655853 - protein, 18 aa, Staphylococcus aureus
SPNELKTLPPVFIAHCNG

SEQ ID NO: 1655854 - protein, 17 aa, Staphylococcus aureus
SRFCLRVMNPIPISMNI

SEQ ID NO: 1655855 - protein, 20 aa, Staphylococcus aureus
STKAQIAFCIDVRSEPFRRH

SEQ ID NO: 1655856 - protein, 24 aa, Staphylococcus aureus
STSGKTGFYFRVLKQGYVSPNDQL

SEQ ID NO: 1655857 - protein, 21 aa, Staphylococcus aureus
SVQPNAKFPPSLRNMYKELAD

SEQ ID NO: 1655858 - protein, 22 aa, Staphylococcus aureus
SYKEELIEFILSIQKNEFNIKI

SEQ ID NO: 1655859 - protein, 24 aa, Staphylococcus aureus
TGIDHNRLSLLMAVLEKKENYLLQ

SEQ ID NO: 1655860 - protein, 19 aa, Staphylococcus aureus
TIEMERLFNGLKDEGAILM

SEQ ID NO: 1655861 - protein, 19 aa, Staphylococcus aureus
TIHDARDLLQYKIDNYDNH

SEQ ID NO: 1655862 - protein, 24 aa, Staphylococcus aureus
TLNAKKEWRNILISTGESSIANMA

SEQ ID NO: 1655863 - protein, 25 aa, Staphylococcus aureus
TLNFECGRFIVAHIGYYVTEVLDIK

SEQ ID NO: 1655864 - protein, 24 aa, Staphylococcus aureus
TNKGRYLFIPVHKLADIRWKELGQ

SEQ ID NO: 1655865 - protein, 18 aa, Staphylococcus aureus
TNVLYGFPKFYDACIANN

SEQ ID NO: 1655866 - protein, 18 aa, Staphylococcus aureus
TVDIRKQFTYDYTALDIK

SEQ ID NO: 1655867 - protein, 29 aa, Staphylococcus aureus
TVYNIPFLWRLSSELNVAQLRQAVQHLIA

SEQ ID NO: 1655868 - protein, 24 aa, Staphylococcus aureus
TWKNKGYPVSIVYPIEGTMLNVDG

SEQ ID NO: 1655869 - protein, 20 aa, Staphylococcus aureus
VDVIAAKIIKNYGISRLDSI

SEQ ID NO: 1655870 - protein, 19 aa, Staphylococcus aureus
VFHYFKEAHPYFDQDVVII

SEQ ID NO: 1655871 - protein, 21 aa, Staphylococcus aureus
VKFEAGWCPDCRAMDLWIDPI

SEQ ID NO: 1655872 - protein, 21 aa, Staphylococcus aureus
VLGEKSYLILIDDFSGTGKSI

SEQ ID NO: 1655873 - protein, 21 aa, Staphylococcus aureus
VLVETLPDFNFHIAAITEMSD

SEQ ID NO: 1655874 - protein, 21 aa, Staphylococcus aureus
VNCVAPGPFWSPLQISGGQPQ

SEQ ID NO: 1655875 - protein, 26 aa, Staphylococcus aureus
VNLKFKSAHSNFYIKEEIANFKSDIS

SEQ ID NO: 1655876 - protein, 29 aa, Staphylococcus aureus
VPYVTKFSMKWFLAMPRAKAWMINTRTPD

SEQ ID NO: 1655877 - protein, 18 aa, Staphylococcus aureus
VQLVKFDDYWQGKPALDK

SEQ ID NO: 1655878 - protein, 27 aa, Staphylococcus aureus
VREILDLPDYVFPVFGMAVGEPADDEN

SEQ ID NO: 1655879 - protein, 24 aa, Staphylococcus aureus
VSEPSYRDNIDWGEINQPIDEETF

SEQ ID NO: 1655880 - protein, 24 aa, Staphylococcus aureus
VVDISGRPYLSFNATLSKEKVGTF

SEQ ID NO: 1655881 - protein, 20 aa, Staphylococcus aureus
WKPLFKRKAKNDFSNKWKEK

SEQ ID NO: 1655882 - protein, 18 aa, Staphylococcus aureus
WLANIEIAMINTRLTPNE

SEQ ID NO: 1655883 - protein, 20 aa, Staphylococcus aureus
WQFRKLFKSYTWQSDVHELK

SEQ ID NO: 1655884 - protein, 27 aa, Staphylococcus aureus
YDPTCGSGSLLLRVGKEAKVYRYFGQE

SEQ ID NO: 1655885 - protein, 17 aa, Staphylococcus aureus
YFGLRTDPTISIKPIPR

SEQ ID NO: 1655886 - protein, 17 aa, Staphylococcus aureus
YGVSSLKALAATIDHTD

SEQ ID NO: 1655887 - protein, 18 aa, Staphylococcus aureus
YHLSEHVKFHGFKTHINE

SEQ ID NO: 1655888 - protein, 25 aa, Staphylococcus aureus
YIDAFKIFIHHVALHVSHRKDLKFN

SEQ ID NO: 1655889 - protein, 17 aa, Staphylococcus aureus
YIIVSYGVKISEVANNV

SEQ ID NO: 1655890 - protein, 17 aa, Staphylococcus aureus
YLQQKGFNPELMSATIH

SEQ ID NO: 1655891 - protein, 22 aa, Staphylococcus aureus
YMYKKFGVIPEMEYEMEEVKQI

SEQ ID NO: 1655892 - protein, 18 aa, Staphylococcus aureus
YPTISNDFLKSFGHVWLV

SEQ ID NO: 1655893 - protein, 24 aa, Staphylococcus aureus
YSQRKIDVELVFGFMKAILGFTRM

SEQ ID NO: 1655894 - protein, 27 aa, Staphylococcus aureus
YVIPNEFLKYTGRVHAQAYFTQNGSNN

SEQ ID NO: 1655895 - protein, 23 aa, Staphylococcus aureus
AELNIRLHEALQYAQPVEVKFYN

SEQ ID NO: 1655896 - protein, 17 aa, Staphylococcus aureus
AFLRLKDIVKETPLQLD

SEQ ID NO: 1655897 - protein, 21 aa, Staphylococcus aureus
AHQRIKFSSFDNEEIIYILDY

SEQ ID NO: 1655898 - protein, 17 aa, Staphylococcus aureus
ATYKTAIVITGKEDVIV

SEQ ID NO: 1655899 - protein, 18 aa, Staphylococcus aureus
AVILAEIFDKVGVPKGVF

SEQ ID NO: 1655900 - protein, 30 aa, Staphylococcus aureus
CARFDVSRMTLRQAIKLLAEDGIVESTRGK

SEQ ID NO: 1655901 - protein, 23 aa, Staphylococcus aureus
CCTPTEYRMMAKLQNLNDYDLTH

SEQ ID NO: 1655902 - protein, 20 aa, Staphylococcus aureus
CRMLYETGSFLELREETIVL

SEQ ID NO: 1655903 - protein, 17 aa, Staphylococcus aureus
DADVKYIAFGNDHNDIV

SEQ ID NO: 1655904 - protein, 23 aa, Staphylococcus aureus
DAKEGYIDCVMVYKTNRLARNTS

SEQ ID NO: 1655905 - protein, 19 aa, Staphylococcus aureus
DALNYYLFYLKNWNYAYAY

SEQ ID NO: 1655906 - protein, 18 aa, Staphylococcus aureus
DAVITLGCVIRGATSHYD

SEQ ID NO: 1655907 - protein, 20 aa, Staphylococcus aureus
DAYTTKALFEKWFHPKDAST

SEQ ID NO: 1655908 - protein, 24 aa, Staphylococcus aureus
DFETFKIALFDPAVKKYAFNANFE

SEQ ID NO: 1655909 - protein, 17 aa, Staphylococcus aureus
DGEIIFVEKTHNIKNGQ

SEQ ID NO: 1655910 - protein, 22 aa, Staphylococcus aureus
DGTAIHIIVPIAAVDKVTHLRA

SEQ ID NO: 1655911 - protein, 17 aa, Staphylococcus aureus
DHQITFIPYFPLASGIL

SEQ ID NO: 1655912 - protein, 22 aa, Staphylococcus aureus
DKRVDELLDMVGLEPEKYKNRK

SEQ ID NO: 1655913 - protein, 17 aa, Staphylococcus aureus
DLIDYSLYIKKGLVEPF

SEQ ID NO: 1655914 - protein, 25 aa, Staphylococcus aureus
DLINDCADCVISVLPSKLGAISDAI

SEQ ID NO: 1655915 - protein, 21 aa, Staphylococcus aureus
DPHFPKKLTLRDIVRANERGI

SEQ ID NO: 1655916 - protein, 23 aa, Staphylococcus aureus
DPQKRLVYYRVVELLEQGKSIST

SEQ ID NO: 1655917 - protein, 17 aa, Staphylococcus aureus
DVGNLYLNRGCTSAVVG

SEQ ID NO: 1655918 - protein, 21 aa, Staphylococcus aureus
DVSIPKERGLLPGNGAITSVV

SEQ ID NO: 1655919 - protein, 30 aa, Staphylococcus aureus
EFYHSNPFKFGASIGRYSGRIDNAKFKLQG

SEQ ID NO: 1655920 - protein, 26 aa, Staphylococcus aureus
EGPERFWPADLVLLSIGFEGTEPTVP

SEQ ID NO: 1655921 - protein, 21 aa, Staphylococcus aureus
EHHQCGVALYQLIPSKKEGEP

SEQ ID NO: 1655922 - protein, 25 aa, Staphylococcus aureus
EIEQARLKFKSEVEKNGYYAMNEKL

SEQ ID NO: 1655923 - protein, 19 aa, Staphylococcus aureus
ENTYKYVLHHGLDKKERLK

SEQ ID NO: 1655924 - protein, 20 aa, Staphylococcus aureus
EPFDWLSYWTDECHYTLKHV

SEQ ID NO: 1655925 - protein, 22 aa, Staphylococcus aureus
EQLKTELFDYVNWYNNFRPHSS

SEQ ID NO: 1655926 - protein, 25 aa, Staphylococcus aureus
ETDAELFGYCYGVAGTVGEVLTPIL

SEQ ID NO: 1655927 - protein, 19 aa, Staphylococcus aureus
ETLKTLSLDGYMVVIDTGV

SEQ ID NO: 1655928 - protein, 28 aa, Staphylococcus aureus
EVAEAIERINAAKVSGVKAIEATTTAQD

SEQ ID NO: 1655929 - protein, 20 aa, Staphylococcus aureus
EVAYLLKGGKVTKVDGNQNS

SEQ ID NO: 1655930 - protein, 24 aa, Staphylococcus aureus
EVTLPKLHSVYFVHVMHTLTEQFV

SEQ ID NO: 1655931 - protein, 18 aa, Staphylococcus aureus
EYTKRFNSLASFNTNINI

SEQ ID NO: 1655932 - protein, 17 aa, Staphylococcus aureus
FEERLKAVLKEVKESDG

SEQ ID NO: 1655933 - protein, 21 aa, Staphylococcus aureus
FKEAHPYFDQDVVIIGGKNSA

SEQ ID NO: 1655934 - protein, 24 aa, Staphylococcus aureus
FKELKIKAFEAHASQTGPFLKQLA

SEQ ID NO: 1655935 - protein, 19 aa, Staphylococcus aureus
FMYVDSINIFRSFHAISSF

SEQ ID NO: 1655936 - protein, 17 aa, Staphylococcus aureus
FPSYTILSIEELNDLLK

SEQ ID NO: 1655937 - protein, 18 aa, Staphylococcus aureus
FTKLTLPLLKNADIYFDN

SEQ ID NO: 1655938 - protein, 18 aa, Staphylococcus aureus
FYKDGKMAYYFIKDDEIR

SEQ ID NO: 1655939 - protein, 26 aa, Staphylococcus aureus
FYKTYDSTLFFAKRAQLIECLENKGF

SEQ ID NO: 1655940 - protein, 19 aa, Staphylococcus aureus
GAITKGVRGYLTFGHSINV

SEQ ID NO: 1655941 - protein, 20 aa, Staphylococcus aureus
GDIKKSIGFYCDKLGFTLVH

SEQ ID NO: 1655942 - protein, 21 aa, Staphylococcus aureus
GESDSSVLLFNIIKNNQPLLL

SEQ ID NO: 1655943 - protein, 21 aa, Staphylococcus aureus
GHLLALPGWAGILYYRSQQHH

SEQ ID NO: 1655944 - protein, 25 aa, Staphylococcus aureus
GPQFWWPADNDIEMMLGAILVQNTR

SEQ ID NO: 1655945 - protein, 17 aa, Staphylococcus aureus
GQLFLLDVFEGNIFKIN

SEQ ID NO: 1655946 - protein, 30 aa, Staphylococcus aureus
GQRAYNYHGEWKLKSADEFIKDNRIVTLTE

SEQ ID NO: 1655947 - protein, 17 aa, Staphylococcus aureus
GTFTVEFFIDSNNQLYV

SEQ ID NO: 1655948 - protein, 19 aa, Staphylococcus aureus
GVRGYLTFGHSINVPSIAE

SEQ ID NO: 1655949 - protein, 23 aa, Staphylococcus aureus
GVSIESLIEFCRLAQLPKNENIQ

SEQ ID NO: 1655950 - protein, 18 aa, Staphylococcus aureus
GYGKLTLPKAYGGEGATI

SEQ ID NO: 1655951 - protein, 17 aa, Staphylococcus aureus
HAEEIAHEIEVRSGYLR

SEQ ID NO: 1655952 - protein, 26 aa, Staphylococcus aureus
HIPFCVRICTYCDFNKYFIQNQPVDE

SEQ ID NO: 1655953 - protein, 17 aa, Staphylococcus aureus
HLFLARKQLEFYSTQCD

SEQ ID NO: 1655954 - protein, 25 aa, Staphylococcus aureus
HLMSRIRRYPLPLVLEISNIESVMP

SEQ ID NO: 1655955 - protein, 17 aa, Staphylococcus aureus
HPIPLKKYQHGFESIHQ

SEQ ID NO: 1655956 - protein, 22 aa, Staphylococcus aureus
HTEFKAEVYVLSKDEGGRHTPF

SEQ ID NO: 1655957 - protein, 19 aa, Staphylococcus aureus
HTYKVSKYWWSILLANTNV

SEQ ID NO: 1655958 - protein, 23 aa, Staphylococcus aureus
IAEALTSHFEFTKLTLPLLKNAD

SEQ ID NO: 1655959 - protein, 21 aa, Staphylococcus aureus
IAFVDARSDLTFDLETILTKI

SEQ ID NO: 1655960 - protein, 31 aa, Staphylococcus aureus
IANEISGMIPVEWEKVYTIAYLDDEGGEVVF

SEQ ID NO: 1655961 - protein, 21 aa, Staphylococcus aureus
IAQVFLKVTLSFMQYGALPEL

SEQ ID NO: 1655962 - protein, 17 aa, Staphylococcus aureus
IAREIIYDLLEEMDLRK

SEQ ID NO: 1655963 - protein, 19 aa, Staphylococcus aureus
IELSSGWNYNSKLVTGKNA

SEQ ID NO: 1655964 - protein, 17 aa, Staphylococcus aureus
IKAELGDNLFVLLCLAN

SEQ ID NO: 1655965 - protein, 24 aa, Staphylococcus aureus
IKLIEMNQGISFLPLYITTNSDYN

SEQ ID NO: 1655966 - protein, 17 aa, Staphylococcus aureus
IKNNRKIVTFGRSMENN

SEQ ID NO: 1655967 - protein, 20 aa, Staphylococcus aureus
IPLLQARSKEILASVNESKE

SEQ ID NO: 1655968 - protein, 17 aa, Staphylococcus aureus
IQLSYRLLPEVSLDCII

SEQ ID NO: 1655969 - protein, 24 aa, Staphylococcus aureus
IRGGCSPVGMKTLFPTVVDKSCEN

SEQ ID NO: 1655970 - protein, 17 aa, Staphylococcus aureus
KAAPLIVTEDTLQKSKG

SEQ ID NO: 1655971 - protein, 19 aa, Staphylococcus aureus
KATARNEITTILNNKLQAI

SEQ ID NO: 1655972 - protein, 25 aa, Staphylococcus aureus
KEIARTDLGRYFDRFADKLDKTQTN

SEQ ID NO: 1655973 - protein, 22 aa, Staphylococcus aureus
KEMAFPSLASVAYKAVAEKELV

SEQ ID NO: 1655974 - protein, 22 aa, Staphylococcus aureus
KFKDFFDFARRIPKRVKTRKLL

SEQ ID NO: 1655975 - protein, 19 aa, Staphylococcus aureus
KIEVESVIPILKDKNVVFT

SEQ ID NO: 1655976 - protein, 19 aa, Staphylococcus aureus
KKHFVRYGTMYISMDETLA

SEQ ID NO: 1655977 - protein, 17 aa, Staphylococcus aureus
KKLRNAFKEDLEPWTSC

SEQ ID NO: 1655978 - protein, 17 aa, Staphylococcus aureus
KLNEVLAAMGLSDKSIE

SEQ ID NO: 1655979 - protein, 19 aa, Staphylococcus aureus
KLQEHYQFHLAISGHEGIN

SEQ ID NO: 1655980 - protein, 23 aa, Staphylococcus aureus
KLTPPRQENVLNYANEQLEEQNS

SEQ ID NO: 1655981 - protein, 19 aa, Staphylococcus aureus
KMETARIQVMSDFSSRLYG

SEQ ID NO: 1655982 - protein, 17 aa, Staphylococcus aureus
KSASGFSEADLEKYAPE

SEQ ID NO: 1655983 - protein, 20 aa, Staphylococcus aureus
KSLWPQPGDHLLVTLRIDRE

SEQ ID NO: 1655984 - protein, 19 aa, Staphylococcus aureus
KSMNIEVSNHMQALEDDQI

SEQ ID NO: 1655985 - protein, 18 aa, Staphylococcus aureus
KTAQELADFLGRPVDEIV

SEQ ID NO: 1655986 - protein, 23 aa, Staphylococcus aureus
KTLIEYMDYLSLKDPKRILKSYP

SEQ ID NO: 1655987 - protein, 24 aa, Staphylococcus aureus
KTPTKAGYFVTCWTKDENNCNQPY

SEQ ID NO: 1655988 - protein, 20 aa, Staphylococcus aureus
KVGFKRLYVGVFNPEATKVV

SEQ ID NO: 1655989 - protein, 17 aa, Staphylococcus aureus
KVIYKWMDLGRKIDERL

SEQ ID NO: 1655990 - protein, 23 aa, Staphylococcus aureus
KVNTDYFCFGKDIIAPANGTVEK

SEQ ID NO: 1655991 - protein, 18 aa, Staphylococcus aureus
KVPEDWRGKVPVRQLDYF

SEQ ID NO: 1655992 - protein, 18 aa, Staphylococcus aureus
KYLAKPIITLFETIQGSK

SEQ ID NO: 1655993 - protein, 17 aa, Staphylococcus aureus
LANIHFVDTKINHHETL

SEQ ID NO: 1655994 - protein, 17 aa, Staphylococcus aureus
LATSGIDYTYVRMAMYM

SEQ ID NO: 1655995 - protein, 20 aa, Staphylococcus aureus
LDDDALCFYDIGSSEMNLDM

SEQ ID NO: 1655996 - protein, 18 aa, Staphylococcus aureus
LDMDLIYRRLDEIPNLRT

SEQ ID NO: 1655997 - protein, 17 aa, Staphylococcus aureus
LDYIDWINTEFDQLGRE

SEQ ID NO: 1655998 - protein, 17 aa, Staphylococcus aureus
LESKSGGKSGDFQRQSN

SEQ ID NO: 1655999 - protein, 20 aa, Staphylococcus aureus
LETELRAVINAMSQNEGKSV

SEQ ID NO: 1656000 - protein, 25 aa, Staphylococcus aureus
LFKGQDLVYFMPREFIEGRDINDIA

SEQ ID NO: 1656001 - protein, 22 aa, Staphylococcus aureus
LFSKEEWLSMSLAERQKAEKAF

SEQ ID NO: 1656002 - protein, 21 aa, Staphylococcus aureus
LKERINELFKGIKSFIEKVYD

SEQ ID NO: 1656003 - protein, 25 aa, Staphylococcus aureus
LMIYQLGALQGFCRIHQVKINHVKP

SEQ ID NO: 1656004 - protein, 18 aa, Staphylococcus aureus
LMPGGVNSPVRAFKSVDT

SEQ ID NO: 1656005 - protein, 19 aa, Staphylococcus aureus
LNYFKLKKFIVALESKTAI

SEQ ID NO: 1656006 - protein, 29 aa, Staphylococcus aureus
LRKAEQYKRLEFNLSFALDDIESTAKDVQ

SEQ ID NO: 1656007 - protein, 18 aa, Staphylococcus aureus
LSCGELCACDLLEHFQFS

SEQ ID NO: 1656008 - protein, 22 aa, Staphylococcus aureus
LYLLKESHLIIAHNALFDISVL

SEQ ID NO: 1656009 - protein, 21 aa, Staphylococcus aureus
MEPMFKDGEIIFVEKTHNIKN

SEQ ID NO: 1656010 - protein, 19 aa, Staphylococcus aureus
MNRPELQRILKDAKEGYID

SEQ ID NO: 1656011 - protein, 21 aa, Staphylococcus aureus
NECDLSYDITSLYTFKQPVSP

SEQ ID NO: 1656012 - protein, 25 aa, Staphylococcus aureus
NIFRSFHAISSFKLENLCSLYDIDK

SEQ ID NO: 1656013 - protein, 18 aa, Staphylococcus aureus
NLKEYRKYYEPLIHKNDK

SEQ ID NO: 1656014 - protein, 24 aa, Staphylococcus aureus
NMGNHSWKAIEIIYETYVHYVIPV

SEQ ID NO: 1656015 - protein, 23 aa, Staphylococcus aureus
NNDRRILEVLVRYANDQNYTARF

SEQ ID NO: 1656016 - protein, 17 aa, Staphylococcus aureus
NNYPIFVEHGAIDHIST

SEQ ID NO: 1656017 - protein, 25 aa, Staphylococcus aureus
NRSRNSLREWLPWVDATEQPSDTRA

SEQ ID NO: 1656018 - protein, 22 aa, Staphylococcus aureus
NTKKYLIKFCQDLIEHIKEHRN

SEQ ID NO: 1656019 - protein, 25 aa, Staphylococcus aureus
NVNGCVSAGVGERLHDETLFTEMVK

SEQ ID NO: 1656020 - protein, 19 aa, Staphylococcus aureus
NVYLPGARIRFMRYEGTKE

SEQ ID NO: 1656021 - protein, 17 aa, Staphylococcus aureus
NWNIAQMRIFWQYTAII

SEQ ID NO: 1656022 - protein, 23 aa, Staphylococcus aureus
NYACILLDLMLPEMDGIQVATKL

SEQ ID NO: 1656023 - protein, 20 aa, Staphylococcus aureus
PETLMPAIIELKKAYKEAKA

SEQ ID NO: 1656024 - protein, 21 aa, Staphylococcus aureus
PGAAVKYIEIEGVLHEFSAVD

SEQ ID NO: 1656025 - protein, 22 aa, Staphylococcus aureus
PKIRKNLRHAIEMLNVKKKEFL

SEQ ID NO: 1656026 - protein, 19 aa, Staphylococcus aureus
PLKHKRAPIQIYINAHYIV

SEQ ID NO: 1656027 - protein, 20 aa, Staphylococcus aureus
PPYKLEIEMLKQQHFDPELK

SEQ ID NO: 1656028 - protein, 23 aa, Staphylococcus aureus
PRFLKLNLQHFADTGVSGIAIGV

SEQ ID NO: 1656029 - protein, 31 aa, Staphylococcus aureus
QFLTKDLFIDWTWGEKFFRKHLIDYDAASNI

SEQ ID NO: 1656030 - protein, 21 aa, Staphylococcus aureus
QNDCPPCTFVKNYLNERQIDF

SEQ ID NO: 1656031 - protein, 18 aa, Staphylococcus aureus
QPYVKLLEILNEENKEET

SEQ ID NO: 1656032 - protein, 17 aa, Staphylococcus aureus
QQDGIICYIQFQMKYLA

SEQ ID NO: 1656033 - protein, 23 aa, Staphylococcus aureus
QTQLKFVLIYTIHIKKLTELSMK

SEQ ID NO: 1656034 - protein, 23 aa, Staphylococcus aureus
QVANCPKQYLAHVLSKHGFTCKK

SEQ ID NO: 1656035 - protein, 26 aa, Staphylococcus aureus
RDQAKQRKKACIIVTHDERLKAYCDR

SEQ ID NO: 1656036 - protein, 17 aa, Staphylococcus aureus
RELELEFSVGKNYLDTT

SEQ ID NO: 1656037 - protein, 20 aa, Staphylococcus aureus
RELFTLMFYTGLRIGEAMAL

SEQ ID NO: 1656038 - protein, 23 aa, Staphylococcus aureus
RENHYKQRLTVIGNQTFIRAIKK

SEQ ID NO: 1656039 - protein, 18 aa, Staphylococcus aureus
RENIKKWFGNAWDGVKSK

SEQ ID NO: 1656040 - protein, 24 aa, Staphylococcus aureus
RESDGFKDIRDVLGQVYETAEELD

SEQ ID NO: 1656041 - protein, 18 aa, Staphylococcus aureus
RGYPIGQILIPSRDEGHM

SEQ ID NO: 1656042 - protein, 21 aa, Staphylococcus aureus
RHNLKRPLILLNWNTLTGDTF

SEQ ID NO: 1656043 - protein, 19 aa, Staphylococcus aureus
RKKAKAFIDDYLASFPGVK

SEQ ID NO: 1656044 - protein, 20 aa, Staphylococcus aureus
RLLYQAIREIADKIGDNQLE

SEQ ID NO: 1656045 - protein, 18 aa, Staphylococcus aureus
RMQYVIPNEFLKYTGRVH

SEQ ID NO: 1656046 - protein, 20 aa, Staphylococcus aureus
RNHDESSEWVGLFKGKFTRS

SEQ ID NO: 1656047 - protein, 19 aa, Staphylococcus aureus
RPAIDVIIPGAKRAEQVVE

SEQ ID NO: 1656048 - protein, 21 aa, Staphylococcus aureus
RPHSSLQYLTPVAFKNLHMKT

SEQ ID NO: 1656049 - protein, 19 aa, Staphylococcus aureus
RQAIKDTIKKASIASGVDI

SEQ ID NO: 1656050 - protein, 17 aa, Staphylococcus aureus
RVGDRRVLCAMSGGVDS

SEQ ID NO: 1656051 - protein, 17 aa, Staphylococcus aureus
SEGKYSESVVVTGNTAI

SEQ ID NO: 1656052 - protein, 24 aa, Staphylococcus aureus
SFISEIKSAVNIGDQCPICGNEIQ

SEQ ID NO: 1656053 - protein, 19 aa, Staphylococcus aureus
SFMRKYSYHLSSSRLISGS

SEQ ID NO: 1656054 - protein, 17 aa, Staphylococcus aureus
SGLLQFADGNGFQCGIW

SEQ ID NO: 1656055 - protein, 24 aa, Staphylococcus aureus
SGVLVCTVIGFPLGASTTATKAFE

SEQ ID NO: 1656056 - protein, 21 aa, Staphylococcus aureus
SKMYGGTCINVGCIPSKTLVH

SEQ ID NO: 1656057 - protein, 18 aa, Staphylococcus aureus
SKTGEAFSKMGRNANHFG

SEQ ID NO: 1656058 - protein, 19 aa, Staphylococcus aureus
SMYEAGEWIQFYAIDEQEF

SEQ ID NO: 1656059 - protein, 26 aa, Staphylococcus aureus
SNGPKARLKLLVALSNNLDKAEIKSY

SEQ ID NO: 1656060 - protein, 19 aa, Staphylococcus aureus
SNINLTLNAKKEWRNILIS

SEQ ID NO: 1656061 - protein, 29 aa, Staphylococcus aureus
SNISWKAKGILLYLLSRPDNWQIYETELE

SEQ ID NO: 1656062 - protein, 27 aa, Staphylococcus aureus
SNYILKYVFANGIAREIIYDLLEEMDL

SEQ ID NO: 1656063 - protein, 17 aa, Staphylococcus aureus
SPIAGRVDNVFPTKHAI

SEQ ID NO: 1656064 - protein, 21 aa, Staphylococcus aureus
SQLTERISNMIGVHQVNINII

SEQ ID NO: 1656065 - protein, 22 aa, Staphylococcus aureus
TADFPYTIRIVSEVLESNGSSS

SEQ ID NO: 1656066 - protein, 25 aa, Staphylococcus aureus
THGYDFPMWFIRPFYAKETTANKLR

SEQ ID NO: 1656067 - protein, 17 aa, Staphylococcus aureus
TLAKLIDTFRHTYQSIE

SEQ ID NO: 1656068 - protein, 23 aa, Staphylococcus aureus
TNKRGYKMLPHFQIGMFEDQLFV

SEQ ID NO: 1656069 - protein, 17 aa, Staphylococcus aureus
TQAFLNEFAESLSKADR

SEQ ID NO: 1656070 - protein, 19 aa, Staphylococcus aureus
TSCEFDFTRDGKLNVSFDY

SEQ ID NO: 1656071 - protein, 22 aa, Staphylococcus aureus
TTTATALQWLLFDKGLDGSTKS

SEQ ID NO: 1656072 - protein, 23 aa, Staphylococcus aureus
TWRGKRSTDDIFTRLKDGHLRFR

SEQ ID NO: 1656073 - protein, 17 aa, Staphylococcus aureus
VAERPFLNKTLERKAVW

SEQ ID NO: 1656074 - protein, 18 aa, Staphylococcus aureus
VAKGFGIDEDVARRLASK

SEQ ID NO: 1656075 - protein, 17 aa, Staphylococcus aureus
VFAEFEIDGKITTFKKE

SEQ ID NO: 1656076 - protein, 19 aa, Staphylococcus aureus
VGGSVNPGGGMPMVTLSGQ

SEQ ID NO: 1656077 - protein, 17 aa, Staphylococcus aureus
VGVERLGARLSTTDDGE

SEQ ID NO: 1656078 - protein, 18 aa, Staphylococcus aureus
VNAGLKVKLLDIVVDKND

SEQ ID NO: 1656079 - protein, 25 aa, Staphylococcus aureus
VPDEASLEFNVRPVPEYDNDFIESF

SEQ ID NO: 1656080 - protein, 17 aa, Staphylococcus aureus
WFMTSARTNKEIEADVK

SEQ ID NO: 1656081 - protein, 18 aa, Staphylococcus aureus
WHAVGAFKTVGFSRTGKK

SEQ ID NO: 1656082 - protein, 18 aa, Staphylococcus aureus
WKETEIFFEKLTDLLDFM

SEQ ID NO: 1656083 - protein, 19 aa, Staphylococcus aureus
YDLTPSPLGKWIKQYQNTG

SEQ ID NO: 1656084 - protein, 20 aa, Staphylococcus aureus
YFDERSYFIFGGMAPKHYSH

SEQ ID NO: 1656085 - protein, 26 aa, Staphylococcus aureus
YGAKDIPPDVAIVFERRNHDESSEWV

SEQ ID NO: 1656086 - protein, 18 aa, Staphylococcus aureus
YIEIEGVLHEFSAVDNVV

SEQ ID NO: 1656087 - protein, 18 aa, Staphylococcus aureus
YKKEWPFDMVVIDELSTF

SEQ ID NO: 1656088 - protein, 17 aa, Staphylococcus aureus
YKTSKNFINKVYKGGFN

SEQ ID NO: 1656089 - protein, 17 aa, Staphylococcus aureus
YNLKNAKIHKIPEDVIL

SEQ ID NO: 1656090 - protein, 17 aa, Staphylococcus aureus
YPGAKEMILIPDITEAI

SEQ ID NO: 1656091 - protein, 23 aa, Staphylococcus aureus
YYMYKKFGVIPEMEYEMEEIKEI

SEQ ID NO: 1656092 - protein, 20 aa, Staphylococcus aureus
AARARGRYGGRPEKLNKQDL

SEQ ID NO: 1656093 - protein, 20 aa, Staphylococcus aureus
ADKGLIYKGKKPVYWSPSSE

SEQ ID NO: 1656094 - protein, 19 aa, Staphylococcus aureus
ADVFIGVSVANALSQDMVK

SEQ ID NO: 1656095 - protein, 17 aa, Staphylococcus aureus
AEKGFGFIEVEGENDVF

SEQ ID NO: 1656096 - protein, 20 aa, Staphylococcus aureus
AELSALIRMNGALSLSNQQF

SEQ ID NO: 1656097 - protein, 19 aa, Staphylococcus aureus
AERLMDVLFEMRKVNIEPK

SEQ ID NO: 1656098 - protein, 18 aa, Staphylococcus aureus
AFESYQRYFNQKGSNEIM

SEQ ID NO: 1656099 - protein, 18 aa, Staphylococcus aureus
AGEVFNSKTSFRIEEKVE

SEQ ID NO: 1656100 - protein, 19 aa, Staphylococcus aureus
AGSEVSALLGRMPSAVGYQ

SEQ ID NO: 1656101 - protein, 30 aa, Staphylococcus aureus
AHIRTLLLTFFYRFMRPLIEAGYVYIAQPP

SEQ ID NO: 1656102 - protein, 21 aa, Staphylococcus aureus
AIPHTKLRDALAHEINKVDLK

SEQ ID NO: 1656103 - protein, 18 aa, Staphylococcus aureus
AKPGICIIGEVVGYTENV

SEQ ID NO: 1656104 - protein, 26 aa, Staphylococcus aureus
AKQELRIGTWSILPFDIEHDANEPVA

SEQ ID NO: 1656105 - protein, 17 aa, Staphylococcus aureus
ALADLGVKYVVIGHSER

SEQ ID NO: 1656106 - protein, 17 aa, Staphylococcus aureus
APDELKTLPPVFIAHCN

SEQ ID NO: 1656107 - protein, 17 aa, Staphylococcus aureus
AQVGWHIPNRFTEGYGP

SEQ ID NO: 1656108 - protein, 25 aa, Staphylococcus aureus
ATNISEAAYLLWLLSRNNIGFTDLK

SEQ ID NO: 1656109 - protein, 19 aa, Staphylococcus aureus
AWYKQIEDLLEFAKKEEHI

SEQ ID NO: 1656110 - protein, 21 aa, Staphylococcus aureus
CSKYPECDFISWDKPIGRDCP

SEQ ID NO: 1656111 - protein, 19 aa, Staphylococcus aureus
DDYQALAILPLWHHDDTYL

SEQ ID NO: 1656112 - protein, 22 aa, Staphylococcus aureus
DGATFPNCLKITAKNDEAIIMA

SEQ ID NO: 1656113 - protein, 21 aa, Staphylococcus aureus
DGDHGVNMVRGFSSLKDKLDD

SEQ ID NO: 1656114 - protein, 25 aa, Staphylococcus aureus
DHLPKYMIPKTITYIDCIPLTTNDK

SEQ ID NO: 1656115 - protein, 22 aa, Staphylococcus aureus
DIGDLRQGYEYSRTANPTRSSV

SEQ ID NO: 1656116 - protein, 26 aa, Staphylococcus aureus
DIKAIYKRDYLCILGETVKEKLTHEL

SEQ ID NO: 1656117 - protein, 20 aa, Staphylococcus aureus
DKITWNWKGVFYPNPEKAIR

SEQ ID NO: 1656118 - protein, 20 aa, Staphylococcus aureus
DKRSASIYVAFNVKDDKGVV

SEQ ID NO: 1656119 - protein, 25 aa, Staphylococcus aureus
DLTKDYVLSVGKEFLKKADTSDKKE

SEQ ID NO: 1656120 - protein, 25 aa, Staphylococcus aureus
DPLTNKWRRVSVVLNKNGKQSQKEA

SEQ ID NO: 1656121 - protein, 17 aa, Staphylococcus aureus
DPSRSVGTFAIKTGAIT

SEQ ID NO: 1656122 - protein, 25 aa, Staphylococcus aureus
DQAFDRFKLNIFISLAELESDNIGE

SEQ ID NO: 1656123 - protein, 18 aa, Staphylococcus aureus
DSFLPQKLDIVVFPSKYG

SEQ ID NO: 1656124 - protein, 25 aa, Staphylococcus aureus
DWTFIKKAIAYYRFRPYAMKILKEN

SEQ ID NO: 1656125 - protein, 27 aa, Staphylococcus aureus
DYDAIILAAAGLRRMGWSDDIVTSYLD

SEQ ID NO: 1656126 - protein, 17 aa, Staphylococcus aureus
DYVKIAFNINRETHPNV

SEQ ID NO: 1656127 - protein, 18 aa, Staphylococcus aureus
EAHFQVWEKVVASYSGCC

SEQ ID NO: 1656128 - protein, 23 aa, Staphylococcus aureus
EDCIKFIEKWYFPTLPFQRFIIA

SEQ ID NO: 1656129 - protein, 23 aa, Staphylococcus aureus
EDVYKKARAFDEILDGMTNAIQH

SEQ ID NO: 1656130 - protein, 20 aa, Staphylococcus aureus
EEQKVIIIYALIQAKEPVKQ

SEQ ID NO: 1656131 - protein, 17 aa, Staphylococcus aureus
EGKLTVAGLLLFSNNIN

SEQ ID NO: 1656132 - protein, 17 aa, Staphylococcus aureus
EHGSNIWFEREAKDLLP

SEQ ID NO: 1656133 - protein, 17 aa, Staphylococcus aureus
EKEREIGAKYVDLDTLL

SEQ ID NO: 1656134 - protein, 18 aa, Staphylococcus aureus
EKIEVIKNADCVVVDSNI

SEQ ID NO: 1656135 - protein, 20 aa, Staphylococcus aureus
EKPGIVGAFCRAYTIEEAIE

SEQ ID NO: 1656136 - protein, 18 aa, Staphylococcus aureus
EKTRKALEDYGIDYDQII

SEQ ID NO: 1656137 - protein, 17 aa, Staphylococcus aureus
EKYNIQQAKGWTQVKMK

SEQ ID NO: 1656138 - protein, 30 aa, Staphylococcus aureus
ELAKALNVNEAWLMGFDISKNRKIENNDIT

SEQ ID NO: 1656139 - protein, 21 aa, Staphylococcus aureus
ELKLKIYEQIMLKIESEYKDI

SEQ ID NO: 1656140 - protein, 23 aa, Staphylococcus aureus
ENFKFFGQYADFKSLKSYNHGDV

SEQ ID NO: 1656141 - protein, 23 aa, Staphylococcus aureus
ENLSVESCELLPVIDDSTFTIDE

SEQ ID NO: 1656142 - protein, 24 aa, Staphylococcus aureus
ENPQSGKVQLVYNEHVELVEVPIK

SEQ ID NO: 1656143 - protein, 19 aa, Staphylococcus aureus
ENSELSIVDSLNFQPAKNK

SEQ ID NO: 1656144 - protein, 23 aa, Staphylococcus aureus
ENVSRLSQYYGHTIGYISQNYAE

SEQ ID NO: 1656145 - protein, 23 aa, Staphylococcus aureus
EQMSQCFKQSLGATEEQMLYFGL

SEQ ID NO: 1656146 - protein, 19 aa, Staphylococcus aureus
ESICKFCGNNLNYNLIKEK

SEQ ID NO: 1656147 - protein, 25 aa, Staphylococcus aureus
ETHALKDVQAVLGFHNDPSRSVGTF

SEQ ID NO: 1656148 - protein, 20 aa, Staphylococcus aureus
ETWVPSLAMRLILGQMSTVV

SEQ ID NO: 1656149 - protein, 22 aa, Staphylococcus aureus
EYKDVVFIYPMHRNPKVRAIAE

SEQ ID NO: 1656150 - protein, 21 aa, Staphylococcus aureus
FDFQLRVKKRAYSVEIVVLDH

SEQ ID NO: 1656151 - protein, 30 aa, Staphylococcus aureus
FELKHQFTHLTWKIKVYAVSGAINIETLPD

SEQ ID NO: 1656152 - protein, 26 aa, Staphylococcus aureus
FELLKRFSNNMIIIFKKVGDQHRDIV

SEQ ID NO: 1656153 - protein, 25 aa, Staphylococcus aureus
FEVARLDYISKLGFSYADMEKQGII

SEQ ID NO: 1656154 - protein, 17 aa, Staphylococcus aureus
FKRRRTPIVKGVSFECP

SEQ ID NO: 1656155 - protein, 17 aa, Staphylococcus aureus
FNAEKGFGFIEVEGEND

SEQ ID NO: 1656156 - protein, 17 aa, Staphylococcus aureus
FNKQHFVVGLKETLKAL

SEQ ID NO: 1656157 - protein, 17 aa, Staphylococcus aureus
FPKKYTEIIKKYKNKTP

SEQ ID NO: 1656158 - protein, 17 aa, Staphylococcus aureus
FQDWLAMEVLPAIRKHG

SEQ ID NO: 1656159 - protein, 18 aa, Staphylococcus aureus
FSLKGALWTLAQEVYQEW

SEQ ID NO: 1656160 - protein, 26 aa, Staphylococcus aureus
GAITKGARGYLTFGHSINVPSIAESY

SEQ ID NO: 1656161 - protein, 17 aa, Staphylococcus aureus
GARIRFMRYEGTKEESG

SEQ ID NO: 1656162 - protein, 19 aa, Staphylococcus aureus
GDFITKRFNIFANNDEMSF

SEQ ID NO: 1656163 - protein, 18 aa, Staphylococcus aureus
GDGSYLFEYPIWQRFGRY

SEQ ID NO: 1656164 - protein, 19 aa, Staphylococcus aureus
GDLTPVFFGSALANFGVQN

SEQ ID NO: 1656165 - protein, 33 aa, Staphylococcus aureus
GEGEFKAGSHCRFCKIKHSCRTRAEYMQNVPQK

SEQ ID NO: 1656166 - protein, 20 aa, Staphylococcus aureus
GKKFYPTKYLLIYNDNKTVE

SEQ ID NO: 1656167 - protein, 17 aa, Staphylococcus aureus
GKSKKPTFNDWGECATR

SEQ ID NO: 1656168 - protein, 23 aa, Staphylococcus aureus
GLKADNGLELLVHIGLDTVQLDG

SEQ ID NO: 1656169 - protein, 17 aa, Staphylococcus aureus
GLYDHRMFQVVAKYDAE

SEQ ID NO: 1656170 - protein, 18 aa, Staphylococcus aureus
GNASEILALIDDTATMKG

SEQ ID NO: 1656171 - protein, 23 aa, Staphylococcus aureus
GNINQCSFGFMLDDKGDEVRFDE

SEQ ID NO: 1656172 - protein, 21 aa, Staphylococcus aureus
GQMPNLWPRLIEIKVPTLILA

SEQ ID NO: 1656173 - protein, 18 aa, Staphylococcus aureus
GSNVYRVYFNDVQLPLLA

SEQ ID NO: 1656174 - protein, 24 aa, Staphylococcus aureus
GSYTGHLFKSFLEKHYKNKFILNI

SEQ ID NO: 1656175 - protein, 27 aa, Staphylococcus aureus
GTMILKPVFRDYLLKLVEAHDIEHQYY

SEQ ID NO: 1656176 - protein, 18 aa, Staphylococcus aureus
GTYMCIAAACGENVILNN

SEQ ID NO: 1656177 - protein, 18 aa, Staphylococcus aureus
GWGKEILGEGWNVYSAGI

SEQ ID NO: 1656178 - protein, 17 aa, Staphylococcus aureus
GWSKISDMFPRDKNAAK

SEQ ID NO: 1656179 - protein, 18 aa, Staphylococcus aureus
GYLNHFDMDFLYLTDTKN

SEQ ID NO: 1656180 - protein, 19 aa, Staphylococcus aureus
HDFRPSYQNVISKVFTLPQ

SEQ ID NO: 1656181 - protein, 20 aa, Staphylococcus aureus
HSQCLKQNLIDDNSIFIDVQ

SEQ ID NO: 1656182 - protein, 19 aa, Staphylococcus aureus
HWHLSREELNEFINSNDLG

SEQ ID NO: 1656183 - protein, 17 aa, Staphylococcus aureus
IAGDGAFQMVMQDFATA

SEQ ID NO: 1656184 - protein, 26 aa, Staphylococcus aureus
IANEISGMIPIEWEKVYTMAYIDDEG

SEQ ID NO: 1656185 - protein, 25 aa, Staphylococcus aureus
IDDGRCYLCPCLGYPRQWRSEDIYQ

SEQ ID NO: 1656186 - protein, 24 aa, Staphylococcus aureus
IDPDNIVGIGIDFTSSTIIFTDEN

SEQ ID NO: 1656187 - protein, 24 aa, Staphylococcus aureus
IEALKRGTAILITGGFKPSNKVID

SEQ ID NO: 1656188 - protein, 18 aa, Staphylococcus aureus
IEGSGHSFWYDLMPESGK

SEQ ID NO: 1656189 - protein, 17 aa, Staphylococcus aureus
IEVSISIEKSNKHLDDV

SEQ ID NO: 1656190 - protein, 20 aa, Staphylococcus aureus
IEYGGKRVLIDPMLSDKGAF

SEQ ID NO: 1656191 - protein, 19 aa, Staphylococcus aureus
IFAVSRSAGWIAHILEQYK

SEQ ID NO: 1656192 - protein, 19 aa, Staphylococcus aureus
IGANYGGVRAFTASAGPGL

SEQ ID NO: 1656193 - protein, 23 aa, Staphylococcus aureus
IHEKMAVFDLYFRKMPFNSGYAV

SEQ ID NO: 1656194 - protein, 20 aa, Staphylococcus aureus
IIDMEMEGLLQLVNPKIISQ

SEQ ID NO: 1656195 - protein, 18 aa, Staphylococcus aureus
IIESLDFFMKYTNIKHDN

SEQ ID NO: 1656196 - protein, 26 aa, Staphylococcus aureus
IKDTMFAPFIDYKCVTTMRLEDEAHH

SEQ ID NO: 1656197 - protein, 24 aa, Staphylococcus aureus
ILDFAKRQNVDWVVIGPEQPLIDG

SEQ ID NO: 1656198 - protein, 25 aa, Staphylococcus aureus
IQKRFTLNILYPYIETIHITKDKNL

SEQ ID NO: 1656199 - protein, 19 aa, Staphylococcus aureus
ISEGSIYPVLMRLNKKGYV

SEQ ID NO: 1656200 - protein, 19 aa, Staphylococcus aureus
ITSLKKRGAKNIRFMCLIA

SEQ ID NO: 1656201 - protein, 17 aa, Staphylococcus aureus
KAAQYVRKNPGEVCPAK

SEQ ID NO: 1656202 - protein, 28 aa, Staphylococcus aureus
KADYELVDFSVVEKLDWKQLNHEDLQQM

SEQ ID NO: 1656203 - protein, 19 aa, Staphylococcus aureus
KAKLFPLSFDNYFKQDEIY

SEQ ID NO: 1656204 - protein, 20 aa, Staphylococcus aureus
KCEYQRWIDIGIQTINKLLQ

SEQ ID NO: 1656205 - protein, 22 aa, Staphylococcus aureus
KDGRRAPFSSIYFLLTDDNISH

SEQ ID NO: 1656206 - protein, 19 aa, Staphylococcus aureus
KDKLGNYLIQPDVKEKTQQ

SEQ ID NO: 1656207 - protein, 18 aa, Staphylococcus aureus
KENGINYINDNDCLKIIE

SEQ ID NO: 1656208 - protein, 39 aa, Staphylococcus aureus
KGFITYKIPKKVIKHAGYVRCKLFLEKEEEKIHVANFSF

SEQ ID NO: 1656209 - protein, 23 aa, Staphylococcus aureus
KIKDAKFKTIIKLYEYQKSSENN

SEQ ID NO: 1656210 - protein, 19 aa, Staphylococcus aureus
KKAKSLDDIKDAINLNVKP

SEQ ID NO: 1656211 - protein, 17 aa, Staphylococcus aureus
KKYTEIIKKYKNKTPEE

SEQ ID NO: 1656212 - protein, 17 aa, Staphylococcus aureus
KLENLFNQFAIKNVEKN

SEQ ID NO: 1656213 - protein, 18 aa, Staphylococcus aureus
KLEVKKAKSLDDIKDAIN

SEQ ID NO: 1656214 - protein, 19 aa, Staphylococcus aureus
KLFDSGFQKIHMKISEINK

SEQ ID NO: 1656215 - protein, 34 aa, Staphylococcus aureus
KLYRVWFCKSRLCPMCNWRRAMKHGIQSQKVVAE

SEQ ID NO: 1656216 - protein, 22 aa, Staphylococcus aureus
KMSAEAKIMYALLKDRFELSIQ

SEQ ID NO: 1656217 - protein, 17 aa, Staphylococcus aureus
KQYITRLFQLSNNETWE

SEQ ID NO: 1656218 - protein, 19 aa, Staphylococcus aureus
KRAIEHLGYEVVVSNKQNI

SEQ ID NO: 1656219 - protein, 19 aa, Staphylococcus aureus
KRGCIVVIETFKAFVIDKD

SEQ ID NO: 1656220 - protein, 18 aa, Staphylococcus aureus
KRIENFKFFGQYANLKEL

SEQ ID NO: 1656221 - protein, 25 aa, Staphylococcus aureus
KRLKANLEYLKMNQMINHLDDVIDF

SEQ ID NO: 1656222 - protein, 26 aa, Staphylococcus aureus
KSSYNLKCLLLKLTYRYLDNQPLNDA

SEQ ID NO: 1656223 - protein, 20 aa, Staphylococcus aureus
KVLEVCKDFYQNQRIYTKIK

SEQ ID NO: 1656224 - protein, 19 aa, Staphylococcus aureus
KVNDLILRQCNKFISKNSI

SEQ ID NO: 1656225 - protein, 18 aa, Staphylococcus aureus
KYLFEDAYFKKMSAEAKI

SEQ ID NO: 1656226 - protein, 17 aa, Staphylococcus aureus
LDEIEKVITRLKNVHPN

SEQ ID NO: 1656227 - protein, 23 aa, Staphylococcus aureus
LENNEVYGLLGINGAGKTTLMKI

SEQ ID NO: 1656228 - protein, 18 aa, Staphylococcus aureus
LFDKYDIKSEILKVNEHR

SEQ ID NO: 1656229 - protein, 21 aa, Staphylococcus aureus
LFMHLKELFSEESFAENQSAF

SEQ ID NO: 1656230 - protein, 22 aa, Staphylococcus aureus
LKFPSDDYITLISRLSEIEEEC

SEQ ID NO: 1656231 - protein, 25 aa, Staphylococcus aureus
LKQKIKCPCCNTTLTNMTVRKKNHT

SEQ ID NO: 1656232 - protein, 18 aa, Staphylococcus aureus
LKTDSGFVVIPEEIVTDI

SEQ ID NO: 1656233 - protein, 17 aa, Staphylococcus aureus
LNDLAVFTINNSIKTMT

SEQ ID NO: 1656234 - protein, 17 aa, Staphylococcus aureus
LQCPGPIVKISQEMKNI

SEQ ID NO: 1656235 - protein, 20 aa, Staphylococcus aureus
LRRPEMTYDIILEILEEEHQ

SEQ ID NO: 1656236 - protein, 18 aa, Staphylococcus aureus
LYNQAGFNHVHYHTGPMS

SEQ ID NO: 1656237 - protein, 24 aa, Staphylococcus aureus
MFDIPYSIMGHVHFRKSVIDDGRC

SEQ ID NO: 1656238 - protein, 25 aa, Staphylococcus aureus
MHGDHIFGLPGLLSSRSFQGGEQKP

SEQ ID NO: 1656239 - protein, 26 aa, Staphylococcus aureus
MHIGLRANKKDFGWIYSSSLASAAAV

SEQ ID NO: 1656240 - protein, 17 aa, Staphylococcus aureus
MINVMMCYCVLFLEPRI

SEQ ID NO: 1656241 - protein, 20 aa, Staphylococcus aureus
MRKAYAVNCAKVLSRTDNIS

SEQ ID NO: 1656242 - protein, 17 aa, Staphylococcus aureus
MTPETATIGRLVDTKTL

SEQ ID NO: 1656243 - protein, 26 aa, Staphylococcus aureus
NDWGECATRIVSIYRYISKLQEHYQF

SEQ ID NO: 1656244 - protein, 27 aa, Staphylococcus aureus
NEIKLHREFIIEVPYMNSRKFELLIAN

SEQ ID NO: 1656245 - protein, 20 aa, Staphylococcus aureus
NELSEALWNIANLTNVLGIN

SEQ ID NO: 1656246 - protein, 17 aa, Staphylococcus aureus
NENKKKYGFESTTEDKQ

SEQ ID NO: 1656247 - protein, 22 aa, Staphylococcus aureus
NGRGKTSLARGIKEIIEENNPD

SEQ ID NO: 1656248 - protein, 19 aa, Staphylococcus aureus
NIWRSMKDLINYDLIKQGI

SEQ ID NO: 1656249 - protein, 17 aa, Staphylococcus aureus
NKGDIIALVGPSGSGKS

SEQ ID NO: 1656250 - protein, 17 aa, Staphylococcus aureus
NKKKYGFESTTEDKQKK

SEQ ID NO: 1656251 - protein, 19 aa, Staphylococcus aureus
NLNISFKKENGINYINDND

SEQ ID NO: 1656252 - protein, 18 aa, Staphylococcus aureus
NMASMVFLLGELNVSDLS

SEQ ID NO: 1656253 - protein, 17 aa, Staphylococcus aureus
NQSAFSITVYTNLDYTA

SEQ ID NO: 1656254 - protein, 17 aa, Staphylococcus aureus
NRYNLKNAKIHKIPEDV

SEQ ID NO: 1656255 - protein, 17 aa, Staphylococcus aureus
NSRYMVFYNDGLTLYTK

SEQ ID NO: 1656256 - protein, 25 aa, Staphylococcus aureus
NTIKGIECIYGLYKKNRRSLQIYGF

SEQ ID NO: 1656257 - protein, 24 aa, Staphylococcus aureus
NVFQGEALLFFLGLTNSMAGFEKL

SEQ ID NO: 1656258 - protein, 25 aa, Staphylococcus aureus
NVKYKEVLTGFKFIAQEIRQLDDHQ

SEQ ID NO: 1656259 - protein, 20 aa, Staphylococcus aureus
PEKYKSYFIGDWYVSGDSAY

SEQ ID NO: 1656260 - protein, 17 aa, Staphylococcus aureus
PFGYEYHNGAFIINQNE

SEQ ID NO: 1656261 - protein, 19 aa, Staphylococcus aureus
PKFKDAMHLADFFDAPYEM

SEQ ID NO: 1656262 - protein, 29 aa, Staphylococcus aureus
PSIEALNYYATRFMLTVPFENIDVQNGKP

SEQ ID NO: 1656263 - protein, 25 aa, Staphylococcus aureus
PYGIQELRELLKLLTEQGTSIIISS

SEQ ID NO: 1656264 - protein, 22 aa, Staphylococcus aureus
QEAFMKGGDFLGAGEFTVKVAN

SEQ ID NO: 1656265 - protein, 29 aa, Staphylococcus aureus
QEDALRMIRCLRFQSQLSFDIATETFEAM

SEQ ID NO: 1656266 - protein, 20 aa, Staphylococcus aureus
QEKSEIEVSISIEKSNKHLD

SEQ ID NO: 1656267 - protein, 17 aa, Staphylococcus aureus
QERLAKLAGGVAVIKVG

SEQ ID NO: 1656268 - protein, 25 aa, Staphylococcus aureus
QFKNGKQYIRWETINKYLGKYLSQE

SEQ ID NO: 1656269 - protein, 18 aa, Staphylococcus aureus
QGIAKMFDLMLPKKNIRM

SEQ ID NO: 1656270 - protein, 20 aa, Staphylococcus aureus
QHCEAFKANFKGAAQGDWVK

SEQ ID NO: 1656271 - protein, 24 aa, Staphylococcus aureus
QHQAKIISELDCLQSFAEIAQKYN

SEQ ID NO: 1656272 - protein, 22 aa, Staphylococcus aureus
QKALDIISDVPLFKRTKQDIHE

SEQ ID NO: 1656273 - protein, 36 aa, Staphylococcus aureus
QKVSMIFQHFNLLWSRTVLKNIMFPLEIAGVPRRRA

SEQ ID NO: 1656274 - protein, 18 aa, Staphylococcus aureus
QLVLQPWQHFIIGSLFGW

SEQ ID NO: 1656275 - protein, 19 aa, Staphylococcus aureus
QQIDLLWQEIESFDDDNIK

SEQ ID NO: 1656276 - protein, 20 aa, Staphylococcus aureus
QSGFSLNDLAVFTINNSIKT

SEQ ID NO: 1656277 - protein, 33 aa, Staphylococcus aureus
QSGLAPEAWLECYLNRTLLPILKLFSNTGISLE

SEQ ID NO: 1656278 - protein, 27 aa, Staphylococcus aureus
QTPNSYRFQKHLDHEVLIHTSLIVRED

SEQ ID NO: 1656279 - protein, 19 aa, Staphylococcus aureus
QVKSAILFASLFSKEPTII

SEQ ID NO: 1656280 - protein, 21 aa, Staphylococcus aureus
REKHLESMIEWAIDQIEQHFD

SEQ ID NO: 1656281 - protein, 17 aa, Staphylococcus aureus
RELLDHYSDLGLDEQDL

SEQ ID NO: 1656282 - protein, 21 aa, Staphylococcus aureus
RFKNQDVLKHINITLENNEVY

SEQ ID NO: 1656283 - protein, 27 aa, Staphylococcus aureus
RIPEWTNGKFLPKRKVVKIEQFENEIK

SEQ ID NO: 1656284 - protein, 20 aa, Staphylococcus aureus
RKQFNYRGLQCPGPIVKISQ

SEQ ID NO: 1656285 - protein, 18 aa, Staphylococcus aureus
RMLYETGSFLELREETIV

SEQ ID NO: 1656286 - protein, 26 aa, Staphylococcus aureus
RQDCRILDYKSAIVIEYDDSERGEGD

SEQ ID NO: 1656287 - protein, 19 aa, Staphylococcus aureus
RQLVLQPWQHFIIGSLFGW

SEQ ID NO: 1656288 - protein, 22 aa, Staphylococcus aureus
RRLEKPKGIMIRNAQTMSSVES

SEQ ID NO: 1656289 - protein, 18 aa, Staphylococcus aureus
RSNGRYKPYNVIERLQVD

SEQ ID NO: 1656290 - protein, 21 aa, Staphylococcus aureus
RSQMAEGWGKEILGEGWNVYS

SEQ ID NO: 1656291 - protein, 19 aa, Staphylococcus aureus
RVSEGKSIQVLVPKSVENY

SEQ ID NO: 1656292 - protein, 21 aa, Staphylococcus aureus
SDFDKMRFVHHSIPSINVNDI

SEQ ID NO: 1656293 - protein, 17 aa, Staphylococcus aureus
SHFEFTKLTLPLLKNAD

SEQ ID NO: 1656294 - protein, 23 aa, Staphylococcus aureus
SIGTACLNNGKFSMSKIVHHPQI

SEQ ID NO: 1656295 - protein, 18 aa, Staphylococcus aureus
SITEGTIAEWLKNLGDSV

SEQ ID NO: 1656296 - protein, 17 aa, Staphylococcus aureus
SLIKDLSIVKVYSSYIN

SEQ ID NO: 1656297 - protein, 27 aa, Staphylococcus aureus
SMALDWPLIEVGQSFKALSQSIKEFRM

SEQ ID NO: 1656298 - protein, 18 aa, Staphylococcus aureus
SNNYPIFVEHGAIDHIST

SEQ ID NO: 1656299 - protein, 19 aa, Staphylococcus aureus
SQQQLRYFFSHNHSLPSSF

SEQ ID NO: 1656300 - protein, 34 aa, Staphylococcus aureus
SQYSNCPIFTFGRSSGAYLSLLIARDRDIDGVID

SEQ ID NO: 1656301 - protein, 35 aa, Staphylococcus aureus
STFKSRVEKSIADWGIKLERTFYVSKFDHPENELE

SEQ ID NO: 1656302 - protein, 19 aa, Staphylococcus aureus
TAGFDMYDLDLAKKHNIVI

SEQ ID NO: 1656303 - protein, 22 aa, Staphylococcus aureus
TARYGEFGSFFVGHIINTNEFD

SEQ ID NO: 1656304 - protein, 27 aa, Staphylococcus aureus
TDIKIPSFEVIDWLRNGLELHNVEESI

SEQ ID NO: 1656305 - protein, 25 aa, Staphylococcus aureus
TEQKNGLTYLAWSYAHQELKKIDPN

SEQ ID NO: 1656306 - protein, 18 aa, Staphylococcus aureus
TNTMKLFLYIIVMFSTSF

SEQ ID NO: 1656307 - protein, 25 aa, Staphylococcus aureus
TQKSPRWAIAYKFPAEEVVTKLLDI

SEQ ID NO: 1656308 - protein, 17 aa, Staphylococcus aureus
TVINRAAKRYINTSTDS

SEQ ID NO: 1656309 - protein, 22 aa, Staphylococcus aureus
VCIIRLKKEYYYNFFGQYLLSR

SEQ ID NO: 1656310 - protein, 18 aa, Staphylococcus aureus
VEKAYQFLVNEGYESISA

SEQ ID NO: 1656311 - protein, 17 aa, Staphylococcus aureus
VFNKRGYPIGQILIPSR

SEQ ID NO: 1656312 - protein, 20 aa, Staphylococcus aureus
VGEQFFKDNFGLKVKATNVV

SEQ ID NO: 1656313 - protein, 18 aa, Staphylococcus aureus
VKLYFKKAKSWSEKHRFP

SEQ ID NO: 1656314 - protein, 20 aa, Staphylococcus aureus
VLKLYIPIIRIIKGKIKASN

SEQ ID NO: 1656315 - protein, 22 aa, Staphylococcus aureus
VLWQLVAHRLMTWKKEYANNAV

SEQ ID NO: 1656316 - protein, 22 aa, Staphylococcus aureus
VNMEAVNHWHLSREELNEFINS

SEQ ID NO: 1656317 - protein, 26 aa, Staphylococcus aureus
VNVLQELKLWMARTIAATRNKAIIDV

SEQ ID NO: 1656318 - protein, 25 aa, Staphylococcus aureus
VPIVPELLKSLNFNQFNLVDAQCKP

SEQ ID NO: 1656319 - protein, 17 aa, Staphylococcus aureus
VQQAIVEGETYQVNYTA

SEQ ID NO: 1656320 - protein, 17 aa, Staphylococcus aureus
WESNTQCYQMLNLGKYQ

SEQ ID NO: 1656321 - protein, 20 aa, Staphylococcus aureus
WPRLIEIKVPTLILAGEYDE

SEQ ID NO: 1656322 - protein, 18 aa, Staphylococcus aureus
YDQDRQRLIGTIEVPMTL

SEQ ID NO: 1656323 - protein, 20 aa, Staphylococcus aureus
YFIEMNARIQVEHTVTEMRA

SEQ ID NO: 1656324 - protein, 20 aa, Staphylococcus aureus
YFNSVIDWISSIFINVEKEM

SEQ ID NO: 1656325 - protein, 17 aa, Staphylococcus aureus
YKCVTTMRLEDEAHHYT

SEQ ID NO: 1656326 - protein, 17 aa, Staphylococcus aureus
YKDYGIRKYGFHGTSHK

SEQ ID NO: 1656327 - protein, 17 aa, Staphylococcus aureus
YKLMFNTLRAMYQQHPI

SEQ ID NO: 1656328 - protein, 22 aa, Staphylococcus aureus
YMGVKRLGKIITQIQQYTDIDY

SEQ ID NO: 1656329 - protein, 18 aa, Staphylococcus aureus
YMHFGECLMIAVRQDCRI

SEQ ID NO: 1656330 - protein, 22 aa, Staphylococcus aureus
YNIQQAKGWTQVKMKAVLHNEA

SEQ ID NO: 1656331 - protein, 19 aa, Staphylococcus aureus
YNRGYEFSNIKLYYSSDDE

SEQ ID NO: 1656332 - protein, 17 aa, Staphylococcus aureus
YSANSAHVTGCRLLKKP

SEQ ID NO: 1656333 - protein, 22 aa, Staphylococcus aureus
YYKGWNKKQLKDVLEFSNKRTI

SEQ ID NO: 1656334 - protein, 17 aa, Staphylococcus aureus
YYYNFFGQYLLSRKGKR

SEQ ID NO: 1656335 - protein, 24 aa, Staphylococcus aureus
AASEVEGINWLELDVAITKDEQLI

SEQ ID NO: 1656336 - protein, 18 aa, Staphylococcus aureus
ACFDDMFAHVVLFLHLYN

SEQ ID NO: 1656337 - protein, 22 aa, Staphylococcus aureus
ADIKGLKIWVFAVDEGNEIRCR

SEQ ID NO: 1656338 - protein, 24 aa, Staphylococcus aureus
ADQAICIGEANALDSYLNIDRIIS

SEQ ID NO: 1656339 - protein, 24 aa, Staphylococcus aureus
AEIYGMKVARDLVHISGDTSDYHI

SEQ ID NO: 1656340 - protein, 17 aa, Staphylococcus aureus
AEKVKHQYGHAFYDSAS

SEQ ID NO: 1656341 - protein, 19 aa, Staphylococcus aureus
AFTVMYLLISKMFENENVD

SEQ ID NO: 1656342 - protein, 22 aa, Staphylococcus aureus
AGDTFRAGAIDQLKVWGERVGV

SEQ ID NO: 1656343 - protein, 25 aa, Staphylococcus aureus
AIDKAYFEKCLPGYTLINKLHPSIE

SEQ ID NO: 1656344 - protein, 19 aa, Staphylococcus aureus
AIREKLNIVNQGLLDPEKY

SEQ ID NO: 1656345 - protein, 19 aa, Staphylococcus aureus
ALLKKGIKTIMLGGQVKEN

SEQ ID NO: 1656346 - protein, 17 aa, Staphylococcus aureus
ALNKAYDLFSMMDSVDK

SEQ ID NO: 1656347 - protein, 25 aa, Staphylococcus aureus
ALSQSIKEFRMWVADERIQHNDNML

SEQ ID NO: 1656348 - protein, 18 aa, Staphylococcus aureus
ALVNRFPSATIYNTYGPT

SEQ ID NO: 1656349 - protein, 18 aa, Staphylococcus aureus
AMSTFVIYDNTIERNSIA

SEQ ID NO: 1656350 - protein, 17 aa, Staphylococcus aureus
ANAIALVLSFNHEVDTF

SEQ ID NO: 1656351 - protein, 17 aa, Staphylococcus aureus
APIQIYINAHYIVGMTA

SEQ ID NO: 1656352 - protein, 18 aa, Staphylococcus aureus
ATKVGIGPGRVCITKIKT

SEQ ID NO: 1656353 - protein, 24 aa, Staphylococcus aureus
AVTPKVMKKQAAKDEIDQLQAAQT

SEQ ID NO: 1656354 - protein, 24 aa, Staphylococcus aureus
AYLLKGAKVTKVYGDQNSVSFVPG

SEQ ID NO: 1656355 - protein, 18 aa, Staphylococcus aureus
DALKFQVLEELPQQLQDY

SEQ ID NO: 1656356 - protein, 20 aa, Staphylococcus aureus
DDLPSLPTHAMFGENLTFDY

SEQ ID NO: 1656357 - protein, 24 aa, Staphylococcus aureus
DDNDIDEIIAWRGEQEELEQKRDT

SEQ ID NO: 1656358 - protein, 25 aa, Staphylococcus aureus
DDNVCSCCGQQLPAEQVSEVREKAL

SEQ ID NO: 1656359 - protein, 23 aa, Staphylococcus aureus
DEVAVGFGRTGKMFACNHEDVQP

SEQ ID NO: 1656360 - protein, 19 aa, Staphylococcus aureus
DLEGICLSRTIATEKQLVP

SEQ ID NO: 1656361 - protein, 26 aa, Staphylococcus aureus
DNRYGCALAIEVLKRLKDENIGINLY

SEQ ID NO: 1656362 - protein, 17 aa, Staphylococcus aureus
DPALIPFIMEKTGKTAE

SEQ ID NO: 1656363 - protein, 17 aa, Staphylococcus aureus
DRFELSIQNEWVDRNNN

SEQ ID NO: 1656364 - protein, 20 aa, Staphylococcus aureus
DTESLLGFKTIKTNAEGQQE

SEQ ID NO: 1656365 - protein, 18 aa, Staphylococcus aureus
DTYSFPRVWLDKDSYDFS

SEQ ID NO: 1656366 - protein, 17 aa, Staphylococcus aureus
DYEFDLGHFRGAIRPNI

SEQ ID NO: 1656367 - protein, 22 aa, Staphylococcus aureus
DYTHARFYTRAMTRKELDILTE

SEQ ID NO: 1656368 - protein, 18 aa, Staphylococcus aureus
EAFAVALETAFLKGTGKD

SEQ ID NO: 1656369 - protein, 17 aa, Staphylococcus aureus
EALPERDTIITIWVKLL

SEQ ID NO: 1656370 - protein, 19 aa, Staphylococcus aureus
EFMDAYRELKMIVPTPHMV

SEQ ID NO: 1656371 - protein, 19 aa, Staphylococcus aureus
EGVLKDKLFIDGKYYDDYM

SEQ ID NO: 1656372 - protein, 24 aa, Staphylococcus aureus
EHRPRLNHPSLYVDLGDHVDLSAP

SEQ ID NO: 1656373 - protein, 19 aa, Staphylococcus aureus
EILDLLSCGELCACDLLEH

SEQ ID NO: 1656374 - protein, 25 aa, Staphylococcus aureus
ELDNGFDFYAPQTFLDEKGRRVLIG

SEQ ID NO: 1656375 - protein, 22 aa, Staphylococcus aureus
EMSLPLMWEFPGGKIEKNETEK

SEQ ID NO: 1656376 - protein, 17 aa, Staphylococcus aureus
ESGGLLMYGIPNMKLDK

SEQ ID NO: 1656377 - protein, 19 aa, Staphylococcus aureus
ESMLIPLIARAKEYENEKP

SEQ ID NO: 1656378 - protein, 17 aa, Staphylococcus aureus
ETVEAMQGYLMQSIKAE

SEQ ID NO: 1656379 - protein, 22 aa, Staphylococcus aureus
EVIKQKPTVRWLFLTLTVKNVY

SEQ ID NO: 1656380 - protein, 19 aa, Staphylococcus aureus
EVLNIPKSTYYRWKNKTYK

SEQ ID NO: 1656381 - protein, 18 aa, Staphylococcus aureus
EVNGETFYSRVIKTLEST

SEQ ID NO: 1656382 - protein, 25 aa, Staphylococcus aureus
FATFGSFRPWPAYLYTIEHSIYVDA

SEQ ID NO: 1656383 - protein, 19 aa, Staphylococcus aureus
FDKRAQLIECLEKKGFEML

SEQ ID NO: 1656384 - protein, 19 aa, Staphylococcus aureus
FDLSCTYDSYQFDGENVSR

SEQ ID NO: 1656385 - protein, 18 aa, Staphylococcus aureus
FEGPIKLHKEFAIPVKFT

SEQ ID NO: 1656386 - protein, 25 aa, Staphylococcus aureus
FETHIKSRISYYFSEKYREPHSYLY

SEQ ID NO: 1656387 - protein, 18 aa, Staphylococcus aureus
FGEHYARLRPKKLKANIE

SEQ ID NO: 1656388 - protein, 18 aa, Staphylococcus aureus
FHKNHIYTTVFYDKHRRN

SEQ ID NO: 1656389 - protein, 20 aa, Staphylococcus aureus
FIELGGIVQRTWKGKRSTDD

SEQ ID NO: 1656390 - protein, 19 aa, Staphylococcus aureus
FKKVIDIKTAEWLNTDSDK

SEQ ID NO: 1656391 - protein, 24 aa, Staphylococcus aureus
FSNSYKSLKDWTGDMYSRAHDRFD

SEQ ID NO: 1656392 - protein, 18 aa, Staphylococcus aureus
FVRYLSMNFKDYFTSIKL

SEQ ID NO: 1656393 - protein, 18 aa, Staphylococcus aureus
FYHIPFPDKYRGMYEQPQ

SEQ ID NO: 1656394 - protein, 20 aa, Staphylococcus aureus
GAIDQLKVWGERVGVDVISQ

SEQ ID NO: 1656395 - protein, 26 aa, Staphylococcus aureus
GASTYRKQFCKLLLKSAKVSVIKGNA

SEQ ID NO: 1656396 - protein, 23 aa, Staphylococcus aureus
GDQCPICGNEIQDLGHHIDFDSI

SEQ ID NO: 1656397 - protein, 17 aa, Staphylococcus aureus
GDTLVLNDTRVMPARLF

SEQ ID NO: 1656398 - protein, 22 aa, Staphylococcus aureus
GEYGHEVLKMYADNKTINSDKL

SEQ ID NO: 1656399 - protein, 17 aa, Staphylococcus aureus
GIIKMKLPIEDLEKKQK

SEQ ID NO: 1656400 - protein, 17 aa, Staphylococcus aureus
GKIPGGFKKREGRPGDD

SEQ ID NO: 1656401 - protein, 19 aa, Staphylococcus aureus
GKYSESVVVTGNTAIDAMK

SEQ ID NO: 1656402 - protein, 18 aa, Staphylococcus aureus
GMKQRVALCRAHVHKPNV

SEQ ID NO: 1656403 - protein, 21 aa, Staphylococcus aureus
GNEIRCRLRSKGQLIINDIAQ

SEQ ID NO: 1656404 - protein, 18 aa, Staphylococcus aureus
GPNIEKLDHQFQQTMQVG

SEQ ID NO: 1656405 - protein, 24 aa, Staphylococcus aureus
GQASRRICEAIEYYFGLRTDKPDE

SEQ ID NO: 1656406 - protein, 24 aa, Staphylococcus aureus
GQESKYSISLIIPKSDTSTIKAIE

SEQ ID NO: 1656407 - protein, 17 aa, Staphylococcus aureus
GQFACKPPMKEQEINAT

SEQ ID NO: 1656408 - protein, 21 aa, Staphylococcus aureus
GQYRGIATWRYDQDRQRLIGT

SEQ ID NO: 1656409 - protein, 23 aa, Staphylococcus aureus
GTQQFRLPVSWQHNHPFDIYRYK

SEQ ID NO: 1656410 - protein, 27 aa, Staphylococcus aureus
HLETNCVFLHCDYILKVPINKLVSYYA

SEQ ID NO: 1656411 - protein, 19 aa, Staphylococcus aureus
HLLRCRVNDYIVYSYALLW

SEQ ID NO: 1656412 - protein, 26 aa, Staphylococcus aureus
HTTDRKGHVIGMLEWALDYIVGNIEV

SEQ ID NO: 1656413 - protein, 17 aa, Staphylococcus aureus
HVEHVHLASDIPFNNDK

SEQ ID NO: 1656414 - protein, 25 aa, Staphylococcus aureus
HVYIKDCKVRQSFELASPKHTEGLI

SEQ ID NO: 1656415 - protein, 22 aa, Staphylococcus aureus
IDLELLIAIVSVKFDINYSLKP

SEQ ID NO: 1656416 - protein, 18 aa, Staphylococcus aureus
IDNHFQLLLYISENHCQL

SEQ ID NO: 1656417 - protein, 18 aa, Staphylococcus aureus
IDPALIPFIMEKTGKTAE

SEQ ID NO: 1656418 - protein, 18 aa, Staphylococcus aureus
IEVWGKFTPRGGISIDPY

SEQ ID NO: 1656419 - protein, 20 aa, Staphylococcus aureus
IFSKFSNYYEFLVRYKKIDT

SEQ ID NO: 1656420 - protein, 17 aa, Staphylococcus aureus
IGALCGEAIVFTKNNEP

SEQ ID NO: 1656421 - protein, 18 aa, Staphylococcus aureus
IITAIGYSGCEIDPNCTY

SEQ ID NO: 1656422 - protein, 21 aa, Staphylococcus aureus
IITKEQLKMFVYDYDTHLIKN

SEQ ID NO: 1656423 - protein, 24 aa, Staphylococcus aureus
IIYYDGVVIGGLYDNRLLVKATKS

SEQ ID NO: 1656424 - protein, 25 aa, Staphylococcus aureus
IKTYIFYHLFDRYIIDYSMASATGM

SEQ ID NO: 1656425 - protein, 26 aa, Staphylococcus aureus
ILNRAKEEFKKVLPIKNDSDFGLLTG

SEQ ID NO: 1656426 - protein, 36 aa, Staphylococcus aureus
ILTSICKKWYINSFKYFRNMYKGFYYSRPDKLDKCF

SEQ ID NO: 1656427 - protein, 26 aa, Staphylococcus aureus
IMEKDMAYELGFDHGLLFKDGVTVGV

SEQ ID NO: 1656428 - protein, 39 aa, Staphylococcus aureus
INIDNYRGSQCWDTPNFIFKRYWGFVTWGNAKDMANYRY

SEQ ID NO: 1656429 - protein, 23 aa, Staphylococcus aureus
INTHRGYFRISREAIEDAKVNVL

SEQ ID NO: 1656430 - protein, 18 aa, Staphylococcus aureus
IREIRIIKSVLLKGKKSF

SEQ ID NO: 1656431 - protein, 18 aa, Staphylococcus aureus
IRMSTRPTPFGLLSGINL

SEQ ID NO: 1656432 - protein, 17 aa, Staphylococcus aureus
IVADSWLDAYQVIRDSD

SEQ ID NO: 1656433 - protein, 17 aa, Staphylococcus aureus
IVHPREIFSIAVRENAN

SEQ ID NO: 1656434 - protein, 20 aa, Staphylococcus aureus
IVIELTKLMRGINVEKSFNH

SEQ ID NO: 1656435 - protein, 25 aa, Staphylococcus aureus
IVITCNYRLGALGYLDWSYFNKDFH

SEQ ID NO: 1656436 - protein, 24 aa, Staphylococcus aureus
IVSVLKRFKAMLLQKNETVEAMQG

SEQ ID NO: 1656437 - protein, 27 aa, Staphylococcus aureus
IWQRFGRYTGGLNFNGGRHYGIDFGMP

SEQ ID NO: 1656438 - protein, 20 aa, Staphylococcus aureus
KAKDEKDGRDSTNQSMVEST

SEQ ID NO: 1656439 - protein, 21 aa, Staphylococcus aureus
KATLWNRRSMRVEFNPNKLSH

SEQ ID NO: 1656440 - protein, 19 aa, Staphylococcus aureus
KDIKTFYVWGYYKNEQIKW

SEQ ID NO: 1656441 - protein, 17 aa, Staphylococcus aureus
KEANAIALVLSFNHEVD

SEQ ID NO: 1656442 - protein, 21 aa, Staphylococcus aureus
KEITKLNGLCLKWVAPGTRGV

SEQ ID NO: 1656443 - protein, 24 aa, Staphylococcus aureus
KEKVMKKMIANLLIEKSLDVISTK

SEQ ID NO: 1656444 - protein, 21 aa, Staphylococcus aureus
KENFRRNHCETLIEAVPGNLL

SEQ ID NO: 1656445 - protein, 20 aa, Staphylococcus aureus
KEYPNALLHWEDFGRGHAKN

SEQ ID NO: 1656446 - protein, 19 aa, Staphylococcus aureus
KFFVQYGNFKDINDYKNGD

SEQ ID NO: 1656447 - protein, 20 aa, Staphylococcus aureus
KKIDCEYTYAMAIAILIRHT

SEQ ID NO: 1656448 - protein, 24 aa, Staphylococcus aureus
KLNLELRIPIIIISGNHDGKERLN

SEQ ID NO: 1656449 - protein, 17 aa, Staphylococcus aureus
KPRHTVQIFEEAQKILQ

SEQ ID NO: 1656450 - protein, 33 aa, Staphylococcus aureus
KQGKTILKKISWQIAKGDKWILYGLNGAGKTTL

SEQ ID NO: 1656451 - protein, 24 aa, Staphylococcus aureus
KQGTHFKEVFSLYKLDRKFRNVLL

SEQ ID NO: 1656452 - protein, 24 aa, Staphylococcus aureus
KQHHAANAWGSWNPDEFTVEDSAF

SEQ ID NO: 1656453 - protein, 23 aa, Staphylococcus aureus
KQLKILRRRGMEVPSSAKRDLEN

SEQ ID NO: 1656454 - protein, 18 aa, Staphylococcus aureus
KRMIDGGFTRSTHVPVLF

SEQ ID NO: 1656455 - protein, 18 aa, Staphylococcus aureus
KSMTHRAIMLASLAEGTS

SEQ ID NO: 1656456 - protein, 18 aa, Staphylococcus aureus
KTTIAQNFVSTVIQTEPS

SEQ ID NO: 1656457 - protein, 26 aa, Staphylococcus aureus
KVRRNPYSVILFDEIEKANPQILTLL

SEQ ID NO: 1656458 - protein, 18 aa, Staphylococcus aureus
KYYYEQGEELFLNPELEE

SEQ ID NO: 1656459 - protein, 23 aa, Staphylococcus aureus
LAGAEVLGVVAIFTYGLKKADDT

SEQ ID NO: 1656460 - protein, 18 aa, Staphylococcus aureus
LAKWFAENDYFYIMHRFD

SEQ ID NO: 1656461 - protein, 17 aa, Staphylococcus aureus
LDLPLATGLVAEVGQGL

SEQ ID NO: 1656462 - protein, 23 aa, Staphylococcus aureus
LDPHKLASCIDVANIDTPIKIIL

SEQ ID NO: 1656463 - protein, 18 aa, Staphylococcus aureus
LGGTVLKQIENVSVNVKR

SEQ ID NO: 1656464 - protein, 17 aa, Staphylococcus aureus
LKALEVLTHEHVHLENH

SEQ ID NO: 1656465 - protein, 19 aa, Staphylococcus aureus
LKKRMIAGGFTRSTHVPVL

SEQ ID NO: 1656466 - protein, 17 aa, Staphylococcus aureus
LKNRERQLLLSVDNIEC

SEQ ID NO: 1656467 - protein, 24 aa, Staphylococcus aureus
LLGYGDMLYLGSGMNKPIRVQGTF

SEQ ID NO: 1656468 - protein, 17 aa, Staphylococcus aureus
LLYKLPDIKKWADEVEH

SEQ ID NO: 1656469 - protein, 19 aa, Staphylococcus aureus
LPEDQRKAVWAIYAVCRKI

SEQ ID NO: 1656470 - protein, 21 aa, Staphylococcus aureus
LPGKLDRLTAAFKNNDNIDMV

SEQ ID NO: 1656471 - protein, 17 aa, Staphylococcus aureus
LPLELRGFQIVSLDDIE

SEQ ID NO: 1656472 - protein, 17 aa, Staphylococcus aureus
LSNMAPTIVMHHGKPIL

SEQ ID NO: 1656473 - protein, 20 aa, Staphylococcus aureus
LTLSCRMEIDASGRVVKHEI

SEQ ID NO: 1656474 - protein, 24 aa, Staphylococcus aureus
LVIEIKKLYPFVFNTLFEAIDKLA

SEQ ID NO: 1656475 - protein, 19 aa, Staphylococcus aureus
LVSYVPKIELHMYGFGSES

SEQ ID NO: 1656476 - protein, 22 aa, Staphylococcus aureus
LYPEIECKLLAFLEEKKVDATQ

SEQ ID NO: 1656477 - protein, 28 aa, Staphylococcus aureus
MANYRYPKGFRFYRYSSGFVPEPGDIAV

SEQ ID NO: 1656478 - protein, 19 aa, Staphylococcus aureus
MCRDIELHWGEPVESTRKL

SEQ ID NO: 1656479 - protein, 29 aa, Staphylococcus aureus
MDASEFRNYILGLIFYCFLSEKAEQEYAD

SEQ ID NO: 1656480 - protein, 23 aa, Staphylococcus aureus
MEEEMFLGLRLNEGVSSRRFKKK

SEQ ID NO: 1656481 - protein, 24 aa, Staphylococcus aureus
MESLVGAKFVKLFTDIDLNDDEVI

SEQ ID NO: 1656482 - protein, 23 aa, Staphylococcus aureus
MKEELKFNAINIIYGVNGRGKTS

SEQ ID NO: 1656483 - protein, 20 aa, Staphylococcus aureus
MLNIPPKVFEQYFPDVSKDV

SEQ ID NO: 1656484 - protein, 33 aa, Staphylococcus aureus
MMNSKLFGHVYIKDCKVRQSFELASPKHTEGLI

SEQ ID NO: 1656485 - protein, 25 aa, Staphylococcus aureus
MRTDVYDFYSLGFGEPYPISGSHGL

SEQ ID NO: 1656486 - protein, 17 aa, Staphylococcus aureus
MVFELPITATERASIKH

SEQ ID NO: 1656487 - protein, 17 aa, Staphylococcus aureus
NDNDCLKIIEKITKKER

SEQ ID NO: 1656488 - protein, 27 aa, Staphylococcus aureus
NGKRFPSKNILFWYVLFMDQSQMHDDI

SEQ ID NO: 1656489 - protein, 24 aa, Staphylococcus aureus
NISPVLWKKVKKGLSAGRVQSVAL

SEQ ID NO: 1656490 - protein, 18 aa, Staphylococcus aureus
PAAPAAVTLEGDFPETTE

SEQ ID NO: 1656491 - protein, 23 aa, Staphylococcus aureus
PEGLIPLLKIQGLGSKKIAKLYK

SEQ ID NO: 1656492 - protein, 19 aa, Staphylococcus aureus
PENQKYGAFHGKEAFKQAI

SEQ ID NO: 1656493 - protein, 23 aa, Staphylococcus aureus
PFFICQILAFLFPKFPHINLLLF

SEQ ID NO: 1656494 - protein, 18 aa, Staphylococcus aureus
PIKSFPFEVIELPEGTKY

SEQ ID NO: 1656495 - protein, 19 aa, Staphylococcus aureus
PLAGPVVACATILNSNHNY

SEQ ID NO: 1656496 - protein, 17 aa, Staphylococcus aureus
PNLYPEIECKLLAFLEE

SEQ ID NO: 1656497 - protein, 25 aa, Staphylococcus aureus
PPISVKDGGLFKVGFNTQLDEYLEA

SEQ ID NO: 1656498 - protein, 17 aa, Staphylococcus aureus
PPLNVKVATRLGHVKGY

SEQ ID NO: 1656499 - protein, 20 aa, Staphylococcus aureus
PTASEVVEWAKSNIGKRINI

SEQ ID NO: 1656500 - protein, 21 aa, Staphylococcus aureus
PYFDLKWLLNQSEYKLFYSGI

SEQ ID NO: 1656501 - protein, 17 aa, Staphylococcus aureus
QDIKLIACTMSMDVMGI

SEQ ID NO: 1656502 - protein, 17 aa, Staphylococcus aureus
QDYKLYYPREMVAKIKD

SEQ ID NO: 1656503 - protein, 20 aa, Staphylococcus aureus
QHMFCNVPIDKGIMINELSE

SEQ ID NO: 1656504 - protein, 17 aa, Staphylococcus aureus
QKLRYLYGMTERQFRNT

SEQ ID NO: 1656505 - protein, 18 aa, Staphylococcus aureus
QLERVYIASVLMLEPKLI

SEQ ID NO: 1656506 - protein, 18 aa, Staphylococcus aureus
QRLLGAKIEILPDEVLGQ

SEQ ID NO: 1656507 - protein, 17 aa, Staphylococcus aureus
QSKGIPVVNAIELENDE

SEQ ID NO: 1656508 - protein, 30 aa, Staphylococcus aureus
RATATYKFAGGKGINVSRVLKTLDVESTAL

SEQ ID NO: 1656509 - protein, 25 aa, Staphylococcus aureus
RDAKESLLKYLIRMSTRPTPFGLLS

SEQ ID NO: 1656510 - protein, 17 aa, Staphylococcus aureus
REVETPKKGFWSRLFGS

SEQ ID NO: 1656511 - protein, 20 aa, Staphylococcus aureus
RKMMGEYIIYYDGVVIGGLY

SEQ ID NO: 1656512 - protein, 17 aa, Staphylococcus aureus
RLACFDDMFAHVVLFLH

SEQ ID NO: 1656513 - protein, 21 aa, Staphylococcus aureus
RLDDLTSVGFIFPNDDKKVFL

SEQ ID NO: 1656514 - protein, 19 aa, Staphylococcus aureus
RLESFIMLELQRIKGASVK

SEQ ID NO: 1656515 - protein, 22 aa, Staphylococcus aureus
RMNEYFNWLKQNYIFKELDSST

SEQ ID NO: 1656516 - protein, 19 aa, Staphylococcus aureus
RSNSYMVMFEFKGHRIVAF

SEQ ID NO: 1656517 - protein, 19 aa, Staphylococcus aureus
RYYKSYSRGTVVYVKLGSN

SEQ ID NO: 1656518 - protein, 20 aa, Staphylococcus aureus
SCGELCACDLLAHFQFSQPT

SEQ ID NO: 1656519 - protein, 17 aa, Staphylococcus aureus
SDIVAFIFNVTFEALSS

SEQ ID NO: 1656520 - protein, 25 aa, Staphylococcus aureus
SDKDGVPFIENWIKQYGSEAWTKQF

SEQ ID NO: 1656521 - protein, 19 aa, Staphylococcus aureus
SHVLKYCQYIYVLKEGQII

SEQ ID NO: 1656522 - protein, 29 aa, Staphylococcus aureus
SICMIRTPLLSVEFFNLFLNTEQIKYSDL

SEQ ID NO: 1656523 - protein, 22 aa, Staphylococcus aureus
SKDRYKIVHLIEYGHVQKGTGK

SEQ ID NO: 1656524 - protein, 30 aa, Staphylococcus aureus
SLFAVSGGARFAGVALRFLTGPIGATITAI

SEQ ID NO: 1656525 - protein, 28 aa, Staphylococcus aureus
SLVIVIRSVFKYAFKYYDLHDISVLDKI

SEQ ID NO: 1656526 - protein, 20 aa, Staphylococcus aureus
SNKHLCEYLGYGEQKIIKLK

SEQ ID NO: 1656527 - protein, 18 aa, Staphylococcus aureus
SQEKFLQHDLLFKINGSK

SEQ ID NO: 1656528 - protein, 25 aa, Staphylococcus aureus
STYYGIALALMRISKAILNNENNVL

SEQ ID NO: 1656529 - protein, 22 aa, Staphylococcus aureus
TAIYRKHYKGSKEEALSKVDKA

SEQ ID NO: 1656530 - protein, 24 aa, Staphylococcus aureus
TAMKLRQRVWRRLAKDLMPENLHE

SEQ ID NO: 1656531 - protein, 17 aa, Staphylococcus aureus
TDKMGVIYHGNYATWFE

SEQ ID NO: 1656532 - protein, 18 aa, Staphylococcus aureus
TDPMKFLPEDGSLQLTAG

SEQ ID NO: 1656533 - protein, 17 aa, Staphylococcus aureus
TIIRLSPPLVIDKEEIH

SEQ ID NO: 1656534 - protein, 18 aa, Staphylococcus aureus
TLDGLPVVNLKSSNLKRG

SEQ ID NO: 1656535 - protein, 25 aa, Staphylococcus aureus
TLFEALRAWLYDEIVADSWLDAYQV

SEQ ID NO: 1656536 - protein, 21 aa, Staphylococcus aureus
TNKGRIKFISKTEHFKEKVMK

SEQ ID NO: 1656537 - protein, 19 aa, Staphylococcus aureus
TPVIVKFEAGWCPDCRAMD

SEQ ID NO: 1656538 - protein, 25 aa, Staphylococcus aureus
TRAFIKRGLLQFADGNGFQCGIWYE

SEQ ID NO: 1656539 - protein, 17 aa, Staphylococcus aureus
TSIGLGMYDRLAGVKKS

SEQ ID NO: 1656540 - protein, 22 aa, Staphylococcus aureus
TTLKSLTFHVACDEWFQNYIKT

SEQ ID NO: 1656541 - protein, 30 aa, Staphylococcus aureus
TVKYRGFAIRREVLEELGFDFSNSYNPNSD

SEQ ID NO: 1656542 - protein, 17 aa, Staphylococcus aureus
TWRRYFHQFPELSDKEF

SEQ ID NO: 1656543 - protein, 28 aa, Staphylococcus aureus
TWVNATMRAFKLGVILPVTKEFLNYTYS

SEQ ID NO: 1656544 - protein, 23 aa, Staphylococcus aureus
VADTKAKVLDKINAIQTQARVKP

SEQ ID NO: 1656545 - protein, 19 aa, Staphylococcus aureus
VDEILERRVAHEKKKADEY

SEQ ID NO: 1656546 - protein, 18 aa, Staphylococcus aureus
VDEPFSLVSKKCHESLAL

SEQ ID NO: 1656547 - protein, 20 aa, Staphylococcus aureus
VEAMQGYLMQSIKAELEETH

SEQ ID NO: 1656548 - protein, 28 aa, Staphylococcus aureus
VEEFFRAVVINARLTTHIDLIRGGNTHH

SEQ ID NO: 1656549 - protein, 20 aa, Staphylococcus aureus
VKAFKGIDTVVFIPSIIHPS

SEQ ID NO: 1656550 - protein, 19 aa, Staphylococcus aureus
VKFDINYSLKPLKLSNRQV

SEQ ID NO: 1656551 - protein, 21 aa, Staphylococcus aureus
VKPKANQAIDAKAQETKESID

SEQ ID NO: 1656552 - protein, 26 aa, Staphylococcus aureus
VLGPMSLFALCVIKGITIENHQHILK

SEQ ID NO: 1656553 - protein, 18 aa, Staphylococcus aureus
VSCGNQATMVDHIVPTKI

SEQ ID NO: 1656554 - protein, 24 aa, Staphylococcus aureus
VSFTRLDLAFDFEFDLNDYYALSD

SEQ ID NO: 1656555 - protein, 17 aa, Staphylococcus aureus
VTYPCAIKRYDVENNYL

SEQ ID NO: 1656556 - protein, 18 aa, Staphylococcus aureus
VYKKAFESYQRYFNQKGS

SEQ ID NO: 1656557 - protein, 18 aa, Staphylococcus aureus
WGQFACKPPMKEQEINAT

SEQ ID NO: 1656558 - protein, 20 aa, Staphylococcus aureus
WLLNQSEYKLFYSGIDNKNS

SEQ ID NO: 1656559 - protein, 18 aa, Staphylococcus aureus
WQEIESFDDDNIKGLLEV

SEQ ID NO: 1656560 - protein, 17 aa, Staphylococcus aureus
YDLFSMMDSVDKHLAVI

SEQ ID NO: 1656561 - protein, 26 aa, Staphylococcus aureus
YFNKLSVFRKLFGNLIYSNTLYENNN

SEQ ID NO: 1656562 - protein, 18 aa, Staphylococcus aureus
YLLIEFPSNEVPHYTDQL

SEQ ID NO: 1656563 - protein, 21 aa, Staphylococcus aureus
YLSMNFKDYFTSIKLVNAINL

SEQ ID NO: 1656564 - protein, 17 aa, Staphylococcus aureus
YNFAVAIDDHYMQISDV

SEQ ID NO: 1656565 - protein, 17 aa, Staphylococcus aureus
YSLDPVWNMSDLKKKLK

SEQ ID NO: 1656566 - protein, 38 aa, Staphylococcus aureus
YTDIDYPIAIVFQASCFNEFVVKGRLSNIISKLQHYSI

SEQ ID NO: 1656567 - protein, 17 aa, Staphylococcus aureus
YVDKGLIDKEEYALITG

SEQ ID NO: 1656568 - protein, 17 aa, Staphylococcus aureus
YYFHGHIVPGWQGVKKT

SEQ ID NO: 1656569 - protein, 23 aa, Staphylococcus aureus
AALARSEADWIVGINATRALTTK

SEQ ID NO: 1656570 - protein, 21 aa, Staphylococcus aureus
AARARGRYGGRPEKLNQKDLN

SEQ ID NO: 1656571 - protein, 22 aa, Staphylococcus aureus
AEGRLVLADAVFYANQYQPSVI

SEQ ID NO: 1656572 - protein, 21 aa, Staphylococcus aureus
AGLPKRPFKPFNEAHRQTLDQ

SEQ ID NO: 1656573 - protein, 34 aa, Staphylococcus aureus
AGQERLPLIHKWINGRMPLIGIGSIFTADDALDA

SEQ ID NO: 1656574 - protein, 19 aa, Staphylococcus aureus
AISCSPKLLIADEPTTALD

SEQ ID NO: 1656575 - protein, 17 aa, Staphylococcus aureus
AKEKKIDYVFADELLSH

SEQ ID NO: 1656576 - protein, 17 aa, Staphylococcus aureus
AKQAIATKANERKAAIA

SEQ ID NO: 1656577 - protein, 24 aa, Staphylococcus aureus
APLDESLYPIIRDICQEVKVHGDK

SEQ ID NO: 1656578 - protein, 24 aa, Staphylococcus aureus
ATSKRGYKMLPHFQIGMFEDQLFV

SEQ ID NO: 1656579 - protein, 18 aa, Staphylococcus aureus
AVQRLIARHEILRTQYIV

SEQ ID NO: 1656580 - protein, 17 aa, Staphylococcus aureus
AYENLLFDCLKGDATNF

SEQ ID NO: 1656581 - protein, 25 aa, Staphylococcus aureus
CAYFNKRLRTTGGRYLLKSHDIEIN

SEQ ID NO: 1656582 - protein, 17 aa, Staphylococcus aureus
CEFDFTNEGKLKVSFDY

SEQ ID NO: 1656583 - protein, 19 aa, Staphylococcus aureus
CRMLYETGSFLELREETIV

SEQ ID NO: 1656584 - protein, 17 aa, Staphylococcus aureus
DCPKIKAKPAITQMKYS

SEQ ID NO: 1656585 - protein, 21 aa, Staphylococcus aureus
DEELRGMVASMQMQVAQVNVL

SEQ ID NO: 1656586 - protein, 21 aa, Staphylococcus aureus
DEIDMVINIGALKDGRFDDVQ

SEQ ID NO: 1656587 - protein, 25 aa, Staphylococcus aureus
DELNLNESITCYGLGLTQSTGNVTD

SEQ ID NO: 1656588 - protein, 20 aa, Staphylococcus aureus
DFDGPVGIGHTRWATHGVPN

SEQ ID NO: 1656589 - protein, 18 aa, Staphylococcus aureus
DFIICTAPLTKETHHKFN

SEQ ID NO: 1656590 - protein, 26 aa, Staphylococcus aureus
DGEHLDLLSKIAITFSEEENVDRIVQ

SEQ ID NO: 1656591 - protein, 20 aa, Staphylococcus aureus
DGITKLVYIKSIQDTIEAVG

SEQ ID NO: 1656592 - protein, 19 aa, Staphylococcus aureus
DGVDLGDIGCRFYTEDENT

SEQ ID NO: 1656593 - protein, 22 aa, Staphylococcus aureus
DPRAEENIQLIIMIIEDGTYVM

SEQ ID NO: 1656594 - protein, 21 aa, Staphylococcus aureus
DRIDVRLGDGLSVIQPEDVID

SEQ ID NO: 1656595 - protein, 17 aa, Staphylococcus aureus
DRIQGFETIASQNKINY

SEQ ID NO: 1656596 - protein, 19 aa, Staphylococcus aureus
DRPLIKPVAFASEIHGESG

SEQ ID NO: 1656597 - protein, 25 aa, Staphylococcus aureus
DSEVLVCTVIGFPLGASTTATKVFE

SEQ ID NO: 1656598 - protein, 18 aa, Staphylococcus aureus
DSFRVYKNGVEISTETNI

SEQ ID NO: 1656599 - protein, 25 aa, Staphylococcus aureus
DSTETEWLPVLDFRNKSLAKGSATT

SEQ ID NO: 1656600 - protein, 23 aa, Staphylococcus aureus
EAIDLELLIAIVSVKFDINYSLK

SEQ ID NO: 1656601 - protein, 22 aa, Staphylococcus aureus
EDGLTGPIGRFFEAENVETLLT

SEQ ID NO: 1656602 - protein, 24 aa, Staphylococcus aureus
EDSSRPNVNISIVYFEDVSTETIL

SEQ ID NO: 1656603 - protein, 20 aa, Staphylococcus aureus
EDTCKFILKSVVQVEDNIER

SEQ ID NO: 1656604 - protein, 26 aa, Staphylococcus aureus
EEGLEPWTSCEFDFTRDGKLNVSFDY

SEQ ID NO: 1656605 - protein, 27 aa, Staphylococcus aureus
EENYELIPTVFAEFEIDGKITTFKKES

SEQ ID NO: 1656606 - protein, 18 aa, Staphylococcus aureus
EESYKLFSERYGKQNIAY

SEQ ID NO: 1656607 - protein, 20 aa, Staphylococcus aureus
EFDYIKSLRRLTTKDIEVGG

SEQ ID NO: 1656608 - protein, 25 aa, Staphylococcus aureus
EGEKNLIAFLFFYFELFEDEKQETI

SEQ ID NO: 1656609 - protein, 25 aa, Staphylococcus aureus
EGKLKVSFDYIDWINSEFGQIGRQN

SEQ ID NO: 1656610 - protein, 25 aa, Staphylococcus aureus
EGQEAKYSISLIIPKSDTSTIKAIE

SEQ ID NO: 1656611 - protein, 19 aa, Staphylococcus aureus
EIRLRPSYFPFTEPSVEVD

SEQ ID NO: 1656612 - protein, 29 aa, Staphylococcus aureus
EKLVVPLPLKFGDYLSASSMRSLINIAAP

SEQ ID NO: 1656613 - protein, 26 aa, Staphylococcus aureus
EPRIYSSHPNRIEWEPQFSQSTILAL

SEQ ID NO: 1656614 - protein, 23 aa, Staphylococcus aureus
ERNEPFDWLSYWTDECHYTLKHV

SEQ ID NO: 1656615 - protein, 22 aa, Staphylococcus aureus
ESREYLALGLQSIWDENKRFLN

SEQ ID NO: 1656616 - protein, 22 aa, Staphylococcus aureus
EVSDGRGIISYEMGSDGTGGKH

SEQ ID NO: 1656617 - protein, 21 aa, Staphylococcus aureus
EVSEAAVLNANYIKARLSKHF

SEQ ID NO: 1656618 - protein, 24 aa, Staphylococcus aureus
FDEANRFYVLELIKKVLKSKFNQI

SEQ ID NO: 1656619 - protein, 17 aa, Staphylococcus aureus
FDFNQPISICDVGAGAG

SEQ ID NO: 1656620 - protein, 17 aa, Staphylococcus aureus
FDKYDIKSEILKVNEHR

SEQ ID NO: 1656621 - protein, 20 aa, Staphylococcus aureus
FDLKDLHVVIGPSTSSSYEI

SEQ ID NO: 1656622 - protein, 19 aa, Staphylococcus aureus
FDNRFLFKSFILKRETGNI

SEQ ID NO: 1656623 - protein, 17 aa, Staphylococcus aureus
FFKQMLVDFMDKTNYTC

SEQ ID NO: 1656624 - protein, 20 aa, Staphylococcus aureus
FGLGNMMMRYVMKKKNVDSL

SEQ ID NO: 1656625 - protein, 17 aa, Staphylococcus aureus
FGQSSINIADWAQNNNY

SEQ ID NO: 1656626 - protein, 17 aa, Staphylococcus aureus
FKSDIFNTQNWKYDELN

SEQ ID NO: 1656627 - protein, 23 aa, Staphylococcus aureus
FKTEVQSSLPFKLTGDVSCNHAP

SEQ ID NO: 1656628 - protein, 22 aa, Staphylococcus aureus
FLFTRLNFYLIDLFRQQNQLKD

SEQ ID NO: 1656629 - protein, 22 aa, Staphylococcus aureus
FNKADYELVDFSLVEKLDWKQL

SEQ ID NO: 1656630 - protein, 20 aa, Staphylococcus aureus
FSEMGYKFELATALANLCTV

SEQ ID NO: 1656631 - protein, 20 aa, Staphylococcus aureus
FSVVEKLDWKQLNHEDLQQM

SEQ ID NO: 1656632 - protein, 28 aa, Staphylococcus aureus
FTDFPKDFKGIAGWILEVKSNTPGNTTQ

SEQ ID NO: 1656633 - protein, 17 aa, Staphylococcus aureus
FTLKRLSNYVTIKDRSY

SEQ ID NO: 1656634 - protein, 26 aa, Staphylococcus aureus
FVSEPSYRDNIDWGEINQPIDEETFL

SEQ ID NO: 1656635 - protein, 20 aa, Staphylococcus aureus
GCGKSTLGKVIIRLEDATSG

SEQ ID NO: 1656636 - protein, 17 aa, Staphylococcus aureus
GCTFCSAAGSGDFAGNR

SEQ ID NO: 1656637 - protein, 17 aa, Staphylococcus aureus
GDALKPLINEGIKLNGL

SEQ ID NO: 1656638 - protein, 35 aa, Staphylococcus aureus
GERALTAIALLFAILKVRSAPFVILDEVEAALDEA

SEQ ID NO: 1656639 - protein, 19 aa, Staphylococcus aureus
GIKLAERGHEVHFITSNIP

SEQ ID NO: 1656640 - protein, 18 aa, Staphylococcus aureus
GLHDIQVVKSKQEVADTK

SEQ ID NO: 1656641 - protein, 26 aa, Staphylococcus aureus
GRDATIDKTMRWLKISNINKLSQKQI

SEQ ID NO: 1656642 - protein, 26 aa, Staphylococcus aureus
GSKKDGYKPALEFATSTSIANALMDM

SEQ ID NO: 1656643 - protein, 24 aa, Staphylococcus aureus
GSKLGLKLNKAFKGADFKDLTEEE

SEQ ID NO: 1656644 - protein, 22 aa, Staphylococcus aureus
HSKEILKLPIRTWFDKYESEIM

SEQ ID NO: 1656645 - protein, 20 aa, Staphylococcus aureus
IAKLAHAIVMYFNNGPQTPH

SEQ ID NO: 1656646 - protein, 17 aa, Staphylococcus aureus
IARIFNETVETVFIIEE

SEQ ID NO: 1656647 - protein, 17 aa, Staphylococcus aureus
IARRIIVDIRDKQLRYQ

SEQ ID NO: 1656648 - protein, 19 aa, Staphylococcus aureus
ICRRCFRLKNYNEVQDVGL

SEQ ID NO: 1656649 - protein, 18 aa, Staphylococcus aureus
IDGNTFLCRFNVAILDDG

SEQ ID NO: 1656650 - protein, 18 aa, Staphylococcus aureus
IEQAPSLVFFSEDVHEEG

SEQ ID NO: 1656651 - protein, 19 aa, Staphylococcus aureus
IFFSTGFSDGFVRFHPNTN

SEQ ID NO: 1656652 - protein, 19 aa, Staphylococcus aureus
IHACWLANIEIAMINTRLT

SEQ ID NO: 1656653 - protein, 22 aa, Staphylococcus aureus
IHEKLYDLIMCHLQRYKNENDQ

SEQ ID NO: 1656654 - protein, 23 aa, Staphylococcus aureus
IHLPNGIKISNRFVLSPMTVNTS

SEQ ID NO: 1656655 - protein, 19 aa, Staphylococcus aureus
IIDDVVKGFLTYKIPKKVI

SEQ ID NO: 1656656 - protein, 17 aa, Staphylococcus aureus
ILFNNSLKYYMNEHPAV

SEQ ID NO: 1656657 - protein, 17 aa, Staphylococcus aureus
IMSILDIGRDNFYSRVK

SEQ ID NO: 1656658 - protein, 19 aa, Staphylococcus aureus
IPTLNLRDSKIAYVVEFFE

SEQ ID NO: 1656659 - protein, 21 aa, Staphylococcus aureus
IRTNLEIPPFIQALTSIEENM

SEQ ID NO: 1656660 - protein, 18 aa, Staphylococcus aureus
ITHEMHVIRRICDEVAVM

SEQ ID NO: 1656661 - protein, 23 aa, Staphylococcus aureus
IVEEDCYYYHSINSIRRVFEEFL

SEQ ID NO: 1656662 - protein, 20 aa, Staphylococcus aureus
IVIELTKLMRGINVEESFNH

SEQ ID NO: 1656663 - protein, 18 aa, Staphylococcus aureus
IVSVKFDINYSLKPLKLS

SEQ ID NO: 1656664 - protein, 18 aa, Staphylococcus aureus
IVVLSGGYSREKANELLK

SEQ ID NO: 1656665 - protein, 20 aa, Staphylococcus aureus
IWQRFGSYTGGLNFNGGRHY

SEQ ID NO: 1656666 - protein, 21 aa, Staphylococcus aureus
KAQKRCFVKASALHGLGLYIY

SEQ ID NO: 1656667 - protein, 23 aa, Staphylococcus aureus
KARDMLGKYYKLFTDKHDINGNV

SEQ ID NO: 1656668 - protein, 22 aa, Staphylococcus aureus
KAYNFKSVCVNPTHVKYAAERL

SEQ ID NO: 1656669 - protein, 31 aa, Staphylococcus aureus
KDTVYNVPFLWRLSSELNVAQLRQAVQRLIA

SEQ ID NO: 1656670 - protein, 23 aa, Staphylococcus aureus
KEDIKAQRIMKVVQSIADKYGVS

SEQ ID NO: 1656671 - protein, 19 aa, Staphylococcus aureus
KEGILQFWISSEDQMYGMS

SEQ ID NO: 1656672 - protein, 25 aa, Staphylococcus aureus
KETCKECLFYPYLLVQGEAGIGKSH

SEQ ID NO: 1656673 - protein, 19 aa, Staphylococcus aureus
KEVYGNKDFIVGYRLSPEE

SEQ ID NO: 1656674 - protein, 21 aa, Staphylococcus aureus
KGESKFDILLFSSIGVIDGDY

SEQ ID NO: 1656675 - protein, 25 aa, Staphylococcus aureus
KIIGLSGMCKMMFYEKNAEYMRILA

SEQ ID NO: 1656676 - protein, 17 aa, Staphylococcus aureus
KKFGKNWEDAQKAGKAV

SEQ ID NO: 1656677 - protein, 22 aa, Staphylococcus aureus
KKFPDALFIFLAPPSLEHLRER

SEQ ID NO: 1656678 - protein, 18 aa, Staphylococcus aureus
KLGSFLTIINVLSHKPYR

SEQ ID NO: 1656679 - protein, 23 aa, Staphylococcus aureus
KLKHWLPVDLYIGGVEHAVLHLL

SEQ ID NO: 1656680 - protein, 24 aa, Staphylococcus aureus
KNAEYMRILAFVIHSEFRKKGYGK

SEQ ID NO: 1656681 - protein, 19 aa, Staphylococcus aureus
KQLFMPIRVAVTGQMHGPE

SEQ ID NO: 1656682 - protein, 20 aa, Staphylococcus aureus
KRLIAFEGLSLKDFASEIEV

SEQ ID NO: 1656683 - protein, 31 aa, Staphylococcus aureus
KSKFNQIFIFTHSWNDFCDITYRLKGEDHNF

SEQ ID NO: 1656684 - protein, 26 aa, Staphylococcus aureus
KTSKKLVKFMLVFCSNSMTAEEIHLC

SEQ ID NO: 1656685 - protein, 24 aa, Staphylococcus aureus
KTTTIGKLAYRYKMEGKKVMLAAG

SEQ ID NO: 1656686 - protein, 19 aa, Staphylococcus aureus
KVGEAFDQTDVMIGNEIGK

SEQ ID NO: 1656687 - protein, 21 aa, Staphylococcus aureus
KVGFKRLYVGVFNPEATKVVK

SEQ ID NO: 1656688 - protein, 22 aa, Staphylococcus aureus
KVGPFLSCPVGYQFQPGGYCDY

SEQ ID NO: 1656689 - protein, 18 aa, Staphylococcus aureus
KVYDEYIEIISLDSFVEN

SEQ ID NO: 1656690 - protein, 17 aa, Staphylococcus aureus
KYDIDFITGHSLGGRDA

SEQ ID NO: 1656691 - protein, 18 aa, Staphylococcus aureus
LANFLYFVAQKNMGIGAG

SEQ ID NO: 1656692 - protein, 25 aa, Staphylococcus aureus
LEHISFKNVCQAVVYISGQKKGDVV

SEQ ID NO: 1656693 - protein, 24 aa, Staphylococcus aureus
LEKLQKILILKSFDFDIAKIKQYI

SEQ ID NO: 1656694 - protein, 17 aa, Staphylococcus aureus
LFSQGRLKDAKNYVLHQ

SEQ ID NO: 1656695 - protein, 17 aa, Staphylococcus aureus
LGKDRTTAIFPKLVFSI

SEQ ID NO: 1656696 - protein, 19 aa, Staphylococcus aureus
LHKANEVGYLLYRPTENTT

SEQ ID NO: 1656697 - protein, 20 aa, Staphylococcus aureus
LIARHEILRTQYIVVDDEVR

SEQ ID NO: 1656698 - protein, 23 aa, Staphylococcus aureus
LKNTRSIDANKDFNTVRYVYNRN

SEQ ID NO: 1656699 - protein, 28 aa, Staphylococcus aureus
LLKYDYRDLEIIKAVILKAKKSFNSRHE

SEQ ID NO: 1656700 - protein, 26 aa, Staphylococcus aureus
LLSEYGVWHPRAWEFAPSRVDFPTTN

SEQ ID NO: 1656701 - protein, 17 aa, Staphylococcus aureus
LNVDIKDIFIFIEEKEE

SEQ ID NO: 1656702 - protein, 20 aa, Staphylococcus aureus
LPLVKKGGQFVALKSSKGEE

SEQ ID NO: 1656703 - protein, 18 aa, Staphylococcus aureus
LQGFNTKILYHNRSRHKD

SEQ ID NO: 1656704 - protein, 18 aa, Staphylococcus aureus
LQSSRHILFAGLGSSGLS

SEQ ID NO: 1656705 - protein, 28 aa, Staphylococcus aureus
LSKLIKRIRFATGVIREIKAYKPDVIHA

SEQ ID NO: 1656706 - protein, 20 aa, Staphylococcus aureus
LSLLLRRPPGREAYPGDVFY

SEQ ID NO: 1656707 - protein, 17 aa, Staphylococcus aureus
LVKRCIDDLTPSVKTND

SEQ ID NO: 1656708 - protein, 22 aa, Staphylococcus aureus
LYEEMNHLLYCSSAGHEPGYIY

SEQ ID NO: 1656709 - protein, 23 aa, Staphylococcus aureus
MPIGKSIADFILLNGKGVVYEIK

SEQ ID NO: 1656710 - protein, 18 aa, Staphylococcus aureus
MSAFNVKYDDIFLGNEYE

SEQ ID NO: 1656711 - protein, 17 aa, Staphylococcus aureus
MTEALSLYIWGCNILNT

SEQ ID NO: 1656712 - protein, 17 aa, Staphylococcus aureus
MVIKDAELRGVASSGMI

SEQ ID NO: 1656713 - protein, 27 aa, Staphylococcus aureus
MVNHMYRLPVMYIEYSGIYGDVSKVQA

SEQ ID NO: 1656714 - protein, 24 aa, Staphylococcus aureus
NANYIKARLSKHFEIPYKQYCKHE

SEQ ID NO: 1656715 - protein, 35 aa, Staphylococcus aureus
NDTVASMIIEFAEWVNTLEFFKNWKKQPGKPLDTQ

SEQ ID NO: 1656716 - protein, 17 aa, Staphylococcus aureus
NELYNYKSFNRQVFQQV

SEQ ID NO: 1656717 - protein, 25 aa, Staphylococcus aureus
NFNGGRHYGIDFGMPSGTNVYAVKG

SEQ ID NO: 1656718 - protein, 22 aa, Staphylococcus aureus
NKDEFCPLRKITLDNKLDSQRV

SEQ ID NO: 1656719 - protein, 23 aa, Staphylococcus aureus
NKDLKLLDYRVQQILEGVLSEST

SEQ ID NO: 1656720 - protein, 17 aa, Staphylococcus aureus
NRVMLDKDLEVIPAPGH

SEQ ID NO: 1656721 - protein, 24 aa, Staphylococcus aureus
NVIVKAGAMSLVPLLKSNTPFANT

SEQ ID NO: 1656722 - protein, 24 aa, Staphylococcus aureus
NVLSHKPYRAIDVIGSAKFLMRYI

SEQ ID NO: 1656723 - protein, 21 aa, Staphylococcus aureus
PAKKFLYLVIEKLMSLITDSI

SEQ ID NO: 1656724 - protein, 28 aa, Staphylococcus aureus
PDTGFYRFWTQGIFARWTDNPNIEDLIQ

SEQ ID NO: 1656725 - protein, 20 aa, Staphylococcus aureus
PELLQSLNFNQFNLVEAQCK

SEQ ID NO: 1656726 - protein, 20 aa, Staphylococcus aureus
PHGVLFRGAAEGVIRRYLIE

SEQ ID NO: 1656727 - protein, 17 aa, Staphylococcus aureus
PKFFKQMLVDFMDKTNY

SEQ ID NO: 1656728 - protein, 28 aa, Staphylococcus aureus
PKGTLIPHRGIVRLVHRNHYVPLNEETT

SEQ ID NO: 1656729 - protein, 19 aa, Staphylococcus aureus
PLVNFELFDPSNFEEAKVA

SEQ ID NO: 1656730 - protein, 17 aa, Staphylococcus aureus
PPWFKVSPTHFVKSWLL

SEQ ID NO: 1656731 - protein, 17 aa, Staphylococcus aureus
QAHFRSVNYRQYNFVEH

SEQ ID NO: 1656732 - protein, 18 aa, Staphylococcus aureus
QALNGMRIGEMLAIKNED

SEQ ID NO: 1656733 - protein, 19 aa, Staphylococcus aureus
QDAKDCLQKGAFVSDKDGD

SEQ ID NO: 1656734 - protein, 22 aa, Staphylococcus aureus
QEVIWLYQYFSDISIAPTTYTL

SEQ ID NO: 1656735 - protein, 25 aa, Staphylococcus aureus
QFETRAGTLLRYYTGLLEHSKVQPC

SEQ ID NO: 1656736 - protein, 20 aa, Staphylococcus aureus
QFRLHSLGLMHVINYLSTSE

SEQ ID NO: 1656737 - protein, 19 aa, Staphylococcus aureus
QHALDVWLLGKLQFAEFED

SEQ ID NO: 1656738 - protein, 17 aa, Staphylococcus aureus
QKVKEGKSYPRIISELL

SEQ ID NO: 1656739 - protein, 18 aa, Staphylococcus aureus
QLMFRMGKDSNIHEKLYD

SEQ ID NO: 1656740 - protein, 18 aa, Staphylococcus aureus
QLTERISNMIGVHQVIIN

SEQ ID NO: 1656741 - protein, 19 aa, Staphylococcus aureus
QPYVKLLEILNEENKEETE

SEQ ID NO: 1656742 - protein, 21 aa, Staphylococcus aureus
QQHSYWKANFIERNIYDHSLM

SEQ ID NO: 1656743 - protein, 17 aa, Staphylococcus aureus
QRNKFISDYEIPHLYVD

SEQ ID NO: 1656744 - protein, 22 aa, Staphylococcus aureus
QTPHYISYEVAQQFMTQDIILK

SEQ ID NO: 1656745 - protein, 21 aa, Staphylococcus aureus
QTSQLRHRLMIQSIVSSELTK

SEQ ID NO: 1656746 - protein, 19 aa, Staphylococcus aureus
QVKSAILFASLFSKEATII

SEQ ID NO: 1656747 - protein, 17 aa, Staphylococcus aureus
RDFNIASSDDLLVCAHE

SEQ ID NO: 1656748 - protein, 18 aa, Staphylococcus aureus
RDLVDALLFEDIAGIVSN

SEQ ID NO: 1656749 - protein, 17 aa, Staphylococcus aureus
RHTHCSYLLAKGVSIHY

SEQ ID NO: 1656750 - protein, 19 aa, Staphylococcus aureus
RHTSEKIVTIGYAKGVSHR

SEQ ID NO: 1656751 - protein, 19 aa, Staphylococcus aureus
RIITAIGYSGCEIDPNCTY

SEQ ID NO: 1656752 - protein, 23 aa, Staphylococcus aureus
RKLDEIVLLEGFMDVIKSDTAGL

SEQ ID NO: 1656753 - protein, 22 aa, Staphylococcus aureus
RKRNYEMVKALVEFQINNGMRI

SEQ ID NO: 1656754 - protein, 24 aa, Staphylococcus aureus
RLENLDCNYRLLGSKVDPKNILSK

SEQ ID NO: 1656755 - protein, 23 aa, Staphylococcus aureus
RLFAEVYTIPGTECYGNATKSAV

SEQ ID NO: 1656756 - protein, 18 aa, Staphylococcus aureus
RLIERRLLRHFSKKGYIT

SEQ ID NO: 1656757 - protein, 18 aa, Staphylococcus aureus
RLITQLATLYGLTADGMK

SEQ ID NO: 1656758 - protein, 20 aa, Staphylococcus aureus
RNNFPSAHQFLVRNFGTGGV

SEQ ID NO: 1656759 - protein, 17 aa, Staphylococcus aureus
RRGEIDFDISEAKVLVN

SEQ ID NO: 1656760 - protein, 22 aa, Staphylococcus aureus
SFSTKQMIEFLGIESLKKHLKN

SEQ ID NO: 1656761 - protein, 24 aa, Staphylococcus aureus
SGKSTFQKQICNLISPTSGELYFK

SEQ ID NO: 1656762 - protein, 20 aa, Staphylococcus aureus
SGRNRIELIEPLDAIEFHNF

SEQ ID NO: 1656763 - protein, 30 aa, Staphylococcus aureus
SIQSLEMVKELDFDVLVPWVTIKDEPLVYF

SEQ ID NO: 1656764 - protein, 24 aa, Staphylococcus aureus
SIRRVFEEFLSFKLKNSDLAQKSN

SEQ ID NO: 1656765 - protein, 18 aa, Staphylococcus aureus
SITEGTIAEWLKNVGDSV

SEQ ID NO: 1656766 - protein, 25 aa, Staphylococcus aureus
SKDTRIVFTAHGWAFTEGVKPAKKF

SEQ ID NO: 1656767 - protein, 19 aa, Staphylococcus aureus
SKFDGIFLVATNPVDILAY

SEQ ID NO: 1656768 - protein, 28 aa, Staphylococcus aureus
SKLYDFSPWKNRSFWGVINNTLETNETI

SEQ ID NO: 1656769 - protein, 19 aa, Staphylococcus aureus
SLSSFLFTRLNFYLIDLFR

SEQ ID NO: 1656770 - protein, 18 aa, Staphylococcus aureus
SNMMFSGYVSEQCINNDE

SEQ ID NO: 1656771 - protein, 22 aa, Staphylococcus aureus
SRGMRMKIALTIALSHDVKLLI

SEQ ID NO: 1656772 - protein, 22 aa, Staphylococcus aureus
SSAIEAVIGFLYLEKREERLEA

SEQ ID NO: 1656773 - protein, 20 aa, Staphylococcus aureus
SVLTAIKIARIFNETVETVF

SEQ ID NO: 1656774 - protein, 18 aa, Staphylococcus aureus
SWDNVGLLIGDEDVEVTG

SEQ ID NO: 1656775 - protein, 18 aa, Staphylococcus aureus
TDFIEDFSVFDGQTIRIK

SEQ ID NO: 1656776 - protein, 19 aa, Staphylococcus aureus
TDIKYELLSSYSEREIQQQ

SEQ ID NO: 1656777 - protein, 22 aa, Staphylococcus aureus
TEHTLAMLLSMARNIPQAHQSL

SEQ ID NO: 1656778 - protein, 23 aa, Staphylococcus aureus
TKVNELEKQIEIFETRAKNDEKY

SEQ ID NO: 1656779 - protein, 23 aa, Staphylococcus aureus
TLNTAMKGLRDSIANEATIKAGQ

SEQ ID NO: 1656780 - protein, 18 aa, Staphylococcus aureus
TMPQIGLGTFRVENDENC

SEQ ID NO: 1656781 - protein, 17 aa, Staphylococcus aureus
TPFGLLSGINLGHFVNE

SEQ ID NO: 1656782 - protein, 25 aa, Staphylococcus aureus
TSITVDTGILCWAWFEEAYQIETFA

SEQ ID NO: 1656783 - protein, 18 aa, Staphylococcus aureus
TTKVCKGLNGEIFKVKDA

SEQ ID NO: 1656784 - protein, 21 aa, Staphylococcus aureus
VAVGYYLRYALSYRDISEILR

SEQ ID NO: 1656785 - protein, 18 aa, Staphylococcus aureus
VDNIVNWRRETLGDIDVI

SEQ ID NO: 1656786 - protein, 27 aa, Staphylococcus aureus
VECHFKRTSRKLFIEKLKSVQYDLQNI

SEQ ID NO: 1656787 - protein, 30 aa, Staphylococcus aureus
VFLANKPEIYICGGTKFLQSMIEALKSLNY

SEQ ID NO: 1656788 - protein, 19 aa, Staphylococcus aureus
VHYSHYGRMCPIETPEGPN

SEQ ID NO: 1656789 - protein, 21 aa, Staphylococcus aureus
VKGKEVGLFLTESGKIHAIHN

SEQ ID NO: 1656790 - protein, 17 aa, Staphylococcus aureus
VNISDGVPRLDALIDSH

SEQ ID NO: 1656791 - protein, 22 aa, Staphylococcus aureus
VNRVSWLEKWQCLEKKGRKEIK

SEQ ID NO: 1656792 - protein, 19 aa, Staphylococcus aureus
VPIVPELLQSLNFNQFNLV

SEQ ID NO: 1656793 - protein, 17 aa, Staphylococcus aureus
VRLFGVKLKEIIAKSNK

SEQ ID NO: 1656794 - protein, 19 aa, Staphylococcus aureus
VRQRIVADVAVDFEEVNTH

SEQ ID NO: 1656795 - protein, 23 aa, Staphylococcus aureus
VRYPEFTSSLTLVNPTSIEGELP

SEQ ID NO: 1656796 - protein, 17 aa, Staphylococcus aureus
VSTRPGHEMVSLEEEMN

SEQ ID NO: 1656797 - protein, 17 aa, Staphylococcus aureus
VTKHPKIQLNIYGHGNG

SEQ ID NO: 1656798 - protein, 17 aa, Staphylococcus aureus
VYYAGGTSNAFRHFAGS

SEQ ID NO: 1656799 - protein, 23 aa, Staphylococcus aureus
WDDGHHRYLFTGDFICFEGKRWR

SEQ ID NO: 1656800 - protein, 25 aa, Staphylococcus aureus
WETGAGTRIRFLKEIEVDRPQDTEE

SEQ ID NO: 1656801 - protein, 27 aa, Staphylococcus aureus
WKIAPALATGCSLVMKPSEITPLTTIR

SEQ ID NO: 1656802 - protein, 17 aa, Staphylococcus aureus
WLEVEILACEAWSELGH

SEQ ID NO: 1656803 - protein, 18 aa, Staphylococcus aureus
YDDIFLGNEYENFVFTND

SEQ ID NO: 1656804 - protein, 20 aa, Staphylococcus aureus
YELVDFSVVEKLDWKQLNHE

SEQ ID NO: 1656805 - protein, 20 aa, Staphylococcus aureus
YLFEIIDPYSVNQQGNDIGQ

SEQ ID NO: 1656806 - protein, 26 aa, Staphylococcus aureus
YPHQPCYEGGMCVCGTGGDKSNSFNI

SEQ ID NO: 1656807 - protein, 25 aa, Staphylococcus aureus
YSQRKIDVEPVFGFMKAILGFTRMS

SEQ ID NO: 1656808 - protein, 20 aa, Staphylococcus aureus
AIAILIRHTMSFDNAHFFAQ

SEQ ID NO: 1656809 - protein, 17 aa, Staphylococcus aureus
AISGIKWIGSKHDNPSK

SEQ ID NO: 1656810 - protein, 22 aa, Staphylococcus aureus
AITLKAAFELGERMGRRAENNR

SEQ ID NO: 1656811 - protein, 17 aa, Staphylococcus aureus
ALGFKHKGFKEGLSKDY

SEQ ID NO: 1656812 - protein, 18 aa, Staphylococcus aureus
ALGGLAVIIHEHMENSRV

SEQ ID NO: 1656813 - protein, 21 aa, Staphylococcus aureus
APHDISYEVAQQFMTQDIILK

SEQ ID NO: 1656814 - protein, 27 aa, Staphylococcus aureus
AQSGRYSYHFNKIYFLRISTLPLSLGQ

SEQ ID NO: 1656815 - protein, 19 aa, Staphylococcus aureus
AQVKSAILFASLFSNDTTV

SEQ ID NO: 1656816 - protein, 20 aa, Staphylococcus aureus
ARAYLPRILVEKLLIKIDDM

SEQ ID NO: 1656817 - protein, 22 aa, Staphylococcus aureus
ASFNAGATFGRFHHLIDTETLA

SEQ ID NO: 1656818 - protein, 24 aa, Staphylococcus aureus
ASRLANEKHIDWLVKAVIVAKRQV

SEQ ID NO: 1656819 - protein, 35 aa, Staphylococcus aureus
ATFKSRVEKSIADWDIKLERTFYVSKFDHSENELG

SEQ ID NO: 1656820 - protein, 21 aa, Staphylococcus aureus
ATGLPTHLCSVAIPHTDVEHI

SEQ ID NO: 1656821 - protein, 24 aa, Staphylococcus aureus
ATLENGKHGFAFSSGVAAISAVVM

SEQ ID NO: 1656822 - protein, 21 aa, Staphylococcus aureus
AVASIISRYAFITYMDQISKY

SEQ ID NO: 1656823 - protein, 21 aa, Staphylococcus aureus
AYRYLERYTDPLTGKYKTVSV

SEQ ID NO: 1656824 - protein, 17 aa, Staphylococcus aureus
CGEVLDIHGYTGGYNIT

SEQ ID NO: 1656825 - protein, 18 aa, Staphylococcus aureus
CGEVLDIHGYTGGYNITS

SEQ ID NO: 1656826 - protein, 18 aa, Staphylococcus aureus
CRKIFNVDGFDFQLRVKK

SEQ ID NO: 1656827 - protein, 21 aa, Staphylococcus aureus
CRMLYETGSFLELREETIVLL

SEQ ID NO: 1656828 - protein, 17 aa, Staphylococcus aureus
DCFYIRKKVFVEEQGVP

SEQ ID NO: 1656829 - protein, 17 aa, Staphylococcus aureus
DCKVVGISMSKLGLISR

SEQ ID NO: 1656830 - protein, 20 aa, Staphylococcus aureus
DEELRGMVASMQMQMTQVNM

SEQ ID NO: 1656831 - protein, 22 aa, Staphylococcus aureus
DFSEINSVLSLVNLNVDKKKKV

SEQ ID NO: 1656832 - protein, 24 aa, Staphylococcus aureus
DKGTWLIRSEMKIQLKGENLESRG

SEQ ID NO: 1656833 - protein, 18 aa, Staphylococcus aureus
DKKDRFAYEINLKDFPDI

SEQ ID NO: 1656834 - protein, 22 aa, Staphylococcus aureus
DLAFRGQELLTFIKEAAERYDF

SEQ ID NO: 1656835 - protein, 22 aa, Staphylococcus aureus
DLEPWTSCEFDFTSEGKLKVSF

SEQ ID NO: 1656836 - protein, 26 aa, Staphylococcus aureus
DLLPMNRLRFTLAHEYGHFIMGHTGV

SEQ ID NO: 1656837 - protein, 36 aa, Staphylococcus aureus
DPAMVPYAAWQKFARPRFDNMISFNSTNDLLTWLQD

SEQ ID NO: 1656838 - protein, 23 aa, Staphylococcus aureus
DRIDVRLGDGLSVIHPEDVIDNI

SEQ ID NO: 1656839 - protein, 33 aa, Staphylococcus aureus
EDIRFGIKENVDFIAASFVRRPSDVLEIREILE

SEQ ID NO: 1656840 - protein, 23 aa, Staphylococcus aureus
EEFYKVAQALLINIGTLTAENEQ

SEQ ID NO: 1656841 - protein, 18 aa, Staphylococcus aureus
EELIAYSLDPVWNMSDLK

SEQ ID NO: 1656842 - protein, 19 aa, Staphylococcus aureus
EEQMLYFGLPRINKYYTAD

SEQ ID NO: 1656843 - protein, 17 aa, Staphylococcus aureus
EETPEFLLLASGSEVSL

SEQ ID NO: 1656844 - protein, 17 aa, Staphylococcus aureus
EHFKPIQSCNHDFLILN

SEQ ID NO: 1656845 - protein, 17 aa, Staphylococcus aureus
EHFKPIQSCNHDFLIVN

SEQ ID NO: 1656846 - protein, 20 aa, Staphylococcus aureus
EKPGIVGAFCRAYTIEEAIS

SEQ ID NO: 1656847 - protein, 18 aa, Staphylococcus aureus
ELLDVGVISQEEFDKKKQ

SEQ ID NO: 1656848 - protein, 17 aa, Staphylococcus aureus
EMHVIRRICDEVAVMES

SEQ ID NO: 1656849 - protein, 19 aa, Staphylococcus aureus
ENGDLLFGTIDTWLVWKLS

SEQ ID NO: 1656850 - protein, 19 aa, Staphylococcus aureus
ENKFIKDIFIFENNRRKPI

SEQ ID NO: 1656851 - protein, 37 aa, Staphylococcus aureus
EQQFKCHIDTIIKKQVPVCCFTFGIPSEQIISRLKAA

SEQ ID NO: 1656852 - protein, 24 aa, Staphylococcus aureus
EQSPKMYGGTCINIGCIPSKTLVH

SEQ ID NO: 1656853 - protein, 25 aa, Staphylococcus aureus
ESDDRKLRESAFRNVYKAYGAHNNT

SEQ ID NO: 1656854 - protein, 27 aa, Staphylococcus aureus
FASCLLFPLHIRYKYINNFNIEQISYK

SEQ ID NO: 1656855 - protein, 26 aa, Staphylococcus aureus
FCNHERWLQRYDLISERNHFNFIRNG

SEQ ID NO: 1656856 - protein, 20 aa, Staphylococcus aureus
FDKALPVAIREARAFINTQL

SEQ ID NO: 1656857 - protein, 27 aa, Staphylococcus aureus
FDYYKNRWGLFGYCRFIPYLKKRLNNK

SEQ ID NO: 1656858 - protein, 17 aa, Staphylococcus aureus
FEKVVQYESVFDFEEMI

SEQ ID NO: 1656859 - protein, 17 aa, Staphylococcus aureus
FESKTLLCQAIMDKKVD

SEQ ID NO: 1656860 - protein, 17 aa, Staphylococcus aureus
FFKQITVTFNPWSERHW

SEQ ID NO: 1656861 - protein, 31 aa, Staphylococcus aureus
FHEFPFEKINSVSYKKGLLFGEIIIHHGSSS

SEQ ID NO: 1656862 - protein, 22 aa, Staphylococcus aureus
FKIYIKNKVRPLAVFKIEETAD

SEQ ID NO: 1656863 - protein, 18 aa, Staphylococcus aureus
FNPSQGFRAFKKAKVGDQ

SEQ ID NO: 1656864 - protein, 17 aa, Staphylococcus aureus
FPETKILILTMFDDEEY

SEQ ID NO: 1656865 - protein, 24 aa, Staphylococcus aureus
FREIKRGDLPSSFPKLDVDNRFYY

SEQ ID NO: 1656866 - protein, 27 aa, Staphylococcus aureus
FTDFPKDFKGIAGWILEVKSNTPGNTT

SEQ ID NO: 1656867 - protein, 20 aa, Staphylococcus aureus
FVAYSHRAKERFKEVTTPKF

SEQ ID NO: 1656868 - protein, 17 aa, Staphylococcus aureus
FVNEYIRTLNVTQSAIK

SEQ ID NO: 1656869 - protein, 17 aa, Staphylococcus aureus
GADIVFHPAVEDMYPGE

SEQ ID NO: 1656870 - protein, 25 aa, Staphylococcus aureus
GDFIPEPMVYKLAFKAGNAVAEKFQ

SEQ ID NO: 1656871 - protein, 17 aa, Staphylococcus aureus
GDFITKRFNIFANNDEM

SEQ ID NO: 1656872 - protein, 18 aa, Staphylococcus aureus
GEEAFLKKILGEEYTGNV

SEQ ID NO: 1656873 - protein, 21 aa, Staphylococcus aureus
GEKGDVALFFGLSGTGKTTLS

SEQ ID NO: 1656874 - protein, 19 aa, Staphylococcus aureus
GGEVKDCIDYALCVNEQGS

SEQ ID NO: 1656875 - protein, 26 aa, Staphylococcus aureus
GHEPWTSCEFDFTREGKLKVSFDYID

SEQ ID NO: 1656876 - protein, 22 aa, Staphylococcus aureus
GHGAFKIIETHALKDVQAVLGF

SEQ ID NO: 1656877 - protein, 23 aa, Staphylococcus aureus
GIAIGVSNFYYAPILKDTENEWE

SEQ ID NO: 1656878 - protein, 24 aa, Staphylococcus aureus
GKELKVAIVVSRFNDFITGRLLEG

SEQ ID NO: 1656879 - protein, 19 aa, Staphylococcus aureus
GKEVQKDIAIYAPLTGEYV

SEQ ID NO: 1656880 - protein, 25 aa, Staphylococcus aureus
GQARLTQLCTLLKNYFNSEDEEMLE

SEQ ID NO: 1656881 - protein, 19 aa, Staphylococcus aureus
GRKEIKCYLEQATDESAFV

SEQ ID NO: 1656882 - protein, 21 aa, Staphylococcus aureus
GSDKRMALVKGYVNEYKLTTV

SEQ ID NO: 1656883 - protein, 18 aa, Staphylococcus aureus
GTDLPGQIARKVDTDVLR

SEQ ID NO: 1656884 - protein, 17 aa, Staphylococcus aureus
GTSNAFRHFAGSYAVQW

SEQ ID NO: 1656885 - protein, 26 aa, Staphylococcus aureus
GVSPSEFKFGLSFLTRSIALARFPWL

SEQ ID NO: 1656886 - protein, 26 aa, Staphylococcus aureus
HDGVRFKREHLSEAASHLTLKPMPEA

SEQ ID NO: 1656887 - protein, 17 aa, Staphylococcus aureus
HFIRATLESLCYQTRDV

SEQ ID NO: 1656888 - protein, 22 aa, Staphylococcus aureus
HFKYVFEVLHDFYAENDQYNIS

SEQ ID NO: 1656889 - protein, 27 aa, Staphylococcus aureus
HFNFIRNGWCYGNTGVMTTLFLIGQAL

SEQ ID NO: 1656890 - protein, 17 aa, Staphylococcus aureus
HKPKLIVAGASAYSRTI

SEQ ID NO: 1656891 - protein, 26 aa, Staphylococcus aureus
HKYKVGELYPAEGYNNPRVELLTNQI

SEQ ID NO: 1656892 - protein, 27 aa, Staphylococcus aureus
HLKNVDGFKALRFLRPRTAGRHYIIIT

SEQ ID NO: 1656893 - protein, 20 aa, Staphylococcus aureus
HTFSRTQAFLNEFAESLSKA

SEQ ID NO: 1656894 - protein, 27 aa, Staphylococcus aureus
HYKKIDYEFLYLLSMDKLFGNKRNRLT

SEQ ID NO: 1656895 - protein, 18 aa, Staphylococcus aureus
IAELKKLEIIGSEGRGPG

SEQ ID NO: 1656896 - protein, 31 aa, Staphylococcus aureus
IANKISSMIPVEWEKVYTMAYIDDGGGEVFF

SEQ ID NO: 1656897 - protein, 17 aa, Staphylococcus aureus
IATFCYKIARNEEIQVN

SEQ ID NO: 1656898 - protein, 21 aa, Staphylococcus aureus
ICDNLLLTICHTAFEKLSIFP

SEQ ID NO: 1656899 - protein, 17 aa, Staphylococcus aureus
IDIKFSSSVFYFGVMII

SEQ ID NO: 1656900 - protein, 21 aa, Staphylococcus aureus
IDKSNVRFVIHYNMPGDLESY

SEQ ID NO: 1656901 - protein, 24 aa, Staphylococcus aureus
IDNFKHSYGTILFYEDQDVVSGLQ

SEQ ID NO: 1656902 - protein, 23 aa, Staphylococcus aureus
IDSVNELGPYIVIAPEIAIAHAR

SEQ ID NO: 1656903 - protein, 24 aa, Staphylococcus aureus
IEANANRYTFVWKKSIQNHESKMN

SEQ ID NO: 1656904 - protein, 24 aa, Staphylococcus aureus
IEKDRFSISIIFKDTYHTLVRIDI

SEQ ID NO: 1656905 - protein, 17 aa, Staphylococcus aureus
IIIKIFTEKGITSKDKL

SEQ ID NO: 1656906 - protein, 18 aa, Staphylococcus aureus
IIVERDIYKATAKTMDYK

SEQ ID NO: 1656907 - protein, 21 aa, Staphylococcus aureus
IKYEGFTGHDIQNWFMNAHIY

SEQ ID NO: 1656908 - protein, 23 aa, Staphylococcus aureus
INCRSDCALLPKSMWPKKPNKKR

SEQ ID NO: 1656909 - protein, 18 aa, Staphylococcus aureus
INFERLRNYFFIKKPKRM

SEQ ID NO: 1656910 - protein, 30 aa, Staphylococcus aureus
IRQFKSLRRFFKIYVRGIRGASELRHQLMN

SEQ ID NO: 1656911 - protein, 20 aa, Staphylococcus aureus
IVDWFLKAREKYGLEKVIAD

SEQ ID NO: 1656912 - protein, 17 aa, Staphylococcus aureus
IVTPIYKKSSYRGPEIE

SEQ ID NO: 1656913 - protein, 18 aa, Staphylococcus aureus
IYLNGVFESINLHIRLKS

SEQ ID NO: 1656914 - protein, 17 aa, Staphylococcus aureus
KALTILEAMFDDWDDLT

SEQ ID NO: 1656915 - protein, 18 aa, Staphylococcus aureus
KASGGVRNLEDFNKMVEA

SEQ ID NO: 1656916 - protein, 24 aa, Staphylococcus aureus
KDDAIKNKVSFLIDKKSGYFYIVN

SEQ ID NO: 1656917 - protein, 23 aa, Staphylococcus aureus
KDLVSKAKEKAYQDILNAQTTND

SEQ ID NO: 1656918 - protein, 19 aa, Staphylococcus aureus
KEFAIPVKFTIKVVLTDPY

SEQ ID NO: 1656919 - protein, 20 aa, Staphylococcus aureus
KFSMSKIVHHPHIQIPSDQI

SEQ ID NO: 1656920 - protein, 20 aa, Staphylococcus aureus
KGGQCVRQLLQADDVEVSDA

SEQ ID NO: 1656921 - protein, 24 aa, Staphylococcus aureus
KIFPRPIDNILPIWRAVGGPPASA

SEQ ID NO: 1656922 - protein, 20 aa, Staphylococcus aureus
KILKENHYDFVIVWGSYTGH

SEQ ID NO: 1656923 - protein, 31 aa, Staphylococcus aureus
KISDLQLIRRSVCEFIKGHSLIDTSILNKSL

SEQ ID NO: 1656924 - protein, 26 aa, Staphylococcus aureus
KKGVSWDYFDIGLFEFDSGYVEAIEA

SEQ ID NO: 1656925 - protein, 18 aa, Staphylococcus aureus
KKHKRVRLVESFLPQSKN

SEQ ID NO: 1656926 - protein, 22 aa, Staphylococcus aureus
KKHLKNSGGIALLPEFIVADEL

SEQ ID NO: 1656927 - protein, 23 aa, Staphylococcus aureus
KKIREIQKLILAYEKTEIGFGEE

SEQ ID NO: 1656928 - protein, 21 aa, Staphylococcus aureus
KLTNELKNFIEYLAKSKKYED

SEQ ID NO: 1656929 - protein, 25 aa, Staphylococcus aureus
KLYMIELLEPLPFLEKISKLTTVKS

SEQ ID NO: 1656930 - protein, 23 aa, Staphylococcus aureus
KRTLHYYDEIGLLVPNKNDKNYR

SEQ ID NO: 1656931 - protein, 18 aa, Staphylococcus aureus
KSEVLKALNLTFEDIAYQ

SEQ ID NO: 1656932 - protein, 23 aa, Staphylococcus aureus
KSKRPGLDKAIEFARSGDTIVVW

SEQ ID NO: 1656933 - protein, 32 aa, Staphylococcus aureus
KSRLPEYMIPRKFEWMEQLPLTSNGKIDRKKI

SEQ ID NO: 1656934 - protein, 21 aa, Staphylococcus aureus
KVANMPIHFFLDIVESKIETK

SEQ ID NO: 1656935 - protein, 26 aa, Staphylococcus aureus
KWFSNSYKSLKGWTGDMYSRAHDRFD

SEQ ID NO: 1656936 - protein, 27 aa, Staphylococcus aureus
KWYQIEYLKEMVTFVVVNRDKNSQNVE

SEQ ID NO: 1656937 - protein, 18 aa, Staphylococcus aureus
KYTIAKFYKLYIERSNKG

SEQ ID NO: 1656938 - protein, 19 aa, Staphylococcus aureus
KYTLITIVNYDFYQSEQGR

SEQ ID NO: 1656939 - protein, 18 aa, Staphylococcus aureus
KYVNEIIMLLRTIPTSKL

SEQ ID NO: 1656940 - protein, 18 aa, Staphylococcus aureus
LAEEKGHEIVGVIENTPK

SEQ ID NO: 1656941 - protein, 21 aa, Staphylococcus aureus
LAFKAGNAVAEKFQDWLAMEV

SEQ ID NO: 1656942 - protein, 21 aa, Staphylococcus aureus
LAGIGRYLLNRVDENEFNVKA

SEQ ID NO: 1656943 - protein, 19 aa, Staphylococcus aureus
LEKHYKNKFILNIRDYFFE

SEQ ID NO: 1656944 - protein, 20 aa, Staphylococcus aureus
LENELGVVLLFRNQKGAKAT

SEQ ID NO: 1656945 - protein, 18 aa, Staphylococcus aureus
LFCRIFKYKFGMVNKVVI

SEQ ID NO: 1656946 - protein, 17 aa, Staphylococcus aureus
LGLGCMSLGTDLKKAEQ

SEQ ID NO: 1656947 - protein, 18 aa, Staphylococcus aureus
LHRYDLYETKYWSVFDEI

SEQ ID NO: 1656948 - protein, 24 aa, Staphylococcus aureus
LINELFIKLANEFNIELFEVFPQF

SEQ ID NO: 1656949 - protein, 21 aa, Staphylococcus aureus
LKPDLILMDLLMDDMDGVEAT

SEQ ID NO: 1656950 - protein, 23 aa, Staphylococcus aureus
LKYYKERVLVPLAYINFDEYIKE

SEQ ID NO: 1656951 - protein, 18 aa, Staphylococcus aureus
LLEVYRIIGELYGKSVEH

SEQ ID NO: 1656952 - protein, 28 aa, Staphylococcus aureus
LLFGTIDTWLVWKLSGKAAHITDYSNAS

SEQ ID NO: 1656953 - protein, 21 aa, Staphylococcus aureus
LLKVINFQCYYREPLYESDVM

SEQ ID NO: 1656954 - protein, 17 aa, Staphylococcus aureus
LLYKLPDIKKWADEVEQ

SEQ ID NO: 1656955 - protein, 19 aa, Staphylococcus aureus
LQHLATKHGINFQEVAFKE

SEQ ID NO: 1656956 - protein, 23 aa, Staphylococcus aureus
LSLQAIKLTFEYLKSSVEKGDKV

SEQ ID NO: 1656957 - protein, 17 aa, Staphylococcus aureus
LSNAGAHVVDESVVVDN

SEQ ID NO: 1656958 - protein, 17 aa, Staphylococcus aureus
LYLTSHMDTVVPAINVK

SEQ ID NO: 1656959 - protein, 18 aa, Staphylococcus aureus
MDEKFCNHERWLQRYDLI

SEQ ID NO: 1656960 - protein, 18 aa, Staphylococcus aureus
MSPYMIVGMIGAIKAGCG

SEQ ID NO: 1656961 - protein, 18 aa, Staphylococcus aureus
MTFAELERTLGFSNGQIR

SEQ ID NO: 1656962 - protein, 24 aa, Staphylococcus aureus
MTQARPGNHYMLSRLKPNGQFIDR

SEQ ID NO: 1656963 - protein, 22 aa, Staphylococcus aureus
MVAKRVRGGWALLEALHAPYGM

SEQ ID NO: 1656964 - protein, 24 aa, Staphylococcus aureus
NGEVSRIYLNFSDPWPKNRHAKRR

SEQ ID NO: 1656965 - protein, 19 aa, Staphylococcus aureus
NHAMPILLVSGYDDPLGDY

SEQ ID NO: 1656966 - protein, 20 aa, Staphylococcus aureus
NKALEMLGRHHKLFTDKQEV

SEQ ID NO: 1656967 - protein, 25 aa, Staphylococcus aureus
NKVAGELLCQYYFKRFGVDTRSVRF

SEQ ID NO: 1656968 - protein, 27 aa, Staphylococcus aureus
NLDKAQLAQYCSFYSDFVKASLILERE

SEQ ID NO: 1656969 - protein, 17 aa, Staphylococcus aureus
NMGALWPTLGAIPTSSF

SEQ ID NO: 1656970 - protein, 34 aa, Staphylococcus aureus
NMKEYKDEFLAAPAEIKFLLYFAKMTKKDKNKLY

SEQ ID NO: 1656971 - protein, 38 aa, Staphylococcus aureus
NNNTYLIVCTDLRLLFLDKGMIYGLKFHEFPFEKINSV

SEQ ID NO: 1656972 - protein, 22 aa, Staphylococcus aureus
NQEGRRVFVTEVVCDSVQFLEP

SEQ ID NO: 1656973 - protein, 21 aa, Staphylococcus aureus
NQYKFPIAVIEEVLKAKEVYG

SEQ ID NO: 1656974 - protein, 18 aa, Staphylococcus aureus
NSVIATFCYKIARNEEIQ

SEQ ID NO: 1656975 - protein, 22 aa, Staphylococcus aureus
NTKKVANAFGLNEEDTNLLINA

SEQ ID NO: 1656976 - protein, 17 aa, Staphylococcus aureus
NTVKGRYVVLKKKNSLF

SEQ ID NO: 1656977 - protein, 17 aa, Staphylococcus aureus
NYFFIKKPKRMKYINKF

SEQ ID NO: 1656978 - protein, 18 aa, Staphylococcus aureus
PEDAVTYHMPTHCPSCGH

SEQ ID NO: 1656979 - protein, 31 aa, Staphylococcus aureus
PMSPLAKIFWMKHEWQDVFQRTAKFADIKTY

SEQ ID NO: 1656980 - protein, 26 aa, Staphylococcus aureus
PRIRYKNVILKPAYWKINEMVLPLPK

SEQ ID NO: 1656981 - protein, 20 aa, Staphylococcus aureus
PYKKWFERMSDYGFEENIDY

SEQ ID NO: 1656982 - protein, 29 aa, Staphylococcus aureus
QNALDFPLPKAFRDAGWFFDVLPGHYNGA

SEQ ID NO: 1656983 - protein, 24 aa, Staphylococcus aureus
QTYNFKNAIIATGSRPIEIPNFKF

SEQ ID NO: 1656984 - protein, 21 aa, Staphylococcus aureus
REKHLELIMKWCAQELKNNFQ

SEQ ID NO: 1656985 - protein, 19 aa, Staphylococcus aureus
RERPGRGYIHHIAVNTPQM

SEQ ID NO: 1656986 - protein, 23 aa, Staphylococcus aureus
RFNYCIKEKMKLSEKDRLKTYKK

SEQ ID NO: 1656987 - protein, 26 aa, Staphylococcus aureus
RHLLKVKDKLGFHVVLTGHEGLNSED

SEQ ID NO: 1656988 - protein, 22 aa, Staphylococcus aureus
RLTKDPELRSAPNGVNVGTFTL

SEQ ID NO: 1656989 - protein, 18 aa, Staphylococcus aureus
RNLSKLGVDNLFVEVIGS

SEQ ID NO: 1656990 - protein, 27 aa, Staphylococcus aureus
RQEIISFKLGIKYLLTIKRGNIEKDRF

SEQ ID NO: 1656991 - protein, 25 aa, Staphylococcus aureus
RRFPQEMAKKTVINRACKKILNSTD

SEQ ID NO: 1656992 - protein, 19 aa, Staphylococcus aureus
RSEAPFKKALLYAPLYPVE

SEQ ID NO: 1656993 - protein, 17 aa, Staphylococcus aureus
RTPRIPRSLLDEYREGL

SEQ ID NO: 1656994 - protein, 19 aa, Staphylococcus aureus
RVRLVESFLPQSKNDHVYE

SEQ ID NO: 1656995 - protein, 19 aa, Staphylococcus aureus
SEFKLQMVRLYKNGKPRNE

SEQ ID NO: 1656996 - protein, 17 aa, Staphylococcus aureus
SHFSLEHAIGMLKANDL

SEQ ID NO: 1656997 - protein, 17 aa, Staphylococcus aureus
SIFKNVFEYTRRIYKLQ

SEQ ID NO: 1656998 - protein, 18 aa, Staphylococcus aureus
SIKIARKELKNWTKTKNV

SEQ ID NO: 1656999 - protein, 17 aa, Staphylococcus aureus
SKLWRKVVNEVSQLYPE

SEQ ID NO: 1657000 - protein, 21 aa, Staphylococcus aureus
SKSLAIAVASIISRYAFITYM

SEQ ID NO: 1657001 - protein, 24 aa, Staphylococcus aureus
SKTKCTFLSEYLYPVKFREKTRIG

SEQ ID NO: 1657002 - protein, 19 aa, Staphylococcus aureus
SKVQPCCFKLYNDPFDMVY

SEQ ID NO: 1657003 - protein, 23 aa, Staphylococcus aureus
SLGMKQRLGIAMALIKKPEILVL

SEQ ID NO: 1657004 - protein, 26 aa, Staphylococcus aureus
SLNKLSFKYIDRILLNWKKNNVKTID

SEQ ID NO: 1657005 - protein, 20 aa, Staphylococcus aureus
SNTAEFGDYVSGPRVITPDV

SEQ ID NO: 1657006 - protein, 24 aa, Staphylococcus aureus
SSIEISNTFSLVGCMCQPAFEFKQ

SEQ ID NO: 1657007 - protein, 18 aa, Staphylococcus aureus
STIYRWVQEYAPILYQIW

SEQ ID NO: 1657008 - protein, 21 aa, Staphylococcus aureus
SYDPMKQFYVVSGSKHDALML

SEQ ID NO: 1657009 - protein, 17 aa, Staphylococcus aureus
SYFRSSGYDGFMQDYVV

SEQ ID NO: 1657010 - protein, 22 aa, Staphylococcus aureus
TAIYRKHYKSSKEEALSKIDKA

SEQ ID NO: 1657011 - protein, 17 aa, Staphylococcus aureus
TALDIKIIMPMFDDALP

SEQ ID NO: 1657012 - protein, 20 aa, Staphylococcus aureus
TCDEYSRILIKNDKTNTMKL

SEQ ID NO: 1657013 - protein, 18 aa, Staphylococcus aureus
TDLLKCHYCGYQETPPNQ

SEQ ID NO: 1657014 - protein, 24 aa, Staphylococcus aureus
TEKGCSYREQLEMILYKYSFSTKQ

SEQ ID NO: 1657015 - protein, 22 aa, Staphylococcus aureus
TESYPIMKYMQPVRKMIGKPTI

SEQ ID NO: 1657016 - protein, 21 aa, Staphylococcus aureus
TGKEIHFAHFFEFENHKKDAK

SEQ ID NO: 1657017 - protein, 32 aa, Staphylococcus aureus
TGYKGEMIIYFSYERMGDYFLSEYLLEKYRNV

SEQ ID NO: 1657018 - protein, 23 aa, Staphylococcus aureus
THTYLQNIINEWAKSHSIGHVQS

SEQ ID NO: 1657019 - protein, 21 aa, Staphylococcus aureus
TKKVANAFGLNEEDTNLLINA

SEQ ID NO: 1657020 - protein, 19 aa, Staphylococcus aureus
TKTGEAFSKMGRNANHFGG

SEQ ID NO: 1657021 - protein, 24 aa, Staphylococcus aureus
TLSHGIPGIILFLDAYQKVFDINT

SEQ ID NO: 1657022 - protein, 17 aa, Staphylococcus aureus
TLSSIALDAYESLNDAM

SEQ ID NO: 1657023 - protein, 18 aa, Staphylococcus aureus
TLYFKIPSIFGSEEAFHI

SEQ ID NO: 1657024 - protein, 25 aa, Staphylococcus aureus
TNFFTEVRWGDIEYLILDLPPGTGD

SEQ ID NO: 1657025 - protein, 19 aa, Staphylococcus aureus
TNTMKLFLYIIVMFSTSFN

SEQ ID NO: 1657026 - protein, 21 aa, Staphylococcus aureus
TQLKFVLIYTIHIKKLTKLSI

SEQ ID NO: 1657027 - protein, 18 aa, Staphylococcus aureus
TSHFEFTKLTLPLLKNAD

SEQ ID NO: 1657028 - protein, 18 aa, Staphylococcus aureus
TVINRACKKILNSTDDAS

SEQ ID NO: 1657029 - protein, 23 aa, Staphylococcus aureus
TVNAMKGIYLRYDENGAITSHTI

SEQ ID NO: 1657030 - protein, 24 aa, Staphylococcus aureus
VADLKVEGALAMILKDAIKPNLVQ

SEQ ID NO: 1657031 - protein, 18 aa, Staphylococcus aureus
VATLRLLEIIKKYNNHIK

SEQ ID NO: 1657032 - protein, 17 aa, Staphylococcus aureus
VDKFNWYHILRKIESYA

SEQ ID NO: 1657033 - protein, 20 aa, Staphylococcus aureus
VGNWRDKFFKEREGKYQVEV

SEQ ID NO: 1657034 - protein, 18 aa, Staphylococcus aureus
VLREPGFFRHLKVMPYAQ

SEQ ID NO: 1657035 - protein, 24 aa, Staphylococcus aureus
VMKQLFEHRGLPQLPYISFLRSEY

SEQ ID NO: 1657036 - protein, 24 aa, Staphylococcus aureus
VSGAGLSFIRHWVEDPNRIDKVDL

SEQ ID NO: 1657037 - protein, 19 aa, Staphylococcus aureus
VSRALKILAEQNVEAYQIG

SEQ ID NO: 1657038 - protein, 22 aa, Staphylococcus aureus
VSYEIIYSIALYESLKAQQDMK

SEQ ID NO: 1657039 - protein, 17 aa, Staphylococcus aureus
VTINDGIINDVFIPLKP

SEQ ID NO: 1657040 - protein, 19 aa, Staphylococcus aureus
VWPKSVTPFDLHLISINPK

SEQ ID NO: 1657041 - protein, 17 aa, Staphylococcus aureus
VYIKEPITDLSLENIQA

SEQ ID NO: 1657042 - protein, 25 aa, Staphylococcus aureus
WFSNAYKSAKGWLTDMANKSRAKWD

SEQ ID NO: 1657043 - protein, 17 aa, Staphylococcus aureus
WNIQTHIYKFNQIVTNE

SEQ ID NO: 1657044 - protein, 18 aa, Staphylococcus aureus
YADIKILYSPASDQNYRY

SEQ ID NO: 1657045 - protein, 20 aa, Staphylococcus aureus
YDLMPESGKKFYPTKYLLIY

SEQ ID NO: 1657046 - protein, 19 aa, Staphylococcus aureus
YILGVSDRIGRLFEITGLK

SEQ ID NO: 1657047 - protein, 18 aa, Staphylococcus aureus
YKLEDIFTKEEIKKYKAE

SEQ ID NO: 1657048 - protein, 18 aa, Staphylococcus aureus
YKTINRFRVNPNTDALIE

SEQ ID NO: 1657049 - protein, 17 aa, Staphylococcus aureus
YKVVMHFADKLCNKQAL

SEQ ID NO: 1657050 - protein, 24 aa, Staphylococcus aureus
YLPEMKRHADIIVVCYHGGFEKDL

SEQ ID NO: 1657051 - protein, 20 aa, Staphylococcus aureus
YLSKGSLAGVDGRLQTRSYE

SEQ ID NO: 1657052 - protein, 19 aa, Staphylococcus aureus
YLYPVKFREKTRIGRFFNI

SEQ ID NO: 1657053 - protein, 20 aa, Staphylococcus aureus
YLYRYYNKISEWLAEHPYVN

SEQ ID NO: 1657054 - protein, 18 aa, Staphylococcus aureus
YQNLKVIWNSKAHIINDR

SEQ ID NO: 1657055 - protein, 17 aa, Staphylococcus aureus
YRKIDGFAAFLNTYTDI

SEQ ID NO: 1657056 - protein, 21 aa, Staphylococcus aureus
YRLYQTVKYWPKGTVFVSVVD

SEQ ID NO: 1657057 - protein, 21 aa, Staphylococcus aureus
YRWVQEYAPILYQIWKKKNKQ

SEQ ID NO: 1657058 - protein, 18 aa, Staphylococcus aureus
AAIIFAIAKFKPFKNRIK

SEQ ID NO: 1657059 - protein, 24 aa, Staphylococcus aureus
ACTSLKIRFLNNLELIKGDVVCGL

SEQ ID NO: 1657060 - protein, 19 aa, Staphylococcus aureus
AEAIGVSQPTVSNWIQQTK

SEQ ID NO: 1657061 - protein, 25 aa, Staphylococcus aureus
AERKGNHIYNGLDMFVYQGAESFKI

SEQ ID NO: 1657062 - protein, 18 aa, Staphylococcus aureus
AERLVIHGFLDPVVRELP

SEQ ID NO: 1657063 - protein, 18 aa, Staphylococcus aureus
AFNPNVRKLYGAVKRLEK

SEQ ID NO: 1657064 - protein, 24 aa, Staphylococcus aureus
AGKTFRENQKWMTPLGRLGKPEEV

SEQ ID NO: 1657065 - protein, 19 aa, Staphylococcus aureus
ALFCRIFKYKFGMVNKVVI

SEQ ID NO: 1657066 - protein, 19 aa, Staphylococcus aureus
ALGVFKLLLIKQFKTPYSA

SEQ ID NO: 1657067 - protein, 26 aa, Staphylococcus aureus
APQPFKIMASHYMFEYIHPFYDGNGR

SEQ ID NO: 1657068 - protein, 26 aa, Staphylococcus aureus
AQSQFNLPTRYIWGIYEPQSDDQNMN

SEQ ID NO: 1657069 - protein, 25 aa, Staphylococcus aureus
ARKFKRWVTSDVLPAIRKHGIYATD

SEQ ID NO: 1657070 - protein, 17 aa, Staphylococcus aureus
ASLMIDLGVDVTVIEAG

SEQ ID NO: 1657071 - protein, 17 aa, Staphylococcus aureus
ATDKEFYIFDSLIQGRS

SEQ ID NO: 1657072 - protein, 21 aa, Staphylococcus aureus
DEIIESLDFFMKYTNIKHDNV

SEQ ID NO: 1657073 - protein, 21 aa, Staphylococcus aureus
DFKNRLDIPKSYRMTDINKNV

SEQ ID NO: 1657074 - protein, 17 aa, Staphylococcus aureus
DHYRKAYAHFIHQYMKQ

SEQ ID NO: 1657075 - protein, 24 aa, Staphylococcus aureus
DKKHLPDFILKKSFQKIKNNDFTR

SEQ ID NO: 1657076 - protein, 29 aa, Staphylococcus aureus
DLLNNFVRRVCDCRGQWTMENFIEIEIEK

SEQ ID NO: 1657077 - protein, 17 aa, Staphylococcus aureus
DTSLRILDFSFYNAGIE

SEQ ID NO: 1657078 - protein, 18 aa, Staphylococcus aureus
DVIGLPITLFKKRNSGIY

SEQ ID NO: 1657079 - protein, 18 aa, Staphylococcus aureus
DVYAELYLGRFYNQYNEL

SEQ ID NO: 1657080 - protein, 20 aa, Staphylococcus aureus
DYDCYFCIVDQHAITMPQDR

SEQ ID NO: 1657081 - protein, 27 aa, Staphylococcus aureus
DYLPEIYKAVKAEVLFNKVAMRPGSVT

SEQ ID NO: 1657082 - protein, 18 aa, Staphylococcus aureus
DYQALAILPLWHHDDTYL

SEQ ID NO: 1657083 - protein, 19 aa, Staphylococcus aureus
EAGIDRILYAADYPYIEPE

SEQ ID NO: 1657084 - protein, 34 aa, Staphylococcus aureus
EAILKGYNFISVLGWPTYYANLGYQRASMYDIYP

SEQ ID NO: 1657085 - protein, 18 aa, Staphylococcus aureus
EASYQEYLTINGDCVLHE

SEQ ID NO: 1657086 - protein, 30 aa, Staphylococcus aureus
EDIWSKLANEWNIGNSLLYNEIGFEEFYKT

SEQ ID NO: 1657087 - protein, 18 aa, Staphylococcus aureus
EEKLRYFLIEDYNQKEHS

SEQ ID NO: 1657088 - protein, 17 aa, Staphylococcus aureus
EEVEKAYQFLVNEGYES

SEQ ID NO: 1657089 - protein, 20 aa, Staphylococcus aureus
EFEVLKLHYSPWVIDIKKGS

SEQ ID NO: 1657090 - protein, 24 aa, Staphylococcus aureus
EFICPNNKRLGFKRYAYRHDKYGY

SEQ ID NO: 1657091 - protein, 18 aa, Staphylococcus aureus
EHSLKYLVLKLITENNQE

SEQ ID NO: 1657092 - protein, 24 aa, Staphylococcus aureus
EIEEFKFFVQYGNFKELENYKEDE

SEQ ID NO: 1657093 - protein, 24 aa, Staphylococcus aureus
EIGRGRGPVNHFAYLKKEGLDDEL

SEQ ID NO: 1657094 - protein, 17 aa, Staphylococcus aureus
EIYFIEPDLHFTIIDFN

SEQ ID NO: 1657095 - protein, 18 aa, Staphylococcus aureus
EKHYKNKFILNIRDYFFE

SEQ ID NO: 1657096 - protein, 18 aa, Staphylococcus aureus
EKKKKFGKNWEDAQKAGK

SEQ ID NO: 1657097 - protein, 21 aa, Staphylococcus aureus
EKPEENWLFKLDDVDKEAFLA

SEQ ID NO: 1657098 - protein, 18 aa, Staphylococcus aureus
ELGVKFADRGLLEVDKQS

SEQ ID NO: 1657099 - protein, 18 aa, Staphylococcus aureus
ELISLKKDIGYLLLDVNQ

SEQ ID NO: 1657100 - protein, 17 aa, Staphylococcus aureus
ELKDILFGPTITVKALL

SEQ ID NO: 1657101 - protein, 19 aa, Staphylococcus aureus
ELLEKGLIGDCIQPIIEPI

SEQ ID NO: 1657102 - protein, 19 aa, Staphylococcus aureus
ELYLGRFYNQYNELIVISP

SEQ ID NO: 1657103 - protein, 19 aa, Staphylococcus aureus
EQLTNYLLKYDYRDLEIIK

SEQ ID NO: 1657104 - protein, 21 aa, Staphylococcus aureus
ERAHLKFLSSLPVGGIGLDFV

SEQ ID NO: 1657105 - protein, 21 aa, Staphylococcus aureus
ERLGIEMKEVMSIGDNLNDLS

SEQ ID NO: 1657106 - protein, 24 aa, Staphylococcus aureus
ERLMSITEALALSASIARGEPQEA

SEQ ID NO: 1657107 - protein, 24 aa, Staphylococcus aureus
ESKIKTVLYGLNFSEEDFNKPIND

SEQ ID NO: 1657108 - protein, 22 aa, Staphylococcus aureus
ESLASRLLRNVNVSEYIKERLE

SEQ ID NO: 1657109 - protein, 22 aa, Staphylococcus aureus
FAATIRPQFIAYQIPIRLGSIK

SEQ ID NO: 1657110 - protein, 21 aa, Staphylococcus aureus
FDEEARIPFIKHMQNSGLFAS

SEQ ID NO: 1657111 - protein, 20 aa, Staphylococcus aureus
FDFNHGYNFELNMLIDHYKR

SEQ ID NO: 1657112 - protein, 17 aa, Staphylococcus aureus
FDHPIWQRFGSYTGGLN

SEQ ID NO: 1657113 - protein, 31 aa, Staphylococcus aureus
FEDVKDCLINFGIWDMCLWNKTDNKVELPNG

SEQ ID NO: 1657114 - protein, 24 aa, Staphylococcus aureus
FEPLYRSRIVKFITEKSELMSPPK

SEQ ID NO: 1657115 - protein, 21 aa, Staphylococcus aureus
FGDSRIVGLIGKNGVGKTTIM

SEQ ID NO: 1657116 - protein, 20 aa, Staphylococcus aureus
FGEKKRAAITHLLNQEISVD

SEQ ID NO: 1657117 - protein, 18 aa, Staphylococcus aureus
FKDVELMQSTGLKDKNNN

SEQ ID NO: 1657118 - protein, 23 aa, Staphylococcus aureus
FKEDRTVYLPKAYHPLLNRETVV

SEQ ID NO: 1657119 - protein, 19 aa, Staphylococcus aureus
FLCTAICPEIADYSIDIKD

SEQ ID NO: 1657120 - protein, 33 aa, Staphylococcus aureus
FLKGAGKSLMKLGFKGGEKFAVKTGLQKTMQQA

SEQ ID NO: 1657121 - protein, 20 aa, Staphylococcus aureus
FLSSLPVGGIGLDFVHDNGY

SEQ ID NO: 1657122 - protein, 18 aa, Staphylococcus aureus
FNRQVFQQVVDYLNMKQS

SEQ ID NO: 1657123 - protein, 20 aa, Staphylococcus aureus
FNYFTTPSFVTNIYETDELY

SEQ ID NO: 1657124 - protein, 20 aa, Staphylococcus aureus
FQFAGHFGEPMWTEHMSLDK

SEQ ID NO: 1657125 - protein, 17 aa, Staphylococcus aureus
FVDTPIIVISARTEEQT

SEQ ID NO: 1657126 - protein, 21 aa, Staphylococcus aureus
FYDKEGYRDGEFEKDDKGTWL

SEQ ID NO: 1657127 - protein, 17 aa, Staphylococcus aureus
FYRTPRIPRSLLDEYRE

SEQ ID NO: 1657128 - protein, 26 aa, Staphylococcus aureus
GASGMGRYHGKYSFDTFTHVKSYIFK

SEQ ID NO: 1657129 - protein, 20 aa, Staphylococcus aureus
GDGNLGYITAILLRKLYPEA

SEQ ID NO: 1657130 - protein, 17 aa, Staphylococcus aureus
GEVEAFFASKLPLLNFR

SEQ ID NO: 1657131 - protein, 25 aa, Staphylococcus aureus
GFATAGRLNSKWISVLYLSTKEQVS

SEQ ID NO: 1657132 - protein, 21 aa, Staphylococcus aureus
GFSPLAIAIHIVYFDEANELR

SEQ ID NO: 1657133 - protein, 17 aa, Staphylococcus aureus
GGIPGYIMIYLVPSTST

SEQ ID NO: 1657134 - protein, 26 aa, Staphylococcus aureus
GGQQQRVCIARCLAIEPEVILMDEPT

SEQ ID NO: 1657135 - protein, 20 aa, Staphylococcus aureus
GKAKLFPLSFDNYFKQDEVY

SEQ ID NO: 1657136 - protein, 17 aa, Staphylococcus aureus
GKFLSIQMYNALAYNYY

SEQ ID NO: 1657137 - protein, 18 aa, Staphylococcus aureus
GKGRHEVSDVPKLLESKN

SEQ ID NO: 1657138 - protein, 18 aa, Staphylococcus aureus
GKKAIIYFYPRYNTPTCT

SEQ ID NO: 1657139 - protein, 24 aa, Staphylococcus aureus
GKNPIKVILSKSGNIHFNQQIYQD

SEQ ID NO: 1657140 - protein, 25 aa, Staphylococcus aureus
GKRLLELYKNYKGNITRFVAENDAL

SEQ ID NO: 1657141 - protein, 19 aa, Staphylococcus aureus
GLCIPELDGKMSYTIAVTG

SEQ ID NO: 1657142 - protein, 22 aa, Staphylococcus aureus
GLCQMIKPTVIDWYIGEYNPKP

SEQ ID NO: 1657143 - protein, 17 aa, Staphylococcus aureus
GNPKKSHTWGWANATRA

SEQ ID NO: 1657144 - protein, 17 aa, Staphylococcus aureus
GQIPLNIDGHIVSADVQ

SEQ ID NO: 1657145 - protein, 18 aa, Staphylococcus aureus
GQMPNLWPRLKEIKVPTL

SEQ ID NO: 1657146 - protein, 19 aa, Staphylococcus aureus
GRIKEVYVDNLSLKDGDRN

SEQ ID NO: 1657147 - protein, 20 aa, Staphylococcus aureus
GSDKRMALVKGYINEYKLTT

SEQ ID NO: 1657148 - protein, 28 aa, Staphylococcus aureus
GSRAVKPPIIYGDVKWTAPLTVDETVYA

SEQ ID NO: 1657149 - protein, 19 aa, Staphylococcus aureus
GTLCFDGRLIDQTIIDTLL

SEQ ID NO: 1657150 - protein, 23 aa, Staphylococcus aureus
GVFGGALTYGCIGVPQAPGQIDV

SEQ ID NO: 1657151 - protein, 21 aa, Staphylococcus aureus
GYADLKILYSPASDQNYRYAN

SEQ ID NO: 1657152 - protein, 26 aa, Staphylococcus aureus
GYKIIDEFLCIDKSYSNSNFDTNSRT

SEQ ID NO: 1657153 - protein, 25 aa, Staphylococcus aureus
GYTKIATVCKFDLPKLAQMKPQDTI

SEQ ID NO: 1657154 - protein, 26 aa, Staphylococcus aureus
HAYDFPMWFIRPNFKSETAPRSVQSP

SEQ ID NO: 1657155 - protein, 19 aa, Staphylococcus aureus
HGEILKMTGHVHGLVLKHS

SEQ ID NO: 1657156 - protein, 26 aa, Staphylococcus aureus
HLMIPCKPDHPLVYWATFSNASDLLS

SEQ ID NO: 1657157 - protein, 24 aa, Staphylococcus aureus
HQVVIRCLMVYFNKVSRAEAVDLK

SEQ ID NO: 1657158 - protein, 20 aa, Staphylococcus aureus
HSLGGRDAMILGMSNDIKHI

SEQ ID NO: 1657159 - protein, 20 aa, Staphylococcus aureus
HYRKAYAHFIHQYMKQAAPF

SEQ ID NO: 1657160 - protein, 18 aa, Staphylococcus aureus
IAAKSGVDVHLMIPCKPD

SEQ ID NO: 1657161 - protein, 23 aa, Staphylococcus aureus
IDAGLPKRPFKPFNEAHRQTLDQ

SEQ ID NO: 1657162 - protein, 17 aa, Staphylococcus aureus
IDQRELAEAIGVSQPTV

SEQ ID NO: 1657163 - protein, 24 aa, Staphylococcus aureus
IEGTLTGRVKFIFQSAEELGHGAF

SEQ ID NO: 1657164 - protein, 18 aa, Staphylococcus aureus
IEKQRFVSGLEFVKRMLK

SEQ ID NO: 1657165 - protein, 17 aa, Staphylococcus aureus
IESQLHLSVVERKKEIL

SEQ ID NO: 1657166 - protein, 25 aa, Staphylococcus aureus
IFNNIKRLNIETIKQENTSFIKEDT

SEQ ID NO: 1657167 - protein, 20 aa, Staphylococcus aureus
IGGGVAINLSKLRARGEAIK

SEQ ID NO: 1657168 - protein, 17 aa, Staphylococcus aureus
IHIDDFKNRLDIPKSYR

SEQ ID NO: 1657169 - protein, 20 aa, Staphylococcus aureus
IKMSDEILQQFEAVKDDKAK

SEQ ID NO: 1657170 - protein, 27 aa, Staphylococcus aureus
INKDELRHLPSYFGLDFGYVNDPSAFI

SEQ ID NO: 1657171 - protein, 18 aa, Staphylococcus aureus
IPDASISFEVFADDLETM

SEQ ID NO: 1657172 - protein, 21 aa, Staphylococcus aureus
ISKLSGIEFEVLKLHYSPWVI

SEQ ID NO: 1657173 - protein, 21 aa, Staphylococcus aureus
ISKRIKDAFLNEDIDILHQQS

SEQ ID NO: 1657174 - protein, 22 aa, Staphylococcus aureus
ISYPTIYRYIRNGLVKVDVKRD

SEQ ID NO: 1657175 - protein, 17 aa, Staphylococcus aureus
KAKAWSEKHRFPLKHIN

SEQ ID NO: 1657176 - protein, 19 aa, Staphylococcus aureus
KAKLFPLSFDNYFKQDEVY

SEQ ID NO: 1657177 - protein, 25 aa, Staphylococcus aureus
KAQFSINLTDKWIIQIAYGKLIIMA

SEQ ID NO: 1657178 - protein, 17 aa, Staphylococcus aureus
KARIAIRGKGVMVVAPL

SEQ ID NO: 1657179 - protein, 19 aa, Staphylococcus aureus
KAYYKWRIDETYIKIKGKW

SEQ ID NO: 1657180 - protein, 20 aa, Staphylococcus aureus
KDLRVAYEHDITKSKQLTEE

SEQ ID NO: 1657181 - protein, 24 aa, Staphylococcus aureus
KDNANYFLSIGIKTVLITLGKQGT

SEQ ID NO: 1657182 - protein, 19 aa, Staphylococcus aureus
KDNSIIGFVMRPLINYDAI

SEQ ID NO: 1657183 - protein, 21 aa, Staphylococcus aureus
KDNSLDNLIIYALYDQSRDMI

SEQ ID NO: 1657184 - protein, 20 aa, Staphylococcus aureus
KEGLLTVLILDGLEDPHNLG

SEQ ID NO: 1657185 - protein, 17 aa, Staphylococcus aureus
KEKHGPDALSFISSSKA

SEQ ID NO: 1657186 - protein, 25 aa, Staphylococcus aureus
KFDRPYIVAISIMYLFEMFSISNEE

SEQ ID NO: 1657187 - protein, 20 aa, Staphylococcus aureus
KHGPDALSFISSSKATNEES

SEQ ID NO: 1657188 - protein, 19 aa, Staphylococcus aureus
KIAKKVFPELAAKGGNAKQ

SEQ ID NO: 1657189 - protein, 25 aa, Staphylococcus aureus
KIITGDWFYGMKIPSHRQLAIQYNV

SEQ ID NO: 1657190 - protein, 20 aa, Staphylococcus aureus
KISFNDIEFLPPVTPPNNVI

SEQ ID NO: 1657191 - protein, 22 aa, Staphylococcus aureus
KKDNFYIISIEIVFFHLSKNFM

SEQ ID NO: 1657192 - protein, 20 aa, Staphylococcus aureus
KKGRKIEWIEFTFDAEKRIH

SEQ ID NO: 1657193 - protein, 20 aa, Staphylococcus aureus
KKIMKNYNWEYFKSQINKKL

SEQ ID NO: 1657194 - protein, 19 aa, Staphylococcus aureus
KLKLLKHASYCLERNNNPE

SEQ ID NO: 1657195 - protein, 18 aa, Staphylococcus aureus
KLYPEAKTYVFGKTDYKL

SEQ ID NO: 1657196 - protein, 19 aa, Staphylococcus aureus
KNGQLKPGYNLQIATNSQF

SEQ ID NO: 1657197 - protein, 24 aa, Staphylococcus aureus
KNHEVHPAVKYRAVLNPKNDGMNI

SEQ ID NO: 1657198 - protein, 33 aa, Staphylococcus aureus
KNTSTLIPMCHPLPLTGIDVHFSWDETNAPLYT

SEQ ID NO: 1657199 - protein, 17 aa, Staphylococcus aureus
KQPRVKFEKVFAEHFFN

SEQ ID NO: 1657200 - protein, 19 aa, Staphylococcus aureus
KRNEVLNIVNVLKKYPLFI

SEQ ID NO: 1657201 - protein, 27 aa, Staphylococcus aureus
KVYLKREDLQWVRSFKLRGAYNAISVL

SEQ ID NO: 1657202 - protein, 25 aa, Staphylococcus aureus
KYNRLNKELTRIGTMLTDDYRQVAK

SEQ ID NO: 1657203 - protein, 18 aa, Staphylococcus aureus
KYTLITIVNYDFYQSEQG

SEQ ID NO: 1657204 - protein, 21 aa, Staphylococcus aureus
LAKRVVKEKWSVRYLENHVNE

SEQ ID NO: 1657205 - protein, 17 aa, Staphylococcus aureus
LEEIIELTKFDSSQLNQ

SEQ ID NO: 1657206 - protein, 19 aa, Staphylococcus aureus
LESRGAVIEINRNTRTAKG

SEQ ID NO: 1657207 - protein, 27 aa, Staphylococcus aureus
LFNRYWPADIHLMAKEIVRFHSIIWPI

SEQ ID NO: 1657208 - protein, 21 aa, Staphylococcus aureus
LFPNAAIIFDRFHIVQHLNRE

SEQ ID NO: 1657209 - protein, 17 aa, Staphylococcus aureus
LGGEVEAFFASKLPLLN

SEQ ID NO: 1657210 - protein, 28 aa, Staphylococcus aureus
LGYLPEALFNFIALLGWSPEGEEEIFSK

SEQ ID NO: 1657211 - protein, 23 aa, Staphylococcus aureus
LHTKDIPGSHVVIFNDAPSDTTI

SEQ ID NO: 1657212 - protein, 19 aa, Staphylococcus aureus
LIEELKAYIDSGGKISQTT

SEQ ID NO: 1657213 - protein, 17 aa, Staphylococcus aureus
LIKRLSIMHHLEIMNRY

SEQ ID NO: 1657214 - protein, 19 aa, Staphylococcus aureus
LIQLCGKSNIPIGIIPASI

SEQ ID NO: 1657215 - protein, 26 aa, Staphylococcus aureus
LKKRTHFNIAGAFNPNVRKLYGAVKR

SEQ ID NO: 1657216 - protein, 21 aa, Staphylococcus aureus
LKLKIYEQIMLKIKSEYKDTY

SEQ ID NO: 1657217 - protein, 24 aa, Staphylococcus aureus
LLHRENEAVLQYCVDHLITFIPYF

SEQ ID NO: 1657218 - protein, 25 aa, Staphylococcus aureus
LLIEVLKSKVIRHTYLDVFENEPLK

SEQ ID NO: 1657219 - protein, 23 aa, Staphylococcus aureus
LMQADVIFIGFPIFQASIPGALK

SEQ ID NO: 1657220 - protein, 27 aa, Staphylococcus aureus
LNLENALKIELEFYFTPPKSWSKKKKT

SEQ ID NO: 1657221 - protein, 27 aa, Staphylococcus aureus
LNQHMRSRLAGYKVPRMYVPVTHMPLN

SEQ ID NO: 1657222 - protein, 19 aa, Staphylococcus aureus
LNWVYKYFFEHGEPMENVM

SEQ ID NO: 1657223 - protein, 18 aa, Staphylococcus aureus
LNYTLKLFNQVFKIIKSM

SEQ ID NO: 1657224 - protein, 19 aa, Staphylococcus aureus
LQDVCALLNHRERQWLMLY

SEQ ID NO: 1657225 - protein, 27 aa, Staphylococcus aureus
LQYCVDHLITFIPYFPLASGILAGKYD

SEQ ID NO: 1657226 - protein, 19 aa, Staphylococcus aureus
LRRRAKLLETILKNTRSID

SEQ ID NO: 1657227 - protein, 17 aa, Staphylococcus aureus
LRVPNKLTIKDIDKVFQ

SEQ ID NO: 1657228 - protein, 26 aa, Staphylococcus aureus
LSAKAKGILLYFLSRPDNWQIYTSEV

SEQ ID NO: 1657229 - protein, 22 aa, Staphylococcus aureus
LSEGKYSESVVVTGNTAIDAMK

SEQ ID NO: 1657230 - protein, 18 aa, Staphylococcus aureus
LSKIGGGVAINLSKLRAR

SEQ ID NO: 1657231 - protein, 21 aa, Staphylococcus aureus
LSTLYRWNKSYKEQGLKGLIY

SEQ ID NO: 1657232 - protein, 18 aa, Staphylococcus aureus
LTEVMGLPKDFKTHPHYK

SEQ ID NO: 1657233 - protein, 20 aa, Staphylococcus aureus
LTHRDCLFIELIDDKGNAYF

SEQ ID NO: 1657234 - protein, 20 aa, Staphylococcus aureus
LTNVGFKFNRWLDLAFYELD

SEQ ID NO: 1657235 - protein, 25 aa, Staphylococcus aureus
LTTKRSRIIGSLIHMRCNRIFGIDK

SEQ ID NO: 1657236 - protein, 18 aa, Staphylococcus aureus
LVGEEIFANKCLANNDVQ

SEQ ID NO: 1657237 - protein, 28 aa, Staphylococcus aureus
LYKDREKMYYFAYEIKDGKAEINREIDP

SEQ ID NO: 1657238 - protein, 19 aa, Staphylococcus aureus
LYKSDAMSTFVIYDNTIER

SEQ ID NO: 1657239 - protein, 24 aa, Staphylococcus aureus
LYLHQRYAIDLVIKENHKTYKNQG

SEQ ID NO: 1657240 - protein, 20 aa, Staphylococcus aureus
MGAALLAFCETTLTKGIDVV

SEQ ID NO: 1657241 - protein, 22 aa, Staphylococcus aureus
MNLPELIQWAWDNPKLSGNKRF

SEQ ID NO: 1657242 - protein, 25 aa, Staphylococcus aureus
MPSGLPIHEWLMLKQFSKYKSAPSL

SEQ ID NO: 1657243 - protein, 18 aa, Staphylococcus aureus
MQLIDAIANYNAVISDEI

SEQ ID NO: 1657244 - protein, 27 aa, Staphylococcus aureus
MYSKDFLKYRFNLTFLDLSILYVISSR

SEQ ID NO: 1657245 - protein, 25 aa, Staphylococcus aureus
NAKSVWKGTSKWFSNSYKSLKDWTG

SEQ ID NO: 1657246 - protein, 24 aa, Staphylococcus aureus
NAKSVWKGTSKWFSNSYKSLKGWT

SEQ ID NO: 1657247 - protein, 26 aa, Staphylococcus aureus
NARKYSNIYLYFGLRDFLKKLMSNYS

SEQ ID NO: 1657248 - protein, 26 aa, Staphylococcus aureus
NDFAYKYRIPWIYGGVVQSTYTEAAF

SEQ ID NO: 1657249 - protein, 25 aa, Staphylococcus aureus
NDNERLKAALLYTLEEECIKQGHTY

SEQ ID NO: 1657250 - protein, 24 aa, Staphylococcus aureus
NENNKYPGLGLIKRLSIMHHLEIM

SEQ ID NO: 1657251 - protein, 23 aa, Staphylococcus aureus
NFKARIMMIFSLYKGEKKKTTKP

SEQ ID NO: 1657252 - protein, 20 aa, Staphylococcus aureus
NGNVPIFINIGEWDGGDEGL

SEQ ID NO: 1657253 - protein, 24 aa, Staphylococcus aureus
NHLRNRILLCSKLYAPKSKKEVKQ

SEQ ID NO: 1657254 - protein, 27 aa, Staphylococcus aureus
NIPLLQARSKEILAFVNESKETAIKDY

SEQ ID NO: 1657255 - protein, 19 aa, Staphylococcus aureus
NKILIGKVIDFDDKVDNFD

SEQ ID NO: 1657256 - protein, 20 aa, Staphylococcus aureus
NKILIGKVIDFDDKVDNFDG

SEQ ID NO: 1657257 - protein, 18 aa, Staphylococcus aureus
NKKIKLGSFLTIINVLSH

SEQ ID NO: 1657258 - protein, 22 aa, Staphylococcus aureus
NLMQAEALRSLKAIRDKTKDKA

SEQ ID NO: 1657259 - protein, 24 aa, Staphylococcus aureus
NPLKSSGFGDDWLQNAKLMNNDNE

SEQ ID NO: 1657260 - protein, 17 aa, Staphylococcus aureus
NQPYSKEVPPLMCASLW

SEQ ID NO: 1657261 - protein, 22 aa, Staphylococcus aureus
NSERYGAVYLVNLFSNIKTPEN

SEQ ID NO: 1657262 - protein, 17 aa, Staphylococcus aureus
NSVIATFCYKIARNEEI

SEQ ID NO: 1657263 - protein, 20 aa, Staphylococcus aureus
NTDYFCFGKDIIAPANGTVE

SEQ ID NO: 1657264 - protein, 25 aa, Staphylococcus aureus
NTLNTAMGALRTSIQNDNTTKTSQN

SEQ ID NO: 1657265 - protein, 25 aa, Staphylococcus aureus
NTLQYCGEKAFSINLVVNSKLTEEE

SEQ ID NO: 1657266 - protein, 18 aa, Staphylococcus aureus
NTQLNIWGGALASGHPYG

SEQ ID NO: 1657267 - protein, 18 aa, Staphylococcus aureus
NVDGFDFQLRVKKRAYSV

SEQ ID NO: 1657268 - protein, 18 aa, Staphylococcus aureus
PELQSILKSFGIKTTGNK

SEQ ID NO: 1657269 - protein, 22 aa, Staphylococcus aureus
PELVEGLKLVTEFIQDENATQE

SEQ ID NO: 1657270 - protein, 18 aa, Staphylococcus aureus
PGGMVVCLETSQPTLPVF

SEQ ID NO: 1657271 - protein, 21 aa, Staphylococcus aureus
PKKSHTWGWANATRAQTSSAM

SEQ ID NO: 1657272 - protein, 28 aa, Staphylococcus aureus
PLNPEVIKWVKKVYGLTVLDTWWMTETG

SEQ ID NO: 1657273 - protein, 17 aa, Staphylococcus aureus
PMYFIRLNFPDKVSVGD

SEQ ID NO: 1657274 - protein, 24 aa, Staphylococcus aureus
PQEMSIKESMVYGTAGFTAALSIF

SEQ ID NO: 1657275 - protein, 22 aa, Staphylococcus aureus
PRVKFEKVFAEHFFNLYEKTKD

SEQ ID NO: 1657276 - protein, 24 aa, Staphylococcus aureus
PSSLEQLDLLLLEIPKSRKVHSDG

SEQ ID NO: 1657277 - protein, 19 aa, Staphylococcus aureus
PTKRIDLLIEVAELVVKKD

SEQ ID NO: 1657278 - protein, 19 aa, Staphylococcus aureus
PYFHKVVLLSGALRLDTLE

SEQ ID NO: 1657279 - protein, 24 aa, Staphylococcus aureus
QNAYKQAVAKAEALLNKQSGTNEV

SEQ ID NO: 1657280 - protein, 25 aa, Staphylococcus aureus
QNDCPPCTFVKNYLNEHHIDFEERN

SEQ ID NO: 1657281 - protein, 23 aa, Staphylococcus aureus
QRELGGAVLKHFDNISVNVKRPD

SEQ ID NO: 1657282 - protein, 20 aa, Staphylococcus aureus
QTSQLRHRLMIQSIVSSELT

SEQ ID NO: 1657283 - protein, 27 aa, Staphylococcus aureus
QVFKIIKSMMKEERYHTLINHIDNHLD

SEQ ID NO: 1657284 - protein, 18 aa, Staphylococcus aureus
RENIKKWFGNAWDGVKTK

SEQ ID NO: 1657285 - protein, 17 aa, Staphylococcus aureus
RGAVIKLGQLFENIREC

SEQ ID NO: 1657286 - protein, 17 aa, Staphylococcus aureus
RGQIVGLVGANGAGKTT

SEQ ID NO: 1657287 - protein, 26 aa, Staphylococcus aureus
RGTFLMTKMMLPLMMNQGGSIVNTSS

SEQ ID NO: 1657288 - protein, 18 aa, Staphylococcus aureus
RKQFNYRGFQCPGPIVKI

SEQ ID NO: 1657289 - protein, 18 aa, Staphylococcus aureus
RPLIRATAYWAIGQILGE

SEQ ID NO: 1657290 - protein, 20 aa, Staphylococcus aureus
RQGKSYLEILEMGGGILSTV

SEQ ID NO: 1657291 - protein, 26 aa, Staphylococcus aureus
RRFTATEINLFFAMCNKLKEQDTNTL

SEQ ID NO: 1657292 - protein, 17 aa, Staphylococcus aureus
RRSGLDKELDFNLVTDD

SEQ ID NO: 1657293 - protein, 19 aa, Staphylococcus aureus
RSSIAVGILEYKGFTNIVN

SEQ ID NO: 1657294 - protein, 23 aa, Staphylococcus aureus
RTLCRQLLLDGCRVAQAEGLNFS

SEQ ID NO: 1657295 - protein, 17 aa, Staphylococcus aureus
RTSEVIGEIGYPSVILN

SEQ ID NO: 1657296 - protein, 21 aa, Staphylococcus aureus
RTSYFGYKAIQLFKNNSKNKQ

SEQ ID NO: 1657297 - protein, 19 aa, Staphylococcus aureus
RYIDGELWIYSAVLDSNKN

SEQ ID NO: 1657298 - protein, 21 aa, Staphylococcus aureus
RYPIRALMMSHMFVEVDGNVH

SEQ ID NO: 1657299 - protein, 24 aa, Staphylococcus aureus
SDFKRLNSLMIGFVIKGEAHIYDE

SEQ ID NO: 1657300 - protein, 18 aa, Staphylococcus aureus
SDLGCPYQRGSIENANGL

SEQ ID NO: 1657301 - protein, 28 aa, Staphylococcus aureus
SEKQAQAILDMRLRRLTGLERDKIEAEY

SEQ ID NO: 1657302 - protein, 17 aa, Staphylococcus aureus
SHRQLAIQYNVNRVTII

SEQ ID NO: 1657303 - protein, 19 aa, Staphylococcus aureus
SINLPDTFSPKEGKKIEIA

SEQ ID NO: 1657304 - protein, 25 aa, Staphylococcus aureus
SIRLKSKKGTLLWLMDETKTPMGAR

SEQ ID NO: 1657305 - protein, 18 aa, Staphylococcus aureus
SISNLRNAIKDNALFHNY

SEQ ID NO: 1657306 - protein, 17 aa, Staphylococcus aureus
SKGLHYQALQVLHTYAK

SEQ ID NO: 1657307 - protein, 17 aa, Staphylococcus aureus
SKQTIFNNIKRLNIETI

SEQ ID NO: 1657308 - protein, 30 aa, Staphylococcus aureus
SLFAVSGGARFAGVALKFLTGPIGATITAI

SEQ ID NO: 1657309 - protein, 25 aa, Staphylococcus aureus
SLNTAMGNLKHALAEKDNTKRSVNY

SEQ ID NO: 1657310 - protein, 29 aa, Staphylococcus aureus
SNKWKEKVHIIRWFLAYKKVPKILVDKII

SEQ ID NO: 1657311 - protein, 18 aa, Staphylococcus aureus
SQLSLISITTFFVNVDPI

SEQ ID NO: 1657312 - protein, 17 aa, Staphylococcus aureus
TALDIKVIMPMFDDALP

SEQ ID NO: 1657313 - protein, 23 aa, Staphylococcus aureus
TDDRKLRESAFRNVYKAYGAHNN

SEQ ID NO: 1657314 - protein, 26 aa, Staphylococcus aureus
TEAKRKGLEPLAIWMKARKHEVSIEE

SEQ ID NO: 1657315 - protein, 25 aa, Staphylococcus aureus
THSFRHTHCALLIEAGVHIKEIQER

SEQ ID NO: 1657316 - protein, 25 aa, Staphylococcus aureus
TIRIDGGVMAYTWPGEMLSDDSWKR

SEQ ID NO: 1657317 - protein, 18 aa, Staphylococcus aureus
TLIYVPACTIIYICEIKK

SEQ ID NO: 1657318 - protein, 20 aa, Staphylococcus aureus
TMVSPFIIDAHASLLGIGSE

SEQ ID NO: 1657319 - protein, 17 aa, Staphylococcus aureus
TRMTKLYGDDVEVLERL

SEQ ID NO: 1657320 - protein, 23 aa, Staphylococcus aureus
TSIPEDRIKMIINKVQPEFVFNT

SEQ ID NO: 1657321 - protein, 30 aa, Staphylococcus aureus
TSVKMTYKIIGDFKRKVPIDELGNKNGLEY

SEQ ID NO: 1657322 - protein, 18 aa, Staphylococcus aureus
TTLDELTPLIGKKVIVKG

SEQ ID NO: 1657323 - protein, 19 aa, Staphylococcus aureus
TTVTYLFDMCHKVRPDNPE

SEQ ID NO: 1657324 - protein, 24 aa, Staphylococcus aureus
TYDKLRFEAIFTELRNRDITFIAA

SEQ ID NO: 1657325 - protein, 17 aa, Staphylococcus aureus
TYLKVPLLIKKAEKAEC

SEQ ID NO: 1657326 - protein, 17 aa, Staphylococcus aureus
VALELIHMATLVHDDVI

SEQ ID NO: 1657327 - protein, 24 aa, Staphylococcus aureus
VDALQLRFILDWNSQAHRPQFEYD

SEQ ID NO: 1657328 - protein, 18 aa, Staphylococcus aureus
VEAAAMPMPQVQSTDNNK

SEQ ID NO: 1657329 - protein, 19 aa, Staphylococcus aureus
VFSYGIDEEAQFMAENIQE

SEQ ID NO: 1657330 - protein, 20 aa, Staphylococcus aureus
VGGIGLDFVHDNGYNLKQIE

SEQ ID NO: 1657331 - protein, 18 aa, Staphylococcus aureus
VHSDGIHFQGFRYSNTNL

SEQ ID NO: 1657332 - protein, 23 aa, Staphylococcus aureus
VIRDYPMIPGIDFAGIVESSSND

SEQ ID NO: 1657333 - protein, 21 aa, Staphylococcus aureus
VKVDGEWLYKLVSYIESIDEY

SEQ ID NO: 1657334 - protein, 23 aa, Staphylococcus aureus
VNEVLAYDVIPYIMKKLNAPFTY

SEQ ID NO: 1657335 - protein, 21 aa, Staphylococcus aureus
VPDLIRLSKTFLIESRELTTV

SEQ ID NO: 1657336 - protein, 35 aa, Staphylococcus aureus
VPDTLRVASILAHTLFDYPSHQLVTFGVTGTNGKT

SEQ ID NO: 1657337 - protein, 24 aa, Staphylococcus aureus
VRRNPYSVILFDEIEKANPQILTL

SEQ ID NO: 1657338 - protein, 25 aa, Staphylococcus aureus
VRSTMKVVLPKGWTLKNVVNHFIAW

SEQ ID NO: 1657339 - protein, 19 aa, Staphylococcus aureus
VSWLEKWQCLEKKGRKEIK

SEQ ID NO: 1657340 - protein, 18 aa, Staphylococcus aureus
VTDELKSRFEAENLIEEH

SEQ ID NO: 1657341 - protein, 19 aa, Staphylococcus aureus
VTDELKSRFEAENLIEEHQ

SEQ ID NO: 1657342 - protein, 22 aa, Staphylococcus aureus
VVFRIKHEYKELLTSAERGKIE

SEQ ID NO: 1657343 - protein, 23 aa, Staphylococcus aureus
VYPRKGYDPTDERIKALASVENK

SEQ ID NO: 1657344 - protein, 19 aa, Staphylococcus aureus
WEKVYTMAYIDDGGGEVFF

SEQ ID NO: 1657345 - protein, 24 aa, Staphylococcus aureus
WFSNAYKSAKGWLTDMANKSRSKW

SEQ ID NO: 1657346 - protein, 23 aa, Staphylococcus aureus
WILHIPSCYLGIAQAARNYAVDF

SEQ ID NO: 1657347 - protein, 20 aa, Staphylococcus aureus
WKINEMVLPLPKNEEWDQQF

SEQ ID NO: 1657348 - protein, 22 aa, Staphylococcus aureus
WNKVNPSFALKSMFGGYDELME

SEQ ID NO: 1657349 - protein, 18 aa, Staphylococcus aureus
WVDPRTKIIYMTQARPGN

SEQ ID NO: 1657350 - protein, 21 aa, Staphylococcus aureus
WVEKVGDLYVFSMTPELQDDI

SEQ ID NO: 1657351 - protein, 33 aa, Staphylococcus aureus
YDEFDGGHQWKDWKPLLSDILLYFLSKNTDDQL

SEQ ID NO: 1657352 - protein, 25 aa, Staphylococcus aureus
YDYIPRLFWPIYYFIQAPMQKMMIH

SEQ ID NO: 1657353 - protein, 19 aa, Staphylococcus aureus
YEAQVKRGAVIKLGQLFEN

SEQ ID NO: 1657354 - protein, 24 aa, Staphylococcus aureus
YFAARSLLSEAICNLDNNQIETLQ

SEQ ID NO: 1657355 - protein, 18 aa, Staphylococcus aureus
YFHKVVLLSGALRLDTLK

SEQ ID NO: 1657356 - protein, 17 aa, Staphylococcus aureus
YGTAGFTAALSIFELEK

SEQ ID NO: 1657357 - protein, 17 aa, Staphylococcus aureus
YIKPADFHVPGDISSAA

SEQ ID NO: 1657358 - protein, 20 aa, Staphylococcus aureus
YKNRSISNMVLLKTVLNHYT

SEQ ID NO: 1657359 - protein, 18 aa, Staphylococcus aureus
YLIEVLQGYSHRIYCFIR

SEQ ID NO: 1657360 - protein, 24 aa, Staphylococcus aureus
YQGKMAFRVYPKWCNQLNKTAGQT

SEQ ID NO: 1657361 - protein, 23 aa, Staphylococcus aureus
YSFINSLVWRKDGSISKHTKCYI

SEQ ID NO: 1657362 - protein, 24 aa, Staphylococcus aureus
YVMKEGLKALLMNWFNTEKINLDV

SEQ ID NO: 1657363 - protein, 23 aa, Staphylococcus aureus
YYAKERPSAFIYTGAAVENGEIY

SEQ ID NO: 1657364 - protein, 25 aa, Staphylococcus aureus
ADESKRNAYTQAVTAAEGILNKQTG

SEQ ID NO: 1657365 - protein, 33 aa, Staphylococcus aureus
AEELTRIGLDLPFPIKINQMLGHQTSFLTYEGL

SEQ ID NO: 1657366 - protein, 25 aa, Staphylococcus aureus
AEQSYRLVIPSIQFESNLKLICDTI

SEQ ID NO: 1657367 - protein, 22 aa, Staphylococcus aureus
AFDLRSKEAFHGGHMHGTINIP

SEQ ID NO: 1657368 - protein, 24 aa, Staphylococcus aureus
AFDRIDVEGPFYIKNDITNTITRV

SEQ ID NO: 1657369 - protein, 23 aa, Staphylococcus aureus
AFLEDLNQPFIYIGKDTVKLQDE

SEQ ID NO: 1657370 - protein, 26 aa, Staphylococcus aureus
AGKSTLLSAICRLIRFENGEVKIDGQ

SEQ ID NO: 1657371 - protein, 19 aa, Staphylococcus aureus
AGYACGYHLVKYFLQKTNI

SEQ ID NO: 1657372 - protein, 18 aa, Staphylococcus aureus
AIQLALNVVEPFASGIGG

SEQ ID NO: 1657373 - protein, 24 aa, Staphylococcus aureus
AKNKELKGIYGAVAEIIDVPSKLT

SEQ ID NO: 1657374 - protein, 18 aa, Staphylococcus aureus
AKPGICIIGEVVDYTENT

SEQ ID NO: 1657375 - protein, 22 aa, Staphylococcus aureus
AKPSGIGKFKGIRSEATKEDKY

SEQ ID NO: 1657376 - protein, 20 aa, Staphylococcus aureus
AKVTFAFDRKAEKFSEDSED

SEQ ID NO: 1657377 - protein, 25 aa, Staphylococcus aureus
ALEIIPGKMSLVIADIMDETTTKDK

SEQ ID NO: 1657378 - protein, 27 aa, Staphylococcus aureus
ALELKEVPQRLAVIGSGYIAAELGQMF

SEQ ID NO: 1657379 - protein, 19 aa, Staphylococcus aureus
ALNGDEKLAAAKQTAKSDI

SEQ ID NO: 1657380 - protein, 21 aa, Staphylococcus aureus
ALQDWKYPRRILWLRKVQSTI

SEQ ID NO: 1657381 - protein, 23 aa, Staphylococcus aureus
AMTQLKQGIANKAQIKGSENYHD

SEQ ID NO: 1657382 - protein, 25 aa, Staphylococcus aureus
ANEISGMIPVEWEKVYTIAYVDDEG

SEQ ID NO: 1657383 - protein, 17 aa, Staphylococcus aureus
ANFIERNIYDHSLMVSS

SEQ ID NO: 1657384 - protein, 26 aa, Staphylococcus aureus
AQALLKKDEFVGIAIPTIVKDKVSVA

SEQ ID NO: 1657385 - protein, 26 aa, Staphylococcus aureus
AQALNEAMKALKESIKDQPQTEASSK

SEQ ID NO: 1657386 - protein, 18 aa, Staphylococcus aureus
AQGILPKHIEALIESHKD

SEQ ID NO: 1657387 - protein, 18 aa, Staphylococcus aureus
AQHALNLLGLATLSLLDT

SEQ ID NO: 1657388 - protein, 23 aa, Staphylococcus aureus
AQSGRYSYHFNKIYFFENINFTI

SEQ ID NO: 1657389 - protein, 18 aa, Staphylococcus aureus
ARNHLRLWSLQGHRDIPN

SEQ ID NO: 1657390 - protein, 19 aa, Staphylococcus aureus
ASIIDGCRLSKAKIIRVNH

SEQ ID NO: 1657391 - protein, 26 aa, Staphylococcus aureus
AVDKVTHLRALLQLRDVAQNNDAIKR

SEQ ID NO: 1657392 - protein, 19 aa, Staphylococcus aureus
AVFFAKAKPSLQIINVARG

SEQ ID NO: 1657393 - protein, 17 aa, Staphylococcus aureus
AVQTGGQLRIWLYERNK

SEQ ID NO: 1657394 - protein, 17 aa, Staphylococcus aureus
AWLDDEIVADSWLDAYQ

SEQ ID NO: 1657395 - protein, 37 aa, Staphylococcus aureus
AYENPRFVEDLIRLIAADLVEFDWLEGFDIECRNEES

SEQ ID NO: 1657396 - protein, 24 aa, Staphylococcus aureus
CFEGKRWRTVILGSSDREKSIQSL

SEQ ID NO: 1657397 - protein, 19 aa, Staphylococcus aureus
CGGVSKLIQSGFETLVEAG

SEQ ID NO: 1657398 - protein, 17 aa, Staphylococcus aureus
CLVTPGLTGLAQIQGGY

SEQ ID NO: 1657399 - protein, 19 aa, Staphylococcus aureus
CNNSSKYKGVSWDKKNNNW

SEQ ID NO: 1657400 - protein, 37 aa, Staphylococcus aureus
CTKAEFIKRLACLPSHIYRLKGFMTFEDTAHTYLIQF

SEQ ID NO: 1657401 - protein, 21 aa, Staphylococcus aureus
DEFNGNVPIIGMKLKLMALEN

SEQ ID NO: 1657402 - protein, 18 aa, Staphylococcus aureus
DEILKSSPFVWFKDALDG

SEQ ID NO: 1657403 - protein, 21 aa, Staphylococcus aureus
DELIQKLMLIMPEGPALTLNP

SEQ ID NO: 1657404 - protein, 22 aa, Staphylococcus aureus
DENRAKITYALCQDEELCVCDI

SEQ ID NO: 1657405 - protein, 19 aa, Staphylococcus aureus
DFLVRRSGKMYFNIKDVLD

SEQ ID NO: 1657406 - protein, 22 aa, Staphylococcus aureus
DGHLLIQWYSKGIYKFKYAILE

SEQ ID NO: 1657407 - protein, 17 aa, Staphylococcus aureus
DGKLKVAHVNYGSDFTI

SEQ ID NO: 1657408 - protein, 19 aa, Staphylococcus aureus
DHKTRMALHPLKEFAKSKL

SEQ ID NO: 1657409 - protein, 27 aa, Staphylococcus aureus
DKAKRDAYTNAVSRAETILNKTQGANT

SEQ ID NO: 1657410 - protein, 21 aa, Staphylococcus aureus
DKVLEVCRDFYQNQRIYTKIK

SEQ ID NO: 1657411 - protein, 21 aa, Staphylococcus aureus
DLRFISKFKYSYDVQKKENLV

SEQ ID NO: 1657412 - protein, 25 aa, Staphylococcus aureus
DNLPKEWFEAAGAPTVEYEKFGEKV

SEQ ID NO: 1657413 - protein, 23 aa, Staphylococcus aureus
DQNTIKQGVNFTDADEAKRNAYT

SEQ ID NO: 1657414 - protein, 22 aa, Staphylococcus aureus
DRFKQEVFKYVWHPTNGEPIKE

SEQ ID NO: 1657415 - protein, 25 aa, Staphylococcus aureus
DSDLKRFKGAHGLLYEQELGLQATI

SEQ ID NO: 1657416 - protein, 19 aa, Staphylococcus aureus
DSPEFFKQITVTFNPWSER

SEQ ID NO: 1657417 - protein, 17 aa, Staphylococcus aureus
DTKVLRETYDTFKAGEN

SEQ ID NO: 1657418 - protein, 22 aa, Staphylococcus aureus
DTRVGYLHGVPVTYDLDENAEK

SEQ ID NO: 1657419 - protein, 23 aa, Staphylococcus aureus
DTYCGIGTIGLYMAPLAKHVYGV

SEQ ID NO: 1657420 - protein, 24 aa, Staphylococcus aureus
DYETFKIALFDPAVKKYAFNANFE

SEQ ID NO: 1657421 - protein, 18 aa, Staphylococcus aureus
DYISGVLNRYKRAKFHPF

SEQ ID NO: 1657422 - protein, 40 aa, Staphylococcus aureus
EAGRSDYFWDLFIQMPAALMFPSGNKFYDWIYSTDEEPHM

SEQ ID NO: 1657423 - protein, 23 aa, Staphylococcus aureus
EAYCLDCKFLSAHFNLMEQLYCQ

SEQ ID NO: 1657424 - protein, 25 aa, Staphylococcus aureus
ECVSRFRSGSAINGFNLSDGRSKGA

SEQ ID NO: 1657425 - protein, 21 aa, Staphylococcus aureus
EEFRPRIKAQIGGRRNGALIS

SEQ ID NO: 1657426 - protein, 21 aa, Staphylococcus aureus
EGSYKWGVTTSLSYFPKDNSE

SEQ ID NO: 1657427 - protein, 18 aa, Staphylococcus aureus
EHGLKAFLSEYAKVDDGL

SEQ ID NO: 1657428 - protein, 20 aa, Staphylococcus aureus
EIIESLDFFMKYTNIKHDNV

SEQ ID NO: 1657429 - protein, 20 aa, Staphylococcus aureus
EINLTRLSIFIFIINILNQL

SEQ ID NO: 1657430 - protein, 27 aa, Staphylococcus aureus
EIREPCWKIQAKYNIPDLVKRMSTSGK

SEQ ID NO: 1657431 - protein, 18 aa, Staphylococcus aureus
ELGRYLFKNTDLMRDSND

SEQ ID NO: 1657432 - protein, 30 aa, Staphylococcus aureus
ELKQFIKSYVQSHSFIKSLVLGISGGQDST

SEQ ID NO: 1657433 - protein, 20 aa, Staphylococcus aureus
ELLRQKVDFDYDIKTVFKEN

SEQ ID NO: 1657434 - protein, 22 aa, Staphylococcus aureus
EMRVIKDICNRVAVMEKGKVVE

SEQ ID NO: 1657435 - protein, 17 aa, Staphylococcus aureus
ENLKVVLEEAGSDLNSV

SEQ ID NO: 1657436 - protein, 22 aa, Staphylococcus aureus
ENTLIYDFLDTVEFRKKKTIID

SEQ ID NO: 1657437 - protein, 26 aa, Staphylococcus aureus
EPVFSRIDSCIKFLYLTQEEKQKVIE

SEQ ID NO: 1657438 - protein, 23 aa, Staphylococcus aureus
EQFGLSVMVAFGYRQQEPPKNKT

SEQ ID NO: 1657439 - protein, 23 aa, Staphylococcus aureus
EQGKRKANEIGTLMHTVMQHLPF

SEQ ID NO: 1657440 - protein, 17 aa, Staphylococcus aureus
EQKRLETIEGIVPSIQA

SEQ ID NO: 1657441 - protein, 24 aa, Staphylococcus aureus
ERDMFALRATMHIAYMNVKPEAFA

SEQ ID NO: 1657442 - protein, 21 aa, Staphylococcus aureus
ESLFVKVGMELFYQEGPQLIN

SEQ ID NO: 1657443 - protein, 23 aa, Staphylococcus aureus
ETAEKYMIFLTWIFSATNNKLRD

SEQ ID NO: 1657444 - protein, 26 aa, Staphylococcus aureus
ETGVTFAFQGCEHINRAITIEKSQYN

SEQ ID NO: 1657445 - protein, 25 aa, Staphylococcus aureus
EYITHRGSASFLVLPGVSKGGYLGE

SEQ ID NO: 1657446 - protein, 17 aa, Staphylococcus aureus
EYLAQGLQSIWDENKRF

SEQ ID NO: 1657447 - protein, 21 aa, Staphylococcus aureus
FDDFWKQRQVPLSQIKTPLLT

SEQ ID NO: 1657448 - protein, 23 aa, Staphylococcus aureus
FDDLWMNLYYLFKNLRNLFKTEE

SEQ ID NO: 1657449 - protein, 20 aa, Staphylococcus aureus
FDFRLRVKKRAYSVEIVVLD

SEQ ID NO: 1657450 - protein, 17 aa, Staphylococcus aureus
FDHMWGYLKKCANEEER

SEQ ID NO: 1657451 - protein, 19 aa, Staphylococcus aureus
FDKVLPIYYNVFYQMFDEG

SEQ ID NO: 1657452 - protein, 30 aa, Staphylococcus aureus
FDQGEAVSMEWLFRPLLKMLAEGDPVPVED

SEQ ID NO: 1657453 - protein, 19 aa, Staphylococcus aureus
FEEKLRYFLIEDYNQKEHS

SEQ ID NO: 1657454 - protein, 17 aa, Staphylococcus aureus
FFAKAKPSLQIINVARG

SEQ ID NO: 1657455 - protein, 25 aa, Staphylococcus aureus
FGSGSRAPIAISILVKDGSYNHDIY

SEQ ID NO: 1657456 - protein, 17 aa, Staphylococcus aureus
FHKVVLLSGALRLDTLK

SEQ ID NO: 1657457 - protein, 25 aa, Staphylococcus aureus
FIGPNCGFYTATHPLNFYHRNEGYE

SEQ ID NO: 1657458 - protein, 18 aa, Staphylococcus aureus
FKAGEAINTVPSNGYLEG

SEQ ID NO: 1657459 - protein, 22 aa, Staphylococcus aureus
FKEIPLVDYIFCTYNTDLYYNT

SEQ ID NO: 1657460 - protein, 17 aa, Staphylococcus aureus
FKPIIIELGSIFNNLTI

SEQ ID NO: 1657461 - protein, 19 aa, Staphylococcus aureus
FLEAAGLYDAHLQDCPSKP

SEQ ID NO: 1657462 - protein, 18 aa, Staphylococcus aureus
FLFPRELLVEKGILASSK

SEQ ID NO: 1657463 - protein, 23 aa, Staphylococcus aureus
FNEVKPLIAEAFYKAFDQAVIFG

SEQ ID NO: 1657464 - protein, 21 aa, Staphylococcus aureus
FPESFSTQIAHYYKNQSTITW

SEQ ID NO: 1657465 - protein, 21 aa, Staphylococcus aureus
FRKEGKLALYSLGDEHIRQIM

SEQ ID NO: 1657466 - protein, 17 aa, Staphylococcus aureus
FRSMGGLFDEISKDGLS

SEQ ID NO: 1657467 - protein, 17 aa, Staphylococcus aureus
FSMLCQALTAFKKQHDV

SEQ ID NO: 1657468 - protein, 17 aa, Staphylococcus aureus
FYKSKTWQNMRRIVLLE

SEQ ID NO: 1657469 - protein, 18 aa, Staphylococcus aureus
GADGLIFHPYLAGERAPL

SEQ ID NO: 1657470 - protein, 28 aa, Staphylococcus aureus
GANTILPGIQFIQGFEVIIHPSCEHAIE

SEQ ID NO: 1657471 - protein, 24 aa, Staphylococcus aureus
GDGPQQREIVFPISTDNASWGGTT

SEQ ID NO: 1657472 - protein, 18 aa, Staphylococcus aureus
GDSIRLGDTNLFAQIEKD

SEQ ID NO: 1657473 - protein, 21 aa, Staphylococcus aureus
GEMICGFADMDIYNLINNKYL

SEQ ID NO: 1657474 - protein, 17 aa, Staphylococcus aureus
GETLWNMEQLGIDLTSN

SEQ ID NO: 1657475 - protein, 27 aa, Staphylococcus aureus
GFGNYELRLPLVSLEDTDTKVLRETYD

SEQ ID NO: 1657476 - protein, 25 aa, Staphylococcus aureus
GFYPKFKQGEIVFVDFGINVNKEFS

SEQ ID NO: 1657477 - protein, 18 aa, Staphylococcus aureus
GGSLIELIIAEGLAENYV

SEQ ID NO: 1657478 - protein, 20 aa, Staphylococcus aureus
GHPGLPMGAAPMAYTLWTRH

SEQ ID NO: 1657479 - protein, 21 aa, Staphylococcus aureus
GHVVFDFKAPIATSASIWETI

SEQ ID NO: 1657480 - protein, 18 aa, Staphylococcus aureus
GIDLKKANAALLIYYGVP

SEQ ID NO: 1657481 - protein, 35 aa, Staphylococcus aureus
GKERMPIEVVYGFAQLKRAAAIANFDLGKLSEAKK

SEQ ID NO: 1657482 - protein, 18 aa, Staphylococcus aureus
GKEVQKDIAIYAPLTGEF

SEQ ID NO: 1657483 - protein, 21 aa, Staphylococcus aureus
GKIAISFREDDELIAVRLTSG

SEQ ID NO: 1657484 - protein, 19 aa, Staphylococcus aureus
GKKLLKAVVEHARENNLKI

SEQ ID NO: 1657485 - protein, 25 aa, Staphylococcus aureus
GKRISNAFLKIVIRDVAKRTAAKQT

SEQ ID NO: 1657486 - protein, 28 aa, Staphylococcus aureus
GLAKRKIDLRFVPGVTFTNPSIATVGLT

SEQ ID NO: 1657487 - protein, 17 aa, Staphylococcus aureus
GNLTNPYNGRWHMRNIK

SEQ ID NO: 1657488 - protein, 25 aa, Staphylococcus aureus
GNTKLKLNGYFIASIISPLNLNKLN

SEQ ID NO: 1657489 - protein, 17 aa, Staphylococcus aureus
GQKRRLSVATALSSKAD

SEQ ID NO: 1657490 - protein, 19 aa, Staphylococcus aureus
GRNRIELIEPLDALEFHNF

SEQ ID NO: 1657491 - protein, 19 aa, Staphylococcus aureus
GRQHKGLGWVLTYDKAQQI

SEQ ID NO: 1657492 - protein, 28 aa, Staphylococcus aureus
GTGAYGDFGRYVFGYAVRNWVKGFKSDQ

SEQ ID NO: 1657493 - protein, 25 aa, Staphylococcus aureus
GTGSFGNAVMKWFLDSNIKEIRIFS

SEQ ID NO: 1657494 - protein, 25 aa, Staphylococcus aureus
GTTDMKGGLMALVVSLIELKEQNEL

SEQ ID NO: 1657495 - protein, 17 aa, Staphylococcus aureus
GVDLGPTAIRYAGLIPR

SEQ ID NO: 1657496 - protein, 24 aa, Staphylococcus aureus
HGELMIKGANVMNVYLYPTDLTGT

SEQ ID NO: 1657497 - protein, 24 aa, Staphylococcus aureus
HGLMIQRFGMTYVLTTKKEAATYI

SEQ ID NO: 1657498 - protein, 17 aa, Staphylococcus aureus
HLIDYFILPLRQIEQVS

SEQ ID NO: 1657499 - protein, 21 aa, Staphylococcus aureus
HLKSDVQALFAGRFYLRELAT

SEQ ID NO: 1657500 - protein, 18 aa, Staphylococcus aureus
HRAKEHFKEVTTPKFYLD

SEQ ID NO: 1657501 - protein, 24 aa, Staphylococcus aureus
HSDAPIAFQEFMILPVGATTFKES

SEQ ID NO: 1657502 - protein, 26 aa, Staphylococcus aureus
HTRSSIGGFKGRKLLADDVITVKINN

SEQ ID NO: 1657503 - protein, 22 aa, Staphylococcus aureus
HWYNLEKEWQEFLNSGKEVKNI

SEQ ID NO: 1657504 - protein, 25 aa, Staphylococcus aureus
IADVKGADVAIDFSNPNLLFPLLDE

SEQ ID NO: 1657505 - protein, 22 aa, Staphylococcus aureus
IAEKDFFIFFRNFFTKKFQREI

SEQ ID NO: 1657506 - protein, 23 aa, Staphylococcus aureus
IAGSYAERIPVIAITGAPTRAVE

SEQ ID NO: 1657507 - protein, 18 aa, Staphylococcus aureus
IANDVRWLASGPRAGLAE

SEQ ID NO: 1657508 - protein, 20 aa, Staphylococcus aureus
IATFRLREGMPIGAKVTLRG

SEQ ID NO: 1657509 - protein, 18 aa, Staphylococcus aureus
IDEIDFNSGYILISTGYK

SEQ ID NO: 1657510 - protein, 17 aa, Staphylococcus aureus
IDRHLFYQFIMKLPESV

SEQ ID NO: 1657511 - protein, 23 aa, Staphylococcus aureus
IDYAQCLVQLGIAKKAEHLFYDN

SEQ ID NO: 1657512 - protein, 19 aa, Staphylococcus aureus
IEAGLRRVLAETSQYITNE

SEQ ID NO: 1657513 - protein, 24 aa, Staphylococcus aureus
IEDEKRLTQSLADFDTLSMREQTH

SEQ ID NO: 1657514 - protein, 18 aa, Staphylococcus aureus
IEDFHLIKEIISKKELEG

SEQ ID NO: 1657515 - protein, 17 aa, Staphylococcus aureus
IELDEAVGIMTGQVVYK

SEQ ID NO: 1657516 - protein, 24 aa, Staphylococcus aureus
IFKNSWFKVYRMFDELRETFKEEG

SEQ ID NO: 1657517 - protein, 26 aa, Staphylococcus aureus
IHRIKYDMLQPNPLRQEVMRRYPQII

SEQ ID NO: 1657518 - protein, 18 aa, Staphylococcus aureus
IIELAHRMKLGQKIDITQ

SEQ ID NO: 1657519 - protein, 19 aa, Staphylococcus aureus
IKDKTFDFVFNKDDVTYCL

SEQ ID NO: 1657520 - protein, 21 aa, Staphylococcus aureus
IKKDEVLAGFLYLTDLEGDMP

SEQ ID NO: 1657521 - protein, 18 aa, Staphylococcus aureus
IKNFNLWQAQREDSLLDI

SEQ ID NO: 1657522 - protein, 21 aa, Staphylococcus aureus
IKSSLFTNGSYTFVGDKIVAI

SEQ ID NO: 1657523 - protein, 34 aa, Staphylococcus aureus
ILRRCHSGPLLKNGRRFGFYRGYNGHSHIHIKGG

SEQ ID NO: 1657524 - protein, 17 aa, Staphylococcus aureus
IPVVFIINQIDKHQDDE

SEQ ID NO: 1657525 - protein, 19 aa, Staphylococcus aureus
ISAAAIKFAQQFEENSTFK

SEQ ID NO: 1657526 - protein, 18 aa, Staphylococcus aureus
ISCSPKLLIADEPTTALD

SEQ ID NO: 1657527 - protein, 25 aa, Staphylococcus aureus
ISTHSFRYTHCALLIESGVHIKEIQ

SEQ ID NO: 1657528 - protein, 21 aa, Staphylococcus aureus
IVFMRKWLDLGNRYGNIQEVM

SEQ ID NO: 1657529 - protein, 27 aa, Staphylococcus aureus
IYLEKISLRDRQEWWYNVFYDDGKYNK

SEQ ID NO: 1657530 - protein, 27 aa, Staphylococcus aureus
KAADIFRSVGIDFCCGGQVSIEAAALE

SEQ ID NO: 1657531 - protein, 21 aa, Staphylococcus aureus
KAEIMPTFKALGLDEYIEVVV

SEQ ID NO: 1657532 - protein, 17 aa, Staphylococcus aureus
KAFIMKIYDEYRSYVIE

SEQ ID NO: 1657533 - protein, 22 aa, Staphylococcus aureus
KAILRCDPDVILIGEIRDKDVA

SEQ ID NO: 1657534 - protein, 23 aa, Staphylococcus aureus
KAIMLPPGLAFVAYSHRAKEHFK

SEQ ID NO: 1657535 - protein, 19 aa, Staphylococcus aureus
KANAALLIYYGVPKENIYT

SEQ ID NO: 1657536 - protein, 23 aa, Staphylococcus aureus
KANELYRVIGVYSKHKGKDTYVN

SEQ ID NO: 1657537 - protein, 17 aa, Staphylococcus aureus
KAQSLIMGCYGIGISRT

SEQ ID NO: 1657538 - protein, 25 aa, Staphylococcus aureus
KCRPIEGWSTVAFAKDWQGPPRLQN

SEQ ID NO: 1657539 - protein, 26 aa, Staphylococcus aureus
KDGRLFICYLGDFKSTGGIFAATENG

SEQ ID NO: 1657540 - protein, 17 aa, Staphylococcus aureus
KDILFGPTITVKALLNM

SEQ ID NO: 1657541 - protein, 18 aa, Staphylococcus aureus
KEIISKKELEGFNITIPH

SEQ ID NO: 1657542 - protein, 19 aa, Staphylococcus aureus
KELFKNKWIGKFLTSLNAF

SEQ ID NO: 1657543 - protein, 26 aa, Staphylococcus aureus
KENNVRIALTEVWKKGGKGGVDLANE

SEQ ID NO: 1657544 - protein, 24 aa, Staphylococcus aureus
KEVDLKAGDKIIFDGKHTYRGYLN

SEQ ID NO: 1657545 - protein, 25 aa, Staphylococcus aureus
KEVLEAMGGKRVVVRTLDIGGDKEL

SEQ ID NO: 1657546 - protein, 18 aa, Staphylococcus aureus
KFRERHRVIIRDSNKQWR

SEQ ID NO: 1657547 - protein, 17 aa, Staphylococcus aureus
KGAMPGFNVIFNGLLES

SEQ ID NO: 1657548 - protein, 26 aa, Staphylococcus aureus
KGMREIKKDIGMIFQHFNLLNSATVF

SEQ ID NO: 1657549 - protein, 18 aa, Staphylococcus aureus
KIDFERLARYCEKNNAVV

SEQ ID NO: 1657550 - protein, 26 aa, Staphylococcus aureus
KKETDILFILSLFRKINWKVYDESTG

SEQ ID NO: 1657551 - protein, 24 aa, Staphylococcus aureus
KKKTIIDISEGFKLNIQQDTMTYF

SEQ ID NO: 1657552 - protein, 17 aa, Staphylococcus aureus
KKLIDNWIDQSASKLYD

SEQ ID NO: 1657553 - protein, 20 aa, Staphylococcus aureus
KKNNNWYACIAVDKKTKNLG

SEQ ID NO: 1657554 - protein, 23 aa, Staphylococcus aureus
KKTAYDQAVAAAKAILNKQTGSN

SEQ ID NO: 1657555 - protein, 23 aa, Staphylococcus aureus
KKYSNIALIFSIRTPFEDVILPK

SEQ ID NO: 1657556 - protein, 19 aa, Staphylococcus aureus
KLAASRRGKLTSVDKENVL

SEQ ID NO: 1657557 - protein, 24 aa, Staphylococcus aureus
KLIDRSVRIIQEICAITYDEAMAL

SEQ ID NO: 1657558 - protein, 24 aa, Staphylococcus aureus
KLRDENHIIYLFLGQFFTKNEDPW

SEQ ID NO: 1657559 - protein, 18 aa, Staphylococcus aureus
KMDMLKKHQKQAVNFQNY

SEQ ID NO: 1657560 - protein, 18 aa, Staphylococcus aureus
KNELYVDNNFVFTDVNGY

SEQ ID NO: 1657561 - protein, 17 aa, Staphylococcus aureus
KNVFKPIIIELGSIFNN

SEQ ID NO: 1657562 - protein, 19 aa, Staphylococcus aureus
KPTGQKILFRGLDDPLKIT

SEQ ID NO: 1657563 - protein, 22 aa, Staphylococcus aureus
KQGDILKLRLFRNDENYAEIYS

SEQ ID NO: 1657564 - protein, 19 aa, Staphylococcus aureus
KQKSGVWLVKVKDLETNET

SEQ ID NO: 1657565 - protein, 18 aa, Staphylococcus aureus
KRESLNLDTSALVRQLKD

SEQ ID NO: 1657566 - protein, 20 aa, Staphylococcus aureus
KRLETIEGIVPSIQAFHVNK

SEQ ID NO: 1657567 - protein, 17 aa, Staphylococcus aureus
KRPLILLNWNTLTGDTF

SEQ ID NO: 1657568 - protein, 18 aa, Staphylococcus aureus
KSAGTKVVPFISVKESKD

SEQ ID NO: 1657569 - protein, 19 aa, Staphylococcus aureus
KSIRLSFAFESNENIKHAL

SEQ ID NO: 1657570 - protein, 20 aa, Staphylococcus aureus
KSLWPQPGDYLLVTLRIDRE

SEQ ID NO: 1657571 - protein, 19 aa, Staphylococcus aureus
KSQEMPIFITYDKHEDISD

SEQ ID NO: 1657572 - protein, 21 aa, Staphylococcus aureus
KSRLDSRLVEVFEQLKDIQGQ

SEQ ID NO: 1657573 - protein, 26 aa, Staphylococcus aureus
KTYSLGMKQKLGIAIAFLNKPQFIIL

SEQ ID NO: 1657574 - protein, 18 aa, Staphylococcus aureus
KVAHIDTSYIIKTAEAKT

SEQ ID NO: 1657575 - protein, 24 aa, Staphylococcus aureus
KVLVETLPDFKFHIAAITEMSDKL

SEQ ID NO: 1657576 - protein, 26 aa, Staphylococcus aureus
KVSRRDLAEVIAMKCVGATTVATTMI

SEQ ID NO: 1657577 - protein, 18 aa, Staphylococcus aureus
KWRLVRDLKQQEVADILG

SEQ ID NO: 1657578 - protein, 22 aa, Staphylococcus aureus
KYIDLIEEYGFDLIRGEASFID

SEQ ID NO: 1657579 - protein, 22 aa, Staphylococcus aureus
KYKIYGTWYPFYKKNDGNLTKQ

SEQ ID NO: 1657580 - protein, 30 aa, Staphylococcus aureus
KYLKMNFDLKWEYYLRLFLNLISAQNNSAI

SEQ ID NO: 1657581 - protein, 19 aa, Staphylococcus aureus
KYLYALIQIHTLRIAHRIR

SEQ ID NO: 1657582 - protein, 25 aa, Staphylococcus aureus
KYRFNRLKLTTIHNGIADVPAVKQT

SEQ ID NO: 1657583 - protein, 17 aa, Staphylococcus aureus
KYRVELKNNKIVLLDNV

SEQ ID NO: 1657584 - protein, 21 aa, Staphylococcus aureus
LALNVVEPFASGIGGGGYLLY

SEQ ID NO: 1657585 - protein, 19 aa, Staphylococcus aureus
LATDKEFYIFDSLIQGLSY

SEQ ID NO: 1657586 - protein, 19 aa, Staphylococcus aureus
LDLADLIPARHVKRIHHVE

SEQ ID NO: 1657587 - protein, 26 aa, Staphylococcus aureus
LDLADLIPARYVKRIHHVENIDEAIA

SEQ ID NO: 1657588 - protein, 19 aa, Staphylococcus aureus
LDLQILLWHMVEKKDNQPH

SEQ ID NO: 1657589 - protein, 24 aa, Staphylococcus aureus
LEQPVLYPGWNRFKSNKVMKQITF

SEQ ID NO: 1657590 - protein, 24 aa, Staphylococcus aureus
LFINDFRVPYVLEEGVNVKKSMNN

SEQ ID NO: 1657591 - protein, 19 aa, Staphylococcus aureus
LGPKGIRVNCVAPGPFWSP

SEQ ID NO: 1657592 - protein, 24 aa, Staphylococcus aureus
LGTMGCGLPGAIASKIAYPNRQAI

SEQ ID NO: 1657593 - protein, 19 aa, Staphylococcus aureus
LHNRGSFEGFKHAASEEKW

SEQ ID NO: 1657594 - protein, 25 aa, Staphylococcus aureus
LIYHLYDDRGLWLAFNNNEDYARYS

SEQ ID NO: 1657595 - protein, 20 aa, Staphylococcus aureus
LKEEIRIFVKEGLSAHAAPR

SEQ ID NO: 1657596 - protein, 23 aa, Staphylococcus aureus
LKKEVLKKVGLDLDIKRIVSSLS

SEQ ID NO: 1657597 - protein, 17 aa, Staphylococcus aureus
LKKYRMESSNFKNKTIV

SEQ ID NO: 1657598 - protein, 21 aa, Staphylococcus aureus
LKLESGKMLGFLGRNGAGKTT

SEQ ID NO: 1657599 - protein, 20 aa, Staphylococcus aureus
LKPTSFVLKEYVKWEKLQEN

SEQ ID NO: 1657600 - protein, 17 aa, Staphylococcus aureus
LKRGISRQLTKEKHDQV

SEQ ID NO: 1657601 - protein, 18 aa, Staphylococcus aureus
LKRRGIDINEAFNQVKRY

SEQ ID NO: 1657602 - protein, 17 aa, Staphylococcus aureus
LLALPNLGAINVHASLL

SEQ ID NO: 1657603 - protein, 22 aa, Staphylococcus aureus
LLDEDFHLPLVVATTGEKEKLL

SEQ ID NO: 1657604 - protein, 19 aa, Staphylococcus aureus
LLDLLRLHLSLFNKYEKDE

SEQ ID NO: 1657605 - protein, 25 aa, Staphylococcus aureus
LLIEVLKSKVIRHAYLDVFENEPLK

SEQ ID NO: 1657606 - protein, 26 aa, Staphylococcus aureus
LLIEVLKSKVIRHAYLDVFENEPLKP

SEQ ID NO: 1657607 - protein, 17 aa, Staphylococcus aureus
LNCSIYFSDLGCPYQRG

SEQ ID NO: 1657608 - protein, 26 aa, Staphylococcus aureus
LPFNSRKLILRRAAQFLTYGDTISIG

SEQ ID NO: 1657609 - protein, 21 aa, Staphylococcus aureus
LQGDIEKRESLNLDTSALVRQ

SEQ ID NO: 1657610 - protein, 18 aa, Staphylococcus aureus
LRDYKINVQNNWKNELYN

SEQ ID NO: 1657611 - protein, 19 aa, Staphylococcus aureus
LRGNINYLFNDEANVVYTY

SEQ ID NO: 1657612 - protein, 21 aa, Staphylococcus aureus
LRLQDIFKLLNHRERLWLKLY

SEQ ID NO: 1657613 - protein, 18 aa, Staphylococcus aureus
LRRFFKIYVRGIRALANF

SEQ ID NO: 1657614 - protein, 27 aa, Staphylococcus aureus
LSGGEKARLLLALLMLQRDNVLILDEP

SEQ ID NO: 1657615 - protein, 17 aa, Staphylococcus aureus
LSRKTIVYKGWLRSDQI

SEQ ID NO: 1657616 - protein, 17 aa, Staphylococcus aureus
LTDSFAPYLTMAEGLKL

SEQ ID NO: 1657617 - protein, 21 aa, Staphylococcus aureus
LTELSSYWVYQNIDIKKEFKV

SEQ ID NO: 1657618 - protein, 25 aa, Staphylococcus aureus
LTMAEGLKLAALTFDKDVSKLSCCA

SEQ ID NO: 1657619 - protein, 18 aa, Staphylococcus aureus
LTNPYNGRWHMRNIKTNR

SEQ ID NO: 1657620 - protein, 18 aa, Staphylococcus aureus
LTNYTKFRGLIMHMSIIS

SEQ ID NO: 1657621 - protein, 18 aa, Staphylococcus aureus
LTPPRQENVLNYANEQLD

SEQ ID NO: 1657622 - protein, 18 aa, Staphylococcus aureus
LVNFELFDPSNFEEAKAA

SEQ ID NO: 1657623 - protein, 17 aa, Staphylococcus aureus
LWNIANLTNVLGINLDE

SEQ ID NO: 1657624 - protein, 18 aa, Staphylococcus aureus
LYAKFGFMPTEPDSGGMY

SEQ ID NO: 1657625 - protein, 33 aa, Staphylococcus aureus
MALAAKDIRIEAPIPGTSRVGIEVPNQNPTTVN

SEQ ID NO: 1657626 - protein, 17 aa, Staphylococcus aureus
MFANTLVYRGQPSLDKM

SEQ ID NO: 1657627 - protein, 20 aa, Staphylococcus aureus
MKAERIAKGISISDMAKKLG

SEQ ID NO: 1657628 - protein, 19 aa, Staphylococcus aureus
MPEILEAIKNQFKQYSRNE

SEQ ID NO: 1657629 - protein, 18 aa, Staphylococcus aureus
MPGKRVNINDGVPRLDTL

SEQ ID NO: 1657630 - protein, 18 aa, Staphylococcus aureus
MPIEYFTHQFEEITYLSD

SEQ ID NO: 1657631 - protein, 22 aa, Staphylococcus aureus
MRHFQKRITIVDGQISNTEELN

SEQ ID NO: 1657632 - protein, 19 aa, Staphylococcus aureus
MTQLKQGIADKEQTKADGN

SEQ ID NO: 1657633 - protein, 20 aa, Staphylococcus aureus
MVDCWKDCFDDLHILKPNLK

SEQ ID NO: 1657634 - protein, 27 aa, Staphylococcus aureus
MVKAKAEFYRHAILPNEFEKPSMEAQR

SEQ ID NO: 1657635 - protein, 20 aa, Staphylococcus aureus
MYDSDGFRLYFNDVQLPLLA

SEQ ID NO: 1657636 - protein, 17 aa, Staphylococcus aureus
MYREVAFHGGITDTGFY

SEQ ID NO: 1657637 - protein, 23 aa, Staphylococcus aureus
NAGENYIDIAWLARKYAYQVTLK

SEQ ID NO: 1657638 - protein, 25 aa, Staphylococcus aureus
NAVNEYWGGVGYLNIIGEDNRLKKR

SEQ ID NO: 1657639 - protein, 27 aa, Staphylococcus aureus
NDLIGKFCHLVLKWKFNEDEGKYFTDF

SEQ ID NO: 1657640 - protein, 19 aa, Staphylococcus aureus
NDSRILEALVRYANDQNYT

SEQ ID NO: 1657641 - protein, 23 aa, Staphylococcus aureus
NEKEKRIVTAYNLLEKYKETEID

SEQ ID NO: 1657642 - protein, 18 aa, Staphylococcus aureus
NESIPLDLQILLWHMVEK

SEQ ID NO: 1657643 - protein, 20 aa, Staphylococcus aureus
NFTKSIAIEYGRDSIRANAI

SEQ ID NO: 1657644 - protein, 19 aa, Staphylococcus aureus
NHAMPILLVSGYDDSLGDY

SEQ ID NO: 1657645 - protein, 34 aa, Staphylococcus aureus
NHDVDMLRMCRYPWKTKQRILGDMGHVSNEDAAH

SEQ ID NO: 1657646 - protein, 18 aa, Staphylococcus aureus
NHNMAWSDFMQKLAQTVR

SEQ ID NO: 1657647 - protein, 23 aa, Staphylococcus aureus
NHTLRYYVCPKNMNASRFVCDFK

SEQ ID NO: 1657648 - protein, 25 aa, Staphylococcus aureus
NIQIWKKPSSFVIKPLPKNKYPDSI

SEQ ID NO: 1657649 - protein, 25 aa, Staphylococcus aureus
NKAILQFWECATAYLKNPPTREQLE

SEQ ID NO: 1657650 - protein, 23 aa, Staphylococcus aureus
NKAKETKKRAFIIIDALNEGEGK

SEQ ID NO: 1657651 - protein, 27 aa, Staphylococcus aureus
NKEPYRIGLKLSNGGWVYVQGLTHFEI

SEQ ID NO: 1657652 - protein, 22 aa, Staphylococcus aureus
NKLLENQQILALESNKKIQKLE

SEQ ID NO: 1657653 - protein, 23 aa, Staphylococcus aureus
NLDIRKGETLGIVGESGSGKSTL

SEQ ID NO: 1657654 - protein, 23 aa, Staphylococcus aureus
NLKVSFDYIDWIKLGFGPSGKEN

SEQ ID NO: 1657655 - protein, 18 aa, Staphylococcus aureus
NNGQRCYIATGEVDKAGN

SEQ ID NO: 1657656 - protein, 20 aa, Staphylococcus aureus
NNYVAIWFRQERRDGTFRTV

SEQ ID NO: 1657657 - protein, 27 aa, Staphylococcus aureus
NPDELFDAVLMTIKYVMRESKVNKDDI

SEQ ID NO: 1657658 - protein, 23 aa, Staphylococcus aureus
NPDTGKMQLVYDEHIQLVTKSPK

SEQ ID NO: 1657659 - protein, 28 aa, Staphylococcus aureus
NSTDGEPCNECHICKGITQGTNSDVIEI

SEQ ID NO: 1657660 - protein, 25 aa, Staphylococcus aureus
NTNWPVCGIPEKFYTDHGSDFTSHH

SEQ ID NO: 1657661 - protein, 18 aa, Staphylococcus aureus
NYSSHGLMIQRFGMTYVL

SEQ ID NO: 1657662 - protein, 19 aa, Staphylococcus aureus
PDCRAMDLWIDPIVEQYND

SEQ ID NO: 1657663 - protein, 25 aa, Staphylococcus aureus
PDEVWKERLELLKPYQVNKEIMDKT

SEQ ID NO: 1657664 - protein, 20 aa, Staphylococcus aureus
PEEVAKLVVFLASDDSSFIT

SEQ ID NO: 1657665 - protein, 19 aa, Staphylococcus aureus
PHTISIGSIKKVGEYPIIQ

SEQ ID NO: 1657666 - protein, 26 aa, Staphylococcus aureus
PHYICPNCKTSEFFNDGSVGSGFDLP

SEQ ID NO: 1657667 - protein, 22 aa, Staphylococcus aureus
PIDLLPYLFFQFAKDGKRLYSD

SEQ ID NO: 1657668 - protein, 33 aa, Staphylococcus aureus
PILNPEFNNPLFLKLMCEYCVNKFKEFDQTISV

SEQ ID NO: 1657669 - protein, 21 aa, Staphylococcus aureus
PIQGMTCTGCEEHVTEALEQA

SEQ ID NO: 1657670 - protein, 17 aa, Staphylococcus aureus
PIVKWAGGKTQLLDAIN

SEQ ID NO: 1657671 - protein, 23 aa, Staphylococcus aureus
PKTKILYSCFACIQESKESDTQT

SEQ ID NO: 1657672 - protein, 17 aa, Staphylococcus aureus
PLINEGIKLNGLISNPP

SEQ ID NO: 1657673 - protein, 24 aa, Staphylococcus aureus
PLSKEFLKWTAKDFFNEVKPLIAE

SEQ ID NO: 1657674 - protein, 18 aa, Staphylococcus aureus
PLSNMAPTIVMYHGKPIL

SEQ ID NO: 1657675 - protein, 18 aa, Staphylococcus aureus
PMAYTLWTRHLNFNPQSK

SEQ ID NO: 1657676 - protein, 18 aa, Staphylococcus aureus
PRILRAETAPLYALSAIS

SEQ ID NO: 1657677 - protein, 19 aa, Staphylococcus aureus
PSKTMLRAGEINGLAQNNP

SEQ ID NO: 1657678 - protein, 24 aa, Staphylococcus aureus
PSSLEQLDLLLLEIPKSRKIHSDG

SEQ ID NO: 1657679 - protein, 17 aa, Staphylococcus aureus
PSSVKRGDYLAILSTGA

SEQ ID NO: 1657680 - protein, 17 aa, Staphylococcus aureus
PYNGRWHMRNIKTNRFS

SEQ ID NO: 1657681 - protein, 18 aa, Staphylococcus aureus
PYSGVTMGEEFMFNGKHV

SEQ ID NO: 1657682 - protein, 25 aa, Staphylococcus aureus
QAFDRLKLNIFISLAELESDNIGEQ

SEQ ID NO: 1657683 - protein, 17 aa, Staphylococcus aureus
QKLTMIFNQFNQMSLSH

SEQ ID NO: 1657684 - protein, 19 aa, Staphylococcus aureus
QLDQAMERLINGIQDKDQV

SEQ ID NO: 1657685 - protein, 18 aa, Staphylococcus aureus
QLVPRLQEAFSNIKVGNP

SEQ ID NO: 1657686 - protein, 18 aa, Staphylococcus aureus
QLVSEAIVAKAPHNISAN

SEQ ID NO: 1657687 - protein, 19 aa, Staphylococcus aureus
QQTAIRCAMQNLKPLFDSP

SEQ ID NO: 1657688 - protein, 31 aa, Staphylococcus aureus
QSAYIHIPFCVRICTYCDFNKYFIQNQPVDE

SEQ ID NO: 1657689 - protein, 19 aa, Staphylococcus aureus
QSLIMGCYGIGISRTLSAI

SEQ ID NO: 1657690 - protein, 18 aa, Staphylococcus aureus
QTFNMFLEDLIELSKYNN

SEQ ID NO: 1657691 - protein, 28 aa, Staphylococcus aureus
RDNHSAYTFIKRLIKQFGKPQMIITDQA

SEQ ID NO: 1657692 - protein, 30 aa, Staphylococcus aureus
RELYKALEVKKRFSAWAEINLKHFKENRDF

SEQ ID NO: 1657693 - protein, 30 aa, Staphylococcus aureus
REMRLMWKEMMVILQAFRVPSVNLLQFMVK

SEQ ID NO: 1657694 - protein, 18 aa, Staphylococcus aureus
REVLVPWEDLPKVKSLWP

SEQ ID NO: 1657695 - protein, 20 aa, Staphylococcus aureus
REVVKHHQLKVNAFEEVLTV

SEQ ID NO: 1657696 - protein, 18 aa, Staphylococcus aureus
REYLAQGLQSIWDENKRF

SEQ ID NO: 1657697 - protein, 18 aa, Staphylococcus aureus
RFDIVDGKLNIQFNEGEP

SEQ ID NO: 1657698 - protein, 19 aa, Staphylococcus aureus
RGLQKIGVETGGDLKTAYA

SEQ ID NO: 1657699 - protein, 19 aa, Staphylococcus aureus
RHRLKRPLILLNWNTLTGD

SEQ ID NO: 1657700 - protein, 20 aa, Staphylococcus aureus
RINVGLDIINTLSKHFKVTA

SEQ ID NO: 1657701 - protein, 17 aa, Staphylococcus aureus
RKRHIDFTITEFERDAW

SEQ ID NO: 1657702 - protein, 17 aa, Staphylococcus aureus
RLQEAFSNIKVGNPQDE

SEQ ID NO: 1657703 - protein, 30 aa, Staphylococcus aureus
RLRTGTMTEKDWSRFTIAVGKLSRTKIFID

SEQ ID NO: 1657704 - protein, 19 aa, Staphylococcus aureus
RLSTHWTNHNMAWSDFMQK

SEQ ID NO: 1657705 - protein, 19 aa, Staphylococcus aureus
RPTIFKVEYEINGERNIRR

SEQ ID NO: 1657706 - protein, 19 aa, Staphylococcus aureus
RQIILNFGHYRFTDLKESG

SEQ ID NO: 1657707 - protein, 17 aa, Staphylococcus aureus
RQMYDSDGFRLYFNDVQ

SEQ ID NO: 1657708 - protein, 20 aa, Staphylococcus aureus
RQNCDKCGHQYDLYKFENGY

SEQ ID NO: 1657709 - protein, 24 aa, Staphylococcus aureus
RREEIKYYIAEAIKAEKAGKKVEM

SEQ ID NO: 1657710 - protein, 30 aa, Staphylococcus aureus
RSDELSIFEMFDYNIAYEIRLQAALESDIL

SEQ ID NO: 1657711 - protein, 19 aa, Staphylococcus aureus
RSEYHHCPVILGSATPCLE

SEQ ID NO: 1657712 - protein, 25 aa, Staphylococcus aureus
RTLKHCDNCGGAIRPDIVLYGEMLD

SEQ ID NO: 1657713 - protein, 18 aa, Staphylococcus aureus
SDLDFKFYKKASEIPESD

SEQ ID NO: 1657714 - protein, 17 aa, Staphylococcus aureus
SEFYSPMMANMNEHELR

SEQ ID NO: 1657715 - protein, 20 aa, Staphylococcus aureus
SFAPYLTMAEGLKLAALTFD

SEQ ID NO: 1657716 - protein, 24 aa, Staphylococcus aureus
SFSPDKILGAILFEQTMDREVESK

SEQ ID NO: 1657717 - protein, 24 aa, Staphylococcus aureus
SGKSTFQKQICNLFSPTSGELYFK

SEQ ID NO: 1657718 - protein, 19 aa, Staphylococcus aureus
SGKSTFQKQICNLISPTSG

SEQ ID NO: 1657719 - protein, 19 aa, Staphylococcus aureus
SICNCPHADGRRVICKHMI

SEQ ID NO: 1657720 - protein, 19 aa, Staphylococcus aureus
SITPYEGGIAFASKPLIDA

SEQ ID NO: 1657721 - protein, 21 aa, Staphylococcus aureus
SKEILKLPIRTWFDKYESEIM

SEQ ID NO: 1657722 - protein, 22 aa, Staphylococcus aureus
SKEKSIRLSFAFESNENIKHAL

SEQ ID NO: 1657723 - protein, 24 aa, Staphylococcus aureus
SKGFKGLAGAMLFNLKPINVLKNS

SEQ ID NO: 1657724 - protein, 27 aa, Staphylococcus aureus
SKSLAIAVASIISRYAFVTYMDQISKN

SEQ ID NO: 1657725 - protein, 18 aa, Staphylococcus aureus
SLALPFSVLYNLPSNGSD

SEQ ID NO: 1657726 - protein, 18 aa, Staphylococcus aureus
SNSGFKRKSDAKHHAEMV

SEQ ID NO: 1657727 - protein, 25 aa, Staphylococcus aureus
SPFDDSFSGFIFKIQANMDPKHRDR

SEQ ID NO: 1657728 - protein, 22 aa, Staphylococcus aureus
SRLPEIYGDFELESTDALPHLY

SEQ ID NO: 1657729 - protein, 17 aa, Staphylococcus aureus
SRYYTNWNTIEKQVNHR

SEQ ID NO: 1657730 - protein, 25 aa, Staphylococcus aureus
SSDSFWQQVIYKLIYDNEVLIVVSD

SEQ ID NO: 1657731 - protein, 24 aa, Staphylococcus aureus
STPSFMEMCLLLPTLNEEQYGSLN

SEQ ID NO: 1657732 - protein, 24 aa, Staphylococcus aureus
TDDYPGWWREIIDGGYIPIHDYQF

SEQ ID NO: 1657733 - protein, 20 aa, Staphylococcus aureus
TFQKQICNLISPTSGELYFK

SEQ ID NO: 1657734 - protein, 18 aa, Staphylococcus aureus
TGKTWLFFGDQHRSSDFL

SEQ ID NO: 1657735 - protein, 21 aa, Staphylococcus aureus
TGNYSKVPWISIYDENITKET

SEQ ID NO: 1657736 - protein, 21 aa, Staphylococcus aureus
TIEYATPISHFVKDELWDKGD

SEQ ID NO: 1657737 - protein, 18 aa, Staphylococcus aureus
TKLFLEIDIDNHRYICLS

SEQ ID NO: 1657738 - protein, 27 aa, Staphylococcus aureus
TNTHLHLIKPLGFRTDDKMLKRAGLDY

SEQ ID NO: 1657739 - protein, 23 aa, Staphylococcus aureus
TPTKSGYFVTCWTKDEDNYNRPY

SEQ ID NO: 1657740 - protein, 17 aa, Staphylococcus aureus
TSIGMIYGSGITISGYG

SEQ ID NO: 1657741 - protein, 17 aa, Staphylococcus aureus
TSSFIPIDIPFIVDIEK

SEQ ID NO: 1657742 - protein, 29 aa, Staphylococcus aureus
TSVKMTYKIIGDFKRKVPIDELGNKNGLE

SEQ ID NO: 1657743 - protein, 25 aa, Staphylococcus aureus
VCDGDWGVAEGLVFDNFKVEDFDWF

SEQ ID NO: 1657744 - protein, 26 aa, Staphylococcus aureus
VDIYGCASAGIGERLYNEPISKEFVR

SEQ ID NO: 1657745 - protein, 21 aa, Staphylococcus aureus
VELPNGAVFLFKGLDNPEKIK

SEQ ID NO: 1657746 - protein, 17 aa, Staphylococcus aureus
VEMTVKRAEYVNKKLKE

SEQ ID NO: 1657747 - protein, 24 aa, Staphylococcus aureus
VIHPREIFKTAILSNANSIMLGHN

SEQ ID NO: 1657748 - protein, 17 aa, Staphylococcus aureus
VKQGVNFTDADKAKRDA

SEQ ID NO: 1657749 - protein, 17 aa, Staphylococcus aureus
VLCCTPTEYRMMAKLQN

SEQ ID NO: 1657750 - protein, 25 aa, Staphylococcus aureus
VLHLLYARFWHKVLYDLAIVPTKEP

SEQ ID NO: 1657751 - protein, 18 aa, Staphylococcus aureus
VLIDEFDKVLPIYYNVFY

SEQ ID NO: 1657752 - protein, 22 aa, Staphylococcus aureus
VMGSGPIGLLVAQVLKSKGATV

SEQ ID NO: 1657753 - protein, 18 aa, Staphylococcus aureus
VNAAKAILTKASGQNVDK

SEQ ID NO: 1657754 - protein, 25 aa, Staphylococcus aureus
VNVGDPLVRFNLEFINNNAKSVISP

SEQ ID NO: 1657755 - protein, 36 aa, Staphylococcus aureus
VPDTLRVASILAHTLFDYPSHQLVTFGVTGTNGKTS

SEQ ID NO: 1657756 - protein, 26 aa, Staphylococcus aureus
VPLLIKKAEKAECVSRFRSGSAINGF

SEQ ID NO: 1657757 - protein, 17 aa, Staphylococcus aureus
VQKILSHRAKGIKMYIF

SEQ ID NO: 1657758 - protein, 22 aa, Staphylococcus aureus
VRNYLLKHKNLYEFNSSPYETG

SEQ ID NO: 1657759 - protein, 18 aa, Staphylococcus aureus
VSGVTDLKNSATSLNNAM

SEQ ID NO: 1657760 - protein, 22 aa, Staphylococcus aureus
VSIESLIEFCRLAQLPKNKNIQ

SEQ ID NO: 1657761 - protein, 17 aa, Staphylococcus aureus
VSTRPGHEMITVEEELN

SEQ ID NO: 1657762 - protein, 21 aa, Staphylococcus aureus
VVFRIKHEYKELLTSTERGKI

SEQ ID NO: 1657763 - protein, 22 aa, Staphylococcus aureus
VVTPSEITAALNKVTQAKNDLN

SEQ ID NO: 1657764 - protein, 19 aa, Staphylococcus aureus
VYNKCSSYLHGSDAILNDV

SEQ ID NO: 1657765 - protein, 17 aa, Staphylococcus aureus
WGKFTPRGGISIDPYTN

SEQ ID NO: 1657766 - protein, 22 aa, Staphylococcus aureus
WICKAPKYTGQEWMVYEDLVKV

SEQ ID NO: 1657767 - protein, 20 aa, Staphylococcus aureus
WKKSRRLGISLSGTGKELEK

SEQ ID NO: 1657768 - protein, 18 aa, Staphylococcus aureus
WNKSYKEQGLKGLIYATR

SEQ ID NO: 1657769 - protein, 21 aa, Staphylococcus aureus
WSTGKLPYLIELGAIEVSINF

SEQ ID NO: 1657770 - protein, 18 aa, Staphylococcus aureus
YDKEGFRDQEFEKGDKGT

SEQ ID NO: 1657771 - protein, 19 aa, Staphylococcus aureus
YDKEIDHLIDYFILPLRQI

SEQ ID NO: 1657772 - protein, 35 aa, Staphylococcus aureus
YDKKKSLALMGDWDYARYGILQGIEYAISEDATLT

SEQ ID NO: 1657773 - protein, 19 aa, Staphylococcus aureus
YDSFLPQKLDIVVFPSKYG

SEQ ID NO: 1657774 - protein, 24 aa, Staphylococcus aureus
YEHLFDYNPLFGVPNNKEMIGDAE

SEQ ID NO: 1657775 - protein, 20 aa, Staphylococcus aureus
YEHYGSIVLIGRGIDGNFYF

SEQ ID NO: 1657776 - protein, 25 aa, Staphylococcus aureus
YELVDFSVVEKLDWKQLNHEDLQQM

SEQ ID NO: 1657777 - protein, 20 aa, Staphylococcus aureus
YEPEFFRYGGKNTINEIEAF

SEQ ID NO: 1657778 - protein, 19 aa, Staphylococcus aureus
YEVEAKVTFAFDRKAEKFS

SEQ ID NO: 1657779 - protein, 19 aa, Staphylococcus aureus
YGAYNYFGIGAFDNDPDYA

SEQ ID NO: 1657780 - protein, 20 aa, Staphylococcus aureus
YHKILIKNFNLWQAQREDSL

SEQ ID NO: 1657781 - protein, 24 aa, Staphylococcus aureus
YIDIKSFLRYDCEVKGNIFESSHL

SEQ ID NO: 1657782 - protein, 20 aa, Staphylococcus aureus
YKKAQAFDEILEGMTNAIQH

SEQ ID NO: 1657783 - protein, 22 aa, Staphylococcus aureus
YKLMFDTLRAMYQQHPIRVDIA

SEQ ID NO: 1657784 - protein, 19 aa, Staphylococcus aureus
YKQPVCKVCGSQIETKIIA

SEQ ID NO: 1657785 - protein, 20 aa, Staphylococcus aureus
YKTHIDYVPIFKRRPIEEKE

SEQ ID NO: 1657786 - protein, 23 aa, Staphylococcus aureus
YKVDVSNCIFILTSNFNSIEEAI

SEQ ID NO: 1657787 - protein, 19 aa, Staphylococcus aureus
YKVSLDFFAKSIIADNYEA

SEQ ID NO: 1657788 - protein, 20 aa, Staphylococcus aureus
YLDGYASLWVNVHGHNNKYL

SEQ ID NO: 1657789 - protein, 18 aa, Staphylococcus aureus
YLESIKASLKRLEDEIER

SEQ ID NO: 1657790 - protein, 17 aa, Staphylococcus aureus
YLTSRTNGLKLTPRENG

SEQ ID NO: 1657791 - protein, 18 aa, Staphylococcus aureus
YLVGLMRSVIYQFKEDEL

SEQ ID NO: 1657792 - protein, 20 aa, Staphylococcus aureus
YNSGPWKRTIVYKDPVPHNF

SEQ ID NO: 1657793 - protein, 18 aa, Staphylococcus aureus
YQMLNLGKYQGISVSALN

SEQ ID NO: 1657794 - protein, 26 aa, Staphylococcus aureus
YQNPPAWVCIEFMQLGQFVSFLNFYY

SEQ ID NO: 1657795 - protein, 23 aa, Staphylococcus aureus
YQPENRKTVLIFYKIQPDNIYIT

SEQ ID NO: 1657796 - protein, 17 aa, Staphylococcus aureus
YQYHKCSEYLRNISENL

SEQ ID NO: 1657797 - protein, 24 aa, Staphylococcus aureus
YRIMKYDWANILVVRRFSNTNKQS

SEQ ID NO: 1657798 - protein, 17 aa, Staphylococcus aureus
YSHRAKEHFKEVTTPKF

SEQ ID NO: 1657799 - protein, 20 aa, Staphylococcus aureus
AAVRAVVRTAIYNEIEVYGV

SEQ ID NO: 1657800 - protein, 20 aa, Staphylococcus aureus
ACKYPIGVVEDEIYYFNEEN

SEQ ID NO: 1657801 - protein, 22 aa, Staphylococcus aureus
ADKDATKATVNFTDADQAKQQA

SEQ ID NO: 1657802 - protein, 17 aa, Staphylococcus aureus
AELNHKGITKAKKDDSS

SEQ ID NO: 1657803 - protein, 17 aa, Staphylococcus aureus
AHSSLEFQIKHLMVSKV

SEQ ID NO: 1657804 - protein, 27 aa, Staphylococcus aureus
AIDMEEVWLADKRVELVTRHIINNHDK

SEQ ID NO: 1657805 - protein, 17 aa, Staphylococcus aureus
AITKSIKKLLAKDLVVE

SEQ ID NO: 1657806 - protein, 22 aa, Staphylococcus aureus
AKAQQLDGAMGQLETSIRDKDT

SEQ ID NO: 1657807 - protein, 18 aa, Staphylococcus aureus
AKILAKRLMQVRQKRVLV

SEQ ID NO: 1657808 - protein, 21 aa, Staphylococcus aureus
ALSTLYRWNKLYKEQGLTGLI

SEQ ID NO: 1657809 - protein, 20 aa, Staphylococcus aureus
AMETLKHLVDNEIPNAEQTV

SEQ ID NO: 1657810 - protein, 23 aa, Staphylococcus aureus
ANEIPKAKIDANKDVDKQVQALI

SEQ ID NO: 1657811 - protein, 28 aa, Staphylococcus aureus
ANEISGMIPVEWEKVYTIAYVNDRGGEV

SEQ ID NO: 1657812 - protein, 26 aa, Staphylococcus aureus
ANEISGMIPVEWEQVFTIAYVTDQAG

SEQ ID NO: 1657813 - protein, 21 aa, Staphylococcus aureus
APMGSPRPRFRNTGRFVQTYM

SEQ ID NO: 1657814 - protein, 27 aa, Staphylococcus aureus
AQALLKKDEFVGIAIPTIVKDKFSVAD

SEQ ID NO: 1657815 - protein, 21 aa, Staphylococcus aureus
ARAYLPRILVEKLLIKIDDML

SEQ ID NO: 1657816 - protein, 19 aa, Staphylococcus aureus
ATQKYNIIKPFILGKQSLS

SEQ ID NO: 1657817 - protein, 17 aa, Staphylococcus aureus
AYLPIYAIQNHLCECGI

SEQ ID NO: 1657818 - protein, 18 aa, Staphylococcus aureus
CKAYVEAHAKFAAENVEK

SEQ ID NO: 1657819 - protein, 20 aa, Staphylococcus aureus
CPLFNEMPEILEAIKNQFKQ

SEQ ID NO: 1657820 - protein, 17 aa, Staphylococcus aureus
DATLRNQNYLDADESKR

SEQ ID NO: 1657821 - protein, 17 aa, Staphylococcus aureus
DDVPCVEENAIIRDLDI

SEQ ID NO: 1657822 - protein, 18 aa, Staphylococcus aureus
DELFALFIDGQWGVGKTY

SEQ ID NO: 1657823 - protein, 22 aa, Staphylococcus aureus
DELSKFANYYIKAGVNADNVKI

SEQ ID NO: 1657824 - protein, 20 aa, Staphylococcus aureus
DEMYSRFKTGMTLQKNPLTL

SEQ ID NO: 1657825 - protein, 26 aa, Staphylococcus aureus
DENVRLKPYFDVLVEKVIYPYRNNEE

SEQ ID NO: 1657826 - protein, 26 aa, Staphylococcus aureus
DESAKKYLWRVLVTQLKKLELNYDVY

SEQ ID NO: 1657827 - protein, 23 aa, Staphylococcus aureus
DFDSIFRRMMKDMQGSNQVGNKK

SEQ ID NO: 1657828 - protein, 18 aa, Staphylococcus aureus
DFNSGYILISTGYKSFDE

SEQ ID NO: 1657829 - protein, 22 aa, Staphylococcus aureus
DFQDALGLSSADSFRDLIKVLV

SEQ ID NO: 1657830 - protein, 22 aa, Staphylococcus aureus
DGATFPNCLKITAKNDEVIIMA

SEQ ID NO: 1657831 - protein, 22 aa, Staphylococcus aureus
DGVDLGDIGCRFYTEDENTASI

SEQ ID NO: 1657832 - protein, 17 aa, Staphylococcus aureus
DGWYSLHLFYAVDWASL

SEQ ID NO: 1657833 - protein, 21 aa, Staphylococcus aureus
DKAVHMGDIFPTTAHKNPLWV

SEQ ID NO: 1657834 - protein, 27 aa, Staphylococcus aureus
DKEPYRIGLKLSNGGWVYVQGLTHFEI

SEQ ID NO: 1657835 - protein, 29 aa, Staphylococcus aureus
DKKMSFTKFKSCLKKHTFEQIMQGTREYL

SEQ ID NO: 1657836 - protein, 24 aa, Staphylococcus aureus
DLIDYLDCKVLFIGNLDELNKKAD

SEQ ID NO: 1657837 - protein, 23 aa, Staphylococcus aureus
DLKIDHAFECVGGKGSQVALQQI

SEQ ID NO: 1657838 - protein, 30 aa, Staphylococcus aureus
DLSKGFPRIPILKDVYGFVEIGRELVELHL

SEQ ID NO: 1657839 - protein, 18 aa, Staphylococcus aureus
DNLDGVWLGDLILIKRGL

SEQ ID NO: 1657840 - protein, 19 aa, Staphylococcus aureus
DNLDGVWLGDLILIKRGLS

SEQ ID NO: 1657841 - protein, 19 aa, Staphylococcus aureus
DPHFPKKLTLRDIVRANER

SEQ ID NO: 1657842 - protein, 20 aa, Staphylococcus aureus
DQEVIWLYQYFSDISLAPTT

SEQ ID NO: 1657843 - protein, 24 aa, Staphylococcus aureus
DRIDVRLGDGLSVIHPEDVIDNIT

SEQ ID NO: 1657844 - protein, 26 aa, Staphylococcus aureus
DSDLKRFKGAHGLLYEHQLGLQATIF

SEQ ID NO: 1657845 - protein, 21 aa, Staphylococcus aureus
DTFKLSRHTGLIAEEVEELGF

SEQ ID NO: 1657846 - protein, 17 aa, Staphylococcus aureus
DVDNALNAVTRAKAALN

SEQ ID NO: 1657847 - protein, 17 aa, Staphylococcus aureus
DVEEKAQLIKSLQYITA

SEQ ID NO: 1657848 - protein, 22 aa, Staphylococcus aureus
EATEKGFKCPNCGNDNPKTVDV

SEQ ID NO: 1657849 - protein, 25 aa, Staphylococcus aureus
EEEKAHSITAIWNFEKQNYYLKNLR

SEQ ID NO: 1657850 - protein, 27 aa, Staphylococcus aureus
EESQHLKKCITRWHINLETTGKKRKKL

SEQ ID NO: 1657851 - protein, 26 aa, Staphylococcus aureus
EISQTRLAYLVLRGMGMSEEMIQETQ

SEQ ID NO: 1657852 - protein, 20 aa, Staphylococcus aureus
EIYQFPLLLFYKGNIKLIKI

SEQ ID NO: 1657853 - protein, 17 aa, Staphylococcus aureus
EKACFVIKMIRDTVQEF

SEQ ID NO: 1657854 - protein, 27 aa, Staphylococcus aureus
EKGMREIKKDIGMIFQHFNLLNSATVF

SEQ ID NO: 1657855 - protein, 17 aa, Staphylococcus aureus
EKQLNWDGVEIIYNNMN

SEQ ID NO: 1657856 - protein, 20 aa, Staphylococcus aureus
EKRFKQADVFEDLYREKLKD

SEQ ID NO: 1657857 - protein, 27 aa, Staphylococcus aureus
EKYKLTIPEIFCKHGEQYFRNLEFTCL

SEQ ID NO: 1657858 - protein, 25 aa, Staphylococcus aureus
ELKIWERWLHKQGYKDIHLDITAQP

SEQ ID NO: 1657859 - protein, 17 aa, Staphylococcus aureus
ELPVRTVEIENEPYFVG

SEQ ID NO: 1657860 - protein, 20 aa, Staphylococcus aureus
ELVELHLNYEKQLNWDGVEI

SEQ ID NO: 1657861 - protein, 17 aa, Staphylococcus aureus
EPIDLELLIAIVSVKFD

SEQ ID NO: 1657862 - protein, 21 aa, Staphylococcus aureus
EPLMRRDLDVLIAKLNQIDGI

SEQ ID NO: 1657863 - protein, 19 aa, Staphylococcus aureus
EQIYPIYLDCFKKAKKMIG

SEQ ID NO: 1657864 - protein, 25 aa, Staphylococcus aureus
EQLDLVYRGSFIMRYLLDGRVPNLP

SEQ ID NO: 1657865 - protein, 20 aa, Staphylococcus aureus
EQLVGFAFVNTTPFQRIKHV

SEQ ID NO: 1657866 - protein, 20 aa, Staphylococcus aureus
ESQLPVLVKHALEENHATNN

SEQ ID NO: 1657867 - protein, 18 aa, Staphylococcus aureus
ETELRAVINSMSQNEGKS

SEQ ID NO: 1657868 - protein, 37 aa, Staphylococcus aureus
EVDGKQLYAWCALDTLMFPALIGRTVHIASPCHGTGK

SEQ ID NO: 1657869 - protein, 20 aa, Staphylococcus aureus
EVGQGLSCIAVRADIDALPI

SEQ ID NO: 1657870 - protein, 25 aa, Staphylococcus aureus
EVLQGYSHRIYCFIRADNEEIAWYK

SEQ ID NO: 1657871 - protein, 25 aa, Staphylococcus aureus
EYQKLEYNYNVLRQFGLQNNGQPVI

SEQ ID NO: 1657872 - protein, 23 aa, Staphylococcus aureus
FDDLWMNLYYLFKNLRNLFKTEG

SEQ ID NO: 1657873 - protein, 24 aa, Staphylococcus aureus
FDGKTKLVYIKSIQDLTESVKEEV

SEQ ID NO: 1657874 - protein, 19 aa, Staphylococcus aureus
FDKALPVAIREARAFINTQ

SEQ ID NO: 1657875 - protein, 18 aa, Staphylococcus aureus
FDKYNSFMLFGVQVVQTG

SEQ ID NO: 1657876 - protein, 18 aa, Staphylococcus aureus
FEADIVIHGAGRVPALDM

SEQ ID NO: 1657877 - protein, 18 aa, Staphylococcus aureus
FESQAKYSYLIVEKGFAK

SEQ ID NO: 1657878 - protein, 17 aa, Staphylococcus aureus
FGDNWKKAQEVGNEIGE

SEQ ID NO: 1657879 - protein, 17 aa, Staphylococcus aureus
FGGGYGHTAIVLNGDYD

SEQ ID NO: 1657880 - protein, 17 aa, Staphylococcus aureus
FIIKLAKAIGIVGGVNA

SEQ ID NO: 1657881 - protein, 17 aa, Staphylococcus aureus
FKHPLDQILLARVSMSS

SEQ ID NO: 1657882 - protein, 22 aa, Staphylococcus aureus
FLRPEIKFDGIDPLVKQMNDDK

SEQ ID NO: 1657883 - protein, 17 aa, Staphylococcus aureus
FNSGYILISTGYKSFNE

SEQ ID NO: 1657884 - protein, 17 aa, Staphylococcus aureus
FPKLQSIQLEDHKQHDV

SEQ ID NO: 1657885 - protein, 17 aa, Staphylococcus aureus
FQPKSNFFEVIKAVADD

SEQ ID NO: 1657886 - protein, 17 aa, Staphylococcus aureus
FSMSKIVHHPQIQIPSD

SEQ ID NO: 1657887 - protein, 18 aa, Staphylococcus aureus
FTPKFNFNDYHIMIVHPW

SEQ ID NO: 1657888 - protein, 25 aa, Staphylococcus aureus
GAYCINGYRWITYIANSGQRRYIAT

SEQ ID NO: 1657889 - protein, 22 aa, Staphylococcus aureus
GCGKSTLLKALSRLLAVKEGEV

SEQ ID NO: 1657890 - protein, 18 aa, Staphylococcus aureus
GDFTEFGNPFGGGKISLN

SEQ ID NO: 1657891 - protein, 20 aa, Staphylococcus aureus
GDVTLGPQFVYVAAYEGGIV

SEQ ID NO: 1657892 - protein, 20 aa, Staphylococcus aureus
GEIKRVIVHLPNFESDTDTF

SEQ ID NO: 1657893 - protein, 18 aa, Staphylococcus aureus
GEVPKLYLTSHMDTVVPA

SEQ ID NO: 1657894 - protein, 17 aa, Staphylococcus aureus
GGRIMCLHYEGILQERL

SEQ ID NO: 1657895 - protein, 18 aa, Staphylococcus aureus
GHEPWTSCEFDFTSEGKL

SEQ ID NO: 1657896 - protein, 17 aa, Staphylococcus aureus
GHPGLPMGAAPMAYTLW

SEQ ID NO: 1657897 - protein, 24 aa, Staphylococcus aureus
GIQLKDFMFEGAVSENDYFEYIDI

SEQ ID NO: 1657898 - protein, 21 aa, Staphylococcus aureus
GKDLSIVLVDFGKKQNIVREL

SEQ ID NO: 1657899 - protein, 19 aa, Staphylococcus aureus
GKLNVVFDYVDWMNSEFGP

SEQ ID NO: 1657900 - protein, 17 aa, Staphylococcus aureus
GKTFSKGLLMGARGNSG

SEQ ID NO: 1657901 - protein, 20 aa, Staphylococcus aureus
GKTGAFGIPLIEKVLGKQGV

SEQ ID NO: 1657902 - protein, 29 aa, Staphylococcus aureus
GKTTLMRHIVSFLKSHGYTVATIKHHGHG

SEQ ID NO: 1657903 - protein, 21 aa, Staphylococcus aureus
GLKAFKNVFKGFVDKVKDKTA

SEQ ID NO: 1657904 - protein, 23 aa, Staphylococcus aureus
GLKAFKNVFKGFVDKVKDKTAQF

SEQ ID NO: 1657905 - protein, 18 aa, Staphylococcus aureus
GQNMTKAQVEAALNQVTT

SEQ ID NO: 1657906 - protein, 18 aa, Staphylococcus aureus
GTDLPGQIARKVDTDILR

SEQ ID NO: 1657907 - protein, 18 aa, Staphylococcus aureus
GTIALVVLDGVSLIKRVD

SEQ ID NO: 1657908 - protein, 26 aa, Staphylococcus aureus
GYAIKKEIIEELGFDFSISHNPYTES

SEQ ID NO: 1657909 - protein, 18 aa, Staphylococcus aureus
GYLDHFDMDFLYLTDTQN

SEQ ID NO: 1657910 - protein, 20 aa, Staphylococcus aureus
HARDVIKFKHLEIDNDAHRV

SEQ ID NO: 1657911 - protein, 17 aa, Staphylococcus aureus
HDITPLIKELKDMIKQH

SEQ ID NO: 1657912 - protein, 17 aa, Staphylococcus aureus
HEFLDFFDIEVFNNLDK

SEQ ID NO: 1657913 - protein, 22 aa, Staphylococcus aureus
HEPRIKFKSWSDIDEDKLEQDL

SEQ ID NO: 1657914 - protein, 17 aa, Staphylococcus aureus
HIMDVISTFAISYDGYI

SEQ ID NO: 1657915 - protein, 17 aa, Staphylococcus aureus
HKLKQNIIDEIKRLALK

SEQ ID NO: 1657916 - protein, 23 aa, Staphylococcus aureus
HLPFKKERISEVELHQYIDGLID

SEQ ID NO: 1657917 - protein, 18 aa, Staphylococcus aureus
HNIYYGRDIPIIGSSGVV

SEQ ID NO: 1657918 - protein, 17 aa, Staphylococcus aureus
HPIWQRFGSYTGGLNFN

SEQ ID NO: 1657919 - protein, 25 aa, Staphylococcus aureus
HTTDRKGHGIGMLEWALDYIVGNIE

SEQ ID NO: 1657920 - protein, 26 aa, Staphylococcus aureus
IADLDFKLNLMLNAFSSDFYYFVKHN

SEQ ID NO: 1657921 - protein, 27 aa, Staphylococcus aureus
IANEISGMIPVEWEKVYTIAYVNDRGG

SEQ ID NO: 1657922 - protein, 19 aa, Staphylococcus aureus
IDDNFHIINNLDLPYVYIP

SEQ ID NO: 1657923 - protein, 24 aa, Staphylococcus aureus
IDGFGELFRYLSYVEDVGTRALLS

SEQ ID NO: 1657924 - protein, 18 aa, Staphylococcus aureus
IDKLDYLKDFGIDVIWLS

SEQ ID NO: 1657925 - protein, 20 aa, Staphylococcus aureus
IDSYFPIKHPFEQALYQTYL

SEQ ID NO: 1657926 - protein, 24 aa, Staphylococcus aureus
IDYKQVIDFIVKFITTHDLNVQAV

SEQ ID NO: 1657927 - protein, 19 aa, Staphylococcus aureus
IDYLSRINVPYQFEDGPGD

SEQ ID NO: 1657928 - protein, 18 aa, Staphylococcus aureus
IEELKAYIDSGGKISQTT

SEQ ID NO: 1657929 - protein, 20 aa, Staphylococcus aureus
IEINAYIPGIGHNLQEHSVV

SEQ ID NO: 1657930 - protein, 17 aa, Staphylococcus aureus
IELSSGWNYNSKLETGK

SEQ ID NO: 1657931 - protein, 19 aa, Staphylococcus aureus
IELTNKYGIEFNFDKYNSF

SEQ ID NO: 1657932 - protein, 25 aa, Staphylococcus aureus
IFKNSWFKVYRMFDELRETFKKEDL

SEQ ID NO: 1657933 - protein, 18 aa, Staphylococcus aureus
IGLFIPHQANIRIMESAR

SEQ ID NO: 1657934 - protein, 19 aa, Staphylococcus aureus
IHRMLEATEGLPINVGFTG

SEQ ID NO: 1657935 - protein, 17 aa, Staphylococcus aureus
IIANYGAGFNNIDIEYA

SEQ ID NO: 1657936 - protein, 17 aa, Staphylococcus aureus
IKDAFLNEDIDILHQQS

SEQ ID NO: 1657937 - protein, 18 aa, Staphylococcus aureus
IKGKNDWIGHKLDDGIDS

SEQ ID NO: 1657938 - protein, 34 aa, Staphylococcus aureus
IKKLEGSFHFETFISLTCQKCPDVVQALNLMSVI

SEQ ID NO: 1657939 - protein, 21 aa, Staphylococcus aureus
ILESKIVRLFQAFIKDKMDQL

SEQ ID NO: 1657940 - protein, 20 aa, Staphylococcus aureus
ILKKKVAYEEAFYDFEPEKV

SEQ ID NO: 1657941 - protein, 23 aa, Staphylococcus aureus
INKEMFKRQGGYGRGRRMQIEKD

SEQ ID NO: 1657942 - protein, 24 aa, Staphylococcus aureus
INNEFRFQILVKYKSEPGLLQAIQ

SEQ ID NO: 1657943 - protein, 19 aa, Staphylococcus aureus
INVNKEFSNSHFAIVMNKN

SEQ ID NO: 1657944 - protein, 17 aa, Staphylococcus aureus
IPDSFVIAGNVGTPEGV

SEQ ID NO: 1657945 - protein, 21 aa, Staphylococcus aureus
IPFAFFKQHVTDFDIPGEGEY

SEQ ID NO: 1657946 - protein, 17 aa, Staphylococcus aureus
IPVNRFINSDAQKRSNA

SEQ ID NO: 1657947 - protein, 27 aa, Staphylococcus aureus
IQGNTVCYMWLRFNMDQQFEDTAINQY

SEQ ID NO: 1657948 - protein, 18 aa, Staphylococcus aureus
IRLKYRYLDLRRHELAQT

SEQ ID NO: 1657949 - protein, 19 aa, Staphylococcus aureus
IRLYIPLNERISADDYRKY

SEQ ID NO: 1657950 - protein, 18 aa, Staphylococcus aureus
IRMYLKDAHYTYSSRRYL

SEQ ID NO: 1657951 - protein, 18 aa, Staphylococcus aureus
ISENFQIFDFELSDEQMT

SEQ ID NO: 1657952 - protein, 19 aa, Staphylococcus aureus
ISKRIKDAFLNEDIDILHQ

SEQ ID NO: 1657953 - protein, 21 aa, Staphylococcus aureus
ISRILKFPNNREVAMDIVKSN

SEQ ID NO: 1657954 - protein, 17 aa, Staphylococcus aureus
ITRGDIFVRDAIKEHMA

SEQ ID NO: 1657955 - protein, 18 aa, Staphylococcus aureus
IVDWFLKAREKYGLEKVI

SEQ ID NO: 1657956 - protein, 20 aa, Staphylococcus aureus
IYLDCFKKAKKMIGAYIIPT

SEQ ID NO: 1657957 - protein, 28 aa, Staphylococcus aureus
KAEPGDLVVFSGRFGGGYGHTAIVLNGD

SEQ ID NO: 1657958 - protein, 20 aa, Staphylococcus aureus
KANFKGAAQGDWVKSAMSEI

SEQ ID NO: 1657959 - protein, 22 aa, Staphylococcus aureus
KAYFKKCLPGYTLINKLHPSIE

SEQ ID NO: 1657960 - protein, 24 aa, Staphylococcus aureus
KCNSEAKYYLNIIEGEWHPQDLND

SEQ ID NO: 1657961 - protein, 19 aa, Staphylococcus aureus
KDFKTFNVEGLDARMEALN

SEQ ID NO: 1657962 - protein, 17 aa, Staphylococcus aureus
KDNYRMIVNSDKKHLPD

SEQ ID NO: 1657963 - protein, 17 aa, Staphylococcus aureus
KEQFKALWQIRDDRYSD

SEQ ID NO: 1657964 - protein, 19 aa, Staphylococcus aureus
KGNASEILALIDDTATMKG

SEQ ID NO: 1657965 - protein, 19 aa, Staphylococcus aureus
KHGLTCAYSTFRAYILKHD

SEQ ID NO: 1657966 - protein, 26 aa, Staphylococcus aureus
KHRFPLKHINLGGGIGVNYADLTNQF

SEQ ID NO: 1657967 - protein, 19 aa, Staphylococcus aureus
KILLCDEATSALDPATTAS

SEQ ID NO: 1657968 - protein, 20 aa, Staphylococcus aureus
KIRKNLRHAIEMLNVKKKEF

SEQ ID NO: 1657969 - protein, 19 aa, Staphylococcus aureus
KKAETLLTREEYAQCEDMG

SEQ ID NO: 1657970 - protein, 20 aa, Staphylococcus aureus
KKIMKNYNWEYFKAQINQKL

SEQ ID NO: 1657971 - protein, 18 aa, Staphylococcus aureus
KKKINAIMTKFRSNPPQE

SEQ ID NO: 1657972 - protein, 17 aa, Staphylococcus aureus
KLYFKKAKSWSEKHRFP

SEQ ID NO: 1657973 - protein, 25 aa, Staphylococcus aureus
KMTKKEFIDIPVLFDDEGNFRIKQV

SEQ ID NO: 1657974 - protein, 38 aa, Staphylococcus aureus
KPLKENIEIALKLLKILLKELERVLGRNTFAERVNKLT

SEQ ID NO: 1657975 - protein, 18 aa, Staphylococcus aureus
KPTFNDWGECATRIVSIY

SEQ ID NO: 1657976 - protein, 26 aa, Staphylococcus aureus
KQELNGDERLRVAKQNANTAIDALTQ

SEQ ID NO: 1657977 - protein, 20 aa, Staphylococcus aureus
KQLFMPIRVAVTGQMHGPEL

SEQ ID NO: 1657978 - protein, 22 aa, Staphylococcus aureus
KQQAKDALRQMTHLSDAQKQSI

SEQ ID NO: 1657979 - protein, 20 aa, Staphylococcus aureus
KQTFGVPSYQGYIDVSETLK

SEQ ID NO: 1657980 - protein, 36 aa, Staphylococcus aureus
KRILKSYPYMLSGGMLQRLMIALALALKPKLIIADE

SEQ ID NO: 1657981 - protein, 23 aa, Staphylococcus aureus
KRMTRIAQTINRFGYTIRGIYGE

SEQ ID NO: 1657982 - protein, 20 aa, Staphylococcus aureus
KRTNEDFAAFKVLIDEDHDQ

SEQ ID NO: 1657983 - protein, 30 aa, Staphylococcus aureus
KSGGRKPILLKVNHLYGYFISLDLTYSSVE

SEQ ID NO: 1657984 - protein, 17 aa, Staphylococcus aureus
KSKSEKVIDFFKDNKRI

SEQ ID NO: 1657985 - protein, 25 aa, Staphylococcus aureus
KSYFFPSKLAFALFFIKQLEITEHH

SEQ ID NO: 1657986 - protein, 19 aa, Staphylococcus aureus
KTLSSRYYTNWNTIEKQVN

SEQ ID NO: 1657987 - protein, 18 aa, Staphylococcus aureus
KVFPELAAKGGNAKQIME

SEQ ID NO: 1657988 - protein, 27 aa, Staphylococcus aureus
KVGASVFTGFGPRIVRINNFSVDLKPN

SEQ ID NO: 1657989 - protein, 21 aa, Staphylococcus aureus
KVSGIGAIRGMTSFGAYINEA

SEQ ID NO: 1657990 - protein, 18 aa, Staphylococcus aureus
KVYRGMGSLGAMEKGSND

SEQ ID NO: 1657991 - protein, 19 aa, Staphylococcus aureus
KYFMRDIISYIGIDQSRIV

SEQ ID NO: 1657992 - protein, 18 aa, Staphylococcus aureus
KYGEKYYAIIGAQNNDQQ

SEQ ID NO: 1657993 - protein, 23 aa, Staphylococcus aureus
KYKIYGTWYPFYKKNDGNLTKQF

SEQ ID NO: 1657994 - protein, 22 aa, Staphylococcus aureus
LAEAKAAAKQNLGTLNHITNAQ

SEQ ID NO: 1657995 - protein, 22 aa, Staphylococcus aureus
LALKEEGYRVILVNSNPATIMT

SEQ ID NO: 1657996 - protein, 19 aa, Staphylococcus aureus
LDDYRIIKSALYGNQSRTT

SEQ ID NO: 1657997 - protein, 19 aa, Staphylococcus aureus
LDEAVGIMTGQVVYKYEEE

SEQ ID NO: 1657998 - protein, 24 aa, Staphylococcus aureus
LDGDTRGGVALSIRSVTQKPIKFV

SEQ ID NO: 1657999 - protein, 17 aa, Staphylococcus aureus
LDINVNRIGIKGGDNNR

SEQ ID NO: 1658000 - protein, 23 aa, Staphylococcus aureus
LEATEGLPINVGFTGKGQATNPT

SEQ ID NO: 1658001 - protein, 17 aa, Staphylococcus aureus
LEMIGLVAEVQELKANP

SEQ ID NO: 1658002 - protein, 30 aa, Staphylococcus aureus
LENRGWDFDGSYGWQCFDLVNVYWNHLYGH

SEQ ID NO: 1658003 - protein, 17 aa, Staphylococcus aureus
LFNEAIKENILIHPGEI

SEQ ID NO: 1658004 - protein, 17 aa, Staphylococcus aureus
LFSAVKISGLFKKMHVR

SEQ ID NO: 1658005 - protein, 25 aa, Staphylococcus aureus
LGHMKEAIKYAVKFYNYPNEHILNS

SEQ ID NO: 1658006 - protein, 18 aa, Staphylococcus aureus
LHPMGGLQERIWNPLQIL

SEQ ID NO: 1658007 - protein, 22 aa, Staphylococcus aureus
LKITNLYIGQSFGTEGNRNVID

SEQ ID NO: 1658008 - protein, 19 aa, Staphylococcus aureus
LKVTPEYLLLKNRQTENEV

SEQ ID NO: 1658009 - protein, 18 aa, Staphylococcus aureus
LLHDSIRMMWLAQDQTPS

SEQ ID NO: 1658010 - protein, 22 aa, Staphylococcus aureus
LLNSAQMNIVFGGHSDEDERYI

SEQ ID NO: 1658011 - protein, 17 aa, Staphylococcus aureus
LMEQLYCQFQYDGLMKE

SEQ ID NO: 1658012 - protein, 26 aa, Staphylococcus aureus
LNFLNTKKLSIGWKIYLEKISLRDRQ

SEQ ID NO: 1658013 - protein, 19 aa, Staphylococcus aureus
LNGDAKLIAAQNAAKQHLG

SEQ ID NO: 1658014 - protein, 25 aa, Staphylococcus aureus
LPKNPRGSVKFTIKVVLTDPYKYSV

SEQ ID NO: 1658015 - protein, 17 aa, Staphylococcus aureus
LPSTSWLKDAVELNERG

SEQ ID NO: 1658016 - protein, 22 aa, Staphylococcus aureus
LQDGHVWVGYTWEGQRYYLPIR

SEQ ID NO: 1658017 - protein, 25 aa, Staphylococcus aureus
LQYMAKRRIGALIVFEKETGLQDYI

SEQ ID NO: 1658018 - protein, 19 aa, Staphylococcus aureus
LRQEIQMIFQDPFASINPR

SEQ ID NO: 1658019 - protein, 17 aa, Staphylococcus aureus
LRRFFKIYVRGIRALAN

SEQ ID NO: 1658020 - protein, 26 aa, Staphylococcus aureus
LSFGYKQGHLEPIFILGKNNKQKRDP

SEQ ID NO: 1658021 - protein, 18 aa, Staphylococcus aureus
LSKTFLIESRELTTVDFE

SEQ ID NO: 1658022 - protein, 17 aa, Staphylococcus aureus
LSLKVKWNTAEGAEDNL

SEQ ID NO: 1658023 - protein, 17 aa, Staphylococcus aureus
LSSRYYTNWDTIEKQVN

SEQ ID NO: 1658024 - protein, 31 aa, Staphylococcus aureus
LTNDMKIAYAILRDRLNLSIKNSWVDEDGNI

SEQ ID NO: 1658025 - protein, 18 aa, Staphylococcus aureus
LVTQLKKLELNYDVYLER

SEQ ID NO: 1658026 - protein, 27 aa, Staphylococcus aureus
LYKDREKMYYFAYEIKDGKAEINREID

SEQ ID NO: 1658027 - protein, 19 aa, Staphylococcus aureus
MGLGYLVNVYDAWKVEKVL

SEQ ID NO: 1658028 - protein, 20 aa, Staphylococcus aureus
MIPVEWEKVYTIAYVNDRGG

SEQ ID NO: 1658029 - protein, 26 aa, Staphylococcus aureus
MKDNANYFLSLGIKTVLITLGKQGTY

SEQ ID NO: 1658030 - protein, 27 aa, Staphylococcus aureus
MNQDLLAKCYLSCLKLADQHSLNHVAF

SEQ ID NO: 1658031 - protein, 21 aa, Staphylococcus aureus
MYKKFGVIPEMEYEMEEVKQI

SEQ ID NO: 1658032 - protein, 22 aa, Staphylococcus aureus
NAPMGSPRPRFRNTGRFVQTYM

SEQ ID NO: 1658033 - protein, 17 aa, Staphylococcus aureus
NDLNWIYLVKNLRNAGV

SEQ ID NO: 1658034 - protein, 18 aa, Staphylococcus aureus
NDNKILLTIMNIEALGTS

SEQ ID NO: 1658035 - protein, 27 aa, Staphylococcus aureus
NDPELVEKLIFMLGWDPQSPVPINDHG

SEQ ID NO: 1658036 - protein, 17 aa, Staphylococcus aureus
NELGIKQIAQRSAGFDT

SEQ ID NO: 1658037 - protein, 27 aa, Staphylococcus aureus
NGMKYYMVGSTYRFKKSDVDEFMEQLT

SEQ ID NO: 1658038 - protein, 22 aa, Staphylococcus aureus
NHLKSLKAFNYMPYFEHLDMNQ

SEQ ID NO: 1658039 - protein, 24 aa, Staphylococcus aureus
NKAYEMLQGYGFPVISRKEMQQEI

SEQ ID NO: 1658040 - protein, 28 aa, Staphylococcus aureus
NKLILFEKHFEPVLGIKMQHSGGHSFGH

SEQ ID NO: 1658041 - protein, 17 aa, Staphylococcus aureus
NLIDAEELFNLVYNANP

SEQ ID NO: 1658042 - protein, 17 aa, Staphylococcus aureus
NNYVELVSWLENPNSKK

SEQ ID NO: 1658043 - protein, 21 aa, Staphylococcus aureus
NPLKSSGFGDDWLQNAKLMNN

SEQ ID NO: 1658044 - protein, 18 aa, Staphylococcus aureus
NPPLNVKVATRLGHVKGY

SEQ ID NO: 1658045 - protein, 18 aa, Staphylococcus aureus
NRGSVPYTVFIDPPLSRV

SEQ ID NO: 1658046 - protein, 19 aa, Staphylococcus aureus
NSGQCRYIATGEVDKAGNR

SEQ ID NO: 1658047 - protein, 19 aa, Staphylococcus aureus
NTWRYRISLGKDAETGKYK

SEQ ID NO: 1658048 - protein, 18 aa, Staphylococcus aureus
NVEFNDKILINWRIIQEK

SEQ ID NO: 1658049 - protein, 17 aa, Staphylococcus aureus
NVFKGFVDKVKDKTAQF

SEQ ID NO: 1658050 - protein, 21 aa, Staphylococcus aureus
NVGTFTLAVNRTFTNAQGERE

SEQ ID NO: 1658051 - protein, 24 aa, Staphylococcus aureus
NVGTFTLAVNRTFTNAQGEREADF

SEQ ID NO: 1658052 - protein, 21 aa, Staphylococcus aureus
NWIYLVKNLRNAGVSIESLIE

SEQ ID NO: 1658053 - protein, 24 aa, Staphylococcus aureus
NYIVNGKPAIEWIIDQYNVSIDKK

SEQ ID NO: 1658054 - protein, 23 aa, Staphylococcus aureus
PASLHKPKAFFGAARNIEAGGSL

SEQ ID NO: 1658055 - protein, 19 aa, Staphylococcus aureus
PDQAFCKGTVRTFDSDIQN

SEQ ID NO: 1658056 - protein, 19 aa, Staphylococcus aureus
PETEIVKGRVRYEQNNKEY

SEQ ID NO: 1658057 - protein, 18 aa, Staphylococcus aureus
PIEKVFDAYTTKELFEKW

SEQ ID NO: 1658058 - protein, 29 aa, Staphylococcus aureus
PIKEKIQHVFKSGCGFDNDSNKGFVYTKI

SEQ ID NO: 1658059 - protein, 23 aa, Staphylococcus aureus
PISKFRIRKVLPQKIKNPVIDSS

SEQ ID NO: 1658060 - protein, 20 aa, Staphylococcus aureus
PKAKPFAKRGFSQRTTSTKK

SEQ ID NO: 1658061 - protein, 19 aa, Staphylococcus aureus
PKMMLKIILYAYELNVPSA

SEQ ID NO: 1658062 - protein, 19 aa, Staphylococcus aureus
PLCGFNEYINSEVKEYHRF

SEQ ID NO: 1658063 - protein, 20 aa, Staphylococcus aureus
PLKSSGFGDDWLQNAKLMNN

SEQ ID NO: 1658064 - protein, 23 aa, Staphylococcus aureus
PLNNDILLKFDRLSVDYTSPSGS

SEQ ID NO: 1658065 - protein, 18 aa, Staphylococcus aureus
PRDVEEVYQTNVFGIVRM

SEQ ID NO: 1658066 - protein, 19 aa, Staphylococcus aureus
PRFSTKGRYAHTYMPTKYT

SEQ ID NO: 1658067 - protein, 17 aa, Staphylococcus aureus
PSKLPPRDVEEVYQTNV

SEQ ID NO: 1658068 - protein, 17 aa, Staphylococcus aureus
PTRQIILNFGHYRFTDL

SEQ ID NO: 1658069 - protein, 26 aa, Staphylococcus aureus
QFYKGEFKSASAFPLPNAEYTPLYLN

SEQ ID NO: 1658070 - protein, 19 aa, Staphylococcus aureus
QKAKLKEQVQSATTLDGVQ

SEQ ID NO: 1658071 - protein, 24 aa, Staphylococcus aureus
QLEVPIPAIISAFEIAKAHGVTTV

SEQ ID NO: 1658072 - protein, 19 aa, Staphylococcus aureus
QLVSEAIVAKAPHNISANE

SEQ ID NO: 1658073 - protein, 20 aa, Staphylococcus aureus
QVETWWRWYRNGESYRFSQH

SEQ ID NO: 1658074 - protein, 17 aa, Staphylococcus aureus
RALGYGLHGEQVDGNDP

SEQ ID NO: 1658075 - protein, 23 aa, Staphylococcus aureus
REEIKYYIAEAIKAEKAGKKVEM

SEQ ID NO: 1658076 - protein, 27 aa, Staphylococcus aureus
RFKVIDVIKRPLIIHGKVKDNDDIIKT

SEQ ID NO: 1658077 - protein, 17 aa, Staphylococcus aureus
RFSIARELGRYLFKNTD

SEQ ID NO: 1658078 - protein, 17 aa, Staphylococcus aureus
RGIVRLVHQNHYVPLNE

SEQ ID NO: 1658079 - protein, 23 aa, Staphylococcus aureus
RGKFDVLIVLSHCGIFFDETLCQ

SEQ ID NO: 1658080 - protein, 20 aa, Staphylococcus aureus
RIITAIGYSGCEIDPNCTYV

SEQ ID NO: 1658081 - protein, 17 aa, Staphylococcus aureus
RINQGIQRLEIKQNEAV

SEQ ID NO: 1658082 - protein, 23 aa, Staphylococcus aureus
RLKHWLPVDLYIGGVEHAVLHLL

SEQ ID NO: 1658083 - protein, 24 aa, Staphylococcus aureus
RNEFGIKGKNDWIGHKLDDGIDSV

SEQ ID NO: 1658084 - protein, 18 aa, Staphylococcus aureus
RNSGIYFYNRGYEFSNIK

SEQ ID NO: 1658085 - protein, 27 aa, Staphylococcus aureus
RRCAEEGIKFIGPHLEHLDMFGDKVKA

SEQ ID NO: 1658086 - protein, 28 aa, Staphylococcus aureus
RSVKSCVGKEFCRFGTQYTTRLGIRLEK

SEQ ID NO: 1658087 - protein, 27 aa, Staphylococcus aureus
RVFYRDEFLCTAISPDLADYSIDIKEI

SEQ ID NO: 1658088 - protein, 18 aa, Staphylococcus aureus
RVTYPCAIKRYDVENNYL

SEQ ID NO: 1658089 - protein, 20 aa, Staphylococcus aureus
SAHVTACRLLKKPHIKQYIQ

SEQ ID NO: 1658090 - protein, 17 aa, Staphylococcus aureus
SAISSQIDRAGHVSEVT

SEQ ID NO: 1658091 - protein, 22 aa, Staphylococcus aureus
SDDDIFMINRFVSAVEREIGYR

SEQ ID NO: 1658092 - protein, 22 aa, Staphylococcus aureus
SEGKLNVSFGYVDWIKLSLGPL

SEQ ID NO: 1658093 - protein, 21 aa, Staphylococcus aureus
SEGKYSESVVVTGNTAIDAMK

SEQ ID NO: 1658094 - protein, 17 aa, Staphylococcus aureus
SEGSIYPVLMRLNKKGY

SEQ ID NO: 1658095 - protein, 27 aa, Staphylococcus aureus
SEVKELLECFDYLIKHKRHATRKRNYE

SEQ ID NO: 1658096 - protein, 20 aa, Staphylococcus aureus
SGRNRIELIEPLDALEFHNF

SEQ ID NO: 1658097 - protein, 20 aa, Staphylococcus aureus
SIAYKVMLDIFYPELITIGS

SEQ ID NO: 1658098 - protein, 17 aa, Staphylococcus aureus
SICKHLSIQLSENEGDI

SEQ ID NO: 1658099 - protein, 18 aa, Staphylococcus aureus
SIHKGIGAGLIINNQLYR

SEQ ID NO: 1658100 - protein, 18 aa, Staphylococcus aureus
SIIIKIFTEKGITSKDKL

SEQ ID NO: 1658101 - protein, 18 aa, Staphylococcus aureus
SKNILDFSDYEHFTLQIL

SEQ ID NO: 1658102 - protein, 23 aa, Staphylococcus aureus
SKTKCTFLSEYLYPVKFREKTRI

SEQ ID NO: 1658103 - protein, 19 aa, Staphylococcus aureus
SPLLARVTGAGCLLGGVIA

SEQ ID NO: 1658104 - protein, 20 aa, Staphylococcus aureus
SQHAGLSWLTILKKKVAYEE

SEQ ID NO: 1658105 - protein, 24 aa, Staphylococcus aureus
SQRAESFDILPLFISSRNKQIEYW

SEQ ID NO: 1658106 - protein, 18 aa, Staphylococcus aureus
SQTTLMSLFSFFQDPELE

SEQ ID NO: 1658107 - protein, 21 aa, Staphylococcus aureus
SSLPSNCQMYYAMKANSERKI

SEQ ID NO: 1658108 - protein, 17 aa, Staphylococcus aureus
SSVMFDFGVLKRPQIFY

SEQ ID NO: 1658109 - protein, 23 aa, Staphylococcus aureus
SYHPKMMLKIILYAYTQSVFSGR

SEQ ID NO: 1658110 - protein, 19 aa, Staphylococcus aureus
TENRLPFILFSASGGARMQ

SEQ ID NO: 1658111 - protein, 18 aa, Staphylococcus aureus
TFLEERGQEFIILADNGE

SEQ ID NO: 1658112 - protein, 18 aa, Staphylococcus aureus
THANGQVSYGARPTQKKP

SEQ ID NO: 1658113 - protein, 29 aa, Staphylococcus aureus
TIKYDGAYCINGYRWITYIANSGQCRYIA

SEQ ID NO: 1658114 - protein, 18 aa, Staphylococcus aureus
TKNLEDFYDKEGFRDQEF

SEQ ID NO: 1658115 - protein, 42 aa, Staphylococcus aureus
TLDPRVEKLMQAFWPGPISFILPLKLGYLCRKVSGGLSSVAV

SEQ ID NO: 1658116 - protein, 24 aa, Staphylococcus aureus
TLKLQRMGVLPKFHGGTKKKKWME

SEQ ID NO: 1658117 - protein, 24 aa, Staphylococcus aureus
TLNEYRKLIEIKAVKDKEEDTYRG

SEQ ID NO: 1658118 - protein, 32 aa, Staphylococcus aureus
TLQSFAESFMRPCQLAKMISRYMIINETDRIL

SEQ ID NO: 1658119 - protein, 17 aa, Staphylococcus aureus
TLTELHGAPGFEEEVKN

SEQ ID NO: 1658120 - protein, 21 aa, Staphylococcus aureus
TTTATALQWLLFDKGLDGSTK

SEQ ID NO: 1658121 - protein, 23 aa, Staphylococcus aureus
VAGSGVYICNECIELCSEIVEEE

SEQ ID NO: 1658122 - protein, 25 aa, Staphylococcus aureus
VDKVTHLRALLQLRDVAQNNDAIKR

SEQ ID NO: 1658123 - protein, 23 aa, Staphylococcus aureus
VGGVSMRPGHEMITVEEELNRVL

SEQ ID NO: 1658124 - protein, 20 aa, Staphylococcus aureus
VGSIFLVRVGNQLKVIEKVH

SEQ ID NO: 1658125 - protein, 17 aa, Staphylococcus aureus
VGYYLRYALSYRDISEI

SEQ ID NO: 1658126 - protein, 22 aa, Staphylococcus aureus
VKEITKLNGLCLKWVAPGTRGV

SEQ ID NO: 1658127 - protein, 23 aa, Staphylococcus aureus
VKEYHRFMELIREYNIIVRASDT

SEQ ID NO: 1658128 - protein, 22 aa, Staphylococcus aureus
VKPLLTKEIDGFGELFRYLSYV

SEQ ID NO: 1658129 - protein, 20 aa, Staphylococcus aureus
VKSSEKYRDADTNKQQEYDN

SEQ ID NO: 1658130 - protein, 19 aa, Staphylococcus aureus
VMLDIFYPELITIGSNSVI

SEQ ID NO: 1658131 - protein, 22 aa, Staphylococcus aureus
VMQELTEYGLIPEDWGGETIFV

SEQ ID NO: 1658132 - protein, 17 aa, Staphylococcus aureus
VNGETFYSRVIKALEST

SEQ ID NO: 1658133 - protein, 17 aa, Staphylococcus aureus
VPDKIKALKGEDNGRSI

SEQ ID NO: 1658134 - protein, 37 aa, Staphylococcus aureus
VPLLIKKAEKAECVSRFRAGSAINGFNLSDGRSKGAT

SEQ ID NO: 1658135 - protein, 17 aa, Staphylococcus aureus
VPSMPFSPVLENEIMMN

SEQ ID NO: 1658136 - protein, 19 aa, Staphylococcus aureus
VTDKILCMNGSYVINKGDK

SEQ ID NO: 1658137 - protein, 19 aa, Staphylococcus aureus
VTSAQRVANVTSIQQTANE

SEQ ID NO: 1658138 - protein, 24 aa, Staphylococcus aureus
VYPRKGYDPTDERIKALASVENKR

SEQ ID NO: 1658139 - protein, 21 aa, Staphylococcus aureus
YDKLRFEANFTELRNRDITFI

SEQ ID NO: 1658140 - protein, 19 aa, Staphylococcus aureus
YDSFRVYKNGVEISTETNI

SEQ ID NO: 1658141 - protein, 17 aa, Staphylococcus aureus
YEGFAPSGSMLIVDALT

SEQ ID NO: 1658142 - protein, 24 aa, Staphylococcus aureus
YFIKKWQRELEALYHIKSKLNTEQ

SEQ ID NO: 1658143 - protein, 25 aa, Staphylococcus aureus
YHDIKSPMIGTFFLQDSKELTEPIV

SEQ ID NO: 1658144 - protein, 23 aa, Staphylococcus aureus
YILSELPCIVAYKNNDIVGLLTY

SEQ ID NO: 1658145 - protein, 18 aa, Staphylococcus aureus
YISDNVIPYDAFRNNFLD

SEQ ID NO: 1658146 - protein, 22 aa, Staphylococcus aureus
YKKAQAFDEILKGLPNAMQDAL

SEQ ID NO: 1658147 - protein, 19 aa, Staphylococcus aureus
YKKNRRSLQIYGFSPCHEI

SEQ ID NO: 1658148 - protein, 19 aa, Staphylococcus aureus
YKVYDEYIEIISLDSFVEN

SEQ ID NO: 1658149 - protein, 24 aa, Staphylococcus aureus
YPTISNDFLKLFGHVWLVERWMDD

SEQ ID NO: 1658150 - protein, 23 aa, Staphylococcus aureus
YYNYRKFGIIPEMEYEMEEVKQI

SEQ ID NO: 1658151 - protein, 18 aa, Staphylococcus aureus
AAPTRTEVAQHVQTATEL

SEQ ID NO: 1658152 - protein, 17 aa, Staphylococcus aureus
AEEQALFDKSVKTLEDT

SEQ ID NO: 1658153 - protein, 18 aa, Staphylococcus aureus
AGIDRILYAADYPYIEPE

SEQ ID NO: 1658154 - protein, 24 aa, Staphylococcus aureus
AGQPVELCGTYVLLASEESSYTTE

SEQ ID NO: 1658155 - protein, 26 aa, Staphylococcus aureus
AIEFARSGDTIVVWRLDRLGRNMADL

SEQ ID NO: 1658156 - protein, 18 aa, Staphylococcus aureus
AIEMANKMKDGFKNKGYR

SEQ ID NO: 1658157 - protein, 29 aa, Staphylococcus aureus
AIVTRVGVGKLCLVEFDYATSQDFLSLSS

SEQ ID NO: 1658158 - protein, 19 aa, Staphylococcus aureus
ALGADAIMLITPYYNKTNQ

SEQ ID NO: 1658159 - protein, 18 aa, Staphylococcus aureus
ANKAVAINMGAKINASAI

SEQ ID NO: 1658160 - protein, 17 aa, Staphylococcus aureus
AQVEAALNQVTTAKNAL

SEQ ID NO: 1658161 - protein, 32 aa, Staphylococcus aureus
ARLRWYQGRYIDFDGWYGYQCADLAVDYIYWL

SEQ ID NO: 1658162 - protein, 25 aa, Staphylococcus aureus
ARNVHKSVLHALDISQQEGHFIETH

SEQ ID NO: 1658163 - protein, 20 aa, Staphylococcus aureus
ASGVPDFRSMGGLFDEISKD

SEQ ID NO: 1658164 - protein, 26 aa, Staphylococcus aureus
ATGIDHNRLSLLMAVLEKKENYLLQQ

SEQ ID NO: 1658165 - protein, 23 aa, Staphylococcus aureus
AVVLPHGVLFRGAAEGIIRRYLI

SEQ ID NO: 1658166 - protein, 31 aa, Staphylococcus aureus
AYEASLSRLGLKYLDLYLVHWPGTNEAVMVD

SEQ ID NO: 1658167 - protein, 38 aa, Staphylococcus aureus
AYENPRFVEDLIRLIAADLVEFDWLEGFDIECRNEESI

SEQ ID NO: 1658168 - protein, 24 aa, Staphylococcus aureus
AYQHLKSGEGIKVLLKPLDLDENE

SEQ ID NO: 1658169 - protein, 18 aa, Staphylococcus aureus
CRSTTVPHVGNWRDKFFK

SEQ ID NO: 1658170 - protein, 25 aa, Staphylococcus aureus
CTQATEAIPNWAAENGYPVTNYEQI

SEQ ID NO: 1658171 - protein, 17 aa, Staphylococcus aureus
CVICGKPHADLAHYEAV

SEQ ID NO: 1658172 - protein, 20 aa, Staphylococcus aureus
DAEQSKKTAYDQAVAAAKAI

SEQ ID NO: 1658173 - protein, 25 aa, Staphylococcus aureus
DDIPIKEYFAGVDWGYEHYGSIVLI

SEQ ID NO: 1658174 - protein, 19 aa, Staphylococcus aureus
DDLKSYRLARDIKNQIEDE

SEQ ID NO: 1658175 - protein, 24 aa, Staphylococcus aureus
DDQNSAWMTTHFDFHSIHDNVLKL

SEQ ID NO: 1658176 - protein, 20 aa, Staphylococcus aureus
DESRNYTEIMTFEEIEEAWK

SEQ ID NO: 1658177 - protein, 28 aa, Staphylococcus aureus
DEVMTGFRVGYHCAQGYFGVTPDLTCLG

SEQ ID NO: 1658178 - protein, 26 aa, Staphylococcus aureus
DFEKHMYAIHILTSLYASTSNTPHIG

SEQ ID NO: 1658179 - protein, 28 aa, Staphylococcus aureus
DFKVIFPDYHVIGISELIPDFDVEETGS

SEQ ID NO: 1658180 - protein, 17 aa, Staphylococcus aureus
DIARMEVPFDCDEFEIN

SEQ ID NO: 1658181 - protein, 19 aa, Staphylococcus aureus
DIERELGHDISFRERNGKI

SEQ ID NO: 1658182 - protein, 26 aa, Staphylococcus aureus
DIRIEAPIPGTSRVGIEVPNQNPTTV

SEQ ID NO: 1658183 - protein, 18 aa, Staphylococcus aureus
DKANAFVNSLNGLNQQQQ

SEQ ID NO: 1658184 - protein, 23 aa, Staphylococcus aureus
DKDATRASSAYVNAEPNKKQSYD

SEQ ID NO: 1658185 - protein, 18 aa, Staphylococcus aureus
DKFFKEREGKYQVEGCFI

SEQ ID NO: 1658186 - protein, 17 aa, Staphylococcus aureus
DKGKRLELVVTDDEAQS

SEQ ID NO: 1658187 - protein, 22 aa, Staphylococcus aureus
DKQHAVTDLNQLNGLNNPQRQA

SEQ ID NO: 1658188 - protein, 17 aa, Staphylococcus aureus
DKTETLNSINFTDADQA

SEQ ID NO: 1658189 - protein, 32 aa, Staphylococcus aureus
DLKRGQRQMELIKILFQKAQEVDSIDKLDNVI

SEQ ID NO: 1658190 - protein, 20 aa, Staphylococcus aureus
DLRGMLRRMIGHPKKDRAAY

SEQ ID NO: 1658191 - protein, 23 aa, Staphylococcus aureus
DNAYSSDGYIMFGSDENYDYGAG

SEQ ID NO: 1658192 - protein, 21 aa, Staphylococcus aureus
DRVFRSLGILQNCRMITMEEA

SEQ ID NO: 1658193 - protein, 21 aa, Staphylococcus aureus
DTPEAVILSGFDPIRREIART

SEQ ID NO: 1658194 - protein, 25 aa, Staphylococcus aureus
DYERKAEERKARFLDKQKNKKTPVV

SEQ ID NO: 1658195 - protein, 18 aa, Staphylococcus aureus
EAPGIGMRFIQINDIKLA

SEQ ID NO: 1658196 - protein, 21 aa, Staphylococcus aureus
EDAYYKYAHEFSGGQRQRVGI

SEQ ID NO: 1658197 - protein, 26 aa, Staphylococcus aureus
EDWTFIKKAIAYYRFRPYAMKILKEN

SEQ ID NO: 1658198 - protein, 24 aa, Staphylococcus aureus
EEELTYRLNNGLPITKSELEEQES

SEQ ID NO: 1658199 - protein, 25 aa, Staphylococcus aureus
EEFFLKSKLPLYLYSFNYVDEYTMK

SEQ ID NO: 1658200 - protein, 19 aa, Staphylococcus aureus
EGIKLKAGDRIVYDSFRVY

SEQ ID NO: 1658201 - protein, 17 aa, Staphylococcus aureus
EGYETDGPVLIDIPVNY

SEQ ID NO: 1658202 - protein, 19 aa, Staphylococcus aureus
EHNIYYGRDIPIIGSSGVV

SEQ ID NO: 1658203 - protein, 24 aa, Staphylococcus aureus
EIMTFEEIEEAWKQSQMVYNGVFK

SEQ ID NO: 1658204 - protein, 17 aa, Staphylococcus aureus
EIYELWRQTLIQVGINR

SEQ ID NO: 1658205 - protein, 27 aa, Staphylococcus aureus
EKVRRNPYSVILFDEIEKANPQILTLL

SEQ ID NO: 1658206 - protein, 31 aa, Staphylococcus aureus
ELKQFIKSYVQSHSFIKSLVLGISGGQDSTL

SEQ ID NO: 1658207 - protein, 20 aa, Staphylococcus aureus
ELNLPTSLVDRFLGDSDEDT

SEQ ID NO: 1658208 - protein, 25 aa, Staphylococcus aureus
EPAPELVEGLKLVTEFVQDENATQE

SEQ ID NO: 1658209 - protein, 20 aa, Staphylococcus aureus
EPGVFGAAWLNDALHTEMIV

SEQ ID NO: 1658210 - protein, 19 aa, Staphylococcus aureus
EQSGSHITIDFALEQNRNV

SEQ ID NO: 1658211 - protein, 25 aa, Staphylococcus aureus
ERMEEEMFLGLRLNEGVSSSRFKKK

SEQ ID NO: 1658212 - protein, 22 aa, Staphylococcus aureus
ETSGMLAECVIFLNESFNISEN

SEQ ID NO: 1658213 - protein, 24 aa, Staphylococcus aureus
EVEAIQGFIYRRAREHNLDTPYLD

SEQ ID NO: 1658214 - protein, 26 aa, Staphylococcus aureus
EVNVGDPLVRFNLEFINNNAKSVISP

SEQ ID NO: 1658215 - protein, 19 aa, Staphylococcus aureus
EVPEYRRPASDRKISIRGA

SEQ ID NO: 1658216 - protein, 24 aa, Staphylococcus aureus
EYCKEAVDLFGCIIYPNDTEICFY

SEQ ID NO: 1658217 - protein, 20 aa, Staphylococcus aureus
EYYQLLLIKMWQLSQIYKPS

SEQ ID NO: 1658218 - protein, 21 aa, Staphylococcus aureus
FDLRSKEAFHGGHMHGTINIP

SEQ ID NO: 1658219 - protein, 23 aa, Staphylococcus aureus
FDPDFYMAQSWQRLREGKNIKKM

SEQ ID NO: 1658220 - protein, 18 aa, Staphylococcus aureus
FEIINWLFSNYKKLDEET

SEQ ID NO: 1658221 - protein, 17 aa, Staphylococcus aureus
FFGQYLLSRKGKRKIFL

SEQ ID NO: 1658222 - protein, 17 aa, Staphylococcus aureus
FHDLKVFVSEDLKDKSM

SEQ ID NO: 1658223 - protein, 25 aa, Staphylococcus aureus
FHKKSLPVPKYRYFKLNNNKIQKML

SEQ ID NO: 1658224 - protein, 20 aa, Staphylococcus aureus
FKLMFKDGEIIDFSAGKGEA

SEQ ID NO: 1658225 - protein, 26 aa, Staphylococcus aureus
FKLYECDDCSECPLKNQCMNFNSKTN

SEQ ID NO: 1658226 - protein, 17 aa, Staphylococcus aureus
FLKEIEVDRPQDTEEDY

SEQ ID NO: 1658227 - protein, 17 aa, Staphylococcus aureus
FNKRYSVIFDGTANGVG

SEQ ID NO: 1658228 - protein, 17 aa, Staphylococcus aureus
FSALDPISREKLQDDLI

SEQ ID NO: 1658229 - protein, 22 aa, Staphylococcus aureus
FSEYDLFTFFKHPSIKSMTIVT

SEQ ID NO: 1658230 - protein, 26 aa, Staphylococcus aureus
FSSLPSHIFKSITFDCGKEFSNWKTL

SEQ ID NO: 1658231 - protein, 23 aa, Staphylococcus aureus
GATLRIDICEIHIEIANYIYEEI

SEQ ID NO: 1658232 - protein, 18 aa, Staphylococcus aureus
GEEFFWSMMDEINEEEDF

SEQ ID NO: 1658233 - protein, 18 aa, Staphylococcus aureus
GEILKMTGHVHGLVLKHS

SEQ ID NO: 1658234 - protein, 23 aa, Staphylococcus aureus
GEIPREDVATVLKEIVTSNHFNH

SEQ ID NO: 1658235 - protein, 20 aa, Staphylococcus aureus
GESDSSVLLFNITKNNQPLL

SEQ ID NO: 1658236 - protein, 31 aa, Staphylococcus aureus
GGEFKAGSHCRFCKINHSCRTRAEYMQNVPQ

SEQ ID NO: 1658237 - protein, 23 aa, Staphylococcus aureus
GGTTCKLGIFTPELEQLHKWSIH

SEQ ID NO: 1658238 - protein, 18 aa, Staphylococcus aureus
GHVDFCFLELLKKGYNRD

SEQ ID NO: 1658239 - protein, 30 aa, Staphylococcus aureus
GINIGQRRLFEWLRQNGFLIKRKGVDYNMP

SEQ ID NO: 1658240 - protein, 19 aa, Staphylococcus aureus
GKRLLELYKNYKGNITRFV

SEQ ID NO: 1658241 - protein, 22 aa, Staphylococcus aureus
GKSTLLLQICASLSQKKKVLYI

SEQ ID NO: 1658242 - protein, 23 aa, Staphylococcus aureus
GMVAKRVRGGWALLEALHAPYGM

SEQ ID NO: 1658243 - protein, 17 aa, Staphylococcus aureus
GQAPKLFIGVNSAKENI

SEQ ID NO: 1658244 - protein, 18 aa, Staphylococcus aureus
GRVCPAPCESACVMKINR

SEQ ID NO: 1658245 - protein, 22 aa, Staphylococcus aureus
GSYTGGLNFNGGRHYGIDFQMP

SEQ ID NO: 1658246 - protein, 20 aa, Staphylococcus aureus
GTYDICKPLTIYGNTTLLLD

SEQ ID NO: 1658247 - protein, 28 aa, Staphylococcus aureus
GVEKAFAIQAGREIRVIVSPEEIDDLKS

SEQ ID NO: 1658248 - protein, 24 aa, Staphylococcus aureus
HAHQFKFIDDWVVIAKDIVSRYGN

SEQ ID NO: 1658249 - protein, 18 aa, Staphylococcus aureus
HDIARMEVPFDCDEYEIY

SEQ ID NO: 1658250 - protein, 32 aa, Staphylococcus aureus
HHTNPLWRVYRLVKFSKVFKNVIIIEFSKFIP

SEQ ID NO: 1658251 - protein, 18 aa, Staphylococcus aureus
HITIDFALEQNRNVYVLP

SEQ ID NO: 1658252 - protein, 17 aa, Staphylococcus aureus
HIYTTVFYDKHRRNNVT

SEQ ID NO: 1658253 - protein, 21 aa, Staphylococcus aureus
HKEGKWTGMCGEMAGDETAIP

SEQ ID NO: 1658254 - protein, 24 aa, Staphylococcus aureus
HKTPAQVVLRWHLAHNRIIIPKSQ

SEQ ID NO: 1658255 - protein, 27 aa, Staphylococcus aureus
IADLDFKLNLMLNAFSSDFYYFVKNNQ

SEQ ID NO: 1658256 - protein, 18 aa, Staphylococcus aureus
IAILIRHTMSFDNAHFFA

SEQ ID NO: 1658257 - protein, 18 aa, Staphylococcus aureus
IAISDRFKLLQSQYTDEK

SEQ ID NO: 1658258 - protein, 24 aa, Staphylococcus aureus
IAKYRFPERNRIISGLSKGVLITE

SEQ ID NO: 1658259 - protein, 30 aa, Staphylococcus aureus
IANEISGMIPVEWDQVFTIAYVNDRGGEIV

SEQ ID NO: 1658260 - protein, 31 aa, Staphylococcus aureus
IANKISSMIPVEWEKVYAMAYIDDGGGEVFY

SEQ ID NO: 1658261 - protein, 24 aa, Staphylococcus aureus
IDAGLPKRPFKPFNEAHRQTLDQL

SEQ ID NO: 1658262 - protein, 19 aa, Staphylococcus aureus
IDENISFYKLVNKFSPEVA

SEQ ID NO: 1658263 - protein, 17 aa, Staphylococcus aureus
IEGRVVSWIIDDITWSG

SEQ ID NO: 1658264 - protein, 17 aa, Staphylococcus aureus
IGAGLIINNQLYRGANG

SEQ ID NO: 1658265 - protein, 25 aa, Staphylococcus aureus
IKAAQMILDDYEWIKSGKSLKKSEK

SEQ ID NO: 1658266 - protein, 18 aa, Staphylococcus aureus
IKKVLKSKFNQIFIFTHS

SEQ ID NO: 1658267 - protein, 34 aa, Staphylococcus aureus
IKNLEGSFHFETFISLTCQKCPDVVQALNLMSVI

SEQ ID NO: 1658268 - protein, 23 aa, Staphylococcus aureus
ILALFCRIFKYKFGMNNKVVIKL

SEQ ID NO: 1658269 - protein, 17 aa, Staphylococcus aureus
ILIGKVIDFDDKVDNFD

SEQ ID NO: 1658270 - protein, 18 aa, Staphylococcus aureus
IMFPLEIAGVPRRRAKQK

SEQ ID NO: 1658271 - protein, 23 aa, Staphylococcus aureus
INCRSDCALLPKSMWPKKPSKKR

SEQ ID NO: 1658272 - protein, 23 aa, Staphylococcus aureus
INRLKLFKQHGISSKCVYVKWNP

SEQ ID NO: 1658273 - protein, 17 aa, Staphylococcus aureus
INYALNHGIDRYNFYGV

SEQ ID NO: 1658274 - protein, 18 aa, Staphylococcus aureus
IPLYLGKTLSNVKGTWII

SEQ ID NO: 1658275 - protein, 22 aa, Staphylococcus aureus
IRVFYRDEFLCTAICPEIADYS

SEQ ID NO: 1658276 - protein, 19 aa, Staphylococcus aureus
ISQTTLMSLFSFFQDPELE

SEQ ID NO: 1658277 - protein, 17 aa, Staphylococcus aureus
ITPFETRQSPNISSQLM

SEQ ID NO: 1658278 - protein, 18 aa, Staphylococcus aureus
IVYKGWLRSDQIKKLYTD

SEQ ID NO: 1658279 - protein, 17 aa, Staphylococcus aureus
KALSMWMTLKCGIVNLP

SEQ ID NO: 1658280 - protein, 19 aa, Staphylococcus aureus
KCYTFIKGYGDFDGQQTFA

SEQ ID NO: 1658281 - protein, 27 aa, Staphylococcus aureus
KDGRLFICYLGDFKSTGGIFAATENGD

SEQ ID NO: 1658282 - protein, 17 aa, Staphylococcus aureus
KDIGIVFQNPDNQFVGS

SEQ ID NO: 1658283 - protein, 27 aa, Staphylococcus aureus
KDLKQYGFKFLGPVTVFSFLEAAGLYD

SEQ ID NO: 1658284 - protein, 25 aa, Staphylococcus aureus
KEEGLEPWTSCEFDFTSEGKLKVSF

SEQ ID NO: 1658285 - protein, 24 aa, Staphylococcus aureus
KEGIELDEAVGIMAGQVIYKYEEE

SEQ ID NO: 1658286 - protein, 21 aa, Staphylococcus aureus
KEIFRSMGVAVPEGRVAFTAE

SEQ ID NO: 1658287 - protein, 21 aa, Staphylococcus aureus
KEIPNSIDLSIKFSDNKINTV

SEQ ID NO: 1658288 - protein, 20 aa, Staphylococcus aureus
KELKVFKSKWQVLNKGMINL

SEQ ID NO: 1658289 - protein, 17 aa, Staphylococcus aureus
KEVWKKYIDELFKKLNV

SEQ ID NO: 1658290 - protein, 19 aa, Staphylococcus aureus
KEYLNQFFGSKRYLYQDNE

SEQ ID NO: 1658291 - protein, 21 aa, Staphylococcus aureus
KEYPNALLHWEDFGRGHAKNI

SEQ ID NO: 1658292 - protein, 21 aa, Staphylococcus aureus
KFKEAMFLKGFNLSDLSRETG

SEQ ID NO: 1658293 - protein, 19 aa, Staphylococcus aureus
KFNGLKGQGVLLVNHIQNI

SEQ ID NO: 1658294 - protein, 24 aa, Staphylococcus aureus
KIDMSEIKTALIAVGPENDKGKRL

SEQ ID NO: 1658295 - protein, 18 aa, Staphylococcus aureus
KIYGSPIIECNERMIRLS

SEQ ID NO: 1658296 - protein, 29 aa, Staphylococcus aureus
KLKEILMQWQRGIYDGGGWNAIFWCNHDQ

SEQ ID NO: 1658297 - protein, 18 aa, Staphylococcus aureus
KLNVSFDYIDWINTEFDQ

SEQ ID NO: 1658298 - protein, 17 aa, Staphylococcus aureus
KNDMDWIKKNYDLYSKL

SEQ ID NO: 1658299 - protein, 20 aa, Staphylococcus aureus
KNGQLKPGYNLQIATNSQFV

SEQ ID NO: 1658300 - protein, 19 aa, Staphylococcus aureus
KNKIINFNGFEFKVSAMKR

SEQ ID NO: 1658301 - protein, 22 aa, Staphylococcus aureus
KNVSGKMSFIYADAQTHHIIDI

SEQ ID NO: 1658302 - protein, 17 aa, Staphylococcus aureus
KPIGTLLSALSVDINPI

SEQ ID NO: 1658303 - protein, 19 aa, Staphylococcus aureus
KPQAKQAIADKVQAQETAI

SEQ ID NO: 1658304 - protein, 20 aa, Staphylococcus aureus
KRGDLPSSFPKLDVDNRFYY

SEQ ID NO: 1658305 - protein, 19 aa, Staphylococcus aureus
KRIENFKFFGQYANLKELK

SEQ ID NO: 1658306 - protein, 17 aa, Staphylococcus aureus
KRIKDAFLNEDIDILHQ

SEQ ID NO: 1658307 - protein, 18 aa, Staphylococcus aureus
KRKYYRPRKMNRFLKHVV

SEQ ID NO: 1658308 - protein, 17 aa, Staphylococcus aureus
KRQINMVTETITVRETL

SEQ ID NO: 1658309 - protein, 19 aa, Staphylococcus aureus
KSAGTKVVPFISVKESKDI

SEQ ID NO: 1658310 - protein, 20 aa, Staphylococcus aureus
KSRLDSRLVEVFEQLKDIQG

SEQ ID NO: 1658311 - protein, 30 aa, Staphylococcus aureus
KTKAQDLDGAMQRLQSAIANKDQTKASENY

SEQ ID NO: 1658312 - protein, 20 aa, Staphylococcus aureus
KTTLATRENNAFIIDIHEDG

SEQ ID NO: 1658313 - protein, 23 aa, Staphylococcus aureus
KTTTATALQWLLFDKGLDGSTKS

SEQ ID NO: 1658314 - protein, 25 aa, Staphylococcus aureus
KVFSEDVWNIMGYKKYNEYFTNRDD

SEQ ID NO: 1658315 - protein, 20 aa, Staphylococcus aureus
KVIAPFNGLISMIVPTKHAV

SEQ ID NO: 1658316 - protein, 19 aa, Staphylococcus aureus
KYVHLLSEYGVWHPRAWEF

SEQ ID NO: 1658317 - protein, 17 aa, Staphylococcus aureus
LAQLVIVPIWTPELKQV

SEQ ID NO: 1658318 - protein, 17 aa, Staphylococcus aureus
LDMDLIYRRLDEIPNLR

SEQ ID NO: 1658319 - protein, 20 aa, Staphylococcus aureus
LEILDLLSCGELCACDLLAH

SEQ ID NO: 1658320 - protein, 17 aa, Staphylococcus aureus
LEPIRYVTYSYHFKSVF

SEQ ID NO: 1658321 - protein, 18 aa, Staphylococcus aureus
LFGLGIRHLGVKASQVLA

SEQ ID NO: 1658322 - protein, 27 aa, Staphylococcus aureus
LKECNLYRLLREISMESVKCIEPMNDV

SEQ ID NO: 1658323 - protein, 23 aa, Staphylococcus aureus
LKKEVLKKVSLDLDIKRIVNSLS

SEQ ID NO: 1658324 - protein, 19 aa, Staphylococcus aureus
LKKIRMHITQGIMSGEGYS

SEQ ID NO: 1658325 - protein, 27 aa, Staphylococcus aureus
LKKKVDFYRYTLGYLFQNFALLENQTI

SEQ ID NO: 1658326 - protein, 18 aa, Staphylococcus aureus
LKSSPFVWFKDALDGYDY

SEQ ID NO: 1658327 - protein, 18 aa, Staphylococcus aureus
LLHIKRSKTILFTSDSRP

SEQ ID NO: 1658328 - protein, 36 aa, Staphylococcus aureus
LLHRENEAVLQYCVDHLITFIPYFPLASGILAGKYD

SEQ ID NO: 1658329 - protein, 24 aa, Staphylococcus aureus
LLITMAVVTWKVWKIERNTRKPVI

SEQ ID NO: 1658330 - protein, 17 aa, Staphylococcus aureus
LLKEAKKPVVLAGAGIN

SEQ ID NO: 1658331 - protein, 22 aa, Staphylococcus aureus
LMIKGANVMNGYLYPTDLTGTF

SEQ ID NO: 1658332 - protein, 20 aa, Staphylococcus aureus
LNHAMPILLVSGYDDSLGDY

SEQ ID NO: 1658333 - protein, 18 aa, Staphylococcus aureus
LNTAMGQLQHGIDDENAT

SEQ ID NO: 1658334 - protein, 17 aa, Staphylococcus aureus
LPIAVRYDGQKAAVAHG

SEQ ID NO: 1658335 - protein, 17 aa, Staphylococcus aureus
LRNANMVRHEKLELPAS

SEQ ID NO: 1658336 - protein, 21 aa, Staphylococcus aureus
LRTELKITHKKQIHFLNYMKT

SEQ ID NO: 1658337 - protein, 21 aa, Staphylococcus aureus
LSQNIPVFFSANMSYGVHALT

SEQ ID NO: 1658338 - protein, 17 aa, Staphylococcus aureus
LSRTYEWIRDIGKDMGR

SEQ ID NO: 1658339 - protein, 26 aa, Staphylococcus aureus
LTNSEIKALAKMYLTNDVEIKTAQLK

SEQ ID NO: 1658340 - protein, 22 aa, Staphylococcus aureus
LYDTLLMNYNFVIIDTPPVNTV

SEQ ID NO: 1658341 - protein, 28 aa, Staphylococcus aureus
MEFQKFIVGSLYGWRRGQYRMFTKAYIS

SEQ ID NO: 1658342 - protein, 17 aa, Staphylococcus aureus
MKGKQILGVDPAFRTGC

SEQ ID NO: 1658343 - protein, 21 aa, Staphylococcus aureus
MKLLDRGRISILNTKTNKDCI

SEQ ID NO: 1658344 - protein, 22 aa, Staphylococcus aureus
MNRQKIDPIISIITAFTEARMH

SEQ ID NO: 1658345 - protein, 23 aa, Staphylococcus aureus
MRAGELLALKWSDIDFENNTINI

SEQ ID NO: 1658346 - protein, 20 aa, Staphylococcus aureus
MSNLKQGIANKDTVKASENY

SEQ ID NO: 1658347 - protein, 21 aa, Staphylococcus aureus
MYKKFGVLPEMEYEMEEIKEI

SEQ ID NO: 1658348 - protein, 18 aa, Staphylococcus aureus
MYLRDGIKEHFILKKVRK

SEQ ID NO: 1658349 - protein, 19 aa, Staphylococcus aureus
NAFSSDFYYFVKNNQKLTK

SEQ ID NO: 1658350 - protein, 27 aa, Staphylococcus aureus
NANHFGGEMKKMWSGIKGIPSKLSSSW

SEQ ID NO: 1658351 - protein, 19 aa, Staphylococcus aureus
NATIAIAVGHELGLIYNTI

SEQ ID NO: 1658352 - protein, 22 aa, Staphylococcus aureus
NEAHQLLKLVGMFAKAQQYIGY

SEQ ID NO: 1658353 - protein, 24 aa, Staphylococcus aureus
NEAYCLDCKFLSAHFNLMEQLYCQ

SEQ ID NO: 1658354 - protein, 29 aa, Staphylococcus aureus
NEKKKVTAFDFFQDNGFGFITPYNLDDLN

SEQ ID NO: 1658355 - protein, 25 aa, Staphylococcus aureus
NEMIPVEWEKVYVIAYVDDGGGQVI

SEQ ID NO: 1658356 - protein, 21 aa, Staphylococcus aureus
NIGGWTYPEGIQVIGVTTVHE

SEQ ID NO: 1658357 - protein, 20 aa, Staphylococcus aureus
NIIFRRDIFELNDIRDDDLK

SEQ ID NO: 1658358 - protein, 17 aa, Staphylococcus aureus
NKILIGKVIDFDDKVDN

SEQ ID NO: 1658359 - protein, 19 aa, Staphylococcus aureus
NKLNEVLAAMGLSDKSIEG

SEQ ID NO: 1658360 - protein, 17 aa, Staphylococcus aureus
NLKEYRKYYEPLIHKND

SEQ ID NO: 1658361 - protein, 25 aa, Staphylococcus aureus
NLKVREIKGLITAKILRAQEMNIPI

SEQ ID NO: 1658362 - protein, 21 aa, Staphylococcus aureus
NLMQAEALRSLKAIRDKTKDK

SEQ ID NO: 1658363 - protein, 30 aa, Staphylococcus aureus
NMHPDLVKIVGRLNYRTSYGQNVLKHSIEV

SEQ ID NO: 1658364 - protein, 37 aa, Staphylococcus aureus
NMLPVMRSDIMLRYKDKCLIIDAKFYKNTLHNYYDTK

SEQ ID NO: 1658365 - protein, 19 aa, Staphylococcus aureus
NMQSAYYYNIFVQKVFLKA

SEQ ID NO: 1658366 - protein, 21 aa, Staphylococcus aureus
NNAQRQLAIQQINNAETLNKA

SEQ ID NO: 1658367 - protein, 22 aa, Staphylococcus aureus
NNIRLLKDYGVSIYPANISESY

SEQ ID NO: 1658368 - protein, 24 aa, Staphylococcus aureus
NNRYKNVLDYILGLEVGLSSNDKK

SEQ ID NO: 1658369 - protein, 26 aa, Staphylococcus aureus
NPIELKNRIGFVYSENYFNERWTTKQ

SEQ ID NO: 1658370 - protein, 19 aa, Staphylococcus aureus
NSELLDADFGYAIDASADV

SEQ ID NO: 1658371 - protein, 23 aa, Staphylococcus aureus
NSGSNLDKAAVENALSQVTNAKG

SEQ ID NO: 1658372 - protein, 23 aa, Staphylococcus aureus
NSMNCLMEVLGLTLPYNGTALAV

SEQ ID NO: 1658373 - protein, 32 aa, Staphylococcus aureus
NYLKKRQNSFLSMLKRSWKKNTVKKIFYMRQY

SEQ ID NO: 1658374 - protein, 32 aa, Staphylococcus aureus
NYNPIVSFCDFYGLELPKLPILNPEFNNPLFL

SEQ ID NO: 1658375 - protein, 19 aa, Staphylococcus aureus
PFNPPMFARVFRKHLEGGI

SEQ ID NO: 1658376 - protein, 18 aa, Staphylococcus aureus
PGSKEMILILDFTEATNL

SEQ ID NO: 1658377 - protein, 18 aa, Staphylococcus aureus
PKADVERAMQAVTQANTA

SEQ ID NO: 1658378 - protein, 25 aa, Staphylococcus aureus
PKQQLPYFISFLSFHQYSIFQVLSP

SEQ ID NO: 1658379 - protein, 20 aa, Staphylococcus aureus
PMLDILKKLDVHNACVVVTR

SEQ ID NO: 1658380 - protein, 25 aa, Staphylococcus aureus
PNDEMKGRIIGREGRNIRTLETLTG

SEQ ID NO: 1658381 - protein, 18 aa, Staphylococcus aureus
PNEFLKHSGKVHAQAFFT

SEQ ID NO: 1658382 - protein, 18 aa, Staphylococcus aureus
PRSGYFVSKIESLTILNN

SEQ ID NO: 1658383 - protein, 17 aa, Staphylococcus aureus
PSILRLVKQVIEASHKE

SEQ ID NO: 1658384 - protein, 31 aa, Staphylococcus aureus
QDMLIPWEMIPRCPKCDAPMEVNKRKAEVGM

SEQ ID NO: 1658385 - protein, 17 aa, Staphylococcus aureus
QHARSQRRKHLKQNIAS

SEQ ID NO: 1658386 - protein, 17 aa, Staphylococcus aureus
QLAKRKNATLKFIPMTA

SEQ ID NO: 1658387 - protein, 21 aa, Staphylococcus aureus
QLELLRILFNYDRLSQYDLTM

SEQ ID NO: 1658388 - protein, 19 aa, Staphylococcus aureus
QLTIMCKLGWDNDKVILFL

SEQ ID NO: 1658389 - protein, 23 aa, Staphylococcus aureus
QNKTEFDDMISLMGMHLENDLDY

SEQ ID NO: 1658390 - protein, 25 aa, Staphylococcus aureus
QSKTKCTFLSEYLYPVKFREKTRIG

SEQ ID NO: 1658391 - protein, 22 aa, Staphylococcus aureus
QVIDKPHIVFMMTFPEDIKPII

SEQ ID NO: 1658392 - protein, 17 aa, Staphylococcus aureus
QVRRLLKKYGYPPDLQK

SEQ ID NO: 1658393 - protein, 18 aa, Staphylococcus aureus
QYAELLVKVGMNVQPKQP

SEQ ID NO: 1658394 - protein, 23 aa, Staphylococcus aureus
QYRFNIMLEDIKAYLPKEKIWDV

SEQ ID NO: 1658395 - protein, 24 aa, Staphylococcus aureus
QYWEKSCRYTLKFVENSNDVRIYD

SEQ ID NO: 1658396 - protein, 26 aa, Staphylococcus aureus
REGELKVSFDYIDWINSEFGQIGRQN

SEQ ID NO: 1658397 - protein, 18 aa, Staphylococcus aureus
REIKRGDLPSSFPKLDVD

SEQ ID NO: 1658398 - protein, 19 aa, Staphylococcus aureus
RFTNGLSVNDFLTRNTVIH

SEQ ID NO: 1658399 - protein, 17 aa, Staphylococcus aureus
RGGEIVFNYTKPGSDEL

SEQ ID NO: 1658400 - protein, 19 aa, Staphylococcus aureus
RKQFNYRGFQCPGPIVKIS

SEQ ID NO: 1658401 - protein, 24 aa, Staphylococcus aureus
RMEEEMFLGLRLNEGVSSSRFKKK

SEQ ID NO: 1658402 - protein, 17 aa, Staphylococcus aureus
RMICSSGNVDSNRLRTG

SEQ ID NO: 1658403 - protein, 18 aa, Staphylococcus aureus
RNDVTIIMLNDLYQIDGN

SEQ ID NO: 1658404 - protein, 19 aa, Staphylococcus aureus
RPTSIPTLAPKEEKETNIK

SEQ ID NO: 1658405 - protein, 23 aa, Staphylococcus aureus
RSRNSLREWLPWVDATEQPSDTR

SEQ ID NO: 1658406 - protein, 28 aa, Staphylococcus aureus
RVYLAVGGGFELDAWLGSNSTDFNVKIG

SEQ ID NO: 1658407 - protein, 19 aa, Staphylococcus aureus
RYICLSSKFNFEKREKEIP

SEQ ID NO: 1658408 - protein, 19 aa, Staphylococcus aureus
SAEWEVMNIIWMKKYASAN

SEQ ID NO: 1658409 - protein, 35 aa, Staphylococcus aureus
SAMIPYAAWQKFARPRFDNMISFNSTNDLLTWLQD

SEQ ID NO: 1658410 - protein, 29 aa, Staphylococcus aureus
SDELSIFEMFDYNIAYEIRLQAALESDIL

SEQ ID NO: 1658411 - protein, 21 aa, Staphylococcus aureus
SDFDGPVGIGHTRWATHGVPN

SEQ ID NO: 1658412 - protein, 22 aa, Staphylococcus aureus
SKGLESWKEKNLEDLIEQEVRK

SEQ ID NO: 1658413 - protein, 18 aa, Staphylococcus aureus
SMAEWDVMNIIWDKKSVS

SEQ ID NO: 1658414 - protein, 19 aa, Staphylococcus aureus
SMAEWDVMNIIWDKKSVSA

SEQ ID NO: 1658415 - protein, 20 aa, Staphylococcus aureus
SQHAGLSWLTILKKKEAYEE

SEQ ID NO: 1658416 - protein, 23 aa, Staphylococcus aureus
SSFKDTEFHKMFNFKDKEFAQDA

SEQ ID NO: 1658417 - protein, 18 aa, Staphylococcus aureus
SSLRRGAQILSKYPNLEI

SEQ ID NO: 1658418 - protein, 19 aa, Staphylococcus aureus
SSVMFDFGVLKRPQIFYAY

SEQ ID NO: 1658419 - protein, 18 aa, Staphylococcus aureus
SYAASRLSTHWTNHNMAW

SEQ ID NO: 1658420 - protein, 19 aa, Staphylococcus aureus
TAVNHDLTEAQALDQLMDA

SEQ ID NO: 1658421 - protein, 20 aa, Staphylococcus aureus
TFKLSRHTGLIAEEVEELGF

SEQ ID NO: 1658422 - protein, 17 aa, Staphylococcus aureus
TGYYSRRINHEHRLVYT

SEQ ID NO: 1658423 - protein, 21 aa, Staphylococcus aureus
THKMKCNVLADVIPEYDSNSI

SEQ ID NO: 1658424 - protein, 18 aa, Staphylococcus aureus
TRTLIPFLTMIQNTFGYL

SEQ ID NO: 1658425 - protein, 25 aa, Staphylococcus aureus
TSEEIPHAIGVNVDRMVKESEDRVH

SEQ ID NO: 1658426 - protein, 17 aa, Staphylococcus aureus
TSLKIRFINNRELIKGD

SEQ ID NO: 1658427 - protein, 22 aa, Staphylococcus aureus
TSVCVPLDAPFEVEVEKEITEE

SEQ ID NO: 1658428 - protein, 17 aa, Staphylococcus aureus
TTLDELTPLIGKKVIVK

SEQ ID NO: 1658429 - protein, 21 aa, Staphylococcus aureus
TTSWTSYQTRYEVLKQLCTTY

SEQ ID NO: 1658430 - protein, 18 aa, Staphylococcus aureus
VALDGDENLVAAKQQANN

SEQ ID NO: 1658431 - protein, 25 aa, Staphylococcus aureus
VAQAKETAKRALASYSNLNNAQSTA

SEQ ID NO: 1658432 - protein, 19 aa, Staphylococcus aureus
VDSYLEWLNQGITKESITT

SEQ ID NO: 1658433 - protein, 20 aa, Staphylococcus aureus
VERVSKRLGINRWKDNVRQV

SEQ ID NO: 1658434 - protein, 19 aa, Staphylococcus aureus
VETWWRWYRNGESYRFSQH

SEQ ID NO: 1658435 - protein, 18 aa, Staphylococcus aureus
VFSYGIDEEAQFMAENIQ

SEQ ID NO: 1658436 - protein, 24 aa, Staphylococcus aureus
VILKRGLKVISHFAHKHLAEQKCF

SEQ ID NO: 1658437 - protein, 18 aa, Staphylococcus aureus
VITSYWSHHCGDLIPETI

SEQ ID NO: 1658438 - protein, 25 aa, Staphylococcus aureus
VKFREKTRIGRFFNITNWYEEIHST

SEQ ID NO: 1658439 - protein, 17 aa, Staphylococcus aureus
VKKNLKSRSMGTVSYTY

SEQ ID NO: 1658440 - protein, 20 aa, Staphylococcus aureus
VMIYDRRKDLIISGGENIYP

SEQ ID NO: 1658441 - protein, 17 aa, Staphylococcus aureus
VNEAMKLFSEPRFNVDV

SEQ ID NO: 1658442 - protein, 38 aa, Staphylococcus aureus
VNMLPVMRSDFMLRYKDKCLIIDAKFYKNTLHNYYDTK

SEQ ID NO: 1658443 - protein, 20 aa, Staphylococcus aureus
VPDLIRLSKTFLIESRELTT

SEQ ID NO: 1658444 - protein, 17 aa, Staphylococcus aureus
VPSQLNYVIKTRFTNEH

SEQ ID NO: 1658445 - protein, 17 aa, Staphylococcus aureus
VQAVLGFHNDPSRPVGT

SEQ ID NO: 1658446 - protein, 17 aa, Staphylococcus aureus
VQYESVFDFEEMINRAV

SEQ ID NO: 1658447 - protein, 25 aa, Staphylococcus aureus
VRQAKSDAKANLGTLTHLNNAQKQD

SEQ ID NO: 1658448 - protein, 19 aa, Staphylococcus aureus
VSIPEGYVGLLTSRSGVSS

SEQ ID NO: 1658449 - protein, 23 aa, Staphylococcus aureus
VSRTALIEKCWESENFIDDNTLA

SEQ ID NO: 1658450 - protein, 20 aa, Staphylococcus aureus
VSWLEKWQCLEKKGRKEIKC

SEQ ID NO: 1658451 - protein, 17 aa, Staphylococcus aureus
VVLSGGYSREKANELLK

SEQ ID NO: 1658452 - protein, 17 aa, Staphylococcus aureus
WGYEHYGSIVLIGRGID

SEQ ID NO: 1658453 - protein, 19 aa, Staphylococcus aureus
WIYLVKNLRNAGVSIESLI

SEQ ID NO: 1658454 - protein, 20 aa, Staphylococcus aureus
WKDNSIIGFVMRPLINYDAI

SEQ ID NO: 1658455 - protein, 19 aa, Staphylococcus aureus
WKKEIWEDGSKWQGHQKGN

SEQ ID NO: 1658456 - protein, 25 aa, Staphylococcus aureus
WTRQKAFEEYEWLKNVAKNDIEIEG

SEQ ID NO: 1658457 - protein, 20 aa, Staphylococcus aureus
YDFDILVVALGFVSETFGIE

SEQ ID NO: 1658458 - protein, 20 aa, Staphylococcus aureus
YDKLRFEANFTELRNRDITF

SEQ ID NO: 1658459 - protein, 18 aa, Staphylococcus aureus
YHAVYKLSKFAINQYIKY

SEQ ID NO: 1658460 - protein, 18 aa, Staphylococcus aureus
YIDGELWIYSAVLDSNKN

SEQ ID NO: 1658461 - protein, 19 aa, Staphylococcus aureus
YINEHGGMIIYLPQEGRGI

SEQ ID NO: 1658462 - protein, 22 aa, Staphylococcus aureus
YIPCKEIVDYFSLIQTEEGVWK

SEQ ID NO: 1658463 - protein, 18 aa, Staphylococcus aureus
YKSDAMSTFVIYDNTIER

SEQ ID NO: 1658464 - protein, 18 aa, Staphylococcus aureus
YKSSEEMLKYHVSTQNCE

SEQ ID NO: 1658465 - protein, 19 aa, Staphylococcus aureus
YKTINRFRVNPNTDALIES

SEQ ID NO: 1658466 - protein, 21 aa, Staphylococcus aureus
YLKKHNCLYVLVDPYLIENLR

SEQ ID NO: 1658467 - protein, 18 aa, Staphylococcus aureus
YLNQFFGFKRYLYQDNER

SEQ ID NO: 1658468 - protein, 18 aa, Staphylococcus aureus
YNDWFERMINYGFEENID

SEQ ID NO: 1658469 - protein, 17 aa, Staphylococcus aureus
YNLAAKIYRDIKNYYLY

SEQ ID NO: 1658470 - protein, 18 aa, Staphylococcus aureus
YQYHKCSEYLRNISENLR

SEQ ID NO: 1658471 - protein, 18 aa, Staphylococcus aureus
YSISNLRNAIKDNALFHN

SEQ ID NO: 1658472 - protein, 21 aa, Staphylococcus aureus
ACTSLKIRFLNNLELIKGDVV

SEQ ID NO: 1658473 - protein, 20 aa, Staphylococcus aureus
AEIMPTFKALGLDEYIEVVV

SEQ ID NO: 1658474 - protein, 17 aa, Staphylococcus aureus
AELKKLEIIGSEGRGPG

SEQ ID NO: 1658475 - protein, 20 aa, Staphylococcus aureus
AFYEYALKLVHNGLFNILAE

SEQ ID NO: 1658476 - protein, 18 aa, Staphylococcus aureus
AGALRATLDYVTERKQFG

SEQ ID NO: 1658477 - protein, 27 aa, Staphylococcus aureus
AGDTFRAGAIDQLKVWGERVGVDVISQ

SEQ ID NO: 1658478 - protein, 21 aa, Staphylococcus aureus
AKNKAEELANSIINNINKATS

SEQ ID NO: 1658479 - protein, 20 aa, Staphylococcus aureus
ALNVLEPFASGIGGGGYLLY

SEQ ID NO: 1658480 - protein, 23 aa, Staphylococcus aureus
ALSKGLAKAGTWMNTGEGGLSEY

SEQ ID NO: 1658481 - protein, 22 aa, Staphylococcus aureus
AMKNIIITYIWIISVNENACKD

SEQ ID NO: 1658482 - protein, 25 aa, Staphylococcus aureus
ANEISSMIPVEWEKVYTMAYIDDGG

SEQ ID NO: 1658483 - protein, 23 aa, Staphylococcus aureus
ANIYYKSIIKITITVKVGTNVQT

SEQ ID NO: 1658484 - protein, 20 aa, Staphylococcus aureus
ANLTSQIERGTTVAGVQGIQ

SEQ ID NO: 1658485 - protein, 21 aa, Staphylococcus aureus
ANTLNGAMGTLRNSIQDNAAT

SEQ ID NO: 1658486 - protein, 23 aa, Staphylococcus aureus
AQSGRYSYLFNKIYFLRISTLPL

SEQ ID NO: 1658487 - protein, 20 aa, Staphylococcus aureus
AQYPNRFVGFATLPINEPEA

SEQ ID NO: 1658488 - protein, 19 aa, Staphylococcus aureus
ASDKAWAHSKSIWKGTSKW

SEQ ID NO: 1658489 - protein, 23 aa, Staphylococcus aureus
ATEEQMLYFGLPRINKYYTADRA

SEQ ID NO: 1658490 - protein, 21 aa, Staphylococcus aureus
AVASIISRYAFVTYMDQISKN

SEQ ID NO: 1658491 - protein, 17 aa, Staphylococcus aureus
AYDRVEWFRNGINGLGE

SEQ ID NO: 1658492 - protein, 18 aa, Staphylococcus aureus
AYGHGVSGVNMGAKTGTG

SEQ ID NO: 1658493 - protein, 21 aa, Staphylococcus aureus
CIIRLKKEYYYNFFGQYLLSR

SEQ ID NO: 1658494 - protein, 23 aa, Staphylococcus aureus
CNFNFEKGKSYALVGESGAGKST

SEQ ID NO: 1658495 - protein, 17 aa, Staphylococcus aureus
DAIPELKKVATTDERPL

SEQ ID NO: 1658496 - protein, 37 aa, Staphylococcus aureus
DCEICGSPMVIKMGRYGKFMACSNFPDCRNTKAIVKS

SEQ ID NO: 1658497 - protein, 25 aa, Staphylococcus aureus
DDFERFMRKYSYHLSSSRLISGSST

SEQ ID NO: 1658498 - protein, 21 aa, Staphylococcus aureus
DDGGHLIARMFGGSKDIDNLV

SEQ ID NO: 1658499 - protein, 18 aa, Staphylococcus aureus
DDLPSLPTHAMFGENLTF

SEQ ID NO: 1658500 - protein, 25 aa, Staphylococcus aureus
DDNVCSCCGQQLPAEQVNEAREKAL

SEQ ID NO: 1658501 - protein, 21 aa, Staphylococcus aureus
DDPAGKPWSEFQRVRDEIKIA

SEQ ID NO: 1658502 - protein, 24 aa, Staphylococcus aureus
DDPRHPNWLVIEVCGGQTDSKRQF

SEQ ID NO: 1658503 - protein, 27 aa, Staphylococcus aureus
DDSYLNLIFKFTRNIPVNKLEESQVLI

SEQ ID NO: 1658504 - protein, 19 aa, Staphylococcus aureus
DDYQLHWTSTNWKGTNTKD

SEQ ID NO: 1658505 - protein, 19 aa, Staphylococcus aureus
DELQFIFFKMQKFNPEYVK

SEQ ID NO: 1658506 - protein, 18 aa, Staphylococcus aureus
DEQKRNAYNQAVSNAETI

SEQ ID NO: 1658507 - protein, 18 aa, Staphylococcus aureus
DEVLKKIRMHITQGIMSG

SEQ ID NO: 1658508 - protein, 17 aa, Staphylococcus aureus
DFIEDFSVFDGQTIRIK

SEQ ID NO: 1658509 - protein, 17 aa, Staphylococcus aureus
DFLKFRGLVDQYKEIEL

SEQ ID NO: 1658510 - protein, 20 aa, Staphylococcus aureus
DGRIHPGRIEDMVEKARKEV

SEQ ID NO: 1658511 - protein, 24 aa, Staphylococcus aureus
DGYKFAQDLGHTITELFPTEVPIT

SEQ ID NO: 1658512 - protein, 21 aa, Staphylococcus aureus
DHYRKAYAHFIHQYMKQAAPF

SEQ ID NO: 1658513 - protein, 29 aa, Staphylococcus aureus
DIFKNSWFKVYRMFDELRETFKEEGLEPW

SEQ ID NO: 1658514 - protein, 17 aa, Staphylococcus aureus
DINNYKFYKGIRLTDND

SEQ ID NO: 1658515 - protein, 27 aa, Staphylococcus aureus
DIQRSTNFSIVWILPISSIDNMPIKDM

SEQ ID NO: 1658516 - protein, 30 aa, Staphylococcus aureus
DKKMSFTKFKSCLKKHSFEQIMQGTREYLK

SEQ ID NO: 1658517 - protein, 24 aa, Staphylococcus aureus
DKRGGFCYELNTFFKAYLQQKGFN

SEQ ID NO: 1658518 - protein, 25 aa, Staphylococcus aureus
DLEPWTSCEFDFTRDGKLNVVFDYV

SEQ ID NO: 1658519 - protein, 22 aa, Staphylococcus aureus
DLKAELIDQVGYFIEPEDLFSA

SEQ ID NO: 1658520 - protein, 19 aa, Staphylococcus aureus
DPTLAKSIIDQATQAVTDA

SEQ ID NO: 1658521 - protein, 24 aa, Staphylococcus aureus
DRMMDIPYSREFISFDDNNEKSFT

SEQ ID NO: 1658522 - protein, 21 aa, Staphylococcus aureus
DTFDHCLAEALTYTSEHQMNF

SEQ ID NO: 1658523 - protein, 17 aa, Staphylococcus aureus
DTVRPALQIIKTKPGVS

SEQ ID NO: 1658524 - protein, 17 aa, Staphylococcus aureus
DVTYCLEVNFFNTSGSK

SEQ ID NO: 1658525 - protein, 17 aa, Staphylococcus aureus
DYHIALNIATILAGGDL

SEQ ID NO: 1658526 - protein, 17 aa, Staphylococcus aureus
DYIFKISLSEVIDYNTV

SEQ ID NO: 1658527 - protein, 19 aa, Staphylococcus aureus
EAGFDYKLNADLSPKFVVG

SEQ ID NO: 1658528 - protein, 20 aa, Staphylococcus aureus
EAKALDQAMQALRNSIQDQQ

SEQ ID NO: 1658529 - protein, 33 aa, Staphylococcus aureus
ECNYPVISEKLEWIPNLFVAGCFADLELGPFGR

SEQ ID NO: 1658530 - protein, 25 aa, Staphylococcus aureus
EDLEPWTSCEFDFTREGELKVSFDY

SEQ ID NO: 1658531 - protein, 24 aa, Staphylococcus aureus
EDLYNKLDMILGYKDEERKKKRAT

SEQ ID NO: 1658532 - protein, 27 aa, Staphylococcus aureus
EELPISRLLQWGADFVKPLARLAYNGG

SEQ ID NO: 1658533 - protein, 19 aa, Staphylococcus aureus
EFDDMISLMGMHLENDLDY

SEQ ID NO: 1658534 - protein, 25 aa, Staphylococcus aureus
EFETRAGTLLRYYTGLLEHSKVQPC

SEQ ID NO: 1658535 - protein, 24 aa, Staphylococcus aureus
EFICPNNKRIGFKRYAYRNDRYSF

SEQ ID NO: 1658536 - protein, 21 aa, Staphylococcus aureus
EIYELWRQTLIQVGINRPTYK

SEQ ID NO: 1658537 - protein, 30 aa, Staphylococcus aureus
EKIVLKNGEGHAMSGILMSRTQAIILAELN

SEQ ID NO: 1658538 - protein, 19 aa, Staphylococcus aureus
EKKASAWDRYCKSVEKDLI

SEQ ID NO: 1658539 - protein, 23 aa, Staphylococcus aureus
EKLKKFITNFAIRNSVDDEDSEI

SEQ ID NO: 1658540 - protein, 17 aa, Staphylococcus aureus
EKLVVPLPLKFGDYLSA

SEQ ID NO: 1658541 - protein, 17 aa, Staphylococcus aureus
EKTMKWYQKQRIYSIKS

SEQ ID NO: 1658542 - protein, 17 aa, Staphylococcus aureus
ELMRVRKIADEEGIETP

SEQ ID NO: 1658543 - protein, 22 aa, Staphylococcus aureus
EMRLDELIKWARSNPELSKGKN

SEQ ID NO: 1658544 - protein, 25 aa, Staphylococcus aureus
EPAPELVEGLRLVTEFVQDENATQE

SEQ ID NO: 1658545 - protein, 25 aa, Staphylococcus aureus
EPARELVEGLKLVTEFVQDENATQE

SEQ ID NO: 1658546 - protein, 22 aa, Staphylococcus aureus
EQLKIRYIEQFGLSNSLKRKVH

SEQ ID NO: 1658547 - protein, 25 aa, Staphylococcus aureus
ESLEPWTSCEFDFTKEDKLKVSFDY

SEQ ID NO: 1658548 - protein, 18 aa, Staphylococcus aureus
FAMMNNLEAYIVLNETDI

SEQ ID NO: 1658549 - protein, 17 aa, Staphylococcus aureus
FDLLISLCLFLNKHDYI

SEQ ID NO: 1658550 - protein, 24 aa, Staphylococcus aureus
FDSKTKLVYIKSIQDLTESVKEEV

SEQ ID NO: 1658551 - protein, 20 aa, Staphylococcus aureus
FGDSRIVGLIGKNGVGKTTI

SEQ ID NO: 1658552 - protein, 19 aa, Staphylococcus aureus
FGEKKRAAITHLLNQEISV

SEQ ID NO: 1658553 - protein, 25 aa, Staphylococcus aureus
FHKKSLPVPKYRYFKLNNKKIQKML

SEQ ID NO: 1658554 - protein, 17 aa, Staphylococcus aureus
FIDIPYLTGHEFGARLP

SEQ ID NO: 1658555 - protein, 24 aa, Staphylococcus aureus
FIGPNCGFYTATHPLNFYHRNEGY

SEQ ID NO: 1658556 - protein, 18 aa, Staphylococcus aureus
FINIIVFKKQAENVNKYL

SEQ ID NO: 1658557 - protein, 19 aa, Staphylococcus aureus
FKLAVKKKDHSILVNILDL

SEQ ID NO: 1658558 - protein, 18 aa, Staphylococcus aureus
FKTSLSILNKTVDNIEFD

SEQ ID NO: 1658559 - protein, 18 aa, Staphylococcus aureus
FNKLCMKYELKINDKKTE

SEQ ID NO: 1658560 - protein, 19 aa, Staphylococcus aureus
FPSNKLIESYLMNIKDTNE

SEQ ID NO: 1658561 - protein, 20 aa, Staphylococcus aureus
FQLSNNEAWECEALEEAAEN

SEQ ID NO: 1658562 - protein, 19 aa, Staphylococcus aureus
FTDNLKKTLLYGGNHILNV

SEQ ID NO: 1658563 - protein, 19 aa, Staphylococcus aureus
GDEVYKKLQGSWICEIEEL

SEQ ID NO: 1658564 - protein, 17 aa, Staphylococcus aureus
GDRFIVESIDRLGRNYN

SEQ ID NO: 1658565 - protein, 21 aa, Staphylococcus aureus
GESFISNPLLIYMEPYASSTA

SEQ ID NO: 1658566 - protein, 24 aa, Staphylococcus aureus
GHEPWTSCEFDFTREGELKVSFDY

SEQ ID NO: 1658567 - protein, 19 aa, Staphylococcus aureus
GKSLAYLLAALMYNIETGK

SEQ ID NO: 1658568 - protein, 25 aa, Staphylococcus aureus
GLGEAFKYVAPVAGALGYTIEDTSI

SEQ ID NO: 1658569 - protein, 18 aa, Staphylococcus aureus
GLTAFGLKAKDSGHLADV

SEQ ID NO: 1658570 - protein, 18 aa, Staphylococcus aureus
GNIDCVMVYKTNRLARNT

SEQ ID NO: 1658571 - protein, 25 aa, Staphylococcus aureus
GRKRASEELRLKESTVRDYIKLLEN

SEQ ID NO: 1658572 - protein, 17 aa, Staphylococcus aureus
GSMKAAENFLDPNKASS

SEQ ID NO: 1658573 - protein, 30 aa, Staphylococcus aureus
GVNIGQRRLFEWLRQNGFLIKRKGVDYNMP

SEQ ID NO: 1658574 - protein, 17 aa, Staphylococcus aureus
GYNKFWHNKNFYRVVKG

SEQ ID NO: 1658575 - protein, 17 aa, Staphylococcus aureus
HHIMTYFWMLQRDQQRF

SEQ ID NO: 1658576 - protein, 20 aa, Staphylococcus aureus
HIFKSITFDCGKEFSNWKTI

SEQ ID NO: 1658577 - protein, 21 aa, Staphylococcus aureus
HLDIPAGAAVRFEPGDKKEVQ

SEQ ID NO: 1658578 - protein, 26 aa, Staphylococcus aureus
HLTEREKRVIKREHVREAQKLVDNYK

SEQ ID NO: 1658579 - protein, 17 aa, Staphylococcus aureus
HPMLRKRHIDFTITEFE

SEQ ID NO: 1658580 - protein, 17 aa, Staphylococcus aureus
HREPGVFGAAWLNDALH

SEQ ID NO: 1658581 - protein, 17 aa, Staphylococcus aureus
HRPIRFIEKFCKPSKGS

SEQ ID NO: 1658582 - protein, 18 aa, Staphylococcus aureus
HTATELNTAMTALKRAIA

SEQ ID NO: 1658583 - protein, 25 aa, Staphylococcus aureus
HVYIKDCKVRKSFELASPKHTEGLI

SEQ ID NO: 1658584 - protein, 22 aa, Staphylococcus aureus
IDHILKVHGAYIDKKEITQKNI

SEQ ID NO: 1658585 - protein, 25 aa, Staphylococcus aureus
IEIEETSALPGRKTGSLVGLSQIDS

SEQ ID NO: 1658586 - protein, 18 aa, Staphylococcus aureus
IGHMGKISPFDILSVVSA

SEQ ID NO: 1658587 - protein, 18 aa, Staphylococcus aureus
IHDARDLLQYKIDNYDNH

SEQ ID NO: 1658588 - protein, 17 aa, Staphylococcus aureus
IHWQFGHVLTIFESALA

SEQ ID NO: 1658589 - protein, 18 aa, Staphylococcus aureus
IIEYFRPGDTLVLNDTRV

SEQ ID NO: 1658590 - protein, 23 aa, Staphylococcus aureus
IINKDIAWWSIVQSYPLLMRQEK

SEQ ID NO: 1658591 - protein, 24 aa, Staphylococcus aureus
IKADGKMLVIDGGFSKAYQSTTGI

SEQ ID NO: 1658592 - protein, 17 aa, Staphylococcus aureus
IKEQFGRIDVLFNNAGV

SEQ ID NO: 1658593 - protein, 19 aa, Staphylococcus aureus
IKGFISAIVDIYRASYGKR

SEQ ID NO: 1658594 - protein, 17 aa, Staphylococcus aureus
IKMLPKIIEQLRENGKQ

SEQ ID NO: 1658595 - protein, 20 aa, Staphylococcus aureus
IKQIIQRLGVNPENLHIIVT

SEQ ID NO: 1658596 - protein, 21 aa, Staphylococcus aureus
IKVDLDGSGFNRGVTGLNRQM

SEQ ID NO: 1658597 - protein, 30 aa, Staphylococcus aureus
ILGKIPFFGICLGHQLFALSQGASSFKMKF

SEQ ID NO: 1658598 - protein, 19 aa, Staphylococcus aureus
ILKKYQCDTVILKANSPSC

SEQ ID NO: 1658599 - protein, 21 aa, Staphylococcus aureus
ILNKLKYKSLVNEVGEGDSTK

SEQ ID NO: 1658600 - protein, 18 aa, Staphylococcus aureus
IMKNYNWEYFKAQINQKL

SEQ ID NO: 1658601 - protein, 17 aa, Staphylococcus aureus
INAYRLAERYSTIATNC

SEQ ID NO: 1658602 - protein, 18 aa, Staphylococcus aureus
INCRCKLLYYIDENELPT

SEQ ID NO: 1658603 - protein, 23 aa, Staphylococcus aureus
INKKIKMCEFQIESMYHLSASTT

SEQ ID NO: 1658604 - protein, 19 aa, Staphylococcus aureus
INPKKCIALKISEEKLNRI

SEQ ID NO: 1658605 - protein, 17 aa, Staphylococcus aureus
INYAELVSWLENPNTKK

SEQ ID NO: 1658606 - protein, 26 aa, Staphylococcus aureus
IPLLQARSKEILAFVNESKETAIKDY

SEQ ID NO: 1658607 - protein, 17 aa, Staphylococcus aureus
IPSVILGVGYEKIHTTN

SEQ ID NO: 1658608 - protein, 18 aa, Staphylococcus aureus
IRFLNNLELIKGDVVCGL

SEQ ID NO: 1658609 - protein, 22 aa, Staphylococcus aureus
IRFSKERNKGLVQIVNGRYATG

SEQ ID NO: 1658610 - protein, 25 aa, Staphylococcus aureus
ITLNEYRKLIEIKAVKDKEEDTYRG

SEQ ID NO: 1658611 - protein, 17 aa, Staphylococcus aureus
IYINCPLFNEMPEILEA

SEQ ID NO: 1658612 - protein, 17 aa, Staphylococcus aureus
IYPNIFPEFKVEGKSKL

SEQ ID NO: 1658613 - protein, 33 aa, Staphylococcus aureus
IYSQRKIDVEPVFGFMKAILGFTRMSVRGLNKV

SEQ ID NO: 1658614 - protein, 19 aa, Staphylococcus aureus
KAIATKILPASQFYKAEDY

SEQ ID NO: 1658615 - protein, 22 aa, Staphylococcus aureus
KATESKSGLTIIMRSSKIEYLP

SEQ ID NO: 1658616 - protein, 23 aa, Staphylococcus aureus
KDAIEFAKKHRKEFEKVGEQFFK

SEQ ID NO: 1658617 - protein, 26 aa, Staphylococcus aureus
KDKKLLDWQLLIKNVYLDTEEDDNLF

SEQ ID NO: 1658618 - protein, 18 aa, Staphylococcus aureus
KDTCARVIYVMNGVIHQN

SEQ ID NO: 1658619 - protein, 18 aa, Staphylococcus aureus
KEALSLLDKVGLKEKADV

SEQ ID NO: 1658620 - protein, 17 aa, Staphylococcus aureus
KENHYDFVIVWGSYTGH

SEQ ID NO: 1658621 - protein, 25 aa, Staphylococcus aureus
KETDILFILSLFRKINWKVYDESTG

SEQ ID NO: 1658622 - protein, 19 aa, Staphylococcus aureus
KFSMSKIVHHPHIQIPSDQ

SEQ ID NO: 1658623 - protein, 19 aa, Staphylococcus aureus
KGAELANFYTGIINDLLRV

SEQ ID NO: 1658624 - protein, 39 aa, Staphylococcus aureus
KGFLTYKIPKKVIKHAGYVRCKLFLEKEEEKIHVANFSF

SEQ ID NO: 1658625 - protein, 22 aa, Staphylococcus aureus
KGYRYARYVDDISFSFNFEEEK

SEQ ID NO: 1658626 - protein, 18 aa, Staphylococcus aureus
KILKENHYDFVIVWGSYT

SEQ ID NO: 1658627 - protein, 19 aa, Staphylococcus aureus
KINASAILYRMDKLDGTNE

SEQ ID NO: 1658628 - protein, 25 aa, Staphylococcus aureus
KISSRDGEDFKRPSSVSGSIPSINV

SEQ ID NO: 1658629 - protein, 19 aa, Staphylococcus aureus
KKADEYAREKAEEAAKEAA

SEQ ID NO: 1658630 - protein, 18 aa, Staphylococcus aureus
KKELGRFLKSIRKQKGKT

SEQ ID NO: 1658631 - protein, 33 aa, Staphylococcus aureus
KKFSRGSIIYLDFGINIGHEFSGRHFGIVLNKN

SEQ ID NO: 1658632 - protein, 17 aa, Staphylococcus aureus
KKLFVYGGAEHPHAAQQ

SEQ ID NO: 1658633 - protein, 23 aa, Staphylococcus aureus
KKVELKIRYKVPKIAYASHLKSD

SEQ ID NO: 1658634 - protein, 19 aa, Staphylococcus aureus
KLDNAMGAVQQYIDEQHLG

SEQ ID NO: 1658635 - protein, 23 aa, Staphylococcus aureus
KLKKKGKIEMESWGIWRVIESQL

SEQ ID NO: 1658636 - protein, 18 aa, Staphylococcus aureus
KLLYRHMGPQNWWPADND

SEQ ID NO: 1658637 - protein, 21 aa, Staphylococcus aureus
KMPSMKITLSFSKSNTTKTTV

SEQ ID NO: 1658638 - protein, 19 aa, Staphylococcus aureus
KNKIISFNGFEFKVSAMKK

SEQ ID NO: 1658639 - protein, 20 aa, Staphylococcus aureus
KPQAKQAIADKVQAQETAID

SEQ ID NO: 1658640 - protein, 25 aa, Staphylococcus aureus
KQIDYEFLYLLSMDKLFGNKRNRLT

SEQ ID NO: 1658641 - protein, 19 aa, Staphylococcus aureus
KQIEIAKKLGAKQVIIIED

SEQ ID NO: 1658642 - protein, 17 aa, Staphylococcus aureus
KQKHKILNLDDAEDGNL

SEQ ID NO: 1658643 - protein, 21 aa, Staphylococcus aureus
KRNAYNQAVSNAETILNKQTG

SEQ ID NO: 1658644 - protein, 19 aa, Staphylococcus aureus
KSQLRRSATTQALKKTTTN

SEQ ID NO: 1658645 - protein, 23 aa, Staphylococcus aureus
KSSSSNKSICFIRERGSGTRVYQ

SEQ ID NO: 1658646 - protein, 17 aa, Staphylococcus aureus
KTINRFRVNPNTDALIE

SEQ ID NO: 1658647 - protein, 17 aa, Staphylococcus aureus
KTLLYGGNHILNVDLSN

SEQ ID NO: 1658648 - protein, 23 aa, Staphylococcus aureus
KTRKLLEALILVGAFDAFGKTRS

SEQ ID NO: 1658649 - protein, 22 aa, Staphylococcus aureus
KVGEQFFKDNFGLKVKATNVVG

SEQ ID NO: 1658650 - protein, 23 aa, Staphylococcus aureus
KYLRPETLFGNKFEGYLNQKAQP

SEQ ID NO: 1658651 - protein, 18 aa, Staphylococcus aureus
LAEALTYTSEHQMNFIDP

SEQ ID NO: 1658652 - protein, 17 aa, Staphylococcus aureus
LALPFSVLYNLPSNGSD

SEQ ID NO: 1658653 - protein, 19 aa, Staphylococcus aureus
LATGERLQGLYAYNIPFDN

SEQ ID NO: 1658654 - protein, 18 aa, Staphylococcus aureus
LAVNRTFTNAQGEREADF

SEQ ID NO: 1658655 - protein, 18 aa, Staphylococcus aureus
LCIPELDGKMSYTIAVTG

SEQ ID NO: 1658656 - protein, 17 aa, Staphylococcus aureus
LDGKMSYMIAVTGDNSA

SEQ ID NO: 1658657 - protein, 20 aa, Staphylococcus aureus
LEGIEASYVVARREDNLIGI

SEQ ID NO: 1658658 - protein, 18 aa, Staphylococcus aureus
LENQVLMIGYTFYHSNKN

SEQ ID NO: 1658659 - protein, 23 aa, Staphylococcus aureus
LETVEIQYDVALFSYNKLLEIFF

SEQ ID NO: 1658660 - protein, 24 aa, Staphylococcus aureus
LGIRHLGVKASQVLAEKYETIDRL

SEQ ID NO: 1658661 - protein, 17 aa, Staphylococcus aureus
LGYPFIVKTRFGGYDGK

SEQ ID NO: 1658662 - protein, 24 aa, Staphylococcus aureus
LKQKIKCPCCNATLTNMTIRKKNH

SEQ ID NO: 1658663 - protein, 21 aa, Staphylococcus aureus
LKYDKLYSLYSLLYTMKKISA

SEQ ID NO: 1658664 - protein, 20 aa, Staphylococcus aureus
LKYEKAWELLDLPEKIKQYG

SEQ ID NO: 1658665 - protein, 22 aa, Staphylococcus aureus
LLEAYPSIEIVMWDERLSTMAA

SEQ ID NO: 1658666 - protein, 17 aa, Staphylococcus aureus
LLISLCLFLNKHDYIKL

SEQ ID NO: 1658667 - protein, 17 aa, Staphylococcus aureus
LLKSYGFLIYFKNPEDM

SEQ ID NO: 1658668 - protein, 17 aa, Staphylococcus aureus
LLPELSGPFLSLSTIVN

SEQ ID NO: 1658669 - protein, 22 aa, Staphylococcus aureus
LNAFSSDFYYFVKHNQKLTKQQ

SEQ ID NO: 1658670 - protein, 18 aa, Staphylococcus aureus
LNAKTYLNTLTSITDAQK

SEQ ID NO: 1658671 - protein, 17 aa, Staphylococcus aureus
LNGNHNLQVAKDNANTA

SEQ ID NO: 1658672 - protein, 23 aa, Staphylococcus aureus
LNIRKIVARRAVYYQIHLKKADF

SEQ ID NO: 1658673 - protein, 20 aa, Staphylococcus aureus
LPLTDKRISPINGTIEGLPP

SEQ ID NO: 1658674 - protein, 17 aa, Staphylococcus aureus
LQGLYAYNIPFDNKAKI

SEQ ID NO: 1658675 - protein, 20 aa, Staphylococcus aureus
LQNIVFKTSLSILNKTVDNI

SEQ ID NO: 1658676 - protein, 18 aa, Staphylococcus aureus
LRETFKEEGLEPWTSCEF

SEQ ID NO: 1658677 - protein, 22 aa, Staphylococcus aureus
LRLQDIFKLLNHRERLWLKLYL

SEQ ID NO: 1658678 - protein, 18 aa, Staphylococcus aureus
LRRYNDVSPFELFVISCP

SEQ ID NO: 1658679 - protein, 17 aa, Staphylococcus aureus
LSANLSQFSRYDNSLEK

SEQ ID NO: 1658680 - protein, 20 aa, Staphylococcus aureus
LSESGYKIFVHESERKAEPR

SEQ ID NO: 1658681 - protein, 18 aa, Staphylococcus aureus
LSIFKNVFEYTRRIYKLQ

SEQ ID NO: 1658682 - protein, 19 aa, Staphylococcus aureus
LTGYYSRRINHEHRLVYTV

SEQ ID NO: 1658683 - protein, 24 aa, Staphylococcus aureus
LTMCYADCVPVYFYSTKHHFIALA

SEQ ID NO: 1658684 - protein, 18 aa, Staphylococcus aureus
LVIKKLQLWIKAILKKTD

SEQ ID NO: 1658685 - protein, 18 aa, Staphylococcus aureus
LVNFELFDPSNFEEAKVA

SEQ ID NO: 1658686 - protein, 27 aa, Staphylococcus aureus
LVVPLPLKFGDYLSASSMRSLINIAAP

SEQ ID NO: 1658687 - protein, 18 aa, Staphylococcus aureus
LVVQRGFEIPSFNFVTEK

SEQ ID NO: 1658688 - protein, 21 aa, Staphylococcus aureus
LWSHIRRGLVLPTIIPNRKQI

SEQ ID NO: 1658689 - protein, 19 aa, Staphylococcus aureus
LYEYALKLVHNGLFNILAE

SEQ ID NO: 1658690 - protein, 23 aa, Staphylococcus aureus
LYLHQRYAIDLVIKENHKTYKNQ

SEQ ID NO: 1658691 - protein, 21 aa, Staphylococcus aureus
MALAAKDIRIEAPIPGTSRVG

SEQ ID NO: 1658692 - protein, 19 aa, Staphylococcus aureus
MGSIFISHEEICFIRKEED

SEQ ID NO: 1658693 - protein, 20 aa, Staphylococcus aureus
MKSKTIQVVVEFKEVPMNLY

SEQ ID NO: 1658694 - protein, 26 aa, Staphylococcus aureus
MNHLRLEKYQDLMLISQKDFEVGNSI

SEQ ID NO: 1658695 - protein, 22 aa, Staphylococcus aureus
MNNKLFGHVYIKDCKVRKSFEL

SEQ ID NO: 1658696 - protein, 17 aa, Staphylococcus aureus
MPQIGLGTFRVENDENC

SEQ ID NO: 1658697 - protein, 20 aa, Staphylococcus aureus
MRLDELIKWARENPDLSQGK

SEQ ID NO: 1658698 - protein, 17 aa, Staphylococcus aureus
MTNIKVYDWVQQVEQLG

SEQ ID NO: 1658699 - protein, 18 aa, Staphylococcus aureus
NAAKHALNNLTSINNAQK

SEQ ID NO: 1658700 - protein, 26 aa, Staphylococcus aureus
NAEDPSGRMKLDFDSMKLVDNEIKNK

SEQ ID NO: 1658701 - protein, 25 aa, Staphylococcus aureus
NDKYNIQQAKGWTQVKMKAVLHNEA

SEQ ID NO: 1658702 - protein, 19 aa, Staphylococcus aureus
NGNVPIFINIGEWDGDDED

SEQ ID NO: 1658703 - protein, 21 aa, Staphylococcus aureus
NHLKSLKAFNYMPYFEHLDMN

SEQ ID NO: 1658704 - protein, 24 aa, Staphylococcus aureus
NITICGMGGPLIAKILKDGQDKLS

SEQ ID NO: 1658705 - protein, 18 aa, Staphylococcus aureus
NKCKIEILKSLKQGLLQK

SEQ ID NO: 1658706 - protein, 18 aa, Staphylococcus aureus
NKFISDYEIPHLYVDREA

SEQ ID NO: 1658707 - protein, 19 aa, Staphylococcus aureus
NKTIPWLYVERGFEIPSFN

SEQ ID NO: 1658708 - protein, 27 aa, Staphylococcus aureus
NLPAEESYFLFYINRPSIIVGKNQNTI

SEQ ID NO: 1658709 - protein, 18 aa, Staphylococcus aureus
NMREMLRSYLESMSQDFN

SEQ ID NO: 1658710 - protein, 27 aa, Staphylococcus aureus
NQGPAFPFAECGAMSQAYIGYQLQESL

SEQ ID NO: 1658711 - protein, 17 aa, Staphylococcus aureus
NRLPFILFSASGGARMQ

SEQ ID NO: 1658712 - protein, 18 aa, Staphylococcus aureus
NTAKSKDFIKARWNQDFR

SEQ ID NO: 1658713 - protein, 24 aa, Staphylococcus aureus
NTLNQAMHGLRESIQDNAATKANS

SEQ ID NO: 1658714 - protein, 19 aa, Staphylococcus aureus
NYFTTPSFVTNIYETDELY

SEQ ID NO: 1658715 - protein, 17 aa, Staphylococcus aureus
PDCRAMDLWIDPIVEQY

SEQ ID NO: 1658716 - protein, 18 aa, Staphylococcus aureus
PEDLFGDRIVPFKGEARQ

SEQ ID NO: 1658717 - protein, 17 aa, Staphylococcus aureus
PGLIGALLIGVNAAKAL

SEQ ID NO: 1658718 - protein, 36 aa, Staphylococcus aureus
PMIYGAHCPGNFQRLMQLSKRLPIIPNINNQRSALY

SEQ ID NO: 1658719 - protein, 19 aa, Staphylococcus aureus
PPFFYPLNELISIGQMIKN

SEQ ID NO: 1658720 - protein, 30 aa, Staphylococcus aureus
PSIEALNYYATRFMLTVPFENIDVQNGKPI

SEQ ID NO: 1658721 - protein, 17 aa, Staphylococcus aureus
PWNAKEMTIKDPDGNLI

SEQ ID NO: 1658722 - protein, 20 aa, Staphylococcus aureus
QEIDSTFSYLERVDYQLLTK

SEQ ID NO: 1658723 - protein, 18 aa, Staphylococcus aureus
QFKHPLDQILLARVSMSS

SEQ ID NO: 1658724 - protein, 23 aa, Staphylococcus aureus
QHREPGVFGAAWLNDALHTEMIV

SEQ ID NO: 1658725 - protein, 19 aa, Staphylococcus aureus
QILACSELDVPVFDAYHTD

SEQ ID NO: 1658726 - protein, 17 aa, Staphylococcus aureus
QMGLLRQQLELYVKQMA

SEQ ID NO: 1658727 - protein, 30 aa, Staphylococcus aureus
QNAYKQAVAKAEALISGTPDVVVTPSEITA

SEQ ID NO: 1658728 - protein, 26 aa, Staphylococcus aureus
QNEKLFKVFAYCLMKASHKDHTQLVG

SEQ ID NO: 1658729 - protein, 24 aa, Staphylococcus aureus
QQKSFLFNEHYGFLNLINDDSNIV

SEQ ID NO: 1658730 - protein, 30 aa, Staphylococcus aureus
QSASKLYDFSPWKNKSFWGVINNTLETNET

SEQ ID NO: 1658731 - protein, 24 aa, Staphylococcus aureus
QSLNNAMKGLRDSIANETTVKASQ

SEQ ID NO: 1658732 - protein, 17 aa, Staphylococcus aureus
QTAKSDIGRLTDLNNAQ

SEQ ID NO: 1658733 - protein, 23 aa, Staphylococcus aureus
RDFLKKLMSNYSYYDSKGNIDLN

SEQ ID NO: 1658734 - protein, 17 aa, Staphylococcus aureus
RDIAFGVSEGERNSTLA

SEQ ID NO: 1658735 - protein, 25 aa, Staphylococcus aureus
RDIKRLELEYDVKIFEFRHSKMSLT

SEQ ID NO: 1658736 - protein, 18 aa, Staphylococcus aureus
RDNLEMFNDLDVAVYGIS

SEQ ID NO: 1658737 - protein, 19 aa, Staphylococcus aureus
READFINIIVFKKQAENVN

SEQ ID NO: 1658738 - protein, 26 aa, Staphylococcus aureus
REGELKVSFDYIDWINSEFGQVGRQN

SEQ ID NO: 1658739 - protein, 17 aa, Staphylococcus aureus
RGSVPYTVFIDPPLSRV

SEQ ID NO: 1658740 - protein, 22 aa, Staphylococcus aureus
RIEKNIMRFAKSVNFNSDEFNG

SEQ ID NO: 1658741 - protein, 17 aa, Staphylococcus aureus
RIIFATFASNIYRVQQA

SEQ ID NO: 1658742 - protein, 20 aa, Staphylococcus aureus
RLESTVMYAGIIVDTRNFTL

SEQ ID NO: 1658743 - protein, 19 aa, Staphylococcus aureus
RLNNIISFEQHKVWRKRVM

SEQ ID NO: 1658744 - protein, 20 aa, Staphylococcus aureus
RLVKKGGIDQIVIESTGISE

SEQ ID NO: 1658745 - protein, 17 aa, Staphylococcus aureus
RQFEVDKAIILAATSRT

SEQ ID NO: 1658746 - protein, 26 aa, Staphylococcus aureus
RQGFVKRVDNYIAFRNTITSIESIVN

SEQ ID NO: 1658747 - protein, 34 aa, Staphylococcus aureus
RQLTKLLFYSGLRIGEALALQWKDYDKIKGEIDV

SEQ ID NO: 1658748 - protein, 19 aa, Staphylococcus aureus
RRPEMTYDIILELLEEEHQ

SEQ ID NO: 1658749 - protein, 21 aa, Staphylococcus aureus
RRPVHLHLPIDVAISEIEIPT

SEQ ID NO: 1658750 - protein, 20 aa, Staphylococcus aureus
RSITNGRLEQQWTVPNEHKS

SEQ ID NO: 1658751 - protein, 23 aa, Staphylococcus aureus
RTSYFGYKAIQLFKNNSKNKQSI

SEQ ID NO: 1658752 - protein, 17 aa, Staphylococcus aureus
SALLKKLGGAWFSDSLV

SEQ ID NO: 1658753 - protein, 24 aa, Staphylococcus aureus
SDGKLCPAIYEYFWELDYSVKDKS

SEQ ID NO: 1658754 - protein, 26 aa, Staphylococcus aureus
SDLKLLKDRFEDLKDNHGWHFEELYP

SEQ ID NO: 1658755 - protein, 18 aa, Staphylococcus aureus
SFALLWGQFACKPPMKEQ

SEQ ID NO: 1658756 - protein, 24 aa, Staphylococcus aureus
SIAYKVMLDIFYPELITIGSNSVI

SEQ ID NO: 1658757 - protein, 21 aa, Staphylococcus aureus
SIETRRYYLMLMLFSKENAMS

SEQ ID NO: 1658758 - protein, 21 aa, Staphylococcus aureus
SKDFIKARWNQDFRLEDFKKV

SEQ ID NO: 1658759 - protein, 27 aa, Staphylococcus aureus
SKSLAIAVASIISRYAFITYMDQISKY

SEQ ID NO: 1658760 - protein, 24 aa, Staphylococcus aureus
SLLNSAQMNIVFGGHSDEDERYIE

SEQ ID NO: 1658761 - protein, 20 aa, Staphylococcus aureus
SLNAFNLYGALSMANSGPNT

SEQ ID NO: 1658762 - protein, 27 aa, Staphylococcus aureus
SMKVARELIELIIAFMFHHQIPMSVET

SEQ ID NO: 1658763 - protein, 25 aa, Staphylococcus aureus
SQKDFEVGNSIYLNILVKDIEEKSQ

SEQ ID NO: 1658764 - protein, 21 aa, Staphylococcus aureus
STNDLLTWLQDPFIKDMPGKR

SEQ ID NO: 1658765 - protein, 17 aa, Staphylococcus aureus
SVILGVGYEKIHTTNER

SEQ ID NO: 1658766 - protein, 18 aa, Staphylococcus aureus
TAKELLATAVQRLAADHT

SEQ ID NO: 1658767 - protein, 26 aa, Staphylococcus aureus
TASHHLRLLKNLGIAKYRKEGKVVYY

SEQ ID NO: 1658768 - protein, 17 aa, Staphylococcus aureus
TESSIIFIQQLGRGLRK

SEQ ID NO: 1658769 - protein, 25 aa, Staphylococcus aureus
TFHALLDEWLEYHIKTSGFKVTTLD

SEQ ID NO: 1658770 - protein, 18 aa, Staphylococcus aureus
TIGSSYTYGEYRLSQHLA

SEQ ID NO: 1658771 - protein, 17 aa, Staphylococcus aureus
TIPNYKGTNFKRLLKSL

SEQ ID NO: 1658772 - protein, 17 aa, Staphylococcus aureus
TLFKKRNSGIYFYNRGY

SEQ ID NO: 1658773 - protein, 25 aa, Staphylococcus aureus
TNLDIKRYFYLVIHKDKYIDTKLNE

SEQ ID NO: 1658774 - protein, 17 aa, Staphylococcus aureus
TPTCIVCRNWEYNFSLL

SEQ ID NO: 1658775 - protein, 21 aa, Staphylococcus aureus
TRTELPFLVKCVQTAVDAGAT

SEQ ID NO: 1658776 - protein, 18 aa, Staphylococcus aureus
TRTSEVIGEIGYPSVILN

SEQ ID NO: 1658777 - protein, 21 aa, Staphylococcus aureus
TRVKIAYVLSLEGELCVCDVA

SEQ ID NO: 1658778 - protein, 17 aa, Staphylococcus aureus
TTALRMINRMIEATEGQ

SEQ ID NO: 1658779 - protein, 28 aa, Staphylococcus aureus
TTFEHKGKMAFRVYPKWCNQLNKRAEQT

SEQ ID NO: 1658780 - protein, 17 aa, Staphylococcus aureus
TYMCIAAACGENVILNN

SEQ ID NO: 1658781 - protein, 17 aa, Staphylococcus aureus
VEAAAMPMPQVQSTDSN

SEQ ID NO: 1658782 - protein, 20 aa, Staphylococcus aureus
VELEKGQFVFGRKRASEELR

SEQ ID NO: 1658783 - protein, 19 aa, Staphylococcus aureus
VEVPIIVERDIYKATAKTM

SEQ ID NO: 1658784 - protein, 25 aa, Staphylococcus aureus
VIKKDGYWWIRFKYQREGSSTNNFY

SEQ ID NO: 1658785 - protein, 22 aa, Staphylococcus aureus
VKDAWYKQIEDLLEFAKKEEHI

SEQ ID NO: 1658786 - protein, 18 aa, Staphylococcus aureus
VKSAILFASLFSKEATII

SEQ ID NO: 1658787 - protein, 24 aa, Staphylococcus aureus
VKSKREALEMAERVDLDLVVVAPN

SEQ ID NO: 1658788 - protein, 17 aa, Staphylococcus aureus
VNEVYSLTGAHFSDEKK

SEQ ID NO: 1658789 - protein, 19 aa, Staphylococcus aureus
VPTKHAVGIQSEDGVDIVI

SEQ ID NO: 1658790 - protein, 17 aa, Staphylococcus aureus
VQKIIERSCKFYGNTYL

SEQ ID NO: 1658791 - protein, 22 aa, Staphylococcus aureus
VSADFRRGEAIFELSDDQIEKA

SEQ ID NO: 1658792 - protein, 24 aa, Staphylococcus aureus
VSTLELRTAIKVFGKKYTAEEKKN

SEQ ID NO: 1658793 - protein, 21 aa, Staphylococcus aureus
WICKAPKYTGKTWITYEELIK

SEQ ID NO: 1658794 - protein, 23 aa, Staphylococcus aureus
WTKQFLAVAIRPMIHMLYYHGIA

SEQ ID NO: 1658795 - protein, 17 aa, Staphylococcus aureus
YDLKRGISRQLTKEKHD

SEQ ID NO: 1658796 - protein, 17 aa, Staphylococcus aureus
YECDDCSACSLRQQCMK

SEQ ID NO: 1658797 - protein, 19 aa, Staphylococcus aureus
YEIQLKAGIPQKLMEMQGL

SEQ ID NO: 1658798 - protein, 18 aa, Staphylococcus aureus
YEYALKLVHNGLFNILAE

SEQ ID NO: 1658799 - protein, 17 aa, Staphylococcus aureus
YGGPLALGLIRNKLEEH

SEQ ID NO: 1658800 - protein, 18 aa, Staphylococcus aureus
YINITGLGFAKLTKEGAE

SEQ ID NO: 1658801 - protein, 20 aa, Staphylococcus aureus
YIYSRPRSGYFVSKIESLTI

SEQ ID NO: 1658802 - protein, 17 aa, Staphylococcus aureus
YKALPAVFGGKNVEIHD

SEQ ID NO: 1658803 - protein, 21 aa, Staphylococcus aureus
YKAPKPLAGLNGESHDFTTTH

SEQ ID NO: 1658804 - protein, 17 aa, Staphylococcus aureus
YKDLYFYDNESVRLVGK

SEQ ID NO: 1658805 - protein, 22 aa, Staphylococcus aureus
YKIPNIYSYLNLMFFMQENKKE

SEQ ID NO: 1658806 - protein, 17 aa, Staphylococcus aureus
YKKEWPFDMVVIDELST

SEQ ID NO: 1658807 - protein, 26 aa, Staphylococcus aureus
YKKIDYEFLYLLSMDKLFGNKRNRLT

SEQ ID NO: 1658808 - protein, 21 aa, Staphylococcus aureus
YLDGYASLWVNVHGHNNKYLN

SEQ ID NO: 1658809 - protein, 17 aa, Staphylococcus aureus
YLFGLSGNPSACFTGFE

SEQ ID NO: 1658810 - protein, 20 aa, Staphylococcus aureus
YLIQLCGKSNIPIGIIPASI

SEQ ID NO: 1658811 - protein, 23 aa, Staphylococcus aureus
YNEIHMWDYKALPAVFGGKNVEI

SEQ ID NO: 1658812 - protein, 25 aa, Staphylococcus aureus
YPFIVKTRFGGYDGKGQVLINNEKD

SEQ ID NO: 1658813 - protein, 19 aa, Staphylococcus aureus
YPYYGATGIIDYVKDYLFN

SEQ ID NO: 1658814 - protein, 19 aa, Staphylococcus aureus
YQQCPFKHYASHGLKLNER

SEQ ID NO: 1658815 - protein, 17 aa, Staphylococcus aureus
YRARILVAGAVEVQALT

SEQ ID NO: 1658816 - protein, 21 aa, Staphylococcus aureus
YWIKSEVKPDAIIEFHLDSAS

SEQ ID NO: 1658817 - protein, 24 aa, Staphylococcus aureus
YYQLCKAKGLLSIIDNTFLTPYLS

SEQ ID NO: 1658818 - protein, 20 aa, Staphylococcus aureus
YYRYLSRRIGAIVETTLSAL

SEQ ID NO: 1658819 - protein, 17 aa, Staphylococcus aureus
AAADLGKNVANKAIGGL

SEQ ID NO: 1658820 - protein, 20 aa, Staphylococcus aureus
AAYQLSERGIKVNLIEMRPV

SEQ ID NO: 1658821 - protein, 24 aa, Staphylococcus aureus
ADDAKRTAYSQAVNAAATILNKTS

SEQ ID NO: 1658822 - protein, 24 aa, Staphylococcus aureus
ADEAKRNAYTNAVTQAEQILNKVQ

SEQ ID NO: 1658823 - protein, 18 aa, Staphylococcus aureus
ADEYIMNGCNGKKAAISA

SEQ ID NO: 1658824 - protein, 21 aa, Staphylococcus aureus
ADRPLIKLVAFASEIHGESGL

SEQ ID NO: 1658825 - protein, 19 aa, Staphylococcus aureus
ADTNLLINAVDLDIKNNMQ

SEQ ID NO: 1658826 - protein, 24 aa, Staphylococcus aureus
AEALNQAMEALRNSIQDQQQTEAG

SEQ ID NO: 1658827 - protein, 21 aa, Staphylococcus aureus
AEALNYMALAGWDSKQMMEGL

SEQ ID NO: 1658828 - protein, 24 aa, Staphylococcus aureus
AEKNKRKFYKFAVYGKIGSGKTTF

SEQ ID NO: 1658829 - protein, 24 aa, Staphylococcus aureus
AERICKRVDCDIDYEEDAEKWMAD

SEQ ID NO: 1658830 - protein, 18 aa, Staphylococcus aureus
AEVVIEVNIFDFEDNIYG

SEQ ID NO: 1658831 - protein, 18 aa, Staphylococcus aureus
AGLYDHRMFQVVAKYDAE

SEQ ID NO: 1658832 - protein, 17 aa, Staphylococcus aureus
AGRGYRRVVPSPQPISI

SEQ ID NO: 1658833 - protein, 24 aa, Staphylococcus aureus
AHRHKEIDDWVAIAKGVIKRHGDI

SEQ ID NO: 1658834 - protein, 21 aa, Staphylococcus aureus
AIGVSRFAMMNNLEAYIVLNE

SEQ ID NO: 1658835 - protein, 24 aa, Staphylococcus aureus
AIVDFWECATAYLGKSAPKREDIE

SEQ ID NO: 1658836 - protein, 21 aa, Staphylococcus aureus
AIYRKHYKSSKEEALSKIDKA

SEQ ID NO: 1658837 - protein, 29 aa, Staphylococcus aureus
AKEQTALRKAYLESFRKGFKQQIENTKVI

SEQ ID NO: 1658838 - protein, 20 aa, Staphylococcus aureus
AKIMALMGLELITNQDVYQD

SEQ ID NO: 1658839 - protein, 18 aa, Staphylococcus aureus
AKKDRPALQEMLNEIDNF

SEQ ID NO: 1658840 - protein, 17 aa, Staphylococcus aureus
AKVAIQELLWFVFEHFD

SEQ ID NO: 1658841 - protein, 20 aa, Staphylococcus aureus
ALFCRIFKYKFGMVNKVVIK

SEQ ID NO: 1658842 - protein, 19 aa, Staphylococcus aureus
ALTSPVARGHLVFGDIFVE

SEQ ID NO: 1658843 - protein, 21 aa, Staphylococcus aureus
AMCRDIELHWGEPVESTRKLL

SEQ ID NO: 1658844 - protein, 28 aa, Staphylococcus aureus
ANIVKYIFECYAKGHGYRKIANALNHKG

SEQ ID NO: 1658845 - protein, 17 aa, Staphylococcus aureus
ANKRQAYDEKVTAAENI

SEQ ID NO: 1658846 - protein, 21 aa, Staphylococcus aureus
APKKFAAKLGLNYEGDIGPSE

SEQ ID NO: 1658847 - protein, 20 aa, Staphylococcus aureus
APQPFKIMASHYLFEYIHPF

SEQ ID NO: 1658848 - protein, 18 aa, Staphylococcus aureus
ARCQTLFIEGMMDKDEAF

SEQ ID NO: 1658849 - protein, 18 aa, Staphylococcus aureus
ASHYLFEYIHPFYDGNGR

SEQ ID NO: 1658850 - protein, 17 aa, Staphylococcus aureus
ASPILSREFRPLRDEIH

SEQ ID NO: 1658851 - protein, 17 aa, Staphylococcus aureus
ATAKLNAKTYLNTLTSI

SEQ ID NO: 1658852 - protein, 34 aa, Staphylococcus aureus
ATFKSRVEKSIADWDIKLEHTFYVSKFDHSENEL

SEQ ID NO: 1658853 - protein, 17 aa, Staphylococcus aureus
AVIKPKKIMLVAGHGYN

SEQ ID NO: 1658854 - protein, 20 aa, Staphylococcus aureus
AWASVCKPPINQSEVNNTFK

SEQ ID NO: 1658855 - protein, 20 aa, Staphylococcus aureus
AYFNITGLGFAKLTKEGAEL

SEQ ID NO: 1658856 - protein, 19 aa, Staphylococcus aureus
AYGIMKGVRAVRVHNVELN

SEQ ID NO: 1658857 - protein, 17 aa, Staphylococcus aureus
AYRFLKEEVPEEYYTVP

SEQ ID NO: 1658858 - protein, 20 aa, Staphylococcus aureus
CFNCLVPQLPALNLTCDTVG

SEQ ID NO: 1658859 - protein, 17 aa, Staphylococcus aureus
DALKTQVNNAQRVSDAN

SEQ ID NO: 1658860 - protein, 21 aa, Staphylococcus aureus
DDEMYSRFKTGMTLQKNPLTL

SEQ ID NO: 1658861 - protein, 24 aa, Staphylococcus aureus
DDLLEIYYSWAFHEIASAVTDEPS

SEQ ID NO: 1658862 - protein, 22 aa, Staphylococcus aureus
DEKRLNYVGFYRLHHKYNKKVM

SEQ ID NO: 1658863 - protein, 23 aa, Staphylococcus aureus
DESKSGMVPRSRLNDKNTEIEEL

SEQ ID NO: 1658864 - protein, 23 aa, Staphylococcus aureus
DESLKGLVQYDAFEKVTKLKRLP

SEQ ID NO: 1658865 - protein, 25 aa, Staphylococcus aureus
DETHRTNFVAVRFGNVLGSRGSVIP

SEQ ID NO: 1658866 - protein, 26 aa, Staphylococcus aureus
DFEKHMYAIHILTSLYAPTSNTPHIG

SEQ ID NO: 1658867 - protein, 24 aa, Staphylococcus aureus
DFLIAKARCSRSIKGTKPIFKEER

SEQ ID NO: 1658868 - protein, 23 aa, Staphylococcus aureus
DGFTRLDLAFDFEDDLSDYYAMS

SEQ ID NO: 1658869 - protein, 20 aa, Staphylococcus aureus
DIAEAFQIQCAREINNQEIE

SEQ ID NO: 1658870 - protein, 17 aa, Staphylococcus aureus
DIENGLKGEEKVLIEQM

SEQ ID NO: 1658871 - protein, 19 aa, Staphylococcus aureus
DIIIPRIFRRDHASVESLT

SEQ ID NO: 1658872 - protein, 26 aa, Staphylococcus aureus
DKEKQALKDRINQILQQGHNDINNAM

SEQ ID NO: 1658873 - protein, 21 aa, Staphylococcus aureus
DKLKVSFDYIDWINTEFDQLG

SEQ ID NO: 1658874 - protein, 20 aa, Staphylococcus aureus
DKVQGNAIAKAEAEQLKQNI

SEQ ID NO: 1658875 - protein, 17 aa, Staphylococcus aureus
DKYNIQQAKGWTQVKMK

SEQ ID NO: 1658876 - protein, 19 aa, Staphylococcus aureus
DLFLRELMRVRKIADEEGI

SEQ ID NO: 1658877 - protein, 34 aa, Staphylococcus aureus
DLIGKFCHLVLKWKFNKDEGKYFTDFSFIKPYKK

SEQ ID NO: 1658878 - protein, 24 aa, Staphylococcus aureus
DLNKIEVLDTLLLKKLSNSSTTEN

SEQ ID NO: 1658879 - protein, 20 aa, Staphylococcus aureus
DLNQPQRDALRNQINQAQAL

SEQ ID NO: 1658880 - protein, 25 aa, Staphylococcus aureus
DLPKEWLNPSALAPVVEFEDMNAYE

SEQ ID NO: 1658881 - protein, 24 aa, Staphylococcus aureus
DLTKDYVLSVGKEFLKKADTSDKK

SEQ ID NO: 1658882 - protein, 17 aa, Staphylococcus aureus
DLVCQTHPFSQLLHDAI

SEQ ID NO: 1658883 - protein, 19 aa, Staphylococcus aureus
DMVKDGRLTSAHGRTLLAI

SEQ ID NO: 1658884 - protein, 17 aa, Staphylococcus aureus
DNHGWHFEELYPHEPNH

SEQ ID NO: 1658885 - protein, 20 aa, Staphylococcus aureus
DNIMRMLHPFMPFVTEKIWQ

SEQ ID NO: 1658886 - protein, 20 aa, Staphylococcus aureus
DQLIILTAIDYVYINFNTEN

SEQ ID NO: 1658887 - protein, 22 aa, Staphylococcus aureus
DRDSCYFLAMGYFYNKEDSNEI

SEQ ID NO: 1658888 - protein, 26 aa, Staphylococcus aureus
DSKIAYVVEFFEWFNTLETFKNWKKK

SEQ ID NO: 1658889 - protein, 17 aa, Staphylococcus aureus
DSLRLVDNISNSFKKKI

SEQ ID NO: 1658890 - protein, 19 aa, Staphylococcus aureus
DVAVLRRYWNGRWIEETPN

SEQ ID NO: 1658891 - protein, 21 aa, Staphylococcus aureus
DYDAIILAAAGLRRMGWSDDI

SEQ ID NO: 1658892 - protein, 25 aa, Staphylococcus aureus
DYLKDFGIDVIWLSPMFKSPNDDNG

SEQ ID NO: 1658893 - protein, 27 aa, Staphylococcus aureus
EAFEYRKVALFKEWKTQKGIVKYLLDQ

SEQ ID NO: 1658894 - protein, 19 aa, Staphylococcus aureus
EAQTLFFGGLARIDYVSGG

SEQ ID NO: 1658895 - protein, 19 aa, Staphylococcus aureus
EDAVWDLTQVFADFAEGDF

SEQ ID NO: 1658896 - protein, 33 aa, Staphylococcus aureus
EDNRFYEHGALDYKRLFGAIGKNLTGGFGSEGA

SEQ ID NO: 1658897 - protein, 19 aa, Staphylococcus aureus
EEFMFNGKHVLIVYDDLTK

SEQ ID NO: 1658898 - protein, 28 aa, Staphylococcus aureus
EEGLEPWTSCEFDFTREGKLKVSFDYID

SEQ ID NO: 1658899 - protein, 20 aa, Staphylococcus aureus
EEGYRLKFIFIGNQNNNIKN

SEQ ID NO: 1658900 - protein, 17 aa, Staphylococcus aureus
EGKLTVAGLLLFSNHIN

SEQ ID NO: 1658901 - protein, 24 aa, Staphylococcus aureus
EGLEPWTSCEFDFTKEDKLKVSFD

SEQ ID NO: 1658902 - protein, 17 aa, Staphylococcus aureus
EGLYPYHIYTYIINELM

SEQ ID NO: 1658903 - protein, 18 aa, Staphylococcus aureus
EHYYMYKKFGIWPEKEYA

SEQ ID NO: 1658904 - protein, 19 aa, Staphylococcus aureus
EIIESLDFFMKYTNIKHDN

SEQ ID NO: 1658905 - protein, 19 aa, Staphylococcus aureus
EILDLLSCGELCACDLLAH

SEQ ID NO: 1658906 - protein, 23 aa, Staphylococcus aureus
EKIRPPYKSNWYKKEYSNLNIDD

SEQ ID NO: 1658907 - protein, 26 aa, Staphylococcus aureus
EKLNNRKSEALQRLDQLTHLNNAQRQ

SEQ ID NO: 1658908 - protein, 20 aa, Staphylococcus aureus
ELKRRGIDINEAFNQVKRYR

SEQ ID NO: 1658909 - protein, 24 aa, Staphylococcus aureus
ELPEFKRLLRYYGAIKVSDNGGVD

SEQ ID NO: 1658910 - protein, 22 aa, Staphylococcus aureus
ELSQNIPVFFSANMSYGVHALT

SEQ ID NO: 1658911 - protein, 17 aa, Staphylococcus aureus
EMIALLIKYHGQYITIH

SEQ ID NO: 1658912 - protein, 17 aa, Staphylococcus aureus
EQGKRKANEIGTLMHTV

SEQ ID NO: 1658913 - protein, 27 aa, Staphylococcus aureus
EQREIIEELMLVKGYRDANDKAFKALK

SEQ ID NO: 1658914 - protein, 21 aa, Staphylococcus aureus
ERHPRQCVFVGTTNNYEFLKD

SEQ ID NO: 1658915 - protein, 28 aa, Staphylococcus aureus
ERKMTAMLRYQFKVILSALKRKGYNLDD

SEQ ID NO: 1658916 - protein, 25 aa, Staphylococcus aureus
ERMEEEMFLGLRLNEGVSSRRFKKK

SEQ ID NO: 1658917 - protein, 22 aa, Staphylococcus aureus
ESGHHFDAILFLKEDTTLQNNV

SEQ ID NO: 1658918 - protein, 25 aa, Staphylococcus aureus
ESISWLINYVKQYPHTVLFVTHDRY

SEQ ID NO: 1658919 - protein, 27 aa, Staphylococcus aureus
ETFVDAFNFVCTFLAKAIARDGEGATK

SEQ ID NO: 1658920 - protein, 25 aa, Staphylococcus aureus
ETKLRRFREALIFMGRKNGKTTTIS

SEQ ID NO: 1658921 - protein, 23 aa, Staphylococcus aureus
ETVKATELNNAMHSLQNGINDET

SEQ ID NO: 1658922 - protein, 18 aa, Staphylococcus aureus
EVIPGVFLQKEPDNPYDE

SEQ ID NO: 1658923 - protein, 20 aa, Staphylococcus aureus
EVWYSKLYFCSNCKNTKNKN

SEQ ID NO: 1658924 - protein, 19 aa, Staphylococcus aureus
FAELGFTFFNYHYTAKLIK

SEQ ID NO: 1658925 - protein, 17 aa, Staphylococcus aureus
FCMTLGTGIGGAYKNNQ

SEQ ID NO: 1658926 - protein, 21 aa, Staphylococcus aureus
FDDAKRLANTLLNSDNTNVND

SEQ ID NO: 1658927 - protein, 17 aa, Staphylococcus aureus
FDEACHVMNTIAPEHAS

SEQ ID NO: 1658928 - protein, 18 aa, Staphylococcus aureus
FDLKDLHVVIGPSTSSSY

SEQ ID NO: 1658929 - protein, 19 aa, Staphylococcus aureus
FDLLISLCLFLNKHDYIKL

SEQ ID NO: 1658930 - protein, 17 aa, Staphylococcus aureus
FDLPLIIRNEKLSPGGE

SEQ ID NO: 1658931 - protein, 18 aa, Staphylococcus aureus
FEALKKKAREMGATTKFS

SEQ ID NO: 1658932 - protein, 20 aa, Staphylococcus aureus
FEETPCEFVDGSKGVRLAYE

SEQ ID NO: 1658933 - protein, 23 aa, Staphylococcus aureus
FENKFDVEYGFYILFIKPIFEIV

SEQ ID NO: 1658934 - protein, 23 aa, Staphylococcus aureus
FGSAPSGVALEFLYTNLNLKADK

SEQ ID NO: 1658935 - protein, 20 aa, Staphylococcus aureus
FKALAKDVFEMFVNEEKVLT

SEQ ID NO: 1658936 - protein, 17 aa, Staphylococcus aureus
FKELPVRTVEIENEPYF

SEQ ID NO: 1658937 - protein, 27 aa, Staphylococcus aureus
FKLFRVPAEQGIPIWTDKEHEELEAFI

SEQ ID NO: 1658938 - protein, 20 aa, Staphylococcus aureus
FKSQNWYWFAYFDGPLKLPK

SEQ ID NO: 1658939 - protein, 19 aa, Staphylococcus aureus
FLAEVYRSLSVLDGAILLI

SEQ ID NO: 1658940 - protein, 23 aa, Staphylococcus aureus
FLMIELPSGRALAYPKALVGENS

SEQ ID NO: 1658941 - protein, 19 aa, Staphylococcus aureus
FNIAGAFNPNVRKLDGAVK

SEQ ID NO: 1658942 - protein, 24 aa, Staphylococcus aureus
FNNIKRLNIETIKQENTSFIKEDT

SEQ ID NO: 1658943 - protein, 19 aa, Staphylococcus aureus
FSPELVDFSIYIIDVAQGE

SEQ ID NO: 1658944 - protein, 19 aa, Staphylococcus aureus
FSTKEPKSLILQGSYGTGK

SEQ ID NO: 1658945 - protein, 17 aa, Staphylococcus aureus
FTIPVKFTIKVVLTDPY

SEQ ID NO: 1658946 - protein, 17 aa, Staphylococcus aureus
FYSPMMANMNEHELRAM

SEQ ID NO: 1658947 - protein, 17 aa, Staphylococcus aureus
GEKVQIWIADYVLSTYG

SEQ ID NO: 1658948 - protein, 18 aa, Staphylococcus aureus
GEKVQIWIADYVLSTYGT

SEQ ID NO: 1658949 - protein, 23 aa, Staphylococcus aureus
GHNEIKMVQDLGVDVIVTDHHEI

SEQ ID NO: 1658950 - protein, 24 aa, Staphylococcus aureus
GIARVMEPGCKFDYMLTLYGPQGV

SEQ ID NO: 1658951 - protein, 17 aa, Staphylococcus aureus
GICGTDIHTYEGHYKVN

SEQ ID NO: 1658952 - protein, 18 aa, Staphylococcus aureus
GIICYIQFQMKYLADKFD

SEQ ID NO: 1658953 - protein, 24 aa, Staphylococcus aureus
GKELKVVIVVSRFNDFITGRLLEG

SEQ ID NO: 1658954 - protein, 20 aa, Staphylococcus aureus
GKLKVSFDYIDWLNTEFDQL

SEQ ID NO: 1658955 - protein, 25 aa, Staphylococcus aureus
GKLQEEYKFHFVITGHEGINKDKDD

SEQ ID NO: 1658956 - protein, 25 aa, Staphylococcus aureus
GKSLKGSHVSLIIPIDGVDYVTGAD

SEQ ID NO: 1658957 - protein, 17 aa, Staphylococcus aureus
GKYSESVVVTGNTAIDA

SEQ ID NO: 1658958 - protein, 20 aa, Staphylococcus aureus
GLMVNYCLQAADILAADGIN

SEQ ID NO: 1658959 - protein, 18 aa, Staphylococcus aureus
GMLDAAVCGEVFTSPIPD

SEQ ID NO: 1658960 - protein, 19 aa, Staphylococcus aureus
GPSEVLGGSASEFSPTQLA

SEQ ID NO: 1658961 - protein, 19 aa, Staphylococcus aureus
GRSGSIYKGRRLESYSFDI

SEQ ID NO: 1658962 - protein, 24 aa, Staphylococcus aureus
GSMLPKIEAAIRFVESGENKKVII

SEQ ID NO: 1658963 - protein, 24 aa, Staphylococcus aureus
GSMLPKIEAAISFIENNPKGSVLI

SEQ ID NO: 1658964 - protein, 23 aa, Staphylococcus aureus
GSYTGHLFKSFLEKHYKNKFILN

SEQ ID NO: 1658965 - protein, 25 aa, Staphylococcus aureus
GTEPKIKLYVSLKCPNFDDVAQKIN

SEQ ID NO: 1658966 - protein, 18 aa, Staphylococcus aureus
GVDLGDIGCRFYTEDENT

SEQ ID NO: 1658967 - protein, 23 aa, Staphylococcus aureus
GVSIESLIEFCRLAQLPKNKNIQ

SEQ ID NO: 1658968 - protein, 19 aa, Staphylococcus aureus
HARNHLRLWSLQGHRDIPN

SEQ ID NO: 1658969 - protein, 24 aa, Staphylococcus aureus
HFTLELVQRCNFVTAIEIDHKLCK

SEQ ID NO: 1658970 - protein, 17 aa, Staphylococcus aureus
HGGGLMFGKANDLSPQY

SEQ ID NO: 1658971 - protein, 26 aa, Staphylococcus aureus
HIYSEYFFRDLLNIVYGYSLENHNKK

SEQ ID NO: 1658972 - protein, 18 aa, Staphylococcus aureus
HLLRCHVNDYIVYSFALL

SEQ ID NO: 1658973 - protein, 29 aa, Staphylococcus aureus
HLTEREKRVIKREHVREAQKLVDNYKDTH

SEQ ID NO: 1658974 - protein, 25 aa, Staphylococcus aureus
HRDEVLKKIRLHITQGIMSGEGYSK

SEQ ID NO: 1658975 - protein, 22 aa, Staphylococcus aureus
HRHNLKRPLILLNWNTLTGDTF

SEQ ID NO: 1658976 - protein, 25 aa, Staphylococcus aureus
HSKSIWKGTSKWFSNAYKSAKGWLT

SEQ ID NO: 1658977 - protein, 31 aa, Staphylococcus aureus
HSLGGRDAIFLGLRYNIKNVVAYNPAPLEVK

SEQ ID NO: 1658978 - protein, 18 aa, Staphylococcus aureus
HWQRHASQMIARLKEDGS

SEQ ID NO: 1658979 - protein, 18 aa, Staphylococcus aureus
IAIRGRIPVQLAREKFPY

SEQ ID NO: 1658980 - protein, 31 aa, Staphylococcus aureus
IANEISSMIPVEWEKVYTMAYIDDGGGEVFF

SEQ ID NO: 1658981 - protein, 23 aa, Staphylococcus aureus
IDEELQWQWVKGIIEAYQEAFPE

SEQ ID NO: 1658982 - protein, 21 aa, Staphylococcus aureus
IDLELLIAIVSVKFDINYSLK

SEQ ID NO: 1658983 - protein, 21 aa, Staphylococcus aureus
IDPKNGVVFFNLANVYYNQQR

SEQ ID NO: 1658984 - protein, 17 aa, Staphylococcus aureus
IEAQLHLTVVERKKEIL

SEQ ID NO: 1658985 - protein, 26 aa, Staphylococcus aureus
IEIGYLPGRLKWLVADLLTKQSLKVV

SEQ ID NO: 1658986 - protein, 19 aa, Staphylococcus aureus
IETRRYYLMLMLFSKENAM

SEQ ID NO: 1658987 - protein, 19 aa, Staphylococcus aureus
IGAIIPRMNSYAVDETIKG

SEQ ID NO: 1658988 - protein, 26 aa, Staphylococcus aureus
IGKMAAICGYGARLAYIDTNGDIRIK

SEQ ID NO: 1658989 - protein, 22 aa, Staphylococcus aureus
IIKEDLPLLSCIEPNDTFDFQK

SEQ ID NO: 1658990 - protein, 26 aa, Staphylococcus aureus
IIQKRFTLNILYPYIETIHITKDKNL

SEQ ID NO: 1658991 - protein, 22 aa, Staphylococcus aureus
IKNADADASAKEIARTDLGRYF

SEQ ID NO: 1658992 - protein, 27 aa, Staphylococcus aureus
IKNNVKEVIAGFDFTFGKFGKGNMTVL

SEQ ID NO: 1658993 - protein, 24 aa, Staphylococcus aureus
IKQKVELYPNMCVTNFTESEQWDT

SEQ ID NO: 1658994 - protein, 26 aa, Staphylococcus aureus
IKTYIFYHLFDRYIIDYSMASATGMF

SEQ ID NO: 1658995 - protein, 21 aa, Staphylococcus aureus
IKVHYAGICGTDIHTYEGHYK

SEQ ID NO: 1658996 - protein, 17 aa, Staphylococcus aureus
ILALFCRIFKYKFGMVN

SEQ ID NO: 1658997 - protein, 17 aa, Staphylococcus aureus
ILQSLQLLDRHYKHYEI

SEQ ID NO: 1658998 - protein, 24 aa, Staphylococcus aureus
ILRAQEMNIPISIEIPDEVSSINL

SEQ ID NO: 1658999 - protein, 18 aa, Staphylococcus aureus
IMTPWIPTDTNIGGEFVP

SEQ ID NO: 1659000 - protein, 21 aa, Staphylococcus aureus
INGDVPIFINIGEWDGDDEEL

SEQ ID NO: 1659001 - protein, 26 aa, Staphylococcus aureus
INKRRVKEWLKRTARKYSLEADDVVL

SEQ ID NO: 1659002 - protein, 20 aa, Staphylococcus aureus
INVDGFDFKLAVKKQDYSIL

SEQ ID NO: 1659003 - protein, 20 aa, Staphylococcus aureus
IPGNGKFLYSPFSIIDNESI

SEQ ID NO: 1659004 - protein, 17 aa, Staphylococcus aureus
IPGYIMIYLVPSTSTIN

SEQ ID NO: 1659005 - protein, 21 aa, Staphylococcus aureus
IPPKLGVSSFVGYLKGKSSLM

SEQ ID NO: 1659006 - protein, 17 aa, Staphylococcus aureus
IPVKFTIKVVLTDPYKY

SEQ ID NO: 1659007 - protein, 20 aa, Staphylococcus aureus
IQAGLGRSGKLFARDWDNVK

SEQ ID NO: 1659008 - protein, 26 aa, Staphylococcus aureus
IQGNTVCYMWLRFNMDQQFDDTAINQ

SEQ ID NO: 1659009 - protein, 24 aa, Staphylococcus aureus
ISMIPVEWEKVYAMAYIDEECGEV

SEQ ID NO: 1659010 - protein, 20 aa, Staphylococcus aureus
ISRKHLAIVLDEFGGTEAIV

SEQ ID NO: 1659011 - protein, 19 aa, Staphylococcus aureus
ITDDGRLSAKEVVGNKKAL

SEQ ID NO: 1659012 - protein, 17 aa, Staphylococcus aureus
KAMLRDLATSLIISERI

SEQ ID NO: 1659013 - protein, 23 aa, Staphylococcus aureus
KAMSDYTAYMLAEMLKGTFKPYG

SEQ ID NO: 1659014 - protein, 17 aa, Staphylococcus aureus
KANYCVQFAYSESLGIQ

SEQ ID NO: 1659015 - protein, 20 aa, Staphylococcus aureus
KAQAFDEILKGLPNAMQDAL

SEQ ID NO: 1659016 - protein, 25 aa, Staphylococcus aureus
KAQALDHAMELLRNSVADNQATLAS

SEQ ID NO: 1659017 - protein, 24 aa, Staphylococcus aureus
KDAAKRQIEGATHVSEVTQAQNNA

SEQ ID NO: 1659018 - protein, 17 aa, Staphylococcus aureus
KDMGRAAADLGKNVANK

SEQ ID NO: 1659019 - protein, 18 aa, Staphylococcus aureus
KDYGMYWIKSEVKPDAII

SEQ ID NO: 1659020 - protein, 17 aa, Staphylococcus aureus
KETCVFKGTLNSSIVHP

SEQ ID NO: 1659021 - protein, 18 aa, Staphylococcus aureus
KEVYGNKDFIVGYRLSPE

SEQ ID NO: 1659022 - protein, 19 aa, Staphylococcus aureus
KGGQCVRQLLQADDVEVSD

SEQ ID NO: 1659023 - protein, 18 aa, Staphylococcus aureus
KGRAGSIVKNRYLNDIEF

SEQ ID NO: 1659024 - protein, 20 aa, Staphylococcus aureus
KGSFEIEGVSLFELQANQLK

SEQ ID NO: 1659025 - protein, 19 aa, Staphylococcus aureus
KGTELEDFAAFNLSIEDTV

SEQ ID NO: 1659026 - protein, 20 aa, Staphylococcus aureus
KHGLTCAYSTFRAYILKHDE

SEQ ID NO: 1659027 - protein, 17 aa, Staphylococcus aureus
KHIMKIRNLKQVDIINK

SEQ ID NO: 1659028 - protein, 25 aa, Staphylococcus aureus
KIKNFKYSLLNGWELMEDELKTEFI

SEQ ID NO: 1659029 - protein, 17 aa, Staphylococcus aureus
KKAREMGATTKFSASDS

SEQ ID NO: 1659030 - protein, 23 aa, Staphylococcus aureus
KKKAAEKIGMISEIVHLEETATE

SEQ ID NO: 1659031 - protein, 19 aa, Staphylococcus aureus
KKVANAFGLNEADTNLLIN

SEQ ID NO: 1659032 - protein, 25 aa, Staphylococcus aureus
KKVELRLRYEVPKIAYASHLKSDIQ

SEQ ID NO: 1659033 - protein, 19 aa, Staphylococcus aureus
KKWMMGAVARIYQPGIKYD

SEQ ID NO: 1659034 - protein, 17 aa, Staphylococcus aureus
KLLDQLREKFKHLSKDQ

SEQ ID NO: 1659035 - protein, 19 aa, Staphylococcus aureus
KLREVYPITTKKSPVLKLH

SEQ ID NO: 1659036 - protein, 20 aa, Staphylococcus aureus
KLVATELLWFIKGDTNIQYL

SEQ ID NO: 1659037 - protein, 19 aa, Staphylococcus aureus
KMHIDGNLKGSSVGYKKLE

SEQ ID NO: 1659038 - protein, 23 aa, Staphylococcus aureus
KMNRQKIDPIISIITAFTEARMH

SEQ ID NO: 1659039 - protein, 17 aa, Staphylococcus aureus
KMPNRKALNRLGYMGQT

SEQ ID NO: 1659040 - protein, 18 aa, Staphylococcus aureus
KMSRRKKTAAKKLLEVSN

SEQ ID NO: 1659041 - protein, 19 aa, Staphylococcus aureus
KMVRSLREMRIRGVKTNIP

SEQ ID NO: 1659042 - protein, 22 aa, Staphylococcus aureus
KNTRSIDANKDFNTVRYVYNRN

SEQ ID NO: 1659043 - protein, 25 aa, Staphylococcus aureus
KPFSPREVVLRVKALLRRTQSTTVE

SEQ ID NO: 1659044 - protein, 20 aa, Staphylococcus aureus
KPSYKQVYSIIKAMPKSVID

SEQ ID NO: 1659045 - protein, 19 aa, Staphylococcus aureus
KQIIEQAFDLKCENCGRKY

SEQ ID NO: 1659046 - protein, 18 aa, Staphylococcus aureus
KQKHKILNLDDAEDGNLI

SEQ ID NO: 1659047 - protein, 20 aa, Staphylococcus aureus
KQKYLLLEFGNFEQEANEKQ

SEQ ID NO: 1659048 - protein, 26 aa, Staphylococcus aureus
KSDNKFSVITVVNWAIYQSMEENSDS

SEQ ID NO: 1659049 - protein, 19 aa, Staphylococcus aureus
KSHLSMSIVKSVKAKGYTV

SEQ ID NO: 1659050 - protein, 18 aa, Staphylococcus aureus
KSIRLSFAFESNENIKHA

SEQ ID NO: 1659051 - protein, 25 aa, Staphylococcus aureus
KTYSLGMKQKLGIAIAFLNEPQFII

SEQ ID NO: 1659052 - protein, 18 aa, Staphylococcus aureus
KWMKNIIDSKVYDNESTS

SEQ ID NO: 1659053 - protein, 17 aa, Staphylococcus aureus
KYLSGRNRIELIEPLDA

SEQ ID NO: 1659054 - protein, 21 aa, Staphylococcus aureus
LAAAGLRRMGWSDDIVTSYLD

SEQ ID NO: 1659055 - protein, 21 aa, Staphylococcus aureus
LAHGEFGKWLEKVGLDKYQAS

SEQ ID NO: 1659056 - protein, 18 aa, Staphylococcus aureus
LDINVNRIGIKGGDNNRY

SEQ ID NO: 1659057 - protein, 20 aa, Staphylococcus aureus
LDLADLIPARHVKRIHHVEN

SEQ ID NO: 1659058 - protein, 17 aa, Staphylococcus aureus
LELIDAIPEDENVTLYS

SEQ ID NO: 1659059 - protein, 18 aa, Staphylococcus aureus
LEPQDIAEAVLYALTQPK

SEQ ID NO: 1659060 - protein, 19 aa, Staphylococcus aureus
LEPQDIAEAVLYALTQPKH

SEQ ID NO: 1659061 - protein, 18 aa, Staphylococcus aureus
LEPSQLIVIAARPSVGKT

SEQ ID NO: 1659062 - protein, 23 aa, Staphylococcus aureus
LETLARSKVDGIVLMATDITERH

SEQ ID NO: 1659063 - protein, 17 aa, Staphylococcus aureus
LFCRIFKYKFGMVNKVV

SEQ ID NO: 1659064 - protein, 24 aa, Staphylococcus aureus
LGKSPAQVVLRWNVQHAVVTIPKS

SEQ ID NO: 1659065 - protein, 17 aa, Staphylococcus aureus
LHNRFIEKYGFEQLVNI

SEQ ID NO: 1659066 - protein, 17 aa, Staphylococcus aureus
LIDPMLSDKGAFEPFPN

SEQ ID NO: 1659067 - protein, 21 aa, Staphylococcus aureus
LIEGKSQRKAYIDAGYSTKGK

SEQ ID NO: 1659068 - protein, 17 aa, Staphylococcus aureus
LIRGVWLLSGIDKNLSE

SEQ ID NO: 1659069 - protein, 21 aa, Staphylococcus aureus
LKKYQPIEVILRQNCDKCGHQ

SEQ ID NO: 1659070 - protein, 27 aa, Staphylococcus aureus
LKQLCTTYKMALDFYIELSSNTVKGRY

SEQ ID NO: 1659071 - protein, 24 aa, Staphylococcus aureus
LKYYKERVLVPLAYINFDEYIKEL

SEQ ID NO: 1659072 - protein, 25 aa, Staphylococcus aureus
LMNHPNKLIPLTFFVKKFKQAKSSI

SEQ ID NO: 1659073 - protein, 27 aa, Staphylococcus aureus
LNPIELKNRIGFVYSENYFNERWTTKQ

SEQ ID NO: 1659074 - protein, 24 aa, Staphylococcus aureus
LPKNPRGSVKFTIKVVLTDPYKYS

SEQ ID NO: 1659075 - protein, 17 aa, Staphylococcus aureus
LQGFNTKILYHNRSRHK

SEQ ID NO: 1659076 - protein, 17 aa, Staphylococcus aureus
LQLPLLKIDLNFYPQFC

SEQ ID NO: 1659077 - protein, 19 aa, Staphylococcus aureus
LQLWIKAILKKTDITNKQI

SEQ ID NO: 1659078 - protein, 21 aa, Staphylococcus aureus
LRKMGIPTIFFINKIDQNGID

SEQ ID NO: 1659079 - protein, 26 aa, Staphylococcus aureus
LRQSFNIPALKAWQSVKQNAGNDAPK

SEQ ID NO: 1659080 - protein, 26 aa, Staphylococcus aureus
LRSYLESMSQDFNVGGFFNKKKKKLQ

SEQ ID NO: 1659081 - protein, 27 aa, Staphylococcus aureus
LSELKKYFYRFSLKARKRVKTVSIDMH

SEQ ID NO: 1659082 - protein, 17 aa, Staphylococcus aureus
LSIASGHVGMVGGQMLD

SEQ ID NO: 1659083 - protein, 26 aa, Staphylococcus aureus
LSRFGLCVMNPIPISIKVKFPPPTSK

SEQ ID NO: 1659084 - protein, 29 aa, Staphylococcus aureus
LYGWNVTDCKICFKYGLYYSPVSTPADFR

SEQ ID NO: 1659085 - protein, 18 aa, Staphylococcus aureus
LYYTRNKLLSVEECTSCS

SEQ ID NO: 1659086 - protein, 17 aa, Staphylococcus aureus
MAEYIGISEPQKLVQLF

SEQ ID NO: 1659087 - protein, 30 aa, Staphylococcus aureus
MGRPVQCVFLSWNRYLYRNAQNYITSSDYI

SEQ ID NO: 1659088 - protein, 18 aa, Staphylococcus aureus
MHIDGNLKGSSVGYKKLE

SEQ ID NO: 1659089 - protein, 18 aa, Staphylococcus aureus
MKDLINYDLIKQGIPDNA

SEQ ID NO: 1659090 - protein, 17 aa, Staphylococcus aureus
MLSDMKESGGIEADASL

SEQ ID NO: 1659091 - protein, 18 aa, Staphylococcus aureus
MMAKETWLNADEAIEQGF

SEQ ID NO: 1659092 - protein, 25 aa, Staphylococcus aureus
MSDFKRLNGLMIGFVIKGEAHIYDE

SEQ ID NO: 1659093 - protein, 19 aa, Staphylococcus aureus
MSKGSFKRAIGHLYKHKII

SEQ ID NO: 1659094 - protein, 17 aa, Staphylococcus aureus
MTIIQPRIDNFSTEELP

SEQ ID NO: 1659095 - protein, 18 aa, Staphylococcus aureus
MYEAGEWIQFYAIDEQEF

SEQ ID NO: 1659096 - protein, 17 aa, Staphylococcus aureus
NALKVTPEYLLLKNRQT

SEQ ID NO: 1659097 - protein, 17 aa, Staphylococcus aureus
NDVAPFFNVSPEQLANE

SEQ ID NO: 1659098 - protein, 18 aa, Staphylococcus aureus
NDVVKNFTANGLLSIGAS

SEQ ID NO: 1659099 - protein, 21 aa, Staphylococcus aureus
NEAHQLLKLVGMSAKAQQYIG

SEQ ID NO: 1659100 - protein, 17 aa, Staphylococcus aureus
NEWKMTAKELNYFINEL

SEQ ID NO: 1659101 - protein, 18 aa, Staphylococcus aureus
NFEKVVQYESVFDFEEMI

SEQ ID NO: 1659102 - protein, 17 aa, Staphylococcus aureus
NFGRIITAIGYSGCEID

SEQ ID NO: 1659103 - protein, 20 aa, Staphylococcus aureus
NGFRKWLSRTYEWIRDIGKD

SEQ ID NO: 1659104 - protein, 29 aa, Staphylococcus aureus
NIIKRKTGVLMLNPELLMRGDDQKQKYLL

SEQ ID NO: 1659105 - protein, 24 aa, Staphylococcus aureus
NKAYETLQGYGFPVISRKEMQQEI

SEQ ID NO: 1659106 - protein, 19 aa, Staphylococcus aureus
NKKTPVVSLEYDFEHKQRV

SEQ ID NO: 1659107 - protein, 17 aa, Staphylococcus aureus
NLKDWTIARLLKTDRII

SEQ ID NO: 1659108 - protein, 17 aa, Staphylococcus aureus
NLKEYRKYYEPLIHKKD

SEQ ID NO: 1659109 - protein, 25 aa, Staphylococcus aureus
NMFIKEVFSRCSYKGARILIDTNPE

SEQ ID NO: 1659110 - protein, 24 aa, Staphylococcus aureus
NNQRSALYIKHLTAFIDQLISLEV

SEQ ID NO: 1659111 - protein, 21 aa, Staphylococcus aureus
NQYKFPIAVIEEVLKSKEVYG

SEQ ID NO: 1659112 - protein, 20 aa, Staphylococcus aureus
NRFIEKYGFEQLVNIKDLIS

SEQ ID NO: 1659113 - protein, 26 aa, Staphylococcus aureus
NRYGCALAVEVLKRLKDENIGINLYS

SEQ ID NO: 1659114 - protein, 19 aa, Staphylococcus aureus
NSIMPRKSRVSLQKIKQKW

SEQ ID NO: 1659115 - protein, 24 aa, Staphylococcus aureus
NSITRPSFRVPNDDALTYYEQRFD

SEQ ID NO: 1659116 - protein, 17 aa, Staphylococcus aureus
NVESALQNVQRAKNDLN

SEQ ID NO: 1659117 - protein, 19 aa, Staphylococcus aureus
NVSSTARASFYIYNTKEDV

SEQ ID NO: 1659118 - protein, 23 aa, Staphylococcus aureus
NYYLNFKELRAFVTGNAPAKLTH

SEQ ID NO: 1659119 - protein, 17 aa, Staphylococcus aureus
PEFLIKRSHLLKKAKCI

SEQ ID NO: 1659120 - protein, 19 aa, Staphylococcus aureus
PELEGKLHGMALRVPTKNV

SEQ ID NO: 1659121 - protein, 19 aa, Staphylococcus aureus
PETLEEMIVRYIKQHLEKL

SEQ ID NO: 1659122 - protein, 22 aa, Staphylococcus aureus
PEVLKKLESVYGKQSMQAKSDR

SEQ ID NO: 1659123 - protein, 17 aa, Staphylococcus aureus
PGVSAPAVLGLYPHTVL

SEQ ID NO: 1659124 - protein, 20 aa, Staphylococcus aureus
PHDISYEVAQQFMTQDIILK

SEQ ID NO: 1659125 - protein, 29 aa, Staphylococcus aureus
PILGICLGAQALTCYYGGEVIKGDKVMHG

SEQ ID NO: 1659126 - protein, 21 aa, Staphylococcus aureus
PKDLRMSDQMSIQYLNNDFWS

SEQ ID NO: 1659127 - protein, 27 aa, Staphylococcus aureus
PKGTLIPHRGIVRLVHRNHYVPLNEET

SEQ ID NO: 1659128 - protein, 21 aa, Staphylococcus aureus
PMYFIRLNFPNNLSVGNKAKG

SEQ ID NO: 1659129 - protein, 17 aa, Staphylococcus aureus
PQAFYFVNGEMVWNRDH

SEQ ID NO: 1659130 - protein, 24 aa, Staphylococcus aureus
PQLRLYGLGAYELLSLMYDIHTIR

SEQ ID NO: 1659131 - protein, 25 aa, Staphylococcus aureus
PQPFKIMASHYMFEYIHPFYDGNGR

SEQ ID NO: 1659132 - protein, 25 aa, Staphylococcus aureus
PTGSSLKPFLAYGPAIENMKWATNH

SEQ ID NO: 1659133 - protein, 18 aa, Staphylococcus aureus
PTLNLRDSKIAYVVEFFE

SEQ ID NO: 1659134 - protein, 17 aa, Staphylococcus aureus
PTRAMGNEMERLGISIT

SEQ ID NO: 1659135 - protein, 21 aa, Staphylococcus aureus
PWLYVERGFEIPSFNYVLKTE

SEQ ID NO: 1659136 - protein, 25 aa, Staphylococcus aureus
QAFDLKCENCGRKYDYYKFDDGSEF

SEQ ID NO: 1659137 - protein, 23 aa, Staphylococcus aureus
QAKERRSMYIFKKDLLPKMYWYG

SEQ ID NO: 1659138 - protein, 17 aa, Staphylococcus aureus
QDGVGLPLFTALPIVSG

SEQ ID NO: 1659139 - protein, 17 aa, Staphylococcus aureus
QGILRTLFDSEKFEAIR

SEQ ID NO: 1659140 - protein, 17 aa, Staphylococcus aureus
QHLGCKVYRTSHEDDDL

SEQ ID NO: 1659141 - protein, 18 aa, Staphylococcus aureus
QIHLKKADFYQIINRNQL

SEQ ID NO: 1659142 - protein, 20 aa, Staphylococcus aureus
QILACSELDVPVFDAYHTDY

SEQ ID NO: 1659143 - protein, 27 aa, Staphylococcus aureus
QKEALKAQVTSAGRVSVANGVEHTATE

SEQ ID NO: 1659144 - protein, 26 aa, Staphylococcus aureus
QLTAEEKTEALAMIKQITDQAKQGIT

SEQ ID NO: 1659145 - protein, 24 aa, Staphylococcus aureus
QNVTIPAIEAIVPQNDPDANDTNN

SEQ ID NO: 1659146 - protein, 26 aa, Staphylococcus aureus
QPWQHFIIGSLFGWVHKETKLRRFRE

SEQ ID NO: 1659147 - protein, 21 aa, Staphylococcus aureus
QRFKCLECNGTFTAKTSIVDE

SEQ ID NO: 1659148 - protein, 17 aa, Staphylococcus aureus
QRRKHLKQNIASPSTTE

SEQ ID NO: 1659149 - protein, 18 aa, Staphylococcus aureus
QVKSAILFASLFSNDTTV

SEQ ID NO: 1659150 - protein, 19 aa, Staphylococcus aureus
QYCKHEFVLSGVRQKEFGV

SEQ ID NO: 1659151 - protein, 24 aa, Staphylococcus aureus
QYFKKNQIIWGFLHLASSKEIVEK

SEQ ID NO: 1659152 - protein, 25 aa, Staphylococcus aureus
RDNHSAYAFIKRLIKQFGKPQKVIT

SEQ ID NO: 1659153 - protein, 23 aa, Staphylococcus aureus
RDVSKRVLSHILGVELPNPSMID

SEQ ID NO: 1659154 - protein, 23 aa, Staphylococcus aureus
REIKRGDLPSSFPKLDVDNRFYY

SEQ ID NO: 1659155 - protein, 17 aa, Staphylococcus aureus
RELLVEKGILTTFEHKG

SEQ ID NO: 1659156 - protein, 18 aa, Staphylococcus aureus
RFEIKRGDKVTGKVRKPK

SEQ ID NO: 1659157 - protein, 22 aa, Staphylococcus aureus
RGPSELCGNVFKIEYTKKRQRL

SEQ ID NO: 1659158 - protein, 17 aa, Staphylococcus aureus
RHISAQYNVEFIPQRAF

SEQ ID NO: 1659159 - protein, 21 aa, Staphylococcus aureus
RIQKINLWLEQEGYPKLERTS

SEQ ID NO: 1659160 - protein, 17 aa, Staphylococcus aureus
RKEERKRVIAQNHMDVP

SEQ ID NO: 1659161 - protein, 19 aa, Staphylococcus aureus
RKERARCQTLFIEGMMDKD

SEQ ID NO: 1659162 - protein, 19 aa, Staphylococcus aureus
RKINWKSLYEKALNHDFAE

SEQ ID NO: 1659163 - protein, 17 aa, Staphylococcus aureus
RKLKISGGGRCNVTNRL

SEQ ID NO: 1659164 - protein, 17 aa, Staphylococcus aureus
RLCTIKAKQELRIGTWS

SEQ ID NO: 1659165 - protein, 21 aa, Staphylococcus aureus
RLKEIKQIIADMFEKYQNDDV

SEQ ID NO: 1659166 - protein, 18 aa, Staphylococcus aureus
RLQYVIPNEFLKHSGKVH

SEQ ID NO: 1659167 - protein, 20 aa, Staphylococcus aureus
RLVNRIIVLKDGMIVDDFAI

SEQ ID NO: 1659168 - protein, 19 aa, Staphylococcus aureus
RLYEKCKLLSQIETTSSTL

SEQ ID NO: 1659169 - protein, 19 aa, Staphylococcus aureus
RMLTPIVLEQAFRKAGTEL

SEQ ID NO: 1659170 - protein, 22 aa, Staphylococcus aureus
RNAKKATGYYFVNKVYDDISKN

SEQ ID NO: 1659171 - protein, 19 aa, Staphylococcus aureus
RPSIPLDEIEQVITRLKEV

SEQ ID NO: 1659172 - protein, 38 aa, Staphylococcus aureus
RQSKVFRSRFRMLVEAQLDLLKNEDWDYLLNYDLDAEQ

SEQ ID NO: 1659173 - protein, 22 aa, Staphylococcus aureus
RQTSLFEMAEYIGISEPQKLVQ

SEQ ID NO: 1659174 - protein, 17 aa, Staphylococcus aureus
RRRAKLLETILKNTRSI

SEQ ID NO: 1659175 - protein, 21 aa, Staphylococcus aureus
RRRKAERIFKQSIMNEDLTKA

SEQ ID NO: 1659176 - protein, 17 aa, Staphylococcus aureus
RSSHLLILVDENPLTFD

SEQ ID NO: 1659177 - protein, 19 aa, Staphylococcus aureus
SAIEAVIGFLYLEKREERL

SEQ ID NO: 1659178 - protein, 17 aa, Staphylococcus aureus
SALKKRMIAGGFTRSTH

SEQ ID NO: 1659179 - protein, 17 aa, Staphylococcus aureus
SDGVGLGHQFLRHVERT

SEQ ID NO: 1659180 - protein, 26 aa, Staphylococcus aureus
SDMERLIRLPGKFKYFEHNVAAHSFK

SEQ ID NO: 1659181 - protein, 17 aa, Staphylococcus aureus
SEEELLTTIDLLHLQNK

SEQ ID NO: 1659182 - protein, 21 aa, Staphylococcus aureus
SERYGAVYLVNLFSNIKTPEN

SEQ ID NO: 1659183 - protein, 18 aa, Staphylococcus aureus
SFSGLKSAVINQLHNQRQ

SEQ ID NO: 1659184 - protein, 20 aa, Staphylococcus aureus
SGFSPDFATVITMDRKATKQ

SEQ ID NO: 1659185 - protein, 30 aa, Staphylococcus aureus
SGMVIKDAELRGVASSGMICSMKELNLPNA

SEQ ID NO: 1659186 - protein, 26 aa, Staphylococcus aureus
SGTEPKIKLYVSLKCPNFDDVAQKIN

SEQ ID NO: 1659187 - protein, 17 aa, Staphylococcus aureus
SHFHKFYNAEKVLTDDI

SEQ ID NO: 1659188 - protein, 19 aa, Staphylococcus aureus
SHGTVSIYDALRQSFNIPA

SEQ ID NO: 1659189 - protein, 20 aa, Staphylococcus aureus
SIDISRFLELSNMILLLDDM

SEQ ID NO: 1659190 - protein, 19 aa, Staphylococcus aureus
SKEFFILFMNIMYSKDFLK

SEQ ID NO: 1659191 - protein, 20 aa, Staphylococcus aureus
SKPKWSKLVNKLSVPIEANY

SEQ ID NO: 1659192 - protein, 21 aa, Staphylococcus aureus
SKSLAIAVASIISRYAFVTYM

SEQ ID NO: 1659193 - protein, 17 aa, Staphylococcus aureus
SNAKLYTDDKFNKRYSV

SEQ ID NO: 1659194 - protein, 35 aa, Staphylococcus aureus
SNERWLRRVINSLVYDYGYPIGCSYKPSERGYYII

SEQ ID NO: 1659195 - protein, 22 aa, Staphylococcus aureus
SQMPFEAAAMPMPQVQSTDNNK

SEQ ID NO: 1659196 - protein, 18 aa, Staphylococcus aureus
SRKIYKIFDQNLKREFSY

SEQ ID NO: 1659197 - protein, 17 aa, Staphylococcus aureus
SRYYTNWDTIEKQVNHR

SEQ ID NO: 1659198 - protein, 20 aa, Staphylococcus aureus
SSAEWEVMNIIWMKKYASAN

SEQ ID NO: 1659199 - protein, 27 aa, Staphylococcus aureus
SSIAYKVMLDIFYPELITIGSNSVIGY

SEQ ID NO: 1659200 - protein, 18 aa, Staphylococcus aureus
SVIYQCILRDGSEVTVDN

SEQ ID NO: 1659201 - protein, 21 aa, Staphylococcus aureus
SYKEELIEFILSIQKNEFNIK

SEQ ID NO: 1659202 - protein, 34 aa, Staphylococcus aureus
TATELNGAMTVLKAAIADKERTKASGNYVNADQE

SEQ ID NO: 1659203 - protein, 19 aa, Staphylococcus aureus
TDAIESPGVFSIKENDSIK

SEQ ID NO: 1659204 - protein, 26 aa, Staphylococcus aureus
TDEVKIKVLQRLSIASGHVGMVGGQM

SEQ ID NO: 1659205 - protein, 31 aa, Staphylococcus aureus
TDIEYKFPFGWGELWGIASRTDFDLRKHAEH

SEQ ID NO: 1659206 - protein, 17 aa, Staphylococcus aureus
TDLPGQIARKVDTDVLR

SEQ ID NO: 1659207 - protein, 23 aa, Staphylococcus aureus
TELLEPYLSFKVYAPQEYLSRAY

SEQ ID NO: 1659208 - protein, 26 aa, Staphylococcus aureus
TELNTAMTALKRAIADKADTKASGNY

SEQ ID NO: 1659209 - protein, 20 aa, Staphylococcus aureus
TETLNSINFTDADQAKKDAY

SEQ ID NO: 1659210 - protein, 19 aa, Staphylococcus aureus
TGGLVAISGGRDFKDVVNR

SEQ ID NO: 1659211 - protein, 19 aa, Staphylococcus aureus
TIILRDLVDALLFEDIAGI

SEQ ID NO: 1659212 - protein, 20 aa, Staphylococcus aureus
TKEGLKTGFVDIVVGTHKLL

SEQ ID NO: 1659213 - protein, 18 aa, Staphylococcus aureus
TKNKDLQRIFSRIMSNTT

SEQ ID NO: 1659214 - protein, 21 aa, Staphylococcus aureus
TKWNCKYHIVFAPKYRRQVIY

SEQ ID NO: 1659215 - protein, 28 aa, Staphylococcus aureus
TLKYAVPTTDCYEIFWGGDNELYNYHYL

SEQ ID NO: 1659216 - protein, 24 aa, Staphylococcus aureus
TMGHFDAIVGRRVLMYLPDAEKCL

SEQ ID NO: 1659217 - protein, 17 aa, Staphylococcus aureus
TMTCGTSISLRVPNRKQ

SEQ ID NO: 1659218 - protein, 18 aa, Staphylococcus aureus
TNAKFDVFEMVDGKYEIR

SEQ ID NO: 1659219 - protein, 23 aa, Staphylococcus aureus
TNFFTEVRWGDIEYLILDLPPGT

SEQ ID NO: 1659220 - protein, 17 aa, Staphylococcus aureus
TPKFNFNDYHIMIVHPW

SEQ ID NO: 1659221 - protein, 17 aa, Staphylococcus aureus
TQDRVFRSLGILQNCRM

SEQ ID NO: 1659222 - protein, 18 aa, Staphylococcus aureus
TQHFLKDDVDTYINRSEL

SEQ ID NO: 1659223 - protein, 19 aa, Staphylococcus aureus
TTFATRDKDAFVIDINEGG

SEQ ID NO: 1659224 - protein, 17 aa, Staphylococcus aureus
TTLPVLCKDFIIDPLQI

SEQ ID NO: 1659225 - protein, 17 aa, Staphylococcus aureus
VAFASEIHGESGLDGPK

SEQ ID NO: 1659226 - protein, 17 aa, Staphylococcus aureus
VANFSFNIIDSGIESAV

SEQ ID NO: 1659227 - protein, 18 aa, Staphylococcus aureus
VCFYSRSKQRLWTKGETS

SEQ ID NO: 1659228 - protein, 26 aa, Staphylococcus aureus
VCIIRLKKEYYYNFFGQYLLSRKGKR

SEQ ID NO: 1659229 - protein, 24 aa, Staphylococcus aureus
VDVGQRGFVPASLISTDFIEDFSV

SEQ ID NO: 1659230 - protein, 23 aa, Staphylococcus aureus
VDYLNRYRILQSLQLLDRHYKHY

SEQ ID NO: 1659231 - protein, 19 aa, Staphylococcus aureus
VFTNGEIKYNSNFEKEDVP

SEQ ID NO: 1659232 - protein, 18 aa, Staphylococcus aureus
VHLVKAKRQGQSMIYSLD

SEQ ID NO: 1659233 - protein, 20 aa, Staphylococcus aureus
VKRAIEHLGYEVVVSNKQNI

SEQ ID NO: 1659234 - protein, 20 aa, Staphylococcus aureus
VKRTDGFITKFNRLIERRLL

SEQ ID NO: 1659235 - protein, 18 aa, Staphylococcus aureus
VKTSIVLKTDDYNVDRGA

SEQ ID NO: 1659236 - protein, 17 aa, Staphylococcus aureus
VLKALNLTFEDIAYQKD

SEQ ID NO: 1659237 - protein, 19 aa, Staphylococcus aureus
VMIYDRRKDLIISGGENIY

SEQ ID NO: 1659238 - protein, 17 aa, Staphylococcus aureus
VMLKQKFLHALRNNDEI

SEQ ID NO: 1659239 - protein, 23 aa, Staphylococcus aureus
VMSEHLWRVEIELKRDMVDYWND

SEQ ID NO: 1659240 - protein, 23 aa, Staphylococcus aureus
VNVGDPLVRFNLEYINNNAKSVI

SEQ ID NO: 1659241 - protein, 20 aa, Staphylococcus aureus
VPDLIRLSKTFLIESRDLTT

SEQ ID NO: 1659242 - protein, 24 aa, Staphylococcus aureus
VPEVEFKRTYVCEDMSKCICLYNA

SEQ ID NO: 1659243 - protein, 19 aa, Staphylococcus aureus
VPSTISGTITEILVEAGQT

SEQ ID NO: 1659244 - protein, 19 aa, Staphylococcus aureus
VSYIVGKPIAFKHTDDEVV

SEQ ID NO: 1659245 - protein, 19 aa, Staphylococcus aureus
VTISIKYIFLRISTLPLSL

SEQ ID NO: 1659246 - protein, 20 aa, Staphylococcus aureus
VTPRNYRWKSRTGTTGQTQY

SEQ ID NO: 1659247 - protein, 18 aa, Staphylococcus aureus
VVECAILMIQGILGKIPF

SEQ ID NO: 1659248 - protein, 17 aa, Staphylococcus aureus
VVKSYPMIPGIDLAGTI

SEQ ID NO: 1659249 - protein, 25 aa, Staphylococcus aureus
VWRDKVCSMEIWKVMMKRDDQPQQH

SEQ ID NO: 1659250 - protein, 22 aa, Staphylococcus aureus
WEPSYVDRGFIFTTCQGNPMQG

SEQ ID NO: 1659251 - protein, 17 aa, Staphylococcus aureus
WGDIEYLILDLPPGTGD

SEQ ID NO: 1659252 - protein, 18 aa, Staphylococcus aureus
WGIWRVIESQLHLSVVER

SEQ ID NO: 1659253 - protein, 20 aa, Staphylococcus aureus
WILIDLADVVVHVFHKDERN

SEQ ID NO: 1659254 - protein, 23 aa, Staphylococcus aureus
WKNKGYPVSIVYPIEGTMLNVDG

SEQ ID NO: 1659255 - protein, 19 aa, Staphylococcus aureus
WNPDNAFGCQCFDTANQYW

SEQ ID NO: 1659256 - protein, 24 aa, Staphylococcus aureus
WTRQKAFEEYEWLKNVAKNDIEIE

SEQ ID NO: 1659257 - protein, 17 aa, Staphylococcus aureus
YDAKLHGEFDMWVNRYD

SEQ ID NO: 1659258 - protein, 24 aa, Staphylococcus aureus
YDSFLPQKLDIVVFPSKYGGGAGH

SEQ ID NO: 1659259 - protein, 30 aa, Staphylococcus aureus
YEAVEMSRKFGIEVFNVFLSQDPITEDVEQ

SEQ ID NO: 1659260 - protein, 23 aa, Staphylococcus aureus
YESDRGTGVLNFAVTKNNRPLSI

SEQ ID NO: 1659261 - protein, 23 aa, Staphylococcus aureus
YISYPTIYRYIRNGLVKVDVKRD

SEQ ID NO: 1659262 - protein, 17 aa, Staphylococcus aureus
YKDDWRQLVVEAIESIN

SEQ ID NO: 1659263 - protein, 20 aa, Staphylococcus aureus
YKEELIEFILSIQKNEFNIK

SEQ ID NO: 1659264 - protein, 20 aa, Staphylococcus aureus
YKGRKCFFYYAKLIYTPEVC

SEQ ID NO: 1659265 - protein, 24 aa, Staphylococcus aureus
YKLISLMIEYLRFANCTQELTIEK

SEQ ID NO: 1659266 - protein, 18 aa, Staphylococcus aureus
YKLMFNTLRAMYQQHPIR

SEQ ID NO: 1659267 - protein, 19 aa, Staphylococcus aureus
YKSSEEMLKYHVSTQNCEP

SEQ ID NO: 1659268 - protein, 24 aa, Staphylococcus aureus
YLDELYQKIMLFGQAVDFSSDKFG

SEQ ID NO: 1659269 - protein, 18 aa, Staphylococcus aureus
YLKHFFGSKRYLYQDNER

SEQ ID NO: 1659270 - protein, 21 aa, Staphylococcus aureus
YLNDIEFDLPLIIRNEKLSPG

SEQ ID NO: 1659271 - protein, 26 aa, Staphylococcus aureus
YLPFGHSMLYLSSIMDIYNGEIVAYK

SEQ ID NO: 1659272 - protein, 20 aa, Staphylococcus aureus
YNEARWILIDLADVVVHVFH

SEQ ID NO: 1659273 - protein, 21 aa, Staphylococcus aureus
YNIQQAKGWTQVKMKAALHNE

SEQ ID NO: 1659274 - protein, 17 aa, Staphylococcus aureus
YPLDMITDLDFETLYQY

SEQ ID NO: 1659275 - protein, 19 aa, Staphylococcus aureus
YQPGIKYDSMIILYGGQGV

SEQ ID NO: 1659276 - protein, 23 aa, Staphylococcus aureus
YQPKHLVIVGGGYIALEFASMFA

SEQ ID NO: 1659277 - protein, 24 aa, Staphylococcus aureus
YQVGDIYPRDGLEVSEERFTELST

SEQ ID NO: 1659278 - protein, 18 aa, Staphylococcus aureus
YRKYYEPLIHKKDKEFKE

SEQ ID NO: 1659279 - protein, 18 aa, Staphylococcus aureus
YRKYYEPLIHKNDKEFKE

SEQ ID NO: 1659280 - protein, 19 aa, Staphylococcus aureus
YSFALLWGQFACKPPMKEQ

SEQ ID NO: 1659281 - protein, 23 aa, Staphylococcus aureus
YSQHFPSVFALIGSHSEYDLHHP

SEQ ID NO: 1659282 - protein, 17 aa, Staphylococcus aureus
YTALTFSYVINRNKSKY

SEQ ID NO: 1659283 - protein, 18 aa, Staphylococcus aureus
YVDDISFSFNFEEEKDKF

SEQ ID NO: 1659284 - protein, 21 aa, Staphylococcus aureus
AAGGHAVMLGSLLAGTEESPG

SEQ ID NO: 1659285 - protein, 19 aa, Staphylococcus aureus
AAIDAIQVDATVKPKANQA

SEQ ID NO: 1659286 - protein, 20 aa, Staphylococcus aureus
ADASLAMLLYRDDYYNRDED

SEQ ID NO: 1659287 - protein, 27 aa, Staphylococcus aureus
AIHACPELLGGLLIPREPAEIIGGDGF

SEQ ID NO: 1659288 - protein, 17 aa, Staphylococcus aureus
AKAALNGADNLRNAKTS

SEQ ID NO: 1659289 - protein, 18 aa, Staphylococcus aureus
AKATFMFDKTAKKFATEQ

SEQ ID NO: 1659290 - protein, 17 aa, Staphylococcus aureus
AKGEFVGMGELIRQFQD

SEQ ID NO: 1659291 - protein, 28 aa, Staphylococcus aureus
AKKGAVKLILKRDFFLEVARDASTKTTA

SEQ ID NO: 1659292 - protein, 18 aa, Staphylococcus aureus
AMIADPAIDIGMLLYNYV

SEQ ID NO: 1659293 - protein, 21 aa, Staphylococcus aureus
ANDANDILAFINKDELELVDD

SEQ ID NO: 1659294 - protein, 23 aa, Staphylococcus aureus
ANSERYGAVYLVNLFSNIRTPEN

SEQ ID NO: 1659295 - protein, 18 aa, Staphylococcus aureus
AQIYGFIVGSGLRGPLHK

SEQ ID NO: 1659296 - protein, 27 aa, Staphylococcus aureus
AQQHIAGFWQRCYQEGVIADLQLKNNG

SEQ ID NO: 1659297 - protein, 25 aa, Staphylococcus aureus
ASEISGMIPVEWEQVFTIAYVTDQA

SEQ ID NO: 1659298 - protein, 26 aa, Staphylococcus aureus
ASFESRSFLFKAIFNITKLLHIKRSK

SEQ ID NO: 1659299 - protein, 25 aa, Staphylococcus aureus
ASGAKRAGKTYVFILLFLMHIATYK

SEQ ID NO: 1659300 - protein, 23 aa, Staphylococcus aureus
ASYRLYQTVKYWPKGTVFVSVVD

SEQ ID NO: 1659301 - protein, 23 aa, Staphylococcus aureus
ATDPRLLPKAKRLDIVSYEEMME

SEQ ID NO: 1659302 - protein, 24 aa, Staphylococcus aureus
ATEHSLAMLLSMARNIPQAHQSLT

SEQ ID NO: 1659303 - protein, 18 aa, Staphylococcus aureus
AVCGEVFTSPTPDKILEA

SEQ ID NO: 1659304 - protein, 18 aa, Staphylococcus aureus
AVPLREIVEAYNYGVRNL

SEQ ID NO: 1659305 - protein, 19 aa, Staphylococcus aureus
CEEDLQIFYSFIVLQNNEV

SEQ ID NO: 1659306 - protein, 24 aa, Staphylococcus aureus
CGCAAGLARPAAVAVATQNEHRPT

SEQ ID NO: 1659307 - protein, 19 aa, Staphylococcus aureus
CICCAMKADVSEQLHQLYL

SEQ ID NO: 1659308 - protein, 17 aa, Staphylococcus aureus
CKPLTIYGNTTLLLDNE

SEQ ID NO: 1659309 - protein, 27 aa, Staphylococcus aureus
CNEKFKKELLSAGIIDDAWLAEIEAEH

SEQ ID NO: 1659310 - protein, 20 aa, Staphylococcus aureus
CPLENGLEIFVGVPSERYPA

SEQ ID NO: 1659311 - protein, 18 aa, Staphylococcus aureus
CTIQRRMQKLVEEAPSPI

SEQ ID NO: 1659312 - protein, 17 aa, Staphylococcus aureus
CVGQAPKLFIGVNSAKE

SEQ ID NO: 1659313 - protein, 17 aa, Staphylococcus aureus
CYYVIQRDLDIFITHFK

SEQ ID NO: 1659314 - protein, 18 aa, Staphylococcus aureus
DALSHFFGSSGQHSSYFE

SEQ ID NO: 1659315 - protein, 26 aa, Staphylococcus aureus
DATVKPKANQAIEVKAEDTKESIDQS

SEQ ID NO: 1659316 - protein, 23 aa, Staphylococcus aureus
DDLLEIYYSWAFHEIASAVTDEP

SEQ ID NO: 1659317 - protein, 24 aa, Staphylococcus aureus
DDNVCSCCGQQLPTEQVNEAREKA

SEQ ID NO: 1659318 - protein, 24 aa, Staphylococcus aureus
DDYKNIPCNLWIDGHQTEIELTAV

SEQ ID NO: 1659319 - protein, 23 aa, Staphylococcus aureus
DEASQIIQFLGFVLNNEIEIDYY

SEQ ID NO: 1659320 - protein, 21 aa, Staphylococcus aureus
DEELRGMVASMQMQVTQVNIL

SEQ ID NO: 1659321 - protein, 17 aa, Staphylococcus aureus
DERILKVDGFLNHQIDA

SEQ ID NO: 1659322 - protein, 17 aa, Staphylococcus aureus
DEVIYHLTNMVDIKEKT

SEQ ID NO: 1659323 - protein, 28 aa, Staphylococcus aureus
DEYTKYKISGTWYPFYKKNDGDLTKQFV

SEQ ID NO: 1659324 - protein, 17 aa, Staphylococcus aureus
DGIPFLYDDIDAELEDG

SEQ ID NO: 1659325 - protein, 23 aa, Staphylococcus aureus
DGKLCPAIYEYFWELDYSVKDKS

SEQ ID NO: 1659326 - protein, 19 aa, Staphylococcus aureus
DGSPAVTPRNYRWKSRTGT

SEQ ID NO: 1659327 - protein, 17 aa, Staphylococcus aureus
DHLKRQINMVTETITVR

SEQ ID NO: 1659328 - protein, 18 aa, Staphylococcus aureus
DKAMLKIACINLNEYQDK

SEQ ID NO: 1659329 - protein, 17 aa, Staphylococcus aureus
DKDWFALHIHIDKPSQD

SEQ ID NO: 1659330 - protein, 18 aa, Staphylococcus aureus
DKDWFALHIHIDKPSQDT

SEQ ID NO: 1659331 - protein, 24 aa, Staphylococcus aureus
DKQYFPATHWKAINGVPYAGSSDI

SEQ ID NO: 1659332 - protein, 24 aa, Staphylococcus aureus
DKYNIQQAKGWTQVKMKAVLHNEA

SEQ ID NO: 1659333 - protein, 22 aa, Staphylococcus aureus
DLEPWTSCEFDFTRKGNLKVSF

SEQ ID NO: 1659334 - protein, 25 aa, Staphylococcus aureus
DLKKIKHSYLKKSFLEIVETLKNDP

SEQ ID NO: 1659335 - protein, 23 aa, Staphylococcus aureus
DLPQPEFNSFFISDIEKARKSPN

SEQ ID NO: 1659336 - protein, 29 aa, Staphylococcus aureus
DLPYAELALGAGMAFLIRRFTKKDQQTEE

SEQ ID NO: 1659337 - protein, 19 aa, Staphylococcus aureus
DPLEIVQTISRNHCAYPNH

SEQ ID NO: 1659338 - protein, 25 aa, Staphylococcus aureus
DPLTAKWRRVSVVLNKNGKQSQKEA

SEQ ID NO: 1659339 - protein, 19 aa, Staphylococcus aureus
DQLVPRLQEAFSNIKVGDP

SEQ ID NO: 1659340 - protein, 17 aa, Staphylococcus aureus
DRHNIWAPRRAVFEVPN

SEQ ID NO: 1659341 - protein, 21 aa, Staphylococcus aureus
DSIELGGIVQRTWKGKRSTDD

SEQ ID NO: 1659342 - protein, 20 aa, Staphylococcus aureus
DTLTFPAFVYSGDAQVVAEG

SEQ ID NO: 1659343 - protein, 25 aa, Staphylococcus aureus
DTNWPVCGIPEKFYTDHGSDFTSNH

SEQ ID NO: 1659344 - protein, 19 aa, Staphylococcus aureus
DVAVLRRYWNGRWIEATPN

SEQ ID NO: 1659345 - protein, 17 aa, Staphylococcus aureus
DVIKYGRLLVDKGAQSV

SEQ ID NO: 1659346 - protein, 17 aa, Staphylococcus aureus
DVNGYPLVIKKLQLWIK

SEQ ID NO: 1659347 - protein, 24 aa, Staphylococcus aureus
DVVIGIRPGRSFDKAKEDGFDVFP

SEQ ID NO: 1659348 - protein, 18 aa, Staphylococcus aureus
DWLHGYWAGVPIGTDKTD

SEQ ID NO: 1659349 - protein, 18 aa, Staphylococcus aureus
DYAMKFAKNKGWTSPAKA

SEQ ID NO: 1659350 - protein, 18 aa, Staphylococcus aureus
EACKDHIHMLVSIPPKLG

SEQ ID NO: 1659351 - protein, 23 aa, Staphylococcus aureus
EAVIKPKKIMLVAGHGYNDPGAV

SEQ ID NO: 1659352 - protein, 18 aa, Staphylococcus aureus
EAYNFLKQVSEDGGQVLF

SEQ ID NO: 1659353 - protein, 21 aa, Staphylococcus aureus
EDGLTGPIGRFFEAENVETLL

SEQ ID NO: 1659354 - protein, 23 aa, Staphylococcus aureus
EDLEPWTSCEFDFTSEGKLKVSF

SEQ ID NO: 1659355 - protein, 19 aa, Staphylococcus aureus
EEIEKRLSQKKAFQIEFGR

SEQ ID NO: 1659356 - protein, 25 aa, Staphylococcus aureus
EELEPWTSCEFDFTRDGKLNVSFDY

SEQ ID NO: 1659357 - protein, 25 aa, Staphylococcus aureus
EFICPNNKRIGFKRYAYRNDRYGFK

SEQ ID NO: 1659358 - protein, 17 aa, Staphylococcus aureus
EFIRLMPTLQKHRDEVL

SEQ ID NO: 1659359 - protein, 25 aa, Staphylococcus aureus
EFTKQIECLGKMPWNNNFKIRQWQD

SEQ ID NO: 1659360 - protein, 21 aa, Staphylococcus aureus
EGKGFKCFVKQNDRVEAGQTL

SEQ ID NO: 1659361 - protein, 24 aa, Staphylococcus aureus
EGKLKVSFDYIDWINSEFGQVGRQ

SEQ ID NO: 1659362 - protein, 22 aa, Staphylococcus aureus
EHHQCGVALYQLIPSKKEGEPD

SEQ ID NO: 1659363 - protein, 20 aa, Staphylococcus aureus
EIIDDVKLPSFIEEIDSIRK

SEQ ID NO: 1659364 - protein, 24 aa, Staphylococcus aureus
EKGLYRKRMLSYGGLLKQKHKILN

SEQ ID NO: 1659365 - protein, 17 aa, Staphylococcus aureus
EKNAIKIGNAYFDEHWL

SEQ ID NO: 1659366 - protein, 19 aa, Staphylococcus aureus
ELAKKREIKGYSDMKKDEL

SEQ ID NO: 1659367 - protein, 20 aa, Staphylococcus aureus
EMICGFADMDIYNLINNKYL

SEQ ID NO: 1659368 - protein, 17 aa, Staphylococcus aureus
EMINYALNHGIDRYNFY

SEQ ID NO: 1659369 - protein, 24 aa, Staphylococcus aureus
EQRPRLNHPSLYVDLGDHVDLSAP

SEQ ID NO: 1659370 - protein, 18 aa, Staphylococcus aureus
ESDLLPNQFVLIATGSSP

SEQ ID NO: 1659371 - protein, 25 aa, Staphylococcus aureus
ESELREEFNKRLNLIHQKLNDNISN

SEQ ID NO: 1659372 - protein, 19 aa, Staphylococcus aureus
ESNAKLYADDKFNKRYSVI

SEQ ID NO: 1659373 - protein, 26 aa, Staphylococcus aureus
ESNYKCTKLSIALRYEMICSRLEHTN

SEQ ID NO: 1659374 - protein, 21 aa, Staphylococcus aureus
EVACLNKHLHFHGTTDEFKSL

SEQ ID NO: 1659375 - protein, 20 aa, Staphylococcus aureus
EWEKVYTMAYIDDGGGEVFF

SEQ ID NO: 1659376 - protein, 26 aa, Staphylococcus aureus
FAKDRIIKLICHLCQTVGYDQDEFYE

SEQ ID NO: 1659377 - protein, 23 aa, Staphylococcus aureus
FCVRICTYCDFNKYFIQNQPVDE

SEQ ID NO: 1659378 - protein, 19 aa, Staphylococcus aureus
FELAGLWIALNEEKDIPRN

SEQ ID NO: 1659379 - protein, 18 aa, Staphylococcus aureus
FESKTLLCQAIMDKKVDQ

SEQ ID NO: 1659380 - protein, 21 aa, Staphylococcus aureus
FINERIIPIIPQQGSLGASGD

SEQ ID NO: 1659381 - protein, 17 aa, Staphylococcus aureus
FITKRFNIFANNDEMSF

SEQ ID NO: 1659382 - protein, 21 aa, Staphylococcus aureus
FKANFKGAAQGDWVKSAMSEI

SEQ ID NO: 1659383 - protein, 17 aa, Staphylococcus aureus
FKEEDIELFKDIADKVK

SEQ ID NO: 1659384 - protein, 28 aa, Staphylococcus aureus
FLDQRVINHYGSLIPLTPLDSSLLRKEQ

SEQ ID NO: 1659385 - protein, 19 aa, Staphylococcus aureus
FNKRYSVIFDGTANGVGST

SEQ ID NO: 1659386 - protein, 38 aa, Staphylococcus aureus
FNVDLWYGFQCFDYANAGWKVLFGLLLKGLGAKDIPFA

SEQ ID NO: 1659387 - protein, 20 aa, Staphylococcus aureus
FQIEFGRKGTNLTYQDKLKI

SEQ ID NO: 1659388 - protein, 24 aa, Staphylococcus aureus
FRDDVICRRCFRLKNYNEVQDVGL

SEQ ID NO: 1659389 - protein, 21 aa, Staphylococcus aureus
FSEMGYKFELATALANLCTVN

SEQ ID NO: 1659390 - protein, 23 aa, Staphylococcus aureus
FSPDKILGAILFEQTMDREVEGK

SEQ ID NO: 1659391 - protein, 18 aa, Staphylococcus aureus
FTLKRLSNYVTIKDRSYP

SEQ ID NO: 1659392 - protein, 18 aa, Staphylococcus aureus
FVDFGINVNKEFSNSHFA

SEQ ID NO: 1659393 - protein, 21 aa, Staphylococcus aureus
FVKHLLITMPQSFGRATMFEN

SEQ ID NO: 1659394 - protein, 26 aa, Staphylococcus aureus
GAKSKRPGLDRAIEFARSGDTIVVWR

SEQ ID NO: 1659395 - protein, 28 aa, Staphylococcus aureus
GAMVRLSQDWKLRHVLIEMHGNNGSIDN

SEQ ID NO: 1659396 - protein, 23 aa, Staphylococcus aureus
GEFKNYLGSIGKSFKEKFSKDMK

SEQ ID NO: 1659397 - protein, 17 aa, Staphylococcus aureus
GELMIKGANVMNGYLYP

SEQ ID NO: 1659398 - protein, 17 aa, Staphylococcus aureus
GFEIPSFNFVTEKESVK

SEQ ID NO: 1659399 - protein, 23 aa, Staphylococcus aureus
GFSEYDLFTFFKHPSIKSMTIVT

SEQ ID NO: 1659400 - protein, 24 aa, Staphylococcus aureus
GGVDRGALILLKHQIIPFFSVGDF

SEQ ID NO: 1659401 - protein, 18 aa, Staphylococcus aureus
GIDLKKANAALLNYYGVP

SEQ ID NO: 1659402 - protein, 18 aa, Staphylococcus aureus
GIRYGCEQGLYGWNVTDC

SEQ ID NO: 1659403 - protein, 20 aa, Staphylococcus aureus
GKWYFSIRYKDVYGNNKRKM

SEQ ID NO: 1659404 - protein, 23 aa, Staphylococcus aureus
GNPKKSHTWGWANATRAQTSSAM

SEQ ID NO: 1659405 - protein, 21 aa, Staphylococcus aureus
GQAEVRQTFKVSKVGTIAGCY

SEQ ID NO: 1659406 - protein, 23 aa, Staphylococcus aureus
GSLRYIHDIWGYIAPNTKKEKQP

SEQ ID NO: 1659407 - protein, 19 aa, Staphylococcus aureus
GSPRPRFSTKGRYAHTYMP

SEQ ID NO: 1659408 - protein, 20 aa, Staphylococcus aureus
GSTFKSYGLAAAIQEGAFDP

SEQ ID NO: 1659409 - protein, 25 aa, Staphylococcus aureus
GSYQPSRCFALPVIQKGHIFIKRVN

SEQ ID NO: 1659410 - protein, 17 aa, Staphylococcus aureus
GTVLSGFEYRAQKEKYD

SEQ ID NO: 1659411 - protein, 23 aa, Staphylococcus aureus
HARDMLKRERLFFDKMQAHIGEV

SEQ ID NO: 1659412 - protein, 18 aa, Staphylococcus aureus
HEPWTSCEFDFTRDGKLN

SEQ ID NO: 1659413 - protein, 18 aa, Staphylococcus aureus
HFDTELNIPMSQWQYAMN

SEQ ID NO: 1659414 - protein, 22 aa, Staphylococcus aureus
HIVLEHGQTLFIITHNLSHVLK

SEQ ID NO: 1659415 - protein, 27 aa, Staphylococcus aureus
HKESFKTSEVPSAIFGTMKPKKLENGR

SEQ ID NO: 1659416 - protein, 28 aa, Staphylococcus aureus
HLKSDIQTLFYGRFYLRELATPDNTIKF

SEQ ID NO: 1659417 - protein, 17 aa, Staphylococcus aureus
HRYDLYETKYWSVFDEI

SEQ ID NO: 1659418 - protein, 25 aa, Staphylococcus aureus
HTTDRKGHVIGMLEWALDYIAGNIE

SEQ ID NO: 1659419 - protein, 19 aa, Staphylococcus aureus
IAGIKQLWAKLEISNDDFI

SEQ ID NO: 1659420 - protein, 26 aa, Staphylococcus aureus
IANKISSMIPVEWEKVYTMAYIDDGG

SEQ ID NO: 1659421 - protein, 17 aa, Staphylococcus aureus
IDAIGFIHYEKSKRHQT

SEQ ID NO: 1659422 - protein, 22 aa, Staphylococcus aureus
IDETKLNFLWVTDWPLLEYDED

SEQ ID NO: 1659423 - protein, 25 aa, Staphylococcus aureus
IEANYKYARGVAVYGDIKDGANDHG

SEQ ID NO: 1659424 - protein, 24 aa, Staphylococcus aureus
IENRPILQKALNFVRMGDRFIVES

SEQ ID NO: 1659425 - protein, 24 aa, Staphylococcus aureus
IETLKESKPYLFASSKPVGKTPQG

SEQ ID NO: 1659426 - protein, 24 aa, Staphylococcus aureus
IETSRLEGVINFENLKVKDVDTTP

SEQ ID NO: 1659427 - protein, 17 aa, Staphylococcus aureus
IGGAPCNVACTVQKLGQ

SEQ ID NO: 1659428 - protein, 18 aa, Staphylococcus aureus
IGNAYFDEHWLFYDLINK

SEQ ID NO: 1659429 - protein, 19 aa, Staphylococcus aureus
IIDDVVKGFLTYNIPKKVI

SEQ ID NO: 1659430 - protein, 17 aa, Staphylococcus aureus
IKRLETFVEKNITRAST

SEQ ID NO: 1659431 - protein, 24 aa, Staphylococcus aureus
IKSRVATLKKSILFEKMKLSQDEE

SEQ ID NO: 1659432 - protein, 32 aa, Staphylococcus aureus
IKYDGAYCINGYRWITYIANNGQRCYIATGEV

SEQ ID NO: 1659433 - protein, 17 aa, Staphylococcus aureus
ILDKAHGQNMTKAQVEA

SEQ ID NO: 1659434 - protein, 23 aa, Staphylococcus aureus
IMEQFELFSIDKFKCNSEAKYYL

SEQ ID NO: 1659435 - protein, 23 aa, Staphylococcus aureus
INAVKNTRIEVVNGDEVSRPGPR

SEQ ID NO: 1659436 - protein, 23 aa, Staphylococcus aureus
INLALRAQYLFESNVDYFVYNGD

SEQ ID NO: 1659437 - protein, 19 aa, Staphylococcus aureus
INVDGFDFKLAVKKKDHSI

SEQ ID NO: 1659438 - protein, 19 aa, Staphylococcus aureus
INVGLDIINTLSKHFKVTA

SEQ ID NO: 1659439 - protein, 18 aa, Staphylococcus aureus
INYKDMLALQYKGGVIRD

SEQ ID NO: 1659440 - protein, 27 aa, Staphylococcus aureus
IPREPAEIIGGDGFDVWNDAAKVVTIS

SEQ ID NO: 1659441 - protein, 20 aa, Staphylococcus aureus
IPYHKGFYRAFSKLHTTTFK

SEQ ID NO: 1659442 - protein, 18 aa, Staphylococcus aureus
IQILRKIGYENITAIVRK

SEQ ID NO: 1659443 - protein, 19 aa, Staphylococcus aureus
IRNPEKCKFPKYEQNYANL

SEQ ID NO: 1659444 - protein, 21 aa, Staphylococcus aureus
IRPPYKSNWYKKEYSNLNIDD

SEQ ID NO: 1659445 - protein, 31 aa, Staphylococcus aureus; identical to SEQ ID NO: 1574627

SEQ ID NO: 1659446 - protein, 24 aa, Staphylococcus aureus
ISPIKCAYILNEHLTFILFDDEEN

SEQ ID NO: 1659447 - protein, 18 aa, Staphylococcus aureus
IVARRAVYYQIHLKKADF

SEQ ID NO: 1659448 - protein, 23 aa, Staphylococcus aureus
IVDEAKALNRVMDQLSQEITGNE

SEQ ID NO: 1659449 - protein, 18 aa, Staphylococcus aureus
IYKDDWRQLVVEAIESIN

SEQ ID NO: 1659450 - protein, 18 aa, Staphylococcus aureus
KALEHLGFGALELGGITP

SEQ ID NO: 1659451 - protein, 19 aa, Staphylococcus aureus
KALVSRFPSATIYNTYGPT

SEQ ID NO: 1659452 - protein, 19 aa, Staphylococcus aureus
KANAALLNYYGVPKENIYT

SEQ ID NO: 1659453 - protein, 17 aa, Staphylococcus aureus
KAYAIKIDPDVEVDKGT

SEQ ID NO: 1659454 - protein, 18 aa, Staphylococcus aureus
KDKYGITNKLALYVPTYR

SEQ ID NO: 1659455 - protein, 22 aa, Staphylococcus aureus
KDLVSKAKEKAYQDILNAQTTN

SEQ ID NO: 1659456 - protein, 20 aa, Staphylococcus aureus
KEDIYLDEAVGIMTSQVVYK

SEQ ID NO: 1659457 - protein, 27 aa, Staphylococcus aureus
KEEIETFFLDPTKTYVFVGSQTLSVEA

SEQ ID NO: 1659458 - protein, 19 aa, Staphylococcus aureus
KEFKEVFLTNKFSTSKFFS

SEQ ID NO: 1659459 - protein, 24 aa, Staphylococcus aureus
KEGIELDEAVGIMTGQVVYKYEEA

SEQ ID NO: 1659460 - protein, 21 aa, Staphylococcus aureus
KEKSIRLSFAFESNENIKHAL

SEQ ID NO: 1659461 - protein, 17 aa, Staphylococcus aureus
KELEGFNITIPHKERII

SEQ ID NO: 1659462 - protein, 21 aa, Staphylococcus aureus
KFKSQNWYWFAYFDGPLKLPK

SEQ ID NO: 1659463 - protein, 21 aa, Staphylococcus aureus
KGAQHVLDLLGLATLSLLDTF

SEQ ID NO: 1659464 - protein, 19 aa, Staphylococcus aureus
KGKPFSISSITYILANPFY

SEQ ID NO: 1659465 - protein, 17 aa, Staphylococcus aureus
KGQWCYLYRAIDADGHT

SEQ ID NO: 1659466 - protein, 18 aa, Staphylococcus aureus
KHVEHLSSYYKFKKPTLL

SEQ ID NO: 1659467 - protein, 22 aa, Staphylococcus aureus
KIGPFLSCPVAYQFQPGGYCDY

SEQ ID NO: 1659468 - protein, 19 aa, Staphylococcus aureus
KKIDCEYTYAMAIAILIRH

SEQ ID NO: 1659469 - protein, 19 aa, Staphylococcus aureus
KKPTFNDWGECATRIVSIY

SEQ ID NO: 1659470 - protein, 17 aa, Staphylococcus aureus
KKVLLVMGGSLGSKKLN

SEQ ID NO: 1659471 - protein, 24 aa, Staphylococcus aureus
KLAPKSKADFAFIQHMVHYLDDEG

SEQ ID NO: 1659472 - protein, 23 aa, Staphylococcus aureus
KLIDLRLDTRISYTESQIKVYRT

SEQ ID NO: 1659473 - protein, 29 aa, Staphylococcus aureus
KLQTYLTPHFISFEIVYEAMDLIDDIEDE

SEQ ID NO: 1659474 - protein, 18 aa, Staphylococcus aureus
KLRIEQIQETFIVAEKND

SEQ ID NO: 1659475 - protein, 18 aa, Staphylococcus aureus
KMNLPGISLLPETERFYP

SEQ ID NO: 1659476 - protein, 21 aa, Staphylococcus aureus
KNGQLKPGYNLQIATNSQFVL

SEQ ID NO: 1659477 - protein, 17 aa, Staphylococcus aureus
KNNGAWNFCPQNAGYWE

SEQ ID NO: 1659478 - protein, 22 aa, Staphylococcus aureus
KRLSQKKAFQIEFGRKGTNLTY

SEQ ID NO: 1659479 - protein, 24 aa, Staphylococcus aureus
KRWTPEYKQTLMLSRIQSTQALYE

SEQ ID NO: 1659480 - protein, 17 aa, Staphylococcus aureus
KRYSVIFDGTANGVGST

SEQ ID NO: 1659481 - protein, 18 aa, Staphylococcus aureus
KSDLSVIDSLNFQPAKVD

SEQ ID NO: 1659482 - protein, 29 aa, Staphylococcus aureus
KSETGELIFKFYRHCFRYNEINLKIQDIF

SEQ ID NO: 1659483 - protein, 20 aa, Staphylococcus aureus
KSGKQRPWREKKIDNVRFCC

SEQ ID NO: 1659484 - protein, 26 aa, Staphylococcus aureus
KSIDVQLIFCTLPLELRGFQIVSLDD

SEQ ID NO: 1659485 - protein, 26 aa, Staphylococcus aureus
KTAYKDWFPRMLKYGFEENTDYTAIA

SEQ ID NO: 1659486 - protein, 17 aa, Staphylococcus aureus
KVKVKRVLGSLEQQIDD

SEQ ID NO: 1659487 - protein, 24 aa, Staphylococcus aureus
KVLGIKTEYLLGFAEREESTKQDT

SEQ ID NO: 1659488 - protein, 17 aa, Staphylococcus aureus
LALELYNNPWIAWYHQQ

SEQ ID NO: 1659489 - protein, 17 aa, Staphylococcus aureus
LDINVNRIGIKGGNNNR

SEQ ID NO: 1659490 - protein, 19 aa, Staphylococcus aureus
LDKEYKKAIELENKNKEQK

SEQ ID NO: 1659491 - protein, 17 aa, Staphylococcus aureus
LDKYFLHNISFYEEDKN

SEQ ID NO: 1659492 - protein, 24 aa, Staphylococcus aureus
LDYRSKRKSLPFTENDENIVVLIH

SEQ ID NO: 1659493 - protein, 18 aa, Staphylococcus aureus
LECVKRKEIELVSDESFN

SEQ ID NO: 1659494 - protein, 25 aa, Staphylococcus aureus
LEKQLPQHFIRISKSEIVNKYYIEK

SEQ ID NO: 1659495 - protein, 18 aa, Staphylococcus aureus
LEPEIEFKAKVKMPTDFG

SEQ ID NO: 1659496 - protein, 25 aa, Staphylococcus aureus
LEQPVLYPGWNHFKANRLMKKIVFR

SEQ ID NO: 1659497 - protein, 17 aa, Staphylococcus aureus
LEVFKNECDLSYDITSL

SEQ ID NO: 1659498 - protein, 35 aa, Staphylococcus aureus
LGDSKPDWKIFQAIANRLGFDWNYKHPSEIMDEVA

SEQ ID NO: 1659499 - protein, 18 aa, Staphylococcus aureus
LIGEGFSYHERRIHNNQM

SEQ ID NO: 1659500 - protein, 17 aa, Staphylococcus aureus
LIGEGNKPFDILNDSQF

SEQ ID NO: 1659501 - protein, 23 aa, Staphylococcus aureus
LKGIECIYALYKKNRRSLQIYGF

SEQ ID NO: 1659502 - protein, 23 aa, Staphylococcus aureus
LKGIECIYTLYKKNRRSLQIYGF

SEQ ID NO: 1659503 - protein, 30 aa, Staphylococcus aureus
LKKKGKVEMESWGKWRVIEAQLHLTVVERK

SEQ ID NO: 1659504 - protein, 28 aa, Staphylococcus aureus
LLKKKVDFYRYTLGYLFQNFALLENQTI

SEQ ID NO: 1659505 - protein, 19 aa, Staphylococcus aureus
LNRAEDFAKVLGIKTEYLL

SEQ ID NO: 1659506 - protein, 18 aa, Staphylococcus aureus
LQDVCALLNHRERQWLML

SEQ ID NO: 1659507 - protein, 24 aa, Staphylococcus aureus
LRDWLFSRQRYWGEPIPVIHWEDG

SEQ ID NO: 1659508 - protein, 17 aa, Staphylococcus aureus
LRFASFAEVDSTLQGQP

SEQ ID NO: 1659509 - protein, 19 aa, Staphylococcus aureus
LSKGSLAGVDGRLQTRNYE

SEQ ID NO: 1659510 - protein, 24 aa, Staphylococcus aureus
LSLAGFKYNLARQMLNIGSTLTIS

SEQ ID NO: 1659511 - protein, 20 aa, Staphylococcus aureus
LSRMKMQGYMPVKRIEKPVF

SEQ ID NO: 1659512 - protein, 19 aa, Staphylococcus aureus
LSSYYKFKKPTLLYDQQIQ

SEQ ID NO: 1659513 - protein, 20 aa, Staphylococcus aureus
LSVGYARSVWAGFKAVINYA

SEQ ID NO: 1659514 - protein, 19 aa, Staphylococcus aureus
LTKDPELRSTPNGVNVGTF

SEQ ID NO: 1659515 - protein, 19 aa, Staphylococcus aureus
LTPLDSSLLRKEQNDTTDK

SEQ ID NO: 1659516 - protein, 19 aa, Staphylococcus aureus
LTREFPLNRAEDFAKVLGI

SEQ ID NO: 1659517 - protein, 19 aa, Staphylococcus aureus
LVGENSWGSQVVEFMGLDL

SEQ ID NO: 1659518 - protein, 18 aa, Staphylococcus aureus
LVKRCIDDLTPSVKTNDY

SEQ ID NO: 1659519 - protein, 18 aa, Staphylococcus aureus
LYAPISGKVVEVNEELED

SEQ ID NO: 1659520 - protein, 20 aa, Staphylococcus aureus
LYGRRLPTKAFYILNDDMTM

SEQ ID NO: 1659521 - protein, 18 aa, Staphylococcus aureus
LYLHIDPYLPYQYLNHDG

SEQ ID NO: 1659522 - protein, 20 aa, Staphylococcus aureus
MGVNFSEPFPEISDINDQRA

SEQ ID NO: 1659523 - protein, 21 aa, Staphylococcus aureus
MHNRMRMVVSQFLTKDLFIDW

SEQ ID NO: 1659524 - protein, 20 aa, Staphylococcus aureus
MIDNYKWMKNIIDSKVYDNE

SEQ ID NO: 1659525 - protein, 24 aa, Staphylococcus aureus
MIDNYKWMKNIIDSKVYDNESTSI

SEQ ID NO: 1659526 - protein, 24 aa, Staphylococcus aureus
MIGGKKLKIVNYILDNVHLSNNTM

SEQ ID NO: 1659527 - protein, 20 aa, Staphylococcus aureus
MKFAKNKGWTSPAKAIMGGA

SEQ ID NO: 1659528 - protein, 26 aa, Staphylococcus aureus
MKVARELIELIIAFMFHHQIPMSVET

SEQ ID NO: 1659529 - protein, 23 aa, Staphylococcus aureus
MLKRAGLDYWEFVNITYHDSIEA

SEQ ID NO: 1659530 - protein, 25 aa, Staphylococcus aureus
MPSNTEILYELGLGKYIVGVSTVDD

SEQ ID NO: 1659531 - protein, 24 aa, Staphylococcus aureus
MRTDVYDFYSLGFGEPYPISGSHG

SEQ ID NO: 1659532 - protein, 17 aa, Staphylococcus aureus
MTVKGCTLILDEAKVVY

SEQ ID NO: 1659533 - protein, 22 aa, Staphylococcus aureus
NAIEFAKKHRKEFEKVGEQFFK

SEQ ID NO: 1659534 - protein, 18 aa, Staphylococcus aureus
NAKDAVNAMTHLNDAQKQ

SEQ ID NO: 1659535 - protein, 19 aa, Staphylococcus aureus
NCIYCYNYVIWLIQHDLPR

SEQ ID NO: 1659536 - protein, 18 aa, Staphylococcus aureus
NCVICGKPHADLAHYEAV

SEQ ID NO: 1659537 - protein, 18 aa, Staphylococcus aureus
NEGLKQLVQCGANIVGLN

SEQ ID NO: 1659538 - protein, 20 aa, Staphylococcus aureus
NGKIINPRISIEVQPAIHNN

SEQ ID NO: 1659539 - protein, 21 aa, Staphylococcus aureus
NGKIINPRISIEVQPAIHNNL

SEQ ID NO: 1659540 - protein, 23 aa, Staphylococcus aureus
NGTIHRIKCNAGFGHKDTTKTAG

SEQ ID NO: 1659541 - protein, 18 aa, Staphylococcus aureus
NGYGYIKLRDIIVERMSK

SEQ ID NO: 1659542 - protein, 18 aa, Staphylococcus aureus
NHIYTTVFYDKHRRNNVT

SEQ ID NO: 1659543 - protein, 24 aa, Staphylococcus aureus
NHLNHLKVSLILGTPKERNDALNT

SEQ ID NO: 1659544 - protein, 18 aa, Staphylococcus aureus
NISLKAIMKRVGHRDEKT

SEQ ID NO: 1659545 - protein, 17 aa, Staphylococcus aureus
NKFISDYEIPHLYVDRE

SEQ ID NO: 1659546 - protein, 17 aa, Staphylococcus aureus
NKLEAGTAILAKKGAVK

SEQ ID NO: 1659547 - protein, 26 aa, Staphylococcus aureus
NKLILFEKHFEPVPGIKMQHSGGHSF

SEQ ID NO: 1659548 - protein, 24 aa, Staphylococcus aureus
NKVAGWLWAWKAVPFKLLGINTSL

SEQ ID NO: 1659549 - protein, 23 aa, Staphylococcus aureus
NLNDIKSNIGIFHVEKVEPNEGM

SEQ ID NO: 1659550 - protein, 17 aa, Staphylococcus aureus
NMMFSGYVSEQCINNDE

SEQ ID NO: 1659551 - protein, 24 aa, Staphylococcus aureus
NNRIKRYIAKYTINPAITHGISEY

SEQ ID NO: 1659552 - protein, 23 aa, Staphylococcus aureus
NQKGYKSDLNWNYINSKDNVDEF

SEQ ID NO: 1659553 - protein, 23 aa, Staphylococcus aureus
NRLKEIKQIIADMFEKYQSDDVY

SEQ ID NO: 1659554 - protein, 23 aa, Staphylococcus aureus
NRNELGIALGKGERVNVGITDPG

SEQ ID NO: 1659555 - protein, 25 aa, Staphylococcus aureus
NVGCITRPFPTGVRITIGFKEQNDK

SEQ ID NO: 1659556 - protein, 25 aa, Staphylococcus aureus
NVIEMYKLKKLLGLADNKEDENDVL

SEQ ID NO: 1659557 - protein, 18 aa, Staphylococcus aureus
NYVAVWFRQERRDGTFRT

SEQ ID NO: 1659558 - protein, 22 aa, Staphylococcus aureus
NYYLNFKELRAFVTGNAPAKLT

SEQ ID NO: 1659559 - protein, 17 aa, Staphylococcus aureus
PACHLRQRGLNQYLESK

SEQ ID NO: 1659560 - protein, 34 aa, Staphylococcus aureus
PAMVPYAAWQKFARPRFDNMISFNSTNDLLTWLQ

SEQ ID NO: 1659561 - protein, 24 aa, Staphylococcus aureus
PDTGELKGALGVEKIFDSYLSGSK

SEQ ID NO: 1659562 - protein, 25 aa, Staphylococcus aureus
PIAGRRILLKEVRDSIFREKMVGEG

SEQ ID NO: 1659563 - protein, 21 aa, Staphylococcus aureus
PILGICLGAQALTCYYGGEVI

SEQ ID NO: 1659564 - protein, 29 aa, Staphylococcus aureus
PKAKMPSQLFQFFMSYLLARFDISLATLL

SEQ ID NO: 1659565 - protein, 23 aa, Staphylococcus aureus
PKIRKNLRHAIEMLNVKKKEFLS

SEQ ID NO: 1659566 - protein, 20 aa, Staphylococcus aureus
PLMRRLIEQRICDALAGDEQ

SEQ ID NO: 1659567 - protein, 19 aa, Staphylococcus aureus
PLVNFELFDPSNFEEAKAA

SEQ ID NO: 1659568 - protein, 23 aa, Staphylococcus aureus
PQFKTNPILVSGVSFTPETKSIM

SEQ ID NO: 1659569 - protein, 30 aa, Staphylococcus aureus
PQNSFEVFCTLAYTGMRAGELLALKWSDID

SEQ ID NO: 1659570 - protein, 17 aa, Staphylococcus aureus
PSLPTHAMFGENLTFDY

SEQ ID NO: 1659571 - protein, 22 aa, Staphylococcus aureus
PSQTEFRLSLMQQLAVNQITSG

SEQ ID NO: 1659572 - protein, 17 aa, Staphylococcus aureus
PSVESIQKYANLLRKDL

SEQ ID NO: 1659573 - protein, 24 aa, Staphylococcus aureus
PVVSKISAGMPIYAEENLIDYIYF

SEQ ID NO: 1659574 - protein, 23 aa, Staphylococcus aureus
PYIMKKLNAPFTYDAEISNIFYD

SEQ ID NO: 1659575 - protein, 18 aa, Staphylococcus aureus
PYKVFTSFYKKWRPYLRH

SEQ ID NO: 1659576 - protein, 19 aa, Staphylococcus aureus
QAGDRFVVFSDEKQARRIG

SEQ ID NO: 1659577 - protein, 21 aa, Staphylococcus aureus
QAGKSLKRFVRQNEREHYIIR

SEQ ID NO: 1659578 - protein, 17 aa, Staphylococcus aureus
QAIADAENVLKQNANKQ

SEQ ID NO: 1659579 - protein, 22 aa, Staphylococcus aureus
QAVEKHYKLYVNMLENGEKHAI

SEQ ID NO: 1659580 - protein, 18 aa, Staphylococcus aureus
QDAIANLDTLRDLNQPQR

SEQ ID NO: 1659581 - protein, 17 aa, Staphylococcus aureus
QEAMKLGDKICLLNEGH

SEQ ID NO: 1659582 - protein, 21 aa, Staphylococcus aureus
QFFEYAKEFLEQEYGKDNLLY

SEQ ID NO: 1659583 - protein, 24 aa, Staphylococcus aureus
QFNPDGWYGFQCYDYANMFFMLAT

SEQ ID NO: 1659584 - protein, 23 aa, Staphylococcus aureus
QHKVWRKRVMKDMGVRKGMKALD

SEQ ID NO: 1659585 - protein, 25 aa, Staphylococcus aureus
QHMHVLLCVENAYFRKKENYITQEE

SEQ ID NO: 1659586 - protein, 17 aa, Staphylococcus aureus
QPFIDYINDIFLQEGDI

SEQ ID NO: 1659587 - protein, 18 aa, Staphylococcus aureus
QQYFTLSLTVKGFDFQLE

SEQ ID NO: 1659588 - protein, 25 aa, Staphylococcus aureus
QRNATELNTAMGQLQHAIADKTTTL

SEQ ID NO: 1659589 - protein, 17 aa, Staphylococcus aureus
QVDEVFDPILVIQAEND

SEQ ID NO: 1659590 - protein, 17 aa, Staphylococcus aureus
RDILTRENIKEVTTKTT

SEQ ID NO: 1659591 - protein, 24 aa, Staphylococcus aureus
RDLKISYTTLSDWINAKTYPRIDK

SEQ ID NO: 1659592 - protein, 25 aa, Staphylococcus aureus
RDMNRLRPFGTDFSRPIFEMDDLSV

SEQ ID NO: 1659593 - protein, 18 aa, Staphylococcus aureus
RDRYRKAIHEATNYVKNV

SEQ ID NO: 1659594 - protein, 18 aa, Staphylococcus aureus
REHVREAQKLVDNYKDTH

SEQ ID NO: 1659595 - protein, 18 aa, Staphylococcus aureus
RGEGIDALQEVGRYEHLF

SEQ ID NO: 1659596 - protein, 19 aa, Staphylococcus aureus
RIDKIEMLAKYFGVEKSSL

SEQ ID NO: 1659597 - protein, 26 aa, Staphylococcus aureus
RINLTEAYTNYAILFISGTYPGGVIE

SEQ ID NO: 1659598 - protein, 17 aa, Staphylococcus aureus
RKIYKIFDQNLKREFSY

SEQ ID NO: 1659599 - protein, 20 aa, Staphylococcus aureus
RLPDGRWPSQTEFRLSLMQQ

SEQ ID NO: 1659600 - protein, 19 aa, Staphylococcus aureus
RNNFPSAHQFLVRNFGTGG

SEQ ID NO: 1659601 - protein, 24 aa, Staphylococcus aureus
RPAVEAGESLGFLPGDLKEKVDPY

SEQ ID NO: 1659602 - protein, 18 aa, Staphylococcus aureus
RQALESQINNAATRDEVA

SEQ ID NO: 1659603 - protein, 22 aa, Staphylococcus aureus
RQLPREDMDALIINALNMVNLN

SEQ ID NO: 1659604 - protein, 17 aa, Staphylococcus aureus
RQSLTTKNYRHYYIHLD

SEQ ID NO: 1659605 - protein, 20 aa, Staphylococcus aureus
RRLYEGKVLAGFAGSVADAF

SEQ ID NO: 1659606 - protein, 20 aa, Staphylococcus aureus
RRSLQIYGFSPCHEIRDMLA

SEQ ID NO: 1659607 - protein, 24 aa, Staphylococcus aureus
RSITNGRLDSQWATPNEHKTAVLF

SEQ ID NO: 1659608 - protein, 22 aa, Staphylococcus aureus
RSQMAEGWAKQILADDWNVYSA

SEQ ID NO: 1659609 - protein, 19 aa, Staphylococcus aureus
RVGDRRVLCAMSGGVDSSV

SEQ ID NO: 1659610 - protein, 18 aa, Staphylococcus aureus
RYEGFGPSGSMLIVDALT

SEQ ID NO: 1659611 - protein, 25 aa, Staphylococcus aureus
RYLNDIEFELPLIIRNEVLAPGGQK

SEQ ID NO: 1659612 - protein, 30 aa, Staphylococcus aureus
SFAPFSLVLRFGYDGIDVIDLNLFEHWFRS

SEQ ID NO: 1659613 - protein, 30 aa, Staphylococcus aureus
SGKTTLMRHIVSFLKSHGYTVATIKHHGHG

SEQ ID NO: 1659614 - protein, 17 aa, Staphylococcus aureus
SIGKSFKEKFSKDMKDG

SEQ ID NO: 1659615 - protein, 18 aa, Staphylococcus aureus
SIPEGYVGLLTSRSGVSS

SEQ ID NO: 1659616 - protein, 22 aa, Staphylococcus aureus
SIPKFPKKIAVLTASTGAAIRD

SEQ ID NO: 1659617 - protein, 26 aa, Staphylococcus aureus
SIRFQNCSLFPLYHGSAKSNIGIDNL

SEQ ID NO: 1659618 - protein, 25 aa, Staphylococcus aureus
SKELLDLLRLHLSLFNKYEKDEIRQ

SEQ ID NO: 1659619 - protein, 17 aa, Staphylococcus aureus
SKGGAYLEMELHEGQNS

SEQ ID NO: 1659620 - protein, 18 aa, Staphylococcus aureus
SLEFQIKHLMVSKVKGSF

SEQ ID NO: 1659621 - protein, 26 aa, Staphylococcus aureus
SLLALPKLGAINVHASLLPKYRGGAP

SEQ ID NO: 1659622 - protein, 17 aa, Staphylococcus aureus
SLSDSYPTLAMIYVTHF

SEQ ID NO: 1659623 - protein, 30 aa, Staphylococcus aureus
SNKWKEKVHIIRWFLAYKKVPKILVDKIIA

SEQ ID NO: 1659624 - protein, 25 aa, Staphylococcus aureus
SNMKLRIGFSDIFFNVDKLTSSEAS

SEQ ID NO: 1659625 - protein, 17 aa, Staphylococcus aureus
SNYNGIVSPAYTVLYPT

SEQ ID NO: 1659626 - protein, 19 aa, Staphylococcus aureus
SQLTERISNMIGVHQVIIN

SEQ ID NO: 1659627 - protein, 18 aa, Staphylococcus aureus
SRQDALAGKIDWVTKFPE

SEQ ID NO: 1659628 - protein, 17 aa, Staphylococcus aureus
SRSMGTVSYTYNDGVPD

SEQ ID NO: 1659629 - protein, 22 aa, Staphylococcus aureus
SSILKFPGVLIRTSTERPEVLD

SEQ ID NO: 1659630 - protein, 19 aa, Staphylococcus aureus
STLGYEKQTNWAFSENNEA

SEQ ID NO: 1659631 - protein, 23 aa, Staphylococcus aureus
SVLLKNKLVEWSLYLKDQRINPI

SEQ ID NO: 1659632 - protein, 18 aa, Staphylococcus aureus
SYEGYKIVVIPIEVDFEI

SEQ ID NO: 1659633 - protein, 22 aa, Staphylococcus aureus
SYHPKMMLKIILYAYTQSVFSG

SEQ ID NO: 1659634 - protein, 23 aa, Staphylococcus aureus
TDIKYSNGFIKEGTYRTATIGSK

SEQ ID NO: 1659635 - protein, 19 aa, Staphylococcus aureus
TEAKLNKRGIFTIGDLAKY

SEQ ID NO: 1659636 - protein, 20 aa, Staphylococcus aureus
TEFDDMISLMGMHLENDLDY

SEQ ID NO: 1659637 - protein, 17 aa, Staphylococcus aureus
TELNIPMSQWQYAMNRT

SEQ ID NO: 1659638 - protein, 17 aa, Staphylococcus aureus
TEVKNPGFLTVKKICDA

SEQ ID NO: 1659639 - protein, 19 aa, Staphylococcus aureus
TFEYRDARNYLSYLYSNHL

SEQ ID NO: 1659640 - protein, 18 aa, Staphylococcus aureus
TFKLSRHTGLIAEEVEEL

SEQ ID NO: 1659641 - protein, 24 aa, Staphylococcus aureus
TGIIDRVDHRYVYVNLGRIEAVLS

SEQ ID NO: 1659642 - protein, 23 aa, Staphylococcus aureus
TIERNSIVGVRYLRTKPIDKTDE

SEQ ID NO: 1659643 - protein, 35 aa, Staphylococcus aureus
TKLVDGFTHLPGWVRKASVGLAIFGASIGPAVLAG

SEQ ID NO: 1659644 - protein, 21 aa, Staphylococcus aureus
TKRFGKMTAVNDISLKLESGK

SEQ ID NO: 1659645 - protein, 18 aa, Staphylococcus aureus
TLEIWDDGNFSRNVAGID

SEQ ID NO: 1659646 - protein, 23 aa, Staphylococcus aureus
TLLKDIFAHLVVERGKELAKLNN

SEQ ID NO: 1659647 - protein, 23 aa, Staphylococcus aureus
TNEKFKTFFNYVMDVGKIDHQEI

SEQ ID NO: 1659648 - protein, 29 aa, Staphylococcus aureus
TNMIFKYAYDMKLIRIMPSEGIKRPKKKI

SEQ ID NO: 1659649 - protein, 25 aa, Staphylococcus aureus
TNSTRAIHVLKHFDRIEDVVVKVIP

SEQ ID NO: 1659650 - protein, 23 aa, Staphylococcus aureus
TQATEAIPNWAAENGYPVTNYEQ

SEQ ID NO: 1659651 - protein, 27 aa, Staphylococcus aureus
TRIDNKLIKIGVFGTFSAGKSSLINAL

SEQ ID NO: 1659652 - protein, 23 aa, Staphylococcus aureus
TRTAKGYYFVRTFYRKDKLPDRK

SEQ ID NO: 1659653 - protein, 25 aa, Staphylococcus aureus
TSEALKDVLSDTGWEVSEQTEYDGL

SEQ ID NO: 1659654 - protein, 28 aa, Staphylococcus aureus
TSVKMTYKIIGDFKRKIPIDELGNKNGL

SEQ ID NO: 1659655 - protein, 28 aa, Staphylococcus aureus
TVNWHHFLRPEIKFDGIDPLVKQMNDDK

SEQ ID NO: 1659656 - protein, 25 aa, Staphylococcus aureus
VDHFKIVPLLIFSAMHYLKDIPNIV

SEQ ID NO: 1659657 - protein, 17 aa, Staphylococcus aureus
VDQAPNLAAVTAAKNKA

SEQ ID NO: 1659658 - protein, 19 aa, Staphylococcus aureus
VFFGSALANFGVQNFLNAY

SEQ ID NO: 1659659 - protein, 19 aa, Staphylococcus aureus
VGNSVIYVGLKTGRDGIHG

SEQ ID NO: 1659660 - protein, 20 aa, Staphylococcus aureus
VICRRCFRLKNYNEVQDVGL

SEQ ID NO: 1659661 - protein, 25 aa, Staphylococcus aureus
VKEGRIVGIGAHLRKGDKHAEVQAL

SEQ ID NO: 1659662 - protein, 18 aa, Staphylococcus aureus
VKSDMSIFNIPSEDLNTV

SEQ ID NO: 1659663 - protein, 24 aa, Staphylococcus aureus
VMMNGKLFGHVYIKDCKVRQSFEL

SEQ ID NO: 1659664 - protein, 27 aa, Staphylococcus aureus
VMSQNLWYFRYFIYYLIKENVISKKEI

SEQ ID NO: 1659665 - protein, 19 aa, Staphylococcus aureus
VNAAQRVSGVTDLKNSATS

SEQ ID NO: 1659666 - protein, 18 aa, Staphylococcus aureus
VNSNSWTGSPGRLVRHPY

SEQ ID NO: 1659667 - protein, 23 aa, Staphylococcus aureus
VSAIIAEHCLFDLDTPIMRLAAP

SEQ ID NO: 1659668 - protein, 18 aa, Staphylococcus aureus
VSKAFKPIMENTLKYLNV

SEQ ID NO: 1659669 - protein, 18 aa, Staphylococcus aureus
VTKHPKIQLNIYGHGNGL

SEQ ID NO: 1659670 - protein, 17 aa, Staphylococcus aureus
VVLPHGVLFRGAAEGVI

SEQ ID NO: 1659671 - protein, 28 aa, Staphylococcus aureus
VVSINAFKGVSFGEGFKAAEKPGSEIQD

SEQ ID NO: 1659672 - protein, 17 aa, Staphylococcus aureus
WANGLPLTDKRISPING

SEQ ID NO: 1659673 - protein, 17 aa, Staphylococcus aureus
WKSFMNTIADFDDETLC

SEQ ID NO: 1659674 - protein, 18 aa, Staphylococcus aureus
WVQEYAPVLYQIWKKKHK

SEQ ID NO: 1659675 - protein, 24 aa, Staphylococcus aureus
YAAGDVKGGLQFTYISLDDYRIIK

SEQ ID NO: 1659676 - protein, 35 aa, Staphylococcus aureus
YAGQERLPLIHKWINGRMPLIGIGSIFTADDALDA

SEQ ID NO: 1659677 - protein, 18 aa, Staphylococcus aureus
YEKQTNWAFSENNEATFI

SEQ ID NO: 1659678 - protein, 23 aa, Staphylococcus aureus
YERFKSNETIKGFMDTPTSSETL

SEQ ID NO: 1659679 - protein, 24 aa, Staphylococcus aureus
YEVDEQYSGIGFVLSDGNNFVCLD

SEQ ID NO: 1659680 - protein, 17 aa, Staphylococcus aureus
YEYALKLVHNGLFNILA

SEQ ID NO: 1659681 - protein, 22 aa, Staphylococcus aureus
YFIEPEDLFSAMIREIETQDFD

SEQ ID NO: 1659682 - protein, 25 aa, Staphylococcus aureus
YFMTIPEASRLVLQAGALAEGGEVF

SEQ ID NO: 1659683 - protein, 18 aa, Staphylococcus aureus
YIDGELWIYSDVLDSNKN

SEQ ID NO: 1659684 - protein, 17 aa, Staphylococcus aureus
YINITGLGFAKLTKEGA

SEQ ID NO: 1659685 - protein, 21 aa, Staphylococcus aureus
YKEANAIALVLSFNHEVDTFS

SEQ ID NO: 1659686 - protein, 19 aa, Staphylococcus aureus
YKLMFNTLRAMYQQHPIRV

SEQ ID NO: 1659687 - protein, 19 aa, Staphylococcus aureus
YLKDQRINPIIYMETPTED

SEQ ID NO: 1659688 - protein, 25 aa, Staphylococcus aureus
YLNESLDQFILLIFYGTFPGGDFTE

SEQ ID NO: 1659689 - protein, 18 aa, Staphylococcus aureus
YMNGKIYIRRNLSEVRKA

SEQ ID NO: 1659690 - protein, 24 aa, Staphylococcus aureus
YMSHVKHIGKLVLRASDVIEHHNF

SEQ ID NO: 1659691 - protein, 22 aa, Staphylococcus aureus
YMYKKFGVIPEMEYEMEEIKEI

SEQ ID NO: 1659692 - protein, 17 aa, Staphylococcus aureus
YNFAVAIDDHYMEISDV

SEQ ID NO: 1659693 - protein, 34 aa, Staphylococcus aureus
YNIPKKVIKHAGYVRCKLFLEKEEEKIHVANFSF

SEQ ID NO: 1659694 - protein, 18 aa, Staphylococcus aureus
YNNPWIAWYHQQMQDKKA

SEQ ID NO: 1659695 - protein, 17 aa, Staphylococcus aureus
YPLRGHNNVQGCSDMGS

SEQ ID NO: 1659696 - protein, 17 aa, Staphylococcus aureus
YQEGVIADLQLKNNGDL

SEQ ID NO: 1659697 - protein, 18 aa, Staphylococcus aureus
YRISLGKDAETGKYKYIS

SEQ ID NO: 1659698 - protein, 24 aa, Staphylococcus aureus
YSQRKIDVEPVFGFMKAILGFTRM

SEQ ID NO: 1659699 - protein, 33 aa, Staphylococcus aureus
YSQRKIDVEPVFGFMKAILGFTRMSVRGINKVK

SEQ ID NO: 1659700 - protein, 25 aa, Staphylococcus aureus
YTYGEYRLSQHLADLAKNYPELYIH

SEQ ID NO: 1659701 - protein, 18 aa, Staphylococcus aureus
YVNDRGGEIVFNYTKPGS

SEQ ID NO: 1659702 - protein, 17 aa, Staphylococcus aureus
AAMIEGCYVLRAIEMVE

SEQ ID NO: 1659703 - protein, 18 aa, Staphylococcus aureus
ADEYIMNGCNGKKAAITA

SEQ ID NO: 1659704 - protein, 17 aa, Staphylococcus aureus
ADIKILYSPASDQNYRY

SEQ ID NO: 1659705 - protein, 18 aa, Staphylococcus aureus
ADTGISFVVGESDDPMKQ

SEQ ID NO: 1659706 - protein, 17 aa, Staphylococcus aureus
AELNHKGITKAKKDDSA

SEQ ID NO: 1659707 - protein, 17 aa, Staphylococcus aureus
AEQVIKLNDAVTAAKKA

SEQ ID NO: 1659708 - protein, 20 aa, Staphylococcus aureus
AETGFSNYLEVELSNDSDSV

SEQ ID NO: 1659709 - protein, 18 aa, Staphylococcus aureus
AETGMHFTITVKNGLTLQ

SEQ ID NO: 1659710 - protein, 17 aa, Staphylococcus aureus
AGSPCGKSLGAIPTSTL

SEQ ID NO: 1659711 - protein, 25 aa, Staphylococcus aureus
AISDRFPGFQLDYFKKTNYLDTDWK

SEQ ID NO: 1659712 - protein, 30 aa, Staphylococcus aureus
AIYINCPLFNEMPEILEAIKNQFKQYSRNE

SEQ ID NO: 1659713 - protein, 23 aa, Staphylococcus aureus
AKENINCRCKLMYYIDENDLPST

SEQ ID NO: 1659714 - protein, 18 aa, Staphylococcus aureus
AKIKVVLNGAGAAGIAIV

SEQ ID NO: 1659715 - protein, 19 aa, Staphylococcus aureus
AKPPKLVTREMVKSMKKGS

SEQ ID NO: 1659716 - protein, 17 aa, Staphylococcus aureus
AKQFGIRYANTQTNEDI

SEQ ID NO: 1659717 - protein, 21 aa, Staphylococcus aureus
AKQLRKGAVKRIVLTRPAVEA

SEQ ID NO: 1659718 - protein, 25 aa, Staphylococcus aureus
ALNDVDGRVGVATMLMHESGEYIEY

SEQ ID NO: 1659719 - protein, 20 aa, Staphylococcus aureus
ALVYYREVVKHHQLKVNAFE

SEQ ID NO: 1659720 - protein, 24 aa, Staphylococcus aureus
AMGRDCGDLALWAGLSVGAETIVV

SEQ ID NO: 1659721 - protein, 24 aa, Staphylococcus aureus
AMIADPAIDIGMLLYNYVPQQQWS

SEQ ID NO: 1659722 - protein, 18 aa, Staphylococcus aureus
AMSTFVIYDNTIERNSIV

SEQ ID NO: 1659723 - protein, 27 aa, Staphylococcus aureus
ANEISGMIPVEWEKVYTIAYVDDEGGE

SEQ ID NO: 1659724 - protein, 38 aa, Staphylococcus aureus
ANHVGKGWFAIELGEKIDFLIKIPKYILNAIAFACQEI

SEQ ID NO: 1659725 - protein, 29 aa, Staphylococcus aureus
ANIFYGTSIPTCILVFKKCRQQDDNVLFI

SEQ ID NO: 1659726 - protein, 30 aa, Staphylococcus aureus
ANKISSMIPVEWEKVYTMAYIDDGGGEVFF

SEQ ID NO: 1659727 - protein, 17 aa, Staphylococcus aureus
ANTLVYRGQPSPDKMWT

SEQ ID NO: 1659728 - protein, 18 aa, Staphylococcus aureus
APPEIIDFKSWLDGQDLN

SEQ ID NO: 1659729 - protein, 21 aa, Staphylococcus aureus
APQPFWNPAIDAGRKTFEQYF

SEQ ID NO: 1659730 - protein, 34 aa, Staphylococcus aureus
AREASWRVLGMYPKEVQLIGAIVLHEGNIAEMQT

SEQ ID NO: 1659731 - protein, 18 aa, Staphylococcus aureus
ASELTKAAGADFVKTSTG

SEQ ID NO: 1659732 - protein, 19 aa, Staphylococcus aureus
ASGGELSRIMLALKSIFVK

SEQ ID NO: 1659733 - protein, 17 aa, Staphylococcus aureus
ASIELLRANMMTTNGGG

SEQ ID NO: 1659734 - protein, 25 aa, Staphylococcus aureus
ASITNFKASKTFSLQQLSQDDVFAQ

SEQ ID NO: 1659735 - protein, 17 aa, Staphylococcus aureus
ASWRGPQYRSWRKVSLQ

SEQ ID NO: 1659736 - protein, 17 aa, Staphylococcus aureus
ATNTINGLPHLTQLQKD

SEQ ID NO: 1659737 - protein, 22 aa, Staphylococcus aureus
ATPNEHKTAVLFDGAANGVGTR

SEQ ID NO: 1659738 - protein, 19 aa, Staphylococcus aureus
AWDATMYSFGTIPRGDTGY

SEQ ID NO: 1659739 - protein, 19 aa, Staphylococcus aureus
CGFDFKAKYGDLGEGFIEI

SEQ ID NO: 1659740 - protein, 20 aa, Staphylococcus aureus
CKYDDLGKMYQIVRQYELGN

SEQ ID NO: 1659741 - protein, 22 aa, Staphylococcus aureus
CMTGCPYKKVYFNWKTNKAEKC

SEQ ID NO: 1659742 - protein, 18 aa, Staphylococcus aureus
DALRKKVKLMKMSIDELG

SEQ ID NO: 1659743 - protein, 19 aa, Staphylococcus aureus
DAVNAMTHLNDAQKQALKG

SEQ ID NO: 1659744 - protein, 17 aa, Staphylococcus aureus
DCGAQLESSMKYINEHG

SEQ ID NO: 1659745 - protein, 22 aa, Staphylococcus aureus
DDPRHPNWLVIEVCGGQTDSKR

SEQ ID NO: 1659746 - protein, 26 aa, Staphylococcus aureus
DDQFRMIIKQLYFFSVANPNPKNWLD

SEQ ID NO: 1659747 - protein, 25 aa, Staphylococcus aureus
DDRDYEFAKKFDLPIIEVIEGGNVE

SEQ ID NO: 1659748 - protein, 19 aa, Staphylococcus aureus
DEAYLDYGMAYDVEMAPHI

SEQ ID NO: 1659749 - protein, 18 aa, Staphylococcus aureus
DELRAFVEAAKIPVVHSL

SEQ ID NO: 1659750 - protein, 19 aa, Staphylococcus aureus
DERRTEIQLGGFEDLEDED

SEQ ID NO: 1659751 - protein, 22 aa, Staphylococcus aureus
DEVARLTPLYAGVSYDRLEGFN

SEQ ID NO: 1659752 - protein, 19 aa, Staphylococcus aureus
DFRAVGLAIKEARMKRGLT

SEQ ID NO: 1659753 - protein, 22 aa, Staphylococcus aureus
DGIESVRWTGRIEQVHDKPLII

SEQ ID NO: 1659754 - protein, 20 aa, Staphylococcus aureus
DGNGGGSYECLITKESGTTL

SEQ ID NO: 1659755 - protein, 24 aa, Staphylococcus aureus
DGNMLKPWFVNSVENPVSKRQFYK

SEQ ID NO: 1659756 - protein, 19 aa, Staphylococcus aureus
DGTFRTVLLPKVMFTNPKI

SEQ ID NO: 1659757 - protein, 19 aa, Staphylococcus aureus
DILSPEKELVVLTRLNEKE

SEQ ID NO: 1659758 - protein, 17 aa, Staphylococcus aureus
DKIPMNIADDIKFHVVI

SEQ ID NO: 1659759 - protein, 21 aa, Staphylococcus aureus
DKLYAKFGFMPTEPDSGGMYI

SEQ ID NO: 1659760 - protein, 21 aa, Staphylococcus aureus
DKQKYNYFVMKWVNKEYKKIF

SEQ ID NO: 1659761 - protein, 20 aa, Staphylococcus aureus
DKSNVRFVIHYNMPGDLESY

SEQ ID NO: 1659762 - protein, 18 aa, Staphylococcus aureus
DKSYPYISFIPMTDDVEL

SEQ ID NO: 1659763 - protein, 24 aa, Staphylococcus aureus
DLEPWTSCEFDFTREGNLKVSFDY

SEQ ID NO: 1659764 - protein, 18 aa, Staphylococcus aureus
DLLMPKKQIEALVYNFYE

SEQ ID NO: 1659765 - protein, 17 aa, Staphylococcus aureus
DLSELYFATDAMRDVIN

SEQ ID NO: 1659766 - protein, 24 aa, Staphylococcus aureus
DLTKDYILSVGKEFLKKADTSDKK

SEQ ID NO: 1659767 - protein, 19 aa, Staphylococcus aureus
DMRIGELLAIKRVNINYED

SEQ ID NO: 1659768 - protein, 24 aa, Staphylococcus aureus
DMSGWTKEDVIAFENLTNIKVNLK

SEQ ID NO: 1659769 - protein, 21 aa, Staphylococcus aureus
DNPLEMLFDYVRIRFPTNDVA

SEQ ID NO: 1659770 - protein, 18 aa, Staphylococcus aureus
DQRREMIRQAAFKLVENI

SEQ ID NO: 1659771 - protein, 20 aa, Staphylococcus aureus
DRLLKHDLLFHDMFLNDAWK

SEQ ID NO: 1659772 - protein, 25 aa, Staphylococcus aureus
DSTHWYREVSGIAVEGARNHGLLNV

SEQ ID NO: 1659773 - protein, 24 aa, Staphylococcus aureus
DTKRWKDEVEPIVGKTDMFVFPHG

SEQ ID NO: 1659774 - protein, 24 aa, Staphylococcus aureus
DTPEKAISGGADFIHKHFLSSTDQ

SEQ ID NO: 1659775 - protein, 17 aa, Staphylococcus aureus
DVFKDGFSLEMWGGATF

SEQ ID NO: 1659776 - protein, 21 aa, Staphylococcus aureus
DVKRNGLLFSKGVILVEGDAE

SEQ ID NO: 1659777 - protein, 19 aa, Staphylococcus aureus
DVYGSWRALEELKENGKIK

SEQ ID NO: 1659778 - protein, 22 aa, Staphylococcus aureus
DYFKHLDRLSAKEVSFSDIDNY

SEQ ID NO: 1659779 - protein, 21 aa, Staphylococcus aureus
EALKIKGMVLYMNRNTKTTKG

SEQ ID NO: 1659780 - protein, 17 aa, Staphylococcus aureus
EESYKLFSERYGKQNIA

SEQ ID NO: 1659781 - protein, 23 aa, Staphylococcus aureus
EFICPNNKRIGFKRYAYHNDRYG

SEQ ID NO: 1659782 - protein, 20 aa, Staphylococcus aureus
EFIQSYVIILLIDIRLPVVR

SEQ ID NO: 1659783 - protein, 21 aa, Staphylococcus aureus
EFRNSIRLSDYEFYYTSKSNL

SEQ ID NO: 1659784 - protein, 18 aa, Staphylococcus aureus
EFTHPLAQLIGKREAPPL

SEQ ID NO: 1659785 - protein, 23 aa, Staphylococcus aureus
EGELVGAWFTPPIDEEEMAERIG

SEQ ID NO: 1659786 - protein, 25 aa, Staphylococcus aureus
EGIKLKAGDKIVYDSFRVYKNGVEI

SEQ ID NO: 1659787 - protein, 23 aa, Staphylococcus aureus
EGKKCLCHNDFSCNHLLLDGNNR

SEQ ID NO: 1659788 - protein, 17 aa, Staphylococcus aureus
EGRPCTIGYDLSETEDF

SEQ ID NO: 1659789 - protein, 27 aa, Staphylococcus aureus
EHKGAYKDGKWKVLMIAAEERYVLLEN

SEQ ID NO: 1659790 - protein, 17 aa, Staphylococcus aureus
EHVKTSIVLKTDDYNVD

SEQ ID NO: 1659791 - protein, 20 aa, Staphylococcus aureus
EHVKTSIVLKTDDYNVDRGA

SEQ ID NO: 1659792 - protein, 19 aa, Staphylococcus aureus
EIENFKFFAQYGSFKDLSK

SEQ ID NO: 1659793 - protein, 19 aa, Staphylococcus aureus
EISKLNGLCLKWVAPGTRG

SEQ ID NO: 1659794 - protein, 22 aa, Staphylococcus aureus
EIYELWRQTLIQVGINRPTYKK

SEQ ID NO: 1659795 - protein, 24 aa, Staphylococcus aureus
EKDAIEFAKKHRKEFEKVGEQFFK

SEQ ID NO: 1659796 - protein, 23 aa, Staphylococcus aureus
EKDMYLKYIDIFKEASIKYLKEK

SEQ ID NO: 1659797 - protein, 22 aa, Staphylococcus aureus
EKLYNFIIAKSFQQPVGSTFTY

SEQ ID NO: 1659798 - protein, 20 aa, Staphylococcus aureus
EKNNAVVLFKMHPFVKNRLN

SEQ ID NO: 1659799 - protein, 23 aa, Staphylococcus aureus
ELKGKGCRQFENFLLAQHRSWYD

SEQ ID NO: 1659800 - protein, 19 aa, Staphylococcus aureus
ELKSLRQEIQMIFQDPFAS

SEQ ID NO: 1659801 - protein, 24 aa, Staphylococcus aureus
ELPNAKPGAYVWRDKVCSMEIWKV

SEQ ID NO: 1659802 - protein, 19 aa, Staphylococcus aureus
ELSNEGMVLYLDRNTRTAK

SEQ ID NO: 1659803 - protein, 18 aa, Staphylococcus aureus
EMIANWFPSQATLYRIKQ

SEQ ID NO: 1659804 - protein, 28 aa, Staphylococcus aureus
ENPDELFDAVLMTIKYVMRESKVNKDDI

SEQ ID NO: 1659805 - protein, 25 aa, Staphylococcus aureus
ENPEDLRVVIDLSNAKAGKYQEKYQ

SEQ ID NO: 1659806 - protein, 24 aa, Staphylococcus aureus
ENYLPSSYFRSSGYDGFMQDYVVM

SEQ ID NO: 1659807 - protein, 18 aa, Staphylococcus aureus
EPPDNAWDFFEFLEDDNA

SEQ ID NO: 1659808 - protein, 20 aa, Staphylococcus aureus
EPTVSQGFYGAMFKDLDGHH

SEQ ID NO: 1659809 - protein, 24 aa, Staphylococcus aureus
ERDKPKIVFADAVATTKTSILVGE

SEQ ID NO: 1659810 - protein, 19 aa, Staphylococcus aureus
ERVANVFQLPSVFLNARSN

SEQ ID NO: 1659811 - protein, 18 aa, Staphylococcus aureus
ESLMRQFDFEAVDKQHIT

SEQ ID NO: 1659812 - protein, 26 aa, Staphylococcus aureus
ESNYKCTKLSIALRYEMICSNLEHTN

SEQ ID NO: 1659813 - protein, 20 aa, Staphylococcus aureus
EVANKLNGAISFKEAKQNYD

SEQ ID NO: 1659814 - protein, 21 aa, Staphylococcus aureus
EYGHEVLKMYADNKTINSDKL

SEQ ID NO: 1659815 - protein, 18 aa, Staphylococcus aureus
EYNLAAKVYREIKNYYLY

SEQ ID NO: 1659816 - protein, 24 aa, Staphylococcus aureus
EYPEDWASEVLREVRELEYEEEQE

SEQ ID NO: 1659817 - protein, 22 aa, Staphylococcus aureus
EYTKRFNSLASFNTNINIIPME

SEQ ID NO: 1659818 - protein, 19 aa, Staphylococcus aureus
FAKDRIIKLICHLCQTVGY

SEQ ID NO: 1659819 - protein, 19 aa, Staphylococcus aureus
FAVEEAKKGTSLREITIKL

SEQ ID NO: 1659820 - protein, 19 aa, Staphylococcus aureus
FDGYSDFKSYLKFESNKTH

SEQ ID NO: 1659821 - protein, 19 aa, Staphylococcus aureus
FDNEICASISLNSESQTIL

SEQ ID NO: 1659822 - protein, 19 aa, Staphylococcus aureus
FDVTVEVYEDLLLLRSLSD

SEQ ID NO: 1659823 - protein, 17 aa, Staphylococcus aureus
FEFFSRDILEDFKGVDK

SEQ ID NO: 1659824 - protein, 17 aa, Staphylococcus aureus
FEKVISLIYKEDYYQHF

SEQ ID NO: 1659825 - protein, 19 aa, Staphylococcus aureus
FERMTEYGFENGIDFISQV

SEQ ID NO: 1659826 - protein, 17 aa, Staphylococcus aureus
FEVPHQWQHNAYSEIPQ

SEQ ID NO: 1659827 - protein, 17 aa, Staphylococcus aureus
FGHSLGHGIGLEIHEGP

SEQ ID NO: 1659828 - protein, 18 aa, Staphylococcus aureus
FGIWPEKEYAINWVEKIK

SEQ ID NO: 1659829 - protein, 17 aa, Staphylococcus aureus
FHEVEWDEALNVIADNF

SEQ ID NO: 1659830 - protein, 21 aa, Staphylococcus aureus
FHKNHIYTTVFYDKHRRNNVT

SEQ ID NO: 1659831 - protein, 18 aa, Staphylococcus aureus
FIENRMGGFFGVKKSKNP

SEQ ID NO: 1659832 - protein, 20 aa, Staphylococcus aureus
FIKSNRLKGLSLKDVELSVL

SEQ ID NO: 1659833 - protein, 25 aa, Staphylococcus aureus
FISQRELAEAIGLSRPSVANIISGL

SEQ ID NO: 1659834 - protein, 23 aa, Staphylococcus aureus
FKHYIFEIFLPWYKTQVKLRTYE

SEQ ID NO: 1659835 - protein, 17 aa, Staphylococcus aureus
FKKTNYLDTDWKDRISS

SEQ ID NO: 1659836 - protein, 17 aa, Staphylococcus aureus
FKLAVKKQDYSILVNVL

SEQ ID NO: 1659837 - protein, 18 aa, Staphylococcus aureus
FKLAVKKQDYSILVNVLD

SEQ ID NO: 1659838 - protein, 17 aa, Staphylococcus aureus
FKNALELSFMEDEVDLD

SEQ ID NO: 1659839 - protein, 19 aa, Staphylococcus aureus
FKSRDGITLTTAHKVKGNE

SEQ ID NO: 1659840 - protein, 20 aa, Staphylococcus aureus
FKSSGCIGQAPKLFVGVNSA

SEQ ID NO: 1659841 - protein, 19 aa, Staphylococcus aureus
FKVPKGIEDHLFRITQEAI

SEQ ID NO: 1659842 - protein, 23 aa, Staphylococcus aureus
FLNELFYLIELYLKAFKGQKKTD

SEQ ID NO: 1659843 - protein, 38 aa, Staphylococcus aureus
FNADLWYGFQCFDYANAAWKVLFGLLLKGLGAKDIPFA

SEQ ID NO: 1659844 - protein, 26 aa, Staphylococcus aureus
FNLDRAAIEFGKMDFNTHLDLKAYSD

SEQ ID NO: 1659845 - protein, 18 aa, Staphylococcus aureus
FNPPMFARVFRKHLEGGI

SEQ ID NO: 1659846 - protein, 24 aa, Staphylococcus aureus
FQVEEVMSLLGLDIPFGSSKNPFE

SEQ ID NO: 1659847 - protein, 21 aa, Staphylococcus aureus
FSLTDLYLFIFNNSIKTLTIV

SEQ ID NO: 1659848 - protein, 18 aa, Staphylococcus aureus
FSTPLYWYSMSASLKLFI

SEQ ID NO: 1659849 - protein, 17 aa, Staphylococcus aureus
FTKHDFEFHETLIKASN

SEQ ID NO: 1659850 - protein, 20 aa, Staphylococcus aureus
FVNNFFLRYINSEVLDNAYG

SEQ ID NO: 1659851 - protein, 20 aa, Staphylococcus aureus
FVQMDLRYSVFEKVQTDFMK

SEQ ID NO: 1659852 - protein, 19 aa, Staphylococcus aureus
FWTKEEFEKVISLIYKEDY

SEQ ID NO: 1659853 - protein, 20 aa, Staphylococcus aureus
FYNRGYEFSNIKLYYSSDDE

SEQ ID NO: 1659854 - protein, 24 aa, Staphylococcus aureus
GAFGEALGAIIVRTNKLEAGTAIL

SEQ ID NO: 1659855 - protein, 19 aa, Staphylococcus aureus
GALILLKHQIIPFFSVGDF

SEQ ID NO: 1659856 - protein, 19 aa, Staphylococcus aureus
GDLGEGFIEIHHLKPMFSI

SEQ ID NO: 1659857 - protein, 26 aa, Staphylococcus aureus
GEHAKELRAKLDLILGDTDNPHKITN

SEQ ID NO: 1659858 - protein, 20 aa, Staphylococcus aureus
GFIEIHHLKPMFSIKREIKV

SEQ ID NO: 1659859 - protein, 17 aa, Staphylococcus aureus
GGPRIFDVVNRHKLKTP

SEQ ID NO: 1659860 - protein, 19 aa, Staphylococcus aureus
GIEDHLFRITQEAISNTLR

SEQ ID NO: 1659861 - protein, 20 aa, Staphylococcus aureus
GKARSQMALDVFASKIHKYI

SEQ ID NO: 1659862 - protein, 23 aa, Staphylococcus aureus
GKSMNRPELQRMLKDAKEGNIDC

SEQ ID NO: 1659863 - protein, 17 aa, Staphylococcus aureus
GKWSYLYRAIDTEGHTL

SEQ ID NO: 1659864 - protein, 26 aa, Staphylococcus aureus
GLAIKEARMKRGLTREQVGTMIEIDP

SEQ ID NO: 1659865 - protein, 19 aa, Staphylococcus aureus
GLLAPRIDTMFAKHNVIYG

SEQ ID NO: 1659866 - protein, 23 aa, Staphylococcus aureus
GNTEAMIKYLLPKATVVTPNLFE

SEQ ID NO: 1659867 - protein, 20 aa, Staphylococcus aureus
GPRILRAETAPLYALSAISY

SEQ ID NO: 1659868 - protein, 23 aa, Staphylococcus aureus
GPRILRAETAPLYALSAISYEKE

SEQ ID NO: 1659869 - protein, 17 aa, Staphylococcus aureus
GQARKEKLSSLFNENNW

SEQ ID NO: 1659870 - protein, 25 aa, Staphylococcus aureus
GRDATIDKTMRWLKISNINKLSQKQ

SEQ ID NO: 1659871 - protein, 22 aa, Staphylococcus aureus
GSRATKIPWSFKGDDGEWYTTY

SEQ ID NO: 1659872 - protein, 22 aa, Staphylococcus aureus
GSYTGGLNFNGGRHYGIDFGMP

SEQ ID NO: 1659873 - protein, 17 aa, Staphylococcus aureus
GTGVLNFAVTKNNRPLS

SEQ ID NO: 1659874 - protein, 19 aa, Staphylococcus aureus
GTNEVKSDMSIFNIPSEDL

SEQ ID NO: 1659875 - protein, 24 aa, Staphylococcus aureus
GTNFGEDILRMYGNIDIEKAKEYQ

SEQ ID NO: 1659876 - protein, 17 aa, Staphylococcus aureus
GTYFKSVAVTTTMGPGV

SEQ ID NO: 1659877 - protein, 19 aa, Staphylococcus aureus
GVFGGALTYGCIGEPQAPG

SEQ ID NO: 1659878 - protein, 19 aa, Staphylococcus aureus
GWQGHWIIISATFEGISEE

SEQ ID NO: 1659879 - protein, 25 aa, Staphylococcus aureus
GYASAEALKALGYKVYIGSRNDVRG

SEQ ID NO: 1659880 - protein, 19 aa, Staphylococcus aureus
GYEARPRFNKPSETNAYNV

SEQ ID NO: 1659881 - protein, 26 aa, Staphylococcus aureus
GYEKIEPRDSLFFVHELMGYNTELKV

SEQ ID NO: 1659882 - protein, 19 aa, Staphylococcus aureus
GYIDWPSFVDYEDFQVEEV

SEQ ID NO: 1659883 - protein, 19 aa, Staphylococcus aureus
GYKKLEIDFSKGGKSDLSV

SEQ ID NO: 1659884 - protein, 22 aa, Staphylococcus aureus
HARDMLKRERLFFDKMQAHIGE

SEQ ID NO: 1659885 - protein, 26 aa, Staphylococcus aureus
HAYDFPMWFIRPNFKSETAPRSIQSP

SEQ ID NO: 1659886 - protein, 17 aa, Staphylococcus aureus
HDALMLCEHLYDEGYGC

SEQ ID NO: 1659887 - protein, 21 aa, Staphylococcus aureus
HGKTTLLDSIRHTKVTAGEAG

SEQ ID NO: 1659888 - protein, 24 aa, Staphylococcus aureus
HLSEKKRNIILLHYFMDMSDVEIA

SEQ ID NO: 1659889 - protein, 19 aa, Staphylococcus aureus
HTAEAYFKSKGIDVELIKL

SEQ ID NO: 1659890 - protein, 17 aa, Staphylococcus aureus
IANTVAFLASDKAKYIT

SEQ ID NO: 1659891 - protein, 17 aa, Staphylococcus aureus
IDGNTFLCRFNVAILDD

SEQ ID NO: 1659892 - protein, 20 aa, Staphylococcus aureus
IDHLIDYFILPLRQIEQVSI

SEQ ID NO: 1659893 - protein, 26 aa, Staphylococcus aureus
IDIRLPVVRLYIIRDIVDTCEGEKDN

SEQ ID NO: 1659894 - protein, 17 aa, Staphylococcus aureus
IDKAYFEKCLPGYTLIN

SEQ ID NO: 1659895 - protein, 25 aa, Staphylococcus aureus
IDMSDIFKHISVVYVDALRDVLREM

SEQ ID NO: 1659896 - protein, 19 aa, Staphylococcus aureus
IDSRTGVLNANDWKSQLRR

SEQ ID NO: 1659897 - protein, 23 aa, Staphylococcus aureus
IDYKQVIDFIVKFITTHDLNVQA

SEQ ID NO: 1659898 - protein, 17 aa, Staphylococcus aureus
IEAARSAIEIMYGDEEE

SEQ ID NO: 1659899 - protein, 26 aa, Staphylococcus aureus
IEGIKLKAGDKIVYDSFRVYKNGVEI

SEQ ID NO: 1659900 - protein, 18 aa, Staphylococcus aureus
IEILKKYEITVPRDENLS

SEQ ID NO: 1659901 - protein, 27 aa, Staphylococcus aureus
IEMIDYFKALFPNGGLYIHLDQATERQ

SEQ ID NO: 1659902 - protein, 29 aa, Staphylococcus aureus
IEREKMSFGVINILLQFVMLKEDMKLPKA

SEQ ID NO: 1659903 - protein, 25 aa, Staphylococcus aureus
IERYAKLAGIHRIRIHGLRHSHASL

SEQ ID NO: 1659904 - protein, 18 aa, Staphylococcus aureus
IFLAMIHFYQRFISPLTP

SEQ ID NO: 1659905 - protein, 24 aa, Staphylococcus aureus
IGEVLRLNMDYMLHEDFGYYSYPE

SEQ ID NO: 1659906 - protein, 19 aa, Staphylococcus aureus
IGKREAKLIIGISSTVTDY

SEQ ID NO: 1659907 - protein, 22 aa, Staphylococcus aureus
IGTRYIKLIFEFLKKERNANAV

SEQ ID NO: 1659908 - protein, 18 aa, Staphylococcus aureus
IHQLFGVSRSTVYNWLKY

SEQ ID NO: 1659909 - protein, 19 aa, Staphylococcus aureus
IIDESGLHFRVGPLETTVQ

SEQ ID NO: 1659910 - protein, 22 aa, Staphylococcus aureus
IKDAKFKTIIKLYEYQKSSENN

SEQ ID NO: 1659911 - protein, 21 aa, Staphylococcus aureus
IKEQLDRSAERGMFPSNLEYV

SEQ ID NO: 1659912 - protein, 17 aa, Staphylococcus aureus
IKHAWFVEDRFVKNELE

SEQ ID NO: 1659913 - protein, 24 aa, Staphylococcus aureus
IKKDGYWWIRFKYQREGSSTNNFY

SEQ ID NO: 1659914 - protein, 17 aa, Staphylococcus aureus
IKMAIKNIHFEYVKGIK

SEQ ID NO: 1659915 - protein, 26 aa, Staphylococcus aureus
IKQSKHIGGFPVSGLFLRCTNQEVID

SEQ ID NO: 1659916 - protein, 17 aa, Staphylococcus aureus
IKSLIALKGTNQKEVAK

SEQ ID NO: 1659917 - protein, 22 aa, Staphylococcus aureus
IKSRVATLKKSILFEKMKLSQD

SEQ ID NO: 1659918 - protein, 26 aa, Staphylococcus aureus
IKYDGAYCINGYRWITYIANSGQRRY

SEQ ID NO: 1659919 - protein, 19 aa, Staphylococcus aureus
ILIPQIVKKLFGINLDELG

SEQ ID NO: 1659920 - protein, 18 aa, Staphylococcus aureus
IMEKDMAYELGFDHGLLF

SEQ ID NO: 1659921 - protein, 22 aa, Staphylococcus aureus
IMICTGCRVSGARNIKTEHINQ

SEQ ID NO: 1659922 - protein, 18 aa, Staphylococcus aureus
INDVAIKHAWFVEDRFVK

SEQ ID NO: 1659923 - protein, 18 aa, Staphylococcus aureus
INGNVRFYGGKTDPMEKR

SEQ ID NO: 1659924 - protein, 18 aa, Staphylococcus aureus
INNEPLLMDIAKTPHALI

SEQ ID NO: 1659925 - protein, 17 aa, Staphylococcus aureus
IPFIKHMQNSGLFASIS

SEQ ID NO: 1659926 - protein, 19 aa, Staphylococcus aureus
IPKDEAISFIRQYHYSKIL

SEQ ID NO: 1659927 - protein, 21 aa, Staphylococcus aureus
IPLYEESYILLAPKETFKNQN

SEQ ID NO: 1659928 - protein, 17 aa, Staphylococcus aureus
IPTMTIGVTLRYMHSNV

SEQ ID NO: 1659929 - protein, 22 aa, Staphylococcus aureus
IQELLWFVFEHFDIKGEHNDVD

SEQ ID NO: 1659930 - protein, 17 aa, Staphylococcus aureus
IQVPGAFPKFGTTDGTI

SEQ ID NO: 1659931 - protein, 19 aa, Staphylococcus aureus
IRSSIAIGILEHKGYHNII

SEQ ID NO: 1659932 - protein, 17 aa, Staphylococcus aureus
ISKLASIELLRANMMTT

SEQ ID NO: 1659933 - protein, 26 aa, Staphylococcus aureus
ISNLTKFGYLKIEIIKEGNEVKQRKM

SEQ ID NO: 1659934 - protein, 17 aa, Staphylococcus aureus
ITQITGFDFNNPEQRVG

SEQ ID NO: 1659935 - protein, 20 aa, Staphylococcus aureus
IVHPREFFSIAVRENANAII

SEQ ID NO: 1659936 - protein, 19 aa, Staphylococcus aureus
IVIELTKLMRGINVEESFN

SEQ ID NO: 1659937 - protein, 26 aa, Staphylococcus aureus
IYRRAEINLSVILCRMDKLDGTNEFY

SEQ ID NO: 1659938 - protein, 26 aa, Staphylococcus aureus
KAAEDRKNTVLYLMHYHKRITDKQWE

SEQ ID NO: 1659939 - protein, 20 aa, Staphylococcus aureus
KADYELVDFSLVEKLDWKQL

SEQ ID NO: 1659940 - protein, 23 aa, Staphylococcus aureus
KAITLKAAFELGERMGRRAENNR

SEQ ID NO: 1659941 - protein, 20 aa, Staphylococcus aureus
KAQKRCFVKASALHGLGLYI

SEQ ID NO: 1659942 - protein, 21 aa, Staphylococcus aureus
KDFDLLFVKWIPREQNKEANQ

SEQ ID NO: 1659943 - protein, 23 aa, Staphylococcus aureus
KDMAYELGFDHGLLFKDGVTVGV

SEQ ID NO: 1659944 - protein, 21 aa, Staphylococcus aureus
KDVDLKAGDKIIFDNKHTYKD

SEQ ID NO: 1659945 - protein, 17 aa, Staphylococcus aureus
KDWEKLKHNITFIHPQS

SEQ ID NO: 1659946 - protein, 18 aa, Staphylococcus aureus
KEEMKVVTEVAPTDEQWE

SEQ ID NO: 1659947 - protein, 17 aa, Staphylococcus aureus
KEIPKDEAISFIRQYHY

SEQ ID NO: 1659948 - protein, 23 aa, Staphylococcus aureus
KELKEKRLAYGVSQNKLAVASHI

SEQ ID NO: 1659949 - protein, 24 aa, Staphylococcus aureus
KELLDLLRLHLSLFNKYEKDEIRQ

SEQ ID NO: 1659950 - protein, 20 aa, Staphylococcus aureus
KELPYCNFDAINISPIKVNN

SEQ ID NO: 1659951 - protein, 21 aa, Staphylococcus aureus
KGEAIKAYLTIAPKNTVLITD

SEQ ID NO: 1659952 - protein, 21 aa, Staphylococcus aureus
KGKDATPFLLGKIVEKTNGKS

SEQ ID NO: 1659953 - protein, 23 aa, Staphylococcus aureus
KGQAPQPFWNPAIDAGRKTFEQY

SEQ ID NO: 1659954 - protein, 18 aa, Staphylococcus aureus
KKARGFTSAGAFLNEGTA

SEQ ID NO: 1659955 - protein, 17 aa, Staphylococcus aureus
KKIIELIESNLTGYEIS

SEQ ID NO: 1659956 - protein, 17 aa, Staphylococcus aureus
KKKKFGKNWEDAQKAGK

SEQ ID NO: 1659957 - protein, 18 aa, Staphylococcus aureus
KKNRRSLQIYGFSPCHEI

SEQ ID NO: 1659958 - protein, 19 aa, Staphylococcus aureus
KKYIDELFKKLNVQKLLIH

SEQ ID NO: 1659959 - protein, 19 aa, Staphylococcus aureus
KLGKYPPYYYLINFTISHK

SEQ ID NO: 1659960 - protein, 18 aa, Staphylococcus aureus
KLKNVGGVLMNDVVESLI

SEQ ID NO: 1659961 - protein, 19 aa, Staphylococcus aureus
KLPDFVLSLGAKFNHQAKE

SEQ ID NO: 1659962 - protein, 24 aa, Staphylococcus aureus
KLSSKVEGIGYWLNYDLHVSHCRN

SEQ ID NO: 1659963 - protein, 18 aa, Staphylococcus aureus
KMDFNTHLDLKAYSDNIK

SEQ ID NO: 1659964 - protein, 19 aa, Staphylococcus aureus
KMNLSRVSKGFTIIDDYTQ

SEQ ID NO: 1659965 - protein, 23 aa, Staphylococcus aureus
KMNQHVKVTFDFTNYNYGTYDLA

SEQ ID NO: 1659966 - protein, 19 aa, Staphylococcus aureus
KMSVFPSHANFVLTKGSAA

SEQ ID NO: 1659967 - protein, 17 aa, Staphylococcus aureus
KNFKTFLSQYLPAQPGD

SEQ ID NO: 1659968 - protein, 24 aa, Staphylococcus aureus
KNMRERALEIGATFHIVSLPDSGT

SEQ ID NO: 1659969 - protein, 20 aa, Staphylococcus aureus
KNPFEFYEILKVIQNIEKGL

SEQ ID NO: 1659970 - protein, 34 aa, Staphylococcus aureus
KNTSTIIPMCHPLPLTGIDVHFSWDETNAPLYTL

SEQ ID NO: 1659971 - protein, 17 aa, Staphylococcus aureus
KNVVLIHGFKNYVALLF

SEQ ID NO: 1659972 - protein, 18 aa, Staphylococcus aureus
KPINEMVKHLSLIAHTFY

SEQ ID NO: 1659973 - protein, 19 aa, Staphylococcus aureus
KPTEIHQLFGVSRSTVYNW

SEQ ID NO: 1659974 - protein, 17 aa, Staphylococcus aureus
KPVKGMLTGPVTILNWS

SEQ ID NO: 1659975 - protein, 20 aa, Staphylococcus aureus
KPYLHCVFNKDILNMDKVDI

SEQ ID NO: 1659976 - protein, 17 aa, Staphylococcus aureus
KQFIDYLNVKGIPHLYV

SEQ ID NO: 1659977 - protein, 24 aa, Staphylococcus aureus
KQYKMTTACLLFFGKYNAISDRFP

SEQ ID NO: 1659978 - protein, 19 aa, Staphylococcus aureus
KRIDEPFKSSGCIGQAPKL

SEQ ID NO: 1659979 - protein, 24 aa, Staphylococcus aureus
KRKDFLVHRLVAFAFIPMIEGKIC

SEQ ID NO: 1659980 - protein, 22 aa, Staphylococcus aureus
KRTLHYYDEIGLLVPNKNDKNY

SEQ ID NO: 1659981 - protein, 21 aa, Staphylococcus aureus
KSDLVKYSLPISSITAKGQKL

SEQ ID NO: 1659982 - protein, 24 aa, Staphylococcus aureus
KSIKKKLPLINRFIGLTGTPSPNS

SEQ ID NO: 1659983 - protein, 17 aa, Staphylococcus aureus
KSMTHRAIMLASLAEGT

SEQ ID NO: 1659984 - protein, 26 aa, Staphylococcus aureus
KSRHRFGEGIGRQYGFGINLISYYQG

SEQ ID NO: 1659985 - protein, 17 aa, Staphylococcus aureus
KTLHIIYPKDRVVSLDH

SEQ ID NO: 1659986 - protein, 21 aa, Staphylococcus aureus
KTNYLDTDWKDRISSGDLGNE

SEQ ID NO: 1659987 - protein, 24 aa, Staphylococcus aureus
KVKIDYYKAYCFPREKTKHNNIEY

SEQ ID NO: 1659988 - protein, 22 aa, Staphylococcus aureus
KVNLKGSGFVSHQSISKGQKLT

SEQ ID NO: 1659989 - protein, 26 aa, Staphylococcus aureus
KVSKESGFRTSLLMYNHTNKKMTKSV

SEQ ID NO: 1659990 - protein, 18 aa, Staphylococcus aureus
KWYAEKDFASLLHEDLKI

SEQ ID NO: 1659991 - protein, 25 aa, Staphylococcus aureus
KYNRLNKELTRIGTMLTDDYRQIAK

SEQ ID NO: 1659992 - protein, 17 aa, Staphylococcus aureus
KYYYEQGEELFLNPELE

SEQ ID NO: 1659993 - protein, 22 aa, Staphylococcus aureus
LAELSGYWAYQDLDKRYVIRVN

SEQ ID NO: 1659994 - protein, 17 aa, Staphylococcus aureus
LAGPQHREFRKEILQAM

SEQ ID NO: 1659995 - protein, 27 aa, Staphylococcus aureus
LAKILNVSEAWLLGYDVESKRIDDKER

SEQ ID NO: 1659996 - protein, 18 aa, Staphylococcus aureus
LAPIAPHIGEELWSKLGH

SEQ ID NO: 1659997 - protein, 20 aa, Staphylococcus aureus
LDGSPAVTPRNYRWKSRTGT

SEQ ID NO: 1659998 - protein, 22 aa, Staphylococcus aureus
LDKKVIKYIIDYGSISKGEALK

SEQ ID NO: 1659999 - protein, 17 aa, Staphylococcus aureus
LDMITDLDFETLYEYML

SEQ ID NO: 1660000 - protein, 20 aa, Staphylococcus aureus
LEFRKQFTPAQWHEINRIID

SEQ ID NO: 1660001 - protein, 17 aa, Staphylococcus aureus
LEIWDDGNFSRNVAGID

SEQ ID NO: 1660002 - protein, 24 aa, Staphylococcus aureus
LEKQLPQHFIRISKSEIVNKYYIE

SEQ ID NO: 1660003 - protein, 19 aa, Staphylococcus aureus
LENELGVVLLFRNQKGAKA

SEQ ID NO: 1660004 - protein, 21 aa, Staphylococcus aureus
LENGLRLFVIPKPGFQKTFVT

SEQ ID NO: 1660005 - protein, 21 aa, Staphylococcus aureus
LEPWTSCEFDFTRKGNLKVSF

SEQ ID NO: 1660006 - protein, 40 aa, Staphylococcus aureus
LGHLNMIYLALKIVEFEACRSRELLNIMLIEEPEAHIHHH

SEQ ID NO: 1660007 - protein, 24 aa, Staphylococcus aureus
LGYKEIKGTFLTPEIYSTMSEEEQ

SEQ ID NO: 1660008 - protein, 17 aa, Staphylococcus aureus
LGYYEIDEWKDWLKHVF

SEQ ID NO: 1660009 - protein, 25 aa, Staphylococcus aureus
LHGCYRSNQRLVDFYSNFQSCPYEI

SEQ ID NO: 1660010 - protein, 17 aa, Staphylococcus aureus
LHHKYTKKVMMAKFNNF

SEQ ID NO: 1660011 - protein, 22 aa, Staphylococcus aureus
LHNRFIEKYGFEQLVNIKDLIS

SEQ ID NO: 1660012 - protein, 24 aa, Staphylococcus aureus
LIDKALKLISEFNLLKENGIIVCE

SEQ ID NO: 1660013 - protein, 26 aa, Staphylococcus aureus
LISYLKRYSLSAIFGITSDQDDDGNE

SEQ ID NO: 1660014 - protein, 17 aa, Staphylococcus aureus
LKEIFINECVAYETTLL

SEQ ID NO: 1660015 - protein, 22 aa, Staphylococcus aureus
LKEIPHRSSFSYILMDKSLNHA

SEQ ID NO: 1660016 - protein, 20 aa, Staphylococcus aureus
LKEIQGMWFSSLEELLENKE

SEQ ID NO: 1660017 - protein, 17 aa, Staphylococcus aureus
LKEWLKEHVPGNHELKD

SEQ ID NO: 1660018 - protein, 19 aa, Staphylococcus aureus
LKGGDPAIFGRVQEEVDTL

SEQ ID NO: 1660019 - protein, 17 aa, Staphylococcus aureus
LKKSILFEKMKLSQDEE

SEQ ID NO: 1660020 - protein, 17 aa, Staphylococcus aureus
LKLQFFAEESDGDNGKS

SEQ ID NO: 1660021 - protein, 17 aa, Staphylococcus aureus
LKNYKVDVQDTWKNELY

SEQ ID NO: 1660022 - protein, 19 aa, Staphylococcus aureus
LKPFGHVWLVERWMDDNIE

SEQ ID NO: 1660023 - protein, 19 aa, Staphylococcus aureus
LKSIDRNGALEGIGKPEKL

SEQ ID NO: 1660024 - protein, 19 aa, Staphylococcus aureus
LLEKGFNIKGIKQIIYDSQ

SEQ ID NO: 1660025 - protein, 27 aa, Staphylococcus aureus
LLGAYLISRLEGVQIFIDQPLSMIDKS

SEQ ID NO: 1660026 - protein, 26 aa, Staphylococcus aureus
LLKYDYRDLEIIKAVILKAKKSFNSR

SEQ ID NO: 1660027 - protein, 20 aa, Staphylococcus aureus
LLPEDQRKAVWAIYAVCRKI

SEQ ID NO: 1660028 - protein, 26 aa, Staphylococcus aureus
LMNEKDIRAVLGRFLFVQDDVKKIIN

SEQ ID NO: 1660029 - protein, 18 aa, Staphylococcus aureus
LNCSIYFSDLGCPYQRGS

SEQ ID NO: 1660030 - protein, 17 aa, Staphylococcus aureus
LNDAWKKDLKVEFENEA

SEQ ID NO: 1660031 - protein, 28 aa, Staphylococcus aureus
LNEIKLHREFIIEVPYMNSRKFELLIAN

SEQ ID NO: 1660032 - protein, 23 aa, Staphylococcus aureus
LNKLLENQQILALESNKKIQKLE

SEQ ID NO: 1660033 - protein, 19 aa, Staphylococcus aureus
LNNASRINVGLDIINTLSK

SEQ ID NO: 1660034 - protein, 17 aa, Staphylococcus aureus
LNWIIKMNEHYVVEKIT

SEQ ID NO: 1660035 - protein, 20 aa, Staphylococcus aureus
LPCNGNLLIHGCIPVDENGE

SEQ ID NO: 1660036 - protein, 25 aa, Staphylococcus aureus
LPDAVTRFRQGLGRLIRSENDRGII

SEQ ID NO: 1660037 - protein, 25 aa, Staphylococcus aureus
LPTARKEVFKELLVNCELPQSLREV

SEQ ID NO: 1660038 - protein, 25 aa, Staphylococcus aureus
LPVIKKAGLKYGFSLEEKAVTPNSN

SEQ ID NO: 1660039 - protein, 23 aa, Staphylococcus aureus
LQDGHVWVGYTWEGQRYYLPIRT

SEQ ID NO: 1660040 - protein, 25 aa, Staphylococcus aureus
LQKKVPMKVVHEIQDFKVPKGIEDH

SEQ ID NO: 1660041 - protein, 17 aa, Staphylococcus aureus
LRIAKSICDIYPLLNKS

SEQ ID NO: 1660042 - protein, 22 aa, Staphylococcus aureus
LRSIIESPSFKNAESKLTVAMG

SEQ ID NO: 1660043 - protein, 20 aa, Staphylococcus aureus
LSIYKKILLHTIDLYEETTE

SEQ ID NO: 1660044 - protein, 19 aa, Staphylococcus aureus
LTEGCICCAMKADVSEQLH

SEQ ID NO: 1660045 - protein, 18 aa, Staphylococcus aureus
LTNIKVNLKGSGFVSHQS

SEQ ID NO: 1660046 - protein, 24 aa, Staphylococcus aureus
LTVKESWTAGKIRGKLNKGQKQVF

SEQ ID NO: 1660047 - protein, 19 aa, Staphylococcus aureus
LWMNLYYLFMNLRDLFKKE

SEQ ID NO: 1660048 - protein, 25 aa, Staphylococcus aureus
LYNLLDMIMCLDISYHKLKFKHNLF

SEQ ID NO: 1660049 - protein, 19 aa, Staphylococcus aureus
MAIDLIERVQSTSYQVDYK

SEQ ID NO: 1660050 - protein, 19 aa, Staphylococcus aureus
MDRVLRPLKSMNANIEGIE

SEQ ID NO: 1660051 - protein, 30 aa, Staphylococcus aureus
MGAMLGRFKKCVIGLPGGCPLGPRPIDQHI

SEQ ID NO: 1660052 - protein, 18 aa, Staphylococcus aureus
MHIDGNLKGSSVGDRKLE

SEQ ID NO: 1660053 - protein, 20 aa, Staphylococcus aureus
MIEGCYVLRAIEMVEEGYEP

SEQ ID NO: 1660054 - protein, 17 aa, Staphylococcus aureus
MKDLINYDLIKQGIPDN

SEQ ID NO: 1660055 - protein, 20 aa, Staphylococcus aureus
MLLDELIKWARENPELSQGK

SEQ ID NO: 1660056 - protein, 22 aa, Staphylococcus aureus
MNSKLFGHVYIKDCKVRQSFEL

SEQ ID NO: 1660057 - protein, 18 aa, Staphylococcus aureus
MNYSKVLVITEDWCGDAM

SEQ ID NO: 1660058 - protein, 23 aa, Staphylococcus aureus
MPKWIIDHWATHYGLEKTETILQ

SEQ ID NO: 1660059 - protein, 22 aa, Staphylococcus aureus
MRALLLHLRPLGLKDKSLGEGI

SEQ ID NO: 1660060 - protein, 21 aa, Staphylococcus aureus
MRKAYAVNCAKVLSRTDNISE

SEQ ID NO: 1660061 - protein, 18 aa, Staphylococcus aureus
MRSKSKFIREKTDVRKTD

SEQ ID NO: 1660062 - protein, 18 aa, Staphylococcus aureus
MSEYKKKIIELIESNLTG

SEQ ID NO: 1660063 - protein, 17 aa, Staphylococcus aureus
MTELRKKALKLTETLEM

SEQ ID NO: 1660064 - protein, 17 aa, Staphylococcus aureus
MVRVRLSGVKLKEIIAK

SEQ ID NO: 1660065 - protein, 20 aa, Staphylococcus aureus
NALTALRILLDDSYYYSSKT

SEQ ID NO: 1660066 - protein, 19 aa, Staphylococcus aureus
NATLFEFDILSSILESDDN

SEQ ID NO: 1660067 - protein, 20 aa, Staphylococcus aureus
NDALIAPAVKVWIETYGGKH

SEQ ID NO: 1660068 - protein, 18 aa, Staphylococcus aureus
NDGTFGYEARPRFNKPSE

SEQ ID NO: 1660069 - protein, 18 aa, Staphylococcus aureus
NDHLPKYMIPKTITHIDC

SEQ ID NO: 1660070 - protein, 17 aa, Staphylococcus aureus
NDVVKNFTANGLLSIGA

SEQ ID NO: 1660071 - protein, 21 aa, Staphylococcus aureus
NEFDERFKLSVLEGKTAVIGD

SEQ ID NO: 1660072 - protein, 20 aa, Staphylococcus aureus
NEPFMYKLVDIVADIMEPYY

SEQ ID NO: 1660073 - protein, 24 aa, Staphylococcus aureus
NFHKNNLPHLLGLHYTHKKVSAKK

SEQ ID NO: 1660074 - protein, 25 aa, Staphylococcus aureus
NFLNTKKLSIGWKIYLEKISLRDRQ

SEQ ID NO: 1660075 - protein, 25 aa, Staphylococcus aureus
NFNGGRHYGIDFGMPTGTNIYAVKG

SEQ ID NO: 1660076 - protein, 18 aa, Staphylococcus aureus
NGKIPHWNEIFNVSDKGI

SEQ ID NO: 1660077 - protein, 21 aa, Staphylococcus aureus
NGWNIDRWIEEIACNDNQVVK

SEQ ID NO: 1660078 - protein, 20 aa, Staphylococcus aureus
NIWAPRRAVFEVPNEPDYIV

SEQ ID NO: 1660079 - protein, 17 aa, Staphylococcus aureus
NKNRFLKIEIAFLKLIM

SEQ ID NO: 1660080 - protein, 24 aa, Staphylococcus aureus
NKPILIHTIEKFILVSEFNEIIIA

SEQ ID NO: 1660081 - protein, 26 aa, Staphylococcus aureus
NKVQPCYLLTKKGCDIVANKMTGSKG

SEQ ID NO: 1660082 - protein, 23 aa, Staphylococcus aureus
NLFEFKYKLKPFFNPENVYSKQD

SEQ ID NO: 1660083 - protein, 18 aa, Staphylococcus aureus
NLLLKLQRERGITFLFIA

SEQ ID NO: 1660084 - protein, 19 aa, Staphylococcus aureus
NMALEAFKATDCSGLVRAD

SEQ ID NO: 1660085 - protein, 18 aa, Staphylococcus aureus
NNELTKFEKLQLINFDNF

SEQ ID NO: 1660086 - protein, 23 aa, Staphylococcus aureus
NPLKSSGFGDDWLQNAKLMNNDN

SEQ ID NO: 1660087 - protein, 17 aa, Staphylococcus aureus
NRMGGFFGVKKSKNPNA

SEQ ID NO: 1660088 - protein, 32 aa, Staphylococcus aureus
NSMVTRVISRWATEYNIFFKRYSSDQFVAYLN

SEQ ID NO: 1660089 - protein, 19 aa, Staphylococcus aureus
NVALMIGIPPGLIYGETAD

SEQ ID NO: 1660090 - protein, 18 aa, Staphylococcus aureus
NVDGFDFRLRVKKRAYSV

SEQ ID NO: 1660091 - protein, 22 aa, Staphylococcus aureus
NYPSIFKHYLFFINEVEDRIKN

SEQ ID NO: 1660092 - protein, 22 aa, Staphylococcus aureus
NYYKYRKFGILPETEYEINKVK

SEQ ID NO: 1660093 - protein, 17 aa, Staphylococcus aureus
PEALKLRIEQIQETFIV

SEQ ID NO: 1660094 - protein, 23 aa, Staphylococcus aureus
PEKWKDFEVIKRQKAIEIANAML

SEQ ID NO: 1660095 - protein, 17 aa, Staphylococcus aureus
PETFNDYEFYAMEGHQY

SEQ ID NO: 1660096 - protein, 23 aa, Staphylococcus aureus
PGHTPESISFLLTDEGAGAQVPM

SEQ ID NO: 1660097 - protein, 18 aa, Staphylococcus aureus
PIKKLPTRFTINVAIGNF

SEQ ID NO: 1660098 - protein, 18 aa, Staphylococcus aureus
PKAMGGVNRAIRQGQNKY

SEQ ID NO: 1660099 - protein, 18 aa, Staphylococcus aureus
PKMMLKITLYAYTQSVFS

SEQ ID NO: 1660100 - protein, 21 aa, Staphylococcus aureus
PLLQASWKIAPALATGCSLVM

SEQ ID NO: 1660101 - protein, 19 aa, Staphylococcus aureus
PLPENYEVINFSQLKISDV

SEQ ID NO: 1660102 - protein, 24 aa, Staphylococcus aureus
PNEYKKVLRFAVEEAKKGTSLREI

SEQ ID NO: 1660103 - protein, 24 aa, Staphylococcus aureus
PNFKFPMKQDIPVIMIGPGTGIAP

SEQ ID NO: 1660104 - protein, 18 aa, Staphylococcus aureus
PNLPAIMRKEPKKVSIEP

SEQ ID NO: 1660105 - protein, 18 aa, Staphylococcus aureus
PQYRSWRKVSLQKCASWR

SEQ ID NO: 1660106 - protein, 20 aa, Staphylococcus aureus
PRSDELFYYTSVIKKYNISR

SEQ ID NO: 1660107 - protein, 17 aa, Staphylococcus aureus
PSGAYYGGETLKPTKIY

SEQ ID NO: 1660108 - protein, 24 aa, Staphylococcus aureus
PVYEMRWDIGYVLQQIALFPHMTI

SEQ ID NO: 1660109 - protein, 24 aa, Staphylococcus aureus
PVYGFKVNMFDQWTIRKVPKYIVY

SEQ ID NO: 1660110 - protein, 22 aa, Staphylococcus aureus
PYANEIMIYQSMLDAVQLYPKS

SEQ ID NO: 1660111 - protein, 23 aa, Staphylococcus aureus
PYDKNFINQIGWYLNYNQEINLI

SEQ ID NO: 1660112 - protein, 17 aa, Staphylococcus aureus
PYLKIKSLIALKGTNQK

SEQ ID NO: 1660113 - protein, 18 aa, Staphylococcus aureus
PYVQYGIKYERNQALRNE

SEQ ID NO: 1660114 - protein, 18 aa, Staphylococcus aureus
PYYGATGIIDYVKDYLFN

SEQ ID NO: 1660115 - protein, 18 aa, Staphylococcus aureus
QALNGMRIGEMLAIQNED

SEQ ID NO: 1660116 - protein, 23 aa, Staphylococcus aureus
QEEVSQLIKERIARERKKSDERI

SEQ ID NO: 1660117 - protein, 17 aa, Staphylococcus aureus
QESTGLEAMTIHRLIGW

SEQ ID NO: 1660118 - protein, 19 aa, Staphylococcus aureus
QIELFSIDKFKCNSEAKYY

SEQ ID NO: 1660119 - protein, 25 aa, Staphylococcus aureus
QKLFFKLLFYSGARKGEIRALTWRD

SEQ ID NO: 1660120 - protein, 20 aa, Staphylococcus aureus
QKYVHLLSEYGVWHPRAWEF

SEQ ID NO: 1660121 - protein, 19 aa, Staphylococcus aureus
QLDVKLFYRKKYGMELTEE

SEQ ID NO: 1660122 - protein, 21 aa, Staphylococcus aureus
QLHSIFLEVIIAPKFTDEALD

SEQ ID NO: 1660123 - protein, 17 aa, Staphylococcus aureus
QLNDLYCSRNLRYNEIA

SEQ ID NO: 1660124 - protein, 18 aa, Staphylococcus aureus
QLNDLYCSRNLRYNEIAF

SEQ ID NO: 1660125 - protein, 18 aa, Staphylococcus aureus
QLTNYLLKYDYRDLEIIK

SEQ ID NO: 1660126 - protein, 18 aa, Staphylococcus aureus
QMADIFPKHAETLTKAFD

SEQ ID NO: 1660127 - protein, 24 aa, Staphylococcus aureus
QNLLKRDIASFLRQMHGLDYTDIS

SEQ ID NO: 1660128 - protein, 17 aa, Staphylococcus aureus
QQLPDIWYQGIIDQYTK

SEQ ID NO: 1660129 - protein, 18 aa, Staphylococcus aureus
QQQISYWLERFDITENRK

SEQ ID NO: 1660130 - protein, 17 aa, Staphylococcus aureus
QREIVFPISTDNASWGG

SEQ ID NO: 1660131 - protein, 20 aa, Staphylococcus aureus
QRRINGRPTILSRSYNLYST

SEQ ID NO: 1660132 - protein, 24 aa, Staphylococcus aureus
QTFGTLKFSALRREVRIQNEDGTV

SEQ ID NO: 1660133 - protein, 24 aa, Staphylococcus aureus
QTLNTAMKGLRDSIANEATIKAEQ

SEQ ID NO: 1660134 - protein, 23 aa, Staphylococcus aureus
QTQLKFVLIYTIHIKKLTELSIK

SEQ ID NO: 1660135 - protein, 24 aa, Staphylococcus aureus
QVDYKYNVIWVWHYSDDYLGKVAS

SEQ ID NO: 1660136 - protein, 18 aa, Staphylococcus aureus
QVQKKWERSDYVFPGNQV

SEQ ID NO: 1660137 - protein, 19 aa, Staphylococcus aureus
QYKKEWPFDMVVIDELSTF

SEQ ID NO: 1660138 - protein, 21 aa, Staphylococcus aureus
QYLYRYYNKISEWLAEHPYVN

SEQ ID NO: 1660139 - protein, 17 aa, Staphylococcus aureus
QYTMSVWMGFSKVKQYG

SEQ ID NO: 1660140 - protein, 18 aa, Staphylococcus aureus
RAETAPLYALSAISYEKE

SEQ ID NO: 1660141 - protein, 24 aa, Staphylococcus aureus
RDNHSAYAFIKRLIKQFGKPQKVV

SEQ ID NO: 1660142 - protein, 18 aa, Staphylococcus aureus
REDMDALIINALNMVNLN

SEQ ID NO: 1660143 - protein, 21 aa, Staphylococcus aureus
REMIRQAAFKLVENIKNDLKP

SEQ ID NO: 1660144 - protein, 18 aa, Staphylococcus aureus
RGNTTWGQLELDKAIKNQ

SEQ ID NO: 1660145 - protein, 18 aa, Staphylococcus aureus
RIDTMFAKHNVIYGDNPL

SEQ ID NO: 1660146 - protein, 22 aa, Staphylococcus aureus
RIIKLICHLCQTVGYDQDEFYE

SEQ ID NO: 1660147 - protein, 18 aa, Staphylococcus aureus
RIKRMLVDRPTLLKHTDD

SEQ ID NO: 1660148 - protein, 19 aa, Staphylococcus aureus
RIQRKCAIVTDLDEQAIPS

SEQ ID NO: 1660149 - protein, 21 aa, Staphylococcus aureus
RKEKLSSLFNENNWVNCFYAN

SEQ ID NO: 1660150 - protein, 19 aa, Staphylococcus aureus
RKKVKLMKMSIDELGPVNL

SEQ ID NO: 1660151 - protein, 23 aa, Staphylococcus aureus
RKLYPESKIYVFGKTDYKLSHFS

SEQ ID NO: 1660152 - protein, 19 aa, Staphylococcus aureus
RMNVLKSFNGKSIVMNPAN

SEQ ID NO: 1660153 - protein, 17 aa, Staphylococcus aureus
RNGKIAISFREDDELIA

SEQ ID NO: 1660154 - protein, 26 aa, Staphylococcus aureus
RNLKNALKLIKLCQTYHVHILSVHDG

SEQ ID NO: 1660155 - protein, 28 aa, Staphylococcus aureus
RPSIEALNYYATRFMLTVPFENIDVQNS

SEQ ID NO: 1660156 - protein, 17 aa, Staphylococcus aureus
RQDIRGAIVGFFTPELF

SEQ ID NO: 1660157 - protein, 25 aa, Staphylococcus aureus
RQGFVKRVDNYIAFRNTIASIESIV

SEQ ID NO: 1660158 - protein, 19 aa, Staphylococcus aureus
RQLPREDMDALIINALNMV

SEQ ID NO: 1660159 - protein, 19 aa, Staphylococcus aureus
RSFKNYRSGELVHRDEKPY

SEQ ID NO: 1660160 - protein, 17 aa, Staphylococcus aureus
RSKLKVKDLVFVDDSVK

SEQ ID NO: 1660161 - protein, 30 aa, Staphylococcus aureus
RSNINLTLNAKKEWRNILISTGESSIANMA

SEQ ID NO: 1660162 - protein, 21 aa, Staphylococcus aureus
RSQMAEGWAKQILADDWNVYS

SEQ ID NO: 1660163 - protein, 24 aa, Staphylococcus aureus
RTKPSYPVINGIYFALELTPQEGR

SEQ ID NO: 1660164 - protein, 28 aa, Staphylococcus aureus
RTLSKAFGIAGLRLGVLMSTAETIQRIQ

SEQ ID NO: 1660165 - protein, 20 aa, Staphylococcus aureus
RYNDWFERMINYGFEENIDY

SEQ ID NO: 1660166 - protein, 17 aa, Staphylococcus aureus
SAEEQALFDKSVKILED

SEQ ID NO: 1660167 - protein, 26 aa, Staphylococcus aureus
SDWKTNERWEWFIGKNRGALRLTTQP

SEQ ID NO: 1660168 - protein, 23 aa, Staphylococcus aureus
SEDAYYKYAHEFSGGQRQRVGIA

SEQ ID NO: 1660169 - protein, 18 aa, Staphylococcus aureus
SEISRMNVLKSFNGKSIV

SEQ ID NO: 1660170 - protein, 21 aa, Staphylococcus aureus
SENDHCLYFFDITEQVQTNEL

SEQ ID NO: 1660171 - protein, 34 aa, Staphylococcus aureus
SFCSTCTRARLSSDGKFYGCLFATVDGFNVKAFI

SEQ ID NO: 1660172 - protein, 25 aa, Staphylococcus aureus
SFGTIPRGDTGYFFNQAYKKDGAIN

SEQ ID NO: 1660173 - protein, 18 aa, Staphylococcus aureus
SFIIGRRQLTKGIDLEGR

SEQ ID NO: 1660174 - protein, 26 aa, Staphylococcus aureus
SFVYKRRLPFHAKRFNDWLETMPNNV

SEQ ID NO: 1660175 - protein, 19 aa, Staphylococcus aureus
SGYRSYHVIIEYPIETLQG

SEQ ID NO: 1660176 - protein, 22 aa, Staphylococcus aureus
SKDRYKIVHLIEYGHVQKETGK

SEQ ID NO: 1660177 - protein, 18 aa, Staphylococcus aureus
SKGSFKRAIGHLYKQKII

SEQ ID NO: 1660178 - protein, 17 aa, Staphylococcus aureus
SKKTGVSQYVLSQLRQG

SEQ ID NO: 1660179 - protein, 20 aa, Staphylococcus aureus
SKLTDCADLVLLTTDQSRNT

SEQ ID NO: 1660180 - protein, 19 aa, Staphylococcus aureus
SKMAIKEQLDRSAERGMFP

SEQ ID NO: 1660181 - protein, 22 aa, Staphylococcus aureus
SKSPYHRIVSLMPSNTEILYEL

SEQ ID NO: 1660182 - protein, 25 aa, Staphylococcus aureus
SKTLKESDFFHGIQNGWQGHWIIIS

SEQ ID NO: 1660183 - protein, 19 aa, Staphylococcus aureus
SLAEFKNALELSFMEDEVD

SEQ ID NO: 1660184 - protein, 19 aa, Staphylococcus aureus
SLEFQIKHLMVSKVKGSFD

SEQ ID NO: 1660185 - protein, 18 aa, Staphylococcus aureus
SLESSFNIARKMGYFDIP

SEQ ID NO: 1660186 - protein, 17 aa, Staphylococcus aureus
SLIKRVDICEDYINLVS

SEQ ID NO: 1660187 - protein, 18 aa, Staphylococcus aureus
SLLSIKINRINGRDFTTS

SEQ ID NO: 1660188 - protein, 27 aa, Staphylococcus aureus
SMKVARELIELIIAFMFHHQIPMSIET

SEQ ID NO: 1660189 - protein, 17 aa, Staphylococcus aureus
SNYRFVEPKTKASVRHI

SEQ ID NO: 1660190 - protein, 18 aa, Staphylococcus aureus
SPRPRFSTKGRYAHTYMP

SEQ ID NO: 1660191 - protein, 24 aa, Staphylococcus aureus
SREKLKEYMEIISKYQVRTVTFAD

SEQ ID NO: 1660192 - protein, 31 aa, Staphylococcus aureus
SSARKLLYVICSRAKNNLFLFSEVGYFTSKG

SEQ ID NO: 1660193 - protein, 17 aa, Staphylococcus aureus
SSAYAYLMPYRKLSWGK

SEQ ID NO: 1660194 - protein, 31 aa, Staphylococcus aureus
SSFNIARKMGYFDIPKDLLIPITEVDNYPKN

SEQ ID NO: 1660195 - protein, 17 aa, Staphylococcus aureus
SSIGHKNLEFTFIENKE

SEQ ID NO: 1660196 - protein, 17 aa, Staphylococcus aureus
SSITELFEKYEIPQGIQ

SEQ ID NO: 1660197 - protein, 24 aa, Staphylococcus aureus
SVGYRAQLTLSIGVGEGTENLIDL

SEQ ID NO: 1660198 - protein, 17 aa, Staphylococcus aureus
SVNEVFPNILKQLDRVK

SEQ ID NO: 1660199 - protein, 20 aa, Staphylococcus aureus
SVPLPRLFWIMLHHLNDFRQ

SEQ ID NO: 1660200 - protein, 18 aa, Staphylococcus aureus
SVSKGVWKAVKYYRKHQR

SEQ ID NO: 1660201 - protein, 18 aa, Staphylococcus aureus
SVSNYIMRVRLSINEIVD

SEQ ID NO: 1660202 - protein, 19 aa, Staphylococcus aureus
SVVRLCVRYAEQLSVFEEF

SEQ ID NO: 1660203 - protein, 18 aa, Staphylococcus aureus
SYDVMALVHECREAGYPC

SEQ ID NO: 1660204 - protein, 25 aa, Staphylococcus aureus
SYVALEQEYAWAFLNELFYLIELYL

SEQ ID NO: 1660205 - protein, 20 aa, Staphylococcus aureus
TANQYWLYLFNHRLKGVGAA

SEQ ID NO: 1660206 - protein, 19 aa, Staphylococcus aureus
TCTKHIAVSLNIDGKTITI

SEQ ID NO: 1660207 - protein, 29 aa, Staphylococcus aureus
TDDVKRRHIRHCYKADPEYGKGVAKALGI

SEQ ID NO: 1660208 - protein, 27 aa, Staphylococcus aureus
TDGFKKRWPINIGFIGNVRFNEINQKL

SEQ ID NO: 1660209 - protein, 17 aa, Staphylococcus aureus
TDILGGTYLDIARDKGA

SEQ ID NO: 1660210 - protein, 22 aa, Staphylococcus aureus
TDKKVGWKVIFNNMVNQNWGPY

SEQ ID NO: 1660211 - protein, 28 aa, Staphylococcus aureus
TEFEIITAMMFLYFGEIHPVDFVIVEAG

SEQ ID NO: 1660212 - protein, 27 aa, Staphylococcus aureus
TFCDEMAEAGIYKWHIDIQAGTCTYID

SEQ ID NO: 1660213 - protein, 17 aa, Staphylococcus aureus
TFFSAKPYLHCVFNKDI

SEQ ID NO: 1660214 - protein, 19 aa, Staphylococcus aureus
TFNDYEFYAMEGHQYHPSY

SEQ ID NO: 1660215 - protein, 24 aa, Staphylococcus aureus
TGGTLRRLLIVPFNANFNGIKENF

SEQ ID NO: 1660216 - protein, 20 aa, Staphylococcus aureus
TGKEIHFAHFFEFENHKKDA

SEQ ID NO: 1660217 - protein, 24 aa, Staphylococcus aureus
THDPVAASFAERVIMLKDGQIHTQ

SEQ ID NO: 1660218 - protein, 24 aa, Staphylococcus aureus
THFSTGSWGKIPFIPFKNNDLEIS

SEQ ID NO: 1660219 - protein, 25 aa, Staphylococcus aureus
TIHGKELESIFGLSRRQLGYRIQKI

SEQ ID NO: 1660220 - protein, 33 aa, Staphylococcus aureus
TIKYDGAYCINGYRWITYIANNGQRCYIATGEV

SEQ ID NO: 1660221 - protein, 17 aa, Staphylococcus aureus
TIVRDFQSVIGKEIKSQ

SEQ ID NO: 1660222 - protein, 19 aa, Staphylococcus aureus
TKLAHAIVMYFNNGPQTPH

SEQ ID NO: 1660223 - protein, 23 aa, Staphylococcus aureus
TKPRGLFRKKKFSPVVGDIVEFE

SEQ ID NO: 1660224 - protein, 20 aa, Staphylococcus aureus
TKRFGKMTAVNDISLKLESG

SEQ ID NO: 1660225 - protein, 17 aa, Staphylococcus aureus
TKRFNIFANNDEMSFID

SEQ ID NO: 1660226 - protein, 20 aa, Staphylococcus aureus
TKTFYGAFCSAIEVIRKNNP

SEQ ID NO: 1660227 - protein, 17 aa, Staphylococcus aureus
TLKYAVPTTDCYEVFWG

SEQ ID NO: 1660228 - protein, 23 aa, Staphylococcus aureus
TLLIKGHNAYGYLKAEKGVHRLV

SEQ ID NO: 1660229 - protein, 21 aa, Staphylococcus aureus
TMGEAEKCYEYLELVNQENKK

SEQ ID NO: 1660230 - protein, 23 aa, Staphylococcus aureus
TNMAVKLINHLGIEYEFISMSRA

SEQ ID NO: 1660231 - protein, 21 aa, Staphylococcus aureus
TPHYISYEVAQQFMTQDIILK

SEQ ID NO: 1660232 - protein, 17 aa, Staphylococcus aureus
TPYNSKKIYTRSITNGR

SEQ ID NO: 1660233 - protein, 24 aa, Staphylococcus aureus
TSYHPKMMLKIILYAYTQSVFSGR

SEQ ID NO: 1660234 - protein, 17 aa, Staphylococcus aureus
TTCKVCGFDFKAKYGDL

SEQ ID NO: 1660235 - protein, 28 aa, Staphylococcus aureus
TTFEHKGKMAFRVYPKWCNQLNKTAGQT

SEQ ID NO: 1660236 - protein, 23 aa, Staphylococcus aureus
TTSWTSYQTRYEVLKQLCTTYKM

SEQ ID NO: 1660237 - protein, 19 aa, Staphylococcus aureus
TVSELYAPISGKVVEVNEE

SEQ ID NO: 1660238 - protein, 29 aa, Staphylococcus aureus
TWVNATMRAFKLGVILPVTKEFLNYTYSQ

SEQ ID NO: 1660239 - protein, 17 aa, Staphylococcus aureus
VAELLLERAKRLVEIGE

SEQ ID NO: 1660240 - protein, 17 aa, Staphylococcus aureus
VAKGFGIDEDVARRLAS

SEQ ID NO: 1660241 - protein, 20 aa, Staphylococcus aureus
VAVGYYLRYALSYRDISEIL

SEQ ID NO: 1660242 - protein, 19 aa, Staphylococcus aureus
VAYSHRAKERFKEVTTPKF

SEQ ID NO: 1660243 - protein, 17 aa, Staphylococcus aureus
VDFGTGYALEFTGETIK

SEQ ID NO: 1660244 - protein, 17 aa, Staphylococcus aureus
VECHVKAKIINNEKVKK

SEQ ID NO: 1660245 - protein, 26 aa, Staphylococcus aureus
VEIKTKYKLLPIFKINFHKNNLPHLL

SEQ ID NO: 1660246 - protein, 21 aa, Staphylococcus aureus
VETKPGVGYPKRWEDQEHYKG

SEQ ID NO: 1660247 - protein, 18 aa, Staphylococcus aureus
VEVPIIVERDIYKATAKT

SEQ ID NO: 1660248 - protein, 19 aa, Staphylococcus aureus
VFASLSLKSELAYKLIDTD

SEQ ID NO: 1660249 - protein, 17 aa, Staphylococcus aureus
VFNKRGYPIGQILIPGR

SEQ ID NO: 1660250 - protein, 21 aa, Staphylococcus aureus
VKAFKGIDTVVFIPSIIHPSF

SEQ ID NO: 1660251 - protein, 18 aa, Staphylococcus aureus
VKDYLKGLKTVSVDDVKG

SEQ ID NO: 1660252 - protein, 22 aa, Staphylococcus aureus
VKGNEYDTVIAINLLNGKIPHW

SEQ ID NO: 1660253 - protein, 20 aa, Staphylococcus aureus
VKHQYGHAFYDSASDQDIFT

SEQ ID NO: 1660254 - protein, 21 aa, Staphylococcus aureus
VKQFKQLRVWIWETKKRDGKH

SEQ ID NO: 1660255 - protein, 18 aa, Staphylococcus aureus
VKSLLQMLLLHAIPTPVI

SEQ ID NO: 1660256 - protein, 27 aa, Staphylococcus aureus
VKVAGTWHYICLFIDLFNREIVGYSAG

SEQ ID NO: 1660257 - protein, 17 aa, Staphylococcus aureus
VLDKCTLTYLSEWKEVQ

SEQ ID NO: 1660258 - protein, 24 aa, Staphylococcus aureus
VLIFRTKDVFPWRQHDVKLVFFLA

SEQ ID NO: 1660259 - protein, 17 aa, Staphylococcus aureus
VMITREAINNVIKHANA

SEQ ID NO: 1660260 - protein, 17 aa, Staphylococcus aureus
VNMMLAKAMGLKNISII

SEQ ID NO: 1660261 - protein, 24 aa, Staphylococcus aureus
VQEAAKLGFKRVIIPKNNIGGWTY

SEQ ID NO: 1660262 - protein, 23 aa, Staphylococcus aureus
VRAMKRDGWSFASHSYGHINFEK

SEQ ID NO: 1660263 - protein, 21 aa, Staphylococcus aureus
VRKKYEMPIIMLTAKDSEIDK

SEQ ID NO: 1660264 - protein, 17 aa, Staphylococcus aureus
VRLCVRYAEQLSVFEEF

SEQ ID NO: 1660265 - protein, 21 aa, Staphylococcus aureus
VRNYLLKHKNLYEFNSSPYET

SEQ ID NO: 1660266 - protein, 17 aa, Staphylococcus aureus
VSMKRAGADMIITYFAK

SEQ ID NO: 1660267 - protein, 24 aa, Staphylococcus aureus
VSNERAKILLGWEPIATQKEAILA

SEQ ID NO: 1660268 - protein, 24 aa, Staphylococcus aureus
VTDFQLFKLFGLRINVESDLLSEA

SEQ ID NO: 1660269 - protein, 19 aa, Staphylococcus aureus
VVALTGYEGVLGYRTNELT

SEQ ID NO: 1660270 - protein, 18 aa, Staphylococcus aureus
VVNSEMKANLSAFDKSEK

SEQ ID NO: 1660271 - protein, 23 aa, Staphylococcus aureus
WEDEVFRVIIEYNNVPIGYGQIY

SEQ ID NO: 1660272 - protein, 19 aa, Staphylococcus aureus
WIKSEVKPDAIIEFHLDSA

SEQ ID NO: 1660273 - protein, 20 aa, Staphylococcus aureus
WKDSEIWKAIQLLDIPVEKI

SEQ ID NO: 1660274 - protein, 18 aa, Staphylococcus aureus
YADLKILYSPASDQNYRY

SEQ ID NO: 1660275 - protein, 18 aa, Staphylococcus aureus
YAGSYSYECHGGETNKTQ

SEQ ID NO: 1660276 - protein, 21 aa, Staphylococcus aureus
YDKEGYRDGEFEKGDKGMWTI

SEQ ID NO: 1660277 - protein, 26 aa, Staphylococcus aureus
YDLETGRKALLIGVTIGPGNNRHHSI

SEQ ID NO: 1660278 - protein, 24 aa, Staphylococcus aureus
YDVMQRLKFHYYFIDIENSKTATH

SEQ ID NO: 1660279 - protein, 20 aa, Staphylococcus aureus
YESDRGTGVLNFAVTKNNRP

SEQ ID NO: 1660280 - protein, 18 aa, Staphylococcus aureus
YFHKVVLLSGALRLDTLE

SEQ ID NO: 1660281 - protein, 20 aa, Staphylococcus aureus
YFLCHDILEDAWKAENNYSK

SEQ ID NO: 1660282 - protein, 19 aa, Staphylococcus aureus
YGGRIIFVDDCIDLNHYIS

SEQ ID NO: 1660283 - protein, 17 aa, Staphylococcus aureus
YGSEAWTKQFLAVAIRP

SEQ ID NO: 1660284 - protein, 19 aa, Staphylococcus aureus
YGSNVYRVYFNDVQLPLLA

SEQ ID NO: 1660285 - protein, 23 aa, Staphylococcus aureus
YIPCKEIVDYFSLIQTEEGVWKT

SEQ ID NO: 1660286 - protein, 27 aa, Staphylococcus aureus
YIVITTEYYWHWDLKNSKLDVFDYKKL

SEQ ID NO: 1660287 - protein, 25 aa, Staphylococcus aureus
YKALEEKGRCNLKIRMQNRKGKMLA

SEQ ID NO: 1660288 - protein, 19 aa, Staphylococcus aureus
YKGRKCFFYYAKLIYTPEV

SEQ ID NO: 1660289 - protein, 21 aa, Staphylococcus aureus
YKIYGTWYPFYKKNDGNLTKQ

SEQ ID NO: 1660290 - protein, 19 aa, Staphylococcus aureus
YKKFGVLPEMEYEMEEIKE

SEQ ID NO: 1660291 - protein, 27 aa, Staphylococcus aureus
YKKGWNTLCTYLKIRVPFDDLDFFESH

SEQ ID NO: 1660292 - protein, 24 aa, Staphylococcus aureus
YKKSRKGLSNDIWSTYSAFANTEG

SEQ ID NO: 1660293 - protein, 19 aa, Staphylococcus aureus
YKNKFILNIRDYFFENNKL

SEQ ID NO: 1660294 - protein, 19 aa, Staphylococcus aureus
YLASSYFRSSGYDGFMQDY

SEQ ID NO: 1660295 - protein, 18 aa, Staphylococcus aureus
YLIGCQRTGEAMIIDPIR

SEQ ID NO: 1660296 - protein, 19 aa, Staphylococcus aureus
YLLPKATVVTPNLFEAGQL

SEQ ID NO: 1660297 - protein, 17 aa, Staphylococcus aureus
YLSRFFGSKRYLYQDNE

SEQ ID NO: 1660298 - protein, 25 aa, Staphylococcus aureus
YLYPHQRYAIDLVIKENHKTYKNQG

SEQ ID NO: 1660299 - protein, 18 aa, Staphylococcus aureus
YMNSRKFELLIANIEQLS

SEQ ID NO: 1660300 - protein, 18 aa, Staphylococcus aureus
YNELKEIQGMWFSSLEEL

SEQ ID NO: 1660301 - protein, 17 aa, Staphylococcus aureus
YNLAAKFYRDIKNYYLY

SEQ ID NO: 1660302 - protein, 21 aa, Staphylococcus aureus
YRFVEPKTKASVRHIVLDKCT

SEQ ID NO: 1660303 - protein, 17 aa, Staphylococcus aureus
YRISLGKDAETGKYKYI

SEQ ID NO: 1660304 - protein, 21 aa, Staphylococcus aureus
YSDNLIKVFSEDVWNIMGYKK

SEQ ID NO: 1660305 - protein, 17 aa, Staphylococcus aureus
YTEAKGKLVAQPITTIN

SEQ ID NO: 1660306 - protein, 17 aa, Staphylococcus aureus
YTLDFYLKPFVKTKIKA

SEQ ID NO: 1660307 - protein, 17 aa, Staphylococcus aureus
YTSCPIVTGYNRLILAE

SEQ ID NO: 1660308 - protein, 20 aa, Staphylococcus aureus
YVGLKTGRDGIHGATFASEE

SEQ ID NO: 1660309 - protein, 17 aa, Staphylococcus aureus
YVRERAIEQHAKPIELD

SEQ ID NO: 1660310 - protein, 18 aa, Staphylococcus aureus
YYQHFLFISLWFLFMTGM

SEQ ID NO: 1660311 - protein, 21 aa, Staphylococcus aureus
AACIYALEHARELNVQNALLY

SEQ ID NO: 1660312 - protein, 25 aa, Staphylococcus aureus
AAILKQLEQFGSYMVISPHIALIHA

SEQ ID NO: 1660313 - protein, 21 aa, Staphylococcus aureus
AARARGRYGGRPEKLNKKDLN

SEQ ID NO: 1660314 - protein, 24 aa, Staphylococcus aureus
ADDAKRTAYSQAVNAAATILNKTA

SEQ ID NO: 1660315 - protein, 24 aa, Staphylococcus aureus
ADEAKRNAYTNAVTQAEQILNKAQ

SEQ ID NO: 1660316 - protein, 30 aa, Staphylococcus aureus
ADITYRAVDVLKRVDMIACEDTRVTSKLCN

SEQ ID NO: 1660317 - protein, 18 aa, Staphylococcus aureus
ADLAIGVGLVNYKGKHFA

SEQ ID NO: 1660318 - protein, 17 aa, Staphylococcus aureus
AELRKKKPHLFNVPQKH

SEQ ID NO: 1660319 - protein, 19 aa, Staphylococcus aureus
AEMNVKVDNIVNWRRETLG

SEQ ID NO: 1660320 - protein, 22 aa, Staphylococcus aureus
AERAGLGFVGRNGFVINPKLGT

SEQ ID NO: 1660321 - protein, 24 aa, Staphylococcus aureus
AEVIKQKPTVRWLFLTLTVKNVYD

SEQ ID NO: 1660322 - protein, 25 aa, Staphylococcus aureus
AFFKGKKGIKRKVIETHDDVKQVDY

SEQ ID NO: 1660323 - protein, 17 aa, Staphylococcus aureus
AGCGYVPVDTSIPEDRI

SEQ ID NO: 1660324 - protein, 18 aa, Staphylococcus aureus
AHPVIASRMKRAQKLFGQ

SEQ ID NO: 1660325 - protein, 18 aa, Staphylococcus aureus
AIDQNIPYTVLRDNIYTH

SEQ ID NO: 1660326 - protein, 30 aa, Staphylococcus aureus; identical to SEQ ID NO: 1580662

SEQ ID NO: 1660327 - protein, 19 aa, Staphylococcus aureus
AIKNIHFEYVKGIKGKRQN

SEQ ID NO: 1660328 - protein, 18 aa, Staphylococcus aureus
AISKFSIEGKAINFNSIA

SEQ ID NO: 1660329 - protein, 31 aa, Staphylococcus aureus
AIYINCPLFNEMPEILEAIKNQFKQYSRNEI

SEQ ID NO: 1660330 - protein, 19 aa, Staphylococcus aureus
AKDEKDGRDSTNQSMVEST

SEQ ID NO: 1660331 - protein, 22 aa, Staphylococcus aureus
AKDGYIDCVMVYKTNRLARNTS

SEQ ID NO: 1660332 - protein, 20 aa, Staphylococcus aureus
AKVYREIKNYYLYIYEKRVS

SEQ ID NO: 1660333 - protein, 19 aa, Staphylococcus aureus
ALHSFKKGMGAMLVSQLEK

SEQ ID NO: 1660334 - protein, 22 aa, Staphylococcus aureus
ALKKKLTEEGCFDKANKKSIPK

SEQ ID NO: 1660335 - protein, 17 aa, Staphylococcus aureus
ALMTRGLAEISRLGEKL

SEQ ID NO: 1660336 - protein, 24 aa, Staphylococcus aureus
ALSLNYLPSLKFDYAQNEAARLED

SEQ ID NO: 1660337 - protein, 26 aa, Staphylococcus aureus
AMEMRRYLMRFVHHIGGLADFSALKF

SEQ ID NO: 1660338 - protein, 19 aa, Staphylococcus aureus
ANAIKRAFNPDGLNIIQNN

SEQ ID NO: 1660339 - protein, 20 aa, Staphylococcus aureus
ANDMRIGELLAIKRVNINYE

SEQ ID NO: 1660340 - protein, 19 aa, Staphylococcus aureus
ANKAVAINMGAKINASAIL

SEQ ID NO: 1660341 - protein, 25 aa, Staphylococcus aureus
ANKISSMIPVEWEKVYTMAYIDDGG

SEQ ID NO: 1660342 - protein, 22 aa, Staphylococcus aureus
APMGSPRPRFRKTGRFVQTYMP

SEQ ID NO: 1660343 - protein, 21 aa, Staphylococcus aureus
ARQGYGEVHHVSFRVKDHDAI

SEQ ID NO: 1660344 - protein, 18 aa, Staphylococcus aureus
ASDGVGLGHQFLRHVERT

SEQ ID NO: 1660345 - protein, 18 aa, Staphylococcus aureus
ASEGGMRDALSIMDQAIA

SEQ ID NO: 1660346 - protein, 18 aa, Staphylococcus aureus
ASLETFGVDSNRLEIQIM

SEQ ID NO: 1660347 - protein, 24 aa, Staphylococcus aureus
ASNCPASDLPNVFVSSKNDGDKLL

SEQ ID NO: 1660348 - protein, 17 aa, Staphylococcus aureus
ASNSIYRRTYSAAANLH

SEQ ID NO: 1660349 - protein, 17 aa, Staphylococcus aureus
ASTSLVFRCLTITEMTH

SEQ ID NO: 1660350 - protein, 18 aa, Staphylococcus aureus
ASTTNKKTWCDFESVSIE

SEQ ID NO: 1660351 - protein, 22 aa, Staphylococcus aureus
ATPEHNYQFGGAMIESERLSEL

SEQ ID NO: 1660352 - protein, 18 aa, Staphylococcus aureus
AWRRYFHQFPELSDKEFK

SEQ ID NO: 1660353 - protein, 24 aa, Staphylococcus aureus
AYFNKRLRTTGGRYLLKSHDIEIN

SEQ ID NO: 1660354 - protein, 17 aa, Staphylococcus aureus
AYIAMTIAQDTEYILLD

SEQ ID NO: 1660355 - protein, 19 aa, Staphylococcus aureus
AYLQQKGFNPALMSATIHT

SEQ ID NO: 1660356 - protein, 17 aa, Staphylococcus aureus
AYPKALVGENSWGSQVV

SEQ ID NO: 1660357 - protein, 19 aa, Staphylococcus aureus
AYRELKMIVPTPHMVDDIQ

SEQ ID NO: 1660358 - protein, 26 aa, Staphylococcus aureus
CHHDFRVNEVLAYDVMPYIMKKLNAP

SEQ ID NO: 1660359 - protein, 22 aa, Staphylococcus aureus
CLQILKSILKPEGILCFQESDS

SEQ ID NO: 1660360 - protein, 18 aa, Staphylococcus aureus
CNACHKSYTKSDVIDRTL

SEQ ID NO: 1660361 - protein, 22 aa, Staphylococcus aureus
CNFNFEKGKSYALVGESGAGKS

SEQ ID NO: 1660362 - protein, 20 aa, Staphylococcus aureus
CTFIAVKLPYGVQKDADEVE

SEQ ID NO: 1660363 - protein, 20 aa, Staphylococcus aureus
CTPTEYRMMAKLQNLNDYDL

SEQ ID NO: 1660364 - protein, 28 aa, Staphylococcus aureus
CTYYVFDRVGGKIGSTWGNASNWANAAA

SEQ ID NO: 1660365 - protein, 18 aa, Staphylococcus aureus
DAALTRRFNEVLVNEPSA

SEQ ID NO: 1660366 - protein, 18 aa, Staphylococcus aureus
DAYTNAVAHAEGILSKAN

SEQ ID NO: 1660367 - protein, 25 aa, Staphylococcus aureus
DDNVCSCCGQQLLAEQVNEAREKAL

SEQ ID NO: 1660368 - protein, 26 aa, Staphylococcus aureus
DEDLELLESVAFQLGSAIKRIYLTDR

SEQ ID NO: 1660369 - protein, 17 aa, Staphylococcus aureus
DEIDRNPILTDKEKQAL

SEQ ID NO: 1660370 - protein, 17 aa, Staphylococcus aureus
DEKRLNYVGFYRLHHKY

SEQ ID NO: 1660371 - protein, 17 aa, Staphylococcus aureus
DESWKNKTVKKYEETVT

SEQ ID NO: 1660372 - protein, 28 aa, Staphylococcus aureus
DEVLETFIIKRSLSFEGCPYDNAITEAT

SEQ ID NO: 1660373 - protein, 23 aa, Staphylococcus aureus
DFEKHMYAIHILTSLYASTSNTP

SEQ ID NO: 1660374 - protein, 31 aa, Staphylococcus aureus; identical to SEQ ID NO: 1575204

SEQ ID NO: 1660375 - protein, 17 aa, Staphylococcus aureus
DFINCFCKGYVEIKTKY

SEQ ID NO: 1660376 - protein, 18 aa, Staphylococcus aureus
DFLYTCRQKIKVLDITYN

SEQ ID NO: 1660377 - protein, 26 aa, Staphylococcus aureus
DGIYIKDGFIIYKGVRIINTEDLVLP

SEQ ID NO: 1660378 - protein, 20 aa, Staphylococcus aureus
DGTKKFVEEFVEELYSDSPK

SEQ ID NO: 1660379 - protein, 17 aa, Staphylococcus aureus
DHLLTFYDFPLAIRKSI

SEQ ID NO: 1660380 - protein, 23 aa, Staphylococcus aureus
DIKILIDRLSYWGHIFKLLGKSG

SEQ ID NO: 1660381 - protein, 21 aa, Staphylococcus aureus
DIQSGEFIAFIGTSGSGKTTA

SEQ ID NO: 1660382 - protein, 20 aa, Staphylococcus aureus
DIRIPRVFRRDHAPVESLTE

SEQ ID NO: 1660383 - protein, 17 aa, Staphylococcus aureus
DKLYAKFGFMPTEPDSG

SEQ ID NO: 1660384 - protein, 23 aa, Staphylococcus aureus
DKRVDELLDMVGLEPEKYKNRKP

SEQ ID NO: 1660385 - protein, 19 aa, Staphylococcus aureus
DKYRLVYQGGITTIKNGQN

SEQ ID NO: 1660386 - protein, 17 aa, Staphylococcus aureus
DLLNNFVRRVCECKGQW

SEQ ID NO: 1660387 - protein, 26 aa, Staphylococcus aureus
DMGLGYLVKVYDAWKVEKVLDDYHKP

SEQ ID NO: 1660388 - protein, 41 aa, Staphylococcus aureus
DNAVKEGKAKINAVKTFSEYKKDALAKIEDAYNAKVNEADN

SEQ ID NO: 1660389 - protein, 18 aa, Staphylococcus aureus
DPELYLSAVQQLNYMPTQ

SEQ ID NO: 1660390 - protein, 21 aa, Staphylococcus aureus
DPEYWKKLFKRYDDWINSFNA

SEQ ID NO: 1660391 - protein, 22 aa, Staphylococcus aureus
DPYFAGTKVKWILDNVEGAREK

SEQ ID NO: 1660392 - protein, 23 aa, Staphylococcus aureus
DQEIIDSIFMEWINRKSSLKMED

SEQ ID NO: 1660393 - protein, 22 aa, Staphylococcus aureus
DQEVIWLYQYFSDISIAPTTYT

SEQ ID NO: 1660394 - protein, 36 aa, Staphylococcus aureus
DSAMIPYAAWQKFARPRFDNMISFNSTNDLLTWLQD

SEQ ID NO: 1660395 - protein, 24 aa, Staphylococcus aureus
DSTETEWLPVLDFRNKSLAKGSAT

SEQ ID NO: 1660396 - protein, 17 aa, Staphylococcus aureus
DTLLPAIGQGALGIECR

SEQ ID NO: 1660397 - protein, 20 aa, Staphylococcus aureus
DWLHGYWAGVPIGTDKTDTK

SEQ ID NO: 1660398 - protein, 18 aa, Staphylococcus aureus
DYAMKFAKNKGWTTPAKA

SEQ ID NO: 1660399 - protein, 23 aa, Staphylococcus aureus
EAALKAGITLFQFREKGESALKG

SEQ ID NO: 1660400 - protein, 27 aa, Staphylococcus aureus
EAFEYRKVALFKEWKTQKGIAKYLLNQ

SEQ ID NO: 1660401 - protein, 24 aa, Staphylococcus aureus
EAISSVLSSVAWYWHTSFSHTTEQ

SEQ ID NO: 1660402 - protein, 23 aa, Staphylococcus aureus
EALKRGTAILITGGFKPSNKVID

SEQ ID NO: 1660403 - protein, 20 aa, Staphylococcus aureus
EAQQICSLNDFYQIWTQKES

SEQ ID NO: 1660404 - protein, 18 aa, Staphylococcus aureus
EAVFSSSIKYIIANLDDK

SEQ ID NO: 1660405 - protein, 25 aa, Staphylococcus aureus
ECHFKRTSRKLFIEKLKSVQYDLQN

SEQ ID NO: 1660406 - protein, 24 aa, Staphylococcus aureus
ECNFNFEKGKSYALVGESGAGKST

SEQ ID NO: 1660407 - protein, 17 aa, Staphylococcus aureus
EDLFGDRIVPFKGEARQ

SEQ ID NO: 1660408 - protein, 21 aa, Staphylococcus aureus
EDQNLKLLGEDEMDDDDDIPA

SEQ ID NO: 1660409 - protein, 23 aa, Staphylococcus aureus
EDVLKKSMELVIKKSVTASISLD

SEQ ID NO: 1660410 - protein, 19 aa, Staphylococcus aureus
EDYIFKISLSDVVDYNTVV

SEQ ID NO: 1660411 - protein, 25 aa, Staphylococcus aureus
EEIEQAKAQLAQALQDIKDLVKAKE

SEQ ID NO: 1660412 - protein, 21 aa, Staphylococcus aureus
EFDYIKSLRRLTTKDIEVGGG

SEQ ID NO: 1660413 - protein, 17 aa, Staphylococcus aureus
EHSRRYLLDEGLNKANI

SEQ ID NO: 1660414 - protein, 19 aa, Staphylococcus aureus
EIDSTFSYLERVDYQLLTK

SEQ ID NO: 1660415 - protein, 23 aa, Staphylococcus aureus
EIENFKFFVQYGNFKDFKDYKNG

SEQ ID NO: 1660416 - protein, 24 aa, Staphylococcus aureus
EIENFKFFVQYGNFKDLSKYKDGD

SEQ ID NO: 1660417 - protein, 19 aa, Staphylococcus aureus
EIKNYYLYIYEKRVSELTI

SEQ ID NO: 1660418 - protein, 18 aa, Staphylococcus aureus
EILDLLSCGELCACDLLE

SEQ ID NO: 1660419 - protein, 23 aa, Staphylococcus aureus
EKELKRLGINATIRREQGSDIDA

SEQ ID NO: 1660420 - protein, 18 aa, Staphylococcus aureus
EKERLLPGGYLFLSDLVG

SEQ ID NO: 1660421 - protein, 21 aa, Staphylococcus aureus
EKGKRGLDILNELYDLDYPTK

SEQ ID NO: 1660422 - protein, 17 aa, Staphylococcus aureus
EKIEVIKNADCVVVDSN

SEQ ID NO: 1660423 - protein, 17 aa, Staphylococcus aureus
EKIRPPYKSNWYKKEYS

SEQ ID NO: 1660424 - protein, 18 aa, Staphylococcus aureus
EKVEAVAISGSLPKGLNQ

SEQ ID NO: 1660425 - protein, 30 aa, Staphylococcus aureus
ELAKALNVNEAWLMGFDISKNRKIENNDIA

SEQ ID NO: 1660426 - protein, 21 aa, Staphylococcus aureus
ELSKRGGLTIVDDIMVQSATA

SEQ ID NO: 1660427 - protein, 20 aa, Staphylococcus aureus
EMSEAIDAPFGMKLNDYREI

SEQ ID NO: 1660428 - protein, 22 aa, Staphylococcus aureus
ENLKKYKHYVFFGNDKVFKNGK

SEQ ID NO: 1660429 - protein, 25 aa, Staphylococcus aureus
ENMPLKGYVVRGGREMENHFECLWD

SEQ ID NO: 1660430 - protein, 21 aa, Staphylococcus aureus
EPEFRRKSFKSFSDGIRKYQH

SEQ ID NO: 1660431 - protein, 21 aa, Staphylococcus aureus
EPTTYLDICHQLEILELVQKL

SEQ ID NO: 1660432 - protein, 25 aa, Staphylococcus aureus
EQSPKMYGGTCINIGCIASKTLVHD

SEQ ID NO: 1660433 - protein, 24 aa, Staphylococcus aureus
ERAEKFRKRHRVIIRDSNKQWREF

SEQ ID NO: 1660434 - protein, 23 aa, Staphylococcus aureus
ERIKPGDIVPIYLKKNPNFKFPM

SEQ ID NO: 1660435 - protein, 23 aa, Staphylococcus aureus
ERLGIEMKEVMAIGDNLNDLSML

SEQ ID NO: 1660436 - protein, 19 aa, Staphylococcus aureus
ERPMIRATAYWAIGQILGE

SEQ ID NO: 1660437 - protein, 20 aa, Staphylococcus aureus
ESQIKWLKSHDAKFLTLKEF

SEQ ID NO: 1660438 - protein, 19 aa, Staphylococcus aureus
ESRNYTEIMTFEEIEEAWK

SEQ ID NO: 1660439 - protein, 20 aa, Staphylococcus aureus
ETFCQRFNSFTNRIEMPYLR

SEQ ID NO: 1660440 - protein, 18 aa, Staphylococcus aureus
ETLPVLNGVLDYRRQITN

SEQ ID NO: 1660441 - protein, 29 aa, Staphylococcus aureus
ETMNLYDIIDEFRALGDYEYEEIETRVVQ

SEQ ID NO: 1660442 - protein, 26 aa, Staphylococcus aureus
ETQKLMELYYFKKPRTLNLTGVAQEI

SEQ ID NO: 1660443 - protein, 25 aa, Staphylococcus aureus
ETQQIKIPVYFSALNMFRYESSQPI

SEQ ID NO: 1660444 - protein, 24 aa, Staphylococcus aureus
EVAQEAFESWSLTSKSERAQMLRD

SEQ ID NO: 1660445 - protein, 24 aa, Staphylococcus aureus
EVDGEPYFIGKDVADILGYANGRD

SEQ ID NO: 1660446 - protein, 21 aa, Staphylococcus aureus
EVEVAGTFPKEYERFKSNETI

SEQ ID NO: 1660447 - protein, 22 aa, Staphylococcus aureus
EVKELNRLLGKVIHAFDETKEK

SEQ ID NO: 1660448 - protein, 23 aa, Staphylococcus aureus
EYPEDWASEVLREVRELEYEEEQ

SEQ ID NO: 1660449 - protein, 18 aa, Staphylococcus aureus
FAKNKGWTTPAKAIMGGA

SEQ ID NO: 1660450 - protein, 18 aa, Staphylococcus aureus
FALTQGDKFAKAVPLSAV

SEQ ID NO: 1660451 - protein, 21 aa, Staphylococcus aureus
FCQNIPKKSWFVSATSTTNNK

SEQ ID NO: 1660452 - protein, 19 aa, Staphylococcus aureus
FDADPGWLGPKNMSTFLST

SEQ ID NO: 1660453 - protein, 18 aa, Staphylococcus aureus
FDADVKYIAFGNDHNDIV

SEQ ID NO: 1660454 - protein, 17 aa, Staphylococcus aureus
FDLKDLHVVIGPSTSSS

SEQ ID NO: 1660455 - protein, 17 aa, Staphylococcus aureus
FDNINIFIIENLSDDLK

SEQ ID NO: 1660456 - protein, 19 aa, Staphylococcus aureus
FDPLVKKLKPFGFFDYNAL

SEQ ID NO: 1660457 - protein, 23 aa, Staphylococcus aureus
FDRLEEFDLVLVYKLDRLTRNVR

SEQ ID NO: 1660458 - protein, 19 aa, Staphylococcus aureus
FDYIDWVNLEFGPLAKENY

SEQ ID NO: 1660459 - protein, 18 aa, Staphylococcus aureus
FEESYGFLSEPFVRDKDA

SEQ ID NO: 1660460 - protein, 18 aa, Staphylococcus aureus
FEFFSRDILDDFKGVDRN

SEQ ID NO: 1660461 - protein, 17 aa, Staphylococcus aureus
FEIINWLFSNYKKLDEE

SEQ ID NO: 1660462 - protein, 17 aa, Staphylococcus aureus
FELQPKFGKQRPITYIA

SEQ ID NO: 1660463 - protein, 17 aa, Staphylococcus aureus
FEPESSQALGFGYRTGF

SEQ ID NO: 1660464 - protein, 17 aa, Staphylococcus aureus
FEVPHQWQHNVYSEIPQ

SEQ ID NO: 1660465 - protein, 22 aa, Staphylococcus aureus
FFNKYPVLCRKLYQVYKTQVDY

SEQ ID NO: 1660466 - protein, 21 aa, Staphylococcus aureus
FFYCGYFKTSVYRDKQSWEKI

SEQ ID NO: 1660467 - protein, 25 aa, Staphylococcus aureus
FGNKKTIWVWTGFLYEYLANDCAER

SEQ ID NO: 1660468 - protein, 25 aa, Staphylococcus aureus
FGNTKTIWVWTGFLYEYLANDCAER

SEQ ID NO: 1660469 - protein, 22 aa, Staphylococcus aureus
FGTRRIKNHLNRVFNREQQMET

SEQ ID NO: 1660470 - protein, 32 aa, Staphylococcus aureus
FHKLKKILMQWQRGIYDGGGWNAIFWCNHDQP

SEQ ID NO: 1660471 - protein, 24 aa, Staphylococcus aureus
FHWYVKGPNFFSLHVKFEELYNEA

SEQ ID NO: 1660472 - protein, 21 aa, Staphylococcus aureus
FILRGIKLIGIDSVCVDHNIR

SEQ ID NO: 1660473 - protein, 17 aa, Staphylococcus aureus
FIQFRLVGRSENKYLEN

SEQ ID NO: 1660474 - protein, 17 aa, Staphylococcus aureus
FITGKKFAAGRHPKISL

SEQ ID NO: 1660475 - protein, 17 aa, Staphylococcus aureus
FITMVGAMAEWERETIR

SEQ ID NO: 1660476 - protein, 25 aa, Staphylococcus aureus
FKDRIWGGHALKAFNYDIPNDTTGE

SEQ ID NO: 1660477 - protein, 17 aa, Staphylococcus aureus
FKSGIFNTQNWKYDELN

SEQ ID NO: 1660478 - protein, 21 aa, Staphylococcus aureus
FKSNKQLNAFVGIDIKRYQSG

SEQ ID NO: 1660479 - protein, 18 aa, Staphylococcus aureus
FKTRGAQVEEVWVNGHEI

SEQ ID NO: 1660480 - protein, 24 aa, Staphylococcus aureus
FLHRYDLYETKYWSVFDEIQGFSH

SEQ ID NO: 1660481 - protein, 19 aa, Staphylococcus aureus
FLITMAVATWKVWKIEKNT

SEQ ID NO: 1660482 - protein, 21 aa, Staphylococcus aureus
FLQKLNGGMGILLGGVPGVPK

SEQ ID NO: 1660483 - protein, 17 aa, Staphylococcus aureus
FMLTVPFENIDVQNSKP

SEQ ID NO: 1660484 - protein, 24 aa, Staphylococcus aureus
FMNKYPGIILFTSHDTRFVKHVSD

SEQ ID NO: 1660485 - protein, 26 aa, Staphylococcus aureus
FMNVIPNRFIYKIALVGKDEKKYKDG

SEQ ID NO: 1660486 - protein, 17 aa, Staphylococcus aureus
FMSYLLARFDISLATLL

SEQ ID NO: 1660487 - protein, 18 aa, Staphylococcus aureus
FNGLKGQGVLLVNHIQNI

SEQ ID NO: 1660488 - protein, 22 aa, Staphylococcus aureus
FNGRKPSECIALKINGDSMNKI

SEQ ID NO: 1660489 - protein, 23 aa, Staphylococcus aureus
FNLNKVCHVHGIKALNVNDLSEA

SEQ ID NO: 1660490 - protein, 18 aa, Staphylococcus aureus
FQEGRDGFVMGEGAGILV

SEQ ID NO: 1660491 - protein, 24 aa, Staphylococcus aureus
FQGHPACVHIPIGKGVCGTAVSER

SEQ ID NO: 1660492 - protein, 21 aa, Staphylococcus aureus
FQKEILQAMQVGVWAPTQKLT

SEQ ID NO: 1660493 - protein, 20 aa, Staphylococcus aureus
FQLGSAIKRIYLTDREKEAA

SEQ ID NO: 1660494 - protein, 19 aa, Staphylococcus aureus
FRGEGIDALQEVGRYEHLF

SEQ ID NO: 1660495 - protein, 17 aa, Staphylococcus aureus
FRKWLSKTYDWIRDIGK

SEQ ID NO: 1660496 - protein, 17 aa, Staphylococcus aureus
FRNWPIVALSYGQKKRV

SEQ ID NO: 1660497 - protein, 17 aa, Staphylococcus aureus
FSAQMHSLIAMDQKHQR

SEQ ID NO: 1660498 - protein, 28 aa, Staphylococcus aureus
FSDFPKDYKGIAGWVLEVKSNTPGNTTQ

SEQ ID NO: 1660499 - protein, 20 aa, Staphylococcus aureus
FSKDERLTHIALKLFETTDP

SEQ ID NO: 1660500 - protein, 17 aa, Staphylococcus aureus
FSYKHFCIVINKKDNKN

SEQ ID NO: 1660501 - protein, 17 aa, Staphylococcus aureus
FTGVEFFNTVFKGTGYK

SEQ ID NO: 1660502 - protein, 22 aa, Staphylococcus aureus
FVQAAFEKLDFMVVQDEFLTFT

SEQ ID NO: 1660503 - protein, 20 aa, Staphylococcus aureus
FVRRVCECKGQWTMENFIEI

SEQ ID NO: 1660504 - protein, 21 aa, Staphylococcus aureus
FYHNCGFKIGSVDTMLYANFE

SEQ ID NO: 1660505 - protein, 23 aa, Staphylococcus aureus
FYRQSELGWDDEINFMKISFLSH

SEQ ID NO: 1660506 - protein, 17 aa, Staphylococcus aureus
GAGTVKHFGLQDKIDFQ

SEQ ID NO: 1660507 - protein, 17 aa, Staphylococcus aureus
GDGSYRGAQRISEECKE

SEQ ID NO: 1660508 - protein, 22 aa, Staphylococcus aureus
GDKAVHMGDIFPTTAHKNPLWV

SEQ ID NO: 1660509 - protein, 17 aa, Staphylococcus aureus
GDLSTFYRTTLPTYRNK

SEQ ID NO: 1660510 - protein, 20 aa, Staphylococcus aureus
GDVLFQFSQTLARFIPTEVS

SEQ ID NO: 1660511 - protein, 21 aa, Staphylococcus aureus
GELCKIDRAYSGEIVILQNEF

SEQ ID NO: 1660512 - protein, 22 aa, Staphylococcus aureus
GESAWGLFSGVFGKSTNINQVL

SEQ ID NO: 1660513 - protein, 26 aa, Staphylococcus aureus
GESGCGKSTLASLVLGLFKPAKGEIY

SEQ ID NO: 1660514 - protein, 18 aa, Staphylococcus aureus
GFTCKKETPFLPNINNER

SEQ ID NO: 1660515 - protein, 22 aa, Staphylococcus aureus
GGELKSKRVVKFLWVTRNGNYE

SEQ ID NO: 1660516 - protein, 24 aa, Staphylococcus aureus
GGERTKLSLAVLFSTKANMLILDE

SEQ ID NO: 1660517 - protein, 24 aa, Staphylococcus aureus
GHMKEAIKYAVKFYDYPNEHLLTG

SEQ ID NO: 1660518 - protein, 23 aa, Staphylococcus aureus
GIALSTDEKVLWVTETTVNRLHR

SEQ ID NO: 1660519 - protein, 20 aa, Staphylococcus aureus
GIKLAERGHEVHFITSNIPF

SEQ ID NO: 1660520 - protein, 17 aa, Staphylococcus aureus
GKDYLKNILKYYYGTLI

SEQ ID NO: 1660521 - protein, 22 aa, Staphylococcus aureus
GKFDVLIVLSHCGIFFDETLCQ

SEQ ID NO: 1660522 - protein, 18 aa, Staphylococcus aureus
GKKIKLIIEKLEDDNNNL

SEQ ID NO: 1660523 - protein, 22 aa, Staphylococcus aureus
GKPCKDLAIGFSDLDVEKYELH

SEQ ID NO: 1660524 - protein, 21 aa, Staphylococcus aureus
GKRKANEIGTLMHTVMQHLPF

SEQ ID NO: 1660525 - protein, 23 aa, Staphylococcus aureus
GKSPAQVVLRWNVQHAVVTIPKS

SEQ ID NO: 1660526 - protein, 17 aa, Staphylococcus aureus
GKTMIFDAMTYALFGKA

SEQ ID NO: 1660527 - protein, 18 aa, Staphylococcus aureus
GKTPYVIGGLTFANTIGA

SEQ ID NO: 1660528 - protein, 23 aa, Staphylococcus aureus
GKTTTIRMLLGLIKPTKGNIKIF

SEQ ID NO: 1660529 - protein, 21 aa, Staphylococcus aureus
GLAHGLSGYLLSLKNVNLNIE

SEQ ID NO: 1660530 - protein, 31 aa, Staphylococcus aureus
GLDYLVKHTDHLTCGDVLRINNGQGHAMENF

SEQ ID NO: 1660531 - protein, 18 aa, Staphylococcus aureus
GLVRFKQLKKNSGNASVP

SEQ ID NO: 1660532 - protein, 25 aa, Staphylococcus aureus
GMGDIGKAFARRLQGFNTKILYHNR

SEQ ID NO: 1660533 - protein, 23 aa, Staphylococcus aureus
GMVAKRVRGGWALLEALNAPYGM

SEQ ID NO: 1660534 - protein, 22 aa, Staphylococcus aureus
GPFETIGIAGFFGLPIQKDAVD

SEQ ID NO: 1660535 - protein, 21 aa, Staphylococcus aureus
GPNSIRVSFKDNWAIAHMTGV

SEQ ID NO: 1660536 - protein, 17 aa, Staphylococcus aureus
GQSLAAYAPKGLMIHHT

SEQ ID NO: 1660537 - protein, 21 aa, Staphylococcus aureus
GRADKWYDIAFCVRSIREDIG

SEQ ID NO: 1660538 - protein, 23 aa, Staphylococcus aureus
GRERKGVCSVHFAERIKPGDIVP

SEQ ID NO: 1660539 - protein, 30 aa, Staphylococcus aureus; identical to SEQ ID NO: 1574620

SEQ ID NO: 1660540 - protein, 20 aa, Staphylococcus aureus
GRKSYQYDWFYHSKAWKKLR

SEQ ID NO: 1660541 - protein, 17 aa, Staphylococcus aureus
GRSGSIYKGRRLESYSF

SEQ ID NO: 1660542 - protein, 25 aa, Staphylococcus aureus
GRTKPSYPVINGIYFALELTPQEGR

SEQ ID NO: 1660543 - protein, 17 aa, Staphylococcus aureus
GSEAAYQLSERGIKVNL

SEQ ID NO: 1660544 - protein, 26 aa, Staphylococcus aureus
GSEKWPIFLERRLVDGIFTIKDQDAF

SEQ ID NO: 1660545 - protein, 19 aa, Staphylococcus aureus
GSIGIALSLSHLVSKKNEE

SEQ ID NO: 1660546 - protein, 18 aa, Staphylococcus aureus
GSSIGHKNLEFTFIENKE

SEQ ID NO: 1660547 - protein, 18 aa, Staphylococcus aureus
GTELEDFAAFNLSIDDTV

SEQ ID NO: 1660548 - protein, 17 aa, Staphylococcus aureus
GTFTSPFIETFNERISL

SEQ ID NO: 1660549 - protein, 24 aa, Staphylococcus aureus
GTGIKEMIEHFGINQEETLVIGDS

SEQ ID NO: 1660550 - protein, 17 aa, Staphylococcus aureus
GTGVLNFAVTKNNKPLS

SEQ ID NO: 1660551 - protein, 17 aa, Staphylococcus aureus
GTIALVVLDGVSLIKRV

SEQ ID NO: 1660552 - protein, 18 aa, Staphylococcus aureus
GTQYRGAFEENIQKLVEG

SEQ ID NO: 1660553 - protein, 23 aa, Staphylococcus aureus
GVSKEVLAACYITQVNQVFQVGG

SEQ ID NO: 1660554 - protein, 18 aa, Staphylococcus aureus
GVVIGGLYDNRLLVKATK

SEQ ID NO: 1660555 - protein, 17 aa, Staphylococcus aureus
GYLAKSYAQVRNYVTES

SEQ ID NO: 1660556 - protein, 21 aa, Staphylococcus aureus
GYRKLLPLKDFKHFIKHSDSK

SEQ ID NO: 1660557 - protein, 17 aa, Staphylococcus aureus
HEFSYKHFCIVINKKDN

SEQ ID NO: 1660558 - protein, 17 aa, Staphylococcus aureus
HFIAEKDFFIFFRNFFT

SEQ ID NO: 1660559 - protein, 19 aa, Staphylococcus aureus
HFLDPRGQYILEVICGSYE

SEQ ID NO: 1660560 - protein, 22 aa, Staphylococcus aureus
HGADTLRLYEMFMGPLDAAIAW

SEQ ID NO: 1660561 - protein, 22 aa, Staphylococcus aureus
HGKEMFKQAIVDFYQRQYDVTL

SEQ ID NO: 1660562 - protein, 22 aa, Staphylococcus aureus
HGVEWVLRLPRRPDVYKRTKPE

SEQ ID NO: 1660563 - protein, 18 aa, Staphylococcus aureus
HIPFCVRICTYCDFNKYF

SEQ ID NO: 1660564 - protein, 21 aa, Staphylococcus aureus
HKNIKYRGFAINKEMLEELGF

SEQ ID NO: 1660565 - protein, 19 aa, Staphylococcus aureus
HLLRCHVNDYIVYSFALLW

SEQ ID NO: 1660566 - protein, 18 aa, Staphylococcus aureus
HLYRIPKYTYEIIEVKKR

SEQ ID NO: 1660567 - protein, 19 aa, Staphylococcus aureus
HNWGNYKLVFNTRNGANLQ

SEQ ID NO: 1660568 - protein, 22 aa, Staphylococcus aureus
HQVVIRCLMVYFNNVSREEAVD

SEQ ID NO: 1660569 - protein, 22 aa, Staphylococcus aureus
HREPGVFGAAWLNDALHTEMIV

SEQ ID NO: 1660570 - protein, 21 aa, Staphylococcus aureus
HSLFFKLAILYFTESGEKVRR

SEQ ID NO: 1660571 - protein, 27 aa, Staphylococcus aureus
HSYRELPIRIAELGTMHRYEASGAVSG

SEQ ID NO: 1660572 - protein, 25 aa, Staphylococcus aureus
HTIMRKRLDMLASFIESKVPDVEIK

SEQ ID NO: 1660573 - protein, 26 aa, Staphylococcus aureus
HYSKILPRLCKYFLGIFSEEKLLGVV

SEQ ID NO: 1660574 - protein, 20 aa, Staphylococcus aureus
IADHDTIVAGGNYTNTSPDK

SEQ ID NO: 1660575 - protein, 20 aa, Staphylococcus aureus
IAELSSYWVYQDINEKKDFK

SEQ ID NO: 1660576 - protein, 29 aa, Staphylococcus aureus
IANEISGMIPVEWEKVYTIAYVDNQGGEV

SEQ ID NO: 1660577 - protein, 22 aa, Staphylococcus aureus
ICPNNKRIGFKRYAYRNDRYGF

SEQ ID NO: 1660578 - protein, 23 aa, Staphylococcus aureus
IDALYQFLFEFIFDIEERYIRMY

SEQ ID NO: 1660579 - protein, 18 aa, Staphylococcus aureus
IDDNFHIINNLDLPYVYI

SEQ ID NO: 1660580 - protein, 24 aa, Staphylococcus aureus
IDEELQWQWVKGIIEAYQEAFPEL

SEQ ID NO: 1660581 - protein, 23 aa, Staphylococcus aureus
IDIAEAFQIQCAREINNQEIENI

SEQ ID NO: 1660582 - protein, 17 aa, Staphylococcus aureus
IDMEMEGLLQLVNPKII

SEQ ID NO: 1660583 - protein, 20 aa, Staphylococcus aureus
IDPKNGVVFFNLANVYYNQQ

SEQ ID NO: 1660584 - protein, 20 aa, Staphylococcus aureus
IESICKRDPLAGKTVTGGII

SEQ ID NO: 1660585 - protein, 17 aa, Staphylococcus aureus
IETRVVQFYTDLNTDGR

SEQ ID NO: 1660586 - protein, 26 aa, Staphylococcus aureus
IFKNSWFKVYRMFDELRETFKEEELE

SEQ ID NO: 1660587 - protein, 20 aa, Staphylococcus aureus
IFPKNEFYIHIQQFPENDSP

SEQ ID NO: 1660588 - protein, 19 aa, Staphylococcus aureus
IFREKMVGEGLAIKAHEES

SEQ ID NO: 1660589 - protein, 23 aa, Staphylococcus aureus
IGEHGDTELAVWSQANVAGISVY

SEQ ID NO: 1660590 - protein, 24 aa, Staphylococcus aureus
IGSALINISIEWAKHKNLHGLMLE

SEQ ID NO: 1660591 - protein, 20 aa, Staphylococcus aureus
IGSFLLSESGYKIFVHESER

SEQ ID NO: 1660592 - protein, 19 aa, Staphylococcus aureus
IGSIFISHEEICFIRKEED

SEQ ID NO: 1660593 - protein, 17 aa, Staphylococcus aureus
IHACWLANIEIAMINTR

SEQ ID NO: 1660594 - protein, 17 aa, Staphylococcus aureus
IHLFRKGITMSEIADLI

SEQ ID NO: 1660595 - protein, 26 aa, Staphylococcus aureus
IINDWSDIIEVFGLKNEKLMSIHFGQ

SEQ ID NO: 1660596 - protein, 18 aa, Staphylococcus aureus
IIYKDLITWIDMLQDGSG

SEQ ID NO: 1660597 - protein, 26 aa, Staphylococcus aureus
IIYVKLGVNVGREFSGNHFCMVLNNH

SEQ ID NO: 1660598 - protein, 24 aa, Staphylococcus aureus
IKAIYKRDYLCILGQTVHDKLGHE

SEQ ID NO: 1660599 - protein, 17 aa, Staphylococcus aureus
IKKVLKSKFNQIFIFTH

SEQ ID NO: 1660600 - protein, 20 aa, Staphylococcus aureus
IKLFKGNAIVNGRKSPYTLY

SEQ ID NO: 1660601 - protein, 20 aa, Staphylococcus aureus
IKPKKIMLVAGHGYNDPGAV

SEQ ID NO: 1660602 - protein, 26 aa, Staphylococcus aureus
IKSLAIKFDIEYVLKECNRIEKEALT

SEQ ID NO: 1660603 - protein, 24 aa, Staphylococcus aureus
IKSYKESFEYRSLEKLAEVEQTQM

SEQ ID NO: 1660604 - protein, 21 aa, Staphylococcus aureus
IKTLKRRVMELKKENKKLQNQ

SEQ ID NO: 1660605 - protein, 21 aa, Staphylococcus aureus
ILEVIRCGFIDGNILIPQGVI

SEQ ID NO: 1660606 - protein, 25 aa, Staphylococcus aureus
ILPFILRGIKLIGIDSVYVDHNIRE

SEQ ID NO: 1660607 - protein, 18 aa, Staphylococcus aureus
ILSPEKELVVLTRLNEKE

SEQ ID NO: 1660608 - protein, 18 aa, Staphylococcus aureus
ILTGFGVDVIENVILTRK

SEQ ID NO: 1660609 - protein, 20 aa, Staphylococcus aureus
ILVLRLGGEYTVKRVRRTET

SEQ ID NO: 1660610 - protein, 23 aa, Staphylococcus aureus
IMTFEEIEEAWKQSQMVYNGVFK

SEQ ID NO: 1660611 - protein, 23 aa, Staphylococcus aureus
INELRLKSIRKIVKRINTWGDEV

SEQ ID NO: 1660612 - protein, 18 aa, Staphylococcus aureus
INIIKLAIDQNIPYTVLR

SEQ ID NO: 1660613 - protein, 27 aa, Staphylococcus aureus
INITLDMDGRIPINVWTGDSIARSGKG

SEQ ID NO: 1660614 - protein, 27 aa, Staphylococcus aureus
INKDEFCPLRKLILNNKLDSQRVMEVD

SEQ ID NO: 1660615 - protein, 21 aa, Staphylococcus aureus
INKIDEFNGFMIITNSNSNNK

SEQ ID NO: 1660616 - protein, 17 aa, Staphylococcus aureus
INTRLGYDLNEQVINMF

SEQ ID NO: 1660617 - protein, 20 aa, Staphylococcus aureus
INVYLPGARIRFMRYEGTKE

SEQ ID NO: 1660618 - protein, 22 aa, Staphylococcus aureus
IPDYEVIPGVFLQKEPDNPYDE

SEQ ID NO: 1660619 - protein, 25 aa, Staphylococcus aureus
IPLTSKSKHNAFVNIHLIKPFLNTL

SEQ ID NO: 1660620 - protein, 21 aa, Staphylococcus aureus
IPQAYQILGIGPVELRVRNAA

SEQ ID NO: 1660621 - protein, 26 aa, Staphylococcus aureus
IPVPGSTLPSVIGWRTLDDTEQMMNI

SEQ ID NO: 1660622 - protein, 24 aa, Staphylococcus aureus
IQKRFTLNMLYPYIDEILITKSKT

SEQ ID NO: 1660623 - protein, 27 aa, Staphylococcus aureus
IQQWCQKFNIALTIKKKQGIIVDGTDN

SEQ ID NO: 1660624 - protein, 17 aa, Staphylococcus aureus
IQSSYGITINKNFNIDS

SEQ ID NO: 1660625 - protein, 19 aa, Staphylococcus aureus
IRGLSPWPVAYTTMDDTNL

SEQ ID NO: 1660626 - protein, 18 aa, Staphylococcus aureus
ISAGMPIYTEENLIDYIY

SEQ ID NO: 1660627 - protein, 28 aa, Staphylococcus aureus
ISPYKGILRVGAATGFVVGKNTILTNRH

SEQ ID NO: 1660628 - protein, 19 aa, Staphylococcus aureus
ITEVELLMHYNPKVINSKI

SEQ ID NO: 1660629 - protein, 22 aa, Staphylococcus aureus
ITKLKKGGHFPKNLDYIESYTD

SEQ ID NO: 1660630 - protein, 18 aa, Staphylococcus aureus
ITLFKKRNSGIYFYNRGY

SEQ ID NO: 1660631 - protein, 24 aa, Staphylococcus aureus
ITNERIKKEMIDDLNSIIDDFFME

SEQ ID NO: 1660632 - protein, 23 aa, Staphylococcus aureus
ITVELKEKGMFVIKKKDDKAYKC

SEQ ID NO: 1660633 - protein, 24 aa, Staphylococcus aureus
ITYKRKTYHIGWSKNIYETALMFN

SEQ ID NO: 1660634 - protein, 19 aa, Staphylococcus aureus
IVVNMFLYLPNFFQNQNSE

SEQ ID NO: 1660635 - protein, 29 aa, Staphylococcus aureus
IYSQRKIDVEPVFGFMKAILGFTRMSVRG

SEQ ID NO: 1660636 - protein, 21 aa, Staphylococcus aureus
KAVTHCHGWGFAHLQMAPKHW

SEQ ID NO: 1660637 - protein, 21 aa, Staphylococcus aureus
KAYFEKCLPGYTLINKLHPSI

SEQ ID NO: 1660638 - protein, 17 aa, Staphylococcus aureus
KCLEDFKLVVSTSQYEG

SEQ ID NO: 1660639 - protein, 20 aa, Staphylococcus aureus
KDFIKARWNQDFRLEDFKKV

SEQ ID NO: 1660640 - protein, 17 aa, Staphylococcus aureus
KDFKVEFENEALSKKFI

SEQ ID NO: 1660641 - protein, 19 aa, Staphylococcus aureus
KDGFVFGGYIDWPSFVDYE

SEQ ID NO: 1660642 - protein, 24 aa, Staphylococcus aureus
KDILPLRIILGSVNLYGILSTNHL

SEQ ID NO: 1660643 - protein, 21 aa, Staphylococcus aureus
KDINNYDWLSGIGSLPSLINH

SEQ ID NO: 1660644 - protein, 25 aa, Staphylococcus aureus
KDSSGLPHEHFTAARDNQTFTVVEA

SEQ ID NO: 1660645 - protein, 18 aa, Staphylococcus aureus
KEAIKFSSVDFPDPDSPI

SEQ ID NO: 1660646 - protein, 21 aa, Staphylococcus aureus
KEFALITGAALLARRRTKNEK

SEQ ID NO: 1660647 - protein, 18 aa, Staphylococcus aureus
KEFYEHIAQLMFNISNKA

SEQ ID NO: 1660648 - protein, 24 aa, Staphylococcus aureus
KEGIELDEAVGIMTGQVVYKYEEE

SEQ ID NO: 1660649 - protein, 18 aa, Staphylococcus aureus
KEILPYLYKGLRDKSPAV

SEQ ID NO: 1660650 - protein, 18 aa, Staphylococcus aureus
KEINSYCMSQKYGSNQKG

SEQ ID NO: 1660651 - protein, 21 aa, Staphylococcus aureus
KEQQARITLYLKHNTKEPNTI

SEQ ID NO: 1660652 - protein, 35 aa, Staphylococcus aureus
KESDIKIRVENVLKICGLYAFRNWPIVALSYGQKK

SEQ ID NO: 1660653 - protein, 19 aa, Staphylococcus aureus
KESLGFDRDTNWLSVLPIY

SEQ ID NO: 1660654 - protein, 24 aa, Staphylococcus aureus
KESMLNKKQLKMFAIHNNIQSLKD

SEQ ID NO: 1660655 - protein, 24 aa, Staphylococcus aureus
KFREKTRIGRFFNITNWYEEIHST

SEQ ID NO: 1660656 - protein, 20 aa, Staphylococcus aureus
KFSLKLQENLILKALEKMKT

SEQ ID NO: 1660657 - protein, 26 aa, Staphylococcus aureus
KFVSRNALIEKCWESEHFIDDNTLAV

SEQ ID NO: 1660658 - protein, 20 aa, Staphylococcus aureus
KGAQHVLDLLGLATLSLLDT

SEQ ID NO: 1660659 - protein, 17 aa, Staphylococcus aureus
KGFDIILRDSETCNMWI

SEQ ID NO: 1660660 - protein, 25 aa, Staphylococcus aureus
KGFIGELLVNVLVRIFLKNFSIVSP

SEQ ID NO: 1660661 - protein, 18 aa, Staphylococcus aureus
KGKIELESWGIWRVVEPQ

SEQ ID NO: 1660662 - protein, 20 aa, Staphylococcus aureus
KGTFKPYGSAYGHGVSGVNM

SEQ ID NO: 1660663 - protein, 17 aa, Staphylococcus aureus
KHGRKSYQYDWFYHSKA

SEQ ID NO: 1660664 - protein, 18 aa, Staphylococcus aureus
KHGTIRLLFKYRHKKKNE

SEQ ID NO: 1660665 - protein, 26 aa, Staphylococcus aureus
KHNIKKYNIIPAWVLFQNFSFGDLST

SEQ ID NO: 1660666 - protein, 25 aa, Staphylococcus aureus
KILKENRYDFVIVWGSYTGHLFKSF

SEQ ID NO: 1660667 - protein, 24 aa, Staphylococcus aureus
KIMKDIKQSITMRNNEAIVDNILK

SEQ ID NO: 1660668 - protein, 17 aa, Staphylococcus aureus
KINDVATKHAWFVEDRF

SEQ ID NO: 1660669 - protein, 19 aa, Staphylococcus aureus
KIRPNLGRKIYINYHKKRK

SEQ ID NO: 1660670 - protein, 22 aa, Staphylococcus aureus
KISEYPTYIMLRKQRFKCKTCE

SEQ ID NO: 1660671 - protein, 25 aa, Staphylococcus aureus
KIVSAAIIDWLVRHSKVFKITGESY

SEQ ID NO: 1660672 - protein, 22 aa, Staphylococcus aureus
KKEVLKKVSLDLDIKRIVNSLS

SEQ ID NO: 1660673 - protein, 17 aa, Staphylococcus aureus
KKIVICASTGNTSASAA

SEQ ID NO: 1660674 - protein, 17 aa, Staphylococcus aureus
KKLRFASFAEVDSTLQG

SEQ ID NO: 1660675 - protein, 25 aa, Staphylococcus aureus
KKNYRPETRHAFLAINAARTITEFL

SEQ ID NO: 1660676 - protein, 21 aa, Staphylococcus aureus
KKWLEEDIDVIITTGGTGIAQ

SEQ ID NO: 1660677 - protein, 20 aa, Staphylococcus aureus
KKYQPIEVILRQNCDKCGHQ

SEQ ID NO: 1660678 - protein, 19 aa, Staphylococcus aureus
KLKPFGFFDYNALQKDAFV

SEQ ID NO: 1660679 - protein, 19 aa, Staphylococcus aureus
KLLHDSIRMMWLAQNQTPS

SEQ ID NO: 1660680 - protein, 20 aa, Staphylococcus aureus
KLSDGSIISLIDFVVKPIHL

SEQ ID NO: 1660681 - protein, 20 aa, Staphylococcus aureus
KLYECNELYIIKYISKKLIS

SEQ ID NO: 1660682 - protein, 19 aa, Staphylococcus aureus
KMFVDEGYRNLKIGKKLLD

SEQ ID NO: 1660683 - protein, 20 aa, Staphylococcus aureus
KMIISGLWTHFGYADEFDVS

SEQ ID NO: 1660684 - protein, 25 aa, Staphylococcus aureus
KMKQWKPSYIDRGFLFTTSKGNPLQ

SEQ ID NO: 1660685 - protein, 20 aa, Staphylococcus aureus
KMQRSACTTCGDVPSYPYLN

SEQ ID NO: 1660686 - protein, 24 aa, Staphylococcus aureus
KMYQMHEAIIRFLDNHIIVAHNTS

SEQ ID NO: 1660687 - protein, 24 aa, Staphylococcus aureus
KNEFGIEVKDYFIDLDLLQLINSV

SEQ ID NO: 1660688 - protein, 25 aa, Staphylococcus aureus
KNFDEVYILYKFDRYLLKQLFSLVN

SEQ ID NO: 1660689 - protein, 18 aa, Staphylococcus aureus
KNKPLYRATFKCTVIQST

SEQ ID NO: 1660690 - protein, 20 aa, Staphylococcus aureus
KNNHFFKLAYFRKNFEKKNG

SEQ ID NO: 1660691 - protein, 23 aa, Staphylococcus aureus
KNNRFVEKVSIEKAIVRHDERVK

SEQ ID NO: 1660692 - protein, 24 aa, Staphylococcus aureus
KNPDRRVAQQNAFYNVLKNDNLTE

SEQ ID NO: 1660693 - protein, 20 aa, Staphylococcus aureus
KPNFDKLVEETKKAVKEADE

SEQ ID NO: 1660694 - protein, 22 aa, Staphylococcus aureus
KPRGLFRKKKFSPVVGDIVEFD

SEQ ID NO: 1660695 - protein, 17 aa, Staphylococcus aureus
KPRNEIIREYDLTPSAL

SEQ ID NO: 1660696 - protein, 18 aa, Staphylococcus aureus
KPSVEWERKAEQAVLSDD

SEQ ID NO: 1660697 - protein, 22 aa, Staphylococcus aureus
KRSIDSSKVYQLRQQRMDVEKQ

SEQ ID NO: 1660698 - protein, 18 aa, Staphylococcus aureus
KSDERIKDAVQEAEKLAK

SEQ ID NO: 1660699 - protein, 22 aa, Staphylococcus aureus
KSMNRPELQRMLKDAKEGNIDC

SEQ ID NO: 1660700 - protein, 18 aa, Staphylococcus aureus
KVAELLLERAKRLVEIGE

SEQ ID NO: 1660701 - protein, 18 aa, Staphylococcus aureus
KVALSSMSPLLFPPSKQD

SEQ ID NO: 1660702 - protein, 19 aa, Staphylococcus aureus
KVIAPFNGLVSMIVPTKHA

SEQ ID NO: 1660703 - protein, 20 aa, Staphylococcus aureus
KVIEIPEGFEVIADSPSTDY

SEQ ID NO: 1660704 - protein, 19 aa, Staphylococcus aureus
KVIPYAGSADLAIVEVEED

SEQ ID NO: 1660705 - protein, 17 aa, Staphylococcus aureus
KVKEVYKDYELLNYTIK

SEQ ID NO: 1660706 - protein, 20 aa, Staphylococcus aureus
KVNDLILRQCNKFISKNSIE

SEQ ID NO: 1660707 - protein, 35 aa, Staphylococcus aureus
KVQQLHANPVKKPAGKKELDQAAADKKTQIEQTPN

SEQ ID NO: 1660708 - protein, 18 aa, Staphylococcus aureus
KYIDELFKKLNVQKLLIH

SEQ ID NO: 1660709 - protein, 24 aa, Staphylococcus aureus
KYKVGELYPAEGYNNPRVELLTNQ

SEQ ID NO: 1660710 - protein, 24 aa, Staphylococcus aureus
KYLLQNGKWGYFNREFFDLLNDHL

SEQ ID NO: 1660711 - protein, 26 aa, Staphylococcus aureus
KYNGQRKSLAWEYISTLNLEDEAEFS

SEQ ID NO: 1660712 - protein, 24 aa, Staphylococcus aureus
KYSFSTKQMVEFLGIESLKKHLKN

SEQ ID NO: 1660713 - protein, 23 aa, Staphylococcus aureus
KYSHNLYILKEFTTTKVKMLTEN

SEQ ID NO: 1660714 - protein, 19 aa, Staphylococcus aureus
LAMTDCLNYGSPEKKEIYQ

SEQ ID NO: 1660715 - protein, 17 aa, Staphylococcus aureus
LDEAVGIMTGQVVYKYE

SEQ ID NO: 1660716 - protein, 19 aa, Staphylococcus aureus
LDGAPAYFSNLPVKAMTKS

SEQ ID NO: 1660717 - protein, 20 aa, Staphylococcus aureus
LDIKTLEALEMFMNKYPGII

SEQ ID NO: 1660718 - protein, 26 aa, Staphylococcus aureus
LDYLKDFGIDVIWLSPMFKSPNDDNG

SEQ ID NO: 1660719 - protein, 17 aa, Staphylococcus aureus
LEAYQLMTTKEGVFSEP

SEQ ID NO: 1660720 - protein, 22 aa, Staphylococcus aureus
LENDELWPRHATMIHGDLHPGH

SEQ ID NO: 1660721 - protein, 22 aa, Staphylococcus aureus
LENLYALPFKERKIIKSEYYDL

SEQ ID NO: 1660722 - protein, 18 aa, Staphylococcus aureus
LESARARGNMGGRKAMPQ

SEQ ID NO: 1660723 - protein, 22 aa, Staphylococcus aureus
LESQHAGLSWLTILKKKEAYEE

SEQ ID NO: 1660724 - protein, 17 aa, Staphylococcus aureus
LFHLFAAFAEFERNLIL

SEQ ID NO: 1660725 - protein, 18 aa, Staphylococcus aureus
LFQFCDSQFPTGAFSHSF

SEQ ID NO: 1660726 - protein, 20 aa, Staphylococcus aureus
LGCRKLIDYEGIFAGGSTGS

SEQ ID NO: 1660727 - protein, 18 aa, Staphylococcus aureus
LGEVIEENGLRMHATNLG

SEQ ID NO: 1660728 - protein, 20 aa, Staphylococcus aureus
LGMKQRLGIARALLHNPELL

SEQ ID NO: 1660729 - protein, 20 aa, Staphylococcus aureus
LKDRSAWDATMYSFGTIPRG

SEQ ID NO: 1660730 - protein, 18 aa, Staphylococcus aureus
LKEELLYEDKVYEIPDYE

SEQ ID NO: 1660731 - protein, 25 aa, Staphylococcus aureus
LKGIYQFALNYVFDIKIIPELLRIV

SEQ ID NO: 1660732 - protein, 34 aa, Staphylococcus aureus
LKGMVGAISRFYPKARFQHCCVHVSRNISHKVRV

SEQ ID NO: 1660733 - protein, 21 aa, Staphylococcus aureus
LKGTFKPYGSAYGHGVSGVNM

SEQ ID NO: 1660734 - protein, 21 aa, Staphylococcus aureus
LKIADVCIASLIKEGVGLGVP

SEQ ID NO: 1660735 - protein, 21 aa, Staphylococcus aureus
LKINHAFECVGGKGSQVALQQ

SEQ ID NO: 1660736 - protein, 22 aa, Staphylococcus aureus
LKLKMKEAFVEKAVAINDISDK

SEQ ID NO: 1660737 - protein, 20 aa, Staphylococcus aureus
LKNILKYYYGTLIIVSHDRA

SEQ ID NO: 1660738 - protein, 23 aa, Staphylococcus aureus
LKNSHGIALLPEFIVADELENKS

SEQ ID NO: 1660739 - protein, 20 aa, Staphylococcus aureus
LKPIKGDNIFVWQGDITTLK

SEQ ID NO: 1660740 - protein, 25 aa, Staphylococcus aureus
LKQKIKCPCCNATLTNMTIRKKNHT

SEQ ID NO: 1660741 - protein, 20 aa, Staphylococcus aureus
LKSIDRNGALEGIGKPEKLK

SEQ ID NO: 1660742 - protein, 22 aa, Staphylococcus aureus
LLADIKSRFGLYKKAIPDLDNL

SEQ ID NO: 1660743 - protein, 18 aa, Staphylococcus aureus
LLGEDEMDDDDDIPAQTD

SEQ ID NO: 1660744 - protein, 18 aa, Staphylococcus aureus
LLHDSIRMMWLAQNQTPS

SEQ ID NO: 1660745 - protein, 24 aa, Staphylococcus aureus
LLQRQFKASCPMEVLTTDITYLPF

SEQ ID NO: 1660746 - protein, 20 aa, Staphylococcus aureus
LLQTELEIMKGYEEISLRDC

SEQ ID NO: 1660747 - protein, 17 aa, Staphylococcus aureus
LLRCHVNDYIVYSFALL

SEQ ID NO: 1660748 - protein, 28 aa, Staphylococcus aureus
LLSKTLNVGEAWLMGYDVDSYRVPDEER

SEQ ID NO: 1660749 - protein, 24 aa, Staphylococcus aureus
LLTIIYLRKSWKIENLLKKIDNLF

SEQ ID NO: 1660750 - protein, 25 aa, Staphylococcus aureus
LLTKTGEVWAYYRVRSESISTANYD

SEQ ID NO: 1660751 - protein, 17 aa, Staphylococcus aureus
LMHYHKRITDKQWEDAK

SEQ ID NO: 1660752 - protein, 21 aa, Staphylococcus aureus
LNANLKSIEQVRAFEKQQLES

SEQ ID NO: 1660753 - protein, 17 aa, Staphylococcus aureus
LNDAIKILNEYDGINVS

SEQ ID NO: 1660754 - protein, 21 aa, Staphylococcus aureus
LNKLLHEARLQRKVNKQWVLY

SEQ ID NO: 1660755 - protein, 21 aa, Staphylococcus aureus
LPKIEAAIRFVESGENKKVII

SEQ ID NO: 1660756 - protein, 18 aa, Staphylococcus aureus
LPLEIYVELVYSIQQEMV

SEQ ID NO: 1660757 - protein, 23 aa, Staphylococcus aureus
LPNRTKLLGVGLWLVPKPVRNFG

SEQ ID NO: 1660758 - protein, 18 aa, Staphylococcus aureus
LPSTPSRQAVAMPASDVI

SEQ ID NO: 1660759 - protein, 27 aa, Staphylococcus aureus
LQEEYNKRLKEELSRRMKQKEKEKQEA

SEQ ID NO: 1660760 - protein, 18 aa, Staphylococcus aureus
LQENLILKALEKMKTDHK

SEQ ID NO: 1660761 - protein, 22 aa, Staphylococcus aureus
LQGEIVQGPDFLTMEQNRPSLS

SEQ ID NO: 1660762 - protein, 18 aa, Staphylococcus aureus
LQNVFWRAIEKKKSNDNV

SEQ ID NO: 1660763 - protein, 19 aa, Staphylococcus aureus
LQPKFELQPKFGKQRPITY

SEQ ID NO: 1660764 - protein, 18 aa, Staphylococcus aureus
LRDLELEFSVGKNYLDTT

SEQ ID NO: 1660765 - protein, 25 aa, Staphylococcus aureus
LRKLNLKWYAVPIISNMDLKIGGIV

SEQ ID NO: 1660766 - protein, 17 aa, Staphylococcus aureus
LRTTGGRYLLKSHDIEI

SEQ ID NO: 1660767 - protein, 17 aa, Staphylococcus aureus
LSARGVKFYEGIKLSEN

SEQ ID NO: 1660768 - protein, 22 aa, Staphylococcus aureus
LSFKYMDRILLNWKKNNVKTID

SEQ ID NO: 1660769 - protein, 34 aa, Staphylococcus aureus
LSGWKFKRNKEMICTNYWCTGSIGIALSLSHLVS

SEQ ID NO: 1660770 - protein, 29 aa, Staphylococcus aureus
LSKGYNMSGFRVGFAVGNKDMIQALKKYQ

SEQ ID NO: 1660771 - protein, 17 aa, Staphylococcus aureus
LSLYIWGCNILNTEKLE

SEQ ID NO: 1660772 - protein, 17 aa, Staphylococcus aureus
LSNMAPTIVMYHGKPIL

SEQ ID NO: 1660773 - protein, 17 aa, Staphylococcus aureus
LSVLEGKTAVIGDDVPV

SEQ ID NO: 1660774 - protein, 31 aa, Staphylococcus aureus
LTDLRSLNIGHLYAYQFEKIALIGGNGTGKT

SEQ ID NO: 1660775 - protein, 17 aa, Staphylococcus aureus
LTHHIVRKSLTYLEEHM

SEQ ID NO: 1660776 - protein, 20 aa, Staphylococcus aureus
LTLSCRMEIDDSGRVVKHEI

SEQ ID NO: 1660777 - protein, 18 aa, Staphylococcus aureus
LTPPRQENVLNYANEQLE

SEQ ID NO: 1660778 - protein, 22 aa, Staphylococcus aureus
LTRAKEQLYLIGRVKNDKSLLE

SEQ ID NO: 1660779 - protein, 22 aa, Staphylococcus aureus
LTYKLEAFRGKVILVVNTATEC

SEQ ID NO: 1660780 - protein, 24 aa, Staphylococcus aureus
LVELGKGMTLLPMAFENKSDIVQE

SEQ ID NO: 1660781 - protein, 17 aa, Staphylococcus aureus
LWLHIKLDTGMGRLGIK

SEQ ID NO: 1660782 - protein, 19 aa, Staphylococcus aureus
LWQEIESFDDDKIKGLLEV

SEQ ID NO: 1660783 - protein, 20 aa, Staphylococcus aureus
LYAECIRLFHSIDISDCPYT

SEQ ID NO: 1660784 - protein, 18 aa, Staphylococcus aureus
LYEFKSLTDYPAKINSND

SEQ ID NO: 1660785 - protein, 21 aa, Staphylococcus aureus
LYMSKICSYAQGFAQMRKASE

SEQ ID NO: 1660786 - protein, 23 aa, Staphylococcus aureus
LYPHQRYAIDLVIKENHKTYKNQ

SEQ ID NO: 1660787 - protein, 18 aa, Staphylococcus aureus
LYQTVKYWPKGTVFVSVV

SEQ ID NO: 1660788 - protein, 20 aa, Staphylococcus aureus
MAVATWKVWKIEKNTRFKLR

SEQ ID NO: 1660789 - protein, 18 aa, Staphylococcus aureus
MCDLKILKEKFEDLKDNH

SEQ ID NO: 1660790 - protein, 28 aa, Staphylococcus aureus
MDASEFRNYILGLIFYCFLSEKAEQEYA

SEQ ID NO: 1660791 - protein, 21 aa, Staphylococcus aureus
MDLMNAFYLLDAVNIPIGIVR

SEQ ID NO: 1660792 - protein, 20 aa, Staphylococcus aureus
MDLPLKEFALITGAALLARR

SEQ ID NO: 1660793 - protein, 23 aa, Staphylococcus aureus
MGAKINASAILYRMDKLDGTNEF

SEQ ID NO: 1660794 - protein, 23 aa, Staphylococcus aureus
MHLANPKLPFGGVGASGMGRYHG

SEQ ID NO: 1660795 - protein, 24 aa, Staphylococcus aureus
MIGVLKAGGAYVPIDTNYPSDRQE

SEQ ID NO: 1660796 - protein, 22 aa, Staphylococcus aureus
MKQGKTILKNISWQINGGDKWI

SEQ ID NO: 1660797 - protein, 24 aa, Staphylococcus aureus
MLQDGHVWVGYTWEGQRYYLPIRT

SEQ ID NO: 1660798 - protein, 24 aa, Staphylococcus aureus
MNPVELRRSIGYVIQQIGLMPHMT

SEQ ID NO: 1660799 - protein, 18 aa, Staphylococcus aureus
MSFDTMVLFGDHAASPHG

SEQ ID NO: 1660800 - protein, 25 aa, Staphylococcus aureus
MSNLASLDLYAPVRNITSSRDIHPI

SEQ ID NO: 1660801 - protein, 18 aa, Staphylococcus aureus
MTKAIQFADIYLMALPTK

SEQ ID NO: 1660802 - protein, 22 aa, Staphylococcus aureus
MVAKRVRGGWALLEALNAPYGM

SEQ ID NO: 1660803 - protein, 23 aa, Staphylococcus aureus
MVKEAGYELNVWTVNKPARANQL

SEQ ID NO: 1660804 - protein, 17 aa, Staphylococcus aureus
NAAKDVWINGFTPQYTM

SEQ ID NO: 1660805 - protein, 18 aa, Staphylococcus aureus
NAAKDVWINGFTPQYTMS

SEQ ID NO: 1660806 - protein, 21 aa, Staphylococcus aureus
NAKVRRLVEEFDYEADSYIRK

SEQ ID NO: 1660807 - protein, 22 aa, Staphylococcus aureus
NARKEYLNQFFGSKRYLYQDNE

SEQ ID NO: 1660808 - protein, 26 aa, Staphylococcus aureus
NDHLPKYMIPKTITYIDCIPLTTNDK

SEQ ID NO: 1660809 - protein, 22 aa, Staphylococcus aureus
NDSRGSFPLLTKVLDANDKLSV

SEQ ID NO: 1660810 - protein, 24 aa, Staphylococcus aureus
NEKEEPRLSTAKILAEYFNVKIND

SEQ ID NO: 1660811 - protein, 24 aa, Staphylococcus aureus
NEQRSSICSIALLKFQDNKMRDAI

SEQ ID NO: 1660812 - protein, 17 aa, Staphylococcus aureus
NESFTGVEFFNTVFKGT

SEQ ID NO: 1660813 - protein, 19 aa, Staphylococcus aureus
NFDEACYVMNTIAPEHASI

SEQ ID NO: 1660814 - protein, 18 aa, Staphylococcus aureus
NFIGHTFAVYDGRKHVPV

SEQ ID NO: 1660815 - protein, 18 aa, Staphylococcus aureus
NFKYGVFGQNGFIKKSAN

SEQ ID NO: 1660816 - protein, 21 aa, Staphylococcus aureus
NGDLFLLLAKENWHEGVLGIV

SEQ ID NO: 1660817 - protein, 17 aa, Staphylococcus aureus
NGKHDIEQLNALNNAQQ

SEQ ID NO: 1660818 - protein, 23 aa, Staphylococcus aureus
NHLHNRILLCSNFTLQKGKKKLS

SEQ ID NO: 1660819 - protein, 18 aa, Staphylococcus aureus
NISLKAIMKRVGHTDEKT

SEQ ID NO: 1660820 - protein, 27 aa, Staphylococcus aureus
NISWQINGGDKWILYGLNGAGKTTLLN

SEQ ID NO: 1660821 - protein, 22 aa, Staphylococcus aureus
NKLGGQLFRNTTFPDEKYLKEL

SEQ ID NO: 1660822 - protein, 26 aa, Staphylococcus aureus
NKRKFPTTRTLFLLLLGFKNSKINDQ

SEQ ID NO: 1660823 - protein, 22 aa, Staphylococcus aureus
NMAEKILPLPHIIDIPKRVFAK

SEQ ID NO: 1660824 - protein, 18 aa, Staphylococcus aureus
NMINEIINSFLVTKLSQE

SEQ ID NO: 1660825 - protein, 21 aa, Staphylococcus aureus
NNIRLLKDYGVSIYPANISES

SEQ ID NO: 1660826 - protein, 23 aa, Staphylococcus aureus
NNISPCSGVICGMGESNQDIVDM

SEQ ID NO: 1660827 - protein, 19 aa, Staphylococcus aureus
NNITSIGYQQRWARPTRNT

SEQ ID NO: 1660828 - protein, 18 aa, Staphylococcus aureus
NNKIWYKNINTIIDSHYS

SEQ ID NO: 1660829 - protein, 27 aa, Staphylococcus aureus
NNYYYRYGQIMGICYLLNASDIHFENI

SEQ ID NO: 1660830 - protein, 20 aa, Staphylococcus aureus
NPIKKLPTRFTINVAIGNFE

SEQ ID NO: 1660831 - protein, 18 aa, Staphylococcus aureus
NQDGTVSYGARPTQNKPS

SEQ ID NO: 1660832 - protein, 33 aa, Staphylococcus aureus
NQQLEKSVECYEIYHPLESVGIYVPGGKASYPS

SEQ ID NO: 1660833 - protein, 17 aa, Staphylococcus aureus
NRGALRLTTQPEPYSFE

SEQ ID NO: 1660834 - protein, 23 aa, Staphylococcus aureus
NRPVFQEALNFVRMGDRFVVESI

SEQ ID NO: 1660835 - protein, 20 aa, Staphylococcus aureus
NSAHVTGCRLLKKPHIKQYI

SEQ ID NO: 1660836 - protein, 22 aa, Staphylococcus aureus
NSERYGAVYLVNLFSNIRTPEN

SEQ ID NO: 1660837 - protein, 26 aa, Staphylococcus aureus
NSIFYALSVLKMFKKSVIDKNKIKFK

SEQ ID NO: 1660838 - protein, 23 aa, Staphylococcus aureus
NSITRPSFRVPNDDALTYYEQRF

SEQ ID NO: 1660839 - protein, 20 aa, Staphylococcus aureus
NTILFNDFFTGHQWYNDLLV

SEQ ID NO: 1660840 - protein, 20 aa, Staphylococcus aureus
NTIMPRKSRASLQKIKQKWL

SEQ ID NO: 1660841 - protein, 24 aa, Staphylococcus aureus
NVNGCVSAGVGERLHGETLFTEMV

SEQ ID NO: 1660842 - protein, 23 aa, Staphylococcus aureus
NVVFRIKHEYKELLTSTERGKIE

SEQ ID NO: 1660843 - protein, 19 aa, Staphylococcus aureus
PAKGTTYKIYFGFADRHAY

SEQ ID NO: 1660844 - protein, 18 aa, Staphylococcus aureus
PDLHFTIIDFNQELLCIY

SEQ ID NO: 1660845 - protein, 18 aa, Staphylococcus aureus
PDLIRLNKTFLIESRELT

SEQ ID NO: 1660846 - protein, 25 aa, Staphylococcus aureus
PEHHYQFGGSLIKSKNLSTLLKPAH

SEQ ID NO: 1660847 - protein, 23 aa, Staphylococcus aureus
PEKHVKDFLNYDIENEKNKDIDL

SEQ ID NO: 1660848 - protein, 29 aa, Staphylococcus aureus
PESSQALGFGYRTGFLGMLHMEIIQERIE

SEQ ID NO: 1660849 - protein, 17 aa, Staphylococcus aureus
PETEEVMLHFLQQLEDD

SEQ ID NO: 1660850 - protein, 22 aa, Staphylococcus aureus
PGAKEMILIPHFVKVTNLTDLF

SEQ ID NO: 1660851 - protein, 17 aa, Staphylococcus aureus
PGSKEMILILDFTEATN

SEQ ID NO: 1660852 - protein, 20 aa, Staphylococcus aureus
PHKLASCIDVANIDTPIKII

SEQ ID NO: 1660853 - protein, 17 aa, Staphylococcus aureus
PIEKVFDAYTTKELFEK

SEQ ID NO: 1660854 - protein, 19 aa, Staphylococcus aureus
PKANQAIDAKAQETKESID

SEQ ID NO: 1660855 - protein, 17 aa, Staphylococcus aureus
PKAYILEIASNWKKKGI

SEQ ID NO: 1660856 - protein, 25 aa, Staphylococcus aureus
PKHLSTIKVAPLFSEDDRHKIRHIV

SEQ ID NO: 1660857 - protein, 21 aa, Staphylococcus aureus
PKNPLCLFCPVQENCEAFDKG

SEQ ID NO: 1660858 - protein, 18 aa, Staphylococcus aureus
PKQIEDFNSNIEYNQTNP

SEQ ID NO: 1660859 - protein, 22 aa, Staphylococcus aureus
PKWKVHAKDLIAYPKLTGKPAA

SEQ ID NO: 1660860 - protein, 19 aa, Staphylococcus aureus
PNEEGLAFYDRIFDELIAQ

SEQ ID NO: 1660861 - protein, 18 aa, Staphylococcus aureus
PNKNLIYFESFHGKQYSD

SEQ ID NO: 1660862 - protein, 18 aa, Staphylococcus aureus
PNLSWRYLYLNPLLLVYE

SEQ ID NO: 1660863 - protein, 18 aa, Staphylococcus aureus
PNSITKYDPTKHNFKEKS

SEQ ID NO: 1660864 - protein, 19 aa, Staphylococcus aureus
PQDKCGIFFTYIVSEMSTE

SEQ ID NO: 1660865 - protein, 23 aa, Staphylococcus aureus
PQDKCGIFFTYRVSEMSTEQKQT

SEQ ID NO: 1660866 - protein, 21 aa, Staphylococcus aureus
PQFNKTPKYVKYRDAGTGIRE

SEQ ID NO: 1660867 - protein, 20 aa, Staphylococcus aureus
PQVYQILGIGPVELRVRNAA

SEQ ID NO: 1660868 - protein, 20 aa, Staphylococcus aureus
PRAHSIYLYEYYWSEAYKNY

SEQ ID NO: 1660869 - protein, 17 aa, Staphylococcus aureus
PRGQYILEVICGSYEDL

SEQ ID NO: 1660870 - protein, 25 aa, Staphylococcus aureus
PRLQPWDFAGGLVILYEVNGQASNL

SEQ ID NO: 1660871 - protein, 31 aa, Staphylococcus aureus
PSFKNAESKLTVAMGYRINNEPLLMDIAKTP

SEQ ID NO: 1660872 - protein, 26 aa, Staphylococcus aureus
PSSKGLAFCKALLIRLKDFYHEIDYK

SEQ ID NO: 1660873 - protein, 21 aa, Staphylococcus aureus
PSYKRTSCRLEVITKRGKSPL

SEQ ID NO: 1660874 - protein, 23 aa, Staphylococcus aureus
PTEKKGPSVLGIIEYQVQGKNEF

SEQ ID NO: 1660875 - protein, 17 aa, Staphylococcus aureus
PTKKTAFDNAITQAESY

SEQ ID NO: 1660876 - protein, 17 aa, Staphylococcus aureus
PVGPLSKIFLFKSNNAF

SEQ ID NO: 1660877 - protein, 18 aa, Staphylococcus aureus
PVPYSVAQIKSFGVPLTS

SEQ ID NO: 1660878 - protein, 19 aa, Staphylococcus aureus
PVVSKISAGMPIYTEENLI

SEQ ID NO: 1660879 - protein, 29 aa, Staphylococcus aureus
PYYYSFKRNNNRVCIPFRTNAQKVPNKYK

SEQ ID NO: 1660880 - protein, 21 aa, Staphylococcus aureus
QADGHTGVIAFEVKDTESAKQ

SEQ ID NO: 1660881 - protein, 22 aa, Staphylococcus aureus
QASQKLGVHYVQLDVTSDYSVK

SEQ ID NO: 1660882 - protein, 18 aa, Staphylococcus aureus
QDIKLIACTMSMDVMGIS

SEQ ID NO: 1660883 - protein, 18 aa, Staphylococcus aureus
QDLVCQTHPFSQLLHDAI

SEQ ID NO: 1660884 - protein, 35 aa, Staphylococcus aureus
QDNQLKPLPFISGYVGTCSFDLVRHEFPKLQSIQL

SEQ ID NO: 1660885 - protein, 20 aa, Staphylococcus aureus
QEINRLLVLNNIDVFQMRVI

SEQ ID NO: 1660886 - protein, 18 aa, Staphylococcus aureus
QELIEMMAKETWLNADEA

SEQ ID NO: 1660887 - protein, 23 aa, Staphylococcus aureus
QENFAISIGIYIDGKPYAGFVYD

SEQ ID NO: 1660888 - protein, 24 aa, Staphylococcus aureus
QFAKREVYNHYALSDIPLPKKTKF

SEQ ID NO: 1660889 - protein, 39 aa, Staphylococcus aureus
QFNIDLWYAFQCFDYANAGWKALFGLLLKGVGAKDIPFA

SEQ ID NO: 1660890 - protein, 23 aa, Staphylococcus aureus
QHQAKIISELDCLQSFAEIAQKY

SEQ ID NO: 1660891 - protein, 22 aa, Staphylococcus aureus
QIDALSNFGCEKIFSEKVSGRK

SEQ ID NO: 1660892 - protein, 18 aa, Staphylococcus aureus
QIEIAKKLGAKQVIIIED

SEQ ID NO: 1660893 - protein, 18 aa, Staphylococcus aureus
QINTRPRMIFDYKSSEEM

SEQ ID NO: 1660894 - protein, 19 aa, Staphylococcus aureus
QIVVPGEPKGTIYEASLII

SEQ ID NO: 1660895 - protein, 18 aa, Staphylococcus aureus
QKHQRLTNNITWADNRAA

SEQ ID NO: 1660896 - protein, 20 aa, Staphylococcus aureus
QLDFLLPERFDLTYIGQDGE

SEQ ID NO: 1660897 - protein, 19 aa, Staphylococcus aureus
QLNDLYCSRNLRYNEIAFK

SEQ ID NO: 1660898 - protein, 19 aa, Staphylococcus aureus
QLRKRYDIPTNKAPKLLLK

SEQ ID NO: 1660899 - protein, 18 aa, Staphylococcus aureus
QNKGVPVILDCSGATLQT

SEQ ID NO: 1660900 - protein, 27 aa, Staphylococcus aureus
QPGTETIYRFSLLVPNQAALHYFEKRL

SEQ ID NO: 1660901 - protein, 24 aa, Staphylococcus aureus
QRELGGAVLKHFDNISVNVKRPDH

SEQ ID NO: 1660902 - protein, 20 aa, Staphylococcus aureus
QRLTNNITWADNRAAKYATV

SEQ ID NO: 1660903 - protein, 17 aa, Staphylococcus aureus
QRRKIFALVKDIEEYTG

SEQ ID NO: 1660904 - protein, 18 aa, Staphylococcus aureus
QSEFVKEAIVVPVYKNDK

SEQ ID NO: 1660905 - protein, 22 aa, Staphylococcus aureus
QSGRYSYLFNKIYFLRISTLPL

SEQ ID NO: 1660906 - protein, 17 aa, Staphylococcus aureus
QSKGIPVVNAIELGNDE

SEQ ID NO: 1660907 - protein, 25 aa, Staphylococcus aureus
QSQFNLPTRYIWGIYEPQSDDQNMN

SEQ ID NO: 1660908 - protein, 17 aa, Staphylococcus aureus
QVVKLLWQVINDSMNGN

SEQ ID NO: 1660909 - protein, 18 aa, Staphylococcus aureus
QYGAVYLVNLFSNIKTPE

SEQ ID NO: 1660910 - protein, 24 aa, Staphylococcus aureus
RAAEEIKERLSLLSIDDDINIWVG

SEQ ID NO: 1660911 - protein, 17 aa, Staphylococcus aureus
RAAQGVRLIRLGDDQFV

SEQ ID NO: 1660912 - protein, 18 aa, Staphylococcus aureus
RAHSIYLYEYYWSEAYKN

SEQ ID NO: 1660913 - protein, 19 aa, Staphylococcus aureus
RAIKPSSYFMITKNDEDYF

SEQ ID NO: 1660914 - protein, 24 aa, Staphylococcus aureus
RDFLKKLMSNYSYYDSKGNIDLNE

SEQ ID NO: 1660915 - protein, 19 aa, Staphylococcus aureus
RDKIVKLAKALRVSPSYIM

SEQ ID NO: 1660916 - protein, 19 aa, Staphylococcus aureus
RDMPHVIDLETLFFNVIPR

SEQ ID NO: 1660917 - protein, 28 aa, Staphylococcus aureus
RDNHSAYTFIKRLIKQFGKPQMIITNQA

SEQ ID NO: 1660918 - protein, 19 aa, Staphylococcus aureus
REINKQIVYICYGNKINKT

SEQ ID NO: 1660919 - protein, 18 aa, Staphylococcus aureus
REKLEIMISDYNKKFETN

SEQ ID NO: 1660920 - protein, 21 aa, Staphylococcus aureus
REQYDKILLYSGNMGQLQDME

SEQ ID NO: 1660921 - protein, 17 aa, Staphylococcus aureus
RFAKEVSNNIVFIHEGM

SEQ ID NO: 1660922 - protein, 18 aa, Staphylococcus aureus
RGAAEGVIRRYLIEEKNY

SEQ ID NO: 1660923 - protein, 22 aa, Staphylococcus aureus
RKEAGSWSDWSELALNDYNTPF

SEQ ID NO: 1660924 - protein, 19 aa, Staphylococcus aureus
RKGYRGECDDKWEGLYSKV

SEQ ID NO: 1660925 - protein, 20 aa, Staphylococcus aureus
RKTKKWSAVIKIDSKSKYLG

SEQ ID NO: 1660926 - protein, 17 aa, Staphylococcus aureus
RLTHIALKLFETTDPVS

SEQ ID NO: 1660927 - protein, 19 aa, Staphylococcus aureus
RLYRPSLYERLGSDTNLSF

SEQ ID NO: 1660928 - protein, 24 aa, Staphylococcus aureus
RMKRAQKLFGQKIHVFDIRKHEMA

SEQ ID NO: 1660929 - protein, 35 aa, Staphylococcus aureus
RNIPREYLNPHIPKGRGIVKWNAFKTIPQQYEILE

SEQ ID NO: 1660930 - protein, 24 aa, Staphylococcus aureus
RNLDKGVAFGAMFSDSEDLMHQKN

SEQ ID NO: 1660931 - protein, 21 aa, Staphylococcus aureus
RNRIAHTDIIYGINFTNTCAK

SEQ ID NO: 1660932 - protein, 24 aa, Staphylococcus aureus
RNTGLKMSKAEYVFFLDSDDLLHE

SEQ ID NO: 1660933 - protein, 21 aa, Staphylococcus aureus
RPESLFNYFKQLFAQVTNPPI

SEQ ID NO: 1660934 - protein, 19 aa, Staphylococcus aureus
RPGSMIDKLMRYINRHVYK

SEQ ID NO: 1660935 - protein, 22 aa, Staphylococcus aureus
RPRMIFDYKSSEEMLKYHVSTQ

SEQ ID NO: 1660936 - protein, 21 aa, Staphylococcus aureus
RPYLKLAEPILEKHNIYYGQW

SEQ ID NO: 1660937 - protein, 17 aa, Staphylococcus aureus
RQCKLGWGPNIEKLDFQ

SEQ ID NO: 1660938 - protein, 17 aa, Staphylococcus aureus
RQDKRPMLSDMKESGGI

SEQ ID NO: 1660939 - protein, 21 aa, Staphylococcus aureus
RRGKSKFKGVYLTQSGYVAQI

SEQ ID NO: 1660940 - protein, 20 aa, Staphylococcus aureus
RRKEELNYRFTQPISDDYVK

SEQ ID NO: 1660941 - protein, 23 aa, Staphylococcus aureus
RRLEKPKGIMIRNAQTMSSVESL

SEQ ID NO: 1660942 - protein, 23 aa, Staphylococcus aureus
RRNRSKVRLALKRGTTVERSDRE

SEQ ID NO: 1660943 - protein, 20 aa, Staphylococcus aureus
RSEAPFKKALLYAPLYPIEV

SEQ ID NO: 1660944 - protein, 24 aa, Staphylococcus aureus
RSEEIKYYLAEAIKAEKAGKKVEM

SEQ ID NO: 1660945 - protein, 31 aa, Staphylococcus aureus
RTLSKAFGIAGLRLGVLISTAGTIQRIQKIE

SEQ ID NO: 1660946 - protein, 30 aa, Staphylococcus aureus
RVGAAKIALERAIEINDHVALVSDGFFPMG

SEQ ID NO: 1660947 - protein, 19 aa, Staphylococcus aureus
RVKQHANDLVRFVQQQLHK

SEQ ID NO: 1660948 - protein, 20 aa, Staphylococcus aureus
RYGAYNYFGIGAFDNDPDYA

SEQ ID NO: 1660949 - protein, 17 aa, Staphylococcus aureus
RYKAIVVSTEQQCQDIS

SEQ ID NO: 1660950 - protein, 18 aa, Staphylococcus aureus
SAEEQALFDKSVKILEDT

SEQ ID NO: 1660951 - protein, 24 aa, Staphylococcus aureus
SAIIAEHCLFELDAPIMRLAAPDV

SEQ ID NO: 1660952 - protein, 34 aa, Staphylococcus aureus
SAMIPYAAWQKFARPRFDNMISFNSTNDLLTWLQ

SEQ ID NO: 1660953 - protein, 25 aa, Staphylococcus aureus
SDFERWSFHLQIYFLAERFKEQKRM

SEQ ID NO: 1660954 - protein, 20 aa, Staphylococcus aureus
SDFGNAHFVVLSKYIKEYES

SEQ ID NO: 1660955 - protein, 18 aa, Staphylococcus aureus
SDFLKFRGLVDQYKEIEL

SEQ ID NO: 1660956 - protein, 17 aa, Staphylococcus aureus
SDLGCPYQRGSIENANG

SEQ ID NO: 1660957 - protein, 18 aa, Staphylococcus aureus
SDLGCPYQRGSIENVNGL

SEQ ID NO: 1660958 - protein, 18 aa, Staphylococcus aureus
SEGSIYPVLMRLNKKGYV

SEQ ID NO: 1660959 - protein, 17 aa, Staphylococcus aureus
SEIYELIDEINIDPYIF

SEQ ID NO: 1660960 - protein, 18 aa, Staphylococcus aureus
SEPFEVIGKIIPRYENEN

SEQ ID NO: 1660961 - protein, 27 aa, Staphylococcus aureus
SEVKELLQCFDYLIKHKRHATRKRNYE

SEQ ID NO: 1660962 - protein, 17 aa, Staphylococcus aureus
SFIIGRRQLTKGIDLEG

SEQ ID NO: 1660963 - protein, 18 aa, Staphylococcus aureus
SFTTYTITTVWGLGYKFE

SEQ ID NO: 1660964 - protein, 25 aa, Staphylococcus aureus
SGDCPYMEAPPCLTCNSGKPCKDLA

SEQ ID NO: 1660965 - protein, 22 aa, Staphylococcus aureus
SGFSLNGLKMFIGNKSIQTTTI

SEQ ID NO: 1660966 - protein, 26 aa, Staphylococcus aureus
SGKFKFKYLDDWLFTKSIIFKNETTL

SEQ ID NO: 1660967 - protein, 17 aa, Staphylococcus aureus
SGLDFQVAFGKDKHGVE

SEQ ID NO: 1660968 - protein, 27 aa, Staphylococcus aureus
SGNEICQEWLYHLGVPTDKIEDLAKHA

SEQ ID NO: 1660969 - protein, 24 aa, Staphylococcus aureus
SIERIVIELTKLMRGINVEESFNH

SEQ ID NO: 1660970 - protein, 26 aa, Staphylococcus aureus
SKGIQGWKDYKELMGKVELADYRFTK

SEQ ID NO: 1660971 - protein, 23 aa, Staphylococcus aureus
SKKFINKDIDIFAGNYGYGCHGG

SEQ ID NO: 1660972 - protein, 27 aa, Staphylococcus aureus
SKLYDFSPWKNKSFWGVINNTLETNET

SEQ ID NO: 1660973 - protein, 19 aa, Staphylococcus aureus
SLDGLPVVNLKSSNLKRGE

SEQ ID NO: 1660974 - protein, 26 aa, Staphylococcus aureus
SLHYRTRILIAGALEVQALTGMRIGE

SEQ ID NO: 1660975 - protein, 18 aa, Staphylococcus aureus
SLIKRVDICEDYINLVSL

SEQ ID NO: 1660976 - protein, 20 aa, Staphylococcus aureus
SLLALPKLGAINVHASLLPK

SEQ ID NO: 1660977 - protein, 19 aa, Staphylococcus aureus
SNAILPVRLDGATKEFFAW

SEQ ID NO: 1660978 - protein, 18 aa, Staphylococcus aureus
SNNYPIFIEHGAIDHIST

SEQ ID NO: 1660979 - protein, 29 aa, Staphylococcus aureus
SNYILKYVFANGIAREIIYDLLEEMDLRK

SEQ ID NO: 1660980 - protein, 25 aa, Staphylococcus aureus
SQGLLEGFKNLGFNTYFAVPKTPEE

SEQ ID NO: 1660981 - protein, 24 aa, Staphylococcus aureus
SQKLLTQVRFQIPYGKNIALVGAN

SEQ ID NO: 1660982 - protein, 22 aa, Staphylococcus aureus
SQRKIDVEPVFGFMKAILGFTR

SEQ ID NO: 1660983 - protein, 23 aa, Staphylococcus aureus
SRLFKLNKIFIIKEKVSLFKEEI

SEQ ID NO: 1660984 - protein, 20 aa, Staphylococcus aureus
SRNFSNKMINIFPKNEFYIH

SEQ ID NO: 1660985 - protein, 17 aa, Staphylococcus aureus
SSFSLTDLYLFIFNNSI

SEQ ID NO: 1660986 - protein, 20 aa, Staphylococcus aureus
SSPEMTLRYAKLLDDTKRKA

SEQ ID NO: 1660987 - protein, 18 aa, Staphylococcus aureus
SSVACIRVSVGVSAAGAS

SEQ ID NO: 1660988 - protein, 18 aa, Staphylococcus aureus
STKEPKSLILQGSYGTGK

SEQ ID NO: 1660989 - protein, 18 aa, Staphylococcus aureus
STSSFIPIDIPFIVDIEK

SEQ ID NO: 1660990 - protein, 18 aa, Staphylococcus aureus
SVVRLCVRYAEQLSVFEE

SEQ ID NO: 1660991 - protein, 26 aa, Staphylococcus aureus
SWGIWRVVEPQLHLTVVERKKEILEE

SEQ ID NO: 1660992 - protein, 24 aa, Staphylococcus aureus
SYCGPGRRKTFTFVNNRPLAALTE

SEQ ID NO: 1660993 - protein, 18 aa, Staphylococcus aureus
TAAARAFVHKPQIIFADE

SEQ ID NO: 1660994 - protein, 19 aa, Staphylococcus aureus
TADEIILTFVKGIPVQIDG

SEQ ID NO: 1660995 - protein, 17 aa, Staphylococcus aureus
TASRLFIPLTVGGGIQS

SEQ ID NO: 1660996 - protein, 17 aa, Staphylococcus aureus
TDDKFNKRYSVIFDGTA

SEQ ID NO: 1660997 - protein, 19 aa, Staphylococcus aureus
TDFMFFMSVVMTLLSRYAR

SEQ ID NO: 1660998 - protein, 17 aa, Staphylococcus aureus
TDIIYGINFTNTCAKHH

SEQ ID NO: 1660999 - protein, 20 aa, Staphylococcus aureus
TDLDYWKDGYIYSIQCYINK

SEQ ID NO: 1661000 - protein, 20 aa, Staphylococcus aureus
TDPHEIIGIIAGGQHAMTMA

SEQ ID NO: 1661001 - protein, 23 aa, Staphylococcus aureus
TEKGCSYREQLEKILYKYSFSTK

SEQ ID NO: 1661002 - protein, 18 aa, Staphylococcus aureus
TELDKCLDYLREGDTLVI

SEQ ID NO: 1661003 - protein, 18 aa, Staphylococcus aureus
TEYGELHLQIPRDRNGEF

SEQ ID NO: 1661004 - protein, 27 aa, Staphylococcus aureus
TFEHKGKMAFRVYPKWCNQLNKRAEQT

SEQ ID NO: 1661005 - protein, 19 aa, Staphylococcus aureus
THANGQVSYGARPTYKKPS

SEQ ID NO: 1661006 - protein, 20 aa, Staphylococcus aureus
THFPKKLTLRDIVRANERGI

SEQ ID NO: 1661007 - protein, 19 aa, Staphylococcus aureus
TIMCKLAGPQHRSWRKVSL

SEQ ID NO: 1661008 - protein, 18 aa, Staphylococcus aureus
TISIKYIFLRISTLPLSL

SEQ ID NO: 1661009 - protein, 17 aa, Staphylococcus aureus
TKHAWFVEDRFVKNELE

SEQ ID NO: 1661010 - protein, 17 aa, Staphylococcus aureus
TKLYVKPVLALKKEVSI

SEQ ID NO: 1661011 - protein, 24 aa, Staphylococcus aureus
TKSQLTIMYKLRMGPNTEKLDSQF

SEQ ID NO: 1661012 - protein, 17 aa, Staphylococcus aureus
TKYDVIKEIGEFSEHHF

SEQ ID NO: 1661013 - protein, 19 aa, Staphylococcus aureus
TLDGLPVVNLKSSNLKRGE

SEQ ID NO: 1661014 - protein, 18 aa, Staphylococcus aureus
TLKYAVPTTDCYEIFWGG

SEQ ID NO: 1661015 - protein, 34 aa, Staphylococcus aureus
TLSSEGFLKFLPKSEKYRIIYSYNMSIIRESNVT

SEQ ID NO: 1661016 - protein, 23 aa, Staphylococcus aureus
TMKSLSIPLQYLVAAALEVTDVN

SEQ ID NO: 1661017 - protein, 20 aa, Staphylococcus aureus
TMLLKLAKQYHASIITTDFN

SEQ ID NO: 1661018 - protein, 18 aa, Staphylococcus aureus
TNDAFFFLYSDLKGNELK

SEQ ID NO: 1661019 - protein, 17 aa, Staphylococcus aureus
TNKKTWCDFESVSIEYE

SEQ ID NO: 1661020 - protein, 19 aa, Staphylococcus aureus
TNKTQCSYGGVTLSDNNKY

SEQ ID NO: 1661021 - protein, 30 aa, Staphylococcus aureus
TNMIFKYAYDMKLIRILPSEGIKRPKKKVS

SEQ ID NO: 1661022 - protein, 22 aa, Staphylococcus aureus
TNRRVTFEYGLFGGVNDQLEHA

SEQ ID NO: 1661023 - protein, 17 aa, Staphylococcus aureus
TPPRQENVLNYANEQLE

SEQ ID NO: 1661024 - protein, 19 aa, Staphylococcus aureus
TPRNYRWKSRTGTTGQTQY

SEQ ID NO: 1661025 - protein, 19 aa, Staphylococcus aureus
TRLGYDLNEQVINMFSFFI

SEQ ID NO: 1661026 - protein, 20 aa, Staphylococcus aureus
TRYGEGIGKQYGFSVDLASY

SEQ ID NO: 1661027 - protein, 19 aa, Staphylococcus aureus
TVKNELLGRYEFYRFRLNE

SEQ ID NO: 1661028 - protein, 28 aa, Staphylococcus aureus
TVYNIPFLWRLSSELNVAQLRQAVQHLI

SEQ ID NO: 1661029 - protein, 23 aa, Staphylococcus aureus
TWTNRPGAEYMWFNNVETKPGVG

SEQ ID NO: 1661030 - protein, 19 aa, Staphylococcus aureus
TWVPSLAMRLILGQMSTVV

SEQ ID NO: 1661031 - protein, 31 aa, Staphylococcus aureus
TYRLSKDLYNLPSYRLQDLAEHFDIKNEEYH

SEQ ID NO: 1661032 - protein, 22 aa, Staphylococcus aureus
VADTKAKVLDKINAIQTQARVK

SEQ ID NO: 1661033 - protein, 18 aa, Staphylococcus aureus
VAKGKYYAGLSYEQDART

SEQ ID NO: 1661034 - protein, 18 aa, Staphylococcus aureus
VCNYLKDLFDKYDIKSEI

SEQ ID NO: 1661035 - protein, 19 aa, Staphylococcus aureus
VDELTSALISKGYKAEGLH

SEQ ID NO: 1661036 - protein, 20 aa, Staphylococcus aureus
VDKGESIAIIGPSGSGKSTF

SEQ ID NO: 1661037 - protein, 20 aa, Staphylococcus aureus
VDNCDLNFYLGQINHIVGKN

SEQ ID NO: 1661038 - protein, 19 aa, Staphylococcus aureus
VEALTIKERIELFKEMEED

SEQ ID NO: 1661039 - protein, 26 aa, Staphylococcus aureus
VFKTRRDRFEAMLAKADLPFVHAKGG

SEQ ID NO: 1661040 - protein, 19 aa, Staphylococcus aureus
VFVDFGINVNKEFSNSHFA

SEQ ID NO: 1661041 - protein, 23 aa, Staphylococcus aureus
VGSDRRSIACLTYSGHYIITPDN

SEQ ID NO: 1661042 - protein, 17 aa, Staphylococcus aureus
VHLFLINPSKHLSSDEI

SEQ ID NO: 1661043 - protein, 22 aa, Staphylococcus aureus
VIDKFKAVYQIFSDVLGVPLKS

SEQ ID NO: 1661044 - protein, 18 aa, Staphylococcus aureus
VIFTPHLVPMARGILSTI

SEQ ID NO: 1661045 - protein, 25 aa, Staphylococcus aureus
VIHPREIFKTAILSNANSIMLGHNH

SEQ ID NO: 1661046 - protein, 25 aa, Staphylococcus aureus
VKKEGLKGGGYYVEYRTDDARLTIE

SEQ ID NO: 1661047 - protein, 23 aa, Staphylococcus aureus
VKLAKALRVSPSYIMGIEDEKPQ

SEQ ID NO: 1661048 - protein, 18 aa, Staphylococcus aureus
VKNRFEIRLKNDRATQAM

SEQ ID NO: 1661049 - protein, 42 aa, Staphylococcus aureus
VKNSALEQLKAQRINPEVKKNALEAIREVVNKQIEIIKNADA

SEQ ID NO: 1661050 - protein, 17 aa, Staphylococcus aureus
VKPKANQAIDAKAQETK

SEQ ID NO: 1661051 - protein, 17 aa, Staphylococcus aureus
VLFENISVKECVKDLME

SEQ ID NO: 1661052 - protein, 24 aa, Staphylococcus aureus
VLIFRTKDVFPWRQHDVRLVFFLA

SEQ ID NO: 1661053 - protein, 23 aa, Staphylococcus aureus
VLLEARVSVFERRGNYQIYVNKM

SEQ ID NO: 1661054 - protein, 18 aa, Staphylococcus aureus
VLNIPKSTYYRWKNKTYK

SEQ ID NO: 1661055 - protein, 19 aa, Staphylococcus aureus
VMATITFQNLFKLFGSFSG

SEQ ID NO: 1661056 - protein, 23 aa, Staphylococcus aureus
VMIYDRRKDLIISGGENIYPYQI

SEQ ID NO: 1661057 - protein, 18 aa, Staphylococcus aureus
VNAAQRVSGVTDLKNSAT

SEQ ID NO: 1661058 - protein, 26 aa, Staphylococcus aureus
VNMEAVNHWHLSREELNEFINSNDLG

SEQ ID NO: 1661059 - protein, 32 aa, Staphylococcus aureus
VNMIFQHFNLLWSRTVLKNIMFPLEIAGVPRR

SEQ ID NO: 1661060 - protein, 31 aa, Staphylococcus aureus
VNNEKKKAAAFDFFQDNGFGFITPYNLDDLN

SEQ ID NO: 1661061 - protein, 23 aa, Staphylococcus aureus
VNVASFTLAVNRTFTNAQGEREA

SEQ ID NO: 1661062 - protein, 21 aa, Staphylococcus aureus
VPDYFKALVAIGTIADLVSLT

SEQ ID NO: 1661063 - protein, 24 aa, Staphylococcus aureus
VPSDIRAAGGVARMANPKIVEEVM

SEQ ID NO: 1661064 - protein, 17 aa, Staphylococcus aureus
VPTKHAVGIQSEDGVDI

SEQ ID NO: 1661065 - protein, 19 aa, Staphylococcus aureus
VQYESVFDFEEMINRAVEN

SEQ ID NO: 1661066 - protein, 18 aa, Staphylococcus aureus
VRPVPEYDNDFIESFFQN

SEQ ID NO: 1661067 - protein, 22 aa, Staphylococcus aureus
VRSRLMPINRAYNVEKLIEAIQ

SEQ ID NO: 1661068 - protein, 19 aa, Staphylococcus aureus
VRYSILCMENLNSDKIEEN

SEQ ID NO: 1661069 - protein, 26 aa, Staphylococcus aureus
VSAASSCYIISLAATLERAKFTDISI

SEQ ID NO: 1661070 - protein, 23 aa, Staphylococcus aureus
VSDELWNRWKQWLENDELWPRHA

SEQ ID NO: 1661071 - protein, 19 aa, Staphylococcus aureus
VSFKDNWAIAHMTGVLSKV

SEQ ID NO: 1661072 - protein, 19 aa, Staphylococcus aureus
VSLIKRVDICEDYINLVSL

SEQ ID NO: 1661073 - protein, 22 aa, Staphylococcus aureus
VSLSGFVLENGFQKIKNNDFTK

SEQ ID NO: 1661074 - protein, 26 aa, Staphylococcus aureus
VSNVKPGQWLGVFGIGGLGNLALQYA

SEQ ID NO: 1661075 - protein, 21 aa, Staphylococcus aureus
VSPRPIPGIKGGIHHITGVEH

SEQ ID NO: 1661076 - protein, 22 aa, Staphylococcus aureus
VSQRSNYALSFSKMTFPHQMMR

SEQ ID NO: 1661077 - protein, 29 aa, Staphylococcus aureus
VSRSHPGLLKRLFEQEVPEIYDGTVIVKS

SEQ ID NO: 1661078 - protein, 24 aa, Staphylococcus aureus
VSVSYPLDKLVLYIIEEKDKLEYY

SEQ ID NO: 1661079 - protein, 20 aa, Staphylococcus aureus
VTEIPHAWMMIEVDATNLVN

SEQ ID NO: 1661080 - protein, 35 aa, Staphylococcus aureus
VVAPLEILDPFKGVLKFQLPNDVIKRDGSYQAQVS

SEQ ID NO: 1661081 - protein, 17 aa, Staphylococcus aureus
VVKACGGTITLEDLAKY

SEQ ID NO: 1661082 - protein, 26 aa, Staphylococcus aureus
VWATAAPGWQKWVWSPFLSVLGSGAT

SEQ ID NO: 1661083 - protein, 20 aa, Staphylococcus aureus
VYELPLAEVVFDFFDQLKSN

SEQ ID NO: 1661084 - protein, 17 aa, Staphylococcus aureus
WDNVGLLIGDEDVEVTG

SEQ ID NO: 1661085 - protein, 20 aa, Staphylococcus aureus
WDSPFNIYKPHSGFTLETQF

SEQ ID NO: 1661086 - protein, 18 aa, Staphylococcus aureus
WEMINYALNHGIDRYNFY

SEQ ID NO: 1661087 - protein, 19 aa, Staphylococcus aureus
WGIWRVIESQLHLSVVERK

SEQ ID NO: 1661088 - protein, 22 aa, Staphylococcus aureus
WNDCFSDLHILQPDWKTIQRTA

SEQ ID NO: 1661089 - protein, 30 aa, Staphylococcus aureus
WPRMKEHIIELNAVFPMFIAEFAMESGESA

SEQ ID NO: 1661090 - protein, 25 aa, Staphylococcus aureus
WRQHDVRLVFFLAISQKDTAFTKQM

SEQ ID NO: 1661091 - protein, 23 aa, Staphylococcus aureus
WVGTLLKMKPVLKFEDGKIIPEE

SEQ ID NO: 1661092 - protein, 23 aa, Staphylococcus aureus
WVIKGSKEYLIPYIADVVKEVDV

SEQ ID NO: 1661093 - protein, 22 aa, Staphylococcus aureus
WWEEVEKAYQFLVNEGYESISA

SEQ ID NO: 1661094 - protein, 17 aa, Staphylococcus aureus
YALKTAGYQSALMVPTE

SEQ ID NO: 1661095 - protein, 25 aa, Staphylococcus aureus
YAVPTTDCYEIFWGGDNELYNYHYL

SEQ ID NO: 1661096 - protein, 26 aa, Staphylococcus aureus
YAVPTTDCYEVFWGGDNELYNYHYLY

SEQ ID NO: 1661097 - protein, 21 aa, Staphylococcus aureus
YDAKVCAKIAYNILKDQDANL

SEQ ID NO: 1661098 - protein, 22 aa, Staphylococcus aureus
YDKSRFEAIFTELRNRDITFIA

SEQ ID NO: 1661099 - protein, 25 aa, Staphylococcus aureus
YDSARFMTVTGCTIGQSDICDNQEV

SEQ ID NO: 1661100 - protein, 23 aa, Staphylococcus aureus
YEGKPMLSYVYDYPHKKLYKAIR

SEQ ID NO: 1661101 - protein, 21 aa, Staphylococcus aureus
YEKYDRIGFNTGNSRNGSYDR

SEQ ID NO: 1661102 - protein, 19 aa, Staphylococcus aureus
YFAAAKIGYHRLFDIKPVN

SEQ ID NO: 1661103 - protein, 19 aa, Staphylococcus aureus
YFDGIPNMDIFKKCYKALI

SEQ ID NO: 1661104 - protein, 19 aa, Staphylococcus aureus
YFIEMNARIQVEHTVTEMR

SEQ ID NO: 1661105 - protein, 17 aa, Staphylococcus aureus
YFLAMGYFYNKEDSNEI

SEQ ID NO: 1661106 - protein, 18 aa, Staphylococcus aureus
YGKHVCFTGALKGFTRNE

SEQ ID NO: 1661107 - protein, 18 aa, Staphylococcus aureus
YIGNVTINGFPNVEKRPK

SEQ ID NO: 1661108 - protein, 17 aa, Staphylococcus aureus
YISTLNLEDEAEFSKLL

SEQ ID NO: 1661109 - protein, 32 aa, Staphylococcus aureus
YKDFIENIIEGFKCTCAIVMKKKDCIIKIIDD

SEQ ID NO: 1661110 - protein, 20 aa, Staphylococcus aureus
YKDYGMYWIKNEVKPDAIIE

SEQ ID NO: 1661111 - protein, 20 aa, Staphylococcus aureus
YKEELIEFILSIQKNEFNIN

SEQ ID NO: 1661112 - protein, 18 aa, Staphylococcus aureus
YKHFCIVINKKDNKNNGK

SEQ ID NO: 1661113 - protein, 19 aa, Staphylococcus aureus
YKIPATGFIITGHVGEENF

SEQ ID NO: 1661114 - protein, 17 aa, Staphylococcus aureus
YKKAQAFDEILKGLPNA

SEQ ID NO: 1661115 - protein, 19 aa, Staphylococcus aureus
YKKFGVIPEMEYEMEEVKQ

SEQ ID NO: 1661116 - protein, 19 aa, Staphylococcus aureus
YKLAFAIRDAAATKNVGTE

SEQ ID NO: 1661117 - protein, 30 aa, Staphylococcus aureus
YKLAIEYKLAFPLHPEFRTMPMVWYCPPLS

SEQ ID NO: 1661118 - protein, 20 aa, Staphylococcus aureus
YKPKNLHIAKLYNTLVNFLN

SEQ ID NO: 1661119 - protein, 25 aa, Staphylococcus aureus
YLEKISLRDRQEWWYNVFYDDGKYN

SEQ ID NO: 1661120 - protein, 18 aa, Staphylococcus aureus
YLHPHLEPILKNTYGVII

SEQ ID NO: 1661121 - protein, 19 aa, Staphylococcus aureus
YLIGCQRTGEAMIIDPIRD

SEQ ID NO: 1661122 - protein, 24 aa, Staphylococcus aureus
YLLKDIKSRFGLYKKQIPDLDNLF

SEQ ID NO: 1661123 - protein, 21 aa, Staphylococcus aureus
YLSKGSLAGVDGRLQTRNYEN

SEQ ID NO: 1661124 - protein, 18 aa, Staphylococcus aureus
YLVKASKMKWVFQFEIVS

SEQ ID NO: 1661125 - protein, 17 aa, Staphylococcus aureus
YNLAAKVYREIKNYYLY

SEQ ID NO: 1661126 - protein, 19 aa, Staphylococcus aureus
YPATVGVMSQNLWYFRYFI

SEQ ID NO: 1661127 - protein, 18 aa, Staphylococcus aureus
YPTYIMLRKQRFKCKTCE

SEQ ID NO: 1661128 - protein, 19 aa, Staphylococcus aureus
YQASSLAMAIYFQDMNDDE

SEQ ID NO: 1661129 - protein, 18 aa, Staphylococcus aureus
YQEGEIFIRPSLSERNKL

SEQ ID NO: 1661130 - protein, 27 aa, Staphylococcus aureus
YQRGEIIYADFGKGVGHEFSYKHFCIV

SEQ ID NO: 1661131 - protein, 17 aa, Staphylococcus aureus
YRLKIVLNAESEFETIV

SEQ ID NO: 1661132 - protein, 19 aa, Staphylococcus aureus
YRTLNLIITTDFYKNKVSN

SEQ ID NO: 1661133 - protein, 21 aa, Staphylococcus aureus
YRYIGNELWIYSAVLDANNNN

SEQ ID NO: 1661134 - protein, 18 aa, Staphylococcus aureus
YSEIPQVYQILGIGPVEL

SEQ ID NO: 1661135 - protein, 17 aa, Staphylococcus aureus
YSIVRNVNEGVNAMTEQ

SEQ ID NO: 1661136 - protein, 27 aa, Staphylococcus aureus
YSQRKIDVEPAFGFMKAILGFTRMSVR

SEQ ID NO: 1661137 - protein, 25 aa, Staphylococcus aureus
YSQRKIDVEPVFGFMKAILGLTRTS

SEQ ID NO: 1661138 - protein, 25 aa, Staphylococcus aureus
YTKHGIIRLVFKYRHNTLQRSVTNG

SEQ ID NO: 1661139 - protein, 19 aa, Staphylococcus aureus
YTPEVCPNCNCKNINGNLI

SEQ ID NO: 1661140 - protein, 17 aa, Staphylococcus aureus
YYYGTLIIVSHDRALID

SEQ ID NO: 1661141 - protein, 25 aa, Staphylococcus aureus
AAKDLVLKAKEKAYQDILNAQTTND

SEQ ID NO: 1661142 - protein, 21 aa, Staphylococcus aureus
AARARGRYGGRPEKLNKQDLN

SEQ ID NO: 1661143 - protein, 25 aa, Staphylococcus aureus
AAYLKEFTNLYALLIPKMNSMNDVK

SEQ ID NO: 1661144 - protein, 24 aa, Staphylococcus aureus
ADEVWYSPVVCMALSKAHNINFYD

SEQ ID NO: 1661145 - protein, 25 aa, Staphylococcus aureus
ADKMKSWYERFGFGKSTKGMFDGEA

SEQ ID NO: 1661146 - protein, 25 aa, Staphylococcus aureus
ADQAICIGEANALGSYLNIDRIISA

SEQ ID NO: 1661147 - protein, 19 aa, Staphylococcus aureus
AEFKLYIIQDYQRLKEREE

SEQ ID NO: 1661148 - protein, 21 aa, Staphylococcus aureus
AEFNKVLKNVCIKIMHNDIKN

SEQ ID NO: 1661149 - protein, 17 aa, Staphylococcus aureus
AEIRRGLDEAGYYNIPI

SEQ ID NO: 1661150 - protein, 23 aa, Staphylococcus aureus
AEKLKLPMNYVRSSNKSHGKQNQ

SEQ ID NO: 1661151 - protein, 17 aa, Staphylococcus aureus
AEMPVDFSFVDTTARQI

SEQ ID NO: 1661152 - protein, 17 aa, Staphylococcus aureus
AETAPLYALSAISYEKE

SEQ ID NO: 1661153 - protein, 19 aa, Staphylococcus aureus
AEYYTHFTSPIRRYPDLTV

SEQ ID NO: 1661154 - protein, 17 aa, Staphylococcus aureus
AFILGVVEGLTEFAPVS

SEQ ID NO: 1661155 - protein, 22 aa, Staphylococcus aureus
AFKEASEQLATWVQEGKIQSQV

SEQ ID NO: 1661156 - protein, 18 aa, Staphylococcus aureus
AFTPLRELGIDWPSVNAN

SEQ ID NO: 1661157 - protein, 18 aa, Staphylococcus aureus
AGISGRKIRKLAIQMIEN

SEQ ID NO: 1661158 - protein, 23 aa, Staphylococcus aureus
AGLCQMIKPTVIDWYISEYNPKP

SEQ ID NO: 1661159 - protein, 20 aa, Staphylococcus aureus
AHQRIKFSSFDNEEIIYILD

SEQ ID NO: 1661160 - protein, 29 aa, Staphylococcus aureus
AIKLGEHLKHPFILKRIVGQSGMSYGALG

SEQ ID NO: 1661161 - protein, 20 aa, Staphylococcus aureus
AIKNIHFEYVKGIKGKRQNS

SEQ ID NO: 1661162 - protein, 21 aa, Staphylococcus aureus
AKAEKDGRDSTNQSMVESTTE

SEQ ID NO: 1661163 - protein, 21 aa, Staphylococcus aureus
AKAHSITAIWNFEKQNYYLRH

SEQ ID NO: 1661164 - protein, 18 aa, Staphylococcus aureus
AKELMITKGHIYYQSRKL

SEQ ID NO: 1661165 - protein, 18 aa, Staphylococcus aureus
AKGADLLVHVVDSSHPEY

SEQ ID NO: 1661166 - protein, 17 aa, Staphylococcus aureus
AKKSLGIQEGTQLWFEF

SEQ ID NO: 1661167 - protein, 17 aa, Staphylococcus aureus
AKPDLILAHESQKATAN

SEQ ID NO: 1661168 - protein, 18 aa, Staphylococcus aureus
AKVASLVTAFARVRQDKE

SEQ ID NO: 1661169 - protein, 17 aa, Staphylococcus aureus
AKWFVENNITSSENSYD

SEQ ID NO: 1661170 - protein, 22 aa, Staphylococcus aureus
AKYRFPERNRIISGLSKGVLIT

SEQ ID NO: 1661171 - protein, 19 aa, Staphylococcus aureus
ALFCRIFKYKFGMVNKVEI

SEQ ID NO: 1661172 - protein, 22 aa, Staphylococcus aureus
ALGCRKLIDYEGIFAGGSTGSI

SEQ ID NO: 1661173 - protein, 19 aa, Staphylococcus aureus
ALKSACRVNNISIITSHAL

SEQ ID NO: 1661174 - protein, 17 aa, Staphylococcus aureus
ALLFALSSGRTFIGQTT

SEQ ID NO: 1661175 - protein, 18 aa, Staphylococcus aureus
ALLKKGIKTIMLGGQVKE

SEQ ID NO: 1661176 - protein, 23 aa, Staphylococcus aureus
ALRNPRMAETFTIARKMNPEGMI

SEQ ID NO: 1661177 - protein, 17 aa, Staphylococcus aureus
ANDKEFYIFDSLIQGRS

SEQ ID NO: 1661178 - protein, 29 aa, Staphylococcus aureus
ANEISGMIPVEWEKVYTIAYLDDEGGEVV

SEQ ID NO: 1661179 - protein, 24 aa, Staphylococcus aureus
ANEKSLFVIDEFYDVAIAIYYLDG

SEQ ID NO: 1661180 - protein, 18 aa, Staphylococcus aureus
ANGAVLVRYGDTVVLSTA

SEQ ID NO: 1661181 - protein, 30 aa, Staphylococcus aureus
ANIFYGTSIPTCILVFKKCRQQEDYVLFID

SEQ ID NO: 1661182 - protein, 24 aa, Staphylococcus aureus
ANKISSMIPVEWETVYAMAYVNER

SEQ ID NO: 1661183 - protein, 20 aa, Staphylococcus aureus
ANQLLKMFVSTMETRLNDHN

SEQ ID NO: 1661184 - protein, 21 aa, Staphylococcus aureus
ANSAHVTGCRLLKKPHIKQYI

SEQ ID NO: 1661185 - protein, 21 aa, Staphylococcus aureus
ANTLNGAMGTLRNSIQDNTAT

SEQ ID NO: 1661186 - protein, 19 aa, Staphylococcus aureus
ANYTRAWSLGYIKDEEYFV

SEQ ID NO: 1661187 - protein, 18 aa, Staphylococcus aureus
APAFTEAKLQDPIPAKIY

SEQ ID NO: 1661188 - protein, 18 aa, Staphylococcus aureus
AQLAALFVNAGLKVKLLD

SEQ ID NO: 1661189 - protein, 28 aa, Staphylococcus aureus
AQTCYQFNVPFVVVRAVSDLANGEAEMS

SEQ ID NO: 1661190 - protein, 24 aa, Staphylococcus aureus
AQTLDHAMELLRNSVADNQTTLAS

SEQ ID NO: 1661191 - protein, 27 aa, Staphylococcus aureus
ARGKKRIDYRLSYNFYITYYDTVEIKK

SEQ ID NO: 1661192 - protein, 24 aa, Staphylococcus aureus
ARKGEIRALTWRDINFDDDFIHIN

SEQ ID NO: 1661193 - protein, 19 aa, Staphylococcus aureus
ARQNLKALMTKVNDDSVMV

SEQ ID NO: 1661194 - protein, 20 aa, Staphylococcus aureus
ARTTIKTNFSYEAVSKKWIE

SEQ ID NO: 1661195 - protein, 22 aa, Staphylococcus aureus
ASDIRWADKIAKLMDKSYKQFG

SEQ ID NO: 1661196 - protein, 21 aa, Staphylococcus aureus
ASGVPDFRSMGGLFDEISKDG

SEQ ID NO: 1661197 - protein, 29 aa, Staphylococcus aureus
ASTDVKTNARAELLTEMQNKITEILNNNE

SEQ ID NO: 1661198 - protein, 23 aa, Staphylococcus aureus
ATKANEQKALIAQTADATTEEKE

SEQ ID NO: 1661199 - protein, 23 aa, Staphylococcus aureus
ATPEHNYQFGGAMIESERLSELL

SEQ ID NO: 1661200 - protein, 23 aa, Staphylococcus aureus
ATPKVSGVLALIIDKYHLEKHPD

SEQ ID NO: 1661201 - protein, 35 aa, Staphylococcus aureus
ATQIQKAIQTQIAIQTRIATQTQIATQIQTQTVTQ

SEQ ID NO: 1661202 - protein, 17 aa, Staphylococcus aureus
AVLKRFNVALSDIEAVI

SEQ ID NO: 1661203 - protein, 24 aa, Staphylococcus aureus
AVMTSQGFVGRVTKVNKFSSQVDL

SEQ ID NO: 1661204 - protein, 17 aa, Staphylococcus aureus
AVPYFRMFNPIRQSERF

SEQ ID NO: 1661205 - protein, 17 aa, Staphylococcus aureus
AVRDVRELIVQKAQEGV

SEQ ID NO: 1661206 - protein, 25 aa, Staphylococcus aureus
AVTPKVMKKQAAKDEIDQLQAAQTA

SEQ ID NO: 1661207 - protein, 18 aa, Staphylococcus aureus
AVVLPHGVLFRGAAEGVI

SEQ ID NO: 1661208 - protein, 21 aa, Staphylococcus aureus
AYFNKRLRTTGGRYLLKSHDI

SEQ ID NO: 1661209 - protein, 29 aa, Staphylococcus aureus
AYLIEALQGYSHRIYCFIRADNEEIARYK

SEQ ID NO: 1661210 - protein, 19 aa, Staphylococcus aureus
AYNFKSVCVNPTHVKYAAE

SEQ ID NO: 1661211 - protein, 18 aa, Staphylococcus aureus
AYYKWRIDETYIKIKGKW

SEQ ID NO: 1661212 - protein, 17 aa, Staphylococcus aureus
AYYKWRVDETYIKIKGQ

SEQ ID NO: 1661213 - protein, 24 aa, Staphylococcus aureus
CDYLFCKAFGKLASNIEKYTNQGT

SEQ ID NO: 1661214 - protein, 36 aa, Staphylococcus aureus
CEICGSPMVIKMGRYGKFMACSNFPDCRNTKAIVKS

SEQ ID NO: 1661215 - protein, 18 aa, Staphylococcus aureus
CKPLTIYGNTTLLLDNET

SEQ ID NO: 1661216 - protein, 29 aa, Staphylococcus aureus
CLLTEARIFKFYKYFYSHRGPLLDYFDAK

SEQ ID NO: 1661217 - protein, 24 aa, Staphylococcus aureus
CNELGFQTMLIVFGIPTNKMNELP

SEQ ID NO: 1661218 - protein, 22 aa, Staphylococcus aureus
CPQCQNKLYLVSSIQKRANGGS

SEQ ID NO: 1661219 - protein, 32 aa, Staphylococcus aureus
CTFIPSCGKCIPCKEGRPALCENGAISNEKGE

SEQ ID NO: 1661220 - protein, 26 aa, Staphylococcus aureus
DACIANNIKPIFGMTIYVTNGLNTIE

SEQ ID NO: 1661221 - protein, 21 aa, Staphylococcus aureus
DAIEFAKKHRKEFEKVGEQFF

SEQ ID NO: 1661222 - protein, 20 aa, Staphylococcus aureus
DAIKEGFSYHERRIHNDQMF

SEQ ID NO: 1661223 - protein, 24 aa, Staphylococcus aureus
DAISSVLSSVAWYWHTSFSHTTEQ

SEQ ID NO: 1661224 - protein, 18 aa, Staphylococcus aureus
DALNYYLFYLKNWNYAYA

SEQ ID NO: 1661225 - protein, 24 aa, Staphylococcus aureus
DAVGTPLKRCAIVNRHNGTIINIF

SEQ ID NO: 1661226 - protein, 20 aa, Staphylococcus aureus
DAVSGMTHLNDAQKQALKGQ

SEQ ID NO: 1661227 - protein, 18 aa, Staphylococcus aureus
DCLLKGVHDRGMKLILDL

SEQ ID NO: 1661228 - protein, 24 aa, Staphylococcus aureus
DDDEIKPPFFIQWEESDSMRTKKL

SEQ ID NO: 1661229 - protein, 22 aa, Staphylococcus aureus
DDPAGKPWSEFQRVRDEIKIAI

SEQ ID NO: 1661230 - protein, 18 aa, Staphylococcus aureus
DDYECIKSGKSLKKAEKQ

SEQ ID NO: 1661231 - protein, 24 aa, Staphylococcus aureus
DDYKNIPCNLWIDGHQAEIELTAV

SEQ ID NO: 1661232 - protein, 22 aa, Staphylococcus aureus
DEANRFYVLELIKKVLKSKFNQ

SEQ ID NO: 1661233 - protein, 21 aa, Staphylococcus aureus
DEELRGMVASMQMQVVQVNVL

SEQ ID NO: 1661234 - protein, 17 aa, Staphylococcus aureus
DEGSHCQIARNIATTMS

SEQ ID NO: 1661235 - protein, 24 aa, Staphylococcus aureus
DEKKPHIMPVWSIKNRALKVRDED

SEQ ID NO: 1661236 - protein, 37 aa, Staphylococcus aureus
DELFDDVCAFMVNEGHISTSLIQRHFQIGYNRAARII

SEQ ID NO: 1661237 - protein, 29 aa, Staphylococcus aureus
DELQFIFFKMQKFNPEYVKLAVMPHNKND

SEQ ID NO: 1661238 - protein, 36 aa, Staphylococcus aureus
DENGARLPVPVDFLLDEWPNIGAIPDYEETLATCRK

SEQ ID NO: 1661239 - protein, 20 aa, Staphylococcus aureus
DENYPGISFDTIYRNLHLFK

SEQ ID NO: 1661240 - protein, 25 aa, Staphylococcus aureus
DFDKPKLEMWIDVLSQNGDYQPTVK

SEQ ID NO: 1661241 - protein, 19 aa, Staphylococcus aureus
DFEFFSRDILDDFKGVDRN

SEQ ID NO: 1661242 - protein, 24 aa, Staphylococcus aureus
DFNQELLCIYIDFDSGLRHSNMAT

SEQ ID NO: 1661243 - protein, 22 aa, Staphylococcus aureus
DGDPRAKYLREMSRQITKDAGR

SEQ ID NO: 1661244 - protein, 21 aa, Staphylococcus aureus
DGGIPGYIMIYLVPSTSTINS

SEQ ID NO: 1661245 - protein, 20 aa, Staphylococcus aureus
DGLDYLVKRTDHLTCGDVLR

SEQ ID NO: 1661246 - protein, 26 aa, Staphylococcus aureus
DGVADLAIGVGMVNYKGKHFANTQQF

SEQ ID NO: 1661247 - protein, 17 aa, Staphylococcus aureus
DGVIDFYGYSGINTEPF

SEQ ID NO: 1661248 - protein, 17 aa, Staphylococcus aureus
DHFFGAIQLLLKKAYYK

SEQ ID NO: 1661249 - protein, 23 aa, Staphylococcus aureus
DHKTLRFDLDRIKEMHARSTKVK

SEQ ID NO: 1661250 - protein, 19 aa, Staphylococcus aureus
DHLSGLLFDDIPYLKVAQE

SEQ ID NO: 1661251 - protein, 24 aa, Staphylococcus aureus
DIEKYFLMRYIKQGDILKLRLFRN

SEQ ID NO: 1661252 - protein, 18 aa, Staphylococcus aureus
DIEMPGMTGLEVLAEIRK

SEQ ID NO: 1661253 - protein, 18 aa, Staphylococcus aureus
DIQARLKVGDKVEVKTIG

SEQ ID NO: 1661254 - protein, 23 aa, Staphylococcus aureus
DIQDQFKPIGILLSALSVDINPI

SEQ ID NO: 1661255 - protein, 23 aa, Staphylococcus aureus
DKDATRASSAYVNAEPNKKQAYD

SEQ ID NO: 1661256 - protein, 25 aa, Staphylococcus aureus
DKDGVPFIEKWIKQYGSEAWTKQFL

SEQ ID NO: 1661257 - protein, 18 aa, Staphylococcus aureus
DKDWLIGMGRVIGDGGTA

SEQ ID NO: 1661258 - protein, 26 aa, Staphylococcus aureus
DKEKQALKDRINQILQQGHNGINNAM

SEQ ID NO: 1661259 - protein, 17 aa, Staphylococcus aureus
DKIYEEFINDDSITTVL

SEQ ID NO: 1661260 - protein, 19 aa, Staphylococcus aureus
DKQAKFVFYDTQLKQNFVS

SEQ ID NO: 1661261 - protein, 27 aa, Staphylococcus aureus
DKQYFPATHWKAINGIPYAGSSDIDGL

SEQ ID NO: 1661262 - protein, 26 aa, Staphylococcus aureus
DKVTIKRLWLTSKVESSIRKAFKNIL

SEQ ID NO: 1661263 - protein, 20 aa, Staphylococcus aureus
DLAKEIKRETEFDILFFSAI

SEQ ID NO: 1661264 - protein, 18 aa, Staphylococcus aureus
DLDLAKKHNIVISNVPSY

SEQ ID NO: 1661265 - protein, 19 aa, Staphylococcus aureus
DLLAISIARLEALGFKIVG

SEQ ID NO: 1661266 - protein, 17 aa, Staphylococcus aureus
DLPTLPIHAMFGENLTF

SEQ ID NO: 1661267 - protein, 19 aa, Staphylococcus aureus
DLSELYIAMDAMRDVINEW

SEQ ID NO: 1661268 - protein, 21 aa, Staphylococcus aureus
DNGKVCGFLTEMVANNDGIEA

SEQ ID NO: 1661269 - protein, 20 aa, Staphylococcus aureus
DNINDYTIPTGKKESATTDL

SEQ ID NO: 1661270 - protein, 17 aa, Staphylococcus aureus
DNLKTFGVEKIFTEKQS

SEQ ID NO: 1661271 - protein, 17 aa, Staphylococcus aureus
DNVEVWLIKKGFNIYNR

SEQ ID NO: 1661272 - protein, 25 aa, Staphylococcus aureus
DPEKYEVLKDLTLIIEDYTMEHGTT

SEQ ID NO: 1661273 - protein, 22 aa, Staphylococcus aureus
DPEVAGVLPVCIGNATRVSDYV

SEQ ID NO: 1661274 - protein, 19 aa, Staphylococcus aureus
DPEYIFYAYKRFNFELKDP

SEQ ID NO: 1661275 - protein, 24 aa, Staphylococcus aureus
DPHYIEVWGKFTPRGGISIDPYTN

SEQ ID NO: 1661276 - protein, 17 aa, Staphylococcus aureus
DPQDIAEAVLYALTQPS

SEQ ID NO: 1661277 - protein, 18 aa, Staphylococcus aureus
DQAKHVFDSTGLLNINYQ

SEQ ID NO: 1661278 - protein, 24 aa, Staphylococcus aureus
DQLQMKEILGIIGGNDTLMILTSS

SEQ ID NO: 1661279 - protein, 17 aa, Staphylococcus aureus
DRFRNRIMFPLKNAQGR

SEQ ID NO: 1661280 - protein, 21 aa, Staphylococcus aureus
DRLLKHDLLFHDMFVNDDWKK

SEQ ID NO: 1661281 - protein, 23 aa, Staphylococcus aureus
DRQCVAFFTLHRGKGVAPFSDNQ

SEQ ID NO: 1661282 - protein, 20 aa, Staphylococcus aureus
DSDLTINEAISFIKDDNPDL

SEQ ID NO: 1661283 - protein, 21 aa, Staphylococcus aureus
DSEYWRELCFGTTEGNRNNAL

SEQ ID NO: 1661284 - protein, 18 aa, Staphylococcus aureus
DSFIEKAKEKLTVSPSMR

SEQ ID NO: 1661285 - protein, 20 aa, Staphylococcus aureus
DSILKAIKLIKVLDDAKILD

SEQ ID NO: 1661286 - protein, 20 aa, Staphylococcus aureus
DSKGKVVLVTAMSPTPAGEG

SEQ ID NO: 1661287 - protein, 22 aa, Staphylococcus aureus
DSLIEGFMHWIKDEKIDWPGEE

SEQ ID NO: 1661288 - protein, 23 aa, Staphylococcus aureus
DSVDSIYPFSWIEKKSHIETGEN

SEQ ID NO: 1661289 - protein, 26 aa, Staphylococcus aureus
DSYLNLIFKFTRNIPVNKLEESQVLI

SEQ ID NO: 1661290 - protein, 22 aa, Staphylococcus aureus
DTKCPNRNIFVVGGPGSYKSAG

SEQ ID NO: 1661291 - protein, 25 aa, Staphylococcus aureus
DTNWPVCGIPEKFYTDHGSDFTSHH

SEQ ID NO: 1661292 - protein, 25 aa, Staphylococcus aureus
DVQSAAYLNIFSFLWDEITKDRTTE

SEQ ID NO: 1661293 - protein, 17 aa, Staphylococcus aureus
DVQTICIGMAASMGSFL

SEQ ID NO: 1661294 - protein, 19 aa, Staphylococcus aureus
DYEEIYNTFDWKDVEQAFS

SEQ ID NO: 1661295 - protein, 17 aa, Staphylococcus aureus
DYEYKSGLASFLKNMYI

SEQ ID NO: 1661296 - protein, 18 aa, Staphylococcus aureus
DYVYEIIDELSICSDYLF

SEQ ID NO: 1661297 - protein, 17 aa, Staphylococcus aureus
EAAINAVTPKVVKKQAA

SEQ ID NO: 1661298 - protein, 18 aa, Staphylococcus aureus
EAFTNALEDILSKATEDI

SEQ ID NO: 1661299 - protein, 30 aa, Staphylococcus aureus
EAIEIAALAGMVVLSCINPVAGAVAIGTYS

SEQ ID NO: 1661300 - protein, 20 aa, Staphylococcus aureus
EAKIKEPFIINEKDEKKKYI

SEQ ID NO: 1661301 - protein, 25 aa, Staphylococcus aureus
EAKPEDYDALLIPGGFSPDHLRGDT

SEQ ID NO: 1661302 - protein, 20 aa, Staphylococcus aureus
EAKPGICIIGEVVGYTENVS

SEQ ID NO: 1661303 - protein, 24 aa, Staphylococcus aureus
EALKKKLTEEGCFDKANKKSIPKF

SEQ ID NO: 1661304 - protein, 21 aa, Staphylococcus aureus
EAMDTYRKKLFAELDALNKFL

SEQ ID NO: 1661305 - protein, 20 aa, Staphylococcus aureus
EAQGIATVKAYVGNMSDTIT

SEQ ID NO: 1661306 - protein, 24 aa, Staphylococcus aureus
EARLKEFRKLGVEYEMAKLKNDLA

SEQ ID NO: 1661307 - protein, 31 aa, Staphylococcus aureus
EDFSSYINQFEWRDAKFPVVQNVNAQGETDK

SEQ ID NO: 1661308 - protein, 19 aa, Staphylococcus aureus
EDIDEELLLVLKRFKGYLV

SEQ ID NO: 1661309 - protein, 17 aa, Staphylococcus aureus
EDLKRAKYAGIEQQKMK

SEQ ID NO: 1661310 - protein, 19 aa, Staphylococcus aureus
EDVSFKLKRGQIVGLVGAN

SEQ ID NO: 1661311 - protein, 20 aa, Staphylococcus aureus
EDYPQIFDFLENVPRGTKTA

SEQ ID NO: 1661312 - protein, 19 aa, Staphylococcus aureus
EEAFAVALETAFLKGTGKD

SEQ ID NO: 1661313 - protein, 23 aa, Staphylococcus aureus
EEAKSFIDSQGFKDMIREAKESR

SEQ ID NO: 1661314 - protein, 24 aa, Staphylococcus aureus
EEFEAFKKRSPKYNPGMNNHDETD

SEQ ID NO: 1661315 - protein, 18 aa, Staphylococcus aureus
EEGLEPWTSSEFDFTSEG

SEQ ID NO: 1661316 - protein, 24 aa, Staphylococcus aureus
EEKAHSITAIWNFEKQNYYLKNLR

SEQ ID NO: 1661317 - protein, 23 aa, Staphylococcus aureus
EELEGVGFFLVDRNLPGVEIADN

SEQ ID NO: 1661318 - protein, 20 aa, Staphylococcus aureus
EENNKIYGFIVVDQDQAEWY

SEQ ID NO: 1661319 - protein, 37 aa, Staphylococcus aureus
EEQQFKCHIDTIIKKQVPVCCFTFGIQNESIIERLKE

SEQ ID NO: 1661320 - protein, 26 aa, Staphylococcus aureus
EFETRAGTLLRYYTGLLESSRETHFA

SEQ ID NO: 1661321 - protein, 22 aa, Staphylococcus aureus
EFGKLRKVAMDKGFKHCQAGPL

SEQ ID NO: 1661322 - protein, 20 aa, Staphylococcus aureus
EFLKSEGFDDIEWGEDFGAP

SEQ ID NO: 1661323 - protein, 31 aa, Staphylococcus aureus
EFSKRIKQNYSYRCAITGIKTKDFLVVTHII

SEQ ID NO: 1661324 - protein, 22 aa, Staphylococcus aureus
EFYKVAQALLINIGTLTAQNEQ

SEQ ID NO: 1661325 - protein, 22 aa, Staphylococcus aureus
EFYKVAQGLLINIGTLTAENEQ

SEQ ID NO: 1661326 - protein, 18 aa, Staphylococcus aureus
EGEFSRQNFTNALETVKD

SEQ ID NO: 1661327 - protein, 20 aa, Staphylococcus aureus
EGHEPWTSCEFDFTKEGKLK

SEQ ID NO: 1661328 - protein, 22 aa, Staphylococcus aureus
EGHLLALPGWAGMLYYRSQQHH

SEQ ID NO: 1661329 - protein, 18 aa, Staphylococcus aureus
EGKFEINRLYKDVKNVNG

SEQ ID NO: 1661330 - protein, 20 aa, Staphylococcus aureus
EGKKIKPIIEKLVDDNNNLQ

SEQ ID NO: 1661331 - protein, 24 aa, Staphylococcus aureus
EGKLKVSFDYIDWINTEFDQLGRQ

SEQ ID NO: 1661332 - protein, 17 aa, Staphylococcus aureus
EGKYFKYFVYKDDSKHL

SEQ ID NO: 1661333 - protein, 18 aa, Staphylococcus aureus
EGMKGLKRQLGVVNSEMK

SEQ ID NO: 1661334 - protein, 19 aa, Staphylococcus aureus
EGMQRARKELNYTANTDVV

SEQ ID NO: 1661335 - protein, 24 aa, Staphylococcus aureus
EIENFKFFVQYGNFKDINDYKNGD

SEQ ID NO: 1661336 - protein, 24 aa, Staphylococcus aureus
EIFSDEIIEFITLNNYVLIKTSPG

SEQ ID NO: 1661337 - protein, 20 aa, Staphylococcus aureus
EIKEFTRFYVNNFKFTNIQI

SEQ ID NO: 1661338 - protein, 23 aa, Staphylococcus aureus
EIKNFKFFVQYGNFKDLKNYKDG

SEQ ID NO: 1661339 - protein, 25 aa, Staphylococcus aureus
EIKQRVTEMLEFVGLSDKKDQFPEE

SEQ ID NO: 1661340 - protein, 17 aa, Staphylococcus aureus
EINFIKYYFCHIPTPNS

SEQ ID NO: 1661341 - protein, 22 aa, Staphylococcus aureus
EISKRIKDAFLNEDIDILHQQS

SEQ ID NO: 1661342 - protein, 24 aa, Staphylococcus aureus
EKDEKKKYIAFKMEITAKKDDKDL

SEQ ID NO: 1661343 - protein, 17 aa, Staphylococcus aureus
EKEGQRILAKIKPQSTV

SEQ ID NO: 1661344 - protein, 20 aa, Staphylococcus aureus
EKINDVAIKHGWFVEDKFVK

SEQ ID NO: 1661345 - protein, 20 aa, Staphylococcus aureus
EKIYGSPIIECNERMIRLSD

SEQ ID NO: 1661346 - protein, 20 aa, Staphylococcus aureus
EKKPACTVITMYPHLDGVLS

SEQ ID NO: 1661347 - protein, 20 aa, Staphylococcus aureus
EKLENLFNQFAIKNVEKNIV

SEQ ID NO: 1661348 - protein, 22 aa, Staphylococcus aureus
EKLKKFITNFAIRNSVDDEDSE

SEQ ID NO: 1661349 - protein, 24 aa, Staphylococcus aureus
EKLPYRAKRHYSIVSGEKNHLTFG

SEQ ID NO: 1661350 - protein, 21 aa, Staphylococcus aureus
EKNKRLKQRQLYPGAPKGQFK

SEQ ID NO: 1661351 - protein, 22 aa, Staphylococcus aureus
EKNLIAFLFFYFELFEDEKQET

SEQ ID NO: 1661352 - protein, 17 aa, Staphylococcus aureus
EKRARDIIEDKYLSERT

SEQ ID NO: 1661353 - protein, 22 aa, Staphylococcus aureus
EKVANMPIHFFLDIVESKIETK

SEQ ID NO: 1661354 - protein, 20 aa, Staphylococcus aureus
ELDGATALSIGWHVSVVGQI

SEQ ID NO: 1661355 - protein, 18 aa, Staphylococcus aureus
ELDTLVVLTKEQKDDIIK

SEQ ID NO: 1661356 - protein, 17 aa, Staphylococcus aureus
ELFDFYYDLFKSDDDIY

SEQ ID NO: 1661357 - protein, 25 aa, Staphylococcus aureus
ELLLVLKRFKGYLVKKQEKVANMEG

SEQ ID NO: 1661358 - protein, 19 aa, Staphylococcus aureus
ELNTAMGQLQHGIDDENAT

SEQ ID NO: 1661359 - protein, 24 aa, Staphylococcus aureus
ELPNTKPGAYVWRDKVCSMEIWKV

SEQ ID NO: 1661360 - protein, 26 aa, Staphylococcus aureus
EMGLKCLRTSIAWTRIFPNGDEDVPN

SEQ ID NO: 1661361 - protein, 17 aa, Staphylococcus aureus
EMPRERLLSHGAKSLSN

SEQ ID NO: 1661362 - protein, 30 aa, Staphylococcus aureus
ENEKKKAAAFDFFQDNGFGFITPYNLDDLN

SEQ ID NO: 1661363 - protein, 20 aa, Staphylococcus aureus
ENEKRYPVKMVDNKIIPTKE

SEQ ID NO: 1661364 - protein, 23 aa, Staphylococcus aureus
ENINIPAQIFVEFDAASRGLGIL

SEQ ID NO: 1661365 - protein, 20 aa, Staphylococcus aureus
ENKLNYDHMVNGKKRTNKIN

SEQ ID NO: 1661366 - protein, 25 aa, Staphylococcus aureus
ENLAIPRAAFKDIVKMMDYGEGLKK

SEQ ID NO: 1661367 - protein, 19 aa, Staphylococcus aureus
ENLEILKWSNKSKIIETLT

SEQ ID NO: 1661368 - protein, 23 aa, Staphylococcus aureus
ENLFRKLLQHYLQLELDLGNRDL

SEQ ID NO: 1661369 - protein, 23 aa, Staphylococcus aureus
ENRPILQKALNFVRMGDRFIVES

SEQ ID NO: 1661370 - protein, 18 aa, Staphylococcus aureus
ENSELSVVDSLNFQPAKK

SEQ ID NO: 1661371 - protein, 20 aa, Staphylococcus aureus
ENTYDGTGFVIARTSDTDIT

SEQ ID NO: 1661372 - protein, 25 aa, Staphylococcus aureus
EPATELVEGLKLVTEFVQDENATQE

SEQ ID NO: 1661373 - protein, 19 aa, Staphylococcus aureus
EPMFSKKSIRNVVKPLLKY

SEQ ID NO: 1661374 - protein, 20 aa, Staphylococcus aureus
EQFKDAYAKFYGLSSEQIIA

SEQ ID NO: 1661375 - protein, 24 aa, Staphylococcus aureus
EQFKEAYAKFYGLLPEQIIAGNGS

SEQ ID NO: 1661376 - protein, 20 aa, Staphylococcus aureus
EQHYAPVLTHFLDPRGQYIL

SEQ ID NO: 1661377 - protein, 23 aa, Staphylococcus aureus
EQKGVAVVICPNDLLTEKIKDTT

SEQ ID NO: 1661378 - protein, 25 aa, Staphylococcus aureus
EQSPKMYGGTCINVGCIASKTLVHD

SEQ ID NO: 1661379 - protein, 25 aa, Staphylococcus aureus
EQYKRTMFWLEFEIRQYTHSNITLD

SEQ ID NO: 1661380 - protein, 25 aa, Staphylococcus aureus
ERKGNHIYNGLDMFVYQGAESFKIW

SEQ ID NO: 1661381 - protein, 28 aa, Staphylococcus aureus
ERKMTAMLRYQFKVILSALKRKGYNLND

SEQ ID NO: 1661382 - protein, 26 aa, Staphylococcus aureus
ERLNNRKAEALQRLDQLTHLNNAQRQ

SEQ ID NO: 1661383 - protein, 19 aa, Staphylococcus aureus
ERMYEFLDKLISVSLPRVR

SEQ ID NO: 1661384 - protein, 23 aa, Staphylococcus aureus
ESDILCPFHYFGVTDYVHQGIKE

SEQ ID NO: 1661385 - protein, 19 aa, Staphylococcus aureus
ESMLIPLIARAKEYEYEKP

SEQ ID NO: 1661386 - protein, 26 aa, Staphylococcus aureus
ESPYSSNLFLPFALANNYYTIDQLID

SEQ ID NO: 1661387 - protein, 21 aa, Staphylococcus aureus
ETLKLLRIVKFAFGSYTSQYL

SEQ ID NO: 1661388 - protein, 17 aa, Staphylococcus aureus
ETSELLFSEELDKNLKY

SEQ ID NO: 1661389 - protein, 29 aa, Staphylococcus aureus
EVEKAKAQGLEAFDNIQIDSTEKQKAIEE

SEQ ID NO: 1661390 - protein, 19 aa, Staphylococcus aureus
EVENAKCISIGVATDNALV

SEQ ID NO: 1661391 - protein, 18 aa, Staphylococcus aureus
EVKTLRILHFVSGDGGKL

SEQ ID NO: 1661392 - protein, 17 aa, Staphylococcus aureus
EVLKEKFEPVLKEPGVV

SEQ ID NO: 1661393 - protein, 18 aa, Staphylococcus aureus
EVLRESGFFRHLKVMPYA

SEQ ID NO: 1661394 - protein, 17 aa, Staphylococcus aureus
EVNRLINDMIYFVRDTI

SEQ ID NO: 1661395 - protein, 20 aa, Staphylococcus aureus
EVVRKSALERYEFTGDITYL

SEQ ID NO: 1661396 - protein, 21 aa, Staphylococcus aureus
EVWLIKKGFNIYNRYTLHRFN

SEQ ID NO: 1661397 - protein, 19 aa, Staphylococcus aureus
EWEQFFFKNKISNITKNDF

SEQ ID NO: 1661398 - protein, 17 aa, Staphylococcus aureus
EYARVKSEWIIKLPDTL

SEQ ID NO: 1661399 - protein, 18 aa, Staphylococcus aureus
EYSEFLLDEVRLLKENKS

SEQ ID NO: 1661400 - protein, 27 aa, Staphylococcus aureus
FAKDRIIKLFCHLCQTVGYDQDEFYEI

SEQ ID NO: 1661401 - protein, 26 aa, Staphylococcus aureus
FARVFRKHLEGGIIKSIKQIGNDRRI

SEQ ID NO: 1661402 - protein, 27 aa, Staphylococcus aureus
FASCLLFPLHIRYKYIDNFNIEQISYK

SEQ ID NO: 1661403 - protein, 17 aa, Staphylococcus aureus
FASPVYWYSISAPLKAF

SEQ ID NO: 1661404 - protein, 21 aa, Staphylococcus aureus
FATARFYIRVLTRFFQNISKN

SEQ ID NO: 1661405 - protein, 21 aa, Staphylococcus aureus
FDFQLRVKKRAYSVEMVVLDH

SEQ ID NO: 1661406 - protein, 20 aa, Staphylococcus aureus
FDFSAVPFKQVYKNEQDVVQ

SEQ ID NO: 1661407 - protein, 18 aa, Staphylococcus aureus
FDHMWGYFKKCANEEERQ

SEQ ID NO: 1661408 - protein, 20 aa, Staphylococcus aureus
FDKRAQLIECLEKKGFEMLQ

SEQ ID NO: 1661409 - protein, 18 aa, Staphylococcus aureus
FDQQYGYVGVPTTLNIDS

SEQ ID NO: 1661410 - protein, 18 aa, Staphylococcus aureus
FDTTGEWLPQETLDTIKE

SEQ ID NO: 1661411 - protein, 24 aa, Staphylococcus aureus
FDYHKKRWGLFGYCRYIPYLKKRL

SEQ ID NO: 1661412 - protein, 24 aa, Staphylococcus aureus
FEDFTLKIAELYKGASESTKAEVV

SEQ ID NO: 1661413 - protein, 23 aa, Staphylococcus aureus
FEKEDRKIATFCVATHRNYKDEN

SEQ ID NO: 1661414 - protein, 18 aa, Staphylococcus aureus
FELFDYNIAYEIRLQAAL

SEQ ID NO: 1661415 - protein, 22 aa, Staphylococcus aureus
FETNKWINAYECYFKNMLGLKC

SEQ ID NO: 1661416 - protein, 18 aa, Staphylococcus aureus
FEVPHQWQHNAYSEIPQV

SEQ ID NO: 1661417 - protein, 20 aa, Staphylococcus aureus
FEVRSVWRGKHIIRVKDGLL

SEQ ID NO: 1661418 - protein, 26 aa, Staphylococcus aureus
FFSTLKDGFPFGSILLYEYENDNKYS

SEQ ID NO: 1661419 - protein, 27 aa, Staphylococcus aureus
FGEVGRALYNFIWDDFCDWYIEMSKIP

SEQ ID NO: 1661420 - protein, 34 aa, Staphylococcus aureus
FGFATAPLVVLGCIMMRVCHKDTCPVGVATQNKD

SEQ ID NO: 1661421 - protein, 18 aa, Staphylococcus aureus
FGIWPEKEYAINWVKKIK

SEQ ID NO: 1661422 - protein, 20 aa, Staphylococcus aureus
FGRYEFYRFRLSELQIESRA

SEQ ID NO: 1661423 - protein, 17 aa, Staphylococcus aureus
FGTGYALEFTGETIKNL

SEQ ID NO: 1661424 - protein, 20 aa, Staphylococcus aureus
FHDLKINISKYVPKASSIYN

SEQ ID NO: 1661425 - protein, 32 aa, Staphylococcus aureus
FHEFPFEKINSVSYKKGLLFGEIIIHHGSSSI

SEQ ID NO: 1661426 - protein, 18 aa, Staphylococcus aureus
FIGPNCGFYTATHPLNFH

SEQ ID NO: 1661427 - protein, 22 aa, Staphylococcus aureus
FIPEAMVYKLAFKAGNSTAEKF

SEQ ID NO: 1661428 - protein, 24 aa, Staphylococcus aureus
FKEDRTVYLPKAYHPLLNRETVVA

SEQ ID NO: 1661429 - protein, 18 aa, Staphylococcus aureus
FKENGQWYKLEKLWEKAI

SEQ ID NO: 1661430 - protein, 17 aa, Staphylococcus aureus
FKHGLSSFIEALEQDVK

SEQ ID NO: 1661431 - protein, 20 aa, Staphylococcus aureus
FKIQGVILICYYYDNLQNYM

SEQ ID NO: 1661432 - protein, 18 aa, Staphylococcus aureus
FKKLRNAFKEDLEPWTSC

SEQ ID NO: 1661433 - protein, 18 aa, Staphylococcus aureus
FKKVLPIKNDSDFGLLTG

SEQ ID NO: 1661434 - protein, 17 aa, Staphylococcus aureus
FKNLMVTQILGIDDIKE

SEQ ID NO: 1661435 - protein, 17 aa, Staphylococcus aureus
FLAYGAVSLPYVDQAIE

SEQ ID NO: 1661436 - protein, 23 aa, Staphylococcus aureus
FLDEKTGFMYMYMYITLNGDSYE

SEQ ID NO: 1661437 - protein, 28 aa, Staphylococcus aureus
FLDQRVINHYGSLIPLTPLDNSLLRKEQ

SEQ ID NO: 1661438 - protein, 19 aa, Staphylococcus aureus
FLIAKARYSRSVKGTKPIF

SEQ ID NO: 1661439 - protein, 19 aa, Staphylococcus aureus
FLNYTYSQFFEEMKPMIAE

SEQ ID NO: 1661440 - protein, 19 aa, Staphylococcus aureus
FLYDREIRGLAQVSVSGES

SEQ ID NO: 1661441 - protein, 17 aa, Staphylococcus aureus
FLYTCRQKIKVLDMNHS

SEQ ID NO: 1661442 - protein, 18 aa, Staphylococcus aureus
FMKAILGFTRMSVRGLNK

SEQ ID NO: 1661443 - protein, 18 aa, Staphylococcus aureus
FMRKYSYHLSSSRLISGS

SEQ ID NO: 1661444 - protein, 19 aa, Staphylococcus aureus
FNGKLPHWSNDDPGKGNLY

SEQ ID NO: 1661445 - protein, 18 aa, Staphylococcus aureus
FNGSDFGGFSGFGGGGFE

SEQ ID NO: 1661446 - protein, 19 aa, Staphylococcus aureus
FNMYKKITIILGEDTESFV

SEQ ID NO: 1661447 - protein, 19 aa, Staphylococcus aureus
FNQPIKLKIVLIHSKLGRT

SEQ ID NO: 1661448 - protein, 17 aa, Staphylococcus aureus
FNSDFGEKMGMKFHTDV

SEQ ID NO: 1661449 - protein, 27 aa, Staphylococcus aureus
FNSYPEWQKQFPFWSERTIKRTFGSLE

SEQ ID NO: 1661450 - protein, 21 aa, Staphylococcus aureus
FPDQLKVIEIINLYQSFYENP

SEQ ID NO: 1661451 - protein, 17 aa, Staphylococcus aureus
FPGIFRGALEVEATHIN

SEQ ID NO: 1661452 - protein, 20 aa, Staphylococcus aureus
FPTKEIMKELNIRNRTQVKN

SEQ ID NO: 1661453 - protein, 21 aa, Staphylococcus aureus
FPVTVIEQAYWVFDQHINDRG

SEQ ID NO: 1661454 - protein, 20 aa, Staphylococcus aureus
FQKEILQTMQVGERGPNTEG

SEQ ID NO: 1661455 - protein, 17 aa, Staphylococcus aureus
FQKIICNLISPTSGTLY

SEQ ID NO: 1661456 - protein, 21 aa, Staphylococcus aureus
FRFNAVSGGDAFYAIKTPTMT

SEQ ID NO: 1661457 - protein, 17 aa, Staphylococcus aureus
FSAVITAELAKGRRLFE

SEQ ID NO: 1661458 - protein, 17 aa, Staphylococcus aureus
FSKFLWSYVNCKPKDLQ

SEQ ID NO: 1661459 - protein, 17 aa, Staphylococcus aureus
FSKLLNVIETYLFQWNL

SEQ ID NO: 1661460 - protein, 19 aa, Staphylococcus aureus
FSKPEWSKLVNKLSVPIEA

SEQ ID NO: 1661461 - protein, 21 aa, Staphylococcus aureus
FSKPKWSKLINKLSVPIEANY

SEQ ID NO: 1661462 - protein, 18 aa, Staphylococcus aureus
FSRGGLQGLLTFQDLPVN

SEQ ID NO: 1661463 - protein, 17 aa, Staphylococcus aureus
FTNGEIKYNSNFEKEDV

SEQ ID NO: 1661464 - protein, 20 aa, Staphylococcus aureus
FVGEHGRYDLMLVHTNRHYG

SEQ ID NO: 1661465 - protein, 23 aa, Staphylococcus aureus
FVSNGVLMGYELNVDNIDNTNET

SEQ ID NO: 1661466 - protein, 17 aa, Staphylococcus aureus
FVWWFATNPEYEGKGYG

SEQ ID NO: 1661467 - protein, 19 aa, Staphylococcus aureus
FWSERTIKRTFGSLEKQNL

SEQ ID NO: 1661468 - protein, 17 aa, Staphylococcus aureus
FYAYKRFNFELKDPNFT

SEQ ID NO: 1661469 - protein, 17 aa, Staphylococcus aureus
FYEKFLFEELDLGEQKK

SEQ ID NO: 1661470 - protein, 18 aa, Staphylococcus aureus
FYRQCKLGWDNEINFVKI

SEQ ID NO: 1661471 - protein, 21 aa, Staphylococcus aureus
GADPMTFLGLGGIGDLIVTCI

SEQ ID NO: 1661472 - protein, 26 aa, Staphylococcus aureus
GAITKGARGYLTFGHSINVPPIAESY

SEQ ID NO: 1661473 - protein, 19 aa, Staphylococcus aureus
GAITKMWTITNIKGEDDLN

SEQ ID NO: 1661474 - protein, 18 aa, Staphylococcus aureus
GAITKMWTITNVKGEDDL

SEQ ID NO: 1661475 - protein, 25 aa, Staphylococcus aureus
GAKSKRPGLDRAIEFARSGDTIVVW

SEQ ID NO: 1661476 - protein, 20 aa, Staphylococcus aureus
GALLKLDFITHSYPHDWRTK

SEQ ID NO: 1661477 - protein, 17 aa, Staphylococcus aureus
GATAFVFNGRFSPETYL

SEQ ID NO: 1661478 - protein, 19 aa, Staphylococcus aureus
GDFEKRVTFDLTGSDANDG

SEQ ID NO: 1661479 - protein, 25 aa, Staphylococcus aureus
GDQLKRVALSSMSPLLFPPSKQDMK

SEQ ID NO: 1661480 - protein, 33 aa, Staphylococcus aureus
GDSKPDWKIFQAIANKLGFDWNYKHPSEIMDEI

SEQ ID NO: 1661481 - protein, 33 aa, Staphylococcus aureus
GEGEFKAGSHCRFCKIKHSCRTRAEYMQDVPQK

SEQ ID NO: 1661482 - protein, 24 aa, Staphylococcus aureus
GEKAKYKLANVISNYSPILLLDEP

SEQ ID NO: 1661483 - protein, 22 aa, Staphylococcus aureus
GELCKIDRAYSGEIVILQNEFL

SEQ ID NO: 1661484 - protein, 21 aa, Staphylococcus aureus
GEQKKILSLIVLFLNAKEENV

SEQ ID NO: 1661485 - protein, 23 aa, Staphylococcus aureus
GEQKRLTVGLVLNEQKKLYIFDE

SEQ ID NO: 1661486 - protein, 26 aa, Staphylococcus aureus
GFDDGNRPIGSFLFVGPTGVGKTELA

SEQ ID NO: 1661487 - protein, 27 aa, Staphylococcus aureus
GFGNYELRLPLITLEDTDTKVLREAYN

SEQ ID NO: 1661488 - protein, 38 aa, Staphylococcus aureus
GFLTYKIPKKVIKHAGYVRCKLFLEKEEEKIHVANFSF

SEQ ID NO: 1661489 - protein, 18 aa, Staphylococcus aureus
GGTIKIKGIHINGLEVDL

SEQ ID NO: 1661490 - protein, 21 aa, Staphylococcus aureus
GHGAFKIIETHALKDVQAVLG

SEQ ID NO: 1661491 - protein, 17 aa, Staphylococcus aureus
GHIPRLTYHTNRIKCSS

SEQ ID NO: 1661492 - protein, 22 aa, Staphylococcus aureus
GHIVKVDAGTYWYNDPYTLDFM

SEQ ID NO: 1661493 - protein, 20 aa, Staphylococcus aureus
GHLLALPGWAGILYYRSQQH

SEQ ID NO: 1661494 - protein, 21 aa, Staphylococcus aureus
GHLLALPGWAGMLYYRSQQHY

SEQ ID NO: 1661495 - protein, 19 aa, Staphylococcus aureus
GHSGDYLKKMHVYLVSLLN

SEQ ID NO: 1661496 - protein, 17 aa, Staphylococcus aureus
GIRCEKFSGWLLKEGFE

SEQ ID NO: 1661497 - protein, 25 aa, Staphylococcus aureus
GIRHFGENRLEGFLQKKEALPSDAV

SEQ ID NO: 1661498 - protein, 21 aa, Staphylococcus aureus
GIRKGETLGIVGESGSGKSTL

SEQ ID NO: 1661499 - protein, 19 aa, Staphylococcus aureus
GITFAELERTLGFSNGQIR

SEQ ID NO: 1661500 - protein, 21 aa, Staphylococcus aureus
GKAYAYLIFVQETWTMLHENM

SEQ ID NO: 1661501 - protein, 19 aa, Staphylococcus aureus
GKIQRGLIEFHPSSGDSVG

SEQ ID NO: 1661502 - protein, 23 aa, Staphylococcus aureus
GKKLTFIISPQWFTNHGLTNQNF

SEQ ID NO: 1661503 - protein, 19 aa, Staphylococcus aureus
GKPTPGYESTNMWKNLKAT

SEQ ID NO: 1661504 - protein, 18 aa, Staphylococcus aureus
GKQPRVIFEKVFAEHFLN

SEQ ID NO: 1661505 - protein, 18 aa, Staphylococcus aureus
GKSTFQKIICNLISPTSG

SEQ ID NO: 1661506 - protein, 20 aa, Staphylococcus aureus
GKTTTFRMFLGLSEPTEGHI

SEQ ID NO: 1661507 - protein, 24 aa, Staphylococcus aureus
GKVPANLKLPLRDGDTEREDDVNY

SEQ ID NO: 1661508 - protein, 17 aa, Staphylococcus aureus
GKYWASLGDVFVNDAFG

SEQ ID NO: 1661509 - protein, 27 aa, Staphylococcus aureus
GKYYVSHQWFPLGAVHGLKYWYNYTSD

SEQ ID NO: 1661510 - protein, 21 aa, Staphylococcus aureus
GLGGLAGDLSNLFNVTNVVVT

SEQ ID NO: 1661511 - protein, 19 aa, Staphylococcus aureus
GLGNMMMRYVMKKKNVDSL

SEQ ID NO: 1661512 - protein, 17 aa, Staphylococcus aureus
GLHDIQVVKSKQEVADT

SEQ ID NO: 1661513 - protein, 23 aa, Staphylococcus aureus
GLIEMQICPPMYYLIDGKGLKLP

SEQ ID NO: 1661514 - protein, 23 aa, Staphylococcus aureus
GLIEMQICPPMYYLIDGKGLRLP

SEQ ID NO: 1661515 - protein, 24 aa, Staphylococcus aureus
GLPMSLLEAMSYGVPVISYPINYG

SEQ ID NO: 1661516 - protein, 17 aa, Staphylococcus aureus
GLTKKGSKQFILISEND

SEQ ID NO: 1661517 - protein, 24 aa, Staphylococcus aureus
GMRAGELLALKWSDIDFENNTINI

SEQ ID NO: 1661518 - protein, 18 aa, Staphylococcus aureus
GNEPLLRVEAPLIQAQLI

SEQ ID NO: 1661519 - protein, 17 aa, Staphylococcus aureus
GNMKLKLWVSTKDSDDM

SEQ ID NO: 1661520 - protein, 25 aa, Staphylococcus aureus
GNSQRPTEFSVRYNINGEQFLKNII

SEQ ID NO: 1661521 - protein, 25 aa, Staphylococcus aureus
GNVVCFCPSCSTGIGTRNNKIPIKD

SEQ ID NO: 1661522 - protein, 17 aa, Staphylococcus aureus
GNYLGEVNLTFEAHKVV

SEQ ID NO: 1661523 - protein, 19 aa, Staphylococcus aureus
GPNIEKLDHQFQQTMQVGV

SEQ ID NO: 1661524 - protein, 20 aa, Staphylococcus aureus
GQALHAGLIGFEHPVTSEYI

SEQ ID NO: 1661525 - protein, 17 aa, Staphylococcus aureus
GQGCISLKSIAEENNLS

SEQ ID NO: 1661526 - protein, 18 aa, Staphylococcus aureus
GQLPGTKVYPWIAKTRGS

SEQ ID NO: 1661527 - protein, 18 aa, Staphylococcus aureus
GQSLAAYAPKGLMIHHTG

SEQ ID NO: 1661528 - protein, 23 aa, Staphylococcus aureus
GRLGSGQQWYSWIHINDLIQAIL

SEQ ID NO: 1661529 - protein, 17 aa, Staphylococcus aureus
GRVLVFNKRGYPIGQIL

SEQ ID NO: 1661530 - protein, 25 aa, Staphylococcus aureus
GSAALKICNYCFEHGVVIIAVAGNV

SEQ ID NO: 1661531 - protein, 18 aa, Staphylococcus aureus
GSEAAYQLSERGIKVNLI

SEQ ID NO: 1661532 - protein, 19 aa, Staphylococcus aureus
GSHYIWMARNFRSYNPRHL

SEQ ID NO: 1661533 - protein, 23 aa, Staphylococcus aureus
GSKDRYKIVHLIENGHVQKGTGK

SEQ ID NO: 1661534 - protein, 24 aa, Staphylococcus aureus
GSKLGLKLNKAFKGSDFKELTEEE

SEQ ID NO: 1661535 - protein, 19 aa, Staphylococcus aureus
GSLLLRVGKETQVYRYFGQ

SEQ ID NO: 1661536 - protein, 18 aa, Staphylococcus aureus
GSMLPKIEAAIRFVESGE

SEQ ID NO: 1661537 - protein, 26 aa, Staphylococcus aureus
GTEPKIKLYVSLKCRNFDDVAQKINA

SEQ ID NO: 1661538 - protein, 17 aa, Staphylococcus aureus
GTFRTVLLPKVMFTNPK

SEQ ID NO: 1661539 - protein, 22 aa, Staphylococcus aureus
GTIHRIKCNAGFGHKDTTKTAG

SEQ ID NO: 1661540 - protein, 19 aa, Staphylococcus aureus
GTLYFKIPSIFGSEEAFHI

SEQ ID NO: 1661541 - protein, 24 aa, Staphylococcus aureus
GTQQFRLPVSWQHNHPFDIYRYKD

SEQ ID NO: 1661542 - protein, 22 aa, Staphylococcus aureus
GVFHSKYLLAWSNKKEDQITNY

SEQ ID NO: 1661543 - protein, 33 aa, Staphylococcus aureus
GVKNAFDFPGFVPAYIRPLFCEGKGQFRFAALS

SEQ ID NO: 1661544 - protein, 18 aa, Staphylococcus aureus
GVNFSEPFPEINDINDQR

SEQ ID NO: 1661545 - protein, 20 aa, Staphylococcus aureus
GVRFYMKKGFLMIELPSGRA

SEQ ID NO: 1661546 - protein, 21 aa, Staphylococcus aureus
GYKWFFAYPDEHIETVNTLTI

SEQ ID NO: 1661547 - protein, 17 aa, Staphylococcus aureus
GYNKFWHNKSFYRVVKG

SEQ ID NO: 1661548 - protein, 26 aa, Staphylococcus aureus
GYYQSLKDSFNYGYKYLTDTYKSYKE

SEQ ID NO: 1661549 - protein, 17 aa, Staphylococcus aureus
HAFKNLFTGDNFGKQVI

SEQ ID NO: 1661550 - protein, 25 aa, Staphylococcus aureus
HDDYKAGQIIGEWIGQQGYQQIEVF

SEQ ID NO: 1661551 - protein, 29 aa, Staphylococcus aureus
HDKEHPDPHIIGLVALPYLNASRDFGNAH

SEQ ID NO: 1661552 - protein, 17 aa, Staphylococcus aureus
HDTIVAGGNYTNTSPDK

SEQ ID NO: 1661553 - protein, 18 aa, Staphylococcus aureus
HGELMIKGANVMNGYLYP

SEQ ID NO: 1661554 - protein, 20 aa, Staphylococcus aureus
HGHTFKSDFKNVAKGDWVNK

SEQ ID NO: 1661555 - protein, 19 aa, Staphylococcus aureus
HHAIKLGKVTHIFITHMHG

SEQ ID NO: 1661556 - protein, 17 aa, Staphylococcus aureus
HHGYLSINFLHYHDSYK

SEQ ID NO: 1661557 - protein, 19 aa, Staphylococcus aureus
HHQCGIALNQLIPSKKEGE

SEQ ID NO: 1661558 - protein, 22 aa, Staphylococcus aureus
HILEGLRIALDHIDEIISTIRE

SEQ ID NO: 1661559 - protein, 24 aa, Staphylococcus aureus
HIMRQKRVDAIFVVDSNNHLLGFL

SEQ ID NO: 1661560 - protein, 23 aa, Staphylococcus aureus
HIMRQKRVDTIFVVDSDNHLLGF

SEQ ID NO: 1661561 - protein, 17 aa, Staphylococcus aureus
HKNCVFLVDTFHTLKSG

SEQ ID NO: 1661562 - protein, 21 aa, Staphylococcus aureus
HKRLEKLFIKYLGVEDTEVNR

SEQ ID NO: 1661563 - protein, 20 aa, Staphylococcus aureus
HKTAIIACINRLLKTIHYLV

SEQ ID NO: 1661564 - protein, 28 aa, Staphylococcus aureus
HKTPAQVVLRWHLAHNRIIIPKSQTPKR

SEQ ID NO: 1661565 - protein, 25 aa, Staphylococcus aureus
HLLNHGVPSYGYRVMAPETTGTINV

SEQ ID NO: 1661566 - protein, 21 aa, Staphylococcus aureus
HLSSYYKFKQPTLLYDQQIQR

SEQ ID NO: 1661567 - protein, 20 aa, Staphylococcus aureus
HNFASGLSYHVLTMLRVAKS

SEQ ID NO: 1661568 - protein, 19 aa, Staphylococcus aureus
HPHLKNNFYGLIDGKEFKL

SEQ ID NO: 1661569 - protein, 18 aa, Staphylococcus aureus
HPSVESIQKYANLLRKDL

SEQ ID NO: 1661570 - protein, 25 aa, Staphylococcus aureus
HQIRVLRELEFHFQLVIDANESLDR

SEQ ID NO: 1661571 - protein, 21 aa, Staphylococcus aureus
HRKDLKFNLYVTTLHNALIEM

SEQ ID NO: 1661572 - protein, 21 aa, Staphylococcus aureus
HRKDLKFNLYVTTLHTSLIEM

SEQ ID NO: 1661573 - protein, 22 aa, Staphylococcus aureus
HSQCLKQNLIDHNSIFIDGTKV

SEQ ID NO: 1661574 - protein, 17 aa, Staphylococcus aureus
HTIMCKLAGPQHREFQK

SEQ ID NO: 1661575 - protein, 19 aa, Staphylococcus aureus
HTYKVSKYWWSILLTNTNV

SEQ ID NO: 1661576 - protein, 17 aa, Staphylococcus aureus
HVACLLSQAGSSCNIHP

SEQ ID NO: 1661577 - protein, 21 aa, Staphylococcus aureus
HVFQNKILRKEITFNDKNKMS

SEQ ID NO: 1661578 - protein, 23 aa, Staphylococcus aureus
HVKPATKPDASWDEMKQKAVEIG

SEQ ID NO: 1661579 - protein, 19 aa, Staphylococcus aureus
HYKHLFALLELAKKQGVEK

SEQ ID NO: 1661580 - protein, 17 aa, Staphylococcus aureus
HYYMYKKFGIWPEKEYA

SEQ ID NO: 1661581 - protein, 22 aa, Staphylococcus aureus
IAARARGRYGGRPEKLNKQDLN

SEQ ID NO: 1661582 - protein, 18 aa, Staphylococcus aureus
IADHDTIVAGGNYTNTSP

SEQ ID NO: 1661583 - protein, 22 aa, Staphylococcus aureus
IAEALTSHFEFTKLTLPLLKNA

SEQ ID NO: 1661584 - protein, 17 aa, Staphylococcus aureus
IAGRRILLKEVRDSIFR

SEQ ID NO: 1661585 - protein, 24 aa, Staphylococcus aureus
IAGSYAERIPVIAITGAPTRAVEQ

SEQ ID NO: 1661586 - protein, 25 aa, Staphylococcus aureus
IAIMSGNFVMRGEPAIYNKFTRAKM

SEQ ID NO: 1661587 - protein, 21 aa, Staphylococcus aureus
IALNIAEIFTHPDVVLDIDKD

SEQ ID NO: 1661588 - protein, 21 aa, Staphylococcus aureus
IANDMRIGELLAIKRVNINYE

SEQ ID NO: 1661589 - protein, 29 aa, Staphylococcus aureus
IANEISGMIPVEWEKVYTIAYVNDRGGEV

SEQ ID NO: 1661590 - protein, 26 aa, Staphylococcus aureus
IANEISGMIPVEWENIYTIAYVTDQG

SEQ ID NO: 1661591 - protein, 30 aa, Staphylococcus aureus
IANKISSMIPVEWEKVYAMAYIDDEGGEVF

SEQ ID NO: 1661592 - protein, 22 aa, Staphylococcus aureus
IAVPLDLPALFKGYYKEPERTA

SEQ ID NO: 1661593 - protein, 25 aa, Staphylococcus aureus
ICFEGKRWRTVILGSSDREKSIQSL

SEQ ID NO: 1661594 - protein, 20 aa, Staphylococcus aureus
ICKAPKYTGKTWITYEELIK

SEQ ID NO: 1661595 - protein, 29 aa, Staphylococcus aureus
IDAYLKVAYQFSLPFGKDYADAHEKMVRE

SEQ ID NO: 1661596 - protein, 20 aa, Staphylococcus aureus
IDFITGHSLGGRDAVVLGMS

SEQ ID NO: 1661597 - protein, 17 aa, Staphylococcus aureus
IDISSKVQALAQKYRDI

SEQ ID NO: 1661598 - protein, 20 aa, Staphylococcus aureus
IDKAATCSIKKFNPETGEFE

SEQ ID NO: 1661599 - protein, 17 aa, Staphylococcus aureus
IDKCRFKRQVVPGDTLT

SEQ ID NO: 1661600 - protein, 21 aa, Staphylococcus aureus
IDKLICSWLKQIDNVIPQLIT

SEQ ID NO: 1661601 - protein, 17 aa, Staphylococcus aureus
IDNHFQLLLYISENHCQ

SEQ ID NO: 1661602 - protein, 24 aa, Staphylococcus aureus
IDTLKEFGCGCVYSERISGVKRTE

SEQ ID NO: 1661603 - protein, 21 aa, Staphylococcus aureus
IDYDKFTVHAAIFKEENNMNI

SEQ ID NO: 1661604 - protein, 24 aa, Staphylococcus aureus
IEALKRGTAILITGGFKPSNKVIN

SEQ ID NO: 1661605 - protein, 25 aa, Staphylococcus aureus
IEANYKYARGVAVYGDIKDNTNDHG

SEQ ID NO: 1661606 - protein, 18 aa, Staphylococcus aureus
IEDGVVCFYSRSKQRLWT

SEQ ID NO: 1661607 - protein, 21 aa, Staphylococcus aureus
IEDIYQLPGHVFIFGGQILFE

SEQ ID NO: 1661608 - protein, 17 aa, Staphylococcus aureus
IEITGSELVRGRGGPRC

SEQ ID NO: 1661609 - protein, 19 aa, Staphylococcus aureus
IENFKFFGQYADFKDLKNY

SEQ ID NO: 1661610 - protein, 20 aa, Staphylococcus aureus
IENFKFFGQYADFKDLKNYK

SEQ ID NO: 1661611 - protein, 18 aa, Staphylococcus aureus
IERFKNKPIQTIKKHDYQ

SEQ ID NO: 1661612 - protein, 17 aa, Staphylococcus aureus
IERGIIEIAPLAYMRGR

SEQ ID NO: 1661613 - protein, 17 aa, Staphylococcus aureus
IERILNMMIKRIEKEIN

SEQ ID NO: 1661614 - protein, 24 aa, Staphylococcus aureus
IERKGLKLVGGKLMQVPMELAETH

SEQ ID NO: 1661615 - protein, 27 aa, Staphylococcus aureus
IFELKHQFTHLTWKIKVYAVSGTINIE

SEQ ID NO: 1661616 - protein, 22 aa, Staphylococcus aureus
IFTHSWNDFCDITYRLKGEDHN

SEQ ID NO: 1661617 - protein, 17 aa, Staphylococcus aureus
IFTPHLVPMARGILSTI

SEQ ID NO: 1661618 - protein, 20 aa, Staphylococcus aureus
IFYYDCPPIDKIVYHPLLKK

SEQ ID NO: 1661619 - protein, 18 aa, Staphylococcus aureus
IGKLKTFFRVLKDEISQT

SEQ ID NO: 1661620 - protein, 31 aa, Staphylococcus aureus
IGRKAQEAYLSYRLEQEYSKDDIFQVYLNKI

SEQ ID NO: 1661621 - protein, 19 aa, Staphylococcus aureus
IGRKTFYLHYIDKYDLLDQ

SEQ ID NO: 1661622 - protein, 19 aa, Staphylococcus aureus
IGSAQKFSTGLLLKQLEEE

SEQ ID NO: 1661623 - protein, 30 aa, Staphylococcus aureus
IGVAPNNKFTMYRVFGSKKTELLWVSKAIV

SEQ ID NO: 1661624 - protein, 19 aa, Staphylococcus aureus
IGWKGWVYMDEQIAKHMKG

SEQ ID NO: 1661625 - protein, 18 aa, Staphylococcus aureus
IGYRIHFLNLYPVLYEAK

SEQ ID NO: 1661626 - protein, 20 aa, Staphylococcus aureus
IHEFKDYKLISVIKNSRAAR

SEQ ID NO: 1661627 - protein, 17 aa, Staphylococcus aureus
IHLIDILKKLSHDEIEA

SEQ ID NO: 1661628 - protein, 17 aa, Staphylococcus aureus
IHPDERSAAFFAVGLIK

SEQ ID NO: 1661629 - protein, 19 aa, Staphylococcus aureus
IIDDVVKGFITYKIPKKVI

SEQ ID NO: 1661630 - protein, 18 aa, Staphylococcus aureus
IIDELSICSDYLFVKIKG

SEQ ID NO: 1661631 - protein, 23 aa, Staphylococcus aureus
IIKEALHKLGFDEGMYDLIKEPL

SEQ ID NO: 1661632 - protein, 23 aa, Staphylococcus aureus
IIPEMLTENFIPRTELRETTMNI

SEQ ID NO: 1661633 - protein, 17 aa, Staphylococcus aureus
IIPMPHRIFDFYNAFIG

SEQ ID NO: 1661634 - protein, 20 aa, Staphylococcus aureus
IIPVHPWQFEHVIQVDLAEE

SEQ ID NO: 1661635 - protein, 19 aa, Staphylococcus aureus
IIVTGGGANIHFDSLSHYY

SEQ ID NO: 1661636 - protein, 18 aa, Staphylococcus aureus
IKAATIINAEHVKKSDKL

SEQ ID NO: 1661637 - protein, 28 aa, Staphylococcus aureus
IKDGKKRYYNFFGIGAFDSSAVRSGKSY

SEQ ID NO: 1661638 - protein, 23 aa, Staphylococcus aureus
IKEKPKARWLFLTLSTKNAIDGD

SEQ ID NO: 1661639 - protein, 19 aa, Staphylococcus aureus
IKESCVFKGTLNSSIVHPR

SEQ ID NO: 1661640 - protein, 20 aa, Staphylococcus aureus
IKFLKYFTFLGKEEIDRLEQ

SEQ ID NO: 1661641 - protein, 21 aa, Staphylococcus aureus
IKFLYELQDGYTIETVLMRHD

SEQ ID NO: 1661642 - protein, 18 aa, Staphylococcus aureus
IKIPANILFGGKDAPSYE

SEQ ID NO: 1661643 - protein, 21 aa, Staphylococcus aureus
IKKDEVLSGFLYLTDLEEDMP

SEQ ID NO: 1661644 - protein, 23 aa, Staphylococcus aureus
IKKGKTAQAMFIYELRGDGNINL

SEQ ID NO: 1661645 - protein, 24 aa, Staphylococcus aureus
IKKKDDKAYKCSFYNPETTNTASN

SEQ ID NO: 1661646 - protein, 29 aa, Staphylococcus aureus
IKLSNDAKMAWGILRDRLDLSIKNGWVDS

SEQ ID NO: 1661647 - protein, 20 aa, Staphylococcus aureus
IKMSDEILQQFEAVKDDNAK

SEQ ID NO: 1661648 - protein, 28 aa, Staphylococcus aureus
IKYDGAYCINGYRWITYIANSGQRRYIA

SEQ ID NO: 1661649 - protein, 23 aa, Staphylococcus aureus
IKYKELLDAGVLSQEEFDKKKQQ

SEQ ID NO: 1661650 - protein, 24 aa, Staphylococcus aureus
IKYQWAPKYSKEFFILFMNIMYSK

SEQ ID NO: 1661651 - protein, 17 aa, Staphylococcus aureus
ILDVGCNQGGFLRQLYD

SEQ ID NO: 1661652 - protein, 31 aa, Staphylococcus aureus
ILGICLGAQALTCYYGGEVIKGDKVMHGKVD

SEQ ID NO: 1661653 - protein, 17 aa, Staphylococcus aureus
ILNLVMLCGCQGVNGGG

SEQ ID NO: 1661654 - protein, 18 aa, Staphylococcus aureus
ILPFLKKGNTIIVESTIA

SEQ ID NO: 1661655 - protein, 21 aa, Staphylococcus aureus
ILPMIGKFVFVYSIKRVIEFS

SEQ ID NO: 1661656 - protein, 18 aa, Staphylococcus aureus
ILVPFKKKFEVQHMPIYN

SEQ ID NO: 1661657 - protein, 17 aa, Staphylococcus aureus
IMGMTFHLVCPKELNPT

SEQ ID NO: 1661658 - protein, 26 aa, Staphylococcus aureus
INAVTPKVVKKQAAKDEIDQLQATQT

SEQ ID NO: 1661659 - protein, 20 aa, Staphylococcus aureus
INGNVPIFINIGEWDGDDEE

SEQ ID NO: 1661660 - protein, 20 aa, Staphylococcus aureus
INLSELCYGLGKVISDELQA

SEQ ID NO: 1661661 - protein, 19 aa, Staphylococcus aureus
INLVKDCATHISIMQQGKL

SEQ ID NO: 1661662 - protein, 23 aa, Staphylococcus aureus
INNKFKEAFSMVVSSREDKYETK

SEQ ID NO: 1661663 - protein, 17 aa, Staphylococcus aureus
INPFEIFSEEVFEKEDE

SEQ ID NO: 1661664 - protein, 20 aa, Staphylococcus aureus
INPKKCIALKISEEKLNRIR

SEQ ID NO: 1661665 - protein, 23 aa, Staphylococcus aureus
INRPKWMHHALKMYQIAPRFFER

SEQ ID NO: 1661666 - protein, 19 aa, Staphylococcus aureus
INVDGFDFKLAVKKQDYSI

SEQ ID NO: 1661667 - protein, 17 aa, Staphylococcus aureus
INVVVFKKQAENVKNYL

SEQ ID NO: 1661668 - protein, 25 aa, Staphylococcus aureus
INVYKSILQNVAMNFMDKEQYETTT

SEQ ID NO: 1661669 - protein, 37 aa, Staphylococcus aureus
IPHENIIKLPARFHKKSLPVPKYRYFKLNNKKIQKML

SEQ ID NO: 1661670 - protein, 17 aa, Staphylococcus aureus
IPSETKLHYIVEFQELE

SEQ ID NO: 1661671 - protein, 18 aa, Staphylococcus aureus
IPSNGVWYDHIGIDKERR

SEQ ID NO: 1661672 - protein, 17 aa, Staphylococcus aureus
IPTYKYLLHLGTQRLNK

SEQ ID NO: 1661673 - protein, 23 aa, Staphylococcus aureus
IQEKRIDLFFKHNLNNYKNMKVT

SEQ ID NO: 1661674 - protein, 21 aa, Staphylococcus aureus
IQELFPEYFFIERVPKMHKNE

SEQ ID NO: 1661675 - protein, 17 aa, Staphylococcus aureus
IQKATQIQKAIQTQIAI

SEQ ID NO: 1661676 - protein, 25 aa, Staphylococcus aureus
IQPILKEKFIALGLDVKEDQAAKHP

SEQ ID NO: 1661677 - protein, 24 aa, Staphylococcus aureus
IQQRFTLNMLYPYIDEINISKNKS

SEQ ID NO: 1661678 - protein, 23 aa, Staphylococcus aureus
IQSEDGVDIVIHIGLNTVDLEGK

SEQ ID NO: 1661679 - protein, 23 aa, Staphylococcus aureus
IQVLPKLAELIGLNEAIVLQQIH

SEQ ID NO: 1661680 - protein, 35 aa, Staphylococcus aureus
IRDVFGYSVDKGWMCIQVFFIRQGNMIKRDTTMIP

SEQ ID NO: 1661681 - protein, 24 aa, Staphylococcus aureus
IREKNSIIVLQRFVAMKNITHIIS

SEQ ID NO: 1661682 - protein, 19 aa, Staphylococcus aureus
IRKLKLDKDDLVIQKNHNG

SEQ ID NO: 1661683 - protein, 18 aa, Staphylococcus aureus
IRKLTLNITLMFDGDFAG

SEQ ID NO: 1661684 - protein, 25 aa, Staphylococcus aureus
IRPLIKRYAIQFIHHQTKLHYEKSE

SEQ ID NO: 1661685 - protein, 23 aa, Staphylococcus aureus
IRRVFEEFLSFKLKNSDLAQKSN

SEQ ID NO: 1661686 - protein, 17 aa, Staphylococcus aureus
IRYIEQFGLSNSLKRKV

SEQ ID NO: 1661687 - protein, 26 aa, Staphylococcus aureus
ISDLQLIRRSVCEFINGHSLIDTSIL

SEQ ID NO: 1661688 - protein, 17 aa, Staphylococcus aureus
ISDNVIPYDAFRNNFLD

SEQ ID NO: 1661689 - protein, 23 aa, Staphylococcus aureus
ISKELRDKYEWNPSLLSKIDNYL

SEQ ID NO: 1661690 - protein, 18 aa, Staphylococcus aureus
ISKLASIELLRANMMTTN

SEQ ID NO: 1661691 - protein, 21 aa, Staphylococcus aureus
ISKLASIELLRANMMTTNGGG

SEQ ID NO: 1661692 - protein, 17 aa, Staphylococcus aureus
ISMLGWDPQSPVPINDH

SEQ ID NO: 1661693 - protein, 20 aa, Staphylococcus aureus
ISQTTLMSLFSFFQDPELEV

SEQ ID NO: 1661694 - protein, 17 aa, Staphylococcus aureus
ISSFIPIDTPFIVEVEE

SEQ ID NO: 1661695 - protein, 27 aa, Staphylococcus aureus
ITITEGFARCIPMIFLNPAPGQELENA

SEQ ID NO: 1661696 - protein, 24 aa, Staphylococcus aureus
ITKWNRKTVLGWMRNPILRGHTKH

SEQ ID NO: 1661697 - protein, 23 aa, Staphylococcus aureus
ITNKWSEMMLWSSRQRSQYTVQL

SEQ ID NO: 1661698 - protein, 32 aa, Staphylococcus aureus
IVAEGPGSYTGLRIGVTVAKILAYALDVKLYG

SEQ ID NO: 1661699 - protein, 23 aa, Staphylococcus aureus
IVINLSLPMTISFLEKLSIKSIH

SEQ ID NO: 1661700 - protein, 17 aa, Staphylococcus aureus
IVLIHSKLGRTMSLSKD

SEQ ID NO: 1661701 - protein, 25 aa, Staphylococcus aureus
IVNRLPKSMPQYHVGHIQQIRQIQA

SEQ ID NO: 1661702 - protein, 24 aa, Staphylococcus aureus
IVRRDLSQMMTFKGDPEFTIVNRL

SEQ ID NO: 1661703 - protein, 25 aa, Staphylococcus aureus
IVVGNTYGRIRAMVNDLGQRIKMAG

SEQ ID NO: 1661704 - protein, 18 aa, Staphylococcus aureus
IVVTETFKAFVIDKDESG

SEQ ID NO: 1661705 - protein, 23 aa, Staphylococcus aureus
IYHLYDDRGLWLAFNNNEDYARY

SEQ ID NO: 1661706 - protein, 18 aa, Staphylococcus aureus
IYNDIAITAQYIAKEYNQ

SEQ ID NO: 1661707 - protein, 27 aa, Staphylococcus aureus
IYNTFDWKDVEQAFSWSETGKMNMAYE

SEQ ID NO: 1661708 - protein, 25 aa, Staphylococcus aureus
IYQTEYLNQFYALYDYKGYNDYHLS

SEQ ID NO: 1661709 - protein, 17 aa, Staphylococcus aureus
IYYDVPYDLNEPNTDDT

SEQ ID NO: 1661710 - protein, 24 aa, Staphylococcus aureus
KAFDRLKLNIFISLAELESDNIGE

SEQ ID NO: 1661711 - protein, 20 aa, Staphylococcus aureus
KAGEVFNSKTSFRIEEKVEN

SEQ ID NO: 1661712 - protein, 24 aa, Staphylococcus aureus
KAIKKELKKLQGYAEENNKSFVKH

SEQ ID NO: 1661713 - protein, 24 aa, Staphylococcus aureus
KAIKKELKKLQGYAEENNKSFVKN

SEQ ID NO: 1661714 - protein, 24 aa, Staphylococcus aureus
KAIKKELKKVQGYVEENNKSFVKN

SEQ ID NO: 1661715 - protein, 21 aa, Staphylococcus aureus
KAIRGEGAFCNGIKMEEPPSL

SEQ ID NO: 1661716 - protein, 24 aa, Staphylococcus aureus
KAMLNEGYQFFGVLYIGAILTKNG

SEQ ID NO: 1661717 - protein, 20 aa, Staphylococcus aureus
KAPKPLAGLNGESHDFTTTH

SEQ ID NO: 1661718 - protein, 17 aa, Staphylococcus aureus
KAQAFDEILEGMTNAIQ

SEQ ID NO: 1661719 - protein, 17 aa, Staphylococcus aureus
KASAWDRYCKSVERDLI

SEQ ID NO: 1661720 - protein, 19 aa, Staphylococcus aureus
KASESAGWIKELESGGHAS

SEQ ID NO: 1661721 - protein, 20 aa, Staphylococcus aureus
KASKMKWVFQFEIVSAHGVH

SEQ ID NO: 1661722 - protein, 25 aa, Staphylococcus aureus
KATKPARIKLKWTPQIMHQIRVLRE

SEQ ID NO: 1661723 - protein, 21 aa, Staphylococcus aureus
KAYFNITGLGFAKLTKEGAKL

SEQ ID NO: 1661724 - protein, 17 aa, Staphylococcus aureus
KAYSESTIDRWFTNALK

SEQ ID NO: 1661725 - protein, 18 aa, Staphylococcus aureus
KAYYKWRVDETYIKIKGQ

SEQ ID NO: 1661726 - protein, 38 aa, Staphylococcus aureus
KCTKAEFIKRLACLPSHIYRLKGFMTFEDTAHTYLIQF

SEQ ID NO: 1661727 - protein, 24 aa, Staphylococcus aureus
KDAAKRQIEGATHVNEVTQAQNNA

SEQ ID NO: 1661728 - protein, 19 aa, Staphylococcus aureus
KDAYTNAVAHAEGILSKAN

SEQ ID NO: 1661729 - protein, 19 aa, Staphylococcus aureus
KDIIDYSLYIKKGLVEPFI

SEQ ID NO: 1661730 - protein, 20 aa, Staphylococcus aureus
KDKDVPVWLDRNSPFNIEGG

SEQ ID NO: 1661731 - protein, 17 aa, Staphylococcus aureus
KDKIIILAYKPLSNDDE

SEQ ID NO: 1661732 - protein, 18 aa, Staphylococcus aureus
KDKLLAIADQRHKDEVRK

SEQ ID NO: 1661733 - protein, 27 aa, Staphylococcus aureus
KDLKEVLKPGGVYYASFADLTNNPSRQ

SEQ ID NO: 1661734 - protein, 25 aa, Staphylococcus aureus
KDLVECSIGLLAREVPEEVVNVVIA

SEQ ID NO: 1661735 - protein, 19 aa, Staphylococcus aureus
KEAFTNALEDILSKATEDI

SEQ ID NO: 1661736 - protein, 17 aa, Staphylococcus aureus
KEAKKFPSNLEYVDSYT

SEQ ID NO: 1661737 - protein, 20 aa, Staphylococcus aureus
KEDVLQMMQLLGLRQGEQLL

SEQ ID NO: 1661738 - protein, 18 aa, Staphylococcus aureus
KEFEECIQIIRKSDSINE

SEQ ID NO: 1661739 - protein, 18 aa, Staphylococcus aureus
KEITSLKMGNIENQVEEI

SEQ ID NO: 1661740 - protein, 17 aa, Staphylococcus aureus
KEKHKILNLDDAEDGNL

SEQ ID NO: 1661741 - protein, 18 aa, Staphylococcus aureus
KEKLCKKSFINPQLSFED

SEQ ID NO: 1661742 - protein, 19 aa, Staphylococcus aureus
KELDFKLRKQLIEKHNLYG

SEQ ID NO: 1661743 - protein, 17 aa, Staphylococcus aureus
KELEGIMYKEKVIDVKE

SEQ ID NO: 1661744 - protein, 31 aa, Staphylococcus aureus
KELEIPQELKLVPNWVLWRAEWNEKQQNFGK

SEQ ID NO: 1661745 - protein, 21 aa, Staphylococcus aureus
KELFENYILDNWDKVNQSINE

SEQ ID NO: 1661746 - protein, 19 aa, Staphylococcus aureus
KELKEMYKTGLWEFETHTH

SEQ ID NO: 1661747 - protein, 19 aa, Staphylococcus aureus
KERGVGKCVSGIAGGAVTG

SEQ ID NO: 1661748 - protein, 20 aa, Staphylococcus aureus
KESFEYRSLEKLAEVEQTQM

SEQ ID NO: 1661749 - protein, 20 aa, Staphylococcus aureus
KESIIYFKFIEVKHLKLNTS

SEQ ID NO: 1661750 - protein, 26 aa, Staphylococcus aureus
KESNLYRLLREISMESVKCIEPMNDV

SEQ ID NO: 1661751 - protein, 20 aa, Staphylococcus aureus
KETVDLPVIGIVKRDYNHSD

SEQ ID NO: 1661752 - protein, 17 aa, Staphylococcus aureus
KEVQKDIAIYTPLTGEF

SEQ ID NO: 1661753 - protein, 27 aa, Staphylococcus aureus
KEWETGAGTRIRFLKEIEVDRPQDTEE

SEQ ID NO: 1661754 - protein, 20 aa, Staphylococcus aureus
KFAFEKAIIYAFNILNMHKI

SEQ ID NO: 1661755 - protein, 17 aa, Staphylococcus aureus
KFFKEREGKYRVEGSFI

SEQ ID NO: 1661756 - protein, 18 aa, Staphylococcus aureus
KFMHYLLRAQERYQMTIV

SEQ ID NO: 1661757 - protein, 18 aa, Staphylococcus aureus
KFTLDFYLKPFVKTKIKA

SEQ ID NO: 1661758 - protein, 21 aa, Staphylococcus aureus
KFTTNKFKVFAAISDTVIHGS

SEQ ID NO: 1661759 - protein, 19 aa, Staphylococcus aureus
KFVYFLVNGCILHESSNIT

SEQ ID NO: 1661760 - protein, 17 aa, Staphylococcus aureus
KGARDVIIQKGDLVKID

SEQ ID NO: 1661761 - protein, 24 aa, Staphylococcus aureus
KGFQKKIMYCFNKINAKAQKNRQK

SEQ ID NO: 1661762 - protein, 22 aa, Staphylococcus aureus
KGILENRGKVFLEAQEKYEVNV

SEQ ID NO: 1661763 - protein, 20 aa, Staphylococcus aureus
KGKKSIAIRLNYLDTEETLT

SEQ ID NO: 1661764 - protein, 20 aa, Staphylococcus aureus
KGKVTGIKKFGAFVELPEGK

SEQ ID NO: 1661765 - protein, 17 aa, Staphylococcus aureus
KGQFRFAALSGDPKDIE

SEQ ID NO: 1661766 - protein, 24 aa, Staphylococcus aureus
KGTFSYLACRQYFSEKETTFQPKS

SEQ ID NO: 1661767 - protein, 20 aa, Staphylococcus aureus
KGWNKKQLKDVLEFSNKRTI

SEQ ID NO: 1661768 - protein, 21 aa, Staphylococcus aureus
KHAFSEKLKALGYGIDKEAQI

SEQ ID NO: 1661769 - protein, 21 aa, Staphylococcus aureus
KHDLAALSYLTFVALDDDGKP

SEQ ID NO: 1661770 - protein, 19 aa, Staphylococcus aureus
KHMNEWMASSQLMITKPGG

SEQ ID NO: 1661771 - protein, 19 aa, Staphylococcus aureus
KHVEHLSSYYKFKQPTLLY

SEQ ID NO: 1661772 - protein, 20 aa, Staphylococcus aureus
KIDMRLAAYIIGIKRTAEAA

SEQ ID NO: 1661773 - protein, 25 aa, Staphylococcus aureus
KIDMSEIKTALIAVGPENDKGKRLE

SEQ ID NO: 1661774 - protein, 20 aa, Staphylococcus aureus
KIFFSTGFSDGFVRFHPNTN

SEQ ID NO: 1661775 - protein, 22 aa, Staphylococcus aureus
KIGGMPFLKSFKDIPLDENNVP

SEQ ID NO: 1661776 - protein, 23 aa, Staphylococcus aureus
KIGGMPFLKYFKDIPLDENNVPM

SEQ ID NO: 1661777 - protein, 20 aa, Staphylococcus aureus
KIIGFAYCYTLLRPDGKTMF

SEQ ID NO: 1661778 - protein, 25 aa, Staphylococcus aureus
KIRFLKLKVGKIINVAKVDIIAFDK

SEQ ID NO: 1661779 - protein, 23 aa, Staphylococcus aureus
KKARKLLFWVIMNIIRGQHHYDN

SEQ ID NO: 1661780 - protein, 19 aa, Staphylococcus aureus
KKCYESLALKHFIENTNDY

SEQ ID NO: 1661781 - protein, 26 aa, Staphylococcus aureus
KKEIIKRYKYNNIYFYSSIIKEDDIK

SEQ ID NO: 1661782 - protein, 20 aa, Staphylococcus aureus
KKETVDFYLAKGVVDRVAEK

SEQ ID NO: 1661783 - protein, 30 aa, Staphylococcus aureus
KKFFRPEFLNRFNGIVEFLHLDKESLQEII

SEQ ID NO: 1661784 - protein, 18 aa, Staphylococcus aureus
KKFYPTKYLLIYNDNKTV

SEQ ID NO: 1661785 - protein, 27 aa, Staphylococcus aureus
KKIPFERAAAFGCAIITGIGAVVNTAQ

SEQ ID NO: 1661786 - protein, 23 aa, Staphylococcus aureus
KKKGEALLLYGTQRAFIRIDLDR

SEQ ID NO: 1661787 - protein, 30 aa, Staphylococcus aureus
KKLSKYQVFAAHWDRYEVELGDLKYSDEIL

SEQ ID NO: 1661788 - protein, 18 aa, Staphylococcus aureus
KKLTPFLRELEKRDIQYK

SEQ ID NO: 1661789 - protein, 23 aa, Staphylococcus aureus
KKNRRSLQIYGFSPCHEISIMLA

SEQ ID NO: 1661790 - protein, 18 aa, Staphylococcus aureus
KKQIEALVYNFYEVNNIN

SEQ ID NO: 1661791 - protein, 18 aa, Staphylococcus aureus
KKTELLWVSKAIVQAAND

SEQ ID NO: 1661792 - protein, 17 aa, Staphylococcus aureus
KLFHPVHTYKMKFIKSF

SEQ ID NO: 1661793 - protein, 18 aa, Staphylococcus aureus
KLKALGYGIDKEAQIDLF

SEQ ID NO: 1661794 - protein, 24 aa, Staphylococcus aureus
KLLAEKGYSCALLTLDDKNYDPLR

SEQ ID NO: 1661795 - protein, 17 aa, Staphylococcus aureus
KLLSTAGAYWRGDSNNK

SEQ ID NO: 1661796 - protein, 18 aa, Staphylococcus aureus
KLNDLRSRVKLETDGKLL

SEQ ID NO: 1661797 - protein, 19 aa, Staphylococcus aureus
KLPPTPIFHKNHETGKEDF

SEQ ID NO: 1661798 - protein, 18 aa, Staphylococcus aureus
KLQNACEYFNLPTQKEGF

SEQ ID NO: 1661799 - protein, 18 aa, Staphylococcus aureus
KLRETFKEEGLEPWTSSE

SEQ ID NO: 1661800 - protein, 19 aa, Staphylococcus aureus
KLSKEMKHDNSLSRSEIEL

SEQ ID NO: 1661801 - protein, 20 aa, Staphylococcus aureus
KLVSYIACGATGAGIGEELY

SEQ ID NO: 1661802 - protein, 25 aa, Staphylococcus aureus
KLYECDDCSECPLKNQCMNFNSKTN

SEQ ID NO: 1661803 - protein, 20 aa, Staphylococcus aureus
KMHIDGDLKGSSVGYKRLEI

SEQ ID NO: 1661804 - protein, 27 aa, Staphylococcus aureus
KMMRDIKKDIGMIFQHFNLLNSATVFK

SEQ ID NO: 1661805 - protein, 20 aa, Staphylococcus aureus
KMYGGTCINVGCIPSKTLVH

SEQ ID NO: 1661806 - protein, 24 aa, Staphylococcus aureus
KNGKAELLAPMSAIAGQRSAIMGA

SEQ ID NO: 1661807 - protein, 17 aa, Staphylococcus aureus
KNIALLFEKDSTRTRCA

SEQ ID NO: 1661808 - protein, 23 aa, Staphylococcus aureus
KNLSERRKAEVLYEELAHHKLTY

SEQ ID NO: 1661809 - protein, 25 aa, Staphylococcus aureus
KPACTVITMYLHLDGVLSLDLTTVL

SEQ ID NO: 1661810 - protein, 26 aa, Staphylococcus aureus
KPLAKEVFRNELLRWNEENINKTSIN

SEQ ID NO: 1661811 - protein, 22 aa, Staphylococcus aureus
KPLPNRRNVVLTSDTSFNVEGV

SEQ ID NO: 1661812 - protein, 20 aa, Staphylococcus aureus
KPTGQKILFRGLDDPLKITS

SEQ ID NO: 1661813 - protein, 17 aa, Staphylococcus aureus
KQIAALLQRIFQNIESM

SEQ ID NO: 1661814 - protein, 28 aa, Staphylococcus aureus
KQYITRLFQLSNIETWECEALEEAAENI

SEQ ID NO: 1661815 - protein, 17 aa, Staphylococcus aureus
KRFNSLASFNTNINIIP

SEQ ID NO: 1661816 - protein, 18 aa, Staphylococcus aureus
KRGCIVVTETFKAFVIDK

SEQ ID NO: 1661817 - protein, 18 aa, Staphylococcus aureus
KRHSYLFLNIVEVYYKDK

SEQ ID NO: 1661818 - protein, 19 aa, Staphylococcus aureus
KRIENFKFFGQYANFKDLE

SEQ ID NO: 1661819 - protein, 19 aa, Staphylococcus aureus
KRKLISFCEVNDWDRYEVF

SEQ ID NO: 1661820 - protein, 18 aa, Staphylococcus aureus
KRMNELFGNVEVVNKDKG

SEQ ID NO: 1661821 - protein, 20 aa, Staphylococcus aureus
KRNYVTIIMLNDLYQIDGND

SEQ ID NO: 1661822 - protein, 19 aa, Staphylococcus aureus
KRSASIYVAFNVKDDKGVV

SEQ ID NO: 1661823 - protein, 22 aa, Staphylococcus aureus
KRTLHYYDEIGLLVPDKNDKNY

SEQ ID NO: 1661824 - protein, 22 aa, Staphylococcus aureus
KRVDELLEMVGLEPEKYKNRKP

SEQ ID NO: 1661825 - protein, 20 aa, Staphylococcus aureus
KRYQSAASLSNFESSAKSWI

SEQ ID NO: 1661826 - protein, 23 aa, Staphylococcus aureus
KSDEMKLEPVLAVDDDEHKRNIT

SEQ ID NO: 1661827 - protein, 17 aa, Staphylococcus aureus
KSFKQDQFEIVKVATDY

SEQ ID NO: 1661828 - protein, 25 aa, Staphylococcus aureus
KSIDVQLIFCTLPLELRGFQIVSLD

SEQ ID NO: 1661829 - protein, 17 aa, Staphylococcus aureus
KSINGNVRFYGGKTDPM

SEQ ID NO: 1661830 - protein, 20 aa, Staphylococcus aureus
KSINGNVRFYGGKTDPMEKR

SEQ ID NO: 1661831 - protein, 20 aa, Staphylococcus aureus
KSISFSLGYQIQHLVELVKE

SEQ ID NO: 1661832 - protein, 23 aa, Staphylococcus aureus
KSKYLGSFVNEWEAAKAYNSAVD

SEQ ID NO: 1661833 - protein, 18 aa, Staphylococcus aureus
KSRSMGTVSYTYNDGVPD

SEQ ID NO: 1661834 - protein, 17 aa, Staphylococcus aureus
KSSALPLVILAAVADTE

SEQ ID NO: 1661835 - protein, 17 aa, Staphylococcus aureus
KSSFYYDLFDFKGKKRV

SEQ ID NO: 1661836 - protein, 17 aa, Staphylococcus aureus
KSSMFVAHIMNVDRHDH

SEQ ID NO: 1661837 - protein, 23 aa, Staphylococcus aureus
KSSRTSLTISNDVYFDLGSRRGS

SEQ ID NO: 1661838 - protein, 20 aa, Staphylococcus aureus
KSTMINLLIEQDILPSSPVP

SEQ ID NO: 1661839 - protein, 19 aa, Staphylococcus aureus
KTGADLTDLSHVYVAKRDP

SEQ ID NO: 1661840 - protein, 19 aa, Staphylococcus aureus
KTIMTELAKDIGLEQDIVT

SEQ ID NO: 1661841 - protein, 17 aa, Staphylococcus aureus
KTLHIIHPKDRVVSLDH

SEQ ID NO: 1661842 - protein, 22 aa, Staphylococcus aureus
KTLIEYMDYLSLKDPKRILKSY

SEQ ID NO: 1661843 - protein, 24 aa, Staphylococcus aureus
KTLKEANLDFGVEICEPQPPSEDF

SEQ ID NO: 1661844 - protein, 21 aa, Staphylococcus aureus
KTLQRKLGKTFIFVTHDMDEA

SEQ ID NO: 1661845 - protein, 19 aa, Staphylococcus aureus
KTTLATRENNAFIIDIHED

SEQ ID NO: 1661846 - protein, 19 aa, Staphylococcus aureus
KTVKINLPEHVTKAQPSET

SEQ ID NO: 1661847 - protein, 17 aa, Staphylococcus aureus
KTVNPFDHKAVPGGSSG

SEQ ID NO: 1661848 - protein, 26 aa, Staphylococcus aureus
KTYSLGMKQKLGIAIAFLNDPQFIIL

SEQ ID NO: 1661849 - protein, 27 aa, Staphylococcus aureus
KTYSLGMKQKLGIAIAFLNEPQFIILD

SEQ ID NO: 1661850 - protein, 17 aa, Staphylococcus aureus
KVADDWIENIKLMNDKN

SEQ ID NO: 1661851 - protein, 17 aa, Staphylococcus aureus
KVEMVAPQYYEEYNGPI

SEQ ID NO: 1661852 - protein, 18 aa, Staphylococcus aureus
KVIAPFNGLISMIVPTKH

SEQ ID NO: 1661853 - protein, 18 aa, Staphylococcus aureus
KVIIIKRNDNVIIVSYEN

SEQ ID NO: 1661854 - protein, 19 aa, Staphylococcus aureus
KVISRAQVILSEFEASADK

SEQ ID NO: 1661855 - protein, 22 aa, Staphylococcus aureus
KVNELEKQIEIFETRAKNDEKY

SEQ ID NO: 1661856 - protein, 25 aa, Staphylococcus aureus
KVRRNPYSVILFDEIEKANPQILTL

SEQ ID NO: 1661857 - protein, 17 aa, Staphylococcus aureus
KWIKAMPLLESKEHRKT

SEQ ID NO: 1661858 - protein, 24 aa, Staphylococcus aureus
KYFEGEGLSILGYRNVPVNKDAIA

SEQ ID NO: 1661859 - protein, 23 aa, Staphylococcus aureus
KYLRPETLFGNKFEGYLNQKAEP

SEQ ID NO: 1661860 - protein, 18 aa, Staphylococcus aureus
KYSEKYYAIIGAQNNDQQ

SEQ ID NO: 1661861 - protein, 19 aa, Staphylococcus aureus
KYTLDFYLKPFVKTKIKAW

SEQ ID NO: 1661862 - protein, 30 aa, Staphylococcus aureus
KYVHLLSEYGVWHPRAWEFAPSRVDFPTTN

SEQ ID NO: 1661863 - protein, 25 aa, Staphylococcus aureus
LADALGVNVSELFTRNHNTHKLEDW

SEQ ID NO: 1661864 - protein, 17 aa, Staphylococcus aureus
LADITVNAMKGIYLRYD

SEQ ID NO: 1661865 - protein, 17 aa, Staphylococcus aureus
LAEEKGHEIVGVIEPTP

SEQ ID NO: 1661866 - protein, 17 aa, Staphylococcus aureus
LAELKQTADQNVNQATS

SEQ ID NO: 1661867 - protein, 20 aa, Staphylococcus aureus
LAFRGQELLTFIKEAAERYD

SEQ ID NO: 1661868 - protein, 17 aa, Staphylococcus aureus
LAIELQVGVPTLEDIIK

SEQ ID NO: 1661869 - protein, 17 aa, Staphylococcus aureus
LALGRGGDQVAIKSING

SEQ ID NO: 1661870 - protein, 17 aa, Staphylococcus aureus
LARKASRAVGKRGTDLP

SEQ ID NO: 1661871 - protein, 18 aa, Staphylococcus aureus
LASALFIYNEHEVYYLSS

SEQ ID NO: 1661872 - protein, 23 aa, Staphylococcus aureus
LAVYRRDLEDFSDRNNLDSLDKV

SEQ ID NO: 1661873 - protein, 19 aa, Staphylococcus aureus
LDFGNGFVKGKINDEKFVI

SEQ ID NO: 1661874 - protein, 19 aa, Staphylococcus aureus
LDMDLIYRRLDEIPNLRTM

SEQ ID NO: 1661875 - protein, 18 aa, Staphylococcus aureus
LDPSILLAPWNVIEERLK

SEQ ID NO: 1661876 - protein, 29 aa, Staphylococcus aureus
LDPSNGICLSLFLAKAFKKGFITFSNSYR

SEQ ID NO: 1661877 - protein, 18 aa, Staphylococcus aureus
LDTNMCANNSFLANELSS

SEQ ID NO: 1661878 - protein, 17 aa, Staphylococcus aureus
LDYDMINDLGFEIDYGT

SEQ ID NO: 1661879 - protein, 25 aa, Staphylococcus aureus
LEAKFKTSALRSWKTDQADAHKLAC

SEQ ID NO: 1661880 - protein, 18 aa, Staphylococcus aureus
LEAVWDYSYDKVGYLGTN

SEQ ID NO: 1661881 - protein, 24 aa, Staphylococcus aureus
LEDFKAAHIDTSYIIKSTEAKTGQ

SEQ ID NO: 1661882 - protein, 24 aa, Staphylococcus aureus
LEGKLKLPTFQRALVWSNNQKQEF

SEQ ID NO: 1661883 - protein, 17 aa, Staphylococcus aureus
LEIKTFFEYFLRIVNKT

SEQ ID NO: 1661884 - protein, 30 aa, Staphylococcus aureus
LEKWYQIEYLKEMVTFVVVNRDKNSQNVEN

SEQ ID NO: 1661885 - protein, 28 aa, Staphylococcus aureus
LERYPFELSGGMAQRVAFIMSLIRRPNY

SEQ ID NO: 1661886 - protein, 19 aa, Staphylococcus aureus
LETELRAVINAMSQNEGKS

SEQ ID NO: 1661887 - protein, 21 aa, Staphylococcus aureus
LETELRAVINAMSQNEGKSVD

SEQ ID NO: 1661888 - protein, 23 aa, Staphylococcus aureus
LEVYCERHHIDLHIKKLDLSHSL

SEQ ID NO: 1661889 - protein, 20 aa, Staphylococcus aureus
LEYPLFCTAIRYIIARDYES

SEQ ID NO: 1661890 - protein, 20 aa, Staphylococcus aureus
LFEIKRFDQQYGYVGVPTTL

SEQ ID NO: 1661891 - protein, 22 aa, Staphylococcus aureus
LFKRLKHKTSINVHPHLFRHTH

SEQ ID NO: 1661892 - protein, 23 aa, Staphylococcus aureus
LFNIRSYVAHAWFNKENLTFIMD

SEQ ID NO: 1661893 - protein, 21 aa, Staphylococcus aureus
LFWRIYRKYLGGKSFNKKPTL

SEQ ID NO: 1661894 - protein, 20 aa, Staphylococcus aureus
LGGLAGDLSNLFNVTNVVVT

SEQ ID NO: 1661895 - protein, 27 aa, Staphylococcus aureus
LGIELGIPEHLVWRQPFPGPGLGIRVL

SEQ ID NO: 1661896 - protein, 18 aa, Staphylococcus aureus
LGKEMHKVSAIDFSSKGA

SEQ ID NO: 1661897 - protein, 17 aa, Staphylococcus aureus
LGKTFIFVTHDMDEAIK

SEQ ID NO: 1661898 - protein, 19 aa, Staphylococcus aureus
LGQDIPLVINGEKIFKDDK

SEQ ID NO: 1661899 - protein, 19 aa, Staphylococcus aureus
LGVGEGFNVIASDALAMLQ

SEQ ID NO: 1661900 - protein, 18 aa, Staphylococcus aureus
LHNRGSFEGFKQAASEEK

SEQ ID NO: 1661901 - protein, 20 aa, Staphylococcus aureus
LHPYGSWQEYWAFESRFITL

SEQ ID NO: 1661902 - protein, 17 aa, Staphylococcus aureus
LHQLCKNNDQIILDRPH

SEQ ID NO: 1661903 - protein, 24 aa, Staphylococcus aureus
LIDRKGFYGCTEYNNGCEFTIPKK

SEQ ID NO: 1661904 - protein, 19 aa, Staphylococcus aureus
LIESQCEVIALDATLQQRP

SEQ ID NO: 1661905 - protein, 23 aa, Staphylococcus aureus
LIGELKSAVDLPIHLHTHDTSGN

SEQ ID NO: 1661906 - protein, 20 aa, Staphylococcus aureus
LIIDDVVKGFITYKIPKKVI

SEQ ID NO: 1661907 - protein, 24 aa, Staphylococcus aureus
LIKIEAIKSLFAMDKSPLEHVKPA

SEQ ID NO: 1661908 - protein, 22 aa, Staphylococcus aureus
LKADNGLELLVHIGLDTVQLDG

SEQ ID NO: 1661909 - protein, 17 aa, Staphylococcus aureus
LKAKPDLILAHESQKAT

SEQ ID NO: 1661910 - protein, 19 aa, Staphylococcus aureus
LKAKPDLILAHESQKATAN

SEQ ID NO: 1661911 - protein, 18 aa, Staphylococcus aureus
LKALEPMGEEYLNVVKEG

SEQ ID NO: 1661912 - protein, 19 aa, Staphylococcus aureus
LKASHLLKLKQWHDEQYDI

SEQ ID NO: 1661913 - protein, 20 aa, Staphylococcus aureus
LKDLMLHQSGLYKYKSSKDY

SEQ ID NO: 1661914 - protein, 21 aa, Staphylococcus aureus
LKERLSHLDVDFKFNREEETL

SEQ ID NO: 1661915 - protein, 23 aa, Staphylococcus aureus
LKFMLKVFLDLNFVTQEDGLIRI

SEQ ID NO: 1661916 - protein, 19 aa, Staphylococcus aureus
LKFQILELLHQTFPGLERL

SEQ ID NO: 1661917 - protein, 25 aa, Staphylococcus aureus
LKFYKEQFDTLSYFQLKVLIVGFER

SEQ ID NO: 1661918 - protein, 19 aa, Staphylococcus aureus
LKKAMELVIKKSVTASISL

SEQ ID NO: 1661919 - protein, 22 aa, Staphylococcus aureus
LKKKGKIEMESWGIWRVIESQL

SEQ ID NO: 1661920 - protein, 24 aa, Staphylococcus aureus
LKQFMEFYENFYFDGEEWDKDVWD

SEQ ID NO: 1661921 - protein, 21 aa, Staphylococcus aureus
LKRAGLDYWEFVNITYHDSIE

SEQ ID NO: 1661922 - protein, 17 aa, Staphylococcus aureus
LKRTYVFELNFDALMSV

SEQ ID NO: 1661923 - protein, 21 aa, Staphylococcus aureus
LKVRNEIMETFALNHHQVEPE

SEQ ID NO: 1661924 - protein, 19 aa, Staphylococcus aureus
LKVTPEYLLLKNRQPENEV

SEQ ID NO: 1661925 - protein, 17 aa, Staphylococcus aureus
LLDTPGILWPKFEDEEV

SEQ ID NO: 1661926 - protein, 17 aa, Staphylococcus aureus
LLIKGFKMATAENKEEL

SEQ ID NO: 1661927 - protein, 17 aa, Staphylococcus aureus
LLKSYGFLIYFKNAEDM

SEQ ID NO: 1661928 - protein, 17 aa, Staphylococcus aureus
LLLEGHLLSKPDLTGQW

SEQ ID NO: 1661929 - protein, 18 aa, Staphylococcus aureus
LLMNYNFVIIDTPPVNTV

SEQ ID NO: 1661930 - protein, 22 aa, Staphylococcus aureus
LLNEIKYSGVIDRKIKSKDIGI

SEQ ID NO: 1661931 - protein, 17 aa, Staphylococcus aureus
LLREQPDALLILGDTNS

SEQ ID NO: 1661932 - protein, 29 aa, Staphylococcus aureus
LLSKTLNVGEAWLMGYDVNSYRVPDEERQ

SEQ ID NO: 1661933 - protein, 18 aa, Staphylococcus aureus
LMHYHKRITDKQWEDAKK

SEQ ID NO: 1661934 - protein, 26 aa, Staphylococcus aureus
LMLRLIKPKYFLPIHGEYRMLKAHGE

SEQ ID NO: 1661935 - protein, 18 aa, Staphylococcus aureus
LMPESGKKFYPTKYLLIY

SEQ ID NO: 1661936 - protein, 19 aa, Staphylococcus aureus
LMQRKNKLFSFDEELDKDF

SEQ ID NO: 1661937 - protein, 24 aa, Staphylococcus aureus
LMSKIRRYPLPLVLEISNIESVMP

SEQ ID NO: 1661938 - protein, 26 aa, Staphylococcus aureus
LNAKQISMGLVFSIMDGVRYLKDNAQ

SEQ ID NO: 1661939 - protein, 18 aa, Staphylococcus aureus
LNASSDFGNAHFVVLSKY

SEQ ID NO: 1661940 - protein, 23 aa, Staphylococcus aureus
LNGEYGYEVLKMYADNKTINSDK

SEQ ID NO: 1661941 - protein, 20 aa, Staphylococcus aureus
LNHAMPILLVSGYDDPLGDY

SEQ ID NO: 1661942 - protein, 17 aa, Staphylococcus aureus
LNITLMFDGDFAGSEAT

SEQ ID NO: 1661943 - protein, 19 aa, Staphylococcus aureus
LNKFKGFETLYIINENQVS

SEQ ID NO: 1661944 - protein, 20 aa, Staphylococcus aureus
LNKLLHEARLQRKVNKQWVL

SEQ ID NO: 1661945 - protein, 24 aa, Staphylococcus aureus
LNKLSYLNLDAFQKRDILAAHYIA

SEQ ID NO: 1661946 - protein, 18 aa, Staphylococcus aureus
LNNFIYFFSSSKEIKNYS

SEQ ID NO: 1661947 - protein, 22 aa, Staphylococcus aureus
LNRAKEEFKKVLPIKNDSDFGL

SEQ ID NO: 1661948 - protein, 22 aa, Staphylococcus aureus
LNRLNGGFFGQVFTVYYNDKYV

SEQ ID NO: 1661949 - protein, 22 aa, Staphylococcus aureus
LNSKYEAIGVIYAGNKPSGEST

SEQ ID NO: 1661950 - protein, 23 aa, Staphylococcus aureus
LNTKRSLALFLMAEVDISILSMV

SEQ ID NO: 1661951 - protein, 20 aa, Staphylococcus aureus
LPNRRNVVLTSDTSFNVVGV

SEQ ID NO: 1661952 - protein, 20 aa, Staphylococcus aureus
LPQFTPEIFMKVSAKNVMKQ

SEQ ID NO: 1661953 - protein, 25 aa, Staphylococcus aureus
LPTHGFAVRIFAYRTQIIEKILGII

SEQ ID NO: 1661954 - protein, 19 aa, Staphylococcus aureus
LPVLPCIEMVLKEMKEETL

SEQ ID NO: 1661955 - protein, 18 aa, Staphylococcus aureus
LQIMHSLFQNKGKFVSRN

SEQ ID NO: 1661956 - protein, 22 aa, Staphylococcus aureus
LQQYTCSFVGHFSAGKSTMINL

SEQ ID NO: 1661957 - protein, 21 aa, Staphylococcus aureus
LRGDGNINLNVHKYSEDKTVD

SEQ ID NO: 1661958 - protein, 17 aa, Staphylococcus aureus
LRHAGHEVALYGGSSQS

SEQ ID NO: 1661959 - protein, 20 aa, Staphylococcus aureus
LRRPEMTYDIILELLEEEHQ

SEQ ID NO: 1661960 - protein, 21 aa, Staphylococcus aureus
LSDSYPMLAMIYVTHFIEEIT

SEQ ID NO: 1661961 - protein, 26 aa, Staphylococcus aureus
LSELKKYFYRFSLKARKRVKTVSIDM

SEQ ID NO: 1661962 - protein, 27 aa, Staphylococcus aureus
LSFLDTKSWCKNKFQVTNQVSVEDTYK

SEQ ID NO: 1661963 - protein, 18 aa, Staphylococcus aureus
LSKACWDNKHKRIFEVAE

SEQ ID NO: 1661964 - protein, 20 aa, Staphylococcus aureus
LSKGSLAGVDGRLQSRSYEN

SEQ ID NO: 1661965 - protein, 21 aa, Staphylococcus aureus
LSLPSNCQMYYAMKANSERTI

SEQ ID NO: 1661966 - protein, 17 aa, Staphylococcus aureus
LSSFQLLGIEKYKPHIA

SEQ ID NO: 1661967 - protein, 22 aa, Staphylococcus aureus
LTDAKWASIMIEQILNNALKYA

SEQ ID NO: 1661968 - protein, 26 aa, Staphylococcus aureus
LTEARTLKFFKYFYTHRGPVMDYTNQ

SEQ ID NO: 1661969 - protein, 28 aa, Staphylococcus aureus
LTIEIVRKSALERYEFTGDITYLNKGET

SEQ ID NO: 1661970 - protein, 17 aa, Staphylococcus aureus
LTLNITLMFDGDFAGSE

SEQ ID NO: 1661971 - protein, 24 aa, Staphylococcus aureus
LTRERVANVFQLPSIFLNARSNTN

SEQ ID NO: 1661972 - protein, 18 aa, Staphylococcus aureus
LTRERVANVFQLPSVFLN

SEQ ID NO: 1661973 - protein, 17 aa, Staphylococcus aureus
LTSYLKKHNCLYVLVDP

SEQ ID NO: 1661974 - protein, 27 aa, Staphylococcus aureus
LTVSPSMRLGFEEFKNASGQIAMGFTE

SEQ ID NO: 1661975 - protein, 17 aa, Staphylococcus aureus
LTVTITLNEYRKLIEIK

SEQ ID NO: 1661976 - protein, 18 aa, Staphylococcus aureus
LVIKKLQLWIKAILKKTN

SEQ ID NO: 1661977 - protein, 19 aa, Staphylococcus aureus
LWMNLYYLFMNLRDLFKEE

SEQ ID NO: 1661978 - protein, 23 aa, Staphylococcus aureus
LYQDVPEQFSIMRYHSLISNPDN

SEQ ID NO: 1661979 - protein, 22 aa, Staphylococcus aureus
LYRYICLEFKNQRQLIGKRQEE

SEQ ID NO: 1661980 - protein, 17 aa, Staphylococcus aureus
MALEAFKATDCSGLVRA

SEQ ID NO: 1661981 - protein, 21 aa, Staphylococcus aureus
MALGRNVVVGFMTWDGYNYED

SEQ ID NO: 1661982 - protein, 24 aa, Staphylococcus aureus
MAQGFRRMMQYKKINKNLVGFMRA

SEQ ID NO: 1661983 - protein, 20 aa, Staphylococcus aureus
MASHYLFEYIHPFYDGNGRV

SEQ ID NO: 1661984 - protein, 21 aa, Staphylococcus aureus
MCRDIELHWGEPVESIRKLLQ

SEQ ID NO: 1661985 - protein, 20 aa, Staphylococcus aureus
MDFTEIVPISALEGLNVDHF

SEQ ID NO: 1661986 - protein, 24 aa, Staphylococcus aureus
MDQFSFKVAQLLINNDGPAIEYTL

SEQ ID NO: 1661987 - protein, 24 aa, Staphylococcus aureus
MEAEPFMWPVYEVIRKSTAEELKA

SEQ ID NO: 1661988 - protein, 17 aa, Staphylococcus aureus
MEKGSPVVFEIGYNQGE

SEQ ID NO: 1661989 - protein, 19 aa, Staphylococcus aureus
METRGMVLYINRNTRTTKG

SEQ ID NO: 1661990 - protein, 22 aa, Staphylococcus aureus
MFENLSRYRAIIVSTEQQKLDI

SEQ ID NO: 1661991 - protein, 23 aa, Staphylococcus aureus
MFENLSRYRAIIVSTEQQKLDVE

SEQ ID NO: 1661992 - protein, 19 aa, Staphylococcus aureus
MGLGYLVNVYDTWKVEKIL

SEQ ID NO: 1661993 - protein, 19 aa, Staphylococcus aureus
MHRLGDILVQYGIQHDTGL

SEQ ID NO: 1661994 - protein, 23 aa, Staphylococcus aureus
MIDNYKWMKNIIDSKVYDNESTS

SEQ ID NO: 1661995 - protein, 20 aa, Staphylococcus aureus
MIDSRTGVLNANDWKSQLRR

SEQ ID NO: 1661996 - protein, 26 aa, Staphylococcus aureus
MIGVLKAGGAYVPIDLNYPSDRQEYI

SEQ ID NO: 1661997 - protein, 18 aa, Staphylococcus aureus
MIHTYSLIHDDLPAMDND

SEQ ID NO: 1661998 - protein, 17 aa, Staphylococcus aureus
MINDLGFEIDYGTCENK

SEQ ID NO: 1661999 - protein, 19 aa, Staphylococcus aureus
MIPVHPWQFEHVIQVDLAE

SEQ ID NO: 1662000 - protein, 21 aa, Staphylococcus aureus
MKDKGWVIDSFYFRYKQQNYI

SEQ ID NO: 1662001 - protein, 19 aa, Staphylococcus aureus
MKHIMDVISTFAISYDGYI

SEQ ID NO: 1662002 - protein, 18 aa, Staphylococcus aureus
MKLPYKYYIGGRLGSGQQ

SEQ ID NO: 1662003 - protein, 21 aa, Staphylococcus aureus
MKNGGKYTFELHKKLQEHRMA

SEQ ID NO: 1662004 - protein, 21 aa, Staphylococcus aureus
MKQLFEHRGLPQLPYISFLRS

SEQ ID NO: 1662005 - protein, 26 aa, Staphylococcus aureus
MKVARELIELIIAFMFHHQIPMSIET

SEQ ID NO: 1662006 - protein, 23 aa, Staphylococcus aureus
MLSTSKMEGFGLAILESLSVGTP

SEQ ID NO: 1662007 - protein, 18 aa, Staphylococcus aureus
MMQLLGLRQGEQLLERYP

SEQ ID NO: 1662008 - protein, 18 aa, Staphylococcus aureus
MNALEHVSFELLKRFSNN

SEQ ID NO: 1662009 - protein, 17 aa, Staphylococcus aureus
MNIADDIKFHVVIYSEN

SEQ ID NO: 1662010 - protein, 19 aa, Staphylococcus aureus
MNRDLSHEWEVARVEEGLT

SEQ ID NO: 1662011 - protein, 20 aa, Staphylococcus aureus
MNRPELQRILKDAKDGYIDC

SEQ ID NO: 1662012 - protein, 18 aa, Staphylococcus aureus
MPGKRVNISDGVPRLDAL

SEQ ID NO: 1662013 - protein, 19 aa, Staphylococcus aureus
MRLDELIKWARENPELSKG

SEQ ID NO: 1662014 - protein, 20 aa, Staphylococcus aureus
MRLDELIKWARENPELSQGK

SEQ ID NO: 1662015 - protein, 17 aa, Staphylococcus aureus
MSGGIAYVIPSDVEAFV

SEQ ID NO: 1662016 - protein, 17 aa, Staphylococcus aureus
MSLIRRPNYLFLDEPTS

SEQ ID NO: 1662017 - protein, 19 aa, Staphylococcus aureus
MVAKHLISPELIKQPAAAV

SEQ ID NO: 1662018 - protein, 24 aa, Staphylococcus aureus
MVEVFKGMDTVVFIPSIIHPSFKR

SEQ ID NO: 1662019 - protein, 17 aa, Staphylococcus aureus
MYIKRDILTRENIKEVT

SEQ ID NO: 1662020 - protein, 21 aa, Staphylococcus aureus
MYKKFGVLPEMEYEMEEVKEI

SEQ ID NO: 1662021 - protein, 18 aa, Staphylococcus aureus
MYKTGLWEFETHTHDLHN

SEQ ID NO: 1662022 - protein, 17 aa, Staphylococcus aureus
MYMVKKLDAGNIISQQA

SEQ ID NO: 1662023 - protein, 22 aa, Staphylococcus aureus
NAGENYIDIAWLARKKGYQVAL

SEQ ID NO: 1662024 - protein, 22 aa, Staphylococcus aureus
NAKDAVNAMTHLNDAQKQALKG

SEQ ID NO: 1662025 - protein, 26 aa, Staphylococcus aureus
NAKRFKRWVTSEVLPTLRKTGAYQVP

SEQ ID NO: 1662026 - protein, 22 aa, Staphylococcus aureus
NAKVRRLVEEFDYEADTYIRQK

SEQ ID NO: 1662027 - protein, 30 aa, Staphylococcus aureus
NALIEMIDYFKALFPNGGLYIHLDQATERH

SEQ ID NO: 1662028 - protein, 17 aa, Staphylococcus aureus
NAPNKLLLRSFSEVLTF

SEQ ID NO: 1662029 - protein, 27 aa, Staphylococcus aureus
NASGQIAMGFTEFFGARYDESTLENDP

SEQ ID NO: 1662030 - protein, 18 aa, Staphylococcus aureus
NDHLPKYMIPKTITHIDY

SEQ ID NO: 1662031 - protein, 18 aa, Staphylococcus aureus
NDLLNNFVRRVCDCKGQW

SEQ ID NO: 1662032 - protein, 22 aa, Staphylococcus aureus
NDSIKAIILSFAYDKNKFKVIG

SEQ ID NO: 1662033 - protein, 17 aa, Staphylococcus aureus
NDWIIGARQALIDQRDI

SEQ ID NO: 1662034 - protein, 25 aa, Staphylococcus aureus
NEEKGNDIGPVRAAYEEGLNNINAA

SEQ ID NO: 1662035 - protein, 19 aa, Staphylococcus aureus
NEGKFVKNLIEDIPPNEII

SEQ ID NO: 1662036 - protein, 19 aa, Staphylococcus aureus
NEKRYPVKMIDNKVIPTKE

SEQ ID NO: 1662037 - protein, 22 aa, Staphylococcus aureus
NETNAMPGFTAFSMYPKLWENM

SEQ ID NO: 1662038 - protein, 18 aa, Staphylococcus aureus
NFAKISFLSHSHWHLRSL

SEQ ID NO: 1662039 - protein, 24 aa, Staphylococcus aureus
NFDNFLTIHFYYYYDFEYDCLILP

SEQ ID NO: 1662040 - protein, 28 aa, Staphylococcus aureus
NFLHKCFIDKEIRLCVIVPKNSINPQKI

SEQ ID NO: 1662041 - protein, 19 aa, Staphylococcus aureus
NFQDLKFNIQQEMTETVIE

SEQ ID NO: 1662042 - protein, 23 aa, Staphylococcus aureus
NGDLAGILGLCISELDGKMSYMI

SEQ ID NO: 1662043 - protein, 25 aa, Staphylococcus aureus
NGHGGFLNEDFRLFSTNNQSGELTY

SEQ ID NO: 1662044 - protein, 18 aa, Staphylococcus aureus
NGQIRRWEKTKPGIDKVQ

SEQ ID NO: 1662045 - protein, 23 aa, Staphylococcus aureus
NHLLPYFKSMDVFKMTTQDVMKF

SEQ ID NO: 1662046 - protein, 24 aa, Staphylococcus aureus
NHLNHLKVSLVLGTPKERNAALNT

SEQ ID NO: 1662047 - protein, 23 aa, Staphylococcus aureus
NHLNHLKVSLVLGTPKERNDALN

SEQ ID NO: 1662048 - protein, 23 aa, Staphylococcus aureus
NHSEAKVPIGNQIVTVERGQRLT

SEQ ID NO: 1662049 - protein, 20 aa, Staphylococcus aureus
NIIIAHGVAEHLDRYDEITA

SEQ ID NO: 1662050 - protein, 18 aa, Staphylococcus aureus
NILNERKIEFKINMQNIY

SEQ ID NO: 1662051 - protein, 17 aa, Staphylococcus aureus
NILNKFADILIRQKTEV

SEQ ID NO: 1662052 - protein, 22 aa, Staphylococcus aureus
NINFFKSLCKNPINDTTINEYL

SEQ ID NO: 1662053 - protein, 19 aa, Staphylococcus aureus
NKGLNYLLTVLKNWNKEGV

SEQ ID NO: 1662054 - protein, 21 aa, Staphylococcus aureus
NKHFRSYFCGQLDVPLTDTGT

SEQ ID NO: 1662055 - protein, 20 aa, Staphylococcus aureus
NKKKGVGVATALLINEGIKV

SEQ ID NO: 1662056 - protein, 21 aa, Staphylococcus aureus
NKNFKMFIVMKNTKVIILKNK

SEQ ID NO: 1662057 - protein, 26 aa, Staphylococcus aureus
NKNIRSNCGLGFKAFWEEETGFHYDL

SEQ ID NO: 1662058 - protein, 25 aa, Staphylococcus aureus
NKPTRRGQLIAGRILFLQEKLAKGE

SEQ ID NO: 1662059 - protein, 17 aa, Staphylococcus aureus
NKTEFDDMISLVGMHLE

SEQ ID NO: 1662060 - protein, 25 aa, Staphylococcus aureus
NLLQRQFKASCPMEVLTTDITYLPF

SEQ ID NO: 1662061 - protein, 22 aa, Staphylococcus aureus
NLSETRKAEVLYEELAHHKLTY

SEQ ID NO: 1662062 - protein, 25 aa, Staphylococcus aureus
NMGNHSWKAIEIIYETYVHYVIPVN

SEQ ID NO: 1662063 - protein, 21 aa, Staphylococcus aureus
NMVDKGVVIWKEKEFEPSDIV

SEQ ID NO: 1662064 - protein, 20 aa, Staphylococcus aureus
NNMNARWIPTVEKIMKDLGG

SEQ ID NO: 1662065 - protein, 37 aa, Staphylococcus aureus
NNTYLIVCTDLRLLFLDKGMIYGLKFHEFPFEKINSV

SEQ ID NO: 1662066 - protein, 21 aa, Staphylococcus aureus
NPAMLPKSIWENFKSQNFENM

SEQ ID NO: 1662067 - protein, 27 aa, Staphylococcus aureus
NPIPIKALTSYLGFGNYELRLPLITLE

SEQ ID NO: 1662068 - protein, 21 aa, Staphylococcus aureus
NPNYCGRVINQYGQYENMFPA

SEQ ID NO: 1662069 - protein, 30 aa, Staphylococcus aureus
NQGSPKCIVFGCYENEALIATAALEQIRYV

SEQ ID NO: 1662070 - protein, 17 aa, Staphylococcus aureus
NQLFIRTDFTSINSPIE

SEQ ID NO: 1662071 - protein, 32 aa, Staphylococcus aureus
NRAMPLLKTFRLENELKVFPSHFSKGMKQKVM

SEQ ID NO: 1662072 - protein, 23 aa, Staphylococcus aureus
NRDIKGDAYLSIHNDALESSNAN

SEQ ID NO: 1662073 - protein, 19 aa, Staphylococcus aureus
NRNEEIRKLLVFYNKNNYH

SEQ ID NO: 1662074 - protein, 20 aa, Staphylococcus aureus
NRNEEIRKLLVFYNKNNYHQ

SEQ ID NO: 1662075 - protein, 18 aa, Staphylococcus aureus
NRPEVRNAFTPKTVAEMI

SEQ ID NO: 1662076 - protein, 22 aa, Staphylococcus aureus
NRPVLQEVLNFVRMGDRFVVES

SEQ ID NO: 1662077 - protein, 20 aa, Staphylococcus aureus
NRYTLHRFNEEYALEPQQLI

SEQ ID NO: 1662078 - protein, 17 aa, Staphylococcus aureus
NSGIYFYNRGYEFSNIK

SEQ ID NO: 1662079 - protein, 20 aa, Staphylococcus aureus
NSIMPRKSRASLQKITQKWL

SEQ ID NO: 1662080 - protein, 17 aa, Staphylococcus aureus
NSIRLVTEIVRSLNDET

SEQ ID NO: 1662081 - protein, 23 aa, Staphylococcus aureus
NSQFKHMHRHSATIVGGALTLAD

SEQ ID NO: 1662082 - protein, 18 aa, Staphylococcus aureus
NTFFKAYLQQKGFNPALM

SEQ ID NO: 1662083 - protein, 21 aa, Staphylococcus aureus
NVKGRAGSIVKNRYLNDIEFD

SEQ ID NO: 1662084 - protein, 23 aa, Staphylococcus aureus
NVLSHKPYRAIDVIGSAKFLMRY

SEQ ID NO: 1662085 - protein, 26 aa, Staphylococcus aureus
NVNKFSYRMLLIYSIKTKNFNPLYEI

SEQ ID NO: 1662086 - protein, 20 aa, Staphylococcus aureus
NVRAGKLFGIPVSGTHAHAF

SEQ ID NO: 1662087 - protein, 19 aa, Staphylococcus aureus
NVSFYGATGGKAFINGSAG

SEQ ID NO: 1662088 - protein, 19 aa, Staphylococcus aureus
NWWRWYRNGESYRFSQHVG

SEQ ID NO: 1662089 - protein, 25 aa, Staphylococcus aureus
NYELIPTVFAEFEIDGKITTFKKES

SEQ ID NO: 1662090 - protein, 17 aa, Staphylococcus aureus
NYFKLKKFIVGLESKTA

SEQ ID NO: 1662091 - protein, 23 aa, Staphylococcus aureus
NYLASSYFRSSGYDGFMQDYVVM

SEQ ID NO: 1662092 - protein, 23 aa, Staphylococcus aureus
NYVKSNFEGKVYLIGHSMGGYTV

SEQ ID NO: 1662093 - protein, 24 aa, Staphylococcus aureus
NYYMYKKFGVIPEMEYEMEEVKQI

SEQ ID NO: 1662094 - protein, 18 aa, Staphylococcus aureus
PADNDIEMMLGAILVQNT

SEQ ID NO: 1662095 - protein, 23 aa, Staphylococcus aureus
PAQFGGPHCGYFATTKKLMRKVP

SEQ ID NO: 1662096 - protein, 22 aa, Staphylococcus aureus
PAYYKLYGDKIVGFDTNDFPIT

SEQ ID NO: 1662097 - protein, 23 aa, Staphylococcus aureus
PDLDFEFIHWLVSGVKGHEPVLD

SEQ ID NO: 1662098 - protein, 24 aa, Staphylococcus aureus
PDLSSDFTLFDFTYDLPLSTYLGQ

SEQ ID NO: 1662099 - protein, 25 aa, Staphylococcus aureus
PEATAVAGYKAWKNKFDRQVQKGAK

SEQ ID NO: 1662100 - protein, 24 aa, Staphylococcus aureus
PEFSGKGYAKFAFEKAIIYAFNIL

SEQ ID NO: 1662101 - protein, 20 aa, Staphylococcus aureus
PENQKYGAFHGKEMFKQAIV

SEQ ID NO: 1662102 - protein, 23 aa, Staphylococcus aureus
PFKKGVGIDLARLSLEKAETLKG

SEQ ID NO: 1662103 - protein, 17 aa, Staphylococcus aureus
PFPLIVKATDGDVEAIN

SEQ ID NO: 1662104 - protein, 18 aa, Staphylococcus aureus
PGNRPLKSLSHMLKGKQG

SEQ ID NO: 1662105 - protein, 18 aa, Staphylococcus aureus
PGRKCIYVQPHSYTIENQ

SEQ ID NO: 1662106 - protein, 17 aa, Staphylococcus aureus
PHDLFTPIFAVSRSAGW

SEQ ID NO: 1662107 - protein, 21 aa, Staphylococcus aureus
PHVPVIIDEAYFEFVTEEDYP

SEQ ID NO: 1662108 - protein, 19 aa, Staphylococcus aureus
PIAILIRHTMSFDNAHFFA

SEQ ID NO: 1662109 - protein, 24 aa, Staphylococcus aureus
PIQYIVGFASFYGRTFDVNSNCLI

SEQ ID NO: 1662110 - protein, 18 aa, Staphylococcus aureus
PKFMLGMTATPERSDELS

SEQ ID NO: 1662111 - protein, 21 aa, Staphylococcus aureus
PKGQSEPIVLVIFTNKDNKSD

SEQ ID NO: 1662112 - protein, 25 aa, Staphylococcus aureus
PKGTLIPHRGIVRLVHQNHYVPLNE

SEQ ID NO: 1662113 - protein, 25 aa, Staphylococcus aureus
PKHLTTIKVAPLFSEDDRHKIRLVV

SEQ ID NO: 1662114 - protein, 22 aa, Staphylococcus aureus
PKIIKKLAYFKMFPNLTETYIA

SEQ ID NO: 1662115 - protein, 21 aa, Staphylococcus aureus
PKIRKNLRHAIEMLNVKKKEF

SEQ ID NO: 1662116 - protein, 20 aa, Staphylococcus aureus
PKITNPLLHEFGTKQYPDEY

SEQ ID NO: 1662117 - protein, 25 aa, Staphylococcus aureus
PKKGGFFEEIERTFKEISEELNEEE

SEQ ID NO: 1662118 - protein, 17 aa, Staphylococcus aureus
PKKKRMGRYQGYTNKRR

SEQ ID NO: 1662119 - protein, 17 aa, Staphylococcus aureus
PKVIIASGNKPNIIEAI

SEQ ID NO: 1662120 - protein, 18 aa, Staphylococcus aureus
PLTFPLIALIVSGGHTEL

SEQ ID NO: 1662121 - protein, 24 aa, Staphylococcus aureus
PLVDFYNQMAFDFGTLGNHEFNYG

SEQ ID NO: 1662122 - protein, 21 aa, Staphylococcus aureus
PNCGFYTATHPLNFHHRNEGF

SEQ ID NO: 1662123 - protein, 26 aa, Staphylococcus aureus
PNMDVFKKCYKALITKQETNIQKEGM

SEQ ID NO: 1662124 - protein, 17 aa, Staphylococcus aureus
PNRMGNLAIKKGWPSMM

SEQ ID NO: 1662125 - protein, 23 aa, Staphylococcus aureus
PRFYGEPVMKGYVRYSIATAPQL

SEQ ID NO: 1662126 - protein, 32 aa, Staphylococcus aureus
PRKYLNPKIPQGRGKIKWQAFATLPQQFEILE

SEQ ID NO: 1662127 - protein, 26 aa, Staphylococcus aureus
PRLQPWDFAGGLVILNEVDGQASNLL

SEQ ID NO: 1662128 - protein, 22 aa, Staphylococcus aureus
PSELKYKVYIIDEVHMLTTGAF

SEQ ID NO: 1662129 - protein, 19 aa, Staphylococcus aureus
PSGQNGPTMRTNWHDARGQ

SEQ ID NO: 1662130 - protein, 19 aa, Staphylococcus aureus
PSIKEIRGRGLFIGIELNT

SEQ ID NO: 1662131 - protein, 25 aa, Staphylococcus aureus
PSSELARPLLSAALSKDNEVVKIDL

SEQ ID NO: 1662132 - protein, 19 aa, Staphylococcus aureus
PSYKQVYSIIKAMPKSVID

SEQ ID NO: 1662133 - protein, 23 aa, Staphylococcus aureus
PTEKKGPSVLGIIEYKVQGENEF

SEQ ID NO: 1662134 - protein, 18 aa, Staphylococcus aureus
PTKRNWIPNFYRQCKLGW

SEQ ID NO: 1662135 - protein, 34 aa, Staphylococcus aureus
PTLKETKGKIVLFNRMGGTYIKSGYGADTSGIQW

SEQ ID NO: 1662136 - protein, 18 aa, Staphylococcus aureus
PTQLASAFAAIANGGTYN

SEQ ID NO: 1662137 - protein, 25 aa, Staphylococcus aureus
PTTKFKTTTIVFKFMAPLEYDTTTA

SEQ ID NO: 1662138 - protein, 23 aa, Staphylococcus aureus
PTTLKSLTFHVACDEWFQNYIKT

SEQ ID NO: 1662139 - protein, 17 aa, Staphylococcus aureus
PVYQSVYVDHRYRTLES

SEQ ID NO: 1662140 - protein, 19 aa, Staphylococcus aureus
PYKLEIEMLKQQHFDPELK

SEQ ID NO: 1662141 - protein, 17 aa, Staphylococcus aureus
PYTKMWRIDGKDTDIKA

SEQ ID NO: 1662142 - protein, 24 aa, Staphylococcus aureus
QAFDRFKLNIFISLAELESDNIGE

SEQ ID NO: 1662143 - protein, 29 aa, Staphylococcus aureus
QALAKVKHLRKSPCYNFELEVIAKNENND

SEQ ID NO: 1662144 - protein, 25 aa, Staphylococcus aureus
QALNLKFYYGQEIRITDQILNDIDR

SEQ ID NO: 1662145 - protein, 30 aa, Staphylococcus aureus
QAQQHIAGFWQRCYQEGVIADLQLKNNGDL

SEQ ID NO: 1662146 - protein, 18 aa, Staphylococcus aureus
QAVYKKIHSTVVDNGGKI

SEQ ID NO: 1662147 - protein, 29 aa, Staphylococcus aureus
QDLGRKGYEHIGFSGAGAMDQFSFKVAQL

SEQ ID NO: 1662148 - protein, 18 aa, Staphylococcus aureus
QDQFEIVKVATDYCKENN

SEQ ID NO: 1662149 - protein, 27 aa, Staphylococcus aureus
QEIDAALWGARAAYIGGFDSTSNVRAG

SEQ ID NO: 1662150 - protein, 20 aa, Staphylococcus aureus
QEKAERAFLKHLMRDKDTFL

SEQ ID NO: 1662151 - protein, 17 aa, Staphylococcus aureus
QELIEMMAKETWLNADE

SEQ ID NO: 1662152 - protein, 26 aa, Staphylococcus aureus
QFDYVKEISEQFGFVNIGVKNYEADD

SEQ ID NO: 1662153 - protein, 27 aa, Staphylococcus aureus
QFIGKRISSAFLKIVIRDVAKRTAAKQ

SEQ ID NO: 1662154 - protein, 20 aa, Staphylococcus aureus
QFTGSFKFRGASNKINHLTD

SEQ ID NO: 1662155 - protein, 27 aa, Staphylococcus aureus
QFYKTYDSTLFFAKRAQLIECLENKGF

SEQ ID NO: 1662156 - protein, 23 aa, Staphylococcus aureus
QGMQCIFTILQLMDLIIFELSIL

SEQ ID NO: 1662157 - protein, 22 aa, Staphylococcus aureus
QGTLIKKQVMMRGFLVSEFANA

SEQ ID NO: 1662158 - protein, 17 aa, Staphylococcus aureus
QGVSFDFVTPFGTYSVK

SEQ ID NO: 1662159 - protein, 27 aa, Staphylococcus aureus
QKDIAFEFASWISAEFKLYIIQDYQRL

SEQ ID NO: 1662160 - protein, 20 aa, Staphylococcus aureus
QKDVIKRLVAYLNNEPIGVV

SEQ ID NO: 1662161 - protein, 27 aa, Staphylococcus aureus
QKEALKAQVTSAGRVSAANGVEHTATE

SEQ ID NO: 1662162 - protein, 17 aa, Staphylococcus aureus
QKTMFPDQLKVIEIINL

SEQ ID NO: 1662163 - protein, 18 aa, Staphylococcus aureus
QLRKRYDIPTNKAPKLLL

SEQ ID NO: 1662164 - protein, 19 aa, Staphylococcus aureus
QLTIMCKLAGPQHSEIGFP

SEQ ID NO: 1662165 - protein, 17 aa, Staphylococcus aureus
QLVSQMMLMAMSIEANQ

SEQ ID NO: 1662166 - protein, 18 aa, Staphylococcus aureus
QLWIKAILKKTNITNKQI

SEQ ID NO: 1662167 - protein, 24 aa, Staphylococcus aureus
QMLISLKMTQLIIISHDTYVLSQF

SEQ ID NO: 1662168 - protein, 19 aa, Staphylococcus aureus
QNHLGELILTISKASNDSN

SEQ ID NO: 1662169 - protein, 18 aa, Staphylococcus aureus
QNIPKIIISDSVFSTNGD

SEQ ID NO: 1662170 - protein, 28 aa, Staphylococcus aureus
QPTHVEKGLKCKRCGSEYDLYKFAPTKK

SEQ ID NO: 1662171 - protein, 29 aa, Staphylococcus aureus
QPVSPHLAFKMADQIFLNKQRVLDKVKVL

SEQ ID NO: 1662172 - protein, 26 aa, Staphylococcus aureus
QPWQHFIIGSLFGWVHKETKLRRYKE

SEQ ID NO: 1662173 - protein, 23 aa, Staphylococcus aureus
QRELGGAILKHFDNISVNVKRPD

SEQ ID NO: 1662174 - protein, 24 aa, Staphylococcus aureus
QRHLTFSNKWLWQKDNGTIHATLL

SEQ ID NO: 1662175 - protein, 17 aa, Staphylococcus aureus
QRMAMMRSYMRSQVTQQ

SEQ ID NO: 1662176 - protein, 20 aa, Staphylococcus aureus
QRRIGYLFQDYQLFPNMTVY

SEQ ID NO: 1662177 - protein, 27 aa, Staphylococcus aureus
QSCLTTGFCLWCQLAFSTYLENAAQPH

SEQ ID NO: 1662178 - protein, 18 aa, Staphylococcus aureus
QSQLCYQGDIDIDLTQTD

SEQ ID NO: 1662179 - protein, 24 aa, Staphylococcus aureus
QSWIPCEIEDQFLNQVINGVTIDS

SEQ ID NO: 1662180 - protein, 23 aa, Staphylococcus aureus
QTNAMHQFTIWTALATKGIGASL

SEQ ID NO: 1662181 - protein, 23 aa, Staphylococcus aureus
QTYNFKNGIIATGSRPIEIPNFK

SEQ ID NO: 1662182 - protein, 22 aa, Staphylococcus aureus
QTYPRLRVTGASFEAVGLPDCI

SEQ ID NO: 1662183 - protein, 17 aa, Staphylococcus aureus
QVILSEFEASADKKSSI

SEQ ID NO: 1662184 - protein, 27 aa, Staphylococcus aureus
QVINMFSFFIGYHFNKLDLGIERIFIQ

SEQ ID NO: 1662185 - protein, 25 aa, Staphylococcus aureus
QVLNMNAKVPNHFNFNRLVIDHDAD

SEQ ID NO: 1662186 - protein, 17 aa, Staphylococcus aureus
QVNNCVTVEPGVYIEGL

SEQ ID NO: 1662187 - protein, 20 aa, Staphylococcus aureus
QVQFVGFVGEHGRYDLMLVH

SEQ ID NO: 1662188 - protein, 23 aa, Staphylococcus aureus
QWEPSYVDRGFIFTTCQGNPMQG

SEQ ID NO: 1662189 - protein, 23 aa, Staphylococcus aureus
QYPDEYRYGFYVKPTLNRLNGGF

SEQ ID NO: 1662190 - protein, 18 aa, Staphylococcus aureus
RAAAGGDEAAIFAGDLMR

SEQ ID NO: 1662191 - protein, 23 aa, Staphylococcus aureus
RACRFCAVKTGLPNELDLNEPER

SEQ ID NO: 1662192 - protein, 19 aa, Staphylococcus aureus
RAHSIYLYEYYWSEAYKNY

SEQ ID NO: 1662193 - protein, 20 aa, Staphylococcus aureus
RASGFCIYNDIAITAQYIAK

SEQ ID NO: 1662194 - protein, 25 aa, Staphylococcus aureus
RASIKKAFMTLLFEKDFDTISIKEI

SEQ ID NO: 1662195 - protein, 29 aa, Staphylococcus aureus
RAYNYHGEWKLKSADEFIKDNRIVTLTEQ

SEQ ID NO: 1662196 - protein, 39 aa, Staphylococcus aureus
RAYYTKPSFEFEKQFGFLLKPWTTVRFMNVIPNRFIYKI

SEQ ID NO: 1662197 - protein, 20 aa, Staphylococcus aureus
RDIPFDKVVKMDVDRFATYE

SEQ ID NO: 1662198 - protein, 22 aa, Staphylococcus aureus
RDLNQPQRDALRNQINQAQALA

SEQ ID NO: 1662199 - protein, 22 aa, Staphylococcus aureus
RDSEYWRELCFGTTEGNRNNAL

SEQ ID NO: 1662200 - protein, 23 aa, Staphylococcus aureus
REKAMKVLKARLYDMKVQEEQQK

SEQ ID NO: 1662201 - protein, 17 aa, Staphylococcus aureus
RETEFDILFFSAIGVGD

SEQ ID NO: 1662202 - protein, 17 aa, Staphylococcus aureus
REVTRRKSALDVASLPG

SEQ ID NO: 1662203 - protein, 19 aa, Staphylococcus aureus
REYLAQGLQSIWDENKRFL

SEQ ID NO: 1662204 - protein, 17 aa, Staphylococcus aureus
RFRLSELQIESRANKEV

SEQ ID NO: 1662205 - protein, 20 aa, Staphylococcus aureus
RGDFITKRFNIFANNDEMSF

SEQ ID NO: 1662206 - protein, 17 aa, Staphylococcus aureus
RGDIFVRDAIKEHMASL

SEQ ID NO: 1662207 - protein, 18 aa, Staphylococcus aureus
RGLDEAGYYNIPIMSYGV

SEQ ID NO: 1662208 - protein, 17 aa, Staphylococcus aureus
RGLSPWPVAYTTMDDTN

SEQ ID NO: 1662209 - protein, 20 aa, Staphylococcus aureus
RGSGKICLNGAASRLVEVGD

SEQ ID NO: 1662210 - protein, 21 aa, Staphylococcus aureus
RIEKNIMRFAKSVNFNSDEFN

SEQ ID NO: 1662211 - protein, 19 aa, Staphylococcus aureus
RIGEVLSLRIDDIKFDFRK

SEQ ID NO: 1662212 - protein, 19 aa, Staphylococcus aureus
RIKEEWEQFFFKNKISNIT

SEQ ID NO: 1662213 - protein, 24 aa, Staphylococcus aureus
RISEKSSGIGLYIVSTISKRLGHK

SEQ ID NO: 1662214 - protein, 25 aa, Staphylococcus aureus
RISRETLEIYAPLAHHLGINTIKWE

SEQ ID NO: 1662215 - protein, 21 aa, Staphylococcus aureus
RKDKQVKIRGFRIELSEIEHA

SEQ ID NO: 1662216 - protein, 17 aa, Staphylococcus aureus
RKELNYTANTDVVSTLF

SEQ ID NO: 1662217 - protein, 20 aa, Staphylococcus aureus
RKEVGSWSDWSELALNDYNT

SEQ ID NO: 1662218 - protein, 19 aa, Staphylococcus aureus
RKIKSKDIGIVFQENKYGD

SEQ ID NO: 1662219 - protein, 17 aa, Staphylococcus aureus
RKITALINQCYTSPINH

SEQ ID NO: 1662220 - protein, 27 aa, Staphylococcus aureus
RKNDDYIWLGHSFVRQGFLDDVKLEPP

SEQ ID NO: 1662221 - protein, 17 aa, Staphylococcus aureus
RKNEHVEIAMAQSDAMY

SEQ ID NO: 1662222 - protein, 23 aa, Staphylococcus aureus
RKPVITGYRAHNVFDVADTKGKP

SEQ ID NO: 1662223 - protein, 17 aa, Staphylococcus aureus
RKYYEPLIHKNDKEFKE

SEQ ID NO: 1662224 - protein, 26 aa, Staphylococcus aureus
RLQGDLEKRESLNLDTSALVRQLKDI

SEQ ID NO: 1662225 - protein, 18 aa, Staphylococcus aureus
RLQYVIPNEILKHSGKVH

SEQ ID NO: 1662226 - protein, 19 aa, Staphylococcus aureus
RLTGIIDFGDSGIIDEYCD

SEQ ID NO: 1662227 - protein, 19 aa, Staphylococcus aureus
RLTPYFTKDFNNISLYFTA

SEQ ID NO: 1662228 - protein, 23 aa, Staphylococcus aureus
RNDYKARGVNEYQTLNYKTNLER

SEQ ID NO: 1662229 - protein, 18 aa, Staphylococcus aureus
RNKIKGMMQGATQVYINY

SEQ ID NO: 1662230 - protein, 26 aa, Staphylococcus aureus
RNLKNALKLMKLCQKYHVHILSVHDG

SEQ ID NO: 1662231 - protein, 18 aa, Staphylococcus aureus
RPNFEMEERLVLEKVNYD

SEQ ID NO: 1662232 - protein, 17 aa, Staphylococcus aureus
RPVPEYDNDFIESFFQN

SEQ ID NO: 1662233 - protein, 18 aa, Staphylococcus aureus
RQLCDKHQILLIADEIQV

SEQ ID NO: 1662234 - protein, 18 aa, Staphylococcus aureus
RRIMMALQHVVQHKNIAF

SEQ ID NO: 1662235 - protein, 36 aa, Staphylococcus aureus
RSLESSFNIARKMGYFDIPKDLLIPITEVDNYPKNE

SEQ ID NO: 1662236 - protein, 25 aa, Staphylococcus aureus
RSNNEWQCPLTIRAPFGGGVHGGLY

SEQ ID NO: 1662237 - protein, 21 aa, Staphylococcus aureus
RSYYTGLFIQCHFAENESRVL

SEQ ID NO: 1662238 - protein, 24 aa, Staphylococcus aureus
RTADGEPVVYCLDKIAKKELTCTE

SEQ ID NO: 1662239 - protein, 25 aa, Staphylococcus aureus
RTAPWLRRLGFENVKEVLLNPERQN

SEQ ID NO: 1662240 - protein, 18 aa, Staphylococcus aureus
RTELVKCLDYLRESDTLV

SEQ ID NO: 1662241 - protein, 20 aa, Staphylococcus aureus
RTTVTRWRKGIRSPKLDKLP

SEQ ID NO: 1662242 - protein, 18 aa, Staphylococcus aureus
RTVASCLASQNYISIVKG

SEQ ID NO: 1662243 - protein, 21 aa, Staphylococcus aureus
RVFYRDEFLCTAICPEIADYS

SEQ ID NO: 1662244 - protein, 18 aa, Staphylococcus aureus
RVGYKFVDGKKVRIAKKS

SEQ ID NO: 1662245 - protein, 17 aa, Staphylococcus aureus
RVNEWLDKVDIERYEDL

SEQ ID NO: 1662246 - protein, 18 aa, Staphylococcus aureus
RVRLSGVKLKEIIAKSNK

SEQ ID NO: 1662247 - protein, 25 aa, Staphylococcus aureus
RVYSSHPNRIEWEPQFSQSTILALI

SEQ ID NO: 1662248 - protein, 20 aa, Staphylococcus aureus
RYDEITAYLNEAGFSVIRYD

SEQ ID NO: 1662249 - protein, 18 aa, Staphylococcus aureus
RYDLMLVHTNRHYGKTLV

SEQ ID NO: 1662250 - protein, 25 aa, Staphylococcus aureus
SAHGGYLIKVLNNWAKENVKTKEDA

SEQ ID NO: 1662251 - protein, 29 aa, Staphylococcus aureus
SAKEIARTDLGRYFDRFADKLDKTQTNAE

SEQ ID NO: 1662252 - protein, 29 aa, Staphylococcus aureus
SAKEIARTDLGRYFDRFADKLDKTQTNTE

SEQ ID NO: 1662253 - protein, 20 aa, Staphylococcus aureus
SALERYEFTGDITYLNKGET

SEQ ID NO: 1662254 - protein, 29 aa, Staphylococcus aureus
SASKLYDFSPWKNKSFWGVINNTLETNET

SEQ ID NO: 1662255 - protein, 23 aa, Staphylococcus aureus
SAVKHLLPDFALDALKERINELF

SEQ ID NO: 1662256 - protein, 20 aa, Staphylococcus aureus
SAYAFIKRLIKQFGKPQKVI

SEQ ID NO: 1662257 - protein, 21 aa, Staphylococcus aureus
SAYAFIKRLIKQFGKPQMIIT

SEQ ID NO: 1662258 - protein, 17 aa, Staphylococcus aureus
SDIAAFIFNVAFETLSS

SEQ ID NO: 1662259 - protein, 20 aa, Staphylococcus aureus
SDLLFKKKFDSADIQARLKV

SEQ ID NO: 1662260 - protein, 19 aa, Staphylococcus aureus
SDNLIKVFSEDVWNIMGYK

SEQ ID NO: 1662261 - protein, 19 aa, Staphylococcus aureus
SDNQDAVFFRSFSVDQRYR

SEQ ID NO: 1662262 - protein, 17 aa, Staphylococcus aureus
SEEELPIFRSFMEDTSE

SEQ ID NO: 1662263 - protein, 17 aa, Staphylococcus aureus
SEHRELFGDFPSKDFPL

SEQ ID NO: 1662264 - protein, 27 aa, Staphylococcus aureus
SEIYKFKYMNSWCLEYSEFLLDEVRLL

SEQ ID NO: 1662265 - protein, 27 aa, Staphylococcus aureus
SELNPTPKWSIARYKGLGEMNADQLWE

SEQ ID NO: 1662266 - protein, 19 aa, Staphylococcus aureus
SELTPNVARVIKRLINETF

SEQ ID NO: 1662267 - protein, 20 aa, Staphylococcus aureus
SENKPIIGENIFKHESGIHQ

SEQ ID NO: 1662268 - protein, 17 aa, Staphylococcus aureus
SEQRYVNSLTREFNNEA

SEQ ID NO: 1662269 - protein, 20 aa, Staphylococcus aureus
SESTIDRWFTNALKVLDEQL

SEQ ID NO: 1662270 - protein, 23 aa, Staphylococcus aureus
SEVKRLKSDPSFYGDFLEDSHHC

SEQ ID NO: 1662271 - protein, 30 aa, Staphylococcus aureus
SFCSTCTRARLSSDGKFYGCLFATVDGFNV

SEQ ID NO: 1662272 - protein, 20 aa, Staphylococcus aureus
SFDFVTPFGTYSVKSPYVGK

SEQ ID NO: 1662273 - protein, 18 aa, Staphylococcus aureus
SFTGVEFFNTVFKGTGYK

SEQ ID NO: 1662274 - protein, 19 aa, Staphylococcus aureus
SGCVGQAPKLFIGVNSAKE

SEQ ID NO: 1662275 - protein, 17 aa, Staphylococcus aureus
SGFSLNDLAVFTINNSI

SEQ ID NO: 1662276 - protein, 18 aa, Staphylococcus aureus
SGGIMLPNHAPLIVAEQF

SEQ ID NO: 1662277 - protein, 22 aa, Staphylococcus aureus
SHPANCLMARIGKNITLEQQQA

SEQ ID NO: 1662278 - protein, 23 aa, Staphylococcus aureus
SHPANCLMARIGKNITLEQQQAF

SEQ ID NO: 1662279 - protein, 24 aa, Staphylococcus aureus
SIGRGMTINRMYWRARRRESIFMT

SEQ ID NO: 1662280 - protein, 19 aa, Staphylococcus aureus
SIPKGQWTSIVGHNGSGKS

SEQ ID NO: 1662281 - protein, 35 aa, Staphylococcus aureus
SIQNHWLFKEKRTFSKFEAWIYLLMEANHSEAKVP

SEQ ID NO: 1662282 - protein, 17 aa, Staphylococcus aureus
SKELKLKVVNEYLNSNQ

SEQ ID NO: 1662283 - protein, 17 aa, Staphylococcus aureus
SKEMSIGVITNDIYTKE

SEQ ID NO: 1662284 - protein, 17 aa, Staphylococcus aureus
SKGSLAGVDGRLQTRNY

SEQ ID NO: 1662285 - protein, 19 aa, Staphylococcus aureus
SKKKPPGITKWNRKTVLGW

SEQ ID NO: 1662286 - protein, 30 aa, Staphylococcus aureus
SKLESAKRFKRWVTSDVLPAIRKHGIYATD

SEQ ID NO: 1662287 - protein, 30 aa, Staphylococcus aureus
SKLESAKRFKRWVTSDVLPAIRKYGIYATD

SEQ ID NO: 1662288 - protein, 19 aa, Staphylococcus aureus
SKLSNRKIDMYKKMTTDEK

SEQ ID NO: 1662289 - protein, 20 aa, Staphylococcus aureus
SKPIPLKDLMLHQSGLYKYK

SEQ ID NO: 1662290 - protein, 24 aa, Staphylococcus aureus
SLGMKQRLGIAMALIKKPEILVLD

SEQ ID NO: 1662291 - protein, 21 aa, Staphylococcus aureus
SLLKHYKIKLETFIELHSKAQ

SEQ ID NO: 1662292 - protein, 18 aa, Staphylococcus aureus
SMAEWDVMNIIWNKKSVS

SEQ ID NO: 1662293 - protein, 29 aa, Staphylococcus aureus
SNINLTLNAKKEWRNILISTGESSIANMA

SEQ ID NO: 1662294 - protein, 23 aa, Staphylococcus aureus
SNSFNISTTVAFVVASAGVKVIK

SEQ ID NO: 1662295 - protein, 24 aa, Staphylococcus aureus
SNTLCIRPGVVVTYDRNYVSNQLL

SEQ ID NO: 1662296 - protein, 18 aa, Staphylococcus aureus
SNTYSLVGCMCQPAFEFK

SEQ ID NO: 1662297 - protein, 23 aa, Staphylococcus aureus
SPDEWKGEVPSIGTILEGLQTLP

SEQ ID NO: 1662298 - protein, 22 aa, Staphylococcus aureus
SPEKHLELIMKWCAQELKNNFQ

SEQ ID NO: 1662299 - protein, 18 aa, Staphylococcus aureus
SPIAGRVDNVFPTKHAIG

SEQ ID NO: 1662300 - protein, 17 aa, Staphylococcus aureus
SPNELKTLPPVFIAHCN

SEQ ID NO: 1662301 - protein, 18 aa, Staphylococcus aureus
SPNELKTLPPVFVAHCNG

SEQ ID NO: 1662302 - protein, 21 aa, Staphylococcus aureus
SQLTTMCRLGWLRRHPRKAKP

SEQ ID NO: 1662303 - protein, 32 aa, Staphylococcus aureus
SQMPRLNLENALKIELAFYFTPPESWSKKKKA

SEQ ID NO: 1662304 - protein, 26 aa, Staphylococcus aureus
SRESDGFKDIRDVLGQVYETAEELDQ

SEQ ID NO: 1662305 - protein, 24 aa, Staphylococcus aureus
SRGMRMKIALTIALSHDVKLLILD

SEQ ID NO: 1662306 - protein, 19 aa, Staphylococcus aureus
SRGSFPQDVNFYINKETSI

SEQ ID NO: 1662307 - protein, 21 aa, Staphylococcus aureus
SSAEWEFMNIIWMKKYASANN

SEQ ID NO: 1662308 - protein, 28 aa, Staphylococcus aureus
SSETIGILKKEVISFTKLIKGTDKEAPQ

SEQ ID NO: 1662309 - protein, 23 aa, Staphylococcus aureus
SSFKNSEFHNMFNFKDKEFAQDA

SEQ ID NO: 1662310 - protein, 23 aa, Staphylococcus aureus
SSNANGMTVYWYHDNQRALADTL

SEQ ID NO: 1662311 - protein, 29 aa, Staphylococcus aureus
STLYYTCEKFKLLVLQGNVLGVQIITNND

SEQ ID NO: 1662312 - protein, 18 aa, Staphylococcus aureus
STPLEYGDIFNYFVKNIL

SEQ ID NO: 1662313 - protein, 28 aa, Staphylococcus aureus
STSLFTGKLGLCYIGLRLLNPKTIDSVS

SEQ ID NO: 1662314 - protein, 24 aa, Staphylococcus aureus
SVKNVSGKMSFIYADAQTHHIIDI

SEQ ID NO: 1662315 - protein, 24 aa, Staphylococcus aureus
SVLRIKESISYPVSHVLVNGIRYK

SEQ ID NO: 1662316 - protein, 23 aa, Staphylococcus aureus
SYDRLEGFNSLQWPVQPDGTDEP

SEQ ID NO: 1662317 - protein, 17 aa, Staphylococcus aureus
SYITKYYGGTVVNISTS

SEQ ID NO: 1662318 - protein, 23 aa, Staphylococcus aureus
SYPVNFVAGTIGDFFKKGDSKES

SEQ ID NO: 1662319 - protein, 26 aa, Staphylococcus aureus
TAFSMYPKLWENMGLSYPELITKLIE

SEQ ID NO: 1662320 - protein, 24 aa, Staphylococcus aureus
TALENGKHGFAFSSGVAAISAVVM

SEQ ID NO: 1662321 - protein, 25 aa, Staphylococcus aureus
TAMYISRLVKPIGIKVTRLAQGLSV

SEQ ID NO: 1662322 - protein, 17 aa, Staphylococcus aureus
TDMPHVVFFTFNQPDEW

SEQ ID NO: 1662323 - protein, 26 aa, Staphylococcus aureus
TDRDLKRFKGAHGLLYEQELGLQATI

SEQ ID NO: 1662324 - protein, 19 aa, Staphylococcus aureus
TDSEKLLFAEITSLSNKYG

SEQ ID NO: 1662325 - protein, 20 aa, Staphylococcus aureus
TEFDDMISLVGMHLENNLDY

SEQ ID NO: 1662326 - protein, 20 aa, Staphylococcus aureus
TELKRRYAQRLLQFPHVHNK

SEQ ID NO: 1662327 - protein, 20 aa, Staphylococcus aureus
TESKSGLTIIMRSSKIEYLP

SEQ ID NO: 1662328 - protein, 26 aa, Staphylococcus aureus
TGGTPFKTACMYGGVTLHDNNQLEEE

SEQ ID NO: 1662329 - protein, 22 aa, Staphylococcus aureus
TGKSHLAYAIAKAVKSKGHTVA

SEQ ID NO: 1662330 - protein, 17 aa, Staphylococcus aureus
TGSFKDRGMVMAVTKAK

SEQ ID NO: 1662331 - protein, 18 aa, Staphylococcus aureus
TGYYSRRINHEHRLVYTV

SEQ ID NO: 1662332 - protein, 17 aa, Staphylococcus aureus
THTELQIMHSLFQNKGK

SEQ ID NO: 1662333 - protein, 24 aa, Staphylococcus aureus
TIDNFRWAGVPFYIRTGKRMKSKT

SEQ ID NO: 1662334 - protein, 31 aa, Staphylococcus aureus
TIERAMKLIDEYDFLYGIIGWHPVDAIDFTE

SEQ ID NO: 1662335 - protein, 17 aa, Staphylococcus aureus
TIGDFFKKGDSKESKNK

SEQ ID NO: 1662336 - protein, 24 aa, Staphylococcus aureus
TIKGIECIYGLYKKNRRSLQIYGF

SEQ ID NO: 1662337 - protein, 22 aa, Staphylococcus aureus
TIYYRYFIEETMLYNIHLFMYK

SEQ ID NO: 1662338 - protein, 17 aa, Staphylococcus aureus
TKDPEYRTTPNGVSVTT

SEQ ID NO: 1662339 - protein, 20 aa, Staphylococcus aureus
TKFGIPSYYVIASSEASSNL

SEQ ID NO: 1662340 - protein, 17 aa, Staphylococcus aureus
TKKSAQKLIDAMEINEN

SEQ ID NO: 1662341 - protein, 20 aa, Staphylococcus aureus
TKLKKGGNFPKNLDYIDSYT

SEQ ID NO: 1662342 - protein, 24 aa, Staphylococcus aureus
TKLRRYKEALIFMGRKNGKTTTIS

SEQ ID NO: 1662343 - protein, 19 aa, Staphylococcus aureus
TKNLEDFYDKEGFRDEEFE

SEQ ID NO: 1662344 - protein, 17 aa, Staphylococcus aureus
TLDSIKAEMNVKVDNIV

SEQ ID NO: 1662345 - protein, 23 aa, Staphylococcus aureus
TLEAMSAAAIKFAQQFEENSTFK

SEQ ID NO: 1662346 - protein, 25 aa, Staphylococcus aureus
TLHQFPIDNLFPIMGQTVTTSELLN

SEQ ID NO: 1662347 - protein, 23 aa, Staphylococcus aureus
TLKGIECIYGLYKKTVGLFRSTD

SEQ ID NO: 1662348 - protein, 24 aa, Staphylococcus aureus
TLKGIECIYTLYKKNRRSLQIYGF

SEQ ID NO: 1662349 - protein, 19 aa, Staphylococcus aureus
TLLQLSWFSHIQVFGPESW

SEQ ID NO: 1662350 - protein, 20 aa, Staphylococcus aureus
TLNKVYGCMLMKQPITKSCF

SEQ ID NO: 1662351 - protein, 24 aa, Staphylococcus aureus
TMILHEFLPFIEIKQVPSSSVNYD

SEQ ID NO: 1662352 - protein, 19 aa, Staphylococcus aureus
TNDLLTWLQDPFIKDMPGK

SEQ ID NO: 1662353 - protein, 27 aa, Staphylococcus aureus
TPFPRISYDDAIEFLKSEGFDDIEWGE

SEQ ID NO: 1662354 - protein, 20 aa, Staphylococcus aureus
TPNLTYFCSYQLAKRTVDSY

SEQ ID NO: 1662355 - protein, 18 aa, Staphylococcus aureus
TPVIVKFEAGWCPDCRAM

SEQ ID NO: 1662356 - protein, 18 aa, Staphylococcus aureus
TQFIKSTKSRSLYEETTY

SEQ ID NO: 1662357 - protein, 20 aa, Staphylococcus aureus
TQTQIAIQIQKATQTQTVTQ

SEQ ID NO: 1662358 - protein, 17 aa, Staphylococcus aureus
TRIKKKLIDNWIDQSTS

SEQ ID NO: 1662359 - protein, 17 aa, Staphylococcus aureus
TRKIDMSEIKTALIAVG

SEQ ID NO: 1662360 - protein, 20 aa, Staphylococcus aureus
TRPLSATKRFRIVEIVEESV

SEQ ID NO: 1662361 - protein, 18 aa, Staphylococcus aureus
TSCEFDFTNEGKLKVSFD

SEQ ID NO: 1662362 - protein, 24 aa, Staphylococcus aureus
TSRLLSTRLDQVFSEIERITQASV

SEQ ID NO: 1662363 - protein, 25 aa, Staphylococcus aureus
TSSAYPELVSELANPFMAIYDTDAK

SEQ ID NO: 1662364 - protein, 22 aa, Staphylococcus aureus
TSTKAQIAFCIDVRSEPFRRHI

SEQ ID NO: 1662365 - protein, 20 aa, Staphylococcus aureus
TSYFGYKAIQLFKNNSKNKQ

SEQ ID NO: 1662366 - protein, 22 aa, Staphylococcus aureus
TTLKSLTFHVACDEWFQSYIKT

SEQ ID NO: 1662367 - protein, 29 aa, Staphylococcus aureus
TVASCAHMMIWEGIELIPVVSSNKKTVGV

SEQ ID NO: 1662368 - protein, 20 aa, Staphylococcus aureus
TVESGQIYGFLGRNGAGKTT

SEQ ID NO: 1662369 - protein, 19 aa, Staphylococcus aureus
TVTRFEPHQALFADNHGYA

SEQ ID NO: 1662370 - protein, 23 aa, Staphylococcus aureus
TWICKAPKYTGQEWMVYEDLVKV

SEQ ID NO: 1662371 - protein, 19 aa, Staphylococcus aureus
VAEHLDRYDEITAYLNEAG

SEQ ID NO: 1662372 - protein, 17 aa, Staphylococcus aureus
VARETRLAMAVGSTHAA

SEQ ID NO: 1662373 - protein, 19 aa, Staphylococcus aureus
VATEKGLDYDLYINFISNG

SEQ ID NO: 1662374 - protein, 27 aa, Staphylococcus aureus
VCEVADELYHLFVLMHALGVDFSEIEA

SEQ ID NO: 1662375 - protein, 24 aa, Staphylococcus aureus
VCISDPKLSFDAMTIVGNLNRDNA

SEQ ID NO: 1662376 - protein, 17 aa, Staphylococcus aureus
VCYDPWNAQSFITTIES

SEQ ID NO: 1662377 - protein, 23 aa, Staphylococcus aureus
VDFSEIKNVLSLVNLNVDKKKKV

SEQ ID NO: 1662378 - protein, 23 aa, Staphylococcus aureus
VDGEPYFIGKDVADILGYANGRD

SEQ ID NO: 1662379 - protein, 17 aa, Staphylococcus aureus
VDGFDFQLRVKKRAYSV

SEQ ID NO: 1662380 - protein, 25 aa, Staphylococcus aureus
VDHFKIVPLLIFSAMHYLKDIPDIV

SEQ ID NO: 1662381 - protein, 25 aa, Staphylococcus aureus
VDIFALKDYETWRTYMLAQETFTGG

SEQ ID NO: 1662382 - protein, 26 aa, Staphylococcus aureus
VDKLRDLYKRFGFRELTDYRTQNNLC

SEQ ID NO: 1662383 - protein, 24 aa, Staphylococcus aureus
VDSKSFKFSKLKTEDFSHRAETRE

SEQ ID NO: 1662384 - protein, 25 aa, Staphylococcus aureus
VEANANRYTFVWKKSIPNHESKLNE

SEQ ID NO: 1662385 - protein, 19 aa, Staphylococcus aureus
VEDLAKYSGVPVWNGLTDE

SEQ ID NO: 1662386 - protein, 23 aa, Staphylococcus aureus
VEERSAVSIGRRVQDPLSELVKI

SEQ ID NO: 1662387 - protein, 17 aa, Staphylococcus aureus
VEIKAATIINAEHVKKS

SEQ ID NO: 1662388 - protein, 27 aa, Staphylococcus aureus
VEKLYKFSPELVYEAWTKKDLLKQWFM

SEQ ID NO: 1662389 - protein, 19 aa, Staphylococcus aureus
VETLPDFNFHIAAITEMSD

SEQ ID NO: 1662390 - protein, 18 aa, Staphylococcus aureus
VFAEFEIDGKITTFKKES

SEQ ID NO: 1662391 - protein, 18 aa, Staphylococcus aureus
VFDSTGLLNINYQPKHLV

SEQ ID NO: 1662392 - protein, 26 aa, Staphylococcus aureus
VFKARRDRFEAMLAKADLPFVHAKGG

SEQ ID NO: 1662393 - protein, 18 aa, Staphylococcus aureus
VFKLKPNCHCTSKYLNNF

SEQ ID NO: 1662394 - protein, 19 aa, Staphylococcus aureus
VFLYHEYNLEFPITKAIPY

SEQ ID NO: 1662395 - protein, 18 aa, Staphylococcus aureus
VFNKRGYPIGQILIPSRD

SEQ ID NO: 1662396 - protein, 21 aa, Staphylococcus aureus
VFNYFKPKFMLGMTATPERSD

SEQ ID NO: 1662397 - protein, 20 aa, Staphylococcus aureus
VGGPGSYKSAGYVIPNVIVK

SEQ ID NO: 1662398 - protein, 21 aa, Staphylococcus aureus
VGGSVNPGGGIPMVTLSGQQV

SEQ ID NO: 1662399 - protein, 23 aa, Staphylococcus aureus
VGNWRDKFFKEREGKYQVEVKEA

SEQ ID NO: 1662400 - protein, 23 aa, Staphylococcus aureus
VGYRAQLTLSIGVGEGTENLIDL

SEQ ID NO: 1662401 - protein, 17 aa, Staphylococcus aureus
VIECPQCQNKLYLVSSI

SEQ ID NO: 1662402 - protein, 17 aa, Staphylococcus aureus
VIEDTGLMQSIDSPMFI

SEQ ID NO: 1662403 - protein, 17 aa, Staphylococcus aureus
VILYDRLVNPLILQYAN

SEQ ID NO: 1662404 - protein, 21 aa, Staphylococcus aureus
VKDVFNNEVWVKRDEIESFTF

SEQ ID NO: 1662405 - protein, 17 aa, Staphylococcus aureus
VKEKIALFNSDEVMGEQ

SEQ ID NO: 1662406 - protein, 20 aa, Staphylococcus aureus
VKKKEFLSLIPNVTCNYIKT

SEQ ID NO: 1662407 - protein, 42 aa, Staphylococcus aureus
VKNSALEQLKAQRINPVVKKNALEAIREVVNKQIEIIKNADA

SEQ ID NO: 1662408 - protein, 33 aa, Staphylococcus aureus
VKPLLTKEIEGFGELFRYLSYVEDVGTRALLSR

SEQ ID NO: 1662409 - protein, 28 aa, Staphylococcus aureus
VKQKEAKFENGVITRKADEKTTNNTAVD

SEQ ID NO: 1662410 - protein, 25 aa, Staphylococcus aureus
VKTPYKKWFERMSDYGFEENIDYVV

SEQ ID NO: 1662411 - protein, 23 aa, Staphylococcus aureus
VLASRLGGYAVDLLMQGETAKGV

SEQ ID NO: 1662412 - protein, 17 aa, Staphylococcus aureus
VLMTYYNIICHYGEQAF

SEQ ID NO: 1662413 - protein, 17 aa, Staphylococcus aureus
VLVETLPDFNFHIAAIT

SEQ ID NO: 1662414 - protein, 22 aa, Staphylococcus aureus
VMKEGLKTLLMNRFNTEKINID

SEQ ID NO: 1662415 - protein, 18 aa, Staphylococcus aureus
VNDDTSLVWLCNPNNPTG

SEQ ID NO: 1662416 - protein, 29 aa, Staphylococcus aureus
VNIFYGTSIPTCILVFKKCCQQDDNVLFI

SEQ ID NO: 1662417 - protein, 17 aa, Staphylococcus aureus
VNILKLTNHLGFVYQLN

SEQ ID NO: 1662418 - protein, 26 aa, Staphylococcus aureus
VNKLRDGYLLSDKKYKDWTEHNQDQI

SEQ ID NO: 1662419 - protein, 17 aa, Staphylococcus aureus
VNLERPINDIAFHLKDN

SEQ ID NO: 1662420 - protein, 18 aa, Staphylococcus aureus
VNQNVHFEVLLVKLAEQI

SEQ ID NO: 1662421 - protein, 25 aa, Staphylococcus aureus
VNRSRNSLREWLPWVDATEQPSDTR

SEQ ID NO: 1662422 - protein, 17 aa, Staphylococcus aureus
VPACTYYSYLKFDKTSN

SEQ ID NO: 1662423 - protein, 17 aa, Staphylococcus aureus
VPLNLIHILSIPQYVTY

SEQ ID NO: 1662424 - protein, 23 aa, Staphylococcus aureus
VPSIQAFHVNKCRFANRCNKKMD

SEQ ID NO: 1662425 - protein, 19 aa, Staphylococcus aureus
VQDALPNFELMRLDQMDQQ

SEQ ID NO: 1662426 - protein, 26 aa, Staphylococcus aureus
VQDAYTLRCIPQIHGASFQVFNYVKQ

SEQ ID NO: 1662427 - protein, 18 aa, Staphylococcus aureus
VQGENEFEGAFIATNERL

SEQ ID NO: 1662428 - protein, 30 aa, Staphylococcus aureus
VRFRRSQEVIQVWHAVGAFKTVGFSRTGKK

SEQ ID NO: 1662429 - protein, 17 aa, Staphylococcus aureus
VRFSRKMTHQGFQELKI

SEQ ID NO: 1662430 - protein, 18 aa, Staphylococcus aureus
VRKKLFLKLQRIKNNAFY

SEQ ID NO: 1662431 - protein, 20 aa, Staphylococcus aureus
VRNYLLKHKNLYEFNSSPYE

SEQ ID NO: 1662432 - protein, 24 aa, Staphylococcus aureus
VRSVPLRLVDTAGIRETEDIVEKI

SEQ ID NO: 1662433 - protein, 20 aa, Staphylococcus aureus
VSFDNFVDFIRWMKTPFEYE

SEQ ID NO: 1662434 - protein, 21 aa, Staphylococcus aureus
VSIRFSVNQNVHFEVLLVKLA

SEQ ID NO: 1662435 - protein, 17 aa, Staphylococcus aureus
VSRTTIYRYLNKLNNQE

SEQ ID NO: 1662436 - protein, 26 aa, Staphylococcus aureus
VSTLSGGQFQRVWIAKALILEPEILI

SEQ ID NO: 1662437 - protein, 17 aa, Staphylococcus aureus
VSWLEKWQRLEKKGRKE

SEQ ID NO: 1662438 - protein, 18 aa, Staphylococcus aureus
VTHIIPWHENEFIRLDPS

SEQ ID NO: 1662439 - protein, 24 aa, Staphylococcus aureus
VTTPHQVFLNWFGQDPAFDYFKTM

SEQ ID NO: 1662440 - protein, 31 aa, Staphylococcus aureus
VWEHNPRAQAFYKRHGFKVVGEHHFQTGDVT

SEQ ID NO: 1662441 - protein, 24 aa, Staphylococcus aureus
VWEKRIKLLEPYRVTKELMKKTGN

SEQ ID NO: 1662442 - protein, 27 aa, Staphylococcus aureus
VYDPTCGSGSLLLRVGKETQVYRYFGQ

SEQ ID NO: 1662443 - protein, 26 aa, Staphylococcus aureus
WAACIYALKHARELNVSNALLYTDSK

SEQ ID NO: 1662444 - protein, 19 aa, Staphylococcus aureus
WAESNATIIADFYKNMKTE

SEQ ID NO: 1662445 - protein, 17 aa, Staphylococcus aureus
WASSETIGILKKEVISF

SEQ ID NO: 1662446 - protein, 17 aa, Staphylococcus aureus
WDDFCDWYIEMSKIPMN

SEQ ID NO: 1662447 - protein, 20 aa, Staphylococcus aureus
WDEMKQKAVEIGKADTTSNK

SEQ ID NO: 1662448 - protein, 19 aa, Staphylococcus aureus
WFSHIQVFGPESWGNINQL

SEQ ID NO: 1662449 - protein, 17 aa, Staphylococcus aureus
WFVENNITSSENSYDGN

SEQ ID NO: 1662450 - protein, 17 aa, Staphylococcus aureus
WIAKALILEPEILILDE

SEQ ID NO: 1662451 - protein, 19 aa, Staphylococcus aureus
WIPNFYRQCKLGWDNEINF

SEQ ID NO: 1662452 - protein, 23 aa, Staphylococcus aureus
WKDSEIWKAIQLLGIPVEKIHLY

SEQ ID NO: 1662453 - protein, 23 aa, Staphylococcus aureus
WLRSKDTIEFLGVWENINNPNFK

SEQ ID NO: 1662454 - protein, 17 aa, Staphylococcus aureus
WMASSQLMITKPGGITI

SEQ ID NO: 1662455 - protein, 18 aa, Staphylococcus aureus
WNAKTVWIRKGTVINKML

SEQ ID NO: 1662456 - protein, 19 aa, Staphylococcus aureus
WPRLIEIKVPTLILAGEYD

SEQ ID NO: 1662457 - protein, 17 aa, Staphylococcus aureus
WQFPMFESEHARREMTE

SEQ ID NO: 1662458 - protein, 21 aa, Staphylococcus aureus
WTSCEFDFTKEGKLKVSFDYI

SEQ ID NO: 1662459 - protein, 21 aa, Staphylococcus aureus
WYDLMPESGKKFYPTKYLLIY

SEQ ID NO: 1662460 - protein, 20 aa, Staphylococcus aureus
YADDKFNKRYSVIFDGTANG

SEQ ID NO: 1662461 - protein, 19 aa, Staphylococcus aureus
YALLFALSSGRTFIGQTTF

SEQ ID NO: 1662462 - protein, 22 aa, Staphylococcus aureus
YDEKSFRKYFAKGYSYNSTGLS

SEQ ID NO: 1662463 - protein, 19 aa, Staphylococcus aureus
YDIKFNLDFNNITNEAYIY

SEQ ID NO: 1662464 - protein, 17 aa, Staphylococcus aureus
YDIPEYVNQVLPKLESF

SEQ ID NO: 1662465 - protein, 18 aa, Staphylococcus aureus
YDKEGFRDEEFEKGDKGT

SEQ ID NO: 1662466 - protein, 21 aa, Staphylococcus aureus
YEALVKIFYRYGEEKFSKQIA

SEQ ID NO: 1662467 - protein, 19 aa, Staphylococcus aureus
YEEVFEFLYDREIRGLAQV

SEQ ID NO: 1662468 - protein, 17 aa, Staphylococcus aureus
YEKRLGPYTKIDIIEVT

SEQ ID NO: 1662469 - protein, 21 aa, Staphylococcus aureus
YELRAMLRMMPSLIDTGDDND

SEQ ID NO: 1662470 - protein, 24 aa, Staphylococcus aureus
YEQGFKNICLRTNNIEAVKNKLQS

SEQ ID NO: 1662471 - protein, 22 aa, Staphylococcus aureus
YEWLQQSTFNFPGKEELKRMFE

SEQ ID NO: 1662472 - protein, 20 aa, Staphylococcus aureus
YGTASGRVFLINTTNGQVVS

SEQ ID NO: 1662473 - protein, 17 aa, Staphylococcus aureus
YHIPFPDKYRGMYEQPQ

SEQ ID NO: 1662474 - protein, 24 aa, Staphylococcus aureus
YHKILIKNFNLWQAQREDSLLDIS

SEQ ID NO: 1662475 - protein, 20 aa, Staphylococcus aureus
YHYRRNNLKGAYKSFNKSKE

SEQ ID NO: 1662476 - protein, 18 aa, Staphylococcus aureus
YIKGMPFGHEFSGVVDAI

SEQ ID NO: 1662477 - protein, 31 aa, Staphylococcus aureus
YKEGRARELSDWLVGINLSRHFTKISRELGN

SEQ ID NO: 1662478 - protein, 17 aa, Staphylococcus aureus
YKIYFGFADRHAYEDFK

SEQ ID NO: 1662479 - protein, 24 aa, Staphylococcus aureus
YKKNRRSLQIYGFSPCHEISIMLA

SEQ ID NO: 1662480 - protein, 19 aa, Staphylococcus aureus
YKLTIPEIFSKHGEQYFRN

SEQ ID NO: 1662481 - protein, 18 aa, Staphylococcus aureus
YKNLCTNSNKLLDKLHKA

SEQ ID NO: 1662482 - protein, 20 aa, Staphylococcus aureus
YKPHSGFTLETQFLPNDINL

SEQ ID NO: 1662483 - protein, 19 aa, Staphylococcus aureus
YKVYDEYIEIISLDSFLEN

SEQ ID NO: 1662484 - protein, 18 aa, Staphylococcus aureus
YLGRKTIMTELAKDIGLE

SEQ ID NO: 1662485 - protein, 17 aa, Staphylococcus aureus
YLKDWTIARLLKTDRII

SEQ ID NO: 1662486 - protein, 18 aa, Staphylococcus aureus
YLKKRLNNKIVIMEYKPA

SEQ ID NO: 1662487 - protein, 17 aa, Staphylococcus aureus
YLNHFDMDFLYLTDTKN

SEQ ID NO: 1662488 - protein, 17 aa, Staphylococcus aureus
YLNRFFGSKRYLYQDNE

SEQ ID NO: 1662489 - protein, 27 aa, Staphylococcus aureus
YLRDKTWSVHVARRIKEIGPRIKKVSD

SEQ ID NO: 1662490 - protein, 17 aa, Staphylococcus aureus
YLYKGLRDKSPVVRRTA

SEQ ID NO: 1662491 - protein, 17 aa, Staphylococcus aureus
YMKTAQDRLNLFKNIIK

SEQ ID NO: 1662492 - protein, 25 aa, Staphylococcus aureus
YNHLRNRILLCSKLYAPKSKKEVKQ

SEQ ID NO: 1662493 - protein, 24 aa, Staphylococcus aureus
YNKAGFDRTKWYSINYETLNKLVA

SEQ ID NO: 1662494 - protein, 19 aa, Staphylococcus aureus
YNMVRVLVAFLIEVGKGRH

SEQ ID NO: 1662495 - protein, 19 aa, Staphylococcus aureus
YNQYMGAYHLQWHMIKYAK

SEQ ID NO: 1662496 - protein, 26 aa, Staphylococcus aureus
YPDKGVRLKAYFNEMTYDDKLRQRIK

SEQ ID NO: 1662497 - protein, 20 aa, Staphylococcus aureus
YPDQLAIVIAIDIAFNLYSI

SEQ ID NO: 1662498 - protein, 19 aa, Staphylococcus aureus
YPQAFIHMVGFSRGGLQGL

SEQ ID NO: 1662499 - protein, 22 aa, Staphylococcus aureus
YPTISNDFLKPFGHVWLVERWM

SEQ ID NO: 1662500 - protein, 17 aa, Staphylococcus aureus
YQMLNLGKYQGVSVSAL

SEQ ID NO: 1662501 - protein, 25 aa, Staphylococcus aureus
YQTQLKFVLIYTIHIKKLTKLSIKK

SEQ ID NO: 1662502 - protein, 18 aa, Staphylococcus aureus
YRKYYEPLIRKNDKEFKE

SEQ ID NO: 1662503 - protein, 19 aa, Staphylococcus aureus
YRNGESYRFSQHVGKQYTY

SEQ ID NO: 1662504 - protein, 21 aa, Staphylococcus aureus
YRYIGNELWIYSAVLDSNKNN

SEQ ID NO: 1662505 - protein, 17 aa, Staphylococcus aureus
YSGVPVWNGLTDEDHPT

SEQ ID NO: 1662506 - protein, 17 aa, Staphylococcus aureus
YSIEAKPGICIIGEVVG

SEQ ID NO: 1662507 - protein, 18 aa, Staphylococcus aureus
YSIIALNIAEIFTHPDVV

SEQ ID NO: 1662508 - protein, 19 aa, Staphylococcus aureus
YSLYIKKGLVEPFIVFYNQ

SEQ ID NO: 1662509 - protein, 21 aa, Staphylococcus aureus
YSPSNAMKQAWLQISQDNKLM

SEQ ID NO: 1662510 - protein, 23 aa, Staphylococcus aureus
YSQRKIDVEPVFGFMKAILGFTR

SEQ ID NO: 1662511 - protein, 18 aa, Staphylococcus aureus
YTDDKFNKRYSVIFDGTA

SEQ ID NO: 1662512 - protein, 19 aa, Staphylococcus aureus
YTFELHKKLQEHRMADVIE

SEQ ID NO: 1662513 - protein, 17 aa, Staphylococcus aureus
YTLAYTGMRAGELLALK

SEQ ID NO: 1662514 - protein, 17 aa, Staphylococcus aureus
YTLLDYFGDDWLIMIDE

SEQ ID NO: 1662515 - protein, 18 aa, Staphylococcus aureus
YTPGLPFKIVGTKNGSLL

SEQ ID NO: 1662516 - protein, 17 aa, Staphylococcus aureus
YTSEHPEFVTVDENTGA

SEQ ID NO: 1662517 - protein, 24 aa, Staphylococcus aureus
YTYFKEGLVLFTYLHLANEEKLTQ

SEQ ID NO: 1662518 - protein, 25 aa, Staphylococcus aureus
YVMMKGKLYGHVYIKDCKVRQSFEL

SEQ ID NO: 1662519 - protein, 19 aa, Staphylococcus aureus
YVNDRGGEIVFNYTKPGSD

SEQ ID NO: 1662520 - protein, 30 aa, Staphylococcus aureus
YVSRSHPGLLKRLFEQEVPEIYDGTVIVKS

SEQ ID NO: 1662521 - protein, 24 aa, Staphylococcus aureus
YWDSEARGAIFGLSRGTEKEHFIR

SEQ ID NO: 1662522 - protein, 17 aa, Staphylococcus aureus
YYNFYGVGALDKDPIKT

SEQ ID NO: 1662523 - protein, 20 aa, Staphylococcus aureus
YYPEYNIAVSWQRLREGKTI

SEQ ID NO: 1662524 - protein, 17 aa, Staphylococcus aureus
AAKPVVHVFIATSPIHL

SEQ ID NO: 1662525 - protein, 24 aa, Staphylococcus aureus
AAMAPCPYIYAEIAKRSQSDHKLN

SEQ ID NO: 1662526 - protein, 20 aa, Staphylococcus aureus
AARARGRYGGRPEKLKKKDL

SEQ ID NO: 1662527 - protein, 21 aa, Staphylococcus aureus
AATIRPQFIAYQIPIGLGSIK

SEQ ID NO: 1662528 - protein, 25 aa, Staphylococcus aureus
ACVSEAIHLLPYNVFFVPARGGLGE

SEQ ID NO: 1662529 - protein, 21 aa, Staphylococcus aureus
ADASLAMLLYRDDYYNRDEDD

SEQ ID NO: 1662530 - protein, 24 aa, Staphylococcus aureus
ADEISGMIPVEWENIYTIAYVTDQ

SEQ ID NO: 1662531 - protein, 17 aa, Staphylococcus aureus
ADGLIFHPYLAGERAPL

SEQ ID NO: 1662532 - protein, 21 aa, Staphylococcus aureus
ADKIIGLSISDLGEYAKSDLT

SEQ ID NO: 1662533 - protein, 24 aa, Staphylococcus aureus
ADKMKSWYERFGFGKSTKGMFDGE

SEQ ID NO: 1662534 - protein, 17 aa, Staphylococcus aureus
ADKNMPLAIDASKDEPS

SEQ ID NO: 1662535 - protein, 20 aa, Staphylococcus aureus
ADQAICIGEANTLDSYLNID

SEQ ID NO: 1662536 - protein, 23 aa, Staphylococcus aureus
ADRILRTSHKFDDKQAFMTKVLT

SEQ ID NO: 1662537 - protein, 23 aa, Staphylococcus aureus
AEAAEYFSKVLFQMDIPNNLLIA

SEQ ID NO: 1662538 - protein, 18 aa, Staphylococcus aureus
AEERKEKFLAKNKDNPVV

SEQ ID NO: 1662539 - protein, 21 aa, Staphylococcus aureus
AEIMGIPGVDVVVGTQDRHKL

SEQ ID NO: 1662540 - protein, 17 aa, Staphylococcus aureus
AEKAFRHEIKKLDDVRM

SEQ ID NO: 1662541 - protein, 18 aa, Staphylococcus aureus
AELEGEFAEMNGWNAEAD

SEQ ID NO: 1662542 - protein, 17 aa, Staphylococcus aureus
AELRKKKPHLFNVPQKN

SEQ ID NO: 1662543 - protein, 23 aa, Staphylococcus aureus
AENILPTRFVDHTPLAHLTLDTY

SEQ ID NO: 1662544 - protein, 24 aa, Staphylococcus aureus
AERRTSGDYDLMFNQTWGLLYDPQ

SEQ ID NO: 1662545 - protein, 19 aa, Staphylococcus aureus
AETGMHFTITVKNGLTLQE

SEQ ID NO: 1662546 - protein, 18 aa, Staphylococcus aureus
AETSLTIMAKEFIEKYSP

SEQ ID NO: 1662547 - protein, 18 aa, Staphylococcus aureus
AEVFKEILGHKVNITTPS

SEQ ID NO: 1662548 - protein, 25 aa, Staphylococcus aureus
AFDRIDVEGPFYIKDDISNTITRVH

SEQ ID NO: 1662549 - protein, 23 aa, Staphylococcus aureus
AFGAIRIKNYLIRAFNRKQPMEE

SEQ ID NO: 1662550 - protein, 19 aa, Staphylococcus aureus
AFIETAKIVLRWLKEQDIQ

SEQ ID NO: 1662551 - protein, 19 aa, Staphylococcus aureus
AFTVMYLLICKMFEDENVD

SEQ ID NO: 1662552 - protein, 22 aa, Staphylococcus aureus
AGLCQMIKPTVIDWYIDEYNPK

SEQ ID NO: 1662553 - protein, 20 aa, Staphylococcus aureus
AGYACGYHLVKYFLQKTNIP

SEQ ID NO: 1662554 - protein, 25 aa, Staphylococcus aureus
AGYASCFNAAFDLILKQNKVRDAHP

SEQ ID NO: 1662555 - protein, 17 aa, Staphylococcus aureus
AHIGPWVTNTNWSRDNV

SEQ ID NO: 1662556 - protein, 17 aa, Staphylococcus aureus
AHIKNIHSFAKTTIEEI

SEQ ID NO: 1662557 - protein, 23 aa, Staphylococcus aureus
AHILEGLRIALDHIDEIISTIRE

SEQ ID NO: 1662558 - protein, 32 aa, Staphylococcus aureus
AIDKRISNPFLRQMLGYFIKYVGSSSYDAPAV

SEQ ID NO: 1662559 - protein, 18 aa, Staphylococcus aureus
AIEFAKKHRKEFEKVGEQ

SEQ ID NO: 1662560 - protein, 26 aa, Staphylococcus aureus
AIEFARSGDTIVVWRLDRLGRNMEDL

SEQ ID NO: 1662561 - protein, 17 aa, Staphylococcus aureus
AIGVSGLITPWNFPTNQ

SEQ ID NO: 1662562 - protein, 17 aa, Staphylococcus aureus
AILKGVDDWEMFEDKNE

SEQ ID NO: 1662563 - protein, 19 aa, Staphylococcus aureus
AIMGMNFHLVCPKELNPTD

SEQ ID NO: 1662564 - protein, 24 aa, Staphylococcus aureus
AISAKAQDGASCVTYIGPNGAGHY

SEQ ID NO: 1662565 - protein, 23 aa, Staphylococcus aureus
AISKVGKGKAAFIGDSSLVEDSS

SEQ ID NO: 1662566 - protein, 20 aa, Staphylococcus aureus
AISTLCPYKLGNAATNASAP

SEQ ID NO: 1662567 - protein, 19 aa, Staphylococcus aureus
AIVSVKFDINYSLKPLKLS

SEQ ID NO: 1662568 - protein, 29 aa, Staphylococcus aureus
AIYTARKGLRTGIVADRMGGQVNDTAGIE

SEQ ID NO: 1662569 - protein, 18 aa, Staphylococcus aureus
AKAALNGADNLRNAKTSA

SEQ ID NO: 1662570 - protein, 28 aa, Staphylococcus aureus
AKAFVASAIKNGWKMNGFVGPVDHGAYN

SEQ ID NO: 1662571 - protein, 17 aa, Staphylococcus aureus
AKDYLKDHPELVDMDGQ

SEQ ID NO: 1662572 - protein, 26 aa, Staphylococcus aureus
AKEIARTDLGRYFDRFADKLDKTQTN

SEQ ID NO: 1662573 - protein, 29 aa, Staphylococcus aureus
AKETKKELLLLLMRLMKVKVKGYGEIIFK

SEQ ID NO: 1662574 - protein, 17 aa, Staphylococcus aureus
AKKHGWDTPEKAISGGA

SEQ ID NO: 1662575 - protein, 17 aa, Staphylococcus aureus
AKKTHTWLHTKDIPGSH

SEQ ID NO: 1662576 - protein, 22 aa, Staphylococcus aureus
AKLETRNGYNLSAMSFDPEMVK

SEQ ID NO: 1662577 - protein, 21 aa, Staphylococcus aureus
AKPYLHCVFNKDILNMDKVDI

SEQ ID NO: 1662578 - protein, 24 aa, Staphylococcus aureus
AKQLKELHRQTGHMIQWYIMTSDI

SEQ ID NO: 1662579 - protein, 23 aa, Staphylococcus aureus
AKQQAKDALRQMTHLSDAQKQSI

SEQ ID NO: 1662580 - protein, 19 aa, Staphylococcus aureus
AKSNQRFTVIEAQSKEEAK

SEQ ID NO: 1662581 - protein, 19 aa, Staphylococcus aureus
AKSNQRFTVVEAESKEEAK

SEQ ID NO: 1662582 - protein, 17 aa, Staphylococcus aureus
AKSVTFSTGHFKDSEEN

SEQ ID NO: 1662583 - protein, 27 aa, Staphylococcus aureus
AKVKEIKENPAAYVLLGYNDTTNRSFV

SEQ ID NO: 1662584 - protein, 20 aa, Staphylococcus aureus
AKVTTPILVKAPIAGRRILL

SEQ ID NO: 1662585 - protein, 23 aa, Staphylococcus aureus
AKYRFPERNRIISGLSKGVLITE

SEQ ID NO: 1662586 - protein, 20 aa, Staphylococcus aureus
ALEVKTRYNDWFERMINYGF

SEQ ID NO: 1662587 - protein, 24 aa, Staphylococcus aureus
ALKEYKKKYLILRIFNVSGEEPQF

SEQ ID NO: 1662588 - protein, 26 aa, Staphylococcus aureus
ALKGIYQFALNYVFDIKIIPELLRIV

SEQ ID NO: 1662589 - protein, 23 aa, Staphylococcus aureus
ALKNRFVVIHVDYIDGDILKNVI

SEQ ID NO: 1662590 - protein, 27 aa, Staphylococcus aureus
ALLIEVLKSRVIRHAYLDEFENEPLKP

SEQ ID NO: 1662591 - protein, 17 aa, Staphylococcus aureus
ALNGDARLNEAKNTAKQ

SEQ ID NO: 1662592 - protein, 17 aa, Staphylococcus aureus
ALTDRNGLRPGRYTITK

SEQ ID NO: 1662593 - protein, 17 aa, Staphylococcus aureus
ALTFSYLTSHDVLGSII

SEQ ID NO: 1662594 - protein, 24 aa, Staphylococcus aureus
ALTSYLKKQNCLYVLVDPYLIENL

SEQ ID NO: 1662595 - protein, 28 aa, Staphylococcus aureus
ALVKALQAWDIYHLYGIPGDSIDAVVDS

SEQ ID NO: 1662596 - protein, 24 aa, Staphylococcus aureus
ALWNKINPSFALKSMFGGYDELME

SEQ ID NO: 1662597 - protein, 22 aa, Staphylococcus aureus
AMDKFLECVLVYKSDVEKELFE

SEQ ID NO: 1662598 - protein, 20 aa, Staphylococcus aureus
AMKGIYLRYDENGAITSHTI

SEQ ID NO: 1662599 - protein, 20 aa, Staphylococcus aureus
ANDLALRLRNQYGVEPNDRV

SEQ ID NO: 1662600 - protein, 29 aa, Staphylococcus aureus
ANEISGMIPVEWEKVYVIAYVDHQGGEVI

SEQ ID NO: 1662601 - protein, 30 aa, Staphylococcus aureus
ANEISSMILVEWEKVYTMAYIDDGGGEVFF

SEQ ID NO: 1662602 - protein, 19 aa, Staphylococcus aureus
ANEWKMTAKELNYFINELV

SEQ ID NO: 1662603 - protein, 28 aa, Staphylococcus aureus
ANKISGMIPVEWEKVYAMAYIDEESGEV

SEQ ID NO: 1662604 - protein, 26 aa, Staphylococcus aureus
ANKISSMIPVEWAKVYAMAYIDEESG

SEQ ID NO: 1662605 - protein, 28 aa, Staphylococcus aureus
ANKISSMIPVEWEKVYTIAYVDDQGGEV

SEQ ID NO: 1662606 - protein, 17 aa, Staphylococcus aureus
ANLLSGLGIDPTLHDKK

SEQ ID NO: 1662607 - protein, 17 aa, Staphylococcus aureus
ANPFMAIYYTDAKSDVN

SEQ ID NO: 1662608 - protein, 22 aa, Staphylococcus aureus
ANRLIGAVLMDLHDEWIYSSRK

SEQ ID NO: 1662609 - protein, 20 aa, Staphylococcus aureus
ANYKRHGMKLMILGNDEPYN

SEQ ID NO: 1662610 - protein, 18 aa, Staphylococcus aureus
APIQIYINAHYIVGMTAI

SEQ ID NO: 1662611 - protein, 20 aa, Staphylococcus aureus
APSKFEAWFLTTEHTEEDIK

SEQ ID NO: 1662612 - protein, 18 aa, Staphylococcus aureus
AQAFDEILEGLPNAMQDA

SEQ ID NO: 1662613 - protein, 17 aa, Staphylococcus aureus
AQAFDEILEGLPNAMQY

SEQ ID NO: 1662614 - protein, 18 aa, Staphylococcus aureus
AQHLGCKVYRTSHEDDDL

SEQ ID NO: 1662615 - protein, 17 aa, Staphylococcus aureus
AQLFVVQILFQYLFSQG

SEQ ID NO: 1662616 - protein, 27 aa, Staphylococcus aureus
AQSGRHSYHFNKIYFLRISTLPLSLGQ

SEQ ID NO: 1662617 - protein, 24 aa, Staphylococcus aureus
AQVLYPKILIDKIIYLLGTVADNG

SEQ ID NO: 1662618 - protein, 17 aa, Staphylococcus aureus
ARFGRTLLLDAMEMANE

SEQ ID NO: 1662619 - protein, 17 aa, Staphylococcus aureus
ARKAIESFVAETTEKYG

SEQ ID NO: 1662620 - protein, 23 aa, Staphylococcus aureus
ARKGEIRALTWRDVNFEDEFIHI

SEQ ID NO: 1662621 - protein, 17 aa, Staphylococcus aureus
ARKHFYQLLKNVNNNHE

SEQ ID NO: 1662622 - protein, 17 aa, Staphylococcus aureus
ARRCSRCLKQLNQDEAY

SEQ ID NO: 1662623 - protein, 17 aa, Staphylococcus aureus
ARTRKMGGTGLGLAISK

SEQ ID NO: 1662624 - protein, 17 aa, Staphylococcus aureus
ARVLEAMGVDYIDESEV

SEQ ID NO: 1662625 - protein, 28 aa, Staphylococcus aureus
ARVREILDLPDYVFPLFGMAVGEPAEDE

SEQ ID NO: 1662626 - protein, 18 aa, Staphylococcus aureus
ASERICFGKFTNAGQTCI

SEQ ID NO: 1662627 - protein, 17 aa, Staphylococcus aureus
ASIELLRANMMTTNGGW

SEQ ID NO: 1662628 - protein, 25 aa, Staphylococcus aureus
ASITNFKASKTFPLQQLSQDDVFAK

SEQ ID NO: 1662629 - protein, 21 aa, Staphylococcus aureus
ASKEANIKHCVMVSTYDSRRQ

SEQ ID NO: 1662630 - protein, 18 aa, Staphylococcus aureus
ASSFKLQIIFVILKMSET

SEQ ID NO: 1662631 - protein, 18 aa, Staphylococcus aureus
ASTGKRLQIGDLLQKPTV

SEQ ID NO: 1662632 - protein, 17 aa, Staphylococcus aureus
ASYQEYLTINGDCVLYE

SEQ ID NO: 1662633 - protein, 35 aa, Staphylococcus aureus
ATFKSRVEKSIADWGIKLERTFYVSKFDHPENELE

SEQ ID NO: 1662634 - protein, 21 aa, Staphylococcus aureus
ATIEHKKWGKGVDVKIDTPDN

SEQ ID NO: 1662635 - protein, 17 aa, Staphylococcus aureus
ATIRRDFSYFGELGKKG

SEQ ID NO: 1662636 - protein, 22 aa, Staphylococcus aureus
ATLDMRLRYMLLPMCLDIEHSL

SEQ ID NO: 1662637 - protein, 25 aa, Staphylococcus aureus
ATLFPNRVDLGLGRAPGTDMMTASA

SEQ ID NO: 1662638 - protein, 22 aa, Staphylococcus aureus
ATLRIDICEIHIEIANYIYEEI

SEQ ID NO: 1662639 - protein, 26 aa, Staphylococcus aureus
AVDKVTHLRALLQLRDVAQDNDAIKR

SEQ ID NO: 1662640 - protein, 19 aa, Staphylococcus aureus
AVDPMKWLKSLKGGGGKVG

SEQ ID NO: 1662641 - protein, 23 aa, Staphylococcus aureus
AVGEAESSLSFIGDLDNIDDKTY

SEQ ID NO: 1662642 - protein, 22 aa, Staphylococcus aureus
AVIKPKKIMLVAGHGYNDPGAV

SEQ ID NO: 1662643 - protein, 17 aa, Staphylococcus aureus
AVINYAKKHYKLLYDPT

SEQ ID NO: 1662644 - protein, 17 aa, Staphylococcus aureus
AVRDVRELIVQKSQEGV

SEQ ID NO: 1662645 - protein, 21 aa, Staphylococcus aureus
AVRGRQVIINKFAVELNKDIY

SEQ ID NO: 1662646 - protein, 22 aa, Staphylococcus aureus
AVRKIMFALNRFMGNKYSNIDL

SEQ ID NO: 1662647 - protein, 18 aa, Staphylococcus aureus
AVVLPHGVLFRGASEGVI

SEQ ID NO: 1662648 - protein, 26 aa, Staphylococcus aureus
AWDNKDRPLALCAALLHDLGHGPFSH

SEQ ID NO: 1662649 - protein, 19 aa, Staphylococcus aureus
AWNSPEMIMQRALKIANNT

SEQ ID NO: 1662650 - protein, 18 aa, Staphylococcus aureus
AYDRVEWFRNGINGLGET

SEQ ID NO: 1662651 - protein, 17 aa, Staphylococcus aureus
AYESLICDALIGNQTNF

SEQ ID NO: 1662652 - protein, 17 aa, Staphylococcus aureus
AYHLQWHMIKYAKSHNI

SEQ ID NO: 1662653 - protein, 19 aa, Staphylococcus aureus
AYLPIYAIQNHLCDYGIAG

SEQ ID NO: 1662654 - protein, 35 aa, Staphylococcus aureus
AYMGMPGDIFSFYSRECIDGMVIEALGQGNIPPSA

SEQ ID NO: 1662655 - protein, 18 aa, Staphylococcus aureus
AYPKALVGENSWGSQVVE

SEQ ID NO: 1662656 - protein, 17 aa, Staphylococcus aureus
AYQLLLDEGYIYSRPRS

SEQ ID NO: 1662657 - protein, 18 aa, Staphylococcus aureus
CARQFLWSTAKGYQQFKD

SEQ ID NO: 1662658 - protein, 18 aa, Staphylococcus aureus
CCTHPVLSGPAKERIENS

SEQ ID NO: 1662659 - protein, 17 aa, Staphylococcus aureus
CECKGQWTMENFIEIEI

SEQ ID NO: 1662660 - protein, 21 aa, Staphylococcus aureus
CENTYDLAPRGTFDNWFNMYI

SEQ ID NO: 1662661 - protein, 17 aa, Staphylococcus aureus
CEVPKALEHLGFGALEL

SEQ ID NO: 1662662 - protein, 17 aa, Staphylococcus aureus
CGATGAGIGEELYDDIL

SEQ ID NO: 1662663 - protein, 20 aa, Staphylococcus aureus
CGIDNHFQLLLYISENHCQL

SEQ ID NO: 1662664 - protein, 19 aa, Staphylococcus aureus
CGLEVGEFIHTFGDAHIYS

SEQ ID NO: 1662665 - protein, 17 aa, Staphylococcus aureus
CHIAEVLMPEGQVDASD

SEQ ID NO: 1662666 - protein, 17 aa, Staphylococcus aureus
CHIAIGITKDGDREIIG

SEQ ID NO: 1662667 - protein, 19 aa, Staphylococcus aureus
CKTPTISAVGHETDFTLSD

SEQ ID NO: 1662668 - protein, 17 aa, Staphylococcus aureus
CLQKGAFVSDKDGDMHY

SEQ ID NO: 1662669 - protein, 21 aa, Staphylococcus aureus
CPFHTRCPIAQDMCKKSMPEL

SEQ ID NO: 1662670 - protein, 20 aa, Staphylococcus aureus
CPNNKRIGFKRYAYRNDRYG

SEQ ID NO: 1662671 - protein, 19 aa, Staphylococcus aureus
CQYPQLAHHNFFFTENAYL

SEQ ID NO: 1662672 - protein, 17 aa, Staphylococcus aureus
CSYAQGFAQMRKASEDH

SEQ ID NO: 1662673 - protein, 22 aa, Staphylococcus aureus
CYHYRRNNLKGAYKSFNKSKEI

SEQ ID NO: 1662674 - protein, 17 aa, Staphylococcus aureus
CYTLLRPDGKTMFYLHS

SEQ ID NO: 1662675 - protein, 17 aa, Staphylococcus aureus
CYYYHSINSIRRVFEEF

SEQ ID NO: 1662676 - protein, 23 aa, Staphylococcus aureus
DAALWGTRAAYIGGFDSTSNVRA

SEQ ID NO: 1662677 - protein, 26 aa, Staphylococcus aureus
DAIRLSCKGLQQFSHAKTKQIVLSID

SEQ ID NO: 1662678 - protein, 19 aa, Staphylococcus aureus
DALIAPAVKVWIETYGGKH

SEQ ID NO: 1662679 - protein, 19 aa, Staphylococcus aureus
DALLKAGSNIIEWVINCYL

SEQ ID NO: 1662680 - protein, 18 aa, Staphylococcus aureus
DANKRQAYDEKVTAAENI

SEQ ID NO: 1662681 - protein, 20 aa, Staphylococcus aureus
DAVLKRFNVALGDIEAVITE

SEQ ID NO: 1662682 - protein, 19 aa, Staphylococcus aureus
DDDKIKGLLEVATQQIDKL

SEQ ID NO: 1662683 - protein, 21 aa, Staphylococcus aureus
DDGYYLPMDKYLFVYHDQLEY

SEQ ID NO: 1662684 - protein, 24 aa, Staphylococcus aureus
DDIPIKEYFAGVDWGYEHYGSIVL

SEQ ID NO: 1662685 - protein, 23 aa, Staphylococcus aureus
DDKEARKALNGHFKENIFTSFIN

SEQ ID NO: 1662686 - protein, 17 aa, Staphylococcus aureus
DDKTASVLKSWRTHQRV

SEQ ID NO: 1662687 - protein, 21 aa, Staphylococcus aureus
DDLWMNLYYLFKNLRNLFKEE

SEQ ID NO: 1662688 - protein, 23 aa, Staphylococcus aureus
DDMSMMVGIVLSGFEYRAQKEKY

SEQ ID NO: 1662689 - protein, 26 aa, Staphylococcus aureus
DDNVCSCCGQKLPVEQVDMAREKALQ

SEQ ID NO: 1662690 - protein, 21 aa, Staphylococcus aureus
DDPMYFIRLNFPDKVSVGDKA

SEQ ID NO: 1662691 - protein, 23 aa, Staphylococcus aureus
DDPRHPNWLVIEVCGGQTDSKRQ

SEQ ID NO: 1662692 - protein, 17 aa, Staphylococcus aureus
DDTLPPLFDELPKEEPK

SEQ ID NO: 1662693 - protein, 20 aa, Staphylococcus aureus
DDVYWCTADPGWVTGTSYGI

SEQ ID NO: 1662694 - protein, 22 aa, Staphylococcus aureus
DDWLHDYWAGVPIGTDKTDTKT

SEQ ID NO: 1662695 - protein, 21 aa, Staphylococcus aureus
DDWLHGYWAGVPIGTDKTDTK

SEQ ID NO: 1662696 - protein, 19 aa, Staphylococcus aureus
DDYFFKNDEWHITAFNKFK

SEQ ID NO: 1662697 - protein, 17 aa, Staphylococcus aureus
DEAEFKFIAGVGPNNFT

SEQ ID NO: 1662698 - protein, 19 aa, Staphylococcus aureus
DEGWQVMPAKGMIGHLHLK

SEQ ID NO: 1662699 - protein, 40 aa, Staphylococcus aureus
DEGYLKLHKTWFCKSKLCPVCNWRRAMKNSYQAQKVIEKV

SEQ ID NO: 1662700 - protein, 23 aa, Staphylococcus aureus
DEIKELSGHVFIFGGQTLYEAMI

SEQ ID NO: 1662701 - protein, 17 aa, Staphylococcus aureus
DEMAEAGIYKWHIDIQA

SEQ ID NO: 1662702 - protein, 17 aa, Staphylococcus aureus
DETKLNFLWVTDWPLLE

SEQ ID NO: 1662703 - protein, 19 aa, Staphylococcus aureus
DETLFKLQRQFAYTKEEIH

SEQ ID NO: 1662704 - protein, 25 aa, Staphylococcus aureus
DFEQLRALLYLELDYSFVLYNELLR

SEQ ID NO: 1662705 - protein, 30 aa, Staphylococcus aureus
DFSSYINQFEWRDAKFLVVQNVNAQGETDK

SEQ ID NO: 1662706 - protein, 20 aa, Staphylococcus aureus
DFTYDLPLSTYLGQVLNMNA

SEQ ID NO: 1662707 - protein, 18 aa, Staphylococcus aureus
DGEKLLFAEITSLSNKYG

SEQ ID NO: 1662708 - protein, 21 aa, Staphylococcus aureus
DGNGGGIYECLLSKTSSTTLR

SEQ ID NO: 1662709 - protein, 22 aa, Staphylococcus aureus
DGNGGGIYECLLSKTSSTTLRI

SEQ ID NO: 1662710 - protein, 21 aa, Staphylococcus aureus
DGNGGGSYECLITKESGTTLK

SEQ ID NO: 1662711 - protein, 18 aa, Staphylococcus aureus
DGNLGYITAILLRKLYPE

SEQ ID NO: 1662712 - protein, 26 aa, Staphylococcus aureus
DGSPAVTPRNYRWTSRTCTTGQTQYG

SEQ ID NO: 1662713 - protein, 19 aa, Staphylococcus aureus
DGSTAYMFVAYLGTDPITG

SEQ ID NO: 1662714 - protein, 19 aa, Staphylococcus aureus
DGVETALENVQRAKNELNG

SEQ ID NO: 1662715 - protein, 20 aa, Staphylococcus aureus
DGYFWFQGRVDDVIMTAGER

SEQ ID NO: 1662716 - protein, 23 aa, Staphylococcus aureus
DGYRIGYGGGYYDRFLANHQTKT

SEQ ID NO: 1662717 - protein, 25 aa, Staphylococcus aureus
DHFARKVSNHWLRLMSVNEEGRFKS

SEQ ID NO: 1662718 - protein, 18 aa, Staphylococcus aureus
DHLHRVTFVHSNFRELTQ

SEQ ID NO: 1662719 - protein, 26 aa, Staphylococcus aureus
DHLLLELTVIFGISALVTSFLKHKHE

SEQ ID NO: 1662720 - protein, 23 aa, Staphylococcus aureus
DHPAYRPHLDRDKDNRACEPDKN

SEQ ID NO: 1662721 - protein, 19 aa, Staphylococcus aureus
DIGALFRKGPGDVVSIDDQ

SEQ ID NO: 1662722 - protein, 20 aa, Staphylococcus aureus
DIKVSTLITRYDRGARGKDL

SEQ ID NO: 1662723 - protein, 19 aa, Staphylococcus aureus
DIPSMPFSPVLENEIMMNP

SEQ ID NO: 1662724 - protein, 17 aa, Staphylococcus aureus
DIYKVVMYFADKLCNKQ

SEQ ID NO: 1662725 - protein, 29 aa, Staphylococcus aureus
DIYSRPRGKFRFPMSVAYENENVKQSADT

SEQ ID NO: 1662726 - protein, 20 aa, Staphylococcus aureus
DKCKVSIRFRGRAITHKEIG

SEQ ID NO: 1662727 - protein, 20 aa, Staphylococcus aureus
DKDKVLGLFADKNMPLAIDA

SEQ ID NO: 1662728 - protein, 18 aa, Staphylococcus aureus
DKDQMFYATYEFKNDKIY

SEQ ID NO: 1662729 - protein, 26 aa, Staphylococcus aureus
DKEKQALKDRINQILQQGHNDINNAL

SEQ ID NO: 1662730 - protein, 18 aa, Staphylococcus aureus
DKEVGLFLTESGKIHAIH

SEQ ID NO: 1662731 - protein, 19 aa, Staphylococcus aureus
DKEVGLFLTESGKIHAIHN

SEQ ID NO: 1662732 - protein, 17 aa, Staphylococcus aureus
DKGYFNFDFKTKRFDNL

SEQ ID NO: 1662733 - protein, 17 aa, Staphylococcus aureus
DKIEWLLPFLQQSGPTI

SEQ ID NO: 1662734 - protein, 26 aa, Staphylococcus aureus
DKIIAGDWFYGMKIPSQRQLAIQYNV

SEQ ID NO: 1662735 - protein, 26 aa, Staphylococcus aureus
DKKMSFTKFKSCVKKHTFEQIMQGTR

SEQ ID NO: 1662736 - protein, 17 aa, Staphylococcus aureus
DKKRKADTWLRNQFFAT

SEQ ID NO: 1662737 - protein, 21 aa, Staphylococcus aureus
DKLLNLFLYYFIQTKRYSDVA

SEQ ID NO: 1662738 - protein, 25 aa, Staphylococcus aureus
DKLNELRSGFNIDNYITLAEYFENW

SEQ ID NO: 1662739 - protein, 23 aa, Staphylococcus aureus
DKRAEERKARFLDNQKIKKTPVV

SEQ ID NO: 1662740 - protein, 19 aa, Staphylococcus aureus
DKRQFSAFVGTDLDLQLRR

SEQ ID NO: 1662741 - protein, 17 aa, Staphylococcus aureus
DKTAFFLNGYVNEYDDT

SEQ ID NO: 1662742 - protein, 22 aa, Staphylococcus aureus
DKTETLNSINFTDADQAKKDAY

SEQ ID NO: 1662743 - protein, 25 aa, Staphylococcus aureus
DKWGSKRGNTTWGQLELDKAINNQS

SEQ ID NO: 1662744 - protein, 18 aa, Staphylococcus aureus
DLDIELYDNARFMTMTGE

SEQ ID NO: 1662745 - protein, 22 aa, Staphylococcus aureus
DLEIKIKIIRLILYTISNVHEK

SEQ ID NO: 1662746 - protein, 24 aa, Staphylococcus aureus
DLEPWTSCEFDFTRDGKLNVSFDY

SEQ ID NO: 1662747 - protein, 18 aa, Staphylococcus aureus
DLFLRELMRVRKIADEEG

SEQ ID NO: 1662748 - protein, 24 aa, Staphylococcus aureus
DLGLPDKDGLCLISEIRQHTDIPI

SEQ ID NO: 1662749 - protein, 28 aa, Staphylococcus aureus
DLGRKGYEHIGFSGAGAMDQFSFKVAQT

SEQ ID NO: 1662750 - protein, 27 aa, Staphylococcus aureus
DLIPVVWIAFKTGLRISDVLTLKNNCL

SEQ ID NO: 1662751 - protein, 27 aa, Staphylococcus aureus
DLIPVVWIAFKTGLRISDVLTLQNNCL

SEQ ID NO: 1662752 - protein, 25 aa, Staphylococcus aureus
DLIQICGREVRILFSSMSEIQGNTV

SEQ ID NO: 1662753 - protein, 23 aa, Staphylococcus aureus
DLKEKAMAADFLILGTPNYHGSY

SEQ ID NO: 1662754 - protein, 17 aa, Staphylococcus aureus
DLSKRLKSTDANRYVKN

SEQ ID NO: 1662755 - protein, 17 aa, Staphylococcus aureus
DLVKAKESAKQDIDKQV

SEQ ID NO: 1662756 - protein, 18 aa, Staphylococcus aureus
DLVTPIGLGQRGLIVAPP

SEQ ID NO: 1662757 - protein, 18 aa, Staphylococcus aureus
DMTHVFHIQGEYILQQCS

SEQ ID NO: 1662758 - protein, 24 aa, Staphylococcus aureus
DMVYRAGSMPKEFKIPDQDTINNI

SEQ ID NO: 1662759 - protein, 18 aa, Staphylococcus aureus
DNALKFSNVGSRIDINIS

SEQ ID NO: 1662760 - protein, 29 aa, Staphylococcus aureus
DNAPALYPNYWGGNKYKVIEELRKQGYNV

SEQ ID NO: 1662761 - protein, 29 aa, Staphylococcus aureus
DNDFKFERPFVVAISIMYLFEMLSISNEE

SEQ ID NO: 1662762 - protein, 18 aa, Staphylococcus aureus
DNGLEVIKTEGEAFDPNI

SEQ ID NO: 1662763 - protein, 20 aa, Staphylococcus aureus
DNIFPTKAFYILNDDMTMTL

SEQ ID NO: 1662764 - protein, 18 aa, Staphylococcus aureus
DNLDICIFAESLGGTETL

SEQ ID NO: 1662765 - protein, 17 aa, Staphylococcus aureus
DNLKNVTGYIRGGLRTM

SEQ ID NO: 1662766 - protein, 31 aa, Staphylococcus aureus
DNNVPIKFKEEFEPRKFVFTNGEIKYNSNFE

SEQ ID NO: 1662767 - protein, 17 aa, Staphylococcus aureus
DNYEDWNAFNIDPYEVL

SEQ ID NO: 1662768 - protein, 25 aa, Staphylococcus aureus
DPKKRMAIEYSMPKWIIDHWATHYG

SEQ ID NO: 1662769 - protein, 18 aa, Staphylococcus aureus
DPMYFIRLNFPDKVSVGD

SEQ ID NO: 1662770 - protein, 20 aa, Staphylococcus aureus
DPNFKDFRHSFSQKAPEGES

SEQ ID NO: 1662771 - protein, 18 aa, Staphylococcus aureus
DPNVRLPLWDNAEDLRQT

SEQ ID NO: 1662772 - protein, 21 aa, Staphylococcus aureus
DPRHPNWLVIEVCGGQTDSKR

SEQ ID NO: 1662773 - protein, 19 aa, Staphylococcus aureus
DPVILEPMMKVTIEMPEEY

SEQ ID NO: 1662774 - protein, 20 aa, Staphylococcus aureus
DQKSRLKLLNELARKQMKSL

SEQ ID NO: 1662775 - protein, 22 aa, Staphylococcus aureus
DQLKLSHMIIINKIDLVTDDSL

SEQ ID NO: 1662776 - protein, 21 aa, Staphylococcus aureus
DRDIPRFVNLYNQGRLNIDSL

SEQ ID NO: 1662777 - protein, 20 aa, Staphylococcus aureus
DRDSCYFLAMGYFYNKEDSN

SEQ ID NO: 1662778 - protein, 23 aa, Staphylococcus aureus
DRFESAVGFVHLGIGYAIIPRFY

SEQ ID NO: 1662779 - protein, 22 aa, Staphylococcus aureus
DRFGEPELKVGEMYYINNQEYQ

SEQ ID NO: 1662780 - protein, 27 aa, Staphylococcus aureus
DRHGFISFTPVGGWWNQVMLSQKVTIT

SEQ ID NO: 1662781 - protein, 19 aa, Staphylococcus aureus
DRLTLSCRMEIDANGRVVK

SEQ ID NO: 1662782 - protein, 24 aa, Staphylococcus aureus
DRRGRIRIVNDMALKMLGMAKEDI

SEQ ID NO: 1662783 - protein, 20 aa, Staphylococcus aureus
DSDCSIVAELIIKSAGDSKI

SEQ ID NO: 1662784 - protein, 26 aa, Staphylococcus aureus
DSDLKRFKGAHGLLYEQELGLQVTIF

SEQ ID NO: 1662785 - protein, 25 aa, Staphylococcus aureus
DSDLKRFKSAHGLLYEQELGLQATI

SEQ ID NO: 1662786 - protein, 18 aa, Staphylococcus aureus
DSEKLLFAEITSLSNKYG

SEQ ID NO: 1662787 - protein, 17 aa, Staphylococcus aureus
DSFLPQKLDIVVFPSKY

SEQ ID NO: 1662788 - protein, 26 aa, Staphylococcus aureus
DTGFYRFWTQGIFARWTDNPNIEDLI

SEQ ID NO: 1662789 - protein, 19 aa, Staphylococcus aureus
DTIKQGLYFKPKVHLNERV

SEQ ID NO: 1662790 - protein, 24 aa, Staphylococcus aureus
DTKDEVLPALAYFTFSPKNYEDKS

SEQ ID NO: 1662791 - protein, 25 aa, Staphylococcus aureus
DTNDFPITWFYPLGEKKVERKSPKL

SEQ ID NO: 1662792 - protein, 26 aa, Staphylococcus aureus
DTSDYSLGYLSGWGHNISDDELKAHI

SEQ ID NO: 1662793 - protein, 18 aa, Staphylococcus aureus
DTVIRFAPPLIITKEELD

SEQ ID NO: 1662794 - protein, 20 aa, Staphylococcus aureus
DVDGFHPINIGKLYIDEQTF

SEQ ID NO: 1662795 - protein, 19 aa, Staphylococcus aureus
DVIELEIAIHLMIRKYERN

SEQ ID NO: 1662796 - protein, 19 aa, Staphylococcus aureus
DVLLGGGAKYFGKSNGNLD

SEQ ID NO: 1662797 - protein, 20 aa, Staphylococcus aureus
DVNAALHYLARLIEAGDLPT

SEQ ID NO: 1662798 - protein, 19 aa, Staphylococcus aureus
DVQEASDIVGKHLSYPEKV

SEQ ID NO: 1662799 - protein, 24 aa, Staphylococcus aureus
DVQREVGRWFAYFVKHAPRVPFVI

SEQ ID NO: 1662800 - protein, 24 aa, Staphylococcus aureus
DVSEELRQGMKIIEIAEQENIQHI

SEQ ID NO: 1662801 - protein, 18 aa, Staphylococcus aureus
DVSINWNVPSYDVEYKMS

SEQ ID NO: 1662802 - protein, 23 aa, Staphylococcus aureus
DVVIARAVARLSVLSELCLPLVK

SEQ ID NO: 1662803 - protein, 23 aa, Staphylococcus aureus
DVYAEIYLGRFYNQYNELIVISP

SEQ ID NO: 1662804 - protein, 17 aa, Staphylococcus aureus
DVYKKAQAFDEILEGMT

SEQ ID NO: 1662805 - protein, 26 aa, Staphylococcus aureus
DYFKQEAIEFAWEFLTSDKWMGMEPD

SEQ ID NO: 1662806 - protein, 20 aa, Staphylococcus aureus
DYGTASGRVFLINTTNGQVV

SEQ ID NO: 1662807 - protein, 22 aa, Staphylococcus aureus
DYMKHVQNMIGYIPKSDLQVVF

SEQ ID NO: 1662808 - protein, 24 aa, Staphylococcus aureus
DYYRTAMIQHIGKMLGIKTPMIDQ

SEQ ID NO: 1662809 - protein, 18 aa, Staphylococcus aureus
EAAHIIPIVRVTAVIDRD

SEQ ID NO: 1662810 - protein, 23 aa, Staphylococcus aureus
EAEPFMWPVYEVIRKSTVEELKA

SEQ ID NO: 1662811 - protein, 17 aa, Staphylococcus aureus
EAFVCYIAMTRARQDVT

SEQ ID NO: 1662812 - protein, 32 aa, Staphylococcus aureus
EAGAKFNGVLCGRATWSGAVQVYIEQGEDAVR

SEQ ID NO: 1662813 - protein, 39 aa, Staphylococcus aureus
EAGRSDYFWDLFIQMPAALMFPSGNKFYDWIYSTDEEPH

SEQ ID NO: 1662814 - protein, 19 aa, Staphylococcus aureus
EAKPGICIIGEVVGYTENT

SEQ ID NO: 1662815 - protein, 20 aa, Staphylococcus aureus
EAKPGICIIGEVVGYTENTP

SEQ ID NO: 1662816 - protein, 19 aa, Staphylococcus aureus
EAKRKLRGCSIYSRAGQYH

SEQ ID NO: 1662817 - protein, 18 aa, Staphylococcus aureus
EALPERDTIITIWVKLLT

SEQ ID NO: 1662818 - protein, 20 aa, Staphylococcus aureus
EALYARVGHILIEISTDGPG

SEQ ID NO: 1662819 - protein, 25 aa, Staphylococcus aureus
EAQALNQAMEALRNSIQDQQQTEAG

SEQ ID NO: 1662820 - protein, 25 aa, Staphylococcus aureus
EAQALNQAMEALRNSIQDQQQTESG

SEQ ID NO: 1662821 - protein, 18 aa, Staphylococcus aureus
EASYQEYLTINGDCVLYE

SEQ ID NO: 1662822 - protein, 19 aa, Staphylococcus aureus
EAVDRACYLLQTYANGKVL

SEQ ID NO: 1662823 - protein, 20 aa, Staphylococcus aureus
EAVKKLKPTHVLSVSTIKDE

SEQ ID NO: 1662824 - protein, 19 aa, Staphylococcus aureus
EAYGNKDFIVGYRLSPEEA

SEQ ID NO: 1662825 - protein, 21 aa, Staphylococcus aureus
ECARLLKKWRLPANRNTIRLH

SEQ ID NO: 1662826 - protein, 18 aa, Staphylococcus aureus
EDCFYIRKKVFVEEQGVP

SEQ ID NO: 1662827 - protein, 18 aa, Staphylococcus aureus
EDCFYLRKKVFVEEQGVP

SEQ ID NO: 1662828 - protein, 23 aa, Staphylococcus aureus
EDFDMMSQFYLIKMAYIDHHPIP

SEQ ID NO: 1662829 - protein, 25 aa, Staphylococcus aureus
EDGEVWYSPVVCIALSKAHNINFYD

SEQ ID NO: 1662830 - protein, 24 aa, Staphylococcus aureus
EDGEVWYSPVVCMALNKAHNINFY

SEQ ID NO: 1662831 - protein, 38 aa, Staphylococcus aureus
EDHEWNLKLGDLAMIWREGCIIRAQFLQKIKDAYDNNP

SEQ ID NO: 1662832 - protein, 26 aa, Staphylococcus aureus
EDLEPWTSCEFDFTRDGKLNVVFDYV

SEQ ID NO: 1662833 - protein, 20 aa, Staphylococcus aureus
EDLETFFAYFQTLAVSVNLY

SEQ ID NO: 1662834 - protein, 25 aa, Staphylococcus aureus
EDPPVWVCLELMSFGQFSAFVEFYS

SEQ ID NO: 1662835 - protein, 20 aa, Staphylococcus aureus
EDSYKWGVTTSLSYFPKDNS

SEQ ID NO: 1662836 - protein, 24 aa, Staphylococcus aureus
EDVDRIYGTHLWSGYPTGTIHSRA

SEQ ID NO: 1662837 - protein, 24 aa, Staphylococcus aureus
EDVYKKARAFDEILEGLPNAMQDA

SEQ ID NO: 1662838 - protein, 24 aa, Staphylococcus aureus
EDVYKKARAFDEILESLPNAMQDA

SEQ ID NO: 1662839 - protein, 26 aa, Staphylococcus aureus
EEGLEPWTSCEFDFTREGNLKVSFDY

SEQ ID NO: 1662840 - protein, 24 aa, Staphylococcus aureus
EEGLEPWTSCEFDFTSEGKLKVSF

SEQ ID NO: 1662841 - protein, 17 aa, Staphylococcus aureus
EEIMLLRHMILSHHGKL

SEQ ID NO: 1662842 - protein, 21 aa, Staphylococcus aureus
EELEYLIKRILKDESVIKIEK

SEQ ID NO: 1662843 - protein, 19 aa, Staphylococcus aureus
EELIAYSLDPVWNMSDLKK

SEQ ID NO: 1662844 - protein, 17 aa, Staphylococcus aureus
EELKLLNKNLRVLNTEL

SEQ ID NO: 1662845 - protein, 20 aa, Staphylococcus aureus
EELKMMINIMKPEYFIPVQG

SEQ ID NO: 1662846 - protein, 29 aa, Staphylococcus aureus
EENKKVGLWSFDFNIDWHAGGDKRQYTFE

SEQ ID NO: 1662847 - protein, 25 aa, Staphylococcus aureus
EENRNLLQRIWDGILEILQSIIQFF

SEQ ID NO: 1662848 - protein, 18 aa, Staphylococcus aureus
EESLFPHIRAIKSEGDHE

SEQ ID NO: 1662849 - protein, 25 aa, Staphylococcus aureus
EFEETSALPGRKSGSLVGISQIDSS

SEQ ID NO: 1662850 - protein, 26 aa, Staphylococcus aureus
EFETRAGTLLRYYTGLLERSKVQPCC

SEQ ID NO: 1662851 - protein, 23 aa, Staphylococcus aureus
EFFLKSKLPLYLYSFNYVDEYTM

SEQ ID NO: 1662852 - protein, 24 aa, Staphylococcus aureus
EFLNNLKIASPILENHLDDIVRNM

SEQ ID NO: 1662853 - protein, 22 aa, Staphylococcus aureus
EFQKEILQAMQVGVWAPTQKLT

SEQ ID NO: 1662854 - protein, 20 aa, Staphylococcus aureus
EFSEALDAPYGMHLKEYREM

SEQ ID NO: 1662855 - protein, 19 aa, Staphylococcus aureus
EGHEPWTSCEFDFTKEGKL

SEQ ID NO: 1662856 - protein, 22 aa, Staphylococcus aureus
EGKLKVSFDYIDWINTEFDQLG

SEQ ID NO: 1662857 - protein, 31 aa, Staphylococcus aureus
EGRLPDAIVACIGCGSNAIGTFYPFIKDDVA

SEQ ID NO: 1662858 - protein, 22 aa, Staphylococcus aureus
EGSYKWGVTTSLSYFPKDNSEF

SEQ ID NO: 1662859 - protein, 19 aa, Staphylococcus aureus
EHGDIYGGMIPKVLDAKNA

SEQ ID NO: 1662860 - protein, 27 aa, Staphylococcus aureus
EHGNEFPISAGFFFINPFEVVYYAGGT

SEQ ID NO: 1662861 - protein, 23 aa, Staphylococcus aureus
EHISKSIATIGHFDLLTINDAGM

SEQ ID NO: 1662862 - protein, 22 aa, Staphylococcus aureus
EHITKAIATIGHFDLLTINDAG

SEQ ID NO: 1662863 - protein, 28 aa, Staphylococcus aureus
EHQFSKEEFKTMLAIAGHEGALNEIETS

SEQ ID NO: 1662864 - protein, 22 aa, Staphylococcus aureus
EHYDLPILGKHNMKNATIAIAV

SEQ ID NO: 1662865 - protein, 17 aa, Staphylococcus aureus
EIDKWRHTSQYAIASKM

SEQ ID NO: 1662866 - protein, 24 aa, Staphylococcus aureus
EIEDFKFFVQYGDFKDINDYKDGD

SEQ ID NO: 1662867 - protein, 24 aa, Staphylococcus aureus
EIEEFKFFVQYGNFKELENYKDGE

SEQ ID NO: 1662868 - protein, 24 aa, Staphylococcus aureus
EIEGIAYDRLWVHLIPIIKNQQSK

SEQ ID NO: 1662869 - protein, 18 aa, Staphylococcus aureus
EIEKNGGKMFESILKKAS

SEQ ID NO: 1662870 - protein, 21 aa, Staphylococcus aureus
EIIDFNMFINKIINRHEMSTK

SEQ ID NO: 1662871 - protein, 25 aa, Staphylococcus aureus
EIIKDRLKQNINLFDERANYNALAV

SEQ ID NO: 1662872 - protein, 17 aa, Staphylococcus aureus
EINSYCMSQKYGSNQKG

SEQ ID NO: 1662873 - protein, 23 aa, Staphylococcus aureus
EINTIKGNVNWMRARQHKLIETL

SEQ ID NO: 1662874 - protein, 20 aa, Staphylococcus aureus
EIQKLISAYEKTEIGFGEKL

SEQ ID NO: 1662875 - protein, 22 aa, Staphylococcus aureus
EIVDYCRDRGFFVLTYHDGQII

SEQ ID NO: 1662876 - protein, 19 aa, Staphylococcus aureus
EIYCCLLNGHTLVIPDKEE

SEQ ID NO: 1662877 - protein, 30 aa, Staphylococcus aureus
EKDKRAKELIKLVDLPESFLERYPAEISGG

SEQ ID NO: 1662878 - protein, 30 aa, Staphylococcus aureus
EKEPWSQPPSGYKWYDPTTFKAGSYGSEKG

SEQ ID NO: 1662879 - protein, 21 aa, Staphylococcus aureus
EKGVFDYRRSLLRTDVVLNSE

SEQ ID NO: 1662880 - protein, 20 aa, Staphylococcus aureus
EKHWFNWLTENNIPIKRRSS

SEQ ID NO: 1662881 - protein, 20 aa, Staphylococcus aureus
EKKFYRQCELGWDDEINFTK

SEQ ID NO: 1662882 - protein, 20 aa, Staphylococcus aureus
EKPNSRWLFLTLSIRNAIGG

SEQ ID NO: 1662883 - protein, 24 aa, Staphylococcus aureus
EKQLPQHFIRISKSEIVNKYYIEK

SEQ ID NO: 1662884 - protein, 19 aa, Staphylococcus aureus
EKRTIGNIIKFIQNNKPNQ

SEQ ID NO: 1662885 - protein, 17 aa, Staphylococcus aureus
EKTEIGFGEKLYKDIVQ

SEQ ID NO: 1662886 - protein, 17 aa, Staphylococcus aureus
EKVFNIDVVLRKDPKTG

SEQ ID NO: 1662887 - protein, 29 aa, Staphylococcus aureus
EKWYQIEYLKEMVTFVVVNRDKNSQNVEN

SEQ ID NO: 1662888 - protein, 25 aa, Staphylococcus aureus
EKYIPYCIEPSLGADRVTLAFLCDA

SEQ ID NO: 1662889 - protein, 23 aa, Staphylococcus aureus
EKYNIQQAKGWTQVKMKAALHNE

SEQ ID NO: 1662890 - protein, 20 aa, Staphylococcus aureus
EKYQTPHIISIDDSEFDYNL

SEQ ID NO: 1662891 - protein, 22 aa, Staphylococcus aureus
EKYSVLRALKAIERSNVVLVVI

SEQ ID NO: 1662892 - protein, 21 aa, Staphylococcus aureus
ELAENLNVCFNCDHHIALTAY

SEQ ID NO: 1662893 - protein, 20 aa, Staphylococcus aureus
ELALITGAALLARRRSKKEK

SEQ ID NO: 1662894 - protein, 22 aa, Staphylococcus aureus
ELAMPRPYVFVSPKDFKNGTTK

SEQ ID NO: 1662895 - protein, 25 aa, Staphylococcus aureus
ELATAGRLNSKWISVLYLSTKEQVS

SEQ ID NO: 1662896 - protein, 18 aa, Staphylococcus aureus
ELDGKMSYMIAVTGDNSI

SEQ ID NO: 1662897 - protein, 34 aa, Staphylococcus aureus
ELHNLFKAITLKGPCYLHYYLQGYDEPMYTRQQV

SEQ ID NO: 1662898 - protein, 20 aa, Staphylococcus aureus
ELIGRLASELGTAMKGLDIN

SEQ ID NO: 1662899 - protein, 21 aa, Staphylococcus aureus
ELKEEIRLFVKEGLSAHAAPR

SEQ ID NO: 1662900 - protein, 26 aa, Staphylococcus aureus
ELKIWKRWLHTQGYKDIHLDITAQPP

SEQ ID NO: 1662901 - protein, 21 aa, Staphylococcus aureus
ELKYEKAWELLDLPEEIKQYG

SEQ ID NO: 1662902 - protein, 18 aa, Staphylococcus aureus
ELLCIKIVTTIPAITPNT

SEQ ID NO: 1662903 - protein, 18 aa, Staphylococcus aureus
ELLKQSGIFRENEHVDER

SEQ ID NO: 1662904 - protein, 19 aa, Staphylococcus aureus
ELLRQKVDFDYDIQTVFKA

SEQ ID NO: 1662905 - protein, 23 aa, Staphylococcus aureus
ELSKRGGLNIVDDIMVQSATAIF

SEQ ID NO: 1662906 - protein, 20 aa, Staphylococcus aureus
ELVDLFNERYDIIIVDTPPV

SEQ ID NO: 1662907 - protein, 20 aa, Staphylococcus aureus
ELVSELANPFMAIYYTDAKS

SEQ ID NO: 1662908 - protein, 28 aa, Staphylococcus aureus
ELYKALEVKKRFSAWAEINLKHFKENRD

SEQ ID NO: 1662909 - protein, 20 aa, Staphylococcus aureus
ELYKNYKGNITRFVAENDAL

SEQ ID NO: 1662910 - protein, 17 aa, Staphylococcus aureus
ELYRSFKKLRNIFKEES

SEQ ID NO: 1662911 - protein, 19 aa, Staphylococcus aureus
EMCKAHFHSLIKIRLPETL

SEQ ID NO: 1662912 - protein, 18 aa, Staphylococcus aureus
EMPRERLLSHGAKSLSNT

SEQ ID NO: 1662913 - protein, 17 aa, Staphylococcus aureus
EMPRYGGQHAHLTEEQR

SEQ ID NO: 1662914 - protein, 25 aa, Staphylococcus aureus
ENAELRTGPNAAYPVIYKVEKGDHF

SEQ ID NO: 1662915 - protein, 23 aa, Staphylococcus aureus
ENAGENYIDIAWLARKKGYQVTL

SEQ ID NO: 1662916 - protein, 19 aa, Staphylococcus aureus
ENAKEKATDFIDKVKGNKG

SEQ ID NO: 1662917 - protein, 24 aa, Staphylococcus aureus
ENEGQLIAFIWGHFSNEKSMVNIE

SEQ ID NO: 1662918 - protein, 23 aa, Staphylococcus aureus
ENFKFFGQYADFKSLKSYNNGDV

SEQ ID NO: 1662919 - protein, 17 aa, Staphylococcus aureus
ENFKFFSQYADFKDLKN

SEQ ID NO: 1662920 - protein, 25 aa, Staphylococcus aureus
ENGKARTGWLIVDYAGYPWPGYDDI

SEQ ID NO: 1662921 - protein, 21 aa, Staphylococcus aureus
ENIIELMIPVFYFYQQDDDFF

SEQ ID NO: 1662922 - protein, 17 aa, Staphylococcus aureus
ENIKKFMHYLLRAQERY

SEQ ID NO: 1662923 - protein, 23 aa, Staphylococcus aureus
ENINIPAQIFVEFDAASQGLGIL

SEQ ID NO: 1662924 - protein, 23 aa, Staphylococcus aureus
ENLYNKLDLIVGRSDDEREERHP

SEQ ID NO: 1662925 - protein, 19 aa, Staphylococcus aureus
ENMLKEAADELGLSYEEAI

SEQ ID NO: 1662926 - protein, 22 aa, Staphylococcus aureus
ENSHTKFFFGMDNVGVDDVVDK

SEQ ID NO: 1662927 - protein, 20 aa, Staphylococcus aureus
ENTYKYVLHHGLDKKERLKK

SEQ ID NO: 1662928 - protein, 22 aa, Staphylococcus aureus
ENVVFWSGWNKITMFALIELVK

SEQ ID NO: 1662929 - protein, 17 aa, Staphylococcus aureus
EPARLDQQIIAYAQEVF

SEQ ID NO: 1662930 - protein, 22 aa, Staphylococcus aureus
EPFFMSLNEMFALKEYKKKYLI

SEQ ID NO: 1662931 - protein, 25 aa, Staphylococcus aureus
EPLRKMEAPMFKKILKNHQLLDDAF

SEQ ID NO: 1662932 - protein, 23 aa, Staphylococcus aureus
EPLYRSRVVKFITEKSELMAPPK

SEQ ID NO: 1662933 - protein, 19 aa, Staphylococcus aureus
EPYKVFTSFYKKWRPYLRI

SEQ ID NO: 1662934 - protein, 19 aa, Staphylococcus aureus
EQAISEVIEYCYREKLIDH

SEQ ID NO: 1662935 - protein, 22 aa, Staphylococcus aureus
EQGFKNICLHTNDIEAVKNKLQ

SEQ ID NO: 1662936 - protein, 20 aa, Staphylococcus aureus
EQIELFSIDKFKCNSEAKYY

SEQ ID NO: 1662937 - protein, 20 aa, Staphylococcus aureus
EQLFAAGYASCFNAAFDLIL

SEQ ID NO: 1662938 - protein, 27 aa, Staphylococcus aureus
EQLHSIFLEVIIAPKFTDEALNILKQK

SEQ ID NO: 1662939 - protein, 17 aa, Staphylococcus aureus
EQLKSNGYETVTIRNEQ

SEQ ID NO: 1662940 - protein, 26 aa, Staphylococcus aureus
EQLMHHMCSGLTLLDSVKIVSTEVKQ

SEQ ID NO: 1662941 - protein, 26 aa, Staphylococcus aureus
EQLNVSGFLTWAVGHLVELKEPQEYD

SEQ ID NO: 1662942 - protein, 20 aa, Staphylococcus aureus
EQLTNYLLKYDYRDLEIIKA

SEQ ID NO: 1662943 - protein, 18 aa, Staphylococcus aureus
EQMPNYYDNFAIWSIQTN

SEQ ID NO: 1662944 - protein, 22 aa, Staphylococcus aureus
EQNFDLLFVKWIPREQNKEANQ

SEQ ID NO: 1662945 - protein, 20 aa, Staphylococcus aureus
EQQFKCHIDTTIKKQVPVCC

SEQ ID NO: 1662946 - protein, 17 aa, Staphylococcus aureus
EQWKVSRTTIYRYLNKL

SEQ ID NO: 1662947 - protein, 24 aa, Staphylococcus aureus
EREADFINVIVFKKQAENVNKYLS

SEQ ID NO: 1662948 - protein, 29 aa, Staphylococcus aureus
ERFKELVDLFNKRYDIIIVDTPPVNTVTD

SEQ ID NO: 1662949 - protein, 17 aa, Staphylococcus aureus
ERFKHVEELKRMGANIE

SEQ ID NO: 1662950 - protein, 21 aa, Staphylococcus aureus
ERGSGKICLNGAASRLVEVGD

SEQ ID NO: 1662951 - protein, 17 aa, Staphylococcus aureus
ERIAQMLIESSVDIGNM

SEQ ID NO: 1662952 - protein, 22 aa, Staphylococcus aureus
ERIKPGDIVPIYLKKNPNFKFP

SEQ ID NO: 1662953 - protein, 17 aa, Staphylococcus aureus
ERVNGWKDVEQYFLDNI

SEQ ID NO: 1662954 - protein, 17 aa, Staphylococcus aureus
ESAERLGLPEARIPLSQ

SEQ ID NO: 1662955 - protein, 17 aa, Staphylococcus aureus
ESALKGNDKLVLAKELQ

SEQ ID NO: 1662956 - protein, 24 aa, Staphylococcus aureus
ESDYFAFEACEYRRHFLSYKPDYA

SEQ ID NO: 1662957 - protein, 20 aa, Staphylococcus aureus
ESEKMLTEEMQFFTYSLNID

SEQ ID NO: 1662958 - protein, 17 aa, Staphylococcus aureus
ESGGLLMCGIPNMKLDK

SEQ ID NO: 1662959 - protein, 17 aa, Staphylococcus aureus
ESIFLLQHACKANDYAQ

SEQ ID NO: 1662960 - protein, 19 aa, Staphylococcus aureus
ESITEGTIAEWLKNLGDSV

SEQ ID NO: 1662961 - protein, 24 aa, Staphylococcus aureus
ESITEGTIAEWLKNLGDSVEKGEA

SEQ ID NO: 1662962 - protein, 24 aa, Staphylococcus aureus
ESKIKTVLHGLSFSEEDFNKPIND

SEQ ID NO: 1662963 - protein, 23 aa, Staphylococcus aureus
ESLEPWTSCEFDFTSEGKLKVSF

SEQ ID NO: 1662964 - protein, 19 aa, Staphylococcus aureus
ESLFNYFKQLFAQVTNPPI

SEQ ID NO: 1662965 - protein, 19 aa, Staphylococcus aureus
ESLGARKGEMVDMTTNDNG

SEQ ID NO: 1662966 - protein, 22 aa, Staphylococcus aureus
ESMEFPEPVIHLSVEPKSKADQ

SEQ ID NO: 1662967 - protein, 19 aa, Staphylococcus aureus
ESNSSVLLFNITKNNQPLL

SEQ ID NO: 1662968 - protein, 23 aa, Staphylococcus aureus
ESQHARLSWLTILKKKEAYEEAF

SEQ ID NO: 1662969 - protein, 18 aa, Staphylococcus aureus
ESQSVWDFMSDVSNVGLE

SEQ ID NO: 1662970 - protein, 18 aa, Staphylococcus aureus
ESSAYVVANYYGLDTSDY

SEQ ID NO: 1662971 - protein, 30 aa, Staphylococcus aureus
ESTVLDCTSFPYKIARPGSITAAMITDILP

SEQ ID NO: 1662972 - protein, 22 aa, Staphylococcus aureus
ETAEKYMIFLTWIFSATNNKLR

SEQ ID NO: 1662973 - protein, 22 aa, Staphylococcus aureus
ETFLTDMIEGMLIAHPELEAVA

SEQ ID NO: 1662974 - protein, 21 aa, Staphylococcus aureus
ETNKWINAYECYFKNMLGLKC

SEQ ID NO: 1662975 - protein, 20 aa, Staphylococcus aureus
ETNYPIAVMEASLISSMRTA

SEQ ID NO: 1662976 - protein, 24 aa, Staphylococcus aureus
ETYIKRDILKRENIKEVTTQTTIR

SEQ ID NO: 1662977 - protein, 25 aa, Staphylococcus aureus
EVAEACLKLGVDIINDQWAGLYDHH

SEQ ID NO: 1662978 - protein, 24 aa, Staphylococcus aureus
EVAEAIERINAAKVSGVKAIEATT

SEQ ID NO: 1662979 - protein, 24 aa, Staphylococcus aureus
EVDKELYFEISVDSIQNYYRKDST

SEQ ID NO: 1662980 - protein, 17 aa, Staphylococcus aureus
EVGRTLYNFIWDDFCDW

SEQ ID NO: 1662981 - protein, 25 aa, Staphylococcus aureus
EVIQWFYKEVDWFEAKLKDDKSNTG

SEQ ID NO: 1662982 - protein, 21 aa, Staphylococcus aureus
EVLKKLESVYGKQAMQAKSDR

SEQ ID NO: 1662983 - protein, 23 aa, Staphylococcus aureus
EVLQGYSHRIYCFIRADNEEIAW

SEQ ID NO: 1662984 - protein, 17 aa, Staphylococcus aureus
EVLWLKQNIISYLDDVS

SEQ ID NO: 1662985 - protein, 20 aa, Staphylococcus aureus
EVNIVWSPPWTKDMMSRYAK

SEQ ID NO: 1662986 - protein, 23 aa, Staphylococcus aureus
EVNLPELIQWAWDNPKLSGNKRF

SEQ ID NO: 1662987 - protein, 28 aa, Staphylococcus aureus
EVPEYRRPASDCKISIRGARSNNLKGVD

SEQ ID NO: 1662988 - protein, 18 aa, Staphylococcus aureus
EVRNAFTPKTVSEMIDAF

SEQ ID NO: 1662989 - protein, 23 aa, Staphylococcus aureus
EVTLKCHPDVNILIGENAQGKTN

SEQ ID NO: 1662990 - protein, 22 aa, Staphylococcus aureus
EVTVLHLAEWLMEMQLDRKAGN

SEQ ID NO: 1662991 - protein, 22 aa, Staphylococcus aureus
EYDEAIVRFFKGDKETLRYGEN

SEQ ID NO: 1662992 - protein, 18 aa, Staphylococcus aureus
EYDLKPSIFSNSIKQHQN

SEQ ID NO: 1662993 - protein, 20 aa, Staphylococcus aureus
EYELKKGKMNTLIDEYSAVH

SEQ ID NO: 1662994 - protein, 18 aa, Staphylococcus aureus
EYKQLLLQNGYYQDKLNS

SEQ ID NO: 1662995 - protein, 19 aa, Staphylococcus aureus
EYNLAAKVYREIKNYYLYI

SEQ ID NO: 1662996 - protein, 27 aa, Staphylococcus aureus
EYPTDTEGWAHCLTIPRVLNVENGQLK

SEQ ID NO: 1662997 - protein, 20 aa, Staphylococcus aureus
EYRKQLKLSVNQLSKLSNVS

SEQ ID NO: 1662998 - protein, 21 aa, Staphylococcus aureus
EYRKQLKLSVNQLSKLSNVSV

SEQ ID NO: 1662999 - protein, 22 aa, Staphylococcus aureus
EYSLDEYLRYGFANQKTSVKMT

SEQ ID NO: 1663000 - protein, 20 aa, Staphylococcus aureus
EYTKRFNSLASFNTNINIIP

SEQ ID NO: 1663001 - protein, 18 aa, Staphylococcus aureus
FAALAFKVMTDPYVGKLT

SEQ ID NO: 1663002 - protein, 23 aa, Staphylococcus aureus
FAHLKELFLEESFADNQSAFSIT

SEQ ID NO: 1663003 - protein, 17 aa, Staphylococcus aureus
FAIKELLEKGLIGNCIQ

SEQ ID NO: 1663004 - protein, 17 aa, Staphylococcus aureus
FAIPVKFTIKVVLTDPY

SEQ ID NO: 1663005 - protein, 18 aa, Staphylococcus aureus
FALLGKPGFEDMKKDLEA

SEQ ID NO: 1663006 - protein, 22 aa, Staphylococcus aureus
FCDENHYASLIFVLSAIDNHSH

SEQ ID NO: 1663007 - protein, 19 aa, Staphylococcus aureus
FCEADDWKPFYETYGSQFE

SEQ ID NO: 1663008 - protein, 17 aa, Staphylococcus aureus
FCTAIRYIIARDYESRG

SEQ ID NO: 1663009 - protein, 20 aa, Staphylococcus aureus
FDDAKRLANTLLNSDNTNVN

SEQ ID NO: 1663010 - protein, 17 aa, Staphylococcus aureus
FDEQFKLGYRERTINLD

SEQ ID NO: 1663011 - protein, 20 aa, Staphylococcus aureus
FDFSAVPFKQVYKNEQDIVQ

SEQ ID NO: 1663012 - protein, 17 aa, Staphylococcus aureus
FDKTKWYSINYQTIEGM

SEQ ID NO: 1663013 - protein, 23 aa, Staphylococcus aureus
FDLGHFRGAIRPNITRFRDLPDW

SEQ ID NO: 1663014 - protein, 21 aa, Staphylococcus aureus
FDLKDLHVVIGPSTSSSYEIN

SEQ ID NO: 1663015 - protein, 18 aa, Staphylococcus aureus
FDLTCTYDSYQFDGQNVS

SEQ ID NO: 1663016 - protein, 23 aa, Staphylococcus aureus
FDNFLTIHFYYYYDFEYDCLILP

SEQ ID NO: 1663017 - protein, 25 aa, Staphylococcus aureus
FDNLFKRIPVKPGDFYYVPAGTVHA

SEQ ID NO: 1663018 - protein, 18 aa, Staphylococcus aureus
FDQQYGYVGVPTALNKDA

SEQ ID NO: 1663019 - protein, 20 aa, Staphylococcus aureus
FDVLIVLSHCGIFFDETLCQ

SEQ ID NO: 1663020 - protein, 21 aa, Staphylococcus aureus
FECKDGRKINVINHVDNNAFF

SEQ ID NO: 1663021 - protein, 17 aa, Staphylococcus aureus
FEHLYRIPKYTYEIIEV

SEQ ID NO: 1663022 - protein, 19 aa, Staphylococcus aureus
FEKDGPRIMALEPQDDNRD

SEQ ID NO: 1663023 - protein, 18 aa, Staphylococcus aureus
FEMLREMLGKHFISQDIV

SEQ ID NO: 1663024 - protein, 17 aa, Staphylococcus aureus
FENIHLMNPGTFLITHF

SEQ ID NO: 1663025 - protein, 24 aa, Staphylococcus aureus
FENKFDVEYGFYILFIKPIFEIVF

SEQ ID NO: 1663026 - protein, 24 aa, Staphylococcus aureus
FEPKRKGNDYIRDWNTKEKHNEWR

SEQ ID NO: 1663027 - protein, 22 aa, Staphylococcus aureus
FESNRCKIAFLINDLNITAIQK

SEQ ID NO: 1663028 - protein, 18 aa, Staphylococcus aureus
FFICQILAFLFPTSPHVN

SEQ ID NO: 1663029 - protein, 17 aa, Staphylococcus aureus
FGDLPFSAMPIVPKDNS

SEQ ID NO: 1663030 - protein, 18 aa, Staphylococcus aureus
FGENVYKIGVTRRLEPMD

SEQ ID NO: 1663031 - protein, 17 aa, Staphylococcus aureus
FGPESWGNINQLRNKYV

SEQ ID NO: 1663032 - protein, 21 aa, Staphylococcus aureus
FGRYEFYRFRLSELQIESRAN

SEQ ID NO: 1663033 - protein, 19 aa, Staphylococcus aureus
FGYCYGVAGTVGEVLTPIL

SEQ ID NO: 1663034 - protein, 18 aa, Staphylococcus aureus
FHSLIKIRLPETLSKELL

SEQ ID NO: 1663035 - protein, 24 aa, Staphylococcus aureus
FHTLLDEWLEYHIKTSGSKVTTLN

SEQ ID NO: 1663036 - protein, 25 aa, Staphylococcus aureus
FIAASLEAPIYVLSNIAGVLINDVV

SEQ ID NO: 1663037 - protein, 25 aa, Staphylococcus aureus
FIGPNCGFYTATHPLNFHHRNEGFE

SEQ ID NO: 1663038 - protein, 18 aa, Staphylococcus aureus
FIKMAIKNIHFEYVKGIK

SEQ ID NO: 1663039 - protein, 22 aa, Staphylococcus aureus
FILRGIKLIGIDSVYVDHNIRE

SEQ ID NO: 1663040 - protein, 17 aa, Staphylococcus aureus
FIRIGGIDIKDLKLSTL

SEQ ID NO: 1663041 - protein, 17 aa, Staphylococcus aureus
FITGHSLGGREAVILGM

SEQ ID NO: 1663042 - protein, 17 aa, Staphylococcus aureus
FITTKVWIENVNYEDTI

SEQ ID NO: 1663043 - protein, 17 aa, Staphylococcus aureus
FIYKNRGVFILVDPYLI

SEQ ID NO: 1663044 - protein, 22 aa, Staphylococcus aureus
FKARIMMIFSLYKGEKKKTTKP

SEQ ID NO: 1663045 - protein, 17 aa, Staphylococcus aureus
FKEILGHKVNITTPSIE

SEQ ID NO: 1663046 - protein, 21 aa, Staphylococcus aureus
FKIIMTEALSLYIWGCNILNT

SEQ ID NO: 1663047 - protein, 19 aa, Staphylococcus aureus
FKLMFKDGEIIDFSAEKGE

SEQ ID NO: 1663048 - protein, 18 aa, Staphylococcus aureus
FKNATLLSEASTIYELIT

SEQ ID NO: 1663049 - protein, 20 aa, Staphylococcus aureus
FKNDEWHITAFNKFKQFQDS

SEQ ID NO: 1663050 - protein, 17 aa, Staphylococcus aureus
FKNQSWVDVEDLPLILP

SEQ ID NO: 1663051 - protein, 20 aa, Staphylococcus aureus
FKQLFRILEDTFARPLSPYE

SEQ ID NO: 1663052 - protein, 17 aa, Staphylococcus aureus
FKQSLMGGGFQIDNPNA

SEQ ID NO: 1663053 - protein, 17 aa, Staphylococcus aureus
FLAKSFSNGFVRFQRNT

SEQ ID NO: 1663054 - protein, 25 aa, Staphylococcus aureus
FLDEKGRRVLIGWMGLPEIEYPTDT

SEQ ID NO: 1663055 - protein, 26 aa, Staphylococcus aureus
FLDKEISFSVSIYGSIVLYTNITYEE

SEQ ID NO: 1663056 - protein, 17 aa, Staphylococcus aureus
FLFEFIFDIEERYIRMY

SEQ ID NO: 1663057 - protein, 27 aa, Staphylococcus aureus
FLHKCFIDKEIRLCVIVPKNSINPQKI

SEQ ID NO: 1663058 - protein, 25 aa, Staphylococcus aureus
FLKHKHEIEFAGILFSFTGQSSTGK

SEQ ID NO: 1663059 - protein, 22 aa, Staphylococcus aureus
FLMIELPSGRALAYPKASVGEN

SEQ ID NO: 1663060 - protein, 18 aa, Staphylococcus aureus
FLNTALIHIVERLKLRIA

SEQ ID NO: 1663061 - protein, 25 aa, Staphylococcus aureus
FLSFQRIPIYIIWINPKSHKTPRYY

SEQ ID NO: 1663062 - protein, 30 aa, Staphylococcus aureus
FLTKDLFINWTWGEDFFRKYLIDYDATSNV

SEQ ID NO: 1663063 - protein, 18 aa, Staphylococcus aureus
FLWSTAKGYQQFKDDSQI

SEQ ID NO: 1663064 - protein, 18 aa, Staphylococcus aureus
FMNANYMMRGRILTNEVA

SEQ ID NO: 1663065 - protein, 35 aa, Staphylococcus aureus
FMNLRDLFKKEGLEPWTSCEFDFTREGNLKVSFDY

SEQ ID NO: 1663066 - protein, 18 aa, Staphylococcus aureus
FMTIPEASRLVLQAGALA

SEQ ID NO: 1663067 - protein, 30 aa, Staphylococcus aureus
FNGKKEWKLFYLYKELIQTFEILYDDTSIT

SEQ ID NO: 1663068 - protein, 27 aa, Staphylococcus aureus
FNGLKRVIDFIEHFGFSKSDLEYLKSI

SEQ ID NO: 1663069 - protein, 17 aa, Staphylococcus aureus
FNISAKTYEEWFKQFSS

SEQ ID NO: 1663070 - protein, 17 aa, Staphylococcus aureus
FNKADYELVDFSLVEKL

SEQ ID NO: 1663071 - protein, 21 aa, Staphylococcus aureus
FNKYRLEIHSNLPKCLFPLTL

SEQ ID NO: 1663072 - protein, 30 aa, Staphylococcus aureus
FNSYPEWQKQFPFWSLITIKRTIYSLEKQN

SEQ ID NO: 1663073 - protein, 38 aa, Staphylococcus aureus
FNVDLWYAFQCFDYANAGWKALFGLLLKGVGAKDIPFA

SEQ ID NO: 1663074 - protein, 20 aa, Staphylococcus aureus
FNYFSTPSFVTNIYETEELY

SEQ ID NO: 1663075 - protein, 22 aa, Staphylococcus aureus
FPDFIEKYRFFDMLQASLHPYG

SEQ ID NO: 1663076 - protein, 24 aa, Staphylococcus aureus
FPDFIEKYRFFDMLQASLHPYGSW

SEQ ID NO: 1663077 - protein, 19 aa, Staphylococcus aureus
FPYPSGAGLHVGHPEGYTA

SEQ ID NO: 1663078 - protein, 19 aa, Staphylococcus aureus
FQKLICNLISPTSGTLYFK

SEQ ID NO: 1663079 - protein, 20 aa, Staphylococcus aureus
FQTHLKWGAQKEIIKLIPGL

SEQ ID NO: 1663080 - protein, 25 aa, Staphylococcus aureus
FQTHLKWGAQKEVIKLIPGLENVDI

SEQ ID NO: 1663081 - protein, 21 aa, Staphylococcus aureus
FRADSQFLYKSAQRGDLGDIY

SEQ ID NO: 1663082 - protein, 18 aa, Staphylococcus aureus
FREKMVGEGLAIKAHEES

SEQ ID NO: 1663083 - protein, 20 aa, Staphylococcus aureus
FRFQILVKYKSEPGLLKAIQ

SEQ ID NO: 1663084 - protein, 19 aa, Staphylococcus aureus
FRIDHYLGKEMVQNIESLR

SEQ ID NO: 1663085 - protein, 20 aa, Staphylococcus aureus
FRKEILQAMRVGVGVPTQKL

SEQ ID NO: 1663086 - protein, 19 aa, Staphylococcus aureus
FRMYQRYCEKKGFKVKTVD

SEQ ID NO: 1663087 - protein, 18 aa, Staphylococcus aureus
FRNWPIAALSYGQKKRVT

SEQ ID NO: 1663088 - protein, 21 aa, Staphylococcus aureus
FSEYDLFTFFKHPSIKSMTIV

SEQ ID NO: 1663089 - protein, 20 aa, Staphylococcus aureus
FSLFRKPSEVLRHIEEIANE

SEQ ID NO: 1663090 - protein, 18 aa, Staphylococcus aureus
FSMSKIVHHPHIQIPSDQ

SEQ ID NO: 1663091 - protein, 31 aa, Staphylococcus aureus
FSNKWKEKVHIIRWFLAYKKVPKILVDKIIA

SEQ ID NO: 1663092 - protein, 19 aa, Staphylococcus aureus
FSYKCSIKDIKYKKLLKAI

SEQ ID NO: 1663093 - protein, 27 aa, Staphylococcus aureus
FTDFPKDLKGIAGWILEVKSNTPGNTT

SEQ ID NO: 1663094 - protein, 23 aa, Staphylococcus aureus
FTGDIKTPVKYASSELKKLFSQV

SEQ ID NO: 1663095 - protein, 17 aa, Staphylococcus aureus
FTKLTLPLLKNADIYFD

SEQ ID NO: 1663096 - protein, 19 aa, Staphylococcus aureus
FTPYNSKKIYARSITNGRL

SEQ ID NO: 1663097 - protein, 22 aa, Staphylococcus aureus
FVDYAEFCFKEFPEVKYWTTFN

SEQ ID NO: 1663098 - protein, 27 aa, Staphylococcus aureus
FVKYFIKRCAMEKGIFNYDNANVLKLD

SEQ ID NO: 1663099 - protein, 18 aa, Staphylococcus aureus
FYISERVIRDLFSNLIAS

SEQ ID NO: 1663100 - protein, 17 aa, Staphylococcus aureus
FYKDGKMAYYFIKDDEI

SEQ ID NO: 1663101 - protein, 19 aa, Staphylococcus aureus
FYMEGYFVKHMNFSGHNLL

SEQ ID NO: 1663102 - protein, 17 aa, Staphylococcus aureus
FYPTKYLLIYNDNKTVE

SEQ ID NO: 1663103 - protein, 25 aa, Staphylococcus aureus
FYYGKSLKESIPIANSRELSRLLLI

SEQ ID NO: 1663104 - protein, 19 aa, Staphylococcus aureus
GADTLRLYEMFMGPLDAAI

SEQ ID NO: 1663105 - protein, 22 aa, Staphylococcus aureus
GALGRKTKQGFYKKDKETKARL

SEQ ID NO: 1663106 - protein, 22 aa, Staphylococcus aureus
GALGRKTKQGFYKKNKETKARL

SEQ ID NO: 1663107 - protein, 17 aa, Staphylococcus aureus
GANRLIKAGAFDKYPIE

SEQ ID NO: 1663108 - protein, 29 aa, Staphylococcus aureus
GANTILPGIQFIQGFEVIIHPSCEHAIEE

SEQ ID NO: 1663109 - protein, 24 aa, Staphylococcus aureus
GATLRIDICEIHIEIANYIYEEIF

SEQ ID NO: 1663110 - protein, 21 aa, Staphylococcus aureus
GCTHYPLLYKPIYDYFDGKKT

SEQ ID NO: 1663111 - protein, 22 aa, Staphylococcus aureus
GDDRLVKELQQFVKNEVAPYKY

SEQ ID NO: 1663112 - protein, 17 aa, Staphylococcus aureus
GDILKLRLYRNDENYNE

SEQ ID NO: 1663113 - protein, 18 aa, Staphylococcus aureus
GDILLQVLLHTSIGKKEG

SEQ ID NO: 1663114 - protein, 21 aa, Staphylococcus aureus
GDIPNNLLFYIYGSLIEGFLH

SEQ ID NO: 1663115 - protein, 18 aa, Staphylococcus aureus
GDKGTWTLLTSFAKSNKP

SEQ ID NO: 1663116 - protein, 23 aa, Staphylococcus aureus
GDLSTVAVVYPFLDKEISFSVSI

SEQ ID NO: 1663117 - protein, 23 aa, Staphylococcus aureus
GDQCPICGNEIQDLGHHIDFESI

SEQ ID NO: 1663118 - protein, 25 aa, Staphylococcus aureus
GDTFFPPYTFENWEVESSVEGQLDE

SEQ ID NO: 1663119 - protein, 21 aa, Staphylococcus aureus
GDVCRKIFNVDGFDFQLRVKK

SEQ ID NO: 1663120 - protein, 25 aa, Staphylococcus aureus
GEDAVREWLRTTGFKNIDDLNKVLK

SEQ ID NO: 1663121 - protein, 17 aa, Staphylococcus aureus
GEEAFLKKILGEEYTGN

SEQ ID NO: 1663122 - protein, 18 aa, Staphylococcus aureus
GEGALAGIYKAYEEKGNN

SEQ ID NO: 1663123 - protein, 21 aa, Staphylococcus aureus
GEMICGFADMDIYNLVNNKYL

SEQ ID NO: 1663124 - protein, 22 aa, Staphylococcus aureus
GEPEAEIVKGRVRYEQNNKEYD

SEQ ID NO: 1663125 - protein, 19 aa, Staphylococcus aureus
GEQFFKDNFGLKVKATNVV

SEQ ID NO: 1663126 - protein, 26 aa, Staphylococcus aureus
GEREADFINCVTFRKQAENVNNYLSK

SEQ ID NO: 1663127 - protein, 23 aa, Staphylococcus aureus
GESAWGLFSGVFGKSTNINQVLS

SEQ ID NO: 1663128 - protein, 20 aa, Staphylococcus aureus
GESDSSVLLFNITKNNQPLF

SEQ ID NO: 1663129 - protein, 23 aa, Staphylococcus aureus
GESGCGKSILSKSIIKLLPEKIS

SEQ ID NO: 1663130 - protein, 23 aa, Staphylococcus aureus
GEVPKLYLTSHMDTVVPAINVKP

SEQ ID NO: 1663131 - protein, 26 aa, Staphylococcus aureus
GFGNYELRLPLVSLEDTDTKVLREAY

SEQ ID NO: 1663132 - protein, 18 aa, Staphylococcus aureus
GGELKHGTIALIEEDTPV

SEQ ID NO: 1663133 - protein, 22 aa, Staphylococcus aureus
GGFSPLAIAIHIVYFDEANELR

SEQ ID NO: 1663134 - protein, 24 aa, Staphylococcus aureus
GGNQGLEIMLPFYIYNEDGNYSEE

SEQ ID NO: 1663135 - protein, 22 aa, Staphylococcus aureus
GGPHKAVCGFSKHNYALYQDDL

SEQ ID NO: 1663136 - protein, 19 aa, Staphylococcus aureus
GHEPWTSCEFDFTNEGKLK

SEQ ID NO: 1663137 - protein, 20 aa, Staphylococcus aureus
GHEPWTSCEFDFTRDGKLKV

SEQ ID NO: 1663138 - protein, 18 aa, Staphylococcus aureus
GHPMLKKRHMAFTITEFE

SEQ ID NO: 1663139 - protein, 26 aa, Staphylococcus aureus
GHQLRFDLTKGFPLLTTKKVSFKLVA

SEQ ID NO: 1663140 - protein, 17 aa, Staphylococcus aureus
GHQRFMAQIDFGGVPFE

SEQ ID NO: 1663141 - protein, 18 aa, Staphylococcus aureus
GHVLPLVAKYLINREDEV

SEQ ID NO: 1663142 - protein, 18 aa, Staphylococcus aureus
GIDIKDLKLSTLMSQISA

SEQ ID NO: 1663143 - protein, 21 aa, Staphylococcus aureus
GIDVPTLDAVIFLAPKKSQVD

SEQ ID NO: 1663144 - protein, 38 aa, Staphylococcus aureus
GIFDRYPKLNMIIGHWGEFIPFFLERMDEALFTEHLNH

SEQ ID NO: 1663145 - protein, 25 aa, Staphylococcus aureus
GIKEIEMFKIMGLPFISHSIVSQDN

SEQ ID NO: 1663146 - protein, 18 aa, Staphylococcus aureus
GILEILQSIIQFFSNLLN

SEQ ID NO: 1663147 - protein, 18 aa, Staphylococcus aureus
GIPSKRVICEGDLVNIDV

SEQ ID NO: 1663148 - protein, 25 aa, Staphylococcus aureus
GIRHFGENRLEGFFQKKEALPSDAV

SEQ ID NO: 1663149 - protein, 25 aa, Staphylococcus aureus
GIVSKRVRGCWEFSEALDAPYGMHL

SEQ ID NO: 1663150 - protein, 22 aa, Staphylococcus aureus
GKDWSSIAFIVPRNKVAFIPSE

SEQ ID NO: 1663151 - protein, 17 aa, Staphylococcus aureus
GKKAIVYFYPRDNTPTC

SEQ ID NO: 1663152 - protein, 19 aa, Staphylococcus aureus
GKKKIESIMTHFRSHPPQE

SEQ ID NO: 1663153 - protein, 27 aa, Staphylococcus aureus
GKKYLLQNGKWGYFNREFFDLLNDHLN

SEQ ID NO: 1663154 - protein, 21 aa, Staphylococcus aureus
GKLKVSFDYIDWINTEFDQLG

SEQ ID NO: 1663155 - protein, 19 aa, Staphylococcus aureus
GKLNVSFDYIDWINTEFDQ

SEQ ID NO: 1663156 - protein, 25 aa, Staphylococcus aureus
GKMAAICGYGARLAYIDTNGDIRIK

SEQ ID NO: 1663157 - protein, 26 aa, Staphylococcus aureus
GKQGTGLGLFICKMIIEEHGGSIDVK

SEQ ID NO: 1663158 - protein, 22 aa, Staphylococcus aureus
GKSTLCHLLLRFYDVNDGFIRI

SEQ ID NO: 1663159 - protein, 18 aa, Staphylococcus aureus
GKYSESVVVTGNTAIDAM

SEQ ID NO: 1663160 - protein, 22 aa, Staphylococcus aureus
GLAGIGRYLLNRVDANATNVKA

SEQ ID NO: 1663161 - protein, 26 aa, Staphylococcus aureus
GLEPLSAVIIPLDIAYNLYSIDQLID

SEQ ID NO: 1663162 - protein, 22 aa, Staphylococcus aureus
GLEPWTSCEFDFTRDGKLNVSF

SEQ ID NO: 1663163 - protein, 19 aa, Staphylococcus aureus
GLEVFRVLYQKYPDESELL

SEQ ID NO: 1663164 - protein, 24 aa, Staphylococcus aureus
GLGAALKTSADFEGQMSRVGAIAQ

SEQ ID NO: 1663165 - protein, 19 aa, Staphylococcus aureus
GLLPHEWHYHISPRGKADI

SEQ ID NO: 1663166 - protein, 18 aa, Staphylococcus aureus
GLNALKKAQTVNVKKQGI

SEQ ID NO: 1663167 - protein, 26 aa, Staphylococcus aureus
GLNMTFNYCKKRVWTYDMDRMDQVLT

SEQ ID NO: 1663168 - protein, 23 aa, Staphylococcus aureus
GLRFSKRSNKGLVQVVNGDYATG

SEQ ID NO: 1663169 - protein, 17 aa, Staphylococcus aureus
GLTIGKDKGYEWNPQPI

SEQ ID NO: 1663170 - protein, 22 aa, Staphylococcus aureus
GMLSLRLNKAYSVAKLLDNLDI

SEQ ID NO: 1663171 - protein, 22 aa, Staphylococcus aureus
GNIGRGFIGYILTDNNVKVTFA

SEQ ID NO: 1663172 - protein, 17 aa, Staphylococcus aureus
GNLKQGIANKDTVKASE

SEQ ID NO: 1663173 - protein, 25 aa, Staphylococcus aureus
GNMKEYKDAFLAAPAEIKFLLYFAK

SEQ ID NO: 1663174 - protein, 27 aa, Staphylococcus aureus
GNMVYIYRWPNLFGKWCKPNYNSVIAT

SEQ ID NO: 1663175 - protein, 18 aa, Staphylococcus aureus
GNNGYYANEFNLMQRKNK

SEQ ID NO: 1663176 - protein, 18 aa, Staphylococcus aureus
GNPFSISAVTYILSNPFY

SEQ ID NO: 1663177 - protein, 27 aa, Staphylococcus aureus
GNSGVILSQLFRGFCKNIESESEINSK

SEQ ID NO: 1663178 - protein, 24 aa, Staphylococcus aureus
GNTKLKLNGYFIASIISPLNLNKL

SEQ ID NO: 1663179 - protein, 20 aa, Staphylococcus aureus
GNYSKVPWISIYDENITKES

SEQ ID NO: 1663180 - protein, 17 aa, Staphylococcus aureus
GNYTRKKAIFFVGDGNN

SEQ ID NO: 1663181 - protein, 20 aa, Staphylococcus aureus
GPLDLLLHLIQKFEIDIYDI

SEQ ID NO: 1663182 - protein, 22 aa, Staphylococcus aureus
GPQQREIGFPISTDNASWGGTT

SEQ ID NO: 1663183 - protein, 27 aa, Staphylococcus aureus
GQALKRLLDKWGMSPSELMAFGDANND

SEQ ID NO: 1663184 - protein, 27 aa, Staphylococcus aureus
GQARLTQLCTLLKNYFKSEDEEMPENT

SEQ ID NO: 1663185 - protein, 20 aa, Staphylococcus aureus
GQMPNLWPRLIEIKVPTLIL

SEQ ID NO: 1663186 - protein, 22 aa, Staphylococcus aureus
GQYRGIATWRYDQERQRLIGTI

SEQ ID NO: 1663187 - protein, 24 aa, Staphylococcus aureus
GRALGGGCELVLYSPIVVATSETY

SEQ ID NO: 1663188 - protein, 19 aa, Staphylococcus aureus
GRLQYVIPNEFLKHSGKVH

SEQ ID NO: 1663189 - protein, 20 aa, Staphylococcus aureus
GRLQYVIPNEFLKHSGKVHA

SEQ ID NO: 1663190 - protein, 18 aa, Staphylococcus aureus
GRTEPRMGMVEKISSLFN

SEQ ID NO: 1663191 - protein, 17 aa, Staphylococcus aureus
GRTLTAVLNVRKDLSNA

SEQ ID NO: 1663192 - protein, 23 aa, Staphylococcus aureus
GSGKTVVAAICMYALKTAGYQSA

SEQ ID NO: 1663193 - protein, 19 aa, Staphylococcus aureus
GSGYENAKRAILRAQSILG

SEQ ID NO: 1663194 - protein, 20 aa, Staphylococcus aureus
GSIFKEALLIEVLKSRVIRH

SEQ ID NO: 1663195 - protein, 24 aa, Staphylococcus aureus
GSKMPRADWGLVENIRVYFPELCE

SEQ ID NO: 1663196 - protein, 17 aa, Staphylococcus aureus
GSLYRAVNDINLAIRKG

SEQ ID NO: 1663197 - protein, 24 aa, Staphylococcus aureus
GSYQPSRCFALPVIQKGHIFIKRV

SEQ ID NO: 1663198 - protein, 24 aa, Staphylococcus aureus
GTEHYYEFHTKKGMLLVTTDGKKN

SEQ ID NO: 1663199 - protein, 19 aa, Staphylococcus aureus
GTKKFVEEFVEELYSDSPK

SEQ ID NO: 1663200 - protein, 24 aa, Staphylococcus aureus
GTSARLHPWLLKIYEKRGYEIYSE

SEQ ID NO: 1663201 - protein, 36 aa, Staphylococcus aureus; identical to SEQ ID NO: 1582818

SEQ ID NO: 1663202 - protein, 18 aa, Staphylococcus aureus
GTVLSGFEYRAQKEKYDN

SEQ ID NO: 1663203 - protein, 18 aa, Staphylococcus aureus
GTYFKSVAVTTTMGPGVK

SEQ ID NO: 1663204 - protein, 26 aa, Staphylococcus aureus
GTYMCIAAACGENIILNNIVPKHVET

SEQ ID NO: 1663205 - protein, 17 aa, Staphylococcus aureus
GVAKELFIKNGYNATTT

SEQ ID NO: 1663206 - protein, 17 aa, Staphylococcus aureus
GVDYFFKTRDAFEALIK

SEQ ID NO: 1663207 - protein, 17 aa, Staphylococcus aureus
GVELLKMPNIEDVMSGE

SEQ ID NO: 1663208 - protein, 17 aa, Staphylococcus aureus
GVETALQNVQRAKNELN

SEQ ID NO: 1663209 - protein, 22 aa, Staphylococcus aureus
GVGRMMLKFKAWDKDKKVMSII

SEQ ID NO: 1663210 - protein, 25 aa, Staphylococcus aureus
GVGTKLRLAIDYGKHDSIGIDAVAM

SEQ ID NO: 1663211 - protein, 23 aa, Staphylococcus aureus
GVHPYRVKLALGQVRHYQLDGLL

SEQ ID NO: 1663212 - protein, 20 aa, Staphylococcus aureus
GVNQGFFGVAGFDLLVDEDD

SEQ ID NO: 1663213 - protein, 21 aa, Staphylococcus aureus
GVRFYMKKGFLMIELPSGRAL

SEQ ID NO: 1663214 - protein, 24 aa, Staphylococcus aureus
GVSIESLIEFCRLAQLPKNKNIQT

SEQ ID NO: 1663215 - protein, 17 aa, Staphylococcus aureus
GVVPFLKVDKGLAEEQN

SEQ ID NO: 1663216 - protein, 17 aa, Staphylococcus aureus
GWSKISNMFPRDKNAAK

SEQ ID NO: 1663217 - protein, 23 aa, Staphylococcus aureus
GYENPDLGTFFLMDTTSRIIGHD

SEQ ID NO: 1663218 - protein, 23 aa, Staphylococcus aureus
GYFIEPEDLFSAMIREIETQDFD

SEQ ID NO: 1663219 - protein, 22 aa, Staphylococcus aureus
GYPMPSVGLGVYKISDENMTKV

SEQ ID NO: 1663220 - protein, 21 aa, Staphylococcus aureus
GYREVMGLNVAMLEIDVHLTK

SEQ ID NO: 1663221 - protein, 20 aa, Staphylococcus aureus
GYTMPPKFYDLSALQEDMND

SEQ ID NO: 1663222 - protein, 20 aa, Staphylococcus aureus
GYVANLKYQFDINQKDKNHI

SEQ ID NO: 1663223 - protein, 17 aa, Staphylococcus aureus
GYYTINDIREWEDLPPV

SEQ ID NO: 1663224 - protein, 24 aa, Staphylococcus aureus
HAKNGYYNGITFHRVINDFMIQGG

SEQ ID NO: 1663225 - protein, 19 aa, Staphylococcus aureus
HAPRVPFVIIGKNSHGHLV

SEQ ID NO: 1663226 - protein, 28 aa, Staphylococcus aureus
HAQGLGFRGNIFGGYILYNLGYIHSTGH

SEQ ID NO: 1663227 - protein, 24 aa, Staphylococcus aureus
HAVSRLVGAPLGYVGHDDGGQLTE

SEQ ID NO: 1663228 - protein, 17 aa, Staphylococcus aureus
HAVYKLSKFAINQYIKY

SEQ ID NO: 1663229 - protein, 27 aa, Staphylococcus aureus
HAYDFPMWFIRPNFKSEIAPRSVQSPT

SEQ ID NO: 1663230 - protein, 27 aa, Staphylococcus aureus
HAYDFPMWFIRPNFKSEITPRSVQSPT

SEQ ID NO: 1663231 - protein, 19 aa, Staphylococcus aureus
HDACGIGFYANMDNKRSHD

SEQ ID NO: 1663232 - protein, 20 aa, Staphylococcus aureus
HDRILVKGSRGMKLEEVVNA

SEQ ID NO: 1663233 - protein, 18 aa, Staphylococcus aureus
HDSLANEKTRVRLYKSGK

SEQ ID NO: 1663234 - protein, 18 aa, Staphylococcus aureus
HDTIVAGGNYTNASPDKQ

SEQ ID NO: 1663235 - protein, 17 aa, Staphylococcus aureus
HEIKESYDILIKQANRL

SEQ ID NO: 1663236 - protein, 17 aa, Staphylococcus aureus
HEPWTSCEFDFTSEGKL

SEQ ID NO: 1663237 - protein, 21 aa, Staphylococcus aureus
HFDTELNIPMSQWQYAMNRTL

SEQ ID NO: 1663238 - protein, 24 aa, Staphylococcus aureus
HFKTEVHSSLPFLLTGDVSCNHAP

SEQ ID NO: 1663239 - protein, 20 aa, Staphylococcus aureus
HGAFKIIETHALKDVQAVLG

SEQ ID NO: 1663240 - protein, 19 aa, Staphylococcus aureus
HGAFKIIETHALQDVQAVL

SEQ ID NO: 1663241 - protein, 23 aa, Staphylococcus aureus
HGCLGSMHGIEILKTGKEIHFAH

SEQ ID NO: 1663242 - protein, 24 aa, Staphylococcus aureus
HGKVARLTQFGVFIDIGGVDGLVH

SEQ ID NO: 1663243 - protein, 24 aa, Staphylococcus aureus
HGLIIQRFGTTYVLTTKKEAATYI

SEQ ID NO: 1663244 - protein, 24 aa, Staphylococcus aureus
HGTKSSEFKPNFVNDSLENETNSI

SEQ ID NO: 1663245 - protein, 18 aa, Staphylococcus aureus
HGVLFRGAAEGVIRRYLI

SEQ ID NO: 1663246 - protein, 26 aa, Staphylococcus aureus
HHCEAFKANFKGAAQGDWVKSAMSEI

SEQ ID NO: 1663247 - protein, 18 aa, Staphylococcus aureus
HIDTTIKKQVPVCCFTFG

SEQ ID NO: 1663248 - protein, 19 aa, Staphylococcus aureus
HIEHRRWGAPFPVIEIVKL

SEQ ID NO: 1663249 - protein, 19 aa, Staphylococcus aureus
HIFKSITFDCGKEFSNWKT

SEQ ID NO: 1663250 - protein, 23 aa, Staphylococcus aureus
HIMRQKRVDAIFVVDSNNHLLGF

SEQ ID NO: 1663251 - protein, 24 aa, Staphylococcus aureus
HKEFTIPVKFTIKVVLTDPYKYSV

SEQ ID NO: 1663252 - protein, 26 aa, Staphylococcus aureus
HKGAEQMLGMFANTLVYRGQPSPDKM

SEQ ID NO: 1663253 - protein, 18 aa, Staphylococcus aureus
HKGLHMLTFEGINNINDI

SEQ ID NO: 1663254 - protein, 21 aa, Staphylococcus aureus
HKIPPTIISRAQRFDFKAISL

SEQ ID NO: 1663255 - protein, 19 aa, Staphylococcus aureus
HKLASCIDVANIDTPIKFI

SEQ ID NO: 1663256 - protein, 20 aa, Staphylococcus aureus
HKLMKLKYVRHIDGSPYKYL

SEQ ID NO: 1663257 - protein, 20 aa, Staphylococcus aureus
HKLPLGLDFEDVELVSLDLT

SEQ ID NO: 1663258 - protein, 17 aa, Staphylococcus aureus
HLHDSWLKVDERLNKML

SEQ ID NO: 1663259 - protein, 18 aa, Staphylococcus aureus
HLHDSWLKVDERLNKMLK

SEQ ID NO: 1663260 - protein, 19 aa, Staphylococcus aureus
HLLPYFKSIDVFKMTTQDV

SEQ ID NO: 1663261 - protein, 28 aa, Staphylococcus aureus
HLQNVDGFKALRFLRPRTAGRHYIIITL

SEQ ID NO: 1663262 - protein, 20 aa, Staphylococcus aureus
HMHVLLCVENAYFRKKKYIT

SEQ ID NO: 1663263 - protein, 18 aa, Staphylococcus aureus
HMNPCGVGIGDTLEQAFH

SEQ ID NO: 1663264 - protein, 24 aa, Staphylococcus aureus
HNPANLMGIRAFRKLLPNIPHVAI

SEQ ID NO: 1663265 - protein, 17 aa, Staphylococcus aureus
HNRGSFEGFKQAVSEEK

SEQ ID NO: 1663266 - protein, 38 aa, Staphylococcus aureus
HPARESYEFGFAVSEGRTRASIILTFVADLRNYIDNEI

SEQ ID NO: 1663267 - protein, 21 aa, Staphylococcus aureus
HPGRRYYGGCEFVDVTESIAI

SEQ ID NO: 1663268 - protein, 23 aa, Staphylococcus aureus
HPSYKSRLGFTLSDNLKFSPDFV

SEQ ID NO: 1663269 - protein, 17 aa, Staphylococcus aureus
HQLPLFRYLTAAQHGFF

SEQ ID NO: 1663270 - protein, 24 aa, Staphylococcus aureus
HQRLSDFKSMLAYNETNYAALVNE

SEQ ID NO: 1663271 - protein, 18 aa, Staphylococcus aureus
HQTLKLNDLRSRVKLETD

SEQ ID NO: 1663272 - protein, 23 aa, Staphylococcus aureus
HQVVIRCLMVYFNNVSREEAVDL

SEQ ID NO: 1663273 - protein, 18 aa, Staphylococcus aureus
HRPIRFIEKFCKPSKGSK

SEQ ID NO: 1663274 - protein, 17 aa, Staphylococcus aureus
HRQGKLPQGKKVVAILT

SEQ ID NO: 1663275 - protein, 20 aa, Staphylococcus aureus
HRTLIYVPACLLLVLNSLST

SEQ ID NO: 1663276 - protein, 20 aa, Staphylococcus aureus
HSLGGREAVILGMSNGIPNI

SEQ ID NO: 1663277 - protein, 26 aa, Staphylococcus aureus
HSRFSTNTFPSWKRAHPNRMLMHNGE

SEQ ID NO: 1663278 - protein, 29 aa, Staphylococcus aureus
HTATELNTAMTALKRAIADKADTKASGNY

SEQ ID NO: 1663279 - protein, 17 aa, Staphylococcus aureus
HTNIALIKYWGKKDEGL

SEQ ID NO: 1663280 - protein, 30 aa, Staphylococcus aureus
HTNPLWHVYRLVKFSKVFKNVIIIEFSKFI

SEQ ID NO: 1663281 - protein, 20 aa, Staphylococcus aureus
HTSALARYLAEHFKTHDIEA

SEQ ID NO: 1663282 - protein, 17 aa, Staphylococcus aureus
HTVLPLNRNFLSAFTQQ

SEQ ID NO: 1663283 - protein, 17 aa, Staphylococcus aureus
HTYGQREIYDFIDEAKR

SEQ ID NO: 1663284 - protein, 24 aa, Staphylococcus aureus
HVAESRLDNIISMADQYLTYTLLR

SEQ ID NO: 1663285 - protein, 27 aa, Staphylococcus aureus
HVCIIRLKKEYYYNFFGQYLLSRKGKR

SEQ ID NO: 1663286 - protein, 17 aa, Staphylococcus aureus
HVEHVHLASDIPFSNDK

SEQ ID NO: 1663287 - protein, 21 aa, Staphylococcus aureus
HVERVSKRLGINRWKDNARQV

SEQ ID NO: 1663288 - protein, 19 aa, Staphylococcus aureus
HVPVLIDEAYFEFVTAEDY

SEQ ID NO: 1663289 - protein, 25 aa, Staphylococcus aureus
HVSELKNRIPLVLEVKSNQYQSSTR

SEQ ID NO: 1663290 - protein, 29 aa, Staphylococcus aureus
HWEELKQSWEFIDYISTEWKKSNVTIPQY

SEQ ID NO: 1663291 - protein, 23 aa, Staphylococcus aureus
HYLKSDQAIKEFTSYLRKQINMK

SEQ ID NO: 1663292 - protein, 19 aa, Staphylococcus aureus
IAAMKWINTFKRIHITSES

SEQ ID NO: 1663293 - protein, 22 aa, Staphylococcus aureus
IAARARGRYGGRPEKLNKQDLK

SEQ ID NO: 1663294 - protein, 22 aa, Staphylococcus aureus
IAARARGRYGGRPEKLNQKDLN

SEQ ID NO: 1663295 - protein, 25 aa, Staphylococcus aureus
IADCKRFLECLNDKNIETIEHSDWV

SEQ ID NO: 1663296 - protein, 33 aa, Staphylococcus aureus
IADLDFKLNLMLNAFSSDFYYFVKHNQKLTKQQ

SEQ ID NO: 1663297 - protein, 18 aa, Staphylococcus aureus
IAEVTAFDKKLNKLNVSI

SEQ ID NO: 1663298 - protein, 20 aa, Staphylococcus aureus
IAFELLAYALQYAFDNFDIR

SEQ ID NO: 1663299 - protein, 20 aa, Staphylococcus aureus
IAFVDARSDLTFDLETILTK

SEQ ID NO: 1663300 - protein, 22 aa, Staphylococcus aureus
IAIGVSNFYYAPILKDTEKEWE

SEQ ID NO: 1663301 - protein, 18 aa, Staphylococcus aureus
IAMTRARQDVTFSYSLMG

SEQ ID NO: 1663302 - protein, 27 aa, Staphylococcus aureus
IANEISGMIPIEWEKVYTMAYIDDEGG

SEQ ID NO: 1663303 - protein, 29 aa, Staphylococcus aureus
IANKISSMIPVEWEKVYTIAYVDDQGGEV

SEQ ID NO: 1663304 - protein, 25 aa, Staphylococcus aureus
IANSRELSRLLLIGSATFSSIDIGH

SEQ ID NO: 1663305 - protein, 28 aa, Staphylococcus aureus
IAQVSEWMFKNGYDIRAFASESISVIIF

SEQ ID NO: 1663306 - protein, 25 aa, Staphylococcus aureus
IARGKKRIDYRLSYNFYTTYYDNVE

SEQ ID NO: 1663307 - protein, 29 aa, Staphylococcus aureus
IASEISGMIPVEWEQVFTIAYVTDQAGEV

SEQ ID NO: 1663308 - protein, 18 aa, Staphylococcus aureus
IASNSIYRRTYSAAANLH

SEQ ID NO: 1663309 - protein, 24 aa, Staphylococcus aureus
IASSLKAPIYVLSNIAGVLINDVV

SEQ ID NO: 1663310 - protein, 19 aa, Staphylococcus aureus
IATDLKLRKSKNEKSYVFF

SEQ ID NO: 1663311 - protein, 20 aa, Staphylococcus aureus
IATGRPYRASQMYYHELNLT

SEQ ID NO: 1663312 - protein, 18 aa, Staphylococcus aureus
IAYKNLYELYSYFMDEIE

SEQ ID NO: 1663313 - protein, 43 aa, Staphylococcus aureus
ICASCVNAPTSKDIYDWLKPLLKRKYPNISFKYTYIDITKDND

SEQ ID NO: 1663314 - protein, 17 aa, Staphylococcus aureus
ICLSSKFNFEKREKEIP

SEQ ID NO: 1663315 - protein, 17 aa, Staphylococcus aureus
ICREHGILIAVDDIQQG

SEQ ID NO: 1663316 - protein, 18 aa, Staphylococcus aureus
IDALDIRLEPKFTSDIVP

SEQ ID NO: 1663317 - protein, 21 aa, Staphylococcus aureus
IDALYQFLFEFIFDIEERYIR

SEQ ID NO: 1663318 - protein, 18 aa, Staphylococcus aureus
IDEYVASIVSYIIEYTTI

SEQ ID NO: 1663319 - protein, 26 aa, Staphylococcus aureus
IDFDKPKLEMWIDVLSQNGDYQPTVK

SEQ ID NO: 1663320 - protein, 26 aa, Staphylococcus aureus
IDKLICSWLKRIDNVIPQLIMEMTTE

SEQ ID NO: 1663321 - protein, 19 aa, Staphylococcus aureus
IDLEMRRNIEIEMATKEEN

SEQ ID NO: 1663322 - protein, 19 aa, Staphylococcus aureus
IDLSELYIATDAMRDVINE

SEQ ID NO: 1663323 - protein, 18 aa, Staphylococcus aureus
IDRYNFYGVSGKFTEDAE

SEQ ID NO: 1663324 - protein, 18 aa, Staphylococcus aureus
IDSSEAMNGYRRGAYEDM

SEQ ID NO: 1663325 - protein, 17 aa, Staphylococcus aureus
IDVRLGDGLSVIHPEDV

SEQ ID NO: 1663326 - protein, 24 aa, Staphylococcus aureus
IDYIKRVSKSKIWTSDDNAAYDLT

SEQ ID NO: 1663327 - protein, 25 aa, Staphylococcus aureus
IEANYKYARGVAVYGDIKNGANDQG

SEQ ID NO: 1663328 - protein, 18 aa, Staphylococcus aureus
IEATLDWTFYNDIPLSYK

SEQ ID NO: 1663329 - protein, 21 aa, Staphylococcus aureus
IECFIHIDLIKGLSHDEFASE

SEQ ID NO: 1663330 - protein, 20 aa, Staphylococcus aureus
IEEFKKIILKTIFGETEVEE

SEQ ID NO: 1663331 - protein, 18 aa, Staphylococcus aureus
IEFIRLMPTLQKHRDEVL

SEQ ID NO: 1663332 - protein, 17 aa, Staphylococcus aureus
IEKMTAIVNIVKGDREN

SEQ ID NO: 1663333 - protein, 29 aa, Staphylococcus aureus
IELFKPDYIFVGMGFPKQEEWIMTHENQF

SEQ ID NO: 1663334 - protein, 20 aa, Staphylococcus aureus
IELGCTAMAIFKYIEKKSYE

SEQ ID NO: 1663335 - protein, 19 aa, Staphylococcus aureus
IELSSAWNYNSKLVTGKNA

SEQ ID NO: 1663336 - protein, 26 aa, Staphylococcus aureus
IELVKRLVPYVPKVELHMYGFGSESK

SEQ ID NO: 1663337 - protein, 19 aa, Staphylococcus aureus
IENFKFFVQYGSFKGIENY

SEQ ID NO: 1663338 - protein, 19 aa, Staphylococcus aureus
IENGCPKVIIASGNKPNII

SEQ ID NO: 1663339 - protein, 17 aa, Staphylococcus aureus
IENLMIFRREYKASERQ

SEQ ID NO: 1663340 - protein, 20 aa, Staphylococcus aureus
IENNKFPLVLGGDHSIAIGS

SEQ ID NO: 1663341 - protein, 19 aa, Staphylococcus aureus
IEPQDLFSAMIREIETQDF

SEQ ID NO: 1663342 - protein, 24 aa, Staphylococcus aureus
IEQARLKFKSEVEKNGYYAMNEKL

SEQ ID NO: 1663343 - protein, 25 aa, Staphylococcus aureus
IEVVRYLEEREGFKVKYVDVKKDGS

SEQ ID NO: 1663344 - protein, 17 aa, Staphylococcus aureus
IEWKEVLAGQKAFDTTG

SEQ ID NO: 1663345 - protein, 24 aa, Staphylococcus aureus
IEYDKEWFAIHIYIEKSSQDTFII

SEQ ID NO: 1663346 - protein, 20 aa, Staphylococcus aureus
IEYGGKRILIDPMLSDKGAF

SEQ ID NO: 1663347 - protein, 17 aa, Staphylococcus aureus
IFEKVFAEHFLNLYEKT

SEQ ID NO: 1663348 - protein, 28 aa, Staphylococcus aureus
IFIAGKGRSGFVANSFAMRLNQLGKQAF

SEQ ID NO: 1663349 - protein, 17 aa, Staphylococcus aureus
IFITRTILNDRDVLPAN

SEQ ID NO: 1663350 - protein, 29 aa, Staphylococcus aureus
IFKEEGYEPWTSCEFDFTKEGELKVSFDY

SEQ ID NO: 1663351 - protein, 27 aa, Staphylococcus aureus
IFKNSWFKVYRMFDELRETFKEEELEP

SEQ ID NO: 1663352 - protein, 27 aa, Staphylococcus aureus
IFKNSWFKVYRMFDELRETFKKEGLEP

SEQ ID NO: 1663353 - protein, 28 aa, Staphylococcus aureus
IFMDLWMKVYRMFDELRETFKKEGHEPW

SEQ ID NO: 1663354 - protein, 28 aa, Staphylococcus aureus
IFMDLWMKVYRMFDELRETFKKERFEPW

SEQ ID NO: 1663355 - protein, 17 aa, Staphylococcus aureus
IFPDAYVPFLQKYNPNI

SEQ ID NO: 1663356 - protein, 20 aa, Staphylococcus aureus
IFSKFSNYYEFLVRYKKNRC

SEQ ID NO: 1663357 - protein, 19 aa, Staphylococcus aureus
IGADLKRDGLIEMQICPPM

SEQ ID NO: 1663358 - protein, 18 aa, Staphylococcus aureus
IGDAGGKLHTGRSRNDQV

SEQ ID NO: 1663359 - protein, 21 aa, Staphylococcus aureus
IGGKWKIPIIFHLLQDKVLRL

SEQ ID NO: 1663360 - protein, 20 aa, Staphylococcus aureus
IGGMPFLKSFKDIPLDENNV

SEQ ID NO: 1663361 - protein, 22 aa, Staphylococcus aureus
IGHYHCQCGFKREQVKYEISSF

SEQ ID NO: 1663362 - protein, 17 aa, Staphylococcus aureus
IGIIPELQERIFERTFR

SEQ ID NO: 1663363 - protein, 26 aa, Staphylococcus aureus
IGKMAAICGYGARLAYIDTNGDVRIK

SEQ ID NO: 1663364 - protein, 18 aa, Staphylococcus aureus
IGLRAYFNKNIVPMKDNL

SEQ ID NO: 1663365 - protein, 24 aa, Staphylococcus aureus
IGQQIFKKYGIREMEVTDEVFESK

SEQ ID NO: 1663366 - protein, 23 aa, Staphylococcus aureus
IGVFHSKYLLAWSNKKEDQITNY

SEQ ID NO: 1663367 - protein, 19 aa, Staphylococcus aureus
IGYSFKFDGAISRQEASKD

SEQ ID NO: 1663368 - protein, 18 aa, Staphylococcus aureus
IHAAGLCHSDLSVINGNR

SEQ ID NO: 1663369 - protein, 26 aa, Staphylococcus aureus
IHACPELLGGLLIPREPAEIIGGDGF

SEQ ID NO: 1663370 - protein, 19 aa, Staphylococcus aureus
IHEEHKLPLGLDFEDVELV

SEQ ID NO: 1663371 - protein, 17 aa, Staphylococcus aureus
IHLIDILKKLSHDEIES

SEQ ID NO: 1663372 - protein, 17 aa, Staphylococcus aureus
IHQKFPQKQVFAVGEAE

SEQ ID NO: 1663373 - protein, 19 aa, Staphylococcus aureus
IIDLKYGKGIEVSAIDNPQ

SEQ ID NO: 1663374 - protein, 18 aa, Staphylococcus aureus
IIFRRDIFELNDIRDDDL

SEQ ID NO: 1663375 - protein, 26 aa, Staphylococcus aureus
IIKEGIPAKARRKGGHPAKRVFQALR

SEQ ID NO: 1663376 - protein, 21 aa, Staphylococcus aureus
IIKPVIMPVAYKHCALQVYAE

SEQ ID NO: 1663377 - protein, 24 aa, Staphylococcus aureus
IINDCADCVISVLPSKLGAISDAI

SEQ ID NO: 1663378 - protein, 19 aa, Staphylococcus aureus
IISTITVRYPWGSVKSISG

SEQ ID NO: 1663379 - protein, 17 aa, Staphylococcus aureus
IITGHSLGGRDAMILGM

SEQ ID NO: 1663380 - protein, 27 aa, Staphylococcus aureus
IIWNIATFYYSRMMKIMNLAILKIKIG

SEQ ID NO: 1663381 - protein, 23 aa, Staphylococcus aureus
IKADGKMLVIDGGFSKAYQSTTG

SEQ ID NO: 1663382 - protein, 27 aa, Staphylococcus aureus
IKAQRYVLRIVLEPMSLKNMLWTKYLK

SEQ ID NO: 1663383 - protein, 18 aa, Staphylococcus aureus
IKDGRLYHEIYRGEESQL

SEQ ID NO: 1663384 - protein, 22 aa, Staphylococcus aureus
IKEKPKARWLFLTLSTKNAIDG

SEQ ID NO: 1663385 - protein, 22 aa, Staphylococcus aureus
IKELLEKGLIGNCIQPIIEPIK

SEQ ID NO: 1663386 - protein, 20 aa, Staphylococcus aureus
IKESYDILIKQANRLSTLFD

SEQ ID NO: 1663387 - protein, 21 aa, Staphylococcus aureus
IKFDFRKGHQIVLKNRFNDNG

SEQ ID NO: 1663388 - protein, 17 aa, Staphylococcus aureus
IKGLLEVATQQIDKLIE

SEQ ID NO: 1663389 - protein, 29 aa, Staphylococcus aureus
IKGLNKHFYKECDRCLKAYNIFIEGINKH

SEQ ID NO: 1663390 - protein, 17 aa, Staphylococcus aureus
IKKAIGQDATVSLFDEF

SEQ ID NO: 1663391 - protein, 19 aa, Staphylococcus aureus
IKKELKKLKGYAEENNKSF

SEQ ID NO: 1663392 - protein, 17 aa, Staphylococcus aureus
IKKFMHYLLRAQERYQM

SEQ ID NO: 1663393 - protein, 18 aa, Staphylococcus aureus
IKKGQTFRLVGESGCGKS

SEQ ID NO: 1663394 - protein, 17 aa, Staphylococcus aureus
IKKRGGFNKINAVKNTR

SEQ ID NO: 1663395 - protein, 18 aa, Staphylococcus aureus
IKKVRYVYNIDFDKPKLE

SEQ ID NO: 1663396 - protein, 21 aa, Staphylococcus aureus
IKLFKGNAIVYGRKSPYTLYD

SEQ ID NO: 1663397 - protein, 23 aa, Staphylococcus aureus
IKNFKYSLLNGWELMEDELKTEF

SEQ ID NO: 1663398 - protein, 24 aa, Staphylococcus aureus
IKNGKAELLAPMSAIAGQRSAIMG

SEQ ID NO: 1663399 - protein, 24 aa, Staphylococcus aureus
IKNNIPSRIAFAVSSQTDSRTIIG

SEQ ID NO: 1663400 - protein, 22 aa, Staphylococcus aureus
IKPENIVLIGMRDLDKGERQFI

SEQ ID NO: 1663401 - protein, 21 aa, Staphylococcus aureus
IKPKKIMLVAGHGYNDPGAVG

SEQ ID NO: 1663402 - protein, 23 aa, Staphylococcus aureus
IKQRKLYPLTEMIRPINTNDNTP

SEQ ID NO: 1663403 - protein, 17 aa, Staphylococcus aureus
IKRAKLRGERSEGMICS

SEQ ID NO: 1663404 - protein, 26 aa, Staphylococcus aureus
IKRLLRLVLRLKIYLLKKQIDFINCF

SEQ ID NO: 1663405 - protein, 23 aa, Staphylococcus aureus
IKSFKQDQFEIVKVATDYCKENN

SEQ ID NO: 1663406 - protein, 19 aa, Staphylococcus aureus
IKTFYVWGCYKNDQIKWYV

SEQ ID NO: 1663407 - protein, 22 aa, Staphylococcus aureus
IKTYIFYHLFDTYIIDYSMASA

SEQ ID NO: 1663408 - protein, 21 aa, Staphylococcus aureus
IKVTRLAQGLSVGGDLEYADE

SEQ ID NO: 1663409 - protein, 17 aa, Staphylococcus aureus
IKWYVDMGVIDKEEYAL

SEQ ID NO: 1663410 - protein, 24 aa, Staphylococcus aureus
IKYAEEPINFILKSSTKLKADIDF

SEQ ID NO: 1663411 - protein, 23 aa, Staphylococcus aureus
IKYFSSHVDYRLKGIAFELLAYA

SEQ ID NO: 1663412 - protein, 26 aa, Staphylococcus aureus
IKYIRRMDMSNLHPKMETARIQVMSD

SEQ ID NO: 1663413 - protein, 19 aa, Staphylococcus aureus
IKYLSLTQRKLFLFTKSTY

SEQ ID NO: 1663414 - protein, 18 aa, Staphylococcus aureus
ILACSELDVPVYDAYHTD

SEQ ID NO: 1663415 - protein, 18 aa, Staphylococcus aureus
ILDKAHGQNMTKAQVEAA

SEQ ID NO: 1663416 - protein, 17 aa, Staphylococcus aureus
ILEQSIPNKEYIDLSEI

SEQ ID NO: 1663417 - protein, 18 aa, Staphylococcus aureus
ILMISRAVLTPGDAIVTS

SEQ ID NO: 1663418 - protein, 19 aa, Staphylococcus aureus
ILNRAKEEFKKVLPTKNDS

SEQ ID NO: 1663419 - protein, 24 aa, Staphylococcus aureus
ILRAQEMNIPISIEIPDEVTRINL

SEQ ID NO: 1663420 - protein, 20 aa, Staphylococcus aureus
ILSLYPTKNLEDFYDKEGFR

SEQ ID NO: 1663421 - protein, 17 aa, Staphylococcus aureus
ILTLIAMEKPESRNSKD

SEQ ID NO: 1663422 - protein, 36 aa, Staphylococcus aureus
ILTSICKKWYINSFKYFRNMYKGFYYSRPDKLNKCF

SEQ ID NO: 1663423 - protein, 17 aa, Staphylococcus aureus
IMAGIPIDYIKQQLECQ

SEQ ID NO: 1663424 - protein, 17 aa, Staphylococcus aureus
INDGAAMMLVMSEDKAK

SEQ ID NO: 1663425 - protein, 23 aa, Staphylococcus aureus
INFAAAYKAPAIFVIQNNNYAIS

SEQ ID NO: 1663426 - protein, 17 aa, Staphylococcus aureus
INGFSNVVSNEFAFLHP

SEQ ID NO: 1663427 - protein, 26 aa, Staphylococcus aureus
INGMIPVDWEKVYVIAYVDDGGGQVI

SEQ ID NO: 1663428 - protein, 21 aa, Staphylococcus aureus
INGNVPIFINIGEWDGDDEEL

SEQ ID NO: 1663429 - protein, 23 aa, Staphylococcus aureus
INIKGEVLITEIYDDYFFKNDEW

SEQ ID NO: 1663430 - protein, 24 aa, Staphylococcus aureus
INKRLHIIPFNYSFKDDQERLSVT

SEQ ID NO: 1663431 - protein, 23 aa, Staphylococcus aureus
INKYKEFVDLFIIDTPSVSYGGT

SEQ ID NO: 1663432 - protein, 18 aa, Staphylococcus aureus
INKYKGFVDLFIIDTPSV

SEQ ID NO: 1663433 - protein, 26 aa, Staphylococcus aureus
INLAPSARKEIVIDLSKMKEEKVNLV

SEQ ID NO: 1663434 - protein, 24 aa, Staphylococcus aureus
INMSRCLVEKTIFLESKKENKKHD

SEQ ID NO: 1663435 - protein, 17 aa, Staphylococcus aureus
INNIILIAGQNPEATAV

SEQ ID NO: 1663436 - protein, 19 aa, Staphylococcus aureus
INNIKRFNQLTGMTEDEIR

SEQ ID NO: 1663437 - protein, 20 aa, Staphylococcus aureus
INRLIKIINVLGYEYNKDTG

SEQ ID NO: 1663438 - protein, 18 aa, Staphylococcus aureus
INSLPEFSQYIDKKLESE

SEQ ID NO: 1663439 - protein, 20 aa, Staphylococcus aureus
INVDGFDFKLAVKKKDHSIL

SEQ ID NO: 1663440 - protein, 25 aa, Staphylococcus aureus
INVIKWVHQFIESFGGDAKNITLMG

SEQ ID NO: 1663441 - protein, 24 aa, Staphylococcus aureus
INYHSKFDILSWLQDPFATPTLGK

SEQ ID NO: 1663442 - protein, 17 aa, Staphylococcus aureus
INYKDMLALQYKGGVIR

SEQ ID NO: 1663443 - protein, 21 aa, Staphylococcus aureus
INYSNGFIKEGTYRTETIGSK

SEQ ID NO: 1663444 - protein, 27 aa, Staphylococcus aureus
IPDELIELPQWVLWRAEWNEKQQQYSK

SEQ ID NO: 1663445 - protein, 21 aa, Staphylococcus aureus
IPEASRLVLQAGALAEGGEVF

SEQ ID NO: 1663446 - protein, 18 aa, Staphylococcus aureus
IPEYQHLNIFTVGRLDKD

SEQ ID NO: 1663447 - protein, 20 aa, Staphylococcus aureus
IPFAFFKQHVTDFDIPGEGE

SEQ ID NO: 1663448 - protein, 25 aa, Staphylococcus aureus
IPGEGEYAVGLFFSKERVLGSEHEA

SEQ ID NO: 1663449 - protein, 17 aa, Staphylococcus aureus
IPGFDFYFVPTVLNSTD

SEQ ID NO: 1663450 - protein, 26 aa, Staphylococcus aureus
IPLLQARSKEILAFVYESKETAIKEY

SEQ ID NO: 1663451 - protein, 20 aa, Staphylococcus aureus
IPREDVATVLKEIVTSNHFN

SEQ ID NO: 1663452 - protein, 27 aa, Staphylococcus aureus
IPREPAEIIGGDGFDVWNNAAKVVTIS

SEQ ID NO: 1663453 - protein, 22 aa, Staphylococcus aureus
IQELLWFVFEHFDIKGEHKDVD

SEQ ID NO: 1663454 - protein, 24 aa, Staphylococcus aureus
IQKRFTLNILYPYIETIHITKDKN

SEQ ID NO: 1663455 - protein, 25 aa, Staphylococcus aureus
IQLSYRLLPEVSLDCIIEDVYASFD

SEQ ID NO: 1663456 - protein, 18 aa, Staphylococcus aureus
IQNGEAFTHAFRVNHNTY

SEQ ID NO: 1663457 - protein, 24 aa, Staphylococcus aureus
IQPETKVKPAAREKINQKANELRA

SEQ ID NO: 1663458 - protein, 20 aa, Staphylococcus aureus
IQQQISYWLERFDITENRKK

SEQ ID NO: 1663459 - protein, 24 aa, Staphylococcus aureus
IQTAIRIQIAIQIQTAIQNQTAIR

SEQ ID NO: 1663460 - protein, 24 aa, Staphylococcus aureus
IQVLPKLAELIGLNEAIVLQQIHY

SEQ ID NO: 1663461 - protein, 23 aa, Staphylococcus aureus
IQYIVGFASFYGRKFDVNSNCLI

SEQ ID NO: 1663462 - protein, 19 aa, Staphylococcus aureus
IREYCDFNNFVVVDVYADR

SEQ ID NO: 1663463 - protein, 20 aa, Staphylococcus aureus
IRFSKERNKGLVQIVNGRYA

SEQ ID NO: 1663464 - protein, 19 aa, Staphylococcus aureus
IRHMMSFDNAHFFAQLRHP

SEQ ID NO: 1663465 - protein, 17 aa, Staphylococcus aureus
IRKLLVFYNKNNYHQEA

SEQ ID NO: 1663466 - protein, 18 aa, Staphylococcus aureus
IRLNNRLSKVEMAKKLDV

SEQ ID NO: 1663467 - protein, 18 aa, Staphylococcus aureus
IRLNNRLSKVEMARKLDV

SEQ ID NO: 1663468 - protein, 18 aa, Staphylococcus aureus
IRLYIPLNERISADDYRK

SEQ ID NO: 1663469 - protein, 19 aa, Staphylococcus aureus
IRLYIPLNERISANDYRNY

SEQ ID NO: 1663470 - protein, 18 aa, Staphylococcus aureus
IRMYRSVQTFDFRGEQPF

SEQ ID NO: 1663471 - protein, 17 aa, Staphylococcus aureus
IRRGKILEFKSAIERII

SEQ ID NO: 1663472 - protein, 21 aa, Staphylococcus aureus
IRVLFNEGFIALRPSGTEPKI

SEQ ID NO: 1663473 - protein, 25 aa, Staphylococcus aureus
ISAMKYIVAKYGWGGFKRAGDYAYA

SEQ ID NO: 1663474 - protein, 22 aa, Staphylococcus aureus
ISFDKPIHVVVCEVKSKAKDLS

SEQ ID NO: 1663475 - protein, 17 aa, Staphylococcus aureus
ISKRTVLFLIQKDITVY

SEQ ID NO: 1663476 - protein, 32 aa, Staphylococcus aureus
ISMKLANIEFPWLRLVVLRAFIDNIKKYHDIN

SEQ ID NO: 1663477 - protein, 31 aa, Staphylococcus aureus
ISNKISSMIPVEWEKVYTMAYIDDGGGEVFF

SEQ ID NO: 1663478 - protein, 23 aa, Staphylococcus aureus
ISNSKHFIGLDVYLESIKNNRNI

SEQ ID NO: 1663479 - protein, 25 aa, Staphylococcus aureus
ISPFGKLRAGFDLFKKPTQMQNGDI

SEQ ID NO: 1663480 - protein, 20 aa, Staphylococcus aureus
ISQLNLLFVKDIKKIDVDVK

SEQ ID NO: 1663481 - protein, 27 aa, Staphylococcus aureus
ISRKEMQQEVPYPFFVIKMPESNRSKY

SEQ ID NO: 1663482 - protein, 17 aa, Staphylococcus aureus
ITIDFALEQNRNVYVLP

SEQ ID NO: 1663483 - protein, 25 aa, Staphylococcus aureus
ITLDMDGRIPINVWTGDSIARSGKG

SEQ ID NO: 1663484 - protein, 17 aa, Staphylococcus aureus
ITLSYAQQVFDEMDNKG

SEQ ID NO: 1663485 - protein, 19 aa, Staphylococcus aureus
ITVPYCQKVINKWNKKYSD

SEQ ID NO: 1663486 - protein, 17 aa, Staphylococcus aureus
ITWSGKYRPELRNMKIF

SEQ ID NO: 1663487 - protein, 17 aa, Staphylococcus aureus
IVARRAVYYQIHLKKAD

SEQ ID NO: 1663488 - protein, 23 aa, Staphylococcus aureus
IVDEAKALNRAMDQLSQEITGNE

SEQ ID NO: 1663489 - protein, 23 aa, Staphylococcus aureus
IVDYAGYPWPGYDDIVSEIIDSN

SEQ ID NO: 1663490 - protein, 19 aa, Staphylococcus aureus
IVESTRGKGHFVVPQTNAQ

SEQ ID NO: 1663491 - protein, 17 aa, Staphylococcus aureus
IVHHPHIQIPSDQIAQL

SEQ ID NO: 1663492 - protein, 18 aa, Staphylococcus aureus
IVHPREFFSIAVRENANA

SEQ ID NO: 1663493 - protein, 25 aa, Staphylococcus aureus
IVITCNYRLGALGYLDWSYFNKGFH

SEQ ID NO: 1663494 - protein, 19 aa, Staphylococcus aureus
IVRSLLGIAVPTQIATHDS

SEQ ID NO: 1663495 - protein, 18 aa, Staphylococcus aureus
IVSAWNPTEIDSMALPPC

SEQ ID NO: 1663496 - protein, 18 aa, Staphylococcus aureus
IVTPIYKKSSYRGPEIEI

SEQ ID NO: 1663497 - protein, 18 aa, Staphylococcus aureus
IWKAASRVIDAAVEKAYN

SEQ ID NO: 1663498 - protein, 17 aa, Staphylococcus aureus
IWKAIQLLDIPVEKIHL

SEQ ID NO: 1663499 - protein, 18 aa, Staphylococcus aureus
IYCDNRVTLGYPLVRGAI

SEQ ID NO: 1663500 - protein, 18 aa, Staphylococcus aureus
IYEHFNVNFIPPAMREDG

SEQ ID NO: 1663501 - protein, 23 aa, Staphylococcus aureus
IYFEKDGKLGFYVQKTQKERGVG

SEQ ID NO: 1663502 - protein, 19 aa, Staphylococcus aureus
IYGGVSYTIHVARPKGQRV

SEQ ID NO: 1663503 - protein, 17 aa, Staphylococcus aureus
IYGSPIIECNERMIRLS

SEQ ID NO: 1663504 - protein, 19 aa, Staphylococcus aureus
IYHELSTDYLDVRDVDAPS

SEQ ID NO: 1663505 - protein, 25 aa, Staphylococcus aureus
IYILKKYIFEVLFDLEEKFLKETKK

SEQ ID NO: 1663506 - protein, 18 aa, Staphylococcus aureus
IYINCPLFNEMPEILEAI

SEQ ID NO: 1663507 - protein, 25 aa, Staphylococcus aureus
IYKGKRKGMPFTQHMVRAHLNHLSK

SEQ ID NO: 1663508 - protein, 17 aa, Staphylococcus aureus
IYLDEAVGIMTGQVVYK

SEQ ID NO: 1663509 - protein, 18 aa, Staphylococcus aureus
IYNCKTPTISAVGHETDF

SEQ ID NO: 1663510 - protein, 18 aa, Staphylococcus aureus
IYRKHYKSRKEEALSKID

SEQ ID NO: 1663511 - protein, 23 aa, Staphylococcus aureus
IYSLEKQNLLLIGNYNKAKFDKT

SEQ ID NO: 1663512 - protein, 18 aa, Staphylococcus aureus
KAATCSIKKFNPETGEFE

SEQ ID NO: 1663513 - protein, 21 aa, Staphylococcus aureus
KADMLRLNKYGVDGVFTNFAD

SEQ ID NO: 1663514 - protein, 25 aa, Staphylococcus aureus
KADVKSKINAASNIAGVNTVKQQGT

SEQ ID NO: 1663515 - protein, 19 aa, Staphylococcus aureus
KAFLLRQIEDTFKSKQTEM

SEQ ID NO: 1663516 - protein, 19 aa, Staphylococcus aureus
KAILNLPIRTWFDKAESEI

SEQ ID NO: 1663517 - protein, 23 aa, Staphylococcus aureus
KAIMLPPGLAFVAYSHHAKERFK

SEQ ID NO: 1663518 - protein, 22 aa, Staphylococcus aureus
KAIQKYNIIKPFILGEQSLSSI

SEQ ID NO: 1663519 - protein, 17 aa, Staphylococcus aureus
KAISRMKLGQVDEITTA

SEQ ID NO: 1663520 - protein, 23 aa, Staphylococcus aureus
KAITLKAAFELGERMGRRADNNR

SEQ ID NO: 1663521 - protein, 22 aa, Staphylococcus aureus
KAITLKAAFELGERMGRRAENN

SEQ ID NO: 1663522 - protein, 19 aa, Staphylococcus aureus
KAKISRITIGYTRDRKPVT

SEQ ID NO: 1663523 - protein, 18 aa, Staphylococcus aureus
KAKKFISLSIQYTPEIGR

SEQ ID NO: 1663524 - protein, 35 aa, Staphylococcus aureus
KAKLFPLDYTHIFPGECIWFDVLKRGNPSIEKMVE

SEQ ID NO: 1663525 - protein, 23 aa, Staphylococcus aureus
KAKLNPAICFTMLGHYLGVDIET

SEQ ID NO: 1663526 - protein, 26 aa, Staphylococcus aureus
KAKMPSQLFQFFMSYLLARFDISLAT

SEQ ID NO: 1663527 - protein, 27 aa, Staphylococcus aureus
KAKQELRIGTWSILPFDIEHDANEPVA

SEQ ID NO: 1663528 - protein, 18 aa, Staphylococcus aureus
KANFIERNIYDHSLMVSS

SEQ ID NO: 1663529 - protein, 21 aa, Staphylococcus aureus
KAPTVKAVFNYYLQGYGYKKI

SEQ ID NO: 1663530 - protein, 24 aa, Staphylococcus aureus
KAYCYHLKLLYEFMEQRGVILNDI

SEQ ID NO: 1663531 - protein, 24 aa, Staphylococcus aureus
KCLQILKSILKPEGILCFQESDAI

SEQ ID NO: 1663532 - protein, 18 aa, Staphylococcus aureus
KCVELLHSVGYYNLKHFM

SEQ ID NO: 1663533 - protein, 19 aa, Staphylococcus aureus
KCVELLHSVGYYNLKHFMY

SEQ ID NO: 1663534 - protein, 17 aa, Staphylococcus aureus
KDEKVLWVTETTANRLH

SEQ ID NO: 1663535 - protein, 21 aa, Staphylococcus aureus
KDELREFIEMAKIPVIHSLPA

SEQ ID NO: 1663536 - protein, 18 aa, Staphylococcus aureus
KDFIANVSHELRTPISLL

SEQ ID NO: 1663537 - protein, 17 aa, Staphylococcus aureus
KDFLVVTHIIPWHENEF

SEQ ID NO: 1663538 - protein, 25 aa, Staphylococcus aureus
KDGVKLLWASCRELFNVIQADEIGA

SEQ ID NO: 1663539 - protein, 22 aa, Staphylococcus aureus
KDKAMLKIACIDINEYQDKLKI

SEQ ID NO: 1663540 - protein, 27 aa, Staphylococcus aureus
KDKGYEWNPQPIKSMKHSGSYMTEKMA

SEQ ID NO: 1663541 - protein, 24 aa, Staphylococcus aureus
KDNKFKIQCVILICYYYDNLQNYM

SEQ ID NO: 1663542 - protein, 30 aa, Staphylococcus aureus
KDTVYNVPFLWRLSSELNVAQLRQAVQHLI

SEQ ID NO: 1663543 - protein, 21 aa, Staphylococcus aureus
KDVDLKAGDKIIFDNKHTYRG

SEQ ID NO: 1663544 - protein, 23 aa, Staphylococcus aureus
KDVEIPKHLIIAFRLSKGKYQIL

SEQ ID NO: 1663545 - protein, 17 aa, Staphylococcus aureus
KDVKGRAAINDDNFTQF

SEQ ID NO: 1663546 - protein, 24 aa, Staphylococcus aureus
KDYEILKPKIVFNGSNPYLALNHI

SEQ ID NO: 1663547 - protein, 19 aa, Staphylococcus aureus
KDYKFLKQYGVSYTIICKM

SEQ ID NO: 1663548 - protein, 20 aa, Staphylococcus aureus
KEAYQPALAELAMPRPYVFV

SEQ ID NO: 1663549 - protein, 18 aa, Staphylococcus aureus
KEDIYLDEAVGIMTGQVV

SEQ ID NO: 1663550 - protein, 20 aa, Staphylococcus aureus
KEDIYLDEAVGIMTGQVVYK

SEQ ID NO: 1663551 - protein, 23 aa, Staphylococcus aureus
KEDIYLDEAVGIMTGQVVYKYEE

SEQ ID NO: 1663552 - protein, 29 aa, Staphylococcus aureus
KEEGLEPWTSCEFDFTREGTLNVSFDYID

SEQ ID NO: 1663553 - protein, 17 aa, Staphylococcus aureus
KEFAIPVKFTIKVVLTD

SEQ ID NO: 1663554 - protein, 18 aa, Staphylococcus aureus
KEFKEVFLTNKFSTSKFF

SEQ ID NO: 1663555 - protein, 25 aa, Staphylococcus aureus
KEGIELDEAVGIMAGQVIYKYEEEQ

SEQ ID NO: 1663556 - protein, 25 aa, Staphylococcus aureus
KEGIELDEAVGIMAGQVVYKYEEEQ

SEQ ID NO: 1663557 - protein, 22 aa, Staphylococcus aureus
KEGNLNGEWCINDVNAVSKIAA

SEQ ID NO: 1663558 - protein, 25 aa, Staphylococcus aureus
KEGVELDEAVGIMAGQVVYKYEEEQ

SEQ ID NO: 1663559 - protein, 18 aa, Staphylococcus aureus
KEILPYLYKGLRDKSPVV

SEQ ID NO: 1663560 - protein, 17 aa, Staphylococcus aureus
KEIRPYKNELVTICNPE

SEQ ID NO: 1663561 - protein, 19 aa, Staphylococcus aureus
KEITSLKMGNIEDRVEEIN

SEQ ID NO: 1663562 - protein, 25 aa, Staphylococcus aureus
KEKGEYFEEFIIFILTCSNIFECTK

SEQ ID NO: 1663563 - protein, 36 aa, Staphylococcus aureus
KEKYFEGCMPFEVMAERGRKTLLFGPMKPVGLEDPK

SEQ ID NO: 1663564 - protein, 31 aa, Staphylococcus aureus
KELEIPQELKLVPNWVLWRAEWNEKQQNYGK

SEQ ID NO: 1663565 - protein, 17 aa, Staphylococcus aureus
KELRKRYNIPTEKAPKL

SEQ ID NO: 1663566 - protein, 25 aa, Staphylococcus aureus
KELVDLFNKRYDIIIVDTPPVNTVT

SEQ ID NO: 1663567 - protein, 17 aa, Staphylococcus aureus
KENNKGLNYLITVLKNW

SEQ ID NO: 1663568 - protein, 25 aa, Staphylococcus aureus
KENPKSGKVQLVYNEHVELIEVPIK

SEQ ID NO: 1663569 - protein, 36 aa, Staphylococcus aureus
KEPLDDVIEMSRPVKMNSLLKLYFDRNILTPQKLLN

SEQ ID NO: 1663570 - protein, 24 aa, Staphylococcus aureus
KERVSWKLSVKELSTLSGVSQTYI

SEQ ID NO: 1663571 - protein, 22 aa, Staphylococcus aureus
KESFIEYLLFRYRFKSRIAVWV

SEQ ID NO: 1663572 - protein, 24 aa, Staphylococcus aureus
KETDILFILSLFRKINWKVYDEST

SEQ ID NO: 1663573 - protein, 18 aa, Staphylococcus aureus
KETFKNQSWVDVEDLPLI

SEQ ID NO: 1663574 - protein, 19 aa, Staphylococcus aureus
KEVLKDHLHRVTFVHSNFR

SEQ ID NO: 1663575 - protein, 17 aa, Staphylococcus aureus
KEVLNFIDDNTIVTILT

SEQ ID NO: 1663576 - protein, 17 aa, Staphylococcus aureus
KEVSFDNFVDFIRWMKT

SEQ ID NO: 1663577 - protein, 19 aa, Staphylococcus aureus
KEYCDFHHFEVKDIYADRG

SEQ ID NO: 1663578 - protein, 17 aa, Staphylococcus aureus
KEYPNIEIVAIEPEASP

SEQ ID NO: 1663579 - protein, 27 aa, Staphylococcus aureus
KFDHPNVICTYDLLFRSGLDLKVDFVI

SEQ ID NO: 1663580 - protein, 27 aa, Staphylococcus aureus
KFGPDFVPNIKLQWLAIDKDKVETTVS

SEQ ID NO: 1663581 - protein, 28 aa, Staphylococcus aureus
KFKHEVQCVVCLPAALLNENSDAIRLSC

SEQ ID NO: 1663582 - protein, 21 aa, Staphylococcus aureus
KFKSQNWYWFAYFDVPLKLPK

SEQ ID NO: 1663583 - protein, 26 aa, Staphylococcus aureus
KFSPDFVPNVKLQWLAIDKDKVETTV

SEQ ID NO: 1663584 - protein, 19 aa, Staphylococcus aureus
KFYGCLFATVDGFNVKAFI

SEQ ID NO: 1663585 - protein, 23 aa, Staphylococcus aureus
KGDFPEKQLRIYSDNKTLSTEHL

SEQ ID NO: 1663586 - protein, 20 aa, Staphylococcus aureus
KGEDIVECITNFADDQDLTF

SEQ ID NO: 1663587 - protein, 25 aa, Staphylococcus aureus
KGEIEGIAYDRLWIHLIPVIKEQQL

SEQ ID NO: 1663588 - protein, 17 aa, Staphylococcus aureus
KGFKGKKFYKVSATINK

SEQ ID NO: 1663589 - protein, 37 aa, Staphylococcus aureus
KGFLTYKIPKKVIKHAGYVRCKLFLEKEEQKIHVANF

SEQ ID NO: 1663590 - protein, 18 aa, Staphylococcus aureus
KGIMPNWEPGKKVHLVGH

SEQ ID NO: 1663591 - protein, 18 aa, Staphylococcus aureus
KGKLILIIHHDLSKAKQY

SEQ ID NO: 1663592 - protein, 24 aa, Staphylococcus aureus
KGLMRHLVVRTGYHTDEMMVIFVT

SEQ ID NO: 1663593 - protein, 19 aa, Staphylococcus aureus
KGNELYNYKSFNWQVFQQV

SEQ ID NO: 1663594 - protein, 25 aa, Staphylococcus aureus
KGNIIKATHVQYLFKQNNNIPNDVL

SEQ ID NO: 1663595 - protein, 28 aa, Staphylococcus aureus
KGNLYTAGQCTWYAYGMRQKMGKPVSTY

SEQ ID NO: 1663596 - protein, 22 aa, Staphylococcus aureus
KGPEVPRGLPVIPEAYTPKLKR

SEQ ID NO: 1663597 - protein, 19 aa, Staphylococcus aureus
KGSSVGYKEIEFIFIENKK

SEQ ID NO: 1663598 - protein, 22 aa, Staphylococcus aureus
KHGLTCAYSTFRAYILKHDEFN

SEQ ID NO: 1663599 - protein, 23 aa, Staphylococcus aureus
KHHTLRYYVCPQNMNASRFVCEF

SEQ ID NO: 1663600 - protein, 19 aa, Staphylococcus aureus
KHIPDSFVIAGNVGTPEGV

SEQ ID NO: 1663601 - protein, 19 aa, Staphylococcus aureus
KHLIERGIDGLIIAQYISS

SEQ ID NO: 1663602 - protein, 17 aa, Staphylococcus aureus
KHLKIYDGMQEQLKTLH

SEQ ID NO: 1663603 - protein, 17 aa, Staphylococcus aureus
KHLTFILDEGLIYLLRI

SEQ ID NO: 1663604 - protein, 17 aa, Staphylococcus aureus
KHNTALKAQFGIAPDEK

SEQ ID NO: 1663605 - protein, 17 aa, Staphylococcus aureus
KHPTHFFSSSPIFYSNN

SEQ ID NO: 1663606 - protein, 18 aa, Staphylococcus aureus
KHSGKVHAQAFFTQNGSN

SEQ ID NO: 1663607 - protein, 33 aa, Staphylococcus aureus
KIAKDRNKVTWGYAKSILNTWLNANLKSIEQVR

SEQ ID NO: 1663608 - protein, 18 aa, Staphylococcus aureus
KIGKSEINSFVAELGSTY

SEQ ID NO: 1663609 - protein, 26 aa, Staphylococcus aureus
KIISDICWKHKIPHIISGGYNGHQGM

SEQ ID NO: 1663610 - protein, 19 aa, Staphylococcus aureus
KIKHPYLKKTFIEIVETLK

SEQ ID NO: 1663611 - protein, 24 aa, Staphylococcus aureus
KIKKTPVVSLEYDFEHKQRIDNEN

SEQ ID NO: 1663612 - protein, 24 aa, Staphylococcus aureus
KIKVHYAGICGTDIHTYEGHYKVN

SEQ ID NO: 1663613 - protein, 20 aa, Staphylococcus aureus
KIMTEHLNIFVGLTDEAQNA

SEQ ID NO: 1663614 - protein, 18 aa, Staphylococcus aureus
KIRNDIMETFALNHHQVE

SEQ ID NO: 1663615 - protein, 23 aa, Staphylococcus aureus
KITDGRHAIYWVNDRYVVLDHKK

SEQ ID NO: 1663616 - protein, 21 aa, Staphylococcus aureus
KITHAHAYGGPIAAMDSVEAT

SEQ ID NO: 1663617 - protein, 21 aa, Staphylococcus aureus
KIVLLCGSGIGTSQLLKSKLN

SEQ ID NO: 1663618 - protein, 19 aa, Staphylococcus aureus
KKAFDIAKQILKLDPNNNV

SEQ ID NO: 1663619 - protein, 25 aa, Staphylococcus aureus
KKAKLNPAICFTMLGHYLGVDIETI

SEQ ID NO: 1663620 - protein, 19 aa, Staphylococcus aureus
KKALFIVYANPLALGLLTA

SEQ ID NO: 1663621 - protein, 20 aa, Staphylococcus aureus
KKATARNEITTILNNKLQAI

SEQ ID NO: 1663622 - protein, 17 aa, Staphylococcus aureus
KKDEISNTFSFSDTNNN

SEQ ID NO: 1663623 - protein, 26 aa, Staphylococcus aureus
KKDILPLRIILGAVNLYGILSTNHLL

SEQ ID NO: 1663624 - protein, 17 aa, Staphylococcus aureus
KKDMDWIKKNYDLYSKL

SEQ ID NO: 1663625 - protein, 18 aa, Staphylococcus aureus
KKDRVVVEGVNIMKNTKN

SEQ ID NO: 1663626 - protein, 26 aa, Staphylococcus aureus
KKEGLEPWTSCEFDFTRDGKLNVSFD

SEQ ID NO: 1663627 - protein, 24 aa, Staphylococcus aureus
KKENIYWIKGEYVWVTPTDINNSK

SEQ ID NO: 1663628 - protein, 19 aa, Staphylococcus aureus
KKETVDFYLAKGVVDRVSE

SEQ ID NO: 1663629 - protein, 30 aa, Staphylococcus aureus
KKFFRPEFLNRFNGIVEFLHLDKDALQDIV

SEQ ID NO: 1663630 - protein, 17 aa, Staphylococcus aureus
KKFGAFVELPEGKSGLV

SEQ ID NO: 1663631 - protein, 20 aa, Staphylococcus aureus
KKFHYRIFQYYRIIKRKLKE

SEQ ID NO: 1663632 - protein, 20 aa, Staphylococcus aureus
KKGFKVKTVDYLPGDEAGIK

SEQ ID NO: 1663633 - protein, 21 aa, Staphylococcus aureus
KKGKEDEARAGASAVPGANIN

SEQ ID NO: 1663634 - protein, 23 aa, Staphylococcus aureus
KKHKRIRLVESFLPQSNNDHVYE

SEQ ID NO: 1663635 - protein, 17 aa, Staphylococcus aureus
KKIELLNNIKFLKGADV

SEQ ID NO: 1663636 - protein, 20 aa, Staphylococcus aureus
KKIEPVFIKGADLEGQDLQQ

SEQ ID NO: 1663637 - protein, 21 aa, Staphylococcus aureus
KKIKHPYLKKTFIEIVETLKN

SEQ ID NO: 1663638 - protein, 17 aa, Staphylococcus aureus
KKIKLGSFLTIINVLSH

SEQ ID NO: 1663639 - protein, 17 aa, Staphylococcus aureus
KKIYARSITNGRLEQQW

SEQ ID NO: 1663640 - protein, 25 aa, Staphylococcus aureus
KKKEYEKFGRWFFNKFKVNRSADAK

SEQ ID NO: 1663641 - protein, 19 aa, Staphylococcus aureus
KKKGVGVATALLINEGIKV

SEQ ID NO: 1663642 - protein, 17 aa, Staphylococcus aureus
KKKGVGVVTALLINEGI

SEQ ID NO: 1663643 - protein, 19 aa, Staphylococcus aureus
KKKKIDSIIEELNNKLDDF

SEQ ID NO: 1663644 - protein, 20 aa, Staphylococcus aureus
KKKLLHFIEEEFKKKVPTRV

SEQ ID NO: 1663645 - protein, 32 aa, Staphylococcus aureus
KKLASAVPEHIDKVCVMVNPDLTTIEHVLSNT

SEQ ID NO: 1663646 - protein, 19 aa, Staphylococcus aureus
KKLLHKESEKMLTEEMQFF

SEQ ID NO: 1663647 - protein, 20 aa, Staphylococcus aureus
KKPHFSRIAQIASYVNPNYA

SEQ ID NO: 1663648 - protein, 23 aa, Staphylococcus aureus
KKSGKSFDCKLILTKENKLQFSF

SEQ ID NO: 1663649 - protein, 22 aa, Staphylococcus aureus
KKSPFDFCGLVLDYNEDTKIAT

SEQ ID NO: 1663650 - protein, 32 aa, Staphylococcus aureus
KKTEYLTSFIYSYKISLERAYYMVENYIDENC

SEQ ID NO: 1663651 - protein, 20 aa, Staphylococcus aureus
KKVANAFGLNEEDTNLLINA

SEQ ID NO: 1663652 - protein, 17 aa, Staphylococcus aureus
KKVKQNLVGFMRSTEVT

SEQ ID NO: 1663653 - protein, 17 aa, Staphylococcus aureus
KKYPDSEIHPIGHSLGA

SEQ ID NO: 1663654 - protein, 24 aa, Staphylococcus aureus
KLALELYNSPWIAWYHQQMQDKKA

SEQ ID NO: 1663655 - protein, 25 aa, Staphylococcus aureus
KLALELYNSPWIAWYYQQMQDKKAK

SEQ ID NO: 1663656 - protein, 17 aa, Staphylococcus aureus
KLDEWRKRKGYTQSSFA

SEQ ID NO: 1663657 - protein, 24 aa, Staphylococcus aureus
KLEKRGRNYIGLCPFHDEKTPSFT

SEQ ID NO: 1663658 - protein, 25 aa, Staphylococcus aureus
KLIDRSVRIIQEICAITYDEAMVLY

SEQ ID NO: 1663659 - protein, 24 aa, Staphylococcus aureus
KLKKYFYRFSLKARKRVKTVSIDM

SEQ ID NO: 1663660 - protein, 18 aa, Staphylococcus aureus
KLNGRDGYKKVNRLFIDC

SEQ ID NO: 1663661 - protein, 19 aa, Staphylococcus aureus
KLNGRDGYKKVNRLFIDCK

SEQ ID NO: 1663662 - protein, 25 aa, Staphylococcus aureus
KLRDENHIIYLFLGQFFTKNEDPWH

SEQ ID NO: 1663663 - protein, 21 aa, Staphylococcus aureus
KMAISDRFKLLQSQYTDEKYK

SEQ ID NO: 1663664 - protein, 17 aa, Staphylococcus aureus
KMPSMKITLSFSEYNTM

SEQ ID NO: 1663665 - protein, 20 aa, Staphylococcus aureus
KMRGNIFFEEGIEHIEMTKK

SEQ ID NO: 1663666 - protein, 23 aa, Staphylococcus aureus
KMTLLELVEWAWNNPEQVESKVF

SEQ ID NO: 1663667 - protein, 18 aa, Staphylococcus aureus
KNELFGRYEFYRFRLSEL

SEQ ID NO: 1663668 - protein, 19 aa, Staphylococcus aureus
KNEVVDFYFNHGSDFNNFK

SEQ ID NO: 1663669 - protein, 21 aa, Staphylococcus aureus
KNGFDKITIIKGNLVNDYGLN

SEQ ID NO: 1663670 - protein, 21 aa, Staphylococcus aureus
KNGKLDCVMVYKTNRLARNTS

SEQ ID NO: 1663671 - protein, 17 aa, Staphylococcus aureus
KNHIISIARLVENKQIT

SEQ ID NO: 1663672 - protein, 20 aa, Staphylococcus aureus
KNKAEELANSIINNINKATS

SEQ ID NO: 1663673 - protein, 20 aa, Staphylococcus aureus
KNKIISFNGFEFKVSVMKRH

SEQ ID NO: 1663674 - protein, 17 aa, Staphylococcus aureus
KNLDDFYDKEGFRDQEF

SEQ ID NO: 1663675 - protein, 32 aa, Staphylococcus aureus
KNLNLEFKYLFLKLIVKEDWSLSNLFNTGAVK

SEQ ID NO: 1663676 - protein, 18 aa, Staphylococcus aureus
KNLPRFIDVLATVLKEME

SEQ ID NO: 1663677 - protein, 17 aa, Staphylococcus aureus
KNLRFEKRIAYQKYEAI

SEQ ID NO: 1663678 - protein, 27 aa, Staphylococcus aureus
KNLTSVILRNRYEAFYRPSDGNLVVYA

SEQ ID NO: 1663679 - protein, 20 aa, Staphylococcus aureus
KNLYELYSYFMDEIENYSND

SEQ ID NO: 1663680 - protein, 20 aa, Staphylococcus aureus
KNNDIEAYFLPQGIITTHYR

SEQ ID NO: 1663681 - protein, 26 aa, Staphylococcus aureus
KNVDVFKALRFLRPRTAGRHYIIITL

SEQ ID NO: 1663682 - protein, 22 aa, Staphylococcus aureus
KNYPGWKLVEGRSRRMITDTNA

SEQ ID NO: 1663683 - protein, 21 aa, Staphylococcus aureus
KPGLNRFAFTLSNADSAYETD

SEQ ID NO: 1663684 - protein, 20 aa, Staphylococcus aureus
KPGQEIEFFGPEIETFTQVV

SEQ ID NO: 1663685 - protein, 18 aa, Staphylococcus aureus
KPRNEIIREYDLTPSALG

SEQ ID NO: 1663686 - protein, 20 aa, Staphylococcus aureus
KPSADMLFEPSFVKDIDVNE

SEQ ID NO: 1663687 - protein, 18 aa, Staphylococcus aureus
KPSEVLRHIEEIANELNI

SEQ ID NO: 1663688 - protein, 18 aa, Staphylococcus aureus
KQEMRNSTVTMVSNAKNN

SEQ ID NO: 1663689 - protein, 28 aa, Staphylococcus aureus
KQFIKSYVQSHSFIKSLVLGISGGQDST

SEQ ID NO: 1663690 - protein, 17 aa, Staphylococcus aureus
KQFKAFTKAFSLEHLIN

SEQ ID NO: 1663691 - protein, 26 aa, Staphylococcus aureus
KQILLSRENFEMVNLFLDNIFYFQQN

SEQ ID NO: 1663692 - protein, 17 aa, Staphylococcus aureus
KQIREKFALKPFDKHQF

SEQ ID NO: 1663693 - protein, 24 aa, Staphylococcus aureus
KQKIKCPYCDSTLTNMTIRKKHHT

SEQ ID NO: 1663694 - protein, 19 aa, Staphylococcus aureus
KQMKSLLNSRTLNYSKNQI

SEQ ID NO: 1663695 - protein, 17 aa, Staphylococcus aureus
KQQWIPVYKSWRLNERH

SEQ ID NO: 1663696 - protein, 19 aa, Staphylococcus aureus
KQSIKIVNCEDFIEFYNPG

SEQ ID NO: 1663697 - protein, 18 aa, Staphylococcus aureus
KQVFNYFSTPSFVTNIYE

SEQ ID NO: 1663698 - protein, 18 aa, Staphylococcus aureus
KQVFNYFTTPSFVTNIYE

SEQ ID NO: 1663699 - protein, 36 aa, Staphylococcus aureus
KRAPYIFRKLNIEWIYRALMDWKRIGRLKSIPIFMY

SEQ ID NO: 1663700 - protein, 21 aa, Staphylococcus aureus
KRAQSFGMKILAFDPYLTYEK

SEQ ID NO: 1663701 - protein, 25 aa, Staphylococcus aureus
KRDRKKHVYDLLETVGLSKEHANRY

SEQ ID NO: 1663702 - protein, 20 aa, Staphylococcus aureus
KRFNQLTGMTEDEIRVLFNE

SEQ ID NO: 1663703 - protein, 23 aa, Staphylococcus aureus
KRFNSVSEFKNATLLSEASTIYE

SEQ ID NO: 1663704 - protein, 19 aa, Staphylococcus aureus
KRGYPIGQILIPSRDEGHM

SEQ ID NO: 1663705 - protein, 17 aa, Staphylococcus aureus
KRHMAFTITEFERDAWL

SEQ ID NO: 1663706 - protein, 27 aa, Staphylococcus aureus
KRIADVGCGYGPIGLMIAKVSPHHSIT

SEQ ID NO: 1663707 - protein, 24 aa, Staphylococcus aureus
KRIGRLKSIPIFMYKIAKAKRKIK

SEQ ID NO: 1663708 - protein, 19 aa, Staphylococcus aureus
KRLGINATIRREQGSDIDA

SEQ ID NO: 1663709 - protein, 22 aa, Staphylococcus aureus
KRLGKKATEIVIEFKKNNNTLR

SEQ ID NO: 1663710 - protein, 26 aa, Staphylococcus aureus
KRNKVCALEVFVECFGKDKGDSRGSM

SEQ ID NO: 1663711 - protein, 19 aa, Staphylococcus aureus
KRPGKELENLVPDHLSGLL

SEQ ID NO: 1663712 - protein, 18 aa, Staphylococcus aureus
KRRLRPWLYDGTPQKHSR

SEQ ID NO: 1663713 - protein, 17 aa, Staphylococcus aureus
KRRLSALGPGGLTRERA

SEQ ID NO: 1663714 - protein, 19 aa, Staphylococcus aureus
KRSLQWGNDAYTMILDRMN

SEQ ID NO: 1663715 - protein, 20 aa, Staphylococcus aureus
KRSNSGTCYNQRPIVAAGDV

SEQ ID NO: 1663716 - protein, 21 aa, Staphylococcus aureus
KRTLHYYDEIGLLVPNKNDKN

SEQ ID NO: 1663717 - protein, 26 aa, Staphylococcus aureus
KRTVNVAKWFVGDYMTSLDMQGFSIT

SEQ ID NO: 1663718 - protein, 21 aa, Staphylococcus aureus
KRVDDETYYAFVDKFVSAVRK

SEQ ID NO: 1663719 - protein, 20 aa, Staphylococcus aureus
KSAGFELGIATGRPYTETVV

SEQ ID NO: 1663720 - protein, 17 aa, Staphylococcus aureus
KSAMDSGTFIDNEKQKY

SEQ ID NO: 1663721 - protein, 26 aa, Staphylococcus aureus
KSDNKFSVITVVNWAIYQSMEENSNS

SEQ ID NO: 1663722 - protein, 21 aa, Staphylococcus aureus
KSGHYDFFDEALFEDTIGELK

SEQ ID NO: 1663723 - protein, 20 aa, Staphylococcus aureus
KSGKMPWPMYHNERRYYRTY

SEQ ID NO: 1663724 - protein, 22 aa, Staphylococcus aureus
KSHAFLLPLMQLFDSEIKEPQA

SEQ ID NO: 1663725 - protein, 20 aa, Staphylococcus aureus
KSHLAYAIAKAVKAKGHTVA

SEQ ID NO: 1663726 - protein, 23 aa, Staphylococcus aureus
KSIPKFPKKIAVLTASTGAAIRD

SEQ ID NO: 1663727 - protein, 19 aa, Staphylococcus aureus
KSITCKSIVGLNPERLRVT

SEQ ID NO: 1663728 - protein, 19 aa, Staphylococcus aureus
KSKELKRSLTAKFKSNENV

SEQ ID NO: 1663729 - protein, 20 aa, Staphylococcus aureus
KSKFNQIFIFTHSWNDFCDI

SEQ ID NO: 1663730 - protein, 17 aa, Staphylococcus aureus
KSKNEKSYVFFNIAVPR

SEQ ID NO: 1663731 - protein, 19 aa, Staphylococcus aureus
KSLIIKKEVLKQINKLNIN

SEQ ID NO: 1663732 - protein, 20 aa, Staphylococcus aureus
KSMSESKCYKNRQVFPQDTN

SEQ ID NO: 1663733 - protein, 17 aa, Staphylococcus aureus
KSQDDLKDDLKEKQQSS

SEQ ID NO: 1663734 - protein, 25 aa, Staphylococcus aureus
KSQMAEKDFRVILVGGDCPKIKAKP

SEQ ID NO: 1663735 - protein, 25 aa, Staphylococcus aureus
KSRLTGRLSGNIGYVASKVAQEVKP

SEQ ID NO: 1663736 - protein, 20 aa, Staphylococcus aureus
KSTRNKLGFDELSKRKDYQI

SEQ ID NO: 1663737 - protein, 20 aa, Staphylococcus aureus
KSTRNKLGFDELSKRKGYQI

SEQ ID NO: 1663738 - protein, 25 aa, Staphylococcus aureus
KSTSKGGVHPIGIATFIMTVNKPGL

SEQ ID NO: 1663739 - protein, 23 aa, Staphylococcus aureus
KSVKKLYFLEGIDAIEKIENNYE

SEQ ID NO: 1663740 - protein, 21 aa, Staphylococcus aureus
KTFTRKAICFNSHDEAVEAID

SEQ ID NO: 1663741 - protein, 17 aa, Staphylococcus aureus
KTIGWLVVQRGFEIPSF

SEQ ID NO: 1663742 - protein, 23 aa, Staphylococcus aureus
KTIKDLIVVFLLNKYNYIKNKDD

SEQ ID NO: 1663743 - protein, 17 aa, Staphylococcus aureus
KTRGAQVEEVWVNGHEI

SEQ ID NO: 1663744 - protein, 33 aa, Staphylococcus aureus
KTSDLISRYAGIRVPRNKAIVGQNAFSHESGIH

SEQ ID NO: 1663745 - protein, 19 aa, Staphylococcus aureus
KTVKINLPEHVSKAEPSET

SEQ ID NO: 1663746 - protein, 18 aa, Staphylococcus aureus
KTYKEFLDTTAKFHNYSI

SEQ ID NO: 1663747 - protein, 18 aa, Staphylococcus aureus
KVAYTGLIIRNNEAAVQV

SEQ ID NO: 1663748 - protein, 17 aa, Staphylococcus aureus
KVFPELAAKGGNAKQIM

SEQ ID NO: 1663749 - protein, 21 aa, Staphylococcus aureus
KVGEQFFKDNFGLKVKATNVV

SEQ ID NO: 1663750 - protein, 22 aa, Staphylococcus aureus
KVIKGKTKFANAVVKVDSELGE

SEQ ID NO: 1663751 - protein, 20 aa, Staphylococcus aureus
KVKYSIKLLLKVLNIPKSTY

SEQ ID NO: 1663752 - protein, 20 aa, Staphylococcus aureus
KVLDERRLSEILSDNQIQMI

SEQ ID NO: 1663753 - protein, 20 aa, Staphylococcus aureus
KVLEVCRDFYQNQRIYTKIK

SEQ ID NO: 1663754 - protein, 17 aa, Staphylococcus aureus
KVLPIIDILSLFILHSK

SEQ ID NO: 1663755 - protein, 23 aa, Staphylococcus aureus
KVNTDYFCFGKDIIAPAHGTVEK

SEQ ID NO: 1663756 - protein, 22 aa, Staphylococcus aureus
KVNTDYFCFGKDIIAPANGTVE

SEQ ID NO: 1663757 - protein, 19 aa, Staphylococcus aureus
KVNYHLSGYGIHYNEALAS

SEQ ID NO: 1663758 - protein, 27 aa, Staphylococcus aureus
KVPKLPYTLCYISRGFVVDYSNKEALN

SEQ ID NO: 1663759 - protein, 18 aa, Staphylococcus aureus
KVQGNAIAKAEAEQLKQN

SEQ ID NO: 1663760 - protein, 17 aa, Staphylococcus aureus
KVQPCCFKLYNDPFDMV

SEQ ID NO: 1663761 - protein, 17 aa, Staphylococcus aureus
KVSGGLSSVAVRMPSHS

SEQ ID NO: 1663762 - protein, 27 aa, Staphylococcus aureus
KVYILSSFPGIFIRRPLRDNNGIFENI

SEQ ID NO: 1663763 - protein, 27 aa, Staphylococcus aureus
KWYQIEYLKEMVTFVVVNRDKNSQNIE

SEQ ID NO: 1663764 - protein, 18 aa, Staphylococcus aureus
KWYSINYQTIEGMIRPSY

SEQ ID NO: 1663765 - protein, 18 aa, Staphylococcus aureus
KYGEKYYAIIGVQNNDQQ

SEQ ID NO: 1663766 - protein, 20 aa, Staphylococcus aureus
KYLLQNGKWGYFNREFFDLL

SEQ ID NO: 1663767 - protein, 21 aa, Staphylococcus aureus
KYNNNIWNEWAFENYVQSDDY

SEQ ID NO: 1663768 - protein, 18 aa, Staphylococcus aureus
KYQESFGYMAQQLCFPEK

SEQ ID NO: 1663769 - protein, 22 aa, Staphylococcus aureus
KYQWAPKYSKEFFILFMNIMYS

SEQ ID NO: 1663770 - protein, 19 aa, Staphylococcus aureus
KYTPGLPFKIVGTKNGSLL

SEQ ID NO: 1663771 - protein, 19 aa, Staphylococcus aureus
KYTSEHPEFVTVDERTGAI

SEQ ID NO: 1663772 - protein, 19 aa, Staphylococcus aureus
KYYNFYGVGALDKDPIKTG

SEQ ID NO: 1663773 - protein, 25 aa, Staphylococcus aureus
LAAPAEIKFLLYFAKMTKKDKNKLY

SEQ ID NO: 1663774 - protein, 18 aa, Staphylococcus aureus
LADLELSLAKILSEMEEI

SEQ ID NO: 1663775 - protein, 26 aa, Staphylococcus aureus
LADQAICIGEAYALDSYLNIDRIISA

SEQ ID NO: 1663776 - protein, 18 aa, Staphylococcus aureus
LAGALSVSALENYKDHIK

SEQ ID NO: 1663777 - protein, 20 aa, Staphylococcus aureus
LAKGRPLFEAVHKAKKFISL

SEQ ID NO: 1663778 - protein, 17 aa, Staphylococcus aureus
LAKRTVNVAKWFVGDYM

SEQ ID NO: 1663779 - protein, 17 aa, Staphylococcus aureus
LAKWFAENDYFYIMHRF

SEQ ID NO: 1663780 - protein, 24 aa, Staphylococcus aureus
LASTDFSYPLLMNVDDRGSFTEFI

SEQ ID NO: 1663781 - protein, 21 aa, Staphylococcus aureus
LCKKIRLKYNINIISISYEDL

SEQ ID NO: 1663782 - protein, 25 aa, Staphylococcus aureus
LCNMRCSHCAVGYTLQTVDPEPLDM

SEQ ID NO: 1663783 - protein, 19 aa, Staphylococcus aureus
LDAEKGIVMDGRDIGTVVL

SEQ ID NO: 1663784 - protein, 18 aa, Staphylococcus aureus
LDAGSWFNKKYPKYARAS

SEQ ID NO: 1663785 - protein, 17 aa, Staphylococcus aureus
LDDCVNLTIGQPDFPLP

SEQ ID NO: 1663786 - protein, 21 aa, Staphylococcus aureus
LDDDALCFYDIGSSEMNLDMA

SEQ ID NO: 1663787 - protein, 22 aa, Staphylococcus aureus
LDDEVFHLSALQDMNRIPIDIA

SEQ ID NO: 1663788 - protein, 21 aa, Staphylococcus aureus
LDDLCNAYRGNTVIKNTRQHA

SEQ ID NO: 1663789 - protein, 27 aa, Staphylococcus aureus
LDDNVCSCCGQKLPVEQVDMAREKALQ

SEQ ID NO: 1663790 - protein, 18 aa, Staphylococcus aureus
LDEAIGIMTSQVVYKYEE

SEQ ID NO: 1663791 - protein, 19 aa, Staphylococcus aureus
LDEAVGIMTGQVVYKYEEA

SEQ ID NO: 1663792 - protein, 17 aa, Staphylococcus aureus
LDEYKGDVMLIVNTASE

SEQ ID NO: 1663793 - protein, 26 aa, Staphylococcus aureus
LDKAQLAQYCSFYSDFVKASLILEQE

SEQ ID NO: 1663794 - protein, 19 aa, Staphylococcus aureus
LDKEFDFILIEGAGGIGVP

SEQ ID NO: 1663795 - protein, 25 aa, Staphylococcus aureus
LDKLPEIANVFGVKPLDLIHDMDDS

SEQ ID NO: 1663796 - protein, 19 aa, Staphylococcus aureus
LDKVVYAICEWGDLFKDEI

SEQ ID NO: 1663797 - protein, 25 aa, Staphylococcus aureus
LDLPFPIKINQMLGYQTSFLTYEGL

SEQ ID NO: 1663798 - protein, 26 aa, Staphylococcus aureus
LDLPFPIKINQMLGYQTSFLTYEGLV

SEQ ID NO: 1663799 - protein, 18 aa, Staphylococcus aureus
LDNAMGAVQQYIDEQHLG

SEQ ID NO: 1663800 - protein, 17 aa, Staphylococcus aureus
LDPHKLASCIDVANIDT

SEQ ID NO: 1663801 - protein, 18 aa, Staphylococcus aureus
LDSMIFNFNEIFRERMPK

SEQ ID NO: 1663802 - protein, 17 aa, Staphylococcus aureus
LDSSITIADHVVSPTLI

SEQ ID NO: 1663803 - protein, 25 aa, Staphylococcus aureus
LDTEILWKMHFGLYPTPIKRLQNYL

SEQ ID NO: 1663804 - protein, 17 aa, Staphylococcus aureus
LDYTLSVTILKDLNDNL

SEQ ID NO: 1663805 - protein, 23 aa, Staphylococcus aureus
LEAVAYNTSMEYIHNCVDGKKEL

SEQ ID NO: 1663806 - protein, 17 aa, Staphylococcus aureus
LEFYSTQCDLELYFTSL

SEQ ID NO: 1663807 - protein, 23 aa, Staphylococcus aureus
LEGAKRPGHFDGVVTVVNKLFNI

SEQ ID NO: 1663808 - protein, 22 aa, Staphylococcus aureus
LEIIKKVGYVYNIDFDKPKLEM

SEQ ID NO: 1663809 - protein, 18 aa, Staphylococcus aureus
LEIIKKVRYVYNIDFDKP

SEQ ID NO: 1663810 - protein, 18 aa, Staphylococcus aureus
LEISKKGLQLEGLNFDRQ

SEQ ID NO: 1663811 - protein, 23 aa, Staphylococcus aureus
LEKFQKILILKSFDFDIAKIKQY

SEQ ID NO: 1663812 - protein, 23 aa, Staphylococcus aureus
LEKHNIYYGQWLILRDIAKYQPT

SEQ ID NO: 1663813 - protein, 20 aa, Staphylococcus aureus
LEKIRKALYMSKICSYAQGF

SEQ ID NO: 1663814 - protein, 23 aa, Staphylococcus aureus
LELEHVNLIMGFVRVFGKGDKER

SEQ ID NO: 1663815 - protein, 18 aa, Staphylococcus aureus
LENFVKYIKENAGPSWKY

SEQ ID NO: 1663816 - protein, 22 aa, Staphylococcus aureus
LENLDICIFVESLGGTETLVTF

SEQ ID NO: 1663817 - protein, 19 aa, Staphylococcus aureus
LEQCIYRSLLECVTVLEYT

SEQ ID NO: 1663818 - protein, 24 aa, Staphylococcus aureus
LEQVKRVFLESCIHERRFFNMAMT

SEQ ID NO: 1663819 - protein, 17 aa, Staphylococcus aureus
LESIKGYQDFHFEMYEH

SEQ ID NO: 1663820 - protein, 17 aa, Staphylococcus aureus
LESKSGGKSGDFQRQSD

SEQ ID NO: 1663821 - protein, 21 aa, Staphylococcus aureus
LESLTALTIAQSFNQLIEDEI

SEQ ID NO: 1663822 - protein, 30 aa, Staphylococcus aureus
LETIFNLLIGFKTHIEYKMGSESPFYEINN

SEQ ID NO: 1663823 - protein, 26 aa, Staphylococcus aureus
LETNCVFLHCDYILKVPINKLVSYYA

SEQ ID NO: 1663824 - protein, 17 aa, Staphylococcus aureus
LFCRIFKYKFGMNNKMV

SEQ ID NO: 1663825 - protein, 25 aa, Staphylococcus aureus
LFIGYKFKTHRMIHKFKINSQGLTS

SEQ ID NO: 1663826 - protein, 17 aa, Staphylococcus aureus
LFLGSGIGVTPLVAMYE

SEQ ID NO: 1663827 - protein, 34 aa, Staphylococcus aureus
LFMNLRDLFKKEGLEPWTSCEFDFTSEGKLKVSF

SEQ ID NO: 1663828 - protein, 18 aa, Staphylococcus aureus
LFPCGSITGAPKLNTMKY

SEQ ID NO: 1663829 - protein, 18 aa, Staphylococcus aureus
LGIGKFIILSIGDLIEIE

SEQ ID NO: 1663830 - protein, 17 aa, Staphylococcus aureus
LGKNDQFGIKDHVGVIL

SEQ ID NO: 1663831 - protein, 24 aa, Staphylococcus aureus
LGKSPAQVVLRWNVQHGVVTIPKS

SEQ ID NO: 1663832 - protein, 17 aa, Staphylococcus aureus
LGLDWRTSIKQAQQLGV

SEQ ID NO: 1663833 - protein, 26 aa, Staphylococcus aureus
LGPTAIRYAGLIPRLKQLDLDVNDKG

SEQ ID NO: 1663834 - protein, 18 aa, Staphylococcus aureus
LHKQVKIVNLYEELKTLY

SEQ ID NO: 1663835 - protein, 17 aa, Staphylococcus aureus
LHNRFIEKYGFEQLVNV

SEQ ID NO: 1663836 - protein, 20 aa, Staphylococcus aureus
LHRIKCNTGFGYKDTTKTTG

SEQ ID NO: 1663837 - protein, 26 aa, Staphylococcus aureus
LIEFEETSALPGRKTGSLVGLSQIDS

SEQ ID NO: 1663838 - protein, 26 aa, Staphylococcus aureus
LIELKGGIPDVCFVRDLEGICLSRTI

SEQ ID NO: 1663839 - protein, 21 aa, Staphylococcus aureus
LIKSIDRNGALKGIGKPEKLK

SEQ ID NO: 1663840 - protein, 22 aa, Staphylococcus aureus
LIPNSKCKLISATGHTIHVEDS

SEQ ID NO: 1663841 - protein, 17 aa, Staphylococcus aureus
LIRGVWLLSGIDKELSE

SEQ ID NO: 1663842 - protein, 19 aa, Staphylococcus aureus
LISGSITNCIKNIDDNIDR

SEQ ID NO: 1663843 - protein, 20 aa, Staphylococcus aureus
LKAELVQSFVERRKGKTTEE

SEQ ID NO: 1663844 - protein, 21 aa, Staphylococcus aureus
LKAKGIRFDKILKMSNRPKQS

SEQ ID NO: 1663845 - protein, 22 aa, Staphylococcus aureus
LKAMNFQCYYREPLYESDVMSF

SEQ ID NO: 1663846 - protein, 19 aa, Staphylococcus aureus
LKAYIDSGGKISQTTLMSL

SEQ ID NO: 1663847 - protein, 20 aa, Staphylococcus aureus
LKEIIIRTAEVLGTGIDDES

SEQ ID NO: 1663848 - protein, 20 aa, Staphylococcus aureus
LKEIRYTRDLFNKHLSMNNE

SEQ ID NO: 1663849 - protein, 17 aa, Staphylococcus aureus
LKEISYIQAEGFAGGEL

SEQ ID NO: 1663850 - protein, 18 aa, Staphylococcus aureus
LKEKGTEITSTFYPKMFK

SEQ ID NO: 1663851 - protein, 18 aa, Staphylococcus aureus
LKELLILAYFYYKNEHSI

SEQ ID NO: 1663852 - protein, 28 aa, Staphylococcus aureus
LKFGPDFVPNVKLQWLAIDKDKVETTVS

SEQ ID NO: 1663853 - protein, 23 aa, Staphylococcus aureus
LKFKSQNWYWFAYFDGPLKLPKN

SEQ ID NO: 1663854 - protein, 20 aa, Staphylococcus aureus
LKFSNVGSRIDINISENKDQ

SEQ ID NO: 1663855 - protein, 22 aa, Staphylococcus aureus
LKGDIYLDEAVGIMTSQVVYKY

SEQ ID NO: 1663856 - protein, 22 aa, Staphylococcus aureus
LKGIECIYALYKKNRRSLQIYG

SEQ ID NO: 1663857 - protein, 18 aa, Staphylococcus aureus
LKGKIVFNEFTKQIECLG

SEQ ID NO: 1663858 - protein, 17 aa, Staphylococcus aureus
LKIKKAFNVKQCGNILE

SEQ ID NO: 1663859 - protein, 17 aa, Staphylococcus aureus
LKIYDGMQEQLKTLHQN

SEQ ID NO: 1663860 - protein, 21 aa, Staphylococcus aureus
LKKAESLLDEAGWKKGKDSDV

SEQ ID NO: 1663861 - protein, 18 aa, Staphylococcus aureus
LKKSYRNEYFYKNTILNK

SEQ ID NO: 1663862 - protein, 17 aa, Staphylococcus aureus
LKKTLLYGGNHILNVDL

SEQ ID NO: 1663863 - protein, 18 aa, Staphylococcus aureus
LKLDYALDFDQDKYTYAE

SEQ ID NO: 1663864 - protein, 19 aa, Staphylococcus aureus
LKLLNELARKQMKSLLNSR

SEQ ID NO: 1663865 - protein, 20 aa, Staphylococcus aureus
LKLSTLMSQISAVFQKVYLF

SEQ ID NO: 1663866 - protein, 20 aa, Staphylococcus aureus
LKLTNHLGFVIQINEDTFFV

SEQ ID NO: 1663867 - protein, 20 aa, Staphylococcus aureus
LKLTRWKNDGLAGFTASSVS

SEQ ID NO: 1663868 - protein, 19 aa, Staphylococcus aureus
LKPFGHVWLVERWMEDDIK

SEQ ID NO: 1663869 - protein, 20 aa, Staphylococcus aureus
LKPGYLCRKVSGGLSSVAVR

SEQ ID NO: 1663870 - protein, 22 aa, Staphylococcus aureus
LKPNPYLSYAANFLYMLRGELP

SEQ ID NO: 1663871 - protein, 17 aa, Staphylococcus aureus
LKQYGVSYTIICKMYHI

SEQ ID NO: 1663872 - protein, 22 aa, Staphylococcus aureus
LKSDSEIKAFTSYLRKQINMKN

SEQ ID NO: 1663873 - protein, 33 aa, Staphylococcus aureus
LKSRLPEYMIPRKFEWMEQLPLTSNGKIDRKKI

SEQ ID NO: 1663874 - protein, 19 aa, Staphylococcus aureus
LKSSPFVWFKDALDGYDYL

SEQ ID NO: 1663875 - protein, 17 aa, Staphylococcus aureus
LKVAIELIEKELEERLK

SEQ ID NO: 1663876 - protein, 18 aa, Staphylococcus aureus
LKVDIYKVESIKRQERQN

SEQ ID NO: 1663877 - protein, 20 aa, Staphylococcus aureus
LKYDKLYSLYSLLYTMKKIS

SEQ ID NO: 1663878 - protein, 19 aa, Staphylococcus aureus
LKYKQLKNINIDIPVLEEQ

SEQ ID NO: 1663879 - protein, 18 aa, Staphylococcus aureus
LKYVRHIDGSPYKYLKKT

SEQ ID NO: 1663880 - protein, 23 aa, Staphylococcus aureus
LLADIKSRFGLYKKAIPDLDNLY

SEQ ID NO: 1663881 - protein, 18 aa, Staphylococcus aureus
LLEYLPFDLTCTYDSYQF

SEQ ID NO: 1663882 - protein, 29 aa, Staphylococcus aureus
LLFRSGLDLKVDFVIRVGKPVISKKLNQW

SEQ ID NO: 1663883 - protein, 28 aa, Staphylococcus aureus
LLFRYRFKSRIAVWVLNYIKVNEAKLAN

SEQ ID NO: 1663884 - protein, 28 aa, Staphylococcus aureus
LLGEDCRRTMDIFRLLGVDIKEYEDKLV

SEQ ID NO: 1663885 - protein, 17 aa, Staphylococcus aureus
LLKSFGFLIYFKNPEDM

SEQ ID NO: 1663886 - protein, 18 aa, Staphylococcus aureus
LLLPELSGPFLSLSTIIN

SEQ ID NO: 1663887 - protein, 17 aa, Staphylococcus aureus
LLPESLLALPKLGAINV

SEQ ID NO: 1663888 - protein, 20 aa, Staphylococcus aureus
LLRVFRFDNKPAKQVSNIHV

SEQ ID NO: 1663889 - protein, 17 aa, Staphylococcus aureus
LLSGLGIDPTLHDKKMA

SEQ ID NO: 1663890 - protein, 24 aa, Staphylococcus aureus
LLTIIYLRKSWKIENLLKKLIIYL

SEQ ID NO: 1663891 - protein, 24 aa, Staphylococcus aureus
LLTTMAVVTWKVWKIERNTRKPVI

SEQ ID NO: 1663892 - protein, 25 aa, Staphylococcus aureus
LMASGLPSYVYTFLGFLPRKEKEKS

SEQ ID NO: 1663893 - protein, 21 aa, Staphylococcus aureus
LMKRIEQAEVRMEEIDVLMIE

SEQ ID NO: 1663894 - protein, 22 aa, Staphylococcus aureus
LMKYDWANILVVRRFSNTNKQS

SEQ ID NO: 1663895 - protein, 17 aa, Staphylococcus aureus
LMLGHAFPNQHEARENL

SEQ ID NO: 1663896 - protein, 17 aa, Staphylococcus aureus
LMSKVNGTYRFRPTTEA

SEQ ID NO: 1663897 - protein, 26 aa, Staphylococcus aureus
LMSMLPAEWNDWIIGARQALIDQRDI

SEQ ID NO: 1663898 - protein, 22 aa, Staphylococcus aureus
LMSTEGIIVLVIYHGHSEGQLE

SEQ ID NO: 1663899 - protein, 23 aa, Staphylococcus aureus
LNCIGVSLAEMPVDFSFVDTTAR

SEQ ID NO: 1663900 - protein, 25 aa, Staphylococcus aureus
LNDLKGAGFELGIATGRPYTETVVP

SEQ ID NO: 1663901 - protein, 34 aa, Staphylococcus aureus
LNDTIASMIIEFAEWVNTLEFFKNWKKQPGKPLD

SEQ ID NO: 1663902 - protein, 22 aa, Staphylococcus aureus
LNGFRTLTKIDWENVTINNEIT

SEQ ID NO: 1663903 - protein, 29 aa, Staphylococcus aureus
LNLEHALKIELDFYFPLLKSWSKKKKSEM

SEQ ID NO: 1663904 - protein, 19 aa, Staphylococcus aureus
LNLPTSLVDRFLGDSDEDT

SEQ ID NO: 1663905 - protein, 23 aa, Staphylococcus aureus
LNLSRTKLLVSIRRLIEKERLSK

SEQ ID NO: 1663906 - protein, 20 aa, Staphylococcus aureus
LNNELITFENIHLMNPGTFL

SEQ ID NO: 1663907 - protein, 20 aa, Staphylococcus aureus
LNPHVDRLTLSCRMEIDANG

SEQ ID NO: 1663908 - protein, 20 aa, Staphylococcus aureus
LNRLHRNLKNALKLMKLCQK

SEQ ID NO: 1663909 - protein, 21 aa, Staphylococcus aureus
LNSAMGNLRQAVADKDQVKRT

SEQ ID NO: 1663910 - protein, 17 aa, Staphylococcus aureus
LNTAMGNLKNSLNDKDT

SEQ ID NO: 1663911 - protein, 24 aa, Staphylococcus aureus
LNYKSEAYVGVWTEESVAVSFLTS

SEQ ID NO: 1663912 - protein, 18 aa, Staphylococcus aureus
LPDILQEYLLYVRYTAIL

SEQ ID NO: 1663913 - protein, 21 aa, Staphylococcus aureus
LPELIKSYINNFSYEEVKSIK

SEQ ID NO: 1663914 - protein, 23 aa, Staphylococcus aureus
LPEMKRHADIIVVCYHGGFEKDL

SEQ ID NO: 1663915 - protein, 17 aa, Staphylococcus aureus
LPFILRGIKLIGIDSVY

SEQ ID NO: 1663916 - protein, 24 aa, Staphylococcus aureus
LPFILRGIKLIGIDSVYVDHNIRE

SEQ ID NO: 1663917 - protein, 21 aa, Staphylococcus aureus
LPKLHSVYFVHVMHTLTEQFV

SEQ ID NO: 1663918 - protein, 18 aa, Staphylococcus aureus
LPLATGLVAEVGQGPSCI

SEQ ID NO: 1663919 - protein, 22 aa, Staphylococcus aureus
LPNGVELKNRYVLAPLTHISSN

SEQ ID NO: 1663920 - protein, 19 aa, Staphylococcus aureus
LPNHAPLIVAEQFGTVATL

SEQ ID NO: 1663921 - protein, 17 aa, Staphylococcus aureus
LPNRRNVVLTNQASFHH

SEQ ID NO: 1663922 - protein, 20 aa, Staphylococcus aureus
LPPCKYKKLIAIIAAAKPLK

SEQ ID NO: 1663923 - protein, 17 aa, Staphylococcus aureus
LPTRFTINVAIGNFEVN

SEQ ID NO: 1663924 - protein, 19 aa, Staphylococcus aureus
LPVEIQHQIRLQRLSQSPQ

SEQ ID NO: 1663925 - protein, 23 aa, Staphylococcus aureus
LQALKEIGYICAKVRNTMQAATK

SEQ ID NO: 1663926 - protein, 20 aa, Staphylococcus aureus
LQAPISFTYIFSKKESPEIL

SEQ ID NO: 1663927 - protein, 19 aa, Staphylococcus aureus
LQDICKLLNDRERLWLKLY

SEQ ID NO: 1663928 - protein, 19 aa, Staphylococcus aureus
LQGDIKIRGYQDLLQPILK

SEQ ID NO: 1663929 - protein, 17 aa, Staphylococcus aureus
LQPKFELQPKFGKQRPI

SEQ ID NO: 1663930 - protein, 17 aa, Staphylococcus aureus
LQRQFAYTKEEIHKYIQ

SEQ ID NO: 1663931 - protein, 22 aa, Staphylococcus aureus
LQSSPFIWFKDALDGYDYLVEQ

SEQ ID NO: 1663932 - protein, 27 aa, Staphylococcus aureus
LQTYLTPHFISFEIVYEAMDLIDDIED

SEQ ID NO: 1663933 - protein, 23 aa, Staphylococcus aureus
LRAQEMNIPISIEIPDEVSSINL

SEQ ID NO: 1663934 - protein, 19 aa, Staphylococcus aureus
LRDLWQQKMLRDNPELSIN

SEQ ID NO: 1663935 - protein, 32 aa, Staphylococcus aureus
LRETFKKERFEPWTSCEFDFTRDGNLNVSFDY

SEQ ID NO: 1663936 - protein, 24 aa, Staphylococcus aureus
LREVRKRQLIELIDDALVNKDEAA

SEQ ID NO: 1663937 - protein, 17 aa, Staphylococcus aureus
LREVYPITTKKSPVLKL

SEQ ID NO: 1663938 - protein, 20 aa, Staphylococcus aureus
LRGKELFNSLVAVVDKVKSE

SEQ ID NO: 1663939 - protein, 18 aa, Staphylococcus aureus
LRHEPLDHVLLFGPPGLG

SEQ ID NO: 1663940 - protein, 19 aa, Staphylococcus aureus
LRHTHCSYLLAKGVSIHYI

SEQ ID NO: 1663941 - protein, 18 aa, Staphylococcus aureus
LRIAKSICDIYPLLNKSL

SEQ ID NO: 1663942 - protein, 19 aa, Staphylococcus aureus
LRKYARVRLSNNIEINAYI

SEQ ID NO: 1663943 - protein, 19 aa, Staphylococcus aureus
LRPLLTYDKEEIIIKSKEI

SEQ ID NO: 1663944 - protein, 20 aa, Staphylococcus aureus
LRRILLSSLPGAAVKYIEIE

SEQ ID NO: 1663945 - protein, 27 aa, Staphylococcus aureus
LRVTQELRKKGVVGKFVEFFGPGVQYL

SEQ ID NO: 1663946 - protein, 26 aa, Staphylococcus aureus
LRYALSNPFLSPARRDKLQKMYNRTL

SEQ ID NO: 1663947 - protein, 17 aa, Staphylococcus aureus
LSAPEFEDYIVITTEYY

SEQ ID NO: 1663948 - protein, 18 aa, Staphylococcus aureus
LSEIYELIDEINIDPYIF

SEQ ID NO: 1663949 - protein, 17 aa, Staphylococcus aureus
LSEKYILEAIEQYKKIY

SEQ ID NO: 1663950 - protein, 21 aa, Staphylococcus aureus
LSERTKRLKLKQLLNSQNVEK

SEQ ID NO: 1663951 - protein, 23 aa, Staphylococcus aureus
LSGEFRKEFKPIASWQNNLVYDK

SEQ ID NO: 1663952 - protein, 20 aa, Staphylococcus aureus
LSHLRVIVRSLLGIAVPTQI

SEQ ID NO: 1663953 - protein, 20 aa, Staphylococcus aureus
LSHVLKYCQYINVLKEGQII

SEQ ID NO: 1663954 - protein, 21 aa, Staphylococcus aureus
LSIIDRIVNWISQKLLITCQP

SEQ ID NO: 1663955 - protein, 17 aa, Staphylococcus aureus
LSKDEKVLWVTETTANR

SEQ ID NO: 1663956 - protein, 25 aa, Staphylococcus aureus
LSKLERNKKGFFLMVEGASIDKSAH

SEQ ID NO: 1663957 - protein, 17 aa, Staphylococcus aureus
LSKTFLIESRELTTVDF

SEQ ID NO: 1663958 - protein, 22 aa, Staphylococcus aureus
LSLLLRRPPGREAYPGDVFYLH

SEQ ID NO: 1663959 - protein, 20 aa, Staphylococcus aureus
LSNIRLGFKQEIEARKNGEK

SEQ ID NO: 1663960 - protein, 26 aa, Staphylococcus aureus
LSPISLGLEPWKFVVIQDQALRDELK

SEQ ID NO: 1663961 - protein, 23 aa, Staphylococcus aureus
LSSASVPFEFDVHALIFSENAFE

SEQ ID NO: 1663962 - protein, 23 aa, Staphylococcus aureus
LSSDWFAELGYTFFNYHYTAKLI

SEQ ID NO: 1663963 - protein, 25 aa, Staphylococcus aureus
LSSGGKRVRPAFVILSSQFGKDKQT

SEQ ID NO: 1663964 - protein, 25 aa, Staphylococcus aureus
LSTEEERLAAKHLVEQALNQAIDQI

SEQ ID NO: 1663965 - protein, 25 aa, Staphylococcus aureus
LTAGWTGDVKYHLGGIKTTDSYGTM

SEQ ID NO: 1663966 - protein, 23 aa, Staphylococcus aureus
LTIIYLRKSWKIENLLKKIDNLF

SEQ ID NO: 1663967 - protein, 17 aa, Staphylococcus aureus
LTIMCKLAGPQQREIGF

SEQ ID NO: 1663968 - protein, 17 aa, Staphylococcus aureus
LTLDIEHSLKCLVLKLI

SEQ ID NO: 1663969 - protein, 19 aa, Staphylococcus aureus
LTLEPKRIVYISCNPSTQQ

SEQ ID NO: 1663970 - protein, 19 aa, Staphylococcus aureus
LTNSGRLHKQVKIVNLYEE

SEQ ID NO: 1663971 - protein, 17 aa, Staphylococcus aureus
LTPLIGKKVIVKGKEVG

SEQ ID NO: 1663972 - protein, 21 aa, Staphylococcus aureus
LTRHNIGFEVVDYILEKNNFS

SEQ ID NO: 1663973 - protein, 17 aa, Staphylococcus aureus
LTYEKAKSLSITKATVD

SEQ ID NO: 1663974 - protein, 17 aa, Staphylococcus aureus
LTYRLKNDLPITKSEFE

SEQ ID NO: 1663975 - protein, 23 aa, Staphylococcus aureus
LVDERIPEINWIEGVKEALIDLK

SEQ ID NO: 1663976 - protein, 23 aa, Staphylococcus aureus
LVEGFKNADFEKVVVYRDEEELQ

SEQ ID NO: 1663977 - protein, 18 aa, Staphylococcus aureus
LVFFVRYGGEFQLKQGFS

SEQ ID NO: 1663978 - protein, 20 aa, Staphylococcus aureus
LVGESGCGKSTLGKVIIRLE

SEQ ID NO: 1663979 - protein, 19 aa, Staphylococcus aureus
LVMNLVFEDFLPVKDVFNN

SEQ ID NO: 1663980 - protein, 18 aa, Staphylococcus aureus
LVQPRVLICDEITSNLDV

SEQ ID NO: 1663981 - protein, 23 aa, Staphylococcus aureus
LVSKRLKKNYGLTFSPCNTKGLA

SEQ ID NO: 1663982 - protein, 24 aa, Staphylococcus aureus
LVTKSGRYGGTFAQKDIAFEFASW

SEQ ID NO: 1663983 - protein, 31 aa, Staphylococcus aureus
LVTLLNKDKVEWIILAGYMRLIGPDLLASFE

SEQ ID NO: 1663984 - protein, 24 aa, Staphylococcus aureus
LVTPDHIVRAAARDAVKQQYEAKK

SEQ ID NO: 1663985 - protein, 19 aa, Staphylococcus aureus
LVVQRGFEIPSFNFVTEKE

SEQ ID NO: 1663986 - protein, 17 aa, Staphylococcus aureus
LVVWAIKEGRGVAKAVD

SEQ ID NO: 1663987 - protein, 22 aa, Staphylococcus aureus
LWSHIRRGLVLPTIIPNRKQII

SEQ ID NO: 1663988 - protein, 18 aa, Staphylococcus aureus
LYDLKKFLELFNELASKV

SEQ ID NO: 1663989 - protein, 21 aa, Staphylococcus aureus
LYEAWEVESRIPGKNGDATKF

SEQ ID NO: 1663990 - protein, 18 aa, Staphylococcus aureus
LYESNKYYPIYGSSELGK

SEQ ID NO: 1663991 - protein, 20 aa, Staphylococcus aureus
LYIAALKLGVAIIPCSEMLR

SEQ ID NO: 1663992 - protein, 17 aa, Staphylococcus aureus
LYILKEFTTTKVKMLTE

SEQ ID NO: 1663993 - protein, 24 aa, Staphylococcus aureus
LYKKGHFKKLVIISTGLEDISDEE

SEQ ID NO: 1663994 - protein, 17 aa, Staphylococcus aureus
LYLTVIDRIDIRKDENH

SEQ ID NO: 1663995 - protein, 17 aa, Staphylococcus aureus
LYNESQSVWDFMSDVSN

SEQ ID NO: 1663996 - protein, 18 aa, Staphylococcus aureus
LYPDLTIYLNVSAEVGRE

SEQ ID NO: 1663997 - protein, 24 aa, Staphylococcus aureus
LYPHQRYAIDLVIKENHKTYKNQG

SEQ ID NO: 1663998 - protein, 24 aa, Staphylococcus aureus
LYSHQRYAIDLVIKENHKTYKNQG

SEQ ID NO: 1663999 - protein, 22 aa, Staphylococcus aureus
MAEAGIYKWHIDIQAGTCTYID

SEQ ID NO: 1664000 - protein, 17 aa, Staphylococcus aureus
MCDLKILKEKFEDLKDN

SEQ ID NO: 1664001 - protein, 20 aa, Staphylococcus aureus
MCRDIELHWGEPVESTRKLL

SEQ ID NO: 1664002 - protein, 21 aa, Staphylococcus aureus
MDDRIPINVWTGDSIARTGKG

SEQ ID NO: 1664003 - protein, 23 aa, Staphylococcus aureus
MDQFSFKVAQTLINNDGPAIEYT

SEQ ID NO: 1664004 - protein, 22 aa, Staphylococcus aureus
MEEGYRLKFIFIGNQNNNIKNK

SEQ ID NO: 1664005 - protein, 19 aa, Staphylococcus aureus
MEELAALGFNAKQTMEAMP

SEQ ID NO: 1664006 - protein, 19 aa, Staphylococcus aureus
MESRGMVLYINRNTRTTKG

SEQ ID NO: 1664007 - protein, 19 aa, Staphylococcus aureus
MFANTLVYRGQPSPDKMWT

SEQ ID NO: 1664008 - protein, 26 aa, Staphylococcus aureus
MFDYSACKYPIGVAEDEIYYFNEENI

SEQ ID NO: 1664009 - protein, 21 aa, Staphylococcus aureus
MFENLSRYRAIIVSTEQQKLD

SEQ ID NO: 1664010 - protein, 25 aa, Staphylococcus aureus
MGGQTIRLMEEFLRNGNKEEIAYHK

SEQ ID NO: 1664011 - protein, 17 aa, Staphylococcus aureus
MGLRKVKIGKTIRYDRQ

SEQ ID NO: 1664012 - protein, 22 aa, Staphylococcus aureus
MGQSAGSMSIWTLLKIPDIEPY

SEQ ID NO: 1664013 - protein, 21 aa, Staphylococcus aureus
MHNRMRMVVSQFLTKDLFINW

SEQ ID NO: 1664014 - protein, 18 aa, Staphylococcus aureus
MIDACKRASAATINIVVP

SEQ ID NO: 1664015 - protein, 23 aa, Staphylococcus aureus
MIERLQRELKHISLIQLQNASIA

SEQ ID NO: 1664016 - protein, 22 aa, Staphylococcus aureus
MIKRDEFEMGRELLVQVRKRQL

SEQ ID NO: 1664017 - protein, 18 aa, Staphylococcus aureus
MINHFGIENISRYYNLSI

SEQ ID NO: 1664018 - protein, 18 aa, Staphylococcus aureus
MKAERIAKGISISDMAKK

SEQ ID NO: 1664019 - protein, 17 aa, Staphylococcus aureus
MKDLINYDLIKQGIPDD

SEQ ID NO: 1664020 - protein, 18 aa, Staphylococcus aureus
MKDLINYDLIKQGIPDDA

SEQ ID NO: 1664021 - protein, 22 aa, Staphylococcus aureus
MKEELKFNAINIIYGVNGRGKT

SEQ ID NO: 1664022 - protein, 20 aa, Staphylococcus aureus
MKLLDRGRISILNTKTNKDC

SEQ ID NO: 1664023 - protein, 19 aa, Staphylococcus aureus
MKPTKVILRDASYVHSKTS

SEQ ID NO: 1664024 - protein, 17 aa, Staphylococcus aureus
MKQRVALCRAHVHKPSV

SEQ ID NO: 1664025 - protein, 22 aa, Staphylococcus aureus
MKSHKLNAFSYMNKSDSTTLKN

SEQ ID NO: 1664026 - protein, 26 aa, Staphylococcus aureus
MKVARELIELIIAFMFHHQIPMSVEM

SEQ ID NO: 1664027 - protein, 19 aa, Staphylococcus aureus
MKYNVKGFKEIQFEEQKEN

SEQ ID NO: 1664028 - protein, 21 aa, Staphylococcus aureus
MLLPMCLDIEHSLKTDILEKI

SEQ ID NO: 1664029 - protein, 33 aa, Staphylococcus aureus
MMNGKLFGHVYIKDCKVRQSFELASPKHTEGLI

SEQ ID NO: 1664030 - protein, 18 aa, Staphylococcus aureus
MMREVRLALLEADVNFKV

SEQ ID NO: 1664031 - protein, 17 aa, Staphylococcus aureus
MNGYRRGAYEDMSKGMN

SEQ ID NO: 1664032 - protein, 18 aa, Staphylococcus aureus
MNIADDIKFHVVIYSENN

SEQ ID NO: 1664033 - protein, 19 aa, Staphylococcus aureus
MNISLKAIMKRVGHTDEKT

SEQ ID NO: 1664034 - protein, 25 aa, Staphylococcus aureus
MNNRYKNVLDYILGLEVGLSSNDKK

SEQ ID NO: 1664035 - protein, 32 aa, Staphylococcus aureus
MNSKLFGHVYIKDCKVRQSFELASPKHTEGLI

SEQ ID NO: 1664036 - protein, 21 aa, Staphylococcus aureus
MNSKLFSHVYIKDCKVRQSFE

SEQ ID NO: 1664037 - protein, 21 aa, Staphylococcus aureus
MNVSLKAIMKRVGHVDEKTTI

SEQ ID NO: 1664038 - protein, 19 aa, Staphylococcus aureus
MPAKGMIGHLHLKTHDLDA

SEQ ID NO: 1664039 - protein, 20 aa, Staphylococcus aureus
MPFGACHFAVAAKPETTNYR

SEQ ID NO: 1664040 - protein, 20 aa, Staphylococcus aureus
MPGKRVNISDGVPRLDALID

SEQ ID NO: 1664041 - protein, 20 aa, Staphylococcus aureus
MPIAILIRHMMSFDNAHFFA

SEQ ID NO: 1664042 - protein, 20 aa, Staphylococcus aureus
MPLLSEKPLFVYISQSGETA

SEQ ID NO: 1664043 - protein, 18 aa, Staphylococcus aureus
MQDSFYITNEILLRTHTS

SEQ ID NO: 1664044 - protein, 17 aa, Staphylococcus aureus
MQYDLDITRWSELEEIK

SEQ ID NO: 1664045 - protein, 22 aa, Staphylococcus aureus
MRIASSRKKYWCLSSTHEVHRA

SEQ ID NO: 1664046 - protein, 19 aa, Staphylococcus aureus
MRLDELIKWARENPDLSQG

SEQ ID NO: 1664047 - protein, 17 aa, Staphylococcus aureus
MSPSELMAFGDANNDKD

SEQ ID NO: 1664048 - protein, 26 aa, Staphylococcus aureus
MTALKAAIADKERTKASGNYVNADQE

SEQ ID NO: 1664049 - protein, 28 aa, Staphylococcus aureus
MTNKSIVGNLVYRNNFYNEVYTQPVYDL

SEQ ID NO: 1664050 - protein, 20 aa, Staphylococcus aureus
MTTIRVARAYTKRNKIIKFA

SEQ ID NO: 1664051 - protein, 19 aa, Staphylococcus aureus
MVCDGYLMRIENLTPSNFF

SEQ ID NO: 1664052 - protein, 36 aa, Staphylococcus aureus
MVVAPLEILDPFKGILKFQLPNDVIKRDGSYQAQVS

SEQ ID NO: 1664053 - protein, 36 aa, Staphylococcus aureus
MVVAPLEILDPFKGVLKFQLPNDVIKRDGSYQAQVS

SEQ ID NO: 1664054 - protein, 25 aa, Staphylococcus aureus
MYAGLEASMAFKIMESVRKGKGLTE

SEQ ID NO: 1664055 - protein, 18 aa, Staphylococcus aureus
MYEAGEWIQFYAIDEQQF

SEQ ID NO: 1664056 - protein, 29 aa, Staphylococcus aureus
MYEILKDRFSFRVKEIAAIILNEIAYSFN

SEQ ID NO: 1664057 - protein, 23 aa, Staphylococcus aureus
MYSDFDKMRFVHHSIPSINVNDI

SEQ ID NO: 1664058 - protein, 19 aa, Staphylococcus aureus
NAFSSDFYYFVKHNQKLTK

SEQ ID NO: 1664059 - protein, 18 aa, Staphylococcus aureus
NAKLRLALASDQGITKHD

SEQ ID NO: 1664060 - protein, 36 aa, Staphylococcus aureus
NAKSVWKGTSKWFGNSYKSLKGWTGDMYSRAHDRFD

SEQ ID NO: 1664061 - protein, 24 aa, Staphylococcus aureus
NAKSVWKGTSKWFSNSYKSLKDWT

SEQ ID NO: 1664062 - protein, 22 aa, Staphylococcus aureus
NAPMGSPRPRFRNTGRYAHTYM

SEQ ID NO: 1664063 - protein, 26 aa, Staphylococcus aureus
NARKYSNIYLYLALKGFLEKLMNDMY

SEQ ID NO: 1664064 - protein, 19 aa, Staphylococcus aureus
NASLFEFSILTGILESDDN

SEQ ID NO: 1664065 - protein, 25 aa, Staphylococcus aureus
NATIIKPSFFMDNFLRIAKVEDERI

SEQ ID NO: 1664066 - protein, 24 aa, Staphylococcus aureus
NATLILDVSHSFGIENYLNYQGVD

SEQ ID NO: 1664067 - protein, 18 aa, Staphylococcus aureus
NCRNVIEAIQLLKEIPHR

SEQ ID NO: 1664068 - protein, 29 aa, Staphylococcus aureus
NDEYTKYKIGGTWYQFYKKVDEELTKKFV

SEQ ID NO: 1664069 - protein, 30 aa, Staphylococcus aureus
NDEYTKYKIGGTWYQFYKKVDEELTKKFVE

SEQ ID NO: 1664070 - protein, 25 aa, Staphylococcus aureus
NDFERWSFHLQIYFLAERFKEQKRM

SEQ ID NO: 1664071 - protein, 20 aa, Staphylococcus aureus
NDIELKFAKQAKYTVHFKNG

SEQ ID NO: 1664072 - protein, 20 aa, Staphylococcus aureus
NDIPMWLRECITSVNEEYQA

SEQ ID NO: 1664073 - protein, 28 aa, Staphylococcus aureus
NDLFIPLKPLRQLEIISGEYNDVINEKV

SEQ ID NO: 1664074 - protein, 21 aa, Staphylococcus aureus
NDLLKEGWDIVHVGTKLVKIL

SEQ ID NO: 1664075 - protein, 26 aa, Staphylococcus aureus
NDLVNMFKGFVFKVNGTLPIDKAFVT

SEQ ID NO: 1664076 - protein, 23 aa, Staphylococcus aureus
NDPSRPVGTFAIKTGAITSAVDR

SEQ ID NO: 1664077 - protein, 18 aa, Staphylococcus aureus
NDQIKWYVDMGVIDKEEY

SEQ ID NO: 1664078 - protein, 22 aa, Staphylococcus aureus
NDRRILEVLVRYANDQNYTARF

SEQ ID NO: 1664079 - protein, 20 aa, Staphylococcus aureus
NDSIKAIILSFAYDKNKFKV

SEQ ID NO: 1664080 - protein, 17 aa, Staphylococcus aureus
NEAKAAAKQTLGTLTHI

SEQ ID NO: 1664081 - protein, 26 aa, Staphylococcus aureus
NEDIQFSGAFSIEFRLSKQTITCTDY

SEQ ID NO: 1664082 - protein, 24 aa, Staphylococcus aureus
NEEKGKDIEPVRAAYEEGLNNINA

SEQ ID NO: 1664083 - protein, 24 aa, Staphylococcus aureus
NEEKYLRLYADFENYKRRIQKENE

SEQ ID NO: 1664084 - protein, 17 aa, Staphylococcus aureus
NEETPIVMSSRIRLARN

SEQ ID NO: 1664085 - protein, 22 aa, Staphylococcus aureus
NEKRIKNHLNRAFNREQPMETL

SEQ ID NO: 1664086 - protein, 25 aa, Staphylococcus aureus
NEKYNIQQAKGWTQVKMKAALHNEA

SEQ ID NO: 1664087 - protein, 21 aa, Staphylococcus aureus
NELLRMIHLIKKYKLAANSKI

SEQ ID NO: 1664088 - protein, 19 aa, Staphylococcus aureus
NENKKKYGFESATEDKQKK

SEQ ID NO: 1664089 - protein, 22 aa, Staphylococcus aureus
NENNYGVGLGMPSFESAVNPLH

SEQ ID NO: 1664090 - protein, 21 aa, Staphylococcus aureus
NESELKLCRDLITEFETLSKY

SEQ ID NO: 1664091 - protein, 17 aa, Staphylococcus aureus
NEVKQAATARKAQNATV

SEQ ID NO: 1664092 - protein, 18 aa, Staphylococcus aureus
NEVMTLPSIKVVEHPDLF

SEQ ID NO: 1664093 - protein, 18 aa, Staphylococcus aureus
NFAKSLGKPIYVFEMNKA

SEQ ID NO: 1664094 - protein, 20 aa, Staphylococcus aureus
NFCSEIDAFYQYRTPLERIL

SEQ ID NO: 1664095 - protein, 18 aa, Staphylococcus aureus
NFDKVVQYESIFDFEEMI

SEQ ID NO: 1664096 - protein, 18 aa, Staphylococcus aureus
NFHELKQQVRLHIIQMNT

SEQ ID NO: 1664097 - protein, 24 aa, Staphylococcus aureus
NFKARIMMIFSLYKGEKRRQPSPI

SEQ ID NO: 1664098 - protein, 24 aa, Staphylococcus aureus
NFMAKEARGLICAPVSKDIAQRLN

SEQ ID NO: 1664099 - protein, 22 aa, Staphylococcus aureus
NFVMDLETSMGIYSIDDSEIKD

SEQ ID NO: 1664100 - protein, 26 aa, Staphylococcus aureus
NGDISVGAFFRARLGNEVLENLIEPL

SEQ ID NO: 1664101 - protein, 28 aa, Staphylococcus aureus
NGENLKGWHTGAGMSYLYNSDVKHYRDN

SEQ ID NO: 1664102 - protein, 19 aa, Staphylococcus aureus
NGFRKWLSRTYEWIRDIGK

SEQ ID NO: 1664103 - protein, 17 aa, Staphylococcus aureus
NGGKYTFELHKKLQEHR

SEQ ID NO: 1664104 - protein, 19 aa, Staphylococcus aureus
NGILACLLLEGHLLSKPDL

SEQ ID NO: 1664105 - protein, 31 aa, Staphylococcus aureus
NGINIGQRRLFEWLRQNGFLIKHKGVDYNMP

SEQ ID NO: 1664106 - protein, 20 aa, Staphylococcus aureus
NGKIQRGLIEFHPSSGDSVG

SEQ ID NO: 1664107 - protein, 19 aa, Staphylococcus aureus
NGKWGYFNREFFDLLNDHL

SEQ ID NO: 1664108 - protein, 25 aa, Staphylococcus aureus
NGLKRNIVHIGHFKAGEAINTVPSN

SEQ ID NO: 1664109 - protein, 19 aa, Staphylococcus aureus
NGYYADTGISFVVGESDDP

SEQ ID NO: 1664110 - protein, 20 aa, Staphylococcus aureus
NHALQILTLIAMEKPESRNS

SEQ ID NO: 1664111 - protein, 18 aa, Staphylococcus aureus
NHAMPILLVSGYDDPLGD

SEQ ID NO: 1664112 - protein, 23 aa, Staphylococcus aureus
NHIDKKEARRMDRFTQYAIVAAR

SEQ ID NO: 1664113 - protein, 18 aa, Staphylococcus aureus
NHPIPLKKYQHGFESIHQ

SEQ ID NO: 1664114 - protein, 19 aa, Staphylococcus aureus
NINYNFSYNDFKTLEDDSY

SEQ ID NO: 1664115 - protein, 19 aa, Staphylococcus aureus
NIPEGITMDQYLARKKKNS

SEQ ID NO: 1664116 - protein, 24 aa, Staphylococcus aureus
NIQVWECIRILISNVKTPMQNSKG

SEQ ID NO: 1664117 - protein, 17 aa, Staphylococcus aureus
NISTDIIRKIVFDSIAD

SEQ ID NO: 1664118 - protein, 18 aa, Staphylococcus aureus
NIWFEREAIDLLPEGFTH

SEQ ID NO: 1664119 - protein, 24 aa, Staphylococcus aureus
NKAFETLQGYGFPVISRKEMQQEV

SEQ ID NO: 1664120 - protein, 25 aa, Staphylococcus aureus
NKAFETLQGYGFPVISRKEMQQEVP

SEQ ID NO: 1664121 - protein, 25 aa, Staphylococcus aureus
NKAYETLQGYGFPVISRKEMQQEIP

SEQ ID NO: 1664122 - protein, 24 aa, Staphylococcus aureus
NKDGVPFIENWIKQYGSEAWTKQF

SEQ ID NO: 1664123 - protein, 18 aa, Staphylococcus aureus
NKDVWYKASVGLLNSLLL

SEQ ID NO: 1664124 - protein, 25 aa, Staphylococcus aureus
NKEIKFKAFLDHAMNLGADYVATGH

SEQ ID NO: 1664125 - protein, 19 aa, Staphylococcus aureus
NKFLWFLMNTDLIRNKIKG

SEQ ID NO: 1664126 - protein, 17 aa, Staphylococcus aureus
NKGRVYKLKGYEVPELS

SEQ ID NO: 1664127 - protein, 24 aa, Staphylococcus aureus
NKKATARNEITAILNNKLQEIQAT

SEQ ID NO: 1664128 - protein, 22 aa, Staphylococcus aureus
NKKIKMCEFQIESMYHMSASTT

SEQ ID NO: 1664129 - protein, 22 aa, Staphylococcus aureus
NKKLHSWLKISTLIDNVKVKDK

SEQ ID NO: 1664130 - protein, 22 aa, Staphylococcus aureus
NKKRSWLAMNVVATNIIRKIHK

SEQ ID NO: 1664131 - protein, 22 aa, Staphylococcus aureus
NKLDLVVKFIHWVSRSCIENMS

SEQ ID NO: 1664132 - protein, 20 aa, Staphylococcus aureus
NKLNEVLTAMGLSDKAIEGS

SEQ ID NO: 1664133 - protein, 18 aa, Staphylococcus aureus
NKNDMDWIKKNYDLYSKL

SEQ ID NO: 1664134 - protein, 17 aa, Staphylococcus aureus
NKPHGEFDFADFKITKI

SEQ ID NO: 1664135 - protein, 17 aa, Staphylococcus aureus
NKQWREFIINWVQDTMD

SEQ ID NO: 1664136 - protein, 18 aa, Staphylococcus aureus
NKRFEKLKAAGYLDKEII

SEQ ID NO: 1664137 - protein, 21 aa, Staphylococcus aureus
NKRINEIKSFYSIPDEKVYIL

SEQ ID NO: 1664138 - protein, 18 aa, Staphylococcus aureus
NKTCARGANYKLVIQEPK

SEQ ID NO: 1664139 - protein, 26 aa, Staphylococcus aureus
NKTKKISIKFLFESYTGKDYTLLNYY

SEQ ID NO: 1664140 - protein, 18 aa, Staphylococcus aureus
NKVLMLGHAFPNQHEARE

SEQ ID NO: 1664141 - protein, 26 aa, Staphylococcus aureus
NLDELFDAVLMTIKYIMRESKVNQDD

SEQ ID NO: 1664142 - protein, 22 aa, Staphylococcus aureus
NLEADMSLAIVIGSEGQGMSRL

SEQ ID NO: 1664143 - protein, 19 aa, Staphylococcus aureus
NLEDGRLNVILMVGVNGVG

SEQ ID NO: 1664144 - protein, 28 aa, Staphylococcus aureus
NLENLPWKELDIDIAIDATGKFNHGDKA

SEQ ID NO: 1664145 - protein, 26 aa, Staphylococcus aureus
NLFSAVKIYGTFKHMRVRMMPAQQPP

SEQ ID NO: 1664146 - protein, 25 aa, Staphylococcus aureus
NLHITDKEFIVFVGPSGCGKSTTLR

SEQ ID NO: 1664147 - protein, 24 aa, Staphylococcus aureus
NLKECGYLHVEIIRNGNEIKQRKL

SEQ ID NO: 1664148 - protein, 30 aa, Staphylococcus aureus
NLKNALKLIKLCQTYRVHILSVHDGYFDMD

SEQ ID NO: 1664149 - protein, 25 aa, Staphylococcus aureus
NLKVREIKGLLTAKILRAQEMNIPI

SEQ ID NO: 1664150 - protein, 26 aa, Staphylococcus aureus
NLLMPKKQMEALVYKFYKENNINLTS

SEQ ID NO: 1664151 - protein, 21 aa, Staphylococcus aureus
NLPKCLFPLTLRTRQSGDTFK

SEQ ID NO: 1664152 - protein, 17 aa, Staphylococcus aureus
NMFALLGKPGFEDMKKD

SEQ ID NO: 1664153 - protein, 23 aa, Staphylococcus aureus
NMQSAYYYNIFVQKVFLKAIDSC

SEQ ID NO: 1664154 - protein, 20 aa, Staphylococcus aureus
NNAQRQLAIQQINNAETLNK

SEQ ID NO: 1664155 - protein, 19 aa, Staphylococcus aureus
NNFHELKQQVRLHIIQMNT

SEQ ID NO: 1664156 - protein, 26 aa, Staphylococcus aureus
NNKGLNYLITVLKNWNKEGVSDKESA

SEQ ID NO: 1664157 - protein, 22 aa, Staphylococcus aureus
NNKYPGLGLIKRLSIMHHLEIM

SEQ ID NO: 1664158 - protein, 19 aa, Staphylococcus aureus
NNLNFFNPRIGKNITSMPH

SEQ ID NO: 1664159 - protein, 18 aa, Staphylococcus aureus
NNMSRPIVTNALTHGLSL

SEQ ID NO: 1664160 - protein, 21 aa, Staphylococcus aureus
NNPDELMAFLKNKRKNILENA

SEQ ID NO: 1664161 - protein, 18 aa, Staphylococcus aureus
NNPGELLKYNVINIKVLD

SEQ ID NO: 1664162 - protein, 17 aa, Staphylococcus aureus
NNSRMITMGSEIVGDTL

SEQ ID NO: 1664163 - protein, 30 aa, Staphylococcus aureus
NNVSIKFKEEFEPRKFVFTNGEIKYNSNFE

SEQ ID NO: 1664164 - protein, 17 aa, Staphylococcus aureus
NNYEVHFVFDLSLMEIR

SEQ ID NO: 1664165 - protein, 20 aa, Staphylococcus aureus
NPDEITRALTQVTDAKNGLN

SEQ ID NO: 1664166 - protein, 23 aa, Staphylococcus aureus
NPDTGKMQLVYDEHIQLVSKSPK

SEQ ID NO: 1664167 - protein, 18 aa, Staphylococcus aureus
NPLDGFVITGYINNDKTN

SEQ ID NO: 1664168 - protein, 29 aa, Staphylococcus aureus
NPTEIDSMALPPCHTMFQFYVQEGKLNCQ

SEQ ID NO: 1664169 - protein, 26 aa, Staphylococcus aureus
NQGEVCSAGSRLLVHEKIYDQLVPRL

SEQ ID NO: 1664170 - protein, 24 aa, Staphylococcus aureus
NQKVIPAVRYKYIRDNSKAGDFLS

SEQ ID NO: 1664171 - protein, 22 aa, Staphylococcus aureus
NQWNAKFIDRGYIFTNTAGSPI

SEQ ID NO: 1664172 - protein, 31 aa, Staphylococcus aureus
NRAMPLLKTFRLENELKVFPSHFSKGMKQKV

SEQ ID NO: 1664173 - protein, 21 aa, Staphylococcus aureus
NRFIEKYGFEQLVNVKDLLSD

SEQ ID NO: 1664174 - protein, 17 aa, Staphylococcus aureus
NRIEFKVIDQIGAGSVS

SEQ ID NO: 1664175 - protein, 20 aa, Staphylococcus aureus
NRLIKAGAFDKYPIEAVFGI

SEQ ID NO: 1664176 - protein, 20 aa, Staphylococcus aureus
NRLTGIIDFGDSGIIDEYCD

SEQ ID NO: 1664177 - protein, 17 aa, Staphylococcus aureus
NRPEVRNAFTPKTVSEM

SEQ ID NO: 1664178 - protein, 20 aa, Staphylococcus aureus
NRPNVRQGLKQAGVVIPETT

SEQ ID NO: 1664179 - protein, 30 aa, Staphylococcus aureus
NRPVLQEALNFLRMGDRFVVESIDCLGRNY

SEQ ID NO: 1664180 - protein, 21 aa, Staphylococcus aureus
NRRKKEKFLYSAIDIDKASIT

SEQ ID NO: 1664181 - protein, 18 aa, Staphylococcus aureus
NRRNVVLTNQASFHHEGV

SEQ ID NO: 1664182 - protein, 17 aa, Staphylococcus aureus
NSDNFKSKIDIINQHGE

SEQ ID NO: 1664183 - protein, 21 aa, Staphylococcus aureus
NSELLDADFGYAIDASADVGT

SEQ ID NO: 1664184 - protein, 22 aa, Staphylococcus aureus
NSGSNLDKAAVENALSQVTNAK

SEQ ID NO: 1664185 - protein, 27 aa, Staphylococcus aureus
NSHLLQFKNGRIIRGKSTLLSFSNLEI

SEQ ID NO: 1664186 - protein, 22 aa, Staphylococcus aureus
NSITRPSFRVPNDDALMYYEQR

SEQ ID NO: 1664187 - protein, 17 aa, Staphylococcus aureus
NSVNWRYIDHSSGLEPM

SEQ ID NO: 1664188 - protein, 21 aa, Staphylococcus aureus
NSYLDEILIMFINSSNSTISD

SEQ ID NO: 1664189 - protein, 23 aa, Staphylococcus aureus
NTEIRPFLMKDLFNDKKLRDYHE

SEQ ID NO: 1664190 - protein, 19 aa, Staphylococcus aureus
NTFFSAKPYLHCVFNKDIL

SEQ ID NO: 1664191 - protein, 18 aa, Staphylococcus aureus
NTILELSENIYLLKDGCF

SEQ ID NO: 1664192 - protein, 21 aa, Staphylococcus aureus
NTKKATGYYFVNKVYDDISKN

SEQ ID NO: 1664193 - protein, 22 aa, Staphylococcus aureus
NTKKVANAFCLNEEDTNLLINA

SEQ ID NO: 1664194 - protein, 19 aa, Staphylococcus aureus
NTLEIGMVCDGYLMRIENL

SEQ ID NO: 1664195 - protein, 24 aa, Staphylococcus aureus
NTLNQAMHGLRQSIQDNAATKANS

SEQ ID NO: 1664196 - protein, 21 aa, Staphylococcus aureus
NTSRFYQYWLDHIDEDLTEAK

SEQ ID NO: 1664197 - protein, 24 aa, Staphylococcus aureus
NTVTGLPSGLTFDSTNNTISGTPT

SEQ ID NO: 1664198 - protein, 25 aa, Staphylococcus aureus
NVAGIWKDNSFFLGLNSYPIMNYHY

SEQ ID NO: 1664199 - protein, 22 aa, Staphylococcus aureus
NVKHQAKQAIADKVQAQETAID

SEQ ID NO: 1664200 - protein, 22 aa, Staphylococcus aureus
NVPDYFKAIVAIGTIADLVSLT

SEQ ID NO: 1664201 - protein, 26 aa, Staphylococcus aureus
NVSFKLRKKHILGIVGESGSGKSITA

SEQ ID NO: 1664202 - protein, 24 aa, Staphylococcus aureus
NVSHELRTPISLLQGYTESIVDGI

SEQ ID NO: 1664203 - protein, 19 aa, Staphylococcus aureus
NVTIPQYKPGSFGPKESDQ

SEQ ID NO: 1664204 - protein, 20 aa, Staphylococcus aureus
NVVSNEFAFLHPHKITTNDL

SEQ ID NO: 1664205 - protein, 26 aa, Staphylococcus aureus
NYDRAVELYYYIKGGRVDYGAAHAAK

SEQ ID NO: 1664206 - protein, 22 aa, Staphylococcus aureus
NYELIPTVFAEFEIDGKITTFK

SEQ ID NO: 1664207 - protein, 17 aa, Staphylococcus aureus
NYFKLKKFIVALESKTA

SEQ ID NO: 1664208 - protein, 19 aa, Staphylococcus aureus
NYGHGAGVVTSRTISANQA

SEQ ID NO: 1664209 - protein, 26 aa, Staphylococcus aureus
NYYRTVMPGFNYEAPPTQHKINPYDI

SEQ ID NO: 1664210 - protein, 25 aa, Staphylococcus aureus
PARIKCATLAWKALEKGTVAKEGTT

SEQ ID NO: 1664211 - protein, 18 aa, Staphylococcus aureus
PATVGVMSQNLWYFRYFI

SEQ ID NO: 1664212 - protein, 18 aa, Staphylococcus aureus
PAVAFRLFKQLVESKYGK

SEQ ID NO: 1664213 - protein, 17 aa, Staphylococcus aureus
PDIPTKSSIMVGLGETI

SEQ ID NO: 1664214 - protein, 18 aa, Staphylococcus aureus
PDIRGNDIAMIFQEPMTA

SEQ ID NO: 1664215 - protein, 28 aa, Staphylococcus aureus
PDNVLNCKPDFWKTLKYKKDKVTYYVYL

SEQ ID NO: 1664216 - protein, 20 aa, Staphylococcus aureus
PEGLIPLMKIQGLGSKKIAK

SEQ ID NO: 1664217 - protein, 21 aa, Staphylococcus aureus
PEIRMPKVGGRVMSLQDPTRK

SEQ ID NO: 1664218 - protein, 19 aa, Staphylococcus aureus
PELQSILKSFGIKTTGNKP

SEQ ID NO: 1664219 - protein, 22 aa, Staphylococcus aureus
PELVEGLKLVTEFVQDENATQE

SEQ ID NO: 1664220 - protein, 21 aa, Staphylococcus aureus
PEVHYLKQFIKHKIEQLLDEG

SEQ ID NO: 1664221 - protein, 23 aa, Staphylococcus aureus
PEVLKKLESVYGKQSMQAKSDRA

SEQ ID NO: 1664222 - protein, 18 aa, Staphylococcus aureus
PFDWLSYWTDECHYTLKH

SEQ ID NO: 1664223 - protein, 23 aa, Staphylococcus aureus
PFFICQILAFSFPTSPHINLLLF

SEQ ID NO: 1664224 - protein, 18 aa, Staphylococcus aureus
PFNPPMFARVFRKHLEGG

SEQ ID NO: 1664225 - protein, 27 aa, Staphylococcus aureus
PFNVDELRARIRVIERIAKSHQETNIV

SEQ ID NO: 1664226 - protein, 25 aa, Staphylococcus aureus
PGEAVRLVKFDDYWQGKPALDKINL

SEQ ID NO: 1664227 - protein, 18 aa, Staphylococcus aureus
PGKKVHLVGHSMGGQTIR

SEQ ID NO: 1664228 - protein, 20 aa, Staphylococcus aureus
PGKLDRLTAAFKNNDNIDMV

SEQ ID NO: 1664229 - protein, 18 aa, Staphylococcus aureus
PHAFKNLFTGDNFGKQVI

SEQ ID NO: 1664230 - protein, 18 aa, Staphylococcus aureus
PHGEFDFADFKITKIMIA

SEQ ID NO: 1664231 - protein, 19 aa, Staphylococcus aureus
PHGVLFRGASEGVIRRYLI

SEQ ID NO: 1664232 - protein, 21 aa, Staphylococcus aureus
PHKLASCIDVANIDTPIKVIL

SEQ ID NO: 1664233 - protein, 18 aa, Staphylococcus aureus
PIDDKGYFNFDFKTKRFD

SEQ ID NO: 1664234 - protein, 23 aa, Staphylococcus aureus
PIGHSLGAFLAQYNLIKHNLANG

SEQ ID NO: 1664235 - protein, 41 aa, Staphylococcus aureus; identical to SEQ ID NO: 1576530

SEQ ID NO: 1664236 - protein, 19 aa, Staphylococcus aureus
PILGELKELIATNKNLFKN

SEQ ID NO: 1664237 - protein, 24 aa, Staphylococcus aureus
PIVMSSRIRLARNLENHVHPLMNA

SEQ ID NO: 1664238 - protein, 27 aa, Staphylococcus aureus
PKAAEDRKNTVLYLMHYHKRITDKQWE

SEQ ID NO: 1664239 - protein, 19 aa, Staphylococcus aureus
PKADVERAMQAVTQANTAL

SEQ ID NO: 1664240 - protein, 27 aa, Staphylococcus aureus
PKAKMPSQLFQFFMSYLLARFDISLAT

SEQ ID NO: 1664241 - protein, 20 aa, Staphylococcus aureus
PKDLRMSDQMSIQYLNNDFW

SEQ ID NO: 1664242 - protein, 18 aa, Staphylococcus aureus
PKERKKKRSDLDIELYDN

SEQ ID NO: 1664243 - protein, 18 aa, Staphylococcus aureus
PKIKAKPAITQMKYSLDF

SEQ ID NO: 1664244 - protein, 21 aa, Staphylococcus aureus
PKKSNAWGWANATRAQTGSAM

SEQ ID NO: 1664245 - protein, 20 aa, Staphylococcus aureus
PKSKPVVEPMAPKKQQETKP

SEQ ID NO: 1664246 - protein, 20 aa, Staphylococcus aureus
PKYEDLRAYYTKPSFEFEKQ

SEQ ID NO: 1664247 - protein, 21 aa, Staphylococcus aureus
PKYEDLRAYYTKPSFEFEKQF

SEQ ID NO: 1664248 - protein, 37 aa, Staphylococcus aureus
PLAKGASYRLEFYRLYLLMVHLLKFGEMYRDSVAHSM

SEQ ID NO: 1664249 - protein, 18 aa, Staphylococcus aureus
PLELTSLLGNISRLDNGH

SEQ ID NO: 1664250 - protein, 18 aa, Staphylococcus aureus
PLEYGLKGLPSIKIKDSH

SEQ ID NO: 1664251 - protein, 17 aa, Staphylococcus aureus
PLGKLSGKHAFSKKLKA

SEQ ID NO: 1664252 - protein, 25 aa, Staphylococcus aureus
PLKPYLPELMKMHKLIYPAGDGRIN

SEQ ID NO: 1664253 - protein, 19 aa, Staphylococcus aureus
PLLTCASWSTQGLHNRGSF

SEQ ID NO: 1664254 - protein, 22 aa, Staphylococcus aureus
PLMRPIEACYARADKQQIAIIE

SEQ ID NO: 1664255 - protein, 19 aa, Staphylococcus aureus
PLMRRLIEQRICDALAGEE

SEQ ID NO: 1664256 - protein, 22 aa, Staphylococcus aureus
PLPLNICVATLFLSCPSRENNT

SEQ ID NO: 1664257 - protein, 25 aa, Staphylococcus aureus
PLTEISIKVFNEFNITEQEASDIIN

SEQ ID NO: 1664258 - protein, 24 aa, Staphylococcus aureus
PMIERLPRELKHISLIQLQNASIA

SEQ ID NO: 1664259 - protein, 18 aa, Staphylococcus aureus
PMIHMLYYHGIAFESHAQ

SEQ ID NO: 1664260 - protein, 37 aa, Staphylococcus aureus
PMIYGAHCPGNFQRLMQLSKRLPIIPNINNQRSALYI

SEQ ID NO: 1664261 - protein, 20 aa, Staphylococcus aureus
PNARIVFKNGMFGVEDDMHG

SEQ ID NO: 1664262 - protein, 28 aa, Staphylococcus aureus
PNEYKKVLRFAVEEAKKGTSLREITIKL

SEQ ID NO: 1664263 - protein, 20 aa, Staphylococcus aureus
PNLPAIMRKAPKKVSIEPVD

SEQ ID NO: 1664264 - protein, 24 aa, Staphylococcus aureus
PNVTGKLHLGHAWDTTLQDIITRM

SEQ ID NO: 1664265 - protein, 19 aa, Staphylococcus aureus
PNYYDNFAIWSIQTNAMHQ

SEQ ID NO: 1664266 - protein, 26 aa, Staphylococcus aureus
PPMIYGAHCPENFQRLMQLSKRLPII

SEQ ID NO: 1664267 - protein, 23 aa, Staphylococcus aureus
PQDKCGIFFTYRVSKMSTKQEQT

SEQ ID NO: 1664268 - protein, 24 aa, Staphylococcus aureus
PQKIVRWRAAMFIFDEGNSEQLPA

SEQ ID NO: 1664269 - protein, 22 aa, Staphylococcus aureus
PQKRLVYYRVVELLEQGKSIST

SEQ ID NO: 1664270 - protein, 17 aa, Staphylococcus aureus
PQLPHVGNWRDKFFKER

SEQ ID NO: 1664271 - protein, 26 aa, Staphylococcus aureus
PRIYSSHPNRIEWEPQFSQYTILALI

SEQ ID NO: 1664272 - protein, 20 aa, Staphylococcus aureus
PRVLICDEITSNLDVIAEQN

SEQ ID NO: 1664273 - protein, 25 aa, Staphylococcus aureus
PSFSPYKILGAILFEQTMDREVEGK

SEQ ID NO: 1664274 - protein, 21 aa, Staphylococcus aureus
PSMKITLSFSEYNTMKTTVTS

SEQ ID NO: 1664275 - protein, 20 aa, Staphylococcus aureus
PSMLNKYFNKLSVFRKLFGN

SEQ ID NO: 1664276 - protein, 17 aa, Staphylococcus aureus
PSQAMDLSTVFAKKKKQ

SEQ ID NO: 1664277 - protein, 24 aa, Staphylococcus aureus
PTDEQWEAMLLGWKVVPSVKSNAI

SEQ ID NO: 1664278 - protein, 23 aa, Staphylococcus aureus
PTISNDFLKLFGHVWLVERWMED

SEQ ID NO: 1664279 - protein, 21 aa, Staphylococcus aureus
PTISNDFLKPFGHVWLVERWM

SEQ ID NO: 1664280 - protein, 24 aa, Staphylococcus aureus
PTKKEGWKARKFEDETGKKSSISK

SEQ ID NO: 1664281 - protein, 18 aa, Staphylococcus aureus
PTPFGLLSGINLGHFVNE

SEQ ID NO: 1664282 - protein, 17 aa, Staphylococcus aureus
PTPTCIVCRNWESNFSL

SEQ ID NO: 1664283 - protein, 18 aa, Staphylococcus aureus
PTPTCIVCRNWESNFSLL

SEQ ID NO: 1664284 - protein, 21 aa, Staphylococcus aureus
PTRSTFETCFAKLEHGVASFA

SEQ ID NO: 1664285 - protein, 24 aa, Staphylococcus aureus
PTTSQPAIGEWITKYEMLRDQGYT

SEQ ID NO: 1664286 - protein, 22 aa, Staphylococcus aureus
PVKGTIYKIYFGFADRQTYEDF

SEQ ID NO: 1664287 - protein, 17 aa, Staphylococcus aureus
PVPELVEGLKLVTEFVQ

SEQ ID NO: 1664288 - protein, 21 aa, Staphylococcus aureus
PVPGGVGPLTITMVLNNTLLA

SEQ ID NO: 1664289 - protein, 20 aa, Staphylococcus aureus
PWRTMPRNAMTVHYSGMTLE

SEQ ID NO: 1664290 - protein, 24 aa, Staphylococcus aureus
PYDYEFYDAIELIGLVNDLCHELN

SEQ ID NO: 1664291 - protein, 21 aa, Staphylococcus aureus
PYFRKEVETLLSNMKLPNFIL

SEQ ID NO: 1664292 - protein, 22 aa, Staphylococcus aureus
PYKKWFERMSDYGFEENIDYVV

SEQ ID NO: 1664293 - protein, 20 aa, Staphylococcus aureus
PYLHPRYKEIGGIINDIPHP

SEQ ID NO: 1664294 - protein, 23 aa, Staphylococcus aureus
PYTDKWKRVSVVLNKDTKQSQKE

SEQ ID NO: 1664295 - protein, 19 aa, Staphylococcus aureus
PYVIVCLNTIVAENDDEAL

SEQ ID NO: 1664296 - protein, 17 aa, Staphylococcus aureus
PYVPKVELHMYGFGSES

SEQ ID NO: 1664297 - protein, 19 aa, Staphylococcus aureus
QAEFKKMGIKLNINGETSD

SEQ ID NO: 1664298 - protein, 28 aa, Staphylococcus aureus
QAISQMTPAFWVYFEFDLQKEEIIDINP

SEQ ID NO: 1664299 - protein, 19 aa, Staphylococcus aureus
QALNGMRIGEMLAIQNEDI

SEQ ID NO: 1664300 - protein, 25 aa, Staphylococcus aureus
QAVAKAEALISATPDVVVTPSEITA

SEQ ID NO: 1664301 - protein, 22 aa, Staphylococcus aureus
QAVGEAFGYYFDRQGQIVHKVK

SEQ ID NO: 1664302 - protein, 17 aa, Staphylococcus aureus
QAYDEKVTAAENIVSGT

SEQ ID NO: 1664303 - protein, 17 aa, Staphylococcus aureus
QCPRLYNVILAGPNIEN

SEQ ID NO: 1664304 - protein, 18 aa, Staphylococcus aureus
QDAKDCLQKGAFVSDKDG

SEQ ID NO: 1664305 - protein, 22 aa, Staphylococcus aureus
QEAFMKGGDFLGAGEFTVKVVN

SEQ ID NO: 1664306 - protein, 23 aa, Staphylococcus aureus
QEGRRFLFETVVKVNHPKHDLTI

SEQ ID NO: 1664307 - protein, 19 aa, Staphylococcus aureus
QEIILRPVDEVKVLLNDLK

SEQ ID NO: 1664308 - protein, 23 aa, Staphylococcus aureus
QFNPDLFYGFQCYDYANMFFMLA

SEQ ID NO: 1664309 - protein, 23 aa, Staphylococcus aureus
QGVGKKLVKAVVEHARENNLKII

SEQ ID NO: 1664310 - protein, 20 aa, Staphylococcus aureus
QHGIKAIIQPGGSIKDQDSI

SEQ ID NO: 1664311 - protein, 19 aa, Staphylococcus aureus
QHGIKAIIQPSGSIKDQDS

SEQ ID NO: 1664312 - protein, 24 aa, Staphylococcus aureus
QHVSDFPRALFMSTNHYHHHIAAN

SEQ ID NO: 1664313 - protein, 17 aa, Staphylococcus aureus
QIHAGGRGKAGGVKITK

SEQ ID NO: 1664314 - protein, 17 aa, Staphylococcus aureus
QKDGLDYLVKRTDHLTC

SEQ ID NO: 1664315 - protein, 21 aa, Staphylococcus aureus
QKDVIKRLVAYLNNEPIGVVD

SEQ ID NO: 1664316 - protein, 19 aa, Staphylococcus aureus
QKERIIIYMKYNVKGFKEI

SEQ ID NO: 1664317 - protein, 20 aa, Staphylococcus aureus
QKGTGKWTSINALELGIPLT

SEQ ID NO: 1664318 - protein, 22 aa, Staphylococcus aureus
QKGYKSDLNWNYINSKDNVDEF

SEQ ID NO: 1664319 - protein, 26 aa, Staphylococcus aureus
QKKVSHKNIKYRGFAINKEMLEELGF

SEQ ID NO: 1664320 - protein, 17 aa, Staphylococcus aureus
QKNKYRITDVIFDAVTE

SEQ ID NO: 1664321 - protein, 17 aa, Staphylococcus aureus
QKNKYRITDVIFNAVTE

SEQ ID NO: 1664322 - protein, 22 aa, Staphylococcus aureus
QKVLDIISDVPLFKRTKQDIHE

SEQ ID NO: 1664323 - protein, 18 aa, Staphylococcus aureus
QLDLTVFFDGNRSASRDI

SEQ ID NO: 1664324 - protein, 23 aa, Staphylococcus aureus
QLEVPIPAIISAFEIAKSHGVTT

SEQ ID NO: 1664325 - protein, 23 aa, Staphylococcus aureus
QLFYCAPEQLLGLKDSSKRSDVF

SEQ ID NO: 1664326 - protein, 18 aa, Staphylococcus aureus
QLIQFVILSKFGYMNVEN

SEQ ID NO: 1664327 - protein, 19 aa, Staphylococcus aureus
QLLIGYAGTNPFSLNDIRT

SEQ ID NO: 1664328 - protein, 30 aa, Staphylococcus aureus
QNALDFPLPKAFRDAGWFLDVLPGHYNGAL

SEQ ID NO: 1664329 - protein, 22 aa, Staphylococcus aureus
QNDCPPCTFVKNYLNERQIDFE

SEQ ID NO: 1664330 - protein, 23 aa, Staphylococcus aureus
QNEYEVFFDRSFLLDNNFLNKKH

SEQ ID NO: 1664331 - protein, 21 aa, Staphylococcus aureus
QNGFRAYVFAPVIKGKVDTGQ

SEQ ID NO: 1664332 - protein, 20 aa, Staphylococcus aureus
QNHVQIMAWSPFAGGKIFDK

SEQ ID NO: 1664333 - protein, 23 aa, Staphylococcus aureus
QNIESLRFGNTIFEPLWNNKYIS

SEQ ID NO: 1664334 - protein, 19 aa, Staphylococcus aureus
QNLKRKIIYASHAQISEQL

SEQ ID NO: 1664335 - protein, 18 aa, Staphylococcus aureus
QNLLGGNVAGIWKDNSFF

SEQ ID NO: 1664336 - protein, 28 aa, Staphylococcus aureus
QNSFEVFCTLAYTGMRAGELLALKWSDI

SEQ ID NO: 1664337 - protein, 24 aa, Staphylococcus aureus
QNVSRLSKYYGHTIGYISQNYAES

SEQ ID NO: 1664338 - protein, 23 aa, Staphylococcus aureus
QNYYKYRKFGILPETEYEINKVK

SEQ ID NO: 1664339 - protein, 21 aa, Staphylococcus aureus
QPAPADHPWRTMPRNAMTVHY

SEQ ID NO: 1664340 - protein, 26 aa, Staphylococcus aureus
QPGTETIYRFSLLVPNQVALHYFEKR

SEQ ID NO: 1664341 - protein, 24 aa, Staphylococcus aureus
QPIRLEPMNTFPVIRDLQVDRSRM

SEQ ID NO: 1664342 - protein, 25 aa, Staphylococcus aureus
QQAVSRISPKMGMMKSSVLNQSRNF

SEQ ID NO: 1664343 - protein, 18 aa, Staphylococcus aureus
QQIEAIIVTGTRAEELQL

SEQ ID NO: 1664344 - protein, 24 aa, Staphylococcus aureus
QQKIKVHLKPSVQLIANVVQTKTL

SEQ ID NO: 1664345 - protein, 17 aa, Staphylococcus aureus
QQQLRYFFSHNHSLPSS

SEQ ID NO: 1664346 - protein, 18 aa, Staphylococcus aureus
QQREIVFPISTDNASWGG

SEQ ID NO: 1664347 - protein, 30 aa, Staphylococcus aureus
QQSFANCKQLRQVYPNGVTADHPAYRPHLD

SEQ ID NO: 1664348 - protein, 17 aa, Staphylococcus aureus
QRFYIMDKQGLLFDDMD

SEQ ID NO: 1664349 - protein, 21 aa, Staphylococcus aureus
QRIQYQLKHHKIDLITDNGVF

SEQ ID NO: 1664350 - protein, 17 aa, Staphylococcus aureus
QRLGEPEAEIVKGRVRY

SEQ ID NO: 1664351 - protein, 24 aa, Staphylococcus aureus
QRLKEIRSYAIGLGPDYTDLTEQN

SEQ ID NO: 1664352 - protein, 21 aa, Staphylococcus aureus
QRLSDFKSMLAYNETNYAALV

SEQ ID NO: 1664353 - protein, 21 aa, Staphylococcus aureus
QRLVNRIIVLKNGMIVDDFTI

SEQ ID NO: 1664354 - protein, 24 aa, Staphylococcus aureus
QRNATELNTAMGQLQHAIADKTTT

SEQ ID NO: 1664355 - protein, 17 aa, Staphylococcus aureus
QRRKHLKQNIASPSTTD

SEQ ID NO: 1664356 - protein, 30 aa, Staphylococcus aureus
QSFANCKQLRQVYPNGVTADHPAYRPHLDR

SEQ ID NO: 1664357 - protein, 22 aa, Staphylococcus aureus
QSGYAAFVVFNMMFGGDPSSVL

SEQ ID NO: 1664358 - protein, 19 aa, Staphylococcus aureus
QTKVPAVLLELGYISNPTD

SEQ ID NO: 1664359 - protein, 18 aa, Staphylococcus aureus
QTQVYGALGVIWRENIYH

SEQ ID NO: 1664360 - protein, 20 aa, Staphylococcus aureus
QVEEFECVSERGAKGFGSSG

SEQ ID NO: 1664361 - protein, 23 aa, Staphylococcus aureus
QVEKQLLVRIGLMANHVNVILIA

SEQ ID NO: 1664362 - protein, 26 aa, Staphylococcus aureus
QVIKKDGYWWIRFKYQREGSSTNNFY

SEQ ID NO: 1664363 - protein, 19 aa, Staphylococcus aureus
QVKSAILFASLFSKESTII

SEQ ID NO: 1664364 - protein, 17 aa, Staphylococcus aureus
QVNEITGNIDFDNLNQY

SEQ ID NO: 1664365 - protein, 22 aa, Staphylococcus aureus
QWNHKYKTVGMMLFNEQRQFLQ

SEQ ID NO: 1664366 - protein, 19 aa, Staphylococcus aureus
QYAELLVKVGMNVQPKQPV

SEQ ID NO: 1664367 - protein, 18 aa, Staphylococcus aureus
QYGAVYLVNLFSNIRTPE

SEQ ID NO: 1664368 - protein, 39 aa, Staphylococcus aureus
QYKDIDYPIAIVFQASCFNEFVVKGRLSNIISKLQHYSI

SEQ ID NO: 1664369 - protein, 18 aa, Staphylococcus aureus
QYRARILVAGAVEVQALT

SEQ ID NO: 1664370 - protein, 19 aa, Staphylococcus aureus
QYRLKIVLNAESEFETIVS

SEQ ID NO: 1664371 - protein, 23 aa, Staphylococcus aureus
RAFIKRGLLQFSDGNGFQCGIWY

SEQ ID NO: 1664372 - protein, 18 aa, Staphylococcus aureus
RAHPNRMLMHNGEINTIK

SEQ ID NO: 1664373 - protein, 18 aa, Staphylococcus aureus
RALYRGKAHHVVNFMHFI

SEQ ID NO: 1664374 - protein, 27 aa, Staphylococcus aureus
RARMFEIMEMYKPYAVYHAAAHKHVPL

SEQ ID NO: 1664375 - protein, 20 aa, Staphylococcus aureus
RDAIKNVALMIGIPPGLIYR

SEQ ID NO: 1664376 - protein, 18 aa, Staphylococcus aureus
RDAVIKLGQLFENIRECG

SEQ ID NO: 1664377 - protein, 31 aa, Staphylococcus aureus
RDFEEMQPLYEWLGLTASLGFVDIVDYEYQK

SEQ ID NO: 1664378 - protein, 23 aa, Staphylococcus aureus
RDIFFEKALKVIRPVYLNQSTIP

SEQ ID NO: 1664379 - protein, 21 aa, Staphylococcus aureus
RDINSYFLIITYRIDKESKQL

SEQ ID NO: 1664380 - protein, 25 aa, Staphylococcus aureus
RDKVCALEVFVECFGKDKGDSRGSM

SEQ ID NO: 1664381 - protein, 22 aa, Staphylococcus aureus
RDLEMNTRFFVVTTSYIDKIEQ

SEQ ID NO: 1664382 - protein, 31 aa, Staphylococcus aureus
RDLLAAKGLELGCLFAFYGHTHVAKYEYING

SEQ ID NO: 1664383 - protein, 25 aa, Staphylococcus aureus
RDNHSAYAFIKRLIKQFGKPQMIIT

SEQ ID NO: 1664384 - protein, 18 aa, Staphylococcus aureus
RDRLNLSIKNNWVDEDGN

SEQ ID NO: 1664385 - protein, 19 aa, Staphylococcus aureus
RDSCYFLAMGYFYNKEDSN

SEQ ID NO: 1664386 - protein, 23 aa, Staphylococcus aureus
RDSIRKVRIGTFLNGDYDGKLMK

SEQ ID NO: 1664387 - protein, 24 aa, Staphylococcus aureus
RDVGLRKTIIYVMLPVLGNTVQSL

SEQ ID NO: 1664388 - protein, 23 aa, Staphylococcus aureus
READFINCVTFRKQADNVNNYLS

SEQ ID NO: 1664389 - protein, 35 aa, Staphylococcus aureus
REAILKRYNFISVLGWPTYYANLGYQRASMYDIYP

SEQ ID NO: 1664390 - protein, 18 aa, Staphylococcus aureus
REDVATVIKEIVTSNHFN

SEQ ID NO: 1664391 - protein, 18 aa, Staphylococcus aureus
REDVATVLKEIVTSNHFN

SEQ ID NO: 1664392 - protein, 20 aa, Staphylococcus aureus
REIRLRPSYFPFTEPSVEVD

SEQ ID NO: 1664393 - protein, 25 aa, Staphylococcus aureus
RELVLRINNLLTRMKKYHHQPVEQL

SEQ ID NO: 1664394 - protein, 24 aa, Staphylococcus aureus
REQILKIQIEFLIAYATAQTELSM

SEQ ID NO: 1664395 - protein, 18 aa, Staphylococcus aureus
RERPGRGYIHHIAVNTPQ

SEQ ID NO: 1664396 - protein, 30 aa, Staphylococcus aureus
REVFKKEGLEPWTSCEFDFTRDGKLNVSFD

SEQ ID NO: 1664397 - protein, 17 aa, Staphylococcus aureus
RFGRTPLLDAMEMANEH

SEQ ID NO: 1664398 - protein, 23 aa, Staphylococcus aureus
RFHGKIVSKFCAKYFTHINIIND

SEQ ID NO: 1664399 - protein, 26 aa, Staphylococcus aureus
RFHKKSLPVPKYRYFKLNNKKIQKML

SEQ ID NO: 1664400 - protein, 17 aa, Staphylococcus aureus
RFIQPELDRYHSKGLES

SEQ ID NO: 1664401 - protein, 20 aa, Staphylococcus aureus
RFISEFKYSYNYQKKENLVY

SEQ ID NO: 1664402 - protein, 18 aa, Staphylococcus aureus
RGDIFVRDAIKEHMASLV

SEQ ID NO: 1664403 - protein, 19 aa, Staphylococcus aureus
RGFEIPSFNFVTEKENVKG

SEQ ID NO: 1664404 - protein, 22 aa, Staphylococcus aureus
RGGFTTVCPMPNTRPVLDSVEH

SEQ ID NO: 1664405 - protein, 17 aa, Staphylococcus aureus
RGLSPWPVAYTTMDDIN

SEQ ID NO: 1664406 - protein, 20 aa, Staphylococcus aureus
RGMIKWAPFIICTNLIKNLI

SEQ ID NO: 1664407 - protein, 18 aa, Staphylococcus aureus
RGVCTRVGTMTPRKPNSA

SEQ ID NO: 1664408 - protein, 21 aa, Staphylococcus aureus
RHGQTLFNFKGLIQGFGDSPL

SEQ ID NO: 1664409 - protein, 19 aa, Staphylococcus aureus
RHNGTIINIFDDMSEKDKE

SEQ ID NO: 1664410 - protein, 21 aa, Staphylococcus aureus
RHRLKRPLILLNWNTLTGDTF

SEQ ID NO: 1664411 - protein, 17 aa, Staphylococcus aureus
RIDEVLGNRFDDKLHSV

SEQ ID NO: 1664412 - protein, 23 aa, Staphylococcus aureus
RISEAGFEYKLNADLSPKFVVGY

SEQ ID NO: 1664413 - protein, 17 aa, Staphylococcus aureus
RIYCFIRADNEEIAWYK

SEQ ID NO: 1664414 - protein, 21 aa, Staphylococcus aureus
RKIIEGFKHLTPNTNYYRTVM

SEQ ID NO: 1664415 - protein, 17 aa, Staphylococcus aureus
RKIPRKYLNPKIPQGRG

SEQ ID NO: 1664416 - protein, 28 aa, Staphylococcus aureus
RKLGEFKNYLGGIGKSFKEKFSKDMKDG

SEQ ID NO: 1664417 - protein, 23 aa, Staphylococcus aureus
RKLKRFVSTISREINRNNVNQSY

SEQ ID NO: 1664418 - protein, 18 aa, Staphylococcus aureus
RKQHQLFTLKYSKQNSET

SEQ ID NO: 1664419 - protein, 20 aa, Staphylococcus aureus
RKSIEDLNITKGHEVMEKYG

SEQ ID NO: 1664420 - protein, 17 aa, Staphylococcus aureus
RKTIILCECKANLQREF

SEQ ID NO: 1664421 - protein, 19 aa, Staphylococcus aureus
RKVKIGKTIRYDRQDIENV

SEQ ID NO: 1664422 - protein, 17 aa, Staphylococcus aureus
RKYGISITTIVQSISQA

SEQ ID NO: 1664423 - protein, 29 aa, Staphylococcus aureus
RKYKCNSYWLYKFRNIRESKYKRRTFKYS

SEQ ID NO: 1664424 - protein, 17 aa, Staphylococcus aureus
RKYWYKKPHFSRIAQIA

SEQ ID NO: 1664425 - protein, 19 aa, Staphylococcus aureus
RLEEQGIQAIKEGQFAVLL

SEQ ID NO: 1664426 - protein, 18 aa, Staphylococcus aureus
RLESFIMLELQRIKGASV

SEQ ID NO: 1664427 - protein, 19 aa, Staphylococcus aureus
RLFYLAMNPQFFKIITQSI

SEQ ID NO: 1664428 - protein, 18 aa, Staphylococcus aureus
RLGAKRADGQFVTGGSIL

SEQ ID NO: 1664429 - protein, 20 aa, Staphylococcus aureus
RLKYIKSLYTELGKITDIVN

SEQ ID NO: 1664430 - protein, 28 aa, Staphylococcus aureus
RLQEEYNKRLKEELSRRMKQKEKEKQEA

SEQ ID NO: 1664431 - protein, 19 aa, Staphylococcus aureus
RLTNNITWADNRAAKYATI

SEQ ID NO: 1664432 - protein, 19 aa, Staphylococcus aureus
RLVGEEIFANKCLANNDVQ

SEQ ID NO: 1664433 - protein, 18 aa, Staphylococcus aureus
RLYEESYILLAPKETFKN

SEQ ID NO: 1664434 - protein, 24 aa, Staphylococcus aureus
RMAMSHPDIRIALISDGKTMLSTN

SEQ ID NO: 1664435 - protein, 19 aa, Staphylococcus aureus
RMFEEAGFINVRVRSFTGG

SEQ ID NO: 1664436 - protein, 21 aa, Staphylococcus aureus
RMHAKGSGAFGTFTVTKDIIK

SEQ ID NO: 1664437 - protein, 22 aa, Staphylococcus aureus
RMTRIAQTINRFGYTIRGIYGE

SEQ ID NO: 1664438 - protein, 23 aa, Staphylococcus aureus
RNLMKQKLEMLGEDIDKNKKSLQ

SEQ ID NO: 1664439 - protein, 24 aa, Staphylococcus aureus
RNNILKFSLFTGENHIVINADDIN

SEQ ID NO: 1664440 - protein, 31 aa, Staphylococcus aureus
RNPYVRHIAHPTGRIIGRRDGYKPNIEQLMA

SEQ ID NO: 1664441 - protein, 19 aa, Staphylococcus aureus
RNQHQRFLIVFSDGEPSAF

SEQ ID NO: 1664442 - protein, 18 aa, Staphylococcus aureus
RNQLPISYLYEGVGILET

SEQ ID NO: 1664443 - protein, 26 aa, Staphylococcus aureus
RPDKLNKCFYKYYGLNKLINLLIKEK

SEQ ID NO: 1664444 - protein, 18 aa, Staphylococcus aureus
RPKGQRVSNMMIRGHAVD

SEQ ID NO: 1664445 - protein, 18 aa, Staphylococcus aureus
RPVVIRRELLDHYSELGL

SEQ ID NO: 1664446 - protein, 22 aa, Staphylococcus aureus
RPYLKLAEPILEKHNIYYGQWL

SEQ ID NO: 1664447 - protein, 18 aa, Staphylococcus aureus
RQKLTMIFNQFNQMSLSH

SEQ ID NO: 1664448 - protein, 23 aa, Staphylococcus aureus
RQMKTFKTELIKMNASYQTRLKN

SEQ ID NO: 1664449 - protein, 21 aa, Staphylococcus aureus
RRDGYKPNIEQLMALAEETNT

SEQ ID NO: 1664450 - protein, 20 aa, Staphylococcus aureus
RRELLDHYSELGLDEQDLVI

SEQ ID NO: 1664451 - protein, 19 aa, Staphylococcus aureus
RRFEIKRGDKVTGKVRKPK

SEQ ID NO: 1664452 - protein, 17 aa, Staphylococcus aureus
RRKDLIISGGENIYPYQ

SEQ ID NO: 1664453 - protein, 22 aa, Staphylococcus aureus
RRLEKPKGIMIRNAQTMSSVEN

SEQ ID NO: 1664454 - protein, 24 aa, Staphylococcus aureus
RRNRSKVRLALKRGTTVERSDRDG

SEQ ID NO: 1664455 - protein, 21 aa, Staphylococcus aureus
RRPVHLHLPIDVAISEIEIPR

SEQ ID NO: 1664456 - protein, 18 aa, Staphylococcus aureus
RRVLEGLVGAKIIKDKKY

SEQ ID NO: 1664457 - protein, 21 aa, Staphylococcus aureus
RRWGAPFPVIEIVKLGINKQE

SEQ ID NO: 1664458 - protein, 17 aa, Staphylococcus aureus
RSFAVYFSPEIKKFIAD

SEQ ID NO: 1664459 - protein, 35 aa, Staphylococcus aureus
RSITNGRLEPQWTVPNEHKSTVLFDGGANGVGTTI

SEQ ID NO: 1664460 - protein, 23 aa, Staphylococcus aureus
RSRDSLREWLPWVDATEQPSDTR

SEQ ID NO: 1664461 - protein, 18 aa, Staphylococcus aureus
RSYQNVRFELQHRKHVEK

SEQ ID NO: 1664462 - protein, 25 aa, Staphylococcus aureus
RTADGEPIVYCLDKIAKKELTCTEY

SEQ ID NO: 1664463 - protein, 17 aa, Staphylococcus aureus
RTARFTNGLSVNDFLTR

SEQ ID NO: 1664464 - protein, 26 aa, Staphylococcus aureus
RTDHIRHLLEFKACTSIDIDQVEPVS

SEQ ID NO: 1664465 - protein, 22 aa, Staphylococcus aureus
RTDVYDFYSLGFGEPYPISGSH

SEQ ID NO: 1664466 - protein, 17 aa, Staphylococcus aureus
RTGKRLGKKATEIVIEF

SEQ ID NO: 1664467 - protein, 24 aa, Staphylococcus aureus
RTLYNFIWDDFCDWYIEMSKIPMN

SEQ ID NO: 1664468 - protein, 24 aa, Staphylococcus aureus
RTTSWTSYQTRYEVLKQLCTTYKM

SEQ ID NO: 1664469 - protein, 23 aa, Staphylococcus aureus
RTVEIFKKIILENKMLKRWNSSY

SEQ ID NO: 1664470 - protein, 25 aa, Staphylococcus aureus
RTWKGKRSTDDIFTRLKDGHLRFRN

SEQ ID NO: 1664471 - protein, 18 aa, Staphylococcus aureus
RVDDETYYVFVDKFVSAV

SEQ ID NO: 1664472 - protein, 18 aa, Staphylococcus aureus
RVKQHANDLVRFVQQQLH

SEQ ID NO: 1664473 - protein, 17 aa, Staphylococcus aureus
RVRLSGVKLKEIIAKSN

SEQ ID NO: 1664474 - protein, 18 aa, Staphylococcus aureus
RVRLSGVKLKEIITKSNK

SEQ ID NO: 1664475 - protein, 21 aa, Staphylococcus aureus
RWEDKLPELAKHTSKRERRAI

SEQ ID NO: 1664476 - protein, 21 aa, Staphylococcus aureus
RYGKTYKGIMPNWEPGKKVHL

SEQ ID NO: 1664477 - protein, 20 aa, Staphylococcus aureus
RYIDGELWIYSAVLDSNKNN

SEQ ID NO: 1664478 - protein, 25 aa, Staphylococcus aureus
RYLNDIEFDLPLIIRNEKLSPGGEK

SEQ ID NO: 1664479 - protein, 27 aa, Staphylococcus aureus
SAAIRLSCKGLQQFSHAKTKQIVLSID

SEQ ID NO: 1664480 - protein, 21 aa, Staphylococcus aureus
SADFRRGEAIFELSDDQIEKA

SEQ ID NO: 1664481 - protein, 23 aa, Staphylococcus aureus
SANRLIGAVLMDLHDEWIYSSRK

SEQ ID NO: 1664482 - protein, 17 aa, Staphylococcus aureus
SASQPTVKIWTGTENEY

SEQ ID NO: 1664483 - protein, 21 aa, Staphylococcus aureus
SAYAFIKRLIKQFGKPQKVIT

SEQ ID NO: 1664484 - protein, 17 aa, Staphylococcus aureus
SCPQCSAPMAASNTTNT

SEQ ID NO: 1664485 - protein, 27 aa, Staphylococcus aureus
SDFPKDYKGIAGWVLEVKSNTPGNTTQ

SEQ ID NO: 1664486 - protein, 17 aa, Staphylococcus aureus
SDFYYFVKHNQKLTKQQ

SEQ ID NO: 1664487 - protein, 18 aa, Staphylococcus aureus
SDIFMYKTLIDAYNRRLS

SEQ ID NO: 1664488 - protein, 17 aa, Staphylococcus aureus
SDIFTRNLFSVKDIKKI

SEQ ID NO: 1664489 - protein, 17 aa, Staphylococcus aureus
SDIVAFIFNVSFEALSS

SEQ ID NO: 1664490 - protein, 17 aa, Staphylococcus aureus
SDLHILQPDWKTIQRTA

SEQ ID NO: 1664491 - protein, 25 aa, Staphylococcus aureus
SDLKHFKGAHGLLYEQELGLQVTIF

SEQ ID NO: 1664492 - protein, 24 aa, Staphylococcus aureus
SDNDRAMFEFGYYTVAMKNARPEI

SEQ ID NO: 1664493 - protein, 18 aa, Staphylococcus aureus
SDWLSTNFGVRFRYNALG

SEQ ID NO: 1664494 - protein, 23 aa, Staphylococcus aureus
SEAGQAKGYRRVTINDGIINDLF

SEQ ID NO: 1664495 - protein, 23 aa, Staphylococcus aureus
SEEIPHAIGVNVDRMVKESEDRV

SEQ ID NO: 1664496 - protein, 17 aa, Staphylococcus aureus
SEETEAKKGFWSRLFGN

SEQ ID NO: 1664497 - protein, 18 aa, Staphylococcus aureus
SEETWTTFFEYLKERGLQ

SEQ ID NO: 1664498 - protein, 21 aa, Staphylococcus aureus
SEFKLQMVRLYEYGRPRNEIL

SEQ ID NO: 1664499 - protein, 25 aa, Staphylococcus aureus
SEFQLRARLFVDQIVSFVNNSPYEH

SEQ ID NO: 1664500 - protein, 21 aa, Staphylococcus aureus
SEGKLKVSFDYIDWKNTEFDQ

SEQ ID NO: 1664501 - protein, 18 aa, Staphylococcus aureus
SEINSFVAELGSTYYTRG

SEQ ID NO: 1664502 - protein, 24 aa, Staphylococcus aureus
SEKRYFILNFFRRGTTLVGNEAIT

SEQ ID NO: 1664503 - protein, 19 aa, Staphylococcus aureus
SELALKMMRLTYCEKSPSG

SEQ ID NO: 1664504 - protein, 17 aa, Staphylococcus aureus
SENFRIFDFELSDEQMT

SEQ ID NO: 1664505 - protein, 24 aa, Staphylococcus aureus
SEPIKRIANHRVLAVNRGRKRESI

SEQ ID NO: 1664506 - protein, 30 aa, Staphylococcus aureus
SERFKELVDLFNKRYDIIIVDTPPVNTVTD

SEQ ID NO: 1664507 - protein, 20 aa, Staphylococcus aureus
SESLKYLLNVNHQRLSDFKS

SEQ ID NO: 1664508 - protein, 17 aa, Staphylococcus aureus
SEVLKALNLTLEDIAYQ

SEQ ID NO: 1664509 - protein, 21 aa, Staphylococcus aureus
SEYKKICKNFEDYDPFSNFMY

SEQ ID NO: 1664510 - protein, 18 aa, Staphylococcus aureus
SFDIPLVVRNDYLSHNGI

SEQ ID NO: 1664511 - protein, 18 aa, Staphylococcus aureus
SFTGVEFFNTVFKGTSYK

SEQ ID NO: 1664512 - protein, 27 aa, Staphylococcus aureus
SFTRLQIMSFFSSLWISSYSIELDENK

SEQ ID NO: 1664513 - protein, 19 aa, Staphylococcus aureus
SGAPRLQSNLFHIVKEFVD

SEQ ID NO: 1664514 - protein, 29 aa, Staphylococcus aureus
SGDYIKLVMKLGIEYFLPVKDVFNNEVWV

SEQ ID NO: 1664515 - protein, 22 aa, Staphylococcus aureus
SGGQRQRVWIAMALAQRTDIIF

SEQ ID NO: 1664516 - protein, 39 aa, Staphylococcus aureus
SGIFDRYPKLNMIIGHWGEFIPFFLERMDEALFAEHLNH

SEQ ID NO: 1664517 - protein, 18 aa, Staphylococcus aureus
SGKQRPWREKKIDNVSYA

SEQ ID NO: 1664518 - protein, 20 aa, Staphylococcus aureus
SHAFLLPLMQLIDSEIKEPQ

SEQ ID NO: 1664519 - protein, 22 aa, Staphylococcus aureus
SHINTGVGFLNHMLTLFTFHSG

SEQ ID NO: 1664520 - protein, 17 aa, Staphylococcus aureus
SHLNKSLVHKITNVLKD

SEQ ID NO: 1664521 - protein, 23 aa, Staphylococcus aureus
SHPILTKKAQAVVKFDDSLKRLL

SEQ ID NO: 1664522 - protein, 21 aa, Staphylococcus aureus
SIEECKIVFINNIKRFNQLTG

SEQ ID NO: 1664523 - protein, 18 aa, Staphylococcus aureus
SIELLEAEGFIYTKVGSG

SEQ ID NO: 1664524 - protein, 17 aa, Staphylococcus aureus
SIKDYKVAPTIHAVTPD

SEQ ID NO: 1664525 - protein, 31 aa, Staphylococcus aureus
SIKLPEKLLCAWLNSIRFLRNRIAHTDIIYG

SEQ ID NO: 1664526 - protein, 18 aa, Staphylococcus aureus
SIPCKPTKVNGGRTRNLP

SEQ ID NO: 1664527 - protein, 25 aa, Staphylococcus aureus
SIPEKAGGITSVMLNRSKLLAEKGY

SEQ ID NO: 1664528 - protein, 23 aa, Staphylococcus aureus
SIRALLDLCDLITVMPVERAIKR

SEQ ID NO: 1664529 - protein, 29 aa, Staphylococcus aureus
SISVIIFETLIRIYWFYKQYFYYGKSLKE

SEQ ID NO: 1664530 - protein, 18 aa, Staphylococcus aureus
SKDGYYLVYLFHPEGEGI

SEQ ID NO: 1664531 - protein, 20 aa, Staphylococcus aureus
SKEILKLPIRTWFDKYESEI

SEQ ID NO: 1664532 - protein, 25 aa, Staphylococcus aureus
SKEVLNFKNNKAFHSYWLDKNLTSN

SEQ ID NO: 1664533 - protein, 20 aa, Staphylococcus aureus
SKFDILSWLQDPFATPTLGK

SEQ ID NO: 1664534 - protein, 18 aa, Staphylococcus aureus
SKINWSKLVNKLSVPIEA

SEQ ID NO: 1664535 - protein, 18 aa, Staphylococcus aureus
SKKFKEKKNIIVKKYAVN

SEQ ID NO: 1664536 - protein, 20 aa, Staphylococcus aureus
SKKYKSFMHHINKDYRTLKN

SEQ ID NO: 1664537 - protein, 20 aa, Staphylococcus aureus
SKLTDCADLVLLTTDQSRNN

SEQ ID NO: 1664538 - protein, 25 aa, Staphylococcus aureus
SKMIKETVCQLEIKLDTGRTHQIRV

SEQ ID NO: 1664539 - protein, 25 aa, Staphylococcus aureus
SKPEKLKTYRMVFNTISVEKMNAIL

SEQ ID NO: 1664540 - protein, 17 aa, Staphylococcus aureus
SKQFWAYLVKTGQLENP

SEQ ID NO: 1664541 - protein, 25 aa, Staphylococcus aureus
SKSIFPSCRVAYMVLPYSIMKKYHS

SEQ ID NO: 1664542 - protein, 27 aa, Staphylococcus aureus
SKTDAARAIDALPHLNNAQKADVKSKI

SEQ ID NO: 1664543 - protein, 17 aa, Staphylococcus aureus
SKVIFCEADDWKPFYEA

SEQ ID NO: 1664544 - protein, 26 aa, Staphylococcus aureus
SKVNLKKIYTCLVYGKTHTSGIIEAN

SEQ ID NO: 1664545 - protein, 19 aa, Staphylococcus aureus
SKYAKNIYLNFKKIFSNLE

SEQ ID NO: 1664546 - protein, 18 aa, Staphylococcus aureus
SLGSHDGVGMVFDKPIAG

SEQ ID NO: 1664547 - protein, 21 aa, Staphylococcus aureus
SLNPSIAYFLKHKPITMNDQN

SEQ ID NO: 1664548 - protein, 25 aa, Staphylococcus aureus
SLPMNRLRFTLAHEYGHFVMGHTGV

SEQ ID NO: 1664549 - protein, 20 aa, Staphylococcus aureus
SLQYQRFIRHVQFLIRRLRR

SEQ ID NO: 1664550 - protein, 17 aa, Staphylococcus aureus
SLYRAVNDINLGIRKGE

SEQ ID NO: 1664551 - protein, 23 aa, Staphylococcus aureus
SLYSKLDLIMGYKDEERANKKAV

SEQ ID NO: 1664552 - protein, 17 aa, Staphylococcus aureus
SMIKIVLLCGSGIGTSQ

SEQ ID NO: 1664553 - protein, 23 aa, Staphylococcus aureus
SMKKGETNFAFTDDRGTDSLDKD

SEQ ID NO: 1664554 - protein, 26 aa, Staphylococcus aureus
SMPDFKRLNGLMIGFVIKGEAHIYDE

SEQ ID NO: 1664555 - protein, 20 aa, Staphylococcus aureus
SMPKWSKLVNKLSVPIEANY

SEQ ID NO: 1664556 - protein, 18 aa, Staphylococcus aureus
SNAWGWANATRAQTSSAM

SEQ ID NO: 1664557 - protein, 31 aa, Staphylococcus aureus
SNDAKIAYAILRDRLQLSIKNNWIDTEGNIY

SEQ ID NO: 1664558 - protein, 20 aa, Staphylococcus aureus
SNIESKIFIKGYTITNKSVT

SEQ ID NO: 1664559 - protein, 28 aa, Staphylococcus aureus
SNISWKAKGILLYLLSRPDNWQIYETEL

SEQ ID NO: 1664560 - protein, 28 aa, Staphylococcus aureus
SNIVYIRWFEDLRTAFINQHMHYSTMIN

SEQ ID NO: 1664561 - protein, 27 aa, Staphylococcus aureus
SNIVYIRWFEDLRTAFINQHMNYSTMI

SEQ ID NO: 1664562 - protein, 21 aa, Staphylococcus aureus
SNKLNKYSIRKFTVGTASILI

SEQ ID NO: 1664563 - protein, 19 aa, Staphylococcus aureus
SNQDFKGLVPNLNQNDNYS

SEQ ID NO: 1664564 - protein, 19 aa, Staphylococcus aureus
SNSTMCQRISALAEQLKIQ

SEQ ID NO: 1664565 - protein, 23 aa, Staphylococcus aureus
SNTGNRMFKRYAVITTSAKILGR

SEQ ID NO: 1664566 - protein, 20 aa, Staphylococcus aureus
SPDVYPGMEEQLLASLKKHH

SEQ ID NO: 1664567 - protein, 25 aa, Staphylococcus aureus
SPEDFYEVMRLIAVEILNTDLEEAH

SEQ ID NO: 1664568 - protein, 18 aa, Staphylococcus aureus
SPELIKQPAAAVLVNDDE

SEQ ID NO: 1664569 - protein, 18 aa, Staphylococcus aureus
SPEQWYSMIEDFKVTIWY

SEQ ID NO: 1664570 - protein, 26 aa, Staphylococcus aureus
SPFDDSFSGFIFKIQANMDPKHRDRI

SEQ ID NO: 1664571 - protein, 19 aa, Staphylococcus aureus
SPLLARVTGAGCLLGGIIA

SEQ ID NO: 1664572 - protein, 17 aa, Staphylococcus aureus
SQFPYNNIEWLIKEGYG

SEQ ID NO: 1664573 - protein, 25 aa, Staphylococcus aureus
SQHPQLKICACLGLTNDEQAKKLKA

SEQ ID NO: 1664574 - protein, 18 aa, Staphylococcus aureus
SQHPRLILQSNIQTESLR

SEQ ID NO: 1664575 - protein, 17 aa, Staphylococcus aureus
SQLTIMCKLGMGPNKEK

SEQ ID NO: 1664576 - protein, 24 aa, Staphylococcus aureus
SQYDLVSIFEYCLNAAVDRSIELS

SEQ ID NO: 1664577 - protein, 24 aa, Staphylococcus aureus
SRLANEKHIDWLVKAVIVAKRQVP

SEQ ID NO: 1664578 - protein, 17 aa, Staphylococcus aureus
SRLKRILEQSIPNKEYI

SEQ ID NO: 1664579 - protein, 18 aa, Staphylococcus aureus
SRNRCLNLSRFLSLSRYL

SEQ ID NO: 1664580 - protein, 18 aa, Staphylococcus aureus
SRSNTLIELSKMLEKGYT

SEQ ID NO: 1664581 - protein, 18 aa, Staphylococcus aureus
SRTLKILAEQNVEAYQIG

SEQ ID NO: 1664582 - protein, 21 aa, Staphylococcus aureus
SSAIEAVIGFLYLEKREERLE

SEQ ID NO: 1664583 - protein, 18 aa, Staphylococcus aureus
SSEFKLQVVRLYENGKLK

SEQ ID NO: 1664584 - protein, 24 aa, Staphylococcus aureus
SSFKDTEFHKMFNFKDKEFAQDAV

SEQ ID NO: 1664585 - protein, 23 aa, Staphylococcus aureus
SSFKDTEFHKMFNFKDKEFAQGA

SEQ ID NO: 1664586 - protein, 17 aa, Staphylococcus aureus
SSKIKINSMENVSFELL

SEQ ID NO: 1664587 - protein, 18 aa, Staphylococcus aureus
SSNEKGWIAGWHTNLDIV

SEQ ID NO: 1664588 - protein, 25 aa, Staphylococcus aureus
SSPRGIYCGAIGLLLPTEDDKMIFN

SEQ ID NO: 1664589 - protein, 19 aa, Staphylococcus aureus
SSTKLKADIDFDDSGAKDF

SEQ ID NO: 1664590 - protein, 20 aa, Staphylococcus aureus
STFMRNGLAIPHGTDEAKTN

SEQ ID NO: 1664591 - protein, 18 aa, Staphylococcus aureus
STGLPHEHFTVARDNQTF

SEQ ID NO: 1664592 - protein, 17 aa, Staphylococcus aureus
STPLYWYSMSASLKLFI

SEQ ID NO: 1664593 - protein, 19 aa, Staphylococcus aureus
STRGFAVYFSPEIKKFIAD

SEQ ID NO: 1664594 - protein, 25 aa, Staphylococcus aureus
STSGKTGFYFRVLKQGYVSPNDQLY

SEQ ID NO: 1664595 - protein, 19 aa, Staphylococcus aureus
STSIFQHAFHVSRDRILET

SEQ ID NO: 1664596 - protein, 19 aa, Staphylococcus aureus
STSSFIPIDIPFIVDIEKE

SEQ ID NO: 1664597 - protein, 17 aa, Staphylococcus aureus
STTNKKTWCDFESVSIE

SEQ ID NO: 1664598 - protein, 17 aa, Staphylococcus aureus
SVDSVLIVLERHQPLIS

SEQ ID NO: 1664599 - protein, 19 aa, Staphylococcus aureus
SVGYKRLEIDFSKEDRDIS

SEQ ID NO: 1664600 - protein, 18 aa, Staphylococcus aureus
SVKGDGYVLALNVEALQD

SEQ ID NO: 1664601 - protein, 24 aa, Staphylococcus aureus
SVKNVTGSMSFIFIDNDTHDVIDI

SEQ ID NO: 1664602 - protein, 24 aa, Staphylococcus aureus
SVTTFTIAVNRTFTNAQGEREADF

SEQ ID NO: 1664603 - protein, 17 aa, Staphylococcus aureus
SVVRFCVRYAEQLSVFE

SEQ ID NO: 1664604 - protein, 19 aa, Staphylococcus aureus
SYAASRLSTHWTNHNMAWS

SEQ ID NO: 1664605 - protein, 25 aa, Staphylococcus aureus
SYDMRFKTLIHEYAHSQLHNNDIGK

SEQ ID NO: 1664606 - protein, 21 aa, Staphylococcus aureus
SYEPEFFRYGGKNTINEIEAF

SEQ ID NO: 1664607 - protein, 18 aa, Staphylococcus aureus
SYINNFSYEEVKSIKSVI

SEQ ID NO: 1664608 - protein, 17 aa, Staphylococcus aureus
SYYKNALAIKRFFIALD

SEQ ID NO: 1664609 - protein, 18 aa, Staphylococcus aureus
TAAGFLMDKEIKFIGGVV

SEQ ID NO: 1664610 - protein, 18 aa, Staphylococcus aureus
TAEQVIKLNDAVTAAKKA

SEQ ID NO: 1664611 - protein, 19 aa, Staphylococcus aureus
TAEQVIKLNDAVTAAKKAL

SEQ ID NO: 1664612 - protein, 20 aa, Staphylococcus aureus
TAFLKNEFPQSDILMSILSN

SEQ ID NO: 1664613 - protein, 21 aa, Staphylococcus aureus
TAKIVLRWLKEQDIQVELLNL

SEQ ID NO: 1664614 - protein, 24 aa, Staphylococcus aureus
TANIYYKSIIKITITVKVGTNLQT

SEQ ID NO: 1664615 - protein, 21 aa, Staphylococcus aureus
TANQYWLYLFNHRLKGVGAAD

SEQ ID NO: 1664616 - protein, 36 aa, Staphylococcus aureus
TAVRHIYEISSLIYKSGMKIKIKAMGINVDEIDKML

SEQ ID NO: 1664617 - protein, 36 aa, Staphylococcus aureus
TDDVKRRHIRHCYKADPEYGKGVARALGIDINSIDL

SEQ ID NO: 1664618 - protein, 23 aa, Staphylococcus aureus
TDEKYFSGSFERLQALTTKTTLP

SEQ ID NO: 1664619 - protein, 23 aa, Staphylococcus aureus
TDKEVQRLLTMINGKGIFESARI

SEQ ID NO: 1664620 - protein, 21 aa, Staphylococcus aureus
TDKKVGWKVIFNNMVNQNWGP

SEQ ID NO: 1664621 - protein, 20 aa, Staphylococcus aureus
TDKYRLVYQGGITTIKNGQN

SEQ ID NO: 1664622 - protein, 22 aa, Staphylococcus aureus
TDNRGSVPFTVFIDPPLSRVGL

SEQ ID NO: 1664623 - protein, 24 aa, Staphylococcus aureus
TDSKNLVPLNGFRGTEPEETGDVR

SEQ ID NO: 1664624 - protein, 21 aa, Staphylococcus aureus
TEDGLKLGKNDQFGIKDHVGV

SEQ ID NO: 1664625 - protein, 22 aa, Staphylococcus aureus
TEHLNHPVSYYFKNNFYITPSG

SEQ ID NO: 1664626 - protein, 20 aa, Staphylococcus aureus
TEIGDYLLKYDVNSINDVRI

SEQ ID NO: 1664627 - protein, 17 aa, Staphylococcus aureus
TEIKSAMDSGTFIDNEK

SEQ ID NO: 1664628 - protein, 25 aa, Staphylococcus aureus
TEITSTFYPKMFKAHPELLNMFNQT

SEQ ID NO: 1664629 - protein, 17 aa, Staphylococcus aureus
TEKEWETGAGTRIRFLK

SEQ ID NO: 1664630 - protein, 22 aa, Staphylococcus aureus
TELPMNPAISLFVPVKDTIEME

SEQ ID NO: 1664631 - protein, 24 aa, Staphylococcus aureus
TEPDEIKESLAIVLDESKRLNRLV

SEQ ID NO: 1664632 - protein, 25 aa, Staphylococcus aureus
TERGWLKRRIETLYKVTLNNNEKRA

SEQ ID NO: 1664633 - protein, 19 aa, Staphylococcus aureus
TESLLGFKTIKTNAEGQQE

SEQ ID NO: 1664634 - protein, 20 aa, Staphylococcus aureus
TETDEYFCEIIFNSDDTFTL

SEQ ID NO: 1664635 - protein, 22 aa, Staphylococcus aureus
TETGRKSASMNIIKKLGNKMLP

SEQ ID NO: 1664636 - protein, 21 aa, Staphylococcus aureus
TFEIKPKYDLNIMKSGQTLSE

SEQ ID NO: 1664637 - protein, 20 aa, Staphylococcus aureus
TFGYVVYFFELVCAMSGYQL

SEQ ID NO: 1664638 - protein, 25 aa, Staphylococcus aureus
TFHTLLEEWLEYHIKTSGSKVTTLN

SEQ ID NO: 1664639 - protein, 19 aa, Staphylococcus aureus
TFLEERGHEFIILADNGED

SEQ ID NO: 1664640 - protein, 24 aa, Staphylococcus aureus
TFRITEMNWEGAFKVNERTLKMTD

SEQ ID NO: 1664641 - protein, 24 aa, Staphylococcus aureus
TFTLKRLSNYVIIKDRSYPMSKIN

SEQ ID NO: 1664642 - protein, 26 aa, Staphylococcus aureus
TGANEWNWYMHLSKQLARQGQRIKAG

SEQ ID NO: 1664643 - protein, 27 aa, Staphylococcus aureus
TGAYGDFGRYVFGYAVRNWVKGFKSDQ

SEQ ID NO: 1664644 - protein, 17 aa, Staphylococcus aureus
TGEGPKELLEFNINTIK

SEQ ID NO: 1664645 - protein, 25 aa, Staphylococcus aureus
TGEVIKAVPGFNVIAAINEGYVGTL

SEQ ID NO: 1664646 - protein, 19 aa, Staphylococcus aureus
TGRTYDWTILKHIKDVPYL

SEQ ID NO: 1664647 - protein, 24 aa, Staphylococcus aureus
THALKDVQAVLGFHNDPSRPVGTF

SEQ ID NO: 1664648 - protein, 19 aa, Staphylococcus aureus
THANGQVSYGARLTQKKPS

SEQ ID NO: 1664649 - protein, 18 aa, Staphylococcus aureus
THANGQVSYGARPTYKKP

SEQ ID NO: 1664650 - protein, 20 aa, Staphylococcus aureus
THARNHLRLWSLQGHRDIPH

SEQ ID NO: 1664651 - protein, 24 aa, Staphylococcus aureus
THFSTGSWGKIPFIPFKNNDLEMS

SEQ ID NO: 1664652 - protein, 27 aa, Staphylococcus aureus
THIEIIYLKSCDLTTILHNLYKRGVGT

SEQ ID NO: 1664653 - protein, 29 aa, Staphylococcus aureus
TIAKQIIEAMFEWIFTNAIPLNYKTSKLM

SEQ ID NO: 1664654 - protein, 17 aa, Staphylococcus aureus
TIATFAAYRGRGIATKL

SEQ ID NO: 1664655 - protein, 17 aa, Staphylococcus aureus
TIATFTAYRGRGIATKL

SEQ ID NO: 1664656 - protein, 19 aa, Staphylococcus aureus
TIFFTFWGLNALKKAQTVN

SEQ ID NO: 1664657 - protein, 20 aa, Staphylococcus aureus
TIGYWLARLLKLDRQDQKAV

SEQ ID NO: 1664658 - protein, 28 aa, Staphylococcus aureus
TIKKQVPVCCFTFGIPSESIIKRLKEAN

SEQ ID NO: 1664659 - protein, 29 aa, Staphylococcus aureus
TKAQDLDGAMQRLESAIANKDQTKASENY

SEQ ID NO: 1664660 - protein, 23 aa, Staphylococcus aureus
TKDEVMPALAYFTFSPKNYEDKS

SEQ ID NO: 1664661 - protein, 17 aa, Staphylococcus aureus
TKDPEFRTTPNGVSVAT

SEQ ID NO: 1664662 - protein, 29 aa, Staphylococcus aureus
TKFKHEVQCVICLPAALLNENSAAIRLSC

SEQ ID NO: 1664663 - protein, 30 aa, Staphylococcus aureus
TKFKHEVQCVICLPAALLNENSDAIRLSCK

SEQ ID NO: 1664664 - protein, 26 aa, Staphylococcus aureus
TKGDKCKVSIRFRGRAITHKEIGQRV

SEQ ID NO: 1664665 - protein, 20 aa, Staphylococcus aureus
TKIAEVIKEYGLDLLHMHYA

SEQ ID NO: 1664666 - protein, 25 aa, Staphylococcus aureus
TKKSGVCSSEIWVLKSTKEDKLLNL

SEQ ID NO: 1664667 - protein, 17 aa, Staphylococcus aureus
TKKSVSKEVKYQKTIEL

SEQ ID NO: 1664668 - protein, 20 aa, Staphylococcus aureus
TKKYLIKFCQDLIEHIKEHR

SEQ ID NO: 1664669 - protein, 17 aa, Staphylococcus aureus
TKLFLEIDIDNHRYICL

SEQ ID NO: 1664670 - protein, 25 aa, Staphylococcus aureus
TKLYFEGVSVFDMLDIVENITLDSI

SEQ ID NO: 1664671 - protein, 22 aa, Staphylococcus aureus
TKMPSMKITLSFSKSNTTKTTV

SEQ ID NO: 1664672 - protein, 21 aa, Staphylococcus aureus
TKQSIKIVNCEDFIEFYNPGN

SEQ ID NO: 1664673 - protein, 18 aa, Staphylococcus aureus
TKRLRKWGLLSLTQLAET

SEQ ID NO: 1664674 - protein, 21 aa, Staphylococcus aureus
TKSQLTIMYKLGMGPNTEKLD

SEQ ID NO: 1664675 - protein, 19 aa, Staphylococcus aureus
TKTVMKLCEYFNITPNEFF

SEQ ID NO: 1664676 - protein, 20 aa, Staphylococcus aureus
TLATCRKYGISITTIVQSIS

SEQ ID NO: 1664677 - protein, 17 aa, Staphylococcus aureus
TLDGVIFPNQFKKYEEL

SEQ ID NO: 1664678 - protein, 27 aa, Staphylococcus aureus
TLHPMGGLQERIWNPLQILNDFGTDVF

SEQ ID NO: 1664679 - protein, 21 aa, Staphylococcus aureus
TLHRIKCNTGFGYKDTTKTTG

SEQ ID NO: 1664680 - protein, 18 aa, Staphylococcus aureus
TLIKYCFEEIDLNRIEIS

SEQ ID NO: 1664681 - protein, 18 aa, Staphylococcus aureus
TLMTDWNIQTQIYKFNQI

SEQ ID NO: 1664682 - protein, 23 aa, Staphylococcus aureus
TLNTAMKGLRDSIANEATIKAEQ

SEQ ID NO: 1664683 - protein, 18 aa, Staphylococcus aureus
TLNVSFDYIDWVNTEFDQ

SEQ ID NO: 1664684 - protein, 20 aa, Staphylococcus aureus
TLRQRICDAAIQLMINIKYV

SEQ ID NO: 1664685 - protein, 33 aa, Staphylococcus aureus
TLTIPKDRPVVFKLQAMDTMTSFWIPQLGGQKY

SEQ ID NO: 1664686 - protein, 21 aa, Staphylococcus aureus
TLWDFKVSKQLPQKNSTLQLV

SEQ ID NO: 1664687 - protein, 22 aa, Staphylococcus aureus
TMGEAEKCYEYLELVNQENKKE

SEQ ID NO: 1664688 - protein, 22 aa, Staphylococcus aureus
TMICAAMAGIQFFVTGGIGGVH

SEQ ID NO: 1664689 - protein, 23 aa, Staphylococcus aureus
TMILHEFLPFIEIKQVPTSSANY

SEQ ID NO: 1664690 - protein, 24 aa, Staphylococcus aureus
TMNVPVDYYVRVNMKAFVEAVNEL

SEQ ID NO: 1664691 - protein, 26 aa, Staphylococcus aureus
TNLNDEYVVSPGWTKDEQAKAFEEYK

SEQ ID NO: 1664692 - protein, 27 aa, Staphylococcus aureus
TNNIAKCPACDNGYLIDRKGFYGCTEY

SEQ ID NO: 1664693 - protein, 24 aa, Staphylococcus aureus
TNSEIKALAKMYLTNDVEIKTAQL

SEQ ID NO: 1664694 - protein, 17 aa, Staphylococcus aureus
TNYYLSIIDRIVNWISQ

SEQ ID NO: 1664695 - protein, 19 aa, Staphylococcus aureus
TPEREIGNDLLIVQNLSKT

SEQ ID NO: 1664696 - protein, 17 aa, Staphylococcus aureus
TPMGGYFIVGYINDDKK

SEQ ID NO: 1664697 - protein, 17 aa, Staphylococcus aureus
TPNKFHADLSIEALNHG

SEQ ID NO: 1664698 - protein, 23 aa, Staphylococcus aureus
TPSPNTMKVVLSFTREDKLSNTY

SEQ ID NO: 1664699 - protein, 26 aa, Staphylococcus aureus
TPVIVKFEAGWCPDCRAMDLWIDPIV

SEQ ID NO: 1664700 - protein, 23 aa, Staphylococcus aureus
TPYKKWFERMSDYGFEENIDYVV

SEQ ID NO: 1664701 - protein, 23 aa, Staphylococcus aureus
TQSLLKQKCHLTLLDNYAESRYQ

SEQ ID NO: 1664702 - protein, 22 aa, Staphylococcus aureus
TRARQDVTFSYSLMGSSGDDKE

SEQ ID NO: 1664703 - protein, 19 aa, Staphylococcus aureus
TRFAIARELGRYLYKIKDN

SEQ ID NO: 1664704 - protein, 18 aa, Staphylococcus aureus
TRGKGHFVVPQTNAQHAS

SEQ ID NO: 1664705 - protein, 19 aa, Staphylococcus aureus
TRIHLKPTQLVGGYAQISY

SEQ ID NO: 1664706 - protein, 24 aa, Staphylococcus aureus
TRIHLKPTQLVGGYAQISYHFNYY

SEQ ID NO: 1664707 - protein, 18 aa, Staphylococcus aureus
TRKADEKTTNNTAVDKKS

SEQ ID NO: 1664708 - protein, 21 aa, Staphylococcus aureus
TRKMGGTGLGLAISKEIVEAH

SEQ ID NO: 1664709 - protein, 17 aa, Staphylococcus aureus
TRNGRKELVKNFYNTDL

SEQ ID NO: 1664710 - protein, 18 aa, Staphylococcus aureus
TRQCPMSGTTIRRKDTDK

SEQ ID NO: 1664711 - protein, 19 aa, Staphylococcus aureus
TRQCPMSGTTIRRKDTDKN

SEQ ID NO: 1664712 - protein, 17 aa, Staphylococcus aureus
TRTRCAFETAAYDQGAH

SEQ ID NO: 1664713 - protein, 21 aa, Staphylococcus aureus
TRYNDWFERMINYGFEENIDY

SEQ ID NO: 1664714 - protein, 20 aa, Staphylococcus aureus
TSCEFDFTKEGKLKVSFDYI

SEQ ID NO: 1664715 - protein, 19 aa, Staphylococcus aureus
TSCEFDFTRDGKLKVSFDY

SEQ ID NO: 1664716 - protein, 19 aa, Staphylococcus aureus
TSKMEGFGLAILESLSVGT

SEQ ID NO: 1664717 - protein, 17 aa, Staphylococcus aureus
TSLVDRFLGDSDEDTEQ

SEQ ID NO: 1664718 - protein, 17 aa, Staphylococcus aureus
TSNVFKYAVSLKIIVDN

SEQ ID NO: 1664719 - protein, 26 aa, Staphylococcus aureus
TSRIIGHDAREEWRKNDGVVPVISSL

SEQ ID NO: 1664720 - protein, 21 aa, Staphylococcus aureus
TSVKGKVALSINNKFINFEES

SEQ ID NO: 1664721 - protein, 25 aa, Staphylococcus aureus
TTEIQRKWIEKFKVIGDTFKAKSEY

SEQ ID NO: 1664722 - protein, 29 aa, Staphylococcus aureus
TTFEHKGKMAFRVYPKWCNQLNKTAEQTQ

SEQ ID NO: 1664723 - protein, 24 aa, Staphylococcus aureus
TTKRSRIIGSLIHMRCNRIFGVDK

SEQ ID NO: 1664724 - protein, 21 aa, Staphylococcus aureus
TTMRLKECGLILGKDLLDHII

SEQ ID NO: 1664725 - protein, 25 aa, Staphylococcus aureus
TVAVIGIGGIGSWTAYSLAMSGIGN

SEQ ID NO: 1664726 - protein, 20 aa, Staphylococcus aureus
TVFCYGLMVNYCLQAADILA

SEQ ID NO: 1664727 - protein, 23 aa, Staphylococcus aureus
TVGTASILIGSLMYLGTQQEAEA

SEQ ID NO: 1664728 - protein, 19 aa, Staphylococcus aureus
TVIIPGIMEHIERAGVHSG

SEQ ID NO: 1664729 - protein, 25 aa, Staphylococcus aureus
TVSTLELRTAIKIFGKKYTAEEKKN

SEQ ID NO: 1664730 - protein, 18 aa, Staphylococcus aureus
TWNLKYKQLKNINIDIPV

SEQ ID NO: 1664731 - protein, 27 aa, Staphylococcus aureus
TYKELVIATETFVDFPINYEDSNVCQF

SEQ ID NO: 1664732 - protein, 18 aa, Staphylococcus aureus
TYNFAVAIDDHYMEISDV

SEQ ID NO: 1664733 - protein, 18 aa, Staphylococcus aureus
VALMIGIPPGLIYRETAD

SEQ ID NO: 1664734 - protein, 19 aa, Staphylococcus aureus
VANMEGYLMRSIIAELEEM

SEQ ID NO: 1664735 - protein, 25 aa, Staphylococcus aureus
VAQAKESAKRALASYSNLNNAQSTA

SEQ ID NO: 1664736 - protein, 19 aa, Staphylococcus aureus
VAQMKEFYVGDYPKHIPMM

SEQ ID NO: 1664737 - protein, 23 aa, Staphylococcus aureus
VASEIMAILCLSRSIKDLKAKIS

SEQ ID NO: 1664738 - protein, 19 aa, Staphylococcus aureus
VASERICFGKFTNAGQTCV

SEQ ID NO: 1664739 - protein, 28 aa, Staphylococcus aureus
VATRLGHVKGYFIYPYQEVMKDSNIKLF

SEQ ID NO: 1664740 - protein, 25 aa, Staphylococcus aureus
VCDGDWGVAEGLVFNNFKVEDFDWF

SEQ ID NO: 1664741 - protein, 18 aa, Staphylococcus aureus
VDAIPELKKVAITDERPM

SEQ ID NO: 1664742 - protein, 20 aa, Staphylococcus aureus
VDEILERRVAHEKKKADEYA

SEQ ID NO: 1664743 - protein, 18 aa, Staphylococcus aureus
VDKLKMFLSDIHSYQQYS

SEQ ID NO: 1664744 - protein, 25 aa, Staphylococcus aureus
VDKVTHLRALLQLRDVAQDNDAIKH

SEQ ID NO: 1664745 - protein, 23 aa, Staphylococcus aureus
VDLLNLGGGFGIKYVEGDESFPI

SEQ ID NO: 1664746 - protein, 17 aa, Staphylococcus aureus
VDLPSMGPRSVDYLHHL

SEQ ID NO: 1664747 - protein, 21 aa, Staphylococcus aureus
VDLRGMLRRMIGHPKKDRAAY

SEQ ID NO: 1664748 - protein, 33 aa, Staphylococcus aureus
VDPDVLRFFVISVHYRSPINYNLELVESARSGL

SEQ ID NO: 1664749 - protein, 18 aa, Staphylococcus aureus
VDQAPNLAAVTAAKNKAT

SEQ ID NO: 1664750 - protein, 21 aa, Staphylococcus aureus
VDYFGGTAFEIYAQVNLDESE

SEQ ID NO: 1664751 - protein, 20 aa, Staphylococcus aureus
VDYVAGAGFGDLPFSAMPIV

SEQ ID NO: 1664752 - protein, 23 aa, Staphylococcus aureus
VEEIPERFSYMIKEVAVKRYNRI

SEQ ID NO: 1664753 - protein, 18 aa, Staphylococcus aureus
VEELYKYPVQDIMTEEFS

SEQ ID NO: 1664754 - protein, 31 aa, Staphylococcus aureus
VEFEETSALPGRKSGSLVGISQIDSSHLTER

SEQ ID NO: 1664755 - protein, 20 aa, Staphylococcus aureus
VEIKIRYKVPKIAYASHLKS

SEQ ID NO: 1664756 - protein, 25 aa, Staphylococcus aureus
VEIKWQIPEIEPQYVLKYQESKQDV

SEQ ID NO: 1664757 - protein, 26 aa, Staphylococcus aureus
VEKALAMKVPLGIFSHQLQRFIHLVW

SEQ ID NO: 1664758 - protein, 17 aa, Staphylococcus aureus
VEKELFENYILDNWDKV

SEQ ID NO: 1664759 - protein, 18 aa, Staphylococcus aureus
VEKHYNLYINMLENGEKH

SEQ ID NO: 1664760 - protein, 17 aa, Staphylococcus aureus
VEKQIREKFALKPFDKH

SEQ ID NO: 1664761 - protein, 20 aa, Staphylococcus aureus
VENGDMTVCYILDQDDDVID

SEQ ID NO: 1664762 - protein, 17 aa, Staphylococcus aureus
VENLMIFRREYKPTERQ

SEQ ID NO: 1664763 - protein, 19 aa, Staphylococcus aureus
VENVYIMLNKPKGYISATE

SEQ ID NO: 1664764 - protein, 21 aa, Staphylococcus aureus
VEVKAKGMFILKKKDDNTYEC

SEQ ID NO: 1664765 - protein, 18 aa, Staphylococcus aureus
VEVPQLPHVGNWRDKFFK

SEQ ID NO: 1664766 - protein, 25 aa, Staphylococcus aureus
VEYLIKDCYIWLYIFFLKKDKNFFE

SEQ ID NO: 1664767 - protein, 22 aa, Staphylococcus aureus
VFDRGGYLYHGRVKALAEAARE

SEQ ID NO: 1664768 - protein, 19 aa, Staphylococcus aureus
VFEKVCLTPLLKKIQNELN

SEQ ID NO: 1664769 - protein, 17 aa, Staphylococcus aureus
VFSHPKTTIAQNFVSTV

SEQ ID NO: 1664770 - protein, 19 aa, Staphylococcus aureus
VFTNGEIKYNSNFEKEDVL

SEQ ID NO: 1664771 - protein, 18 aa, Staphylococcus aureus
VFVNCARGSLVDTKALLD

SEQ ID NO: 1664772 - protein, 25 aa, Staphylococcus aureus
VGAAKIALERAIEINDHVALVSDGF

SEQ ID NO: 1664773 - protein, 19 aa, Staphylococcus aureus
VGIGVPGPVDFEKGTVNGA

SEQ ID NO: 1664774 - protein, 17 aa, Staphylococcus aureus
VGINIDIYQHFRQEEYE

SEQ ID NO: 1664775 - protein, 18 aa, Staphylococcus aureus
VGNWRDKFFKEREGKYQV

SEQ ID NO: 1664776 - protein, 17 aa, Staphylococcus aureus
VGRELREMMPFIKSKSI

SEQ ID NO: 1664777 - protein, 19 aa, Staphylococcus aureus
VGRIVGIWNGMMRRNGYKN

SEQ ID NO: 1664778 - protein, 17 aa, Staphylococcus aureus
VHHGMVYLHHELGKFLD

SEQ ID NO: 1664779 - protein, 19 aa, Staphylococcus aureus
VHQAIKYVLVKERHISQEE

SEQ ID NO: 1664780 - protein, 21 aa, Staphylococcus aureus
VHSKTSITFILKDVAIEEDNK

SEQ ID NO: 1664781 - protein, 18 aa, Staphylococcus aureus
VHVAFKLAASRRRKLTSV

SEQ ID NO: 1664782 - protein, 24 aa, Staphylococcus aureus
VHYVNEYCCLNVHVIYNGADNTLK

SEQ ID NO: 1664783 - protein, 21 aa, Staphylococcus aureus
VIEAIQLLKEIPHRSSFSYIL

SEQ ID NO: 1664784 - protein, 24 aa, Staphylococcus aureus
VIHPESFKSILAIRLGETKLMAGT

SEQ ID NO: 1664785 - protein, 18 aa, Staphylococcus aureus
VIIVTTFKRPGYFEKAVA

SEQ ID NO: 1664786 - protein, 17 aa, Staphylococcus aureus
VILYDRLVNPLILQYAK

SEQ ID NO: 1664787 - protein, 18 aa, Staphylococcus aureus
VINIPVGYVANLKYQFDI

SEQ ID NO: 1664788 - protein, 28 aa, Staphylococcus aureus
VISRKEMQQEVPYPFFVIKMPESNRSKY

SEQ ID NO: 1664789 - protein, 25 aa, Staphylococcus aureus
VITMYPHLDGVLSLDLTTVLILNQL

SEQ ID NO: 1664790 - protein, 27 aa, Staphylococcus aureus
VKAAGTWHYICLFIDLFNREIIGYSAG

SEQ ID NO: 1664791 - protein, 17 aa, Staphylococcus aureus
VKAGSLYPLSYYDGDWY

SEQ ID NO: 1664792 - protein, 39 aa, Staphylococcus aureus
VKCTKAQFIKRLACLPSHIYRLKGFMTFEDTTHTYLIQF

SEQ ID NO: 1664793 - protein, 19 aa, Staphylococcus aureus
VKDVFNNEVWVKRDEIESF

SEQ ID NO: 1664794 - protein, 19 aa, Staphylococcus aureus
VKDYLKGLKTVSVDDVKGF

SEQ ID NO: 1664795 - protein, 26 aa, Staphylococcus aureus
VKEGVELDEAVGIMAGQVVYKYEEEQ

SEQ ID NO: 1664796 - protein, 19 aa, Staphylococcus aureus
VKGLGTPATRADIIENLKK

SEQ ID NO: 1664797 - protein, 17 aa, Staphylococcus aureus
VKGRAAINDDNFTQFQI

SEQ ID NO: 1664798 - protein, 17 aa, Staphylococcus aureus
VKHMNPCGVGIGDTLEQ

SEQ ID NO: 1664799 - protein, 25 aa, Staphylococcus aureus
VKIDRFPIFIPQALINEQIEYKIIK

SEQ ID NO: 1664800 - protein, 20 aa, Staphylococcus aureus
VKIGESIKDVLTKYKNPMYS

SEQ ID NO: 1664801 - protein, 18 aa, Staphylococcus aureus
VKKNLKSRSMGTVSYTYN

SEQ ID NO: 1664802 - protein, 22 aa, Staphylococcus aureus
VKQFKQLRVWIWETKKRDGKHH

SEQ ID NO: 1664803 - protein, 21 aa, Staphylococcus aureus
VKQFLNKKVKRYEIPSMIHHV

SEQ ID NO: 1664804 - protein, 25 aa, Staphylococcus aureus
VKRTDHLTCGDVLRINNGQGHAMEN

SEQ ID NO: 1664805 - protein, 24 aa, Staphylococcus aureus
VKRTLTRLRLKTHTPTNAMRESFH

SEQ ID NO: 1664806 - protein, 17 aa, Staphylococcus aureus
VKTRYNDWFERMINYGF

SEQ ID NO: 1664807 - protein, 23 aa, Staphylococcus aureus
VKVDGEWLYKLISYIESNDEYYQ

SEQ ID NO: 1664808 - protein, 25 aa, Staphylococcus aureus
VKYAESFGAKGLRITNQEELEAAIK

SEQ ID NO: 1664809 - protein, 28 aa, Staphylococcus aureus
VKYLSNDGFCYLSYWYGDNENIVNIFHF

SEQ ID NO: 1664810 - protein, 24 aa, Staphylococcus aureus
VLAEALINEGFRIVSGGTDNHLVA

SEQ ID NO: 1664811 - protein, 23 aa, Staphylococcus aureus
VLAETLINEGFRIVSGGTDNHLV

SEQ ID NO: 1664812 - protein, 26 aa, Staphylococcus aureus
VLDACSAPGGKACHIAEVLMPEGQVD

SEQ ID NO: 1664813 - protein, 26 aa, Staphylococcus aureus
VLDEAHCLSEWGYDFRPHYALIGKVT

SEQ ID NO: 1664814 - protein, 18 aa, Staphylococcus aureus
VLESFKIKYSLSTKSCPY

SEQ ID NO: 1664815 - protein, 17 aa, Staphylococcus aureus
VLFRGAAEGVIRRYLIE

SEQ ID NO: 1664816 - protein, 26 aa, Staphylococcus aureus
VLIEVLKSKVIRHAYLDVFENEPLKP

SEQ ID NO: 1664817 - protein, 17 aa, Staphylococcus aureus
VLKALNLTLEDIAYQKD

SEQ ID NO: 1664818 - protein, 29 aa, Staphylococcus aureus
VLKENVTTVLGFKSIRQGESIAEMQQPFS

SEQ ID NO: 1664819 - protein, 26 aa, Staphylococcus aureus
VLMAVRIAYFKVHHPLYYYASYFTIR

SEQ ID NO: 1664820 - protein, 17 aa, Staphylococcus aureus
VLSERFVNYFKHHQMEV

SEQ ID NO: 1664821 - protein, 25 aa, Staphylococcus aureus
VLTFKAIQACKEYGVQRLIVAGGVA

SEQ ID NO: 1664822 - protein, 22 aa, Staphylococcus aureus
VMSEHLWRVEIELKRDMVDYWN

SEQ ID NO: 1664823 - protein, 20 aa, Staphylococcus aureus
VMYYAKYGLNFNMHKRKITF

SEQ ID NO: 1664824 - protein, 27 aa, Staphylococcus aureus
VNAKGRLPDCLVQWSAKRLKEQGANAV

SEQ ID NO: 1664825 - protein, 17 aa, Staphylococcus aureus
VNFKNFLASDRQNFFDY

SEQ ID NO: 1664826 - protein, 19 aa, Staphylococcus aureus
VNGTYYFHGHYKTMFKGVK

SEQ ID NO: 1664827 - protein, 18 aa, Staphylococcus aureus
VNILKLTNHLGFVIQINE

SEQ ID NO: 1664828 - protein, 19 aa, Staphylococcus aureus
VNINEIKDKVLSEHNSTVQ

SEQ ID NO: 1664829 - protein, 18 aa, Staphylococcus aureus
VNISDGVPRLDALIDSHV

SEQ ID NO: 1664830 - protein, 22 aa, Staphylococcus aureus
VNLPELIQWAWDNPKLSGNKRF

SEQ ID NO: 1664831 - protein, 17 aa, Staphylococcus aureus
VNQNVHFEVLLVKLAEQ

SEQ ID NO: 1664832 - protein, 17 aa, Staphylococcus aureus
VNYGLAYNEHRIHNEQV

SEQ ID NO: 1664833 - protein, 17 aa, Staphylococcus aureus
VPACLLLVLNSLSTLKP

SEQ ID NO: 1664834 - protein, 20 aa, Staphylococcus aureus
VPAYLPIKNLIALVLDSLDI

SEQ ID NO: 1664835 - protein, 29 aa, Staphylococcus aureus
VPDEASLEFNVRPVPEYDNDFIESFFQNI

SEQ ID NO: 1664836 - protein, 25 aa, Staphylococcus aureus
VPDEASLEFNVRPVPEYDNDFVESF

SEQ ID NO: 1664837 - protein, 18 aa, Staphylococcus aureus
VPEDAEIIAWFDAIGKKR

SEQ ID NO: 1664838 - protein, 21 aa, Staphylococcus aureus
VPEFGTGFVRQMLEDTKPTTF

SEQ ID NO: 1664839 - protein, 22 aa, Staphylococcus aureus
VPELRFPGFEGEWEEKKLESII

SEQ ID NO: 1664840 - protein, 22 aa, Staphylococcus aureus
VPELRFPGFEGEWEEKKLGDLT

SEQ ID NO: 1664841 - protein, 24 aa, Staphylococcus aureus
VPELRFPGFEGEYSLDIFGNLATN

SEQ ID NO: 1664842 - protein, 19 aa, Staphylococcus aureus
VPISETWDLTDLFKDDQQY

SEQ ID NO: 1664843 - protein, 23 aa, Staphylococcus aureus
VPNKRFGQIGVLLYYGDVTLTHK

SEQ ID NO: 1664844 - protein, 24 aa, Staphylococcus aureus
VPQFKTNPILVSGVSFTPETKSIT

SEQ ID NO: 1664845 - protein, 17 aa, Staphylococcus aureus
VQAVLGFHNDPSRSVGT

SEQ ID NO: 1664846 - protein, 28 aa, Staphylococcus aureus
VQPLNKYPVVFVHGFLGLVGDNAPALYP

SEQ ID NO: 1664847 - protein, 24 aa, Staphylococcus aureus
VQQKSFLFNEHYGFLNLINDDSNI

SEQ ID NO: 1664848 - protein, 17 aa, Staphylococcus aureus
VQSLLHYLAFYTGKNKQ

SEQ ID NO: 1664849 - protein, 18 aa, Staphylococcus aureus
VQSLLHYLAFYTSKDKEQ

SEQ ID NO: 1664850 - protein, 18 aa, Staphylococcus aureus
VQTFDFRGEQPFTNYVQC

SEQ ID NO: 1664851 - protein, 18 aa, Staphylococcus aureus
VQVRRLLKKYGYPPDLQK

SEQ ID NO: 1664852 - protein, 17 aa, Staphylococcus aureus
VRAAYEEGLNNINAATT

SEQ ID NO: 1664853 - protein, 19 aa, Staphylococcus aureus
VRDVFNMINHFGIENISRY

SEQ ID NO: 1664854 - protein, 26 aa, Staphylococcus aureus
VREGIELDEAIGIMTGQVVYKYEEEQ

SEQ ID NO: 1664855 - protein, 25 aa, Staphylococcus aureus
VRFRPSQEIIQVWHAVGAFKTVGFS

SEQ ID NO: 1664856 - protein, 22 aa, Staphylococcus aureus
VRFVICCQFYHQYFYQHTLIGA

SEQ ID NO: 1664857 - protein, 19 aa, Staphylococcus aureus
VRGLFQFYGAGTGRWAGRG

SEQ ID NO: 1664858 - protein, 24 aa, Staphylococcus aureus
VRIPETLLDIKLEMLDLMHKYQVK

SEQ ID NO: 1664859 - protein, 20 aa, Staphylococcus aureus
VRLGDGLSVIHPEDVIDNIT

SEQ ID NO: 1664860 - protein, 21 aa, Staphylococcus aureus
VRNLLAMCYLYLGEYDRAKAL

SEQ ID NO: 1664861 - protein, 24 aa, Staphylococcus aureus
VRQAKSDAKANLGTLTHLNNAQKQ

SEQ ID NO: 1664862 - protein, 31 aa, Staphylococcus aureus
VRSKGIVWLAQYNRVACLLSQAGSSCNIHPV

SEQ ID NO: 1664863 - protein, 17 aa, Staphylococcus aureus
VRYVYNIDFDKPKLEMW

SEQ ID NO: 1664864 - protein, 32 aa, Staphylococcus aureus
VSESGTGAGVRRIEALTGKAAFLYLEDIQEKF

SEQ ID NO: 1664865 - protein, 19 aa, Staphylococcus aureus
VSFSIKKGQTFRLVGESGC

SEQ ID NO: 1664866 - protein, 17 aa, Staphylococcus aureus
VSHAELVTGVNAIKQNA

SEQ ID NO: 1664867 - protein, 17 aa, Staphylococcus aureus
VSIKFRINDNLEQYEQI

SEQ ID NO: 1664868 - protein, 19 aa, Staphylococcus aureus
VSLNVGATFGRFHHLIDTE

SEQ ID NO: 1664869 - protein, 23 aa, Staphylococcus aureus
VSNRGHDSIAIFKVLDNGQHLEL

SEQ ID NO: 1664870 - protein, 25 aa, Staphylococcus aureus
VSPILKCLILKGLVKKERCELDERR

SEQ ID NO: 1664871 - protein, 21 aa, Staphylococcus aureus
VSRRDLAEIVAMKRIGATTVA

SEQ ID NO: 1664872 - protein, 25 aa, Staphylococcus aureus
VSTMASELNTAMSNLQRGINDEAAT

SEQ ID NO: 1664873 - protein, 17 aa, Staphylococcus aureus
VSTRPGHEMVSLEEELN

SEQ ID NO: 1664874 - protein, 22 aa, Staphylococcus aureus
VSYEPEFFRYGGKNTIDEIESF

SEQ ID NO: 1664875 - protein, 18 aa, Staphylococcus aureus
VTDALAIASCINAHPYVK

SEQ ID NO: 1664876 - protein, 18 aa, Staphylococcus aureus
VTDKILCMNGSYVINKGD

SEQ ID NO: 1664877 - protein, 29 aa, Staphylococcus aureus
VTGCPAIPCYQCEYCLKGEYARCEKVIRH

SEQ ID NO: 1664878 - protein, 18 aa, Staphylococcus aureus
VTGYIRGGLRTMQITIAV

SEQ ID NO: 1664879 - protein, 17 aa, Staphylococcus aureus
VTLPKLHSVYFVHVMHT

SEQ ID NO: 1664880 - protein, 18 aa, Staphylococcus aureus
VTSAQRVANVTSIQQTAN

SEQ ID NO: 1664881 - protein, 22 aa, Staphylococcus aureus
VVMKEGHGAYLYDVDGNKFIDY

SEQ ID NO: 1664882 - protein, 26 aa, Staphylococcus aureus
VYFFELVCAMSGYQLGVNPFNQPGVE

SEQ ID NO: 1664883 - protein, 18 aa, Staphylococcus aureus
VYIKEPITDLSLKDIQAH

SEQ ID NO: 1664884 - protein, 20 aa, Staphylococcus aureus
VYNIPELHVAQIKMTKTHAI

SEQ ID NO: 1664885 - protein, 18 aa, Staphylococcus aureus
WAGFKAVINYAKKHYKLL

SEQ ID NO: 1664886 - protein, 18 aa, Staphylococcus aureus
WANERQYTGIDFLGVSYA

SEQ ID NO: 1664887 - protein, 20 aa, Staphylococcus aureus
WCDLKKAKGKVLARHIVPYP

SEQ ID NO: 1664888 - protein, 17 aa, Staphylococcus aureus
WEQVFTIAYVTDQAGEV

SEQ ID NO: 1664889 - protein, 25 aa, Staphylococcus aureus
WFSNAYKSAKGWLTDMANKSRSKWD

SEQ ID NO: 1664890 - protein, 19 aa, Staphylococcus aureus
WGAQKEIIKLIPGLENVDI

SEQ ID NO: 1664891 - protein, 24 aa, Staphylococcus aureus
WGSYTGHLFKSFLEKHYKNKFILN

SEQ ID NO: 1664892 - protein, 20 aa, Staphylococcus aureus
WIEGGKRGRKPTTISPIKCA

SEQ ID NO: 1664893 - protein, 17 aa, Staphylococcus aureus
WKRAHPNRMLMHNGEIN

SEQ ID NO: 1664894 - protein, 21 aa, Staphylococcus aureus
WLEVYNRNGVTLPLSSLSITN

SEQ ID NO: 1664895 - protein, 22 aa, Staphylococcus aureus
WLINYVKQYPHTVLFVTHDRYF

SEQ ID NO: 1664896 - protein, 25 aa, Staphylococcus aureus
WLNANLKSIEQVRAFEKQQIESKKQ

SEQ ID NO: 1664897 - protein, 25 aa, Staphylococcus aureus
WLNANLKSIEQVRAFEKQQLESKKQ

SEQ ID NO: 1664898 - protein, 21 aa, Staphylococcus aureus
WLNQAPFSFDLSVMAIYPCLA

SEQ ID NO: 1664899 - protein, 17 aa, Staphylococcus aureus
WMNEGYMQKENILTTAN

SEQ ID NO: 1664900 - protein, 18 aa, Staphylococcus aureus
WNDCFSDLHILQPDWKTI

SEQ ID NO: 1664901 - protein, 23 aa, Staphylococcus aureus
WNDCFSDLHILQPDWKTIQRTAD

SEQ ID NO: 1664902 - protein, 30 aa, Staphylococcus aureus
WQARAKVKHLRKSPCYNFELEVIAKNENND

SEQ ID NO: 1664903 - protein, 19 aa, Staphylococcus aureus
WRTSIKQAQQLGVTKTLQG

SEQ ID NO: 1664904 - protein, 26 aa, Staphylococcus aureus
WSGKYRPELRNMKIFPRPIDNTLPIW

SEQ ID NO: 1664905 - protein, 29 aa, Staphylococcus aureus
WSKGEIEAVPGRTMPNFAIVERDYTKIYD

SEQ ID NO: 1664906 - protein, 30 aa, Staphylococcus aureus
WSKGEIEAVPGRTMPSFAIVERDYTKIYDK

SEQ ID NO: 1664907 - protein, 19 aa, Staphylococcus aureus
WTDGYGLCKKIRLKYNINI

SEQ ID NO: 1664908 - protein, 19 aa, Staphylococcus aureus
WTPELKQVEEFECVSERGA

SEQ ID NO: 1664909 - protein, 20 aa, Staphylococcus aureus
WTQVKMKAVLHNEAIKNVLE

SEQ ID NO: 1664910 - protein, 21 aa, Staphylococcus aureus
WYTNTFVDLVLSMKGYSYHVE

SEQ ID NO: 1664911 - protein, 17 aa, Staphylococcus aureus
YAEYCFKEFPEVKYWTT

SEQ ID NO: 1664912 - protein, 24 aa, Staphylococcus aureus
YAGIELLKKYGLEKITLSNILYEF

SEQ ID NO: 1664913 - protein, 17 aa, Staphylococcus aureus
YAKNIYLNFKKIFSNLE

SEQ ID NO: 1664914 - protein, 19 aa, Staphylococcus aureus
YASRNDVAFVYPKGQSEPI

SEQ ID NO: 1664915 - protein, 33 aa, Staphylococcus aureus
YDAVNRIVLKDGWLFRKMRIETMQKVLKYGTSK

SEQ ID NO: 1664916 - protein, 27 aa, Staphylococcus aureus
YDGAYCINGYRWITYIANSGQRRYIAT

SEQ ID NO: 1664917 - protein, 21 aa, Staphylococcus aureus
YDIKVSTLITRYDRGARGKDL

SEQ ID NO: 1664918 - protein, 18 aa, Staphylococcus aureus
YDLTPSALGKWIKQHQNT

SEQ ID NO: 1664919 - protein, 17 aa, Staphylococcus aureus
YDNIKHLIDRGIDGLII

SEQ ID NO: 1664920 - protein, 18 aa, Staphylococcus aureus
YDNIKHLIERGIDGLIIA

SEQ ID NO: 1664921 - protein, 26 aa, Staphylococcus aureus
YDPTCGSGSLLLRVGKETKVYRYFGQ

SEQ ID NO: 1664922 - protein, 19 aa, Staphylococcus aureus
YDPTKQFYVVSGSKHDALM

SEQ ID NO: 1664923 - protein, 24 aa, Staphylococcus aureus
YDQSYKYSALFKIINKDVGELLSV

SEQ ID NO: 1664924 - protein, 25 aa, Staphylococcus aureus
YDSARFMTVTGCTIGQNDICDNQEV

SEQ ID NO: 1664925 - protein, 17 aa, Staphylococcus aureus
YDSEIFKANLDRNDVRV

SEQ ID NO: 1664926 - protein, 23 aa, Staphylococcus aureus
YDSLIEGFIHWIKDEKIDWPGED

SEQ ID NO: 1664927 - protein, 20 aa, Staphylococcus aureus
YDSPEFFKQITVTFNPWSER

SEQ ID NO: 1664928 - protein, 22 aa, Staphylococcus aureus
YDYEFYDAVELIGLVNDLCHEL

SEQ ID NO: 1664929 - protein, 19 aa, Staphylococcus aureus
YELISRPNIQFAGQMTGVE

SEQ ID NO: 1664930 - protein, 20 aa, Staphylococcus aureus
YELKKEKMNTLIDEYSAVHY

SEQ ID NO: 1664931 - protein, 18 aa, Staphylococcus aureus
YELKKGKMNTLIDEYSAV

SEQ ID NO: 1664932 - protein, 21 aa, Staphylococcus aureus
YESKLNYQSRFGVKDDEVSTF

SEQ ID NO: 1664933 - protein, 22 aa, Staphylococcus aureus
YEYKTGSDLVRFFNQYFNRKDT

SEQ ID NO: 1664934 - protein, 21 aa, Staphylococcus aureus
YFDERSYFIFGGMAPKHYSHV

SEQ ID NO: 1664935 - protein, 17 aa, Staphylococcus aureus
YFHGHIVPGWQGVKKTF

SEQ ID NO: 1664936 - protein, 25 aa, Staphylococcus aureus
YFNFDFKTKRFDNLELKKNDDISLT

SEQ ID NO: 1664937 - protein, 18 aa, Staphylococcus aureus
YGAYNYFGIGAFDNDPDY

SEQ ID NO: 1664938 - protein, 17 aa, Staphylococcus aureus
YGIKRKGKLVTEEAYIQ

SEQ ID NO: 1664939 - protein, 17 aa, Staphylococcus aureus
YGSLIMEHIMKYIKNVA

SEQ ID NO: 1664940 - protein, 17 aa, Staphylococcus aureus
YGTQRAFIRIDLDREET

SEQ ID NO: 1664941 - protein, 18 aa, Staphylococcus aureus
YHGLCEEILEIGNRRDDR

SEQ ID NO: 1664942 - protein, 23 aa, Staphylococcus aureus
YHKILIKNFNLWQAQREDSLLDI

SEQ ID NO: 1664943 - protein, 19 aa, Staphylococcus aureus
YHLSEHVKFHGFKTHINEE

SEQ ID NO: 1664944 - protein, 24 aa, Staphylococcus aureus
YHSKGLESWKEKNLENLIEQEVQK

SEQ ID NO: 1664945 - protein, 27 aa, Staphylococcus aureus
YHTLLTIGRFPICYINIEMNPILVDVN

SEQ ID NO: 1664946 - protein, 23 aa, Staphylococcus aureus
YIGIYNPRFNQIYKYDMTQADSE

SEQ ID NO: 1664947 - protein, 23 aa, Staphylococcus aureus
YIKDCKVRQSFELASPKHTEGLI

SEQ ID NO: 1664948 - protein, 18 aa, Staphylococcus aureus
YILANPFYIGKIQFAKYK

SEQ ID NO: 1664949 - protein, 19 aa, Staphylococcus aureus
YILANPFYIGKIQFAKYKD

SEQ ID NO: 1664950 - protein, 17 aa, Staphylococcus aureus
YILPGYRDVPQIIWHGL

SEQ ID NO: 1664951 - protein, 24 aa, Staphylococcus aureus
YILTLKIEIIIFCIHITEDAEKKN

SEQ ID NO: 1664952 - protein, 22 aa, Staphylococcus aureus
YISYPTIYRYIRNGLVKVDVKR

SEQ ID NO: 1664953 - protein, 27 aa, Staphylococcus aureus
YIYSRPRSGYYVSEIESLTILNTQPIH

SEQ ID NO: 1664954 - protein, 18 aa, Staphylococcus aureus
YKALAKYGRDLVEEVRQG

SEQ ID NO: 1664955 - protein, 21 aa, Staphylococcus aureus
YKDFFDFARRIPKRVKTRKLL

SEQ ID NO: 1664956 - protein, 23 aa, Staphylococcus aureus
YKDKAMLKIACIDLNEYQDKLKI

SEQ ID NO: 1664957 - protein, 17 aa, Staphylococcus aureus
YKIPKKVIKHAGYVRCK

SEQ ID NO: 1664958 - protein, 17 aa, Staphylococcus aureus
YKKAFKMKDDIEVPSAL

SEQ ID NO: 1664959 - protein, 19 aa, Staphylococcus aureus
YKKFGVIPEMEYEMEEIKE

SEQ ID NO: 1664960 - protein, 19 aa, Staphylococcus aureus
YKKFGVIPEMEYEMEEVKE

SEQ ID NO: 1664961 - protein, 21 aa, Staphylococcus aureus
YKKQRYELIGVIAKLRDCNKE

SEQ ID NO: 1664962 - protein, 22 aa, Staphylococcus aureus
YKKRSISNMVLLKTVLNHYTEK

SEQ ID NO: 1664963 - protein, 21 aa, Staphylococcus aureus
YKLSDGSIISLIDFVIKPIHL

SEQ ID NO: 1664964 - protein, 17 aa, Staphylococcus aureus
YKNLCTNSNKLLDKLHK

SEQ ID NO: 1664965 - protein, 21 aa, Staphylococcus aureus
YKSEPGLLKAIQFLDDYYHEK

SEQ ID NO: 1664966 - protein, 20 aa, Staphylococcus aureus
YKSEPGLLQAIQFLDDYYHE

SEQ ID NO: 1664967 - protein, 20 aa, Staphylococcus aureus
YKSGKNWVKSGIKEIEMFKI

SEQ ID NO: 1664968 - protein, 19 aa, Staphylococcus aureus
YKTSINISKILDFQISENK

SEQ ID NO: 1664969 - protein, 26 aa, Staphylococcus aureus
YKYDTRLKYILFKYIMLIEQSLKTNL

SEQ ID NO: 1664970 - protein, 17 aa, Staphylococcus aureus
YLECFTEEKMIKEVEDV

SEQ ID NO: 1664971 - protein, 24 aa, Staphylococcus aureus
YLLLRGLKTLHLRIERAQSNARKL

SEQ ID NO: 1664972 - protein, 21 aa, Staphylococcus aureus
YLLSRKGKRKIFLAQSGGSRE

SEQ ID NO: 1664973 - protein, 24 aa, Staphylococcus aureus
YLMEPWDGPTMISFCNGDKLGALT

SEQ ID NO: 1664974 - protein, 21 aa, Staphylococcus aureus
YLNGRFSNMILGHNGDGINEV

SEQ ID NO: 1664975 - protein, 17 aa, Staphylococcus aureus
YLNQFFGSKRYLYQNNE

SEQ ID NO: 1664976 - protein, 23 aa, Staphylococcus aureus
YMGVKRLGKIITQIQQYKDIDYP

SEQ ID NO: 1664977 - protein, 17 aa, Staphylococcus aureus
YMYKKFGVIPEMEYEME

SEQ ID NO: 1664978 - protein, 26 aa, Staphylococcus aureus
YNDSDLNWIYLVKNLRNAGVSIESLI

SEQ ID NO: 1664979 - protein, 17 aa, Staphylococcus aureus
YNFKSVCVNPTHVKYAA

SEQ ID NO: 1664980 - protein, 20 aa, Staphylococcus aureus
YNIRSSTQVKNWIKMYTVGK

SEQ ID NO: 1664981 - protein, 19 aa, Staphylococcus aureus
YNISIKFFNNNCATKTQKY

SEQ ID NO: 1664982 - protein, 17 aa, Staphylococcus aureus
YNKCSSYLHGSDAILND

SEQ ID NO: 1664983 - protein, 18 aa, Staphylococcus aureus
YNLNIPRYVDTFEEEAPI

SEQ ID NO: 1664984 - protein, 17 aa, Staphylococcus aureus
YNNIEWLIKEGYGKLTL

SEQ ID NO: 1664985 - protein, 31 aa, Staphylococcus aureus
YNPIVSFCDFYGLELPKLPILNPEFNNPLFL

SEQ ID NO: 1664986 - protein, 18 aa, Staphylococcus aureus
YNRTIFNEVIEWLETELT

SEQ ID NO: 1664987 - protein, 20 aa, Staphylococcus aureus
YNVIIKIYIVMSTLKLEKLT

SEQ ID NO: 1664988 - protein, 21 aa, Staphylococcus aureus
YPDQLAIVIAIDIAYNLYTID

SEQ ID NO: 1664989 - protein, 36 aa, Staphylococcus aureus
YPFKELPLYEIGWRLLPEFWGKGLATEGAKAALKLA

SEQ ID NO: 1664990 - protein, 20 aa, Staphylococcus aureus
YPHEIISIGDTVRVKHRDFN

SEQ ID NO: 1664991 - protein, 17 aa, Staphylococcus aureus
YPMIPGIDLAGTIVESE

SEQ ID NO: 1664992 - protein, 27 aa, Staphylococcus aureus
YPMNWPIGMGQSFFGIIDRKSKTIEPF

SEQ ID NO: 1664993 - protein, 18 aa, Staphylococcus aureus
YPVKVVNNKIVFTKDVKD

SEQ ID NO: 1664994 - protein, 18 aa, Staphylococcus aureus
YPYKVERKAKSPLLFGSI

SEQ ID NO: 1664995 - protein, 19 aa, Staphylococcus aureus
YQDLNGRIDGIVQAEQSEE

SEQ ID NO: 1664996 - protein, 20 aa, Staphylococcus aureus
YQEIILRPVDEVKVLLNDLK

SEQ ID NO: 1664997 - protein, 28 aa, Staphylococcus aureus
YQFDFKRFNSVSEFKNATLLSETSTIYE

SEQ ID NO: 1664998 - protein, 17 aa, Staphylococcus aureus
YQKRGSYFGQRNRISKE

SEQ ID NO: 1664999 - protein, 17 aa, Staphylococcus aureus
YQMLNLGKYQGISVSAL

SEQ ID NO: 1665000 - protein, 25 aa, Staphylococcus aureus
YQRSADIFLGVPFNIASYALLTHLV

SEQ ID NO: 1665001 - protein, 20 aa, Staphylococcus aureus
YQYKTVRQIVKYMHQDQQSL

SEQ ID NO: 1665002 - protein, 21 aa, Staphylococcus aureus
YRELFTLMFYTGLRIGEAMAL

SEQ ID NO: 1665003 - protein, 21 aa, Staphylococcus aureus
YRNLSKYNKCLMLKPEPLVGK

SEQ ID NO: 1665004 - protein, 22 aa, Staphylococcus aureus
YRPYLKLAEPILEKHNIYYGQW

SEQ ID NO: 1665005 - protein, 21 aa, Staphylococcus aureus
YRTAEGFEGYYMMKRMNAPFL

SEQ ID NO: 1665006 - protein, 17 aa, Staphylococcus aureus
YSATLMTSFFVDKNPLT

SEQ ID NO: 1665007 - protein, 22 aa, Staphylococcus aureus
YSFINSLVWRKDGSISKHTKCY

SEQ ID NO: 1665008 - protein, 25 aa, Staphylococcus aureus
YSMGGRVALYYAINGHIPISNLILE

SEQ ID NO: 1665009 - protein, 27 aa, Staphylococcus aureus
YSPQVRKLKGGFFFAALTPTLRHLGKL

SEQ ID NO: 1665010 - protein, 28 aa, Staphylococcus aureus
YSQRKIDVEPVFGFMKAILGFTRMSVRG

SEQ ID NO: 1665011 - protein, 20 aa, Staphylococcus aureus
YSYYEFKYHSTVLYGCRCIS

SEQ ID NO: 1665012 - protein, 19 aa, Staphylococcus aureus
YTDDKFNKRYSVIFDGTAN

SEQ ID NO: 1665013 - protein, 38 aa, Staphylococcus aureus
YTDIDYPIAIVFQASCFNEFVVKGRLSNIISKLQDYSI

SEQ ID NO: 1665014 - protein, 22 aa, Staphylococcus aureus
YTDKWKRVSVVLNKNTKQSQKE

SEQ ID NO: 1665015 - protein, 24 aa, Staphylococcus aureus
YTGEIIRLIQELAHDFPTGTHERQ

SEQ ID NO: 1665016 - protein, 26 aa, Staphylococcus aureus
YTKHGIIRLVFKYRHNTLQRSVTNGA

SEQ ID NO: 1665017 - protein, 21 aa, Staphylococcus aureus
YTLALPFGLAVQYYSIDQLID

SEQ ID NO: 1665018 - protein, 17 aa, Staphylococcus aureus
YTLITIVNYDFYQSEQG

SEQ ID NO: 1665019 - protein, 31 aa, Staphylococcus aureus
YTTTFKNVLKYCGEKEFRINLVVNSKLTEEE

SEQ ID NO: 1665020 - protein, 26 aa, Staphylococcus aureus
YTYGEYRLSQHLADLAKNYPELYIHV

SEQ ID NO: 1665021 - protein, 18 aa, Staphylococcus aureus
YVGLKTGRDGIHGATFAS

SEQ ID NO: 1665022 - protein, 17 aa, Staphylococcus aureus
YVLHHGLDKKERLKKTE

SEQ ID NO: 1665023 - protein, 42 aa, Staphylococcus aureus
YVTQLICYDLRFPELLRYPARSGAKIAFYVAQWPMSRLQHWH

SEQ ID NO: 1665024 - protein, 19 aa, Staphylococcus aureus
YWIKNEVKPDAIIEFHLDS

SEQ ID NO: 1665025 - protein, 20 aa, Staphylococcus aureus
YWIKNEVKPDAIIEFHLDSA

SEQ ID NO: 1665026 - protein, 35 aa, Staphylococcus aureus
YYAIFRTLAFTGFRRGELMALTWNDIDFTKQTISI

SEQ ID NO: 1665027 - protein, 34 aa, Staphylococcus aureus
YYDEFEGGHQWKDWKPLLSDILLYFLSKNTDDQL

SEQ ID NO: 1665028 - protein, 21 aa, Staphylococcus aureus
YYERCGGCQLQHLSYEAQLEM

SEQ ID NO: 1665029 - protein, 17 aa, Staphylococcus aureus
YYFHGHIVPGWQSVKKT

SEQ ID NO: 1665030 - protein, 24 aa, Staphylococcus aureus
YYIVCAGGVRSAKVVDYLEANGID

SEQ ID NO: 1665031 - protein, 18 aa, Staphylococcus aureus
YYKSYSRGTVVYVKLGSN

SEQ ID NO: 1665032 - protein, 23 aa, Staphylococcus aureus
YYMYKKFGVIPEMEYEMKEIKEI

SEQ ID NO: 1665033 - protein, 23 aa, Staphylococcus aureus
YYQAYKRIRKYGGGAIASTQQIK

SEQ ID NO: 1665034 - protein, 18 aa, Staphylococcus aureus
YYQLLLIKMWQLSQIYKP

SEQ ID NO: 1665035 - protein, 18 aa, Staphylococcus aureus
YYQNLEVIWNNKAHIVND

SEQ ID NO: 1665036 - protein, 17 aa, Staphylococcus aureus
YYSPKSDEIVISDDLSY

SEQ ID NO: 1665037 - protein, 22 aa, Staphylococcus aureus
YYSSDELKQFLTFVEDDPLYYA

SEQ ID NO: 1665038 - protein, 17 aa, Staphylococcus aureus
AAAKQTLGTLTHINNAQ

SEQ ID NO: 1665039 - protein, 17 aa, Staphylococcus aureus
AAARQNLGTLNHITNAQ

SEQ ID NO: 1665040 - protein, 22 aa, Staphylococcus aureus
AACIYALEHARELNVQNALLYT

SEQ ID NO: 1665041 - protein, 21 aa, Staphylococcus aureus
AADEAYKSWKTWSANDRAELM

SEQ ID NO: 1665042 - protein, 23 aa, Staphylococcus aureus
AADIGQNFRKGWTGNQDEKDINP

SEQ ID NO: 1665043 - protein, 24 aa, Staphylococcus aureus
AAGYACGYHLVKYFLQKQTYLLKL

SEQ ID NO: 1665044 - protein, 21 aa, Staphylococcus aureus
AAGYACGYHLVKYFLQKTNIP

SEQ ID NO: 1665045 - protein, 21 aa, Staphylococcus aureus
AAHGGLHPYGATFFVFSDNLK

SEQ ID NO: 1665046 - protein, 18 aa, Staphylococcus aureus
AAIDAIQVDATVKPKANQ

SEQ ID NO: 1665047 - protein, 18 aa, Staphylococcus aureus
AAIHFELHGGNYLRNNIL

SEQ ID NO: 1665048 - protein, 18 aa, Staphylococcus aureus
AAILAEIFDKVGVPKGVF

SEQ ID NO: 1665049 - protein, 18 aa, Staphylococcus aureus
AAILSGKIDKKWLEDKNV

SEQ ID NO: 1665050 - protein, 18 aa, Staphylococcus aureus
AAILSGKINNKWFEDKNV

SEQ ID NO: 1665051 - protein, 20 aa, Staphylococcus aureus
AAIRSGKYIRARPFCYDLID

SEQ ID NO: 1665052 - protein, 22 aa, Staphylococcus aureus
AAKGGSGLHLILEQVPTREPGI

SEQ ID NO: 1665053 - protein, 23 aa, Staphylococcus aureus
AAKIIKKYGISRLDTISKKHFKN

SEQ ID NO: 1665054 - protein, 17 aa, Staphylococcus aureus
AAKRSGTTIGLIPTMGA

SEQ ID NO: 1665055 - protein, 23 aa, Staphylococcus aureus
AALARSEADWIVGINATRTLTTK

SEQ ID NO: 1665056 - protein, 25 aa, Staphylococcus aureus
AALENGKHGFAFSSGVAAISVVVML

SEQ ID NO: 1665057 - protein, 22 aa, Staphylococcus aureus
AALKSQIEGASTVAGVNQVSTT

SEQ ID NO: 1665058 - protein, 22 aa, Staphylococcus aureus
AANGAGAFTIDHVVKNNSTHNA

SEQ ID NO: 1665059 - protein, 22 aa, Staphylococcus aureus
AAPNEHKTAVLFDGAANGVGTR

SEQ ID NO: 1665060 - protein, 18 aa, Staphylococcus aureus
AAQMYGINEVYLISHALL

SEQ ID NO: 1665061 - protein, 19 aa, Staphylococcus aureus
AARMRDWLEGSALTTRQAE

SEQ ID NO: 1665062 - protein, 18 aa, Staphylococcus aureus
AAVDLKVILEYGESAPKI

SEQ ID NO: 1665063 - protein, 32 aa, Staphylococcus aureus; identical to SEQ ID NO: 1575366

SEQ ID NO: 1665064 - protein, 25 aa, Staphylococcus aureus
AAYLKEFTNLYALLIPKMNNMDDVK

SEQ ID NO: 1665065 - protein, 24 aa, Staphylococcus aureus
ACDKNKFKVIGPFVADNYVLSVET

SEQ ID NO: 1665066 - protein, 17 aa, Staphylococcus aureus
ACKDHIHMLVSIPPKLG

SEQ ID NO: 1665067 - protein, 24 aa, Staphylococcus aureus
ACKELSTILKFSFGIAPRKVEYGD

SEQ ID NO: 1665068 - protein, 17 aa, Staphylococcus aureus
ACRNWKSNFSMLGPLTL

SEQ ID NO: 1665069 - protein, 21 aa, Staphylococcus aureus
ADDSWKKKTVKKYGETETKSP

SEQ ID NO: 1665070 - protein, 17 aa, Staphylococcus aureus
ADDYCKYTKVLANKIGH

SEQ ID NO: 1665071 - protein, 23 aa, Staphylococcus aureus
ADEAYPSIKARGGGYQRIAIDTF

SEQ ID NO: 1665072 - protein, 27 aa, Staphylococcus aureus
ADEISGMIPVEWEKVYTIAYVDDEGGE

SEQ ID NO: 1665073 - protein, 25 aa, Staphylococcus aureus
ADEISGMIPVEWENIYTIAYVTDQG

SEQ ID NO: 1665074 - protein, 17 aa, Staphylococcus aureus
ADELDDGCVYVFPRKDC

SEQ ID NO: 1665075 - protein, 25 aa, Staphylococcus aureus
ADEQKRNAYNQAVSAAETILNKQTG

SEQ ID NO: 1665076 - protein, 19 aa, Staphylococcus aureus
ADFAVIKAYAKEHPEDDIP

SEQ ID NO: 1665077 - protein, 24 aa, Staphylococcus aureus
ADFSSLCFHVPFTKMGKKALESII

SEQ ID NO: 1665078 - protein, 18 aa, Staphylococcus aureus
ADGAAVYLKNGINHYHSG

SEQ ID NO: 1665079 - protein, 18 aa, Staphylococcus aureus
ADGAAVYLKNGISHYHSG

SEQ ID NO: 1665080 - protein, 23 aa, Staphylococcus aureus
ADGATFPNCLKVTAKNDEAIIMA

SEQ ID NO: 1665081 - protein, 20 aa, Staphylococcus aureus
ADGMSAYYFMQVGETGPTQK

SEQ ID NO: 1665082 - protein, 17 aa, Staphylococcus aureus
ADGREIPADLVVMAVGI

SEQ ID NO: 1665083 - protein, 19 aa, Staphylococcus aureus
ADGVFIYIGMKPLTALFKD

SEQ ID NO: 1665084 - protein, 17 aa, Staphylococcus aureus
ADHQYQIVIGPGTVDEV

SEQ ID NO: 1665085 - protein, 21 aa, Staphylococcus aureus
ADIKGLKIWVFAVDEDNEIRC

SEQ ID NO: 1665086 - protein, 21 aa, Staphylococcus aureus
ADIKGLKIWVFAVDEGSEIRC

SEQ ID NO: 1665087 - protein, 20 aa, Staphylococcus aureus
ADIKYALKEAFNESIPHTIE

SEQ ID NO: 1665088 - protein, 17 aa, Staphylococcus aureus
ADISCKVVREKVSKGYY

SEQ ID NO: 1665089 - protein, 20 aa, Staphylococcus aureus
ADKDATKATVNFTDADQAKQ

SEQ ID NO: 1665090 - protein, 25 aa, Staphylococcus aureus
ADKMKSWYERFGFGKSTEGMFDGEA

SEQ ID NO: 1665091 - protein, 21 aa, Staphylococcus aureus
ADLIKKYALPVQFIIVNEAGA

SEQ ID NO: 1665092 - protein, 20 aa, Staphylococcus aureus
ADLSPKFVVGYVETKDKHPD

SEQ ID NO: 1665093 - protein, 25 aa, Staphylococcus aureus
ADNAYSSDGYIMFGSDENYDYGAGI

SEQ ID NO: 1665094 - protein, 17 aa, Staphylococcus aureus
ADNLLKGAALNAVQVLE

SEQ ID NO: 1665095 - protein, 21 aa, Staphylococcus aureus
ADPAIDIGMLLYNYVPQLQWS

SEQ ID NO: 1665096 - protein, 27 aa, Staphylococcus aureus
ADPKKRMAIEYSMPKWIIDHWATHYGL

SEQ ID NO: 1665097 - protein, 23 aa, Staphylococcus aureus
ADQAICIGEANALDSYLNIDHII

SEQ ID NO: 1665098 - protein, 24 aa, Staphylococcus aureus
ADQAICIGEANALDSYLNIDHIIS

SEQ ID NO: 1665099 - protein, 21 aa, Staphylococcus aureus
ADRILRTSHKFDDKQTSMTKV

SEQ ID NO: 1665100 - protein, 18 aa, Staphylococcus aureus
ADRLMDVLFEMRKANIEP

SEQ ID NO: 1665101 - protein, 26 aa, Staphylococcus aureus
ADSEVLVCTVIGFPLGASTTATKAFE

SEQ ID NO: 1665102 - protein, 17 aa, Staphylococcus aureus
ADTKAKALDKINAIQTQ

SEQ ID NO: 1665103 - protein, 18 aa, Staphylococcus aureus
ADVAKIAQRQISWIKTKL

SEQ ID NO: 1665104 - protein, 17 aa, Staphylococcus aureus
ADVKSKINAASNIAGVN

SEQ ID NO: 1665105 - protein, 17 aa, Staphylococcus aureus
ADYFKLSNGSAIPDATI

SEQ ID NO: 1665106 - protein, 26 aa, Staphylococcus aureus
AEAKALNQAMEALRNSIQDQQQTESG

SEQ ID NO: 1665107 - protein, 17 aa, Staphylococcus aureus
AEAKQNAKSDIGHLSDL

SEQ ID NO: 1665108 - protein, 25 aa, Staphylococcus aureus
AEDPFTCPHGRPIIINFSKYELEKL

SEQ ID NO: 1665109 - protein, 32 aa, Staphylococcus aureus
AEEFMYPYYLTAFLRYRLGLDQIVMNQSGTTY

SEQ ID NO: 1665110 - protein, 29 aa, Staphylococcus aureus
AEFCDACIKYQYIGICYGQPGVGKTLSSR

SEQ ID NO: 1665111 - protein, 21 aa, Staphylococcus aureus
AEFNKVLKNVCIKIMNDDIKN

SEQ ID NO: 1665112 - protein, 20 aa, Staphylococcus aureus
AEGDITWRKVIDGFFSSFKQ

SEQ ID NO: 1665113 - protein, 19 aa, Staphylococcus aureus
AEGHVPRPPAMVETLAYIK

SEQ ID NO: 1665114 - protein, 19 aa, Staphylococcus aureus
AEGKWQCVNKHMRPQQIFD

SEQ ID NO: 1665115 - protein, 21 aa, Staphylococcus aureus
AEGLTTIGLDLPFPIKINQML

SEQ ID NO: 1665116 - protein, 17 aa, Staphylococcus aureus
AEGPILNPDTRYDSHGV

SEQ ID NO: 1665117 - protein, 22 aa, Staphylococcus aureus
AEHLNHPVSYYFKNNFYITPSG

SEQ ID NO: 1665118 - protein, 25 aa, Staphylococcus aureus
AEHRPRLNHPSLYVDLGDHVDLSAP

SEQ ID NO: 1665119 - protein, 17 aa, Staphylococcus aureus
AEIAKIEAIQPATTTKD

SEQ ID NO: 1665120 - protein, 17 aa, Staphylococcus aureus
AEIGHPVIGDPLYGDST

SEQ ID NO: 1665121 - protein, 24 aa, Staphylococcus aureus
AEIKNFKFFVQYGNFKDLKNYKDG

SEQ ID NO: 1665122 - protein, 20 aa, Staphylococcus aureus
AEIMPTFKALGLDDYIEVVV

SEQ ID NO: 1665123 - protein, 21 aa, Staphylococcus aureus
AEIMPTFKALGLDDYIEVVVG

SEQ ID NO: 1665124 - protein, 28 aa, Staphylococcus aureus
AEIMPTFKALVLDDYIEVVVGREDVEQV

SEQ ID NO: 1665125 - protein, 18 aa, Staphylococcus aureus
AEISFEAFLEKAAVSSSQ

SEQ ID NO: 1665126 - protein, 21 aa, Staphylococcus aureus
AEITKELLAFYAKYAKDTGLN

SEQ ID NO: 1665127 - protein, 25 aa, Staphylococcus aureus
AEKDAIEFAKKHRKEFEKVGEQFFK

SEQ ID NO: 1665128 - protein, 27 aa, Staphylococcus aureus
AEKGLELGCLFVFYGHTHVAKYEYING

SEQ ID NO: 1665129 - protein, 24 aa, Staphylococcus aureus
AEKGVYAHYMLKEIHEQPAVMRRI

SEQ ID NO: 1665130 - protein, 19 aa, Staphylococcus aureus
AEKIFKEMGLVFLAHNFRK

SEQ ID NO: 1665131 - protein, 18 aa, Staphylococcus aureus
AEKIGMISEIVHLEETAT

SEQ ID NO: 1665132 - protein, 23 aa, Staphylococcus aureus
AEKRLITEISRKGVPNIKPSVKG

SEQ ID NO: 1665133 - protein, 26 aa, Staphylococcus aureus
AEKYLQMAHEFCPYSKATQGNINVDL

SEQ ID NO: 1665134 - protein, 20 aa, Staphylococcus aureus
AEKYYHCLILLIYLNVSLLN

SEQ ID NO: 1665135 - protein, 21 aa, Staphylococcus aureus
AELFGYCYGVTGTVGEVLTPI

SEQ ID NO: 1665136 - protein, 21 aa, Staphylococcus aureus
AEMEIGFNVSYVLDVLNALKC

SEQ ID NO: 1665137 - protein, 24 aa, Staphylococcus aureus
AENIKFFKSLCKTPISNTTINEYL

SEQ ID NO: 1665138 - protein, 23 aa, Staphylococcus aureus
AENILPTRFVDHTPLAHLTLETY

SEQ ID NO: 1665139 - protein, 27 aa, Staphylococcus aureus
AEQARELGCLFAFYGHTHVAKYEYING

SEQ ID NO: 1665140 - protein, 24 aa, Staphylococcus aureus
AEQRRELINGVFIDINPYIKNMMY

SEQ ID NO: 1665141 - protein, 19 aa, Staphylococcus aureus
AEQSKKTAYDQAVAAAKAI

SEQ ID NO: 1665142 - protein, 24 aa, Staphylococcus aureus
AEQWKVSRTTIYRYLNKLNNQENK

SEQ ID NO: 1665143 - protein, 19 aa, Staphylococcus aureus
AESSAYVVANYYGLDTSDY

SEQ ID NO: 1665144 - protein, 17 aa, Staphylococcus aureus
AETAPLYALSAISYENE

SEQ ID NO: 1665145 - protein, 33 aa, Staphylococcus aureus
AEVEAIKHFISKQIDRFRVAYGHYIEDFPRQCI

SEQ ID NO: 1665146 - protein, 31 aa, Staphylococcus aureus
AEVEAIKHFISKQVDRFRVAYGHYIEDFPRQ

SEQ ID NO: 1665147 - protein, 33 aa, Staphylococcus aureus
AEVEAIKHFISKQVDRFRVAYGHYIEDFPRQCV

SEQ ID NO: 1665148 - protein, 29 aa, Staphylococcus aureus
AEVLSRYVFRSDVAYDWNISMDELNEDTR

SEQ ID NO: 1665149 - protein, 17 aa, Staphylococcus aureus
AEVYFKAVRSGYYTIND

SEQ ID NO: 1665150 - protein, 17 aa, Staphylococcus aureus
AFDHMWGYFKKFANEEE

SEQ ID NO: 1665151 - protein, 24 aa, Staphylococcus aureus
AFDRIDVEGPFYIKDNITNTITRV

SEQ ID NO: 1665152 - protein, 20 aa, Staphylococcus aureus
AFDYLKRLVSFNDNELKFLF

SEQ ID NO: 1665153 - protein, 19 aa, Staphylococcus aureus
AFEESYGFLSDPFVRDKDA

SEQ ID NO: 1665154 - protein, 24 aa, Staphylococcus aureus
AFIETAKIVLHWLKEHNIQVDLLN

SEQ ID NO: 1665155 - protein, 26 aa, Staphylococcus aureus
AFIETAKIVLRWLKEQDIQVELLNLG

SEQ ID NO: 1665156 - protein, 18 aa, Staphylococcus aureus
AFIKRLIKQFGKPQKVIT

SEQ ID NO: 1665157 - protein, 20 aa, Staphylococcus aureus
AFINAKRDVITLAEGDISVT

SEQ ID NO: 1665158 - protein, 27 aa, Staphylococcus aureus
AFKEEGLEPWTSCEFDFTSEGKLKVSF

SEQ ID NO: 1665159 - protein, 23 aa, Staphylococcus aureus
AFLEDLNQPFIYIGKDSVKLQDE

SEQ ID NO: 1665160 - protein, 23 aa, Staphylococcus aureus
AFLEDLNQPFIYIGKDSVKLQYE

SEQ ID NO: 1665161 - protein, 23 aa, Staphylococcus aureus
AFLEDLNQPFIYIGKDTVKLPDE

SEQ ID NO: 1665162 - protein, 23 aa, Staphylococcus aureus
AFLEDLNQPFIYIGKDTVKLQYE

SEQ ID NO: 1665163 - protein, 33 aa, Staphylococcus aureus
AFNKKAPYDERMPKIVIVIDELADLMMMAPQEV

SEQ ID NO: 1665164 - protein, 27 aa, Staphylococcus aureus
AFNQLESFKLALPYLMTAAELDKDKDA

SEQ ID NO: 1665165 - protein, 18 aa, Staphylococcus aureus
AFNVEGLDARMEAVNEYI

SEQ ID NO: 1665166 - protein, 21 aa, Staphylococcus aureus
AFRNEVKMYPEIAIREAVANA

SEQ ID NO: 1665167 - protein, 19 aa, Staphylococcus aureus
AGDIRRAAKRMGVNVTSAD

SEQ ID NO: 1665168 - protein, 28 aa, Staphylococcus aureus
AGDKIKDGASWLGDKIGDVWDYVQHPGK

SEQ ID NO: 1665169 - protein, 19 aa, Staphylococcus aureus
AGEVFNSKTSFRIEEKVEN

SEQ ID NO: 1665170 - protein, 18 aa, Staphylococcus aureus
AGFDYKLNANLSPKFVVG

SEQ ID NO: 1665171 - protein, 25 aa, Staphylococcus aureus
AGGCFWCMVKPFTSYPGIRSVVSGY

SEQ ID NO: 1665172 - protein, 21 aa, Staphylococcus aureus
AGGGAFGAFVTTDSYGVATTY

SEQ ID NO: 1665173 - protein, 17 aa, Staphylococcus aureus
AGGTGLYIQSLIYNYEL

SEQ ID NO: 1665174 - protein, 19 aa, Staphylococcus aureus
AGHSLGGTIAQVMTVLFNF

SEQ ID NO: 1665175 - protein, 17 aa, Staphylococcus aureus
AGIYKWHIDIQAGTCTY

SEQ ID NO: 1665176 - protein, 17 aa, Staphylococcus aureus
AGKPWIDIPENYHQVNV

SEQ ID NO: 1665177 - protein, 21 aa, Staphylococcus aureus
AGKRKIFGFRGMVNGPIDESH

SEQ ID NO: 1665178 - protein, 21 aa, Staphylococcus aureus
AGKRKIFGFRGMVNGPIDESR

SEQ ID NO: 1665179 - protein, 27 aa, Staphylococcus aureus
AGKSTLLSAICRLIRFDNGEVKIDGQL

SEQ ID NO: 1665180 - protein, 25 aa, Staphylococcus aureus
AGLCQMIKPTVIEWYIGEYNPKPAW

SEQ ID NO: 1665181 - protein, 22 aa, Staphylococcus aureus
AGLIPLLKIQGLGSKKIAKLYK

SEQ ID NO: 1665182 - protein, 21 aa, Staphylococcus aureus
AGLPKRPFKPFNEAHRQTLDH

SEQ ID NO: 1665183 - protein, 18 aa, Staphylococcus aureus
AGLYDHRMFQVVAKYDSE

SEQ ID NO: 1665184 - protein, 21 aa, Staphylococcus aureus
AGNVLRFQPPLVITYEQLDTA

SEQ ID NO: 1665185 - protein, 33 aa, Staphylococcus aureus
AGQERLPLIHKWINGRMPLIGIGSIFTADDALD

SEQ ID NO: 1665186 - protein, 23 aa, Staphylococcus aureus
AGQPVELCGTYVLLASEESSYTT

SEQ ID NO: 1665187 - protein, 17 aa, Staphylococcus aureus
AGSGKSNSIAWLAYHLA

SEQ ID NO: 1665188 - protein, 18 aa, Staphylococcus aureus
AGSRRKIAINSRIANVLK

SEQ ID NO: 1665189 - protein, 17 aa, Staphylococcus aureus
AGTFIGEYQFYTGNKPV

SEQ ID NO: 1665190 - protein, 17 aa, Staphylococcus aureus
AGTPCKVIKAASEVQDT

SEQ ID NO: 1665191 - protein, 21 aa, Staphylococcus aureus
AGTQYRGAFEENIQKLIEGVK

SEQ ID NO: 1665192 - protein, 19 aa, Staphylococcus aureus
AGVEAGLASARRGAKTLML

SEQ ID NO: 1665193 - protein, 23 aa, Staphylococcus aureus
AGYACGYHLVKYFLQKTNIPIEV

SEQ ID NO: 1665194 - protein, 18 aa, Staphylococcus aureus
AHIGPWVTNTNWSRDNVK

SEQ ID NO: 1665195 - protein, 22 aa, Staphylococcus aureus
AHILEGLRIALDHIDEIISTIR

SEQ ID NO: 1665196 - protein, 20 aa, Staphylococcus aureus
AHKSLVSKWEKAMSAPSRER

SEQ ID NO: 1665197 - protein, 17 aa, Staphylococcus aureus
AHNERLYNFLLPKDKIV

SEQ ID NO: 1665198 - protein, 20 aa, Staphylococcus aureus
AHNLKGRILVSTEGINGTLS

SEQ ID NO: 1665199 - protein, 22 aa, Staphylococcus aureus
AHNVKKGIIAWGDDEHLCKIEA

SEQ ID NO: 1665200 - protein, 19 aa, Staphylococcus aureus
AHSITAIWNFEKQNYYLRH

SEQ ID NO: 1665201 - protein, 19 aa, Staphylococcus aureus
AHSKWTSKWFSNAYKSAKG

SEQ ID NO: 1665202 - protein, 17 aa, Staphylococcus aureus
AHVKGVSVLVESKEVKQ

SEQ ID NO: 1665203 - protein, 30 aa, Staphylococcus aureus
AHYRSAYHILDMVFWFGNLQILAAHQYPTT

SEQ ID NO: 1665204 - protein, 25 aa, Staphylococcus aureus
AHYRSAYHILDMVFWFVNLQILAAH

SEQ ID NO: 1665205 - protein, 24 aa, Staphylococcus aureus
AIADKDATKALVNFTDADQAKQQA

SEQ ID NO: 1665206 - protein, 19 aa, Staphylococcus aureus
AIAKAYLLVEPDLTFDKNE

SEQ ID NO: 1665207 - protein, 32 aa, Staphylococcus aureus
AIALNEEFDLLALRKSVIRWCELLLTNKPMAL

SEQ ID NO: 1665208 - protein, 21 aa, Staphylococcus aureus
AIASVKFDINYSLKPLKLSNR

SEQ ID NO: 1665209 - protein, 24 aa, Staphylococcus aureus
AIATDVAKVLGFRDAHTAVRVLPE

SEQ ID NO: 1665210 - protein, 21 aa, Staphylococcus aureus
AICIGEANALDSYLNIDRIIS

SEQ ID NO: 1665211 - protein, 18 aa, Staphylococcus aureus
AIFKAFSRALGIALTSTN

SEQ ID NO: 1665212 - protein, 27 aa, Staphylococcus aureus
AIHRIKFDMLQPNPLRQEVMHRYPQII

SEQ ID NO: 1665213 - protein, 19 aa, Staphylococcus aureus
AIIMKRLVYCFKLDNDKFN

SEQ ID NO: 1665214 - protein, 22 aa, Staphylococcus aureus
AIKGGRFSYQEFLKTIEDSQGT

SEQ ID NO: 1665215 - protein, 23 aa, Staphylococcus aureus
AIKKELKKLQGYAEENNKSFVKH

SEQ ID NO: 1665216 - protein, 26 aa, Staphylococcus aureus
AIKKGWASMMYRIWKNPEKYKSYFIG

SEQ ID NO: 1665217 - protein, 26 aa, Staphylococcus aureus
AIKKGWPSMMYRIWKNPEKYKAYFIG

SEQ ID NO: 1665218 - protein, 24 aa, Staphylococcus aureus
AILKAEGNMNIFIIEYDDINKDIA

SEQ ID NO: 1665219 - protein, 17 aa, Staphylococcus aureus
AIMSLKSTPLSVGLSLH

SEQ ID NO: 1665220 - protein, 24 aa, Staphylococcus aureus
AINIKGEVLITEIYDDYFFKNDEW

SEQ ID NO: 1665221 - protein, 23 aa, Staphylococcus aureus
AINKEMLEELGFDFSNSHNPYSD

SEQ ID NO: 1665222 - protein, 20 aa, Staphylococcus aureus
AINLEFDRFTIPQVSKKMLE

SEQ ID NO: 1665223 - protein, 22 aa, Staphylococcus aureus
AIPVCGFAWIHWSVANVGVSGN

SEQ ID NO: 1665224 - protein, 18 aa, Staphylococcus aureus
AIQFNYRLSPLVAACLKL

SEQ ID NO: 1665225 - protein, 18 aa, Staphylococcus aureus
AIQKRKLQKFLAIDNNKE

SEQ ID NO: 1665226 - protein, 19 aa, Staphylococcus aureus
AIREKLNIVNQGLLDPDKY

SEQ ID NO: 1665227 - protein, 24 aa, Staphylococcus aureus
AIRHLEKKRIVIFAAGIGNPYFST

SEQ ID NO: 1665228 - protein, 24 aa, Staphylococcus aureus
AIRLSCKGLQQFNHAKTKQIVLSI

SEQ ID NO: 1665229 - protein, 24 aa, Staphylococcus aureus
AISDGRPKLMGIRQIIDSYLNHQI

SEQ ID NO: 1665230 - protein, 26 aa, Staphylococcus aureus
AISGKRLDSFGQRGIRATHFSFEDMN

SEQ ID NO: 1665231 - protein, 21 aa, Staphylococcus aureus
AISSVLSNVAWFWHTSYSHRT

SEQ ID NO: 1665232 - protein, 31 aa, Staphylococcus aureus
AITLGTRIDSNKSFHFSGKVNLGNKYEGNGN

SEQ ID NO: 1665233 - protein, 23 aa, Staphylococcus aureus
AIVSVKFDINYSLKPLKLSNRQA

SEQ ID NO: 1665234 - protein, 28 aa, Staphylococcus aureus
AIVTRVGVGKLCLVEFDYATSQDFLSLS

SEQ ID NO: 1665235 - protein, 20 aa, Staphylococcus aureus
AIYIEPRFNNPTGRSLTNEQ

SEQ ID NO: 1665236 - protein, 26 aa, Staphylococcus aureus
AIYINCPLFNEMPEILEAIKNQFKQY

SEQ ID NO: 1665237 - protein, 20 aa, Staphylococcus aureus
AIYRKHYKSSKEEALSKIDK

SEQ ID NO: 1665238 - protein, 17 aa, Staphylococcus aureus
AKAALNGAENLRNAKTS

SEQ ID NO: 1665239 - protein, 18 aa, Staphylococcus aureus
AKAALNGAENLRNAKTSA

SEQ ID NO: 1665240 - protein, 17 aa, Staphylococcus aureus
AKAALNGAENLRNTKTS

SEQ ID NO: 1665241 - protein, 28 aa, Staphylococcus aureus
AKAELLDWGDIRGFKTKFLRTLASHYLT

SEQ ID NO: 1665242 - protein, 30 aa, Staphylococcus aureus
AKAFVASAIKSGWKMNDFVGPVDHGAYNRI

SEQ ID NO: 1665243 - protein, 19 aa, Staphylococcus aureus
AKALDQAMQALRNSIQDQQ

SEQ ID NO: 1665244 - protein, 20 aa, Staphylococcus aureus
AKALVSRFPSATVYNTYGPT

SEQ ID NO: 1665245 - protein, 25 aa, Staphylococcus aureus
AKASIKPFIRRTPLIKSMYLSQSIT

SEQ ID NO: 1665246 - protein, 18 aa, Staphylococcus aureus
AKATFMFDKTAQKFATEQ

SEQ ID NO: 1665247 - protein, 30 aa, Staphylococcus aureus
AKAWDNRYGCVLAIEILELLKDIELDVDLY

SEQ ID NO: 1665248 - protein, 39 aa, Staphylococcus aureus
AKCTKAQFIKRLACLPSHIYRLKGFMTFEDTTHTYLIQF

SEQ ID NO: 1665249 - protein, 25 aa, Staphylococcus aureus
AKDRNKVNWGYAKSILNSWLQMNLS

SEQ ID NO: 1665250 - protein, 25 aa, Staphylococcus aureus
AKEDAKNAIKALANAKRDQINSNPD

SEQ ID NO: 1665251 - protein, 19 aa, Staphylococcus aureus
AKEGITDGLVRISVGIEDT

SEQ ID NO: 1665252 - protein, 23 aa, Staphylococcus aureus
AKENINCRCKLMYYIDEDDLPST

SEQ ID NO: 1665253 - protein, 29 aa, Staphylococcus aureus
AKEQTVLRKAYLESFRKGFKQQIENTKVI

SEQ ID NO: 1665254 - protein, 26 aa, Staphylococcus aureus
AKGCLPDCLVEWSAKRLKEQGANAVK

SEQ ID NO: 1665255 - protein, 20 aa, Staphylococcus aureus
AKGGSGLHLILEQVPTREPG

SEQ ID NO: 1665256 - protein, 26 aa, Staphylococcus aureus
AKGHLPDCLVEWSAKRLKEQGANAVK

SEQ ID NO: 1665257 - protein, 17 aa, Staphylococcus aureus
AKGHYFVTTFYRNGKLP

SEQ ID NO: 1665258 - protein, 22 aa, Staphylococcus aureus
AKGLKPRAIRAMIVGIPNVGKS

SEQ ID NO: 1665259 - protein, 20 aa, Staphylococcus aureus
AKHIIAGFRKIFINDSQTNK

SEQ ID NO: 1665260 - protein, 17 aa, Staphylococcus aureus
AKIDYLFNALIDDGPEL

SEQ ID NO: 1665261 - protein, 17 aa, Staphylococcus aureus
AKIFRYQYRDVNLTWIC

SEQ ID NO: 1665262 - protein, 18 aa, Staphylococcus aureus
AKIFRYQYRDVNLTWICK

SEQ ID NO: 1665263 - protein, 21 aa, Staphylococcus aureus
AKIIKKYGISRLDTISKKHFK

SEQ ID NO: 1665264 - protein, 20 aa, Staphylococcus aureus
AKIISELDCLQSFAEIAQKF

SEQ ID NO: 1665265 - protein, 17 aa, Staphylococcus aureus
AKIIVPFSKTNITLLTL

SEQ ID NO: 1665266 - protein, 21 aa, Staphylococcus aureus
AKIMALMGLELITNQDVYQDV

SEQ ID NO: 1665267 - protein, 21 aa, Staphylococcus aureus
AKIMTEHLNIFVGLTDEAQNA

SEQ ID NO: 1665268 - protein, 21 aa, Staphylococcus aureus
AKINASAILYRMDKLDGTNEF

SEQ ID NO: 1665269 - protein, 23 aa, Staphylococcus aureus
AKIRFECKLSQIILLGDELDGAD

SEQ ID NO: 1665270 - protein, 20 aa, Staphylococcus aureus
AKKATGYYFVNKVYDDISKN

SEQ ID NO: 1665271 - protein, 17 aa, Staphylococcus aureus
AKKFISMSIQYTPEIGR

SEQ ID NO: 1665272 - protein, 17 aa, Staphylococcus aureus
AKKFPSNLEYVDSYTDS

SEQ ID NO: 1665273 - protein, 20 aa, Staphylococcus aureus
AKKFRQANMVHVKPSINVNG

SEQ ID NO: 1665274 - protein, 18 aa, Staphylococcus aureus
AKKIERWQKIIKEAAEQS

SEQ ID NO: 1665275 - protein, 17 aa, Staphylococcus aureus
AKKIFSNIIRKQKKYGH

SEQ ID NO: 1665276 - protein, 18 aa, Staphylococcus aureus
AKKLLGHTLYRRHYYPKE

SEQ ID NO: 1665277 - protein, 19 aa, Staphylococcus aureus
AKKPVVLAGAGIKQSKSNQ

SEQ ID NO: 1665278 - protein, 18 aa, Staphylococcus aureus
AKKYKMPVIYSTHPRSWK

SEQ ID NO: 1665279 - protein, 29 aa, Staphylococcus aureus
AKLADRLGFKRIWFTEHHNVPAFACSSPE

SEQ ID NO: 1665280 - protein, 19 aa, Staphylococcus aureus
AKLAHAIVMYFNNGPQTPH

SEQ ID NO: 1665281 - protein, 23 aa, Staphylococcus aureus
AKLIDLRLDTRISYTESQIKVYR

SEQ ID NO: 1665282 - protein, 21 aa, Staphylococcus aureus
AKLLRPKILVKSLLKEEIEKL

SEQ ID NO: 1665283 - protein, 17 aa, Staphylococcus aureus
AKLSDFKSEDYPTLTEL

SEQ ID NO: 1665284 - protein, 23 aa, Staphylococcus aureus
AKNGYYNGITFHRVINDFMIQGG

SEQ ID NO: 1665285 - protein, 26 aa, Staphylococcus aureus
AKNKAEELAISIINNINKAISNQDVS

SEQ ID NO: 1665286 - protein, 26 aa, Staphylococcus aureus
AKNYAHRLLMDLGFSREVMSQSPFQM

SEQ ID NO: 1665287 - protein, 18 aa, Staphylococcus aureus
AKPGICIIGEVVGYTENT

SEQ ID NO: 1665288 - protein, 19 aa, Staphylococcus aureus
AKPLKFYNMESLNKEQQKK

SEQ ID NO: 1665289 - protein, 20 aa, Staphylococcus aureus
AKPPKLVTREMVKSMKKGSV

SEQ ID NO: 1665290 - protein, 20 aa, Staphylococcus aureus
AKPPVARIMDYGKFKFEQQE

SEQ ID NO: 1665291 - protein, 21 aa, Staphylococcus aureus
AKPPVARIMDYGKFKFEQQKK

SEQ ID NO: 1665292 - protein, 22 aa, Staphylococcus aureus
AKPYRVLRIGSFLLSESGYKIF

SEQ ID NO: 1665293 - protein, 20 aa, Staphylococcus aureus
AKQEALANLDTLRDLNQPQR

SEQ ID NO: 1665294 - protein, 20 aa, Staphylococcus aureus
AKQILNEWAEDVAEGIAQIQ

SEQ ID NO: 1665295 - protein, 21 aa, Staphylococcus aureus
AKQILNEWAEDVAEGIAQIQV

SEQ ID NO: 1665296 - protein, 17 aa, Staphylococcus aureus
AKQKFKQREYKRAAEYF

SEQ ID NO: 1665297 - protein, 24 aa, Staphylococcus aureus
AKQLKELHRQTGHIIQWYIMTSDI

SEQ ID NO: 1665298 - protein, 19 aa, Staphylococcus aureus
AKQTAKSDIGRLTDLNNAQ

SEQ ID NO: 1665299 - protein, 20 aa, Staphylococcus aureus
AKQTAKSDIGRLTDLNNAQR

SEQ ID NO: 1665300 - protein, 24 aa, Staphylococcus aureus
AKRLKEIKQIIADMFEKYQSDDVY

SEQ ID NO: 1665301 - protein, 20 aa, Staphylococcus aureus
AKSGPWLKDVLRQIEIAIVT

SEQ ID NO: 1665302 - protein, 19 aa, Staphylococcus aureus
AKSKGIICASAGNHAQGVA

SEQ ID NO: 1665303 - protein, 17 aa, Staphylococcus aureus
AKSSISMNNVTYTTQDE

SEQ ID NO: 1665304 - protein, 17 aa, Staphylococcus aureus
AKVSGVKAIEATTTAQD

SEQ ID NO: 1665305 - protein, 17 aa, Staphylococcus aureus
AKVTKVYGDQNSVSFVP

SEQ ID NO: 1665306 - protein, 20 aa, Staphylococcus aureus
AKVYREIKNYYLYIYEKESF

SEQ ID NO: 1665307 - protein, 24 aa, Staphylococcus aureus
AKVYREIKNYYLYIYEKRVSELTI

SEQ ID NO: 1665308 - protein, 19 aa, Staphylococcus aureus
AKWIKAMPLLESKEHRKTI

SEQ ID NO: 1665309 - protein, 20 aa, Staphylococcus aureus
AKYDVIYNGHTFATSLPAKF

SEQ ID NO: 1665310 - protein, 22 aa, Staphylococcus aureus
AKYFDISCVPILTRSQKSLQGI

SEQ ID NO: 1665311 - protein, 19 aa, Staphylococcus aureus
AKYIRFMVDKLMIGKSASE

SEQ ID NO: 1665312 - protein, 26 aa, Staphylococcus aureus
AKYKGYKWMEMNGLGSFNTEILPKPK

SEQ ID NO: 1665313 - protein, 17 aa, Staphylococcus aureus
AKYLLAVDFGDEVAYNI

SEQ ID NO: 1665314 - protein, 26 aa, Staphylococcus aureus
AKYNGYKWMEMNGLGSFNTEYRNRKA

SEQ ID NO: 1665315 - protein, 18 aa, Staphylococcus aureus
ALDQARNGLTVDKAPLEN

SEQ ID NO: 1665316 - protein, 19 aa, Staphylococcus aureus
ALDSIALVTPEHIVRAGAR

SEQ ID NO: 1665317 - protein, 18 aa, Staphylococcus aureus
ALEKFKIFIKNQGGDETV

SEQ ID NO: 1665318 - protein, 18 aa, Staphylococcus aureus
ALEMLGRHHKLFTDKQEV

SEQ ID NO: 1665319 - protein, 19 aa, Staphylococcus aureus
ALERYEFTGDITYLNKGET

SEQ ID NO: 1665320 - protein, 23 aa, Staphylococcus aureus
ALESQHAGLSWLTILKKKEAYEE

SEQ ID NO: 1665321 - protein, 20 aa, Staphylococcus aureus
ALFEALRSWLDDEIVADSWL

SEQ ID NO: 1665322 - protein, 26 aa, Staphylococcus aureus
ALFILGETLYNFGLIPQGLEVFRVLY

SEQ ID NO: 1665323 - protein, 17 aa, Staphylococcus aureus
ALFRPDENFKRLNNSLA

SEQ ID NO: 1665324 - protein, 21 aa, Staphylococcus aureus
ALFSIELCGGIHVRNTSEIGL

SEQ ID NO: 1665325 - protein, 20 aa, Staphylococcus aureus
ALGVFKLLLIKQFKAPYSAG

SEQ ID NO: 1665326 - protein, 19 aa, Staphylococcus aureus
ALHSFKKGMGAMLVNQLEK

SEQ ID NO: 1665327 - protein, 18 aa, Staphylococcus aureus
ALIKYCFDEIDLNRIEIS

SEQ ID NO: 1665328 - protein, 18 aa, Staphylococcus aureus
ALILPGNDQIFWLPIQKI

SEQ ID NO: 1665329 - protein, 21 aa, Staphylococcus aureus
ALKDWKYPRRILWLRKVQSTI

SEQ ID NO: 1665330 - protein, 23 aa, Staphylococcus aureus
ALKEGKIVLCDRYIDSSLAYQGY

SEQ ID NO: 1665331 - protein, 24 aa, Staphylococcus aureus
ALKIELDFYFPLLKSWSKKKKSEM

SEQ ID NO: 1665332 - protein, 20 aa, Staphylococcus aureus
ALKIKGMLLKIDRNTRSAKG

SEQ ID NO: 1665333 - protein, 21 aa, Staphylococcus aureus
ALKIKGMLLKINRKYKKCKRI

SEQ ID NO: 1665334 - protein, 25 aa, Staphylococcus aureus
ALKKWKYPRKVLWLRKVQATITDSL

SEQ ID NO: 1665335 - protein, 18 aa, Staphylococcus aureus
ALKVKGMVLYMNRNTKTT

SEQ ID NO: 1665336 - protein, 25 aa, Staphylococcus aureus
ALLAKGRLPGIQFLELFTDNLYFNI

SEQ ID NO: 1665337 - protein, 19 aa, Staphylococcus aureus
ALMPPHEYDAITVTLEVAG

SEQ ID NO: 1665338 - protein, 19 aa, Staphylococcus aureus
ALMPPHEYDVITVTLEVAG

SEQ ID NO: 1665339 - protein, 26 aa, Staphylococcus aureus
ALPNGEIKARSSISMNNVTYTTQDEH

SEQ ID NO: 1665340 - protein, 23 aa, Staphylococcus aureus
ALPNGYCRLPVIAGPCPHANACL

SEQ ID NO: 1665341 - protein, 25 aa, Staphylococcus aureus
ALQALAKEKEKALAAIDQAQTNSQV

SEQ ID NO: 1665342 - protein, 24 aa, Staphylococcus aureus
ALSLNYLPSLKFDYAQNEATRLEE

SEQ ID NO: 1665343 - protein, 25 aa, Staphylococcus aureus
ALSQSIKEFRMWVADKRIQHNDNTL

SEQ ID NO: 1665344 - protein, 25 aa, Staphylococcus aureus
ALSQSIKEFRMWVADKRIQHSDNTL

SEQ ID NO: 1665345 - protein, 18 aa, Staphylococcus aureus
ALSSYLVSLDQHRETIED

SEQ ID NO: 1665346 - protein, 21 aa, Staphylococcus aureus
ALSTLYRWNKLYKEEGLTGLI

SEQ ID NO: 1665347 - protein, 18 aa, Staphylococcus aureus
ALSTRTKLATLLKGGADI

SEQ ID NO: 1665348 - protein, 21 aa, Staphylococcus aureus
ALTDRNGLRPGRYTITKDNFI

SEQ ID NO: 1665349 - protein, 18 aa, Staphylococcus aureus
ALTHSIDGATTVAGVNQE

SEQ ID NO: 1665350 - protein, 19 aa, Staphylococcus aureus
ALTSYLKKQNCLYVLIDPY

SEQ ID NO: 1665351 - protein, 26 aa, Staphylococcus aureus
ALVYYREVVKHHQLKVTAFEEVLTVK

SEQ ID NO: 1665352 - protein, 24 aa, Staphylococcus aureus
ALWNKVNPSFALKSMFGGYDELME

SEQ ID NO: 1665353 - protein, 28 aa, Staphylococcus aureus
AMAIEGEAGIPFLRKAKKKELREYYKNI

SEQ ID NO: 1665354 - protein, 22 aa, Staphylococcus aureus
AMCRDIELHWGEPVESIRKLLQ

SEQ ID NO: 1665355 - protein, 20 aa, Staphylococcus aureus
AMCRDIELHWGEPVESTRKL

SEQ ID NO: 1665356 - protein, 27 aa, Staphylococcus aureus
AMEIEGEPGIPFLRKAKKKELRESYGN

SEQ ID NO: 1665357 - protein, 22 aa, Staphylococcus aureus
AMEKFLECVLVYKNEEEKELFE

SEQ ID NO: 1665358 - protein, 20 aa, Staphylococcus aureus
AMETLKHLVDNEIPTAEQTV

SEQ ID NO: 1665359 - protein, 25 aa, Staphylococcus aureus
AMFDIPYSIMGHVHFRKSVMDNGRC

SEQ ID NO: 1665360 - protein, 24 aa, Staphylococcus aureus
AMGRDCGDLTLWAGLSVGAETIVV

SEQ ID NO: 1665361 - protein, 17 aa, Staphylococcus aureus
AMIAIKTGNPIIFAFHP

SEQ ID NO: 1665362 - protein, 24 aa, Staphylococcus aureus
AMICNRLNVRQGLKQAGVVIPETT

SEQ ID NO: 1665363 - protein, 17 aa, Staphylococcus aureus
AMILGMSNDIKHIVVYN

SEQ ID NO: 1665364 - protein, 23 aa, Staphylococcus aureus
AMIQFKLEIPIIKRRPNFEMEER

SEQ ID NO: 1665365 - protein, 22 aa, Staphylococcus aureus
AMKEIRKNIELEQIKQQVSYMK

SEQ ID NO: 1665366 - protein, 26 aa, Staphylococcus aureus
AMNITQNEIVTWILVYTTSIEDMKQQ

SEQ ID NO: 1665367 - protein, 23 aa, Staphylococcus aureus
AMNLKLVDFKIEFGKTETDQILL

SEQ ID NO: 1665368 - protein, 17 aa, Staphylococcus aureus
AMQGYLMQSIKAELEET

SEQ ID NO: 1665369 - protein, 20 aa, Staphylococcus aureus
AMSAAAIKFAQQFEENSTFK

SEQ ID NO: 1665370 - protein, 18 aa, Staphylococcus aureus
AMSTFVIYDNTVERNSIA

SEQ ID NO: 1665371 - protein, 19 aa, Staphylococcus aureus
AMTGLKRGVANHNQVVQSD

SEQ ID NO: 1665372 - protein, 23 aa, Staphylococcus aureus
AMTQLKQGIANKAQIKVSENYHD

SEQ ID NO: 1665373 - protein, 17 aa, Staphylococcus aureus
AMTRARQDVTFSYSLMG

SEQ ID NO: 1665374 - protein, 22 aa, Staphylococcus aureus
AMYRGELAISKILYAKNESLCE

SEQ ID NO: 1665375 - protein, 21 aa, Staphylococcus aureus
ANDANDILAFINKDELELADD

SEQ ID NO: 1665376 - protein, 18 aa, Staphylococcus aureus
ANDKEFYIFDSLIQGRSF

SEQ ID NO: 1665377 - protein, 22 aa, Staphylococcus aureus
ANEIPKAKIDANKDVDKQVQAL

SEQ ID NO: 1665378 - protein, 26 aa, Staphylococcus aureus
ANEISGMIPIEWEKVYTIAYVDDEGG

SEQ ID NO: 1665379 - protein, 28 aa, Staphylococcus aureus
ANEISGMIPVEWEKVYTIAYLDDEGGEV

SEQ ID NO: 1665380 - protein, 26 aa, Staphylococcus aureus
ANEISGMIPVEWEKVYTIAYVNDRGG

SEQ ID NO: 1665381 - protein, 28 aa, Staphylococcus aureus
ANEISGMIPVEWEQVFTIAYVDDEGGEV

SEQ ID NO: 1665382 - protein, 28 aa, Staphylococcus aureus
ANEISGMIPVEWGKVYAMAYIDDEGGEV

SEQ ID NO: 1665383 - protein, 28 aa, Staphylococcus aureus
ANEISSMIPVEWEKVYTMAYIDDEGGEV

SEQ ID NO: 1665384 - protein, 30 aa, Staphylococcus aureus
ANEISSMIPVEWEKVYTMAYIDDGGDEVFF

SEQ ID NO: 1665385 - protein, 24 aa, Staphylococcus aureus
ANEKGIKGVYVILKDSNGKELDRT

SEQ ID NO: 1665386 - protein, 50 aa, Staphylococcus aureus; identical to SEQ ID NO: 1579488

SEQ ID NO: 1665387 - protein, 18 aa, Staphylococcus aureus
ANERKAAIAQTQEITAEE

SEQ ID NO: 1665388 - protein, 25 aa, Staphylococcus aureus
ANEVLKTPFHYVLSIYQNKNNDISE

SEQ ID NO: 1665389 - protein, 18 aa, Staphylococcus aureus
ANFEKLKRFGLEDKVKAI

SEQ ID NO: 1665390 - protein, 18 aa, Staphylococcus aureus
ANFGRIITAIGYSGCDIN

SEQ ID NO: 1665391 - protein, 19 aa, Staphylococcus aureus
ANFKGAAQGDWVKSAMSEI

SEQ ID NO: 1665392 - protein, 22 aa, Staphylococcus aureus
ANGACAFTIDHVVKSNSTHNAS

SEQ ID NO: 1665393 - protein, 19 aa, Staphylococcus aureus
ANGLLSIGVSPAMSEAPEE

SEQ ID NO: 1665394 - protein, 24 aa, Staphylococcus aureus
ANGLPTDGFTYKWNNAATGTNDAN

SEQ ID NO: 1665395 - protein, 18 aa, Staphylococcus aureus
ANIVKYIFESYAKGHGYR

SEQ ID NO: 1665396 - protein, 21 aa, Staphylococcus aureus
ANKFYKFAIYGRFGTGKTTFL

SEQ ID NO: 1665397 - protein, 25 aa, Staphylococcus aureus
ANKISSMIPVEWAKVYAMAYIDEES

SEQ ID NO: 1665398 - protein, 28 aa, Staphylococcus aureus
ANKISSMIPVEWEKVYAMAYIDEECGEV

SEQ ID NO: 1665399 - protein, 26 aa, Staphylococcus aureus
ANKISSMIPVEWEKVYAMAYVNERSG

SEQ ID NO: 1665400 - protein, 28 aa, Staphylococcus aureus
ANKISSMIPVEWEKVYTIAYVDDEGGEV

SEQ ID NO: 1665401 - protein, 24 aa, Staphylococcus aureus
ANKISSMIPVEWEQVYAMAYVTDQ

SEQ ID NO: 1665402 - protein, 17 aa, Staphylococcus aureus
ANKRQAYDEKVTAAEHI

SEQ ID NO: 1665403 - protein, 17 aa, Staphylococcus aureus
ANKRQAYDEKVTVAENI

SEQ ID NO: 1665404 - protein, 19 aa, Staphylococcus aureus
ANLGMAIGVLTGVATKEEL

SEQ ID NO: 1665405 - protein, 19 aa, Staphylococcus aureus
ANLSYQFNVVKEMYDYYLY

SEQ ID NO: 1665406 - protein, 20 aa, Staphylococcus aureus
ANLTEQIERGTTVAGVQGIQ

SEQ ID NO: 1665407 - protein, 20 aa, Staphylococcus aureus
ANNGVDIFVLQSLMRHAQIT

SEQ ID NO: 1665408 - protein, 20 aa, Staphylococcus aureus
ANPKLPFGGVGASGMGRYHG

SEQ ID NO: 1665409 - protein, 17 aa, Staphylococcus aureus
ANPRIGDVVRVAEPTIG

SEQ ID NO: 1665410 - protein, 21 aa, Staphylococcus aureus
ANQLLKMLVSTMETRLNDHNK

SEQ ID NO: 1665411 - protein, 22 aa, Staphylococcus aureus
ANQYKFPVAVIEEVLKAKEVYG

SEQ ID NO: 1665412 - protein, 21 aa, Staphylococcus aureus
ANRLIKIMTFAPEVEGAKEAL

SEQ ID NO: 1665413 - protein, 26 aa, Staphylococcus aureus
ANRYHLKCKIFAPYGFSEEKINIMIA

SEQ ID NO: 1665414 - protein, 23 aa, Staphylococcus aureus
ANSERYGAVYLVNLFSNIKTPEN

SEQ ID NO: 1665415 - protein, 23 aa, Staphylococcus aureus
ANSKSISASPIFKSNNNSELSKY

SEQ ID NO: 1665416 - protein, 17 aa, Staphylococcus aureus
ANTKIAIIDTGVMQTHD

SEQ ID NO: 1665417 - protein, 24 aa, Staphylococcus aureus
ANTLNLAMHGLRESIQDNAATKAN

SEQ ID NO: 1665418 - protein, 17 aa, Staphylococcus aureus
ANTLVYRGQPSPDKMWI

SEQ ID NO: 1665419 - protein, 19 aa, Staphylococcus aureus
ANVILKEFQALYDAQQSGL

SEQ ID NO: 1665420 - protein, 21 aa, Staphylococcus aureus
ANVKGLGVISSREFSKAETQR

SEQ ID NO: 1665421 - protein, 28 aa, Staphylococcus aureus
ANVKGYFIWSLMDVFSWSNGYEKRYGLF

SEQ ID NO: 1665422 - protein, 22 aa, Staphylococcus aureus
ANVPVVAGFGIRTPQHVADIKE

SEQ ID NO: 1665423 - protein, 17 aa, Staphylococcus aureus
ANYLSILQHYGMQTSLL

SEQ ID NO: 1665424 - protein, 22 aa, Staphylococcus aureus
ANYRSVGTIEFLVTDNAHYFIE

SEQ ID NO: 1665425 - protein, 18 aa, Staphylococcus aureus
APFGGYKKSGIGRETYKG

SEQ ID NO: 1665426 - protein, 18 aa, Staphylococcus aureus
APFGYTYRNGTFTINQDE

SEQ ID NO: 1665427 - protein, 19 aa, Staphylococcus aureus
APFSNYWMHNGFINIDNEK

SEQ ID NO: 1665428 - protein, 19 aa, Staphylococcus aureus
APFSYEKHEYILLSRFKNN

SEQ ID NO: 1665429 - protein, 23 aa, Staphylococcus aureus
APGDFEKRVTFGLTGADANDGII

SEQ ID NO: 1665430 - protein, 22 aa, Staphylococcus aureus
APGDFEKRVTFGLTGSDANDGI

SEQ ID NO: 1665431 - protein, 20 aa, Staphylococcus aureus
APIEKVFDAYTIKALFEKWF

SEQ ID NO: 1665432 - protein, 25 aa, Staphylococcus aureus
APIKETLAASLIRLANWKGDTPLID

SEQ ID NO: 1665433 - protein, 17 aa, Staphylococcus aureus
APKYTGQEWMVYEDLVK

SEQ ID NO: 1665434 - protein, 24 aa, Staphylococcus aureus
APLKRGASTIAMLSKSPILPVAYV

SEQ ID NO: 1665435 - protein, 27 aa, Staphylococcus aureus
APLKYKQKLPCAFCSYQSVCHVDGMID

SEQ ID NO: 1665436 - protein, 21 aa, Staphylococcus aureus
APMGSPRPRFRKTGRYAQTYM

SEQ ID NO: 1665437 - protein, 21 aa, Staphylococcus aureus
APMGSPRPRFRNTGRFVRTYM

SEQ ID NO: 1665438 - protein, 24 aa, Staphylococcus aureus
APTKQRPAKEENDDKASKDESKDK

SEQ ID NO: 1665439 - protein, 17 aa, Staphylococcus aureus
APVAPIYQKGVAHLTNP

SEQ ID NO: 1665440 - protein, 24 aa, Staphylococcus aureus
AQADGRTGVIAFEVKDTESAKQLI

SEQ ID NO: 1665441 - protein, 17 aa, Staphylococcus aureus
AQAFDEILEGLPDAMQY

SEQ ID NO: 1665442 - protein, 17 aa, Staphylococcus aureus
AQAFDEILEGLPNVCKM

SEQ ID NO: 1665443 - protein, 17 aa, Staphylococcus aureus
AQAFDEIRESINAQWVE

SEQ ID NO: 1665444 - protein, 22 aa, Staphylococcus aureus
AQAGKSLKRFVRQNEREHYIIR

SEQ ID NO: 1665445 - protein, 24 aa, Staphylococcus aureus
AQAKEAAKRALASYSNLNNAQSTA

SEQ ID NO: 1665446 - protein, 17 aa, Staphylococcus aureus
AQCQGEMLVAVPHQDVL

SEQ ID NO: 1665447 - protein, 18 aa, Staphylococcus aureus
AQEDIMFEQALTVQQFED

SEQ ID NO: 1665448 - protein, 19 aa, Staphylococcus aureus
AQEKFLQHDLLFKINGSKI

SEQ ID NO: 1665449 - protein, 27 aa, Staphylococcus aureus
AQELREILASLGLKRVEDLVGRTDLLQ

SEQ ID NO: 1665450 - protein, 20 aa, Staphylococcus aureus
AQGFRRMMQYKKINKNLVGF

SEQ ID NO: 1665451 - protein, 24 aa, Staphylococcus aureus
AQGIGFKIAERLVEDGFKVSVVDF

SEQ ID NO: 1665452 - protein, 19 aa, Staphylococcus aureus
AQINACIGRGVCSIKGDKF

SEQ ID NO: 1665453 - protein, 23 aa, Staphylococcus aureus
AQLVEGLIHFVSRQAMNIDGLGT

SEQ ID NO: 1665454 - protein, 27 aa, Staphylococcus aureus
AQSQFNLPTRYIWGIYEPQSDDQNMNE

SEQ ID NO: 1665455 - protein, 25 aa, Staphylococcus aureus
AQTEKRIKAVVGISAADIGQNFRKG

SEQ ID NO: 1665456 - protein, 28 aa, Staphylococcus aureus
AQVLKDLELRIAKALPNVDRYDIVSKSI

SEQ ID NO: 1665457 - protein, 21 aa, Staphylococcus aureus
AQYPNCFVGFATLPINEPEAA

SEQ ID NO: 1665458 - protein, 21 aa, Staphylococcus aureus
ARAGIEDIIIVTGRHKRAIED

SEQ ID NO: 1665459 - protein, 19 aa, Staphylococcus aureus
ARARGRYGGRPEKLNKQDL

SEQ ID NO: 1665460 - protein, 19 aa, Staphylococcus aureus
ARAYLPRILVEKLLIKIDD

SEQ ID NO: 1665461 - protein, 17 aa, Staphylococcus aureus
ARDGLLDPVIGRDKEIQ

SEQ ID NO: 1665462 - protein, 19 aa, Staphylococcus aureus
ARENLKIYWSPRTEKKIID

SEQ ID NO: 1665463 - protein, 18 aa, Staphylococcus aureus
ARERKKSDERIKDAKESN

SEQ ID NO: 1665464 - protein, 20 aa, Staphylococcus aureus
ARESGGLLMYGIPNMKLDKD

SEQ ID NO: 1665465 - protein, 21 aa, Staphylococcus aureus
ARFTNGLSVNDFLTRNTVIHL

SEQ ID NO: 1665466 - protein, 17 aa, Staphylococcus aureus
ARGAEVILTDTFALNKP

SEQ ID NO: 1665467 - protein, 24 aa, Staphylococcus aureus
ARGKKRIDYRLSYNFYTTYYDNVE

SEQ ID NO: 1665468 - protein, 25 aa, Staphylococcus aureus
ARGNKRIDYRLSYNFYTTYYDNVEI

SEQ ID NO: 1665469 - protein, 21 aa, Staphylococcus aureus
ARHYAIRNALRRALKALDLTL

SEQ ID NO: 1665470 - protein, 19 aa, Staphylococcus aureus
ARIFKFYKYFYSHRGPLLD

SEQ ID NO: 1665471 - protein, 25 aa, Staphylococcus aureus
ARKFKRWVTSEVLPTLRKTGAYQIP

SEQ ID NO: 1665472 - protein, 17 aa, Staphylococcus aureus
ARKTMIVAQQLYEGIDL

SEQ ID NO: 1665473 - protein, 21 aa, Staphylococcus aureus
ARKYLARISELCNVQISIFSV

SEQ ID NO: 1665474 - protein, 19 aa, Staphylococcus aureus
ARLDIVDEFSAHFIERDAL

SEQ ID NO: 1665475 - protein, 25 aa, Staphylococcus aureus
ARLKFKSEVEKNGYFAMNEKLQKKQ

SEQ ID NO: 1665476 - protein, 17 aa, Staphylococcus aureus
ARLKLSDNIKFRPINEN

SEQ ID NO: 1665477 - protein, 20 aa, Staphylococcus aureus
ARLRVMLDYIWEDIKEKGDY

SEQ ID NO: 1665478 - protein, 32 aa, Staphylococcus aureus
ARLRWYQGRYIDFDGWHGYQCADLAVDYIYWL

SEQ ID NO: 1665479 - protein, 25 aa, Staphylococcus aureus
ARMDLYNKLDMIVGYSEDEREERHP

SEQ ID NO: 1665480 - protein, 17 aa, Staphylococcus aureus
ARMEVPFDCDEFEINVE

SEQ ID NO: 1665481 - protein, 18 aa, Staphylococcus aureus
ARMFEIMETYKPYAVYHA

SEQ ID NO: 1665482 - protein, 19 aa, Staphylococcus aureus
ARMRDWLEGSILTTRQAEI

SEQ ID NO: 1665483 - protein, 25 aa, Staphylococcus aureus
ARPIKIGLAVLVDRGHRELPIRADF

SEQ ID NO: 1665484 - protein, 20 aa, Staphylococcus aureus
ARPLISKTFSSKMSIFNNQK

SEQ ID NO: 1665485 - protein, 19 aa, Staphylococcus aureus
ARPLRRIVEQQVRNKITDY

SEQ ID NO: 1665486 - protein, 20 aa, Staphylococcus aureus
ARQTQAWAAQQLHIPSEHVA

SEQ ID NO: 1665487 - protein, 18 aa, Staphylococcus aureus
ARRLLDGQASTTGYFDNI

SEQ ID NO: 1665488 - protein, 17 aa, Staphylococcus aureus
ARSLLSETICNLDNNQI

SEQ ID NO: 1665489 - protein, 22 aa, Staphylococcus aureus
ARTKIQEIDRVLASHPDVATIR

SEQ ID NO: 1665490 - protein, 17 aa, Staphylococcus aureus
ARTMGTVSYTYVTDIPS

SEQ ID NO: 1665491 - protein, 17 aa, Staphylococcus aureus
ARTPLIISGEAEKSTSL

SEQ ID NO: 1665492 - protein, 19 aa, Staphylococcus aureus
ARWNQDFRLEDFKKVIDIK

SEQ ID NO: 1665493 - protein, 25 aa, Staphylococcus aureus
ARYCEKYNAVVLFKMHPFVKNRLNI

SEQ ID NO: 1665494 - protein, 31 aa, Staphylococcus aureus
ASAKEIARTDLGRYFDRFADKLDKTQTNTEV

SEQ ID NO: 1665495 - protein, 28 aa, Staphylococcus aureus
ASCVNAPTSKDIYDWLQPLLKRKYPNIS

SEQ ID NO: 1665496 - protein, 19 aa, Staphylococcus aureus
ASDKAWAHSKSIWRGTSKW

SEQ ID NO: 1665497 - protein, 26 aa, Staphylococcus aureus
ASEINSFVPSMHWIAANPKDLNDYKY

SEQ ID NO: 1665498 - protein, 17 aa, Staphylococcus aureus
ASESAGWIKELESGGHA

SEQ ID NO: 1665499 - protein, 18 aa, Staphylococcus aureus
ASFSYRLVGACGLDSMRV

SEQ ID NO: 1665500 - protein, 24 aa, Staphylococcus aureus
ASGMGRYHGKYSFDTFTHEKSYIF

SEQ ID NO: 1665501 - protein, 24 aa, Staphylococcus aureus
ASHHLRLLKNLGIAKYRKEGKVVY

SEQ ID NO: 1665502 - protein, 22 aa, Staphylococcus aureus
ASKAGFYALMNALRLESPNLNI

SEQ ID NO: 1665503 - protein, 19 aa, Staphylococcus aureus
ASKCNYKLKKHYFVQSTNE

SEQ ID NO: 1665504 - protein, 17 aa, Staphylococcus aureus
ASLRQTSLFEMAEYIGI

SEQ ID NO: 1665505 - protein, 19 aa, Staphylococcus aureus
ASLVQYGGWESVRFQDTHY

SEQ ID NO: 1665506 - protein, 19 aa, Staphylococcus aureus
ASLVVSINDVFYVTDVGFG

SEQ ID NO: 1665507 - protein, 21 aa, Staphylococcus aureus
ASNIESKIFIKGYTITNKSVT

SEQ ID NO: 1665508 - protein, 24 aa, Staphylococcus aureus
ASNPAMLPYASWEQYKNSKFKNMI

SEQ ID NO: 1665509 - protein, 23 aa, Staphylococcus aureus
ASPEHNYQFGGAMIKSEGVDKLL

SEQ ID NO: 1665510 - protein, 25 aa, Staphylococcus aureus
ASQALAKEKEKALATIDQAQTNSQV

SEQ ID NO: 1665511 - protein, 24 aa, Staphylococcus aureus
ASQIRRFEIKRGDKVTGKVRKPKD

SEQ ID NO: 1665512 - protein, 21 aa, Staphylococcus aureus
ASRALKILAEQDVEAYQIGHI

SEQ ID NO: 1665513 - protein, 21 aa, Staphylococcus aureus
ASRLFIPLTVGGGIQSLDDIT

SEQ ID NO: 1665514 - protein, 25 aa, Staphylococcus aureus
ASTDVKTNARAELLNEMQNKITEIL

SEQ ID NO: 1665515 - protein, 22 aa, Staphylococcus aureus
ASYLVGCQRTGEAIIIDPVRDL

SEQ ID NO: 1665516 - protein, 18 aa, Staphylococcus aureus
ASYYKWVHYQSSELELEN

SEQ ID NO: 1665517 - protein, 25 aa, Staphylococcus aureus
ATAALKICNYCFEHGVVIIAVAGNV

SEQ ID NO: 1665518 - protein, 20 aa, Staphylococcus aureus
ATAYIFIKMVQQMKELGVLN

SEQ ID NO: 1665519 - protein, 19 aa, Staphylococcus aureus
ATCKEMLISGVGVTILPEI

SEQ ID NO: 1665520 - protein, 27 aa, Staphylococcus aureus
ATEAKRKGLEPLAIWMKALKHEVSIEE

SEQ ID NO: 1665521 - protein, 28 aa, Staphylococcus aureus
ATEAKRKGLEPLAIWMKARKHEVSIEEK

SEQ ID NO: 1665522 - protein, 25 aa, Staphylococcus aureus
ATELVKFYYEYAWENTKEFPNKLYE

SEQ ID NO: 1665523 - protein, 21 aa, Staphylococcus aureus
ATEPMPHLFIISDEFAELKSE

SEQ ID NO: 1665524 - protein, 22 aa, Staphylococcus aureus
ATESKSGLTIIVRSSKTEYLPQ

SEQ ID NO: 1665525 - protein, 31 aa, Staphylococcus aureus
ATGHIVNLYFPFVEVETLLTLLDMAQIYVSS

SEQ ID NO: 1665526 - protein, 24 aa, Staphylococcus aureus
ATIEKEIKCLSKGLEALYGVTCTL

SEQ ID NO: 1665527 - protein, 21 aa, Staphylococcus aureus
ATIFLMNAVYEFDLVREHQIH

SEQ ID NO: 1665528 - protein, 17 aa, Staphylococcus aureus
ATIGRLVDTKTLFLEYR

SEQ ID NO: 1665529 - protein, 22 aa, Staphylococcus aureus
ATIKNGTAMPTNLAGGSTTTIP

SEQ ID NO: 1665530 - protein, 18 aa, Staphylococcus aureus
ATIVMALYQMFHLLPSFS

SEQ ID NO: 1665531 - protein, 20 aa, Staphylococcus aureus
ATKVGIGPGRVCITKIKTGF

SEQ ID NO: 1665532 - protein, 17 aa, Staphylococcus aureus
ATLCGRDTVQYENASIT

SEQ ID NO: 1665533 - protein, 17 aa, Staphylococcus aureus
ATNLVPFLTVKQQFTLL

SEQ ID NO: 1665534 - protein, 34 aa, Staphylococcus aureus
ATQIQKAIQTQIAIQTRIATQTQIATQIQTQTVT

SEQ ID NO: 1665535 - protein, 19 aa, Staphylococcus aureus
ATQIQTAIQNRIATQTATQ

SEQ ID NO: 1665536 - protein, 19 aa, Staphylococcus aureus
ATQKYNIIKPFILGNQSLS

SEQ ID NO: 1665537 - protein, 19 aa, Staphylococcus aureus
ATQTQIAIQIQTATQTQTV

SEQ ID NO: 1665538 - protein, 21 aa, Staphylococcus aureus
ATRIQIAIRIQTVTRIQIVTQ

SEQ ID NO: 1665539 - protein, 17 aa, Staphylococcus aureus
ATSPIHLEHKLKMSQED

SEQ ID NO: 1665540 - protein, 25 aa, Staphylococcus aureus
ATSSYRFNVVKEMYDYYLYDFQIIK

SEQ ID NO: 1665541 - protein, 19 aa, Staphylococcus aureus
ATTKIWQNVHIDITPNNPS

SEQ ID NO: 1665542 - protein, 19 aa, Staphylococcus aureus
ATTTVPGLRNNIAGNEKAQ

SEQ ID NO: 1665543 - protein, 27 aa, Staphylococcus aureus
ATVSSLRLDVVIKYLIRKSRTIAKGGG

SEQ ID NO: 1665544 - protein, 21 aa, Staphylococcus aureus
ATYELLGLSTYFTAGVQEVHA

SEQ ID NO: 1665545 - protein, 17 aa, Staphylococcus aureus
ATYYLNIIEGEWHPQDL

SEQ ID NO: 1665546 - protein, 18 aa, Staphylococcus aureus
ATYYLNIIEGEWHPQDLN

SEQ ID NO: 1665547 - protein, 24 aa, Staphylococcus aureus
AVADALKAYPLLNSSWQGNEILLH

SEQ ID NO: 1665548 - protein, 23 aa, Staphylococcus aureus
AVASIISRYAFVTNMDQISKNIN

SEQ ID NO: 1665549 - protein, 18 aa, Staphylococcus aureus
AVCYDPWNAQSFITTIES

SEQ ID NO: 1665550 - protein, 18 aa, Staphylococcus aureus
AVCYDPWNAQSFVTTIES

SEQ ID NO: 1665551 - protein, 19 aa, Staphylococcus aureus
AVEKFDFNKGFKFSTYATW

SEQ ID NO: 1665552 - protein, 22 aa, Staphylococcus aureus
AVEKGLKVPEYVKASLAPGSKV

SEQ ID NO: 1665553 - protein, 19 aa, Staphylococcus aureus
AVEKHYNLYVNMLENGEKH

SEQ ID NO: 1665554 - protein, 20 aa, Staphylococcus aureus
AVEKHYNLYVNMLENGEKHA

SEQ ID NO: 1665555 - protein, 24 aa, Staphylococcus aureus
AVEREIGYRLKIISGGNSSMLPQL

SEQ ID NO: 1665556 - protein, 25 aa, Staphylococcus aureus
AVETALKAARRWAYDVKGMEPNKAE

SEQ ID NO: 1665557 - protein, 18 aa, Staphylococcus aureus
AVGIGATHLADWAYQANI

SEQ ID NO: 1665558 - protein, 27 aa, Staphylococcus aureus
AVGIGGLSNAFGFKLDTYHNTSKPNAA

SEQ ID NO: 1665559 - protein, 18 aa, Staphylococcus aureus
AVGYYLRYALSYRDISEI

SEQ ID NO: 1665560 - protein, 20 aa, Staphylococcus aureus
AVIGHTGWYDYSFAAQRFSL

SEQ ID NO: 1665561 - protein, 17 aa, Staphylococcus aureus
AVIKPKKIMLVSGHGYN

SEQ ID NO: 1665562 - protein, 17 aa, Staphylococcus aureus
AVISIDIVNGIQLKDFM

SEQ ID NO: 1665563 - protein, 20 aa, Staphylococcus aureus
AVRGRQVIINKFAVKLNKDI

SEQ ID NO: 1665564 - protein, 17 aa, Staphylococcus aureus
AVRRLIDEYTDLALVYP

SEQ ID NO: 1665565 - protein, 18 aa, Staphylococcus aureus
AVSGMTHLNDAQKQALKG

SEQ ID NO: 1665566 - protein, 24 aa, Staphylococcus aureus
AVSHGLSGLEIDVFDLHSNKSRHI

SEQ ID NO: 1665567 - protein, 17 aa, Staphylococcus aureus
AVVKIILHELCHYHLHI

SEQ ID NO: 1665568 - protein, 19 aa, Staphylococcus aureus
AVVTWKVWKIERNTRKPVI

SEQ ID NO: 1665569 - protein, 20 aa, Staphylococcus aureus
AVYELGQSVGIEMNLKSQGV

SEQ ID NO: 1665570 - protein, 17 aa, Staphylococcus aureus
AWYKQIEDLLEFAKKEE

SEQ ID NO: 1665571 - protein, 20 aa, Staphylococcus aureus
AYAFIKRLIKQFGKPQMIIT

SEQ ID NO: 1665572 - protein, 24 aa, Staphylococcus aureus
AYAKFIDEVFEIVRIDGNDPVENW

SEQ ID NO: 1665573 - protein, 19 aa, Staphylococcus aureus
AYATGGKVFDGWYNLGEDG

SEQ ID NO: 1665574 - protein, 20 aa, Staphylococcus aureus
AYEFLIGRFAATAGKKAGEF

SEQ ID NO: 1665575 - protein, 17 aa, Staphylococcus aureus
AYEMLDVAMHYKAREMA

SEQ ID NO: 1665576 - protein, 17 aa, Staphylococcus aureus
AYEMLDVVMHYKAREMA

SEQ ID NO: 1665577 - protein, 25 aa, Staphylococcus aureus
AYENLEFYGRLSGLKGNLLKDNIEK

SEQ ID NO: 1665578 - protein, 25 aa, Staphylococcus aureus
AYENPRFVEDLIRLIAADLVGFDWL

SEQ ID NO: 1665579 - protein, 19 aa, Staphylococcus aureus
AYGAELVLTPGLEAMKGAI

SEQ ID NO: 1665580 - protein, 17 aa, Staphylococcus aureus
AYGVYFTPEIKKFIAEN

SEQ ID NO: 1665581 - protein, 20 aa, Staphylococcus aureus
AYHFKSVCVNPTHVKYVAER

SEQ ID NO: 1665582 - protein, 17 aa, Staphylococcus aureus
AYHLQWHMIKYAKSDNI

SEQ ID NO: 1665583 - protein, 18 aa, Staphylococcus aureus
AYIKSSRNDGCYIEIIGI

SEQ ID NO: 1665584 - protein, 18 aa, Staphylococcus aureus
AYINITGLGFAKLTKEGA

SEQ ID NO: 1665585 - protein, 18 aa, Staphylococcus aureus
AYITMLFGGSLRRQDENF

SEQ ID NO: 1665586 - protein, 20 aa, Staphylococcus aureus
AYKRDGKVALFRPEENFKRL

SEQ ID NO: 1665587 - protein, 22 aa, Staphylococcus aureus
AYLHMGGRIGVLAVVEGSTDEE

SEQ ID NO: 1665588 - protein, 20 aa, Staphylococcus aureus
AYLLKDGKFTKVYVNQDSVS

SEQ ID NO: 1665589 - protein, 19 aa, Staphylococcus aureus
AYLLVEPDLTFDKNEKVTD

SEQ ID NO: 1665590 - protein, 18 aa, Staphylococcus aureus
AYLPIYAIQNHLCDYGIA

SEQ ID NO: 1665591 - protein, 24 aa, Staphylococcus aureus
AYMFRFKKKVKPEVDMSIKEFILL

SEQ ID NO: 1665592 - protein, 17 aa, Staphylococcus aureus
AYMPRRSFLRLNEEKEK

SEQ ID NO: 1665593 - protein, 17 aa, Staphylococcus aureus
AYNEVKQAATARKAQNA

SEQ ID NO: 1665594 - protein, 18 aa, Staphylococcus aureus
AYNFKSVCVNPTHVKYAA

SEQ ID NO: 1665595 - protein, 17 aa, Staphylococcus aureus
AYPKALVGENSWGSQVI

SEQ ID NO: 1665596 - protein, 24 aa, Staphylococcus aureus
AYQHLKSGEGIKVLLKTLDLDENE

SEQ ID NO: 1665597 - protein, 17 aa, Staphylococcus aureus
AYQIRKAFQNIIQQRFT

SEQ ID NO: 1665598 - protein, 23 aa, Staphylococcus aureus
AYSEIPLAYQILGIGPVELRVRN

SEQ ID NO: 1665599 - protein, 21 aa, Staphylococcus aureus
AYSQKGAITLGTRIDSNKSFH

SEQ ID NO: 1665600 - protein, 19 aa, Staphylococcus aureus
AYVKLWKHHGAYKEAEKLY

SEQ ID NO: 1665601 - protein, 24 aa, Staphylococcus aureus
AYVKRLAIDSCIEFVARAVAQSHF

SEQ ID NO: 1665602 - protein, 25 aa, Staphylococcus aureus
AYVKRLAIDSCIEFVARAVAQSHFK

SEQ ID NO: 1665603 - protein, 25 aa, Staphylococcus aureus
AYYKKSHKVRTLIKNDFDKVFENYD

SEQ ID NO: 1665604 - protein, 19 aa, Staphylococcus aureus
AYYYNIFVQKVFLKAIDSC

SEQ ID NO: 1665605 - protein, 17 aa, Staphylococcus aureus
CALEVVPFMSLRDKLTK

SEQ ID NO: 1665606 - protein, 25 aa, Staphylococcus aureus
CCNDRWLQRYDLISERNHFNYIRNG

SEQ ID NO: 1665607 - protein, 28 aa, Staphylococcus aureus
CDILCCYRLNRLHRNLKNALKLIKLCQT

SEQ ID NO: 1665608 - protein, 17 aa, Staphylococcus aureus
CDLTTILHNLYKRGVGT

SEQ ID NO: 1665609 - protein, 21 aa, Staphylococcus aureus
CDQLIILTAIDYVYINFNTEN

SEQ ID NO: 1665610 - protein, 18 aa, Staphylococcus aureus
CDSKMRMVKITRSGKRQN

SEQ ID NO: 1665611 - protein, 18 aa, Staphylococcus aureus
CDSLPLVVFTGQVATPGI

SEQ ID NO: 1665612 - protein, 17 aa, Staphylococcus aureus
CEADDWKPFYEAYGSHF

SEQ ID NO: 1665613 - protein, 20 aa, Staphylococcus aureus
CEKHNVVVLFKMHPFVKNRL

SEQ ID NO: 1665614 - protein, 21 aa, Staphylococcus aureus
CEKNNAVVLFKMHPFVKNRLN

SEQ ID NO: 1665615 - protein, 20 aa, Staphylococcus aureus
CEVFSYGIDEEAQFMAKNIQ

SEQ ID NO: 1665616 - protein, 38 aa, Staphylococcus aureus
CFMSEKRLATSLLLGRALELMCRLILNKFDKDIIKQTP

SEQ ID NO: 1665617 - protein, 23 aa, Staphylococcus aureus
CGCAAGLARPAAVAVATQNEHRP

SEQ ID NO: 1665618 - protein, 20 aa, Staphylococcus aureus
CGICPLLEDCREGQKRYKAS

SEQ ID NO: 1665619 - protein, 38 aa, Staphylococcus aureus
CGRPTRFTPELGNIIKYYLKCHWSPEQIVGRLLQNQIC

SEQ ID NO: 1665620 - protein, 18 aa, Staphylococcus aureus
CGSYGRNSISYNVSATDL

SEQ ID NO: 1665621 - protein, 25 aa, Staphylococcus aureus
CGYSGEILQGLIFVSSKKEAYDLAD

SEQ ID NO: 1665622 - protein, 18 aa, Staphylococcus aureus
CKACKKFTNVLPKREETT

SEQ ID NO: 1665623 - protein, 19 aa, Staphylococcus aureus
CKAYVEAHAKFAAENVENV

SEQ ID NO: 1665624 - protein, 19 aa, Staphylococcus aureus
CKEIMKHSPTALRFLKAAM

SEQ ID NO: 1665625 - protein, 17 aa, Staphylococcus aureus
CKFILKSVVQVEDNIER

SEQ ID NO: 1665626 - protein, 18 aa, Staphylococcus aureus
CKGGRKINVINHVDNNAF

SEQ ID NO: 1665627 - protein, 17 aa, Staphylococcus aureus
CKLAGPQHREFRKEILQ

SEQ ID NO: 1665628 - protein, 17 aa, Staphylococcus aureus
CKVRQSFELASPKHTEG

SEQ ID NO: 1665629 - protein, 17 aa, Staphylococcus aureus
CLDPIVFLDGIEANEML

SEQ ID NO: 1665630 - protein, 30 aa, Staphylococcus aureus
CLLTEARIFKFYKYFYSHRGPLFDYFDAKL

SEQ ID NO: 1665631 - protein, 30 aa, Staphylococcus aureus
CLNSADGEPCNECHICKGITQGTNSDVIEI

SEQ ID NO: 1665632 - protein, 22 aa, Staphylococcus aureus
CLQILKSILKPEGILCFQESDA

SEQ ID NO: 1665633 - protein, 21 aa, Staphylococcus aureus
CLSRMKMQGYMPVKRLEKPVF

SEQ ID NO: 1665634 - protein, 17 aa, Staphylococcus aureus
CLSSNFPGKEWTATLHY

SEQ ID NO: 1665635 - protein, 18 aa, Staphylococcus aureus
CLVGKPFIVNEEWAVIGH

SEQ ID NO: 1665636 - protein, 20 aa, Staphylococcus aureus
CLYGRCVPTKAFYILNDDLT

SEQ ID NO: 1665637 - protein, 21 aa, Staphylococcus aureus
CLYGRCVPTKAFYILNDDLTM

SEQ ID NO: 1665638 - protein, 17 aa, Staphylococcus aureus
CMYRFGRGQKRYIKIDK

SEQ ID NO: 1665639 - protein, 26 aa, Staphylococcus aureus
CNEKFKKELLSAGIIDDAWLTEIEAE

SEQ ID NO: 1665640 - protein, 25 aa, Staphylococcus aureus
CNEMAEAGIYKWHIDIQAGTCTYID

SEQ ID NO: 1665641 - protein, 17 aa, Staphylococcus aureus
CNFFYDKDVIVIANTNT

SEQ ID NO: 1665642 - protein, 30 aa, Staphylococcus aureus
CNIQYRPKRVIDTLEIFKIAFPTDKSYQLS

SEQ ID NO: 1665643 - protein, 17 aa, Staphylococcus aureus
CPIAQDMCKKSMPELKD

SEQ ID NO: 1665644 - protein, 21 aa, Staphylococcus aureus
CPNNKRIGFKRYAYRNDRYGF

SEQ ID NO: 1665645 - protein, 19 aa, Staphylococcus aureus
CPYGPRPGEQVKQYTVEIA

SEQ ID NO: 1665646 - protein, 20 aa, Staphylococcus aureus
CQDKVELIKKCEKYTDEVIR

SEQ ID NO: 1665647 - protein, 25 aa, Staphylococcus aureus
CQEIRKVSTVPIIFISSRNDSMDQV

SEQ ID NO: 1665648 - protein, 24 aa, Staphylococcus aureus
CQSGIRSSIAIGILEHKGYHNIIN

SEQ ID NO: 1665649 - protein, 18 aa, Staphylococcus aureus
CRDIELHWGEPVESIRKL

SEQ ID NO: 1665650 - protein, 17 aa, Staphylococcus aureus
CRIKRDIVPTDIDYHVR

SEQ ID NO: 1665651 - protein, 17 aa, Staphylococcus aureus
CRILDEKSAIVINYEDT

SEQ ID NO: 1665652 - protein, 18 aa, Staphylococcus aureus
CRIYWNNHNEWVWHERLI

SEQ ID NO: 1665653 - protein, 30 aa, Staphylococcus aureus
CRKIFNVDGFDFQLRVKKRAYSVEIVVLDH

SEQ ID NO: 1665654 - protein, 17 aa, Staphylococcus aureus
CRMIIRQILSNALKYSE

SEQ ID NO: 1665655 - protein, 19 aa, Staphylococcus aureus
CSFEGFIDYSGERFYSEAI

SEQ ID NO: 1665656 - protein, 19 aa, Staphylococcus aureus
CSISYLSTVYLEYIDNTWT

SEQ ID NO: 1665657 - protein, 20 aa, Staphylococcus aureus
CSTGLEGFLGSSFAGGTGLP

SEQ ID NO: 1665658 - protein, 17 aa, Staphylococcus aureus
CSYKEMSRVLIFSLESI

SEQ ID NO: 1665659 - protein, 27 aa, Staphylococcus aureus
CTGGTPFKTACMYGGVTLHDNNQLEEE

SEQ ID NO: 1665660 - protein, 22 aa, Staphylococcus aureus
CTGRMRYLGVLLYDADRVHEAA

SEQ ID NO: 1665661 - protein, 37 aa, Staphylococcus aureus
CTKAEFIERLACLPSHIYRLKGFMTFQDTTHTYLIQF

SEQ ID NO: 1665662 - protein, 35 aa, Staphylococcus aureus
CTKAEFIKRLACLPSHIYRLKGFMRFEDTTHTYLI

SEQ ID NO: 1665663 - protein, 18 aa, Staphylococcus aureus
CTKFVPIINSIGFNNHDG

SEQ ID NO: 1665664 - protein, 19 aa, Staphylococcus aureus
CTPKDVFAREIQIEAISTG

SEQ ID NO: 1665665 - protein, 18 aa, Staphylococcus aureus
CTPNKFHANLSIEALNHG

SEQ ID NO: 1665666 - protein, 19 aa, Staphylococcus aureus
CVGQAPKLFIGVNSAKENI

SEQ ID NO: 1665667 - protein, 18 aa, Staphylococcus aureus
CVICGKPHADLSHYEAVG

SEQ ID NO: 1665668 - protein, 17 aa, Staphylococcus aureus
CVLLDMHIGHIKSIMEL

SEQ ID NO: 1665669 - protein, 18 aa, Staphylococcus aureus
CVNSGFDLDSLFQKSLTY

SEQ ID NO: 1665670 - protein, 24 aa, Staphylococcus aureus
CYFKNMLGIKCELQSIDAFNFIQQ

SEQ ID NO: 1665671 - protein, 24 aa, Staphylococcus aureus
CYQFNVPFVVVRAVSDLANGEAEM

SEQ ID NO: 1665672 - protein, 26 aa, Staphylococcus aureus
CYQLNVLQLIRLCRYFVEVLRQSANG

SEQ ID NO: 1665673 - protein, 18 aa, Staphylococcus aureus
CYTLLRPDGKTMFYLHSI

SEQ ID NO: 1665674 - protein, 18 aa, Staphylococcus aureus
CYYYHSINSIRRVFEEFL

SEQ ID NO: 1665675 - protein, 18 aa, Staphylococcus aureus
DAAKDLNDFLGINYYMSD

SEQ ID NO: 1665676 - protein, 23 aa, Staphylococcus aureus
DAAKDLNDFLGINYYMSDWMRGY

SEQ ID NO: 1665677 - protein, 22 aa, Staphylococcus aureus
DAANLLSGLGIDPTLHDKKLAE

SEQ ID NO: 1665678 - protein, 17 aa, Staphylococcus aureus
DACKDFTVHQPGGSILV

SEQ ID NO: 1665679 - protein, 25 aa, Staphylococcus aureus
DADEAKRNVYTNAVTQAEQILNKAQ

SEQ ID NO: 1665680 - protein, 36 aa, Staphylococcus aureus; identical to SEQ ID NO: 1574270

SEQ ID NO: 1665681 - protein, 18 aa, Staphylococcus aureus
DAEKLLIRDKVKKYGFLD

SEQ ID NO: 1665682 - protein, 23 aa, Staphylococcus aureus
DAESLDMFLNIILKESNRIESLV

SEQ ID NO: 1665683 - protein, 19 aa, Staphylococcus aureus
DAEVLAMVMHIYQSFGLKH

SEQ ID NO: 1665684 - protein, 20 aa, Staphylococcus aureus
DAGKIAGLEVERIINEPTAA

SEQ ID NO: 1665685 - protein, 18 aa, Staphylococcus aureus
DAGRGYRRVVPSPQPISI

SEQ ID NO: 1665686 - protein, 17 aa, Staphylococcus aureus
DAIRILVDRVWPRGISK

SEQ ID NO: 1665687 - protein, 22 aa, Staphylococcus aureus
DAIRILVDRVWPRGISKRTANL

SEQ ID NO: 1665688 - protein, 37 aa, Staphylococcus aureus
DAITDARGIYQLKDGYKYYSFVDSIGLHSGSHVFVER

SEQ ID NO: 1665689 - protein, 25 aa, Staphylococcus aureus
DAIYQLKKFIGLCNQSIKYNEDILD

SEQ ID NO: 1665690 - protein, 24 aa, Staphylococcus aureus
DAKNFYFNYPFLFGNDDYIFKKNG

SEQ ID NO: 1665691 - protein, 23 aa, Staphylococcus aureus
DALEYWIKLIVEAYERLYANEKF

SEQ ID NO: 1665692 - protein, 18 aa, Staphylococcus aureus
DALQYFIDCMPKSEWLKC

SEQ ID NO: 1665693 - protein, 19 aa, Staphylococcus aureus
DALRIKWVEKGNIESYDDF

SEQ ID NO: 1665694 - protein, 18 aa, Staphylococcus aureus
DANDAWKKLTDKLKEKQI

SEQ ID NO: 1665695 - protein, 23 aa, Staphylococcus aureus
DAPYSGLCVESFTGDYSAGLYDY

SEQ ID NO: 1665696 - protein, 30 aa, Staphylococcus aureus
DASAALKICNYCFERGVVIIAVAGNVLRFQ

SEQ ID NO: 1665697 - protein, 18 aa, Staphylococcus aureus
DASDKAWAHSKWTSKWFS

SEQ ID NO: 1665698 - protein, 29 aa, Staphylococcus aureus
DASEFRNYILGLIFYRFLSEKAEQEYADA

SEQ ID NO: 1665699 - protein, 18 aa, Staphylococcus aureus
DATITWVSGQAPNKDNTR

SEQ ID NO: 1665700 - protein, 25 aa, Staphylococcus aureus
DATVKPKANQAIEVKAEDTKESIDQ

SEQ ID NO: 1665701 - protein, 34 aa, Staphylococcus aureus
DAVASMIIEFAEWVNTLEFFKNWKKQPGKPLDTQ

SEQ ID NO: 1665702 - protein, 19 aa, Staphylococcus aureus
DAVEKARRLAFQTEDMKRQ

SEQ ID NO: 1665703 - protein, 18 aa, Staphylococcus aureus
DAVGIGRKGTINKPYLLE

SEQ ID NO: 1665704 - protein, 23 aa, Staphylococcus aureus
DAVKRQIEGATHVNEVTQAQNNA

SEQ ID NO: 1665705 - protein, 26 aa, Staphylococcus aureus
DAVLDQYVRTCIVLKLKSKPNKLHQM

SEQ ID NO: 1665706 - protein, 21 aa, Staphylococcus aureus
DAVLKRFNVALGDIEAVITEK

SEQ ID NO: 1665707 - protein, 19 aa, Staphylococcus aureus
DAVLKRFNVALSDIEAVIT

SEQ ID NO: 1665708 - protein, 19 aa, Staphylococcus aureus
DAVNAMTHLNDAQKQALKA

SEQ ID NO: 1665709 - protein, 24 aa, Staphylococcus aureus
DAVQIVPLIIKYASELKLYGKTLK

SEQ ID NO: 1665710 - protein, 26 aa, Staphylococcus aureus
DAVYKAQLYLSSYGPKQYVEHLNQNT

SEQ ID NO: 1665711 - protein, 24 aa, Staphylococcus aureus
DAYEFLMGALRRQRVKKQASSIHH

SEQ ID NO: 1665712 - protein, 40 aa, Staphylococcus aureus
DAYSQKGAITLGTRIDSNKSFHFSGKVNLGNKYEGHGNGG

SEQ ID NO: 1665713 - protein, 17 aa, Staphylococcus aureus
DAYTNAVSHAEGILSKA

SEQ ID NO: 1665714 - protein, 22 aa, Staphylococcus aureus
DCIGVSLAEMPVDFSFVDTTAR

SEQ ID NO: 1665715 - protein, 20 aa, Staphylococcus aureus
DCNIEFGFGGLHGVHKKKNN

SEQ ID NO: 1665716 - protein, 18 aa, Staphylococcus aureus
DDAKRLANTLLNSDNTNV

SEQ ID NO: 1665717 - protein, 26 aa, Staphylococcus aureus
DDALKGKAYTSAKQFFSTVLIPLSTS

SEQ ID NO: 1665718 - protein, 32 aa, Staphylococcus aureus
DDALKGKAYTSAKQFFSTVLIPLSTSMKTLSD

SEQ ID NO: 1665719 - protein, 20 aa, Staphylococcus aureus
DDALNYYLFYLKIGIMRTPI

SEQ ID NO: 1665720 - protein, 30 aa, Staphylococcus aureus
DDALNYYLFYLKNWNYAYAYSLKLIDAYAS

SEQ ID NO: 1665721 - protein, 22 aa, Staphylococcus aureus
DDCIPHFELDAIVWEEVDNLSK

SEQ ID NO: 1665722 - protein, 24 aa, Staphylococcus aureus
DDDWLHGYWQGVPIGDSKIDLKTF

SEQ ID NO: 1665723 - protein, 19 aa, Staphylococcus aureus
DDERALQLYQDFFKAKAKQ

SEQ ID NO: 1665724 - protein, 25 aa, Staphylococcus aureus
DDFAYKHRIPWIYGGVVQSTYTEAA

SEQ ID NO: 1665725 - protein, 17 aa, Staphylococcus aureus
DDFLYPQIEEIISSFAT

SEQ ID NO: 1665726 - protein, 22 aa, Staphylococcus aureus
DDHAMLKLAYIDLNEYLKTLQL

SEQ ID NO: 1665727 - protein, 24 aa, Staphylococcus aureus
DDITWRIRDSFDYIGGLKNKEFNE

SEQ ID NO: 1665728 - protein, 24 aa, Staphylococcus aureus
DDITWRIRDSFDYIGGLKNKEISE

SEQ ID NO: 1665729 - protein, 24 aa, Staphylococcus aureus
DDKFLSCKTIFYTAPPVRPSKIHK

SEQ ID NO: 1665730 - protein, 17 aa, Staphylococcus aureus
DDKIKGLLELATQQIDK

SEQ ID NO: 1665731 - protein, 22 aa, Staphylococcus aureus
DDKNLRDAIEMYMSKKYTLDEI

SEQ ID NO: 1665732 - protein, 23 aa, Staphylococcus aureus
DDLGPEVNIINALMLLNQQQVTL

SEQ ID NO: 1665733 - protein, 25 aa, Staphylococcus aureus
DDLLEIYYSWAFREIASAVTDKPSK

SEQ ID NO: 1665734 - protein, 22 aa, Staphylococcus aureus
DDLPSLPTHAMFGENLTFDYLD

SEQ ID NO: 1665735 - protein, 17 aa, Staphylococcus aureus
DDLPTLPTHAMFGENLT

SEQ ID NO: 1665736 - protein, 19 aa, Staphylococcus aureus
DDLTEEFGIEFDDSEDIDT

SEQ ID NO: 1665737 - protein, 22 aa, Staphylococcus aureus
DDLWMNLYYLFKNLRNLFKEEG

SEQ ID NO: 1665738 - protein, 18 aa, Staphylococcus aureus
DDMQVFRFNFRHQIDKKI

SEQ ID NO: 1665739 - protein, 20 aa, Staphylococcus aureus
DDNDYLKIVEKITKKERTTQ

SEQ ID NO: 1665740 - protein, 18 aa, Staphylococcus aureus
DDPLKLLIKYEGFTGHDI

SEQ ID NO: 1665741 - protein, 26 aa, Staphylococcus aureus
DDQFRMIIKQLYFFSVANPDPTNWLD

SEQ ID NO: 1665742 - protein, 27 aa, Staphylococcus aureus
DDQFRMIIKQLYFFSVANPDPTNWLDQ

SEQ ID NO: 1665743 - protein, 23 aa, Staphylococcus aureus
DDRCFPIKAFYILNDDLNMTLIW

SEQ ID NO: 1665744 - protein, 18 aa, Staphylococcus aureus
DDTLPPLFDELPKEEPKS

SEQ ID NO: 1665745 - protein, 17 aa, Staphylococcus aureus
DDVHCLYFHLTDATTSK

SEQ ID NO: 1665746 - protein, 28 aa, Staphylococcus aureus
DDVKLEPPIKEWEKMGLLTIVDDDVIEI

SEQ ID NO: 1665747 - protein, 17 aa, Staphylococcus aureus
DDVRMPFSSAHDAQVKL

SEQ ID NO: 1665748 - protein, 19 aa, Staphylococcus aureus
DDVYWCTADPGWVTGTSYG

SEQ ID NO: 1665749 - protein, 22 aa, Staphylococcus aureus
DDWLHGYWAGVPIGTDKTDTKT

SEQ ID NO: 1665750 - protein, 19 aa, Staphylococcus aureus
DDYFFKNDEWHISAFNKFK

SEQ ID NO: 1665751 - protein, 18 aa, Staphylococcus aureus
DEAFVCYIAMTRARQDVT

SEQ ID NO: 1665752 - protein, 22 aa, Staphylococcus aureus
DEASKFLKQRDELIGDIAKLRE

SEQ ID NO: 1665753 - protein, 18 aa, Staphylococcus aureus
DEAYLDYGMAYDVELAPH

SEQ ID NO: 1665754 - protein, 19 aa, Staphylococcus aureus
DEDHYASLIFVLSAIDNHS

SEQ ID NO: 1665755 - protein, 17 aa, Staphylococcus aureus
DEDKCLVVIPLNKAISE

SEQ ID NO: 1665756 - protein, 21 aa, Staphylococcus aureus
DEIDMVINISALKDGRFDDVQ

SEQ ID NO: 1665757 - protein, 30 aa, Staphylococcus aureus
DEIQVGLGRTGKWFAMEWEQVIPDIYILGK

SEQ ID NO: 1665758 - protein, 30 aa, Staphylococcus aureus
DEIQVGLGRTGKWLAMEWEQVVPDIYILGK

SEQ ID NO: 1665759 - protein, 17 aa, Staphylococcus aureus
DEKARIPFIKHMQNSGL

SEQ ID NO: 1665760 - protein, 17 aa, Staphylococcus aureus
DEKRYPVKMEHNKIIPT

SEQ ID NO: 1665761 - protein, 24 aa, Staphylococcus aureus
DELIQKLMLIMPEGPALTLNPDFL

SEQ ID NO: 1665762 - protein, 25 aa, Staphylococcus aureus
DELNEGVAPGVPWKNGPVPEDKAIY

SEQ ID NO: 1665763 - protein, 25 aa, Staphylococcus aureus
DELNEGVAPGVPWKNGPVPVDKAIY

SEQ ID NO: 1665764 - protein, 27 aa, Staphylococcus aureus
DELNLNESITCYGLGLSQSTGNVTDLI

SEQ ID NO: 1665765 - protein, 26 aa, Staphylococcus aureus
DELNLNESITCYGLGLTQSTDNVTDL

SEQ ID NO: 1665766 - protein, 21 aa, Staphylococcus aureus
DELSKVAGYYIKSGVNADNVK

SEQ ID NO: 1665767 - protein, 19 aa, Staphylococcus aureus
DELSMGMSNDYLIAVDEGA

SEQ ID NO: 1665768 - protein, 22 aa, Staphylococcus aureus
DELTEFEVAYAPPYSHPKDLIN

SEQ ID NO: 1665769 - protein, 32 aa, Staphylococcus aureus
DENEKKKAVAFDFFQDNGFGFITPYNLDDLNY

SEQ ID NO: 1665770 - protein, 21 aa, Staphylococcus aureus
DENHIIYLFLGQFFTKNEDPW

SEQ ID NO: 1665771 - protein, 18 aa, Staphylococcus aureus
DENISFYKLVNNFSPEVA

SEQ ID NO: 1665772 - protein, 23 aa, Staphylococcus aureus
DENPHAHLLCTLRGIDENNEFEP

SEQ ID NO: 1665773 - protein, 25 aa, Staphylococcus aureus
DENRRIIEGFKHLTPNTNHYRTVMP

SEQ ID NO: 1665774 - protein, 22 aa, Staphylococcus aureus
DEQKERIIIYMKYNVKGYKEIN

SEQ ID NO: 1665775 - protein, 24 aa, Staphylococcus aureus
DEQKRNAYNQAVSAAETILNKQTG

SEQ ID NO: 1665776 - protein, 17 aa, Staphylococcus aureus
DEQRQWQWVKGIIEAYQ

SEQ ID NO: 1665777 - protein, 28 aa, Staphylococcus aureus
DEQVTYEKFAFATLGVRNGATFISTNPD

SEQ ID NO: 1665778 - protein, 17 aa, Staphylococcus aureus
DEQVTYEKIAIATLGVR

SEQ ID NO: 1665779 - protein, 17 aa, Staphylococcus aureus
DEQVTYEKLAFATLGVR

SEQ ID NO: 1665780 - protein, 20 aa, Staphylococcus aureus
DERLKSCRKLDAIKDFKEID

SEQ ID NO: 1665781 - protein, 24 aa, Staphylococcus aureus
DESFKLGIVLSYLKQYRASQQLLY

SEQ ID NO: 1665782 - protein, 18 aa, Staphylococcus aureus
DESIKVTLENGAVLESKT

SEQ ID NO: 1665783 - protein, 31 aa, Staphylococcus aureus
DESKYGEVIYRMGFGQAVSRGILTDYKVMVL

SEQ ID NO: 1665784 - protein, 18 aa, Staphylococcus aureus
DESRTIKAIEELETQMGI

SEQ ID NO: 1665785 - protein, 24 aa, Staphylococcus aureus
DETLFKLQRQFAYTKEEIHKYIQE

SEQ ID NO: 1665786 - protein, 22 aa, Staphylococcus aureus
DEVAVGFGRTGKMFACNHEGVQ

SEQ ID NO: 1665787 - protein, 17 aa, Staphylococcus aureus
DEVLKKIRMHITQGIMS

SEQ ID NO: 1665788 - protein, 27 aa, Staphylococcus aureus
DEYHATYNWKTRLRMLNHFPKPTFEDI

SEQ ID NO: 1665789 - protein, 21 aa, Staphylococcus aureus
DEYTKRFNSLASFNTNINIIP

SEQ ID NO: 1665790 - protein, 27 aa, Staphylococcus aureus
DEYTKYKISGTWYPFYKKNDGDLTKEF

SEQ ID NO: 1665791 - protein, 21 aa, Staphylococcus aureus
DEYYQLLLIKMWQLSQIYKPS

SEQ ID NO: 1665792 - protein, 24 aa, Staphylococcus aureus
DFAKNWLYTFLKAIGIDDNNGQFN

SEQ ID NO: 1665793 - protein, 23 aa, Staphylococcus aureus
DFDDIIQIGITFVRNIQIIDTYH

SEQ ID NO: 1665794 - protein, 23 aa, Staphylococcus aureus
DFDKPKFEMWIDVLSQNGDYQPT

SEQ ID NO: 1665795 - protein, 17 aa, Staphylococcus aureus
DFDSILRRMMQDMQNSN

SEQ ID NO: 1665796 - protein, 25 aa, Staphylococcus aureus
DFEKHMYAIHILTSLYASTSNTPHI

SEQ ID NO: 1665797 - protein, 20 aa, Staphylococcus aureus
DFENFYLLTCNMTDSLNRQL

SEQ ID NO: 1665798 - protein, 17 aa, Staphylococcus aureus
DFGTFDMYGFKATYTDE

SEQ ID NO: 1665799 - protein, 26 aa, Staphylococcus aureus
DFGYMWECPDYFNLDNQDVILICPQG

SEQ ID NO: 1665800 - protein, 18 aa, Staphylococcus aureus
DFIIIEAYMFRFKKKVKP

SEQ ID NO: 1665801 - protein, 22 aa, Staphylococcus aureus
DFIMKLPDGYKTLLHEKGNNLS

SEQ ID NO: 1665802 - protein, 22 aa, Staphylococcus aureus
DFIMKLPDGYKTVLHEKGNNLS

SEQ ID NO: 1665803 - protein, 18 aa, Staphylococcus aureus
DFITGHSLGGREAVILGM

SEQ ID NO: 1665804 - protein, 19 aa, Staphylococcus aureus
DFLVANLVEGYRMLEVARD

SEQ ID NO: 1665805 - protein, 18 aa, Staphylococcus aureus
DFMFEGALSENDYFEYID

SEQ ID NO: 1665806 - protein, 19 aa, Staphylococcus aureus
DFMFEGAVSENDYFEYIDI

SEQ ID NO: 1665807 - protein, 18 aa, Staphylococcus aureus
DFNRYIIEIMKIRQRVME

SEQ ID NO: 1665808 - protein, 24 aa, Staphylococcus aureus
DFQARRANIRFKRDKAAKPELAHT

SEQ ID NO: 1665809 - protein, 20 aa, Staphylococcus aureus
DFQNLILLFLESWYLKASFS

SEQ ID NO: 1665810 - protein, 31 aa, Staphylococcus aureus
DFRAVGLAIKEARMKRGLTREQVGTMIEIDP

SEQ ID NO: 1665811 - protein, 20 aa, Staphylococcus aureus
DFRGEQPFTNYVQCLITSVK

SEQ ID NO: 1665812 - protein, 30 aa, Staphylococcus aureus
DFSSYINQFEWRDAKFPVVQNVNAQGETDN

SEQ ID NO: 1665813 - protein, 30 aa, Staphylococcus aureus
DFSSYINQFEWRDAKFPVVQNVNAQGVTDK

SEQ ID NO: 1665814 - protein, 18 aa, Staphylococcus aureus
DFTSFCQLNELTAVVMDY

SEQ ID NO: 1665815 - protein, 46 aa, Staphylococcus aureus
DFTYTFDPRVEKLMQAFWPGPISFILPLKLGYLCRKVSGGLSSVAV

SEQ ID NO: 1665816 - protein, 17 aa, Staphylococcus aureus
DFVKQLFTLLEYTKTNH

SEQ ID NO: 1665817 - protein, 26 aa, Staphylococcus aureus
DFVVEGPLWIQVHAFDKGVEVTISKS

SEQ ID NO: 1665818 - protein, 19 aa, Staphylococcus aureus
DFYFIKLNHFNDDTVTYDS

SEQ ID NO: 1665819 - protein, 17 aa, Staphylococcus aureus
DGAAIYLKNGINHYHSG

SEQ ID NO: 1665820 - protein, 23 aa, Staphylococcus aureus
DGAKFCPECGYKIANLNNVSNIR

SEQ ID NO: 1665821 - protein, 25 aa, Staphylococcus aureus
DGAYCINGYRWITYIANSGQRRYIA

SEQ ID NO: 1665822 - protein, 27 aa, Staphylococcus aureus
DGAYCINGYRWITYIANSGQRRYIATG

SEQ ID NO: 1665823 - protein, 26 aa, Staphylococcus aureus
DGDISVGAFFRARLGNEVLENLIEPL

SEQ ID NO: 1665824 - protein, 20 aa, Staphylococcus aureus
DGFNVKAFIRSGVTDEELKE

SEQ ID NO: 1665825 - protein, 18 aa, Staphylococcus aureus
DGFVFGGYIDWPSFVDYE

SEQ ID NO: 1665826 - protein, 21 aa, Staphylococcus aureus
DGGNFGCHFAFDEKDEREDIL

SEQ ID NO: 1665827 - protein, 17 aa, Staphylococcus aureus
DGGNYLRNNILKFSLFT

SEQ ID NO: 1665828 - protein, 34 aa, Staphylococcus aureus
DGHLLIQWYLKGIYKFKYAILEAVRKVFDYKSIY

SEQ ID NO: 1665829 - protein, 17 aa, Staphylococcus aureus
DGHTTALMLFVQRCKDM

SEQ ID NO: 1665830 - protein, 21 aa, Staphylococcus aureus
DGITKLVYIKSIQDTIEAVGK

SEQ ID NO: 1665831 - protein, 19 aa, Staphylococcus aureus
DGKEIKKAIGQDATVSLFD

SEQ ID NO: 1665832 - protein, 19 aa, Staphylococcus aureus
DGKIYKFYLYINGILETSD

SEQ ID NO: 1665833 - protein, 25 aa, Staphylococcus aureus
DGKKPIKVILSKSGNIHFNQQIYQD

SEQ ID NO: 1665834 - protein, 21 aa, Staphylococcus aureus
DGKLCPAINEYFWELDYSVKD

SEQ ID NO: 1665835 - protein, 19 aa, Staphylococcus aureus
DGKSIFESVRILRDKLPLR

SEQ ID NO: 1665836 - protein, 17 aa, Staphylococcus aureus
DGLLVPFVRDCDKKNFA

SEQ ID NO: 1665837 - protein, 17 aa, Staphylococcus aureus
DGNGFQCGIWYEGTLVG

SEQ ID NO: 1665838 - protein, 18 aa, Staphylococcus aureus
DGNKEYAGHSIVINPNGD

SEQ ID NO: 1665839 - protein, 23 aa, Staphylococcus aureus
DGNMLKPWFVNSVENPVSKRQFY

SEQ ID NO: 1665840 - protein, 23 aa, Staphylococcus aureus
DGNQFVCRFNVAILDNGYYLPED

SEQ ID NO: 1665841 - protein, 17 aa, Staphylococcus aureus
DGNTFICRFNVAILDDG

SEQ ID NO: 1665842 - protein, 24 aa, Staphylococcus aureus
DGNTFKCRFNVAILDDGYYLPMDK

SEQ ID NO: 1665843 - protein, 20 aa, Staphylococcus aureus
DGREGVLTYDVLDYIKKIIH

SEQ ID NO: 1665844 - protein, 20 aa, Staphylococcus aureus
DGRIHPGRIEDMVEKARKEI

SEQ ID NO: 1665845 - protein, 20 aa, Staphylococcus aureus
DGRSGSIYKGRRLESYSFDI

SEQ ID NO: 1665846 - protein, 24 aa, Staphylococcus aureus
DGTAIHIIVPIAAVDKVTHLRALL

SEQ ID NO: 1665847 - protein, 17 aa, Staphylococcus aureus
DGTKLGFMSFFTKASVA

SEQ ID NO: 1665848 - protein, 19 aa, Staphylococcus aureus
DGVELGDIGCRFYTEDENT

SEQ ID NO: 1665849 - protein, 19 aa, Staphylococcus aureus
DGWYSLHLFYAVNWASLRL

SEQ ID NO: 1665850 - protein, 24 aa, Staphylococcus aureus
DGYRIGYGGGYYDRFLANYLTKTI

SEQ ID NO: 1665851 - protein, 21 aa, Staphylococcus aureus
DHAMLKLAYIDLNEDLKTLQL

SEQ ID NO: 1665852 - protein, 17 aa, Staphylococcus aureus
DHLIDYFILPLRQIEQV

SEQ ID NO: 1665853 - protein, 18 aa, Staphylococcus aureus
DHLMGVPILAKHFKDDPN

SEQ ID NO: 1665854 - protein, 20 aa, Staphylococcus aureus
DHNLTFAIEFCSKTIANNTK

SEQ ID NO: 1665855 - protein, 27 aa, Staphylococcus aureus
DHRIIDGKEAVGFLKTIKELIENPEDL

SEQ ID NO: 1665856 - protein, 35 aa, Staphylococcus aureus
DHVEELTRIGLDLPFPIKINQMLGHQTSFLTYEGL

SEQ ID NO: 1665857 - protein, 22 aa, Staphylococcus aureus
DHYRKAYAHFIHQYMKQAAPFI

SEQ ID NO: 1665858 - protein, 18 aa, Staphylococcus aureus
DIASKLKEFFNFMNKNCE

SEQ ID NO: 1665859 - protein, 23 aa, Staphylococcus aureus
DIDKEINKLMALIERTTTVNDIT

SEQ ID NO: 1665860 - protein, 36 aa, Staphylococcus aureus
DIDYPITIVFQASCFNEFVVKGRLSNIVGKLEHYAI

SEQ ID NO: 1665861 - protein, 18 aa, Staphylococcus aureus
DIEKMTAIVNIVKGDRGN

SEQ ID NO: 1665862 - protein, 18 aa, Staphylococcus aureus
DIENGLKGEEKVLIEQLA

SEQ ID NO: 1665863 - protein, 18 aa, Staphylococcus aureus
DIERELGHDISFRERNGK

SEQ ID NO: 1665864 - protein, 18 aa, Staphylococcus aureus
DIERELGHEISFRERNGK

SEQ ID NO: 1665865 - protein, 23 aa, Staphylococcus aureus
DIEYDKGWFALHIHIDKPSQDTF

SEQ ID NO: 1665866 - protein, 19 aa, Staphylococcus aureus
DIGALFRKGPGDVVSINDQ

SEQ ID NO: 1665867 - protein, 24 aa, Staphylococcus aureus
DIIEINCHGGILTINRVLELTMTY

SEQ ID NO: 1665868 - protein, 23 aa, Staphylococcus aureus
DIIELLKQLQLDFDITYLFITHD

SEQ ID NO: 1665869 - protein, 19 aa, Staphylococcus aureus
DIILHLIKTYGVDFGTGYA

SEQ ID NO: 1665870 - protein, 20 aa, Staphylococcus aureus
DIISPEKELVVLTRLNEKEI

SEQ ID NO: 1665871 - protein, 27 aa, Staphylococcus aureus
DIIVIKCNYRLGALGYLDWSYFNKDFH

SEQ ID NO: 1665872 - protein, 26 aa, Staphylococcus aureus
DIKAIYKRDYLCILGQTVHDKLGHEM

SEQ ID NO: 1665873 - protein, 26 aa, Staphylococcus aureus
DIKAIYKRDYLCILGQTVHDKLGHEV

SEQ ID NO: 1665874 - protein, 22 aa, Staphylococcus aureus
DIKELIEILISPSIGTDIKYEL

SEQ ID NO: 1665875 - protein, 22 aa, Staphylococcus aureus
DIKHSLKCLVLKLITENNQEDG

SEQ ID NO: 1665876 - protein, 28 aa, Staphylococcus aureus
DIKLEFGDAPLLVKYLWDNLTDAPHGIV

SEQ ID NO: 1665877 - protein, 24 aa, Staphylococcus aureus
DIKSLDCLIYASGQSLYGVLQNMK

SEQ ID NO: 1665878 - protein, 23 aa, Staphylococcus aureus
DILNPYLCIIFCNSRDNANDLAS

SEQ ID NO: 1665879 - protein, 19 aa, Staphylococcus aureus
DINTIPFDLYVYVNKYISN

SEQ ID NO: 1665880 - protein, 21 aa, Staphylococcus aureus
DINTPKLIVFESVYSMDGDIA

SEQ ID NO: 1665881 - protein, 27 aa, Staphylococcus aureus
DIQQGFGRTGKWSSVSHFNFTPDLITF

SEQ ID NO: 1665882 - protein, 21 aa, Staphylococcus aureus
DIRLPTVRLYIIRRIVDECEK

SEQ ID NO: 1665883 - protein, 17 aa, Staphylococcus aureus
DISCNLGSLNIVNVMES

SEQ ID NO: 1665884 - protein, 18 aa, Staphylococcus aureus
DISLATLLGVHQGLGHNT

SEQ ID NO: 1665885 - protein, 23 aa, Staphylococcus aureus
DIVEFKDGVLMIAGDDESLVDTI

SEQ ID NO: 1665886 - protein, 22 aa, Staphylococcus aureus
DIVELLKYLYIEEVAFVCHEMS

SEQ ID NO: 1665887 - protein, 19 aa, Staphylococcus aureus
DIVEYPGKEDLAIVHVHET

SEQ ID NO: 1665888 - protein, 29 aa, Staphylococcus aureus
DIYSRPRGKFRFPMSVAYENENVEQSADI

SEQ ID NO: 1665889 - protein, 27 aa, Staphylococcus aureus
DKAAKAFFKDHLDQVDEIYEFNEVLER

SEQ ID NO: 1665890 - protein, 20 aa, Staphylococcus aureus
DKAIATKILLASQFYKAEDY

SEQ ID NO: 1665891 - protein, 29 aa, Staphylococcus aureus
DKAKRDAYTNAVSRAEAILNKTQGANTSK

SEQ ID NO: 1665892 - protein, 18 aa, Staphylococcus aureus
DKANAFVDTLNGLNQQQQ

SEQ ID NO: 1665893 - protein, 17 aa, Staphylococcus aureus
DKANAFVNSLNGLNQQQ

SEQ ID NO: 1665894 - protein, 22 aa, Staphylococcus aureus
DKETFMNWMTWSQHNEILSTKI

SEQ ID NO: 1665895 - protein, 18 aa, Staphylococcus aureus
DKFFKEREGKYQVEEKEA

SEQ ID NO: 1665896 - protein, 21 aa, Staphylococcus aureus
DKFKLTVLVDMFGRETPVEVE

SEQ ID NO: 1665897 - protein, 23 aa, Staphylococcus aureus
DKFPEKARKIWLSTDKQKFEDVI

SEQ ID NO: 1665898 - protein, 27 aa, Staphylococcus aureus
DKGEIEGIAYDRLWIHLIPVIKEQQLR

SEQ ID NO: 1665899 - protein, 20 aa, Staphylococcus aureus
DKGGQCVRQLLQADDVEVSD

SEQ ID NO: 1665900 - protein, 21 aa, Staphylococcus aureus
DKGRRLNVFYATQVAIEPPTF

SEQ ID NO: 1665901 - protein, 25 aa, Staphylococcus aureus
DKHYPHLRFGFIHVPYIPEQVDGKS

SEQ ID NO: 1665902 - protein, 25 aa, Staphylococcus aureus
DKHYPHLRFGFIHVPYIPEQVIRKP

SEQ ID NO: 1665903 - protein, 25 aa, Staphylococcus aureus
DKHYPHLRFGFIHVPYIPEQVVGKS

SEQ ID NO: 1665904 - protein, 25 aa, Staphylococcus aureus
DKIIAGDWFYGMKIPPQRQLAIQYN

SEQ ID NO: 1665905 - protein, 18 aa, Staphylococcus aureus
DKILCMNGSYVINKGDKL

SEQ ID NO: 1665906 - protein, 25 aa, Staphylococcus aureus
DKINFGDGIARFDLRKEGAKHFHHH

SEQ ID NO: 1665907 - protein, 24 aa, Staphylococcus aureus
DKIRHLPSYFGLDFGYINDPSALI

SEQ ID NO: 1665908 - protein, 20 aa, Staphylococcus aureus
DKITLAFDMNKFHFFDEKTG

SEQ ID NO: 1665909 - protein, 19 aa, Staphylococcus aureus
DKIYWERVQLFVEGHSENL

SEQ ID NO: 1665910 - protein, 24 aa, Staphylococcus aureus
DKKHLPDFILKKSFQKIKKQMISQ

SEQ ID NO: 1665911 - protein, 30 aa, Staphylococcus aureus
DKKISFTKFKSCLKKHSFEQIMQGTREYLK

SEQ ID NO: 1665912 - protein, 29 aa, Staphylococcus aureus
DKKMSFAKFKSCLKKHTFEQIMQGTREYL

SEQ ID NO: 1665913 - protein, 20 aa, Staphylococcus aureus
DKLAKGMIDAESFRKQTHLM

SEQ ID NO: 1665914 - protein, 24 aa, Staphylococcus aureus
DKLLETYYSWAFYEIVSAVTDDYI

SEQ ID NO: 1665915 - protein, 23 aa, Staphylococcus aureus
DKLMIQVINDFYKLRLKKLNSAS

SEQ ID NO: 1665916 - protein, 24 aa, Staphylococcus aureus
DKLNELRNGFNIDNGITLEEYFEN

SEQ ID NO: 1665917 - protein, 20 aa, Staphylococcus aureus
DKLRFEANFIELRNRDITFI

SEQ ID NO: 1665918 - protein, 24 aa, Staphylococcus aureus
DKLVEIFWSGPLNIILKNKTSYNY

SEQ ID NO: 1665919 - protein, 25 aa, Staphylococcus aureus
DKLVIKRNGNVVTTFTRRNNTSPWV

SEQ ID NO: 1665920 - protein, 20 aa, Staphylococcus aureus
DKNDVVGFFVLHRYYQHEGY

SEQ ID NO: 1665921 - protein, 28 aa, Staphylococcus aureus
DKNKVIQIWPEFDIDGAVELQYTFRLIQ

SEQ ID NO: 1665922 - protein, 27 aa, Staphylococcus aureus
DKNTSRIYAKFGKEIYVAAKSGEPNPK

SEQ ID NO: 1665923 - protein, 26 aa, Staphylococcus aureus
DKRIRHYDFEKVLGFSDFLKPQHLNK

SEQ ID NO: 1665924 - protein, 17 aa, Staphylococcus aureus
DKRRWEVYREWKHFING

SEQ ID NO: 1665925 - protein, 26 aa, Staphylococcus aureus
DKSDLEIMGYFFLKIVNIKLEKDVSG

SEQ ID NO: 1665926 - protein, 21 aa, Staphylococcus aureus
DKSNVRFVIHYNMPGDLESYY

SEQ ID NO: 1665927 - protein, 23 aa, Staphylococcus aureus
DKSVKRKYIALVHGNIPHDYGTI

SEQ ID NO: 1665928 - protein, 24 aa, Staphylococcus aureus
DKTAYKMEVTLGNDTYSKDVIVDY

SEQ ID NO: 1665929 - protein, 17 aa, Staphylococcus aureus
DKTETLNSINFTDADKA

SEQ ID NO: 1665930 - protein, 28 aa, Staphylococcus aureus
DKVGGIGFDLRNFWTLKLNSETMKKSYE

SEQ ID NO: 1665931 - protein, 25 aa, Staphylococcus aureus
DKVLELIDYPSFFSMQNLNLPTDKK

SEQ ID NO: 1665932 - protein, 24 aa, Staphylococcus aureus
DKVLYLEIGIGYTTPQFVKHPFQR

SEQ ID NO: 1665933 - protein, 19 aa, Staphylococcus aureus
DKVQGNAIAKAEAEQLKQN

SEQ ID NO: 1665934 - protein, 35 aa, Staphylococcus aureus
DKVTGCPAIPCYQCEYCLKGEYARCEKLFVIGSYE

SEQ ID NO: 1665935 - protein, 17 aa, Staphylococcus aureus
DKWFERMTEYGFENGID

SEQ ID NO: 1665936 - protein, 18 aa, Staphylococcus aureus
DKYWGFRTWGNADAMAQK

SEQ ID NO: 1665937 - protein, 23 aa, Staphylococcus aureus
DLAFRGQELLAFIKEAAERYDFD

SEQ ID NO: 1665938 - protein, 22 aa, Staphylococcus aureus
DLAFRGQELLTFIKEAAERYEF

SEQ ID NO: 1665939 - protein, 18 aa, Staphylococcus aureus
DLAKARYHKIVIMTDADV

SEQ ID NO: 1665940 - protein, 23 aa, Staphylococcus aureus
DLDHARQALTPDKAPLQTAKTQL

SEQ ID NO: 1665941 - protein, 17 aa, Staphylococcus aureus
DLEIELYDSARFMTVTG

SEQ ID NO: 1665942 - protein, 23 aa, Staphylococcus aureus
DLEPWTSCEFDFTREGELKVSFD

SEQ ID NO: 1665943 - protein, 26 aa, Staphylococcus aureus
DLEPWTSCEFDFTREGKLKVSFDYID

SEQ ID NO: 1665944 - protein, 26 aa, Staphylococcus aureus
DLEPWTSCEFDFTREGKLNVSFDYID

SEQ ID NO: 1665945 - protein, 21 aa, Staphylococcus aureus
DLEPWTSCEFDFTSEGKLNVS

SEQ ID NO: 1665946 - protein, 21 aa, Staphylococcus aureus
DLESRITKALPNVDRYDIVSK

SEQ ID NO: 1665947 - protein, 25 aa, Staphylococcus aureus
DLETSLKINNEWLATAENISFELSK

SEQ ID NO: 1665948 - protein, 18 aa, Staphylococcus aureus
DLGQNMFYPKGILSQSAE

SEQ ID NO: 1665949 - protein, 24 aa, Staphylococcus aureus
DLIRRLGKRTGITFTAHILRHTHA

SEQ ID NO: 1665950 - protein, 20 aa, Staphylococcus aureus
DLKAELIDQVGYFIEPQDLF

SEQ ID NO: 1665951 - protein, 21 aa, Staphylococcus aureus
DLKAELIDQVGYFIEPQDLFS

SEQ ID NO: 1665952 - protein, 17 aa, Staphylococcus aureus
DLKELTHNLSWINKFGN

SEQ ID NO: 1665953 - protein, 19 aa, Staphylococcus aureus
DLKGRSLLKESDFTKAEFE

SEQ ID NO: 1665954 - protein, 19 aa, Staphylococcus aureus
DLKGRSLLKESDFTKVEFE

SEQ ID NO: 1665955 - protein, 18 aa, Staphylococcus aureus
DLKKIHSFIEDKKALFIV

SEQ ID NO: 1665956 - protein, 20 aa, Staphylococcus aureus
DLKLLKDRFEDLKDNHGWHF

SEQ ID NO: 1665957 - protein, 23 aa, Staphylococcus aureus
DLKLPEHHSYIISYNGSKTINMT

SEQ ID NO: 1665958 - protein, 18 aa, Staphylococcus aureus
DLLAISIARLEASGFKIV

SEQ ID NO: 1665959 - protein, 30 aa, Staphylococcus aureus
DLLFRSGLDLTVDFIIRVGKPVISKKLNQW

SEQ ID NO: 1665960 - protein, 17 aa, Staphylococcus aureus
DLLMHLIQKFEIDIYDI

SEQ ID NO: 1665961 - protein, 19 aa, Staphylococcus aureus
DLLTFPLIALIVSGGHTEL

SEQ ID NO: 1665962 - protein, 20 aa, Staphylococcus aureus
DLLTMMSFDGKLFSAKFAEL

SEQ ID NO: 1665963 - protein, 25 aa, Staphylococcus aureus
DLNEPEILFSYQLYLTDHYNKIVEH

SEQ ID NO: 1665964 - protein, 19 aa, Staphylococcus aureus
DLNKANGIAHLPGTKTKNS

SEQ ID NO: 1665965 - protein, 21 aa, Staphylococcus aureus
DLNQPQRDALRNQINQAQALA

SEQ ID NO: 1665966 - protein, 20 aa, Staphylococcus aureus
DLQGAVFLSQLTFWADKGKN

SEQ ID NO: 1665967 - protein, 17 aa, Staphylococcus aureus
DLRCTYDSYQFDGENVS

SEQ ID NO: 1665968 - protein, 22 aa, Staphylococcus aureus
DLRGKELFNSLVAVVDKVKSES

SEQ ID NO: 1665969 - protein, 24 aa, Staphylococcus aureus
DLRLCNWPKFINRLNSVSKKSVSK

SEQ ID NO: 1665970 - protein, 21 aa, Staphylococcus aureus
DLRLMLESFAFSRVKNQERLP

SEQ ID NO: 1665971 - protein, 19 aa, Staphylococcus aureus
DLRLMLESFAFSRVKNRER

SEQ ID NO: 1665972 - protein, 18 aa, Staphylococcus aureus
DLSELYIAMDAMHDVINE

SEQ ID NO: 1665973 - protein, 18 aa, Staphylococcus aureus
DLSKRLKSTDANRYVKNP

SEQ ID NO: 1665974 - protein, 33 aa, Staphylococcus aureus
DLSLPIRAGYSLEIKVPLNAIKIPKSVLTKGNN

SEQ ID NO: 1665975 - protein, 19 aa, Staphylococcus aureus
DLSPKFVVGYVETKDKHPD

SEQ ID NO: 1665976 - protein, 24 aa, Staphylococcus aureus
DLTGRENLTFFARIYMRDKEDIKK

SEQ ID NO: 1665977 - protein, 22 aa, Staphylococcus aureus
DLTKDYVLSVGKEFLKKADTSD

SEQ ID NO: 1665978 - protein, 18 aa, Staphylococcus aureus
DLTKQACDNFVSRYTSEV

SEQ ID NO: 1665979 - protein, 24 aa, Staphylococcus aureus
DLVARLKTMQGFYVERKAGWDTHG

SEQ ID NO: 1665980 - protein, 17 aa, Staphylococcus aureus
DLVDALLFEDIAGIVSN

SEQ ID NO: 1665981 - protein, 17 aa, Staphylococcus aureus
DLVKAKEDAKNAIKALA

SEQ ID NO: 1665982 - protein, 17 aa, Staphylococcus aureus
DLVKAKEDAKQDVDKQV

SEQ ID NO: 1665983 - protein, 18 aa, Staphylococcus aureus
DLVKAKESAKQDIDKQVQ

SEQ ID NO: 1665984 - protein, 21 aa, Staphylococcus aureus
DLVRHEFPKLQSIQLEDHKQH

SEQ ID NO: 1665985 - protein, 21 aa, Staphylococcus aureus
DLVSKAKEKAYQDILNAQTTN

SEQ ID NO: 1665986 - protein, 24 aa, Staphylococcus aureus
DLYLNPRASKFLDDYGTFDHTALV

SEQ ID NO: 1665987 - protein, 17 aa, Staphylococcus aureus
DMFKALLHETFKANGVL

SEQ ID NO: 1665988 - protein, 18 aa, Staphylococcus aureus
DMGRLRGKIFYQSGERPR

SEQ ID NO: 1665989 - protein, 22 aa, Staphylococcus aureus
DMKDKGWVIDSFYFRYKQQNYI

SEQ ID NO: 1665990 - protein, 24 aa, Staphylococcus aureus
DMKSHKLNAFSYMDKSDSTTLKDM

SEQ ID NO: 1665991 - protein, 31 aa, Staphylococcus aureus
DMLIPWEMIPRCPKCDAPMEVNKRKAEVGMV

SEQ ID NO: 1665992 - protein, 24 aa, Staphylococcus aureus
DMPNSRINKVWVEKAASYSNEITI

SEQ ID NO: 1665993 - protein, 20 aa, Staphylococcus aureus
DMRIGELLAIKRENINYEDK

SEQ ID NO: 1665994 - protein, 19 aa, Staphylococcus aureus
DMSEIKTALIAVGPENDKG

SEQ ID NO: 1665995 - protein, 24 aa, Staphylococcus aureus
DMSGWTKEDVIAFENLTNIKINLK

SEQ ID NO: 1665996 - protein, 18 aa, Staphylococcus aureus
DMTPKYEDLRAYYTKPSF

SEQ ID NO: 1665997 - protein, 19 aa, Staphylococcus aureus
DMYREVAFHVGIPDTGFYR

SEQ ID NO: 1665998 - protein, 17 aa, Staphylococcus aureus
DNAWNLYERAGFMHTAT

SEQ ID NO: 1665999 - protein, 25 aa, Staphylococcus aureus
DNDKNIPCNLWIDGHQTEIELTAVK

SEQ ID NO: 1666000 - protein, 20 aa, Staphylococcus aureus
DNDLAWLVDIMLPRMKAHGV

SEQ ID NO: 1666001 - protein, 24 aa, Staphylococcus aureus
DNDRAMFEFGHYTVAMKNARPEIQ

SEQ ID NO: 1666002 - protein, 23 aa, Staphylococcus aureus
DNEIKRLLVKEGTIKDHGDQLMQ

SEQ ID NO: 1666003 - protein, 24 aa, Staphylococcus aureus
DNERLKAALLYTLEECIKQGHTYL

SEQ ID NO: 1666004 - protein, 22 aa, Staphylococcus aureus
DNFPEALKITGRTDDCIQSFEH

SEQ ID NO: 1666005 - protein, 17 aa, Staphylococcus aureus
DNHGWHFDELYPYEPNH

SEQ ID NO: 1666006 - protein, 20 aa, Staphylococcus aureus
DNHQIIWVILNYEFNEARPT

SEQ ID NO: 1666007 - protein, 23 aa, Staphylococcus aureus
DNHSAYAFIKRLIKQFGKPQKVI

SEQ ID NO: 1666008 - protein, 17 aa, Staphylococcus aureus
DNIKGLLEVATQQIDKL

SEQ ID NO: 1666009 - protein, 17 aa, Staphylococcus aureus
DNIKGLLGVATQQIDKL

SEQ ID NO: 1666010 - protein, 17 aa, Staphylococcus aureus
DNIKKEKLLEAKEENQI

SEQ ID NO: 1666011 - protein, 23 aa, Staphylococcus aureus
DNIKKKVDHFYGLSSKNDKYVSY

SEQ ID NO: 1666012 - protein, 23 aa, Staphylococcus aureus
DNILRHPANDFVRDFIGQNRPIQ

SEQ ID NO: 1666013 - protein, 23 aa, Staphylococcus aureus
DNINYKFSYNDFKTLEDDSYIYI

SEQ ID NO: 1666014 - protein, 21 aa, Staphylococcus aureus
DNKDGKRVFVTEVVADNVQFL

SEQ ID NO: 1666015 - protein, 22 aa, Staphylococcus aureus
DNKFKIQCVTLICYYNDNLQNY

SEQ ID NO: 1666016 - protein, 20 aa, Staphylococcus aureus
DNKPLYPEHCNKALDLICEK

SEQ ID NO: 1666017 - protein, 21 aa, Staphylococcus aureus
DNLILLGIKTRGEYLANRIQD

SEQ ID NO: 1666018 - protein, 18 aa, Staphylococcus aureus
DNLKNVTGYIRGGCSPVG

SEQ ID NO: 1666019 - protein, 18 aa, Staphylococcus aureus
DNLKTFGVEKIFTEKQSG

SEQ ID NO: 1666020 - protein, 17 aa, Staphylococcus aureus
DNLKVVLEEAGSDLNSV

SEQ ID NO: 1666021 - protein, 19 aa, Staphylococcus aureus
DNMSRPIVTNALTYGLSLV

SEQ ID NO: 1666022 - protein, 24 aa, Staphylococcus aureus
DNNCIKRYIAKYTINPAITHGISE

SEQ ID NO: 1666023 - protein, 24 aa, Staphylococcus aureus
DNNDINEIIAWGGEQEELEQKRDT

SEQ ID NO: 1666024 - protein, 28 aa, Staphylococcus aureus
DNNFSYRLCYQMRNFTQHHGLAITNIKE

SEQ ID NO: 1666025 - protein, 27 aa, Staphylococcus aureus
DNNFSYRLCYQMRSFTQHHGLAITNIK

SEQ ID NO: 1666026 - protein, 32 aa, Staphylococcus aureus
DNNPSCLGLCIYKDSLIQLKRGLSFERKKQIL

SEQ ID NO: 1666027 - protein, 31 aa, Staphylococcus aureus
DNNVPIKFKEEFEPRKFVFTNGEIKYNNNFE

SEQ ID NO: 1666028 - protein, 17 aa, Staphylococcus aureus
DNSRTPMQWSDDVNAGF

SEQ ID NO: 1666029 - protein, 20 aa, Staphylococcus aureus
DNVNEVYSLTGAHFSDEKKI

SEQ ID NO: 1666030 - protein, 30 aa, Staphylococcus aureus
DNWLHSTKFMLPKWLYKIAKQRADNKQLQN

SEQ ID NO: 1666031 - protein, 17 aa, Staphylococcus aureus
DPEKVLQSHVLIFRTKD

SEQ ID NO: 1666032 - protein, 18 aa, Staphylococcus aureus
DPKFKRADAIKVNGDIRK

SEQ ID NO: 1666033 - protein, 19 aa, Staphylococcus aureus
DPKRRIPYMEIVGQVHGTY

SEQ ID NO: 1666034 - protein, 23 aa, Staphylococcus aureus
DPKTLMFAHAIGFGLLERPVVRW

SEQ ID NO: 1666035 - protein, 19 aa, Staphylococcus aureus
DPMYFIRLNFPDKVSVGDK

SEQ ID NO: 1666036 - protein, 24 aa, Staphylococcus aureus
DPQKRLVYYRVVELLEQGKSISTI

SEQ ID NO: 1666037 - protein, 22 aa, Staphylococcus aureus
DPSYKQLISYCILENEHGEILV

SEQ ID NO: 1666038 - protein, 20 aa, Staphylococcus aureus
DPTKPRAIEIVSDQTNDNIN

SEQ ID NO: 1666039 - protein, 19 aa, Staphylococcus aureus
DPVCAFYVLHTRVMCLLTC

SEQ ID NO: 1666040 - protein, 19 aa, Staphylococcus aureus
DPYELIEWFVFQSYDRDIT

SEQ ID NO: 1666041 - protein, 17 aa, Staphylococcus aureus
DPYWFDITYNQMFKKWQ

SEQ ID NO: 1666042 - protein, 17 aa, Staphylococcus aureus
DQAFFKGTVRTFDSKIQ

SEQ ID NO: 1666043 - protein, 19 aa, Staphylococcus aureus
DQAKHVFDSTGLLNINYQP

SEQ ID NO: 1666044 - protein, 31 aa, Staphylococcus aureus
DQAKLNMGYRFPTQYGQSGYAAFVVFNMMFG

SEQ ID NO: 1666045 - protein, 22 aa, Staphylococcus aureus
DQFKLMFKDGEIIDFSAEKGEA

SEQ ID NO: 1666046 - protein, 19 aa, Staphylococcus aureus
DQGVYRPKRYPSIDKDLKI

SEQ ID NO: 1666047 - protein, 17 aa, Staphylococcus aureus
DQHLITFSLEIVNERYL

SEQ ID NO: 1666048 - protein, 26 aa, Staphylococcus aureus
DQIWSNSKFKLALKVQDRQDSNEILK

SEQ ID NO: 1666049 - protein, 23 aa, Staphylococcus aureus
DQLLPRLQEAFSNIKVGDPQDEA

SEQ ID NO: 1666050 - protein, 18 aa, Staphylococcus aureus
DQMRRLNQEIIDYIDTLK

SEQ ID NO: 1666051 - protein, 18 aa, Staphylococcus aureus
DQMRRLNQEIIDYIDTLN

SEQ ID NO: 1666052 - protein, 23 aa, Staphylococcus aureus
DQNTIKQGVNFTDADEAKRNVYT

SEQ ID NO: 1666053 - protein, 22 aa, Staphylococcus aureus
DQNTVKQSVKFTDADKAKRDAY

SEQ ID NO: 1666054 - protein, 20 aa, Staphylococcus aureus
DQPIEGFFSIAGFKEDAEKI

SEQ ID NO: 1666055 - protein, 22 aa, Staphylococcus aureus
DQQEIFQLAEIVGGKNNKNLTL

SEQ ID NO: 1666056 - protein, 17 aa, Staphylococcus aureus
DQQRIFERFYRVDKARS

SEQ ID NO: 1666057 - protein, 24 aa, Staphylococcus aureus
DQRREMIRQAAFKLVENIKNGLKP

SEQ ID NO: 1666058 - protein, 19 aa, Staphylococcus aureus
DQRRIEWKRVLDMNDRALR

SEQ ID NO: 1666059 - protein, 24 aa, Staphylococcus aureus
DQSSEVYSPISPIKIATQDNSGNA

SEQ ID NO: 1666060 - protein, 18 aa, Staphylococcus aureus
DQYIRLGPLTNKILHTYT

SEQ ID NO: 1666061 - protein, 23 aa, Staphylococcus aureus
DQYMSIDALRAFLEDLNQPFIYI

SEQ ID NO: 1666062 - protein, 25 aa, Staphylococcus aureus
DQYRLYKLIWERFVASQMAPAILDT

SEQ ID NO: 1666063 - protein, 17 aa, Staphylococcus aureus
DRDDFNFVKYNLYETEI

SEQ ID NO: 1666064 - protein, 24 aa, Staphylococcus aureus
DRDYEFAKKFDLLIIEVIEGGNVE

SEQ ID NO: 1666065 - protein, 18 aa, Staphylococcus aureus
DRFEDLKDNHGWHFEELY

SEQ ID NO: 1666066 - protein, 22 aa, Staphylococcus aureus
DRFESAVGFVHLGLGYAIIPRF

SEQ ID NO: 1666067 - protein, 32 aa, Staphylococcus aureus
DRFKVTDLDSANWVFKKLDAITTKENEINDLA

SEQ ID NO: 1666068 - protein, 25 aa, Staphylococcus aureus
DRKARSRKPITAKLVANLIETAGAT

SEQ ID NO: 1666069 - protein, 21 aa, Staphylococcus aureus
DRLLKHDLLFHDMFVNVASKK

SEQ ID NO: 1666070 - protein, 17 aa, Staphylococcus aureus
DRLMTFPNIVHHRKKLE

SEQ ID NO: 1666071 - protein, 20 aa, Staphylococcus aureus
DRNDLKDGLFFEPTVITNCD

SEQ ID NO: 1666072 - protein, 18 aa, Staphylococcus aureus
DRPFHPLAKEKRGLREVD

SEQ ID NO: 1666073 - protein, 21 aa, Staphylococcus aureus
DRSAAYAARYVAKNIVAAGLA

SEQ ID NO: 1666074 - protein, 18 aa, Staphylococcus aureus
DRSAWDATMYSFGTIPRG

SEQ ID NO: 1666075 - protein, 17 aa, Staphylococcus aureus
DRVFLCEIFGSIRENTG

SEQ ID NO: 1666076 - protein, 25 aa, Staphylococcus aureus
DRVNELYQLCDIYLDINEGNEILNA

SEQ ID NO: 1666077 - protein, 17 aa, Staphylococcus aureus
DRYGFKRDFKLYECDDC

SEQ ID NO: 1666078 - protein, 22 aa, Staphylococcus aureus
DRYTNQWNRLHWIGNNYKNQNT

SEQ ID NO: 1666079 - protein, 25 aa, Staphylococcus aureus
DSCGDCTICVDRCPTNALVGNGQLN

SEQ ID NO: 1666080 - protein, 23 aa, Staphylococcus aureus
DSDFDKMRFVHHSIPSINVNDID

SEQ ID NO: 1666081 - protein, 22 aa, Staphylococcus aureus
DSDLTINEAISFIKDGNPDLDF

SEQ ID NO: 1666082 - protein, 25 aa, Staphylococcus aureus
DSDVLVCTVIGFPLGASTTATKAFE

SEQ ID NO: 1666083 - protein, 17 aa, Staphylococcus aureus
DSFCAAVVYSWLNGMST

SEQ ID NO: 1666084 - protein, 17 aa, Staphylococcus aureus
DSGDFDGPVGIGHTRWA

SEQ ID NO: 1666085 - protein, 25 aa, Staphylococcus aureus
DSGVLVCTVIGFPLGASTTATKAFE

SEQ ID NO: 1666086 - protein, 17 aa, Staphylococcus aureus
DSIDYVNRMSFPKLEVY

SEQ ID NO: 1666087 - protein, 23 aa, Staphylococcus aureus
DSIELGGIVQRTWKGKRSTDDIF

SEQ ID NO: 1666088 - protein, 19 aa, Staphylococcus aureus
DSINLVHIVYVYNEPYKKT

SEQ ID NO: 1666089 - protein, 25 aa, Staphylococcus aureus
DSIWRSMLEHVNWNMIDNGVAPKDK

SEQ ID NO: 1666090 - protein, 21 aa, Staphylococcus aureus
DSKHLPVIKIAKEVLSNGGYV

SEQ ID NO: 1666091 - protein, 28 aa, Staphylococcus aureus
DSKLTAKRKLSVFIYSVNDFTDFNARSQ

SEQ ID NO: 1666092 - protein, 24 aa, Staphylococcus aureus
DSKRLKWWMDLLLLTNHSDKKVML

SEQ ID NO: 1666093 - protein, 25 aa, Staphylococcus aureus
DSKSISFGLGYQIKQIVELVLLQSK

SEQ ID NO: 1666094 - protein, 19 aa, Staphylococcus aureus
DSLGVCIHTSYGAIVYTGG

SEQ ID NO: 1666095 - protein, 22 aa, Staphylococcus aureus
DSLIEGFIHWIKDEKIDWLGED

SEQ ID NO: 1666096 - protein, 26 aa, Staphylococcus aureus
DSLPMNRLRFTLAHEYGHFVMGHTGV

SEQ ID NO: 1666097 - protein, 20 aa, Staphylococcus aureus
DSLSESYPTLAMIYVTHFIE

SEQ ID NO: 1666098 - protein, 24 aa, Staphylococcus aureus
DSNAKLWLAEFAWHDTSSAHYRSA

SEQ ID NO: 1666099 - protein, 24 aa, Staphylococcus aureus
DSNAQLWLAEFAWHDTSSTHYRSA

SEQ ID NO: 1666100 - protein, 25 aa, Staphylococcus aureus
DSNRGGCCQSCRWDYELLEVDDNGE

SEQ ID NO: 1666101 - protein, 25 aa, Staphylococcus aureus
DSQYFLRRFLKYTGQNEITKINLNF

SEQ ID NO: 1666102 - protein, 17 aa, Staphylococcus aureus
DSRTAREGSIFVASVGY

SEQ ID NO: 1666103 - protein, 17 aa, Staphylococcus aureus
DSSDFDGPVGIGHTRWA

SEQ ID NO: 1666104 - protein, 22 aa, Staphylococcus aureus
DSSIEAGLRRVLAETSQYITIE

SEQ ID NO: 1666105 - protein, 23 aa, Staphylococcus aureus
DSSIEAGLRRVLAETSQYITNEF

SEQ ID NO: 1666106 - protein, 24 aa, Staphylococcus aureus
DSVGMASDASRVFKGQKMPGRMGG

SEQ ID NO: 1666107 - protein, 21 aa, Staphylococcus aureus
DSYIKAIRWSSDRLNNKGIIG

SEQ ID NO: 1666108 - protein, 26 aa, Staphylococcus aureus
DTCIANNIKPIFGMTIYVTNGLNTVE

SEQ ID NO: 1666109 - protein, 21 aa, Staphylococcus aureus
DTCTKHIAVSLKIDGKTVTIG

SEQ ID NO: 1666110 - protein, 26 aa, Staphylococcus aureus
DTDSLVIVDIRFDVDVLCELLNDADV

SEQ ID NO: 1666111 - protein, 21 aa, Staphylococcus aureus
DTESLLGFKTIKTNAERQQEI

SEQ ID NO: 1666112 - protein, 18 aa, Staphylococcus aureus
DTIITIWVKLLILSGKYN

SEQ ID NO: 1666113 - protein, 31 aa, Staphylococcus aureus
DTIMYKVHLMKECLDREIKVISSMGAANKTD

SEQ ID NO: 1666114 - protein, 32 aa, Staphylococcus aureus
DTIMYKVHLMKECLDRGIKVISSMGAANKTDP

SEQ ID NO: 1666115 - protein, 21 aa, Staphylococcus aureus
DTIRTALVLRQAIWKKSDSNW

SEQ ID NO: 1666116 - protein, 23 aa, Staphylococcus aureus
DTKELLIADSFYREEYALYDDIF

SEQ ID NO: 1666117 - protein, 22 aa, Staphylococcus aureus
DTKTVMKLCEYFGVTPNEFFGI

SEQ ID NO: 1666118 - protein, 18 aa, Staphylococcus aureus
DTKWRFENHFKTDDMKEQ

SEQ ID NO: 1666119 - protein, 17 aa, Staphylococcus aureus
DTLQPYTEFLIKYRTQL

SEQ ID NO: 1666120 - protein, 23 aa, Staphylococcus aureus
DTLTRINIGGLMYHSMVGKHIFL

SEQ ID NO: 1666121 - protein, 25 aa, Staphylococcus aureus
DTNDFPITWFYPLGEKKVERKAPKL

SEQ ID NO: 1666122 - protein, 25 aa, Staphylococcus aureus
DTNDFPITWFYPLGEKKVERTTPKL

SEQ ID NO: 1666123 - protein, 23 aa, Staphylococcus aureus
DTNDVITAFEFENIIKTNRINDN

SEQ ID NO: 1666124 - protein, 24 aa, Staphylococcus aureus
DTQVKRVYDEAVDKAKEALNKATG

SEQ ID NO: 1666125 - protein, 26 aa, Staphylococcus aureus
DTRFVDGKRSLLFGPFAGFSPKFLKT

SEQ ID NO: 1666126 - protein, 25 aa, Staphylococcus aureus
DTSDYSLGYLSGWGQNISDDELKDH

SEQ ID NO: 1666127 - protein, 26 aa, Staphylococcus aureus
DTTASERWMRMGILGVEMESAALYMN

SEQ ID NO: 1666128 - protein, 29 aa, Staphylococcus aureus
DTTYGKLGVKVWIYRGEVLPTKNTNTSGG

SEQ ID NO: 1666129 - protein, 19 aa, Staphylococcus aureus
DTTYPKGTYQVAWEENGKE

SEQ ID NO: 1666130 - protein, 17 aa, Staphylococcus aureus
DVAEGIAQIQVMYDPGL

SEQ ID NO: 1666131 - protein, 17 aa, Staphylococcus aureus
DVAYLLHDGKNEIREIE

SEQ ID NO: 1666132 - protein, 26 aa, Staphylococcus aureus
DVDAVLKRFNVALGDIEAVITEKENS

SEQ ID NO: 1666133 - protein, 22 aa, Staphylococcus aureus
DVEFVHTPYLLKCVTSEQTYTN

SEQ ID NO: 1666134 - protein, 17 aa, Staphylococcus aureus
DVEGVKLADGREIPADL

SEQ ID NO: 1666135 - protein, 18 aa, Staphylococcus aureus
DVEKELFENYILDNWDKV

SEQ ID NO: 1666136 - protein, 18 aa, Staphylococcus aureus
DVESYVFFLGRELKQNFE

SEQ ID NO: 1666137 - protein, 28 aa, Staphylococcus aureus
DVFAHGEIRLDINFALYGNGTDSISDIK

SEQ ID NO: 1666138 - protein, 21 aa, Staphylococcus aureus
DVFVVKELIDPNGRLSTVGGV

SEQ ID NO: 1666139 - protein, 22 aa, Staphylococcus aureus
DVIEMSRPVKMNSLLKLYFDRN

SEQ ID NO: 1666140 - protein, 17 aa, Staphylococcus aureus
DVIKALIQFFDIETQTV

SEQ ID NO: 1666141 - protein, 19 aa, Staphylococcus aureus
DVIRLARQHHARLIYVSTI

SEQ ID NO: 1666142 - protein, 24 aa, Staphylococcus aureus
DVIVSGVSIDHLWLYETNKCYALA

SEQ ID NO: 1666143 - protein, 18 aa, Staphylococcus aureus
DVIYRKLATIEVFEDIKS

SEQ ID NO: 1666144 - protein, 23 aa, Staphylococcus aureus
DVKGTINVFKLVPVVTNVTQSLY

SEQ ID NO: 1666145 - protein, 24 aa, Staphylococcus aureus
DVKKGEYLFVLTAWYDQQRTLDSA

SEQ ID NO: 1666146 - protein, 27 aa, Staphylococcus aureus
DVKLEPPIKEWEKMGLLTIVDNDVIEI

SEQ ID NO: 1666147 - protein, 25 aa, Staphylococcus aureus
DVKRTLTRLRLKTHTPTNAMRESFH

SEQ ID NO: 1666148 - protein, 21 aa, Staphylococcus aureus
DVKTNARAELLNEMQNKITEI

SEQ ID NO: 1666149 - protein, 21 aa, Staphylococcus aureus
DVLCCYRLNRLHRNLKNALKL

SEQ ID NO: 1666150 - protein, 22 aa, Staphylococcus aureus
DVLCCYRLNRLHRNLKNALKLM

SEQ ID NO: 1666151 - protein, 27 aa, Staphylococcus aureus
DVLCCYRLNRLHRNLKNALKLMKLCQK

SEQ ID NO: 1666152 - protein, 27 aa, Staphylococcus aureus
DVLCCYRLNRLHRNLKNALKLMKLCQT

SEQ ID NO: 1666153 - protein, 21 aa, Staphylococcus aureus
DVLHFKHIVASNMVQGISPID

SEQ ID NO: 1666154 - protein, 22 aa, Staphylococcus aureus
DVLKKSMELVIKKSVTASISLD

SEQ ID NO: 1666155 - protein, 24 aa, Staphylococcus aureus
DVNFKVVKEFIKTVSERALGSDVM

SEQ ID NO: 1666156 - protein, 18 aa, Staphylococcus aureus
DVPAGIMTKCPKCKKIMY

SEQ ID NO: 1666157 - protein, 18 aa, Staphylococcus aureus
DVPQAGDRFVVFSDEKQA

SEQ ID NO: 1666158 - protein, 17 aa, Staphylococcus aureus
DVPQIIWHGLPLTEAFL

SEQ ID NO: 1666159 - protein, 19 aa, Staphylococcus aureus
DVTDIIAAQLLYTIKKYGP

SEQ ID NO: 1666160 - protein, 19 aa, Staphylococcus aureus
DVTEIIAAQLLYTIKKIWS

SEQ ID NO: 1666161 - protein, 23 aa, Staphylococcus aureus
DVTPLSLGIEILGGRMNTLIERN

SEQ ID NO: 1666162 - protein, 17 aa, Staphylococcus aureus
DVVKARGAEVILTDTFA

SEQ ID NO: 1666163 - protein, 19 aa, Staphylococcus aureus
DVYAEIYLGRFYNQHNELI

SEQ ID NO: 1666164 - protein, 21 aa, Staphylococcus aureus
DVYECRFLTIATGYYGQHNTL

SEQ ID NO: 1666165 - protein, 19 aa, Staphylococcus aureus
DVYGSWRALEELKETGKIK

SEQ ID NO: 1666166 - protein, 17 aa, Staphylococcus aureus
DVYKTSINISKILDFQI

SEQ ID NO: 1666167 - protein, 19 aa, Staphylococcus aureus
DWASLRLAPKDERDALVTE

SEQ ID NO: 1666168 - protein, 25 aa, Staphylococcus aureus
DWGECATRIVSIYRYISKLQEHYQF

SEQ ID NO: 1666169 - protein, 23 aa, Staphylococcus aureus
DWLEVYNRNGVVTARAVISHRMP

SEQ ID NO: 1666170 - protein, 24 aa, Staphylococcus aureus
DWLEVYNRNGVVTARAVISHRMPK

SEQ ID NO: 1666171 - protein, 24 aa, Staphylococcus aureus
DWTFIKKAIAYYRFRPYAMKILKE

SEQ ID NO: 1666172 - protein, 24 aa, Staphylococcus aureus
DWYADLPLASPQIWGEQTDVPESS

SEQ ID NO: 1666173 - protein, 18 aa, Staphylococcus aureus
DYCGYSFAFEVTKNNTKL

SEQ ID NO: 1666174 - protein, 18 aa, Staphylococcus aureus
DYCIPRPFDKRVAPSVAR

SEQ ID NO: 1666175 - protein, 28 aa, Staphylococcus aureus
DYDAIILAAAGLRRMGWSDDIVTSYLDI

SEQ ID NO: 1666176 - protein, 19 aa, Staphylococcus aureus
DYEVIPGVFLQKEPDNPYD

SEQ ID NO: 1666177 - protein, 17 aa, Staphylococcus aureus
DYFVDYAEFCFKEFPEV

SEQ ID NO: 1666178 - protein, 17 aa, Staphylococcus aureus
DYGMYWIKSEVKPDAII

SEQ ID NO: 1666179 - protein, 26 aa, Staphylococcus aureus
DYIDAFKIFIHHVALHVSHRKDLKFN

SEQ ID NO: 1666180 - protein, 32 aa, Staphylococcus aureus
DYIVSSYPVWFPKDEIEEIIKDMIELILEEKK

SEQ ID NO: 1666181 - protein, 33 aa, Staphylococcus aureus
DYIVSSYPVWFPKDEVEEIIKDMIELILEEKKV

SEQ ID NO: 1666182 - protein, 27 aa, Staphylococcus aureus
DYLPEIYKSVKAEVLFNKVAMRPGSVT

SEQ ID NO: 1666183 - protein, 19 aa, Staphylococcus aureus
DYNLNIPRYVDTFEEEAPI

SEQ ID NO: 1666184 - protein, 20 aa, Staphylococcus aureus
DYPMIPGIDFAGIVESSSND

SEQ ID NO: 1666185 - protein, 24 aa, Staphylococcus aureus
DYQRPRLKVLSDYYEGKTKNLVEL

SEQ ID NO: 1666186 - protein, 24 aa, Staphylococcus aureus
DYQWSEKLIPYWQDLAEFAKEQDV

SEQ ID NO: 1666187 - protein, 19 aa, Staphylococcus aureus
DYRSNRKSLPFTENDENIV

SEQ ID NO: 1666188 - protein, 20 aa, Staphylococcus aureus
DYSCSAFLMYIGIDIDVTDQ

SEQ ID NO: 1666189 - protein, 18 aa, Staphylococcus aureus
DYTLGVQTGRDWWTTGFS

SEQ ID NO: 1666190 - protein, 17 aa, Staphylococcus aureus
DYYTSKLEVLRNAENTL

SEQ ID NO: 1666191 - protein, 17 aa, Staphylococcus aureus
EAAEILGLTEYLGRKPK

SEQ ID NO: 1666192 - protein, 20 aa, Staphylococcus aureus
EACDILKTRVVSGNVSLYNE

SEQ ID NO: 1666193 - protein, 18 aa, Staphylococcus aureus
EACSTLLTTFFKNLRANK

SEQ ID NO: 1666194 - protein, 26 aa, Staphylococcus aureus
EADVLPDNLDGVWLGDLILIKRGLSD

SEQ ID NO: 1666195 - protein, 30 aa, Staphylococcus aureus
EAEDPFTCPHGRPIIINFSKYELEKLFKRV

SEQ ID NO: 1666196 - protein, 19 aa, Staphylococcus aureus
EAELRKKKPHLFNVPQKHS

SEQ ID NO: 1666197 - protein, 19 aa, Staphylococcus aureus
EAEMGSPIRGGRPSTHAVK

SEQ ID NO: 1666198 - protein, 18 aa, Staphylococcus aureus
EAFAVALETAFLKSTGKD

SEQ ID NO: 1666199 - protein, 19 aa, Staphylococcus aureus
EAFFELCKKVTIKQVYIAG

SEQ ID NO: 1666200 - protein, 17 aa, Staphylococcus aureus
EAIKTKAINDINQTAPA

SEQ ID NO: 1666201 - protein, 34 aa, Staphylococcus aureus
EAILKGYDFISVLGWPTYYANLGYQRASMYDIYP

SEQ ID NO: 1666202 - protein, 26 aa, Staphylococcus aureus
EAIRPKILLHSCCAPCSTYTLEFLTK

SEQ ID NO: 1666203 - protein, 23 aa, Staphylococcus aureus
EAIRYLERIGFDAIHNYEQELTI

SEQ ID NO: 1666204 - protein, 23 aa, Staphylococcus aureus
EAIRYLERIGFEAIHKYEQELTI

SEQ ID NO: 1666205 - protein, 19 aa, Staphylococcus aureus
EAISNKYYDGFVITHGTDT

SEQ ID NO: 1666206 - protein, 19 aa, Staphylococcus aureus
EAKAAEHTNGELNQSKNET

SEQ ID NO: 1666207 - protein, 20 aa, Staphylococcus aureus
EAKALNRVMDQLSQGITGNE

SEQ ID NO: 1666208 - protein, 22 aa, Staphylococcus aureus
EAKEFADLIGYPLVLKPTNTAS

SEQ ID NO: 1666209 - protein, 25 aa, Staphylococcus aureus
EAKELKGAHIFLDMVSVGATINIML

SEQ ID NO: 1666210 - protein, 25 aa, Staphylococcus aureus
EAKGSQLPKMFGFQAEGASPIVQNK

SEQ ID NO: 1666211 - protein, 27 aa, Staphylococcus aureus
EAKHTFDYYAGLSFRTLVPKYPAMSPH

SEQ ID NO: 1666212 - protein, 19 aa, Staphylococcus aureus
EAKPRIGDVVRVAEPTIGY

SEQ ID NO: 1666213 - protein, 22 aa, Staphylococcus aureus
EALAHAMVRIGNNVGRNTMAII

SEQ ID NO: 1666214 - protein, 22 aa, Staphylococcus aureus
EALDFQDWICDVLVELRTSTKL

SEQ ID NO: 1666215 - protein, 17 aa, Staphylococcus aureus
EALFRAGVLPDKKVKDL

SEQ ID NO: 1666216 - protein, 18 aa, Staphylococcus aureus
EALIDFIPNITNANLKDV

SEQ ID NO: 1666217 - protein, 17 aa, Staphylococcus aureus
EALIDFIPNITNVNLKD

SEQ ID NO: 1666218 - protein, 17 aa, Staphylococcus aureus
EALIDFIPNVTNANLKD

SEQ ID NO: 1666219 - protein, 25 aa, Staphylococcus aureus
EALIKIIPSYHALIARSQTTVTENI

SEQ ID NO: 1666220 - protein, 22 aa, Staphylococcus aureus
EALKDVLSDTGWEVSEQTEYDG

SEQ ID NO: 1666221 - protein, 20 aa, Staphylococcus aureus
EALKIKGMVLYMNRNTKTTK

SEQ ID NO: 1666222 - protein, 23 aa, Staphylococcus aureus
EALKKKLTEEGCFDNANKKSIPK

SEQ ID NO: 1666223 - protein, 17 aa, Staphylococcus aureus
EALLCLDATTGQNALSQ

SEQ ID NO: 1666224 - protein, 21 aa, Staphylococcus aureus
EALMGKYRISGVPIVDNKEDR

SEQ ID NO: 1666225 - protein, 18 aa, Staphylococcus aureus
EALNFLCAYITKHQIKLV

SEQ ID NO: 1666226 - protein, 30 aa, Staphylococcus aureus
EAMLVVSRLKRFGHHISMQTLYQYKTVRQI

SEQ ID NO: 1666227 - protein, 29 aa, Staphylococcus aureus
EAMVRMAQDFSYRYPLVDGQGNFGSMDGD

SEQ ID NO: 1666228 - protein, 20 aa, Staphylococcus aureus
EANAALDFERELAYGKHLDI

SEQ ID NO: 1666229 - protein, 20 aa, Staphylococcus aureus
EANLKIIYWLQGTGVVSINL

SEQ ID NO: 1666230 - protein, 17 aa, Staphylococcus aureus
EAQHFFELAYPTMKTNI

SEQ ID NO: 1666231 - protein, 18 aa, Staphylococcus aureus
EAQVKRDAIIKVGQLFEN

SEQ ID NO: 1666232 - protein, 21 aa, Staphylococcus aureus
EARIDDAIIVGFHFEDVDKRR

SEQ ID NO: 1666233 - protein, 20 aa, Staphylococcus aureus
EARIFKFYKYFYSHRGPLLD

SEQ ID NO: 1666234 - protein, 34 aa, Staphylococcus aureus
EASFAKKVYCSSELEFLIELFISHNNIHSFSDGN

SEQ ID NO: 1666235 - protein, 27 aa, Staphylococcus aureus
EASSLDYTVLRPAWLTNNDEIEYETTV

SEQ ID NO: 1666236 - protein, 25 aa, Staphylococcus aureus
EAVEAAIKIARKWGSEVKDITDGQV

SEQ ID NO: 1666237 - protein, 25 aa, Staphylococcus aureus
EAVEAAIKIARKWGSEVKGIADGQV

SEQ ID NO: 1666238 - protein, 25 aa, Staphylococcus aureus
EAVKRDLKILTEVELSYLISEAPII

SEQ ID NO: 1666239 - protein, 17 aa, Staphylococcus aureus
EAYERAVNYAKSRGSFL

SEQ ID NO: 1666240 - protein, 19 aa, Staphylococcus aureus
EAYRDAVRDLIHFYEVSGV

SEQ ID NO: 1666241 - protein, 28 aa, Staphylococcus aureus
ECEELFKAKLLLLVYLKIIPNINSFYQS

SEQ ID NO: 1666242 - protein, 20 aa, Staphylococcus aureus
ECGRFIVAHIGYYVTEVLDI

SEQ ID NO: 1666243 - protein, 26 aa, Staphylococcus aureus
ECINEFYWVSTYVMKGLWRNQLLYAF

SEQ ID NO: 1666244 - protein, 19 aa, Staphylococcus aureus
ECKKSVFNYEKEWRDFSKD

SEQ ID NO: 1666245 - protein, 19 aa, Staphylococcus aureus
EDAMIRMTRIIESFDRETN

SEQ ID NO: 1666246 - protein, 23 aa, Staphylococcus aureus
EDARFRTIIKLYSYYTSLKEQSS

SEQ ID NO: 1666247 - protein, 26 aa, Staphylococcus aureus
EDCPSGYKVAYSEFGPVVAAHLGSGG

SEQ ID NO: 1666248 - protein, 25 aa, Staphylococcus aureus
EDESVRYMPVWAYDASNWSNEETAY

SEQ ID NO: 1666249 - protein, 25 aa, Staphylococcus aureus
EDFFNEFLGLYSIKEKDEFLNILNE

SEQ ID NO: 1666250 - protein, 22 aa, Staphylococcus aureus
EDFLLVKREIFSSGKSLCKINN

SEQ ID NO: 1666251 - protein, 22 aa, Staphylococcus aureus
EDGGNFGCHFAFDEKDEREDIL

SEQ ID NO: 1666252 - protein, 17 aa, Staphylococcus aureus
EDGHTFLPIAQNFIEQY

SEQ ID NO: 1666253 - protein, 29 aa, Staphylococcus aureus
EDGMPGLTICGGYQFLGEKYITPDGTELE

SEQ ID NO: 1666254 - protein, 23 aa, Staphylococcus aureus
EDIELDEAVGIMTGQVVYKYEEA

SEQ ID NO: 1666255 - protein, 17 aa, Staphylococcus aureus
EDIRFLIYPQDFPKREK

SEQ ID NO: 1666256 - protein, 29 aa, Staphylococcus aureus
EDIWSKLANEWNIGNSLLYNEIGFEEFYK

SEQ ID NO: 1666257 - protein, 18 aa, Staphylococcus aureus
EDKGCPWDKVQTHETLKR

SEQ ID NO: 1666258 - protein, 23 aa, Staphylococcus aureus
EDKQKAYALMSIPRHNLPESEKA

SEQ ID NO: 1666259 - protein, 25 aa, Staphylococcus aureus
EDLDPTFMWHLAFAYGQEERDKEAQ

SEQ ID NO: 1666260 - protein, 26 aa, Staphylococcus aureus
EDLEPWTSCEFDFTRDGKLNVSFDYI

SEQ ID NO: 1666261 - protein, 24 aa, Staphylococcus aureus
EDLEPWTSCEFDFTREGELKVSFD

SEQ ID NO: 1666262 - protein, 26 aa, Staphylococcus aureus
EDLIKEVARIYGYDDIPSTLPVFDKV

SEQ ID NO: 1666263 - protein, 20 aa, Staphylococcus aureus
EDLILFRTIPSYYRSLPGKL

SEQ ID NO: 1666264 - protein, 19 aa, Staphylococcus aureus
EDLKVELIDQVGYFIEPQD

SEQ ID NO: 1666265 - protein, 17 aa, Staphylococcus aureus
EDLLFYDIEVFKHNAFV

SEQ ID NO: 1666266 - protein, 17 aa, Staphylococcus aureus
EDLPLLSCIEPNDTFDF

SEQ ID NO: 1666267 - protein, 18 aa, Staphylococcus aureus
EDLRLIVSREHRLAKYET

SEQ ID NO: 1666268 - protein, 20 aa, Staphylococcus aureus
EDQEHYKGGLVLNRKGKLEL

SEQ ID NO: 1666269 - protein, 18 aa, Staphylococcus aureus
EDRIKNFFQSGGKYTELE

SEQ ID NO: 1666270 - protein, 18 aa, Staphylococcus aureus
EDTCKFILKSVVQVEDNI

SEQ ID NO: 1666271 - protein, 22 aa, Staphylococcus aureus
EDVEIPKHLIIASRLSKGKYQI

SEQ ID NO: 1666272 - protein, 24 aa, Staphylococcus aureus
EDVLKKSMELVIKKSVTASISLDF

SEQ ID NO: 1666273 - protein, 22 aa, Staphylococcus aureus
EDVLKLPRAVFKHRNSGLYFYN

SEQ ID NO: 1666274 - protein, 22 aa, Staphylococcus aureus
EDVLKLPRAVFKHRNSGLYYYN

SEQ ID NO: 1666275 - protein, 22 aa, Staphylococcus aureus
EDVLYFKALDNHRLSNESNNET

SEQ ID NO: 1666276 - protein, 30 aa, Staphylococcus aureus
EDVRSCLIFFKIWDLCKWNKTDNKVVLPNG

SEQ ID NO: 1666277 - protein, 18 aa, Staphylococcus aureus
EDVYKKAQAFDEILEGMT

SEQ ID NO: 1666278 - protein, 23 aa, Staphylococcus aureus
EDVYKKAQAFDRLLEDINNFTQS

SEQ ID NO: 1666279 - protein, 23 aa, Staphylococcus aureus
EDVYKKARAFDEILEGMTNAIQH

SEQ ID NO: 1666280 - protein, 24 aa, Staphylococcus aureus
EDVYKKARAFDEILEGMTNAIQHS

SEQ ID NO: 1666281 - protein, 17 aa, Staphylococcus aureus
EDYEFDRLKSEIHSLCA

SEQ ID NO: 1666282 - protein, 17 aa, Staphylococcus aureus
EDYYEMIEWAAKQPWSN

SEQ ID NO: 1666283 - protein, 18 aa, Staphylococcus aureus
EEACPKCHGKGTENKTVK

SEQ ID NO: 1666284 - protein, 23 aa, Staphylococcus aureus
EEALGYGKWAFRSITEDKYLDLD

SEQ ID NO: 1666285 - protein, 24 aa, Staphylococcus aureus
EEALQKLKSLGLKDVTIEKVYNNQ

SEQ ID NO: 1666286 - protein, 35 aa, Staphylococcus aureus
EEAQRFASDWSEVRPEWGLAKNSSFIIGRRQLTKG

SEQ ID NO: 1666287 - protein, 24 aa, Staphylococcus aureus
EEDKILPIHVGVHFVKLFVNDAFK

SEQ ID NO: 1666288 - protein, 22 aa, Staphylococcus aureus
EEDTCKFILKSVVQVEDNIERE

SEQ ID NO: 1666289 - protein, 17 aa, Staphylococcus aureus
EEFEKVISLIYKEDYYQ

SEQ ID NO: 1666290 - protein, 24 aa, Staphylococcus aureus
EEFSYKCSIKDIKHKKLLKAISNQ

SEQ ID NO: 1666291 - protein, 17 aa, Staphylococcus aureus
EEGHSYSHYLLIEQAIN

SEQ ID NO: 1666292 - protein, 26 aa, Staphylococcus aureus
EEGLEPWTSCEFDFTKKSKLKVSFDY

SEQ ID NO: 1666293 - protein, 27 aa, Staphylococcus aureus
EEGLEPWTSCEFDFTREGKLKVSFDYI

SEQ ID NO: 1666294 - protein, 18 aa, Staphylococcus aureus
EEICRIVKQHEDARNKVN

SEQ ID NO: 1666295 - protein, 24 aa, Staphylococcus aureus
EEIEQAKAQLAQALQDIKDLVKAK

SEQ ID NO: 1666296 - protein, 23 aa, Staphylococcus aureus
EEIFPDYEVINGQQIIKEKKATD

SEQ ID NO: 1666297 - protein, 17 aa, Staphylococcus aureus
EEIGEDVPVIPVSTITR

SEQ ID NO: 1666298 - protein, 23 aa, Staphylococcus aureus
EEKAHSITAIWNFEKQNYYLKDL

SEQ ID NO: 1666299 - protein, 23 aa, Staphylococcus aureus
EEKAHSITAIWNFEKQNYYLKNL

SEQ ID NO: 1666300 - protein, 24 aa, Staphylococcus aureus
EEKAHSITAIWNFEKQNYYLKNLK

SEQ ID NO: 1666301 - protein, 31 aa, Staphylococcus aureus
EEKDKRAKELIKLVDLPESFLERYPAEISGG

SEQ ID NO: 1666302 - protein, 21 aa, Staphylococcus aureus
EEKKVPINLWIDGKQNTVPLG

SEQ ID NO: 1666303 - protein, 29 aa, Staphylococcus aureus
EEKLRVSMYRPFTKNGYFSIIKLFIDQGN

SEQ ID NO: 1666304 - protein, 18 aa, Staphylococcus aureus
EELCIEIDPGMAFGTGDH

SEQ ID NO: 1666305 - protein, 17 aa, Staphylococcus aureus
EELIYYDRHHYLKSDSE

SEQ ID NO: 1666306 - protein, 18 aa, Staphylococcus aureus
EELKRMFEEAGFINVRVR

SEQ ID NO: 1666307 - protein, 27 aa, Staphylococcus aureus
EELPISRLLQWVTDFVKPLARLAYNGE

SEQ ID NO: 1666308 - protein, 17 aa, Staphylococcus aureus
EELRKHLIEKYSIGVIA

SEQ ID NO: 1666309 - protein, 18 aa, Staphylococcus aureus
EELRKHLIEKYSIGVIAL

SEQ ID NO: 1666310 - protein, 17 aa, Staphylococcus aureus
EELRRMVASMQMQMTQL

SEQ ID NO: 1666311 - protein, 22 aa, Staphylococcus aureus
EELRYAVSEGVQRIHVESMHEL

SEQ ID NO: 1666312 - protein, 27 aa, Staphylococcus aureus
EELSDSLIRRTMGPTRQAMKDAGLTNS

SEQ ID NO: 1666313 - protein, 22 aa, Staphylococcus aureus
EEMKSWVPLMIEGRKSDEPIAL

SEQ ID NO: 1666314 - protein, 18 aa, Staphylococcus aureus
EEMMEMSALGAGVLETRS

SEQ ID NO: 1666315 - protein, 18 aa, Staphylococcus aureus
EENAELWSPIQKLEADTM

SEQ ID NO: 1666316 - protein, 20 aa, Staphylococcus aureus
EENDKIYGFIVVDQDQAEWY

SEQ ID NO: 1666317 - protein, 21 aa, Staphylococcus aureus
EEQMLYFGLPRINKYCTADRA

SEQ ID NO: 1666318 - protein, 17 aa, Staphylococcus aureus
EEQMLYFGLPRINKYYT

SEQ ID NO: 1666319 - protein, 20 aa, Staphylococcus aureus
EEQMLYFGLPRINKYYTAER

SEQ ID NO: 1666320 - protein, 25 aa, Staphylococcus aureus
EERAERRYKDNLLRGIESNFEDLKR

SEQ ID NO: 1666321 - protein, 19 aa, Staphylococcus aureus
EERFIEMIQYFKDKITEGD

SEQ ID NO: 1666322 - protein, 23 aa, Staphylococcus aureus
EERLNGTVIWLGESDELYHPQQS

SEQ ID NO: 1666323 - protein, 23 aa, Staphylococcus aureus
EERQLKYSFDTTMNNRQNINPQE

SEQ ID NO: 1666324 - protein, 20 aa, Staphylococcus aureus
EESICKFCGNNLNYNLIKEK

SEQ ID NO: 1666325 - protein, 21 aa, Staphylococcus aureus
EETPFAAAILAEIFDKVGVPK

SEQ ID NO: 1666326 - protein, 17 aa, Staphylococcus aureus
EETYKLFSERYGKQNIA

SEQ ID NO: 1666327 - protein, 18 aa, Staphylococcus aureus
EEVAEADAAVDAAQTEGL

SEQ ID NO: 1666328 - protein, 24 aa, Staphylococcus aureus
EEVENLGLKEFVTYDDKGEIEGIA

SEQ ID NO: 1666329 - protein, 22 aa, Staphylococcus aureus
EEVSQLIKERIARERKKSDERI

SEQ ID NO: 1666330 - protein, 23 aa, Staphylococcus aureus
EEVYEIFQNTLLKRANEDESQWN

SEQ ID NO: 1666331 - protein, 21 aa, Staphylococcus aureus
EEVYKQLLLMSPIITLGEDES

SEQ ID NO: 1666332 - protein, 19 aa, Staphylococcus aureus
EEVYKTNVFGIVRMMNTFV

SEQ ID NO: 1666333 - protein, 17 aa, Staphylococcus aureus
EEWWKLYDRKKDKKISF

SEQ ID NO: 1666334 - protein, 19 aa, Staphylococcus aureus
EEYIKRFNSLASFNTNINI

SEQ ID NO: 1666335 - protein, 22 aa, Staphylococcus aureus
EEYKNAIFTYLFTSKGKLKEHV

SEQ ID NO: 1666336 - protein, 27 aa, Staphylococcus aureus
EFCDNCAKYKYMGVCYGNPGVGKTFSA

SEQ ID NO: 1666337 - protein, 23 aa, Staphylococcus aureus
EFDFLKDRCEVIYLKRTEGISTT

SEQ ID NO: 1666338 - protein, 19 aa, Staphylococcus aureus
EFETLRFYQLPKFLFEDEY

SEQ ID NO: 1666339 - protein, 23 aa, Staphylococcus aureus
EFETRAGTLLRYYTGLLERSKVQ

SEQ ID NO: 1666340 - protein, 24 aa, Staphylococcus aureus
EFFESRILPYDIHLEVLDLGINTN

SEQ ID NO: 1666341 - protein, 24 aa, Staphylococcus aureus
EFICPNNKRIGFKRYANRNDRYGF

SEQ ID NO: 1666342 - protein, 25 aa, Staphylococcus aureus
EFICPNNKRIGFKRYAYLNDRYGFK

SEQ ID NO: 1666343 - protein, 24 aa, Staphylococcus aureus
EFICPNNKRIGFKRYAYRNDRYGF

SEQ ID NO: 1666344 - protein, 24 aa, Staphylococcus aureus
EFIEMIKPKISLISSGKNNMYHLP

SEQ ID NO: 1666345 - protein, 21 aa, Staphylococcus aureus
EFIGRVPIVANLETLDVTALK

SEQ ID NO: 1666346 - protein, 26 aa, Staphylococcus aureus
EFLPHCFKFGIKNAIRIYNHNTSKSW

SEQ ID NO: 1666347 - protein, 20 aa, Staphylococcus aureus
EFNKVLKNVCIKIMNDDIKN

SEQ ID NO: 1666348 - protein, 19 aa, Staphylococcus aureus
EFQTHLFGYYNYYYTSNLT

SEQ ID NO: 1666349 - protein, 21 aa, Staphylococcus aureus
EFRKEILQAMRVGVWAPTKRI

SEQ ID NO: 1666350 - protein, 20 aa, Staphylococcus aureus
EFSYKCSIKDIKYKKLLKAI

SEQ ID NO: 1666351 - protein, 25 aa, Staphylococcus aureus
EFTKQIECLGKMPWNTNFKIRQWQD

SEQ ID NO: 1666352 - protein, 20 aa, Staphylococcus aureus
EGADLTKVFHYFKEAHPYFD

SEQ ID NO: 1666353 - protein, 19 aa, Staphylococcus aureus
EGALKSREMILYINRNTRT

SEQ ID NO: 1666354 - protein, 25 aa, Staphylococcus aureus
EGEKALTYLLERGFTDALIKERGIG

SEQ ID NO: 1666355 - protein, 24 aa, Staphylococcus aureus
EGELKVSFDYIDWINTEFDQLGRE

SEQ ID NO: 1666356 - protein, 22 aa, Staphylococcus aureus
EGEPPDNAWDFFEFLEDDNAPN

SEQ ID NO: 1666357 - protein, 23 aa, Staphylococcus aureus
EGFELPDMGLVVITERELFKSKQ

SEQ ID NO: 1666358 - protein, 22 aa, Staphylococcus aureus
EGFHICKGELFGKHRHGEDCLF

SEQ ID NO: 1666359 - protein, 23 aa, Staphylococcus aureus
EGFYRRMVIIPMLRKFGKGGQKK

SEQ ID NO: 1666360 - protein, 20 aa, Staphylococcus aureus
EGHEPWTSCEFDFTNEGKLK

SEQ ID NO: 1666361 - protein, 29 aa, Staphylococcus aureus
EGHEPWTSCEFDFTREGKLNVSFDYIDWI

SEQ ID NO: 1666362 - protein, 19 aa, Staphylococcus aureus
EGIFEPFFDYILIDESQDF

SEQ ID NO: 1666363 - protein, 17 aa, Staphylococcus aureus
EGIKEFVGYVNEGKEVL

SEQ ID NO: 1666364 - protein, 17 aa, Staphylococcus aureus
EGIKFLSVENIKTLNSS

SEQ ID NO: 1666365 - protein, 19 aa, Staphylococcus aureus
EGIRYGCEQGLYGWNVTDC

SEQ ID NO: 1666366 - protein, 17 aa, Staphylococcus aureus
EGKAWNPDNAFGCQCFD

SEQ ID NO: 1666367 - protein, 25 aa, Staphylococcus aureus
EGKHSPIIIQDLWDKVQLRKKQVSQ

SEQ ID NO: 1666368 - protein, 20 aa, Staphylococcus aureus
EGKKKINAIMTKFRSNPPQE

SEQ ID NO: 1666369 - protein, 24 aa, Staphylococcus aureus
EGKNRRLNINPTWEYIKIKANEKI

SEQ ID NO: 1666370 - protein, 17 aa, Staphylococcus aureus
EGKRFGEIKKFFANISQ

SEQ ID NO: 1666371 - protein, 19 aa, Staphylococcus aureus
EGKVGQFVTGPWNINEYQE

SEQ ID NO: 1666372 - protein, 23 aa, Staphylococcus aureus
EGLDPWTSCEFDFTSEGKLYVSF

SEQ ID NO: 1666373 - protein, 22 aa, Staphylococcus aureus
EGLDPWTSCEFDFTSEGNLKVS

SEQ ID NO: 1666374 - protein, 25 aa, Staphylococcus aureus
EGLEPWTSCEFDFTRDGKLNVSFDY

SEQ ID NO: 1666375 - protein, 26 aa, Staphylococcus aureus
EGLHRKRLISYGGLLKEIHKKLNLDD

SEQ ID NO: 1666376 - protein, 19 aa, Staphylococcus aureus
EGLISVSHPLAAKIGKDVL

SEQ ID NO: 1666377 - protein, 17 aa, Staphylococcus aureus
EGLLKEVEDVYKKAQAF

SEQ ID NO: 1666378 - protein, 27 aa, Staphylococcus aureus
EGLRTLLDFRYQRHFKASKGENGQSSN

SEQ ID NO: 1666379 - protein, 18 aa, Staphylococcus aureus
EGLTDLFEFMTMIEYNHQ

SEQ ID NO: 1666380 - protein, 21 aa, Staphylococcus aureus
EGNLNGEWCINDVNAVSKIAA

SEQ ID NO: 1666381 - protein, 20 aa, Staphylococcus aureus
EGRLVLADAVYYANQYQPSV

SEQ ID NO: 1666382 - protein, 29 aa, Staphylococcus aureus
EGSHQWKDWKPLLSDILLYFLSKNTDDQL

SEQ ID NO: 1666383 - protein, 19 aa, Staphylococcus aureus
EGSMLPKIEAAIRFVESGE

SEQ ID NO: 1666384 - protein, 19 aa, Staphylococcus aureus
EGVDFPFVYQEVRTPMGGR

SEQ ID NO: 1666385 - protein, 17 aa, Staphylococcus aureus
EGVLTYDVLDYIKEIIH

SEQ ID NO: 1666386 - protein, 17 aa, Staphylococcus aureus
EGVSIVDHLTAAKQFEL

SEQ ID NO: 1666387 - protein, 18 aa, Staphylococcus aureus
EGWIIFFLNATERMINSI

SEQ ID NO: 1666388 - protein, 17 aa, Staphylococcus aureus
EGYEADGPVLIDIPVNY

SEQ ID NO: 1666389 - protein, 17 aa, Staphylococcus aureus
EGYGFEFSQDDMKKVKK

SEQ ID NO: 1666390 - protein, 25 aa, Staphylococcus aureus
EGYKATNFLDAKGWVGAGTKRGLPK

SEQ ID NO: 1666391 - protein, 21 aa, Staphylococcus aureus
EGYSGDYLKKMHVYLVSLLNH

SEQ ID NO: 1666392 - protein, 19 aa, Staphylococcus aureus
EGYTATDIISRYKRMQGYN

SEQ ID NO: 1666393 - protein, 32 aa, Staphylococcus aureus
EHEAIFKKYFEGEGLSILGYRNVPVNKDAIAK

SEQ ID NO: 1666394 - protein, 17 aa, Staphylococcus aureus
EHEHPDIVLLDLVMPGM

SEQ ID NO: 1666395 - protein, 19 aa, Staphylococcus aureus
EHFIRATIESLCYQTRDVM

SEQ ID NO: 1666396 - protein, 24 aa, Staphylococcus aureus
EHFSKLDVPFIYRVHEQPKSERLR

SEQ ID NO: 1666397 - protein, 19 aa, Staphylococcus aureus
EHKEVPKINNALVIDVPKE

SEQ ID NO: 1666398 - protein, 20 aa, Staphylococcus aureus
EHKYKFCIQGEYMKESTLEK

SEQ ID NO: 1666399 - protein, 19 aa, Staphylococcus aureus
EHNEVPKINNALVIDVPEE

SEQ ID NO: 1666400 - protein, 23 aa, Staphylococcus aureus
EHNGNYKYVFSFKDPNVNGKYSI

SEQ ID NO: 1666401 - protein, 20 aa, Staphylococcus aureus
EHNIYYGRDIPIIGSSGVVH

SEQ ID NO: 1666402 - protein, 21 aa, Staphylococcus aureus
EHVIILPIWHKVSVEDVRAYN

SEQ ID NO: 1666403 - protein, 23 aa, Staphylococcus aureus
EIAGENYIDIVWLARKNAYQVAL

SEQ ID NO: 1666404 - protein, 17 aa, Staphylococcus aureus
EIASLRQTSLFEMAEYI

SEQ ID NO: 1666405 - protein, 28 aa, Staphylococcus aureus
EICRQVCNFYPERIILLGHGENSIYLIN

SEQ ID NO: 1666406 - protein, 20 aa, Staphylococcus aureus
EIDLGDKLQFERMGDVLNSK

SEQ ID NO: 1666407 - protein, 22 aa, Staphylococcus aureus
EIDRLVKGCTGVKRTTGQHPGG

SEQ ID NO: 1666408 - protein, 22 aa, Staphylococcus aureus
EIEEFKKIILKTIFGETEVEEY

SEQ ID NO: 1666409 - protein, 19 aa, Staphylococcus aureus
EIEEFNFFVQYGNFKELEN

SEQ ID NO: 1666410 - protein, 20 aa, Staphylococcus aureus
EIEIIFSRSKEEAFIMLTAL

SEQ ID NO: 1666411 - protein, 18 aa, Staphylococcus aureus
EIELPFADQFWGGKMGIF

SEQ ID NO: 1666412 - protein, 20 aa, Staphylococcus aureus
EIENFKFFAQYGNFKDLTKY

SEQ ID NO: 1666413 - protein, 20 aa, Staphylococcus aureus
EIENFKFFAQYSNFKDLMNY

SEQ ID NO: 1666414 - protein, 25 aa, Staphylococcus aureus
EIENFKFFVQYGDFKDINDYKDGDI

SEQ ID NO: 1666415 - protein, 24 aa, Staphylococcus aureus
EIENFKFFVQYGDFKDISDYKDGD

SEQ ID NO: 1666416 - protein, 24 aa, Staphylococcus aureus
EIENFKFFVQYGDFKNLKNYKDGD

SEQ ID NO: 1666417 - protein, 21 aa, Staphylococcus aureus
EIENFKFFVQYGNFKDFKDYK

SEQ ID NO: 1666418 - protein, 23 aa, Staphylococcus aureus
EIENFKFFVQYGNFKDFKDYKDG

SEQ ID NO: 1666419 - protein, 24 aa, Staphylococcus aureus
EIENFKFFVQYGNFKDINDYKDGD

SEQ ID NO: 1666420 - protein, 21 aa, Staphylococcus aureus
EIENFKFFVQYGNFTDINDYK

SEQ ID NO: 1666421 - protein, 20 aa, Staphylococcus aureus
EIENFKLFSQYGEFKSLNTD

SEQ ID NO: 1666422 - protein, 24 aa, Staphylococcus aureus
EIENLKFFVQYGNFKDINDYKDGD

SEQ ID NO: 1666423 - protein, 24 aa, Staphylococcus aureus
EIEQAKAQLAQALKEIKDLVKAKE

SEQ ID NO: 1666424 - protein, 23 aa, Staphylococcus aureus
EIEQAKAQLAQALQDIKDLVKAK

SEQ ID NO: 1666425 - protein, 21 aa, Staphylococcus aureus
EIEQAKAQLGQALQDIKDLVK

SEQ ID NO: 1666426 - protein, 23 aa, Staphylococcus aureus
EIEQAKAQLGQALQDIKDLVKAK

SEQ ID NO: 1666427 - protein, 25 aa, Staphylococcus aureus
EIERLRYLVDNDFYFNVFDIYSEAD

SEQ ID NO: 1666428 - protein, 19 aa, Staphylococcus aureus
EIFANRAFEGYKVEQVKDL

SEQ ID NO: 1666429 - protein, 38 aa, Staphylococcus aureus
EIFATAMNRKGYYLYGYRHFSSRIKGGHTNNKIRVSTT

SEQ ID NO: 1666430 - protein, 19 aa, Staphylococcus aureus
EIFKGDQIALVGPSGAGKS

SEQ ID NO: 1666431 - protein, 21 aa, Staphylococcus aureus
EIHYLKQFIKHKIEQLLDEGL

SEQ ID NO: 1666432 - protein, 18 aa, Staphylococcus aureus
EIICVFDAYDQSCVEREY

SEQ ID NO: 1666433 - protein, 20 aa, Staphylococcus aureus
EIIDFEFVIGKSFVEGKYID

SEQ ID NO: 1666434 - protein, 25 aa, Staphylococcus aureus
EIIKDRLKQNINLFDERSNYNALAV

SEQ ID NO: 1666435 - protein, 17 aa, Staphylococcus aureus
EIIKKGRGGNHVTSQNP

SEQ ID NO: 1666436 - protein, 17 aa, Staphylococcus aureus
EIIKKVRGGNHVTSQNP

SEQ ID NO: 1666437 - protein, 29 aa, Staphylococcus aureus
EIKDTMFAPFIDYKCVTTMRLEDEAHHYT

SEQ ID NO: 1666438 - protein, 24 aa, Staphylococcus aureus
EIKIERPLLKEKFFSDIEKELIQN

SEQ ID NO: 1666439 - protein, 21 aa, Staphylococcus aureus
EIKNFKFFVQYGNFKDLKNYK

SEQ ID NO: 1666440 - protein, 21 aa, Staphylococcus aureus
EIKNFKFFVQYGNFKDLSKYK

SEQ ID NO: 1666441 - protein, 22 aa, Staphylococcus aureus
EIKPRMKRSTDVTAVAEKEVVE

SEQ ID NO: 1666442 - protein, 18 aa, Staphylococcus aureus
EILQAMQVGVGRRNKFCE

SEQ ID NO: 1666443 - protein, 18 aa, Staphylococcus aureus
EILRSWISIISGNDNYIL

SEQ ID NO: 1666444 - protein, 18 aa, Staphylococcus aureus
EIMTPWIPADTNIGGEFV

SEQ ID NO: 1666445 - protein, 28 aa, Staphylococcus aureus
EINGAFPRMTYKEAMRRFGSDKPDTRFE

SEQ ID NO: 1666446 - protein, 22 aa, Staphylococcus aureus
EINKGDIIALVGPSGSGKSTFL

SEQ ID NO: 1666447 - protein, 25 aa, Staphylococcus aureus
EINLPKWMHYALKMYQIAPRFFERC

SEQ ID NO: 1666448 - protein, 24 aa, Staphylococcus aureus
EINLTRLSIFIFIINILKQLRGIV

SEQ ID NO: 1666449 - protein, 21 aa, Staphylococcus aureus
EINRLIKIVNVLGYEYNKDTG

SEQ ID NO: 1666450 - protein, 25 aa, Staphylococcus aureus
EINTIKGNVNWMRACQHKLIETLFG

SEQ ID NO: 1666451 - protein, 22 aa, Staphylococcus aureus
EIPFAFFKQHVTDFEIPGEGEY

SEQ ID NO: 1666452 - protein, 24 aa, Staphylococcus aureus
EIPFQRYNWSISFESVCKDALEKL

SEQ ID NO: 1666453 - protein, 38 aa, Staphylococcus aureus
EIPHENIIKLPARFHKKSLPVPKYRYFKLNNNKIQKML

SEQ ID NO: 1666454 - protein, 25 aa, Staphylococcus aureus
EIPYRENLNVIACLMEIRRNPVNIK

SEQ ID NO: 1666455 - protein, 21 aa, Staphylococcus aureus
EIQNRIIPRILKKTNLIGQSQ

SEQ ID NO: 1666456 - protein, 24 aa, Staphylococcus aureus
EIQNRIIPRILKRTNLIGQSQTST

SEQ ID NO: 1666457 - protein, 20 aa, Staphylococcus aureus
EIRCRLRSKGQLIINDIAQD

SEQ ID NO: 1666458 - protein, 19 aa, Staphylococcus aureus
EIRGRGLFIGIELNTDAAP

SEQ ID NO: 1666459 - protein, 24 aa, Staphylococcus aureus
EISEDAKFGKFVVEPLERGYGTTL

SEQ ID NO: 1666460 - protein, 24 aa, Staphylococcus aureus
EISPNKVKGFCKICNQESDTSLFL

SEQ ID NO: 1666461 - protein, 26 aa, Staphylococcus aureus
EISQTRLAYLVLRGMGMSEGMIQETQ

SEQ ID NO: 1666462 - protein, 25 aa, Staphylococcus aureus
EIYKFKYMNSWCLEYSEFLLDEVRL

SEQ ID NO: 1666463 - protein, 17 aa, Staphylococcus aureus
EIYLSFLDKKSWCKNKF

SEQ ID NO: 1666464 - protein, 18 aa, Staphylococcus aureus
EIYLSFLDTKSWCKNKFQ

SEQ ID NO: 1666465 - protein, 30 aa, Staphylococcus aureus
EIYLSFLDTKSWCKNKFQVTNQVSVEDRYK

SEQ ID NO: 1666466 - protein, 19 aa, Staphylococcus aureus
EIYQFPLFLFYKGNIKLIK

SEQ ID NO: 1666467 - protein, 24 aa, Staphylococcus aureus
EIYVFEEYILFDLEINKVINELDI

SEQ ID NO: 1666468 - protein, 22 aa, Staphylococcus aureus
EKAKYKLANVISNYSPILLLDE

SEQ ID NO: 1666469 - protein, 21 aa, Staphylococcus aureus
EKARHKGVIVVFNDEIHTARN

SEQ ID NO: 1666470 - protein, 31 aa, Staphylococcus aureus
EKDQERFFGLHFFNPPRIMKLVELIPTSHTK

SEQ ID NO: 1666471 - protein, 19 aa, Staphylococcus aureus
EKDSFEYNAELQFIKEKEK

SEQ ID NO: 1666472 - protein, 23 aa, Staphylococcus aureus
EKEAFTNALEYILSKATEDISDQ

SEQ ID NO: 1666473 - protein, 19 aa, Staphylococcus aureus
EKEFKEWKNNISNIYDNNF

SEQ ID NO: 1666474 - protein, 22 aa, Staphylococcus aureus
EKEIPNSIDLSIKFSDNKINTV

SEQ ID NO: 1666475 - protein, 19 aa, Staphylococcus aureus
EKEKFEFTTEGTWQQRQSN

SEQ ID NO: 1666476 - protein, 18 aa, Staphylococcus aureus
EKFISVTEYEMLKEHVKK

SEQ ID NO: 1666477 - protein, 17 aa, Staphylococcus aureus
EKFKAQGGTLIYKTWKD

SEQ ID NO: 1666478 - protein, 17 aa, Staphylococcus aureus
EKFMSIKDFINLKEYVS

SEQ ID NO: 1666479 - protein, 21 aa, Staphylococcus aureus
EKFRHYCEHEVLSSIINGSYI

SEQ ID NO: 1666480 - protein, 20 aa, Staphylococcus aureus
EKFSELHALYSFDTEIKNLF

SEQ ID NO: 1666481 - protein, 22 aa, Staphylococcus aureus
EKFSGWLLKEGFEDIAQLHGGI

SEQ ID NO: 1666482 - protein, 26 aa, Staphylococcus aureus
EKGGMPIEVEIAGPIVIENKFIDPKT

SEQ ID NO: 1666483 - protein, 19 aa, Staphylococcus aureus
EKGIYRLIMRSNKTEALDF

SEQ ID NO: 1666484 - protein, 21 aa, Staphylococcus aureus
EKGKKSIAIRLNYLETEETLT

SEQ ID NO: 1666485 - protein, 25 aa, Staphylococcus aureus
EKGLYRKRMLSYGGLLKQKHKILNL

SEQ ID NO: 1666486 - protein, 28 aa, Staphylococcus aureus
EKGMREIKKDIGMIFQHFNLLNSATVFK

SEQ ID NO: 1666487 - protein, 23 aa, Staphylococcus aureus
EKGMYLKYIDIFKEASIQYLKEK

SEQ ID NO: 1666488 - protein, 25 aa, Staphylococcus aureus
EKGYFARPTIFINVNNQMTIAQEEI

SEQ ID NO: 1666489 - protein, 23 aa, Staphylococcus aureus
EKHGIKMIYGMEGMLVDDGAPIA

SEQ ID NO: 1666490 - protein, 22 aa, Staphylococcus aureus
EKHNIYYGQWLILRDIAKHQPT

SEQ ID NO: 1666491 - protein, 25 aa, Staphylococcus aureus
EKHQITDFMFFKSVVMTLLSRYARK

SEQ ID NO: 1666492 - protein, 27 aa, Staphylococcus aureus
EKHRFPLKHINLGGGIGVNYADLTNQF

SEQ ID NO: 1666493 - protein, 27 aa, Staphylococcus aureus
EKHRFPLKHINLGGGIGVNYADLTSQF

SEQ ID NO: 1666494 - protein, 23 aa, Staphylococcus aureus
EKIRRANGLSGNNIRNGQQIVIP

SEQ ID NO: 1666495 - protein, 23 aa, Staphylococcus aureus
EKKDLTAELSLNLFIDPTTVTQK

SEQ ID NO: 1666496 - protein, 24 aa, Staphylococcus aureus
EKKGCKEIKCYLEQATDESAFVGE

SEQ ID NO: 1666497 - protein, 20 aa, Staphylococcus aureus
EKKLGLDDMVNGSFTITNGG

SEQ ID NO: 1666498 - protein, 18 aa, Staphylococcus aureus
EKKVPINLWIDGKQNTVP

SEQ ID NO: 1666499 - protein, 29 aa, Staphylococcus aureus
EKLALVYARPLFYFGNIMKPLIWLMNGSA

SEQ ID NO: 1666500 - protein, 18 aa, Staphylococcus aureus
EKLIPYWQDLAEFAKEQD

SEQ ID NO: 1666501 - protein, 24 aa, Staphylococcus aureus
EKLLYSCWASIDGVCLRELEQAIS

SEQ ID NO: 1666502 - protein, 20 aa, Staphylococcus aureus
EKMLNDSIRMMWLSQNQKPS

SEQ ID NO: 1666503 - protein, 17 aa, Staphylococcus aureus
EKMPEKLQAKSYVLSND

SEQ ID NO: 1666504 - protein, 20 aa, Staphylococcus aureus
EKNFGVYFTPQLKEFIQNNI

SEQ ID NO: 1666505 - protein, 20 aa, Staphylococcus aureus
EKNRYFKFNVKSYLRADSAT

SEQ ID NO: 1666506 - protein, 24 aa, Staphylococcus aureus
EKNTLVFEKFCLTPLLKKIQNELN

SEQ ID NO: 1666507 - protein, 21 aa, Staphylococcus aureus
EKPEENWLFKLDDVDKEAFNA

SEQ ID NO: 1666508 - protein, 26 aa, Staphylococcus aureus
EKQAQAILDMRLRRLTGLERDKIEAE

SEQ ID NO: 1666509 - protein, 23 aa, Staphylococcus aureus
EKQLPQHFIRISKSEIVNKYCIE

SEQ ID NO: 1666510 - protein, 18 aa, Staphylococcus aureus
EKRARDIIEDKYLSERTK

SEQ ID NO: 1666511 - protein, 20 aa, Staphylococcus aureus
EKRVEFHLHTAMSQMDGIPN

SEQ ID NO: 1666512 - protein, 20 aa, Staphylococcus aureus
EKSGIVGAFCRAYTIEEAIE

SEQ ID NO: 1666513 - protein, 22 aa, Staphylococcus aureus
EKSPSGTGLHCFFKGELPKERK

SEQ ID NO: 1666514 - protein, 23 aa, Staphylococcus aureus
EKSYQSAHVFKRRRTPIVKGVSF

SEQ ID NO: 1666515 - protein, 25 aa, Staphylococcus aureus
EKTEFELIRLFGKRGRGLYNKARGI

SEQ ID NO: 1666516 - protein, 18 aa, Staphylococcus aureus
EKTMKWYQKQRIYSIKSE

SEQ ID NO: 1666517 - protein, 17 aa, Staphylococcus aureus
EKTRKALEDYGIDYDQI

SEQ ID NO: 1666518 - protein, 23 aa, Staphylococcus aureus
EKTYKYVLHLGLGKKERLKKTEK

SEQ ID NO: 1666519 - protein, 25 aa, Staphylococcus aureus
EKVLKDNEHSPLLFAKRRKDKEEDV

SEQ ID NO: 1666520 - protein, 18 aa, Staphylococcus aureus
EKVMKKMIANLLIEKSLD

SEQ ID NO: 1666521 - protein, 20 aa, Staphylococcus aureus
EKWPIFLERRLVDGIFTIKD

SEQ ID NO: 1666522 - protein, 20 aa, Staphylococcus aureus
EKYDAIYLRECNQPNEIWQA

SEQ ID NO: 1666523 - protein, 21 aa, Staphylococcus aureus
EKYDEVMRFGKYHPDYKKVML

SEQ ID NO: 1666524 - protein, 17 aa, Staphylococcus aureus
EKYFSYKDGKPEVQKII

SEQ ID NO: 1666525 - protein, 19 aa, Staphylococcus aureus
EKYKSYFIGDWYVSGDSAY

SEQ ID NO: 1666526 - protein, 24 aa, Staphylococcus aureus
EKYNIQQAKGWTQVKMKAVLHNEA

SEQ ID NO: 1666527 - protein, 19 aa, Staphylococcus aureus
EKYTLLTMHGLFNQLKLGI

SEQ ID NO: 1666528 - protein, 18 aa, Staphylococcus aureus
ELAKALNVNEAWLMGFDI

SEQ ID NO: 1666529 - protein, 29 aa, Staphylococcus aureus
ELAKALNVNEAWLMGFDISKNRKIENNDI

SEQ ID NO: 1666530 - protein, 29 aa, Staphylococcus aureus
ELAKALNVNEAWLMGFDISKNRKVENNDI

SEQ ID NO: 1666531 - protein, 26 aa, Staphylococcus aureus
ELAKGRPLFEAVYKAKKFISMSIQYT

SEQ ID NO: 1666532 - protein, 17 aa, Staphylococcus aureus
ELARRVGVAKSAVSRYL

SEQ ID NO: 1666533 - protein, 19 aa, Staphylococcus aureus
ELCKVCKQYQLPLFMDGAR

SEQ ID NO: 1666534 - protein, 17 aa, Staphylococcus aureus
ELDEYLITKNYEKANSG

SEQ ID NO: 1666535 - protein, 17 aa, Staphylococcus aureus
ELDFKLRKQLIEQHNLY

SEQ ID NO: 1666536 - protein, 20 aa, Staphylococcus aureus
ELDGKMSYMIAVAGDNSADI

SEQ ID NO: 1666537 - protein, 31 aa, Staphylococcus aureus
ELDLSALVAGAKYRGEFEERLKVVLKEVKES

SEQ ID NO: 1666538 - protein, 17 aa, Staphylococcus aureus
ELDRMVSEFAQRIQQQG

SEQ ID NO: 1666539 - protein, 24 aa, Staphylococcus aureus
ELEKTGKQYVYFNGQLEQFKSNFY

SEQ ID NO: 1666540 - protein, 22 aa, Staphylococcus aureus
ELEPWTSCEFDFTRDGKLNVSF

SEQ ID NO: 1666541 - protein, 19 aa, Staphylococcus aureus
ELERVYKVNAKLIGVNNRD

SEQ ID NO: 1666542 - protein, 17 aa, Staphylococcus aureus
ELFDFYYDLFKSDDDIF

SEQ ID NO: 1666543 - protein, 20 aa, Staphylococcus aureus
ELFYYPKHPYTWGLLASMPT

SEQ ID NO: 1666544 - protein, 22 aa, Staphylococcus aureus
ELGADVFVATGFDEGGTVPEKI

SEQ ID NO: 1666545 - protein, 18 aa, Staphylococcus aureus
ELGDNLFVLLCLANSMGI

SEQ ID NO: 1666546 - protein, 19 aa, Staphylococcus aureus
ELGGIVLKQIENVSVNVKR

SEQ ID NO: 1666547 - protein, 25 aa, Staphylococcus aureus
ELGKTECWYILDAAPGAEIIYGVHA

SEQ ID NO: 1666548 - protein, 17 aa, Staphylococcus aureus
ELIKAKQQIAGAVTNAD

SEQ ID NO: 1666549 - protein, 18 aa, Staphylococcus aureus
ELIRSGWDAAYVQKRLGH

SEQ ID NO: 1666550 - protein, 21 aa, Staphylococcus aureus
ELKKQYSTCREFLDDYLYTAW

SEQ ID NO: 1666551 - protein, 24 aa, Staphylococcus aureus
ELKMARLYRQAKFPVRRTLDNYEW

SEQ ID NO: 1666552 - protein, 21 aa, Staphylococcus aureus
ELKQFIKSYVQSHSFIKSLVL

SEQ ID NO: 1666553 - protein, 19 aa, Staphylococcus aureus
ELKRRGIDINEAFNQVKRY

SEQ ID NO: 1666554 - protein, 21 aa, Staphylococcus aureus
ELKSIPLKNSFGIWGDGNLGY

SEQ ID NO: 1666555 - protein, 18 aa, Staphylococcus aureus
ELKVFKSKWQALNKGMIN

SEQ ID NO: 1666556 - protein, 21 aa, Staphylococcus aureus
ELKYEKAWELLDLPEKIKQYG

SEQ ID NO: 1666557 - protein, 19 aa, Staphylococcus aureus
ELLAISIARLEASGFKIVG

SEQ ID NO: 1666558 - protein, 32 aa, Staphylococcus aureus
ELLNFKESYMGFKVNDIFLIEEFMRGQEYSIE

SEQ ID NO: 1666559 - protein, 20 aa, Staphylococcus aureus
ELLRQKVDFDYDIKTIFKAN

SEQ ID NO: 1666560 - protein, 20 aa, Staphylococcus aureus
ELNGDERLREAKQNANTAID

SEQ ID NO: 1666561 - protein, 23 aa, Staphylococcus aureus
ELNGLKIPHTYALQNSNDYLEIM

SEQ ID NO: 1666562 - protein, 24 aa, Staphylococcus aureus
ELNKDFNFSAAHHIPCEEAGICQN

SEQ ID NO: 1666563 - protein, 18 aa, Staphylococcus aureus
ELNKLGIIVSRRKIGRIM

SEQ ID NO: 1666564 - protein, 25 aa, Staphylococcus aureus
ELNLNEYITCYGLGLTQSTGNVTDL

SEQ ID NO: 1666565 - protein, 26 aa, Staphylococcus aureus
ELPISRLLQWGTDFVKPLARLAYNGG

SEQ ID NO: 1666566 - protein, 20 aa, Staphylococcus aureus
ELPNGAVFLFKGLDNPEKIK

SEQ ID NO: 1666567 - protein, 27 aa, Staphylococcus aureus
ELPNLYVKTPRGWHLYFVLDTPFYAKG

SEQ ID NO: 1666568 - protein, 26 aa, Staphylococcus aureus
ELPTARKEVFKELLVNCELPQSLREV

SEQ ID NO: 1666569 - protein, 17 aa, Staphylococcus aureus
ELQPKFGKQRPITYIAD

SEQ ID NO: 1666570 - protein, 23 aa, Staphylococcus aureus
ELRDLWQQKMLRDNPELSIDNMS

SEQ ID NO: 1666571 - protein, 19 aa, Staphylococcus aureus
ELRETFKEEGLEPWTSCEF

SEQ ID NO: 1666572 - protein, 18 aa, Staphylococcus aureus
ELSALIRMNGALSLSNQQ

SEQ ID NO: 1666573 - protein, 20 aa, Staphylococcus aureus
ELSDSLIRRTMEPTRQAMKD

SEQ ID NO: 1666574 - protein, 20 aa, Staphylococcus aureus
ELSKRGGLTIIDDIMVQSAT

SEQ ID NO: 1666575 - protein, 19 aa, Staphylococcus aureus
ELSKYGVIIDDLSLPIRAG

SEQ ID NO: 1666576 - protein, 18 aa, Staphylococcus aureus
ELTYRLNNNLPLTKSEFE

SEQ ID NO: 1666577 - protein, 20 aa, Staphylococcus aureus
ELVDIFNERYDIIIVDTPPV

SEQ ID NO: 1666578 - protein, 24 aa, Staphylococcus aureus
ELVSVLKRFKAMLLQKNETVETMQ

SEQ ID NO: 1666579 - protein, 26 aa, Staphylococcus aureus
ELYIADLKLGVAIIPCSEMLRTKDLQ

SEQ ID NO: 1666580 - protein, 29 aa, Staphylococcus aureus
ELYKALEVKKRFSAWAEINLKHFKENRDF

SEQ ID NO: 1666581 - protein, 20 aa, Staphylococcus aureus
ELYTKYGAIVSKIFSKTDIP

SEQ ID NO: 1666582 - protein, 18 aa, Staphylococcus aureus
EMADLFICGRDLAENAER

SEQ ID NO: 1666583 - protein, 23 aa, Staphylococcus aureus
EMGMSGFHEIEFLSNLTQPDIAV

SEQ ID NO: 1666584 - protein, 30 aa, Staphylococcus aureus
EMGRPAQCVFLSWNRYLYRNAQNYITSSDY

SEQ ID NO: 1666585 - protein, 23 aa, Staphylococcus aureus
EMHRGICIRRLKYSRFNNKSKVG

SEQ ID NO: 1666586 - protein, 25 aa, Staphylococcus aureus
EMIDNYKWMKNIIDSKVYDNESTSI

SEQ ID NO: 1666587 - protein, 20 aa, Staphylococcus aureus
EMKEACYAATPAIQLAKDYL

SEQ ID NO: 1666588 - protein, 21 aa, Staphylococcus aureus
EMKSWVPLMIEGRKSDEPIVL

SEQ ID NO: 1666589 - protein, 23 aa, Staphylococcus aureus
EMLRRLDHRGGVGADGITGDGAG

SEQ ID NO: 1666590 - protein, 21 aa, Staphylococcus aureus
EMPGKRINIRDGVPTLNGLID

SEQ ID NO: 1666591 - protein, 24 aa, Staphylococcus aureus
EMRELSYAGFIVFHDEALQPLYKD

SEQ ID NO: 1666592 - protein, 23 aa, Staphylococcus aureus
EMRVIKDICNRVAVMEKGKVVET

SEQ ID NO: 1666593 - protein, 23 aa, Staphylococcus aureus
EMSLPLMWEFPGGKIEKNETEKD

SEQ ID NO: 1666594 - protein, 22 aa, Staphylococcus aureus
EMVKSMKKGSVLIDIAIDQGGT

SEQ ID NO: 1666595 - protein, 21 aa, Staphylococcus aureus
EMWFRNFSYFIHKIDSEFILE

SEQ ID NO: 1666596 - protein, 25 aa, Staphylococcus aureus
ENALNGDANLQCAKTEATQAIDNLT

SEQ ID NO: 1666597 - protein, 31 aa, Staphylococcus aureus
ENCNFLVFFGYNFNSSFLKYGELALLNSLIE

SEQ ID NO: 1666598 - protein, 18 aa, Staphylococcus aureus
ENDGIIIYLNFKDVNYQL

SEQ ID NO: 1666599 - protein, 19 aa, Staphylococcus aureus
ENDGIIIYLNFKDVNYQLI

SEQ ID NO: 1666600 - protein, 23 aa, Staphylococcus aureus
ENDILKQAALILASHPVIVDDIP

SEQ ID NO: 1666601 - protein, 24 aa, Staphylococcus aureus
ENDIPWRIPKDWEYVKNTTKGHPI

SEQ ID NO: 1666602 - protein, 24 aa, Staphylococcus aureus
ENDQWKPLFKRKAKNDFSNKWKEK

SEQ ID NO: 1666603 - protein, 25 aa, Staphylococcus aureus
ENDQWKPLFKRKAKNDFSNKWKEKV

SEQ ID NO: 1666604 - protein, 25 aa, Staphylococcus aureus
ENEIKNWEFPFVIKPGDDLPAAGGY

SEQ ID NO: 1666605 - protein, 21 aa, Staphylococcus aureus
ENEKRYPVKMVDNKVIPTKEI

SEQ ID NO: 1666606 - protein, 19 aa, Staphylococcus aureus
ENELEALSSYLVSLDQHRE

SEQ ID NO: 1666607 - protein, 19 aa, Staphylococcus aureus
ENELKRPPVSNIDTLVIVM

SEQ ID NO: 1666608 - protein, 24 aa, Staphylococcus aureus
ENELLRYPYIESFEDVDEVIQVAK

SEQ ID NO: 1666609 - protein, 31 aa, Staphylococcus aureus
ENEWKNYFHPFRASKNFTIVPSWETYAKEAD

SEQ ID NO: 1666610 - protein, 17 aa, Staphylococcus aureus
ENFVKYIKENAGPSWKY

SEQ ID NO: 1666611 - protein, 18 aa, Staphylococcus aureus
ENGEALEISQLLKEGSSG

SEQ ID NO: 1666612 - protein, 20 aa, Staphylococcus aureus
ENGGDVFVHFSGIASDGYKT

SEQ ID NO: 1666613 - protein, 22 aa, Staphylococcus aureus
ENGYLFVFVIDYYRHHLVDQHA

SEQ ID NO: 1666614 - protein, 23 aa, Staphylococcus aureus
ENIGESMHQIFKAVRDLADEYKD

SEQ ID NO: 1666615 - protein, 23 aa, Staphylococcus aureus
ENIKEAKDLMAQMNKRVKSIEDT

SEQ ID NO: 1666616 - protein, 19 aa, Staphylococcus aureus
ENIKKFMHYLLRAQERYQM

SEQ ID NO: 1666617 - protein, 22 aa, Staphylococcus aureus
ENILPTRFVEHSPLAHLTLETY

SEQ ID NO: 1666618 - protein, 21 aa, Staphylococcus aureus
ENINCRCKLMYYIDEDDLPST

SEQ ID NO: 1666619 - protein, 24 aa, Staphylococcus aureus
ENINIPAQIFVEFDAASLGLGILL

SEQ ID NO: 1666620 - protein, 22 aa, Staphylococcus aureus
ENIVFWSGWNKITMFALIELIK

SEQ ID NO: 1666621 - protein, 22 aa, Staphylococcus aureus
ENIVFWSGWNKITMLALIELVK

SEQ ID NO: 1666622 - protein, 17 aa, Staphylococcus aureus
ENKDYGYIILPIVIPAG

SEQ ID NO: 1666623 - protein, 18 aa, Staphylococcus aureus
ENKGCPWDKVQTHETLKR

SEQ ID NO: 1666624 - protein, 23 aa, Staphylococcus aureus
ENLGRLGETVAFLSASGQDSEWE

SEQ ID NO: 1666625 - protein, 24 aa, Staphylococcus aureus
ENLKKYKHFMFFGNDIVLKNGKGH

SEQ ID NO: 1666626 - protein, 19 aa, Staphylococcus aureus
ENLKTFGVEKIFTEKQSGK

SEQ ID NO: 1666627 - protein, 35 aa, Staphylococcus aureus
ENLPENFSQVFRPKAFKYSNGEIVFNEDYPEEKDD

SEQ ID NO: 1666628 - protein, 18 aa, Staphylococcus aureus
ENLSTFKPFEKVLNLKEV

SEQ ID NO: 1666629 - protein, 23 aa, Staphylococcus aureus
ENLSVESCELLPVIDDPTFTIDE

SEQ ID NO: 1666630 - protein, 25 aa, Staphylococcus aureus
ENMNAWLKPYRRALNLEEPVVKITE

SEQ ID NO: 1666631 - protein, 19 aa, Staphylococcus aureus
ENNKVLVFFVRYGGEFQLK

SEQ ID NO: 1666632 - protein, 17 aa, Staphylococcus aureus
ENNRAKIIVPFSKTNIT

SEQ ID NO: 1666633 - protein, 21 aa, Staphylococcus aureus
ENPHAHLLCTLRGLDKNNEFE

SEQ ID NO: 1666634 - protein, 23 aa, Staphylococcus aureus
ENPHAHLLCTLRGLDKNNEFEPK

SEQ ID NO: 1666635 - protein, 20 aa, Staphylococcus aureus
ENPLDGFVITGYINNDKTNT

SEQ ID NO: 1666636 - protein, 28 aa, Staphylococcus aureus
ENQEGRRVFVTEVMCDSVQFLEPKNAQQ

SEQ ID NO: 1666637 - protein, 24 aa, Staphylococcus aureus
ENQEGRRVFVTEVVCDSVQFLEPK

SEQ ID NO: 1666638 - protein, 24 aa, Staphylococcus aureus
ENQEIWPEVELVYPNKKVDYYVEK

SEQ ID NO: 1666639 - protein, 19 aa, Staphylococcus aureus
ENQKYGAFHGKEMFKQAIV

SEQ ID NO: 1666640 - protein, 24 aa, Staphylococcus aureus
ENQWNAKFIDRGYIFTNTAGSPID

SEQ ID NO: 1666641 - protein, 17 aa, Staphylococcus aureus
ENRTILYTSHYIEEVER

SEQ ID NO: 1666642 - protein, 18 aa, Staphylococcus aureus
ENTEVLKFASGAQVNDRL

SEQ ID NO: 1666643 - protein, 28 aa, Staphylococcus aureus
ENVIFIGLLCKHGHWHAVIYDIAQGKTA

SEQ ID NO: 1666644 - protein, 23 aa, Staphylococcus aureus
ENVPDYFKAIVAIGTIADLVSLT

SEQ ID NO: 1666645 - protein, 24 aa, Staphylococcus aureus
ENVSRLSKYYGHTIGYISQNYAES

SEQ ID NO: 1666646 - protein, 19 aa, Staphylococcus aureus
ENVYKDKKKLLNTDIKTKF

SEQ ID NO: 1666647 - protein, 26 aa, Staphylococcus aureus
EPARELVEGLKLVTEFVQDENATQED

SEQ ID NO: 1666648 - protein, 20 aa, Staphylococcus aureus
EPDLHFTIIDFNQELLCIYI

SEQ ID NO: 1666649 - protein, 24 aa, Staphylococcus aureus
EPDQLRKCFKMTLNGLEDALNFID

SEQ ID NO: 1666650 - protein, 19 aa, Staphylococcus aureus
EPDYLFEEKELLKKHKHNH

SEQ ID NO: 1666651 - protein, 20 aa, Staphylococcus aureus
EPELRHEIQLYKEKMRKAEM

SEQ ID NO: 1666652 - protein, 26 aa, Staphylococcus aureus
EPERFWPADLVLLSIGFEGTEPTVPN

SEQ ID NO: 1666653 - protein, 17 aa, Staphylococcus aureus
EPGQKAKIEVVFKNTGT

SEQ ID NO: 1666654 - protein, 27 aa, Staphylococcus aureus
EPGTIVPLNGLRIMGKFGDSVTTDHIS

SEQ ID NO: 1666655 - protein, 17 aa, Staphylococcus aureus
EPLHSSFIMSKMALAAY

SEQ ID NO: 1666656 - protein, 24 aa, Staphylococcus aureus
EPLRKMEAPMFKKILKKHQLFDDA

SEQ ID NO: 1666657 - protein, 17 aa, Staphylococcus aureus
EPMSMYEAGEWIQFYAI

SEQ ID NO: 1666658 - protein, 30 aa, Staphylococcus aureus
EPQTLKLFKVCKMRGIPIFTFINKLDRVGK

SEQ ID NO: 1666659 - protein, 27 aa, Staphylococcus aureus
EPRIYSSHPNRIEWEPQFSQSTILALI

SEQ ID NO: 1666660 - protein, 19 aa, Staphylococcus aureus
EPTKLYVKPVLALKKEVSI

SEQ ID NO: 1666661 - protein, 18 aa, Staphylococcus aureus
EPVINKKATAREQLTTLF

SEQ ID NO: 1666662 - protein, 26 aa, Staphylococcus aureus
EPVPELVEGLKLVTEFVQDENATQED

SEQ ID NO: 1666663 - protein, 23 aa, Staphylococcus aureus
EPWLNRRIRQLILKRWKKIKTKY

SEQ ID NO: 1666664 - protein, 24 aa, Staphylococcus aureus
EPWLNRRIRQLILKRWKKIKTKYK

SEQ ID NO: 1666665 - protein, 20 aa, Staphylococcus aureus
EPWTSCEFDFTSEGKLKVSF

SEQ ID NO: 1666666 - protein, 20 aa, Staphylococcus aureus
EPYIRRRAIRHLEKKRIVIF

SEQ ID NO: 1666667 - protein, 20 aa, Staphylococcus aureus
EQAEAIVMLQLYRLTNTDIV

SEQ ID NO: 1666668 - protein, 23 aa, Staphylococcus aureus
EQFGLSVMVAFGYGQQDPPKNKT

SEQ ID NO: 1666669 - protein, 23 aa, Staphylococcus aureus
EQFGLSVMVAFGYRQQDPPKNKT

SEQ ID NO: 1666670 - protein, 21 aa, Staphylococcus aureus
EQFKDAYAKFYGLSSEQIIAG

SEQ ID NO: 1666671 - protein, 26 aa, Staphylococcus aureus
EQGKYFVRLSYVKVWNKGDEVVNKPE

SEQ ID NO: 1666672 - protein, 17 aa, Staphylococcus aureus
EQIDVFFEKIIDIHLSD

SEQ ID NO: 1666673 - protein, 19 aa, Staphylococcus aureus
EQKDRLLAQYGIVTTEDED

SEQ ID NO: 1666674 - protein, 20 aa, Staphylococcus aureus
EQLDQAMERLINGIQDKDQV

SEQ ID NO: 1666675 - protein, 19 aa, Staphylococcus aureus
EQLIIKVDQMFGWKSIKGY

SEQ ID NO: 1666676 - protein, 17 aa, Staphylococcus aureus
EQLKIRYIEQFGLSNSL

SEQ ID NO: 1666677 - protein, 24 aa, Staphylococcus aureus
EQLKSVVIAYEPIWAIGTGKSSTS

SEQ ID NO: 1666678 - protein, 17 aa, Staphylococcus aureus
EQLLKPLFQHFKEKYLE

SEQ ID NO: 1666679 - protein, 27 aa, Staphylococcus aureus
EQLNVSGFLTWAVGHLVELQEPQEYDE

SEQ ID NO: 1666680 - protein, 17 aa, Staphylococcus aureus
EQLRDEFHFAKRRSTEA

SEQ ID NO: 1666681 - protein, 24 aa, Staphylococcus aureus
EQMAQCFKQSLGATEEQMLYFGLP

SEQ ID NO: 1666682 - protein, 19 aa, Staphylococcus aureus
EQNIPLVDYMFCTYNTDLY

SEQ ID NO: 1666683 - protein, 22 aa, Staphylococcus aureus
EQPEYIQSLTFHSAFETLQQHL

SEQ ID NO: 1666684 - protein, 28 aa, Staphylococcus aureus
EQPGIFGSPIKWNFTKFIIDRQANVVNR

SEQ ID NO: 1666685 - protein, 38 aa, Staphylococcus aureus
EQQFKCHIDTIIKKQVPVCCFTFGIPSESIIKRLKEAN

SEQ ID NO: 1666686 - protein, 38 aa, Staphylococcus aureus
EQQFKCHINTIIKKQVPVCCFTFGIPNESIIKRLKEAN

SEQ ID NO: 1666687 - protein, 27 aa, Staphylococcus aureus
EQQRVALIRMMLKDPIVMLADEPTGAL

SEQ ID NO: 1666688 - protein, 29 aa, Staphylococcus aureus
EQQRVALIRMMLKDPIVMLADEPTGALDP

SEQ ID NO: 1666689 - protein, 26 aa, Staphylococcus aureus
EQRISIEVSDDAKAWLGQEAYEPQYG

SEQ ID NO: 1666690 - protein, 19 aa, Staphylococcus aureus
EQRRKLIIATEEMKARRNK

SEQ ID NO: 1666691 - protein, 28 aa, Staphylococcus aureus
EQVINMFSFFIGYHFNKLDLGIERIFIQ

SEQ ID NO: 1666692 - protein, 25 aa, Staphylococcus aureus
EQVPRLEMLEDYYLNRNTDILTDNR

SEQ ID NO: 1666693 - protein, 19 aa, Staphylococcus aureus
EQYCQFNGYELVDIYADRG

SEQ ID NO: 1666694 - protein, 20 aa, Staphylococcus aureus
EQYDKIILYSGNMGQLQDME

SEQ ID NO: 1666695 - protein, 20 aa, Staphylococcus aureus
ERAGLGFVGRNGFVINPKLG

SEQ ID NO: 1666696 - protein, 24 aa, Staphylococcus aureus
ERARRMQFFLSQNFHVAEQFTGQK

SEQ ID NO: 1666697 - protein, 19 aa, Staphylococcus aureus
ERDALRTYLNQVYDIERLV

SEQ ID NO: 1666698 - protein, 24 aa, Staphylococcus aureus
EREADFINCVTFRKQAENVNNYLS

SEQ ID NO: 1666699 - protein, 25 aa, Staphylococcus aureus
ERGISDLDLKFAKQAKYTVYFKNGK

SEQ ID NO: 1666700 - protein, 22 aa, Staphylococcus aureus
ERHPRQCVFVGTTNNYEFLKDQ

SEQ ID NO: 1666701 - protein, 27 aa, Staphylococcus aureus
ERIEKASNLKLAITAGVGSDHVDLAAA

SEQ ID NO: 1666702 - protein, 17 aa, Staphylococcus aureus
ERIKKELIVSSLMINKR

SEQ ID NO: 1666703 - protein, 21 aa, Staphylococcus aureus
ERIKPGDIVPIYLKKNPNFKF

SEQ ID NO: 1666704 - protein, 21 aa, Staphylococcus aureus
ERIKPGDIVSIYLKKNPNFKF

SEQ ID NO: 1666705 - protein, 20 aa, Staphylococcus aureus
ERILYYTGRIHKIGETHEGA

SEQ ID NO: 1666706 - protein, 21 aa, Staphylococcus aureus
ERKGLKLVGGKLMQVPMELAE

SEQ ID NO: 1666707 - protein, 28 aa, Staphylococcus aureus
ERKMTAMLRYQFKVILSALKRKGYNMDD

SEQ ID NO: 1666708 - protein, 21 aa, Staphylococcus aureus
ERKSIPLKNSFGIWGDGNLGY

SEQ ID NO: 1666709 - protein, 24 aa, Staphylococcus aureus
ERKSIPLKTSFGIWGDGNLGYITA

SEQ ID NO: 1666710 - protein, 18 aa, Staphylococcus aureus
ERLEYLIDYMWRERNDND

SEQ ID NO: 1666711 - protein, 17 aa, Staphylococcus aureus
ERLFKKGLMKRYKLLFH

SEQ ID NO: 1666712 - protein, 21 aa, Staphylococcus aureus
ERLGSFLLKALLQLKHPSIKE

SEQ ID NO: 1666713 - protein, 17 aa, Staphylococcus aureus
ERLKAYCDRSYHMKDGV

SEQ ID NO: 1666714 - protein, 17 aa, Staphylococcus aureus
ERLKLQHIIGSKVGKIY

SEQ ID NO: 1666715 - protein, 18 aa, Staphylococcus aureus
ERLLHAIFGEKAREVRDT

SEQ ID NO: 1666716 - protein, 26 aa, Staphylococcus aureus
ERLNNRKSEALQRLDQLTHLNNAQRQ

SEQ ID NO: 1666717 - protein, 18 aa, Staphylococcus aureus
ERLYYLGQEGVVFKDEDD

SEQ ID NO: 1666718 - protein, 19 aa, Staphylococcus aureus
ERSAVSIGRRVQDPLSELV

SEQ ID NO: 1666719 - protein, 18 aa, Staphylococcus aureus
ERVANVFQIPSVFLNAKS

SEQ ID NO: 1666720 - protein, 19 aa, Staphylococcus aureus
ERVHLKFLSSLPVGGLGLD

SEQ ID NO: 1666721 - protein, 32 aa, Staphylococcus aureus
ERVKEYYLNIMYGEYDLFYGFIENDEDFLNNV

SEQ ID NO: 1666722 - protein, 17 aa, Staphylococcus aureus
ERVRGLFQFYGAGTGRW

SEQ ID NO: 1666723 - protein, 21 aa, Staphylococcus aureus
ERWLRRVINSLVYDYGYPIGC

SEQ ID NO: 1666724 - protein, 20 aa, Staphylococcus aureus
ESALKGNDKLVLAKELQHLC

SEQ ID NO: 1666725 - protein, 22 aa, Staphylococcus aureus
ESATESFLKFSHITGSDGVQAV

SEQ ID NO: 1666726 - protein, 19 aa, Staphylococcus aureus
ESCVIRIAPQFFQQQKSTY

SEQ ID NO: 1666727 - protein, 22 aa, Staphylococcus aureus
ESDEVILAWGAYAKKPVVEARV

SEQ ID NO: 1666728 - protein, 17 aa, Staphylococcus aureus
ESDLKIAFNINDIETTY

SEQ ID NO: 1666729 - protein, 25 aa, Staphylococcus aureus
ESDLKRFKGAHGLLYEQELGLQATI

SEQ ID NO: 1666730 - protein, 25 aa, Staphylococcus aureus
ESDLKRFKSAHGLLYEQELGLQATI

SEQ ID NO: 1666731 - protein, 17 aa, Staphylococcus aureus
ESDRGTGVLNFSVTKNN

SEQ ID NO: 1666732 - protein, 25 aa, Staphylococcus aureus
ESEEMRRKYPLFVSHLETFKYVTLD

SEQ ID NO: 1666733 - protein, 19 aa, Staphylococcus aureus
ESEIAFVVLHFGGSIKNQG

SEQ ID NO: 1666734 - protein, 21 aa, Staphylococcus aureus
ESELKICRDLITEFETLSKYN

SEQ ID NO: 1666735 - protein, 20 aa, Staphylococcus aureus
ESELKLCRNLITEFETLSKY

SEQ ID NO: 1666736 - protein, 18 aa, Staphylococcus aureus
ESENIMAVPAVFLNGEEF

SEQ ID NO: 1666737 - protein, 24 aa, Staphylococcus aureus
ESESLSDPVSLVESESESLAESES

SEQ ID NO: 1666738 - protein, 23 aa, Staphylococcus aureus
ESETSESFKDCGIKLTEKDLVVD

SEQ ID NO: 1666739 - protein, 24 aa, Staphylococcus aureus
ESFDVILSSLAFHYVADYENLIKK

SEQ ID NO: 1666740 - protein, 19 aa, Staphylococcus aureus
ESFHKSSVIDIKKINIKLR

SEQ ID NO: 1666741 - protein, 20 aa, Staphylococcus aureus
ESGHHFDAILFLKEDTTLQN

SEQ ID NO: 1666742 - protein, 22 aa, Staphylococcus aureus
ESGNKLENIWFIDWSSTALNNS

SEQ ID NO: 1666743 - protein, 18 aa, Staphylococcus aureus
ESGNYRLLTENDFHKLNY

SEQ ID NO: 1666744 - protein, 20 aa, Staphylococcus aureus
ESGQKAVLIPGDIRDEQFNY

SEQ ID NO: 1666745 - protein, 19 aa, Staphylococcus aureus
ESINEVFEKQAEIFFDKNY

SEQ ID NO: 1666746 - protein, 17 aa, Staphylococcus aureus
ESKGQNVLLEYVSANPT

SEQ ID NO: 1666747 - protein, 18 aa, Staphylococcus aureus
ESKISFIDKTRVLFNDIN

SEQ ID NO: 1666748 - protein, 19 aa, Staphylococcus aureus
ESKISFIDKTRVLFNDINK

SEQ ID NO: 1666749 - protein, 18 aa, Staphylococcus aureus
ESKISMTGYSIINKNTST

SEQ ID NO: 1666750 - protein, 30 aa, Staphylococcus aureus
ESKYGEVIYRMGFGQAVSRGILTDYKVMVL

SEQ ID NO: 1666751 - protein, 25 aa, Staphylococcus aureus
ESLEPWTSCEFDFTKKSKLKVSFDY

SEQ ID NO: 1666752 - protein, 17 aa, Staphylococcus aureus
ESLGFIFQDYSILPTLT

SEQ ID NO: 1666753 - protein, 24 aa, Staphylococcus aureus
ESLKFPTKYLLKNNDILFAMSGGT

SEQ ID NO: 1666754 - protein, 32 aa, Staphylococcus aureus
ESLKIGDRVSVAWMFESCGRCEYCTTGRETLC

SEQ ID NO: 1666755 - protein, 19 aa, Staphylococcus aureus
ESLMRQFDFEAVDKQHITT

SEQ ID NO: 1666756 - protein, 21 aa, Staphylococcus aureus
ESLSDPVSLVESESESLAESE

SEQ ID NO: 1666757 - protein, 22 aa, Staphylococcus aureus
ESLVGAKFVKLFTDIDLNVDEV

SEQ ID NO: 1666758 - protein, 26 aa, Staphylococcus aureus
ESMKIQSSRLMLGFKNKPLQEAPQKY

SEQ ID NO: 1666759 - protein, 18 aa, Staphylococcus aureus
ESMLIPLIARAKEYENEK

SEQ ID NO: 1666760 - protein, 19 aa, Staphylococcus aureus
ESQIKWLKSHDAKFLTLKE

SEQ ID NO: 1666761 - protein, 20 aa, Staphylococcus aureus
ESQLSLISITTFFVNVDPIC

SEQ ID NO: 1666762 - protein, 25 aa, Staphylococcus aureus
ESREKELLKYFPSDYKKPEEKTSDT

SEQ ID NO: 1666763 - protein, 20 aa, Staphylococcus aureus
ESRKRYSPNSTYKIYLAMFG

SEQ ID NO: 1666764 - protein, 27 aa, Staphylococcus aureus
ESSCVSCGQCATVCPCNAMMEVNMEGN

SEQ ID NO: 1666765 - protein, 18 aa, Staphylococcus aureus
ESSIRKAFKNILPKEKTY

SEQ ID NO: 1666766 - protein, 17 aa, Staphylococcus aureus
ESSMKYINEHGGMIIYL

SEQ ID NO: 1666767 - protein, 18 aa, Staphylococcus aureus
ESTNMWKNLKATKEGHIV

SEQ ID NO: 1666768 - protein, 22 aa, Staphylococcus aureus
ESTRYPNIFMIGATVENDNAKL

SEQ ID NO: 1666769 - protein, 28 aa, Staphylococcus aureus
ESVECYEIYHPLESVGIYVPGGKASYPS

SEQ ID NO: 1666770 - protein, 19 aa, Staphylococcus aureus
ESVKLLFNVDCEVKFAEGY

SEQ ID NO: 1666771 - protein, 21 aa, Staphylococcus aureus
ESVPETVKIVITRQHGLMYVT

SEQ ID NO: 1666772 - protein, 18 aa, Staphylococcus aureus
ESYYKNALAIKRFFIALD

SEQ ID NO: 1666773 - protein, 18 aa, Staphylococcus aureus
ETAFPLLYTYFVKNGDWT

SEQ ID NO: 1666774 - protein, 22 aa, Staphylococcus aureus
ETAIPLLLGLGLDEFSMSATSI

SEQ ID NO: 1666775 - protein, 24 aa, Staphylococcus aureus
ETALKAGITLFQFREKGESALKGN

SEQ ID NO: 1666776 - protein, 24 aa, Staphylococcus aureus
ETALPEFYERVSFAPEMSDPSMIQ

SEQ ID NO: 1666777 - protein, 17 aa, Staphylococcus aureus
ETCHAIFEATHGTAPKY

SEQ ID NO: 1666778 - protein, 17 aa, Staphylococcus aureus
ETCPISANAYDQFNKFL

SEQ ID NO: 1666779 - protein, 23 aa, Staphylococcus aureus
ETGCYECLERQLVSKFPGKIENY

SEQ ID NO: 1666780 - protein, 23 aa, Staphylococcus aureus
ETHRTNFVAVRFGNVLGSRGSVI

SEQ ID NO: 1666781 - protein, 24 aa, Staphylococcus aureus
ETHRTNFVAVRFGNVLGSRGSVIP

SEQ ID NO: 1666782 - protein, 26 aa, Staphylococcus aureus
ETIAKRLGIEMKDVMAIGDNLNDVSM

SEQ ID NO: 1666783 - protein, 21 aa, Staphylococcus aureus
ETIEYATPVSHFVKDELWDKC

SEQ ID NO: 1666784 - protein, 24 aa, Staphylococcus aureus
ETIKDFGADVNIGLHIVTDKDPHY

SEQ ID NO: 1666785 - protein, 17 aa, Staphylococcus aureus
ETIKNTFDSASTFGRKI

SEQ ID NO: 1666786 - protein, 32 aa, Staphylococcus aureus
ETIKYDGAYCINGYRWITYIANSGQRRYIATG

SEQ ID NO: 1666787 - protein, 19 aa, Staphylococcus aureus
ETISRRISNLIKFGYLKIE

SEQ ID NO: 1666788 - protein, 19 aa, Staphylococcus aureus
ETISRRISNLTNFGYLKIE

SEQ ID NO: 1666789 - protein, 18 aa, Staphylococcus aureus
ETITEGIPPVGYNSKYGP

SEQ ID NO: 1666790 - protein, 23 aa, Staphylococcus aureus
ETKISMVTAYDFPSAKQVEAAGI

SEQ ID NO: 1666791 - protein, 26 aa, Staphylococcus aureus
ETKKELLLLLMRLMKVKVKGYGEIIF

SEQ ID NO: 1666792 - protein, 28 aa, Staphylococcus aureus
ETKKSVSKEVKYQKTIELLKHQSELSSL

SEQ ID NO: 1666793 - protein, 25 aa, Staphylococcus aureus
ETLEEARALLIEAINSGAALEKFKI

SEQ ID NO: 1666794 - protein, 19 aa, Staphylococcus aureus
ETLELTSLLGNISRLDNGH

SEQ ID NO: 1666795 - protein, 25 aa, Staphylococcus aureus
ETMGHFDAIVGRRVLMYLPDAEKCL

SEQ ID NO: 1666796 - protein, 18 aa, Staphylococcus aureus
ETPIGRNGIKATFKGLGK

SEQ ID NO: 1666797 - protein, 17 aa, Staphylococcus aureus
ETPRIRLYIPLNERISA

SEQ ID NO: 1666798 - protein, 20 aa, Staphylococcus aureus
ETRTKIQLLAPVIAHRKGSH

SEQ ID NO: 1666799 - protein, 20 aa, Staphylococcus aureus
ETRTKIQLLAPVISHRKGSH

SEQ ID NO: 1666800 - protein, 20 aa, Staphylococcus aureus
ETSYFKKTVNPFDHKAVPGG

SEQ ID NO: 1666801 - protein, 17 aa, Staphylococcus aureus
ETTRTAVKQDLTEAQAL

SEQ ID NO: 1666802 - protein, 17 aa, Staphylococcus aureus
ETTRTAVKQDLTEVQAL

SEQ ID NO: 1666803 - protein, 20 aa, Staphylococcus aureus
ETVHTQGLLEICDRIIDQYD

SEQ ID NO: 1666804 - protein, 31 aa, Staphylococcus aureus
ETVKAEGFNHVIARHYAIRNALRSALKALDL

SEQ ID NO: 1666805 - protein, 18 aa, Staphylococcus aureus
ETYEIMTPQLVGVSMTEL

SEQ ID NO: 1666806 - protein, 17 aa, Staphylococcus aureus
ETYGYRKITALINQCYT

SEQ ID NO: 1666807 - protein, 24 aa, Staphylococcus aureus
ETYIKRDILKRENIKEVTTKTTIR

SEQ ID NO: 1666808 - protein, 20 aa, Staphylococcus aureus
ETYVKGSVVGFFTPELFHGI

SEQ ID NO: 1666809 - protein, 22 aa, Staphylococcus aureus
EVACLNKHLHFHGTTDEFKSLD

SEQ ID NO: 1666810 - protein, 23 aa, Staphylococcus aureus
EVADELYHLFVLMHALGVDFSEI

SEQ ID NO: 1666811 - protein, 25 aa, Staphylococcus aureus
EVAEACLKLGVDMINDQWAGLYDHR

SEQ ID NO: 1666812 - protein, 24 aa, Staphylococcus aureus
EVARLDYISKLGFSYADMEKRGII

SEQ ID NO: 1666813 - protein, 21 aa, Staphylococcus aureus
EVAVNWCPALGTVLSNEEVID

SEQ ID NO: 1666814 - protein, 18 aa, Staphylococcus aureus
EVDKFNWYHILRKIESYA

SEQ ID NO: 1666815 - protein, 20 aa, Staphylococcus aureus
EVDKFNWYQILRKIESYADI

SEQ ID NO: 1666816 - protein, 25 aa, Staphylococcus aureus
EVEAIQGFIYRRAREHNLDTPYLDT

SEQ ID NO: 1666817 - protein, 23 aa, Staphylococcus aureus
EVEELYSELDLIVGEVQDKSDKK

SEQ ID NO: 1666818 - protein, 27 aa, Staphylococcus aureus
EVEKLIYRPIREMYIPIPNSKKFHESN

SEQ ID NO: 1666819 - protein, 19 aa, Staphylococcus aureus
EVERVTSHVVIRGLHPNEF

SEQ ID NO: 1666820 - protein, 20 aa, Staphylococcus aureus
EVESVICGPAIQLDALTTAV

SEQ ID NO: 1666821 - protein, 17 aa, Staphylococcus aureus
EVFEMMNCFKFSFINEN

SEQ ID NO: 1666822 - protein, 23 aa, Staphylococcus aureus
EVFEMMNCFKFSFINENKELILD

SEQ ID NO: 1666823 - protein, 17 aa, Staphylococcus aureus
EVFREPFVEFFYKNDAL

SEQ ID NO: 1666824 - protein, 17 aa, Staphylococcus aureus
EVGKLVVFLASDDSSFI

SEQ ID NO: 1666825 - protein, 24 aa, Staphylococcus aureus
EVHAGDYCGYSFAFEVTKNNTKLA

SEQ ID NO: 1666826 - protein, 20 aa, Staphylococcus aureus
EVHVASEFVYNMPLLSEKPL

SEQ ID NO: 1666827 - protein, 17 aa, Staphylococcus aureus
EVIDVWFDSGSMPFAQH

SEQ ID NO: 1666828 - protein, 22 aa, Staphylococcus aureus
EVIKQKPTVRWLFLTITVKNVY

SEQ ID NO: 1666829 - protein, 20 aa, Staphylococcus aureus
EVKAKGMFILTKKDDNTYEC

SEQ ID NO: 1666830 - protein, 23 aa, Staphylococcus aureus
EVKKCRTSYTYFSYTYSSDIDSN

SEQ ID NO: 1666831 - protein, 17 aa, Staphylococcus aureus
EVKRKAKAFDEIDNLMN

SEQ ID NO: 1666832 - protein, 17 aa, Staphylococcus aureus
EVKTLRILHFVSGDGGK

SEQ ID NO: 1666833 - protein, 25 aa, Staphylococcus aureus
EVLDPSLPIDLIIDYAHTADGMNEL

SEQ ID NO: 1666834 - protein, 25 aa, Staphylococcus aureus
EVLIKIIPSYHALIVRSQTTVTENI

SEQ ID NO: 1666835 - protein, 25 aa, Staphylococcus aureus
EVLSLNYLPSLKFDYAQNEAARLEE

SEQ ID NO: 1666836 - protein, 25 aa, Staphylococcus aureus
EVLTFKAIQACKQYSVQRLIVAGGV

SEQ ID NO: 1666837 - protein, 20 aa, Staphylococcus aureus
EVLVSLKYLLIGGEVLNAKW

SEQ ID NO: 1666838 - protein, 19 aa, Staphylococcus aureus
EVNGETFYSRVIKTLESTN

SEQ ID NO: 1666839 - protein, 32 aa, Staphylococcus aureus
EVPDWYLDSCLKIKYMFPKAHAAAYVLMAVRI

SEQ ID NO: 1666840 - protein, 23 aa, Staphylococcus aureus
EVQDLLIPLTFHFSKDEQLVIDQ

SEQ ID NO: 1666841 - protein, 19 aa, Staphylococcus aureus
EVRNAFTPKTVAEMIDAFS

SEQ ID NO: 1666842 - protein, 19 aa, Staphylococcus aureus
EVRNAFTPKTVSEMIDAFS

SEQ ID NO: 1666843 - protein, 32 aa, Staphylococcus aureus
EVRPERRTTLGLRWLVNYARLRGEKTMEDRLA

SEQ ID NO: 1666844 - protein, 19 aa, Staphylococcus aureus
EVSIKFRINDNLEQYEQIG

SEQ ID NO: 1666845 - protein, 26 aa, Staphylococcus aureus
EVSSGGYFVWLVFKIDIDIKYLFYEL

SEQ ID NO: 1666846 - protein, 22 aa, Staphylococcus aureus
EVTAATFACFGYGWHIDVGIHA

SEQ ID NO: 1666847 - protein, 18 aa, Staphylococcus aureus
EVTAFAFGIATAEEIDEF

SEQ ID NO: 1666848 - protein, 30 aa, Staphylococcus aureus
EVTGSGVFMEWSCSFVIKSDDLKDCKRKAK

SEQ ID NO: 1666849 - protein, 25 aa, Staphylococcus aureus
EVTLPKLHSVYFVHVMHTLTEQFVK

SEQ ID NO: 1666850 - protein, 26 aa, Staphylococcus aureus
EVVRKSALERYEFTGDIAYLNKGETS

SEQ ID NO: 1666851 - protein, 26 aa, Staphylococcus aureus
EVYDPRKYLGPAHEAIKETVKGKIKE

SEQ ID NO: 1666852 - protein, 27 aa, Staphylococcus aureus
EVYKPYIEGFVKMLAPIAPHIGEELWS

SEQ ID NO: 1666853 - protein, 20 aa, Staphylococcus aureus
EWEERRFADIFKFHNKLRKP

SEQ ID NO: 1666854 - protein, 26 aa, Staphylococcus aureus
EWGECASRIVSIYRYISKLQEHYQFH

SEQ ID NO: 1666855 - protein, 31 aa, Staphylococcus aureus
EWMLDFRLKSLKLFYKMPMPQWGGNLSELNF

SEQ ID NO: 1666856 - protein, 17 aa, Staphylococcus aureus
EYATFVKTVRIVLMHDW

SEQ ID NO: 1666857 - protein, 26 aa, Staphylococcus aureus
EYAVFKKPMIFYAFDLEYYITTRDFY

SEQ ID NO: 1666858 - protein, 29 aa, Staphylococcus aureus
EYDYYPTMFYKRGKKSFVIHIKKDGSRFQ

SEQ ID NO: 1666859 - protein, 24 aa, Staphylococcus aureus
EYIVNGKSAIEWIMDQYQLKTDKK

SEQ ID NO: 1666860 - protein, 28 aa, Staphylococcus aureus
EYKDLVVSVRVGMEMDRSELLRKTCRCA

SEQ ID NO: 1666861 - protein, 25 aa, Staphylococcus aureus
EYKDVVFIYPMHRNLKVRAIAEKYL

SEQ ID NO: 1666862 - protein, 22 aa, Staphylococcus aureus
EYKGGKCFFYYAKLIYTPEVCP

SEQ ID NO: 1666863 - protein, 30 aa, Staphylococcus aureus
EYKRIKSIIAKKSIPIQWVIGDYEKVKESF

SEQ ID NO: 1666864 - protein, 25 aa, Staphylococcus aureus
EYLKQHNIHVIPLSLTIDGKSYTDQ

SEQ ID NO: 1666865 - protein, 21 aa, Staphylococcus aureus
EYPQFLYENVMSKISSRDGED

SEQ ID NO: 1666866 - protein, 26 aa, Staphylococcus aureus
EYQYFKKDQIIWGFLHLASSKEIVEK

SEQ ID NO: 1666867 - protein, 19 aa, Staphylococcus aureus
EYRKYYEPLIHKKDKEFKE

SEQ ID NO: 1666868 - protein, 26 aa, Staphylococcus aureus
EYVVLRLYGPGTWYGKDGMIYNQFMD

SEQ ID NO: 1666869 - protein, 19 aa, Staphylococcus aureus
FAAFAEFERNLILERSSAG

SEQ ID NO: 1666870 - protein, 25 aa, Staphylococcus aureus
FAAGDARRGQSLVVWVIKEGRGVAK

SEQ ID NO: 1666871 - protein, 17 aa, Staphylococcus aureus
FACSSPELLMMHTLAQT

SEQ ID NO: 1666872 - protein, 17 aa, Staphylococcus aureus
FAFFKQHVTDFDIPGEG

SEQ ID NO: 1666873 - protein, 18 aa, Staphylococcus aureus
FAGNRADSIAVQFKEIKE

SEQ ID NO: 1666874 - protein, 28 aa, Staphylococcus aureus
FAHLQMAAKHWLCINEDDLVWATAAPGW

SEQ ID NO: 1666875 - protein, 24 aa, Staphylococcus aureus
FAINQYIKYCRWQNSVLEPTLSAI

SEQ ID NO: 1666876 - protein, 18 aa, Staphylococcus aureus
FAKNKGWTSPAKAIMGGA

SEQ ID NO: 1666877 - protein, 19 aa, Staphylococcus aureus
FAMSPKDLKLIESIPQMMD

SEQ ID NO: 1666878 - protein, 18 aa, Staphylococcus aureus
FASLSLKSELAYKIIDSD

SEQ ID NO: 1666879 - protein, 35 aa, Staphylococcus aureus
FASNLANMNFLRWVNFPQDYTVTWTNAKIANRPTD

SEQ ID NO: 1666880 - protein, 22 aa, Staphylococcus aureus
FATGLPTHLCSVAIPHTDVEHI

SEQ ID NO: 1666881 - protein, 25 aa, Staphylococcus aureus
FCDEMAEAGIYKWHIDIQSGTCTYI

SEQ ID NO: 1666882 - protein, 26 aa, Staphylococcus aureus
FCSNNRWLQRYDLISERNHFNYIRNG

SEQ ID NO: 1666883 - protein, 17 aa, Staphylococcus aureus
FCSTCTRARLSSDGKFY

SEQ ID NO: 1666884 - protein, 18 aa, Staphylococcus aureus
FCTAIRYIIARDYESRGY

SEQ ID NO: 1666885 - protein, 18 aa, Staphylococcus aureus
FDAAYQLAKNGSDIALYT

SEQ ID NO: 1666886 - protein, 22 aa, Staphylococcus aureus
FDARRQAVYTGMFQWQNGQLVT

SEQ ID NO: 1666887 - protein, 20 aa, Staphylococcus aureus
FDAYTIKALFEKWFHPKDAS

SEQ ID NO: 1666888 - protein, 21 aa, Staphylococcus aureus
FDAYTTKALFEKWFHPKDAST

SEQ ID NO: 1666889 - protein, 17 aa, Staphylococcus aureus
FDCYAYRLASVDLGSEI

SEQ ID NO: 1666890 - protein, 18 aa, Staphylococcus aureus
FDDACHVMNTIAPEHASI

SEQ ID NO: 1666891 - protein, 19 aa, Staphylococcus aureus
FDDAKRLANTLLNSDNTNV

SEQ ID NO: 1666892 - protein, 18 aa, Staphylococcus aureus
FDDLRVPNKLTIKDIDKI

SEQ ID NO: 1666893 - protein, 23 aa, Staphylococcus aureus
FDDPAGKPWSEFQRVRDEIKIAI

SEQ ID NO: 1666894 - protein, 17 aa, Staphylococcus aureus
FDEAHCISKWGHDFRPS

SEQ ID NO: 1666895 - protein, 24 aa, Staphylococcus aureus
FDEFMYPTFFSYEAIVGEKTKIFI

SEQ ID NO: 1666896 - protein, 29 aa, Staphylococcus aureus
FDFNKGFKFSTYATWWIRQAITRAIADQA

SEQ ID NO: 1666897 - protein, 21 aa, Staphylococcus aureus
FDFPKALRKEEIVGSIENDEI

SEQ ID NO: 1666898 - protein, 28 aa, Staphylococcus aureus
FDFQAKGIKCVMIAKLPFMNKHNAKYWL

SEQ ID NO: 1666899 - protein, 21 aa, Staphylococcus aureus
FDFRGEQPFTNYVQCLITSVK

SEQ ID NO: 1666900 - protein, 23 aa, Staphylococcus aureus
FDGKTKLVYIKSIQDLTESVKEE

SEQ ID NO: 1666901 - protein, 18 aa, Staphylococcus aureus
FDGNKFKFYEFALFLYEE

SEQ ID NO: 1666902 - protein, 18 aa, Staphylococcus aureus
FDGTGPFKLGEHKKDESA

SEQ ID NO: 1666903 - protein, 19 aa, Staphylococcus aureus
FDGTGPFKLGEHKKDESAD

SEQ ID NO: 1666904 - protein, 24 aa, Staphylococcus aureus
FDHEFKLSVLEGKAVVIGDDVPVG

SEQ ID NO: 1666905 - protein, 17 aa, Staphylococcus aureus
FDHLNICREMLLLMLAW

SEQ ID NO: 1666906 - protein, 19 aa, Staphylococcus aureus
FDHPIWQRFGSYTGGLNFN

SEQ ID NO: 1666907 - protein, 17 aa, Staphylococcus aureus
FDIAGGTADVYDKKYAF

SEQ ID NO: 1666908 - protein, 17 aa, Staphylococcus aureus
FDICGEGSEKTRLRKII

SEQ ID NO: 1666909 - protein, 18 aa, Staphylococcus aureus
FDIMLASYIIDPSRTISD

SEQ ID NO: 1666910 - protein, 17 aa, Staphylococcus aureus
FDIPLVVRNDYLSHNGF

SEQ ID NO: 1666911 - protein, 17 aa, Staphylococcus aureus
FDKNINFYNILRHSSST

SEQ ID NO: 1666912 - protein, 20 aa, Staphylococcus aureus
FDKRAQLIECLEKKGFEMIQ

SEQ ID NO: 1666913 - protein, 25 aa, Staphylococcus aureus
FDLAHELGHLVLHRHIQFDLLSPEE

SEQ ID NO: 1666914 - protein, 24 aa, Staphylococcus aureus
FDLGHFRGAIRPNITRFRDLPDWI

SEQ ID NO: 1666915 - protein, 22 aa, Staphylococcus aureus
FDNPAGKPWSEFQRVRDEIKIA

SEQ ID NO: 1666916 - protein, 20 aa, Staphylococcus aureus
FDRDTNWLSVLPIYHISGLS

SEQ ID NO: 1666917 - protein, 23 aa, Staphylococcus aureus
FDRIDVEGPFYIKNDITNTITRV

SEQ ID NO: 1666918 - protein, 19 aa, Staphylococcus aureus
FDRKRAKQLIKDVGLGHYQ

SEQ ID NO: 1666919 - protein, 17 aa, Staphylococcus aureus
FDSADIQARLKVGDKVE

SEQ ID NO: 1666920 - protein, 25 aa, Staphylococcus aureus
FDSKTKLVYIKSIQDLTESVKEEVE

SEQ ID NO: 1666921 - protein, 17 aa, Staphylococcus aureus
FDSTGLLNINYQPKHLV

SEQ ID NO: 1666922 - protein, 20 aa, Staphylococcus aureus
FDTNGGYSLNFNNLDQSKNY

SEQ ID NO: 1666923 - protein, 26 aa, Staphylococcus aureus
FDVDVPRTDWDWMIYPQGLYDQIMRV

SEQ ID NO: 1666924 - protein, 31 aa, Staphylococcus aureus
FDVEMPIVMPRLRITYLNDRIEKILSKYNIP

SEQ ID NO: 1666925 - protein, 29 aa, Staphylococcus aureus
FDVEMPIVMPRLRITYLNDRIEKLLSKYN

SEQ ID NO: 1666926 - protein, 22 aa, Staphylococcus aureus
FDVKNIFTISNFVKIHKAPKQF

SEQ ID NO: 1666927 - protein, 19 aa, Staphylococcus aureus
FDYIKSLRKLTTKDIEVGG

SEQ ID NO: 1666928 - protein, 17 aa, Staphylococcus aureus
FDYVDWIKLSLGPLARE

SEQ ID NO: 1666929 - protein, 19 aa, Staphylococcus aureus
FDYYKNRWGLFGYCRFIPY

SEQ ID NO: 1666930 - protein, 24 aa, Staphylococcus aureus
FDYYKNRWGLFGYCRFIPYLKKKV

SEQ ID NO: 1666931 - protein, 19 aa, Staphylococcus aureus
FEALKKKAREMGATTKFSA

SEQ ID NO: 1666932 - protein, 18 aa, Staphylococcus aureus
FEAYYVGGSVRDYVMGRN

SEQ ID NO: 1666933 - protein, 25 aa, Staphylococcus aureus
FEDIARVFLKVTLSFMQYGALPELH

SEQ ID NO: 1666934 - protein, 21 aa, Staphylococcus aureus
FEDYFLIVSDLIHYAKMNDVM

SEQ ID NO: 1666935 - protein, 18 aa, Staphylococcus aureus
FEEHLSAYGIKYNDKTHE

SEQ ID NO: 1666936 - protein, 19 aa, Staphylococcus aureus
FEELVKIYLQNEPVYKNLY

SEQ ID NO: 1666937 - protein, 18 aa, Staphylococcus aureus
FEERLKVVLKEVKESDGR

SEQ ID NO: 1666938 - protein, 18 aa, Staphylococcus aureus
FEFFSRDILEDFKGVDKN

SEQ ID NO: 1666939 - protein, 19 aa, Staphylococcus aureus
FEFTHPLAQLIGKREAPPL

SEQ ID NO: 1666940 - protein, 18 aa, Staphylococcus aureus
FEGTILFVSHDRYFINQL

SEQ ID NO: 1666941 - protein, 24 aa, Staphylococcus aureus
FEHKGKMAFRVYPKWCNQLNKTAG

SEQ ID NO: 1666942 - protein, 17 aa, Staphylococcus aureus
FEHSHIYCLAPFAESVK

SEQ ID NO: 1666943 - protein, 24 aa, Staphylococcus aureus
FEIKDIRIIKSILLKGKKSFNNTH

SEQ ID NO: 1666944 - protein, 18 aa, Staphylococcus aureus
FEIKPKYDLNIMKSGQTL

SEQ ID NO: 1666945 - protein, 19 aa, Staphylococcus aureus
FEIYEPRFGAIFESKANVE

SEQ ID NO: 1666946 - protein, 31 aa, Staphylococcus aureus
FEKARELFDGMAIPTSEDWKKLQQDVEQYGL

SEQ ID NO: 1666947 - protein, 21 aa, Staphylococcus aureus
FEKDGPRIIALEPQDDNRDGV

SEQ ID NO: 1666948 - protein, 18 aa, Staphylococcus aureus
FEKRINLLKDYQVNQQMF

SEQ ID NO: 1666949 - protein, 19 aa, Staphylococcus aureus
FEKRVTFGLTGSDANDGII

SEQ ID NO: 1666950 - protein, 24 aa, Staphylococcus aureus
FELDGDLPLFPGHGPYTTVDDEQL

SEQ ID NO: 1666951 - protein, 17 aa, Staphylococcus aureus
FELLDEIEETLNIETYP

SEQ ID NO: 1666952 - protein, 17 aa, Staphylococcus aureus
FELLKKQFIGEFISSLN

SEQ ID NO: 1666953 - protein, 18 aa, Staphylococcus aureus
FELQPKFGKQRPITYIAD

SEQ ID NO: 1666954 - protein, 20 aa, Staphylococcus aureus
FELRKKLFLKLQRIKNNAFY

SEQ ID NO: 1666955 - protein, 21 aa, Staphylococcus aureus
FEMMNCFKFSFINENKELILD

SEQ ID NO: 1666956 - protein, 17 aa, Staphylococcus aureus
FENQLPWHLPNDLKHVK

SEQ ID NO: 1666957 - protein, 18 aa, Staphylococcus aureus
FENQLPWHLPNDLKHVKE

SEQ ID NO: 1666958 - protein, 20 aa, Staphylococcus aureus
FENQLPWHLPNDLKYVKKLS

SEQ ID NO: 1666959 - protein, 24 aa, Staphylococcus aureus
FEPKRKGNKFVRDWNTDEKHNEWR

SEQ ID NO: 1666960 - protein, 19 aa, Staphylococcus aureus
FESANEWMNFYGADIAHAN

SEQ ID NO: 1666961 - protein, 21 aa, Staphylococcus aureus
FESSFGISLEFDSLNLDINDN

SEQ ID NO: 1666962 - protein, 19 aa, Staphylococcus aureus
FETFCDEMAQAGIYKWHID

SEQ ID NO: 1666963 - protein, 23 aa, Staphylococcus aureus
FETFKIALFDPAVKKYAFNANFE

SEQ ID NO: 1666964 - protein, 23 aa, Staphylococcus aureus
FETNKWINAYECYFKNMLGIKCE

SEQ ID NO: 1666965 - protein, 38 aa, Staphylococcus aureus
FEVDGKQLYAWCALDTLMFPALIGRTVHIASPCHGTGK

SEQ ID NO: 1666966 - protein, 19 aa, Staphylococcus aureus
FEVNSDFSAKVAFENEEAY

SEQ ID NO: 1666967 - protein, 17 aa, Staphylococcus aureus
FEVPHQWQHNAYSEIPL

SEQ ID NO: 1666968 - protein, 17 aa, Staphylococcus aureus
FEYKDARNYLSYLYSNH

SEQ ID NO: 1666969 - protein, 24 aa, Staphylococcus aureus
FEYLSRKSIRVIIYKGNNRIETLK

SEQ ID NO: 1666970 - protein, 25 aa, Staphylococcus aureus
FEYTESAVTQVRYVDVTTGKDIIPP

SEQ ID NO: 1666971 - protein, 18 aa, Staphylococcus aureus
FFELLRFINEKSPQAIFI

SEQ ID NO: 1666972 - protein, 17 aa, Staphylococcus aureus
FFGSALANFGVQNFLNA

SEQ ID NO: 1666973 - protein, 17 aa, Staphylococcus aureus
FFHLKKGNTVLFTSDSR

SEQ ID NO: 1666974 - protein, 21 aa, Staphylococcus aureus
FFNKYRFVIYEYIKKWNQINK

SEQ ID NO: 1666975 - protein, 17 aa, Staphylococcus aureus
FFVQYGNFKDFKDYKNG

SEQ ID NO: 1666976 - protein, 19 aa, Staphylococcus aureus
FGCLDPIVFLNGIEANEML

SEQ ID NO: 1666977 - protein, 20 aa, Staphylococcus aureus
FGDSRIVGLIGKNGVGKTTV

SEQ ID NO: 1666978 - protein, 18 aa, Staphylococcus aureus
FGEIKKFFANISQGSLTK

SEQ ID NO: 1666979 - protein, 17 aa, Staphylococcus aureus
FGGPLYTFHKIFSIITL

SEQ ID NO: 1666980 - protein, 17 aa, Staphylococcus aureus
FGIDFAERAIKNEDIVN

SEQ ID NO: 1666981 - protein, 21 aa, Staphylococcus aureus
FGIEVKDYFIDLDLLQLINSV

SEQ ID NO: 1666982 - protein, 24 aa, Staphylococcus aureus
FGISGPAALRCSQFVYKEKKIKRH

SEQ ID NO: 1666983 - protein, 19 aa, Staphylococcus aureus
FGIWPEKEYAINWVEKIKD

SEQ ID NO: 1666984 - protein, 18 aa, Staphylococcus aureus
FGKTKAFAEVNGETFYSR

SEQ ID NO: 1666985 - protein, 21 aa, Staphylococcus aureus
FGLNKRQGRQLLAYLGVPKEL

SEQ ID NO: 1666986 - protein, 26 aa, Staphylococcus aureus
FGNYELRLPLVSLEDTDTKVLREAYD

SEQ ID NO: 1666987 - protein, 29 aa, Staphylococcus aureus
FGTFEYTESAVTQVRYVDVTTGKDIIPPK

SEQ ID NO: 1666988 - protein, 24 aa, Staphylococcus aureus
FGTMKHKKLENGRIPVSKPSEKVE

SEQ ID NO: 1666989 - protein, 17 aa, Staphylococcus aureus
FGVCHFAVAAKPETTNY

SEQ ID NO: 1666990 - protein, 18 aa, Staphylococcus aureus
FGVHFIKGGMYGMAQGLA

SEQ ID NO: 1666991 - protein, 24 aa, Staphylococcus aureus
FGVLKRQQIFYAYDLDKYGDELRG

SEQ ID NO: 1666992 - protein, 17 aa, Staphylococcus aureus
FHEGVDFPFVYQEVRTP

SEQ ID NO: 1666993 - protein, 26 aa, Staphylococcus aureus
FHKKSLPIPKYRYFKLNNNKIQKMLY

SEQ ID NO: 1666994 - protein, 24 aa, Staphylococcus aureus
FHSECGWPSFSKALDDEEIIELVD

SEQ ID NO: 1666995 - protein, 18 aa, Staphylococcus aureus
FHSLIKIKLPETLSKELL

SEQ ID NO: 1666996 - protein, 18 aa, Staphylococcus aureus
FHTVLPLNRNFLSAFTQQ

SEQ ID NO: 1666997 - protein, 24 aa, Staphylococcus aureus
FHYFKEAHPYFDQDVVIIGGKNSA

SEQ ID NO: 1666998 - protein, 24 aa, Staphylococcus aureus
FIAASLEAPIYVLSNIAGVLINDV

SEQ ID NO: 1666999 - protein, 23 aa, Staphylococcus aureus
FICPNNKRIGLKRYAYRNDRYGF

SEQ ID NO: 1667000 - protein, 18 aa, Staphylococcus aureus
FIDREYHGEYLFEGNDYQ

SEQ ID NO: 1667001 - protein, 17 aa, Staphylococcus aureus
FIDSRTTIFPILGGGER

SEQ ID NO: 1667002 - protein, 19 aa, Staphylococcus aureus
FIDVEHAFGISIDEDNDMI

SEQ ID NO: 1667003 - protein, 18 aa, Staphylococcus aureus
FIEGRVVSWIIDDITWSG

SEQ ID NO: 1667004 - protein, 17 aa, Staphylococcus aureus
FIFKAIFNTTKFFHLKK

SEQ ID NO: 1667005 - protein, 18 aa, Staphylococcus aureus
FIGPNCGFYTATHPLNFY

SEQ ID NO: 1667006 - protein, 19 aa, Staphylococcus aureus
FIHQYPLAVVHVMRDQCSM

SEQ ID NO: 1667007 - protein, 17 aa, Staphylococcus aureus
FIICTAPLTKETHHNFN

SEQ ID NO: 1667008 - protein, 17 aa, Staphylococcus aureus
FIIGRRQLTKGIDLEGR

SEQ ID NO: 1667009 - protein, 19 aa, Staphylococcus aureus
FIKDKVIDIMNMFQNHADI

SEQ ID NO: 1667010 - protein, 19 aa, Staphylococcus aureus
FIKSNRLKGLSLKDVELSV

SEQ ID NO: 1667011 - protein, 21 aa, Staphylococcus aureus
FIKYGDDFIEAAFDIISNTIV

SEQ ID NO: 1667012 - protein, 18 aa, Staphylococcus aureus
FILHGSIEKYKFKNSKAT

SEQ ID NO: 1667013 - protein, 21 aa, Staphylococcus aureus
FILRGIKLIGIDSVYVDHNIR

SEQ ID NO: 1667014 - protein, 25 aa, Staphylococcus aureus
FIPLKSLRQLEIISGEYNDVINEKV

SEQ ID NO: 1667015 - protein, 24 aa, Staphylococcus aureus
FIQAYLNYQVKGWKRYAASSRKDP

SEQ ID NO: 1667016 - protein, 17 aa, Staphylococcus aureus
FIQEIKKKYSSIKITKA

SEQ ID NO: 1667017 - protein, 18 aa, Staphylococcus aureus
FIQFRLAGRSENKYLEKI

SEQ ID NO: 1667018 - protein, 26 aa, Staphylococcus aureus
FIQNPPHGATVAWHDNPDTWKNTVGN

SEQ ID NO: 1667019 - protein, 17 aa, Staphylococcus aureus
FITGHSLGGRDTMILGM

SEQ ID NO: 1667020 - protein, 17 aa, Staphylococcus aureus
FIVPMPHRIFDFYNAFI

SEQ ID NO: 1667021 - protein, 17 aa, Staphylococcus aureus
FKADHQYQIVIGPGTVD

SEQ ID NO: 1667022 - protein, 17 aa, Staphylococcus aureus
FKAEGPILNPDTRYDSH

SEQ ID NO: 1667023 - protein, 19 aa, Staphylococcus aureus
FKANGVLFIDAQFEPLRKM

SEQ ID NO: 1667024 - protein, 21 aa, Staphylococcus aureus
FKATQPRNWRSARIAVTPNKA

SEQ ID NO: 1667025 - protein, 20 aa, Staphylococcus aureus
FKDRSIGISTNRDSWVYSFS

SEQ ID NO: 1667026 - protein, 26 aa, Staphylococcus aureus
FKEETIEAGYEWQFKLNYRTTEIPYA

SEQ ID NO: 1667027 - protein, 20 aa, Staphylococcus aureus
FKEKYLEVISKIDDVVLGNV

SEQ ID NO: 1667028 - protein, 22 aa, Staphylococcus aureus
FKELKRRILGIVFDLPEGQTFT

SEQ ID NO: 1667029 - protein, 27 aa, Staphylococcus aureus
FKELVDLFNKRYDIIIVDTPPVNTVTD

SEQ ID NO: 1667030 - protein, 22 aa, Staphylococcus aureus
FKETSLDFFVIEDFSYSPRLVN

SEQ ID NO: 1667031 - protein, 21 aa, Staphylococcus aureus
FKFFSQYGSFRGLKNYKDGDY

SEQ ID NO: 1667032 - protein, 17 aa, Staphylococcus aureus
FKFIAGVGPNNFTDISA

SEQ ID NO: 1667033 - protein, 18 aa, Staphylococcus aureus
FKFIAGVGPNNFTDISAT

SEQ ID NO: 1667034 - protein, 18 aa, Staphylococcus aureus
FKGGHALESDTTFSSIGA

SEQ ID NO: 1667035 - protein, 17 aa, Staphylococcus aureus
FKGINAQALEASVLSTC

SEQ ID NO: 1667036 - protein, 31 aa, Staphylococcus aureus
FKGKRVLDLGCGYGWHCIYAMENGASSVVGV

SEQ ID NO: 1667037 - protein, 19 aa, Staphylococcus aureus
FKIINWLFSNYKRLDEETA

SEQ ID NO: 1667038 - protein, 20 aa, Staphylococcus aureus
FKIQASRVDKVNGFQAMAVS

SEQ ID NO: 1667039 - protein, 19 aa, Staphylococcus aureus
FKIQCVILICYYYDNLQNY

SEQ ID NO: 1667040 - protein, 21 aa, Staphylococcus aureus
FKIRQHLVKNYGLYKGTTKYG

SEQ ID NO: 1667041 - protein, 23 aa, Staphylococcus aureus
FKIYIKNKVRPLAVFKIEETADG

SEQ ID NO: 1667042 - protein, 24 aa, Staphylococcus aureus
FKKAAPKAKIVYVGADEKNLISSM

SEQ ID NO: 1667043 - protein, 21 aa, Staphylococcus aureus
FKKEFKPVMHLKGDAFNQQLQ

SEQ ID NO: 1667044 - protein, 21 aa, Staphylococcus aureus
FKKEFKPVMHLKGDALNQQLQ

SEQ ID NO: 1667045 - protein, 18 aa, Staphylococcus aureus
FKKGIIRWDSCVRISEER

SEQ ID NO: 1667046 - protein, 30 aa, Staphylococcus aureus
FKKPENFKGANAISALGFPIEYKHIGNTKS

SEQ ID NO: 1667047 - protein, 25 aa, Staphylococcus aureus
FKKVIKLNELEGWIHNISNLIRTKI

SEQ ID NO: 1667048 - protein, 17 aa, Staphylococcus aureus
FKLDTYHNTSKPNAAAK

SEQ ID NO: 1667049 - protein, 17 aa, Staphylococcus aureus
FKLKPDCHCTSKYLNNL

SEQ ID NO: 1667050 - protein, 24 aa, Staphylococcus aureus
FKLLKRRILGIGFVLPEGQVFTFH

SEQ ID NO: 1667051 - protein, 19 aa, Staphylococcus aureus
FKLMFKDGEIIDFSSGKGE

SEQ ID NO: 1667052 - protein, 20 aa, Staphylococcus aureus
FKLNDLMSEFNISRSTALRD

SEQ ID NO: 1667053 - protein, 22 aa, Staphylococcus aureus
FKLQAMDTMTSFWIPQLGGQKY

SEQ ID NO: 1667054 - protein, 17 aa, Staphylococcus aureus
FKLSRHTGLIAEEVEEL

SEQ ID NO: 1667055 - protein, 20 aa, Staphylococcus aureus
FKNDEWHISAFNKFKQFQDS

SEQ ID NO: 1667056 - protein, 25 aa, Staphylococcus aureus
FKNKNLRLAIAQAIDKKGYVDSVKN

SEQ ID NO: 1667057 - protein, 19 aa, Staphylococcus aureus
FKNKPLYRATFKCTVIQST

SEQ ID NO: 1667058 - protein, 25 aa, Staphylococcus aureus
FKNPSRILGSFFIKHHGYRVRIDDI

SEQ ID NO: 1667059 - protein, 25 aa, Staphylococcus aureus
FKNPSRVLGSFFIKHHGYRVRIDDI

SEQ ID NO: 1667060 - protein, 19 aa, Staphylococcus aureus
FKNQLLFTKHNLRGIEFPG

SEQ ID NO: 1667061 - protein, 25 aa, Staphylococcus aureus
FKNRIWGGHALKAFNYDIPNETTGE

SEQ ID NO: 1667062 - protein, 22 aa, Staphylococcus aureus
FKNTGTYMFHCHILEHEDNGMM

SEQ ID NO: 1667063 - protein, 26 aa, Staphylococcus aureus
FKPEEYWIIEGEFRYKKSKFNAKFLH

SEQ ID NO: 1667064 - protein, 19 aa, Staphylococcus aureus
FKQLFRILEDTFARTLSPY

SEQ ID NO: 1667065 - protein, 20 aa, Staphylococcus aureus
FKQLFRLLEDTFARPLSPYE

SEQ ID NO: 1667066 - protein, 20 aa, Staphylococcus aureus
FKRADAIKVNGDIRKFDKIL

SEQ ID NO: 1667067 - protein, 26 aa, Staphylococcus aureus
FKRATVNATFGYKNDIPFRFYDENNP

SEQ ID NO: 1667068 - protein, 29 aa, Staphylococcus aureus
FKRIKVHGFRHTHCSLLFEAGLSIQEVQD

SEQ ID NO: 1667069 - protein, 30 aa, Staphylococcus aureus
FKRIKVHGFRHTHCSLLFEAGLSIQEVQDR

SEQ ID NO: 1667070 - protein, 17 aa, Staphylococcus aureus
FKSERLSLIEAEIEEIK

SEQ ID NO: 1667071 - protein, 18 aa, Staphylococcus aureus
FKSIGEKEFKEWKNNISN

SEQ ID NO: 1667072 - protein, 26 aa, Staphylococcus aureus
FKSKILEELPHLSVEIMDNTKELVEK

SEQ ID NO: 1667073 - protein, 20 aa, Staphylococcus aureus
FKSKILPKLGRIPIKEISRV

SEQ ID NO: 1667074 - protein, 19 aa, Staphylococcus aureus
FKSKLNIPSVRFVGESNQK

SEQ ID NO: 1667075 - protein, 21 aa, Staphylococcus aureus
FKSVDFVNLYFLHFLSTARTF

SEQ ID NO: 1667076 - protein, 17 aa, Staphylococcus aureus
FKTELIKMNASYQTRLK

SEQ ID NO: 1667077 - protein, 17 aa, Staphylococcus aureus
FKTGYFSPLANLARLTE

SEQ ID NO: 1667078 - protein, 20 aa, Staphylococcus aureus
FKTKFLRTLASHYLTELLTS

SEQ ID NO: 1667079 - protein, 24 aa, Staphylococcus aureus
FKTTSKRLGIIFTPVEVVDFIIKS

SEQ ID NO: 1667080 - protein, 20 aa, Staphylococcus aureus
FKTTTIVFKFMAPLEYDTIT

SEQ ID NO: 1667081 - protein, 19 aa, Staphylococcus aureus
FKVATLVREYISAIVNIRI

SEQ ID NO: 1667082 - protein, 24 aa, Staphylococcus aureus
FKVIKEALTLNGYFIKWKVLNAKD

SEQ ID NO: 1667083 - protein, 25 aa, Staphylococcus aureus
FKVKIKKIEAAYKMSQNRNEQDYNN

SEQ ID NO: 1667084 - protein, 19 aa, Staphylococcus aureus
FKVTILLRNMTCHRYVRFY

SEQ ID NO: 1667085 - protein, 17 aa, Staphylococcus aureus
FKYKFGMNNKVVIKLSC

SEQ ID NO: 1667086 - protein, 20 aa, Staphylococcus aureus
FKYSNGEIVFNENYSEEKDD

SEQ ID NO: 1667087 - protein, 22 aa, Staphylococcus aureus
FLEDLNQPFIYIGKDTVKLQDD

SEQ ID NO: 1667088 - protein, 19 aa, Staphylococcus aureus
FLERSYKDKFILNIRDYFF

SEQ ID NO: 1667089 - protein, 21 aa, Staphylococcus aureus
FLFPRELLIEKGILTTFEHKG

SEQ ID NO: 1667090 - protein, 19 aa, Staphylococcus aureus
FLFPRELLVEKGILASSKY

SEQ ID NO: 1667091 - protein, 19 aa, Staphylococcus aureus
FLFPRELLVEKGILTTFEH

SEQ ID NO: 1667092 - protein, 24 aa, Staphylococcus aureus
FLGRTVRCYRAFFGGNNAGHTIQF

SEQ ID NO: 1667093 - protein, 17 aa, Staphylococcus aureus
FLHHGFTDVEAKNIVGH

SEQ ID NO: 1667094 - protein, 24 aa, Staphylococcus aureus
FLHRYDLYETKYWSVFDEIQGFIH

SEQ ID NO: 1667095 - protein, 17 aa, Staphylococcus aureus
FLIPGLPGTSSFSPVGN

SEQ ID NO: 1667096 - protein, 17 aa, Staphylococcus aureus
FLKSDRDDFNFVKYNLY

SEQ ID NO: 1667097 - protein, 23 aa, Staphylococcus aureus
FLNELFYLIELYLKAFKGQKKTG

SEQ ID NO: 1667098 - protein, 23 aa, Staphylococcus aureus
FLNKTLERKAVWDKWMEQDKNNN

SEQ ID NO: 1667099 - protein, 19 aa, Staphylococcus aureus
FLNLMMYTMYFKNIIKKHL

SEQ ID NO: 1667100 - protein, 17 aa, Staphylococcus aureus
FLRYDCEVKGNIFESSH

SEQ ID NO: 1667101 - protein, 17 aa, Staphylococcus aureus
FLSQYADFKDLKNYQDG

SEQ ID NO: 1667102 - protein, 23 aa, Staphylococcus aureus
FLTDMLEGLLIVHPELDLIANTV

SEQ ID NO: 1667103 - protein, 24 aa, Staphylococcus aureus
FLTEAGIRIQLVKEVRLVGKDLDE

SEQ ID NO: 1667104 - protein, 17 aa, Staphylococcus aureus
FLYTCRQKIKVLDITYN

SEQ ID NO: 1667105 - protein, 25 aa, Staphylococcus aureus
FMIDACQKLRAEQLIKQYHPYETPV

SEQ ID NO: 1667106 - protein, 19 aa, Staphylococcus aureus
FMKAILGFTRMSVRGINKV

SEQ ID NO: 1667107 - protein, 20 aa, Staphylococcus aureus
FMKAILGFTRMSVRGINKVK

SEQ ID NO: 1667108 - protein, 19 aa, Staphylococcus aureus
FMKAILGFTRMSVRGLNKV

SEQ ID NO: 1667109 - protein, 17 aa, Staphylococcus aureus
FMLDAGLMFPEDEMLGI

SEQ ID NO: 1667110 - protein, 17 aa, Staphylococcus aureus
FMNANYMMRGKILTNEV

SEQ ID NO: 1667111 - protein, 19 aa, Staphylococcus aureus
FMNLRDLFKEEGLEPWTSC

SEQ ID NO: 1667112 - protein, 18 aa, Staphylococcus aureus
FMNLRDLFKKEDLEPWTS

SEQ ID NO: 1667113 - protein, 19 aa, Staphylococcus aureus
FMNVVPDYFIYKIALVGKD

SEQ ID NO: 1667114 - protein, 17 aa, Staphylococcus aureus
FMRDVITYIGLDQSRIV

SEQ ID NO: 1667115 - protein, 24 aa, Staphylococcus aureus
FMTIPEASRLVLQAGALAEGGEVF

SEQ ID NO: 1667116 - protein, 26 aa, Staphylococcus aureus
FMYYNLLSNMFWNWYNSNNQGASTIK

SEQ ID NO: 1667117 - protein, 38 aa, Staphylococcus aureus
FNADLWYGFQCFDYANAGWKVLFGLLLKGLGAKDIPFA

SEQ ID NO: 1667118 - protein, 18 aa, Staphylococcus aureus
FNAKLLAMICNRLNVRQG

SEQ ID NO: 1667119 - protein, 18 aa, Staphylococcus aureus
FNASEFLTSFDALHQLFI

SEQ ID NO: 1667120 - protein, 24 aa, Staphylococcus aureus
FNDGRHYGIDFGMPTGTNVYAVKG

SEQ ID NO: 1667121 - protein, 23 aa, Staphylococcus aureus
FNDYPVEVARLLDIVEIKVHALY

SEQ ID NO: 1667122 - protein, 19 aa, Staphylococcus aureus
FNEIIIATPAQWISHTQDI

SEQ ID NO: 1667123 - protein, 24 aa, Staphylococcus aureus
FNFDFKTKRFDNLELKEGNDISLT

SEQ ID NO: 1667124 - protein, 17 aa, Staphylococcus aureus
FNGFEFKVSVMKRHNGI

SEQ ID NO: 1667125 - protein, 17 aa, Staphylococcus aureus
FNGFIYVSNIIKQPTYI

SEQ ID NO: 1667126 - protein, 24 aa, Staphylococcus aureus
FNGKTKLVYIKSIQDLTESVKEEV

SEQ ID NO: 1667127 - protein, 17 aa, Staphylococcus aureus
FNGLKGQGVLLVNQIQN

SEQ ID NO: 1667128 - protein, 17 aa, Staphylococcus aureus
FNIDNKVCYQVFYDEKG

SEQ ID NO: 1667129 - protein, 17 aa, Staphylococcus aureus
FNKADYELVDFSVVEKL

SEQ ID NO: 1667130 - protein, 18 aa, Staphylococcus aureus
FNKEGSNQIQVTWGEKGV

SEQ ID NO: 1667131 - protein, 17 aa, Staphylococcus aureus
FNKKEFLSILSTSQLKE

SEQ ID NO: 1667132 - protein, 18 aa, Staphylococcus aureus
FNKVLKSVCIKIMNDDIK

SEQ ID NO: 1667133 - protein, 17 aa, Staphylococcus aureus
FNLPKDEKWECESIEEV

SEQ ID NO: 1667134 - protein, 27 aa, Staphylococcus aureus
FNLTKGRLQKDLINWFIDGQYKLFYKK

SEQ ID NO: 1667135 - protein, 28 aa, Staphylococcus aureus
FNLTKGRLQKDLINWFIVDQYKLFYKKQ

SEQ ID NO: 1667136 - protein, 25 aa, Staphylococcus aureus
FNMAEKILPLLHIIDIPKRVFAKLD

SEQ ID NO: 1667137 - protein, 26 aa, Staphylococcus aureus
FNNFKMGQKWTKSKFKQENKLKIHEY

SEQ ID NO: 1667138 - protein, 23 aa, Staphylococcus aureus
FNNIKRLNIETIKQENTSFIKED

SEQ ID NO: 1667139 - protein, 17 aa, Staphylococcus aureus
FNNLLSKQVDGIIFLGG

SEQ ID NO: 1667140 - protein, 24 aa, Staphylococcus aureus
FNNRIIRLQLPYNRNKCYKLSNLI

SEQ ID NO: 1667141 - protein, 19 aa, Staphylococcus aureus
FNPDAKNFKIYEVTDQNQF

SEQ ID NO: 1667142 - protein, 19 aa, Staphylococcus aureus
FNPDGWYGFQCYDYANMFF

SEQ ID NO: 1667143 - protein, 23 aa, Staphylococcus aureus
FNPDLFFGFQCYDYANMFFMLAT

SEQ ID NO: 1667144 - protein, 21 aa, Staphylococcus aureus
FNPDLFYGFQCYDYANMFFMI

SEQ ID NO: 1667145 - protein, 22 aa, Staphylococcus aureus
FNPDLFYGFQCYDYANMFFMLA

SEQ ID NO: 1667146 - protein, 19 aa, Staphylococcus aureus
FNQAIKLKIVLIHSKLSRT

SEQ ID NO: 1667147 - protein, 24 aa, Staphylococcus aureus
FNQELLCIYIDFDSGLRHSNMATE

SEQ ID NO: 1667148 - protein, 27 aa, Staphylococcus aureus
FNQGEVCSAGSRLLVHEKIYNQLVPRL

SEQ ID NO: 1667149 - protein, 17 aa, Staphylococcus aureus
FNQKEIIDFEFVIAKSF

SEQ ID NO: 1667150 - protein, 20 aa, Staphylococcus aureus
FNQPDEWDSPCNIYKPHSGF

SEQ ID NO: 1667151 - protein, 21 aa, Staphylococcus aureus
FNSEIKRLWFEEEPIKKINLD

SEQ ID NO: 1667152 - protein, 18 aa, Staphylococcus aureus
FNSLASFNTNINIIPMEN

SEQ ID NO: 1667153 - protein, 38 aa, Staphylococcus aureus
FNVDLWYGFQCFDYANAGWKVLFGLLLKGVGAKDIPFA

SEQ ID NO: 1667154 - protein, 17 aa, Staphylococcus aureus
FNVKAFIRSGVTDEELK

SEQ ID NO: 1667155 - protein, 28 aa, Staphylococcus aureus
FNVLQPSPFHWRLLDKITLSTLYEVVLP

SEQ ID NO: 1667156 - protein, 29 aa, Staphylococcus aureus
FNVLQPSPFHWRLLDKITLSTLYEVVLPI

SEQ ID NO: 1667157 - protein, 17 aa, Staphylococcus aureus
FNVLYPVLRPYLTSNAH

SEQ ID NO: 1667158 - protein, 25 aa, Staphylococcus aureus
FNYIRNGWCYGNTGVMTTLFLIGQA

SEQ ID NO: 1667159 - protein, 19 aa, Staphylococcus aureus
FNYLYIFNLRGDQRTQGEI

SEQ ID NO: 1667160 - protein, 25 aa, Staphylococcus aureus
FNYQNCVISLVAIRNYKKPNFKIYV

SEQ ID NO: 1667161 - protein, 25 aa, Staphylococcus aureus
FNYRCWTQGIFARWTDNPNIEDLIQ

SEQ ID NO: 1667162 - protein, 25 aa, Staphylococcus aureus
FPASKEELCIRVEFFGDEIDRIREV

SEQ ID NO: 1667163 - protein, 17 aa, Staphylococcus aureus
FPDKYRGMYEQPQANSV

SEQ ID NO: 1667164 - protein, 20 aa, Staphylococcus aureus
FPDYRRVLPKNPDKHLEAGC

SEQ ID NO: 1667165 - protein, 21 aa, Staphylococcus aureus
FPEGEYSKIYLFSSNLEKITA

SEQ ID NO: 1667166 - protein, 17 aa, Staphylococcus aureus
FPEKIDLKTGIKDIINF

SEQ ID NO: 1667167 - protein, 20 aa, Staphylococcus aureus
FPELSKSYINNFSYEEVKSI

SEQ ID NO: 1667168 - protein, 21 aa, Staphylococcus aureus
FPESEIAFIVLHFGGSIKNQG

SEQ ID NO: 1667169 - protein, 17 aa, Staphylococcus aureus
FPGIFRGALEAEATHIN

SEQ ID NO: 1667170 - protein, 21 aa, Staphylococcus aureus
FPHILRGVNILGIDSVFTAIK

SEQ ID NO: 1667171 - protein, 17 aa, Staphylococcus aureus
FPIPHISTGDMFRKAIK

SEQ ID NO: 1667172 - protein, 17 aa, Staphylococcus aureus
FPKQEEWIMTHENQFKS

SEQ ID NO: 1667173 - protein, 18 aa, Staphylococcus aureus
FPKVLRKEEIVGSIENDE

SEQ ID NO: 1667174 - protein, 26 aa, Staphylococcus aureus
FPLKHINLGGGIGFNYADLTSQFEWD

SEQ ID NO: 1667175 - protein, 25 aa, Staphylococcus aureus
FPLPKEFRDAGWFFDVLPGHYNGAV

SEQ ID NO: 1667176 - protein, 19 aa, Staphylococcus aureus
FPMCVEFRHQSWFSDAFKE

SEQ ID NO: 1667177 - protein, 19 aa, Staphylococcus aureus
FPMKQDIPVIMIGPGTGIA

SEQ ID NO: 1667178 - protein, 17 aa, Staphylococcus aureus
FPNATLHMAGRPTQFGI

SEQ ID NO: 1667179 - protein, 19 aa, Staphylococcus aureus
FPPHVSTLYVDDGPDAVDY

SEQ ID NO: 1667180 - protein, 21 aa, Staphylococcus aureus
FPQDYTVTWTNAKIANRPTDG

SEQ ID NO: 1667181 - protein, 24 aa, Staphylococcus aureus
FPSISNWICNGFKKTNSINTMGSR

SEQ ID NO: 1667182 - protein, 25 aa, Staphylococcus aureus
FPSSLGLEPWKFVVIQDQALRDELK

SEQ ID NO: 1667183 - protein, 23 aa, Staphylococcus aureus
FPTEHKGVAGWNLYVEASNTGGF

SEQ ID NO: 1667184 - protein, 22 aa, Staphylococcus aureus
FPVTVIEQAYWVFDQHINDRGI

SEQ ID NO: 1667185 - protein, 22 aa, Staphylococcus aureus
FPYSPRIGTPAVRMDDQIDEEI

SEQ ID NO: 1667186 - protein, 19 aa, Staphylococcus aureus
FPYYCEPKVEIGRFQNTAI

SEQ ID NO: 1667187 - protein, 18 aa, Staphylococcus aureus
FPYYYVYNDFSDHYPIKA

SEQ ID NO: 1667188 - protein, 19 aa, Staphylococcus aureus
FQALTPLYPDERIKLETET

SEQ ID NO: 1667189 - protein, 20 aa, Staphylococcus aureus
FQCGKSYTLIGKSGCGKSTL

SEQ ID NO: 1667190 - protein, 19 aa, Staphylococcus aureus
FQDYVKFLYGYEERISLSN

SEQ ID NO: 1667191 - protein, 25 aa, Staphylococcus aureus
FQECARLLKKWGLPANRNTIRLHNE

SEQ ID NO: 1667192 - protein, 19 aa, Staphylococcus aureus
FQHREPGVFGAAWLNDALH

SEQ ID NO: 1667193 - protein, 20 aa, Staphylococcus aureus
FQKAFPHYNIHALRHSYASY

SEQ ID NO: 1667194 - protein, 19 aa, Staphylococcus aureus
FQKEILQTMQVGERGPNIE

SEQ ID NO: 1667195 - protein, 20 aa, Staphylococcus aureus
FQKQLDHEVLIHTSLIVRED

SEQ ID NO: 1667196 - protein, 17 aa, Staphylococcus aureus
FQLGGFAPVSPISMNRI

SEQ ID NO: 1667197 - protein, 19 aa, Staphylococcus aureus
FQNLILLFLESWYLKASFS

SEQ ID NO: 1667198 - protein, 17 aa, Staphylococcus aureus
FQPPLVITYEQLDTALN

SEQ ID NO: 1667199 - protein, 17 aa, Staphylococcus aureus
FQQIEAIEVKKCDFKDD

SEQ ID NO: 1667200 - protein, 20 aa, Staphylococcus aureus
FRATLFRQTMFAEFEHKIHT

SEQ ID NO: 1667201 - protein, 18 aa, Staphylococcus aureus
FRDKRPFTFTNLKTDEGL

SEQ ID NO: 1667202 - protein, 17 aa, Staphylococcus aureus
FRGHSNLNWSLVPKAGR

SEQ ID NO: 1667203 - protein, 20 aa, Staphylococcus aureus
FRITEMNWEGAFKVNERTLK

SEQ ID NO: 1667204 - protein, 20 aa, Staphylococcus aureus
FRKEILQAMQVGVWGPTQKL

SEQ ID NO: 1667205 - protein, 17 aa, Staphylococcus aureus
FRKEILQTMQVGGAPNI

SEQ ID NO: 1667206 - protein, 21 aa, Staphylococcus aureus
FRKHLEGGIIESIKQIVNDRR

SEQ ID NO: 1667207 - protein, 28 aa, Staphylococcus aureus
FRKNDDYIWLGHSFVRQGFLDDVKLEPP

SEQ ID NO: 1667208 - protein, 29 aa, Staphylococcus aureus
FRKNDDYIWLGHSFVRQGFLDDVKLEPPI

SEQ ID NO: 1667209 - protein, 18 aa, Staphylococcus aureus
FRKQSFNTRQFIFKAIFN

SEQ ID NO: 1667210 - protein, 19 aa, Staphylococcus aureus
FRKVDFRDVDALKAAINEN

SEQ ID NO: 1667211 - protein, 17 aa, Staphylococcus aureus
FRLAGRSENKYLEKIIR

SEQ ID NO: 1667212 - protein, 21 aa, Staphylococcus aureus
FRLIENFKPASWIFLYLKTSI

SEQ ID NO: 1667213 - protein, 24 aa, Staphylococcus aureus
FRNFDMRPYFIIFDEVTAFTSTLD

SEQ ID NO: 1667214 - protein, 25 aa, Staphylococcus aureus
FRNQKVYNCMDWKHGFTNVQKMRSK

SEQ ID NO: 1667215 - protein, 25 aa, Staphylococcus aureus
FRPKAFKYSNGEIVFNEDYSEEKDD

SEQ ID NO: 1667216 - protein, 20 aa, Staphylococcus aureus
FRPKAFKYSNGEIVFNENYS

SEQ ID NO: 1667217 - protein, 32 aa, Staphylococcus aureus
FRQLFILPQGEFKRFLISNSREKQGILRTLFD

SEQ ID NO: 1667218 - protein, 17 aa, Staphylococcus aureus
FRSFSVIIQQIYALTTL

SEQ ID NO: 1667219 - protein, 17 aa, Staphylococcus aureus
FRTIPSYYRSLPGKLAR

SEQ ID NO: 1667220 - protein, 17 aa, Staphylococcus aureus
FRTRKFEGYGILSHQSI

SEQ ID NO: 1667221 - protein, 17 aa, Staphylococcus aureus
FRVAYGHYIEDFPRQCI

SEQ ID NO: 1667222 - protein, 24 aa, Staphylococcus aureus
FRYFTQRIAMNYNIVGTVQNVDDY

SEQ ID NO: 1667223 - protein, 25 aa, Staphylococcus aureus
FRYFTQRIAMNYNIVGTVQNVDDYV

SEQ ID NO: 1667224 - protein, 22 aa, Staphylococcus aureus
FSALSRPLIAKKLVEIAEKTNS

SEQ ID NO: 1667225 - protein, 18 aa, Staphylococcus aureus
FSDLHILQPDWKTIQRTA

SEQ ID NO: 1667226 - protein, 17 aa, Staphylococcus aureus
FSEKSNLIISERNGEGK

SEQ ID NO: 1667227 - protein, 21 aa, Staphylococcus aureus
FSEKYWLHILQGVWRPEKIST

SEQ ID NO: 1667228 - protein, 27 aa, Staphylococcus aureus
FSELFKSELKIAIGPVERGGAGGGIAA

SEQ ID NO: 1667229 - protein, 17 aa, Staphylococcus aureus
FSFNFPFSVEVQEESNN

SEQ ID NO: 1667230 - protein, 20 aa, Staphylococcus aureus
FSFSDLEIGLGEWITITGAN

SEQ ID NO: 1667231 - protein, 20 aa, Staphylococcus aureus
FSGLKKAISNWGKAGKDPRE

SEQ ID NO: 1667232 - protein, 22 aa, Staphylococcus aureus
FSHQNLYTWGQCTYHVFNRRAE

SEQ ID NO: 1667233 - protein, 25 aa, Staphylococcus aureus
FSHYLKVRPGAFFLTGCGNKSKGIT

SEQ ID NO: 1667234 - protein, 17 aa, Staphylococcus aureus
FSIEGVDELVPMLQRTI

SEQ ID NO: 1667235 - protein, 25 aa, Staphylococcus aureus
FSKEVALVMMVLRLNTLLKGHSGAT

SEQ ID NO: 1667236 - protein, 20 aa, Staphylococcus aureus
FSKINWSKLVNKLSVPIEAN

SEQ ID NO: 1667237 - protein, 21 aa, Staphylococcus aureus
FSKINWSKLVNKLSVPIEANY

SEQ ID NO: 1667238 - protein, 23 aa, Staphylococcus aureus
FSKKRANHALVIIANTIKGKGIP

SEQ ID NO: 1667239 - protein, 25 aa, Staphylococcus aureus
FSKLLNVLETYLFQWNLYIHEIDED

SEQ ID NO: 1667240 - protein, 21 aa, Staphylococcus aureus
FSKPKWSKLVNKLSVPIEANY

SEQ ID NO: 1667241 - protein, 17 aa, Staphylococcus aureus
FSLEKTRNIGIMAHIDA

SEQ ID NO: 1667242 - protein, 22 aa, Staphylococcus aureus
FSLNVFNLYGALSMANSGPNTN

SEQ ID NO: 1667243 - protein, 19 aa, Staphylococcus aureus
FSPELVDFSIYIIAVAQGE

SEQ ID NO: 1667244 - protein, 20 aa, Staphylococcus aureus
FSQECIKHSKAFSSKIVMKL

SEQ ID NO: 1667245 - protein, 23 aa, Staphylococcus aureus
FSQFKSKQILVGYFTISNKPLVF

SEQ ID NO: 1667246 - protein, 25 aa, Staphylococcus aureus
FSRGMRMKIALTIALSHDVKLLILD

SEQ ID NO: 1667247 - protein, 25 aa, Staphylococcus aureus
FSSDCFKLSAILSKLRIEYNQFIRI

SEQ ID NO: 1667248 - protein, 17 aa, Staphylococcus aureus
FSSDLIIIFKNVADEHR

SEQ ID NO: 1667249 - protein, 28 aa, Staphylococcus aureus
FSSKEDPELCVLRVIPQSIKLMNDKSLE

SEQ ID NO: 1667250 - protein, 19 aa, Staphylococcus aureus
FSSNLEKITAFRNELKQNH

SEQ ID NO: 1667251 - protein, 20 aa, Staphylococcus aureus
FSSNLEKITAFRYELKQNHV

SEQ ID NO: 1667252 - protein, 23 aa, Staphylococcus aureus
FSSSYKSLKSWTGDMYSRAHDRF

SEQ ID NO: 1667253 - protein, 21 aa, Staphylococcus aureus
FSTKQMIEFLGIESLKKHLKN

SEQ ID NO: 1667254 - protein, 19 aa, Staphylococcus aureus
FSYHFKKYLQMAPSDYCKQ

SEQ ID NO: 1667255 - protein, 17 aa, Staphylococcus aureus
FTANGLLSIGASPAMSE

SEQ ID NO: 1667256 - protein, 27 aa, Staphylococcus aureus
FTDFPKDFKGIAGWILEIKSNTPGNTT

SEQ ID NO: 1667257 - protein, 28 aa, Staphylococcus aureus
FTDFPKDYKGIAGWVLEVKSNTPGNTTQ

SEQ ID NO: 1667258 - protein, 17 aa, Staphylococcus aureus
FTDKYGVRWMLHGQDYT

SEQ ID NO: 1667259 - protein, 27 aa, Staphylococcus aureus
FTELFLFELRMQWLNRLEKSSDEAIEI

SEQ ID NO: 1667260 - protein, 27 aa, Staphylococcus aureus
FTFDERLRIALQLEKWGVDVIEAGFPA

SEQ ID NO: 1667261 - protein, 24 aa, Staphylococcus aureus
FTGDIKTPVKYASSELKKLFSQVE

SEQ ID NO: 1667262 - protein, 20 aa, Staphylococcus aureus
FTLNMLHPYIDEIRITKNKA

SEQ ID NO: 1667263 - protein, 19 aa, Staphylococcus aureus
FTYDLPLSTYLGQVLNMNA

SEQ ID NO: 1667264 - protein, 25 aa, Staphylococcus aureus
FVCGKAEEVILQWKAQGIKPDVVMV

SEQ ID NO: 1667265 - protein, 17 aa, Staphylococcus aureus
FVDHTPLAHLTLDTYTY

SEQ ID NO: 1667266 - protein, 18 aa, Staphylococcus aureus
FVDHTPLAHLTLDTYTYY

SEQ ID NO: 1667267 - protein, 32 aa, Staphylococcus aureus
FVEKFANFFKMLWLRLKAMKHYKALNKESKKQ

SEQ ID NO: 1667268 - protein, 24 aa, Staphylococcus aureus
FVGEHSRYDLMLVHTNRHYGKTLV

SEQ ID NO: 1667269 - protein, 18 aa, Staphylococcus aureus
FVGKDIAEILGYARADNA

SEQ ID NO: 1667270 - protein, 23 aa, Staphylococcus aureus
FVIDKRHFSAFVGTDLDLQLRRR

SEQ ID NO: 1667271 - protein, 23 aa, Staphylococcus aureus
FVIDKRQFSVFVGTDLDLQLRRR

SEQ ID NO: 1667272 - protein, 24 aa, Staphylococcus aureus
FVIMIKTLQYWSAHKDEVDIDEIA

SEQ ID NO: 1667273 - protein, 21 aa, Staphylococcus aureus
FVKATFKDAVIDREKEFATGL

SEQ ID NO: 1667274 - protein, 22 aa, Staphylococcus aureus
FVKNGKKSFAHYKVSILKDEIA

SEQ ID NO: 1667275 - protein, 18 aa, Staphylococcus aureus
FVLLCLANSMGIDMTESF

SEQ ID NO: 1667276 - protein, 18 aa, Staphylococcus aureus
FVNLSEGFEDGVREEVLA

SEQ ID NO: 1667277 - protein, 20 aa, Staphylococcus aureus
FVTDELKSRFEAENLIEQHQ

SEQ ID NO: 1667278 - protein, 18 aa, Staphylococcus aureus
FVYQGAESFKIWTNKDAD

SEQ ID NO: 1667279 - protein, 20 aa, Staphylococcus aureus
FWVDPRTKIIYMTQARPGNH

SEQ ID NO: 1667280 - protein, 21 aa, Staphylococcus aureus
FWVDPRTKIIYMTQARPGNHY

SEQ ID NO: 1667281 - protein, 20 aa, Staphylococcus aureus
FYATEFDFPKALRKEEIVGS

SEQ ID NO: 1667282 - protein, 18 aa, Staphylococcus aureus
FYAVDWASLRLAPKDERD

SEQ ID NO: 1667283 - protein, 19 aa, Staphylococcus aureus
FYDYPKMVHDFPIYPIRQS

SEQ ID NO: 1667284 - protein, 19 aa, Staphylococcus aureus
FYEQCKLGWEPQKREIGFP

SEQ ID NO: 1667285 - protein, 17 aa, Staphylococcus aureus
FYFPLLKSWSKKKKSEM

SEQ ID NO: 1667286 - protein, 20 aa, Staphylococcus aureus
FYHFKYPYADGEGFIEIATT

SEQ ID NO: 1667287 - protein, 25 aa, Staphylococcus aureus
FYHFKYPYADVEGFIEIATTRPETM

SEQ ID NO: 1667288 - protein, 28 aa, Staphylococcus aureus
FYHSNPFKFGASIGRYSGRIDNAKFKLK

SEQ ID NO: 1667289 - protein, 29 aa, Staphylococcus aureus
FYHSNPFKLGASIGRYSGRIHNAKFKLKG

SEQ ID NO: 1667290 - protein, 20 aa, Staphylococcus aureus
FYKDVEMDSAEVLKQLNSQP

SEQ ID NO: 1667291 - protein, 20 aa, Staphylococcus aureus
FYKECLKIDKKVALMHCGAE

SEQ ID NO: 1667292 - protein, 34 aa, Staphylococcus aureus
FYLRPFVKTKIKAWVRQLLWMSIYQYVYLDKVPN

SEQ ID NO: 1667293 - protein, 29 aa, Staphylococcus aureus
FYNEQKERITLYLKYNIKNFKSVEFTSIE

SEQ ID NO: 1667294 - protein, 17 aa, Staphylococcus aureus
FYNMESLNKEQQKKDNI

SEQ ID NO: 1667295 - protein, 21 aa, Staphylococcus aureus
FYNRGYEFSNIKLYYSSDDES

SEQ ID NO: 1667296 - protein, 17 aa, Staphylococcus aureus
FYQCKILSQKGYSGQQI

SEQ ID NO: 1667297 - protein, 17 aa, Staphylococcus aureus
FYQLPKFLFEDEYFSKM

SEQ ID NO: 1667298 - protein, 24 aa, Staphylococcus aureus
FYYPKLTFRSSILELIKENKVTAK

SEQ ID NO: 1667299 - protein, 24 aa, Staphylococcus aureus
FYYQAYKRIRKYGGGAIASTQQIK

SEQ ID NO: 1667300 - protein, 17 aa, Staphylococcus aureus
GAAEGVIRRYLIEEKNY

SEQ ID NO: 1667301 - protein, 25 aa, Staphylococcus aureus
GAAKPRLPFDHVFHHNKYRADKETQ

SEQ ID NO: 1667302 - protein, 23 aa, Staphylococcus aureus
GAAVKYIEIEGVLHEFSAVDNVV

SEQ ID NO: 1667303 - protein, 18 aa, Staphylococcus aureus
GADNLGLGHPLSLKKYQH

SEQ ID NO: 1667304 - protein, 21 aa, Staphylococcus aureus
GADPMTFLGLGGIGDLIVTCT

SEQ ID NO: 1667305 - protein, 26 aa, Staphylococcus aureus
GAERICKRVDCDIDYEEDAEKWMADI

SEQ ID NO: 1667306 - protein, 30 aa, Staphylococcus aureus
GAETNYDYTKLVFAKPIYNDPSLVKSDTND

SEQ ID NO: 1667307 - protein, 24 aa, Staphylococcus aureus
GAFGEALGAIIVRSNKLEAGTAIL

SEQ ID NO: 1667308 - protein, 20 aa, Staphylococcus aureus
GAGDSFCAAVVYSWLNGMPT

SEQ ID NO: 1667309 - protein, 19 aa, Staphylococcus aureus
GAGDSFCAAVVYSWLNGMS

SEQ ID NO: 1667310 - protein, 17 aa, Staphylococcus aureus
GAIAGELPYKAWIDNHK

SEQ ID NO: 1667311 - protein, 19 aa, Staphylococcus aureus
GAIGKLMGRLNVTMKNVDD

SEQ ID NO: 1667312 - protein, 23 aa, Staphylococcus aureus
GAISVYGSVKFLKNTYVKTAYAG

SEQ ID NO: 1667313 - protein, 17 aa, Staphylococcus aureus
GAIVGFFTPELFHGVGS

SEQ ID NO: 1667314 - protein, 23 aa, Staphylococcus aureus
GAKEMILIPDFVKVINITNLFEC

SEQ ID NO: 1667315 - protein, 22 aa, Staphylococcus aureus
GAKIMVLMGLELITNQDVYQDI

SEQ ID NO: 1667316 - protein, 25 aa, Staphylococcus aureus
GALELDEAIGIMVSQVIYEYKEELE

SEQ ID NO: 1667317 - protein, 24 aa, Staphylococcus aureus
GALELDEAIGIMVSQVIYEYKEQE

SEQ ID NO: 1667318 - protein, 22 aa, Staphylococcus aureus
GALGRKTKQGFYKKDKETKTRL

SEQ ID NO: 1667319 - protein, 19 aa, Staphylococcus aureus
GALHNFKIQASRVDKVNGF

SEQ ID NO: 1667320 - protein, 17 aa, Staphylococcus aureus
GALKDGRFDDVQQDIEA

SEQ ID NO: 1667321 - protein, 27 aa, Staphylococcus aureus
GALWTLAQEVYQEWYLGSKLYEEVEKK

SEQ ID NO: 1667322 - protein, 28 aa, Staphylococcus aureus
GALWTLAQEVYQEWYLGSKLYEEVEKKT

SEQ ID NO: 1667323 - protein, 26 aa, Staphylococcus aureus
GALWTLAQEVYQEWYLGSKLYEEVKR

SEQ ID NO: 1667324 - protein, 19 aa, Staphylococcus aureus
GAMLEKYFECEHLSPDETE

SEQ ID NO: 1667325 - protein, 22 aa, Staphylococcus aureus
GANRLIKAGAFDKYPIEAVFGI

SEQ ID NO: 1667326 - protein, 20 aa, Staphylococcus aureus
GANVKASILLLQKLDSKTME

SEQ ID NO: 1667327 - protein, 19 aa, Staphylococcus aureus
GAPPRYYLNNSFRILNNDP

SEQ ID NO: 1667328 - protein, 23 aa, Staphylococcus aureus
GARCMDCGTPFCQTGQQYGRKTI

SEQ ID NO: 1667329 - protein, 18 aa, Staphylococcus aureus
GARLNDCRLSIDTKNRKY

SEQ ID NO: 1667330 - protein, 24 aa, Staphylococcus aureus
GARSFKMKFGHRGANHPVKNLETG

SEQ ID NO: 1667331 - protein, 23 aa, Staphylococcus aureus
GASGPLYGFSFVKMSAVAKDDMH

SEQ ID NO: 1667332 - protein, 24 aa, Staphylococcus aureus
GASTHPGAGVPIVLTSAKITVDEM

SEQ ID NO: 1667333 - protein, 25 aa, Staphylococcus aureus
GASTYRKQFCKLLLKSTKVSVIKGN

SEQ ID NO: 1667334 - protein, 21 aa, Staphylococcus aureus
GATHLADWAYQANILGLKDKT

SEQ ID NO: 1667335 - protein, 18 aa, Staphylococcus aureus
GAVVKIILHELCHYHLHI

SEQ ID NO: 1667336 - protein, 31 aa, Staphylococcus aureus
GAWNAKSVWIRKGTVISRMMGFLNLKYPNIT

SEQ ID NO: 1667337 - protein, 26 aa, Staphylococcus aureus
GAYGDFGRYVFGYAVRNWVKGFKSDQ

SEQ ID NO: 1667338 - protein, 24 aa, Staphylococcus aureus
GCDYRCSWCDSAFTWDGSAKSDIK

SEQ ID NO: 1667339 - protein, 28 aa, Staphylococcus aureus
GCHSELIHPKRCLKLPEIFFSPKNDVYN

SEQ ID NO: 1667340 - protein, 19 aa, Staphylococcus aureus
GCLWGVEAFFTTIPGIIHT

SEQ ID NO: 1667341 - protein, 17 aa, Staphylococcus aureus
GCVSAGVGESLHEEAIF

SEQ ID NO: 1667342 - protein, 20 aa, Staphylococcus aureus
GDAFARRSQYALDIDFKVEP

SEQ ID NO: 1667343 - protein, 23 aa, Staphylococcus aureus
GDDLPAAGGYGVMICYHDADLQK

SEQ ID NO: 1667344 - protein, 18 aa, Staphylococcus aureus
GDEIKAHPNGFYNNGGGL

SEQ ID NO: 1667345 - protein, 24 aa, Staphylococcus aureus
GDELLRKSDLVFTIGYDPIEYEAS

SEQ ID NO: 1667346 - protein, 18 aa, Staphylococcus aureus
GDFIFVGDIGRPDLLEKA

SEQ ID NO: 1667347 - protein, 18 aa, Staphylococcus aureus
GDFTEFGNPFGGGKISLS

SEQ ID NO: 1667348 - protein, 18 aa, Staphylococcus aureus
GDHFKKIGKVGKWIEVED

SEQ ID NO: 1667349 - protein, 19 aa, Staphylococcus aureus
GDHFKKIGKVGKWIEVEDT

SEQ ID NO: 1667350 - protein, 19 aa, Staphylococcus aureus
GDHGINMVRGFSSLKDKLD

SEQ ID NO: 1667351 - protein, 18 aa, Staphylococcus aureus
GDIAPIVEIVELAKEYNS

SEQ ID NO: 1667352 - protein, 17 aa, Staphylococcus aureus
GDILKLRLYRNDENYNV

SEQ ID NO: 1667353 - protein, 21 aa, Staphylococcus aureus
GDIPNNLLFYIYGSLIEGFLY

SEQ ID NO: 1667354 - protein, 17 aa, Staphylococcus aureus
GDIQRVGTDIFLCTPDN

SEQ ID NO: 1667355 - protein, 18 aa, Staphylococcus aureus
GDIRRAAKRMGVNVTSGD

SEQ ID NO: 1667356 - protein, 19 aa, Staphylococcus aureus
GDIVKGYVIYHNDDEKNVE

SEQ ID NO: 1667357 - protein, 19 aa, Staphylococcus aureus
GDKAVHMGDIFPTTTHKNP

SEQ ID NO: 1667358 - protein, 17 aa, Staphylococcus aureus
GDKGMWVLYSSIVSEFK

SEQ ID NO: 1667359 - protein, 19 aa, Staphylococcus aureus
GDKGTWIVNSEMVIEPKGK

SEQ ID NO: 1667360 - protein, 24 aa, Staphylococcus aureus
GDKGTWVISSAMVKQPKGKIMRSR

SEQ ID NO: 1667361 - protein, 27 aa, Staphylococcus aureus
GDKLIKVLIDKDCRIKRDIVPTDIDYH

SEQ ID NO: 1667362 - protein, 22 aa, Staphylococcus aureus
GDLAGILGLCIPELDGKMSYMI

SEQ ID NO: 1667363 - protein, 27 aa, Staphylococcus aureus
GDLSIDGHVVFDFKVPLATSASIWETI

SEQ ID NO: 1667364 - protein, 23 aa, Staphylococcus aureus
GDMKGAIKYVVKFYNYPNEYLLT

SEQ ID NO: 1667365 - protein, 20 aa, Staphylococcus aureus
GDMTYGLADMEVFDYITPEF

SEQ ID NO: 1667366 - protein, 25 aa, Staphylococcus aureus
GDQKLARDQLQAVTTVNALPNLNHA

SEQ ID NO: 1667367 - protein, 26 aa, Staphylococcus aureus
GDQSSEVYSPISPIKIATQDNSGNAV

SEQ ID NO: 1667368 - protein, 17 aa, Staphylococcus aureus
GDRLIVESIDRLGRNYE

SEQ ID NO: 1667369 - protein, 33 aa, Staphylococcus aureus
GDSKPDWKIFQAIANRLGFDWNYKHPSEIMDEV

SEQ ID NO: 1667370 - protein, 20 aa, Staphylococcus aureus
GDSVEKGEAILELETDKVNV

SEQ ID NO: 1667371 - protein, 19 aa, Staphylococcus aureus
GDTELPVWSHANIADQPLK

SEQ ID NO: 1667372 - protein, 17 aa, Staphylococcus aureus
GDTNLVIDIWSVSDDLG

SEQ ID NO: 1667373 - protein, 23 aa, Staphylococcus aureus
GDVCLGGAIIDDVFKNEGQLNYV

SEQ ID NO: 1667374 - protein, 24 aa, Staphylococcus aureus
GDVEYKEHIGVVFDDLRVPNKLTI

SEQ ID NO: 1667375 - protein, 30 aa, Staphylococcus aureus
GDVQFLPGYCVLLPKREVRLLNDLTLEERQ

SEQ ID NO: 1667376 - protein, 21 aa, Staphylococcus aureus
GDVTLGPQFVYVAAYEGGIVA

SEQ ID NO: 1667377 - protein, 20 aa, Staphylococcus aureus
GDYCGYSFAFEVTKDNTKLA

SEQ ID NO: 1667378 - protein, 18 aa, Staphylococcus aureus
GDYGEPLLVYKPKTLETN

SEQ ID NO: 1667379 - protein, 28 aa, Staphylococcus aureus
GDYLEKSRCIPINLWVNGNHKTISTDKV

SEQ ID NO: 1667380 - protein, 27 aa, Staphylococcus aureus
GDYNFPKKPFKYGIHYSEIEDFDNFNK

SEQ ID NO: 1667381 - protein, 20 aa, Staphylococcus aureus
GEAIAWHLSKILELKDSKEN

SEQ ID NO: 1667382 - protein, 20 aa, Staphylococcus aureus
GEALKSIILSKFPDKKIDII

SEQ ID NO: 1667383 - protein, 19 aa, Staphylococcus aureus
GEESRLVFQQRITDSLALV

SEQ ID NO: 1667384 - protein, 21 aa, Staphylococcus aureus
GEGAFRGNQRLEPLRSSNLRQ

SEQ ID NO: 1667385 - protein, 32 aa, Staphylococcus aureus
GEGEFKAGSHCRFCKINHSCRTRAEYMQNVPQ

SEQ ID NO: 1667386 - protein, 23 aa, Staphylococcus aureus
GEGFHICKGELFGKHRHGEDCLF

SEQ ID NO: 1667387 - protein, 19 aa, Staphylococcus aureus
GEHALLFVSKIREILMKEG

SEQ ID NO: 1667388 - protein, 22 aa, Staphylococcus aureus
GEIAKGLAFKPANHIIFGGPSK

SEQ ID NO: 1667389 - protein, 24 aa, Staphylococcus aureus
GEIIRLTQELAHDFPTGTHERQDH

SEQ ID NO: 1667390 - protein, 19 aa, Staphylococcus aureus
GEIKRVIAHLPNFESDTDT

SEQ ID NO: 1667391 - protein, 17 aa, Staphylococcus aureus
GEILKMTGHVHGMILKH

SEQ ID NO: 1667392 - protein, 17 aa, Staphylococcus aureus
GEIPREDVATVLKEIVT

SEQ ID NO: 1667393 - protein, 25 aa, Staphylococcus aureus
GELDNNSFLLLEFIENGHAYPESYR

SEQ ID NO: 1667394 - protein, 21 aa, Staphylococcus aureus
GEMICGFAGMDIYNLINNKYL

SEQ ID NO: 1667395 - protein, 18 aa, Staphylococcus aureus
GEMKFRIACTNHHHHHFI

SEQ ID NO: 1667396 - protein, 20 aa, Staphylococcus aureus
GEMNRRYMGDLVFNHPEKRL

SEQ ID NO: 1667397 - protein, 20 aa, Staphylococcus aureus
GENDSSVLLFNITKNNQPLF

SEQ ID NO: 1667398 - protein, 17 aa, Staphylococcus aureus
GEPFTFAHLIERKNVKG

SEQ ID NO: 1667399 - protein, 24 aa, Staphylococcus aureus
GEQKRLTVGLVLNEQKKLYIFDEL

SEQ ID NO: 1667400 - protein, 17 aa, Staphylococcus aureus
GERELKYAKKATYTVHF

SEQ ID NO: 1667401 - protein, 21 aa, Staphylococcus aureus
GESDSSVLLFNIIKNNQPLFL

SEQ ID NO: 1667402 - protein, 20 aa, Staphylococcus aureus
GESDSSVLLFNISKNNQPLL

SEQ ID NO: 1667403 - protein, 33 aa, Staphylococcus aureus
GESKPDWKIFQAIANKLGFDWNYKHPSEIMDEI

SEQ ID NO: 1667404 - protein, 18 aa, Staphylococcus aureus
GEVIDPYGGTKEMYVHTY

SEQ ID NO: 1667405 - protein, 20 aa, Staphylococcus aureus
GEYVRKRIDQWVSKYNSVGD

SEQ ID NO: 1667406 - protein, 22 aa, Staphylococcus aureus
GFAMSVGLALAERHLAGKFNKE

SEQ ID NO: 1667407 - protein, 17 aa, Staphylococcus aureus
GFEIPSFNFVTEKENVK

SEQ ID NO: 1667408 - protein, 26 aa, Staphylococcus aureus
GFGNYELRLPLVSLKDTDTKVLREAY

SEQ ID NO: 1667409 - protein, 18 aa, Staphylococcus aureus
GFGTGGWQLAALNICSKA

SEQ ID NO: 1667410 - protein, 27 aa, Staphylococcus aureus
GFINFCHKRLLFVDTMPNIVHDWIAKL

SEQ ID NO: 1667411 - protein, 17 aa, Staphylococcus aureus
GFITNKNDMDWIKKNYD

SEQ ID NO: 1667412 - protein, 25 aa, Staphylococcus aureus
GFKGSYRTVCVFIQDWKATHYAEIS

SEQ ID NO: 1667413 - protein, 23 aa, Staphylococcus aureus
GFKSLRFLRPRTAGRHYIIITLW

SEQ ID NO: 1667414 - protein, 24 aa, Staphylococcus aureus
GFLEARPRVGYYYSGKSKGKLFNE

SEQ ID NO: 1667415 - protein, 18 aa, Staphylococcus aureus
GFLTYKISKKVIKHAGYV

SEQ ID NO: 1667416 - protein, 18 aa, Staphylococcus aureus
GFNHYSRFIHLFKETYGD

SEQ ID NO: 1667417 - protein, 19 aa, Staphylococcus aureus
GFRKWLSKTYEWIRDIGKD

SEQ ID NO: 1667418 - protein, 23 aa, Staphylococcus aureus
GFRNEYYYLTAIPYTLDEYKRYF

SEQ ID NO: 1667419 - protein, 20 aa, Staphylococcus aureus
GFTCKKETPFLPNINNERLV

SEQ ID NO: 1667420 - protein, 17 aa, Staphylococcus aureus
GFTKSIHVPVLFEAAEE

SEQ ID NO: 1667421 - protein, 22 aa, Staphylococcus aureus
GFTRSTHVPVLFGAAEEGDDIA

SEQ ID NO: 1667422 - protein, 19 aa, Staphylococcus aureus
GFVGEHGRYDLMLVNTNRH

SEQ ID NO: 1667423 - protein, 17 aa, Staphylococcus aureus
GGARGLGIALRFITGPI

SEQ ID NO: 1667424 - protein, 20 aa, Staphylococcus aureus
GGDFTEFGSPFGGGKISLNP

SEQ ID NO: 1667425 - protein, 17 aa, Staphylococcus aureus
GGEVLYQAFGLKMQPEQ

SEQ ID NO: 1667426 - protein, 28 aa, Staphylococcus aureus
GGGKTYFLFYVIRELFRRHSEVRLLDPK

SEQ ID NO: 1667427 - protein, 17 aa, Staphylococcus aureus
GGIDSFDAGAGMLQALG

SEQ ID NO: 1667428 - protein, 25 aa, Staphylococcus aureus
GGKLGSGQQWYSWIHINDLIQAILF

SEQ ID NO: 1667429 - protein, 26 aa, Staphylococcus aureus
GGKPMKPFLGVRGWYLSEYSKHKYWA

SEQ ID NO: 1667430 - protein, 18 aa, Staphylococcus aureus
GGKSLPNFLESFKDDKYT

SEQ ID NO: 1667431 - protein, 20 aa, Staphylococcus aureus
GGLAMGLTVEGFRPVMEVQF

SEQ ID NO: 1667432 - protein, 19 aa, Staphylococcus aureus
GGLLKEIHKKLNLDDTEEG

SEQ ID NO: 1667433 - protein, 21 aa, Staphylococcus aureus
GGLQERIWNPLQILNDFGTDV

SEQ ID NO: 1667434 - protein, 17 aa, Staphylococcus aureus
GGMVVCLETSQPTLPAF

SEQ ID NO: 1667435 - protein, 27 aa, Staphylococcus aureus
GGNMGVSGSVAYMFDHVATFGIEGKTV

SEQ ID NO: 1667436 - protein, 46 aa, Staphylococcus aureus
GGNSGSPVFNEKNEVIGIHWGGVPNEFNGAVFINENVRNFLKQNIE

SEQ ID NO: 1667437 - protein, 18 aa, Staphylococcus aureus
GGPGTFSPLLLDTLYHLN

SEQ ID NO: 1667438 - protein, 23 aa, Staphylococcus aureus
GGPHKAVCGFSKHNYALYKDDLP

SEQ ID NO: 1667439 - protein, 30 aa, Staphylococcus aureus
GGPPSTKNKLYWNGEINWFSPIEIGNKTYV

SEQ ID NO: 1667440 - protein, 18 aa, Staphylococcus aureus
GGQSYTYDTIKSFKEQHK

SEQ ID NO: 1667441 - protein, 24 aa, Staphylococcus aureus
GGRLTDSYYCFSYSLKDNSKKVLG

SEQ ID NO: 1667442 - protein, 21 aa, Staphylococcus aureus
GGRTRPSLISDVFEAFIGALY

SEQ ID NO: 1667443 - protein, 23 aa, Staphylococcus aureus
GGRYKGKWIHDQMMRVAKRESNY

SEQ ID NO: 1667444 - protein, 17 aa, Staphylococcus aureus
GGSLIELIIAEGLAENY

SEQ ID NO: 1667445 - protein, 17 aa, Staphylococcus aureus
GGTADVYDKKYAFISQN

SEQ ID NO: 1667446 - protein, 28 aa, Staphylococcus aureus
GGTIAQVMTVLFNFDKTKTFSAPNGYNI

SEQ ID NO: 1667447 - protein, 20 aa, Staphylococcus aureus
GGVSMRPGHEMVSLEEEMNR

SEQ ID NO: 1667448 - protein, 17 aa, Staphylococcus aureus
GHELIFASARPIRDLLP

SEQ ID NO: 1667449 - protein, 20 aa, Staphylococcus aureus
GHEPWTSCEFDFTKEGELKV

SEQ ID NO: 1667450 - protein, 19 aa, Staphylococcus aureus
GHFAPIASYQLLEKAVETA

SEQ ID NO: 1667451 - protein, 23 aa, Staphylococcus aureus
GHFRADCDQRFKCNCGRSGCIET

SEQ ID NO: 1667452 - protein, 21 aa, Staphylococcus aureus
GHLLIQWYSKGIYKFKYVILE

SEQ ID NO: 1667453 - protein, 19 aa, Staphylococcus aureus
GHRELPIRADFVGKNIPTS

SEQ ID NO: 1667454 - protein, 20 aa, Staphylococcus aureus
GHSNLNWSLVPKAGRAPYDK

SEQ ID NO: 1667455 - protein, 20 aa, Staphylococcus aureus
GHSVRFGKTKAFAEVNGETF

SEQ ID NO: 1667456 - protein, 26 aa, Staphylococcus aureus
GHTFATSLPAKFVVKDVQPAKPTVTE

SEQ ID NO: 1667457 - protein, 26 aa, Staphylococcus aureus
GHTFATSLPAKFVVKNVQPAKPTVTE

SEQ ID NO: 1667458 - protein, 18 aa, Staphylococcus aureus
GHTIQWYIMISDINHEET

SEQ ID NO: 1667459 - protein, 24 aa, Staphylococcus aureus
GHTPDLIKSAAFSNILPSSTNPTL

SEQ ID NO: 1667460 - protein, 21 aa, Staphylococcus aureus
GHTSIKGKVALSINNKFINFE

SEQ ID NO: 1667461 - protein, 20 aa, Staphylococcus aureus
GHYVLPGFIDIHIHGGYGQD

SEQ ID NO: 1667462 - protein, 23 aa, Staphylococcus aureus
GIAIGVSNFYYAPILKGTENEWE

SEQ ID NO: 1667463 - protein, 18 aa, Staphylococcus aureus
GIALSKDEKVLWVTETTA

SEQ ID NO: 1667464 - protein, 23 aa, Staphylococcus aureus
GIDVPNLDAVIFFAPKKSQVDIV

SEQ ID NO: 1667465 - protein, 20 aa, Staphylococcus aureus
GIEAIICGIGINLTQQLEDF

SEQ ID NO: 1667466 - protein, 20 aa, Staphylococcus aureus
GIEAIICGIGINLTQQLENF

SEQ ID NO: 1667467 - protein, 23 aa, Staphylococcus aureus
GIEAKLKLLQDITNLLNYIENRE

SEQ ID NO: 1667468 - protein, 17 aa, Staphylococcus aureus
GIEELRDLWQQKMLRDN

SEQ ID NO: 1667469 - protein, 18 aa, Staphylococcus aureus
GIEELRDLWQQKMLRDNP

SEQ ID NO: 1667470 - protein, 29 aa, Staphylococcus aureus
GIEKRLSRYPQLYSRIGFSHQFDKLTNDE

SEQ ID NO: 1667471 - protein, 17 aa, Staphylococcus aureus
GIETGFKLSVGKNYKFI

SEQ ID NO: 1667472 - protein, 22 aa, Staphylococcus aureus
GIEWIGYIPKYWTITKLKNIID

SEQ ID NO: 1667473 - protein, 17 aa, Staphylococcus aureus
GIFDIFDYVMLGHLHHP

SEQ ID NO: 1667474 - protein, 37 aa, Staphylococcus aureus
GIFDRYPKLNMIIGHWGEFIPFFLERMDEALFAEHLN

SEQ ID NO: 1667475 - protein, 17 aa, Staphylococcus aureus
GIGRLTGKPGVVLVTSG

SEQ ID NO: 1667476 - protein, 24 aa, Staphylococcus aureus
GIGTCWKSPLYIYDLKVRKTLGIK

SEQ ID NO: 1667477 - protein, 21 aa, Staphylococcus aureus
GIHDRGMKLILDLVVNHTSDE

SEQ ID NO: 1667478 - protein, 21 aa, Staphylococcus aureus
GIIDRYFFKSLYYRHNSIMYE

SEQ ID NO: 1667479 - protein, 23 aa, Staphylococcus aureus
GIIRCPQCGAPMAASNTTNTLKD

SEQ ID NO: 1667480 - protein, 18 aa, Staphylococcus aureus
GIKLKAGDRIVYDSFRVY

SEQ ID NO: 1667481 - protein, 22 aa, Staphylococcus aureus
GIKNIQIGMAHRGRLNVLTHVL

SEQ ID NO: 1667482 - protein, 29 aa, Staphylococcus aureus
GIKQSKHIGGFPVSGLFLRCTNQEVIDRH

SEQ ID NO: 1667483 - protein, 31 aa, Staphylococcus aureus
GILEKIPFFGICLGHQLFALSQGASSFKMKF

SEQ ID NO: 1667484 - protein, 17 aa, Staphylococcus aureus
GINRSKYLLIEFPTGEV

SEQ ID NO: 1667485 - protein, 25 aa, Staphylococcus aureus
GIPNIGAYVKQAADWGHPAIAVTDH

SEQ ID NO: 1667486 - protein, 26 aa, Staphylococcus aureus
GIQEKMGRPAVEVILTVLHAGGKFGG

SEQ ID NO: 1667487 - protein, 18 aa, Staphylococcus aureus
GIQLKDFMFEGAVSENDY

SEQ ID NO: 1667488 - protein, 25 aa, Staphylococcus aureus
GIRDRGVSFKVVYFQPASSLNTENI

SEQ ID NO: 1667489 - protein, 25 aa, Staphylococcus aureus
GIRHLGVKVSQVLAEKYETIDRLLT

SEQ ID NO: 1667490 - protein, 25 aa, Staphylococcus aureus
GITLREGDEVVGLDVAHANSIDEVL

SEQ ID NO: 1667491 - protein, 23 aa, Staphylococcus aureus
GITYPESFKVFGSEQSKVIFCEA

SEQ ID NO: 1667492 - protein, 19 aa, Staphylococcus aureus
GIYGKRWLDDELFNVEHFS

SEQ ID NO: 1667493 - protein, 21 aa, Staphylococcus aureus
GKAKLFPLSFDNYFKQDEIYD

SEQ ID NO: 1667494 - protein, 18 aa, Staphylococcus aureus
GKALLKMRRNIGMIFQHF

SEQ ID NO: 1667495 - protein, 20 aa, Staphylococcus aureus
GKAREVVKRQSLRQLIINDT

SEQ ID NO: 1667496 - protein, 19 aa, Staphylococcus aureus
GKARSQMALDVFASKIHKY

SEQ ID NO: 1667497 - protein, 21 aa, Staphylococcus aureus
GKARTGWLIVDYAGYPWPGYD

SEQ ID NO: 1667498 - protein, 21 aa, Staphylococcus aureus
GKASYPSTVLMTATLAQVAGV

SEQ ID NO: 1667499 - protein, 17 aa, Staphylococcus aureus
GKATINFRECRYNYSLL

SEQ ID NO: 1667500 - protein, 20 aa, Staphylococcus aureus
GKDDIYAVAYSFEKAESINS

SEQ ID NO: 1667501 - protein, 17 aa, Staphylococcus aureus
GKDFIFEATVTVEPVVK

SEQ ID NO: 1667502 - protein, 21 aa, Staphylococcus aureus
GKDIIPPKTYSGNVDQVVTID

SEQ ID NO: 1667503 - protein, 20 aa, Staphylococcus aureus
GKDKLKEPIIEHSTPIELEF

SEQ ID NO: 1667504 - protein, 21 aa, Staphylococcus aureus
GKDRFKGLPYWHRSKSNWLFK

SEQ ID NO: 1667505 - protein, 17 aa, Staphylococcus aureus
GKDSIMAGIQFISQFEI

SEQ ID NO: 1667506 - protein, 17 aa, Staphylococcus aureus
GKEDLAIVHVHETSTEG

SEQ ID NO: 1667507 - protein, 24 aa, Staphylococcus aureus
GKEFKTNRINIRRNYDNKPQNLKL

SEQ ID NO: 1667508 - protein, 25 aa, Staphylococcus aureus
GKEGLRLSQFYKELMYTTGCLEIEH

SEQ ID NO: 1667509 - protein, 18 aa, Staphylococcus aureus
GKEIKKAIGQDATVSLFD

SEQ ID NO: 1667510 - protein, 21 aa, Staphylococcus aureus
GKEKIEFLVSLNVHYTITNVD

SEQ ID NO: 1667511 - protein, 17 aa, Staphylococcus aureus
GKEWMATLHYMKTKDIN

SEQ ID NO: 1667512 - protein, 20 aa, Staphylococcus aureus
GKFGCANCYATFKDDIIDIA

SEQ ID NO: 1667513 - protein, 24 aa, Staphylococcus aureus
GKFYQRPASIIAIYSAKYKGYKWM

SEQ ID NO: 1667514 - protein, 19 aa, Staphylococcus aureus
GKGFKCFVKQNDRVEAGQT

SEQ ID NO: 1667515 - protein, 30 aa, Staphylococcus aureus
GKGKSFLAKLLWIYTSFFKGQMIYWDPKSE

SEQ ID NO: 1667516 - protein, 31 aa, Staphylococcus aureus
GKGKSFLAKLLWLYTSFFKGQMIYWDPKSEF

SEQ ID NO: 1667517 - protein, 21 aa, Staphylococcus aureus
GKGTTVRLIFPLQNEIVERMS

SEQ ID NO: 1667518 - protein, 18 aa, Staphylococcus aureus
GKHPPIISQELWDKVQSR

SEQ ID NO: 1667519 - protein, 17 aa, Staphylococcus aureus
GKHSPIISQELWDKVHS

SEQ ID NO: 1667520 - protein, 17 aa, Staphylococcus aureus
GKHYARLRPKKLKANIE

SEQ ID NO: 1667521 - protein, 19 aa, Staphylococcus aureus
GKIDKKWLEDKNVVALVSG

SEQ ID NO: 1667522 - protein, 19 aa, Staphylococcus aureus
GKIINPRISIEVQPAIHNN

SEQ ID NO: 1667523 - protein, 19 aa, Staphylococcus aureus
GKINNKWFEDKNVVALVSG

SEQ ID NO: 1667524 - protein, 19 aa, Staphylococcus aureus
GKINNKWLEDKNVVALVSG

SEQ ID NO: 1667525 - protein, 18 aa, Staphylococcus aureus
GKIRLRLLNGSNARDLNL

SEQ ID NO: 1667526 - protein, 18 aa, Staphylococcus aureus
GKKAIIYFYPRDNTPTCT

SEQ ID NO: 1667527 - protein, 19 aa, Staphylococcus aureus
GKKKINAIMTKFRSNPPQE

SEQ ID NO: 1667528 - protein, 20 aa, Staphylococcus aureus
GKKPASITAYNNSIRALQSD

SEQ ID NO: 1667529 - protein, 17 aa, Staphylococcus aureus
GKLIFKDISCAINDQHL

SEQ ID NO: 1667530 - protein, 17 aa, Staphylococcus aureus
GKLLASIGYESKYHDRK

SEQ ID NO: 1667531 - protein, 25 aa, Staphylococcus aureus
GKLNVSFDYIDWIKLGFGPSGKENY

SEQ ID NO: 1667532 - protein, 20 aa, Staphylococcus aureus
GKLNVSFGYVDWIKLSLGPL

SEQ ID NO: 1667533 - protein, 19 aa, Staphylococcus aureus
GKLSEKQLRNFGVDEESHI

SEQ ID NO: 1667534 - protein, 25 aa, Staphylococcus aureus
GKLYVSFDYIDWIKLGFGPSGKENY

SEQ ID NO: 1667535 - protein, 17 aa, Staphylococcus aureus
GKMAIVLPDSVLTGPKL

SEQ ID NO: 1667536 - protein, 22 aa, Staphylococcus aureus
GKMETLLLCARQFLWSTAKGYQ

SEQ ID NO: 1667537 - protein, 24 aa, Staphylococcus aureus
GKPLPNRRIVVLTSDTSFNVEGVD

SEQ ID NO: 1667538 - protein, 25 aa, Staphylococcus aureus
GKQGTGLGLFICKMIIEEHGGSIDV

SEQ ID NO: 1667539 - protein, 24 aa, Staphylococcus aureus
GKQVFNYFATPSFVTNIYETDELY

SEQ ID NO: 1667540 - protein, 24 aa, Staphylococcus aureus
GKQVFNYFSTPSFVTNIYETDELY

SEQ ID NO: 1667541 - protein, 20 aa, Staphylococcus aureus
GKSGCGKSILLNTIAGLEKM

SEQ ID NO: 1667542 - protein, 18 aa, Staphylococcus aureus
GKSGCGKSTLLNTIAGLE

SEQ ID NO: 1667543 - protein, 22 aa, Staphylococcus aureus
GKSKKPTFNDWGECATRIVSIY

SEQ ID NO: 1667544 - protein, 18 aa, Staphylococcus aureus
GKSLADFSSLCFHVPFTK

SEQ ID NO: 1667545 - protein, 21 aa, Staphylococcus aureus
GKSLIAKALLEYLPFDLRCTY

SEQ ID NO: 1667546 - protein, 19 aa, Staphylococcus aureus
GKSLLTRTILGMKPSQLSY

SEQ ID NO: 1667547 - protein, 23 aa, Staphylococcus aureus
GKSMNRPELQRMLNDAKNGKLDC

SEQ ID NO: 1667548 - protein, 24 aa, Staphylococcus aureus
GKSSTRMLISAGLKDYYPLQNRFN

SEQ ID NO: 1667549 - protein, 21 aa, Staphylococcus aureus
GKSSYKRALSLGHILDSNGKK

SEQ ID NO: 1667550 - protein, 21 aa, Staphylococcus aureus
GKSTLLKLVLGLLPLQSGEIF

SEQ ID NO: 1667551 - protein, 24 aa, Staphylococcus aureus
GKTFSAQYYANWDYVNPIITEYLG

SEQ ID NO: 1667552 - protein, 25 aa, Staphylococcus aureus
GKTFSHKFFVSKSWINNAPTKEDIA

SEQ ID NO: 1667553 - protein, 19 aa, Staphylococcus aureus
GKTRGMSAILNFEATTNQA

SEQ ID NO: 1667554 - protein, 28 aa, Staphylococcus aureus
GKTTLMRHIVSFLKSHGYTVATIKHHGH

SEQ ID NO: 1667555 - protein, 17 aa, Staphylococcus aureus
GKTWLFFGDQHRSSDFL

SEQ ID NO: 1667556 - protein, 18 aa, Staphylococcus aureus
GKVADDWIENIKLMNDKN

SEQ ID NO: 1667557 - protein, 20 aa, Staphylococcus aureus
GKVALFRPEENFKRLNNSLA

SEQ ID NO: 1667558 - protein, 17 aa, Staphylococcus aureus
GKVHAQAFFTQHGSNNV

SEQ ID NO: 1667559 - protein, 24 aa, Staphylococcus aureus
GKVNTDYFCFGKDIIAPANGTVEK

SEQ ID NO: 1667560 - protein, 27 aa, Staphylococcus aureus
GKVNYLLAYDAKVFRKGGVSQHTVYTI

SEQ ID NO: 1667561 - protein, 18 aa, Staphylococcus aureus
GKVQLVYNEHVELIEVPI

SEQ ID NO: 1667562 - protein, 40 aa, Staphylococcus aureus
GKVTGCPAIPCYQCEYCLKGEYARCKKLFVIGSYEPGSFA

SEQ ID NO: 1667563 - protein, 17 aa, Staphylococcus aureus
GKWSYLYRAIDAEGHTL

SEQ ID NO: 1667564 - protein, 19 aa, Staphylococcus aureus
GKWYYDFGHEGKRYKKKGF

SEQ ID NO: 1667565 - protein, 24 aa, Staphylococcus aureus
GKYEIRESKVISGTQFIIELLGVN

SEQ ID NO: 1667566 - protein, 23 aa, Staphylococcus aureus
GKYHPHGDLSIYKAMVRMAQDFS

SEQ ID NO: 1667567 - protein, 17 aa, Staphylococcus aureus
GKYRFDNLDSGKYKVIF

SEQ ID NO: 1667568 - protein, 20 aa, Staphylococcus aureus
GKYRPELRNMKIFPRPIDNI

SEQ ID NO: 1667569 - protein, 19 aa, Staphylococcus aureus
GLCIPELDGKMSYMIAVAG

SEQ ID NO: 1667570 - protein, 21 aa, Staphylococcus aureus
GLCQMIKPTVIDWYISEYNPK

SEQ ID NO: 1667571 - protein, 19 aa, Staphylococcus aureus
GLDINVNRIGIKGGNNNRY

SEQ ID NO: 1667572 - protein, 18 aa, Staphylococcus aureus
GLDTRFQRFNKEKISWID

SEQ ID NO: 1667573 - protein, 23 aa, Staphylococcus aureus
GLEPWTSCEFDFTRDGKLNVSFD

SEQ ID NO: 1667574 - protein, 25 aa, Staphylococcus aureus
GLFLFPKKCLLKSLWYMAQPVLRQH

SEQ ID NO: 1667575 - protein, 18 aa, Staphylococcus aureus
GLGEPFSKEVALVMMVLR

SEQ ID NO: 1667576 - protein, 19 aa, Staphylococcus aureus
GLGNIMMRYVMKKKNVDSL

SEQ ID NO: 1667577 - protein, 20 aa, Staphylococcus aureus
GLGNLMMRYVMKKKNVDTLP

SEQ ID NO: 1667578 - protein, 22 aa, Staphylococcus aureus
GLIEGKSQRKAYIDAGYSTKNK

SEQ ID NO: 1667579 - protein, 23 aa, Staphylococcus aureus
GLIIQRFGMTYVLTTKKEAATYI

SEQ ID NO: 1667580 - protein, 20 aa, Staphylococcus aureus
GLISNFKGDNLIIINKDRTP

SEQ ID NO: 1667581 - protein, 20 aa, Staphylococcus aureus
GLKKMGYKVSWLLNDVDYCH

SEQ ID NO: 1667582 - protein, 23 aa, Staphylococcus aureus
GLKQYGIDIAERIEVIVPETAHN

SEQ ID NO: 1667583 - protein, 22 aa, Staphylococcus aureus
GLKQYGIDIAERIEVIVPETVH

SEQ ID NO: 1667584 - protein, 24 aa, Staphylococcus aureus
GLKTDVMLAAYGYHMMDIQIVNEV

SEQ ID NO: 1667585 - protein, 18 aa, Staphylococcus aureus
GLLAPRIDTMFAKHNVIY

SEQ ID NO: 1667586 - protein, 26 aa, Staphylococcus aureus
GLLITLAKLSAHYGLGLKSSIDITNA

SEQ ID NO: 1667587 - protein, 20 aa, Staphylococcus aureus
GLNRRGYRLAQGEAPIKETL

SEQ ID NO: 1667588 - protein, 25 aa, Staphylococcus aureus
GLPYWHRSKSNWLFKEYNGKISNTY

SEQ ID NO: 1667589 - protein, 21 aa, Staphylococcus aureus
GLSLLKLNQHVAFCDEDHYAS

SEQ ID NO: 1667590 - protein, 20 aa, Staphylococcus aureus
GLSLLKLNQHVAFCDENHYA

SEQ ID NO: 1667591 - protein, 21 aa, Staphylococcus aureus
GLSLLKLNQHVAFCDENHYAS

SEQ ID NO: 1667592 - protein, 20 aa, Staphylococcus aureus
GLTYLAWSYAHQELKKIDPN

SEQ ID NO: 1667593 - protein, 19 aa, Staphylococcus aureus
GLVKRCIDDLTPSVKTNDY

SEQ ID NO: 1667594 - protein, 36 aa, Staphylococcus aureus
GLYPGLKINSYRVFGSESAESIWVIKGIIEAAKDDS

SEQ ID NO: 1667595 - protein, 25 aa, Staphylococcus aureus
GMAHPEGYRKALRLMKQAEKFNRPI

SEQ ID NO: 1667596 - protein, 23 aa, Staphylococcus aureus
GMATMKYDMCGAANVVGIIEAAS

SEQ ID NO: 1667597 - protein, 22 aa, Staphylococcus aureus
GMGTALLAFCETTLTKGIDVVF

SEQ ID NO: 1667598 - protein, 21 aa, Staphylococcus aureus
GMKHPFHIHGTQFKVLSVDGK

SEQ ID NO: 1667599 - protein, 19 aa, Staphylococcus aureus
GMKKRVALCRAHVHKPNVI

SEQ ID NO: 1667600 - protein, 22 aa, Staphylococcus aureus
GMLSLRLNKAYSVAKLLENLGI

SEQ ID NO: 1667601 - protein, 17 aa, Staphylococcus aureus
GMQRARKELNYTANTNT

SEQ ID NO: 1667602 - protein, 24 aa, Staphylococcus aureus
GMTGFAEACILAFSQTKKNKIVVS

SEQ ID NO: 1667603 - protein, 18 aa, Staphylococcus aureus
GMTSSMFNRSREFYDANI

SEQ ID NO: 1667604 - protein, 23 aa, Staphylococcus aureus
GMVSKRIKDGWELHEAMDAPEGT

SEQ ID NO: 1667605 - protein, 21 aa, Staphylococcus aureus
GNACTVDLCLDVLALPSGEYE

SEQ ID NO: 1667606 - protein, 25 aa, Staphylococcus aureus
GNAIIKAGAMSLVPLLKSNTPFADT

SEQ ID NO: 1667607 - protein, 26 aa, Staphylococcus aureus
GNAIKALCQKLGYSVDQVIAFGDSMN

SEQ ID NO: 1667608 - protein, 19 aa, Staphylococcus aureus
GNASWGWAPTQRISKRNST

SEQ ID NO: 1667609 - protein, 25 aa, Staphylococcus aureus
GNDNIKVILPKVQVKPAARQSVGVK

SEQ ID NO: 1667610 - protein, 19 aa, Staphylococcus aureus
GNDQIFWLPIQKINNSEYS

SEQ ID NO: 1667611 - protein, 22 aa, Staphylococcus aureus
GNETRIAWEVALESESTPTSLV

SEQ ID NO: 1667612 - protein, 17 aa, Staphylococcus aureus
GNEYIDYVLSWGPLILG

SEQ ID NO: 1667613 - protein, 19 aa, Staphylococcus aureus
GNFNPEFISVLSHKQNDTK

SEQ ID NO: 1667614 - protein, 21 aa, Staphylococcus aureus
GNGGGIYECLLTKTSSTTLRI

SEQ ID NO: 1667615 - protein, 17 aa, Staphylococcus aureus
GNGKFLYSPFSIFDNES

SEQ ID NO: 1667616 - protein, 30 aa, Staphylococcus aureus
GNGNGGDGIGFAFSPGVLGETGLNGAAVGI

SEQ ID NO: 1667617 - protein, 18 aa, Staphylococcus aureus
GNGRVGRFIIAKLLSDYY

SEQ ID NO: 1667618 - protein, 18 aa, Staphylococcus aureus
GNGVIPLLLFAKHRRHIE

SEQ ID NO: 1667619 - protein, 23 aa, Staphylococcus aureus
GNHSTREAFAIHPQGIGNTKQPE

SEQ ID NO: 1667620 - protein, 30 aa, Staphylococcus aureus
GNIIKRKTGALMLNPELLMRGDDQKQKYLL

SEQ ID NO: 1667621 - protein, 18 aa, Staphylococcus aureus
GNILKDTLVFDVYQGEHL

SEQ ID NO: 1667622 - protein, 23 aa, Staphylococcus aureus
GNINQCSFGFMLDDKGDEMRFDE

SEQ ID NO: 1667623 - protein, 17 aa, Staphylococcus aureus
GNITRFVAENDALTENL

SEQ ID NO: 1667624 - protein, 17 aa, Staphylococcus aureus
GNITRIVSDKDWLTNII

SEQ ID NO: 1667625 - protein, 24 aa, Staphylococcus aureus
GNKKPLRRLWIRSVTKKAIQQGFK

SEQ ID NO: 1667626 - protein, 18 aa, Staphylococcus aureus
GNLKQGIANKDTVKASEN

SEQ ID NO: 1667627 - protein, 21 aa, Staphylococcus aureus
GNLPILPCIEMDLKEMQEETL

SEQ ID NO: 1667628 - protein, 22 aa, Staphylococcus aureus
GNLTSPYNGRWHMRNIKTNRFS

SEQ ID NO: 1667629 - protein, 17 aa, Staphylococcus aureus
GNLYVRISLALDDQQLD

SEQ ID NO: 1667630 - protein, 25 aa, Staphylococcus aureus
GNNNIKVILPKVQVKPAARQSVSAK

SEQ ID NO: 1667631 - protein, 17 aa, Staphylococcus aureus
GNPFSINSITYILVNPF

SEQ ID NO: 1667632 - protein, 17 aa, Staphylococcus aureus
GNQFVCRFNVAILDNGY

SEQ ID NO: 1667633 - protein, 45 aa, Staphylococcus aureus
GNSGSPVFNEKNEVIGIHWGGVPNQFNGAVFINENVRNFLKQNIE

SEQ ID NO: 1667634 - protein, 18 aa, Staphylococcus aureus
GNSSIIWGDLGIANILVK

SEQ ID NO: 1667635 - protein, 22 aa, Staphylococcus aureus
GNTEAMIKYLLPKATVVAPNLF

SEQ ID NO: 1667636 - protein, 17 aa, Staphylococcus aureus
GNTTWGQLELDKAIKNQ

SEQ ID NO: 1667637 - protein, 24 aa, Staphylococcus aureus
GNTVLNLISTLSFVLEKGKLGQII

SEQ ID NO: 1667638 - protein, 18 aa, Staphylococcus aureus
GNYEYCFFESEGREQFKP

SEQ ID NO: 1667639 - protein, 18 aa, Staphylococcus aureus
GNYEYCFFESKGRGQFKP

SEQ ID NO: 1667640 - protein, 17 aa, Staphylococcus aureus
GNYLGEVNLTFEAHQVV

SEQ ID NO: 1667641 - protein, 19 aa, Staphylococcus aureus
GPFGGALKKDIFVESGYAV

SEQ ID NO: 1667642 - protein, 21 aa, Staphylococcus aureus
GPLDAAIAWSEKGLDGSRRFL

SEQ ID NO: 1667643 - protein, 25 aa, Staphylococcus aureus
GPPKNRRAGVITFNLQDVHPHDVAT

SEQ ID NO: 1667644 - protein, 18 aa, Staphylococcus aureus
GPQIRRLPVSKMNRDLLA

SEQ ID NO: 1667645 - protein, 24 aa, Staphylococcus aureus
GPRILRAETAPLYALSAISYEKEL

SEQ ID NO: 1667646 - protein, 17 aa, Staphylococcus aureus
GPSELIQDGFNGYLVPQ

SEQ ID NO: 1667647 - protein, 29 aa, Staphylococcus aureus
GQALKRLLDKWGMSSSELMAFGDANNDKD

SEQ ID NO: 1667648 - protein, 31 aa, Staphylococcus aureus
GQALKRLLDKWGMSSSELMAFGDANNDKDML

SEQ ID NO: 1667649 - protein, 25 aa, Staphylococcus aureus
GQARLTQLCTLLKNYFNSEDEEILE

SEQ ID NO: 1667650 - protein, 23 aa, Staphylococcus aureus
GQARLTQLCTLLKNYFNSEDEEM

SEQ ID NO: 1667651 - protein, 24 aa, Staphylococcus aureus
GQASRRICEAIEYYFGLRSEKPDE

SEQ ID NO: 1667652 - protein, 23 aa, Staphylococcus aureus
GQDIPFETFLGFKGDKVPDIDLN

SEQ ID NO: 1667653 - protein, 21 aa, Staphylococcus aureus
GQELTPEWVDYLLKEADVTSF

SEQ ID NO: 1667654 - protein, 23 aa, Staphylococcus aureus
GQESKYSISLIIPKSDTSTIKAI

SEQ ID NO: 1667655 - protein, 19 aa, Staphylococcus aureus
GQFLIKMGIQPEVTKDKTM

SEQ ID NO: 1667656 - protein, 19 aa, Staphylococcus aureus
GQLERVYIASVLMLEPKLI

SEQ ID NO: 1667657 - protein, 22 aa, Staphylococcus aureus
GQLKAMGIQAAFLNSSLTQKEQ

SEQ ID NO: 1667658 - protein, 17 aa, Staphylococcus aureus
GQLKPGYNIQLATENQF

SEQ ID NO: 1667659 - protein, 18 aa, Staphylococcus aureus
GQLRKSYTAKEWMKHIQY

SEQ ID NO: 1667660 - protein, 25 aa, Staphylococcus aureus
GQMKQADRLGAKFTIVIGDQELENN

SEQ ID NO: 1667661 - protein, 26 aa, Staphylococcus aureus
GQMPNLWPRLIEIKVPTLILAGEYDE

SEQ ID NO: 1667662 - protein, 18 aa, Staphylococcus aureus
GQMPNLWPRLKEIKAPTL

SEQ ID NO: 1667663 - protein, 20 aa, Staphylococcus aureus
GQNASFIFAVCEYLKHEDNP

SEQ ID NO: 1667664 - protein, 18 aa, Staphylococcus aureus
GQNIYPAHVERLLTQSLS

SEQ ID NO: 1667665 - protein, 26 aa, Staphylococcus aureus
GQNRLFKWLRNNGYLIKKSGESYNLP

SEQ ID NO: 1667666 - protein, 19 aa, Staphylococcus aureus
GQRQFTLNGQVIQIMDIIN

SEQ ID NO: 1667667 - protein, 25 aa, Staphylococcus aureus
GQSGFSLNDLEMFIENKSIRTLTIV

SEQ ID NO: 1667668 - protein, 17 aa, Staphylococcus aureus
GQSYTYDTIKSFKEQHK

SEQ ID NO: 1667669 - protein, 22 aa, Staphylococcus aureus
GQVLQCTQIYFVHPIKKNNIYI

SEQ ID NO: 1667670 - protein, 18 aa, Staphylococcus aureus
GQVLYLYNKVQSIYEKRE

SEQ ID NO: 1667671 - protein, 22 aa, Staphylococcus aureus
GQYRGIATWRYDQDRQRLIGTI

SEQ ID NO: 1667672 - protein, 17 aa, Staphylococcus aureus
GQYRGIATWRYDQKRQR

SEQ ID NO: 1667673 - protein, 17 aa, Staphylococcus aureus
GRALPLAQGVKMANKDL

SEQ ID NO: 1667674 - protein, 18 aa, Staphylococcus aureus
GRARVNVGARSSVFAPFK

SEQ ID NO: 1667675 - protein, 25 aa, Staphylococcus aureus
GRDGLKSECILLFSERDINLHEYFI

SEQ ID NO: 1667676 - protein, 17 aa, Staphylococcus aureus
GRDIPIIGSSGVVHNFD

SEQ ID NO: 1667677 - protein, 19 aa, Staphylococcus aureus
GRDTRGLIRLHQFDKVEMV

SEQ ID NO: 1667678 - protein, 24 aa, Staphylococcus aureus
GRERKGVCSVHFAERIKPGDIVSI

SEQ ID NO: 1667679 - protein, 17 aa, Staphylococcus aureus
GRFSNMVLGHNGDGINE

SEQ ID NO: 1667680 - protein, 23 aa, Staphylococcus aureus
GRFSNQAILHFGKVYGPSPMTLH

SEQ ID NO: 1667681 - protein, 21 aa, Staphylococcus aureus
GRGMIKWAPFVICTNLIKNLI

SEQ ID NO: 1667682 - protein, 23 aa, Staphylococcus aureus
GRGSGLPVPGWFSLQKLQFGKIP

SEQ ID NO: 1667683 - protein, 24 aa, Staphylococcus aureus
GRGSGLPVPGWFSLQKLQFGKIPL

SEQ ID NO: 1667684 - protein, 18 aa, Staphylococcus aureus
GRGSIQMRSRAEIEERGG

SEQ ID NO: 1667685 - protein, 17 aa, Staphylococcus aureus
GRHDLRDELTITIDGAD

SEQ ID NO: 1667686 - protein, 17 aa, Staphylococcus aureus
GRIKFISKTEHFKEKVM

SEQ ID NO: 1667687 - protein, 22 aa, Staphylococcus aureus
GRKEYLKHFFGSKRYLYQDNER

SEQ ID NO: 1667688 - protein, 28 aa, Staphylococcus aureus
GRKFRHCAYFNKRLRTTGGRYLLKSHDI

SEQ ID NO: 1667689 - protein, 23 aa, Staphylococcus aureus
GRKRASEELRLKESTVRDYIKLL

SEQ ID NO: 1667690 - protein, 20 aa, Staphylococcus aureus
GRLIEKTCMYGGVTEHDGNQ

SEQ ID NO: 1667691 - protein, 17 aa, Staphylococcus aureus
GRLVLARCCVLCKSISA

SEQ ID NO: 1667692 - protein, 22 aa, Staphylococcus aureus
GRMGNFLENMVDWNIGRNRYWG

SEQ ID NO: 1667693 - protein, 19 aa, Staphylococcus aureus
GRMQYVIPNEFLKYTGRIH

SEQ ID NO: 1667694 - protein, 19 aa, Staphylococcus aureus
GRMQYVIPNEFLKYTGRVH

SEQ ID NO: 1667695 - protein, 31 aa, Staphylococcus aureus
GRMQYVIPNEFLKYTGRVHAQAYFTQNGSNN

SEQ ID NO: 1667696 - protein, 18 aa, Staphylococcus aureus
GRNFKGFLHHISKGRSYK

SEQ ID NO: 1667697 - protein, 21 aa, Staphylococcus aureus
GRNGIKATFKGLGKGPTIALR

SEQ ID NO: 1667698 - protein, 26 aa, Staphylococcus aureus
GRPRIYTDVCLLCFSLKEAGHGRLLQ

SEQ ID NO: 1667699 - protein, 22 aa, Staphylococcus aureus
GRQCVAFFTLHRGKGVAPFSDN

SEQ ID NO: 1667700 - protein, 18 aa, Staphylococcus aureus
GRQHKGLGWVLTYDEAQE

SEQ ID NO: 1667701 - protein, 18 aa, Staphylococcus aureus
GRRKGAVKNRSQVKNPKT

SEQ ID NO: 1667702 - protein, 20 aa, Staphylococcus aureus
GRSRWKGIRPTVRGSVMNPN

SEQ ID NO: 1667703 - protein, 22 aa, Staphylococcus aureus
GRSSGAYLSLLIARDRDIDGVI

SEQ ID NO: 1667704 - protein, 21 aa, Staphylococcus aureus
GRVGKMAVHCPFEEMTEAFRT

SEQ ID NO: 1667705 - protein, 18 aa, Staphylococcus aureus
GRVVSWIIDDITWSGHEF

SEQ ID NO: 1667706 - protein, 17 aa, Staphylococcus aureus
GRWFAYFVKQAPRVPFI

SEQ ID NO: 1667707 - protein, 22 aa, Staphylococcus aureus
GSCGRSLCCSTFLGDFEPVSIK

SEQ ID NO: 1667708 - protein, 17 aa, Staphylococcus aureus
GSDAFIFESNHDVDMLR

SEQ ID NO: 1667709 - protein, 18 aa, Staphylococcus aureus
GSDKRMALVKGYINEYKL

SEQ ID NO: 1667710 - protein, 18 aa, Staphylococcus aureus
GSDQYRGWFNSSITTAVA

SEQ ID NO: 1667711 - protein, 23 aa, Staphylococcus aureus
GSGSRTPISISIMVKDGSNDHKV

SEQ ID NO: 1667712 - protein, 17 aa, Staphylococcus aureus
GSIKNQGNRFLNILVVC

SEQ ID NO: 1667713 - protein, 18 aa, Staphylococcus aureus
GSILKPSEAKKFINRVYN

SEQ ID NO: 1667714 - protein, 23 aa, Staphylococcus aureus
GSIRGDLGLTVGRNIIHGSDSLE

SEQ ID NO: 1667715 - protein, 18 aa, Staphylococcus aureus
GSIVKYHVAFGLENHAVP

SEQ ID NO: 1667716 - protein, 19 aa, Staphylococcus aureus
GSLRCDANISLRPYGQEKF

SEQ ID NO: 1667717 - protein, 27 aa, Staphylococcus aureus
GSLVDCLKFDISGEVYEDLLLLRSLSD

SEQ ID NO: 1667718 - protein, 18 aa, Staphylococcus aureus
GSLYRAVNDINLAIRKGE

SEQ ID NO: 1667719 - protein, 18 aa, Staphylococcus aureus
GSLYRAVNDINLGIRKGE

SEQ ID NO: 1667720 - protein, 17 aa, Staphylococcus aureus
GSMKRPSLQKLFDRLEE

SEQ ID NO: 1667721 - protein, 20 aa, Staphylococcus aureus
GSMSCKVTAIGKAVHSSVPF

SEQ ID NO: 1667722 - protein, 17 aa, Staphylococcus aureus
GSNTCDEYSRILIKNDK

SEQ ID NO: 1667723 - protein, 18 aa, Staphylococcus aureus
GSPAVTPRNYRWTSRTGT

SEQ ID NO: 1667724 - protein, 19 aa, Staphylococcus aureus
GSSIGHKNLEFTFIENKEE

SEQ ID NO: 1667725 - protein, 18 aa, Staphylococcus aureus
GSSVGYKEIEFIFIENKK

SEQ ID NO: 1667726 - protein, 17 aa, Staphylococcus aureus
GSSVGYKKIEFTFLENK

SEQ ID NO: 1667727 - protein, 17 aa, Staphylococcus aureus
GSSVGYKKIEFTFVENE

SEQ ID NO: 1667728 - protein, 24 aa, Staphylococcus aureus
GSVLLKNKLVEWSLYLKDQRINPI

SEQ ID NO: 1667729 - protein, 17 aa, Staphylococcus aureus
GSVVGFFTPELFHGIGS

SEQ ID NO: 1667730 - protein, 19 aa, Staphylococcus aureus
GSVVLPGRFFVDIIKKITW

SEQ ID NO: 1667731 - protein, 17 aa, Staphylococcus aureus
GSWICEIEELSAFQKST

SEQ ID NO: 1667732 - protein, 18 aa, Staphylococcus aureus
GTDLPGQIARKVDIDILR

SEQ ID NO: 1667733 - protein, 19 aa, Staphylococcus aureus
GTEAAIAYQSGFNCNMSAI

SEQ ID NO: 1667734 - protein, 26 aa, Staphylococcus aureus
GTEPKIKLYVSLKCPNFDDVAQKINA

SEQ ID NO: 1667735 - protein, 27 aa, Staphylococcus aureus
GTEPKIKLYVSLKCRNFDDVAQKINAM

SEQ ID NO: 1667736 - protein, 19 aa, Staphylococcus aureus
GTESIDFIQEIKKKYPSIK

SEQ ID NO: 1667737 - protein, 20 aa, Staphylococcus aureus
GTESIDFIQEIKKKYSSIKI

SEQ ID NO: 1667738 - protein, 20 aa, Staphylococcus aureus
GTESIDFIQEIKKNYSSIKI

SEQ ID NO: 1667739 - protein, 18 aa, Staphylococcus aureus
GTGCTFSAVITAELAKGR

SEQ ID NO: 1667740 - protein, 24 aa, Staphylococcus aureus
GTGIKEMIAHFGIHQDETLVIGDS

SEQ ID NO: 1667741 - protein, 24 aa, Staphylococcus aureus
GTGIKEMIAHFGIHQEETLVIGDS

SEQ ID NO: 1667742 - protein, 19 aa, Staphylococcus aureus
GTIAQVMTVLCNFDKTKTF

SEQ ID NO: 1667743 - protein, 20 aa, Staphylococcus aureus
GTICGDDTCLIICRSKEASD

SEQ ID NO: 1667744 - protein, 17 aa, Staphylococcus aureus
GTIHRIKCNAGFGHKDT

SEQ ID NO: 1667745 - protein, 24 aa, Staphylococcus aureus
GTISKAIGVVGGYVAGTKELIDWL

SEQ ID NO: 1667746 - protein, 17 aa, Staphylococcus aureus
GTKKFVEEFVDELYSDS

SEQ ID NO: 1667747 - protein, 19 aa, Staphylococcus aureus
GTLCFNGKSIDPSIVDALL

SEQ ID NO: 1667748 - protein, 22 aa, Staphylococcus aureus
GTLRIDICEIHIEIANYIYEEI

SEQ ID NO: 1667749 - protein, 18 aa, Staphylococcus aureus
GTNEVKSDMSIFNIPSED

SEQ ID NO: 1667750 - protein, 19 aa, Staphylococcus aureus
GTQIKSAVIDKQLNMFDYQ

SEQ ID NO: 1667751 - protein, 20 aa, Staphylococcus aureus
GTQLYHIVASNAYHKDTEDF

SEQ ID NO: 1667752 - protein, 24 aa, Staphylococcus aureus
GTSARLNPWLLKIYEKRGYEIYRE

SEQ ID NO: 1667753 - protein, 25 aa, Staphylococcus aureus
GTTDMKGGLMALVITLIELKEQNQL

SEQ ID NO: 1667754 - protein, 17 aa, Staphylococcus aureus
GTTTGKKPASITAYNNS

SEQ ID NO: 1667755 - protein, 20 aa, Staphylococcus aureus
GTVTPQGFFAIIEKPHYDIS

SEQ ID NO: 1667756 - protein, 22 aa, Staphylococcus aureus
GTYDICKPLTIYGNTTLLLDNE

SEQ ID NO: 1667757 - protein, 26 aa, Staphylococcus aureus
GVDIKEVFLKLPIIGTEVYDESNEID

SEQ ID NO: 1667758 - protein, 17 aa, Staphylococcus aureus
GVDLGDIGCRFYTEDEN

SEQ ID NO: 1667759 - protein, 18 aa, Staphylococcus aureus
GVELLKMPNIEDVMSGEL

SEQ ID NO: 1667760 - protein, 19 aa, Staphylococcus aureus
GVFHSKYLLAWSNKKEDQI

SEQ ID NO: 1667761 - protein, 22 aa, Staphylococcus aureus
GVFHSKYLLAWSNKKENQITNY

SEQ ID NO: 1667762 - protein, 17 aa, Staphylococcus aureus
GVGKCVSGIAGGAVTGG

SEQ ID NO: 1667763 - protein, 23 aa, Staphylococcus aureus
GVGMGYSLHAGMVVVADGSERAE

SEQ ID NO: 1667764 - protein, 20 aa, Staphylococcus aureus
GVGNSVIYVGLKTGRDGIHG

SEQ ID NO: 1667765 - protein, 19 aa, Staphylococcus aureus
GVHFVKLFVNDAFKKATSS

SEQ ID NO: 1667766 - protein, 18 aa, Staphylococcus aureus
GVHFYFKKPENFKGANAI

SEQ ID NO: 1667767 - protein, 21 aa, Staphylococcus aureus
GVIGMEFASLMIDLGVDVTVI

SEQ ID NO: 1667768 - protein, 17 aa, Staphylococcus aureus
GVIKYIRRMDMSNLHPK

SEQ ID NO: 1667769 - protein, 17 aa, Staphylococcus aureus
GVISVIANVILKEFQAL

SEQ ID NO: 1667770 - protein, 19 aa, Staphylococcus aureus
GVIYEYYCSDMTRTIKFGK

SEQ ID NO: 1667771 - protein, 18 aa, Staphylococcus aureus
GVKANSFVTPNGQVSAYD

SEQ ID NO: 1667772 - protein, 17 aa, Staphylococcus aureus
GVKEMVLIPHFVKVTNL

SEQ ID NO: 1667773 - protein, 18 aa, Staphylococcus aureus
GVMYMLKLVHMVDDKLHA

SEQ ID NO: 1667774 - protein, 26 aa, Staphylococcus aureus
GVNPDEVVAMGAAIQGGVITGDVKDV

SEQ ID NO: 1667775 - protein, 24 aa, Staphylococcus aureus
GVNRPEHHKEFSLGNVSYLDHVLD

SEQ ID NO: 1667776 - protein, 26 aa, Staphylococcus aureus
GVNVASFTLAVNRTFTNAQGEREADF

SEQ ID NO: 1667777 - protein, 20 aa, Staphylococcus aureus
GVPIKAPVAGIAMGLVTRED

SEQ ID NO: 1667778 - protein, 22 aa, Staphylococcus aureus
GVQCIFTILQLMNLIILELSIL

SEQ ID NO: 1667779 - protein, 17 aa, Staphylococcus aureus
GVSGGWFGTTHHCLEDM

SEQ ID NO: 1667780 - protein, 28 aa, Staphylococcus aureus
GVSTARKVPEIKNGSVVMATGEVLEGGK

SEQ ID NO: 1667781 - protein, 19 aa, Staphylococcus aureus
GVSTRPGHEMISLEEELNR

SEQ ID NO: 1667782 - protein, 18 aa, Staphylococcus aureus
GVSTRPGHEMVSLEEEMN

SEQ ID NO: 1667783 - protein, 26 aa, Staphylococcus aureus
GVSVDKIWLDPGIGFAKTREEEAEVM

SEQ ID NO: 1667784 - protein, 18 aa, Staphylococcus aureus
GVTNVTGIVLTKLDGTAK

SEQ ID NO: 1667785 - protein, 19 aa, Staphylococcus aureus
GVTTLPCSTGLEGFLGSSF

SEQ ID NO: 1667786 - protein, 18 aa, Staphylococcus aureus
GWKARKFEDETGKKSSIS

SEQ ID NO: 1667787 - protein, 26 aa, Staphylococcus aureus
GYAIKKEIIEELGFDFSVSHNPYTES

SEQ ID NO: 1667788 - protein, 17 aa, Staphylococcus aureus
GYGVGRNNAMFSVALYY

SEQ ID NO: 1667789 - protein, 25 aa, Staphylococcus aureus
GYHPDYEFLKSVGIQINTNEFGTAP

SEQ ID NO: 1667790 - protein, 26 aa, Staphylococcus aureus
GYINCNHKLDFALAIRTMMIDEQYIN

SEQ ID NO: 1667791 - protein, 25 aa, Staphylococcus aureus
GYINCNHNLDFALAIRTMMIDEQYI

SEQ ID NO: 1667792 - protein, 20 aa, Staphylococcus aureus
GYLLKDGKVIKVYGDQDNVS

SEQ ID NO: 1667793 - protein, 18 aa, Staphylococcus aureus
GYMQKIFSQELRFKDENG

SEQ ID NO: 1667794 - protein, 18 aa, Staphylococcus aureus
GYNVINLDGGYKAYEEEN

SEQ ID NO: 1667795 - protein, 17 aa, Staphylococcus aureus
GYNVINLDGGYKAYEEN

SEQ ID NO: 1667796 - protein, 25 aa, Staphylococcus aureus
GYPKFDFIICDEAHRTTGITEEGKK

SEQ ID NO: 1667797 - protein, 25 aa, Staphylococcus aureus
GYQGKPLVCVGILKGSAMFMSDLIK

SEQ ID NO: 1667798 - protein, 17 aa, Staphylococcus aureus
GYRKLEIDFSKRENSKL

SEQ ID NO: 1667799 - protein, 22 aa, Staphylococcus aureus
GYRTAEGFEGYYMMKRMNAPFL

SEQ ID NO: 1667800 - protein, 25 aa, Staphylococcus aureus
GYSANSAHVTGCRLLKKPHIKQYIQ

SEQ ID NO: 1667801 - protein, 18 aa, Staphylococcus aureus
GYSDFLFLNRKDYPKTSD

SEQ ID NO: 1667802 - protein, 20 aa, Staphylococcus aureus
GYSGDYLKKMHVYLVSLLNH

SEQ ID NO: 1667803 - protein, 25 aa, Staphylococcus aureus
GYSKHFPSVFALIGSHSEYDLHHPQ

SEQ ID NO: 1667804 - protein, 23 aa, Staphylococcus aureus
GYTGCPIAGFKKNNIEKLLELDH

SEQ ID NO: 1667805 - protein, 18 aa, Staphylococcus aureus
GYVANLKYQFDINQKEKN

SEQ ID NO: 1667806 - protein, 27 aa, Staphylococcus aureus
GYYQSLKDSFNYGYKYLTDTYKSYKEK

SEQ ID NO: 1667807 - protein, 17 aa, Staphylococcus aureus
HAEPMPNIPEMRQVWEP

SEQ ID NO: 1667808 - protein, 19 aa, Staphylococcus aureus
HAFSEKLKALGYDIDKEAQ

SEQ ID NO: 1667809 - protein, 25 aa, Staphylococcus aureus
HAGQVCSAGSRILVQNSIKDKFKQA

SEQ ID NO: 1667810 - protein, 18 aa, Staphylococcus aureus
HAHLFQRYEWEDESVRYM

SEQ ID NO: 1667811 - protein, 31 aa, Staphylococcus aureus
HAIKLGEHLKHPFILKRIVGQSGMSYGALGK

SEQ ID NO: 1667812 - protein, 26 aa, Staphylococcus aureus
HAIKSARKKYPLTLEELGGKVGVSHA

SEQ ID NO: 1667813 - protein, 18 aa, Staphylococcus aureus
HARELIRLIQQLRKKKNL

SEQ ID NO: 1667814 - protein, 18 aa, Staphylococcus aureus
HASGALKNFGLTDHQVDV

SEQ ID NO: 1667815 - protein, 17 aa, Staphylococcus aureus
HAVEIIGIDIVREADGL

SEQ ID NO: 1667816 - protein, 19 aa, Staphylococcus aureus
HCEAFKANFKGAAQGDWVK

SEQ ID NO: 1667817 - protein, 22 aa, Staphylococcus aureus
HCGFGLGLERTVAWISGVEHVR

SEQ ID NO: 1667818 - protein, 36 aa, Staphylococcus aureus
HCNISESYCSILFVRYLSMNFKDYFTSIKLVNAINL

SEQ ID NO: 1667819 - protein, 18 aa, Staphylococcus aureus
HDDLGMAVSNSLAAIESG

SEQ ID NO: 1667820 - protein, 28 aa, Staphylococcus aureus
HDEAWHRFKYYVVVNHLGHLVSTIGKAT

SEQ ID NO: 1667821 - protein, 19 aa, Staphylococcus aureus
HDIARMEVPFDCDEYEINV

SEQ ID NO: 1667822 - protein, 23 aa, Staphylococcus aureus
HDIKSPMVGTFFLQDSKELTESI

SEQ ID NO: 1667823 - protein, 17 aa, Staphylococcus aureus
HDLKAFLSEYAKVDDGL

SEQ ID NO: 1667824 - protein, 30 aa, Staphylococcus aureus
HDLRLQDIFKFLNHRERLWLKLYLEGYKQF

SEQ ID NO: 1667825 - protein, 19 aa, Staphylococcus aureus
HDNEKRYPVKMVDNKIIPT

SEQ ID NO: 1667826 - protein, 19 aa, Staphylococcus aureus
HDPWTSCEFDFTRDGKLNV

SEQ ID NO: 1667827 - protein, 18 aa, Staphylococcus aureus
HDQPRVVSRFGDTSSEEM

SEQ ID NO: 1667828 - protein, 29 aa, Staphylococcus aureus
HDVVEVLRMLRLVIDMSKEPDLYLQISAI

SEQ ID NO: 1667829 - protein, 23 aa, Staphylococcus aureus
HDYHIALNIAIILAGGDLPRNTF

SEQ ID NO: 1667830 - protein, 18 aa, Staphylococcus aureus
HEALLCLDSTTGQNALSQ

SEQ ID NO: 1667831 - protein, 21 aa, Staphylococcus aureus
HEDYYRLILLSRHQNDIPMWL

SEQ ID NO: 1667832 - protein, 18 aa, Staphylococcus aureus
HEHFTAARDNQTFTVVEA

SEQ ID NO: 1667833 - protein, 17 aa, Staphylococcus aureus
HEIKYCDIGDYLSTQEK

SEQ ID NO: 1667834 - protein, 23 aa, Staphylococcus aureus
HEMRVIKDICNRVAVMEKGQVVE

SEQ ID NO: 1667835 - protein, 19 aa, Staphylococcus aureus
HEMVNVLLPGSVDFEKIYK

SEQ ID NO: 1667836 - protein, 30 aa, Staphylococcus aureus
HENGIPVYLGMPIGIVFEVEGKTIYHTGDT

SEQ ID NO: 1667837 - protein, 17 aa, Staphylococcus aureus
HEPLTSCEFDFTKEGEL

SEQ ID NO: 1667838 - protein, 22 aa, Staphylococcus aureus
HESIGYLADCYGFVQKGIQNMN

SEQ ID NO: 1667839 - protein, 22 aa, Staphylococcus aureus
HFAELAVKVADYMSVDTIAFGS

SEQ ID NO: 1667840 - protein, 19 aa, Staphylococcus aureus
HFDNEIGFYNVLRHSSSTY

SEQ ID NO: 1667841 - protein, 23 aa, Staphylococcus aureus
HFEMPLHLAKYYGGFRNREVVDY

SEQ ID NO: 1667842 - protein, 25 aa, Staphylococcus aureus
HFEQYKKFILDSGISSTQFVYNNLS

SEQ ID NO: 1667843 - protein, 28 aa, Staphylococcus aureus
HFGISGPAALRCSQFVYKEQKIKRHSIF

SEQ ID NO: 1667844 - protein, 23 aa, Staphylococcus aureus
HFKDKSDLCFYVIQRDLNTFITQ

SEQ ID NO: 1667845 - protein, 17 aa, Staphylococcus aureus
HFKSVCVNPTHVKYAAE

SEQ ID NO: 1667846 - protein, 23 aa, Staphylococcus aureus
HFLRPEIKFDGIDPLVKQMNDDK

SEQ ID NO: 1667847 - protein, 27 aa, Staphylococcus aureus
HFNYIRNGWCYGNTGVMTTLFLIGQAI

SEQ ID NO: 1667848 - protein, 27 aa, Staphylococcus aureus
HFNYIRNGWCYGNTGVMTTLFLIGQAL

SEQ ID NO: 1667849 - protein, 22 aa, Staphylococcus aureus
HFSEPHHLRLGFSQKGNTGKGT

SEQ ID NO: 1667850 - protein, 17 aa, Staphylococcus aureus
HFTAVFKQLFGGGNAEL

SEQ ID NO: 1667851 - protein, 24 aa, Staphylococcus aureus
HFYEANAALDFERELAYGKHLDIP

SEQ ID NO: 1667852 - protein, 19 aa, Staphylococcus aureus
HGAGCTFAAVTTAYLANGK

SEQ ID NO: 1667853 - protein, 20 aa, Staphylococcus aureus
HGAGSPCGKSLGAIPTSTLG

SEQ ID NO: 1667854 - protein, 17 aa, Staphylococcus aureus
HGDEALRAHGIEVECVD

SEQ ID NO: 1667855 - protein, 17 aa, Staphylococcus aureus
HGDIYGGMIPKVLDAKN

SEQ ID NO: 1667856 - protein, 17 aa, Staphylococcus aureus
HGELDVYKALNVANQKA

SEQ ID NO: 1667857 - protein, 25 aa, Staphylococcus aureus
HGELMIKGANVMNGYLYPTDLTDTF

SEQ ID NO: 1667858 - protein, 18 aa, Staphylococcus aureus
HGISTLRKVPEIKSTDGQ

SEQ ID NO: 1667859 - protein, 22 aa, Staphylococcus aureus
HGKTTLLDSIRHTKVTAGEAGG

SEQ ID NO: 1667860 - protein, 20 aa, Staphylococcus aureus
HGKYNLKVEPIENGLQVGNH

SEQ ID NO: 1667861 - protein, 17 aa, Staphylococcus aureus
HGNDYWKVYKVENGEDV

SEQ ID NO: 1667862 - protein, 22 aa, Staphylococcus aureus
HGQRLNDVILTYVASTGKMRAE

SEQ ID NO: 1667863 - protein, 17 aa, Staphylococcus aureus
HGSAIITLVERVSKMIT

SEQ ID NO: 1667864 - protein, 22 aa, Staphylococcus aureus
HGTESIDFIQEIKKKYSSIKIT

SEQ ID NO: 1667865 - protein, 17 aa, Staphylococcus aureus
HGTIRLLFKYRHKKKNE

SEQ ID NO: 1667866 - protein, 24 aa, Staphylococcus aureus
HGTKSSEFKPNFINDSLENETNSI

SEQ ID NO: 1667867 - protein, 17 aa, Staphylococcus aureus
HGVKVISMAFFVEENAP

SEQ ID NO: 1667868 - protein, 19 aa, Staphylococcus aureus
HHESHLFIRVIKDANNKRI

SEQ ID NO: 1667869 - protein, 18 aa, Staphylococcus aureus
HHGFDLKGTTRALFSTIS

SEQ ID NO: 1667870 - protein, 27 aa, Staphylococcus aureus
HHTHGLRFYIKKGFLMIELPSGRALAY

SEQ ID NO: 1667871 - protein, 17 aa, Staphylococcus aureus
HIDGDIKGSSIGYKKVE

SEQ ID NO: 1667872 - protein, 17 aa, Staphylococcus aureus
HIDGDLKGSSVGYRKLE

SEQ ID NO: 1667873 - protein, 19 aa, Staphylococcus aureus
HIDTVCVMVNPDLTTIEHV

SEQ ID NO: 1667874 - protein, 17 aa, Staphylococcus aureus
HIEMMCEMFKLRSFCEN

SEQ ID NO: 1667875 - protein, 21 aa, Staphylococcus aureus
HIFESMPYLYGDDINKLQGRP

SEQ ID NO: 1667876 - protein, 17 aa, Staphylococcus aureus
HIFKLDSAKHISDDDLD

SEQ ID NO: 1667877 - protein, 26 aa, Staphylococcus aureus
HIGEFSLRAGIIDIFPLIGEPIRIEL

SEQ ID NO: 1667878 - protein, 22 aa, Staphylococcus aureus
HIGHFPEMWLLSSSPSSAKIAA

SEQ ID NO: 1667879 - protein, 17 aa, Staphylococcus aureus
HIGHIKSIMELLKQNHI

SEQ ID NO: 1667880 - protein, 20 aa, Staphylococcus aureus
HIGLLKIDFLGLRNLSIIHQ

SEQ ID NO: 1667881 - protein, 25 aa, Staphylococcus aureus
HIGLRANKKDFGWIYSSSLASAAAV

SEQ ID NO: 1667882 - protein, 29 aa, Staphylococcus aureus
HIGRYLRYEFMPLKYKKRIVMNGEQESNT

SEQ ID NO: 1667883 - protein, 17 aa, Staphylococcus aureus
HIIDIPKRVFAKLDIPA

SEQ ID NO: 1667884 - protein, 18 aa, Staphylococcus aureus
HILDIPKYKQAFELDYVD

SEQ ID NO: 1667885 - protein, 17 aa, Staphylococcus aureus
HILEYKWQELSLPVSYE

SEQ ID NO: 1667886 - protein, 20 aa, Staphylococcus aureus
HILKVHGAYIDKKEITQKNI

SEQ ID NO: 1667887 - protein, 17 aa, Staphylococcus aureus
HIMDVISSFAISYDGYI

SEQ ID NO: 1667888 - protein, 19 aa, Staphylococcus aureus
HIMPVWSIKNRALKVRDED

SEQ ID NO: 1667889 - protein, 23 aa, Staphylococcus aureus
HIMRQKRVDTIFVVDRDKHLLGF

SEQ ID NO: 1667890 - protein, 17 aa, Staphylococcus aureus
HIPFCVRICTYCDFNKY

SEQ ID NO: 1667891 - protein, 28 aa, Staphylococcus aureus
HIQVLLLTFFFKYMKPLVQADRVFIALP

SEQ ID NO: 1667892 - protein, 23 aa, Staphylococcus aureus
HITKKKMLVGIYFKNEPLNIVNQ

SEQ ID NO: 1667893 - protein, 23 aa, Staphylococcus aureus
HITNKWSEMMLWSSQQRSQYTVQ

SEQ ID NO: 1667894 - protein, 22 aa, Staphylococcus aureus
HIVERLKLRIAFATAREAQEND

SEQ ID NO: 1667895 - protein, 22 aa, Staphylococcus aureus
HIVERLKLRIAFATAREEQEND

SEQ ID NO: 1667896 - protein, 24 aa, Staphylococcus aureus
HKAHGGEISPLFTGGHNNMVASIT

SEQ ID NO: 1667897 - protein, 25 aa, Staphylococcus aureus
HKAHGGEISPLFTGGHNNMVASITT

SEQ ID NO: 1667898 - protein, 17 aa, Staphylococcus aureus
HKAIKKTVTETIEYEEV

SEQ ID NO: 1667899 - protein, 24 aa, Staphylococcus aureus
HKDTEDFYISLKIVDVKQPEGDQR

SEQ ID NO: 1667900 - protein, 23 aa, Staphylococcus aureus
HKGTEQMLGMFANTLVYRGQPSP

SEQ ID NO: 1667901 - protein, 30 aa, Staphylococcus aureus
HKILLMVDWKDGREGVLTYDILDYIKEIIH

SEQ ID NO: 1667902 - protein, 27 aa, Staphylococcus aureus
HKKGVSWDYFDIGLFEFDSGYVEAIEA

SEQ ID NO: 1667903 - protein, 24 aa, Staphylococcus aureus
HKKSLPVPKYRYFKLNNNIQKMLY

SEQ ID NO: 1667904 - protein, 17 aa, Staphylococcus aureus
HKLEIAKSLGAHQTINS

SEQ ID NO: 1667905 - protein, 22 aa, Staphylococcus aureus
HKLNPELYKNGINITFKTAEPH

SEQ ID NO: 1667906 - protein, 19 aa, Staphylococcus aureus
HKMKCNVLADVIPEYDSNS

SEQ ID NO: 1667907 - protein, 22 aa, Staphylococcus aureus
HKMNYLMMFVHLWLMKDIFQHH

SEQ ID NO: 1667908 - protein, 17 aa, Staphylococcus aureus
HKPEIEQYLSIVAGQDV

SEQ ID NO: 1667909 - protein, 18 aa, Staphylococcus aureus
HKQPFLLIDKVVEYEEGQ

SEQ ID NO: 1667910 - protein, 22 aa, Staphylococcus aureus
HKSLIYRYDATLGTQITTNDIL

SEQ ID NO: 1667911 - protein, 17 aa, Staphylococcus aureus
HKTAVLFDGAANGVGTR

SEQ ID NO: 1667912 - protein, 22 aa, Staphylococcus aureus
HKTLRFDLDRIKEMHARSTKVK

SEQ ID NO: 1667913 - protein, 20 aa, Staphylococcus aureus
HKVITEWEIMGLRKVKIGKT

SEQ ID NO: 1667914 - protein, 17 aa, Staphylococcus aureus
HLANPKLPFGGVGASGM

SEQ ID NO: 1667915 - protein, 23 aa, Staphylococcus aureus
HLCKIEADVPIYYYGFKDSDDIY

SEQ ID NO: 1667916 - protein, 20 aa, Staphylococcus aureus
HLDIPAGAAVRFEPGDKKEV

SEQ ID NO: 1667917 - protein, 26 aa, Staphylococcus aureus
HLDRKLSERRIFPAIEIGRSSTRKEE

SEQ ID NO: 1667918 - protein, 25 aa, Staphylococcus aureus
HLDWPLIEVGQSFKALSQSIKEFRM

SEQ ID NO: 1667919 - protein, 18 aa, Staphylococcus aureus
HLEGGIIESIKQIGNDRR

SEQ ID NO: 1667920 - protein, 20 aa, Staphylococcus aureus
HLEGKFDINRLYKDVINVKG

SEQ ID NO: 1667921 - protein, 21 aa, Staphylococcus aureus
HLEHLIPRVELEDEVGEQNIT

SEQ ID NO: 1667922 - protein, 27 aa, Staphylococcus aureus
HLIALLRYGGGISYQLLDDHSNYISLY

SEQ ID NO: 1667923 - protein, 17 aa, Staphylococcus aureus
HLIDILKKLSHDEIEAF

SEQ ID NO: 1667924 - protein, 29 aa, Staphylococcus aureus
HLKNVDGFKALRFLRPRTAGRHYIIITLW

SEQ ID NO: 1667925 - protein, 25 aa, Staphylococcus aureus
HLKSDIQTLFYGRFYLRELATPDNT

SEQ ID NO: 1667926 - protein, 20 aa, Staphylococcus aureus
HLKSLKAFNYMPYFEHLDMN

SEQ ID NO: 1667927 - protein, 17 aa, Staphylococcus aureus
HLLKEGGRLNMVHRADR

SEQ ID NO: 1667928 - protein, 17 aa, Staphylococcus aureus
HLLKEGGRLNMVHRTDR

SEQ ID NO: 1667929 - protein, 25 aa, Staphylococcus aureus
HLMNLKEKFLVKLQERAIPFELNGS

SEQ ID NO: 1667930 - protein, 17 aa, Staphylococcus aureus
HLNEYWKLSSRGLYYKH

SEQ ID NO: 1667931 - protein, 17 aa, Staphylococcus aureus
HLNGVMFYDHIDKNHPL

SEQ ID NO: 1667932 - protein, 21 aa, Staphylococcus aureus
HLNICREMLLLMLAWDKGHLL

SEQ ID NO: 1667933 - protein, 24 aa, Staphylococcus aureus
HLPEKKRNIILLHYFMDMSDVEIA

SEQ ID NO: 1667934 - protein, 27 aa, Staphylococcus aureus
HLPEMKRYADIIVVCYHGRFEKDIESG

SEQ ID NO: 1667935 - protein, 19 aa, Staphylococcus aureus
HLPGLSIMKRMTRIAQTIN

SEQ ID NO: 1667936 - protein, 18 aa, Staphylococcus aureus
HLPKPVVFIDDIHDIEIS

SEQ ID NO: 1667937 - protein, 21 aa, Staphylococcus aureus
HLTIIKVAPLFSEDDRHKIRH

SEQ ID NO: 1667938 - protein, 19 aa, Staphylococcus aureus
HMFCNVPIDKGIMINELSE

SEQ ID NO: 1667939 - protein, 18 aa, Staphylococcus aureus
HMGGRIGVLTVVEGSTDE

SEQ ID NO: 1667940 - protein, 18 aa, Staphylococcus aureus
HMLVSIPPKLGVSSFVGY

SEQ ID NO: 1667941 - protein, 17 aa, Staphylococcus aureus
HMNPCGVGIGDTLEQAF

SEQ ID NO: 1667942 - protein, 27 aa, Staphylococcus aureus
HNATELNTAMGTLKHAIADKTNTLASS

SEQ ID NO: 1667943 - protein, 17 aa, Staphylococcus aureus
HNAYRYIGNELWIYSAV

SEQ ID NO: 1667944 - protein, 20 aa, Staphylococcus aureus
HNDLFIVSGKFDFRKQQRQL

SEQ ID NO: 1667945 - protein, 18 aa, Staphylococcus aureus
HNEIKMVQDLGVDVIVTD

SEQ ID NO: 1667946 - protein, 23 aa, Staphylococcus aureus
HNEWISMLGVVPVIRALREKAMA

SEQ ID NO: 1667947 - protein, 33 aa, Staphylococcus aureus
HNHVPPWILIIPLNFGETIKWLSILKPKDKQEV

SEQ ID NO: 1667948 - protein, 18 aa, Staphylococcus aureus
HNHYAFERIAQMLIESSV

SEQ ID NO: 1667949 - protein, 19 aa, Staphylococcus aureus
HNHYAFERIAQMLIESSVD

SEQ ID NO: 1667950 - protein, 35 aa, Staphylococcus aureus
HNKEKSWQIFYFIKEFIQSLDLLEEFNFNYFRGQR

SEQ ID NO: 1667951 - protein, 25 aa, Staphylococcus aureus
HNKGLDFAFGLSMTSKNVARYESIN

SEQ ID NO: 1667952 - protein, 20 aa, Staphylococcus aureus
HNVTRFLVIKNRQQFDQNAT

SEQ ID NO: 1667953 - protein, 19 aa, Staphylococcus aureus
HNYKVSKYWWSILLTNTNV

SEQ ID NO: 1667954 - protein, 19 aa, Staphylococcus aureus
HNYSINNIILIAGQNPEAT

SEQ ID NO: 1667955 - protein, 23 aa, Staphylococcus aureus
HNYSINNIMLIAGQNPEATAVAG

SEQ ID NO: 1667956 - protein, 19 aa, Staphylococcus aureus
HPDIVLLDLVMPGMNGIEI

SEQ ID NO: 1667957 - protein, 21 aa, Staphylococcus aureus
HPFFEYARSFDFIIVSDIGLI

SEQ ID NO: 1667958 - protein, 21 aa, Staphylococcus aureus
HPFKLGEEDPVFCKPQQTIEY

SEQ ID NO: 1667959 - protein, 22 aa, Staphylococcus aureus
HPILTKKAQAVIKFDDSLKRLL

SEQ ID NO: 1667960 - protein, 19 aa, Staphylococcus aureus
HPILTKKAQAVKKFDDSLK

SEQ ID NO: 1667961 - protein, 20 aa, Staphylococcus aureus
HPKMMLKIILYAYELNVPSA

SEQ ID NO: 1667962 - protein, 29 aa, Staphylococcus aureus
HPMSPLAKIFWMKHEWQDVFQRTTKFADI

SEQ ID NO: 1667963 - protein, 20 aa, Staphylococcus aureus
HPSLLPKYKGIDAIGQAYHS

SEQ ID NO: 1667964 - protein, 20 aa, Staphylococcus aureus
HPTAAFVAARAGAMAKHTDH

SEQ ID NO: 1667965 - protein, 17 aa, Staphylococcus aureus
HPYFDQDVVIIGGKNSA

SEQ ID NO: 1667966 - protein, 28 aa, Staphylococcus aureus
HQCLYVKLDPYWLYHLYDKDIVPFEGRE

SEQ ID NO: 1667967 - protein, 17 aa, Staphylococcus aureus
HQIRVLRVLDFHFQLVI

SEQ ID NO: 1667968 - protein, 21 aa, Staphylococcus aureus
HQLEEERQLSYSFDKSTNDRE

SEQ ID NO: 1667969 - protein, 26 aa, Staphylococcus aureus
HQLIIKFSSAWSFLVPAILQIDEDKI

SEQ ID NO: 1667970 - protein, 26 aa, Staphylococcus aureus
HQLIIKFSSAWSFLVPEILQIDEDKN

SEQ ID NO: 1667971 - protein, 17 aa, Staphylococcus aureus
HQLPLFRYLTAAQHGFL

SEQ ID NO: 1667972 - protein, 19 aa, Staphylococcus aureus
HQNLYTWGQCTYHVFNRRA

SEQ ID NO: 1667973 - protein, 19 aa, Staphylococcus aureus
HQSAIQWIWETVKQEGGNI

SEQ ID NO: 1667974 - protein, 17 aa, Staphylococcus aureus
HQTLKLNDLRSRVKLET

SEQ ID NO: 1667975 - protein, 18 aa, Staphylococcus aureus
HQTQIIKILSKVKPDPPR

SEQ ID NO: 1667976 - protein, 17 aa, Staphylococcus aureus
HQYKFLKDYYLCELLAH

SEQ ID NO: 1667977 - protein, 22 aa, Staphylococcus aureus
HRKRLISYGGLLKEIHKKLNLD

SEQ ID NO: 1667978 - protein, 18 aa, Staphylococcus aureus
HRLKEVDLNDVLKGMINH

SEQ ID NO: 1667979 - protein, 20 aa, Staphylococcus aureus
HRNNLVVPPGAWGDWINGGG

SEQ ID NO: 1667980 - protein, 18 aa, Staphylococcus aureus
HRYCIKSINNWEAVADIS

SEQ ID NO: 1667981 - protein, 18 aa, Staphylococcus aureus
HRYCVKSINNWEAVADIS

SEQ ID NO: 1667982 - protein, 17 aa, Staphylococcus aureus
HSFTELFSSLYQESVDV

SEQ ID NO: 1667983 - protein, 25 aa, Staphylococcus aureus
HSKSIWKGTSKWFSNSYKSLKDWTG

SEQ ID NO: 1667984 - protein, 24 aa, Staphylococcus aureus
HSKSIWRGTSKWFSNAYKSAKGWP

SEQ ID NO: 1667985 - protein, 25 aa, Staphylococcus aureus
HSKSIWRGTSKWFSSAYKSAKGWLT

SEQ ID NO: 1667986 - protein, 21 aa, Staphylococcus aureus
HSLFFKLAILYFTESGENVRR

SEQ ID NO: 1667987 - protein, 19 aa, Staphylococcus aureus
HSLGGREAVILGMSNGIPN

SEQ ID NO: 1667988 - protein, 24 aa, Staphylococcus aureus
HSNNRKRFTIAHEIGHFLHNHKNK

SEQ ID NO: 1667989 - protein, 21 aa, Staphylococcus aureus
HSPGSLTYVFDEFAVVGDTLF

SEQ ID NO: 1667990 - protein, 17 aa, Staphylococcus aureus
HSQCLKQNLIDNNSIFI

SEQ ID NO: 1667991 - protein, 29 aa, Staphylococcus aureus
HTATELNTAMTALKRAIADKAETKASGNY

SEQ ID NO: 1667992 - protein, 25 aa, Staphylococcus aureus
HTIMRKRLDMLAAFIESKVPDVEIK

SEQ ID NO: 1667993 - protein, 25 aa, Staphylococcus aureus
HTLIKWKKNIPDFLDAIKKGKEVSD

SEQ ID NO: 1667994 - protein, 32 aa, Staphylococcus aureus
HTPSQMGIRKPEFSSAISTISSSIAFDELLDY

SEQ ID NO: 1667995 - protein, 20 aa, Staphylococcus aureus
HTQFIIDEILAIKLPAEVIK

SEQ ID NO: 1667996 - protein, 29 aa, Staphylococcus aureus
HTQKRLAMVLVQFPPWFDCNAQNIKYILY

SEQ ID NO: 1667997 - protein, 27 aa, Staphylococcus aureus
HTSKPMIRKGPNIKLPSVSLLEEPQVI

SEQ ID NO: 1667998 - protein, 25 aa, Staphylococcus aureus
HTTDRKGHVIGMLEWALDYIVGNIE

SEQ ID NO: 1667999 - protein, 19 aa, Staphylococcus aureus
HTYKVSKYWWSILLINTNV

SEQ ID NO: 1668000 - protein, 19 aa, Staphylococcus aureus
HTYLQNIINEWAKSHSIGH

SEQ ID NO: 1668001 - protein, 17 aa, Staphylococcus aureus
HVFDSTGLLNINYQPKH

SEQ ID NO: 1668002 - protein, 25 aa, Staphylococcus aureus
HVGNWRDKFFKEREGKYQVEDDTTK

SEQ ID NO: 1668003 - protein, 24 aa, Staphylococcus aureus
HVGSWRDKFFKEREGKYQVEEKEA

SEQ ID NO: 1668004 - protein, 17 aa, Staphylococcus aureus
HVLFAGLGSSGLSATEF

SEQ ID NO: 1668005 - protein, 31 aa, Staphylococcus aureus
HVNGFDFKLLILKGHMGISIQVKDMNNIPIK

SEQ ID NO: 1668006 - protein, 30 aa, Staphylococcus aureus
HVNGFDFKLSILKGHMGISIQVKDMNNVPI

SEQ ID NO: 1668007 - protein, 18 aa, Staphylococcus aureus
HVRSNWKDVTDIIAAQLL

SEQ ID NO: 1668008 - protein, 25 aa, Staphylococcus aureus
HVSELKNRIPLVLEVKTDQYQSSTR

SEQ ID NO: 1668009 - protein, 18 aa, Staphylococcus aureus
HVVFFTFNQPDEWDSPCN

SEQ ID NO: 1668010 - protein, 18 aa, Staphylococcus aureus
HVVFFTFNQPDEWDSPFN

SEQ ID NO: 1668011 - protein, 18 aa, Staphylococcus aureus
HVVISLGGIDSFDAGAGM

SEQ ID NO: 1668012 - protein, 22 aa, Staphylococcus aureus
HVVQVHCCYVLVKKHKCIVISV

SEQ ID NO: 1668013 - protein, 18 aa, Staphylococcus aureus
HVYPRKGYNPTDERVKSL

SEQ ID NO: 1668014 - protein, 23 aa, Staphylococcus aureus
HYDAIKGKPMYKLYLYEYPDRLE

SEQ ID NO: 1668015 - protein, 21 aa, Staphylococcus aureus
HYFIEMNARIQVEHTVTEMRA

SEQ ID NO: 1668016 - protein, 17 aa, Staphylococcus aureus
HYISIFINGRYIKNFML

SEQ ID NO: 1668017 - protein, 29 aa, Staphylococcus aureus
HYLFNAELFKHFKKDAVFVNCARGSLVDT

SEQ ID NO: 1668018 - protein, 24 aa, Staphylococcus aureus
HYLNLRHCLSRNRYLNLSHYLILN

SEQ ID NO: 1668019 - protein, 31 aa, Staphylococcus aureus
HYRDNFWATADMKRLAGTTTLDNEEPKSTDV

SEQ ID NO: 1668020 - protein, 20 aa, Staphylococcus aureus
HYRKAYAHFIHQYMKQATPF

SEQ ID NO: 1668021 - protein, 17 aa, Staphylococcus aureus
IAAELGIGLSVGTFLLP

SEQ ID NO: 1668022 - protein, 21 aa, Staphylococcus aureus
IAARARGRYGGRPEKLNKQDL

SEQ ID NO: 1668023 - protein, 21 aa, Staphylococcus aureus
IADAIKIPVIAAGGIGDVRGV

SEQ ID NO: 1668024 - protein, 21 aa, Staphylococcus aureus
IADHDTIVAGGNYTNASPDKQ

SEQ ID NO: 1668025 - protein, 23 aa, Staphylococcus aureus
IAEIPLTREEYRLEQNERKRCEK

SEQ ID NO: 1668026 - protein, 18 aa, Staphylococcus aureus
IAEMLKERVNQEEQLIVV

SEQ ID NO: 1668027 - protein, 21 aa, Staphylococcus aureus
IAESVKLLFNVECEVKFAEGY

SEQ ID NO: 1668028 - protein, 25 aa, Staphylococcus aureus
IAGAILKKDLVEFAKKMDYSEYGGS

SEQ ID NO: 1668029 - protein, 18 aa, Staphylococcus aureus
IAGDGAFQMVMQDFATAV

SEQ ID NO: 1668030 - protein, 25 aa, Staphylococcus aureus
IAGNLGRLGETVAFLSASGQDSEWE

SEQ ID NO: 1668031 - protein, 24 aa, Staphylococcus aureus
IAGSYAERIPVIAITGAPTRAVEE

SEQ ID NO: 1668032 - protein, 24 aa, Staphylococcus aureus
IAGSYAERIPVIAITGAPTRAVEH

SEQ ID NO: 1668033 - protein, 17 aa, Staphylococcus aureus
IAHGVPADTVVSVANSG

SEQ ID NO: 1668034 - protein, 30 aa, Staphylococcus aureus
IAIERAAKVLGSWRLARLHIICNLRTMCHV

SEQ ID NO: 1668035 - protein, 21 aa, Staphylococcus aureus
IAIGVSNFYYAPILKDTEKEW

SEQ ID NO: 1668036 - protein, 17 aa, Staphylococcus aureus
IAIRGRVPVQLARKKFP

SEQ ID NO: 1668037 - protein, 25 aa, Staphylococcus aureus
IAKGIKDKWRFVFYFEGSQFSKYKF

SEQ ID NO: 1668038 - protein, 23 aa, Staphylococcus aureus
IAKQILNEWAEDVAEGIAQIQVM

SEQ ID NO: 1668039 - protein, 22 aa, Staphylococcus aureus
IAKRNPCEIAQAIVDNLDTEKA

SEQ ID NO: 1668040 - protein, 19 aa, Staphylococcus aureus
IAKSDPRNNISRKKSIIQS

SEQ ID NO: 1668041 - protein, 17 aa, Staphylococcus aureus
IALSKDEKVLWVTETTA

SEQ ID NO: 1668042 - protein, 27 aa, Staphylococcus aureus
IALVTPEHIVRAGARDAVKQQYEAKKQ

SEQ ID NO: 1668043 - protein, 19 aa, Staphylococcus aureus
IAMDDLKYELEVINEGHQI

SEQ ID NO: 1668044 - protein, 25 aa, Staphylococcus aureus
IAMTRARQDVTFSYRLMGSSGDDKE

SEQ ID NO: 1668045 - protein, 21 aa, Staphylococcus aureus
IANDSKYGLAGGVFSQNITRA

SEQ ID NO: 1668046 - protein, 27 aa, Staphylococcus aureus
IANEISGMIPVEWEKIYTIAYVDDQGG

SEQ ID NO: 1668047 - protein, 30 aa, Staphylococcus aureus
IANEISGMIPVEWEKVYTIAYVNDRGGEIV

SEQ ID NO: 1668048 - protein, 31 aa, Staphylococcus aureus
IANEISGMIPVEWEKVYTMAYIDDGGGEVFF

SEQ ID NO: 1668049 - protein, 26 aa, Staphylococcus aureus
IANEISNMIPVEWEKVYTMAYIDDGG

SEQ ID NO: 1668050 - protein, 30 aa, Staphylococcus aureus
IANKISSMIPVEWEKVYAIAYVDDEGGEVI

SEQ ID NO: 1668051 - protein, 25 aa, Staphylococcus aureus
IANRPTDGGLSWSDDHKSLIYRYDA

SEQ ID NO: 1668052 - protein, 24 aa, Staphylococcus aureus
IAPKKAEHFHIFMGNDNDALLKEM

SEQ ID NO: 1668053 - protein, 26 aa, Staphylococcus aureus
IAQKARACGIHMLVATQRPSVNVITG

SEQ ID NO: 1668054 - protein, 29 aa, Staphylococcus aureus
IAQTCYQFNVPFVVVRAVSDLANGEAEIS

SEQ ID NO: 1668055 - protein, 23 aa, Staphylococcus aureus
IAQVFLKVTLSFMQYGTLPELHG

SEQ ID NO: 1668056 - protein, 22 aa, Staphylococcus aureus
IAQVFLKVTLSFMQYGVLPELH

SEQ ID NO: 1668057 - protein, 18 aa, Staphylococcus aureus
IARIFNETVETIFIIEED

SEQ ID NO: 1668058 - protein, 23 aa, Staphylococcus aureus
IARVMEPGCKFDYMLTLYGPQGV

SEQ ID NO: 1668059 - protein, 21 aa, Staphylococcus aureus
IASCGCGSSFRTAKVAGNPEN

SEQ ID NO: 1668060 - protein, 21 aa, Staphylococcus aureus
IASGGELSRIMLALKSIFVKS

SEQ ID NO: 1668061 - protein, 19 aa, Staphylococcus aureus
IASNSIYRRTYSAAANLHI

SEQ ID NO: 1668062 - protein, 18 aa, Staphylococcus aureus
IATDLKLRKSKNDKSYVF

SEQ ID NO: 1668063 - protein, 17 aa, Staphylococcus aureus
IATGRPYTETVVPFENL

SEQ ID NO: 1668064 - protein, 19 aa, Staphylococcus aureus
IATSPIHLEHKLKMSQDDV

SEQ ID NO: 1668065 - protein, 27 aa, Staphylococcus aureus
IATVSKGGHLKIRLVANKGRGYALAEQ

SEQ ID NO: 1668066 - protein, 17 aa, Staphylococcus aureus
IAVKKAKDWYRALSKEE

SEQ ID NO: 1668067 - protein, 18 aa, Staphylococcus aureus
IAYFKVHHPLYYYASYFT

SEQ ID NO: 1668068 - protein, 17 aa, Staphylococcus aureus
ICIITDKAAKAFFKDHL

SEQ ID NO: 1668069 - protein, 21 aa, Staphylococcus aureus
ICKAPKYTGQEWMVYEDLVKV

SEQ ID NO: 1668070 - protein, 26 aa, Staphylococcus aureus
ICRQVCNFYPERIILLGHGENSIYLI

SEQ ID NO: 1668071 - protein, 27 aa, Staphylococcus aureus
ICRQVCNFYPERIILLGHGENSIYLIN

SEQ ID NO: 1668072 - protein, 19 aa, Staphylococcus aureus
ICTPEIFAKLLHTIATRNI

SEQ ID NO: 1668073 - protein, 17 aa, Staphylococcus aureus
IDAESFRKQTHLMNQKH

SEQ ID NO: 1668074 - protein, 27 aa, Staphylococcus aureus
IDAICDVLKNAGTIFLFGFGASSLTIG

SEQ ID NO: 1668075 - protein, 18 aa, Staphylococcus aureus
IDAIGFIHYEKSKSHQTI

SEQ ID NO: 1668076 - protein, 24 aa, Staphylococcus aureus
IDAIRYSVCNLIFKDKKTENKIDD

SEQ ID NO: 1668077 - protein, 23 aa, Staphylococcus aureus
IDAKGYHVVPGFIDIHIHGGYGQ

SEQ ID NO: 1668078 - protein, 17 aa, Staphylococcus aureus
IDALVNYISSLGYLSDD

SEQ ID NO: 1668079 - protein, 19 aa, Staphylococcus aureus
IDARIYPVGRLDYDTSGLL

SEQ ID NO: 1668080 - protein, 28 aa, Staphylococcus aureus
IDAYLKVAYQFSLPFGKDYADAHEEMIR

SEQ ID NO: 1668081 - protein, 23 aa, Staphylococcus aureus
IDDLKRLLVKYERHREDPVLWDN

SEQ ID NO: 1668082 - protein, 24 aa, Staphylococcus aureus
IDEADLMIDLGLIEDVDYIAARLE

SEQ ID NO: 1668083 - protein, 39 aa, Staphylococcus aureus
IDEILAIKLPAEVIKASPKVGQPAPKVCTPIKKEDKQEV

SEQ ID NO: 1668084 - protein, 22 aa, Staphylococcus aureus
IDEKILKVDGFLNHQIDAKLMN

SEQ ID NO: 1668085 - protein, 25 aa, Staphylococcus aureus
IDEKLQWKWVKGIIEAYQEAFPELN

SEQ ID NO: 1668086 - protein, 22 aa, Staphylococcus aureus
IDELNIYYSHYVSVLENNPTSR

SEQ ID NO: 1668087 - protein, 26 aa, Staphylococcus aureus
IDFDKPKLEMWIDVLSQNGDYQPTAK

SEQ ID NO: 1668088 - protein, 18 aa, Staphylococcus aureus
IDFELSLRPTRLRQYIGQ

SEQ ID NO: 1668089 - protein, 20 aa, Staphylococcus aureus
IDFNSGYILISTGYKSFNEV

SEQ ID NO: 1668090 - protein, 25 aa, Staphylococcus aureus
IDGGHRVSSLIAWIHDDFGKNDINS

SEQ ID NO: 1668091 - protein, 17 aa, Staphylococcus aureus
IDHILKVHGAYIDKKEI

SEQ ID NO: 1668092 - protein, 17 aa, Staphylococcus aureus
IDHLYGIPGDSIDAVVD

SEQ ID NO: 1668093 - protein, 17 aa, Staphylococcus aureus
IDICSGLAQKGFKPYFS

SEQ ID NO: 1668094 - protein, 25 aa, Staphylococcus aureus
IDIDFPKKRQCAILEDAKVTAVMSY

SEQ ID NO: 1668095 - protein, 18 aa, Staphylococcus aureus
IDIPEVNQVVMLRPTESS

SEQ ID NO: 1668096 - protein, 19 aa, Staphylococcus aureus
IDIPEVNQVVMLRPTESSI

SEQ ID NO: 1668097 - protein, 17 aa, Staphylococcus aureus
IDIPSDVTVTFDGNYVT

SEQ ID NO: 1668098 - protein, 18 aa, Staphylococcus aureus
IDISRFLELSNMILLLDD

SEQ ID NO: 1668099 - protein, 17 aa, Staphylococcus aureus
IDISSKVQALAQKYREI

SEQ ID NO: 1668100 - protein, 17 aa, Staphylococcus aureus
IDKALSWVNLQSKDILN

SEQ ID NO: 1668101 - protein, 23 aa, Staphylococcus aureus
IDKEINKLMALIECTTTVNDITE

SEQ ID NO: 1668102 - protein, 23 aa, Staphylococcus aureus
IDKESKQLAAIKQWLLNPETNSA

SEQ ID NO: 1668103 - protein, 24 aa, Staphylococcus aureus
IDKESKQLAAIKQWLPDPETNSAI

SEQ ID NO: 1668104 - protein, 25 aa, Staphylococcus aureus
IDKNNAKNVLFDWNDVEVHRNKNFD

SEQ ID NO: 1668105 - protein, 23 aa, Staphylococcus aureus
IDLDELYDELQIAEFNDKAKTAD

SEQ ID NO: 1668106 - protein, 24 aa, Staphylococcus aureus
IDLLRLLHSQGLSFILLNQFNDIL

SEQ ID NO: 1668107 - protein, 18 aa, Staphylococcus aureus
IDLSKRLHSDLANVYVKN

SEQ ID NO: 1668108 - protein, 20 aa, Staphylococcus aureus
IDLTELIVAYQRVKNRVALN

SEQ ID NO: 1668109 - protein, 20 aa, Staphylococcus aureus
IDLTELIVAYQRVKNRVELN

SEQ ID NO: 1668110 - protein, 21 aa, Staphylococcus aureus
IDMTKYYLKVPISITNTSTKR

SEQ ID NO: 1668111 - protein, 17 aa, Staphylococcus aureus
IDNFKKFVHRNHRHERW

SEQ ID NO: 1668112 - protein, 19 aa, Staphylococcus aureus
IDNLRLRYEHVGYHGQPLV

SEQ ID NO: 1668113 - protein, 20 aa, Staphylococcus aureus
IDPALIPFIMEKQVKLLNKY

SEQ ID NO: 1668114 - protein, 17 aa, Staphylococcus aureus
IDPAVWKSLKAVKDNKV

SEQ ID NO: 1668115 - protein, 33 aa, Staphylococcus aureus
IDPDVLRFFMISVHYRSPINYNLELVESARSGL

SEQ ID NO: 1668116 - protein, 21 aa, Staphylococcus aureus
IDPKNGVVFYNLANVYYNQQR

SEQ ID NO: 1668117 - protein, 17 aa, Staphylococcus aureus
IDPVIGLSPFQARRIAF

SEQ ID NO: 1668118 - protein, 25 aa, Staphylococcus aureus
IDQKSRLKLLNELARKQMKSLLNSR

SEQ ID NO: 1668119 - protein, 19 aa, Staphylococcus aureus
IDRYNFYGVSGKFTEDAGV

SEQ ID NO: 1668120 - protein, 26 aa, Staphylococcus aureus
IDSYNLWWYGCIEGKAISVNIAEKLN

SEQ ID NO: 1668121 - protein, 21 aa, Staphylococcus aureus
IDSYNLWWYGGIEGKAISVNI

SEQ ID NO: 1668122 - protein, 23 aa, Staphylococcus aureus
IDTLKEFGCGCVYSERISGVKRT

SEQ ID NO: 1668123 - protein, 23 aa, Staphylococcus aureus
IDTNCSRGEWGFDPKYDLASMTK

SEQ ID NO: 1668124 - protein, 22 aa, Staphylococcus aureus
IDVESDLSCDIETLVESDSLID

SEQ ID NO: 1668125 - protein, 18 aa, Staphylococcus aureus
IDVIKGIIAFSSNKKNNS

SEQ ID NO: 1668126 - protein, 34 aa, Staphylococcus aureus
IDVLKEPDALVLVDWLCDIESLNDVDVLVELESL

SEQ ID NO: 1668127 - protein, 24 aa, Staphylococcus aureus
IDVPEYAEILAWFDAIGKKRGLIR

SEQ ID NO: 1668128 - protein, 22 aa, Staphylococcus aureus
IDVRLGDGLSVIHPEDVIDNIT

SEQ ID NO: 1668129 - protein, 17 aa, Staphylococcus aureus
IDYKCFSLYDGRNCIIK

SEQ ID NO: 1668130 - protein, 17 aa, Staphylococcus aureus
IDYYTNKLEVFRNAENI

SEQ ID NO: 1668131 - protein, 24 aa, Staphylococcus aureus
IEAMISKRPVVAFDIKYGPSDFIE

SEQ ID NO: 1668132 - protein, 21 aa, Staphylococcus aureus
IEANDAWKKLVDKLKEKHIVK

SEQ ID NO: 1668133 - protein, 25 aa, Staphylococcus aureus
IEANYKYARGVAVYGDIKNFANDQG

SEQ ID NO: 1668134 - protein, 25 aa, Staphylococcus aureus
IEANYKYARGVAVYGDIKNGANNHG

SEQ ID NO: 1668135 - protein, 20 aa, Staphylococcus aureus
IEARCQCLSEVELDNLNQLL

SEQ ID NO: 1668136 - protein, 19 aa, Staphylococcus aureus
IEARIYPVGRLDYDTSGLL

SEQ ID NO: 1668137 - protein, 29 aa, Staphylococcus aureus
IEARVIAWYAKEQWRLDVFNTHGKIYEAS

SEQ ID NO: 1668138 - protein, 30 aa, Staphylococcus aureus
IEARVIAWYAKEQWRLDVFNTHGKIYEASA

SEQ ID NO: 1668139 - protein, 17 aa, Staphylococcus aureus
IEASLVQYGGWESVRFQ

SEQ ID NO: 1668140 - protein, 19 aa, Staphylococcus aureus
IECTYYQYWGKKTERKTIE

SEQ ID NO: 1668141 - protein, 21 aa, Staphylococcus aureus
IEDIYQLPGHVFIFGGQTLYE

SEQ ID NO: 1668142 - protein, 18 aa, Staphylococcus aureus
IEDNLDWLCKQVATTLDT

SEQ ID NO: 1668143 - protein, 20 aa, Staphylococcus aureus
IEEELKILLIPKDPNDDKDV

SEQ ID NO: 1668144 - protein, 20 aa, Staphylococcus aureus
IEEHKNEIIGNIGDQTTDDG

SEQ ID NO: 1668145 - protein, 23 aa, Staphylococcus aureus
IEFKDGIPDVCFVRDLEGICLSR

SEQ ID NO: 1668146 - protein, 23 aa, Staphylococcus aureus
IEFKGFLGNNIVKFFDYTFASVG

SEQ ID NO: 1668147 - protein, 17 aa, Staphylococcus aureus
IEFVARAVAQSHFKVLE

SEQ ID NO: 1668148 - protein, 17 aa, Staphylococcus aureus
IEFYSPIVDYFGDSISV

SEQ ID NO: 1668149 - protein, 18 aa, Staphylococcus aureus
IEGFLYWIKDEKIDWPSE

SEQ ID NO: 1668150 - protein, 20 aa, Staphylococcus aureus
IEGFTVRIVDKFNAEQILTM

SEQ ID NO: 1668151 - protein, 20 aa, Staphylococcus aureus
IEGKIKIGLESEDLEILATN

SEQ ID NO: 1668152 - protein, 26 aa, Staphylococcus aureus
IEGVVVRLANFGAFVEIASGVQGLVH

SEQ ID NO: 1668153 - protein, 23 aa, Staphylococcus aureus
IEHHQCGVALYQLIPSKKEGEPD

SEQ ID NO: 1668154 - protein, 23 aa, Staphylococcus aureus
IEHHQCGVVLYQLIPSKKEGEPD

SEQ ID NO: 1668155 - protein, 23 aa, Staphylococcus aureus
IEIADLLNLKVSWIDSKNKEQIF

SEQ ID NO: 1668156 - protein, 23 aa, Staphylococcus aureus
IEIGPGKVLSGLIKKVNRDVKLT

SEQ ID NO: 1668157 - protein, 28 aa, Staphylococcus aureus
IEIGYLPGRLKWLVAELLTKQGLKVVND

SEQ ID NO: 1668158 - protein, 18 aa, Staphylococcus aureus
IEIIKMLQAHPAVQQVFH

SEQ ID NO: 1668159 - protein, 19 aa, Staphylococcus aureus
IEITEYIKAHYPEIKVLVL

SEQ ID NO: 1668160 - protein, 18 aa, Staphylococcus aureus
IEKGEFAVIVGLSGAGKS

SEQ ID NO: 1668161 - protein, 28 aa, Staphylococcus aureus
IEKGNAILKLNGYFVASILETLNLNRVK

SEQ ID NO: 1668162 - protein, 23 aa, Staphylococcus aureus
IEKGSEVLKAFSPEFYTEGYGYV

SEQ ID NO: 1668163 - protein, 24 aa, Staphylococcus aureus
IEKTLVASKRWIRYIHEVEEPDSL

SEQ ID NO: 1668164 - protein, 17 aa, Staphylococcus aureus
IELAERGHEVHFITSNI

SEQ ID NO: 1668165 - protein, 17 aa, Staphylococcus aureus
IELAIEMLAQHLITKPV

SEQ ID NO: 1668166 - protein, 20 aa, Staphylococcus aureus
IELDEAVGIMTGQVVYEYEE

SEQ ID NO: 1668167 - protein, 21 aa, Staphylococcus aureus
IELGCTAMAIFKYIEKKSYEG

SEQ ID NO: 1668168 - protein, 20 aa, Staphylococcus aureus
IELIKRLVSYVPKIELHMYG

SEQ ID NO: 1668169 - protein, 18 aa, Staphylococcus aureus
IELPMKYDELIVDPLSFV

SEQ ID NO: 1668170 - protein, 37 aa, Staphylococcus aureus
IELVGNLLPGDYFGTIRFGRKEQLFEIRVKPHTPTII

SEQ ID NO: 1668171 - protein, 22 aa, Staphylococcus aureus
IELVKVDGRISVITFHSLEDRL

SEQ ID NO: 1668172 - protein, 24 aa, Staphylococcus aureus
IELVKVEGRISVITFHSLEDRLCK

SEQ ID NO: 1668173 - protein, 20 aa, Staphylococcus aureus
IENFKFFGQYADFKDLKNYQ

SEQ ID NO: 1668174 - protein, 24 aa, Staphylococcus aureus
IENFKFFGQYADFKSLKSYNNGDV

SEQ ID NO: 1668175 - protein, 18 aa, Staphylococcus aureus
IENFKFFSQYADFKDLKN

SEQ ID NO: 1668176 - protein, 18 aa, Staphylococcus aureus
IENFKFFSQYGSFRGLKN

SEQ ID NO: 1668177 - protein, 20 aa, Staphylococcus aureus
IENFKFFVQYGSFKGIENYE

SEQ ID NO: 1668178 - protein, 20 aa, Staphylococcus aureus
IENFKFLSQYADFKDLKNYQ

SEQ ID NO: 1668179 - protein, 18 aa, Staphylococcus aureus
IENLMIFRREYKASERQL

SEQ ID NO: 1668180 - protein, 17 aa, Staphylococcus aureus
IENLRKRGIKGLVVIGG

SEQ ID NO: 1668181 - protein, 19 aa, Staphylococcus aureus
IENNNKWLGHYGYNVSSEW

SEQ ID NO: 1668182 - protein, 17 aa, Staphylococcus aureus
IENRPVLQEALNFLRMG

SEQ ID NO: 1668183 - protein, 23 aa, Staphylococcus aureus
IENSHTKFFFGMDNVGVDDVVDK

SEQ ID NO: 1668184 - protein, 17 aa, Staphylococcus aureus
IENVMKGKIKKPTFNDW

SEQ ID NO: 1668185 - protein, 18 aa, Staphylococcus aureus
IEPARLDQQIIAYAQEVF

SEQ ID NO: 1668186 - protein, 34 aa, Staphylococcus aureus
IEPQTLKLFKVCKLRGIPIFTFINKLDRVGKEPF

SEQ ID NO: 1668187 - protein, 19 aa, Staphylococcus aureus
IEPSPIWMQAHLIKAGIRP

SEQ ID NO: 1668188 - protein, 22 aa, Staphylococcus aureus
IEPYFHKVILLSGALRLDTLES

SEQ ID NO: 1668189 - protein, 18 aa, Staphylococcus aureus
IEQARLKFKSEVEKNGYF

SEQ ID NO: 1668190 - protein, 25 aa, Staphylococcus aureus
IEQKKGPFAPDFIKVWNERYKKIRQ

SEQ ID NO: 1668191 - protein, 22 aa, Staphylococcus aureus
IEQMSLCELVGVEAKQYVQSSG

SEQ ID NO: 1668192 - protein, 17 aa, Staphylococcus aureus
IEQSNKLFLLFINTYGE

SEQ ID NO: 1668193 - protein, 20 aa, Staphylococcus aureus
IEQSNKLFLLFINTYGEIFE

SEQ ID NO: 1668194 - protein, 27 aa, Staphylococcus aureus
IEQSTLKSAFAFGISRAGMFINNEDTF

SEQ ID NO: 1668195 - protein, 20 aa, Staphylococcus aureus
IEQYCQFNGYELVDIYADRG

SEQ ID NO: 1668196 - protein, 24 aa, Staphylococcus aureus
IEQYCQFNGYELVDIYADRGISGK

SEQ ID NO: 1668197 - protein, 23 aa, Staphylococcus aureus
IERKGLKLVGGKLMQVPMEHAET

SEQ ID NO: 1668198 - protein, 20 aa, Staphylococcus aureus
IERYPSRRLKISDGALQDCD

SEQ ID NO: 1668199 - protein, 18 aa, Staphylococcus aureus
IESAERLSLPEARIPLSQ

SEQ ID NO: 1668200 - protein, 22 aa, Staphylococcus aureus
IESDPMGGYAINGYINNNKDLS

SEQ ID NO: 1668201 - protein, 23 aa, Staphylococcus aureus
IESKEHYRILCIDGGSTDQTIPM

SEQ ID NO: 1668202 - protein, 22 aa, Staphylococcus aureus
IESKRGGGGYIRITKIENRDAT

SEQ ID NO: 1668203 - protein, 21 aa, Staphylococcus aureus
IESMASFLNSFLMFKDDTRNT

SEQ ID NO: 1668204 - protein, 17 aa, Staphylococcus aureus
IESSYIFESTFFADVLD

SEQ ID NO: 1668205 - protein, 24 aa, Staphylococcus aureus
IESVNELGPYIVIAPEIAIAHARP

SEQ ID NO: 1668206 - protein, 17 aa, Staphylococcus aureus
IETFEFYCRLRDELKNS

SEQ ID NO: 1668207 - protein, 26 aa, Staphylococcus aureus
IETLKESKPYLFAPSKPVGNSPQQGD

SEQ ID NO: 1668208 - protein, 17 aa, Staphylococcus aureus
IETMLAGWLGYSACTIL

SEQ ID NO: 1668209 - protein, 21 aa, Staphylococcus aureus
IETPSNPLLRVTDIKKSAEIA

SEQ ID NO: 1668210 - protein, 18 aa, Staphylococcus aureus
IETQTVWTDRGVHFYFKK

SEQ ID NO: 1668211 - protein, 19 aa, Staphylococcus aureus
IETRFWRVSDLVSELERQW

SEQ ID NO: 1668212 - protein, 24 aa, Staphylococcus aureus
IEVPEDAEILAWFDAIGKKRGLIR

SEQ ID NO: 1668213 - protein, 23 aa, Staphylococcus aureus
IEVVKRLQGIRSRIYNSQQNGQV

SEQ ID NO: 1668214 - protein, 17 aa, Staphylococcus aureus
IEVWGKFTPRGGISIDP

SEQ ID NO: 1668215 - protein, 18 aa, Staphylococcus aureus
IEYLKAHITAAMEAVDQD

SEQ ID NO: 1668216 - protein, 18 aa, Staphylococcus aureus
IFAREWQNRVLPHHLPFI

SEQ ID NO: 1668217 - protein, 22 aa, Staphylococcus aureus
IFASARPIRYLLPVLPSVFHQH

SEQ ID NO: 1668218 - protein, 17 aa, Staphylococcus aureus
IFDAMTYALFGKASTEQ

SEQ ID NO: 1668219 - protein, 24 aa, Staphylococcus aureus
IFEILRQYRNVIAHGQRFYSYRSD

SEQ ID NO: 1668220 - protein, 18 aa, Staphylococcus aureus
IFEKVFAEHFLNLYEKTK

SEQ ID NO: 1668221 - protein, 18 aa, Staphylococcus aureus
IFENYTLDYDIVFSPMFV

SEQ ID NO: 1668222 - protein, 17 aa, Staphylococcus aureus
IFESVRILRDKLPLRRD

SEQ ID NO: 1668223 - protein, 17 aa, Staphylococcus aureus
IFESYAKGHGYRKIANA

SEQ ID NO: 1668224 - protein, 25 aa, Staphylococcus aureus
IFITCNYRLGALGYLDWSYFNKGFH

SEQ ID NO: 1668225 - protein, 23 aa, Staphylococcus aureus
IFKNSWFKVYRMFDELRETFKEE

SEQ ID NO: 1668226 - protein, 27 aa, Staphylococcus aureus
IFKNSWFKVYRMFDELRETFKEEGLEP

SEQ ID NO: 1668227 - protein, 24 aa, Staphylococcus aureus
IFKNSWFKVYRMFDELRETFKKED

SEQ ID NO: 1668228 - protein, 18 aa, Staphylococcus aureus
IFKSITFDCGKEFSNWKT

SEQ ID NO: 1668229 - protein, 27 aa, Staphylococcus aureus
IFMDLWMKVYRMFDELRETFKKEDLEP

SEQ ID NO: 1668230 - protein, 17 aa, Staphylococcus aureus
IFNTTKFFHLKKGNTVL

SEQ ID NO: 1668231 - protein, 24 aa, Staphylococcus aureus
IFNVLRLARRYILTNKSGANVLRY

SEQ ID NO: 1668232 - protein, 20 aa, Staphylococcus aureus
IFPKKEFYIHIQQFPENDSP

SEQ ID NO: 1668233 - protein, 25 aa, Staphylococcus aureus
IFQFNSRFLVYFAVDHFNVLMTTKL

SEQ ID NO: 1668234 - protein, 26 aa, Staphylococcus aureus
IFRPQLRALLRASVYGKLNIMFPMVA

SEQ ID NO: 1668235 - protein, 20 aa, Staphylococcus aureus
IFSKFSNYYEFLVRYNKIDT

SEQ ID NO: 1668236 - protein, 17 aa, Staphylococcus aureus
IFTGTPIMFTAVHNIND

SEQ ID NO: 1668237 - protein, 27 aa, Staphylococcus aureus
IFVAGKGRSGFVANSFAMRLNQLDKQA

SEQ ID NO: 1668238 - protein, 27 aa, Staphylococcus aureus
IFVAGKGRSGFVANSFAMRLNQLGKKA

SEQ ID NO: 1668239 - protein, 19 aa, Staphylococcus aureus
IFYDIDLCLDFLLDNNFSL

SEQ ID NO: 1668240 - protein, 26 aa, Staphylococcus aureus
IFYDPKHPYTWGLLSSMPDLSTTNDT

SEQ ID NO: 1668241 - protein, 23 aa, Staphylococcus aureus
IGAITKMWTITHVEGEDDFNEYV

SEQ ID NO: 1668242 - protein, 20 aa, Staphylococcus aureus
IGAITKMWTITNVKGEDDLN

SEQ ID NO: 1668243 - protein, 17 aa, Staphylococcus aureus
IGAIVLHEGNIAEMQTG

SEQ ID NO: 1668244 - protein, 22 aa, Staphylococcus aureus
IGALGICAGGGYTIKAAQTEKR

SEQ ID NO: 1668245 - protein, 20 aa, Staphylococcus aureus
IGCSGRLSGYINSYGVHSIH

SEQ ID NO: 1668246 - protein, 18 aa, Staphylococcus aureus
IGDFFKKMDILISKQKIK

SEQ ID NO: 1668247 - protein, 19 aa, Staphylococcus aureus
IGDFFKKMDILISKQKMKI

SEQ ID NO: 1668248 - protein, 26 aa, Staphylococcus aureus
IGDVRGVRAAFCLGAEGVFVGSVLIP

SEQ ID NO: 1668249 - protein, 17 aa, Staphylococcus aureus
IGEDINVTANILIDGET

SEQ ID NO: 1668250 - protein, 20 aa, Staphylococcus aureus
IGENKLRRLAEENKNENWLI

SEQ ID NO: 1668251 - protein, 19 aa, Staphylococcus aureus
IGFGLLERPVVRWLSDEEW

SEQ ID NO: 1668252 - protein, 18 aa, Staphylococcus aureus
IGGELDVYTVPELEEVLT

SEQ ID NO: 1668253 - protein, 17 aa, Staphylococcus aureus
IGIAGFFGLPIQKDAVG

SEQ ID NO: 1668254 - protein, 17 aa, Staphylococcus aureus
IGIFGGFVGSREHFGMN

SEQ ID NO: 1668255 - protein, 20 aa, Staphylococcus aureus
IGIHAFKLGFIINAVNRELP

SEQ ID NO: 1668256 - protein, 24 aa, Staphylococcus aureus
IGISTNRDSWVYSFSKDSSRENTL

SEQ ID NO: 1668257 - protein, 18 aa, Staphylococcus aureus
IGKKLLDLHLNYEAVAPC

SEQ ID NO: 1668258 - protein, 18 aa, Staphylococcus aureus
IGKTEIIPNEFIAEKKER

SEQ ID NO: 1668259 - protein, 17 aa, Staphylococcus aureus
IGLAALVDRGHRELPIR

SEQ ID NO: 1668260 - protein, 19 aa, Staphylococcus aureus
IGLNILKGYLWSDYMIENI

SEQ ID NO: 1668261 - protein, 26 aa, Staphylococcus aureus
IGLSNLRHSSIDWSIFDFEKPKEVVV

SEQ ID NO: 1668262 - protein, 19 aa, Staphylococcus aureus
IGMKNVILIALDLAIKEDK

SEQ ID NO: 1668263 - protein, 20 aa, Staphylococcus aureus
IGSSEMNVDMAIEMYEGNHR

SEQ ID NO: 1668264 - protein, 21 aa, Staphylococcus aureus
IGTACLNNGKFSMSKIVHHPH

SEQ ID NO: 1668265 - protein, 25 aa, Staphylococcus aureus
IGTYFKRTCNLCGHSQKFNKDNPKK

SEQ ID NO: 1668266 - protein, 20 aa, Staphylococcus aureus
IGVSRFAMMNNLEAYIVLNE

SEQ ID NO: 1668267 - protein, 27 aa, Staphylococcus aureus
IGYHPDYEFLKSVGIQINTNEFGTAPM

SEQ ID NO: 1668268 - protein, 21 aa, Staphylococcus aureus
IGYTMPPKFYDLSALQEDMND

SEQ ID NO: 1668269 - protein, 17 aa, Staphylococcus aureus
IHDVRDLLQYKIDNYDN

SEQ ID NO: 1668270 - protein, 19 aa, Staphylococcus aureus
IHDVVTYGYVWRFEGNEII

SEQ ID NO: 1668271 - protein, 23 aa, Staphylococcus aureus
IHEKLYDLIMCHLQRYKNKNDQI

SEQ ID NO: 1668272 - protein, 23 aa, Staphylococcus aureus
IHEKLYDLIMCHLQRYKNKNDQM

SEQ ID NO: 1668273 - protein, 20 aa, Staphylococcus aureus
IHIASYLPIKHPFDQALYQT

SEQ ID NO: 1668274 - protein, 17 aa, Staphylococcus aureus
IHIPDSFVIAGNVGTPE

SEQ ID NO: 1668275 - protein, 25 aa, Staphylococcus aureus
IHKGKRKGMPFTQHMVRAHLNHLAK

SEQ ID NO: 1668276 - protein, 23 aa, Staphylococcus aureus
IHLPNGIKISNRFVLSPMTINAS

SEQ ID NO: 1668277 - protein, 17 aa, Staphylococcus aureus
IHNCLKQPIDDAIQEGL

SEQ ID NO: 1668278 - protein, 18 aa, Staphylococcus aureus
IHQCQQVIHLIRIMCLIK

SEQ ID NO: 1668279 - protein, 20 aa, Staphylococcus aureus
IHRIKCNAGFGHKDTTKTAG

SEQ ID NO: 1668280 - protein, 20 aa, Staphylococcus aureus
IHRIKYDMIQANPLKQEVYK

SEQ ID NO: 1668281 - protein, 19 aa, Staphylococcus aureus
IHRKIKHAKHMKMLLNGLD

SEQ ID NO: 1668282 - protein, 20 aa, Staphylococcus aureus
IHTATAMKVFGVEADQVDIL

SEQ ID NO: 1668283 - protein, 24 aa, Staphylococcus aureus
IHTLCRQLLLDGCRVAQAEGLDFS

SEQ ID NO: 1668284 - protein, 17 aa, Staphylococcus aureus
IHVPVLFEAAEEGDDIA

SEQ ID NO: 1668285 - protein, 24 aa, Staphylococcus aureus
IIAIPDWFWSYQMAMTLNEETCFE

SEQ ID NO: 1668286 - protein, 18 aa, Staphylococcus aureus
IICLKSCDLTTILHNLYK

SEQ ID NO: 1668287 - protein, 19 aa, Staphylococcus aureus
IICNDAIELNEYFRDGEVS

SEQ ID NO: 1668288 - protein, 17 aa, Staphylococcus aureus
IIDAIGQLIGMRASSDF

SEQ ID NO: 1668289 - protein, 20 aa, Staphylococcus aureus
IIDRYFFKSLYYRHNSIMYE

SEQ ID NO: 1668290 - protein, 25 aa, Staphylococcus aureus
IIDVSRVALDYALTGLEFACGIPGS

SEQ ID NO: 1668291 - protein, 20 aa, Staphylococcus aureus
IIENADASAKEIARTDLGRY

SEQ ID NO: 1668292 - protein, 26 aa, Staphylococcus aureus
IIFITCNYRLGALGYLDWSYFNKGFH

SEQ ID NO: 1668293 - protein, 24 aa, Staphylococcus aureus
IIGLSDLRNSQINWADFSFERPEQ

SEQ ID NO: 1668294 - protein, 25 aa, Staphylococcus aureus
IIGLSDLRNSQINWADFSFERPEQT

SEQ ID NO: 1668295 - protein, 23 aa, Staphylococcus aureus
IIIMYKKFGVIPEMEYEMEEVKE

SEQ ID NO: 1668296 - protein, 17 aa, Staphylococcus aureus
IIISDSIFSTNGDVVDI

SEQ ID NO: 1668297 - protein, 18 aa, Staphylococcus aureus
IIITYIWIISVNENACKD

SEQ ID NO: 1668298 - protein, 21 aa, Staphylococcus aureus
IIKADSLGVLITKTSELFNKI

SEQ ID NO: 1668299 - protein, 27 aa, Staphylococcus aureus
IIKEGIPAKARRKGGHPAKRVFQALRI

SEQ ID NO: 1668300 - protein, 21 aa, Staphylococcus aureus
IIKKRYILKTVIDQIKKNYNF

SEQ ID NO: 1668301 - protein, 21 aa, Staphylococcus aureus
IIKKVRYVYNIDFDKPKLEMW

SEQ ID NO: 1668302 - protein, 18 aa, Staphylococcus aureus
IIKLAMVKFAHKMKETTY

SEQ ID NO: 1668303 - protein, 22 aa, Staphylococcus aureus
IIKSIELLEAEGFIYTKVGSGT

SEQ ID NO: 1668304 - protein, 24 aa, Staphylococcus aureus
IILHELCHYHLHIAGKGYQHKDQD

SEQ ID NO: 1668305 - protein, 18 aa, Staphylococcus aureus
IIMKRLVYCFKLDNDEFN

SEQ ID NO: 1668306 - protein, 18 aa, Staphylococcus aureus
IIMTEALSLYIWGCNILN

SEQ ID NO: 1668307 - protein, 26 aa, Staphylococcus aureus
IINKEFKRMLAKFFIFVGDGGNGKGT

SEQ ID NO: 1668308 - protein, 18 aa, Staphylococcus aureus
IINLRFQIQIDDDLKPEM

SEQ ID NO: 1668309 - protein, 23 aa, Staphylococcus aureus
IIPEMLTENFILRTELRETTMNI

SEQ ID NO: 1668310 - protein, 18 aa, Staphylococcus aureus
IIPHKQPFLLIDKVVEYE

SEQ ID NO: 1668311 - protein, 25 aa, Staphylococcus aureus
IIQKRFTLNILYPYIETIHITKDKN

SEQ ID NO: 1668312 - protein, 17 aa, Staphylococcus aureus
IIQRLGVNPENLHIIVT

SEQ ID NO: 1668313 - protein, 24 aa, Staphylococcus aureus
IISIFKLSIFKGIPIDNDYHEHHY

SEQ ID NO: 1668314 - protein, 19 aa, Staphylococcus aureus
IISQELWDKVQSRKKQVSQ

SEQ ID NO: 1668315 - protein, 18 aa, Staphylococcus aureus
IITGHSLGGRDAMILGMS

SEQ ID NO: 1668316 - protein, 20 aa, Staphylococcus aureus
IITKEQLKIFVYDYDTNLIK

SEQ ID NO: 1668317 - protein, 18 aa, Staphylococcus aureus
IITSHALRHTHCSYLLAK

SEQ ID NO: 1668318 - protein, 23 aa, Staphylococcus aureus
IIVEMHDFFKNALLSDSLLRDIK

SEQ ID NO: 1668319 - protein, 19 aa, Staphylococcus aureus
IIVNEEGKRIIFCPKCGSE

SEQ ID NO: 1668320 - protein, 26 aa, Staphylococcus aureus
IIWIAKSCFLTGVFLSNLDQEYSDAY

SEQ ID NO: 1668321 - protein, 25 aa, Staphylococcus aureus
IIYVKLGVNVGREFSGNHFCMVLNN

SEQ ID NO: 1668322 - protein, 19 aa, Staphylococcus aureus
IIYYDGEAALALLRLYQKD

SEQ ID NO: 1668323 - protein, 18 aa, Staphylococcus aureus
IIYYDGEAALALMRLFQQ

SEQ ID NO: 1668324 - protein, 22 aa, Staphylococcus aureus
IKAGCGYVPVDISIPEDRIKMI

SEQ ID NO: 1668325 - protein, 17 aa, Staphylococcus aureus
IKAKYKKAFKMKDEIEV

SEQ ID NO: 1668326 - protein, 18 aa, Staphylococcus aureus
IKDIPYLIAGGINSENIQ

SEQ ID NO: 1668327 - protein, 21 aa, Staphylococcus aureus
IKDKFKQALIDRVKKIKLGNG

SEQ ID NO: 1668328 - protein, 32 aa, Staphylococcus aureus
IKDLKVAVIGTGRIGRVVAYIFANGYQSDVVA

SEQ ID NO: 1668329 - protein, 23 aa, Staphylococcus aureus
IKDLKVAVIGTGRIGRVVSDIFA

SEQ ID NO: 1668330 - protein, 26 aa, Staphylococcus aureus
IKDSLKRLIVPSIEREIHVDLTEKAE

SEQ ID NO: 1668331 - protein, 17 aa, Staphylococcus aureus
IKEGFSYHERRIHNDQM

SEQ ID NO: 1668332 - protein, 20 aa, Staphylococcus aureus
IKEKFRIIYYDGEAALALMR

SEQ ID NO: 1668333 - protein, 21 aa, Staphylococcus aureus
IKFDFRKGHQIVLKNRFNSNG

SEQ ID NO: 1668334 - protein, 20 aa, Staphylococcus aureus
IKFGADIVTILGVSEDASIK

SEQ ID NO: 1668335 - protein, 19 aa, Staphylococcus aureus
IKFLASKCNYKLKKHYFVQ

SEQ ID NO: 1668336 - protein, 26 aa, Staphylococcus aureus
IKGDKFLYYFLEWFATQNKWIRFSQG

SEQ ID NO: 1668337 - protein, 17 aa, Staphylococcus aureus
IKGDNIFVWQGDITTLK

SEQ ID NO: 1668338 - protein, 17 aa, Staphylococcus aureus
IKGEIDLSDGIRQYGTY

SEQ ID NO: 1668339 - protein, 20 aa, Staphylococcus aureus
IKGFKGKKFYKVSATINKDD

SEQ ID NO: 1668340 - protein, 23 aa, Staphylococcus aureus
IKGKTILDVGCNQGGFLRKLYDT

SEQ ID NO: 1668341 - protein, 20 aa, Staphylococcus aureus
IKGKWSYLYRAIDAEGHTLD

SEQ ID NO: 1668342 - protein, 21 aa, Staphylococcus aureus
IKGLDFYKEYSNIFRDRLEMA

SEQ ID NO: 1668343 - protein, 26 aa, Staphylococcus aureus
IKGLEFPFIICITTSVLNSNTNIRNS

SEQ ID NO: 1668344 - protein, 17 aa, Staphylococcus aureus
IKGLLGVATQQIDKLIE

SEQ ID NO: 1668345 - protein, 23 aa, Staphylococcus aureus
IKGNIKLALSLSDFGEGEVNTLN

SEQ ID NO: 1668346 - protein, 19 aa, Staphylococcus aureus
IKGRHDLRNELTITIDGAD

SEQ ID NO: 1668347 - protein, 17 aa, Staphylococcus aureus
IKHAKHMKMLLNGLDQK

SEQ ID NO: 1668348 - protein, 17 aa, Staphylococcus aureus
IKHGWFVEDRFVKNELE

SEQ ID NO: 1668349 - protein, 21 aa, Staphylococcus aureus
IKIPTLNYEVMLTIPAGTQTG

SEQ ID NO: 1668350 - protein, 24 aa, Staphylococcus aureus
IKKDGYWWIRFKYQREGSSTNDFY

SEQ ID NO: 1668351 - protein, 17 aa, Staphylococcus aureus
IKKGSWWFYPNDDTNRK

SEQ ID NO: 1668352 - protein, 22 aa, Staphylococcus aureus
IKKIDCEYTYAMAIAILIRHTM

SEQ ID NO: 1668353 - protein, 26 aa, Staphylococcus aureus
IKKIFTIHTNHFMSPYSYGAEIKPEF

SEQ ID NO: 1668354 - protein, 25 aa, Staphylococcus aureus
IKKIFTIHTNHFMSPYSYGTEIKPE

SEQ ID NO: 1668355 - protein, 23 aa, Staphylococcus aureus
IKKKDDKAYKCSFYNPETTNTAS

SEQ ID NO: 1668356 - protein, 29 aa, Staphylococcus aureus
IKKLASAVPEHIDKVCVVVNPDLTTIEHV

SEQ ID NO: 1668357 - protein, 33 aa, Staphylococcus aureus
IKKLASAVPNHIDKVCVMVNPDLTTIEHVLSNT

SEQ ID NO: 1668358 - protein, 33 aa, Staphylococcus aureus
IKKLEGSFHFETFISLTCQKCPDVVQALNLMSV

SEQ ID NO: 1668359 - protein, 24 aa, Staphylococcus aureus
IKKLRLTNIKAFQYDATKPYDKTY

SEQ ID NO: 1668360 - protein, 22 aa, Staphylococcus aureus
IKKSLYKMIIFFDDITKSVSDK

SEQ ID NO: 1668361 - protein, 19 aa, Staphylococcus aureus
IKKVIAILETLDFKVEMIG

SEQ ID NO: 1668362 - protein, 22 aa, Staphylococcus aureus
IKKWQRELEALYHIKSKLNTEQ

SEQ ID NO: 1668363 - protein, 19 aa, Staphylococcus aureus
IKLAKGINIIGLINIQFVI

SEQ ID NO: 1668364 - protein, 17 aa, Staphylococcus aureus
IKLCGALLQYYRETGIY

SEQ ID NO: 1668365 - protein, 20 aa, Staphylococcus aureus
IKLHQKFAFKHAGTLTNVGF

SEQ ID NO: 1668366 - protein, 25 aa, Staphylococcus aureus
IKLIEMNQGISFLPIYITTNSDYNI

SEQ ID NO: 1668367 - protein, 25 aa, Staphylococcus aureus
IKLIEMNQGISFLPIYITTNSNYNI

SEQ ID NO: 1668368 - protein, 17 aa, Staphylococcus aureus
IKLKAGDRIVYDSFRVY

SEQ ID NO: 1668369 - protein, 17 aa, Staphylococcus aureus
IKLREDGKIYKFYLYIN

SEQ ID NO: 1668370 - protein, 17 aa, Staphylococcus aureus
IKLYESLGIKQVYVEDF

SEQ ID NO: 1668371 - protein, 26 aa, Staphylococcus aureus
IKMGRYGKFMACSNFPDCRNTKAIVK

SEQ ID NO: 1668372 - protein, 18 aa, Staphylococcus aureus
IKMKLKKQKHLWKKQAVT

SEQ ID NO: 1668373 - protein, 18 aa, Staphylococcus aureus
IKMLPKIIEQLRENGKQI

SEQ ID NO: 1668374 - protein, 19 aa, Staphylococcus aureus
IKMVQDLGVDVIVTDHHEI

SEQ ID NO: 1668375 - protein, 23 aa, Staphylococcus aureus
IKNCSFKGFVDYSGERFYSEAIQ

SEQ ID NO: 1668376 - protein, 17 aa, Staphylococcus aureus
IKNEIINRIDLKKETIS

SEQ ID NO: 1668377 - protein, 20 aa, Staphylococcus aureus
IKNFMLNKAILEGYHTLLTI

SEQ ID NO: 1668378 - protein, 18 aa, Staphylococcus aureus
IKNIDPYNVVFVGDNILE

SEQ ID NO: 1668379 - protein, 18 aa, Staphylococcus aureus
IKNINPYNVIFVGDNILE

SEQ ID NO: 1668380 - protein, 18 aa, Staphylococcus aureus
IKNIPLKAYEYIVNGKSA

SEQ ID NO: 1668381 - protein, 20 aa, Staphylococcus aureus
IKNKIINFNGFEFKVSAMKR

SEQ ID NO: 1668382 - protein, 25 aa, Staphylococcus aureus
IKNKIISFNGFEFKVSVMKRHDGIS

SEQ ID NO: 1668383 - protein, 18 aa, Staphylococcus aureus
IKNLEGLYDKEGYRDGEF

SEQ ID NO: 1668384 - protein, 25 aa, Staphylococcus aureus
IKNQRSALYIKHLTAFIDQLISLEV

SEQ ID NO: 1668385 - protein, 21 aa, Staphylococcus aureus
IKNTMFAPLIDYKCVTTMRLE

SEQ ID NO: 1668386 - protein, 22 aa, Staphylococcus aureus
IKNYKHFSAVIKMLPKIIEQLR

SEQ ID NO: 1668387 - protein, 20 aa, Staphylococcus aureus
IKPDLAIAVDVGIAYDTPGM

SEQ ID NO: 1668388 - protein, 18 aa, Staphylococcus aureus
IKPECLIEEISISKDTFL

SEQ ID NO: 1668389 - protein, 20 aa, Staphylococcus aureus
IKPGIPLKDIDHIARNIILE

SEQ ID NO: 1668390 - protein, 21 aa, Staphylococcus aureus
IKPKEIGLVYGTVNIKTVDKN

SEQ ID NO: 1668391 - protein, 25 aa, Staphylococcus aureus
IKQMLIDENMPFIVIGKPTSDIDHQ

SEQ ID NO: 1668392 - protein, 25 aa, Staphylococcus aureus
IKQQPSPDCLMLFQHHNLLPWKTVN

SEQ ID NO: 1668393 - protein, 25 aa, Staphylococcus aureus
IKQQPSPDCLMLFQHHNLLSWKTIN

SEQ ID NO: 1668394 - protein, 20 aa, Staphylococcus aureus
IKRLYIEEGCAIQKDITLDS

SEQ ID NO: 1668395 - protein, 34 aa, Staphylococcus aureus
IKRQKAIEIANAMLKEGYIEKDVVPIAAKKAKDW

SEQ ID NO: 1668396 - protein, 34 aa, Staphylococcus aureus
IKRQKAIEIANAMLKEGYLEKDVVPIAVKKAKDW

SEQ ID NO: 1668397 - protein, 22 aa, Staphylococcus aureus
IKSHLRKIYIDGVSNMQEHLVV

SEQ ID NO: 1668398 - protein, 18 aa, Staphylococcus aureus
IKSRFGLYKKQIPDLDNL

SEQ ID NO: 1668399 - protein, 17 aa, Staphylococcus aureus
IKTFYVWGCYKNEQIKW

SEQ ID NO: 1668400 - protein, 19 aa, Staphylococcus aureus
IKTFYVWGCYKNEQIKWYA

SEQ ID NO: 1668401 - protein, 17 aa, Staphylococcus aureus
IKTFYVWGYYKNEQIKW

SEQ ID NO: 1668402 - protein, 19 aa, Staphylococcus aureus
IKTILVGYVIKFIRNKLSG

SEQ ID NO: 1668403 - protein, 18 aa, Staphylococcus aureus
IKTKYKMLRKYGLDHDSA

SEQ ID NO: 1668404 - protein, 21 aa, Staphylococcus aureus
IKTNEDAILWSFEKGNSTKES

SEQ ID NO: 1668405 - protein, 21 aa, Staphylococcus aureus
IKTPLLTCTSWSTQGLHNRGS

SEQ ID NO: 1668406 - protein, 25 aa, Staphylococcus aureus
IKTYCYHLKLFYEFMSQSRIELGDL

SEQ ID NO: 1668407 - protein, 17 aa, Staphylococcus aureus
IKVEEGQEIFIEKLDVN

SEQ ID NO: 1668408 - protein, 18 aa, Staphylococcus aureus
IKVERRVNEDVAFITDNG

SEQ ID NO: 1668409 - protein, 23 aa, Staphylococcus aureus
IKVIREVCRNGVIELGVGSKTIK

SEQ ID NO: 1668410 - protein, 17 aa, Staphylococcus aureus
IKVSEKLSKVDVDKLPK

SEQ ID NO: 1668411 - protein, 18 aa, Staphylococcus aureus
IKVSEKLSKVDVDKLPKK

SEQ ID NO: 1668412 - protein, 18 aa, Staphylococcus aureus
IKVYDWVQQVEQLGAGEL

SEQ ID NO: 1668413 - protein, 22 aa, Staphylococcus aureus
IKVYSRGTGDWNLGEPPHKGTQ

SEQ ID NO: 1668414 - protein, 30 aa, Staphylococcus aureus
IKYDGAYCINGYRWITYIANSGQRRYIATG

SEQ ID NO: 1668415 - protein, 17 aa, Staphylococcus aureus
ILACSELDVPVFDAYHT

SEQ ID NO: 1668416 - protein, 18 aa, Staphylococcus aureus
ILAKIPFFGICLGHQLFA

SEQ ID NO: 1668417 - protein, 22 aa, Staphylococcus aureus
ILALFCRIFKYKFGMNNKVVIK

SEQ ID NO: 1668418 - protein, 23 aa, Staphylococcus aureus
ILALFCRIFKYKFGMVNKVEIKL

SEQ ID NO: 1668419 - protein, 23 aa, Staphylococcus aureus
ILALFCRIFKYKFGMVNKVVIKL

SEQ ID NO: 1668420 - protein, 24 aa, Staphylococcus aureus
ILDPACGTGGFLVAALKHVEESII

SEQ ID NO: 1668421 - protein, 26 aa, Staphylococcus aureus
ILDSARFRLLLSEAFDVAPRSVDALI

SEQ ID NO: 1668422 - protein, 17 aa, Staphylococcus aureus
ILEDAWKAEKNYSKQDA

SEQ ID NO: 1668423 - protein, 23 aa, Staphylococcus aureus
ILEKHWFNWLTANNIPIKRRSST

SEQ ID NO: 1668424 - protein, 22 aa, Staphylococcus aureus
ILESKIVRLFQAFIKDKMDQLF

SEQ ID NO: 1668425 - protein, 21 aa, Staphylococcus aureus
ILFGPTITVKALLNMRMENKV

SEQ ID NO: 1668426 - protein, 17 aa, Staphylococcus aureus
ILGEPDFDMISHENIQL

SEQ ID NO: 1668427 - protein, 32 aa, Staphylococcus aureus
ILGICLGAQALTCYYGGEVIKGDKVMHGKVDT

SEQ ID NO: 1668428 - protein, 17 aa, Staphylococcus aureus
ILGSIVAMHVLKDYPEV

SEQ ID NO: 1668429 - protein, 22 aa, Staphylococcus aureus
ILHELCHYHLHIAGKGYQHKDQ

SEQ ID NO: 1668430 - protein, 19 aa, Staphylococcus aureus
ILHELCHYHLHISGKGYQH

SEQ ID NO: 1668431 - protein, 19 aa, Staphylococcus aureus
ILHSYNHYNLINAYKDNFI

SEQ ID NO: 1668432 - protein, 18 aa, Staphylococcus aureus
ILIDPMLSDKGAFEPFPN

SEQ ID NO: 1668433 - protein, 24 aa, Staphylococcus aureus
ILIHTLEKFILINDFEKIIIATPQ

SEQ ID NO: 1668434 - protein, 22 aa, Staphylococcus aureus
ILKDMYKFIVDEKFCCNDRWLQ

SEQ ID NO: 1668435 - protein, 17 aa, Staphylococcus aureus
ILKGYLWSDYMIENINE

SEQ ID NO: 1668436 - protein, 17 aa, Staphylococcus aureus
ILKKYSFQLSGGQLERV

SEQ ID NO: 1668437 - protein, 26 aa, Staphylococcus aureus
ILKNTWSIDANKDFNTVRYVYNRNLP

SEQ ID NO: 1668438 - protein, 19 aa, Staphylococcus aureus
ILLHKDINISIAVADENKL

SEQ ID NO: 1668439 - protein, 17 aa, Staphylococcus aureus
ILLKTGLRISEFGGLTL

SEQ ID NO: 1668440 - protein, 20 aa, Staphylococcus aureus
ILLSDAELKTHINSRIYYYK

SEQ ID NO: 1668441 - protein, 19 aa, Staphylococcus aureus
ILNIEVIPSNILLKNLSDG

SEQ ID NO: 1668442 - protein, 17 aa, Staphylococcus aureus
ILNKFADILIRQKIEVF

SEQ ID NO: 1668443 - protein, 19 aa, Staphylococcus aureus
ILNNFKFDVEITTMADNDV

SEQ ID NO: 1668444 - protein, 19 aa, Staphylococcus aureus
ILNQFEQFGSYMVISPHIS

SEQ ID NO: 1668445 - protein, 17 aa, Staphylococcus aureus
ILNSWLQMNLSNYDQIK

SEQ ID NO: 1668446 - protein, 19 aa, Staphylococcus aureus
ILPFLKKGNTIIVESTIAP

SEQ ID NO: 1668447 - protein, 17 aa, Staphylococcus aureus
ILPPNVKKEHWGFDDPA

SEQ ID NO: 1668448 - protein, 19 aa, Staphylococcus aureus
ILQLLLLKIDLNFYPQFCK

SEQ ID NO: 1668449 - protein, 25 aa, Staphylococcus aureus
ILRAQEMNFPISIEIPDEVSSINLN

SEQ ID NO: 1668450 - protein, 27 aa, Staphylococcus aureus
ILRMEKRYKGPIAFEYTHINNNTERGW

SEQ ID NO: 1668451 - protein, 33 aa, Staphylococcus aureus
ILRRCHSGPLLKNGHRFGFYRGYNGHSYIHIKG

SEQ ID NO: 1668452 - protein, 23 aa, Staphylococcus aureus
ILRRYCFDKVFIGMNGLDIELGL

SEQ ID NO: 1668453 - protein, 21 aa, Staphylococcus aureus
ILRSLHCLRNLGYLKEIVILV

SEQ ID NO: 1668454 - protein, 26 aa, Staphylococcus aureus
ILSDLKFTGDPRVGYKDISKKVKSVL

SEQ ID NO: 1668455 - protein, 19 aa, Staphylococcus aureus
ILSELPCIVAYKNNDIVGL

SEQ ID NO: 1668456 - protein, 24 aa, Staphylococcus aureus
ILSKRPSLACLVTIIERKTRYLYA

SEQ ID NO: 1668457 - protein, 22 aa, Staphylococcus aureus
ILTELKLSLIKQYEALLQTEEV

SEQ ID NO: 1668458 - protein, 22 aa, Staphylococcus aureus
ILTLKIEIIIFCIHITEDAEKK

SEQ ID NO: 1668459 - protein, 32 aa, Staphylococcus aureus
ILTSEYLRPEICKELRQKLKQYHYVESELFPD

SEQ ID NO: 1668460 - protein, 21 aa, Staphylococcus aureus
ILVDMTKLLAPILVHTAEEVW

SEQ ID NO: 1668461 - protein, 23 aa, Staphylococcus aureus
ILVKDRYDDLVFLFENEFATRWF

SEQ ID NO: 1668462 - protein, 18 aa, Staphylococcus aureus
ILVNMFLYLPNFFQNQNS

SEQ ID NO: 1668463 - protein, 19 aa, Staphylococcus aureus
ILVVALGFVSETFRIEGMK

SEQ ID NO: 1668464 - protein, 18 aa, Staphylococcus aureus
ILYLEGFNFDNGKAKLFP

SEQ ID NO: 1668465 - protein, 28 aa, Staphylococcus aureus
IMDQIRVLRELDFHFQLVIDANESLNRQ

SEQ ID NO: 1668466 - protein, 23 aa, Staphylococcus aureus
IMEQFELFSIDKFKCNSEATYYL

SEQ ID NO: 1668467 - protein, 19 aa, Staphylococcus aureus
IMETYKPYAVYHAAAHKHV

SEQ ID NO: 1668468 - protein, 22 aa, Staphylococcus aureus
IMKDIKQSITMRNNEAIVDNIL

SEQ ID NO: 1668469 - protein, 18 aa, Staphylococcus aureus
IMMPRSIATYELYIADLK

SEQ ID NO: 1668470 - protein, 24 aa, Staphylococcus aureus
IMQGVQFIQGFKVYVHPSCVHTIE

SEQ ID NO: 1668471 - protein, 17 aa, Staphylococcus aureus
IMQPFKVYPNGFPEVLI

SEQ ID NO: 1668472 - protein, 18 aa, Staphylococcus aureus
IMSILDIGRDNFYSRVKD

SEQ ID NO: 1668473 - protein, 17 aa, Staphylococcus aureus
IMSRSLEIPAIVGTKSI

SEQ ID NO: 1668474 - protein, 18 aa, Staphylococcus aureus
IMTEIPFAFFKQHVTDFE

SEQ ID NO: 1668475 - protein, 18 aa, Staphylococcus aureus
IMVHSTFQGMEMISKLDS

SEQ ID NO: 1668476 - protein, 19 aa, Staphylococcus aureus
IMYKVHLMKECLDRGIKVI

SEQ ID NO: 1668477 - protein, 21 aa, Staphylococcus aureus
IMYSPKFKGGHALESDTTFSS

SEQ ID NO: 1668478 - protein, 17 aa, Staphylococcus aureus
INAASNIAGVNTVKQQG

SEQ ID NO: 1668479 - protein, 24 aa, Staphylococcus aureus
INAGIATCWFNFRGFDHNPGIIPD

SEQ ID NO: 1668480 - protein, 18 aa, Staphylococcus aureus
INANTFLYFLTPIINCPD

SEQ ID NO: 1668481 - protein, 24 aa, Staphylococcus aureus
INASNLFIHKLFYMDQLPFMETLL

SEQ ID NO: 1668482 - protein, 18 aa, Staphylococcus aureus
INAYIPGIGHNLQEHSVV

SEQ ID NO: 1668483 - protein, 18 aa, Staphylococcus aureus
INCRCKLLYYIDEDELPT

SEQ ID NO: 1668484 - protein, 17 aa, Staphylococcus aureus
INCRCKLLYYIDKDELP

SEQ ID NO: 1668485 - protein, 23 aa, Staphylococcus aureus
INCRSDCALLPKSMWPQKPSKKR

SEQ ID NO: 1668486 - protein, 24 aa, Staphylococcus aureus
INDLKLDYINYWIGKYRSHPYNKK

SEQ ID NO: 1668487 - protein, 30 aa, Staphylococcus aureus
INEAFLRRCPNLKWIAWFATGVNTLPLDYI

SEQ ID NO: 1668488 - protein, 26 aa, Staphylococcus aureus
INEITYRLSKIFGIKSISPLLKVEKT

SEQ ID NO: 1668489 - protein, 28 aa, Staphylococcus aureus
INENVRNFLKQNIEDIHFANDDQPNNPD

SEQ ID NO: 1668490 - protein, 27 aa, Staphylococcus aureus
INENVRNFLKQNIEDINFANDDHPNNP

SEQ ID NO: 1668491 - protein, 19 aa, Staphylococcus aureus
INFEHLPKPVVFIDDIHDI

SEQ ID NO: 1668492 - protein, 20 aa, Staphylococcus aureus
INFERLRNYFFIKKPKRMKY

SEQ ID NO: 1668493 - protein, 21 aa, Staphylococcus aureus
INFIGTFTVEFFIDSNNQLYV

SEQ ID NO: 1668494 - protein, 21 aa, Staphylococcus aureus
INFSSPSGMLYVTISDVYSGS

SEQ ID NO: 1668495 - protein, 30 aa, Staphylococcus aureus
INGEIRPGIVHRIDMDTSGLLMVAKNDIAH

SEQ ID NO: 1668496 - protein, 23 aa, Staphylococcus aureus
INGGKFNGIIPISQLSTRHIDSP

SEQ ID NO: 1668497 - protein, 30 aa, Staphylococcus aureus
INGIRLIKFKGGTIGLEFIWIDIENPPNDV

SEQ ID NO: 1668498 - protein, 24 aa, Staphylococcus aureus
INGKELESIFGLSRRQLGYRIQKI

SEQ ID NO: 1668499 - protein, 20 aa, Staphylococcus aureus
INGNVPIFINIGEWDGDDED

SEQ ID NO: 1668500 - protein, 18 aa, Staphylococcus aureus
INHTIPIVNIPVGYSETI

SEQ ID NO: 1668501 - protein, 18 aa, Staphylococcus aureus
INIIKLAIDQNIPYTILR

SEQ ID NO: 1668502 - protein, 25 aa, Staphylococcus aureus
INIIMKGRQAGVFMFLTAQRPDADV

SEQ ID NO: 1668503 - protein, 24 aa, Staphylococcus aureus
INIKGEVLITEIYDDYFLKNDEWH

SEQ ID NO: 1668504 - protein, 23 aa, Staphylococcus aureus
INILKQLRGIVIYQNDTMIVTKF

SEQ ID NO: 1668505 - protein, 19 aa, Staphylococcus aureus
INILNERKIEFKINMQNIY

SEQ ID NO: 1668506 - protein, 17 aa, Staphylococcus aureus
INKARGIEQVRQFLNID

SEQ ID NO: 1668507 - protein, 23 aa, Staphylococcus aureus
INKEELKKGVTIGKYDIKQSDQQ

SEQ ID NO: 1668508 - protein, 20 aa, Staphylococcus aureus
INKGEALGIVGESGCGKSTF

SEQ ID NO: 1668509 - protein, 17 aa, Staphylococcus aureus
INKMKVIYPVSAKEQRK

SEQ ID NO: 1668510 - protein, 17 aa, Staphylococcus aureus
INKRTTLMTSIYNQYLE

SEQ ID NO: 1668511 - protein, 18 aa, Staphylococcus aureus
INKYGADSLRWALISDSA

SEQ ID NO: 1668512 - protein, 23 aa, Staphylococcus aureus
INLALRAQYLFESNIDYFVYNGD

SEQ ID NO: 1668513 - protein, 25 aa, Staphylococcus aureus
INLDMDGRIPINVWTGDSIARSGKG

SEQ ID NO: 1668514 - protein, 21 aa, Staphylococcus aureus
INLNRYIYKDIKGEFIEILHD

SEQ ID NO: 1668515 - protein, 22 aa, Staphylococcus aureus
INLNRYIYKDIKGEFIEILHDI

SEQ ID NO: 1668516 - protein, 25 aa, Staphylococcus aureus
INLTEAYTNYAILFISGTYPGGVIE

SEQ ID NO: 1668517 - protein, 24 aa, Staphylococcus aureus
INMSRCLVEKTIFLESKKENKKDD

SEQ ID NO: 1668518 - protein, 18 aa, Staphylococcus aureus
INNAATRGEVAQKLAEAK

SEQ ID NO: 1668519 - protein, 17 aa, Staphylococcus aureus
INNRFIEEMSQYEGDIP

SEQ ID NO: 1668520 - protein, 19 aa, Staphylococcus aureus
INNVLAFPGIFRGALEVEA

SEQ ID NO: 1668521 - protein, 18 aa, Staphylococcus aureus
INNYPFPNTFKVLAVSGA

SEQ ID NO: 1668522 - protein, 26 aa, Staphylococcus aureus
INPDIILRLPHGMSEEVKKMFQKEFK

SEQ ID NO: 1668523 - protein, 22 aa, Staphylococcus aureus
INPDLIGGFRVKVGTTVLDGSV

SEQ ID NO: 1668524 - protein, 17 aa, Staphylococcus aureus
INPSTVGNNKWLEMVDK

SEQ ID NO: 1668525 - protein, 17 aa, Staphylococcus aureus
INPSTVGNNKWLEMVNK

SEQ ID NO: 1668526 - protein, 22 aa, Staphylococcus aureus
INPYIKNMMYVLANNRHISLIA

SEQ ID NO: 1668527 - protein, 23 aa, Staphylococcus aureus
INPYLIGGFRVKVGTTVLDGSVR

SEQ ID NO: 1668528 - protein, 27 aa, Staphylococcus aureus
INQFPFISFDRIIEFTAFDLVDKLLTQ

SEQ ID NO: 1668529 - protein, 26 aa, Staphylococcus aureus
INQLMYRSGDIIRLLPDGNIDYLYRK

SEQ ID NO: 1668530 - protein, 20 aa, Staphylococcus aureus
INRLIKIINVLGYKYNKETG

SEQ ID NO: 1668531 - protein, 18 aa, Staphylococcus aureus
INRMKVIYPVSAKEQKKI

SEQ ID NO: 1668532 - protein, 22 aa, Staphylococcus aureus
INRRKKEKFLYSAIDIDKASIT

SEQ ID NO: 1668533 - protein, 18 aa, Staphylococcus aureus
INSLPEFSQYIDQKLESE

SEQ ID NO: 1668534 - protein, 25 aa, Staphylococcus aureus
INSTHSFNMFRFHINVNLEEFNGIE

SEQ ID NO: 1668535 - protein, 17 aa, Staphylococcus aureus
INTAFFVKLFKTALAER

SEQ ID NO: 1668536 - protein, 18 aa, Staphylococcus aureus
INVDGFDFRLRVKKRAYS

SEQ ID NO: 1668537 - protein, 19 aa, Staphylococcus aureus
INVDGFDFRLRVKKRAYSV

SEQ ID NO: 1668538 - protein, 19 aa, Staphylococcus aureus
INVKVCYYSLCKEKIKSSL

SEQ ID NO: 1668539 - protein, 18 aa, Staphylococcus aureus
INVNKEFSNSHFAIVMNK

SEQ ID NO: 1668540 - protein, 25 aa, Staphylococcus aureus
INVPEARLLVISPYDKSSVADIEKA

SEQ ID NO: 1668541 - protein, 21 aa, Staphylococcus aureus
INVYLPGARIRFMRYEGTKEE

SEQ ID NO: 1668542 - protein, 18 aa, Staphylococcus aureus
INYDLGIGLGIYDIHSPR

SEQ ID NO: 1668543 - protein, 18 aa, Staphylococcus aureus
INYHSKFDILSWLQDPFA

SEQ ID NO: 1668544 - protein, 19 aa, Staphylococcus aureus
INYHSKFDILSWLQDPFAT

SEQ ID NO: 1668545 - protein, 20 aa, Staphylococcus aureus
IPDATITWVSGQAPNKNNTT

SEQ ID NO: 1668546 - protein, 30 aa, Staphylococcus aureus
IPDTGFYHFWIQGIFARWTDNPNIEDMIQA

SEQ ID NO: 1668547 - protein, 18 aa, Staphylococcus aureus
IPEGITMDQYLARKKKNS

SEQ ID NO: 1668548 - protein, 24 aa, Staphylococcus aureus
IPEKAGGITSVMLNRSKLLAEKGY

SEQ ID NO: 1668549 - protein, 21 aa, Staphylococcus aureus
IPENQKYGAFHGKEAFKQAIV

SEQ ID NO: 1668550 - protein, 26 aa, Staphylococcus aureus
IPFFGICLGHQLFALSQGASSFKMKF

SEQ ID NO: 1668551 - protein, 21 aa, Staphylococcus aureus
IPGNGKFLYSPFSIFDNESII

SEQ ID NO: 1668552 - protein, 26 aa, Staphylococcus aureus
IPHENIIKLPARFHKKSLPIPKYRYF

SEQ ID NO: 1668553 - protein, 26 aa, Staphylococcus aureus
IPHGHAVMVGIIYQFIVANALFDSKY

SEQ ID NO: 1668554 - protein, 26 aa, Staphylococcus aureus
IPHGHAVMVGIIYQFIVANSLFDSKH

SEQ ID NO: 1668555 - protein, 18 aa, Staphylococcus aureus
IPHISTGDMFRKAIKEET

SEQ ID NO: 1668556 - protein, 23 aa, Staphylococcus aureus
IPIAIQIPTVIPTQIAIPTQIAT

SEQ ID NO: 1668557 - protein, 24 aa, Staphylococcus aureus
IPIDLLPYLFFQFAKDGKRLYSDN

SEQ ID NO: 1668558 - protein, 25 aa, Staphylococcus aureus
IPIDLLPYLFFQFAKDGKRLYSDNG

SEQ ID NO: 1668559 - protein, 18 aa, Staphylococcus aureus
IPIHPWQFEHVIQVDLAE

SEQ ID NO: 1668560 - protein, 23 aa, Staphylococcus aureus
IPIKRKSSTIVFGDYEHKSGLAS

SEQ ID NO: 1668561 - protein, 22 aa, Staphylococcus aureus
IPISKEIAALILVQEQRVADEL

SEQ ID NO: 1668562 - protein, 17 aa, Staphylococcus aureus
IPKGRGKIERFFQTVNL

SEQ ID NO: 1668563 - protein, 24 aa, Staphylococcus aureus
IPKHFIKNKMHYFIDSQSKIDIKD

SEQ ID NO: 1668564 - protein, 17 aa, Staphylococcus aureus
IPKNFILLPTHPYQINV

SEQ ID NO: 1668565 - protein, 17 aa, Staphylococcus aureus
IPLEAYKYVINGKSAIE

SEQ ID NO: 1668566 - protein, 20 aa, Staphylococcus aureus
IPLERALENLSTFKPFEKVL

SEQ ID NO: 1668567 - protein, 17 aa, Staphylococcus aureus
IPLKAYEYIVNGKSAIE

SEQ ID NO: 1668568 - protein, 25 aa, Staphylococcus aureus
IPMIERLPRELKHISLIQLQNASIA

SEQ ID NO: 1668569 - protein, 19 aa, Staphylococcus aureus
IPNEFLKHSGKVHAQAFFT

SEQ ID NO: 1668570 - protein, 20 aa, Staphylococcus aureus
IPNEFLKHSGKVHAQAFFTQ

SEQ ID NO: 1668571 - protein, 18 aa, Staphylococcus aureus
IPNKGDWTHKSLRYTVKG

SEQ ID NO: 1668572 - protein, 21 aa, Staphylococcus aureus
IPRIRNHSVIYGLLRFDSYQL

SEQ ID NO: 1668573 - protein, 21 aa, Staphylococcus aureus
IPSDAKGSFLNELEPDQLRKC

SEQ ID NO: 1668574 - protein, 17 aa, Staphylococcus aureus
IPSGKELDWAKVSHEKY

SEQ ID NO: 1668575 - protein, 19 aa, Staphylococcus aureus
IPSIIKISGNYVAADILVT

SEQ ID NO: 1668576 - protein, 19 aa, Staphylococcus aureus
IPSLTLGCGSYGRNSISYN

SEQ ID NO: 1668577 - protein, 21 aa, Staphylococcus aureus
IPVCGFAWIHWSVANVGVSGN

SEQ ID NO: 1668578 - protein, 21 aa, Staphylococcus aureus
IPVCGFAWIHWSVANVSVSGN

SEQ ID NO: 1668579 - protein, 26 aa, Staphylococcus aureus
IPVPGSTLPSVIGWRTIDDTEQMMNV

SEQ ID NO: 1668580 - protein, 17 aa, Staphylococcus aureus
IPYLIAGGINTENIQTV

SEQ ID NO: 1668581 - protein, 20 aa, Staphylococcus aureus
IPYPVEVGGATVFVMPVDAF

SEQ ID NO: 1668582 - protein, 20 aa, Staphylococcus aureus
IPYRLNEEINAINGNEITFK

SEQ ID NO: 1668583 - protein, 19 aa, Staphylococcus aureus
IQAGLGRSGKLFATDWDNV

SEQ ID NO: 1668584 - protein, 22 aa, Staphylococcus aureus
IQAGSIYGVIGFSGAGKSTLIR

SEQ ID NO: 1668585 - protein, 17 aa, Staphylococcus aureus
IQCVTLICYYNDNLQNY

SEQ ID NO: 1668586 - protein, 18 aa, Staphylococcus aureus
IQELHHQIMNRKHHQILK

SEQ ID NO: 1668587 - protein, 29 aa, Staphylococcus aureus
IQGNTVCYMWLRFNIDLQFDDTTINQYFK

SEQ ID NO: 1668588 - protein, 26 aa, Staphylococcus aureus
IQGNTVCYMWLRFNMDQQFEDTAINQ

SEQ ID NO: 1668589 - protein, 27 aa, Staphylococcus aureus
IQGNTVCYMWLRFNMDQQFEDTVINQY

SEQ ID NO: 1668590 - protein, 18 aa, Staphylococcus aureus
IQHARSQRRKHLKQNIAS

SEQ ID NO: 1668591 - protein, 17 aa, Staphylococcus aureus
IQIAIPTQTVTQIQIAT

SEQ ID NO: 1668592 - protein, 24 aa, Staphylococcus aureus
IQIATQIQTAIQIQTVIQTQTATQ

SEQ ID NO: 1668593 - protein, 20 aa, Staphylococcus aureus
IQKINLWLEQEGYPKLERTS

SEQ ID NO: 1668594 - protein, 17 aa, Staphylococcus aureus
IQLHGTESIDFIQEIKK

SEQ ID NO: 1668595 - protein, 17 aa, Staphylococcus aureus
IQLIDAIANYNAVISDE

SEQ ID NO: 1668596 - protein, 17 aa, Staphylococcus aureus
IQLKDFMFEGALSENDY

SEQ ID NO: 1668597 - protein, 28 aa, Staphylococcus aureus
IQNATGLPTDGFTYKWNNAATGTNDANW

SEQ ID NO: 1668598 - protein, 24 aa, Staphylococcus aureus
IQNELWRKTLHVAFPKKINKNEIG

SEQ ID NO: 1668599 - protein, 19 aa, Staphylococcus aureus
IQNGEAFTHAFRVNHNTYY

SEQ ID NO: 1668600 - protein, 25 aa, Staphylococcus aureus
IQNPPHGATVAWHDSPDTWKNTVGN

SEQ ID NO: 1668601 - protein, 18 aa, Staphylococcus aureus
IQNVINWYNNTNFGNKSN

SEQ ID NO: 1668602 - protein, 25 aa, Staphylococcus aureus
IQPETKIKPAAREKINQKANELRAQ

SEQ ID NO: 1668603 - protein, 24 aa, Staphylococcus aureus
IQPFAATIPYYFTGHEGPDSCCID

SEQ ID NO: 1668604 - protein, 17 aa, Staphylococcus aureus
IQPKFELQPKFGKQRPI

SEQ ID NO: 1668605 - protein, 18 aa, Staphylococcus aureus
IQQQIWYWLERFDITENR

SEQ ID NO: 1668606 - protein, 24 aa, Staphylococcus aureus
IQQRFTLNMLYPYIDQIHITKKKM

SEQ ID NO: 1668607 - protein, 33 aa, Staphylococcus aureus
IQQRQCDVLCCYRLNRLHRNLKNALKLMKLCQK

SEQ ID NO: 1668608 - protein, 25 aa, Staphylococcus aureus
IQSEVPAHVQAGWMLTTIASVGELE

SEQ ID NO: 1668609 - protein, 26 aa, Staphylococcus aureus
IQSWIPCKIEDQFLNQEINGVTIDSR

SEQ ID NO: 1668610 - protein, 18 aa, Staphylococcus aureus
IQTAIPTQIVIQIQTATQ

SEQ ID NO: 1668611 - protein, 19 aa, Staphylococcus aureus
IQTAIRIQIATPIQIAIRI

SEQ ID NO: 1668612 - protein, 25 aa, Staphylococcus aureus
IQTTLFIDEGWAFSASRQGKKVAKG

SEQ ID NO: 1668613 - protein, 20 aa, Staphylococcus aureus
IRAEIFLKQQFERLQNEQIF

SEQ ID NO: 1668614 - protein, 25 aa, Staphylococcus aureus
IRAILNRKNCSGLSIGDMADERYFV

SEQ ID NO: 1668615 - protein, 21 aa, Staphylococcus aureus
IRAKEGITDGLVRISVGIEDT

SEQ ID NO: 1668616 - protein, 20 aa, Staphylococcus aureus
IRATAYWAIGQILGEEARDF

SEQ ID NO: 1668617 - protein, 26 aa, Staphylococcus aureus
IRDVSKRVLSHILGVELPNPSMIDES

SEQ ID NO: 1668618 - protein, 19 aa, Staphylococcus aureus
IREGLTAVVSIRIPEELLQ

SEQ ID NO: 1668619 - protein, 24 aa, Staphylococcus aureus
IREIEPVINRKASAREQLTTLFND

SEQ ID NO: 1668620 - protein, 25 aa, Staphylococcus aureus
IREIEPVINRKASAREQLTTLFNDK

SEQ ID NO: 1668621 - protein, 19 aa, Staphylococcus aureus
IREVNYLTGEVLKEREHFA

SEQ ID NO: 1668622 - protein, 34 aa, Staphylococcus aureus
IREVNYRTGEVLKEREHFAIFPASHFVTREEKLK

SEQ ID NO: 1668623 - protein, 22 aa, Staphylococcus aureus
IRFHNCSLFPVYHGSAKNNIGI

SEQ ID NO: 1668624 - protein, 17 aa, Staphylococcus aureus
IRGRGLFIGIELNTDAA

SEQ ID NO: 1668625 - protein, 18 aa, Staphylococcus aureus
IRGRGLFIGIELNTDAAP

SEQ ID NO: 1668626 - protein, 21 aa, Staphylococcus aureus
IRHLGVKASQVLAEKYETIDR

SEQ ID NO: 1668627 - protein, 19 aa, Staphylococcus aureus
IRHTMSFDNAHFFAQLRHP

SEQ ID NO: 1668628 - protein, 27 aa, Staphylococcus aureus
IRHVQFLIRRLRRKEYIHAQDDFVSMI

SEQ ID NO: 1668629 - protein, 26 aa, Staphylococcus aureus
IRIQIATPIQIAIRIQTVSQTQTAIR

SEQ ID NO: 1668630 - protein, 18 aa, Staphylococcus aureus
IRKAAELADKCIEIGVSY

SEQ ID NO: 1668631 - protein, 19 aa, Staphylococcus aureus
IRKAFKPTSKDSVILSADY

SEQ ID NO: 1668632 - protein, 17 aa, Staphylococcus aureus
IRKLLVFYNKNNYHQET

SEQ ID NO: 1668633 - protein, 21 aa, Staphylococcus aureus
IRKNDSVEYVFGKKLVNEGVI

SEQ ID NO: 1668634 - protein, 25 aa, Staphylococcus aureus
IRLIAADLVGFDWLDGFDIECRNEE

SEQ ID NO: 1668635 - protein, 26 aa, Staphylococcus aureus
IRLLYARVGKPYCPNHHIEIESQTVQ

SEQ ID NO: 1668636 - protein, 21 aa, Staphylococcus aureus
IRLYEKCKLLSHIETTSSTLE

SEQ ID NO: 1668637 - protein, 22 aa, Staphylococcus aureus
IRMQREHVHMSLIIDEYGGTAG

SEQ ID NO: 1668638 - protein, 17 aa, Staphylococcus aureus
IRMYLKDAHYTYSSRRY

SEQ ID NO: 1668639 - protein, 25 aa, Staphylococcus aureus
IRNFKPEEYWTIDGEFRYKKSKFNA

SEQ ID NO: 1668640 - protein, 29 aa, Staphylococcus aureus
IRNFKPEEYWTIEGEFRYKKSKFNAKFLH

SEQ ID NO: 1668641 - protein, 17 aa, Staphylococcus aureus
IRPEFGDILMTRIGDIG

SEQ ID NO: 1668642 - protein, 24 aa, Staphylococcus aureus
IRSEEGVDIVIHIGVNTVDLEGKG

SEQ ID NO: 1668643 - protein, 22 aa, Staphylococcus aureus
IRTNLEIPPFIQALTSIEEKML

SEQ ID NO: 1668644 - protein, 19 aa, Staphylococcus aureus
IRVDIAGSVESIYDIIKDD

SEQ ID NO: 1668645 - protein, 28 aa, Staphylococcus aureus
IRVFYRDEFLCTAISPDLADYSIDIKDI

SEQ ID NO: 1668646 - protein, 23 aa, Staphylococcus aureus
IRWNGFYWAGANYKNFKTRTFKS

SEQ ID NO: 1668647 - protein, 23 aa, Staphylococcus aureus
IRYASDEQIEFAVIDEGPGISLE

SEQ ID NO: 1668648 - protein, 17 aa, Staphylococcus aureus
IRYTRDLFNKHLSMNNE

SEQ ID NO: 1668649 - protein, 24 aa, Staphylococcus aureus
ISAIKHLLPDFALDALKERINELF

SEQ ID NO: 1668650 - protein, 17 aa, Staphylococcus aureus
ISALFQCDVDATLEENK

SEQ ID NO: 1668651 - protein, 18 aa, Staphylococcus aureus
ISALKDGRFDDVQQDIEA

SEQ ID NO: 1668652 - protein, 18 aa, Staphylococcus aureus
ISDIKRQIDLKVKYATRA

SEQ ID NO: 1668653 - protein, 22 aa, Staphylococcus aureus
ISDLDLKFAKQAKYTVYFKNGK

SEQ ID NO: 1668654 - protein, 31 aa, Staphylococcus aureus
ISDLQLIRLSVCKFIKGHSLIDTSILNKTLQ

SEQ ID NO: 1668655 - protein, 35 aa, Staphylococcus aureus; identical to SEQ ID NO: 1579652

SEQ ID NO: 1668656 - protein, 18 aa, Staphylococcus aureus
ISDVPKLLELKNRKNVPF

SEQ ID NO: 1668657 - protein, 23 aa, Staphylococcus aureus
ISEIPKDFILLPIHPYQINVLQQ

SEQ ID NO: 1668658 - protein, 30 aa, Staphylococcus aureus
ISEKLVVLLPLKFGDYLSSSSMRSLIDIAA

SEQ ID NO: 1668659 - protein, 18 aa, Staphylococcus aureus
ISEKNVRNLLAINDLIIL

SEQ ID NO: 1668660 - protein, 18 aa, Staphylococcus aureus
ISELGLAIEAGMNAEDIA

SEQ ID NO: 1668661 - protein, 18 aa, Staphylococcus aureus
ISELKKLEIIGSEGRGPG

SEQ ID NO: 1668662 - protein, 21 aa, Staphylococcus aureus
ISFEIYKGKTLGLVGESGCGK

SEQ ID NO: 1668663 - protein, 17 aa, Staphylococcus aureus
ISFNVLYPVLRPYLTSN

SEQ ID NO: 1668664 - protein, 26 aa, Staphylococcus aureus
ISFSTIEEFINWDLEKLKSHLNKNQL

SEQ ID NO: 1668665 - protein, 24 aa, Staphylococcus aureus
ISGIPLDPSALVYLVASTNQTTNG

SEQ ID NO: 1668666 - protein, 26 aa, Staphylococcus aureus
ISGKELRDTLHFEMLWDTSKIYKKEL

SEQ ID NO: 1668667 - protein, 27 aa, Staphylococcus aureus
ISGMIPVEWEKVYTIAYLDDEGGEVVF

SEQ ID NO: 1668668 - protein, 22 aa, Staphylococcus aureus
ISGPATLRCSQFVYKEQKNQKT

SEQ ID NO: 1668669 - protein, 19 aa, Staphylococcus aureus
ISGTYPGGVIEVFSLTSIP

SEQ ID NO: 1668670 - protein, 32 aa, Staphylococcus aureus
ISIKLPEKLLCAWLNSIRFLRNRIAHTDIIYG

SEQ ID NO: 1668671 - protein, 33 aa, Staphylococcus aureus
ISIKLPEKLLCAWLNSIRFLRNRIAHTDIIYGI

SEQ ID NO: 1668672 - protein, 17 aa, Staphylococcus aureus
ISISYVIDDFNGQQAIE

SEQ ID NO: 1668673 - protein, 19 aa, Staphylococcus aureus
ISITGVTTLPCSTGLEGFL

SEQ ID NO: 1668674 - protein, 18 aa, Staphylococcus aureus
ISKDISIEEIGHIKLTDE

SEQ ID NO: 1668675 - protein, 24 aa, Staphylococcus aureus
ISKELRDKYEWNLSLLSKIDNYLK

SEQ ID NO: 1668676 - protein, 24 aa, Staphylococcus aureus
ISKIPRFPFDKFEKGERELGTQMK

SEQ ID NO: 1668677 - protein, 24 aa, Staphylococcus aureus
ISKKITGYGLKTTAVIGGAFTVNM

SEQ ID NO: 1668678 - protein, 26 aa, Staphylococcus aureus
ISKLQQHFQFHLAISGHEGINKDKDD

SEQ ID NO: 1668679 - protein, 19 aa, Staphylococcus aureus
ISKNMLFIPFKGENVDGHR

SEQ ID NO: 1668680 - protein, 18 aa, Staphylococcus aureus
ISKQFWAYLVKTGQLDNP

SEQ ID NO: 1668681 - protein, 20 aa, Staphylococcus aureus
ISKRIKDAFLNENIDILHQQ

SEQ ID NO: 1668682 - protein, 17 aa, Staphylococcus aureus
ISLKEIIGDILYKQSDV

SEQ ID NO: 1668683 - protein, 24 aa, Staphylococcus aureus
ISLMIEYLRFAKCTQELTIEKYGM

SEQ ID NO: 1668684 - protein, 19 aa, Staphylococcus aureus
ISNDFLKPFGHVWLVERWM

SEQ ID NO: 1668685 - protein, 20 aa, Staphylococcus aureus
ISNDFLKPFGHVWLVERWME

SEQ ID NO: 1668686 - protein, 25 aa, Staphylococcus aureus
ISNDFLKSFGHVWLVERWMDDNIEE

SEQ ID NO: 1668687 - protein, 27 aa, Staphylococcus aureus
ISNLTNFGYLKIEIIKEGNEVKQRKMY

SEQ ID NO: 1668688 - protein, 23 aa, Staphylococcus aureus
ISNYILRVRFSINEIVDKDQVLA

SEQ ID NO: 1668689 - protein, 17 aa, Staphylococcus aureus
ISQELWDKVHSRMKQVS

SEQ ID NO: 1668690 - protein, 23 aa, Staphylococcus aureus
ISQRELAEAIGLSRPSVANIISG

SEQ ID NO: 1668691 - protein, 17 aa, Staphylococcus aureus
ISRIPLIVLTSDRPHEL

SEQ ID NO: 1668692 - protein, 24 aa, Staphylococcus aureus
ISRLFKLNKIFIIKEKVSLFKEEI

SEQ ID NO: 1668693 - protein, 25 aa, Staphylococcus aureus
ISRLFKLNKIFIIKEKVSLFKEEIY

SEQ ID NO: 1668694 - protein, 22 aa, Staphylococcus aureus
ISRQRVWGVPLPVFYAENGDII

SEQ ID NO: 1668695 - protein, 17 aa, Staphylococcus aureus
ISSIGVDVSKVYRTNEA

SEQ ID NO: 1668696 - protein, 18 aa, Staphylococcus aureus
ISSIGVDVSNVYRTNEAN

SEQ ID NO: 1668697 - protein, 22 aa, Staphylococcus aureus
ISSMIPVEWEKVYAMAYVNERS

SEQ ID NO: 1668698 - protein, 27 aa, Staphylococcus aureus
ISSMIPVEWEKVYTMAYIDDGGGEVFF

SEQ ID NO: 1668699 - protein, 21 aa, Staphylococcus aureus
ISSMIPVEWEQVFTIAYVTDQ

SEQ ID NO: 1668700 - protein, 20 aa, Staphylococcus aureus
ISTNLADCFNLNEQLPLQFL

SEQ ID NO: 1668701 - protein, 25 aa, Staphylococcus aureus
ISVIDEFFKILKIIPKEYHNINVEL

SEQ ID NO: 1668702 - protein, 22 aa, Staphylococcus aureus
ISVPKNCKLLVIGATEEEVSSS

SEQ ID NO: 1668703 - protein, 17 aa, Staphylococcus aureus
ISVRGRVLGISSQTRYQ

SEQ ID NO: 1668704 - protein, 17 aa, Staphylococcus aureus
ISYIPKVGYYDKITHAH

SEQ ID NO: 1668705 - protein, 21 aa, Staphylococcus aureus
ISYPTIYRYIRNGLVKVDVKR

SEQ ID NO: 1668706 - protein, 26 aa, Staphylococcus aureus
ITDVDLRLSKQAKYTVNFKNGTKKVI

SEQ ID NO: 1668707 - protein, 29 aa, Staphylococcus aureus
ITEMKQKALAKVRMSEIGFILQATNLVPF

SEQ ID NO: 1668708 - protein, 17 aa, Staphylococcus aureus
ITGARYSDVINMTYKDL

SEQ ID NO: 1668709 - protein, 18 aa, Staphylococcus aureus
ITGARYSDVINMTYKDLN

SEQ ID NO: 1668710 - protein, 20 aa, Staphylococcus aureus
ITGQWGKKGYLIKGEKDRLQ

SEQ ID NO: 1668711 - protein, 22 aa, Staphylococcus aureus
ITGRMLPGTKLQAGLHQAIEAK

SEQ ID NO: 1668712 - protein, 22 aa, Staphylococcus aureus
ITHEMHVIRRICDEVAVMESGK

SEQ ID NO: 1668713 - protein, 25 aa, Staphylococcus aureus
ITHKMRVIKDICNRVAVMEKGQVVE

SEQ ID NO: 1668714 - protein, 25 aa, Staphylococcus aureus
ITILRTYYNFCRPFKSADKKVLTPA

SEQ ID NO: 1668715 - protein, 18 aa, Staphylococcus aureus
ITKEQLKMFVYDYDTHLI

SEQ ID NO: 1668716 - protein, 19 aa, Staphylococcus aureus
ITKEQLKMFVYDYDTNLIK

SEQ ID NO: 1668717 - protein, 19 aa, Staphylococcus aureus
ITKRLGFENGEVFREPFVE

SEQ ID NO: 1668718 - protein, 19 aa, Staphylococcus aureus
ITKRLGFENGEVFRESLVE

SEQ ID NO: 1668719 - protein, 32 aa, Staphylococcus aureus
ITLEFKGQDAFEFKPYVKLIFASNELPMSNDK

SEQ ID NO: 1668720 - protein, 17 aa, Staphylococcus aureus
ITNEILQLLLLKIDLNF

SEQ ID NO: 1668721 - protein, 25 aa, Staphylococcus aureus
ITNERIKKEMIDDLNSIIDDFFMET

SEQ ID NO: 1668722 - protein, 26 aa, Staphylococcus aureus
ITPDSIGLILGFLVERFMNNQEKLHI

SEQ ID NO: 1668723 - protein, 18 aa, Staphylococcus aureus
ITPFEKRQSPNISSQLME

SEQ ID NO: 1668724 - protein, 24 aa, Staphylococcus aureus
ITPNNPSGHLINPTQAMDIAYTEK

SEQ ID NO: 1668725 - protein, 20 aa, Staphylococcus aureus
ITRSDIFVRGAIKEHMASLV

SEQ ID NO: 1668726 - protein, 19 aa, Staphylococcus aureus
ITSEGAFKYFSKQYGITPG

SEQ ID NO: 1668727 - protein, 25 aa, Staphylococcus aureus
ITSSQRWGLNQGINANGWMRTDLKG

SEQ ID NO: 1668728 - protein, 29 aa, Staphylococcus aureus
ITTNKDGYKYYSFIDNVGLFSGSHLYVKN

SEQ ID NO: 1668729 - protein, 21 aa, Staphylococcus aureus
ITTPLKNHWNDFIRIYADTLP

SEQ ID NO: 1668730 - protein, 19 aa, Staphylococcus aureus
ITVYIKAHYPDIKVLVLTS

SEQ ID NO: 1668731 - protein, 36 aa, Staphylococcus aureus
ITYKIPKKVIKHAGYVRCKLFLEKEEEKIHVANFSF

SEQ ID NO: 1668732 - protein, 18 aa, Staphylococcus aureus
ITYTLAFYDNENIFFTNI

SEQ ID NO: 1668733 - protein, 18 aa, Staphylococcus aureus
ITYTLAFYDNENVFFTNI

SEQ ID NO: 1668734 - protein, 26 aa, Staphylococcus aureus
IVCKKEFKNNLALCVYYLEKLIKDNK

SEQ ID NO: 1668735 - protein, 23 aa, Staphylococcus aureus
IVDEAKALNRAMDQLSQEITDNE

SEQ ID NO: 1668736 - protein, 23 aa, Staphylococcus aureus
IVDEAKALNRAMNQLSQEITGNE

SEQ ID NO: 1668737 - protein, 17 aa, Staphylococcus aureus
IVDEAKALNRVMDQLSQ

SEQ ID NO: 1668738 - protein, 18 aa, Staphylococcus aureus
IVDEKFCCNDRWLQRYDL

SEQ ID NO: 1668739 - protein, 24 aa, Staphylococcus aureus
IVDFAKKQSVDWVVIGPEQPLIDG

SEQ ID NO: 1668740 - protein, 18 aa, Staphylococcus aureus
IVDWFLKAREKYGIEKVI

SEQ ID NO: 1668741 - protein, 20 aa, Staphylococcus aureus
IVDYAGYTWPGYDDIVSEII

SEQ ID NO: 1668742 - protein, 23 aa, Staphylococcus aureus
IVFATARFYIRVLTRFFQNITKN

SEQ ID NO: 1668743 - protein, 22 aa, Staphylococcus aureus
IVFYQLMFRMGKDSNIHEKLYD

SEQ ID NO: 1668744 - protein, 24 aa, Staphylococcus aureus
IVGGFPCQAFSIAGYQKGFEDERG

SEQ ID NO: 1668745 - protein, 22 aa, Staphylococcus aureus
IVHCPQCGAPMAASNTTNTLKD

SEQ ID NO: 1668746 - protein, 18 aa, Staphylococcus aureus
IVHPREIFSIAVRENANA

SEQ ID NO: 1668747 - protein, 19 aa, Staphylococcus aureus
IVIELTKLMRGINVEKSFN

SEQ ID NO: 1668748 - protein, 26 aa, Staphylococcus aureus
IVKEGRIVGIGAHLRKGDKHAEVQAL

SEQ ID NO: 1668749 - protein, 17 aa, Staphylococcus aureus
IVKELRSRYNISTEKSP

SEQ ID NO: 1668750 - protein, 19 aa, Staphylococcus aureus
IVLEHGQTLFIITHNLSHV

SEQ ID NO: 1668751 - protein, 25 aa, Staphylococcus aureus
IVLFDRSQYQAGWTDYMHFGECLMV

SEQ ID NO: 1668752 - protein, 29 aa, Staphylococcus aureus
IVLKNGEGHSMSGFLISGTQAIILAELNK

SEQ ID NO: 1668753 - protein, 17 aa, Staphylococcus aureus
IVLNGGLIGLPTETVYG

SEQ ID NO: 1668754 - protein, 17 aa, Staphylococcus aureus
IVNYSVNVVFRIKHEHK

SEQ ID NO: 1668755 - protein, 25 aa, Staphylococcus aureus
IVRDKRGGFCYELNTFFKTYLQQKG

SEQ ID NO: 1668756 - protein, 23 aa, Staphylococcus aureus
IVRRYGWGGFKRAGDYAYATGGK

SEQ ID NO: 1668757 - protein, 23 aa, Staphylococcus aureus
IVRSKGIVWLAQYNHVACLLSQA

SEQ ID NO: 1668758 - protein, 17 aa, Staphylococcus aureus
IVSNFGFDVNLDDQILD

SEQ ID NO: 1668759 - protein, 17 aa, Staphylococcus aureus
IVVPGEPKGIIYETSLI

SEQ ID NO: 1668760 - protein, 22 aa, Staphylococcus aureus
IWNYKDMVGDHIIPWSKGGKTE

SEQ ID NO: 1668761 - protein, 20 aa, Staphylococcus aureus
IWQRFGRYTGGLNFNDGRHY

SEQ ID NO: 1668762 - protein, 27 aa, Staphylococcus aureus
IWQRFGSYTGGLNFNGGRHYGIDFQMP

SEQ ID NO: 1668763 - protein, 19 aa, Staphylococcus aureus
IYAGSYSYECHGGETNKTQ

SEQ ID NO: 1668764 - protein, 22 aa, Staphylococcus aureus
IYDEVPGAFGKWNNDNIGPYLP

SEQ ID NO: 1668765 - protein, 17 aa, Staphylococcus aureus
IYDGTVIVKSVAREAGD

SEQ ID NO: 1668766 - protein, 19 aa, Staphylococcus aureus
IYDRTALRHICVDWYDNKN

SEQ ID NO: 1668767 - protein, 19 aa, Staphylococcus aureus
IYGGVSYTIHVGRPKGERV

SEQ ID NO: 1668768 - protein, 24 aa, Staphylococcus aureus
IYGSLIEGFLHWIKDEKIDWPSEE

SEQ ID NO: 1668769 - protein, 20 aa, Staphylococcus aureus
IYHLYDDRGLWVAFNNNEDY

SEQ ID NO: 1668770 - protein, 18 aa, Staphylococcus aureus
IYINKFLNLLNFVSNDKK

SEQ ID NO: 1668771 - protein, 17 aa, Staphylococcus aureus
IYKAHVKALLPLKPQTI

SEQ ID NO: 1668772 - protein, 17 aa, Staphylococcus aureus
IYKIALVGKDEKKYKDG

SEQ ID NO: 1668773 - protein, 17 aa, Staphylococcus aureus
IYLGRFYNQHNELIVIS

SEQ ID NO: 1668774 - protein, 18 aa, Staphylococcus aureus
IYLKYKVAKYLEELSYDF

SEQ ID NO: 1668775 - protein, 17 aa, Staphylococcus aureus
IYLNGVFESINLHIRLK

SEQ ID NO: 1668776 - protein, 19 aa, Staphylococcus aureus
IYLNKGVAVGGDINILTPQ

SEQ ID NO: 1668777 - protein, 18 aa, Staphylococcus aureus
IYLVKNLRNAGVSIESLI

SEQ ID NO: 1668778 - protein, 25 aa, Staphylococcus aureus
IYMGVKRLGKIIAQIQQYTNIDYPI

SEQ ID NO: 1668779 - protein, 18 aa, Staphylococcus aureus
IYNYWKKKNPSLVTNSQI

SEQ ID NO: 1668780 - protein, 21 aa, Staphylococcus aureus
IYPNIFPEFKVEGKSKLIHSF

SEQ ID NO: 1668781 - protein, 22 aa, Staphylococcus aureus
IYQPGIKYDCMIILYGGQGVGK

SEQ ID NO: 1668782 - protein, 25 aa, Staphylococcus aureus
IYRIMKYDWANILVVRRFSNTNKQS

SEQ ID NO: 1668783 - protein, 22 aa, Staphylococcus aureus
IYRPEISSAPGSVSQVRESTQS

SEQ ID NO: 1668784 - protein, 18 aa, Staphylococcus aureus
IYSGVSYTIHVGRPKGQR

SEQ ID NO: 1668785 - protein, 21 aa, Staphylococcus aureus
IYSQRKIDVEPVFGFMKAILG

SEQ ID NO: 1668786 - protein, 34 aa, Staphylococcus aureus
IYSQRKIDVESVFGFMKAILGFTRMSVRGINKVK

SEQ ID NO: 1668787 - protein, 24 aa, Staphylococcus aureus
IYVKLGVNVGREFSGNHFCMVLNN

SEQ ID NO: 1668788 - protein, 17 aa, Staphylococcus aureus
IYVKSNMMFSGYVSEQC

SEQ ID NO: 1668789 - protein, 17 aa, Staphylococcus aureus
IYWSPRTEKKIIDNIIS

SEQ ID NO: 1668790 - protein, 17 aa, Staphylococcus aureus
IYYDGVVIGGLYDNRLL

SEQ ID NO: 1668791 - protein, 22 aa, Staphylococcus aureus
IYYERCGGCQLQHLSYESQLEM

SEQ ID NO: 1668792 - protein, 28 aa, Staphylococcus aureus
KAADIFRSVGIDFCCGGQISIEAASLEK

SEQ ID NO: 1668793 - protein, 25 aa, Staphylococcus aureus
KAADIFRSVGIDFCCGGQVSIEAAS

SEQ ID NO: 1668794 - protein, 24 aa, Staphylococcus aureus
KAAKRSGTTIGFIPTMGVLHDGHL

SEQ ID NO: 1668795 - protein, 18 aa, Staphylococcus aureus
KAATIIFDKGAKHVIIKG

SEQ ID NO: 1668796 - protein, 19 aa, Staphylococcus aureus
KADALKAITALKLQMDEEL

SEQ ID NO: 1668797 - protein, 18 aa, Staphylococcus aureus
KADALKAITALKLQMDKE

SEQ ID NO: 1668798 - protein, 18 aa, Staphylococcus aureus
KADKRELITAKNHLDDPV

SEQ ID NO: 1668799 - protein, 17 aa, Staphylococcus aureus
KADQFKYEVTLPQGVTY

SEQ ID NO: 1668800 - protein, 20 aa, Staphylococcus aureus
KAEERKEKFLAKNKDNPVVS

SEQ ID NO: 1668801 - protein, 25 aa, Staphylococcus aureus
KAFDRLKLNIFISLAELESDNIGEQ

SEQ ID NO: 1668802 - protein, 25 aa, Staphylococcus aureus
KAFDRLKLNIFMSLAELESDNIGEQ

SEQ ID NO: 1668803 - protein, 20 aa, Staphylococcus aureus
KAFNAMHLYDKNGFKTTLGL

SEQ ID NO: 1668804 - protein, 24 aa, Staphylococcus aureus
KAFRHKAKMYVRHKDFSREANRVL

SEQ ID NO: 1668805 - protein, 18 aa, Staphylococcus aureus
KAGTVGRISKFISKSKDT

SEQ ID NO: 1668806 - protein, 19 aa, Staphylococcus aureus
KAHAAAYVLMAVRIAYFKV

SEQ ID NO: 1668807 - protein, 17 aa, Staphylococcus aureus
KAICRKSSHRNCDSKMR

SEQ ID NO: 1668808 - protein, 17 aa, Staphylococcus aureus
KAIEAMKEVGIDISNHT

SEQ ID NO: 1668809 - protein, 21 aa, Staphylococcus aureus
KAIEIILRKNHFFTYYQVFES

SEQ ID NO: 1668810 - protein, 19 aa, Staphylococcus aureus
KAIKEAFANVKANEESKKL

SEQ ID NO: 1668811 - protein, 20 aa, Staphylococcus aureus
KAILNLPIRTWFDKAESEIL

SEQ ID NO: 1668812 - protein, 22 aa, Staphylococcus aureus
KAIRGEGAFCNGIKMKEPPSLK

SEQ ID NO: 1668813 - protein, 19 aa, Staphylococcus aureus
KAISKFSIEGKVINFNSIA

SEQ ID NO: 1668814 - protein, 24 aa, Staphylococcus aureus
KAKAQQLDGAMGQLETSIRDKDTT

SEQ ID NO: 1668815 - protein, 20 aa, Staphylococcus aureus
KAKDRISVIGYPKGAQTKYK

SEQ ID NO: 1668816 - protein, 22 aa, Staphylococcus aureus
KAKKALEEKGFKVESKEEYSDD

SEQ ID NO: 1668817 - protein, 20 aa, Staphylococcus aureus
KAKKKELRESYGNIGFTELK

SEQ ID NO: 1668818 - protein, 18 aa, Staphylococcus aureus
KALAMKAPLGIFSHQLQR

SEQ ID NO: 1668819 - protein, 27 aa, Staphylococcus aureus
KALARELKCPVIALSQLSRGVEQRQDK

SEQ ID NO: 1668820 - protein, 18 aa, Staphylococcus aureus
KALGFKHKGFKEGLSKDY

SEQ ID NO: 1668821 - protein, 21 aa, Staphylococcus aureus
KALLGDLWAAKFAPTQMDESD

SEQ ID NO: 1668822 - protein, 26 aa, Staphylococcus aureus
KALLHETFKAYGVLFVDAQFEPLRKM

SEQ ID NO: 1668823 - protein, 27 aa, Staphylococcus aureus
KALNVNEAWLMGFDISKNRKIENNDIT

SEQ ID NO: 1668824 - protein, 17 aa, Staphylococcus aureus
KALPKQYVYIIEELLYK

SEQ ID NO: 1668825 - protein, 23 aa, Staphylococcus aureus
KALYRQQMVGFVFQYFNLLPTMT

SEQ ID NO: 1668826 - protein, 26 aa, Staphylococcus aureus
KAMMYRDEATWFALMNHLVDVSVKYV

SEQ ID NO: 1668827 - protein, 29 aa, Staphylococcus aureus
KAMVRLSQDWKLRHVLIEMHGNNGSIDND

SEQ ID NO: 1668828 - protein, 29 aa, Staphylococcus aureus
KANEALVKALQAWDIDHLYGIPGDSIDAV

SEQ ID NO: 1668829 - protein, 19 aa, Staphylococcus aureus
KANELRAQINQDKEATAEE

SEQ ID NO: 1668830 - protein, 18 aa, Staphylococcus aureus
KANFIERNIYDHSLMISS

SEQ ID NO: 1668831 - protein, 25 aa, Staphylococcus aureus
KANGKARTGWLIVDYAGYPWPGYDD

SEQ ID NO: 1668832 - protein, 26 aa, Staphylococcus aureus
KANGKARTGWLIVDYAGYTWPGYDDI

SEQ ID NO: 1668833 - protein, 18 aa, Staphylococcus aureus
KANQAIDAKAQETKESID

SEQ ID NO: 1668834 - protein, 17 aa, Staphylococcus aureus
KAPIRMHRLLQGDVGSG

SEQ ID NO: 1668835 - protein, 21 aa, Staphylococcus aureus
KAQAEAGGRPNYRTTGYSQAN

SEQ ID NO: 1668836 - protein, 18 aa, Staphylococcus aureus
KAQAFDEILEGITNAMQH

SEQ ID NO: 1668837 - protein, 18 aa, Staphylococcus aureus
KAQAFDEILEGLHNAMQD

SEQ ID NO: 1668838 - protein, 18 aa, Staphylococcus aureus
KAQAFDEILEGMTNAIQH

SEQ ID NO: 1668839 - protein, 25 aa, Staphylococcus aureus
KAQALDHAMELLRNSIADNQATLAS

SEQ ID NO: 1668840 - protein, 24 aa, Staphylococcus aureus
KAQKEGFPEFDLIISDEAHRTTGA

SEQ ID NO: 1668841 - protein, 25 aa, Staphylococcus aureus
KAQKEGFPEFDLIISDEAHRTTGAH

SEQ ID NO: 1668842 - protein, 24 aa, Staphylococcus aureus
KAQLKALYLTVIDRIDIRKDGNHK

SEQ ID NO: 1668843 - protein, 26 aa, Staphylococcus aureus
KAQSIKAGNKVLPHSKVLLLTDGDLT

SEQ ID NO: 1668844 - protein, 25 aa, Staphylococcus aureus
KAQTLDHAMELLRNSVADNQTTLAS

SEQ ID NO: 1668845 - protein, 18 aa, Staphylococcus aureus
KARIAIRGKGVMVVAPLE

SEQ ID NO: 1668846 - protein, 18 aa, Staphylococcus aureus
KARIMMIFSLYKGEKKKT

SEQ ID NO: 1668847 - protein, 18 aa, Staphylococcus aureus
KARIVIRGKGVMVVAPLE

SEQ ID NO: 1668848 - protein, 20 aa, Staphylococcus aureus
KARRCSRCLKHLNQDEAYCL

SEQ ID NO: 1668849 - protein, 20 aa, Staphylococcus aureus
KARRCSRCLKHLNQNEAYCL

SEQ ID NO: 1668850 - protein, 18 aa, Staphylococcus aureus
KARRCSRCLKQLNQDEAY

SEQ ID NO: 1668851 - protein, 17 aa, Staphylococcus aureus
KARRLAFQTEDMKRQSK

SEQ ID NO: 1668852 - protein, 21 aa, Staphylococcus aureus
KARRLLFWVVMNIIREKHHFD

SEQ ID NO: 1668853 - protein, 22 aa, Staphylococcus aureus
KASKMKWVFQFEIVSAYCVHCI

SEQ ID NO: 1668854 - protein, 18 aa, Staphylococcus aureus
KATARNEITTILNNKLQA

SEQ ID NO: 1668855 - protein, 17 aa, Staphylococcus aureus
KATESKSGLTIIMRSSK

SEQ ID NO: 1668856 - protein, 25 aa, Staphylococcus aureus
KATKPTRIKLKWTPQIMDQIRVLRE

SEQ ID NO: 1668857 - protein, 26 aa, Staphylococcus aureus
KATKPTRIKLKWTPQIMHQIRVLRVL

SEQ ID NO: 1668858 - protein, 30 aa, Staphylococcus aureus
KATQIQTAIQNRIATQTATQTQTVIQNRIA

SEQ ID NO: 1668859 - protein, 18 aa, Staphylococcus aureus
KATTLFGSGWTWLVVNNG

SEQ ID NO: 1668860 - protein, 25 aa, Staphylococcus aureus
KAVAEMKLAVGLLVDKKLSYMRIHS

SEQ ID NO: 1668861 - protein, 17 aa, Staphylococcus aureus
KAVHMGDIFPTTAHKNP

SEQ ID NO: 1668862 - protein, 19 aa, Staphylococcus aureus
KAVHMGDIFPTTAHKNPLW

SEQ ID NO: 1668863 - protein, 25 aa, Staphylococcus aureus
KAVKEADSVLLAWGSYGKKPLVENR

SEQ ID NO: 1668864 - protein, 20 aa, Staphylococcus aureus
KAYYKWRIDETYIKIKAKWN

SEQ ID NO: 1668865 - protein, 20 aa, Staphylococcus aureus
KAYYKWRIDETYIKIKGKWN

SEQ ID NO: 1668866 - protein, 20 aa, Staphylococcus aureus
KAYYKWRIDKTYIKIKGKWN

SEQ ID NO: 1668867 - protein, 19 aa, Staphylococcus aureus
KAYYKYDVHIEVIDQQNKI

SEQ ID NO: 1668868 - protein, 17 aa, Staphylococcus aureus
KCERCWNYSGDLGAVDE

SEQ ID NO: 1668869 - protein, 20 aa, Staphylococcus aureus
KCVYVKWNPYSYTYAKQHQI

SEQ ID NO: 1668870 - protein, 18 aa, Staphylococcus aureus
KCYTFIKGYGDFDGQQTF

SEQ ID NO: 1668871 - protein, 26 aa, Staphylococcus aureus
KDAKIAMEKARLFALKHELKNEIQSM

SEQ ID NO: 1668872 - protein, 27 aa, Staphylococcus aureus
KDAKIAMEKARLFALKHELKSEIQSMI

SEQ ID NO: 1668873 - protein, 18 aa, Staphylococcus aureus
KDALKTQVNNAQRVSDAN

SEQ ID NO: 1668874 - protein, 24 aa, Staphylococcus aureus
KDAVKRQIEGATHVNEVTQAQNNA

SEQ ID NO: 1668875 - protein, 25 aa, Staphylococcus aureus
KDDAIKNKVSFLIDKKSGYFYIVND

SEQ ID NO: 1668876 - protein, 19 aa, Staphylococcus aureus
KDELREFIEMAKIPVIHSL

SEQ ID NO: 1668877 - protein, 19 aa, Staphylococcus aureus
KDFKAFNVEGLDARMEAVN

SEQ ID NO: 1668878 - protein, 18 aa, Staphylococcus aureus
KDFLVVTHIIPWHENEFI

SEQ ID NO: 1668879 - protein, 17 aa, Staphylococcus aureus
KDGFVFGGYIEWPTLDY

SEQ ID NO: 1668880 - protein, 18 aa, Staphylococcus aureus
KDGFVFGGYIEWPTLDYY

SEQ ID NO: 1668881 - protein, 21 aa, Staphylococcus aureus
KDHKTRMALHPLKEFAKSKLI

SEQ ID NO: 1668882 - protein, 40 aa, Staphylococcus aureus
KDHPARESYEFGFAVSEGRTRASIILTFVADLRNYIDNEI

SEQ ID NO: 1668883 - protein, 20 aa, Staphylococcus aureus
KDIAHWEVSSGGYFVWLVFK

SEQ ID NO: 1668884 - protein, 19 aa, Staphylococcus aureus
KDIEKMTAIVNIVKGDREN

SEQ ID NO: 1668885 - protein, 17 aa, Staphylococcus aureus
KDIITPFSIRNDEINFK

SEQ ID NO: 1668886 - protein, 17 aa, Staphylococcus aureus
KDIKTFYVWGYYKNEQI

SEQ ID NO: 1668887 - protein, 26 aa, Staphylococcus aureus
KDIYNYYFAGFLIKFEINEQNSPLFI

SEQ ID NO: 1668888 - protein, 21 aa, Staphylococcus aureus
KDKAMLKIACINLNEYQDKLK

SEQ ID NO: 1668889 - protein, 23 aa, Staphylococcus aureus
KDKKGNDVVLVYKKVKDGFDVQV

SEQ ID NO: 1668890 - protein, 20 aa, Staphylococcus aureus
KDKQTIIQYIVNYDVNITEK

SEQ ID NO: 1668891 - protein, 23 aa, Staphylococcus aureus
KDKSRPYVVTTLFSTKDNFTKDN

SEQ ID NO: 1668892 - protein, 20 aa, Staphylococcus aureus
KDLHRYYSSESFEFSNISGK

SEQ ID NO: 1668893 - protein, 17 aa, Staphylococcus aureus
KDLKAYYDKGYKTDITN

SEQ ID NO: 1668894 - protein, 22 aa, Staphylococcus aureus
KDLKIKAFEAHASQTGPFLKQL

SEQ ID NO: 1668895 - protein, 27 aa, Staphylococcus aureus
KDLNDFGPAWIERFVRVQIEEAFAVAL

SEQ ID NO: 1668896 - protein, 20 aa, Staphylococcus aureus
KDLNKANGIVHLPGTKTKNS

SEQ ID NO: 1668897 - protein, 20 aa, Staphylococcus aureus
KDLREAIQLRLNRKEQVVLF

SEQ ID NO: 1668898 - protein, 27 aa, Staphylococcus aureus
KDLTVREIGYLLGFSDTYFIKLRNGSR

SEQ ID NO: 1668899 - protein, 17 aa, Staphylococcus aureus
KDLVKAKEDAKQDVDKQ

SEQ ID NO: 1668900 - protein, 19 aa, Staphylococcus aureus
KDLYFAGASTHPGAGVPIV

SEQ ID NO: 1668901 - protein, 18 aa, Staphylococcus aureus
KDMMVNGGVLMAHLNAKS

SEQ ID NO: 1668902 - protein, 19 aa, Staphylococcus aureus
KDNDYLKIIEKITKKEKTT

SEQ ID NO: 1668903 - protein, 25 aa, Staphylococcus aureus
KDNESKLGGFDWFKRKTNKKDTHEN

SEQ ID NO: 1668904 - protein, 18 aa, Staphylococcus aureus
KDNESVWAGVNYSDSAKT

SEQ ID NO: 1668905 - protein, 18 aa, Staphylococcus aureus
KDNESVWAGVNYSNSTQT

SEQ ID NO: 1668906 - protein, 20 aa, Staphylococcus aureus
KDNFYIISIEIVFFHLSKNF

SEQ ID NO: 1668907 - protein, 23 aa, Staphylococcus aureus
KDNSLDNLIIYALYDQFRDMITL

SEQ ID NO: 1668908 - protein, 25 aa, Staphylococcus aureus
KDNYRKLTCLHVNHGVRSASIEEAR

SEQ ID NO: 1668909 - protein, 22 aa, Staphylococcus aureus
KDPDYIQGYLFLQSLYENEKKL

SEQ ID NO: 1668910 - protein, 22 aa, Staphylococcus aureus
KDPDYIQGYLFLQSLYENEKNY

SEQ ID NO: 1668911 - protein, 21 aa, Staphylococcus aureus
KDPKRRIPYMEIVGQVHGTYI

SEQ ID NO: 1668912 - protein, 20 aa, Staphylococcus aureus
KDPKYKLSVDEIIEKEHLDK

SEQ ID NO: 1668913 - protein, 19 aa, Staphylococcus aureus
KDQHVITFSLEIVNERYLR

SEQ ID NO: 1668914 - protein, 17 aa, Staphylococcus aureus
KDQMFYATYEFKNDKIF

SEQ ID NO: 1668915 - protein, 18 aa, Staphylococcus aureus
KDREFLWNKVHDVEKRKD

SEQ ID NO: 1668916 - protein, 18 aa, Staphylococcus aureus
KDRSHILEGLRIALDHID

SEQ ID NO: 1668917 - protein, 21 aa, Staphylococcus aureus
KDSDCSIVAELIIKSAGDSKM

SEQ ID NO: 1668918 - protein, 25 aa, Staphylococcus aureus
KDSEHYGLWAFKKVWGTYLSEKIGE

SEQ ID NO: 1668919 - protein, 19 aa, Staphylococcus aureus
KDSGLKYNISYASKAFTCI

SEQ ID NO: 1668920 - protein, 24 aa, Staphylococcus aureus
KDSLGFDHDTIWLSVLPIYHISGL

SEQ ID NO: 1668921 - protein, 22 aa, Staphylococcus aureus
KDSTGLPHEHFTAARDNQTFTV

SEQ ID NO: 1668922 - protein, 17 aa, Staphylococcus aureus
KDTCARVIYVMNGVIHQ

SEQ ID NO: 1668923 - protein, 23 aa, Staphylococcus aureus
KDTEPTSAISFMAYEIENANNHN

SEQ ID NO: 1668924 - protein, 19 aa, Staphylococcus aureus
KDTLFKEHVFKTVYDQTMG

SEQ ID NO: 1668925 - protein, 30 aa, Staphylococcus aureus
KDTVYNVLFLWRLSSELNVAQLRQAVQHLI

SEQ ID NO: 1668926 - protein, 21 aa, Staphylococcus aureus
KDVEYPLFFMVTKNLSRKQEL

SEQ ID NO: 1668927 - protein, 24 aa, Staphylococcus aureus
KDVKKILNFINEFIFADKLPSEEI

SEQ ID NO: 1668928 - protein, 21 aa, Staphylococcus aureus
KDVTEIIAAQLLYTIKKYGPD

SEQ ID NO: 1668929 - protein, 22 aa, Staphylococcus aureus
KDVTEIIAAQLLYTIKKYGPDR

SEQ ID NO: 1668930 - protein, 23 aa, Staphylococcus aureus
KDVTEIIAAQLLYTIKKYGPDRI

SEQ ID NO: 1668931 - protein, 21 aa, Staphylococcus aureus
KDVYECRFLTIATGYYGQHNT

SEQ ID NO: 1668932 - protein, 17 aa, Staphylococcus aureus
KDWSSIAFIVPSNKVAF

SEQ ID NO: 1668933 - protein, 21 aa, Staphylococcus aureus
KDYIQPRMTMITPIDKTDDEL

SEQ ID NO: 1668934 - protein, 17 aa, Staphylococcus aureus
KDYKFLKQYGVSNTFIC

SEQ ID NO: 1668935 - protein, 22 aa, Staphylococcus aureus
KDYKVWCHSNFIRKPVNKDDFI

SEQ ID NO: 1668936 - protein, 20 aa, Staphylococcus aureus
KEAHPYFDQDVVIIGGKNSA

SEQ ID NO: 1668937 - protein, 22 aa, Staphylococcus aureus
KEALQRMAMMRSYMRSQVTQQP

SEQ ID NO: 1668938 - protein, 17 aa, Staphylococcus aureus
KEARRMLDEAGFTETKI

SEQ ID NO: 1668939 - protein, 24 aa, Staphylococcus aureus
KEAYEALQGVWLMEMAELAATRKA

SEQ ID NO: 1668940 - protein, 26 aa, Staphylococcus aureus
KECNLYRLLREISMESVKCIEPMNDV

SEQ ID NO: 1668941 - protein, 26 aa, Staphylococcus aureus
KECYEIYHPLESVGIYVPGGKASYPS

SEQ ID NO: 1668942 - protein, 24 aa, Staphylococcus aureus
KEDIKAQRIMKVVQLIADKYGVSD

SEQ ID NO: 1668943 - protein, 23 aa, Staphylococcus aureus
KEDIKKRVNLCSSMVQLDNDLDK

SEQ ID NO: 1668944 - protein, 25 aa, Staphylococcus aureus
KEDIYLDEAVGIMVSQVVYKYEEEQ

SEQ ID NO: 1668945 - protein, 20 aa, Staphylococcus aureus
KEDLLRARRTYAFTELFLFE

SEQ ID NO: 1668946 - protein, 41 aa, Staphylococcus aureus
KEDLLRARRTYAFTELFLFELRMQWLNRLEKSSDEAIEIDY

SEQ ID NO: 1668947 - protein, 27 aa, Staphylococcus aureus
KEDWSFIKKAIAYYRFRPYAKKILEEN

SEQ ID NO: 1668948 - protein, 17 aa, Staphylococcus aureus
KEEIKKEVLYLLKCVGL

SEQ ID NO: 1668949 - protein, 25 aa, Staphylococcus aureus
KEEKRCPSCHMTLKDIAHVGKFGCA

SEQ ID NO: 1668950 - protein, 25 aa, Staphylococcus aureus
KEELKRMFEEAGFINVRVRSFTGGV

SEQ ID NO: 1668951 - protein, 21 aa, Staphylococcus aureus
KEEPIKLLALITSNYRLFYQC

SEQ ID NO: 1668952 - protein, 17 aa, Staphylococcus aureus
KEEVKKEKAQIENRYQQ

SEQ ID NO: 1668953 - protein, 18 aa, Staphylococcus aureus
KEFFNFMNKNCEGIQRIH

SEQ ID NO: 1668954 - protein, 20 aa, Staphylococcus aureus
KEFYCNNCGFKIYQEKITKK

SEQ ID NO: 1668955 - protein, 20 aa, Staphylococcus aureus
KEGDCFLKYYQWKMKKEHII

SEQ ID NO: 1668956 - protein, 28 aa, Staphylococcus aureus
KEGDTFKFKYGQYFRPGSVRLPSQTQNL

SEQ ID NO: 1668957 - protein, 24 aa, Staphylococcus aureus
KEGEAEFFKKVFVGYTDSEDHSED

SEQ ID NO: 1668958 - protein, 23 aa, Staphylococcus aureus
KEGEAEFFKKVFVGYTDSGEHSD

SEQ ID NO: 1668959 - protein, 25 aa, Staphylococcus aureus
KEGIELDEAIGIMVSQVIYEYKEEL

SEQ ID NO: 1668960 - protein, 25 aa, Staphylococcus aureus
KEGIELDEAVGIVAGQVVYKYEEEQ

SEQ ID NO: 1668961 - protein, 20 aa, Staphylococcus aureus
KEGKSYPRIISELLGHHEAL

SEQ ID NO: 1668962 - protein, 18 aa, Staphylococcus aureus
KEGKWTGMCGEMAGDETA

SEQ ID NO: 1668963 - protein, 20 aa, Staphylococcus aureus
KEGNIDCVMIYKTNRLARNT

SEQ ID NO: 1668964 - protein, 28 aa, Staphylococcus aureus
KEGPERFWPADLVLLSIGFEGTEPTVPN

SEQ ID NO: 1668965 - protein, 18 aa, Staphylococcus aureus
KEGVGIDLARLSLEKAET

SEQ ID NO: 1668966 - protein, 18 aa, Staphylococcus aureus
KEHLNQFFGSKRYLYQDN

SEQ ID NO: 1668967 - protein, 23 aa, Staphylococcus aureus
KEHYKGNIYLIGHSMGGYGSVLY

SEQ ID NO: 1668968 - protein, 25 aa, Staphylococcus aureus
KEIEEFKFFVQYGNFKELENYKEDE

SEQ ID NO: 1668969 - protein, 22 aa, Staphylococcus aureus
KEIEKFKFFVQYGNFKELKNYK

SEQ ID NO: 1668970 - protein, 26 aa, Staphylococcus aureus
KEIENFKFFVQYGDFKDINDYKDGDI

SEQ ID NO: 1668971 - protein, 21 aa, Staphylococcus aureus
KEIIDFEFVIAKSFVEGKYID

SEQ ID NO: 1668972 - protein, 21 aa, Staphylococcus aureus
KEIKYSVTVDGFLETYSTVEQ

SEQ ID NO: 1668973 - protein, 17 aa, Staphylococcus aureus
KEILQTMQVGVGRRNKF

SEQ ID NO: 1668974 - protein, 17 aa, Staphylococcus aureus
KEIRPFKNELVTICNPE

SEQ ID NO: 1668975 - protein, 21 aa, Staphylococcus aureus
KEIYQFPLLLFYKGNIKLIKI

SEQ ID NO: 1668976 - protein, 26 aa, Staphylococcus aureus
KEIYQFPLLLFYKGNIKLINNMHHLA

SEQ ID NO: 1668977 - protein, 22 aa, Staphylococcus aureus
KEKGFTPKLSVILVGNDGASQS

SEQ ID NO: 1668978 - protein, 23 aa, Staphylococcus aureus
KEKPMEWRGWGFLNEMLISEGDI

SEQ ID NO: 1668979 - protein, 18 aa, Staphylococcus aureus
KEKQALKDRINQICNKVI

SEQ ID NO: 1668980 - protein, 17 aa, Staphylococcus aureus
KEKTIKFEVKQEAATLW

SEQ ID NO: 1668981 - protein, 20 aa, Staphylococcus aureus
KEKYPRLLVTRTVKQGTGKY

SEQ ID NO: 1668982 - protein, 22 aa, Staphylococcus aureus
KELAVDILAGVGIIALTIVNPV

SEQ ID NO: 1668983 - protein, 20 aa, Staphylococcus aureus
KELDFKLRKQLIEKHNLYGN

SEQ ID NO: 1668984 - protein, 21 aa, Staphylococcus aureus
KELFENYILHNWDKVNQSINE

SEQ ID NO: 1668985 - protein, 21 aa, Staphylococcus aureus
KELGKGFTLQRYKGLGEMNSE

SEQ ID NO: 1668986 - protein, 17 aa, Staphylococcus aureus
KELIKYAKSVTIILTTD

SEQ ID NO: 1668987 - protein, 21 aa, Staphylococcus aureus
KELILKTVIDLVDKRVPIIAG

SEQ ID NO: 1668988 - protein, 21 aa, Staphylococcus aureus
KELILKTVIDLVDKRVTIIAG

SEQ ID NO: 1668989 - protein, 20 aa, Staphylococcus aureus
KELIRFNADYAKIEGELSYR

SEQ ID NO: 1668990 - protein, 20 aa, Staphylococcus aureus
KELIVSSLMINKRASFGKSN

SEQ ID NO: 1668991 - protein, 20 aa, Staphylococcus aureus
KELKEMYKTGLWEFETHTHD

SEQ ID NO: 1668992 - protein, 17 aa, Staphylococcus aureus
KELKEMYKTGLWELETH

SEQ ID NO: 1668993 - protein, 21 aa, Staphylococcus aureus
KELLIADSFYREEYALYDDIF

SEQ ID NO: 1668994 - protein, 19 aa, Staphylococcus aureus
KELLVDMIAVQNLEQRAAE

SEQ ID NO: 1668995 - protein, 17 aa, Staphylococcus aureus
KELRCNINDLIVLDSGF

SEQ ID NO: 1668996 - protein, 19 aa, Staphylococcus aureus
KELRKRYNIPTEKAPKLLL

SEQ ID NO: 1668997 - protein, 18 aa, Staphylococcus aureus
KELSELVERVDDVEILAN

SEQ ID NO: 1668998 - protein, 19 aa, Staphylococcus aureus
KELSTGHTLVMGRKTFESI

SEQ ID NO: 1668999 - protein, 19 aa, Staphylococcus aureus
KELVDIFFGDVIDKNTGYF

SEQ ID NO: 1669000 - protein, 26 aa, Staphylococcus aureus
KELVDMFNKRYDIIIVDTPPVNTVTD

SEQ ID NO: 1669001 - protein, 19 aa, Staphylococcus aureus
KELVHLSINFKKRTTTYDV

SEQ ID NO: 1669002 - protein, 21 aa, Staphylococcus aureus
KEMAFPSLASVAYKAVAEKKL

SEQ ID NO: 1669003 - protein, 18 aa, Staphylococcus aureus
KEMGLVFLAHNFRKLVTR

SEQ ID NO: 1669004 - protein, 32 aa, Staphylococcus aureus
KEMGRPAQCVFLSWNRYLYRNAQNYINSSDYI

SEQ ID NO: 1669005 - protein, 32 aa, Staphylococcus aureus
KEMGRPAQCVFLSWNRYLYRNAQNYITRSDYI

SEQ ID NO: 1669006 - protein, 21 aa, Staphylococcus aureus
KEMKDSNLIYQWRRRYVRANK

SEQ ID NO: 1669007 - protein, 30 aa, Staphylococcus aureus
KENLEAATHCVTRLRLVLKDESKVDKDALS

SEQ ID NO: 1669008 - protein, 20 aa, Staphylococcus aureus
KENLEAMGGGDLVGGILDPD

SEQ ID NO: 1669009 - protein, 18 aa, Staphylococcus aureus
KENPMIITSFRPFTKKWM

SEQ ID NO: 1669010 - protein, 20 aa, Staphylococcus aureus
KENVFKIIVNEEGKRIIFCP

SEQ ID NO: 1669011 - protein, 27 aa, Staphylococcus aureus
KENYKLLIGSIIPRPIAFVTTLNQDIS

SEQ ID NO: 1669012 - protein, 17 aa, Staphylococcus aureus
KEPKIAIIAEIKSKSPT

SEQ ID NO: 1669013 - protein, 32 aa, Staphylococcus aureus
KEPLDDVIEMSRPVKMNSLLKLYFDRNLLTPQ

SEQ ID NO: 1669014 - protein, 17 aa, Staphylococcus aureus
KEPVRLFAVKKQKELAA

SEQ ID NO: 1669015 - protein, 18 aa, Staphylococcus aureus
KEQNELDSQANQYQQLPQ

SEQ ID NO: 1669016 - protein, 24 aa, Staphylococcus aureus
KEQNGRKGYAIGFEGLINYINDQL

SEQ ID NO: 1669017 - protein, 22 aa, Staphylococcus aureus
KEQQARITLYLKHNTIEPNTIK

SEQ ID NO: 1669018 - protein, 17 aa, Staphylococcus aureus
KERYEAQATRALDYLEN

SEQ ID NO: 1669019 - protein, 37 aa, Staphylococcus aureus
KESDIKIRVENVLKICGLYAFRNWPIVALSYGQKKRV

SEQ ID NO: 1669020 - protein, 33 aa, Staphylococcus aureus
KESDIKIRVENVLKICRLYAFRNWPIAALSYGQ

SEQ ID NO: 1669021 - protein, 19 aa, Staphylococcus aureus
KESGLKYNISYASKAFTCL

SEQ ID NO: 1669022 - protein, 23 aa, Staphylococcus aureus
KESHQWIGFIGLNYIPETSEYPF

SEQ ID NO: 1669023 - protein, 17 aa, Staphylococcus aureus
KESKLVSYIACGATGAG

SEQ ID NO: 1669024 - protein, 25 aa, Staphylococcus aureus
KESLGFDHDTNWLSVLPIYHISGLS

SEQ ID NO: 1669025 - protein, 27 aa, Staphylococcus aureus
KESNLPFELIGAIPVLIKKNGNIDEYI

SEQ ID NO: 1669026 - protein, 22 aa, Staphylococcus aureus
KETHQWIGFIGLNYIPETSDYP

SEQ ID NO: 1669027 - protein, 21 aa, Staphylococcus aureus
KETKFLKWLGIKISNTPEYLE

SEQ ID NO: 1669028 - protein, 18 aa, Staphylococcus aureus
KETTTYELMKAMLNSPMY

SEQ ID NO: 1669029 - protein, 20 aa, Staphylococcus aureus
KETVDLPVIGIVKRDYDYSD

SEQ ID NO: 1669030 - protein, 17 aa, Staphylococcus aureus
KETWSQQIEMFLGNKAR

SEQ ID NO: 1669031 - protein, 22 aa, Staphylococcus aureus
KEVERVTSHVVIRGRHPNEFVS

SEQ ID NO: 1669032 - protein, 17 aa, Staphylococcus aureus
KEVMKYINKESAEIDKE

SEQ ID NO: 1669033 - protein, 17 aa, Staphylococcus aureus
KEVPYKEIIDANRIKDK

SEQ ID NO: 1669034 - protein, 17 aa, Staphylococcus aureus
KEVQKDIAIYAPLTGEF

SEQ ID NO: 1669035 - protein, 30 aa, Staphylococcus aureus
KEVTGSGVFMEWSCLFVIKSDDLRDCKRKA

SEQ ID NO: 1669036 - protein, 17 aa, Staphylococcus aureus
KEVTTYNGLKQVNYWYV

SEQ ID NO: 1669037 - protein, 25 aa, Staphylococcus aureus
KEWRDFSKDLGYWVDMDSPYITLEN

SEQ ID NO: 1669038 - protein, 20 aa, Staphylococcus aureus
KEYFNWLKQNYIFKELDSST

SEQ ID NO: 1669039 - protein, 17 aa, Staphylococcus aureus
KEYLNQFFGSKRYLYQD

SEQ ID NO: 1669040 - protein, 20 aa, Staphylococcus aureus
KFADILIRQKIEVFAIDNLG

SEQ ID NO: 1669041 - protein, 22 aa, Staphylococcus aureus
KFATNKFKVFAAISDTVIHGSD

SEQ ID NO: 1669042 - protein, 27 aa, Staphylococcus aureus
KFCSNNRWLQRYDLISERNHFNYIRNG

SEQ ID NO: 1669043 - protein, 18 aa, Staphylococcus aureus
KFDILSWLQDPFATPTLG

SEQ ID NO: 1669044 - protein, 24 aa, Staphylococcus aureus
KFDRPYIVAISIMYLFEMFSISNE

SEQ ID NO: 1669045 - protein, 19 aa, Staphylococcus aureus
KFEDVRIVRDMRNSVNRLV

SEQ ID NO: 1669046 - protein, 26 aa, Staphylococcus aureus
KFEGLKLYGIDIAERIEVIVPETVHN

SEQ ID NO: 1669047 - protein, 18 aa, Staphylococcus aureus
KFEGYGILSHQSIDDLKV

SEQ ID NO: 1669048 - protein, 20 aa, Staphylococcus aureus
KFEYEPVEFFANNAIKSYDV

SEQ ID NO: 1669049 - protein, 17 aa, Staphylococcus aureus
KFFKEREGKYQVEGCFI

SEQ ID NO: 1669050 - protein, 17 aa, Staphylococcus aureus
KFFKEREGKYQVEVKEA

SEQ ID NO: 1669051 - protein, 21 aa, Staphylococcus aureus
KFGIWPEKEYAINWVEKIKNY

SEQ ID NO: 1669052 - protein, 26 aa, Staphylococcus aureus
KFGPDFVPNIKLQWLAIDKGKVETTV

SEQ ID NO: 1669053 - protein, 17 aa, Staphylococcus aureus
KFIDEVFDIVRIDGNDP

SEQ ID NO: 1669054 - protein, 19 aa, Staphylococcus aureus
KFKELSYNFERPLKVEGVS

SEQ ID NO: 1669055 - protein, 18 aa, Staphylococcus aureus
KFKSAIFNTQNWKYDELN

SEQ ID NO: 1669056 - protein, 20 aa, Staphylococcus aureus
KFKSDIFKTQNWKYDELNDE

SEQ ID NO: 1669057 - protein, 19 aa, Staphylococcus aureus
KFKSGIFNTQNWKYDELNN

SEQ ID NO: 1669058 - protein, 21 aa, Staphylococcus aureus
KFKYKNFEDEIEIDFTDSNHL

SEQ ID NO: 1669059 - protein, 18 aa, Staphylococcus aureus
KFLADKFANMRCYTEKVY

SEQ ID NO: 1669060 - protein, 19 aa, Staphylococcus aureus
KFLECVLVYKSDVEKELFE

SEQ ID NO: 1669061 - protein, 17 aa, Staphylococcus aureus
KFLSCLMSKVNGTYRFR

SEQ ID NO: 1669062 - protein, 21 aa, Staphylococcus aureus
KFNVPSPKYKAIRSYEEAKEF

SEQ ID NO: 1669063 - protein, 21 aa, Staphylococcus aureus
KFPNTPQNMWVFNDDLENLDI

SEQ ID NO: 1669064 - protein, 18 aa, Staphylococcus aureus
KFYGCLFATVDGFNVKAF

SEQ ID NO: 1669065 - protein, 26 aa, Staphylococcus aureus
KFYQQLFKLLEDMRVLNSIKVKRPST

SEQ ID NO: 1669066 - protein, 27 aa, Staphylococcus aureus
KFYQQLFKLLEDMRVLNSINVERPSTA

SEQ ID NO: 1669067 - protein, 20 aa, Staphylococcus aureus
KFYSLDGINGLSLLDTLSRT

SEQ ID NO: 1669068 - protein, 29 aa, Staphylococcus aureus
KGALWTLAQEVYQEWYLGSKLYEEVEKKI

SEQ ID NO: 1669069 - protein, 21 aa, Staphylococcus aureus
KGCSYREQLEMILYKYSFSTK

SEQ ID NO: 1669070 - protein, 24 aa, Staphylococcus aureus
KGDEAKEYWLCWVTTERNEQGPYY

SEQ ID NO: 1669071 - protein, 26 aa, Staphylococcus aureus
KGDGLNAINPIAPVTVVKQAARDAVS

SEQ ID NO: 1669072 - protein, 21 aa, Staphylococcus aureus
KGECLKDCLSLEMICDELWVF

SEQ ID NO: 1669073 - protein, 20 aa, Staphylococcus aureus
KGEDIIECITTFADDQDLTF

SEQ ID NO: 1669074 - protein, 19 aa, Staphylococcus aureus
KGEDIVECITNFADDQDLT

SEQ ID NO: 1669075 - protein, 25 aa, Staphylococcus aureus
KGEIPREEVATVLKEIVTSNHFNHQ

SEQ ID NO: 1669076 - protein, 24 aa, Staphylococcus aureus
KGENTFKISAYRKAAQSLELDERP

SEQ ID NO: 1669077 - protein, 25 aa, Staphylococcus aureus
KGESYKRRVMWLPIYTKPAKKEKNF

SEQ ID NO: 1669078 - protein, 20 aa, Staphylococcus aureus
KGFDFKGEFPKPDKSKYNGQ

SEQ ID NO: 1669079 - protein, 23 aa, Staphylococcus aureus
KGFKGLAGAMLFNLKPINVLKNS

SEQ ID NO: 1669080 - protein, 40 aa, Staphylococcus aureus
KGFLTYKIPKKVIKHAGYVRCKLFLEKKEQKIHVANFSFN

SEQ ID NO: 1669081 - protein, 24 aa, Staphylococcus aureus
KGGIKEFKLDFANKNIIGKLGKLL

SEQ ID NO: 1669082 - protein, 24 aa, Staphylococcus aureus
KGGSLKTDSGFVLIPEEIVTDILT

SEQ ID NO: 1669083 - protein, 21 aa, Staphylococcus aureus
KGHALYEIVCLDVQKLQQAVV

SEQ ID NO: 1669084 - protein, 23 aa, Staphylococcus aureus
KGHELYEIVCLDVQKLQQAVVAK

SEQ ID NO: 1669085 - protein, 21 aa, Staphylococcus aureus
KGHTCAALYAILYKLNKLKEK

SEQ ID NO: 1669086 - protein, 22 aa, Staphylococcus aureus
KGIECIYALYKKNRRSLQIYGF

SEQ ID NO: 1669087 - protein, 22 aa, Staphylococcus aureus
KGIECIYTLYKKNRRSLQIYGF

SEQ ID NO: 1669088 - protein, 25 aa, Staphylococcus aureus
KGIYKFKYVILEAVRKVFDYKSIYE

SEQ ID NO: 1669089 - protein, 19 aa, Staphylococcus aureus
KGKAVEILDLVGIKNAELR

SEQ ID NO: 1669090 - protein, 20 aa, Staphylococcus aureus
KGKKVILLTAHRRENIGESM

SEQ ID NO: 1669091 - protein, 19 aa, Staphylococcus aureus
KGKPFSIGSVTYILSNPFY

SEQ ID NO: 1669092 - protein, 22 aa, Staphylococcus aureus
KGKQLFMPIRVAVTGQMHGPEL

SEQ ID NO: 1669093 - protein, 19 aa, Staphylococcus aureus
KGKVLKNHFEISVIDEFFK

SEQ ID NO: 1669094 - protein, 22 aa, Staphylococcus aureus
KGLEKREWIIRIKVANDKRSNY

SEQ ID NO: 1669095 - protein, 29 aa, Staphylococcus aureus
KGLGIPSYILHRISDEFKEKGYSPTLNDF

SEQ ID NO: 1669096 - protein, 27 aa, Staphylococcus aureus
KGLMKRYKLLFHILNLTGVHKYDYSTI

SEQ ID NO: 1669097 - protein, 28 aa, Staphylococcus aureus
KGLNKHFYKECDRCLKAYNIFIEGINKH

SEQ ID NO: 1669098 - protein, 24 aa, Staphylococcus aureus
KGMGTTCVCAIVFEKSVVIANVGD

SEQ ID NO: 1669099 - protein, 20 aa, Staphylococcus aureus
KGMPHVKLLSRTEIEELNEG

SEQ ID NO: 1669100 - protein, 33 aa, Staphylococcus aureus
KGMVGAISRFYPKARFQHCCVHVSRNISHKVRV

SEQ ID NO: 1669101 - protein, 17 aa, Staphylococcus aureus
KGQIDRFNTYNNKEIYD

SEQ ID NO: 1669102 - protein, 17 aa, Staphylococcus aureus
KGRHEISDVPKLLELKN

SEQ ID NO: 1669103 - protein, 19 aa, Staphylococcus aureus
KGRQAYVICPLIESSEHLE

SEQ ID NO: 1669104 - protein, 19 aa, Staphylococcus aureus
KGSEFTFTPEAPKTITELE

SEQ ID NO: 1669105 - protein, 24 aa, Staphylococcus aureus
KGSWPEVRESLIFEESKQTMQQLV

SEQ ID NO: 1669106 - protein, 17 aa, Staphylococcus aureus
KGTEITSTFYPKMFKAH

SEQ ID NO: 1669107 - protein, 21 aa, Staphylococcus aureus
KGTEKKFTFWADKPGAYWVGE

SEQ ID NO: 1669108 - protein, 20 aa, Staphylococcus aureus
KGTELEDFAAFNLSIEDTVT

SEQ ID NO: 1669109 - protein, 21 aa, Staphylococcus aureus
KGTELEDFAAFNLSIEDTVTV

SEQ ID NO: 1669110 - protein, 20 aa, Staphylococcus aureus
KGTTVKLIFPLQNEIVERMS

SEQ ID NO: 1669111 - protein, 20 aa, Staphylococcus aureus
KGVAVVICPNDLLTEKIKDT

SEQ ID NO: 1669112 - protein, 31 aa, Staphylococcus aureus
KGVEINGAFPRMTYKEAMRRFGSDKPDTRFE

SEQ ID NO: 1669113 - protein, 20 aa, Staphylococcus aureus
KGVFDYRRSLLRTDVVLNSE

SEQ ID NO: 1669114 - protein, 22 aa, Staphylococcus aureus
KGYFKRRLSMFGTVVFSVEENG

SEQ ID NO: 1669115 - protein, 24 aa, Staphylococcus aureus
KGYFPMWVTMNVLTLGNIVNMYDI

SEQ ID NO: 1669116 - protein, 23 aa, Staphylococcus aureus
KHAFSEKLKALGYDIDKEAQIDL

SEQ ID NO: 1669117 - protein, 20 aa, Staphylococcus aureus
KHDALMLCERLYDKGYGCLL

SEQ ID NO: 1669118 - protein, 23 aa, Staphylococcus aureus
KHDFNLKGRIGWQGLTSNEYQTV

SEQ ID NO: 1669119 - protein, 19 aa, Staphylococcus aureus
KHFEFHSKLDYVSTINLSR

SEQ ID NO: 1669120 - protein, 22 aa, Staphylococcus aureus
KHGRKSYQYDWFYHSKAWKRLR

SEQ ID NO: 1669121 - protein, 23 aa, Staphylococcus aureus
KHGRKSYRYDWFYHSKAWKKLRE

SEQ ID NO: 1669122 - protein, 17 aa, Staphylococcus aureus
KHHLYINDFPAIPIEEN

SEQ ID NO: 1669123 - protein, 25 aa, Staphylococcus aureus
KHIEHLSSYYKFKQPTLLYDQQIQR

SEQ ID NO: 1669124 - protein, 18 aa, Staphylococcus aureus
KHIPMMPDKVFMEDIREA

SEQ ID NO: 1669125 - protein, 18 aa, Staphylococcus aureus
KHIPMMPDKVLMDDIQEA

SEQ ID NO: 1669126 - protein, 18 aa, Staphylococcus aureus
KHISDIIGVMYLGHIVEI

SEQ ID NO: 1669127 - protein, 21 aa, Staphylococcus aureus
KHKLKHLLVETSVDKKAMESL

SEQ ID NO: 1669128 - protein, 23 aa, Staphylococcus aureus
KHKRKYWCSKGLALPEVYAGNYS

SEQ ID NO: 1669129 - protein, 23 aa, Staphylococcus aureus
KHLDIPAGAAVRFEPGDKKEVQL

SEQ ID NO: 1669130 - protein, 21 aa, Staphylococcus aureus
KHLKNSGGIALLPEFIVADEL

SEQ ID NO: 1669131 - protein, 22 aa, Staphylococcus aureus
KHLTLSFVEFTILAIITSQNKN

SEQ ID NO: 1669132 - protein, 18 aa, Staphylococcus aureus
KHLYRQVLLDMKNNNNKP

SEQ ID NO: 1669133 - protein, 19 aa, Staphylococcus aureus
KHLYRQVLLDMKNNNNKPT

SEQ ID NO: 1669134 - protein, 33 aa, Staphylococcus aureus
KHNHIPPWILIIPLNFGETIKWLSILKPKDKQE

SEQ ID NO: 1669135 - protein, 17 aa, Staphylococcus aureus
KHNRLREEWDKKQEKIK

SEQ ID NO: 1669136 - protein, 26 aa, Staphylococcus aureus
KHNVLAFAHGFNIHFGVIQPPADVDV

SEQ ID NO: 1669137 - protein, 20 aa, Staphylococcus aureus
KHPNHHMIAFDIAGGTADVY

SEQ ID NO: 1669138 - protein, 18 aa, Staphylococcus aureus
KHSKAFSSKIVMKLWEDR

SEQ ID NO: 1669139 - protein, 20 aa, Staphylococcus aureus
KHVVISLGGIDSFDAGAGIL

SEQ ID NO: 1669140 - protein, 20 aa, Staphylococcus aureus
KHVVISLGGIDSFDAGAGML

SEQ ID NO: 1669141 - protein, 23 aa, Staphylococcus aureus
KHYPLLRFGFIHVPYIPEQIDGK

SEQ ID NO: 1669142 - protein, 21 aa, Staphylococcus aureus
KHYYGIEVCQSMGADNATFLK

SEQ ID NO: 1669143 - protein, 20 aa, Staphylococcus aureus
KIAEALSKQSNRQFKVLYLV

SEQ ID NO: 1669144 - protein, 20 aa, Staphylococcus aureus
KIAISDRFKLLQSQYTDEKY

SEQ ID NO: 1669145 - protein, 29 aa, Staphylococcus aureus
KIAKDRNKVTWGYAKSILNTWLNANLKSI

SEQ ID NO: 1669146 - protein, 34 aa, Staphylococcus aureus
KIAKDRNKVTWGYAKSILNTWLNANLKSIEQVRA

SEQ ID NO: 1669147 - protein, 27 aa, Staphylococcus aureus
KIANRPTDGGLSWSDDHKSLIYRYDAT

SEQ ID NO: 1669148 - protein, 19 aa, Staphylococcus aureus
KIASLDLDFIAKLYNDLYI

SEQ ID NO: 1669149 - protein, 18 aa, Staphylococcus aureus
KIDDWIYSIEVLANKDYE

SEQ ID NO: 1669150 - protein, 19 aa, Staphylococcus aureus
KIDELNGFMIITNSNSNNK

SEQ ID NO: 1669151 - protein, 18 aa, Staphylococcus aureus
KIDFERLARYCDKHNAVV

SEQ ID NO: 1669152 - protein, 18 aa, Staphylococcus aureus
KIDFERLARYCEKHNVVV

SEQ ID NO: 1669153 - protein, 18 aa, Staphylococcus aureus
KIDFERLARYCEKYNAVV

SEQ ID NO: 1669154 - protein, 25 aa, Staphylococcus aureus
KIDGKGWQKDKSWGGYNVTRYEVVN

SEQ ID NO: 1669155 - protein, 20 aa, Staphylococcus aureus
KIDGNTFLCRFNVAILDDGY

SEQ ID NO: 1669156 - protein, 21 aa, Staphylococcus aureus
KIDQCVLQFGDIKIMIADDTE

SEQ ID NO: 1669157 - protein, 19 aa, Staphylococcus aureus
KIDSEFILEEYLEDYLPKE

SEQ ID NO: 1669158 - protein, 18 aa, Staphylococcus aureus
KIDVEPVFGFMKAILGFT

SEQ ID NO: 1669159 - protein, 24 aa, Staphylococcus aureus
KIDYYTNKLEVFRNAENILEDYYD

SEQ ID NO: 1669160 - protein, 24 aa, Staphylococcus aureus
KIEFKIKKGIKWHDGNELKIDDWI

SEQ ID NO: 1669161 - protein, 18 aa, Staphylococcus aureus
KIEVVFKNTGTYMFHCHI

SEQ ID NO: 1669162 - protein, 24 aa, Staphylococcus aureus
KIFPRPIDNILPIWRAVGGPSASA

SEQ ID NO: 1669163 - protein, 17 aa, Staphylococcus aureus
KIFSFNFPFSVEVQEES

SEQ ID NO: 1669164 - protein, 25 aa, Staphylococcus aureus
KIGYEIPFTRLFYKYTPPEPSEVIS

SEQ ID NO: 1669165 - protein, 19 aa, Staphylococcus aureus
KIHAAGLCHSDLSVINGNR

SEQ ID NO: 1669166 - protein, 20 aa, Staphylococcus aureus
KIHKIEAAYKMSQNRNEKDY

SEQ ID NO: 1669167 - protein, 17 aa, Staphylococcus aureus
KIHSFIEDKKALFIVYA

SEQ ID NO: 1669168 - protein, 20 aa, Staphylococcus aureus
KIIERSCKFYGNTYLGKKSE

SEQ ID NO: 1669169 - protein, 18 aa, Staphylococcus aureus
KIIGLSISDLGEYAKSDL

SEQ ID NO: 1669170 - protein, 21 aa, Staphylococcus aureus
KIIIGGGMVYTFLKAQGKEIG

SEQ ID NO: 1669171 - protein, 20 aa, Staphylococcus aureus
KIIMTEALSLYIWGCNILNT

SEQ ID NO: 1669172 - protein, 17 aa, Staphylococcus aureus
KIINRFRVNPNTDALIE

SEQ ID NO: 1669173 - protein, 18 aa, Staphylococcus aureus
KIIPYAGSEDLAIVQVEE

SEQ ID NO: 1669174 - protein, 24 aa, Staphylococcus aureus
KIKDEVLYWKDVVEEIRRNNPELE

SEQ ID NO: 1669175 - protein, 17 aa, Staphylococcus aureus
KIKEMVPSFGYRLTDHE

SEQ ID NO: 1669176 - protein, 24 aa, Staphylococcus aureus
KIKGGTDALVLRYLTPHGKWNIHS

SEQ ID NO: 1669177 - protein, 25 aa, Staphylococcus aureus
KIKGGTDALVLRYLTPHGKWNIHSM

SEQ ID NO: 1669178 - protein, 18 aa, Staphylococcus aureus
KIKGKWSYLYRAIDTEGH

SEQ ID NO: 1669179 - protein, 23 aa, Staphylococcus aureus
KILKQFFCFTFSKYLYRHIYFDK

SEQ ID NO: 1669180 - protein, 19 aa, Staphylococcus aureus
KILLCDEATSALDPSTTAS

SEQ ID NO: 1669181 - protein, 19 aa, Staphylococcus aureus
KINDVAIKHGWFVEDRFVK

SEQ ID NO: 1669182 - protein, 19 aa, Staphylococcus aureus
KINEMVLPLPKNEEWDQQF

SEQ ID NO: 1669183 - protein, 22 aa, Staphylococcus aureus
KINLKGSGFVSHQSISKGQKLT

SEQ ID NO: 1669184 - protein, 20 aa, Staphylococcus aureus
KINLMFSKVGVPRGRGKIER

SEQ ID NO: 1669185 - protein, 24 aa, Staphylococcus aureus
KINQELGITILINLHFVDLAKEYG

SEQ ID NO: 1669186 - protein, 23 aa, Staphylococcus aureus
KINRQKIDPIISIITAFTEARMH

SEQ ID NO: 1669187 - protein, 27 aa, Staphylococcus aureus
KIPFFGICLGHQLFALSQGARSFKMKF

SEQ ID NO: 1669188 - protein, 17 aa, Staphylococcus aureus
KIRNDIMETFALNHHQV

SEQ ID NO: 1669189 - protein, 17 aa, Staphylococcus aureus
KIRPKAYIASWKDIEPA

SEQ ID NO: 1669190 - protein, 20 aa, Staphylococcus aureus
KISAGLPIYCEENLVDYIYF

SEQ ID NO: 1669191 - protein, 23 aa, Staphylococcus aureus
KISEFPRIVTLKDLNKIEVLDTL

SEQ ID NO: 1669192 - protein, 31 aa, Staphylococcus aureus
KISELQLIRRSVCEFIKGHSLIDTSILNKSL

SEQ ID NO: 1669193 - protein, 23 aa, Staphylococcus aureus
KITERHARAVLSLSNSEQEALIE

SEQ ID NO: 1669194 - protein, 17 aa, Staphylococcus aureus
KITRVASDIGVKYLTLY

SEQ ID NO: 1669195 - protein, 19 aa, Staphylococcus aureus
KITWNWKGVFYPNPEKAIR

SEQ ID NO: 1669196 - protein, 18 aa, Staphylococcus aureus
KIYVRGIRGASELRHQLM

SEQ ID NO: 1669197 - protein, 18 aa, Staphylococcus aureus
KKAAALVGEKKLQLMPLD

SEQ ID NO: 1669198 - protein, 19 aa, Staphylococcus aureus
KKAEHGECISKFRTASSIA

SEQ ID NO: 1669199 - protein, 22 aa, Staphylococcus aureus
KKAEQIIDCAIENGITYFDTAD

SEQ ID NO: 1669200 - protein, 19 aa, Staphylococcus aureus
KKAICRKSSHKNCDSKMRM

SEQ ID NO: 1669201 - protein, 23 aa, Staphylococcus aureus
KKAKLNPAICFTMLGHHLGVDIE

SEQ ID NO: 1669202 - protein, 24 aa, Staphylococcus aureus
KKAKLNPAICFTMLGHHLGVDIET

SEQ ID NO: 1669203 - protein, 23 aa, Staphylococcus aureus
KKARRLLFWVVMNIIRGQHHYDN

SEQ ID NO: 1669204 - protein, 17 aa, Staphylococcus aureus
KKASAWDRYCKSVEKDL

SEQ ID NO: 1669205 - protein, 17 aa, Staphylococcus aureus
KKDEIGNTFSFSDTNNN

SEQ ID NO: 1669206 - protein, 21 aa, Staphylococcus aureus
KKDIRTIIHFHLSTSPSNYIQ

SEQ ID NO: 1669207 - protein, 17 aa, Staphylococcus aureus
KKDTVLIREIIERDQDI

SEQ ID NO: 1669208 - protein, 18 aa, Staphylococcus aureus
KKDYDIDFITGHSLGGRD

SEQ ID NO: 1669209 - protein, 18 aa, Staphylococcus aureus
KKEALDWLTDDIDNNEAR

SEQ ID NO: 1669210 - protein, 19 aa, Staphylococcus aureus
KKEIEEFAHYPINRNDEYR

SEQ ID NO: 1669211 - protein, 24 aa, Staphylococcus aureus
KKEILKIRQFDKCLKPLTEGTSKK

SEQ ID NO: 1669212 - protein, 19 aa, Staphylococcus aureus
KKELIKFNLLTQERVGLNK

SEQ ID NO: 1669213 - protein, 19 aa, Staphylococcus aureus
KKELVEIASVAGLQVDEKQ

SEQ ID NO: 1669214 - protein, 22 aa, Staphylococcus aureus
KKEMKKEIQKLVNRKQLKDHDG

SEQ ID NO: 1669215 - protein, 24 aa, Staphylococcus aureus
KKEMRLDELIKWARSNPELSKGKN

SEQ ID NO: 1669216 - protein, 25 aa, Staphylococcus aureus
KKETDILFILSLFRKINWKVYDEST

SEQ ID NO: 1669217 - protein, 30 aa, Staphylococcus aureus
KKETDILFILSLFRKINWKVYDESTGVPSL

SEQ ID NO: 1669218 - protein, 20 aa, Staphylococcus aureus
KKETVDFYLAKGIVDRVSEK

SEQ ID NO: 1669219 - protein, 23 aa, Staphylococcus aureus
KKFAMCRDIELHWGEPVESTRKL

SEQ ID NO: 1669220 - protein, 17 aa, Staphylococcus aureus
KKFGVIPEMEYEMEEVK

SEQ ID NO: 1669221 - protein, 18 aa, Staphylococcus aureus
KKFGVLPEMEYEINKIKE

SEQ ID NO: 1669222 - protein, 18 aa, Staphylococcus aureus
KKFGVLPEMEYEMEEIKE

SEQ ID NO: 1669223 - protein, 18 aa, Staphylococcus aureus
KKFGVLPEMEYEMEEVKE

SEQ ID NO: 1669224 - protein, 19 aa, Staphylococcus aureus
KKFKNRAVDVYGLSYSGYC

SEQ ID NO: 1669225 - protein, 21 aa, Staphylococcus aureus
KKFSPVVGDIVEFDVQNINEG

SEQ ID NO: 1669226 - protein, 22 aa, Staphylococcus aureus
KKFWKSNIKPIVSECLEDINTI

SEQ ID NO: 1669227 - protein, 27 aa, Staphylococcus aureus
KKFYALDMFPYPSGAGLHVGHPEGYTA

SEQ ID NO: 1669228 - protein, 20 aa, Staphylococcus aureus
KKGFIPYEISIELNPNPEIE

SEQ ID NO: 1669229 - protein, 27 aa, Staphylococcus aureus
KKGMKEARKGVGYKAEIEVHTTLFSKS

SEQ ID NO: 1669230 - protein, 17 aa, Staphylococcus aureus
KKGRMKMISTMNEIMKC

SEQ ID NO: 1669231 - protein, 21 aa, Staphylococcus aureus
KKGTTIVVCGDTPLITKETLE

SEQ ID NO: 1669232 - protein, 22 aa, Staphylococcus aureus
KKGYVRLRIDGEIVDVNEVPEL

SEQ ID NO: 1669233 - protein, 18 aa, Staphylococcus aureus
KKHFELMKDEALFINIGR

SEQ ID NO: 1669234 - protein, 17 aa, Staphylococcus aureus
KKHKRVRLVESFLPQSK

SEQ ID NO: 1669235 - protein, 20 aa, Staphylococcus aureus
KKHTLRYYICPKNMNESRFV

SEQ ID NO: 1669236 - protein, 17 aa, Staphylococcus aureus
KKIIEKVAEANRVIAKS

SEQ ID NO: 1669237 - protein, 19 aa, Staphylococcus aureus
KKILSRDLIMLDISTTQIL

SEQ ID NO: 1669238 - protein, 23 aa, Staphylococcus aureus
KKIREIQKLILAYEKTEIGFGEK

SEQ ID NO: 1669239 - protein, 20 aa, Staphylococcus aureus
KKIRPNLGRKIYINYHKKRK

SEQ ID NO: 1669240 - protein, 17 aa, Staphylococcus aureus
KKKAIVIGGGLLGLECA

SEQ ID NO: 1669241 - protein, 18 aa, Staphylococcus aureus
KKKAREMGATTKFSASDS

SEQ ID NO: 1669242 - protein, 25 aa, Staphylococcus aureus
KKKEYEKFGRWFFNKFNVNRSADAK

SEQ ID NO: 1669243 - protein, 19 aa, Staphylococcus aureus
KKKHFELMKDEALFINVGR

SEQ ID NO: 1669244 - protein, 20 aa, Staphylococcus aureus
KKKKIDSIVEELNNKLDDFK

SEQ ID NO: 1669245 - protein, 23 aa, Staphylococcus aureus
KKKLLIFPRYHQLDVVKKLISDT

SEQ ID NO: 1669246 - protein, 18 aa, Staphylococcus aureus
KKKVDNFYGLSSKNDKYV

SEQ ID NO: 1669247 - protein, 27 aa, Staphylococcus aureus
KKKVTAFDFFQDNGFGFITPYNLDDLN

SEQ ID NO: 1669248 - protein, 17 aa, Staphylococcus aureus
KKLLGHTLYRRHYYPKE

SEQ ID NO: 1669249 - protein, 18 aa, Staphylococcus aureus
KKLMEFFESRILPYDIHL

SEQ ID NO: 1669250 - protein, 20 aa, Staphylococcus aureus
KKLREDVAIMMSCKKSIKAN

SEQ ID NO: 1669251 - protein, 21 aa, Staphylococcus aureus
KKLREVYPITTKKSPVLKLHI

SEQ ID NO: 1669252 - protein, 17 aa, Staphylococcus aureus
KKLRNAFKEEGLEPWTS

SEQ ID NO: 1669253 - protein, 20 aa, Staphylococcus aureus
KKLTDKLKEKQIVKNGDTVT

SEQ ID NO: 1669254 - protein, 25 aa, Staphylococcus aureus
KKLVDKLKEKHIVKVGDKVTIHSKD

SEQ ID NO: 1669255 - protein, 19 aa, Staphylococcus aureus
KKMTNIKVYDWVQQVEQLG

SEQ ID NO: 1669256 - protein, 37 aa, Staphylococcus aureus
KKNGYRSLHIVVSIPVFLAERVEVLPVEIQIRTIGMD

SEQ ID NO: 1669257 - protein, 19 aa, Staphylococcus aureus
KKNHFELMKDEALFINIGR

SEQ ID NO: 1669258 - protein, 25 aa, Staphylococcus aureus
KKNHILRYYVCPKNMNASRFVCDFK

SEQ ID NO: 1669259 - protein, 18 aa, Staphylococcus aureus
KKNKEIFSEIANWINNDL

SEQ ID NO: 1669260 - protein, 23 aa, Staphylococcus aureus
KKNVQRLIFVTALGIYDEVPGAF

SEQ ID NO: 1669261 - protein, 23 aa, Staphylococcus aureus
KKPNWPVTPWPTAYSEIYDYQWI

SEQ ID NO: 1669262 - protein, 23 aa, Staphylococcus aureus
KKPNWPVTPWPTAYSEIYDYQWS

SEQ ID NO: 1669263 - protein, 18 aa, Staphylococcus aureus
KKRLQEQLFLVVEEGNDI

SEQ ID NO: 1669264 - protein, 19 aa, Staphylococcus aureus
KKRMIDGGFTKSIHVPVLF

SEQ ID NO: 1669265 - protein, 17 aa, Staphylococcus aureus
KKRPHFQALTPLYPDER

SEQ ID NO: 1669266 - protein, 20 aa, Staphylococcus aureus
KKRYHEIEMEIARLESLTKD

SEQ ID NO: 1669267 - protein, 22 aa, Staphylococcus aureus
KKSGKSFDCKLILTKENKVQFS

SEQ ID NO: 1669268 - protein, 24 aa, Staphylococcus aureus
KKSGLRIYKQPAIKVDSLPSTDFF

SEQ ID NO: 1669269 - protein, 18 aa, Staphylococcus aureus
KKSIKANHYLQKHEMSDL

SEQ ID NO: 1669270 - protein, 25 aa, Staphylococcus aureus
KKSRLKALYLSVIDRIDIKKDGNHK

SEQ ID NO: 1669271 - protein, 26 aa, Staphylococcus aureus
KKSRLTGRLSGNIGYVASKVAQEVQP

SEQ ID NO: 1669272 - protein, 17 aa, Staphylococcus aureus
KKSTPIKVYLNGNFEGI

SEQ ID NO: 1669273 - protein, 18 aa, Staphylococcus aureus
KKTAAFSNIEYGGRGMSL

SEQ ID NO: 1669274 - protein, 18 aa, Staphylococcus aureus
KKTPKFILGFGGIDDDAL

SEQ ID NO: 1669275 - protein, 25 aa, Staphylococcus aureus
KKVIKHAGYVRCKLFLEKEEEKIHV

SEQ ID NO: 1669276 - protein, 18 aa, Staphylococcus aureus
KKVLKEHLHKVTFVHSNF

SEQ ID NO: 1669277 - protein, 19 aa, Staphylococcus aureus
KKWIDEVIIYGWAYGSKGK

SEQ ID NO: 1669278 - protein, 21 aa, Staphylococcus aureus
KKWLEEDIDVIITTGGTGIAK

SEQ ID NO: 1669279 - protein, 22 aa, Staphylococcus aureus
KKYGEEAFEVVIEAIKGEQKSI

SEQ ID NO: 1669280 - protein, 17 aa, Staphylococcus aureus
KKYLDLLSQRFDTPEKL

SEQ ID NO: 1669281 - protein, 23 aa, Staphylococcus aureus
KLAEAKAAARQNLGTLNHITNAQ

SEQ ID NO: 1669282 - protein, 18 aa, Staphylococcus aureus
KLAKGINIIGLINIQFVI

SEQ ID NO: 1669283 - protein, 18 aa, Staphylococcus aureus
KLAKWFAENDYFYIMHRF

SEQ ID NO: 1669284 - protein, 25 aa, Staphylococcus aureus
KLALELYNSPWIAWYHQQMQDKKAK

SEQ ID NO: 1669285 - protein, 18 aa, Staphylococcus aureus
KLAPKSKADFAFIQHMIH

SEQ ID NO: 1669286 - protein, 17 aa, Staphylococcus aureus
KLAVKKKDHSILVNILD

SEQ ID NO: 1669287 - protein, 21 aa, Staphylococcus aureus
KLDEFFTVILSIRYIQTELHL

SEQ ID NO: 1669288 - protein, 22 aa, Staphylococcus aureus
KLDEFFTVILSIRYIQTELHLS

SEQ ID NO: 1669289 - protein, 19 aa, Staphylococcus aureus
KLDKDVVRRRIKLMEEAGI

SEQ ID NO: 1669290 - protein, 18 aa, Staphylococcus aureus
KLDKVVFSICDWGDDFLD

SEQ ID NO: 1669291 - protein, 25 aa, Staphylococcus aureus
KLDNGQEVIIIWNPWDNGFMTQDAK

SEQ ID NO: 1669292 - protein, 18 aa, Staphylococcus aureus
KLFDSGFQKIHMKISEIN

SEQ ID NO: 1669293 - protein, 26 aa, Staphylococcus aureus
KLFESLGIKCINTFDTIKICTDKLIQ

SEQ ID NO: 1669294 - protein, 18 aa, Staphylococcus aureus
KLFIPIFLYDTNLKDELY

SEQ ID NO: 1669295 - protein, 22 aa, Staphylococcus aureus
KLFPGQEIRITDSILQGLDNGS

SEQ ID NO: 1669296 - protein, 25 aa, Staphylococcus aureus
KLFQKRINLGLSIVMVTHDDEIIER

SEQ ID NO: 1669297 - protein, 20 aa, Staphylococcus aureus
KLFSESRFNVDVLKVEVPVN

SEQ ID NO: 1669298 - protein, 19 aa, Staphylococcus aureus
KLGFMSFFTKASVAALKKY

SEQ ID NO: 1669299 - protein, 22 aa, Staphylococcus aureus
KLGGQYKRAYLIGQSSYIKNND

SEQ ID NO: 1669300 - protein, 20 aa, Staphylococcus aureus
KLGMARSSLYAVFEKHINKG

SEQ ID NO: 1669301 - protein, 17 aa, Staphylococcus aureus
KLHKRLNTTTIYVTHDQ

SEQ ID NO: 1669302 - protein, 21 aa, Staphylococcus aureus
KLHQAKQPIIITGHEINSFHL

SEQ ID NO: 1669303 - protein, 23 aa, Staphylococcus aureus
KLIMSGKVLKVMVSNDIERNHFD

SEQ ID NO: 1669304 - protein, 22 aa, Staphylococcus aureus
KLKDVTGQFDVIYSNDNKTATV

SEQ ID NO: 1669305 - protein, 20 aa, Staphylococcus aureus
KLKEERIVGTAGGGMVTVTV

SEQ ID NO: 1669306 - protein, 23 aa, Staphylococcus aureus
KLKERLSHLDVEFKFNREEETLR

SEQ ID NO: 1669307 - protein, 26 aa, Staphylococcus aureus
KLKHFKPKRIVFWGIYEDYPKLVRLC

SEQ ID NO: 1669308 - protein, 21 aa, Staphylococcus aureus
KLKIFGSYDLRTMWTQERDAS

SEQ ID NO: 1669309 - protein, 22 aa, Staphylococcus aureus
KLKIYKFFIIIAKYIKHNEQFF

SEQ ID NO: 1669310 - protein, 21 aa, Staphylococcus aureus
KLKKERTIDVSKELMALYTDY

SEQ ID NO: 1669311 - protein, 18 aa, Staphylococcus aureus
KLKLLKHASYCLETSNNP

SEQ ID NO: 1669312 - protein, 25 aa, Staphylococcus aureus
KLKMIGHYIGMSFQIIDDVLDFTSA

SEQ ID NO: 1669313 - protein, 27 aa, Staphylococcus aureus
KLKNIIDFISGYAFKSELFTISDNNKK

SEQ ID NO: 1669314 - protein, 20 aa, Staphylococcus aureus
KLKNRILGISINLPEGQTFT

SEQ ID NO: 1669315 - protein, 23 aa, Staphylococcus aureus
KLKPEHYEDIVAVTSLYRPGPME

SEQ ID NO: 1669316 - protein, 19 aa, Staphylococcus aureus
KLLENQQVLALESNKKIQK

SEQ ID NO: 1669317 - protein, 18 aa, Staphylococcus aureus
KLLHEARLQRKVNKQWVL

SEQ ID NO: 1669318 - protein, 21 aa, Staphylococcus aureus
KLLKKNIEVIPLNNHKKPTVS

SEQ ID NO: 1669319 - protein, 17 aa, Staphylococcus aureus
KLLKMHCKIDHNSEDKL

SEQ ID NO: 1669320 - protein, 28 aa, Staphylococcus aureus
KLMKAFWPGPISFILPLKPGYLCRKVSG

SEQ ID NO: 1669321 - protein, 19 aa, Staphylococcus aureus
KLNESVGIMAGQVVYKYEE

SEQ ID NO: 1669322 - protein, 17 aa, Staphylococcus aureus
KLNHERIEFRHCSEKIE

SEQ ID NO: 1669323 - protein, 18 aa, Staphylococcus aureus
KLNVSFDYIDWVNSEFGP

SEQ ID NO: 1669324 - protein, 20 aa, Staphylococcus aureus
KLNVSFDYVDWIKLSLGPLA

SEQ ID NO: 1669325 - protein, 25 aa, Staphylococcus aureus
KLNWVYKYFFANGVQMEGVLIRQSS

SEQ ID NO: 1669326 - protein, 18 aa, Staphylococcus aureus
KLPKSAIGFRKLMSEERR

SEQ ID NO: 1669327 - protein, 18 aa, Staphylococcus aureus
KLPVVPANMQTVMNEKLA

SEQ ID NO: 1669328 - protein, 17 aa, Staphylococcus aureus
KLQGYKVTYQYATAINI

SEQ ID NO: 1669329 - protein, 18 aa, Staphylococcus aureus
KLRDENHIIYLFLGQFFT

SEQ ID NO: 1669330 - protein, 20 aa, Staphylococcus aureus
KLRDITMDDIMGGKSKKPTF

SEQ ID NO: 1669331 - protein, 17 aa, Staphylococcus aureus
KLREELSYYGINELSLF

SEQ ID NO: 1669332 - protein, 17 aa, Staphylococcus aureus
KLREFNQKSPEIFKEVE

SEQ ID NO: 1669333 - protein, 19 aa, Staphylococcus aureus
KLRESAFKNVYKAYGAHNN

SEQ ID NO: 1669334 - protein, 17 aa, Staphylococcus aureus
KLRNEIIREYDLTPSAL

SEQ ID NO: 1669335 - protein, 17 aa, Staphylococcus aureus
KLSFKESQIRDYESKSK

SEQ ID NO: 1669336 - protein, 24 aa, Staphylococcus aureus
KLSNDKYRTWAWNYGRNPKYNFER

SEQ ID NO: 1669337 - protein, 19 aa, Staphylococcus aureus
KLTFHDACNEWLEHYKTHS

SEQ ID NO: 1669338 - protein, 22 aa, Staphylococcus aureus
KLTNELKNFIEYLAKSKKYEDI

SEQ ID NO: 1669339 - protein, 18 aa, Staphylococcus aureus
KLTNLGMLTEPGLYYLYT

SEQ ID NO: 1669340 - protein, 19 aa, Staphylococcus aureus
KLVADRNLENLPWKELDID

SEQ ID NO: 1669341 - protein, 20 aa, Staphylococcus aureus
KLVIKRNGNVVTTFTRHNNT

SEQ ID NO: 1669342 - protein, 17 aa, Staphylococcus aureus
KLVMLFGDNLLDFTDPK

SEQ ID NO: 1669343 - protein, 19 aa, Staphylococcus aureus
KLVPKNSVLIAMYGGFNQI

SEQ ID NO: 1669344 - protein, 20 aa, Staphylococcus aureus
KLYECNELYIIKYISKKADF

SEQ ID NO: 1669345 - protein, 19 aa, Staphylococcus aureus
KLYESNKYYPIYGSSELGK

SEQ ID NO: 1669346 - protein, 26 aa, Staphylococcus aureus
KLYMIELLEPLPFLEKISKLTTVKSI

SEQ ID NO: 1669347 - protein, 20 aa, Staphylococcus aureus
KMETLLLCTRQFLWSTAKGY

SEQ ID NO: 1669348 - protein, 24 aa, Staphylococcus aureus
KMFEFKQGVKLFGAIVILSQSGYT

SEQ ID NO: 1669349 - protein, 19 aa, Staphylococcus aureus
KMGLQIRHYTVQSLKLLKT

SEQ ID NO: 1669350 - protein, 19 aa, Staphylococcus aureus
KMIKETVCQLEIKLDTGRT

SEQ ID NO: 1669351 - protein, 25 aa, Staphylococcus aureus
KMNHGLCNLISFTGDTLDHLWRVTS

SEQ ID NO: 1669352 - protein, 28 aa, Staphylococcus aureus
KMPKKMRRLALRSALSFKAQENGLTVVD

SEQ ID NO: 1669353 - protein, 17 aa, Staphylococcus aureus
KMPSMKITLSFSEFNTM

SEQ ID NO: 1669354 - protein, 19 aa, Staphylococcus aureus
KMPSMKITLSFSESNTTKT

SEQ ID NO: 1669355 - protein, 20 aa, Staphylococcus aureus
KMRGNIFLEEGIEHIEMTKK

SEQ ID NO: 1669356 - protein, 24 aa, Staphylococcus aureus
KMRRIYRRKLTYILNRLKPYKEQL

SEQ ID NO: 1669357 - protein, 22 aa, Staphylococcus aureus
KMSAEAKIMYALLKDRFELSLQ

SEQ ID NO: 1669358 - protein, 30 aa, Staphylococcus aureus
KMSREEILILLTLWQKGFMTLKEMDRFVEV

SEQ ID NO: 1669359 - protein, 33 aa, Staphylococcus aureus
KMSREEILILLTLWQKGSMMLKEMDRFVEVKPY

SEQ ID NO: 1669360 - protein, 20 aa, Staphylococcus aureus
KMSRRKKTAAKKLLEVSNNT

SEQ ID NO: 1669361 - protein, 24 aa, Staphylococcus aureus
KMTFPHQMMRVVLIEQVYRAFKIM

SEQ ID NO: 1669362 - protein, 25 aa, Staphylococcus aureus
KMTKKEFIDFPVLFDDEGNFRKKQV

SEQ ID NO: 1669363 - protein, 19 aa, Staphylococcus aureus
KMVELAPYNGLPHLVAPVI

SEQ ID NO: 1669364 - protein, 18 aa, Staphylococcus aureus
KNADAFDVKAFRHKAKMY

SEQ ID NO: 1669365 - protein, 19 aa, Staphylococcus aureus
KNAQEYFGVAFDDLNKAVG

SEQ ID NO: 1669366 - protein, 23 aa, Staphylococcus aureus
KNDDLLYFWKSVREKKSNLNEII

SEQ ID NO: 1669367 - protein, 18 aa, Staphylococcus aureus
KNEFGIEVKDYFIDLDLL

SEQ ID NO: 1669368 - protein, 20 aa, Staphylococcus aureus
KNEILSFYLNNIYFGDNQYT

SEQ ID NO: 1669369 - protein, 26 aa, Staphylococcus aureus
KNFGEHNLTFAIEFCSKAIANNTKRH

SEQ ID NO: 1669370 - protein, 23 aa, Staphylococcus aureus
KNGDYATNIAMVLTKIAKRNPCE

SEQ ID NO: 1669371 - protein, 23 aa, Staphylococcus aureus
KNGEKRYQFNVYLGIDKVTGKKK

SEQ ID NO: 1669372 - protein, 22 aa, Staphylococcus aureus
KNGEVWAYYRIRSESISTANYD

SEQ ID NO: 1669373 - protein, 21 aa, Staphylococcus aureus
KNGILACLLLEGHLLSKPDLT

SEQ ID NO: 1669374 - protein, 17 aa, Staphylococcus aureus
KNGINFMILDGNNEPIV

SEQ ID NO: 1669375 - protein, 23 aa, Staphylococcus aureus
KNGKKRISHQMDMLFTHFGISGP

SEQ ID NO: 1669376 - protein, 22 aa, Staphylococcus aureus
KNGKLDCVMVYKTNRLARNTSD

SEQ ID NO: 1669377 - protein, 21 aa, Staphylococcus aureus
KNGQLKPRYNLQIATNSQFVL

SEQ ID NO: 1669378 - protein, 27 aa, Staphylococcus aureus
KNGRYSETFIALKSVYIESLFEMVKSI

SEQ ID NO: 1669379 - protein, 18 aa, Staphylococcus aureus
KNGSPVIMGYMIRSQEMP

SEQ ID NO: 1669380 - protein, 17 aa, Staphylococcus aureus
KNGTNFMILDGNNEPIV

SEQ ID NO: 1669381 - protein, 20 aa, Staphylococcus aureus
KNHFEISVIDEFFKILKIIP

SEQ ID NO: 1669382 - protein, 22 aa, Staphylococcus aureus
KNIHFVGLAFNFMCFKSDAPSD

SEQ ID NO: 1669383 - protein, 18 aa, Staphylococcus aureus
KNKEFSRVKNGLEPTEVA

SEQ ID NO: 1669384 - protein, 23 aa, Staphylococcus aureus
KNKEGYNLTFFAFFVKAVADALK

SEQ ID NO: 1669385 - protein, 19 aa, Staphylococcus aureus
KNKHHMFESTGKILSIDGN

SEQ ID NO: 1669386 - protein, 19 aa, Staphylococcus aureus
KNKIASVLSGKVKNSRLFA

SEQ ID NO: 1669387 - protein, 17 aa, Staphylococcus aureus
KNLEDFYDKEGFRDQEF

SEQ ID NO: 1669388 - protein, 32 aa, Staphylococcus aureus
KNLEGSFHFETFISLTCQKCPDVVQALNLMSV

SEQ ID NO: 1669389 - protein, 27 aa, Staphylococcus aureus
KNLKEFYCNNCGFKIYQEKITKKGKLI

SEQ ID NO: 1669390 - protein, 19 aa, Staphylococcus aureus
KNLKEWRLEDLPIIPKYMK

SEQ ID NO: 1669391 - protein, 29 aa, Staphylococcus aureus
KNLKVIYMPHWLKFYSIAIHSDVTSNKKR

SEQ ID NO: 1669392 - protein, 31 aa, Staphylococcus aureus
KNLPAEESYFLFYINRPSIIVGKNQNTIEEV

SEQ ID NO: 1669393 - protein, 20 aa, Staphylococcus aureus
KNMFENYGLIALKDNHIEVK

SEQ ID NO: 1669394 - protein, 19 aa, Staphylococcus aureus
KNMFENYGLISLKDDHIEV

SEQ ID NO: 1669395 - protein, 17 aa, Staphylococcus aureus
KNNCKLSDIGHPHLSIV

SEQ ID NO: 1669396 - protein, 26 aa, Staphylococcus aureus
KNNLKEVIAGFDFTFGKFGKGNMTVL

SEQ ID NO: 1669397 - protein, 17 aa, Staphylococcus aureus
KNNLKINLVHMLLQLYL

SEQ ID NO: 1669398 - protein, 24 aa, Staphylococcus aureus
KNNVKKAWWQKFITQSPFNIGIDA

SEQ ID NO: 1669399 - protein, 22 aa, Staphylococcus aureus
KNPEKYKSYFIGDWYVSGDSAY

SEQ ID NO: 1669400 - protein, 20 aa, Staphylococcus aureus
KNPFIALLFMVSEENKNKIN

SEQ ID NO: 1669401 - protein, 21 aa, Staphylococcus aureus
KNPKLLFKGAGNIKGSSVGYK

SEQ ID NO: 1669402 - protein, 36 aa, Staphylococcus aureus
KNQFPWVVAAFPSKAWAKRVYPELSVEEAYIKFIDE

SEQ ID NO: 1669403 - protein, 30 aa, Staphylococcus aureus
KNQFPWVVAAFPSKAWAKSVYPELSVEEAY

SEQ ID NO: 1669404 - protein, 21 aa, Staphylococcus aureus
KNRRSLQIYGFSPCYEISHML

SEQ ID NO: 1669405 - protein, 23 aa, Staphylococcus aureus
KNSARLCLEVMRAVQEVIDKEAP

SEQ ID NO: 1669406 - protein, 18 aa, Staphylococcus aureus
KNSDGIALLPEFIVADEL

SEQ ID NO: 1669407 - protein, 25 aa, Staphylococcus aureus
KNSLFKGKEIEYGKDLVGLTRKIDM

SEQ ID NO: 1669408 - protein, 25 aa, Staphylococcus aureus
KNSSDLRTCLALAYDEIKNRKGKMI

SEQ ID NO: 1669409 - protein, 21 aa, Staphylococcus aureus
KNTGTYMFHCHILEHEDNGMM

SEQ ID NO: 1669410 - protein, 18 aa, Staphylococcus aureus
KNTIVICTSNAGFGNGTD

SEQ ID NO: 1669411 - protein, 20 aa, Staphylococcus aureus
KNTRFDSDIETVVYRVVQEA

SEQ ID NO: 1669412 - protein, 17 aa, Staphylococcus aureus
KNTVPFIARYRKEQTGG

SEQ ID NO: 1669413 - protein, 18 aa, Staphylococcus aureus
KNVIYRDVIVLDYDEIND

SEQ ID NO: 1669414 - protein, 28 aa, Staphylococcus aureus
KNVVLIHGFKNYVALLFHKGAILEDKYH

SEQ ID NO: 1669415 - protein, 25 aa, Staphylococcus aureus
KNVWLLKDVPSEFSISKKDLGVDLV

SEQ ID NO: 1669416 - protein, 23 aa, Staphylococcus aureus
KNYLIRRLIEEIIEQSLVSDSDF

SEQ ID NO: 1669417 - protein, 23 aa, Staphylococcus aureus
KNYPGWKLVEGRSRRVITDTKAT

SEQ ID NO: 1669418 - protein, 19 aa, Staphylococcus aureus
KPDSELIINFTTMQTNSKQ

SEQ ID NO: 1669419 - protein, 24 aa, Staphylococcus aureus
KPEKLKTYRMVFNTISVEKMNAIL

SEQ ID NO: 1669420 - protein, 22 aa, Staphylococcus aureus
KPHDEILVSFDLYGGTFRLFQF

SEQ ID NO: 1669421 - protein, 18 aa, Staphylococcus aureus
KPHIVFMMTFTEDIKPII

SEQ ID NO: 1669422 - protein, 20 aa, Staphylococcus aureus
KPIFEALFSKYSFVNNNPVS

SEQ ID NO: 1669423 - protein, 30 aa, Staphylococcus aureus
KPIKENLRVKGSYPYYGATGIIDYVDDFIF

SEQ ID NO: 1669424 - protein, 23 aa, Staphylococcus aureus
KPIRLDRYFPDWHEAYSKVQTVN

SEQ ID NO: 1669425 - protein, 18 aa, Staphylococcus aureus
KPKQLRVIGVGPSPDKEN

SEQ ID NO: 1669426 - protein, 19 aa, Staphylococcus aureus
KPKRMKYINKFNEENPNAF

SEQ ID NO: 1669427 - protein, 23 aa, Staphylococcus aureus
KPLDCVKKAIDFIIDNYIYEKGD

SEQ ID NO: 1669428 - protein, 17 aa, Staphylococcus aureus
KPLLTKEIEGFGELFRY

SEQ ID NO: 1669429 - protein, 19 aa, Staphylococcus aureus
KPLNIKVIIVTTFKRPGYF

SEQ ID NO: 1669430 - protein, 18 aa, Staphylococcus aureus
KPLSISKHNAMTSIVLKT

SEQ ID NO: 1669431 - protein, 19 aa, Staphylococcus aureus
KPMLARGELHCIGATTLNE

SEQ ID NO: 1669432 - protein, 19 aa, Staphylococcus aureus
KPNSAITITPKAGTGHSAS

SEQ ID NO: 1669433 - protein, 19 aa, Staphylococcus aureus
KPNSSITITPKAGTGHSVS

SEQ ID NO: 1669434 - protein, 17 aa, Staphylococcus aureus
KPPKLVTREMVKSMKKG

SEQ ID NO: 1669435 - protein, 22 aa, Staphylococcus aureus
KPPYFVELGHIIPAPIDNKSEF

SEQ ID NO: 1669436 - protein, 18 aa, Staphylococcus aureus
KPQAKQAIADKVQAQETA

SEQ ID NO: 1669437 - protein, 21 aa, Staphylococcus aureus
KPRAMHYSRYWKYLPERIKLF

SEQ ID NO: 1669438 - protein, 21 aa, Staphylococcus aureus
KPRGLFRKKKFSPVVGDIVEF

SEQ ID NO: 1669439 - protein, 29 aa, Staphylococcus aureus
KPRGLFRKKKFSPVVGDLVEFEVQNINEG

SEQ ID NO: 1669440 - protein, 17 aa, Staphylococcus aureus
KPSACYCCGVKNEGQIH

SEQ ID NO: 1669441 - protein, 19 aa, Staphylococcus aureus
KPSACYCCGVKNEGQIHKH

SEQ ID NO: 1669442 - protein, 20 aa, Staphylococcus aureus
KPSIPEMGENGIAIRDEIVL

SEQ ID NO: 1669443 - protein, 19 aa, Staphylococcus aureus
KPSLKRVEGNAGKMILESS

SEQ ID NO: 1669444 - protein, 27 aa, Staphylococcus aureus
KPTASEVVEWALYMAKNRRVIDVDRAY

SEQ ID NO: 1669445 - protein, 19 aa, Staphylococcus aureus
KPTFNDWGECATRIVSIYR

SEQ ID NO: 1669446 - protein, 18 aa, Staphylococcus aureus
KPTFNEWGECASRIVSIY

SEQ ID NO: 1669447 - protein, 27 aa, Staphylococcus aureus
KPVIENLRFTIGEDICLVHCPERVLPG

SEQ ID NO: 1669448 - protein, 17 aa, Staphylococcus aureus
KPVMLIGVGAKHAKDEL

SEQ ID NO: 1669449 - protein, 18 aa, Staphylococcus aureus
KQAIADAENVLKQNANKQ

SEQ ID NO: 1669450 - protein, 19 aa, Staphylococcus aureus
KQAIADAENVLKQNANKQQ

SEQ ID NO: 1669451 - protein, 24 aa, Staphylococcus aureus
KQAIAGLTPDLAPLQAAKTQLQND

SEQ ID NO: 1669452 - protein, 23 aa, Staphylococcus aureus
KQAIAGLTPDLAPLQTAKTQLQN

SEQ ID NO: 1669453 - protein, 25 aa, Staphylococcus aureus
KQALLYEWSRINSMLDTQLYITRLE

SEQ ID NO: 1669454 - protein, 19 aa, Staphylococcus aureus
KQDAIANLDTLRDLNQPQR

SEQ ID NO: 1669455 - protein, 19 aa, Staphylococcus aureus
KQEYLRIVPHMQELPISNL

SEQ ID NO: 1669456 - protein, 19 aa, Staphylococcus aureus
KQFFSTVLIPLSTSMKTLS

SEQ ID NO: 1669457 - protein, 24 aa, Staphylococcus aureus
KQFKSKRMLLYAGLIPILRDHIAP

SEQ ID NO: 1669458 - protein, 40 aa, Staphylococcus aureus
KQFNIDFWYAFQCFDYANAGWKALFGLLLKGVGAKDIPFA

SEQ ID NO: 1669459 - protein, 21 aa, Staphylococcus aureus
KQGDILKLRLFRNDENYAEIY

SEQ ID NO: 1669460 - protein, 18 aa, Staphylococcus aureus
KQGYVYQSFCYQILKEDI

SEQ ID NO: 1669461 - protein, 21 aa, Staphylococcus aureus
KQHAVTDLNQLNGLNNPQRQA

SEQ ID NO: 1669462 - protein, 24 aa, Staphylococcus aureus
KQHDAANAWGSWNPDEFTVEDSAF

SEQ ID NO: 1669463 - protein, 20 aa, Staphylococcus aureus
KQHHPSRFFNFGIAEMASID

SEQ ID NO: 1669464 - protein, 19 aa, Staphylococcus aureus
KQIDGAPCNVACTVQKLGQ

SEQ ID NO: 1669465 - protein, 19 aa, Staphylococcus aureus
KQIKTWLGITQYKLNKMIE

SEQ ID NO: 1669466 - protein, 23 aa, Staphylococcus aureus
KQKGYFCRVGEKWDNSNLSHENI

SEQ ID NO: 1669467 - protein, 18 aa, Staphylococcus aureus
KQKHKILNLDDVKDGNLI

SEQ ID NO: 1669468 - protein, 25 aa, Staphylococcus aureus
KQKKHPKVLILMGVPGSYLVATDKS

SEQ ID NO: 1669469 - protein, 20 aa, Staphylococcus aureus
KQKYNYFVMKWVNKEYKKIF

SEQ ID NO: 1669470 - protein, 20 aa, Staphylococcus aureus
KQLEDWLDYEITTLPYDMTL

SEQ ID NO: 1669471 - protein, 18 aa, Staphylococcus aureus
KQLFRVLEDTFARPLSPY

SEQ ID NO: 1669472 - protein, 18 aa, Staphylococcus aureus
KQLIRATSYYTLAESLGA

SEQ ID NO: 1669473 - protein, 24 aa, Staphylococcus aureus
KQLKVVPLLLFSAMHYLKDIPNIV

SEQ ID NO: 1669474 - protein, 29 aa, Staphylococcus aureus
KQLMHAMSLKLVDFKIEFGKTETGQILLA

SEQ ID NO: 1669475 - protein, 23 aa, Staphylococcus aureus
KQLRKRYDIPTSKAPKLLLKGSG

SEQ ID NO: 1669476 - protein, 23 aa, Staphylococcus aureus
KQLRKSGKVPAVVYGYGTKNVSV

SEQ ID NO: 1669477 - protein, 19 aa, Staphylococcus aureus
KQNAKSDIGHLSDLNNAQQ

SEQ ID NO: 1669478 - protein, 24 aa, Staphylococcus aureus
KQNDIWKHFKAVKNNHVYDIEEVP

SEQ ID NO: 1669479 - protein, 26 aa, Staphylococcus aureus
KQNMKFKRFHVRGAEKIFKEMGLVFL

SEQ ID NO: 1669480 - protein, 24 aa, Staphylococcus aureus
KQPELPYIVVIVDELADLMMVAGK

SEQ ID NO: 1669481 - protein, 27 aa, Staphylococcus aureus
KQPGTETIYRFSLLVPNQAALHYFEKR

SEQ ID NO: 1669482 - protein, 17 aa, Staphylococcus aureus
KQQAYGLINAGLDSMIF

SEQ ID NO: 1669483 - protein, 17 aa, Staphylococcus aureus
KQQAYGLVNAGLDSMIF

SEQ ID NO: 1669484 - protein, 17 aa, Staphylococcus aureus
KQQEEKEQNELDSQANQ

SEQ ID NO: 1669485 - protein, 17 aa, Staphylococcus aureus
KQQIAGAVTNADVAYLL

SEQ ID NO: 1669486 - protein, 17 aa, Staphylococcus aureus
KQQVRLHIIQMNTQTFE

SEQ ID NO: 1669487 - protein, 18 aa, Staphylococcus aureus
KQRDELIGDIAKLRERNK

SEQ ID NO: 1669488 - protein, 17 aa, Staphylococcus aureus
KQRKLIFALCNDIEAHT

SEQ ID NO: 1669489 - protein, 21 aa, Staphylococcus aureus
KQRLSEEFKMTYETSLTGWAA

SEQ ID NO: 1669490 - protein, 18 aa, Staphylococcus aureus
KQSGMVFQSYNLFPHKTA

SEQ ID NO: 1669491 - protein, 20 aa, Staphylococcus aureus
KQSIKIVNCEDFIEFYNPGN

SEQ ID NO: 1669492 - protein, 18 aa, Staphylococcus aureus
KQSNLYCRFYEKNYERHC

SEQ ID NO: 1669493 - protein, 21 aa, Staphylococcus aureus
KQSRKELVVVGIFYKNEKRDL

SEQ ID NO: 1669494 - protein, 19 aa, Staphylococcus aureus
KQTFGVPSYQGYIDASETL

SEQ ID NO: 1669495 - protein, 24 aa, Staphylococcus aureus
KQTKISMVTAYDFPSAKQVEAAGI

SEQ ID NO: 1669496 - protein, 19 aa, Staphylococcus aureus
KQVEVIRARRLLDGQASTT

SEQ ID NO: 1669497 - protein, 26 aa, Staphylococcus aureus
KQYFPATHWKAINGIPYAGSSDIDGV

SEQ ID NO: 1669498 - protein, 37 aa, Staphylococcus aureus
KQYFRMLQRPILYTGLTRAKMSLVLLGDPEAFDIGLK

SEQ ID NO: 1669499 - protein, 21 aa, Staphylococcus aureus
KQYGITPGYIWEINTEKQGTP

SEQ ID NO: 1669500 - protein, 18 aa, Staphylococcus aureus
KQYQLPLFMDGARLGYGL

SEQ ID NO: 1669501 - protein, 22 aa, Staphylococcus aureus
KRAQSFGMKVLAFDPYLTDEKA

SEQ ID NO: 1669502 - protein, 21 aa, Staphylococcus aureus
KRAVTSIAFNLPVGTMFMYHD

SEQ ID NO: 1669503 - protein, 20 aa, Staphylococcus aureus
KRDEFEMGRELLVQVRKRQL

SEQ ID NO: 1669504 - protein, 23 aa, Staphylococcus aureus
KRDKGTWIINSGMNIQLKEGALK

SEQ ID NO: 1669505 - protein, 19 aa, Staphylococcus aureus
KREAETEITAAQRVIDNGD

SEQ ID NO: 1669506 - protein, 17 aa, Staphylococcus aureus
KRFNIPHAVETPSELFE

SEQ ID NO: 1669507 - protein, 24 aa, Staphylococcus aureus
KRGIDEYLIRLSLGVENYEDIEHD

SEQ ID NO: 1669508 - protein, 19 aa, Staphylococcus aureus
KRGYPIGQILIPGREEGHM

SEQ ID NO: 1669509 - protein, 19 aa, Staphylococcus aureus
KRIAEMLKERVNQDEQLIV

SEQ ID NO: 1669510 - protein, 18 aa, Staphylococcus aureus
KRIATKYCDIKTANLDEA

SEQ ID NO: 1669511 - protein, 17 aa, Staphylococcus aureus
KRIIYHRVVEMLEEGQS

SEQ ID NO: 1669512 - protein, 18 aa, Staphylococcus aureus
KRIKEAQISLNTVIGNRD

SEQ ID NO: 1669513 - protein, 23 aa, Staphylococcus aureus
KRIKKEFPHITVISNYEVAQYYE

SEQ ID NO: 1669514 - protein, 21 aa, Staphylococcus aureus
KRIKNHLNRAFNREQPMETLV

SEQ ID NO: 1669515 - protein, 19 aa, Staphylococcus aureus
KRINRIILDIEVSKDKYVE

SEQ ID NO: 1669516 - protein, 20 aa, Staphylococcus aureus
KRIQMGAVQPSVKVSQFKFI

SEQ ID NO: 1669517 - protein, 18 aa, Staphylococcus aureus
KRIRNLEFQYVIASDLAS

SEQ ID NO: 1669518 - protein, 27 aa, Staphylococcus aureus
KRKAKRLVKRLKETEIYAVNPLADQLQ

SEQ ID NO: 1669519 - protein, 20 aa, Staphylococcus aureus
KRKANEIGTLMHTVMQHLPF

SEQ ID NO: 1669520 - protein, 20 aa, Staphylococcus aureus
KRKGMPYTQHMVRAHLNHLS

SEQ ID NO: 1669521 - protein, 19 aa, Staphylococcus aureus
KRKLCGRPTRFTPELGNII

SEQ ID NO: 1669522 - protein, 24 aa, Staphylococcus aureus
KRKLHPRYNTYTDLAVYKIKSVKD

SEQ ID NO: 1669523 - protein, 19 aa, Staphylococcus aureus
KRKLISFCEVNDWNRYEVF

SEQ ID NO: 1669524 - protein, 22 aa, Staphylococcus aureus
KRLAQDPALKYQFLRLDQPQNI

SEQ ID NO: 1669525 - protein, 20 aa, Staphylococcus aureus
KRLESSVRHALEKYDTVILT

SEQ ID NO: 1669526 - protein, 18 aa, Staphylococcus aureus
KRLFLARKQLEFYSTQCN

SEQ ID NO: 1669527 - protein, 18 aa, Staphylococcus aureus
KRLITSIDLDELYDELQI

SEQ ID NO: 1669528 - protein, 32 aa, Staphylococcus aureus
KRLKKYISDLNVRPILFVGSGFSQRYINTPNW

SEQ ID NO: 1669529 - protein, 17 aa, Staphylococcus aureus
KRLLDKWEMSSSELMAF

SEQ ID NO: 1669530 - protein, 24 aa, Staphylococcus aureus
KRLSDKDVVFDWDLVQRAITHLDI

SEQ ID NO: 1669531 - protein, 18 aa, Staphylococcus aureus
KRMIDGGFTKSTHVPVLF

SEQ ID NO: 1669532 - protein, 19 aa, Staphylococcus aureus
KRNEVLNIVNVLKKYRIFI

SEQ ID NO: 1669533 - protein, 20 aa, Staphylococcus aureus
KRPEKVSVNLLANGEKVKTL

SEQ ID NO: 1669534 - protein, 20 aa, Staphylococcus aureus
KRPGKELENLVPDHLSGLLF

SEQ ID NO: 1669535 - protein, 20 aa, Staphylococcus aureus
KRPSTAKLIDLRLDTRISYT

SEQ ID NO: 1669536 - protein, 20 aa, Staphylococcus aureus
KRQAYDEKVTVAENIVSGTP

SEQ ID NO: 1669537 - protein, 39 aa, Staphylococcus aureus
KRQSKVFRSRFRMLVEAQLDLLKNEDWDYLLNYDLDAEQ

SEQ ID NO: 1669538 - protein, 33 aa, Staphylococcus aureus
KRQSKVFRSRFRMLVEAQLDLLKNKDWDYLLNY

SEQ ID NO: 1669539 - protein, 21 aa, Staphylococcus aureus
KRSGTTIGLIPTMGALHDGHL

SEQ ID NO: 1669540 - protein, 22 aa, Staphylococcus aureus
KRSSGKIAFLQLRDGTGFMQGV

SEQ ID NO: 1669541 - protein, 17 aa, Staphylococcus aureus
KRTDLEITHLALNDGTV

SEQ ID NO: 1669542 - protein, 19 aa, Staphylococcus aureus
KRTEFKWKNEAIVGVMLAS

SEQ ID NO: 1669543 - protein, 21 aa, Staphylococcus aureus
KRTELDKCLDYLREGDILVVY

SEQ ID NO: 1669544 - protein, 23 aa, Staphylococcus aureus
KRTLHYYDEIGLLVPDKNDKNYR

SEQ ID NO: 1669545 - protein, 26 aa, Staphylococcus aureus
KRVAIEMASPLGWHKYVGTAGEVIAI

SEQ ID NO: 1669546 - protein, 26 aa, Staphylococcus aureus
KRVAIEMASSLGWHKYVGTAGKVIAI

SEQ ID NO: 1669547 - protein, 32 aa, Staphylococcus aureus
KRVESNGIATLKGVEPHIVVKPEAQEAIKASA

SEQ ID NO: 1669548 - protein, 17 aa, Staphylococcus aureus
KRVPVTVNVYQFEFPQT

SEQ ID NO: 1669549 - protein, 19 aa, Staphylococcus aureus
KRVYTRSIINGKLDSQWTV

SEQ ID NO: 1669550 - protein, 19 aa, Staphylococcus aureus
KRYGKHVAVDNISFNINEG

SEQ ID NO: 1669551 - protein, 17 aa, Staphylococcus aureus
KRYKIPTNKAPKLLLKG

SEQ ID NO: 1669552 - protein, 21 aa, Staphylococcus aureus
KRYLFEAVYGDGIIRMYELNT

SEQ ID NO: 1669553 - protein, 24 aa, Staphylococcus aureus
KRYPIRALMMSHMFVEVDGNVHAQ

SEQ ID NO: 1669554 - protein, 17 aa, Staphylococcus aureus
KRYPVKMEHNKIIPTKP

SEQ ID NO: 1669555 - protein, 18 aa, Staphylococcus aureus
KRYPVKMEHNKIIPTKPL

SEQ ID NO: 1669556 - protein, 17 aa, Staphylococcus aureus
KRYPVKMVDNKIIPTKE

SEQ ID NO: 1669557 - protein, 17 aa, Staphylococcus aureus
KRYPVKMVDNKVIPTKE

SEQ ID NO: 1669558 - protein, 21 aa, Staphylococcus aureus
KRYVGRGMLFLDLIQEGNMGL

SEQ ID NO: 1669559 - protein, 18 aa, Staphylococcus aureus
KSAISSQIDRAGHVSEVT

SEQ ID NO: 1669560 - protein, 22 aa, Staphylococcus aureus
KSAKEYVLKLAIDTLADMLQRD

SEQ ID NO: 1669561 - protein, 18 aa, Staphylococcus aureus
KSARIVGDVMGKYHPHGD

SEQ ID NO: 1669562 - protein, 20 aa, Staphylococcus aureus
KSARVHANIVWSYLKEFDTL

SEQ ID NO: 1669563 - protein, 21 aa, Staphylococcus aureus
KSCSFEGFIDYSGERFYSEAI

SEQ ID NO: 1669564 - protein, 20 aa, Staphylococcus aureus
KSDLEIMGYFCLKIVNIKLE

SEQ ID NO: 1669565 - protein, 17 aa, Staphylococcus aureus
KSDRDDFNFVKYNLYET

SEQ ID NO: 1669566 - protein, 17 aa, Staphylococcus aureus
KSDTNVISIEGGKYNEN

SEQ ID NO: 1669567 - protein, 20 aa, Staphylococcus aureus
KSEDYRAILVHPWQYDHTIG

SEQ ID NO: 1669568 - protein, 21 aa, Staphylococcus aureus
KSFDLLFVKWIPREQNKEANQ

SEQ ID NO: 1669569 - protein, 17 aa, Staphylococcus aureus
KSFHVIDLNELYIATDA

SEQ ID NO: 1669570 - protein, 17 aa, Staphylococcus aureus
KSFHVIDLSELYIATDA

SEQ ID NO: 1669571 - protein, 17 aa, Staphylococcus aureus
KSFHVVDLSELYIAMDA

SEQ ID NO: 1669572 - protein, 28 aa, Staphylococcus aureus
KSFTRLQIMSFFSSLWISSYSIELDENK

SEQ ID NO: 1669573 - protein, 25 aa, Staphylococcus aureus
KSGANVLRYLLFVFNNRIIRLQLPY

SEQ ID NO: 1669574 - protein, 23 aa, Staphylococcus aureus
KSGEFPEWIKLDIVTSTEKILFK

SEQ ID NO: 1669575 - protein, 21 aa, Staphylococcus aureus
KSGICDLSSVIGCRDDIMVYL

SEQ ID NO: 1669576 - protein, 24 aa, Staphylococcus aureus
KSGKIRFGKDYGVQIAYVRDESLE

SEQ ID NO: 1669577 - protein, 18 aa, Staphylococcus aureus
KSGLEHMSFYNGSVKEVE

SEQ ID NO: 1669578 - protein, 18 aa, Staphylococcus aureus
KSGSLVGISQIDSSHLTE

SEQ ID NO: 1669579 - protein, 19 aa, Staphylococcus aureus
KSGSLVGISQIDSSHLTER

SEQ ID NO: 1669580 - protein, 19 aa, Staphylococcus aureus
KSGTTIVLFSGELDKAVAA

SEQ ID NO: 1669581 - protein, 17 aa, Staphylococcus aureus
KSIAGFDVESFNVSHDA

SEQ ID NO: 1669582 - protein, 17 aa, Staphylococcus aureus
KSIALAMIKRDEFEMGR

SEQ ID NO: 1669583 - protein, 19 aa, Staphylococcus aureus
KSIDFINLYFLHILSTART

SEQ ID NO: 1669584 - protein, 21 aa, Staphylococcus aureus
KSIFPSCRVAYMVLPYSIMKK

SEQ ID NO: 1669585 - protein, 21 aa, Staphylococcus aureus
KSIKKKLPLINRFIGLTGTSS

SEQ ID NO: 1669586 - protein, 19 aa, Staphylococcus aureus
KSILNTWLNANLKSIEQVR

SEQ ID NO: 1669587 - protein, 17 aa, Staphylococcus aureus
KSITIELAIEMLAQHLI

SEQ ID NO: 1669588 - protein, 20 aa, Staphylococcus aureus
KSKEKTPSWLTNQNQNTAVQ

SEQ ID NO: 1669589 - protein, 18 aa, Staphylococcus aureus
KSKELKRSLTAKFKSNEN

SEQ ID NO: 1669590 - protein, 21 aa, Staphylococcus aureus
KSKFNQIFIFTHSWNDFCDIT

SEQ ID NO: 1669591 - protein, 17 aa, Staphylococcus aureus
KSKKSGKSFDCKLILTK

SEQ ID NO: 1669592 - protein, 23 aa, Staphylococcus aureus
KSKLCPVCNWRRAMKNSYQAQKV

SEQ ID NO: 1669593 - protein, 20 aa, Staphylococcus aureus
KSKLIHSFEAVFPGEATEYV

SEQ ID NO: 1669594 - protein, 28 aa, Staphylococcus aureus
KSKLNPTPKWSIARYKGLGEMNADQLWE

SEQ ID NO: 1669595 - protein, 20 aa, Staphylococcus aureus
KSKPMLFVSVVPTFSTSPNL

SEQ ID NO: 1669596 - protein, 19 aa, Staphylococcus aureus
KSKPVVEPMAPKKQQETKP

SEQ ID NO: 1669597 - protein, 22 aa, Staphylococcus aureus
KSKQAFTDWLKSDVFKAAHKHV

SEQ ID NO: 1669598 - protein, 18 aa, Staphylococcus aureus
KSKVSQTLMQSVPSEIKE

SEQ ID NO: 1669599 - protein, 24 aa, Staphylococcus aureus
KSKYLGSFVDEWEAAKAYNSAVDK

SEQ ID NO: 1669600 - protein, 17 aa, Staphylococcus aureus
KSLADLLPEHRISVNTQ

SEQ ID NO: 1669601 - protein, 18 aa, Staphylococcus aureus
KSLFIKKEVLKQINKLNI

SEQ ID NO: 1669602 - protein, 18 aa, Staphylococcus aureus
KSLGNFILVHDIIKEIDP

SEQ ID NO: 1669603 - protein, 17 aa, Staphylococcus aureus
KSLKDKKVIAVSKDVKP

SEQ ID NO: 1669604 - protein, 17 aa, Staphylococcus aureus
KSLPLEEVEYNEGTATL

SEQ ID NO: 1669605 - protein, 17 aa, Staphylococcus aureus
KSLRQEIQMIFQDPFAS

SEQ ID NO: 1669606 - protein, 19 aa, Staphylococcus aureus
KSMNIEASNHMQALEDDQI

SEQ ID NO: 1669607 - protein, 18 aa, Staphylococcus aureus
KSMTHRAIMLASLAEGVS

SEQ ID NO: 1669608 - protein, 18 aa, Staphylococcus aureus
KSNDLLGLTHERYSYIFD

SEQ ID NO: 1669609 - protein, 18 aa, Staphylococcus aureus
KSNFYRDKLGSLFQNYGL

SEQ ID NO: 1669610 - protein, 20 aa, Staphylococcus aureus
KSNMMFSGYVSEQCINNDEW

SEQ ID NO: 1669611 - protein, 17 aa, Staphylococcus aureus
KSNQRFTVVDAESKEEA

SEQ ID NO: 1669612 - protein, 18 aa, Staphylococcus aureus
KSNQRFTVVEAESKEEAK

SEQ ID NO: 1669613 - protein, 17 aa, Staphylococcus aureus
KSPILKLHIDGDIKGSS

SEQ ID NO: 1669614 - protein, 27 aa, Staphylococcus aureus
KSPLAEISVKVFNEFNISEREASDIVH

SEQ ID NO: 1669615 - protein, 21 aa, Staphylococcus aureus
KSPSGTGLHCFFKGELPKERK

SEQ ID NO: 1669616 - protein, 18 aa, Staphylococcus aureus
KSPSGTGLHCFFKGKLPD

SEQ ID NO: 1669617 - protein, 20 aa, Staphylococcus aureus
KSPTVKAVFNYYLQGYGYKK

SEQ ID NO: 1669618 - protein, 24 aa, Staphylococcus aureus
KSQLKALYLTVIDRIDIRKDENHK

SEQ ID NO: 1669619 - protein, 24 aa, Staphylococcus aureus
KSQLKALYLTVIERIDIRKDENHK

SEQ ID NO: 1669620 - protein, 19 aa, Staphylococcus aureus
KSRGYKLGVVTSDTKKGVE

SEQ ID NO: 1669621 - protein, 17 aa, Staphylococcus aureus
KSSEEMLKYHVSTQNCE

SEQ ID NO: 1669622 - protein, 20 aa, Staphylococcus aureus
KSSFDFCGLVLDYNEDTKIA

SEQ ID NO: 1669623 - protein, 27 aa, Staphylococcus aureus
KSSFECLSIMLLFVYFKSALKINPKNS

SEQ ID NO: 1669624 - protein, 21 aa, Staphylococcus aureus
KSSHKNCDSKMRMVKITRSGK

SEQ ID NO: 1669625 - protein, 18 aa, Staphylococcus aureus
KSSKTFVGGTKFDDQHAS

SEQ ID NO: 1669626 - protein, 25 aa, Staphylococcus aureus
KSSLIKSIQYCLGSNLKAFPKGWDY

SEQ ID NO: 1669627 - protein, 25 aa, Staphylococcus aureus
KSTFANCINGLIPFKTRGNITGELY

SEQ ID NO: 1669628 - protein, 17 aa, Staphylococcus aureus
KSTLINHICNFFYDKDV

SEQ ID NO: 1669629 - protein, 19 aa, Staphylococcus aureus
KSTTERLGIVFTPIEVVDF

SEQ ID NO: 1669630 - protein, 18 aa, Staphylococcus aureus
KSVPQKSASRYTTTSEER

SEQ ID NO: 1669631 - protein, 19 aa, Staphylococcus aureus
KSVVMTLLSRYARKDDVVV

SEQ ID NO: 1669632 - protein, 23 aa, Staphylococcus aureus
KSYFEVLGVPAGQVYPIAYEKDA

SEQ ID NO: 1669633 - protein, 25 aa, Staphylococcus aureus
KSYFFPSKLAFVLFFIKQLEITEHH

SEQ ID NO: 1669634 - protein, 21 aa, Staphylococcus aureus
KSYIFKSTRLESGVHLPPYKG

SEQ ID NO: 1669635 - protein, 22 aa, Staphylococcus aureus
KSYVKHALVFKGNFKMFYDKRG

SEQ ID NO: 1669636 - protein, 24 aa, Staphylococcus aureus
KSYVQSHSFIKSLVLGISGGQDST

SEQ ID NO: 1669637 - protein, 21 aa, Staphylococcus aureus
KTAQYRLNLFKDIIKNYSENE

SEQ ID NO: 1669638 - protein, 19 aa, Staphylococcus aureus
KTAVIACINRLLKTIHYLV

SEQ ID NO: 1669639 - protein, 17 aa, Staphylococcus aureus
KTCHEILDLGIAQNIIQ

SEQ ID NO: 1669640 - protein, 17 aa, Staphylococcus aureus
KTDRIILRMATYEILHS

SEQ ID NO: 1669641 - protein, 19 aa, Staphylococcus aureus
KTEIEDIKKFVALLNGKLE

SEQ ID NO: 1669642 - protein, 19 aa, Staphylococcus aureus
KTFASDWLTSLNMSSDNMR

SEQ ID NO: 1669643 - protein, 19 aa, Staphylococcus aureus
KTGAFGIPLIEKVVGKQGV

SEQ ID NO: 1669644 - protein, 28 aa, Staphylococcus aureus
KTGAFGIPLIEKVVWKQGVQSLILAPTR

SEQ ID NO: 1669645 - protein, 20 aa, Staphylococcus aureus
KTGFALNMMLNIARNGYKTS

SEQ ID NO: 1669646 - protein, 20 aa, Staphylococcus aureus
KTIEFKKRLASGVDTLDTLL

SEQ ID NO: 1669647 - protein, 19 aa, Staphylococcus aureus
KTIEGGVAFATQIVQDKYE

SEQ ID NO: 1669648 - protein, 25 aa, Staphylococcus aureus
KTIGCPIGNYIPEWNDLVYHQDFKT

SEQ ID NO: 1669649 - protein, 18 aa, Staphylococcus aureus
KTIIGKDWFDGKPCERYI

SEQ ID NO: 1669650 - protein, 19 aa, Staphylococcus aureus
KTIVYKGWLRSDQIKKVYT

SEQ ID NO: 1669651 - protein, 30 aa, Staphylococcus aureus
KTKAQDLDGAMQRLQSAIANKDQTKANENY

SEQ ID NO: 1669652 - protein, 18 aa, Staphylococcus aureus
KTKLYPTQYIRFEEATIE

SEQ ID NO: 1669653 - protein, 18 aa, Staphylococcus aureus
KTKNCLYYRNGDNKLSEY

SEQ ID NO: 1669654 - protein, 25 aa, Staphylococcus aureus
KTKNPRLAKEVLLSLPNDFDREVQT

SEQ ID NO: 1669655 - protein, 17 aa, Staphylococcus aureus
KTKRTELDKCLDYLREG

SEQ ID NO: 1669656 - protein, 17 aa, Staphylococcus aureus
KTKYKMLRKYGLDHDSA

SEQ ID NO: 1669657 - protein, 17 aa, Staphylococcus aureus
KTLDWALENDRFIVTLC

SEQ ID NO: 1669658 - protein, 24 aa, Staphylococcus aureus
KTLPAKAKLLYALISERQSLSKAN

SEQ ID NO: 1669659 - protein, 22 aa, Staphylococcus aureus
KTLSSRYYTNWDTIEKQVNHRG

SEQ ID NO: 1669660 - protein, 17 aa, Staphylococcus aureus
KTLSSRYYTNWNTIEKQ

SEQ ID NO: 1669661 - protein, 23 aa, Staphylococcus aureus
KTNAKFDVFEMVDGKYEIRESKV

SEQ ID NO: 1669662 - protein, 21 aa, Staphylococcus aureus
KTNELEKQMEFFETRAKNDEK

SEQ ID NO: 1669663 - protein, 24 aa, Staphylococcus aureus
KTPTKSGYFVTCWTKDEDNYNRPY

SEQ ID NO: 1669664 - protein, 25 aa, Staphylococcus aureus
KTPTKTGYFVTCWTKDENNCNQPYS

SEQ ID NO: 1669665 - protein, 17 aa, Staphylococcus aureus
KTPYVIGGLTFANTIGA

SEQ ID NO: 1669666 - protein, 27 aa, Staphylococcus aureus
KTQNTCLFRLLAFTGMRKGEVLALHWS

SEQ ID NO: 1669667 - protein, 17 aa, Staphylococcus aureus
KTRLCVLNKIKSLEYKV

SEQ ID NO: 1669668 - protein, 46 aa, Staphylococcus aureus
KTRVRLYKSGKNWVKSGIKEIEMFKIMGLPFISHSIVSQDNQSISK

SEQ ID NO: 1669669 - protein, 19 aa, Staphylococcus aureus
KTRYKQIVKTSVNSDSSYN

SEQ ID NO: 1669670 - protein, 25 aa, Staphylococcus aureus
KTSKKLVKFMLVFCSNSMTAEEIHL

SEQ ID NO: 1669671 - protein, 26 aa, Staphylococcus aureus
KTSLSDARFRTIIKLYEYQRLLENKE

SEQ ID NO: 1669672 - protein, 26 aa, Staphylococcus aureus
KTSLSDARFRTIIKLYEYQRSLENKE

SEQ ID NO: 1669673 - protein, 24 aa, Staphylococcus aureus
KTTAVIGGAFTVNMLHDQQAFAAS

SEQ ID NO: 1669674 - protein, 19 aa, Staphylococcus aureus
KTTLLRMINALEIPTEGTV

SEQ ID NO: 1669675 - protein, 19 aa, Staphylococcus aureus
KTVDIRKQFTYDYTALDTK

SEQ ID NO: 1669676 - protein, 21 aa, Staphylococcus aureus
KTYLSWLAQVGFKHVETFTDF

SEQ ID NO: 1669677 - protein, 17 aa, Staphylococcus aureus
KTYSESTIDRWFTTALK

SEQ ID NO: 1669678 - protein, 23 aa, Staphylococcus aureus
KTYSESTIDRWFTTALKVLDDQL

SEQ ID NO: 1669679 - protein, 18 aa, Staphylococcus aureus
KVAHTLPLAQIVVVHMEA

SEQ ID NO: 1669680 - protein, 17 aa, Staphylococcus aureus
KVAHYLPKDYVYAPIQT

SEQ ID NO: 1669681 - protein, 19 aa, Staphylococcus aureus
KVAKEKPDLIIVYSTDKDI

SEQ ID NO: 1669682 - protein, 17 aa, Staphylococcus aureus
KVALMHCGAELNDGQLD

SEQ ID NO: 1669683 - protein, 22 aa, Staphylococcus aureus
KVANEAYKSWKTWSANDRAELM

SEQ ID NO: 1669684 - protein, 24 aa, Staphylococcus aureus
KVAQDAFESWSLTSKSERAQMLRD

SEQ ID NO: 1669685 - protein, 30 aa, Staphylococcus aureus
KVATRLGHVKGYFIYPYQEVMKDSNIKLFS

SEQ ID NO: 1669686 - protein, 23 aa, Staphylococcus aureus
KVAVLKPFRLGGIDKVQTAIDTL

SEQ ID NO: 1669687 - protein, 17 aa, Staphylococcus aureus
KVAVQRWNNRFSMAMLE

SEQ ID NO: 1669688 - protein, 19 aa, Staphylococcus aureus
KVDGFKFFVHAIREVNGVA

SEQ ID NO: 1669689 - protein, 18 aa, Staphylococcus aureus
KVDLNTRLAIAKYLYDGN

SEQ ID NO: 1669690 - protein, 26 aa, Staphylococcus aureus
KVDQMFGWKSIKGYEVKNKTKDALFI

SEQ ID NO: 1669691 - protein, 25 aa, Staphylococcus aureus
KVEGIGYRLNYDLHVSHCKNERDYM

SEQ ID NO: 1669692 - protein, 22 aa, Staphylococcus aureus
KVEKELPNTGSEGMDLPLKEFA

SEQ ID NO: 1669693 - protein, 20 aa, Staphylococcus aureus
KVELKIRYKVSKIAYASHLK

SEQ ID NO: 1669694 - protein, 20 aa, Staphylococcus aureus
KVFESMGPKLTKMGDGLKSI

SEQ ID NO: 1669695 - protein, 26 aa, Staphylococcus aureus
KVFKTAYDHVEWFRKGINGLGETIKF

SEQ ID NO: 1669696 - protein, 28 aa, Staphylococcus aureus
KVGASVFTGFGPRIVRINNFSVDLKPNQ

SEQ ID NO: 1669697 - protein, 19 aa, Staphylococcus aureus
KVGFKRLYVGVFNPEATKV

SEQ ID NO: 1669698 - protein, 23 aa, Staphylococcus aureus
KVGPFLSCPVGYQFQPGGYCDYT

SEQ ID NO: 1669699 - protein, 23 aa, Staphylococcus aureus
KVIDEMASRFVVVVDETKMVQYL

SEQ ID NO: 1669700 - protein, 21 aa, Staphylococcus aureus
KVIEFNARFGDPEAQVLLSRM

SEQ ID NO: 1669701 - protein, 26 aa, Staphylococcus aureus
KVIKGKTKFANAVVKVYSELGEAQLF

SEQ ID NO: 1669702 - protein, 17 aa, Staphylococcus aureus
KVILPKVQVKPAARQSV

SEQ ID NO: 1669703 - protein, 18 aa, Staphylococcus aureus
KVITEWEMMGLRKVKIGK

SEQ ID NO: 1669704 - protein, 18 aa, Staphylococcus aureus
KVIYEKAKAINISSLTDL

SEQ ID NO: 1669705 - protein, 17 aa, Staphylococcus aureus
KVIYKWMDLGRKTDERL

SEQ ID NO: 1669706 - protein, 17 aa, Staphylococcus aureus
KVKDSLIDSNIILGNEY

SEQ ID NO: 1669707 - protein, 17 aa, Staphylococcus aureus
KVKQAFINAKRDVITLA

SEQ ID NO: 1669708 - protein, 26 aa, Staphylococcus aureus
KVKRDFYDVRGFLSCSRILVDKQQTL

SEQ ID NO: 1669709 - protein, 19 aa, Staphylococcus aureus
KVKVIAWYDNEWGYSNRVV

SEQ ID NO: 1669710 - protein, 19 aa, Staphylococcus aureus
KVLAHKMNKAIVIVLHDIN

SEQ ID NO: 1669711 - protein, 20 aa, Staphylococcus aureus
KVLAVSGAKLKEAIERSAEY

SEQ ID NO: 1669712 - protein, 20 aa, Staphylococcus aureus
KVLEKDFNYIYVINLKGSLS

SEQ ID NO: 1669713 - protein, 24 aa, Staphylococcus aureus
KVLNVSEAWLLGYDVSSERPTDEE

SEQ ID NO: 1669714 - protein, 23 aa, Staphylococcus aureus
KVMQRYCLEKRIGKYTLHSIRHT

SEQ ID NO: 1669715 - protein, 19 aa, Staphylococcus aureus
KVNELEKQVEIFETRAKND

SEQ ID NO: 1669716 - protein, 24 aa, Staphylococcus aureus
KVNEVIKRLNYRPNAVARGLASKK

SEQ ID NO: 1669717 - protein, 19 aa, Staphylococcus aureus
KVNSSKLLLPKEDRTFKLK

SEQ ID NO: 1669718 - protein, 22 aa, Staphylococcus aureus
KVPANLKLPLRDGDTEREDDVN

SEQ ID NO: 1669719 - protein, 18 aa, Staphylococcus aureus
KVQPCCFKLYNDPFDMVY

SEQ ID NO: 1669720 - protein, 18 aa, Staphylococcus aureus
KVRAANFALKNGYCDIQI

SEQ ID NO: 1669721 - protein, 17 aa, Staphylococcus aureus
KVRPYRGSIAIYKEYSA

SEQ ID NO: 1669722 - protein, 18 aa, Staphylococcus aureus
KVSDRNKADALKAITALK

SEQ ID NO: 1669723 - protein, 20 aa, Staphylococcus aureus
KVSEMDAFGSINFVNLYSNI

SEQ ID NO: 1669724 - protein, 20 aa, Staphylococcus aureus
KVSGIGAIRGMTSFGAYINE

SEQ ID NO: 1669725 - protein, 18 aa, Staphylococcus aureus
KVSNRNKADALKAITALK

SEQ ID NO: 1669726 - protein, 25 aa, Staphylococcus aureus
KVSTLSKRPFNVFMTPSDKKRMMDR

SEQ ID NO: 1669727 - protein, 22 aa, Staphylococcus aureus
KVTALHLPQGFNVRVDSLLYPG

SEQ ID NO: 1669728 - protein, 20 aa, Staphylococcus aureus
KVTDKRAHFIQELELLAKPI

SEQ ID NO: 1669729 - protein, 35 aa, Staphylococcus aureus
KVTGCPAIACYQCGYCLKGEYARCEKLFVIGSYEP

SEQ ID NO: 1669730 - protein, 18 aa, Staphylococcus aureus
KVTYKLLDKLGFGGNDLG

SEQ ID NO: 1669731 - protein, 23 aa, Staphylococcus aureus
KVVVLKPFRLGGIDKVQTAIDTL

SEQ ID NO: 1669732 - protein, 24 aa, Staphylococcus aureus
KVVVLKPLRLGGMDKVQTAIDALK

SEQ ID NO: 1669733 - protein, 18 aa, Staphylococcus aureus
KVWGERVGVDVISQSEGS

SEQ ID NO: 1669734 - protein, 20 aa, Staphylococcus aureus
KWAESNATIIADFYKNMKTE

SEQ ID NO: 1669735 - protein, 21 aa, Staphylococcus aureus
KWAESNATIIADFYKNMKTEG

SEQ ID NO: 1669736 - protein, 25 aa, Staphylococcus aureus
KWFSNAYKSAKGWLTDMANKSRSKW

SEQ ID NO: 1669737 - protein, 21 aa, Staphylococcus aureus
KWGERLWVERSWGSKVDKNSG

SEQ ID NO: 1669738 - protein, 23 aa, Staphylococcus aureus
KWPTITKNWLYHWAQYIKTIFNK

SEQ ID NO: 1669739 - protein, 23 aa, Staphylococcus aureus
KWPTITNNWLYHWAKYIKTIFNK

SEQ ID NO: 1669740 - protein, 37 aa, Staphylococcus aureus; identical to SEQ ID NO: 1579708

SEQ ID NO: 1669741 - protein, 17 aa, Staphylococcus aureus
KYAGVDWGYEHYGSIMV

SEQ ID NO: 1669742 - protein, 19 aa, Staphylococcus aureus
KYDDLGKMYQIVRQYELGN

SEQ ID NO: 1669743 - protein, 20 aa, Staphylococcus aureus
KYDEVMRFGKYHPDYKKVML

SEQ ID NO: 1669744 - protein, 18 aa, Staphylococcus aureus
KYDKLKARYERFQNQSFK

SEQ ID NO: 1669745 - protein, 24 aa, Staphylococcus aureus
KYEAEFKAKCIADFDKNIEYNQTH

SEQ ID NO: 1669746 - protein, 34 aa, Staphylococcus aureus
KYEGHGNGGDGIGFAFSPGVLGETGLNGAAVGIG

SEQ ID NO: 1669747 - protein, 23 aa, Staphylococcus aureus
KYELDVAPMFKSLIGKDISEEDA

SEQ ID NO: 1669748 - protein, 22 aa, Staphylococcus aureus
KYFDERSYFIFGGMAPKHYSHV

SEQ ID NO: 1669749 - protein, 18 aa, Staphylococcus aureus
KYFGLRTDPTISIKPIPR

SEQ ID NO: 1669750 - protein, 17 aa, Staphylococcus aureus
KYFKLLENEIAKWHKKD

SEQ ID NO: 1669751 - protein, 19 aa, Staphylococcus aureus
KYGEKYYAIIGAQNNNQQG

SEQ ID NO: 1669752 - protein, 19 aa, Staphylococcus aureus
KYGPSELITSDFNGYLITK

SEQ ID NO: 1669753 - protein, 26 aa, Staphylococcus aureus
KYGVGRRISLHYTRQMVNQAISGKLK

SEQ ID NO: 1669754 - protein, 19 aa, Staphylococcus aureus
KYGYGIEVCQSMGADNATF

SEQ ID NO: 1669755 - protein, 24 aa, Staphylococcus aureus
KYHDHWLGYCTNELVQIYPEAKYF

SEQ ID NO: 1669756 - protein, 25 aa, Staphylococcus aureus
KYIKGPDFPTGGIIQGVDGIKKAYE

SEQ ID NO: 1669757 - protein, 24 aa, Staphylococcus aureus
KYKLFGLEQVRAIKERLFKKGLMK

SEQ ID NO: 1669758 - protein, 26 aa, Staphylococcus aureus
KYKLTIPEIFCKHGEQYFRNLEFTCL

SEQ ID NO: 1669759 - protein, 20 aa, Staphylococcus aureus
KYKTRHIAGCLITHEHGDHA

SEQ ID NO: 1669760 - protein, 18 aa, Staphylococcus aureus
KYLHFKDIIEYFRPGDTL

SEQ ID NO: 1669761 - protein, 25 aa, Staphylococcus aureus
KYLIEGSNFTTGWIFFINSVGELEL

SEQ ID NO: 1669762 - protein, 23 aa, Staphylococcus aureus
KYLKKRLITGDIVFATARFYIRV

SEQ ID NO: 1669763 - protein, 23 aa, Staphylococcus aureus
KYLRPETLFGNKFEGYLNQKIQP

SEQ ID NO: 1669764 - protein, 22 aa, Staphylococcus aureus
KYLRPETLFGSKFEGYLNQKIQ

SEQ ID NO: 1669765 - protein, 22 aa, Staphylococcus aureus
KYLRPETLFGSKFEGYLNTKNT

SEQ ID NO: 1669766 - protein, 17 aa, Staphylococcus aureus
KYMAREFSLEKTRNIGI

SEQ ID NO: 1669767 - protein, 20 aa, Staphylococcus aureus
KYNIPVKSILGFGDSGNDEA

SEQ ID NO: 1669768 - protein, 22 aa, Staphylococcus aureus
KYNIPVKSILGFGDSGNDEALK

SEQ ID NO: 1669769 - protein, 22 aa, Staphylococcus aureus
KYNIPVKSILGFGDSGNDETYL

SEQ ID NO: 1669770 - protein, 18 aa, Staphylococcus aureus
KYPIGAVEDEIYYFNEEN

SEQ ID NO: 1669771 - protein, 23 aa, Staphylococcus aureus
KYPKGNRGVRFMFKLVDGNDKDL

SEQ ID NO: 1669772 - protein, 19 aa, Staphylococcus aureus
KYPLADFALTPDVAIIDSQ

SEQ ID NO: 1669773 - protein, 19 aa, Staphylococcus aureus
KYQGFGYGMKIMMSLPQYV

SEQ ID NO: 1669774 - protein, 18 aa, Staphylococcus aureus
KYRILDYVNHFDSQRRKV

SEQ ID NO: 1669775 - protein, 23 aa, Staphylococcus aureus
KYSTDMRDAREFDGLDKTVIDMS

SEQ ID NO: 1669776 - protein, 20 aa, Staphylococcus aureus
KYTEKSTHSYKQRIKELDGT

SEQ ID NO: 1669777 - protein, 18 aa, Staphylococcus aureus
KYTKFFIKDILSIQDAQI

SEQ ID NO: 1669778 - protein, 18 aa, Staphylococcus aureus
KYTTAGAFNEAILTTDTC

SEQ ID NO: 1669779 - protein, 24 aa, Staphylococcus aureus
KYTVKSHRVHKGLHMLTFEGINNI

SEQ ID NO: 1669780 - protein, 24 aa, Staphylococcus aureus
KYVINGKSAIEWIMDQYQVKTDKK

SEQ ID NO: 1669781 - protein, 19 aa, Staphylococcus aureus
KYYEWRNDRKFNKLIRPET

SEQ ID NO: 1669782 - protein, 18 aa, Staphylococcus aureus
KYYLGLHSHIDWETLTDN

SEQ ID NO: 1669783 - protein, 23 aa, Staphylococcus aureus
LAAMIEGCYVLRAIEMVEEGYEP

SEQ ID NO: 1669784 - protein, 24 aa, Staphylococcus aureus
LAAMIEGCYVLRAIEMVGEGYEPQ

SEQ ID NO: 1669785 - protein, 28 aa, Staphylococcus aureus
LAARAVNVAKWFVGDYMTSLDMQGFSIT

SEQ ID NO: 1669786 - protein, 18 aa, Staphylococcus aureus
LADMEVFDYITPEFLIKR

SEQ ID NO: 1669787 - protein, 27 aa, Staphylococcus aureus
LADRLGFKRIWFTEHHNVPAFACSSPE

SEQ ID NO: 1669788 - protein, 20 aa, Staphylococcus aureus
LAEAKAAARQNLGTLNHITN

SEQ ID NO: 1669789 - protein, 27 aa, Staphylococcus aureus
LAEANLRLVVSIAKRYVGRGMLFLDLI

SEQ ID NO: 1669790 - protein, 19 aa, Staphylococcus aureus
LAEEIKRETEFDILFFSAI

SEQ ID NO: 1669791 - protein, 26 aa, Staphylococcus aureus
LAFCKAHHLKGRILVSTEGINGTLSG

SEQ ID NO: 1669792 - protein, 20 aa, Staphylococcus aureus
LAILPFKLLGKGIGLASKSV

SEQ ID NO: 1669793 - protein, 22 aa, Staphylococcus aureus
LAIRKGETLGIVGESGSGKSTL

SEQ ID NO: 1669794 - protein, 19 aa, Staphylococcus aureus
LAITGRVSMNQAFNGDITF

SEQ ID NO: 1669795 - protein, 21 aa, Staphylococcus aureus
LAKDDIYAVAYSFKKAENINS

SEQ ID NO: 1669796 - protein, 21 aa, Staphylococcus aureus
LAKGRPLFEAVHKAKKFISMS

SEQ ID NO: 1669797 - protein, 24 aa, Staphylococcus aureus
LAKIIERYERFLGKQAYAIPSQVT

SEQ ID NO: 1669798 - protein, 21 aa, Staphylococcus aureus
LAKRVVKEKWSVRYLENHFNE

SEQ ID NO: 1669799 - protein, 17 aa, Staphylococcus aureus
LAKVKVLIDQYVADGNR

SEQ ID NO: 1669800 - protein, 19 aa, Staphylococcus aureus
LALELYNNPWIAWYHQQMQ

SEQ ID NO: 1669801 - protein, 24 aa, Staphylococcus aureus
LALESQHAGLSWLTILKKKEASEE

SEQ ID NO: 1669802 - protein, 17 aa, Staphylococcus aureus
LALPFSVLYNLPSKGSD

SEQ ID NO: 1669803 - protein, 18 aa, Staphylococcus aureus
LANMNVFVILSYANQPFI

SEQ ID NO: 1669804 - protein, 17 aa, Staphylococcus aureus
LANTLLNSDNTNVNDIN

SEQ ID NO: 1669805 - protein, 17 aa, Staphylococcus aureus
LAPKSKADFAFIQHMVH

SEQ ID NO: 1669806 - protein, 22 aa, Staphylococcus aureus
LAQQLDCFEHIHSIPGIGKLSA

SEQ ID NO: 1669807 - protein, 18 aa, Staphylococcus aureus
LAQVGFKHVETFTDFNID

SEQ ID NO: 1669808 - protein, 21 aa, Staphylococcus aureus
LARQHHARLIYVSTISVGTYF

SEQ ID NO: 1669809 - protein, 19 aa, Staphylococcus aureus
LASALFIYNEHEVYYLSSG

SEQ ID NO: 1669810 - protein, 17 aa, Staphylococcus aureus
LASSYFRSSGYDGFMQD

SEQ ID NO: 1669811 - protein, 18 aa, Staphylococcus aureus
LATAKLNAKTYLNTLTSI

SEQ ID NO: 1669812 - protein, 19 aa, Staphylococcus aureus
LATENQFALAYDCYPNPTD

SEQ ID NO: 1669813 - protein, 17 aa, Staphylococcus aureus
LATIEVFEDIKSHIVSE

SEQ ID NO: 1669814 - protein, 17 aa, Staphylococcus aureus
LAVNRTFTNAQGEREAD

SEQ ID NO: 1669815 - protein, 17 aa, Staphylococcus aureus
LAVQYPDQFERLMELQN

SEQ ID NO: 1669816 - protein, 18 aa, Staphylococcus aureus
LAVSGPFHSLLMKVIEED

SEQ ID NO: 1669817 - protein, 19 aa, Staphylococcus aureus
LAVSLKAAHLRFVTSSPGI

SEQ ID NO: 1669818 - protein, 24 aa, Staphylococcus aureus
LCEEFSYKCFIKDIKYKKLLKDIS

SEQ ID NO: 1669819 - protein, 17 aa, Staphylococcus aureus
LCELLAHLIEIPQTSYD

SEQ ID NO: 1669820 - protein, 22 aa, Staphylococcus aureus
LCESDSLLCIDADVESLNDVDD

SEQ ID NO: 1669821 - protein, 19 aa, Staphylococcus aureus
LCEYFGVTPNEFFGINEKK

SEQ ID NO: 1669822 - protein, 19 aa, Staphylococcus aureus
LCNHYDIPTPLKSYHEHNK

SEQ ID NO: 1669823 - protein, 26 aa, Staphylococcus aureus
LCNMRCSHCAVGYTLQTVDLEPLDMD

SEQ ID NO: 1669824 - protein, 22 aa, Staphylococcus aureus
LCTTYKMVLDFYIELSSNTVKG

SEQ ID NO: 1669825 - protein, 19 aa, Staphylococcus aureus
LDAGLMFPEDEMLGIDIVI

SEQ ID NO: 1669826 - protein, 24 aa, Staphylococcus aureus
LDAKSANIKFGFDRNTGNDVMHVK

SEQ ID NO: 1669827 - protein, 26 aa, Staphylococcus aureus
LDALTEKKVSYGLIYTVLEGVKGLVE

SEQ ID NO: 1669828 - protein, 23 aa, Staphylococcus aureus
LDCIGVSLAEMPVDFSFVDTTAR

SEQ ID NO: 1669829 - protein, 23 aa, Staphylococcus aureus
LDCKEKKEILLRMFSNSKISMVY

SEQ ID NO: 1669830 - protein, 24 aa, Staphylococcus aureus
LDDFSRAIAGYRIEFGAPDTIRTA

SEQ ID NO: 1669831 - protein, 17 aa, Staphylococcus aureus
LDDRFFRCHNIESIDSK

SEQ ID NO: 1669832 - protein, 23 aa, Staphylococcus aureus
LDEANIIRYAKYLNELSDETQFI

SEQ ID NO: 1669833 - protein, 25 aa, Staphylococcus aureus
LDELIKELRRLGANVYVSIENGIKS

SEQ ID NO: 1669834 - protein, 19 aa, Staphylococcus aureus
LDEQVTYEKLAIATLGVRN

SEQ ID NO: 1669835 - protein, 17 aa, Staphylococcus aureus
LDFYLRPFVKTKIKAWV

SEQ ID NO: 1669836 - protein, 36 aa, Staphylococcus aureus
LDFYLRPFVKTKIKAWVRQLLWMSIYQYVYLDKVPN

SEQ ID NO: 1669837 - protein, 23 aa, Staphylococcus aureus
LDGELFRKNFVGVHDGSTNKHIH

SEQ ID NO: 1669838 - protein, 24 aa, Staphylococcus aureus
LDGELFRKNFVGVHDGSTNKYIHV

SEQ ID NO: 1669839 - protein, 17 aa, Staphylococcus aureus
LDGEYWPGCHSCGEEEV

SEQ ID NO: 1669840 - protein, 29 aa, Staphylococcus aureus
LDGSPAVTPRNYRWKSCTGTTGQTQYGFI

SEQ ID NO: 1669841 - protein, 26 aa, Staphylococcus aureus
LDGSRRFLDRVWRLIVNEDGTLSSKI

SEQ ID NO: 1669842 - protein, 18 aa, Staphylococcus aureus
LDGTRLLDQAKQTAKQQL

SEQ ID NO: 1669843 - protein, 25 aa, Staphylococcus aureus
LDIKLFPGQEIRITDSILQGLDNGS

SEQ ID NO: 1669844 - protein, 27 aa, Staphylococcus aureus
LDIVNKLGLVEGWKRDGLTDEQIARNL

SEQ ID NO: 1669845 - protein, 26 aa, Staphylococcus aureus
LDKAQLAQYCSFYSDFVKASLILERE

SEQ ID NO: 1669846 - protein, 18 aa, Staphylococcus aureus
LDKAVAALIIANGARAAG

SEQ ID NO: 1669847 - protein, 19 aa, Staphylococcus aureus
LDKEFDFILVEGAGGIGVP

SEQ ID NO: 1669848 - protein, 24 aa, Staphylococcus aureus
LDKERLADMEVWMAFRNDIHEYGQ

SEQ ID NO: 1669849 - protein, 24 aa, Staphylococcus aureus
LDKIPKCDVCGGFIDGYSTENQNI

SEQ ID NO: 1669850 - protein, 25 aa, Staphylococcus aureus
LDKLPEIANVFGVKPLDLIHDMNDS

SEQ ID NO: 1669851 - protein, 23 aa, Staphylococcus aureus
LDKNMIAGVRYFNVKDFDNTPIQ

SEQ ID NO: 1669852 - protein, 21 aa, Staphylococcus aureus
LDKVQGSAIAKAEAEQLKQHI

SEQ ID NO: 1669853 - protein, 19 aa, Staphylococcus aureus
LDLADLVPARHVKRMHHVE

SEQ ID NO: 1669854 - protein, 18 aa, Staphylococcus aureus
LDLAFDFEDDLSDYYAMS

SEQ ID NO: 1669855 - protein, 17 aa, Staphylococcus aureus
LDLAKKHNIVISNVPSY

SEQ ID NO: 1669856 - protein, 24 aa, Staphylococcus aureus
LDLHKDILNQMAFKPIIADHLKLV

SEQ ID NO: 1669857 - protein, 17 aa, Staphylococcus aureus
LDLLKNKDWDYLLNYDL

SEQ ID NO: 1669858 - protein, 25 aa, Staphylococcus aureus
LDLPFPIKINQMLGHQTSFLTYEGL

SEQ ID NO: 1669859 - protein, 22 aa, Staphylococcus aureus
LDLVYRGSFIMRYLLDGRVPNL

SEQ ID NO: 1669860 - protein, 22 aa, Staphylococcus aureus
LDLVYRGSFVMRYLLDGRVPNL

SEQ ID NO: 1669861 - protein, 17 aa, Staphylococcus aureus
LDLYYQAGFNHVHYHTG

SEQ ID NO: 1669862 - protein, 17 aa, Staphylococcus aureus
LDMITDLDFETLYQYML

SEQ ID NO: 1669863 - protein, 18 aa, Staphylococcus aureus
LDMYPIKNLEGLYDKEGY

SEQ ID NO: 1669864 - protein, 18 aa, Staphylococcus aureus
LDNLKNVTGYIRGGCSPV

SEQ ID NO: 1669865 - protein, 23 aa, Staphylococcus aureus
LDPHKLASCIDVANIDTPIKVIL

SEQ ID NO: 1669866 - protein, 41 aa, Staphylococcus aureus
LDPRVEKLMQAFWPGPISFILPLKLGYLCRKVSGGLSSVAV

SEQ ID NO: 1669867 - protein, 24 aa, Staphylococcus aureus
LDQRVINHYGSLIPLTPLDNSLLR

SEQ ID NO: 1669868 - protein, 25 aa, Staphylococcus aureus
LDQRVINHYGSLIPLTPLDSSLLRK

SEQ ID NO: 1669869 - protein, 24 aa, Staphylococcus aureus
LDRKLSERRIFPAIDIGRSSTRKE

SEQ ID NO: 1669870 - protein, 20 aa, Staphylococcus aureus
LDRNPYQLIYDIKGIGFNKA

SEQ ID NO: 1669871 - protein, 22 aa, Staphylococcus aureus
LDSGFRKLIITEFSVSKKRIFI

SEQ ID NO: 1669872 - protein, 19 aa, Staphylococcus aureus
LDSMIFNFNEIFRERMPKY

SEQ ID NO: 1669873 - protein, 29 aa, Staphylococcus aureus
LDSNIPVGRGMIKWAPFATLPEQFETIQQ

SEQ ID NO: 1669874 - protein, 26 aa, Staphylococcus aureus
LDTEILWKMHFGLYPTPIKRLQNYLL

SEQ ID NO: 1669875 - protein, 34 aa, Staphylococcus aureus
LDTIFKNAGFEWREPGCSMCLGMNPDQVPDGVHC

SEQ ID NO: 1669876 - protein, 17 aa, Staphylococcus aureus
LDTLWQLRNLFTDSTDF

SEQ ID NO: 1669877 - protein, 18 aa, Staphylococcus aureus
LDVEFKFNREEETLRIYR

SEQ ID NO: 1669878 - protein, 27 aa, Staphylococcus aureus
LDVQEGLRVYWYYDLIDNEIKIVCIDP

SEQ ID NO: 1669879 - protein, 17 aa, Staphylococcus aureus
LDYDMINDLGFEVDYDT

SEQ ID NO: 1669880 - protein, 19 aa, Staphylococcus aureus
LDYRELYRNLPYIGTLKPE

SEQ ID NO: 1669881 - protein, 19 aa, Staphylococcus aureus
LDYRELYRNLPYISTLKPE

SEQ ID NO: 1669882 - protein, 23 aa, Staphylococcus aureus
LDYRSKRKSLPFTENDENIVMLI

SEQ ID NO: 1669883 - protein, 23 aa, Staphylococcus aureus
LDYRSKRKSLPFTENDKNIVVLI

SEQ ID NO: 1669884 - protein, 18 aa, Staphylococcus aureus
LEAARKRPGMYIGSTSER

SEQ ID NO: 1669885 - protein, 25 aa, Staphylococcus aureus
LEAKFRTSSLRSWKTDQADAHKLAQ

SEQ ID NO: 1669886 - protein, 19 aa, Staphylococcus aureus
LEALYPPSYSSYIDFLYTC

SEQ ID NO: 1669887 - protein, 22 aa, Staphylococcus aureus
LEAMSAAAIKFAQQFEENSTFK

SEQ ID NO: 1669888 - protein, 22 aa, Staphylococcus aureus
LEAVAYNTSMEYIHNCVDGKKE

SEQ ID NO: 1669889 - protein, 25 aa, Staphylococcus aureus
LEDFKAAHIDTSFIIKTTEAKTGQA

SEQ ID NO: 1669890 - protein, 19 aa, Staphylococcus aureus
LEDFLINFDNTVIVVSHDR

SEQ ID NO: 1669891 - protein, 20 aa, Staphylococcus aureus
LEDGLIPAIIMWESNEGDLL

SEQ ID NO: 1669892 - protein, 18 aa, Staphylococcus aureus
LEEKKKLLIFPRYHQLDV

SEQ ID NO: 1669893 - protein, 21 aa, Staphylococcus aureus
LEEPPAHAIFILATTEPHKIP

SEQ ID NO: 1669894 - protein, 19 aa, Staphylococcus aureus
LEFRKQFTPAQWHEINRII

SEQ ID NO: 1669895 - protein, 26 aa, Staphylococcus aureus
LEFYHPEFKKEYVILAEEGAQSDEGD

SEQ ID NO: 1669896 - protein, 17 aa, Staphylococcus aureus
LEGASIVEKPTSYTVKV

SEQ ID NO: 1669897 - protein, 24 aa, Staphylococcus aureus
LEHISFKNVCQAVVYISGQKKGDV

SEQ ID NO: 1669898 - protein, 21 aa, Staphylococcus aureus
LEHLDRIRISFFTYHRSDADI

SEQ ID NO: 1669899 - protein, 26 aa, Staphylococcus aureus
LEIEEVKRPWLPPLPENVYQEDLVET

SEQ ID NO: 1669900 - protein, 23 aa, Staphylococcus aureus
LEIIKKVRYVYNIDFDKPKFEMW

SEQ ID NO: 1669901 - protein, 23 aa, Staphylococcus aureus
LEIIKKVRYVYNIDFDKPKLEMW

SEQ ID NO: 1669902 - protein, 29 aa, Staphylococcus aureus
LEIPHEMKLVPNWVLWRAEWNEKQQNFGK

SEQ ID NO: 1669903 - protein, 20 aa, Staphylococcus aureus
LEIQFSDGLTVLSGETGSGK

SEQ ID NO: 1669904 - protein, 17 aa, Staphylococcus aureus
LEKDGTFTNTERRIQRL

SEQ ID NO: 1669905 - protein, 22 aa, Staphylococcus aureus
LEKGEDIVECITIFADDQDLTF

SEQ ID NO: 1669906 - protein, 19 aa, Staphylococcus aureus
LEKGIARTGYEVMDLDGNI

SEQ ID NO: 1669907 - protein, 24 aa, Staphylococcus aureus
LEKGKLGQIILCLSYTNHENIELR

SEQ ID NO: 1669908 - protein, 24 aa, Staphylococcus aureus
LEKIDPRFSRNMLFLKDGDDEEYS

SEQ ID NO: 1669909 - protein, 20 aa, Staphylococcus aureus
LEKLGRYLMDSFVNIDGTDN

SEQ ID NO: 1669910 - protein, 25 aa, Staphylococcus aureus
LEKQLPQHFIRISKSEIVNKYYIEN

SEQ ID NO: 1669911 - protein, 20 aa, Staphylococcus aureus
LEKVKRVINRAVPDALHEAL

SEQ ID NO: 1669912 - protein, 20 aa, Staphylococcus aureus
LEKVKRVINRAVPDAPHEAL

SEQ ID NO: 1669913 - protein, 29 aa, Staphylococcus aureus
LEKWYQIEYLKEMVTFVVVNRDKNSQNVD

SEQ ID NO: 1669914 - protein, 29 aa, Staphylococcus aureus
LEKWYQIEYLKEMVTLVVVNRDKNSQNVE

SEQ ID NO: 1669915 - protein, 19 aa, Staphylococcus aureus
LELAKKVIISHRYESEDRP

SEQ ID NO: 1669916 - protein, 17 aa, Staphylococcus aureus
LELIMKWCAQELKNNFQ

SEQ ID NO: 1669917 - protein, 17 aa, Staphylococcus aureus
LELTSLLGNISRLDNGH

SEQ ID NO: 1669918 - protein, 25 aa, Staphylococcus aureus
LEMFKKGLEHFGLEYKITYDKKKDR

SEQ ID NO: 1669919 - protein, 18 aa, Staphylococcus aureus
LEMINGLERIRISSIEAS

SEQ ID NO: 1669920 - protein, 17 aa, Staphylococcus aureus
LEMSKAGIINIEQQHNF

SEQ ID NO: 1669921 - protein, 18 aa, Staphylococcus aureus
LENLGICIFAESLGGTET

SEQ ID NO: 1669922 - protein, 20 aa, Staphylococcus aureus
LENLKIVLEEAGSDLNSVAK

SEQ ID NO: 1669923 - protein, 18 aa, Staphylococcus aureus
LENLKMFGAEKIFTEKQS

SEQ ID NO: 1669924 - protein, 18 aa, Staphylococcus aureus
LEPGQKAKIEVVFKNTGT

SEQ ID NO: 1669925 - protein, 19 aa, Staphylococcus aureus
LEPSMAFKIMESVRKGKGL

SEQ ID NO: 1669926 - protein, 24 aa, Staphylococcus aureus
LEQPLTVAGIFTFKPNEDDRDGEV

SEQ ID NO: 1669927 - protein, 24 aa, Staphylococcus aureus
LEQPVLYPGWNHFKANRLMKKIVF

SEQ ID NO: 1669928 - protein, 23 aa, Staphylococcus aureus
LERELEKRFGIKKMVKVQDKALI

SEQ ID NO: 1669929 - protein, 18 aa, Staphylococcus aureus
LERLRFVDEDILCIEYSY

SEQ ID NO: 1669930 - protein, 19 aa, Staphylococcus aureus
LERPVVRWLSDEEWEACGY

SEQ ID NO: 1669931 - protein, 25 aa, Staphylococcus aureus
LESINEVFEKQAGIFFDKNYPDQSL

SEQ ID NO: 1669932 - protein, 20 aa, Staphylococcus aureus
LESLTALTIAQSFNQLIEDE

SEQ ID NO: 1669933 - protein, 20 aa, Staphylococcus aureus
LESRGAVIEINRNTRTAKGN

SEQ ID NO: 1669934 - protein, 20 aa, Staphylococcus aureus
LESRGAVLEINRNTRTAKGH

SEQ ID NO: 1669935 - protein, 17 aa, Staphylococcus aureus
LETELFKDTLLEDSNLS

SEQ ID NO: 1669936 - protein, 19 aa, Staphylococcus aureus
LETELRAVINSMSQNEGKS

SEQ ID NO: 1669937 - protein, 18 aa, Staphylococcus aureus
LETGNGWFEKALEQAGKS

SEQ ID NO: 1669938 - protein, 21 aa, Staphylococcus aureus
LETIFHCYHQMMPCCNDVIED

SEQ ID NO: 1669939 - protein, 24 aa, Staphylococcus aureus
LETLARSKVDGIVLMATDITEKHI

SEQ ID NO: 1669940 - protein, 26 aa, Staphylococcus aureus
LETLTGQFAYWSAMGHHMYHSEVWLI

SEQ ID NO: 1669941 - protein, 27 aa, Staphylococcus aureus
LEVEAIQGFIYRRARAHQLDTPYLDTI

SEQ ID NO: 1669942 - protein, 25 aa, Staphylococcus aureus
LEVEAIQGFIYRRAREHDLDTPYLD

SEQ ID NO: 1669943 - protein, 20 aa, Staphylococcus aureus
LEVGPTLSTKCFEEEEFERA

SEQ ID NO: 1669944 - protein, 20 aa, Staphylococcus aureus
LEVIIAPKFTDKALNILKQK

SEQ ID NO: 1669945 - protein, 35 aa, Staphylococcus aureus
LEVKTLRILHFVSRDGGKLKIHYELYQDNEKMGSY

SEQ ID NO: 1669946 - protein, 22 aa, Staphylococcus aureus
LEVRKISNVFLYNKSKDKAKVF

SEQ ID NO: 1669947 - protein, 23 aa, Staphylococcus aureus
LEVTNLLQLRQKYFISVTTMKHN

SEQ ID NO: 1669948 - protein, 21 aa, Staphylococcus aureus
LEYAPCDELSMGMSNDYLIAV

SEQ ID NO: 1669949 - protein, 17 aa, Staphylococcus aureus
LEYLPFDLSCTYDSYQF

SEQ ID NO: 1669950 - protein, 25 aa, Staphylococcus aureus
LFALEEISFMLNRAMANEDRLTINE

SEQ ID NO: 1669951 - protein, 17 aa, Staphylococcus aureus
LFCRIFKYKFGMNNKVV

SEQ ID NO: 1669952 - protein, 18 aa, Staphylococcus aureus
LFCRIFKYKFGMNNKVVI

SEQ ID NO: 1669953 - protein, 18 aa, Staphylococcus aureus
LFDSNWMFDNGIPIDFTP

SEQ ID NO: 1669954 - protein, 17 aa, Staphylococcus aureus
LFEAVHKAKKFISMSIQ

SEQ ID NO: 1669955 - protein, 19 aa, Staphylococcus aureus
LFEIKRFDQQYGYVGVPTA

SEQ ID NO: 1669956 - protein, 20 aa, Staphylococcus aureus
LFEIKRFDQQYGYVGVPTAL

SEQ ID NO: 1669957 - protein, 17 aa, Staphylococcus aureus
LFESLSESESLDESESL

SEQ ID NO: 1669958 - protein, 17 aa, Staphylococcus aureus
LFESLSESESLSDPVSL

SEQ ID NO: 1669959 - protein, 19 aa, Staphylococcus aureus
LFESLSESESLSDPVSLVE

SEQ ID NO: 1669960 - protein, 18 aa, Staphylococcus aureus
LFGGPLYIFHKIFSIITL

SEQ ID NO: 1669961 - protein, 17 aa, Staphylococcus aureus
LFGLGIRHLGVKVSQVL

SEQ ID NO: 1669962 - protein, 19 aa, Staphylococcus aureus
LFIGYKFKTHRMIHKFKIN

SEQ ID NO: 1669963 - protein, 24 aa, Staphylococcus aureus
LFIVFSIHLIDILKKLSHDEIEAF

SEQ ID NO: 1669964 - protein, 25 aa, Staphylococcus aureus
LFKEKEKLAGWHIGLPDIVQLQYDF

SEQ ID NO: 1669965 - protein, 24 aa, Staphylococcus aureus
LFKIVSASLVKYFYRTPRIPRSLL

SEQ ID NO: 1669966 - protein, 21 aa, Staphylococcus aureus
LFKKLRNAFKEDLEPWTSCEF

SEQ ID NO: 1669967 - protein, 23 aa, Staphylococcus aureus
LFKRLKHKTSINVHPHLFRHTHA

SEQ ID NO: 1669968 - protein, 17 aa, Staphylococcus aureus
LFLRELMRVRKIADEEG

SEQ ID NO: 1669969 - protein, 18 aa, Staphylococcus aureus
LFMDGARLGYGLMSVQSD

SEQ ID NO: 1669970 - protein, 20 aa, Staphylococcus aureus
LFMNLRDLFKEEGLEPWTSC

SEQ ID NO: 1669971 - protein, 18 aa, Staphylococcus aureus
LFNEALRIIEHLDSTIEQ

SEQ ID NO: 1669972 - protein, 18 aa, Staphylococcus aureus
LFNEIAFVLDDFRNDDDY

SEQ ID NO: 1669973 - protein, 18 aa, Staphylococcus aureus
LFNQGLDLLQEIIWNPLI

SEQ ID NO: 1669974 - protein, 21 aa, Staphylococcus aureus
LFPGQEIRITDSILKGLDNGS

SEQ ID NO: 1669975 - protein, 20 aa, Staphylococcus aureus
LFPNAAIIFDRFHIVQHLNR

SEQ ID NO: 1669976 - protein, 19 aa, Staphylococcus aureus
LFQHFKEKYLEVISKIDDV

SEQ ID NO: 1669977 - protein, 20 aa, Staphylococcus aureus
LFRYIQMFIISNGVETRYFS

SEQ ID NO: 1669978 - protein, 21 aa, Staphylococcus aureus
LFRYIQMFIISNGVETRYFSN

SEQ ID NO: 1669979 - protein, 17 aa, Staphylococcus aureus
LFSAVKISGLFKKMHIR

SEQ ID NO: 1669980 - protein, 24 aa, Staphylococcus aureus
LFSAVKISGLFKKNACTNDAGTRA

SEQ ID NO: 1669981 - protein, 20 aa, Staphylococcus aureus
LFSGELDKAVAALIIANGAR

SEQ ID NO: 1669982 - protein, 21 aa, Staphylococcus aureus
LFSGSHLYVKNRDLAPKATNN

SEQ ID NO: 1669983 - protein, 20 aa, Staphylococcus aureus
LFTRLNYYLIDLFRQQNQLK

SEQ ID NO: 1669984 - protein, 17 aa, Staphylococcus aureus
LFYAEKHLSSLIDIDQN

SEQ ID NO: 1669985 - protein, 24 aa, Staphylococcus aureus
LFYAVNWASLRLVPKDERDALVTE

SEQ ID NO: 1669986 - protein, 17 aa, Staphylococcus aureus
LGACVLGLKAVDDIEDF

SEQ ID NO: 1669987 - protein, 17 aa, Staphylococcus aureus
LGADAIMLITTYYNKTN

SEQ ID NO: 1669988 - protein, 23 aa, Staphylococcus aureus
LGAPLSLSERVHYQMGLNHFIAA

SEQ ID NO: 1669989 - protein, 18 aa, Staphylococcus aureus
LGDIGCRFYTEDENTASI

SEQ ID NO: 1669990 - protein, 21 aa, Staphylococcus aureus
LGEAFGNYFFGGDHQIIPLIT

SEQ ID NO: 1669991 - protein, 20 aa, Staphylococcus aureus
LGEEGVLCLLSDSTNSLVPY

SEQ ID NO: 1669992 - protein, 25 aa, Staphylococcus aureus
LGEFKNYLGSIGRSFKEKFSKDMKD

SEQ ID NO: 1669993 - protein, 17 aa, Staphylococcus aureus
LGEGIEALGGLAVIIHE

SEQ ID NO: 1669994 - protein, 19 aa, Staphylococcus aureus
LGEKQGKKLFVYGGAEHPH

SEQ ID NO: 1669995 - protein, 33 aa, Staphylococcus aureus
LGELGRFGVGLPRVSDGQLLFQLNGISKLKETG

SEQ ID NO: 1669996 - protein, 18 aa, Staphylococcus aureus
LGFISIRQGESITEMQQP

SEQ ID NO: 1669997 - protein, 18 aa, Staphylococcus aureus
LGGILIHRTPILILDELL

SEQ ID NO: 1669998 - protein, 17 aa, Staphylococcus aureus
LGGILIHRTPILILDEP

SEQ ID NO: 1669999 - protein, 19 aa, Staphylococcus aureus
LGHVDFCFLELLKKGYNRD

SEQ ID NO: 1670000 - protein, 22 aa, Staphylococcus aureus
LGISSPDIFKVINLDKRYDVHT

SEQ ID NO: 1670001 - protein, 20 aa, Staphylococcus aureus
LGIYYSWAFHEIASAVTDEP

SEQ ID NO: 1670002 - protein, 17 aa, Staphylococcus aureus
LGKIPFFGICLGHQLFA

SEQ ID NO: 1670003 - protein, 17 aa, Staphylococcus aureus
LGLKAVDDIEDFSIISS

SEQ ID NO: 1670004 - protein, 17 aa, Staphylococcus aureus
LGLLPYFEADFIATASD

SEQ ID NO: 1670005 - protein, 20 aa, Staphylococcus aureus
LGLNITYLFEKPSVFKSLVS

SEQ ID NO: 1670006 - protein, 17 aa, Staphylococcus aureus
LGNDGVIHIGRVSSPTL

SEQ ID NO: 1670007 - protein, 19 aa, Staphylococcus aureus
LGNSLRRILLSSLPGAAVK

SEQ ID NO: 1670008 - protein, 19 aa, Staphylococcus aureus
LGNSLRRILLSSLSGAAVK

SEQ ID NO: 1670009 - protein, 33 aa, Staphylococcus aureus
LGNTKRFLDPKVFPELNSLVGHTLMVTDGTSLL

SEQ ID NO: 1670010 - protein, 25 aa, Staphylococcus aureus
LGPTAIRYAGLISRLKQLDLDAYDK

SEQ ID NO: 1670011 - protein, 19 aa, Staphylococcus aureus
LGQGLSCIAVRADIDALPI

SEQ ID NO: 1670012 - protein, 22 aa, Staphylococcus aureus
LGQNASFIFAVCEYLKVHENGY

SEQ ID NO: 1670013 - protein, 17 aa, Staphylococcus aureus
LGQRPGAGAVYLNIFHY

SEQ ID NO: 1670014 - protein, 19 aa, Staphylococcus aureus
LGRELKQNFELSTKEFLII

SEQ ID NO: 1670015 - protein, 19 aa, Staphylococcus aureus
LGSLFEQASQLFLDSVVMG

SEQ ID NO: 1670016 - protein, 25 aa, Staphylococcus aureus
LGSLFEQASQLFLDSVVMGLMTEMN

SEQ ID NO: 1670017 - protein, 23 aa, Staphylococcus aureus
LGSTYYTRGLIIATVDEWNSNAR

SEQ ID NO: 1670018 - protein, 23 aa, Staphylococcus aureus
LGSTYYTRGLIISTVDEWNSNAR

SEQ ID NO: 1670019 - protein, 17 aa, Staphylococcus aureus
LGTFNCGYHIAEDLLKL

SEQ ID NO: 1670020 - protein, 25 aa, Staphylococcus aureus
LGVQTGRDWWTTGFSKLETINNSER

SEQ ID NO: 1670021 - protein, 18 aa, Staphylococcus aureus
LGVRFTLSGLDRINNPYS

SEQ ID NO: 1670022 - protein, 19 aa, Staphylococcus aureus
LGYKAAGLDTSRKAILTAV

SEQ ID NO: 1670023 - protein, 17 aa, Staphylococcus aureus
LGYLKEIVILVSTATPK

SEQ ID NO: 1670024 - protein, 25 aa, Staphylococcus aureus
LGYTGCPIAGFKKNNIEKLLELDHV

SEQ ID NO: 1670025 - protein, 18 aa, Staphylococcus aureus
LHGAPGFEEEVKNYMIQQ

SEQ ID NO: 1670026 - protein, 18 aa, Staphylococcus aureus
LHGAPGFEEEVKNYVTQQ

SEQ ID NO: 1670027 - protein, 17 aa, Staphylococcus aureus
LHGIKATFKGSGDGPTI

SEQ ID NO: 1670028 - protein, 21 aa, Staphylococcus aureus
LHGMWQFPMFKSEHARREITE

SEQ ID NO: 1670029 - protein, 17 aa, Staphylococcus aureus
LHHKYNKKVMMAKFNNF

SEQ ID NO: 1670030 - protein, 19 aa, Staphylococcus aureus
LHKEVKIVNLYEELKMLYD

SEQ ID NO: 1670031 - protein, 21 aa, Staphylococcus aureus
LHKVETLRANWIQITGGPLSS

SEQ ID NO: 1670032 - protein, 17 aa, Staphylococcus aureus
LHMLPLFEEHYHLYAPS

SEQ ID NO: 1670033 - protein, 23 aa, Staphylococcus aureus
LHNRFIEKYGFEQLVNVKDLLSD

SEQ ID NO: 1670034 - protein, 18 aa, Staphylococcus aureus
LHNRGSFEGFKQAVSEEK

SEQ ID NO: 1670035 - protein, 20 aa, Staphylococcus aureus
LHPYGSWQEYWAFESRFIKL

SEQ ID NO: 1670036 - protein, 17 aa, Staphylococcus aureus
LHQYPELSFEEFQTHDY

SEQ ID NO: 1670037 - protein, 22 aa, Staphylococcus aureus
LHSKTSITFILKDVVIEEDNEI

SEQ ID NO: 1670038 - protein, 28 aa, Staphylococcus aureus
LHTMFVDKRLRGVKAVQTLSRLNRTMPG

SEQ ID NO: 1670039 - protein, 19 aa, Staphylococcus aureus
LIDHSKFNKVYFARVPLLE

SEQ ID NO: 1670040 - protein, 25 aa, Staphylococcus aureus
LIDPFCGSGTIAIEACLIAQNIAPG

SEQ ID NO: 1670041 - protein, 20 aa, Staphylococcus aureus
LIDPNGRLSTVGGVTKKNNK

SEQ ID NO: 1670042 - protein, 18 aa, Staphylococcus aureus
LIDVEIDVLLLVELLNDV

SEQ ID NO: 1670043 - protein, 25 aa, Staphylococcus aureus
LIDYGCHLLDLSLWLLGKDMVPHEV

SEQ ID NO: 1670044 - protein, 26 aa, Staphylococcus aureus
LIEIEETSALPGRKTGSLVGLSQIDS

SEQ ID NO: 1670045 - protein, 18 aa, Staphylococcus aureus
LIEIGCMSHNFDLVITSL

SEQ ID NO: 1670046 - protein, 23 aa, Staphylococcus aureus
LIFASARPIRYLLPVLPSVFHQH

SEQ ID NO: 1670047 - protein, 17 aa, Staphylococcus aureus
LIFEEANETFVISGGNF

SEQ ID NO: 1670048 - protein, 17 aa, Staphylococcus aureus
LIGCQKTGEAMIIDPIR

SEQ ID NO: 1670049 - protein, 19 aa, Staphylococcus aureus
LIGGRGRRANLYGLFNKSI

SEQ ID NO: 1670050 - protein, 17 aa, Staphylococcus aureus
LIIEAKHTFDYYAGLSF

SEQ ID NO: 1670051 - protein, 27 aa, Staphylococcus aureus
LIKANIPTRIAFMVSSSVDSRTILDSG

SEQ ID NO: 1670052 - protein, 18 aa, Staphylococcus aureus
LIKGHDWNIYPPKANEEF

SEQ ID NO: 1670053 - protein, 20 aa, Staphylococcus aureus
LIKHFGDIVVQHIDQTTLQH

SEQ ID NO: 1670054 - protein, 17 aa, Staphylococcus aureus
LIKYCFDEIDLNRIEIS

SEQ ID NO: 1670055 - protein, 17 aa, Staphylococcus aureus
LIKYCFEELDLNRIEIS

SEQ ID NO: 1670056 - protein, 24 aa, Staphylococcus aureus
LILFEKHFEPVPGIKMQHSGGHSF

SEQ ID NO: 1670057 - protein, 25 aa, Staphylococcus aureus
LIMMPRSIATYELYIAALKLGVAII

SEQ ID NO: 1670058 - protein, 17 aa, Staphylococcus aureus
LINLASWLQEHNIELKI

SEQ ID NO: 1670059 - protein, 25 aa, Staphylococcus aureus
LIPETRRSTILSSKKLGDKVHLETD

SEQ ID NO: 1670060 - protein, 19 aa, Staphylococcus aureus
LIPEYQHLNIFTVGRLDKD

SEQ ID NO: 1670061 - protein, 17 aa, Staphylococcus aureus
LIREPRIAEHIESITLM

SEQ ID NO: 1670062 - protein, 22 aa, Staphylococcus aureus
LIRFPESTLRPLGRTATGVKGI

SEQ ID NO: 1670063 - protein, 27 aa, Staphylococcus aureus
LISNPGCFPTETLLALHPLISEKIVDL

SEQ ID NO: 1670064 - protein, 17 aa, Staphylococcus aureus
LITAKNHLDDPVSTDGK

SEQ ID NO: 1670065 - protein, 20 aa, Staphylococcus aureus
LITFKSGERYNMVPDHAEAR

SEQ ID NO: 1670066 - protein, 24 aa, Staphylococcus aureus
LITKSGRYGGTFAQKDIAFEFASW

SEQ ID NO: 1670067 - protein, 18 aa, Staphylococcus aureus
LIVFESVYSMDGDIAPIV

SEQ ID NO: 1670068 - protein, 20 aa, Staphylococcus aureus
LIVHRDDIITEQDILAHINL

SEQ ID NO: 1670069 - protein, 18 aa, Staphylococcus aureus
LIWSRFTTAQIHLLLKTF

SEQ ID NO: 1670070 - protein, 24 aa, Staphylococcus aureus
LIYFEKDGKLGFYVQKTQKERGVG

SEQ ID NO: 1670071 - protein, 17 aa, Staphylococcus aureus
LIYVPACIIIYIFEIKK

SEQ ID NO: 1670072 - protein, 20 aa, Staphylococcus aureus
LKAHGETGVECGVEEDNVFI

SEQ ID NO: 1670073 - protein, 20 aa, Staphylococcus aureus
LKAHHPDVVVLNGGANQFFE

SEQ ID NO: 1670074 - protein, 17 aa, Staphylococcus aureus
LKAHIKNIHSFAKTTIE

SEQ ID NO: 1670075 - protein, 23 aa, Staphylococcus aureus
LKAISPRTTLPILTGIKIDAKEH

SEQ ID NO: 1670076 - protein, 18 aa, Staphylococcus aureus
LKAREKYGLEKVIADNYR

SEQ ID NO: 1670077 - protein, 18 aa, Staphylococcus aureus
LKAYCDRSYHMKDGVLNL

SEQ ID NO: 1670078 - protein, 17 aa, Staphylococcus aureus
LKCSRQTIYNVINAFKS

SEQ ID NO: 1670079 - protein, 17 aa, Staphylococcus aureus
LKDAIVLFDRSQYQAGW

SEQ ID NO: 1670080 - protein, 21 aa, Staphylococcus aureus
LKDELKTVFLGEVLGQSYLNT

SEQ ID NO: 1670081 - protein, 17 aa, Staphylococcus aureus
LKDFMFEGAVSENDYFE

SEQ ID NO: 1670082 - protein, 18 aa, Staphylococcus aureus
LKDHFTVVAVDRRDYGES

SEQ ID NO: 1670083 - protein, 19 aa, Staphylococcus aureus
LKDIDHIARNIILEKGYGE

SEQ ID NO: 1670084 - protein, 25 aa, Staphylococcus aureus
LKDLESRIAKALPNVDRYDIVSKSI

SEQ ID NO: 1670085 - protein, 19 aa, Staphylococcus aureus
LKEALKYYRRLKADDNQLE

SEQ ID NO: 1670086 - protein, 27 aa, Staphylococcus aureus
LKECNLYRLLREISMESVKCIESMNDV

SEQ ID NO: 1670087 - protein, 26 aa, Staphylococcus aureus
LKECNLYRLLREITMESVKCIEPMND

SEQ ID NO: 1670088 - protein, 27 aa, Staphylococcus aureus
LKECNLYRLLREITMESVKCIEPMNDV

SEQ ID NO: 1670089 - protein, 25 aa, Staphylococcus aureus
LKEDIYLDEAVGIMTGQVVYKYEED

SEQ ID NO: 1670090 - protein, 21 aa, Staphylococcus aureus
LKEDIYLDEAVGIMTSQVVYK

SEQ ID NO: 1670091 - protein, 25 aa, Staphylococcus aureus
LKEEIFKFSEFMQSLGKEVSVNDVH

SEQ ID NO: 1670092 - protein, 20 aa, Staphylococcus aureus
LKEGFKLIETSECVAEKYLN

SEQ ID NO: 1670093 - protein, 23 aa, Staphylococcus aureus
LKEGVKEAFQFDRKLVIEQGVNA

SEQ ID NO: 1670094 - protein, 21 aa, Staphylococcus aureus
LKEIFINECVAYETILLLDKN

SEQ ID NO: 1670095 - protein, 23 aa, Staphylococcus aureus
LKEIKDLVKAKENAKQDVDKQVQ

SEQ ID NO: 1670096 - protein, 18 aa, Staphylococcus aureus
LKEIRYTRDLFNKHLSMN

SEQ ID NO: 1670097 - protein, 27 aa, Staphylococcus aureus
LKEIYQFPLLLFYKGNIKLINNMHHLA

SEQ ID NO: 1670098 - protein, 19 aa, Staphylococcus aureus
LKELEGMNIISTHGSSKND

SEQ ID NO: 1670099 - protein, 21 aa, Staphylococcus aureus
LKENVDYLFGYPGGAVLPLYD

SEQ ID NO: 1670100 - protein, 22 aa, Staphylococcus aureus
LKENVTTVLGFISIRQGESITE

SEQ ID NO: 1670101 - protein, 23 aa, Staphylococcus aureus
LKETFGDLYFMGVDEKFKYEDGE

SEQ ID NO: 1670102 - protein, 21 aa, Staphylococcus aureus
LKETFGDLYFMGVDEKYKYED

SEQ ID NO: 1670103 - protein, 29 aa, Staphylococcus aureus
LKEVKESDGRIILFIDEIHMLVGAGKTDG

SEQ ID NO: 1670104 - protein, 21 aa, Staphylococcus aureus
LKEYRKYYEPLIRKNDKEFKE

SEQ ID NO: 1670105 - protein, 17 aa, Staphylococcus aureus
LKFEIVEQLHQTFPGLE

SEQ ID NO: 1670106 - protein, 18 aa, Staphylococcus aureus
LKFLFNFYTEEEISEELF

SEQ ID NO: 1670107 - protein, 19 aa, Staphylococcus aureus
LKFLSCLMSKVNGTYRFRP

SEQ ID NO: 1670108 - protein, 17 aa, Staphylococcus aureus
LKFMNANYMMRGRILTN

SEQ ID NO: 1670109 - protein, 22 aa, Staphylococcus aureus
LKFTGDPRVGYKDISKKVKSVL

SEQ ID NO: 1670110 - protein, 24 aa, Staphylococcus aureus
LKGKITGIKKFGAFVELPEGKSGL

SEQ ID NO: 1670111 - protein, 19 aa, Staphylococcus aureus
LKGKTVIVRADFNVPLKDG

SEQ ID NO: 1670112 - protein, 18 aa, Staphylococcus aureus
LKGLKPSTVTGRISTLDV

SEQ ID NO: 1670113 - protein, 17 aa, Staphylococcus aureus
LKIRYIEQFGLSNSLKR

SEQ ID NO: 1670114 - protein, 18 aa, Staphylococcus aureus
LKIVEKITKKERTTQNKE

SEQ ID NO: 1670115 - protein, 17 aa, Staphylococcus aureus
LKIWGHLFQYIKSEHIE

SEQ ID NO: 1670116 - protein, 21 aa, Staphylococcus aureus
LKKAKCIIVDLNLGKEALNFL

SEQ ID NO: 1670117 - protein, 20 aa, Staphylococcus aureus
LKKDVIDKILYFEKQMSQAA

SEQ ID NO: 1670118 - protein, 28 aa, Staphylococcus aureus
LKKEAPYLKCGYIIPLQFGHFKETSLDF

SEQ ID NO: 1670119 - protein, 23 aa, Staphylococcus aureus
LKKEVLKKVGLDLDIKRIVSSIS

SEQ ID NO: 1670120 - protein, 21 aa, Staphylococcus aureus
LKKGFIPYEISIELNPNPEIE

SEQ ID NO: 1670121 - protein, 24 aa, Staphylococcus aureus
LKKIKHPYLKKSFLEIVETLKNDP

SEQ ID NO: 1670122 - protein, 20 aa, Staphylococcus aureus
LKKIRMHITQGIMSGEGYSK

SEQ ID NO: 1670123 - protein, 29 aa, Staphylococcus aureus
LKKKGKIAMESWGVWRVIESQLHLSVVER

SEQ ID NO: 1670124 - protein, 22 aa, Staphylococcus aureus
LKKKLVDKVKSWFEDFGGGGDG

SEQ ID NO: 1670125 - protein, 27 aa, Staphylococcus aureus
LKKKVDFYRYTLGYLFQNFALLDNQTI

SEQ ID NO: 1670126 - protein, 24 aa, Staphylococcus aureus
LKKLKAFLPYNYEIVSSIFDNFSE

SEQ ID NO: 1670127 - protein, 20 aa, Staphylococcus aureus
LKKQRVIEAKSTLTQEQLID

SEQ ID NO: 1670128 - protein, 17 aa, Staphylococcus aureus
LKKSYRNEYFYKNTILN

SEQ ID NO: 1670129 - protein, 17 aa, Staphylococcus aureus
LKLADRPLDEVALAKLI

SEQ ID NO: 1670130 - protein, 30 aa, Staphylococcus aureus
LKLAFKETFFGKEIQGILDLDSELMQVIDS

SEQ ID NO: 1670131 - protein, 29 aa, Staphylococcus aureus
LKLEHALKIELDFYFPLLKSWSKKKKSEM

SEQ ID NO: 1670132 - protein, 21 aa, Staphylococcus aureus
LKLLKSVHLVKAKRQGQSMIY

SEQ ID NO: 1670133 - protein, 21 aa, Staphylococcus aureus
LKLLSAPSLDYGLIGFVSHDY

SEQ ID NO: 1670134 - protein, 22 aa, Staphylococcus aureus
LKLPEHHSFIISYNGSKTINMT

SEQ ID NO: 1670135 - protein, 17 aa, Staphylococcus aureus
LKLQFFAEESDEDNGEL

SEQ ID NO: 1670136 - protein, 17 aa, Staphylococcus aureus
LKLSNNQSFEYIASEGG

SEQ ID NO: 1670137 - protein, 19 aa, Staphylococcus aureus
LKLSNNQSFEYIASEGGHL

SEQ ID NO: 1670138 - protein, 19 aa, Staphylococcus aureus
LKLTRWKNDGLAGFTASSV

SEQ ID NO: 1670139 - protein, 19 aa, Staphylococcus aureus
LKNEISRRFIDIEQRNHIS

SEQ ID NO: 1670140 - protein, 26 aa, Staphylococcus aureus
LKNGEGHSMSGFLISGTQAIILSELN

SEQ ID NO: 1670141 - protein, 18 aa, Staphylococcus aureus
LKNGHIMIQSFSDESLKK

SEQ ID NO: 1670142 - protein, 18 aa, Staphylococcus aureus
LKNGHVMIQSFSDESLKK

SEQ ID NO: 1670143 - protein, 17 aa, Staphylococcus aureus
LKNGRKFLTKGDKCKVS

SEQ ID NO: 1670144 - protein, 17 aa, Staphylococcus aureus
LKNKEVKSVEHVRRDHN

SEQ ID NO: 1670145 - protein, 18 aa, Staphylococcus aureus
LKNLDEFLNNLKIASPIL

SEQ ID NO: 1670146 - protein, 19 aa, Staphylococcus aureus
LKNLDEFLNNLKIASPILE

SEQ ID NO: 1670147 - protein, 22 aa, Staphylococcus aureus
LKNLWLIAWEMTYESQLKQKIK

SEQ ID NO: 1670148 - protein, 24 aa, Staphylococcus aureus
LKNRARLCLEVMRAVQEVIDKEAS

SEQ ID NO: 1670149 - protein, 17 aa, Staphylococcus aureus
LKNSGFLNGVYASNTIY

SEQ ID NO: 1670150 - protein, 26 aa, Staphylococcus aureus
LKNVDGFKALRFLRPRTAGRHYIIIT

SEQ ID NO: 1670151 - protein, 19 aa, Staphylococcus aureus
LKNVDGFKSLRFLRPRTAG

SEQ ID NO: 1670152 - protein, 17 aa, Staphylococcus aureus
LKNYKVDVQDTWKNGLY

SEQ ID NO: 1670153 - protein, 25 aa, Staphylococcus aureus
LKPALRLSSIMGLNARFIFTHDSIA

SEQ ID NO: 1670154 - protein, 20 aa, Staphylococcus aureus
LKPPLIDAFDYIPNIFHTYI

SEQ ID NO: 1670155 - protein, 23 aa, Staphylococcus aureus
LKPYLPELMKMHKLIYPAGDGRI

SEQ ID NO: 1670156 - protein, 23 aa, Staphylococcus aureus
LKQHNIHVIPLSLTIDGKSYTDQ

SEQ ID NO: 1670157 - protein, 24 aa, Staphylococcus aureus
LKQKIKCPCCDSTLTNMTIRKKHT

SEQ ID NO: 1670158 - protein, 25 aa, Staphylococcus aureus
LKQKIKCPCCNATLTNMTVRKKNHI

SEQ ID NO: 1670159 - protein, 25 aa, Staphylococcus aureus
LKQKIKCPCCNATLTNMTVRKKNHT

SEQ ID NO: 1670160 - protein, 25 aa, Staphylococcus aureus
LKQKIKCPYCHSTLTNMTVRKPDHS

SEQ ID NO: 1670161 - protein, 17 aa, Staphylococcus aureus
LKQQRIVLNEQIDAQEA

SEQ ID NO: 1670162 - protein, 17 aa, Staphylococcus aureus
LKQTLKTMFIRMKETVH

SEQ ID NO: 1670163 - protein, 17 aa, Staphylococcus aureus
LKQTYTICVNNYRAVGG

SEQ ID NO: 1670164 - protein, 20 aa, Staphylococcus aureus
LKRDFDIPISERLREELIHS

SEQ ID NO: 1670165 - protein, 32 aa, Staphylococcus aureus
LKRFVEAYRLLAKIILRLKAFDEFEFTIDEIG

SEQ ID NO: 1670166 - protein, 30 aa, Staphylococcus aureus
LKRGQRQMELIKILFQKAQEVDSIDKLDNV

SEQ ID NO: 1670167 - protein, 31 aa, Staphylococcus aureus
LKRGQRQMELIKILFQKAQEVDSIDKLDNVI

SEQ ID NO: 1670168 - protein, 20 aa, Staphylococcus aureus
LKRSVGAFMHALKRRAFANK

SEQ ID NO: 1670169 - protein, 19 aa, Staphylococcus aureus
LKRTICAITKAPYTKSDIG

SEQ ID NO: 1670170 - protein, 20 aa, Staphylococcus aureus
LKSHILKDNFGRFKPVIKGG

SEQ ID NO: 1670171 - protein, 23 aa, Staphylococcus aureus
LKSHIPKENFGRFKPVIKGGTIT

SEQ ID NO: 1670172 - protein, 23 aa, Staphylococcus aureus
LKSHIPKENFGRFKPVIKGGTVT

SEQ ID NO: 1670173 - protein, 19 aa, Staphylococcus aureus
LKSIEQVRAFEKQQLESKK

SEQ ID NO: 1670174 - protein, 26 aa, Staphylococcus aureus
LKSPNLYPGIECKLLAFLEKKKVDAT

SEQ ID NO: 1670175 - protein, 19 aa, Staphylococcus aureus
LKSRHDIHQLLNIMKSKCL

SEQ ID NO: 1670176 - protein, 20 aa, Staphylococcus aureus
LKSTGRMVGIISHVSELKNR

SEQ ID NO: 1670177 - protein, 23 aa, Staphylococcus aureus
LKTDVMLAAYGYHMMDVQIVNEV

SEQ ID NO: 1670178 - protein, 17 aa, Staphylococcus aureus
LKTFFRVLKDEISQTEI

SEQ ID NO: 1670179 - protein, 17 aa, Staphylococcus aureus
LKTFPIRFKQSVENAQK

SEQ ID NO: 1670180 - protein, 21 aa, Staphylococcus aureus
LKTFYGAFCSAINIIKENNPQ

SEQ ID NO: 1670181 - protein, 25 aa, Staphylococcus aureus
LKTHDLDAAYHCYIEQLGFQHVSDF

SEQ ID NO: 1670182 - protein, 24 aa, Staphylococcus aureus
LKTIKDLIVVFLLNKYNYIKNKDD

SEQ ID NO: 1670183 - protein, 23 aa, Staphylococcus aureus
LKTKEVQKILSHRAKGIKMYIFV

SEQ ID NO: 1670184 - protein, 25 aa, Staphylococcus aureus
LKTKLWGGQRLSVFGYQLDNDTTGE

SEQ ID NO: 1670185 - protein, 19 aa, Staphylococcus aureus
LKVKISRITIGYTRDRKPV

SEQ ID NO: 1670186 - protein, 21 aa, Staphylococcus aureus
LKVKYSIKLLLKVLNIPKSTY

SEQ ID NO: 1670187 - protein, 18 aa, Staphylococcus aureus
LKVQHLEQLRAIYDEHNL

SEQ ID NO: 1670188 - protein, 18 aa, Staphylococcus aureus
LKVRRRIEAIFKSENLTT

SEQ ID NO: 1670189 - protein, 20 aa, Staphylococcus aureus
LKVVDGLIIQAARLRVMLDY

SEQ ID NO: 1670190 - protein, 20 aa, Staphylococcus aureus
LKYEKAWELLDLPEEIKQYG

SEQ ID NO: 1670191 - protein, 20 aa, Staphylococcus aureus
LKYEKAWELLDLPEKVKQYG

SEQ ID NO: 1670192 - protein, 19 aa, Staphylococcus aureus
LLADKAKSVGADIVLITTN

SEQ ID NO: 1670193 - protein, 25 aa, Staphylococcus aureus
LLALESQHAGLSWLTILKKKEAYEE

SEQ ID NO: 1670194 - protein, 24 aa, Staphylococcus aureus
LLAQPRVLICDEITSNLDVIAEQN

SEQ ID NO: 1670195 - protein, 17 aa, Staphylococcus aureus
LLDDLTEEFGIEFDDSE

SEQ ID NO: 1670196 - protein, 18 aa, Staphylococcus aureus
LLDKINIANVEGLENKLQ

SEQ ID NO: 1670197 - protein, 20 aa, Staphylococcus aureus
LLDKWEMSSSELMAFGDANN

SEQ ID NO: 1670198 - protein, 19 aa, Staphylococcus aureus
LLDVLKRDFDIPISERLRE

SEQ ID NO: 1670199 - protein, 25 aa, Staphylococcus aureus
LLEESIFTGFLLKFIPEKQRNYIDI

SEQ ID NO: 1670200 - protein, 26 aa, Staphylococcus aureus
LLEGMKELFRQAGGIPRKIRIDNMST

SEQ ID NO: 1670201 - protein, 20 aa, Staphylococcus aureus
LLEKEIQAIEIIKDKNNENF

SEQ ID NO: 1670202 - protein, 19 aa, Staphylococcus aureus
LLELTSLLGNISRLDNGHF

SEQ ID NO: 1670203 - protein, 18 aa, Staphylococcus aureus
LLENLGAERICKRVDCDI

SEQ ID NO: 1670204 - protein, 18 aa, Staphylococcus aureus
LLEYLPFDLTCTYYSYQF

SEQ ID NO: 1670205 - protein, 27 aa, Staphylococcus aureus
LLFGTIDTWLVWKLSGKAAHITDYSNA

SEQ ID NO: 1670206 - protein, 18 aa, Staphylococcus aureus
LLFNEALRIIEHLDSTIE

SEQ ID NO: 1670207 - protein, 26 aa, Staphylococcus aureus
LLFYDIEVFKHNAFVVFKDINKNEVG

SEQ ID NO: 1670208 - protein, 17 aa, Staphylococcus aureus
LLFYKGNIKLIKIICII

SEQ ID NO: 1670209 - protein, 17 aa, Staphylococcus aureus
LLGSGLDEFSMSATSIL

SEQ ID NO: 1670210 - protein, 20 aa, Staphylococcus aureus
LLHETFKANGVLFIDAQFEP

SEQ ID NO: 1670211 - protein, 19 aa, Staphylococcus aureus
LLHGSEYYVDGVIGNLLLI

SEQ ID NO: 1670212 - protein, 17 aa, Staphylococcus aureus
LLHNSIRMMWLAQDQTP

SEQ ID NO: 1670213 - protein, 25 aa, Staphylococcus aureus
LLITLAKLSAHYGLGLKSSIDITNT

SEQ ID NO: 1670214 - protein, 19 aa, Staphylococcus aureus
LLITMAVVTWKVWKIERNT

SEQ ID NO: 1670215 - protein, 17 aa, Staphylococcus aureus
LLKEAKKPVVLAGAGIK

SEQ ID NO: 1670216 - protein, 20 aa, Staphylococcus aureus
LLKNKDWDYLLNYDLDAEQV

SEQ ID NO: 1670217 - protein, 19 aa, Staphylococcus aureus
LLKSLGIPYVREDRKVNKA

SEQ ID NO: 1670218 - protein, 18 aa, Staphylococcus aureus
LLKTFRLENELKVFPSHF

SEQ ID NO: 1670219 - protein, 17 aa, Staphylococcus aureus
LLLMLAWDKGHLLDYKV

SEQ ID NO: 1670220 - protein, 17 aa, Staphylococcus aureus
LLLVGSGAYPMTLIQVA

SEQ ID NO: 1670221 - protein, 27 aa, Staphylococcus aureus
LLLVPETLRIIALISIVDACTPTLSNF

SEQ ID NO: 1670222 - protein, 23 aa, Staphylococcus aureus
LLNEIKYSGVINRKIKSKDIGIV

SEQ ID NO: 1670223 - protein, 26 aa, Staphylococcus aureus
LLNLKGKNLYLIDGIKISELEDELVD

SEQ ID NO: 1670224 - protein, 18 aa, Staphylococcus aureus
LLNMPFGVCHFAVAAKPE

SEQ ID NO: 1670225 - protein, 21 aa, Staphylococcus aureus
LLNNDIFRSGKFNTNFLEQNS

SEQ ID NO: 1670226 - protein, 22 aa, Staphylococcus aureus
LLNVCRIDYAGEFALYKEGITK

SEQ ID NO: 1670227 - protein, 19 aa, Staphylococcus aureus
LLNYILEAFGIDFNSLTKG

SEQ ID NO: 1670228 - protein, 17 aa, Staphylococcus aureus
LLPEHRISVNTQSLSIN

SEQ ID NO: 1670229 - protein, 19 aa, Staphylococcus aureus
LLPNTSWLKDAVELNERGE

SEQ ID NO: 1670230 - protein, 20 aa, Staphylococcus aureus
LLPNTSWVKYAVELNERGEI

SEQ ID NO: 1670231 - protein, 25 aa, Staphylococcus aureus
LLQLNCIGFSLAEMPVDFSFVDTTA

SEQ ID NO: 1670232 - protein, 21 aa, Staphylococcus aureus
LLQQLPDIWCQGIIDQYTKSS

SEQ ID NO: 1670233 - protein, 19 aa, Staphylococcus aureus
LLSKLLVRATKKWPTDKSF

SEQ ID NO: 1670234 - protein, 29 aa, Staphylococcus aureus
LLTKEIEGFGELFRYLSYVEDVGTRALLS

SEQ ID NO: 1670235 - protein, 25 aa, Staphylococcus aureus
LLTKSGEVWAYYRIRSESISTANYD

SEQ ID NO: 1670236 - protein, 17 aa, Staphylococcus aureus
LLYKLPDIKKWADEVEK

SEQ ID NO: 1670237 - protein, 26 aa, Staphylococcus aureus
LMASGLPSYVYTFLGFLPRKEKEKSD

SEQ ID NO: 1670238 - protein, 19 aa, Staphylococcus aureus
LMAVRIAYFKVHHPLYYYA

SEQ ID NO: 1670239 - protein, 29 aa, Staphylococcus aureus
LMEFQKFIVGSLYGWRRGQYRMFTKAYIS

SEQ ID NO: 1670240 - protein, 17 aa, Staphylococcus aureus
LMERMVWTRILDQRSIS

SEQ ID NO: 1670241 - protein, 18 aa, Staphylococcus aureus
LMERMVWTRILDQRSISL

SEQ ID NO: 1670242 - protein, 17 aa, Staphylococcus aureus
LMHALGIDFSEIEAELA

SEQ ID NO: 1670243 - protein, 20 aa, Staphylococcus aureus
LMIEYLRFANCTQELIIEKY

SEQ ID NO: 1670244 - protein, 23 aa, Staphylococcus aureus
LMLSTSKMEGFGLAILESLSVGT

SEQ ID NO: 1670245 - protein, 25 aa, Staphylococcus aureus
LMNEKDIRSVLGRFLFVQDDVKKII

SEQ ID NO: 1670246 - protein, 17 aa, Staphylococcus aureus
LMPDANIAVAHGQMTER

SEQ ID NO: 1670247 - protein, 25 aa, Staphylococcus aureus
LMPSGLPIHEWLMLKQFSQYKSAPS

SEQ ID NO: 1670248 - protein, 20 aa, Staphylococcus aureus
LMQLSKRLLIIPNINNQRSA

SEQ ID NO: 1670249 - protein, 18 aa, Staphylococcus aureus
LMQSIGINLWGRELYEGD

SEQ ID NO: 1670250 - protein, 24 aa, Staphylococcus aureus
LMSGGTLILQCYFNGEELNDMIAQ

SEQ ID NO: 1670251 - protein, 17 aa, Staphylococcus aureus
LMSLFSFFQDPELEVKK

SEQ ID NO: 1670252 - protein, 24 aa, Staphylococcus aureus
LMSRARRYPLPLVLEISNIESVIP

SEQ ID NO: 1670253 - protein, 24 aa, Staphylococcus aureus
LMSRVRRYPLPLVLEISNIESVIP

SEQ ID NO: 1670254 - protein, 19 aa, Staphylococcus aureus
LMVNYCLQAVDILAADGIN

SEQ ID NO: 1670255 - protein, 17 aa, Staphylococcus aureus
LMYRSGDIVCLLPDGNI

SEQ ID NO: 1670256 - protein, 22 aa, Staphylococcus aureus
LNANLKSIEQVRAFEKQQIESK

SEQ ID NO: 1670257 - protein, 17 aa, Staphylococcus aureus
LNASGGFELVNYTTGDI

SEQ ID NO: 1670258 - protein, 25 aa, Staphylococcus aureus
LNCIGVSLAEMPVDFSFVDTTARQI

SEQ ID NO: 1670259 - protein, 36 aa, Staphylococcus aureus
LNDTIASMIIEFAEWVNTLEFFKNWKKQPGKPLDTQ

SEQ ID NO: 1670260 - protein, 30 aa, Staphylococcus aureus
LNEKVINMFSFFIGYHFNKLDIGIERIFIQ

SEQ ID NO: 1670261 - protein, 24 aa, Staphylococcus aureus
LNGEYGREVLKMYADNKTINSDKL

SEQ ID NO: 1670262 - protein, 20 aa, Staphylococcus aureus
LNGKIFKVKDMIPGVNAPPM

SEQ ID NO: 1670263 - protein, 24 aa, Staphylococcus aureus
LNGLKKWLTSVEMWQNHQMTLRVG

SEQ ID NO: 1670264 - protein, 26 aa, Staphylococcus aureus
LNGPKARLKLLVALSNNLDKTEIKSY

SEQ ID NO: 1670265 - protein, 17 aa, Staphylococcus aureus
LNHRERLWLKLYLEGYK

SEQ ID NO: 1670266 - protein, 17 aa, Staphylococcus aureus
LNHVRYSVLALGDQTYE

SEQ ID NO: 1670267 - protein, 17 aa, Staphylococcus aureus
LNIATYIFRHREETRQF

SEQ ID NO: 1670268 - protein, 17 aa, Staphylococcus aureus
LNINVLVVIEMANKHPR

SEQ ID NO: 1670269 - protein, 18 aa, Staphylococcus aureus
LNIPPKVFEQYFPDVSKD

SEQ ID NO: 1670270 - protein, 18 aa, Staphylococcus aureus
LNIVRKLVDQFIFKEYFK

SEQ ID NO: 1670271 - protein, 24 aa, Staphylococcus aureus
LNKASRAINRAVQLDDAMGAVQQY

SEQ ID NO: 1670272 - protein, 24 aa, Staphylococcus aureus
LNKLLENQQILALESNKKIQKLEH

SEQ ID NO: 1670273 - protein, 23 aa, Staphylococcus aureus
LNKLLENQQILSLENNKKIQKLE

SEQ ID NO: 1670274 - protein, 18 aa, Staphylococcus aureus
LNKVLKKRHEPFNKEDGL

SEQ ID NO: 1670275 - protein, 30 aa, Staphylococcus aureus
LNLEFKYLFLKLIVKEDWSLSNLFNTGAVK

SEQ ID NO: 1670276 - protein, 30 aa, Staphylococcus aureus
LNLEFKYLFLKLIVKEDWSLSNVFNTGAVK

SEQ ID NO: 1670277 - protein, 29 aa, Staphylococcus aureus
LNLEHALKIELDFYFPLLKSWSKKKKIEM

SEQ ID NO: 1670278 - protein, 29 aa, Staphylococcus aureus
LNLEHALKIELDFYFPLLKSWSKKKKNEM

SEQ ID NO: 1670279 - protein, 29 aa, Staphylococcus aureus
LNLENALKIELEFYFPLLKSWSKKKKNEM

SEQ ID NO: 1670280 - protein, 29 aa, Staphylococcus aureus
LNLENALKIELEFYFPLLKSWSKKKKSEM

SEQ ID NO: 1670281 - protein, 17 aa, Staphylococcus aureus
LNLKELDTLVVLTKEQK

SEQ ID NO: 1670282 - protein, 21 aa, Staphylococcus aureus
LNLKFQCGKSYALIGKSGCGK

SEQ ID NO: 1670283 - protein, 19 aa, Staphylococcus aureus
LNLKFQCGKSYTLIGKSGC

SEQ ID NO: 1670284 - protein, 22 aa, Staphylococcus aureus
LNLKNGFYLNEFLKEVNQHKID

SEQ ID NO: 1670285 - protein, 19 aa, Staphylococcus aureus
LNLLITMLYEKRIIDGLKE

SEQ ID NO: 1670286 - protein, 18 aa, Staphylococcus aureus
LNLPEYLFDAQFEAWQYG

SEQ ID NO: 1670287 - protein, 19 aa, Staphylococcus aureus
LNNFIYFFSSSKEIKNYSV

SEQ ID NO: 1670288 - protein, 19 aa, Staphylococcus aureus
LNNFLYFFSSSKEIKNYSV

SEQ ID NO: 1670289 - protein, 19 aa, Staphylococcus aureus
LNNLFKDIAHWEVSSGGYF

SEQ ID NO: 1670290 - protein, 18 aa, Staphylococcus aureus
LNNLMSVCHACHNKIHAN

SEQ ID NO: 1670291 - protein, 25 aa, Staphylococcus aureus
LNNQASDFLKFRGLVDQYKEIELNK

SEQ ID NO: 1670292 - protein, 17 aa, Staphylococcus aureus
LNPKFLNVLSLIQYIQA

SEQ ID NO: 1670293 - protein, 23 aa, Staphylococcus aureus
LNPLLELEGAFNVIKDFNDFKNL

SEQ ID NO: 1670294 - protein, 19 aa, Staphylococcus aureus
LNQEIIDYIDTLKYIDQYS

SEQ ID NO: 1670295 - protein, 27 aa, Staphylococcus aureus
LNQGSPKCIVFGCYENETLIATAALEQ

SEQ ID NO: 1670296 - protein, 18 aa, Staphylococcus aureus
LNQYPVVPMNFKERYDYM

SEQ ID NO: 1670297 - protein, 33 aa, Staphylococcus aureus
LNRGLNLGLDDIRNTHVWEVDEQPAVNEIFEAT

SEQ ID NO: 1670298 - protein, 19 aa, Staphylococcus aureus
LNRHFSFSRTNGFSFKVKL

SEQ ID NO: 1670299 - protein, 20 aa, Staphylococcus aureus
LNRVKKLYVDEDYYYTYNEL

SEQ ID NO: 1670300 - protein, 17 aa, Staphylococcus aureus
LNSAMTALKAAIADKER

SEQ ID NO: 1670301 - protein, 18 aa, Staphylococcus aureus
LNSAMTALKAAIADKERT

SEQ ID NO: 1670302 - protein, 25 aa, Staphylococcus aureus
LNSANWVFKKLDAITTKENEVKELA

SEQ ID NO: 1670303 - protein, 17 aa, Staphylococcus aureus
LNSLRFGELDNKQNQRL

SEQ ID NO: 1670304 - protein, 18 aa, Staphylococcus aureus
LNSYSLVGCMCQPAFEFK

SEQ ID NO: 1670305 - protein, 22 aa, Staphylococcus aureus
LNTAMKGLRDSIANEATIKAGQ

SEQ ID NO: 1670306 - protein, 23 aa, Staphylococcus aureus
LNTARQGLTLDRQPALTTLHGAS

SEQ ID NO: 1670307 - protein, 18 aa, Staphylococcus aureus
LNTFALFNINLSWIESRP

SEQ ID NO: 1670308 - protein, 19 aa, Staphylococcus aureus
LNTFFKAYLQQKGFNPALM

SEQ ID NO: 1670309 - protein, 23 aa, Staphylococcus aureus
LNTTFYRKFIKWYGSNHSTETVR

SEQ ID NO: 1670310 - protein, 18 aa, Staphylococcus aureus
LNVPFAIADATSLTEAGY

SEQ ID NO: 1670311 - protein, 21 aa, Staphylococcus aureus
LNVSFDYIDWIKLGLGPLARE

SEQ ID NO: 1670312 - protein, 17 aa, Staphylococcus aureus
LNVSFDYIDWINTEFDQ

SEQ ID NO: 1670313 - protein, 17 aa, Staphylococcus aureus
LNVSFDYIDWVNSEFGP

SEQ ID NO: 1670314 - protein, 18 aa, Staphylococcus aureus
LNVYKQFFGDAVDMTEGA

SEQ ID NO: 1670315 - protein, 17 aa, Staphylococcus aureus
LNYEGIEFDYLELLNYF

SEQ ID NO: 1670316 - protein, 19 aa, Staphylococcus aureus
LNYFKLKKFIVGLESKTAI

SEQ ID NO: 1670317 - protein, 19 aa, Staphylococcus aureus
LPDAILCISDEEAIGIMHS

SEQ ID NO: 1670318 - protein, 22 aa, Staphylococcus aureus
LPDHNWGNYKLVFNTRNGANLQ

SEQ ID NO: 1670319 - protein, 18 aa, Staphylococcus aureus
LPEGSIIGTSSLRRGAQI

SEQ ID NO: 1670320 - protein, 17 aa, Staphylococcus aureus
LPEILGISLEERVKEYY

SEQ ID NO: 1670321 - protein, 19 aa, Staphylococcus aureus
LPEKLHKIIWRYDMTNKSE

SEQ ID NO: 1670322 - protein, 21 aa, Staphylococcus aureus
LPEKYTEVFKTYKNGTPEEKA

SEQ ID NO: 1670323 - protein, 22 aa, Staphylococcus aureus
LPENFSQVFRPKAFKYSNGEIV

SEQ ID NO: 1670324 - protein, 28 aa, Staphylococcus aureus
LPENNKVLVFFVRYGGEFQLKQGFSPAF

SEQ ID NO: 1670325 - protein, 24 aa, Staphylococcus aureus
LPFKQRVSLELSNNFEASLSGWSA

SEQ ID NO: 1670326 - protein, 17 aa, Staphylococcus aureus
LPIKNIQKIFPIAGGYV

SEQ ID NO: 1670327 - protein, 27 aa, Staphylococcus aureus
LPILCIEMRSDIPLARGLGSSASALVG

SEQ ID NO: 1670328 - protein, 22 aa, Staphylococcus aureus
LPKNFSQVFRPKAFKYSNGEIV

SEQ ID NO: 1670329 - protein, 18 aa, Staphylococcus aureus
LPLATGLVAELGQGLSCI

SEQ ID NO: 1670330 - protein, 18 aa, Staphylococcus aureus
LPLINRFIGLTGTSSPNS

SEQ ID NO: 1670331 - protein, 18 aa, Staphylococcus aureus
LPLREKRKARKAIESFVA

SEQ ID NO: 1670332 - protein, 17 aa, Staphylococcus aureus
LPLTIVIIGESLDTNHI

SEQ ID NO: 1670333 - protein, 33 aa, Staphylococcus aureus
LPNKEFQLLFMLATRPKQIFTREQIIEKIWGYD

SEQ ID NO: 1670334 - protein, 20 aa, Staphylococcus aureus
LPNRRNVVLTSDTSFNVEGV

SEQ ID NO: 1670335 - protein, 24 aa, Staphylococcus aureus
LPNRTKLLGVGLWFVPKPVRNFGY

SEQ ID NO: 1670336 - protein, 22 aa, Staphylococcus aureus
LPPFFYPLNELISIGQMIKNAG

SEQ ID NO: 1670337 - protein, 21 aa, Staphylococcus aureus
LPQFTPEIFMKVSAKNVMKQK

SEQ ID NO: 1670338 - protein, 18 aa, Staphylococcus aureus
LPQQNQYQYVPPQQQAPT

SEQ ID NO: 1670339 - protein, 19 aa, Staphylococcus aureus
LPQVDSFVNLMASFVERPK

SEQ ID NO: 1670340 - protein, 18 aa, Staphylococcus aureus
LPSIFAIMEDVLKLPRAV

SEQ ID NO: 1670341 - protein, 26 aa, Staphylococcus aureus
LPSSELARPLLLAALSKANEVVKIDL

SEQ ID NO: 1670342 - protein, 18 aa, Staphylococcus aureus
LPTTQAIMILTDLNTGEH

SEQ ID NO: 1670343 - protein, 28 aa, Staphylococcus aureus
LPYAELALGAGMAFLIRRFTKKDQQTEE

SEQ ID NO: 1670344 - protein, 23 aa, Staphylococcus aureus
LQDDHVWVGYTWEGQRYYLPIRT

SEQ ID NO: 1670345 - protein, 19 aa, Staphylococcus aureus
LQDIFKLLNHRERLWLKLY

SEQ ID NO: 1670346 - protein, 17 aa, Staphylococcus aureus
LQDIFKLLNQRERQWLK

SEQ ID NO: 1670347 - protein, 24 aa, Staphylococcus aureus
LQDSYIRALRWSTDRIGDTGIIGF

SEQ ID NO: 1670348 - protein, 18 aa, Staphylococcus aureus
LQEAIDYCRYDVDTTIEI

SEQ ID NO: 1670349 - protein, 18 aa, Staphylococcus aureus
LQEDFKGDIALVNEDVEN

SEQ ID NO: 1670350 - protein, 17 aa, Staphylococcus aureus
LQEHYQFHLAISGHEGI

SEQ ID NO: 1670351 - protein, 18 aa, Staphylococcus aureus
LQEYKVMGKIDFQLTPMN

SEQ ID NO: 1670352 - protein, 18 aa, Staphylococcus aureus
LQGFNTKILYHNRSRHND

SEQ ID NO: 1670353 - protein, 17 aa, Staphylococcus aureus
LQGLYAYNIPFDNKTKI

SEQ ID NO: 1670354 - protein, 24 aa, Staphylococcus aureus
LQGVSFDFVTPFGTYQVKSPYVGK

SEQ ID NO: 1670355 - protein, 20 aa, Staphylococcus aureus
LQHALDVWLLGKLQFAEFEH

SEQ ID NO: 1670356 - protein, 24 aa, Staphylococcus aureus
LQHLATKHGINFQEVVFKEEKRCP

SEQ ID NO: 1670357 - protein, 17 aa, Staphylococcus aureus
LQKTVDVYRNYKGKKEE

SEQ ID NO: 1670358 - protein, 20 aa, Staphylococcus aureus
LQLSEKYILEAIEQYKKIYG

SEQ ID NO: 1670359 - protein, 19 aa, Staphylococcus aureus
LQMDEELKTARTNADVDAV

SEQ ID NO: 1670360 - protein, 18 aa, Staphylococcus aureus
LQMLVLFDKTIFKDEKQF

SEQ ID NO: 1670361 - protein, 25 aa, Staphylococcus aureus
LQNVTIPAIEAIVPQKDPNANDTNS

SEQ ID NO: 1670362 - protein, 18 aa, Staphylococcus aureus
LQNYYNTRIETIKVSEKL

SEQ ID NO: 1670363 - protein, 20 aa, Staphylococcus aureus
LQNYYNTRIETIKVSEKLSK

SEQ ID NO: 1670364 - protein, 21 aa, Staphylococcus aureus
LQPELFTMVPVNIEIEHQSPL

SEQ ID NO: 1670365 - protein, 25 aa, Staphylococcus aureus
LQRVIGFENQVPWHLPNDLKHVKKL

SEQ ID NO: 1670366 - protein, 19 aa, Staphylococcus aureus
LQSIIKPALESDFEIQRSD

SEQ ID NO: 1670367 - protein, 24 aa, Staphylococcus aureus
LQSKHLKLKGVHCHIGSQIEGTEA

SEQ ID NO: 1670368 - protein, 19 aa, Staphylococcus aureus
LQSSRHVLFAGLGSSGLSA

SEQ ID NO: 1670369 - protein, 26 aa, Staphylococcus aureus
LQTYLKEFRKGGISKKTVYTVTPEIS

SEQ ID NO: 1670370 - protein, 33 aa, Staphylococcus aureus
LQVIPSIKGIGAWTVQMFMLFQFPHVAFENIPV

SEQ ID NO: 1670371 - protein, 18 aa, Staphylococcus aureus
LRDADACFITLSEQIDAE

SEQ ID NO: 1670372 - protein, 17 aa, Staphylococcus aureus
LRDIYPITTKKAPILKL

SEQ ID NO: 1670373 - protein, 19 aa, Staphylococcus aureus
LRDLWQQKMLRDNPDLSID

SEQ ID NO: 1670374 - protein, 23 aa, Staphylococcus aureus
LRDYDEKLIIPGFFGVSHEGYIV

SEQ ID NO: 1670375 - protein, 17 aa, Staphylococcus aureus
LREETIVLLKTGIQEYD

SEQ ID NO: 1670376 - protein, 30 aa, Staphylococcus aureus
LREIFKEEGLEPWTSCEFDFTSEGKLNVSF

SEQ ID NO: 1670377 - protein, 21 aa, Staphylococcus aureus
LRERGCKNGDIVRILGGEFEF

SEQ ID NO: 1670378 - protein, 24 aa, Staphylococcus aureus
LRGNHYKQRLTVIGNQTFIRAIKK

SEQ ID NO: 1670379 - protein, 17 aa, Staphylococcus aureus
LRIKWIEKGNIESYDDF

SEQ ID NO: 1670380 - protein, 38 aa, Staphylococcus aureus
LRKIKYFCPVCGKQVILKRGLKVISHFAHKHLTEQKCF

SEQ ID NO: 1670381 - protein, 19 aa, Staphylococcus aureus
LRKKLSEIGMDSAVETKVG

SEQ ID NO: 1670382 - protein, 20 aa, Staphylococcus aureus
LRKPDWLRIKLNTNENYTGL

SEQ ID NO: 1670383 - protein, 23 aa, Staphylococcus aureus
LRLAKRVVKEKWSVRYLENHFNE

SEQ ID NO: 1670384 - protein, 19 aa, Staphylococcus aureus
LRLRFGLDDGRTRTLEEVG

SEQ ID NO: 1670385 - protein, 18 aa, Staphylococcus aureus
LRLTDMGHELGMISEERY

SEQ ID NO: 1670386 - protein, 25 aa, Staphylococcus aureus
LRMNDIGKIIGIWNGMIKRQGTSGK

SEQ ID NO: 1670387 - protein, 26 aa, Staphylococcus aureus
LRNELTVCGSWNCLSSNFPGKDWTAT

SEQ ID NO: 1670388 - protein, 25 aa, Staphylococcus aureus
LRNELTVCGSWNCLSSNFPGKEWMA

SEQ ID NO: 1670389 - protein, 25 aa, Staphylococcus aureus
LRNELTVCGSWNCLSSNFPGKEWTA

SEQ ID NO: 1670390 - protein, 17 aa, Staphylococcus aureus
LRNLFSEIIFLDAISLR

SEQ ID NO: 1670391 - protein, 19 aa, Staphylococcus aureus
LRNMIGIKSDYFYKCLYVN

SEQ ID NO: 1670392 - protein, 18 aa, Staphylococcus aureus
LRNMMMRYVMKKKNVDSL

SEQ ID NO: 1670393 - protein, 20 aa, Staphylococcus aureus
LRPNGQFIDSSWIVGGGHGT

SEQ ID NO: 1670394 - protein, 22 aa, Staphylococcus aureus
LRQTSLFEMAEYIGISEPQKLV

SEQ ID NO: 1670395 - protein, 21 aa, Staphylococcus aureus
LRRPEMTYDIVLEILEEEHQL

SEQ ID NO: 1670396 - protein, 18 aa, Staphylococcus aureus
LRRRAKLLETILKNTRSI

SEQ ID NO: 1670397 - protein, 23 aa, Staphylococcus aureus
LRRYLQEEYNIYGFNDTNKGRNY

SEQ ID NO: 1670398 - protein, 22 aa, Staphylococcus aureus
LRSEALFKKALLYAPLYPVEVT

SEQ ID NO: 1670399 - protein, 17 aa, Staphylococcus aureus
LRSKEAYHGGHIEGTIN

SEQ ID NO: 1670400 - protein, 18 aa, Staphylococcus aureus
LRSTKNFVREELKTIRRF

SEQ ID NO: 1670401 - protein, 26 aa, Staphylococcus aureus
LRSYLESMSQDFNVGGLFNKKKKKLK

SEQ ID NO: 1670402 - protein, 22 aa, Staphylococcus aureus
LRVIEGNSGLFVAMPSKRTPDG

SEQ ID NO: 1670403 - protein, 17 aa, Staphylococcus aureus
LRVNYKIICDFSTEREE

SEQ ID NO: 1670404 - protein, 18 aa, Staphylococcus aureus
LRVNYKIICDFSTEREEK

SEQ ID NO: 1670405 - protein, 19 aa, Staphylococcus aureus
LRVPHGAGGIILDVKVFNR

SEQ ID NO: 1670406 - protein, 23 aa, Staphylococcus aureus
LRVPHGAGGIVLDVKVFNREEGD

SEQ ID NO: 1670407 - protein, 19 aa, Staphylococcus aureus
LRVPNKLTIKDIDKVFQSI

SEQ ID NO: 1670408 - protein, 27 aa, Staphylococcus aureus
LRVTQELRKKGVIGKFVEFFGPGVQHL

SEQ ID NO: 1670409 - protein, 19 aa, Staphylococcus aureus
LRYAVSEGVQRIHVESMHE

SEQ ID NO: 1670410 - protein, 17 aa, Staphylococcus aureus
LRYIYDVYFDRDDCITV

SEQ ID NO: 1670411 - protein, 27 aa, Staphylococcus aureus
LSAKAKGILLYFLSRPDNWQIYTSEVV

SEQ ID NO: 1670412 - protein, 22 aa, Staphylococcus aureus
LSAKELKGGFKDVPQVTLSNDT

SEQ ID NO: 1670413 - protein, 21 aa, Staphylococcus aureus
LSALYHNFAGFGLNIFDNHKA

SEQ ID NO: 1670414 - protein, 17 aa, Staphylococcus aureus
LSCGELCACDLLEHFQF

SEQ ID NO: 1670415 - protein, 18 aa, Staphylococcus aureus
LSDALFKAYHVVVQGVDE

SEQ ID NO: 1670416 - protein, 21 aa, Staphylococcus aureus
LSDAQVERIIDTYKRKETIDK

SEQ ID NO: 1670417 - protein, 24 aa, Staphylococcus aureus
LSDVEPYIGAFIYLYFKNQPRNVT

SEQ ID NO: 1670418 - protein, 17 aa, Staphylococcus aureus
LSEFVVLGIDTTIPFHI

SEQ ID NO: 1670419 - protein, 24 aa, Staphylococcus aureus
LSEKSLKHTPSFSVNRPGEETGVT

SEQ ID NO: 1670420 - protein, 22 aa, Staphylococcus aureus
LSERTKRLKLKQLLNSQNVEKD

SEQ ID NO: 1670421 - protein, 24 aa, Staphylococcus aureus
LSESKFTIMMLLSYEKDMILSPSD

SEQ ID NO: 1670422 - protein, 21 aa, Staphylococcus aureus
LSFLDTKSWCKNKFQVTNQVS

SEQ ID NO: 1670423 - protein, 23 aa, Staphylococcus aureus
LSFQRIPIYIIWINPKSHKTPRY

SEQ ID NO: 1670424 - protein, 17 aa, Staphylococcus aureus
LSFRAFYALPLLSNKAG

SEQ ID NO: 1670425 - protein, 18 aa, Staphylococcus aureus
LSFYDWYADLPLASPQIW

SEQ ID NO: 1670426 - protein, 21 aa, Staphylococcus aureus
LSGGQRQRAYIAMTIAQDTEY

SEQ ID NO: 1670427 - protein, 23 aa, Staphylococcus aureus
LSGRYKNLIIWYLKTEGKRFGEI

SEQ ID NO: 1670428 - protein, 18 aa, Staphylococcus aureus
LSGSGCREFEHYLINRNE

SEQ ID NO: 1670429 - protein, 22 aa, Staphylococcus aureus
LSGTVTPQGFFAIIEKPQYDIS

SEQ ID NO: 1670430 - protein, 17 aa, Staphylococcus aureus
LSGVYAHICENMNFFHT

SEQ ID NO: 1670431 - protein, 17 aa, Staphylococcus aureus
LSGYPVKLELWAMPTED

SEQ ID NO: 1670432 - protein, 24 aa, Staphylococcus aureus
LSIPRDTISYIPKVGYYDKITHAH

SEQ ID NO: 1670433 - protein, 28 aa, Staphylococcus aureus
LSKGFPRIPILKDVYGFVEIGRELVELH

SEQ ID NO: 1670434 - protein, 18 aa, Staphylococcus aureus
LSKGSLAGVDGRLQTRSY

SEQ ID NO: 1670435 - protein, 19 aa, Staphylococcus aureus
LSKQGKRKANEIGTLMHTV

SEQ ID NO: 1670436 - protein, 17 aa, Staphylococcus aureus
LSKQRRIIARELRDHIV

SEQ ID NO: 1670437 - protein, 17 aa, Staphylococcus aureus
LSKQSNRQFKVLYLVPS

SEQ ID NO: 1670438 - protein, 18 aa, Staphylococcus aureus
LSKREIEVLREMVKGKTN

SEQ ID NO: 1670439 - protein, 20 aa, Staphylococcus aureus
LSKREIEVLREMVKGKTNKE

SEQ ID NO: 1670440 - protein, 17 aa, Staphylococcus aureus
LSKTFLIESRDLTTVDF

SEQ ID NO: 1670441 - protein, 19 aa, Staphylococcus aureus
LSKTYEWIRDIGKDMGRAA

SEQ ID NO: 1670442 - protein, 18 aa, Staphylococcus aureus
LSLLKLNQHVAFCDEDHY

SEQ ID NO: 1670443 - protein, 21 aa, Staphylococcus aureus
LSLNVRRIFFSTYDRSCLNDC

SEQ ID NO: 1670444 - protein, 19 aa, Staphylococcus aureus
LSLYPTKNLEDFYDKEGFR

SEQ ID NO: 1670445 - protein, 17 aa, Staphylococcus aureus
LSMFKNVFEYTRRIYKL

SEQ ID NO: 1670446 - protein, 32 aa, Staphylococcus aureus
LSNDAKIAYAILRDRLQLSIKNNWIDTEGNIY

SEQ ID NO: 1670447 - protein, 20 aa, Staphylococcus aureus
LSNGSAIPDATITWVSGQAP

SEQ ID NO: 1670448 - protein, 22 aa, Staphylococcus aureus
LSNKIGGYFLNKLDLNMINSSD

SEQ ID NO: 1670449 - protein, 17 aa, Staphylococcus aureus
LSNKNVRSLIYITILAY

SEQ ID NO: 1670450 - protein, 17 aa, Staphylococcus aureus
LSNNQSFEYIASEGGHL

SEQ ID NO: 1670451 - protein, 26 aa, Staphylococcus aureus
LSPELRNKIQIVTKCGIILPSKQLDF

SEQ ID NO: 1670452 - protein, 18 aa, Staphylococcus aureus
LSREGLDINVNRIGIKGG

SEQ ID NO: 1670453 - protein, 25 aa, Staphylococcus aureus
LSSGGKRVRPAFVILSSQFGKDDQT

SEQ ID NO: 1670454 - protein, 18 aa, Staphylococcus aureus
LSSGRNFIGQTTFHPEKL

SEQ ID NO: 1670455 - protein, 19 aa, Staphylococcus aureus
LSSHYKGDHLVNFIDINEN

SEQ ID NO: 1670456 - protein, 23 aa, Staphylococcus aureus
LSSHYKGDHLVNFIDINENHEGV

SEQ ID NO: 1670457 - protein, 19 aa, Staphylococcus aureus
LSSKIKMNSMENVSFELLQ

SEQ ID NO: 1670458 - protein, 18 aa, Staphylococcus aureus
LSSNFPGKEWMATLHYMK

SEQ ID NO: 1670459 - protein, 17 aa, Staphylococcus aureus
LSSRYYTNWNTIEKQVN

SEQ ID NO: 1670460 - protein, 18 aa, Staphylococcus aureus
LSTLKPPLIDAFDYIPNI

SEQ ID NO: 1670461 - protein, 23 aa, Staphylococcus aureus
LSTLKPPLIDAFDYIPNIFHTYI

SEQ ID NO: 1670462 - protein, 17 aa, Staphylococcus aureus
LSVGKEFLKKADTSDKK

SEQ ID NO: 1670463 - protein, 24 aa, Staphylococcus aureus
LSVIGGRWKIAIVYHLLHSNCLRL

SEQ ID NO: 1670464 - protein, 17 aa, Staphylococcus aureus
LSVILPQYVESLIYGTI

SEQ ID NO: 1670465 - protein, 18 aa, Staphylococcus aureus
LSVLEGKTAVIGDDVPVG

SEQ ID NO: 1670466 - protein, 28 aa, Staphylococcus aureus
LSYSGYCLKNKYMYGGVTLAGDYLEKSR

SEQ ID NO: 1670467 - protein, 21 aa, Staphylococcus aureus
LTAEEVIKLNDAVTAAKQALN

SEQ ID NO: 1670468 - protein, 27 aa, Staphylococcus aureus
LTAGIARVMKPGCKFDYMLTLYGPQGV

SEQ ID NO: 1670469 - protein, 18 aa, Staphylococcus aureus
LTAHILMLKVINDMLKYS

SEQ ID NO: 1670470 - protein, 17 aa, Staphylococcus aureus
LTAKGYNYTSVDSSYAS

SEQ ID NO: 1670471 - protein, 22 aa, Staphylococcus aureus
LTAYEIVNNWSYEALVKIFYRY

SEQ ID NO: 1670472 - protein, 20 aa, Staphylococcus aureus
LTDSEKLLFAEITSLSNKYG

SEQ ID NO: 1670473 - protein, 24 aa, Staphylococcus aureus
LTDVELYIGAFIYLYFKNQPRNVT

SEQ ID NO: 1670474 - protein, 25 aa, Staphylococcus aureus
LTEARTLKFFKFFYTHRGPVMDYTN

SEQ ID NO: 1670475 - protein, 21 aa, Staphylococcus aureus
LTELSGYWVYQDINTNKEIKV

SEQ ID NO: 1670476 - protein, 17 aa, Staphylococcus aureus
LTEPIVKVGDKVNKGDI

SEQ ID NO: 1670477 - protein, 23 aa, Staphylococcus aureus
LTESFRRLFKYKKISKNLIGFMH

SEQ ID NO: 1670478 - protein, 24 aa, Staphylococcus aureus
LTESFRRLFKYKKISKNLIGFMHS

SEQ ID NO: 1670479 - protein, 17 aa, Staphylococcus aureus
LTESIVKVGDKVNKGDI

SEQ ID NO: 1670480 - protein, 18 aa, Staphylococcus aureus
LTHNLSWINKFGNIIMMQ

SEQ ID NO: 1670481 - protein, 19 aa, Staphylococcus aureus
LTHRDCLFIELIDDKGNRY

SEQ ID NO: 1670482 - protein, 18 aa, Staphylococcus aureus
LTIGLVLAIARRIVEGDQ

SEQ ID NO: 1670483 - protein, 25 aa, Staphylococcus aureus
LTILKPRIQKSIKLKEIENIGYNTI

SEQ ID NO: 1670484 - protein, 18 aa, Staphylococcus aureus
LTIMCKLGMGPNKEKLDS

SEQ ID NO: 1670485 - protein, 19 aa, Staphylococcus aureus
LTIMCKLGMGPNKEKLDSQ

SEQ ID NO: 1670486 - protein, 18 aa, Staphylococcus aureus
LTKEMLADIEPYRLNSNS

SEQ ID NO: 1670487 - protein, 23 aa, Staphylococcus aureus
LTKLDDALCFYDIGSSEMNLDMA

SEQ ID NO: 1670488 - protein, 20 aa, Staphylococcus aureus
LTKLRTGALSGIATKYLSRE

SEQ ID NO: 1670489 - protein, 35 aa, Staphylococcus aureus
LTKLVDGFTHLPGWVRKASLGLAIFGASIGPAVLA

SEQ ID NO: 1670490 - protein, 36 aa, Staphylococcus aureus
LTKLVDGFTHLPGWVRKASVGLAIFGASIGPAVLAG

SEQ ID NO: 1670491 - protein, 36 aa, Staphylococcus aureus
LTKLVDGFTHLPGWVRKASVGLALFGAAIGPAVLAG

SEQ ID NO: 1670492 - protein, 35 aa, Staphylococcus aureus
LTKLVDGFTHLPGWVRKASVGLALFGASIGPAVLA

SEQ ID NO: 1670493 - protein, 19 aa, Staphylococcus aureus
LTLLKATTTVPGLRNNIAG

SEQ ID NO: 1670494 - protein, 19 aa, Staphylococcus aureus
LTMLKATTTVPGLRNNITG

SEQ ID NO: 1670495 - protein, 27 aa, Staphylococcus aureus
LTMVHLSRFAEEIIFWSTDEAKFITLS

SEQ ID NO: 1670496 - protein, 17 aa, Staphylococcus aureus
LTNKYGIEFNFDKYNSF

SEQ ID NO: 1670497 - protein, 24 aa, Staphylococcus aureus
LTPKELECFIMVKCEGLTYKESAC

SEQ ID NO: 1670498 - protein, 17 aa, Staphylococcus aureus
LTPRLHLFMEDGSIFKN

SEQ ID NO: 1670499 - protein, 19 aa, Staphylococcus aureus
LTQHFLKDDVDTYINRSEL

SEQ ID NO: 1670500 - protein, 18 aa, Staphylococcus aureus
LTQSEMIVVFVLDETINQ

SEQ ID NO: 1670501 - protein, 22 aa, Staphylococcus aureus
LTRERVANVFQLPSVFLNAKSN

SEQ ID NO: 1670502 - protein, 21 aa, Staphylococcus aureus
LTSEGKLLFNEALRIIEHLDS

SEQ ID NO: 1670503 - protein, 25 aa, Staphylococcus aureus
LTSEGKLLFNEALRIIEHLDSTIEQ

SEQ ID NO: 1670504 - protein, 32 aa, Staphylococcus aureus
LTSEYLRPEICKELREKLKQYHYVESGLFPDV

SEQ ID NO: 1670505 - protein, 31 aa, Staphylococcus aureus
LTSILTLSDLFNWSRFKVKTFLDLLESDGML

SEQ ID NO: 1670506 - protein, 32 aa, Staphylococcus aureus
LTSILTLSDLFNWSRFKVKTFLDLLESGGMLE

SEQ ID NO: 1670507 - protein, 22 aa, Staphylococcus aureus
LTSKFNKWVKVMSVRSGQPGIN

SEQ ID NO: 1670508 - protein, 17 aa, Staphylococcus aureus
LTSVKGRMKQKVRAANF

SEQ ID NO: 1670509 - protein, 25 aa, Staphylococcus aureus
LTTLSRLVAPFVPFISEKIHYNLTG

SEQ ID NO: 1670510 - protein, 19 aa, Staphylococcus aureus
LTVKESWTAGEISYSKETV

SEQ ID NO: 1670511 - protein, 18 aa, Staphylococcus aureus
LTVLLSDYIETFHEKNIH

SEQ ID NO: 1670512 - protein, 18 aa, Staphylococcus aureus
LTVSGPFHSSLMKVIEED

SEQ ID NO: 1670513 - protein, 18 aa, Staphylococcus aureus
LTVTITLNEYRKLIEIKA

SEQ ID NO: 1670514 - protein, 19 aa, Staphylococcus aureus
LTVWKSKQAFTDWLKSDVF

SEQ ID NO: 1670515 - protein, 19 aa, Staphylococcus aureus
LTYSERYFLMKFFGLPTDE

SEQ ID NO: 1670516 - protein, 18 aa, Staphylococcus aureus
LVADRNLENLPWKELDID

SEQ ID NO: 1670517 - protein, 17 aa, Staphylococcus aureus
LVAFFFKALTSYLKKHN

SEQ ID NO: 1670518 - protein, 24 aa, Staphylococcus aureus
LVDERIPEINWVDGVEETLQKLKS

SEQ ID NO: 1670519 - protein, 19 aa, Staphylococcus aureus
LVDIMLPRMKAHGVINDDF

SEQ ID NO: 1670520 - protein, 18 aa, Staphylococcus aureus
LVEGVRLVTEFVQDEKAT

SEQ ID NO: 1670521 - protein, 18 aa, Staphylococcus aureus
LVEMVRPQLSSVIQPLYD

SEQ ID NO: 1670522 - protein, 26 aa, Staphylococcus aureus
LVFYHLKLDVEFASILGLTKDKSLLQ

SEQ ID NO: 1670523 - protein, 20 aa, Staphylococcus aureus
LVGACGLDSMRVAKGQFGAH

SEQ ID NO: 1670524 - protein, 19 aa, Staphylococcus aureus
LVGENSWGSQVIEFMGLDL

SEQ ID NO: 1670525 - protein, 25 aa, Staphylococcus aureus
LVGIDFKRYDGIYEHEECEELFKAK

SEQ ID NO: 1670526 - protein, 25 aa, Staphylococcus aureus
LVHKIKNVLKDAGIYYQVYTSRAIY

SEQ ID NO: 1670527 - protein, 22 aa, Staphylococcus aureus
LVICGLKNAYILKHTSEAFKED

SEQ ID NO: 1670528 - protein, 22 aa, Staphylococcus aureus
LVICGLKSAYILKRTSEAFKED

SEQ ID NO: 1670529 - protein, 24 aa, Staphylococcus aureus
LVIEIKKLYPFVFNTLFGAIDKLA

SEQ ID NO: 1670530 - protein, 19 aa, Staphylococcus aureus
LVITKGKGVKFWDTDGKQY

SEQ ID NO: 1670531 - protein, 18 aa, Staphylococcus aureus
LVKRCIDDLTPSLKTNDY

SEQ ID NO: 1670532 - protein, 23 aa, Staphylococcus aureus
LVKRIDDNYLIFNNLALSYVYIP

SEQ ID NO: 1670533 - protein, 24 aa, Staphylococcus aureus
LVLCRELRSPIEYEKLLHYVQAFK

SEQ ID NO: 1670534 - protein, 18 aa, Staphylococcus aureus
LVMITREAINNVIKHANA

SEQ ID NO: 1670535 - protein, 23 aa, Staphylococcus aureus
LVMMGVLPLEFTKGESADSLGLD

SEQ ID NO: 1670536 - protein, 26 aa, Staphylococcus aureus
LVNSGGFKIDTGYIYTSSMDKTEKQA

SEQ ID NO: 1670537 - protein, 17 aa, Staphylococcus aureus
LVPFKKKFEVQQMPIYN

SEQ ID NO: 1670538 - protein, 21 aa, Staphylococcus aureus
LVPMMIKSLLLVYNNEHTIQS

SEQ ID NO: 1670539 - protein, 18 aa, Staphylococcus aureus
LVSEEMRLVYVALTRAKE

SEQ ID NO: 1670540 - protein, 23 aa, Staphylococcus aureus
LVSKRLKKDYGLSFSPCNTKGLA

SEQ ID NO: 1670541 - protein, 24 aa, Staphylococcus aureus
LVSTARIGRSLGIHLILATQKPSG

SEQ ID NO: 1670542 - protein, 17 aa, Staphylococcus aureus
LVTRYLDGMGEFIKVSE

SEQ ID NO: 1670543 - protein, 20 aa, Staphylococcus aureus
LVTRYLDGMGEFIKVSKLDQ

SEQ ID NO: 1670544 - protein, 17 aa, Staphylococcus aureus
LVVVGIFYKNEKRDLQY

SEQ ID NO: 1670545 - protein, 25 aa, Staphylococcus aureus
LWDDIKEAIYGKIVRKVGNRRYLED

SEQ ID NO: 1670546 - protein, 21 aa, Staphylococcus aureus
LWQIVAHRLMTWKKEYANNAV

SEQ ID NO: 1670547 - protein, 22 aa, Staphylococcus aureus
LWSQDMLEQFAVEINNGALVNR

SEQ ID NO: 1670548 - protein, 20 aa, Staphylococcus aureus
LWTGKYSSLFGKRAMTTFER

SEQ ID NO: 1670549 - protein, 18 aa, Staphylococcus aureus
LWWQGIDPIAAIRILGQA

SEQ ID NO: 1670550 - protein, 18 aa, Staphylococcus aureus
LYDAKHFNPYLALDNQMN

SEQ ID NO: 1670551 - protein, 24 aa, Staphylococcus aureus
LYDTCKTLESIGCDLLVIRHPYNN

SEQ ID NO: 1670552 - protein, 21 aa, Staphylococcus aureus
LYEAWEVESRIPGKNGDTTKF

SEQ ID NO: 1670553 - protein, 18 aa, Staphylococcus aureus
LYECDDYSACSLRQQCMK

SEQ ID NO: 1670554 - protein, 17 aa, Staphylococcus aureus
LYEKRKLLSHIESTSST

SEQ ID NO: 1670555 - protein, 19 aa, Staphylococcus aureus
LYESLGIKQVYVEDFEHKS

SEQ ID NO: 1670556 - protein, 17 aa, Staphylococcus aureus
LYGYEERISLSNCSRTI

SEQ ID NO: 1670557 - protein, 26 aa, Staphylococcus aureus
LYHALKRRGHRVCVFKPFQTEERQDG

SEQ ID NO: 1670558 - protein, 24 aa, Staphylococcus aureus
LYIAALKLGVAIIPCSEMLRTKDL

SEQ ID NO: 1670559 - protein, 23 aa, Staphylococcus aureus
LYIDDAWKKRVRQTIPELPDERK

SEQ ID NO: 1670560 - protein, 27 aa, Staphylococcus aureus
LYKELAIKIARLRNARIESSKEQIKGF

SEQ ID NO: 1670561 - protein, 19 aa, Staphylococcus aureus
LYKELIQTFEILYDDTSTT

SEQ ID NO: 1670562 - protein, 25 aa, Staphylococcus aureus
LYKKNRRSLQIYGFSPCHEISIMLA

SEQ ID NO: 1670563 - protein, 19 aa, Staphylococcus aureus
LYKSDAMSTFVIYDNTVER

SEQ ID NO: 1670564 - protein, 20 aa, Staphylococcus aureus
LYLEDLRHYFKNSLSKFENG

SEQ ID NO: 1670565 - protein, 17 aa, Staphylococcus aureus
LYLGRFYNQYNELIVIS

SEQ ID NO: 1670566 - protein, 20 aa, Staphylococcus aureus
LYLKDQRINPIIYMETPTED

SEQ ID NO: 1670567 - protein, 27 aa, Staphylococcus aureus
LYLSSDWFAELGFTFFNYHYTAKLIKS

SEQ ID NO: 1670568 - protein, 19 aa, Staphylococcus aureus
LYLYRKFLGLLDLTDNTLE

SEQ ID NO: 1670569 - protein, 21 aa, Staphylococcus aureus
LYNAQGNIIAKGIYDSKTNTT

SEQ ID NO: 1670570 - protein, 18 aa, Staphylococcus aureus
LYNLGGGAAKKIAIEVLL

SEQ ID NO: 1670571 - protein, 20 aa, Staphylococcus aureus
LYNMVRVLVAFLIEVGKGRY

SEQ ID NO: 1670572 - protein, 20 aa, Staphylococcus aureus
LYNNPWIAWYHQQMQDKKAK

SEQ ID NO: 1670573 - protein, 23 aa, Staphylococcus aureus
LYPHQRYAIDLVIKENHKTYKKQ

SEQ ID NO: 1670574 - protein, 21 aa, Staphylococcus aureus
LYPHQRYVIDLVIKENHKTYK

SEQ ID NO: 1670575 - protein, 18 aa, Staphylococcus aureus
LYQLLSERERVIVMQEDS

SEQ ID NO: 1670576 - protein, 17 aa, Staphylococcus aureus
LYSDVWLLKEIPEKYGI

SEQ ID NO: 1670577 - protein, 24 aa, Staphylococcus aureus
LYTIRLLPVGGYVRMAGDGLEEPP

SEQ ID NO: 1670578 - protein, 38 aa, Staphylococcus aureus
LYVALRISLIKVLRPYYPFPLIVDDAFVHFDKKRTEKM

SEQ ID NO: 1670579 - protein, 22 aa, Staphylococcus aureus
LYVESCKDLRKAIKSLITNIIT

SEQ ID NO: 1670580 - protein, 19 aa, Staphylococcus aureus
LYYHIGQCLGPCVYDVDLS

SEQ ID NO: 1670581 - protein, 19 aa, Staphylococcus aureus
LYYQAGFNHVHYHTGPMSL

SEQ ID NO: 1670582 - protein, 17 aa, Staphylococcus aureus
LYYYTSLLNKYDISESE

SEQ ID NO: 1670583 - protein, 25 aa, Staphylococcus aureus
MACKELSTILKFSFGIAPRKVEYGD

SEQ ID NO: 1670584 - protein, 18 aa, Staphylococcus aureus
MAIDLIERVQSTAYEVEY

SEQ ID NO: 1670585 - protein, 19 aa, Staphylococcus aureus
MAIDLIERVQSTAYQVDYK

SEQ ID NO: 1670586 - protein, 19 aa, Staphylococcus aureus
MAKQKFKQREYKRAAEYFE

SEQ ID NO: 1670587 - protein, 20 aa, Staphylococcus aureus
MALAAKDIRIEAPIPGTSRV

SEQ ID NO: 1670588 - protein, 24 aa, Staphylococcus aureus
MAVVLPHGILFRGAAEGVIRRYLI

SEQ ID NO: 1670589 - protein, 30 aa, Staphylococcus aureus
MDASEFRNYILGLIFYRFLSEKAEQEYSDA

SEQ ID NO: 1670590 - protein, 20 aa, Staphylococcus aureus
MDDRIPINVWTGDSIARTGK

SEQ ID NO: 1670591 - protein, 19 aa, Staphylococcus aureus
MDGMDGFQLCNTLKNDYDI

SEQ ID NO: 1670592 - protein, 18 aa, Staphylococcus aureus
MDKCYLGLHSHIDWETLT

SEQ ID NO: 1670593 - protein, 19 aa, Staphylococcus aureus
MDKCYLGLHSHIDWETLTD

SEQ ID NO: 1670594 - protein, 18 aa, Staphylococcus aureus
MDKEIKFIGGVVNDPHKP

SEQ ID NO: 1670595 - protein, 18 aa, Staphylococcus aureus
MDLPESPDNLILFKEEIG

SEQ ID NO: 1670596 - protein, 26 aa, Staphylococcus aureus
MDLPLKEFALITGAALLARRRTKNEK

SEQ ID NO: 1670597 - protein, 21 aa, Staphylococcus aureus
MDLVTPIGLGQRGLIVAPPKA

SEQ ID NO: 1670598 - protein, 25 aa, Staphylococcus aureus
MDNGRCYLCPCLGYPRQWRSEDIYQ

SEQ ID NO: 1670599 - protein, 23 aa, Staphylococcus aureus
MDRRTKMYNVFEYFKQISNNKHF

SEQ ID NO: 1670600 - protein, 18 aa, Staphylococcus aureus
MDSDIFKDRSIGISTNRD

SEQ ID NO: 1670601 - protein, 18 aa, Staphylococcus aureus
MDSEGMVLHLNRNTRTAT

SEQ ID NO: 1670602 - protein, 18 aa, Staphylococcus aureus
MDTFESFNPGIVILDVQL

SEQ ID NO: 1670603 - protein, 18 aa, Staphylococcus aureus
MDTKRLAQDPALKYQFLR

SEQ ID NO: 1670604 - protein, 24 aa, Staphylococcus aureus
MDYVKRGAANLALISEDPDLMNGI

SEQ ID NO: 1670605 - protein, 17 aa, Staphylococcus aureus
MEADLGYDLFTRSTKDI

SEQ ID NO: 1670606 - protein, 17 aa, Staphylococcus aureus
MEDSLKISNLEQVIVFK

SEQ ID NO: 1670607 - protein, 17 aa, Staphylococcus aureus
MEHIERAGVHSGDSIAV

SEQ ID NO: 1670608 - protein, 25 aa, Staphylococcus aureus
MEHNIKIIACYGGVSGGWFGTTHHC

SEQ ID NO: 1670609 - protein, 17 aa, Staphylococcus aureus
MEILNCKKEKLTKIKKG

SEQ ID NO: 1670610 - protein, 20 aa, Staphylococcus aureus
MEIYCCLLNGHTLVIPDREE

SEQ ID NO: 1670611 - protein, 17 aa, Staphylococcus aureus
MEMEGLLQLVNPKIIRQ

SEQ ID NO: 1670612 - protein, 33 aa, Staphylococcus aureus
MEMLKDLKKGQCIFSDFYGRVGKMAVHCPFEEM

SEQ ID NO: 1670613 - protein, 32 aa, Staphylococcus aureus
MEMLKDLKKGQCIFSDFYGRVGKMVVHCPFEE

SEQ ID NO: 1670614 - protein, 17 aa, Staphylococcus aureus
MEMVRKVDIDNYFEENI

SEQ ID NO: 1670615 - protein, 23 aa, Staphylococcus aureus
MENNIKIGMELGYIKVPPETFIE

SEQ ID NO: 1670616 - protein, 17 aa, Staphylococcus aureus
MEPGCYLMKDRNDQVIY

SEQ ID NO: 1670617 - protein, 18 aa, Staphylococcus aureus
MERVQKNQFAWVVAAFPS

SEQ ID NO: 1670618 - protein, 19 aa, Staphylococcus aureus
MFDYSACKYPIGAVEDEIY

SEQ ID NO: 1670619 - protein, 18 aa, Staphylococcus aureus
MFEAGFSLMFVKANSGTD

SEQ ID NO: 1670620 - protein, 18 aa, Staphylococcus aureus
MFNEAITQLKHVLMIDKN

SEQ ID NO: 1670621 - protein, 17 aa, Staphylococcus aureus
MFNRINTQLYKTCHYNK

SEQ ID NO: 1670622 - protein, 21 aa, Staphylococcus aureus
MGAALLAFCETTLTKGIDVIF

SEQ ID NO: 1670623 - protein, 17 aa, Staphylococcus aureus
MGAILFAKDLTKFEYLS

SEQ ID NO: 1670624 - protein, 22 aa, Staphylococcus aureus
MGGLQERIWNPLQILNDFGTDV

SEQ ID NO: 1670625 - protein, 18 aa, Staphylococcus aureus
MGIIKMKLPIEDLEKKEK

SEQ ID NO: 1670626 - protein, 19 aa, Staphylococcus aureus
MGLGYLVNVYDTWKVEKVL

SEQ ID NO: 1670627 - protein, 17 aa, Staphylococcus aureus
MGLPGGCPLGPRPIDQH

SEQ ID NO: 1670628 - protein, 19 aa, Staphylococcus aureus
MGNLRFQQEYFRIYKNNTE

SEQ ID NO: 1670629 - protein, 17 aa, Staphylococcus aureus
MGPKIFSFRKNETLYTI

SEQ ID NO: 1670630 - protein, 24 aa, Staphylococcus aureus
MGRDCGDLALWAGLSVGAETIVVP

SEQ ID NO: 1670631 - protein, 18 aa, Staphylococcus aureus
MGSRSVDYLHHLIQAMHL

SEQ ID NO: 1670632 - protein, 20 aa, Staphylococcus aureus
MGYFCLKIVNIKLEKDVSGK

SEQ ID NO: 1670633 - protein, 20 aa, Staphylococcus aureus
MHNRMRMVVSQFLTKNLFIN

SEQ ID NO: 1670634 - protein, 24 aa, Staphylococcus aureus
MHPWCRSTTVPYVGNWRDKFFKER

SEQ ID NO: 1670635 - protein, 27 aa, Staphylococcus aureus
MHQIRVLRELDFHFQLVIDANESLDRQ

SEQ ID NO: 1670636 - protein, 27 aa, Staphylococcus aureus
MHQIRVLRELDFHFQLVIDANESLIRQ

SEQ ID NO: 1670637 - protein, 24 aa, Staphylococcus aureus
MIATGRPYRASQMYYHELNLTTPI

SEQ ID NO: 1670638 - protein, 19 aa, Staphylococcus aureus
MIDKLDYLKDFGIDVIWLS

SEQ ID NO: 1670639 - protein, 25 aa, Staphylococcus aureus
MIEAMISKRPVVAFDIKYGPSDFIE

SEQ ID NO: 1670640 - protein, 17 aa, Staphylococcus aureus
MIEKGLEYKQCKLNQKT

SEQ ID NO: 1670641 - protein, 23 aa, Staphylococcus aureus
MIGGKKLKIVNYILDNIHLSNNT

SEQ ID NO: 1670642 - protein, 17 aa, Staphylococcus aureus
MIIMGAGINHWFNSDTI

SEQ ID NO: 1670643 - protein, 18 aa, Staphylococcus aureus
MILESSVDFTIDRALTPK

SEQ ID NO: 1670644 - protein, 19 aa, Staphylococcus aureus
MIMKFDLALQRMLLGEPVQ

SEQ ID NO: 1670645 - protein, 17 aa, Staphylococcus aureus
MINDLGFEVDYDTCENK

SEQ ID NO: 1670646 - protein, 20 aa, Staphylococcus aureus
MINYHSKFDILSWLQDPFAT

SEQ ID NO: 1670647 - protein, 19 aa, Staphylococcus aureus
MISSLKIASDLERIGDNAA

SEQ ID NO: 1670648 - protein, 20 aa, Staphylococcus aureus
MIYMPCVDLNSKIGIVKIVS

SEQ ID NO: 1670649 - protein, 24 aa, Staphylococcus aureus
MKAGAPKDIIQWIEVPSIEATKQL

SEQ ID NO: 1670650 - protein, 20 aa, Staphylococcus aureus
MKDFMEDFVYFGLGEEDSLS

SEQ ID NO: 1670651 - protein, 17 aa, Staphylococcus aureus
MKDLMQRAKIITEGAGA

SEQ ID NO: 1670652 - protein, 18 aa, Staphylococcus aureus
MKENANDVVLSFYDETIK

SEQ ID NO: 1670653 - protein, 23 aa, Staphylococcus aureus
MKETFNVYNKVCYQVFYDEKGYP

SEQ ID NO: 1670654 - protein, 23 aa, Staphylococcus aureus
MKEYLEQEVINFKAKVDEYELQL

SEQ ID NO: 1670655 - protein, 23 aa, Staphylococcus aureus
MKGATPFKSKWIKKVKPNGLASR

SEQ ID NO: 1670656 - protein, 25 aa, Staphylococcus aureus
MKGKIKKPTFNDWGECASRIVSIYR

SEQ ID NO: 1670657 - protein, 25 aa, Staphylococcus aureus
MKGLWRNQLLYAFDHLNICREMLLL

SEQ ID NO: 1670658 - protein, 19 aa, Staphylococcus aureus
MKHEQELERISGLTQEEAI

SEQ ID NO: 1670659 - protein, 22 aa, Staphylococcus aureus
MKHLHFKDIIEYFRPGDTLVLN

SEQ ID NO: 1670660 - protein, 17 aa, Staphylococcus aureus
MKHLKIVSENIVLIKNQ

SEQ ID NO: 1670661 - protein, 20 aa, Staphylococcus aureus
MKHPFHIHGTQFKVLSVDGK

SEQ ID NO: 1670662 - protein, 18 aa, Staphylococcus aureus
MKHQIGYDLLTPNVDVSE

SEQ ID NO: 1670663 - protein, 17 aa, Staphylococcus aureus
MKISASLLSQSDMFIAM

SEQ ID NO: 1670664 - protein, 20 aa, Staphylococcus aureus
MKKAAALVGEKKLQLMPLDN

SEQ ID NO: 1670665 - protein, 20 aa, Staphylococcus aureus
MKKMIANLLIEKSLDVISTK

SEQ ID NO: 1670666 - protein, 24 aa, Staphylococcus aureus
MKMFEFKQGVKLFAANVILSQSGY

SEQ ID NO: 1670667 - protein, 25 aa, Staphylococcus aureus
MKNGGKYTFELHKKLQEHRMAGTNI

SEQ ID NO: 1670668 - protein, 22 aa, Staphylococcus aureus
MKNGQLKPGYNLQIATNSQFVL

SEQ ID NO: 1670669 - protein, 20 aa, Staphylococcus aureus
MKPEYFIPVQGEFKMQIAHA

SEQ ID NO: 1670670 - protein, 24 aa, Staphylococcus aureus
MKQGETGRQIGWFISYDKDNPNMM

SEQ ID NO: 1670671 - protein, 17 aa, Staphylococcus aureus
MKQRVALCRAHVHKPNV

SEQ ID NO: 1670672 - protein, 20 aa, Staphylococcus aureus
MKRHADIIVVCYHGGFEKDL

SEQ ID NO: 1670673 - protein, 17 aa, Staphylococcus aureus
MKTGNVYYRTGYVQTGR

SEQ ID NO: 1670674 - protein, 25 aa, Staphylococcus aureus
MKVARELIELIIAFMFHHQIPMSIE

SEQ ID NO: 1670675 - protein, 26 aa, Staphylococcus aureus
MKVARELIELIIAFMFHHQIPMSLET

SEQ ID NO: 1670676 - protein, 19 aa, Staphylococcus aureus
MKVSLDYLLQFKIDNKTLL

SEQ ID NO: 1670677 - protein, 23 aa, Staphylococcus aureus
MLAKLKVLYEMFGLEIVDNELSD

SEQ ID NO: 1670678 - protein, 26 aa, Staphylococcus aureus
MLCGCQGVNGGGWAHYVGQEKCRPIE

SEQ ID NO: 1670679 - protein, 26 aa, Staphylococcus aureus
MLCGCQGVNGGGWGHYVGQEKCRPIE

SEQ ID NO: 1670680 - protein, 20 aa, Staphylococcus aureus
MLEIELRAVINAMSQNEGKS

SEQ ID NO: 1670681 - protein, 17 aa, Staphylococcus aureus
MLETGNFIPKYSDEDRK

SEQ ID NO: 1670682 - protein, 25 aa, Staphylococcus aureus
MLGDAYEFLIGRFAATAGKKAGEFY

SEQ ID NO: 1670683 - protein, 19 aa, Staphylococcus aureus
MLGPIGIGVLFGKRELLQK

SEQ ID NO: 1670684 - protein, 20 aa, Staphylococcus aureus
MLLDELIKWARENPDLSQGK

SEQ ID NO: 1670685 - protein, 24 aa, Staphylococcus aureus
MLNIARNGYKTSFFSLETTGTSVL

SEQ ID NO: 1670686 - protein, 25 aa, Staphylococcus aureus
MLNRKKEDLEFIIDKFFKKIQQERP

SEQ ID NO: 1670687 - protein, 36 aa, Staphylococcus aureus
MLPHYRPYKIAEHFRMMAALYPNRIDLGIGNNPGTT

SEQ ID NO: 1670688 - protein, 17 aa, Staphylococcus aureus
MLPLFEEHYHLYAPSDD

SEQ ID NO: 1670689 - protein, 23 aa, Staphylococcus aureus
MLQDCHVWVGYTWEGQRYYLPIR

SEQ ID NO: 1670690 - protein, 19 aa, Staphylococcus aureus
MLTSIPINIWVSTPSFMEM

SEQ ID NO: 1670691 - protein, 20 aa, Staphylococcus aureus
MLTTMNLHFESNVVSDYINE

SEQ ID NO: 1670692 - protein, 25 aa, Staphylococcus aureus
MLVNNSRFGFKMGHQSIVDSMVYDG

SEQ ID NO: 1670693 - protein, 17 aa, Staphylococcus aureus
MLVSIPPKLGVSSFVGY

SEQ ID NO: 1670694 - protein, 20 aa, Staphylococcus aureus
MMCEMFKLRSFCENKDNNYS

SEQ ID NO: 1670695 - protein, 24 aa, Staphylococcus aureus
MMFRDEATWFALMNHLVDVSVKYV

SEQ ID NO: 1670696 - protein, 25 aa, Staphylococcus aureus
MMGAMLGRFKKCVMGLPGGCPLGPR

SEQ ID NO: 1670697 - protein, 18 aa, Staphylococcus aureus
MMGEYIIYYDGVVIGGLY

SEQ ID NO: 1670698 - protein, 21 aa, Staphylococcus aureus
MMLEPKIAILDEIDSGLDIDA

SEQ ID NO: 1670699 - protein, 19 aa, Staphylococcus aureus
MMLKFKAWDKDKKVMSIID

SEQ ID NO: 1670700 - protein, 23 aa, Staphylococcus aureus
MMNGKLFGHVYIKDCKVRQSFEL

SEQ ID NO: 1670701 - protein, 27 aa, Staphylococcus aureus
MMRDIKRDIGMIFQHFNLLNSATVFKN

SEQ ID NO: 1670702 - protein, 19 aa, Staphylococcus aureus
MMRYVMKKKNVDTLPSLID

SEQ ID NO: 1670703 - protein, 22 aa, Staphylococcus aureus
MNELGLTMGYNFMHRKKPANGF

SEQ ID NO: 1670704 - protein, 17 aa, Staphylococcus aureus
MNIKEQFLVKLQERAIP

SEQ ID NO: 1670705 - protein, 20 aa, Staphylococcus aureus
MNKPVEWAEGLNLNSDGFTS

SEQ ID NO: 1670706 - protein, 21 aa, Staphylococcus aureus
MNLPELIQWAWDNRKLSGNKR

SEQ ID NO: 1670707 - protein, 22 aa, Staphylococcus aureus
MNPNYCGRVINQYGQYNNMVPP

SEQ ID NO: 1670708 - protein, 21 aa, Staphylococcus aureus
MNRLTGRRICESCGTTYHLVF

SEQ ID NO: 1670709 - protein, 19 aa, Staphylococcus aureus
MNRPELQRILKDAKDGYID

SEQ ID NO: 1670710 - protein, 18 aa, Staphylococcus aureus
MNSDIHRSRLLNSKYDEM

SEQ ID NO: 1670711 - protein, 18 aa, Staphylococcus aureus
MNSEGMVLHFNRNTRTAT

SEQ ID NO: 1670712 - protein, 19 aa, Staphylococcus aureus
MNVDMAIEMYEGNHRVLKV

SEQ ID NO: 1670713 - protein, 25 aa, Staphylococcus aureus
MNVIPNRFIYKIALVGKDEKKYKDG

SEQ ID NO: 1670714 - protein, 20 aa, Staphylococcus aureus
MNVSLKAIMKRVGHTDEKTT

SEQ ID NO: 1670715 - protein, 21 aa, Staphylococcus aureus
MNVSLKAIMKRVGHTDEKTTI

SEQ ID NO: 1670716 - protein, 18 aa, Staphylococcus aureus
MNWEGAFKVNERTLKMTD

SEQ ID NO: 1670717 - protein, 36 aa, Staphylococcus aureus
MPDKILDLRYKLRVNNVPTPRTVTFNETLTYKTYTQ

SEQ ID NO: 1670718 - protein, 17 aa, Staphylococcus aureus
MPDKLCLYYHIGQCLGP

SEQ ID NO: 1670719 - protein, 17 aa, Staphylococcus aureus
MPFGVCHFAVAAKPETT

SEQ ID NO: 1670720 - protein, 17 aa, Staphylococcus aureus
MPFMSGGYGNYVKITSG

SEQ ID NO: 1670721 - protein, 18 aa, Staphylococcus aureus
MPGKRVNINDGVPRLDAL

SEQ ID NO: 1670722 - protein, 19 aa, Staphylococcus aureus
MPGKRVNINDGVPRLDALI

SEQ ID NO: 1670723 - protein, 19 aa, Staphylococcus aureus
MPHRIFDFYNAFIGTSDFN

SEQ ID NO: 1670724 - protein, 20 aa, Staphylococcus aureus
MPIAILIRHMMSFDNTHFFA

SEQ ID NO: 1670725 - protein, 23 aa, Staphylococcus aureus
MPKWIIDHWATHYGLEGTETILQ

SEQ ID NO: 1670726 - protein, 19 aa, Staphylococcus aureus
MPKWSKLVNKLSVPIEANY

SEQ ID NO: 1670727 - protein, 20 aa, Staphylococcus aureus
MPLSKMNMFGLRNMMMRYVM

SEQ ID NO: 1670728 - protein, 18 aa, Staphylococcus aureus
MPNIPEMRQVWEPMGNAS

SEQ ID NO: 1670729 - protein, 23 aa, Staphylococcus aureus
MPTEVEIAGPIVIENKFIDPKTN

SEQ ID NO: 1670730 - protein, 23 aa, Staphylococcus aureus
MPTPELKTGSGIDWSDEALTDQI

SEQ ID NO: 1670731 - protein, 17 aa, Staphylococcus aureus
MPTSFEALWELYRGLAN

SEQ ID NO: 1670732 - protein, 17 aa, Staphylococcus aureus
MPVEAAAMPMPQAQSTD

SEQ ID NO: 1670733 - protein, 20 aa, Staphylococcus aureus
MQAKAIVGFKVKIKKIEAAY

SEQ ID NO: 1670734 - protein, 22 aa, Staphylococcus aureus
MQAKGIVGFKVKIHKIEAAYKM

SEQ ID NO: 1670735 - protein, 18 aa, Staphylococcus aureus
MQFECSWSANIKEDKVHV

SEQ ID NO: 1670736 - protein, 21 aa, Staphylococcus aureus
MQFTGSFKFRGASNKINHLSD

SEQ ID NO: 1670737 - protein, 17 aa, Staphylococcus aureus
MQKGSPVVFEIGYNQGE

SEQ ID NO: 1670738 - protein, 26 aa, Staphylococcus aureus
MQLMCKGDMKRHCNIIIPDKNEYEMM

SEQ ID NO: 1670739 - protein, 18 aa, Staphylococcus aureus
MQTFKRVFVEHVLNDQQK

SEQ ID NO: 1670740 - protein, 23 aa, Staphylococcus aureus
MRDQCSMCHAVLPQIEDLMQSYP

SEQ ID NO: 1670741 - protein, 23 aa, Staphylococcus aureus
MRDQCSVCHAVLPQIEDLMQSFP

SEQ ID NO: 1670742 - protein, 19 aa, Staphylococcus aureus
MRFAKEVSNNIVFIHEGMI

SEQ ID NO: 1670743 - protein, 24 aa, Staphylococcus aureus
MRFAKEVSNNIVFIHEGMIGEQGA

SEQ ID NO: 1670744 - protein, 18 aa, Staphylococcus aureus
MRKAHFHSLIKIKLPETL

SEQ ID NO: 1670745 - protein, 19 aa, Staphylococcus aureus
MRLAEIFSERLSDIGHQVV

SEQ ID NO: 1670746 - protein, 20 aa, Staphylococcus aureus
MRLDELIKWARSNPELSKGK

SEQ ID NO: 1670747 - protein, 23 aa, Staphylococcus aureus
MRLDELIKWAWDNPGLATGRNFY

SEQ ID NO: 1670748 - protein, 23 aa, Staphylococcus aureus
MRLKESGLILGIDLLDHIIIGDN

SEQ ID NO: 1670749 - protein, 17 aa, Staphylococcus aureus
MRNNFNVQYSVHRQSSN

SEQ ID NO: 1670750 - protein, 18 aa, Staphylococcus aureus
MRRIYRRKLTYILKRLKP

SEQ ID NO: 1670751 - protein, 20 aa, Staphylococcus aureus
MRSNGRYKPYNVIERLQGDL

SEQ ID NO: 1670752 - protein, 23 aa, Staphylococcus aureus
MRSNGRYKPYNVIERLQVDLYQA

SEQ ID NO: 1670753 - protein, 19 aa, Staphylococcus aureus
MRSNGRYKPYSVIERLQVE

SEQ ID NO: 1670754 - protein, 21 aa, Staphylococcus aureus
MRSRGMYLFLNRNTRTAKGYF

SEQ ID NO: 1670755 - protein, 30 aa, Staphylococcus aureus
MRTDVYDFYSLGFGEPYPISGAHGLGLGDL

SEQ ID NO: 1670756 - protein, 18 aa, Staphylococcus aureus
MRYVMKKKNVDSLPTLIN

SEQ ID NO: 1670757 - protein, 18 aa, Staphylococcus aureus
MRYVMKKKNVDSLYSLID

SEQ ID NO: 1670758 - protein, 19 aa, Staphylococcus aureus
MSAAAIKFAQQFEENSTFK

SEQ ID NO: 1670759 - protein, 31 aa, Staphylococcus aureus
MSARMHKGTEKMLGMFANTLVYRGQPSPDKM

SEQ ID NO: 1670760 - protein, 17 aa, Staphylococcus aureus
MSDKIILIENGEIKLND

SEQ ID NO: 1670761 - protein, 21 aa, Staphylococcus aureus
MSDVLFQNGFVKATFKDAVID

SEQ ID NO: 1670762 - protein, 24 aa, Staphylococcus aureus
MSEIKRLNLDAILAKNTDKKMIGI

SEQ ID NO: 1670763 - protein, 21 aa, Staphylococcus aureus
MSLNGLNNFFIYPGQKLKVTG

SEQ ID NO: 1670764 - protein, 25 aa, Staphylococcus aureus
MSNIASLDLYAPVRNITSSRDIHPI

SEQ ID NO: 1670765 - protein, 18 aa, Staphylococcus aureus
MSPKDLKLIESIPQMMDI

SEQ ID NO: 1670766 - protein, 28 aa, Staphylococcus aureus
MSPYSYGAEIKPEFRNMLLNLKELDTLV

SEQ ID NO: 1670767 - protein, 26 aa, Staphylococcus aureus
MSQLQCAKSSLSLETIFHCYHQMMPC

SEQ ID NO: 1670768 - protein, 17 aa, Staphylococcus aureus
MSTFVIYDNTIERNSIV

SEQ ID NO: 1670769 - protein, 17 aa, Staphylococcus aureus
MSTKIGRKVLARRRRKG

SEQ ID NO: 1670770 - protein, 23 aa, Staphylococcus aureus
MTKKEFIDFPVLFDDEGNFRKKQ

SEQ ID NO: 1670771 - protein, 31 aa, Staphylococcus aureus
MTNKSIVGNLVYRNNFYNEVYTQPVYDLDDS

SEQ ID NO: 1670772 - protein, 18 aa, Staphylococcus aureus
MTPETATIGRLVDTKTLF

SEQ ID NO: 1670773 - protein, 18 aa, Staphylococcus aureus
MTPKELTTEIPAGTKSKP

SEQ ID NO: 1670774 - protein, 17 aa, Staphylococcus aureus
MTPKYEDLRAYYTKPSF

SEQ ID NO: 1670775 - protein, 22 aa, Staphylococcus aureus
MTVIEGNLFLKGKNQLLNEQVM

SEQ ID NO: 1670776 - protein, 18 aa, Staphylococcus aureus
MTVLCNFDKTKTFSAPNG

SEQ ID NO: 1670777 - protein, 22 aa, Staphylococcus aureus
MVAKRVRGGWALQEALHAPYGM

SEQ ID NO: 1670778 - protein, 22 aa, Staphylococcus aureus
MVAKRVRGGWKLLEALHAPYGM

SEQ ID NO: 1670779 - protein, 22 aa, Staphylococcus aureus
MVATINEFREAKAILLEEKENL

SEQ ID NO: 1670780 - protein, 18 aa, Staphylococcus aureus
MVDWNIGRNRYWGTPLNV

SEQ ID NO: 1670781 - protein, 34 aa, Staphylococcus aureus
MVGEGLAIKAHEEFKVIAPFSGKVSMIVPTKHAI

SEQ ID NO: 1670782 - protein, 22 aa, Staphylococcus aureus
MVKTIEGGVAFATQIVQEKYEQ

SEQ ID NO: 1670783 - protein, 19 aa, Staphylococcus aureus
MVPSFGYRLTDHEDLYHKI

SEQ ID NO: 1670784 - protein, 18 aa, Staphylococcus aureus
MVQKRLSDKDVVFDWDLV

SEQ ID NO: 1670785 - protein, 18 aa, Staphylococcus aureus
MVSKRVKDGWELHEAMDA

SEQ ID NO: 1670786 - protein, 36 aa, Staphylococcus aureus
MVVAPLEILDPFKGALKFQLPNDVIKRDGSYQAQVS

SEQ ID NO: 1670787 - protein, 17 aa, Staphylococcus aureus
MVYTFLKAQGKEIGISL

SEQ ID NO: 1670788 - protein, 17 aa, Staphylococcus aureus
MYFYNILDKEDLKTIQR

SEQ ID NO: 1670789 - protein, 21 aa, Staphylococcus aureus
MYKKFGVIPEMEYEMEEVKEI

SEQ ID NO: 1670790 - protein, 18 aa, Staphylococcus aureus
MYKTGLWEFETHTHDMHN

SEQ ID NO: 1670791 - protein, 24 aa, Staphylococcus aureus
MYSDFDKMRFVHHSIPSINVNDID

SEQ ID NO: 1670792 - protein, 17 aa, Staphylococcus aureus
MYYRKDMMVNGGVLMAH

SEQ ID NO: 1670793 - protein, 17 aa, Staphylococcus aureus
NAAKVSGVKAIEATTTA

SEQ ID NO: 1670794 - protein, 19 aa, Staphylococcus aureus
NAAKVSGVKAIEATTTAQD

SEQ ID NO: 1670795 - protein, 17 aa, Staphylococcus aureus
NAAQRVSGVTDLKNSAT

SEQ ID NO: 1670796 - protein, 36 aa, Staphylococcus aureus; identical to SEQ ID NO: 1578615

SEQ ID NO: 1670797 - protein, 17 aa, Staphylococcus aureus
NAEVKKVVFFNEEVKYS

SEQ ID NO: 1670798 - protein, 18 aa, Staphylococcus aureus
NAFKEDLEPWTSCEFDFT

SEQ ID NO: 1670799 - protein, 22 aa, Staphylococcus aureus
NAGENYIDIAWLARKKGYQVTL

SEQ ID NO: 1670800 - protein, 18 aa, Staphylococcus aureus
NAHWTKAYKLFDIIEEEF

SEQ ID NO: 1670801 - protein, 17 aa, Staphylococcus aureus
NAIVYGRKSPYTLYDEK

SEQ ID NO: 1670802 - protein, 18 aa, Staphylococcus aureus
NAIVYGRKSPYTLYDEKL

SEQ ID NO: 1670803 - protein, 18 aa, Staphylococcus aureus
NAKISGKVYDELYENGNK

SEQ ID NO: 1670804 - protein, 26 aa, Staphylococcus aureus
NAKRFKRWVTSEVLPTLRKTGAYQIP

SEQ ID NO: 1670805 - protein, 25 aa, Staphylococcus aureus
NAKSVWKGTSKWFSNSYKSLKGWTG

SEQ ID NO: 1670806 - protein, 24 aa, Staphylococcus aureus
NAKSVWKGTSKWFSSSYKSLKSWT

SEQ ID NO: 1670807 - protein, 17 aa, Staphylococcus aureus
NALYASGAYIMTQKNAY

SEQ ID NO: 1670808 - protein, 26 aa, Staphylococcus aureus
NAMLEKLRFSKMFFSSNAVNKGTVMT

SEQ ID NO: 1670809 - protein, 21 aa, Staphylococcus aureus
NANYKRHGMKLMILGNDEPYN

SEQ ID NO: 1670810 - protein, 17 aa, Staphylococcus aureus
NASSDFGNAHFVVLSKY

SEQ ID NO: 1670811 - protein, 19 aa, Staphylococcus aureus
NATIAIAVGHELGLTYNRI

SEQ ID NO: 1670812 - protein, 17 aa, Staphylococcus aureus
NAVIKLGQLFENIRECG

SEQ ID NO: 1670813 - protein, 22 aa, Staphylococcus aureus
NAVNEKAREAITNINATPGATR

SEQ ID NO: 1670814 - protein, 23 aa, Staphylococcus aureus
NAVPFFDEIHQIIGSGATGSDSG

SEQ ID NO: 1670815 - protein, 22 aa, Staphylococcus aureus
NAYKQAVAKAEALLNKQSGTNE

SEQ ID NO: 1670816 - protein, 19 aa, Staphylococcus aureus
NAYPEFGDKVAHYISENTG

SEQ ID NO: 1670817 - protein, 20 aa, Staphylococcus aureus
NCGFYTATHPLNFYHRNEGY

SEQ ID NO: 1670818 - protein, 32 aa, Staphylococcus aureus
NCLNSADGEPCNECHICKGITQGTNSDVIEID

SEQ ID NO: 1670819 - protein, 23 aa, Staphylococcus aureus
NDAFPRMTYKEAMRRYGSDKPDT

SEQ ID NO: 1670820 - protein, 24 aa, Staphylococcus aureus
NDAHKGHIAAAIFNLGYLPKGDKS

SEQ ID NO: 1670821 - protein, 24 aa, Staphylococcus aureus
NDDFTHWRKIMGAAPISEEERENM

SEQ ID NO: 1670822 - protein, 21 aa, Staphylococcus aureus
NDDLLLWIVYKIYKEISDFII

SEQ ID NO: 1670823 - protein, 21 aa, Staphylococcus aureus
NDDRIKYLEGMYAEKDVTVVK

SEQ ID NO: 1670824 - protein, 17 aa, Staphylococcus aureus
NDERVRGLFQFYGAGTG

SEQ ID NO: 1670825 - protein, 29 aa, Staphylococcus aureus
NDEYTKYKIGGTWYPFYKKNDGDLTKRFV

SEQ ID NO: 1670826 - protein, 28 aa, Staphylococcus aureus
NDFKFERPFIVAISIMYLFEMLSISNEE

SEQ ID NO: 1670827 - protein, 19 aa, Staphylococcus aureus
NDGDAVFFYNFRPDRAAQL

SEQ ID NO: 1670828 - protein, 26 aa, Staphylococcus aureus
NDHFARKVSNHWLRLMSVNEEGRFKS

SEQ ID NO: 1670829 - protein, 17 aa, Staphylococcus aureus
NDIPMWLHECITSVNEE

SEQ ID NO: 1670830 - protein, 19 aa, Staphylococcus aureus
NDIPMWLRECIASVNEEYQ

SEQ ID NO: 1670831 - protein, 29 aa, Staphylococcus aureus
NDIQRSTNFSIVWILPISSIDNMPIKDMV

SEQ ID NO: 1670832 - protein, 21 aa, Staphylococcus aureus
NDIRVGKVLYMTVDEVSDEKV

SEQ ID NO: 1670833 - protein, 18 aa, Staphylococcus aureus
NDLAWLVDVMLPRMKAHG

SEQ ID NO: 1670834 - protein, 17 aa, Staphylococcus aureus
NDLAWLVDVMLQRMKAH

SEQ ID NO: 1670835 - protein, 17 aa, Staphylococcus aureus
NDLAWLVGVMLQRMKAH

SEQ ID NO: 1670836 - protein, 35 aa, Staphylococcus aureus
NDLIGKFCHLVLKWKFNKDEGKYFTDFSFIKPYKK

SEQ ID NO: 1670837 - protein, 24 aa, Staphylococcus aureus
NDLQICCKSYFYGANQRFKTSSLF

SEQ ID NO: 1670838 - protein, 24 aa, Staphylococcus aureus
NDLQLPIGILPGGTFNDFTKTLNI

SEQ ID NO: 1670839 - protein, 23 aa, Staphylococcus aureus
NDMGRLRGKIFYQSGERPRIVSR

SEQ ID NO: 1670840 - protein, 30 aa, Staphylococcus aureus
NDNAKLCYIYKFRARFAVLAHLLTQREGLP

SEQ ID NO: 1670841 - protein, 18 aa, Staphylococcus aureus
NDNDCLKIIEKITKKERT

SEQ ID NO: 1670842 - protein, 18 aa, Staphylococcus aureus
NDNIKVILPKVQVKPAAR

SEQ ID NO: 1670843 - protein, 22 aa, Staphylococcus aureus
NDRLLKHDLLFHDMFVNDDWKK

SEQ ID NO: 1670844 - protein, 22 aa, Staphylococcus aureus
NDSDLNWIYLVKNLRNAGVSIE

SEQ ID NO: 1670845 - protein, 23 aa, Staphylococcus aureus
NDSIKAIILSFAYDKNKFKVIGP

SEQ ID NO: 1670846 - protein, 23 aa, Staphylococcus aureus
NDTFKILGVGVDFNDEKQPFWTE

SEQ ID NO: 1670847 - protein, 35 aa, Staphylococcus aureus
NDTVASMIIEFVEWVNTLEFFKNWKKQPGKPLDTQ

SEQ ID NO: 1670848 - protein, 18 aa, Staphylococcus aureus
NDTYFKFIRSIMKKSSRK

SEQ ID NO: 1670849 - protein, 17 aa, Staphylococcus aureus
NDVAFVYPKGQSEPIVL

SEQ ID NO: 1670850 - protein, 24 aa, Staphylococcus aureus
NDVLKACVDLSIQYIPQRLLPDKA

SEQ ID NO: 1670851 - protein, 17 aa, Staphylococcus aureus
NDVVKNFTANGLLSIGV

SEQ ID NO: 1670852 - protein, 27 aa, Staphylococcus aureus
NDWGECASRIVSIYRYISKLQEQYQFH

SEQ ID NO: 1670853 - protein, 26 aa, Staphylococcus aureus
NDWGECATRIVSIYRYISKLQQHFQF

SEQ ID NO: 1670854 - protein, 23 aa, Staphylococcus aureus
NDWYTNTFVDLVLSMKGYSYHVE

SEQ ID NO: 1670855 - protein, 22 aa, Staphylococcus aureus
NDYNLNIPRYVDTFEEEAPIDL

SEQ ID NO: 1670856 - protein, 17 aa, Staphylococcus aureus
NECHKSYTKSDVIDRTL

SEQ ID NO: 1670857 - protein, 27 aa, Staphylococcus aureus
NEDIPFSGAFSIKFRLSKQTITCTDYK

SEQ ID NO: 1670858 - protein, 26 aa, Staphylococcus aureus
NEDIWRHLSKIWYTDRQLLINNLISQ

SEQ ID NO: 1670859 - protein, 29 aa, Staphylococcus aureus
NEDKVEWIILAGYMRLIGPDLLDSFEGKI

SEQ ID NO: 1670860 - protein, 27 aa, Staphylococcus aureus
NEEKGNDIGPVRAAYEEGLNNINAATT

SEQ ID NO: 1670861 - protein, 18 aa, Staphylococcus aureus
NEEQRNGFIQSLKDDPSQ

SEQ ID NO: 1670862 - protein, 23 aa, Staphylococcus aureus
NEERCLMCGHSVFVDDKDIFELI

SEQ ID NO: 1670863 - protein, 24 aa, Staphylococcus aureus
NEGLKQLVQCGANIVGLNCHHGPH

SEQ ID NO: 1670864 - protein, 22 aa, Staphylococcus aureus
NEGLPLPDLIIVDGGKGHMNGV

SEQ ID NO: 1670865 - protein, 26 aa, Staphylococcus aureus
NEHFARKASNHWLRLMSVNEEGRFKS

SEQ ID NO: 1670866 - protein, 17 aa, Staphylococcus aureus
NEIGEKLTSAEVIDELR

SEQ ID NO: 1670867 - protein, 24 aa, Staphylococcus aureus
NEIHMWDYKALPAVFGGKNVEIHD

SEQ ID NO: 1670868 - protein, 17 aa, Staphylococcus aureus
NEIINRIDLKKETISEN

SEQ ID NO: 1670869 - protein, 21 aa, Staphylococcus aureus
NEIISYAVIGGFEEGIDIENL

SEQ ID NO: 1670870 - protein, 17 aa, Staphylococcus aureus
NEIKDIVLNGGLIGLPT

SEQ ID NO: 1670871 - protein, 26 aa, Staphylococcus aureus
NEIMQRLGRAFALLKVTGEVLNDIDG

SEQ ID NO: 1670872 - protein, 23 aa, Staphylococcus aureus
NEISGMIPVEWEQVFTIAYVTDQ

SEQ ID NO: 1670873 - protein, 18 aa, Staphylococcus aureus
NEIYAMGVAVDMMVEYEI

SEQ ID NO: 1670874 - protein, 23 aa, Staphylococcus aureus
NEKAQAEAGGRPNYKTTGYSQSN

SEQ ID NO: 1670875 - protein, 17 aa, Staphylococcus aureus
NEKKKVTAFDFFQDNGF

SEQ ID NO: 1670876 - protein, 17 aa, Staphylococcus aureus
NEKRYPVKMVDNKVIPT

SEQ ID NO: 1670877 - protein, 22 aa, Staphylococcus aureus
NEKYQTPHIMSIDDYEFDYNLT

SEQ ID NO: 1670878 - protein, 17 aa, Staphylococcus aureus
NELEALSTYLVSLDQDR

SEQ ID NO: 1670879 - protein, 20 aa, Staphylococcus aureus
NELKDILFGPTITVKALLNM

SEQ ID NO: 1670880 - protein, 17 aa, Staphylococcus aureus
NELKFLFNFYTEEEISE

SEQ ID NO: 1670881 - protein, 18 aa, Staphylococcus aureus
NELKRRVNGLAKVNKIKG

SEQ ID NO: 1670882 - protein, 20 aa, Staphylococcus aureus
NELRLKSIRKIVKRINTWSD

SEQ ID NO: 1670883 - protein, 21 aa, Staphylococcus aureus
NELWLKTVENLMDRFIEKKYW

SEQ ID NO: 1670884 - protein, 21 aa, Staphylococcus aureus
NEMRKLKGLKPLKINSDLAHI

SEQ ID NO: 1670885 - protein, 17 aa, Staphylococcus aureus
NEMVLTLPKNEEWDQQF

SEQ ID NO: 1670886 - protein, 18 aa, Staphylococcus aureus
NENCNPPLNSREFNATFE

SEQ ID NO: 1670887 - protein, 17 aa, Staphylococcus aureus
NENKKKYGFESATEDKQ

SEQ ID NO: 1670888 - protein, 27 aa, Staphylococcus aureus
NEPALELVEGLKLVTEFIQDENATQED

SEQ ID NO: 1670889 - protein, 23 aa, Staphylococcus aureus
NEPNKAFLFGINYVIVSDDQEYR

SEQ ID NO: 1670890 - protein, 18 aa, Staphylococcus aureus
NEQIKWYADMGVIDKEEY

SEQ ID NO: 1670891 - protein, 24 aa, Staphylococcus aureus
NEQIKWYVDMGVIDKEEYALITGE

SEQ ID NO: 1670892 - protein, 33 aa, Staphylococcus aureus
NERWLRKVINSLVYDYGYPIGCSYKPSERGYYI

SEQ ID NO: 1670893 - protein, 20 aa, Staphylococcus aureus
NESFTGVEFFNTVFKGTSYK

SEQ ID NO: 1670894 - protein, 19 aa, Staphylococcus aureus
NESYIKWSQGLKDKFIKSE

SEQ ID NO: 1670895 - protein, 36 aa, Staphylococcus aureus
NETNAMPGFTAFSMYPKLWGNMGLSYPELITKLIEL

SEQ ID NO: 1670896 - protein, 29 aa, Staphylococcus aureus
NEVFLRRCPNLKWIAWFATGVNILPLDYI

SEQ ID NO: 1670897 - protein, 21 aa, Staphylococcus aureus
NEVIKDFPILDQKFNGKRLAY

SEQ ID NO: 1670898 - protein, 23 aa, Staphylococcus aureus
NEVKKRMVISDAYVYTKSNHIEN

SEQ ID NO: 1670899 - protein, 22 aa, Staphylococcus aureus
NEVLAYDVIPYIMKKLNAPFTY

SEQ ID NO: 1670900 - protein, 20 aa, Staphylococcus aureus
NEVMTLPSIKVVEHPDLFVE

SEQ ID NO: 1670901 - protein, 18 aa, Staphylococcus aureus
NEVVKIDLYTSVPNKQNI

SEQ ID NO: 1670902 - protein, 26 aa, Staphylococcus aureus
NFALKNGYCDIQICGYNSLYKSHSTF

SEQ ID NO: 1670903 - protein, 24 aa, Staphylococcus aureus
NFDDAKRLANALINSDNTNVNDIN

SEQ ID NO: 1670904 - protein, 19 aa, Staphylococcus aureus
NFDKYNSFMLFGVQVVQTG

SEQ ID NO: 1670905 - protein, 24 aa, Staphylococcus aureus
NFESLKRQFDFEAVDKQHITASFE

SEQ ID NO: 1670906 - protein, 22 aa, Staphylococcus aureus
NFFYCGYFKTSVYRDKQSWEKI

SEQ ID NO: 1670907 - protein, 17 aa, Staphylococcus aureus
NFIEYLAKSKKYEDIAV

SEQ ID NO: 1670908 - protein, 22 aa, Staphylococcus aureus
NFKEVTNVTGIVLTKLDGTAKG

SEQ ID NO: 1670909 - protein, 18 aa, Staphylococcus aureus
NFKFLKRMINVMMCYCVL

SEQ ID NO: 1670910 - protein, 17 aa, Staphylococcus aureus
NFNEIFRERMPKYINHQ

SEQ ID NO: 1670911 - protein, 25 aa, Staphylococcus aureus
NFNGGRHYGIDFGMPTGTNVYAVKG

SEQ ID NO: 1670912 - protein, 21 aa, Staphylococcus aureus
NFNGKKEWELFYLYKELIQTF

SEQ ID NO: 1670913 - protein, 19 aa, Staphylococcus aureus
NFNPEFLSVLSHRQDGAKK

SEQ ID NO: 1670914 - protein, 25 aa, Staphylococcus aureus
NFTKSIAIEYGREGIRANAIAPGTI

SEQ ID NO: 1670915 - protein, 21 aa, Staphylococcus aureus
NGAEHSKTINVVRGQNNQWTI

SEQ ID NO: 1670916 - protein, 17 aa, Staphylococcus aureus
NGDIPWITTGDIHNIKR

SEQ ID NO: 1670917 - protein, 18 aa, Staphylococcus aureus
NGDKLGALTDRNGLRPGR

SEQ ID NO: 1670918 - protein, 21 aa, Staphylococcus aureus
NGDLFRFYKNPDFKKVNPSKY

SEQ ID NO: 1670919 - protein, 23 aa, Staphylococcus aureus
NGEYGHEVLKMYADNKTINSDKL

SEQ ID NO: 1670920 - protein, 20 aa, Staphylococcus aureus
NGFAVIYLISQRLVKKSLDD

SEQ ID NO: 1670921 - protein, 19 aa, Staphylococcus aureus
NGGGIYECLLSKTSSTTLR

SEQ ID NO: 1670922 - protein, 23 aa, Staphylococcus aureus
NGGPAGDLYVVFRVKPSEKFKRD

SEQ ID NO: 1670923 - protein, 19 aa, Staphylococcus aureus
NGGPRRKYYMITESGLKEL

SEQ ID NO: 1670924 - protein, 21 aa, Staphylococcus aureus
NGIRYKIVDTRAYRHETSYYI

SEQ ID NO: 1670925 - protein, 24 aa, Staphylococcus aureus
NGISKLKETGRMAIIHNGSALFSG

SEQ ID NO: 1670926 - protein, 17 aa, Staphylococcus aureus
NGKIVVANKAYYEQFNI

SEQ ID NO: 1670927 - protein, 19 aa, Staphylococcus aureus
NGLIKIMTFAPEVEGAKEA

SEQ ID NO: 1670928 - protein, 25 aa, Staphylococcus aureus
NGMATMKYDMCGAANVVGIIEAASR

SEQ ID NO: 1670929 - protein, 28 aa, Staphylococcus aureus
NGMKYYMVGSTYRFKKFDVDEFMEQLTA

SEQ ID NO: 1670930 - protein, 21 aa, Staphylococcus aureus
NGNAHSGYQLTGFNENKKVLL

SEQ ID NO: 1670931 - protein, 19 aa, Staphylococcus aureus
NGNVPIFINIGEWDGDDDK

SEQ ID NO: 1670932 - protein, 18 aa, Staphylococcus aureus
NGNVPIFINIGEWDGDDE

SEQ ID NO: 1670933 - protein, 20 aa, Staphylococcus aureus
NGNVPIFINIGEWDGDDEEV

SEQ ID NO: 1670934 - protein, 21 aa, Staphylococcus aureus
NGNVPIFINIGEWDGGDEGLD

SEQ ID NO: 1670935 - protein, 20 aa, Staphylococcus aureus
NGNVPMFINIGEWDGDDEEL

SEQ ID NO: 1670936 - protein, 25 aa, Staphylococcus aureus
NGQFKGAMLKAGFDVKDKTQLNWHF

SEQ ID NO: 1670937 - protein, 24 aa, Staphylococcus aureus
NGQFKGAMLKAGFDVKNKTQLNWH

SEQ ID NO: 1670938 - protein, 26 aa, Staphylococcus aureus
NGQLERFKSNFYRDKLGYLFQNYGLI

SEQ ID NO: 1670939 - protein, 18 aa, Staphylococcus aureus
NGQLKPGYNLQIATNSQF

SEQ ID NO: 1670940 - protein, 21 aa, Staphylococcus aureus
NGQTIKFKGFMTLYVETKDDS

SEQ ID NO: 1670941 - protein, 26 aa, Staphylococcus aureus
NGRHELLDSVFLWQSGQKYRIPVHDA

SEQ ID NO: 1670942 - protein, 21 aa, Staphylococcus aureus
NGRPMKRAISFIDSIENSKKI

SEQ ID NO: 1670943 - protein, 19 aa, Staphylococcus aureus
NGRRARKIFDLARQGQIQG

SEQ ID NO: 1670944 - protein, 20 aa, Staphylococcus aureus
NGSLIKAFRNCGFDIDKIIF

SEQ ID NO: 1670945 - protein, 17 aa, Staphylococcus aureus
NGSPVIMGYMIRSQEMP

SEQ ID NO: 1670946 - protein, 20 aa, Staphylococcus aureus
NGTHEYFIYSGVFIENKNII

SEQ ID NO: 1670947 - protein, 19 aa, Staphylococcus aureus
NGVGFSLTYFTEGVEFGSK

SEQ ID NO: 1670948 - protein, 31 aa, Staphylococcus aureus
NGVNIGQRRLFEWLRQNGFLIKRKGVDYNMP

SEQ ID NO: 1670949 - protein, 21 aa, Staphylococcus aureus
NGYLFIFVIDYYRHHLVDQHA

SEQ ID NO: 1670950 - protein, 23 aa, Staphylococcus aureus
NGYPMPSVGLGVYKISDEDMTKV

SEQ ID NO: 1670951 - protein, 18 aa, Staphylococcus aureus
NHIECFIHIDLIKGLSHD

SEQ ID NO: 1670952 - protein, 26 aa, Staphylococcus aureus
NHIHLPKINASDFLMYYANETEKQNN

SEQ ID NO: 1670953 - protein, 26 aa, Staphylococcus aureus
NHISQFKAGVSVEVFIGGTDIEKDRQ

SEQ ID NO: 1670954 - protein, 27 aa, Staphylococcus aureus
NHIYSEYFFRDLLNIVYGYSLENHNKK

SEQ ID NO: 1670955 - protein, 28 aa, Staphylococcus aureus
NHIYSEYFFRDLLNIVYGYSLENHNKKQ

SEQ ID NO: 1670956 - protein, 26 aa, Staphylococcus aureus
NHLYLKHIFESMPYLYGDDINKLQGR

SEQ ID NO: 1670957 - protein, 20 aa, Staphylococcus aureus
NHPPMIAIAVQRAGGKRKDT

SEQ ID NO: 1670958 - protein, 25 aa, Staphylococcus aureus
NHVDARYNLGLALFMKNENIDEVIT

SEQ ID NO: 1670959 - protein, 20 aa, Staphylococcus aureus
NHWHLSREELNEFINSNDLG

SEQ ID NO: 1670960 - protein, 17 aa, Staphylococcus aureus
NIDLNHYLEIIIDKLTK

SEQ ID NO: 1670961 - protein, 19 aa, Staphylococcus aureus
NIEKGRMMVESEIKEQGFR

SEQ ID NO: 1670962 - protein, 17 aa, Staphylococcus aureus
NIFEISKDISIEEIGHI

SEQ ID NO: 1670963 - protein, 20 aa, Staphylococcus aureus
NIFFARVALELGSKKFEKGM

SEQ ID NO: 1670964 - protein, 17 aa, Staphylococcus aureus
NIIDACAETDYKLKSSY

SEQ ID NO: 1670965 - protein, 21 aa, Staphylococcus aureus
NIIFQFPLYWYSSPSLLKKWI

SEQ ID NO: 1670966 - protein, 25 aa, Staphylococcus aureus
NIKHLRLNNIYPIIVHGGGPFINDA

SEQ ID NO: 1670967 - protein, 24 aa, Staphylococcus aureus
NIKKYPNCHQLIWQSALILDTHRL

SEQ ID NO: 1670968 - protein, 19 aa, Staphylococcus aureus
NIMFPMVATINEFREAKAI

SEQ ID NO: 1670969 - protein, 20 aa, Staphylococcus aureus
NINCRCKLLYYIDEDELPTV

SEQ ID NO: 1670970 - protein, 18 aa, Staphylococcus aureus
NINDYTIPTGKKESATTD

SEQ ID NO: 1670971 - protein, 17 aa, Staphylococcus aureus
NINHLSYSHTLAVVGSP

SEQ ID NO: 1670972 - protein, 19 aa, Staphylococcus aureus
NINKYKGFVDLFIIDTPSV

SEQ ID NO: 1670973 - protein, 26 aa, Staphylococcus aureus
NIPLLQVRSKEILAFVNESKETAIKE

SEQ ID NO: 1670974 - protein, 24 aa, Staphylococcus aureus
NIPSRLKALHWHEDMFQIPQQAEL

SEQ ID NO: 1670975 - protein, 17 aa, Staphylococcus aureus
NIQHGSKNIFGLIDRYD

SEQ ID NO: 1670976 - protein, 24 aa, Staphylococcus aureus
NIQYLGGVRDNWGVTANGRIDTLN

SEQ ID NO: 1670977 - protein, 17 aa, Staphylococcus aureus
NIRAHVGDFIFTSKLVD

SEQ ID NO: 1670978 - protein, 18 aa, Staphylococcus aureus
NIRIKRINGDIIVEKGLK

SEQ ID NO: 1670979 - protein, 29 aa, Staphylococcus aureus
NISPYKGIVRIGSATGFVVGKNTILTNKH

SEQ ID NO: 1670980 - protein, 20 aa, Staphylococcus aureus
NIVLVPKLLKWTEEEKDKRA

SEQ ID NO: 1670981 - protein, 17 aa, Staphylococcus aureus
NIVMTRYNLGVLEDSLS

SEQ ID NO: 1670982 - protein, 18 aa, Staphylococcus aureus
NIWRSMKDLINYDLIKQG

SEQ ID NO: 1670983 - protein, 24 aa, Staphylococcus aureus
NIYFSQEGYSIWFEEFERDQLQRR

SEQ ID NO: 1670984 - protein, 28 aa, Staphylococcus aureus
NIYRYLRNDLKLGLELTAVALNPHDLRD

SEQ ID NO: 1670985 - protein, 17 aa, Staphylococcus aureus
NKAAEKLVNAMNKSEDA

SEQ ID NO: 1670986 - protein, 20 aa, Staphylococcus aureus
NKADALKAITALKLQMDEEL

SEQ ID NO: 1670987 - protein, 23 aa, Staphylococcus aureus
NKANNRFSHVAFIKPNNGKTTSV

SEQ ID NO: 1670988 - protein, 18 aa, Staphylococcus aureus
NKCYLGLHSHIDWETLTD

SEQ ID NO: 1670989 - protein, 26 aa, Staphylococcus aureus
NKDALLYICTKFVPIINSIGFNTHDG

SEQ ID NO: 1670990 - protein, 18 aa, Staphylococcus aureus
NKDVWYKSSVGLLNSLLL

SEQ ID NO: 1670991 - protein, 18 aa, Staphylococcus aureus
NKEIFKQRIHDYFEQHSS

SEQ ID NO: 1670992 - protein, 27 aa, Staphylococcus aureus
NKEPYRIGLKLSNGGWVYVQGLTHYEV

SEQ ID NO: 1670993 - protein, 24 aa, Staphylococcus aureus
NKERFNLFLDEQFEMGIDIDTLVK

SEQ ID NO: 1670994 - protein, 18 aa, Staphylococcus aureus
NKEVALRQLGVIKESIDP

SEQ ID NO: 1670995 - protein, 21 aa, Staphylococcus aureus
NKFAAELAKSFQVVLIDLRGH

SEQ ID NO: 1670996 - protein, 20 aa, Staphylococcus aureus
NKFGLGFSVNPENLKGIGDE

SEQ ID NO: 1670997 - protein, 18 aa, Staphylococcus aureus
NKFIKDIFIFENNRRKPI

SEQ ID NO: 1670998 - protein, 17 aa, Staphylococcus aureus
NKFKGFETLYIINENQV

SEQ ID NO: 1670999 - protein, 21 aa, Staphylococcus aureus
NKFKIQCVTLICYYNDNLQNY

SEQ ID NO: 1671000 - protein, 23 aa, Staphylococcus aureus
NKFKIQGVILICYYYDNLQNYMK

SEQ ID NO: 1671001 - protein, 17 aa, Staphylococcus aureus
NKFKSFETSYIINENQV

SEQ ID NO: 1671002 - protein, 20 aa, Staphylococcus aureus
NKFLWFLMNTDLIRNKIKGM

SEQ ID NO: 1671003 - protein, 25 aa, Staphylococcus aureus
NKGGCPKCRPAINYYLNMVYPNDHE

SEQ ID NO: 1671004 - protein, 17 aa, Staphylococcus aureus
NKGIKILPFDANNIKED

SEQ ID NO: 1671005 - protein, 23 aa, Staphylococcus aureus
NKGKLKGIFLTHGHEHAIGAVSY

SEQ ID NO: 1671006 - protein, 17 aa, Staphylococcus aureus
NKHHMYQSTGTVLSING

SEQ ID NO: 1671007 - protein, 19 aa, Staphylococcus aureus
NKHLCEYLGYGEQKIIKLK

SEQ ID NO: 1671008 - protein, 22 aa, Staphylococcus aureus
NKIDFSKDFNFKVRVANNHQSN

SEQ ID NO: 1671009 - protein, 28 aa, Staphylococcus aureus
NKIKAFVKKVEMISGMTFADLDTLVDGL

SEQ ID NO: 1671010 - protein, 17 aa, Staphylococcus aureus
NKIKPDLAIAVDVGIAY

SEQ ID NO: 1671011 - protein, 25 aa, Staphylococcus aureus
NKIVTCVKGKFSWGHINSDQRLTKP

SEQ ID NO: 1671012 - protein, 25 aa, Staphylococcus aureus
NKKATARNEITAILNNKLQEIQATP

SEQ ID NO: 1671013 - protein, 22 aa, Staphylococcus aureus
NKKDIRTIIHFHLSISPSNYIQ

SEQ ID NO: 1671014 - protein, 20 aa, Staphylococcus aureus
NKKKGVGVATALLINEGINV

SEQ ID NO: 1671015 - protein, 32 aa, Staphylococcus aureus
NKKKPEAYTDFDILKRTHLLSTNYHYSVNLKD

SEQ ID NO: 1671016 - protein, 17 aa, Staphylococcus aureus
NKKKYGFESATEDKQKK

SEQ ID NO: 1671017 - protein, 23 aa, Staphylococcus aureus
NKKLDFAKHLSLGRMRKLNHPIP

SEQ ID NO: 1671018 - protein, 23 aa, Staphylococcus aureus
NKKNLCMTILDFIVELERETELK

SEQ ID NO: 1671019 - protein, 22 aa, Staphylococcus aureus
NKKPLRRLWISSVTKKAIQQSF

SEQ ID NO: 1671020 - protein, 22 aa, Staphylococcus aureus
NKKPTGRLIISFDGTDFSDIND

SEQ ID NO: 1671021 - protein, 21 aa, Staphylococcus aureus
NKKSMKNYNWEYFKAQINQKL

SEQ ID NO: 1671022 - protein, 18 aa, Staphylococcus aureus
NKKTPVVSLEYDFEHKQR

SEQ ID NO: 1671023 - protein, 18 aa, Staphylococcus aureus
NKKVILVSGGARSIKDYY

SEQ ID NO: 1671024 - protein, 29 aa, Staphylococcus aureus
NKLIRPETLFKYEYFKKYVVEDIHNNIEV

SEQ ID NO: 1671025 - protein, 25 aa, Staphylococcus aureus
NKLKSLGLNSNWDMLFIVFSIHLID

SEQ ID NO: 1671026 - protein, 34 aa, Staphylococcus aureus
NKLKSLGLNSNWDMLFIVFSIHLIDILKKLSHEE

SEQ ID NO: 1671027 - protein, 19 aa, Staphylococcus aureus
NKLVKSLFKVGGNVQDRAI

SEQ ID NO: 1671028 - protein, 19 aa, Staphylococcus aureus
NKNDMDWIKKNYDLYSKLI

SEQ ID NO: 1671029 - protein, 18 aa, Staphylococcus aureus
NKNFKMFIVIKNTKVIIL

SEQ ID NO: 1671030 - protein, 20 aa, Staphylococcus aureus
NKNFKMFIVMKNTKVIILKN

SEQ ID NO: 1671031 - protein, 19 aa, Staphylococcus aureus
NKNGSLAITGRVSMNQAFN

SEQ ID NO: 1671032 - protein, 24 aa, Staphylococcus aureus
NKNIFPIYICKEINEDSRRIILNN

SEQ ID NO: 1671033 - protein, 23 aa, Staphylococcus aureus
NKPDAKLFILLVGERPEEVTDLE

SEQ ID NO: 1671034 - protein, 17 aa, Staphylococcus aureus
NKPKVLFADSVAGSDNS

SEQ ID NO: 1671035 - protein, 18 aa, Staphylococcus aureus
NKQEFLKDIEEIQLKNSD

SEQ ID NO: 1671036 - protein, 17 aa, Staphylococcus aureus
NKRGYKMLPHFQIGMFE

SEQ ID NO: 1671037 - protein, 22 aa, Staphylococcus aureus
NKRGYKMLPHFQIGMFEDQLFV

SEQ ID NO: 1671038 - protein, 19 aa, Staphylococcus aureus
NKRNHLVHSSKIAEDEKKV

SEQ ID NO: 1671039 - protein, 21 aa, Staphylococcus aureus
NKRVDIMLDHGLFREVQQLVE

SEQ ID NO: 1671040 - protein, 26 aa, Staphylococcus aureus
NKTTTTFKYEVTRNSMSDSVSTSGST

SEQ ID NO: 1671041 - protein, 23 aa, Staphylococcus aureus
NKVDGKFSHFAYMKPNNQSLSSV

SEQ ID NO: 1671042 - protein, 17 aa, Staphylococcus aureus
NKVEVIKEIIKKGRGGN

SEQ ID NO: 1671043 - protein, 18 aa, Staphylococcus aureus
NKWLKSRGIIASESMAED

SEQ ID NO: 1671044 - protein, 17 aa, Staphylococcus aureus
NKWYFSIRYKDVYGNNK

SEQ ID NO: 1671045 - protein, 25 aa, Staphylococcus aureus
NKYKLKRNDILFARTGASTGKSYIH

SEQ ID NO: 1671046 - protein, 25 aa, Staphylococcus aureus
NLAIMGRYVLTPEIFDYLKTQKEGA

SEQ ID NO: 1671047 - protein, 24 aa, Staphylococcus aureus
NLAIPRAAFKDIVKMMDYGEGLKK

SEQ ID NO: 1671048 - protein, 25 aa, Staphylococcus aureus
NLCIEMRSDIPLARGLGSSASALVG

SEQ ID NO: 1671049 - protein, 28 aa, Staphylococcus aureus
NLEHALKIELDFYFPLLKSWSKKKKIEM

SEQ ID NO: 1671050 - protein, 18 aa, Staphylococcus aureus
NLEIPRNFFDLVTDNEKS

SEQ ID NO: 1671051 - protein, 29 aa, Staphylococcus aureus
NLERAMSGNGRFGGHFVLGHVDELGTVSK

SEQ ID NO: 1671052 - protein, 17 aa, Staphylococcus aureus
NLERKKLIYRYVDAQDT

SEQ ID NO: 1671053 - protein, 22 aa, Staphylococcus aureus
NLESRGAVLEINRNTRTAKGHY

SEQ ID NO: 1671054 - protein, 23 aa, Staphylococcus aureus
NLEVPVKVYPVANAKAPSRDVKG

SEQ ID NO: 1671055 - protein, 23 aa, Staphylococcus aureus
NLFKTRGAVVEEVWVNGHEITET

SEQ ID NO: 1671056 - protein, 25 aa, Staphylococcus aureus
NLFSAVKIYGIFKHMHVRMMPAQQP

SEQ ID NO: 1671057 - protein, 27 aa, Staphylococcus aureus
NLFSAVKIYGTFKYMHVRMMPAQQPPY

SEQ ID NO: 1671058 - protein, 24 aa, Staphylococcus aureus
NLFSEIIFLDAISLRTFENYTLDY

SEQ ID NO: 1671059 - protein, 20 aa, Staphylococcus aureus
NLFSLKGALWTLAQEVYQEW

SEQ ID NO: 1671060 - protein, 25 aa, Staphylococcus aureus
NLFVLLCLANSMGIDMTESFNETMK

SEQ ID NO: 1671061 - protein, 17 aa, Staphylococcus aureus
NLGDYVWEDTNKDGKQD

SEQ ID NO: 1671062 - protein, 18 aa, Staphylococcus aureus
NLGLLPYFEADFIATASD

SEQ ID NO: 1671063 - protein, 21 aa, Staphylococcus aureus
NLIDYDFGIDFAERAIKNEDI

SEQ ID NO: 1671064 - protein, 24 aa, Staphylococcus aureus
NLIPNSKCKLISATGHTIHVEDSD

SEQ ID NO: 1671065 - protein, 25 aa, Staphylococcus aureus
NLIYHLYDDIGLWLAFNNNEDYARY

SEQ ID NO: 1671066 - protein, 18 aa, Staphylococcus aureus
NLKEYRKYYEPLIHKKDK

SEQ ID NO: 1671067 - protein, 24 aa, Staphylococcus aureus
NLKFKSAHSNFYIKEEIANFKSDI

SEQ ID NO: 1671068 - protein, 23 aa, Staphylococcus aureus
NLKFPSDDYITLISRLSEIEEEC

SEQ ID NO: 1671069 - protein, 31 aa, Staphylococcus aureus
NLKNALKLIKLCQTYRVHILSVHDGYFDMDQ

SEQ ID NO: 1671070 - protein, 24 aa, Staphylococcus aureus
NLKVREIKGLITAKILRAQEMNFP

SEQ ID NO: 1671071 - protein, 17 aa, Staphylococcus aureus
NLLDITYTLAFYDNENI

SEQ ID NO: 1671072 - protein, 25 aa, Staphylococcus aureus
NLNESLDQFILLIFYGTFPGGDFTE

SEQ ID NO: 1671073 - protein, 17 aa, Staphylococcus aureus
NLNIPRYVDTFEEEAPI

SEQ ID NO: 1671074 - protein, 21 aa, Staphylococcus aureus
NLPPCKYKKLIAIIAAAKPLK

SEQ ID NO: 1671075 - protein, 21 aa, Staphylococcus aureus
NLQRALGLLLMVEMDIKMLKK

SEQ ID NO: 1671076 - protein, 26 aa, Staphylococcus aureus
NLQVWKKPSSFVIKPLPKNKYPDSIE

SEQ ID NO: 1671077 - protein, 25 aa, Staphylococcus aureus
NLRKRGIKGLVVIGGDGSYRGAQRI

SEQ ID NO: 1671078 - protein, 19 aa, Staphylococcus aureus
NLSPKFVVGYVETKDKHPD

SEQ ID NO: 1671079 - protein, 20 aa, Staphylococcus aureus
NLSQDMCLQRAKLFESLGIK

SEQ ID NO: 1671080 - protein, 19 aa, Staphylococcus aureus
NLTEQIERGTTVAGVQGIQ

SEQ ID NO: 1671081 - protein, 19 aa, Staphylococcus aureus
NLTGYKFNPDAKNFKIYEV

SEQ ID NO: 1671082 - protein, 20 aa, Staphylococcus aureus
NLTNIKINLKGSGFVSHQSI

SEQ ID NO: 1671083 - protein, 29 aa, Staphylococcus aureus
NLTNIKVNLKGSGFVSHQSISKGQKLTEK

SEQ ID NO: 1671084 - protein, 19 aa, Staphylococcus aureus
NLVELEWIYKERPVDDERT

SEQ ID NO: 1671085 - protein, 23 aa, Staphylococcus aureus
NLVKDYATHISIMQQGQLIESGE

SEQ ID NO: 1671086 - protein, 21 aa, Staphylococcus aureus
NLWGRELYEGDILKVVSTKLW

SEQ ID NO: 1671087 - protein, 21 aa, Staphylococcus aureus
NLYCEASLLARRLKAYQQSRV

SEQ ID NO: 1671088 - protein, 26 aa, Staphylococcus aureus
NLYTAGQCTWYAYGMRQKMGKPVSTY

SEQ ID NO: 1671089 - protein, 21 aa, Staphylococcus aureus
NMGILNSRFVVVFLSPNFIES

SEQ ID NO: 1671090 - protein, 25 aa, Staphylococcus aureus
NMGNHSWKALEIIYETYVHYVIPVK

SEQ ID NO: 1671091 - protein, 18 aa, Staphylococcus aureus
NMGYFCVDNLPPVLLPKF

SEQ ID NO: 1671092 - protein, 24 aa, Staphylococcus aureus
NMKEYKDEFLAAPTEIKFLLYFAK

SEQ ID NO: 1671093 - protein, 36 aa, Staphylococcus aureus
NMKNEPEWMLGFRLKSLKLFYKMPMPQWGGDLSELN

SEQ ID NO: 1671094 - protein, 24 aa, Staphylococcus aureus
NMLEKYWFSWLTKNNIPIKRKSST

SEQ ID NO: 1671095 - protein, 17 aa, Staphylococcus aureus
NMPDSLHAIDWIITNKD

SEQ ID NO: 1671096 - protein, 23 aa, Staphylococcus aureus
NMRERALEIGATFHIVSLPDSGT

SEQ ID NO: 1671097 - protein, 17 aa, Staphylococcus aureus
NMSLDFDTNGGYSLNFN

SEQ ID NO: 1671098 - protein, 18 aa, Staphylococcus aureus
NNAFSKDNKRLITSIDLD

SEQ ID NO: 1671099 - protein, 17 aa, Staphylococcus aureus
NNAKTALNGDARLNEAK

SEQ ID NO: 1671100 - protein, 24 aa, Staphylococcus aureus
NNALYASVCMVRLGRLTQNQKLVE

SEQ ID NO: 1671101 - protein, 21 aa, Staphylococcus aureus
NNDLFLRELMCVRKIADEEGI

SEQ ID NO: 1671102 - protein, 17 aa, Staphylococcus aureus
NNEDAFAGLEMVEDEIT

SEQ ID NO: 1671103 - protein, 23 aa, Staphylococcus aureus
NNEGLSSLLLNWSSYQDSIISTE

SEQ ID NO: 1671104 - protein, 17 aa, Staphylococcus aureus
NNEICLSDDGLTINELE

SEQ ID NO: 1671105 - protein, 18 aa, Staphylococcus aureus
NNFPSAHQFLVRNFGTGG

SEQ ID NO: 1671106 - protein, 23 aa, Staphylococcus aureus
NNGFKPLCLNSNFVEIEQTDDYV

SEQ ID NO: 1671107 - protein, 21 aa, Staphylococcus aureus
NNHPPMIAIAVQRAGGKRKDT

SEQ ID NO: 1671108 - protein, 25 aa, Staphylococcus aureus
NNIGAKVFYSALGFDILSFEKNAIK

SEQ ID NO: 1671109 - protein, 29 aa, Staphylococcus aureus
NNIPMGRGMIKWAAFIICTNLIKKSNLIG

SEQ ID NO: 1671110 - protein, 27 aa, Staphylococcus aureus
NNIRSAVYLLLCKMIRQPNFAVLEVSL

SEQ ID NO: 1671111 - protein, 18 aa, Staphylococcus aureus
NNKRIGFKRFCCKVRNIV

SEQ ID NO: 1671112 - protein, 23 aa, Staphylococcus aureus
NNLMLTHAYTMYRKMKLIQAEKW

SEQ ID NO: 1671113 - protein, 22 aa, Staphylococcus aureus
NNLPSFIYYMLSYKGNQKKIKR

SEQ ID NO: 1671114 - protein, 21 aa, Staphylococcus aureus
NNMKDLARMSVGQILNEHDID

SEQ ID NO: 1671115 - protein, 17 aa, Staphylococcus aureus
NNNFLLYLQDFERKDFI

SEQ ID NO: 1671116 - protein, 22 aa, Staphylococcus aureus
NNNIVYWYGWNKQAFNLVSDLV

SEQ ID NO: 1671117 - protein, 24 aa, Staphylococcus aureus
NNPYICVGRAYYIAENYIVTNFDD

SEQ ID NO: 1671118 - protein, 17 aa, Staphylococcus aureus
NNQFLCIAYCNELENQS

SEQ ID NO: 1671119 - protein, 23 aa, Staphylococcus aureus
NNQRSALYITHLTAFIDQLISLE

SEQ ID NO: 1671120 - protein, 19 aa, Staphylococcus aureus
NNTFQDFDINYNGDTKVMT

SEQ ID NO: 1671121 - protein, 17 aa, Staphylococcus aureus
NNYPFPNTFKVLVVSGA

SEQ ID NO: 1671122 - protein, 22 aa, Staphylococcus aureus
NPAMLPKSIWENFKSQNFKNMI

SEQ ID NO: 1671123 - protein, 21 aa, Staphylococcus aureus
NPDEITRALTQVTDAKNGLNG

SEQ ID NO: 1671124 - protein, 26 aa, Staphylococcus aureus
NPDELFDAVLMTIKYIMRESKVNQDD

SEQ ID NO: 1671125 - protein, 26 aa, Staphylococcus aureus
NPDELFDAVLMTIKYIMRESKVNQDN

SEQ ID NO: 1671126 - protein, 20 aa, Staphylococcus aureus
NPDLFYGFQCYDYANMFFMI

SEQ ID NO: 1671127 - protein, 23 aa, Staphylococcus aureus
NPDTGKMQLVYDEHIQLVSKTPK

SEQ ID NO: 1671128 - protein, 17 aa, Staphylococcus aureus
NPHDLRDYFLIQSYYYH

SEQ ID NO: 1671129 - protein, 23 aa, Staphylococcus aureus
NPHKRIVYHRVIELLDKGESISK

SEQ ID NO: 1671130 - protein, 24 aa, Staphylococcus aureus
NPHRLDLRADIVRKYPNVKLTINT

SEQ ID NO: 1671131 - protein, 27 aa, Staphylococcus aureus
NPIPIKALTSYLGFGNYELRLPLVSLK

SEQ ID NO: 1671132 - protein, 24 aa, Staphylococcus aureus
NPLDNEGLLAFGSDLQKQMSQFSH

SEQ ID NO: 1671133 - protein, 52 aa, Staphylococcus aureus
NPLTDMIKFKYPRLFENVRLALNDCWPDLIFPESEIAFIILHFGGSIKNQGN

SEQ ID NO: 1671134 - protein, 45 aa, Staphylococcus aureus
NPLTDMIKFKYPRLFENVRLALNDCWPDLIFPESEIAFVVLHFGG

SEQ ID NO: 1671135 - protein, 39 aa, Staphylococcus aureus
NPLTDMIKFKYPRLFENVRLALNDSWPDLIFPESEIAFI

SEQ ID NO: 1671136 - protein, 22 aa, Staphylococcus aureus
NPMYFIRLNFPNNLSVGNKAKG

SEQ ID NO: 1671137 - protein, 22 aa, Staphylococcus aureus
NPMYFIRLNFPNSLSVGDKAKG

SEQ ID NO: 1671138 - protein, 26 aa, Staphylococcus aureus
NPNVFYELGYRHALERPTITMINKDE

SEQ ID NO: 1671139 - protein, 19 aa, Staphylococcus aureus
NPSGHLINPTQAMDIAYTE

SEQ ID NO: 1671140 - protein, 21 aa, Staphylococcus aureus
NPTRIPYKEIIDYLNEKTGKK

SEQ ID NO: 1671141 - protein, 22 aa, Staphylococcus aureus
NPVRYEIELNYYSPKSKKDTST

SEQ ID NO: 1671142 - protein, 20 aa, Staphylococcus aureus
NPYELLKYDSITIRHAYIEV

SEQ ID NO: 1671143 - protein, 17 aa, Staphylococcus aureus
NQDFKGLVPNINQNDNY

SEQ ID NO: 1671144 - protein, 18 aa, Staphylococcus aureus
NQDFKGLVPNINQNDNYS

SEQ ID NO: 1671145 - protein, 26 aa, Staphylococcus aureus
NQGEVCSAGSRLLVHEKIYDQLLPRL

SEQ ID NO: 1671146 - protein, 24 aa, Staphylococcus aureus
NQGGFLRKLYDTTPFKEGVGIDLA

SEQ ID NO: 1671147 - protein, 26 aa, Staphylococcus aureus
NQHMHVLLCVENAYFRKKENYITQVE

SEQ ID NO: 1671148 - protein, 24 aa, Staphylococcus aureus
NQIFQRERIKKFGAEGIRDKDVHD

SEQ ID NO: 1671149 - protein, 25 aa, Staphylococcus aureus
NQIKKGYCLLVGIGQDSTEQDADVI

SEQ ID NO: 1671150 - protein, 25 aa, Staphylococcus aureus
NQIKKGYCLLVGIGQNSTEQDADVI

SEQ ID NO: 1671151 - protein, 27 aa, Staphylococcus aureus
NQLRNIGYFHGFKGYNFFLNKEEELNF

SEQ ID NO: 1671152 - protein, 18 aa, Staphylococcus aureus
NQLVPRLQEAFSNIEVGD

SEQ ID NO: 1671153 - protein, 24 aa, Staphylococcus aureus
NQMRWENFGALMITHYQRLLNYIT

SEQ ID NO: 1671154 - protein, 20 aa, Staphylococcus aureus
NQPFIKAFNFLTNLLDITYT

SEQ ID NO: 1671155 - protein, 26 aa, Staphylococcus aureus
NQQILGEWILQGVFQLAPREILTGDK

SEQ ID NO: 1671156 - protein, 34 aa, Staphylococcus aureus
NQQLEKSVECYEIYHPLESVGIYVPGGKASYPST

SEQ ID NO: 1671157 - protein, 17 aa, Staphylococcus aureus
NQQVLALESNKKIQKLE

SEQ ID NO: 1671158 - protein, 24 aa, Staphylococcus aureus
NQRFKTSSLFGFTKFSMELHKNKE

SEQ ID NO: 1671159 - protein, 18 aa, Staphylococcus aureus
NQSIYEWIEENADDYDRL

SEQ ID NO: 1671160 - protein, 18 aa, Staphylococcus aureus
NQSPKMNVCEDVIVRCHL

SEQ ID NO: 1671161 - protein, 24 aa, Staphylococcus aureus
NQTIEVGKTMNPVVLTTTDNGTGT

SEQ ID NO: 1671162 - protein, 23 aa, Staphylococcus aureus
NQTSLKLAAAFATGSPVVLKPSE

SEQ ID NO: 1671163 - protein, 23 aa, Staphylococcus aureus
NQVFQFGGAQSIAALTYGTETIP

SEQ ID NO: 1671164 - protein, 17 aa, Staphylococcus aureus
NQVVPFRNGDFITKDYK

SEQ ID NO: 1671165 - protein, 27 aa, Staphylococcus aureus
NQYCSKSYMVRWSKEYSEKHNLNQNVL

SEQ ID NO: 1671166 - protein, 21 aa, Staphylococcus aureus
NQYKFPIAVIEEVLKAKEMYG

SEQ ID NO: 1671167 - protein, 17 aa, Staphylococcus aureus
NQYKTIVDYVADSAKQF

SEQ ID NO: 1671168 - protein, 20 aa, Staphylococcus aureus
NQYQPMGLLLANHVIEQDRR

SEQ ID NO: 1671169 - protein, 27 aa, Staphylococcus aureus
NRDLQAGEIIGLFSYGSGSVGEFYSAT

SEQ ID NO: 1671170 - protein, 24 aa, Staphylococcus aureus
NRENIKKWFGKAWQSVKSTTGSIY

SEQ ID NO: 1671171 - protein, 24 aa, Staphylococcus aureus
NRFHGKIVSKFCAKYFTHINIIND

SEQ ID NO: 1671172 - protein, 17 aa, Staphylococcus aureus
NRFRADSQFLYKSAQRG

SEQ ID NO: 1671173 - protein, 20 aa, Staphylococcus aureus
NRHNGTIINIFDDMSEKDKE

SEQ ID NO: 1671174 - protein, 23 aa, Staphylococcus aureus
NRIPRKDRLLLGTLFLNHVSKMN

SEQ ID NO: 1671175 - protein, 19 aa, Staphylococcus aureus
NRISVGVMYMLKLVHMVDD

SEQ ID NO: 1671176 - protein, 24 aa, Staphylococcus aureus
NRKDIPFDELVLFSSARSAGKEVE

SEQ ID NO: 1671177 - protein, 21 aa, Staphylococcus aureus
NRKIKSKDIGIVFQENKYGDL

SEQ ID NO: 1671178 - protein, 24 aa, Staphylococcus aureus
NRKKVDYKAGISITKEDKKGTISH

SEQ ID NO: 1671179 - protein, 25 aa, Staphylococcus aureus
NRKNIPFDELVLFSSARSAGKEVEF

SEQ ID NO: 1671180 - protein, 28 aa, Staphylococcus aureus
NRKQLKDHDGFKLKASDFQTQPETAIKH

SEQ ID NO: 1671181 - protein, 23 aa, Staphylococcus aureus
NRLKEIKQIIADMFEKYQNDDVY

SEQ ID NO: 1671182 - protein, 20 aa, Staphylococcus aureus
NRLLEIVCVNSGFDLDSLFQ

SEQ ID NO: 1671183 - protein, 17 aa, Staphylococcus aureus
NRLPSYKAMQQRAQNDE

SEQ ID NO: 1671184 - protein, 26 aa, Staphylococcus aureus
NRMAMSHPDIRIALISDGKTILSTNG

SEQ ID NO: 1671185 - protein, 19 aa, Staphylococcus aureus
NRNDIFGVIGYSGAGKSTL

SEQ ID NO: 1671186 - protein, 21 aa, Staphylococcus aureus
NRNELGIALGKGERVNVGITD

SEQ ID NO: 1671187 - protein, 17 aa, Staphylococcus aureus
NRPELQRLLKDANEGQI

SEQ ID NO: 1671188 - protein, 18 aa, Staphylococcus aureus
NRPELQRMLNDAKNGKLD

SEQ ID NO: 1671189 - protein, 18 aa, Staphylococcus aureus
NRPEVRNAFTPKTVSEMI

SEQ ID NO: 1671190 - protein, 26 aa, Staphylococcus aureus
NRPVFQEVLNFLRMGDRLIVESIDRL

SEQ ID NO: 1671191 - protein, 22 aa, Staphylococcus aureus
NRPVFQEVLSFVRMGDRLVVES

SEQ ID NO: 1671192 - protein, 31 aa, Staphylococcus aureus
NRPVLQEALNFLRMGDRFVVESIDCLGRNYD

SEQ ID NO: 1671193 - protein, 20 aa, Staphylococcus aureus
NRRILKVILNEAITNEDFQN

SEQ ID NO: 1671194 - protein, 17 aa, Staphylococcus aureus
NRSINNMALLKKVLNHY

SEQ ID NO: 1671195 - protein, 28 aa, Staphylococcus aureus
NRSMSRDIFFEKALKVIRPVYLNQSTIP

SEQ ID NO: 1671196 - protein, 17 aa, Staphylococcus aureus
NRVNERLTQAINQLVPL

SEQ ID NO: 1671197 - protein, 23 aa, Staphylococcus aureus
NRVSWLEKWQRIEKKGCKEIKCY

SEQ ID NO: 1671198 - protein, 19 aa, Staphylococcus aureus
NRVSWLEKWQRLEKKGRKE

SEQ ID NO: 1671199 - protein, 21 aa, Staphylococcus aureus
NRYNNSDGFETLKTKVNELEK

SEQ ID NO: 1671200 - protein, 22 aa, Staphylococcus aureus
NSAHVTACRLLKKPHIKQYIQE

SEQ ID NO: 1671201 - protein, 28 aa, Staphylococcus aureus
NSANAIIQKPIRTVQEVQSALTNVNRVN

SEQ ID NO: 1671202 - protein, 19 aa, Staphylococcus aureus
NSDFLLQSIIKPALESDFE

SEQ ID NO: 1671203 - protein, 19 aa, Staphylococcus aureus
NSDLLDADFGYAIDASADV

SEQ ID NO: 1671204 - protein, 24 aa, Staphylococcus aureus
NSDVFKCLENGFDTDTLEGIQSSN

SEQ ID NO: 1671205 - protein, 17 aa, Staphylococcus aureus
NSEGMVLHFNRNTRTAT

SEQ ID NO: 1671206 - protein, 17 aa, Staphylococcus aureus
NSEKPEENWLFKLDDVD

SEQ ID NO: 1671207 - protein, 26 aa, Staphylococcus aureus
NSGVILSQLFRGFCKNIESESEINSK

SEQ ID NO: 1671208 - protein, 27 aa, Staphylococcus aureus
NSHLLQFKNGRIIRGKSTLFSFSDLEI

SEQ ID NO: 1671209 - protein, 26 aa, Staphylococcus aureus
NSHLLQFKNGRIIRGKSTLLSFSDLE

SEQ ID NO: 1671210 - protein, 25 aa, Staphylococcus aureus
NSIRAAQELLNFIGDYTIVTILTVV

SEQ ID NO: 1671211 - protein, 22 aa, Staphylococcus aureus
NSITRPSFRVPNDDALIYYEQR

SEQ ID NO: 1671212 - protein, 31 aa, Staphylococcus aureus
NSKLFGHVYIKDCKVRQSFELASPKYTEGLI

SEQ ID NO: 1671213 - protein, 20 aa, Staphylococcus aureus
NSLENLLFGLGIRHLGVKVS

SEQ ID NO: 1671214 - protein, 17 aa, Staphylococcus aureus
NSLSFRAFYALPLLSNK

SEQ ID NO: 1671215 - protein, 29 aa, Staphylococcus aureus
NSNFKGAKWSTRLWNDMELVQKEVERVTS

SEQ ID NO: 1671216 - protein, 29 aa, Staphylococcus aureus
NSPEGKRLLELYKNYKGNITRFVAENDEL

SEQ ID NO: 1671217 - protein, 21 aa, Staphylococcus aureus
NSPYDGAPLERAIAFTRTIED

SEQ ID NO: 1671218 - protein, 30 aa, Staphylococcus aureus
NSRNHWYQWLKHNLTLEGYHVTLFNFESPE

SEQ ID NO: 1671219 - protein, 17 aa, Staphylococcus aureus
NSSIIWGDLGIANILVK

SEQ ID NO: 1671220 - protein, 18 aa, Staphylococcus aureus
NSSIIWGDLGIANILVKS

SEQ ID NO: 1671221 - protein, 25 aa, Staphylococcus aureus
NSYKRGTIIYVDFGINVGSEISGGH

SEQ ID NO: 1671222 - protein, 18 aa, Staphylococcus aureus
NTALDWAHDIAKIAKSVT

SEQ ID NO: 1671223 - protein, 22 aa, Staphylococcus aureus
NTAMTGLKRGVANHNQVVQSDN

SEQ ID NO: 1671224 - protein, 23 aa, Staphylococcus aureus
NTARQGLTLDRQPAFTTLHGASN

SEQ ID NO: 1671225 - protein, 24 aa, Staphylococcus aureus
NTDKAYEIYQIWCVNNGYHHLNKF

SEQ ID NO: 1671226 - protein, 29 aa, Staphylococcus aureus
NTDKPSMLKRIFSRAKSSINEIFSRMQSV

SEQ ID NO: 1671227 - protein, 40 aa, Staphylococcus aureus
NTDKPSMLKRIFSRAKSSINEIFSRMQSVSAQVDRITIQL

SEQ ID NO: 1671228 - protein, 18 aa, Staphylococcus aureus
NTFALFNINLSWIESRPL

SEQ ID NO: 1671229 - protein, 19 aa, Staphylococcus aureus
NTFDSASTFGRKIQNDLLK

SEQ ID NO: 1671230 - protein, 18 aa, Staphylococcus aureus
NTFFKAYLQQKGFNPELM

SEQ ID NO: 1671231 - protein, 22 aa, Staphylococcus aureus
NTGHAYLAYAGKFADKATVLDA

SEQ ID NO: 1671232 - protein, 22 aa, Staphylococcus aureus
NTHRGYFRISREAIEDAKVNVL

SEQ ID NO: 1671233 - protein, 25 aa, Staphylococcus aureus
NTIKGIECIYGLYKKNRRSLQIYRF

SEQ ID NO: 1671234 - protein, 22 aa, Staphylococcus aureus
NTIKGNVNWMRARQHKLIETLF

SEQ ID NO: 1671235 - protein, 17 aa, Staphylococcus aureus
NTKKVANAFGLNEEDTN

SEQ ID NO: 1671236 - protein, 23 aa, Staphylococcus aureus
NTKKYLIKFCQDLIEHIKEHRNQ

SEQ ID NO: 1671237 - protein, 31 aa, Staphylococcus aureus
NTKPRGLFRKKKFSPVVGDIVEFEVQNINEG

SEQ ID NO: 1671238 - protein, 22 aa, Staphylococcus aureus
NTKRSLALFLMAEVDISILSMV

SEQ ID NO: 1671239 - protein, 24 aa, Staphylococcus aureus
NTLKGVECIYGLYKKTRRSLQIYG

SEQ ID NO: 1671240 - protein, 23 aa, Staphylococcus aureus
NTLKNRALTDIGVTSTTAMVNSI

SEQ ID NO: 1671241 - protein, 17 aa, Staphylococcus aureus
NTLLIPIELQLDSRGSK

SEQ ID NO: 1671242 - protein, 19 aa, Staphylococcus aureus
NTLNGAMGTLRNSIQDNTA

SEQ ID NO: 1671243 - protein, 23 aa, Staphylococcus aureus
NTLNQAMHGLRESIQDNAATKAN

SEQ ID NO: 1671244 - protein, 23 aa, Staphylococcus aureus
NTLNQAMHGLRQSIQDNAATKAN

SEQ ID NO: 1671245 - protein, 20 aa, Staphylococcus aureus
NTRFAIARELGRYLYKIKDN

SEQ ID NO: 1671246 - protein, 18 aa, Staphylococcus aureus
NTRIETIKVSEKLSKVDV

SEQ ID NO: 1671247 - protein, 17 aa, Staphylococcus aureus
NTRRNYIDFGISLDKYW

SEQ ID NO: 1671248 - protein, 17 aa, Staphylococcus aureus
NTSDSKYAYVLYPGLSK

SEQ ID NO: 1671249 - protein, 17 aa, Staphylococcus aureus
NTVKQGVNFTDADKAKR

SEQ ID NO: 1671250 - protein, 25 aa, Staphylococcus aureus
NTVTGLPSGLSYDSATNSIIGTPTK

SEQ ID NO: 1671251 - protein, 18 aa, Staphylococcus aureus
NTWRYRISLGKDAETGKY

SEQ ID NO: 1671252 - protein, 29 aa, Staphylococcus aureus
NTYYKRTIKISGLKAMYALKSKDFKKMSE

SEQ ID NO: 1671253 - protein, 24 aa, Staphylococcus aureus
NVAGGGAFGAFVTTDSYGVATTYT

SEQ ID NO: 1671254 - protein, 20 aa, Staphylococcus aureus
NVASFTLAVNRTFTNAQGER

SEQ ID NO: 1671255 - protein, 18 aa, Staphylococcus aureus
NVDGFDFKLAVKKKDHSI

SEQ ID NO: 1671256 - protein, 17 aa, Staphylococcus aureus
NVDGFDFRLRVKKRAYS

SEQ ID NO: 1671257 - protein, 23 aa, Staphylococcus aureus
NVDRIYGTHLWSGYPTGTIHSRA

SEQ ID NO: 1671258 - protein, 18 aa, Staphylococcus aureus
NVEFCYRVSGEACFVFKV

SEQ ID NO: 1671259 - protein, 25 aa, Staphylococcus aureus
NVEFYPVLCGTAFKNKGVQLMLDAV

SEQ ID NO: 1671260 - protein, 25 aa, Staphylococcus aureus
NVEVPVKVYPVANAKAPSRDVKGQN

SEQ ID NO: 1671261 - protein, 25 aa, Staphylococcus aureus
NVEYKEVLTGFKFIAQEIRQLDNHQ

SEQ ID NO: 1671262 - protein, 20 aa, Staphylococcus aureus
NVFKARRDRFEAMLTKVDLP

SEQ ID NO: 1671263 - protein, 23 aa, Staphylococcus aureus
NVFKNLWLIAWEMTYESQVKQKI

SEQ ID NO: 1671264 - protein, 20 aa, Staphylococcus aureus
NVFYWAGANYKNFKTRTFKS

SEQ ID NO: 1671265 - protein, 30 aa, Staphylococcus aureus
NVGDAIVVGNAYGRIRAMVNDLGQRIKTAG

SEQ ID NO: 1671266 - protein, 17 aa, Staphylococcus aureus
NVGSEISGGHFAIVLNK

SEQ ID NO: 1671267 - protein, 17 aa, Staphylococcus aureus
NVIEIDVLENMSRDITS

SEQ ID NO: 1671268 - protein, 20 aa, Staphylococcus aureus
NVIEMYKLKKILGIDDDKED

SEQ ID NO: 1671269 - protein, 24 aa, Staphylococcus aureus
NVIEPRSKLKVKYLVFVDDSVRRY

SEQ ID NO: 1671270 - protein, 17 aa, Staphylococcus aureus
NVINFKNTIVICTSNAG

SEQ ID NO: 1671271 - protein, 24 aa, Staphylococcus aureus
NVIVKAGAMSLVPLLKSNTPFADT

SEQ ID NO: 1671272 - protein, 22 aa, Staphylococcus aureus
NVKEIRLSPTIEEHDFQTKLKN

SEQ ID NO: 1671273 - protein, 24 aa, Staphylococcus aureus
NVKKKEFLSLIPNVTWNYIKTKLE

SEQ ID NO: 1671274 - protein, 18 aa, Staphylococcus aureus
NVKLCPKTRIKYLVGNDD

SEQ ID NO: 1671275 - protein, 25 aa, Staphylococcus aureus
NVKQLKRRYNIPKNASTKVELKGMS

SEQ ID NO: 1671276 - protein, 25 aa, Staphylococcus aureus
NVKQLKRRYNIPSNASTKVELKGMS

SEQ ID NO: 1671277 - protein, 23 aa, Staphylococcus aureus
NVLGVLTRGVWCIDIDVDHEDGK

SEQ ID NO: 1671278 - protein, 18 aa, Staphylococcus aureus
NVLSNLIDLLGIEYGVDT

SEQ ID NO: 1671279 - protein, 17 aa, Staphylococcus aureus
NVMKKIMVIFGTRPEAI

SEQ ID NO: 1671280 - protein, 18 aa, Staphylococcus aureus
NVMKKIMVIFGTRPEAIK

SEQ ID NO: 1671281 - protein, 19 aa, Staphylococcus aureus
NVNEVYSLSGAHFSDEKKI

SEQ ID NO: 1671282 - protein, 18 aa, Staphylococcus aureus
NVNEVYSLTGAHFSDEKK

SEQ ID NO: 1671283 - protein, 31 aa, Staphylococcus aureus
NVPGFRKGKVPRSIFEQRFGVEALYQDAIDI

SEQ ID NO: 1671284 - protein, 19 aa, Staphylococcus aureus
NVPLNKRVSQAYIDSLTNQ

SEQ ID NO: 1671285 - protein, 29 aa, Staphylococcus aureus
NVRVYRDDFRVIFEVQDFGIGIKLEDQQR

SEQ ID NO: 1671286 - protein, 24 aa, Staphylococcus aureus
NVSKSWLYKEYDIRQRIESLRERQ

SEQ ID NO: 1671287 - protein, 19 aa, Staphylococcus aureus
NVSSTARASFYIYNTKEDI

SEQ ID NO: 1671288 - protein, 20 aa, Staphylococcus aureus
NVSSTARASLYIYNTKEDID

SEQ ID NO: 1671289 - protein, 20 aa, Staphylococcus aureus
NVTGSMSFIFIDNDTHDVID

SEQ ID NO: 1671290 - protein, 22 aa, Staphylococcus aureus
NVVRIIVLSGGYSREKANELLK

SEQ ID NO: 1671291 - protein, 20 aa, Staphylococcus aureus
NVYLPGARIRFMRYEGTKEE

SEQ ID NO: 1671292 - protein, 17 aa, Staphylococcus aureus
NYAELRLSVDTSNIEAQ

SEQ ID NO: 1671293 - protein, 18 aa, Staphylococcus aureus
NYAMKFAKNKGWTSPAKA

SEQ ID NO: 1671294 - protein, 19 aa, Staphylococcus aureus
NYDTLLLGIEMSRKTLYSR

SEQ ID NO: 1671295 - protein, 17 aa, Staphylococcus aureus
NYKWMKNIIDSKVYDNE

SEQ ID NO: 1671296 - protein, 20 aa, Staphylococcus aureus
NYLASSYFRSSGYDGFMQDY

SEQ ID NO: 1671297 - protein, 24 aa, Staphylococcus aureus
NYLCEIKSKATIIISSHEHDINKK

SEQ ID NO: 1671298 - protein, 21 aa, Staphylococcus aureus
NYLFEIIDPYSVNQQGNDIGE

SEQ ID NO: 1671299 - protein, 17 aa, Staphylococcus aureus
NYLPLPIVISEAEGVWV

SEQ ID NO: 1671300 - protein, 26 aa, Staphylococcus aureus
NYQARGNVAALGRVNANDSTDHGNFN

SEQ ID NO: 1671301 - protein, 26 aa, Staphylococcus aureus
NYSEDRVMCPLHFAIIDEVDSILIDE

SEQ ID NO: 1671302 - protein, 18 aa, Staphylococcus aureus
NYSINNIILIAGQNPEAT

SEQ ID NO: 1671303 - protein, 20 aa, Staphylococcus aureus
NYVLMTYYNIICHYGEQAFF

SEQ ID NO: 1671304 - protein, 17 aa, Staphylococcus aureus
NYVPSYRYAQIKYEDDD

SEQ ID NO: 1671305 - protein, 24 aa, Staphylococcus aureus
NYYLNFKELRAFVIGNAPAKLTHA

SEQ ID NO: 1671306 - protein, 23 aa, Staphylococcus aureus
NYYMYKKFEVIPEMEYEMEEIKE

SEQ ID NO: 1671307 - protein, 23 aa, Staphylococcus aureus
NYYMYKKFEVIPEMEYKMEEIKE

SEQ ID NO: 1671308 - protein, 23 aa, Staphylococcus aureus
NYYMYKKFGVIPEMKYEMEEIKE

SEQ ID NO: 1671309 - protein, 24 aa, Staphylococcus aureus
NYYNYRKFGIIPEMEYEMEEVKQI

SEQ ID NO: 1671310 - protein, 19 aa, Staphylococcus aureus
PAFEFKQFELFKQSELFVQ

SEQ ID NO: 1671311 - protein, 18 aa, Staphylococcus aureus
PAKAKKGTDILVESLFYN

SEQ ID NO: 1671312 - protein, 17 aa, Staphylococcus aureus
PAKRIKVGNKLNFGNDK

SEQ ID NO: 1671313 - protein, 20 aa, Staphylococcus aureus
PALGICYGMQLTTKLLGGKV

SEQ ID NO: 1671314 - protein, 24 aa, Staphylococcus aureus
PALKEGKVVLCDRYIDSSLAYQGY

SEQ ID NO: 1671315 - protein, 20 aa, Staphylococcus aureus
PAMLPKSIWENFKSQNFENM

SEQ ID NO: 1671316 - protein, 25 aa, Staphylococcus aureus
PARIKCATLAWKALEKGTVAKEGKV

SEQ ID NO: 1671317 - protein, 17 aa, Staphylococcus aureus
PASITAYNNSIRALQSD

SEQ ID NO: 1671318 - protein, 17 aa, Staphylococcus aureus
PATPSRQAVAMPASDVI

SEQ ID NO: 1671319 - protein, 19 aa, Staphylococcus aureus
PAVAFRLFKQLAEERYGKE

SEQ ID NO: 1671320 - protein, 17 aa, Staphylococcus aureus
PAYTGEGKQFFSTQDII

SEQ ID NO: 1671321 - protein, 17 aa, Staphylococcus aureus
PCIVAYKNNDIVGLLTY

SEQ ID NO: 1671322 - protein, 17 aa, Staphylococcus aureus
PDDITRALTQVTDAKNG

SEQ ID NO: 1671323 - protein, 22 aa, Staphylococcus aureus
PDDVEFVYTPYLLKCVTSEQTY

SEQ ID NO: 1671324 - protein, 17 aa, Staphylococcus aureus
PDDYPVQIVTGARSDGV

SEQ ID NO: 1671325 - protein, 17 aa, Staphylococcus aureus
PDEIFPYAPPQGIEELR

SEQ ID NO: 1671326 - protein, 19 aa, Staphylococcus aureus
PDEIFPYASPQGIEELRDL

SEQ ID NO: 1671327 - protein, 17 aa, Staphylococcus aureus
PDFKGKRVLDLGCGYGW

SEQ ID NO: 1671328 - protein, 23 aa, Staphylococcus aureus
PDGLIPLLKIQGLGSKKIAKLYK

SEQ ID NO: 1671329 - protein, 21 aa, Staphylococcus aureus
PDHSLRYYVCPQNMNNARFVC

SEQ ID NO: 1671330 - protein, 24 aa, Staphylococcus aureus
PDIPADSMVRMMELAVQYPDQFER

SEQ ID NO: 1671331 - protein, 19 aa, Staphylococcus aureus
PDIRGNDIAMIFQEPMTAL

SEQ ID NO: 1671332 - protein, 19 aa, Staphylococcus aureus
PDITLLAPIARLLDISLDT

SEQ ID NO: 1671333 - protein, 22 aa, Staphylococcus aureus
PDIVEKLALLKGHEINVCTMQD

SEQ ID NO: 1671334 - protein, 19 aa, Staphylococcus aureus
PDLFYGFQCYDYANMFFMI

SEQ ID NO: 1671335 - protein, 26 aa, Staphylococcus aureus
PDMSGWTKEDVIAFENLTNIKVNLKG

SEQ ID NO: 1671336 - protein, 24 aa, Staphylococcus aureus
PDNTIKAAGGFIIQVMPGAKDGTI

SEQ ID NO: 1671337 - protein, 17 aa, Staphylococcus aureus
PDQFIALKGVGPYTQAA

SEQ ID NO: 1671338 - protein, 18 aa, Staphylococcus aureus
PDQLAIVIVIDIAYNLYS

SEQ ID NO: 1671339 - protein, 18 aa, Staphylococcus aureus
PDQLYYLMSRRISQREAE

SEQ ID NO: 1671340 - protein, 22 aa, Staphylococcus aureus
PDRDIPRFVNLYNQGRLNIDSL

SEQ ID NO: 1671341 - protein, 20 aa, Staphylococcus aureus
PDSLHAIDWIITNKDETETY

SEQ ID NO: 1671342 - protein, 29 aa, Staphylococcus aureus
PDTGFYRFWAQGIFARWTDNPNIEDLIQA

SEQ ID NO: 1671343 - protein, 28 aa, Staphylococcus aureus
PDTGFYRFWTQGIFARWTDNPNIEALIQ

SEQ ID NO: 1671344 - protein, 21 aa, Staphylococcus aureus
PDVAVLRRYWNGRWIEATPND

SEQ ID NO: 1671345 - protein, 22 aa, Staphylococcus aureus
PDVAVLRRYWNGRWIEATPNDV

SEQ ID NO: 1671346 - protein, 23 aa, Staphylococcus aureus
PDVAVLRRYWNGRWIEATPNDVE

SEQ ID NO: 1671347 - protein, 18 aa, Staphylococcus aureus
PEAITFTENASWPLAMPV

SEQ ID NO: 1671348 - protein, 20 aa, Staphylococcus aureus
PEAQEAIKASADNQVESIKD

SEQ ID NO: 1671349 - protein, 21 aa, Staphylococcus aureus
PEDHFVVIVSGAFGNRFKQIT

SEQ ID NO: 1671350 - protein, 18 aa, Staphylococcus aureus
PEDPRPIGVIPDSRGILR

SEQ ID NO: 1671351 - protein, 20 aa, Staphylococcus aureus
PEELRKHLIEKYSIGVIALN

SEQ ID NO: 1671352 - protein, 30 aa, Staphylococcus aureus
PEEYKGLVVSVRVGMEMDRSELLRKLVDVQ

SEQ ID NO: 1671353 - protein, 17 aa, Staphylococcus aureus
PEEYLMLHKKFIKPINK

SEQ ID NO: 1671354 - protein, 20 aa, Staphylococcus aureus
PEGEYSKIYLFSSNLEKITT

SEQ ID NO: 1671355 - protein, 18 aa, Staphylococcus aureus
PEGILCFQESDAINAGIG

SEQ ID NO: 1671356 - protein, 17 aa, Staphylococcus aureus
PEGILCFQESDAINAGV

SEQ ID NO: 1671357 - protein, 18 aa, Staphylococcus aureus
PEGILCFQESDAINAGVG

SEQ ID NO: 1671358 - protein, 18 aa, Staphylococcus aureus
PEGILCFQESDAINTGVG

SEQ ID NO: 1671359 - protein, 17 aa, Staphylococcus aureus
PEIEQYLSIVAGQDVSV

SEQ ID NO: 1671360 - protein, 22 aa, Staphylococcus aureus
PEIRSPKEAYAYLEKLRSIIQY

SEQ ID NO: 1671361 - protein, 19 aa, Staphylococcus aureus
PEKCGLEAVVDWVQVTFQV

SEQ ID NO: 1671362 - protein, 17 aa, Staphylococcus aureus
PEKEFEYGRLLVGQQKR

SEQ ID NO: 1671363 - protein, 20 aa, Staphylococcus aureus
PEKRFNVSEEVYEIFQNTLL

SEQ ID NO: 1671364 - protein, 20 aa, Staphylococcus aureus
PEKRTIGNIIKFIQNNKPNH

SEQ ID NO: 1671365 - protein, 18 aa, Staphylococcus aureus
PEKVKMPNVIGLPKEEAL

SEQ ID NO: 1671366 - protein, 20 aa, Staphylococcus aureus
PEKVQELWLNQSKGAVTIED

SEQ ID NO: 1671367 - protein, 18 aa, Staphylococcus aureus
PELMAEKWRNNPFGKGKL

SEQ ID NO: 1671368 - protein, 30 aa, Staphylococcus aureus
PELNIKYIDCLEVGPTLSTKCFEEEDFERA

SEQ ID NO: 1671369 - protein, 21 aa, Staphylococcus aureus
PELVEGLKLVTEFIQDENATQ

SEQ ID NO: 1671370 - protein, 20 aa, Staphylococcus aureus
PENNKVLVFFVRYGGEFQLK

SEQ ID NO: 1671371 - protein, 20 aa, Staphylococcus aureus
PEPTKLTGDWMNRKVDVDGT

SEQ ID NO: 1671372 - protein, 19 aa, Staphylococcus aureus
PEQLLKPLFQHFKEKYPEV

SEQ ID NO: 1671373 - protein, 21 aa, Staphylococcus aureus
PEQLTNYLLKYDYRDLEIIKA

SEQ ID NO: 1671374 - protein, 29 aa, Staphylococcus aureus
PEQLYKYYYDRGYTLTWDNGLVLYSNKAN

SEQ ID NO: 1671375 - protein, 19 aa, Staphylococcus aureus
PEQMVISTMMLRSMQQAHY

SEQ ID NO: 1671376 - protein, 23 aa, Staphylococcus aureus
PEQMVISTMMLRSMQQAHYDDVN

SEQ ID NO: 1671377 - protein, 18 aa, Staphylococcus aureus
PESKSCIDIKLDHTELKR

SEQ ID NO: 1671378 - protein, 20 aa, Staphylococcus aureus
PESYRKLGKIVANMHKNINS

SEQ ID NO: 1671379 - protein, 22 aa, Staphylococcus aureus
PEVHPGPTLLNVCRIDYAGEFA

SEQ ID NO: 1671380 - protein, 21 aa, Staphylococcus aureus
PEVIGDYVAGPSHVLPTNRTA

SEQ ID NO: 1671381 - protein, 32 aa, Staphylococcus aureus
PEVRDAVFEMMNWWFDKGIDGFRVDAITHIKK

SEQ ID NO: 1671382 - protein, 23 aa, Staphylococcus aureus
PEYSLDEYLRYGFANQKTSVKMT

SEQ ID NO: 1671383 - protein, 18 aa, Staphylococcus aureus
PFDGAPLERAIAFTRTIE

SEQ ID NO: 1671384 - protein, 20 aa, Staphylococcus aureus
PFDLTCTYYSYQFDGENVSR

SEQ ID NO: 1671385 - protein, 19 aa, Staphylococcus aureus
PFEIYEPRFGTIFESKANV

SEQ ID NO: 1671386 - protein, 19 aa, Staphylococcus aureus
PFHTRCPIAQDKCKENIPQ

SEQ ID NO: 1671387 - protein, 22 aa, Staphylococcus aureus
PFIKSNRLKGLSLKDVELSVLK

SEQ ID NO: 1671388 - protein, 17 aa, Staphylococcus aureus
PFPLIVKATDGDVEAIS

SEQ ID NO: 1671389 - protein, 18 aa, Staphylococcus aureus
PFQLVFEPLIGAIAAGNT

SEQ ID NO: 1671390 - protein, 24 aa, Staphylococcus aureus
PFVHAKGGIYVWLETPSGYDSEQF

SEQ ID NO: 1671391 - protein, 18 aa, Staphylococcus aureus
PFWTVDTLFYCTPKKETD

SEQ ID NO: 1671392 - protein, 20 aa, Staphylococcus aureus
PGAWGDWINGGGWLVINGYH

SEQ ID NO: 1671393 - protein, 23 aa, Staphylococcus aureus
PGDKFCKLDELLENEEKRQAFMK

SEQ ID NO: 1671394 - protein, 24 aa, Staphylococcus aureus
PGEGEYAVGLFFSKERILGSEHEA

SEQ ID NO: 1671395 - protein, 23 aa, Staphylococcus aureus
PGEGEYAVGLFFSKERVLGSEHE

SEQ ID NO: 1671396 - protein, 20 aa, Staphylococcus aureus
PGGIIETFGLTALPNAIQLS

SEQ ID NO: 1671397 - protein, 19 aa, Staphylococcus aureus
PGGVIEVFSLTSIPNAIQL

SEQ ID NO: 1671398 - protein, 24 aa, Staphylococcus aureus
PGHTPESISFLLTDEGAGAQVPMG

SEQ ID NO: 1671399 - protein, 24 aa, Staphylococcus aureus
PGITLKIAVSVLIRAIFLKTNAIT

SEQ ID NO: 1671400 - protein, 17 aa, Staphylococcus aureus
PGLNRFAFTLSNADNAY

SEQ ID NO: 1671401 - protein, 17 aa, Staphylococcus aureus
PGLPMGAAPMAYTLWTR

SEQ ID NO: 1671402 - protein, 19 aa, Staphylococcus aureus
PGNGKFLYSPFSIFDNESI

SEQ ID NO: 1671403 - protein, 17 aa, Staphylococcus aureus
PGYIMIYLVPSTRTINS

SEQ ID NO: 1671404 - protein, 31 aa, Staphylococcus aureus; identical to SEQ ID NO: 1578630

SEQ ID NO: 1671405 - protein, 18 aa, Staphylococcus aureus
PHENIIKLPDRFHKKSLP

SEQ ID NO: 1671406 - protein, 24 aa, Staphylococcus aureus
PHFKLMFEEGYRALLPNPLGQTVE

SEQ ID NO: 1671407 - protein, 19 aa, Staphylococcus aureus
PHGTFKIGIKDTLDCNAFM

SEQ ID NO: 1671408 - protein, 19 aa, Staphylococcus aureus
PHLPFDHVFHHNKYHADKE

SEQ ID NO: 1671409 - protein, 21 aa, Staphylococcus aureus
PHPTAAFVAARAGAMAKHTDH

SEQ ID NO: 1671410 - protein, 17 aa, Staphylococcus aureus
PHSKVLLLTDGDLTMPD

SEQ ID NO: 1671411 - protein, 17 aa, Staphylococcus aureus
PIAARYLNHNSRLFKLY

SEQ ID NO: 1671412 - protein, 18 aa, Staphylococcus aureus
PIAENMINTTLVLCRELR

SEQ ID NO: 1671413 - protein, 18 aa, Staphylococcus aureus
PIEDVKRQLREVIKRKVS

SEQ ID NO: 1671414 - protein, 18 aa, Staphylococcus aureus
PIELEFKSEPPVEKHELT

SEQ ID NO: 1671415 - protein, 25 aa, Staphylococcus aureus
PIFEILRQYRNVIAHGQRFYSYRSD

SEQ ID NO: 1671416 - protein, 20 aa, Staphylococcus aureus
PIHDACTILYLLQPELFTMV

SEQ ID NO: 1671417 - protein, 21 aa, Staphylococcus aureus
PIKEISRVYCQTVVNGWSKEM

SEQ ID NO: 1671418 - protein, 32 aa, Staphylococcus aureus
PILGICLGAQALTCYYGGEVIKGDKVMHGKVD

SEQ ID NO: 1671419 - protein, 17 aa, Staphylococcus aureus
PINENELDVGAFKDVNH

SEQ ID NO: 1671420 - protein, 20 aa, Staphylococcus aureus
PINMVRVRLSGVKLKEIITK

SEQ ID NO: 1671421 - protein, 18 aa, Staphylococcus aureus
PIQVGSHFHFYEANAALD

SEQ ID NO: 1671422 - protein, 19 aa, Staphylococcus aureus
PISGHGIETFEISGGSVKI

SEQ ID NO: 1671423 - protein, 23 aa, Staphylococcus aureus
PISGHGIGTFEFSGGSVKIKVDG

SEQ ID NO: 1671424 - protein, 27 aa, Staphylococcus aureus
PISKFRIRKVLPPKIKNPVIDSSDIML

SEQ ID NO: 1671425 - protein, 42 aa, Staphylococcus aureus
PITKTATYKVVRTVPKHVFETARGVLYPGVSDMYDAKQYVKP

SEQ ID NO: 1671426 - protein, 32 aa, Staphylococcus aureus
PIVKEKNKYIEVGRKLSELHINYEKQTPLAEI

SEQ ID NO: 1671427 - protein, 17 aa, Staphylococcus aureus
PIVTNALTYGLSLVGDL

SEQ ID NO: 1671428 - protein, 22 aa, Staphylococcus aureus
PKAVTHCHGWGFAHLQMAAKHW

SEQ ID NO: 1671429 - protein, 22 aa, Staphylococcus aureus
PKDPKRIAVVAPTYAGGLKKLG

SEQ ID NO: 1671430 - protein, 19 aa, Staphylococcus aureus
PKDYVVFIPPVGKQIRAVV

SEQ ID NO: 1671431 - protein, 18 aa, Staphylococcus aureus
PKFDIKKLNLYTGDMDQI

SEQ ID NO: 1671432 - protein, 17 aa, Staphylococcus aureus
PKFILGFGGIDDDALKP

SEQ ID NO: 1671433 - protein, 20 aa, Staphylococcus aureus
PKFKDAMHLADFFDVPYEMF

SEQ ID NO: 1671434 - protein, 19 aa, Staphylococcus aureus
PKFLNVLSLIQYIQAAYHE

SEQ ID NO: 1671435 - protein, 20 aa, Staphylococcus aureus
PKGGCSGSLMNLLQQSNFNH

SEQ ID NO: 1671436 - protein, 23 aa, Staphylococcus aureus
PKGTLIPHRGIVRLVHQNHYLPL

SEQ ID NO: 1671437 - protein, 23 aa, Staphylococcus aureus
PKGVPMKVMLEGFEKKTGFTNAD

SEQ ID NO: 1671438 - protein, 23 aa, Staphylococcus aureus
PKGVPMKVMLEGLEKKTGFTNAD

SEQ ID NO: 1671439 - protein, 25 aa, Staphylococcus aureus
PKHLTTIKVAPLFSEDDRHKIIHVV

SEQ ID NO: 1671440 - protein, 21 aa, Staphylococcus aureus
PKHPYTWGLLASMPTLESNSK

SEQ ID NO: 1671441 - protein, 26 aa, Staphylococcus aureus
PKIPQGRGKIKWQAFATLPKQFEILE

SEQ ID NO: 1671442 - protein, 21 aa, Staphylococcus aureus
PKKDRVVVEGVNIMKKHQKPT

SEQ ID NO: 1671443 - protein, 17 aa, Staphylococcus aureus
PKKIMLVAGHGYNDPGA

SEQ ID NO: 1671444 - protein, 18 aa, Staphylococcus aureus
PKKIMLVAGHGYNDPGAV

SEQ ID NO: 1671445 - protein, 18 aa, Staphylococcus aureus
PKKIMLVSGHGYNDSGAV

SEQ ID NO: 1671446 - protein, 25 aa, Staphylococcus aureus
PKKRMAVEYSMPKWIIDHWATHYGL

SEQ ID NO: 1671447 - protein, 26 aa, Staphylococcus aureus
PKKVIKHAGYVRCKLFLEKEEEKIHV

SEQ ID NO: 1671448 - protein, 23 aa, Staphylococcus aureus
PKLAAALTQYKWVRESNEGVGRI

SEQ ID NO: 1671449 - protein, 25 aa, Staphylococcus aureus
PKLLSHELRTCFALTEPEHGSDVAG

SEQ ID NO: 1671450 - protein, 19 aa, Staphylococcus aureus
PKLTVKRAAAITSYSQPTV

SEQ ID NO: 1671451 - protein, 20 aa, Staphylococcus aureus
PKLTVKRAAAITSYSQPTVR

SEQ ID NO: 1671452 - protein, 19 aa, Staphylococcus aureus
PKMKFPKKYTEIIKKYKNK

SEQ ID NO: 1671453 - protein, 21 aa, Staphylococcus aureus
PKMNVCEDVIVRCHLYKNEYK

SEQ ID NO: 1671454 - protein, 20 aa, Staphylococcus aureus
PKMVHDFPIYPIRQSHKAIK

SEQ ID NO: 1671455 - protein, 23 aa, Staphylococcus aureus
PKNPLCLFCPVQENCVAFDKGTF

SEQ ID NO: 1671456 - protein, 17 aa, Staphylococcus aureus
PKPIVKGDQVGRNDDCP

SEQ ID NO: 1671457 - protein, 20 aa, Staphylococcus aureus
PKPTFEDIPLLDLALSDEKA

SEQ ID NO: 1671458 - protein, 27 aa, Staphylococcus aureus
PKRRDNEFWKSIAFGVSTGNRNQMLTS

SEQ ID NO: 1671459 - protein, 19 aa, Staphylococcus aureus
PKRRIPYMEIVAKYMERIL

SEQ ID NO: 1671460 - protein, 22 aa, Staphylococcus aureus
PKSEKYRIIYSYNMSIIRESNV

SEQ ID NO: 1671461 - protein, 26 aa, Staphylococcus aureus
PKSEWLKCADIYIDGFHNFSTIEYLI

SEQ ID NO: 1671462 - protein, 18 aa, Staphylococcus aureus
PKSIIEIMHNQILLEQPQ

SEQ ID NO: 1671463 - protein, 19 aa, Staphylococcus aureus
PKSIIEIMHNQILLEQPQS

SEQ ID NO: 1671464 - protein, 20 aa, Staphylococcus aureus
PKSKADFAFIQHMIHYLDDE

SEQ ID NO: 1671465 - protein, 19 aa, Staphylococcus aureus
PKSKPVVEPMAPKKQPETK

SEQ ID NO: 1671466 - protein, 22 aa, Staphylococcus aureus
PKSWDIAAQFLFAELLNLKMTT

SEQ ID NO: 1671467 - protein, 17 aa, Staphylococcus aureus
PKTRIKYLVGNDDETHI

SEQ ID NO: 1671468 - protein, 19 aa, Staphylococcus aureus
PKVAHYLPKDYVYAPIQTT

SEQ ID NO: 1671469 - protein, 21 aa, Staphylococcus aureus
PKVSGALALIIDKYHLEKHPD

SEQ ID NO: 1671470 - protein, 24 aa, Staphylococcus aureus
PLAGPVVACAPILNSNHNYLGLDD

SEQ ID NO: 1671471 - protein, 21 aa, Staphylococcus aureus
PLATHLPLIFQKNGDDYYISG

SEQ ID NO: 1671472 - protein, 26 aa, Staphylococcus aureus
PLATKRSRIIGSLIHMRCNRIFGVDK

SEQ ID NO: 1671473 - protein, 22 aa, Staphylococcus aureus
PLDESLYPIIRDICQEVKVHGD

SEQ ID NO: 1671474 - protein, 18 aa, Staphylococcus aureus
PLFTRAVYPLANYYFENR

SEQ ID NO: 1671475 - protein, 23 aa, Staphylococcus aureus
PLGHSLGAFLAQYNLIKHNLDNG

SEQ ID NO: 1671476 - protein, 17 aa, Staphylococcus aureus
PLGKLSGKHAFSEKLKA

SEQ ID NO: 1671477 - protein, 19 aa, Staphylococcus aureus
PLLNSSWQGNEILLHKDIN

SEQ ID NO: 1671478 - protein, 21 aa, Staphylococcus aureus
PLLQASWKIAPALATGCSIVM

SEQ ID NO: 1671479 - protein, 20 aa, Staphylococcus aureus
PLMRRLIEQRICDALAGEEQ

SEQ ID NO: 1671480 - protein, 18 aa, Staphylococcus aureus
PLNIKVIIVTTFKRPGYF

SEQ ID NO: 1671481 - protein, 18 aa, Staphylococcus aureus
PLNNDILLKFDRVSVDYK

SEQ ID NO: 1671482 - protein, 29 aa, Staphylococcus aureus
PLNPEVIKWAKKVYGLTVLDTWWMTETGG

SEQ ID NO: 1671483 - protein, 19 aa, Staphylococcus aureus
PLPYRHMYDNDGFRVYLNG

SEQ ID NO: 1671484 - protein, 25 aa, Staphylococcus aureus
PLRDRFGVHLRLEYYNESDLKEIII

SEQ ID NO: 1671485 - protein, 19 aa, Staphylococcus aureus
PLRIEKGKTASYIVKVDGK

SEQ ID NO: 1671486 - protein, 22 aa, Staphylococcus aureus
PLRIKYPYIRGKLWDLWTEALE

SEQ ID NO: 1671487 - protein, 25 aa, Staphylococcus aureus
PLSELARPLLLAALSKDNEVVKIDL

SEQ ID NO: 1671488 - protein, 21 aa, Staphylococcus aureus
PLSHSLTLYALLFALSSGRNF

SEQ ID NO: 1671489 - protein, 18 aa, Staphylococcus aureus
PLSPYEIETLNQWIDVDR

SEQ ID NO: 1671490 - protein, 18 aa, Staphylococcus aureus
PLTDKRISPINGTIEGLP

SEQ ID NO: 1671491 - protein, 26 aa, Staphylococcus aureus
PLVIKKLQLWIKVILKKTDITNKQIS

SEQ ID NO: 1671492 - protein, 19 aa, Staphylococcus aureus
PMAQLAMRAIIGEKLTDMG

SEQ ID NO: 1671493 - protein, 36 aa, Staphylococcus aureus
PMIDTIKSLMAFLKQRHIPMAIATSSVKAEIMPNFK

SEQ ID NO: 1671494 - protein, 36 aa, Staphylococcus aureus
PMIDTIKSLMAFLKQRHIPMAIATSSVKSEIMPTFK

SEQ ID NO: 1671495 - protein, 21 aa, Staphylococcus aureus
PMIEMMFGVHFIKGGMYGMAQ

SEQ ID NO: 1671496 - protein, 28 aa, Staphylococcus aureus
PMIYGAHCPGNFQRLMQLSKRLPIIPVI

SEQ ID NO: 1671497 - protein, 18 aa, Staphylococcus aureus
PMLSDMKESGGIEADASL

SEQ ID NO: 1671498 - protein, 18 aa, Staphylococcus aureus
PMRPDKLTNLGMLTEPGL

SEQ ID NO: 1671499 - protein, 19 aa, Staphylococcus aureus
PMYFIRLNFPDSISVKDKA

SEQ ID NO: 1671500 - protein, 19 aa, Staphylococcus aureus
PNARIVFKNGMFGVEDDMH

SEQ ID NO: 1671501 - protein, 19 aa, Staphylococcus aureus
PNFDKLVEETKKAVKEADD

SEQ ID NO: 1671502 - protein, 20 aa, Staphylococcus aureus
PNFICGKAQPSETIYVSYFI

SEQ ID NO: 1671503 - protein, 28 aa, Staphylococcus aureus
PNFIESGWSRYEFLSFLNREINEEHVII

SEQ ID NO: 1671504 - protein, 23 aa, Staphylococcus aureus
PNFKFPMKQDIPVIMIGPGTGIA

SEQ ID NO: 1671505 - protein, 19 aa, Staphylococcus aureus
PNFNRKGYNEISNMRYGNT

SEQ ID NO: 1671506 - protein, 18 aa, Staphylococcus aureus
PNFSRIAQIASYVNPNYA

SEQ ID NO: 1671507 - protein, 19 aa, Staphylococcus aureus
PNGGIKAKSSISMNNVTYT

SEQ ID NO: 1671508 - protein, 20 aa, Staphylococcus aureus
PNGYCRLPVVAGGCPHANVC

SEQ ID NO: 1671509 - protein, 36 aa, Staphylococcus aureus
PNKQKSVCFYGQIALFDLCKRLSKSCEIININTDGV

SEQ ID NO: 1671510 - protein, 26 aa, Staphylococcus aureus
PNLCIEMRSDIPLARGLGSSASALVG

SEQ ID NO: 1671511 - protein, 26 aa, Staphylococcus aureus
PNMDVFKKCYKALITKQETNIEKEGM

SEQ ID NO: 1671512 - protein, 17 aa, Staphylococcus aureus
PNPYKNKHHMFESTGKI

SEQ ID NO: 1671513 - protein, 17 aa, Staphylococcus aureus
PNRMGNLAIKKGWASMM

SEQ ID NO: 1671514 - protein, 17 aa, Staphylococcus aureus
PNSLKMVVLDCLLSKYY

SEQ ID NO: 1671515 - protein, 19 aa, Staphylococcus aureus
PNSRYMVFYNDGLTLYTKT

SEQ ID NO: 1671516 - protein, 23 aa, Staphylococcus aureus
PNSTYKIYLAMFGLDRHIINDEN

SEQ ID NO: 1671517 - protein, 17 aa, Staphylococcus aureus
PNTAQVINAKYDVIYNG

SEQ ID NO: 1671518 - protein, 24 aa, Staphylococcus aureus
PNVIDYYLKHCQIETIMSQFNLID

SEQ ID NO: 1671519 - protein, 19 aa, Staphylococcus aureus
PNYCGRVINQYGQYDNMFP

SEQ ID NO: 1671520 - protein, 18 aa, Staphylococcus aureus
PPEGADWVEGSQGHRSTL

SEQ ID NO: 1671521 - protein, 23 aa, Staphylococcus aureus
PPGREAYPGDVFYLHSRLLERAA

SEQ ID NO: 1671522 - protein, 19 aa, Staphylococcus aureus
PPIGDAFARRSAYALNVDF

SEQ ID NO: 1671523 - protein, 23 aa, Staphylococcus aureus
PPKDLRMSDQISIQYLNNDFWSN

SEQ ID NO: 1671524 - protein, 25 aa, Staphylococcus aureus
PPKDRRAGVITFNLQDVHPHDVATA

SEQ ID NO: 1671525 - protein, 29 aa, Staphylococcus aureus
PPMIYGAHCPGNFQRLMQLSKRLLIIPNI

SEQ ID NO: 1671526 - protein, 19 aa, Staphylococcus aureus
PPQGCPFHTRCPIAQDKCK

SEQ ID NO: 1671527 - protein, 22 aa, Staphylococcus aureus
PPSRESLDLLLLTTSKPRKIRR

SEQ ID NO: 1671528 - protein, 30 aa, Staphylococcus aureus
PPSVREIGEAVGLASSFTVHGHLSRLEEKG

SEQ ID NO: 1671529 - protein, 18 aa, Staphylococcus aureus
PPYKSNWYKKEYSNLDID

SEQ ID NO: 1671530 - protein, 23 aa, Staphylococcus aureus
PQDKCGIFFTYRVSKMSTEQKQT

SEQ ID NO: 1671531 - protein, 23 aa, Staphylococcus aureus
PQDKCGIFFTYRVSKMSTKQKQT

SEQ ID NO: 1671532 - protein, 17 aa, Staphylococcus aureus
PQDLFSAMIREIETQDF

SEQ ID NO: 1671533 - protein, 25 aa, Staphylococcus aureus
PQDSYLLVRGIKTLGLRMKQINRSV

SEQ ID NO: 1671534 - protein, 20 aa, Staphylococcus aureus
PQFNKTPKYVKYRDAGTGIR

SEQ ID NO: 1671535 - protein, 19 aa, Staphylococcus aureus
PQIEVTFDIDKNGIVNVTA

SEQ ID NO: 1671536 - protein, 25 aa, Staphylococcus aureus
PQKIVRWRAAMFIFDEGNAEQLPAL

SEQ ID NO: 1671537 - protein, 23 aa, Staphylococcus aureus
PQKRIIYKRVVEMLEGGQTISKI

SEQ ID NO: 1671538 - protein, 25 aa, Staphylococcus aureus
PQLRLYGLGAYELFSLMYDIHTVRM

SEQ ID NO: 1671539 - protein, 26 aa, Staphylococcus aureus
PQMVLRFKRRFGDDVAVLHSGLSSGE

SEQ ID NO: 1671540 - protein, 20 aa, Staphylococcus aureus
PQNVSLDWECFIISKSEMLL

SEQ ID NO: 1671541 - protein, 21 aa, Staphylococcus aureus
PQNVSLDWECFIISKSEMLLD

SEQ ID NO: 1671542 - protein, 20 aa, Staphylococcus aureus
PQQREIVFPISTDNASWGGT

SEQ ID NO: 1671543 - protein, 32 aa, Staphylococcus aureus; identical to SEQ ID NO: 1576533

SEQ ID NO: 1671544 - protein, 23 aa, Staphylococcus aureus
PQVIDKPHIVFMMTFPEDIKPII

SEQ ID NO: 1671545 - protein, 17 aa, Staphylococcus aureus
PRAVLGYLTSEEVIQVY

SEQ ID NO: 1671546 - protein, 17 aa, Staphylococcus aureus
PRAVLNYLTSEEVIQVY

SEQ ID NO: 1671547 - protein, 17 aa, Staphylococcus aureus
PRDAFRIAKTLDISIDE

SEQ ID NO: 1671548 - protein, 17 aa, Staphylococcus aureus
PRDAFRIAKTLNISIDE

SEQ ID NO: 1671549 - protein, 18 aa, Staphylococcus aureus
PRDFPENTMVGYREVMGL

SEQ ID NO: 1671550 - protein, 17 aa, Staphylococcus aureus
PREIFSIAVRENANAII

SEQ ID NO: 1671551 - protein, 23 aa, Staphylococcus aureus
PRFFNQVTVPTFWEIKGNNNSAT

SEQ ID NO: 1671552 - protein, 23 aa, Staphylococcus aureus
PRFYGEPVMKGYVRYSIATASQL

SEQ ID NO: 1671553 - protein, 19 aa, Staphylococcus aureus
PRIDTMFAKHNVIYGDNPL

SEQ ID NO: 1671554 - protein, 21 aa, Staphylococcus aureus
PRIRLYIPLNERISADDYRKY

SEQ ID NO: 1671555 - protein, 26 aa, Staphylococcus aureus
PRIRYKNVILKPAYWKINEMLLPLPK

SEQ ID NO: 1671556 - protein, 24 aa, Staphylococcus aureus
PRIRYKNVILKPAYWKINEMVLPL

SEQ ID NO: 1671557 - protein, 26 aa, Staphylococcus aureus
PRIRYKNVILKPAYWKINEMVLTLPK

SEQ ID NO: 1671558 - protein, 19 aa, Staphylococcus aureus
PRKDCSPLKQDTFRVKLNE

SEQ ID NO: 1671559 - protein, 26 aa, Staphylococcus aureus
PRKHHEMIKKLLIEFIIDNKDSKIVS

SEQ ID NO: 1671560 - protein, 20 aa, Staphylococcus aureus
PRKYLKPKIPQGRGKIKWQA

SEQ ID NO: 1671561 - protein, 25 aa, Staphylococcus aureus
PRPFDKRVAPSVARNVAKAAMESGV

SEQ ID NO: 1671562 - protein, 18 aa, Staphylococcus aureus
PRRVGWFDSVVLRHSRRV

SEQ ID NO: 1671563 - protein, 21 aa, Staphylococcus aureus
PRSLLDEYREGLLVGTACDEG

SEQ ID NO: 1671564 - protein, 23 aa, Staphylococcus aureus
PRTRIPLSSEILAEFEKIRRGHH

SEQ ID NO: 1671565 - protein, 18 aa, Staphylococcus aureus
PRVGYYYSGKSKGKFFNE

SEQ ID NO: 1671566 - protein, 19 aa, Staphylococcus aureus
PRYEKAYEIPEKQLEEKNG

SEQ ID NO: 1671567 - protein, 19 aa, Staphylococcus aureus
PSCEDYCALRINAGMSPKT

SEQ ID NO: 1671568 - protein, 22 aa, Staphylococcus aureus
PSDLGNGLYLFIDRKNKVGEAI

SEQ ID NO: 1671569 - protein, 20 aa, Staphylococcus aureus
PSDVYSIISNDFLKPFGHVW

SEQ ID NO: 1671570 - protein, 17 aa, Staphylococcus aureus
PSETIYVSYFINQDEQT

SEQ ID NO: 1671571 - protein, 17 aa, Staphylococcus aureus
PSETNAYNVTTNQDGTV

SEQ ID NO: 1671572 - protein, 35 aa, Staphylococcus aureus
PSFKNAESKLTVAMGYRINNEPLLMDIAKTPHALI

SEQ ID NO: 1671573 - protein, 19 aa, Staphylococcus aureus
PSFNKPVLVLRRVTERPEG

SEQ ID NO: 1671574 - protein, 20 aa, Staphylococcus aureus
PSFNKPVLVLRSVTERPEGV

SEQ ID NO: 1671575 - protein, 24 aa, Staphylococcus aureus
PSGESTRGFAVYFSPEIKKFIADN

SEQ ID NO: 1671576 - protein, 21 aa, Staphylococcus aureus
PSHIKEGRMGNFLENMVDWNI

SEQ ID NO: 1671577 - protein, 18 aa, Staphylococcus aureus
PSILRLVKKVIEASHKEG

SEQ ID NO: 1671578 - protein, 29 aa, Staphylococcus aureus
PSKRIADVGCGYGPIGLMIAKVSPHHSIT

SEQ ID NO: 1671579 - protein, 28 aa, Staphylococcus aureus
PSLPILRGGQHYKLHFDFDATPAGSVYF

SEQ ID NO: 1671580 - protein, 25 aa, Staphylococcus aureus
PSMGPRSVDYLHHLIQAMHLAYSDR

SEQ ID NO: 1671581 - protein, 22 aa, Staphylococcus aureus
PSMKITLSFSEFNTMKTTVTST

SEQ ID NO: 1671582 - protein, 18 aa, Staphylococcus aureus
PSSAYAYLMPYRKLSWGK

SEQ ID NO: 1671583 - protein, 25 aa, Staphylococcus aureus
PSSELARPLLSASLSKDNEVVKIDL

SEQ ID NO: 1671584 - protein, 19 aa, Staphylococcus aureus
PSSETNYLLDVWVLEEPHL

SEQ ID NO: 1671585 - protein, 24 aa, Staphylococcus aureus
PSSLGLEPWKFVVIQDQALRDELK

SEQ ID NO: 1671586 - protein, 17 aa, Staphylococcus aureus
PSYALFKGQDLVYFMPR

SEQ ID NO: 1671587 - protein, 19 aa, Staphylococcus aureus
PSYALFKGQDLVYFMPREF

SEQ ID NO: 1671588 - protein, 22 aa, Staphylococcus aureus
PSYKQLISYCLLENEYGEILVY

SEQ ID NO: 1671589 - protein, 18 aa, Staphylococcus aureus
PSYKQVYSIIKAMPKSVI

SEQ ID NO: 1671590 - protein, 23 aa, Staphylococcus aureus
PTASEVVEWALYIAKKKIAIDVP

SEQ ID NO: 1671591 - protein, 21 aa, Staphylococcus aureus
PTASEVVEWALYIAKNKIAID

SEQ ID NO: 1671592 - protein, 23 aa, Staphylococcus aureus
PTASEVVEWALYIAKNKIAIDVP

SEQ ID NO: 1671593 - protein, 19 aa, Staphylococcus aureus
PTAYSEIYDYQWIEKLIPY

SEQ ID NO: 1671594 - protein, 18 aa, Staphylococcus aureus
PTDAKVMYALLKDRFELS

SEQ ID NO: 1671595 - protein, 18 aa, Staphylococcus aureus
PTFRGSGHGTAYYPFFKI

SEQ ID NO: 1671596 - protein, 19 aa, Staphylococcus aureus
PTGNGASASDYFKLSNGSA

SEQ ID NO: 1671597 - protein, 24 aa, Staphylococcus aureus
PTISNDFLKLFGHVWLVERWMEDD

SEQ ID NO: 1671598 - protein, 17 aa, Staphylococcus aureus
PTISNDFLKSFGHVWLV

SEQ ID NO: 1671599 - protein, 18 aa, Staphylococcus aureus
PTKKEGWKARKFEDETGK

SEQ ID NO: 1671600 - protein, 18 aa, Staphylococcus aureus
PTKKTAFDNAITQAESYL

SEQ ID NO: 1671601 - protein, 23 aa, Staphylococcus aureus
PTKLRWDNYYGCTHFIRPKYKSE

SEQ ID NO: 1671602 - protein, 17 aa, Staphylococcus aureus
PTLAKSIIDQATQAVTD

SEQ ID NO: 1671603 - protein, 18 aa, Staphylococcus aureus
PTLAKSIIDQATQAVTDA

SEQ ID NO: 1671604 - protein, 19 aa, Staphylococcus aureus
PTLNLAMEEYVLKNLPAEE

SEQ ID NO: 1671605 - protein, 18 aa, Staphylococcus aureus
PTLSNFVGKIEWIASKVP

SEQ ID NO: 1671606 - protein, 23 aa, Staphylococcus aureus
PTNCAVAGCASNKLAIQPVIATA

SEQ ID NO: 1671607 - protein, 19 aa, Staphylococcus aureus
PTPTCIVCRNWESNFSLLG

SEQ ID NO: 1671608 - protein, 17 aa, Staphylococcus aureus
PTPTCIVCRNWESNFSV

SEQ ID NO: 1671609 - protein, 19 aa, Staphylococcus aureus
PTQLLAWLKAEQGLDIPNL

SEQ ID NO: 1671610 - protein, 23 aa, Staphylococcus aureus
PTSVKALLKEAGYNDDIDEETIG

SEQ ID NO: 1671611 - protein, 23 aa, Staphylococcus aureus
PTTLKSLTFHAASDEWFQNYIKT

SEQ ID NO: 1671612 - protein, 17 aa, Staphylococcus aureus
PTTSQPAIGEWITKYEM

SEQ ID NO: 1671613 - protein, 17 aa, Staphylococcus aureus
PTVKAIFHYYLQDYGYK

SEQ ID NO: 1671614 - protein, 30 aa, Staphylococcus aureus
PTVTQIPIVTRIQRVIQIQIAIQNQIVTQT

SEQ ID NO: 1671615 - protein, 31 aa, Staphylococcus aureus
PVCGKQVILKRGLKVISHFAHKHLAEQKCFN

SEQ ID NO: 1671616 - protein, 24 aa, Staphylococcus aureus
PVPELVEGLKLVTEFVQDENATQE

SEQ ID NO: 1671617 - protein, 17 aa, Staphylococcus aureus
PVVKAYIDAISIAGKTF

SEQ ID NO: 1671618 - protein, 25 aa, Staphylococcus aureus
PVVKPNAKKAIRDKATKQREIINAT

SEQ ID NO: 1671619 - protein, 20 aa, Staphylococcus aureus
PVVKRIAENIAESLDNSELP

SEQ ID NO: 1671620 - protein, 22 aa, Staphylococcus aureus
PWFQLSPTHFVKSWLLDSRAPK

SEQ ID NO: 1671621 - protein, 26 aa, Staphylococcus aureus
PWGSVKSISGYPFVWWFATNPEYEGK

SEQ ID NO: 1671622 - protein, 20 aa, Staphylococcus aureus
PWLYVERGFEIPSFNYVLKT

SEQ ID NO: 1671623 - protein, 24 aa, Staphylococcus aureus
PYDKNFINQIGWYLNYDQEINLIG

SEQ ID NO: 1671624 - protein, 19 aa, Staphylococcus aureus
PYDNYFYAYDVDEFYRLPH

SEQ ID NO: 1671625 - protein, 21 aa, Staphylococcus aureus
PYEVNKGSLVKRIDELRADKK

SEQ ID NO: 1671626 - protein, 21 aa, Staphylococcus aureus
PYFAGTKVKWILDNVECAREK

SEQ ID NO: 1671627 - protein, 20 aa, Staphylococcus aureus
PYFHKVVLLSGALRLDTLES

SEQ ID NO: 1671628 - protein, 18 aa, Staphylococcus aureus
PYKVFTSFYKKWRPYLRI

SEQ ID NO: 1671629 - protein, 19 aa, Staphylococcus aureus
PYKVFTSFYRKWRSYLRHR

SEQ ID NO: 1671630 - protein, 28 aa, Staphylococcus aureus
PYLIYMLGFMPGFPYLGGLDEQLHTPRR

SEQ ID NO: 1671631 - protein, 20 aa, Staphylococcus aureus
PYLPELMNMHKLIYPAGDGR

SEQ ID NO: 1671632 - protein, 20 aa, Staphylococcus aureus
PYMNIKEATEYIGVSYNTFR

SEQ ID NO: 1671633 - protein, 25 aa, Staphylococcus aureus
PYNKNFINQIGWYLDFEKDIDVIGD

SEQ ID NO: 1671634 - protein, 17 aa, Staphylococcus aureus
PYPLYLLLDKEYQLIEP

SEQ ID NO: 1671635 - protein, 18 aa, Staphylococcus aureus
PYTLLDYFGDDWLVMIDE

SEQ ID NO: 1671636 - protein, 18 aa, Staphylococcus aureus
QAAMEILSIIAYNQPLSR

SEQ ID NO: 1671637 - protein, 19 aa, Staphylococcus aureus
QADGHTGVIAFEVKNTESA

SEQ ID NO: 1671638 - protein, 21 aa, Staphylococcus aureus
QAENWLRNNIKDINFQLYHYA

SEQ ID NO: 1671639 - protein, 20 aa, Staphylococcus aureus
QAIAEAENVLKQNANKQQVD

SEQ ID NO: 1671640 - protein, 17 aa, Staphylococcus aureus
QAKHVFDSTGLLNINYQ

SEQ ID NO: 1671641 - protein, 29 aa, Staphylococcus aureus
QAKLNMGYRFPTQYGQSGYAAFVVFNMMF

SEQ ID NO: 1671642 - protein, 23 aa, Staphylococcus aureus
QAKQREKACIIVTHDERLKAYCD

SEQ ID NO: 1671643 - protein, 26 aa, Staphylococcus aureus
QALEILARSKVDGIVLMATDITERHI

SEQ ID NO: 1671644 - protein, 17 aa, Staphylococcus aureus
QALESQINNAATRDEVA

SEQ ID NO: 1671645 - protein, 19 aa, Staphylococcus aureus
QALESQINNAATRGEVAQK

SEQ ID NO: 1671646 - protein, 18 aa, Staphylococcus aureus
QALNGMRIGEMLAIKNEV

SEQ ID NO: 1671647 - protein, 24 aa, Staphylococcus aureus
QALNNAMKGLRDSIANETTVKASQ

SEQ ID NO: 1671648 - protein, 24 aa, Staphylococcus aureus
QALNNAMKGLRDSIANETTVKTSQ

SEQ ID NO: 1671649 - protein, 25 aa, Staphylococcus aureus
QANILGLKDKTDWVGHKIDEGIDNF

SEQ ID NO: 1671650 - protein, 18 aa, Staphylococcus aureus
QASQLFLDSVVMGLMTEM

SEQ ID NO: 1671651 - protein, 22 aa, Staphylococcus aureus
QATEAIPNWAAENGYPVTNYEL

SEQ ID NO: 1671652 - protein, 24 aa, Staphylococcus aureus
QATTKIWQNGHIDITPNNPSGHLI

SEQ ID NO: 1671653 - protein, 24 aa, Staphylococcus aureus
QATTKIWQNGHVDITPNNPSGHLI

SEQ ID NO: 1671654 - protein, 25 aa, Staphylococcus aureus
QATVKRIEKYGAFVGLFPGKDALLH

SEQ ID NO: 1671655 - protein, 24 aa, Staphylococcus aureus
QAVAKAEALISGTPDVVVTPSEIT

SEQ ID NO: 1671656 - protein, 25 aa, Staphylococcus aureus
QAVAKAEALISGTPDVVVTPSEITA

SEQ ID NO: 1671657 - protein, 20 aa, Staphylococcus aureus
QAVIKKIHEPFVIYDGITNG

SEQ ID NO: 1671658 - protein, 19 aa, Staphylococcus aureus
QAYDEKVTAAEHIVSGTPT

SEQ ID NO: 1671659 - protein, 18 aa, Staphylococcus aureus
QAYFKGMFNETCPSFDDI

SEQ ID NO: 1671660 - protein, 31 aa, Staphylococcus aureus
QAYVKRLAIDSCIEFVARAVAQSHFKVLEGN

SEQ ID NO: 1671661 - protein, 17 aa, Staphylococcus aureus
QCGKSYALIGKSGCGKS

SEQ ID NO: 1671662 - protein, 17 aa, Staphylococcus aureus
QCLKQNLIDNNSIFIDG

SEQ ID NO: 1671663 - protein, 29 aa, Staphylococcus aureus
QCLYVKLDPYWLYHLYNKDIVPFEGREKN

SEQ ID NO: 1671664 - protein, 17 aa, Staphylococcus aureus
QCTYHVFNRRAEIGKGI

SEQ ID NO: 1671665 - protein, 30 aa, Staphylococcus aureus
QCTYYVFDRVGGKIGSTWGNASNWANAAAS

SEQ ID NO: 1671666 - protein, 30 aa, Staphylococcus aureus
QCTYYVFDRVGGKIGSTWGNASNWASAAAS

SEQ ID NO: 1671667 - protein, 30 aa, Staphylococcus aureus
QCWDVPNYILERYWGFRTWGNANAMAQKSN

SEQ ID NO: 1671668 - protein, 17 aa, Staphylococcus aureus
QDAIANLDTLRDLNQPQ

SEQ ID NO: 1671669 - protein, 17 aa, Staphylococcus aureus
QDDWCTIFVDKRMDHLK

SEQ ID NO: 1671670 - protein, 25 aa, Staphylococcus aureus
QDFKHWRLVAILEVIEIKSCHYAAS

SEQ ID NO: 1671671 - protein, 17 aa, Staphylococcus aureus
QDFPKTEFEVIVVDDCS

SEQ ID NO: 1671672 - protein, 31 aa, Staphylococcus aureus
QDGRTTADIFGRCLHTYLIRDAIHDGNVFGF

SEQ ID NO: 1671673 - protein, 22 aa, Staphylococcus aureus
QDINVTAHILIDGETTPITKTA

SEQ ID NO: 1671674 - protein, 22 aa, Staphylococcus aureus
QDIPFETFLGFKGDKVPDIDLN

SEQ ID NO: 1671675 - protein, 18 aa, Staphylococcus aureus
QDIVPSYRAVLIYFDEQS

SEQ ID NO: 1671676 - protein, 18 aa, Staphylococcus aureus
QDKLPLFNPFKVINKGNQ

SEQ ID NO: 1671677 - protein, 24 aa, Staphylococcus aureus
QDKYNIRCQFGLSEEETFYYIYAV

SEQ ID NO: 1671678 - protein, 27 aa, Staphylococcus aureus
QDLKEVLKPGGVYYASFADLTNNPSRQ

SEQ ID NO: 1671679 - protein, 19 aa, Staphylococcus aureus
QDLLIPLTFHFSKDEQLVI

SEQ ID NO: 1671680 - protein, 30 aa, Staphylococcus aureus
QDMLIPWEMIPRCSKCDAPMEVNKRKAEVG

SEQ ID NO: 1671681 - protein, 31 aa, Staphylococcus aureus
QDMRIPWDMIPRCPKCDAPMEVNKRKAEVGM

SEQ ID NO: 1671682 - protein, 20 aa, Staphylococcus aureus
QDMYRRYKIGPKETLNTLQS

SEQ ID NO: 1671683 - protein, 25 aa, Staphylococcus aureus
QDPHAWLSLDNGIKYVKTIQQTFID

SEQ ID NO: 1671684 - protein, 29 aa, Staphylococcus aureus
QDPSYPVSSPRGWLYFGGARPQDVKGTIN

SEQ ID NO: 1671685 - protein, 17 aa, Staphylococcus aureus
QDVCALLNHRERQWLML

SEQ ID NO: 1671686 - protein, 17 aa, Staphylococcus aureus
QDVSFKYTFDKDTELVG

SEQ ID NO: 1671687 - protein, 18 aa, Staphylococcus aureus
QDYVKFLYGYEERISLSN

SEQ ID NO: 1671688 - protein, 18 aa, Staphylococcus aureus
QEAATLWYHPHPSPNTAK

SEQ ID NO: 1671689 - protein, 19 aa, Staphylococcus aureus
QEANTALGHLNNLNNAQRQ

SEQ ID NO: 1671690 - protein, 20 aa, Staphylococcus aureus
QEANTALGHLNNLNNAQRQN

SEQ ID NO: 1671691 - protein, 29 aa, Staphylococcus aureus
QEDALRMIRCLRFQSQLSFEIATETFEAM

SEQ ID NO: 1671692 - protein, 29 aa, Staphylococcus aureus
QEDGCKIIDEFLCIDKSYSNSNFDTNSRT

SEQ ID NO: 1671693 - protein, 21 aa, Staphylococcus aureus
QEDYYRLILLSRHQNDIPMWL

SEQ ID NO: 1671694 - protein, 22 aa, Staphylococcus aureus
QEFKGIANVTCRFTVTNGTNQD

SEQ ID NO: 1671695 - protein, 17 aa, Staphylococcus aureus
QEFTKMMLGEDYVITEE

SEQ ID NO: 1671696 - protein, 17 aa, Staphylococcus aureus
QEHGLDMIVIDYLQLIQ

SEQ ID NO: 1671697 - protein, 20 aa, Staphylococcus aureus
QEKEHLLSPLFKDWHKYNTD

SEQ ID NO: 1671698 - protein, 21 aa, Staphylococcus aureus
QEPQPFWNPAIDAGRKTFEQY

SEQ ID NO: 1671699 - protein, 22 aa, Staphylococcus aureus
QEPTVSQGFYGAMFKDLDGHHF

SEQ ID NO: 1671700 - protein, 19 aa, Staphylococcus aureus
QETGITIMYMVKKLDVGNI

SEQ ID NO: 1671701 - protein, 25 aa, Staphylococcus aureus
QEVKVHGDKALKMYNLTFDHAKTDH

SEQ ID NO: 1671702 - protein, 26 aa, Staphylococcus aureus
QEVLIKDVVMLAARILLESGAEGTRV

SEQ ID NO: 1671703 - protein, 21 aa, Staphylococcus aureus
QEYKYIRRILEGKVKADNYFV

SEQ ID NO: 1671704 - protein, 17 aa, Staphylococcus aureus
QEYLRILPHMQELPISN

SEQ ID NO: 1671705 - protein, 19 aa, Staphylococcus aureus
QEYWAFESRFIKLNYLDQP

SEQ ID NO: 1671706 - protein, 20 aa, Staphylococcus aureus
QFIDSSWIVGGGHGTHNGYR

SEQ ID NO: 1671707 - protein, 29 aa, Staphylococcus aureus
QFKLEIPVIKRRSNFEMDERLVLEKVNYD

SEQ ID NO: 1671708 - protein, 30 aa, Staphylococcus aureus
QFLTKNLFINWTWGEDFFRKYLIDYDSASN

SEQ ID NO: 1671709 - protein, 24 aa, Staphylococcus aureus
QFNLDGWYGFQCYDYANMFFMLAT

SEQ ID NO: 1671710 - protein, 24 aa, Staphylococcus aureus
QFNPDLFFGFQCYDYANMFFMLAT

SEQ ID NO: 1671711 - protein, 17 aa, Staphylococcus aureus
QFTENYDTLLLGIEMSR

SEQ ID NO: 1671712 - protein, 25 aa, Staphylococcus aureus
QFYKGEFKSAFPLPNTEYTPLYLNA

SEQ ID NO: 1671713 - protein, 20 aa, Staphylococcus aureus
QGAESFKIWTNKDADINSMK

SEQ ID NO: 1671714 - protein, 18 aa, Staphylococcus aureus
QGAGVIKYIRRMDMSNLH

SEQ ID NO: 1671715 - protein, 20 aa, Staphylococcus aureus
QGAGVIKYIRRMDMSNLHPK

SEQ ID NO: 1671716 - protein, 18 aa, Staphylococcus aureus
QGDFENVISLIDLYDQAQ

SEQ ID NO: 1671717 - protein, 20 aa, Staphylococcus aureus
QGDILKLRLFRNDENYAEIY

SEQ ID NO: 1671718 - protein, 18 aa, Staphylococcus aureus
QGDKVLLHGSEYYVDGVI

SEQ ID NO: 1671719 - protein, 21 aa, Staphylococcus aureus
QGEASYQEYLMINGDCVLYEN

SEQ ID NO: 1671720 - protein, 17 aa, Staphylococcus aureus
QGFRRMMQYKKINKNLV

SEQ ID NO: 1671721 - protein, 23 aa, Staphylococcus aureus
QGIGFKIAERLVEDGFKIAERLV

SEQ ID NO: 1671722 - protein, 20 aa, Staphylococcus aureus
QGIGRLTGKPGIVLVTSGPG

SEQ ID NO: 1671723 - protein, 19 aa, Staphylococcus aureus
QGILRTLFDSEKFEAIREI

SEQ ID NO: 1671724 - protein, 24 aa, Staphylococcus aureus
QGLLRIFPEMIVFSDSKNHASIIN

SEQ ID NO: 1671725 - protein, 20 aa, Staphylococcus aureus
QGRGKAMIVTASRLHAVRYM

SEQ ID NO: 1671726 - protein, 21 aa, Staphylococcus aureus
QGVDFLKNRGYDIEYSQADVP

SEQ ID NO: 1671727 - protein, 18 aa, Staphylococcus aureus
QGVKLIACTMSMDVMGIT

SEQ ID NO: 1671728 - protein, 18 aa, Staphylococcus aureus
QGWSKISDMFPRDKNAAK

SEQ ID NO: 1671729 - protein, 17 aa, Staphylococcus aureus
QGYVYQSFCYQILKEDI

SEQ ID NO: 1671730 - protein, 19 aa, Staphylococcus aureus
QHAGLSWLTILKKKEAYEE

SEQ ID NO: 1671731 - protein, 18 aa, Staphylococcus aureus
QHAREFDYIKSLRKLTTK

SEQ ID NO: 1671732 - protein, 17 aa, Staphylococcus aureus
QHGHGYDLVAFDPTNTD

SEQ ID NO: 1671733 - protein, 20 aa, Staphylococcus aureus
QHGIKAIIQPSGSIKDQDSI

SEQ ID NO: 1671734 - protein, 20 aa, Staphylococcus aureus
QHGIKTIIQPGGSIKDQDSI

SEQ ID NO: 1671735 - protein, 18 aa, Staphylococcus aureus
QHLGCKVYRTSHEDDDLK

SEQ ID NO: 1671736 - protein, 24 aa, Staphylococcus aureus
QHLKKMYHAMAHKFGDNWKKAQEV

SEQ ID NO: 1671737 - protein, 17 aa, Staphylococcus aureus
QHLPDYVQLNLKHFSNT

SEQ ID NO: 1671738 - protein, 21 aa, Staphylococcus aureus
QHMHVLLCVENAYFRKKKYIT

SEQ ID NO: 1671739 - protein, 19 aa, Staphylococcus aureus
QHMNFQFVGTYGPNKDVVG

SEQ ID NO: 1671740 - protein, 18 aa, Staphylococcus aureus
QHVYFKPIDKEKFINRLV

SEQ ID NO: 1671741 - protein, 17 aa, Staphylococcus aureus
QIADYALIYGRTDENEM

SEQ ID NO: 1671742 - protein, 20 aa, Staphylococcus aureus
QIATQIRIATQIQMQENIHL

SEQ ID NO: 1671743 - protein, 26 aa, Staphylococcus aureus
QIDLTRIWEILGEIIGETASDELIDQ

SEQ ID NO: 1671744 - protein, 17 aa, Staphylococcus aureus
QIEIAKKLGAKQVIIIE

SEQ ID NO: 1671745 - protein, 25 aa, Staphylococcus aureus
QIELIKRLIPYVPKVELHMYGFGSE

SEQ ID NO: 1671746 - protein, 26 aa, Staphylococcus aureus
QIGNNKPNCPFIINMQLTGVFDIEYE

SEQ ID NO: 1671747 - protein, 17 aa, Staphylococcus aureus
QIHLKKADFYQIINRNQ

SEQ ID NO: 1671748 - protein, 27 aa, Staphylococcus aureus
QIIQVCARLIYLLSLQKGVKCINLKTS

SEQ ID NO: 1671749 - protein, 21 aa, Staphylococcus aureus
QIKARLNKFIQDIDHVNPDEV

SEQ ID NO: 1671750 - protein, 24 aa, Staphylococcus aureus
QIKDLPMVMVMLYASLGSVLLREF

SEQ ID NO: 1671751 - protein, 24 aa, Staphylococcus aureus
QIKKGYCLLVGIGQDSTEQDADVI

SEQ ID NO: 1671752 - protein, 23 aa, Staphylococcus aureus
QIKKGYCLLVGIGQNSTEQDADV

SEQ ID NO: 1671753 - protein, 35 aa, Staphylococcus aureus
QIKKLEGSFHFETFISLTCQKCPDVVQALNLMSVI

SEQ ID NO: 1671754 - protein, 18 aa, Staphylococcus aureus
QIKLDLDSLTAFHEQILA

SEQ ID NO: 1671755 - protein, 24 aa, Staphylococcus aureus
QIKPKVRRKRAALDNIDESNNNQL

SEQ ID NO: 1671756 - protein, 23 aa, Staphylococcus aureus
QIKPKVRRKRAALDSIEENNKNQ

SEQ ID NO: 1671757 - protein, 18 aa, Staphylococcus aureus
QIKQISCFAKLVQSETID

SEQ ID NO: 1671758 - protein, 23 aa, Staphylococcus aureus
QIKTPLLTCASWSTQGLHNRGSF

SEQ ID NO: 1671759 - protein, 18 aa, Staphylococcus aureus
QILMLTTMNLHFESNVVS

SEQ ID NO: 1671760 - protein, 18 aa, Staphylococcus aureus
QINGRLGYDLNEKVINMF

SEQ ID NO: 1671761 - protein, 20 aa, Staphylococcus aureus
QINNVLAFPGIFRGALEAEA

SEQ ID NO: 1671762 - protein, 17 aa, Staphylococcus aureus
QIPEIEPQYVLEYQESK

SEQ ID NO: 1671763 - protein, 21 aa, Staphylococcus aureus
QIPTVTRIQIAIPTQTVTQIQ

SEQ ID NO: 1671764 - protein, 25 aa, Staphylococcus aureus
QIPYMFNYKFEVFDVSNPFFSNETK

SEQ ID NO: 1671765 - protein, 25 aa, Staphylococcus aureus
QIQTAIRIQIAIQIQTAIQNQTAIR

SEQ ID NO: 1671766 - protein, 19 aa, Staphylococcus aureus
QISELPISYEENLSLHEND

SEQ ID NO: 1671767 - protein, 29 aa, Staphylococcus aureus
QIVTPIQIAIRIQRVIQTQVVTPIHQVIQ

SEQ ID NO: 1671768 - protein, 26 aa, Staphylococcus aureus
QKALDIISDVPLFKCTKQDIHETLTR

SEQ ID NO: 1671769 - protein, 21 aa, Staphylococcus aureus
QKANELRAKINQDKEATAEER

SEQ ID NO: 1671770 - protein, 22 aa, Staphylococcus aureus
QKANELRAKINQDKEATAEERQ

SEQ ID NO: 1671771 - protein, 19 aa, Staphylococcus aureus
QKASERKTAIEAMNDSTTE

SEQ ID NO: 1671772 - protein, 23 aa, Staphylococcus aureus
QKASERKTAIEAMNDSTTEEQQA

SEQ ID NO: 1671773 - protein, 20 aa, Staphylococcus aureus
QKDAIKRLVAYLNNEPIGVV

SEQ ID NO: 1671774 - protein, 26 aa, Staphylococcus aureus
QKEALKAQVTSAGRVSAANGVEHTAT

SEQ ID NO: 1671775 - protein, 29 aa, Staphylococcus aureus
QKFRAKQIFEWLYQKRVDSIDEMTNLSKD

SEQ ID NO: 1671776 - protein, 21 aa, Staphylococcus aureus
QKGVAVVICPNDLLTEKIKDT

SEQ ID NO: 1671777 - protein, 19 aa, Staphylococcus aureus
QKGVKCINLKTSILKEVIF

SEQ ID NO: 1671778 - protein, 24 aa, Staphylococcus aureus
QKHALFPKYEFFRADTDYADIAKF

SEQ ID NO: 1671779 - protein, 17 aa, Staphylococcus aureus
QKHSKLKFDHLIIDEAH

SEQ ID NO: 1671780 - protein, 23 aa, Staphylococcus aureus
QKKFWKSNIKPIVSECSDGINTT

SEQ ID NO: 1671781 - protein, 21 aa, Staphylococcus aureus
QKLIVVPLFLYDGRLVNKVKQ

SEQ ID NO: 1671782 - protein, 24 aa, Staphylococcus aureus
QKLMELYYFKKPRTLNLTGVAQEI

SEQ ID NO: 1671783 - protein, 17 aa, Staphylococcus aureus
QKLMIIKRGPIVEIENQ

SEQ ID NO: 1671784 - protein, 21 aa, Staphylococcus aureus
QKLPTTLIVAFKSTLEEAKGA

SEQ ID NO: 1671785 - protein, 17 aa, Staphylococcus aureus
QKMGYKVAVLDPTEDCP

SEQ ID NO: 1671786 - protein, 23 aa, Staphylococcus aureus
QKMVDKGVVIWKEKEFEPSDIVN

SEQ ID NO: 1671787 - protein, 19 aa, Staphylococcus aureus
QKNQFAWVVAAFPSKAWAK

SEQ ID NO: 1671788 - protein, 18 aa, Staphylococcus aureus
QKPGAWLVKVKDLETNET

SEQ ID NO: 1671789 - protein, 26 aa, Staphylococcus aureus
QKQKLKLLSFLLEDHDLIILDEITNA

SEQ ID NO: 1671790 - protein, 21 aa, Staphylococcus aureus
QKQKYLLLEFGNFEQEASEKQ

SEQ ID NO: 1671791 - protein, 21 aa, Staphylococcus aureus
QKSVFDIFDYVMLGHLHHPFS

SEQ ID NO: 1671792 - protein, 23 aa, Staphylococcus aureus
QLAAEEKTAALATIKQITDQAKQ

SEQ ID NO: 1671793 - protein, 20 aa, Staphylococcus aureus
QLAAQHLIELGHNHIIIVAP

SEQ ID NO: 1671794 - protein, 19 aa, Staphylococcus aureus
QLAEEGFNVAVNYAGSKEK

SEQ ID NO: 1671795 - protein, 28 aa, Staphylococcus aureus
QLALPVEFLFEFLCVGAPPRYYLNNSFR

SEQ ID NO: 1671796 - protein, 18 aa, Staphylococcus aureus
QLDLTVFFDGNRSMSRDI

SEQ ID NO: 1671797 - protein, 19 aa, Staphylococcus aureus
QLEFYSTQCNLELYFTSLS

SEQ ID NO: 1671798 - protein, 24 aa, Staphylococcus aureus
QLEKMIAPFYRKWDHQVFEFYLEK

SEQ ID NO: 1671799 - protein, 18 aa, Staphylococcus aureus
QLERVYIASVLMLEPELI

SEQ ID NO: 1671800 - protein, 17 aa, Staphylococcus aureus
QLESSFYKLTPGRQHQY

SEQ ID NO: 1671801 - protein, 23 aa, Staphylococcus aureus
QLEVPIPAIISAFEIAKAHDVTT

SEQ ID NO: 1671802 - protein, 22 aa, Staphylococcus aureus
QLGYDIVEVILLFEKVDQNHAD

SEQ ID NO: 1671803 - protein, 20 aa, Staphylococcus aureus
QLHSIFLEVIIAPKFTDKAL

SEQ ID NO: 1671804 - protein, 23 aa, Staphylococcus aureus
QLIICTLPLELRGFQIVSLDDIE

SEQ ID NO: 1671805 - protein, 17 aa, Staphylococcus aureus
QLIKATSYYTLAESLGA

SEQ ID NO: 1671806 - protein, 21 aa, Staphylococcus aureus
QLKGFIKKYVATMLADVGEVI

SEQ ID NO: 1671807 - protein, 19 aa, Staphylococcus aureus
QLKQHIIDAQQALNGDQNL

SEQ ID NO: 1671808 - protein, 26 aa, Staphylococcus aureus
QLKQKIKCPCCGSTLTNMTIRKKNHT

SEQ ID NO: 1671809 - protein, 17 aa, Staphylococcus aureus
QLKSVVIAYEPIWAIGT

SEQ ID NO: 1671810 - protein, 19 aa, Staphylococcus aureus
QLLASMLHKPELLILDEPF

SEQ ID NO: 1671811 - protein, 39 aa, Staphylococcus aureus
QLLKRYPFELSGGMAQRIAFIMSLIRRPDYLFLDEPTSA

SEQ ID NO: 1671812 - protein, 19 aa, Staphylococcus aureus
QLLKVARTKLALQPNERYE

SEQ ID NO: 1671813 - protein, 17 aa, Staphylococcus aureus
QLMFRMGKDSNIHEKLY

SEQ ID NO: 1671814 - protein, 22 aa, Staphylococcus aureus
QLMMLEPKFAILDEIDSGLDID

SEQ ID NO: 1671815 - protein, 24 aa, Staphylococcus aureus
QLPKGRKPIITTWAKHEQYDKVLM

SEQ ID NO: 1671816 - protein, 21 aa, Staphylococcus aureus
QLPTRGAIIYAISPKPKDAPG

SEQ ID NO: 1671817 - protein, 19 aa, Staphylococcus aureus
QLQSGYPYLMFKDNANRVH

SEQ ID NO: 1671818 - protein, 20 aa, Staphylococcus aureus
QLRDAMKVLTEHPIDTKITY

SEQ ID NO: 1671819 - protein, 19 aa, Staphylococcus aureus
QLRKRYNIPTNKAPKLLLK

SEQ ID NO: 1671820 - protein, 20 aa, Staphylococcus aureus
QLRKRYNIPTNKAPKLLLKG

SEQ ID NO: 1671821 - protein, 24 aa, Staphylococcus aureus
QLTDMRLILGELIFTELIIVEMHD

SEQ ID NO: 1671822 - protein, 18 aa, Staphylococcus aureus
QLWIKAILKKTDITNKQI

SEQ ID NO: 1671823 - protein, 17 aa, Staphylococcus aureus
QLWNMLVLARVITIGAY

SEQ ID NO: 1671824 - protein, 23 aa, Staphylococcus aureus
QLYPDLDKQIAYILSKYNDQSSK

SEQ ID NO: 1671825 - protein, 21 aa, Staphylococcus aureus
QMAAQCLIQAIGGEGYVYVKG

SEQ ID NO: 1671826 - protein, 19 aa, Staphylococcus aureus
QMCLREGKITDANIVHHIV

SEQ ID NO: 1671827 - protein, 18 aa, Staphylococcus aureus
QMDEELKTARTNADVDAV

SEQ ID NO: 1671828 - protein, 18 aa, Staphylococcus aureus
QMDKELKTARTNADVDAV

SEQ ID NO: 1671829 - protein, 19 aa, Staphylococcus aureus
QMITRNSFVMGVKLRELSD

SEQ ID NO: 1671830 - protein, 23 aa, Staphylococcus aureus
QMKSGVRFFDIRGRASADNMISV

SEQ ID NO: 1671831 - protein, 38 aa, Staphylococcus aureus
QMMLYELRNLFPEIIFLDAISLRIFENYTLDYDIVFSP

SEQ ID NO: 1671832 - protein, 33 aa, Staphylococcus aureus
QMMLYELRNLFPEIIFLDVISLRTFENYTLDYD

SEQ ID NO: 1671833 - protein, 20 aa, Staphylococcus aureus
QMMLYELRNLFSEIIFLDAI

SEQ ID NO: 1671834 - protein, 18 aa, Staphylococcus aureus
QMMQRLVDYIAHEDYYRL

SEQ ID NO: 1671835 - protein, 19 aa, Staphylococcus aureus
QMPNLWPRLIEIKVPTLIL

SEQ ID NO: 1671836 - protein, 18 aa, Staphylococcus aureus
QMSFCVVSGLAQGADAMA

SEQ ID NO: 1671837 - protein, 23 aa, Staphylococcus aureus
QMSPKDAILFKFLCNQKVIPAVR

SEQ ID NO: 1671838 - protein, 24 aa, Staphylococcus aureus
QMSPKDAILFKFLCNQKVIPAVRY

SEQ ID NO: 1671839 - protein, 24 aa, Staphylococcus aureus
QMTWFKNKMSVHWLDKENMSLQMM

SEQ ID NO: 1671840 - protein, 24 aa, Staphylococcus aureus
QMYALYFKFVMPIFGKLFAKSKEE

SEQ ID NO: 1671841 - protein, 29 aa, Staphylococcus aureus
QNALDFPLPKAFRDAGWFFDVLPGRYNGA

SEQ ID NO: 1671842 - protein, 24 aa, Staphylococcus aureus
QNANKFYKFAIYGKFGTGKTTFLT

SEQ ID NO: 1671843 - protein, 25 aa, Staphylococcus aureus
QNDCPPCTFVKIYLNERQIDFEERN

SEQ ID NO: 1671844 - protein, 25 aa, Staphylococcus aureus
QNDCPPCTFVKNYLNEHQIDFEDRN

SEQ ID NO: 1671845 - protein, 24 aa, Staphylococcus aureus
QNDCPPCTFVKNYLNEHQIDFEER

SEQ ID NO: 1671846 - protein, 21 aa, Staphylococcus aureus
QNDIPMWLRECITSVNEEYQA

SEQ ID NO: 1671847 - protein, 25 aa, Staphylococcus aureus
QNEKLFKVFAYCLMKASHKDHTQLV

SEQ ID NO: 1671848 - protein, 24 aa, Staphylococcus aureus
QNGNQPKVRIFEYLGNNEDIAKSV

SEQ ID NO: 1671849 - protein, 23 aa, Staphylococcus aureus
QNHIECFIHIDLIKGLSHDEFAS

SEQ ID NO: 1671850 - protein, 19 aa, Staphylococcus aureus
QNHVQIMAWSPFAGGKTFD

SEQ ID NO: 1671851 - protein, 18 aa, Staphylococcus aureus
QNIINEWAKSHSIGHVQS

SEQ ID NO: 1671852 - protein, 17 aa, Staphylococcus aureus
QNIPKIIISDSIFSTNG

SEQ ID NO: 1671853 - protein, 23 aa, Staphylococcus aureus
QNMPFPVECHIKAKIVENDKVKK

SEQ ID NO: 1671854 - protein, 23 aa, Staphylococcus aureus
QNMVDKGVVIWKEKEFEPSDIVD

SEQ ID NO: 1671855 - protein, 25 aa, Staphylococcus aureus
QNPPAWVCIEFMQLGQFVSFLNFYY

SEQ ID NO: 1671856 - protein, 34 aa, Staphylococcus aureus
QNRERIYIVGFKCRKAFDLFEFPEKIDLKTGIKD

SEQ ID NO: 1671857 - protein, 21 aa, Staphylococcus aureus
QNRKLRRPNLTFATLDHNVPT

SEQ ID NO: 1671858 - protein, 29 aa, Staphylococcus aureus
QNSFEVFCTLAYTGMRAGELLALKWSDID

SEQ ID NO: 1671859 - protein, 21 aa, Staphylococcus aureus
QNSRAFKGYMERVQKNQFAWV

SEQ ID NO: 1671860 - protein, 25 aa, Staphylococcus aureus
QNYLKEQYKGIGILYKNQQWYFVVV

SEQ ID NO: 1671861 - protein, 19 aa, Staphylococcus aureus
QPAIGEWITKYEMLRDQGY

SEQ ID NO: 1671862 - protein, 18 aa, Staphylococcus aureus
QPAPKVCTPIKKEETHES

SEQ ID NO: 1671863 - protein, 18 aa, Staphylococcus aureus
QPDIPTKSSIMVGLGETI

SEQ ID NO: 1671864 - protein, 19 aa, Staphylococcus aureus
QPFKIMASHYMFEYIHPFY

SEQ ID NO: 1671865 - protein, 24 aa, Staphylococcus aureus
QPGDDVDRAFSFETTEYILDQLPC

SEQ ID NO: 1671866 - protein, 20 aa, Staphylococcus aureus
QPILDIGIFGGFVGSREHFG

SEQ ID NO: 1671867 - protein, 23 aa, Staphylococcus aureus
QPISSSRALRVWFNKNQKDDYII

SEQ ID NO: 1671868 - protein, 26 aa, Staphylococcus aureus
QPKGVGIENLCPFSRDGQMRVVDNNQ

SEQ ID NO: 1671869 - protein, 30 aa, Staphylococcus aureus
QPKSERLRQFFDFITNFGIMIKGTGEDIHP

SEQ ID NO: 1671870 - protein, 24 aa, Staphylococcus aureus
QPKVKVHLKPSVQLIANVVQTKTL

SEQ ID NO: 1671871 - protein, 20 aa, Staphylococcus aureus
QPLFEGVEWIIVSLGAQGAF

SEQ ID NO: 1671872 - protein, 21 aa, Staphylococcus aureus
QPLKLFHPVYTYKMKFIKSFE

SEQ ID NO: 1671873 - protein, 17 aa, Staphylococcus aureus
QPLSLGLNTYKGHVTNK

SEQ ID NO: 1671874 - protein, 18 aa, Staphylococcus aureus
QPPMKGKQILGVDPAFRT

SEQ ID NO: 1671875 - protein, 26 aa, Staphylococcus aureus
QPRNNGRFSPVVFKLASEHDIDLSQV

SEQ ID NO: 1671876 - protein, 24 aa, Staphylococcus aureus
QPSPFHWRLLDKITLSTLYEVVLP

SEQ ID NO: 1671877 - protein, 18 aa, Staphylococcus aureus
QPVGRRSLSEYMDMTERV

SEQ ID NO: 1671878 - protein, 31 aa, Staphylococcus aureus
QPVSPHLAFKMADQIFLKKQRVLDKVKVLDK

SEQ ID NO: 1671879 - protein, 25 aa, Staphylococcus aureus
QPYAECVFVKAPVFSFNKLKNVDIT

SEQ ID NO: 1671880 - protein, 36 aa, Staphylococcus aureus
QQADYTFASLDIFNGLKRRAQTILDENRNNVPLNKR

SEQ ID NO: 1671881 - protein, 22 aa, Staphylococcus aureus
QQEDYCIILAYFYEGKPMLSYV

SEQ ID NO: 1671882 - protein, 21 aa, Staphylococcus aureus
QQEIFQLAEIVSGKNNKNLTL

SEQ ID NO: 1671883 - protein, 23 aa, Staphylococcus aureus
QQERPESIPALTSEKNHNQTMAL

SEQ ID NO: 1671884 - protein, 24 aa, Staphylococcus aureus
QQGGHIIVWFGLTWSLELYQQANA

SEQ ID NO: 1671885 - protein, 22 aa, Staphylococcus aureus
QQIANGIPTPVLTPDTVTQAVT

SEQ ID NO: 1671886 - protein, 24 aa, Staphylococcus aureus
QQIDLLWQEIESFDDDNIKGLLEV

SEQ ID NO: 1671887 - protein, 23 aa, Staphylococcus aureus
QQKAQNLFARWKQLQNSNSESSN

SEQ ID NO: 1671888 - protein, 24 aa, Staphylococcus aureus
QQKSFLFNEHYGFFNLINDDSNIV

SEQ ID NO: 1671889 - protein, 20 aa, Staphylococcus aureus
QQLCFPEKLTFHPKTFEETI

SEQ ID NO: 1671890 - protein, 20 aa, Staphylococcus aureus
QQLKSMLRQVLFLIDTGDDN

SEQ ID NO: 1671891 - protein, 17 aa, Staphylococcus aureus
QQLNRTGTTTGKKPASI

SEQ ID NO: 1671892 - protein, 17 aa, Staphylococcus aureus
QQLPLFRYLTAAQHGFF

SEQ ID NO: 1671893 - protein, 17 aa, Staphylococcus aureus
QQLPQQNQYQYVPPQQQ

SEQ ID NO: 1671894 - protein, 19 aa, Staphylococcus aureus
QQLQVFPMCVEFRHQSWFS

SEQ ID NO: 1671895 - protein, 23 aa, Staphylococcus aureus
QQQRTAAARAFVHKPQIIFADEP

SEQ ID NO: 1671896 - protein, 19 aa, Staphylococcus aureus
QQRKLIFALCNDIEAHTGQ

SEQ ID NO: 1671897 - protein, 23 aa, Staphylococcus aureus
QQRRIGYLFQDYQLFPNMTVYKN

SEQ ID NO: 1671898 - protein, 25 aa, Staphylococcus aureus
QQTEVKIVFMLAMDKVDDQLKLLQQ

SEQ ID NO: 1671899 - protein, 23 aa, Staphylococcus aureus
QQTKGRYSIVIFDTYGTLTLDND

SEQ ID NO: 1671900 - protein, 19 aa, Staphylococcus aureus
QQVIHLIRIMCLIKKRLVI

SEQ ID NO: 1671901 - protein, 28 aa, Staphylococcus aureus
QQWCQKFNIALKIKKKQGIVVDGTDNDI

SEQ ID NO: 1671902 - protein, 18 aa, Staphylococcus aureus
QQYAELLVKVGMNVQPKQ

SEQ ID NO: 1671903 - protein, 23 aa, Staphylococcus aureus
QRAESFDILPLFISSRNKQIEYW

SEQ ID NO: 1671904 - protein, 19 aa, Staphylococcus aureus
QRDLDIFITHFKQIKDDYH

SEQ ID NO: 1671905 - protein, 25 aa, Staphylococcus aureus
QRDNHAAYAFIKRLIKQFGKPQKVI

SEQ ID NO: 1671906 - protein, 23 aa, Staphylococcus aureus
QRELAEALYAEFNTKFDVLYDDR

SEQ ID NO: 1671907 - protein, 20 aa, Staphylococcus aureus
QRERPGRGYIHHIAVNTPLM

SEQ ID NO: 1671908 - protein, 19 aa, Staphylococcus aureus
QRFKCLECNGTFTAKTSIV

SEQ ID NO: 1671909 - protein, 25 aa, Staphylococcus aureus
QRGAFLCYDYLYSLNITDIKRINRI

SEQ ID NO: 1671910 - protein, 24 aa, Staphylococcus aureus
QRGKFDLLIVLSHCGIFFDETLCQ

SEQ ID NO: 1671911 - protein, 19 aa, Staphylococcus aureus
QRIDKIIYFYSPQAENKKS

SEQ ID NO: 1671912 - protein, 21 aa, Staphylococcus aureus
QRISIEVSDDAKAWIGQEAYE

SEQ ID NO: 1671913 - protein, 20 aa, Staphylococcus aureus
QRKIDVEPVFGFMKAILGFT

SEQ ID NO: 1671914 - protein, 22 aa, Staphylococcus aureus
QRKSEALKERFINRQKSKNESV

SEQ ID NO: 1671915 - protein, 19 aa, Staphylococcus aureus
QRLLGAKIEILPDEVLGQK

SEQ ID NO: 1671916 - protein, 21 aa, Staphylococcus aureus
QRLLGAKVEILPDEMLGEKAN

SEQ ID NO: 1671917 - protein, 25 aa, Staphylococcus aureus
QRLLKGVVKGIGGYGNCIGIPTTAG

SEQ ID NO: 1671918 - protein, 22 aa, Staphylococcus aureus
QRLVNRIIVLKDGMIVDDFAIE

SEQ ID NO: 1671919 - protein, 25 aa, Staphylococcus aureus
QRNATELNTAMGQLQHAIADKTNTL

SEQ ID NO: 1671920 - protein, 27 aa, Staphylococcus aureus
QRNATELNTAMGTLKHAIADKTNTLAS

SEQ ID NO: 1671921 - protein, 20 aa, Staphylococcus aureus
QRPGAGAVYLNIFHYDVEEF

SEQ ID NO: 1671922 - protein, 20 aa, Staphylococcus aureus
QRPVLINMQANWMIIINGIS

SEQ ID NO: 1671923 - protein, 25 aa, Staphylococcus aureus
QRQRIRIARALAVEPEFIIADEPIS

SEQ ID NO: 1671924 - protein, 21 aa, Staphylococcus aureus
QRRKEIGKPVPLTWGNGGDWG

SEQ ID NO: 1671925 - protein, 17 aa, Staphylococcus aureus
QRTAAARAFVHKPQIIF

SEQ ID NO: 1671926 - protein, 17 aa, Staphylococcus aureus
QRYIRWITDRINDKENP

SEQ ID NO: 1671927 - protein, 18 aa, Staphylococcus aureus
QSAPSIGGSGSFNYSKTI

SEQ ID NO: 1671928 - protein, 23 aa, Staphylococcus aureus
QSAYIHIPFCVRICTYCDFNKYF

SEQ ID NO: 1671929 - protein, 27 aa, Staphylococcus aureus
QSCLTTGFCLWCQLAFSTYLENATQTH

SEQ ID NO: 1671930 - protein, 29 aa, Staphylococcus aureus
QSFANCKQLRQVYPNGVTADHPAYRPHLD

SEQ ID NO: 1671931 - protein, 24 aa, Staphylococcus aureus
QSFPKEVFEYYLGISNNIMNDKIN

SEQ ID NO: 1671932 - protein, 23 aa, Staphylococcus aureus
QSFWIDPRTKIIYMTQARPGNHY

SEQ ID NO: 1671933 - protein, 20 aa, Staphylococcus aureus
QSGFSLNYLAFFTINNSIKT

SEQ ID NO: 1671934 - protein, 25 aa, Staphylococcus aureus
QSGKEYLQSLVIEYFRIQKEQDSKF

SEQ ID NO: 1671935 - protein, 25 aa, Staphylococcus aureus
QSGKEYLQSLVIEYYRIQKEQDSKF

SEQ ID NO: 1671936 - protein, 30 aa, Staphylococcus aureus
QSGLAPEAWLECYLDRTLLPILKLYSNTGI

SEQ ID NO: 1671937 - protein, 18 aa, Staphylococcus aureus
QSGQKYRIPVHDADMNEV

SEQ ID NO: 1671938 - protein, 17 aa, Staphylococcus aureus
QSGSHITIDFALEQNRN

SEQ ID NO: 1671939 - protein, 17 aa, Staphylococcus aureus
QSINFIGTFTVEFFIDS

SEQ ID NO: 1671940 - protein, 38 aa, Staphylococcus aureus; identical to SEQ ID NO: 1580452

SEQ ID NO: 1671941 - protein, 24 aa, Staphylococcus aureus
QSIVPRKGVLDSYYVYTISNILKI

SEQ ID NO: 1671942 - protein, 19 aa, Staphylococcus aureus
QSKVIFCEADDWKPFYETY

SEQ ID NO: 1671943 - protein, 20 aa, Staphylococcus aureus
QSKVIFCEADDWKPFYETYG

SEQ ID NO: 1671944 - protein, 24 aa, Staphylococcus aureus
QSKVIFCEADDWKPFYETYGSQFE

SEQ ID NO: 1671945 - protein, 25 aa, Staphylococcus aureus
QSLAAESIIAYAIYLSRYEYSIYKN

SEQ ID NO: 1671946 - protein, 19 aa, Staphylococcus aureus
QSLGALRVKLAKELGLIDE

SEQ ID NO: 1671947 - protein, 18 aa, Staphylococcus aureus
QSLGMIGQQLKNKNDELS

SEQ ID NO: 1671948 - protein, 17 aa, Staphylococcus aureus
QSLMGGGFQIDNPNAIA

SEQ ID NO: 1671949 - protein, 23 aa, Staphylococcus aureus
QSLNCYNSLGLKEAGTMQKVESI

SEQ ID NO: 1671950 - protein, 27 aa, Staphylococcus aureus
QSLNNAMKGLRYSIANETTVKASQNYT

SEQ ID NO: 1671951 - protein, 29 aa, Staphylococcus aureus
QSLSSFLFTRLNFYLIDLFRQQNQLKDVI

SEQ ID NO: 1671952 - protein, 25 aa, Staphylococcus aureus
QSNKEYLQSLVIEYFRIEKEKDKKF

SEQ ID NO: 1671953 - protein, 18 aa, Staphylococcus aureus
QSNKLFLLFINTYGEIFE

SEQ ID NO: 1671954 - protein, 26 aa, Staphylococcus aureus
QSNVFKTRRVRFEAMLAKADLPFVHA

SEQ ID NO: 1671955 - protein, 26 aa, Staphylococcus aureus
QSQFNLPMRYIWGIYEPQSDDQNMNE

SEQ ID NO: 1671956 - protein, 21 aa, Staphylococcus aureus
QSVKCCFDYLNNIIMMNQNKS

SEQ ID NO: 1671957 - protein, 26 aa, Staphylococcus aureus
QSYCGPGRRKTFAFVNNRPLAALTEE

SEQ ID NO: 1671958 - protein, 20 aa, Staphylococcus aureus
QTAIQIPIAIQIPTVTQIPI

SEQ ID NO: 1671959 - protein, 18 aa, Staphylococcus aureus
QTAIQIQIVIQIQTVTQI

SEQ ID NO: 1671960 - protein, 25 aa, Staphylococcus aureus
QTAIQNRIATQTATQTQTVIQNRIA

SEQ ID NO: 1671961 - protein, 19 aa, Staphylococcus aureus
QTELAYMQNIFSFDERHAK

SEQ ID NO: 1671962 - protein, 19 aa, Staphylococcus aureus
QTIEVGKTMNPIVLTTTDN

SEQ ID NO: 1671963 - protein, 23 aa, Staphylococcus aureus
QTKHLKLKGVHCHIGSQIEGTEA

SEQ ID NO: 1671964 - protein, 20 aa, Staphylococcus aureus
QTKVPAVLLELGYISNPTDE

SEQ ID NO: 1671965 - protein, 24 aa, Staphylococcus aureus
QTLNTAMKGLRDSIANEATIKAGQ

SEQ ID NO: 1671966 - protein, 22 aa, Staphylococcus aureus
QTPNSYRFQKQLDHEVLIHTSL

SEQ ID NO: 1671967 - protein, 22 aa, Staphylococcus aureus
QTQLKFVLIYTIHIKKLTKLSI

SEQ ID NO: 1671968 - protein, 23 aa, Staphylococcus aureus
QTQLKFVLIYTIHIKKLTKLSIK

SEQ ID NO: 1671969 - protein, 18 aa, Staphylococcus aureus
QTQTVIRTQIAMQTQTVT

SEQ ID NO: 1671970 - protein, 29 aa, Staphylococcus aureus
QTQVVPLIQIVTRIQRVIQTQVVTQIHQV

SEQ ID NO: 1671971 - protein, 21 aa, Staphylococcus aureus
QTTELGKFFIGKYSIKTDKTI

SEQ ID NO: 1671972 - protein, 24 aa, Staphylococcus aureus
QTTIFIDEGWAFTASRQGKKVGKR

SEQ ID NO: 1671973 - protein, 20 aa, Staphylococcus aureus
QTVIQNRIATQTQTATQTQI

SEQ ID NO: 1671974 - protein, 24 aa, Staphylococcus aureus
QTWPFKQILLPLLYQHDSGGGSMP

SEQ ID NO: 1671975 - protein, 25 aa, Staphylococcus aureus
QTWPFKQILLPLLYQRGSGGGSMPS

SEQ ID NO: 1671976 - protein, 19 aa, Staphylococcus aureus
QTYAKFKAIATPEQLAKVK

SEQ ID NO: 1671977 - protein, 21 aa, Staphylococcus aureus
QTYAKFKAIATPEQLAKVKAL

SEQ ID NO: 1671978 - protein, 20 aa, Staphylococcus aureus
QTYAKFKAIATPEQLAKVKV

SEQ ID NO: 1671979 - protein, 18 aa, Staphylococcus aureus
QTYEFFCQAGKDVDALLE

SEQ ID NO: 1671980 - protein, 24 aa, Staphylococcus aureus
QVANCPKQYLAYVLSKHGFTCKKE

SEQ ID NO: 1671981 - protein, 22 aa, Staphylococcus aureus
QVEQLTHAFKQAKDNLHGDQKL

SEQ ID NO: 1671982 - protein, 17 aa, Staphylococcus aureus
QVIDFIMDFITTHDLNV

SEQ ID NO: 1671983 - protein, 19 aa, Staphylococcus aureus
QVIEFIIDFIETHDLNVKA

SEQ ID NO: 1671984 - protein, 18 aa, Staphylococcus aureus
QVIHELPFDKGLSRVCTN

SEQ ID NO: 1671985 - protein, 26 aa, Staphylococcus aureus
QVIKKDGYWWIRFKYQREGSSTNDFY

SEQ ID NO: 1671986 - protein, 23 aa, Staphylococcus aureus
QVILRCLVERDIVVLAKSVNPER

SEQ ID NO: 1671987 - protein, 25 aa, Staphylococcus aureus
QVINAKYDVIYNGHTFATSLPAKFV

SEQ ID NO: 1671988 - protein, 24 aa, Staphylococcus aureus
QVKKWLKEDIDVIITTGGTGIAQR

SEQ ID NO: 1671989 - protein, 17 aa, Staphylococcus aureus
QVLKYQFLNQRNHAPFI

SEQ ID NO: 1671990 - protein, 17 aa, Staphylococcus aureus
QVNDIIGNIDFENLNQY

SEQ ID NO: 1671991 - protein, 20 aa, Staphylococcus aureus
QVNEVLAYDVMPYIMKKLNA

SEQ ID NO: 1671992 - protein, 20 aa, Staphylococcus aureus
QVQFVGFVGEHGRYDLMLVN

SEQ ID NO: 1671993 - protein, 18 aa, Staphylococcus aureus
QVVGSGFEGRVTKKDLMS

SEQ ID NO: 1671994 - protein, 21 aa, Staphylococcus aureus
QVWEPMGNASIFISNGKNPKQ

SEQ ID NO: 1671995 - protein, 27 aa, Staphylococcus aureus
QYELRELQSRLGITFIFVTHDQEEALA

SEQ ID NO: 1671996 - protein, 30 aa, Staphylococcus aureus
QYHYVESGLFPDVYRHIGYIQSNFLSNQTN

SEQ ID NO: 1671997 - protein, 19 aa, Staphylococcus aureus
QYIDCISGFSVANQGHCHP

SEQ ID NO: 1671998 - protein, 22 aa, Staphylococcus aureus
QYKNSKFKNMISFHSTNDLLSW

SEQ ID NO: 1671999 - protein, 22 aa, Staphylococcus aureus
QYRFNIMLEDIKAYLPKEKIWD

SEQ ID NO: 1672000 - protein, 21 aa, Staphylococcus aureus
QYRFNIMLEDIKSYLPKEKIW

SEQ ID NO: 1672001 - protein, 19 aa, Staphylococcus aureus
QYRLKIVLHAESEFETIVS

SEQ ID NO: 1672002 - protein, 22 aa, Staphylococcus aureus
QYSKFADKFGVSIEEADEIVGK

SEQ ID NO: 1672003 - protein, 18 aa, Staphylococcus aureus
QYTMSVWMGFSKVKQYGE

SEQ ID NO: 1672004 - protein, 18 aa, Staphylococcus aureus
QYVESLIYGTILDAKASE

SEQ ID NO: 1672005 - protein, 19 aa, Staphylococcus aureus
QYVLMTYYNIICHYGEQAF

SEQ ID NO: 1672006 - protein, 17 aa, Staphylococcus aureus
QYYTLSLTVKGFDFQLE

SEQ ID NO: 1672007 - protein, 20 aa, Staphylococcus aureus
RAAEKAGIEGLDEFLTGPTA

SEQ ID NO: 1672008 - protein, 22 aa, Staphylococcus aureus
RACYHLLRLITTLYTKGGINMM

SEQ ID NO: 1672009 - protein, 20 aa, Staphylococcus aureus
RAEKGVYHLLSLPNRVNQQA

SEQ ID NO: 1672010 - protein, 17 aa, Staphylococcus aureus
RAENVMIVDLLRNDIGR

SEQ ID NO: 1672011 - protein, 23 aa, Staphylococcus aureus
RAFIKRGLLQFADGNGFQCGIWY

SEQ ID NO: 1672012 - protein, 24 aa, Staphylococcus aureus
RAFIKRGLLQFADGNGFQCGIWYV

SEQ ID NO: 1672013 - protein, 24 aa, Staphylococcus aureus
RAFIKRGLLQFSDGNGFQCGIWYE

SEQ ID NO: 1672014 - protein, 21 aa, Staphylococcus aureus
RAIDWQAIILDWRRKPRAMHY

SEQ ID NO: 1672015 - protein, 18 aa, Staphylococcus aureus
RAIEHLGYEVVVSNKQNI

SEQ ID NO: 1672016 - protein, 18 aa, Staphylococcus aureus
RAIEYLGYEVVVSNKQNI

SEQ ID NO: 1672017 - protein, 20 aa, Staphylococcus aureus
RAKLAKARAESHLENDDDNT

SEQ ID NO: 1672018 - protein, 28 aa, Staphylococcus aureus
RALFKQLAYVEGFGKYLHKNFVGAKRFS

SEQ ID NO: 1672019 - protein, 19 aa, Staphylococcus aureus
RALPDRRNIILTRDKGFTF

SEQ ID NO: 1672020 - protein, 20 aa, Staphylococcus aureus
RALSEFVVLGIDTTIPFHIK

SEQ ID NO: 1672021 - protein, 17 aa, Staphylococcus aureus
RALYRGKAHHVVNFMHF

SEQ ID NO: 1672022 - protein, 28 aa, Staphylococcus aureus
RAMGFEMKESIALFSQWEKSGVNTEIAF

SEQ ID NO: 1672023 - protein, 17 aa, Staphylococcus aureus
RAQVILSEFEASADKKS

SEQ ID NO: 1672024 - protein, 19 aa, Staphylococcus aureus
RAREAGVNRMFVVGFNKST

SEQ ID NO: 1672025 - protein, 21 aa, Staphylococcus aureus
RARQDVTFSYSLMGSSGDDKE

SEQ ID NO: 1672026 - protein, 21 aa, Staphylococcus aureus
RARRTYAFTELFLFELRMQWL

SEQ ID NO: 1672027 - protein, 21 aa, Staphylococcus aureus
RASVETLELTHLIVEEAYNCG

SEQ ID NO: 1672028 - protein, 18 aa, Staphylococcus aureus
RATAYWAIGQILGEEARD

SEQ ID NO: 1672029 - protein, 19 aa, Staphylococcus aureus
RATKIPWSFEGDDGEWYTT

SEQ ID NO: 1672030 - protein, 19 aa, Staphylococcus aureus
RATYEFFNKDGFTKVDPPI

SEQ ID NO: 1672031 - protein, 23 aa, Staphylococcus aureus
RAVHNYAKYVTRFIVGYLTRNPI

SEQ ID NO: 1672032 - protein, 17 aa, Staphylococcus aureus
RAVVAKGGRGGRGNSRF

SEQ ID NO: 1672033 - protein, 17 aa, Staphylococcus aureus
RAYNYHGEWKLKSSDEF

SEQ ID NO: 1672034 - protein, 39 aa, Staphylococcus aureus
RAYYTKPSFEFEKQFGFMLKPWTTVRFMNVIPNRFIYKI

SEQ ID NO: 1672035 - protein, 22 aa, Staphylococcus aureus
RCAESLKLSLSYMEHNIKIIAC

SEQ ID NO: 1672036 - protein, 25 aa, Staphylococcus aureus
RCELIEARCQCLSEVELDNLNQLLD

SEQ ID NO: 1672037 - protein, 20 aa, Staphylococcus aureus
RCPYGPRPGEQVKQFTVEIA

SEQ ID NO: 1672038 - protein, 21 aa, Staphylococcus aureus
RDAEQSKKTAYDQAVAAAKAI

SEQ ID NO: 1672039 - protein, 29 aa, Staphylococcus aureus
RDAEQSKKTAYDQAVAAAKAILNKQTGSN

SEQ ID NO: 1672040 - protein, 18 aa, Staphylococcus aureus
RDAIIKVGQLFENIRECG

SEQ ID NO: 1672041 - protein, 24 aa, Staphylococcus aureus
RDAIKNVALMIGIPPGLIYGETAD

SEQ ID NO: 1672042 - protein, 30 aa, Staphylococcus aureus
RDAKESLLKYLIRMSTRPTPFGLLSGINLG

SEQ ID NO: 1672043 - protein, 23 aa, Staphylococcus aureus
RDDKNLRDAIEMYMSKKYTLDEI

SEQ ID NO: 1672044 - protein, 17 aa, Staphylococcus aureus
RDEESYIFLYILGITGA

SEQ ID NO: 1672045 - protein, 18 aa, Staphylococcus aureus
RDEESYIFLYILGITGAR

SEQ ID NO: 1672046 - protein, 23 aa, Staphylococcus aureus
RDEFLCTAISPDLADYSIDIKDI

SEQ ID NO: 1672047 - protein, 23 aa, Staphylococcus aureus
RDEFLCTAISPDLADYSIDIKEI

SEQ ID NO: 1672048 - protein, 17 aa, Staphylococcus aureus
RDEKVAIVGSGPAGLAA

SEQ ID NO: 1672049 - protein, 17 aa, Staphylococcus aureus
RDEKVAIVGSGPAGLTA

SEQ ID NO: 1672050 - protein, 22 aa, Staphylococcus aureus
RDELKAHSWGAAKQLDTASHFV

SEQ ID NO: 1672051 - protein, 19 aa, Staphylococcus aureus
RDEVLKKIRMHITQGIMSG

SEQ ID NO: 1672052 - protein, 24 aa, Staphylococcus aureus
RDEVLKKIRMHITQGIMSGEGYSK

SEQ ID NO: 1672053 - protein, 19 aa, Staphylococcus aureus
RDGYKPNIEQLMALAEETN

SEQ ID NO: 1672054 - protein, 34 aa, Staphylococcus aureus
RDIDRALVWGFTWKLGPFQLWDAMGYERVKTRME

SEQ ID NO: 1672055 - protein, 19 aa, Staphylococcus aureus
RDISCNLGSLNIVNVMENG

SEQ ID NO: 1672056 - protein, 19 aa, Staphylococcus aureus
RDKTWSAHVPRRIKEIGPR

SEQ ID NO: 1672057 - protein, 24 aa, Staphylococcus aureus
RDLLAKCYLSCLKLADQHSLNHVA

SEQ ID NO: 1672058 - protein, 23 aa, Staphylococcus aureus
RDLNQPQRDALRNQINQAQALAT

SEQ ID NO: 1672059 - protein, 22 aa, Staphylococcus aureus
RDLTELSGYWVYQDLKDNSTIK

SEQ ID NO: 1672060 - protein, 17 aa, Staphylococcus aureus
RDLVQYSQIDIVLEANI

SEQ ID NO: 1672061 - protein, 17 aa, Staphylococcus aureus
RDLYDSRGFLSCSRTLT

SEQ ID NO: 1672062 - protein, 25 aa, Staphylococcus aureus
RDNHSAYAFIKRLIKQFGKPQKVVT

SEQ ID NO: 1672063 - protein, 18 aa, Staphylococcus aureus
RDNYFIHAIDRIYINTSK

SEQ ID NO: 1672064 - protein, 23 aa, Staphylococcus aureus
RDQCSVCQAVLPQIEDLMQSYPN

SEQ ID NO: 1672065 - protein, 22 aa, Staphylococcus aureus
RDRIAFMRIVSGAFERGMDVTL

SEQ ID NO: 1672066 - protein, 17 aa, Staphylococcus aureus
RDRMFELVRDFEADSLM

SEQ ID NO: 1672067 - protein, 17 aa, Staphylococcus aureus
RDSCYFLAMGYFYNKED

SEQ ID NO: 1672068 - protein, 18 aa, Staphylococcus aureus
RDTSEKIVTIGYAKGVSH

SEQ ID NO: 1672069 - protein, 18 aa, Staphylococcus aureus
RDTSWIYDVDFEKLSKQQ

SEQ ID NO: 1672070 - protein, 25 aa, Staphylococcus aureus
RDVGLRKTIIYVMLPVLGNTVQSLS

SEQ ID NO: 1672071 - protein, 21 aa, Staphylococcus aureus
RDVLIPLQMLVLFDKTIFKDE

SEQ ID NO: 1672072 - protein, 24 aa, Staphylococcus aureus
RDVLIPLQMLVLFDKTIFKDEKQF

SEQ ID NO: 1672073 - protein, 24 aa, Staphylococcus aureus
RDVSKRVLSHILGIELPNPSMIDE

SEQ ID NO: 1672074 - protein, 23 aa, Staphylococcus aureus
READFINIIVFKKQAENVNKYLS

SEQ ID NO: 1672075 - protein, 17 aa, Staphylococcus aureus
REAESEITAAQRVIDNG

SEQ ID NO: 1672076 - protein, 17 aa, Staphylococcus aureus
REAGLFHIALLLPTTED

SEQ ID NO: 1672077 - protein, 17 aa, Staphylococcus aureus
REAITNINATPGATREE

SEQ ID NO: 1672078 - protein, 22 aa, Staphylococcus aureus
REDGSDVFVHFSAIAEDGYKSL

SEQ ID NO: 1672079 - protein, 20 aa, Staphylococcus aureus
REFDITKSLSSMELIIDVYE

SEQ ID NO: 1672080 - protein, 20 aa, Staphylococcus aureus
REFDITKSLSSMKLIIDVYE

SEQ ID NO: 1672081 - protein, 18 aa, Staphylococcus aureus
REFERCINDLGFKGALIT

SEQ ID NO: 1672082 - protein, 26 aa, Staphylococcus aureus
REFKFKDVMLKYYFNEDELTETQITM

SEQ ID NO: 1672083 - protein, 25 aa, Staphylococcus aureus
REFMDVGVYSMLGFVKGIDNHSSKV

SEQ ID NO: 1672084 - protein, 25 aa, Staphylococcus aureus
REGELKVSFDYIDWINSEFGQIGRQ

SEQ ID NO: 1672085 - protein, 17 aa, Staphylococcus aureus
REIEPPKKGFWSRFFGN

SEQ ID NO: 1672086 - protein, 17 aa, Staphylococcus aureus
REIFSSGKSLCKINNQT

SEQ ID NO: 1672087 - protein, 21 aa, Staphylococcus aureus
REIIDDIRLPSFIEEIESICK

SEQ ID NO: 1672088 - protein, 17 aa, Staphylococcus aureus
REIPYRLNEEINAINGN

SEQ ID NO: 1672089 - protein, 26 aa, Staphylococcus aureus
REITGRIFISLAVKFSKARLIDNIII

SEQ ID NO: 1672090 - protein, 22 aa, Staphylococcus aureus
REKFRHYCEHEVLSSIINGAYI

SEQ ID NO: 1672091 - protein, 19 aa, Staphylococcus aureus
REKHLELIMKWCAQELKNN

SEQ ID NO: 1672092 - protein, 23 aa, Staphylococcus aureus
REKLKEYMEIISKYQVRTVTFAD

SEQ ID NO: 1672093 - protein, 19 aa, Staphylococcus aureus
RELAHLIKGLNCHVNLIPV

SEQ ID NO: 1672094 - protein, 19 aa, Staphylococcus aureus
RELEYYLSEYLGRATPLTY

SEQ ID NO: 1672095 - protein, 17 aa, Staphylococcus aureus
RELGHEISFRERNGKIV

SEQ ID NO: 1672096 - protein, 20 aa, Staphylococcus aureus
RELITAKNHLDDPVSTEGKK

SEQ ID NO: 1672097 - protein, 17 aa, Staphylococcus aureus
RELKYAKKATYTVHFKN

SEQ ID NO: 1672098 - protein, 19 aa, Staphylococcus aureus
RELSRDGQVLYLYNKVQSI

SEQ ID NO: 1672099 - protein, 31 aa, Staphylococcus aureus
REMRLMWKEMMVILQAFRLPSVNLLQFMVKE

SEQ ID NO: 1672100 - protein, 19 aa, Staphylococcus aureus
RENIKKWFGNAWDGVKTKT

SEQ ID NO: 1672101 - protein, 21 aa, Staphylococcus aureus
RENKGKVVLVTAMSPTPAGEG

SEQ ID NO: 1672102 - protein, 27 aa, Staphylococcus aureus
RENYKLLIGSIIPRPIAFVTTLNQDAS

SEQ ID NO: 1672103 - protein, 18 aa, Staphylococcus aureus
REQLLKQQLELIVRDAGL

SEQ ID NO: 1672104 - protein, 18 aa, Staphylococcus aureus
RERERKVLQKRRFKKALQ

SEQ ID NO: 1672105 - protein, 18 aa, Staphylococcus aureus
RESGGLLMCGIPNMKLDK

SEQ ID NO: 1672106 - protein, 20 aa, Staphylococcus aureus
RETKWNISKTIAEDYEGKTL

SEQ ID NO: 1672107 - protein, 17 aa, Staphylococcus aureus
REVEPPKKRFWSRLFGN

SEQ ID NO: 1672108 - protein, 18 aa, Staphylococcus aureus
REVKRQAHILGEHVQIDD

SEQ ID NO: 1672109 - protein, 24 aa, Staphylococcus aureus
REVRKRQLIEFIDDALVNKDEAAF

SEQ ID NO: 1672110 - protein, 20 aa, Staphylococcus aureus
REYHGEYLFEGNDYQTQSDN

SEQ ID NO: 1672111 - protein, 31 aa, Staphylococcus aureus
REYLNPRIPKGRGIVKWNAFKTIPQQYEILE

SEQ ID NO: 1672112 - protein, 21 aa, Staphylococcus aureus
REYNYQIDIWWSEDEPNEQAE

SEQ ID NO: 1672113 - protein, 29 aa, Staphylococcus aureus
RFADFDFKEVRKHWELKLNQYSEREQSLR

SEQ ID NO: 1672114 - protein, 19 aa, Staphylococcus aureus
RFDIVDGKLNIQFNECEPY

SEQ ID NO: 1672115 - protein, 23 aa, Staphylococcus aureus
RFDKSPYDGFAIRSVDSQGASGQ

SEQ ID NO: 1672116 - protein, 29 aa, Staphylococcus aureus
RFDNLDSGKYKVIFEKPAGLTQTGTNTTE

SEQ ID NO: 1672117 - protein, 29 aa, Staphylococcus aureus
RFEGFTFDYCISNPPFGVDWKKDQKAVKA

SEQ ID NO: 1672118 - protein, 19 aa, Staphylococcus aureus
RFEKELKNLRFNSLKEEKI

SEQ ID NO: 1672119 - protein, 19 aa, Staphylococcus aureus
RFKKAIHDRGVKGQKETIK

SEQ ID NO: 1672120 - protein, 26 aa, Staphylococcus aureus
RFKVIDVIKRPLIIHGKTKNDDEAIN

SEQ ID NO: 1672121 - protein, 31 aa, Staphylococcus aureus
RFKVTDLDSANWVFKKLDAITTKENEINELA

SEQ ID NO: 1672122 - protein, 25 aa, Staphylococcus aureus
RFLEAYCDRHHIDLHIKKLDLSHSL

SEQ ID NO: 1672123 - protein, 17 aa, Staphylococcus aureus
RFLFPSATHGKKVYKLS

SEQ ID NO: 1672124 - protein, 19 aa, Staphylococcus aureus
RFNLKTSKTPKLLFKGSGD

SEQ ID NO: 1672125 - protein, 18 aa, Staphylococcus aureus
RFNYCIKEKMKLSEKDRL

SEQ ID NO: 1672126 - protein, 17 aa, Staphylococcus aureus
RFSTKGRYAHTYMPTKY

SEQ ID NO: 1672127 - protein, 18 aa, Staphylococcus aureus
RFVGSKMKQFLEDKFKLI

SEQ ID NO: 1672128 - protein, 17 aa, Staphylococcus aureus
RGAAEGVIRRYLIEEKN

SEQ ID NO: 1672129 - protein, 18 aa, Staphylococcus aureus
RGAHYKPEFPERNDEEWL

SEQ ID NO: 1672130 - protein, 25 aa, Staphylococcus aureus
RGAKIVEFGGWAMPVQFSSIKEEHN

SEQ ID NO: 1672131 - protein, 17 aa, Staphylococcus aureus
RGASFSWYEYSPLRIKY

SEQ ID NO: 1672132 - protein, 22 aa, Staphylococcus aureus
RGDGTFEYPLNGRKIVHNQEIE

SEQ ID NO: 1672133 - protein, 25 aa, Staphylococcus aureus
RGDTFFPPYTFEDWEIASSVEGKLD

SEQ ID NO: 1672134 - protein, 17 aa, Staphylococcus aureus
RGFESVINYLLHSQEVT

SEQ ID NO: 1672135 - protein, 22 aa, Staphylococcus aureus
RGGCSPVGMKTLFPTVVDKSCE

SEQ ID NO: 1672136 - protein, 18 aa, Staphylococcus aureus
RGGEVLYQAFGLKMQPEQ

SEQ ID NO: 1672137 - protein, 19 aa, Staphylococcus aureus
RGGEVLYQAFGLKMQPEQQ

SEQ ID NO: 1672138 - protein, 17 aa, Staphylococcus aureus
RGILRSLHCLRNLGYLK

SEQ ID NO: 1672139 - protein, 17 aa, Staphylococcus aureus
RGIVRLVHQNHYLPLNE

SEQ ID NO: 1672140 - protein, 24 aa, Staphylococcus aureus
RGLANVRPALPVSETYLAVQDALL

SEQ ID NO: 1672141 - protein, 18 aa, Staphylococcus aureus
RGLIRGIGQMAGQLVDAA

SEQ ID NO: 1672142 - protein, 19 aa, Staphylococcus aureus
RGLSDREKAGILFEELAHN

SEQ ID NO: 1672143 - protein, 17 aa, Staphylococcus aureus
RGLSFERKKQILIHELL

SEQ ID NO: 1672144 - protein, 22 aa, Staphylococcus aureus
RGMRMKIALTIVLSHDVKLLIL

SEQ ID NO: 1672145 - protein, 23 aa, Staphylococcus aureus
RGNKRIDYRLSYNFYTTYYDNVE

SEQ ID NO: 1672146 - protein, 20 aa, Staphylococcus aureus
RGPFGGALKKDIFVESGYAV

SEQ ID NO: 1672147 - protein, 22 aa, Staphylococcus aureus
RGPSLYSIIPMIEMMFGVHFIK

SEQ ID NO: 1672148 - protein, 20 aa, Staphylococcus aureus
RGRGPVNHFAYLKKEGLDDE

SEQ ID NO: 1672149 - protein, 20 aa, Staphylococcus aureus
RGTGKTSIAKMFAKAINCLN

SEQ ID NO: 1672150 - protein, 27 aa, Staphylococcus aureus
RGVLECPRCQSKLHLSRSIKKYDNGKT

SEQ ID NO: 1672151 - protein, 20 aa, Staphylococcus aureus
RGYKMLPHFQIGMFEDQLFV

SEQ ID NO: 1672152 - protein, 23 aa, Staphylococcus aureus
RHALEKYDTVILTGGLGPTKDDL

SEQ ID NO: 1672153 - protein, 23 aa, Staphylococcus aureus
RHCFDKAFIGMNGLDIELGLTTP

SEQ ID NO: 1672154 - protein, 22 aa, Staphylococcus aureus
RHDIKMTAWMPLMRNRGLLDDP

SEQ ID NO: 1672155 - protein, 24 aa, Staphylococcus aureus
RHELLRMISWKVGIETGFKLSVGK

SEQ ID NO: 1672156 - protein, 22 aa, Staphylococcus aureus
RHGQTLFNFKGLIQGFGDSPIT

SEQ ID NO: 1672157 - protein, 19 aa, Staphylococcus aureus
RHGTMPLTMFITKKGKQVK

SEQ ID NO: 1672158 - protein, 24 aa, Staphylococcus aureus
RHLQRRLYIENGRLIADDRNISVN

SEQ ID NO: 1672159 - protein, 18 aa, Staphylococcus aureus
RHMMSFDNTHFFAQLRHP

SEQ ID NO: 1672160 - protein, 24 aa, Staphylococcus aureus
RHNLPESEKAIYDKVISTAIQNIN

SEQ ID NO: 1672161 - protein, 23 aa, Staphylococcus aureus
RIAARARGRYGGRPEKLNKQDLT

SEQ ID NO: 1672162 - protein, 18 aa, Staphylococcus aureus
RIAEHIESITLMGGGTFG

SEQ ID NO: 1672163 - protein, 17 aa, Staphylococcus aureus
RIAQGVVSINAFKGVSF

SEQ ID NO: 1672164 - protein, 26 aa, Staphylococcus aureus
RIASPEFMFPSFYGIDVSTTAELISA

SEQ ID NO: 1672165 - protein, 19 aa, Staphylococcus aureus
RIDILSGNPTRIPYKEIID

SEQ ID NO: 1672166 - protein, 17 aa, Staphylococcus aureus
RIENFKFFGQYANLKEL

SEQ ID NO: 1672167 - protein, 23 aa, Staphylococcus aureus
RIFRGTEIVYQFLKYLFTHTYEH

SEQ ID NO: 1672168 - protein, 27 aa, Staphylococcus aureus
RIFRGTEIVYRFLKYLFTHTYEHKNEE

SEQ ID NO: 1672169 - protein, 23 aa, Staphylococcus aureus
RIGRLKSIPIFMYKIAKAKRKMK

SEQ ID NO: 1672170 - protein, 21 aa, Staphylococcus aureus
RIHVANFHFYIIDSGIDNAVQ

SEQ ID NO: 1672171 - protein, 24 aa, Staphylococcus aureus
RIIHSELLRFAGIGESKVETILID

SEQ ID NO: 1672172 - protein, 23 aa, Staphylococcus aureus
RIILDFTNTEWFNAELTVLLSDY

SEQ ID NO: 1672173 - protein, 19 aa, Staphylococcus aureus
RIITAIGYSGCDINPHSTY

SEQ ID NO: 1672174 - protein, 19 aa, Staphylococcus aureus
RILIDPMLSDKGAFEPFPN

SEQ ID NO: 1672175 - protein, 23 aa, Staphylococcus aureus
RILKQKHLDAIIILSDYNRRYLS

SEQ ID NO: 1672176 - protein, 17 aa, Staphylococcus aureus
RILLSSLSGAAVKYIEI

SEQ ID NO: 1672177 - protein, 19 aa, Staphylococcus aureus
RINDSIDAYSFWSKDQTPF

SEQ ID NO: 1672178 - protein, 18 aa, Staphylococcus aureus
RINGDIIVEKGLKPGDKL

SEQ ID NO: 1672179 - protein, 19 aa, Staphylococcus aureus
RINGIKFDYINKLPKNGKI

SEQ ID NO: 1672180 - protein, 17 aa, Staphylococcus aureus
RINKIYDEYKFKVNEEK

SEQ ID NO: 1672181 - protein, 18 aa, Staphylococcus aureus
RINTRPRAVLGYLTSEEV

SEQ ID NO: 1672182 - protein, 27 aa, Staphylococcus aureus
RIPEWTNGKFLPKRKVVKIEHFENEIK

SEQ ID NO: 1672183 - protein, 20 aa, Staphylococcus aureus
RIRLYIPLNERISADDYCKY

SEQ ID NO: 1672184 - protein, 26 aa, Staphylococcus aureus
RISNLIKFGYLKIEIIKEGNEVKQRK

SEQ ID NO: 1672185 - protein, 24 aa, Staphylococcus aureus
RITHGEINAVIALEPFTVEFEKNK

SEQ ID NO: 1672186 - protein, 25 aa, Staphylococcus aureus
RIVGYKKAREIWYLCRQYNAQEALD

SEQ ID NO: 1672187 - protein, 19 aa, Staphylococcus aureus
RKADEKTPNNTAVDKKSGK

SEQ ID NO: 1672188 - protein, 20 aa, Staphylococcus aureus
RKAKKKELREYYKNIEFTEL

SEQ ID NO: 1672189 - protein, 27 aa, Staphylococcus aureus
RKAKRLIKRLKETNIYAVNPLADQLQL

SEQ ID NO: 1672190 - protein, 19 aa, Staphylococcus aureus
RKALLIGVTIGPGNNRHHS

SEQ ID NO: 1672191 - protein, 19 aa, Staphylococcus aureus
RKARKAIESFVAETTEKYG

SEQ ID NO: 1672192 - protein, 31 aa, Staphylococcus aureus
RKDGRYLYKYMDSFGDPQFVYSWKLVPTDRI

SEQ ID NO: 1672193 - protein, 22 aa, Staphylococcus aureus
RKDLKFNLHLTTLHTSLIEMID

SEQ ID NO: 1672194 - protein, 17 aa, Staphylococcus aureus
RKDMESMQEQTDEEELF

SEQ ID NO: 1672195 - protein, 20 aa, Staphylococcus aureus
RKDMFFDYVSLKRMVIDEIQ

SEQ ID NO: 1672196 - protein, 20 aa, Staphylococcus aureus
RKDMYFDYVSLKRMVIDEIQ

SEQ ID NO: 1672197 - protein, 22 aa, Staphylococcus aureus
RKEAGSWSDWSELAINDYNMPF

SEQ ID NO: 1672198 - protein, 19 aa, Staphylococcus aureus
RKEILQTMQVGVGPQQREI

SEQ ID NO: 1672199 - protein, 20 aa, Staphylococcus aureus
RKEMGSWSDWSELALNDYNT

SEQ ID NO: 1672200 - protein, 35 aa, Staphylococcus aureus
RKEQVVLFLNRRGYASFMLCRDCGYVPQCPNCDIS

SEQ ID NO: 1672201 - protein, 18 aa, Staphylococcus aureus
RKEVMKYINKESAEIDKE

SEQ ID NO: 1672202 - protein, 21 aa, Staphylococcus aureus
RKFKSDIFNTQNWKYDELNDE

SEQ ID NO: 1672203 - protein, 23 aa, Staphylococcus aureus
RKGDEIKYFPIELATVVKALNID

SEQ ID NO: 1672204 - protein, 20 aa, Staphylococcus aureus
RKIIDHWIWTDSKRLKWWMD

SEQ ID NO: 1672205 - protein, 19 aa, Staphylococcus aureus
RKIPGSKMMYFYKDSVSPS

SEQ ID NO: 1672206 - protein, 32 aa, Staphylococcus aureus
RKIRREGIYFKGLRYFSTTLIAYITEDVFIRY

SEQ ID NO: 1672207 - protein, 22 aa, Staphylococcus aureus
RKKRVYDLLETVGLSKEHANRY

SEQ ID NO: 1672208 - protein, 19 aa, Staphylococcus aureus
RKLFSHFSEPHHLRLGFSQ

SEQ ID NO: 1672209 - protein, 18 aa, Staphylococcus aureus
RKLLKNKVHVTLLVRDVD

SEQ ID NO: 1672210 - protein, 20 aa, Staphylococcus aureus
RKLYPEAKIYVFGKTNYKLS

SEQ ID NO: 1672211 - protein, 21 aa, Staphylococcus aureus
RKMMGEYIIYYDGVVIGGLYD

SEQ ID NO: 1672212 - protein, 26 aa, Staphylococcus aureus
RKNDDYIWLGHSFVRKGVLDDVKLEP

SEQ ID NO: 1672213 - protein, 17 aa, Staphylococcus aureus
RKNEHVEIAMAQSDAMD

SEQ ID NO: 1672214 - protein, 30 aa, Staphylococcus aureus
RKNGRKSVFLMLNIKKGIFKTHPNLRQAVV

SEQ ID NO: 1672215 - protein, 22 aa, Staphylococcus aureus
RKNNGFIVFVRVKFYDGKDALK

SEQ ID NO: 1672216 - protein, 23 aa, Staphylococcus aureus
RKNNGFIVFVRVKFYDGKDALQP

SEQ ID NO: 1672217 - protein, 25 aa, Staphylococcus aureus
RKQALLFEWSRINSMLDTQLYITRL

SEQ ID NO: 1672218 - protein, 20 aa, Staphylococcus aureus
RKQMKSLLNSRTLNYSKNQI

SEQ ID NO: 1672219 - protein, 18 aa, Staphylococcus aureus
RKRQRLFGEHDVNHINQY

SEQ ID NO: 1672220 - protein, 24 aa, Staphylococcus aureus
RKSISLKTSFGIWGDGNLGYITAI

SEQ ID NO: 1672221 - protein, 26 aa, Staphylococcus aureus
RKSKEKEYGYIILPIVIPAGTNPENI

SEQ ID NO: 1672222 - protein, 17 aa, Staphylococcus aureus
RKSLGYRTPLEVFMSFI

SEQ ID NO: 1672223 - protein, 19 aa, Staphylococcus aureus
RKSNCGRHRIVLPEEQADY

SEQ ID NO: 1672224 - protein, 18 aa, Staphylococcus aureus
RKTAIEAMNDSTTEEQQA

SEQ ID NO: 1672225 - protein, 21 aa, Staphylococcus aureus
RKTSEIELKLDARGRLYYFHQ

SEQ ID NO: 1672226 - protein, 17 aa, Staphylococcus aureus
RKVHGCLARCIKDALYD

SEQ ID NO: 1672227 - protein, 22 aa, Staphylococcus aureus
RKVLQKRRFKKALQQKREEHKN

SEQ ID NO: 1672228 - protein, 24 aa, Staphylococcus aureus
RKVVKELPNTGSEEMDLPLKELAL

SEQ ID NO: 1672229 - protein, 18 aa, Staphylococcus aureus
RKWIEKFKAIGDTFKAKS

SEQ ID NO: 1672230 - protein, 27 aa, Staphylococcus aureus
RLAEPGEFTKRAFLNGRIDLSQAEAVM

SEQ ID NO: 1672231 - protein, 21 aa, Staphylococcus aureus
RLDDLTSVGFIFPNDNKKVFL

SEQ ID NO: 1672232 - protein, 21 aa, Staphylococcus aureus
RLDDLTSVGFIFPTDNKSVFL

SEQ ID NO: 1672233 - protein, 26 aa, Staphylococcus aureus
RLEKELKSIIGNGFAVIYLISQRLVK

SEQ ID NO: 1672234 - protein, 20 aa, Staphylococcus aureus
RLFIDHGMGVVIGETCTIGD

SEQ ID NO: 1672235 - protein, 19 aa, Staphylococcus aureus
RLGVKSGVSPYGSRQAHGH

SEQ ID NO: 1672236 - protein, 35 aa, Staphylococcus aureus
RLGYDLNEKVINMFSFFIAYHFNKLDIGIERIFIQ

SEQ ID NO: 1672237 - protein, 23 aa, Staphylococcus aureus
RLHKVETLRVNWIQTTGGSLSSS

SEQ ID NO: 1672238 - protein, 23 aa, Staphylococcus aureus
RLIKKAERGECISKFRSASSISG

SEQ ID NO: 1672239 - protein, 17 aa, Staphylococcus aureus
RLILKDPKIILADEPTG

SEQ ID NO: 1672240 - protein, 21 aa, Staphylococcus aureus
RLKEIKQIIADMFEKYQNDDA

SEQ ID NO: 1672241 - protein, 22 aa, Staphylococcus aureus
RLKEIKQIIADMFEKYQSDDVY

SEQ ID NO: 1672242 - protein, 22 aa, Staphylococcus aureus
RLKEVHPNILIFVDNCYGEFVE

SEQ ID NO: 1672243 - protein, 18 aa, Staphylococcus aureus
RLKKAIHDRGVKGQKETI

SEQ ID NO: 1672244 - protein, 19 aa, Staphylococcus aureus
RLLNNDILLKFNRVSVDYT

SEQ ID NO: 1672245 - protein, 26 aa, Staphylococcus aureus
RLMQLSKRLPIIPVIKNQRSALYIKH

SEQ ID NO: 1672246 - protein, 20 aa, Staphylococcus aureus
RLNNNLPLTKSEFEEQESKK

SEQ ID NO: 1672247 - protein, 19 aa, Staphylococcus aureus
RLNYVGFYRLHHKYNKKVM

SEQ ID NO: 1672248 - protein, 20 aa, Staphylococcus aureus
RLQDIFKLLNHRERLWLKLY

SEQ ID NO: 1672249 - protein, 17 aa, Staphylococcus aureus
RLQEAFSNIEVGDPQDE

SEQ ID NO: 1672250 - protein, 18 aa, Staphylococcus aureus
RLQPLLIYITTAGYQLDG

SEQ ID NO: 1672251 - protein, 18 aa, Staphylococcus aureus
RLSGSDLVGIDFKRYDGI

SEQ ID NO: 1672252 - protein, 32 aa, Staphylococcus aureus
RLSLPEARIPLSQAVIELCLSPKSNSAMSAID

SEQ ID NO: 1672253 - protein, 26 aa, Staphylococcus aureus
RLSPYTRQRLGNVIKQGARIEMNVHY

SEQ ID NO: 1672254 - protein, 19 aa, Staphylococcus aureus
RLTNIKGLEIPRVSYTLDD

SEQ ID NO: 1672255 - protein, 19 aa, Staphylococcus aureus
RLVGYNISPVLWKKVKKGL

SEQ ID NO: 1672256 - protein, 30 aa, Staphylococcus aureus
RLVGYNISPVLWKKVKKGLSAGRVQSVALR

SEQ ID NO: 1672257 - protein, 18 aa, Staphylococcus aureus
RLVYCFKLDNDKFNLKNK

SEQ ID NO: 1672258 - protein, 17 aa, Staphylococcus aureus
RMGDYFLSEYLLEKYRN

SEQ ID NO: 1672259 - protein, 21 aa, Staphylococcus aureus
RMGSMGSVIGEKICRIIDYCT

SEQ ID NO: 1672260 - protein, 17 aa, Staphylococcus aureus
RMHKGTEQMLGMFANTL

SEQ ID NO: 1672261 - protein, 17 aa, Staphylococcus aureus
RMINVMMCYCVLFLEPC

SEQ ID NO: 1672262 - protein, 18 aa, Staphylococcus aureus
RMMQYKKINKNLVGFMRA

SEQ ID NO: 1672263 - protein, 17 aa, Staphylococcus aureus
RMNELFGNVEVANKDKG

SEQ ID NO: 1672264 - protein, 17 aa, Staphylococcus aureus
RMQYVIPNEFLKYTGRV

SEQ ID NO: 1672265 - protein, 18 aa, Staphylococcus aureus
RMRMCLSGSSFDDNLKHN

SEQ ID NO: 1672266 - protein, 21 aa, Staphylococcus aureus
RNAKKATGYYFVNKVYDDISK

SEQ ID NO: 1672267 - protein, 18 aa, Staphylococcus aureus
RNDEEWLKTTMASFQGAF

SEQ ID NO: 1672268 - protein, 22 aa, Staphylococcus aureus
RNEAHQLLKLVGMSAKAQQYIG

SEQ ID NO: 1672269 - protein, 19 aa, Staphylococcus aureus
RNEENFSYYDRFRNRIMFP

SEQ ID NO: 1672270 - protein, 25 aa, Staphylococcus aureus
RNELTICGSWNCLSSNFPGKEWTAT

SEQ ID NO: 1672271 - protein, 26 aa, Staphylococcus aureus
RNESLASFMRILRICEERGSGVDKIV

SEQ ID NO: 1672272 - protein, 17 aa, Staphylococcus aureus
RNGESLFNQGLDLLQEI

SEQ ID NO: 1672273 - protein, 17 aa, Staphylococcus aureus
RNGNVVTTFTRHNNTSP

SEQ ID NO: 1672274 - protein, 25 aa, Staphylococcus aureus
RNGYEHIGFSGAGAMDQFSFKVAQS

SEQ ID NO: 1672275 - protein, 17 aa, Staphylococcus aureus
RNHLRLWSLQGHRDIPH

SEQ ID NO: 1672276 - protein, 19 aa, Staphylococcus aureus
RNIYQYFVCYTAIELGCRV

SEQ ID NO: 1672277 - protein, 26 aa, Staphylococcus aureus
RNKCYKLSNLILDYKCVPFDQMPFTA

SEQ ID NO: 1672278 - protein, 22 aa, Staphylococcus aureus
RNKFGGQLFRNTTFPDEKYLKE

SEQ ID NO: 1672279 - protein, 22 aa, Staphylococcus aureus
RNKLEPIMLRIVNDVDHPINER

SEQ ID NO: 1672280 - protein, 35 aa, Staphylococcus aureus
RNLFKKEGLDPWTSCEFDFTREGKLNVSFDYIDWI

SEQ ID NO: 1672281 - protein, 31 aa, Staphylococcus aureus
RNLKNALKLIKLCQTYRVHILSVHDGYFDMD

SEQ ID NO: 1672282 - protein, 26 aa, Staphylococcus aureus
RNLKNALKLMKLCQKYHVHILSIHDG

SEQ ID NO: 1672283 - protein, 25 aa, Staphylococcus aureus
RNLKNALKLMKLCQTYHVHILSVHD

SEQ ID NO: 1672284 - protein, 17 aa, Staphylococcus aureus
RNLSKFNKCIMLNPEPL

SEQ ID NO: 1672285 - protein, 20 aa, Staphylococcus aureus
RNLSKYNKCLMLKPESLVGK

SEQ ID NO: 1672286 - protein, 22 aa, Staphylococcus aureus
RNMVDKGVVIWKGKEFEPSDIV

SEQ ID NO: 1672287 - protein, 20 aa, Staphylococcus aureus
RNNAMFSVALYYYSKNIDMK

SEQ ID NO: 1672288 - protein, 18 aa, Staphylococcus aureus
RNNWKLYHHYVWEKYYGE

SEQ ID NO: 1672289 - protein, 30 aa, Staphylococcus aureus
RNPYVRHIAHPTGRIIGRRDGYKPNIEQLM

SEQ ID NO: 1672290 - protein, 19 aa, Staphylococcus aureus
RNRLHKVETLRANWTQTTG

SEQ ID NO: 1672291 - protein, 18 aa, Staphylococcus aureus
RNRYWGTPLNVWICNDCN

SEQ ID NO: 1672292 - protein, 24 aa, Staphylococcus aureus
RNVKPEFFIRTVVAQILNLNIPII

SEQ ID NO: 1672293 - protein, 17 aa, Staphylococcus aureus
RNWCSNFSMLGPRQLLL

SEQ ID NO: 1672294 - protein, 17 aa, Staphylococcus aureus
RNWKSNFSMLGPLTLIE

SEQ ID NO: 1672295 - protein, 18 aa, Staphylococcus aureus
RNYFFIKKPKRMKYINKF

SEQ ID NO: 1672296 - protein, 20 aa, Staphylococcus aureus
RNYIDFGISLDKYWNVTFLP

SEQ ID NO: 1672297 - protein, 22 aa, Staphylococcus aureus
RNYVDFGIAFDSQWNFAVLPEE

SEQ ID NO: 1672298 - protein, 21 aa, Staphylococcus aureus
RPAKGTTYKIYFGFADRHAYE

SEQ ID NO: 1672299 - protein, 18 aa, Staphylococcus aureus
RPDLPASKIAQYIRKDIL

SEQ ID NO: 1672300 - protein, 17 aa, Staphylococcus aureus
RPELQRMLNDAKNGKLD

SEQ ID NO: 1672301 - protein, 26 aa, Staphylococcus aureus
RPERFWPADLVLLSIGFEGTEPTVPN

SEQ ID NO: 1672302 - protein, 18 aa, Staphylococcus aureus
RPETEEVMLHFLQQLEDD

SEQ ID NO: 1672303 - protein, 20 aa, Staphylococcus aureus
RPHSSLQYLTPVAFKNLHMK

SEQ ID NO: 1672304 - protein, 20 aa, Staphylococcus aureus
RPIDNTLPIWRAVGGPPASA

SEQ ID NO: 1672305 - protein, 17 aa, Staphylococcus aureus
RPKGQRVSDMMIQGHAV

SEQ ID NO: 1672306 - protein, 26 aa, Staphylococcus aureus
RPKHIYSIYRKMMKQKKQFDQIFDLL

SEQ ID NO: 1672307 - protein, 19 aa, Staphylococcus aureus
RPKRKVNIIDIGRISELDF

SEQ ID NO: 1672308 - protein, 19 aa, Staphylococcus aureus
RPNVGKSTIFNRIVGERVS

SEQ ID NO: 1672309 - protein, 17 aa, Staphylococcus aureus
RPPEPYKGKGIRYQGEY

SEQ ID NO: 1672310 - protein, 25 aa, Staphylococcus aureus
RPRIYTDVCLLCFSLKEAGHGRLLQ

SEQ ID NO: 1672311 - protein, 24 aa, Staphylococcus aureus
RPSEWFKTCNLVDVEISEEKFKEL

SEQ ID NO: 1672312 - protein, 18 aa, Staphylococcus aureus
RPSIPLDEIEEVITRLKE

SEQ ID NO: 1672313 - protein, 17 aa, Staphylococcus aureus
RPTEFLVQYLVNGKAKS

SEQ ID NO: 1672314 - protein, 17 aa, Staphylococcus aureus
RPTNTVTIFAGQDKEAT

SEQ ID NO: 1672315 - protein, 19 aa, Staphylococcus aureus
RPVDLTTRLAIAKYLYDGV

SEQ ID NO: 1672316 - protein, 22 aa, Staphylococcus aureus
RPVFQEALNFVRMGDRFVVESI

SEQ ID NO: 1672317 - protein, 23 aa, Staphylococcus aureus
RQAKSDAKANLGTLTHLNNAQKQ

SEQ ID NO: 1672318 - protein, 21 aa, Staphylococcus aureus
RQALESQINNAATRGEVAQKL

SEQ ID NO: 1672319 - protein, 23 aa, Staphylococcus aureus
RQARNFVHACLGIEEIVVKPEEA

SEQ ID NO: 1672320 - protein, 17 aa, Staphylococcus aureus
RQAVYAGIFQWQNGQLV

SEQ ID NO: 1672321 - protein, 26 aa, Staphylococcus aureus
RQCKLGRDRNKFCENIIFVLLPLSFL

SEQ ID NO: 1672322 - protein, 19 aa, Staphylococcus aureus
RQGYGEVHHVSFRVKDHDA

SEQ ID NO: 1672323 - protein, 17 aa, Staphylococcus aureus
RQLRYIYDVYFDRDDCI

SEQ ID NO: 1672324 - protein, 34 aa, Staphylococcus aureus
RQLTRLLFYSGLRIGEALALQWKDYDKIKGEIDV

SEQ ID NO: 1672325 - protein, 18 aa, Staphylococcus aureus
RQMYDCNVYRVYFNDVQL

SEQ ID NO: 1672326 - protein, 26 aa, Staphylococcus aureus
RQQLQAFPICVEFRHQSWFSDAFKEQ

SEQ ID NO: 1672327 - protein, 17 aa, Staphylococcus aureus
RQRKRAYEMLDVVMHYK

SEQ ID NO: 1672328 - protein, 18 aa, Staphylococcus aureus
RQSLTTKNYRHYYIHLDE

SEQ ID NO: 1672329 - protein, 19 aa, Staphylococcus aureus
RQTHLIGAIIPRMNSYAVD

SEQ ID NO: 1672330 - protein, 21 aa, Staphylococcus aureus
RQVPELTFDICGEGSEKTRLR

SEQ ID NO: 1672331 - protein, 24 aa, Staphylococcus aureus
RRAEIGKGISTYWWNANNWDNAAA

SEQ ID NO: 1672332 - protein, 25 aa, Staphylococcus aureus
RRAEIGKGISTYWWNANNWDNAAAA

SEQ ID NO: 1672333 - protein, 22 aa, Staphylococcus aureus
RRDRFEAMLTKVDLPFFHAKGG

SEQ ID NO: 1672334 - protein, 19 aa, Staphylococcus aureus
RRILLKEVRDSIFREKMVG

SEQ ID NO: 1672335 - protein, 18 aa, Staphylococcus aureus
RRIMMALQHVAQHKNIAF

SEQ ID NO: 1672336 - protein, 17 aa, Staphylococcus aureus
RRKKFPSNLEYIDSHTD

SEQ ID NO: 1672337 - protein, 26 aa, Staphylococcus aureus
RRKVKRELYDGRGFLICSRILGEGQR

SEQ ID NO: 1672338 - protein, 26 aa, Staphylococcus aureus
RRKVKRELYDGRGFLSCSRILGEGQR

SEQ ID NO: 1672339 - protein, 26 aa, Staphylococcus aureus
RRKVKREWYDGRGFLSCSRILGEGQR

SEQ ID NO: 1672340 - protein, 23 aa, Staphylococcus aureus
RRLEKPKGIMIRNAQTMSSVENL

SEQ ID NO: 1672341 - protein, 17 aa, Staphylococcus aureus
RRLLIVPFNADFNDSNE

SEQ ID NO: 1672342 - protein, 19 aa, Staphylococcus aureus
RRNIGMIFQHFNLVKRSSV

SEQ ID NO: 1672343 - protein, 20 aa, Staphylococcus aureus
RRNLIAIKFFEDKQVEQSEA

SEQ ID NO: 1672344 - protein, 18 aa, Staphylococcus aureus
RRNQALVYYREVVKHHQL

SEQ ID NO: 1672345 - protein, 25 aa, Staphylococcus aureus
RRQAKAVNFGIVYGISDYGLSQSLG

SEQ ID NO: 1672346 - protein, 21 aa, Staphylococcus aureus
RRQDERISWNKPGRQVFNQIR

SEQ ID NO: 1672347 - protein, 18 aa, Staphylococcus aureus
RRSITFRLIENFKPASWI

SEQ ID NO: 1672348 - protein, 26 aa, Staphylococcus aureus
RRVLAETSQYITIEFDFTEAEQAGYV

SEQ ID NO: 1672349 - protein, 23 aa, Staphylococcus aureus
RSARAYGSAALEIVSVATGNLEA

SEQ ID NO: 1672350 - protein, 18 aa, Staphylococcus aureus
RSGSIYKGRRLESYSFDI

SEQ ID NO: 1672351 - protein, 20 aa, Staphylococcus aureus
RSIINGKLDSQWTVPNEHKT

SEQ ID NO: 1672352 - protein, 18 aa, Staphylococcus aureus
RSIKDLKVKISRITIGYT

SEQ ID NO: 1672353 - protein, 26 aa, Staphylococcus aureus
RSIPERRPEGAVTYHMPTHCPSCGHE

SEQ ID NO: 1672354 - protein, 24 aa, Staphylococcus aureus
RSITNGRLDSQWAAPNEHKTAVLF

SEQ ID NO: 1672355 - protein, 26 aa, Staphylococcus aureus
RSITNGRLEPQWTVPNEHKSTVLFDG

SEQ ID NO: 1672356 - protein, 20 aa, Staphylococcus aureus
RSKQFKAFMKAFSLEHLINK

SEQ ID NO: 1672357 - protein, 18 aa, Staphylococcus aureus
RSLKEYRKYYEPLIHKND

SEQ ID NO: 1672358 - protein, 20 aa, Staphylococcus aureus
RSLQIYGFSPCRVISIMLAS

SEQ ID NO: 1672359 - protein, 25 aa, Staphylococcus aureus
RSMNEVFRYLVFEKKNGNELESSTK

SEQ ID NO: 1672360 - protein, 21 aa, Staphylococcus aureus
RSNINLTLNAKKEWRNILIST

SEQ ID NO: 1672361 - protein, 19 aa, Staphylococcus aureus
RSNNIYPIIVHGGGPFINE

SEQ ID NO: 1672362 - protein, 23 aa, Staphylococcus aureus
RSNWKVLPGLLRDSTNKEHINHF

SEQ ID NO: 1672363 - protein, 20 aa, Staphylococcus aureus
RSQMAEGWAKQILAEDWNVY

SEQ ID NO: 1672364 - protein, 24 aa, Staphylococcus aureus
RSQMAEGWGKEILGEGWNVYSAGI

SEQ ID NO: 1672365 - protein, 22 aa, Staphylococcus aureus
RSQSGTLALCLENISKNINDYS

SEQ ID NO: 1672366 - protein, 22 aa, Staphylococcus aureus
RSRKASQFLAQRGYDVVNLDGG

SEQ ID NO: 1672367 - protein, 20 aa, Staphylococcus aureus
RSSVETLELTHLIVEEAYRC

SEQ ID NO: 1672368 - protein, 18 aa, Staphylococcus aureus
RSTDDIFTRLKDGHLRFR

SEQ ID NO: 1672369 - protein, 17 aa, Staphylococcus aureus
RSTDDIFTRLNDGHLRF

SEQ ID NO: 1672370 - protein, 18 aa, Staphylococcus aureus
RSTDVTAVAEKEVVEETK

SEQ ID NO: 1672371 - protein, 21 aa, Staphylococcus aureus
RSVIEIIKMLQAHPAVQQVFH

SEQ ID NO: 1672372 - protein, 19 aa, Staphylococcus aureus
RSVRFPGLISHVKESGGGT

SEQ ID NO: 1672373 - protein, 23 aa, Staphylococcus aureus
RSYKEELIEFILSIQKNEFNIKI

SEQ ID NO: 1672374 - protein, 24 aa, Staphylococcus aureus
RSYPTVEIIFNLAYGIIMKIKEKY

SEQ ID NO: 1672375 - protein, 20 aa, Staphylococcus aureus
RTAVKQDLTEAQALDQLMDA

SEQ ID NO: 1672376 - protein, 22 aa, Staphylococcus aureus
RTAVKQDLTEVQALDQLMDALQ

SEQ ID NO: 1672377 - protein, 24 aa, Staphylococcus aureus
RTAVKQDLTEVQALDQLMDALQQS

SEQ ID NO: 1672378 - protein, 30 aa, Staphylococcus aureus
RTDHIRHLLEFKACTPIDIDRVEPVSDIVK

SEQ ID NO: 1672379 - protein, 25 aa, Staphylococcus aureus
RTEEIKYYLAEAIKAEKAGKKVEMK

SEQ ID NO: 1672380 - protein, 20 aa, Staphylococcus aureus
RTELPFLVKCVQTAVDAGAT

SEQ ID NO: 1672381 - protein, 19 aa, Staphylococcus aureus
RTELVKCLDYLRGDDTLVF

SEQ ID NO: 1672382 - protein, 22 aa, Staphylococcus aureus
RTFYRRFEKYLGKEWNTDAKCR

SEQ ID NO: 1672383 - protein, 17 aa, Staphylococcus aureus
RTGESDSSVLLFNITKN

SEQ ID NO: 1672384 - protein, 18 aa, Staphylococcus aureus
RTGPHFEVLAKIENRLME

SEQ ID NO: 1672385 - protein, 18 aa, Staphylococcus aureus
RTGYEVMDLDGNIIGEVT

SEQ ID NO: 1672386 - protein, 18 aa, Staphylococcus aureus
RTIIRLSPPLVIDKEEIN

SEQ ID NO: 1672387 - protein, 23 aa, Staphylococcus aureus
RTKAGGDALMILSVDQPVSNNII

SEQ ID NO: 1672388 - protein, 19 aa, Staphylococcus aureus
RTKIQEIDRVLASHPDVAT

SEQ ID NO: 1672389 - protein, 17 aa, Staphylococcus aureus
RTLIPFLTMIQNTFGYL

SEQ ID NO: 1672390 - protein, 18 aa, Staphylococcus aureus
RTLIYVPACNNFLREVNI

SEQ ID NO: 1672391 - protein, 25 aa, Staphylococcus aureus
RTLKHCDNCGGAIRPDIVSYGEMLD

SEQ ID NO: 1672392 - protein, 25 aa, Staphylococcus aureus
RTLKHCDNCGGTIRPDIVLYGEMLD

SEQ ID NO: 1672393 - protein, 29 aa, Staphylococcus aureus
RTLSKAFGIAGLRLGVLISTAETIQRIQT

SEQ ID NO: 1672394 - protein, 17 aa, Staphylococcus aureus
RTNGFSFKVKLEDQPQW

SEQ ID NO: 1672395 - protein, 21 aa, Staphylococcus aureus
RTPRGRKATPLAYGHFAKSNE

SEQ ID NO: 1672396 - protein, 20 aa, Staphylococcus aureus
RTQIATPIQIVTPIQTVSQI

SEQ ID NO: 1672397 - protein, 20 aa, Staphylococcus aureus
RTRIIDCLETAHTRLQLLSR

SEQ ID NO: 1672398 - protein, 17 aa, Staphylococcus aureus
RTRNPIRLMIGFDYPDT

SEQ ID NO: 1672399 - protein, 18 aa, Staphylococcus aureus
RTSTKLKEYEVFHMLDKE

SEQ ID NO: 1672400 - protein, 23 aa, Staphylococcus aureus
RTSYFGYKAIQLFKNNSKNKKSI

SEQ ID NO: 1672401 - protein, 23 aa, Staphylococcus aureus
RTTIKNDVWIGANVIIMDGLTIN

SEQ ID NO: 1672402 - protein, 20 aa, Staphylococcus aureus
RTTKQLINLASWLQEHNIEL

SEQ ID NO: 1672403 - protein, 18 aa, Staphylococcus aureus
RTVASCLASQDYVSIVKG

SEQ ID NO: 1672404 - protein, 32 aa, Staphylococcus aureus
RTVGLELLEKGIARTGYEVMDLDGNIIGKVTS

SEQ ID NO: 1672405 - protein, 32 aa, Staphylococcus aureus; identical to SEQ ID NO: 1581533

SEQ ID NO: 1672406 - protein, 19 aa, Staphylococcus aureus
RTVTPCEVFSYGIDEEAQF

SEQ ID NO: 1672407 - protein, 22 aa, Staphylococcus aureus
RVAFDLRSKEAFHGGHTKGTIN

SEQ ID NO: 1672408 - protein, 17 aa, Staphylococcus aureus
RVDIAGSVENIYDITKD

SEQ ID NO: 1672409 - protein, 18 aa, Staphylococcus aureus
RVDKRIATKYCDIKTANL

SEQ ID NO: 1672410 - protein, 20 aa, Staphylococcus aureus
RVDTLIKRRLSQMALDKDTS

SEQ ID NO: 1672411 - protein, 21 aa, Staphylococcus aureus
RVEEELSQDIAVLVKEKEKEA

SEQ ID NO: 1672412 - protein, 32 aa, Staphylococcus aureus
RVETNGIATLKGVQPHIVIKPEAQQAIKASAE

SEQ ID NO: 1672413 - protein, 39 aa, Staphylococcus aureus
RVETNGIATLKGVQPHIVIKPEVQQAIKASAENQVESIK

SEQ ID NO: 1672414 - protein, 19 aa, Staphylococcus aureus
RVGEALALRISDFDLKNQT

SEQ ID NO: 1672415 - protein, 20 aa, Staphylococcus aureus
RVGRSSRIGYAYFLHPENKV

SEQ ID NO: 1672416 - protein, 25 aa, Staphylococcus aureus
RVHHPNEILECILIEAPDLKNTASD

SEQ ID NO: 1672417 - protein, 19 aa, Staphylococcus aureus
RVHYQMGLNHFIAARDALD

SEQ ID NO: 1672418 - protein, 17 aa, Staphylococcus aureus
RVKALLRRTQSTTVEQS

SEQ ID NO: 1672419 - protein, 25 aa, Staphylococcus aureus
RVKEAAKLGFKRVIIPKNNIGGWTY

SEQ ID NO: 1672420 - protein, 17 aa, Staphylococcus aureus
RVLELTMTYGARLAEPG

SEQ ID NO: 1672421 - protein, 19 aa, Staphylococcus aureus
RVLPFLDGEYWPGCHSCGE

SEQ ID NO: 1672422 - protein, 20 aa, Staphylococcus aureus
RVLRVLDFHFQLVIDANESL

SEQ ID NO: 1672423 - protein, 17 aa, Staphylococcus aureus
RVLTPHEVKVMRHLAEH

SEQ ID NO: 1672424 - protein, 19 aa, Staphylococcus aureus
RVMNGEKMIHPKAQDVFET

SEQ ID NO: 1672425 - protein, 23 aa, Staphylococcus aureus
RVNELYQLCDIYLDRVNELYQLC

SEQ ID NO: 1672426 - protein, 17 aa, Staphylococcus aureus
RVPHGAGGIVLDVKVFN

SEQ ID NO: 1672427 - protein, 20 aa, Staphylococcus aureus
RVQGVGFRYFTQRIAMNYNI

SEQ ID NO: 1672428 - protein, 25 aa, Staphylococcus aureus
RVQHPNEILECILIEAPDLKNAASD

SEQ ID NO: 1672429 - protein, 17 aa, Staphylococcus aureus
RVQSVALRLVIDRENEI

SEQ ID NO: 1672430 - protein, 27 aa, Staphylococcus aureus
RVSVSRTCDILGIGVGTYYHKLEWLYR

SEQ ID NO: 1672431 - protein, 18 aa, Staphylococcus aureus
RVTYPCAIKRFDVENNYL

SEQ ID NO: 1672432 - protein, 18 aa, Staphylococcus aureus
RVTYPCVIKRYDVENNYL

SEQ ID NO: 1672433 - protein, 17 aa, Staphylococcus aureus
RVVNFKNFLASDRQNFF

SEQ ID NO: 1672434 - protein, 24 aa, Staphylococcus aureus
RVYLAVGGGFELDVWLGSNSTDFN

SEQ ID NO: 1672435 - protein, 19 aa, Staphylococcus aureus
RVYLNNQFLCIAYCNELEN

SEQ ID NO: 1672436 - protein, 17 aa, Staphylococcus aureus
RVYRTFVQGKMIETDAR

SEQ ID NO: 1672437 - protein, 20 aa, Staphylococcus aureus
RWAIAYKFPAEEVVTKLLDI

SEQ ID NO: 1672438 - protein, 24 aa, Staphylococcus aureus
RWEVYREWKHFINGANKITLSMKP

SEQ ID NO: 1672439 - protein, 18 aa, Staphylococcus aureus
RWKPKYEKKIIAQIDIKV

SEQ ID NO: 1672440 - protein, 17 aa, Staphylococcus aureus
RWNQDFRLEDFKKVIDI

SEQ ID NO: 1672441 - protein, 21 aa, Staphylococcus aureus
RWNSGDIKLLIAHPASAGHGL

SEQ ID NO: 1672442 - protein, 23 aa, Staphylococcus aureus
RWNSGDIKLLIAHPASAGHGLNL

SEQ ID NO: 1672443 - protein, 25 aa, Staphylococcus aureus
RWNSSHHQLIFFGRYHCLARKPKCD

SEQ ID NO: 1672444 - protein, 21 aa, Staphylococcus aureus
RYDVGEKLGFVKTTIEYALKD

SEQ ID NO: 1672445 - protein, 28 aa, Staphylococcus aureus
RYEDDLRKIIPRIPLLKNVKKFVNIGKK

SEQ ID NO: 1672446 - protein, 23 aa, Staphylococcus aureus
RYFLNMLQRIKIHLVAFDEAHCI

SEQ ID NO: 1672447 - protein, 18 aa, Staphylococcus aureus
RYHHAFKDSGLKYNISYA

SEQ ID NO: 1672448 - protein, 18 aa, Staphylococcus aureus
RYHHAFKESGLKYNISYA

SEQ ID NO: 1672449 - protein, 19 aa, Staphylococcus aureus
RYICLSPKFNFEKREKEIP

SEQ ID NO: 1672450 - protein, 17 aa, Staphylococcus aureus
RYICLSSKFNFEKREKE

SEQ ID NO: 1672451 - protein, 19 aa, Staphylococcus aureus
RYIDGELWIYSAVLDGNKN

SEQ ID NO: 1672452 - protein, 20 aa, Staphylococcus aureus
RYINGELWIYSAVLDSNKNN

SEQ ID NO: 1672453 - protein, 20 aa, Staphylococcus aureus
RYLHQYPELSFEEFQTHDYI

SEQ ID NO: 1672454 - protein, 24 aa, Staphylococcus aureus
RYLNDIEFELPLIIRNEVLAPGGQ

SEQ ID NO: 1672455 - protein, 25 aa, Staphylococcus aureus
RYNKMLFLPTSFKWNGSEYPIQYNY

SEQ ID NO: 1672456 - protein, 18 aa, Staphylococcus aureus
RYNLQIATNSQFVLSYDL

SEQ ID NO: 1672457 - protein, 21 aa, Staphylococcus aureus
RYPIRALMMSHMFVEVDDNVH

SEQ ID NO: 1672458 - protein, 23 aa, Staphylococcus aureus
RYPIRALMMSHMFVEVDGNVHAQ

SEQ ID NO: 1672459 - protein, 18 aa, Staphylococcus aureus
RYQLPLFIVKNGFGAVDE

SEQ ID NO: 1672460 - protein, 18 aa, Staphylococcus aureus
RYVDLVIPEKGWGQKEDD

SEQ ID NO: 1672461 - protein, 17 aa, Staphylococcus aureus
RYVMKKKNVDSLPTLIN

SEQ ID NO: 1672462 - protein, 17 aa, Staphylococcus aureus
RYVRANKSGVVPTLTAN

SEQ ID NO: 1672463 - protein, 17 aa, Staphylococcus aureus
RYYNKISEWLAEHPYVN

SEQ ID NO: 1672464 - protein, 23 aa, Staphylococcus aureus
SAAKRVPVTVNVYQFEFPQTSYT

SEQ ID NO: 1672465 - protein, 23 aa, Staphylococcus aureus
SADGRRVIVAGLDMDFRGEPFEP

SEQ ID NO: 1672466 - protein, 18 aa, Staphylococcus aureus
SADQALLQRLDLMKFQLE

SEQ ID NO: 1672467 - protein, 22 aa, Staphylococcus aureus
SAEALNYMALAGWDSKQMMEGL

SEQ ID NO: 1672468 - protein, 22 aa, Staphylococcus aureus
SAEFAALAFKVMTDPYVGKLTF

SEQ ID NO: 1672469 - protein, 24 aa, Staphylococcus aureus
SAGEPCLRYHQTFYTMTGKPFDSS

SEQ ID NO: 1672470 - protein, 17 aa, Staphylococcus aureus
SAGTKVVPFISVKESTD

SEQ ID NO: 1672471 - protein, 26 aa, Staphylococcus aureus
SAHGGYLIKVLNNWAKENVKTKEDAE

SEQ ID NO: 1672472 - protein, 19 aa, Staphylococcus aureus
SAHVTACRLLKKPHIKQYI

SEQ ID NO: 1672473 - protein, 22 aa, Staphylococcus aureus
SAIGRAAAIAYAKEGADVAINY

SEQ ID NO: 1672474 - protein, 23 aa, Staphylococcus aureus
SAIKHFFEKLLKLESLMHTDTAK

SEQ ID NO: 1672475 - protein, 17 aa, Staphylococcus aureus
SAIQLICNLFKPHDEIL

SEQ ID NO: 1672476 - protein, 28 aa, Staphylococcus aureus
SAKEIARTDLGRYFDRFADKLDKTQTNA

SEQ ID NO: 1672477 - protein, 21 aa, Staphylococcus aureus
SAKEYVLKLAIDTLADMLQRD

SEQ ID NO: 1672478 - protein, 20 aa, Staphylococcus aureus
SALDQARNGLTVDKAPLENA

SEQ ID NO: 1672479 - protein, 22 aa, Staphylococcus aureus
SALKKRMIAGGFTRTTHVPVLF

SEQ ID NO: 1672480 - protein, 19 aa, Staphylococcus aureus
SALSFGMYPKVAMLSFSTK

SEQ ID NO: 1672481 - protein, 26 aa, Staphylococcus aureus
SANAIIQKPIRSVQEVQTALTNVNRV

SEQ ID NO: 1672482 - protein, 18 aa, Staphylococcus aureus
SANLKMELIFSKVGIPKG

SEQ ID NO: 1672483 - protein, 18 aa, Staphylococcus aureus
SARVIIRMFGVNPDAQTD

SEQ ID NO: 1672484 - protein, 20 aa, Staphylococcus aureus
SASDYFKLSNGSAIPDATIT

SEQ ID NO: 1672485 - protein, 18 aa, Staphylococcus aureus
SCEFDFTRDGKLNVSFDY

SEQ ID NO: 1672486 - protein, 21 aa, Staphylococcus aureus
SCKAYVEAHAKFAAENVEKVG

SEQ ID NO: 1672487 - protein, 18 aa, Staphylococcus aureus
SCLQEKYYILNFLKSIAI

SEQ ID NO: 1672488 - protein, 18 aa, Staphylococcus aureus
SCSWKVFVKNGVITWENQ

SEQ ID NO: 1672489 - protein, 18 aa, Staphylococcus aureus
SDDEKIFITRTILNDRDV

SEQ ID NO: 1672490 - protein, 20 aa, Staphylococcus aureus
SDDEKIFITRTILNDRDVLP

SEQ ID NO: 1672491 - protein, 28 aa, Staphylococcus aureus
SDDYRYFPEPDIVPLYIDDAWKKRVRQT

SEQ ID NO: 1672492 - protein, 18 aa, Staphylococcus aureus
SDENGAVYCCFSNDNMAN

SEQ ID NO: 1672493 - protein, 19 aa, Staphylococcus aureus
SDERVRGLFQFYGAGTGRW

SEQ ID NO: 1672494 - protein, 20 aa, Staphylococcus aureus
SDFLTRYLIYKEKQDSYVKK

SEQ ID NO: 1672495 - protein, 17 aa, Staphylococcus aureus
SDFSAKVAFENEEAYII

SEQ ID NO: 1672496 - protein, 18 aa, Staphylococcus aureus
SDGLAMRLVYDALENDDT

SEQ ID NO: 1672497 - protein, 25 aa, Staphylococcus aureus
SDGNKRTALNYFLDLINKYTKFFIK

SEQ ID NO: 1672498 - protein, 17 aa, Staphylococcus aureus
SDGQRQFTLNGQVIQIM

SEQ ID NO: 1672499 - protein, 32 aa, Staphylococcus aureus
SDIAYHLIALLRYGGGISYQLLDDHSNYISLY

SEQ ID NO: 1672500 - protein, 18 aa, Staphylococcus aureus
SDIFTPNLFSAKDIKKID

SEQ ID NO: 1672501 - protein, 19 aa, Staphylococcus aureus
SDIFTPNLFSAKDIKKIDI

SEQ ID NO: 1672502 - protein, 26 aa, Staphylococcus aureus
SDILEVNNPFLGKVFELVDISETSIN

SEQ ID NO: 1672503 - protein, 18 aa, Staphylococcus aureus
SDILHDIYKMINLEIIKT

SEQ ID NO: 1672504 - protein, 21 aa, Staphylococcus aureus
SDIPPIIKISGSYIAADILVT

SEQ ID NO: 1672505 - protein, 18 aa, Staphylococcus aureus
SDIVKFRTRLGLENYAKE

SEQ ID NO: 1672506 - protein, 24 aa, Staphylococcus aureus
SDKQFKVLYLVPSIQLLTQTLRGW

SEQ ID NO: 1672507 - protein, 25 aa, Staphylococcus aureus
SDLDHARQALTPDKAPLQTAKTQLE

SEQ ID NO: 1672508 - protein, 20 aa, Staphylococcus aureus
SDLDLKFAKQAKYTVYFKNG

SEQ ID NO: 1672509 - protein, 17 aa, Staphylococcus aureus
SDLIIIFKNVADEHRDI

SEQ ID NO: 1672510 - protein, 27 aa, Staphylococcus aureus
SDLIPELQGRFPLRVELDSLSVEDFVR

SEQ ID NO: 1672511 - protein, 25 aa, Staphylococcus aureus
SDLKHFKGAHGLLYEQELGLQATIF

SEQ ID NO: 1672512 - protein, 25 aa, Staphylococcus aureus
SDLKLLKDRFEDLKDNHGWHFEELY

SEQ ID NO: 1672513 - protein, 21 aa, Staphylococcus aureus
SDLNDFIRLKVFSSYNNIHDK

SEQ ID NO: 1672514 - protein, 23 aa, Staphylococcus aureus
SDLPEDVQYDFRVTLRNFNKWYN

SEQ ID NO: 1672515 - protein, 22 aa, Staphylococcus aureus
SDLSALPGKYFIFKDLQIEEYQ

SEQ ID NO: 1672516 - protein, 25 aa, Staphylococcus aureus
SDLVGLDIAMSVIKGMQQVPEETPY

SEQ ID NO: 1672517 - protein, 20 aa, Staphylococcus aureus
SDNQNAVFFRSFSVDQRYRN

SEQ ID NO: 1672518 - protein, 18 aa, Staphylococcus aureus
SDPLIEYLIKEISDDKNI

SEQ ID NO: 1672519 - protein, 23 aa, Staphylococcus aureus
SDQLKVIEIIKLYQSFYENPLTL

SEQ ID NO: 1672520 - protein, 23 aa, Staphylococcus aureus
SDSFWQQVIYKLIYDNEVLIVVS

SEQ ID NO: 1672521 - protein, 24 aa, Staphylococcus aureus
SDSIVPFQVSYAISIHKAQGLEFN

SEQ ID NO: 1672522 - protein, 23 aa, Staphylococcus aureus
SDSKYAYVLYPGLSKSDFKSKNN

SEQ ID NO: 1672523 - protein, 26 aa, Staphylococcus aureus
SDSNWPICGIPEKFYTDHGKDYTSEH

SEQ ID NO: 1672524 - protein, 20 aa, Staphylococcus aureus
SDSRKSRWPVYQEWSRFIKG

SEQ ID NO: 1672525 - protein, 21 aa, Staphylococcus aureus
SDSRPTMSGNFEYIYNEMLRQ

SEQ ID NO: 1672526 - protein, 22 aa, Staphylococcus aureus
SDYILRKMVASMQKQVVQSTKL

SEQ ID NO: 1672527 - protein, 18 aa, Staphylococcus aureus
SEADWIVGINATRALTTK

SEQ ID NO: 1672528 - protein, 30 aa, Staphylococcus aureus
SEAGKGYFLVEGFLLPPVMFTAAEVGALIT

SEQ ID NO: 1672529 - protein, 32 aa, Staphylococcus aureus
SEAIKREGKNIFDIKTGVAIIILVKDGSNAHS

SEQ ID NO: 1672530 - protein, 17 aa, Staphylococcus aureus
SECWYIIDAEEDAEIII

SEQ ID NO: 1672531 - protein, 18 aa, Staphylococcus aureus
SEDKRYLFEAVYGDGIIR

SEQ ID NO: 1672532 - protein, 17 aa, Staphylococcus aureus
SEDLLCEAEEKVREIVE

SEQ ID NO: 1672533 - protein, 17 aa, Staphylococcus aureus
SEDRPKSIIEIMHNQIL

SEQ ID NO: 1672534 - protein, 27 aa, Staphylococcus aureus
SEDTYKLDRYVGLIAEEVENLGLKEFV

SEQ ID NO: 1672535 - protein, 20 aa, Staphylococcus aureus
SEERFIEMIQYFKEKIAEGD

SEQ ID NO: 1672536 - protein, 17 aa, Staphylococcus aureus
SEETEPKKGFWSRLFGN

SEQ ID NO: 1672537 - protein, 17 aa, Staphylococcus aureus
SEETEPKKGFWSRLFGR

SEQ ID NO: 1672538 - protein, 17 aa, Staphylococcus aureus
SEFKLQVVRLYENGKLK

SEQ ID NO: 1672539 - protein, 27 aa, Staphylococcus aureus
SEGAVFIKGGDGFDFGHVERFIQNPPH

SEQ ID NO: 1672540 - protein, 25 aa, Staphylococcus aureus
SEGKLKVSFDYIDWINTEFDQLGRE

SEQ ID NO: 1672541 - protein, 24 aa, Staphylococcus aureus
SEGVIKVMAKMGISTVQSYQGAQI

SEQ ID NO: 1672542 - protein, 24 aa, Staphylococcus aureus
SEGVIKVMVKMGISTVQSYQGAQI

SEQ ID NO: 1672543 - protein, 21 aa, Staphylococcus aureus
SEHLYYLGQEGVVFKDEDDLE

SEQ ID NO: 1672544 - protein, 19 aa, Staphylococcus aureus
SEIKFLGIDAPEIGIEPGR

SEQ ID NO: 1672545 - protein, 28 aa, Staphylococcus aureus
SEIKYWAELKGVFELFDVEMPIVMPRLR

SEQ ID NO: 1672546 - protein, 21 aa, Staphylococcus aureus
SEIMPTFKALGLDDYIEVVIG

SEQ ID NO: 1672547 - protein, 21 aa, Staphylococcus aureus
SEIPMSDVIVGGFPCQAFSIA

SEQ ID NO: 1672548 - protein, 26 aa, Staphylococcus aureus
SEIYKFKYMNSWCLEYSEFLLDEVRL

SEQ ID NO: 1672549 - protein, 17 aa, Staphylococcus aureus
SEKNVVLTQIFKKDEFT

SEQ ID NO: 1672550 - protein, 24 aa, Staphylococcus aureus
SELEKLCKVCKQYQLPLFMDGARL

SEQ ID NO: 1672551 - protein, 25 aa, Staphylococcus aureus
SELKKYFYRFSLKARKRVKTVSIDM

SEQ ID NO: 1672552 - protein, 17 aa, Staphylococcus aureus
SELYAPISGKVVEVNEE

SEQ ID NO: 1672553 - protein, 17 aa, Staphylococcus aureus
SEMPRERLLSHGAKSLS

SEQ ID NO: 1672554 - protein, 27 aa, Staphylococcus aureus
SENKAKDEKDGRDSTNQSMVESTTETL

SEQ ID NO: 1672555 - protein, 23 aa, Staphylococcus aureus
SEQTRLKLLPIIDNPFEEIKKME

SEQ ID NO: 1672556 - protein, 22 aa, Staphylococcus aureus
SERLYYLGREGVVFKDEDDLEI

SEQ ID NO: 1672557 - protein, 20 aa, Staphylococcus aureus
SERTKRLKLKQLLNSQNVEK

SEQ ID NO: 1672558 - protein, 23 aa, Staphylococcus aureus
SESLSDPVSLVESESESLAESES

SEQ ID NO: 1672559 - protein, 22 aa, Staphylococcus aureus
SESLSESLSESESLSESESLSE

SEQ ID NO: 1672560 - protein, 22 aa, Staphylococcus aureus
SESNFKDVVGLKMRQNGHEAKL

SEQ ID NO: 1672561 - protein, 21 aa, Staphylococcus aureus
SESQSASAFLSESLSESTSES

SEQ ID NO: 1672562 - protein, 18 aa, Staphylococcus aureus
SETCPISANAYDQFNEFL

SEQ ID NO: 1672563 - protein, 17 aa, Staphylococcus aureus
SETPITPVIIGDRKNNS

SEQ ID NO: 1672564 - protein, 25 aa, Staphylococcus aureus
SETTRISDALIRMQREHVHMSLIID

SEQ ID NO: 1672565 - protein, 27 aa, Staphylococcus aureus
SEVADELYHLFVLMHALGIDFSEIEAE

SEQ ID NO: 1672566 - protein, 17 aa, Staphylococcus aureus
SEVIGEIGYPSVILNDP

SEQ ID NO: 1672567 - protein, 18 aa, Staphylococcus aureus
SEVKEGQVVIGLVSSGIH

SEQ ID NO: 1672568 - protein, 19 aa, Staphylococcus aureus
SEVKLGIDLNYIELQNFKF

SEQ ID NO: 1672569 - protein, 24 aa, Staphylococcus aureus
SEVLVCTVIGFPLGASTTATKAFE

SEQ ID NO: 1672570 - protein, 18 aa, Staphylococcus aureus
SEVLVPWEDLPKVKSLWP

SEQ ID NO: 1672571 - protein, 17 aa, Staphylococcus aureus
SEYDLFTFFKHPSIKSM

SEQ ID NO: 1672572 - protein, 23 aa, Staphylococcus aureus
SEYIKSTFIFEKVIHDFQMFNLS

SEQ ID NO: 1672573 - protein, 18 aa, Staphylococcus aureus
SEYKLQMVRLYENGKPRN

SEQ ID NO: 1672574 - protein, 24 aa, Staphylococcus aureus
SEYLRTVTPYEVFSYGIDEEAQFM

SEQ ID NO: 1672575 - protein, 17 aa, Staphylococcus aureus
SFALLWGQFACKPPMKE

SEQ ID NO: 1672576 - protein, 34 aa, Staphylococcus aureus
SFCSTCTRARLSSDGKFYGCLFATVDGFNVKTFI

SEQ ID NO: 1672577 - protein, 27 aa, Staphylococcus aureus
SFDGFRKCVYEEFNYIYIYNLRGDQRT

SEQ ID NO: 1672578 - protein, 24 aa, Staphylococcus aureus
SFESRSFLFKAIFNITKLLHIKRS

SEQ ID NO: 1672579 - protein, 26 aa, Staphylococcus aureus
SFKFSRLPQDINFFAWLQHVKDSDKT

SEQ ID NO: 1672580 - protein, 24 aa, Staphylococcus aureus
SFKKKRVLKNISFDIEKGTCIALI

SEQ ID NO: 1672581 - protein, 17 aa, Staphylococcus aureus
SFMKNCAYHFAPGDTPV

SEQ ID NO: 1672582 - protein, 21 aa, Staphylococcus aureus
SFNAGEVVGLIGPSGTGKTTL

SEQ ID NO: 1672583 - protein, 19 aa, Staphylococcus aureus
SFNGFEFKVSVMKRHDGIS

SEQ ID NO: 1672584 - protein, 21 aa, Staphylococcus aureus
SFNGFIWRFYERCIVNWVSKR

SEQ ID NO: 1672585 - protein, 23 aa, Staphylococcus aureus
SFTRKVKELFVAHRVEKQYNKNE

SEQ ID NO: 1672586 - protein, 21 aa, Staphylococcus aureus
SFVPGEKATELLLDSKPNSIV

SEQ ID NO: 1672587 - protein, 26 aa, Staphylococcus aureus
SFVYKRRLPFHAKRFNDWLESMASNI

SEQ ID NO: 1672588 - protein, 17 aa, Staphylococcus aureus
SFYREGQILLPHHTHAR

SEQ ID NO: 1672589 - protein, 18 aa, Staphylococcus aureus
SFYREGQILLPHHTHARV

SEQ ID NO: 1672590 - protein, 18 aa, Staphylococcus aureus
SFYRKWRSYLRHRDVYHY

SEQ ID NO: 1672591 - protein, 22 aa, Staphylococcus aureus
SGAGLSLIRHWVEDPNRIDKVD

SEQ ID NO: 1672592 - protein, 25 aa, Staphylococcus aureus
SGEEQIEWFDVLNLAGSRVPELQMK

SEQ ID NO: 1672593 - protein, 24 aa, Staphylococcus aureus
SGFRNEYYYLTAIPYTLDEYKKYF

SEQ ID NO: 1672594 - protein, 20 aa, Staphylococcus aureus
SGFSPDFATVITMDRKASKQ

SEQ ID NO: 1672595 - protein, 26 aa, Staphylococcus aureus
SGFVLRGRPKSGIDLINNNFKRYVFF

SEQ ID NO: 1672596 - protein, 26 aa, Staphylococcus aureus
SGGEKVRLQLALLMLQRDNVLILDEP

SEQ ID NO: 1672597 - protein, 24 aa, Staphylococcus aureus
SGGQFPRDFNIVSSDDLLVCAHEQ

SEQ ID NO: 1672598 - protein, 30 aa, Staphylococcus aureus
SGGQMRRIELCRLLVMKPDLVIFDEPATGL

SEQ ID NO: 1672599 - protein, 23 aa, Staphylococcus aureus
SGILKEGRLEFRPPLVDITQLQP

SEQ ID NO: 1672600 - protein, 20 aa, Staphylococcus aureus
SGINDGAAMILVMSEDKAKE

SEQ ID NO: 1672601 - protein, 25 aa, Staphylococcus aureus
SGKFKFKYLDDWLYTKSIIFKNETT

SEQ ID NO: 1672602 - protein, 21 aa, Staphylococcus aureus
SGKSNSIAWLAYHLASLHSNE

SEQ ID NO: 1672603 - protein, 18 aa, Staphylococcus aureus
SGKSTLLRCMNLLEVPTK

SEQ ID NO: 1672604 - protein, 19 aa, Staphylococcus aureus
SGKTMIFDAMTYALFGKAS

SEQ ID NO: 1672605 - protein, 31 aa, Staphylococcus aureus
SGKTTLMRHIVSFLKSHGYTVATIKHHGHSK

SEQ ID NO: 1672606 - protein, 21 aa, Staphylococcus aureus
SGKYPTWVKLDIVTSQKTIPF

SEQ ID NO: 1672607 - protein, 23 aa, Staphylococcus aureus
SGLAGIGRYLLNRVDANATNVKA

SEQ ID NO: 1672608 - protein, 26 aa, Staphylococcus aureus
SGLDIPRVLGDIIICTDVAQEQANNY

SEQ ID NO: 1672609 - protein, 17 aa, Staphylococcus aureus
SGLPHEHFTAARDNQTF

SEQ ID NO: 1672610 - protein, 21 aa, Staphylococcus aureus
SGMGAQCWDLANYLLDKYWGF

SEQ ID NO: 1672611 - protein, 19 aa, Staphylococcus aureus
SGMVIKDAELRGVASSGMI

SEQ ID NO: 1672612 - protein, 23 aa, Staphylococcus aureus
SGNEVFIMPNFEKYNLSQVKTER

SEQ ID NO: 1672613 - protein, 29 aa, Staphylococcus aureus
SGNKTTTTFKYEVTRNSMSDSVSTSGSTQ

SEQ ID NO: 1672614 - protein, 28 aa, Staphylococcus aureus
SGRVGYHPTWKMVLGLFPKEDKIKAMDA

SEQ ID NO: 1672615 - protein, 31 aa, Staphylococcus aureus
SGSSDFLDCFCLVGATALTFSLISITGVTTL

SEQ ID NO: 1672616 - protein, 26 aa, Staphylococcus aureus
SGTEPKIKLYVSLKCPDFDDVAQKIN

SEQ ID NO: 1672617 - protein, 18 aa, Staphylococcus aureus
SGTGWLLEIVISNEHYET

SEQ ID NO: 1672618 - protein, 19 aa, Staphylococcus aureus
SGTGWLLEIVISNEHYETF

SEQ ID NO: 1672619 - protein, 29 aa, Staphylococcus aureus
SGTYTMPCARTLVPVKVPLDVTTTEVFDL

SEQ ID NO: 1672620 - protein, 17 aa, Staphylococcus aureus
SGVTDLKNSTTSLNNAM

SEQ ID NO: 1672621 - protein, 20 aa, Staphylococcus aureus
SGYAAFVVFNMMFGGDPSSV

SEQ ID NO: 1672622 - protein, 18 aa, Staphylococcus aureus
SGYAHIQNATGLPTDGFT

SEQ ID NO: 1672623 - protein, 19 aa, Staphylococcus aureus
SGYPDCRDSFIKSMNVTLS

SEQ ID NO: 1672624 - protein, 22 aa, Staphylococcus aureus
SHEIEKLILFLGDRPTINKQDV

SEQ ID NO: 1672625 - protein, 18 aa, Staphylococcus aureus
SHFFRKKVAVQRWNNRFS

SEQ ID NO: 1672626 - protein, 19 aa, Staphylococcus aureus
SHFSLEHAIGMLKANDLTR

SEQ ID NO: 1672627 - protein, 24 aa, Staphylococcus aureus
SHKKEHMIRAALEGVIYNLYTVYL

SEQ ID NO: 1672628 - protein, 23 aa, Staphylococcus aureus
SHKKEHMIRASLEGVLYNLYTVY

SEQ ID NO: 1672629 - protein, 18 aa, Staphylococcus aureus
SHVLKYCDYINVIKDGDI

SEQ ID NO: 1672630 - protein, 19 aa, Staphylococcus aureus
SHVLKYCQYINVLKEGQII

SEQ ID NO: 1672631 - protein, 17 aa, Staphylococcus aureus
SHVVIRGRHPNEFVSEF

SEQ ID NO: 1672632 - protein, 25 aa, Staphylococcus aureus
SHYLNLRHCLSRNRYLNLSHYLILN

SEQ ID NO: 1672633 - protein, 20 aa, Staphylococcus aureus
SIAFMYEPGEGLAYEKTALD

SEQ ID NO: 1672634 - protein, 18 aa, Staphylococcus aureus
SIATYELYIADLKLGVAI

SEQ ID NO: 1672635 - protein, 30 aa, Staphylococcus aureus
SICMIRTPLLSVEFFNLFFNTEQIKYSDLQ

SEQ ID NO: 1672636 - protein, 25 aa, Staphylococcus aureus
SIDALYQFLFEFIFDIEERYIRMYV

SEQ ID NO: 1672637 - protein, 20 aa, Staphylococcus aureus
SIDAYSFWSKDQTPFIILGT

SEQ ID NO: 1672638 - protein, 26 aa, Staphylococcus aureus
SIDNIKKVLLFLSRNTSSSGIQTEEK

SEQ ID NO: 1672639 - protein, 24 aa, Staphylococcus aureus
SIDNRKGQESFVFYDGPPTANGLP

SEQ ID NO: 1672640 - protein, 17 aa, Staphylococcus aureus
SIEEARFLEAYCEGHHI

SEQ ID NO: 1672641 - protein, 17 aa, Staphylococcus aureus
SIEFKKFVSSLQHNINE

SEQ ID NO: 1672642 - protein, 22 aa, Staphylococcus aureus
SIELGGIVQRTWRGKRSTDDIF

SEQ ID NO: 1672643 - protein, 24 aa, Staphylococcus aureus
SIESKEHYRILCIDGGSTDQTILM

SEQ ID NO: 1672644 - protein, 24 aa, Staphylococcus aureus
SIESKEHYRILCIDGGSTDQTISM

SEQ ID NO: 1672645 - protein, 21 aa, Staphylococcus aureus
SIETRRYYLMLMLFSKENPMS

SEQ ID NO: 1672646 - protein, 22 aa, Staphylococcus aureus
SIFTKEQLKIFVYDYDTNLIKN

SEQ ID NO: 1672647 - protein, 22 aa, Staphylococcus aureus
SIGDMFVVLIIMMQQIKGNIKL

SEQ ID NO: 1672648 - protein, 23 aa, Staphylococcus aureus
SIGLHSGSHVFVERRTMDPTATN

SEQ ID NO: 1672649 - protein, 22 aa, Staphylococcus aureus
SIGVKCPKCNDADVVERKSKKN

SEQ ID NO: 1672650 - protein, 22 aa, Staphylococcus aureus
SIGVKCPKCNDGDVVERKSKNN

SEQ ID NO: 1672651 - protein, 19 aa, Staphylococcus aureus
SIHLIDILKKLSHEEIEAF

SEQ ID NO: 1672652 - protein, 18 aa, Staphylococcus aureus
SIKDLPDYIQIWPGHGAG

SEQ ID NO: 1672653 - protein, 19 aa, Staphylococcus aureus
SIKLFKADNTPLTITNTTY

SEQ ID NO: 1672654 - protein, 19 aa, Staphylococcus aureus
SILFDRYQRDVGYSEAKET

SEQ ID NO: 1672655 - protein, 37 aa, Staphylococcus aureus
SISKKMTGYGLKTTAVIGGAFTVNMLHDQQAFVASDA

SEQ ID NO: 1672656 - protein, 20 aa, Staphylococcus aureus
SISKNMLFIPFKGENVDGHR

SEQ ID NO: 1672657 - protein, 17 aa, Staphylococcus aureus
SITNGRLEQQWTVPNEH

SEQ ID NO: 1672658 - protein, 17 aa, Staphylococcus aureus
SITPYEGGIAFVSKPLI

SEQ ID NO: 1672659 - protein, 22 aa, Staphylococcus aureus
SITQLIERFLFPSATHGKKVYK

SEQ ID NO: 1672660 - protein, 24 aa, Staphylococcus aureus
SITRKIRQHGVLKAGFTNRKEDID

SEQ ID NO: 1672661 - protein, 17 aa, Staphylococcus aureus
SIVKLTGVPGCGKSLIL

SEQ ID NO: 1672662 - protein, 17 aa, Staphylococcus aureus
SIVRFSRKMTHQGFQEL

SEQ ID NO: 1672663 - protein, 18 aa, Staphylococcus aureus
SKAQYFVSMMGYSPGFPY

SEQ ID NO: 1672664 - protein, 21 aa, Staphylococcus aureus
SKCVYVKWNPYSYTYAKQHRI

SEQ ID NO: 1672665 - protein, 22 aa, Staphylococcus aureus
SKDGIKALLDHEQFKVDIQTGL

SEQ ID NO: 1672666 - protein, 21 aa, Staphylococcus aureus
SKDIFGKLSYIGSTVKTLLNP

SEQ ID NO: 1672667 - protein, 23 aa, Staphylococcus aureus
SKDKGHKGMYCNDNPIGRGVSQN

SEQ ID NO: 1672668 - protein, 28 aa, Staphylococcus aureus
SKDLKQYGFKFLGPVTVFSFLAAAGLYD

SEQ ID NO: 1672669 - protein, 28 aa, Staphylococcus aureus
SKDLKQYGFKFLGPVTVFSFLEAAGFYD

SEQ ID NO: 1672670 - protein, 39 aa, Staphylococcus aureus
SKDNIRGRFPFSDVLTILSVFYFRYLYIDSNTHAKHKNA

SEQ ID NO: 1672671 - protein, 19 aa, Staphylococcus aureus
SKDNKRLITSIDLDELYDE

SEQ ID NO: 1672672 - protein, 19 aa, Staphylococcus aureus
SKDRYKIVHLIEYGHVQKG

SEQ ID NO: 1672673 - protein, 18 aa, Staphylococcus aureus
SKEGYMLSINKNVYEELE

SEQ ID NO: 1672674 - protein, 20 aa, Staphylococcus aureus
SKEILPYLYKGLRDKSPAVR

SEQ ID NO: 1672675 - protein, 19 aa, Staphylococcus aureus
SKEILPYLYKGLRDKSPVV

SEQ ID NO: 1672676 - protein, 23 aa, Staphylococcus aureus
SKEKIYVVYDWTGGTTLGKEALL

SEQ ID NO: 1672677 - protein, 18 aa, Staphylococcus aureus
SKEVLNFKNNKMFHSYWL

SEQ ID NO: 1672678 - protein, 19 aa, Staphylococcus aureus
SKFDGIFLVATNPVDILVY

SEQ ID NO: 1672679 - protein, 26 aa, Staphylococcus aureus
SKGFFKFIPVVAEWVSELPSLMLEQY

SEQ ID NO: 1672680 - protein, 24 aa, Staphylococcus aureus
SKGFKGLAGAMLFNLKPINVLKNT

SEQ ID NO: 1672681 - protein, 26 aa, Staphylococcus aureus
SKGIAYELAKFLKLKLTVANRTMARF

SEQ ID NO: 1672682 - protein, 18 aa, Staphylococcus aureus
SKGVHILDPFTGTGTFVA

SEQ ID NO: 1672683 - protein, 20 aa, Staphylococcus aureus
SKGVKWGVKANSFVTPNGQV

SEQ ID NO: 1672684 - protein, 21 aa, Staphylococcus aureus
SKIFFTCYSKILAQDLNERIP

SEQ ID NO: 1672685 - protein, 21 aa, Staphylococcus aureus
SKIQIGEKLTRGLGAGANPEI

SEQ ID NO: 1672686 - protein, 29 aa, Staphylococcus aureus
SKISSRDGEDFKRPSSVSGSIPSINVSGS

SEQ ID NO: 1672687 - protein, 28 aa, Staphylococcus aureus
SKIYLELWVKVQRDWRNKVNFIRQIGYV

SEQ ID NO: 1672688 - protein, 27 aa, Staphylococcus aureus
SKKADAFCFTFLPIDIVETYKINTQNQ

SEQ ID NO: 1672689 - protein, 23 aa, Staphylococcus aureus
SKKAPSRYGMSLTRNTSRFYQYW

SEQ ID NO: 1672690 - protein, 19 aa, Staphylococcus aureus
SKKKPPGITKWNRKMILNK

SEQ ID NO: 1672691 - protein, 18 aa, Staphylococcus aureus
SKKSFKNYSMKEELKFNA

SEQ ID NO: 1672692 - protein, 23 aa, Staphylococcus aureus
SKLISHSCIKQINERLGYDLNEK

SEQ ID NO: 1672693 - protein, 25 aa, Staphylococcus aureus
SKLKSIVGPFAYYIKGFEMLPQMKA

SEQ ID NO: 1672694 - protein, 23 aa, Staphylococcus aureus
SKLKVSFDYIDWINSEFGQVGRQ

SEQ ID NO: 1672695 - protein, 21 aa, Staphylococcus aureus
SKLKVSFDYIDWINTEFDQLG

SEQ ID NO: 1672696 - protein, 20 aa, Staphylococcus aureus
SKLLENQQVLALESNKKIQK

SEQ ID NO: 1672697 - protein, 24 aa, Staphylococcus aureus
SKLNHLYPEFNIWDAYSIYQLDEK

SEQ ID NO: 1672698 - protein, 26 aa, Staphylococcus aureus
SKLTAKRKLSVFIYSVNDFTDFNARS

SEQ ID NO: 1672699 - protein, 21 aa, Staphylococcus aureus
SKMYGGTCINIGCIPSKTLVH

SEQ ID NO: 1672700 - protein, 23 aa, Staphylococcus aureus
SKNGHPQFVITFIHKEEGEFTHY

SEQ ID NO: 1672701 - protein, 18 aa, Staphylococcus aureus
SKNNLKINLVHMLLQLYL

SEQ ID NO: 1672702 - protein, 19 aa, Staphylococcus aureus
SKNNLRNVVTMNNATPNNA

SEQ ID NO: 1672703 - protein, 18 aa, Staphylococcus aureus
SKQIFLMFNPVSKLNWVY

SEQ ID NO: 1672704 - protein, 21 aa, Staphylococcus aureus
SKQPLEYPSCGSVFQRPLGHF

SEQ ID NO: 1672705 - protein, 18 aa, Staphylococcus aureus
SKRFFKKDAQTINIEMVS

SEQ ID NO: 1672706 - protein, 25 aa, Staphylococcus aureus
SKRYQKLIVVPLFLYDGRLVNKVKQ

SEQ ID NO: 1672707 - protein, 24 aa, Staphylococcus aureus
SKSLAIAVASIISRYAFITYMDQI

SEQ ID NO: 1672708 - protein, 21 aa, Staphylococcus aureus
SKSLAIAVASIISRYAFVTNM

SEQ ID NO: 1672709 - protein, 20 aa, Staphylococcus aureus
SKSLAIAVASIISRYAFVTY

SEQ ID NO: 1672710 - protein, 17 aa, Staphylococcus aureus
SKSLKLYLFSFRNHGDF

SEQ ID NO: 1672711 - protein, 19 aa, Staphylococcus aureus
SKVQPCCFKLYNDPFDMCY

SEQ ID NO: 1672712 - protein, 24 aa, Staphylococcus aureus
SKVTREGLALGVYIILSGSRSSAI

SEQ ID NO: 1672713 - protein, 19 aa, Staphylococcus aureus
SKYAYVLYPGLSKSDFKSK

SEQ ID NO: 1672714 - protein, 17 aa, Staphylococcus aureus
SKYIYWKNIEITKKGDN

SEQ ID NO: 1672715 - protein, 17 aa, Staphylococcus aureus
SKYKVYIIDEVHMLTTG

SEQ ID NO: 1672716 - protein, 18 aa, Staphylococcus aureus
SKYLLAWSNKKEDQITNY

SEQ ID NO: 1672717 - protein, 21 aa, Staphylococcus aureus
SKYMTELPCETCHGQRLSREA

SEQ ID NO: 1672718 - protein, 24 aa, Staphylococcus aureus
SLADKAIDVIIQFVAQNRGKFSDD

SEQ ID NO: 1672719 - protein, 24 aa, Staphylococcus aureus
SLADKAIDVIIQFVAQNRGKFSDE

SEQ ID NO: 1672720 - protein, 18 aa, Staphylococcus aureus
SLESMGFKEPTPIQKDSI

SEQ ID NO: 1672721 - protein, 18 aa, Staphylococcus aureus
SLETFTMAFAEEATGIPE

SEQ ID NO: 1672722 - protein, 30 aa, Staphylococcus aureus
SLFAVSGGARFAGAALRFLTGPIGATITAI

SEQ ID NO: 1672723 - protein, 30 aa, Staphylococcus aureus
SLFAVSGGARFAGVALRFLTGPIGSTITAI

SEQ ID NO: 1672724 - protein, 21 aa, Staphylococcus aureus
SLFEDYGKIFGRMIGAQLKNY

SEQ ID NO: 1672725 - protein, 18 aa, Staphylococcus aureus
SLGGRDTMILGMSNDIKH

SEQ ID NO: 1672726 - protein, 21 aa, Staphylococcus aureus
SLGLEPWKFVVIQDQALRDEL

SEQ ID NO: 1672727 - protein, 19 aa, Staphylococcus aureus
SLGSHDGVGMVFDKPIAGK

SEQ ID NO: 1672728 - protein, 26 aa, Staphylococcus aureus
SLIDYGCHLLDLSLWLLGKNMVPHEV

SEQ ID NO: 1672729 - protein, 19 aa, Staphylococcus aureus
SLISIPALMTHASIPADIR

SEQ ID NO: 1672730 - protein, 19 aa, Staphylococcus aureus
SLIYRYDATLGTQITTNDI

SEQ ID NO: 1672731 - protein, 23 aa, Staphylococcus aureus
SLKDRIALAMIEKAEREGKIKPG

SEQ ID NO: 1672732 - protein, 19 aa, Staphylococcus aureus
SLKEALYYYRCLTDNTAQD

SEQ ID NO: 1672733 - protein, 20 aa, Staphylococcus aureus
SLKEDETWMRDMIRSQDPIN

SEQ ID NO: 1672734 - protein, 21 aa, Staphylococcus aureus
SLKEDETWMRDMIRSQDPING

SEQ ID NO: 1672735 - protein, 21 aa, Staphylococcus aureus
SLKEDETWMREMIRSQDPING

SEQ ID NO: 1672736 - protein, 20 aa, Staphylococcus aureus
SLKIFSLKGNEALAQEVADQ

SEQ ID NO: 1672737 - protein, 21 aa, Staphylococcus aureus
SLKISKDLIDTVHEYFNGLYI

SEQ ID NO: 1672738 - protein, 24 aa, Staphylococcus aureus
SLKSHIPKDNFGRFKPVIKGGTVT

SEQ ID NO: 1672739 - protein, 18 aa, Staphylococcus aureus
SLKSRGMILKLDRNKRTA

SEQ ID NO: 1672740 - protein, 17 aa, Staphylococcus aureus
SLLISAEVVGTVVLDYL

SEQ ID NO: 1672741 - protein, 22 aa, Staphylococcus aureus
SLLKHYKIKLETFIELHSKTQY

SEQ ID NO: 1672742 - protein, 19 aa, Staphylococcus aureus
SLLLRRPPGREAYPGDVFY

SEQ ID NO: 1672743 - protein, 20 aa, Staphylococcus aureus
SLLMDCQFCNAIRPGISLYG

SEQ ID NO: 1672744 - protein, 20 aa, Staphylococcus aureus
SLLQRQFRIGYNRASRLMDD

SEQ ID NO: 1672745 - protein, 17 aa, Staphylococcus aureus
SLLSFALINEANQLATQ

SEQ ID NO: 1672746 - protein, 26 aa, Staphylococcus aureus
SLLSKLLVRATKKWPTDKLFNNHLAD

SEQ ID NO: 1672747 - protein, 19 aa, Staphylococcus aureus
SLLTRTIITHILKDDLGPE

SEQ ID NO: 1672748 - protein, 21 aa, Staphylococcus aureus
SLMSIEGIIVLVIYHGHNEGQ

SEQ ID NO: 1672749 - protein, 21 aa, Staphylococcus aureus
SLNAFNLYGALSMANSGPNTN

SEQ ID NO: 1672750 - protein, 20 aa, Staphylococcus aureus
SLNDEFNYLYIFNLRGDQRT

SEQ ID NO: 1672751 - protein, 18 aa, Staphylococcus aureus
SLNEALCVKIIDRTQLIL

SEQ ID NO: 1672752 - protein, 20 aa, Staphylococcus aureus
SLNGYFVIDEAYLDYGMAYD

SEQ ID NO: 1672753 - protein, 21 aa, Staphylococcus aureus
SLQAIKLTFEYLKSSVEKGDK

SEQ ID NO: 1672754 - protein, 26 aa, Staphylococcus aureus
SLSSFLFTRLNFYLIDLFRQQNQLKD

SEQ ID NO: 1672755 - protein, 18 aa, Staphylococcus aureus
SLSSFLFTRLNYYLIDLF

SEQ ID NO: 1672756 - protein, 19 aa, Staphylococcus aureus
SLTAVLAVPLWYKNKVYGV

SEQ ID NO: 1672757 - protein, 27 aa, Staphylococcus aureus
SLVDSDSTVLCEPLILIEVESLILSDV

SEQ ID NO: 1672758 - protein, 18 aa, Staphylococcus aureus
SLVLKFAPVDAITPNANV

SEQ ID NO: 1672759 - protein, 19 aa, Staphylococcus aureus
SLVVWAIKEGRGVAKAVDQ

SEQ ID NO: 1672760 - protein, 21 aa, Staphylococcus aureus
SLYEKCEILEVLAKMKELGYT

SEQ ID NO: 1672761 - protein, 17 aa, Staphylococcus aureus
SLYEYTETSIIFITHDL

SEQ ID NO: 1672762 - protein, 22 aa, Staphylococcus aureus
SMEDFGLPFAIDSFVKNETDSI

SEQ ID NO: 1672763 - protein, 17 aa, Staphylococcus aureus
SMGLGLYLVQTILHKHQ

SEQ ID NO: 1672764 - protein, 19 aa, Staphylococcus aureus
SMIEDFKVTILLRNMTCHR

SEQ ID NO: 1672765 - protein, 26 aa, Staphylococcus aureus
SMLDFKRLNGLMIGFVIKGEAHIYDE

SEQ ID NO: 1672766 - protein, 23 aa, Staphylococcus aureus
SMRHFQKRITIVDGQISNTEELN

SEQ ID NO: 1672767 - protein, 21 aa, Staphylococcus aureus
SMSQIRWLSVLDLKDKTEDQL

SEQ ID NO: 1672768 - protein, 21 aa, Staphylococcus aureus
SMVGKHIFLENGVSTFGALVP

SEQ ID NO: 1672769 - protein, 19 aa, Staphylococcus aureus
SMYEAGDWIQFYAIDEQQF

SEQ ID NO: 1672770 - protein, 19 aa, Staphylococcus aureus
SMYEAGEWIQFYAIDEQKF

SEQ ID NO: 1672771 - protein, 22 aa, Staphylococcus aureus
SNAQLWLAEFAWHDTSSAHYRS

SEQ ID NO: 1672772 - protein, 18 aa, Staphylococcus aureus
SNDIKHIVVYNPAPLAIK

SEQ ID NO: 1672773 - protein, 20 aa, Staphylococcus aureus
SNDKYRTWEWNYGRNPKYNF

SEQ ID NO: 1672774 - protein, 18 aa, Staphylococcus aureus
SNEGDLLIIDGGHRVSSL

SEQ ID NO: 1672775 - protein, 22 aa, Staphylococcus aureus
SNEKYQTPHIISIDDSEFDYNL

SEQ ID NO: 1672776 - protein, 22 aa, Staphylococcus aureus
SNENNYGIGLGMPSFESAVNPL

SEQ ID NO: 1672777 - protein, 24 aa, Staphylococcus aureus
SNGYEKRYGLFYVDFETQERYPKK

SEQ ID NO: 1672778 - protein, 18 aa, Staphylococcus aureus
SNIAVHNFEIKFVNEKIS

SEQ ID NO: 1672779 - protein, 20 aa, Staphylococcus aureus
SNIESKIFIKGYTITNKSVI

SEQ ID NO: 1672780 - protein, 24 aa, Staphylococcus aureus
SNIFRDRLEMAGLDHLFIQKNTEV

SEQ ID NO: 1672781 - protein, 18 aa, Staphylococcus aureus
SNIMAVMIAVWSKGTSLE

SEQ ID NO: 1672782 - protein, 27 aa, Staphylococcus aureus
SNIWFEREAKDLLPEGFTHPGSPNGTF

SEQ ID NO: 1672783 - protein, 20 aa, Staphylococcus aureus
SNKHLCEYLGYAEQKIIKLK

SEQ ID NO: 1672784 - protein, 22 aa, Staphylococcus aureus
SNKHYISIFINGRYIKNFMLNK

SEQ ID NO: 1672785 - protein, 17 aa, Staphylococcus aureus
SNLDKTAVENALSQVAN

SEQ ID NO: 1672786 - protein, 21 aa, Staphylococcus aureus
SNLFRGYILGYSFQDLTGEFD

SEQ ID NO: 1672787 - protein, 23 aa, Staphylococcus aureus
SNLKNKLFINVEELFRPEKFIIS

SEQ ID NO: 1672788 - protein, 24 aa, Staphylococcus aureus
SNMKLRVGFSDIFFNVDQLTSSEA

SEQ ID NO: 1672789 - protein, 30 aa, Staphylococcus aureus
SNNPCLICNIPDYKPPKSIEWLEAHEVKEF

SEQ ID NO: 1672790 - protein, 23 aa, Staphylococcus aureus
SNNRKRFTIAHEIGHFLHNHKNK

SEQ ID NO: 1672791 - protein, 23 aa, Staphylococcus aureus
SNQALRLVLERARTYSVPNHIIE

SEQ ID NO: 1672792 - protein, 19 aa, Staphylococcus aureus
SNQLFPPHVSTLYVDDGPD

SEQ ID NO: 1672793 - protein, 24 aa, Staphylococcus aureus
SNRDINSYFLIITYRIDKESKQLA

SEQ ID NO: 1672794 - protein, 33 aa, Staphylococcus aureus
SNRELKTKFEVLKKRGKFPSNLEYIDSHTDKKY

SEQ ID NO: 1672795 - protein, 24 aa, Staphylococcus aureus
SNRGGCCQSCRWDYELLEVDDNGE

SEQ ID NO: 1672796 - protein, 24 aa, Staphylococcus aureus
SNRQFKVLYLVPSIQLLTQTLRGW

SEQ ID NO: 1672797 - protein, 17 aa, Staphylococcus aureus
SNSGFKRKSDAKHHAEM

SEQ ID NO: 1672798 - protein, 19 aa, Staphylococcus aureus
SNSGVSINGFWKHKKERKD

SEQ ID NO: 1672799 - protein, 21 aa, Staphylococcus aureus
SNSNKVFMCGQFYPNKDRLTF

SEQ ID NO: 1672800 - protein, 21 aa, Staphylococcus aureus
SNTEIRCIKSVLNKAKASYNH

SEQ ID NO: 1672801 - protein, 18 aa, Staphylococcus aureus
SNTLGAFKHRFDKVKLII

SEQ ID NO: 1672802 - protein, 20 aa, Staphylococcus aureus
SNYAELRLSVDTSNIEAQVL

SEQ ID NO: 1672803 - protein, 28 aa, Staphylococcus aureus
SNYILKYVFASGIAREIIYALLEEMDLR

SEQ ID NO: 1672804 - protein, 25 aa, Staphylococcus aureus
SNYKCTKLSIALRYEMICSRLEHTN

SEQ ID NO: 1672805 - protein, 27 aa, Staphylococcus aureus
SNYTAAILKQFEQFGSYMVISPHIALI

SEQ ID NO: 1672806 - protein, 17 aa, Staphylococcus aureus
SPARLMPDKILDLRYKL

SEQ ID NO: 1672807 - protein, 21 aa, Staphylococcus aureus
SPCNTKGLAISGGDVGGSKNF

SEQ ID NO: 1672808 - protein, 18 aa, Staphylococcus aureus
SPDNLILFKEEIGEDVPV

SEQ ID NO: 1672809 - protein, 17 aa, Staphylococcus aureus
SPDTWKNTVGNTHKTAV

SEQ ID NO: 1672810 - protein, 19 aa, Staphylococcus aureus
SPELIKQPAAAVLVNDDES

SEQ ID NO: 1672811 - protein, 19 aa, Staphylococcus aureus
SPEQWYSMIEDFKVTILLR

SEQ ID NO: 1672812 - protein, 24 aa, Staphylococcus aureus
SPILKCLILKGLVKKERCELDERR

SEQ ID NO: 1672813 - protein, 21 aa, Staphylococcus aureus
SPKFFKQKLVDFMDKTNYTCD

SEQ ID NO: 1672814 - protein, 23 aa, Staphylococcus aureus
SPKLKLYADKFIDTYMNISKDSK

SEQ ID NO: 1672815 - protein, 25 aa, Staphylococcus aureus
SPLGKLRAGLDLIKKPIQMQDGDIS

SEQ ID NO: 1672816 - protein, 26 aa, Staphylococcus aureus
SPLPLMHLYKMFRPFVNEDIEIANNY

SEQ ID NO: 1672817 - protein, 27 aa, Staphylococcus aureus
SPLRLQKTLYFLFAYYGASYGQLSKSK

SEQ ID NO: 1672818 - protein, 17 aa, Staphylococcus aureus
SPNELKALPPVFIAHCN

SEQ ID NO: 1672819 - protein, 23 aa, Staphylococcus aureus
SPNLKVIANMAVGYDNIDIESAT

SEQ ID NO: 1672820 - protein, 17 aa, Staphylococcus aureus
SPNTMKVVLSYTREDKL

SEQ ID NO: 1672821 - protein, 25 aa, Staphylococcus aureus
SPRALEEVIYFASYVVVNPGPTGLE

SEQ ID NO: 1672822 - protein, 21 aa, Staphylococcus aureus
SPRGIYCGTIGLLLPTEDDKM

SEQ ID NO: 1672823 - protein, 20 aa, Staphylococcus aureus
SPRLYNVILRGPNTEADEKS

SEQ ID NO: 1672824 - protein, 21 aa, Staphylococcus aureus
SPRLYNVILRGPNTEKLDSQF

SEQ ID NO: 1672825 - protein, 23 aa, Staphylococcus aureus
SPSIKPWILPNFTALVNHEKIDM

SEQ ID NO: 1672826 - protein, 30 aa, Staphylococcus aureus
SPSYALFKGRDLVYFMPREFIEGRDINDIA

SEQ ID NO: 1672827 - protein, 24 aa, Staphylococcus aureus
SPTNLKIIKSYGVNVEMVEEPDAH

SEQ ID NO: 1672828 - protein, 23 aa, Staphylococcus aureus
SPWVKEASAANVAGIAGTNNGIT

SEQ ID NO: 1672829 - protein, 27 aa, Staphylococcus aureus
SPYSYGAEIKPEFRNMLLNLKELDTLV

SEQ ID NO: 1672830 - protein, 24 aa, Staphylococcus aureus
SPYTRSKFYSELKVLEAVKNGLDG

SEQ ID NO: 1672831 - protein, 24 aa, Staphylococcus aureus
SQALAKEKEKALAAIDQAQTNSQV

SEQ ID NO: 1672832 - protein, 25 aa, Staphylococcus aureus
SQDFLNEFRILAGYYDNIDENTAIF

SEQ ID NO: 1672833 - protein, 19 aa, Staphylococcus aureus
SQEKFLQHDLLFKINGSKI

SEQ ID NO: 1672834 - protein, 24 aa, Staphylococcus aureus
SQERKTNWVKCGLGTVGGAGTGGL

SEQ ID NO: 1672835 - protein, 32 aa, Staphylococcus aureus
SQHLKKMYHVMAHKFGDNWKKAQKVGNEIGEK

SEQ ID NO: 1672836 - protein, 17 aa, Staphylococcus aureus
SQHPRLILQSNIQTENL

SEQ ID NO: 1672837 - protein, 27 aa, Staphylococcus aureus
SQITQALDHAMELLRNSIADNQATLAS

SEQ ID NO: 1672838 - protein, 18 aa, Staphylococcus aureus
SQLIPLSFGVNIFQNTIF

SEQ ID NO: 1672839 - protein, 25 aa, Staphylococcus aureus
SQNAVLFFDEIHQIIGSDATGSDSG

SEQ ID NO: 1672840 - protein, 25 aa, Staphylococcus aureus
SQNAVLFFDEIHQIIGSNATGSDSG

SEQ ID NO: 1672841 - protein, 17 aa, Staphylococcus aureus
SQPPIGRFIETYEQLAQ

SEQ ID NO: 1672842 - protein, 17 aa, Staphylococcus aureus
SQRQLAIQYNVNRVTII

SEQ ID NO: 1672843 - protein, 17 aa, Staphylococcus aureus
SQSCIKQINGRLGYDLN

SEQ ID NO: 1672844 - protein, 18 aa, Staphylococcus aureus
SQVKGIGFDIDFKVDNHV

SEQ ID NO: 1672845 - protein, 18 aa, Staphylococcus aureus
SQVKGIGFDVDFKVDDYV

SEQ ID NO: 1672846 - protein, 18 aa, Staphylococcus aureus
SQVRWMGVLNLEGKTPET

SEQ ID NO: 1672847 - protein, 19 aa, Staphylococcus aureus
SQVRWMGVLNLEGKTPETL

SEQ ID NO: 1672848 - protein, 25 aa, Staphylococcus aureus
SQYSNCPIFTFGRSSGAYLSLLIAR

SEQ ID NO: 1672849 - protein, 26 aa, Staphylococcus aureus
SRAPWKIKRPHSVYETALPEFYERVS

SEQ ID NO: 1672850 - protein, 27 aa, Staphylococcus aureus
SRAVKPPIIYGDVKWIAPLTVDETVYA

SEQ ID NO: 1672851 - protein, 19 aa, Staphylococcus aureus
SRDSFPQDVNFYINKETGI

SEQ ID NO: 1672852 - protein, 24 aa, Staphylococcus aureus
SRERLKEIAEYGGMTLPEILGISL

SEQ ID NO: 1672853 - protein, 25 aa, Staphylococcus aureus
SRFDEAYYLYTIVCVDIGEQVKIRL

SEQ ID NO: 1672854 - protein, 19 aa, Staphylococcus aureus
SRFFNFGIAEMASIDICSG

SEQ ID NO: 1672855 - protein, 17 aa, Staphylococcus aureus
SRIGYAYFLHPENKVLT

SEQ ID NO: 1672856 - protein, 19 aa, Staphylococcus aureus
SRILQGGYLYNYRSRNRYT

SEQ ID NO: 1672857 - protein, 18 aa, Staphylococcus aureus
SRINQGIQRLEIKQNEAV

SEQ ID NO: 1672858 - protein, 19 aa, Staphylococcus aureus
SRINQGIQRLEIKQNEAVQ

SEQ ID NO: 1672859 - protein, 22 aa, Staphylococcus aureus
SRKDNNYHFLLFNKINDRYMSD

SEQ ID NO: 1672860 - protein, 18 aa, Staphylococcus aureus
SRKTFAIISHPDAGKTTL

SEQ ID NO: 1672861 - protein, 22 aa, Staphylococcus aureus
SRLRNKGSLIILTENAFFKLNK

SEQ ID NO: 1672862 - protein, 25 aa, Staphylococcus aureus
SRMYDMLKNFYLYRYQKRIETLSID

SEQ ID NO: 1672863 - protein, 19 aa, Staphylococcus aureus
SRNDGCYIEIIGISIGGGT

SEQ ID NO: 1672864 - protein, 24 aa, Staphylococcus aureus
SRNFSNKMINIFPKKEFYIHIQQF

SEQ ID NO: 1672865 - protein, 25 aa, Staphylococcus aureus
SRNGLKIYADMDEHTPIFVWSGDAI

SEQ ID NO: 1672866 - protein, 20 aa, Staphylococcus aureus
SRNINNIMVLFSLTSKLNIT

SEQ ID NO: 1672867 - protein, 32 aa, Staphylococcus aureus
SRPESEVNYIMNLPVNFLETFLPELIEKNVKV

SEQ ID NO: 1672868 - protein, 31 aa, Staphylococcus aureus
SRPESEVNYIMNLPVNFLKTFLSELIEKNVK

SEQ ID NO: 1672869 - protein, 18 aa, Staphylococcus aureus
SRQDALAGKIDWVNEFPE

SEQ ID NO: 1672870 - protein, 20 aa, Staphylococcus aureus
SRQKYSMIYYFTAHKNGKLK

SEQ ID NO: 1672871 - protein, 25 aa, Staphylococcus aureus
SRRDLAEVVAMKCIGATTVATTMIC

SEQ ID NO: 1672872 - protein, 17 aa, Staphylococcus aureus
SRSVGTFAIKTGAITSA

SEQ ID NO: 1672873 - protein, 21 aa, Staphylococcus aureus
SRTKMYNVFEYFKQISNSKHF

SEQ ID NO: 1672874 - protein, 25 aa, Staphylococcus aureus
SRTLLDFRYQRHFKASKGENGQSSN

SEQ ID NO: 1672875 - protein, 19 aa, Staphylococcus aureus
SRTPIAITVLVKDESEKHE

SEQ ID NO: 1672876 - protein, 17 aa, Staphylococcus aureus
SRVDKVNGFQAMAVSPK

SEQ ID NO: 1672877 - protein, 19 aa, Staphylococcus aureus
SRYGHGELDVYKALNVANQ

SEQ ID NO: 1672878 - protein, 29 aa, Staphylococcus aureus
SRYWKYLPERIKLFLSHSDWKEQNQRLNH

SEQ ID NO: 1672879 - protein, 20 aa, Staphylococcus aureus
SSAEWEVMNIIWMKKYASTN

SEQ ID NO: 1672880 - protein, 22 aa, Staphylococcus aureus
SSAKLSFVGHYNYLVLPRNLYE

SEQ ID NO: 1672881 - protein, 24 aa, Staphylococcus aureus
SSDVLKLKANYTIDDSVKEGDTFK

SEQ ID NO: 1672882 - protein, 18 aa, Staphylococcus aureus
SSEFKLQMVRLYENGKPR

SEQ ID NO: 1672883 - protein, 19 aa, Staphylococcus aureus
SSEFKLQMVRLYENGKPRN

SEQ ID NO: 1672884 - protein, 20 aa, Staphylococcus aureus
SSEFKLQMVRLYENGKPRNE

SEQ ID NO: 1672885 - protein, 18 aa, Staphylococcus aureus
SSEGSAILDLTKVYYGMQ

SEQ ID NO: 1672886 - protein, 22 aa, Staphylococcus aureus
SSEHVKTSIVLKTDDYNVDRGA

SEQ ID NO: 1672887 - protein, 17 aa, Staphylococcus aureus
SSELMAFGDANNDKDML

SEQ ID NO: 1672888 - protein, 19 aa, Staphylococcus aureus
SSEQWYSMIEDFKVTIWYT

SEQ ID NO: 1672889 - protein, 29 aa, Staphylococcus aureus
SSETIGILRKEVIDFTNLIKGTDKEAPQN

SEQ ID NO: 1672890 - protein, 28 aa, Staphylococcus aureus
SSETIGILRKEVISFTKLIKGTDKEAPQ

SEQ ID NO: 1672891 - protein, 24 aa, Staphylococcus aureus
SSFKNTEFHKMFNFKDKEFAQDAV

SEQ ID NO: 1672892 - protein, 22 aa, Staphylococcus aureus
SSFRGLYQFIGFIDELIERGKD

SEQ ID NO: 1672893 - protein, 23 aa, Staphylococcus aureus
SSFSLTDLYLFIFNNSIKTLTIV

SEQ ID NO: 1672894 - protein, 22 aa, Staphylococcus aureus
SSGCVGQAPKLFVGVNSAKENI

SEQ ID NO: 1672895 - protein, 19 aa, Staphylococcus aureus
SSGKIAFLQLRDGTGFMQG

SEQ ID NO: 1672896 - protein, 17 aa, Staphylococcus aureus
SSGMGLYLVNSVKDQLG

SEQ ID NO: 1672897 - protein, 24 aa, Staphylococcus aureus
SSGMKQKLNFASMLLVDSNVLLLD

SEQ ID NO: 1672898 - protein, 21 aa, Staphylococcus aureus
SSHPNRIEWEPQFSQSTILAL

SEQ ID NO: 1672899 - protein, 18 aa, Staphylococcus aureus
SSHRNCDSKMRIVKIIHI

SEQ ID NO: 1672900 - protein, 24 aa, Staphylococcus aureus
SSIAFDELLDYVTINYHDNEETEE

SEQ ID NO: 1672901 - protein, 17 aa, Staphylococcus aureus
SSIGHKNLEFIFIENKE

SEQ ID NO: 1672902 - protein, 20 aa, Staphylococcus aureus
SSILKTLTFHTLLDEWFEYH

SEQ ID NO: 1672903 - protein, 22 aa, Staphylococcus aureus
SSKCVYVKWNPYSYTYAKQHQI

SEQ ID NO: 1672904 - protein, 22 aa, Staphylococcus aureus
SSKEITHYMGIPIEESFLKLAD

SEQ ID NO: 1672905 - protein, 22 aa, Staphylococcus aureus
SSLFSVKKITFDLSDAKKTSKA

SEQ ID NO: 1672906 - protein, 24 aa, Staphylococcus aureus
SSLGLEPWKFVVIQDQALRDELKA

SEQ ID NO: 1672907 - protein, 21 aa, Staphylococcus aureus
SSLPSNCQIYYAMKANSERKI

SEQ ID NO: 1672908 - protein, 22 aa, Staphylococcus aureus
SSLPSNCQMYYAMKANSERTIL

SEQ ID NO: 1672909 - protein, 17 aa, Staphylococcus aureus
SSLYAVFEKHINKGTII

SEQ ID NO: 1672910 - protein, 19 aa, Staphylococcus aureus
SSNIYFLIEGNIIREHYNQ

SEQ ID NO: 1672911 - protein, 28 aa, Staphylococcus aureus
SSNNIAKCPACDNGYLIDRKGFYGCTEY

SEQ ID NO: 1672912 - protein, 24 aa, Staphylococcus aureus
SSRRFKKKFGQSIESVFGQTINNL

SEQ ID NO: 1672913 - protein, 21 aa, Staphylococcus aureus
SSSILKTLTFHSLLDEWLEYH

SEQ ID NO: 1672914 - protein, 19 aa, Staphylococcus aureus
SSSMSGSVSKSTSLSDSIS

SEQ ID NO: 1672915 - protein, 24 aa, Staphylococcus aureus
SSTREIAGVFGIPLHKFGIETANM

SEQ ID NO: 1672916 - protein, 17 aa, Staphylococcus aureus
SSVLSNVAWFWHTSFSH

SEQ ID NO: 1672917 - protein, 19 aa, Staphylococcus aureus
SSVMFDFGVLKRQQIFYAY

SEQ ID NO: 1672918 - protein, 25 aa, Staphylococcus aureus
SSYNLKCLLLKLTYRYLDNQPINDA

SEQ ID NO: 1672919 - protein, 17 aa, Staphylococcus aureus
SSYPVWFPKDEVEEIIK

SEQ ID NO: 1672920 - protein, 26 aa, Staphylococcus aureus
STALGFAGGFPGKFIIDTLKNSAIQS

SEQ ID NO: 1672921 - protein, 26 aa, Staphylococcus aureus
STALGFAGGFPGKFIINTLNNSAIQS

SEQ ID NO: 1672922 - protein, 29 aa, Staphylococcus aureus
STAPVKLRTFSRLAMSTFASAATTTAVTA

SEQ ID NO: 1672923 - protein, 27 aa, Staphylococcus aureus
STDGEPCNECHICKGITQGTNSDVIEI

SEQ ID NO: 1672924 - protein, 22 aa, Staphylococcus aureus
STEALKALGYKVYIGSRNDVRG

SEQ ID NO: 1672925 - protein, 19 aa, Staphylococcus aureus
STEEERLAAKHLVEQTLNQ

SEQ ID NO: 1672926 - protein, 23 aa, Staphylococcus aureus
STETEWLPVLDFRNKSLAKGSAT

SEQ ID NO: 1672927 - protein, 23 aa, Staphylococcus aureus
STFANCINGLIPFKTKGNITGEL

SEQ ID NO: 1672928 - protein, 21 aa, Staphylococcus aureus
STFHSFCLKLIQQHYDVLNID

SEQ ID NO: 1672929 - protein, 23 aa, Staphylococcus aureus
STGGPGVGSFGFTAESPSALPPP

SEQ ID NO: 1672930 - protein, 27 aa, Staphylococcus aureus
STHIIKRISMLEVMLPSAIKAKYKKAF

SEQ ID NO: 1672931 - protein, 23 aa, Staphylococcus aureus
STIEFYFSYSFKSLHSLEIEIDI

SEQ ID NO: 1672932 - protein, 17 aa, Staphylococcus aureus
STIIEYFQKDAIIAVDE

SEQ ID NO: 1672933 - protein, 24 aa, Staphylococcus aureus
STIYRWVQEYAPILYQIWKKKNKQ

SEQ ID NO: 1672934 - protein, 23 aa, Staphylococcus aureus
STKGVYVVPAFVGLGTPYWDSEA

SEQ ID NO: 1672935 - protein, 17 aa, Staphylococcus aureus
STLIDILIGNVNANSGE

SEQ ID NO: 1672936 - protein, 19 aa, Staphylococcus aureus
STLTGRRILILGDVLELGE

SEQ ID NO: 1672937 - protein, 17 aa, Staphylococcus aureus
STNMWKNLKATKEGHIV

SEQ ID NO: 1672938 - protein, 20 aa, Staphylococcus aureus
STPLSVGLSLHLTKKQSYAV

SEQ ID NO: 1672939 - protein, 20 aa, Staphylococcus aureus
STQNLDLWYGDNHALQNINL

SEQ ID NO: 1672940 - protein, 18 aa, Staphylococcus aureus
STRLESGVHLPPYKGKFK

SEQ ID NO: 1672941 - protein, 21 aa, Staphylococcus aureus
STRSFAVYFSPEIKKFIADNL

SEQ ID NO: 1672942 - protein, 18 aa, Staphylococcus aureus
STRTRCAFETAAYDQGAH

SEQ ID NO: 1672943 - protein, 25 aa, Staphylococcus aureus
STSDSLRTSTSLSDSLSMSTSGSLS

SEQ ID NO: 1672944 - protein, 23 aa, Staphylococcus aureus
STSGKTGFYFRVLKQGYVSPSDQ

SEQ ID NO: 1672945 - protein, 19 aa, Staphylococcus aureus
STSIFQHAFHVSRDKILET

SEQ ID NO: 1672946 - protein, 17 aa, Staphylococcus aureus
STSKLYDFSPWKNKSFW

SEQ ID NO: 1672947 - protein, 28 aa, Staphylococcus aureus
STSLFTGKLGLCYIGLRLLNPETIDSVS

SEQ ID NO: 1672948 - protein, 18 aa, Staphylococcus aureus
STTGGNSGSPVFNEKNEV

SEQ ID NO: 1672949 - protein, 29 aa, Staphylococcus aureus
STVLDCTSFPYKIARPGSITAAMITEILP

SEQ ID NO: 1672950 - protein, 23 aa, Staphylococcus aureus
STWRYRISLGKDVKTGKYKYISN

SEQ ID NO: 1672951 - protein, 19 aa, Staphylococcus aureus
SVALRLVIDRENEIRNFKP

SEQ ID NO: 1672952 - protein, 20 aa, Staphylococcus aureus
SVCVPLDAPFEVEVEEEITE

SEQ ID NO: 1672953 - protein, 26 aa, Staphylococcus aureus
SVDVFKSELPFSWVYDENGITETMKS

SEQ ID NO: 1672954 - protein, 25 aa, Staphylococcus aureus
SVDVTICSGLIKADKYEWLLQKATE

SEQ ID NO: 1672955 - protein, 25 aa, Staphylococcus aureus
SVENRKANGYKLFKDDIEITTSDVN

SEQ ID NO: 1672956 - protein, 18 aa, Staphylococcus aureus
SVGTFAIKTEAITSAVDR

SEQ ID NO: 1672957 - protein, 18 aa, Staphylococcus aureus
SVGTFAIKTGAITSAVDR

SEQ ID NO: 1672958 - protein, 21 aa, Staphylococcus aureus
SVGYKRLEIDFSKEGRDISVI

SEQ ID NO: 1672959 - protein, 17 aa, Staphylococcus aureus
SVGYRKLEIDFSKRENS

SEQ ID NO: 1672960 - protein, 19 aa, Staphylococcus aureus
SVGYRKLEIDFSKRENSKL

SEQ ID NO: 1672961 - protein, 22 aa, Staphylococcus aureus
SVIKSKHLTISFYLTTHSIPET

SEQ ID NO: 1672962 - protein, 22 aa, Staphylococcus aureus
SVKDRIALAMIEKAEREGKIKP

SEQ ID NO: 1672963 - protein, 33 aa, Staphylococcus aureus
SVLKGYWAADRWDIRICPHPSAIELSKNPSLRN

SEQ ID NO: 1672964 - protein, 17 aa, Staphylococcus aureus
SVLKRFKAMLLQKNETV

SEQ ID NO: 1672965 - protein, 23 aa, Staphylococcus aureus
SVLRIKESISYPVSHVLINGIRY

SEQ ID NO: 1672966 - protein, 24 aa, Staphylococcus aureus
SVLRVKESISYPVSHVLINGIRYK

SEQ ID NO: 1672967 - protein, 19 aa, Staphylococcus aureus
SVLYKDYLESVKLGSVKLT

SEQ ID NO: 1672968 - protein, 20 aa, Staphylococcus aureus
SVMNCMTRVRIKVLDENKVD

SEQ ID NO: 1672969 - protein, 30 aa, Staphylococcus aureus
SVPDEASLEFNVRPVPEYDNDFIESFFQNI

SEQ ID NO: 1672970 - protein, 26 aa, Staphylococcus aureus
SVPDEASLEFNVRPVPEYDNDFVESF

SEQ ID NO: 1672971 - protein, 20 aa, Staphylococcus aureus
SVPDRFDIYGPQMLIQELSN

SEQ ID NO: 1672972 - protein, 22 aa, Staphylococcus aureus
SVPEDLQVLFSIIKNDDSIVPA

SEQ ID NO: 1672973 - protein, 20 aa, Staphylococcus aureus
SVPTRCRVSPVLPALADKPA

SEQ ID NO: 1672974 - protein, 22 aa, Staphylococcus aureus
SVQPNAKFPPSLRNMYKELADD

SEQ ID NO: 1672975 - protein, 23 aa, Staphylococcus aureus
SVSKEVKYQKTIELLKHQSELSS

SEQ ID NO: 1672976 - protein, 23 aa, Staphylococcus aureus
SVTTFTIAVNRTFTNAQGEREAD

SEQ ID NO: 1672977 - protein, 24 aa, Staphylococcus aureus
SVVEEIKRLIEINSIQDVEPDYQF

SEQ ID NO: 1672978 - protein, 20 aa, Staphylococcus aureus
SVVIAYEPIWAIGTGKSSTS

SEQ ID NO: 1672979 - protein, 19 aa, Staphylococcus aureus
SWCKNKFQVTNQVSVEDTY

SEQ ID NO: 1672980 - protein, 20 aa, Staphylococcus aureus
SWDGILYKNSFEGLAQYKSQ

SEQ ID NO: 1672981 - protein, 25 aa, Staphylococcus aureus
SYDMRFKTLIHEYAHSQLHNDDIGQ

SEQ ID NO: 1672982 - protein, 18 aa, Staphylococcus aureus
SYFFRKKVAVQRWNNRFS

SEQ ID NO: 1672983 - protein, 24 aa, Staphylococcus aureus
SYFNGRLNGCGGFIDITQSVNKII

SEQ ID NO: 1672984 - protein, 25 aa, Staphylococcus aureus
SYHPDYEFLKSVGIQINTNEFGTAP

SEQ ID NO: 1672985 - protein, 25 aa, Staphylococcus aureus
SYIDYKGDIFLAWDAVQGDLPLSVY

SEQ ID NO: 1672986 - protein, 19 aa, Staphylococcus aureus
SYKRTSCRLEVIAKRGKSP

SEQ ID NO: 1672987 - protein, 17 aa, Staphylococcus aureus
SYMPGYEGDVIMAAGTF

SEQ ID NO: 1672988 - protein, 19 aa, Staphylococcus aureus
SYNRTIFNEVIEWLETELT

SEQ ID NO: 1672989 - protein, 18 aa, Staphylococcus aureus
SYPTLAMIYVTHFIEEIT

SEQ ID NO: 1672990 - protein, 20 aa, Staphylococcus aureus
SYPWGQCTWYVHQRRKEIGK

SEQ ID NO: 1672991 - protein, 18 aa, Staphylococcus aureus
SYRRRAHQYFFVGQIVVP

SEQ ID NO: 1672992 - protein, 22 aa, Staphylococcus aureus
SYTGHLFKSFLEKHYKNKFILN

SEQ ID NO: 1672993 - protein, 21 aa, Staphylococcus aureus
SYVKHTLVFKGNFKMFYDKRG

SEQ ID NO: 1672994 - protein, 25 aa, Staphylococcus aureus
SYYPEYNIAVSWQRLREGKTIKKQD

SEQ ID NO: 1672995 - protein, 21 aa, Staphylococcus aureus
TADGKPLALGNGKIIDQPLIT

SEQ ID NO: 1672996 - protein, 33 aa, Staphylococcus aureus
TADHCHYIKDGSCWCVKAFNQHRLMKASNIVNC

SEQ ID NO: 1672997 - protein, 21 aa, Staphylococcus aureus
TADSLYGFHIRKEEYEKAEEY

SEQ ID NO: 1672998 - protein, 19 aa, Staphylococcus aureus
TAEKYMIFLTWIFSTTNNK

SEQ ID NO: 1672999 - protein, 19 aa, Staphylococcus aureus
TAGVLKNARGFTAVCNPLV

SEQ ID NO: 1673000 - protein, 22 aa, Staphylococcus aureus
TAGYTFPLAMLKNEAGINATKD

SEQ ID NO: 1673001 - protein, 20 aa, Staphylococcus aureus
TAIELGCRVGEALALRISDF

SEQ ID NO: 1673002 - protein, 25 aa, Staphylococcus aureus
TAIKLRQRVWRRLAKDLKPENLHEI

SEQ ID NO: 1673003 - protein, 21 aa, Staphylococcus aureus
TAIYRKHYKSSKEEALSKIDK

SEQ ID NO: 1673004 - protein, 19 aa, Staphylococcus aureus
TAKELLATAVQRLAADHTS

SEQ ID NO: 1673005 - protein, 17 aa, Staphylococcus aureus
TAKHALNNLTSINNAQK

SEQ ID NO: 1673006 - protein, 25 aa, Staphylococcus aureus
TAKIVLRWLKEQGIQVDLLNLGGGF

SEQ ID NO: 1673007 - protein, 22 aa, Staphylococcus aureus
TAKIVLRWLKEQGIQVELLNLG

SEQ ID NO: 1673008 - protein, 19 aa, Staphylococcus aureus
TAKQVIKLNDAVTAAKKAL

SEQ ID NO: 1673009 - protein, 17 aa, Staphylococcus aureus
TAKTALNGDERLNEAKN

SEQ ID NO: 1673010 - protein, 18 aa, Staphylococcus aureus
TALMLFVQRCKDMQDSGQ

SEQ ID NO: 1673011 - protein, 23 aa, Staphylococcus aureus
TALSIRMYYALFLNKPIITTDDT

SEQ ID NO: 1673012 - protein, 21 aa, Staphylococcus aureus
TAMTGLKRGVANHNQVVQSDN

SEQ ID NO: 1673013 - protein, 24 aa, Staphylococcus aureus
TANIYYKSIIKITITVKVGTNVQT

SEQ ID NO: 1673014 - protein, 26 aa, Staphylococcus aureus
TAPIKLRTFSRLAMSTFASAATTSAV

SEQ ID NO: 1673015 - protein, 21 aa, Staphylococcus aureus
TAPLGKRMGHAGAIISGGKGT

SEQ ID NO: 1673016 - protein, 18 aa, Staphylococcus aureus
TAPVKLRTFSRLAMSTFA

SEQ ID NO: 1673017 - protein, 17 aa, Staphylococcus aureus
TAPVRQIAENAGLEGSV

SEQ ID NO: 1673018 - protein, 18 aa, Staphylococcus aureus
TAQYPPQLAFAIGNAIKC

SEQ ID NO: 1673019 - protein, 19 aa, Staphylococcus aureus
TAREGSIFVASVGYTVDSH

SEQ ID NO: 1673020 - protein, 22 aa, Staphylococcus aureus
TARLKDNIYYPISTLYERLTQF

SEQ ID NO: 1673021 - protein, 19 aa, Staphylococcus aureus
TASESKPRVTRSADVAEAK

SEQ ID NO: 1673022 - protein, 26 aa, Staphylococcus aureus
TASHHLRLLKNLGIAKYRKEGKLVYY

SEQ ID NO: 1673023 - protein, 19 aa, Staphylococcus aureus
TATALQWLLFDKGLDGSTK

SEQ ID NO: 1673024 - protein, 23 aa, Staphylococcus aureus
TAVCGLARCKKSDIDAVYEATKD

SEQ ID NO: 1673025 - protein, 34 aa, Staphylococcus aureus; identical to SEQ ID NO: 1579881

SEQ ID NO: 1673026 - protein, 26 aa, Staphylococcus aureus
TAVSGIFPFKFLKSGKFYYKQTANGK

SEQ ID NO: 1673027 - protein, 17 aa, Staphylococcus aureus
TAYSEIYDYQWSEKLIP

SEQ ID NO: 1673028 - protein, 24 aa, Staphylococcus aureus
TCGDRIRLTFDIEEGIIKDAKFEG

SEQ ID NO: 1673029 - protein, 23 aa, Staphylococcus aureus
TCTRARLSSDGKFYGCLFATVDG

SEQ ID NO: 1673030 - protein, 17 aa, Staphylococcus aureus
TCVYFVVDFQLYMNVVA

SEQ ID NO: 1673031 - protein, 17 aa, Staphylococcus aureus
TDAELFGYCYGVTGTVG

SEQ ID NO: 1673032 - protein, 19 aa, Staphylococcus aureus
TDARNAVNEKAREAITNIN

SEQ ID NO: 1673033 - protein, 19 aa, Staphylococcus aureus
TDAVLYFRMFNPIRQSERF

SEQ ID NO: 1673034 - protein, 17 aa, Staphylococcus aureus
TDDCGKAIESSEQSIDS

SEQ ID NO: 1673035 - protein, 31 aa, Staphylococcus aureus
TDDKYYIAGHVFRIVSCLNQVLFACNNAYCI

SEQ ID NO: 1673036 - protein, 19 aa, Staphylococcus aureus
TDEAIKVTLENGAILESKT

SEQ ID NO: 1673037 - protein, 19 aa, Staphylococcus aureus
TDFLEWGRQNNFKKFRRAN

SEQ ID NO: 1673038 - protein, 21 aa, Staphylococcus aureus
TDFPTERKGVAGWNLYVEASN

SEQ ID NO: 1673039 - protein, 23 aa, Staphylococcus aureus
TDGLNAILGFLVLTGVIQDPTTK

SEQ ID NO: 1673040 - protein, 31 aa, Staphylococcus aureus
TDIEYKFPFGWGELWGIASRTDFDLRKHGEH

SEQ ID NO: 1673041 - protein, 28 aa, Staphylococcus aureus
TDIKIPSFEVIDWLRNGLELHNVEESIC

SEQ ID NO: 1673042 - protein, 20 aa, Staphylococcus aureus
TDIKYELLSSYSEREIQQQE

SEQ ID NO: 1673043 - protein, 21 aa, Staphylococcus aureus
TDKGGQCVRQLLQADDVEVSD

SEQ ID NO: 1673044 - protein, 22 aa, Staphylococcus aureus
TDKGGQCVRQLLQADNVEVSDA

SEQ ID NO: 1673045 - protein, 22 aa, Staphylococcus aureus
TDKGRRLNVFYATQVALEPPTF

SEQ ID NO: 1673046 - protein, 21 aa, Staphylococcus aureus
TDKKVGWKVIFNNMMNQNWGP

SEQ ID NO: 1673047 - protein, 17 aa, Staphylococcus aureus
TDLEITHLALNDGTVEG

SEQ ID NO: 1673048 - protein, 17 aa, Staphylococcus aureus
TDLLFLYLEHAILSQDF

SEQ ID NO: 1673049 - protein, 22 aa, Staphylococcus aureus
TDLNLILKKKFQEISEVDDFIS

SEQ ID NO: 1673050 - protein, 22 aa, Staphylococcus aureus
TDNRGGVPYTVFIDPPLSRVGL

SEQ ID NO: 1673051 - protein, 23 aa, Staphylococcus aureus
TDQLWWSYRETFTGGVTPAAKPS

SEQ ID NO: 1673052 - protein, 27 aa, Staphylococcus aureus
TDRDLKRFKGAHGLLYEHQLGLQATIF

SEQ ID NO: 1673053 - protein, 18 aa, Staphylococcus aureus
TDRIGSKGVISFVTNGAF

SEQ ID NO: 1673054 - protein, 17 aa, Staphylococcus aureus
TDRLMDVLFEMRKVNIE

SEQ ID NO: 1673055 - protein, 25 aa, Staphylococcus aureus
TDSKNLVPLNGFRGTEPEEIGDVRD

SEQ ID NO: 1673056 - protein, 17 aa, Staphylococcus aureus
TDYNYKIVLLLKEGETH

SEQ ID NO: 1673057 - protein, 25 aa, Staphylococcus aureus
TEAIDLELLIAIASVKFDINYSLKP

SEQ ID NO: 1673058 - protein, 26 aa, Staphylococcus aureus
TEAKRKGLEPLAIWMKALKHEVSIEE

SEQ ID NO: 1673059 - protein, 18 aa, Staphylococcus aureus
TEANKFGLGFSVNPENLK

SEQ ID NO: 1673060 - protein, 23 aa, Staphylococcus aureus
TEARTLKFFKYFYTHRGPVMDYT

SEQ ID NO: 1673061 - protein, 18 aa, Staphylococcus aureus
TEASRRALPQKLTHSEAV

SEQ ID NO: 1673062 - protein, 35 aa, Staphylococcus aureus
TEDHCHYIKDGSCWCVKAFNQRRLMKASNIVNCSR

SEQ ID NO: 1673063 - protein, 20 aa, Staphylococcus aureus
TEFDDMISLMGMHLENNLDY

SEQ ID NO: 1673064 - protein, 23 aa, Staphylococcus aureus
TEFEIITAMMFLYFGETHPVDFV

SEQ ID NO: 1673065 - protein, 17 aa, Staphylococcus aureus
TEGCICCAMKADVSEQL

SEQ ID NO: 1673066 - protein, 20 aa, Staphylococcus aureus
TEGPGLIGALLIGVNAAKAL

SEQ ID NO: 1673067 - protein, 21 aa, Staphylococcus aureus
TEHEDCLYLNVWKQHNDQTKK

SEQ ID NO: 1673068 - protein, 17 aa, Staphylococcus aureus
TEHLRLLADKAKSVGAD

SEQ ID NO: 1673069 - protein, 24 aa, Staphylococcus aureus
TEINPKFKDLRAYYTKPSLEFKNE

SEQ ID NO: 1673070 - protein, 17 aa, Staphylococcus aureus
TEIRGTTLASKESKFKS

SEQ ID NO: 1673071 - protein, 23 aa, Staphylococcus aureus
TEIVPDFLLNRVYRTDPKTLMFA

SEQ ID NO: 1673072 - protein, 21 aa, Staphylococcus aureus
TEIYDYIRLLYARVGKPYCPN

SEQ ID NO: 1673073 - protein, 17 aa, Staphylococcus aureus
TEKGCSYREQLEMILYK

SEQ ID NO: 1673074 - protein, 25 aa, Staphylococcus aureus
TEKKGGQLLESWLANHLVPRIDFKI

SEQ ID NO: 1673075 - protein, 26 aa, Staphylococcus aureus
TEKVNHIFEVLGISLFECYDMTEKLY

SEQ ID NO: 1673076 - protein, 31 aa, Staphylococcus aureus
TELNGAMTALKAAIADKERTKASGNYVNADQ

SEQ ID NO: 1673077 - protein, 32 aa, Staphylococcus aureus
TELNGAMTALKAAIADKERTKASGNYVNADQE

SEQ ID NO: 1673078 - protein, 31 aa, Staphylococcus aureus
TELNGAMTALKAVIADKERTKASGNYVNADQ

SEQ ID NO: 1673079 - protein, 26 aa, Staphylococcus aureus
TELNTAMTALKRAIADKAETKASGNY

SEQ ID NO: 1673080 - protein, 22 aa, Staphylococcus aureus
TELSKRGGLTIVDDIMVQSVTA

SEQ ID NO: 1673081 - protein, 24 aa, Staphylococcus aureus
TEMEFLSFAFFKICHDEIDLLRLL

SEQ ID NO: 1673082 - protein, 20 aa, Staphylococcus aureus
TEPYTNYSILLVSGTYPGGV

SEQ ID NO: 1673083 - protein, 21 aa, Staphylococcus aureus
TEPYTNYSILLVSGTYPGGVI

SEQ ID NO: 1673084 - protein, 21 aa, Staphylococcus aureus
TEPYTNYSVLLISGTYPGGII

SEQ ID NO: 1673085 - protein, 23 aa, Staphylococcus aureus
TERLARAAIQYAIDNNRKSVTLV

SEQ ID NO: 1673086 - protein, 22 aa, Staphylococcus aureus
TESFRRLFKYKKISKNLIGFMH

SEQ ID NO: 1673087 - protein, 20 aa, Staphylococcus aureus
TETLNSINFTDADKAKKDAY

SEQ ID NO: 1673088 - protein, 20 aa, Staphylococcus aureus
TETLNSINFTDADQAKKDDY

SEQ ID NO: 1673089 - protein, 17 aa, Staphylococcus aureus
TEVRDQPYLKLLEILNE

SEQ ID NO: 1673090 - protein, 26 aa, Staphylococcus aureus
TEYLRFNPKLAEFSVSSILGQIRTKF

SEQ ID NO: 1673091 - protein, 18 aa, Staphylococcus aureus
TFAAPNVYHSFTGDFKKD

SEQ ID NO: 1673092 - protein, 26 aa, Staphylococcus aureus
TFCQLTIMCKLGWAPTKRISKGNSTD

SEQ ID NO: 1673093 - protein, 18 aa, Staphylococcus aureus
TFELHKKLQEHRMADVID

SEQ ID NO: 1673094 - protein, 18 aa, Staphylococcus aureus
TFELHKKLQENRMADVIN

SEQ ID NO: 1673095 - protein, 31 aa, Staphylococcus aureus
TFGTAGIRGKFGLGEGRLNKFTIEKLALGLA

SEQ ID NO: 1673096 - protein, 32 aa, Staphylococcus aureus
TFGTAGIRGKFGLGEGRLNKFTIEKLALGLSR

SEQ ID NO: 1673097 - protein, 25 aa, Staphylococcus aureus
TFHSLLDEWLEYHIKTSGFKVTTLD

SEQ ID NO: 1673098 - protein, 19 aa, Staphylococcus aureus
TFIAVKLPYGVQKDADEVE

SEQ ID NO: 1673099 - protein, 34 aa, Staphylococcus aureus
TFKSRVEKSIADWGIKLERTFYVSKFAHPENELE

SEQ ID NO: 1673100 - protein, 19 aa, Staphylococcus aureus
TFLCRFNVAILDDGYYLPM

SEQ ID NO: 1673101 - protein, 17 aa, Staphylococcus aureus
TFLSLYISHHEVLRDME

SEQ ID NO: 1673102 - protein, 20 aa, Staphylococcus aureus
TFNKEGANQIQVTWGEKGVF

SEQ ID NO: 1673103 - protein, 22 aa, Staphylococcus aureus
TFQFAGHFGEPMWTEHMSLDKI

SEQ ID NO: 1673104 - protein, 24 aa, Staphylococcus aureus
TFRLENELKVFPSHFSKGMKQKVM

SEQ ID NO: 1673105 - protein, 23 aa, Staphylococcus aureus
TFTSLKIAESFAKDSGKKIYNIL

SEQ ID NO: 1673106 - protein, 26 aa, Staphylococcus aureus
TFVCGKAEEVILQWKAQGIKPDVVMV

SEQ ID NO: 1673107 - protein, 28 aa, Staphylococcus aureus
TFVKTVRIVLMHDWLKGKIIVDSLGLHS

SEQ ID NO: 1673108 - protein, 25 aa, Staphylococcus aureus
TFVPSICYNESMGPIQTCDTCTVEI

SEQ ID NO: 1673109 - protein, 19 aa, Staphylococcus aureus
TFYAWKRQAMIFLKETYSD

SEQ ID NO: 1673110 - protein, 20 aa, Staphylococcus aureus
TGADGWGFLFSKGNAEEYLT

SEQ ID NO: 1673111 - protein, 26 aa, Staphylococcus aureus
TGAGDSFCAAVVYSWLNGMSTEDILI

SEQ ID NO: 1673112 - protein, 26 aa, Staphylococcus aureus
TGANEWNWYMHLSKQLVRQGQRIKAG

SEQ ID NO: 1673113 - protein, 17 aa, Staphylococcus aureus
TGCTFSAVITAELAKGR

SEQ ID NO: 1673114 - protein, 19 aa, Staphylococcus aureus
TGCYECLERQLVSKFPGKI

SEQ ID NO: 1673115 - protein, 21 aa, Staphylococcus aureus
TGDEGSHCQIARNIATTMSHY

SEQ ID NO: 1673116 - protein, 24 aa, Staphylococcus aureus
TGETSIMLQECVTFLNESFNISQS

SEQ ID NO: 1673117 - protein, 19 aa, Staphylococcus aureus
TGHSLGGTIAQVMTVLCNF

SEQ ID NO: 1673118 - protein, 18 aa, Staphylococcus aureus
TGICDLSSVIGCRDDIMV

SEQ ID NO: 1673119 - protein, 18 aa, Staphylococcus aureus
TGKTEFWATSSDVLKLKA

SEQ ID NO: 1673120 - protein, 22 aa, Staphylococcus aureus
TGLLPHEWHYYISPRGKADIVQ

SEQ ID NO: 1673121 - protein, 17 aa, Staphylococcus aureus
TGLPHEHFTVARDNQTF

SEQ ID NO: 1673122 - protein, 25 aa, Staphylococcus aureus
TGLPMKRVDDIKAYIQDDVHKVMGV

SEQ ID NO: 1673123 - protein, 25 aa, Staphylococcus aureus
TGLPMKRVDDIKAYIQDNVPKVMGV

SEQ ID NO: 1673124 - protein, 26 aa, Staphylococcus aureus
TGLPMKRVDDIKAYIQGDVPKVMGVH

SEQ ID NO: 1673125 - protein, 18 aa, Staphylococcus aureus
TGLTISVDNAIWKVIDFQ

SEQ ID NO: 1673126 - protein, 25 aa, Staphylococcus aureus
TGMRKGEVLALHWSDINFVNKDLYV

SEQ ID NO: 1673127 - protein, 17 aa, Staphylococcus aureus
TGPKLQYVRNYILKRFK

SEQ ID NO: 1673128 - protein, 20 aa, Staphylococcus aureus
TGQMPNLWPRLKEIKVPTLI

SEQ ID NO: 1673129 - protein, 21 aa, Staphylococcus aureus
TGRGSIQMRSRAVIEERGGRR

SEQ ID NO: 1673130 - protein, 24 aa, Staphylococcus aureus
TGTRVLGGLTYRESHFALELLHQS

SEQ ID NO: 1673131 - protein, 20 aa, Staphylococcus aureus
TGTTTGKKPASITAYNNSIR

SEQ ID NO: 1673132 - protein, 17 aa, Staphylococcus aureus
TGYFYPEIAMYFKNPSR

SEQ ID NO: 1673133 - protein, 41 aa, Staphylococcus aureus
TGYPGDKPVATMWESKGKITYLKGEAMQYDLSTTGGNSGSP

SEQ ID NO: 1673134 - protein, 18 aa, Staphylococcus aureus
THANGQVSYGARPTQNKP

SEQ ID NO: 1673135 - protein, 19 aa, Staphylococcus aureus
THFDAFINLFVENRSKFIY

SEQ ID NO: 1673136 - protein, 19 aa, Staphylococcus aureus
THFPQIEYECCAIEDVDFP

SEQ ID NO: 1673137 - protein, 17 aa, Staphylococcus aureus
THGLSLVGDLFVNQGDT

SEQ ID NO: 1673138 - protein, 18 aa, Staphylococcus aureus
THGNGQVSYGARPTQNKP

SEQ ID NO: 1673139 - protein, 17 aa, Staphylococcus aureus
THIPDSFVIAGNVGTPE

SEQ ID NO: 1673140 - protein, 24 aa, Staphylococcus aureus
THKPLPKWSSIRLHKDVNKQKHEK

SEQ ID NO: 1673141 - protein, 17 aa, Staphylococcus aureus
THVPVLFEAAEEGDDIA

SEQ ID NO: 1673142 - protein, 31 aa, Staphylococcus aureus
THYRSAYHILDMVFWFGNLQILAAHQYPTTT

SEQ ID NO: 1673143 - protein, 17 aa, Staphylococcus aureus
TIAKLYKKIGLKGIYFI

SEQ ID NO: 1673144 - protein, 25 aa, Staphylococcus aureus
TIAKRLGIEMKDVMAIGDNLNDVSM

SEQ ID NO: 1673145 - protein, 22 aa, Staphylococcus aureus
TIAPAIRIGWIVASEKTIEQLA

SEQ ID NO: 1673146 - protein, 19 aa, Staphylococcus aureus
TIDGLKIVEINGRPGGDEI

SEQ ID NO: 1673147 - protein, 20 aa, Staphylococcus aureus
TIDPIVIMAEFIFKCTKNNF

SEQ ID NO: 1673148 - protein, 18 aa, Staphylococcus aureus
TIDSRLRIMVPDEKEDDD

SEQ ID NO: 1673149 - protein, 18 aa, Staphylococcus aureus
TIEAMSAAAIKFAQQFEE

SEQ ID NO: 1673150 - protein, 18 aa, Staphylococcus aureus
TIEDGVVCFYSRSKQRLW

SEQ ID NO: 1673151 - protein, 24 aa, Staphylococcus aureus
TIEDGVVCFYSRSKQRLWTKGETS

SEQ ID NO: 1673152 - protein, 23 aa, Staphylococcus aureus
TIENRKANDYKLYKDDTQTTNSD

SEQ ID NO: 1673153 - protein, 19 aa, Staphylococcus aureus
TIFCTFWGLNALKKIQSQR

SEQ ID NO: 1673154 - protein, 23 aa, Staphylococcus aureus
TIFKASTSFNFDVLRERLQESAF

SEQ ID NO: 1673155 - protein, 24 aa, Staphylococcus aureus
TIHDARDLLKYKIDNYDNHIAKIN

SEQ ID NO: 1673156 - protein, 21 aa, Staphylococcus aureus
TIHTFLPLAHIIKVSDEELEF

SEQ ID NO: 1673157 - protein, 21 aa, Staphylococcus aureus
TIHTNHFLSPYSYGAEIKPEF

SEQ ID NO: 1673158 - protein, 17 aa, Staphylococcus aureus
TIIGKDWFDGKPCERYI

SEQ ID NO: 1673159 - protein, 18 aa, Staphylococcus aureus
TIILRDLVDALLFEDIAG

SEQ ID NO: 1673160 - protein, 18 aa, Staphylococcus aureus
TIKAELGDNLFVLLCLAN

SEQ ID NO: 1673161 - protein, 23 aa, Staphylococcus aureus
TIKDFGADVNIGLHIVTDKDPHY

SEQ ID NO: 1673162 - protein, 22 aa, Staphylococcus aureus
TIKGRLLFHPRFEKELRAQGIV

SEQ ID NO: 1673163 - protein, 21 aa, Staphylococcus aureus
TIKLLELLKESKINVNDIDYD

SEQ ID NO: 1673164 - protein, 17 aa, Staphylococcus aureus
TIKNGRYSETFIALKSV

SEQ ID NO: 1673165 - protein, 20 aa, Staphylococcus aureus
TIKNGTAMPTNLAGGSTTTI

SEQ ID NO: 1673166 - protein, 19 aa, Staphylococcus aureus
TIKTHVSHIFSKLQVSDRT

SEQ ID NO: 1673167 - protein, 29 aa, Staphylococcus aureus
TIKYDGAYCINGYRWITYIANSGQRRYIA

SEQ ID NO: 1673168 - protein, 21 aa, Staphylococcus aureus
TINFRECRYNYSLLRLNLNDG

SEQ ID NO: 1673169 - protein, 25 aa, Staphylococcus aureus
TISPWNFPFAIMAGTTLAPVVAGNT

SEQ ID NO: 1673170 - protein, 18 aa, Staphylococcus aureus
TISSIILTVVALYTTYKD

SEQ ID NO: 1673171 - protein, 21 aa, Staphylococcus aureus
TITGQWGKKGYLIKGEKDRLQ

SEQ ID NO: 1673172 - protein, 17 aa, Staphylococcus aureus
TITWPEQIGHKIAIPHK

SEQ ID NO: 1673173 - protein, 18 aa, Staphylococcus aureus
TIVDAINGRLQYVIPNEF

SEQ ID NO: 1673174 - protein, 18 aa, Staphylococcus aureus
TIVDAINGRMQYVIPNEF

SEQ ID NO: 1673175 - protein, 19 aa, Staphylococcus aureus
TIVKMFVNLSEGFEDGVRE

SEQ ID NO: 1673176 - protein, 24 aa, Staphylococcus aureus
TIVNNAKRLNISFEKENGINYIKD

SEQ ID NO: 1673177 - protein, 18 aa, Staphylococcus aureus
TIVYKGWLRSDQIKKVYT

SEQ ID NO: 1673178 - protein, 20 aa, Staphylococcus aureus
TKADKRELITAKNHLDDPVS

SEQ ID NO: 1673179 - protein, 25 aa, Staphylococcus aureus
TKAIYKRDYLCILGQTVYDKLGHEM

SEQ ID NO: 1673180 - protein, 17 aa, Staphylococcus aureus
TKAKALDKINAIQTQAR

SEQ ID NO: 1673181 - protein, 19 aa, Staphylococcus aureus
TKAQIAFCIDVRSEPFRRH

SEQ ID NO: 1673182 - protein, 28 aa, Staphylococcus aureus
TKCSFEMAELKLGLKTISFETSASSVSK

SEQ ID NO: 1673183 - protein, 17 aa, Staphylococcus aureus
TKDLSLGRLRKLNHPIP

SEQ ID NO: 1673184 - protein, 17 aa, Staphylococcus aureus
TKDPELRSTPNGVNVGT

SEQ ID NO: 1673185 - protein, 17 aa, Staphylococcus aureus
TKEELKQFMLYLEEENK

SEQ ID NO: 1673186 - protein, 25 aa, Staphylococcus aureus
TKELLFKRRIDIGGVNNNFKGDSKR

SEQ ID NO: 1673187 - protein, 18 aa, Staphylococcus aureus
TKFFKGNKIIAIGQISDL

SEQ ID NO: 1673188 - protein, 18 aa, Staphylococcus aureus
TKFVPIINSIGFNKHDGE

SEQ ID NO: 1673189 - protein, 17 aa, Staphylococcus aureus
TKHAWFVEDRFVKKELE

SEQ ID NO: 1673190 - protein, 21 aa, Staphylococcus aureus
TKIAEVIKEYGLDLLHMHYAV

SEQ ID NO: 1673191 - protein, 19 aa, Staphylococcus aureus
TKKAPILKLHIDGDIKGSS

SEQ ID NO: 1673192 - protein, 19 aa, Staphylococcus aureus
TKKATGYYFVNKIYDDISK

SEQ ID NO: 1673193 - protein, 19 aa, Staphylococcus aureus
TKKELVEIANLASLDVDEK

SEQ ID NO: 1673194 - protein, 19 aa, Staphylococcus aureus
TKKNIGYHFLDKPKITVKK

SEQ ID NO: 1673195 - protein, 26 aa, Staphylococcus aureus
TKKPVIFRATPQWFASISKVRKDILD

SEQ ID NO: 1673196 - protein, 26 aa, Staphylococcus aureus
TKKPVIFRATSQWFASISKVRQDILD

SEQ ID NO: 1673197 - protein, 18 aa, Staphylococcus aureus
TKLKRIAEMLKERVNQDE

SEQ ID NO: 1673198 - protein, 24 aa, Staphylococcus aureus
TKLNNKYASIGMDFENQDKTLTAK

SEQ ID NO: 1673199 - protein, 34 aa, Staphylococcus aureus
TKLVDGFTHLPGWVRKASLGLAIFGASIGPAVLA

SEQ ID NO: 1673200 - protein, 34 aa, Staphylococcus aureus
TKLVDGFTHLPGWVRKASVGLALFGASIGPAVLA

SEQ ID NO: 1673201 - protein, 24 aa, Staphylococcus aureus
TKMPSMKITLSFSEFNTTKTTVTS

SEQ ID NO: 1673202 - protein, 20 aa, Staphylococcus aureus
TKMPSMKITLSFSKSNTTKT

SEQ ID NO: 1673203 - protein, 17 aa, Staphylococcus aureus
TKNFPDFIEKYRFFDML

SEQ ID NO: 1673204 - protein, 17 aa, Staphylococcus aureus
TKNGRKVLARRRRKGRK

SEQ ID NO: 1673205 - protein, 35 aa, Staphylococcus aureus
TKPSLEFKNEIGIILKKWTTIRFMNVVPDYFIYKI

SEQ ID NO: 1673206 - protein, 22 aa, Staphylococcus aureus
TKQCPMRGTTIRRKDTDKNKLG

SEQ ID NO: 1673207 - protein, 17 aa, Staphylococcus aureus
TKRFVEIASEPIRTKQH

SEQ ID NO: 1673208 - protein, 19 aa, Staphylococcus aureus
TKSAVKIGDQCPICGNEIQ

SEQ ID NO: 1673209 - protein, 27 aa, Staphylococcus aureus
TKSQLTIMCKLGWDDEINFAKISFLSH

SEQ ID NO: 1673210 - protein, 21 aa, Staphylococcus aureus
TKTFYGAFCSAIEVIRKNNPD

SEQ ID NO: 1673211 - protein, 20 aa, Staphylococcus aureus
TKTGFYIGRIDKFIRSVSRE

SEQ ID NO: 1673212 - protein, 30 aa, Staphylococcus aureus
TKTKEGLFTKGLRRRAKLLETILKNTRSID

SEQ ID NO: 1673213 - protein, 24 aa, Staphylococcus aureus
TKTKEGLFTKGLRRRTKLLETILK

SEQ ID NO: 1673214 - protein, 22 aa, Staphylococcus aureus
TKYGCLDPIVFLDGIEANEMLK

SEQ ID NO: 1673215 - protein, 19 aa, Staphylococcus aureus
TKYKGDLLVLDKSEYFDTT

SEQ ID NO: 1673216 - protein, 19 aa, Staphylococcus aureus
TKYKISGTWYPFYKKMTAI

SEQ ID NO: 1673217 - protein, 19 aa, Staphylococcus aureus
TLAGMAFANAFLGIAHSIA

SEQ ID NO: 1673218 - protein, 23 aa, Staphylococcus aureus
TLATCRKYGISITTIVQSISQAV

SEQ ID NO: 1673219 - protein, 18 aa, Staphylococcus aureus
TLDSIKAEMNVKVDNIVN

SEQ ID NO: 1673220 - protein, 24 aa, Staphylococcus aureus
TLEMKQFFKRGGKQQIPYMFNYKF

SEQ ID NO: 1673221 - protein, 19 aa, Staphylococcus aureus
TLFDSEKFEAIREILKEEL

SEQ ID NO: 1673222 - protein, 19 aa, Staphylococcus aureus
TLFDSEKFEAIREILKEEV

SEQ ID NO: 1673223 - protein, 17 aa, Staphylococcus aureus
TLFPEDVLSIAKGLTDG

SEQ ID NO: 1673224 - protein, 29 aa, Staphylococcus aureus
TLFYKLTSEHLVEFMPIIYDPVVAQSIEQ

SEQ ID NO: 1673225 - protein, 28 aa, Staphylococcus aureus
TLGYPFIVKTRFGGYDGKGQVLINNEKD

SEQ ID NO: 1673226 - protein, 25 aa, Staphylococcus aureus
TLHPMGGLQERIWNLLQILNDFGTD

SEQ ID NO: 1673227 - protein, 25 aa, Staphylococcus aureus
TLHQFPIDNLFPIMGQTVTTSDILN

SEQ ID NO: 1673228 - protein, 25 aa, Staphylococcus aureus
TLHQFPIDNLFPLMGQTITTNDFLN

SEQ ID NO: 1673229 - protein, 23 aa, Staphylococcus aureus
TLHQFPIDNVFPLMGQTITTNDF

SEQ ID NO: 1673230 - protein, 23 aa, Staphylococcus aureus
TLHQFPIDYVFPLMGQTITTNDL

SEQ ID NO: 1673231 - protein, 26 aa, Staphylococcus aureus
TLIEFDRSWEKIGVRFVESLLDTFPV

SEQ ID NO: 1673232 - protein, 26 aa, Staphylococcus aureus
TLIEFDRSWEKIGVRLVQSLLETFPV

SEQ ID NO: 1673233 - protein, 19 aa, Staphylococcus aureus
TLILRDLVDALLFEDIAGI

SEQ ID NO: 1673234 - protein, 22 aa, Staphylococcus aureus
TLKAHHPDIIVLNGGANQFFEG

SEQ ID NO: 1673235 - protein, 26 aa, Staphylococcus aureus
TLKAISPRTTLPILTGIKIDAKEHEV

SEQ ID NO: 1673236 - protein, 18 aa, Staphylococcus aureus
TLKELIEASMTYSDNTAN

SEQ ID NO: 1673237 - protein, 23 aa, Staphylococcus aureus
TLKGIECIYALYKKNRRSLQIYG

SEQ ID NO: 1673238 - protein, 24 aa, Staphylococcus aureus
TLKGIECIYGLYKKNRRSLQIYGF

SEQ ID NO: 1673239 - protein, 25 aa, Staphylococcus aureus
TLKLQRMGVLPKFHGGTKKKDWLDQ

SEQ ID NO: 1673240 - protein, 24 aa, Staphylococcus aureus
TLKLYPTKNLDGFYDKEGFRDQEF

SEQ ID NO: 1673241 - protein, 24 aa, Staphylococcus aureus
TLLKSSAGGTEFPKLAKELPEKLN

SEQ ID NO: 1673242 - protein, 23 aa, Staphylococcus aureus
TLNEYRKLIEIKAVKDKEEDTYR

SEQ ID NO: 1673243 - protein, 19 aa, Staphylococcus aureus
TLNKADFAVIKAYAKEHPE

SEQ ID NO: 1673244 - protein, 17 aa, Staphylococcus aureus
TLNMRMILDNVKKSIRQ

SEQ ID NO: 1673245 - protein, 18 aa, Staphylococcus aureus
TLNQFKAAPLIVTAEALQ

SEQ ID NO: 1673246 - protein, 17 aa, Staphylococcus aureus
TLNSINFTDADQAKKDD

SEQ ID NO: 1673247 - protein, 28 aa, Staphylococcus aureus
TLPCSTGLEGFLGSSFAGGTGLPGSAGT

SEQ ID NO: 1673248 - protein, 25 aa, Staphylococcus aureus
TLPFKKIVSDLCYKQSDLVQHIKVL

SEQ ID NO: 1673249 - protein, 24 aa, Staphylococcus aureus
TLRTEPKLSLPTARSIIAIAVGYP

SEQ ID NO: 1673250 - protein, 23 aa, Staphylococcus aureus
TLRYYVCPQNLNASRFVCEFKGI

SEQ ID NO: 1673251 - protein, 24 aa, Staphylococcus aureus
TLSGGQFQRVWIAKALILEPEILI

SEQ ID NO: 1673252 - protein, 24 aa, Staphylococcus aureus
TLSHGIPGLILFLDAYQKAYNTNT

SEQ ID NO: 1673253 - protein, 24 aa, Staphylococcus aureus
TLSYGIPGLILFLDAYQKAYNTNT

SEQ ID NO: 1673254 - protein, 17 aa, Staphylococcus aureus
TLTGRRILILGDVLELG

SEQ ID NO: 1673255 - protein, 26 aa, Staphylococcus aureus
TLTIPKDRPVVFKLQAMDTMTSFWIP

SEQ ID NO: 1673256 - protein, 24 aa, Staphylococcus aureus
TLYKMRWNPAHPGTHQYATDVDWA

SEQ ID NO: 1673257 - protein, 28 aa, Staphylococcus aureus
TLYYTCEKFKLLVLQGNVLGVQIITNND

SEQ ID NO: 1673258 - protein, 26 aa, Staphylococcus aureus
TLYYTCEKFKLLVLQGNVLGVQVITN

SEQ ID NO: 1673259 - protein, 24 aa, Staphylococcus aureus
TMILHEFLPFIEIKQIPSSSANYD

SEQ ID NO: 1673260 - protein, 25 aa, Staphylococcus aureus
TMILKPAFRDYLLKLVEAHDIEYQY

SEQ ID NO: 1673261 - protein, 22 aa, Staphylococcus aureus
TMIRLLSKQGFILAGDETLQRL

SEQ ID NO: 1673262 - protein, 20 aa, Staphylococcus aureus
TMLYEKRIIDGLKESSIDRK

SEQ ID NO: 1673263 - protein, 19 aa, Staphylococcus aureus
TNDLLSWLQDPFAKEMPGK

SEQ ID NO: 1673264 - protein, 19 aa, Staphylococcus aureus
TNDVVKDFTANGLLSIGAS

SEQ ID NO: 1673265 - protein, 20 aa, Staphylococcus aureus
TNEAINIYFVPSDLVNPTIS

SEQ ID NO: 1673266 - protein, 19 aa, Staphylococcus aureus
TNEKFKTFFNYVMDAGKID

SEQ ID NO: 1673267 - protein, 20 aa, Staphylococcus aureus
TNELPEFFTRESGVKLTSSV

SEQ ID NO: 1673268 - protein, 36 aa, Staphylococcus aureus
TNIDYPIAIVFQASCFNEFVVKGRLSNIVGKLEHYA

SEQ ID NO: 1673269 - protein, 18 aa, Staphylococcus aureus
TNIKRVQQAIVEGETYQV

SEQ ID NO: 1673270 - protein, 20 aa, Staphylococcus aureus
TNIKTRVALYLFENNELTNI

SEQ ID NO: 1673271 - protein, 23 aa, Staphylococcus aureus
TNKGDMTFKLFLNIAPKTVENFV

SEQ ID NO: 1673272 - protein, 33 aa, Staphylococcus aureus
TNKGRYLFIPVHKLADIRWKELGQHVSQIVPIE

SEQ ID NO: 1673273 - protein, 19 aa, Staphylococcus aureus
TNKLEVFRNAENILEDYYD

SEQ ID NO: 1673274 - protein, 27 aa, Staphylococcus aureus
TNKSIVGNLVYRNNFYNEVYTQPVYDL

SEQ ID NO: 1673275 - protein, 18 aa, Staphylococcus aureus
TNLADCFNLNEQLPLQFL

SEQ ID NO: 1673276 - protein, 20 aa, Staphylococcus aureus
TNLLDITYTLAFYDNENVFF

SEQ ID NO: 1673277 - protein, 29 aa, Staphylococcus aureus
TNMIFKYAYDMKLIRIMPSEDIKRPKKKT

SEQ ID NO: 1673278 - protein, 29 aa, Staphylococcus aureus
TNMIFKYAYDMKLIRIMPSEGIKRPKKKV

SEQ ID NO: 1673279 - protein, 18 aa, Staphylococcus aureus
TNNKEFTVTTSLKNNGNS

SEQ ID NO: 1673280 - protein, 20 aa, Staphylococcus aureus
TNQDGTVSYGARPTQNKPSE

SEQ ID NO: 1673281 - protein, 27 aa, Staphylococcus aureus
TNRDLRFIEDFSIKIVDVMTQENLITA

SEQ ID NO: 1673282 - protein, 24 aa, Staphylococcus aureus
TNSDLALNLSIYGRAYEIVYRDTD

SEQ ID NO: 1673283 - protein, 22 aa, Staphylococcus aureus
TNSKQGATNLVIKDAKKNTELA

SEQ ID NO: 1673284 - protein, 24 aa, Staphylococcus aureus
TNTISNWYIRRSRGRFWEQGISND

SEQ ID NO: 1673285 - protein, 19 aa, Staphylococcus aureus
TNTNARIEPGAFIREQAII

SEQ ID NO: 1673286 - protein, 17 aa, Staphylococcus aureus
TNVGFKFNQWLDLAFYE

SEQ ID NO: 1673287 - protein, 18 aa, Staphylococcus aureus
TNVLGLRLVEKSVNQDNT

SEQ ID NO: 1673288 - protein, 23 aa, Staphylococcus aureus
TNVSGSFEQVAFAKRENATTDKT

SEQ ID NO: 1673289 - protein, 22 aa, Staphylococcus aureus
TNYRFDVGQAIYAPGTLIYVFE

SEQ ID NO: 1673290 - protein, 17 aa, Staphylococcus aureus
TNYTKFRGLIMHMSIIS

SEQ ID NO: 1673291 - protein, 17 aa, Staphylococcus aureus
TPARLKYIKSLYTELGK

SEQ ID NO: 1673292 - protein, 23 aa, Staphylococcus aureus
TPDEIFPYVPPQGIEELRDLWQQ

SEQ ID NO: 1673293 - protein, 24 aa, Staphylococcus aureus
TPDFKLKEHCSALRIRVKDNQYEM

SEQ ID NO: 1673294 - protein, 18 aa, Staphylococcus aureus
TPEALKLRIEQIQETFIV

SEQ ID NO: 1673295 - protein, 22 aa, Staphylococcus aureus
TPEFKLQMVRLFENGKSKSDIV

SEQ ID NO: 1673296 - protein, 18 aa, Staphylococcus aureus
TPELKQVEEFECVSERGA

SEQ ID NO: 1673297 - protein, 23 aa, Staphylococcus aureus
TPEQMRQAIEFVKKHKLKHLLVE

SEQ ID NO: 1673298 - protein, 18 aa, Staphylococcus aureus
TPEREIGNDLLIVQNLSK

SEQ ID NO: 1673299 - protein, 19 aa, Staphylococcus aureus
TPGDFEKRVTFGLTGSDAN

SEQ ID NO: 1673300 - protein, 17 aa, Staphylococcus aureus
TPIFKEIIVNVQADELP

SEQ ID NO: 1673301 - protein, 26 aa, Staphylococcus aureus
TPITKTATYKVVRTVPKQVFETARGV

SEQ ID NO: 1673302 - protein, 19 aa, Staphylococcus aureus
TPKPGDWAVWANRNPGHVA

SEQ ID NO: 1673303 - protein, 17 aa, Staphylococcus aureus
TPLDSSLLRKEQNDTTD

SEQ ID NO: 1673304 - protein, 23 aa, Staphylococcus aureus
TPNEGVGYIGEWAKESGHEVYIY

SEQ ID NO: 1673305 - protein, 19 aa, Staphylococcus aureus
TPNEHKTAVLFDGAANGVG

SEQ ID NO: 1673306 - protein, 21 aa, Staphylococcus aureus
TPSFNKPVLVLRSVTERPEGV

SEQ ID NO: 1673307 - protein, 23 aa, Staphylococcus aureus
TPSRMRALLDKYGFNFKKSLGQN

SEQ ID NO: 1673308 - protein, 22 aa, Staphylococcus aureus
TPTKAGYFVTCWTKDEDNYNRP

SEQ ID NO: 1673309 - protein, 25 aa, Staphylococcus aureus
TPVIVKFEAGWCPDCRAMDMWIDPI

SEQ ID NO: 1673310 - protein, 23 aa, Staphylococcus aureus
TPVPGGVGPLTITMVLNNTLLAE

SEQ ID NO: 1673311 - protein, 17 aa, Staphylococcus aureus
TPYIAYKLMEIIEEAGL

SEQ ID NO: 1673312 - protein, 21 aa, Staphylococcus aureus
TPYKKWFERMSDYGFEENIDY

SEQ ID NO: 1673313 - protein, 22 aa, Staphylococcus aureus
TQARPGNHYMLSRLKPNGQFID

SEQ ID NO: 1673314 - protein, 18 aa, Staphylococcus aureus
TQFHGVVWSERLWTNTEA

SEQ ID NO: 1673315 - protein, 17 aa, Staphylococcus aureus
TQFIVDEILAIKLPAEA

SEQ ID NO: 1673316 - protein, 22 aa, Staphylococcus aureus
TQHILLRVNLAGPFPNATLHMA

SEQ ID NO: 1673317 - protein, 23 aa, Staphylococcus aureus
TQIATRTQIAIRIQTVTQVQTVS

SEQ ID NO: 1673318 - protein, 17 aa, Staphylococcus aureus
TQIKVIFKTVLKSADDH

SEQ ID NO: 1673319 - protein, 31 aa, Staphylococcus aureus
TQILTVPRIQRVIQILIQRVTQDQTTTQTVI

SEQ ID NO: 1673320 - protein, 25 aa, Staphylococcus aureus
TQILTVPRIQRVIQTQVVTQIHQVI

SEQ ID NO: 1673321 - protein, 18 aa, Staphylococcus aureus
TQKDGLDYLVKRTDHLTC

SEQ ID NO: 1673322 - protein, 21 aa, Staphylococcus aureus
TQLKFVLFYTIHIKKLTKLSI

SEQ ID NO: 1673323 - protein, 17 aa, Staphylococcus aureus
TQLKQGIADKEQTKADG

SEQ ID NO: 1673324 - protein, 17 aa, Staphylococcus aureus
TQLKQGIANKDTVKASE

SEQ ID NO: 1673325 - protein, 24 aa, Staphylococcus aureus
TQMKSGVRFFDIRGRASADNMISV

SEQ ID NO: 1673326 - protein, 24 aa, Staphylococcus aureus
TQPKNWKRYVSIYRTNAEQKFLKR

SEQ ID NO: 1673327 - protein, 19 aa, Staphylococcus aureus
TQTLIKYGNIYAQVYSDQQ

SEQ ID NO: 1673328 - protein, 27 aa, Staphylococcus aureus
TQTQIAIPTRIAIQNQIVTQIQIAIPT

SEQ ID NO: 1673329 - protein, 23 aa, Staphylococcus aureus
TQTVIQIQTAIQIQIATQIQTAI

SEQ ID NO: 1673330 - protein, 17 aa, Staphylococcus aureus
TRCPIAQDMCKKSMPEL

SEQ ID NO: 1673331 - protein, 19 aa, Staphylococcus aureus
TRELAMQVAERLREFSRGQ

SEQ ID NO: 1673332 - protein, 17 aa, Staphylococcus aureus
TRERVANVFQLPSVFLN

SEQ ID NO: 1673333 - protein, 19 aa, Staphylococcus aureus
TRFSIARELGRYLFKNTDL

SEQ ID NO: 1673334 - protein, 19 aa, Staphylococcus aureus
TRFSIARELGRYLYKIKDN

SEQ ID NO: 1673335 - protein, 17 aa, Staphylococcus aureus
TRIETIKVSEKLSKVDV

SEQ ID NO: 1673336 - protein, 17 aa, Staphylococcus aureus
TRILGYYNITLYEFIEN

SEQ ID NO: 1673337 - protein, 18 aa, Staphylococcus aureus
TRKDITYMLDLDMIEDLS

SEQ ID NO: 1673338 - protein, 18 aa, Staphylococcus aureus
TRKFTSFEMACKELSTIL

SEQ ID NO: 1673339 - protein, 19 aa, Staphylococcus aureus
TRKFTSFEMACKELSTILK

SEQ ID NO: 1673340 - protein, 19 aa, Staphylococcus aureus
TRLEEIMSILSDNMQREKE

SEQ ID NO: 1673341 - protein, 19 aa, Staphylococcus aureus
TRLLPKAKRLDIVSYEEMM

SEQ ID NO: 1673342 - protein, 22 aa, Staphylococcus aureus
TRPEAIKMAPLVKALEQEKMLE

SEQ ID NO: 1673343 - protein, 23 aa, Staphylococcus aureus
TRPEAIKMAPLVKALEQKKMLEP

SEQ ID NO: 1673344 - protein, 21 aa, Staphylococcus aureus
TRPFSFEGRKRQTQAAAGVEA

SEQ ID NO: 1673345 - protein, 21 aa, Staphylococcus aureus
TRPLSATKRFRLVEIVEESVI

SEQ ID NO: 1673346 - protein, 24 aa, Staphylococcus aureus
TRQCPMSGTIIRRKDTDKNKLGLT

SEQ ID NO: 1673347 - protein, 23 aa, Staphylococcus aureus
TRQKAFEEYEWLKNVAKNDIEIE

SEQ ID NO: 1673348 - protein, 18 aa, Staphylococcus aureus
TRQRKRAYEMLDVAMHYK

SEQ ID NO: 1673349 - protein, 18 aa, Staphylococcus aureus
TRQRKRAYEMLDVVMHYN

SEQ ID NO: 1673350 - protein, 24 aa, Staphylococcus aureus
TRRDSEYWRELSFGTTEGNRNNAL

SEQ ID NO: 1673351 - protein, 24 aa, Staphylococcus aureus
TRRVLAIECVIALQATELKGVEGL

SEQ ID NO: 1673352 - protein, 17 aa, Staphylococcus aureus
TRSELVQVIGSMIVIYR

SEQ ID NO: 1673353 - protein, 17 aa, Staphylococcus aureus
TRSKLRRALPEQYVFIV

SEQ ID NO: 1673354 - protein, 18 aa, Staphylococcus aureus
TRSYRSATYKDIVILERS

SEQ ID NO: 1673355 - protein, 18 aa, Staphylococcus aureus
TRTAKGYYFVRKTYNEED

SEQ ID NO: 1673356 - protein, 19 aa, Staphylococcus aureus
TRTLIPFLTMIQNTFGYLP

SEQ ID NO: 1673357 - protein, 20 aa, Staphylococcus aureus
TRTLIPFLTMIQNTFGYLPV

SEQ ID NO: 1673358 - protein, 19 aa, Staphylococcus aureus
TRTLIPFLTMIQNTFVIYQ

SEQ ID NO: 1673359 - protein, 20 aa, Staphylococcus aureus
TRTYNNLVELEWIYKERPVD

SEQ ID NO: 1673360 - protein, 20 aa, Staphylococcus aureus
TRVKIAYVLSLEGELCVCDV

SEQ ID NO: 1673361 - protein, 45 aa, Staphylococcus aureus; identical to SEQ ID NO: 1586060

SEQ ID NO: 1673362 - protein, 18 aa, Staphylococcus aureus
TRYLDGMGEFIKVSELDQ

SEQ ID NO: 1673363 - protein, 24 aa, Staphylococcus aureus
TSARLHPWLLKIYEKEVMKYTANM

SEQ ID NO: 1673364 - protein, 17 aa, Staphylococcus aureus
TSCEFDFTKEGELKVSF

SEQ ID NO: 1673365 - protein, 18 aa, Staphylococcus aureus
TSCEFDFTKEGELKVSFD

SEQ ID NO: 1673366 - protein, 29 aa, Staphylococcus aureus
TSDKPRFKRWVIGSILSRTYYHNMVTHLL

SEQ ID NO: 1673367 - protein, 26 aa, Staphylococcus aureus
TSDLISRYAGIRVPRNKAIVGQNAFS

SEQ ID NO: 1673368 - protein, 29 aa, Staphylococcus aureus
TSDNPRFKRWIIGSILSRTYYHNMVTHLL

SEQ ID NO: 1673369 - protein, 29 aa, Staphylococcus aureus
TSDNPRFKRWVIGSILFRTYYHNMVTHLL

SEQ ID NO: 1673370 - protein, 17 aa, Staphylococcus aureus
TSEAFKEDTRFYYHQLK

SEQ ID NO: 1673371 - protein, 24 aa, Staphylococcus aureus
TSEGKLLFNEALRIIEHLDSTTEQ

SEQ ID NO: 1673372 - protein, 23 aa, Staphylococcus aureus
TSELKLSERWNVSRNTVRNYLNA

SEQ ID NO: 1673373 - protein, 17 aa, Staphylococcus aureus
TSGIQWADNATFETKIN

SEQ ID NO: 1673374 - protein, 20 aa, Staphylococcus aureus
TSHLFCSFGCEKTVLHQMWW

SEQ ID NO: 1673375 - protein, 20 aa, Staphylococcus aureus
TSHLNKSLVHKIKNVLKDAG

SEQ ID NO: 1673376 - protein, 17 aa, Staphylococcus aureus
TSIGMIYGSGITIPGYG

SEQ ID NO: 1673377 - protein, 17 aa, Staphylococcus aureus
TSIPEDRIKMIINKVQP

SEQ ID NO: 1673378 - protein, 31 aa, Staphylococcus aureus
TSKLIFASWSPRLHFNASLFQIEDDDILSLY

SEQ ID NO: 1673379 - protein, 22 aa, Staphylococcus aureus
TSLLQRQFRIGYNRASRLMDDL

SEQ ID NO: 1673380 - protein, 17 aa, Staphylococcus aureus
TSLNLTLDEYFNYLKKI

SEQ ID NO: 1673381 - protein, 23 aa, Staphylococcus aureus
TSNIIMNVIIDFNKSMIQSFPEM

SEQ ID NO: 1673382 - protein, 26 aa, Staphylococcus aureus
TSNIKFKMNLAFDWENSILKANHVNI

SEQ ID NO: 1673383 - protein, 23 aa, Staphylococcus aureus
TSPWVKEASAATVAGIAGTNNGI

SEQ ID NO: 1673384 - protein, 19 aa, Staphylococcus aureus
TSQLRHRLMIQSIVSSDLT

SEQ ID NO: 1673385 - protein, 17 aa, Staphylococcus aureus
TSQPAIGEWITKYEMLR

SEQ ID NO: 1673386 - protein, 20 aa, Staphylococcus aureus
TSQPPIGRFIETYEQLAQDD

SEQ ID NO: 1673387 - protein, 26 aa, Staphylococcus aureus
TSRFDEIYYLYTIICVDIGEQVKIRL

SEQ ID NO: 1673388 - protein, 20 aa, Staphylococcus aureus
TSRFYQYWFDHIDEDLAEAK

SEQ ID NO: 1673389 - protein, 24 aa, Staphylococcus aureus
TSRLLSTRLEQVFSEIECITQASV

SEQ ID NO: 1673390 - protein, 21 aa, Staphylococcus aureus
TSTDMGYVFEELVRKFSESYN

SEQ ID NO: 1673391 - protein, 22 aa, Staphylococcus aureus
TSVCVPLDAPFEVEVEEEITEE

SEQ ID NO: 1673392 - protein, 29 aa, Staphylococcus aureus
TSVKMTYKIIGDFKRKIPIDELGNKNGLE

SEQ ID NO: 1673393 - protein, 30 aa, Staphylococcus aureus
TSVKMTYKIIGDFKRKIPIEELGNKNGLEY

SEQ ID NO: 1673394 - protein, 34 aa, Staphylococcus aureus
TSYHAGLVGKEFLEKWAGVPTEVHVASEFVYNMP

SEQ ID NO: 1673395 - protein, 24 aa, Staphylococcus aureus
TTAKAAALEEFDEVVQAQIDQAPL

SEQ ID NO: 1673396 - protein, 25 aa, Staphylococcus aureus
TTDLLKCHYCGYQATPPNQCPNCES

SEQ ID NO: 1673397 - protein, 30 aa, Staphylococcus aureus; identical to SEQ ID NO: 1577286

SEQ ID NO: 1673398 - protein, 24 aa, Staphylococcus aureus
TTEIQRKWIEKFKAIGDIFKAKAE

SEQ ID NO: 1673399 - protein, 20 aa, Staphylococcus aureus
TTEIQRKWIEKFKAIGDTFK

SEQ ID NO: 1673400 - protein, 36 aa, Staphylococcus aureus
TTGNTEFWATSSDVLKLKANYTIDDSVKEGDTFTFK

SEQ ID NO: 1673401 - protein, 21 aa, Staphylococcus aureus
TTHANGQVSYGARPTQNKPSE

SEQ ID NO: 1673402 - protein, 21 aa, Staphylococcus aureus
TTHANGQVSYGARPTQNKPSK

SEQ ID NO: 1673403 - protein, 24 aa, Staphylococcus aureus
TTIFIDEGWAFSASRQGKKVAKGI

SEQ ID NO: 1673404 - protein, 22 aa, Staphylococcus aureus
TTIRLKECGLILGIDLLDHIII

SEQ ID NO: 1673405 - protein, 24 aa, Staphylococcus aureus
TTKFKAKYFQGFHNKFELKAEANG

SEQ ID NO: 1673406 - protein, 18 aa, Staphylococcus aureus
TTKFKTTTIVFKFMAPLE

SEQ ID NO: 1673407 - protein, 25 aa, Staphylococcus aureus
TTKRRFRFGKSIGRQYGFQIDLSSY

SEQ ID NO: 1673408 - protein, 23 aa, Staphylococcus aureus
TTKRSRIIGSLIHMRCNRIFGID

SEQ ID NO: 1673409 - protein, 18 aa, Staphylococcus aureus
TTLATRENNAFIIDIHED

SEQ ID NO: 1673410 - protein, 18 aa, Staphylococcus aureus
TTLLRMINALEIPTEGTV

SEQ ID NO: 1673411 - protein, 26 aa, Staphylococcus aureus
TTLSSEGFLKFLPKSEKYRIIYSYNM

SEQ ID NO: 1673412 - protein, 35 aa, Staphylococcus aureus
TTLSSEGFLKFLPKSEKYRIIYSYNMNIIRESNVS

SEQ ID NO: 1673413 - protein, 28 aa, Staphylococcus aureus
TTMKQKALAKVRMSEIGFILQATNLVPF

SEQ ID NO: 1673414 - protein, 22 aa, Staphylococcus aureus
TTNSAFLIYLFAKDLSNHDELM

SEQ ID NO: 1673415 - protein, 17 aa, Staphylococcus aureus
TTTGRPRRVGWFDSVVL

SEQ ID NO: 1673416 - protein, 22 aa, Staphylococcus aureus
TTTIGKLAYRYKMEGKKVMLAA

SEQ ID NO: 1673417 - protein, 26 aa, Staphylococcus aureus
TTTIKQRALNRMAVNTVAAPQQGTNV

SEQ ID NO: 1673418 - protein, 20 aa, Staphylococcus aureus
TVALKTLGLIIVMAQSGLLI

SEQ ID NO: 1673419 - protein, 17 aa, Staphylococcus aureus
TVCGEVFTSPTPDKILE

SEQ ID NO: 1673420 - protein, 18 aa, Staphylococcus aureus
TVCQLEIKLDTGRTHQIR

SEQ ID NO: 1673421 - protein, 22 aa, Staphylococcus aureus
TVDIRKQFTYDYTVLDIKVIMP

SEQ ID NO: 1673422 - protein, 26 aa, Staphylococcus aureus
TVEGFRPVMEVQFLGFVFEVFDAIAG

SEQ ID NO: 1673423 - protein, 24 aa, Staphylococcus aureus
TVEGGPTLRLFKVPDNVRNLKIQF

SEQ ID NO: 1673424 - protein, 19 aa, Staphylococcus aureus
TVFCYGLMVNYCLQAVDIL

SEQ ID NO: 1673425 - protein, 21 aa, Staphylococcus aureus
TVGLELLEKGIARTGYEVMDL

SEQ ID NO: 1673426 - protein, 18 aa, Staphylococcus aureus
TVIQNRIATQTQTATQTQ

SEQ ID NO: 1673427 - protein, 26 aa, Staphylococcus aureus
TVKAEGFNHVIARHYAIRNALRRALK

SEQ ID NO: 1673428 - protein, 30 aa, Staphylococcus aureus
TVKAEGFNHVIARHYAIRNALRSALKALDL

SEQ ID NO: 1673429 - protein, 24 aa, Staphylococcus aureus
TVKRPYLIEYIDSFATPQGAKDTK

SEQ ID NO: 1673430 - protein, 17 aa, Staphylococcus aureus
TVLRGCKPYYVEYGAFS

SEQ ID NO: 1673431 - protein, 17 aa, Staphylococcus aureus
TVNDLYLIVKKLSQGDV

SEQ ID NO: 1673432 - protein, 30 aa, Staphylococcus aureus
TVNGQENLYRIAIQYYGSGSPENVEKIRRA

SEQ ID NO: 1673433 - protein, 20 aa, Staphylococcus aureus
TVNWHHFLRPEIKFDGIDPL

SEQ ID NO: 1673434 - protein, 25 aa, Staphylococcus aureus
TVPVKHVIPEIVAHSHYTVQGQDFP

SEQ ID NO: 1673435 - protein, 23 aa, Staphylococcus aureus
TVQGEIVQGPDFLTMEQSGPSLS

SEQ ID NO: 1673436 - protein, 20 aa, Staphylococcus aureus
TVRIYKPWLTAHHLSLPKYV

SEQ ID NO: 1673437 - protein, 23 aa, Staphylococcus aureus
TVRKNIKHYLLMLDEKMKNLDDY

SEQ ID NO: 1673438 - protein, 17 aa, Staphylococcus aureus
TVSELYAPISGKVVEVN

SEQ ID NO: 1673439 - protein, 24 aa, Staphylococcus aureus
TVSKAIVGGAKFIGNSYVKAGQNT

SEQ ID NO: 1673440 - protein, 24 aa, Staphylococcus aureus
TVSSLRLDVVIKEMIRKSRTIAKQ

SEQ ID NO: 1673441 - protein, 23 aa, Staphylococcus aureus
TVTGLPSGLSYDSATNSIIGTPT

SEQ ID NO: 1673442 - protein, 17 aa, Staphylococcus aureus
TVVAPNLFEAGQLSGLG

SEQ ID NO: 1673443 - protein, 19 aa, Staphylococcus aureus
TVVDAINGRLQYVIPNEFL

SEQ ID NO: 1673444 - protein, 20 aa, Staphylococcus aureus
TWRGKRSTDDIFTRLNDGHL

SEQ ID NO: 1673445 - protein, 20 aa, Staphylococcus aureus
TWSQRLWNDMELVQKEVERV

SEQ ID NO: 1673446 - protein, 23 aa, Staphylococcus aureus
TWTNRPGAEYLWFNNVETKPGVG

SEQ ID NO: 1673447 - protein, 17 aa, Staphylococcus aureus
TYDFTPFLFDGNKTLLV

SEQ ID NO: 1673448 - protein, 23 aa, Staphylococcus aureus
TYDLGIRAIMFFGVPNSKDDIGT

SEQ ID NO: 1673449 - protein, 20 aa, Staphylococcus aureus
TYEKLAFATLGVRNGATFIS

SEQ ID NO: 1673450 - protein, 17 aa, Staphylococcus aureus
TYFPEYDIEFLFEKEKE

SEQ ID NO: 1673451 - protein, 26 aa, Staphylococcus aureus
TYGPKGRFGGLVYDTLGFNAVDKKVS

SEQ ID NO: 1673452 - protein, 18 aa, Staphylococcus aureus
TYGYVWRFEGNEIIYATD

SEQ ID NO: 1673453 - protein, 18 aa, Staphylococcus aureus
TYHYNFKTYKVFTENKEI

SEQ ID NO: 1673454 - protein, 22 aa, Staphylococcus aureus
TYIKRDILKRENIKEVTTKTTI

SEQ ID NO: 1673455 - protein, 28 aa, Staphylococcus aureus
TYKELVIATETFVDFPINYEDSNVCQFI

SEQ ID NO: 1673456 - protein, 23 aa, Staphylococcus aureus
TYLEVQRIYFLKDFQGGGRGSQL

SEQ ID NO: 1673457 - protein, 17 aa, Staphylococcus aureus
TYNYPIILFYKRNINHL

SEQ ID NO: 1673458 - protein, 26 aa, Staphylococcus aureus
TYPTISNDFLKLFGHVWLVERWMDDD

SEQ ID NO: 1673459 - protein, 17 aa, Staphylococcus aureus
TYSVEFSTPAGYTPTTA

SEQ ID NO: 1673460 - protein, 20 aa, Staphylococcus aureus
TYTKETFVTNLTGYKFNPDA

SEQ ID NO: 1673461 - protein, 19 aa, Staphylococcus aureus
TYVSDALRQVNLQSDIFAV

SEQ ID NO: 1673462 - protein, 19 aa, Staphylococcus aureus
TYYKLYGDKIVGFDTNDFP

SEQ ID NO: 1673463 - protein, 17 aa, Staphylococcus aureus
VAAICGATISLADIGIL

SEQ ID NO: 1673464 - protein, 19 aa, Staphylococcus aureus
VACTFRILIKNLIYNKIKQ

SEQ ID NO: 1673465 - protein, 22 aa, Staphylococcus aureus
VADALKAYPLLNSSWQGNEIVL

SEQ ID NO: 1673466 - protein, 18 aa, Staphylococcus aureus
VADQGCKLVVVNKEQSLS

SEQ ID NO: 1673467 - protein, 22 aa, Staphylococcus aureus
VAEAIERINAAKVSGVKAIEAT

SEQ ID NO: 1673468 - protein, 31 aa, Staphylococcus aureus
VAEGPGSYTGLRIGVTVAKTLAYALDVKLYG

SEQ ID NO: 1673469 - protein, 23 aa, Staphylococcus aureus
VAEHFNISYGQIYQWVHKYQAHG

SEQ ID NO: 1673470 - protein, 19 aa, Staphylococcus aureus
VAFREFIHQYPLAVVHVMR

SEQ ID NO: 1673471 - protein, 23 aa, Staphylococcus aureus
VAFSKKSARIFGAYRKGYFKRRL

SEQ ID NO: 1673472 - protein, 18 aa, Staphylococcus aureus
VAGSGVYICNECIELCSE

SEQ ID NO: 1673473 - protein, 20 aa, Staphylococcus aureus
VAHLPGHLSPLLKNYYLNLY

SEQ ID NO: 1673474 - protein, 21 aa, Staphylococcus aureus
VAHTCAYLYHPNARSVTGTIQ

SEQ ID NO: 1673475 - protein, 19 aa, Staphylococcus aureus
VAIEPPTFVVFVNDVELMH

SEQ ID NO: 1673476 - protein, 18 aa, Staphylococcus aureus
VALCRAHVHKPNVILMDE

SEQ ID NO: 1673477 - protein, 21 aa, Staphylococcus aureus
VALEPPTFVVFVNDVELMHFS

SEQ ID NO: 1673478 - protein, 17 aa, Staphylococcus aureus
VALGRAIVRDAKVFLMD

SEQ ID NO: 1673479 - protein, 17 aa, Staphylococcus aureus
VALMIGIPPGLIYGETA

SEQ ID NO: 1673480 - protein, 25 aa, Staphylococcus aureus
VAMRFGDGIKAIFNYPSQETAEGKW

SEQ ID NO: 1673481 - protein, 17 aa, Staphylococcus aureus
VANCPKQYLAHVLSKHG

SEQ ID NO: 1673482 - protein, 20 aa, Staphylococcus aureus
VANMEGYLMRSIIAELEEMH

SEQ ID NO: 1673483 - protein, 18 aa, Staphylococcus aureus
VANTLPLAQIVVVHMEAV

SEQ ID NO: 1673484 - protein, 17 aa, Staphylococcus aureus
VAPDFRTVTPIIQNISV

SEQ ID NO: 1673485 - protein, 21 aa, Staphylococcus aureus
VAPYSGVTWMGAGTGFVVGNH

SEQ ID NO: 1673486 - protein, 23 aa, Staphylococcus aureus
VASEIMAILCLSRSIKDLKVKIS

SEQ ID NO: 1673487 - protein, 19 aa, Staphylococcus aureus
VATDKEFYIFDSLIQGRSY

SEQ ID NO: 1673488 - protein, 19 aa, Staphylococcus aureus
VATRAWTFRTVGYGHSPYV

SEQ ID NO: 1673489 - protein, 20 aa, Staphylococcus aureus
VCDETAWWSYMGQDNDIFKD

SEQ ID NO: 1673490 - protein, 25 aa, Staphylococcus aureus
VCDGDWGVAEGLVFDNFKVTDFDWR

SEQ ID NO: 1673491 - protein, 18 aa, Staphylococcus aureus
VCEFKGINAQALEASVLS

SEQ ID NO: 1673492 - protein, 19 aa, Staphylococcus aureus
VCEGNIKAWVNIMYGCDKF

SEQ ID NO: 1673493 - protein, 18 aa, Staphylococcus aureus
VCHEMSGIIGADISVRYP

SEQ ID NO: 1673494 - protein, 18 aa, Staphylococcus aureus
VCRFNVAILDNGYYLPED

SEQ ID NO: 1673495 - protein, 17 aa, Staphylococcus aureus
VCYHGRFEKDIESGTPT

SEQ ID NO: 1673496 - protein, 20 aa, Staphylococcus aureus
VCYMWLRFNMDQQFEDTAIN

SEQ ID NO: 1673497 - protein, 18 aa, Staphylococcus aureus
VCYYSLCKEKIKSSLFTN

SEQ ID NO: 1673498 - protein, 26 aa, Staphylococcus aureus
VDAFNFDCTFLAKAIARDGEGATKLI

SEQ ID NO: 1673499 - protein, 31 aa, Staphylococcus aureus
VDAHLFFRTFLRLRMYITFYTHLICKKCFDL

SEQ ID NO: 1673500 - protein, 17 aa, Staphylococcus aureus
VDALPLIDVEIDVLLLV

SEQ ID NO: 1673501 - protein, 18 aa, Staphylococcus aureus
VDAPPYWYKNINYQHDLD

SEQ ID NO: 1673502 - protein, 21 aa, Staphylococcus aureus
VDASINWALGLMNEGSQIIDN

SEQ ID NO: 1673503 - protein, 24 aa, Staphylococcus aureus
VDAVLKRFNVALSDIEAVITEKEN

SEQ ID NO: 1673504 - protein, 25 aa, Staphylococcus aureus
VDAVLKRFNVALSDIEAVITEKENS

SEQ ID NO: 1673505 - protein, 19 aa, Staphylococcus aureus
VDCGIAFKRMKNYLYDIKY

SEQ ID NO: 1673506 - protein, 22 aa, Staphylococcus aureus
VDCNYMIGMAFNQLESFKLALP

SEQ ID NO: 1673507 - protein, 19 aa, Staphylococcus aureus
VDEDILCIEYSYYHKEVVK

SEQ ID NO: 1673508 - protein, 17 aa, Staphylococcus aureus
VDEILAIKLPAEATKVS

SEQ ID NO: 1673509 - protein, 18 aa, Staphylococcus aureus
VDELDEANQLISDTLKKA

SEQ ID NO: 1673510 - protein, 19 aa, Staphylococcus aureus
VDEVEFIKVIREVCRNGVI

SEQ ID NO: 1673511 - protein, 23 aa, Staphylococcus aureus
VDGEIIFKHGLSLDQVKQIINLA

SEQ ID NO: 1673512 - protein, 19 aa, Staphylococcus aureus
VDGFHPINIGKLYIDEQTF

SEQ ID NO: 1673513 - protein, 22 aa, Staphylococcus aureus
VDGRSGAIYKGRRLESYSFDIP

SEQ ID NO: 1673514 - protein, 22 aa, Staphylococcus aureus
VDGRSGSIYKGRRLESYSFDIP

SEQ ID NO: 1673515 - protein, 23 aa, Staphylococcus aureus
VDGRSGSIYKGRRLESYSFDIPL

SEQ ID NO: 1673516 - protein, 21 aa, Staphylococcus aureus
VDHQITFIPYFPLVSGILAGK

SEQ ID NO: 1673517 - protein, 23 aa, Staphylococcus aureus
VDILDLLSAKGISLYIINLNKNL

SEQ ID NO: 1673518 - protein, 21 aa, Staphylococcus aureus
VDKKLSHMRIHSINIKEFETN

SEQ ID NO: 1673519 - protein, 21 aa, Staphylococcus aureus
VDKKLSYMRIHSINIKEFETN

SEQ ID NO: 1673520 - protein, 18 aa, Staphylococcus aureus
VDKSEMKSEDALYDEAYL

SEQ ID NO: 1673521 - protein, 19 aa, Staphylococcus aureus
VDKSEMKSEDALYDEAYLF

SEQ ID NO: 1673522 - protein, 25 aa, Staphylococcus aureus
VDKVTHLRALLQLRDVAQDNDAIER

SEQ ID NO: 1673523 - protein, 18 aa, Staphylococcus aureus
VDLAFSRDQEHKEYVQHR

SEQ ID NO: 1673524 - protein, 21 aa, Staphylococcus aureus
VDLRGMLRRMIGHPKKDRVAY

SEQ ID NO: 1673525 - protein, 22 aa, Staphylococcus aureus
VDLRGMLRRMIGHPKKDRVAYE

SEQ ID NO: 1673526 - protein, 19 aa, Staphylococcus aureus
VDMMIKYEIPLSIENLKVD

SEQ ID NO: 1673527 - protein, 17 aa, Staphylococcus aureus
VDMRLHRVIYNVIEEIE

SEQ ID NO: 1673528 - protein, 24 aa, Staphylococcus aureus
VDNHVYTDIKWCRMIIRQILSNAL

SEQ ID NO: 1673529 - protein, 17 aa, Staphylococcus aureus
VDNIVNWRRETLGDIDV

SEQ ID NO: 1673530 - protein, 22 aa, Staphylococcus aureus
VDPAFRTGCKLAAINPFGTFIA

SEQ ID NO: 1673531 - protein, 21 aa, Staphylococcus aureus
VDRYLLNRLREFTASTINNYE

SEQ ID NO: 1673532 - protein, 20 aa, Staphylococcus aureus
VDTYHWLPVTFTISKKEMEC

SEQ ID NO: 1673533 - protein, 18 aa, Staphylococcus aureus
VDVEEVWNLIDYKLRTYE

SEQ ID NO: 1673534 - protein, 18 aa, Staphylococcus aureus
VDVIAAKIIKNYGISRLD

SEQ ID NO: 1673535 - protein, 25 aa, Staphylococcus aureus
VDVKSWGEKTFYHFDVPDEHDTEMS

SEQ ID NO: 1673536 - protein, 19 aa, Staphylococcus aureus
VDVQDTWKNGLYVDNNFVF

SEQ ID NO: 1673537 - protein, 18 aa, Staphylococcus aureus
VDYLHHLIQAMHLAYSDR

SEQ ID NO: 1673538 - protein, 17 aa, Staphylococcus aureus
VEAAAMPMPQVQSTDNN

SEQ ID NO: 1673539 - protein, 22 aa, Staphylococcus aureus
VEAFKGMDTVVFIPSIIHPSFK

SEQ ID NO: 1673540 - protein, 19 aa, Staphylococcus aureus
VEAFREFIHQYPLAVVHVM

SEQ ID NO: 1673541 - protein, 19 aa, Staphylococcus aureus
VEAMQGYLMKSLKSEFAEV

SEQ ID NO: 1673542 - protein, 26 aa, Staphylococcus aureus
VEANANRYTFVWKKSIPNHESKLNEN

SEQ ID NO: 1673543 - protein, 25 aa, Staphylococcus aureus
VEANANRYTFVWKKSIQNHESKLNE

SEQ ID NO: 1673544 - protein, 24 aa, Staphylococcus aureus
VEASANRYTFVWKKSIQNYESKLN

SEQ ID NO: 1673545 - protein, 18 aa, Staphylococcus aureus
VECAIPMIQGILAKIPFF

SEQ ID NO: 1673546 - protein, 30 aa, Staphylococcus aureus
VEDIRWLRCDIKSLNLLGNVLAKEYAVKYN

SEQ ID NO: 1673547 - protein, 17 aa, Staphylococcus aureus
VEEDCYYYHSINSIRRV

SEQ ID NO: 1673548 - protein, 19 aa, Staphylococcus aureus
VEEFECVSERGAKGFGSSG

SEQ ID NO: 1673549 - protein, 17 aa, Staphylococcus aureus
VEERSAVSIGRRVQDPL

SEQ ID NO: 1673550 - protein, 17 aa, Staphylococcus aureus
VEFEFALFDSDIDNLKH

SEQ ID NO: 1673551 - protein, 21 aa, Staphylococcus aureus
VEGFKNADFEKVVVYRDEEEL

SEQ ID NO: 1673552 - protein, 21 aa, Staphylococcus aureus
VEGIKIELEDKIYILFHKPTQ

SEQ ID NO: 1673553 - protein, 23 aa, Staphylococcus aureus
VEGRAEVILNELFQQILQKSEKK

SEQ ID NO: 1673554 - protein, 24 aa, Staphylococcus aureus
VEIADKLYKGKHLLNDVPPHTINY

SEQ ID NO: 1673555 - protein, 17 aa, Staphylococcus aureus
VEIKHKGQYVISITYVE

SEQ ID NO: 1673556 - protein, 17 aa, Staphylococcus aureus
VEIPFYTEEELTYRLNN

SEQ ID NO: 1673557 - protein, 18 aa, Staphylococcus aureus
VEKHYNLYVNMLENGEKH

SEQ ID NO: 1673558 - protein, 17 aa, Staphylococcus aureus
VEKLFDLNIGKQINSSE

SEQ ID NO: 1673559 - protein, 18 aa, Staphylococcus aureus
VEKLGGIVVGIAFIIELK

SEQ ID NO: 1673560 - protein, 19 aa, Staphylococcus aureus
VELEKGQFVFGRKRASEEL

SEQ ID NO: 1673561 - protein, 17 aa, Staphylococcus aureus
VELHLNYEKQLNWDGVE

SEQ ID NO: 1673562 - protein, 19 aa, Staphylococcus aureus
VEMTLSLIFTSNHILKSWE

SEQ ID NO: 1673563 - protein, 18 aa, Staphylococcus aureus
VENFDTYGLAIVDFHYPE

SEQ ID NO: 1673564 - protein, 18 aa, Staphylococcus aureus
VENLMIFRREYKASEQQA

SEQ ID NO: 1673565 - protein, 18 aa, Staphylococcus aureus
VENVYIMLNKPKGYISGT

SEQ ID NO: 1673566 - protein, 20 aa, Staphylococcus aureus
VERLMGLDKLSKLEVLNTDP

SEQ ID NO: 1673567 - protein, 18 aa, Staphylococcus aureus
VETIFDLALLTLLKGDLS

SEQ ID NO: 1673568 - protein, 18 aa, Staphylococcus aureus
VETLCDIDSLDAVDADLL

SEQ ID NO: 1673569 - protein, 19 aa, Staphylococcus aureus
VEVLKEKFEPVLKEPGVVG

SEQ ID NO: 1673570 - protein, 18 aa, Staphylococcus aureus
VEVLPGVASKAIHHIQKE

SEQ ID NO: 1673571 - protein, 17 aa, Staphylococcus aureus
VEWEKVYTIAYVNDRGG

SEQ ID NO: 1673572 - protein, 24 aa, Staphylococcus aureus
VEYKEVLTGFKFIAQEIRQLDDYQ

SEQ ID NO: 1673573 - protein, 24 aa, Staphylococcus aureus
VEYKEVLTGFKFIAQEIRQLDNHQ

SEQ ID NO: 1673574 - protein, 24 aa, Staphylococcus aureus
VEYTKRLGYKILVIVNDSTNPITY

SEQ ID NO: 1673575 - protein, 19 aa, Staphylococcus aureus
VFASLSLKSELAYKLIDAD

SEQ ID NO: 1673576 - protein, 19 aa, Staphylococcus aureus
VFEIINGWCRIYWNNHNEW

SEQ ID NO: 1673577 - protein, 19 aa, Staphylococcus aureus
VFFLNGFQMKGVIEEFDKY

SEQ ID NO: 1673578 - protein, 18 aa, Staphylococcus aureus
VFGPESWGNINQLRNKYV

SEQ ID NO: 1673579 - protein, 17 aa, Staphylococcus aureus
VFHLSALQDMNRIPIDI

SEQ ID NO: 1673580 - protein, 26 aa, Staphylococcus aureus
VFKARRDRFEAMLAKVDLPFVHAKGG

SEQ ID NO: 1673581 - protein, 24 aa, Staphylococcus aureus
VFLVKDLFKGYVWNRIPRKDRLLL

SEQ ID NO: 1673582 - protein, 20 aa, Staphylococcus aureus
VFMRKWLDLGNRYGNIEEVM

SEQ ID NO: 1673583 - protein, 24 aa, Staphylococcus aureus
VFNEMLKILFIKLMDERNHTSRIA

SEQ ID NO: 1673584 - protein, 18 aa, Staphylococcus aureus
VFNKRGYPIGQILIPGRE

SEQ ID NO: 1673585 - protein, 18 aa, Staphylococcus aureus
VFPIRFIVDKENEVSDPK

SEQ ID NO: 1673586 - protein, 18 aa, Staphylococcus aureus
VFQKLKTLCLGNHQEQCP

SEQ ID NO: 1673587 - protein, 22 aa, Staphylococcus aureus
VFRGEGIGALQEVGRYEHLFDY

SEQ ID NO: 1673588 - protein, 19 aa, Staphylococcus aureus
VFSICDWGDDFLDTVKINN

SEQ ID NO: 1673589 - protein, 24 aa, Staphylococcus aureus
VFTKELRLSDAHHFICQVNKTKSR

SEQ ID NO: 1673590 - protein, 19 aa, Staphylococcus aureus
VGADIVFHPAVEDIYPGEL

SEQ ID NO: 1673591 - protein, 19 aa, Staphylococcus aureus
VGADIVFHPAVEDMYPGEL

SEQ ID NO: 1673592 - protein, 28 aa, Staphylococcus aureus
VGATTFKESLRWGTEIFHNLKSILSKRG

SEQ ID NO: 1673593 - protein, 28 aa, Staphylococcus aureus
VGCRIGCTFCASTLGGLKRNLEAGEIVS

SEQ ID NO: 1673594 - protein, 20 aa, Staphylococcus aureus
VGDYSTPLTERVFGKDQRTV

SEQ ID NO: 1673595 - protein, 18 aa, Staphylococcus aureus
VGEAFDQTDVMIGNEIGK

SEQ ID NO: 1673596 - protein, 25 aa, Staphylococcus aureus
VGESGCGKSTFGKSIIRLLEVPEET

SEQ ID NO: 1673597 - protein, 18 aa, Staphylococcus aureus
VGFALTYFTEGIIFGSKA

SEQ ID NO: 1673598 - protein, 17 aa, Staphylococcus aureus
VGFFYPEIAMYFKNPSR

SEQ ID NO: 1673599 - protein, 19 aa, Staphylococcus aureus
VGGSVNPGGSMPMVTLSGQ

SEQ ID NO: 1673600 - protein, 19 aa, Staphylococcus aureus
VGHLRGALDEKYRDITIEA

SEQ ID NO: 1673601 - protein, 18 aa, Staphylococcus aureus
VGITRSVIVNALRKLESA

SEQ ID NO: 1673602 - protein, 20 aa, Staphylococcus aureus
VGKQIRAVVYYNKVVASNMS

SEQ ID NO: 1673603 - protein, 18 aa, Staphylococcus aureus
VGKSTLFNAITKAGALAA

SEQ ID NO: 1673604 - protein, 21 aa, Staphylococcus aureus
VGKTGALLGKYNINIASMTLG

SEQ ID NO: 1673605 - protein, 21 aa, Staphylococcus aureus
VGNLTSPYNGRWHMRNIRTNR

SEQ ID NO: 1673606 - protein, 19 aa, Staphylococcus aureus
VGNVNFISRLLEGHYPDTT

SEQ ID NO: 1673607 - protein, 23 aa, Staphylococcus aureus
VGNWRDKFFKEREGKYQVEDDTT

SEQ ID NO: 1673608 - protein, 19 aa, Staphylococcus aureus
VGPQIRRLPVSKMNQDLLV

SEQ ID NO: 1673609 - protein, 20 aa, Staphylococcus aureus
VGRKPDLPFGGYKQSGLGRE

SEQ ID NO: 1673610 - protein, 17 aa, Staphylococcus aureus
VGRLDYDTSGLLLLTND

SEQ ID NO: 1673611 - protein, 20 aa, Staphylococcus aureus
VGSMAAVLGLDFDKVNEICK

SEQ ID NO: 1673612 - protein, 29 aa, Staphylococcus aureus
VGTYYHKLEWLYRRCLEFLERYETQPLQT

SEQ ID NO: 1673613 - protein, 19 aa, Staphylococcus aureus
VGVGPKHREIGFPISTDNA

SEQ ID NO: 1673614 - protein, 19 aa, Staphylococcus aureus
VGVPRGRGKIERFFQTVNQ

SEQ ID NO: 1673615 - protein, 18 aa, Staphylococcus aureus
VGYKEIEIIFSRSKEEAF

SEQ ID NO: 1673616 - protein, 25 aa, Staphylococcus aureus
VGYLNRYRILQSLQLLDRHYKHYEI

SEQ ID NO: 1673617 - protein, 18 aa, Staphylococcus aureus
VGYYLRYALSYRDISEIL

SEQ ID NO: 1673618 - protein, 22 aa, Staphylococcus aureus
VHEPRIKFKSWSDIDENKLEQD

SEQ ID NO: 1673619 - protein, 17 aa, Staphylococcus aureus
VHLYPSINIDRVNELYQ

SEQ ID NO: 1673620 - protein, 17 aa, Staphylococcus aureus
VHMGDIFPTTAHKNPLW

SEQ ID NO: 1673621 - protein, 17 aa, Staphylococcus aureus
VHMGDIFPTTTHKNPLW

SEQ ID NO: 1673622 - protein, 20 aa, Staphylococcus aureus
VHPSPLSAYRGFFGSKPYSK

SEQ ID NO: 1673623 - protein, 22 aa, Staphylococcus aureus
VHPYRVKLALGQVRHYQLDELL

SEQ ID NO: 1673624 - protein, 24 aa, Staphylococcus aureus
VHQPELAIIFGRTKRRVDELTSAL

SEQ ID NO: 1673625 - protein, 22 aa, Staphylococcus aureus
VHSKTSITFILKDVVIEEDNKI

SEQ ID NO: 1673626 - protein, 18 aa, Staphylococcus aureus
VIAAGCLTSIKIVRSNDK

SEQ ID NO: 1673627 - protein, 18 aa, Staphylococcus aureus
VIAAGGIMDGRGVLASIV

SEQ ID NO: 1673628 - protein, 18 aa, Staphylococcus aureus
VIASHVGGISELVTDNGI

SEQ ID NO: 1673629 - protein, 17 aa, Staphylococcus aureus
VIDEAYLDYGMAYDVEM

SEQ ID NO: 1673630 - protein, 26 aa, Staphylococcus aureus
VIDLNLFEHWFRSVFNRRHPYYVIIS

SEQ ID NO: 1673631 - protein, 19 aa, Staphylococcus aureus
VIDNLRLRYEHVGYHGQPL

SEQ ID NO: 1673632 - protein, 22 aa, Staphylococcus aureus
VIEENKYVFVLKHSETCPISAN

SEQ ID NO: 1673633 - protein, 23 aa, Staphylococcus aureus
VIEENKYVFVLKHSETCPISANA

SEQ ID NO: 1673634 - protein, 17 aa, Staphylococcus aureus
VIEGNLFLKGKKPIVER

SEQ ID NO: 1673635 - protein, 18 aa, Staphylococcus aureus
VIEIKSCHYAASKWYEEN

SEQ ID NO: 1673636 - protein, 23 aa, Staphylococcus aureus
VIEKGDMITLDFGAYYNGYCSDI

SEQ ID NO: 1673637 - protein, 26 aa, Staphylococcus aureus
VIGAGRIGLGVAKRAQSFGMKVLAFD

SEQ ID NO: 1673638 - protein, 25 aa, Staphylococcus aureus
VIHLKRIKIADLELDSNLESGNYRL

SEQ ID NO: 1673639 - protein, 23 aa, Staphylococcus aureus
VIHPREIFKTAILSNATGMIIGH

SEQ ID NO: 1673640 - protein, 23 aa, Staphylococcus aureus
VIKELKGSYVVFGDVQFLPGYCV

SEQ ID NO: 1673641 - protein, 24 aa, Staphylococcus aureus
VIKGLCRKEILFAIDHFNQIVRHE

SEQ ID NO: 1673642 - protein, 18 aa, Staphylococcus aureus
VIKIPANILFGGKDEPSY

SEQ ID NO: 1673643 - protein, 26 aa, Staphylococcus aureus
VILEYGESAPKIFRKVTELVKEQVKH

SEQ ID NO: 1673644 - protein, 20 aa, Staphylococcus aureus
VINIPVGYVANLKYQFDINQ

SEQ ID NO: 1673645 - protein, 17 aa, Staphylococcus aureus
VIRACRDLGIQTVAIYS

SEQ ID NO: 1673646 - protein, 17 aa, Staphylococcus aureus
VIRKQPLPYRHMYDNDG

SEQ ID NO: 1673647 - protein, 24 aa, Staphylococcus aureus
VITMYPHLDGVLSLDLTTVLILNQ

SEQ ID NO: 1673648 - protein, 17 aa, Staphylococcus aureus
VIYEKAKAINISSFTDL

SEQ ID NO: 1673649 - protein, 20 aa, Staphylococcus aureus
VKAGDLIKQMAPIVSGKGGG

SEQ ID NO: 1673650 - protein, 19 aa, Staphylococcus aureus
VKALKRILTYFKDIQYSQN

SEQ ID NO: 1673651 - protein, 20 aa, Staphylococcus aureus
VKALKRILTYFKDIQYSQNS

SEQ ID NO: 1673652 - protein, 21 aa, Staphylococcus aureus
VKALKRILTYFKDIQYSQNSW

SEQ ID NO: 1673653 - protein, 20 aa, Staphylococcus aureus
VKARGAEVILTDTFALNKPA

SEQ ID NO: 1673654 - protein, 19 aa, Staphylococcus aureus
VKCCFDYLNNIIMMNQNKS

SEQ ID NO: 1673655 - protein, 18 aa, Staphylococcus aureus
VKDAWYKQIEDLLELAKK

SEQ ID NO: 1673656 - protein, 17 aa, Staphylococcus aureus
VKDLSAVVKFQLTNSKD

SEQ ID NO: 1673657 - protein, 35 aa, Staphylococcus aureus; identical to SEQ ID NO: 1576388

SEQ ID NO: 1673658 - protein, 19 aa, Staphylococcus aureus
VKEKFRIIYYDGEAALALL

SEQ ID NO: 1673659 - protein, 24 aa, Staphylococcus aureus
VKELKLIPFPLPVKFEQDKISQFI

SEQ ID NO: 1673660 - protein, 25 aa, Staphylococcus aureus
VKELKLIPFPLPVKFEQDKISQFIL

SEQ ID NO: 1673661 - protein, 24 aa, Staphylococcus aureus
VKELRKKTGAGMMDCKKALTETDG

SEQ ID NO: 1673662 - protein, 23 aa, Staphylococcus aureus
VKETSGIKWEYIFHDDASKQLPT

SEQ ID NO: 1673663 - protein, 19 aa, Staphylococcus aureus
VKFDINYSLKPLKLSNRQA

SEQ ID NO: 1673664 - protein, 17 aa, Staphylococcus aureus
VKFRTRLGLENYAKEGK

SEQ ID NO: 1673665 - protein, 20 aa, Staphylococcus aureus
VKFYTGILKDREVVITQSGI

SEQ ID NO: 1673666 - protein, 18 aa, Staphylococcus aureus
VKGAIKNHIMPMIEKQIT

SEQ ID NO: 1673667 - protein, 21 aa, Staphylococcus aureus
VKGAYKTYAYVVSYKPTNGNE

SEQ ID NO: 1673668 - protein, 20 aa, Staphylococcus aureus
VKGKHDVPVILFGVGASHLI

SEQ ID NO: 1673669 - protein, 17 aa, Staphylococcus aureus
VKGSGSNVYRCYIDMEH

SEQ ID NO: 1673670 - protein, 23 aa, Staphylococcus aureus
VKHKFSELHVFPYSPRIGTPAVR

SEQ ID NO: 1673671 - protein, 29 aa, Staphylococcus aureus
VKHLNEIVICISFLFLTIFIGGCGTGKEA

SEQ ID NO: 1673672 - protein, 19 aa, Staphylococcus aureus
VKHRVNAFVTVSHAAKEYY

SEQ ID NO: 1673673 - protein, 18 aa, Staphylococcus aureus
VKIAYVLSLEGELCVCDV

SEQ ID NO: 1673674 - protein, 17 aa, Staphylococcus aureus
VKIDSHNDFILWKEVST

SEQ ID NO: 1673675 - protein, 19 aa, Staphylococcus aureus
VKIEFMIDACQKLRAEQLI

SEQ ID NO: 1673676 - protein, 28 aa, Staphylococcus aureus
VKISGLFKKMHIRMMPAQEPPYTRLIDS

SEQ ID NO: 1673677 - protein, 17 aa, Staphylococcus aureus
VKKAKDWYRALSKEEIK

SEQ ID NO: 1673678 - protein, 19 aa, Staphylococcus aureus
VKKIFTIHTNHFLSPYSYG

SEQ ID NO: 1673679 - protein, 26 aa, Staphylococcus aureus
VKKKRTRSSLALFIMICTGCRVSGAR

SEQ ID NO: 1673680 - protein, 20 aa, Staphylococcus aureus
VKKSRAVVERIIENEKTVYG

SEQ ID NO: 1673681 - protein, 23 aa, Staphylococcus aureus
VKLEPPIKEWGKMGLLTIVDDDV

SEQ ID NO: 1673682 - protein, 18 aa, Staphylococcus aureus
VKLSRYYLQGLRSLNGGR

SEQ ID NO: 1673683 - protein, 30 aa, Staphylococcus aureus
VKLTGVPGCGKSLILYDFYKECLKIDKKVA

SEQ ID NO: 1673684 - protein, 18 aa, Staphylococcus aureus
VKNELLGRYEFYRFRLNE

SEQ ID NO: 1673685 - protein, 17 aa, Staphylococcus aureus
VKNRFEIRLKNDRATQA

SEQ ID NO: 1673686 - protein, 23 aa, Staphylococcus aureus
VKNVSGKMSFIYADAQTHHIIDI

SEQ ID NO: 1673687 - protein, 17 aa, Staphylococcus aureus
VKPEVVDAMMMIYNSHY

SEQ ID NO: 1673688 - protein, 19 aa, Staphylococcus aureus
VKPLLKYAHNRGIYTQMNS

SEQ ID NO: 1673689 - protein, 21 aa, Staphylococcus aureus
VKPLLKYTHHRGIYTQMNSNL

SEQ ID NO: 1673690 - protein, 25 aa, Staphylococcus aureus
VKQKEAKFENGVITRKADEKTPNNT

SEQ ID NO: 1673691 - protein, 24 aa, Staphylococcus aureus
VKQKGADIARLWVSSTDYLADVRI

SEQ ID NO: 1673692 - protein, 20 aa, Staphylococcus aureus
VKQRLKGLGDKVTNPVRYEI

SEQ ID NO: 1673693 - protein, 19 aa, Staphylococcus aureus
VKRKIPSVLNILNSFETIS

SEQ ID NO: 1673694 - protein, 26 aa, Staphylococcus aureus
VKRTDHLTCGDVLRINNGQGHAMENF

SEQ ID NO: 1673695 - protein, 21 aa, Staphylococcus aureus
VKRYNNGVYKVCWYKNLRKKS

SEQ ID NO: 1673696 - protein, 17 aa, Staphylococcus aureus
VKSILGFGDSGNDEAYL

SEQ ID NO: 1673697 - protein, 17 aa, Staphylococcus aureus
VKSIYIVRKYKELRKYF

SEQ ID NO: 1673698 - protein, 19 aa, Staphylococcus aureus
VKSKINAASNIAGVNTVKQ

SEQ ID NO: 1673699 - protein, 26 aa, Staphylococcus aureus
VKSKREALEMAERVDLDLVVVAPNAK

SEQ ID NO: 1673700 - protein, 30 aa, Staphylococcus aureus
VKSKRVSENTAFLQRYGAMEIVNKKKPEAY

SEQ ID NO: 1673701 - protein, 17 aa, Staphylococcus aureus
VKSLPPFFYPLNELISI

SEQ ID NO: 1673702 - protein, 17 aa, Staphylococcus aureus
VKTILVGYVIKFIRNKL

SEQ ID NO: 1673703 - protein, 26 aa, Staphylococcus aureus
VKVAQEAFESWSLTSKSERAQMLRDI

SEQ ID NO: 1673704 - protein, 25 aa, Staphylococcus aureus
VKVAQEAFESWSLTSKSERTQMLRD

SEQ ID NO: 1673705 - protein, 23 aa, Staphylococcus aureus
VKVDGEWLYKLISYIESIDEYYQ

SEQ ID NO: 1673706 - protein, 23 aa, Staphylococcus aureus
VKVDGEWLYKLVSYIESIDEYYQ

SEQ ID NO: 1673707 - protein, 23 aa, Staphylococcus aureus
VKVNARQSPLIGGDSFNHSSKNK

SEQ ID NO: 1673708 - protein, 25 aa, Staphylococcus aureus
VKYAESFGAKGLRVTNQEELEVAIK

SEQ ID NO: 1673709 - protein, 17 aa, Staphylococcus aureus
VKYEVNWKTHEVKIKSI

SEQ ID NO: 1673710 - protein, 28 aa, Staphylococcus aureus
VKYLSNDGFCYLSYWYGDNENIVNIFYF

SEQ ID NO: 1673711 - protein, 18 aa, Staphylococcus aureus
VLAPLKYLLIGGEVLNAK

SEQ ID NO: 1673712 - protein, 30 aa, Staphylococcus aureus
VLDACSAPGGKACHIAEVLMPEGQVGASDI

SEQ ID NO: 1673713 - protein, 24 aa, Staphylococcus aureus
VLDPSLPIDLIIDYAHTADGMNKL

SEQ ID NO: 1673714 - protein, 19 aa, Staphylococcus aureus
VLESTLLKADFVVHLAGVN

SEQ ID NO: 1673715 - protein, 27 aa, Staphylococcus aureus
VLFPDKSLKLSYKVNVANIDTPKNIDF

SEQ ID NO: 1673716 - protein, 20 aa, Staphylococcus aureus
VLGPHCYKLILTLSMTANIT

SEQ ID NO: 1673717 - protein, 19 aa, Staphylococcus aureus
VLHDFCKYDDLGKMYQIVR

SEQ ID NO: 1673718 - protein, 23 aa, Staphylococcus aureus
VLHNRFIEKYGFEQLVNIKDLIS

SEQ ID NO: 1673719 - protein, 22 aa, Staphylococcus aureus
VLKAKGIRFDKILKMSNRPKQS

SEQ ID NO: 1673720 - protein, 24 aa, Staphylococcus aureus
VLKEREHFAIFPASHFVTREEKMK

SEQ ID NO: 1673721 - protein, 20 aa, Staphylococcus aureus
VLKLYIPIIRIIKGKIKASS

SEQ ID NO: 1673722 - protein, 19 aa, Staphylococcus aureus
VLKVCQDFYQDQHIYVKIK

SEQ ID NO: 1673723 - protein, 17 aa, Staphylococcus aureus
VLLKEIYQFPLLLFYKG

SEQ ID NO: 1673724 - protein, 23 aa, Staphylococcus aureus
VLNCKSDFWKTLKYKKDKITYYV

SEQ ID NO: 1673725 - protein, 25 aa, Staphylococcus aureus
VLNERPESLFNYFKQLFAQVTNPPI

SEQ ID NO: 1673726 - protein, 23 aa, Staphylococcus aureus
VLNFRFKDCVLEGGMTKEDSIFR

SEQ ID NO: 1673727 - protein, 19 aa, Staphylococcus aureus
VLPSVFLSAHINWRKWCYD

SEQ ID NO: 1673728 - protein, 18 aa, Staphylococcus aureus
VLQQLLNVCYSINVREHE

SEQ ID NO: 1673729 - protein, 19 aa, Staphylococcus aureus
VLQRLVNRIIVIKDGAIVD

SEQ ID NO: 1673730 - protein, 18 aa, Staphylococcus aureus
VLSELCLPLVKKGGQFVA

SEQ ID NO: 1673731 - protein, 17 aa, Staphylococcus aureus
VLSNVAWFWHTSFSHTT

SEQ ID NO: 1673732 - protein, 19 aa, Staphylococcus aureus
VLTAIKIARIFNETVETIF

SEQ ID NO: 1673733 - protein, 17 aa, Staphylococcus aureus
VLTDILPAIDNIERALQ

SEQ ID NO: 1673734 - protein, 22 aa, Staphylococcus aureus
VLTEFKEWVGDAIFVAHNASFD

SEQ ID NO: 1673735 - protein, 25 aa, Staphylococcus aureus
VLTFKAIQACKEYSVQRLIVAGGVA

SEQ ID NO: 1673736 - protein, 17 aa, Staphylococcus aureus
VLTIITMYPHYDGVINV

SEQ ID NO: 1673737 - protein, 23 aa, Staphylococcus aureus
VLVEPDWLVLLDILVESLSDVDV

SEQ ID NO: 1673738 - protein, 19 aa, Staphylococcus aureus
VLVKHSYISKARSKIDERN

SEQ ID NO: 1673739 - protein, 18 aa, Staphylococcus aureus
VLVVSGAELKNAIERSAE

SEQ ID NO: 1673740 - protein, 18 aa, Staphylococcus aureus
VLYKAINLEFDRFTIPQV

SEQ ID NO: 1673741 - protein, 17 aa, Staphylococcus aureus
VLYPVLRPYLTSNAHIV

SEQ ID NO: 1673742 - protein, 24 aa, Staphylococcus aureus
VLYQDVPEQFSIMRYHSLISNPDN

SEQ ID NO: 1673743 - protein, 32 aa, Staphylococcus aureus
VMATGEVLEGGKIRYTFTNDIEDKVDVTAELE

SEQ ID NO: 1673744 - protein, 19 aa, Staphylococcus aureus
VMCGWPYEYSNHRDISKTE

SEQ ID NO: 1673745 - protein, 19 aa, Staphylococcus aureus
VMCKCGAIFLDGGKEYQRY

SEQ ID NO: 1673746 - protein, 24 aa, Staphylococcus aureus
VMEELRLLARAVFVLDADNKVVYN

SEQ ID NO: 1673747 - protein, 19 aa, Staphylococcus aureus
VMEGKAVLFKSFAGINGVP

SEQ ID NO: 1673748 - protein, 23 aa, Staphylococcus aureus
VMKEGRGAYLYDVDGNKFIDYLQ

SEQ ID NO: 1673749 - protein, 34 aa, Staphylococcus aureus
VMMNGKLFGHVYIKDCKVRQSFELASPKHTEGLI

SEQ ID NO: 1673750 - protein, 18 aa, Staphylococcus aureus
VMTVKYAGQTWTRNISDW

SEQ ID NO: 1673751 - protein, 17 aa, Staphylococcus aureus
VMVNPDLTTIEHVLSNT

SEQ ID NO: 1673752 - protein, 19 aa, Staphylococcus aureus
VNAAQRVSGVTDLKNSTTS

SEQ ID NO: 1673753 - protein, 21 aa, Staphylococcus aureus
VNADYFCFGKDIIAPANGTVE

SEQ ID NO: 1673754 - protein, 17 aa, Staphylococcus aureus
VNAFAPGIVQTPMMESI

SEQ ID NO: 1673755 - protein, 20 aa, Staphylococcus aureus
VNDINGAIQAVKDAIQNLNG

SEQ ID NO: 1673756 - protein, 17 aa, Staphylococcus aureus
VNEAMKLFSESRFNVDV

SEQ ID NO: 1673757 - protein, 17 aa, Staphylococcus aureus
VNEDIEIANNYVLSRKD

SEQ ID NO: 1673758 - protein, 17 aa, Staphylococcus aureus
VNERLTQAINQLVPLAD

SEQ ID NO: 1673759 - protein, 30 aa, Staphylococcus aureus
VNGFDFKLFILKGHMGISIQVKDMNNIPIK

SEQ ID NO: 1673760 - protein, 18 aa, Staphylococcus aureus
VNGKRFMQVDSYNDDKNR

SEQ ID NO: 1673761 - protein, 23 aa, Staphylococcus aureus
VNGRGKTSLARGIKEIIEENNPD

SEQ ID NO: 1673762 - protein, 18 aa, Staphylococcus aureus
VNGRKDIEKMTAIVNIVK

SEQ ID NO: 1673763 - protein, 19 aa, Staphylococcus aureus
VNGTISIGCSSLIGQTILP

SEQ ID NO: 1673764 - protein, 26 aa, Staphylococcus aureus
VNHMYRLPVMYLEYSGIYGDVSKVQA

SEQ ID NO: 1673765 - protein, 18 aa, Staphylococcus aureus
VNHNDIFGVIGYSGAGKS

SEQ ID NO: 1673766 - protein, 28 aa, Staphylococcus aureus
VNIFYGTSIPTCILVFKKCRQQDDNVLF

SEQ ID NO: 1673767 - protein, 20 aa, Staphylococcus aureus
VNIIQCLVKPADIYILDEPF

SEQ ID NO: 1673768 - protein, 24 aa, Staphylococcus aureus
VNINKGRLTKSFASNLANMNFLRW

SEQ ID NO: 1673769 - protein, 23 aa, Staphylococcus aureus
VNKAAKFLLALYNVFIEKDCSIV

SEQ ID NO: 1673770 - protein, 18 aa, Staphylococcus aureus
VNKVEMISGMIFADLDTL

SEQ ID NO: 1673771 - protein, 20 aa, Staphylococcus aureus
VNKYCIEKLLLEPNGLIRMY

SEQ ID NO: 1673772 - protein, 18 aa, Staphylococcus aureus
VNLERPINDIAFHLKDNA

SEQ ID NO: 1673773 - protein, 18 aa, Staphylococcus aureus
VNLIDAEELFNLVYNANP

SEQ ID NO: 1673774 - protein, 19 aa, Staphylococcus aureus
VNLYEELKMLYDVENTEIE

SEQ ID NO: 1673775 - protein, 38 aa, Staphylococcus aureus
VNMLPVMRSDFMLRYKDKCLIIDAKFYKNTLHNYYDAK

SEQ ID NO: 1673776 - protein, 26 aa, Staphylococcus aureus
VNNIKKFGVEPVVAINAFIHDTDAEV

SEQ ID NO: 1673777 - protein, 18 aa, Staphylococcus aureus
VNNKIVFTKDVKDPALKQ

SEQ ID NO: 1673778 - protein, 19 aa, Staphylococcus aureus
VNPRSSRTVPFLSKITDIP

SEQ ID NO: 1673779 - protein, 26 aa, Staphylococcus aureus
VNRSRNSLREWLPWVDATEQPSDTRA

SEQ ID NO: 1673780 - protein, 23 aa, Staphylococcus aureus
VNRVSWLEKWQCIEKKGRKEIKC

SEQ ID NO: 1673781 - protein, 21 aa, Staphylococcus aureus
VNTDYFCFGKDIIAPANGTVE

SEQ ID NO: 1673782 - protein, 21 aa, Staphylococcus aureus
VNTLEFFKNWKKQPGKPLDTQ

SEQ ID NO: 1673783 - protein, 25 aa, Staphylococcus aureus
VNTLKNRALNDIGVTSTTAMVNSIR

SEQ ID NO: 1673784 - protein, 17 aa, Staphylococcus aureus
VNTRLGFTGKELESATE

SEQ ID NO: 1673785 - protein, 18 aa, Staphylococcus aureus
VNVGARSSVFAPFKNLGL

SEQ ID NO: 1673786 - protein, 20 aa, Staphylococcus aureus
VNVLKRFKATLIQKNETVEA

SEQ ID NO: 1673787 - protein, 26 aa, Staphylococcus aureus
VNVLQELKLWMARTIAATRNQAIIDV

SEQ ID NO: 1673788 - protein, 21 aa, Staphylococcus aureus
VNYDYWILPGRYKRHTKEYHE

SEQ ID NO: 1673789 - protein, 17 aa, Staphylococcus aureus
VNYGLTYNEHRIHNEQV

SEQ ID NO: 1673790 - protein, 17 aa, Staphylococcus aureus
VNYLLAYDAKVFRKGGV

SEQ ID NO: 1673791 - protein, 20 aa, Staphylococcus aureus
VPACIIIYIFEIKKTGTYRE

SEQ ID NO: 1673792 - protein, 18 aa, Staphylococcus aureus
VPAGDGWDSNPFEPVVIE

SEQ ID NO: 1673793 - protein, 23 aa, Staphylococcus aureus
VPCEISTVPVIHVDPFIHQQSRQ

SEQ ID NO: 1673794 - protein, 24 aa, Staphylococcus aureus
VPCEISTVPVIHVDPFINQQSRQK

SEQ ID NO: 1673795 - protein, 19 aa, Staphylococcus aureus
VPDPLVYAYCFMWNENCNP

SEQ ID NO: 1673796 - protein, 34 aa, Staphylococcus aureus
VPDTLRVASILAHTLFDYPSHQLVTFGVTGTNGK

SEQ ID NO: 1673797 - protein, 27 aa, Staphylococcus aureus
VPEDHAYIRFPVSDGTQELKIVSSTQI

SEQ ID NO: 1673798 - protein, 17 aa, Staphylococcus aureus
VPEGAPFGGYKKIRYRS

SEQ ID NO: 1673799 - protein, 23 aa, Staphylococcus aureus
VPELRFPGFEGEWEEKKLGDLTT

SEQ ID NO: 1673800 - protein, 23 aa, Staphylococcus aureus
VPELRFPGFEGEWEEKKLGDVAT

SEQ ID NO: 1673801 - protein, 22 aa, Staphylococcus aureus
VPELRFPGFEGEWEEKKLGEIF

SEQ ID NO: 1673802 - protein, 22 aa, Staphylococcus aureus
VPELRFPGFEGEWEEKKLGEVA

SEQ ID NO: 1673803 - protein, 22 aa, Staphylococcus aureus
VPELRFPGFEGEWEEKQLGEVG

SEQ ID NO: 1673804 - protein, 19 aa, Staphylococcus aureus
VPFQLQLLFVESGNGITIS

SEQ ID NO: 1673805 - protein, 20 aa, Staphylococcus aureus
VPGLNRFAFTLSNADNAYSS

SEQ ID NO: 1673806 - protein, 25 aa, Staphylococcus aureus
VPIVPELLKSLNFNQFNLVEAQCEP

SEQ ID NO: 1673807 - protein, 22 aa, Staphylococcus aureus
VPNEHKSTVLFDGGANGVGTSI

SEQ ID NO: 1673808 - protein, 22 aa, Staphylococcus aureus
VPNEHKTSVLFDGAASGVGTTI

SEQ ID NO: 1673809 - protein, 19 aa, Staphylococcus aureus
VPRNKAIVGQNAFSHESGI

SEQ ID NO: 1673810 - protein, 20 aa, Staphylococcus aureus
VPSGGYFVWLVFKIDIDIKY

SEQ ID NO: 1673811 - protein, 20 aa, Staphylococcus aureus
VPSYRAVLIYFDEQAITSYK

SEQ ID NO: 1673812 - protein, 20 aa, Staphylococcus aureus
VPSYRAVLIYFDEQSITPSK

SEQ ID NO: 1673813 - protein, 21 aa, Staphylococcus aureus
VPTKRIDLLIDVAELVVKKDE

SEQ ID NO: 1673814 - protein, 23 aa, Staphylococcus aureus
VPVKHVIPEIVAHSHYTVQGQDF

SEQ ID NO: 1673815 - protein, 18 aa, Staphylococcus aureus
VPYHSREKLEIMISDYNK

SEQ ID NO: 1673816 - protein, 23 aa, Staphylococcus aureus
VQEPTVSQGFYGAMFKDLDGHHF

SEQ ID NO: 1673817 - protein, 19 aa, Staphylococcus aureus
VQESIFTKADKRELITAKN

SEQ ID NO: 1673818 - protein, 23 aa, Staphylococcus aureus
VQEVHAWTFKQGMTAPQCAGIIH

SEQ ID NO: 1673819 - protein, 17 aa, Staphylococcus aureus
VQEYAPILYQIWKKKHK

SEQ ID NO: 1673820 - protein, 23 aa, Staphylococcus aureus
VQGDLPLSVYHDMTFFIRHEDEK

SEQ ID NO: 1673821 - protein, 19 aa, Staphylococcus aureus
VQGVGFRYFTQRIAMNYNI

SEQ ID NO: 1673822 - protein, 20 aa, Staphylococcus aureus
VQILFQYLFSQGRLKDAKNY

SEQ ID NO: 1673823 - protein, 19 aa, Staphylococcus aureus
VQILFQYLFSQGRLKDTKN

SEQ ID NO: 1673824 - protein, 18 aa, Staphylococcus aureus
VQKELGFFEIFNEEVLLT

SEQ ID NO: 1673825 - protein, 21 aa, Staphylococcus aureus
VQKIQQGWFGFDVVVATPDMM

SEQ ID NO: 1673826 - protein, 18 aa, Staphylococcus aureus
VQKVFLKAIDSCWLEQVD

SEQ ID NO: 1673827 - protein, 17 aa, Staphylococcus aureus
VQLVKFDDYWQGKPALD

SEQ ID NO: 1673828 - protein, 18 aa, Staphylococcus aureus
VQNYRKVSDRNKADALKA

SEQ ID NO: 1673829 - protein, 18 aa, Staphylococcus aureus
VQNYRKVSNRNKADALKA

SEQ ID NO: 1673830 - protein, 19 aa, Staphylococcus aureus
VQPNAKFPPSLRNMYKELA

SEQ ID NO: 1673831 - protein, 18 aa, Staphylococcus aureus
VQQDEWHEFIAPNIRSKS

SEQ ID NO: 1673832 - protein, 20 aa, Staphylococcus aureus
VQQDEWHEFIAPNIRSKSTY

SEQ ID NO: 1673833 - protein, 21 aa, Staphylococcus aureus
VQQLHANPVKKPAGKTELDQA

SEQ ID NO: 1673834 - protein, 19 aa, Staphylococcus aureus
VQQYRKVYQATDFYLVGCE

SEQ ID NO: 1673835 - protein, 37 aa, Staphylococcus aureus
VQRNQFPWVVAAFPSKAWAKRVYPELSVEEAYIKFID

SEQ ID NO: 1673836 - protein, 23 aa, Staphylococcus aureus
VQSSRIDKVNGFQAMAVSPKDSK

SEQ ID NO: 1673837 - protein, 20 aa, Staphylococcus aureus
VQTALECINNGVDNGDVDDA

SEQ ID NO: 1673838 - protein, 25 aa, Staphylococcus aureus
VQTFKPELLSVLGRTHNTEDIYASV

SEQ ID NO: 1673839 - protein, 20 aa, Staphylococcus aureus
VQVIHELPFDKGLSRVCTNI

SEQ ID NO: 1673840 - protein, 21 aa, Staphylococcus aureus
VQYIVGFASFYGRTFEVNTNC

SEQ ID NO: 1673841 - protein, 21 aa, Staphylococcus aureus
VRAIAKYQSLHPWVLRQKAEI

SEQ ID NO: 1673842 - protein, 18 aa, Staphylococcus aureus
VREYLPFESLILDLNQPF

SEQ ID NO: 1673843 - protein, 19 aa, Staphylococcus aureus
VRFRKFLETKVYGMKTKKM

SEQ ID NO: 1673844 - protein, 20 aa, Staphylococcus aureus
VRKITIKYIPSLREQQNKEV

SEQ ID NO: 1673845 - protein, 25 aa, Staphylococcus aureus
VRKKRTRSSLALFIMICTGCHVSGA

SEQ ID NO: 1673846 - protein, 22 aa, Staphylococcus aureus
VRKNPGEVCPAKWEEGAKTLQP

SEQ ID NO: 1673847 - protein, 19 aa, Staphylococcus aureus
VRKQERFADFDFKEVRKHW

SEQ ID NO: 1673848 - protein, 20 aa, Staphylococcus aureus
VRLALFEADVNFKVVKEFIK

SEQ ID NO: 1673849 - protein, 18 aa, Staphylococcus aureus
VRLCVRYAEQLSVFEEFT

SEQ ID NO: 1673850 - protein, 29 aa, Staphylococcus aureus
VRLDGATKEFFAWGFRVGFITFGTSDQTT

SEQ ID NO: 1673851 - protein, 18 aa, Staphylococcus aureus
VRLVESFLPQSKNDHVYE

SEQ ID NO: 1673852 - protein, 17 aa, Staphylococcus aureus
VRMQRNRIAYSIDEASK

SEQ ID NO: 1673853 - protein, 22 aa, Staphylococcus aureus
VRMQTPFIIASNHYPKFKESGE

SEQ ID NO: 1673854 - protein, 23 aa, Staphylococcus aureus
VRMQTPFIIASNHYPKFKESGEQ

SEQ ID NO: 1673855 - protein, 17 aa, Staphylococcus aureus
VRNMKPLIVNQIFEPSH

SEQ ID NO: 1673856 - protein, 23 aa, Staphylococcus aureus
VRQERGITFGLFRLSVGLEDPDE

SEQ ID NO: 1673857 - protein, 17 aa, Staphylococcus aureus
VRSNWKDVTEIIAAQLL

SEQ ID NO: 1673858 - protein, 26 aa, Staphylococcus aureus
VRSYNCLKRAGINSVQELADKSEADM

SEQ ID NO: 1673859 - protein, 21 aa, Staphylococcus aureus
VRTILKRKVRNVPVVDDKQRL

SEQ ID NO: 1673860 - protein, 18 aa, Staphylococcus aureus
VRVVNFKNFLASDRQNFF

SEQ ID NO: 1673861 - protein, 20 aa, Staphylococcus aureus
VRVVNFKNFLASDRQNFFDY

SEQ ID NO: 1673862 - protein, 17 aa, Staphylococcus aureus
VRYDLLKELNYEGIEFD

SEQ ID NO: 1673863 - protein, 20 aa, Staphylococcus aureus
VRYEIELNYYSPKSKKDTST

SEQ ID NO: 1673864 - protein, 23 aa, Staphylococcus aureus
VSADFRRGEAIFELSDDQIEKAK

SEQ ID NO: 1673865 - protein, 17 aa, Staphylococcus aureus
VSAPAVLGLYPHTVLEL

SEQ ID NO: 1673866 - protein, 23 aa, Staphylococcus aureus
VSDFKFGEALLIKNTYFPEYDIE

SEQ ID NO: 1673867 - protein, 30 aa, Staphylococcus aureus
VSDTAVMIAWLVKIPHSIMPVLGTSQLKRI

SEQ ID NO: 1673868 - protein, 28 aa, Staphylococcus aureus
VSEEFKKRWPINIGFIGNVRFNEINQKL

SEQ ID NO: 1673869 - protein, 21 aa, Staphylococcus aureus
VSEIKLIKSVLLKAKTSFNNS

SEQ ID NO: 1673870 - protein, 19 aa, Staphylococcus aureus
VSEVAVLNANYIKARLSEH

SEQ ID NO: 1673871 - protein, 17 aa, Staphylococcus aureus
VSFSIKKGQTFGLVGES

SEQ ID NO: 1673872 - protein, 26 aa, Staphylococcus aureus
VSGGAKFAGAALRFLTGPIGATITAI

SEQ ID NO: 1673873 - protein, 27 aa, Staphylococcus aureus
VSGHAIDACGINGLYIKNCSFEGFIDY

SEQ ID NO: 1673874 - protein, 28 aa, Staphylococcus aureus
VSGHAIDACGINGLYIKNCSFKGFVDYS

SEQ ID NO: 1673875 - protein, 25 aa, Staphylococcus aureus
VSGQSGLKYSIDYIVSETKSQPEKL

SEQ ID NO: 1673876 - protein, 19 aa, Staphylococcus aureus
VSGSLSIAASQSVSTSTSD

SEQ ID NO: 1673877 - protein, 22 aa, Staphylococcus aureus
VSIESLIEFCRLAQFPKNENIQ

SEQ ID NO: 1673878 - protein, 18 aa, Staphylococcus aureus
VSINGFWKHKKERKDRVR

SEQ ID NO: 1673879 - protein, 17 aa, Staphylococcus aureus
VSINWNVPSYDVEYKMS

SEQ ID NO: 1673880 - protein, 18 aa, Staphylococcus aureus
VSIPLATLNSAFEIVSGK

SEQ ID NO: 1673881 - protein, 20 aa, Staphylococcus aureus
VSIPYAMHVAPLCIKYRFFI

SEQ ID NO: 1673882 - protein, 22 aa, Staphylococcus aureus
VSIRIPEELLQFEGQTKSKLGT

SEQ ID NO: 1673883 - protein, 22 aa, Staphylococcus aureus
VSKEVKYQKTIELLKHQSELSS

SEQ ID NO: 1673884 - protein, 19 aa, Staphylococcus aureus
VSKKDYKAIAKELSISEDY

SEQ ID NO: 1673885 - protein, 17 aa, Staphylococcus aureus
VSKKRIFIFNKLNDDRI

SEQ ID NO: 1673886 - protein, 17 aa, Staphylococcus aureus
VSKSWLYKQKDIRTRVE

SEQ ID NO: 1673887 - protein, 23 aa, Staphylococcus aureus
VSKVYPNCHVGLKNINLNIEKGE

SEQ ID NO: 1673888 - protein, 22 aa, Staphylococcus aureus
VSLNAGATFGRFHHLIDTETLA

SEQ ID NO: 1673889 - protein, 29 aa, Staphylococcus aureus
VSNIVYIRWFEDLRTAFINQHMNYSTMIN

SEQ ID NO: 1673890 - protein, 17 aa, Staphylococcus aureus
VSNNIVFIHEGMIGEQG

SEQ ID NO: 1673891 - protein, 19 aa, Staphylococcus aureus
VSQAIKFGADIVTILGVSE

SEQ ID NO: 1673892 - protein, 19 aa, Staphylococcus aureus
VSQIREIRLYPKGDDYVAK

SEQ ID NO: 1673893 - protein, 21 aa, Staphylococcus aureus
VSRIYLNFSDPWPKNRHAKRR

SEQ ID NO: 1673894 - protein, 22 aa, Staphylococcus aureus
VSRLIGAPLGYIGHDEGGQLTE

SEQ ID NO: 1673895 - protein, 20 aa, Staphylococcus aureus
VSRRDLAEIVAMQRIGATTV

SEQ ID NO: 1673896 - protein, 21 aa, Staphylococcus aureus
VSRRDLAEIVAMQRIGATTVA

SEQ ID NO: 1673897 - protein, 18 aa, Staphylococcus aureus
VSSFCMDNNIPLTVFSIM

SEQ ID NO: 1673898 - protein, 18 aa, Staphylococcus aureus
VSSTARASFYIYNTKEDI

SEQ ID NO: 1673899 - protein, 19 aa, Staphylococcus aureus
VSTLSKRPFNVVMTPSDKK

SEQ ID NO: 1673900 - protein, 24 aa, Staphylococcus aureus
VSVAGLSLIRHWVEDPNRIDKVDL

SEQ ID NO: 1673901 - protein, 25 aa, Staphylococcus aureus
VSYVPKIELHMYGFGFGSKKLNDMD

SEQ ID NO: 1673902 - protein, 17 aa, Staphylococcus aureus
VTAELEINLFIDPKTVQ

SEQ ID NO: 1673903 - protein, 18 aa, Staphylococcus aureus
VTAIGKAVHSSVPFIGDN

SEQ ID NO: 1673904 - protein, 24 aa, Staphylococcus aureus
VTDFQLFTLYGLRINVESDLLSEA

SEQ ID NO: 1673905 - protein, 20 aa, Staphylococcus aureus
VTEIPHAWMMIEVDATNLVK

SEQ ID NO: 1673906 - protein, 24 aa, Staphylococcus aureus
VTEKGCSYREQLEKILYKYSFSTK

SEQ ID NO: 1673907 - protein, 17 aa, Staphylococcus aureus
VTFQLPSIFAIMEDVLK

SEQ ID NO: 1673908 - protein, 27 aa, Staphylococcus aureus
VTGAGCLLGGIIAGFLFRETEPDIEAL

SEQ ID NO: 1673909 - protein, 24 aa, Staphylococcus aureus
VTHNFKIYPYCIAGNDWVYDCQNL

SEQ ID NO: 1673910 - protein, 23 aa, Staphylococcus aureus
VTIKPLRDKYRVGTSSTAANPVR

SEQ ID NO: 1673911 - protein, 26 aa, Staphylococcus aureus
VTIPPWNFPFAIMAGTTLAPVVAGNI

SEQ ID NO: 1673912 - protein, 26 aa, Staphylococcus aureus
VTLPEYPEFAWFEGMINSIVHRRYDN

SEQ ID NO: 1673913 - protein, 24 aa, Staphylococcus aureus
VTLPEYPEFAWFEGVINSIVHRRY

SEQ ID NO: 1673914 - protein, 26 aa, Staphylococcus aureus
VTLSHGIPGLILFLDAYQKAYNTNTE

SEQ ID NO: 1673915 - protein, 17 aa, Staphylococcus aureus
VTNPKILLCDEATSALD

SEQ ID NO: 1673916 - protein, 22 aa, Staphylococcus aureus
VTPIHQVIQIPIQRVTQDQTTT

SEQ ID NO: 1673917 - protein, 23 aa, Staphylococcus aureus
VTPKVMKKQAAKDEIDQLQAAQT

SEQ ID NO: 1673918 - protein, 18 aa, Staphylococcus aureus
VTPSEITAALNKVTQATL

SEQ ID NO: 1673919 - protein, 22 aa, Staphylococcus aureus
VTRTKHKLVLVVNRNKELYIDL

SEQ ID NO: 1673920 - protein, 20 aa, Staphylococcus aureus
VTSFGFKHGIQMDADLVFDV

SEQ ID NO: 1673921 - protein, 17 aa, Staphylococcus aureus
VTSKLCNHYDIPTPLKS

SEQ ID NO: 1673922 - protein, 18 aa, Staphylococcus aureus
VTTYNGLKQVNYWYVDKS

SEQ ID NO: 1673923 - protein, 24 aa, Staphylococcus aureus
VTVFSFLEAAGFYDAHLKDCPSKP

SEQ ID NO: 1673924 - protein, 17 aa, Staphylococcus aureus
VTWDYISQTTFMYGSKV

SEQ ID NO: 1673925 - protein, 35 aa, Staphylococcus aureus
VVAPLEILDPFKGILKFQLPNDVIKRDGSYQAQVS

SEQ ID NO: 1673926 - protein, 35 aa, Staphylococcus aureus
VVAPLEILDSFKGILKFQIPNDVIKRDGSYQAQVS

SEQ ID NO: 1673927 - protein, 27 aa, Staphylococcus aureus
VVEALRTLRLVIDMSKEPDLYLQISAI

SEQ ID NO: 1673928 - protein, 23 aa, Staphylococcus aureus
VVETESDFGLAFDGDGDRIIAVD

SEQ ID NO: 1673929 - protein, 21 aa, Staphylococcus aureus
VVGMLPWRIINHVQADQITKV

SEQ ID NO: 1673930 - protein, 19 aa, Staphylococcus aureus
VVHCPFEEMTEAFKTQEDS

SEQ ID NO: 1673931 - protein, 22 aa, Staphylococcus aureus
VVKEKPTARWLFLTLSTKNAID

SEQ ID NO: 1673932 - protein, 18 aa, Staphylococcus aureus
VVKHHQLKVNAFEEVLTV

SEQ ID NO: 1673933 - protein, 17 aa, Staphylococcus aureus
VVKKLKPTHVLSVSTIK

SEQ ID NO: 1673934 - protein, 18 aa, Staphylococcus aureus
VVKPEAQEAIKASADNQV

SEQ ID NO: 1673935 - protein, 21 aa, Staphylococcus aureus
VVKSYPMIPGIDLAGTIVESE

SEQ ID NO: 1673936 - protein, 18 aa, Staphylococcus aureus
VVLLCGSGIGTSQLLKSK

SEQ ID NO: 1673937 - protein, 17 aa, Staphylococcus aureus
VVLPHGVLFRGAAEGII

SEQ ID NO: 1673938 - protein, 23 aa, Staphylococcus aureus
VVLWQLVAHRLMTWKKEYANNAV

SEQ ID NO: 1673939 - protein, 22 aa, Staphylococcus aureus
VVMKEGHGAYLYDVDGNRFIDY

SEQ ID NO: 1673940 - protein, 21 aa, Staphylococcus aureus
VVNDKAREAITNINATTGATR

SEQ ID NO: 1673941 - protein, 19 aa, Staphylococcus aureus
VVNNKIVFTKDVKDPALKQ

SEQ ID NO: 1673942 - protein, 17 aa, Staphylococcus aureus
VVNSNFKGVTWSQRLWN

SEQ ID NO: 1673943 - protein, 18 aa, Staphylococcus aureus
VVRKSALERYEFTGDITY

SEQ ID NO: 1673944 - protein, 19 aa, Staphylococcus aureus
VVRYLEAHEGFKVKYVDVK

SEQ ID NO: 1673945 - protein, 25 aa, Staphylococcus aureus
VVSDDFKNHMLIAVTELRTKGEIDT

SEQ ID NO: 1673946 - protein, 33 aa, Staphylococcus aureus
VVVVAPLEILDPFKGILKFQLPNDVIKRDGSYQ

SEQ ID NO: 1673947 - protein, 19 aa, Staphylococcus aureus
VVWYCPPLSPIMSYFEGKN

SEQ ID NO: 1673948 - protein, 21 aa, Staphylococcus aureus
VWIAMALAQRTDIIFLDEPTT

SEQ ID NO: 1673949 - protein, 22 aa, Staphylococcus aureus
VWIAMALAQRTDIIFLDEPTTY

SEQ ID NO: 1673950 - protein, 22 aa, Staphylococcus aureus
VWLKTELKYFYYLHLNNGAWNA

SEQ ID NO: 1673951 - protein, 18 aa, Staphylococcus aureus
VWMGGTFLSKGNVEEPEH

SEQ ID NO: 1673952 - protein, 24 aa, Staphylococcus aureus
VWRDKVCSMEIWKVMMKRDDQPQQ

SEQ ID NO: 1673953 - protein, 20 aa, Staphylococcus aureus
VYDFKIEEFDQWNIQKVPKK

SEQ ID NO: 1673954 - protein, 26 aa, Staphylococcus aureus
VYDIKTHRGYFRISRESIEDSKVNVL

SEQ ID NO: 1673955 - protein, 17 aa, Staphylococcus aureus
VYEDLLLLRSLSDLNEH

SEQ ID NO: 1673956 - protein, 18 aa, Staphylococcus aureus
VYGDGIIRMYELNTHTGE

SEQ ID NO: 1673957 - protein, 17 aa, Staphylococcus aureus
VYGHAKSLLFSQLGEDL

SEQ ID NO: 1673958 - protein, 18 aa, Staphylococcus aureus
VYHELSTDYLDVRDVDAP

SEQ ID NO: 1673959 - protein, 22 aa, Staphylococcus aureus
VYIEKKLACQWSPRQIAERIEQ

SEQ ID NO: 1673960 - protein, 17 aa, Staphylococcus aureus
VYIKEPITDLSLENIQE

SEQ ID NO: 1673961 - protein, 31 aa, Staphylococcus aureus
VYIKRLKKAPHWKTVFNIPRNGENLGLPEKN

SEQ ID NO: 1673962 - protein, 19 aa, Staphylococcus aureus
VYKKAFESYQRYFNQKGSN

SEQ ID NO: 1673963 - protein, 19 aa, Staphylococcus aureus
VYLELWVKVQRDWRNKVNF

SEQ ID NO: 1673964 - protein, 18 aa, Staphylococcus aureus
VYPLANYYFENRIAYQDR

SEQ ID NO: 1673965 - protein, 21 aa, Staphylococcus aureus
VYSVRTPKYINMKDIERNDKG

SEQ ID NO: 1673966 - protein, 25 aa, Staphylococcus aureus
WAETKKLTGWYARRIAVGRDGEIQG

SEQ ID NO: 1673967 - protein, 17 aa, Staphylococcus aureus
WAGFKAVINYAKKHYKL

SEQ ID NO: 1673968 - protein, 17 aa, Staphylococcus aureus
WASSETIGILRKEVIDF

SEQ ID NO: 1673969 - protein, 17 aa, Staphylococcus aureus
WASSETIGILRKEVISF

SEQ ID NO: 1673970 - protein, 19 aa, Staphylococcus aureus
WASVCKPPINQSEVNNTFK

SEQ ID NO: 1673971 - protein, 19 aa, Staphylococcus aureus
WCKNKFQVTNQVSVEDTYK

SEQ ID NO: 1673972 - protein, 20 aa, Staphylococcus aureus
WCRSTTVPHVGNWRDKFFKE

SEQ ID NO: 1673973 - protein, 17 aa, Staphylococcus aureus
WCSNFSMLGPRQLLLNT

SEQ ID NO: 1673974 - protein, 17 aa, Staphylococcus aureus
WCTADNLLKGAALNAVQ

SEQ ID NO: 1673975 - protein, 21 aa, Staphylococcus aureus
WDIDKEVLTIITMYPHYDGVI

SEQ ID NO: 1673976 - protein, 22 aa, Staphylococcus aureus
WDMLFIVFSIHLIDILKKLSHD

SEQ ID NO: 1673977 - protein, 27 aa, Staphylococcus aureus
WDSPCNIYKPHSGFTLETQFLPNDINL

SEQ ID NO: 1673978 - protein, 21 aa, Staphylococcus aureus
WEESGRWGAYGTELMRLQDRH

SEQ ID NO: 1673979 - protein, 28 aa, Staphylococcus aureus
WEHNPRAQAFYKRHGFKEVGEHHFQTGD

SEQ ID NO: 1673980 - protein, 18 aa, Staphylococcus aureus
WEIMGLNIMQPFKVYPNG

SEQ ID NO: 1673981 - protein, 18 aa, Staphylococcus aureus
WEKVYTMAYIDDGGGEVF

SEQ ID NO: 1673982 - protein, 20 aa, Staphylococcus aureus
WEMINYALNHGIDRYNFYGV

SEQ ID NO: 1673983 - protein, 26 aa, Staphylococcus aureus
WEPKIKKMVPSFGYRLTDHEDLYHKI

SEQ ID NO: 1673984 - protein, 17 aa, Staphylococcus aureus
WEPTILSKSIKDLKVAV

SEQ ID NO: 1673985 - protein, 28 aa, Staphylococcus aureus
WFSNAYKSAKGWPDMANKSRAKWDNISS

SEQ ID NO: 1673986 - protein, 24 aa, Staphylococcus aureus
WFSSAYKSAKGWLTDMTNKSRSKW

SEQ ID NO: 1673987 - protein, 25 aa, Staphylococcus aureus
WGSYTGHLFKRFLERSYKDKFILNI

SEQ ID NO: 1673988 - protein, 25 aa, Staphylococcus aureus
WGVKEYKVGDPILFNETNKYSPILF

SEQ ID NO: 1673989 - protein, 35 aa, Staphylococcus aureus
WHGLPLTEAFLFSRGHFKGNQFPEGVNALSPQIII

SEQ ID NO: 1673990 - protein, 20 aa, Staphylococcus aureus
WIGSIPSNWSVRKIKHDFNL

SEQ ID NO: 1673991 - protein, 34 aa, Staphylococcus aureus
WIHERTKFGIKPGVKRMEWMLAKFNNPQNNIKGI

SEQ ID NO: 1673992 - protein, 19 aa, Staphylococcus aureus
WILALSPQGGYTYTFGTSL

SEQ ID NO: 1673993 - protein, 19 aa, Staphylococcus aureus
WIREKEILEIQDIVPSYRA

SEQ ID NO: 1673994 - protein, 17 aa, Staphylococcus aureus
WKGKEFEPSDIVDAYLV

SEQ ID NO: 1673995 - protein, 17 aa, Staphylococcus aureus
WKGNPKMDEYLRPKTLF

SEQ ID NO: 1673996 - protein, 26 aa, Staphylococcus aureus
WKIAPALATGCSIVMKPSEITPLTTI

SEQ ID NO: 1673997 - protein, 17 aa, Staphylococcus aureus
WKIKVYAASGAINIETL

SEQ ID NO: 1673998 - protein, 19 aa, Staphylococcus aureus
WKKARGFTSAGAFLNEGTA

SEQ ID NO: 1673999 - protein, 20 aa, Staphylococcus aureus
WKLYHHYVWEKYYGEIPPKH

SEQ ID NO: 1674000 - protein, 24 aa, Staphylococcus aureus
WKNPEKYKAYFIGDWYVSGDSAYK

SEQ ID NO: 1674001 - protein, 19 aa, Staphylococcus aureus
WKSNFSMLGPLTLIEKSLL

SEQ ID NO: 1674002 - protein, 20 aa, Staphylococcus aureus
WKVSRTTIYRYLNKLNNQEN

SEQ ID NO: 1674003 - protein, 22 aa, Staphylococcus aureus
WLANHLVPRIDFKIHEISKNAC

SEQ ID NO: 1674004 - protein, 18 aa, Staphylococcus aureus
WLEFYSIAIHSDVTSNKK

SEQ ID NO: 1674005 - protein, 17 aa, Staphylococcus aureus
WLGYCTNELVQINPQDK

SEQ ID NO: 1674006 - protein, 18 aa, Staphylococcus aureus
WLKDVLRQIEIAIVTGKV

SEQ ID NO: 1674007 - protein, 28 aa, Staphylococcus aureus
WLKEMAHTFPGRIYFSVDAYGEDIKVNG

SEQ ID NO: 1674008 - protein, 17 aa, Staphylococcus aureus
WLKEQGIQVELLNLGGG

SEQ ID NO: 1674009 - protein, 21 aa, Staphylococcus aureus
WLKSDVFKAAHKHVRSKNEDE

SEQ ID NO: 1674010 - protein, 20 aa, Staphylococcus aureus
WLLKEIPEKYGIPKQDTGVD

SEQ ID NO: 1674011 - protein, 17 aa, Staphylococcus aureus
WLTVVLDDFSRAIAGYR

SEQ ID NO: 1674012 - protein, 20 aa, Staphylococcus aureus
WMHGTCWIEESVVRIIFSEV

SEQ ID NO: 1674013 - protein, 17 aa, Staphylococcus aureus
WMMGAVARIYQPGIKYD

SEQ ID NO: 1674014 - protein, 22 aa, Staphylococcus aureus
WMRQPHYYMRLYSYTYSAGLTI

SEQ ID NO: 1674015 - protein, 36 aa, Staphylococcus aureus
WMSVVLRPNVAFSMISKFNLFIALGIRDAIQHSSQD

SEQ ID NO: 1674016 - protein, 19 aa, Staphylococcus aureus
WNDCFSDLHILQPDWKTIQ

SEQ ID NO: 1674017 - protein, 21 aa, Staphylococcus aureus
WNHKYKTVGMMLFDEQRQFLQ

SEQ ID NO: 1674018 - protein, 17 aa, Staphylococcus aureus
WNIANLANVLGINLDAI

SEQ ID NO: 1674019 - protein, 18 aa, Staphylococcus aureus
WNIYPPKANEEFISLDAD

SEQ ID NO: 1674020 - protein, 18 aa, Staphylococcus aureus
WNKSYKEQGLKGLIYATK

SEQ ID NO: 1674021 - protein, 22 aa, Staphylococcus aureus
WNKVNPSFALKSMFDGYDELME

SEQ ID NO: 1674022 - protein, 24 aa, Staphylococcus aureus
WNRSHHQLIFFGRYHCLARKPKCG

SEQ ID NO: 1674023 - protein, 20 aa, Staphylococcus aureus
WPDLIFPESEIAFIVLHFGG

SEQ ID NO: 1674024 - protein, 26 aa, Staphylococcus aureus
WPRLKEIKAPTLILAGEYDEKFVQIA

SEQ ID NO: 1674025 - protein, 18 aa, Staphylococcus aureus
WQEIESFDDDNIKGLLGV

SEQ ID NO: 1674026 - protein, 17 aa, Staphylococcus aureus
WQFKLNYRTTEIPYANT

SEQ ID NO: 1674027 - protein, 22 aa, Staphylococcus aureus
WQFRKLFKSYTWQSDVRELKVC

SEQ ID NO: 1674028 - protein, 17 aa, Staphylococcus aureus
WQHKVPFGVWWETLQQE

SEQ ID NO: 1674029 - protein, 17 aa, Staphylococcus aureus
WQQKMLRDNPELSIDNM

SEQ ID NO: 1674030 - protein, 19 aa, Staphylococcus aureus
WQYHDHWLGYCTNELVQIN

SEQ ID NO: 1674031 - protein, 17 aa, Staphylococcus aureus
WRDWLIGGQDRYLDQRQ

SEQ ID NO: 1674032 - protein, 17 aa, Staphylococcus aureus
WRFENHFKTDDMKEQLI

SEQ ID NO: 1674033 - protein, 19 aa, Staphylococcus aureus
WRGKRSTDDIFTRLKDGHL

SEQ ID NO: 1674034 - protein, 22 aa, Staphylococcus aureus
WRGPNIKADFLSAYNNVQVGVG

SEQ ID NO: 1674035 - protein, 24 aa, Staphylococcus aureus
WRSQFNPRGGWSPSGPRRYANGGL

SEQ ID NO: 1674036 - protein, 22 aa, Staphylococcus aureus
WSAHVPRRIKEIGPRIKKVSDE

SEQ ID NO: 1674037 - protein, 17 aa, Staphylococcus aureus
WSSIAFIVPSNKVAFIP

SEQ ID NO: 1674038 - protein, 20 aa, Staphylococcus aureus
WSTDRIGDTGIIGFITNNGY

SEQ ID NO: 1674039 - protein, 20 aa, Staphylococcus aureus
WSTGNLPYLIELEAIEVSIN

SEQ ID NO: 1674040 - protein, 25 aa, Staphylococcus aureus
WSYLKEFDTLYAYDLFLLTHIFIIF

SEQ ID NO: 1674041 - protein, 18 aa, Staphylococcus aureus
WTQVKMKAVLHNEAVKNV

SEQ ID NO: 1674042 - protein, 23 aa, Staphylococcus aureus
WTRQKAFEEYEWLKNTAKNDIEV

SEQ ID NO: 1674043 - protein, 24 aa, Staphylococcus aureus
WTVPNEHKSTVLFDGGANGVGTTI

SEQ ID NO: 1674044 - protein, 19 aa, Staphylococcus aureus
WVDPRTKIIYMTQARPGNH

SEQ ID NO: 1674045 - protein, 22 aa, Staphylococcus aureus
WVEKVGDLYVFSMTPELQDDIG

SEQ ID NO: 1674046 - protein, 17 aa, Staphylococcus aureus
WVGDAIFVAHNASFDMG

SEQ ID NO: 1674047 - protein, 23 aa, Staphylococcus aureus
WVNQYKFPVAVIEEVLKAKEAYG

SEQ ID NO: 1674048 - protein, 19 aa, Staphylococcus aureus
WVQEYAPIVYQIWKKKHKK

SEQ ID NO: 1674049 - protein, 29 aa, Staphylococcus aureus
WVVAAFPSKAWAKRVYPELPIEEAYAKFI

SEQ ID NO: 1674050 - protein, 18 aa, Staphylococcus aureus
WVYDCQNLTLTEQKSKSD

SEQ ID NO: 1674051 - protein, 24 aa, Staphylococcus aureus
WWNHRNTRCSCCGSSSAQRTKKFL

SEQ ID NO: 1674052 - protein, 18 aa, Staphylococcus aureus
WYADMGVIDKEEYALITG

SEQ ID NO: 1674053 - protein, 17 aa, Staphylococcus aureus
WYLGSKLYEEVEKKIAR

SEQ ID NO: 1674054 - protein, 24 aa, Staphylococcus aureus
WYNLGEDGHPEWIIPTDPARRNDA

SEQ ID NO: 1674055 - protein, 21 aa, Staphylococcus aureus
YADIKYQLGLIGKNENEKLLK

SEQ ID NO: 1674056 - protein, 20 aa, Staphylococcus aureus
YAECVKLHIDDRMLTITDIM

SEQ ID NO: 1674057 - protein, 22 aa, Staphylococcus aureus
YAEIAKELLAFYAKYATTAGLT

SEQ ID NO: 1674058 - protein, 35 aa, Staphylococcus aureus
YAGQTWTRNISDWIAKSGTTNFSLSMTASTGGATN

SEQ ID NO: 1674059 - protein, 17 aa, Staphylococcus aureus
YAIFKTAIVITGEEDVI

SEQ ID NO: 1674060 - protein, 24 aa, Staphylococcus aureus
YAIKKEIIEELGFDFSISHNPYTE

SEQ ID NO: 1674061 - protein, 19 aa, Staphylococcus aureus
YAKELNLKSKEIINELKSM

SEQ ID NO: 1674062 - protein, 17 aa, Staphylococcus aureus
YAKKAYYTVYFKNGGKR

SEQ ID NO: 1674063 - protein, 18 aa, Staphylococcus aureus
YALENKIGYFVIDSLEEI

SEQ ID NO: 1674064 - protein, 26 aa, Staphylococcus aureus
YAMGVAVDMMVEYEIPLSIENLKVDD

SEQ ID NO: 1674065 - protein, 23 aa, Staphylococcus aureus
YASRNDVAFVYPKGQSEPIVLVI

SEQ ID NO: 1674066 - protein, 18 aa, Staphylococcus aureus
YATEFDFPKVLRKEEIVG

SEQ ID NO: 1674067 - protein, 19 aa, Staphylococcus aureus
YAVELNERGEIVIDRNNNT

SEQ ID NO: 1674068 - protein, 17 aa, Staphylococcus aureus
YCSDMTRTIKFGKPSKE

SEQ ID NO: 1674069 - protein, 20 aa, Staphylococcus aureus
YDCNVYRVYFNDVQLPLLAD

SEQ ID NO: 1674070 - protein, 18 aa, Staphylococcus aureus
YDDYFLKNDEWHISAFNK

SEQ ID NO: 1674071 - protein, 23 aa, Staphylococcus aureus
YDEAFHYAKLNIKKYPNCHQLIW

SEQ ID NO: 1674072 - protein, 25 aa, Staphylococcus aureus
YDECIKNMLLYSFIGLINKYSTELN

SEQ ID NO: 1674073 - protein, 32 aa, Staphylococcus aureus
YDEFEGGHQWKDWKPLLSDILLYFFSNQSPDQ

SEQ ID NO: 1674074 - protein, 19 aa, Staphylococcus aureus
YDELIGYSLDPVWNMSDLK

SEQ ID NO: 1674075 - protein, 19 aa, Staphylococcus aureus
YDELIGYTLDPVWNMSDLK

SEQ ID NO: 1674076 - protein, 23 aa, Staphylococcus aureus
YDELSKVAGYYIKSGVNADNVKI

SEQ ID NO: 1674077 - protein, 17 aa, Staphylococcus aureus
YDEPVMKGYVRYSIATT

SEQ ID NO: 1674078 - protein, 18 aa, Staphylococcus aureus
YDEQVMKGYVRYSIATAS

SEQ ID NO: 1674079 - protein, 18 aa, Staphylococcus aureus
YDFDILVVALGFVSETFR

SEQ ID NO: 1674080 - protein, 22 aa, Staphylococcus aureus
YDGYAECVKLHFDDSKLSITDI

SEQ ID NO: 1674081 - protein, 26 aa, Staphylococcus aureus
YDIEKEWKNAINFGKEVKNIKIEVKY

SEQ ID NO: 1674082 - protein, 21 aa, Staphylococcus aureus
YDIKVSTLITRYDRGSRGKDL

SEQ ID NO: 1674083 - protein, 18 aa, Staphylococcus aureus
YDKEGFRDQEFEKGDKGN

SEQ ID NO: 1674084 - protein, 17 aa, Staphylococcus aureus
YDKEGYCDDQFDKNDKG

SEQ ID NO: 1674085 - protein, 22 aa, Staphylococcus aureus
YDKEGYRDGEFEKGDKGMWVLY

SEQ ID NO: 1674086 - protein, 21 aa, Staphylococcus aureus
YDKEGYRDGEFEKGDKGTWTI

SEQ ID NO: 1674087 - protein, 23 aa, Staphylococcus aureus
YDKNKFKVIGPFVADKYVLSVDT

SEQ ID NO: 1674088 - protein, 17 aa, Staphylococcus aureus
YDLFTFFKHPSIKSMTI

SEQ ID NO: 1674089 - protein, 17 aa, Staphylococcus aureus
YDLMLVHTNRHYGKTLV

SEQ ID NO: 1674090 - protein, 17 aa, Staphylococcus aureus
YDLMRKWLHKMRNTHKR

SEQ ID NO: 1674091 - protein, 19 aa, Staphylococcus aureus
YDLYETKYWSVFDEIQGFS

SEQ ID NO: 1674092 - protein, 18 aa, Staphylococcus aureus
YDMKLSNLYIYKLAVIAN

SEQ ID NO: 1674093 - protein, 21 aa, Staphylococcus aureus
YDMSRSLKWRAQRRKERQENS

SEQ ID NO: 1674094 - protein, 25 aa, Staphylococcus aureus
YDNDPLREGIKYAKQAGWDTVSKAI

SEQ ID NO: 1674095 - protein, 24 aa, Staphylococcus aureus
YDNKEGRRVFVTEVVADSVQFLEP

SEQ ID NO: 1674096 - protein, 19 aa, Staphylococcus aureus
YDQKRQRLIGTIEVPMTLA

SEQ ID NO: 1674097 - protein, 22 aa, Staphylococcus aureus
YDSRSILLAALIVLSKEINANT

SEQ ID NO: 1674098 - protein, 19 aa, Staphylococcus aureus
YDSSVFFDKRAQLIECLEK

SEQ ID NO: 1674099 - protein, 19 aa, Staphylococcus aureus
YDSTKQFYVVSGSKHDALM

SEQ ID NO: 1674100 - protein, 23 aa, Staphylococcus aureus
YDTKIAITHQITWDFVKAPHGLV

SEQ ID NO: 1674101 - protein, 19 aa, Staphylococcus aureus
YDYGYPIGCSYKPSERGYY

SEQ ID NO: 1674102 - protein, 19 aa, Staphylococcus aureus
YEAQVKRGAVIKVGQLFEN

SEQ ID NO: 1674103 - protein, 29 aa, Staphylococcus aureus
YEASLSRLGLKYLDLYLVHWPGTNEAVMV

SEQ ID NO: 1674104 - protein, 21 aa, Staphylococcus aureus
YEAWEVESRIPGKGGDATKFK

SEQ ID NO: 1674105 - protein, 21 aa, Staphylococcus aureus
YECEDCTGCPLREKCTKAKEG

SEQ ID NO: 1674106 - protein, 18 aa, Staphylococcus aureus
YEDYFSKYIHMIRKTVYS

SEQ ID NO: 1674107 - protein, 21 aa, Staphylococcus aureus
YEEVKSIKSVILKARKSFNNK

SEQ ID NO: 1674108 - protein, 17 aa, Staphylococcus aureus
YEGDVIMAAGTFIQGSS

SEQ ID NO: 1674109 - protein, 17 aa, Staphylococcus aureus
YEGIEFDYLELLNYFSD

SEQ ID NO: 1674110 - protein, 22 aa, Staphylococcus aureus
YEGKPMLSYVYDYPHKKLYKAI

SEQ ID NO: 1674111 - protein, 17 aa, Staphylococcus aureus
YEHAELGVRFTLSGLDR

SEQ ID NO: 1674112 - protein, 25 aa, Staphylococcus aureus
YEHFRTVIQLLPKVIEQLRENGKQI

SEQ ID NO: 1674113 - protein, 34 aa, Staphylococcus aureus
YEHNYPHCWRCGNPLIYYAMEGWFIKTTNFKNEI

SEQ ID NO: 1674114 - protein, 20 aa, Staphylococcus aureus
YEIADKVGFSEYKMFSYHFK

SEQ ID NO: 1674115 - protein, 19 aa, Staphylococcus aureus
YEISKRTVLFLIQKDITVY

SEQ ID NO: 1674116 - protein, 17 aa, Staphylococcus aureus
YEITKPYIAEGRRYTGS

SEQ ID NO: 1674117 - protein, 17 aa, Staphylococcus aureus
YEKHEYILLSRFKNNGF

SEQ ID NO: 1674118 - protein, 18 aa, Staphylococcus aureus
YEKIAIATLGVRNGATFI

SEQ ID NO: 1674119 - protein, 17 aa, Staphylococcus aureus
YELKLNFSSVGPKLGNK

SEQ ID NO: 1674120 - protein, 17 aa, Staphylococcus aureus
YELMKAMLNSPMYTPSY

SEQ ID NO: 1674121 - protein, 20 aa, Staphylococcus aureus
YEPEFFRYGGKNTIDEIESF

SEQ ID NO: 1674122 - protein, 20 aa, Staphylococcus aureus
YEPGEGLAYEKTALDFNSTG

SEQ ID NO: 1674123 - protein, 32 aa, Staphylococcus aureus
YEPPIVACGTWRLVYQRLKALEVLTHEHVHLE

SEQ ID NO: 1674124 - protein, 24 aa, Staphylococcus aureus
YEQFKDAYAKFYGLSSEQIIAGNG

SEQ ID NO: 1674125 - protein, 17 aa, Staphylococcus aureus
YEQSVKCCFDYLNNIIM

SEQ ID NO: 1674126 - protein, 24 aa, Staphylococcus aureus
YERYLKELSHDISFMKSSILQQKA

SEQ ID NO: 1674127 - protein, 22 aa, Staphylococcus aureus
YESCQSMQAIGYKELIPVINGQ

SEQ ID NO: 1674128 - protein, 22 aa, Staphylococcus aureus
YESDRGTGVLNFAVTKNNKPLS

SEQ ID NO: 1674129 - protein, 21 aa, Staphylococcus aureus
YESKLNYQSRFGVKDDEVNTF

SEQ ID NO: 1674130 - protein, 19 aa, Staphylococcus aureus
YESRMNLLNNLKRKYGKDI

SEQ ID NO: 1674131 - protein, 24 aa, Staphylococcus aureus
YEVEYKYNIIWVWHYSDDYLGKIA

SEQ ID NO: 1674132 - protein, 18 aa, Staphylococcus aureus
YFAARSLLSETICNLDNN

SEQ ID NO: 1674133 - protein, 24 aa, Staphylococcus aureus
YFAVYKWDIHGDLKFNKPHAYCLV

SEQ ID NO: 1674134 - protein, 20 aa, Staphylococcus aureus
YFDHQILRRLVAFMYEIPST

SEQ ID NO: 1674135 - protein, 21 aa, Staphylococcus aureus
YFDHQILRRLVAFMYEIPSTI

SEQ ID NO: 1674136 - protein, 18 aa, Staphylococcus aureus
YFDLNCYLTLLDVLDSHN

SEQ ID NO: 1674137 - protein, 26 aa, Staphylococcus aureus
YFEQTEVRLALSFLRAIDNPLQDIYL

SEQ ID NO: 1674138 - protein, 25 aa, Staphylococcus aureus
YFGGIKLGGGGLIRAYSSAVRDVIY

SEQ ID NO: 1674139 - protein, 18 aa, Staphylococcus aureus
YFHGHIVPGWQGVKKTFD

SEQ ID NO: 1674140 - protein, 19 aa, Staphylococcus aureus
YFIEYRKGDEIKYFPIELA

SEQ ID NO: 1674141 - protein, 24 aa, Staphylococcus aureus
YFILLKHEFGIRWLRGRDFNDQDR

SEQ ID NO: 1674142 - protein, 25 aa, Staphylococcus aureus
YFILLKHEFGIRWLRGRDFNDQDRN

SEQ ID NO: 1674143 - protein, 18 aa, Staphylococcus aureus
YFIRLNFPNNLSVGNKAK

SEQ ID NO: 1674144 - protein, 18 aa, Staphylococcus aureus
YFKHLGRLSAKEVSFSDT

SEQ ID NO: 1674145 - protein, 19 aa, Staphylococcus aureus
YFLCHDILEDAWKAEKNYS

SEQ ID NO: 1674146 - protein, 19 aa, Staphylococcus aureus
YFLCHDILEDAWKSENNYS

SEQ ID NO: 1674147 - protein, 21 aa, Staphylococcus aureus
YFLERTYRKPSDFYNMTSLVQ

SEQ ID NO: 1674148 - protein, 26 aa, Staphylococcus aureus
YFNKLSVFRKLFGNLIYSNTLYDNNN

SEQ ID NO: 1674149 - protein, 24 aa, Staphylococcus aureus
YFNKLSVFRKLFGNLTYSNTLYEK

SEQ ID NO: 1674150 - protein, 17 aa, Staphylococcus aureus
YFTAGVQEVHAWTFKQG

SEQ ID NO: 1674151 - protein, 19 aa, Staphylococcus aureus
YFVCYTAIELGCRVGEALA

SEQ ID NO: 1674152 - protein, 19 aa, Staphylococcus aureus
YFVEHPIIFIGYSLNDSNI

SEQ ID NO: 1674153 - protein, 19 aa, Staphylococcus aureus
YGADSLRWALISDSAPWNN

SEQ ID NO: 1674154 - protein, 17 aa, Staphylococcus aureus
YGAGYGHVAWVIEATLD

SEQ ID NO: 1674155 - protein, 17 aa, Staphylococcus aureus
YGCLDPIVFLDGIEANE

SEQ ID NO: 1674156 - protein, 18 aa, Staphylococcus aureus
YGDFRFILEGEKLSDSSG

SEQ ID NO: 1674157 - protein, 26 aa, Staphylococcus aureus
YGEKGGTPWLDQKHTVFGQIIDGETT

SEQ ID NO: 1674158 - protein, 25 aa, Staphylococcus aureus
YGEYFPHRLGHGLGLQEHEYQDVSS

SEQ ID NO: 1674159 - protein, 17 aa, Staphylococcus aureus
YGGQCWDVPNYILERYW

SEQ ID NO: 1674160 - protein, 20 aa, Staphylococcus aureus
YGHEVLKMYADNKTIISDKL

SEQ ID NO: 1674161 - protein, 17 aa, Staphylococcus aureus
YGIDEEAQFMAKNIQES

SEQ ID NO: 1674162 - protein, 26 aa, Staphylococcus aureus
YGIPHGRANAILLPHIIRYNAKDPQK

SEQ ID NO: 1674163 - protein, 29 aa, Staphylococcus aureus
YGKEIFRLGFGEAVARGYLTDYKVMVLTV

SEQ ID NO: 1674164 - protein, 27 aa, Staphylococcus aureus
YGKFKGDLAEIVKAFLVEFQEKYESFY

SEQ ID NO: 1674165 - protein, 26 aa, Staphylococcus aureus
YGKFKGDLAEIVKVFLVEFQEKYESF

SEQ ID NO: 1674166 - protein, 17 aa, Staphylococcus aureus
YGKHVAVDNISFNINEG

SEQ ID NO: 1674167 - protein, 23 aa, Staphylococcus aureus
YGKLSNGKLAWIKSTDLAKELIK

SEQ ID NO: 1674168 - protein, 18 aa, Staphylococcus aureus
YGNYLGEVNLTFEAHQVV

SEQ ID NO: 1674169 - protein, 17 aa, Staphylococcus aureus
YGQIYQWVHKYQAHGKN

SEQ ID NO: 1674170 - protein, 17 aa, Staphylococcus aureus
YGQKIGYLPSVDIKAHP

SEQ ID NO: 1674171 - protein, 18 aa, Staphylococcus aureus
YGRFYLRELATPDNTIKF

SEQ ID NO: 1674172 - protein, 23 aa, Staphylococcus aureus
YGSLIEGFLHWIKDEKIDWPSEE

SEQ ID NO: 1674173 - protein, 18 aa, Staphylococcus aureus
YGSPKIKNITLKFNGDPN

SEQ ID NO: 1674174 - protein, 18 aa, Staphylococcus aureus
YGSWQEYWAFESRFITLN

SEQ ID NO: 1674175 - protein, 23 aa, Staphylococcus aureus
YGTEIKPEFRNMLLNLKELDTLV

SEQ ID NO: 1674176 - protein, 18 aa, Staphylococcus aureus
YGTQRAFIRIDLDREETR

SEQ ID NO: 1674177 - protein, 17 aa, Staphylococcus aureus
YGVDFGTGYALEFTGET

SEQ ID NO: 1674178 - protein, 24 aa, Staphylococcus aureus
YHDIKSPMVGTFFLQDSKELNEPI

SEQ ID NO: 1674179 - protein, 24 aa, Staphylococcus aureus
YHDIKSPMVGTFFLQDSKELTEPI

SEQ ID NO: 1674180 - protein, 17 aa, Staphylococcus aureus
YHEGKEGEAEFFKKVFV

SEQ ID NO: 1674181 - protein, 18 aa, Staphylococcus aureus
YHFKSVCVNPTHVKYAAE

SEQ ID NO: 1674182 - protein, 19 aa, Staphylococcus aureus
YHFKSVCVNPTHVKYAAER

SEQ ID NO: 1674183 - protein, 25 aa, Staphylococcus aureus
YHHILRIIQKYELDYIIDDDWNYAA

SEQ ID NO: 1674184 - protein, 17 aa, Staphylococcus aureus
YHITNMGAILFAKDLTK

SEQ ID NO: 1674185 - protein, 19 aa, Staphylococcus aureus
YHKAIKKTVTETIEYEEVE

SEQ ID NO: 1674186 - protein, 28 aa, Staphylococcus aureus
YHKESFKTSEVPSAIFGTMKHKKLENGR

SEQ ID NO: 1674187 - protein, 24 aa, Staphylococcus aureus
YHKILIKNFNLWQAQREDSLLDIE

SEQ ID NO: 1674188 - protein, 25 aa, Staphylococcus aureus
YHLQWEMIKFAKAHHIDRYNFYGIT

SEQ ID NO: 1674189 - protein, 26 aa, Staphylococcus aureus
YHNKDLDFAFGLSMTSKNIARYENIN

SEQ ID NO: 1674190 - protein, 25 aa, Staphylococcus aureus
YHNLKSRFSSYGFDVLEINGHDYKE

SEQ ID NO: 1674191 - protein, 21 aa, Staphylococcus aureus
YHPFHIYSMRQAIEEGFILNV

SEQ ID NO: 1674192 - protein, 21 aa, Staphylococcus aureus
YHPKMMLKIILYAYTQSVFSG

SEQ ID NO: 1674193 - protein, 28 aa, Staphylococcus aureus
YHTLLTIGRFPICYINIEMDPILVDVNV

SEQ ID NO: 1674194 - protein, 19 aa, Staphylococcus aureus
YHYRRNNLKGAYKSFNKSK

SEQ ID NO: 1674195 - protein, 20 aa, Staphylococcus aureus
YIAIRGRIPVQLARKKFPYH

SEQ ID NO: 1674196 - protein, 17 aa, Staphylococcus aureus
YIALEFASMFANLGSKV

SEQ ID NO: 1674197 - protein, 30 aa, Staphylococcus aureus
YIATFIMPKFLKSFFNEHPFIDVSLQVKNE

SEQ ID NO: 1674198 - protein, 31 aa, Staphylococcus aureus
YIATFMMPKFLKSFFNEHPFIDVSLHVKNEN

SEQ ID NO: 1674199 - protein, 17 aa, Staphylococcus aureus
YIDEIRITKNKALVGIY

SEQ ID NO: 1674200 - protein, 17 aa, Staphylococcus aureus
YIDGDIKGSSVGYKKIE

SEQ ID NO: 1674201 - protein, 25 aa, Staphylococcus aureus
YIEDFPRQCVFIGTTNKVDFLRDET

SEQ ID NO: 1674202 - protein, 17 aa, Staphylococcus aureus
YIEQLGFQHVSDFPRAL

SEQ ID NO: 1674203 - protein, 20 aa, Staphylococcus aureus
YIFDYSACKYPIGVVEDEIY

SEQ ID NO: 1674204 - protein, 18 aa, Staphylococcus aureus
YIFESYAKGHGYRKMANA

SEQ ID NO: 1674205 - protein, 25 aa, Staphylococcus aureus
YIFGESYEIFYANALDVQVSITDLM

SEQ ID NO: 1674206 - protein, 17 aa, Staphylococcus aureus
YIHEVEEPDSLIVIYHG

SEQ ID NO: 1674207 - protein, 25 aa, Staphylococcus aureus
YIIYYDGVVIGGLYDNRLLVKATKS

SEQ ID NO: 1674208 - protein, 17 aa, Staphylococcus aureus
YIKGMPFGHEFSGVVDA

SEQ ID NO: 1674209 - protein, 23 aa, Staphylococcus aureus
YILKYVFANGIAREIIYALLEEM

SEQ ID NO: 1674210 - protein, 23 aa, Staphylococcus aureus
YILTLKIEIIIFCIHITEDAEKK

SEQ ID NO: 1674211 - protein, 21 aa, Staphylococcus aureus
YIPCKEIVDYFSLIQTEEGVW

SEQ ID NO: 1674212 - protein, 33 aa, Staphylococcus aureus
YIQAAGVAFALKKRGKYAVAITYTGDGGSSQGD

SEQ ID NO: 1674213 - protein, 17 aa, Staphylococcus aureus
YIQGMPFGHEFSGVVDA

SEQ ID NO: 1674214 - protein, 19 aa, Staphylococcus aureus
YITEIMKIRQRVMEMLLLP

SEQ ID NO: 1674215 - protein, 21 aa, Staphylococcus aureus
YIVDWFLKAREKYGLEKVIAD

SEQ ID NO: 1674216 - protein, 31 aa, Staphylococcus aureus
YIVSSYPVWFPKDEVEEIIKDMIELILEEKK

SEQ ID NO: 1674217 - protein, 17 aa, Staphylococcus aureus
YIVTWALGHLVTNATSE

SEQ ID NO: 1674218 - protein, 18 aa, Staphylococcus aureus
YIYDVYFDRDDCITVPTD

SEQ ID NO: 1674219 - protein, 19 aa, Staphylococcus aureus
YIYSRPRSGYFVSKIESLT

SEQ ID NO: 1674220 - protein, 20 aa, Staphylococcus aureus
YKADFSRLLHIDMEKINVPP

SEQ ID NO: 1674221 - protein, 20 aa, Staphylococcus aureus
YKAEDYWFTDPITLEHLRSK

SEQ ID NO: 1674222 - protein, 31 aa, Staphylococcus aureus
YKAMVRMAQDFSYRYPLVDGQGNFGSMDGDG

SEQ ID NO: 1674223 - protein, 19 aa, Staphylococcus aureus
YKAQLYLTPYGPKQYVEHL

SEQ ID NO: 1674224 - protein, 23 aa, Staphylococcus aureus
YKDEEILKTISWVIYDENGNIPT

SEQ ID NO: 1674225 - protein, 21 aa, Staphylococcus aureus
YKDGKVIVIGIQLYKDREKMY

SEQ ID NO: 1674226 - protein, 18 aa, Staphylococcus aureus
YKDIEAIRHSDIFTAVMM

SEQ ID NO: 1674227 - protein, 33 aa, Staphylococcus aureus
YKDKWNTVLKRFWKFEGTAVYEKVGIKENEKND

SEQ ID NO: 1674228 - protein, 26 aa, Staphylococcus aureus
YKDSYRKLTCLHVNHGVRSASNEEAR

SEQ ID NO: 1674229 - protein, 23 aa, Staphylococcus aureus
YKDYKVWCHSNFIRKPVNKDDFI

SEQ ID NO: 1674230 - protein, 18 aa, Staphylococcus aureus
YKELATFLKVLSDPSRLE

SEQ ID NO: 1674231 - protein, 22 aa, Staphylococcus aureus
YKELMYTTGCLEIEHGDANEGV

SEQ ID NO: 1674232 - protein, 21 aa, Staphylococcus aureus
YKFAQDLGHTITELFPTEVPI

SEQ ID NO: 1674233 - protein, 20 aa, Staphylococcus aureus
YKFKTHRMIHKFKINSQGLT

SEQ ID NO: 1674234 - protein, 18 aa, Staphylococcus aureus
YKGDHLVNFIDINENHEG

SEQ ID NO: 1674235 - protein, 18 aa, Staphylococcus aureus
YKGGLVLNRKGKLELKSG

SEQ ID NO: 1674236 - protein, 17 aa, Staphylococcus aureus
YKGTGTMIGKDIVLTAA

SEQ ID NO: 1674237 - protein, 19 aa, Staphylococcus aureus
YKHKMAIYALKDVKKILNF

SEQ ID NO: 1674238 - protein, 23 aa, Staphylococcus aureus
YKHYRNVPSLSYFFLSLNKMIDY

SEQ ID NO: 1674239 - protein, 28 aa, Staphylococcus aureus
YKIAEHFRMMAALYPNRIDLGIGNNPGT

SEQ ID NO: 1674240 - protein, 20 aa, Staphylococcus aureus
YKIPATGFIITGHVGEENFH

SEQ ID NO: 1674241 - protein, 30 aa, Staphylococcus aureus
YKISKKVIKHAGYVRCKLFLEKEEGKIHVA

SEQ ID NO: 1674242 - protein, 18 aa, Staphylococcus aureus
YKIVHLIEYGHVQKGTGK

SEQ ID NO: 1674243 - protein, 17 aa, Staphylococcus aureus
YKKAFKMKDEIEVPSAL

SEQ ID NO: 1674244 - protein, 20 aa, Staphylococcus aureus
YKKAQAFDEILEGMTNAMQD

SEQ ID NO: 1674245 - protein, 17 aa, Staphylococcus aureus
YKKFGIWPEKEYAINWV

SEQ ID NO: 1674246 - protein, 19 aa, Staphylococcus aureus
YKKFGVIPEMEYEINKVKE

SEQ ID NO: 1674247 - protein, 20 aa, Staphylococcus aureus
YKKFGVIPEMEYEMEEIKEI

SEQ ID NO: 1674248 - protein, 19 aa, Staphylococcus aureus
YKKFGVIPEMEYEMEEIKQ

SEQ ID NO: 1674249 - protein, 19 aa, Staphylococcus aureus
YKKFGVIPEMEYEMKEIKE

SEQ ID NO: 1674250 - protein, 20 aa, Staphylococcus aureus
YKKFGVLPEMEYEINKVKEI

SEQ ID NO: 1674251 - protein, 19 aa, Staphylococcus aureus
YKKFGVLPEMEYEMEEIRE

SEQ ID NO: 1674252 - protein, 19 aa, Staphylococcus aureus
YKKFGVLPEMEYEMEEVKE

SEQ ID NO: 1674253 - protein, 20 aa, Staphylococcus aureus
YKKFGVLPEMEYEMEEVKEI

SEQ ID NO: 1674254 - protein, 19 aa, Staphylococcus aureus
YKKKDYKYISDYVKNNSQL

SEQ ID NO: 1674255 - protein, 21 aa, Staphylococcus aureus
YKKKLLHFIEEEFKKKVPTRV

SEQ ID NO: 1674256 - protein, 18 aa, Staphylococcus aureus
YKKLEIDFSKGGKSDLSV

SEQ ID NO: 1674257 - protein, 24 aa, Staphylococcus aureus
YKKTPKFILGFGGIDNDALKPHVD

SEQ ID NO: 1674258 - protein, 24 aa, Staphylococcus aureus
YKKTRRSLQIYGFSPCHEISIMLT

SEQ ID NO: 1674259 - protein, 35 aa, Staphylococcus aureus
YKLAIEYKLAFPLHPEFRTMPVVWYCPPLSPIMSY

SEQ ID NO: 1674260 - protein, 24 aa, Staphylococcus aureus
YKLKKPVEDFGLWNRYEIQMRRTN

SEQ ID NO: 1674261 - protein, 20 aa, Staphylococcus aureus
YKLLDKLGFGGNDLGSDALK

SEQ ID NO: 1674262 - protein, 21 aa, Staphylococcus aureus
YKLMFNTLCAMYQRHPIRVDI

SEQ ID NO: 1674263 - protein, 17 aa, Staphylococcus aureus
YKMCVLLDMHIGHIKSI

SEQ ID NO: 1674264 - protein, 30 aa, Staphylococcus aureus
YKMPKKMRRLALRSALSFKVQENGLTLVDA

SEQ ID NO: 1674265 - protein, 17 aa, Staphylococcus aureus
YKNDIPFRFYDENNPNI

SEQ ID NO: 1674266 - protein, 26 aa, Staphylococcus aureus
YKNPFPSRWRYVVDILQQLLQTKKLD

SEQ ID NO: 1674267 - protein, 27 aa, Staphylococcus aureus
YKNPFPSRWRYVVDILQQLLQTKKLDE

SEQ ID NO: 1674268 - protein, 23 aa, Staphylococcus aureus
YKNPPKFILGFGGIDDDALKPHV

SEQ ID NO: 1674269 - protein, 17 aa, Staphylococcus aureus
YKNSFEGLAQYKSQSFP

SEQ ID NO: 1674270 - protein, 25 aa, Staphylococcus aureus
YKNTLFKFTNEIIIGRKYNSGIIKD

SEQ ID NO: 1674271 - protein, 22 aa, Staphylococcus aureus
YKNVWLLKDVPSEFNISKKDLG

SEQ ID NO: 1674272 - protein, 24 aa, Staphylococcus aureus
YKPHEYGKVILPMTVIKRLHDTLL

SEQ ID NO: 1674273 - protein, 22 aa, Staphylococcus aureus
YKQCKLGWGPTKRNWIPNFNRQ

SEQ ID NO: 1674274 - protein, 17 aa, Staphylococcus aureus
YKQVIDFIMDFITTHDL

SEQ ID NO: 1674275 - protein, 25 aa, Staphylococcus aureus
YKRRKNSYFMPKWSLVNRLGNPNAD

SEQ ID NO: 1674276 - protein, 24 aa, Staphylococcus aureus
YKRSLKASFYIAIEDDYVRKNPFN

SEQ ID NO: 1674277 - protein, 24 aa, Staphylococcus aureus
YKSLHSISKLKVRRINKYDPSGKM

SEQ ID NO: 1674278 - protein, 19 aa, Staphylococcus aureus
YKSSEEMLKYHVSTQNFEP

SEQ ID NO: 1674279 - protein, 20 aa, Staphylococcus aureus
YKSSEEMLKYHVSTQNFEQP

SEQ ID NO: 1674280 - protein, 21 aa, Staphylococcus aureus
YKTPKPLAGLNGESHDFTTTH

SEQ ID NO: 1674281 - protein, 20 aa, Staphylococcus aureus
YKTSINISKILDFQISENKP

SEQ ID NO: 1674282 - protein, 18 aa, Staphylococcus aureus
YKTSKNFINKVYKGGFNS

SEQ ID NO: 1674283 - protein, 17 aa, Staphylococcus aureus
YKTTLEIYTHVTDQMAK

SEQ ID NO: 1674284 - protein, 22 aa, Staphylococcus aureus
YKVFDFFQENGFGFITQYILED

SEQ ID NO: 1674285 - protein, 23 aa, Staphylococcus aureus
YKVGELYPAEGYNNPRVELLTNQ

SEQ ID NO: 1674286 - protein, 17 aa, Staphylococcus aureus
YKVKKIIPYAGSEDLAI

SEQ ID NO: 1674287 - protein, 17 aa, Staphylococcus aureus
YLDSDLTSVKGRMKQKV

SEQ ID NO: 1674288 - protein, 18 aa, Staphylococcus aureus
YLEDWSKDVNEIAQRYIR

SEQ ID NO: 1674289 - protein, 17 aa, Staphylococcus aureus
YLEHAFLSQDFFDIPSI

SEQ ID NO: 1674290 - protein, 17 aa, Staphylococcus aureus
YLETVMIVEGIKNNKIL

SEQ ID NO: 1674291 - protein, 17 aa, Staphylococcus aureus
YLFEDAYFKKMSAEAKI

SEQ ID NO: 1674292 - protein, 19 aa, Staphylococcus aureus
YLFSQGRLKDAKNYVLHQP

SEQ ID NO: 1674293 - protein, 24 aa, Staphylococcus aureus
YLGKKYKVIASMGHVRDLPRSQMG

SEQ ID NO: 1674294 - protein, 17 aa, Staphylococcus aureus
YLIEKSMDNKEVKRWED

SEQ ID NO: 1674295 - protein, 20 aa, Staphylococcus aureus
YLKKQNCLYVLIDPYLIENL

SEQ ID NO: 1674296 - protein, 20 aa, Staphylococcus aureus
YLLEKACERKGFPFEPKEID

SEQ ID NO: 1674297 - protein, 19 aa, Staphylococcus aureus
YLLEKSCERKGIPFEPKEI

SEQ ID NO: 1674298 - protein, 18 aa, Staphylococcus aureus
YLLKGAKVTKVYGDQNSV

SEQ ID NO: 1674299 - protein, 19 aa, Staphylococcus aureus
YLLKGAKVTKVYGDQNSVS

SEQ ID NO: 1674300 - protein, 30 aa, Staphylococcus aureus
YLLKYDYRDLEIIKAVILKAKKSFNSRHED

SEQ ID NO: 1674301 - protein, 19 aa, Staphylococcus aureus
YLLPKATVVAPNLFEAGQL

SEQ ID NO: 1674302 - protein, 23 aa, Staphylococcus aureus
YLNDIEFDLPLIIRNEKLSPGGE

SEQ ID NO: 1674303 - protein, 20 aa, Staphylococcus aureus
YLNDKVKSVLKIERGISDLD

SEQ ID NO: 1674304 - protein, 21 aa, Staphylococcus aureus
YLNDKVKSVLKIERGISDLDL

SEQ ID NO: 1674305 - protein, 20 aa, Staphylococcus aureus
YLNGRFSNMIIGHNGDGINE

SEQ ID NO: 1674306 - protein, 26 aa, Staphylococcus aureus
YLNHNSRLFKLYKGYKGNITRIVSDK

SEQ ID NO: 1674307 - protein, 27 aa, Staphylococcus aureus
YLNHNSRLFKLYKGYKGNITRIVSDKD

SEQ ID NO: 1674308 - protein, 17 aa, Staphylococcus aureus
YLNQFFGSKRYLYRDNE

SEQ ID NO: 1674309 - protein, 17 aa, Staphylococcus aureus
YLNQFFGSKSYLYQDNE

SEQ ID NO: 1674310 - protein, 17 aa, Staphylococcus aureus
YLPIYAIQNHLCDCGIA

SEQ ID NO: 1674311 - protein, 17 aa, Staphylococcus aureus
YLRYRDVYHYDLKSFED

SEQ ID NO: 1674312 - protein, 18 aa, Staphylococcus aureus
YLSCLKLADQQSLNHIAF

SEQ ID NO: 1674313 - protein, 18 aa, Staphylococcus aureus
YLSEEYLIQIDVESANHQ

SEQ ID NO: 1674314 - protein, 18 aa, Staphylococcus aureus
YLSEEYLIQIDVESSNHQ

SEQ ID NO: 1674315 - protein, 21 aa, Staphylococcus aureus
YLSKGSLAGVDGRLQTRSYDN

SEQ ID NO: 1674316 - protein, 19 aa, Staphylococcus aureus
YLSSSYFRSSGYDGFMQDY

SEQ ID NO: 1674317 - protein, 19 aa, Staphylococcus aureus
YLVQESYDVMALVHECREA

SEQ ID NO: 1674318 - protein, 17 aa, Staphylococcus aureus
YLYGDDINKLQGRPIVG

SEQ ID NO: 1674319 - protein, 17 aa, Staphylococcus aureus
YLYLTGRQQDMLIIGGQ

SEQ ID NO: 1674320 - protein, 21 aa, Staphylococcus aureus
YMDFTEIVPISALDGLNVDHF

SEQ ID NO: 1674321 - protein, 19 aa, Staphylococcus aureus
YMFRFKKKVKPEVDMTIKE

SEQ ID NO: 1674322 - protein, 25 aa, Staphylococcus aureus
YMGSTHLNSTMCQRISALAEQLKIQ

SEQ ID NO: 1674323 - protein, 21 aa, Staphylococcus aureus
YMGVKRLGKIITQIQQYTDID

SEQ ID NO: 1674324 - protein, 18 aa, Staphylococcus aureus
YMHFGECLMVAVRQDCRI

SEQ ID NO: 1674325 - protein, 17 aa, Staphylococcus aureus
YMIFLTWIFSTTNNKLR

SEQ ID NO: 1674326 - protein, 18 aa, Staphylococcus aureus
YMNAYLFKQLVKNNGVEG

SEQ ID NO: 1674327 - protein, 20 aa, Staphylococcus aureus
YMNGKIYIRRNLSEVRKAEV

SEQ ID NO: 1674328 - protein, 17 aa, Staphylococcus aureus
YMRIHSINIKEFETNCD

SEQ ID NO: 1674329 - protein, 22 aa, Staphylococcus aureus
YMYKKFGVLPEMEYEMEEVKEI

SEQ ID NO: 1674330 - protein, 38 aa, Staphylococcus aureus
YNADGWYGFQCFDYANAGWKALFGLLLKGVGAKDIPFA

SEQ ID NO: 1674331 - protein, 26 aa, Staphylococcus aureus
YNAFDWKDVEQAFSWSETGKMNMAYE

SEQ ID NO: 1674332 - protein, 24 aa, Staphylococcus aureus
YNATLILDVSHSFGIENYSNYQGI

SEQ ID NO: 1674333 - protein, 25 aa, Staphylococcus aureus
YNATLILDVSHSFGIENYSNYQGVD

SEQ ID NO: 1674334 - protein, 24 aa, Staphylococcus aureus
YNDSDLNWIYLVENLRNAGVSIES

SEQ ID NO: 1674335 - protein, 18 aa, Staphylococcus aureus
YNGAVYFTPQIKDFIQKH

SEQ ID NO: 1674336 - protein, 26 aa, Staphylococcus aureus
YNGYIFKLVVFVSALLTSHGYIEITR

SEQ ID NO: 1674337 - protein, 19 aa, Staphylococcus aureus
YNIPELHVAQIKMTKTHAN

SEQ ID NO: 1674338 - protein, 17 aa, Staphylococcus aureus
YNIPLYLGKTLSNMKGT

SEQ ID NO: 1674339 - protein, 27 aa, Staphylococcus aureus
YNIPNGYKYYSLYDEKNRWMGYFNSND

SEQ ID NO: 1674340 - protein, 18 aa, Staphylococcus aureus
YNISTDIVKRITFESQAK

SEQ ID NO: 1674341 - protein, 17 aa, Staphylococcus aureus
YNLAAKIYRDIKDYYLY

SEQ ID NO: 1674342 - protein, 21 aa, Staphylococcus aureus
YNLDPKLWYFAAGSTTTTIKQ

SEQ ID NO: 1674343 - protein, 18 aa, Staphylococcus aureus
YNLNIPRYVDAFEEEAPI

SEQ ID NO: 1674344 - protein, 18 aa, Staphylococcus aureus
YNLNIPRYVDTFEEEEPI

SEQ ID NO: 1674345 - protein, 17 aa, Staphylococcus aureus
YNLPAKYIVHTVGPQIR

SEQ ID NO: 1674346 - protein, 17 aa, Staphylococcus aureus
YNLSFILSRVLNTGTIM

SEQ ID NO: 1674347 - protein, 18 aa, Staphylococcus aureus
YNMVRVLVAFLIEVGKGR

SEQ ID NO: 1674348 - protein, 17 aa, Staphylococcus aureus
YNNEVERLMGLDKLSKL

SEQ ID NO: 1674349 - protein, 21 aa, Staphylococcus aureus
YNNGYGYIKLRDIIVERMSKQ

SEQ ID NO: 1674350 - protein, 18 aa, Staphylococcus aureus
YNPKEARAHWDKAKKELG

SEQ ID NO: 1674351 - protein, 19 aa, Staphylococcus aureus
YNPPLNVKVATRLGHVKGY

SEQ ID NO: 1674352 - protein, 18 aa, Staphylococcus aureus
YNRGYTFGNIQIFYSDKD

SEQ ID NO: 1674353 - protein, 22 aa, Staphylococcus aureus
YNSVIATFCYKIARNEEIQVNN

SEQ ID NO: 1674354 - protein, 24 aa, Staphylococcus aureus
YNTEDVAMAFGFFDGMHKGHDKVF

SEQ ID NO: 1674355 - protein, 26 aa, Staphylococcus aureus
YNTFDWKDVEQAFSWSETGKMNMAYE

SEQ ID NO: 1674356 - protein, 20 aa, Staphylococcus aureus
YNTMLELIKPLGHITTIVAF

SEQ ID NO: 1674357 - protein, 27 aa, Staphylococcus aureus
YNYHGEWKLKSADEFIKDNRIVTLTEQ

SEQ ID NO: 1674358 - protein, 27 aa, Staphylococcus aureus
YNYHGEWKLKSSDEFIKDNRIVTLTEQ

SEQ ID NO: 1674359 - protein, 24 aa, Staphylococcus aureus
YNYYMEIIFTLGFLYKKEHKNSII

SEQ ID NO: 1674360 - protein, 17 aa, Staphylococcus aureus
YPDIKVEVSGPLGTHPL

SEQ ID NO: 1674361 - protein, 18 aa, Staphylococcus aureus
YPEHCNKALDLICEKNSF

SEQ ID NO: 1674362 - protein, 17 aa, Staphylococcus aureus
YPEKIIWDIGGIAPKPC

SEQ ID NO: 1674363 - protein, 36 aa, Staphylococcus aureus
YPFKELPLYEIGWRLLPEFWGKGLATEGANATLKLA

SEQ ID NO: 1674364 - protein, 20 aa, Staphylococcus aureus
YPFPEEEIETLLAQLPNLEE

SEQ ID NO: 1674365 - protein, 18 aa, Staphylococcus aureus
YPGAKEMILIPDFTEATN

SEQ ID NO: 1674366 - protein, 17 aa, Staphylococcus aureus
YPGLSKSDFKSKNNNVS

SEQ ID NO: 1674367 - protein, 19 aa, Staphylococcus aureus
YPGSKEMILILDFTEATNL

SEQ ID NO: 1674368 - protein, 24 aa, Staphylococcus aureus
YPHKRGVYSGGVGYINCNHKLDFA

SEQ ID NO: 1674369 - protein, 24 aa, Staphylococcus aureus
YPHKRGVYSGGVGYINCNHNLDFA

SEQ ID NO: 1674370 - protein, 38 aa, Staphylococcus aureus
YPLAKGASYRLEFYRLYLLMVHLLKFGEMYRDSVAQSM

SEQ ID NO: 1674371 - protein, 25 aa, Staphylococcus aureus
YPLGKATSHLLGYVGPINSEELKQK

SEQ ID NO: 1674372 - protein, 25 aa, Staphylococcus aureus
YPLLNSSWQGNEIVLHKDINISIAV

SEQ ID NO: 1674373 - protein, 21 aa, Staphylococcus aureus
YPNKDRLTFAISDIGIGLSKK

SEQ ID NO: 1674374 - protein, 20 aa, Staphylococcus aureus
YPPQLAFAIGNAIKCLSRAP

SEQ ID NO: 1674375 - protein, 18 aa, Staphylococcus aureus
YPQAFIHMVGFSRGGLQG

SEQ ID NO: 1674376 - protein, 19 aa, Staphylococcus aureus
YPQIEEIISSFATSEDSNL

SEQ ID NO: 1674377 - protein, 17 aa, Staphylococcus aureus
YPRRILWLRKVQSTIKD

SEQ ID NO: 1674378 - protein, 25 aa, Staphylococcus aureus
YPTDNEGWAHCLTTPRVLNVENGQL

SEQ ID NO: 1674379 - protein, 25 aa, Staphylococcus aureus
YPTDSPGGWQIIGRTPLKVFSSERE

SEQ ID NO: 1674380 - protein, 23 aa, Staphylococcus aureus
YPTIYRYIREGLVKYVKKDLRQG

SEQ ID NO: 1674381 - protein, 23 aa, Staphylococcus aureus
YPTIYRYMREGLVEYVKKDLRQG

SEQ ID NO: 1674382 - protein, 18 aa, Staphylococcus aureus
YPVWFPKDEVEEIIKDMI

SEQ ID NO: 1674383 - protein, 20 aa, Staphylococcus aureus
YPYADGEGFIEIATTRPETM

SEQ ID NO: 1674384 - protein, 34 aa, Staphylococcus aureus
YPYFDLKWLLSQNNFEVFYGRDFITNFATIEDSK

SEQ ID NO: 1674385 - protein, 19 aa, Staphylococcus aureus
YPYYGATGIIDYVKEYLFN

SEQ ID NO: 1674386 - protein, 23 aa, Staphylococcus aureus
YQAQGNVIALGRIHGTDTNDHGD

SEQ ID NO: 1674387 - protein, 18 aa, Staphylococcus aureus
YQDISFSTIEEFINWDLE

SEQ ID NO: 1674388 - protein, 32 aa, Staphylococcus aureus
YQFDFKRFNSVSEFKNATLLSETSTIYELITN

SEQ ID NO: 1674389 - protein, 18 aa, Staphylococcus aureus
YQHGIGCYENYKAYASEI

SEQ ID NO: 1674390 - protein, 21 aa, Staphylococcus aureus
YQLGALQVFCRIHQVKINHVK

SEQ ID NO: 1674391 - protein, 25 aa, Staphylococcus aureus
YQLNVLQLIRLCRYFVDVLRQSDNG

SEQ ID NO: 1674392 - protein, 26 aa, Staphylococcus aureus
YQLPAPKFEAGDSFMKVTMYAYKKLV

SEQ ID NO: 1674393 - protein, 19 aa, Staphylococcus aureus
YQLPGHFAPIASYQLLEKA

SEQ ID NO: 1674394 - protein, 17 aa, Staphylococcus aureus
YQMTIVFITHDINLVKD

SEQ ID NO: 1674395 - protein, 18 aa, Staphylococcus aureus
YQPWPTYDEALLVDDEIE

SEQ ID NO: 1674396 - protein, 17 aa, Staphylococcus aureus
YQPWPTYDEALLVDDEV

SEQ ID NO: 1674397 - protein, 17 aa, Staphylococcus aureus
YQQELMESYQLNKANEL

SEQ ID NO: 1674398 - protein, 28 aa, Staphylococcus aureus
YQSLHPWVLRQKAEIMIEQFRSVTQKAV

SEQ ID NO: 1674399 - protein, 18 aa, Staphylococcus aureus
YQYIDWDGGSLIELIIAE

SEQ ID NO: 1674400 - protein, 19 aa, Staphylococcus aureus
YRAKRYNRWLQFDYVIHSA

SEQ ID NO: 1674401 - protein, 19 aa, Staphylococcus aureus
YRASQQLLYPLYKKGKFLS

SEQ ID NO: 1674402 - protein, 19 aa, Staphylococcus aureus
YRDNSLWLFRGHSNLNWSL

SEQ ID NO: 1674403 - protein, 19 aa, Staphylococcus aureus
YRFSERNRIISGLSKGVLI

SEQ ID NO: 1674404 - protein, 20 aa, Staphylococcus aureus
YRGIATWRYDQKRQRLIGTI

SEQ ID NO: 1674405 - protein, 26 aa, Staphylococcus aureus
YRHVDLPASVPLAWGAHSAASIVAEQ

SEQ ID NO: 1674406 - protein, 20 aa, Staphylococcus aureus
YRHVVVPTKIIAGEFGERTT

SEQ ID NO: 1674407 - protein, 29 aa, Staphylococcus aureus
YRKEVPPLMCASLWSKFDLFKKYANSELI

SEQ ID NO: 1674408 - protein, 30 aa, Staphylococcus aureus
YRKEVPPLMCASLWSKFDLFKKYANSELIL

SEQ ID NO: 1674409 - protein, 18 aa, Staphylococcus aureus
YRKIDGFAAFLNTYTDIM

SEQ ID NO: 1674410 - protein, 19 aa, Staphylococcus aureus
YRKLLPLKEYKDSIKHSDS

SEQ ID NO: 1674411 - protein, 28 aa, Staphylococcus aureus
YRKMKLIQAEKWFLLKDFGRSGKGLFMA

SEQ ID NO: 1674412 - protein, 20 aa, Staphylococcus aureus
YRLYQTVKYWPKGTVFVSVV

SEQ ID NO: 1674413 - protein, 18 aa, Staphylococcus aureus
YRMLKAGGNLVFTVEHPV

SEQ ID NO: 1674414 - protein, 19 aa, Staphylococcus aureus
YRNLHLFKDLGIIENTELD

SEQ ID NO: 1674415 - protein, 20 aa, Staphylococcus aureus
YRNTIDMVLMINGIPLVALE

SEQ ID NO: 1674416 - protein, 23 aa, Staphylococcus aureus
YRNVTAMVRWIREKEILEIQDIV

SEQ ID NO: 1674417 - protein, 17 aa, Staphylococcus aureus
YRPGDFESITVTVDADK

SEQ ID NO: 1674418 - protein, 17 aa, Staphylococcus aureus
YRPVVNIKAIKPNQKGD

SEQ ID NO: 1674419 - protein, 21 aa, Staphylococcus aureus
YRQCKLAGPQHREFQKEILQT

SEQ ID NO: 1674420 - protein, 25 aa, Staphylococcus aureus
YRVSGEACFVFKVRLENMDEVETFV

SEQ ID NO: 1674421 - protein, 20 aa, Staphylococcus aureus
YRYLERYTDPLTGKYKTVSV

SEQ ID NO: 1674422 - protein, 18 aa, Staphylococcus aureus
YSANSAHVTGCRLLKKPH

SEQ ID NO: 1674423 - protein, 24 aa, Staphylococcus aureus
YSANSAHVTGCRLLKKPHIKQYIQ

SEQ ID NO: 1674424 - protein, 17 aa, Staphylococcus aureus
YSATLMTSFFVDKKPLT

SEQ ID NO: 1674425 - protein, 25 aa, Staphylococcus aureus
YSDDWYTNAFVDLVLSMKGYSYHVE

SEQ ID NO: 1674426 - protein, 23 aa, Staphylococcus aureus
YSDIKAIRIYTSNVFKYAVSLKI

SEQ ID NO: 1674427 - protein, 24 aa, Staphylococcus aureus
YSDIKAIRIYTSNVFKYAVSLKII

SEQ ID NO: 1674428 - protein, 20 aa, Staphylococcus aureus
YSDNLIKVFSEDVWNIMGYK

SEQ ID NO: 1674429 - protein, 23 aa, Staphylococcus aureus
YSDYKESLGQWFVNPNKQNTQYS

SEQ ID NO: 1674430 - protein, 21 aa, Staphylococcus aureus
YSESTIDRWFTTALKVLDDQL

SEQ ID NO: 1674431 - protein, 18 aa, Staphylococcus aureus
YSFALLWGQFACKPPMKE

SEQ ID NO: 1674432 - protein, 26 aa, Staphylococcus aureus
YSGGMKRRLSLAISFLQNPNILILDE

SEQ ID NO: 1674433 - protein, 17 aa, Staphylococcus aureus
YSIEAKPGICIIGEVVD

SEQ ID NO: 1674434 - protein, 17 aa, Staphylococcus aureus
YSKDVIVDYGNQKGQQL

SEQ ID NO: 1674435 - protein, 18 aa, Staphylococcus aureus
YSKFLAMDSDIFKDRSIG

SEQ ID NO: 1674436 - protein, 23 aa, Staphylococcus aureus
YSKILSRLCKYFLGIFSEEKLLG

SEQ ID NO: 1674437 - protein, 19 aa, Staphylococcus aureus
YSKQLDCFIIVKNNQYEVI

SEQ ID NO: 1674438 - protein, 27 aa, Staphylococcus aureus
YSKSELKELCKVCKQYQLPLFMDGARL

SEQ ID NO: 1674439 - protein, 17 aa, Staphylococcus aureus
YSLAAFFSGVGGIELGF

SEQ ID NO: 1674440 - protein, 26 aa, Staphylococcus aureus
YSLTEIKSRVEAFLPEIKSIGMAIEP

SEQ ID NO: 1674441 - protein, 26 aa, Staphylococcus aureus
YSNTIYRLLGYNGDSSFEMKLKNEIS

SEQ ID NO: 1674442 - protein, 24 aa, Staphylococcus aureus
YSPSIKPWILPNFTALVNHEKIDM

SEQ ID NO: 1674443 - protein, 19 aa, Staphylococcus aureus
YSQIRLVALSTRTKLATLL

SEQ ID NO: 1674444 - protein, 26 aa, Staphylococcus aureus
YSQRKIDVESVFGFMKAILGFTRMSV

SEQ ID NO: 1674445 - protein, 27 aa, Staphylococcus aureus
YSSEFNQHIKLKIVLIHSKLSRTMSLS

SEQ ID NO: 1674446 - protein, 17 aa, Staphylococcus aureus
YSSTSGFQEMMPENPKS

SEQ ID NO: 1674447 - protein, 22 aa, Staphylococcus aureus
YSTDMRDAREFDGLDKTVIDMS

SEQ ID NO: 1674448 - protein, 20 aa, Staphylococcus aureus
YSTELANIFYVRQKEQKGLG

SEQ ID NO: 1674449 - protein, 21 aa, Staphylococcus aureus
YSTQCNLELYFTSLSRKTIVY

SEQ ID NO: 1674450 - protein, 20 aa, Staphylococcus aureus
YSTSIFQHAFHVSRDKIFET

SEQ ID NO: 1674451 - protein, 20 aa, Staphylococcus aureus
YSTSIFQHAFHVSRDRILET

SEQ ID NO: 1674452 - protein, 19 aa, Staphylococcus aureus
YSVECNLKYSITKKLLNGS

SEQ ID NO: 1674453 - protein, 20 aa, Staphylococcus aureus
YSVECNLKYSITKKLLNGSI

SEQ ID NO: 1674454 - protein, 20 aa, Staphylococcus aureus
YSYYEFKYHSTVLYACRCIS

SEQ ID NO: 1674455 - protein, 19 aa, Staphylococcus aureus
YTALDIKIIMPMFDDALPY

SEQ ID NO: 1674456 - protein, 20 aa, Staphylococcus aureus
YTALDIKVIMPIFDDALPYY

SEQ ID NO: 1674457 - protein, 17 aa, Staphylococcus aureus
YTKRFNSLASFNTNINI

SEQ ID NO: 1674458 - protein, 17 aa, Staphylococcus aureus
YTLMTMHGLFNQLKLGI

SEQ ID NO: 1674459 - protein, 18 aa, Staphylococcus aureus
YTMTLTFEEAVFGTTKEI

SEQ ID NO: 1674460 - protein, 25 aa, Staphylococcus aureus
YTSNLTWKNGVAFYSNNAQGDGKDK

SEQ ID NO: 1674461 - protein, 17 aa, Staphylococcus aureus
YTVEIARKLMGFDIKML

SEQ ID NO: 1674462 - protein, 32 aa, Staphylococcus aureus
YTVNRIVLKDGWLFRKMRIETMQKVLKYGTSK

SEQ ID NO: 1674463 - protein, 19 aa, Staphylococcus aureus
YVAKLKGYLMREEVKALEK

SEQ ID NO: 1674464 - protein, 24 aa, Staphylococcus aureus
YVALEKEYAWAFLNELFYLIELYL

SEQ ID NO: 1674465 - protein, 18 aa, Staphylococcus aureus
YVAPDFRTVTPIIQNISV

SEQ ID NO: 1674466 - protein, 19 aa, Staphylococcus aureus
YVAPDFRTVTPIIQNISVA

SEQ ID NO: 1674467 - protein, 19 aa, Staphylococcus aureus
YVDDISFSFNFEEEKDKFY

SEQ ID NO: 1674468 - protein, 19 aa, Staphylococcus aureus
YVFFLGRELKQNFELSTKE

SEQ ID NO: 1674469 - protein, 17 aa, Staphylococcus aureus
YVFFNIAVPRQFDNDRT

SEQ ID NO: 1674470 - protein, 25 aa, Staphylococcus aureus
YVGNWRDKFFKEREGKYQVEDDTTK

SEQ ID NO: 1674471 - protein, 17 aa, Staphylococcus aureus
YVHFSRIVQGFWRANEW

SEQ ID NO: 1674472 - protein, 23 aa, Staphylococcus aureus
YVINGKSAINWIMSEYQIKTNKA

SEQ ID NO: 1674473 - protein, 27 aa, Staphylococcus aureus
YVIPNEFLKYTGRIHAQAYFTQNGSNN

SEQ ID NO: 1674474 - protein, 26 aa, Staphylococcus aureus
YVIPNEFLKYTGRVHAQAYFTQNGSN

SEQ ID NO: 1674475 - protein, 22 aa, Staphylococcus aureus
YVIQARLVFNYAKKLELIDKNP

SEQ ID NO: 1674476 - protein, 22 aa, Staphylococcus aureus
YVKEGCLYPLSYYDGDWYGEDK

SEQ ID NO: 1674477 - protein, 19 aa, Staphylococcus aureus
YVKEGILYPLSYYDSDWYG

SEQ ID NO: 1674478 - protein, 23 aa, Staphylococcus aureus
YVKTAYAGMVPYFTKNVNKIKSS

SEQ ID NO: 1674479 - protein, 22 aa, Staphylococcus aureus
YVLSNHFDMFWTLTFDPKKYDG

SEQ ID NO: 1674480 - protein, 25 aa, Staphylococcus aureus
YVLYPGLSKDVFKSKASKVTVVKQE

SEQ ID NO: 1674481 - protein, 23 aa, Staphylococcus aureus
YVMLGHLHHPFSIEDEKIKYSGS

SEQ ID NO: 1674482 - protein, 17 aa, Staphylococcus aureus
YVNDRGGEIVFNYTKPG

SEQ ID NO: 1674483 - protein, 17 aa, Staphylococcus aureus
YVNDRGGEVVFNYTKPG

SEQ ID NO: 1674484 - protein, 17 aa, Staphylococcus aureus
YVNDRGGEVVFNYTKPN

SEQ ID NO: 1674485 - protein, 19 aa, Staphylococcus aureus
YVQAIRWATDRIGSKGVIS

SEQ ID NO: 1674486 - protein, 27 aa, Staphylococcus aureus
YVRNYILKRFKVVGVVSLPYETFIPHG

SEQ ID NO: 1674487 - protein, 17 aa, Staphylococcus aureus
YVRYNFFSATPIMKDFS

SEQ ID NO: 1674488 - protein, 27 aa, Staphylococcus aureus
YVTHLKQFMEFYEDFYFDGEEWEKDVW

SEQ ID NO: 1674489 - protein, 25 aa, Staphylococcus aureus
YVTLEPCVMCAGTIVMSRIPRVVYG

SEQ ID NO: 1674490 - protein, 18 aa, Staphylococcus aureus
YVVRPFIDKIKHFQEIAN

SEQ ID NO: 1674491 - protein, 17 aa, Staphylococcus aureus
YVVRPFIDKIKHFQETA

SEQ ID NO: 1674492 - protein, 17 aa, Staphylococcus aureus
YWDKITVNYYVYENGSL

SEQ ID NO: 1674493 - protein, 17 aa, Staphylococcus aureus
YWDNRLANKAIEFVEML

SEQ ID NO: 1674494 - protein, 25 aa, Staphylococcus aureus
YWGTPLNVWICNDCNHEYAPSSIKD

SEQ ID NO: 1674495 - protein, 21 aa, Staphylococcus aureus
YWKINEMLLPLPKNEEWDQQF

SEQ ID NO: 1674496 - protein, 22 aa, Staphylococcus aureus
YWKINEMVLPLPKNEEWDQQFL

SEQ ID NO: 1674497 - protein, 18 aa, Staphylococcus aureus
YWKLSSRGLYYKHSVYGQ

SEQ ID NO: 1674498 - protein, 25 aa, Staphylococcus aureus
YWYERSIKLFSEFFGENMLVKNITR

SEQ ID NO: 1674499 - protein, 26 aa, Staphylococcus aureus
YWYERSIKLFSEFFGLNMLVKNITRI

SEQ ID NO: 1674500 - protein, 22 aa, Staphylococcus aureus
YYADGWIFGLLMKNTISDGLPK

SEQ ID NO: 1674501 - protein, 23 aa, Staphylococcus aureus
YYAKERPSAFIYTGAAVENGETY

SEQ ID NO: 1674502 - protein, 34 aa, Staphylococcus aureus
YYDEFEGGHQWKDWKPLLSDILLYFLSKNTDDKL

SEQ ID NO: 1674503 - protein, 17 aa, Staphylococcus aureus
YYDEQKERIIIYMKYNV

SEQ ID NO: 1674504 - protein, 22 aa, Staphylococcus aureus
YYFEVRSAWRGKHIIRVKDGLL

SEQ ID NO: 1674505 - protein, 24 aa, Staphylococcus aureus
YYGEIPPKHAVIFLNGNKKDFRIE

SEQ ID NO: 1674506 - protein, 17 aa, Staphylococcus aureus
YYICPKNMNESRFVCSF

SEQ ID NO: 1674507 - protein, 22 aa, Staphylococcus aureus
YYIKGFEMLPQMKAVDLRIEYD

SEQ ID NO: 1674508 - protein, 23 aa, Staphylococcus aureus
YYILNFLKSIAIAKQFYKTNAGG

SEQ ID NO: 1674509 - protein, 18 aa, Staphylococcus aureus
YYIQRFLARAFGFEVDDI

SEQ ID NO: 1674510 - protein, 23 aa, Staphylococcus aureus
YYKNRWGLFGYCRFIPYLKKRLN

SEQ ID NO: 1674511 - protein, 21 aa, Staphylococcus aureus
YYKYRKFGILPETEYEINKVK

SEQ ID NO: 1674512 - protein, 18 aa, Staphylococcus aureus
YYLCELLAHLIEIPQTSY

SEQ ID NO: 1674513 - protein, 18 aa, Staphylococcus aureus
YYLCELLAHLIEIPQTTY

SEQ ID NO: 1674514 - protein, 23 aa, Staphylococcus aureus
YYMYKKFGVIPEMEYEMEEVKEI

SEQ ID NO: 1674515 - protein, 18 aa, Staphylococcus aureus
YYNIICHYGEQAFFEKCR

SEQ ID NO: 1674516 - protein, 18 aa, Staphylococcus aureus
YYNQCYFSADNMELNDGR

SEQ ID NO: 1674517 - protein, 17 aa, Staphylococcus aureus
YYPFFKIDFERLARYCE

SEQ ID NO: 1674518 - protein, 24 aa, Staphylococcus aureus
YYQLCKAKSLLSIIDNTFLTPYLS

SEQ ID NO: 1674519 - protein, 23 aa, Staphylococcus aureus
YYQLCKDKGLLSIIDNTFLTPYL

SEQ ID NO: 1674520 - protein, 18 aa, Staphylococcus aureus
YYQSKCVINLKSYSETQF

SEQ ID NO: 1674521 - protein, 22 aa, Staphylococcus aureus
YYQWKMKKEHIVPISKEVALLI

SEQ ID NO: 1674522 - protein, 19 aa, Staphylococcus aureus
YYRGDEVSFTMGVSDRHSG

SEQ ID NO: 1674523 - protein, 19 aa, Staphylococcus aureus
YYRSLPGKLARELEEMDKN

SEQ ID NO: 1674524 - protein, 27 aa, Staphylococcus aureus
YYSDKSICSRFKREFDITKSLSSMELI

SEQ ID NO: 1674525 - protein, 27 aa, Staphylococcus aureus
YYSDKSICSRFKREFDITKSLSSMKLI

SEQ ID NO: 1674526 - protein, 25 aa, Staphylococcus aureus
YYSEIKSVQNLFRIKTHTNKLTEIE

SEQ ID NO: 1674527 - protein, 36 aa, Staphylococcus aureus
YYTKPSFEFEKQFGFMLKPWTTVRFMNVIPNRFIYK

SEQ ID NO: 1674528 - protein, 17 aa, Staphylococcus aureus
YYTNKLEVFRNAENILE

SEQ ID NO: 1674529 - protein, 17 aa, Staphylococcus aureus
YYVQRFLARAFGFEVDD

SEQ ID NO: 1674530 - protein, 18 aa, Staphylococcus aureus
YYYPRKKQSITILSTTYQ

SEQ ID NO: 1674531 - protein, 24 aa, Staphylococcus aureus
YAVFKKPMIFYAFDLEDYITTRDF

SEQ ID NO: 1674532 - protein, 22 aa, Staphylococcus aureus
EFRNYILGLIFYRFLSEKAEQE

SEQ ID NO: 1674533 - protein, 17 aa, Staphylococcus aureus
KARIMMIFSLYKGEKKK

SEQ ID NO: 1674534 - protein, 20 aa, Staphylococcus aureus
ISSMIPVEWEKVYTMAYIDD

SEQ ID NO: 1674535 - protein, 17 aa, Staphylococcus aureus
QNKRPDYMTAFWNIVNW

SEQ ID NO: 1674536 - protein, 18 aa, Staphylococcus aureus
RHRLLELFLIEILKYNWE

SEQ ID NO: 1674537 - protein, 17 aa, Staphylococcus aureus
RKEIKAMTPKIIEFSEL

SEQ ID NO: 1674538 - protein, 20 aa, Staphylococcus aureus
RPDYMTAFWNIVNWKKVDEL

SEQ ID NO: 1674539 - protein, 24 aa, Staphylococcus aureus
ACGTWRLVYQRLKALEVLTHEHVH

SEQ ID NO: 1674540 - protein, 17 aa, Staphylococcus aureus
AFDGEIRAYAALTTETV

SEQ ID NO: 1674541 - protein, 17 aa, Staphylococcus aureus
ANCMVMLPGGSRGFKAG

SEQ ID NO: 1674542 - protein, 19 aa, Staphylococcus aureus
ASGLPSYVYTFLGFLPRKE

SEQ ID NO: 1674543 - protein, 22 aa, Staphylococcus aureus
AVSRTSFNWGVHVPSNPKHVVY

SEQ ID NO: 1674544 - protein, 22 aa, Staphylococcus aureus
DLKGSWSVVCFYPADFSFVCPT

SEQ ID NO: 1674545 - protein, 17 aa, Staphylococcus aureus
DQFKRIRIGVGRPTNGM

SEQ ID NO: 1674546 - protein, 21 aa, Staphylococcus aureus
DSARFRLLLSEAFDVAPRSVD

SEQ ID NO: 1674547 - protein, 18 aa, Staphylococcus aureus
DVADEFDVQIALHADTLN

SEQ ID NO: 1674548 - protein, 20 aa, Staphylococcus aureus
EALFNFIALLGWSPEGEEEI

SEQ ID NO: 1674549 - protein, 23 aa, Staphylococcus aureus
EDPRFTDRFELFIVGREHANAFT

SEQ ID NO: 1674550 - protein, 19 aa, Staphylococcus aureus
EFDLLALRKSVIRWCELLL

SEQ ID NO: 1674551 - protein, 18 aa, Staphylococcus aureus
EFTELGSGFKIAMRDLNI

SEQ ID NO: 1674552 - protein, 18 aa, Staphylococcus aureus
EMTVELIAPIAIEDGTRF

SEQ ID NO: 1674553 - protein, 25 aa, Staphylococcus aureus
ESLQFSVALSTVWKFISRTNKYIDE

SEQ ID NO: 1674554 - protein, 25 aa, Staphylococcus aureus
EWNLKLGDLAMIWREGCIIRAQFLQ

SEQ ID NO: 1674555 - protein, 18 aa, Staphylococcus aureus
FDEKRLSKSPAFFDKQKL

SEQ ID NO: 1674556 - protein, 18 aa, Staphylococcus aureus
FDNLKWLGLDWDESVDKD

SEQ ID NO: 1674557 - protein, 19 aa, Staphylococcus aureus
FEPKAHWDIVEELKMADFD

SEQ ID NO: 1674558 - protein, 17 aa, Staphylococcus aureus
FGEMEVWALEAYGAAYT

SEQ ID NO: 1674559 - protein, 19 aa, Staphylococcus aureus
FGWEPPRFGHMSLIVNEER

SEQ ID NO: 1674560 - protein, 19 aa, Staphylococcus aureus
FIEDFSIKIVDVMTQENLI

SEQ ID NO: 1674561 - protein, 19 aa, Staphylococcus aureus
FPTAGLILGKSGIRRAYET

SEQ ID NO: 1674562 - protein, 22 aa, Staphylococcus aureus
GAIGLKVHEDWGATPSALSHAL

SEQ ID NO: 1674563 - protein, 20 aa, Staphylococcus aureus
GDTFIGAFVSRLNKSQDNLA

SEQ ID NO: 1674564 - protein, 22 aa, Staphylococcus aureus
GEIGSAVARRARAFDMDVLYTG

SEQ ID NO: 1674565 - protein, 18 aa, Staphylococcus aureus
GIELGIPEHLVWRQPFPG

SEQ ID NO: 1674566 - protein, 18 aa, Staphylococcus aureus
GTDLAWLSAVTKYIIDHD

SEQ ID NO: 1674567 - protein, 20 aa, Staphylococcus aureus
HMRSRLAGYKVPRMYVPVTH

SEQ ID NO: 1674568 - protein, 24 aa, Staphylococcus aureus
IADVGCGYGPIGLMIAKVSPHHSI

SEQ ID NO: 1674569 - protein, 19 aa, Staphylococcus aureus
IPEHLVWRQPFPGPGLGIR

SEQ ID NO: 1674570 - protein, 17 aa, Staphylococcus aureus
IRESPAFDIYELLNQEP

SEQ ID NO: 1674571 - protein, 26 aa, Staphylococcus aureus
IRTLLLTFFYRFMRPLIEAGYVYIAQ

SEQ ID NO: 1674572 - protein, 17 aa, Staphylococcus aureus
ITLREGDEVVGLDVAHA

SEQ ID NO: 1674573 - protein, 21 aa, Staphylococcus aureus
KEVSEGFIWYNELPLSLFKDD

SEQ ID NO: 1674574 - protein, 22 aa, Staphylococcus aureus
KVKMYVCGPTVYNYIHIGNARP

SEQ ID NO: 1674575 - protein, 18 aa, Staphylococcus aureus
KVNFPVTLGHEFSGEIVE

SEQ ID NO: 1674576 - protein, 24 aa, Staphylococcus aureus
LFACFKTGAVFLPLNWRLNPKEIA

SEQ ID NO: 1674577 - protein, 17 aa, Staphylococcus aureus
LNENFSFDIPINEIDKW

SEQ ID NO: 1674578 - protein, 18 aa, Staphylococcus aureus
LTQYIGHLNVVLFAPEDL

SEQ ID NO: 1674579 - protein, 24 aa, Staphylococcus aureus
MGLKCLRTSIAWTRIFPNGDEDVP

SEQ ID NO: 1674580 - protein, 18 aa, Staphylococcus aureus
MIRQHIKPVLFVINNDGY

SEQ ID NO: 1674581 - protein, 20 aa, Staphylococcus aureus
MKLIDEYDFLYGIIGWHPVD

SEQ ID NO: 1674582 - protein, 17 aa, Staphylococcus aureus
MTLKLAQHYPLKRIAVM

SEQ ID NO: 1674583 - protein, 18 aa, Staphylococcus aureus
PARAMGMVSVWYKQEDAE

SEQ ID NO: 1674584 - protein, 19 aa, Staphylococcus aureus
PEEVRFILKQMGLKEKTID

SEQ ID NO: 1674585 - protein, 18 aa, Staphylococcus aureus
PKDAPGFPVRAFAIKPSN

SEQ ID NO: 1674586 - protein, 18 aa, Staphylococcus aureus
PLSREKLSPVLALVKAQS

SEQ ID NO: 1674587 - protein, 19 aa, Staphylococcus aureus
PSDVDLCFLTSTATDLYDN

SEQ ID NO: 1674588 - protein, 24 aa, Staphylococcus aureus
PTLRLKRDLIREFIDNVVPSLNKD

SEQ ID NO: 1674589 - protein, 19 aa, Staphylococcus aureus
QGLKCCLNASIISRELLTS

SEQ ID NO: 1674590 - protein, 20 aa, Staphylococcus aureus
RAVDVLKRVDMIACEDTRVT

SEQ ID NO: 1674591 - protein, 17 aa, Staphylococcus aureus
RDLFKYIPFDGSIITIS

SEQ ID NO: 1674592 - protein, 20 aa, Staphylococcus aureus
RKPYSVILFDEIEKAHPDVF

SEQ ID NO: 1674593 - protein, 23 aa, Staphylococcus aureus
RNGPTGTVKLHFMKQYNKFTDID

SEQ ID NO: 1674594 - protein, 18 aa, Staphylococcus aureus
SMMFYTCILDMIKYEESS

SEQ ID NO: 1674595 - protein, 19 aa, Staphylococcus aureus
SRIYAKFGKEIYVAAKSGE

SEQ ID NO: 1674596 - protein, 23 aa, Staphylococcus aureus
VEFYPVLCGTAFKNKGVQLMLDA

SEQ ID NO: 1674597 - protein, 17 aa, Staphylococcus aureus
VELIAPIAIEDGTRFSI

SEQ ID NO: 1674598 - protein, 19 aa, Staphylococcus aureus
VEVAFRLGIDTRKNDQQIR

SEQ ID NO: 1674599 - protein, 24 aa, Staphylococcus aureus
VIVFKYAGAYGWSISHHDFLSHPH

SEQ ID NO: 1674600 - protein, 18 aa, Staphylococcus aureus
VRLPDNFKTYCAKMSIKT

SEQ ID NO: 1674601 - protein, 24 aa, Staphylococcus aureus
YETFLKNEIARWIKIQEDIGLDVL

SEQ ID NO: 1674602 - protein, 22 aa, Staphylococcus aureus
YMRIAIELHLKRLIVGGLEKVY

SEQ ID NO: 1674603 - protein, 19 aa, Staphylococcus aureus
YYLPDVLSLILNDGGIVEV

SEQ ID NO: 1674604 - protein, 22 aa, Staphylococcus aureus
AAIFAGDLMRMYSKYAESQGFK

SEQ ID NO: 1674605 - protein, 20 aa, Staphylococcus aureus
AFNFVCTFLAKAIARDGEGA

SEQ ID NO: 1674606 - protein, 23 aa, Staphylococcus aureus
AKELKGAHIFLDMVSVGATINIM

SEQ ID NO: 1674607 - protein, 19 aa, Staphylococcus aureus
ARRGELVSCFLLEVDDSLN

SEQ ID NO: 1674608 - protein, 17 aa, Staphylococcus aureus
ARTIFLFGFGASSLTIG

SEQ ID NO: 1674609 - protein, 21 aa, Staphylococcus aureus
ASKEELCIRVEFFGDEIDRIR

SEQ ID NO: 1674610 - protein, 25 aa, Staphylococcus aureus
ATATYKFAGGKGINVSRVLKTLDVE

SEQ ID NO: 1674611 - protein, 22 aa, Staphylococcus aureus
ATDLRAAAALILAGLVADGKTS

SEQ ID NO: 1674612 - protein, 17 aa, Staphylococcus aureus
ATFTLAVNRTFTNAQGE

SEQ ID NO: 1674613 - protein, 23 aa, Staphylococcus aureus
AVAEMKLAVGLLVDKKLSHMRIH

SEQ ID NO: 1674614 - protein, 25 aa, Staphylococcus aureus
CGVGIPGELCTSGFGLAAGYLNQPE

SEQ ID NO: 1674615 - protein, 21 aa, Staphylococcus aureus
CPEFTSLCPITGQPDFATIYI

SEQ ID NO: 1674616 - protein, 18 aa, Staphylococcus aureus
DERAKAGLFLAMQYPSEI

SEQ ID NO: 1674617 - protein, 31 aa, Staphylococcus aureus
DIDRALVWGFNWKLGPFQLWDAMGYERVKTR

SEQ ID NO: 1674618 - protein, 21 aa, Staphylococcus aureus
DVMQRLKFHYYFIDIENSKTA

SEQ ID NO: 1674619 - protein, 23 aa, Staphylococcus aureus
EADLKADIILTMSYSHKELIEAH

SEQ ID NO: 1674620 - protein, 19 aa, Staphylococcus aureus
EALHKLGFDEGMYDLIKEP

SEQ ID NO: 1674621 - protein, 17 aa, Staphylococcus aureus
EGIAAKVLESFNITEDK

SEQ ID NO: 1674622 - protein, 17 aa, Staphylococcus aureus
EGIKFIGPHLEHLDMFG

SEQ ID NO: 1674623 - protein, 20 aa, Staphylococcus aureus
EIRRFLPRKVRTFQLQEAQR

SEQ ID NO: 1674624 - protein, 17 aa, Staphylococcus aureus
ENPRFVEDLIRLIAADL

SEQ ID NO: 1674625 - protein, 23 aa, Staphylococcus aureus
EPYRIGLKLSNGGWVYVQGLTHF

SEQ ID NO: 1674626 - protein, 25 aa, Staphylococcus aureus
FASDWSEVRPEWGLAKNASFIIGRR

SEQ ID NO: 1674627 - protein, 18 aa, Staphylococcus aureus
FDRVKVVVATNAFGMGID

SEQ ID NO: 1674628 - protein, 22 aa, Staphylococcus aureus
FFPENRVEYFVSYYDYYQPEAY

SEQ ID NO: 1674629 - protein, 18 aa, Staphylococcus aureus
FGRIGRLAFRRIQEVEGL

SEQ ID NO: 1674630 - protein, 23 aa, Staphylococcus aureus
FLNVGENLWGLRDWYSVDDIEEK

SEQ ID NO: 1674631 - protein, 17 aa, Staphylococcus aureus
FRGKRPFTFTNLKTDEG

SEQ ID NO: 1674632 - protein, 17 aa, Staphylococcus aureus
FSLEMWGGATFDVAYNF

SEQ ID NO: 1674633 - protein, 25 aa, Staphylococcus aureus
GATTFKESLRWGTEIFHNLKSILSK

SEQ ID NO: 1674634 - protein, 18 aa, Staphylococcus aureus
GHSVRFGKPKAFAEVNGE

SEQ ID NO: 1674635 - protein, 23 aa, Staphylococcus aureus
GKGCNVCKHTGWIEILGAGMVHP

SEQ ID NO: 1674636 - protein, 22 aa, Staphylococcus aureus
GKQTEMFARFSTVAGERGAADA

SEQ ID NO: 1674637 - protein, 19 aa, Staphylococcus aureus
GLECARGLLDQGMEVTVLH

SEQ ID NO: 1674638 - protein, 17 aa, Staphylococcus aureus
GTPWLDQKHTVFGQIID

SEQ ID NO: 1674639 - protein, 23 aa, Staphylococcus aureus
GVLKRPQIFYAYDLDKYGDELRG

SEQ ID NO: 1674640 - protein, 18 aa, Staphylococcus aureus
GVSYCAVCDGAFFKNKRL

SEQ ID NO: 1674641 - protein, 19 aa, Staphylococcus aureus
GYHPTWKMVLGLFPKEDKI

SEQ ID NO: 1674642 - protein, 22 aa, Staphylococcus aureus
HFARKVSNHWLRLMSVNEEGRF

SEQ ID NO: 1674643 - protein, 23 aa, Staphylococcus aureus
IALLRYGGGISYQLLDDHSNYIS

SEQ ID NO: 1674644 - protein, 27 aa, Staphylococcus aureus
ICHCLKRSETIFIYGFGASFVVATDLY

SEQ ID NO: 1674645 - protein, 17 aa, Staphylococcus aureus
ICSAGLYALVNGDIVEG

SEQ ID NO: 1674646 - protein, 18 aa, Staphylococcus aureus
IFKKRDSMNWNEITQGIE

SEQ ID NO: 1674647 - protein, 20 aa, Staphylococcus aureus
IMIYEAFGWEPPRFGHMSLI

SEQ ID NO: 1674648 - protein, 18 aa, Staphylococcus aureus
IVKTRFGGYDGKGQVLIN

SEQ ID NO: 1674649 - protein, 19 aa, Staphylococcus aureus
KAFAPVREWAWSREEEIDY

SEQ ID NO: 1674650 - protein, 22 aa, Staphylococcus aureus
KFRGIRSNIMFSKANGEVKRLL

SEQ ID NO: 1674651 - protein, 18 aa, Staphylococcus aureus
KHHLRVVGGFQFSSHKSD

SEQ ID NO: 1674652 - protein, 18 aa, Staphylococcus aureus
KIALFAGIDKCRFKRQVV

SEQ ID NO: 1674653 - protein, 23 aa, Staphylococcus aureus
KINELRIGETLFRGVDTTTNQAI

SEQ ID NO: 1674654 - protein, 19 aa, Staphylococcus aureus
KIVSDLCYKQSDLVQHIKV

SEQ ID NO: 1674655 - protein, 21 aa, Staphylococcus aureus
KKDFTGISFLNLVDFDALYGH

SEQ ID NO: 1674656 - protein, 26 aa, Staphylococcus aureus
KMNGREVFKFAVRIMGDASTRVVEKA

SEQ ID NO: 1674657 - protein, 20 aa, Staphylococcus aureus
KQQPSPDCLMLFQHHNLLPW

SEQ ID NO: 1674658 - protein, 21 aa, Staphylococcus aureus
KQRVTEMLEFVGLSDKKDQFP

SEQ ID NO: 1674659 - protein, 21 aa, Staphylococcus aureus
KRLKIPVFHMEAGNRCFDQNV

SEQ ID NO: 1674660 - protein, 20 aa, Staphylococcus aureus
KRYLECFTEEKMIKEVEDVY

SEQ ID NO: 1674661 - protein, 19 aa, Staphylococcus aureus
LDPSLPIDLIIDYAHTADG

SEQ ID NO: 1674662 - protein, 17 aa, Staphylococcus aureus
LKSIPIFMYKIAKAKRK

SEQ ID NO: 1674663 - protein, 17 aa, Staphylococcus aureus
LKYAVAVFLKIIELEQV

SEQ ID NO: 1674664 - protein, 19 aa, Staphylococcus aureus
LQLPVNIVGVLACAENMIN

SEQ ID NO: 1674665 - protein, 17 aa, Staphylococcus aureus
LQMAHEFCPYSKATQGN

SEQ ID NO: 1674666 - protein, 17 aa, Staphylococcus aureus
LRCIPQIHGASFQVFNY

SEQ ID NO: 1674667 - protein, 17 aa, Staphylococcus aureus
LRMKACRVLVNTPSAVG

SEQ ID NO: 1674668 - protein, 18 aa, Staphylococcus aureus
MLFRGVHYEICCIDNKGY

SEQ ID NO: 1674669 - protein, 22 aa, Staphylococcus aureus
NKAEKCTFCFPRIEAGMPTVCS

SEQ ID NO: 1674670 - protein, 25 aa, Staphylococcus aureus
NLPEEMNPFLGYRAIRLCLAQQDIF

SEQ ID NO: 1674671 - protein, 18 aa, Staphylococcus aureus
PEIYKAVKAEVLFNKVAM

SEQ ID NO: 1674672 - protein, 18 aa, Staphylococcus aureus
PIEIPNFKFGKRVIDSTG

SEQ ID NO: 1674673 - protein, 20 aa, Staphylococcus aureus
PQGEFKRFLISNSREKQGIL

SEQ ID NO: 1674674 - protein, 23 aa, Staphylococcus aureus
PSNKIWLDPGIGFAKTRNEEAEV

SEQ ID NO: 1674675 - protein, 18 aa, Staphylococcus aureus
QNDFLFDRVKVVVATNAF

SEQ ID NO: 1674676 - protein, 18 aa, Staphylococcus aureus
RANAILLPHIIRYNAKDP

SEQ ID NO: 1674677 - protein, 21 aa, Staphylococcus aureus
RELQSRLGITFIFVTHDQEEA

SEQ ID NO: 1674678 - protein, 17 aa, Staphylococcus aureus
RKMREVSNVPILFLSSR

SEQ ID NO: 1674679 - protein, 17 aa, Staphylococcus aureus
SKCLIILTTHHLDEVEA

SEQ ID NO: 1674680 - protein, 19 aa, Staphylococcus aureus
SPFHWRLLDKITLSTLYEV

SEQ ID NO: 1674681 - protein, 19 aa, Staphylococcus aureus
THCGICSAGLYALVNGDIV

SEQ ID NO: 1674682 - protein, 17 aa, Staphylococcus aureus
TIHRFTRKLGFDGYSDF

SEQ ID NO: 1674683 - protein, 24 aa, Staphylococcus aureus
TIMGVFLRYCLKLDEALKHNIGNC

SEQ ID NO: 1674684 - protein, 24 aa, Staphylococcus aureus
TTLGLRWLVNYARLRGEKTMEDRL

SEQ ID NO: 1674685 - protein, 19 aa, Staphylococcus aureus
TVNVAKWFVGDYMTSLDMQ

SEQ ID NO: 1674686 - protein, 25 aa, Staphylococcus aureus
TYTMPCARTLVPVKVPLDVTTTEVF

SEQ ID NO: 1674687 - protein, 19 aa, Staphylococcus aureus
VAGRGELHLSILIENMRRE

SEQ ID NO: 1674688 - protein, 25 aa, Staphylococcus aureus
VAWNFPMLLAAWKIAPAIAAGNTIV

SEQ ID NO: 1674689 - protein, 20 aa, Staphylococcus aureus
VDGKRSLLFGPFAGFSPKFL

SEQ ID NO: 1674690 - protein, 17 aa, Staphylococcus aureus
VELRPASLDDLGLEAAF

SEQ ID NO: 1674691 - protein, 18 aa, Staphylococcus aureus
VFRSLGILQNCRMITMEE

SEQ ID NO: 1674692 - protein, 18 aa, Staphylococcus aureus
VHLSRFAEEIIFWSTDEA

SEQ ID NO: 1674693 - protein, 21 aa, Staphylococcus aureus
VIDVIKRPLIIHGKVKDNDDI

SEQ ID NO: 1674694 - protein, 24 aa, Staphylococcus aureus
VKDMYRRVNFLFGDIVKVTPSSKV

SEQ ID NO: 1674695 - protein, 23 aa, Staphylococcus aureus
VKNFRVTKIFGYFGLKRLEIEEA

SEQ ID NO: 1674696 - protein, 18 aa, Staphylococcus aureus
VQSCKDCFLESMQVQATN

SEQ ID NO: 1674697 - protein, 22 aa, Staphylococcus aureus
VRMAQDFSYRYPLVDGQGNFGS

SEQ ID NO: 1674698 - protein, 17 aa, Staphylococcus aureus
VSIAWMFESCGRCEYCT

SEQ ID NO: 1674699 - protein, 24 aa, Staphylococcus aureus
VSPSEFKFGLSFLTRSIALARFPW

SEQ ID NO: 1674700 - protein, 18 aa, Staphylococcus aureus
VTLGHEFSGEIVEVGADV

SEQ ID NO: 1674701 - protein, 18 aa, Staphylococcus aureus
VTTMAITVAREFKTENIV

SEQ ID NO: 1674702 - protein, 18 aa, Staphylococcus aureus
WGGATFDVAYNFLKENPW

SEQ ID NO: 1674703 - protein, 17 aa, Staphylococcus aureus
YDIAGLRMMCQFVEDID

SEQ ID NO: 1674704 - protein, 22 aa, Staphylococcus aureus
YDYKRLHLFLTLTKEDGTLAST

SEQ ID NO: 1674705 - protein, 19 aa, Staphylococcus aureus
YELAKEFAEEAGFPLMIKA

SEQ ID NO: 1674706 - protein, 18 aa, Staphylococcus aureus
YPEFHIWDAYSIYQLEES

SEQ ID NO: 1674707 - protein, 17 aa, Staphylococcus aureus
YRSSGGFGVRLDAGDGF

SEQ ID NO: 1674708 - protein, 23 aa, Staphylococcus aureus
YTTRLGIRLEKTFEYIDTPHKFK

SEQ ID NO: 1674709 - protein, 25 aa, Staphylococcus aureus
YVTKFSMKWFLAMPRAKAWMINTRT

SEQ ID NO: 1674710 - protein, 21 aa, Staphylococcus aureus
AALKAGITLFQFREKGESALK

SEQ ID NO: 1674711 - protein, 18 aa, Staphylococcus aureus
AALMFPSGNKFYDWIYST

SEQ ID NO: 1674712 - protein, 17 aa, Staphylococcus aureus
AAYPINHIDNIVVPSKA

SEQ ID NO: 1674713 - protein, 19 aa, Staphylococcus aureus
AEHKIKCFLQVNVSGEASK

SEQ ID NO: 1674714 - protein, 21 aa, Staphylococcus aureus
AEYSVSIALQLVRRFPDIERR

SEQ ID NO: 1674715 - protein, 20 aa, Staphylococcus aureus
AGFWQRCYQEGVIADLQLKN

SEQ ID NO: 1674716 - protein, 17 aa, Staphylococcus aureus
AGVRRIEALTGKAAFLY

SEQ ID NO: 1674717 - protein, 20 aa, Staphylococcus aureus
AHMMIWEGIELIPVVSSNKK

SEQ ID NO: 1674718 - protein, 17 aa, Staphylococcus aureus
ALLEMYQGFFLAPHVVS

SEQ ID NO: 1674719 - protein, 17 aa, Staphylococcus aureus
APIGRPSPMSPWGKPTL

SEQ ID NO: 1674720 - protein, 20 aa, Staphylococcus aureus
ARKGLPYVFAGHFAPQQMKE

SEQ ID NO: 1674721 - protein, 18 aa, Staphylococcus aureus
ARRIQFFLSQNFHVAEQF

SEQ ID NO: 1674722 - protein, 22 aa, Staphylococcus aureus
ASEISMMFGIHVDDAEKAVLST

SEQ ID NO: 1674723 - protein, 20 aa, Staphylococcus aureus
ASKFKNLCVVGDSDQSIYGW

SEQ ID NO: 1674724 - protein, 22 aa, Staphylococcus aureus
ATAPLVVLGCIMMRVCHKDTCP

SEQ ID NO: 1674725 - protein, 18 aa, Staphylococcus aureus
ATQSLKWAVEEMERRYKL

SEQ ID NO: 1674726 - protein, 29 aa, Staphylococcus aureus
AVNRIVLKDGWLFRKMRIETMQKVLKYGT

SEQ ID NO: 1674727 - protein, 18 aa, Staphylococcus aureus
CDKFCTYCIVPFTRGKER

SEQ ID NO: 1674728 - protein, 20 aa, Staphylococcus aureus
CGDIAVSVYSGWLAYSTFDH

SEQ ID NO: 1674729 - protein, 18 aa, Staphylococcus aureus
CINSILMSLLYKNHPEEL

SEQ ID NO: 1674730 - protein, 20 aa, Staphylococcus aureus
CSAGSRLLVHEKIYDQLVPR

SEQ ID NO: 1674731 - protein, 18 aa, Staphylococcus aureus
CSEHRMLVDLGRNDIHRV

SEQ ID NO: 1674732 - protein, 27 aa, Staphylococcus aureus
DIEYKFPFGWGELWGIASRTDFDLRKH

SEQ ID NO: 1674733 - protein, 21 aa, Staphylococcus aureus
DKTCETCGAPLIKEGQDIPFE

SEQ ID NO: 1674734 - protein, 17 aa, Staphylococcus aureus
DKVSAKRIIDFLSGTVY

SEQ ID NO: 1674735 - protein, 23 aa, Staphylococcus aureus
DLFTCLRPVRWFKGVPSPVKRPQ

SEQ ID NO: 1674736 - protein, 24 aa, Staphylococcus aureus
DNGIKFFGSDGFKLSDEQENEIEA

SEQ ID NO: 1674737 - protein, 22 aa, Staphylococcus aureus
DSYRYGLKHMMEFYQLDFHGHH

SEQ ID NO: 1674738 - protein, 17 aa, Staphylococcus aureus
DTCKTLESIGCDLLVIR

SEQ ID NO: 1674739 - protein, 18 aa, Staphylococcus aureus
EEKRCPSCHMTLKDIAHV

SEQ ID NO: 1674740 - protein, 24 aa, Staphylococcus aureus
EGMETWDFAHCLPYFKKLEKTYGA

SEQ ID NO: 1674741 - protein, 19 aa, Staphylococcus aureus
EITSIFYPKMFKAHPELLN

SEQ ID NO: 1674742 - protein, 25 aa, Staphylococcus aureus
EKYAMGWHLDGRASAVVGTHTHIQT

SEQ ID NO: 1674743 - protein, 22 aa, Staphylococcus aureus
EKYSRLRSVYKYEIFNEKGELA

SEQ ID NO: 1674744 - protein, 20 aa, Staphylococcus aureus
ELMLRVSAIIRRRKAEIAAI

SEQ ID NO: 1674745 - protein, 20 aa, Staphylococcus aureus
ELRARIRVIERIAKSHQETN

SEQ ID NO: 1674746 - protein, 21 aa, Staphylococcus aureus
ELVDFPALVKEGAFAFTDDGV

SEQ ID NO: 1674747 - protein, 22 aa, Staphylococcus aureus
EQTEVRLVLSFLRAIDNPLQDI

SEQ ID NO: 1674748 - protein, 25 aa, Staphylococcus aureus
ESHACPICGFSIGELEPRMFSFNSP

SEQ ID NO: 1674749 - protein, 20 aa, Staphylococcus aureus
ETDRTGLRIAIELKKDVNSE

SEQ ID NO: 1674750 - protein, 26 aa, Staphylococcus aureus
ETTKWLEDYLRYFKGAIVIISHDRYF

SEQ ID NO: 1674751 - protein, 23 aa, Staphylococcus aureus
ETTVCILEAMKLFNEIQAEISGE

SEQ ID NO: 1674752 - protein, 18 aa, Staphylococcus aureus
EVMSIPTLIVFKDGQPVD

SEQ ID NO: 1674753 - protein, 19 aa, Staphylococcus aureus
FGKFFKLMLNQGINLAPSK

SEQ ID NO: 1674754 - protein, 18 aa, Staphylococcus aureus
FGTIDTWLVWKLSGKAAH

SEQ ID NO: 1674755 - protein, 17 aa, Staphylococcus aureus
FIIGDGIGPDIWKAASR

SEQ ID NO: 1674756 - protein, 17 aa, Staphylococcus aureus
FKRVVNMIIDVYKDFGF

SEQ ID NO: 1674757 - protein, 20 aa, Staphylococcus aureus
FKSSKTILDYVWDQYPLMNE

SEQ ID NO: 1674758 - protein, 17 aa, Staphylococcus aureus
FLLALGLEHLMAVKDNR

SEQ ID NO: 1674759 - protein, 24 aa, Staphylococcus aureus
FNGDIGVIVGIFWAKENALNKDVL

SEQ ID NO: 1674760 - protein, 18 aa, Staphylococcus aureus
FNIARKMGYFDIPKDLLI

SEQ ID NO: 1674761 - protein, 17 aa, Staphylococcus aureus
FQLLFMLAARPKQIFTR

SEQ ID NO: 1674762 - protein, 27 aa, Staphylococcus aureus
FRDEKRPRFGLLRGREFIMKDAYSFHA

SEQ ID NO: 1674763 - protein, 28 aa, Staphylococcus aureus
FRKLNIEWIYRALIDWKRIGRLKSIPIF

SEQ ID NO: 1674764 - protein, 23 aa, Staphylococcus aureus
FVEAYRLLAKIILRLKAFDEFEF

SEQ ID NO: 1674765 - protein, 24 aa, Staphylococcus aureus
FYDRKEIKDLLSYLRIIANSNDDI

SEQ ID NO: 1674766 - protein, 23 aa, Staphylococcus aureus
GAHGEWTALMIFKAYHENNGEGH

SEQ ID NO: 1674767 - protein, 22 aa, Staphylococcus aureus
GDFKAPMGCRSFLPSWKDAEGH

SEQ ID NO: 1674768 - protein, 25 aa, Staphylococcus aureus
GDQAEVIWMSTFHSMCVRILRRDAD

SEQ ID NO: 1674769 - protein, 18 aa, Staphylococcus aureus
GEIDPVIRFYTWNPATLS

SEQ ID NO: 1674770 - protein, 21 aa, Staphylococcus aureus
GEQRISNFLIWQVSYSEFIFN

SEQ ID NO: 1674771 - protein, 18 aa, Staphylococcus aureus
GFVPKFKSYFAIGEQTAR

SEQ ID NO: 1674772 - protein, 18 aa, Staphylococcus aureus
GGYNIWRVVPRAWSHVFL

SEQ ID NO: 1674773 - protein, 22 aa, Staphylococcus aureus
GKEVKRRIFLGTFALSSGYYDA

SEQ ID NO: 1674774 - protein, 18 aa, Staphylococcus aureus
GNVLRFQPPLVITYEQLD

SEQ ID NO: 1674775 - protein, 18 aa, Staphylococcus aureus
GQILRIGHMGKISPFDIL

SEQ ID NO: 1674776 - protein, 17 aa, Staphylococcus aureus
GVYRFKRGFNVQIEELI

SEQ ID NO: 1674777 - protein, 22 aa, Staphylococcus aureus
GWTNIFIYPGFDFKAIDGQITN

SEQ ID NO: 1674778 - protein, 19 aa, Staphylococcus aureus
GYFARPTIFINVDNQMTIA

SEQ ID NO: 1674779 - protein, 19 aa, Staphylococcus aureus
GYFIWSLMDVFSWSNGYEK

SEQ ID NO: 1674780 - protein, 18 aa, Staphylococcus aureus
HHTFFEMLGNFSIGDYFK

SEQ ID NO: 1674781 - protein, 17 aa, Staphylococcus aureus
HLVAPVITDVKAATQSL

SEQ ID NO: 1674782 - protein, 20 aa, Staphylococcus aureus
HPEGIYLSGALLMFAGSKSY

SEQ ID NO: 1674783 - protein, 18 aa, Staphylococcus aureus
HPQLKICACLGLTNDEQA

SEQ ID NO: 1674784 - protein, 22 aa, Staphylococcus aureus
IALARFPWLSANIEYNVTKEPY

SEQ ID NO: 1674785 - protein, 19 aa, Staphylococcus aureus
ICYNTAYKILTMIQKQFDV

SEQ ID NO: 1674786 - protein, 18 aa, Staphylococcus aureus
IDETLCTMWQGFNYEIDM

SEQ ID NO: 1674787 - protein, 18 aa, Staphylococcus aureus
IDVFRIFDSLNWVDQMKV

SEQ ID NO: 1674788 - protein, 18 aa, Staphylococcus aureus
IEFDRSWEKIGVRFVQSL

SEQ ID NO: 1674789 - protein, 17 aa, Staphylococcus aureus
IGIGRVFRGKMRVGDNV

SEQ ID NO: 1674790 - protein, 20 aa, Staphylococcus aureus
IKFSSAWSFLVPEILQIDED

SEQ ID NO: 1674791 - protein, 18 aa, Staphylococcus aureus
IKTGAPLVYELTDDLEVI

SEQ ID NO: 1674792 - protein, 18 aa, Staphylococcus aureus
IKVLQRLSIASGHVGMVG

SEQ ID NO: 1674793 - protein, 24 aa, Staphylococcus aureus
INAFKGVSFGEGFKAAEKPGSEIQ

SEQ ID NO: 1674794 - protein, 17 aa, Staphylococcus aureus
INLLEFRQQMDLLEAIG

SEQ ID NO: 1674795 - protein, 19 aa, Staphylococcus aureus
IRPGIVHRIDMDTSGLLMV

SEQ ID NO: 1674796 - protein, 21 aa, Staphylococcus aureus
ITQNEIVTWILGYTTSIEDMK

SEQ ID NO: 1674797 - protein, 23 aa, Staphylococcus aureus
ITVNRAGSMIGYFLNEGPVTNFE

SEQ ID NO: 1674798 - protein, 19 aa, Staphylococcus aureus
IVVSIPVFLAERVEVLPVE

SEQ ID NO: 1674799 - protein, 23 aa, Staphylococcus aureus
KAAARFGSGWAWLVVNNGQLEIV

SEQ ID NO: 1674800 - protein, 24 aa, Staphylococcus aureus
KDPKRPIGSFIFLGPTGVGKTELA

SEQ ID NO: 1674801 - protein, 18 aa, Staphylococcus aureus
KDYPEVVKKIAFHEPPIN

SEQ ID NO: 1674802 - protein, 18 aa, Staphylococcus aureus
KELIKLVDLPESFLERYP

SEQ ID NO: 1674803 - protein, 23 aa, Staphylococcus aureus
KELPMEYAVEMNRLIKFEMEGSI

SEQ ID NO: 1674804 - protein, 18 aa, Staphylococcus aureus
KFAKAVPLSAVFEAQNLM

SEQ ID NO: 1674805 - protein, 19 aa, Staphylococcus aureus
KGLEFPIVFIMGMEESLFP

SEQ ID NO: 1674806 - protein, 23 aa, Staphylococcus aureus
KHFDLRPAGIIKMLDLKQPIYKQ

SEQ ID NO: 1674807 - protein, 28 aa, Staphylococcus aureus
KIAIPRVRFTTSHPWDFTDHMIDVISEG

SEQ ID NO: 1674808 - protein, 23 aa, Staphylococcus aureus
KMKAKEILDELGILKDGIFTHEI

SEQ ID NO: 1674809 - protein, 20 aa, Staphylococcus aureus
KQADRLGAKFTIVIGDQELE

SEQ ID NO: 1674810 - protein, 17 aa, Staphylococcus aureus
KRIHMIIGTDEESDWKC

SEQ ID NO: 1674811 - protein, 21 aa, Staphylococcus aureus
KRMPFIGLQWIFTRTGAAASN

SEQ ID NO: 1674812 - protein, 20 aa, Staphylococcus aureus
KSAYLVDLLENFVLERGIYG

SEQ ID NO: 1674813 - protein, 17 aa, Staphylococcus aureus
KVFRGKRPFTFTNLKTD

SEQ ID NO: 1674814 - protein, 19 aa, Staphylococcus aureus
LAFKLGRYGGYVLAHNKGE

SEQ ID NO: 1674815 - protein, 19 aa, Staphylococcus aureus
LDQLPCWLTYTNAETHKVI

SEQ ID NO: 1674816 - protein, 19 aa, Staphylococcus aureus
LFDGMAIPTSEDWKKLQQD

SEQ ID NO: 1674817 - protein, 24 aa, Staphylococcus aureus
LHIGHLLPFLTLRRFQEHGHRPIV

SEQ ID NO: 1674818 - protein, 17 aa, Staphylococcus aureus
LIIKFSSAWSFLVPEIL

SEQ ID NO: 1674819 - protein, 19 aa, Staphylococcus aureus
LIKPLGFRTDDKMLKRAGL

SEQ ID NO: 1674820 - protein, 18 aa, Staphylococcus aureus
LIRMMLKDPIVMLADEPT

SEQ ID NO: 1674821 - protein, 23 aa, Staphylococcus aureus
LKDRYEFIGGLSPLAGTTDDQAD

SEQ ID NO: 1674822 - protein, 17 aa, Staphylococcus aureus
LKPFILLVVDRKEEGLK

SEQ ID NO: 1674823 - protein, 19 aa, Staphylococcus aureus
LLESVAFQLGSAIKRIYLT

SEQ ID NO: 1674824 - protein, 20 aa, Staphylococcus aureus
LLFMLAARPKQIFTREQIIE

SEQ ID NO: 1674825 - protein, 19 aa, Staphylococcus aureus
LNMGYRFPTQYGQSGYAAF

SEQ ID NO: 1674826 - protein, 20 aa, Staphylococcus aureus
LRCTACFEMRLDIVAKAAVE

SEQ ID NO: 1674827 - protein, 19 aa, Staphylococcus aureus
LRENIKLFVVIGQLNQLIK

SEQ ID NO: 1674828 - protein, 25 aa, Staphylococcus aureus
LRMEKRYKGPIAFEYTHINNNTERG

SEQ ID NO: 1674829 - protein, 20 aa, Staphylococcus aureus
LRQFFDFITNFGIMIKGTGE

SEQ ID NO: 1674830 - protein, 19 aa, Staphylococcus aureus
LRYPARSGAKIAFYVAQWP

SEQ ID NO: 1674831 - protein, 17 aa, Staphylococcus aureus
LTLSGVFSRAGATYDDI

SEQ ID NO: 1674832 - protein, 18 aa, Staphylococcus aureus
LYFEGVSVFDMLDIVENI

SEQ ID NO: 1674833 - protein, 20 aa, Staphylococcus aureus
MSGNGRFGGHFVLGHVDELG

SEQ ID NO: 1674834 - protein, 17 aa, Staphylococcus aureus
MSRLQHWHSLLKARAIE

SEQ ID NO: 1674835 - protein, 17 aa, Staphylococcus aureus
MTCGVCLEVCPNVTENN

SEQ ID NO: 1674836 - protein, 17 aa, Staphylococcus aureus
MVHELPTFFSSNFDYSE

SEQ ID NO: 1674837 - protein, 25 aa, Staphylococcus aureus
NAESKLTVAMGYRINNEPLLMDIAK

SEQ ID NO: 1674838 - protein, 24 aa, Staphylococcus aureus
NALSWSSAGALGFKGSKKSTPFAA

SEQ ID NO: 1674839 - protein, 25 aa, Staphylococcus aureus
NESRYCPNCGRLLQYDYIHYNQIGH

SEQ ID NO: 1674840 - protein, 22 aa, Staphylococcus aureus
NGVLCGRATWSGAVQVYIEQGE

SEQ ID NO: 1674841 - protein, 24 aa, Staphylococcus aureus
NHPEELRLLLIDPKMVELAPYNGL

SEQ ID NO: 1674842 - protein, 18 aa, Staphylococcus aureus
NKEFQLLFMLAARPKQIF

SEQ ID NO: 1674843 - protein, 19 aa, Staphylococcus aureus
NLLFLSFAGALAYQIGAKH

SEQ ID NO: 1674844 - protein, 23 aa, Staphylococcus aureus
NMIFQFEHLGLWNSGDSHFDVNS

SEQ ID NO: 1674845 - protein, 19 aa, Staphylococcus aureus
NMSGFRVGFAVGNKDMIQA

SEQ ID NO: 1674846 - protein, 26 aa, Staphylococcus aureus
NNVKPNWCPGCGDFSVQAAIQKAAAN

SEQ ID NO: 1674847 - protein, 17 aa, Staphylococcus aureus
NRFKLIILRKGRGLAGT

SEQ ID NO: 1674848 - protein, 20 aa, Staphylococcus aureus
NRYGCVLAIEILELLKDIEL

SEQ ID NO: 1674849 - protein, 18 aa, Staphylococcus aureus
PDVLRFFMISVHYRSPIN

SEQ ID NO: 1674850 - protein, 20 aa, Staphylococcus aureus
PEYGATCGFFPVDDESLKYM

SEQ ID NO: 1674851 - protein, 18 aa, Staphylococcus aureus
PGLLKRLFEQEVPEIYDG

SEQ ID NO: 1674852 - protein, 24 aa, Staphylococcus aureus
PGYEAPCYIAWSGKNRSPLIRVPS

SEQ ID NO: 1674853 - protein, 17 aa, Staphylococcus aureus
PNVAFSMISKFNLFIAL

SEQ ID NO: 1674854 - protein, 23 aa, Staphylococcus aureus
PQLFKQLLMISGFDKYYQIVKCF

SEQ ID NO: 1674855 - protein, 24 aa, Staphylococcus aureus
PQVRKLKEGFFFAALTPTLRHLGK

SEQ ID NO: 1674856 - protein, 17 aa, Staphylococcus aureus
PRSSVCFDAPSWYELVV

SEQ ID NO: 1674857 - protein, 19 aa, Staphylococcus aureus
QGMIGYWLETEINRILTEM

SEQ ID NO: 1674858 - protein, 22 aa, Staphylococcus aureus
QIAKIKGCRVVGIAGGDKKVNY

SEQ ID NO: 1674859 - protein, 19 aa, Staphylococcus aureus
QKFGLRLPGEFNRQQMTEA

SEQ ID NO: 1674860 - protein, 17 aa, Staphylococcus aureus
QNKRPDYIGAFWNVVNW

SEQ ID NO: 1674861 - protein, 18 aa, Staphylococcus aureus
QRHIPMAIATSSVKAEIM

SEQ ID NO: 1674862 - protein, 23 aa, Staphylococcus aureus
RDGLKSECILLFSERDINLHEYF

SEQ ID NO: 1674863 - protein, 19 aa, Staphylococcus aureus
RDHFLRISIDKEGGVDLND

SEQ ID NO: 1674864 - protein, 17 aa, Staphylococcus aureus
REHFAIFPASHFVTREE

SEQ ID NO: 1674865 - protein, 19 aa, Staphylococcus aureus
RFVPFGAYCRQSIENYLEH

SEQ ID NO: 1674866 - protein, 20 aa, Staphylococcus aureus
RGFEIKPEIAGLMLSAIISD

SEQ ID NO: 1674867 - protein, 24 aa, Staphylococcus aureus
RKVAKRLDKIVAILLDTKGPEIRT

SEQ ID NO: 1674868 - protein, 19 aa, Staphylococcus aureus
RNPYSVILFDEIEKANPQI

SEQ ID NO: 1674869 - protein, 19 aa, Staphylococcus aureus
RPIGSFLFVGPTGVGKTEL

SEQ ID NO: 1674870 - protein, 20 aa, Staphylococcus aureus
RQCSIVWGVQPVVKKGRKST

SEQ ID NO: 1674871 - protein, 20 aa, Staphylococcus aureus
RRKAEIAAIMVYEAGKPWDE

SEQ ID NO: 1674872 - protein, 20 aa, Staphylococcus aureus
RSQEVIQVWHAVGAFKTVGF

SEQ ID NO: 1674873 - protein, 20 aa, Staphylococcus aureus
RYLENQIRAAFGFEGTPIHI

SEQ ID NO: 1674874 - protein, 18 aa, Staphylococcus aureus
SCFKCKGKGCNVCKHTGW

SEQ ID NO: 1674875 - protein, 20 aa, Staphylococcus aureus
SEHLELFFSYRLEKGQTGRM

SEQ ID NO: 1674876 - protein, 21 aa, Staphylococcus aureus
SEPKALIGFAGRRVIEQTINE

SEQ ID NO: 1674877 - protein, 22 aa, Staphylococcus aureus
SEPSYRDNIDWGEINQPIDEET

SEQ ID NO: 1674878 - protein, 20 aa, Staphylococcus aureus
SKTEYRGREATDFKEEDIEL

SEQ ID NO: 1674879 - protein, 18 aa, Staphylococcus aureus
SYYTGLFIQCHFAENESR

SEQ ID NO: 1674880 - protein, 26 aa, Staphylococcus aureus
TAMNRKGYYLYGYRHFSSRIKGGHTN

SEQ ID NO: 1674881 - protein, 19 aa, Staphylococcus aureus
TDVLFPWEKLDKVEELKDA

SEQ ID NO: 1674882 - protein, 22 aa, Staphylococcus aureus
TEGRYGTFAKYFTKNDVPTFAI

SEQ ID NO: 1674883 - protein, 25 aa, Staphylococcus aureus
TFDERLRIALQLEKWGVDVIEAGFP

SEQ ID NO: 1674884 - protein, 18 aa, Staphylococcus aureus
TGIGFALSIERLLLALEE

SEQ ID NO: 1674885 - protein, 23 aa, Staphylococcus aureus
TGSVVLPGRFFVDIIKKLPGKDV

SEQ ID NO: 1674886 - protein, 17 aa, Staphylococcus aureus
TLIHLPFDYVFFTGSEN

SEQ ID NO: 1674887 - protein, 18 aa, Staphylococcus aureus
TPELAFKLGRYGGYVLAH

SEQ ID NO: 1674888 - protein, 26 aa, Staphylococcus aureus
TQLICYDLRFPELLRYPARSGAKIAF

SEQ ID NO: 1674889 - protein, 24 aa, Staphylococcus aureus
TRMVKEVLEGAGLDQAITYSLVSK

SEQ ID NO: 1674890 - protein, 25 aa, Staphylococcus aureus
TSIPLWKNQMAIALTLMRQRNAVAA

SEQ ID NO: 1674891 - protein, 19 aa, Staphylococcus aureus
TSLYRPGPMEEIPTYITRR

SEQ ID NO: 1674892 - protein, 22 aa, Staphylococcus aureus
TVSELLSVFGFKVVDADKAARE

SEQ ID NO: 1674893 - protein, 20 aa, Staphylococcus aureus
TYDSLKFAVITPFQGHTEKW

SEQ ID NO: 1674894 - protein, 17 aa, Staphylococcus aureus
TYMPLAIYLSHQLAKRL

SEQ ID NO: 1674895 - protein, 19 aa, Staphylococcus aureus
VATINEFREAKAILLEEKE

SEQ ID NO: 1674896 - protein, 18 aa, Staphylococcus aureus
VDLTLPLVVRLEGTNVEL

SEQ ID NO: 1674897 - protein, 26 aa, Staphylococcus aureus
VEMSRKFGIEVFNVFLSQDPITEDVE

SEQ ID NO: 1674898 - protein, 19 aa, Staphylococcus aureus
VFISWTGKMAEAFVLAHEL

SEQ ID NO: 1674899 - protein, 17 aa, Staphylococcus aureus
VLACILAGVPIKAIIDS

SEQ ID NO: 1674900 - protein, 19 aa, Staphylococcus aureus
VSHLKRFGHHISMQTLYQY

SEQ ID NO: 1674901 - protein, 17 aa, Staphylococcus aureus
VVEKIKVARSFGDLSEN

SEQ ID NO: 1674902 - protein, 17 aa, Staphylococcus aureus
WDGPTMISFCNGDKLGA

SEQ ID NO: 1674903 - protein, 24 aa, Staphylococcus aureus
YADVEFKLYLGLKHISPFIEDAVE

SEQ ID NO: 1674904 - protein, 19 aa, Staphylococcus aureus
YARHGGGCFSGKDPTKVDR

SEQ ID NO: 1674905 - protein, 19 aa, Staphylococcus aureus
YDIIFFWVARMIFQGLEFT

SEQ ID NO: 1674906 - protein, 23 aa, Staphylococcus aureus
YDPRKYLGPAREAIKETVKGKIK

SEQ ID NO: 1674907 - protein, 18 aa, Staphylococcus aureus
YIPYCIEPSLGADRVTLA

SEQ ID NO: 1674908 - protein, 19 aa, Staphylococcus aureus
YKQGHLEPIFILGKNNKQK

SEQ ID NO: 1674909 - protein, 17 aa, Staphylococcus aureus
YLDGLLFDDIPYLEVAQ

SEQ ID NO: 1674910 - protein, 22 aa, Staphylococcus aureus
YQLCKAKGLLSIIDNTFLTPYL

SEQ ID NO: 1674911 - protein, 19 aa, Staphylococcus aureus
YVLRRLLRRAVRFSQTLGI

SEQ ID NO: 1674912 - protein, 18 aa, Staphylococcus aureus
AFESWSLTSKSERAQMLR

SEQ ID NO: 1674913 - protein, 21 aa, Staphylococcus aureus
AGGCFWCMVKPFTSYPGIKSV

SEQ ID NO: 1674914 - protein, 18 aa, Staphylococcus aureus
AKYRGEFEERLKAVLKEV

SEQ ID NO: 1674915 - protein, 20 aa, Staphylococcus aureus
ANLRLVVSIAKRYVGRGMLF

SEQ ID NO: 1674916 - protein, 18 aa, Staphylococcus aureus
AVARDVGRIMGFDEVTLN

SEQ ID NO: 1674917 - protein, 25 aa, Staphylococcus aureus
AVFEMMNWWFDKGIDGFRVDAITHI

SEQ ID NO: 1674918 - protein, 17 aa, Staphylococcus aureus
CFGCKKGGNVFQFTQEI

SEQ ID NO: 1674919 - protein, 20 aa, Staphylococcus aureus
CPAIPCYQCEYCLKGEYARC

SEQ ID NO: 1674920 - protein, 20 aa, Staphylococcus aureus
DELKAHSWGAAKQLDTASHF

SEQ ID NO: 1674921 - protein, 23 aa, Staphylococcus aureus
DHIRHLLEFKACTPIDIDQVEPV

SEQ ID NO: 1674922 - protein, 23 aa, Staphylococcus aureus
DVDVPRTDWDWMIYPQGLYDQIM

SEQ ID NO: 1674923 - protein, 17 aa, Staphylococcus aureus
EAVEMSRKFGIEVFNVF

SEQ ID NO: 1674924 - protein, 23 aa, Staphylococcus aureus
EEMAELYNFLGLTVGLNLNSKTT

SEQ ID NO: 1674925 - protein, 18 aa, Staphylococcus aureus
EGDITWRKVIDGFFSSFK

SEQ ID NO: 1674926 - protein, 18 aa, Staphylococcus aureus
EGHKLIGIRGMPRVGKTE

SEQ ID NO: 1674927 - protein, 21 aa, Staphylococcus aureus
EMAELKLGLKTISFETSTSSV

SEQ ID NO: 1674928 - protein, 20 aa, Staphylococcus aureus
EQWEAMLLGWKVVPSVKSNA

SEQ ID NO: 1674929 - protein, 18 aa, Staphylococcus aureus
EVPAHVQAGWMLTTIASV

SEQ ID NO: 1674930 - protein, 23 aa, Staphylococcus aureus
FILGETLYNFGLMPQGLEVFRVL

SEQ ID NO: 1674931 - protein, 20 aa, Staphylococcus aureus
FKDRIWGGHALKAFNYDIPN

SEQ ID NO: 1674932 - protein, 19 aa, Staphylococcus aureus
FKLALPYLMTAAELDKDKD

SEQ ID NO: 1674933 - protein, 21 aa, Staphylococcus aureus
FRSRFRMLVEAQLDLLKNEDW

SEQ ID NO: 1674934 - protein, 19 aa, Staphylococcus aureus
FTRKLGFDGYSDFKSYLKF

SEQ ID NO: 1674935 - protein, 18 aa, Staphylococcus aureus
GASAVLFGSVNAIIGLTS

SEQ ID NO: 1674936 - protein, 18 aa, Staphylococcus aureus
GDCTICVDRCPTSALVGN

SEQ ID NO: 1674937 - protein, 23 aa, Staphylococcus aureus
GELHLRFQLAFYLFTNRGVICDP

SEQ ID NO: 1674938 - protein, 20 aa, Staphylococcus aureus
GFLALHGFLHLLGYDHMTEA

SEQ ID NO: 1674939 - protein, 17 aa, Staphylococcus aureus
GKSNITDAIKWVLGEQS

SEQ ID NO: 1674940 - protein, 24 aa, Staphylococcus aureus
GVNGIRISIAWSRIFPNGYGEVNP

SEQ ID NO: 1674941 - protein, 19 aa, Staphylococcus aureus
GYASFMLCRDCGYVPQCPN

SEQ ID NO: 1674942 - protein, 22 aa, Staphylococcus aureus
HNPRAQAFYKRHGFKVVGEHHF

SEQ ID NO: 1674943 - protein, 18 aa, Staphylococcus aureus
HSECGWPSFSKALDDDEI

SEQ ID NO: 1674944 - protein, 23 aa, Staphylococcus aureus
HTLDYYAGLSFRTLVPKYPAMSP

SEQ ID NO: 1674945 - protein, 18 aa, Staphylococcus aureus
IGLLKIDFLGLRNLSIIH

SEQ ID NO: 1674946 - protein, 17 aa, Staphylococcus aureus
ILDELKMTLSHVEADEF

SEQ ID NO: 1674947 - protein, 21 aa, Staphylococcus aureus
IPETRRSTILSSKKLGDKVHL

SEQ ID NO: 1674948 - protein, 24 aa, Staphylococcus aureus
IQQAIWYKLLVNLGINSITALGRQ

SEQ ID NO: 1674949 - protein, 19 aa, Staphylococcus aureus
IRLSCKGLQQFSHAKTKQI

SEQ ID NO: 1674950 - protein, 17 aa, Staphylococcus aureus
ISVHYRSPINYNLELVE

SEQ ID NO: 1674951 - protein, 20 aa, Staphylococcus aureus
KDGRQAIQFLKERNLGRATF

SEQ ID NO: 1674952 - protein, 23 aa, Staphylococcus aureus
KLTAKRKLSVFIYSVNDFTDFNA

SEQ ID NO: 1674953 - protein, 24 aa, Staphylococcus aureus
KMGRYGKFMACSNFPDCRNTKAIV

SEQ ID NO: 1674954 - protein, 18 aa, Staphylococcus aureus
KREALEMAERVDLDLVVV

SEQ ID NO: 1674955 - protein, 20 aa, Staphylococcus aureus
KRISMLEVMLPSAIKAKYKK

SEQ ID NO: 1674956 - protein, 21 aa, Staphylococcus aureus
KRLPLYYRFVSSLKSKGIDRV

SEQ ID NO: 1674957 - protein, 18 aa, Staphylococcus aureus
LCGIGMPGELCIAGDSLA

SEQ ID NO: 1674958 - protein, 17 aa, Staphylococcus aureus
LDCKFLSAHFNLMEQLY

SEQ ID NO: 1674959 - protein, 22 aa, Staphylococcus aureus
LFLFELRMQWLNRLEKSSDEAI

SEQ ID NO: 1674960 - protein, 17 aa, Staphylococcus aureus
LKAALLYTLEEECIKQG

SEQ ID NO: 1674961 - protein, 21 aa, Staphylococcus aureus
LKIKYMFPKAHAAAYVLMAVR

SEQ ID NO: 1674962 - protein, 23 aa, Staphylococcus aureus
LLFAILKVRSAPFVILDEVEAAL

SEQ ID NO: 1674963 - protein, 18 aa, Staphylococcus aureus
LLGGTCLHKGCIPTKSLL

SEQ ID NO: 1674964 - protein, 19 aa, Staphylococcus aureus
LLLTFFFKYMKPLVQAGRV

SEQ ID NO: 1674965 - protein, 17 aa, Staphylococcus aureus
LLSHGFVMDGEGKKMSK

SEQ ID NO: 1674966 - protein, 18 aa, Staphylococcus aureus
LMFEEGYRALLPNPLGQT

SEQ ID NO: 1674967 - protein, 17 aa, Staphylococcus aureus
LPRPFFILAPMEDVTDI

SEQ ID NO: 1674968 - protein, 19 aa, Staphylococcus aureus
LRKRIKLVAEKNYDQISSI

SEQ ID NO: 1674969 - protein, 21 aa, Staphylococcus aureus
LRTLLDFRYQRHFKASKGENG

SEQ ID NO: 1674970 - protein, 19 aa, Staphylococcus aureus
MKIQSPRLMLGFKNKPLQE

SEQ ID NO: 1674971 - protein, 21 aa, Staphylococcus aureus
MSHVKHIGKLVLRASDVIEHH

SEQ ID NO: 1674972 - protein, 24 aa, Staphylococcus aureus
NNVKEVIAGFDFTFGKFGKGNMTV

SEQ ID NO: 1674973 - protein, 20 aa, Staphylococcus aureus
PEFIGRVPIVANLETLDVTA

SEQ ID NO: 1674974 - protein, 20 aa, Staphylococcus aureus
PGLTICGGYQFLGKKYITPD

SEQ ID NO: 1674975 - protein, 18 aa, Staphylococcus aureus
PIGSFLFLGPTGVGKTEL

SEQ ID NO: 1674976 - protein, 22 aa, Staphylococcus aureus
PRLVSHATKLLWLGIPDDAIIG

SEQ ID NO: 1674977 - protein, 17 aa, Staphylococcus aureus
PRPIGWISTVSKDGKDN

SEQ ID NO: 1674978 - protein, 19 aa, Staphylococcus aureus
QLESFKLALPYLMTAAELD

SEQ ID NO: 1674979 - protein, 19 aa, Staphylococcus aureus
QPLLKRKYPNISFKYTYID

SEQ ID NO: 1674980 - protein, 18 aa, Staphylococcus aureus
QSYRLVIPSIQFESNLKL

SEQ ID NO: 1674981 - protein, 21 aa, Staphylococcus aureus
REFKQYFPQSGWVEHDANEIW

SEQ ID NO: 1674982 - protein, 19 aa, Staphylococcus aureus
RGGFCYELNTFFKAYLQQK

SEQ ID NO: 1674983 - protein, 19 aa, Staphylococcus aureus
RKGLRTGIVADRIGGQVND

SEQ ID NO: 1674984 - protein, 18 aa, Staphylococcus aureus
RLDHRGGVGADGITGDGA

SEQ ID NO: 1674985 - protein, 23 aa, Staphylococcus aureus
RSYNCLKRAGINSVQELADKSEA

SEQ ID NO: 1674986 - protein, 20 aa, Staphylococcus aureus
RTIRIPVHMVETINKLIRVQ

SEQ ID NO: 1674987 - protein, 18 aa, Staphylococcus aureus
SALYIKHLTAFIDQLISL

SEQ ID NO: 1674988 - protein, 22 aa, Staphylococcus aureus
SHYLKVRPGAFFLTGCGNESKG

SEQ ID NO: 1674989 - protein, 18 aa, Staphylococcus aureus
SKGGFYFTDFRGYSTNPL

SEQ ID NO: 1674990 - protein, 21 aa, Staphylococcus aureus
SNITDAIKWVLGEQSAKSLRG

SEQ ID NO: 1674991 - protein, 21 aa, Staphylococcus aureus
SQFKAGVSVKVFIGGTDIEKD

SEQ ID NO: 1674992 - protein, 19 aa, Staphylococcus aureus
SRAIPIFVFLNDQFEQETV

SEQ ID NO: 1674993 - protein, 24 aa, Staphylococcus aureus
SSGRSPSQLGFRYYVNRLLEQTSH

SEQ ID NO: 1674994 - protein, 18 aa, Staphylococcus aureus
SVVLRPNVAFSMISKFNL

SEQ ID NO: 1674995 - protein, 19 aa, Staphylococcus aureus
TAGPLCYRAEPVGCTATIL

SEQ ID NO: 1674996 - protein, 24 aa, Staphylococcus aureus
TDMIKFKYPRLFENVRLALNDCWP

SEQ ID NO: 1674997 - protein, 23 aa, Staphylococcus aureus
TEGFARCIPMIFLNPAPGQELEN

SEQ ID NO: 1674998 - protein, 17 aa, Staphylococcus aureus
TSVKALLKEAGYNDNID

SEQ ID NO: 1674999 - protein, 18 aa, Staphylococcus aureus
VCGSWNCLSSNFPGKEWT

SEQ ID NO: 1675000 - protein, 24 aa, Staphylococcus aureus
VDIKEVFLKLPIIGTEVYDESNEI

SEQ ID NO: 1675001 - protein, 23 aa, Staphylococcus aureus
VETALKAARRWAYDVKGIEPNKA

SEQ ID NO: 1675002 - protein, 23 aa, Staphylococcus aureus
VHHPNEILECILIEAPDLKNAAS

SEQ ID NO: 1675003 - protein, 19 aa, Staphylococcus aureus
VKFFYKYLKGINVDNIAVI

SEQ ID NO: 1675004 - protein, 18 aa, Staphylococcus aureus
VPEARLLVISPYDKTSVA

SEQ ID NO: 1675005 - protein, 22 aa, Staphylococcus aureus
VVEGPLWIQVHAFEKGVEVTIS

SEQ ID NO: 1675006 - protein, 23 aa, Staphylococcus aureus
WEMIPRCPKCDAPMEVNKRKAEV

SEQ ID NO: 1675007 - protein, 18 aa, Staphylococcus aureus
WFNVICMFREDGIYYYCN

SEQ ID NO: 1675008 - protein, 17 aa, Staphylococcus aureus
WHPRAWEFAPSRVDFPT

SEQ ID NO: 1675009 - protein, 21 aa, Staphylococcus aureus
WRLLPEFWGKGLATEGAKATL

SEQ ID NO: 1675010 - protein, 21 aa, Staphylococcus aureus
WYLDSCLKIKYMFPKAHAAAY

SEQ ID NO: 1675011 - protein, 20 aa, Staphylococcus aureus
YCFDKAFIGMNGLDIELGLT

SEQ ID NO: 1675012 - protein, 17 aa, Staphylococcus aureus
YFHPFRASKKFTIVPSW

SEQ ID NO: 1675013 - protein, 20 aa, Staphylococcus aureus
YGMKVARDLVHISGDTSDYH

SEQ ID NO: 1675014 - protein, 22 aa, Staphylococcus aureus
YKGEPKLGFKEMEEIGLSTGLP

SEQ ID NO: 1675015 - protein, 27 aa, Staphylococcus aureus
YLDLFLIHWPCEADGLFLETYKAMEEL

SEQ ID NO: 1675016 - protein, 21 aa, Staphylococcus aureus
YQFNVPFVVVRAVSDLANGEA

SEQ ID NO: 1675017 - protein, 25 aa, Staphylococcus aureus
AEECAKAESVVICWAMGITQQDIGS

SEQ ID NO: 1675018 - protein, 17 aa, Staphylococcus aureus
AIKRLYGNVKFGVGPVI

SEQ ID NO: 1675019 - protein, 20 aa, Staphylococcus aureus
AKAKDGASCVTYIGPNGAGH

SEQ ID NO: 1675020 - protein, 21 aa, Staphylococcus aureus
AKPRLPFDHVFHHNKYHADKE

SEQ ID NO: 1675021 - protein, 17 aa, Staphylococcus aureus
AYYKYAHEFSGGQRQRV

SEQ ID NO: 1675022 - protein, 17 aa, Staphylococcus aureus
DACSAPGGKACHIAEVL

SEQ ID NO: 1675023 - protein, 20 aa, Staphylococcus aureus
DCKYVLSVASPVFFGKTDDA

SEQ ID NO: 1675024 - protein, 19 aa, Staphylococcus aureus
DKGDSRFYLSLQDELMIRF

SEQ ID NO: 1675025 - protein, 17 aa, Staphylococcus aureus
EDGRFIPTIAFYSPNAL

SEQ ID NO: 1675026 - protein, 17 aa, Staphylococcus aureus
EFRKLGVEYEMAKLKND

SEQ ID NO: 1675027 - protein, 18 aa, Staphylococcus aureus
EHMIRAALEGVLYNLYTV

SEQ ID NO: 1675028 - protein, 17 aa, Staphylococcus aureus
EKLRFSKMFFSSNAVNK

SEQ ID NO: 1675029 - protein, 17 aa, Staphylococcus aureus
ELLRYPYIESFEDVDEV

SEQ ID NO: 1675030 - protein, 18 aa, Staphylococcus aureus
FDDVCAFMVNEGHISTSL

SEQ ID NO: 1675031 - protein, 17 aa, Staphylococcus aureus
FGLGLERTVAWISGVEH

SEQ ID NO: 1675032 - protein, 18 aa, Staphylococcus aureus
FHKDVVIDLVGYRRFGHN

SEQ ID NO: 1675033 - protein, 26 aa, Staphylococcus aureus
FKHEVQCVICLPAALLNENSDAIRLS

SEQ ID NO: 1675034 - protein, 20 aa, Staphylococcus aureus
FPEIIFLDAISLRTFENYTL

SEQ ID NO: 1675035 - protein, 21 aa, Staphylococcus aureus
FRPQLRALLRASVYGKLNIMF

SEQ ID NO: 1675036 - protein, 20 aa, Staphylococcus aureus
FSQEGYSIWFEEFERDQLQR

SEQ ID NO: 1675037 - protein, 18 aa, Staphylococcus aureus
GADLPKVFHYFKEAHPYF

SEQ ID NO: 1675038 - protein, 23 aa, Staphylococcus aureus
GKVARLTQFGAFIDIGGVDGLVH

SEQ ID NO: 1675039 - protein, 17 aa, Staphylococcus aureus
GLGVAKRAQSFGMKILA

SEQ ID NO: 1675040 - protein, 17 aa, Staphylococcus aureus
GNIGRGFIGYILADNNV

SEQ ID NO: 1675041 - protein, 18 aa, Staphylococcus aureus
GYVGHHLFIKLGNYHQTI

SEQ ID NO: 1675042 - protein, 19 aa, Staphylococcus aureus
HIAHPTGRIIGRRDGYKPN

SEQ ID NO: 1675043 - protein, 23 aa, Staphylococcus aureus
HRKKPANGFVCYMIGRLILENCR

SEQ ID NO: 1675044 - protein, 19 aa, Staphylococcus aureus
IAPALATGCSLVMKPSEIT

SEQ ID NO: 1675045 - protein, 19 aa, Staphylococcus aureus
IKKDIGMIFQHFNLLNSAT

SEQ ID NO: 1675046 - protein, 20 aa, Staphylococcus aureus
IVMPRLRITYLNDRIEKLLS

SEQ ID NO: 1675047 - protein, 18 aa, Staphylococcus aureus
KDIADLFLDSGLGKEAYS

SEQ ID NO: 1675048 - protein, 23 aa, Staphylococcus aureus
KEVTRLANHLGWKGKGTNFDVLP

SEQ ID NO: 1675049 - protein, 19 aa, Staphylococcus aureus
KIDRFPIFIPQALINEQIE

SEQ ID NO: 1675050 - protein, 19 aa, Staphylococcus aureus
KIPDEFVVGYGLDYRELYR

SEQ ID NO: 1675051 - protein, 17 aa, Staphylococcus aureus
KKGFLLDGFPRTIEQAE

SEQ ID NO: 1675052 - protein, 19 aa, Staphylococcus aureus
KKRVYDLLETVGLSKEHAN

SEQ ID NO: 1675053 - protein, 21 aa, Staphylococcus aureus
KMKELQDFIARFSANASKSKQ

SEQ ID NO: 1675054 - protein, 17 aa, Staphylococcus aureus
KMYKRFSILTTISKNQP

SEQ ID NO: 1675055 - protein, 18 aa, Staphylococcus aureus
KPDLILLTFPTPVMSVLT

SEQ ID NO: 1675056 - protein, 26 aa, Staphylococcus aureus
KRISNPYLRQMLGYFIKYVGSSSYDA

SEQ ID NO: 1675057 - protein, 21 aa, Staphylococcus aureus
KSFKGSIIFTSYDFEFINTIA

SEQ ID NO: 1675058 - protein, 19 aa, Staphylococcus aureus
KYAESFGAKGLRVTNQEEL

SEQ ID NO: 1675059 - protein, 24 aa, Staphylococcus aureus
LDGATKEFFAWGFRVGFMTFGTSD

SEQ ID NO: 1675060 - protein, 22 aa, Staphylococcus aureus
LESYSYHLGMMFQIKDDLLDCY

SEQ ID NO: 1675061 - protein, 17 aa, Staphylococcus aureus
LINECIYFASKNKKLVR

SEQ ID NO: 1675062 - protein, 21 aa, Staphylococcus aureus
LKGPCYLHYYLQGYDEPMYTR

SEQ ID NO: 1675063 - protein, 20 aa, Staphylococcus aureus
LKTKLWGGQRLSEFGYQLDN

SEQ ID NO: 1675064 - protein, 18 aa, Staphylococcus aureus
LKYIKSLYTELGKITDIV

SEQ ID NO: 1675065 - protein, 23 aa, Staphylococcus aureus
LMCKGDMKRHCNIIIPDKNEYET

SEQ ID NO: 1675066 - protein, 23 aa, Staphylococcus aureus
MILGAVCTRACRFCAVKTGLPNE

SEQ ID NO: 1675067 - protein, 17 aa, Staphylococcus aureus
NELTVCGSWNCLSSNFP

SEQ ID NO: 1675068 - protein, 25 aa, Staphylococcus aureus
NIPKSWKLIAQMPFGDIREAAGEKT

SEQ ID NO: 1675069 - protein, 17 aa, Staphylococcus aureus
NKFKVIGPFVADNYVLS

SEQ ID NO: 1675070 - protein, 18 aa, Staphylococcus aureus
NQIIWGFLHLASSKEIVE

SEQ ID NO: 1675071 - protein, 19 aa, Staphylococcus aureus
NVIKWVHQFIESFGGDANN

SEQ ID NO: 1675072 - protein, 22 aa, Staphylococcus aureus
PKSEWLKRADIYIDGFHNFSTI

SEQ ID NO: 1675073 - protein, 20 aa, Staphylococcus aureus
PRLFEGFSMGNPRIQTGNLL

SEQ ID NO: 1675074 - protein, 20 aa, Staphylococcus aureus
PVYLGMPMGIVFEVEGKTIY

SEQ ID NO: 1675075 - protein, 21 aa, Staphylococcus aureus
QHFNLLWSRTVLKNIMFPLEI

SEQ ID NO: 1675076 - protein, 21 aa, Staphylococcus aureus
QKIVRWRAAMFIFDEGNAEQL

SEQ ID NO: 1675077 - protein, 21 aa, Staphylococcus aureus
QPIIWLCGGLDRGNEFDELIP

SEQ ID NO: 1675078 - protein, 24 aa, Staphylococcus aureus
QYRFKSRIAVWVLNYIKVNEAKLA

SEQ ID NO: 1675079 - protein, 17 aa, Staphylococcus aureus
RGQGVQVVTVFGGMPIE

SEQ ID NO: 1675080 - protein, 18 aa, Staphylococcus aureus
RPLYDGLYTVLGREQTER

SEQ ID NO: 1675081 - protein, 19 aa, Staphylococcus aureus
RRSGLNYTILHPGALTNAA

SEQ ID NO: 1675082 - protein, 23 aa, Staphylococcus aureus
RVAIEMASPLGWHKYVGTAGKVI

SEQ ID NO: 1675083 - protein, 17 aa, Staphylococcus aureus
TGFGPRIVRINNFSVDL

SEQ ID NO: 1675084 - protein, 18 aa, Staphylococcus aureus
VSPYKFLLSHGFVMDGEG

SEQ ID NO: 1675085 - protein, 19 aa, Staphylococcus aureus
WVHQFIESFGGDANNITLM

SEQ ID NO: 1675086 - protein, 19 aa, Staphylococcus aureus
YQCEYCLKGEYARCEKLFV

SEQ ID NO: 1675087 - protein, 20 aa, Staphylococcus aureus
YRKLTCLHVNHGVRSASIEE

SEQ ID NO: 1675088 - protein, 25 aa, Staphylococcus aureus
YSRPRGKFRFPMSVAYENENVEQSA

SEQ ID NO: 1675089 - protein, 22 aa, Staphylococcus aureus
AENFKEAVQWLYLAYLAAIKEQ

SEQ ID NO: 1675090 - protein, 23 aa, Staphylococcus aureus
ALRTLRLVIDMSKEPDLYLQISA

SEQ ID NO: 1675091 - protein, 18 aa, Staphylococcus aureus
ARGAIFGLTRGTEKEHFI

SEQ ID NO: 1675092 - protein, 19 aa, Staphylococcus aureus
CATLAWKALEKGTVAKEGK

SEQ ID NO: 1675093 - protein, 18 aa, Staphylococcus aureus
CCQSCRWDYELLEVDDNG

SEQ ID NO: 1675094 - protein, 23 aa, Staphylococcus aureus
DDYKAGQIIGEWIGQQGYQQVEV

SEQ ID NO: 1675095 - protein, 20 aa, Staphylococcus aureus
DELYHLFVLMHALGVDFSEI

SEQ ID NO: 1675096 - protein, 19 aa, Staphylococcus aureus
DIIDEFRALGDYEYEEIEN

SEQ ID NO: 1675097 - protein, 24 aa, Staphylococcus aureus
DNPRFKRWVIGSILSRTYYHNMVT

SEQ ID NO: 1675098 - protein, 20 aa, Staphylococcus aureus
EIFWPGPLNIILKNKTSYNY

SEQ ID NO: 1675099 - protein, 20 aa, Staphylococcus aureus
EIPHAIGVNVDRMVKESEDR

SEQ ID NO: 1675100 - protein, 21 aa, Staphylococcus aureus
EKSLKRTPSFSVNRPGEETGV

SEQ ID NO: 1675101 - protein, 25 aa, Staphylococcus aureus
FFRPEFLNRFNGIVEFLHLDKDALQ

SEQ ID NO: 1675102 - protein, 17 aa, Staphylococcus aureus
FMLKVFLDLKFVTQEDG

SEQ ID NO: 1675103 - protein, 24 aa, Staphylococcus aureus
FPGVKGEVLVNAFSKYDIMISTTS

SEQ ID NO: 1675104 - protein, 21 aa, Staphylococcus aureus
HLQMAPKHWLCINEDDLVWAT

SEQ ID NO: 1675105 - protein, 18 aa, Staphylococcus aureus
IDKLICSWLKQIDNVIPQ

SEQ ID NO: 1675106 - protein, 19 aa, Staphylococcus aureus
IDYPIAIVFQASCFNEFVV

SEQ ID NO: 1675107 - protein, 22 aa, Staphylococcus aureus
IFNEWQIPIIFVTHSNYEAEQM

SEQ ID NO: 1675108 - protein, 18 aa, Staphylococcus aureus
IKPPFFIQWEESDSMRTK

SEQ ID NO: 1675109 - protein, 20 aa, Staphylococcus aureus
KEAAMLAGYFSKAGNSGQIP

SEQ ID NO: 1675110 - protein, 18 aa, Staphylococcus aureus
KFLKSFFNEHPFIDVSLH

SEQ ID NO: 1675111 - protein, 17 aa, Staphylococcus aureus
KGNHIYNGLDMFVYQGA

SEQ ID NO: 1675112 - protein, 17 aa, Staphylococcus aureus
KKGTLLWLMDETKTPMG

SEQ ID NO: 1675113 - protein, 19 aa, Staphylococcus aureus
KLGVKVWIYRGEVLPTKNT

SEQ ID NO: 1675114 - protein, 17 aa, Staphylococcus aureus
KRIIDFLSGTVYAIGGD

SEQ ID NO: 1675115 - protein, 17 aa, Staphylococcus aureus
KVLILMGVPGSYLVATD

SEQ ID NO: 1675116 - protein, 20 aa, Staphylococcus aureus
LPYRRVILCTGDIGFSASKT

SEQ ID NO: 1675117 - protein, 17 aa, Staphylococcus aureus
LTNIKAFQHDATKPYDK

SEQ ID NO: 1675118 - protein, 18 aa, Staphylococcus aureus
LWTLAQEVYQEWYLGSKL

SEQ ID NO: 1675119 - protein, 18 aa, Staphylococcus aureus
MGTTCVCALVFEKSVVIA

SEQ ID NO: 1675120 - protein, 21 aa, Staphylococcus aureus
PFFGICLGHQLFALSQGASSF

SEQ ID NO: 1675121 - protein, 20 aa, Staphylococcus aureus
PSFMEMCLLLPTLNEEQYGS

SEQ ID NO: 1675122 - protein, 20 aa, Staphylococcus aureus
RETLEIYAPLAHRLGINTIK

SEQ ID NO: 1675123 - protein, 17 aa, Staphylococcus aureus
RGTAILITGGFKPSNKV

SEQ ID NO: 1675124 - protein, 22 aa, Staphylococcus aureus
RHFGENRLEGFFQKKEALPSDA

SEQ ID NO: 1675125 - protein, 21 aa, Staphylococcus aureus
RIAPRKVRLVLDLIRGKNAAE

SEQ ID NO: 1675126 - protein, 18 aa, Staphylococcus aureus
RTLKFFKYFYTHRGPVMD

SEQ ID NO: 1675127 - protein, 22 aa, Staphylococcus aureus
SGGKRVRPAFVILSSQFGKDEQ

SEQ ID NO: 1675128 - protein, 22 aa, Staphylococcus aureus
SIRAGSIYGVIGFSGAGKSTLI

SEQ ID NO: 1675129 - protein, 17 aa, Staphylococcus aureus
TKLKLAIDYGKHDSIGI

SEQ ID NO: 1675130 - protein, 26 aa, Staphylococcus aureus
TLKLFKVCKMRGIPIFTFINKLDRVG

SEQ ID NO: 1675131 - protein, 17 aa, Staphylococcus aureus
TLLTIGRFPICYINIEM

SEQ ID NO: 1675132 - protein, 18 aa, Staphylococcus aureus
TVIKPSFFMDNFLRIAKV

SEQ ID NO: 1675133 - protein, 25 aa, Staphylococcus aureus
VLGMYPKEVQLIGAIVLHEGNIAEM

SEQ ID NO: 1675134 - protein, 23 aa, Staphylococcus aureus
VPGSTLPSVIGWRTIDDTEQMMN

SEQ ID NO: 1675135 - protein, 17 aa, Staphylococcus aureus
VTCTLEYNDDYPALYND

SEQ ID NO: 1675136 - protein, 20 aa, Staphylococcus aureus
YHPDYEFLKSVGIQINTNEF

SEQ ID NO: 1675137 - protein, 18 aa, Staphylococcus aureus
YIMNLPVNFLKTFLPELI

SEQ ID NO: 1675138 - protein, 22 aa, Staphylococcus aureus
YKVHLMKECLDRGIKVISSMGA

SEQ ID NO: 1675139 - protein, 23 aa, Staphylococcus aureus
YMLSGGMLQRLMIALALALKPKL

SEQ ID NO: 1675140 - protein, 24 aa, Staphylococcus aureus
AKGRLPDCLVEWSAKRLKEQGANA

SEQ ID NO: 1675141 - protein, 17 aa, Staphylococcus aureus
CGMGGPLIAKILKDGQD

SEQ ID NO: 1675142 - protein, 20 aa, Staphylococcus aureus
EEILILLTLWQKGSMTLKEM

SEQ ID NO: 1675143 - protein, 17 aa, Staphylococcus aureus
ERLNGTVLWLGESDELY

SEQ ID NO: 1675144 - protein, 21 aa, Staphylococcus aureus
GEPCNECHICKGITQGTNSDV

SEQ ID NO: 1675145 - protein, 17 aa, Staphylococcus aureus
HQWKDWKPLLSDILLYF

SEQ ID NO: 1675146 - protein, 17 aa, Staphylococcus aureus
IGEAVGLASSSTVHGHL

SEQ ID NO: 1675147 - protein, 19 aa, Staphylococcus aureus
IKFLFELQDGYTIETVLMR

SEQ ID NO: 1675148 - protein, 18 aa, Staphylococcus aureus
KAWAKRVYPELSVEEAYI

SEQ ID NO: 1675149 - protein, 19 aa, Staphylococcus aureus
KGLEPLAIWMKARKHEVSI

SEQ ID NO: 1675150 - protein, 20 aa, Staphylococcus aureus
KLDKCFYKYYGLNKLINLLI

SEQ ID NO: 1675151 - protein, 18 aa, Staphylococcus aureus
KLWENMGLSYPELITKLI

SEQ ID NO: 1675152 - protein, 21 aa, Staphylococcus aureus
KTKIKAWVRQLLWMSIYQYVY

SEQ ID NO: 1675153 - protein, 19 aa, Staphylococcus aureus
LIHGFKNYVALLFHKGAIL

SEQ ID NO: 1675154 - protein, 17 aa, Staphylococcus aureus
LKIGDRVSIAWMFESCG

SEQ ID NO: 1675155 - protein, 19 aa, Staphylococcus aureus
LRKAYLESFRKGFKQQIEN

SEQ ID NO: 1675156 - protein, 18 aa, Staphylococcus aureus
NQLLKMFVSTMETRLNDH

SEQ ID NO: 1675157 - protein, 22 aa, Staphylococcus aureus
NYKSEAYVGVWTEESVAVSFLT

SEQ ID NO: 1675158 - protein, 17 aa, Staphylococcus aureus
PDIILRLPHGMPEEVKK

SEQ ID NO: 1675159 - protein, 19 aa, Staphylococcus aureus
PEEYWTIEGEFRYKKSKFN

SEQ ID NO: 1675160 - protein, 18 aa, Staphylococcus aureus
PKYFLPIHGEYRMLKAHG

SEQ ID NO: 1675161 - protein, 17 aa, Staphylococcus aureus
PRISYDDAIEFLKAEGF

SEQ ID NO: 1675162 - protein, 18 aa, Staphylococcus aureus
PSVQIGDPFVGKKLMEAT

SEQ ID NO: 1675163 - protein, 17 aa, Staphylococcus aureus
PSVREIGEAVGLASSST

SEQ ID NO: 1675164 - protein, 18 aa, Staphylococcus aureus
QTHLKWGAQKEVIKLIPG

SEQ ID NO: 1675165 - protein, 19 aa, Staphylococcus aureus
REWGDYGIEEFLEVKSIAG

SEQ ID NO: 1675166 - protein, 20 aa, Staphylococcus aureus
RMLQRPILYTGLTRAKTSLV

SEQ ID NO: 1675167 - protein, 24 aa, Staphylococcus aureus
RMQGYNVLHPMGWDAFGLPAEQYA

SEQ ID NO: 1675168 - protein, 17 aa, Staphylococcus aureus
TDGRMKALVSITLDEAF

SEQ ID NO: 1675169 - protein, 21 aa, Staphylococcus aureus
TKELIDWLKAQSRPFLFSTSL

SEQ ID NO: 1675170 - protein, 20 aa, Staphylococcus aureus
TYRKQFCKLLLKSAKVSVIK

SEQ ID NO: 1675171 - protein, 23 aa, Staphylococcus aureus
VNKSLKGLDGFVVKGKRDRMYIE

SEQ ID NO: 1675172 - protein, 22 aa, Staphylococcus aureus
VSELKNRIPLVLEVKSDQYQSS

SEQ ID NO: 1675173 - protein, 18 aa, Staphylococcus aureus
VVINARLTTHIDLIRGGN

SEQ ID NO: 1675174 - protein, 21 aa, Staphylococcus aureus
WSVHVPRRIKEIGPRIKKVSD

SEQ ID NO: 1675175 - protein, 22 aa, Staphylococcus aureus
YSGEILQGLIFVSSKKEAYDLA

SEQ ID NO: 1675176 - protein, 17 aa, Staphylococcus aureus
AGFELGIATGRPYTETV

SEQ ID NO: 1675177 - protein, 17 aa, Staphylococcus aureus
DKTWSVHVPRRIKEIGP

SEQ ID NO: 1675178 - protein, 25 aa, Staphylococcus aureus
DVDMLRMCRYPWKTKQRILGDMGHV

SEQ ID NO: 1675179 - protein, 24 aa, Staphylococcus aureus
EDIPFSGAFSIEFRLSKQTITCTD

SEQ ID NO: 1675180 - protein, 19 aa, Staphylococcus aureus
EGLKGGGYYVEYRTDDARL

SEQ ID NO: 1675181 - protein, 26 aa, Staphylococcus aureus
EMERRYKLFAHYHVRNITAFNKKAPY

SEQ ID NO: 1675182 - protein, 23 aa, Staphylococcus aureus
GLKRVIDFIEHFGFSESDLEYLK

SEQ ID NO: 1675183 - protein, 21 aa, Staphylococcus aureus
GVAFCPHCDGPLFENKDVAVI

SEQ ID NO: 1675184 - protein, 19 aa, Staphylococcus aureus
IELLKQLQLDFGITYLFIT

SEQ ID NO: 1675185 - protein, 24 aa, Staphylococcus aureus
IKKGWPSMMYRIWKNPEKYKSYFI

SEQ ID NO: 1675186 - protein, 20 aa, Staphylococcus aureus
IPRTLAISVFGEMDVSSIKQ

SEQ ID NO: 1675187 - protein, 18 aa, Staphylococcus aureus
ISKAIATIGHFDLLTIND

SEQ ID NO: 1675188 - protein, 20 aa, Staphylococcus aureus
ISYDDAIEFLKAEGFDDIEW

SEQ ID NO: 1675189 - protein, 18 aa, Staphylococcus aureus
KERTRLRTLFPYINEASE

SEQ ID NO: 1675190 - protein, 18 aa, Staphylococcus aureus
KPYIEGFVKMLAPIAPHI

SEQ ID NO: 1675191 - protein, 18 aa, Staphylococcus aureus
KTKQRILGDMGHVSNEDA

SEQ ID NO: 1675192 - protein, 25 aa, Staphylococcus aureus
KVINMFSFFIAYHFNKLDIGIERIF

SEQ ID NO: 1675193 - protein, 18 aa, Staphylococcus aureus
LEGSFHFETFISLTCQKC

SEQ ID NO: 1675194 - protein, 23 aa, Staphylococcus aureus
LETSLKINNEWLATVENISFELS

SEQ ID NO: 1675195 - protein, 17 aa, Staphylococcus aureus
LILLGIKTRGEYLANRI

SEQ ID NO: 1675196 - protein, 21 aa, Staphylococcus aureus
LKCMKRFGFTASFNRCAVSGN

SEQ ID NO: 1675197 - protein, 18 aa, Staphylococcus aureus
LNGTVLWLGESDELYHPQ

SEQ ID NO: 1675198 - protein, 22 aa, Staphylococcus aureus
PEKWKEFEVIKRQKAIEIANAM

SEQ ID NO: 1675199 - protein, 20 aa, Staphylococcus aureus
PRETMIGSMAYYISHAKNNK

SEQ ID NO: 1675200 - protein, 19 aa, Staphylococcus aureus
PWDVYAFPYYYVYNDFSDH

SEQ ID NO: 1675201 - protein, 21 aa, Staphylococcus aureus
QQGFGRTGTWSSVSHFNFTPD

SEQ ID NO: 1675202 - protein, 17 aa, Staphylococcus aureus
RIFKFYKYFYSHRGPLL

SEQ ID NO: 1675203 - protein, 17 aa, Staphylococcus aureus
RLRPGGKEATDWLIQQG

SEQ ID NO: 1675204 - protein, 22 aa, Staphylococcus aureus
TKGRLQKDLINWFIDDQYKLFY

SEQ ID NO: 1675205 - protein, 18 aa, Staphylococcus aureus
TRIKLKWTPQIMHQIRVL

SEQ ID NO: 1675206 - protein, 21 aa, Staphylococcus aureus
VKRELYDGRGFLSCSRILGEG

SEQ ID NO: 1675207 - protein, 17 aa, Staphylococcus aureus
WMEQLPLTSNGKIDRKK

SEQ ID NO: 1675208 - protein, 20 aa, Staphylococcus aureus
YHDKIKMCTGKSVNQIPGSG

SEQ ID NO: 1675209 - protein, 22 aa, Staphylococcus aureus
EWREPGCSMCLGMNPDQVPEGV

SEQ ID NO: 1675210 - protein, 17 aa, Staphylococcus aureus
FLDRVWRLMVNEDGTLS

SEQ ID NO: 1675211 - protein, 17 aa, Staphylococcus aureus
GKMAEAFVLAHELGHAG

SEQ ID NO: 1675212 - protein, 17 aa, Staphylococcus aureus
GLPEARIPLSQAVIELC

SEQ ID NO: 1675213 - protein, 17 aa, Staphylococcus aureus
HGGIKWYNLVKNIKKDD

SEQ ID NO: 1675214 - protein, 18 aa, Staphylococcus aureus
IHGKELESIFGLSRRQLG

SEQ ID NO: 1675215 - protein, 22 aa, Staphylococcus aureus
ISKSGFGPFAFDEWRYLPDGSD

SEQ ID NO: 1675216 - protein, 19 aa, Staphylococcus aureus
KCIVFGCYENETLIATAAL

SEQ ID NO: 1675217 - protein, 18 aa, Staphylococcus aureus
LESIFGLSRRQLGYRIQK

SEQ ID NO: 1675218 - protein, 17 aa, Staphylococcus aureus
LRKPDWLKIKLNTNENY

SEQ ID NO: 1675219 - protein, 25 aa, Staphylococcus aureus
NNIPMGRGMIKWAPFATLPEQFETI

SEQ ID NO: 1675220 - protein, 22 aa, Staphylococcus aureus
PKLPYTLCYISRGFVVDYSNKE

SEQ ID NO: 1675221 - protein, 18 aa, Staphylococcus aureus
QTSLFEMAEYIGISEPQK

SEQ ID NO: 1675222 - protein, 20 aa, Staphylococcus aureus
RELQDIIAILGMDELSDEDK

SEQ ID NO: 1675223 - protein, 21 aa, Staphylococcus aureus
SFMRPCQLAKMISRYMIINET

SEQ ID NO: 1675224 - protein, 18 aa, Staphylococcus aureus
SRRFLDRVWRLMVNEDGT

SEQ ID NO: 1675225 - protein, 19 aa, Staphylococcus aureus
VRVGMEMDRSELLRKLVDV

SEQ ID NO: 1675226 - protein, 19 aa, Staphylococcus aureus
VSWDYFDIGLFEFDSGYVE

SEQ ID NO: 1675227 - protein, 21 aa, Staphylococcus aureus
WSRLDMGQFLLGGSRFVDSQR

SEQ ID NO: 1675228 - protein, 17 aa, Staphylococcus aureus
WTGKMAEAFVLAHELGH

SEQ ID NO: 1675229 - protein, 21 aa, Staphylococcus aureus
AKKYLWRVLVTQLKKLELNYD

SEQ ID NO: 1675230 - protein, 17 aa, Staphylococcus aureus
AQFYKALGFKINRNPQM

SEQ ID NO: 1675231 - protein, 17 aa, Staphylococcus aureus
AVTRFRQGLGRLIRNEN

SEQ ID NO: 1675232 - protein, 18 aa, Staphylococcus aureus
DTFKILGVGVDFNDEKQP

SEQ ID NO: 1675233 - protein, 24 aa, Staphylococcus aureus
EINPKFKIGTMISHVPIYPYSCHP

SEQ ID NO: 1675234 - protein, 17 aa, Staphylococcus aureus
FRRSQEVIQVWHAVGAF

SEQ ID NO: 1675235 - protein, 23 aa, Staphylococcus aureus
IKPGVKRMEWMLAQFNNPQNNIK

SEQ ID NO: 1675236 - protein, 17 aa, Staphylococcus aureus
KPFVKTKIKAWVRQLLW

SEQ ID NO: 1675237 - protein, 18 aa, Staphylococcus aureus
KPMIRKGPNIKLPSVSLL

SEQ ID NO: 1675238 - protein, 17 aa, Staphylococcus aureus
LNGLAALVTTFGVGELS

SEQ ID NO: 1675239 - protein, 17 aa, Staphylococcus aureus
LRMNYLFDFYQSLLTNK

SEQ ID NO: 1675240 - protein, 20 aa, Staphylococcus aureus
LTGGCPMGPYIVTKDELPLP

SEQ ID NO: 1675241 - protein, 17 aa, Staphylococcus aureus
MGGRVALYYAINGHIPI

SEQ ID NO: 1675242 - protein, 17 aa, Staphylococcus aureus
PFKKIVSDLCYKQSDLV

SEQ ID NO: 1675243 - protein, 17 aa, Staphylococcus aureus
PKMPNTHPLFIGAIVDE

SEQ ID NO: 1675244 - protein, 18 aa, Staphylococcus aureus
QPVELCGTYVLLASEESS

SEQ ID NO: 1675245 - protein, 19 aa, Staphylococcus aureus
RALEEVIYFASYVVVDPGP

SEQ ID NO: 1675246 - protein, 19 aa, Staphylococcus aureus
RDEATWFALMNHLVDVSVK

SEQ ID NO: 1675247 - protein, 18 aa, Staphylococcus aureus
RIPLSQAVIELCLSPKSN

SEQ ID NO: 1675248 - protein, 19 aa, Staphylococcus aureus
RKLSERRIFPAIDIGRSST

SEQ ID NO: 1675249 - protein, 17 aa, Staphylococcus aureus
SGGFGVRLDAGDGFQGA

SEQ ID NO: 1675250 - protein, 18 aa, Staphylococcus aureus
TSEVPSAIFGTMKPKKLE

SEQ ID NO: 1675251 - protein, 18 aa, Staphylococcus aureus
VAMAFGFFDGMHKGHDKV

SEQ ID NO: 1675252 - protein, 21 aa, Staphylococcus aureus
VRLSQDWKLRHVLIEMHGNNG

SEQ ID NO: 1675253 - protein, 20 aa, Staphylococcus aureus
YEIYHPLESVGIYVPGGKAS

SEQ ID NO: 1675254 - protein, 18 aa, Staphylococcus aureus
YNGYKWMEMNGLGSFNTE

SEQ ID NO: 1675255 - protein, 17 aa, Staphylococcus aureus
AELLAPMSAIAGQRSAI

SEQ ID NO: 1675256 - protein, 19 aa, Staphylococcus aureus
DHFRLGISVSKKLGNAVLR

SEQ ID NO: 1675257 - protein, 21 aa, Staphylococcus aureus
DNEGWAHCLTIPRVLNVENGQ

SEQ ID NO: 1675258 - protein, 17 aa, Staphylococcus aureus
DPFTCPHGRPIIINFSK

SEQ ID NO: 1675259 - protein, 20 aa, Staphylococcus aureus
EAAEGLPINVGFTGKGQATN

SEQ ID NO: 1675260 - protein, 18 aa, Staphylococcus aureus
EGELCFGNEPLLRVEAPL

SEQ ID NO: 1675261 - protein, 19 aa, Staphylococcus aureus
FDFLSDIVYQWERFAQQFE

SEQ ID NO: 1675262 - protein, 19 aa, Staphylococcus aureus
FPIFIPQALINEQIEYKII

SEQ ID NO: 1675263 - protein, 17 aa, Staphylococcus aureus
FYLKNWNYAYAYSLKLI

SEQ ID NO: 1675264 - protein, 19 aa, Staphylococcus aureus
FYRPTAVIYDLDFLKTLPF

SEQ ID NO: 1675265 - protein, 20 aa, Staphylococcus aureus
GIPAKARRKGGHPAKRVFQA

SEQ ID NO: 1675266 - protein, 23 aa, Staphylococcus aureus
HAQMKMFLTRLGFGSKMVVTGDQ

SEQ ID NO: 1675267 - protein, 24 aa, Staphylococcus aureus
HIELAAPVSHIWYFKGIPSRMGLL

SEQ ID NO: 1675268 - protein, 19 aa, Staphylococcus aureus
ITFTHEFMFARPIHRTPDM

SEQ ID NO: 1675269 - protein, 17 aa, Staphylococcus aureus
KDRVVVEGVNIMKKHQK

SEQ ID NO: 1675270 - protein, 17 aa, Staphylococcus aureus
KSLDCLIYASGQSLYGV

SEQ ID NO: 1675271 - protein, 18 aa, Staphylococcus aureus
KWIIDHWATHYGLEETET

SEQ ID NO: 1675272 - protein, 20 aa, Staphylococcus aureus
LKRLIVPSIEREIHADLTEK

SEQ ID NO: 1675273 - protein, 17 aa, Staphylococcus aureus
LNGLRVMGKFGDSVTTD

SEQ ID NO: 1675274 - protein, 17 aa, Staphylococcus aureus
LRFDLSKGFPLLTTKKV

SEQ ID NO: 1675275 - protein, 23 aa, Staphylococcus aureus
LSSDWFAELGFTFFNYHYTAKLI

SEQ ID NO: 1675276 - protein, 23 aa, Staphylococcus aureus
LTTGFCLWCQLAFSTYLENATQP

SEQ ID NO: 1675277 - protein, 28 aa, Staphylococcus aureus
MGRPAQCVFLSWNRYLYRNAQNYITSSD

SEQ ID NO: 1675278 - protein, 19 aa, Staphylococcus aureus
RELECPVIALSQLSRGVEQ

SEQ ID NO: 1675279 - protein, 19 aa, Staphylococcus aureus
SDSPGGWQIIGRTPLKVFS

SEQ ID NO: 1675280 - protein, 17 aa, Staphylococcus aureus
TQAPRVLGFDAIGTVEA

SEQ ID NO: 1675281 - protein, 24 aa, Staphylococcus aureus
YQIEYLKEMVTFVVVNRDKNSQNV

SEQ ID NO: 1675282 - protein, 21 aa, Staphylococcus aureus
AGGCFWCMTKPFDTFDGIEKV

SEQ ID NO: 1675283 - protein, 19 aa, Staphylococcus aureus
AGNITAYWKGFKEYHEAKG

SEQ ID NO: 1675284 - protein, 19 aa, Staphylococcus aureus
AYKDGKWKVLMIAAEERYV

SEQ ID NO: 1675285 - protein, 24 aa, Staphylococcus aureus
EDISKWSFQTEMFFLCNRYKQFQD

SEQ ID NO: 1675286 - protein, 23 aa, Staphylococcus aureus
EDRLRSRFEWGLIVDITPPDYET

SEQ ID NO: 1675287 - protein, 22 aa, Staphylococcus aureus
ETEVINVFPIRFIVDKENEVSD

SEQ ID NO: 1675288 - protein, 21 aa, Staphylococcus aureus
FELRKKHILGIVGESGSGKSI

SEQ ID NO: 1675289 - protein, 17 aa, Staphylococcus aureus
FPHRLGHGLGLQEHEYQ

SEQ ID NO: 1675290 - protein, 17 aa, Staphylococcus aureus
GVALPWAISAALVRPNT

SEQ ID NO: 1675291 - protein, 22 aa, Staphylococcus aureus
ILKRGLKVISHFAHKHLAEQKC

SEQ ID NO: 1675292 - protein, 18 aa, Staphylococcus aureus
KIRNEIMETFALNHHQVE

SEQ ID NO: 1675293 - protein, 19 aa, Staphylococcus aureus
KSCVGKEFCRFGTQYTTRL

SEQ ID NO: 1675294 - protein, 19 aa, Staphylococcus aureus
LKNRFKITIAGGQGHLKGQ

SEQ ID NO: 1675295 - protein, 21 aa, Staphylococcus aureus
MQPLYEWLGLTASLGFVDIVD

SEQ ID NO: 1675296 - protein, 25 aa, Staphylococcus aureus
NKSIAQVILRWLVERDIVVLAKSVN

SEQ ID NO: 1675297 - protein, 17 aa, Staphylococcus aureus
QLSLAIGKRGQNARLAA

SEQ ID NO: 1675298 - protein, 20 aa, Staphylococcus aureus
SRLPQDINFFSWLQHVKDSD

SEQ ID NO: 1675299 - protein, 18 aa, Staphylococcus aureus
VAEVDIMYGQGISKEGEL

SEQ ID NO: 1675300 - protein, 18 aa, Staphylococcus aureus
YFEKCLPGYTLINKLHPS

SEQ ID NO: 1675301 - protein, 22 aa, Staphylococcus aureus
YLKREDLQWVRSFKLRGAYNAI

SEQ ID NO: 1675302 - protein, 19 aa, Staphylococcus aureus
DERMPKIVIVIDELADLMM

SEQ ID NO: 1675303 - protein, 23 aa, Staphylococcus aureus
DGDTRGGAALSIRSVTQKPIKFV

SEQ ID NO: 1675304 - protein, 19 aa, Staphylococcus aureus
DNANYFLSLGIKTVLITLG

SEQ ID NO: 1675305 - protein, 17 aa, Staphylococcus aureus
FSRGHFKGNQFPEGVNA

SEQ ID NO: 1675306 - protein, 20 aa, Staphylococcus aureus
FYHPEFKKEYVILAEEGAQS

SEQ ID NO: 1675307 - protein, 17 aa, Staphylococcus aureus
GELFRKNFVGVHDGSTN

SEQ ID NO: 1675308 - protein, 19 aa, Staphylococcus aureus
IINFFSLFSKFVINIPKML

SEQ ID NO: 1675309 - protein, 18 aa, Staphylococcus aureus
IQQAKGWTQVKMKAVLHN

SEQ ID NO: 1675310 - protein, 23 aa, Staphylococcus aureus
KANIPTRIAFMVSSSVDSRTILD

SEQ ID NO: 1675311 - protein, 17 aa, Staphylococcus aureus
KEVALVMMILRLNTLLK

SEQ ID NO: 1675312 - protein, 18 aa, Staphylococcus aureus
KHWLPVDLYIGGVEHAVL

SEQ ID NO: 1675313 - protein, 22 aa, Staphylococcus aureus
KSELGSRMRLRIMPELMYEYDQ

SEQ ID NO: 1675314 - protein, 24 aa, Staphylococcus aureus
LALNDCWPDLIFPESEIAFIVLHF

SEQ ID NO: 1675315 - protein, 17 aa, Staphylococcus aureus
LKPAVIMNEFGKMSVDG

SEQ ID NO: 1675316 - protein, 17 aa, Staphylococcus aureus
LPNGIKISNRFVLSPMT

SEQ ID NO: 1675317 - protein, 19 aa, Staphylococcus aureus
SGAKIAFYVAQWPMSRLQH

SEQ ID NO: 1675318 - protein, 19 aa, Staphylococcus aureus
TMPQTRFVLKKALEQNLKP

SEQ ID NO: 1675319 - protein, 19 aa, Staphylococcus aureus
VEVARLPKDVKVEIELVSK

SEQ ID NO: 1675320 - protein, 23 aa, Staphylococcus aureus
VMSKLRPLLHYARAKDIDNYRTV

SEQ ID NO: 1675321 - protein, 17 aa, Staphylococcus aureus
ACPGFVPLVEQMRYSDP

SEQ ID NO: 1675322 - protein, 17 aa, Staphylococcus aureus
DYDALLIPGGFSPDHLR

SEQ ID NO: 1675323 - protein, 24 aa, Staphylococcus aureus
FYKGEFKSASAFPLPNTEYTPLYL

SEQ ID NO: 1675324 - protein, 17 aa, Staphylococcus aureus
IDFDGWYGYQCADLAVD

SEQ ID NO: 1675325 - protein, 17 aa, Staphylococcus aureus
LKLLVALSNNLDKAEIK

SEQ ID NO: 1675326 - protein, 18 aa, Staphylococcus aureus
LLALPKLGAINVHASLLP

SEQ ID NO: 1675327 - protein, 18 aa, Staphylococcus aureus
LQGYSHRIYCFIRADNEE

SEQ ID NO: 1675328 - protein, 17 aa, Staphylococcus aureus
RLSEVKLGIDLNYIELQ

SEQ ID NO: 1675329 - protein, 30 aa, Staphylococcus aureus
SDIKIRVENVLKICGLYAFRNWPIAALSYG

SEQ ID NO: 1675330 - protein, 18 aa, Staphylococcus aureus
SLYRIVNHWIDFGVDGFR

SEQ ID NO: 1675331 - protein, 23 aa, Staphylococcus aureus
TIMRKRLDMLAAFIESKVPDVEI

SEQ ID NO: 1675332 - protein, 23 aa, Staphylococcus aureus
DEVWKERLELLKPYQVNKEMMDK

SEQ ID NO: 1675333 - protein, 20 aa, Staphylococcus aureus
FKTTMSIVFECHIYTLRQQY

SEQ ID NO: 1675334 - protein, 17 aa, Staphylococcus aureus
GGSVLLGLEGTVVKAHG

SEQ ID NO: 1675335 - protein, 17 aa, Staphylococcus aureus
LKLPMNYVRSSNKSHGK

SEQ ID NO: 1675336 - protein, 19 aa, Staphylococcus aureus
LNEGYQFFGVLYIGAILTK

SEQ ID NO: 1675337 - protein, 24 aa, Staphylococcus aureus
MQAFWPGPISFILPLKPGYLCRKV

SEQ ID NO: 1675338 - protein, 24 aa, Staphylococcus aureus
MRLMWKEMMAILQAFRVPSVNLLQ

SEQ ID NO: 1675339 - protein, 20 aa, Staphylococcus aureus
PKDRRAGVITFNLQDVHPHD

SEQ ID NO: 1675340 - protein, 22 aa, Staphylococcus aureus
PVQSIICYLALHRLHKVPMMME

SEQ ID NO: 1675341 - protein, 19 aa, Staphylococcus aureus
RVSPDLFIKRLNFYDYLLL

SEQ ID NO: 1675342 - protein, 18 aa, Staphylococcus aureus
SGMGRYHGKYSFDTFTHE

SEQ ID NO: 1675343 - protein, 22 aa, Staphylococcus aureus
SVEIAIKMAYQYWKNIDREKYA

SEQ ID NO: 1675344 - protein, 18 aa, Staphylococcus aureus
FDIVIQWGVLALIVIFQP

SEQ ID NO: 1675345 - protein, 21 aa, Staphylococcus aureus
FKKELLSAGIIDDAWLAEIEA

SEQ ID NO: 1675346 - protein, 19 aa, Staphylococcus aureus
FRMIIKQLYFFSVANPNPT

SEQ ID NO: 1675347 - protein, 18 aa, Staphylococcus aureus
GEKARLQLALLMLQRDNV

SEQ ID NO: 1675348 - protein, 18 aa, Staphylococcus aureus
GKHGFAFSSGVAAISAVV

SEQ ID NO: 1675349 - protein, 18 aa, Staphylococcus aureus
KALAKVRMSEIGFILQAT

SEQ ID NO: 1675350 - protein, 17 aa, Staphylococcus aureus
KDAFKLYDTYGFPIELT

SEQ ID NO: 1675351 - protein, 20 aa, Staphylococcus aureus
LFEKHFEPVPGIKMQHSGGH

SEQ ID NO: 1675352 - protein, 18 aa, Staphylococcus aureus
MRCSHCAVGYTLQTVDPE

SEQ ID NO: 1675353 - protein, 17 aa, Staphylococcus aureus
PKLSLPTARSIIAIAVG

SEQ ID NO: 1675354 - protein, 20 aa, Staphylococcus aureus
SQHFPSVFALIGSHSEYDLH

SEQ ID NO: 1675355 - protein, 20 aa, Staphylococcus aureus
VEGVKSIFHVMDFISVDKEN

SEQ ID NO: 1675356 - protein, 17 aa, Staphylococcus aureus
WHRLKYYVVVNHLGHLV

SEQ ID NO: 1675357 - protein, 21 aa, Staphylococcus aureus
YMAKRRIGALIVFEKETGLQD

SEQ ID NO: 1675358 - protein, 17 aa, Staphylococcus aureus
EACARFVDRWQQQRPEI

SEQ ID NO: 1675359 - protein, 19 aa, Staphylococcus aureus
EGCMPFEVMAERGRKTLLF

SEQ ID NO: 1675360 - protein, 25 aa, Staphylococcus aureus
FKVERLKGIFAWGFRFNSDEPEEGL

SEQ ID NO: 1675361 - protein, 23 aa, Staphylococcus aureus
GLAPEAWLECYLDRTLLPILKLF

SEQ ID NO: 1675362 - protein, 19 aa, Staphylococcus aureus
GSLKRLGIDHIDLYQLHGG

SEQ ID NO: 1675363 - protein, 19 aa, Staphylococcus aureus
IGGFKGRKLLANDVITVKI

SEQ ID NO: 1675364 - protein, 18 aa, Staphylococcus aureus
IKLLCHLCQTVGYDQDEF

SEQ ID NO: 1675365 - protein, 22 aa, Staphylococcus aureus
ISKSELLEKVWGYDYYEDANTV

SEQ ID NO: 1675366 - protein, 21 aa, Staphylococcus aureus
LCTTYKMVLDFYIELSSNTVK

SEQ ID NO: 1675367 - protein, 18 aa, Staphylococcus aureus
LKSKKGTLLWLMDETKTP

SEQ ID NO: 1675368 - protein, 18 aa, Staphylococcus aureus
MISRSEFYTAYTPYQPEI

SEQ ID NO: 1675369 - protein, 22 aa, Staphylococcus aureus
NKPEIYICGGTKFLQSMIEALK

SEQ ID NO: 1675370 - protein, 20 aa, Staphylococcus aureus
TETIYRFSLLVPNQAALHYF

SEQ ID NO: 1675371 - protein, 20 aa, Staphylococcus aureus
TLFPNRVDLGLGRAPGTDMM

SEQ ID NO: 1675372 - protein, 20 aa, Staphylococcus aureus
YNGLPHLVAPVITDVKAATQ

SEQ ID NO: 1675373 - protein, 22 aa, Staphylococcus aureus
AGPSWKYLKFIFNKDEEKNNIM

SEQ ID NO: 1675374 - protein, 22 aa, Staphylococcus aureus
AYLKEFTNLYALLIPKMNSMND

SEQ ID NO: 1675375 - protein, 18 aa, Staphylococcus aureus
EHYGLWAFKKVWGTYLSE

SEQ ID NO: 1675376 - protein, 17 aa, Staphylococcus aureus
GSFKWGVTTSLSYFPKD

SEQ ID NO: 1675377 - protein, 17 aa, Staphylococcus aureus
IPFKNVCQAVVYISGQK

SEQ ID NO: 1675378 - protein, 19 aa, Staphylococcus aureus
KRDSMNWNEITQGIEHIPG

SEQ ID NO: 1675379 - protein, 18 aa, Staphylococcus aureus
LAEISVKVFNEFNISERE

SEQ ID NO: 1675380 - protein, 17 aa, Staphylococcus aureus
LEIAEAFVRSGAVDIVV

SEQ ID NO: 1675381 - protein, 21 aa, Staphylococcus aureus
LNPEVIKWAKKVYGLTVLDTW

SEQ ID NO: 1675382 - protein, 20 aa, Staphylococcus aureus
LNRITSAFVRLQYNIDTLHV

SEQ ID NO: 1675383 - protein, 19 aa, Staphylococcus aureus
LRFRYWDCPIGCYEWEDIA

SEQ ID NO: 1675384 - protein, 23 aa, Staphylococcus aureus
NEVLKMPFHYVLSIYQNKNNDIS

SEQ ID NO: 1675385 - protein, 17 aa, Staphylococcus aureus
NYIKARLSEHFEIPYKQ

SEQ ID NO: 1675386 - protein, 18 aa, Staphylococcus aureus
SFLFKAIFNITKLLHIKR

SEQ ID NO: 1675387 - protein, 19 aa, Staphylococcus aureus
SKIKTVLHGLNFSEEDFNK

SEQ ID NO: 1675388 - protein, 20 aa, Staphylococcus aureus
AIQKEYYVGFVIDRATDQVT

SEQ ID NO: 1675389 - protein, 20 aa, Staphylococcus aureus
DRLGFKRIWFTEHHNVPAFA

SEQ ID NO: 1675390 - protein, 17 aa, Staphylococcus aureus
GETIGLFSYGSGSVGEF

SEQ ID NO: 1675391 - protein, 18 aa, Staphylococcus aureus
GVGRRISLHYTRQMVNQA

SEQ ID NO: 1675392 - protein, 17 aa, Staphylococcus aureus
HEVMEKYGLSNIVVHAP

SEQ ID NO: 1675393 - protein, 20 aa, Staphylococcus aureus
KRTRSSLALFIMICTGCRVS

SEQ ID NO: 1675394 - protein, 17 aa, Staphylococcus aureus
LFDAVLMTIKYIMRESK

SEQ ID NO: 1675395 - protein, 22 aa, Staphylococcus aureus
LNKRKSAVMSYEITSTDLEVTY

SEQ ID NO: 1675396 - protein, 21 aa, Staphylococcus aureus
LPESFYRGAHQHIFRAMMHLN

SEQ ID NO: 1675397 - protein, 21 aa, Staphylococcus aureus
LYKDRIPVVIKNTNRPQDKGT

SEQ ID NO: 1675398 - protein, 17 aa, Staphylococcus aureus
QAGETIGLFSYGSGSVG

SEQ ID NO: 1675399 - protein, 18 aa, Staphylococcus aureus
RVLGDIIICTDVAQEQAN

SEQ ID NO: 1675400 - protein, 19 aa, Staphylococcus aureus
SLLPKYRGGAPIHQAIIDG

SEQ ID NO: 1675401 - protein, 21 aa, Staphylococcus aureus
VAADIYRPAAINQLQTVGKQI

SEQ ID NO: 1675402 - protein, 21 aa, Staphylococcus aureus
WPIGMGQSFFGIIDRKSKTIE

SEQ ID NO: 1675403 - protein, 18 aa, Staphylococcus aureus
IKSAVKIGDQCPICGNEI

SEQ ID NO: 1675404 - protein, 18 aa, Staphylococcus aureus
KPEAWGWEQFTSQIALGR

SEQ ID NO: 1675405 - protein, 20 aa, Staphylococcus aureus
KYWAELKDVFELFDVEMPIV

SEQ ID NO: 1675406 - protein, 21 aa, Staphylococcus aureus
LELAEQMGIIFIDEIDKVATN

SEQ ID NO: 1675407 - protein, 23 aa, Staphylococcus aureus
QAKKRKKACIIVTHDERLKAYCD

SEQ ID NO: 1675408 - protein, 21 aa, Staphylococcus aureus
QSGYLPLEWINKWKHYSSELL

SEQ ID NO: 1675409 - protein, 17 aa, Staphylococcus aureus
SAGSRILVQNSIKDKFE

SEQ ID NO: 1675410 - protein, 18 aa, Staphylococcus aureus
SVLPARFPNLLANGASGI

SEQ ID NO: 1675411 - protein, 23 aa, Staphylococcus aureus
TASERWMRMGILGVEMESAALYM

SEQ ID NO: 1675412 - protein, 17 aa, Staphylococcus aureus
WMEMNGLGSFNTEILPK

SEQ ID NO: 1675413 - protein, 18 aa, Staphylococcus aureus
WVYEMLGMDSTCPKDVLT

SEQ ID NO: 1675414 - protein, 17 aa, Staphylococcus aureus
YLCPCLGYPRQWRSEDI

SEQ ID NO: 1675415 - protein, 23 aa, Staphylococcus aureus
DLSRGCSIEDVYNLSIITAAQAL

SEQ ID NO: 1675416 - protein, 18 aa, Staphylococcus aureus
DRYPKLNMIIGHWGEFIP

SEQ ID NO: 1675417 - protein, 19 aa, Staphylococcus aureus
ELKVSFDYIDWINTEFDQL

SEQ ID NO: 1675418 - protein, 20 aa, Staphylococcus aureus
EPIIPFIIGDGIGPDIWKAA

SEQ ID NO: 1675419 - protein, 17 aa, Staphylococcus aureus
INQFEWRDAKFPVVQNV

SEQ ID NO: 1675420 - protein, 17 aa, Staphylococcus aureus
KPLHIFSDLSSKMFTWN

SEQ ID NO: 1675421 - protein, 20 aa, Staphylococcus aureus
KRLAIDSCIEFVARAVAQSH

SEQ ID NO: 1675422 - protein, 18 aa, Staphylococcus aureus
LYARFWHKVLYDLGIVPT

SEQ ID NO: 1675423 - protein, 18 aa, Staphylococcus aureus
PSMLKRIFSRAKSSINEI

SEQ ID NO: 1675424 - protein, 18 aa, Staphylococcus aureus
RNEVRIMLGEEPSDNPEL

SEQ ID NO: 1675425 - protein, 20 aa, Staphylococcus aureus
SDLISRYAGIRVPRNKAIVG

SEQ ID NO: 1675426 - protein, 24 aa, Staphylococcus aureus
SPFGEGRPGWHIECSVMAFHELGP

SEQ ID NO: 1675427 - protein, 19 aa, Staphylococcus aureus
TKVFTRFGIEVDFVDTTHT

SEQ ID NO: 1675428 - protein, 19 aa, Staphylococcus aureus
VRRVCDCKGQWTMENFIEI

SEQ ID NO: 1675429 - protein, 18 aa, Staphylococcus aureus
WHYICLFIDLFNREIVGY

SEQ ID NO: 1675430 - protein, 18 aa, Staphylococcus aureus
YKEHIGVVFDDLRVPNKL

SEQ ID NO: 1675431 - protein, 18 aa, Staphylococcus aureus
YLKELSHDISLMKSSILQ

SEQ ID NO: 1675432 - protein, 18 aa, Staphylococcus aureus
AAELRLGIVNGHIAEGTL

SEQ ID NO: 1675433 - protein, 25 aa, Staphylococcus aureus
AIERAAKVLGSWRLEGCTLYVTLEP

SEQ ID NO: 1675434 - protein, 17 aa, Staphylococcus aureus
AKRVLAFEIDQRLIPVL

SEQ ID NO: 1675435 - protein, 17 aa, Staphylococcus aureus
CTMWQGFNYEIDMNQEP

SEQ ID NO: 1675436 - protein, 18 aa, Staphylococcus aureus
DDVEFVYTPYLLKCVTSE

SEQ ID NO: 1675437 - protein, 17 aa, Staphylococcus aureus
DLTEAFAPFVVLAGHAS

SEQ ID NO: 1675438 - protein, 19 aa, Staphylococcus aureus
GESGLKYSIDYIVSETKSQ

SEQ ID NO: 1675439 - protein, 24 aa, Staphylococcus aureus
HSNPFKFGASIGRYSGRIDNAKFK

SEQ ID NO: 1675440 - protein, 22 aa, Staphylococcus aureus
IRRRAVPTWGVFLDEEAQGGGP

SEQ ID NO: 1675441 - protein, 24 aa, Staphylococcus aureus
IVEKSLRGAAIWDELKDRLHTNAY

SEQ ID NO: 1675442 - protein, 20 aa, Staphylococcus aureus
KARACGIHMLVATQRPSVNV

SEQ ID NO: 1675443 - protein, 17 aa, Staphylococcus aureus
KPGEISWDSPFGEGRPG

SEQ ID NO: 1675444 - protein, 17 aa, Staphylococcus aureus
LFSEPRFNVDVLKVEVP

SEQ ID NO: 1675445 - protein, 17 aa, Staphylococcus aureus
LNNSLARLEMPQVDEAE

SEQ ID NO: 1675446 - protein, 18 aa, Staphylococcus aureus
LRFKRRFGDDVAVLHSGL

SEQ ID NO: 1675447 - protein, 19 aa, Staphylococcus aureus
LVFLEGIFKTLLNKNSQVV

SEQ ID NO: 1675448 - protein, 19 aa, Staphylococcus aureus
NPFPKEWRMHAFFMDALPI

SEQ ID NO: 1675449 - protein, 22 aa, Staphylococcus aureus
PYTRSKFYSELKVLEAVNNGLD

SEQ ID NO: 1675450 - protein, 17 aa, Staphylococcus aureus
QDALGLSSADSFRDLIK

SEQ ID NO: 1675451 - protein, 17 aa, Staphylococcus aureus
QIKIATKGSHEFDENQE

SEQ ID NO: 1675452 - protein, 18 aa, Staphylococcus aureus
RASKKFTIVPSWETYAKE

SEQ ID NO: 1675453 - protein, 17 aa, Staphylococcus aureus
RLPHGMPEEVKKMFQKE

SEQ ID NO: 1675454 - protein, 19 aa, Staphylococcus aureus
TGEPCLRYHQTFYTMTGKP

SEQ ID NO: 1675455 - protein, 21 aa, Staphylococcus aureus
TSKKLVKFMLVFCSNSMTAEE

SEQ ID NO: 1675456 - protein, 17 aa, Staphylococcus aureus
VELRNRFVLAPLTHISS

SEQ ID NO: 1675457 - protein, 18 aa, Staphylococcus aureus
AKMGLALNRLVRDGEISA

SEQ ID NO: 1675458 - protein, 18 aa, Staphylococcus aureus
ALKLKLSPNEVWNAVTVN

SEQ ID NO: 1675459 - protein, 20 aa, Staphylococcus aureus
ARYNLGLALFMKNEDIDEAI

SEQ ID NO: 1675460 - protein, 20 aa, Staphylococcus aureus
EILDLPDYVFPVFGMAVGEP

SEQ ID NO: 1675461 - protein, 20 aa, Staphylococcus aureus
GFRGEALASISSVAKVTLKT

SEQ ID NO: 1675462 - protein, 17 aa, Staphylococcus aureus
GRSDYFWDLFIQMPAAL

SEQ ID NO: 1675463 - protein, 18 aa, Staphylococcus aureus
HGDKALKMYNLTFDHTKT

SEQ ID NO: 1675464 - protein, 17 aa, Staphylococcus aureus
HPACVHIPIGKGVCGTA

SEQ ID NO: 1675465 - protein, 23 aa, Staphylococcus aureus
ILDIRFGSLWTNIPLAFLKSLEI

SEQ ID NO: 1675466 - protein, 18 aa, Staphylococcus aureus
ILRHRGIDAGLPKRPFKP

SEQ ID NO: 1675467 - protein, 19 aa, Staphylococcus aureus
IVNHWIDFGVDGFRFDVIN

SEQ ID NO: 1675468 - protein, 18 aa, Staphylococcus aureus
KRIRLNINLENWNKQKLY

SEQ ID NO: 1675469 - protein, 17 aa, Staphylococcus aureus
KRVVISLTYIYGIGTST

SEQ ID NO: 1675470 - protein, 18 aa, Staphylococcus aureus
KSIEMIIAMIGVLKAGGA

SEQ ID NO: 1675471 - protein, 21 aa, Staphylococcus aureus
KYYKDRVLVPLAYINFDEYIK

SEQ ID NO: 1675472 - protein, 18 aa, Staphylococcus aureus
LAESVLPYHPLFIKPNKD

SEQ ID NO: 1675473 - protein, 17 aa, Staphylococcus aureus
LCIEMRSDIPLARGLGS

SEQ ID NO: 1675474 - protein, 22 aa, Staphylococcus aureus
LIPEMHLKPILSYMKAHTMQTY

SEQ ID NO: 1675475 - protein, 20 aa, Staphylococcus aureus
MAMFKDMNFELGIMELYAIE

SEQ ID NO: 1675476 - protein, 20 aa, Staphylococcus aureus
SFLECFKLTVEPVVKSFKPD

SEQ ID NO: 1675477 - protein, 17 aa, Staphylococcus aureus
SGTTIGFIPTMGALHDG

SEQ ID NO: 1675478 - protein, 17 aa, Staphylococcus aureus
VDARYNLGLALFMKNED

SEQ ID NO: 1675479 - protein, 22 aa, Staphylococcus aureus
VSGGKRPLVCFFSNDLNIHRTK

SEQ ID NO: 1675480 - protein, 19 aa, Staphylococcus aureus
ALYNFIWDDFCDWYIEMSK

SEQ ID NO: 1675481 - protein, 22 aa, Staphylococcus aureus
AYLKVAYQFSLPFGKDYADAHE

SEQ ID NO: 1675482 - protein, 22 aa, Staphylococcus aureus
CIANNIKPIFGMTIYVTNGLNT

SEQ ID NO: 1675483 - protein, 23 aa, Staphylococcus aureus
CVIFDEIHYFFGPEMVNVKRGGL

SEQ ID NO: 1675484 - protein, 18 aa, Staphylococcus aureus
DFYEVMRLIAVEILNADL

SEQ ID NO: 1675485 - protein, 19 aa, Staphylococcus aureus
EEFFRAVVINARLTTHIDL

SEQ ID NO: 1675486 - protein, 21 aa, Staphylococcus aureus
GEMKKRYGLIYVDRDNDGHGT

SEQ ID NO: 1675487 - protein, 22 aa, Staphylococcus aureus
GKRFALPNAEVMIHQPLGGAQG

SEQ ID NO: 1675488 - protein, 17 aa, Staphylococcus aureus
GPGPRKALDYMYEIAHR

SEQ ID NO: 1675489 - protein, 18 aa, Staphylococcus aureus
IIGGGMAYTFLKAQGKEI

SEQ ID NO: 1675490 - protein, 23 aa, Staphylococcus aureus
IPELQGRFPIRVELDSLSVEDFV

SEQ ID NO: 1675491 - protein, 21 aa, Staphylococcus aureus
IPFRTAHEIVGKIVLECIQQG

SEQ ID NO: 1675492 - protein, 19 aa, Staphylococcus aureus
IRRLLKMYLERESFEIHEA

SEQ ID NO: 1675493 - protein, 17 aa, Staphylococcus aureus
IYLKSCDLTTILHNLYK

SEQ ID NO: 1675494 - protein, 18 aa, Staphylococcus aureus
KEGLRLSQFYKELMYTTG

SEQ ID NO: 1675495 - protein, 17 aa, Staphylococcus aureus
KRTCGYLGNPVQRPVIK

SEQ ID NO: 1675496 - protein, 18 aa, Staphylococcus aureus
LIDLRLDTRISYTESQIK

SEQ ID NO: 1675497 - protein, 20 aa, Staphylococcus aureus
LKLLSFLLEDHDLIILDEVT

SEQ ID NO: 1675498 - protein, 20 aa, Staphylococcus aureus
LLQARSKEILAFVNESKETA

SEQ ID NO: 1675499 - protein, 17 aa, Staphylococcus aureus
LNITCLFEKPSVFKSLV

SEQ ID NO: 1675500 - protein, 18 aa, Staphylococcus aureus
LNVFRMELLGAKVVAVED

SEQ ID NO: 1675501 - protein, 24 aa, Staphylococcus aureus
NAELFKHFKKGAVFVNCARGSLVD

SEQ ID NO: 1675502 - protein, 24 aa, Staphylococcus aureus
NEITYRLSKIFGIKSISPVLKVEK

SEQ ID NO: 1675503 - protein, 17 aa, Staphylococcus aureus
NGVELRNRFVLAPLTHI

SEQ ID NO: 1675504 - protein, 23 aa, Staphylococcus aureus
NHMYRLPVMYIEYSGIYGDVSKV

SEQ ID NO: 1675505 - protein, 18 aa, Staphylococcus aureus
NVEQAGAVALVLEAIPND

SEQ ID NO: 1675506 - protein, 23 aa, Staphylococcus aureus
PKKMRRLALRSALSFKAQENGLT

SEQ ID NO: 1675507 - protein, 18 aa, Staphylococcus aureus
QKSPRWAIAYKFPAEEVV

SEQ ID NO: 1675508 - protein, 20 aa, Staphylococcus aureus
SSLPIYNLYFIKRNIEKLIN

SEQ ID NO: 1675509 - protein, 18 aa, Staphylococcus aureus
TEAIPNWAAENGYPVTNY

SEQ ID NO: 1675510 - protein, 22 aa, Staphylococcus aureus
TKIATVCKFDLPKLAQMKPQDT

SEQ ID NO: 1675511 - protein, 17 aa, Staphylococcus aureus
VKVFNEFNISEREASDI

SEQ ID NO: 1675512 - protein, 23 aa, Staphylococcus aureus
YILKYVFANGIAREIIYALLEEM

SEQ ID NO: 1675513 - protein, 25 aa, Staphylococcus aureus
YSVDKGWMCIQVFFIRQGNMIKRDT

SEQ ID NO: 1675514 - protein, 17 aa, Staphylococcus aureus
AEEIIFWSTDEAKFITL

SEQ ID NO: 1675515 - protein, 19 aa, Staphylococcus aureus
ESYKLVGIVTSREMINTKD

SEQ ID NO: 1675516 - protein, 21 aa, Staphylococcus aureus
ETKKLTGWYARRIAVGRDGEV

SEQ ID NO: 1675517 - protein, 17 aa, Staphylococcus aureus
FAGGLVILYEVNGQASN

SEQ ID NO: 1675518 - protein, 17 aa, Staphylococcus aureus
FLECLNDKNVETIEHSD

SEQ ID NO: 1675519 - protein, 17 aa, Staphylococcus aureus
GEYAVGLFFSKERILGS

SEQ ID NO: 1675520 - protein, 18 aa, Staphylococcus aureus
GIDEYLIRLSLGVENYED

SEQ ID NO: 1675521 - protein, 17 aa, Staphylococcus aureus
GVEEVRALNEFAINGLY

SEQ ID NO: 1675522 - protein, 19 aa, Staphylococcus aureus
GYEPWTSCEFDFTKEGELK

SEQ ID NO: 1675523 - protein, 17 aa, Staphylococcus aureus
HPDLDTWVIFPWTAGQG

SEQ ID NO: 1675524 - protein, 19 aa, Staphylococcus aureus
IAKELGIGMGTLYRHFKDK

SEQ ID NO: 1675525 - protein, 25 aa, Staphylococcus aureus
ILKGYNFISVLGWPTYYANLGYQRA

SEQ ID NO: 1675526 - protein, 26 aa, Staphylococcus aureus
IQVGLGRTGKWFAMEWEQVVPDIYIL

SEQ ID NO: 1675527 - protein, 17 aa, Staphylococcus aureus
IRGEGAFCNGIKMEEPP

SEQ ID NO: 1675528 - protein, 19 aa, Staphylococcus aureus
KFNELMVAIQSPFLLDEED

SEQ ID NO: 1675529 - protein, 19 aa, Staphylococcus aureus
KIIDEFLCIDKSYSNSNFD

SEQ ID NO: 1675530 - protein, 20 aa, Staphylococcus aureus
KKGPFAPDFIKVWKERYKKI

SEQ ID NO: 1675531 - protein, 21 aa, Staphylococcus aureus
KKRALEILNLVGLPNAEKRFK

SEQ ID NO: 1675532 - protein, 17 aa, Staphylococcus aureus
KNIPFDELVLFSSARSA

SEQ ID NO: 1675533 - protein, 20 aa, Staphylococcus aureus
KRPDYIGAFWNVVNWEKVDE

SEQ ID NO: 1675534 - protein, 20 aa, Staphylococcus aureus
LDLLSKIAITFSEEENVDRI

SEQ ID NO: 1675535 - protein, 21 aa, Staphylococcus aureus
LDYIKLLGVDYIWLTPVYESP

SEQ ID NO: 1675536 - protein, 17 aa, Staphylococcus aureus
LPFQRFIIANIFLIDKN

SEQ ID NO: 1675537 - protein, 21 aa, Staphylococcus aureus
LPLTEAFLFSRGHFKGNQFPE

SEQ ID NO: 1675538 - protein, 20 aa, Staphylococcus aureus
LQPWDFAGGLVILYEVNGQA

SEQ ID NO: 1675539 - protein, 20 aa, Staphylococcus aureus
MATMKFDMCGAANVVGIIEA

SEQ ID NO: 1675540 - protein, 18 aa, Staphylococcus aureus
MRLRRVGNKFSIKTWKFD

SEQ ID NO: 1675541 - protein, 22 aa, Staphylococcus aureus
NAIKALCHKLGYSVDQVIAFGD

SEQ ID NO: 1675542 - protein, 18 aa, Staphylococcus aureus
NKTIPWLYVERGFEIPSF

SEQ ID NO: 1675543 - protein, 17 aa, Staphylococcus aureus
NSRLFAFYCKLDDPKEV

SEQ ID NO: 1675544 - protein, 25 aa, Staphylococcus aureus
RAKVKHLRKSPCYNFELEVIAKNEN

SEQ ID NO: 1675545 - protein, 19 aa, Staphylococcus aureus
RIIKIPVQYGGTYGPDIEE

SEQ ID NO: 1675546 - protein, 22 aa, Staphylococcus aureus
RSTMKVVLPKGWTLKNVVNHFI

SEQ ID NO: 1675547 - protein, 17 aa, Staphylococcus aureus
SKEILAFVNESKETAIK

SEQ ID NO: 1675548 - protein, 18 aa, Staphylococcus aureus
SRLTGRLSGNIGYVASKV

SEQ ID NO: 1675549 - protein, 19 aa, Staphylococcus aureus
TFGSFRPWPAYLYTIEHSI

SEQ ID NO: 1675550 - protein, 18 aa, Staphylococcus aureus
VASFTLAVNRTFTNAQGE

SEQ ID NO: 1675551 - protein, 21 aa, Staphylococcus aureus
VEAAIKIARKWGSEVKGITDG

SEQ ID NO: 1675552 - protein, 24 aa, Staphylococcus aureus
VITTEYYWHWDLKNSKLDVFDYKK

SEQ ID NO: 1675553 - protein, 17 aa, Staphylococcus aureus
VKIPHRIMPILGTSQLK

SEQ ID NO: 1675554 - protein, 17 aa, Staphylococcus aureus
VKKSGYIQYEFVKEDLT

SEQ ID NO: 1675555 - protein, 17 aa, Staphylococcus aureus
YYLAEAIKAEKAGKKVE

SEQ ID NO: 1675556 - protein, 21 aa, Staphylococcus aureus
ANELYRVIGVYSKHKGKDTYV

SEQ ID NO: 1675557 - protein, 17 aa, Staphylococcus aureus
CDLSHEWEVARVEEGLT

SEQ ID NO: 1675558 - protein, 17 aa, Staphylococcus aureus
DTLRVASILAHTLYDYP

SEQ ID NO: 1675559 - protein, 18 aa, Staphylococcus aureus
EIQRKWIEKFKVIRDTFK

SEQ ID NO: 1675560 - protein, 19 aa, Staphylococcus aureus
FKVTAPIFIDNAESVTELI

SEQ ID NO: 1675561 - protein, 17 aa, Staphylococcus aureus
GDTIVVWRLDRLGRNME

SEQ ID NO: 1675562 - protein, 17 aa, Staphylococcus aureus
GSFLAKFLYDLGAKIVG

SEQ ID NO: 1675563 - protein, 19 aa, Staphylococcus aureus
GVHKLPFVCVIINNKYAIS

SEQ ID NO: 1675564 - protein, 20 aa, Staphylococcus aureus
HTPESISFLLTDLGGGSSVP

SEQ ID NO: 1675565 - protein, 19 aa, Staphylococcus aureus
IGLRANKKDFGWIYSSSLA

SEQ ID NO: 1675566 - protein, 17 aa, Staphylococcus aureus
INDCADCVISVLPSKLG

SEQ ID NO: 1675567 - protein, 18 aa, Staphylococcus aureus
KHPYTWGLLSSMPDLSTT

SEQ ID NO: 1675568 - protein, 18 aa, Staphylococcus aureus
KKIYTCLVYGKTHTSGII

SEQ ID NO: 1675569 - protein, 17 aa, Staphylococcus aureus
KSSLSLETIFHCYHHMM

SEQ ID NO: 1675570 - protein, 20 aa, Staphylococcus aureus
KVTHLRALLQLRDVAQDNDA

SEQ ID NO: 1675571 - protein, 20 aa, Staphylococcus aureus
LEEARALLIEAINSGAALEK

SEQ ID NO: 1675572 - protein, 30 aa, Staphylococcus aureus
NPQAFNLLDWKKRRSLLFEIAKPINDEDVI

SEQ ID NO: 1675573 - protein, 18 aa, Staphylococcus aureus
PEVRESLIFEESKQTMQQ

SEQ ID NO: 1675574 - protein, 20 aa, Staphylococcus aureus
PRLFWPIYYFIQAPMQKMMI

SEQ ID NO: 1675575 - protein, 20 aa, Staphylococcus aureus
PVRKRIGMVFQFPESQLFED

SEQ ID NO: 1675576 - protein, 23 aa, Staphylococcus aureus
QPILKEKFIALGLDVKEDEAAKH

SEQ ID NO: 1675577 - protein, 27 aa, Staphylococcus aureus
RLPEYMIPRKFEWMEQLPLTSNGKIDR

SEQ ID NO: 1675578 - protein, 19 aa, Staphylococcus aureus
RPMMYIALSYDHRIIDGKE

SEQ ID NO: 1675579 - protein, 19 aa, Staphylococcus aureus
RVLGGLSYRESHFALELLH

SEQ ID NO: 1675580 - protein, 26 aa, Staphylococcus aureus
SLMKLGFKGGEKFAVKTGLQKTMQQA

SEQ ID NO: 1675581 - protein, 21 aa, Staphylococcus aureus
TGVDFPKLFKAFKDMGMTYNI

SEQ ID NO: 1675582 - protein, 20 aa, Staphylococcus aureus
TKLWPIQPLRDFWGINRRTE

SEQ ID NO: 1675583 - protein, 17 aa, Staphylococcus aureus
VTPEHLEHFIADKNMQT

SEQ ID NO: 1675584 - protein, 18 aa, Staphylococcus aureus
YERCGGCQLQHLSYEAQL

SEQ ID NO: 1675585 - protein, 19 aa, Staphylococcus aureus
AEACLKLGVDMINDQWAGL

SEQ ID NO: 1675586 - protein, 21 aa, Staphylococcus aureus
DEQLKSLPFISGYVGTCSFDL

SEQ ID NO: 1675587 - protein, 17 aa, Staphylococcus aureus
EESYFLFYINRPSIIVG

SEQ ID NO: 1675588 - protein, 23 aa, Staphylococcus aureus
ELSQRLKQQFSHYGVKIISLVAM

SEQ ID NO: 1675589 - protein, 20 aa, Staphylococcus aureus
FDLSKGFPLLTTKKVSFKLV

SEQ ID NO: 1675590 - protein, 17 aa, Staphylococcus aureus
FKGIIGLVTMKKVRDPL

SEQ ID NO: 1675591 - protein, 20 aa, Staphylococcus aureus
FYRFWTQGIFARWTDNPNIE

SEQ ID NO: 1675592 - protein, 22 aa, Staphylococcus aureus
GDEAKEYWLCWVTTERNEQGPY

SEQ ID NO: 1675593 - protein, 19 aa, Staphylococcus aureus
GNYELRLPLVSLEDTDTKV

SEQ ID NO: 1675594 - protein, 23 aa, Staphylococcus aureus
GVVVRLANFGAFVEIAPGVQGLV

SEQ ID NO: 1675595 - protein, 18 aa, Staphylococcus aureus
HAIDACGINGLYIKSCSF

SEQ ID NO: 1675596 - protein, 23 aa, Staphylococcus aureus
HGFISFTPVGGWWNQVMLSQKVT

SEQ ID NO: 1675597 - protein, 19 aa, Staphylococcus aureus
HLTTIKVAPLFSEDDRHKI

SEQ ID NO: 1675598 - protein, 17 aa, Staphylococcus aureus
IQACKEYGVQRLIVAGG

SEQ ID NO: 1675599 - protein, 19 aa, Staphylococcus aureus
ITGRIFISLAVKFSKARLI

SEQ ID NO: 1675600 - protein, 23 aa, Staphylococcus aureus
KGLELGCLFAFYGHTHVAKYEYI

SEQ ID NO: 1675601 - protein, 18 aa, Staphylococcus aureus
KIVLRWLKEQGIQVELLN

SEQ ID NO: 1675602 - protein, 20 aa, Staphylococcus aureus
KKLGIRKGIPVVFSDESPIV

SEQ ID NO: 1675603 - protein, 19 aa, Staphylococcus aureus
KRLNPTYFIRIHRSYIINT

SEQ ID NO: 1675604 - protein, 18 aa, Staphylococcus aureus
LGALQGFCRIHQVKINHV

SEQ ID NO: 1675605 - protein, 17 aa, Staphylococcus aureus
LPMNPAISLFVTVKDTI

SEQ ID NO: 1675606 - protein, 20 aa, Staphylococcus aureus
MDIFKKCYKALITKQETNIQ

SEQ ID NO: 1675607 - protein, 20 aa, Staphylococcus aureus
PENELEVLSSYLISLDQHRE

SEQ ID NO: 1675608 - protein, 20 aa, Staphylococcus aureus
PTAIRYAGLISRLKQLDLDV

SEQ ID NO: 1675609 - protein, 26 aa, Staphylococcus aureus
QSQFNLPMRYIWGIYEPQSDDQNMNE

SEQ ID NO: 1675610 - protein, 26 aa, Staphylococcus aureus
QVLEKFKSLIFISGTLKFNHSFEAFK

SEQ ID NO: 1675611 - protein, 20 aa, Staphylococcus aureus
RPLMEEWLFNTVAFVGGPSE

SEQ ID NO: 1675612 - protein, 18 aa, Staphylococcus aureus
SPEILVFIKSFKKYIANE

SEQ ID NO: 1675613 - protein, 19 aa, Staphylococcus aureus
SRISPKMGMMKNSVLNQSR

SEQ ID NO: 1675614 - protein, 29 aa, Staphylococcus aureus
SRVEKSIADWGIKLERTFYVSKFDHPENE

SEQ ID NO: 1675615 - protein, 17 aa, Staphylococcus aureus
DIVWKFAEKVIFPHVEQ

SEQ ID NO: 1675616 - protein, 17 aa, Staphylococcus aureus
FVIISFKHKVILIGGTE

SEQ ID NO: 1675617 - protein, 17 aa, Staphylococcus aureus
GRVKFIFQPAEELGHGA

SEQ ID NO: 1675618 - protein, 19 aa, Staphylococcus aureus
GRYSYHFNKIYFLRISTLP

SEQ ID NO: 1675619 - protein, 20 aa, Staphylococcus aureus
IAIPDWFWSYQMAMTLDEET

SEQ ID NO: 1675620 - protein, 17 aa, Staphylococcus aureus
ICNYCFEHGVVIIAVAG

SEQ ID NO: 1675621 - protein, 22 aa, Staphylococcus aureus
ILKPVFRDYLLKLVEAHDIEHQ

SEQ ID NO: 1675622 - protein, 19 aa, Staphylococcus aureus
INFCHKRLLFVDTMPNIVH

SEQ ID NO: 1675623 - protein, 21 aa, Staphylococcus aureus
IRVLRELDFHFQLVIDANESL

SEQ ID NO: 1675624 - protein, 22 aa, Staphylococcus aureus
KDLFIDWTWGEKFFRKHLIDYD

SEQ ID NO: 1675625 - protein, 17 aa, Staphylococcus aureus
LEFQKRGAVAFDYGNNI

SEQ ID NO: 1675626 - protein, 18 aa, Staphylococcus aureus
LFESIRFMYPQIVRSVNR

SEQ ID NO: 1675627 - protein, 18 aa, Staphylococcus aureus
LNTGMSFIRGVGYPKQQF

SEQ ID NO: 1675628 - protein, 17 aa, Staphylococcus aureus
LPFHAKRFNDWLESMPN

SEQ ID NO: 1675629 - protein, 18 aa, Staphylococcus aureus
LYGNVKFGVGPVIEGGFY

SEQ ID NO: 1675630 - protein, 17 aa, Staphylococcus aureus
PELLSVLGRTHNTEDIY

SEQ ID NO: 1675631 - protein, 19 aa, Staphylococcus aureus
QEVYQEWYLGSKLYEDVEK

SEQ ID NO: 1675632 - protein, 18 aa, Staphylococcus aureus
QWAGSCWYYLRYIDPKNE

SEQ ID NO: 1675633 - protein, 18 aa, Staphylococcus aureus
RKVAIALRNRYRRSLLDE

SEQ ID NO: 1675634 - protein, 20 aa, Staphylococcus aureus
RLLKDRIIMLGSQIDDNVAN

SEQ ID NO: 1675635 - protein, 18 aa, Staphylococcus aureus
RPASLDDLGLEAAFKSYF

SEQ ID NO: 1675636 - protein, 18 aa, Staphylococcus aureus
TEEIKYYLAEAIKAEKAG

SEQ ID NO: 1675637 - protein, 22 aa, Staphylococcus aureus
TEVKIVFMLAMDKVDDQLKLLQ

SEQ ID NO: 1675638 - protein, 18 aa, Staphylococcus aureus
VYEMRWDIGYVLQQIALF

SEQ ID NO: 1675639 - protein, 19 aa, Staphylococcus aureus
WCQKFNIALTIKKKQGIVV

SEQ ID NO: 1675640 - protein, 18 aa, Staphylococcus aureus
WLYVERGFEIPSFNYVLK

SEQ ID NO: 1675641 - protein, 19 aa, Staphylococcus aureus
YTCEKFKLLVLQGNVLGVQ

SEQ ID NO: 1675642 - protein, 23 aa, Staphylococcus aureus
ATGAGWRKLNIPGEEQLINKGVA

SEQ ID NO: 1675643 - protein, 17 aa, Staphylococcus aureus
ECVKLHFDDRMLTITDI

SEQ ID NO: 1675644 - protein, 19 aa, Staphylococcus aureus
FGDGIKAIFNYPSQETAED

SEQ ID NO: 1675645 - protein, 22 aa, Staphylococcus aureus
FLRRCPNLKWIAWFATGVNTLP

SEQ ID NO: 1675646 - protein, 19 aa, Staphylococcus aureus
GPAALRCSQFVYKEQKNQK

SEQ ID NO: 1675647 - protein, 22 aa, Staphylococcus aureus
IPGELIMKILAFDGNLEKIDKA

SEQ ID NO: 1675648 - protein, 18 aa, Staphylococcus aureus
IQIWPEFDIDGAVELQYT

SEQ ID NO: 1675649 - protein, 20 aa, Staphylococcus aureus
KELRDTLHFEMLWDTSKIDV

SEQ ID NO: 1675650 - protein, 20 aa, Staphylococcus aureus
KSIVGPFAYYIKGFEMLPQM

SEQ ID NO: 1675651 - protein, 19 aa, Staphylococcus aureus
LEGDLPLFPGHGPYTTVDD

SEQ ID NO: 1675652 - protein, 23 aa, Staphylococcus aureus
LVNNSRFGFKMGHQSMVDSMVYD

SEQ ID NO: 1675653 - protein, 22 aa, Staphylococcus aureus
PILGVCLGFQCIVSYFGGNIIH

SEQ ID NO: 1675654 - protein, 17 aa, Staphylococcus aureus
PWLRRLGFENVKEVLLD

SEQ ID NO: 1675655 - protein, 18 aa, Staphylococcus aureus
PYAGFVYDVMADVLYHAK

SEQ ID NO: 1675656 - protein, 17 aa, Staphylococcus aureus
RALKYIIPDTADFPYTI

SEQ ID NO: 1675657 - protein, 17 aa, Staphylococcus aureus
RCDYCMPKEVFGDDFVF

SEQ ID NO: 1675658 - protein, 21 aa, Staphylococcus aureus
SSELARPLLLAALSKDNEVVK

SEQ ID NO: 1675659 - protein, 19 aa, Staphylococcus aureus
TDIPFCIYNKTALCTGRGE

SEQ ID NO: 1675660 - protein, 18 aa, Staphylococcus aureus
TFKPELLSVLGRTHNTED

SEQ ID NO: 1675661 - protein, 18 aa, Staphylococcus aureus
VLTGFKFIAQEIRQLDDH

SEQ ID NO: 1675662 - protein, 18 aa, Staphylococcus aureus
VPSGGYFVWLVFKIDIDI

SEQ ID NO: 1675663 - protein, 19 aa, Staphylococcus aureus
ASPEFMFPSFYGIDVSTTA

SEQ ID NO: 1675664 - protein, 17 aa, Staphylococcus aureus
FERWSFHLQIYFLAERF

SEQ ID NO: 1675665 - protein, 18 aa, Staphylococcus aureus
GAGRIGLGVAKRAQSFGM

SEQ ID NO: 1675666 - protein, 17 aa, Staphylococcus aureus
GKFLPKRKVVKIEQFEN

SEQ ID NO: 1675667 - protein, 20 aa, Staphylococcus aureus
HCDNCGGAIRPDIVLYGEML

SEQ ID NO: 1675668 - protein, 17 aa, Staphylococcus aureus
HHQLIFFGRYHCLARKP

SEQ ID NO: 1675669 - protein, 17 aa, Staphylococcus aureus
KEFELLWYLASRENEVI

SEQ ID NO: 1675670 - protein, 21 aa, Staphylococcus aureus
KFTEGSFKQWGYDLALSEFGD

SEQ ID NO: 1675671 - protein, 17 aa, Staphylococcus aureus
KLGGFDWFKRKTNKKDT

SEQ ID NO: 1675672 - protein, 20 aa, Staphylococcus aureus
KQKALELVELVGLKGREKAY

SEQ ID NO: 1675673 - protein, 20 aa, Staphylococcus aureus
LKQYGFKFLGPVTVFSFLEA

SEQ ID NO: 1675674 - protein, 17 aa, Staphylococcus aureus
LVLRINNLLTRMKKYHH

SEQ ID NO: 1675675 - protein, 19 aa, Staphylococcus aureus
MNVDWKKRIHMIIGTDEES

SEQ ID NO: 1675676 - protein, 24 aa, Staphylococcus aureus
NNDWSRNQIQDWIKAGLVVANDKV

SEQ ID NO: 1675677 - protein, 23 aa, Staphylococcus aureus
NPPHLKAMIPWEGLNDMYREVAF

SEQ ID NO: 1675678 - protein, 17 aa, Staphylococcus aureus
NVGDPLVRFNLEYINNN

SEQ ID NO: 1675679 - protein, 18 aa, Staphylococcus aureus
NYYATRFMLTVPFENIDV

SEQ ID NO: 1675680 - protein, 19 aa, Staphylococcus aureus
PLQMCSVMEDFYIEKLITG

SEQ ID NO: 1675681 - protein, 17 aa, Staphylococcus aureus
PTPKWSIARYKGLGEMN

SEQ ID NO: 1675682 - protein, 25 aa, Staphylococcus aureus
SDLQLIRRSVCEFIKGLSLIDTSIL

SEQ ID NO: 1675683 - protein, 18 aa, Staphylococcus aureus
TNEVMPIFDAAMKYKEDG

SEQ ID NO: 1675684 - protein, 17 aa, Staphylococcus aureus
YRLKGFMTFEDTAHTYL

SEQ ID NO: 1675685 - protein, 17 aa, Staphylococcus aureus
ARLKLLVALSNNLDKAE

SEQ ID NO: 1675686 - protein, 17 aa, Staphylococcus aureus
ARLQLALLMLQRDNVLI

SEQ ID NO: 1675687 - protein, 20 aa, Staphylococcus aureus
DLPFPIKINQMLGHQTSFLT

SEQ ID NO: 1675688 - protein, 18 aa, Staphylococcus aureus
DQCSVCHAVLPQIEDLMQ

SEQ ID NO: 1675689 - protein, 19 aa, Staphylococcus aureus
EASLEFNVRPVPEYDNDFI

SEQ ID NO: 1675690 - protein, 20 aa, Staphylococcus aureus
EMIKRLSTPFMNLDHVQQFE

SEQ ID NO: 1675691 - protein, 18 aa, Staphylococcus aureus
ENFSQVFRPKAFKYSNGE

SEQ ID NO: 1675692 - protein, 20 aa, Staphylococcus aureus
ENLPWKELDIDIAIDATGKF

SEQ ID NO: 1675693 - protein, 19 aa, Staphylococcus aureus
EQPLTIAGIFTFKPNEDDR

SEQ ID NO: 1675694 - protein, 17 aa, Staphylococcus aureus
ERLKAALLYTLEEECIK

SEQ ID NO: 1675695 - protein, 24 aa, Staphylococcus aureus
FLPHCFKFGIKNAIRIYNHNTSKS

SEQ ID NO: 1675696 - protein, 17 aa, Staphylococcus aureus
HGEWKLKSADEFIKDNR

SEQ ID NO: 1675697 - protein, 22 aa, Staphylococcus aureus
IPIKALTSYLGFGNYELRLPLV

SEQ ID NO: 1675698 - protein, 18 aa, Staphylococcus aureus
KADTWLRNQFFATEEYKE

SEQ ID NO: 1675699 - protein, 18 aa, Staphylococcus aureus
KDGIPDVCFVRDLEGICL

SEQ ID NO: 1675700 - protein, 18 aa, Staphylococcus aureus
KKGEYLFVLTAWYDQQRT

SEQ ID NO: 1675701 - protein, 17 aa, Staphylococcus aureus
KKLPFGIGQIGKSFRNE

SEQ ID NO: 1675702 - protein, 20 aa, Staphylococcus aureus
KSELKIAIGPVERGGAGGGI

SEQ ID NO: 1675703 - protein, 21 aa, Staphylococcus aureus
LNDFGPAWIERFVRVQIEEAF

SEQ ID NO: 1675704 - protein, 19 aa, Staphylococcus aureus
LNIDVVLECTGFYTDKDKA

SEQ ID NO: 1675705 - protein, 17 aa, Staphylococcus aureus
MPMGIVFEVEGKTIYHT

SEQ ID NO: 1675706 - protein, 22 aa, Staphylococcus aureus
NIEVLRFANAMFEPLWNNKYIS

SEQ ID NO: 1675707 - protein, 18 aa, Staphylococcus aureus
PVMEVQFLGFVFEVFDAI

SEQ ID NO: 1675708 - protein, 19 aa, Staphylococcus aureus
QLIGMRASSDFVRHGEKKA

SEQ ID NO: 1675709 - protein, 19 aa, Staphylococcus aureus
SIGLILGFLVERFMNNQEE

SEQ ID NO: 1675710 - protein, 18 aa, Staphylococcus aureus
TKEELKEIVTMMVNKLTN

SEQ ID NO: 1675711 - protein, 17 aa, Staphylococcus aureus
TKLKLNGYFIASIISPL

SEQ ID NO: 1675712 - protein, 30 aa, Staphylococcus aureus
ASYRLEFYRLYLLMVHLLKFGEMYRDSVAH

SEQ ID NO: 1675713 - protein, 17 aa, Staphylococcus aureus
EALTGKAAFLYLEDIQE

SEQ ID NO: 1675714 - protein, 19 aa, Staphylococcus aureus
EEMKHYFILNFPQRPGALR

SEQ ID NO: 1675715 - protein, 18 aa, Staphylococcus aureus
EIFKKIILENKMLKRWNS

SEQ ID NO: 1675716 - protein, 21 aa, Staphylococcus aureus
EVLVCTVIGFPLGASTTATKA

SEQ ID NO: 1675717 - protein, 20 aa, Staphylococcus aureus
GMGRIGRMVLRIALQNKNLN

SEQ ID NO: 1675718 - protein, 18 aa, Staphylococcus aureus
GSPIKWNFTKFIIDRQGN

SEQ ID NO: 1675719 - protein, 17 aa, Staphylococcus aureus
IRLEPMNTFPVIRDLQV

SEQ ID NO: 1675720 - protein, 19 aa, Staphylococcus aureus
LFSTLLRLEWDDVPSKILI

SEQ ID NO: 1675721 - protein, 17 aa, Staphylococcus aureus
LKLGVDMINDQWAGLYD

SEQ ID NO: 1675722 - protein, 17 aa, Staphylococcus aureus
LRLLARAVFVLDADNKV

SEQ ID NO: 1675723 - protein, 19 aa, Staphylococcus aureus
LVLRFGYDGIDVIDLNLFE

SEQ ID NO: 1675724 - protein, 23 aa, Staphylococcus aureus
MLKRWNSSYVDRGFIFTTKKGNP

SEQ ID NO: 1675725 - protein, 18 aa, Staphylococcus aureus
NTEKWWNGLKSWWSNFRE

SEQ ID NO: 1675726 - protein, 19 aa, Staphylococcus aureus
PILKCLILKGLVKKERCEL

SEQ ID NO: 1675727 - protein, 22 aa, Staphylococcus aureus
QPDEFYFLPSFMSPLKKHHDFI

SEQ ID NO: 1675728 - protein, 22 aa, Staphylococcus aureus
QVAINFAKLILCQTDSQCETKV

SEQ ID NO: 1675729 - protein, 19 aa, Staphylococcus aureus
RGNIFGGYILYNLGYIHST

SEQ ID NO: 1675730 - protein, 20 aa, Staphylococcus aureus
RSAYHILDMVFWFGNLQILA

SEQ ID NO: 1675731 - protein, 21 aa, Staphylococcus aureus
VDFYNRMAFDFGTLGNHEFNY

SEQ ID NO: 1675732 - protein, 17 aa, Staphylococcus aureus
VEFKRTYVCEDMSKCIC

SEQ ID NO: 1675733 - protein, 17 aa, Staphylococcus aureus
VKIAIELHAGFLVHTPY

SEQ ID NO: 1675734 - protein, 21 aa, Staphylococcus aureus
WLMLDVFQWTRTDFVVHMHDD

SEQ ID NO: 1675735 - protein, 23 aa, Staphylococcus aureus
YLIEGSNFTTGWIFFINSVGEHE

SEQ ID NO: 1675736 - protein, 27 aa, Staphylococcus aureus
AAWQKFARPRFDNMISFNSTNDLLTWL

SEQ ID NO: 1675737 - protein, 21 aa, Staphylococcus aureus
DFPLPKAFRDAGWFFDVLPGH

SEQ ID NO: 1675738 - protein, 18 aa, Staphylococcus aureus
DWSRFTIAVGKLSRTKIF

SEQ ID NO: 1675739 - protein, 17 aa, Staphylococcus aureus
EGNMNIFIIEYDDVNKD

SEQ ID NO: 1675740 - protein, 18 aa, Staphylococcus aureus
GHIIVWFGLTWSLELYQQ

SEQ ID NO: 1675741 - protein, 23 aa, Staphylococcus aureus
GNELPISAGFFFINPFEVVYYAG

SEQ ID NO: 1675742 - protein, 25 aa, Staphylococcus aureus
HREISPRLRLVIPLKRNVNADEYEA

SEQ ID NO: 1675743 - protein, 17 aa, Staphylococcus aureus
IFLERRLVDGIFTIKDQ

SEQ ID NO: 1675744 - protein, 19 aa, Staphylococcus aureus
KALFAASFVTHFSGQTPHI

SEQ ID NO: 1675745 - protein, 23 aa, Staphylococcus aureus
LRMIRCLRFQSQLSFDIATETFE

SEQ ID NO: 1675746 - protein, 19 aa, Staphylococcus aureus
LTKEELKEIVTMMVNKLTN

SEQ ID NO: 1675747 - protein, 20 aa, Staphylococcus aureus
RGKKRIDYRLSYNFYTTYYD

SEQ ID NO: 1675748 - protein, 20 aa, Staphylococcus aureus
RPRKCLNWKFPYEVLCDELL

SEQ ID NO: 1675749 - protein, 18 aa, Staphylococcus aureus
RQRVWRRLAKDLKPENLH

SEQ ID NO: 1675750 - protein, 27 aa, Staphylococcus aureus
TSTIIPMCHPLPLTGIDVHFSWDETNA

SEQ ID NO: 1675751 - protein, 17 aa, Staphylococcus aureus
VADELYHLFVLMHALGV

SEQ ID NO: 1675752 - protein, 20 aa, Staphylococcus aureus
YEFLYLLSMDKLFGNKRNRL

SEQ ID NO: 1675753 - protein, 18 aa, Staphylococcus aureus
ANVIRYAKYLNELSDETQ

SEQ ID NO: 1675754 - protein, 19 aa, Staphylococcus aureus
ANVIRYAKYLNELSDETQF

SEQ ID NO: 1675755 - protein, 20 aa, Staphylococcus aureus
DMKGAIKYAVKFYNYPNEYL

SEQ ID NO: 1675756 - protein, 18 aa, Staphylococcus aureus
DMSEIKTALIAVGPENDK

SEQ ID NO: 1675757 - protein, 20 aa, Staphylococcus aureus
EDFPRQCIFIGTTNKVDFLR

SEQ ID NO: 1675758 - protein, 21 aa, Staphylococcus aureus
EEKYLRLYAEFENYKRRIQKE

SEQ ID NO: 1675759 - protein, 20 aa, Staphylococcus aureus
EKYLRLYAEFENYKRRIQKE

SEQ ID NO: 1675760 - protein, 17 aa, Staphylococcus aureus
IARAICINPKYILFDEA

SEQ ID NO: 1675761 - protein, 20 aa, Staphylococcus aureus
KEYKQKYLILRIFNVSGKEP

SEQ ID NO: 1675762 - protein, 19 aa, Staphylococcus aureus
LKVSFDYIDWIKLGFGPSG

SEQ ID NO: 1675763 - protein, 21 aa, Staphylococcus aureus
LNARLKLQLLDDVKSVFNSQM

SEQ ID NO: 1675764 - protein, 18 aa, Staphylococcus aureus
LNIDVVLECTGFYTDKDK

SEQ ID NO: 1675765 - protein, 19 aa, Staphylococcus aureus
MGRIGRMVLRIALQNKNLN

SEQ ID NO: 1675766 - protein, 18 aa, Staphylococcus aureus
NRHWSSSKGQGLWMSVVL

SEQ ID NO: 1675767 - protein, 19 aa, Staphylococcus aureus
NRHWSSSKGQGLWMSVVLR

SEQ ID NO: 1675768 - protein, 18 aa, Staphylococcus aureus
PILKCLILKGLVKKERCE

SEQ ID NO: 1675769 - protein, 19 aa, Staphylococcus aureus
PLPREWRDAGWFLEVKPPQ

SEQ ID NO: 1675770 - protein, 17 aa, Staphylococcus aureus
PLWRVYRLVKFSKVFKN

SEQ ID NO: 1675771 - protein, 19 aa, Staphylococcus aureus
RPVMEVQFLGFVFEVFDAI

SEQ ID NO: 1675772 - protein, 20 aa, Staphylococcus aureus
SRLKALYLSVIDRIDIKKDG

SEQ ID NO: 1675773 - protein, 19 aa, Staphylococcus aureus
STLELRTAIKVFGKKYTAE

SEQ ID NO: 1675774 - protein, 24 aa, Staphylococcus aureus
TTDMKGGLMALVITLIELKEQNQL

SEQ ID NO: 1675775 - protein, 17 aa, Staphylococcus aureus
VAQEAFESWSLTSKSER

SEQ ID NO: 1675776 - protein, 17 aa, Staphylococcus aureus
YAHRLLMDLGFSRDVMS

SEQ ID NO: 1675777 - protein, 18 aa, Staphylococcus aureus
YKMIKQRMVDAFILLYSK

SEQ ID NO: 1675778 - protein, 19 aa, Staphylococcus aureus
ANLLRICARYDNLDIIEDA

SEQ ID NO: 1675779 - protein, 22 aa, Staphylococcus aureus
AVIYDLDFLKTLPFEQILSGYA

SEQ ID NO: 1675780 - protein, 17 aa, Staphylococcus aureus
CKVRQSFELASPKHTEG

SEQ ID NO: 1675781 - protein, 18 aa, Staphylococcus aureus
EALYGVTCTLEYNDDYPA

SEQ ID NO: 1675782 - protein, 20 aa, Staphylococcus aureus
EGKRAVLLLHGFTGNSSDVR

SEQ ID NO: 1675783 - protein, 19 aa, Staphylococcus aureus
FGSPIKWNFTKFIIDRQGN

SEQ ID NO: 1675784 - protein, 21 aa, Staphylococcus aureus
FKSELKIAIGPVERGGAGGGI

SEQ ID NO: 1675785 - protein, 21 aa, Staphylococcus aureus
HKGKMAFRVYPKWCNQLNKTA

SEQ ID NO: 1675786 - protein, 17 aa, Staphylococcus aureus
IVFQASCFNEFVVKGRL

SEQ ID NO: 1675787 - protein, 23 aa, Staphylococcus aureus
LAQHYPLKRIAVMSAPKEKSDDG

SEQ ID NO: 1675788 - protein, 17 aa, Staphylococcus aureus
LGLTASLGFVDIVDYEY

SEQ ID NO: 1675789 - protein, 17 aa, Staphylococcus aureus
LPIDLIIDYAHTADGMN

SEQ ID NO: 1675790 - protein, 18 aa, Staphylococcus aureus
LRFANAMFEPLWNNKYIS

SEQ ID NO: 1675791 - protein, 17 aa, Staphylococcus aureus
MPIEVVYGFAQLKRAAA

SEQ ID NO: 1675792 - protein, 19 aa, Staphylococcus aureus
NIEVLRFANAMFEPLWNNK

SEQ ID NO: 1675793 - protein, 21 aa, Staphylococcus aureus
PGELIMKILAFDGNLEKIDKA

SEQ ID NO: 1675794 - protein, 17 aa, Staphylococcus aureus
PYTNYSILLVSGTYPGG

SEQ ID NO: 1675795 - protein, 22 aa, Staphylococcus aureus
QFETRAGTLLRYYTGLLEHSKV

SEQ ID NO: 1675796 - protein, 18 aa, Staphylococcus aureus
SNFTTGWIFFINSVGEHE

SEQ ID NO: 1675797 - protein, 18 aa, Staphylococcus aureus
SPEFMFPSFYGIDVSTTA

SEQ ID NO: 1675798 - protein, 21 aa, Staphylococcus aureus
WEMIKRLSTPFMNLDHVQQFE

SEQ ID NO: 1675799 - protein, 17 aa, Staphylococcus aureus
AGYVRCKLFLEKEEEKI

SEQ ID NO: 1675800 - protein, 23 aa, Staphylococcus aureus
AHGEIRLDINFALYGNGTDSISD

SEQ ID NO: 1675801 - protein, 17 aa, Staphylococcus aureus
ATGAGWRKLNIPGEEQL

SEQ ID NO: 1675802 - protein, 19 aa, Staphylococcus aureus
DGVDIVIHIGVNTVDLEGK

SEQ ID NO: 1675803 - protein, 18 aa, Staphylococcus aureus
EGLSLIPLPGMGFLKGAG

SEQ ID NO: 1675804 - protein, 18 aa, Staphylococcus aureus
EVADELYHLFVLMHALGV

SEQ ID NO: 1675805 - protein, 21 aa, Staphylococcus aureus
EWTNGKFLPKRKVVKIEQFEN

SEQ ID NO: 1675806 - protein, 21 aa, Staphylococcus aureus
GAGWRKLNIPGEEQLINKGVA

SEQ ID NO: 1675807 - protein, 17 aa, Staphylococcus aureus
GLLCVYEGFLKALKGEK

SEQ ID NO: 1675808 - protein, 20 aa, Staphylococcus aureus
GNELPISAGFFFINPFEVVY

SEQ ID NO: 1675809 - protein, 19 aa, Staphylococcus aureus
GVLSSLYICFSIKSEMSKD

SEQ ID NO: 1675810 - protein, 18 aa, Staphylococcus aureus
IYQFPLLLFYKGNIKLIN

SEQ ID NO: 1675811 - protein, 18 aa, Staphylococcus aureus
KAPNLKLAITAGVGSDHV

SEQ ID NO: 1675812 - protein, 17 aa, Staphylococcus aureus
KCLRHSRFIFLSPEFLL

SEQ ID NO: 1675813 - protein, 17 aa, Staphylococcus aureus
KHFKVTAPIFIDNAESV

SEQ ID NO: 1675814 - protein, 23 aa, Staphylococcus aureus
KLNELRSGFNIDNYITLEEYFEN

SEQ ID NO: 1675815 - protein, 21 aa, Staphylococcus aureus
KSTLLSAICRLIRFDNGEVKI

SEQ ID NO: 1675816 - protein, 25 aa, Staphylococcus aureus
LNSDWSRNQIQDWIKAGLVVANDKV

SEQ ID NO: 1675817 - protein, 22 aa, Staphylococcus aureus
LVNNSRFGFKMGHQSMVDSMVY

SEQ ID NO: 1675818 - protein, 20 aa, Staphylococcus aureus
MNVDWKKRIHMIIGTDEESD

SEQ ID NO: 1675819 - protein, 17 aa, Staphylococcus aureus
NEVMPIFDAAMKYKEDG

SEQ ID NO: 1675820 - protein, 17 aa, Staphylococcus aureus
PQLAFAIGNAIKYLSRA

SEQ ID NO: 1675821 - protein, 20 aa, Staphylococcus aureus
SIGLILGFLVERFMNNQEEL

SEQ ID NO: 1675822 - protein, 21 aa, Staphylococcus aureus
TEVKIVFMLAMDKVDDQLKLL

SEQ ID NO: 1675823 - protein, 18 aa, Staphylococcus aureus
DEKLQWKWVKGIIEAYQE

SEQ ID NO: 1675824 - protein, 18 aa, Staphylococcus aureus
EADLEFGVEICEPQPPSE

SEQ ID NO: 1675825 - protein, 22 aa, Staphylococcus aureus
EVIPGKMSLVIADIMDETTTKD

SEQ ID NO: 1675826 - protein, 18 aa, Staphylococcus aureus
IAKGDKWILYGLNGAGKT

SEQ ID NO: 1675827 - protein, 17 aa, Staphylococcus aureus
IFECIHAGLPVILSPVK

SEQ ID NO: 1675828 - protein, 18 aa, Staphylococcus aureus
ISAGFFFINPFEVVYYAG

SEQ ID NO: 1675829 - protein, 21 aa, Staphylococcus aureus
KELRDTLHFEMLWDTSKIDVI

SEQ ID NO: 1675830 - protein, 18 aa, Staphylococcus aureus
KIEPRDSVFFVHELMGYN

SEQ ID NO: 1675831 - protein, 19 aa, Staphylococcus aureus
MIDYFKALFPNGGLYIHLD

SEQ ID NO: 1675832 - protein, 17 aa, Staphylococcus aureus
MKHYFILNFPQRPGALR

SEQ ID NO: 1675833 - protein, 18 aa, Staphylococcus aureus
MPMGIVFEVEGKTIYHTG

SEQ ID NO: 1675834 - protein, 23 aa, Staphylococcus aureus
NKKEFKNNLALCVYYLEKLIKDS

SEQ ID NO: 1675835 - protein, 22 aa, Staphylococcus aureus
NPPHLKAMIPWEGLNDMYREVA

SEQ ID NO: 1675836 - protein, 18 aa, Staphylococcus aureus
PRDSVFFVHELMGYNTEL

SEQ ID NO: 1675837 - protein, 25 aa, Staphylococcus aureus
QRVPILGVCLGFQCIVSYFGGNIIH

SEQ ID NO: 1675838 - protein, 18 aa, Staphylococcus aureus
RFKGIIGLVTMKKVRDPL

SEQ ID NO: 1675839 - protein, 25 aa, Staphylococcus aureus
RRCHSGPLLKNGHRFGFYRGYNGHS

SEQ ID NO: 1675840 - protein, 18 aa, Staphylococcus aureus
RTKMYNVFEYFKQISNNK

SEQ ID NO: 1675841 - protein, 18 aa, Staphylococcus aureus
SKLGGFDWFKRKTNKKDT

SEQ ID NO: 1675842 - protein, 21 aa, Staphylococcus aureus
YKLDRYVGLIAEEVENLGLKE

SEQ ID NO: 1675843 - protein, 19 aa, Staphylococcus aureus
YKYARGVAVYGDIKNGAND

SEQ ID NO: 1675844 - protein, 24 aa, Staphylococcus aureus
DFPKDFKGIAGWILEVKSNTPGNT

SEQ ID NO: 1675845 - protein, 18 aa, Staphylococcus aureus
DLVEFDWLDGFDIECRNE

SEQ ID NO: 1675846 - protein, 19 aa, Staphylococcus aureus
DQCSVCHAVLPQIEDLMQS

SEQ ID NO: 1675847 - protein, 19 aa, Staphylococcus aureus
ENLPWKELDIDIAIDATGK

SEQ ID NO: 1675848 - protein, 17 aa, Staphylococcus aureus
FAVITPFQGHTEKWNEH

SEQ ID NO: 1675849 - protein, 17 aa, Staphylococcus aureus
FKLIILRKGRGLAGTVM

SEQ ID NO: 1675850 - protein, 22 aa, Staphylococcus aureus
FLQRCPNLKWIAWFATGVNTLP

SEQ ID NO: 1675851 - protein, 18 aa, Staphylococcus aureus
GDGIKAIFNYPSQETAED

SEQ ID NO: 1675852 - protein, 19 aa, Staphylococcus aureus
GLMIQRFGTTYVLTTKKEA

SEQ ID NO: 1675853 - protein, 17 aa, Staphylococcus aureus
IEVVYGFAQLKRAAALA

SEQ ID NO: 1675854 - protein, 17 aa, Staphylococcus aureus
IFSVMWSEHCSYKHSKP

SEQ ID NO: 1675855 - protein, 20 aa, Staphylococcus aureus
IGLRANKKDFGWIYSSSLAS

SEQ ID NO: 1675856 - protein, 18 aa, Staphylococcus aureus
IRVLKDINIHINAGEFIA

SEQ ID NO: 1675857 - protein, 19 aa, Staphylococcus aureus
KAAHIDTSYIIKTTEAKTG

SEQ ID NO: 1675858 - protein, 21 aa, Staphylococcus aureus
KHCDNCGGAIRPDIVLYGEML

SEQ ID NO: 1675859 - protein, 26 aa, Staphylococcus aureus
KLNMIIGHWGEFIPFFLERMDEALFA

SEQ ID NO: 1675860 - protein, 18 aa, Staphylococcus aureus
KMLARKGYDFGWQEGDDS

SEQ ID NO: 1675861 - protein, 23 aa, Staphylococcus aureus
KNLWLRTELKYFYFYHLNNGIWN

SEQ ID NO: 1675862 - protein, 17 aa, Staphylococcus aureus
KPLLSDILLYFLRKNTD

SEQ ID NO: 1675863 - protein, 18 aa, Staphylococcus aureus
LEGDLPLFPGHGPYTTVD

SEQ ID NO: 1675864 - protein, 19 aa, Staphylococcus aureus
LIEGSNFTTGWIFFINSVG

SEQ ID NO: 1675865 - protein, 19 aa, Staphylococcus aureus
LRPASLDDLGLEAAFKSYF

SEQ ID NO: 1675866 - protein, 19 aa, Staphylococcus aureus
LSDLFNWSRFKVKTFLDLL

SEQ ID NO: 1675867 - protein, 19 aa, Staphylococcus aureus
LYGNVKFGVGPVIEGGFYY

SEQ ID NO: 1675868 - protein, 20 aa, Staphylococcus aureus
MKRVDDIKAYIQGDVPKVMG

SEQ ID NO: 1675869 - protein, 17 aa, Staphylococcus aureus
MRSDIPLARGLGSSASA

SEQ ID NO: 1675870 - protein, 19 aa, Staphylococcus aureus
PQWAGSCWYYLRYIDPKNE

SEQ ID NO: 1675871 - protein, 17 aa, Staphylococcus aureus
RKVAIALRNRYRRSLLD

SEQ ID NO: 1675872 - protein, 21 aa, Staphylococcus aureus
VIYMPHWLEFYSIAIHSDVTS

SEQ ID NO: 1675873 - protein, 18 aa, Staphylococcus aureus
VKKRMVISDAYVYTKSNH

SEQ ID NO: 1675874 - protein, 20 aa, Staphylococcus aureus
WLMLDVFQWTRTDFVVHMHD

SEQ ID NO: 1675875 - protein, 17 aa, Staphylococcus aureus
WRYMLDRCEIMLSESKK

SEQ ID NO: 1675876 - protein, 17 aa, Staphylococcus aureus
YAGFVYDVMADVLYHAK

SEQ ID NO: 1675877 - protein, 19 aa, Staphylococcus aureus
YMLDRCEIMLSESKKHILN

SEQ ID NO: 1675878 - protein, 19 aa, Staphylococcus aureus
ANLLRICARYDNLDIVEDA

SEQ ID NO: 1675879 - protein, 17 aa, Staphylococcus aureus
AQVVLRWNVQHGVVTIP

SEQ ID NO: 1675880 - protein, 17 aa, Staphylococcus aureus
ARGYLTFGHTINVPPIA

SEQ ID NO: 1675881 - protein, 18 aa, Staphylococcus aureus
DIVWKFAEKVIFPHVEQN

SEQ ID NO: 1675882 - protein, 20 aa, Staphylococcus aureus
EAKEYWLCWVTTERNEQGPY

SEQ ID NO: 1675883 - protein, 19 aa, Staphylococcus aureus
FDLSKGFPLLTTKKVSFKL

SEQ ID NO: 1675884 - protein, 24 aa, Staphylococcus aureus
FELSQRLKQQFSHYGVKIISLVAM

SEQ ID NO: 1675885 - protein, 17 aa, Staphylococcus aureus
FKNYLGSIGKSFKEKFS

SEQ ID NO: 1675886 - protein, 18 aa, Staphylococcus aureus
HAIDACGINGLYIKNCSF

SEQ ID NO: 1675887 - protein, 18 aa, Staphylococcus aureus
ICNYCFEHGVVIIAVAGN

SEQ ID NO: 1675888 - protein, 19 aa, Staphylococcus aureus
IELDFYFPLLKSWSKKKKS

SEQ ID NO: 1675889 - protein, 17 aa, Staphylococcus aureus
IQIWPEFDIDGAVELQY

SEQ ID NO: 1675890 - protein, 23 aa, Staphylococcus aureus
IQRSTNFSIVWILPISSIDNMPI

SEQ ID NO: 1675891 - protein, 18 aa, Staphylococcus aureus
ITGRIFISLAVKFSKARL

SEQ ID NO: 1675892 - protein, 18 aa, Staphylococcus aureus
KALFAASFVTHFSGQTPH

SEQ ID NO: 1675893 - protein, 21 aa, Staphylococcus aureus
KFTEGSFKQWGYDLALTEFGD

SEQ ID NO: 1675894 - protein, 19 aa, Staphylococcus aureus
KHPYTWGLLSSMPDLSTTN

SEQ ID NO: 1675895 - protein, 24 aa, Staphylococcus aureus
KLAQHYPLKRIAVMSAPKEKSDDG

SEQ ID NO: 1675896 - protein, 17 aa, Staphylococcus aureus
KSSLSLETIFHCYHQMM

SEQ ID NO: 1675897 - protein, 20 aa, Staphylococcus aureus
LEEARALLIEAIDSGAALEK

SEQ ID NO: 1675898 - protein, 19 aa, Staphylococcus aureus
LKSKVIRHAYLDVFENEPL

SEQ ID NO: 1675899 - protein, 21 aa, Staphylococcus aureus
LMDHKRIFVPKMDYLNHQMTF

SEQ ID NO: 1675900 - protein, 19 aa, Staphylococcus aureus
LPFPIKINQMLGHQTSFLT

SEQ ID NO: 1675901 - protein, 19 aa, Staphylococcus aureus
MPIEVVYGFAQLKRAAALA

SEQ ID NO: 1675902 - protein, 17 aa, Staphylococcus aureus
NGFGYDPIFYVPKLDKT

SEQ ID NO: 1675903 - protein, 17 aa, Staphylococcus aureus
NVGVPALVVFLNKVDMV

SEQ ID NO: 1675904 - protein, 18 aa, Staphylococcus aureus
PWLRRLGFENVKEVLLDP

SEQ ID NO: 1675905 - protein, 22 aa, Staphylococcus aureus
QPDEFYFLPSFMSPLKKHNNFI

SEQ ID NO: 1675906 - protein, 17 aa, Staphylococcus aureus
QPLTVAGIFTFKPNEDD

SEQ ID NO: 1675907 - protein, 20 aa, Staphylococcus aureus
QRSYHGNVMMLKRDAGAQDV

SEQ ID NO: 1675908 - protein, 26 aa, Staphylococcus aureus
QVLEKFKSLIFISGTLKFNHSFDAFK

SEQ ID NO: 1675909 - protein, 17 aa, Staphylococcus aureus
REKRVVISLTYIYGIGT

SEQ ID NO: 1675910 - protein, 20 aa, Staphylococcus aureus
RLLDKWGMSSSELMAFGDAN

SEQ ID NO: 1675911 - protein, 18 aa, Staphylococcus aureus
RLNYPVLCANIYENDSTL

SEQ ID NO: 1675912 - protein, 17 aa, Staphylococcus aureus
VKKVEMISGMTFADLDT

SEQ ID NO: 1675913 - protein, 18 aa, Staphylococcus aureus
AEESYFLFYINRPSIIVG

SEQ ID NO: 1675914 - protein, 20 aa, Staphylococcus aureus
AGVHKLPFVCVIINNKYAIS

SEQ ID NO: 1675915 - protein, 24 aa, Staphylococcus aureus
ARVIAWYAKEQWRLDVFNTHGKIY

SEQ ID NO: 1675916 - protein, 17 aa, Staphylococcus aureus
DFRRLGVRGDFNDPYIT

SEQ ID NO: 1675917 - protein, 18 aa, Staphylococcus aureus
DGVDIVIHIGVNTVDLEG

SEQ ID NO: 1675918 - protein, 19 aa, Staphylococcus aureus
DKPRFEAIFTELRNRDITF

SEQ ID NO: 1675919 - protein, 21 aa, Staphylococcus aureus
DPTFMWHLAFAYGQEERDKEA

SEQ ID NO: 1675920 - protein, 25 aa, Staphylococcus aureus
DVIEMSRPVKMNSLLKLYFDRNILT

SEQ ID NO: 1675921 - protein, 20 aa, Staphylococcus aureus
DYIKLLGVDYIWLTPVYESP

SEQ ID NO: 1675922 - protein, 21 aa, Staphylococcus aureus
EVIPGKMSLVIADIMDETTTK

SEQ ID NO: 1675923 - protein, 19 aa, Staphylococcus aureus
EWTNGKFLPKRKVVKIEQF

SEQ ID NO: 1675924 - protein, 18 aa, Staphylococcus aureus
FNELMVAIQSPFLLDEED

SEQ ID NO: 1675925 - protein, 17 aa, Staphylococcus aureus
GEIIFKHGLSLAQVQQI

SEQ ID NO: 1675926 - protein, 21 aa, Staphylococcus aureus
GEMKKRYGLIYVDRDNDGRGT

SEQ ID NO: 1675927 - protein, 17 aa, Staphylococcus aureus
GFPSIPLKIMFPQLKVT

SEQ ID NO: 1675928 - protein, 18 aa, Staphylococcus aureus
GMIPVEWEKVYTIAYVDD

SEQ ID NO: 1675929 - protein, 17 aa, Staphylococcus aureus
HHLKGRILVSTEGINGT

SEQ ID NO: 1675930 - protein, 18 aa, Staphylococcus aureus
HHQLIFFGRYHCLARKPK

SEQ ID NO: 1675931 - protein, 18 aa, Staphylococcus aureus
HLSTIKVAPLFSEDDRHK

SEQ ID NO: 1675932 - protein, 18 aa, Staphylococcus aureus
IANFKSGKSYVFKPKSLF

SEQ ID NO: 1675933 - protein, 17 aa, Staphylococcus aureus
ICTYDLLFRSGLDLKVD

SEQ ID NO: 1675934 - protein, 21 aa, Staphylococcus aureus
IELKNRIGFVYAENYFNERWT

SEQ ID NO: 1675935 - protein, 20 aa, Staphylococcus aureus
IKKGYCLLVGIGQDSTEQDA

SEQ ID NO: 1675936 - protein, 17 aa, Staphylococcus aureus
IVCAGASAVLFGSVNAI

SEQ ID NO: 1675937 - protein, 18 aa, Staphylococcus aureus
KEFLEKWAGVPTEVHVAS

SEQ ID NO: 1675938 - protein, 21 aa, Staphylococcus aureus
KKQVPVCCFTFGIPNESIIKR

SEQ ID NO: 1675939 - protein, 20 aa, Staphylococcus aureus
KLTSEHLVEFMPIIYDPVIA

SEQ ID NO: 1675940 - protein, 19 aa, Staphylococcus aureus
KLWPIQPLRDFWGINRRTE

SEQ ID NO: 1675941 - protein, 21 aa, Staphylococcus aureus
KNAFDFPGFVPAYIRPLFCEG

SEQ ID NO: 1675942 - protein, 18 aa, Staphylococcus aureus
KQYGFKFLGPVTVFSFLE

SEQ ID NO: 1675943 - protein, 20 aa, Staphylococcus aureus
KSTLLSAICRLIRFDEGEVK

SEQ ID NO: 1675944 - protein, 19 aa, Staphylococcus aureus
LELSFGFKFLREIDNRLGL

SEQ ID NO: 1675945 - protein, 23 aa, Staphylococcus aureus
LLNHGIPSYGYRVMAPETTGTIN

SEQ ID NO: 1675946 - protein, 20 aa, Staphylococcus aureus
MDVFKKCYKALITKQETNIQ

SEQ ID NO: 1675947 - protein, 17 aa, Staphylococcus aureus
NLFPEIIFLDAISLRTF

SEQ ID NO: 1675948 - protein, 19 aa, Staphylococcus aureus
NYYATRFMLTVPFENIDVQ

SEQ ID NO: 1675949 - protein, 20 aa, Staphylococcus aureus
PTAIRYAGLIPRLKQLDLDV

SEQ ID NO: 1675950 - protein, 20 aa, Staphylococcus aureus
QRRLFEWLRQNGFLIKRKGV

SEQ ID NO: 1675951 - protein, 24 aa, Staphylococcus aureus
RSGLDLKVDFVIRVGKPVISKKLN

SEQ ID NO: 1675952 - protein, 18 aa, Staphylococcus aureus
TFEYRDARNYLSYLYSNH

SEQ ID NO: 1675953 - protein, 17 aa, Staphylococcus aureus
VHKSVLHALDISQQEGH

SEQ ID NO: 1675954 - protein, 18 aa, Staphylococcus aureus
VLGGLTYRESHFALELLH

SEQ ID NO: 1675955 - protein, 21 aa, Staphylococcus aureus
YEKRLNPAYFIRIHRSYIINT

SEQ ID NO: 1675956 - protein, 21 aa, Staphylococcus aureus
AACLLTAVPVMKVFKYFYSNR

SEQ ID NO: 1675957 - protein, 18 aa, Staphylococcus aureus
ALNEEFDLLALRKSVIRW

SEQ ID NO: 1675958 - protein, 22 aa, Staphylococcus aureus
DACIKYQYIGICYGQPGVGKTL

SEQ ID NO: 1675959 - protein, 21 aa, Staphylococcus aureus
DLFIDWTWGEKFFRKHLIDYD

SEQ ID NO: 1675960 - protein, 17 aa, Staphylococcus aureus
EIKNWEFPFVIKPGDDL

SEQ ID NO: 1675961 - protein, 21 aa, Staphylococcus aureus
ETKKLTGWYARRIAVGRDGEI

SEQ ID NO: 1675962 - protein, 22 aa, Staphylococcus aureus
EVLVCTVIGFPLGASTTATKAF

SEQ ID NO: 1675963 - protein, 22 aa, Staphylococcus aureus
EVPPLMCASLWSKFDLFKKYAN

SEQ ID NO: 1675964 - protein, 19 aa, Staphylococcus aureus
EYPEFAWFEGMINSIVHRR

SEQ ID NO: 1675965 - protein, 25 aa, Staphylococcus aureus
FKEKRTFSKFEAWIYLLMEANHSKA

SEQ ID NO: 1675966 - protein, 22 aa, Staphylococcus aureus
GKDLKVAIVVSRFNDFITGRLL

SEQ ID NO: 1675967 - protein, 22 aa, Staphylococcus aureus
HGFISFTPVGGWWNQVMLSQKV

SEQ ID NO: 1675968 - protein, 18 aa, Staphylococcus aureus
IAKELGIGMGTLYRHFKD

SEQ ID NO: 1675969 - protein, 17 aa, Staphylococcus aureus
IEAKLKLLQDITNLLNY

SEQ ID NO: 1675970 - protein, 20 aa, Staphylococcus aureus
IKNWEFPLVIKPGDDLPTAG

SEQ ID NO: 1675971 - protein, 23 aa, Staphylococcus aureus
ITTEYYWHWDLKNSKLDVFDYKK

SEQ ID NO: 1675972 - protein, 19 aa, Staphylococcus aureus
KAAHIDTSYIIKTAEAKTG

SEQ ID NO: 1675973 - protein, 18 aa, Staphylococcus aureus
KGLEHFGLEYKITYDKKK

SEQ ID NO: 1675974 - protein, 23 aa, Staphylococcus aureus
KIPLVRLKLNFSYDYKEKLKREL

SEQ ID NO: 1675975 - protein, 23 aa, Staphylococcus aureus
KLRRFKEALIFMGRKNGKTTTIS

SEQ ID NO: 1675976 - protein, 17 aa, Staphylococcus aureus
KMIKQRMVDAFILLYSK

SEQ ID NO: 1675977 - protein, 21 aa, Staphylococcus aureus
KRFALPNAEVMIHQPLGGAQG

SEQ ID NO: 1675978 - protein, 21 aa, Staphylococcus aureus
KSFLAKLLWIYTSFFKGQMLY

SEQ ID NO: 1675979 - protein, 17 aa, Staphylococcus aureus
LDQFILLIFYGTFPGGD

SEQ ID NO: 1675980 - protein, 17 aa, Staphylococcus aureus
LIIQRFGTTYVLTTKKE

SEQ ID NO: 1675981 - protein, 19 aa, Staphylococcus aureus
LKSRVIRHAYLDVFENEPL

SEQ ID NO: 1675982 - protein, 18 aa, Staphylococcus aureus
LPEGLACEGRVVIQTGTV

SEQ ID NO: 1675983 - protein, 19 aa, Staphylococcus aureus
MDGRIPINVWTGDSIARSG

SEQ ID NO: 1675984 - protein, 18 aa, Staphylococcus aureus
NAIGKRWIVSHVEGENDK

SEQ ID NO: 1675985 - protein, 23 aa, Staphylococcus aureus
NAIKALCHKLGYSVDQVIAFGDS

SEQ ID NO: 1675986 - protein, 20 aa, Staphylococcus aureus
NIPFLWRLSSELNVAQLRQA

SEQ ID NO: 1675987 - protein, 17 aa, Staphylococcus aureus
NYGTLGLAFIKQYESKK

SEQ ID NO: 1675988 - protein, 17 aa, Staphylococcus aureus
PFCVKITFEIDKNDNWL

SEQ ID NO: 1675989 - protein, 20 aa, Staphylococcus aureus
PLTEAFLFSRGHFKGNQFPE

SEQ ID NO: 1675990 - protein, 18 aa, Staphylococcus aureus
PTEIKFLLYFAKMTKKDK

SEQ ID NO: 1675991 - protein, 19 aa, Staphylococcus aureus
QEVYQEWYLGSKLYEEVEK

SEQ ID NO: 1675992 - protein, 19 aa, Staphylococcus aureus
RIKEFELLWYLASRENEVI

SEQ ID NO: 1675993 - protein, 20 aa, Staphylococcus aureus
RKIKGGFTFAILTKDALYGA

SEQ ID NO: 1675994 - protein, 17 aa, Staphylococcus aureus
RLTGRLSGNIGYVASKV

SEQ ID NO: 1675995 - protein, 19 aa, Staphylococcus aureus
RPDYIGAFWNVVNWEKVDE

SEQ ID NO: 1675996 - protein, 20 aa, Staphylococcus aureus
RPMMYIALSYDHRIIDGKEA

SEQ ID NO: 1675997 - protein, 23 aa, Staphylococcus aureus
RPVRKRIGMVFQFPESQLFEDTV

SEQ ID NO: 1675998 - protein, 24 aa, Staphylococcus aureus
SGIHKRFYLFVALMTEFQALNGMR

SEQ ID NO: 1675999 - protein, 19 aa, Staphylococcus aureus
SGVFIEWVFMFVIKSDDYR

SEQ ID NO: 1676000 - protein, 20 aa, Staphylococcus aureus
TDIPFCIYNKTALCTGKGEK

SEQ ID NO: 1676001 - protein, 20 aa, Staphylococcus aureus
TFKPELLSVLGRTHNTEDIY

SEQ ID NO: 1676002 - protein, 19 aa, Staphylococcus aureus
TGEVWAYYRVRSESISTAN

SEQ ID NO: 1676003 - protein, 17 aa, Staphylococcus aureus
TGFDGWAPLFFRGREVS

SEQ ID NO: 1676004 - protein, 18 aa, Staphylococcus aureus
VAAVWKLDLKGHKPALEG

SEQ ID NO: 1676005 - protein, 24 aa, Staphylococcus aureus
VASMIIEFVEWINTLEFFKNWKKQ

SEQ ID NO: 1676006 - protein, 20 aa, Staphylococcus aureus
VGLWSFDFNIDWHAGGDKRK

SEQ ID NO: 1676007 - protein, 22 aa, Staphylococcus aureus
VPFRTAESWDNVGLLIGDEDVE

SEQ ID NO: 1676008 - protein, 17 aa, Staphylococcus aureus
WAIAYKFPAEEVVTKLL

SEQ ID NO: 1676009 - protein, 18 aa, Staphylococcus aureus
WNIIRPPFNVTRISEYAA

SEQ ID NO: 1676010 - protein, 23 aa, Staphylococcus aureus
WQHFIIGSLFGWVHKETKLRRFK

SEQ ID NO: 1676011 - protein, 21 aa, Staphylococcus aureus
YNVPFLWRLSSGLNVAQLQQA

SEQ ID NO: 1676012 - protein, 24 aa, Staphylococcus aureus
AEFIKRLACLPSHIYRLKGFMTFE

SEQ ID NO: 1676013 - protein, 19 aa, Staphylococcus aureus
AGEPCLRYHQTFYTMTGKP

SEQ ID NO: 1676014 - protein, 17 aa, Staphylococcus aureus
AKMGLALNRLVRDGEIS

SEQ ID NO: 1676015 - protein, 18 aa, Staphylococcus aureus
AKRVLAFEIDQRLIPVLN

SEQ ID NO: 1676016 - protein, 30 aa, Staphylococcus aureus
ASYRLEFYRLYLLMVHLLKFGEMYRDSVTH

SEQ ID NO: 1676017 - protein, 17 aa, Staphylococcus aureus
CKLPKGIDPYKFHEYLI

SEQ ID NO: 1676018 - protein, 18 aa, Staphylococcus aureus
DKNNAKNVLFDWNDVEIH

SEQ ID NO: 1676019 - protein, 17 aa, Staphylococcus aureus
DMSEIKTALIAVGPEND

SEQ ID NO: 1676020 - protein, 24 aa, Staphylococcus aureus
DVIEMSRPVKMNSLLKLYFDRNIL

SEQ ID NO: 1676021 - protein, 24 aa, Staphylococcus aureus
EDKELRKAMLYAIDREKWIKAFFN

SEQ ID NO: 1676022 - protein, 20 aa, Staphylococcus aureus
EELTRIGLDLPFPIKINQML

SEQ ID NO: 1676023 - protein, 21 aa, Staphylococcus aureus
EGKRAVLLLHGFTGNSSDVRQ

SEQ ID NO: 1676024 - protein, 24 aa, Staphylococcus aureus
EGVVVRLANFGAFVEIAPGVQGLV

SEQ ID NO: 1676025 - protein, 17 aa, Staphylococcus aureus
EIQRKWIEKFKVIGDTF

SEQ ID NO: 1676026 - protein, 27 aa, Staphylococcus aureus
EIQVGLGRTGKWFAMEWEQVVPDIYIL

SEQ ID NO: 1676027 - protein, 18 aa, Staphylococcus aureus
ELLFKRRIDIGGVNNNFK

SEQ ID NO: 1676028 - protein, 18 aa, Staphylococcus aureus
FEIKRFDQQYGYVGVPTT

SEQ ID NO: 1676029 - protein, 18 aa, Staphylococcus aureus
FLDKKSWCKNKFQVTNQV

SEQ ID NO: 1676030 - protein, 18 aa, Staphylococcus aureus
FLKTLPFEQILSGYAEVY

SEQ ID NO: 1676031 - protein, 18 aa, Staphylococcus aureus
FTLNILYPYIETIHITKD

SEQ ID NO: 1676032 - protein, 18 aa, Staphylococcus aureus
GPGPRKALDYMYEIAHRD

SEQ ID NO: 1676033 - protein, 23 aa, Staphylococcus aureus
HCNYWKSSFLFRSSLSTSEMIEK

SEQ ID NO: 1676034 - protein, 17 aa, Staphylococcus aureus
IDEGWAFSASRQGKKVG

SEQ ID NO: 1676035 - protein, 17 aa, Staphylococcus aureus
IFIGLLCKHGHWHAVIY

SEQ ID NO: 1676036 - protein, 19 aa, Staphylococcus aureus
IIIGGGMAYTFLKAQGKEI

SEQ ID NO: 1676037 - protein, 19 aa, Staphylococcus aureus
IMQRLGRAFALLQVTGEVL

SEQ ID NO: 1676038 - protein, 22 aa, Staphylococcus aureus
IRRRAVPTWGVFLNEEAQGGGP

SEQ ID NO: 1676039 - protein, 17 aa, Staphylococcus aureus
KDKVEWIILAGYMRLIG

SEQ ID NO: 1676040 - protein, 20 aa, Staphylococcus aureus
KKGPFAPDFIKVWKDRYKKI

SEQ ID NO: 1676041 - protein, 22 aa, Staphylococcus aureus
KLSRYPQLYSRIGFAHEFDNLS

SEQ ID NO: 1676042 - protein, 24 aa, Staphylococcus aureus
KNVEKAGAVALVLEAIPNDLAEEI

SEQ ID NO: 1676043 - protein, 18 aa, Staphylococcus aureus
KNVFDLLPVNAFRDKVIG

SEQ ID NO: 1676044 - protein, 18 aa, Staphylococcus aureus
KNVLFDWNDVEIHRNKNF

SEQ ID NO: 1676045 - protein, 17 aa, Staphylococcus aureus
KPGEISWNSPFGEGRPG

SEQ ID NO: 1676046 - protein, 20 aa, Staphylococcus aureus
KRFKGAHGLLYEQELGLQAT

SEQ ID NO: 1676047 - protein, 17 aa, Staphylococcus aureus
KRIRLNINLENWNKQKL

SEQ ID NO: 1676048 - protein, 18 aa, Staphylococcus aureus
LAESVLPFHPLFIKPNKD

SEQ ID NO: 1676049 - protein, 25 aa, Staphylococcus aureus
LKDLKKGQCIFSDFYGRVGKMVVHC

SEQ ID NO: 1676050 - protein, 23 aa, Staphylococcus aureus
LLKRFSNNMIIIFKNVADEHRDI

SEQ ID NO: 1676051 - protein, 18 aa, Staphylococcus aureus
LLPVNAFRDKVIGLVATA

SEQ ID NO: 1676052 - protein, 17 aa, Staphylococcus aureus
LNNSLARLEMPQVNEGE

SEQ ID NO: 1676053 - protein, 17 aa, Staphylococcus aureus
LPFHAKRFNDWLESMSN

SEQ ID NO: 1676054 - protein, 20 aa, Staphylococcus aureus
MGVKRLGKIIAQIQQYTDID

SEQ ID NO: 1676055 - protein, 18 aa, Staphylococcus aureus
MKLRIGFSDIFFNVDKLT

SEQ ID NO: 1676056 - protein, 17 aa, Staphylococcus aureus
NGFGYDPIFYVPKLDRT

SEQ ID NO: 1676057 - protein, 18 aa, Staphylococcus aureus
NGKKEWKLFYLYKELIQT

SEQ ID NO: 1676058 - protein, 17 aa, Staphylococcus aureus
NMFWRQNISQMWVETEF

SEQ ID NO: 1676059 - protein, 18 aa, Staphylococcus aureus
NPFPKEWRMHAFFMDALP

SEQ ID NO: 1676060 - protein, 17 aa, Staphylococcus aureus
NVFDLLPVNAFRDKVIG

SEQ ID NO: 1676061 - protein, 17 aa, Staphylococcus aureus
PHERLFALLIKKDGKQV

SEQ ID NO: 1676062 - protein, 17 aa, Staphylococcus aureus
PHLRFGFIHVPYIPEQV

SEQ ID NO: 1676063 - protein, 19 aa, Staphylococcus aureus
PLQMCSIMEDFYIEKLITG

SEQ ID NO: 1676064 - protein, 26 aa, Staphylococcus aureus
RAKVKHLRKSPCYNFELEVIAKNENN

SEQ ID NO: 1676065 - protein, 23 aa, Staphylococcus aureus
RHKTSEELVRWQTYMETLSENLY

SEQ ID NO: 1676066 - protein, 24 aa, Staphylococcus aureus
RPKIYADLCLLCMSLSEAGHGRML

SEQ ID NO: 1676067 - protein, 24 aa, Staphylococcus aureus
RRCHSGPLLKNGHRFGFYRGYNGH

SEQ ID NO: 1676068 - protein, 24 aa, Staphylococcus aureus
SEYLRPEICKELREKLKQYHYVES

SEQ ID NO: 1676069 - protein, 25 aa, Staphylococcus aureus
SKLIKRIRFATGVIREIKAFKPDVI

SEQ ID NO: 1676070 - protein, 21 aa, Staphylococcus aureus
SSLPIYNLYFIKRNIEKLINA

SEQ ID NO: 1676071 - protein, 19 aa, Staphylococcus aureus
TAAIKDFWEKVGLKTNVKL

SEQ ID NO: 1676072 - protein, 25 aa, Staphylococcus aureus
TKAQFIKRLACLPTHIYRLKGFMTF

SEQ ID NO: 1676073 - protein, 22 aa, Staphylococcus aureus
TKIATVCKFDLPKLAQMKPKDT

SEQ ID NO: 1676074 - protein, 18 aa, Staphylococcus aureus
VAAVWKLDLKGHKPALED

SEQ ID NO: 1676075 - protein, 21 aa, Staphylococcus aureus
VEAAIKIARKWGSDVKGITDG

SEQ ID NO: 1676076 - protein, 17 aa, Staphylococcus aureus
VGKEFLEKWAGVPTEVH

SEQ ID NO: 1676077 - protein, 19 aa, Staphylococcus aureus
VKKRMVISDAYAFTKSNHI

SEQ ID NO: 1676078 - protein, 18 aa, Staphylococcus aureus
VKRTCGYLGNPVQRPVIK

SEQ ID NO: 1676079 - protein, 18 aa, Staphylococcus aureus
VNHWIDFGVDGFRFDVIN

SEQ ID NO: 1676080 - protein, 17 aa, Staphylococcus aureus
WLYETNKYYALAMELIH

SEQ ID NO: 1676081 - protein, 17 aa, Staphylococcus aureus
YETNKYYALAMELIHQR

SEQ ID NO: 1676082 - protein, 23 aa, Staphylococcus aureus
YILKYVFANGIAREIIYDLLEEM

SEQ ID NO: 1676083 - protein, 26 aa, Staphylococcus aureus
AIERAAKVLGSWRLEDCTLYVTLEPC

SEQ ID NO: 1676084 - protein, 25 aa, Staphylococcus aureus
ANHFGGEMKKMWSGIKGIPSKLSSG

SEQ ID NO: 1676085 - protein, 18 aa, Staphylococcus aureus
ARRLKQWIDRPLISKEQI

SEQ ID NO: 1676086 - protein, 19 aa, Staphylococcus aureus
ARRLKQWIDRPLISKEQIE

SEQ ID NO: 1676087 - protein, 26 aa, Staphylococcus aureus
AYLKVAYQFSLPFGRDYADAHEKMVR

SEQ ID NO: 1676088 - protein, 17 aa, Staphylococcus aureus
CTMWQGFNYEIDMNLEP

SEQ ID NO: 1676089 - protein, 24 aa, Staphylococcus aureus
CVDKGWMCIQVFFIRQGNMIKRDT

SEQ ID NO: 1676090 - protein, 23 aa, Staphylococcus aureus
DLSRGCSIEDVYNLSFITAAQAL

SEQ ID NO: 1676091 - protein, 18 aa, Staphylococcus aureus
DLTEAFAPFVVLAGHASH

SEQ ID NO: 1676092 - protein, 18 aa, Staphylococcus aureus
DLVEFDWLEGFDIECRNE

SEQ ID NO: 1676093 - protein, 17 aa, Staphylococcus aureus
DNGRIIVISSIWGETGA

SEQ ID NO: 1676094 - protein, 18 aa, Staphylococcus aureus
DSWLYSTKFMLPKWLYKI

SEQ ID NO: 1676095 - protein, 23 aa, Staphylococcus aureus
DTDKGGQCVLQLLQVDNVEVSDA

SEQ ID NO: 1676096 - protein, 26 aa, Staphylococcus aureus
DTGFYRFWIQGIFARWTDNPNIEDMI

SEQ ID NO: 1676097 - protein, 17 aa, Staphylococcus aureus
DWSRFTIAVGKLSRTKI

SEQ ID NO: 1676098 - protein, 19 aa, Staphylococcus aureus
EAHHLLKLVGISAKAQQYI

SEQ ID NO: 1676099 - protein, 22 aa, Staphylococcus aureus
EDVYKLLNWIKLIIIEYISNIV

SEQ ID NO: 1676100 - protein, 19 aa, Staphylococcus aureus
EGLFTKGLRRRAKLLETIL

SEQ ID NO: 1676101 - protein, 17 aa, Staphylococcus aureus
EGLRLSQFYKELMYTTG

SEQ ID NO: 1676102 - protein, 24 aa, Staphylococcus aureus
EQARELGCVFAFYGHTHVAKYEYI

SEQ ID NO: 1676103 - protein, 24 aa, Staphylococcus aureus
FAHGEIRLDINFALYGNGSNTISD

SEQ ID NO: 1676104 - protein, 20 aa, Staphylococcus aureus
FEKRLFLMAIFNRNRTLFYK

SEQ ID NO: 1676105 - protein, 18 aa, Staphylococcus aureus
FGSFRPWPAYQYTIEHSI

SEQ ID NO: 1676106 - protein, 18 aa, Staphylococcus aureus
FIKKAIAYYRFRPYAMKI

SEQ ID NO: 1676107 - protein, 18 aa, Staphylococcus aureus
FINQIGWYLDFEKDIDLI

SEQ ID NO: 1676108 - protein, 19 aa, Staphylococcus aureus
FLECFKLTVEPVVKSFKPD

SEQ ID NO: 1676109 - protein, 22 aa, Staphylococcus aureus
FPDKSLKLSYKVNVANIDTPKN

SEQ ID NO: 1676110 - protein, 18 aa, Staphylococcus aureus
FSTIEEFINWDLEKLKSH

SEQ ID NO: 1676111 - protein, 18 aa, Staphylococcus aureus
FYKALGFKINRNPQMLDK

SEQ ID NO: 1676112 - protein, 18 aa, Staphylococcus aureus
GNIFGGYILYNLGYIHST

SEQ ID NO: 1676113 - protein, 18 aa, Staphylococcus aureus
GPFERFRIVHLIENGHVE

SEQ ID NO: 1676114 - protein, 18 aa, Staphylococcus aureus
HHRICYTTSASVLTEAVK

SEQ ID NO: 1676115 - protein, 20 aa, Staphylococcus aureus
IAIPDWFWSYQMAMTLNEET

SEQ ID NO: 1676116 - protein, 19 aa, Staphylococcus aureus
IALNEEFDLLALRKSVIRW

SEQ ID NO: 1676117 - protein, 21 aa, Staphylococcus aureus
IANNIKPIFGMTIYVTNGLNN

SEQ ID NO: 1676118 - protein, 26 aa, Staphylococcus aureus
ILKGYNFISVLGWPNYYANLGYQRAS

SEQ ID NO: 1676119 - protein, 20 aa, Staphylococcus aureus
IPLENIIKLPARFHKKSLPV

SEQ ID NO: 1676120 - protein, 22 aa, Staphylococcus aureus
IRVLRELDFHFQLVIDANESLN

SEQ ID NO: 1676121 - protein, 19 aa, Staphylococcus aureus
KAAALEEFDEVVQAQIDQA

SEQ ID NO: 1676122 - protein, 18 aa, Staphylococcus aureus
KDNGIAVLEQDVITPTVK

SEQ ID NO: 1676123 - protein, 35 aa, Staphylococcus aureus
KEGKAKINAVKTFSEYKKDALAKIADAYNAKVNEA

SEQ ID NO: 1676124 - protein, 25 aa, Staphylococcus aureus
KEVPPLMCASLWPKFDLFKKYANSE

SEQ ID NO: 1676125 - protein, 18 aa, Staphylococcus aureus
KKIYTCLVYGKTHTFGII

SEQ ID NO: 1676126 - protein, 18 aa, Staphylococcus aureus
KKSFKRKQLGFFRMIGYC

SEQ ID NO: 1676127 - protein, 24 aa, Staphylococcus aureus
KLSESVLRLKGYVSFRDQPNAIYE

SEQ ID NO: 1676128 - protein, 17 aa, Staphylococcus aureus
KSPRWAIAYKFPAEEVV

SEQ ID NO: 1676129 - protein, 21 aa, Staphylococcus aureus
LDLLSKIAITFSEEGNVDRIV

SEQ ID NO: 1676130 - protein, 18 aa, Staphylococcus aureus
LGALQGFCRIHQLKINHV

SEQ ID NO: 1676131 - protein, 17 aa, Staphylococcus aureus
LHRQTGHKIQWYIMTSD

SEQ ID NO: 1676132 - protein, 17 aa, Staphylococcus aureus
LIKSAAFPNILPSSTNP

SEQ ID NO: 1676133 - protein, 18 aa, Staphylococcus aureus
LKNSIGFVYSENYFNERW

SEQ ID NO: 1676134 - protein, 17 aa, Staphylococcus aureus
LKVSFDYIDWINTEFDQ

SEQ ID NO: 1676135 - protein, 17 aa, Staphylococcus aureus
LKYSIDYIVSETKSQPE

SEQ ID NO: 1676136 - protein, 17 aa, Staphylococcus aureus
LLHSRFIFLSPEFLLQP

SEQ ID NO: 1676137 - protein, 21 aa, Staphylococcus aureus
LNARLKLQLLDDIKSVFNSQM

SEQ ID NO: 1676138 - protein, 18 aa, Staphylococcus aureus
LNVFRMELLGAKVVAVEE

SEQ ID NO: 1676139 - protein, 26 aa, Staphylococcus aureus
LPEYMIPRKFEWMEQLPLTSNGKIDR

SEQ ID NO: 1676140 - protein, 19 aa, Staphylococcus aureus
LPLRIILGSVNLYGILSTN

SEQ ID NO: 1676141 - protein, 23 aa, Staphylococcus aureus
LQPWDFAGGLVILNEVDGLASNL

SEQ ID NO: 1676142 - protein, 17 aa, Staphylococcus aureus
LRIKYPYIRGKLWDLWT

SEQ ID NO: 1676143 - protein, 23 aa, Staphylococcus aureus
LRMIRCLRFQSQLSFDIAMETFE

SEQ ID NO: 1676144 - protein, 20 aa, Staphylococcus aureus
MAIFKDMNFELGIMELYAIE

SEQ ID NO: 1676145 - protein, 17 aa, Staphylococcus aureus
MDIENFFPSITFKQVRK

SEQ ID NO: 1676146 - protein, 25 aa, Staphylococcus aureus
MKLPESVLRLKGYVSFRNQPNAIYE

SEQ ID NO: 1676147 - protein, 25 aa, Staphylococcus aureus
MVNHLYRLPVMYIEYSGIYGDVSKV

SEQ ID NO: 1676148 - protein, 17 aa, Staphylococcus aureus
MYHAMAHKFGDNWKKAQ

SEQ ID NO: 1676149 - protein, 18 aa, Staphylococcus aureus
NAELLYKFANGIFSDENY

SEQ ID NO: 1676150 - protein, 19 aa, Staphylococcus aureus
NELYRVIGVYSKHKGKDTY

SEQ ID NO: 1676151 - protein, 22 aa, Staphylococcus aureus
NIPFRTAHEIVGKIVLECIQQG

SEQ ID NO: 1676152 - protein, 20 aa, Staphylococcus aureus
NSFVPSMHWIAADPKELNDY

SEQ ID NO: 1676153 - protein, 18 aa, Staphylococcus aureus
NVGDPLVRFNLEFINNNA

SEQ ID NO: 1676154 - protein, 18 aa, Staphylococcus aureus
PDQLKVIEIINLYQSFYE

SEQ ID NO: 1676155 - protein, 22 aa, Staphylococcus aureus
PGHPPESISFLLTDEGGGSSIP

SEQ ID NO: 1676156 - protein, 18 aa, Staphylococcus aureus
PHLAFKMANQIFLNKQCV

SEQ ID NO: 1676157 - protein, 28 aa, Staphylococcus aureus
PKLNMIIGHWGEFIPFFLERMDEALFAE

SEQ ID NO: 1676158 - protein, 22 aa, Staphylococcus aureus
PYTRSKFYSELKVLEAVKNGLD

SEQ ID NO: 1676159 - protein, 24 aa, Staphylococcus aureus
QKTMFPDQLKVIGIIKLYQSFYEN

SEQ ID NO: 1676160 - protein, 21 aa, Staphylococcus aureus
QVAINFAKLILCQTDSQCETK

SEQ ID NO: 1676161 - protein, 26 aa, Staphylococcus aureus
QVISSIKGIGSWTVQMFMLFQFPHVA

SEQ ID NO: 1676162 - protein, 17 aa, Staphylococcus aureus
RRLKQWIDRPLISKEQI

SEQ ID NO: 1676163 - protein, 19 aa, Staphylococcus aureus
SCNSEYFFTLSYFLKPGKA

SEQ ID NO: 1676164 - protein, 18 aa, Staphylococcus aureus
SELARPLLSAALSEDNEV

SEQ ID NO: 1676165 - protein, 20 aa, Staphylococcus aureus
SGPAALRCSQFVYKEQKNQK

SEQ ID NO: 1676166 - protein, 20 aa, Staphylococcus aureus
SIFEMFDYNIAYEIRLQAAL

SEQ ID NO: 1676167 - protein, 17 aa, Staphylococcus aureus
SNAWGWANATRAQTSSA

SEQ ID NO: 1676168 - protein, 24 aa, Staphylococcus aureus
SPFGEGRPGWHIECSVMAFHELGA

SEQ ID NO: 1676169 - protein, 21 aa, Staphylococcus aureus
SPGLRIGWIIADEKVIHHLAD

SEQ ID NO: 1676170 - protein, 20 aa, Staphylococcus aureus
TASEVVEWALYIAKNKIAID

SEQ ID NO: 1676171 - protein, 26 aa, Staphylococcus aureus
TAVIYDLDFLKTLPFEQILSGYAEVY

SEQ ID NO: 1676172 - protein, 23 aa, Staphylococcus aureus
TAYFKLAGLWIALNEEKDIPRNE

SEQ ID NO: 1676173 - protein, 18 aa, Staphylococcus aureus
TEAIPNWAAENGYPITNY

SEQ ID NO: 1676174 - protein, 17 aa, Staphylococcus aureus
TKSRCLYEETTYHILTN

SEQ ID NO: 1676175 - protein, 18 aa, Staphylococcus aureus
TMRAFKLGVILPVTKEFL

SEQ ID NO: 1676176 - protein, 17 aa, Staphylococcus aureus
TSLTISNDVYFDLGSQR

SEQ ID NO: 1676177 - protein, 27 aa, Staphylococcus aureus
TSTIIPMCHPLPLTGIDVHFNWDETNA

SEQ ID NO: 1676178 - protein, 24 aa, Staphylococcus aureus
TTDMKGGLMALVIALIELKEQNQL

SEQ ID NO: 1676179 - protein, 19 aa, Staphylococcus aureus
VDFRLIEPSAFYHTLQHFT

SEQ ID NO: 1676180 - protein, 20 aa, Staphylococcus aureus
WKKPSSFVIKPLPKNKYPDS

SEQ ID NO: 1676181 - protein, 21 aa, Staphylococcus aureus
WRGPNKFKIQCVILICYYYDN

SEQ ID NO: 1676182 - protein, 17 aa, Staphylococcus aureus
YERCGGCQLQHLSYEAQ

SEQ ID NO: 1676183 - protein, 23 aa, Staphylococcus aureus
YLIPEMHLKPILSYMKAHTMQTY

SEQ ID NO: 1676184 - protein, 17 aa, Staphylococcus aureus
YNLKCLLLKLTYRYLDN

SEQ ID NO: 1676185 - protein, 25 aa, Staphylococcus aureus
YQDCLLFFRLGDFYEMFYEDAKEAS

SEQ ID NO: 1676186 - protein, 23 aa, Staphylococcus aureus
YTGLRIGVTVAKTLAYALDVKLY

SEQ ID NO: 1676187 - protein, 19 aa, Staphylococcus aureus
AAELRLGIVNGHIAEGTLL

SEQ ID NO: 1676188 - protein, 21 aa, Staphylococcus aureus
ADLDFKLNLMLNAFSSDFYYF

SEQ ID NO: 1676189 - protein, 19 aa, Staphylococcus aureus
APFPSRWLYVVKHLQTLIQ

SEQ ID NO: 1676190 - protein, 17 aa, Staphylococcus aureus
CGIPEKFYTDHGSDFTS

SEQ ID NO: 1676191 - protein, 20 aa, Staphylococcus aureus
DIVCAGASAVLFGSVNAIIG

SEQ ID NO: 1676192 - protein, 20 aa, Staphylococcus aureus
DPTFIWHLAFAYGQEERDKE

SEQ ID NO: 1676193 - protein, 18 aa, Staphylococcus aureus
DSLFKRIPVKSGDFYYVP

SEQ ID NO: 1676194 - protein, 17 aa, Staphylococcus aureus
EIECKLLAFLEEKKVDA

SEQ ID NO: 1676195 - protein, 18 aa, Staphylococcus aureus
ELVTRLGIKLNLPSLDFD

SEQ ID NO: 1676196 - protein, 21 aa, Staphylococcus aureus
EQYKRLEFNLSIALDDVESTA

SEQ ID NO: 1676197 - protein, 17 aa, Staphylococcus aureus
FDRFKLNIFISLAELES

SEQ ID NO: 1676198 - protein, 18 aa, Staphylococcus aureus
FMRLNFYLIDLFRQQKRL

SEQ ID NO: 1676199 - protein, 18 aa, Staphylococcus aureus
FQDALGLSSADSFRDLIK

SEQ ID NO: 1676200 - protein, 17 aa, Staphylococcus aureus
FRVGFAVGNKDMIQALK

SEQ ID NO: 1676201 - protein, 17 aa, Staphylococcus aureus
FYEVMRLIAVEILNADL

SEQ ID NO: 1676202 - protein, 25 aa, Staphylococcus aureus
GFTHLPGWVRKASVGLALFGAAIGP

SEQ ID NO: 1676203 - protein, 22 aa, Staphylococcus aureus
GLRIGEAMALVWTDYNKYKKEI

SEQ ID NO: 1676204 - protein, 19 aa, Staphylococcus aureus
HGNLSLELDVLFGVSSLVT

SEQ ID NO: 1676205 - protein, 17 aa, Staphylococcus aureus
IATFYYSRMMKIMNLAI

SEQ ID NO: 1676206 - protein, 18 aa, Staphylococcus aureus
IENFKFFVQYGDFKDIND

SEQ ID NO: 1676207 - protein, 18 aa, Staphylococcus aureus
IFESMPFLYGDDINKLQG

SEQ ID NO: 1676208 - protein, 18 aa, Staphylococcus aureus
IVPLLLFSAMHYLKDIPN

SEQ ID NO: 1676209 - protein, 17 aa, Staphylococcus aureus
KFYKFAIYGKFGTGKTT

SEQ ID NO: 1676210 - protein, 22 aa, Staphylococcus aureus
KGNLKLRIEIVKYMKRRGVDCN

SEQ ID NO: 1676211 - protein, 17 aa, Staphylococcus aureus
KVGFKRLYVGVFNPEAT

SEQ ID NO: 1676212 - protein, 28 aa, Staphylococcus aureus
LEQLKAQRINPVVKKNALEAIREVVNKQ

SEQ ID NO: 1676213 - protein, 24 aa, Staphylococcus aureus
LKDDLKELISLVGREEAVLIFVNR

SEQ ID NO: 1676214 - protein, 18 aa, Staphylococcus aureus
LLGGIIAGFLFRETEPDI

SEQ ID NO: 1676215 - protein, 22 aa, Staphylococcus aureus
LNHGIPSYGYRVMAPETTGTIN

SEQ ID NO: 1676216 - protein, 18 aa, Staphylococcus aureus
LNITCLFDKPSVFKSLVS

SEQ ID NO: 1676217 - protein, 17 aa, Staphylococcus aureus
LPDLKGFGRRNIDISND

SEQ ID NO: 1676218 - protein, 18 aa, Staphylococcus aureus
LPDLKGFGRRNIDISNEE

SEQ ID NO: 1676219 - protein, 19 aa, Staphylococcus aureus
LRARIRVALRMSRSTETIQ

SEQ ID NO: 1676220 - protein, 18 aa, Staphylococcus aureus
LYNFIWDDFCDWYIEMSK

SEQ ID NO: 1676221 - protein, 19 aa, Staphylococcus aureus
MDHKRIFVPKMDYLNHQMT

SEQ ID NO: 1676222 - protein, 18 aa, Staphylococcus aureus
NAFDFPGFVPAYIRPLFC

SEQ ID NO: 1676223 - protein, 19 aa, Staphylococcus aureus
NDKYRTWAWNYGRNPKYNF

SEQ ID NO: 1676224 - protein, 18 aa, Staphylococcus aureus
NPEILAFIKSFKKYIANE

SEQ ID NO: 1676225 - protein, 21 aa, Staphylococcus aureus
NRKRWPLYRPWALFIKDTEKL

SEQ ID NO: 1676226 - protein, 17 aa, Staphylococcus aureus
NSVSEFKNATLLSETST

SEQ ID NO: 1676227 - protein, 24 aa, Staphylococcus aureus
PKKMRRLALRSALSFKVQENGLTV

SEQ ID NO: 1676228 - protein, 23 aa, Staphylococcus aureus
QEFERYKLAFAIRDAAATKNVGT

SEQ ID NO: 1676229 - protein, 18 aa, Staphylococcus aureus
QKALELVELVGLKGREKA

SEQ ID NO: 1676230 - protein, 18 aa, Staphylococcus aureus
QRINCIYDEFSLNTYMNK

SEQ ID NO: 1676231 - protein, 18 aa, Staphylococcus aureus
RIGCTFCASTLGGLKRNL

SEQ ID NO: 1676232 - protein, 19 aa, Staphylococcus aureus
RKKTGAGMMDCKKALTETD

SEQ ID NO: 1676233 - protein, 19 aa, Staphylococcus aureus
RLANMIQNFGILSLKDDYI

SEQ ID NO: 1676234 - protein, 17 aa, Staphylococcus aureus
RRLAYEINDFKDGFYNI

SEQ ID NO: 1676235 - protein, 17 aa, Staphylococcus aureus
SINWALGLMNEGSQIID

SEQ ID NO: 1676236 - protein, 21 aa, Staphylococcus aureus
SQRKIDVEPVFGFMKAILGFT

SEQ ID NO: 1676237 - protein, 22 aa, Staphylococcus aureus
TASERWMRMGILGVEMESAALY

SEQ ID NO: 1676238 - protein, 21 aa, Staphylococcus aureus
TEVHSSLPFLLTGDVPCNHAP

SEQ ID NO: 1676239 - protein, 17 aa, Staphylococcus aureus
TKVFTRFGVEVDFVDTT

SEQ ID NO: 1676240 - protein, 22 aa, Staphylococcus aureus
TSKKLVKFMLVFCSNSMTAEEI

SEQ ID NO: 1676241 - protein, 25 aa, Staphylococcus aureus
TTNKDGYKYYSFIDNVGLFSGSHLY

SEQ ID NO: 1676242 - protein, 17 aa, Staphylococcus aureus
VDARYNLGLALFMKNEN

SEQ ID NO: 1676243 - protein, 18 aa, Staphylococcus aureus
VFSASVFHYWLENYEVDN

SEQ ID NO: 1676244 - protein, 17 aa, Staphylococcus aureus
VKGYFIYPYQEVMKDSN

SEQ ID NO: 1676245 - protein, 19 aa, Staphylococcus aureus
VLRFKRRFGDDVAVLHSGL

SEQ ID NO: 1676246 - protein, 17 aa, Staphylococcus aureus
YMWECPDYFNLDNQDVI

SEQ ID NO: 1676247 - protein, 22 aa, Staphylococcus aureus
YTGLRIGVTVAKTLAYALDVKL

SEQ ID NO: 1676248 - protein, 20 aa, Staphylococcus aureus
ARYNLGLALFMKNENIDEAI

SEQ ID NO: 1676249 - protein, 23 aa, Staphylococcus aureus
DTLRVASILAHTLFDYPSHQLVT

SEQ ID NO: 1676250 - protein, 19 aa, Staphylococcus aureus
EPIIPFIIGDGIGPDIWKA

SEQ ID NO: 1676251 - protein, 17 aa, Staphylococcus aureus
FIHHVALHVSHRKDLKF

SEQ ID NO: 1676252 - protein, 17 aa, Staphylococcus aureus
FKRLNGLMIGFVIKGEA

SEQ ID NO: 1676253 - protein, 19 aa, Staphylococcus aureus
GFRGEALASISSVAKVTLK

SEQ ID NO: 1676254 - protein, 17 aa, Staphylococcus aureus
GGMKRRLSLAITLLAEP

SEQ ID NO: 1676255 - protein, 23 aa, Staphylococcus aureus
GKDLKVAIVVSRFNDFITGRLLE

SEQ ID NO: 1676256 - protein, 18 aa, Staphylococcus aureus
GLLCVYEGFLKALKGEKV

SEQ ID NO: 1676257 - protein, 21 aa, Staphylococcus aureus
IELLSRLGIKLNLPDLTFDTD

SEQ ID NO: 1676258 - protein, 20 aa, Staphylococcus aureus
IPNEFLKYTGRVHAQAYFTQ

SEQ ID NO: 1676259 - protein, 18 aa, Staphylococcus aureus
IVGPFAYYIKGFEMLPQM

SEQ ID NO: 1676260 - protein, 19 aa, Staphylococcus aureus
IYMPHWLEFYSIAIHSDVT

SEQ ID NO: 1676261 - protein, 17 aa, Staphylococcus aureus
KDFLKYRFNLTFLDLSI

SEQ ID NO: 1676262 - protein, 17 aa, Staphylococcus aureus
KEHIGVVFDDLRVPNKL

SEQ ID NO: 1676263 - protein, 21 aa, Staphylococcus aureus
KEKVHIIRWFLAYKKVPKILV

SEQ ID NO: 1676264 - protein, 18 aa, Staphylococcus aureus
KKGYCLLVGIGQNSTEQD

SEQ ID NO: 1676265 - protein, 20 aa, Staphylococcus aureus
KKIRPNLCRKIYINYHKKRK

SEQ ID NO: 1676266 - protein, 21 aa, Staphylococcus aureus
KKQVPVCCFTFGIPNESIIER

SEQ ID NO: 1676267 - protein, 22 aa, Staphylococcus aureus
KLNELRSGFNIDNYITLEEYFE

SEQ ID NO: 1676268 - protein, 22 aa, Staphylococcus aureus
KNAFDFPGFVPAYIRPLFCEGK

SEQ ID NO: 1676269 - protein, 17 aa, Staphylococcus aureus
KPLRRLWISSVTKKAIQ

SEQ ID NO: 1676270 - protein, 17 aa, Staphylococcus aureus
KVHGDKALKMYNLTFDH

SEQ ID NO: 1676271 - protein, 17 aa, Staphylococcus aureus
LECPAGKVLFFHEGVSM

SEQ ID NO: 1676272 - protein, 18 aa, Staphylococcus aureus
LHPDLDTWVIFPWTAGQG

SEQ ID NO: 1676273 - protein, 22 aa, Staphylococcus aureus
LPESFYRGAHQHIFRAMMHLNE

SEQ ID NO: 1676274 - protein, 17 aa, Staphylococcus aureus
MIAHFGIHQEETLVIGD

SEQ ID NO: 1676275 - protein, 18 aa, Staphylococcus aureus
MIDYFKALFPNGGLYVHL

SEQ ID NO: 1676276 - protein, 17 aa, Staphylococcus aureus
MKLRIGFSDIFFNVDQL

SEQ ID NO: 1676277 - protein, 18 aa, Staphylococcus aureus
MKLRIGFSDIFFNVDQLT

SEQ ID NO: 1676278 - protein, 17 aa, Staphylococcus aureus
NIIRPPFNVTRISEYAA

SEQ ID NO: 1676279 - protein, 17 aa, Staphylococcus aureus
NMIPVEWEKVYTMAYID

SEQ ID NO: 1676280 - protein, 17 aa, Staphylococcus aureus
PRALKILAEQNVEAYQI

SEQ ID NO: 1676281 - protein, 18 aa, Staphylococcus aureus
QRKIDVEPVFGFMKAILG

SEQ ID NO: 1676282 - protein, 26 aa, Staphylococcus aureus
RKEVPPLMCASLWPKFDLFKKYANSE

SEQ ID NO: 1676283 - protein, 17 aa, Staphylococcus aureus
RVPILGVCLGFQCIVSY

SEQ ID NO: 1676284 - protein, 19 aa, Staphylococcus aureus
SLFKDEVMQYFLSNRKIYP

SEQ ID NO: 1676285 - protein, 17 aa, Staphylococcus aureus
SMLKRIFSRAKSSINEI

SEQ ID NO: 1676286 - protein, 24 aa, Staphylococcus aureus
SYTGLRIGVTVAKTLAYALDVKLY

SEQ ID NO: 1676287 - protein, 17 aa, Staphylococcus aureus
TPLEYGDIFNYFVKKYS

SEQ ID NO: 1676288 - protein, 23 aa, Staphylococcus aureus
VEKSLRGAAIWDELKDRLHTNAY

SEQ ID NO: 1676289 - protein, 17 aa, Staphylococcus aureus
AESRLDNIISMADQDLT

SEQ ID NO: 1676290 - protein, 23 aa, Staphylococcus aureus
AKDIPPDVAIVFERRNHDESSEW

SEQ ID NO: 1676291 - protein, 20 aa, Staphylococcus aureus
CGSGSLLLRVGKEAKVYRYF

SEQ ID NO: 1676292 - protein, 20 aa, Staphylococcus aureus
EEFFRAVVINARLTTHIDLI

SEQ ID NO: 1676293 - protein, 22 aa, Staphylococcus aureus
EEMKPMIAEAFYKKFDEAGILN

SEQ ID NO: 1676294 - protein, 21 aa, Staphylococcus aureus
EILDLPDYVFPLFGMAVGEPA

SEQ ID NO: 1676295 - protein, 17 aa, Staphylococcus aureus
EKLKLPMNYVRSSNKSH

SEQ ID NO: 1676296 - protein, 22 aa, Staphylococcus aureus
EQYKRLEFNLSFALDDIESTAK

SEQ ID NO: 1676297 - protein, 19 aa, Staphylococcus aureus
FDRYPKLNMIIGHWGEFIP

SEQ ID NO: 1676298 - protein, 19 aa, Staphylococcus aureus
GIAGLRLGVLMSTVETIQR

SEQ ID NO: 1676299 - protein, 17 aa, Staphylococcus aureus
GIDEYLIRLSLGVENYE

SEQ ID NO: 1676300 - protein, 18 aa, Staphylococcus aureus
GPKARLKLLVALSNNLDK

SEQ ID NO: 1676301 - protein, 21 aa, Staphylococcus aureus
GQRRLFEWLRQNGFLIKRKGV

SEQ ID NO: 1676302 - protein, 18 aa, Staphylococcus aureus
GRSDYFWDLFIQMPAALM

SEQ ID NO: 1676303 - protein, 23 aa, Staphylococcus aureus
IPELQGRFPIRVELDSLAVEDFV

SEQ ID NO: 1676304 - protein, 21 aa, Staphylococcus aureus
KARACGIHMLVATQRPSVNVI

SEQ ID NO: 1676305 - protein, 18 aa, Staphylococcus aureus
KDFLKYRFNLTFLDLSIL

SEQ ID NO: 1676306 - protein, 18 aa, Staphylococcus aureus
KIAYVVEFFEWFNTLETF

SEQ ID NO: 1676307 - protein, 21 aa, Staphylococcus aureus
KLALEILNLVGLPNAEKRFKA

SEQ ID NO: 1676308 - protein, 18 aa, Staphylococcus aureus
KLKVSLDYIDWINTEFDQ

SEQ ID NO: 1676309 - protein, 20 aa, Staphylococcus aureus
KQRKKACIIVTHDERLKAYC

SEQ ID NO: 1676310 - protein, 17 aa, Staphylococcus aureus
KSIKNLCLMKKFEPYVT

SEQ ID NO: 1676311 - protein, 18 aa, Staphylococcus aureus
LLKSLNFNQFNLVEAQCK

SEQ ID NO: 1676312 - protein, 18 aa, Staphylococcus aureus
LPDLKGFGRRNIDISNDE

SEQ ID NO: 1676313 - protein, 20 aa, Staphylococcus aureus
MDHKRIFVPKMDYLNHQMTF

SEQ ID NO: 1676314 - protein, 18 aa, Staphylococcus aureus
MIDYFKALFPNGGLYIHL

SEQ ID NO: 1676315 - protein, 25 aa, Staphylococcus aureus
MKLPESVLRLKGYVSFRDQPNAIYE

SEQ ID NO: 1676316 - protein, 22 aa, Staphylococcus aureus
NEISGMIPIEWEKVYTMAYIDD

SEQ ID NO: 1676317 - protein, 17 aa, Staphylococcus aureus
PEAWGWEQFTSQIALGR

SEQ ID NO: 1676318 - protein, 18 aa, Staphylococcus aureus
PPQLAFAIGNAIKYLSRA

SEQ ID NO: 1676319 - protein, 20 aa, Staphylococcus aureus
PRFLKLNLQHFADTGVSGIA

SEQ ID NO: 1676320 - protein, 17 aa, Staphylococcus aureus
RENYGTLGLAFIKQYES

SEQ ID NO: 1676321 - protein, 19 aa, Staphylococcus aureus
RYLKELSHDISLMKSSILQ

SEQ ID NO: 1676322 - protein, 19 aa, Staphylococcus aureus
SDLISRYAGIRVPRNKAIV

SEQ ID NO: 1676323 - protein, 20 aa, Staphylococcus aureus
SGYLPLEWINKWKHYSSELL

SEQ ID NO: 1676324 - protein, 20 aa, Staphylococcus aureus
SHIYRLKGFMTFEDTTHTYL

SEQ ID NO: 1676325 - protein, 17 aa, Staphylococcus aureus
TNTFPSWKRAHPNRMLM

SEQ ID NO: 1676326 - protein, 22 aa, Staphylococcus aureus
VNGCVSAGVGERLHDETLFTEM

SEQ ID NO: 1676327 - protein, 20 aa, Staphylococcus aureus
YKDRIPVVIKNTNRPQDKGT

SEQ ID NO: 1676328 - protein, 24 aa, Staphylococcus aureus
YVSGGKRPLICFFSNDLNIHRTKT

SEQ ID NO: 1676329 - protein, 19 aa, Staphylococcus aureus
ADLVEFDWLDGFDIECRNE

SEQ ID NO: 1676330 - protein, 17 aa, Staphylococcus aureus
ADTWLRNQFFATEEYKE

SEQ ID NO: 1676331 - protein, 19 aa, Staphylococcus aureus
AIYKRDYLCILGETVKEKL

SEQ ID NO: 1676332 - protein, 17 aa, Staphylococcus aureus
ASKKFTIVPSWETYAKE

SEQ ID NO: 1676333 - protein, 25 aa, Staphylococcus aureus
CKSRLCPMCNWRRAMKHGIQSQKVV

SEQ ID NO: 1676334 - protein, 18 aa, Staphylococcus aureus
CSAGSRILVQNSIKDKFE

SEQ ID NO: 1676335 - protein, 19 aa, Staphylococcus aureus
EMIEHFGINQKETLVIGDS

SEQ ID NO: 1676336 - protein, 17 aa, Staphylococcus aureus
FTEVRWGDIEYLILDLP

SEQ ID NO: 1676337 - protein, 23 aa, Staphylococcus aureus
GLAPEAWLECYLNRTLLPILKLF

SEQ ID NO: 1676338 - protein, 21 aa, Staphylococcus aureus
IELKNRIGFVYSENYFNERWT

SEQ ID NO: 1676339 - protein, 19 aa, Staphylococcus aureus
ILCIEMRSDIPLARGLGSS

SEQ ID NO: 1676340 - protein, 17 aa, Staphylococcus aureus
INQIGWYLDFEKDIDLI

SEQ ID NO: 1676341 - protein, 21 aa, Staphylococcus aureus
ISGMIPVEWEKVYTIAYLDDE

SEQ ID NO: 1676342 - protein, 17 aa, Staphylococcus aureus
KQYIRWETINKYLGKYL

SEQ ID NO: 1676343 - protein, 20 aa, Staphylococcus aureus
KVHGDKALKMYNLTFDHTKT

SEQ ID NO: 1676344 - protein, 17 aa, Staphylococcus aureus
KYFCLTLDNYLVLAYLD

SEQ ID NO: 1676345 - protein, 19 aa, Staphylococcus aureus
KYWAELKDVFELFDVEMPI

SEQ ID NO: 1676346 - protein, 22 aa, Staphylococcus aureus
LDPTFMWHLAFAYGQEERDKEA

SEQ ID NO: 1676347 - protein, 18 aa, Staphylococcus aureus
LFDAVLMTIKYVMRESKV

SEQ ID NO: 1676348 - protein, 19 aa, Staphylococcus aureus
LIVCTDLRLLFLDKGMIYG

SEQ ID NO: 1676349 - protein, 19 aa, Staphylococcus aureus
LKANLEYLKMNQMINHLDD

SEQ ID NO: 1676350 - protein, 23 aa, Staphylococcus aureus
LLKRFSNNMIIIFKKVGDQHRDI

SEQ ID NO: 1676351 - protein, 18 aa, Staphylococcus aureus
LLKSLNFNQFNLVDAQCK

SEQ ID NO: 1676352 - protein, 17 aa, Staphylococcus aureus
MYQGFFLAPHVVSQSLK

SEQ ID NO: 1676353 - protein, 18 aa, Staphylococcus aureus
NLFEHWFRSVFNRRHPYY

SEQ ID NO: 1676354 - protein, 24 aa, Staphylococcus aureus
NVLQELKLWMARTIAATRNKAIID

SEQ ID NO: 1676355 - protein, 20 aa, Staphylococcus aureus
NVPFLWRLSSELNVAQLRQA

SEQ ID NO: 1676356 - protein, 17 aa, Staphylococcus aureus
PGGKACHIAEVLMPEGQ

SEQ ID NO: 1676357 - protein, 19 aa, Staphylococcus aureus
PLMEEWLFNTVAFIGGPSE

SEQ ID NO: 1676358 - protein, 19 aa, Staphylococcus aureus
PRVLGDIIICTDVAQEQAN

SEQ ID NO: 1676359 - protein, 17 aa, Staphylococcus aureus
QLFQFFMSYLLARFDIS

SEQ ID NO: 1676360 - protein, 17 aa, Staphylococcus aureus
QPIEGFFSIAGFKEDAE

SEQ ID NO: 1676361 - protein, 18 aa, Staphylococcus aureus
QRKIDVELVFGFMKAILG

SEQ ID NO: 1676362 - protein, 17 aa, Staphylococcus aureus
SKYSISLIIPKSDTSTI

SEQ ID NO: 1676363 - protein, 18 aa, Staphylococcus aureus
SLQIYGFSPCRVISIMLA

SEQ ID NO: 1676364 - protein, 18 aa, Staphylococcus aureus
VARELIELIIAFMFHHQI

SEQ ID NO: 1676365 - protein, 19 aa, Staphylococcus aureus
YGVGRRISLHYTRQMVNQA

SEQ ID NO: 1676366 - protein, 18 aa, Staphylococcus aureus
YLCPCLGYPRQWRSEDIY

SEQ ID NO: 1676367 - protein, 17 aa, Staphylococcus aureus
AKKEWRNILISTGESSI

SEQ ID NO: 1676368 - protein, 22 aa, Staphylococcus aureus
ALELAEQMGIIFIDEIDKVATN

SEQ ID NO: 1676369 - protein, 23 aa, Staphylococcus aureus
AYLKEFTNLYALLIPKMNSMNDV

SEQ ID NO: 1676370 - protein, 25 aa, Staphylococcus aureus
DEFKKRWPINIGFIGNVRFNEINQK

SEQ ID NO: 1676371 - protein, 17 aa, Staphylococcus aureus
DRWCKIRNSHIGEYSYI

SEQ ID NO: 1676372 - protein, 23 aa, Staphylococcus aureus
ENIIGAYCTIVFNDGRDNYIEVM

SEQ ID NO: 1676373 - protein, 19 aa, Staphylococcus aureus
FAIRREVLEELGFDFSNSY

SEQ ID NO: 1676374 - protein, 20 aa, Staphylococcus aureus
FKFGASIGRYSGRIDNAKFK

SEQ ID NO: 1676375 - protein, 17 aa, Staphylococcus aureus
FLECLNDKNVKTIEHSD

SEQ ID NO: 1676376 - protein, 18 aa, Staphylococcus aureus
FLYLLSMDKLFGNKRNRL

SEQ ID NO: 1676377 - protein, 21 aa, Staphylococcus aureus
FPSKNILFWYVLFMDQSQMHD

SEQ ID NO: 1676378 - protein, 18 aa, Staphylococcus aureus
FRCDYCMPKEVFGDDFVF

SEQ ID NO: 1676379 - protein, 20 aa, Staphylococcus aureus
FRNYILGLIFYCFLSEKAEQ

SEQ ID NO: 1676380 - protein, 23 aa, Staphylococcus aureus
FTGVDFPKLFKAFKDMGMTYNIV

SEQ ID NO: 1676381 - protein, 17 aa, Staphylococcus aureus
GAGRIGLGVAKRAQSFG

SEQ ID NO: 1676382 - protein, 19 aa, Staphylococcus aureus
HSNPFKFGASIGRYSGRID

SEQ ID NO: 1676383 - protein, 20 aa, Staphylococcus aureus
IKKGYCLLVGIGQNSTEQDA

SEQ ID NO: 1676384 - protein, 19 aa, Staphylococcus aureus
IQKEYYVGFVIDRATDQVT

SEQ ID NO: 1676385 - protein, 18 aa, Staphylococcus aureus
IQVWKKPSSFVIKPLPKN

SEQ ID NO: 1676386 - protein, 17 aa, Staphylococcus aureus
IRAAGGVARMANPKIVE

SEQ ID NO: 1676387 - protein, 17 aa, Staphylococcus aureus
ISAVPVIHVDPFINQQS

SEQ ID NO: 1676388 - protein, 17 aa, Staphylococcus aureus
ISFKNVCQAVVYISGQK

SEQ ID NO: 1676389 - protein, 20 aa, Staphylococcus aureus
ISWKAKGILLYLLSRPDNWQ

SEQ ID NO: 1676390 - protein, 20 aa, Staphylococcus aureus
KEVLTGFKFIAQEIRQLDDH

SEQ ID NO: 1676391 - protein, 19 aa, Staphylococcus aureus
KGLLCVYEGFLKALKGEKV

SEQ ID NO: 1676392 - protein, 17 aa, Staphylococcus aureus
KPLLSDILLYFLSKNTD

SEQ ID NO: 1676393 - protein, 20 aa, Staphylococcus aureus
LELRIPIIIISGNHDGKERL

SEQ ID NO: 1676394 - protein, 19 aa, Staphylococcus aureus
LLKDRIIMLGSQIDDNVAN

SEQ ID NO: 1676395 - protein, 24 aa, Staphylococcus aureus
LLNHGIPSYGYRVMAPETTGTINV

SEQ ID NO: 1676396 - protein, 19 aa, Staphylococcus aureus
LNLFEHWFRSVFNRRHPYY

SEQ ID NO: 1676397 - protein, 19 aa, Staphylococcus aureus
MALNEEFDLLALRKSVIRW

SEQ ID NO: 1676398 - protein, 19 aa, Staphylococcus aureus
MKQKLNFASMLLVDSNVLL

SEQ ID NO: 1676399 - protein, 17 aa, Staphylococcus aureus
MRLRRVGNKFSIKTWKF

SEQ ID NO: 1676400 - protein, 18 aa, Staphylococcus aureus
NGFGYDPIFYVPKLDKTM

SEQ ID NO: 1676401 - protein, 21 aa, Staphylococcus aureus
NKPEIYICGGTKFLQSMIEAL

SEQ ID NO: 1676402 - protein, 18 aa, Staphylococcus aureus
PAEIKFLLYFAKMTKKDK

SEQ ID NO: 1676403 - protein, 17 aa, Staphylococcus aureus
PEVRESLIFEESKQTMQ

SEQ ID NO: 1676404 - protein, 17 aa, Staphylococcus aureus
QGKTILKNISWQIAKGD

SEQ ID NO: 1676405 - protein, 18 aa, Staphylococcus aureus
QLIGMRASSDFVRHGEKK

SEQ ID NO: 1676406 - protein, 17 aa, Staphylococcus aureus
QRVWRRLAKDLKPENLH

SEQ ID NO: 1676407 - protein, 22 aa, Staphylococcus aureus
RLREFYRKFGFTEIKDHTSENN

SEQ ID NO: 1676408 - protein, 25 aa, Staphylococcus aureus
VSGGARFAGVALRFLTGPIGATITA

SEQ ID NO: 1676409 - protein, 18 aa, Staphylococcus aureus
WHRLKYYVVVNHLGHLVS

SEQ ID NO: 1676410 - protein, 20 aa, Staphylococcus aureus
WPIGMGQSFFGIIDRKSKTI

SEQ ID NO: 1676411 - protein, 18 aa, Staphylococcus aureus
YFDLKWLLNQSEYKLFYS

SEQ ID NO: 1676412 - protein, 19 aa, Staphylococcus aureus
YHGEWKLKSADEFIKDNRI

SEQ ID NO: 1676413 - protein, 18 aa, Staphylococcus aureus
YKSLKGWTGDMYSRAHDR

SEQ ID NO: 1676414 - protein, 17 aa, Staphylococcus aureus
YRGSQCWDTPNFIFKRY

SEQ ID NO: 1676415 - protein, 17 aa, Staphylococcus aureus
YRKFGILPETEYEINKV

SEQ ID NO: 1676416 - protein, 21 aa, Staphylococcus aureus
AKAQGLEAFDNIQIDSTEKQK

SEQ ID NO: 1676417 - protein, 18 aa, Staphylococcus aureus
CYLGDFKSTGGIFAATEN

SEQ ID NO: 1676418 - protein, 18 aa, Staphylococcus aureus
DFSPWKNRSFWGVINNTL

SEQ ID NO: 1676419 - protein, 20 aa, Staphylococcus aureus
ENGKHGFAFSSGVAAISAVV

SEQ ID NO: 1676420 - protein, 21 aa, Staphylococcus aureus
EVLVCTVIGFPLGASTTATKV

SEQ ID NO: 1676421 - protein, 21 aa, Staphylococcus aureus
GVLVCTVIGFPLGASTTATKA

SEQ ID NO: 1676422 - protein, 17 aa, Staphylococcus aureus
HKPYRAIDVIGSAKFLM

SEQ ID NO: 1676423 - protein, 19 aa, Staphylococcus aureus
IDKTMRWLKISNINKLSQK

SEQ ID NO: 1676424 - protein, 17 aa, Staphylococcus aureus
IIFKHGLSLAQVQQITN

SEQ ID NO: 1676425 - protein, 22 aa, Staphylococcus aureus
ILDIRFGSLWTNIPLAFLKSLE

SEQ ID NO: 1676426 - protein, 19 aa, Staphylococcus aureus
IPKDYWLSQAPKLNSKQLI

SEQ ID NO: 1676427 - protein, 17 aa, Staphylococcus aureus
IRNGWCYGNTGVMTTLF

SEQ ID NO: 1676428 - protein, 21 aa, Staphylococcus aureus
IVKAGAMSLVPLLKSNTPFAN

SEQ ID NO: 1676429 - protein, 17 aa, Staphylococcus aureus
IYQFPLLLFYRGNIKLI

SEQ ID NO: 1676430 - protein, 17 aa, Staphylococcus aureus
KNHMLIAVTELRTKDEI

SEQ ID NO: 1676431 - protein, 20 aa, Staphylococcus aureus
KNLIAFLFFYFELFEDEKQE

SEQ ID NO: 1676432 - protein, 18 aa, Staphylococcus aureus
KRDSMNWNEITQGIEHIP

SEQ ID NO: 1676433 - protein, 19 aa, Staphylococcus aureus
KRVDDIKAYIQGDVPKVMG

SEQ ID NO: 1676434 - protein, 20 aa, Staphylococcus aureus
KVTHLRALLQLRDVAQNNDA

SEQ ID NO: 1676435 - protein, 21 aa, Staphylococcus aureus
LKKLGIRKGIPVVFSDESPIV

SEQ ID NO: 1676436 - protein, 20 aa, Staphylococcus aureus
LNESITCYGLGLTQSTGNVT

SEQ ID NO: 1676437 - protein, 17 aa, Staphylococcus aureus
LPLKFGDYLSASSMRSL

SEQ ID NO: 1676438 - protein, 17 aa, Staphylococcus aureus
LSHKPYRAIDVIGSAKF

SEQ ID NO: 1676439 - protein, 22 aa, Staphylococcus aureus
LVAADIYRPAAINQLQTVGKQI

SEQ ID NO: 1676440 - protein, 20 aa, Staphylococcus aureus
MIRTPLLSVEFFNLFLNTEQ

SEQ ID NO: 1676441 - protein, 20 aa, Staphylococcus aureus
NVCSCCGQQLPAEQVSEVRE

SEQ ID NO: 1676442 - protein, 19 aa, Staphylococcus aureus
SEHYGLWAFKKVWGTYLSE

SEQ ID NO: 1676443 - protein, 25 aa, Staphylococcus aureus
SKLIKRIRFATGVIREIKAYKPDVI

SEQ ID NO: 1676444 - protein, 21 aa, Staphylococcus aureus
SKSELLEKVWGYDYYEDANTV

SEQ ID NO: 1676445 - protein, 18 aa, Staphylococcus aureus
SLKRLGIDHIDLYQLHGG

SEQ ID NO: 1676446 - protein, 20 aa, Staphylococcus aureus
SLLPKYRGGAPIHQAIIDGE

SEQ ID NO: 1676447 - protein, 19 aa, Staphylococcus aureus
SREYLALGLQSIWDENKRF

SEQ ID NO: 1676448 - protein, 18 aa, Staphylococcus aureus
SWCKNKFQVTNQVSVEDT

SEQ ID NO: 1676449 - protein, 21 aa, Staphylococcus aureus
TLFPNRVDLGLGRAPGTDMMT

SEQ ID NO: 1676450 - protein, 18 aa, Staphylococcus aureus
YHGEWKLKSADEFIKDNR

SEQ ID NO: 1676451 - protein, 19 aa, Staphylococcus aureus
YNGLPHLVAPVITDVKAAT

SEQ ID NO: 1676452 - protein, 18 aa, Staphylococcus aureus
YTCEKFKLLVLQGNVLGV

SEQ ID NO: 1676453 - protein, 17 aa, Staphylococcus aureus
ASLEFNVRPVPEYDNDF

SEQ ID NO: 1676454 - protein, 17 aa, Staphylococcus aureus
DQLKVIEIINLYQSFYE

SEQ ID NO: 1676455 - protein, 19 aa, Staphylococcus aureus
DRLGFKRIWFTEHHNVPAF

SEQ ID NO: 1676456 - protein, 19 aa, Staphylococcus aureus
DRPYIVAISIMYLFEMFSI

SEQ ID NO: 1676457 - protein, 19 aa, Staphylococcus aureus
EGVKSIFHVMDFISVDKEN

SEQ ID NO: 1676458 - protein, 23 aa, Staphylococcus aureus
EIISFKLGIKYLLTIKRGNIEKD

SEQ ID NO: 1676459 - protein, 18 aa, Staphylococcus aureus
EPKLSLPTARSIIAIAVG

SEQ ID NO: 1676460 - protein, 18 aa, Staphylococcus aureus
EPMVYKLAFKAGNAVAEK

SEQ ID NO: 1676461 - protein, 19 aa, Staphylococcus aureus
FKTTMSIVFECHIYTLRQQ

SEQ ID NO: 1676462 - protein, 24 aa, Staphylococcus aureus
FKVERLKGIFAWGFRFNSDEPEEG

SEQ ID NO: 1676463 - protein, 17 aa, Staphylococcus aureus
FLFKAIFNITKLLHIKR

SEQ ID NO: 1676464 - protein, 23 aa, Staphylococcus aureus
GKELKVAIVVSRFNDFITGRLLE

SEQ ID NO: 1676465 - protein, 25 aa, Staphylococcus aureus
GKSYVFKPKSLFVLYDILSNNSVYL

SEQ ID NO: 1676466 - protein, 18 aa, Staphylococcus aureus
GMIPVEWEKVYTIAYVND

SEQ ID NO: 1676467 - protein, 17 aa, Staphylococcus aureus
GPMSLFALCVIKGITIE

SEQ ID NO: 1676468 - protein, 17 aa, Staphylococcus aureus
IADWDIKLERTFYVSKF

SEQ ID NO: 1676469 - protein, 22 aa, Staphylococcus aureus
IDYEFLYLLSMDKLFGNKRNRL

SEQ ID NO: 1676470 - protein, 18 aa, Staphylococcus aureus
IECIYGLYKKNRRSLQIY

SEQ ID NO: 1676471 - protein, 17 aa, Staphylococcus aureus
IGCTFCASTLGGLKRNL

SEQ ID NO: 1676472 - protein, 17 aa, Staphylococcus aureus
IKLERTFYVSKFDHSEN

SEQ ID NO: 1676473 - protein, 19 aa, Staphylococcus aureus
IPGKMSLVIADIMDETTTK

SEQ ID NO: 1676474 - protein, 18 aa, Staphylococcus aureus
IYLKSCDLTTILHNLYKR

SEQ ID NO: 1676475 - protein, 17 aa, Staphylococcus aureus
KALAKVRMSEIGFILQA

SEQ ID NO: 1676476 - protein, 18 aa, Staphylococcus aureus
KGILLYFLSRPDNWQIYT

SEQ ID NO: 1676477 - protein, 18 aa, Staphylococcus aureus
KIHQCSRAIAKAVAQSVI

SEQ ID NO: 1676478 - protein, 18 aa, Staphylococcus aureus
KKYFCLTLDNYLVLAYLD

SEQ ID NO: 1676479 - protein, 18 aa, Staphylococcus aureus
KLKVSFDYIDWINTEFDQ

SEQ ID NO: 1676480 - protein, 19 aa, Staphylococcus aureus
KMYGGTCINIGCIPSKTLV

SEQ ID NO: 1676481 - protein, 19 aa, Staphylococcus aureus
KNWEFPLVIKPGDDLPTAG

SEQ ID NO: 1676482 - protein, 19 aa, Staphylococcus aureus
KQVPVCCFTFGIPSEQIIS

SEQ ID NO: 1676483 - protein, 17 aa, Staphylococcus aureus
LAQYCSFYSDFVKASLI

SEQ ID NO: 1676484 - protein, 17 aa, Staphylococcus aureus
LEPWTSCEFDFTRDGKL

SEQ ID NO: 1676485 - protein, 18 aa, Staphylococcus aureus
LKNGFYLNEFLKEVNQHK

SEQ ID NO: 1676486 - protein, 17 aa, Staphylococcus aureus
LKVSFDYIDWINSEFGQ

SEQ ID NO: 1676487 - protein, 22 aa, Staphylococcus aureus
LPMNRLRFTLAHEYGHFIMGHT

SEQ ID NO: 1676488 - protein, 23 aa, Staphylococcus aureus
LTEREKRVIKREHVREAQKLVDN

SEQ ID NO: 1676489 - protein, 18 aa, Staphylococcus aureus
LVEGLKLVTEFIQDENAT

SEQ ID NO: 1676490 - protein, 18 aa, Staphylococcus aureus
MAYELGFDHGLLFKDGVT

SEQ ID NO: 1676491 - protein, 18 aa, Staphylococcus aureus
RGELITGDFDKLIYGIPQ

SEQ ID NO: 1676492 - protein, 17 aa, Staphylococcus aureus
RTMDIFRLLGVDIKEDE

SEQ ID NO: 1676493 - protein, 17 aa, Staphylococcus aureus
RVEKSIADWDIKLERTF

SEQ ID NO: 1676494 - protein, 18 aa, Staphylococcus aureus
SAYHILDMVFWFGNLQIL

SEQ ID NO: 1676495 - protein, 24 aa, Staphylococcus aureus
SDLQLIRRSVCEFIKGHSLIDTSI

SEQ ID NO: 1676496 - protein, 25 aa, Staphylococcus aureus
TVASMIIEFAEWVNTLEFFKNWKKQ

SEQ ID NO: 1676497 - protein, 18 aa, Staphylococcus aureus
VCYMWLRFNMDQQFDGTA

SEQ ID NO: 1676498 - protein, 21 aa, Staphylococcus aureus
VQSIICYLALHRLHKVPMMME

SEQ ID NO: 1676499 - protein, 17 aa, Staphylococcus aureus
WDIKLERTFYVSKFDHS

SEQ ID NO: 1676500 - protein, 17 aa, Staphylococcus aureus
YEHIGFSGAGAMDQFSF

SEQ ID NO: 1676501 - protein, 17 aa, Staphylococcus aureus
YLFCKAFGKLASNIEKY

SEQ ID NO: 1676502 - protein, 17 aa, Staphylococcus aureus
YMIELLEPLPFLEKISK

SEQ ID NO: 1676503 - protein, 25 aa, Staphylococcus aureus
AVIYDLDFLKTLPFEQILSGYAEVY

SEQ ID NO: 1676504 - protein, 21 aa, Staphylococcus aureus
DCLINFGIWDMCLWNKTDNKV

SEQ ID NO: 1676505 - protein, 23 aa, Staphylococcus aureus
DELRHLPSYFGLDFGYVNDPSAF

SEQ ID NO: 1676506 - protein, 18 aa, Staphylococcus aureus
EASLEFNVRPVPEYDNDF

SEQ ID NO: 1676507 - protein, 22 aa, Staphylococcus aureus
EEGKRAVLLLHGFTGNSSDVRQ

SEQ ID NO: 1676508 - protein, 20 aa, Staphylococcus aureus
ELVEGLKLVTEFVQDENATQ

SEQ ID NO: 1676509 - protein, 21 aa, Staphylococcus aureus
FAYKYRIPWIYGGVVQSTYTE

SEQ ID NO: 1676510 - protein, 24 aa, Staphylococcus aureus
FKAGSHCRFCKIKHSCRTRAEYMQ

SEQ ID NO: 1676511 - protein, 18 aa, Staphylococcus aureus
FKPLHIFSDLSSKMFTWN

SEQ ID NO: 1676512 - protein, 17 aa, Staphylococcus aureus
GEMIIYFSYERMGDYFL

SEQ ID NO: 1676513 - protein, 19 aa, Staphylococcus aureus
GIAGLRLGVLISTAGTIKH

SEQ ID NO: 1676514 - protein, 17 aa, Staphylococcus aureus
GTLTGRVKFIFQSAEEL

SEQ ID NO: 1676515 - protein, 21 aa, Staphylococcus aureus
HKGKMAFRVYPKWCNQLNKRA

SEQ ID NO: 1676516 - protein, 17 aa, Staphylococcus aureus
IKLPARFHKKSLPVPKY

SEQ ID NO: 1676517 - protein, 20 aa, Staphylococcus aureus
KAHSITAIWNFEKQNYYLKN

SEQ ID NO: 1676518 - protein, 19 aa, Staphylococcus aureus
KDRRAGVITFNLQDVHPHD

SEQ ID NO: 1676519 - protein, 18 aa, Staphylococcus aureus
KHLPDFILKKSFQKIKNN

SEQ ID NO: 1676520 - protein, 18 aa, Staphylococcus aureus
KIKHSYLKKSFLEIVETL

SEQ ID NO: 1676521 - protein, 17 aa, Staphylococcus aureus
KKDFGWIYSSSLASSAA

SEQ ID NO: 1676522 - protein, 27 aa, Staphylococcus aureus
KLNMIIGHWGEFIPFFLERMDEALFAE

SEQ ID NO: 1676523 - protein, 17 aa, Staphylococcus aureus
LQLRFILDWNSQAHRPQ

SEQ ID NO: 1676524 - protein, 17 aa, Staphylococcus aureus
LRFILDWNSQAHRPQFE

SEQ ID NO: 1676525 - protein, 17 aa, Staphylococcus aureus
LYRSRIVKFITEKSELM

SEQ ID NO: 1676526 - protein, 22 aa, Staphylococcus aureus
MSKLRPLLHYARAKDIDNYRTV

SEQ ID NO: 1676527 - protein, 20 aa, Staphylococcus aureus
NDFGPAWIERFVRVQIEEAF

SEQ ID NO: 1676528 - protein, 17 aa, Staphylococcus aureus
PDHPLVYWATFSNASDL

SEQ ID NO: 1676529 - protein, 17 aa, Staphylococcus aureus
PELRFPGFEGEWEEKKV

SEQ ID NO: 1676530 - protein, 17 aa, Staphylococcus aureus
QLIGMRASSDFVRHGEK

SEQ ID NO: 1676531 - protein, 24 aa, Staphylococcus aureus
QSQFNLPTRYIWGIYEPQSDDQNM

SEQ ID NO: 1676532 - protein, 24 aa, Staphylococcus aureus
RFTATEINLFFAMCNKLKEQDTNT

SEQ ID NO: 1676533 - protein, 23 aa, Staphylococcus aureus
RKYSNIYLYFGLRDFLKKLMSNY

SEQ ID NO: 1676534 - protein, 17 aa, Staphylococcus aureus
RLIAFEGLSLKDFASEI

SEQ ID NO: 1676535 - protein, 19 aa, Staphylococcus aureus
RSAYHILDMVFWFGNLQIL

SEQ ID NO: 1676536 - protein, 17 aa, Staphylococcus aureus
SEVKLGIDLNYIELQNF

SEQ ID NO: 1676537 - protein, 24 aa, Staphylococcus aureus
SGGARFAGVALKFLTGPIGATITA

SEQ ID NO: 1676538 - protein, 18 aa, Staphylococcus aureus
SGMGRYHGKYSFDTFTHV

SEQ ID NO: 1676539 - protein, 18 aa, Staphylococcus aureus
SHIYRLKGFMTFEDTAHT

SEQ ID NO: 1676540 - protein, 19 aa, Staphylococcus aureus
SLYRIVNHWIDFGVDGFRF

SEQ ID NO: 1676541 - protein, 17 aa, Staphylococcus aureus
SVLPARFPNLLANGASG

SEQ ID NO: 1676542 - protein, 27 aa, Staphylococcus aureus
TSTLIPMCHPLPLTGIDVHFSWDETNA

SEQ ID NO: 1676543 - protein, 22 aa, Staphylococcus aureus
VAEACLKLGVDIINDQWAGLYD

SEQ ID NO: 1676544 - protein, 18 aa, Staphylococcus aureus
VCYMWLRFNIDQQFDDTA

SEQ ID NO: 1676545 - protein, 21 aa, Staphylococcus aureus
VEIAIKMAYQYWKNIDREKYA

SEQ ID NO: 1676546 - protein, 17 aa, Staphylococcus aureus
VKDKLGFHVVLTGHEGL

SEQ ID NO: 1676547 - protein, 17 aa, Staphylococcus aureus
VKEAGYELNVWTVNKPA

SEQ ID NO: 1676548 - protein, 19 aa, Staphylococcus aureus
VYEMRWDIGYVLQQIALFP

SEQ ID NO: 1676549 - protein, 22 aa, Staphylococcus aureus
YDFPMWFIRPNFKSETAPRSVQ

SEQ ID NO: 1676550 - protein, 22 aa, Staphylococcus aureus
AKRDAYTNAVSRAETILNKTQG

SEQ ID NO: 1676551 - protein, 17 aa, Staphylococcus aureus
ARLSEHFEIPYKQYCKH

SEQ ID NO: 1676552 - protein, 20 aa, Staphylococcus aureus
AYKDGKWKVLMIAAEERYVL

SEQ ID NO: 1676553 - protein, 23 aa, Staphylococcus aureus
DEVWKERLELLKPYQVNKEIMDK

SEQ ID NO: 1676554 - protein, 23 aa, Staphylococcus aureus
DISKWSFQTEMFFLCNRYKQFQD

SEQ ID NO: 1676555 - protein, 24 aa, Staphylococcus aureus
DIYGCASAGIGERLYNEPISKEFV

SEQ ID NO: 1676556 - protein, 21 aa, Staphylococcus aureus
DWDYARYGILQGIEYAISEDA

SEQ ID NO: 1676557 - protein, 18 aa, Staphylococcus aureus
DYDALLIPGGFSPDHLRG

SEQ ID NO: 1676558 - protein, 20 aa, Staphylococcus aureus
ECNLYRLLREISMESVKCIE

SEQ ID NO: 1676559 - protein, 22 aa, Staphylococcus aureus
EDRLRSRFEWGLIVDITPPDYE

SEQ ID NO: 1676560 - protein, 18 aa, Staphylococcus aureus
EKNIMRFAKSVNFNSDEF

SEQ ID NO: 1676561 - protein, 17 aa, Staphylococcus aureus
ELRRLGANVYVSIENGI

SEQ ID NO: 1676562 - protein, 19 aa, Staphylococcus aureus
ELTRIGLDLPFPIKINQML

SEQ ID NO: 1676563 - protein, 17 aa, Staphylococcus aureus
ENFKFFVQYGDFKDIND

SEQ ID NO: 1676564 - protein, 18 aa, Staphylococcus aureus
FDLKWEYYLRLFLNLISA

SEQ ID NO: 1676565 - protein, 17 aa, Staphylococcus aureus
FEALRAWLYDEIVADSW

SEQ ID NO: 1676566 - protein, 21 aa, Staphylococcus aureus
FGIAGLRLGVLISTAGTIKHI

SEQ ID NO: 1676567 - protein, 17 aa, Staphylococcus aureus
FKGAHGLLYEQELGLQA

SEQ ID NO: 1676568 - protein, 24 aa, Staphylococcus aureus
GEAVSMEWLFRPLLKMLAEGDPVP

SEQ ID NO: 1676569 - protein, 18 aa, Staphylococcus aureus
GGFKGRKLLADDVITVKI

SEQ ID NO: 1676570 - protein, 18 aa, Staphylococcus aureus
GKLCPAIYEYFWELDYSV

SEQ ID NO: 1676571 - protein, 17 aa, Staphylococcus aureus
GNHSWKAIEIIYETYVH

SEQ ID NO: 1676572 - protein, 21 aa, Staphylococcus aureus
GTETIYRFSLLVPNQAALHYF

SEQ ID NO: 1676573 - protein, 23 aa, Staphylococcus aureus
HGYDFPMWFIRPFYAKETTANKL

SEQ ID NO: 1676574 - protein, 20 aa, Staphylococcus aureus
HIKSRISYYFSEKYREPHSY

SEQ ID NO: 1676575 - protein, 18 aa, Staphylococcus aureus
IEEFKFFVQYGNFKELEN

SEQ ID NO: 1676576 - protein, 18 aa, Staphylococcus aureus
IQQAKGWTQVKMKAALHN

SEQ ID NO: 1676577 - protein, 23 aa, Staphylococcus aureus
IVIRSVFKYAFKYYDLHDISVLD

SEQ ID NO: 1676578 - protein, 17 aa, Staphylococcus aureus
KEFLKWTAKDFFNEVKP

SEQ ID NO: 1676579 - protein, 19 aa, Staphylococcus aureus
KELLFKRRIDIGGVNNNFK

SEQ ID NO: 1676580 - protein, 20 aa, Staphylococcus aureus
KKELLSAGIIDDAWLAEIEA

SEQ ID NO: 1676581 - protein, 19 aa, Staphylococcus aureus
KKKSLALMGDWDYARYGIL

SEQ ID NO: 1676582 - protein, 23 aa, Staphylococcus aureus
KQVAINFAKLILCQTDSQCETKV

SEQ ID NO: 1676583 - protein, 24 aa, Staphylococcus aureus
KRKIDLRFVPGVTFTNPSIATVGL

SEQ ID NO: 1676584 - protein, 21 aa, Staphylococcus aureus
KSTLLSAICRLIRFENGEVKI

SEQ ID NO: 1676585 - protein, 18 aa, Staphylococcus aureus
LDTLMFPALIGRTVHIAS

SEQ ID NO: 1676586 - protein, 24 aa, Staphylococcus aureus
LELKEVPQRLAVIGSGYIAAELGQ

SEQ ID NO: 1676587 - protein, 21 aa, Staphylococcus aureus
LKKDEFVGIAIPTIVKDKVSV

SEQ ID NO: 1676588 - protein, 17 aa, Staphylococcus aureus
LMIQRFGMTYVLTTKKE

SEQ ID NO: 1676589 - protein, 20 aa, Staphylococcus aureus
LNARLKLQLLDDVKSVFNSQ

SEQ ID NO: 1676590 - protein, 18 aa, Staphylococcus aureus
LYARFWHKVLYDLAIVPT

SEQ ID NO: 1676591 - protein, 19 aa, Staphylococcus aureus
MQQEIPYPFFVIKMPESNR

SEQ ID NO: 1676592 - protein, 17 aa, Staphylococcus aureus
MRCSHCAVGYTLQTVDP

SEQ ID NO: 1676593 - protein, 20 aa, Staphylococcus aureus
MSLFALCVIKGITIENHQHI

SEQ ID NO: 1676594 - protein, 18 aa, Staphylococcus aureus
NAKKEWRNILISTGESSI

SEQ ID NO: 1676595 - protein, 17 aa, Staphylococcus aureus
NAYTQAVTAAEGILNKQ

SEQ ID NO: 1676596 - protein, 17 aa, Staphylococcus aureus
NEISGMIPVEWEKVYTI

SEQ ID NO: 1676597 - protein, 20 aa, Staphylococcus aureus
NEYWGGVGYLNIIGEDNRLK

SEQ ID NO: 1676598 - protein, 17 aa, Staphylococcus aureus
NHYPICYNTAYKILTMI

SEQ ID NO: 1676599 - protein, 20 aa, Staphylococcus aureus
NIKCLRHSRFIFLSPEFLLQ

SEQ ID NO: 1676600 - protein, 17 aa, Staphylococcus aureus
NNVRIALTEVWKKGGKG

SEQ ID NO: 1676601 - protein, 19 aa, Staphylococcus aureus
NRITSAFVRLQYNIDTLHV

SEQ ID NO: 1676602 - protein, 17 aa, Staphylococcus aureus
NRYTFVWKKSIQNHESK

SEQ ID NO: 1676603 - protein, 18 aa, Staphylococcus aureus
PHTISIGSIKKVGEYPII

SEQ ID NO: 1676604 - protein, 19 aa, Staphylococcus aureus
PIKEYFAGVDWGYEHYGSI

SEQ ID NO: 1676605 - protein, 18 aa, Staphylococcus aureus
PVLYPGWNRFKSNKVMKQ

SEQ ID NO: 1676606 - protein, 23 aa, Staphylococcus aureus
RLMWKEMMVILQAFRVPSVNLLQ

SEQ ID NO: 1676607 - protein, 24 aa, Staphylococcus aureus
RRCHSGPLLKNGRRFGFYRGYNGH

SEQ ID NO: 1676608 - protein, 24 aa, Staphylococcus aureus
SGGEKARLLLALLMLQRDNVLILD

SEQ ID NO: 1676609 - protein, 21 aa, Staphylococcus aureus
SRLLKDRIIMLGSQIDDNVAN

SEQ ID NO: 1676610 - protein, 18 aa, Staphylococcus aureus
SYKLVGIVTSREMINTKD

SEQ ID NO: 1676611 - protein, 22 aa, Staphylococcus aureus
TCKECLFYPYLLVQGEAGIGKS

SEQ ID NO: 1676612 - protein, 19 aa, Staphylococcus aureus
TNCVFLHCDYILKVPINKL

SEQ ID NO: 1676613 - protein, 25 aa, Staphylococcus aureus
TPNFIFKRYWGFVTWGNAKDMANYR

SEQ ID NO: 1676614 - protein, 20 aa, Staphylococcus aureus
VIYMPHWLEFYSIAIHSDVT

SEQ ID NO: 1676615 - protein, 17 aa, Staphylococcus aureus
VSPDLFIKRLNFYDYLL

SEQ ID NO: 1676616 - protein, 18 aa, Staphylococcus aureus
YKVGELYPAEGYNNPRVE

SEQ ID NO: 1676617 - protein, 22 aa, Staphylococcus aureus
YLWRSSEGMTEFIFNGFYDNVI

SEQ ID NO: 1676618 - protein, 19 aa, Staphylococcus aureus
AEACLKLGVDIINDQWAGL

SEQ ID NO: 1676619 - protein, 17 aa, Staphylococcus aureus
AKGDKWILYGLNGAGKT

SEQ ID NO: 1676620 - protein, 22 aa, Staphylococcus aureus
ANIPTRIAFMVSSSVDSRTILD

SEQ ID NO: 1676621 - protein, 19 aa, Staphylococcus aureus
ATEGLPINVGFTGKGQATN

SEQ ID NO: 1676622 - protein, 19 aa, Staphylococcus aureus
CRILDYKSAIVIEYDDSER

SEQ ID NO: 1676623 - protein, 17 aa, Staphylococcus aureus
DAIKNKVSFLIDKKSGY

SEQ ID NO: 1676624 - protein, 21 aa, Staphylococcus aureus
DMKIAYAILRDRLNLSIKNSW

SEQ ID NO: 1676625 - protein, 17 aa, Staphylococcus aureus
ELGITILINLHFVDLAK

SEQ ID NO: 1676626 - protein, 27 aa, Staphylococcus aureus
ENRGWDFDGSYGWQCFDLVNVYWNHLY

SEQ ID NO: 1676627 - protein, 18 aa, Staphylococcus aureus
EPGDLVVFSGRFGGGYGH

SEQ ID NO: 1676628 - protein, 18 aa, Staphylococcus aureus
ERMPKIVIVIDELADLMM

SEQ ID NO: 1676629 - protein, 24 aa, Staphylococcus aureus
FAHGEIRLDINFALYGNGTDSISD

SEQ ID NO: 1676630 - protein, 17 aa, Staphylococcus aureus
FDILPLFISSRNKQIEY

SEQ ID NO: 1676631 - protein, 18 aa, Staphylococcus aureus
FIDIPVLFDDEGNFRIKQ

SEQ ID NO: 1676632 - protein, 24 aa, Staphylococcus aureus
FQKFIVGSLYGWRRGQYRMFTKAY

SEQ ID NO: 1676633 - protein, 20 aa, Staphylococcus aureus
FRGNIFGGYILYNLGYIHST

SEQ ID NO: 1676634 - protein, 22 aa, Staphylococcus aureus
FTGVDFPKLFKAFKDMGMTYNI

SEQ ID NO: 1676635 - protein, 20 aa, Staphylococcus aureus
FVRRVCDCRGQWTMENFIEI

SEQ ID NO: 1676636 - protein, 19 aa, Staphylococcus aureus
FYHPEFKKEYVILAEEGAQ

SEQ ID NO: 1676637 - protein, 24 aa, Staphylococcus aureus
FYKGEFKSASAFPLPNAEYTPLYL

SEQ ID NO: 1676638 - protein, 21 aa, Staphylococcus aureus
GDTRGGVALSIRSVTQKPIKF

SEQ ID NO: 1676639 - protein, 19 aa, Staphylococcus aureus
GEIIFKHGLSLAQVQQITN

SEQ ID NO: 1676640 - protein, 26 aa, Staphylococcus aureus
GHIELAAPVSHIWYFKGIPSRMGLLL

SEQ ID NO: 1676641 - protein, 18 aa, Staphylococcus aureus
GKSYVFKPKSLFVLYDIL

SEQ ID NO: 1676642 - protein, 18 aa, Staphylococcus aureus
GKTKLVYIKSIQDLTESV

SEQ ID NO: 1676643 - protein, 17 aa, Staphylococcus aureus
IHQCSRAIAKAVAQSVI

SEQ ID NO: 1676644 - protein, 22 aa, Staphylococcus aureus
ILFEKHFEPVLGIKMQHSGGHS

SEQ ID NO: 1676645 - protein, 17 aa, Staphylococcus aureus
IRKGETLGIVGESGSGK

SEQ ID NO: 1676646 - protein, 17 aa, Staphylococcus aureus
IRLSPTIEEHDFQTKLK

SEQ ID NO: 1676647 - protein, 23 aa, Staphylococcus aureus
ISQTRLAYLVLRGMGMSEEMIQE

SEQ ID NO: 1676648 - protein, 17 aa, Staphylococcus aureus
KKDGYKPALEFATSTSI

SEQ ID NO: 1676649 - protein, 18 aa, Staphylococcus aureus
KLANEWNIGNSLLYNEIG

SEQ ID NO: 1676650 - protein, 25 aa, Staphylococcus aureus
KLAQHYPLKRIAVMSAPKEKSDDGL

SEQ ID NO: 1676651 - protein, 18 aa, Staphylococcus aureus
KLTIPEIFCKHGEQYFRN

SEQ ID NO: 1676652 - protein, 18 aa, Staphylococcus aureus
KPSSFVIKPLPKNKYPDS

SEQ ID NO: 1676653 - protein, 18 aa, Staphylococcus aureus
KQKLNFASMLLVDSNVLL

SEQ ID NO: 1676654 - protein, 19 aa, Staphylococcus aureus
LEIYYSWAFHEIASAVTDE

SEQ ID NO: 1676655 - protein, 18 aa, Staphylococcus aureus
LHSEFAIIMLLKINEKGA

SEQ ID NO: 1676656 - protein, 19 aa, Staphylococcus aureus
LKHWLPVDLYIGGVEHAVL

SEQ ID NO: 1676657 - protein, 24 aa, Staphylococcus aureus
LKILLKELERVLGRNTFAERVNKL

SEQ ID NO: 1676658 - protein, 21 aa, Staphylococcus aureus
LKKDEFVGIAIPTIVKDKFSV

SEQ ID NO: 1676659 - protein, 17 aa, Staphylococcus aureus
LKLGVDIINDQWAGLYD

SEQ ID NO: 1676660 - protein, 17 aa, Staphylococcus aureus
LKNGFYLNEFLKEVNQH

SEQ ID NO: 1676661 - protein, 17 aa, Staphylococcus aureus
LRELLKLLTEQGTSIII

SEQ ID NO: 1676662 - protein, 19 aa, Staphylococcus aureus
LVEGLKLVTEFVQDENATQ

SEQ ID NO: 1676663 - protein, 23 aa, Staphylococcus aureus
MLPVMRSDFMLRYKDKCLIIDAK

SEQ ID NO: 1676664 - protein, 18 aa, Staphylococcus aureus
MLQGYGFPVISRKEMQQE

SEQ ID NO: 1676665 - protein, 24 aa, Staphylococcus aureus
MQAFWPGPISFILPLKLGYLCRKV

SEQ ID NO: 1676666 - protein, 21 aa, Staphylococcus aureus
PELVEKLIFMLGWDPQSPVPI

SEQ ID NO: 1676667 - protein, 19 aa, Staphylococcus aureus
PILKEKFISLGLDVKEDEA

SEQ ID NO: 1676668 - protein, 22 aa, Staphylococcus aureus
QARGNVAALGRVNANDSTDHGN

SEQ ID NO: 1676669 - protein, 17 aa, Staphylococcus aureus
QIKELGFSYDWDREVNT

SEQ ID NO: 1676670 - protein, 23 aa, Staphylococcus aureus
QPILKEKFISLGLDVKEDEAAKH

SEQ ID NO: 1676671 - protein, 17 aa, Staphylococcus aureus
QTALRKAYLESFRKGFK

SEQ ID NO: 1676672 - protein, 25 aa, Staphylococcus aureus
RKMTAMLRYQFKVILSALKRKGYNL

SEQ ID NO: 1676673 - protein, 18 aa, Staphylococcus aureus
SCVGKEFCRFGTQYTTRL

SEQ ID NO: 1676674 - protein, 21 aa, Staphylococcus aureus
SELGSRMRLRIMPELMYEYDQ

SEQ ID NO: 1676675 - protein, 22 aa, Staphylococcus aureus
SFTKFKSCLKKHTFEQIMQGTR

SEQ ID NO: 1676676 - protein, 18 aa, Staphylococcus aureus
SGAKIAFYVAQWPMSRLQ

SEQ ID NO: 1676677 - protein, 17 aa, Staphylococcus aureus
SMIPVEWEKVYAMAYVN

SEQ ID NO: 1676678 - protein, 18 aa, Staphylococcus aureus
SMIPVEWEKVYAMAYVNE

SEQ ID NO: 1676679 - protein, 20 aa, Staphylococcus aureus
SRAPIAISILVKDGSYNHDI

SEQ ID NO: 1676680 - protein, 21 aa, Staphylococcus aureus
TDMKGGLMALVVSLIELKEQN

SEQ ID NO: 1676681 - protein, 18 aa, Staphylococcus aureus
THIYRLKGFMTFEDTAHT

SEQ ID NO: 1676682 - protein, 18 aa, Staphylococcus aureus
TMPQTRFVLKKALEQNLK

SEQ ID NO: 1676683 - protein, 22 aa, Staphylococcus aureus
VDFYNRMAFDFGTLGNHEFNYG

SEQ ID NO: 1676684 - protein, 21 aa, Staphylococcus aureus
VFKPKSLFVLYDILSNNSVYL

SEQ ID NO: 1676685 - protein, 18 aa, Staphylococcus aureus
WTNGKFLPKRKVVKIEQF

SEQ ID NO: 1676686 - protein, 17 aa, Staphylococcus aureus
YEMLQGYGFPVISRKEM

SEQ ID NO: 1676687 - protein, 17 aa, Staphylococcus aureus
YFKKCLPGYTLINKLHP

SEQ ID NO: 1676688 - protein, 23 aa, Staphylococcus aureus
YQARGNVAALGRVNANDSTDHGN

SEQ ID NO: 1676689 - protein, 17 aa, Staphylococcus aureus
AAYLLWLLSRNNIGFTD

SEQ ID NO: 1676690 - protein, 17 aa, Staphylococcus aureus
AEVDIMYGQGISKEGEL

SEQ ID NO: 1676691 - protein, 21 aa, Staphylococcus aureus
ALNEAMKALKESIKDQPQTEA

SEQ ID NO: 1676692 - protein, 19 aa, Staphylococcus aureus
CGSGSLLLRVGKETQVYRY

SEQ ID NO: 1676693 - protein, 17 aa, Staphylococcus aureus
DHLITFIPYFPLASGIL

SEQ ID NO: 1676694 - protein, 23 aa, Staphylococcus aureus
EINPKFKIGTMISHVPIYPYSCH

SEQ ID NO: 1676695 - protein, 18 aa, Staphylococcus aureus
ELECPVIALSQLSRGVEQ

SEQ ID NO: 1676696 - protein, 18 aa, Staphylococcus aureus
ETAKRALASYSNLNNAQS

SEQ ID NO: 1676697 - protein, 26 aa, Staphylococcus aureus
EYQDCLLFFRLGDFYEMFYEDAKEAS

SEQ ID NO: 1676698 - protein, 20 aa, Staphylococcus aureus
FDFLSDIVYQWERFAQQFEQ

SEQ ID NO: 1676699 - protein, 20 aa, Staphylococcus aureus
FEGCMPFEVMAERGRKTLLF

SEQ ID NO: 1676700 - protein, 18 aa, Staphylococcus aureus
FSRGHFKGNQFPEGVNAL

SEQ ID NO: 1676701 - protein, 21 aa, Staphylococcus aureus
GELKVSFDYIDWINSEFGQIG

SEQ ID NO: 1676702 - protein, 17 aa, Staphylococcus aureus
HQLLKLVGMFAKAQQYI

SEQ ID NO: 1676703 - protein, 21 aa, Staphylococcus aureus
IHPREIFKTAILSNANSIMLG

SEQ ID NO: 1676704 - protein, 17 aa, Staphylococcus aureus
IKEFRMWVADERIQHND

SEQ ID NO: 1676705 - protein, 21 aa, Staphylococcus aureus
ISSMIPVEWEKVYAMAYIDDG

SEQ ID NO: 1676706 - protein, 19 aa, Staphylococcus aureus
IVCAGASAVLFGSVNAIIG

SEQ ID NO: 1676707 - protein, 17 aa, Staphylococcus aureus
KALAKMYLTNDVEIKTA

SEQ ID NO: 1676708 - protein, 24 aa, Staphylococcus aureus
KENIIGAYCTIVFNDGRDNYIEVM

SEQ ID NO: 1676709 - protein, 18 aa, Staphylococcus aureus
KNRFKITIAGGQGHLKGQ

SEQ ID NO: 1676710 - protein, 20 aa, Staphylococcus aureus
KRFKGAHGLLYEHQLGLQAT

SEQ ID NO: 1676711 - protein, 17 aa, Staphylococcus aureus
KSKKGTLLWLMDETKTP

SEQ ID NO: 1676712 - protein, 18 aa, Staphylococcus aureus
KVGFKRLYVGVFNPEATK

SEQ ID NO: 1676713 - protein, 18 aa, Staphylococcus aureus
LGVALPWAISAALVRPNT

SEQ ID NO: 1676714 - protein, 17 aa, Staphylococcus aureus
LKLAIDYGKHDSIGIDA

SEQ ID NO: 1676715 - protein, 18 aa, Staphylococcus aureus
LNEYRKLIEIKAVKDKEE

SEQ ID NO: 1676716 - protein, 18 aa, Staphylococcus aureus
LNGLAALVTTFGVGELSA

SEQ ID NO: 1676717 - protein, 21 aa, Staphylococcus aureus
LNKRKSAVMSYEITSTDLEVT

SEQ ID NO: 1676718 - protein, 22 aa, Staphylococcus aureus
LRMIRCLRFQSQLSFDIATETF

SEQ ID NO: 1676719 - protein, 21 aa, Staphylococcus aureus
MKYYMVGSTYRFKKSDVDEFM

SEQ ID NO: 1676720 - protein, 17 aa, Staphylococcus aureus
NAVMKWFLDSNIKEIRI

SEQ ID NO: 1676721 - protein, 18 aa, Staphylococcus aureus
NHYPICYNTAYKILTMIQ

SEQ ID NO: 1676722 - protein, 17 aa, Staphylococcus aureus
NSGDIKLLIAHPASAGH

SEQ ID NO: 1676723 - protein, 19 aa, Staphylococcus aureus
QKALELVELVGLKGREKAY

SEQ ID NO: 1676724 - protein, 19 aa, Staphylococcus aureus
QMELIKILFQKAQEVDSID

SEQ ID NO: 1676725 - protein, 18 aa, Staphylococcus aureus
SHHLRLLKNLGIAKYRKE

SEQ ID NO: 1676726 - protein, 17 aa, Staphylococcus aureus
SMASFLNSFPMFKDDTR

SEQ ID NO: 1676727 - protein, 17 aa, Staphylococcus aureus
THIYRLKGFMTFEDTAH

SEQ ID NO: 1676728 - protein, 17 aa, Staphylococcus aureus
VADGIVIGSEIVKRFKS

SEQ ID NO: 1676729 - protein, 19 aa, Staphylococcus aureus
VKIVGRLNYRTSYGQNVLK

SEQ ID NO: 1676730 - protein, 18 aa, Staphylococcus aureus
YQLSLAIGKRGQNARLAA

SEQ ID NO: 1676731 - protein, 17 aa, Staphylococcus aureus
AAEWAIPLLPKEHVTLL

SEQ ID NO: 1676732 - protein, 20 aa, Staphylococcus aureus
ACLLTAVPVMKVFKYFYSNR

SEQ ID NO: 1676733 - protein, 19 aa, Staphylococcus aureus
AEERKARFLDKQKNKKTPV

SEQ ID NO: 1676734 - protein, 25 aa, Staphylococcus aureus
AEFIKRLACLPSHIYRLKGFMTFED

SEQ ID NO: 1676735 - protein, 22 aa, Staphylococcus aureus
AGSHCRFCKINHSCRTRAEYMQ

SEQ ID NO: 1676736 - protein, 17 aa, Staphylococcus aureus
AHCLSEWGYDFRPHYAL

SEQ ID NO: 1676737 - protein, 18 aa, Staphylococcus aureus
AKYSISLIIPKSDTSTIK

SEQ ID NO: 1676738 - protein, 25 aa, Staphylococcus aureus
ANHFGGEMKKMWSGIKGIPSKLSSS

SEQ ID NO: 1676739 - protein, 20 aa, Staphylococcus aureus
ANLLRICARYDNLDIIEDAY

SEQ ID NO: 1676740 - protein, 17 aa, Staphylococcus aureus
CYMWLRFNIDQQFDDTA

SEQ ID NO: 1676741 - protein, 18 aa, Staphylococcus aureus
DAELRGVASSGMICSMKE

SEQ ID NO: 1676742 - protein, 21 aa, Staphylococcus aureus
DEMKGRIIGREGRNIRTLETL

SEQ ID NO: 1676743 - protein, 18 aa, Staphylococcus aureus
DGEDFKRPSSVSGSIPSI

SEQ ID NO: 1676744 - protein, 17 aa, Staphylococcus aureus
DVEFVYTPYLLKCVTSE

SEQ ID NO: 1676745 - protein, 20 aa, Staphylococcus aureus
EDGVDIVIHIGVNTVDLEGK

SEQ ID NO: 1676746 - protein, 23 aa, Staphylococcus aureus
EDPSGRMKLDFDSMKLVDNEIKN

SEQ ID NO: 1676747 - protein, 18 aa, Staphylococcus aureus
EEVWLADKRVELVTRHII

SEQ ID NO: 1676748 - protein, 22 aa, Staphylococcus aureus
EFETRAGTLLRYYTGLLEHSKV

SEQ ID NO: 1676749 - protein, 20 aa, Staphylococcus aureus
EKLFKVFAYCLMKASHKDHT

SEQ ID NO: 1676750 - protein, 17 aa, Staphylococcus aureus
EVARLPKDVKVEIELVS

SEQ ID NO: 1676751 - protein, 19 aa, Staphylococcus aureus
FEGKRWRTVILGSSDREKS

SEQ ID NO: 1676752 - protein, 22 aa, Staphylococcus aureus
FELRKKHILGIVGESGSGKSIT

SEQ ID NO: 1676753 - protein, 17 aa, Staphylococcus aureus
FKYVAPVAGALGYTIED

SEQ ID NO: 1676754 - protein, 17 aa, Staphylococcus aureus
FLTRLGFGSKMVVTGDQ

SEQ ID NO: 1676755 - protein, 21 aa, Staphylococcus aureus
FNNPLFLKLMCEYCVNKFKEF

SEQ ID NO: 1676756 - protein, 30 aa, Staphylococcus aureus
FSRGSIIYLDFGINIGHEFSGRHFGIVLNK

SEQ ID NO: 1676757 - protein, 17 aa, Staphylococcus aureus
GDEAKEYWLCWVTTERN

SEQ ID NO: 1676758 - protein, 17 aa, Staphylococcus aureus
GDTIVVWRLDRLGRNMA

SEQ ID NO: 1676759 - protein, 21 aa, Staphylococcus aureus
GELKVSFDYIDWINSEFGQVG

SEQ ID NO: 1676760 - protein, 20 aa, Staphylococcus aureus
GIAGLRLGVLISTAGTIKHI

SEQ ID NO: 1676761 - protein, 20 aa, Staphylococcus aureus
HACPELLGGLLIPREPAEII

SEQ ID NO: 1676762 - protein, 21 aa, Staphylococcus aureus
HAQMKMFLTRLGFGSKMVVTG

SEQ ID NO: 1676763 - protein, 20 aa, Staphylococcus aureus
HLRNRILLCSKLYAPKSKKE

SEQ ID NO: 1676764 - protein, 17 aa, Staphylococcus aureus
HPFILKRIVGQSGMSYG

SEQ ID NO: 1676765 - protein, 17 aa, Staphylococcus aureus
IKNKVSFLIDKKSGYFY

SEQ ID NO: 1676766 - protein, 23 aa, Staphylococcus aureus
IQVWKKPSSFVIKPLPKNKYPDS

SEQ ID NO: 1676767 - protein, 18 aa, Staphylococcus aureus
IVCAGASAVLFGSVNAII

SEQ ID NO: 1676768 - protein, 17 aa, Staphylococcus aureus
IVHIGHFKAGEAINTVP

SEQ ID NO: 1676769 - protein, 21 aa, Staphylococcus aureus
KEFKNNLALCVYYLEKLIKDS

SEQ ID NO: 1676770 - protein, 19 aa, Staphylococcus aureus
KELLECFDYLIKHKRHATR

SEQ ID NO: 1676771 - protein, 18 aa, Staphylococcus aureus
KFNQIFIFTHSWNDFCDI

SEQ ID NO: 1676772 - protein, 22 aa, Staphylococcus aureus
KFSRLPQDINFFSWLQHVKDSD

SEQ ID NO: 1676773 - protein, 19 aa, Staphylococcus aureus
KKLGIRKGIPVVFSDESPI

SEQ ID NO: 1676774 - protein, 19 aa, Staphylococcus aureus
KLFILKGHMGISIQVKDMN

SEQ ID NO: 1676775 - protein, 17 aa, Staphylococcus aureus
KPGAYVWRDKVCSMEIW

SEQ ID NO: 1676776 - protein, 19 aa, Staphylococcus aureus
KRPGLDRAIEFARSGDTIV

SEQ ID NO: 1676777 - protein, 17 aa, Staphylococcus aureus
LGTVWINDFHPYFAQAP

SEQ ID NO: 1676778 - protein, 17 aa, Staphylococcus aureus
LKFGDYLSASSMRSLIN

SEQ ID NO: 1676779 - protein, 19 aa, Staphylococcus aureus
LKLMCEYCVNKFKEFDQTI

SEQ ID NO: 1676780 - protein, 20 aa, Staphylococcus aureus
LKREDLQWVRSFKLRGAYNA

SEQ ID NO: 1676781 - protein, 17 aa, Staphylococcus aureus
LLKNLGIAKYRKEGKVV

SEQ ID NO: 1676782 - protein, 20 aa, Staphylococcus aureus
LPLKFGDYLSASSMRSLINI

SEQ ID NO: 1676783 - protein, 19 aa, Staphylococcus aureus
LTGGCPMGPYIVTKDELPL

SEQ ID NO: 1676784 - protein, 19 aa, Staphylococcus aureus
LVEGLRLVTEFVQDENATQ

SEQ ID NO: 1676785 - protein, 18 aa, Staphylococcus aureus
MDGRIPINVWTGDSIARS

SEQ ID NO: 1676786 - protein, 19 aa, Staphylococcus aureus
MPIEVVYGFAQLKRAAAIA

SEQ ID NO: 1676787 - protein, 17 aa, Staphylococcus aureus
MYRLLGLAKYEDRFVIP

SEQ ID NO: 1676788 - protein, 20 aa, Staphylococcus aureus
NHLRLEKYQDLMLISQKDFE

SEQ ID NO: 1676789 - protein, 24 aa, Staphylococcus aureus
NKSIAQVILRWLVERDIVVLAKSV

SEQ ID NO: 1676790 - protein, 21 aa, Staphylococcus aureus
NRYGCALAIEVLKRLKDENIG

SEQ ID NO: 1676791 - protein, 18 aa, Staphylococcus aureus
NVNEAWLMGFDISKNRKI

SEQ ID NO: 1676792 - protein, 22 aa, Staphylococcus aureus
NVRLKPYFDVLVEKVIYPYRNN

SEQ ID NO: 1676793 - protein, 17 aa, Staphylococcus aureus
NYEMVKALVEFQINNGM

SEQ ID NO: 1676794 - protein, 17 aa, Staphylococcus aureus
NYKCTKLSIALRYEMIC

SEQ ID NO: 1676795 - protein, 17 aa, Staphylococcus aureus
PDCLMLFQHHNLLPWKT

SEQ ID NO: 1676796 - protein, 20 aa, Staphylococcus aureus
PLAEISVKVFNEFNISEREA

SEQ ID NO: 1676797 - protein, 17 aa, Staphylococcus aureus
PMLSYVYDYPHKKLYKA

SEQ ID NO: 1676798 - protein, 19 aa, Staphylococcus aureus
QAGETIGLFSYGSGSVGEF

SEQ ID NO: 1676799 - protein, 23 aa, Staphylococcus aureus
QGFVKRVDNYIAFRNTITSIESI

SEQ ID NO: 1676800 - protein, 20 aa, Staphylococcus aureus
RALEEVIYFASYVVVDPGPT

SEQ ID NO: 1676801 - protein, 19 aa, Staphylococcus aureus
RDLAEVIAMKCVGATTVAT

SEQ ID NO: 1676802 - protein, 17 aa, Staphylococcus aureus
RHFSAFVGTDLDLQLRR

SEQ ID NO: 1676803 - protein, 20 aa, Staphylococcus aureus
SITFTHEFMFARPIHRTPDM

SEQ ID NO: 1676804 - protein, 17 aa, Staphylococcus aureus
SYKLVGIVTSREMINTK

SEQ ID NO: 1676805 - protein, 17 aa, Staphylococcus aureus
TKMYNVFEYFKQISNNK

SEQ ID NO: 1676806 - protein, 18 aa, Staphylococcus aureus
VGNSIYLNILVKDIEEKS

SEQ ID NO: 1676807 - protein, 18 aa, Staphylococcus aureus
VTQAPRVLGFDAIGTVEA

SEQ ID NO: 1676808 - protein, 22 aa, Staphylococcus aureus
VTRVGVGKLCLVEFDYATSQDF

SEQ ID NO: 1676809 - protein, 17 aa, Staphylococcus aureus
WREGCIIRAQFLQKIKD

SEQ ID NO: 1676810 - protein, 17 aa, Staphylococcus aureus
WYGFQCFDYANAGWKVL

SEQ ID NO: 1676811 - protein, 21 aa, Staphylococcus aureus
YDKLRFEAIFTELRNRDITFI

SEQ ID NO: 1676812 - protein, 19 aa, Staphylococcus aureus
ANAGWKALFGLLLKGVGAK

SEQ ID NO: 1676813 - protein, 23 aa, Staphylococcus aureus
ANAGWKVLFGLLLKGLGAKDIPF

SEQ ID NO: 1676814 - protein, 17 aa, Staphylococcus aureus
ANYFLSIGIKTVLITLG

SEQ ID NO: 1676815 - protein, 22 aa, Staphylococcus aureus
AQALDHAMELLRNSVADNQATL

SEQ ID NO: 1676816 - protein, 19 aa, Staphylococcus aureus
ARLKLLVALSNNLDKAEIK

SEQ ID NO: 1676817 - protein, 17 aa, Staphylococcus aureus
ARLLKKWGLPANRNTIR

SEQ ID NO: 1676818 - protein, 29 aa, Staphylococcus aureus
ASYRLEFYRLYLLMVHLLKFGEMYRDSVA

SEQ ID NO: 1676819 - protein, 17 aa, Staphylococcus aureus
AYELGFDHGLLFKDGVT

SEQ ID NO: 1676820 - protein, 19 aa, Staphylococcus aureus
CHLVLKWKFNKDEGKYFTD

SEQ ID NO: 1676821 - protein, 17 aa, Staphylococcus aureus
DHFRLGISVSKKLGNAV

SEQ ID NO: 1676822 - protein, 17 aa, Staphylococcus aureus
DTFKILGVGVDFNDEKQ

SEQ ID NO: 1676823 - protein, 17 aa, Staphylococcus aureus
EEMKHYFILNFPQRPGA

SEQ ID NO: 1676824 - protein, 25 aa, Staphylococcus aureus
EFKAGSHCRFCKIKHSCRTRAEYMQ

SEQ ID NO: 1676825 - protein, 23 aa, Staphylococcus aureus
ETEVINVFPIRFIVDKENEVSDP

SEQ ID NO: 1676826 - protein, 18 aa, Staphylococcus aureus
FAELGFTFFNYHYTAKLI

SEQ ID NO: 1676827 - protein, 20 aa, Staphylococcus aureus
FEVFCTLAYTGMRAGELLAL

SEQ ID NO: 1676828 - protein, 17 aa, Staphylococcus aureus
FLKTLPFEQILSGYAEV

SEQ ID NO: 1676829 - protein, 18 aa, Staphylococcus aureus
FLNTKKLSIGWKIYLEKI

SEQ ID NO: 1676830 - protein, 17 aa, Staphylococcus aureus
FSTGSWGKIPFIPFKNN

SEQ ID NO: 1676831 - protein, 17 aa, Staphylococcus aureus
GAVLKHFDNISVNVKRP

SEQ ID NO: 1676832 - protein, 24 aa, Staphylococcus aureus
GFTHLPGWVRKASVGLAIFGASIG

SEQ ID NO: 1676833 - protein, 22 aa, Staphylococcus aureus
GKELKVVIVVSRFNDFITGRLL

SEQ ID NO: 1676834 - protein, 18 aa, Staphylococcus aureus
HGEFGKWLEKVGLDKYQA

SEQ ID NO: 1676835 - protein, 21 aa, Staphylococcus aureus
HLRNRILLCSKLYAPKSKKEV

SEQ ID NO: 1676836 - protein, 17 aa, Staphylococcus aureus
ICTYDLLFRSGLDLNVD

SEQ ID NO: 1676837 - protein, 17 aa, Staphylococcus aureus
IEAAISFIENNPKGSVL

SEQ ID NO: 1676838 - protein, 18 aa, Staphylococcus aureus
IGEALALQWKDYDKIKGE

SEQ ID NO: 1676839 - protein, 17 aa, Staphylococcus aureus
IGLSGMCKMMFYEKNAE

SEQ ID NO: 1676840 - protein, 19 aa, Staphylococcus aureus
IGLSGMCKMMFYEKNAEYM

SEQ ID NO: 1676841 - protein, 19 aa, Staphylococcus aureus
IIYLKSCDLTTILHNLYKR

SEQ ID NO: 1676842 - protein, 17 aa, Staphylococcus aureus
IKHSYLKKSFLEIVETL

SEQ ID NO: 1676843 - protein, 18 aa, Staphylococcus aureus
INFFSLFSKFVINIPKML

SEQ ID NO: 1676844 - protein, 19 aa, Staphylococcus aureus
IPIKALTSYLGFGNYELRL

SEQ ID NO: 1676845 - protein, 20 aa, Staphylococcus aureus
IPLQMCSVMEDFYIEKLITG

SEQ ID NO: 1676846 - protein, 18 aa, Staphylococcus aureus
ISNTFSLVGCMCQPAFEF

SEQ ID NO: 1676847 - protein, 17 aa, Staphylococcus aureus
IWVWTGFLYEYLANDCT

SEQ ID NO: 1676848 - protein, 19 aa, Staphylococcus aureus
KIELEFYFTPPKSWSKKKK

SEQ ID NO: 1676849 - protein, 19 aa, Staphylococcus aureus
KKYFYRFSLKARKRVKTVS

SEQ ID NO: 1676850 - protein, 18 aa, Staphylococcus aureus
KLQKILILKSFDFDIAKI

SEQ ID NO: 1676851 - protein, 22 aa, Staphylococcus aureus
KLRRFREALIFMGRKNGKTTTI

SEQ ID NO: 1676852 - protein, 17 aa, Staphylococcus aureus
KLSIALRYEMICSRLEH

SEQ ID NO: 1676853 - protein, 19 aa, Staphylococcus aureus
KSLKGSHVSLIIPIDGVDY

SEQ ID NO: 1676854 - protein, 22 aa, Staphylococcus aureus
KVTHLRALLQLRDVAQNNDAIK

SEQ ID NO: 1676855 - protein, 21 aa, Staphylococcus aureus
KYKISGTWYPFYKKNDGDLTK

SEQ ID NO: 1676856 - protein, 25 aa, Staphylococcus aureus
LALNDCWPDLIFPESEIAFIVLHFG

SEQ ID NO: 1676857 - protein, 21 aa, Staphylococcus aureus
LCTTYKMALDFYIELSSNTVK

SEQ ID NO: 1676858 - protein, 18 aa, Staphylococcus aureus
LDQFILLIFYGTFPGGDF

SEQ ID NO: 1676859 - protein, 17 aa, Staphylococcus aureus
LESIFGLSRRQLGYRIQ

SEQ ID NO: 1676860 - protein, 24 aa, Staphylococcus aureus
LFRVPAEQGIPIWTDKEHEELEAF

SEQ ID NO: 1676861 - protein, 18 aa, Staphylococcus aureus
LNEGYQFFGVLYIGAILT

SEQ ID NO: 1676862 - protein, 22 aa, Staphylococcus aureus
LNNRKSEALQRLDQLTHLNNAQ

SEQ ID NO: 1676863 - protein, 17 aa, Staphylococcus aureus
LNTGMSFIRGVGYPKQQ

SEQ ID NO: 1676864 - protein, 17 aa, Staphylococcus aureus
LPVNAFRDKVIGLVATA

SEQ ID NO: 1676865 - protein, 20 aa, Staphylococcus aureus
LQAGETIGLFSYGSGSVGEF

SEQ ID NO: 1676866 - protein, 17 aa, Staphylococcus aureus
LQEEYKFHFVITGHEGI

SEQ ID NO: 1676867 - protein, 17 aa, Staphylococcus aureus
LQKILILKSFDFDIAKI

SEQ ID NO: 1676868 - protein, 24 aa, Staphylococcus aureus
LTAEEKTEALAMIKQITDQAKQGI

SEQ ID NO: 1676869 - protein, 21 aa, Staphylococcus aureus
LWRSSEGMTEFIFNGFYDNVI

SEQ ID NO: 1676870 - protein, 19 aa, Staphylococcus aureus
LYARFWHKVLYDLGIVPTK

SEQ ID NO: 1676871 - protein, 19 aa, Staphylococcus aureus
MCRYPWKTKQRILGDMGHV

SEQ ID NO: 1676872 - protein, 17 aa, Staphylococcus aureus
MISRSEFYTAYTPYQPE

SEQ ID NO: 1676873 - protein, 22 aa, Staphylococcus aureus
MQPLYEWLGLTASLGFVDIVDY

SEQ ID NO: 1676874 - protein, 18 aa, Staphylococcus aureus
MRSDIMLRYKDKCLIIDA

SEQ ID NO: 1676875 - protein, 17 aa, Staphylococcus aureus
NEYRKLIEIKAVKDKEE

SEQ ID NO: 1676876 - protein, 17 aa, Staphylococcus aureus
NKKEFKNNLALCVYYLE

SEQ ID NO: 1676877 - protein, 17 aa, Staphylococcus aureus
NKRIDYRLSYNFYTTYY

SEQ ID NO: 1676878 - protein, 22 aa, Staphylococcus aureus
NRYGCALAIEVLKRLKDENIGI

SEQ ID NO: 1676879 - protein, 20 aa, Staphylococcus aureus
NVCSCCGQQLPAEQVNEARE

SEQ ID NO: 1676880 - protein, 19 aa, Staphylococcus aureus
PSVLPARFPNLLANGASGI

SEQ ID NO: 1676881 - protein, 17 aa, Staphylococcus aureus
QHFPSVFALIGSHSEYD

SEQ ID NO: 1676882 - protein, 17 aa, Staphylococcus aureus
QPVELCGTYVLLASEES

SEQ ID NO: 1676883 - protein, 17 aa, Staphylococcus aureus
RDRQEWWYNVFYDDGKY

SEQ ID NO: 1676884 - protein, 21 aa, Staphylococcus aureus
REIIEELMLVKGYRDANDKAF

SEQ ID NO: 1676885 - protein, 21 aa, Staphylococcus aureus
RELQDIIAILGMDELSDEDKQ

SEQ ID NO: 1676886 - protein, 19 aa, Staphylococcus aureus
RGELITGDFDKLIYGIPQL

SEQ ID NO: 1676887 - protein, 19 aa, Staphylococcus aureus
RGIDEYLIRLSLGVENYED

SEQ ID NO: 1676888 - protein, 19 aa, Staphylococcus aureus
RIPLSQAVIELCLSPKSNS

SEQ ID NO: 1676889 - protein, 17 aa, Staphylococcus aureus
RKIDVEPVFGFMKAILG

SEQ ID NO: 1676890 - protein, 19 aa, Staphylococcus aureus
RKNTVLYLMHYHKRITDKQ

SEQ ID NO: 1676891 - protein, 17 aa, Staphylococcus aureus
RPLIKLVAFASEIHGES

SEQ ID NO: 1676892 - protein, 20 aa, Staphylococcus aureus
RPLMEEWLFNTVAFIGGPSE

SEQ ID NO: 1676893 - protein, 24 aa, Staphylococcus aureus
RQSFNIPALKAWQSVKQNAGNDAP

SEQ ID NO: 1676894 - protein, 21 aa, Staphylococcus aureus
RSTNFSIVWILPISSIDNMPI

SEQ ID NO: 1676895 - protein, 17 aa, Staphylococcus aureus
RTMDIFRLLGVEIKEDD

SEQ ID NO: 1676896 - protein, 17 aa, Staphylococcus aureus
RVEKSIADWDIKLEHTF

SEQ ID NO: 1676897 - protein, 22 aa, Staphylococcus aureus
SAKKYLWRVLVTQLKKLELNYD

SEQ ID NO: 1676898 - protein, 20 aa, Staphylococcus aureus
SDSPGGWQIIGRTPLKVFSS

SEQ ID NO: 1676899 - protein, 18 aa, Staphylococcus aureus
SEYFFRDLLNIVYGYSLE

SEQ ID NO: 1676900 - protein, 19 aa, Staphylococcus aureus
SIVGPFAYYIKGFEMLPQM

SEQ ID NO: 1676901 - protein, 19 aa, Staphylococcus aureus
SWCKNKFQVTNQVSVEDTY

SEQ ID NO: 1676902 - protein, 17 aa, Staphylococcus aureus
TFPNCLKITAKNDEVII

SEQ ID NO: 1676903 - protein, 24 aa, Staphylococcus aureus
TIMRKRLDMLAAFIESKVPDVEIK

SEQ ID NO: 1676904 - protein, 17 aa, Staphylococcus aureus
TKQRILGDMGHVSNEDA

SEQ ID NO: 1676905 - protein, 18 aa, Staphylococcus aureus
TRLRPGGKEATDWLIQQG

SEQ ID NO: 1676906 - protein, 19 aa, Staphylococcus aureus
VCYMWLRFNMDQQFDDTAI

SEQ ID NO: 1676907 - protein, 19 aa, Staphylococcus aureus
VDVSNCIFILTSNFNSIEE

SEQ ID NO: 1676908 - protein, 18 aa, Staphylococcus aureus
VEWEKVYVIAYVDDGGGQ

SEQ ID NO: 1676909 - protein, 17 aa, Staphylococcus aureus
VPTTDCYEIFWGGDNEL

SEQ ID NO: 1676910 - protein, 25 aa, Staphylococcus aureus
WNVTDCKICFKYGLYYSPVSTPADF

SEQ ID NO: 1676911 - protein, 17 aa, Staphylococcus aureus
WPIFLERSLVDGIFTIK

SEQ ID NO: 1676912 - protein, 23 aa, Staphylococcus aureus
WQHFIIGSLFGWVHKETKLRRFR

SEQ ID NO: 1676913 - protein, 17 aa, Staphylococcus aureus
YEFLYLLSMDKLFGNKR

SEQ ID NO: 1676914 - protein, 17 aa, Staphylococcus aureus
YKALGFKINRNPQMLDK

SEQ ID NO: 1676915 - protein, 18 aa, Staphylococcus aureus
YKFHFVITGHEGINKDKD

SEQ ID NO: 1676916 - protein, 20 aa, Staphylococcus aureus
YKLDRYVGLIAEEVENLGLK

SEQ ID NO: 1676917 - protein, 19 aa, Staphylococcus aureus
YPHQRYAIDLVIKENHKTY

SEQ ID NO: 1676918 - protein, 17 aa, Staphylococcus aureus
YQKIMLFGQAVDFSSDK

SEQ ID NO: 1676919 - protein, 18 aa, Staphylococcus aureus
YRYARYVDDISFSFNFEE

SEQ ID NO: 1676920 - protein, 18 aa, Staphylococcus aureus
YSLLNGWELMEDELKTEF

SEQ ID NO: 1676921 - protein, 18 aa, Staphylococcus aureus
AELLAPMSAIAGQRSAIM

SEQ ID NO: 1676922 - protein, 17 aa, Staphylococcus aureus
ALFAASFVTHFSGQTPH

SEQ ID NO: 1676923 - protein, 17 aa, Staphylococcus aureus
ARKEVFKELLVNCELPQ

SEQ ID NO: 1676924 - protein, 26 aa, Staphylococcus aureus
AWQKFARPRFDNMISFNSTNDLLTWL

SEQ ID NO: 1676925 - protein, 18 aa, Staphylococcus aureus
CHGGIKWYNLVKNIKKDD

SEQ ID NO: 1676926 - protein, 17 aa, Staphylococcus aureus
CNMCTTSIYLAHTYGCH

SEQ ID NO: 1676927 - protein, 18 aa, Staphylococcus aureus
CRILDYKSAIVIEYDDSE

SEQ ID NO: 1676928 - protein, 17 aa, Staphylococcus aureus
CYLGDFKSTGGIFAATE

SEQ ID NO: 1676929 - protein, 20 aa, Staphylococcus aureus
DEQYSGIGFVLSDGNNFVCL

SEQ ID NO: 1676930 - protein, 18 aa, Staphylococcus aureus
DFKRLNGLMIGFVIKGEA

SEQ ID NO: 1676931 - protein, 17 aa, Staphylococcus aureus
DLKRFKGAHGLLYEQEL

SEQ ID NO: 1676932 - protein, 17 aa, Staphylococcus aureus
DTLRVASILAHTLFDYP

SEQ ID NO: 1676933 - protein, 17 aa, Staphylococcus aureus
EAFKYVAPVAGALGYTI

SEQ ID NO: 1676934 - protein, 17 aa, Staphylococcus aureus
EAIKYAVKFYNYPNEHI

SEQ ID NO: 1676935 - protein, 19 aa, Staphylococcus aureus
EAKYSISLIIPKSDTSTIK

SEQ ID NO: 1676936 - protein, 18 aa, Staphylococcus aureus
EGKRWRTVILGSSDREKS

SEQ ID NO: 1676937 - protein, 24 aa, Staphylococcus aureus
EKAKAQGLEAFDNIQIDSTEKQKA

SEQ ID NO: 1676938 - protein, 20 aa, Staphylococcus aureus
EPAEIIGGDGFDVWNDAAKV

SEQ ID NO: 1676939 - protein, 24 aa, Staphylococcus aureus
ETGELIFKFYRHCFRYNEINLKIQ

SEQ ID NO: 1676940 - protein, 22 aa, Staphylococcus aureus
ETSRLEGVINFENLKVKDVDTT

SEQ ID NO: 1676941 - protein, 17 aa, Staphylococcus aureus
FEYRKVALFKEWKTQKG

SEQ ID NO: 1676942 - protein, 18 aa, Staphylococcus aureus
FPIFIPQALINEQIEYKI

SEQ ID NO: 1676943 - protein, 17 aa, Staphylococcus aureus
FRLGISVSKKLGNAVLR

SEQ ID NO: 1676944 - protein, 17 aa, Staphylococcus aureus
GERALKYIIPDTADFPY

SEQ ID NO: 1676945 - protein, 17 aa, Staphylococcus aureus
GHGIGMLEWALDYIVGN

SEQ ID NO: 1676946 - protein, 17 aa, Staphylococcus aureus
GHVIGMLEWALDYIVGN

SEQ ID NO: 1676947 - protein, 20 aa, Staphylococcus aureus
GKVEMESWGKWRVIEAQLHL

SEQ ID NO: 1676948 - protein, 18 aa, Staphylococcus aureus
GNITAYWKGFKEYHEAKG

SEQ ID NO: 1676949 - protein, 18 aa, Staphylococcus aureus
GSGSLLLRVGKETQVYRY

SEQ ID NO: 1676950 - protein, 20 aa, Staphylococcus aureus
GVAFCPHCDGPLFENKDVAV

SEQ ID NO: 1676951 - protein, 21 aa, Staphylococcus aureus
HGYDFPMWFIRPFYAKETTAN

SEQ ID NO: 1676952 - protein, 18 aa, Staphylococcus aureus
IKEFELLWYLASRENEVI

SEQ ID NO: 1676953 - protein, 17 aa, Staphylococcus aureus
KAYEMLQGYGFPVISRK

SEQ ID NO: 1676954 - protein, 17 aa, Staphylococcus aureus
KDVFPWRQHDVKLVFFL

SEQ ID NO: 1676955 - protein, 23 aa, Staphylococcus aureus
KEALKAQVTSAGRVSVANGVEHT

SEQ ID NO: 1676956 - protein, 20 aa, Staphylococcus aureus
KELLFKRRIDIGGVNNNFKG

SEQ ID NO: 1676957 - protein, 19 aa, Staphylococcus aureus
KFKEAMFLKGFNLSDLSRE

SEQ ID NO: 1676958 - protein, 17 aa, Staphylococcus aureus
KFNQIFIFTHSWNDFCD

SEQ ID NO: 1676959 - protein, 24 aa, Staphylococcus aureus
KGAVKLILKRDFFLEVARDASTKT

SEQ ID NO: 1676960 - protein, 20 aa, Staphylococcus aureus
KLGEHLKHPFILKRIVGQSG

SEQ ID NO: 1676961 - protein, 18 aa, Staphylococcus aureus
KRNIILLHYFMDMSDVEI

SEQ ID NO: 1676962 - protein, 18 aa, Staphylococcus aureus
LEFQKRGAVAFDYGNNIR

SEQ ID NO: 1676963 - protein, 17 aa, Staphylococcus aureus
LEGSFHFETFISLTCQK

SEQ ID NO: 1676964 - protein, 17 aa, Staphylococcus aureus
LFLDKGMIYGLKFHEFP

SEQ ID NO: 1676965 - protein, 19 aa, Staphylococcus aureus
LKDGIPDVCFVRDLEGICL

SEQ ID NO: 1676966 - protein, 18 aa, Staphylococcus aureus
LKFGDYLSASSMRSLINI

SEQ ID NO: 1676967 - protein, 21 aa, Staphylococcus aureus
LKRLIVPSIEREIHADLTEKA

SEQ ID NO: 1676968 - protein, 17 aa, Staphylococcus aureus
LSGMCKMMFYEKNAEYM

SEQ ID NO: 1676969 - protein, 22 aa, Staphylococcus aureus
LTTGFCLWCQLAFSTYLENATQ

SEQ ID NO: 1676970 - protein, 18 aa, Staphylococcus aureus
MQQEIPYPFFVIKMPESN

SEQ ID NO: 1676971 - protein, 17 aa, Staphylococcus aureus
NEGYQFFGVLYIGAILT

SEQ ID NO: 1676972 - protein, 20 aa, Staphylococcus aureus
NLWYFRYFIYYLIKENVISK

SEQ ID NO: 1676973 - protein, 26 aa, Staphylococcus aureus
NRVGWGEIPMSLGFTYSSNTLMMHLQ

SEQ ID NO: 1676974 - protein, 18 aa, Staphylococcus aureus
NSRLFAFYCKLDDPKEVD

SEQ ID NO: 1676975 - protein, 17 aa, Staphylococcus aureus
PILKDVYGFVEIGRELV

SEQ ID NO: 1676976 - protein, 19 aa, Staphylococcus aureus
QHFPSVFALIGSHSEYDLH

SEQ ID NO: 1676977 - protein, 20 aa, Staphylococcus aureus
QSIKEFRMWVADERIQHNDN

SEQ ID NO: 1676978 - protein, 19 aa, Staphylococcus aureus
RFKGAHGLLYEQELGLQAT

SEQ ID NO: 1676979 - protein, 21 aa, Staphylococcus aureus
RFQNCSLFPLYHGSAKSNIGI

SEQ ID NO: 1676980 - protein, 23 aa, Staphylococcus aureus
RISKSGFGPFAFDEWRYLPDGSD

SEQ ID NO: 1676981 - protein, 18 aa, Staphylococcus aureus
RKLSERRIFPAIDIGRSS

SEQ ID NO: 1676982 - protein, 20 aa, Staphylococcus aureus
RLSQDWKLRHVLIEMHGNNG

SEQ ID NO: 1676983 - protein, 18 aa, Staphylococcus aureus
RMIIKQLYFFSVANPNPT

SEQ ID NO: 1676984 - protein, 23 aa, Staphylococcus aureus
RVIAWYAKEQWRLDVFNTHGKIY

SEQ ID NO: 1676985 - protein, 17 aa, Staphylococcus aureus
SNTFSLVGCMCQPAFEF

SEQ ID NO: 1676986 - protein, 18 aa, Staphylococcus aureus
SSMIPVEWEKVYTMAYID

SEQ ID NO: 1676987 - protein, 18 aa, Staphylococcus aureus
SWDYFDIGLFEFDSGYVE

SEQ ID NO: 1676988 - protein, 20 aa, Staphylococcus aureus
TDIPFCIYNKTALCTGRGEK

SEQ ID NO: 1676989 - protein, 20 aa, Staphylococcus aureus
TKELIDWLKAQSRPFLFSTS

SEQ ID NO: 1676990 - protein, 20 aa, Staphylococcus aureus
TNCVFLHCDYILKVPINKLV

SEQ ID NO: 1676991 - protein, 19 aa, Staphylococcus aureus
VCYMWLRFNMDQQFEDTAI

SEQ ID NO: 1676992 - protein, 20 aa, Staphylococcus aureus
VDMLRMCRYPWKTKQRILGD

SEQ ID NO: 1676993 - protein, 17 aa, Staphylococcus aureus
VEPYIGAFIYLYFKNQP

SEQ ID NO: 1676994 - protein, 24 aa, Staphylococcus aureus
VKNLWLRTELKYFYFYHLNNGIWN

SEQ ID NO: 1676995 - protein, 17 aa, Staphylococcus aureus
VNQFKLIFEFMNITNYR

SEQ ID NO: 1676996 - protein, 17 aa, Staphylococcus aureus
VQIMGGIAIHKGDIAEM

SEQ ID NO: 1676997 - protein, 18 aa, Staphylococcus aureus
VRVGMEMDRSELLRKLVD

SEQ ID NO: 1676998 - protein, 17 aa, Staphylococcus aureus
VTIPAIEAIVPQNDPDA

SEQ ID NO: 1676999 - protein, 17 aa, Staphylococcus aureus
WGKWRVIEAQLHLTVVE

SEQ ID NO: 1677000 - protein, 18 aa, Staphylococcus aureus
WRRVSVVLNKNGKQSQKE

SEQ ID NO: 1677001 - protein, 22 aa, Staphylococcus aureus
WSRLDMGQFLLGGSRFVDSQRQ

SEQ ID NO: 1677002 - protein, 24 aa, Staphylococcus aureus
YAIKKEIIEELGFDFSISHNPYTE

SEQ ID NO: 1677003 - protein, 18 aa, Staphylococcus aureus
YIDFDGWYGYQCADLAVD

SEQ ID NO: 1677004 - protein, 24 aa, Staphylococcus aureus
YKALEVKKRFSAWAEINLKHFKEN

SEQ ID NO: 1677005 - protein, 18 aa, Staphylococcus aureus
YKDWFPRMLKYGFEENTD

SEQ ID NO: 1677006 - protein, 18 aa, Staphylococcus aureus
AENFKEAVQWLYLAYLAA

SEQ ID NO: 1677007 - protein, 22 aa, Staphylococcus aureus
AFGEALGAIIVRTNKLEAGTAI

SEQ ID NO: 1677008 - protein, 18 aa, Staphylococcus aureus
AKILLGWEPIATQKEAIL

SEQ ID NO: 1677009 - protein, 18 aa, Staphylococcus aureus
ALTSYLGFGNYELRLPLV

SEQ ID NO: 1677010 - protein, 17 aa, Staphylococcus aureus
AVTRFRQGLGRLIRSEN

SEQ ID NO: 1677011 - protein, 19 aa, Staphylococcus aureus
AYLSYRLEQEYSKDDIFQV

SEQ ID NO: 1677012 - protein, 18 aa, Staphylococcus aureus
AYTNYAILFISGTYPGGV

SEQ ID NO: 1677013 - protein, 20 aa, Staphylococcus aureus
CVIFDEIHYFFGPEMVNVKR

SEQ ID NO: 1677014 - protein, 17 aa, Staphylococcus aureus
CYMWLRFNMDQQFDGTA

SEQ ID NO: 1677015 - protein, 17 aa, Staphylococcus aureus
DEATWFALMNHLVDVSV

SEQ ID NO: 1677016 - protein, 24 aa, Staphylococcus aureus
DFPKDYKGIAGWVLEVKSNTPGNT

SEQ ID NO: 1677017 - protein, 25 aa, Staphylococcus aureus
DGFKKRWPINIGFIGNVRFNEINQK

SEQ ID NO: 1677018 - protein, 17 aa, Staphylococcus aureus
DIQTLFYGRFYLRELAT

SEQ ID NO: 1677019 - protein, 18 aa, Staphylococcus aureus
EAAYLLWLLSRNNIGFTD

SEQ ID NO: 1677020 - protein, 21 aa, Staphylococcus aureus
EACRSRELLNIMLIEEPEAHI

SEQ ID NO: 1677021 - protein, 21 aa, Staphylococcus aureus
EEMKPMIAEAFYKKFDEAGIL

SEQ ID NO: 1677022 - protein, 18 aa, Staphylococcus aureus
EGCMPFEVMAERGRKTLL

SEQ ID NO: 1677023 - protein, 20 aa, Staphylococcus aureus
EILDLPDYVFPLFGMAVGEP

SEQ ID NO: 1677024 - protein, 20 aa, Staphylococcus aureus
EKQALKDRINQILQQGHNDI

SEQ ID NO: 1677025 - protein, 20 aa, Staphylococcus aureus
EQPLTIAGIFTFKPNEDDRD

SEQ ID NO: 1677026 - protein, 17 aa, Staphylococcus aureus
ERAKILLGWEPIATQKE

SEQ ID NO: 1677027 - protein, 17 aa, Staphylococcus aureus
FDHAFECVGGRGSQSAI

SEQ ID NO: 1677028 - protein, 17 aa, Staphylococcus aureus
FEIKRFDQQYGYVGVPT

SEQ ID NO: 1677029 - protein, 21 aa, Staphylococcus aureus
FETRAGTLLRYYTGLLEHSKV

SEQ ID NO: 1677030 - protein, 18 aa, Staphylococcus aureus
FGTIPRGDTGYFFNQAYK

SEQ ID NO: 1677031 - protein, 19 aa, Staphylococcus aureus
FKEAVQWLYLAYLAAIKEQ

SEQ ID NO: 1677032 - protein, 19 aa, Staphylococcus aureus
FTLNILYPYIETIHITKDK

SEQ ID NO: 1677033 - protein, 17 aa, Staphylococcus aureus
GAANLALISEDPDLMDG

SEQ ID NO: 1677034 - protein, 17 aa, Staphylococcus aureus
GDTGYFFNQAYKKDGAI

SEQ ID NO: 1677035 - protein, 19 aa, Staphylococcus aureus
GIAGLRLGVLMSTAETIQR

SEQ ID NO: 1677036 - protein, 20 aa, Staphylococcus aureus
GLYRKRMLSYGGLLKQKHKI

SEQ ID NO: 1677037 - protein, 17 aa, Staphylococcus aureus
GPFLSCPVAYQFQPGGY

SEQ ID NO: 1677038 - protein, 17 aa, Staphylococcus aureus
GTFTLAVNRTFTNAQGE

SEQ ID NO: 1677039 - protein, 19 aa, Staphylococcus aureus
HDKIKMCTGKSVNQIPGSG

SEQ ID NO: 1677040 - protein, 17 aa, Staphylococcus aureus
IAEAFVRSGAVDIVVVD

SEQ ID NO: 1677041 - protein, 18 aa, Staphylococcus aureus
IDKTMRWLKISNINKLSQ

SEQ ID NO: 1677042 - protein, 17 aa, Staphylococcus aureus
IDSCIKFLYLTQEEKQK

SEQ ID NO: 1677043 - protein, 20 aa, Staphylococcus aureus
IELLKQLQLDFGITYLFITH

SEQ ID NO: 1677044 - protein, 18 aa, Staphylococcus aureus
IKNKVSFLIDKKSGYFYI

SEQ ID NO: 1677045 - protein, 19 aa, Staphylococcus aureus
IPAKARRKGGHPAKRVFQA

SEQ ID NO: 1677046 - protein, 19 aa, Staphylococcus aureus
IYLALKIVEFEACRSRELL

SEQ ID NO: 1677047 - protein, 20 aa, Staphylococcus aureus
KAQGLEAFDNIQIDSTEKQK

SEQ ID NO: 1677048 - protein, 17 aa, Staphylococcus aureus
KEARMKRGLTREQVGTM

SEQ ID NO: 1677049 - protein, 20 aa, Staphylococcus aureus
KEGLKGGGYYVEYRTDDARL

SEQ ID NO: 1677050 - protein, 21 aa, Staphylococcus aureus
KESGFRTSLLMYNHTNKKMTK

SEQ ID NO: 1677051 - protein, 17 aa, Staphylococcus aureus
KFSRLPQDINFFSWLQH

SEQ ID NO: 1677052 - protein, 18 aa, Staphylococcus aureus
KGHVIGMLEWALDYIAGN

SEQ ID NO: 1677053 - protein, 18 aa, Staphylococcus aureus
KGHVIGMLEWALDYIVGN

SEQ ID NO: 1677054 - protein, 17 aa, Staphylococcus aureus
KGIECIYGLYKKNRRSL

SEQ ID NO: 1677055 - protein, 22 aa, Staphylococcus aureus
KIEPRDSLFFVHELMGYNTELK

SEQ ID NO: 1677056 - protein, 19 aa, Staphylococcus aureus
KKCITRWHINLETTGKKRK

SEQ ID NO: 1677057 - protein, 18 aa, Staphylococcus aureus
KKDRVVVEGVNIMKKHQK

SEQ ID NO: 1677058 - protein, 27 aa, Staphylococcus aureus
KKMSFTKFKSCLKKHSFEQIMQGTREY

SEQ ID NO: 1677059 - protein, 19 aa, Staphylococcus aureus
KKYFCLTLDNYLVLAYLDV

SEQ ID NO: 1677060 - protein, 19 aa, Staphylococcus aureus
KLFFKLLFYSGARKGEIRA

SEQ ID NO: 1677061 - protein, 21 aa, Staphylococcus aureus
KLPYTLCYISRGFVVDYSNKE

SEQ ID NO: 1677062 - protein, 17 aa, Staphylococcus aureus
KLSIALRYEMICSNLEH

SEQ ID NO: 1677063 - protein, 17 aa, Staphylococcus aureus
KNWEFPFVIKPGDDLPT

SEQ ID NO: 1677064 - protein, 17 aa, Staphylococcus aureus
KPALEFATSTSIANALM

SEQ ID NO: 1677065 - protein, 25 aa, Staphylococcus aureus
KSVECYEIYHPLESVGIYVPGGKAS

SEQ ID NO: 1677066 - protein, 22 aa, Staphylococcus aureus
KVKRELYDGRGFLSCSRILGEG

SEQ ID NO: 1677067 - protein, 19 aa, Staphylococcus aureus
KWIIDHWATHYGLEKTETI

SEQ ID NO: 1677068 - protein, 17 aa, Staphylococcus aureus
LAILPFKLLKNGLGLAA

SEQ ID NO: 1677069 - protein, 17 aa, Staphylococcus aureus
LENALKIELEFYFTPPK

SEQ ID NO: 1677070 - protein, 20 aa, Staphylococcus aureus
LKCMKRFGFTASFNRCAVSG

SEQ ID NO: 1677071 - protein, 18 aa, Staphylococcus aureus
LKIGDRVSIAWMFESCGR

SEQ ID NO: 1677072 - protein, 19 aa, Staphylococcus aureus
LKIRNEIMETFALNHHQVE

SEQ ID NO: 1677073 - protein, 20 aa, Staphylococcus aureus
LKKCITRWHINLETTGKKRK

SEQ ID NO: 1677074 - protein, 20 aa, Staphylococcus aureus
LNVSEAWLLGYDVESKRIDD

SEQ ID NO: 1677075 - protein, 17 aa, Staphylococcus aureus
LPFHAKRFNDWLETMPN

SEQ ID NO: 1677076 - protein, 19 aa, Staphylococcus aureus
LPISRLLQWGADFVKPLAR

SEQ ID NO: 1677077 - protein, 21 aa, Staphylococcus aureus
LRVASILAHTLFDYPSHQLVT

SEQ ID NO: 1677078 - protein, 20 aa, Staphylococcus aureus
MALNEEFDLLALRKSVIRWC

SEQ ID NO: 1677079 - protein, 17 aa, Staphylococcus aureus
MRQKRVDAIFVVDSNNH

SEQ ID NO: 1677080 - protein, 17 aa, Staphylococcus aureus
MTTACLLFFGKYNAISD

SEQ ID NO: 1677081 - protein, 22 aa, Staphylococcus aureus
NAAWKVLFGLLLKGLGAKDIPF

SEQ ID NO: 1677082 - protein, 17 aa, Staphylococcus aureus
NANRYTFVWKKSIQNHE

SEQ ID NO: 1677083 - protein, 19 aa, Staphylococcus aureus
NLTEAYTNYAILFISGTYP

SEQ ID NO: 1677084 - protein, 17 aa, Staphylococcus aureus
NLTKFGYLKIEIIKEGN

SEQ ID NO: 1677085 - protein, 19 aa, Staphylococcus aureus
NPEDLRVVIDLSNAKAGKY

SEQ ID NO: 1677086 - protein, 22 aa, Staphylococcus aureus
PEKWKDFEVIKRQKAIEIANAM

SEQ ID NO: 1677087 - protein, 17 aa, Staphylococcus aureus
PKYFLPIHGEYRMLKAH

SEQ ID NO: 1677088 - protein, 19 aa, Staphylococcus aureus
PRTLAISVFGEMDVSSIKQ

SEQ ID NO: 1677089 - protein, 17 aa, Staphylococcus aureus
PSVQIGDPFVGKKLMEA

SEQ ID NO: 1677090 - protein, 17 aa, Staphylococcus aureus
PYIEGFVKMLAPIAPHI

SEQ ID NO: 1677091 - protein, 23 aa, Staphylococcus aureus
QGFVKRVDNYIAFRNTIASIESI

SEQ ID NO: 1677092 - protein, 17 aa, Staphylococcus aureus
QVWKKPSSFVIKPLPKN

SEQ ID NO: 1677093 - protein, 18 aa, Staphylococcus aureus
REWGDYGIEEFLEVKSIA

SEQ ID NO: 1677094 - protein, 18 aa, Staphylococcus aureus
RIDSCIKFLYLTQEEKQK

SEQ ID NO: 1677095 - protein, 23 aa, Staphylococcus aureus
RIFNEWQIPIIFVTHSNYEAEQM

SEQ ID NO: 1677096 - protein, 17 aa, Staphylococcus aureus
RLKEIKVPTLILAGEYD

SEQ ID NO: 1677097 - protein, 17 aa, Staphylococcus aureus
RLNYPVLCANIYENDST

SEQ ID NO: 1677098 - protein, 24 aa, Staphylococcus aureus
RVISRWATEYNIFFKRYSSDQFVA

SEQ ID NO: 1677099 - protein, 31 aa, Staphylococcus aureus
SDIKIRVENVLKICGLYAFRNWPIVALSYGQ

SEQ ID NO: 1677100 - protein, 22 aa, Staphylococcus aureus
SDRFPGFQLDYFKKTNYLDTDW

SEQ ID NO: 1677101 - protein, 22 aa, Staphylococcus aureus
SFMRPCQLAKMISRYMIINETD

SEQ ID NO: 1677102 - protein, 17 aa, Staphylococcus aureus
SNTEILYELGLGKYIVG

SEQ ID NO: 1677103 - protein, 20 aa, Staphylococcus aureus
SRRFLDRVWRLMVNEDGTLS

SEQ ID NO: 1677104 - protein, 17 aa, Staphylococcus aureus
SSLKPFLAYGPAIENMK

SEQ ID NO: 1677105 - protein, 26 aa, Staphylococcus aureus
TDEFKKRWPINIGFIGNVRFNEINQK

SEQ ID NO: 1677106 - protein, 22 aa, Staphylococcus aureus
TDNEGWAHCLTIPRVLNVENGQ

SEQ ID NO: 1677107 - protein, 19 aa, Staphylococcus aureus
TFIKKAIAYYRFRPYAMKI

SEQ ID NO: 1677108 - protein, 18 aa, Staphylococcus aureus
TPESISFLLTDEGAGAQV

SEQ ID NO: 1677109 - protein, 19 aa, Staphylococcus aureus
VARELIELIIAFMFHHQIP

SEQ ID NO: 1677110 - protein, 18 aa, Staphylococcus aureus
VEFFEWFNTLETFKNWKK

SEQ ID NO: 1677111 - protein, 17 aa, Staphylococcus aureus
VNEAWLMGFDISKNRKI

SEQ ID NO: 1677112 - protein, 18 aa, Staphylococcus aureus
VTCTLEYNDDYPALYNDP

SEQ ID NO: 1677113 - protein, 20 aa, Staphylococcus aureus
WKTNERWEWFIGKNRGALRL

SEQ ID NO: 1677114 - protein, 18 aa, Staphylococcus aureus
WNTLCTYLKIRVPFDDLD

SEQ ID NO: 1677115 - protein, 20 aa, Staphylococcus aureus
WREPGCSMCLGMNPDQVPEG

SEQ ID NO: 1677116 - protein, 18 aa, Staphylococcus aureus
WYGFQCFDYANAAWKVLF

SEQ ID NO: 1677117 - protein, 22 aa, Staphylococcus aureus
YDFPMWFIRPNFKSETAPRSIQ

SEQ ID NO: 1677118 - protein, 17 aa, Staphylococcus aureus
YEMRWDIGYVLQQIALF

SEQ ID NO: 1677119 - protein, 23 aa, Staphylococcus aureus
YKALEVKKRFSAWAEINLKHFKE

SEQ ID NO: 1677120 - protein, 18 aa, Staphylococcus aureus
YKNIPCNLWIDGHQTEIE

SEQ ID NO: 1677121 - protein, 17 aa, Staphylococcus aureus
YNKWRGMGTLNSVDVIS

SEQ ID NO: 1677122 - protein, 23 aa, Staphylococcus aureus
YNLLDMIMCLDISYHKLKFKHNL

SEQ ID NO: 1677123 - protein, 25 aa, Staphylococcus aureus
YQIEYLKEMVTFVVVNRDKNSQNVE

SEQ ID NO: 1677124 - protein, 18 aa, Staphylococcus aureus
YRPTAVIYDLDFLKTLPF

SEQ ID NO: 1677125 - protein, 19 aa, Staphylococcus aureus
AAEEIKERLSLLSIDDDIN

SEQ ID NO: 1677126 - protein, 21 aa, Staphylococcus aureus
AEACLKLGVDIINDQWAGLYD

SEQ ID NO: 1677127 - protein, 20 aa, Staphylococcus aureus
AGNITAYWKGFKEYHEAKGS

SEQ ID NO: 1677128 - protein, 18 aa, Staphylococcus aureus
AIPDWFWSYQMAMTLDEE

SEQ ID NO: 1677129 - protein, 19 aa, Staphylococcus aureus
AKRFKRWVTSEVLPTLRKT

SEQ ID NO: 1677130 - protein, 18 aa, Staphylococcus aureus
ALIEKCWESEHFIDDNTL

SEQ ID NO: 1677131 - protein, 17 aa, Staphylococcus aureus
ANGRIIVISSIWGETGA

SEQ ID NO: 1677132 - protein, 17 aa, Staphylococcus aureus
CSCCGQKLPVEQVDMAR

SEQ ID NO: 1677133 - protein, 17 aa, Staphylococcus aureus
DCVISVLPSKLGAISDA

SEQ ID NO: 1677134 - protein, 19 aa, Staphylococcus aureus
DIIDEFRALGDYEYEEIET

SEQ ID NO: 1677135 - protein, 23 aa, Staphylococcus aureus
DRLREFYRKFGFTEIKDHTSENN

SEQ ID NO: 1677136 - protein, 17 aa, Staphylococcus aureus
DWSDIIEVFGLKNEKLM

SEQ ID NO: 1677137 - protein, 19 aa, Staphylococcus aureus
EANANRYTFVWKKSIQNHE

SEQ ID NO: 1677138 - protein, 24 aa, Staphylococcus aureus
EECAKAESVVICWAMGITQQDIGS

SEQ ID NO: 1677139 - protein, 27 aa, Staphylococcus aureus
EEMERRYKLFAHYHVRNITAFNKKAPY

SEQ ID NO: 1677140 - protein, 24 aa, Staphylococcus aureus
EHAKELRAKLDLILGDTDNPHKIT

SEQ ID NO: 1677141 - protein, 19 aa, Staphylococcus aureus
EKQALKDRINQILQQGHND

SEQ ID NO: 1677142 - protein, 23 aa, Staphylococcus aureus
EPKIKLYVSLKCRNFDDVAQKIN

SEQ ID NO: 1677143 - protein, 20 aa, Staphylococcus aureus
ERLNGTVLWLGESDELYHPQ

SEQ ID NO: 1677144 - protein, 17 aa, Staphylococcus aureus
ERTRLRTLFPYINEASE

SEQ ID NO: 1677145 - protein, 18 aa, Staphylococcus aureus
EVARLPKDVKVEIELVSK

SEQ ID NO: 1677146 - protein, 19 aa, Staphylococcus aureus
EVHSSLPFLLTGDVPCNHA

SEQ ID NO: 1677147 - protein, 19 aa, Staphylococcus aureus
EVLKPGGVYYASFADLTNN

SEQ ID NO: 1677148 - protein, 19 aa, Staphylococcus aureus
FEKRLFLMAIFNRNRTLFY

SEQ ID NO: 1677149 - protein, 18 aa, Staphylococcus aureus
FPATHWKAINGIPYAGSS

SEQ ID NO: 1677150 - protein, 17 aa, Staphylococcus aureus
FSKRSNKGLVQVVNGDY

SEQ ID NO: 1677151 - protein, 21 aa, Staphylococcus aureus
GESGLKYSIDYIVSETKSQPE

SEQ ID NO: 1677152 - protein, 24 aa, Staphylococcus aureus
GGTPFKTACMYGGVTLHDNNQLEE

SEQ ID NO: 1677153 - protein, 19 aa, Staphylococcus aureus
GHSMLYLSSIMDIYNGEIV

SEQ ID NO: 1677154 - protein, 19 aa, Staphylococcus aureus
GKKRIDYRLSYNFYTTYYD

SEQ ID NO: 1677155 - protein, 18 aa, Staphylococcus aureus
GLEPWTSCEFDFTRDGKL

SEQ ID NO: 1677156 - protein, 18 aa, Staphylococcus aureus
GMIPVEWEKVYTIAYVDN

SEQ ID NO: 1677157 - protein, 17 aa, Staphylococcus aureus
GPFLSCPVGYQFQPGGY

SEQ ID NO: 1677158 - protein, 18 aa, Staphylococcus aureus
GQFQRVWIAKALILEPEI

SEQ ID NO: 1677159 - protein, 18 aa, Staphylococcus aureus
HHYQFGGSLIKSKNLSTL

SEQ ID NO: 1677160 - protein, 20 aa, Staphylococcus aureus
HLHNRILLCSNFTLQKGKKK

SEQ ID NO: 1677161 - protein, 17 aa, Staphylococcus aureus
HSITAIWNFEKQNYYLR

SEQ ID NO: 1677162 - protein, 18 aa, Staphylococcus aureus
HYRTRILIAGALEVQALT

SEQ ID NO: 1677163 - protein, 18 aa, Staphylococcus aureus
IADWDIKLEHTFYVSKFD

SEQ ID NO: 1677164 - protein, 17 aa, Staphylococcus aureus
IAYVVEFFEWFNTLETF

SEQ ID NO: 1677165 - protein, 18 aa, Staphylococcus aureus
ICGMGGPLIAKILKDGQD

SEQ ID NO: 1677166 - protein, 18 aa, Staphylococcus aureus
IELEFYFTPPKSWSKKKK

SEQ ID NO: 1677167 - protein, 18 aa, Staphylococcus aureus
IGHLYAYQFEKIALIGGN

SEQ ID NO: 1677168 - protein, 22 aa, Staphylococcus aureus
IHPREIFKTAILSNANSIMLGH

SEQ ID NO: 1677169 - protein, 17 aa, Staphylococcus aureus
INKEMLEELGFDFSNSH

SEQ ID NO: 1677170 - protein, 18 aa, Staphylococcus aureus
IPKDYWLSQAPKLNSKQL

SEQ ID NO: 1677171 - protein, 23 aa, Staphylococcus aureus
IPKGRGIVKWNAFKTIPQQYEIL

SEQ ID NO: 1677172 - protein, 17 aa, Staphylococcus aureus
IRIPRVFRRDHAPVESL

SEQ ID NO: 1677173 - protein, 21 aa, Staphylococcus aureus
ISGMIPVEWEKVYTIAYVNDR

SEQ ID NO: 1677174 - protein, 25 aa, Staphylococcus aureus
KAEFIKRLACLPSHIYRLKGFMTFE

SEQ ID NO: 1677175 - protein, 23 aa, Staphylococcus aureus
KDEFCPLRKLILNNKLDSQRVME

SEQ ID NO: 1677176 - protein, 17 aa, Staphylococcus aureus
KDVFPWRQHDVRLVFFL

SEQ ID NO: 1677177 - protein, 18 aa, Staphylococcus aureus
KEFRKLGVEYEMAKLKND

SEQ ID NO: 1677178 - protein, 19 aa, Staphylococcus aureus
KEMLEELGFDFSNSHNPYS

SEQ ID NO: 1677179 - protein, 18 aa, Staphylococcus aureus
KGHGIGMLEWALDYIVGN

SEQ ID NO: 1677180 - protein, 17 aa, Staphylococcus aureus
KILPRLCKYFLGIFSEE

SEQ ID NO: 1677181 - protein, 18 aa, Staphylococcus aureus
KKGIKRKVIETHDDVKQV

SEQ ID NO: 1677182 - protein, 19 aa, Staphylococcus aureus
KMYGGTCINIGCIASKTLV

SEQ ID NO: 1677183 - protein, 18 aa, Staphylococcus aureus
KPKLEMWIDVLSQNGDYQ

SEQ ID NO: 1677184 - protein, 18 aa, Staphylococcus aureus
KPLRRLWISSVTKKAIQQ

SEQ ID NO: 1677185 - protein, 17 aa, Staphylococcus aureus
KPPFFIQWEESDSMRTK

SEQ ID NO: 1677186 - protein, 22 aa, Staphylococcus aureus
KQWKPSYIDRGFLFTTSKGNPL

SEQ ID NO: 1677187 - protein, 21 aa, Staphylococcus aureus
KRTRSSLALFIMICTGCRVSG

SEQ ID NO: 1677188 - protein, 24 aa, Staphylococcus aureus
KSLAIKFDIEYVLKECNRIEKEAL

SEQ ID NO: 1677189 - protein, 20 aa, Staphylococcus aureus
KSLFKDEVMQYFLSNRKIYP

SEQ ID NO: 1677190 - protein, 17 aa, Staphylococcus aureus
KTYHIGWSKNIYETALM

SEQ ID NO: 1677191 - protein, 18 aa, Staphylococcus aureus
KVALFKEWKTQKGIAKYL

SEQ ID NO: 1677192 - protein, 20 aa, Staphylococcus aureus
KVDVSNCIFILTSNFNSIEE

SEQ ID NO: 1677193 - protein, 18 aa, Staphylococcus aureus
KYFYRFSLKARKRVKTVS

SEQ ID NO: 1677194 - protein, 19 aa, Staphylococcus aureus
LAELSGYWAYQDLDKRYVI

SEQ ID NO: 1677195 - protein, 19 aa, Staphylococcus aureus
LAFCKALLIRLKDFYHEID

SEQ ID NO: 1677196 - protein, 20 aa, Staphylococcus aureus
LEPWTSCEFDFTREGKLKVS

SEQ ID NO: 1677197 - protein, 19 aa, Staphylococcus aureus
LETSLKINNEWLATVENIS

SEQ ID NO: 1677198 - protein, 18 aa, Staphylococcus aureus
LHQFPIDNLFPIMGQTVT

SEQ ID NO: 1677199 - protein, 18 aa, Staphylococcus aureus
LKAQRINPEVKKNALEAI

SEQ ID NO: 1677200 - protein, 19 aa, Staphylococcus aureus
LKINNEWLATVENISFELS

SEQ ID NO: 1677201 - protein, 19 aa, Staphylococcus aureus
LMFEEGYRALLPNPLGQTV

SEQ ID NO: 1677202 - protein, 19 aa, Staphylococcus aureus
LNVGEAWLMGYDVDSYRVP

SEQ ID NO: 1677203 - protein, 17 aa, Staphylococcus aureus
LPDLKGFGRRNIDISNE

SEQ ID NO: 1677204 - protein, 20 aa, Staphylococcus aureus
LPEKLLCAWLNSIRFLRNRI

SEQ ID NO: 1677205 - protein, 19 aa, Staphylococcus aureus
LPEYMIPRKFEWMEQLPLT

SEQ ID NO: 1677206 - protein, 18 aa, Staphylococcus aureus
LPFPIKINQMLGYQTSFL

SEQ ID NO: 1677207 - protein, 17 aa, Staphylococcus aureus
LPRLCKYFLGIFSEEKL

SEQ ID NO: 1677208 - protein, 18 aa, Staphylococcus aureus
LRKAYLESFRKGFKQQIE

SEQ ID NO: 1677209 - protein, 18 aa, Staphylococcus aureus
MGNHSWKAIEIIYETYVH

SEQ ID NO: 1677210 - protein, 17 aa, Staphylococcus aureus
MIEHFGINQEETLVIGD

SEQ ID NO: 1677211 - protein, 18 aa, Staphylococcus aureus
MIEHFGINQKETLVIGDS

SEQ ID NO: 1677212 - protein, 22 aa, Staphylococcus aureus
MIPRKFEWMEQLPLTSNGKIDR

SEQ ID NO: 1677213 - protein, 17 aa, Staphylococcus aureus
MPLKGYVVRGGREMENH

SEQ ID NO: 1677214 - protein, 18 aa, Staphylococcus aureus
MQQEVPYPFFVIKMPESN

SEQ ID NO: 1677215 - protein, 18 aa, Staphylococcus aureus
MQRLGRAFALLQVTGEVL

SEQ ID NO: 1677216 - protein, 21 aa, Staphylococcus aureus
MRRYLMRFVHHIGGLADFSAL

SEQ ID NO: 1677217 - protein, 17 aa, Staphylococcus aureus
NDVDGRVGVATMLMHES

SEQ ID NO: 1677218 - protein, 24 aa, Staphylococcus aureus
NEICQEWLYHLGVPTDKIEDLAKH

SEQ ID NO: 1677219 - protein, 17 aa, Staphylococcus aureus
NIKCLRHSRFIFLSPEF

SEQ ID NO: 1677220 - protein, 23 aa, Staphylococcus aureus
NIKKYNIIPAWVLFQNFSFGDLS

SEQ ID NO: 1677221 - protein, 19 aa, Staphylococcus aureus
NLNKVCHVHGIKALNVNDL

SEQ ID NO: 1677222 - protein, 18 aa, Staphylococcus aureus
NNNRVCIPFRTNAQKVPN

SEQ ID NO: 1677223 - protein, 17 aa, Staphylococcus aureus
NQLKPLPFISGYVGTCS

SEQ ID NO: 1677224 - protein, 23 aa, Staphylococcus aureus
NVIPNRFIYKIALVGKDEKKYKD

SEQ ID NO: 1677225 - protein, 18 aa, Staphylococcus aureus
NYGTLGLAFIKQYESKKD

SEQ ID NO: 1677226 - protein, 24 aa, Staphylococcus aureus
NYYYRYGQIMGICYLLNASDIHFE

SEQ ID NO: 1677227 - protein, 17 aa, Staphylococcus aureus
PHQRYAIDLVIKENHKT

SEQ ID NO: 1677228 - protein, 19 aa, Staphylococcus aureus
PLAEISVKVFNEFNISERE

SEQ ID NO: 1677229 - protein, 17 aa, Staphylococcus aureus
PMIRKGPNIKLPSVSLL

SEQ ID NO: 1677230 - protein, 24 aa, Staphylococcus aureus
PNFIFKRYWGFVTWGNAKDMANYR

SEQ ID NO: 1677231 - protein, 18 aa, Staphylococcus aureus
PSVREIGEAVGLASSSTV

SEQ ID NO: 1677232 - protein, 20 aa, Staphylococcus aureus
QINGGDKWILYGLNGAGKTT

SEQ ID NO: 1677233 - protein, 18 aa, Staphylococcus aureus
QRKIDVEPAFGFMKAILG

SEQ ID NO: 1677234 - protein, 24 aa, Staphylococcus aureus
RFYEHGALDYKRLFGAIGKNLTGG

SEQ ID NO: 1677235 - protein, 20 aa, Staphylococcus aureus
RHRFGEGIGRQYGFGINLIS

SEQ ID NO: 1677236 - protein, 17 aa, Staphylococcus aureus
RIAKVYAELGVKKIRIT

SEQ ID NO: 1677237 - protein, 19 aa, Staphylococcus aureus
RKGHVIGMLEWALDYIVGN

SEQ ID NO: 1677238 - protein, 24 aa, Staphylococcus aureus
RLSKDLYNLPSYRLQDLAEHFDIK

SEQ ID NO: 1677239 - protein, 26 aa, Staphylococcus aureus
RPVQCVFLSWNRYLYRNAQNYITSSD

SEQ ID NO: 1677240 - protein, 22 aa, Staphylococcus aureus
RQHDVRLVFFLAISQKDTAFTK

SEQ ID NO: 1677241 - protein, 18 aa, Staphylococcus aureus
RRVCDCKGQWTMENFIEI

SEQ ID NO: 1677242 - protein, 18 aa, Staphylococcus aureus
RSSICSIALLKFQDNKMR

SEQ ID NO: 1677243 - protein, 18 aa, Staphylococcus aureus
RTMDIFRLLGVEIKEDDE

SEQ ID NO: 1677244 - protein, 18 aa, Staphylococcus aureus
SEEIKYYLAEAIKAEKAG

SEQ ID NO: 1677245 - protein, 19 aa, Staphylococcus aureus
SEHLWRVEIELKRDMVDYW

SEQ ID NO: 1677246 - protein, 17 aa, Staphylococcus aureus
SEVPSAIFGTMKPKKLE

SEQ ID NO: 1677247 - protein, 19 aa, Staphylococcus aureus
SFMEMCLLLPTLNEEQYGS

SEQ ID NO: 1677248 - protein, 17 aa, Staphylococcus aureus
SGSLLLRVGKETQVYRY

SEQ ID NO: 1677249 - protein, 18 aa, Staphylococcus aureus
SHIYRLKGFMTFEDTTHT

SEQ ID NO: 1677250 - protein, 20 aa, Staphylococcus aureus
SIVGNLVYRNNFYNEVYTQP

SEQ ID NO: 1677251 - protein, 19 aa, Staphylococcus aureus
SLDQFILLIFYGTFPGGDF

SEQ ID NO: 1677252 - protein, 18 aa, Staphylococcus aureus
SMIPVEWEKVYTMAYIDD

SEQ ID NO: 1677253 - protein, 24 aa, Staphylococcus aureus
SNFWIYWKTMFAFEPWHSAMEMRR

SEQ ID NO: 1677254 - protein, 17 aa, Staphylococcus aureus
SYLKRYSLSAIFGITSD

SEQ ID NO: 1677255 - protein, 21 aa, Staphylococcus aureus
THIKSRISYYFSEKYREPHSY

SEQ ID NO: 1677256 - protein, 17 aa, Staphylococcus aureus
TRTLFLLLLGFKNSKIN

SEQ ID NO: 1677257 - protein, 18 aa, Staphylococcus aureus
VACPGFVPLVEQMRYSDP

SEQ ID NO: 1677258 - protein, 20 aa, Staphylococcus aureus
VCSCCGQQLLAEQVNEAREK

SEQ ID NO: 1677259 - protein, 18 aa, Staphylococcus aureus
VCYMWLRFNMDQQFEDTA

SEQ ID NO: 1677260 - protein, 24 aa, Staphylococcus aureus
VINMFSFFIGYHFNKLDLGIERIF

SEQ ID NO: 1677261 - protein, 36 aa, Staphylococcus aureus
VKEGKAKINAVKTFSEYKKDALAKIEDAYNAKVNEA

SEQ ID NO: 1677262 - protein, 17 aa, Staphylococcus aureus
VLEELGFDFSNSYNPNS

SEQ ID NO: 1677263 - protein, 23 aa, Staphylococcus aureus
VPGSTLPSVIGWRTLDDTEQMMN

SEQ ID NO: 1677264 - protein, 19 aa, Staphylococcus aureus
VTHLRALLQLRDVAQDNDA

SEQ ID NO: 1677265 - protein, 19 aa, Staphylococcus aureus
WCQKFNIALTIKKKQGIIV

SEQ ID NO: 1677266 - protein, 23 aa, Staphylococcus aureus
YAIKKEIIEELGFDFSISHNPYT

SEQ ID NO: 1677267 - protein, 20 aa, Staphylococcus aureus
YDKLRFEAIFTELRNRDITF

SEQ ID NO: 1677268 - protein, 21 aa, Staphylococcus aureus
YKGILRVGAATGFVVGKNTIL

SEQ ID NO: 1677269 - protein, 18 aa, Staphylococcus aureus
YKLAFAIRDAAATKNVGT

SEQ ID NO: 1677270 - protein, 20 aa, Staphylococcus aureus
YLIEGSNFTTGWIFFINSVG

SEQ ID NO: 1677271 - protein, 19 aa, Staphylococcus aureus
YRKQFCKLLLKSAKVSVIK

SEQ ID NO: 1677272 - protein, 17 aa, Staphylococcus aureus
YRLKGFMTFEDTTHTYL

SEQ ID NO: 1677273 - protein, 20 aa, Staphylococcus aureus
YTCEKFKLLVLQGNVLGVQI

SEQ ID NO: 1677274 - protein, 18 aa, Staphylococcus aureus
YVKLGVNVGREFSGNHFC

SEQ ID NO: 1677275 - protein, 17 aa, Staphylococcus aureus
YYATRFMLTVPFENIDV

SEQ ID NO: 1677276 - protein, 23 aa, Staphylococcus aureus
YYTCEKFKLLVLQGNVLGVQIIT

SEQ ID NO: 1677277 - protein, 18 aa, Staphylococcus aureus
ADALGVNVSELFTRNHNT

SEQ ID NO: 1677278 - protein, 18 aa, Staphylococcus aureus
AGYVRCKLFLEKEEEKIH

SEQ ID NO: 1677279 - protein, 23 aa, Staphylococcus aureus
AHGEIRLDINFALYGNGSNTISD

SEQ ID NO: 1677280 - protein, 18 aa, Staphylococcus aureus
AIQTRIATQTQIATQIQT

SEQ ID NO: 1677281 - protein, 19 aa, Staphylococcus aureus
AKRFKRWVTSDVLPAIRKH

SEQ ID NO: 1677282 - protein, 19 aa, Staphylococcus aureus
AKRFKRWVTSDVLPAIRKY

SEQ ID NO: 1677283 - protein, 17 aa, Staphylococcus aureus
AKVPNHFNFNRLVIDHD

SEQ ID NO: 1677284 - protein, 33 aa, Staphylococcus aureus
ALEQLKAQRINPVVKKNALEAIREVVNKQIEII

SEQ ID NO: 1677285 - protein, 17 aa, Staphylococcus aureus
ALQAWDIDHLYGIPGDS

SEQ ID NO: 1677286 - protein, 18 aa, Staphylococcus aureus
ALQAWDIDHLYGIPGDSI

SEQ ID NO: 1677287 - protein, 18 aa, Staphylococcus aureus
ALTSYLGFGNYELRLPLI

SEQ ID NO: 1677288 - protein, 19 aa, Staphylococcus aureus
ALWGARAAYIGGFDSTSNV

SEQ ID NO: 1677289 - protein, 19 aa, Staphylococcus aureus
APNNKFTMYRVFGSKKTEL

SEQ ID NO: 1677290 - protein, 18 aa, Staphylococcus aureus
ARGAIFGLSRGTEKEHFI

SEQ ID NO: 1677291 - protein, 17 aa, Staphylococcus aureus
AYAKFYGLLPEQIIAGN

SEQ ID NO: 1677292 - protein, 17 aa, Staphylococcus aureus
CNFYPERIILLGHGENS

SEQ ID NO: 1677293 - protein, 23 aa, Staphylococcus aureus
DDYKAGQIIGEWIGQQGYQQIEV

SEQ ID NO: 1677294 - protein, 17 aa, Staphylococcus aureus
DFWECATAYLGKSAPKR

SEQ ID NO: 1677295 - protein, 24 aa, Staphylococcus aureus
DGKKRYYNFFGIGAFDSSAVRSGK

SEQ ID NO: 1677296 - protein, 17 aa, Staphylococcus aureus
DIRAVLGRFLFVQDDVK

SEQ ID NO: 1677297 - protein, 21 aa, Staphylococcus aureus
DYKNIPCNLWIDGHQAEIELT

SEQ ID NO: 1677298 - protein, 19 aa, Staphylococcus aureus
EAAMLAGYFSKAGNSGQIP

SEQ ID NO: 1677299 - protein, 17 aa, Staphylococcus aureus
EEFKFFVQYGNFKELEN

SEQ ID NO: 1677300 - protein, 22 aa, Staphylococcus aureus
EFETRAGTLLRYYTGLLESSRE

SEQ ID NO: 1677301 - protein, 21 aa, Staphylococcus aureus
EFRNYILGLIFYCFLSEKAEQ

SEQ ID NO: 1677302 - protein, 17 aa, Staphylococcus aureus
EGELCFGNEPLLRVEAP

SEQ ID NO: 1677303 - protein, 18 aa, Staphylococcus aureus
EIHYFFGPEMVNVKRGGL

SEQ ID NO: 1677304 - protein, 19 aa, Staphylococcus aureus
EIPHAIGVNVDRMVKESED

SEQ ID NO: 1677305 - protein, 27 aa, Staphylococcus aureus
EIPQELKLVPNWVLWRAEWNEKQQNFG

SEQ ID NO: 1677306 - protein, 19 aa, Staphylococcus aureus
EISEQFGFVNIGVKNYEAD

SEQ ID NO: 1677307 - protein, 18 aa, Staphylococcus aureus
EIYYSWAFHEIASAVTDE

SEQ ID NO: 1677308 - protein, 18 aa, Staphylococcus aureus
EKGYSCALLTLDDKNYDP

SEQ ID NO: 1677309 - protein, 20 aa, Staphylococcus aureus
EKQALKDRINQILQQGHNGI

SEQ ID NO: 1677310 - protein, 19 aa, Staphylococcus aureus
EKYEVLKDLTLIIEDYTME

SEQ ID NO: 1677311 - protein, 17 aa, Staphylococcus aureus
ENFKFFVQYGNFKDIND

SEQ ID NO: 1677312 - protein, 18 aa, Staphylococcus aureus
FEALRAWLYDEIVADSWL

SEQ ID NO: 1677313 - protein, 25 aa, Staphylococcus aureus
FFRPEFLNRFNGIVEFLHLDKESLQ

SEQ ID NO: 1677314 - protein, 25 aa, Staphylococcus aureus
FKEKRTFSKFEAWIYLLMEANHSEA

SEQ ID NO: 1677315 - protein, 17 aa, Staphylococcus aureus
FMLKVFLDLNFVTQEDG

SEQ ID NO: 1677316 - protein, 25 aa, Staphylococcus aureus
FNNPLFLKLMCEYCVNKFKEFDQTI

SEQ ID NO: 1677317 - protein, 23 aa, Staphylococcus aureus
FPGVKGEVLVNAFSKYDIMISTT

SEQ ID NO: 1677318 - protein, 22 aa, Staphylococcus aureus
FQHFNLLWSRTVLKNIMFPLEI

SEQ ID NO: 1677319 - protein, 17 aa, Staphylococcus aureus
FSYLACRQYFSEKETTF

SEQ ID NO: 1677320 - protein, 20 aa, Staphylococcus aureus
FTEGSFKQWGYDLALSEFGD

SEQ ID NO: 1677321 - protein, 17 aa, Staphylococcus aureus
FYQRPASIIAIYSAKYN

SEQ ID NO: 1677322 - protein, 20 aa, Staphylococcus aureus
GEPCNECHICKGITQGTNSD

SEQ ID NO: 1677323 - protein, 17 aa, Staphylococcus aureus
GGFFEEIERTFKEISEE

SEQ ID NO: 1677324 - protein, 18 aa, Staphylococcus aureus
GGFKGRKLLANDVITVKI

SEQ ID NO: 1677325 - protein, 18 aa, Staphylococcus aureus
GHQWKDWKPLLSDILLYF

SEQ ID NO: 1677326 - protein, 20 aa, Staphylococcus aureus
GHSMLYLSSIMDIYNGEIVA

SEQ ID NO: 1677327 - protein, 19 aa, Staphylococcus aureus
GIAGLRLGVLISTAGTIQR

SEQ ID NO: 1677328 - protein, 20 aa, Staphylococcus aureus
GKLGLCYIGLRLLNPKTIDS

SEQ ID NO: 1677329 - protein, 17 aa, Staphylococcus aureus
GKLYGHVYIKDCKVRQS

SEQ ID NO: 1677330 - protein, 18 aa, Staphylococcus aureus
GKTAQAMFIYELRGDGNI

SEQ ID NO: 1677331 - protein, 18 aa, Staphylococcus aureus
GMIPVEWEKVYTIAYLDD

SEQ ID NO: 1677332 - protein, 21 aa, Staphylococcus aureus
GNYELRLPLITLEDTDTKVLR

SEQ ID NO: 1677333 - protein, 18 aa, Staphylococcus aureus
GPAALRCSQFVYKEQKNQ

SEQ ID NO: 1677334 - protein, 17 aa, Staphylococcus aureus
GRLFICYLGDFKSTGGI

SEQ ID NO: 1677335 - protein, 27 aa, Staphylococcus aureus
GRPVQCVFLSWNRYLYRNAQNYITSSD

SEQ ID NO: 1677336 - protein, 17 aa, Staphylococcus aureus
GTFSYLACRQYFSENEA

SEQ ID NO: 1677337 - protein, 18 aa, Staphylococcus aureus
HGGFLNEDFRLFSTNNQS

SEQ ID NO: 1677338 - protein, 19 aa, Staphylococcus aureus
HGGYLIKVLNNWAKENVKT

SEQ ID NO: 1677339 - protein, 19 aa, Staphylococcus aureus
HPDPHIIGLVALPYLNASR

SEQ ID NO: 1677340 - protein, 18 aa, Staphylococcus aureus
HQVFLNWFGQDPAFDYFK

SEQ ID NO: 1677341 - protein, 17 aa, Staphylococcus aureus
HTYKMKFIKSFEAIDLH

SEQ ID NO: 1677342 - protein, 17 aa, Staphylococcus aureus
IADWDIKLEHTFYVSKF

SEQ ID NO: 1677343 - protein, 17 aa, Staphylococcus aureus
IANRLGFDWNYKHPSEI

SEQ ID NO: 1677344 - protein, 20 aa, Staphylococcus aureus
IAPRKVRLVLDLIRGKNAAE

SEQ ID NO: 1677345 - protein, 19 aa, Staphylococcus aureus
IDKLICSWLKQIDNVIPQL

SEQ ID NO: 1677346 - protein, 18 aa, Staphylococcus aureus
IEMYKLKKLLGLADNKED

SEQ ID NO: 1677347 - protein, 17 aa, Staphylococcus aureus
IEVVYGFAQLKRAAAIA

SEQ ID NO: 1677348 - protein, 19 aa, Staphylococcus aureus
IKKAGLKYGFSLEEKAVTP

SEQ ID NO: 1677349 - protein, 20 aa, Staphylococcus aureus
ILCIEMRSDIPLARGLGSSA

SEQ ID NO: 1677350 - protein, 17 aa, Staphylococcus aureus
ILYELGLGKYIVGVSTV

SEQ ID NO: 1677351 - protein, 22 aa, Staphylococcus aureus
IMRKRLDMLASFIESKVPDVEI

SEQ ID NO: 1677352 - protein, 17 aa, Staphylococcus aureus
INLMFSKVGVPRGRGKI

SEQ ID NO: 1677353 - protein, 24 aa, Staphylococcus aureus
INPEVKKNALEAIREVVNKQIEII

SEQ ID NO: 1677354 - protein, 22 aa, Staphylococcus aureus
IPELQGRFPIRVELDSLAVEDF

SEQ ID NO: 1677355 - protein, 21 aa, Staphylococcus aureus
IRAGSIYGVIGFSGAGKSTLI

SEQ ID NO: 1677356 - protein, 19 aa, Staphylococcus aureus
ISKAIATIGHFDLLTINDA

SEQ ID NO: 1677357 - protein, 17 aa, Staphylococcus aureus
ISLHYTRQMVNQAISGK

SEQ ID NO: 1677358 - protein, 18 aa, Staphylococcus aureus
ISMGLVFSIMDGVRYLKD

SEQ ID NO: 1677359 - protein, 21 aa, Staphylococcus aureus
ISSMIPVEWEKVYAMAYIDDE

SEQ ID NO: 1677360 - protein, 19 aa, Staphylococcus aureus
ISYDDAIEFLKSEGFDDIE

SEQ ID NO: 1677361 - protein, 19 aa, Staphylococcus aureus
KAAHIDTSYIIKSTEAKTG

SEQ ID NO: 1677362 - protein, 18 aa, Staphylococcus aureus
KCIPCKEGRPALCENGAI

SEQ ID NO: 1677363 - protein, 19 aa, Staphylococcus aureus
KCIVFGCYENEALIATAAL

SEQ ID NO: 1677364 - protein, 19 aa, Staphylococcus aureus
KDDKAYKCSFYNPETTNTA

SEQ ID NO: 1677365 - protein, 17 aa, Staphylococcus aureus
KDGKLGFYVQKTQKERG

SEQ ID NO: 1677366 - protein, 24 aa, Staphylococcus aureus
KDIAFEFASWISAEFKLYIIQDYQ

SEQ ID NO: 1677367 - protein, 19 aa, Staphylococcus aureus
KDRPVVFKLQAMDTMTSFW

SEQ ID NO: 1677368 - protein, 21 aa, Staphylococcus aureus
KESPEILAFIKSFKKYIANEQ

SEQ ID NO: 1677369 - protein, 20 aa, Staphylococcus aureus
KFKEAMFLKGFNLSDLSRET

SEQ ID NO: 1677370 - protein, 18 aa, Staphylococcus aureus
KGNHIYNGLDMFVYQGAE

SEQ ID NO: 1677371 - protein, 20 aa, Staphylococcus aureus
KIPDEFVVGYGLDYRELYRN

SEQ ID NO: 1677372 - protein, 17 aa, Staphylococcus aureus
KIVLRWLKEQDIQVELL

SEQ ID NO: 1677373 - protein, 17 aa, Staphylococcus aureus
KIYTCLVYGKTHTSGII

SEQ ID NO: 1677374 - protein, 18 aa, Staphylococcus aureus
KKEVISFTKLIKGTDKEA

SEQ ID NO: 1677375 - protein, 19 aa, Staphylococcus aureus
KKGYCLLVGIGQNSTEQDA

SEQ ID NO: 1677376 - protein, 19 aa, Staphylococcus aureus
KKKYIAFKMEITAKKDDKD

SEQ ID NO: 1677377 - protein, 22 aa, Staphylococcus aureus
KKLALEILNLVGLPNAEKRFKA

SEQ ID NO: 1677378 - protein, 20 aa, Staphylococcus aureus
KKQVPVCCFTFGIPSESIIK

SEQ ID NO: 1677379 - protein, 20 aa, Staphylococcus aureus
KKQVPVCCFTFGIQNESIIE

SEQ ID NO: 1677380 - protein, 19 aa, Staphylococcus aureus
KLANEWNIGNSLLYNEIGF

SEQ ID NO: 1677381 - protein, 19 aa, Staphylococcus aureus
KLKTYRMVFNTISVEKMNA

SEQ ID NO: 1677382 - protein, 24 aa, Staphylococcus aureus
KLPESVLRLKGYVSFRDQPNAIYE

SEQ ID NO: 1677383 - protein, 23 aa, Staphylococcus aureus
KLRDLYKRFGFRELTDYRTQNNL

SEQ ID NO: 1677384 - protein, 21 aa, Staphylococcus aureus
KPARIKLKWTPQIMHQIRVLR

SEQ ID NO: 1677385 - protein, 22 aa, Staphylococcus aureus
KQKEAKFENGVITRKADEKTTN

SEQ ID NO: 1677386 - protein, 20 aa, Staphylococcus aureus
KRALEILNLVGLPNAEKRFK

SEQ ID NO: 1677387 - protein, 20 aa, Staphylococcus aureus
KRGELITGDFDKLIYGIPQL

SEQ ID NO: 1677388 - protein, 30 aa, Staphylococcus aureus
KSRVEKSIADWGIKLERTFYVSKFDHPENE

SEQ ID NO: 1677389 - protein, 23 aa, Staphylococcus aureus
KVKHLRKSPCYNFELEVIAKNEN

SEQ ID NO: 1677390 - protein, 17 aa, Staphylococcus aureus
KVLRFAVEEAKKGTSLR

SEQ ID NO: 1677391 - protein, 17 aa, Staphylococcus aureus
KVRNEIMETFALNHHQV

SEQ ID NO: 1677392 - protein, 18 aa, Staphylococcus aureus
KYARGVAVYGDIKDGAND

SEQ ID NO: 1677393 - protein, 22 aa, Staphylococcus aureus
LDFPLPKAFRDAGWFFDVLPGH

SEQ ID NO: 1677394 - protein, 17 aa, Staphylococcus aureus
LEQEYAWAFLNELFYLI

SEQ ID NO: 1677395 - protein, 18 aa, Staphylococcus aureus
LFLDKGMIYGLKFHEFPF

SEQ ID NO: 1677396 - protein, 19 aa, Staphylococcus aureus
LKDGFPFGSILLYEYENDN

SEQ ID NO: 1677397 - protein, 18 aa, Staphylococcus aureus
LKDYETWRTYMLAQETFT

SEQ ID NO: 1677398 - protein, 17 aa, Staphylococcus aureus
LKIAELYKGASESTKAE

SEQ ID NO: 1677399 - protein, 19 aa, Staphylococcus aureus
LKQYGFKFLGPVTVFSFLE

SEQ ID NO: 1677400 - protein, 17 aa, Staphylococcus aureus
LNGTVLWLGESDELYHP

SEQ ID NO: 1677401 - protein, 22 aa, Staphylococcus aureus
LNHGVPSYGYRVMAPETTGTIN

SEQ ID NO: 1677402 - protein, 17 aa, Staphylococcus aureus
LNHLRENIKLFVVIGQL

SEQ ID NO: 1677403 - protein, 17 aa, Staphylococcus aureus
LNQFYALYDYKGYNDYH

SEQ ID NO: 1677404 - protein, 22 aa, Staphylococcus aureus
LPMNRLRFTLAHEYGHFVMGHT

SEQ ID NO: 1677405 - protein, 23 aa, Staphylococcus aureus
LQPWDFAGGLVILNEVDGQASNL

SEQ ID NO: 1677406 - protein, 18 aa, Staphylococcus aureus
LQRPILYTGLTRAKTSLV

SEQ ID NO: 1677407 - protein, 17 aa, Staphylococcus aureus
LREEFNKRLNLIHQKLN

SEQ ID NO: 1677408 - protein, 18 aa, Staphylococcus aureus
LRLLARAVFVLDADNKVV

SEQ ID NO: 1677409 - protein, 21 aa, Staphylococcus aureus
LRRYKEALIFMGRKNGKTTTI

SEQ ID NO: 1677410 - protein, 22 aa, Staphylococcus aureus
LSNDAKMAWGILRDRLDLSIKN

SEQ ID NO: 1677411 - protein, 23 aa, Staphylococcus aureus
LTKGRLQKDLINWFIDDQYKLFY

SEQ ID NO: 1677412 - protein, 23 aa, Staphylococcus aureus
LTTGFCLWCQLAFSTYLENAAQP

SEQ ID NO: 1677413 - protein, 18 aa, Staphylococcus aureus
LVEGLKLVTEFVQDENAT

SEQ ID NO: 1677414 - protein, 17 aa, Staphylococcus aureus
LYVERGFEIPSFNYVLK

SEQ ID NO: 1677415 - protein, 17 aa, Staphylococcus aureus
MADQIFLNKQRVLDKVK

SEQ ID NO: 1677416 - protein, 17 aa, Staphylococcus aureus
MDGRIPINVWTGDSIAR

SEQ ID NO: 1677417 - protein, 20 aa, Staphylococcus aureus
MSHVKHIGKLVLRASDVIEH

SEQ ID NO: 1677418 - protein, 17 aa, Staphylococcus aureus
NANRYTFVWKKSIPNHE

SEQ ID NO: 1677419 - protein, 24 aa, Staphylococcus aureus
NCKQLRQVYPNGVTADHPAYRPHL

SEQ ID NO: 1677420 - protein, 19 aa, Staphylococcus aureus
NDFPITWFYPLGEKKVERK

SEQ ID NO: 1677421 - protein, 20 aa, Staphylococcus aureus
NESYKLVGIVTSREMINTKD

SEQ ID NO: 1677422 - protein, 22 aa, Staphylococcus aureus
NGARLPVPVDFLLDEWPNIGAI

SEQ ID NO: 1677423 - protein, 17 aa, Staphylococcus aureus
NIEIALKLLKILLKELE

SEQ ID NO: 1677424 - protein, 18 aa, Staphylococcus aureus
NIEIALKLLKILLKELER

SEQ ID NO: 1677425 - protein, 18 aa, Staphylococcus aureus
NLENALKIELAFYFTPPE

SEQ ID NO: 1677426 - protein, 18 aa, Staphylococcus aureus
NLIAFLFFYFELFEDEKQ

SEQ ID NO: 1677427 - protein, 18 aa, Staphylococcus aureus
NLYALPFKERKIIKSEYY

SEQ ID NO: 1677428 - protein, 17 aa, Staphylococcus aureus
NRYEKRLNPAYFIRIHR

SEQ ID NO: 1677429 - protein, 18 aa, Staphylococcus aureus
NSTRAIHVLKHFDRIEDV

SEQ ID NO: 1677430 - protein, 18 aa, Staphylococcus aureus
NSYPEWQKQFPFWSERTI

SEQ ID NO: 1677431 - protein, 17 aa, Staphylococcus aureus
PELRFPGFEGEWEEKKL

SEQ ID NO: 1677432 - protein, 18 aa, Staphylococcus aureus
PHLAFKMADQIFLNKQRV

SEQ ID NO: 1677433 - protein, 18 aa, Staphylococcus aureus
PISRLLQWGADFVKPLAR

SEQ ID NO: 1677434 - protein, 19 aa, Staphylococcus aureus
PKFLKSFFNEHPFIDVSLH

SEQ ID NO: 1677435 - protein, 18 aa, Staphylococcus aureus
PLPREWRDAGWFLEVKPP

SEQ ID NO: 1677436 - protein, 19 aa, Staphylococcus aureus
PRETMIGSMAYYISHAKNN

SEQ ID NO: 1677437 - protein, 17 aa, Staphylococcus aureus
PRGSVKFTIKVVLTDPY

SEQ ID NO: 1677438 - protein, 17 aa, Staphylococcus aureus
PRISYDDAIEFLKSEGF

SEQ ID NO: 1677439 - protein, 17 aa, Staphylococcus aureus
PVNCINILPEHHKYIDW

SEQ ID NO: 1677440 - protein, 17 aa, Staphylococcus aureus
PWLRRLGFENVKEVLLN

SEQ ID NO: 1677441 - protein, 23 aa, Staphylococcus aureus
PYSSNLFLPFALANNYYTIDQLI

SEQ ID NO: 1677442 - protein, 20 aa, Staphylococcus aureus
QGFGRTGTWSSVSHFNFTPD

SEQ ID NO: 1677443 - protein, 20 aa, Staphylococcus aureus
QGRGKIKWQAFATLPQQFEI

SEQ ID NO: 1677444 - protein, 23 aa, Staphylococcus aureus
QPILKEKFIALGLDVKEDQAAKH

SEQ ID NO: 1677445 - protein, 18 aa, Staphylococcus aureus
QSAAYLNIFSFLWDEITK

SEQ ID NO: 1677446 - protein, 22 aa, Staphylococcus aureus
QSQFNLPTRYIWGIYEPQSDDQ

SEQ ID NO: 1677447 - protein, 19 aa, Staphylococcus aureus
QTLDHAMELLRNSVADNQT

SEQ ID NO: 1677448 - protein, 23 aa, Staphylococcus aureus
QTQLKFVLIYTIHIKKLTKLSIK

SEQ ID NO: 1677449 - protein, 24 aa, Staphylococcus aureus
RDKTWSVHVARRIKEIGPRIKKVS

SEQ ID NO: 1677450 - protein, 18 aa, Staphylococcus aureus
RDLAEVIAMKCVGATTVA

SEQ ID NO: 1677451 - protein, 17 aa, Staphylococcus aureus
RDLKRFKGAHGLLYEQE

SEQ ID NO: 1677452 - protein, 25 aa, Staphylococcus aureus
RFYEHGALDYKRLFGAIGKNLTGGF

SEQ ID NO: 1677453 - protein, 18 aa, Staphylococcus aureus
RGTAILITGGFKPSNKVI

SEQ ID NO: 1677454 - protein, 21 aa, Staphylococcus aureus
RIKQNYSYRCAITGIKTKDFL

SEQ ID NO: 1677455 - protein, 20 aa, Staphylococcus aureus
RKSLAWEYISTLNLEDEAEF

SEQ ID NO: 1677456 - protein, 18 aa, Staphylococcus aureus
RLKLLVALSNNLDKAEIK

SEQ ID NO: 1677457 - protein, 18 aa, Staphylococcus aureus
RLLSTRLDQVFSEIERIT

SEQ ID NO: 1677458 - protein, 18 aa, Staphylococcus aureus
RMIIKQLYFFSVANPNPK

SEQ ID NO: 1677459 - protein, 17 aa, Staphylococcus aureus
RMLQRPILYTGLTRAKT

SEQ ID NO: 1677460 - protein, 20 aa, Staphylococcus aureus
RPLIKRYAIQFIHHQTKLHY

SEQ ID NO: 1677461 - protein, 24 aa, Staphylococcus aureus
SDLQLIRRSVCEFINGHSLIDTSI

SEQ ID NO: 1677462 - protein, 23 aa, Staphylococcus aureus
SEGRTRASIILTFVADLRNYIDN

SEQ ID NO: 1677463 - protein, 18 aa, Staphylococcus aureus
SELARPLLSAALSKDNEV

SEQ ID NO: 1677464 - protein, 22 aa, Staphylococcus aureus
SFTKFKSCLKKHSFEQIMQGTR

SEQ ID NO: 1677465 - protein, 24 aa, Staphylococcus aureus
SGQIAMGFTEFFGARYDESTLEND

SEQ ID NO: 1677466 - protein, 18 aa, Staphylococcus aureus
SMGGRVALYYAINGHIPI

SEQ ID NO: 1677467 - protein, 17 aa, Staphylococcus aureus
SMIPVEWAKVYAMAYID

SEQ ID NO: 1677468 - protein, 17 aa, Staphylococcus aureus
SMIPVEWEKVYTMAYID

SEQ ID NO: 1677469 - protein, 18 aa, Staphylococcus aureus
SNFEGKVYLIGHSMGGYT

SEQ ID NO: 1677470 - protein, 18 aa, Staphylococcus aureus
SNLYRLLREISMESVKCI

SEQ ID NO: 1677471 - protein, 21 aa, Staphylococcus aureus
SYRKLTCLHVNHGVRSASIEE

SEQ ID NO: 1677472 - protein, 17 aa, Staphylococcus aureus
TDHWLPVTFTISKKETE

SEQ ID NO: 1677473 - protein, 18 aa, Staphylococcus aureus
TEILWKMHFGLYPTPIKR

SEQ ID NO: 1677474 - protein, 17 aa, Staphylococcus aureus
TELSSYWVYQNIDIKKE

SEQ ID NO: 1677475 - protein, 19 aa, Staphylococcus aureus
TETIYRFSLLVPNQAALHY

SEQ ID NO: 1677476 - protein, 21 aa, Staphylococcus aureus
TFKPELLSVLGRTHNTEDIYT

SEQ ID NO: 1677477 - protein, 17 aa, Staphylococcus aureus
TICIKSNMMFSGYVSEQ

SEQ ID NO: 1677478 - protein, 18 aa, Staphylococcus aureus
TKDYILSVGKEFLKKADT

SEQ ID NO: 1677479 - protein, 22 aa, Staphylococcus aureus
TKYKIGGTWYQFYKKVDEELTK

SEQ ID NO: 1677480 - protein, 17 aa, Staphylococcus aureus
TLIEYMDYLSLKDPKRI

SEQ ID NO: 1677481 - protein, 24 aa, Staphylococcus aureus
TLKETKGKIVLFNRMGGTYIKSGY

SEQ ID NO: 1677482 - protein, 21 aa, Staphylococcus aureus
TLNVGEAWLMGYDVNSYRVPD

SEQ ID NO: 1677483 - protein, 17 aa, Staphylococcus aureus
TLTLAFKLARLFDTTVD

SEQ ID NO: 1677484 - protein, 17 aa, Staphylococcus aureus
TRLNFYLIDLFRQQNQL

SEQ ID NO: 1677485 - protein, 17 aa, Staphylococcus aureus
TSLTISNDVYFDLGSRR

SEQ ID NO: 1677486 - protein, 17 aa, Staphylococcus aureus
TTFTIAVNRTFTNAQGE

SEQ ID NO: 1677487 - protein, 17 aa, Staphylococcus aureus
VALEQEYAWAFLNELFY

SEQ ID NO: 1677488 - protein, 17 aa, Staphylococcus aureus
VALFKEWKTQKGIVKYL

SEQ ID NO: 1677489 - protein, 20 aa, Staphylococcus aureus
VARELIELIIAFMFHHQIPM

SEQ ID NO: 1677490 - protein, 18 aa, Staphylococcus aureus
VATFTLAVNRTFTNAQGE

SEQ ID NO: 1677491 - protein, 19 aa, Staphylococcus aureus
VDFWECATAYLGKSAPKRE

SEQ ID NO: 1677492 - protein, 17 aa, Staphylococcus aureus
VINLSLPMTISFLEKLS

SEQ ID NO: 1677493 - protein, 24 aa, Staphylococcus aureus
VIVIRSVFKYAFKYYDLHDISVLD

SEQ ID NO: 1677494 - protein, 21 aa, Staphylococcus aureus
VKELLQCFDYLIKHKRHATRK

SEQ ID NO: 1677495 - protein, 19 aa, Staphylococcus aureus
VKTNARAELLTEMQNKITE

SEQ ID NO: 1677496 - protein, 18 aa, Staphylococcus aureus
VLKDLTLIIEDYTMEHGT

SEQ ID NO: 1677497 - protein, 17 aa, Staphylococcus aureus
VLVCTVIGFPLGASTTA

SEQ ID NO: 1677498 - protein, 19 aa, Staphylococcus aureus
VLVCTVIGFPLGASTTATK

SEQ ID NO: 1677499 - protein, 24 aa, Staphylococcus aureus
VNKFSYRMLLIYSIKTKNFNPLYE

SEQ ID NO: 1677500 - protein, 17 aa, Staphylococcus aureus
VNVSELFTRNHNTHKLE

SEQ ID NO: 1677501 - protein, 23 aa, Staphylococcus aureus
VSGGKRPLICFFSNDLNIHRTKT

SEQ ID NO: 1677502 - protein, 23 aa, Staphylococcus aureus
VSPSMRLGFEEFKNASGQIAMGF

SEQ ID NO: 1677503 - protein, 23 aa, Staphylococcus aureus
WQHFIIGSLFGWVHKETKLRRYK

SEQ ID NO: 1677504 - protein, 19 aa, Staphylococcus aureus
WQKQFPFWSERTIKRTFGS

SEQ ID NO: 1677505 - protein, 19 aa, Staphylococcus aureus
WTGKMAEAFVLAHELGHAG

SEQ ID NO: 1677506 - protein, 20 aa, Staphylococcus aureus
WTGKMAEAFVLAHELGHAGH

SEQ ID NO: 1677507 - protein, 22 aa, Staphylococcus aureus
YEKRLNPAYFIRIHRSYIINTK

SEQ ID NO: 1677508 - protein, 21 aa, Staphylococcus aureus
YHPDYEFLKSVGIQINTNEFG

SEQ ID NO: 1677509 - protein, 19 aa, Staphylococcus aureus
YKYARGVAVYGDIKDGAND

SEQ ID NO: 1677510 - protein, 19 aa, Staphylococcus aureus
YKYARGVAVYGDIKDNTND

SEQ ID NO: 1677511 - protein, 17 aa, Staphylococcus aureus
YRALMNLELDMLYQMID

SEQ ID NO: 1677512 - protein, 23 aa, Staphylococcus aureus
YRRAEINLSVILCRMDKLDGTNE

SEQ ID NO: 1677513 - protein, 17 aa, Staphylococcus aureus
YRYTLGYLFQNFALLEN

SEQ ID NO: 1677514 - protein, 21 aa, Staphylococcus aureus
YTAGQCTWYAYGMRQKMGKPV

SEQ ID NO: 1677515 - protein, 22 aa, Staphylococcus aureus
YTGLRIGVTVAKILAYALDVKL

SEQ ID NO: 1677516 - protein, 24 aa, Staphylococcus aureus
ADQAICIGEAYALDSYLNIDRIIS

SEQ ID NO: 1677517 - protein, 17 aa, Staphylococcus aureus
AEEPINFILKSSTKLKA

SEQ ID NO: 1677518 - protein, 17 aa, Staphylococcus aureus
AEIPFDMEKVIQKEITV

SEQ ID NO: 1677519 - protein, 19 aa, Staphylococcus aureus
AELRTGPNAAYPVIYKVEK

SEQ ID NO: 1677520 - protein, 17 aa, Staphylococcus aureus
AESRLDNIISMADQYLT

SEQ ID NO: 1677521 - protein, 18 aa, Staphylococcus aureus
AGYVRCKLFLEKEEQKIH

SEQ ID NO: 1677522 - protein, 18 aa, Staphylococcus aureus
AHSITAIWNFEKQNYYLK

SEQ ID NO: 1677523 - protein, 26 aa, Staphylococcus aureus
AILKRYNFISVLGWPTYYANLGYQRA

SEQ ID NO: 1677524 - protein, 23 aa, Staphylococcus aureus
AINKEMLEELGFDFSNSHNPYSD

SEQ ID NO: 1677525 - protein, 20 aa, Staphylococcus aureus
AIRLSCKGLQQFSHAKTKQI

SEQ ID NO: 1677526 - protein, 18 aa, Staphylococcus aureus
AIYKRDYLCILGQTVHDK

SEQ ID NO: 1677527 - protein, 19 aa, Staphylococcus aureus
AKAKDGASCVTYIGPNGAG

SEQ ID NO: 1677528 - protein, 23 aa, Staphylococcus aureus
AKGLELGCLFAFYGHTHVAKYEY

SEQ ID NO: 1677529 - protein, 31 aa, Staphylococcus aureus
AKLFPLDYTHIFPGECIWFDVLKRGNPSIEK

SEQ ID NO: 1677530 - protein, 19 aa, Staphylococcus aureus
AKLNPAICFTMLGHYLGVD

SEQ ID NO: 1677531 - protein, 17 aa, Staphylococcus aureus
AKPRLPFDHVFHHNKYH

SEQ ID NO: 1677532 - protein, 19 aa, Staphylococcus aureus
ALQAWDIYHLYGIPGDSID

SEQ ID NO: 1677533 - protein, 17 aa, Staphylococcus aureus
ALSNPFLSPARRDKLQK

SEQ ID NO: 1677534 - protein, 17 aa, Staphylococcus aureus
AMKALKESIKDQPQTEA

SEQ ID NO: 1677535 - protein, 18 aa, Staphylococcus aureus
ANANRYTFVWKKSIQNHE

SEQ ID NO: 1677536 - protein, 24 aa, Staphylococcus aureus
ANHFGGEMKKMWSGIKGIPSKLSS

SEQ ID NO: 1677537 - protein, 26 aa, Staphylococcus aureus
ANIEFPWLRLVVLRAFIDNIKKYHDI

SEQ ID NO: 1677538 - protein, 17 aa, Staphylococcus aureus
AQDGASCVTYIGPNGAG

SEQ ID NO: 1677539 - protein, 17 aa, Staphylococcus aureus
ARLSWLTILKKKEAYEE

SEQ ID NO: 1677540 - protein, 21 aa, Staphylococcus aureus
ASLLPKYRGGAPIHQAIIDGE

SEQ ID NO: 1677541 - protein, 26 aa, Staphylococcus aureus
ATAPLVVLGCIMMRVCHKDTCPVGVA

SEQ ID NO: 1677542 - protein, 23 aa, Staphylococcus aureus
AYLKVAYQFSLPFGKDYADAHEK

SEQ ID NO: 1677543 - protein, 17 aa, Staphylococcus aureus
CKIKHSCRTRAEYMQNV

SEQ ID NO: 1677544 - protein, 19 aa, Staphylococcus aureus
CSNNRWLQRYDLISERNHF

SEQ ID NO: 1677545 - protein, 18 aa, Staphylococcus aureus
DAVREWLRTTGFKNIDDL

SEQ ID NO: 1677546 - protein, 20 aa, Staphylococcus aureus
DEVLPALAYFTFSPKNYEDK

SEQ ID NO: 1677547 - protein, 20 aa, Staphylococcus aureus
DEVMPALAYFTFSPKNYEDK

SEQ ID NO: 1677548 - protein, 24 aa, Staphylococcus aureus
DFPKDLKGIAGWILEVKSNTPGNT

SEQ ID NO: 1677549 - protein, 25 aa, Staphylococcus aureus
DFPKDYKGIAGWVLEVKSNTPGNTT

SEQ ID NO: 1677550 - protein, 20 aa, Staphylococcus aureus
DFPLPKAFRDAGWFLDVLPG

SEQ ID NO: 1677551 - protein, 18 aa, Staphylococcus aureus
DFYEVMRLIAVEILNTDL

SEQ ID NO: 1677552 - protein, 23 aa, Staphylococcus aureus
DHIRHLLEFKACTSIDIDQVEPV

SEQ ID NO: 1677553 - protein, 19 aa, Staphylococcus aureus
DHVDFIGVDFLDFKRKGAE

SEQ ID NO: 1677554 - protein, 22 aa, Staphylococcus aureus
DILPLRIILGAVNLYGILSTNH

SEQ ID NO: 1677555 - protein, 22 aa, Staphylococcus aureus
DLKRFKGAHGLLYEQELGLQAT

SEQ ID NO: 1677556 - protein, 18 aa, Staphylococcus aureus
DVEIPKHLIIAFRLSKGK

SEQ ID NO: 1677557 - protein, 17 aa, Staphylococcus aureus
EALKDVLSDTGWEVSEQ

SEQ ID NO: 1677558 - protein, 19 aa, Staphylococcus aureus
EASLEFNVRPVPEYDNDFV

SEQ ID NO: 1677559 - protein, 18 aa, Staphylococcus aureus
EASMAFKIMESVRKGKGL

SEQ ID NO: 1677560 - protein, 20 aa, Staphylococcus aureus
EAYLSYRLEQEYSKDDIFQV

SEQ ID NO: 1677561 - protein, 20 aa, Staphylococcus aureus
ECNLYRLLREITMESVKCIE

SEQ ID NO: 1677562 - protein, 24 aa, Staphylococcus aureus
EDIQFSGAFSIEFRLSKQTITCTD

SEQ ID NO: 1677563 - protein, 19 aa, Staphylococcus aureus
EEKRCPSCHMTLKDIAHVG

SEQ ID NO: 1677564 - protein, 18 aa, Staphylococcus aureus
EERKARFLDNQKIKKTPV

SEQ ID NO: 1677565 - protein, 22 aa, Staphylococcus aureus
EFETRAGTLLRYYTGLLERSKV

SEQ ID NO: 1677566 - protein, 17 aa, Staphylococcus aureus
EFRKEFKPIASWQNNLV

SEQ ID NO: 1677567 - protein, 19 aa, Staphylococcus aureus
EGELCFGNEPLLRVEAPLI

SEQ ID NO: 1677568 - protein, 17 aa, Staphylococcus aureus
EGFRPVMEVQFLGFVFE

SEQ ID NO: 1677569 - protein, 17 aa, Staphylococcus aureus
EHLWRVEIELKRDMVDY

SEQ ID NO: 1677570 - protein, 18 aa, Staphylococcus aureus
EHLWRVEIELKRDMVDYW

SEQ ID NO: 1677571 - protein, 19 aa, Staphylococcus aureus
EIKNWEFPFVIKPGDDLPT

SEQ ID NO: 1677572 - protein, 21 aa, Staphylococcus aureus
EIKNWEFPLVIKPGDDLPTAG

SEQ ID NO: 1677573 - protein, 27 aa, Staphylococcus aureus
EIPQELKLVPNWVLWRAEWNEKQQNYG

SEQ ID NO: 1677574 - protein, 22 aa, Staphylococcus aureus
EKMKELQDFIARFSANASKSKQ

SEQ ID NO: 1677575 - protein, 22 aa, Staphylococcus aureus
EKSLKRTPSFSVNRPGEETGVT

SEQ ID NO: 1677576 - protein, 18 aa, Staphylococcus aureus
ELHRQTGHMIQWYIMTSD

SEQ ID NO: 1677577 - protein, 21 aa, Staphylococcus aureus
ELIELPQWVLWRAEWNEKQQQ

SEQ ID NO: 1677578 - protein, 17 aa, Staphylococcus aureus
ELYYYIKGGRVDYGAAH

SEQ ID NO: 1677579 - protein, 20 aa, Staphylococcus aureus
EMQQEIPYPFFVIKMPESNR

SEQ ID NO: 1677580 - protein, 24 aa, Staphylococcus aureus
ENLKGWHTGAGMSYLYNSDVKHYR

SEQ ID NO: 1677581 - protein, 20 aa, Staphylococcus aureus
EPAEIIGGDGFDVWNNAAKV

SEQ ID NO: 1677582 - protein, 18 aa, Staphylococcus aureus
EPHERLFALLIKKDGKQV

SEQ ID NO: 1677583 - protein, 20 aa, Staphylococcus aureus
EPLSAVIIPLDIAYNLYSID

SEQ ID NO: 1677584 - protein, 20 aa, Staphylococcus aureus
EQYKRLEFNLSIALDDVEST

SEQ ID NO: 1677585 - protein, 23 aa, Staphylococcus aureus
ERGWLKRRIETLYKVTLNNNEKR

SEQ ID NO: 1677586 - protein, 23 aa, Staphylococcus aureus
ETCKECLFYPYLLVQGEAGIGKS

SEQ ID NO: 1677587 - protein, 19 aa, Staphylococcus aureus
EVFCTLAYTGMRAGELLAL

SEQ ID NO: 1677588 - protein, 17 aa, Staphylococcus aureus
FELVCAMSGYQLGVNPF

SEQ ID NO: 1677589 - protein, 17 aa, Staphylococcus aureus
FESMPFLYGDDINKLQG

SEQ ID NO: 1677590 - protein, 17 aa, Staphylococcus aureus
FGELFRYLSYVEDVGTR

SEQ ID NO: 1677591 - protein, 20 aa, Staphylococcus aureus
FGENRLEGFLQKKEALPSDA

SEQ ID NO: 1677592 - protein, 17 aa, Staphylococcus aureus
FHGEVAMQLFLNDELKL

SEQ ID NO: 1677593 - protein, 19 aa, Staphylococcus aureus
FHKDVVIDLVGYRRFGHNE

SEQ ID NO: 1677594 - protein, 26 aa, Staphylococcus aureus
FKHEVQCVICLPAALLNENSAAIRLS

SEQ ID NO: 1677595 - protein, 21 aa, Staphylococcus aureus
FKLRKKHILGIVGESGSGKSI

SEQ ID NO: 1677596 - protein, 18 aa, Staphylococcus aureus
FKNYLGGIGKSFKEKFSK

SEQ ID NO: 1677597 - protein, 17 aa, Staphylococcus aureus
FLNTKKLSIGWKIYLEK

SEQ ID NO: 1677598 - protein, 19 aa, Staphylococcus aureus
FMRLNFYLIDLFRQQKRLN

SEQ ID NO: 1677599 - protein, 17 aa, Staphylococcus aureus
FPATHWKAINGIPYAGS

SEQ ID NO: 1677600 - protein, 19 aa, Staphylococcus aureus
FRMIIKQLYFFSVANPNPK

SEQ ID NO: 1677601 - protein, 20 aa, Staphylococcus aureus
FSPYKILGAILFEQTMDREV

SEQ ID NO: 1677602 - protein, 18 aa, Staphylococcus aureus
FTLNMLYPYIDEILITKS

SEQ ID NO: 1677603 - protein, 18 aa, Staphylococcus aureus
FTPVGGWWNQVMLSQKVT

SEQ ID NO: 1677604 - protein, 18 aa, Staphylococcus aureus
FVIISFKHKVILIGGTEY

SEQ ID NO: 1677605 - protein, 19 aa, Staphylococcus aureus
FVRRVCDCRGQWTMENFIE

SEQ ID NO: 1677606 - protein, 20 aa, Staphylococcus aureus
GAEIKPEFRNMLLNLKELDT

SEQ ID NO: 1677607 - protein, 18 aa, Staphylococcus aureus
GAGFELGIATGRPYTETV

SEQ ID NO: 1677608 - protein, 26 aa, Staphylococcus aureus
GDIFSFYSRECIDGMVIEALGQGNIP

SEQ ID NO: 1677609 - protein, 17 aa, Staphylococcus aureus
GEYAVGLFFSKERVLGS

SEQ ID NO: 1677610 - protein, 24 aa, Staphylococcus aureus
GFTHLPGWVRKASLGLAIFGASIG

SEQ ID NO: 1677611 - protein, 25 aa, Staphylococcus aureus
GFTHLPGWVRKASVGLALFGASIGP

SEQ ID NO: 1677612 - protein, 18 aa, Staphylococcus aureus
GGAVLKHFDNISVNVKRP

SEQ ID NO: 1677613 - protein, 18 aa, Staphylococcus aureus
GIAGLRLGVLMSTVETIQ

SEQ ID NO: 1677614 - protein, 18 aa, Staphylococcus aureus
GKLFGHVYIKDCKVRQSF

SEQ ID NO: 1677615 - protein, 20 aa, Staphylococcus aureus
GKLGVKVWIYRGEVLPTKNT

SEQ ID NO: 1677616 - protein, 18 aa, Staphylococcus aureus
GLEPWTSCEFDFTREGNL

SEQ ID NO: 1677617 - protein, 22 aa, Staphylococcus aureus
GLEPWTSCEFDFTREGTLNVSF

SEQ ID NO: 1677618 - protein, 23 aa, Staphylococcus aureus
GLKRVIDFIEHFGFSKSDLEYLK

SEQ ID NO: 1677619 - protein, 17 aa, Staphylococcus aureus
GLMRHLVVRTGYHTDEM

SEQ ID NO: 1677620 - protein, 20 aa, Staphylococcus aureus
GMIPVEWEKVYVIAYVDHQG

SEQ ID NO: 1677621 - protein, 17 aa, Staphylococcus aureus
GNIGRGFIGYILTDNNV

SEQ ID NO: 1677622 - protein, 23 aa, Staphylococcus aureus
GPMSLFALCVIKGITIENHQHIL

SEQ ID NO: 1677623 - protein, 21 aa, Staphylococcus aureus
GQRRLFEWLRQNGFLIKHKGV

SEQ ID NO: 1677624 - protein, 22 aa, Staphylococcus aureus
GQRRLFEWLRQNGFLIKRKGVD

SEQ ID NO: 1677625 - protein, 19 aa, Staphylococcus aureus
GRHSYHFNKIYFLRISTLP

SEQ ID NO: 1677626 - protein, 17 aa, Staphylococcus aureus
GRLKSIPIFMYKIAKAK

SEQ ID NO: 1677627 - protein, 19 aa, Staphylococcus aureus
GRLKSIPIFMYKIAKAKRK

SEQ ID NO: 1677628 - protein, 18 aa, Staphylococcus aureus
GRSGFVANSFAMRLNQLG

SEQ ID NO: 1677629 - protein, 18 aa, Staphylococcus aureus
GSGLPVPGWFSLQKLQFG

SEQ ID NO: 1677630 - protein, 17 aa, Staphylococcus aureus
GSVKFTIKVVLTDPYKY

SEQ ID NO: 1677631 - protein, 18 aa, Staphylococcus aureus
GTKLKLAIDYGKHDSIGI

SEQ ID NO: 1677632 - protein, 17 aa, Staphylococcus aureus
GTLTGRVKFIFQPAEEL

SEQ ID NO: 1677633 - protein, 22 aa, Staphylococcus aureus
GVVVRLANFGAFVEIAPGVQGL

SEQ ID NO: 1677634 - protein, 18 aa, Staphylococcus aureus
GYEHIGFSGAGAMDQFSF

SEQ ID NO: 1677635 - protein, 20 aa, Staphylococcus aureus
GYEPWTSCEFDFTKEGELKV

SEQ ID NO: 1677636 - protein, 17 aa, Staphylococcus aureus
HGDKALKMYNLTFDHTK

SEQ ID NO: 1677637 - protein, 20 aa, Staphylococcus aureus
HGFISFTPVGGWWNQVMLSQ

SEQ ID NO: 1677638 - protein, 24 aa, Staphylococcus aureus
HGNEFPISAGFFFINPFEVVYYAG

SEQ ID NO: 1677639 - protein, 21 aa, Staphylococcus aureus
HIYEISSLIYKSGMKIKIKAM

SEQ ID NO: 1677640 - protein, 20 aa, Staphylococcus aureus
HLQMAPKHWLCINEDDLVWA

SEQ ID NO: 1677641 - protein, 20 aa, Staphylococcus aureus
HPREIFKTAILSNANSIMLG

SEQ ID NO: 1677642 - protein, 18 aa, Staphylococcus aureus
IATFYYSRMMKIMNLAIL

SEQ ID NO: 1677643 - protein, 18 aa, Staphylococcus aureus
ICLSLFLAKAFKKGFITF

SEQ ID NO: 1677644 - protein, 17 aa, Staphylococcus aureus
IDEGWAFSASRQGKKVA

SEQ ID NO: 1677645 - protein, 19 aa, Staphylococcus aureus
IDKLICSWLKRIDNVIPQL

SEQ ID NO: 1677646 - protein, 29 aa, Staphylococcus aureus
IDKRISNPFLRQMLGYFIKYVGSSSYDAP

SEQ ID NO: 1677647 - protein, 17 aa, Staphylococcus aureus
IDRFPIFIPQALINEQI

SEQ ID NO: 1677648 - protein, 19 aa, Staphylococcus aureus
IELDFYFPLLKSWSKKKKI

SEQ ID NO: 1677649 - protein, 23 aa, Staphylococcus aureus
IELKGGIPDVCFVRDLEGICLSR

SEQ ID NO: 1677650 - protein, 17 aa, Staphylococcus aureus
IFLERSLVDGIFTIKDQ

SEQ ID NO: 1677651 - protein, 18 aa, Staphylococcus aureus
IGCGSNAIGTFYPFIKDD

SEQ ID NO: 1677652 - protein, 17 aa, Staphylococcus aureus
IHYFFGPEMVNVKRGGL

SEQ ID NO: 1677653 - protein, 18 aa, Staphylococcus aureus
IIKKVGYVYNIDFDKPKL

SEQ ID NO: 1677654 - protein, 17 aa, Staphylococcus aureus
IKESLAIVLDESKRLNR

SEQ ID NO: 1677655 - protein, 18 aa, Staphylococcus aureus
IKKAGLKYGFSLEEKAVT

SEQ ID NO: 1677656 - protein, 17 aa, Staphylococcus aureus
IKTDHWLPVTFTISKKE

SEQ ID NO: 1677657 - protein, 19 aa, Staphylococcus aureus
IKTDHWLPVTFTISKKETE

SEQ ID NO: 1677658 - protein, 17 aa, Staphylococcus aureus
IKVLNNWAKENVKTKED

SEQ ID NO: 1677659 - protein, 18 aa, Staphylococcus aureus
ILFILSLFRKINWKVYDE

SEQ ID NO: 1677660 - protein, 17 aa, Staphylococcus aureus
ILGAILFEQTMDREVEG

SEQ ID NO: 1677661 - protein, 17 aa, Staphylococcus aureus
INGYRWITYIANSGQRR

SEQ ID NO: 1677662 - protein, 24 aa, Staphylococcus aureus
IPKSWKLIAQMPFGDIREAAGEKT

SEQ ID NO: 1677663 - protein, 17 aa, Staphylococcus aureus
IPLKPLRQLEIISGEYN

SEQ ID NO: 1677664 - protein, 19 aa, Staphylococcus aureus
IPVDWEKVYVIAYVDDGGG

SEQ ID NO: 1677665 - protein, 22 aa, Staphylococcus aureus
IRFLKLKVGKIINVAKVDIIAF

SEQ ID NO: 1677666 - protein, 20 aa, Staphylococcus aureus
IRRLLKMYLERESFEIHEAS

SEQ ID NO: 1677667 - protein, 17 aa, Staphylococcus aureus
ISAGFFFINPFEVVYYA

SEQ ID NO: 1677668 - protein, 18 aa, Staphylococcus aureus
ISFSVSIYGSIVLYTNIT

SEQ ID NO: 1677669 - protein, 17 aa, Staphylococcus aureus
ISRLLQWGTDFVKPLAR

SEQ ID NO: 1677670 - protein, 20 aa, Staphylococcus aureus
ISSMIPVEWEKVYTIAYVDD

SEQ ID NO: 1677671 - protein, 19 aa, Staphylococcus aureus
ISSMIPVEWEKVYTMAYID

SEQ ID NO: 1677672 - protein, 17 aa, Staphylococcus aureus
ISVGAFFRARLGNEVLE

SEQ ID NO: 1677673 - protein, 24 aa, Staphylococcus aureus
ITEGFARCIPMIFLNPAPGQELEN

SEQ ID NO: 1677674 - protein, 17 aa, Staphylococcus aureus
IVACIGCGSNAIGTFYP

SEQ ID NO: 1677675 - protein, 18 aa, Staphylococcus aureus
KALAMKVPLGIFSHQLQR

SEQ ID NO: 1677676 - protein, 21 aa, Staphylococcus aureus
KALEVKKRFSAWAEINLKHFK

SEQ ID NO: 1677677 - protein, 25 aa, Staphylococcus aureus
KAQFIKRLACLPSHIYRLKGFMTFE

SEQ ID NO: 1677678 - protein, 17 aa, Staphylococcus aureus
KARIMMIFSLYKGEKRR

SEQ ID NO: 1677679 - protein, 20 aa, Staphylococcus aureus
KARTGWLIVDYAGYPWPGYD

SEQ ID NO: 1677680 - protein, 20 aa, Staphylococcus aureus
KCATLAWKALEKGTVAKEGT

SEQ ID NO: 1677681 - protein, 18 aa, Staphylococcus aureus
KCIVFGCYENETLIATAA

SEQ ID NO: 1677682 - protein, 18 aa, Staphylococcus aureus
KDCYIWLYIFFLKKDKNF

SEQ ID NO: 1677683 - protein, 20 aa, Staphylococcus aureus
KDRFSFRVKEIAAIILNEIA

SEQ ID NO: 1677684 - protein, 21 aa, Staphylococcus aureus
KEALKAQVTSAGRVSAANGVE

SEQ ID NO: 1677685 - protein, 17 aa, Staphylococcus aureus
KEGRIVGIGAHLRKGDK

SEQ ID NO: 1677686 - protein, 19 aa, Staphylococcus aureus
KENPAAYVLLGYNDTTNRS

SEQ ID NO: 1677687 - protein, 19 aa, Staphylococcus aureus
KESAKRALASYSNLNNAQS

SEQ ID NO: 1677688 - protein, 17 aa, Staphylococcus aureus
KEVFKELLVNCELPQSL

SEQ ID NO: 1677689 - protein, 18 aa, Staphylococcus aureus
KEVTRLANHLGWKGKGTN

SEQ ID NO: 1677690 - protein, 19 aa, Staphylococcus aureus
KEYEKFGRWFFNKFKVNRS

SEQ ID NO: 1677691 - protein, 18 aa, Staphylococcus aureus
KEYWLCWVTTERNEQGPY

SEQ ID NO: 1677692 - protein, 22 aa, Staphylococcus aureus
KFERPFVVAISIMYLFEMLSIS

SEQ ID NO: 1677693 - protein, 21 aa, Staphylococcus aureus
KGEPKLGFKEMEEIGLSTGLP

SEQ ID NO: 1677694 - protein, 19 aa, Staphylococcus aureus
KGLEPLAIWMKALKHEVSI

SEQ ID NO: 1677695 - protein, 20 aa, Staphylococcus aureus
KGPCYLHYYLQGYDEPMYTR

SEQ ID NO: 1677696 - protein, 21 aa, Staphylococcus aureus
KGRLPDCLVQWSAKRLKEQGA

SEQ ID NO: 1677697 - protein, 17 aa, Staphylococcus aureus
KGRYSVVIFDIYGTLTL

SEQ ID NO: 1677698 - protein, 17 aa, Staphylococcus aureus
KGYEWNPQPIKSMKHSG

SEQ ID NO: 1677699 - protein, 19 aa, Staphylococcus aureus
KHFYKECDRCLKAYNIFIE

SEQ ID NO: 1677700 - protein, 19 aa, Staphylococcus aureus
KIWKRWLHTQGYKDIHLDI

SEQ ID NO: 1677701 - protein, 20 aa, Staphylococcus aureus
KKAAAFDFFQDNGFGFITPY

SEQ ID NO: 1677702 - protein, 19 aa, Staphylococcus aureus
KKHVYDLLETVGLSKEHAN

SEQ ID NO: 1677703 - protein, 19 aa, Staphylococcus aureus
KKIEPVFIKGADLEGQDLQ

SEQ ID NO: 1677704 - protein, 19 aa, Staphylococcus aureus
KKISIKFLFESYTGKDYTL

SEQ ID NO: 1677705 - protein, 22 aa, Staphylococcus aureus
KLGEHLKHPFILKRIVGQSGMS

SEQ ID NO: 1677706 - protein, 18 aa, Staphylococcus aureus
KLLFWVIMNIIRGQHHYD

SEQ ID NO: 1677707 - protein, 22 aa, Staphylococcus aureus
KLNELRSGFNIDNYITLAEYFE

SEQ ID NO: 1677708 - protein, 20 aa, Staphylococcus aureus
KLNKCFYKYYGLNKLINLLI

SEQ ID NO: 1677709 - protein, 20 aa, Staphylococcus aureus
KMTLLELVEWAWNNPEQVES

SEQ ID NO: 1677710 - protein, 23 aa, Staphylococcus aureus
KNIPFRTAHEIVGKIVLECIQQG

SEQ ID NO: 1677711 - protein, 17 aa, Staphylococcus aureus
KNPRGSVKFTIKVVLTD

SEQ ID NO: 1677712 - protein, 17 aa, Staphylococcus aureus
KPKLEMWIDVLSQNGDY

SEQ ID NO: 1677713 - protein, 18 aa, Staphylococcus aureus
KPLLKRKYPNISFKYTYI

SEQ ID NO: 1677714 - protein, 19 aa, Staphylococcus aureus
KRLHIIPFNYSFKDDQERL

SEQ ID NO: 1677715 - protein, 17 aa, Staphylococcus aureus
KRMAIEYSMPKWIIDHW

SEQ ID NO: 1677716 - protein, 20 aa, Staphylococcus aureus
KRTMFWLEFEIRQYTHSNIT

SEQ ID NO: 1677717 - protein, 18 aa, Staphylococcus aureus
KSGMKIKIKAMGINVDEI

SEQ ID NO: 1677718 - protein, 24 aa, Staphylococcus aureus
KSKLCPVCNWRRAMKNSYQAQKVI

SEQ ID NO: 1677719 - protein, 18 aa, Staphylococcus aureus
KSRVIRHAYLDEFENEPL

SEQ ID NO: 1677720 - protein, 17 aa, Staphylococcus aureus
KVGELYPAEGYNNPRVE

SEQ ID NO: 1677721 - protein, 21 aa, Staphylococcus aureus
KVGLWSFDFNIDWHAGGDKRQ

SEQ ID NO: 1677722 - protein, 18 aa, Staphylococcus aureus
KYARGVAVYGDIKNGAND

SEQ ID NO: 1677723 - protein, 19 aa, Staphylococcus aureus
KYMNSWCLEYSEFLLDEVR

SEQ ID NO: 1677724 - protein, 17 aa, Staphylococcus aureus
KYRPELRNMKIFPRPID

SEQ ID NO: 1677725 - protein, 21 aa, Staphylococcus aureus
KYSNIYLYLALKGFLEKLMND

SEQ ID NO: 1677726 - protein, 17 aa, Staphylococcus aureus
LAKEVFRNELLRWNEEN

SEQ ID NO: 1677727 - protein, 17 aa, Staphylococcus aureus
LASLNVHAAIIGKAAHQ

SEQ ID NO: 1677728 - protein, 19 aa, Staphylococcus aureus
LDEAIGIMVSQVIYEYKEE

SEQ ID NO: 1677729 - protein, 17 aa, Staphylococcus aureus
LDHRGGVGADGITGDGA

SEQ ID NO: 1677730 - protein, 26 aa, Staphylococcus aureus
LDLFLIHWPCEADGLFLETYKAMEEL

SEQ ID NO: 1677731 - protein, 19 aa, Staphylococcus aureus
LDLLSKIAITFSEEENVDR

SEQ ID NO: 1677732 - protein, 20 aa, Staphylococcus aureus
LELAEQMGIIFIDEIDKVAT

SEQ ID NO: 1677733 - protein, 21 aa, Staphylococcus aureus
LESYSYHLGMMFQIKDDLLDC

SEQ ID NO: 1677734 - protein, 19 aa, Staphylococcus aureus
LFINWTWGEDFFRKYLIDY

SEQ ID NO: 1677735 - protein, 17 aa, Staphylococcus aureus
LGGIIAGFLFRETEPDI

SEQ ID NO: 1677736 - protein, 17 aa, Staphylococcus aureus
LGIVLSYLKQYRASQQL

SEQ ID NO: 1677737 - protein, 18 aa, Staphylococcus aureus
LILDELKMTLSHVEADEF

SEQ ID NO: 1677738 - protein, 17 aa, Staphylococcus aureus
LKHPFILKRIVGQSGMS

SEQ ID NO: 1677739 - protein, 17 aa, Staphylococcus aureus
LKIQIEFLIAYATAQTE

SEQ ID NO: 1677740 - protein, 19 aa, Staphylococcus aureus
LKLIPFPLPVKFEQDKISQ

SEQ ID NO: 1677741 - protein, 19 aa, Staphylococcus aureus
LKQSWEFIDYISTEWKKSN

SEQ ID NO: 1677742 - protein, 22 aa, Staphylococcus aureus
LKSFKGSIIFTSYDFEFINTIA

SEQ ID NO: 1677743 - protein, 19 aa, Staphylococcus aureus
LLCGIGMPGELCIAGDSLA

SEQ ID NO: 1677744 - protein, 19 aa, Staphylococcus aureus
LLDKWGMSPSELMAFGDAN

SEQ ID NO: 1677745 - protein, 17 aa, Staphylococcus aureus
LLKSLNFNQFNLVEAQC

SEQ ID NO: 1677746 - protein, 17 aa, Staphylococcus aureus
LLLSEAFDVAPRSVDAQ

SEQ ID NO: 1677747 - protein, 18 aa, Staphylococcus aureus
LLQARSKEILAFVYESKE

SEQ ID NO: 1677748 - protein, 17 aa, Staphylococcus aureus
LNFKELRAFVTGNAPAK

SEQ ID NO: 1677749 - protein, 17 aa, Staphylococcus aureus
LNITCLFDKPSVFKSLV

SEQ ID NO: 1677750 - protein, 23 aa, Staphylococcus aureus
LNNRKAEALQRLDQLTHLNNAQR

SEQ ID NO: 1677751 - protein, 18 aa, Staphylococcus aureus
LPMNPAISLFVPVKDTIE

SEQ ID NO: 1677752 - protein, 17 aa, Staphylococcus aureus
LPSHIFKSITFDCGKEF

SEQ ID NO: 1677753 - protein, 17 aa, Staphylococcus aureus
LRFPGFEGEWEEKKLGD

SEQ ID NO: 1677754 - protein, 26 aa, Staphylococcus aureus
LRPFVKTKIKAWVRQLLWMSIYQYVY

SEQ ID NO: 1677755 - protein, 18 aa, Staphylococcus aureus
LSDFKSMLAYNETNYAAL

SEQ ID NO: 1677756 - protein, 17 aa, Staphylococcus aureus
LTKGFPLLTTKKVSFKL

SEQ ID NO: 1677757 - protein, 22 aa, Staphylococcus aureus
LTSVILRNRYEAFYRPSDGNLV

SEQ ID NO: 1677758 - protein, 18 aa, Staphylococcus aureus
LVGKEFLEKWAGVPTEVH

SEQ ID NO: 1677759 - protein, 17 aa, Staphylococcus aureus
LYFEISVDSIQNYYRKD

SEQ ID NO: 1677760 - protein, 17 aa, Staphylococcus aureus
LYFLEGIDAIEKIENNY

SEQ ID NO: 1677761 - protein, 17 aa, Staphylococcus aureus
LYNFIWDDFCDWYIEMS

SEQ ID NO: 1677762 - protein, 19 aa, Staphylococcus aureus
LYPNYWGGNKYKVIEELRK

SEQ ID NO: 1677763 - protein, 17 aa, Staphylococcus aureus
LYRKRMLSYGGLLKQKH

SEQ ID NO: 1677764 - protein, 18 aa, Staphylococcus aureus
MALPPCHTMFQFYVQEGK

SEQ ID NO: 1677765 - protein, 21 aa, Staphylococcus aureus
MAMFKDMNFELGIMELYAIES

SEQ ID NO: 1677766 - protein, 17 aa, Staphylococcus aureus
MGTTCVCALVFEKSVVI

SEQ ID NO: 1677767 - protein, 20 aa, Staphylococcus aureus
MHHMCSGLTLLDSVKIVSTE

SEQ ID NO: 1677768 - protein, 17 aa, Staphylococcus aureus
MHVLLCVENAYFRKKEN

SEQ ID NO: 1677769 - protein, 18 aa, Staphylococcus aureus
MHVLLCVENAYFRKKENY

SEQ ID NO: 1677770 - protein, 19 aa, Staphylococcus aureus
MHVLLCVENAYFRKKENYI

SEQ ID NO: 1677771 - protein, 18 aa, Staphylococcus aureus
MIKFAKAHHIDRYNFYGI

SEQ ID NO: 1677772 - protein, 17 aa, Staphylococcus aureus
MKEAIKYAVKFYNYPNE

SEQ ID NO: 1677773 - protein, 17 aa, Staphylococcus aureus
MKLRIGFSDIFFNVDKL

SEQ ID NO: 1677774 - protein, 19 aa, Staphylococcus aureus
MKLRIGFSDIFFNVDKLTS

SEQ ID NO: 1677775 - protein, 21 aa, Staphylococcus aureus
MLPAEWNDWIIGARQALIDQR

SEQ ID NO: 1677776 - protein, 23 aa, Staphylococcus aureus
MLVAADIYRPAAINQLQTVGKQI

SEQ ID NO: 1677777 - protein, 17 aa, Staphylococcus aureus
MMNCFKFSFINENKELI

SEQ ID NO: 1677778 - protein, 25 aa, Staphylococcus aureus
MQAFWPGPISFILPLKLGYLCRKVS

SEQ ID NO: 1677779 - protein, 17 aa, Staphylococcus aureus
MQWQRGIYDGGGWNAIF

SEQ ID NO: 1677780 - protein, 18 aa, Staphylococcus aureus
MQWQRGIYDGGGWNAIFW

SEQ ID NO: 1677781 - protein, 21 aa, Staphylococcus aureus
MSLFALCVIKGITIENHQHIL

SEQ ID NO: 1677782 - protein, 18 aa, Staphylococcus aureus
MTPAFWVYFEFDLQKEEI

SEQ ID NO: 1677783 - protein, 18 aa, Staphylococcus aureus
MYGGTCINVGCIASKTLV

SEQ ID NO: 1677784 - protein, 19 aa, Staphylococcus aureus
NCKPDFWKTLKYKKDKVTY

SEQ ID NO: 1677785 - protein, 21 aa, Staphylococcus aureus
NCKQLRQVYPNGVTADHPAYR

SEQ ID NO: 1677786 - protein, 17 aa, Staphylococcus aureus
NELITFENIHLMNPGTF

SEQ ID NO: 1677787 - protein, 17 aa, Staphylococcus aureus
NIHVIPLSLTIDGKSYT

SEQ ID NO: 1677788 - protein, 18 aa, Staphylococcus aureus
NIIKATHVQYLFKQNNNI

SEQ ID NO: 1677789 - protein, 19 aa, Staphylococcus aureus
NKDKVEWIILAGYMRLIGP

SEQ ID NO: 1677790 - protein, 23 aa, Staphylococcus aureus
NLNDEYVVSPGWTKDEQAKAFEE

SEQ ID NO: 1677791 - protein, 22 aa, Staphylococcus aureus
NLTEAYTNYAILFISGTYPGGV

SEQ ID NO: 1677792 - protein, 17 aa, Staphylococcus aureus
NNILKFSLFTGEKHIVI

SEQ ID NO: 1677793 - protein, 17 aa, Staphylococcus aureus
NPDRRVAQQNAFYNVLK

SEQ ID NO: 1677794 - protein, 23 aa, Staphylococcus aureus
NPFPSRWRYVVDILQQLLQTKKL

SEQ ID NO: 1677795 - protein, 23 aa, Staphylococcus aureus
NPHKGYVGHHLFIKLGNYHQTIF

SEQ ID NO: 1677796 - protein, 22 aa, Staphylococcus aureus
NRKRWPLYRPWALFIKDTEKLN

SEQ ID NO: 1677797 - protein, 19 aa, Staphylococcus aureus
NRMGGTYIKSGYGADTSGI

SEQ ID NO: 1677798 - protein, 17 aa, Staphylococcus aureus
NSADGEPCNECHICKGI

SEQ ID NO: 1677799 - protein, 18 aa, Staphylococcus aureus
NSGDIKLLIAHPASAGHG

SEQ ID NO: 1677800 - protein, 18 aa, Staphylococcus aureus
NSYPEWQKQFPFWSLITI

SEQ ID NO: 1677801 - protein, 19 aa, Staphylococcus aureus
NVIKWVHQFIESFGGDAKN

SEQ ID NO: 1677802 - protein, 21 aa, Staphylococcus aureus
NVRLKPYFDVLVEKVIYPYRN

SEQ ID NO: 1677803 - protein, 22 aa, Staphylococcus aureus
NWPIGMGQSFFGIIDRKSKTIE

SEQ ID NO: 1677804 - protein, 21 aa, Staphylococcus aureus
NYKSEAYVGVWTEESVAVSFL

SEQ ID NO: 1677805 - protein, 19 aa, Staphylococcus aureus
PELRFPGFEGEYSLDIFGN

SEQ ID NO: 1677806 - protein, 21 aa, Staphylococcus aureus
PFGKLRAGFDLFKKPTQMQNG

SEQ ID NO: 1677807 - protein, 18 aa, Staphylococcus aureus
PHLRFGFIHVPYIPEQVI

SEQ ID NO: 1677808 - protein, 20 aa, Staphylococcus aureus
PIIWLCGGLDRGNEFDELIP

SEQ ID NO: 1677809 - protein, 20 aa, Staphylococcus aureus
PKCIVFGCYENETLIATAAL

SEQ ID NO: 1677810 - protein, 23 aa, Staphylococcus aureus
PKLPYTLCYISRGFVVDYSNKEA

SEQ ID NO: 1677811 - protein, 17 aa, Staphylococcus aureus
PLYDGLYTVLGREQTER

SEQ ID NO: 1677812 - protein, 18 aa, Staphylococcus aureus
PPVWVCLELMSFGQFSAF

SEQ ID NO: 1677813 - protein, 23 aa, Staphylococcus aureus
PRIYTDVCLLCFSLKEAGHGRLL

SEQ ID NO: 1677814 - protein, 19 aa, Staphylococcus aureus
PRLPFDHVFHHNKYHADKE

SEQ ID NO: 1677815 - protein, 21 aa, Staphylococcus aureus
PSHIYRLKGFMTFEDTTHTYL

SEQ ID NO: 1677816 - protein, 23 aa, Staphylococcus aureus
PTDTEGWAHCLTIPRVLNVENGQ

SEQ ID NO: 1677817 - protein, 22 aa, Staphylococcus aureus
PTRRGQLIAGRILFLQEKLAKG

SEQ ID NO: 1677818 - protein, 19 aa, Staphylococcus aureus
PVEWEKVYVIAYVDDGGGQ

SEQ ID NO: 1677819 - protein, 17 aa, Staphylococcus aureus
QEYAWAFLNELFYLIEL

SEQ ID NO: 1677820 - protein, 18 aa, Staphylococcus aureus
QGTGLGLFICKMIIEEHG

SEQ ID NO: 1677821 - protein, 22 aa, Staphylococcus aureus
QKARACGIHMLVATQRPSVNVI

SEQ ID NO: 1677822 - protein, 21 aa, Staphylococcus aureus
QKIVRWRAAMFIFDEGNSEQL

SEQ ID NO: 1677823 - protein, 20 aa, Staphylococcus aureus
QVWECIRILISNVKTPMQNS

SEQ ID NO: 1677824 - protein, 18 aa, Staphylococcus aureus
QWEAMLLGWKVVPSVKSN

SEQ ID NO: 1677825 - protein, 19 aa, Staphylococcus aureus
RAIHVLKHFDRIEDVVVKV

SEQ ID NO: 1677826 - protein, 23 aa, Staphylococcus aureus
RCHSGPLLKNGHRFGFYRGYNGH

SEQ ID NO: 1677827 - protein, 18 aa, Staphylococcus aureus
RDEATWFALMNHLVDVSV

SEQ ID NO: 1677828 - protein, 20 aa, Staphylococcus aureus
REKRVIKREHVREAQKLVDN

SEQ ID NO: 1677829 - protein, 18 aa, Staphylococcus aureus
RETMIGSMAYYISHAKNN

SEQ ID NO: 1677830 - protein, 17 aa, Staphylococcus aureus
RGIYCGAIGLLLPTEDD

SEQ ID NO: 1677831 - protein, 17 aa, Staphylococcus aureus
RHFGENRLEGFLQKKEA

SEQ ID NO: 1677832 - protein, 20 aa, Staphylococcus aureus
RHIAHPTGRIIGRRDGYKPN

SEQ ID NO: 1677833 - protein, 17 aa, Staphylococcus aureus
RHWSSSKGQGLWMSVVL

SEQ ID NO: 1677834 - protein, 24 aa, Staphylococcus aureus
RKEVPPLMCASLWSKFDLFKKYAN

SEQ ID NO: 1677835 - protein, 17 aa, Staphylococcus aureus
RKFKRWVTSDVLPAIRK

SEQ ID NO: 1677836 - protein, 20 aa, Staphylococcus aureus
RKGLEPLAIWMKARKHEVSI

SEQ ID NO: 1677837 - protein, 19 aa, Staphylococcus aureus
RKGLRTGIVADRMGGQVND

SEQ ID NO: 1677838 - protein, 17 aa, Staphylococcus aureus
RKIDVELVFGFMKAILG

SEQ ID NO: 1677839 - protein, 22 aa, Staphylococcus aureus
RKKPANGFVCYMIGRLILENCR

SEQ ID NO: 1677840 - protein, 28 aa, Staphylococcus aureus
RKLNIEWIYRALMDWKRIGRLKSIPIFM

SEQ ID NO: 1677841 - protein, 19 aa, Staphylococcus aureus
RLFEGFSMGNPRIQTGNLL

SEQ ID NO: 1677842 - protein, 18 aa, Staphylococcus aureus
RLGFKRIWFTEHHNVPAF

SEQ ID NO: 1677843 - protein, 18 aa, Staphylococcus aureus
RLGIEMKDVMAIGDNLND

SEQ ID NO: 1677844 - protein, 19 aa, Staphylococcus aureus
RLGKKATEIVIEFKKNNNT

SEQ ID NO: 1677845 - protein, 18 aa, Staphylococcus aureus
RMIIKQLYFFSVANPDPT

SEQ ID NO: 1677846 - protein, 20 aa, Staphylococcus aureus
RNKVTWGYAKSILNTWLNAN

SEQ ID NO: 1677847 - protein, 19 aa, Staphylococcus aureus
RNLLQRIWDGILEILQSII

SEQ ID NO: 1677848 - protein, 20 aa, Staphylococcus aureus
RPQLRALLRASVYGKLNIMF

SEQ ID NO: 1677849 - protein, 22 aa, Staphylococcus aureus
RRAEINLSVILCRMDKLDGTNE

SEQ ID NO: 1677850 - protein, 18 aa, Staphylococcus aureus
RSGLNYTILHPGALTNAA

SEQ ID NO: 1677851 - protein, 18 aa, Staphylococcus aureus
RTVMPGFNYEAPPTQHKI

SEQ ID NO: 1677852 - protein, 20 aa, Staphylococcus aureus
RVGVGKLCLVEFDYATSQDF

SEQ ID NO: 1677853 - protein, 20 aa, Staphylococcus aureus
RVLRELEFHFQLVIDANESL

SEQ ID NO: 1677854 - protein, 24 aa, Staphylococcus aureus
RYRFKSRIAVWVLNYIKVNEAKLA

SEQ ID NO: 1677855 - protein, 18 aa, Staphylococcus aureus
SALPGRKSGSLVGISQID

SEQ ID NO: 1677856 - protein, 17 aa, Staphylococcus aureus
SEFKPNFVNDSLENETN

SEQ ID NO: 1677857 - protein, 19 aa, Staphylococcus aureus
SEVPAHVQAGWMLTTIASV

SEQ ID NO: 1677858 - protein, 21 aa, Staphylococcus aureus
SEWMFKNGYDIRAFASESISV

SEQ ID NO: 1677859 - protein, 22 aa, Staphylococcus aureus
SGGKRVRPAFVILSSQFGKDKQ

SEQ ID NO: 1677860 - protein, 19 aa, Staphylococcus aureus
SGMIPVEWEKVYAMAYIDE

SEQ ID NO: 1677861 - protein, 20 aa, Staphylococcus aureus
SGVCSSEIWVLKSTKEDKLL

SEQ ID NO: 1677862 - protein, 23 aa, Staphylococcus aureus
SHYLKVRPGAFFLTGCGNESKGI

SEQ ID NO: 1677863 - protein, 17 aa, Staphylococcus aureus
SIGLLAIQWARIFGAAH

SEQ ID NO: 1677864 - protein, 19 aa, Staphylococcus aureus
SKIAYVVEFFEWFNTLETF

SEQ ID NO: 1677865 - protein, 20 aa, Staphylococcus aureus
SKIAYVVEFFEWFNTLETFK

SEQ ID NO: 1677866 - protein, 20 aa, Staphylococcus aureus
SKIKTVLHGLSFSEEDFNKP

SEQ ID NO: 1677867 - protein, 17 aa, Staphylococcus aureus
SKVFRSRFRMLVEAQLD

SEQ ID NO: 1677868 - protein, 18 aa, Staphylococcus aureus
SMIPVEWEKVYTIAYVDD

SEQ ID NO: 1677869 - protein, 17 aa, Staphylococcus aureus
SNAWGWANATRAQTGSA

SEQ ID NO: 1677870 - protein, 24 aa, Staphylococcus aureus
SPQVRKLKGGFFFAALTPTLRHLG

SEQ ID NO: 1677871 - protein, 21 aa, Staphylococcus aureus
SQFNLPTRYIWGIYEPQSDDQ

SEQ ID NO: 1677872 - protein, 19 aa, Staphylococcus aureus
SRISPKMGMMKSSVLNQSR

SEQ ID NO: 1677873 - protein, 18 aa, Staphylococcus aureus
SSDELKQFLTFVEDDPLY

SEQ ID NO: 1677874 - protein, 21 aa, Staphylococcus aureus
STLELRTAIKIFGKKYTAEEK

SEQ ID NO: 1677875 - protein, 24 aa, Staphylococcus aureus
TDAARAIDALPHLNNAQKADVKSK

SEQ ID NO: 1677876 - protein, 25 aa, Staphylococcus aureus
TDFPKDFKGIAGWILEVKSNTPGNT

SEQ ID NO: 1677877 - protein, 17 aa, Staphylococcus aureus
TEILYELGLGKYIVGVS

SEQ ID NO: 1677878 - protein, 21 aa, Staphylococcus aureus
TETIYRFSLLVPNQVALHYFE

SEQ ID NO: 1677879 - protein, 17 aa, Staphylococcus aureus
TFFPPYTFENWEVESSV

SEQ ID NO: 1677880 - protein, 17 aa, Staphylococcus aureus
THLKWGAQKEVIKLIPG

SEQ ID NO: 1677881 - protein, 24 aa, Staphylococcus aureus
TIASMIIEFAEWVNTLEFFKNWKK

SEQ ID NO: 1677882 - protein, 17 aa, Staphylococcus aureus
TKDYILSVGKEFLKKAD

SEQ ID NO: 1677883 - protein, 18 aa, Staphylococcus aureus
TKDYVLSVGKEFLKKADT

SEQ ID NO: 1677884 - protein, 17 aa, Staphylococcus aureus
TKFKSCVKKHTFEQIMQ

SEQ ID NO: 1677885 - protein, 21 aa, Staphylococcus aureus
TKKELLLLLMRLMKVKVKGYG

SEQ ID NO: 1677886 - protein, 18 aa, Staphylococcus aureus
TRKLGFDGYSDFKSYLKF

SEQ ID NO: 1677887 - protein, 17 aa, Staphylococcus aureus
TRYIWGIYEPQSDDQNM

SEQ ID NO: 1677888 - protein, 19 aa, Staphylococcus aureus
TSALPGRKSGSLVGISQID

SEQ ID NO: 1677889 - protein, 19 aa, Staphylococcus aureus
VALEQEYAWAFLNELFYLI

SEQ ID NO: 1677890 - protein, 18 aa, Staphylococcus aureus
VALFKEWKTQKGIVKYLL

SEQ ID NO: 1677891 - protein, 19 aa, Staphylococcus aureus
VCYMWLRFNMDQQFDGTAI

SEQ ID NO: 1677892 - protein, 19 aa, Staphylococcus aureus
VFDRVGGKIGSTWGNASNW

SEQ ID NO: 1677893 - protein, 23 aa, Staphylococcus aureus
VGTKLRLAIDYGKHDSIGIDAVA

SEQ ID NO: 1677894 - protein, 20 aa, Staphylococcus aureus
VIEMYKLKKLLGLADNKEDE

SEQ ID NO: 1677895 - protein, 18 aa, Staphylococcus aureus
VISVHYRSPINYNLELVE

SEQ ID NO: 1677896 - protein, 20 aa, Staphylococcus aureus
VKELLECFDYLIKHKRHATR

SEQ ID NO: 1677897 - protein, 22 aa, Staphylococcus aureus
VKYFIKRCAMEKGIFNYDNANV

SEQ ID NO: 1677898 - protein, 17 aa, Staphylococcus aureus
VLHGLSFSEEDFNKPIN

SEQ ID NO: 1677899 - protein, 17 aa, Staphylococcus aureus
VLKACVDLSIQYIPQRL

SEQ ID NO: 1677900 - protein, 18 aa, Staphylococcus aureus
VLTGFKFIAQEIRQLDNH

SEQ ID NO: 1677901 - protein, 18 aa, Staphylococcus aureus
VLVCTVIGFPLGASTTAT

SEQ ID NO: 1677902 - protein, 19 aa, Staphylococcus aureus
VMRSDIMLRYKDKCLIIDA

SEQ ID NO: 1677903 - protein, 22 aa, Staphylococcus aureus
VSELKNRIPLVLEVKSNQYQSS

SEQ ID NO: 1677904 - protein, 18 aa, Staphylococcus aureus
VTAFDFFQDNGFGFITPY

SEQ ID NO: 1677905 - protein, 18 aa, Staphylococcus aureus
VWHPRAWEFAPSRVDFPT

SEQ ID NO: 1677906 - protein, 17 aa, Staphylococcus aureus
VYNRNGVVTARAVISHR

SEQ ID NO: 1677907 - protein, 18 aa, Staphylococcus aureus
WAIAYKFPAEEVVTKLLD

SEQ ID NO: 1677908 - protein, 17 aa, Staphylococcus aureus
WATWCGPCKMIAPVLEE

SEQ ID NO: 1677909 - protein, 18 aa, Staphylococcus aureus
WGECASRIVSIYRYISKL

SEQ ID NO: 1677910 - protein, 17 aa, Staphylococcus aureus
WGGNKYKVIEELRKQGY

SEQ ID NO: 1677911 - protein, 17 aa, Staphylococcus aureus
WIIDHWATHYGLEETET

SEQ ID NO: 1677912 - protein, 17 aa, Staphylococcus aureus
WKAKGILLYLLSRPDNW

SEQ ID NO: 1677913 - protein, 25 aa, Staphylococcus aureus
WKEKVHIIRWFLAYKKVPKILVDKI

SEQ ID NO: 1677914 - protein, 18 aa, Staphylococcus aureus
WQIPEIEPQYVLKYQESK

SEQ ID NO: 1677915 - protein, 21 aa, Staphylococcus aureus
WQKQFPFWSLITIKRTIYSLE

SEQ ID NO: 1677916 - protein, 21 aa, Staphylococcus aureus
WRLLPEFWGKGLATEGAKAAL

SEQ ID NO: 1677917 - protein, 19 aa, Staphylococcus aureus
WVHQFIESFGGDAKNITLM

SEQ ID NO: 1677918 - protein, 17 aa, Staphylococcus aureus
WYAVHTYSGYENKVKKN

SEQ ID NO: 1677919 - protein, 23 aa, Staphylococcus aureus
YDFPMWFIRPNFKSEIAPRSVQS

SEQ ID NO: 1677920 - protein, 23 aa, Staphylococcus aureus
YDFPMWFIRPNFKSEITPRSVQS

SEQ ID NO: 1677921 - protein, 17 aa, Staphylococcus aureus
YFYRFSLKARKRVKTVS

SEQ ID NO: 1677922 - protein, 19 aa, Staphylococcus aureus
YINQFEWRDAKFLVVQNVN

SEQ ID NO: 1677923 - protein, 19 aa, Staphylococcus aureus
YKEHIGVVFDDLRVPNKLT

SEQ ID NO: 1677924 - protein, 18 aa, Staphylococcus aureus
YKKKYLILRIFNVSGEEP

SEQ ID NO: 1677925 - protein, 25 aa, Staphylococcus aureus
YLSNDGFCYLSYWYGDNENIVNIFH

SEQ ID NO: 1677926 - protein, 18 aa, Staphylococcus aureus
YPHQRYAIDLVIKENHKT

SEQ ID NO: 1677927 - protein, 20 aa, Staphylococcus aureus
YPVVFVHGFLGLVGDNAPAL

SEQ ID NO: 1677928 - protein, 24 aa, Staphylococcus aureus
YQIEYLKEMVTFVVVNRDKNSQNI

SEQ ID NO: 1677929 - protein, 18 aa, Staphylococcus aureus
YRDLEIIKAVILKAKKSF

SEQ ID NO: 1677930 - protein, 21 aa, Staphylococcus aureus
YRPRKCLNWKFPYEVLCDELL

SEQ ID NO: 1677931 - protein, 17 aa, Staphylococcus aureus
YRPTAVIYDLDFLKTLP

SEQ ID NO: 1677932 - protein, 20 aa, Staphylococcus aureus
YSEYFFRDLLNIVYGYSLEN

SEQ ID NO: 1677933 - protein, 20 aa, Staphylococcus aureus
YSLGYLSGWGHNISDDELKA

SEQ ID NO: 1677934 - protein, 25 aa, Staphylococcus aureus
YSRPRGKFRFPMSVAYENENVKQSA

SEQ ID NO: 1677935 - protein, 20 aa, Staphylococcus aureus
YTCEKFKLLVLQGNVLGVQV

SEQ ID NO: 1677936 - protein, 32 aa, Staphylococcus aureus
YTKPSFEFEKQFGFLLKPWTTVRFMNVIPNRF

SEQ ID NO: 1677937 - protein, 17 aa, Staphylococcus aureus
YVKEISEQFGFVNIGVK

SEQ ID NO: 1677938 - protein, 17 aa, Staphylococcus aureus
AAVWKLDLKGHKPALEG

SEQ ID NO: 1677939 - protein, 18 aa, Staphylococcus aureus
ADSMVRMMELAVQYPDQF

SEQ ID NO: 1677940 - protein, 18 aa, Staphylococcus aureus
AEERKARFLDKQKNKKTP

SEQ ID NO: 1677941 - protein, 23 aa, Staphylococcus aureus
AEFIKRLACLPSHIYRLKGFMTF

SEQ ID NO: 1677942 - protein, 17 aa, Staphylococcus aureus
AEKSIEMIIAMIGVLKA

SEQ ID NO: 1677943 - protein, 20 aa, Staphylococcus aureus
AEKSIEMIIAMIGVLKAGGA

SEQ ID NO: 1677944 - protein, 19 aa, Staphylococcus aureus
AELLDWGDIRGFKTKFLRT

SEQ ID NO: 1677945 - protein, 23 aa, Staphylococcus aureus
AETKKLTGWYARRIAVGRDGEIQ

SEQ ID NO: 1677946 - protein, 18 aa, Staphylococcus aureus
AFESWSLTSKSERTQMLR

SEQ ID NO: 1677947 - protein, 22 aa, Staphylococcus aureus
AFGEALGAIIVRSNKLEAGTAI

SEQ ID NO: 1677948 - protein, 20 aa, Staphylococcus aureus
AFNFDCTFLAKAIARDGEGA

SEQ ID NO: 1677949 - protein, 20 aa, Staphylococcus aureus
AGGCFWCMTKPFDTFDGIEK

SEQ ID NO: 1677950 - protein, 21 aa, Staphylococcus aureus
AGGCFWCMVKPFTSYPGIRSV

SEQ ID NO: 1677951 - protein, 18 aa, Staphylococcus aureus
AGIGRYLLNRVDANATNV

SEQ ID NO: 1677952 - protein, 25 aa, Staphylococcus aureus
AGQRAVLKYKLKFENGLHQGDYFDF

SEQ ID NO: 1677953 - protein, 25 aa, Staphylococcus aureus
AGQTWTRNISDWIAKSGTTNFSLSM

SEQ ID NO: 1677954 - protein, 18 aa, Staphylococcus aureus
AGYVRCKLFLEKKEQKIH

SEQ ID NO: 1677955 - protein, 18 aa, Staphylococcus aureus
AHVPRRIKEIGPRIKKVS

SEQ ID NO: 1677956 - protein, 19 aa, Staphylococcus aureus
AIKALCQKLGYSVDQVIAF

SEQ ID NO: 1677957 - protein, 18 aa, Staphylococcus aureus
AIKSGWKMNDFVGPVDHG

SEQ ID NO: 1677958 - protein, 19 aa, Staphylococcus aureus
AIQGFIYRRARAHQLDTPY

SEQ ID NO: 1677959 - protein, 20 aa, Staphylococcus aureus
AIRYSVCNLIFKDKKTENKI

SEQ ID NO: 1677960 - protein, 22 aa, Staphylococcus aureus
AKAQGLEAFDNIQIDSTEKQKA

SEQ ID NO: 1677961 - protein, 17 aa, Staphylococcus aureus
AKIAYAILRDRLQLSIK

SEQ ID NO: 1677962 - protein, 18 aa, Staphylococcus aureus
AKLNPAICFTMLGHHLGV

SEQ ID NO: 1677963 - protein, 20 aa, Staphylococcus aureus
AKNWLYTFLKAIGIDDNNGQ

SEQ ID NO: 1677964 - protein, 17 aa, Staphylococcus aureus
AKPRLPFDHVFHHNKYR

SEQ ID NO: 1677965 - protein, 24 aa, Staphylococcus aureus
AKRDAYTNAVSRAEAILNKTQGAN

SEQ ID NO: 1677966 - protein, 17 aa, Staphylococcus aureus
AKSLLSIIDNTFLTPYL

SEQ ID NO: 1677967 - protein, 19 aa, Staphylococcus aureus
AKVLGSWRLARLHIICNLR

SEQ ID NO: 1677968 - protein, 18 aa, Staphylococcus aureus
AKYRGEFEERLKVVLKEV

SEQ ID NO: 1677969 - protein, 21 aa, Staphylococcus aureus
ALARFPWLSANIEYNVTKEPY

SEQ ID NO: 1677970 - protein, 17 aa, Staphylococcus aureus
ALFPNGGLYIHLDQATE

SEQ ID NO: 1677971 - protein, 17 aa, Staphylococcus aureus
ALNDSWPDLIFPESEIA

SEQ ID NO: 1677972 - protein, 22 aa, Staphylococcus aureus
ALRTLRLVIDMSKEPDLYLQIS

SEQ ID NO: 1677973 - protein, 25 aa, Staphylococcus aureus
ALWTLAQEVYQEWYLGSKLYEDVEK

SEQ ID NO: 1677974 - protein, 25 aa, Staphylococcus aureus
ALWTLAQEVYQEWYLGSKLYEEVEK

SEQ ID NO: 1677975 - protein, 17 aa, Staphylococcus aureus
AMLKAGFDVKNKTQLNW

SEQ ID NO: 1677976 - protein, 24 aa, Staphylococcus aureus
AMVRMAQDFSYRYPLVDGQGNFGS

SEQ ID NO: 1677977 - protein, 21 aa, Staphylococcus aureus
ANAGWKALFGLLLKGVGAKDI

SEQ ID NO: 1677978 - protein, 23 aa, Staphylococcus aureus
ANAGWKVLFGLLLKGVGAKDIPF

SEQ ID NO: 1677979 - protein, 17 aa, Staphylococcus aureus
ANDAWKKLVDKLKEKHI

SEQ ID NO: 1677980 - protein, 23 aa, Staphylococcus aureus
ANKPEIYICGGTKFLQSMIEALK

SEQ ID NO: 1677981 - protein, 17 aa, Staphylococcus aureus
ANLKSIEQVRAFEKQQL

SEQ ID NO: 1677982 - protein, 18 aa, Staphylococcus aureus
ANYIKARLSEHFEIPYKQ

SEQ ID NO: 1677983 - protein, 18 aa, Staphylococcus aureus
APALATGCSIVMKPSEIT

SEQ ID NO: 1677984 - protein, 18 aa, Staphylococcus aureus
APALATGCSLVMKPSEIT

SEQ ID NO: 1677985 - protein, 23 aa, Staphylococcus aureus
APIKLRTFSRLAMSTFASAATTS

SEQ ID NO: 1677986 - protein, 22 aa, Staphylococcus aureus
APKKAEHFHIFMGNDNDALLKE

SEQ ID NO: 1677987 - protein, 22 aa, Staphylococcus aureus
AQALDHAMELLRNSIADNQATL

SEQ ID NO: 1677988 - protein, 17 aa, Staphylococcus aureus
AQDPALKYQFLRLDQPQ

SEQ ID NO: 1677989 - protein, 19 aa, Staphylococcus aureus
AQELLNFIGDYTIVTILTV

SEQ ID NO: 1677990 - protein, 17 aa, Staphylococcus aureus
AQVVLRWHLAHNRIIIP

SEQ ID NO: 1677991 - protein, 17 aa, Staphylococcus aureus
AQVVLRWNVQHGVVIIP

SEQ ID NO: 1677992 - protein, 17 aa, Staphylococcus aureus
ARELIELIIAFMFHHQI

SEQ ID NO: 1677993 - protein, 18 aa, Staphylococcus aureus
ARKKYPLTLEELGGKVGV

SEQ ID NO: 1677994 - protein, 17 aa, Staphylococcus aureus
ARLKLLVALSNNLDKTE

SEQ ID NO: 1677995 - protein, 17 aa, Staphylococcus aureus
ARPKQIFTREQIIEKIW

SEQ ID NO: 1677996 - protein, 20 aa, Staphylococcus aureus
ARTDLGRYFDRFADKLDKTQ

SEQ ID NO: 1677997 - protein, 20 aa, Staphylococcus aureus
ARTLKFFKFFYTHRGPVMDY

SEQ ID NO: 1677998 - protein, 20 aa, Staphylococcus aureus
ARYNLGLALFMKNENIDEVI

SEQ ID NO: 1677999 - protein, 21 aa, Staphylococcus aureus
ASEISMMFGIHVDDAEKAVLS

SEQ ID NO: 1678000 - protein, 23 aa, Staphylococcus aureus
ASWRGPNKFKIQCVILICYYYDN

SEQ ID NO: 1678001 - protein, 20 aa, Staphylococcus aureus
ASWSPRLHFNASLFQIEDDD

SEQ ID NO: 1678002 - protein, 30 aa, Staphylococcus aureus
ASYRLEFYRLYLLMVHLLKFGEMYRDSVAQ

SEQ ID NO: 1678003 - protein, 18 aa, Staphylococcus aureus
ATINEFREAKAILLEEKE

SEQ ID NO: 1678004 - protein, 17 aa, Staphylococcus aureus
ATKPARIKLKWTPQIMH

SEQ ID NO: 1678005 - protein, 22 aa, Staphylococcus aureus
ATLKGVQPHIVIKPEAQQAIKA

SEQ ID NO: 1678006 - protein, 18 aa, Staphylococcus aureus
ATSHLLGYVGPINSEELK

SEQ ID NO: 1678007 - protein, 23 aa, Staphylococcus aureus
AVAEMKLAVGLLVDKKLSYMRIH

SEQ ID NO: 1678008 - protein, 24 aa, Staphylococcus aureus
AVETALKAARRWAYDVKGIEPNKA

SEQ ID NO: 1678009 - protein, 18 aa, Staphylococcus aureus
AVKQDLTEVQALDQLMDA

SEQ ID NO: 1678010 - protein, 18 aa, Staphylococcus aureus
AVKRQIEGATHVNEVTQA

SEQ ID NO: 1678011 - protein, 19 aa, Staphylococcus aureus
AVNVAKWFVGDYMTSLDMQ

SEQ ID NO: 1678012 - protein, 17 aa, Staphylococcus aureus
AVSRISPKMGMMKNSVL

SEQ ID NO: 1678013 - protein, 18 aa, Staphylococcus aureus
AVTRFRQGLGRLIRNEND

SEQ ID NO: 1678014 - protein, 18 aa, Staphylococcus aureus
AWPAGLIVLSGQSGVGKS

SEQ ID NO: 1678015 - protein, 22 aa, Staphylococcus aureus
AYLKEFTNLYALLIPKMNNMDD

SEQ ID NO: 1678016 - protein, 21 aa, Staphylococcus aureus
AYLKVAYQFSLPFGKDYADAH

SEQ ID NO: 1678017 - protein, 17 aa, Staphylococcus aureus
AYNQAVSAAETILNKQT

SEQ ID NO: 1678018 - protein, 18 aa, Staphylococcus aureus
CATLAWKALEKGTVAKEG

SEQ ID NO: 1678019 - protein, 17 aa, Staphylococcus aureus
CCQSCRWDYELLEVDDN

SEQ ID NO: 1678020 - protein, 17 aa, Staphylococcus aureus
CDVLCCYRLNRLHRNLK

SEQ ID NO: 1678021 - protein, 25 aa, Staphylococcus aureus
CEELFKAKLLLLVYLKIIPNINSFY

SEQ ID NO: 1678022 - protein, 18 aa, Staphylococcus aureus
CGSGSLLLRVGKETKVYR

SEQ ID NO: 1678023 - protein, 20 aa, Staphylococcus aureus
CKECLFYPYLLVQGEAGIGK

SEQ ID NO: 1678024 - protein, 20 aa, Staphylococcus aureus
CKIIDEFLCIDKSYSNSNFD

SEQ ID NO: 1678025 - protein, 17 aa, Staphylococcus aureus
CLDRGIKVISSMGAANK

SEQ ID NO: 1678026 - protein, 24 aa, Staphylococcus aureus
CLIFFKIWDLCKWNKTDNKVVLPN

SEQ ID NO: 1678027 - protein, 24 aa, Staphylococcus aureus
CNISESYCSILFVRYLSMNFKDYF

SEQ ID NO: 1678028 - protein, 20 aa, Staphylococcus aureus
CSAGSRLLVHEKIYDQLLPR

SEQ ID NO: 1678029 - protein, 20 aa, Staphylococcus aureus
CSAGSRLLVHEKIYNQLVPR

SEQ ID NO: 1678030 - protein, 21 aa, Staphylococcus aureus
CSSELEFLIELFISHNNIHSF

SEQ ID NO: 1678031 - protein, 21 aa, Staphylococcus aureus
CYEIYHPLESVGIYVPGGKAS

SEQ ID NO: 1678032 - protein, 17 aa, Staphylococcus aureus
CYMWLRFNMDQQFEDTA

SEQ ID NO: 1678033 - protein, 21 aa, Staphylococcus aureus
DAIKNKVSFLIDKKSGYFYIV

SEQ ID NO: 1678034 - protein, 26 aa, Staphylococcus aureus
DAVFEMMNWWFDKGIDGFRVDAITHI

SEQ ID NO: 1678035 - protein, 19 aa, Staphylococcus aureus
DAVLKRFNVALGDIEAVIT

SEQ ID NO: 1678036 - protein, 19 aa, Staphylococcus aureus
DAVTRFRQGLGRLIRNEND

SEQ ID NO: 1678037 - protein, 17 aa, Staphylococcus aureus
DDKAYKCSFYNPETTNT

SEQ ID NO: 1678038 - protein, 20 aa, Staphylococcus aureus
DEASLEFNVRPVPEYDNDFI

SEQ ID NO: 1678039 - protein, 20 aa, Staphylococcus aureus
DELYHLFVLMHALGIDFSEI

SEQ ID NO: 1678040 - protein, 17 aa, Staphylococcus aureus
DEMKGRIIGREGRNIRT

SEQ ID NO: 1678041 - protein, 17 aa, Staphylococcus aureus
DETLCTMWQGFNYEIDM

SEQ ID NO: 1678042 - protein, 17 aa, Staphylococcus aureus
DEWPNIGAIPDYEETLA

SEQ ID NO: 1678043 - protein, 20 aa, Staphylococcus aureus
DFLNEFRILAGYYDNIDENT

SEQ ID NO: 1678044 - protein, 24 aa, Staphylococcus aureus
DFPKDFKGIAGWILEIKSNTPGNT

SEQ ID NO: 1678045 - protein, 21 aa, Staphylococcus aureus
DFPLPKAFRDAGWFFDVLPGR

SEQ ID NO: 1678046 - protein, 20 aa, Staphylococcus aureus
DGELFRKNFVGVHDGSTNKY

SEQ ID NO: 1678047 - protein, 26 aa, Staphylococcus aureus
DGFTHLPGWVRKASVGLALFGAAIGP

SEQ ID NO: 1678048 - protein, 23 aa, Staphylococcus aureus
DHIRHLLEFKACTPIDIDRVEPV

SEQ ID NO: 1678049 - protein, 17 aa, Staphylococcus aureus
DIADLFLDSGLGKEAYS

SEQ ID NO: 1678050 - protein, 20 aa, Staphylococcus aureus
DIDYPIAIVFQASCFNEFVV

SEQ ID NO: 1678051 - protein, 24 aa, Staphylococcus aureus
DIEKEWKNAINFGKEVKNIKIEVK

SEQ ID NO: 1678052 - protein, 24 aa, Staphylococcus aureus
DILDIRFGSLWTNIPLAFLKSLEI

SEQ ID NO: 1678053 - protein, 18 aa, Staphylococcus aureus
DISVGAFFRARLGNEVLE

SEQ ID NO: 1678054 - protein, 23 aa, Staphylococcus aureus
DIVCAGASAVLFGSVNAIIGLTS

SEQ ID NO: 1678055 - protein, 17 aa, Staphylococcus aureus
DKDATKALVNFTDADQA

SEQ ID NO: 1678056 - protein, 17 aa, Staphylococcus aureus
DKDGLCLISEIRQHTDI

SEQ ID NO: 1678057 - protein, 23 aa, Staphylococcus aureus
DKLNELRSGFNIDNYITLEEYFE

SEQ ID NO: 1678058 - protein, 18 aa, Staphylococcus aureus
DKNNAKNVLFDWNDVEVH

SEQ ID NO: 1678059 - protein, 24 aa, Staphylococcus aureus
DKPRFKRWVIGSILSRTYYHNMVT

SEQ ID NO: 1678060 - protein, 19 aa, Staphylococcus aureus
DKRLRGVKAVQTLSRLNRT

SEQ ID NO: 1678061 - protein, 18 aa, Staphylococcus aureus
DKYRTWAWNYGRNPKYNF

SEQ ID NO: 1678062 - protein, 18 aa, Staphylococcus aureus
DLDFKLNLMLNAFSSDFY

SEQ ID NO: 1678063 - protein, 19 aa, Staphylococcus aureus
DLDFKLNLMLNAFSSDFYY

SEQ ID NO: 1678064 - protein, 20 aa, Staphylococcus aureus
DLFIDWTWGEKFFRKHLIDY

SEQ ID NO: 1678065 - protein, 23 aa, Staphylococcus aureus
DLLEIYYSWAFREIASAVTDKPS

SEQ ID NO: 1678066 - protein, 18 aa, Staphylococcus aureus
DLPLKEFALITGAALLAR

SEQ ID NO: 1678067 - protein, 21 aa, Staphylococcus aureus
DMKGAIKYAVKFYNYPNEYLL

SEQ ID NO: 1678068 - protein, 21 aa, Staphylococcus aureus
DNCAKYKYMGVCYGNPGVGKT

SEQ ID NO: 1678069 - protein, 22 aa, Staphylococcus aureus
DNESKLGGFDWFKRKTNKKDTH

SEQ ID NO: 1678070 - protein, 24 aa, Staphylococcus aureus
DNPRFKRWIIGSILSRTYYHNMVT

SEQ ID NO: 1678071 - protein, 26 aa, Staphylococcus aureus
DNPRFKRWVIGSILFRTYYHNMVTHL

SEQ ID NO: 1678072 - protein, 21 aa, Staphylococcus aureus
DPDVLRFFVISVHYRSPINYN

SEQ ID NO: 1678073 - protein, 22 aa, Staphylococcus aureus
DPDVLRFFVISVHYRSPINYNL

SEQ ID NO: 1678074 - protein, 18 aa, Staphylococcus aureus
DPFTCPHGRPIIINFSKY

SEQ ID NO: 1678075 - protein, 17 aa, Staphylococcus aureus
DPKRIAVVAPTYAGGLK

SEQ ID NO: 1678076 - protein, 17 aa, Staphylococcus aureus
DQCSVCHAVLPQIEDLM

SEQ ID NO: 1678077 - protein, 19 aa, Staphylococcus aureus
DQLRKCFKMTLNGLEDALN

SEQ ID NO: 1678078 - protein, 18 aa, Staphylococcus aureus
DQMFGWKSIKGYEVKNKT

SEQ ID NO: 1678079 - protein, 20 aa, Staphylococcus aureus
DRCFPIKAFYILNDDLNMTL

SEQ ID NO: 1678080 - protein, 22 aa, Staphylococcus aureus
DRNKVTWGYAKSILNTWLNANL

SEQ ID NO: 1678081 - protein, 27 aa, Staphylococcus aureus
DSGFYKTPKYSLGDYVWYDSNKDGKQD

SEQ ID NO: 1678082 - protein, 21 aa, Staphylococcus aureus
DSGKYKVIFEKPAGLTQTGTN

SEQ ID NO: 1678083 - protein, 17 aa, Staphylococcus aureus
DSLGFDHDTIWLSVLPI

SEQ ID NO: 1678084 - protein, 24 aa, Staphylococcus aureus
DSNWPICGIPEKFYTDHGKDYTSE

SEQ ID NO: 1678085 - protein, 21 aa, Staphylococcus aureus
DVDMLRMCRYPWKTKQRILGD

SEQ ID NO: 1678086 - protein, 24 aa, Staphylococcus aureus
DVDVPRTDWDWMIYPQGLYDQIMR

SEQ ID NO: 1678087 - protein, 20 aa, Staphylococcus aureus
DVELYIGAFIYLYFKNQPRN

SEQ ID NO: 1678088 - protein, 25 aa, Staphylococcus aureus
DVIEMSRPVKMNSLLKLYFDRNLLT

SEQ ID NO: 1678089 - protein, 17 aa, Staphylococcus aureus
DVLKLKANYTIDDSVKE

SEQ ID NO: 1678090 - protein, 21 aa, Staphylococcus aureus
DVLVCTVIGFPLGASTTATKA

SEQ ID NO: 1678091 - protein, 22 aa, Staphylococcus aureus
DVRGVRAAFCLGAEGVFVGSVL

SEQ ID NO: 1678092 - protein, 22 aa, Staphylococcus aureus
DYKNIPCNLWIDGHQTEIELTA

SEQ ID NO: 1678093 - protein, 17 aa, Staphylococcus aureus
EAAKRALASYSNLNNAQ

SEQ ID NO: 1678094 - protein, 18 aa, Staphylococcus aureus
EAEFKAKCIADFDKNIEY

SEQ ID NO: 1678095 - protein, 17 aa, Staphylococcus aureus
EAIKHFISKQIDRFRVA

SEQ ID NO: 1678096 - protein, 17 aa, Staphylococcus aureus
EAIKHFISKQVDRFRVA

SEQ ID NO: 1678097 - protein, 24 aa, Staphylococcus aureus
EALRTLRLVIDMSKEPDLYLQISA

SEQ ID NO: 1678098 - protein, 17 aa, Staphylococcus aureus
EALTLNGYFIKWKVLNA

SEQ ID NO: 1678099 - protein, 22 aa, Staphylococcus aureus
EANANRYTFVWKKSIQNHESKL

SEQ ID NO: 1678100 - protein, 17 aa, Staphylococcus aureus
ECARLLKKWGLPANRNT

SEQ ID NO: 1678101 - protein, 17 aa, Staphylococcus aureus
ECLSIMLLFVYFKSALK

SEQ ID NO: 1678102 - protein, 23 aa, Staphylococcus aureus
EDFKAAHIDTSFIIKTTEAKTGQ

SEQ ID NO: 1678103 - protein, 17 aa, Staphylococcus aureus
EDFKFFVQYGDFKDIND

SEQ ID NO: 1678104 - protein, 18 aa, Staphylococcus aureus
EDGHPEWIIPTDPARRND

SEQ ID NO: 1678105 - protein, 23 aa, Staphylococcus aureus
EDIPFSGAFSIKFRLSKQTITCT

SEQ ID NO: 1678106 - protein, 19 aa, Staphylococcus aureus
EDWSRFTIAVGKLSRTKIF

SEQ ID NO: 1678107 - protein, 17 aa, Staphylococcus aureus
EEEAKAWIDAVVNDTEP

SEQ ID NO: 1678108 - protein, 21 aa, Staphylococcus aureus
EEFMYPYYLTAFLRYRLGLDQ

SEQ ID NO: 1678109 - protein, 20 aa, Staphylococcus aureus
EEGHKLIGIRGMPRVGKTES

SEQ ID NO: 1678110 - protein, 21 aa, Staphylococcus aureus
EEILILLTLWQKGFMTLKEMD

SEQ ID NO: 1678111 - protein, 20 aa, Staphylococcus aureus
EEILILLTLWQKGSMMLKEM

SEQ ID NO: 1678112 - protein, 20 aa, Staphylococcus aureus
EFALITGAALLARRRTKNEK

SEQ ID NO: 1678113 - protein, 20 aa, Staphylococcus aureus
EFGDAPLLVKYLWDNLTDAP

SEQ ID NO: 1678114 - protein, 20 aa, Staphylococcus aureus
EFIERLACLPSHIYRLKGFM

SEQ ID NO: 1678115 - protein, 19 aa, Staphylococcus aureus
EFIGRVPIVANLETLDVTA

SEQ ID NO: 1678116 - protein, 20 aa, Staphylococcus aureus
EFKNYLGSIGRSFKEKFSKD

SEQ ID NO: 1678117 - protein, 18 aa, Staphylococcus aureus
EFMYPTFFSYEAIVGEKT

SEQ ID NO: 1678118 - protein, 21 aa, Staphylococcus aureus
EFRNYILGLIFYRFLSEKAEQ

SEQ ID NO: 1678119 - protein, 29 aa, Staphylococcus aureus
EGDTFTFKYGQYFRPGSVRLPSQTQNLYN

SEQ ID NO: 1678120 - protein, 18 aa, Staphylococcus aureus
EGEYAVGLFFSKERILGS

SEQ ID NO: 1678121 - protein, 20 aa, Staphylococcus aureus
EGLFTKGLRRRAKLLETILK

SEQ ID NO: 1678122 - protein, 19 aa, Staphylococcus aureus
EGLSLIPLPGMGFLKGAGK

SEQ ID NO: 1678123 - protein, 17 aa, Staphylococcus aureus
EGMKELFRQAGGIPRKI

SEQ ID NO: 1678124 - protein, 17 aa, Staphylococcus aureus
EGNMNIFIIEYDDINKD

SEQ ID NO: 1678125 - protein, 17 aa, Staphylococcus aureus
EGVDIVIHIGVNTVDLE

SEQ ID NO: 1678126 - protein, 24 aa, Staphylococcus aureus
EGVVVRLANFGAFVEIASGVQGLV

SEQ ID NO: 1678127 - protein, 24 aa, Staphylococcus aureus
EHFARKASNHWLRLMSVNEEGRFK

SEQ ID NO: 1678128 - protein, 18 aa, Staphylococcus aureus
EHMIRAALEGVIYNLYTV

SEQ ID NO: 1678129 - protein, 23 aa, Staphylococcus aureus
EHNPRAQAFYKRHGFKVVGEHHF

SEQ ID NO: 1678130 - protein, 30 aa, Staphylococcus aureus
EHNYPHCWRCGNPLIYYAMEGWFIKTTNFK

SEQ ID NO: 1678131 - protein, 18 aa, Staphylococcus aureus
EHSLKCLVLKLITENNQE

SEQ ID NO: 1678132 - protein, 20 aa, Staphylococcus aureus
EIGEAVGLASSFTVHGHLSR

SEQ ID NO: 1678133 - protein, 20 aa, Staphylococcus aureus
EIKKDIGMIFQHFNLLNSAT

SEQ ID NO: 1678134 - protein, 17 aa, Staphylococcus aureus
EIKPEFRNMLLNLKELD

SEQ ID NO: 1678135 - protein, 19 aa, Staphylococcus aureus
EIKTGAPLVYELTDDLEVI

SEQ ID NO: 1678136 - protein, 17 aa, Staphylococcus aureus
EILRSWISIISGNDNYI

SEQ ID NO: 1678137 - protein, 22 aa, Staphylococcus aureus
EIYGMKVARDLVHISGDTSDYH

SEQ ID NO: 1678138 - protein, 18 aa, Staphylococcus aureus
EIYHPLESVGIYVPGGKA

SEQ ID NO: 1678139 - protein, 17 aa, Staphylococcus aureus
EKAKAQGLEAFDNIQID

SEQ ID NO: 1678140 - protein, 18 aa, Staphylococcus aureus
EKALTYLLERGFTDALIK

SEQ ID NO: 1678141 - protein, 17 aa, Staphylococcus aureus
EKARLQLALLMLQRDNV

SEQ ID NO: 1678142 - protein, 19 aa, Staphylococcus aureus
EKEKLAGWHIGLPDIVQLQ

SEQ ID NO: 1678143 - protein, 28 aa, Staphylococcus aureus
EKFANFFKMLWLRLKAMKHYKALNKESK

SEQ ID NO: 1678144 - protein, 22 aa, Staphylococcus aureus
EKGKLGQIILCLSYTNHENIEL

SEQ ID NO: 1678145 - protein, 22 aa, Staphylococcus aureus
EKLIYRPIREMYIPIPNSKKFH

SEQ ID NO: 1678146 - protein, 19 aa, Staphylococcus aureus
EKQALKDRINQILQQGHNG

SEQ ID NO: 1678147 - protein, 20 aa, Staphylococcus aureus
EKSRCIPINLWVNGNHKTIS

SEQ ID NO: 1678148 - protein, 17 aa, Staphylococcus aureus
EKVRLQLALLMLQRDNV

SEQ ID NO: 1678149 - protein, 20 aa, Staphylococcus aureus
ELFDGMAIPTSEDWKKLQQD

SEQ ID NO: 1678150 - protein, 17 aa, Staphylococcus aureus
ELFIKLANEFNIELFEV

SEQ ID NO: 1678151 - protein, 17 aa, Staphylococcus aureus
ELGRFGVGLPRVSDGQL

SEQ ID NO: 1678152 - protein, 18 aa, Staphylococcus aureus
ELHRQTGHIIQWYIMTSD

SEQ ID NO: 1678153 - protein, 18 aa, Staphylococcus aureus
ELKAHSWGAAKQLDTASH

SEQ ID NO: 1678154 - protein, 19 aa, Staphylococcus aureus
ELKVSFDYIDWINSEFGQI

SEQ ID NO: 1678155 - protein, 18 aa, Staphylococcus aureus
ELLKQLQLDFGITYLFIT

SEQ ID NO: 1678156 - protein, 17 aa, Staphylococcus aureus
ELPFSWVYDENGITETM

SEQ ID NO: 1678157 - protein, 20 aa, Staphylococcus aureus
ELREEFNKRLNLIHQKLNDN

SEQ ID NO: 1678158 - protein, 18 aa, Staphylococcus aureus
ELVLRINNLLTRMKKYHH

SEQ ID NO: 1678159 - protein, 21 aa, Staphylococcus aureus
EMAELKLGLKTISFETSASSV

SEQ ID NO: 1678160 - protein, 19 aa, Staphylococcus aureus
EMIKRLSTPFMNLDHVQQF

SEQ ID NO: 1678161 - protein, 20 aa, Staphylococcus aureus
EMKPMIAEAFYKKFDEAGIL

SEQ ID NO: 1678162 - protein, 17 aa, Staphylococcus aureus
EMWFRNFSYFIHKIDSE

SEQ ID NO: 1678163 - protein, 17 aa, Staphylococcus aureus
ENFKFFVQYGDFKDISD

SEQ ID NO: 1678164 - protein, 17 aa, Staphylococcus aureus
ENFKFFVQYGDFKNLKN

SEQ ID NO: 1678165 - protein, 17 aa, Staphylococcus aureus
ENLKFFVQYGNFKDIND

SEQ ID NO: 1678166 - protein, 19 aa, Staphylococcus aureus
ENPKSGKVQLVYNEHVELI

SEQ ID NO: 1678167 - protein, 18 aa, Staphylococcus aureus
ENPRFVEDLIRLIAADLV

SEQ ID NO: 1678168 - protein, 24 aa, Staphylococcus aureus
EPALELVEGLKLVTEFIQDENATQ

SEQ ID NO: 1678169 - protein, 22 aa, Staphylococcus aureus
EPKRKGNKFVRDWNTDEKHNEW

SEQ ID NO: 1678170 - protein, 17 aa, Staphylococcus aureus
EQYKKFILDSGISSTQF

SEQ ID NO: 1678171 - protein, 22 aa, Staphylococcus aureus
EQYKRLEFNLSIALDDVESTAK

SEQ ID NO: 1678172 - protein, 19 aa, Staphylococcus aureus
ERICKRVDCDIDYEEDAEK

SEQ ID NO: 1678173 - protein, 17 aa, Staphylococcus aureus
ERLKAALLYTLEECIKQ

SEQ ID NO: 1678174 - protein, 27 aa, Staphylococcus aureus
ERVTLKYKWKFGEGIKAGDYFDFTLSD

SEQ ID NO: 1678175 - protein, 19 aa, Staphylococcus aureus
ESFIEYLLFRYRFKSRIAV

SEQ ID NO: 1678176 - protein, 24 aa, Staphylococcus aureus
ESHACPICGFSIGELEPRMFSFNS

SEQ ID NO: 1678177 - protein, 19 aa, Staphylococcus aureus
ESIIAYAIYLSRYEYSIYK

SEQ ID NO: 1678178 - protein, 18 aa, Staphylococcus aureus
ESKFTIMMLLSYEKDMIL

SEQ ID NO: 1678179 - protein, 17 aa, Staphylococcus aureus
ESLDMFLNIILKESNRI

SEQ ID NO: 1678180 - protein, 18 aa, Staphylococcus aureus
ESMASFLNSFPMFKDDTR

SEQ ID NO: 1678181 - protein, 20 aa, Staphylococcus aureus
ESPEILAFIKSFKKYIANEQ

SEQ ID NO: 1678182 - protein, 17 aa, Staphylococcus aureus
ESYEIFYANALDVQVSI

SEQ ID NO: 1678183 - protein, 20 aa, Staphylococcus aureus
ETAGPLCYRAEPVGCTATIL

SEQ ID NO: 1678184 - protein, 23 aa, Staphylococcus aureus
ETLKESKPYLFAPSKPVGNSPQQ

SEQ ID NO: 1678185 - protein, 19 aa, Staphylococcus aureus
ETRAGTLLRYYTGLLERSK

SEQ ID NO: 1678186 - protein, 20 aa, Staphylococcus aureus
ETSIMLQECVTFLNESFNIS

SEQ ID NO: 1678187 - protein, 23 aa, Staphylococcus aureus
EVADELYHLFVLMHALGVDFSEI

SEQ ID NO: 1678188 - protein, 19 aa, Staphylococcus aureus
EVHSSLPFLLTGDVSCNHA

SEQ ID NO: 1678189 - protein, 17 aa, Staphylococcus aureus
EVIPGKMSLVIADIMDE

SEQ ID NO: 1678190 - protein, 22 aa, Staphylococcus aureus
EVIYRMGFGQAVSRGILTDYKV

SEQ ID NO: 1678191 - protein, 19 aa, Staphylococcus aureus
EVLDTLLLKNYRILQLQKI

SEQ ID NO: 1678192 - protein, 17 aa, Staphylococcus aureus
EVLITEIYDDYFLKNDE

SEQ ID NO: 1678193 - protein, 19 aa, Staphylococcus aureus
EVLTGFKFIAQEIRQLDDH

SEQ ID NO: 1678194 - protein, 22 aa, Staphylococcus aureus
EVQCVVCLPAALLNENSDAIRL

SEQ ID NO: 1678195 - protein, 17 aa, Staphylococcus aureus
EVWLADKRVELVTRHII

SEQ ID NO: 1678196 - protein, 22 aa, Staphylococcus aureus
EWREPGCSMCLGMNPDQVPDGV

SEQ ID NO: 1678197 - protein, 21 aa, Staphylococcus aureus
EWTNGKFLPKRKVVKIEHFEN

SEQ ID NO: 1678198 - protein, 17 aa, Staphylococcus aureus
EYTKYKIGGTWYPFYKK

SEQ ID NO: 1678199 - protein, 24 aa, Staphylococcus aureus
EYTKYKIGGTWYQFYKKVDEELTK

SEQ ID NO: 1678200 - protein, 17 aa, Staphylococcus aureus
FAEKVIFPHVEQNELLG

SEQ ID NO: 1678201 - protein, 17 aa, Staphylococcus aureus
FAGGFPGKFIIDTLNNS

SEQ ID NO: 1678202 - protein, 18 aa, Staphylococcus aureus
FALITGAALLARRCTKNE

SEQ ID NO: 1678203 - protein, 23 aa, Staphylococcus aureus
FALKKRGKYAVAITYTGDGGSSQ

SEQ ID NO: 1678204 - protein, 25 aa, Staphylococcus aureus
FASDWSEVRPEWGLAKNSSFIIGRR

SEQ ID NO: 1678205 - protein, 18 aa, Staphylococcus aureus
FDDAKRLANALINSDNTN

SEQ ID NO: 1678206 - protein, 22 aa, Staphylococcus aureus
FDEAYYLYTIVCVDIGEQVKIR

SEQ ID NO: 1678207 - protein, 21 aa, Staphylococcus aureus
FDYYAGLSFRTLVPKYPAMSP

SEQ ID NO: 1678208 - protein, 24 aa, Staphylococcus aureus
FEQTEVRLALSFLRAIDNPLQDIY

SEQ ID NO: 1678209 - protein, 20 aa, Staphylococcus aureus
FERPFIVAISIMYLFEMLSI

SEQ ID NO: 1678210 - protein, 20 aa, Staphylococcus aureus
FFGICLGHQLFALSQGARSF

SEQ ID NO: 1678211 - protein, 20 aa, Staphylococcus aureus
FFGICLGHQLFALSQGASSF

SEQ ID NO: 1678212 - protein, 21 aa, Staphylococcus aureus
FGIAGLRLGVLISTAGTIQRI

SEQ ID NO: 1678213 - protein, 19 aa, Staphylococcus aureus
FGSPIKWNFTKFIIDRQAN

SEQ ID NO: 1678214 - protein, 18 aa, Staphylococcus aureus
FIICDEAHRTTGITEEGK

SEQ ID NO: 1678215 - protein, 18 aa, Staphylococcus aureus
FIKKAIAYYRFRPYAKKI

SEQ ID NO: 1678216 - protein, 23 aa, Staphylococcus aureus
FILGETLYNFGLIPQGLEVFRVL

SEQ ID NO: 1678217 - protein, 17 aa, Staphylococcus aureus
FILKHLSNIYIEYLNIH

SEQ ID NO: 1678218 - protein, 18 aa, Staphylococcus aureus
FIQSLDLLEEFNFNYFRG

SEQ ID NO: 1678219 - protein, 24 aa, Staphylococcus aureus
FKAGSHCRFCKINHSCRTRAEYMQ

SEQ ID NO: 1678220 - protein, 18 aa, Staphylococcus aureus
FKAKCIADFDKNIEYNQT

SEQ ID NO: 1678221 - protein, 22 aa, Staphylococcus aureus
FKFKDVMLKYYFNEDELTETQI

SEQ ID NO: 1678222 - protein, 18 aa, Staphylococcus aureus
FKGAHGLLYEQELGLQAT

SEQ ID NO: 1678223 - protein, 17 aa, Staphylococcus aureus
FKGAHGLLYEQELGLQV

SEQ ID NO: 1678224 - protein, 22 aa, Staphylococcus aureus
FKGQDAFEFKPYVKLIFASNEL

SEQ ID NO: 1678225 - protein, 17 aa, Staphylococcus aureus
FKKMHIRMMPAQEPPYT

SEQ ID NO: 1678226 - protein, 20 aa, Staphylococcus aureus
FKLGASIGRYSGRIHNAKFK

SEQ ID NO: 1678227 - protein, 20 aa, Staphylococcus aureus
FKNRIWGGHALKAFNYDIPN

SEQ ID NO: 1678228 - protein, 17 aa, Staphylococcus aureus
FKNRLDIPKSYRMTDIN

SEQ ID NO: 1678229 - protein, 17 aa, Staphylococcus aureus
FKNTEFHKMFNFKDKEF

SEQ ID NO: 1678230 - protein, 21 aa, Staphylococcus aureus
FKPEEYWTIEGEFRYKKSKFN

SEQ ID NO: 1678231 - protein, 17 aa, Staphylococcus aureus
FKPELLSVLGRTHNTED

SEQ ID NO: 1678232 - protein, 19 aa, Staphylococcus aureus
FKQILLPLLYQRGSGGGSM

SEQ ID NO: 1678233 - protein, 20 aa, Staphylococcus aureus
FKRFHVRGAEKIFKEMGLVF

SEQ ID NO: 1678234 - protein, 20 aa, Staphylococcus aureus
FKRKGAELANFYTGIINDLL

SEQ ID NO: 1678235 - protein, 17 aa, Staphylococcus aureus
FKSAFPLPNTEYTPLYL

SEQ ID NO: 1678236 - protein, 20 aa, Staphylococcus aureus
FKYMNSWCLEYSEFLLDEVR

SEQ ID NO: 1678237 - protein, 18 aa, Staphylococcus aureus
FLEAAGFYDAHLKDCPSK

SEQ ID NO: 1678238 - protein, 21 aa, Staphylococcus aureus
FLFELRMQWLNRLEKSSDEAI

SEQ ID NO: 1678239 - protein, 23 aa, Staphylococcus aureus
FLRRCPNLKWIAWFATGVNILPL

SEQ ID NO: 1678240 - protein, 23 aa, Staphylococcus aureus
FMSEKRLATSLLLGRALELMCRL

SEQ ID NO: 1678241 - protein, 17 aa, Staphylococcus aureus
FNGAFDLILKQNKVRDA

SEQ ID NO: 1678242 - protein, 19 aa, Staphylococcus aureus
FNQHIKLKIVLIHSKLSRT

SEQ ID NO: 1678243 - protein, 18 aa, Staphylococcus aureus
FNVLRLARRYILTNKSGA

SEQ ID NO: 1678244 - protein, 20 aa, Staphylococcus aureus
FPEIIFLDAISLRIFENYTL

SEQ ID NO: 1678245 - protein, 20 aa, Staphylococcus aureus
FPEIIFLDVISLRTFENYTL

SEQ ID NO: 1678246 - protein, 20 aa, Staphylococcus aureus
FPKEVFEYYLGISNNIMNDK

SEQ ID NO: 1678247 - protein, 20 aa, Staphylococcus aureus
FPLPKAFRDAGWFFDVLPGH

SEQ ID NO: 1678248 - protein, 20 aa, Staphylococcus aureus
FPQDYTVTWTNAKIANRPTD

SEQ ID NO: 1678249 - protein, 17 aa, Staphylococcus aureus
FPTTRTLFLLLLGFKNS

SEQ ID NO: 1678250 - protein, 17 aa, Staphylococcus aureus
FQLLFMLATRPKQIFTR

SEQ ID NO: 1678251 - protein, 17 aa, Staphylococcus aureus
FRFGKSIGRQYGFQIDL

SEQ ID NO: 1678252 - protein, 18 aa, Staphylococcus aureus
FRGIRSNIMFSKANGEVK

SEQ ID NO: 1678253 - protein, 17 aa, Staphylococcus aureus
FRKGGISKKTVYTVTPE

SEQ ID NO: 1678254 - protein, 19 aa, Staphylococcus aureus
FRNYILGLIFYCFLSEKAE

SEQ ID NO: 1678255 - protein, 21 aa, Staphylococcus aureus
FRSRFRMLVEAQLDLLKNKDW

SEQ ID NO: 1678256 - protein, 17 aa, Staphylococcus aureus
FSASVFHYWLENYEVDN

SEQ ID NO: 1678257 - protein, 17 aa, Staphylococcus aureus
FSKDLGYWVDMDSPYIT

SEQ ID NO: 1678258 - protein, 17 aa, Staphylococcus aureus
FSLRAGIIDIFPLIGEP

SEQ ID NO: 1678259 - protein, 18 aa, Staphylococcus aureus
FSYKCFIKDIKYKKLLKD

SEQ ID NO: 1678260 - protein, 19 aa, Staphylococcus aureus
FTGFGPRIVRINNFSVDLK

SEQ ID NO: 1678261 - protein, 21 aa, Staphylococcus aureus
FTKFKSCLKKHSFEQIMQGTR

SEQ ID NO: 1678262 - protein, 17 aa, Staphylococcus aureus
FTLNMLYPYIDEILITK

SEQ ID NO: 1678263 - protein, 19 aa, Staphylococcus aureus
FTRLNFYLIDLFRQQNQLK

SEQ ID NO: 1678264 - protein, 20 aa, Staphylococcus aureus
FTRNEVRIMLGEEPSDNPEL

SEQ ID NO: 1678265 - protein, 19 aa, Staphylococcus aureus
FYHFWIQGIFARWTDNPNI

SEQ ID NO: 1678266 - protein, 17 aa, Staphylococcus aureus
FYKEQFDTLSYFQLKVL

SEQ ID NO: 1678267 - protein, 18 aa, Staphylococcus aureus
GAFLCYDYLYSLNITDIK

SEQ ID NO: 1678268 - protein, 19 aa, Staphylococcus aureus
GAGFELGIATGRPYTETVV

SEQ ID NO: 1678269 - protein, 18 aa, Staphylococcus aureus
GALKFQLPNDVIKRDGSY

SEQ ID NO: 1678270 - protein, 17 aa, Staphylococcus aureus
GALLMFAGSKSYYLYGA

SEQ ID NO: 1678271 - protein, 18 aa, Staphylococcus aureus
GAMLKAGFDVKDKTQLNW

SEQ ID NO: 1678272 - protein, 17 aa, Staphylococcus aureus
GCIMMRVCHKDTCPVGV

SEQ ID NO: 1678273 - protein, 21 aa, Staphylococcus aureus
GCLPDCLVEWSAKRLKEQGAN

SEQ ID NO: 1678274 - protein, 18 aa, Staphylococcus aureus
GDCTICVDRCPTNALVGN

SEQ ID NO: 1678275 - protein, 18 aa, Staphylococcus aureus
GDGIKAIFNYPSQETAEG

SEQ ID NO: 1678276 - protein, 19 aa, Staphylococcus aureus
GDIAVSVYSGWLAYSTFDH

SEQ ID NO: 1678277 - protein, 22 aa, Staphylococcus aureus
GDKFLYYFLEWFATQNKWIRFS

SEQ ID NO: 1678278 - protein, 19 aa, Staphylococcus aureus
GDMTFKLFLNIAPKTVENF

SEQ ID NO: 1678279 - protein, 24 aa, Staphylococcus aureus
GDTFKFKYGQYFRPGSVRLPSQTQ

SEQ ID NO: 1678280 - protein, 17 aa, Staphylococcus aureus
GEAEFFKKVFVGYTDSE

SEQ ID NO: 1678281 - protein, 19 aa, Staphylococcus aureus
GEEQIEWFDVLNLAGSRVP

SEQ ID NO: 1678282 - protein, 25 aa, Staphylococcus aureus
GEGLAIKAHEEFKVIAPFSGKVSMI

SEQ ID NO: 1678283 - protein, 21 aa, Staphylococcus aureus
GEIPPKHAVIFLNGNKKDFRI

SEQ ID NO: 1678284 - protein, 17 aa, Staphylococcus aureus
GENYIDIVWLARKNAYQ

SEQ ID NO: 1678285 - protein, 24 aa, Staphylococcus aureus
GEVIYRMGFGQAVSRGILTDYKVM

SEQ ID NO: 1678286 - protein, 18 aa, Staphylococcus aureus
GEVWAYYRIRSESISTAN

SEQ ID NO: 1678287 - protein, 17 aa, Staphylococcus aureus
GFMPGFPYLGGLDEQLH

SEQ ID NO: 1678288 - protein, 18 aa, Staphylococcus aureus
GFPSIPLKIMFPQLKVTI

SEQ ID NO: 1678289 - protein, 24 aa, Staphylococcus aureus
GFYRFWAQGIFARWTDNPNIEDLI

SEQ ID NO: 1678290 - protein, 17 aa, Staphylococcus aureus
GGHRVSSLIAWIHDDFG

SEQ ID NO: 1678291 - protein, 29 aa, Staphylococcus aureus
GHGNGGDGIGFAFSPGVLGETGLNGAAVG

SEQ ID NO: 1678292 - protein, 17 aa, Staphylococcus aureus
GHIIVWFGLTWSLELYQ

SEQ ID NO: 1678293 - protein, 22 aa, Staphylococcus aureus
GHLPDCLVEWSAKRLKEQGANA

SEQ ID NO: 1678294 - protein, 18 aa, Staphylococcus aureus
GHSVRFGKTKAFAEVNGE

SEQ ID NO: 1678295 - protein, 20 aa, Staphylococcus aureus
GHVKGYFIYPYQEVMKDSNI

SEQ ID NO: 1678296 - protein, 20 aa, Staphylococcus aureus
GHWGEFIPFFLERMDEALFA

SEQ ID NO: 1678297 - protein, 19 aa, Staphylococcus aureus
GIAGLRLGVLISTAETIQR

SEQ ID NO: 1678298 - protein, 24 aa, Staphylococcus aureus
GIATLKGVEPHIVVKPEAQEAIKA

SEQ ID NO: 1678299 - protein, 19 aa, Staphylococcus aureus
GIAYELAKFLKLKLTVANR

SEQ ID NO: 1678300 - protein, 19 aa, Staphylococcus aureus
GIDVFRIFDSLNWVDQMKV

SEQ ID NO: 1678301 - protein, 20 aa, Staphylococcus aureus
GIECIYGLYKKNCRSLQIYG

SEQ ID NO: 1678302 - protein, 18 aa, Staphylococcus aureus
GIEWIGYIPKYWTITKLK

SEQ ID NO: 1678303 - protein, 22 aa, Staphylococcus aureus
GIGFDLRNFWTLKLNSETMKKS

SEQ ID NO: 1678304 - protein, 22 aa, Staphylococcus aureus
GIGGLSNAFGFKLDTYHNTSKP

SEQ ID NO: 1678305 - protein, 18 aa, Staphylococcus aureus
GIILKKWTTIRFMNVVPD

SEQ ID NO: 1678306 - protein, 21 aa, Staphylococcus aureus
GKARTGWLIVDYAGYPWPGYD

SEQ ID NO: 1678307 - protein, 22 aa, Staphylococcus aureus
GKEYLQSLVIEYFRIQKEQDSK

SEQ ID NO: 1678308 - protein, 22 aa, Staphylococcus aureus
GKEYLQSLVIEYYRIQKEQDSK

SEQ ID NO: 1678309 - protein, 17 aa, Staphylococcus aureus
GKGYAKFAFEKAIIYAF

SEQ ID NO: 1678310 - protein, 18 aa, Staphylococcus aureus
GKHGFAFSSGVAAISVVV

SEQ ID NO: 1678311 - protein, 20 aa, Staphylococcus aureus
GKLGLCYIGLRLLNPETIDS

SEQ ID NO: 1678312 - protein, 21 aa, Staphylococcus aureus
GKLGVKVWIYRGEVLPTKNTN

SEQ ID NO: 1678313 - protein, 17 aa, Staphylococcus aureus
GKLKLPTFQRALVWSNN

SEQ ID NO: 1678314 - protein, 23 aa, Staphylococcus aureus
GKPMKPFLGVRGWYLSEYSKHKY

SEQ ID NO: 1678315 - protein, 17 aa, Staphylococcus aureus
GKSAIEWIMDQYQVKTD

SEQ ID NO: 1678316 - protein, 19 aa, Staphylococcus aureus
GKTKLVYIKSIQDLTESVK

SEQ ID NO: 1678317 - protein, 18 aa, Staphylococcus aureus
GKVQLVYNEHVELIEVPI

SEQ ID NO: 1678318 - protein, 23 aa, Staphylococcus aureus
GLAPEAWLECYLDRTLLPILKLY

SEQ ID NO: 1678319 - protein, 22 aa, Staphylococcus aureus
GLDPWTSCEFDFTREGKLNVSF

SEQ ID NO: 1678320 - protein, 22 aa, Staphylococcus aureus
GLELGCLFVFYGHTHVAKYEYI

SEQ ID NO: 1678321 - protein, 22 aa, Staphylococcus aureus
GLEPWTSCEFDFTREGKLKVSF

SEQ ID NO: 1678322 - protein, 17 aa, Staphylococcus aureus
GLEPWTSCEFDFTSEGK

SEQ ID NO: 1678323 - protein, 18 aa, Staphylococcus aureus
GLEPWTSCEFDFTSEGKL

SEQ ID NO: 1678324 - protein, 17 aa, Staphylococcus aureus
GLGVAKRAQSFGMKVLA

SEQ ID NO: 1678325 - protein, 18 aa, Staphylococcus aureus
GLRMKACRVLVNTPSAVG

SEQ ID NO: 1678326 - protein, 18 aa, Staphylococcus aureus
GLVVSVRVGMEMDRSELL

SEQ ID NO: 1678327 - protein, 19 aa, Staphylococcus aureus
GMIPVEWEKVYTIAYLDDE

SEQ ID NO: 1678328 - protein, 19 aa, Staphylococcus aureus
GNKRIDYRLSYNFYTTYYD

SEQ ID NO: 1678329 - protein, 20 aa, Staphylococcus aureus
GNLGRLGETVAFLSASGQDS

SEQ ID NO: 1678330 - protein, 18 aa, Staphylococcus aureus
GNQPKVRIFEYLGNNEDI

SEQ ID NO: 1678331 - protein, 21 aa, Staphylococcus aureus
GNYELRLPLVSLKDTDTKVLR

SEQ ID NO: 1678332 - protein, 18 aa, Staphylococcus aureus
GPAALRCSQFVYKEKKIK

SEQ ID NO: 1678333 - protein, 18 aa, Staphylococcus aureus
GPFLSCPVGYQFQPGGYC

SEQ ID NO: 1678334 - protein, 22 aa, Staphylococcus aureus
GPKGRFGGLVYDTLGFNAVDKK

SEQ ID NO: 1678335 - protein, 18 aa, Staphylococcus aureus
GPTLRLFKVPDNVRNLKI

SEQ ID NO: 1678336 - protein, 19 aa, Staphylococcus aureus
GQSGLKYSIDYIVSETKSQ

SEQ ID NO: 1678337 - protein, 18 aa, Staphylococcus aureus
GRENLTFFARIYMRDKED

SEQ ID NO: 1678338 - protein, 22 aa, Staphylococcus aureus
GRKSVFLMLNIKKGIFKTHPNL

SEQ ID NO: 1678339 - protein, 25 aa, Staphylococcus aureus
GRPAQCVFLSWNRYLYRNAQNYITS

SEQ ID NO: 1678340 - protein, 20 aa, Staphylococcus aureus
GRTVRCYRAFFGGNNAGHTI

SEQ ID NO: 1678341 - protein, 18 aa, Staphylococcus aureus
GSGSLLLRVGKEAKVYRY

SEQ ID NO: 1678342 - protein, 17 aa, Staphylococcus aureus
GSGSLLLRVGKETQVYR

SEQ ID NO: 1678343 - protein, 18 aa, Staphylococcus aureus
GSIGLLAIQWARIFGAAH

SEQ ID NO: 1678344 - protein, 22 aa, Staphylococcus aureus
GSRAPIAISILVKDGSYNHDIY

SEQ ID NO: 1678345 - protein, 18 aa, Staphylococcus aureus
GSSLKPFLAYGPAIENMK

SEQ ID NO: 1678346 - protein, 23 aa, Staphylococcus aureus
GVKEYKVGDPILFNETNKYSPIL

SEQ ID NO: 1678347 - protein, 22 aa, Staphylococcus aureus
GVLVCTVIGFPLGASTTATKAF

SEQ ID NO: 1678348 - protein, 17 aa, Staphylococcus aureus
GVLYPGVSDMYDAKQYV

SEQ ID NO: 1678349 - protein, 19 aa, Staphylococcus aureus
GYFARPTIFINVNNQMTIA

SEQ ID NO: 1678350 - protein, 18 aa, Staphylococcus aureus
GYFHGFKGYNFFLNKEEE

SEQ ID NO: 1678351 - protein, 19 aa, Staphylococcus aureus
HAGYVRCKLFLEKEEEKIH

SEQ ID NO: 1678352 - protein, 23 aa, Staphylococcus aureus
HAKELRAKLDLILGDTDNPHKIT

SEQ ID NO: 1678353 - protein, 18 aa, Staphylococcus aureus
HATYNWKTRLRMLNHFPK

SEQ ID NO: 1678354 - protein, 18 aa, Staphylococcus aureus
HCFGCKKGGNVFQFTQEI

SEQ ID NO: 1678355 - protein, 18 aa, Staphylococcus aureus
HCVTRLRLVLKDESKVDK

SEQ ID NO: 1678356 - protein, 23 aa, Staphylococcus aureus
HEVQCVVCLPAALLNENSDAIRL

SEQ ID NO: 1678357 - protein, 18 aa, Staphylococcus aureus
HGDKALKMYNLTFDHAKT

SEQ ID NO: 1678358 - protein, 18 aa, Staphylococcus aureus
HGEWKLKSSDEFIKDNRI

SEQ ID NO: 1678359 - protein, 20 aa, Staphylococcus aureus
HGGYLIKVLNNWAKENVKTK

SEQ ID NO: 1678360 - protein, 20 aa, Staphylococcus aureus
HHEMIKKLLIEFIIDNKDSK

SEQ ID NO: 1678361 - protein, 17 aa, Staphylococcus aureus
HHLRLLKNLGIAKYRKE

SEQ ID NO: 1678362 - protein, 18 aa, Staphylococcus aureus
HIIKRISMLEVMLPSAIK

SEQ ID NO: 1678363 - protein, 20 aa, Staphylococcus aureus
HIYEISSLIYKVTMKIKIKA

SEQ ID NO: 1678364 - protein, 17 aa, Staphylococcus aureus
HIYRLKGFMTFEDTAHT

SEQ ID NO: 1678365 - protein, 19 aa, Staphylococcus aureus
HKLEWLYRRCLEFLERYET

SEQ ID NO: 1678366 - protein, 23 aa, Staphylococcus aureus
HLNEIVICISFLFLTIFIGGCGT

SEQ ID NO: 1678367 - protein, 24 aa, Staphylococcus aureus
HLQMAAKHWLCINEDDLVWATAAP

SEQ ID NO: 1678368 - protein, 18 aa, Staphylococcus aureus
HLVLKWKFNKDEGKYFTD

SEQ ID NO: 1678369 - protein, 20 aa, Staphylococcus aureus
HMHVLLCVENAYFRKKENYI

SEQ ID NO: 1678370 - protein, 18 aa, Staphylococcus aureus
HNLKSRFSSYGFDVLEIN

SEQ ID NO: 1678371 - protein, 19 aa, Staphylococcus aureus
HNLTFAIEFCSKAIANNTK

SEQ ID NO: 1678372 - protein, 22 aa, Staphylococcus aureus
HNPRAQAFYKRHGFKEVGEHHF

SEQ ID NO: 1678373 - protein, 19 aa, Staphylococcus aureus
HPEGIYLSGALLMFAGSKS

SEQ ID NO: 1678374 - protein, 17 aa, Staphylococcus aureus
HQWIGFIGLNYIPETSD

SEQ ID NO: 1678375 - protein, 19 aa, Staphylococcus aureus
HRFGEGIGRQYGFGINLIS

SEQ ID NO: 1678376 - protein, 18 aa, Staphylococcus aureus
HSECGWPSFSKALDDEEI

SEQ ID NO: 1678377 - protein, 17 aa, Staphylococcus aureus
HSITAIWNFEKQNYYLK

SEQ ID NO: 1678378 - protein, 24 aa, Staphylococcus aureus
HTFATSLPAKFVVKDVQPAKPTVT

SEQ ID NO: 1678379 - protein, 20 aa, Staphylococcus aureus
HTPESISFLLTDEGAGAQVP

SEQ ID NO: 1678380 - protein, 29 aa, Staphylococcus aureus
HVPPWILIIPLNFGETIKWLSILKPKDKQ

SEQ ID NO: 1678381 - protein, 18 aa, Staphylococcus aureus
IADLLNLKVSWIDSKNKE

SEQ ID NO: 1678382 - protein, 17 aa, Staphylococcus aureus
IAGVFGIPLHKFGIETA

SEQ ID NO: 1678383 - protein, 21 aa, Staphylococcus aureus
IANNIKPIFGMTIYVTNGLNT

SEQ ID NO: 1678384 - protein, 25 aa, Staphylococcus aureus
IATLKGVQPHIVIKPEVQQAIKASA

SEQ ID NO: 1678385 - protein, 18 aa, Staphylococcus aureus
ICGSWNCLSSNFPGKEWT

SEQ ID NO: 1678386 - protein, 19 aa, Staphylococcus aureus
ICLSLFLAKAFKKGFITFS

SEQ ID NO: 1678387 - protein, 17 aa, Staphylococcus aureus
ICPNCKTSEFFNDGSVG

SEQ ID NO: 1678388 - protein, 19 aa, Staphylococcus aureus
IDNIKKVLLFLSRNTSSSG

SEQ ID NO: 1678389 - protein, 17 aa, Staphylococcus aureus
IDRALVWGFTWKLGPFQ

SEQ ID NO: 1678390 - protein, 19 aa, Staphylococcus aureus
IDSNKSFHFSGKVNLGNKY

SEQ ID NO: 1678391 - protein, 22 aa, Staphylococcus aureus
IDYKGDIFLAWDAVQGDLPLSV

SEQ ID NO: 1678392 - protein, 18 aa, Staphylococcus aureus
IEDFKFFVQYGDFKDIND

SEQ ID NO: 1678393 - protein, 19 aa, Staphylococcus aureus
IEEFKFFVQYGNFKELENY

SEQ ID NO: 1678394 - protein, 18 aa, Staphylococcus aureus
IEFDRSWEKIGVRFVESL

SEQ ID NO: 1678395 - protein, 18 aa, Staphylococcus aureus
IEFDRSWEKIGVRLVQSL

SEQ ID NO: 1678396 - protein, 17 aa, Staphylococcus aureus
IEFVEWVNTLEFFKNWK

SEQ ID NO: 1678397 - protein, 20 aa, Staphylococcus aureus
IEGIAYDRLWIHLIPVIKEQ

SEQ ID NO: 1678398 - protein, 27 aa, Staphylococcus aureus
IEKRLSRYPQLYSRIGFSHQFDKLTND

SEQ ID NO: 1678399 - protein, 17 aa, Staphylococcus aureus
IELDEAIGIMVSQVIYE

SEQ ID NO: 1678400 - protein, 19 aa, Staphylococcus aureus
IELDFYFPLLKSWSKKKKN

SEQ ID NO: 1678401 - protein, 17 aa, Staphylococcus aureus
IELEFYFTPPKSWSKKK

SEQ ID NO: 1678402 - protein, 17 aa, Staphylococcus aureus
IELLKKYGLEKITLSNI

SEQ ID NO: 1678403 - protein, 17 aa, Staphylococcus aureus
IEMIKPKISLISSGKNN

SEQ ID NO: 1678404 - protein, 19 aa, Staphylococcus aureus
IENFKFFVQYGDFKDINDY

SEQ ID NO: 1678405 - protein, 17 aa, Staphylococcus aureus
IERAAKVLGSWRLARLH

SEQ ID NO: 1678406 - protein, 23 aa, Staphylococcus aureus
IESGWSRYEFLSFLNREINEEHV

SEQ ID NO: 1678407 - protein, 17 aa, Staphylococcus aureus
IEVEIAGPIVIENKFID

SEQ ID NO: 1678408 - protein, 18 aa, Staphylococcus aureus
IFIHHVALHVSHRKDLKF

SEQ ID NO: 1678409 - protein, 22 aa, Staphylococcus aureus
IFNGLKRRAQTILDENRNNVPL

SEQ ID NO: 1678410 - protein, 17 aa, Staphylococcus aureus
IFPSCRVAYMVLPYSIM

SEQ ID NO: 1678411 - protein, 29 aa, Staphylococcus aureus
IFRKLNIEWIYRALIDWKRIGRLKSIPIF

SEQ ID NO: 1678412 - protein, 22 aa, Staphylococcus aureus
IFRLGFGEAVARGYLTDYKVMV

SEQ ID NO: 1678413 - protein, 18 aa, Staphylococcus aureus
IGIGRVFRGKMRVGDNVS

SEQ ID NO: 1678414 - protein, 17 aa, Staphylococcus aureus
IHLKRIKIADLELDSNL

SEQ ID NO: 1678415 - protein, 17 aa, Staphylococcus aureus
IHVLKHFDRIEDVVVKV

SEQ ID NO: 1678416 - protein, 18 aa, Staphylococcus aureus
IIDEFLCIDKSYSNSNFD

SEQ ID NO: 1678417 - protein, 19 aa, Staphylococcus aureus
IIQKPIRSVQEVQTALTNV

SEQ ID NO: 1678418 - protein, 17 aa, Staphylococcus aureus
IKAISDKVLQEFLEKNN

SEQ ID NO: 1678419 - protein, 17 aa, Staphylococcus aureus
IKAVVGISAADIGQNFR

SEQ ID NO: 1678420 - protein, 17 aa, Staphylococcus aureus
IKCINTFDTIKICTDKL

SEQ ID NO: 1678421 - protein, 17 aa, Staphylococcus aureus
IKEAIYGKIVRKVGNRR

SEQ ID NO: 1678422 - protein, 17 aa, Staphylococcus aureus
IKELRRLGANVYVSIEN

SEQ ID NO: 1678423 - protein, 20 aa, Staphylococcus aureus
IKFKEEFEPRKFVFTNGEIK

SEQ ID NO: 1678424 - protein, 20 aa, Staphylococcus aureus
IKFLFELQDGYTIETVLMRH

SEQ ID NO: 1678425 - protein, 20 aa, Staphylococcus aureus
IKFSSAWSFLVPAILQIDED

SEQ ID NO: 1678426 - protein, 21 aa, Staphylococcus aureus
IKGIGAWTVQMFMLFQFPHVA

SEQ ID NO: 1678427 - protein, 18 aa, Staphylococcus aureus
IKGNVNWMRARQHKLIET

SEQ ID NO: 1678428 - protein, 22 aa, Staphylococcus aureus
IKHLRLNNIYPIIVHGGGPFIN

SEQ ID NO: 1678429 - protein, 17 aa, Staphylococcus aureus
IKIADLELDSNLESGNY

SEQ ID NO: 1678430 - protein, 18 aa, Staphylococcus aureus
IKKDIGMIFQHFNLLNSA

SEQ ID NO: 1678431 - protein, 23 aa, Staphylococcus aureus
IKKGWASMMYRIWKNPEKYKSYF

SEQ ID NO: 1678432 - protein, 24 aa, Staphylococcus aureus
IKKGWPSMMYRIWKNPEKYKAYFI

SEQ ID NO: 1678433 - protein, 21 aa, Staphylococcus aureus
IKKGYCLLVGIGQDSTEQDAD

SEQ ID NO: 1678434 - protein, 18 aa, Staphylococcus aureus
IKLFSEFFGENMLVKNIT

SEQ ID NO: 1678435 - protein, 17 aa, Staphylococcus aureus
IKNGWKMNDFVGPVDHG

SEQ ID NO: 1678436 - protein, 18 aa, Staphylococcus aureus
IKNMLLYSFIGLINKYST

SEQ ID NO: 1678437 - protein, 24 aa, Staphylococcus aureus
IKPGVKRMEWMLAKFNNPQNNIKG

SEQ ID NO: 1678438 - protein, 22 aa, Staphylococcus aureus
IKPGVKRMEWMLAQFNNPQNNI

SEQ ID NO: 1678439 - protein, 21 aa, Staphylococcus aureus
IKQRALNRMAVNTVAAPQQGT

SEQ ID NO: 1678440 - protein, 22 aa, Staphylococcus aureus
IKQRVTEMLEFVGLSDKKDQFP

SEQ ID NO: 1678441 - protein, 17 aa, Staphylococcus aureus
IKQSITIRNNEAIVDNI

SEQ ID NO: 1678442 - protein, 19 aa, Staphylococcus aureus
IKRDIGMIFQHFNLLNSAT

SEQ ID NO: 1678443 - protein, 19 aa, Staphylococcus aureus
IKSRVEAFLPEIKSIGMAI

SEQ ID NO: 1678444 - protein, 18 aa, Staphylococcus aureus
IKYMFPKAHAAAYVLMAV

SEQ ID NO: 1678445 - protein, 24 aa, Staphylococcus aureus
IKYWAELKGVFELFDVEMPIVMPR

SEQ ID NO: 1678446 - protein, 17 aa, Staphylococcus aureus
ILDSFKGILKFQIPNDV

SEQ ID NO: 1678447 - protein, 21 aa, Staphylococcus aureus
ILFEKHFEPVPGIKMQHSGGH

SEQ ID NO: 1678448 - protein, 19 aa, Staphylococcus aureus
ILFILSLFRKINWKVYDES

SEQ ID NO: 1678449 - protein, 21 aa, Staphylococcus aureus
ILGLKDKTDWVGHKIDEGIDN

SEQ ID NO: 1678450 - protein, 25 aa, Staphylococcus aureus
ILKGYDFISVLGWPTYYANLGYQRA

SEQ ID NO: 1678451 - protein, 22 aa, Staphylococcus aureus
ILKRGLKVISHFAHKHLTEQKC

SEQ ID NO: 1678452 - protein, 17 aa, Staphylococcus aureus
ILRHRGIDAGLPKRPFK

SEQ ID NO: 1678453 - protein, 21 aa, Staphylococcus aureus
ILRKEVIDFTNLIKGTDKEAP

SEQ ID NO: 1678454 - protein, 21 aa, Staphylococcus aureus
ILRKEVISFTKLIKGTDKEAP

SEQ ID NO: 1678455 - protein, 27 aa, Staphylococcus aureus
ILTVPRIQRVIQILIQRVTQDQTTTQT

SEQ ID NO: 1678456 - protein, 17 aa, Staphylococcus aureus
IMIKTLQYWSAHKDEVD

SEQ ID NO: 1678457 - protein, 21 aa, Staphylococcus aureus
IMIYEAFGWEPPRFGHMSLIV

SEQ ID NO: 1678458 - protein, 22 aa, Staphylococcus aureus
IMQRLGRAFALLKVTGEVLNDI

SEQ ID NO: 1678459 - protein, 20 aa, Staphylococcus aureus
IMQRLGRAFALLQVTGEVLN

SEQ ID NO: 1678460 - protein, 23 aa, Staphylococcus aureus
INCNHKLDFALAIRTMMIDEQYI

SEQ ID NO: 1678461 - protein, 18 aa, Staphylococcus aureus
INEFYWVSTYVMKGLWRN

SEQ ID NO: 1678462 - protein, 17 aa, Staphylococcus aureus
INFFSLFSKFVINIPKM

SEQ ID NO: 1678463 - protein, 22 aa, Staphylococcus aureus
INLPKWMHYALKMYQIAPRFFE

SEQ ID NO: 1678464 - protein, 17 aa, Staphylococcus aureus
INQIGWYLDFEKDIDVI

SEQ ID NO: 1678465 - protein, 18 aa, Staphylococcus aureus
INSYFLIITYRIDKESKQ

SEQ ID NO: 1678466 - protein, 17 aa, Staphylococcus aureus
IPAIEAIVPQNDPDAND

SEQ ID NO: 1678467 - protein, 18 aa, Staphylococcus aureus
IPAKARRKGGHPAKRVFQ

SEQ ID NO: 1678468 - protein, 22 aa, Staphylococcus aureus
IPFFGICLGHQLFALSQGASSF

SEQ ID NO: 1678469 - protein, 26 aa, Staphylococcus aureus
IPHEMKLVPNWVLWRAEWNEKQQNFG

SEQ ID NO: 1678470 - protein, 18 aa, Staphylococcus aureus
IPIKALTSYLGFGNYELR

SEQ ID NO: 1678471 - protein, 19 aa, Staphylococcus aureus
IPNEFLKYTGRVHAQAYFT

SEQ ID NO: 1678472 - protein, 23 aa, Staphylococcus aureus
IPNEFLKYTGRVHAQAYFTQNGS

SEQ ID NO: 1678473 - protein, 17 aa, Staphylococcus aureus
IPSRIAFAVSSQTDSRT

SEQ ID NO: 1678474 - protein, 17 aa, Staphylococcus aureus
IPTCILVFKKCRQQDDN

SEQ ID NO: 1678475 - protein, 21 aa, Staphylococcus aureus
IPVYLGMPIGIVFEVEGKTIY

SEQ ID NO: 1678476 - protein, 20 aa, Staphylococcus aureus
IQIATPIQIAIRIQTVSQTQ

SEQ ID NO: 1678477 - protein, 25 aa, Staphylococcus aureus
IQQAIWYKLLVNLGINSITALGRQT

SEQ ID NO: 1678478 - protein, 24 aa, Staphylococcus aureus
IQVCARLIYLLSLQKGVKCINLKT

SEQ ID NO: 1678479 - protein, 26 aa, Staphylococcus aureus
IQVGLGRTGKWFAMEWEQVIPDIYIL

SEQ ID NO: 1678480 - protein, 26 aa, Staphylococcus aureus
IQVGLGRTGKWLAMEWEQVVPDIYIL

SEQ ID NO: 1678481 - protein, 17 aa, Staphylococcus aureus
IRESKVISGTQFIIELL

SEQ ID NO: 1678482 - protein, 23 aa, Staphylococcus aureus
IRFLKLKVGKIINVAKVDIIAFD

SEQ ID NO: 1678483 - protein, 17 aa, Staphylococcus aureus
IRGEGAFCNGIKMKEPP

SEQ ID NO: 1678484 - protein, 18 aa, Staphylococcus aureus
IRLSCKGLQQFNHAKTKQ

SEQ ID NO: 1678485 - protein, 18 aa, Staphylococcus aureus
IRNGWCYGNTGVMTTLFL

SEQ ID NO: 1678486 - protein, 23 aa, Staphylococcus aureus
IRPETLFKYEYFKKYVVEDIHNN

SEQ ID NO: 1678487 - protein, 22 aa, Staphylococcus aureus
IRSAVYLLLCKMIRQPNFAVLE

SEQ ID NO: 1678488 - protein, 18 aa, Staphylococcus aureus
IRSNIMFSKANGEVKRLL

SEQ ID NO: 1678489 - protein, 19 aa, Staphylococcus aureus
IRTPLLSVEFFNLFLNTEQ

SEQ ID NO: 1678490 - protein, 22 aa, Staphylococcus aureus
IRVLRELDFHFQLVIDANESLI

SEQ ID NO: 1678491 - protein, 21 aa, Staphylococcus aureus
IRVLRELEFHFQLVIDANESL

SEQ ID NO: 1678492 - protein, 17 aa, Staphylococcus aureus
IRYYSCSNFRNKGSKVC

SEQ ID NO: 1678493 - protein, 21 aa, Staphylococcus aureus
ISGMIPIEWEKVYTIAYVDDE

SEQ ID NO: 1678494 - protein, 20 aa, Staphylococcus aureus
ISGMIPVEWEKVYTMAYIDD

SEQ ID NO: 1678495 - protein, 19 aa, Staphylococcus aureus
ISNMIPVEWEKVYTMAYID

SEQ ID NO: 1678496 - protein, 23 aa, Staphylococcus aureus
ISQTRLAYLVLRGMGMSEGMIQE

SEQ ID NO: 1678497 - protein, 19 aa, Staphylococcus aureus
ISSMILVEWEKVYTMAYID

SEQ ID NO: 1678498 - protein, 19 aa, Staphylococcus aureus
ISWKAKGILLYLLSRPDNW

SEQ ID NO: 1678499 - protein, 19 aa, Staphylococcus aureus
ISYDDAIEFLKAEGFDDIE

SEQ ID NO: 1678500 - protein, 23 aa, Staphylococcus aureus
ITQALDHAMELLRNSIADNQATL

SEQ ID NO: 1678501 - protein, 21 aa, Staphylococcus aureus
ITQNEIVTWILVYTTSIEDMK

SEQ ID NO: 1678502 - protein, 25 aa, Staphylococcus aureus
IVEKSLRGAAIWDELKDRLHTNAYS

SEQ ID NO: 1678503 - protein, 23 aa, Staphylococcus aureus
IVFKYAGAYGWSISHHDFLSHPH

SEQ ID NO: 1678504 - protein, 19 aa, Staphylococcus aureus
IVGFKCRKAFDLFEFPEKI

SEQ ID NO: 1678505 - protein, 20 aa, Staphylococcus aureus
IVMPRLRITYLNDRIEKILS

SEQ ID NO: 1678506 - protein, 19 aa, Staphylococcus aureus
IVMPRLRITYLNDRIEKLL

SEQ ID NO: 1678507 - protein, 18 aa, Staphylococcus aureus
IVNKLGLVEGWKRDGLTD

SEQ ID NO: 1678508 - protein, 18 aa, Staphylococcus aureus
IVPDFLLNRVYRTDPKTL

SEQ ID NO: 1678509 - protein, 19 aa, Staphylococcus aureus
IVPLLLFSAMHYLKDIPNI

SEQ ID NO: 1678510 - protein, 26 aa, Staphylococcus aureus
IVTPIQIAIRIQRVIQTQVVTPIHQV

SEQ ID NO: 1678511 - protein, 20 aa, Staphylococcus aureus
IVTRIQRVIQIQIAIQNQIV

SEQ ID NO: 1678512 - protein, 19 aa, Staphylococcus aureus
IVVGNAYGRIRAMVNDLGQ

SEQ ID NO: 1678513 - protein, 17 aa, Staphylococcus aureus
IWERWLHKQGYKDIHLD

SEQ ID NO: 1678514 - protein, 24 aa, Staphylococcus aureus
IWIAKSCFLTGVFLSNLDQEYSDA

SEQ ID NO: 1678515 - protein, 21 aa, Staphylococcus aureus
IWSNSKFKLALKVQDRQDSNE

SEQ ID NO: 1678516 - protein, 17 aa, Staphylococcus aureus
IYFSQEGYSIWFEEFER

SEQ ID NO: 1678517 - protein, 17 aa, Staphylococcus aureus
IYGDVKWTAPLTVDETV

SEQ ID NO: 1678518 - protein, 19 aa, Staphylococcus aureus
IYLELWVKVQRDWRNKVNF

SEQ ID NO: 1678519 - protein, 18 aa, Staphylococcus aureus
IYMPHWLEFYSIAIHSDV

SEQ ID NO: 1678520 - protein, 18 aa, Staphylococcus aureus
IYQFPLLLFYRGNIKLIN

SEQ ID NO: 1678521 - protein, 26 aa, Staphylococcus aureus
IYQLKDGYKYYSFVDSIGLHSGSHVF

SEQ ID NO: 1678522 - protein, 21 aa, Staphylococcus aureus
IYVKLGVNVGREFSGNHFCMV

SEQ ID NO: 1678523 - protein, 18 aa, Staphylococcus aureus
KAEELAISIINNINKAIS

SEQ ID NO: 1678524 - protein, 25 aa, Staphylococcus aureus
KAEFIKRLACLPSHIYRLKGFMRFE

SEQ ID NO: 1678525 - protein, 23 aa, Staphylococcus aureus
KAGSHCRFCKINHSCRTRAEYMQ

SEQ ID NO: 1678526 - protein, 23 aa, Staphylococcus aureus
KAIYKRDYLCILGQTVYDKLGHE

SEQ ID NO: 1678527 - protein, 22 aa, Staphylococcus aureus
KALEVKKRFSAWAEINLKHFKE

SEQ ID NO: 1678528 - protein, 18 aa, Staphylococcus aureus
KAPSRYGMSLTRNTSRFY

SEQ ID NO: 1678529 - protein, 19 aa, Staphylococcus aureus
KAQLYLSSYGPKQYVEHLN

SEQ ID NO: 1678530 - protein, 20 aa, Staphylococcus aureus
KARTGWLIVDYAGYTWPGYD

SEQ ID NO: 1678531 - protein, 19 aa, Staphylococcus aureus
KASNLKLAITAGVGSDHVD

SEQ ID NO: 1678532 - protein, 19 aa, Staphylococcus aureus
KAWAKRVYPELSVEEAYIK

SEQ ID NO: 1678533 - protein, 20 aa, Staphylococcus aureus
KCATLAWKALEKGTVAKEGK

SEQ ID NO: 1678534 - protein, 18 aa, Staphylococcus aureus
KDAFKLYDTYGFPIELTE

SEQ ID NO: 1678535 - protein, 19 aa, Staphylococcus aureus
KDCKVRQSFELASPKHTEG

SEQ ID NO: 1678536 - protein, 21 aa, Staphylococcus aureus
KDGRYLYKYMDSFGDPQFVYS

SEQ ID NO: 1678537 - protein, 21 aa, Staphylococcus aureus
KDIDYPIAIVFQASCFNEFVV

SEQ ID NO: 1678538 - protein, 19 aa, Staphylococcus aureus
KDIPFDELVLFSSARSAGK

SEQ ID NO: 1678539 - protein, 23 aa, Staphylococcus aureus
KDPKRPIGSFIFLGPTGVGKTEL

SEQ ID NO: 1678540 - protein, 19 aa, Staphylococcus aureus
KEAKFENGVITRKADEKTP

SEQ ID NO: 1678541 - protein, 20 aa, Staphylococcus aureus
KEALKAQVTSAGRVSAANGV

SEQ ID NO: 1678542 - protein, 23 aa, Staphylococcus aureus
KEALKAQVTSAGRVSAANGVEHT

SEQ ID NO: 1678543 - protein, 24 aa, Staphylococcus aureus
KEALKAQVTSAGRVSVANGVEHTA

SEQ ID NO: 1678544 - protein, 18 aa, Staphylococcus aureus
KEARMKRGLTREQVGTMI

SEQ ID NO: 1678545 - protein, 19 aa, Staphylococcus aureus
KEDLEFIIDKFFKKIQQER

SEQ ID NO: 1678546 - protein, 18 aa, Staphylococcus aureus
KEFLSLIPNVTWNYIKTK

SEQ ID NO: 1678547 - protein, 17 aa, Staphylococcus aureus
KEFQLLFMLATRPKQIF

SEQ ID NO: 1678548 - protein, 20 aa, Staphylococcus aureus
KEFYCNNCGFKIYQEKITKK

SEQ ID NO: 1678549 - protein, 17 aa, Staphylococcus aureus
KEILQAMRVGVGAPSQK

SEQ ID NO: 1678550 - protein, 22 aa, Staphylococcus aureus
KEIYYTWRLIFMISYHVDLQNH

SEQ ID NO: 1678551 - protein, 22 aa, Staphylococcus aureus
KEKPMEWRGWVFLNEMLISEGD

SEQ ID NO: 1678552 - protein, 19 aa, Staphylococcus aureus
KELLKYFPSDYKKPEEKTS

SEQ ID NO: 1678553 - protein, 19 aa, Staphylococcus aureus
KELLQCFDYLIKHKRHATR

SEQ ID NO: 1678554 - protein, 23 aa, Staphylococcus aureus
KELPMEYAVEMNRLIKFEMEDSI

SEQ ID NO: 1678555 - protein, 20 aa, Staphylococcus aureus
KELRDTLHFEMLWDTSKIYK

SEQ ID NO: 1678556 - protein, 27 aa, Staphylococcus aureus
KEPDALVLVDWLCDIESLNDVDVLVEL

SEQ ID NO: 1678557 - protein, 24 aa, Staphylococcus aureus
KEPYRIGLKLSNGGWVYVQGLTHY

SEQ ID NO: 1678558 - protein, 18 aa, Staphylococcus aureus
KEQFDTLSYFQLKVLIVG

SEQ ID NO: 1678559 - protein, 21 aa, Staphylococcus aureus
KESYMGFKVNDIFLIEEFMRG

SEQ ID NO: 1678560 - protein, 18 aa, Staphylococcus aureus
KEVARIYGYDDIPSTLPV

SEQ ID NO: 1678561 - protein, 17 aa, Staphylococcus aureus
KEVFSRCSYKGARILID

SEQ ID NO: 1678562 - protein, 17 aa, Staphylococcus aureus
KEVQLIGAIVLHEGNIA

SEQ ID NO: 1678563 - protein, 21 aa, Staphylococcus aureus
KEYLQSLVIEYFRIEKEKDKK

SEQ ID NO: 1678564 - protein, 17 aa, Staphylococcus aureus
KFKEEFEPRKFVFTNGE

SEQ ID NO: 1678565 - protein, 19 aa, Staphylococcus aureus
KFKEEFEPRKFVFTNGEIK

SEQ ID NO: 1678566 - protein, 17 aa, Staphylococcus aureus
KFSRLPQDINFFAWLQH

SEQ ID NO: 1678567 - protein, 18 aa, Staphylococcus aureus
KGDSRFYLSLQDELMIRF

SEQ ID NO: 1678568 - protein, 22 aa, Staphylococcus aureus
KGFFKFIPVVAEWVSELPSLML

SEQ ID NO: 1678569 - protein, 20 aa, Staphylococcus aureus
KGIECIYGLYKKNRRSLQIY

SEQ ID NO: 1678570 - protein, 17 aa, Staphylococcus aureus
KGIKCVMIAKLPFMNKH

SEQ ID NO: 1678571 - protein, 20 aa, Staphylococcus aureus
KGIVRIGSATGFVVGKNTIL

SEQ ID NO: 1678572 - protein, 18 aa, Staphylococcus aureus
KGKIAMESWGVWRVIESQ

SEQ ID NO: 1678573 - protein, 19 aa, Staphylococcus aureus
KGKNLYLIDGIKISELEDE

SEQ ID NO: 1678574 - protein, 28 aa, Staphylococcus aureus
KGKRVLDLGCGYGWHCIYAMENGASSVV

SEQ ID NO: 1678575 - protein, 18 aa, Staphylococcus aureus
KGLCRKEILFAIDHFNQI

SEQ ID NO: 1678576 - protein, 19 aa, Staphylococcus aureus
KGLDFAFGLSMTSKNVARY

SEQ ID NO: 1678577 - protein, 23 aa, Staphylococcus aureus
KGLEFPFIICITTSVLNSNTNIR

SEQ ID NO: 1678578 - protein, 18 aa, Staphylococcus aureus
KGLWRNQLLYAFDHLNIC

SEQ ID NO: 1678579 - protein, 24 aa, Staphylococcus aureus
KGMKEARKGVGYKAEIEVHTTLFS

SEQ ID NO: 1678580 - protein, 17 aa, Staphylococcus aureus
KGNDYIRDWNTKEKHNE

SEQ ID NO: 1678581 - protein, 21 aa, Staphylococcus aureus
KHCDNCGGAIRPDIVSYGEML

SEQ ID NO: 1678582 - protein, 21 aa, Staphylococcus aureus
KHCDNCGGTIRPDIVLYGEML

SEQ ID NO: 1678583 - protein, 17 aa, Staphylococcus aureus
KHLDAIIILSDYNRRYL

SEQ ID NO: 1678584 - protein, 24 aa, Staphylococcus aureus
KHTLDYYAGLSFRTLVPKYPAMSP

SEQ ID NO: 1678585 - protein, 18 aa, Staphylococcus aureus
KIGDRVSVAWMFESCGRC

SEQ ID NO: 1678586 - protein, 21 aa, Staphylococcus aureus
KIKKIEAAYKMSQNRNEQDYN

SEQ ID NO: 1678587 - protein, 18 aa, Staphylococcus aureus
KINASDFLMYYANETEKQ

SEQ ID NO: 1678588 - protein, 26 aa, Staphylococcus aureus
KIRREGIYFKGLRYFSTTLIAYITED

SEQ ID NO: 1678589 - protein, 18 aa, Staphylococcus aureus
KIVLRWLKEQGIQVDLLN

SEQ ID NO: 1678590 - protein, 20 aa, Staphylococcus aureus
KKDFTGISFLNLVDFDALYG

SEQ ID NO: 1678591 - protein, 19 aa, Staphylococcus aureus
KKELLLLLMRLMKVKVKGY

SEQ ID NO: 1678592 - protein, 20 aa, Staphylococcus aureus
KKELLSAGIIDDAWLTEIEA

SEQ ID NO: 1678593 - protein, 17 aa, Staphylococcus aureus
KKEMRLDELIKWARSNP

SEQ ID NO: 1678594 - protein, 22 aa, Staphylococcus aureus
KKESPEILAFIRSFKKYIANEQ

SEQ ID NO: 1678595 - protein, 21 aa, Staphylococcus aureus
KKEYEKFGRWFFNKFNVNRSA

SEQ ID NO: 1678596 - protein, 19 aa, Staphylococcus aureus
KKGFLLDGFPRTIEQAEAL

SEQ ID NO: 1678597 - protein, 19 aa, Staphylococcus aureus
KKGPFAPDFIKVWNERYKK

SEQ ID NO: 1678598 - protein, 17 aa, Staphylococcus aureus
KKILNFINEFIFADKLP

SEQ ID NO: 1678599 - protein, 17 aa, Staphylococcus aureus
KKIRLHITQGIMSGEGY

SEQ ID NO: 1678600 - protein, 23 aa, Staphylococcus aureus
KKKAVAFDFFQDNGFGFITPYNL

SEQ ID NO: 1678601 - protein, 22 aa, Staphylococcus aureus
KKMRRLALRSALSFKAQENGLT

SEQ ID NO: 1678602 - protein, 17 aa, Staphylococcus aureus
KKMSFAKFKSCLKKHTF

SEQ ID NO: 1678603 - protein, 23 aa, Staphylococcus aureus
KKPEAYTDFDILKRTHLLSTNYH

SEQ ID NO: 1678604 - protein, 18 aa, Staphylococcus aureus
KKPIKVILSKSGNIHFNQ

SEQ ID NO: 1678605 - protein, 19 aa, Staphylococcus aureus
KKPSSFVIKPLPKNKYPDS

SEQ ID NO: 1678606 - protein, 17 aa, Staphylococcus aureus
KKRQCAILEDAKVTAVM

SEQ ID NO: 1678607 - protein, 17 aa, Staphylococcus aureus
KLFGHVYIKDCKVRQSF

SEQ ID NO: 1678608 - protein, 19 aa, Staphylococcus aureus
KLFKVFAYCLMKASHKDHT

SEQ ID NO: 1678609 - protein, 21 aa, Staphylococcus aureus
KLLKRRILGIGFVLPEGQVFT

SEQ ID NO: 1678610 - protein, 22 aa, Staphylococcus aureus
KLNELRNGFNIDNGITLEEYFE

SEQ ID NO: 1678611 - protein, 19 aa, Staphylococcus aureus
KLNHLRENIKLFVVIGQLN

SEQ ID NO: 1678612 - protein, 26 aa, Staphylococcus aureus
KLNMIIGHWGEFIPFFLERMDEALFT

SEQ ID NO: 1678613 - protein, 27 aa, Staphylococcus aureus
KLNMIIGHWGEFIPFFLERMDEALFTE

SEQ ID NO: 1678614 - protein, 24 aa, Staphylococcus aureus
KLPESVLRLKGYVSFRNQPNAIYE

SEQ ID NO: 1678615 - protein, 17 aa, Staphylococcus aureus
KLSERRIFPAIDIGRSS

SEQ ID NO: 1678616 - protein, 20 aa, Staphylococcus aureus
KLTSEHLVEFMPIIYDPVVA

SEQ ID NO: 1678617 - protein, 19 aa, Staphylococcus aureus
KMADQIFLKKQRVLDKVKV

SEQ ID NO: 1678618 - protein, 20 aa, Staphylococcus aureus
KMTGYGLKTTAVIGGAFTVN

SEQ ID NO: 1678619 - protein, 18 aa, Staphylococcus aureus
KMYHAMAHKFGDNWKKAQ

SEQ ID NO: 1678620 - protein, 17 aa, Staphylococcus aureus
KNFKFFVQYGNFKDLKN

SEQ ID NO: 1678621 - protein, 17 aa, Staphylococcus aureus
KNHMLIAVTELRTKGEI

SEQ ID NO: 1678622 - protein, 23 aa, Staphylococcus aureus
KNIIDFISGYAFKSELFTISDNN

SEQ ID NO: 1678623 - protein, 17 aa, Staphylococcus aureus
KNISFKVPQGFVTGFIG

SEQ ID NO: 1678624 - protein, 21 aa, Staphylococcus aureus
KNKNLRLAIAQAIDKKGYVDS

SEQ ID NO: 1678625 - protein, 18 aa, Staphylococcus aureus
KNVLFDWNDVEVHRNKNF

SEQ ID NO: 1678626 - protein, 20 aa, Staphylococcus aureus
KPEEYWTIEGEFRYKKSKFN

SEQ ID NO: 1678627 - protein, 17 aa, Staphylococcus aureus
KPSSFVIKPLPKNKYPD

SEQ ID NO: 1678628 - protein, 23 aa, Staphylococcus aureus
KPTRRGQLIAGRILFLQEKLAKG

SEQ ID NO: 1678629 - protein, 18 aa, Staphylococcus aureus
KQFMEFYEDFYFDGEEWE

SEQ ID NO: 1678630 - protein, 20 aa, Staphylococcus aureus
KQQPSPDCLMLFQHHNLLSW

SEQ ID NO: 1678631 - protein, 20 aa, Staphylococcus aureus
KQVPVCCFTFGIPNESIIKR

SEQ ID NO: 1678632 - protein, 18 aa, Staphylococcus aureus
KQYGFKFLGPVTVFSFLA

SEQ ID NO: 1678633 - protein, 19 aa, Staphylococcus aureus
KREALEMAERVDLDLVVVA

SEQ ID NO: 1678634 - protein, 19 aa, Staphylococcus aureus
KREWYDGRGFLSCSRILGE

SEQ ID NO: 1678635 - protein, 19 aa, Staphylococcus aureus
KRFKGAHGLLYEHQLGLQA

SEQ ID NO: 1678636 - protein, 19 aa, Staphylococcus aureus
KRGGFCYELNTFFKTYLQQ

SEQ ID NO: 1678637 - protein, 17 aa, Staphylococcus aureus
KRIDYRLSYNFYITYYD

SEQ ID NO: 1678638 - protein, 19 aa, Staphylococcus aureus
KRLIVPSIEREIHADLTEK

SEQ ID NO: 1678639 - protein, 17 aa, Staphylococcus aureus
KRLKWWMDLLLLTNHSD

SEQ ID NO: 1678640 - protein, 21 aa, Staphylococcus aureus
KRLLDKWGMSSSELMAFGDAN

SEQ ID NO: 1678641 - protein, 17 aa, Staphylococcus aureus
KRPGLDRAIEFARSGDT

SEQ ID NO: 1678642 - protein, 23 aa, Staphylococcus aureus
KRRKNSYFMPKWSLVNRLGNPNA

SEQ ID NO: 1678643 - protein, 18 aa, Staphylococcus aureus
KRRVMWLPIYTKPAKKEK

SEQ ID NO: 1678644 - protein, 20 aa, Staphylococcus aureus
KRTRSSLALFIMICTGCHVS

SEQ ID NO: 1678645 - protein, 18 aa, Staphylococcus aureus
KRVYDLLETVGLSKEHAN

SEQ ID NO: 1678646 - protein, 23 aa, Staphylococcus aureus
KSDLEIMGYFFLKIVNIKLEKDV

SEQ ID NO: 1678647 - protein, 17 aa, Staphylococcus aureus
KSERLRQFFDFITNFGI

SEQ ID NO: 1678648 - protein, 22 aa, Staphylococcus aureus
KSFLAKLLWLYTSFFKGQMIYW

SEQ ID NO: 1678649 - protein, 19 aa, Staphylococcus aureus
KSLAWEYISTLNLEDEAEF

SEQ ID NO: 1678650 - protein, 20 aa, Staphylococcus aureus
KSLKRTPSFSVNRPGEETGV

SEQ ID NO: 1678651 - protein, 27 aa, Staphylococcus aureus
KSLMKLGFKGGEKFAVKTGLQKTMQQA

SEQ ID NO: 1678652 - protein, 18 aa, Staphylococcus aureus
KSNAWGWANATRAQTSSA

SEQ ID NO: 1678653 - protein, 17 aa, Staphylococcus aureus
KSNFYRDKLGYLFQNYG

SEQ ID NO: 1678654 - protein, 19 aa, Staphylococcus aureus
KSRFSSYGFDVLEINGHDY

SEQ ID NO: 1678655 - protein, 18 aa, Staphylococcus aureus
KSYMVRWSKEYSEKHNLN

SEQ ID NO: 1678656 - protein, 19 aa, Staphylococcus aureus
KTATYKVVRTVPKQVFETA

SEQ ID NO: 1678657 - protein, 18 aa, Staphylococcus aureus
KTKFEVLKKRGKFPSNLE

SEQ ID NO: 1678658 - protein, 20 aa, Staphylococcus aureus
KTKIKAWVRQLLWMSIYQYV

SEQ ID NO: 1678659 - protein, 19 aa, Staphylococcus aureus
KTSEVPSAIFGTMKPKKLE

SEQ ID NO: 1678660 - protein, 20 aa, Staphylococcus aureus
KTSEVPSAIFGTMKPKKLEN

SEQ ID NO: 1678661 - protein, 23 aa, Staphylococcus aureus
KTVRIVLMHDWLKGKIIVDSLGL

SEQ ID NO: 1678662 - protein, 19 aa, Staphylococcus aureus
KVHLMKECLDREIKVISSM

SEQ ID NO: 1678663 - protein, 20 aa, Staphylococcus aureus
KVIQIWPEFDIDGAVELQYT

SEQ ID NO: 1678664 - protein, 22 aa, Staphylococcus aureus
KVKRELYDGRGFLICSRILGEG

SEQ ID NO: 1678665 - protein, 19 aa, Staphylococcus aureus
KVTAFDFFQDNGFGFITPY

SEQ ID NO: 1678666 - protein, 18 aa, Staphylococcus aureus
KWIIDHWATHYGLEGTET

SEQ ID NO: 1678667 - protein, 28 aa, Staphylococcus aureus
KWNTVLKRFWKFEGTAVYEKVGIKENEK

SEQ ID NO: 1678668 - protein, 19 aa, Staphylococcus aureus
KWVYEMLGMDSTCPKDVLT

SEQ ID NO: 1678669 - protein, 17 aa, Staphylococcus aureus
KYAESFGAKGLRITNQE

SEQ ID NO: 1678670 - protein, 18 aa, Staphylococcus aureus
KYAESFGAKGLRITNQEE

SEQ ID NO: 1678671 - protein, 17 aa, Staphylococcus aureus
KYGKDISELIAYQEKLN

SEQ ID NO: 1678672 - protein, 17 aa, Staphylococcus aureus
KYKEVLTGFKFIAQEIR

SEQ ID NO: 1678673 - protein, 18 aa, Staphylococcus aureus
KYMNSWCLEYSEFLLDEV

SEQ ID NO: 1678674 - protein, 18 aa, Staphylococcus aureus
KYYLAEAIKAEKAGKKVE

SEQ ID NO: 1678675 - protein, 19 aa, Staphylococcus aureus
LAEISVKVFNEFNISEREA

SEQ ID NO: 1678676 - protein, 18 aa, Staphylococcus aureus
LAELSGYWAYQDLDKRYV

SEQ ID NO: 1678677 - protein, 17 aa, Staphylococcus aureus
LAETSQYITIEFDFTEA

SEQ ID NO: 1678678 - protein, 18 aa, Staphylococcus aureus
LAIKIARLRNARIESSKE

SEQ ID NO: 1678679 - protein, 18 aa, Staphylococcus aureus
LAKEVFRNELLRWNEENI

SEQ ID NO: 1678680 - protein, 19 aa, Staphylococcus aureus
LALITGAALLARRRSKKEK

SEQ ID NO: 1678681 - protein, 25 aa, Staphylococcus aureus
LALNDCWPDLIFPESEIAFIILHFG

SEQ ID NO: 1678682 - protein, 23 aa, Staphylococcus aureus
LALNDCWPDLIFPESEIAFVVLH

SEQ ID NO: 1678683 - protein, 18 aa, Staphylococcus aureus
LANHLGWKGKGTNFDVLP

SEQ ID NO: 1678684 - protein, 28 aa, Staphylococcus aureus
LANMNFLRWVNFPQDYTVTWTNAKIANR

SEQ ID NO: 1678685 - protein, 23 aa, Staphylococcus aureus
LARELKCPVIALSQLSRGVEQRQ

SEQ ID NO: 1678686 - protein, 19 aa, Staphylococcus aureus
LCRELRSPIEYEKLLHYVQ

SEQ ID NO: 1678687 - protein, 21 aa, Staphylococcus aureus
LCYIYKFRARFAVLAHLLTQR

SEQ ID NO: 1678688 - protein, 18 aa, Staphylococcus aureus
LDEAIGIMVSQVIYEYKE

SEQ ID NO: 1678689 - protein, 22 aa, Staphylococcus aureus
LDFKRKGAELANFYTGIINDLL

SEQ ID NO: 1678690 - protein, 25 aa, Staphylococcus aureus
LDGATKEFFAWGFRVGFITFGTSDQ

SEQ ID NO: 1678691 - protein, 18 aa, Staphylococcus aureus
LDGDLPLFPGHGPYTTVD

SEQ ID NO: 1678692 - protein, 21 aa, Staphylococcus aureus
LDIVWKFAEKVIFPHVEQNEL

SEQ ID NO: 1678693 - protein, 17 aa, Staphylococcus aureus
LDNNSFLLLEFIENGHA

SEQ ID NO: 1678694 - protein, 18 aa, Staphylococcus aureus
LDSCLKIKYMFPKAHAAA

SEQ ID NO: 1678695 - protein, 18 aa, Staphylococcus aureus
LEILARSKVDGIVLMATD

SEQ ID NO: 1678696 - protein, 18 aa, Staphylococcus aureus
LEKLRFSKMFFSSNAVNK

SEQ ID NO: 1678697 - protein, 17 aa, Staphylococcus aureus
LEMLEDYYLNRNTDILT

SEQ ID NO: 1678698 - protein, 17 aa, Staphylococcus aureus
LEPWTSCEFDFTREGKL

SEQ ID NO: 1678699 - protein, 21 aa, Staphylococcus aureus
LEPWTSCEFDFTREGKLKVSF

SEQ ID NO: 1678700 - protein, 17 aa, Staphylococcus aureus
LEPWTSCEFDFTSEGKL

SEQ ID NO: 1678701 - protein, 17 aa, Staphylococcus aureus
LERYEFTGDIAYLNKGE

SEQ ID NO: 1678702 - protein, 19 aa, Staphylococcus aureus
LETSLKINNEWLATAENIS

SEQ ID NO: 1678703 - protein, 20 aa, Staphylococcus aureus
LETYYSWAFYEIVSAVTDDY

SEQ ID NO: 1678704 - protein, 21 aa, Staphylococcus aureus
LEVNNPFLGKVFELVDISETS

SEQ ID NO: 1678705 - protein, 19 aa, Staphylococcus aureus
LFEKHFEPVPGIKMQHSGG

SEQ ID NO: 1678706 - protein, 17 aa, Staphylococcus aureus
LFENYILDNWDKVNQSI

SEQ ID NO: 1678707 - protein, 21 aa, Staphylococcus aureus
LFESLGIKCINTFDTIKICTD

SEQ ID NO: 1678708 - protein, 17 aa, Staphylococcus aureus
LFKRLKHKTSINVHPHL

SEQ ID NO: 1678709 - protein, 17 aa, Staphylococcus aureus
LFNRMGGTYIKSGYGAD

SEQ ID NO: 1678710 - protein, 22 aa, Staphylococcus aureus
LFQKRINLGLSIVMVTHDDEII

SEQ ID NO: 1678711 - protein, 19 aa, Staphylococcus aureus
LFYLKNWNYAYAYSLKLID

SEQ ID NO: 1678712 - protein, 17 aa, Staphylococcus aureus
LGALQGFCRIHQVKINH

SEQ ID NO: 1678713 - protein, 17 aa, Staphylococcus aureus
LGFAGGFPGKFIIDTLN

SEQ ID NO: 1678714 - protein, 21 aa, Staphylococcus aureus
LGFLALHGFLHLLGYDHMTEA

SEQ ID NO: 1678715 - protein, 18 aa, Staphylococcus aureus
LGFMPGFPYLGGLDEQLH

SEQ ID NO: 1678716 - protein, 18 aa, Staphylococcus aureus
LGKLRAGLDLIKKPIQMQ

SEQ ID NO: 1678717 - protein, 25 aa, Staphylococcus aureus
LGLDDIRNTHVWEVDEQPAVNEIFE

SEQ ID NO: 1678718 - protein, 19 aa, Staphylococcus aureus
LGLVEGWKRDGLTDEQIAR

SEQ ID NO: 1678719 - protein, 17 aa, Staphylococcus aureus
LGMYPKEVQLIGAIVLH

SEQ ID NO: 1678720 - protein, 17 aa, Staphylococcus aureus
LGVNVGREFSGNHFCMV

SEQ ID NO: 1678721 - protein, 17 aa, Staphylococcus aureus
LHETFKAYGVLFIDAQF

SEQ ID NO: 1678722 - protein, 17 aa, Staphylococcus aureus
LHETFKAYGVLFVDAQF

SEQ ID NO: 1678723 - protein, 17 aa, Staphylococcus aureus
LHFKHIVASNMVQGISP

SEQ ID NO: 1678724 - protein, 17 aa, Staphylococcus aureus
LHQFPIDYVFPLMGQTI

SEQ ID NO: 1678725 - protein, 19 aa, Staphylococcus aureus
LHRKRLISYGGLLKEIHKK

SEQ ID NO: 1678726 - protein, 17 aa, Staphylococcus aureus
LIEKCWESENFIDDNTL

SEQ ID NO: 1678727 - protein, 17 aa, Staphylococcus aureus
LIIKFSSAWSFLVPAIL

SEQ ID NO: 1678728 - protein, 24 aa, Staphylococcus aureus
LIKFKGGTIGLEFIWIDIENPPND

SEQ ID NO: 1678729 - protein, 17 aa, Staphylococcus aureus
LIKSAAFSNILPSSTNP

SEQ ID NO: 1678730 - protein, 24 aa, Staphylococcus aureus
LIPELQGRFPLRVELDSLSVEDFV

SEQ ID NO: 1678731 - protein, 17 aa, Staphylococcus aureus
LIQAEKWFLLKDFGRSG

SEQ ID NO: 1678732 - protein, 17 aa, Staphylococcus aureus
LIQKLMLIMPEGPALTL

SEQ ID NO: 1678733 - protein, 17 aa, Staphylococcus aureus
LISYGGLLKEIHKKLNL

SEQ ID NO: 1678734 - protein, 18 aa, Staphylococcus aureus
LKAALLYTLEECIKQGHT

SEQ ID NO: 1678735 - protein, 18 aa, Staphylococcus aureus
LKAFLPYNYEIVSSIFDN

SEQ ID NO: 1678736 - protein, 19 aa, Staphylococcus aureus
LKAGITLFQFREKGESALK

SEQ ID NO: 1678737 - protein, 22 aa, Staphylococcus aureus
LKDLELRIAKALPNVDRYDIVS

SEQ ID NO: 1678738 - protein, 24 aa, Staphylococcus aureus
LKDLKKGQCIFSDFYGRVGKMAVH

SEQ ID NO: 1678739 - protein, 23 aa, Staphylococcus aureus
LKDLKKGQCIFSDFYGRVGKMVV

SEQ ID NO: 1678740 - protein, 24 aa, Staphylococcus aureus
LKDLKKGQCIFSDFYGRVGKMVVH

SEQ ID NO: 1678741 - protein, 25 aa, Staphylococcus aureus
LKDPKRPIGSFIFLGPTGVGKTELA

SEQ ID NO: 1678742 - protein, 17 aa, Staphylococcus aureus
LKEFRKGGISKKTVYTV

SEQ ID NO: 1678743 - protein, 22 aa, Staphylococcus aureus
LKHINLGGGIGFNYADLTSQFE

SEQ ID NO: 1678744 - protein, 21 aa, Staphylococcus aureus
LKICNYCFERGVVIIAVAGNV

SEQ ID NO: 1678745 - protein, 17 aa, Staphylococcus aureus
LKISFNKVFGYFIEITR

SEQ ID NO: 1678746 - protein, 19 aa, Staphylococcus aureus
LKKRGKFPSNLEYIDSHTD

SEQ ID NO: 1678747 - protein, 17 aa, Staphylococcus aureus
LKKRGKNAVAITYTGDG

SEQ ID NO: 1678748 - protein, 27 aa, Staphylococcus aureus
LKLFKVCKLRGIPIFTFINKLDRVGKE

SEQ ID NO: 1678749 - protein, 24 aa, Staphylococcus aureus
LKLFKVCKMRGIPIFTFINKLDRV

SEQ ID NO: 1678750 - protein, 17 aa, Staphylococcus aureus
LKLKANYTIDDSVKEGD

SEQ ID NO: 1678751 - protein, 20 aa, Staphylococcus aureus
LKLLSFLLEDHDLIILDEIT

SEQ ID NO: 1678752 - protein, 17 aa, Staphylococcus aureus
LKLLVALSNNLDKTEIK

SEQ ID NO: 1678753 - protein, 18 aa, Staphylococcus aureus
LKLYGIDIAERIEVIVPE

SEQ ID NO: 1678754 - protein, 24 aa, Staphylococcus aureus
LKNTWSIDANKDFNTVRYVYNRNL

SEQ ID NO: 1678755 - protein, 21 aa, Staphylococcus aureus
LKREDLQWVRSFKLRGAYNAI

SEQ ID NO: 1678756 - protein, 18 aa, Staphylococcus aureus
LKRFKVVGVVSLPYETFI

SEQ ID NO: 1678757 - protein, 20 aa, Staphylococcus aureus
LKRLIVPSIEREIHVDLTEK

SEQ ID NO: 1678758 - protein, 22 aa, Staphylococcus aureus
LKRLPLYYRFVSSLKSKGIDRV

SEQ ID NO: 1678759 - protein, 19 aa, Staphylococcus aureus
LKSAFAFGISRAGMFINNE

SEQ ID NO: 1678760 - protein, 20 aa, Staphylococcus aureus
LKSKKGTLLWLMDETKTPMG

SEQ ID NO: 1678761 - protein, 21 aa, Staphylococcus aureus
LKTKLWGGQRLSEFGYQLDND

SEQ ID NO: 1678762 - protein, 22 aa, Staphylococcus aureus
LKTKLWGGQRLSVFGYQLDNDT

SEQ ID NO: 1678763 - protein, 25 aa, Staphylococcus aureus
LKVIYMPHWLKFYSIAIHSDVTSNK

SEQ ID NO: 1678764 - protein, 18 aa, Staphylococcus aureus
LKYAVAVFLKIIELEQVF

SEQ ID NO: 1678765 - protein, 18 aa, Staphylococcus aureus
LLEPLPFLEKISKLTTVK

SEQ ID NO: 1678766 - protein, 23 aa, Staphylococcus aureus
LLFMLATRPKQIFTREQIIEKIW

SEQ ID NO: 1678767 - protein, 17 aa, Staphylococcus aureus
LLGGTCLHKGCIPTKSL

SEQ ID NO: 1678768 - protein, 18 aa, Staphylococcus aureus
LLKSLNFNQFNLVEAQCE

SEQ ID NO: 1678769 - protein, 19 aa, Staphylococcus aureus
LLLTFFFKYMKPLVQADRV

SEQ ID NO: 1678770 - protein, 17 aa, Staphylococcus aureus
LLPHEWHYYISPRGKAD

SEQ ID NO: 1678771 - protein, 19 aa, Staphylococcus aureus
LLQARSKEILAFVNESKET

SEQ ID NO: 1678772 - protein, 22 aa, Staphylococcus aureus
LLQARSKEILAFVNESKETAIK

SEQ ID NO: 1678773 - protein, 19 aa, Staphylococcus aureus
LLQVRSKEILAFVNESKET

SEQ ID NO: 1678774 - protein, 17 aa, Staphylococcus aureus
LLSHELRTCFALTEPEH

SEQ ID NO: 1678775 - protein, 23 aa, Staphylococcus aureus
LMCKGDMKRHCNIIIPDKNEYEM

SEQ ID NO: 1678776 - protein, 17 aa, Staphylococcus aureus
LMEEWLFNTVAFIGGPS

SEQ ID NO: 1678777 - protein, 18 aa, Staphylococcus aureus
LMYRSGDIIRLLPDGNID

SEQ ID NO: 1678778 - protein, 17 aa, Staphylococcus aureus
LNEAMKALKESIKDQPQ

SEQ ID NO: 1678779 - protein, 18 aa, Staphylococcus aureus
LNEAMKALKESIKDQPQT

SEQ ID NO: 1678780 - protein, 20 aa, Staphylococcus aureus
LNESITCYGLGLSQSTGNVT

SEQ ID NO: 1678781 - protein, 20 aa, Staphylococcus aureus
LNESITCYGLGLTQSTDNVT

SEQ ID NO: 1678782 - protein, 20 aa, Staphylococcus aureus
LNEYITCYGLGLTQSTGNVT

SEQ ID NO: 1678783 - protein, 17 aa, Staphylococcus aureus
LNFKELRAFVIGNAPAK

SEQ ID NO: 1678784 - protein, 20 aa, Staphylococcus aureus
LNIMYGEYDLFYGFIENDED

SEQ ID NO: 1678785 - protein, 18 aa, Staphylococcus aureus
LNKYPVVFVHGFLGLVGD

SEQ ID NO: 1678786 - protein, 20 aa, Staphylococcus aureus
LNLFEHWFRSVFNRRHPYYV

SEQ ID NO: 1678787 - protein, 20 aa, Staphylococcus aureus
LNMIIGHWGEFIPFFLERMD

SEQ ID NO: 1678788 - protein, 23 aa, Staphylococcus aureus
LNNAMKGLRYSIANETTVKASQN

SEQ ID NO: 1678789 - protein, 22 aa, Staphylococcus aureus
LNNRKAEALQRLDQLTHLNNAQ

SEQ ID NO: 1678790 - protein, 22 aa, Staphylococcus aureus
LNPEVIKWAKKVYGLTVLDTWW

SEQ ID NO: 1678791 - protein, 17 aa, Staphylococcus aureus
LNRKNCSGLSIGDMADE

SEQ ID NO: 1678792 - protein, 18 aa, Staphylococcus aureus
LNVFNLYGALSMANSGPN

SEQ ID NO: 1678793 - protein, 19 aa, Staphylococcus aureus
LNWVYKYFFANGVQMEGVL

SEQ ID NO: 1678794 - protein, 17 aa, Staphylococcus aureus
LPAPKFEAGDSFMKVTM

SEQ ID NO: 1678795 - protein, 17 aa, Staphylococcus aureus
LPFHAKRFNDWLESMAS

SEQ ID NO: 1678796 - protein, 19 aa, Staphylococcus aureus
LPHCFKFGIKNAIRIYNHN

SEQ ID NO: 1678797 - protein, 19 aa, Staphylococcus aureus
LPIRAGYSLEIKVPLNAIK

SEQ ID NO: 1678798 - protein, 17 aa, Staphylococcus aureus
LPKGIDPYKFHEYLIHL

SEQ ID NO: 1678799 - protein, 17 aa, Staphylococcus aureus
LPNRRIVVLTSDTSFNV

SEQ ID NO: 1678800 - protein, 18 aa, Staphylococcus aureus
LPSGLSYDSATNSIIGTP

SEQ ID NO: 1678801 - protein, 17 aa, Staphylococcus aureus
LPSGLTFDSTNNTISGT

SEQ ID NO: 1678802 - protein, 17 aa, Staphylococcus aureus
LPWKELDIDIAIDATGK

SEQ ID NO: 1678803 - protein, 18 aa, Staphylococcus aureus
LPWKELDIDIAIDATGKF

SEQ ID NO: 1678804 - protein, 17 aa, Staphylococcus aureus
LQGYGFPVISRKEMQQE

SEQ ID NO: 1678805 - protein, 17 aa, Staphylococcus aureus
LQIYGFSPCRVISIMLA

SEQ ID NO: 1678806 - protein, 23 aa, Staphylococcus aureus
LQLIRLSVCKFIKGHSLIDTSIL

SEQ ID NO: 1678807 - protein, 19 aa, Staphylococcus aureus
LQRPILYTGLTRAKMSLVL

SEQ ID NO: 1678808 - protein, 23 aa, Staphylococcus aureus
LQVWKKPSSFVIKPLPKNKYPDS

SEQ ID NO: 1678809 - protein, 17 aa, Staphylococcus aureus
LRARLFVDQIVSFVNNS

SEQ ID NO: 1678810 - protein, 18 aa, Staphylococcus aureus
LRDKYEWNLSLLSKIDNY

SEQ ID NO: 1678811 - protein, 17 aa, Staphylococcus aureus
LRFYIKKGFLMIELPSG

SEQ ID NO: 1678812 - protein, 17 aa, Staphylococcus aureus
LRHCLSRNRYLNLSHYL

SEQ ID NO: 1678813 - protein, 20 aa, Staphylococcus aureus
LRIGEALALQWKDYDKIKGE

SEQ ID NO: 1678814 - protein, 18 aa, Staphylococcus aureus
LRKPDWLRIKLNTNENYT

SEQ ID NO: 1678815 - protein, 18 aa, Staphylococcus aureus
LRKRIKLVAEKNYDQISS

SEQ ID NO: 1678816 - protein, 18 aa, Staphylococcus aureus
LRLPHGMPEEVKKMFQKE

SEQ ID NO: 1678817 - protein, 17 aa, Staphylococcus aureus
LRLYGPGTWYGKDGMIY

SEQ ID NO: 1678818 - protein, 23 aa, Staphylococcus aureus
LRMIRCLRFQSQLSFEIATETFE

SEQ ID NO: 1678819 - protein, 20 aa, Staphylococcus aureus
LRPASLDDLGLEAAFKSYFK

SEQ ID NO: 1678820 - protein, 20 aa, Staphylococcus aureus
LRVASILAHTLFDYPSHQLV

SEQ ID NO: 1678821 - protein, 18 aa, Staphylococcus aureus
LSIMLLFVYFKSALKINP

SEQ ID NO: 1678822 - protein, 17 aa, Staphylococcus aureus
LSKAIGVVGGYVAGTKE

SEQ ID NO: 1678823 - protein, 17 aa, Staphylococcus aureus
LSLAVAFSHHAELYIFD

SEQ ID NO: 1678824 - protein, 19 aa, Staphylococcus aureus
LSRKSIRVIIYKGNNRIET

SEQ ID NO: 1678825 - protein, 21 aa, Staphylococcus aureus
LSRYPQLYSRIGFAHEFDNLS

SEQ ID NO: 1678826 - protein, 22 aa, Staphylococcus aureus
LTAKRKLSVFIYSVNDFTDFNA

SEQ ID NO: 1678827 - protein, 19 aa, Staphylococcus aureus
LTEAFLFSRGHFKGNQFPE

SEQ ID NO: 1678828 - protein, 19 aa, Staphylococcus aureus
LTELSGYWVYQDINTNKEI

SEQ ID NO: 1678829 - protein, 24 aa, Staphylococcus aureus
LTGVPGCGKSLILYDFYKECLKID

SEQ ID NO: 1678830 - protein, 20 aa, Staphylococcus aureus
LTIMCKLGWAPTKRISKGNS

SEQ ID NO: 1678831 - protein, 18 aa, Staphylococcus aureus
LTNIKAFQYDATKPYDKT

SEQ ID NO: 1678832 - protein, 23 aa, Staphylococcus aureus
LTTGFCLWCQLAFSTYLENATQT

SEQ ID NO: 1678833 - protein, 19 aa, Staphylococcus aureus
LVMKLGIEYFLPVKDVFNN

SEQ ID NO: 1678834 - protein, 23 aa, Staphylococcus aureus
LVNNSRFGFKMGHQSIVDSMVYD

SEQ ID NO: 1678835 - protein, 24 aa, Staphylococcus aureus
LVPETLRIIALISIVDACTPTLSN

SEQ ID NO: 1678836 - protein, 17 aa, Staphylococcus aureus
LVPRWYVEYDGEWYVYN

SEQ ID NO: 1678837 - protein, 24 aa, Staphylococcus aureus
LVTPEHIVRAGARDAVKQQYEAKK

SEQ ID NO: 1678838 - protein, 17 aa, Staphylococcus aureus
LWGNMGLSYPELITKLI

SEQ ID NO: 1678839 - protein, 17 aa, Staphylococcus aureus
LYALPFKERKIIKSEYY

SEQ ID NO: 1678840 - protein, 19 aa, Staphylococcus aureus
LYGLGAYELFSLMYDIHTV

SEQ ID NO: 1678841 - protein, 17 aa, Staphylococcus aureus
LYGPGTWYGKDGMIYNQ

SEQ ID NO: 1678842 - protein, 23 aa, Staphylococcus aureus
LYIADLKLGVAIIPCSEMLRTKD

SEQ ID NO: 1678843 - protein, 17 aa, Staphylococcus aureus
LYVKTPRGWHLYFVLDT

SEQ ID NO: 1678844 - protein, 17 aa, Staphylococcus aureus
MAERGRKTLLFGPMKPV

SEQ ID NO: 1678845 - protein, 22 aa, Staphylococcus aureus
MCKGDMKRHCNIIIPDKNEYET

SEQ ID NO: 1678846 - protein, 17 aa, Staphylococcus aureus
MDHRHLWLRSKKQHAVM

SEQ ID NO: 1678847 - protein, 20 aa, Staphylococcus aureus
MDVFKKCYKALITKQETNIE

SEQ ID NO: 1678848 - protein, 19 aa, Staphylococcus aureus
MEGLSLIPLPGMGFLKGAG

SEQ ID NO: 1678849 - protein, 20 aa, Staphylococcus aureus
MEGLSLIPLPGMGFLKGAGK

SEQ ID NO: 1678850 - protein, 17 aa, Staphylococcus aureus
MERLIRLPGKFKYFEHN

SEQ ID NO: 1678851 - protein, 20 aa, Staphylococcus aureus
MFNYKFEVFDVSNPFFSNET

SEQ ID NO: 1678852 - protein, 25 aa, Staphylococcus aureus
MGFEMKESIALFSQWEKSGVNTEIA

SEQ ID NO: 1678853 - protein, 21 aa, Staphylococcus aureus
MGRGMIKWAAFIICTNLIKKS

SEQ ID NO: 1678854 - protein, 28 aa, Staphylococcus aureus
MGRPAQCVFLSWNRYLYRNAQNYINSSD

SEQ ID NO: 1678855 - protein, 28 aa, Staphylococcus aureus
MGRPAQCVFLSWNRYLYRNAQNYITRSD

SEQ ID NO: 1678856 - protein, 20 aa, Staphylococcus aureus
MGVKRLGKIIAQIQQYTNID

SEQ ID NO: 1678857 - protein, 19 aa, Staphylococcus aureus
MIDYFKALFPNGGLYVHLD

SEQ ID NO: 1678858 - protein, 18 aa, Staphylococcus aureus
MIKRLSTPFMNLDHVQQF

SEQ ID NO: 1678859 - protein, 17 aa, Staphylococcus aureus
MIPVEWEKVYTIAYVND

SEQ ID NO: 1678860 - protein, 20 aa, Staphylococcus aureus
MIRTPLLSVEFFNLFFNTEQ

SEQ ID NO: 1678861 - protein, 24 aa, Staphylococcus aureus
MKAFWPGPISFILPLKPGYLCRKV

SEQ ID NO: 1678862 - protein, 21 aa, Staphylococcus aureus
MKELFRQAGGIPRKIRIDNMS

SEQ ID NO: 1678863 - protein, 19 aa, Staphylococcus aureus
MKGRIIGREGRNIRTLETL

SEQ ID NO: 1678864 - protein, 18 aa, Staphylococcus aureus
MKIQSSRLMLGFKNKPLQ

SEQ ID NO: 1678865 - protein, 21 aa, Staphylococcus aureus
MKQKALAKVRMSEIGFILQAT

SEQ ID NO: 1678866 - protein, 17 aa, Staphylococcus aureus
MKYYMVGSTYRFKKSDV

SEQ ID NO: 1678867 - protein, 19 aa, Staphylococcus aureus
MLEKLRFSKMFFSSNAVNK

SEQ ID NO: 1678868 - protein, 17 aa, Staphylococcus aureus
MLPKIEAAISFIENNPK

SEQ ID NO: 1678869 - protein, 17 aa, Staphylococcus aureus
MNAKVPNHFNFNRLVID

SEQ ID NO: 1678870 - protein, 21 aa, Staphylococcus aureus
MNDIGKIIGIWNGMIKRQGTS

SEQ ID NO: 1678871 - protein, 17 aa, Staphylococcus aureus
MPQTRFVLKKALEQNLK

SEQ ID NO: 1678872 - protein, 22 aa, Staphylococcus aureus
MQLSKRLPIIPVIKNQRSALYI

SEQ ID NO: 1678873 - protein, 18 aa, Staphylococcus aureus
MRCSHCAVGYTLQTVDLE

SEQ ID NO: 1678874 - protein, 19 aa, Staphylococcus aureus
MRCSHCAVGYTLQTVDPEP

SEQ ID NO: 1678875 - protein, 17 aa, Staphylococcus aureus
MRELSYAGFIVFHDEAL

SEQ ID NO: 1678876 - protein, 22 aa, Staphylococcus aureus
MRKGEVLALHWSDINFVNKDLY

SEQ ID NO: 1678877 - protein, 21 aa, Staphylococcus aureus
MRLDELIKWAWDNPGLATGRN

SEQ ID NO: 1678878 - protein, 17 aa, Staphylococcus aureus
MRVIKDICNRVAVMEKG

SEQ ID NO: 1678879 - protein, 23 aa, Staphylococcus aureus
MSFAKFKSCLKKHTFEQIMQGTR

SEQ ID NO: 1678880 - protein, 17 aa, Staphylococcus aureus
MSGWTKEDVIAFENLTN

SEQ ID NO: 1678881 - protein, 19 aa, Staphylococcus aureus
MTGYGLKTTAVIGGAFTVN

SEQ ID NO: 1678882 - protein, 22 aa, Staphylococcus aureus
MVRLSQDWKLRHVLIEMHGNNG

SEQ ID NO: 1678883 - protein, 17 aa, Staphylococcus aureus
NAFDFPGFVPAYIRPLF

SEQ ID NO: 1678884 - protein, 22 aa, Staphylococcus aureus
NAIIKAGAMSLVPLLKSNTPFA

SEQ ID NO: 1678885 - protein, 21 aa, Staphylococcus aureus
NAIIQKPIRTVQEVQSALTNV

SEQ ID NO: 1678886 - protein, 23 aa, Staphylococcus aureus
NALKIELEFYFPLLKSWSKKKKN

SEQ ID NO: 1678887 - protein, 23 aa, Staphylococcus aureus
NALKIELEFYFPLLKSWSKKKKS

SEQ ID NO: 1678888 - protein, 17 aa, Staphylococcus aureus
NATELNTAMGTLKHAIA

SEQ ID NO: 1678889 - protein, 18 aa, Staphylococcus aureus
NAYNQAVSAAETILNKQT

SEQ ID NO: 1678890 - protein, 17 aa, Staphylococcus aureus
NCHQLIWQSALILDTHR

SEQ ID NO: 1678891 - protein, 22 aa, Staphylococcus aureus
NDCPPCTFVKIYLNERQIDFEE

SEQ ID NO: 1678892 - protein, 19 aa, Staphylococcus aureus
NDFPITWFYPLGEKKVERT

SEQ ID NO: 1678893 - protein, 22 aa, Staphylococcus aureus
NDKNIPCNLWIDGHQTEIELTA

SEQ ID NO: 1678894 - protein, 20 aa, Staphylococcus aureus
NDKYRTWAWNYGRNPKYNFE

SEQ ID NO: 1678895 - protein, 18 aa, Staphylococcus aureus
NDVDGRVGVATMLMHESG

SEQ ID NO: 1678896 - protein, 17 aa, Staphylococcus aureus
NEISGMIPIEWEKVYTI

SEQ ID NO: 1678897 - protein, 23 aa, Staphylococcus aureus
NEISGMIPIEWEKVYTMAYIDDE

SEQ ID NO: 1678898 - protein, 17 aa, Staphylococcus aureus
NEISGMIPVEWEKVYTM

SEQ ID NO: 1678899 - protein, 24 aa, Staphylococcus aureus
NEITYRLSKIFGIKSISPLLKVEK

SEQ ID NO: 1678900 - protein, 18 aa, Staphylococcus aureus
NELFIKLANEFNIELFEV

SEQ ID NO: 1678901 - protein, 19 aa, Staphylococcus aureus
NELPISAGFFFINPFEVVY

SEQ ID NO: 1678902 - protein, 20 aa, Staphylococcus aureus
NEVFRYLVFEKKNGNELESS

SEQ ID NO: 1678903 - protein, 17 aa, Staphylococcus aureus
NEVVGFFVLHRYYQHEG

SEQ ID NO: 1678904 - protein, 17 aa, Staphylococcus aureus
NGDERLRVAKQNANTAI

SEQ ID NO: 1678905 - protein, 18 aa, Staphylococcus aureus
NGDERLRVAKQNANTAID

SEQ ID NO: 1678906 - protein, 19 aa, Staphylococcus aureus
NGEGHSMSGFLISGTQAII

SEQ ID NO: 1678907 - protein, 22 aa, Staphylococcus aureus
NGGDGIGFAFSPGVLGETGLNG

SEQ ID NO: 1678908 - protein, 17 aa, Staphylococcus aureus
NGKKEWELFYLYKELIQ

SEQ ID NO: 1678909 - protein, 24 aa, Staphylococcus aureus
NGQENLYRIAIQYYGSGSPENVEK

SEQ ID NO: 1678910 - protein, 30 aa, Staphylococcus aureus
NHIPPWILIIPLNFGETIKWLSILKPKDKQ

SEQ ID NO: 1678911 - protein, 24 aa, Staphylococcus aureus
NHMYRLPVMYLEYSGIYGDVSKVQ

SEQ ID NO: 1678912 - protein, 23 aa, Staphylococcus aureus
NIIMKGRQAGVFMFLTAQRPDAD

SEQ ID NO: 1678913 - protein, 19 aa, Staphylococcus aureus
NIKCLRHSRFIFLSPEFLL

SEQ ID NO: 1678914 - protein, 21 aa, Staphylococcus aureus
NIKCLRHSRFIFLSPEFLLQP

SEQ ID NO: 1678915 - protein, 34 aa, Staphylococcus aureus
NIRGRFPFSDVLTILSVFYFRYLYIDSNTHAKHK

SEQ ID NO: 1678916 - protein, 22 aa, Staphylococcus aureus
NKDLDFAFGLSMTSKNIARYEN

SEQ ID NO: 1678917 - protein, 21 aa, Staphylococcus aureus
NKEFKRMLAKFFIFVGDGGNG

SEQ ID NO: 1678918 - protein, 17 aa, Staphylococcus aureus
NKFKVIGPFVADKYVLS

SEQ ID NO: 1678919 - protein, 18 aa, Staphylococcus aureus
NKFYKFAIYGKFGTGKTT

SEQ ID NO: 1678920 - protein, 17 aa, Staphylococcus aureus
NKISSMIPVEWEKVYAM

SEQ ID NO: 1678921 - protein, 19 aa, Staphylococcus aureus
NKPNCPFIINMQLTGVFDI

SEQ ID NO: 1678922 - protein, 26 aa, Staphylococcus aureus
NKQKSVCFYGQIALFDLCKRLSKSCE

SEQ ID NO: 1678923 - protein, 19 aa, Staphylococcus aureus
NKVKGFCKICNQESDTSLF

SEQ ID NO: 1678924 - protein, 19 aa, Staphylococcus aureus
NKVTWGYAKSILNTWLNAN

SEQ ID NO: 1678925 - protein, 20 aa, Staphylococcus aureus
NLFINWTWGEDFFRKYLIDY

SEQ ID NO: 1678926 - protein, 22 aa, Staphylococcus aureus
NLFPEIIFLDAISLRTFENYTL

SEQ ID NO: 1678927 - protein, 20 aa, Staphylococcus aureus
NLKLRIEIVKYMKRRGVDCN

SEQ ID NO: 1678928 - protein, 20 aa, Staphylococcus aureus
NLKVSFDYIDWIKLGFGPSG

SEQ ID NO: 1678929 - protein, 20 aa, Staphylococcus aureus
NLLFLSFAGALAYQIGAKHI

SEQ ID NO: 1678930 - protein, 17 aa, Staphylococcus aureus
NLNVIACLMEIRRNPVN

SEQ ID NO: 1678931 - protein, 18 aa, Staphylococcus aureus
NLPWKELDIDIAIDATGK

SEQ ID NO: 1678932 - protein, 18 aa, Staphylococcus aureus
NLRHCLSRNRYLNLSHYL

SEQ ID NO: 1678933 - protein, 19 aa, Staphylococcus aureus
NNCIKRYIAKYTINPAITH

SEQ ID NO: 1678934 - protein, 24 aa, Staphylococcus aureus
NNLKEVIAGFDFTFGKFGKGNMTV

SEQ ID NO: 1678935 - protein, 18 aa, Staphylococcus aureus
NNRFKLIILRKGRGLAGT

SEQ ID NO: 1678936 - protein, 19 aa, Staphylococcus aureus
NPEVIKWAKKVYGLTVLDT

SEQ ID NO: 1678937 - protein, 23 aa, Staphylococcus aureus
NPEVKKNALEAIREVVNKQIEII

SEQ ID NO: 1678938 - protein, 19 aa, Staphylococcus aureus
NPTPKWSIARYKGLGEMNA

SEQ ID NO: 1678939 - protein, 19 aa, Staphylococcus aureus
NPVELRRNIGYVIQQIGLM

SEQ ID NO: 1678940 - protein, 19 aa, Staphylococcus aureus
NPYICVGRAYYIAENYIVT

SEQ ID NO: 1678941 - protein, 17 aa, Staphylococcus aureus
NQIIWGFLHLASSKEIV

SEQ ID NO: 1678942 - protein, 24 aa, Staphylococcus aureus
NQLESFKLALPYLMTAAELDKDKD

SEQ ID NO: 1678943 - protein, 21 aa, Staphylococcus aureus
NRIIKIPVQYGGTYGPDIEEV

SEQ ID NO: 1678944 - protein, 27 aa, Staphylococcus aureus
NRIVLKDGWLFRKMRIETMQKVLKYGT

SEQ ID NO: 1678945 - protein, 20 aa, Staphylococcus aureus
NRKANGYKLFKDDIEITTSD

SEQ ID NO: 1678946 - protein, 20 aa, Staphylococcus aureus
NRKSEALQRLDQLTHLNNAQ

SEQ ID NO: 1678947 - protein, 18 aa, Staphylococcus aureus
NRLFKWLRNNGYLIKKSG

SEQ ID NO: 1678948 - protein, 20 aa, Staphylococcus aureus
NRMGGTYIKSGYGADTSGIQ

SEQ ID NO: 1678949 - protein, 19 aa, Staphylococcus aureus
NRTKLLGVGLWFVPKPVRN

SEQ ID NO: 1678950 - protein, 18 aa, Staphylococcus aureus
NRYTFVWKKSIPNHESKL

SEQ ID NO: 1678951 - protein, 20 aa, Staphylococcus aureus
NSFVPSMHWIAANPKDLNDY

SEQ ID NO: 1678952 - protein, 21 aa, Staphylococcus aureus
NVCSCCGQQLPAEQVSEVREK

SEQ ID NO: 1678953 - protein, 22 aa, Staphylococcus aureus
NVIPNRFIYKIALVGKDEKKYK

SEQ ID NO: 1678954 - protein, 24 aa, Staphylococcus aureus
NVLQELKLWMARTIAATRNQAIID

SEQ ID NO: 1678955 - protein, 18 aa, Staphylococcus aureus
NVNEAWLMGFDISKNRKV

SEQ ID NO: 1678956 - protein, 17 aa, Staphylococcus aureus
NWPVCGIPEKFYTDHGS

SEQ ID NO: 1678957 - protein, 23 aa, Staphylococcus aureus
NYLKEQYKGIGILYKNQQWYFVV

SEQ ID NO: 1678958 - protein, 20 aa, Staphylococcus aureus
NYQNCVISLVAIRNYKKPNF

SEQ ID NO: 1678959 - protein, 23 aa, Staphylococcus aureus
NYRCWTQGIFARWTDNPNIEDLI

SEQ ID NO: 1678960 - protein, 19 aa, Staphylococcus aureus
NYVDFGIAFDSQWNFAVLP

SEQ ID NO: 1678961 - protein, 17 aa, Staphylococcus aureus
NYVMKWKETEIFFEKLT

SEQ ID NO: 1678962 - protein, 17 aa, Staphylococcus aureus
PACNEVQCGWAASHSLE

SEQ ID NO: 1678963 - protein, 20 aa, Staphylococcus aureus
PAEESYFLFYINRPSIIVGK

SEQ ID NO: 1678964 - protein, 27 aa, Staphylococcus aureus
PAIACYQCGYCLKGEYARCEKLFVIGS

SEQ ID NO: 1678965 - protein, 20 aa, Staphylococcus aureus
PAYRPHLDRDKDKRACEPDK

SEQ ID NO: 1678966 - protein, 17 aa, Staphylococcus aureus
PDIILRLPHGMSEEVKK

SEQ ID NO: 1678967 - protein, 19 aa, Staphylococcus aureus
PEEYWIIEGEFRYKKSKFN

SEQ ID NO: 1678968 - protein, 18 aa, Staphylococcus aureus
PEEYWTIDGEFRYKKSKF

SEQ ID NO: 1678969 - protein, 17 aa, Staphylococcus aureus
PEILAFIKSFKKYIANE

SEQ ID NO: 1678970 - protein, 19 aa, Staphylococcus aureus
PELRFPGFEGEWEEKQLGE

SEQ ID NO: 1678971 - protein, 20 aa, Staphylococcus aureus
PETRRSTILSSKKLGDKVHL

SEQ ID NO: 1678972 - protein, 17 aa, Staphylococcus aureus
PGLDRAIEFARSGDTIV

SEQ ID NO: 1678973 - protein, 20 aa, Staphylococcus aureus
PGLTICGGYQFLGEKYITPD

SEQ ID NO: 1678974 - protein, 19 aa, Staphylococcus aureus
PHLAFKMADQIFLKKQRVL

SEQ ID NO: 1678975 - protein, 17 aa, Staphylococcus aureus
PIGSFLFLGPTGVGKTE

SEQ ID NO: 1678976 - protein, 23 aa, Staphylococcus aureus
PILRGGQHYKLHFDFDATPAGSV

SEQ ID NO: 1678977 - protein, 18 aa, Staphylococcus aureus
PISRLLQWVTDFVKPLAR

SEQ ID NO: 1678978 - protein, 18 aa, Staphylococcus aureus
PKEVQLIGAIVLHEGNIA

SEQ ID NO: 1678979 - protein, 19 aa, Staphylococcus aureus
PKFLKSFFNEHPFIDVSLQ

SEQ ID NO: 1678980 - protein, 17 aa, Staphylococcus aureus
PKIKLYVSLKCPDFDDV

SEQ ID NO: 1678981 - protein, 24 aa, Staphylococcus aureus
PKKMRRLALRSALSFKVQENGLTL

SEQ ID NO: 1678982 - protein, 20 aa, Staphylococcus aureus
PKNRRAGVITFNLQDVHPHD

SEQ ID NO: 1678983 - protein, 21 aa, Staphylococcus aureus
PKRKGNDYIRDWNTKEKHNEW

SEQ ID NO: 1678984 - protein, 19 aa, Staphylococcus aureus
PLNGLRIMGKFGDSVTTDH

SEQ ID NO: 1678985 - protein, 18 aa, Staphylococcus aureus
PLNGLRVMGKFGDSVTTD

SEQ ID NO: 1678986 - protein, 18 aa, Staphylococcus aureus
PLYEWLGLTASLGFVDIV

SEQ ID NO: 1678987 - protein, 17 aa, Staphylococcus aureus
PMMYIALSYDHRIIDGK

SEQ ID NO: 1678988 - protein, 18 aa, Staphylococcus aureus
PNEFLKYTGRIHAQAYFT

SEQ ID NO: 1678989 - protein, 23 aa, Staphylococcus aureus
PNGEIKARSSISMNNVTYTTQDE

SEQ ID NO: 1678990 - protein, 17 aa, Staphylococcus aureus
PNGYKYYSLYDEKNRWM

SEQ ID NO: 1678991 - protein, 19 aa, Staphylococcus aureus
PRCQSKLHLSRSIKKYDNG

SEQ ID NO: 1678992 - protein, 17 aa, Staphylococcus aureus
PRFSRNMLFLKDGDDEE

SEQ ID NO: 1678993 - protein, 25 aa, Staphylococcus aureus
PRIPKGRGIVKWNAFKTIPQQYEIL

SEQ ID NO: 1678994 - protein, 17 aa, Staphylococcus aureus
PRLEMLEDYYLNRNTDI

SEQ ID NO: 1678995 - protein, 19 aa, Staphylococcus aureus
PRLPFDHVFHHNKYRADKE

SEQ ID NO: 1678996 - protein, 18 aa, Staphylococcus aureus
PSGYKVAYSEFGPVVAAH

SEQ ID NO: 1678997 - protein, 19 aa, Staphylococcus aureus
PSHIYRLKGFMTFQDTTHT

SEQ ID NO: 1678998 - protein, 24 aa, Staphylococcus aureus
PSLEFKNEIGIILKKWTTIRFMNV

SEQ ID NO: 1678999 - protein, 21 aa, Staphylococcus aureus
PSTKNKLYWNGEINWFSPIEI

SEQ ID NO: 1679000 - protein, 17 aa, Staphylococcus aureus
PSVREIGEAVGLASSFT

SEQ ID NO: 1679001 - protein, 24 aa, Staphylococcus aureus
PSYPVSSPRGWLYFGGARPQDVKG

SEQ ID NO: 1679002 - protein, 20 aa, Staphylococcus aureus
PTAIRYAGLISRLKQLDLDA

SEQ ID NO: 1679003 - protein, 19 aa, Staphylococcus aureus
PTFIWHLAFAYGQEERDKE

SEQ ID NO: 1679004 - protein, 19 aa, Staphylococcus aureus
PTFMWHLAFAYGQEERDKE

SEQ ID NO: 1679005 - protein, 19 aa, Staphylococcus aureus
PTMFYKRGKKSFVIHIKKD

SEQ ID NO: 1679006 - protein, 19 aa, Staphylococcus aureus
PTPELKTGSGIDWSDEALT

SEQ ID NO: 1679007 - protein, 25 aa, Staphylococcus aureus
PVFNEKNEVIGIHWGGVPNEFNGAV

SEQ ID NO: 1679008 - protein, 26 aa, Staphylococcus aureus
PVFNEKNEVIGIHWGGVPNQFNGAVF

SEQ ID NO: 1679009 - protein, 22 aa, Staphylococcus aureus
PVRKRIGMVFQFPESQLFEDTV

SEQ ID NO: 1679010 - protein, 23 aa, Staphylococcus aureus
PWDMIPRCPKCDAPMEVNKRKAE

SEQ ID NO: 1679011 - protein, 24 aa, Staphylococcus aureus
PWEMIPRCPKCDAPMEVNKRKAEV

SEQ ID NO: 1679012 - protein, 18 aa, Staphylococcus aureus
PWTSCEFDFTREGKLKVS

SEQ ID NO: 1679013 - protein, 25 aa, Staphylococcus aureus
PYAELALGAGMAFLIRRFTKKDQQT

SEQ ID NO: 1679014 - protein, 17 aa, Staphylococcus aureus
PYMFNYKFEVFDVSNPF

SEQ ID NO: 1679015 - protein, 19 aa, Staphylococcus aureus
PYRRVILCTGDIGFSASKT

SEQ ID NO: 1679016 - protein, 21 aa, Staphylococcus aureus
PYTRSKFYSELKVLEAVKNGL

SEQ ID NO: 1679017 - protein, 21 aa, Staphylococcus aureus
QADGRTGVIAFEVKDTESAKQ

SEQ ID NO: 1679018 - protein, 17 aa, Staphylococcus aureus
QALRLVLERAKTYSVPN

SEQ ID NO: 1679019 - protein, 23 aa, Staphylococcus aureus
QARELGCLFAFYGHTHVAKYEYI

SEQ ID NO: 1679020 - protein, 17 aa, Staphylococcus aureus
QDIFKFLNHRERLWLKL

SEQ ID NO: 1679021 - protein, 20 aa, Staphylococcus aureus
QEAFESWSLTSKSERAQMLR

SEQ ID NO: 1679022 - protein, 17 aa, Staphylococcus aureus
QEGYSIWFEEFERDQLQ

SEQ ID NO: 1679023 - protein, 18 aa, Staphylococcus aureus
QFNSRFLVYFAVDHFNVL

SEQ ID NO: 1679024 - protein, 24 aa, Staphylococcus aureus
QFSKEEFKTMLAIAGHEGALNEIE

SEQ ID NO: 1679025 - protein, 25 aa, Staphylococcus aureus
QFSKEEFKTMLAIAGHEGALNEIET

SEQ ID NO: 1679026 - protein, 24 aa, Staphylococcus aureus
QGELHLRFQLAFYLFTNRGVICDP

SEQ ID NO: 1679027 - protein, 25 aa, Staphylococcus aureus
QGELHLRFQLAFYLFTNRGVICDPN

SEQ ID NO: 1679028 - protein, 21 aa, Staphylococcus aureus
QGFGRTGKWSSVSHFNFTPDL

SEQ ID NO: 1679029 - protein, 17 aa, Staphylococcus aureus
QGKPLVCVGILKGSAMF

SEQ ID NO: 1679030 - protein, 20 aa, Staphylococcus aureus
QGRGKIKWQAFATLPKQFEI

SEQ ID NO: 1679031 - protein, 21 aa, Staphylococcus aureus
QIAIPTRIAIQNQIVTQIQIA

SEQ ID NO: 1679032 - protein, 23 aa, Staphylococcus aureus
QIEYLKEMVTLVVVNRDKNSQNV

SEQ ID NO: 1679033 - protein, 19 aa, Staphylococcus aureus
QKALAKVRMSEIGFILQAT

SEQ ID NO: 1679034 - protein, 20 aa, Staphylococcus aureus
QKERITLYLKYNIKNFKSVE

SEQ ID NO: 1679035 - protein, 17 aa, Staphylococcus aureus
QKFNIALKIKKKQGIVV

SEQ ID NO: 1679036 - protein, 22 aa, Staphylococcus aureus
QKIKCPCCGSTLTNMTIRKKNH

SEQ ID NO: 1679037 - protein, 22 aa, Staphylococcus aureus
QKIKCPYCHSTLTNMTVRKPDH

SEQ ID NO: 1679038 - protein, 17 aa, Staphylococcus aureus
QKLARDQLQAVTTVNAL

SEQ ID NO: 1679039 - protein, 19 aa, Staphylococcus aureus
QLNVFRMELLGAKVVAVED

SEQ ID NO: 1679040 - protein, 17 aa, Staphylococcus aureus
QLQAFPICVEFRHQSWF

SEQ ID NO: 1679041 - protein, 17 aa, Staphylococcus aureus
QNFKFNELMVAIQSPFL

SEQ ID NO: 1679042 - protein, 19 aa, Staphylococcus aureus
QNMKFKRFHVRGAEKIFKE

SEQ ID NO: 1679043 - protein, 23 aa, Staphylococcus aureus
QNTCLFRLLAFTGMRKGEVLALH

SEQ ID NO: 1679044 - protein, 23 aa, Staphylococcus aureus
QNVTIPAIEAIVPQKDPNANDTN

SEQ ID NO: 1679045 - protein, 19 aa, Staphylococcus aureus
QPLYEWLGLTASLGFVDIV

SEQ ID NO: 1679046 - protein, 18 aa, Staphylococcus aureus
QRHIPMAIATSSVKSEIM

SEQ ID NO: 1679047 - protein, 20 aa, Staphylococcus aureus
QRKIDVESVFGFMKAILGFT

SEQ ID NO: 1679048 - protein, 20 aa, Staphylococcus aureus
QRSALYIKHLTAFIDQLISL

SEQ ID NO: 1679049 - protein, 22 aa, Staphylococcus aureus
QRSTNFSIVWILPISSIDNMPI

SEQ ID NO: 1679050 - protein, 17 aa, Staphylococcus aureus
QRVSLELSNNFEASLSG

SEQ ID NO: 1679051 - protein, 20 aa, Staphylococcus aureus
QSIKEFRMWVADKRIQHNDN

SEQ ID NO: 1679052 - protein, 19 aa, Staphylococcus aureus
QSIKEFRMWVADKRIQHSD

SEQ ID NO: 1679053 - protein, 19 aa, Staphylococcus aureus
QSYRLVIPSIQFESNLKLI

SEQ ID NO: 1679054 - protein, 21 aa, Staphylococcus aureus
QTLDHAMELLRNSVADNQTTL

SEQ ID NO: 1679055 - protein, 25 aa, Staphylococcus aureus
QVFETARGVLYPGVSDMYDAKQYVK

SEQ ID NO: 1679056 - protein, 20 aa, Staphylococcus aureus
QYFLRRFLKYTGQNEITKIN

SEQ ID NO: 1679057 - protein, 21 aa, Staphylococcus aureus
QYRPKRVIDTLEIFKIAFPTD

SEQ ID NO: 1679058 - protein, 17 aa, Staphylococcus aureus
RAIHVLKHFDRIEDVVV

SEQ ID NO: 1679059 - protein, 19 aa, Staphylococcus aureus
RALEEVIYFASYVVVNPGP

SEQ ID NO: 1679060 - protein, 18 aa, Staphylococcus aureus
RALVWGFTWKLGPFQLWD

SEQ ID NO: 1679061 - protein, 17 aa, Staphylococcus aureus
RAQEMNFPISIEIPDEV

SEQ ID NO: 1679062 - protein, 19 aa, Staphylococcus aureus
RARRYPLPLVLEISNIESV

SEQ ID NO: 1679063 - protein, 17 aa, Staphylococcus aureus
RCYLCPCLGYPRQWRSE

SEQ ID NO: 1679064 - protein, 20 aa, Staphylococcus aureus
RCYLCPCLGYPRQWRSEDIY

SEQ ID NO: 1679065 - protein, 20 aa, Staphylococcus aureus
RDGEDFKRPSSVSGSIPSIN

SEQ ID NO: 1679066 - protein, 20 aa, Staphylococcus aureus
RDGLKSECILLFSERDINLH

SEQ ID NO: 1679067 - protein, 18 aa, Staphylococcus aureus
RDKTWSVHVPRRIKEIGP

SEQ ID NO: 1679068 - protein, 17 aa, Staphylococcus aureus
RDLEIIKAVILKAKKSF

SEQ ID NO: 1679069 - protein, 18 aa, Staphylococcus aureus
RDLKRFKGAHGLLYEHQL

SEQ ID NO: 1679070 - protein, 24 aa, Staphylococcus aureus
RDLQAGEIIGLFSYGSGSVGEFYS

SEQ ID NO: 1679071 - protein, 17 aa, Staphylococcus aureus
RDLRFIEDFSIKIVDVM

SEQ ID NO: 1679072 - protein, 20 aa, Staphylococcus aureus
RDQCSMCHAVLPQIEDLMQS

SEQ ID NO: 1679073 - protein, 18 aa, Staphylococcus aureus
RDQLQAVTTVNALPNLNH

SEQ ID NO: 1679074 - protein, 17 aa, Staphylococcus aureus
RDSEYWRELSFGTTEGN

SEQ ID NO: 1679075 - protein, 21 aa, Staphylococcus aureus
REEILILLTLWQKGSMTLKEM

SEQ ID NO: 1679076 - protein, 21 aa, Staphylococcus aureus
REIKKDIGMIFQHFNLLNSAT

SEQ ID NO: 1679077 - protein, 17 aa, Staphylococcus aureus
RELSRLLLIGSATFSSI

SEQ ID NO: 1679078 - protein, 18 aa, Staphylococcus aureus
RELSRLLLIGSATFSSID

SEQ ID NO: 1679079 - protein, 19 aa, Staphylococcus aureus
RFKGAHGLLYEHQLGLQAT

SEQ ID NO: 1679080 - protein, 19 aa, Staphylococcus aureus
RFKGAHGLLYEQELGLQVT

SEQ ID NO: 1679081 - protein, 24 aa, Staphylococcus aureus
RFVEAYRLLAKIILRLKAFDEFEF

SEQ ID NO: 1679082 - protein, 25 aa, Staphylococcus aureus
RFVEAYRLLAKIILRLKAFDEFEFT

SEQ ID NO: 1679083 - protein, 21 aa, Staphylococcus aureus
RGKKRIDYRLSYNFYTTYYDN

SEQ ID NO: 1679084 - protein, 20 aa, Staphylococcus aureus
RGYASFMLCRDCGYVPQCPN

SEQ ID NO: 1679085 - protein, 22 aa, Staphylococcus aureus
RHFGENRLEGFLQKKEALPSDA

SEQ ID NO: 1679086 - protein, 20 aa, Staphylococcus aureus
RHLPSYFGLDFGYINDPSAL

SEQ ID NO: 1679087 - protein, 23 aa, Staphylococcus aureus
RHVDLPASVPLAWGAHSAASIVA

SEQ ID NO: 1679088 - protein, 18 aa, Staphylococcus aureus
RIAKVYAELGVKKIRITG

SEQ ID NO: 1679089 - protein, 17 aa, Staphylococcus aureus
RIFKFYKYFYSHRGPLF

SEQ ID NO: 1679090 - protein, 19 aa, Staphylococcus aureus
RIGCTFCASTLGGLKRNLE

SEQ ID NO: 1679091 - protein, 19 aa, Staphylococcus aureus
RIGEALALQWKDYDKIKGE

SEQ ID NO: 1679092 - protein, 20 aa, Staphylococcus aureus
RIIKIPVQYGGTYGPDIEEV

SEQ ID NO: 1679093 - protein, 19 aa, Staphylococcus aureus
RIRHYDFEKVLGFSDFLKP

SEQ ID NO: 1679094 - protein, 19 aa, Staphylococcus aureus
RISMLEVMLPSAIKAKYKK

SEQ ID NO: 1679095 - protein, 20 aa, Staphylococcus aureus
RKCVYEEFNYIYIYNLRGDQ

SEQ ID NO: 1679096 - protein, 18 aa, Staphylococcus aureus
RKFKRWVTSEVLPTLRKT

SEQ ID NO: 1679097 - protein, 17 aa, Staphylococcus aureus
RKIDVESVFGFMKAILG

SEQ ID NO: 1679098 - protein, 18 aa, Staphylococcus aureus
RKIIPRIPLLKNVKKFVN

SEQ ID NO: 1679099 - protein, 19 aa, Staphylococcus aureus
RKLLFWVIMNIIRGQHHYD

SEQ ID NO: 1679100 - protein, 19 aa, Staphylococcus aureus
RKLSERRIFPAIEIGRSST

SEQ ID NO: 1679101 - protein, 25 aa, Staphylococcus aureus
RKMTAMLRYQFKVILSALKRKGYNM

SEQ ID NO: 1679102 - protein, 17 aa, Staphylococcus aureus
RKNCSGLSIGDMADERY

SEQ ID NO: 1679103 - protein, 19 aa, Staphylococcus aureus
RKRGIKGLVVIGGDGSYRG

SEQ ID NO: 1679104 - protein, 19 aa, Staphylococcus aureus
RKYLGPAHEAIKETVKGKI

SEQ ID NO: 1679105 - protein, 17 aa, Staphylococcus aureus
RKYWCSKGLALPEVYAG

SEQ ID NO: 1679106 - protein, 19 aa, Staphylococcus aureus
RLAIDSCIEFVARAVAQSH

SEQ ID NO: 1679107 - protein, 18 aa, Staphylococcus aureus
RLAKEVLLSLPNDFDREV

SEQ ID NO: 1679108 - protein, 20 aa, Staphylococcus aureus
RLAMVLVQFPPWFDCNAQNI

SEQ ID NO: 1679109 - protein, 17 aa, Staphylococcus aureus
RLARAAIQYAIDNNRKS

SEQ ID NO: 1679110 - protein, 19 aa, Staphylococcus aureus
RLDVVIKYLIRKSRTIAKG

SEQ ID NO: 1679111 - protein, 19 aa, Staphylococcus aureus
RLGFKRIWFTEHHNVPAFA

SEQ ID NO: 1679112 - protein, 19 aa, Staphylococcus aureus
RLKALYLSVIDRIDIKKDG

SEQ ID NO: 1679113 - protein, 17 aa, Staphylococcus aureus
RLKEIKAPTLILAGEYD

SEQ ID NO: 1679114 - protein, 23 aa, Staphylococcus aureus
RLKKAPHWKTVFNIPRNGENLGL

SEQ ID NO: 1679115 - protein, 17 aa, Staphylococcus aureus
RLLFWVVMNIIRGQHHY

SEQ ID NO: 1679116 - protein, 23 aa, Staphylococcus aureus
RLMWKEMMVILQAFRLPSVNLLQ

SEQ ID NO: 1679117 - protein, 19 aa, Staphylococcus aureus
RLPQDINFFSWLQHVKDSD

SEQ ID NO: 1679118 - protein, 18 aa, Staphylococcus aureus
RLQKTLYFLFAYYGASYG

SEQ ID NO: 1679119 - protein, 20 aa, Staphylococcus aureus
RLRQFFDFITNFGIMIKGTG

SEQ ID NO: 1679120 - protein, 39 aa, Staphylococcus aureus
RLYKSGKNWVKSGIKEIEMFKIMGLPFISHSIVSQDNQS

SEQ ID NO: 1679121 - protein, 39 aa, Staphylococcus aureus
RLYKSGKNWVKSGIKEIEMFKIMGLPFISHSLVSQDNQS

SEQ ID NO: 1679122 - protein, 17 aa, Staphylococcus aureus
RMLQRPILYTGLTRAKM

SEQ ID NO: 1679123 - protein, 22 aa, Staphylococcus aureus
RMYDMLKNFYLYRYQKRIETLS

SEQ ID NO: 1679124 - protein, 18 aa, Staphylococcus aureus
RNDLKLGLELTAVALNPH

SEQ ID NO: 1679125 - protein, 18 aa, Staphylococcus aureus
RNELTVCGSWNCLSSNFP

SEQ ID NO: 1679126 - protein, 19 aa, Staphylococcus aureus
RNELTVCGSWNCLSSNFPG

SEQ ID NO: 1679127 - protein, 17 aa, Staphylococcus aureus
RNEVKMYPEIAIREAVA

SEQ ID NO: 1679128 - protein, 19 aa, Staphylococcus aureus
RPIGSFLFLGPTGVGKTEL

SEQ ID NO: 1679129 - protein, 19 aa, Staphylococcus aureus
RPLFYFGNIMKPLIWLMNG

SEQ ID NO: 1679130 - protein, 19 aa, Staphylococcus aureus
RPQLRALLRASVYGKLNIM

SEQ ID NO: 1679131 - protein, 21 aa, Staphylococcus aureus
RPTDGGLSWSDDHKSLIYRYD

SEQ ID NO: 1679132 - protein, 20 aa, Staphylococcus aureus
RPYYPFPLIVDDAFVHFDKK

SEQ ID NO: 1679133 - protein, 17 aa, Staphylococcus aureus
RQCDVLCCYRLNRLHRN

SEQ ID NO: 1679134 - protein, 17 aa, Staphylococcus aureus
RQFSVFVGTDLDLQLRR

SEQ ID NO: 1679135 - protein, 24 aa, Staphylococcus aureus
RRDNEFWKSIAFGVSTGNRNQMLT

SEQ ID NO: 1679136 - protein, 17 aa, Staphylococcus aureus
RRGHRVCVFKPFQTEER

SEQ ID NO: 1679137 - protein, 17 aa, Staphylococcus aureus
RRMQFFLSQNFHVAEQF

SEQ ID NO: 1679138 - protein, 19 aa, Staphylococcus aureus
RSALYIKHLTAFIDQLISL

SEQ ID NO: 1679139 - protein, 19 aa, Staphylococcus aureus
RSAYHILDMVFWFVNLQIL

SEQ ID NO: 1679140 - protein, 17 aa, Staphylococcus aureus
RTLIYFPACLSFMSRSQ

SEQ ID NO: 1679141 - protein, 19 aa, Staphylococcus aureus
RTMDIFRLLGVEIKEDDEK

SEQ ID NO: 1679142 - protein, 23 aa, Staphylococcus aureus
RVAIEMASPLGWHKYVGTAGEVI

SEQ ID NO: 1679143 - protein, 24 aa, Staphylococcus aureus
RVPILGVCLGFQCIVSYFGGNIIH

SEQ ID NO: 1679144 - protein, 18 aa, Staphylococcus aureus
RVRGCWEFSEALDAPYGM

SEQ ID NO: 1679145 - protein, 43 aa, Staphylococcus aureus; identical to SEQ ID NO: 1586607

SEQ ID NO: 1679146 - protein, 18 aa, Staphylococcus aureus
RVSPDLFIKRLNFYDYLL

SEQ ID NO: 1679147 - protein, 20 aa, Staphylococcus aureus
RWDIRICPHPSAIELSKNPS

SEQ ID NO: 1679148 - protein, 19 aa, Staphylococcus aureus
RYADIIVVCYHGRFEKDIE

SEQ ID NO: 1679149 - protein, 18 aa, Staphylococcus aureus
RYLQEEYNIYGFNDTNKG

SEQ ID NO: 1679150 - protein, 21 aa, Staphylococcus aureus
RYPFELSGGMAQRIAFIMSLI

SEQ ID NO: 1679151 - protein, 17 aa, Staphylococcus aureus
RYTFVWKKSIPNHESKL

SEQ ID NO: 1679152 - protein, 17 aa, Staphylococcus aureus
SAGSRILVQNSIKDKFK

SEQ ID NO: 1679153 - protein, 19 aa, Staphylococcus aureus
SAYHILDMVFWFGNLQILA

SEQ ID NO: 1679154 - protein, 19 aa, Staphylococcus aureus
SCFKCKGKGCNVCKHTGWI

SEQ ID NO: 1679155 - protein, 18 aa, Staphylococcus aureus
SCNSEYFFTLSYFLKPGK

SEQ ID NO: 1679156 - protein, 26 aa, Staphylococcus aureus
SDFLDCFCLVGATALTFSLISITGVT

SEQ ID NO: 1679157 - protein, 27 aa, Staphylococcus aureus
SDIKIRVENVLKICRLYAFRNWPIAAL

SEQ ID NO: 1679158 - protein, 18 aa, Staphylococcus aureus
SDSLRTSTSLSDSLSMST

SEQ ID NO: 1679159 - protein, 17 aa, Staphylococcus aureus
SDSSVLLFNIIKNNQPL

SEQ ID NO: 1679160 - protein, 17 aa, Staphylococcus aureus
SDVAYDWNISMDELNED

SEQ ID NO: 1679161 - protein, 17 aa, Staphylococcus aureus
SECILLFSERDINLHEY

SEQ ID NO: 1679162 - protein, 26 aa, Staphylococcus aureus
SEEFKKRWPINIGFIGNVRFNEINQK

SEQ ID NO: 1679163 - protein, 17 aa, Staphylococcus aureus
SEFKPNFINDSLENETN

SEQ ID NO: 1679164 - protein, 17 aa, Staphylococcus aureus
SEINAIIKQCLSLPQTR

SEQ ID NO: 1679165 - protein, 20 aa, Staphylococcus aureus
SELARPLLLAALSKDNEVVK

SEQ ID NO: 1679166 - protein, 18 aa, Staphylococcus aureus
SELARPLLSASLSKDNEV

SEQ ID NO: 1679167 - protein, 19 aa, Staphylococcus aureus
SELKIAIGPVERGGAGGGI

SEQ ID NO: 1679168 - protein, 21 aa, Staphylococcus aureus
SELKNRIPLVLEVKSDQYQSS

SEQ ID NO: 1679169 - protein, 19 aa, Staphylococcus aureus
SELLEKVWGYDYYEDANTV

SEQ ID NO: 1679170 - protein, 24 aa, Staphylococcus aureus
SELQLIRRSVCEFIKGHSLIDTSI

SEQ ID NO: 1679171 - protein, 18 aa, Staphylococcus aureus
SESAESIWVIKGIIEAAK

SEQ ID NO: 1679172 - protein, 20 aa, Staphylococcus aureus
SEVYSPISPIKIATQDNSGN

SEQ ID NO: 1679173 - protein, 24 aa, Staphylococcus aureus
SEYLRPEICKELRQKLKQYHYVES

SEQ ID NO: 1679174 - protein, 23 aa, Staphylococcus aureus
SFELRKKHILGIVGESGSGKSIT

SEQ ID NO: 1679175 - protein, 18 aa, Staphylococcus aureus
SFIEYLLFRYRFKSRIAV

SEQ ID NO: 1679176 - protein, 20 aa, Staphylococcus aureus
SFLAKLLWIYTSFFKGQMIY

SEQ ID NO: 1679177 - protein, 20 aa, Staphylococcus aureus
SGEVWAYYRIRSESISTANY

SEQ ID NO: 1679178 - protein, 24 aa, Staphylococcus aureus
SGGAKFAGAALRFLTGPIGATITA

SEQ ID NO: 1679179 - protein, 22 aa, Staphylococcus aureus
SGGKRVRPAFVILSSQFGKDDQ

SEQ ID NO: 1679180 - protein, 24 aa, Staphylococcus aureus
SGGMKRRLSLAISFLQNPNILILD

SEQ ID NO: 1679181 - protein, 18 aa, Staphylococcus aureus
SGLFKKMHIRMMPAQEPP

SEQ ID NO: 1679182 - protein, 19 aa, Staphylococcus aureus
SGLFPDVYRHIGYIQSNFL

SEQ ID NO: 1679183 - protein, 20 aa, Staphylococcus aureus
SGMIPVEWEKVYTIAYLDDE

SEQ ID NO: 1679184 - protein, 19 aa, Staphylococcus aureus
SGMIPVEWEKVYTIAYVDD

SEQ ID NO: 1679185 - protein, 20 aa, Staphylococcus aureus
SGMIPVEWEKVYTIAYVNDR

SEQ ID NO: 1679186 - protein, 19 aa, Staphylococcus aureus
SGMIPVEWGKVYAMAYIDD

SEQ ID NO: 1679187 - protein, 20 aa, Staphylococcus aureus
SGPAALRCSQFVYKEQKIKR

SEQ ID NO: 1679188 - protein, 17 aa, Staphylococcus aureus
SGTTIGFIPTMGVLHDG

SEQ ID NO: 1679189 - protein, 20 aa, Staphylococcus aureus
SGVFMEWSCLFVIKSDDLRD

SEQ ID NO: 1679190 - protein, 21 aa, Staphylococcus aureus
SGVFMEWSCSFVIKSDDLKDC

SEQ ID NO: 1679191 - protein, 20 aa, Staphylococcus aureus
SGYCLKNKYMYGGVTLAGDY

SEQ ID NO: 1679192 - protein, 20 aa, Staphylococcus aureus
SHIYRLKGFMTFEDTAHTYL

SEQ ID NO: 1679193 - protein, 20 aa, Staphylococcus aureus
SHYLKVRPGAFFLTGCGNKS

SEQ ID NO: 1679194 - protein, 19 aa, Staphylococcus aureus
SIGLILGFLVERFMNNQEK

SEQ ID NO: 1679195 - protein, 18 aa, Staphylococcus aureus
SIISRYAFVTNMDQISKN

SEQ ID NO: 1679196 - protein, 17 aa, Staphylococcus aureus
SINEVFEKQAGIFFDKN

SEQ ID NO: 1679197 - protein, 23 aa, Staphylococcus aureus
SIPERRPEGAVTYHMPTHCPSCG

SEQ ID NO: 1679198 - protein, 23 aa, Staphylococcus aureus
SKGKITYLKGEAMQYDLSTTGGN

SEQ ID NO: 1679199 - protein, 20 aa, Staphylococcus aureus
SKHFPSVFALIGSHSEYDLH

SEQ ID NO: 1679200 - protein, 19 aa, Staphylococcus aureus
SKILEELPHLSVEIMDNTK

SEQ ID NO: 1679201 - protein, 17 aa, Staphylococcus aureus
SKSELLEKVWGYDYYED

SEQ ID NO: 1679202 - protein, 18 aa, Staphylococcus aureus
SKTKLVYIKSIQDLTESV

SEQ ID NO: 1679203 - protein, 20 aa, Staphylococcus aureus
SLIKVLRPYYPFPLIVDDAF

SEQ ID NO: 1679204 - protein, 17 aa, Staphylococcus aureus
SLPIPKYRYFKLNNNKI

SEQ ID NO: 1679205 - protein, 19 aa, Staphylococcus aureus
SLVDCLKFDISGEVYEDLL

SEQ ID NO: 1679206 - protein, 17 aa, Staphylococcus aureus
SMIPVEWEKVYTIAYVD

SEQ ID NO: 1679207 - protein, 22 aa, Staphylococcus aureus
SNAKLWLAEFAWHDTSSAHYRS

SEQ ID NO: 1679208 - protein, 18 aa, Staphylococcus aureus
SNFTTGWIFFINSVGELE

SEQ ID NO: 1679209 - protein, 24 aa, Staphylococcus aureus
SNIKFKMNLAFDWENSILKANHVN

SEQ ID NO: 1679210 - protein, 25 aa, Staphylococcus aureus
SNIPVGRGMIKWAPFATLPEQFETI

SEQ ID NO: 1679211 - protein, 18 aa, Staphylococcus aureus
SNLIKFGYLKIEIIKEGN

SEQ ID NO: 1679212 - protein, 23 aa, Staphylococcus aureus
SNLPFELIGAIPVLIKKNGNIDE

SEQ ID NO: 1679213 - protein, 19 aa, Staphylococcus aureus
SNLTWKNGVAFYSNNAQGD

SEQ ID NO: 1679214 - protein, 18 aa, Staphylococcus aureus
SNPFKLGASIGRYSGRIH

SEQ ID NO: 1679215 - protein, 19 aa, Staphylococcus aureus
SNTEILYELGLGKYIVGVS

SEQ ID NO: 1679216 - protein, 19 aa, Staphylococcus aureus
SQEGYSIWFEEFERDQLQR

SEQ ID NO: 1679217 - protein, 24 aa, Staphylococcus aureus
SQFNLPMRYIWGIYEPQSDDQNMN

SEQ ID NO: 1679218 - protein, 21 aa, Staphylococcus aureus
SQLTIMCKLGWDDEINFAKIS

SEQ ID NO: 1679219 - protein, 20 aa, Staphylococcus aureus
SQRKIDVEPVFGFMKAILGF

SEQ ID NO: 1679220 - protein, 18 aa, Staphylococcus aureus
SRAIPIFVFLNDQFEQET

SEQ ID NO: 1679221 - protein, 23 aa, Staphylococcus aureus
SRFDEIYYLYTIICVDIGEQVKI

SEQ ID NO: 1679222 - protein, 19 aa, Staphylococcus aureus
SRIDSCIKFLYLTQEEKQK

SEQ ID NO: 1679223 - protein, 20 aa, Staphylococcus aureus
SRLPQDINFFAWLQHVKDSD

SEQ ID NO: 1679224 - protein, 17 aa, Staphylococcus aureus
SRTPISISIMVKDGSND

SEQ ID NO: 1679225 - protein, 29 aa, Staphylococcus aureus
SRVEKSIADWGIKLERTFYVSKFAHPENE

SEQ ID NO: 1679226 - protein, 21 aa, Staphylococcus aureus
SRYVFRSDVAYDWNISMDELN

SEQ ID NO: 1679227 - protein, 20 aa, Staphylococcus aureus
SSDLRTCLALAYDEIKNRKG

SEQ ID NO: 1679228 - protein, 24 aa, Staphylococcus aureus
SSDVLKLKANYTIDDSVKEGDTFT

SEQ ID NO: 1679229 - protein, 21 aa, Staphylococcus aureus
SSELARPLLLAALSKANEVVK

SEQ ID NO: 1679230 - protein, 19 aa, Staphylococcus aureus
SSLFSVKKITFDLSDAKKT

SEQ ID NO: 1679231 - protein, 18 aa, Staphylococcus aureus
SSMILVEWEKVYTMAYID

SEQ ID NO: 1679232 - protein, 20 aa, Staphylococcus aureus
SSMIPVEWEKVYAIAYVDDE

SEQ ID NO: 1679233 - protein, 19 aa, Staphylococcus aureus
SSMIPVEWEKVYAMAYIDE

SEQ ID NO: 1679234 - protein, 19 aa, Staphylococcus aureus
SSMIPVEWEKVYAMAYVNE

SEQ ID NO: 1679235 - protein, 25 aa, Staphylococcus aureus
SSSGRSPSQLGFRYYVNRLLEQTSH

SEQ ID NO: 1679236 - protein, 18 aa, Staphylococcus aureus
STGLEGFLGSSFAGGTGL

SEQ ID NO: 1679237 - protein, 17 aa, Staphylococcus aureus
STLSKRPFNVFMTPSDK

SEQ ID NO: 1679238 - protein, 18 aa, Staphylococcus aureus
STWRYRISLGKDVKTGKY

SEQ ID NO: 1679239 - protein, 18 aa, Staphylococcus aureus
SVSRTCDILGIGVGTYYH

SEQ ID NO: 1679240 - protein, 17 aa, Staphylococcus aureus
SWIPCKIEDQFLNQEIN

SEQ ID NO: 1679241 - protein, 18 aa, Staphylococcus aureus
SWKAKGILLYLLSRPDNW

SEQ ID NO: 1679242 - protein, 19 aa, Staphylococcus aureus
SYILHRISDEFKEKGYSPT

SEQ ID NO: 1679243 - protein, 21 aa, Staphylococcus aureus
SYNCLKRAGINSVQELADKSE

SEQ ID NO: 1679244 - protein, 18 aa, Staphylococcus aureus
TADMKRLAGTTTLDNEEP

SEQ ID NO: 1679245 - protein, 19 aa, Staphylococcus aureus
TAFLRYRLGLDQIVMNQSG

SEQ ID NO: 1679246 - protein, 25 aa, Staphylococcus aureus
TAPVKLRTFSRLAMSTFASAATTTA

SEQ ID NO: 1679247 - protein, 19 aa, Staphylococcus aureus
TASEVVEWALYIAKKKIAI

SEQ ID NO: 1679248 - protein, 19 aa, Staphylococcus aureus
TASEVVEWALYIAKNKIAI

SEQ ID NO: 1679249 - protein, 20 aa, Staphylococcus aureus
TASEVVEWALYMAKNRRVID

SEQ ID NO: 1679250 - protein, 19 aa, Staphylococcus aureus
TAVKQDLTEVQALDQLMDA

SEQ ID NO: 1679251 - protein, 20 aa, Staphylococcus aureus
TCGSGSLLLRVGKETQVYRY

SEQ ID NO: 1679252 - protein, 17 aa, Staphylococcus aureus
TCSFDLVRHEFPKLQSI

SEQ ID NO: 1679253 - protein, 25 aa, Staphylococcus aureus
TDMIKFKYPRLFENVRLALNDSWPD

SEQ ID NO: 1679254 - protein, 19 aa, Staphylococcus aureus
TDSPGGWQIIGRTPLKVFS

SEQ ID NO: 1679255 - protein, 18 aa, Staphylococcus aureus
TDSYYCFSYSLKDNSKKV

SEQ ID NO: 1679256 - protein, 19 aa, Staphylococcus aureus
TDVDLRLSKQAKYTVNFKN

SEQ ID NO: 1679257 - protein, 17 aa, Staphylococcus aureus
TEFKEWVGDAIFVAHNA

SEQ ID NO: 1679258 - protein, 17 aa, Staphylococcus aureus
TEIVYRFLKYLFTHTYE

SEQ ID NO: 1679259 - protein, 20 aa, Staphylococcus aureus
TEVHSSLPFLLTGDVSCNHA

SEQ ID NO: 1679260 - protein, 20 aa, Staphylococcus aureus
TFASLDIFNGLKRRAQTILD

SEQ ID NO: 1679261 - protein, 22 aa, Staphylococcus aureus
TFATSLPAKFVVKNVQPAKPTV

SEQ ID NO: 1679262 - protein, 21 aa, Staphylococcus aureus
TFGSFRPWPAYLYTIEHSIYV

SEQ ID NO: 1679263 - protein, 19 aa, Staphylococcus aureus
TFGSFRPWPAYQYTIEHSI

SEQ ID NO: 1679264 - protein, 17 aa, Staphylococcus aureus
TFMMPKFLKSFFNEHPF

SEQ ID NO: 1679265 - protein, 17 aa, Staphylococcus aureus
TFPNCLKITAKNDEAII

SEQ ID NO: 1679266 - protein, 17 aa, Staphylococcus aureus
TFPNCLKVTAKNDEAII

SEQ ID NO: 1679267 - protein, 25 aa, Staphylococcus aureus
TGEVLEGGKIRYTFTNDIEDKVDVT

SEQ ID NO: 1679268 - protein, 17 aa, Staphylococcus aureus
TGRPYRASQMYYHELNL

SEQ ID NO: 1679269 - protein, 24 aa, Staphylococcus aureus
TGSVVLPGRFFVDIIKKLPGKDVK

SEQ ID NO: 1679270 - protein, 17 aa, Staphylococcus aureus
TGYGLKTTAVIGGAFTV

SEQ ID NO: 1679271 - protein, 17 aa, Staphylococcus aureus
THLADWAYQANILGLKD

SEQ ID NO: 1679272 - protein, 25 aa, Staphylococcus aureus
TIASMIIEFAEWVNTLEFFKNWKKQ

SEQ ID NO: 1679273 - protein, 23 aa, Staphylococcus aureus
TIMRKRLDMLASFIESKVPDVEI

SEQ ID NO: 1679274 - protein, 19 aa, Staphylococcus aureus
TIRIPVHMVETINKLIRVQ

SEQ ID NO: 1679275 - protein, 27 aa, Staphylococcus aureus
TKAQFIKRLACLPSHIYRLKGFMTFED

SEQ ID NO: 1679276 - protein, 22 aa, Staphylococcus aureus
TKGRLQKDLINWFIDGQYKLFY

SEQ ID NO: 1679277 - protein, 23 aa, Staphylococcus aureus
TKGRLQKDLINWFIVDQYKLFYK

SEQ ID NO: 1679278 - protein, 19 aa, Staphylococcus aureus
TKIKAWVRQLLWMSIYQYV

SEQ ID NO: 1679279 - protein, 17 aa, Staphylococcus aureus
TKIKPAAREKINQKANE

SEQ ID NO: 1679280 - protein, 18 aa, Staphylococcus aureus
TKNPRLAKEVLLSLPNDF

SEQ ID NO: 1679281 - protein, 24 aa, Staphylococcus aureus
TKPSFEFEKQFGFMLKPWTTVRFM

SEQ ID NO: 1679282 - protein, 19 aa, Staphylococcus aureus
TKRRFRFGKSIGRQYGFQI

SEQ ID NO: 1679283 - protein, 18 aa, Staphylococcus aureus
TKVFTRFGVEVDFVDTTH

SEQ ID NO: 1679284 - protein, 17 aa, Staphylococcus aureus
TKVKPAAREKINQKANE

SEQ ID NO: 1679285 - protein, 22 aa, Staphylococcus aureus
TKYKIGGTWYPFYKKNDGDLTK

SEQ ID NO: 1679286 - protein, 22 aa, Staphylococcus aureus
TLGLRWLVNYARLRGEKTMEDR

SEQ ID NO: 1679287 - protein, 19 aa, Staphylococcus aureus
TLLDFRYQRHFKASKGENG

SEQ ID NO: 1679288 - protein, 18 aa, Staphylococcus aureus
TLLTIGRFPICYINIEMD

SEQ ID NO: 1679289 - protein, 18 aa, Staphylococcus aureus
TLQGYGFPVISRKEMQQE

SEQ ID NO: 1679290 - protein, 24 aa, Staphylococcus aureus
TNKDGYKYYSFIDNVGLFSGSHLY

SEQ ID NO: 1679291 - protein, 25 aa, Staphylococcus aureus
TNYDYTKLVFAKPIYNDPSLVKSDT

SEQ ID NO: 1679292 - protein, 18 aa, Staphylococcus aureus
TPEFKLQMVRLFENGKSK

SEQ ID NO: 1679293 - protein, 17 aa, Staphylococcus aureus
TPISISIMVKDGSNDHK

SEQ ID NO: 1679294 - protein, 18 aa, Staphylococcus aureus
TRIKLKWTPQIMDQIRVL

SEQ ID NO: 1679295 - protein, 19 aa, Staphylococcus aureus
TRIKLKWTPQIMHQIRVLR

SEQ ID NO: 1679296 - protein, 20 aa, Staphylococcus aureus
TRISDALIRMQREHVHMSLI

SEQ ID NO: 1679297 - protein, 18 aa, Staphylococcus aureus
TRIWEILGEIIGETASDE

SEQ ID NO: 1679298 - protein, 20 aa, Staphylococcus aureus
TRLANHLGWKGKGTNFDVLP

SEQ ID NO: 1679299 - protein, 23 aa, Staphylococcus aureus
TRMVKEVLEGAGLDQAITYSLVS

SEQ ID NO: 1679300 - protein, 17 aa, Staphylococcus aureus
TRNAFFIGRTIDYNVSL

SEQ ID NO: 1679301 - protein, 18 aa, Staphylococcus aureus
TRNISDWIAKSGTTNFSL

SEQ ID NO: 1679302 - protein, 17 aa, Staphylococcus aureus
TSEVPSAIFGTMKHKKL

SEQ ID NO: 1679303 - protein, 17 aa, Staphylococcus aureus
TSIPTCILVFKKCRQQD

SEQ ID NO: 1679304 - protein, 17 aa, Staphylococcus aureus
TSLFEMAEYIGISEPQK

SEQ ID NO: 1679305 - protein, 18 aa, Staphylococcus aureus
TSSQRWGLNQGINANGWM

SEQ ID NO: 1679306 - protein, 17 aa, Staphylococcus aureus
TSVKALLKEAGYNDDID

SEQ ID NO: 1679307 - protein, 24 aa, Staphylococcus aureus
TTASERWMRMGILGVEMESAALYM

SEQ ID NO: 1679308 - protein, 18 aa, Staphylococcus aureus
TTAVIGGAFTVNMLHDQQ

SEQ ID NO: 1679309 - protein, 18 aa, Staphylococcus aureus
TTTTFKYEVTRNSMSDSV

SEQ ID NO: 1679310 - protein, 24 aa, Staphylococcus aureus
TVASMIIEFAEWVNTLEFFKNWKK

SEQ ID NO: 1679311 - protein, 18 aa, Staphylococcus aureus
TYFLFYVIRELFRRHSEV

SEQ ID NO: 1679312 - protein, 17 aa, Staphylococcus aureus
VADELYHLFVLMHALGI

SEQ ID NO: 1679313 - protein, 18 aa, Staphylococcus aureus
VAESRLDNIISMADQDLT

SEQ ID NO: 1679314 - protein, 22 aa, Staphylococcus aureus
VAIEMASPLGWHKYVGTAGKVI

SEQ ID NO: 1679315 - protein, 22 aa, Staphylococcus aureus
VAIEMASSLGWHKYVGTAGKVI

SEQ ID NO: 1679316 - protein, 18 aa, Staphylococcus aureus
VALDYALTGLEFACGIPG

SEQ ID NO: 1679317 - protein, 17 aa, Staphylococcus aureus
VALSSMSPLLFPPSKQD

SEQ ID NO: 1679318 - protein, 17 aa, Staphylococcus aureus
VARDVGRIMGFDEVTLN

SEQ ID NO: 1679319 - protein, 23 aa, Staphylococcus aureus
VASMIIEFAEWVNTLEFFKNWKK

SEQ ID NO: 1679320 - protein, 19 aa, Staphylococcus aureus
VASMIIEFVEWVNTLEFFK

SEQ ID NO: 1679321 - protein, 18 aa, Staphylococcus aureus
VCGSWNCLSSNFPGKDWT

SEQ ID NO: 1679322 - protein, 18 aa, Staphylococcus aureus
VCGSWNCLSSNFPGKEWM

SEQ ID NO: 1679323 - protein, 24 aa, Staphylococcus aureus
VCKKEFKNNLALCVYYLEKLIKDN

SEQ ID NO: 1679324 - protein, 19 aa, Staphylococcus aureus
VCSCCGQQLPAEQVNEARE

SEQ ID NO: 1679325 - protein, 21 aa, Staphylococcus aureus
VCYMWLRFNIDLQFDDTTINQ

SEQ ID NO: 1679326 - protein, 19 aa, Staphylococcus aureus
VCYMWLRFNIDQQFDDTAI

SEQ ID NO: 1679327 - protein, 18 aa, Staphylococcus aureus
VCYMWLRFNMDQQFEDTV

SEQ ID NO: 1679328 - protein, 18 aa, Staphylococcus aureus
VDMMVEYEIPLSIENLKV

SEQ ID NO: 1679329 - protein, 21 aa, Staphylococcus aureus
VEAAIKIARKWGSEVKDITDG

SEQ ID NO: 1679330 - protein, 21 aa, Staphylococcus aureus
VEAAIKIARKWGSEVKGIADG

SEQ ID NO: 1679331 - protein, 28 aa, Staphylococcus aureus
VEEMERRYKLFAHYHVRNITAFNKKAPY

SEQ ID NO: 1679332 - protein, 17 aa, Staphylococcus aureus
VEFFNLFFNTEQIKYSD

SEQ ID NO: 1679333 - protein, 18 aa, Staphylococcus aureus
VEFLFEFLCVGAPPRYYL

SEQ ID NO: 1679334 - protein, 17 aa, Staphylococcus aureus
VEIIFNLAYGIIMKIKE

SEQ ID NO: 1679335 - protein, 19 aa, Staphylococcus aureus
VEPYIGAFIYLYFKNQPRN

SEQ ID NO: 1679336 - protein, 23 aa, Staphylococcus aureus
VETALKAARRWAYDVKGMEPNKA

SEQ ID NO: 1679337 - protein, 23 aa, Staphylococcus aureus
VEVLRMLRLVIDMSKEPDLYLQI

SEQ ID NO: 1679338 - protein, 19 aa, Staphylococcus aureus
VFETARGVLYPGVSDMYDA

SEQ ID NO: 1679339 - protein, 23 aa, Staphylococcus aureus
VFIKGGDGFDFGHVERFIQNPPH

SEQ ID NO: 1679340 - protein, 17 aa, Staphylococcus aureus
VFKTRRVRFEAMLAKAD

SEQ ID NO: 1679341 - protein, 25 aa, Staphylococcus aureus
VGIGGLSNAFGFKLDTYHNTSKPNS

SEQ ID NO: 1679342 - protein, 19 aa, Staphylococcus aureus
VGLWSFDFNIDWHAGGDKR

SEQ ID NO: 1679343 - protein, 26 aa, Staphylococcus aureus
VGNLLPGDYFGTIRFGRKEQLFEIRV

SEQ ID NO: 1679344 - protein, 23 aa, Staphylococcus aureus
VHHPNEILECILIEAPDLKNTAS

SEQ ID NO: 1679345 - protein, 17 aa, Staphylococcus aureus
VIDEFFKILKIIPKEYH

SEQ ID NO: 1679346 - protein, 19 aa, Staphylococcus aureus
VIDVIKRPLIIHGKTKNDD

SEQ ID NO: 1679347 - protein, 20 aa, Staphylococcus aureus
VIEMYKLKKFLGIDDDKDDD

SEQ ID NO: 1679348 - protein, 19 aa, Staphylococcus aureus
VIEMYKLKKLLGLADNKED

SEQ ID NO: 1679349 - protein, 18 aa, Staphylococcus aureus
VIENLRFTIGEDICLVHC

SEQ ID NO: 1679350 - protein, 21 aa, Staphylococcus aureus
VIKCNYRLGALGYLDWSYFNK

SEQ ID NO: 1679351 - protein, 24 aa, Staphylococcus aureus
VINMFSFFIGYHFNKLDIGIERIF

SEQ ID NO: 1679352 - protein, 19 aa, Staphylococcus aureus
VIPSIKGIGAWTVQMFMLF

SEQ ID NO: 1679353 - protein, 22 aa, Staphylococcus aureus
VIRSVFKYAFKYYDLHDISVLD

SEQ ID NO: 1679354 - protein, 20 aa, Staphylococcus aureus
VKAGAMSLVPLLKSNTPFAD

SEQ ID NO: 1679355 - protein, 21 aa, Staphylococcus aureus
VKFFYKYLKGINVDNIAVIGS

SEQ ID NO: 1679356 - protein, 17 aa, Staphylococcus aureus
VKHVIPEIVAHSHYTVQ

SEQ ID NO: 1679357 - protein, 18 aa, Staphylococcus aureus
VKISGLFKKNACTNDAGT

SEQ ID NO: 1679358 - protein, 19 aa, Staphylococcus aureus
VKRPWLPPLPENVYQEDLV

SEQ ID NO: 1679359 - protein, 17 aa, Staphylococcus aureus
VKVEGRISVITFHSLED

SEQ ID NO: 1679360 - protein, 18 aa, Staphylococcus aureus
VLECPRCQSKLHLSRSIK

SEQ ID NO: 1679361 - protein, 18 aa, Staphylococcus aureus
VLFLWRLSSELNVAQLRQ

SEQ ID NO: 1679362 - protein, 17 aa, Staphylococcus aureus
VLKELGFDFSNSYNPNS

SEQ ID NO: 1679363 - protein, 20 aa, Staphylococcus aureus
VLKTPFHYVLSIYQNKNNDI

SEQ ID NO: 1679364 - protein, 17 aa, Staphylococcus aureus
VLQEALNFLRMGDRFVV

SEQ ID NO: 1679365 - protein, 18 aa, Staphylococcus aureus
VLRFGYDGIDVIDLNLFE

SEQ ID NO: 1679366 - protein, 20 aa, Staphylococcus aureus
VLRKAYLESFRKGFKQQIEN

SEQ ID NO: 1679367 - protein, 18 aa, Staphylococcus aureus
VLTGFKFIAQEIRQLDDY

SEQ ID NO: 1679368 - protein, 18 aa, Staphylococcus aureus
VMKLGIEYFLPVKDVFNN

SEQ ID NO: 1679369 - protein, 18 aa, Staphylococcus aureus
VNDIFLIEEFMRGQEYSI

SEQ ID NO: 1679370 - protein, 17 aa, Staphylococcus aureus
VNFGIVYGISDYGLSQS

SEQ ID NO: 1679371 - protein, 18 aa, Staphylococcus aureus
VPEARLLVISPYDKSSVA

SEQ ID NO: 1679372 - protein, 22 aa, Staphylococcus aureus
VPEDHAYIRFPVSDGTQELKIV

SEQ ID NO: 1679373 - protein, 24 aa, Staphylococcus aureus
VQEGLRVYWYYDLIDNEIKIVCID

SEQ ID NO: 1679374 - protein, 19 aa, Staphylococcus aureus
VQFLPGYCVLLPKREVRLL

SEQ ID NO: 1679375 - protein, 23 aa, Staphylococcus aureus
VQHPNEILECILIEAPDLKNAAS

SEQ ID NO: 1679376 - protein, 18 aa, Staphylococcus aureus
VQTGRDWWTTGFSKLETI

SEQ ID NO: 1679377 - protein, 17 aa, Staphylococcus aureus
VRGCWEFSEALDAPYGM

SEQ ID NO: 1679378 - protein, 22 aa, Staphylococcus aureus
VRNFLKQNIEDIHFANDDQPNN

SEQ ID NO: 1679379 - protein, 20 aa, Staphylococcus aureus
VRNFLKQNIEDINFANDDHP

SEQ ID NO: 1679380 - protein, 18 aa, Staphylococcus aureus
VRPGAFFLTGCGNKSKGI

SEQ ID NO: 1679381 - protein, 19 aa, Staphylococcus aureus
VRVGMEMDRSELLRKTCRC

SEQ ID NO: 1679382 - protein, 19 aa, Staphylococcus aureus
VRYMPVWAYDASNWSNEET

SEQ ID NO: 1679383 - protein, 22 aa, Staphylococcus aureus
VSELKNRIPLVLEVKTDQYQSS

SEQ ID NO: 1679384 - protein, 17 aa, Staphylococcus aureus
VSFKVVYFQPASSLNTE

SEQ ID NO: 1679385 - protein, 24 aa, Staphylococcus aureus
VSGGARFAGAALRFLTGPIGATIT

SEQ ID NO: 1679386 - protein, 25 aa, Staphylococcus aureus
VSGGARFAGVALRFLTGPIGSTITA

SEQ ID NO: 1679387 - protein, 21 aa, Staphylococcus aureus
VSGIFPFKFLKSGKFYYKQTA

SEQ ID NO: 1679388 - protein, 19 aa, Staphylococcus aureus
VSPYKFLLSHGFVMDGEGK

SEQ ID NO: 1679389 - protein, 20 aa, Staphylococcus aureus
VSRLKRFGHHISMQTLYQYK

SEQ ID NO: 1679390 - protein, 18 aa, Staphylococcus aureus
VSSLRLDVVIKYLIRKSR

SEQ ID NO: 1679391 - protein, 24 aa, Staphylococcus aureus
VSVDKIWLDPGIGFAKTREEEAEV

SEQ ID NO: 1679392 - protein, 17 aa, Staphylococcus aureus
VTAFDFFQDNGFGFITP

SEQ ID NO: 1679393 - protein, 17 aa, Staphylococcus aureus
VTDLDSANWVFKKLDAI

SEQ ID NO: 1679394 - protein, 19 aa, Staphylococcus aureus
VVEEIKRLIEINSIQDVEP

SEQ ID NO: 1679395 - protein, 22 aa, Staphylococcus aureus
VVEGPLWIQVHAFDKGVEVTIS

SEQ ID NO: 1679396 - protein, 21 aa, Staphylococcus aureus
VVEGPLWIQVHAFEKGVEVTI

SEQ ID NO: 1679397 - protein, 17 aa, Staphylococcus aureus
VVLRLYGPGTWYGKDGM

SEQ ID NO: 1679398 - protein, 17 aa, Staphylococcus aureus
VVLRPNVAFSMISKFNL

SEQ ID NO: 1679399 - protein, 25 aa, Staphylococcus aureus
VWGFTWKLGPFQLWDAMGYERVKTR

SEQ ID NO: 1679400 - protein, 17 aa, Staphylococcus aureus
VYILYKFDRYLLKQLFS

SEQ ID NO: 1679401 - protein, 17 aa, Staphylococcus aureus
VYREWKHFINGANKITL

SEQ ID NO: 1679402 - protein, 19 aa, Staphylococcus aureus
VYTDIKWCRMIIRQILSNA

SEQ ID NO: 1679403 - protein, 19 aa, Staphylococcus aureus
WFNVICMFREDGIYYYCNL

SEQ ID NO: 1679404 - protein, 26 aa, Staphylococcus aureus
WGGVPNEFNGAVFINENVRNFLKQNI

SEQ ID NO: 1679405 - protein, 26 aa, Staphylococcus aureus
WGGVPNQFNGAVFINENVRNFLKQNI

SEQ ID NO: 1679406 - protein, 17 aa, Staphylococcus aureus
WGLNQGINANGWMRTDL

SEQ ID NO: 1679407 - protein, 18 aa, Staphylococcus aureus
WHRFKYYVVVNHLGHLVS

SEQ ID NO: 1679408 - protein, 18 aa, Staphylococcus aureus
WKPLLSDILLYFLSKNTD

SEQ ID NO: 1679409 - protein, 17 aa, Staphylococcus aureus
WLKPYRRALHLEEPVVK

SEQ ID NO: 1679410 - protein, 17 aa, Staphylococcus aureus
WMEMNGLGSFNTEYRNR

SEQ ID NO: 1679411 - protein, 19 aa, Staphylococcus aureus
WNAKFIDRGYIFTNTAGSP

SEQ ID NO: 1679412 - protein, 21 aa, Staphylococcus aureus
WRLLPEFWGKGLATEGANATL

SEQ ID NO: 1679413 - protein, 20 aa, Staphylococcus aureus
WRNQLLYAFDHLNICREMLL

SEQ ID NO: 1679414 - protein, 17 aa, Staphylococcus aureus
WRVYRLVKFSKVFKNVI

SEQ ID NO: 1679415 - protein, 17 aa, Staphylococcus aureus
WYAFQCFDYANAGWKAL

SEQ ID NO: 1679416 - protein, 20 aa, Staphylococcus aureus
WYERSIKLFSEFFGENMLVK

SEQ ID NO: 1679417 - protein, 24 aa, Staphylococcus aureus
WYERSIKLFSEFFGLNMLVKNITR

SEQ ID NO: 1679418 - protein, 18 aa, Staphylococcus aureus
WYGFQCFDYANAGWKALF

SEQ ID NO: 1679419 - protein, 17 aa, Staphylococcus aureus
YAHRLLMDLGFSREVMS

SEQ ID NO: 1679420 - protein, 24 aa, Staphylococcus aureus
YAIKKEIIEELGFDFSVSHNPYTE

SEQ ID NO: 1679421 - protein, 24 aa, Staphylococcus aureus
YAVFKKPMIFYAFDLEYYITTRDF

SEQ ID NO: 1679422 - protein, 17 aa, Staphylococcus aureus
YAVGLFFSKERVLGSEH

SEQ ID NO: 1679423 - protein, 25 aa, Staphylococcus aureus
YCVDKGWMCIQVFFIRQGNMIKRDT

SEQ ID NO: 1679424 - protein, 19 aa, Staphylococcus aureus
YCYHLKLFYEFMSQSRIEL

SEQ ID NO: 1679425 - protein, 17 aa, Staphylococcus aureus
YDDAIEFLKAEGFDDIE

SEQ ID NO: 1679426 - protein, 17 aa, Staphylococcus aureus
YDDIGLWLAFNNNEDYA

SEQ ID NO: 1679427 - protein, 17 aa, Staphylococcus aureus
YDIEVFKHNAFVVFKDI

SEQ ID NO: 1679428 - protein, 17 aa, Staphylococcus aureus
YEILKPKIVFNGSNPYL

SEQ ID NO: 1679429 - protein, 17 aa, Staphylococcus aureus
YEIYQIWCVNNGYHHLN

SEQ ID NO: 1679430 - protein, 18 aa, Staphylococcus aureus
YERCGGCQLQHLSYESQL

SEQ ID NO: 1679431 - protein, 17 aa, Staphylococcus aureus
YFCPVCGKQVILKRGLK

SEQ ID NO: 1679432 - protein, 17 aa, Staphylococcus aureus
YFEGEGLSILGYRNVPV

SEQ ID NO: 1679433 - protein, 17 aa, Staphylococcus aureus
YFHPFRASKNFTIVPSW

SEQ ID NO: 1679434 - protein, 20 aa, Staphylococcus aureus
YFKRTCNLCGHSQKFNKDNP

SEQ ID NO: 1679435 - protein, 18 aa, Staphylococcus aureus
YFLVEGFLLPPVMFTAAE

SEQ ID NO: 1679436 - protein, 19 aa, Staphylococcus aureus
YHLKCKIFAPYGFSEEKIN

SEQ ID NO: 1679437 - protein, 17 aa, Staphylococcus aureus
YHPTWKMVLGLFPKEDK

SEQ ID NO: 1679438 - protein, 18 aa, Staphylococcus aureus
YIDFDGWHGYQCADLAVD

SEQ ID NO: 1679439 - protein, 17 aa, Staphylococcus aureus
YIGNELWIYSAVLDANN

SEQ ID NO: 1679440 - protein, 24 aa, Staphylococcus aureus
YILKYVFASGIAREIIYALLEEMD

SEQ ID NO: 1679441 - protein, 19 aa, Staphylococcus aureus
YIMNLPVNFLKTFLPELIE

SEQ ID NO: 1679442 - protein, 18 aa, Staphylococcus aureus
YIMNLPVNFLKTFLSELI

SEQ ID NO: 1679443 - protein, 19 aa, Staphylococcus aureus
YKGEFKSAFPLPNTEYTPL

SEQ ID NO: 1679444 - protein, 18 aa, Staphylococcus aureus
YKGYKWMEMNGLGSFNTE

SEQ ID NO: 1679445 - protein, 21 aa, Staphylococcus aureus
YKKIRPNLCRKIYINYHKKRK

SEQ ID NO: 1679446 - protein, 20 aa, Staphylococcus aureus
YKLSNLILDYKCVPFDQMPF

SEQ ID NO: 1679447 - protein, 24 aa, Staphylococcus aureus
YKRTIKISGLKAMYALKSKDFKKM

SEQ ID NO: 1679448 - protein, 21 aa, Staphylococcus aureus
YKRTMFWLEFEIRQYTHSNIT

SEQ ID NO: 1679449 - protein, 23 aa, Staphylococcus aureus
YKVHLMKECLDRGIKVISSMGAA

SEQ ID NO: 1679450 - protein, 19 aa, Staphylococcus aureus
YKYARGVAVYGDIKNFAND

SEQ ID NO: 1679451 - protein, 19 aa, Staphylococcus aureus
YKYARGVAVYGDIKNGANN

SEQ ID NO: 1679452 - protein, 21 aa, Staphylococcus aureus
YKYYYDRGYTLTWDNGLVLYS

SEQ ID NO: 1679453 - protein, 22 aa, Staphylococcus aureus
YLKEFDTLYAYDLFLLTHIFII

SEQ ID NO: 1679454 - protein, 25 aa, Staphylococcus aureus
YLSNDGFCYLSYWYGDNENIVNIFY

SEQ ID NO: 1679455 - protein, 18 aa, Staphylococcus aureus
YMIELLEPLPFLEKISKL

SEQ ID NO: 1679456 - protein, 17 aa, Staphylococcus aureus
YMMHWFMINYCFDNGYD

SEQ ID NO: 1679457 - protein, 17 aa, Staphylococcus aureus
YMVGSTYRFKKSDVDEF

SEQ ID NO: 1679458 - protein, 17 aa, Staphylococcus aureus
YNCMDWKHGFTNVQKMR

SEQ ID NO: 1679459 - protein, 23 aa, Staphylococcus aureus
YNFPKKPFKYGIHYSEIEDFDNF

SEQ ID NO: 1679460 - protein, 19 aa, Staphylococcus aureus
YNIRCQFGLSEEETFYYIY

SEQ ID NO: 1679461 - protein, 18 aa, Staphylococcus aureus
YNLKCLLLKLTYRYLDNQ

SEQ ID NO: 1679462 - protein, 17 aa, Staphylococcus aureus
YNNSDGFETLKTKVNEL

SEQ ID NO: 1679463 - protein, 19 aa, Staphylococcus aureus
YPHLRFGFIHVPYIPEQVD

SEQ ID NO: 1679464 - protein, 17 aa, Staphylococcus aureus
YPLDKLVLYIIEEKDKL

SEQ ID NO: 1679465 - protein, 17 aa, Staphylococcus aureus
YPRKVLWLRKVQATITD

SEQ ID NO: 1679466 - protein, 18 aa, Staphylococcus aureus
YQAYKRIRKYGGGAIAST

SEQ ID NO: 1679467 - protein, 19 aa, Staphylococcus aureus
YQCEYCLKGEYARCKKLFV

SEQ ID NO: 1679468 - protein, 18 aa, Staphylococcus aureus
YQLCKAKSLLSIIDNTFL

SEQ ID NO: 1679469 - protein, 17 aa, Staphylococcus aureus
YQSLKDSFNYGYKYLTD

SEQ ID NO: 1679470 - protein, 21 aa, Staphylococcus aureus
YRDDFRVIFEVQDFGIGIKLE

SEQ ID NO: 1679471 - protein, 19 aa, Staphylococcus aureus
YRFWTQGIFARWTDNPNIE

SEQ ID NO: 1679472 - protein, 18 aa, Staphylococcus aureus
YRKFGILPETEYEINKVK

SEQ ID NO: 1679473 - protein, 20 aa, Staphylococcus aureus
YRKLTCLHVNHGVRSASNEE

SEQ ID NO: 1679474 - protein, 18 aa, Staphylococcus aureus
YRKQFCKLLLKSTKVSVI

SEQ ID NO: 1679475 - protein, 17 aa, Staphylococcus aureus
YRLKGFMTFQDTTHTYL

SEQ ID NO: 1679476 - protein, 21 aa, Staphylococcus aureus
YRLYKLIWERFVASQMAPAIL

SEQ ID NO: 1679477 - protein, 17 aa, Staphylococcus aureus
YRYARYVDDISFSFNFE

SEQ ID NO: 1679478 - protein, 18 aa, Staphylococcus aureus
YRYTLGYLFQNFALLENQ

SEQ ID NO: 1679479 - protein, 23 aa, Staphylococcus aureus
YSEDRVMCPLHFAIIDEVDSILI

SEQ ID NO: 1679480 - protein, 20 aa, Staphylococcus aureus
YSLGYLSGWGQNISDDELKD

SEQ ID NO: 1679481 - protein, 17 aa, Staphylococcus aureus
YSNGEIVFNEDYPEEKD

SEQ ID NO: 1679482 - protein, 19 aa, Staphylococcus aureus
YSQKGAITLGTRIDSNKSF

SEQ ID NO: 1679483 - protein, 17 aa, Staphylococcus aureus
YSRPRSGYFVSEIESLT

SEQ ID NO: 1679484 - protein, 17 aa, Staphylococcus aureus
YTESAVTQVRYVDVTTG

SEQ ID NO: 1679485 - protein, 33 aa, Staphylococcus aureus
YTKPSFEFEKQFGFLLKPWTTVRFMNVIPNRFI

SEQ ID NO: 1679486 - protein, 33 aa, Staphylococcus aureus
YTKPSFEFEKQFGFMLKPWTTVRFMNVIPNRFI

SEQ ID NO: 1679487 - protein, 26 aa, Staphylococcus aureus
YWKYLPERIKLFLSHSDWKEQNQRLN

SEQ ID NO: 1679488 - protein, 20 aa, Staphylococcus aureus
YYMVGSTYRFKKFDVDEFME

SEQ ID NO: 1679489 - protein, 21 aa, Staphylococcus aureus
YYTCEKFKLLVLQGNVLGVQI

SEQ ID NO: 1679490 - protein, 33 aa, Staphylococcus aureus
DYSSLIYEYAVFKKPMIFYAFDLEDYITTRDFY

SEQ ID NO: 1679491 - protein, 26 aa, Staphylococcus aureus
MLGDAYEFLIGRFAATAGKKAGEFYT

SEQ ID NO: 1679492 - protein, 24 aa, Staphylococcus aureus
DTSKTIFSKYRWNKSFKAYKRSSD

SEQ ID NO: 1679493 - protein, 26 aa, Staphylococcus aureus
QGLRKDLRLCNWPKFINRLNSVSKKS

SEQ ID NO: 1679494 - protein, 24 aa, Staphylococcus aureus
EKNYLEAVIGLPANIFYGTSIPTC

SEQ ID NO: 1679495 - protein, 30 aa, Staphylococcus aureus
TIDMYEPYVRLFRDLFPNAAIIFDRFHIVQ

SEQ ID NO: 1679496 - protein, 22 aa, Staphylococcus aureus
FKARIMMIFSLYKGEKKKTTKP

SEQ ID NO: 1679497 - protein, 19 aa, Staphylococcus aureus
NTRLVLEKGLTLIGSSRSG

SEQ ID NO: 1679498 - protein, 31 aa, Staphylococcus aureus
MDASEFRNYILGLIFYRFLSEKAEQEYADAL

SEQ ID NO: 1679499 - protein, 17 aa, Staphylococcus aureus
RRPTPARLTRIEKSLLQ

SEQ ID NO: 1679500 - protein, 17 aa, Staphylococcus aureus
HTLLKPESTRTQIDQII

SEQ ID NO: 1679501 - protein, 23 aa, Staphylococcus aureus
RQFKSLRRFFKIYVRGIRGASEL

SEQ ID NO: 1679502 - protein, 23 aa, Staphylococcus aureus
MAVVLPHGVLFRGAAEGVIRRYL

SEQ ID NO: 1679503 - protein, 26 aa, Staphylococcus aureus
AQTPYPIMINKWYIPQEISELTLTRI

SEQ ID NO: 1679504 - protein, 18 aa, Staphylococcus aureus
ATFTLAVNRTFTNAQGER

SEQ ID NO: 1679505 - protein, 17 aa, Staphylococcus aureus
CLNLQVPLALLKQDDDV

SEQ ID NO: 1679506 - protein, 25 aa, Staphylococcus aureus
DTHCWLIIETLYAQTPYPIMINKWY

SEQ ID NO: 1679507 - protein, 22 aa, Staphylococcus aureus
EFKMLCMGFKRKEIKAMTPKII

SEQ ID NO: 1679508 - protein, 19 aa, Staphylococcus aureus
GMRAKLGFSINITVNPDIL

SEQ ID NO: 1679509 - protein, 19 aa, Staphylococcus aureus
HFNHSLFWEILSPNSEEKG

SEQ ID NO: 1679510 - protein, 22 aa, Staphylococcus aureus
KHKNKTFFALDDISLKAYEGDV

SEQ ID NO: 1679511 - protein, 23 aa, Staphylococcus aureus
KQADAFCFTFIPLNVIDTFKVNT

SEQ ID NO: 1679512 - protein, 18 aa, Staphylococcus aureus
LGCRKLIDYEGIFAGGST

SEQ ID NO: 1679513 - protein, 24 aa, Staphylococcus aureus
NLGIALAMIAKIKGLKLTCVVDPK

SEQ ID NO: 1679514 - protein, 24 aa, Staphylococcus aureus
NYEPSMQYFNEWWKQLFGESEGKD

SEQ ID NO: 1679515 - protein, 24 aa, Staphylococcus aureus
QLALKYRFNRLKLTTIHNGIADVP

SEQ ID NO: 1679516 - protein, 25 aa, Staphylococcus aureus
QNKRPDYMTAFWNIVNWKKVDELYQ

SEQ ID NO: 1679517 - protein, 22 aa, Staphylococcus aureus
QVRQFCTKIAWIEGGKLKDYGE

SEQ ID NO: 1679518 - protein, 25 aa, Staphylococcus aureus
TDQPYIEYDWLQKGAFISNISIMDV

SEQ ID NO: 1679519 - protein, 24 aa, Staphylococcus aureus
TPHFKLMFEEGYRALLPNPLGQTV

SEQ ID NO: 1679520 - protein, 19 aa, Staphylococcus aureus
TPILLFDVWEHAYYLKYQN

SEQ ID NO: 1679521 - protein, 30 aa, Staphylococcus aureus
TVFSKALNIYLKLPIHVKITNFIRTNDLEQ

SEQ ID NO: 1679522 - protein, 17 aa, Staphylococcus aureus
VTILPDRGDRYLDLVYS

SEQ ID NO: 1679523 - protein, 22 aa, Staphylococcus aureus
AAEILGLTEYLGRKPKALSGGQ

SEQ ID NO: 1679524 - protein, 28 aa, Staphylococcus aureus
ADIIASMSYFFNLLSGIGYTDDIDHLGN

SEQ ID NO: 1679525 - protein, 30 aa, Staphylococcus aureus
AHQTSIANIVLAFYLTRPAIDVIIPGAKRA

SEQ ID NO: 1679526 - protein, 42 aa, Staphylococcus aureus
AKEIVRFHSIIWPILLMALDLPLPKKVFAHGWILMKDGKMSK

SEQ ID NO: 1679527 - protein, 25 aa, Staphylococcus aureus
AKQYFDRIILLNQTLRYFGDSEEAM

SEQ ID NO: 1679528 - protein, 18 aa, Staphylococcus aureus
ALELFKPFVMKELVQREI

SEQ ID NO: 1679529 - protein, 26 aa, Staphylococcus aureus
ALQNSTLPMFGTCAGLIVLAQDIVGE

SEQ ID NO: 1679530 - protein, 23 aa, Staphylococcus aureus
AMTLMNNRIYGGYSLLLDVNYEA

SEQ ID NO: 1679531 - protein, 27 aa, Staphylococcus aureus
APEPNLTVLWSVRLPDNFKTYCAKMSI

SEQ ID NO: 1679532 - protein, 21 aa, Staphylococcus aureus
AQLAALFVNAGLKVKLLDIVV

SEQ ID NO: 1679533 - protein, 24 aa, Staphylococcus aureus
ARRRKARGLKLNHPEALALISDEL

SEQ ID NO: 1679534 - protein, 26 aa, Staphylococcus aureus
ASHQYKLLIILSPSGAYYGGETLKPT

SEQ ID NO: 1679535 - protein, 26 aa, Staphylococcus aureus
AVEDKSFDFILTNPPIRAGKETVHRI

SEQ ID NO: 1679536 - protein, 22 aa, Staphylococcus aureus
CAKAESVVICWAMGITQQDIGS

SEQ ID NO: 1679537 - protein, 24 aa, Staphylococcus aureus
CGYGPIGLMIAKVSPHHSITMLDV

SEQ ID NO: 1679538 - protein, 19 aa, Staphylococcus aureus
CMKNDGAVLLLIMEKDMAY

SEQ ID NO: 1679539 - protein, 23 aa, Staphylococcus aureus
DATGYINHLLQLIGPSISQQQAY

SEQ ID NO: 1679540 - protein, 37 aa, Staphylococcus aureus
DCEKIMVVANLPYYITTPILLNLMQQDIPIDGYVVMM

SEQ ID NO: 1679541 - protein, 20 aa, Staphylococcus aureus
DDYLPILDKILASDTIIFAS

SEQ ID NO: 1679542 - protein, 19 aa, Staphylococcus aureus
DELNHASIIDGCRLSKAKI

SEQ ID NO: 1679543 - protein, 22 aa, Staphylococcus aureus
DEPLNRLFNTSPVFSQIPGPNH

SEQ ID NO: 1679544 - protein, 18 aa, Staphylococcus aureus
DFRKLVKILAQHLKTRIE

SEQ ID NO: 1679545 - protein, 19 aa, Staphylococcus aureus
DKFLNKRKYYRPRKMNRFL

SEQ ID NO: 1679546 - protein, 23 aa, Staphylococcus aureus
DLSLNVRRIFFSTYDRSCLNDCY

SEQ ID NO: 1679547 - protein, 23 aa, Staphylococcus aureus
DMVKDGRLTSAHGRTLLAIKDEQ

SEQ ID NO: 1679548 - protein, 18 aa, Staphylococcus aureus
DQLTCIFVDHGLLRKGEG

SEQ ID NO: 1679549 - protein, 22 aa, Staphylococcus aureus
DRYLDLVYSDTWLEKMKSRQGV

SEQ ID NO: 1679550 - protein, 24 aa, Staphylococcus aureus
DTINVNYIMNILRQIDLEDKAEQR

SEQ ID NO: 1679551 - protein, 25 aa, Staphylococcus aureus
DVSGKWFFDRYSPTTNIKAVGNADV

SEQ ID NO: 1679552 - protein, 25 aa, Staphylococcus aureus
EDRLRSRFEWGLIVDITPPDYETRM

SEQ ID NO: 1679553 - protein, 28 aa, Staphylococcus aureus
EGELPEERLFRKYAHIIRNWDPEKQDKF

SEQ ID NO: 1679554 - protein, 26 aa, Staphylococcus aureus
EGPDFPTAGLILGKSGIRRAYETGRG

SEQ ID NO: 1679555 - protein, 19 aa, Staphylococcus aureus
EHVTDNQLIFFNMAAAMGS

SEQ ID NO: 1679556 - protein, 24 aa, Staphylococcus aureus
EIFQGRQYKVYRGMGSLGAMEKGS

SEQ ID NO: 1679557 - protein, 21 aa, Staphylococcus aureus
EKVTLLFTGPLTDLAKALQKD

SEQ ID NO: 1679558 - protein, 18 aa, Staphylococcus aureus
ELCNVQISIFSVGPDREQ

SEQ ID NO: 1679559 - protein, 24 aa, Staphylococcus aureus
ELNGSILPGITRKSIIELAKNLGY

SEQ ID NO: 1679560 - protein, 29 aa, Staphylococcus aureus
ELSVKAKKFTLLTKSLRPLPDKFHGLQDI

SEQ ID NO: 1679561 - protein, 26 aa, Staphylococcus aureus
ENAKSLLYSRFFDPKRYDLASVGRYK

SEQ ID NO: 1679562 - protein, 24 aa, Staphylococcus aureus
ERYRNIDVLLIDDIQFIQNKVQTQ

SEQ ID NO: 1679563 - protein, 25 aa, Staphylococcus aureus
ESEDNFLVFATKRGVVKRSALSNFS

SEQ ID NO: 1679564 - protein, 19 aa, Staphylococcus aureus
ESLTFDDVLLIPAQSDILP

SEQ ID NO: 1679565 - protein, 29 aa, Staphylococcus aureus
ESRYLTEDIAYGLVLWSSLGRVIDVPTPN

SEQ ID NO: 1679566 - protein, 24 aa, Staphylococcus aureus
ETEKLKYLCDIAEKYHGASKTSGA

SEQ ID NO: 1679567 - protein, 27 aa, Staphylococcus aureus
EVQEIIDHFIMKLRIVKFARTPDYNEL

SEQ ID NO: 1679568 - protein, 34 aa, Staphylococcus aureus
FIEQYRDLGYLPEALFNFIALLGWSPEGEEEIFS

SEQ ID NO: 1679569 - protein, 26 aa, Staphylococcus aureus
FKEDGRFIPTIAFYSPNALGAITKAL

SEQ ID NO: 1679570 - protein, 19 aa, Staphylococcus aureus
FKYHRHFFVPDNVGHDGFL

SEQ ID NO: 1679571 - protein, 29 aa, Staphylococcus aureus
FNDFEMHFYRYVFPYYDTLYTLEKLSQKG

SEQ ID NO: 1679572 - protein, 25 aa, Staphylococcus aureus
FTVQSIHALIKYYETFKRLNKKLEQ

SEQ ID NO: 1679573 - protein, 27 aa, Staphylococcus aureus
GIDHNRLSLLMAVLEKKENYLLQQQDA

SEQ ID NO: 1679574 - protein, 22 aa, Staphylococcus aureus
GIEGLDEFLTGPTAIATSSEDA

SEQ ID NO: 1679575 - protein, 26 aa, Staphylococcus aureus
GKEVKSLLQMLLLHAIPTPVISDKKA

SEQ ID NO: 1679576 - protein, 17 aa, Staphylococcus aureus
GMRFYGYHGALSAENEI

SEQ ID NO: 1679577 - protein, 27 aa, Staphylococcus aureus
GMRQRVMIAMALILKPQILIADEPTTA

SEQ ID NO: 1679578 - protein, 19 aa, Staphylococcus aureus
GNVPLPKQFLDLDNKPILI

SEQ ID NO: 1679579 - protein, 27 aa, Staphylococcus aureus
GQRQRVWIAMALAQRTDIIFLDEPTTY

SEQ ID NO: 1679580 - protein, 20 aa, Staphylococcus aureus
GRIIGDYRRVALYGVDFLME

SEQ ID NO: 1679581 - protein, 17 aa, Staphylococcus aureus
GSTPPFTYLVQESYDVM

SEQ ID NO: 1679582 - protein, 27 aa, Staphylococcus aureus
GYHPTWKMVLGLFPKEDKIKAMDALER

SEQ ID NO: 1679583 - protein, 26 aa, Staphylococcus aureus
HDIHQLLNIMKSKCLIILTTHHLDEV

SEQ ID NO: 1679584 - protein, 26 aa, Staphylococcus aureus
HDVDMLRMCRYPWKTKQRILGDMGHV

SEQ ID NO: 1679585 - protein, 23 aa, Staphylococcus aureus
HLLTDYLAIRLVVEQLLVGDEFK

SEQ ID NO: 1679586 - protein, 30 aa, Staphylococcus aureus
HLVENIRYAAVLLRPFLTHAPKEIFEQLNI

SEQ ID NO: 1679587 - protein, 24 aa, Staphylococcus aureus
HMIEEGFIDPKYRALAPLCDTKES

SEQ ID NO: 1679588 - protein, 25 aa, Staphylococcus aureus
IAYPRQIAMYLSRELTDFSLPKIGE

SEQ ID NO: 1679589 - protein, 29 aa, Staphylococcus aureus
IEKEIYDQMMWIGFKPFKITNIKQESEDI

SEQ ID NO: 1679590 - protein, 31 aa, Staphylococcus aureus
IERAMKLIDEYDFLYGIIGWHPVDAIDFTEE

SEQ ID NO: 1679591 - protein, 24 aa, Staphylococcus aureus
IGIDRLVMLLTDSPSIRDVLLFPY

SEQ ID NO: 1679592 - protein, 42 aa, Staphylococcus aureus
IGIFAPNDIAILDLLFACFKTGAVFLPLNWRLNPKEIAAIVE

SEQ ID NO: 1679593 - protein, 18 aa, Staphylococcus aureus
ILPGGESTTLRRLMNLYG

SEQ ID NO: 1679594 - protein, 24 aa, Staphylococcus aureus
IPGKTPCFNCLVPQLPALNLTCDT

SEQ ID NO: 1679595 - protein, 24 aa, Staphylococcus aureus
IPMDQKFIFNPYETKSIAGFDVES

SEQ ID NO: 1679596 - protein, 26 aa, Staphylococcus aureus
ITGQKADLLLWFLRPEMKSLNHIENE

SEQ ID NO: 1679597 - protein, 18 aa, Staphylococcus aureus
ITIKDIVIYPDAYSIKKR

SEQ ID NO: 1679598 - protein, 22 aa, Staphylococcus aureus
IYDYLEKVLNLNISYSSKSITF

SEQ ID NO: 1679599 - protein, 24 aa, Staphylococcus aureus
KDGKWKVLMIAAEERYVLLENGKM

SEQ ID NO: 1679600 - protein, 28 aa, Staphylococcus aureus
KDQERFFGLHFFNPPRIMKLVELIPTSH

SEQ ID NO: 1679601 - protein, 23 aa, Staphylococcus aureus
KDRPLALCAALLHDLGHGPFSHS

SEQ ID NO: 1679602 - protein, 33 aa, Staphylococcus aureus
KEDRNLVGILTNRDLRFIEDFSIKIVDVMTQEN

SEQ ID NO: 1679603 - protein, 23 aa, Staphylococcus aureus
KEIAKKIAILPQSPEVADGLTVG

SEQ ID NO: 1679604 - protein, 18 aa, Staphylococcus aureus
KEMFLEDLGIEEPGLDRL

SEQ ID NO: 1679605 - protein, 26 aa, Staphylococcus aureus
KEVSEGFIWYNELPLSLFKDDELKSL

SEQ ID NO: 1679606 - protein, 23 aa, Staphylococcus aureus
KFEILPYHQLGVHKWKTLGIAYE

SEQ ID NO: 1679607 - protein, 24 aa, Staphylococcus aureus
KHVEVMVRQMLRKVRIIEAGDTKL

SEQ ID NO: 1679608 - protein, 24 aa, Staphylococcus aureus
KKFDQMMDWLAGVYINSLNVIHYM

SEQ ID NO: 1679609 - protein, 24 aa, Staphylococcus aureus
KNRDATYAAPLRVKVRLIIKETGE

SEQ ID NO: 1679610 - protein, 29 aa, Staphylococcus aureus
KTIKVMVADYQFDPLKNQITHIDFLAINM

SEQ ID NO: 1679611 - protein, 27 aa, Staphylococcus aureus
KTTVKKTFPGYVLVELIMTDESWYVVR

SEQ ID NO: 1679612 - protein, 23 aa, Staphylococcus aureus
KVEKFAQLLEEIKQQLNSTADAV

SEQ ID NO: 1679613 - protein, 23 aa, Staphylococcus aureus
KVHGAWYAILRGGTQQFRLPVSW

SEQ ID NO: 1679614 - protein, 19 aa, Staphylococcus aureus
KVLFIEPMTMMNLSGEAVA

SEQ ID NO: 1679615 - protein, 17 aa, Staphylococcus aureus
LAYEINDFKDGFYNIVR

SEQ ID NO: 1679616 - protein, 18 aa, Staphylococcus aureus
LDLLALDGMIQKIHGKGS

SEQ ID NO: 1679617 - protein, 27 aa, Staphylococcus aureus
LEALLINQYDIIFLDVNLMDENGIELG

SEQ ID NO: 1679618 - protein, 25 aa, Staphylococcus aureus
LEEVQALNLKFYYGQEIRITDQILN

SEQ ID NO: 1679619 - protein, 25 aa, Staphylococcus aureus
LEGALTRLLAYSQLLGKPITTELTA

SEQ ID NO: 1679620 - protein, 26 aa, Staphylococcus aureus
LFFTNKGRVYKLKGYEVPELSRQSKG

SEQ ID NO: 1679621 - protein, 18 aa, Staphylococcus aureus
LFNAITKAGALAANYPFA

SEQ ID NO: 1679622 - protein, 26 aa, Staphylococcus aureus
LGDLAMIWREGCIIRAQFLQKIKDAY

SEQ ID NO: 1679623 - protein, 18 aa, Staphylococcus aureus
LHLKHRLFNQKLAEPIVN

SEQ ID NO: 1679624 - protein, 30 aa, Staphylococcus aureus
LIEIQTKSYEWFLREGLIEMFRDISPIEDF

SEQ ID NO: 1679625 - protein, 19 aa, Staphylococcus aureus
LIHENGWPTRIALKDFHDG

SEQ ID NO: 1679626 - protein, 19 aa, Staphylococcus aureus
LIHTFGCKKLIRVGSCGAM

SEQ ID NO: 1679627 - protein, 27 aa, Staphylococcus aureus
LIKNDGTYTYFLPDIAYHFDKVKRGND

SEQ ID NO: 1679628 - protein, 19 aa, Staphylococcus aureus
LILVLDFGSQYNQLITRRI

SEQ ID NO: 1679629 - protein, 25 aa, Staphylococcus aureus
LINTTQEVLLPESFYRGAHQHIFRA

SEQ ID NO: 1679630 - protein, 20 aa, Staphylococcus aureus
LNNVNYFGTMLVYAGKADGL

SEQ ID NO: 1679631 - protein, 27 aa, Staphylococcus aureus
LPVDKMNLDIPRLVLDGIEVVGSLVGT

SEQ ID NO: 1679632 - protein, 21 aa, Staphylococcus aureus
LSDSNLTGCIFGLTLQTKHED

SEQ ID NO: 1679633 - protein, 17 aa, Staphylococcus aureus
LSKDIQYKDLGLLIVDE

SEQ ID NO: 1679634 - protein, 32 aa, Staphylococcus aureus
LSKSRPYIANMLRLLHLPKKIADMVKDGRLTS

SEQ ID NO: 1679635 - protein, 20 aa, Staphylococcus aureus
LSRTKIFIDDTPGIRINDLR

SEQ ID NO: 1679636 - protein, 23 aa, Staphylococcus aureus
LTQYIGHLNVVLFAPEDLNIVKG

SEQ ID NO: 1679637 - protein, 17 aa, Staphylococcus aureus
LVEAGVGLLPSGGGLAE

SEQ ID NO: 1679638 - protein, 24 aa, Staphylococcus aureus
LVEGRAIRLHPLVTTAYNADFDGD

SEQ ID NO: 1679639 - protein, 17 aa, Staphylococcus aureus
LVERFMTKLRSHKTYRD

SEQ ID NO: 1679640 - protein, 26 aa, Staphylococcus aureus
MGCGSIGLLAIQWARIFGAAHIIAID

SEQ ID NO: 1679641 - protein, 19 aa, Staphylococcus aureus
MMRVVLIEQVYRAFKIMRG

SEQ ID NO: 1679642 - protein, 18 aa, Staphylococcus aureus
MNIGQVLELHLGMAAKNL

SEQ ID NO: 1679643 - protein, 36 aa, Staphylococcus aureus
MPQTREHILLSRNVGVPALVVFLNKVDMVDDEELLE

SEQ ID NO: 1679644 - protein, 19 aa, Staphylococcus aureus
MTVELIAPIAIEDGTRFSI

SEQ ID NO: 1679645 - protein, 17 aa, Staphylococcus aureus
MVMTPYFPKPDVMIYLE

SEQ ID NO: 1679646 - protein, 34 aa, Staphylococcus aureus
NALDATLYMRIAIELHLKRLIVGGLEKVYEIGRV

SEQ ID NO: 1679647 - protein, 24 aa, Staphylococcus aureus
NASSILYPILKRPDEKRVTERAYE

SEQ ID NO: 1679648 - protein, 18 aa, Staphylococcus aureus
NEFGFIETPYRKVDLDTH

SEQ ID NO: 1679649 - protein, 24 aa, Staphylococcus aureus
NGMKSIIKMLGTDQFKRIRIGVGR

SEQ ID NO: 1679650 - protein, 19 aa, Staphylococcus aureus
NRHVDVREFIQLNYTLYEG

SEQ ID NO: 1679651 - protein, 23 aa, Staphylococcus aureus
NRPMFCKMFKTMTKLRKDMNYIT

SEQ ID NO: 1679652 - protein, 23 aa, Staphylococcus aureus
NTKVGPFAQLRPGAQLGADVKVG

SEQ ID NO: 1679653 - protein, 30 aa, Staphylococcus aureus
PAENFKEAVQWLYLAYLAAIKEQNGAAMSL

SEQ ID NO: 1679654 - protein, 18 aa, Staphylococcus aureus
PAVEVILTVLHAGGKFGG

SEQ ID NO: 1679655 - protein, 19 aa, Staphylococcus aureus
PFTYLVQESYDVMALVHEC

SEQ ID NO: 1679656 - protein, 23 aa, Staphylococcus aureus
PGVNQLVRVYIVQKRKIHVGDKM

SEQ ID NO: 1679657 - protein, 26 aa, Staphylococcus aureus
PHYTDQLFFELQSKGFVPIIAHPERN

SEQ ID NO: 1679658 - protein, 17 aa, Staphylococcus aureus
PIDIMLNPLGVPSRMNI

SEQ ID NO: 1679659 - protein, 19 aa, Staphylococcus aureus
PKLINLKEALVHYLEHQKT

SEQ ID NO: 1679660 - protein, 39 aa, Staphylococcus aureus
PKQFLDLDNKPILIHTLEKFILINDFEKIIIATPQQWMT

SEQ ID NO: 1679661 - protein, 25 aa, Staphylococcus aureus
PPSEDFAYYAKERPSAFIYTGAAVE

SEQ ID NO: 1679662 - protein, 23 aa, Staphylococcus aureus
PRFTDRFELFIVGREHANAFTEL

SEQ ID NO: 1679663 - protein, 30 aa, Staphylococcus aureus
PSHDGLVSMLLSVLQAPVRNFAYAVKAIGE

SEQ ID NO: 1679664 - protein, 26 aa, Staphylococcus aureus
PVGYANNFLLKKNYAVEATPGNLKQL

SEQ ID NO: 1679665 - protein, 25 aa, Staphylococcus aureus
PVNLHLMELLIMIDACKRASAATIN

SEQ ID NO: 1679666 - protein, 18 aa, Staphylococcus aureus
QALLEIYERLRPGEPPTV

SEQ ID NO: 1679667 - protein, 18 aa, Staphylococcus aureus
QAYFKGMFNETCPSFDDI

SEQ ID NO: 1679668 - protein, 22 aa, Staphylococcus aureus
QEAQTRHYTWPTASAAMGRTMT

SEQ ID NO: 1679669 - protein, 27 aa, Staphylococcus aureus
QFINTQIATLFLIDIVSYHLLENTNLS

SEQ ID NO: 1679670 - protein, 31 aa, Staphylococcus aureus
QIDIAGPGFINFYLDNQYLTAIIPEAIEKGD

SEQ ID NO: 1679671 - protein, 26 aa, Staphylococcus aureus
QKEVFRKQIALAKRLKLPIIIHNREA

SEQ ID NO: 1679672 - protein, 17 aa, Staphylococcus aureus
QLIFFNMAAAMGSIRFM

SEQ ID NO: 1679673 - protein, 24 aa, Staphylococcus aureus
QLSRTTGFDGWAPLFFRGREVSGK

SEQ ID NO: 1679674 - protein, 23 aa, Staphylococcus aureus
QNLDILYDLINKGALSQVTTASL

SEQ ID NO: 1679675 - protein, 33 aa, Staphylococcus aureus
QQAHQQFTGVDFPKLFKAFKDMGMTYNIVNIQD

SEQ ID NO: 1679676 - protein, 26 aa, Staphylococcus aureus
QQWFNYTYMVILTNGVKMQVGRSFMK

SEQ ID NO: 1679677 - protein, 17 aa, Staphylococcus aureus
QSIHLPNGIKISNRFVL

SEQ ID NO: 1679678 - protein, 19 aa, Staphylococcus aureus
QTEVKIVFMLAMDKVDDQL

SEQ ID NO: 1679679 - protein, 18 aa, Staphylococcus aureus
RCQHVYFKPIDKEKFINR

SEQ ID NO: 1679680 - protein, 18 aa, Staphylococcus aureus
REGLTVLEYFISTHGARK

SEQ ID NO: 1679681 - protein, 25 aa, Staphylococcus aureus
RELTKDPKYLIGRIIARPYVGEPGN

SEQ ID NO: 1679682 - protein, 26 aa, Staphylococcus aureus
REQSFYHAWLHLAQHDHSFTKAQRQV

SEQ ID NO: 1679683 - protein, 36 aa, Staphylococcus aureus
RKSVIRWCELLLTNKPMALIGIIDLLKQAKNKKLQS

SEQ ID NO: 1679684 - protein, 24 aa, Staphylococcus aureus
RRFRASKIAGLKYVSAIIKDLTDE

SEQ ID NO: 1679685 - protein, 23 aa, Staphylococcus aureus
RRRKVPGWGVFTNKALQGGGSLI

SEQ ID NO: 1679686 - protein, 23 aa, Staphylococcus aureus
RTQAILPLRGKILNVEKARLDRI

SEQ ID NO: 1679687 - protein, 23 aa, Staphylococcus aureus
RVINRNNRLKRLLDLGAPGIIVQ

SEQ ID NO: 1679688 - protein, 18 aa, Staphylococcus aureus
RWYAVHTYSGYENKVKKN

SEQ ID NO: 1679689 - protein, 23 aa, Staphylococcus aureus
SAATINIVVPYYGYARQDRKARS

SEQ ID NO: 1679690 - protein, 23 aa, Staphylococcus aureus
SAEWNAYWDPEAVKIVFDSDIEI

SEQ ID NO: 1679691 - protein, 22 aa, Staphylococcus aureus
SEHFERFLYENPQVARTVVEKG

SEQ ID NO: 1679692 - protein, 24 aa, Staphylococcus aureus
SEPFRRHIEAAGPFETIGIAGFFG

SEQ ID NO: 1679693 - protein, 24 aa, Staphylococcus aureus
SGGEPLLQMPFLEKLFAELKENGV

SEQ ID NO: 1679694 - protein, 32 aa, Staphylococcus aureus
SGNKPSWMILDVLPIIPPEIRPMVQLDGGRFA

SEQ ID NO: 1679695 - protein, 27 aa, Staphylococcus aureus
SRFINRDLFKYIPFDGSIITISELQEL

SEQ ID NO: 1679696 - protein, 27 aa, Staphylococcus aureus
STWQHKVPFGVWWETLQQEHRLPWTTE

SEQ ID NO: 1679697 - protein, 18 aa, Staphylococcus aureus
TAEERLLHAIFGEKAREV

SEQ ID NO: 1679698 - protein, 23 aa, Staphylococcus aureus
TDNPHAMALYRQQGYQYMGDSMF

SEQ ID NO: 1679699 - protein, 26 aa, Staphylococcus aureus
TEDMIMPNMIIFLDADLDVLKSRIAK

SEQ ID NO: 1679700 - protein, 27 aa, Staphylococcus aureus
TEEQFKTVYGVNVAGVLWGIQAAHEQF

SEQ ID NO: 1679701 - protein, 18 aa, Staphylococcus aureus
TEFYYRMIRMGLKGNVTT

SEQ ID NO: 1679702 - protein, 24 aa, Staphylococcus aureus
TGVEMFRKLLDYAEAGDNIGALLR

SEQ ID NO: 1679703 - protein, 28 aa, Staphylococcus aureus
TITVQDVMFLLLYAIKDLGGVLNMTPIT

SEQ ID NO: 1679704 - protein, 30 aa, Staphylococcus aureus
TKHTVRLLHAIELERLNLGRRLGFELSTAK

SEQ ID NO: 1679705 - protein, 23 aa, Staphylococcus aureus
TLIQPTFIYGHPTEISPLAKKNP

SEQ ID NO: 1679706 - protein, 18 aa, Staphylococcus aureus
TMIELYEAYADYHDIMDL

SEQ ID NO: 1679707 - protein, 20 aa, Staphylococcus aureus
TPQQLINIRPVIASIKEFFG

SEQ ID NO: 1679708 - protein, 26 aa, Staphylococcus aureus
TTGRPRRVGWFDSVVLRHSRRVSGIT

SEQ ID NO: 1679709 - protein, 18 aa, Staphylococcus aureus
VEHIVKLSRYYPQGLRSL

SEQ ID NO: 1679710 - protein, 20 aa, Staphylococcus aureus
VEKLSRLRPAFKKDGTVTAG

SEQ ID NO: 1679711 - protein, 22 aa, Staphylococcus aureus
VGKIIFNEIIPDSFAYINEPTQ

SEQ ID NO: 1679712 - protein, 17 aa, Staphylococcus aureus
VGRTFYEQFKDKGITKI

SEQ ID NO: 1679713 - protein, 18 aa, Staphylococcus aureus
VIVFKYAGAYGWSISHHD

SEQ ID NO: 1679714 - protein, 17 aa, Staphylococcus aureus
VQMRTEILKLHKRLNTT

SEQ ID NO: 1679715 - protein, 31 aa, Staphylococcus aureus
VQYDYLVEDLLKSLGIPYVREDRKVNKAFRH

SEQ ID NO: 1679716 - protein, 18 aa, Staphylococcus aureus
VRKKYEMPIIMLTAKDSE

SEQ ID NO: 1679717 - protein, 35 aa, Staphylococcus aureus
VRKLGIELGIPEHLVWRQPFPGPGLGIRVLGEITE

SEQ ID NO: 1679718 - protein, 26 aa, Staphylococcus aureus
VSDYKEHVVFILWGKPAQQKIKLIDT

SEQ ID NO: 1679719 - protein, 32 aa, Staphylococcus aureus
VSNVKPGQWLGVFGIGGLGNLALQYAKNVMGA

SEQ ID NO: 1679720 - protein, 17 aa, Staphylococcus aureus
VSRLIKRRTLAKEVSDQ

SEQ ID NO: 1679721 - protein, 23 aa, Staphylococcus aureus
VTNKLNFYISLGGPVTFKNAKQP

SEQ ID NO: 1679722 - protein, 26 aa, Staphylococcus aureus
VYEDRSFTFITKTPPAPVLLKKAAGI

SEQ ID NO: 1679723 - protein, 30 aa, Staphylococcus aureus
VYVRIDRTRKLPLTVLLRALGFSSDQEIVD

SEQ ID NO: 1679724 - protein, 18 aa, Staphylococcus aureus
WAPLFFRGREVSGKTIGI

SEQ ID NO: 1679725 - protein, 25 aa, Staphylococcus aureus
WSFQTEMFFLCNRYKQFQDVTQLNQ

SEQ ID NO: 1679726 - protein, 17 aa, Staphylococcus aureus
YARVNEFGFIETPYRKV

SEQ ID NO: 1679727 - protein, 19 aa, Staphylococcus aureus
YLKKRTCVPTLLINGEHDP

SEQ ID NO: 1679728 - protein, 17 aa, Staphylococcus aureus
YMKIGLASPEKIRSWSF

SEQ ID NO: 1679729 - protein, 19 aa, Staphylococcus aureus
YQHRGIGQALLDAIMAWCL

SEQ ID NO: 1679730 - protein, 21 aa, Staphylococcus aureus
AAAALILAGLVADGKTSVTEL

SEQ ID NO: 1679731 - protein, 24 aa, Staphylococcus aureus
AAFMKKVIDTRAVFKIGGIGLAFK

SEQ ID NO: 1679732 - protein, 26 aa, Staphylococcus aureus
AAYRELSLLLRRPPGREAYPGDVFYL

SEQ ID NO: 1679733 - protein, 30 aa, Staphylococcus aureus
AEEKISYQGLPSRIAWLGYGERAKMGLALN

SEQ ID NO: 1679734 - protein, 35 aa, Staphylococcus aureus
AEQGTKLTFLPYVVKALVSALKKYPALNTSFNEEA

SEQ ID NO: 1679735 - protein, 31 aa, Staphylococcus aureus
AFKVMTDPYVGKLTFFRVYSGTMTSGSYVKN

SEQ ID NO: 1679736 - protein, 19 aa, Staphylococcus aureus
AFVIPVPGSTLPSVIGWRT

SEQ ID NO: 1679737 - protein, 24 aa, Staphylococcus aureus
AGIDVFRIFDSLNWVDQMKVANEA

SEQ ID NO: 1679738 - protein, 29 aa, Staphylococcus aureus
AGQERLPLIHKWINGRMPLIGIGSIFTAD

SEQ ID NO: 1679739 - protein, 23 aa, Staphylococcus aureus
AGSDFLGWVDLPVDYDKEEFSRI

SEQ ID NO: 1679740 - protein, 21 aa, Staphylococcus aureus
AIFAGDLMRMYSKYAESQGFK

SEQ ID NO: 1679741 - protein, 29 aa, Staphylococcus aureus
AKDPQKHALFPKYEFFRADTDYADIAKFL

SEQ ID NO: 1679742 - protein, 34 aa, Staphylococcus aureus
AKKRAPYIFRKLNIEWIYRALIDWKRIGRLKSIP

SEQ ID NO: 1679743 - protein, 18 aa, Staphylococcus aureus
AKQKFLDIGKRTYKIGMP

SEQ ID NO: 1679744 - protein, 20 aa, Staphylococcus aureus
ALSMWMTLKCGIVNLPYGGG

SEQ ID NO: 1679745 - protein, 26 aa, Staphylococcus aureus
AMDAAKAMWMFFEHPETSFFGAKQKF

SEQ ID NO: 1679746 - protein, 20 aa, Staphylococcus aureus
ANIIPDYTHARFYTRAMTRK

SEQ ID NO: 1679747 - protein, 25 aa, Staphylococcus aureus
ASEPSPLLYIAPYSGVTMGEEFMFN

SEQ ID NO: 1679748 - protein, 23 aa, Staphylococcus aureus
ASNATIHRFTRKLGFDGYSDFKS

SEQ ID NO: 1679749 - protein, 32 aa, Staphylococcus aureus
ASVAIAYRMKGNERFYLITDAMRAKGMPEGEY

SEQ ID NO: 1679750 - protein, 27 aa, Staphylococcus aureus
ATDLQQPITPLLFMANGPSFVTDTIYP

SEQ ID NO: 1679751 - protein, 20 aa, Staphylococcus aureus
ATISIIKYWVMDKQPISVDE

SEQ ID NO: 1679752 - protein, 36 aa, Staphylococcus aureus
ATLELVRQLQFFINERIIPIIPQQGSLGASGDLAPL

SEQ ID NO: 1679753 - protein, 27 aa, Staphylococcus aureus
ATRILTERGILLVPDVLASAGGVTVSY

SEQ ID NO: 1679754 - protein, 21 aa, Staphylococcus aureus
AVSVYSGWLAYSTFDHEWVKH

SEQ ID NO: 1679755 - protein, 18 aa, Staphylococcus aureus
CFELLSMVTYADKLKSLI

SEQ ID NO: 1679756 - protein, 25 aa, Staphylococcus aureus
CSGNGVIPLLLFAKHPRHIEGVEIQ

SEQ ID NO: 1679757 - protein, 20 aa, Staphylococcus aureus
DDIIVFHKLTKEELKEIVTM

SEQ ID NO: 1679758 - protein, 24 aa, Staphylococcus aureus
DEIDVQALWDHRKKFKEIAAEQGT

SEQ ID NO: 1679759 - protein, 28 aa, Staphylococcus aureus
DGNLGYITAILLRKLYPESKIYVFGKTD

SEQ ID NO: 1679760 - protein, 26 aa, Staphylococcus aureus
DHTREYIPVIMYSPKFKGGHALESDT

SEQ ID NO: 1679761 - protein, 24 aa, Staphylococcus aureus
DHYNFEMLNLPKSHPARDMQDSFY

SEQ ID NO: 1679762 - protein, 18 aa, Staphylococcus aureus
DIDIESGYFYTLLGPSGC

SEQ ID NO: 1679763 - protein, 17 aa, Staphylococcus aureus
DIDYLLDRRDSFGTVTN

SEQ ID NO: 1679764 - protein, 26 aa, Staphylococcus aureus
DIENYYCLVIYDWRVIESETIMSNFE

SEQ ID NO: 1679765 - protein, 25 aa, Staphylococcus aureus
DIGAPYEILKQIKDNGRLPVVNFAA

SEQ ID NO: 1679766 - protein, 27 aa, Staphylococcus aureus
DIKTTDLLIRLYEKVINHLDYHDKKRE

SEQ ID NO: 1679767 - protein, 23 aa, Staphylococcus aureus
DIQLRLKGYPAIVFQHEIDHLNG

SEQ ID NO: 1679768 - protein, 26 aa, Staphylococcus aureus
DKEMDLMNAFYLLDAVNIPIGIVRPH

SEQ ID NO: 1679769 - protein, 22 aa, Staphylococcus aureus
DKNTSRIYAKFGKEIYVAAKSG

SEQ ID NO: 1679770 - protein, 25 aa, Staphylococcus aureus
DLDIRAQYGINIIAIKRGKEFIISP

SEQ ID NO: 1679771 - protein, 29 aa, Staphylococcus aureus
DLKSRLPEYMIPRKFEWMEQLPLTSNGKI

SEQ ID NO: 1679772 - protein, 23 aa, Staphylococcus aureus
DMRLAAYIIGIKRTAEAARYRGW

SEQ ID NO: 1679773 - protein, 22 aa, Staphylococcus aureus
DNGNYILDCKLPKGIDPYKFHE

SEQ ID NO: 1679774 - protein, 33 aa, Staphylococcus aureus
DQIPRLNVLDLQRLIRIIPKPVIAMVKGYAVGG

SEQ ID NO: 1679775 - protein, 23 aa, Staphylococcus aureus
DREDLFITTKLWNDYQGYEKTFE

SEQ ID NO: 1679776 - protein, 25 aa, Staphylococcus aureus
DRQLVKVAAWYDNEMSYTAQLVRTL

SEQ ID NO: 1679777 - protein, 17 aa, Staphylococcus aureus
DRYINEFLKKGSSNYPI

SEQ ID NO: 1679778 - protein, 37 aa, Staphylococcus aureus
DSKEFLNLMMYTMYFKNIIKKHLTLSFVEFTILAIIT

SEQ ID NO: 1679779 - protein, 24 aa, Staphylococcus aureus
DYATNIAMVLTKIAKRNPREIAQA

SEQ ID NO: 1679780 - protein, 25 aa, Staphylococcus aureus
DYVGRIGIGRVFRGKMRVGDNVSLI

SEQ ID NO: 1679781 - protein, 23 aa, Staphylococcus aureus
EADFINCVVFRRQADNVNNYLSK

SEQ ID NO: 1679782 - protein, 24 aa, Staphylococcus aureus
EAEKISDFLSLIGGYQALLKFEDV

SEQ ID NO: 1679783 - protein, 31 aa, Staphylococcus aureus
EEVRALNEFAINGLYPDLTIYLNVSAEVGRE

SEQ ID NO: 1679784 - protein, 18 aa, Staphylococcus aureus
EFFGTMKPFILKPKGDDS

SEQ ID NO: 1679785 - protein, 24 aa, Staphylococcus aureus
EGAARYMSGFYTIVKMVEGLMHDL

SEQ ID NO: 1679786 - protein, 18 aa, Staphylococcus aureus
EGQRRYVESLSAYARQFL

SEQ ID NO: 1679787 - protein, 26 aa, Staphylococcus aureus
EGYDPEYGARPLIRAIQKTIEDNLSE

SEQ ID NO: 1679788 - protein, 18 aa, Staphylococcus aureus
EHAIIPDRIEAGTLLIAG

SEQ ID NO: 1679789 - protein, 18 aa, Staphylococcus aureus
EHMKSIMTMLDAKNIDDL

SEQ ID NO: 1679790 - protein, 26 aa, Staphylococcus aureus
EILNRMDDIVLFKPLSIDDMSMIVDK

SEQ ID NO: 1679791 - protein, 24 aa, Staphylococcus aureus
EIQQAGNVILFIDELHTLVGAGGA

SEQ ID NO: 1679792 - protein, 21 aa, Staphylococcus aureus
EKIDYPILLSESLTAVLAVPL

SEQ ID NO: 1679793 - protein, 24 aa, Staphylococcus aureus
EKNPILAWDLNMGGLMNALEAART

SEQ ID NO: 1679794 - protein, 26 aa, Staphylococcus aureus
ELEREGFHILAIKDMAGLLKPKAAYE

SEQ ID NO: 1679795 - protein, 20 aa, Staphylococcus aureus
ELERFRATLFRQTMFAEFEH

SEQ ID NO: 1679796 - protein, 18 aa, Staphylococcus aureus
ELFKKYFASVVPAADNKF

SEQ ID NO: 1679797 - protein, 22 aa, Staphylococcus aureus
ELGPYIVIAPEIAIAHARPNND

SEQ ID NO: 1679798 - protein, 22 aa, Staphylococcus aureus
ELIFRIRAVLRRYNINSNSEMT

SEQ ID NO: 1679799 - protein, 25 aa, Staphylococcus aureus
ELLKPAVMMNLLGKDLDLLENEFNE

SEQ ID NO: 1679800 - protein, 21 aa, Staphylococcus aureus
ELNPTPKWSIARYKGLGEMNA

SEQ ID NO: 1679801 - protein, 18 aa, Staphylococcus aureus
EPNDLFFIISLSGETHEL

SEQ ID NO: 1679802 - protein, 24 aa, Staphylococcus aureus
ERAKAGLFLAMQYPSEITGVTNAD

SEQ ID NO: 1679803 - protein, 23 aa, Staphylococcus aureus
ERKLTEMGIYPAVDPLASTSRAL

SEQ ID NO: 1679804 - protein, 29 aa, Staphylococcus aureus
ERLERLRKAIPNVLFQMLLRASNAVGYKN

SEQ ID NO: 1679805 - protein, 25 aa, Staphylococcus aureus
ERLGSFLLKALLQLKHPSIKEIRGR

SEQ ID NO: 1679806 - protein, 23 aa, Staphylococcus aureus
ERNEPFDWLSYWTDECHYTLKHV

SEQ ID NO: 1679807 - protein, 18 aa, Staphylococcus aureus
ESGYFYTLLGPSGCGKTT

SEQ ID NO: 1679808 - protein, 28 aa, Staphylococcus aureus
ESLKDTLVRVIPFWTDHISQYLLDGQTV

SEQ ID NO: 1679809 - protein, 26 aa, Staphylococcus aureus
ESRSDLEIYLYDRGPRILRNFPEKLS

SEQ ID NO: 1679810 - protein, 26 aa, Staphylococcus aureus
ETEKYGFQTLKERLPIWIKQSKRAIR

SEQ ID NO: 1679811 - protein, 18 aa, Staphylococcus aureus
ETFLKNEIARWIKIQEDI

SEQ ID NO: 1679812 - protein, 22 aa, Staphylococcus aureus
ETWSQQIEMFLGNKARLDMLEQ

SEQ ID NO: 1679813 - protein, 20 aa, Staphylococcus aureus
EVLIKNWPGLHIEPLQAPEN

SEQ ID NO: 1679814 - protein, 18 aa, Staphylococcus aureus
FAFDLKLINEKRPHILDA

SEQ ID NO: 1679815 - protein, 21 aa, Staphylococcus aureus
FDASVMEIYCCLLNGHTLVIP

SEQ ID NO: 1679816 - protein, 19 aa, Staphylococcus aureus
FECGRFIVAHIGYYVTEVL

SEQ ID NO: 1679817 - protein, 19 aa, Staphylococcus aureus
FECNCSHEKFLNAIKGLGE

SEQ ID NO: 1679818 - protein, 18 aa, Staphylococcus aureus
FEEGKRAVLLLHGFTGNS

SEQ ID NO: 1679819 - protein, 23 aa, Staphylococcus aureus
FGEPAIAVPFNAGKIKVLIEALE

SEQ ID NO: 1679820 - protein, 19 aa, Staphylococcus aureus
FKRTYVCEDMSKCICLYNA

SEQ ID NO: 1679821 - protein, 18 aa, Staphylococcus aureus
FLGNIIAEVFNRFSITDT

SEQ ID NO: 1679822 - protein, 19 aa, Staphylococcus aureus
FMSDLIKRIDTHLSIDFMD

SEQ ID NO: 1679823 - protein, 27 aa, Staphylococcus aureus
FNLDHTKVVAPFIRLAGTMEGLNGDVI

SEQ ID NO: 1679824 - protein, 19 aa, Staphylococcus aureus
FNTVRNMFGFTGTYKGKKV

SEQ ID NO: 1679825 - protein, 24 aa, Staphylococcus aureus
FPETKILILTMFDDEEYLFHVLRN

SEQ ID NO: 1679826 - protein, 34 aa, Staphylococcus aureus
FRDIDRALVWGFNWKLGPFQLWDAMGYERVKTRM

SEQ ID NO: 1679827 - protein, 25 aa, Staphylococcus aureus
FSDRNVYTAPIFNLTPESIPVVAVL

SEQ ID NO: 1679828 - protein, 18 aa, Staphylococcus aureus
FSETSLYEKGEILEVLAK

SEQ ID NO: 1679829 - protein, 28 aa, Staphylococcus aureus
FSKEVALVMMILRLNTLLKGHSGATLEL

SEQ ID NO: 1679830 - protein, 18 aa, Staphylococcus aureus
FVILAKTLNYRLASEEIN

SEQ ID NO: 1679831 - protein, 23 aa, Staphylococcus aureus
FVTKEHVPILKTLGVDDSKKLTD

SEQ ID NO: 1679832 - protein, 19 aa, Staphylococcus aureus
GAFDMERILRLMRPSKDEV

SEQ ID NO: 1679833 - protein, 24 aa, Staphylococcus aureus
GAGRGGSMLLLAKDLPTAKNIVKA

SEQ ID NO: 1679834 - protein, 19 aa, Staphylococcus aureus
GAHIFLDMVSVGATINIML

SEQ ID NO: 1679835 - protein, 22 aa, Staphylococcus aureus
GAKNIRFMCLIAAPEGVEKMHE

SEQ ID NO: 1679836 - protein, 22 aa, Staphylococcus aureus
GDFDYLPEIYKAVKAEVLFNKV

SEQ ID NO: 1679837 - protein, 27 aa, Staphylococcus aureus
GDGIIKIEMHFLPDVYVPCEVCDGKRY

SEQ ID NO: 1679838 - protein, 23 aa, Staphylococcus aureus
GDTTTLVLAPLVAAVDVPVAKMS

SEQ ID NO: 1679839 - protein, 25 aa, Staphylococcus aureus
GEKLQGFLVTKFGWVQSYGSRAVKP

SEQ ID NO: 1679840 - protein, 28 aa, Staphylococcus aureus
GGEQKRLYLLRLLVHQPNVLLLDEPTND

SEQ ID NO: 1679841 - protein, 29 aa, Staphylococcus aureus
GGESTTLRRLMNLYGFKEALQNSTLPMFG

SEQ ID NO: 1679842 - protein, 20 aa, Staphylococcus aureus
GGGWNAIFWCNHDQPRVVSR

SEQ ID NO: 1679843 - protein, 32 aa, Staphylococcus aureus
GGRHTPFFSNYRPQFYFRTTDVTGVVHLPEGT

SEQ ID NO: 1679844 - protein, 26 aa, Staphylococcus aureus
GHTKKVDLFLKKNIKLTKDIYGTSVK

SEQ ID NO: 1679845 - protein, 18 aa, Staphylococcus aureus
GIEEPGLDRLIRTTYELL

SEQ ID NO: 1679846 - protein, 26 aa, Staphylococcus aureus
GIENYSVHLTLRPLGSTPYTLLDYFG

SEQ ID NO: 1679847 - protein, 21 aa, Staphylococcus aureus
GIFAFNNKTLFEKLTQVKNDN

SEQ ID NO: 1679848 - protein, 33 aa, Staphylococcus aureus
GIIEKLDYIKLLGVDYIWLTPVYESPMNDNGYD

SEQ ID NO: 1679849 - protein, 29 aa, Staphylococcus aureus
GIPHGRANAILLPHIIRYNAKDPQKHALF

SEQ ID NO: 1679850 - protein, 22 aa, Staphylococcus aureus
GIQELVDLFQDKGIFSALETQG

SEQ ID NO: 1679851 - protein, 18 aa, Staphylococcus aureus
GLAFVCAAKGYKAVFTMP

SEQ ID NO: 1679852 - protein, 23 aa, Staphylococcus aureus
GNMRIMSRILTTSLPQDYTVTLV

SEQ ID NO: 1679853 - protein, 23 aa, Staphylococcus aureus
GRYSVLTAVGLLPIATAGINIEA

SEQ ID NO: 1679854 - protein, 25 aa, Staphylococcus aureus
GSGKTMIFDAMTYALFGKASTEQRE

SEQ ID NO: 1679855 - protein, 30 aa, Staphylococcus aureus
GSLIDYGCHLLDLSLWLLGKDMVPHEVLGK

SEQ ID NO: 1679856 - protein, 25 aa, Staphylococcus aureus
GSSALRQLPTYLRKNYDNLNVITMI

SEQ ID NO: 1679857 - protein, 20 aa, Staphylococcus aureus
GTLLQAFHQYSHMLSKVAFV

SEQ ID NO: 1679858 - protein, 25 aa, Staphylococcus aureus
GVCLNVGCIPSKALLHASHRFVEAQ

SEQ ID NO: 1679859 - protein, 19 aa, Staphylococcus aureus
GVNFYTLPYATVSEMKHYF

SEQ ID NO: 1679860 - protein, 23 aa, Staphylococcus aureus
HAAKHMYLVYQNPELQFITNSVY

SEQ ID NO: 1679861 - protein, 20 aa, Staphylococcus aureus
HGRKINWKSLYEKALNHDFA

SEQ ID NO: 1679862 - protein, 25 aa, Staphylococcus aureus
HIEDTYLLMDSFISKYDQLSDVLMA

SEQ ID NO: 1679863 - protein, 22 aa, Staphylococcus aureus
HKENLLLQKYYHLDSIPVGDFS

SEQ ID NO: 1679864 - protein, 24 aa, Staphylococcus aureus
HPGFPTDMQSQMMALLLTANGHKV

SEQ ID NO: 1679865 - protein, 17 aa, Staphylococcus aureus
HRKRPATAKPVLLGITK

SEQ ID NO: 1679866 - protein, 24 aa, Staphylococcus aureus
HVASALIKWFNTNYHYIVPEWDNV

SEQ ID NO: 1679867 - protein, 20 aa, Staphylococcus aureus
IADNFNVTLPEFGKSYLKEL

SEQ ID NO: 1679868 - protein, 18 aa, Staphylococcus aureus
IAGLRMMCQFVEDIDVVV

SEQ ID NO: 1679869 - protein, 28 aa, Staphylococcus aureus
IAQYHPTFIIMIPTMYYSTLRASNFNPE

SEQ ID NO: 1679870 - protein, 26 aa, Staphylococcus aureus
IDTVHEYFNGLYIITPFQNVEDSLEL

SEQ ID NO: 1679871 - protein, 22 aa, Staphylococcus aureus
IEEYFPLPEHLTSTHNSDIFIL

SEQ ID NO: 1679872 - protein, 20 aa, Staphylococcus aureus
IFPHQHGFKIIYNSAAYDLL

SEQ ID NO: 1679873 - protein, 25 aa, Staphylococcus aureus
IGDRVSIAWMFESCGRCEYCTTGRE

SEQ ID NO: 1679874 - protein, 18 aa, Staphylococcus aureus
IIASPRIGIPNKGDWTHK

SEQ ID NO: 1679875 - protein, 22 aa, Staphylococcus aureus
IIREGLKQIIPWGDYHFNTIYT

SEQ ID NO: 1679876 - protein, 17 aa, Staphylococcus aureus
IIYAIPDLTGVNISIEQ

SEQ ID NO: 1679877 - protein, 17 aa, Staphylococcus aureus
ILNQQFGLGMDYFDVDK

SEQ ID NO: 1679878 - protein, 27 aa, Staphylococcus aureus
ILTYSTIYDLPILADPLSHLRKFDHPN

SEQ ID NO: 1679879 - protein, 23 aa, Staphylococcus aureus
INKKAHAIFKHGMTPIICVGETD

SEQ ID NO: 1679880 - protein, 23 aa, Staphylococcus aureus
IPATIAIIDGKIKIGLESEDLEI

SEQ ID NO: 1679881 - protein, 23 aa, Staphylococcus aureus
IRDFIIIEAYMFRFKKKVKPEVD

SEQ ID NO: 1679882 - protein, 26 aa, Staphylococcus aureus
IRKHKQLHMLPLFEEHYHLYAPSDDP

SEQ ID NO: 1679883 - protein, 24 aa, Staphylococcus aureus
ISEEYNVPLLMKFELHGKNKDVIE

SEQ ID NO: 1679884 - protein, 28 aa, Staphylococcus aureus
ISFAHHIMTYFWMLQRDQQRFEDSLKRI

SEQ ID NO: 1679885 - protein, 27 aa, Staphylococcus aureus
ITDGQIFLQSDLFFSGVRPAINAGQSV

SEQ ID NO: 1679886 - protein, 27 aa, Staphylococcus aureus
IVAGSYFVTALQTVVSRRLSPFETGVV

SEQ ID NO: 1679887 - protein, 24 aa, Staphylococcus aureus
IVHKHYWNIGIAADTDRGLLVPVV

SEQ ID NO: 1679888 - protein, 25 aa, Staphylococcus aureus
IVKKDFTGISFLNLVDFDALYGHRR

SEQ ID NO: 1679889 - protein, 23 aa, Staphylococcus aureus
IVSIGARPINLLNSLRFGELDNK

SEQ ID NO: 1679890 - protein, 18 aa, Staphylococcus aureus
IYLAHTYGCHIQGVDINK

SEQ ID NO: 1679891 - protein, 23 aa, Staphylococcus aureus
KAHPDVFNILLQVLDDGHLTDTK

SEQ ID NO: 1679892 - protein, 22 aa, Staphylococcus aureus
KALNPSLKAFAPVREWAWSREE

SEQ ID NO: 1679893 - protein, 22 aa, Staphylococcus aureus
KDAGIYYQVYTSRAIYTEDPQR

SEQ ID NO: 1679894 - protein, 25 aa, Staphylococcus aureus
KDDDTIVLVGFGGGLTWGAMTIKWG

SEQ ID NO: 1679895 - protein, 21 aa, Staphylococcus aureus
KDRNFNIEFITKLEGAHLDYE

SEQ ID NO: 1679896 - protein, 28 aa, Staphylococcus aureus
KDYVDIVEIGTPIIYNEGLPAVKHMADN

SEQ ID NO: 1679897 - protein, 24 aa, Staphylococcus aureus
KESILSVILPQYVESLIYGTILDA

SEQ ID NO: 1679898 - protein, 26 aa, Staphylococcus aureus
KFKDAMHLADFFDAPYEMFLESKVKE

SEQ ID NO: 1679899 - protein, 19 aa, Staphylococcus aureus
KGGRLIYIGAGTSGRLGVL

SEQ ID NO: 1679900 - protein, 23 aa, Staphylococcus aureus
KHGDKIVLPVDTKVAKEFSNDAK

SEQ ID NO: 1679901 - protein, 24 aa, Staphylococcus aureus
KKFGAFVELPEGKSGLVHISEVAD

SEQ ID NO: 1679902 - protein, 23 aa, Staphylococcus aureus
KNQQWLVIANFSASAVDLPEGLA

SEQ ID NO: 1679903 - protein, 26 aa, Staphylococcus aureus
KQQQKQRALYKEELAWMRAGAKARTT

SEQ ID NO: 1679904 - protein, 18 aa, Staphylococcus aureus
KRPATAKPVLLGITKASL

SEQ ID NO: 1679905 - protein, 18 aa, Staphylococcus aureus
KSYELAKEFAEEAGFPLM

SEQ ID NO: 1679906 - protein, 20 aa, Staphylococcus aureus
KTIIRGLRAVSDFEYELRLT

SEQ ID NO: 1679907 - protein, 26 aa, Staphylococcus aureus
KVNLKSIMGVMSLGVGKDAEITIYAD

SEQ ID NO: 1679908 - protein, 17 aa, Staphylococcus aureus
KWFLQDVEVLINGVRET

SEQ ID NO: 1679909 - protein, 20 aa, Staphylococcus aureus
LAFDTIYAEGQRRYVESLSA

SEQ ID NO: 1679910 - protein, 29 aa, Staphylococcus aureus
LAQGKKGLFIVPLNGLKKWLTPVEMWQNH

SEQ ID NO: 1679911 - protein, 24 aa, Staphylococcus aureus
LAQYQRILKQKNNYLKQLQLGQKK

SEQ ID NO: 1679912 - protein, 25 aa, Staphylococcus aureus
LDDEKRLLLLNQELERFRATLFRQT

SEQ ID NO: 1679913 - protein, 26 aa, Staphylococcus aureus
LDEETFGYVVYFFELACAMSGYQLGV

SEQ ID NO: 1679914 - protein, 20 aa, Staphylococcus aureus
LDQVSIDKMMIALDGTPNKG

SEQ ID NO: 1679915 - protein, 26 aa, Staphylococcus aureus
LDRLIRTTYELLGLSTYFTAGVQEVR

SEQ ID NO: 1679916 - protein, 26 aa, Staphylococcus aureus
LEAARTYNLHFFTPSSIGAFGDSTPK

SEQ ID NO: 1679917 - protein, 24 aa, Staphylococcus aureus
LEDIDLKELVLPLIVLDFSTEVAN

SEQ ID NO: 1679918 - protein, 19 aa, Staphylococcus aureus
LELLSSDGMLVKRPLAVMG

SEQ ID NO: 1679919 - protein, 27 aa, Staphylococcus aureus
LESGDAPLLVKYLWDNLTDAPHGIVKF

SEQ ID NO: 1679920 - protein, 22 aa, Staphylococcus aureus
LIGYTPWGIIDIVSFTTGEMKK

SEQ ID NO: 1679921 - protein, 19 aa, Staphylococcus aureus
LIMYGQMTAGSWIYIGSQG

SEQ ID NO: 1679922 - protein, 18 aa, Staphylococcus aureus
LLQLTKWAETKKLTGWYA

SEQ ID NO: 1679923 - protein, 24 aa, Staphylococcus aureus
LNQMAFKPIIADHLKLIDTSIYKE

SEQ ID NO: 1679924 - protein, 23 aa, Staphylococcus aureus
LNRAPTLHRLGIQAFEPTLVEGR

SEQ ID NO: 1679925 - protein, 18 aa, Staphylococcus aureus
LPTHGFAVRIFAYRTQII

SEQ ID NO: 1679926 - protein, 26 aa, Staphylococcus aureus
LSHFSFVDDVFFINKIPEGLTFDHAF

SEQ ID NO: 1679927 - protein, 25 aa, Staphylococcus aureus
LTACYLLVNKAIRRGYKSMPEHVNM

SEQ ID NO: 1679928 - protein, 26 aa, Staphylococcus aureus
LTDDDMLAHLLKYDTMQGRFTGEVEV

SEQ ID NO: 1679929 - protein, 23 aa, Staphylococcus aureus
MAQDFSYRYPLVDGQGNFGSMDG

SEQ ID NO: 1679930 - protein, 25 aa, Staphylococcus aureus
MEVQFLGFVFEVFDAIAGQIARTRF

SEQ ID NO: 1679931 - protein, 26 aa, Staphylococcus aureus
MIGEDFSHYLKVRPGAFFLTGCGNES

SEQ ID NO: 1679932 - protein, 20 aa, Staphylococcus aureus
MIVMGFIEPFTKELPMEYAV

SEQ ID NO: 1679933 - protein, 23 aa, Staphylococcus aureus
MLDAVIDYLPSPLDVKPIIGHRA

SEQ ID NO: 1679934 - protein, 18 aa, Staphylococcus aureus
MLDILKKLDVHNACVVVT

SEQ ID NO: 1679935 - protein, 17 aa, Staphylococcus aureus
MLESIRYVDLVIPEKGW

SEQ ID NO: 1679936 - protein, 19 aa, Staphylococcus aureus
MSMTRGYGIINHTFEEFRP

SEQ ID NO: 1679937 - protein, 24 aa, Staphylococcus aureus
NAGSFLAKFLYDLGAKIVGISDAY

SEQ ID NO: 1679938 - protein, 19 aa, Staphylococcus aureus
NAITAWYDLAKLANKYVLE

SEQ ID NO: 1679939 - protein, 17 aa, Staphylococcus aureus
NEFLKKGSSNYPIEILK

SEQ ID NO: 1679940 - protein, 25 aa, Staphylococcus aureus
NEPPGARMRVALSGLTMAEYFRDEQ

SEQ ID NO: 1679941 - protein, 17 aa, Staphylococcus aureus
NEQGPYYAGLTACYLLV

SEQ ID NO: 1679942 - protein, 23 aa, Staphylococcus aureus
NFEEAFVVKQILQHLATKHGINF

SEQ ID NO: 1679943 - protein, 22 aa, Staphylococcus aureus
NFNDYHIMIVHPWQLDDVLHSD

SEQ ID NO: 1679944 - protein, 23 aa, Staphylococcus aureus
NIQKAVAEMKLAVGLLVDKKLSH

SEQ ID NO: 1679945 - protein, 23 aa, Staphylococcus aureus
NKNNRFKLIILRKGRGLAGTVMK

SEQ ID NO: 1679946 - protein, 24 aa, Staphylococcus aureus
NLNIDQRLKFITLTDKGRAYLKER

SEQ ID NO: 1679947 - protein, 19 aa, Staphylococcus aureus
NMPDSLHAIDWIITNKDET

SEQ ID NO: 1679948 - protein, 18 aa, Staphylococcus aureus
NNALLRKVVEDYTVLRGC

SEQ ID NO: 1679949 - protein, 24 aa, Staphylococcus aureus
NNYEKLYLTYLVQGLTLNKLDFIH

SEQ ID NO: 1679950 - protein, 22 aa, Staphylococcus aureus
NPFDLTKVWYHDEYPLIEVGEF

SEQ ID NO: 1679951 - protein, 28 aa, Staphylococcus aureus
NPGNTEAMIKYLLPKATVVTPNLFEAGQ

SEQ ID NO: 1679952 - protein, 24 aa, Staphylococcus aureus
NQNVHFEVLLVKLAEQIKGQPQVI

SEQ ID NO: 1679953 - protein, 24 aa, Staphylococcus aureus
NRIVQALPTIQYIIEQGGKIVLFS

SEQ ID NO: 1679954 - protein, 25 aa, Staphylococcus aureus
NTKGESTIPLIKKLSADNVRLNVTA

SEQ ID NO: 1679955 - protein, 18 aa, Staphylococcus aureus
NTQRFDFEKASESAGWIK

SEQ ID NO: 1679956 - protein, 19 aa, Staphylococcus aureus
NWKSLYEKALNHDFAEVFT

SEQ ID NO: 1679957 - protein, 24 aa, Staphylococcus aureus
PDFATIYISYIPNVKMVESKSLKL

SEQ ID NO: 1679958 - protein, 29 aa, Staphylococcus aureus
PFKELPLYEIGWRLLPEFWGKGLATEGAK

SEQ ID NO: 1679959 - protein, 26 aa, Staphylococcus aureus
PFLLKQLNIPIYGGPLALGLIRNKLE

SEQ ID NO: 1679960 - protein, 19 aa, Staphylococcus aureus
PFNKKFLGNIIAEVFNRFS

SEQ ID NO: 1679961 - protein, 23 aa, Staphylococcus aureus
PHDEILVSFDLYGGTFRLFEFYE

SEQ ID NO: 1679962 - protein, 19 aa, Staphylococcus aureus
PHELYLRLKKHIKNGRINV

SEQ ID NO: 1679963 - protein, 20 aa, Staphylococcus aureus
PIVIMAEFILSAQKIISRTI

SEQ ID NO: 1679964 - protein, 22 aa, Staphylococcus aureus
PKHVVYVWIDALVNYISALGYL

SEQ ID NO: 1679965 - protein, 22 aa, Staphylococcus aureus
PKLIEHLLEIRGLGIINVMTLF

SEQ ID NO: 1679966 - protein, 20 aa, Staphylococcus aureus
PKNKLIVMTGLSGSGKSSLA

SEQ ID NO: 1679967 - protein, 23 aa, Staphylococcus aureus
PKVSRNVLLDRFKYAQSLNVNAH

SEQ ID NO: 1679968 - protein, 29 aa, Staphylococcus aureus
PLPVEHQVLIIYALTKGYLDDIPVVDITR

SEQ ID NO: 1679969 - protein, 25 aa, Staphylococcus aureus
PMRIKEFELLWYLASRENEVISKSE

SEQ ID NO: 1679970 - protein, 23 aa, Staphylococcus aureus
PQDAALMMELGADGVFVGSGIFK

SEQ ID NO: 1679971 - protein, 25 aa, Staphylococcus aureus
PSANSLYYALNGFPRHLRTDIEGME

SEQ ID NO: 1679972 - protein, 20 aa, Staphylococcus aureus
PTNIIPGLDFSPDKMLQGRL

SEQ ID NO: 1679973 - protein, 21 aa, Staphylococcus aureus
PVLALSLSFDHRQIDGATGQN

SEQ ID NO: 1679974 - protein, 17 aa, Staphylococcus aureus
QAIKLTFEYLKSSVEKG

SEQ ID NO: 1679975 - protein, 26 aa, Staphylococcus aureus
QDNPGLLRRPIILDNKRLQVGYNEDE

SEQ ID NO: 1679976 - protein, 30 aa, Staphylococcus aureus
QDYALFPHLNVYDNIAFGLKLKKLSKTEID

SEQ ID NO: 1679977 - protein, 32 aa, Staphylococcus aureus
QFDNFLDQFYQIKGQYFIITHINTLIGDFHSE

SEQ ID NO: 1679978 - protein, 22 aa, Staphylococcus aureus
QGKSYLEILEMGGGILSTVNAT

SEQ ID NO: 1679979 - protein, 20 aa, Staphylococcus aureus
QGQKFILAEIQIRTLAMNFW

SEQ ID NO: 1679980 - protein, 26 aa, Staphylococcus aureus
QILKEIISRLTFLNNVGLEYLTLNRA

SEQ ID NO: 1679981 - protein, 33 aa, Staphylococcus aureus
QLMDKGPRRVSPFFVPMLIPDMATGQVSIDLGA

SEQ ID NO: 1679982 - protein, 21 aa, Staphylococcus aureus
QLRMTLPEYMIPVNFMHIEQI

SEQ ID NO: 1679983 - protein, 35 aa, Staphylococcus aureus
QMDADLVFDVRFLPNPYYVVDLRPLTGLDKDVYNY

SEQ ID NO: 1679984 - protein, 19 aa, Staphylococcus aureus
QMLSIEYPIIQAGMAGSTT

SEQ ID NO: 1679985 - protein, 23 aa, Staphylococcus aureus
QNREKAMKVLKARLYDMKVQEEQ

SEQ ID NO: 1679986 - protein, 30 aa, Staphylococcus aureus
QNYALYPHMTVFENMAFGLKLRKVNKKEIE

SEQ ID NO: 1679987 - protein, 20 aa, Staphylococcus aureus
QSHPVCHYIYDLVGLEHHLQ

SEQ ID NO: 1679988 - protein, 24 aa, Staphylococcus aureus
QSLYRIVNHWIDFGVDGFRFDVIN

SEQ ID NO: 1679989 - protein, 27 aa, Staphylococcus aureus
QTDYLDLFLIHWPCEADGLFLETYKAM

SEQ ID NO: 1679990 - protein, 24 aa, Staphylococcus aureus
QTMNRPRILTLEEALQFINDDELV

SEQ ID NO: 1679991 - protein, 30 aa, Staphylococcus aureus
RAGIKDPNRPIGSFLFLGPTGVGKTELAKS

SEQ ID NO: 1679992 - protein, 29 aa, Staphylococcus aureus
RDEQGQDVLLFIDNIFRFTQAGSEVSALL

SEQ ID NO: 1679993 - protein, 26 aa, Staphylococcus aureus
REAERLVIHGFLDPVVRELPIEDVKR

SEQ ID NO: 1679994 - protein, 21 aa, Staphylococcus aureus
REVFKFAVRIMGDASTRVVEK

SEQ ID NO: 1679995 - protein, 23 aa, Staphylococcus aureus
RGPLLMQDIYFLEQMSQFDREVI

SEQ ID NO: 1679996 - protein, 22 aa, Staphylococcus aureus
RHGTMPLTMFITKKGKQVKVNH

SEQ ID NO: 1679997 - protein, 24 aa, Staphylococcus aureus
RIDEPTLEMTFKVNNSPFAGREGD

SEQ ID NO: 1679998 - protein, 30 aa, Staphylococcus aureus
RKELLGLDDLKMYDLYTPLIKDIKFEMPYE

SEQ ID NO: 1679999 - protein, 22 aa, Staphylococcus aureus
RKTPNRYFIDPTTLGEGGLKEY

SEQ ID NO: 1680000 - protein, 24 aa, Staphylococcus aureus
RLSDMERLIRLPGKFKYFEHNVAA

SEQ ID NO: 1680001 - protein, 24 aa, Staphylococcus aureus
RNEDLYHAYPYPDKPMDMTISGQN

SEQ ID NO: 1680002 - protein, 30 aa, Staphylococcus aureus
RNQYGNLSLLDTPTFFFGMRNGETVEIEID

SEQ ID NO: 1680003 - protein, 20 aa, Staphylococcus aureus
RSAAFFAVGLIKGSERPVAI

SEQ ID NO: 1680004 - protein, 30 aa, Staphylococcus aureus
RVANEKVRFARFRPFPFWKRVHDSFISSDE

SEQ ID NO: 1680005 - protein, 25 aa, Staphylococcus aureus
RVDALVMSKLRPLLHYARAKDIDNY

SEQ ID NO: 1680006 - protein, 20 aa, Staphylococcus aureus
RYVSDRFLPDKAIDLIDEAS

SEQ ID NO: 1680007 - protein, 28 aa, Staphylococcus aureus
SDAPIAFQEFMILPVGATTFKESLRWGT

SEQ ID NO: 1680008 - protein, 17 aa, Staphylococcus aureus
SDFLFVLKDGKIQQFGT

SEQ ID NO: 1680009 - protein, 23 aa, Staphylococcus aureus
SDKCDFYIKIPMVGHVNSLNASV

SEQ ID NO: 1680010 - protein, 34 aa, Staphylococcus aureus
SDLRLEDIGFIFQSSHLVPYLKVIEQLTLVGQEA

SEQ ID NO: 1680011 - protein, 24 aa, Staphylococcus aureus
SDRYITDRFLPDKAIDLVDQACAT

SEQ ID NO: 1680012 - protein, 29 aa, Staphylococcus aureus
SEAHASLRQSLLPHLIEAASYNVARKNKD

SEQ ID NO: 1680013 - protein, 17 aa, Staphylococcus aureus
SEFQVIEYPLLEIIMRY

SEQ ID NO: 1680014 - protein, 23 aa, Staphylococcus aureus
SEHPKVRMMSFTGSGPTGSKIME

SEQ ID NO: 1680015 - protein, 24 aa, Staphylococcus aureus
SEYKMFSYHFKKYLQMSPSDYCKQ

SEQ ID NO: 1680016 - protein, 25 aa, Staphylococcus aureus
SFNDIEFLPPVTPPNNVIAFGRNYK

SEQ ID NO: 1680017 - protein, 28 aa, Staphylococcus aureus
SGAHLTNPFILLNWSNTISDLYTLVHEF

SEQ ID NO: 1680018 - protein, 28 aa, Staphylococcus aureus
SGEKIPKALALDYVYGYTIINDITDRKA

SEQ ID NO: 1680019 - protein, 26 aa, Staphylococcus aureus
SIGELEPRMFSFNSPFGACPTCDGLG

SEQ ID NO: 1680020 - protein, 22 aa, Staphylococcus aureus
SKKLNQWLKKTDAFQILVQNND

SEQ ID NO: 1680021 - protein, 28 aa, Staphylococcus aureus
SLAAYYYAIVAPYKRHPMIKLMNRMHYD

SEQ ID NO: 1680022 - protein, 33 aa, Staphylococcus aureus
SLFAQLFTVDILYYRFVALNYHAILDCITQSKM

SEQ ID NO: 1680023 - protein, 17 aa, Staphylococcus aureus
SLQQIDRSLFWVNPDCG

SEQ ID NO: 1680024 - protein, 19 aa, Staphylococcus aureus
SMCLLYQLLNDYKDSYRKL

SEQ ID NO: 1680025 - protein, 24 aa, Staphylococcus aureus
SNEYDMEPLILTLKPGASYKNFNP

SEQ ID NO: 1680026 - protein, 31 aa, Staphylococcus aureus
SNYKRVIDALSYYQFFILKFVVGEQRIKDAI

SEQ ID NO: 1680027 - protein, 25 aa, Staphylococcus aureus
SPVQSIICYLALHRLHKVPMMMEGK

SEQ ID NO: 1680028 - protein, 33 aa, Staphylococcus aureus
SQGDQQLMLRLIKPKYFLPIHGEYRMLKAHGET

SEQ ID NO: 1680029 - protein, 30 aa, Staphylococcus aureus
SQIRVRYIRSPLHAYLFIDTHHIINDGMSN

SEQ ID NO: 1680030 - protein, 21 aa, Staphylococcus aureus
SSDGMLVKRPLAVMGDKITLG

SEQ ID NO: 1680031 - protein, 21 aa, Staphylococcus aureus
SSIVQYIEKLVWMGGTFLPKG

SEQ ID NO: 1680032 - protein, 17 aa, Staphylococcus aureus
SSLAFDTIYAEGQRRYV

SEQ ID NO: 1680033 - protein, 23 aa, Staphylococcus aureus
SSVMFDFGVLKRPQIFYAYDLDK

SEQ ID NO: 1680034 - protein, 28 aa, Staphylococcus aureus
STPPLDELQFIFFKMQKFNPEYVKLAVM

SEQ ID NO: 1680035 - protein, 28 aa, Staphylococcus aureus
SVKSISGYPFVWWFATNPEYEGKGYGSQ

SEQ ID NO: 1680036 - protein, 20 aa, Staphylococcus aureus
SYRFNGIGSSALRQLPTYLR

SEQ ID NO: 1680037 - protein, 18 aa, Staphylococcus aureus
SYTELVTVSLHAIRRFEK

SEQ ID NO: 1680038 - protein, 24 aa, Staphylococcus aureus
TADLTIGLVLAVARRIVEGDQLSR

SEQ ID NO: 1680039 - protein, 26 aa, Staphylococcus aureus
TDYSSFISYHIFFETLVRKYNEYLLH

SEQ ID NO: 1680040 - protein, 26 aa, Staphylococcus aureus
TEDDKMIFNIPIRTIEYKYGQAIYGV

SEQ ID NO: 1680041 - protein, 27 aa, Staphylococcus aureus
TEKVRRKPYSVILFDEIEKAHPDVFNI

SEQ ID NO: 1680042 - protein, 25 aa, Staphylococcus aureus
TELGAFFIKQLYQHGDLFFSDRNVY

SEQ ID NO: 1680043 - protein, 25 aa, Staphylococcus aureus
TEQDIISYVLYPKVYEQYIQTRNQY

SEQ ID NO: 1680044 - protein, 25 aa, Staphylococcus aureus
TEVNIVWSPPWTKDMMSRYAKIALG

SEQ ID NO: 1680045 - protein, 24 aa, Staphylococcus aureus
TGAEPLYFLDYIATNKVVPEVIEQ

SEQ ID NO: 1680046 - protein, 26 aa, Staphylococcus aureus
TGIKVVDLLAPYIKGGKIGLFGGAGV

SEQ ID NO: 1680047 - protein, 24 aa, Staphylococcus aureus
TGPVTILNWSFERVDLPRKVVQDQ

SEQ ID NO: 1680048 - protein, 24 aa, Staphylococcus aureus
TGSTMELLLPQMAQLIKERGYNIT

SEQ ID NO: 1680049 - protein, 29 aa, Staphylococcus aureus
TGSVVLPGRFFVDIIKKLPGKDVKLSTNE

SEQ ID NO: 1680050 - protein, 23 aa, Staphylococcus aureus
THETLKRYLLEETFELFEAIDNE

SEQ ID NO: 1680051 - protein, 30 aa, Staphylococcus aureus
THIDVKDTFFKLLKHPTIASKHYLYDQYDQ

SEQ ID NO: 1680052 - protein, 34 aa, Staphylococcus aureus
THTLDIIKRHRLLELFLIEILKYNWEEVHQEAEI

SEQ ID NO: 1680053 - protein, 26 aa, Staphylococcus aureus
TIIFASPVYWYSISAPLKAFIEHWSE

SEQ ID NO: 1680054 - protein, 23 aa, Staphylococcus aureus
TLAMNFWATIEHTLRYKYDGAYP

SEQ ID NO: 1680055 - protein, 17 aa, Staphylococcus aureus
TMFITKKGKQVKVNHLE

SEQ ID NO: 1680056 - protein, 27 aa, Staphylococcus aureus
TPAQVVLRWHLAHNRIIIPKSQTPKRI

SEQ ID NO: 1680057 - protein, 26 aa, Staphylococcus aureus
TRELARLYVYAHYKGLKSLYYTRNKL

SEQ ID NO: 1680058 - protein, 18 aa, Staphylococcus aureus
TTLFVYEKPKSTISEKFR

SEQ ID NO: 1680059 - protein, 19 aa, Staphylococcus aureus
TVDLCLDVLALPSGEYELV

SEQ ID NO: 1680060 - protein, 33 aa, Staphylococcus aureus
VATPDMMGEVGKLGRVLGPKGLMPNPKTGTVTM

SEQ ID NO: 1680061 - protein, 18 aa, Staphylococcus aureus
VDKSYRFNGIGSSALRQL

SEQ ID NO: 1680062 - protein, 25 aa, Staphylococcus aureus
VEAYKQNMFALLGKPGFEDLKKELE

SEQ ID NO: 1680063 - protein, 34 aa, Staphylococcus aureus
VGVKYTAPNFFLLERIRKAFPDKLILSGFDEMLV

SEQ ID NO: 1680064 - protein, 19 aa, Staphylococcus aureus
VIFTTTILERGFTMANLDV

SEQ ID NO: 1680065 - protein, 19 aa, Staphylococcus aureus
VILTVLHAGGKFGGGGYKV

SEQ ID NO: 1680066 - protein, 26 aa, Staphylococcus aureus
VKTVHKYLPLLHRYTELRKELLGLDD

SEQ ID NO: 1680067 - protein, 28 aa, Staphylococcus aureus
VLKDGRRAPFSSIYFLLTDDNISHFHRI

SEQ ID NO: 1680068 - protein, 21 aa, Staphylococcus aureus
VLKKQWLNEPLPDKMPELKVQ

SEQ ID NO: 1680069 - protein, 26 aa, Staphylococcus aureus
VLKNARTIFLFGFGASSLTIGDLFQK

SEQ ID NO: 1680070 - protein, 32 aa, Staphylococcus aureus
VLNEFYDMKLSNLYIYKLAVIANMKLQSLSSC

SEQ ID NO: 1680071 - protein, 19 aa, Staphylococcus aureus
VLTGVNWLIQENELICTAT

SEQ ID NO: 1680072 - protein, 29 aa, Staphylococcus aureus
VNADQFRQLFILPQGEFKRFLISNSREKQ

SEQ ID NO: 1680073 - protein, 31 aa, Staphylococcus aureus
VPLFNGRHELLDSVFLWQSGQKYRIPVHDAD

SEQ ID NO: 1680074 - protein, 17 aa, Staphylococcus aureus
VPMLDILKKLDVHNACV

SEQ ID NO: 1680075 - protein, 23 aa, Staphylococcus aureus
VQEVRAWTFKQGMTAPQCAGIIH

SEQ ID NO: 1680076 - protein, 21 aa, Staphylococcus aureus
VQNFLNAYVDFAPMPNARQTK

SEQ ID NO: 1680077 - protein, 22 aa, Staphylococcus aureus
VQRYETLFKAYKALHDIHGYKK

SEQ ID NO: 1680078 - protein, 18 aa, Staphylococcus aureus
VRITHLPTGVIATSSEKS

SEQ ID NO: 1680079 - protein, 26 aa, Staphylococcus aureus
VRPERRTTLGLRWLVNYARLRGEKTM

SEQ ID NO: 1680080 - protein, 23 aa, Staphylococcus aureus
VSEEQLFYLMSRGISEEEATEMI

SEQ ID NO: 1680081 - protein, 35 aa, Staphylococcus aureus
VSKMRASILVMGPLLARLGHAIVALPGGCAIGSRP

SEQ ID NO: 1680082 - protein, 18 aa, Staphylococcus aureus
VVTVLPSNGERYLSTPLY

SEQ ID NO: 1680083 - protein, 24 aa, Staphylococcus aureus
VWKSKQAFTDWLKSDVFKAAHKHV

SEQ ID NO: 1680084 - protein, 26 aa, Staphylococcus aureus
WSRIPHFYMNYYVYQYATGYSAAQSL

SEQ ID NO: 1680085 - protein, 22 aa, Staphylococcus aureus
WVNQAQLLTSKKMLYIANVGED

SEQ ID NO: 1680086 - protein, 19 aa, Staphylococcus aureus
YALNFVGLGLIVQNAENVQ

SEQ ID NO: 1680087 - protein, 27 aa, Staphylococcus aureus
YDALSAVTPFYYPFTFEEIRDYYFDII

SEQ ID NO: 1680088 - protein, 26 aa, Staphylococcus aureus
YDEYDEGYILNWLVSKSNEYDMEPLI

SEQ ID NO: 1680089 - protein, 22 aa, Staphylococcus aureus
YGVPRIVFVNKMDKLGANFEYS

SEQ ID NO: 1680090 - protein, 31 aa, Staphylococcus aureus
YHATKHLNKPFFIGIMPIASYKNALFLHNEV

SEQ ID NO: 1680091 - protein, 20 aa, Staphylococcus aureus
YHQVIFLDTTTNFKFLSGST

SEQ ID NO: 1680092 - protein, 17 aa, Staphylococcus aureus
YIEVWGKFTPRGGISID

SEQ ID NO: 1680093 - protein, 18 aa, Staphylococcus aureus
YLEHMKLYRSFREEVPEE

SEQ ID NO: 1680094 - protein, 26 aa, Staphylococcus aureus
YLKAEKGVHRLVRISPFDSSGRRHTS

SEQ ID NO: 1680095 - protein, 23 aa, Staphylococcus aureus
YLNRYRILQSLQLLDRHYKHYEI

SEQ ID NO: 1680096 - protein, 19 aa, Staphylococcus aureus
YLQTWHGTPLKKIGLDISN

SEQ ID NO: 1680097 - protein, 28 aa, Staphylococcus aureus
YNGKRPVYFTALLFNKLTSNILYSDDTC

SEQ ID NO: 1680098 - protein, 18 aa, Staphylococcus aureus
YTHARFYTRAMTRKELDI

SEQ ID NO: 1680099 - protein, 20 aa, Staphylococcus aureus
YTLVSLLTKGGEEASLSIAD

SEQ ID NO: 1680100 - protein, 27 aa, Staphylococcus aureus
YVVENGYLFVFVIDYYRHHLVDQHAET

SEQ ID NO: 1680101 - protein, 26 aa, Staphylococcus aureus
AATTAKLMILAFEKFEKLPLDTLKQL

SEQ ID NO: 1680102 - protein, 20 aa, Staphylococcus aureus
ADRLYFLKQHTLVTELKYDE

SEQ ID NO: 1680103 - protein, 24 aa, Staphylococcus aureus
ADSIPINFLHPIKGTKFGSMDDLT

SEQ ID NO: 1680104 - protein, 24 aa, Staphylococcus aureus
ADVDVFLVAPKGPGHLVRRTFVEG

SEQ ID NO: 1680105 - protein, 19 aa, Staphylococcus aureus
ADYINIPYSILQPYQSECF

SEQ ID NO: 1680106 - protein, 23 aa, Staphylococcus aureus
AEDNAFFPSPYSLSQYTAPKTDF

SEQ ID NO: 1680107 - protein, 22 aa, Staphylococcus aureus
AEQYQCPVIVLSDLQLSLGKQT

SEQ ID NO: 1680108 - protein, 21 aa, Staphylococcus aureus
AGLFGINLRYPEGFEFEKAMD

SEQ ID NO: 1680109 - protein, 26 aa, Staphylococcus aureus
AGLHAVWSHLIAHKLYNQKKYVAARA

SEQ ID NO: 1680110 - protein, 33 aa, Staphylococcus aureus; identical to SEQ ID NO: 1646768

SEQ ID NO: 1680111 - protein, 19 aa, Staphylococcus aureus
AHLMAHAIKRLYGNVKFGV

SEQ ID NO: 1680112 - protein, 23 aa, Staphylococcus aureus
AHTNIALIKYWGKKDEALIIPMN

SEQ ID NO: 1680113 - protein, 23 aa, Staphylococcus aureus
AHYLFEHDGIARKILIASQPGNP

SEQ ID NO: 1680114 - protein, 26 aa, Staphylococcus aureus
AKDFNRPGHLFPLVAQDKGVLARNGH

SEQ ID NO: 1680115 - protein, 28 aa, Staphylococcus aureus
AKEQTALRKAYLESFRKGFKQQIENTKV

SEQ ID NO: 1680116 - protein, 27 aa, Staphylococcus aureus
AKGSTYYGIALALMRISKAILNNENNV

SEQ ID NO: 1680117 - protein, 17 aa, Staphylococcus aureus
AKMSGQVILLLDEIHRL

SEQ ID NO: 1680118 - protein, 25 aa, Staphylococcus aureus
AKTLMLTINLDNIAFMPCNPSVGGP

SEQ ID NO: 1680119 - protein, 26 aa, Staphylococcus aureus
ALGERALKYIIPDTADFPYTIRIVSE

SEQ ID NO: 1680120 - protein, 19 aa, Staphylococcus aureus
ALIKGAKIMALMGLELITN

SEQ ID NO: 1680121 - protein, 26 aa, Staphylococcus aureus
ALNSFNQPIIWLCGGLDRGNEFDELI

SEQ ID NO: 1680122 - protein, 25 aa, Staphylococcus aureus
AMELKDILKYIGPKTLLIVGNREDV

SEQ ID NO: 1680123 - protein, 25 aa, Staphylococcus aureus
AMSQGMIGYWLETEINRILTEMNSD

SEQ ID NO: 1680124 - protein, 23 aa, Staphylococcus aureus
AMTTFERYFIADKASHKEEKNPY

SEQ ID NO: 1680125 - protein, 17 aa, Staphylococcus aureus
AMVFGQMNEPPGARMRV

SEQ ID NO: 1680126 - protein, 18 aa, Staphylococcus aureus
AMVRFDSLVEMDYYRHGG

SEQ ID NO: 1680127 - protein, 22 aa, Staphylococcus aureus
ANDPIPEMYYLDVASPGAERPI

SEQ ID NO: 1680128 - protein, 17 aa, Staphylococcus aureus
ANGFVCYMIGRLILENC

SEQ ID NO: 1680129 - protein, 17 aa, Staphylococcus aureus
ANLDLNITKARAQVVKA

SEQ ID NO: 1680130 - protein, 20 aa, Staphylococcus aureus
ANRHHLKCKIFAPYGFSEEK

SEQ ID NO: 1680131 - protein, 24 aa, Staphylococcus aureus
APGMKYKHYSPNTPLTIITDIESK

SEQ ID NO: 1680132 - protein, 30 aa, Staphylococcus aureus
APGPLSHSLTLYALLFALSSGRTFIGQTTF

SEQ ID NO: 1680133 - protein, 36 aa, Staphylococcus aureus
ARVTSVFLETFLFFSGFYYPLYLAGQGKMTTSGEII

SEQ ID NO: 1680134 - protein, 23 aa, Staphylococcus aureus
ASDVIELPYGAVPIDFAYAIHSE

SEQ ID NO: 1680135 - protein, 29 aa, Staphylococcus aureus
ASGLPSYVYTFLGFLPRKEKEKSAVLEQR

SEQ ID NO: 1680136 - protein, 24 aa, Staphylococcus aureus
ASHALHYDVLPDRLVTVFAGQDKE

SEQ ID NO: 1680137 - protein, 18 aa, Staphylococcus aureus
ASRILGMGDVLSLIEKAQ

SEQ ID NO: 1680138 - protein, 21 aa, Staphylococcus aureus
ASRREHLVLKVIPALKEGKVV

SEQ ID NO: 1680139 - protein, 17 aa, Staphylococcus aureus
ATEYLEKEKKIPRAVLI

SEQ ID NO: 1680140 - protein, 19 aa, Staphylococcus aureus
ATPFLLGKIVEKTNGKSLA

SEQ ID NO: 1680141 - protein, 36 aa, Staphylococcus aureus
ATQSLKWAVEEMERRYKLFAHYHVRNITAFNKKAPY

SEQ ID NO: 1680142 - protein, 18 aa, Staphylococcus aureus
AVKKVFVDLYNKGIIYRG

SEQ ID NO: 1680143 - protein, 23 aa, Staphylococcus aureus
AVNRELPYHLAIKNLKQLDENFG

SEQ ID NO: 1680144 - protein, 29 aa, Staphylococcus aureus
AVRAGHHCAQPLMKWLNVSSTARASFYIY

SEQ ID NO: 1680145 - protein, 20 aa, Staphylococcus aureus
AVSLKYVDGYFVQGLTRGDG

SEQ ID NO: 1680146 - protein, 24 aa, Staphylococcus aureus
AYAQNLMLLLYEAGIGTCWKSPLY

SEQ ID NO: 1680147 - protein, 26 aa, Staphylococcus aureus
AYTEDVYDFWRPTGHKYPLVDGALSK

SEQ ID NO: 1680148 - protein, 20 aa, Staphylococcus aureus
CDVFIIQPTSYPVNLHLMEL

SEQ ID NO: 1680149 - protein, 17 aa, Staphylococcus aureus
CFNCDHHIALTAYKRIE

SEQ ID NO: 1680150 - protein, 20 aa, Staphylococcus aureus
CLNFYELIQSLIKEQEFLEI

SEQ ID NO: 1680151 - protein, 34 aa, Staphylococcus aureus
CMEELKMMINIMKPEYFIPVQGEFKMQIAHAKLA

SEQ ID NO: 1680152 - protein, 17 aa, Staphylococcus aureus
CNKQALYRTLSISLSQF

SEQ ID NO: 1680153 - protein, 26 aa, Staphylococcus aureus
CYAILGLVHTLWKPMPGRFKDYIAMP

SEQ ID NO: 1680154 - protein, 25 aa, Staphylococcus aureus
CYTNYTIPPYYDSMVAKLIIHEPTR

SEQ ID NO: 1680155 - protein, 24 aa, Staphylococcus aureus
DAAKPVVHVFIATSPIHLEHKLKM

SEQ ID NO: 1680156 - protein, 31 aa, Staphylococcus aureus
DAEDIRFGIKENVDFIAASFVRRPSDVLEIR

SEQ ID NO: 1680157 - protein, 18 aa, Staphylococcus aureus
DAIALILAGAIDSPLEIL

SEQ ID NO: 1680158 - protein, 20 aa, Staphylococcus aureus
DDIHNVFMYFAGLADKDGGE

SEQ ID NO: 1680159 - protein, 25 aa, Staphylococcus aureus
DDNAQVRVLPYASITTRQLGKELVD

SEQ ID NO: 1680160 - protein, 23 aa, Staphylococcus aureus
DDTTFVVINSTCGCAAGLARPAA

SEQ ID NO: 1680161 - protein, 23 aa, Staphylococcus aureus
DDYSEFILNPIYEQQFNAWRDVE

SEQ ID NO: 1680162 - protein, 22 aa, Staphylococcus aureus
DEAHLLYQSFLKSKEKYDEVMR

SEQ ID NO: 1680163 - protein, 26 aa, Staphylococcus aureus
DEEIRNTIRILSRKTKNNPVLIGEPG

SEQ ID NO: 1680164 - protein, 30 aa, Staphylococcus aureus
DEIIIPGPIYAGYIPLIEVLGGKPIYIDTT

SEQ ID NO: 1680165 - protein, 23 aa, Staphylococcus aureus
DELKNRRATLVNLQRIDKVSAKR

SEQ ID NO: 1680166 - protein, 26 aa, Staphylococcus aureus
DESAKKYLWRVLVTQLKKLELNYDVY

SEQ ID NO: 1680167 - protein, 18 aa, Staphylococcus aureus
DGDPWFVVGKNLKDNVLY

SEQ ID NO: 1680168 - protein, 32 aa, Staphylococcus aureus
DGIPNTFVPARNLLFLSFAGALAYQIGAKHII

SEQ ID NO: 1680169 - protein, 24 aa, Staphylococcus aureus
DGNRPIGSFLFVGPTGVGKTELAK

SEQ ID NO: 1680170 - protein, 23 aa, Staphylococcus aureus
DGRTWITREPAIVYFHSEYWFNV

SEQ ID NO: 1680171 - protein, 28 aa, Staphylococcus aureus
DGTVKNFRVTKIFGYFGLKRLEIEEAQA

SEQ ID NO: 1680172 - protein, 24 aa, Staphylococcus aureus
DHHSRRGLLKMVGRRRHLLNYLRS

SEQ ID NO: 1680173 - protein, 22 aa, Staphylococcus aureus
DHPLYEYAPLTKGDTGLLTQWT

SEQ ID NO: 1680174 - protein, 32 aa, Staphylococcus aureus
DHPQWETFVDAFNFVCTFLAKAIARDGEGATK

SEQ ID NO: 1680175 - protein, 23 aa, Staphylococcus aureus
DHYIVRQGLRFLLSTIENIEVLQ

SEQ ID NO: 1680176 - protein, 34 aa, Staphylococcus aureus
DIEHFEILPDILQEYLLYVRYTAILIDPFSQPDE

SEQ ID NO: 1680177 - protein, 24 aa, Staphylococcus aureus
DIESTWAGIRPLIYEEGKDPSEIS

SEQ ID NO: 1680178 - protein, 18 aa, Staphylococcus aureus
DIIDYAYTIGIDSIGFTT

SEQ ID NO: 1680179 - protein, 24 aa, Staphylococcus aureus
DIKELQLIKVPIPSGQYVYSLPND

SEQ ID NO: 1680180 - protein, 17 aa, Staphylococcus aureus
DIQWGNHDVLWVGAYAG

SEQ ID NO: 1680181 - protein, 18 aa, Staphylococcus aureus
DIWNVNTVIVPVGGGGLI

SEQ ID NO: 1680182 - protein, 27 aa, Staphylococcus aureus
DKDFVIHTPLMWLNKAETWKLSDELEV

SEQ ID NO: 1680183 - protein, 17 aa, Staphylococcus aureus
DKIYWERVQLFVEGHSE

SEQ ID NO: 1680184 - protein, 30 aa, Staphylococcus aureus
DKMVAELERPYILVTDKKISSFQDILPLLE

SEQ ID NO: 1680185 - protein, 32 aa, Staphylococcus aureus
DKRVSPDLFIKRLNFYDYLLLNSDGLTDYVKD

SEQ ID NO: 1680186 - protein, 19 aa, Staphylococcus aureus
DLERIFNVERLLMDYLSAL

SEQ ID NO: 1680187 - protein, 27 aa, Staphylococcus aureus
DLKEKVDPYLRPLYDGLYTVLGREQTE

SEQ ID NO: 1680188 - protein, 25 aa, Staphylococcus aureus
DLLQAISKIAIPRVRFTTSHPWDFT

SEQ ID NO: 1680189 - protein, 18 aa, Staphylococcus aureus
DLPQFTPEIFMKVSAKNV

SEQ ID NO: 1680190 - protein, 28 aa, Staphylococcus aureus
DLTEKRMILEKILPILSDREREIIQCTF

SEQ ID NO: 1680191 - protein, 17 aa, Staphylococcus aureus
DMAFLSGVVSRKKQIVP

SEQ ID NO: 1680192 - protein, 23 aa, Staphylococcus aureus
DMVDRILFNNSLKYYMNEHPAVT

SEQ ID NO: 1680193 - protein, 19 aa, Staphylococcus aureus
DNIILAPKLLKKDNNDELH

SEQ ID NO: 1680194 - protein, 20 aa, Staphylococcus aureus
DNRYQLIRREAVSHGLSGLE

SEQ ID NO: 1680195 - protein, 18 aa, Staphylococcus aureus
DPDQLYYLMSRGISQREA

SEQ ID NO: 1680196 - protein, 23 aa, Staphylococcus aureus
DQERFLMYAHFQDPKYRILDYVN

SEQ ID NO: 1680197 - protein, 24 aa, Staphylococcus aureus
DRVDHRYVYVNLGRIEAVLSEAER

SEQ ID NO: 1680198 - protein, 25 aa, Staphylococcus aureus
DSEAKIYEHFNVNFIPPAMREDGSE

SEQ ID NO: 1680199 - protein, 17 aa, Staphylococcus aureus
DSHYRLYGIFLLDQLNG

SEQ ID NO: 1680200 - protein, 17 aa, Staphylococcus aureus
DSMFNNFIQSFNPSDIR

SEQ ID NO: 1680201 - protein, 24 aa, Staphylococcus aureus
DTDMPHVVFFTFNQPDEWDSPFNI

SEQ ID NO: 1680202 - protein, 20 aa, Staphylococcus aureus
DTFFLLVQRGRKESFYAAEI

SEQ ID NO: 1680203 - protein, 24 aa, Staphylococcus aureus
DTNAIIVYTLIKPEMKQYMSEKVA

SEQ ID NO: 1680204 - protein, 23 aa, Staphylococcus aureus
DTSVAVQWLIDKGYDVVACCLDV

SEQ ID NO: 1680205 - protein, 25 aa, Staphylococcus aureus
DTTLEPMVLPSRFPNLLVNGSTGIS

SEQ ID NO: 1680206 - protein, 26 aa, Staphylococcus aureus
DVDTLSPTYKLLMGVPGRSNAFDISK

SEQ ID NO: 1680207 - protein, 25 aa, Staphylococcus aureus
DVMISGLGFITIGPGAKVIVRVPKN

SEQ ID NO: 1680208 - protein, 26 aa, Staphylococcus aureus
DVMVEPFYEWVVEKDAWYGPELNHIK

SEQ ID NO: 1680209 - protein, 26 aa, Staphylococcus aureus
DVQGIKIHLLHLLKGTPMVKQYDKGL

SEQ ID NO: 1680210 - protein, 24 aa, Staphylococcus aureus
DVYIRYLRNKLKPYDRDKMIETVR

SEQ ID NO: 1680211 - protein, 33 aa, Staphylococcus aureus
DYRLKGIAFELLAYALQYAFDNFDIRKVYFKIR

SEQ ID NO: 1680212 - protein, 23 aa, Staphylococcus aureus
DYSKYFEHVYQPPNLKEAKKRGK

SEQ ID NO: 1680213 - protein, 20 aa, Staphylococcus aureus
EADRLRFDFSHFGPMTNDEI

SEQ ID NO: 1680214 - protein, 21 aa, Staphylococcus aureus
EAEVPIIVAVNKIDKPTSNPD

SEQ ID NO: 1680215 - protein, 30 aa, Staphylococcus aureus
EAFIGALYLDQGLDIVWKFAEKVIFPHVEQ

SEQ ID NO: 1680216 - protein, 26 aa, Staphylococcus aureus
EAGRTKKPILLKRGLSATIEEFVYAA

SEQ ID NO: 1680217 - protein, 19 aa, Staphylococcus aureus
EALNFLCAYTTKHQIKLVI

SEQ ID NO: 1680218 - protein, 27 aa, Staphylococcus aureus
EATTNSAFLIYLFAKDLPNHDELMTQT

SEQ ID NO: 1680219 - protein, 19 aa, Staphylococcus aureus
EAYNIWHKDIGLEESRIIR

SEQ ID NO: 1680220 - protein, 24 aa, Staphylococcus aureus
ECHFKIRVICGKGTYIRTLATDIG

SEQ ID NO: 1680221 - protein, 17 aa, Staphylococcus aureus
ECYGIVGMASRQQVRDG

SEQ ID NO: 1680222 - protein, 18 aa, Staphylococcus aureus
EDDLAMIFVVINQHSKKV

SEQ ID NO: 1680223 - protein, 23 aa, Staphylococcus aureus
EDQEHILFIINNMSYRNGKNDHV

SEQ ID NO: 1680224 - protein, 23 aa, Staphylococcus aureus
EDVSTIIMNIKQLALKIYSEEDK

SEQ ID NO: 1680225 - protein, 25 aa, Staphylococcus aureus
EEEKRFMHHYNFPNFSVGETGPVRA

SEQ ID NO: 1680226 - protein, 25 aa, Staphylococcus aureus
EEGKAFYRLTLVINSETLISPQDLL

SEQ ID NO: 1680227 - protein, 22 aa, Staphylococcus aureus
EEILRKVWELSGKTAERLNKLQ

SEQ ID NO: 1680228 - protein, 29 aa, Staphylococcus aureus
EEIYFPDFEDYILLWKLEVLPKYQNRGYA

SEQ ID NO: 1680229 - protein, 26 aa, Staphylococcus aureus
EEMRKLFPENEKLLRWLDLAEEKISY

SEQ ID NO: 1680230 - protein, 25 aa, Staphylococcus aureus
EENGKFNMIFQFEHLGLWNSGDSHF

SEQ ID NO: 1680231 - protein, 21 aa, Staphylococcus aureus
EERHLLGQMMNQVHQQQQELK

SEQ ID NO: 1680232 - protein, 24 aa, Staphylococcus aureus
EETQTLIHLPFDYVFFTGSENVGK

SEQ ID NO: 1680233 - protein, 24 aa, Staphylococcus aureus
EGAALAMSILDHVRKIGSLVMATT

SEQ ID NO: 1680234 - protein, 24 aa, Staphylococcus aureus
EGCHAQLIELPFTATAKELGTALM

SEQ ID NO: 1680235 - protein, 19 aa, Staphylococcus aureus
EGFLLAQDISSYSLTIVAH

SEQ ID NO: 1680236 - protein, 23 aa, Staphylococcus aureus
EGGFTTYWPTNEVMPIFDAAMKY

SEQ ID NO: 1680237 - protein, 19 aa, Staphylococcus aureus
EGLAIKASKFPYAANGRAL

SEQ ID NO: 1680238 - protein, 21 aa, Staphylococcus aureus
EGMKVKSFKVPFKAIGKAVID

SEQ ID NO: 1680239 - protein, 26 aa, Staphylococcus aureus
EGTMPQTRFVLKKALEQNLKPVVVVN

SEQ ID NO: 1680240 - protein, 21 aa, Staphylococcus aureus
EHMLFYFAYKTFITTADEIIE

SEQ ID NO: 1680241 - protein, 24 aa, Staphylococcus aureus
EHVMNLLMHVDQVSYVRFASVYKE

SEQ ID NO: 1680242 - protein, 19 aa, Staphylococcus aureus
EIIQCTFIEGLSQKETGER

SEQ ID NO: 1680243 - protein, 20 aa, Staphylococcus aureus
EIKIPRYFFLAETEEFEPGN

SEQ ID NO: 1680244 - protein, 17 aa, Staphylococcus aureus
EILVRKKMKLKKNNIYI

SEQ ID NO: 1680245 - protein, 22 aa, Staphylococcus aureus
EINLMQFIKKLDKNMDFLDIDK

SEQ ID NO: 1680246 - protein, 17 aa, Staphylococcus aureus
EIQFLYVAPERFENRYF

SEQ ID NO: 1680247 - protein, 25 aa, Staphylococcus aureus
EKAAMLLIPEPWLYNEANDANVRAF

SEQ ID NO: 1680248 - protein, 24 aa, Staphylococcus aureus
EKANPQILTLLLQVMDDGNLTDGQ

SEQ ID NO: 1680249 - protein, 21 aa, Staphylococcus aureus
EKEEALKPFILLVVDRKEEGL

SEQ ID NO: 1680250 - protein, 22 aa, Staphylococcus aureus
EKHAVSRLIGAPPGYIGHDEGG

SEQ ID NO: 1680251 - protein, 23 aa, Staphylococcus aureus
EKKIPRAVLIDAIEAALITAYKK

SEQ ID NO: 1680252 - protein, 23 aa, Staphylococcus aureus
EKVQLIGFGNFEVRERAARKGRN

SEQ ID NO: 1680253 - protein, 20 aa, Staphylococcus aureus
ELAQIRILSPNDDYFYQSIV

SEQ ID NO: 1680254 - protein, 18 aa, Staphylococcus aureus
ELELFTNSQLVGAGLPLW

SEQ ID NO: 1680255 - protein, 23 aa, Staphylococcus aureus
ELKEQMLTQIPLARFGQDTDIAN

SEQ ID NO: 1680256 - protein, 23 aa, Staphylococcus aureus
ELLARIRAILRRQPQKDIIDVNG

SEQ ID NO: 1680257 - protein, 18 aa, Staphylococcus aureus
ELNLIKRLIQVQNQFKTF

SEQ ID NO: 1680258 - protein, 27 aa, Staphylococcus aureus
ELNVYKPVIMHNTLQSIYLLADGMETF

SEQ ID NO: 1680259 - protein, 29 aa, Staphylococcus aureus
ELPNLEEELKILLIPKDPNDDKDVIVEIR

SEQ ID NO: 1680260 - protein, 35 aa, Staphylococcus aureus
ELSYLNLPEEMNPFLGYRAIRLCLAQQDIFRPQLR

SEQ ID NO: 1680261 - protein, 25 aa, Staphylococcus aureus
ELTPELAFKLGRYGGYVLAHNKGEK

SEQ ID NO: 1680262 - protein, 24 aa, Staphylococcus aureus
ELTPKEFELLLYLIERQGRVITRE

SEQ ID NO: 1680263 - protein, 18 aa, Staphylococcus aureus
ENAYIMPHNMREMLRSYL

SEQ ID NO: 1680264 - protein, 19 aa, Staphylococcus aureus
ENHFFGRVGLFRNQVGDEL

SEQ ID NO: 1680265 - protein, 23 aa, Staphylococcus aureus
ENHRKLFIAIAKDVRVILVKLAD

SEQ ID NO: 1680266 - protein, 24 aa, Staphylococcus aureus
ENTPNLLAVLKEVGVVDSGGKGLL

SEQ ID NO: 1680267 - protein, 25 aa, Staphylococcus aureus
EPHERLFALLIKKDGKQVLFCPKME

SEQ ID NO: 1680268 - protein, 25 aa, Staphylococcus aureus
EQAEAIVMLQLYRLTNTDIVALEGE

SEQ ID NO: 1680269 - protein, 33 aa, Staphylococcus aureus
EQAQEQFGFLLDAFKYGAPPHGGIALGLDRLVM

SEQ ID NO: 1680270 - protein, 25 aa, Staphylococcus aureus
EQLLDIRVVITRPANDPALFESTVK

SEQ ID NO: 1680271 - protein, 26 aa, Staphylococcus aureus
EQMNEFERMILLRSIDSHWTDHIDTM

SEQ ID NO: 1680272 - protein, 27 aa, Staphylococcus aureus
EQQRHRLMLLQQRYNLKALLSSVNQEQ

SEQ ID NO: 1680273 - protein, 27 aa, Staphylococcus aureus
EQRISNFLIWQVSYSEFIFNQKLWPDF

SEQ ID NO: 1680274 - protein, 23 aa, Staphylococcus aureus
EQRKIEFLAGRFATKEAFSKALG

SEQ ID NO: 1680275 - protein, 23 aa, Staphylococcus aureus
EQTETFLRGFLGRMLFSGEEVKK

SEQ ID NO: 1680276 - protein, 23 aa, Staphylococcus aureus
EREDLGLLVDFLAELFKEEGHKL

SEQ ID NO: 1680277 - protein, 27 aa, Staphylococcus aureus
ERELGFLALHGFLHLLGYDHMTEADEK

SEQ ID NO: 1680278 - protein, 26 aa, Staphylococcus aureus
ERFENRYFLNMLQRIKIHLVAFDEAH

SEQ ID NO: 1680279 - protein, 19 aa, Staphylococcus aureus
ERGHDVFLDLKLHDIPNTV

SEQ ID NO: 1680280 - protein, 19 aa, Staphylococcus aureus
ERINAIAKRTPYLSKIAPS

SEQ ID NO: 1680281 - protein, 22 aa, Staphylococcus aureus
ESKETLDYFIDTLISIAEEAKN

SEQ ID NO: 1680282 - protein, 18 aa, Staphylococcus aureus
ESYSVIIQVLRGESTDYI

SEQ ID NO: 1680283 - protein, 28 aa, Staphylococcus aureus
ETAGPLCYRAEPVGCTATILYKMFRERG

SEQ ID NO: 1680284 - protein, 24 aa, Staphylococcus aureus
ETTPGGRALKFYSSVRLEVRRAEQ

SEQ ID NO: 1680285 - protein, 19 aa, Staphylococcus aureus
EVDLTLPLVVRLEGTNVEL

SEQ ID NO: 1680286 - protein, 26 aa, Staphylococcus aureus
EVDMTIKEFILLTYLFHQQENTLPFK

SEQ ID NO: 1680287 - protein, 27 aa, Staphylococcus aureus
EVDYPNLMFHFLPIAVRYDGQKAAVAH

SEQ ID NO: 1680288 - protein, 23 aa, Staphylococcus aureus
EVLDPSLPIDLIIDYAHTADGMN

SEQ ID NO: 1680289 - protein, 24 aa, Staphylococcus aureus
EVNAKLMVDMAHIAGLVAAGLHPN

SEQ ID NO: 1680290 - protein, 22 aa, Staphylococcus aureus
EVYKTLPFDFLSDIVYQWERFA

SEQ ID NO: 1680291 - protein, 23 aa, Staphylococcus aureus
EWDSPFNIYKPHSGFTLETQFLP

SEQ ID NO: 1680292 - protein, 32 aa, Staphylococcus aureus
EWRYQDVPTKLWPIQPLRDFWGINRRTEAKLN

SEQ ID NO: 1680293 - protein, 27 aa, Staphylococcus aureus
EYGNTVYIYRWPNLFGKWCKPNYNSVI

SEQ ID NO: 1680294 - protein, 29 aa, Staphylococcus aureus
EYMDDKYPFYLDPMPNLYFTRDPQASIGH

SEQ ID NO: 1680295 - protein, 25 aa, Staphylococcus aureus
FADKAAARFGSGWAWLVVNNGQLEI

SEQ ID NO: 1680296 - protein, 19 aa, Staphylococcus aureus
FCVDNLPPVLLPKFVELME

SEQ ID NO: 1680297 - protein, 17 aa, Staphylococcus aureus
FDAAMKYKEDGTGLVVL

SEQ ID NO: 1680298 - protein, 25 aa, Staphylococcus aureus
FERNYERYQFLNWATKAFDNYNAVP

SEQ ID NO: 1680299 - protein, 30 aa, Staphylococcus aureus
FETTEYILDQLPCWLTYTNAETHKVIDDNL

SEQ ID NO: 1680300 - protein, 17 aa, Staphylococcus aureus
FGSPKSIIPKKLAHEIN

SEQ ID NO: 1680301 - protein, 19 aa, Staphylococcus aureus
FIQYIVKHHPRFKDANIPI

SEQ ID NO: 1680302 - protein, 18 aa, Staphylococcus aureus
FKATVDSMLFRGVHYEIC

SEQ ID NO: 1680303 - protein, 17 aa, Staphylococcus aureus
FKDDIIDIVRRVQGGQF

SEQ ID NO: 1680304 - protein, 20 aa, Staphylococcus aureus
FLHEIRVDRIIFGDPAVVMY

SEQ ID NO: 1680305 - protein, 24 aa, Staphylococcus aureus
FMGPYMMHWFMINYCFDNGYDRYN

SEQ ID NO: 1680306 - protein, 17 aa, Staphylococcus aureus
FNQKIRKDILIVQDIMT

SEQ ID NO: 1680307 - protein, 22 aa, Staphylococcus aureus
FQFDETFMMYLPRLCEHCLNPS

SEQ ID NO: 1680308 - protein, 17 aa, Staphylococcus aureus
FQVALLDYNDYVGRIGI

SEQ ID NO: 1680309 - protein, 23 aa, Staphylococcus aureus
FSHFSNQLYPPHVSTLYVDDGPD

SEQ ID NO: 1680310 - protein, 21 aa, Staphylococcus aureus
FSYAFDLLPEDQRKAVWAIYA

SEQ ID NO: 1680311 - protein, 17 aa, Staphylococcus aureus
FTTFEHIEVSQLIVVKK

SEQ ID NO: 1680312 - protein, 28 aa, Staphylococcus aureus
FVETSGWTNIFIYPGFDFKAIDGQITNF

SEQ ID NO: 1680313 - protein, 27 aa, Staphylococcus aureus
FYQPKPGTDLAWLSAVTKYIIDHDLHD

SEQ ID NO: 1680314 - protein, 24 aa, Staphylococcus aureus
FYSTKHHFIALAHAGWRGTYTEIV

SEQ ID NO: 1680315 - protein, 29 aa, Staphylococcus aureus
GATLSPIDSYLLLRGLKTLHLRIERAQSN

SEQ ID NO: 1680316 - protein, 25 aa, Staphylococcus aureus
GAVLPLYDTFYDGKIKHILARHEQG

SEQ ID NO: 1680317 - protein, 25 aa, Staphylococcus aureus
GCDETFIQTLLTLEPKRIVYISCNP

SEQ ID NO: 1680318 - protein, 20 aa, Staphylococcus aureus
GCDKFCTYCIVPFTRGKERS

SEQ ID NO: 1680319 - protein, 28 aa, Staphylococcus aureus
GCNNFCTFCIIPWARGLMRSRDPEKVVE

SEQ ID NO: 1680320 - protein, 24 aa, Staphylococcus aureus
GDLAKYPYKFLKKEFGILGVDMHL

SEQ ID NO: 1680321 - protein, 23 aa, Staphylococcus aureus
GDLSHRKLFPSIFHLYQQDNLDE

SEQ ID NO: 1680322 - protein, 23 aa, Staphylococcus aureus
GDMHYDVMSAFQKSIRGSDVNAA

SEQ ID NO: 1680323 - protein, 25 aa, Staphylococcus aureus
GDYNRIRIMELLSVSEASVGHISHQ

SEQ ID NO: 1680324 - protein, 25 aa, Staphylococcus aureus
GEEIMLLRHMILSHHGKLEYGSPKL

SEQ ID NO: 1680325 - protein, 23 aa, Staphylococcus aureus
GELHLLNKCLSSKAGTGCYVSIS

SEQ ID NO: 1680326 - protein, 20 aa, Staphylococcus aureus
GFGRIGRLAFRRIQEVEGLE

SEQ ID NO: 1680327 - protein, 19 aa, Staphylococcus aureus
GFHIIIAGSFSDIFYMNCT

SEQ ID NO: 1680328 - protein, 32 aa, Staphylococcus aureus
GHPGLPMGAAPMAYTLWTRHLNFNPQSKDYFN

SEQ ID NO: 1680329 - protein, 24 aa, Staphylococcus aureus
GIAMGHIGMRYSLPSREIIADAAE

SEQ ID NO: 1680330 - protein, 28 aa, Staphylococcus aureus
GIKCVMIAKLPFMNKHNAKYWLMDSEFT

SEQ ID NO: 1680331 - protein, 25 aa, Staphylococcus aureus
GKADYIFVDDFHPLIYTVRFRRSQE

SEQ ID NO: 1680332 - protein, 24 aa, Staphylococcus aureus
GKGLLCVYEGFLKALKGEKVEAKV

SEQ ID NO: 1680333 - protein, 23 aa, Staphylococcus aureus
GKKVKLNMILNAKSGICPENCGY

SEQ ID NO: 1680334 - protein, 21 aa, Staphylococcus aureus
GKNVWFGVREFAMGAAVNGMA

SEQ ID NO: 1680335 - protein, 24 aa, Staphylococcus aureus
GKPFYNDLISFITSAPVFAMVVEG

SEQ ID NO: 1680336 - protein, 23 aa, Staphylococcus aureus
GKSTLLRCMNLLEVPTKGQVIFE

SEQ ID NO: 1680337 - protein, 24 aa, Staphylococcus aureus
GKVLTYEMILKRIYGYVNKTEMPS

SEQ ID NO: 1680338 - protein, 18 aa, Staphylococcus aureus
GLEELGVKFADRGLLEVD

SEQ ID NO: 1680339 - protein, 18 aa, Staphylococcus aureus
GLEKGYFARPTIFINVDN

SEQ ID NO: 1680340 - protein, 36 aa, Staphylococcus aureus
GLLNDPNGLIFYKGKYYVSHQWFPLGAVHGLKYWYN

SEQ ID NO: 1680341 - protein, 25 aa, Staphylococcus aureus
GLQARLMSQALRKLSGAISKSNTTA

SEQ ID NO: 1680342 - protein, 23 aa, Staphylococcus aureus
GLRVGIIRDWEAKWYAEKDFASL

SEQ ID NO: 1680343 - protein, 22 aa, Staphylococcus aureus
GLSQMHVSRLQRTAIKKLQEAA

SEQ ID NO: 1680344 - protein, 18 aa, Staphylococcus aureus
GMEVTVLHLAEWLMEMQL

SEQ ID NO: 1680345 - protein, 20 aa, Staphylococcus aureus
GMKHHVLDMSLLSQLTPNAL

SEQ ID NO: 1680346 - protein, 28 aa, Staphylococcus aureus
GMKQKVMIICAFIVNPELYIIDEPFLGL

SEQ ID NO: 1680347 - protein, 29 aa, Staphylococcus aureus
GMSRQHHRFLFFINKLPGITIKSLLEILE

SEQ ID NO: 1680348 - protein, 24 aa, Staphylococcus aureus
GMVKQWQDKFFNQRFSHSVFNGQP

SEQ ID NO: 1680349 - protein, 22 aa, Staphylococcus aureus
GNEEIFASRTLIDRLKEHDFEI

SEQ ID NO: 1680350 - protein, 24 aa, Staphylococcus aureus
GNLGIVIDAFGAGSFMVATKIKGM

SEQ ID NO: 1680351 - protein, 26 aa, Staphylococcus aureus
GQTESTLLIGFLKDTPQRIGSMGKGI

SEQ ID NO: 1680352 - protein, 24 aa, Staphylococcus aureus
GRRRHLLNYLRSKDIQRYRELIKS

SEQ ID NO: 1680353 - protein, 25 aa, Staphylococcus aureus
GSEEPIRLNPFYINVLLGISETCNQ

SEQ ID NO: 1680354 - protein, 20 aa, Staphylococcus aureus
GSGSVFMKPAAPGTGVIAGG

SEQ ID NO: 1680355 - protein, 24 aa, Staphylococcus aureus
GSIELDIIFKSQGPKRLLAQFAPI

SEQ ID NO: 1680356 - protein, 23 aa, Staphylococcus aureus
GTDLDLQLRRRGIDTIVLGGVAT

SEQ ID NO: 1680357 - protein, 28 aa, Staphylococcus aureus
GTILDSARFRLLLSEAFDVAPRSVDAQI

SEQ ID NO: 1680358 - protein, 27 aa, Staphylococcus aureus
GTVNTEHMLFIGAGAFHVSKPSDLIPE

SEQ ID NO: 1680359 - protein, 17 aa, Staphylococcus aureus
GVGLSLHEAPAHVLNYF

SEQ ID NO: 1680360 - protein, 17 aa, Staphylococcus aureus
GVRRIEALTGKAAFLYL

SEQ ID NO: 1680361 - protein, 24 aa, Staphylococcus aureus
GYGEYFPHRLGHGLGLQEHEYQDV

SEQ ID NO: 1680362 - protein, 30 aa, Staphylococcus aureus
GYLARIVGHKKAREIWYLCRQYNAQEALDM

SEQ ID NO: 1680363 - protein, 20 aa, Staphylococcus aureus
GYTLNVPLFVNEGDVLIINT

SEQ ID NO: 1680364 - protein, 21 aa, Staphylococcus aureus
HAMALAISNLLGLVCDPVAGL

SEQ ID NO: 1680365 - protein, 37 aa, Staphylococcus aureus
HDGEFYALPQSPQLFKQLLMISGFDKYYQIVKCFRDE

SEQ ID NO: 1680366 - protein, 32 aa, Staphylococcus aureus
HDHLDIPIDLLPYLFFQFAKDGKRLYSDNGVD

SEQ ID NO: 1680367 - protein, 26 aa, Staphylococcus aureus
HEVEEPDFLIVIYHGGLNKISNSTKN

SEQ ID NO: 1680368 - protein, 24 aa, Staphylococcus aureus
HHVVNFMHFIAQELREILASLGLK

SEQ ID NO: 1680369 - protein, 18 aa, Staphylococcus aureus
HIDFIDRQLIQECLGHLI

SEQ ID NO: 1680370 - protein, 17 aa, Staphylococcus aureus
HIINIAESVYFYLTGTH

SEQ ID NO: 1680371 - protein, 24 aa, Staphylococcus aureus
HKGPIHFNLPFRDPLTPDLNATEL

SEQ ID NO: 1680372 - protein, 27 aa, Staphylococcus aureus
HLEPEQLLKPLFQHFKEKYPEVISKID

SEQ ID NO: 1680373 - protein, 19 aa, Staphylococcus aureus
HLNHSLFWELLSPNSEEKG

SEQ ID NO: 1680374 - protein, 27 aa, Staphylococcus aureus
HLRENIKLFVVIGQLNQLIKGGRISKT

SEQ ID NO: 1680375 - protein, 19 aa, Staphylococcus aureus
HLRLEYYNESDLKEIIIRT

SEQ ID NO: 1680376 - protein, 24 aa, Staphylococcus aureus
HLSTDQIYKLIQKASQFKSGERQL

SEQ ID NO: 1680377 - protein, 21 aa, Staphylococcus aureus
HLVRRTFVEGSAVPSLFGIQQ

SEQ ID NO: 1680378 - protein, 23 aa, Staphylococcus aureus
HNKVYWFNEEYYGFGAGASGYVD

SEQ ID NO: 1680379 - protein, 28 aa, Staphylococcus aureus
HPALAPYKAAILPLSKKLSGEAIKIFEQ

SEQ ID NO: 1680380 - protein, 29 aa, Staphylococcus aureus
HPRFKDANIPIWLDRDCPFNIEGGDELVL

SEQ ID NO: 1680381 - protein, 18 aa, Staphylococcus aureus
HPVTYWVASMSEAQQTQI

SEQ ID NO: 1680382 - protein, 22 aa, Staphylococcus aureus
HRHERWFSICKKLEGLPRHTST

SEQ ID NO: 1680383 - protein, 24 aa, Staphylococcus aureus
HRVHKGLHMLTFEGINNINDIEHL

SEQ ID NO: 1680384 - protein, 25 aa, Staphylococcus aureus
HSDAGLLYISYLTHPTTGGVSASFA

SEQ ID NO: 1680385 - protein, 21 aa, Staphylococcus aureus
HSIVTLLKYNLETAGYEVVVA

SEQ ID NO: 1680386 - protein, 33 aa, Staphylococcus aureus
HTLTIITNCLPVYKILLEKQTAHFRVYLIGGEM

SEQ ID NO: 1680387 - protein, 19 aa, Staphylococcus aureus
HYETEAIWQLFKEANYERV

SEQ ID NO: 1680388 - protein, 18 aa, Staphylococcus aureus
IAEYSVSIALQLVRRFPD

SEQ ID NO: 1680389 - protein, 25 aa, Staphylococcus aureus
IAFHEPPINTFLPDSTYWKDKNDDI

SEQ ID NO: 1680390 - protein, 20 aa, Staphylococcus aureus
IAIDTFPEQQLLSLKVFVDT

SEQ ID NO: 1680391 - protein, 21 aa, Staphylococcus aureus
IALGLDRLVMLLTNRTNLRDT

SEQ ID NO: 1680392 - protein, 23 aa, Staphylococcus aureus
IALLTALTYPTIFSRVAMLSPHS

SEQ ID NO: 1680393 - protein, 17 aa, Staphylococcus aureus
IAVDGSHEAEWAFNRAV

SEQ ID NO: 1680394 - protein, 26 aa, Staphylococcus aureus
ICDIYPLLNKSLLYSGIILHDIGKVR

SEQ ID NO: 1680395 - protein, 31 aa, Staphylococcus aureus
IDEMSMVDTWLFHQFLSAVPLDAQLIFVGDE

SEQ ID NO: 1680396 - protein, 31 aa, Staphylococcus aureus
IDGNEYIDYVLSWGPLILGHRDPQVISHLHE

SEQ ID NO: 1680397 - protein, 25 aa, Staphylococcus aureus
IDIDELFDMFIYKNERLKLKMKEAF

SEQ ID NO: 1680398 - protein, 18 aa, Staphylococcus aureus
IDLKKQGTIGLITYMRTD

SEQ ID NO: 1680399 - protein, 18 aa, Staphylococcus aureus
IEGNDWEVLLKPAKRIKV

SEQ ID NO: 1680400 - protein, 24 aa, Staphylococcus aureus
IEHDLAILMIVGEGMNKVIGTANK

SEQ ID NO: 1680401 - protein, 21 aa, Staphylococcus aureus
IENIIDISYSFGKTIQTRDIS

SEQ ID NO: 1680402 - protein, 25 aa, Staphylococcus aureus
IEYDAIVPTQLWPTLETKMIKNLYT

SEQ ID NO: 1680403 - protein, 20 aa, Staphylococcus aureus
IFEQFVDCPVYVDNDANIAA

SEQ ID NO: 1680404 - protein, 19 aa, Staphylococcus aureus
IFITEKVANYIGYLCSIIS

SEQ ID NO: 1680405 - protein, 29 aa, Staphylococcus aureus
IFITHMHGDHIFGLPGLLSSRSFQGGEQK

SEQ ID NO: 1680406 - protein, 25 aa, Staphylococcus aureus
IGANYYRPKMPNTHPLFIGAIVDEI

SEQ ID NO: 1680407 - protein, 32 aa, Staphylococcus aureus
IGRVKPFYGNFGIYLRAYTYIRTMGATGLKEV

SEQ ID NO: 1680408 - protein, 25 aa, Staphylococcus aureus
IHGANHYLIHQFVSPYYNRRNDVWA

SEQ ID NO: 1680409 - protein, 28 aa, Staphylococcus aureus
IHNMTQIDYFFLHKFQNIIDIEHQLKEH

SEQ ID NO: 1680410 - protein, 30 aa, Staphylococcus aureus
IIELLKQLQLDFGITYLFITHDMGVINEIC

SEQ ID NO: 1680411 - protein, 18 aa, Staphylococcus aureus
IIIGGGMAYTFLKAQGKE

SEQ ID NO: 1680412 - protein, 26 aa, Staphylococcus aureus
IILQKYVHLLSEYGVWHPRAWEFAPS

SEQ ID NO: 1680413 - protein, 23 aa, Staphylococcus aureus
IKQPIDYFVAPVSTTGSIMGMSR

SEQ ID NO: 1680414 - protein, 18 aa, Staphylococcus aureus
ILDDCDHDYISGLSLLGG

SEQ ID NO: 1680415 - protein, 17 aa, Staphylococcus aureus
ILIGFMGTGKSTIGKYV

SEQ ID NO: 1680416 - protein, 20 aa, Staphylococcus aureus
ILYLLIHEQTFIPINTIANQ

SEQ ID NO: 1680417 - protein, 31 aa, Staphylococcus aureus
INNVHLIRANPNLVIMVIVFSSGHVEHVHLA

SEQ ID NO: 1680418 - protein, 19 aa, Staphylococcus aureus
INVEALKNIGLEPGPKYQE

SEQ ID NO: 1680419 - protein, 27 aa, Staphylococcus aureus
IPREKRVVISLTYIYGIGTSTAQKILE

SEQ ID NO: 1680420 - protein, 25 aa, Staphylococcus aureus
IQGLFYEQLAYCSVLFVNKIDSADV

SEQ ID NO: 1680421 - protein, 23 aa, Staphylococcus aureus
IQGMIDLIFVKDGVHYFVDYKTD

SEQ ID NO: 1680422 - protein, 19 aa, Staphylococcus aureus
IQIGEKLTRGLGAGANPEI

SEQ ID NO: 1680423 - protein, 26 aa, Staphylococcus aureus
IQIQQLLIHLILIIKRKQSLSELDTL

SEQ ID NO: 1680424 - protein, 24 aa, Staphylococcus aureus
IQKLSLQFIECNLAHFVASDAHSC

SEQ ID NO: 1680425 - protein, 20 aa, Staphylococcus aureus
IRQRNLLNLVHAWSTELQLG

SEQ ID NO: 1680426 - protein, 27 aa, Staphylococcus aureus
ISSKPPILLTPLFPTYFFPTHSDRQNE

SEQ ID NO: 1680427 - protein, 27 aa, Staphylococcus aureus
ITALKYIEMIDQPIEGFFSIAGFKEDA

SEQ ID NO: 1680428 - protein, 23 aa, Staphylococcus aureus
ITDKTILVSIMFVNNEVGTVQQI

SEQ ID NO: 1680429 - protein, 28 aa, Staphylococcus aureus
ITKTTPEKSLLKPLPKKAGRNNQGKLTV

SEQ ID NO: 1680430 - protein, 19 aa, Staphylococcus aureus
ITPGMILAAMRTNVPAIFC

SEQ ID NO: 1680431 - protein, 20 aa, Staphylococcus aureus
ITQNEIVTWILGYTTSIEDM

SEQ ID NO: 1680432 - protein, 23 aa, Staphylococcus aureus
ITRDNLLMRMKEQEWDDVIDTNL

SEQ ID NO: 1680433 - protein, 26 aa, Staphylococcus aureus
ITTIDPIKFNLLFERFLNPERVTMPD

SEQ ID NO: 1680434 - protein, 25 aa, Staphylococcus aureus
IVDKILTQLNIRLLEQRISIEVSDD

SEQ ID NO: 1680435 - protein, 18 aa, Staphylococcus aureus
IVDRLTLDLIKQLIRMNN

SEQ ID NO: 1680436 - protein, 25 aa, Staphylococcus aureus
IVGNKKIILAANKLDLLPKQINKRR

SEQ ID NO: 1680437 - protein, 26 aa, Staphylococcus aureus
IYSYELYNFFDVDTIIRIGSCGALQE

SEQ ID NO: 1680438 - protein, 20 aa, Staphylococcus aureus
IYVPKNIKLDTPLQAYFRIN

SEQ ID NO: 1680439 - protein, 27 aa, Staphylococcus aureus
KAAVDTLIVIPNDRLLDIVDKSTPMME

SEQ ID NO: 1680440 - protein, 24 aa, Staphylococcus aureus
KAKQDFLLPHLENGKIVLIGATTS

SEQ ID NO: 1680441 - protein, 30 aa, Staphylococcus aureus
KAPEAYPHPIYNNVLPHIDVFLENGYTKEE

SEQ ID NO: 1680442 - protein, 20 aa, Staphylococcus aureus
KAPEIGLATVYRTLELLAEL

SEQ ID NO: 1680443 - protein, 26 aa, Staphylococcus aureus
KAQSKKFFEIYTPLLKHQGLVITDNV

SEQ ID NO: 1680444 - protein, 24 aa, Staphylococcus aureus
KDFANIFFMMMNFYSIERSMEIAK

SEQ ID NO: 1680445 - protein, 20 aa, Staphylococcus aureus
KDVDILFILGGDGTVNELIN

SEQ ID NO: 1680446 - protein, 23 aa, Staphylococcus aureus
KEEHLDFVIIDTAGRLHIDEALM

SEQ ID NO: 1680447 - protein, 19 aa, Staphylococcus aureus
KEIKDLLSYLRIIANSNDD

SEQ ID NO: 1680448 - protein, 26 aa, Staphylococcus aureus
KESDGRIILFIDEIHMLVGAGKTDGA

SEQ ID NO: 1680449 - protein, 24 aa, Staphylococcus aureus
KESLKLYINAYRLAERYSTIATNC

SEQ ID NO: 1680450 - protein, 28 aa, Staphylococcus aureus
KESLQYQRFIRHVQFLIRRLRRKEYIHA

SEQ ID NO: 1680451 - protein, 24 aa, Staphylococcus aureus
KHPKLKNLYFLQENAKQAIASMSQ

SEQ ID NO: 1680452 - protein, 21 aa, Staphylococcus aureus
KHSGLMYYTIGQRHGLGIGGD

SEQ ID NO: 1680453 - protein, 31 aa, Staphylococcus aureus
KIIKKLNQINKPLKAILLTHAHFDHIGAVDD

SEQ ID NO: 1680454 - protein, 20 aa, Staphylococcus aureus
KIQQGWFDFDVVVATPDMMG

SEQ ID NO: 1680455 - protein, 24 aa, Staphylococcus aureus
KKGIFSVMNYLLPMQDIMSMHCSA

SEQ ID NO: 1680456 - protein, 24 aa, Staphylococcus aureus
KKSKFNAKFLHYKNKPFKLKTKKD

SEQ ID NO: 1680457 - protein, 29 aa, Staphylococcus aureus
KLPVEVDKFNWYHILRKIESYADIKVERR

SEQ ID NO: 1680458 - protein, 34 aa, Staphylococcus aureus
KLRQKMGMVFQNFNLFPHKKVVDNIILAPKLLKK

SEQ ID NO: 1680459 - protein, 30 aa, Staphylococcus aureus
KNDNAQGEYYLPDVLSLILNDGGIVEVYRT

SEQ ID NO: 1680460 - protein, 26 aa, Staphylococcus aureus
KQFDQIFDLLAIRVIVNSINDCYAIL

SEQ ID NO: 1680461 - protein, 26 aa, Staphylococcus aureus
KRGGKVWIKIFPHTPYTKKPLEVRMG

SEQ ID NO: 1680462 - protein, 20 aa, Staphylococcus aureus
KRMYPDILNYDKLVEILGDF

SEQ ID NO: 1680463 - protein, 17 aa, Staphylococcus aureus
KRQKLDIPFIYLTAKTQ

SEQ ID NO: 1680464 - protein, 21 aa, Staphylococcus aureus
KTEFIAYFLQRLNLTRDDIVI

SEQ ID NO: 1680465 - protein, 25 aa, Staphylococcus aureus
KTIQLRRYLHQYPELSFEEFQTHDY

SEQ ID NO: 1680466 - protein, 27 aa, Staphylococcus aureus
KTTTAGKLALLMRKKYNKKPMLVAADI

SEQ ID NO: 1680467 - protein, 18 aa, Staphylococcus aureus
KVARLICDVYKTDGTPFE

SEQ ID NO: 1680468 - protein, 20 aa, Staphylococcus aureus
KVFVDLYNKGIIYRGERIIN

SEQ ID NO: 1680469 - protein, 28 aa, Staphylococcus aureus
KYDCKVYLKREDLQWVRSFKLRGAYNAI

SEQ ID NO: 1680470 - protein, 21 aa, Staphylococcus aureus
KYDLFVLVVTDIINSDSKILV

SEQ ID NO: 1680471 - protein, 21 aa, Staphylococcus aureus
KYEVMSIPTLIVFKDGQPVDK

SEQ ID NO: 1680472 - protein, 22 aa, Staphylococcus aureus
KYGLSNIVVHAPYIINIANTTK

SEQ ID NO: 1680473 - protein, 20 aa, Staphylococcus aureus
LADFALTPDVAIIDPQFVMS

SEQ ID NO: 1680474 - protein, 22 aa, Staphylococcus aureus
LAGYPLIDVKAKLYDGSYHDVD

SEQ ID NO: 1680475 - protein, 31 aa, Staphylococcus aureus
LAKGASYRLEFYRLYLLMVHLLKFGEMYRDS

SEQ ID NO: 1680476 - protein, 37 aa, Staphylococcus aureus
LCLAQQDIFRPQLRALLRASVYGKLNIMFPMVATINE

SEQ ID NO: 1680477 - protein, 28 aa, Staphylococcus aureus
LDFRDEDIWMLFGTLPVFPCLKDDEDQK

SEQ ID NO: 1680478 - protein, 29 aa, Staphylococcus aureus
LDKALSHYYDLIILDLMLPSINGLEICRK

SEQ ID NO: 1680479 - protein, 30 aa, Staphylococcus aureus
LEAGRSDYFWDLFIQMPAALMFPSGNKFYD

SEQ ID NO: 1680480 - protein, 24 aa, Staphylococcus aureus
LEANNIHVIPLSLTIEGASYVDQV

SEQ ID NO: 1680481 - protein, 25 aa, Staphylococcus aureus
LEANVKYLALDLGPDNIRVNAISAG

SEQ ID NO: 1680482 - protein, 18 aa, Staphylococcus aureus
LEDGSFYEGYRLGSDNLT

SEQ ID NO: 1680483 - protein, 23 aa, Staphylococcus aureus
LEFPIVFIMGMEESLFPHIRAIK

SEQ ID NO: 1680484 - protein, 19 aa, Staphylococcus aureus
LEIQKMREERHLLGQMMNQ

SEQ ID NO: 1680485 - protein, 26 aa, Staphylococcus aureus
LEKEKDFLQVIVKNDDKNLPTNQNVA

SEQ ID NO: 1680486 - protein, 25 aa, Staphylococcus aureus
LEKIRKALYMSKICSYAQGFAQMRK

SEQ ID NO: 1680487 - protein, 30 aa, Staphylococcus aureus
LEQRLIDNPGWILSPYPVAIPHLRDNMIKH

SEQ ID NO: 1680488 - protein, 23 aa, Staphylococcus aureus
LETAAGFLMDKEIKFIGGVVNDP

SEQ ID NO: 1680489 - protein, 23 aa, Staphylococcus aureus
LETALDTLLNLKSTGRMVGIISH

SEQ ID NO: 1680490 - protein, 18 aa, Staphylococcus aureus
LEWDDELLELLTVPKNML

SEQ ID NO: 1680491 - protein, 22 aa, Staphylococcus aureus
LFAASFVTHFSGQTPHIHFDIA

SEQ ID NO: 1680492 - protein, 28 aa, Staphylococcus aureus
LFAQMFTIDILYYRYVALNYHASLDFIT

SEQ ID NO: 1680493 - protein, 23 aa, Staphylococcus aureus
LFVKVGMELFYQEGPQLINEIKE

SEQ ID NO: 1680494 - protein, 29 aa, Staphylococcus aureus
LGFGPKLSMAIYQFYLGDTLTILDRNPYQ

SEQ ID NO: 1680495 - protein, 29 aa, Staphylococcus aureus
LGLIDETKLNFLWVTDWPLLEYDEDAKRY

SEQ ID NO: 1680496 - protein, 18 aa, Staphylococcus aureus
LGNISRLDNGHFAHLHAT

SEQ ID NO: 1680497 - protein, 20 aa, Staphylococcus aureus
LGQQVIMKQTARKVRRLYEG

SEQ ID NO: 1680498 - protein, 27 aa, Staphylococcus aureus
LGRDRKFQAILPLRGKVINTEKARLED

SEQ ID NO: 1680499 - protein, 18 aa, Staphylococcus aureus
LHQGTPIMQLFLDSKEPI

SEQ ID NO: 1680500 - protein, 19 aa, Staphylococcus aureus
LIDFQIVGMPLPKNDRSQR

SEQ ID NO: 1680501 - protein, 25 aa, Staphylococcus aureus
LKANGYGLIIRKLIQHDINLIAMHT

SEQ ID NO: 1680502 - protein, 17 aa, Staphylococcus aureus
LKEVTFKVACDVSNPLL

SEQ ID NO: 1680503 - protein, 24 aa, Staphylococcus aureus
LKGALFTSLFLEKMNMNTTPKYYE

SEQ ID NO: 1680504 - protein, 25 aa, Staphylococcus aureus
LKGSWSVVCFYPADFSFVCPTELED

SEQ ID NO: 1680505 - protein, 25 aa, Staphylococcus aureus
LKTLQKFPVLFPVVDKLFTYKNPTL

SEQ ID NO: 1680506 - protein, 17 aa, Staphylococcus aureus
LKVVIPSGPYDAKGLLI

SEQ ID NO: 1680507 - protein, 17 aa, Staphylococcus aureus
LKWRGLIYQQTDEQGIE

SEQ ID NO: 1680508 - protein, 18 aa, Staphylococcus aureus
LLMDCQFCNAIRPGISLY

SEQ ID NO: 1680509 - protein, 28 aa, Staphylococcus aureus
LLYEEMKHYFILNFPQRPGALREFVNDV

SEQ ID NO: 1680510 - protein, 25 aa, Staphylococcus aureus
LNALLEMYQGFFLAPHVVSQSLKGA

SEQ ID NO: 1680511 - protein, 26 aa, Staphylococcus aureus
LNEMSKWEQFFIDKGYYPVSVDAKHG

SEQ ID NO: 1680512 - protein, 24 aa, Staphylococcus aureus
LNGHITLPILLEMRKNPDFKLKIE

SEQ ID NO: 1680513 - protein, 25 aa, Staphylococcus aureus
LNNPDELMAFLKNKRKNILENAYIM

SEQ ID NO: 1680514 - protein, 23 aa, Staphylococcus aureus
LNQSLMLVTALNPHIGYEKAAQI

SEQ ID NO: 1680515 - protein, 18 aa, Staphylococcus aureus
LNTQLLGELPLEQPSWNP

SEQ ID NO: 1680516 - protein, 29 aa, Staphylococcus aureus
LPANEGRGYVLRRLLRRAVRFSQTLGINE

SEQ ID NO: 1680517 - protein, 19 aa, Staphylococcus aureus
LPELEGKLHGMALRVPTKN

SEQ ID NO: 1680518 - protein, 21 aa, Staphylococcus aureus
LPKADIVLLGISRTSKTPLSQ

SEQ ID NO: 1680519 - protein, 28 aa, Staphylococcus aureus
LPKQQLPYFISFLSFHQYSIFQVLSPKK

SEQ ID NO: 1680520 - protein, 24 aa, Staphylococcus aureus
LPSKDNLAILYGEGFHICKGELFG

SEQ ID NO: 1680521 - protein, 24 aa, Staphylococcus aureus
LQDLVKTLQRKLGKTFIFVTHDMD

SEQ ID NO: 1680522 - protein, 22 aa, Staphylococcus aureus
LRDTLHFEMLWDTSKIDVIIRK

SEQ ID NO: 1680523 - protein, 17 aa, Staphylococcus aureus
LSGVVSRKKQIVPQITE

SEQ ID NO: 1680524 - protein, 22 aa, Staphylococcus aureus
LSKSLLLAQALYQDGERQSKVI

SEQ ID NO: 1680525 - protein, 26 aa, Staphylococcus aureus
LSLPQTRLRKLLKRMDFYIKFDDTQH

SEQ ID NO: 1680526 - protein, 20 aa, Staphylococcus aureus
LSPMTVIANLLPTGTVSGAP

SEQ ID NO: 1680527 - protein, 24 aa, Staphylococcus aureus
LTAKRKLSVFIYSVNDFTDFNARS

SEQ ID NO: 1680528 - protein, 21 aa, Staphylococcus aureus
LTISADLPFAQKRWCASAGLD

SEQ ID NO: 1680529 - protein, 25 aa, Staphylococcus aureus
LTPKEYELLIYLAKTPNKVFDREQL

SEQ ID NO: 1680530 - protein, 24 aa, Staphylococcus aureus
LTRFVKEYTGLPAERVIGSGTVLD

SEQ ID NO: 1680531 - protein, 34 aa, Staphylococcus aureus
LTSTTLPMIDTIKSLMAFLKQRHIPMAIATSSVK

SEQ ID NO: 1680532 - protein, 38 aa, Staphylococcus aureus
LTTGAFNALLKTLEEPPAHAIFILATTEPHKIPPTIIS

SEQ ID NO: 1680533 - protein, 18 aa, Staphylococcus aureus
LVLIDIAVPRDIEPGISA

SEQ ID NO: 1680534 - protein, 32 aa, Staphylococcus aureus
LVVSIAKRYVGRGMLFLDLIQEGNMGLIKAVE

SEQ ID NO: 1680535 - protein, 19 aa, Staphylococcus aureus
LWINSGVATLKKYFDGRET

SEQ ID NO: 1680536 - protein, 24 aa, Staphylococcus aureus
LYEKHQYKNFIYTPVGFVCEHLEV

SEQ ID NO: 1680537 - protein, 18 aa, Staphylococcus aureus
LYVDIKVVTPTKLTDRQK

SEQ ID NO: 1680538 - protein, 25 aa, Staphylococcus aureus
MCNDYNIFRQCYCGCVFAAMQQGID

SEQ ID NO: 1680539 - protein, 24 aa, Staphylococcus aureus
MDAGNMLKPMLARGELHCIGATTL

SEQ ID NO: 1680540 - protein, 31 aa, Staphylococcus aureus
MDDLTPMKCLRIVALFRLINPTKEIRIAGGR

SEQ ID NO: 1680541 - protein, 19 aa, Staphylococcus aureus
MDYYRHGGILQMVLRNKLA

SEQ ID NO: 1680542 - protein, 17 aa, Staphylococcus aureus
MEAREIFLVVTGANKRD

SEQ ID NO: 1680543 - protein, 27 aa, Staphylococcus aureus
MEDLGFTDFNLGPEPEFFLFKLDEKGE

SEQ ID NO: 1680544 - protein, 26 aa, Staphylococcus aureus
METWDFAHCLPYFKKLEKTYGAAPYD

SEQ ID NO: 1680545 - protein, 18 aa, Staphylococcus aureus
MFNIHDLEWDDELLELLT

SEQ ID NO: 1680546 - protein, 23 aa, Staphylococcus aureus
MGALTVGVVTRPFSFEGRKRQTQ

SEQ ID NO: 1680547 - protein, 20 aa, Staphylococcus aureus
MIGMAFNQLESFKLALPYLM

SEQ ID NO: 1680548 - protein, 26 aa, Staphylococcus aureus
MIHHRYPDIPFYLQVGNPYLSDSVDN

SEQ ID NO: 1680549 - protein, 34 aa, Staphylococcus aureus
MKEEPIKLLALITSNYRLFYQCKILSQKGYSGQQ

SEQ ID NO: 1680550 - protein, 32 aa, Staphylococcus aureus
MKSFLTKDQYRLYKLIWERFVASQMAPAILDT

SEQ ID NO: 1680551 - protein, 26 aa, Staphylococcus aureus
MNRKGYYLYGYRHFSSRIKGGHTNNK

SEQ ID NO: 1680552 - protein, 22 aa, Staphylococcus aureus
MNRLRPFGTDFSRPIFEMDDLS

SEQ ID NO: 1680553 - protein, 23 aa, Staphylococcus aureus
MRQRVMIAMAISCSPKLLIADEP

SEQ ID NO: 1680554 - protein, 28 aa, Staphylococcus aureus
MSFGVINILLQFVMLKEDMKLPKAYILE

SEQ ID NO: 1680555 - protein, 26 aa, Staphylococcus aureus
MSQMIFDNFLFSSRSKWGERSGLTLF

SEQ ID NO: 1680556 - protein, 17 aa, Staphylococcus aureus
NALKLKSITFTHEFMFA

SEQ ID NO: 1680557 - protein, 28 aa, Staphylococcus aureus
NAVNEMRALIWQLKPVGLEQGLIHALTA

SEQ ID NO: 1680558 - protein, 18 aa, Staphylococcus aureus
NCMVMLPGGSRGFKAGHT

SEQ ID NO: 1680559 - protein, 24 aa, Staphylococcus aureus
NDAKRKVAIALRNRYRRSLLDEES

SEQ ID NO: 1680560 - protein, 24 aa, Staphylococcus aureus
NDEAQLILQTMLVSLQTIEEEYNE

SEQ ID NO: 1680561 - protein, 23 aa, Staphylococcus aureus
NDGPAIEYTLIGPTIQFNTQNTF

SEQ ID NO: 1680562 - protein, 24 aa, Staphylococcus aureus
NDKEALSLNYLPSLKFDYAQNEAA

SEQ ID NO: 1680563 - protein, 24 aa, Staphylococcus aureus
NDTPLLAIPGAPPDLLHPPKGDAF

SEQ ID NO: 1680564 - protein, 24 aa, Staphylococcus aureus
NDVQVGSYILLDDGLIELQVKDID

SEQ ID NO: 1680565 - protein, 26 aa, Staphylococcus aureus
NEEEDFVVEGPLWIQVHAFEKGVEVT

SEQ ID NO: 1680566 - protein, 26 aa, Staphylococcus aureus
NETETYMPLAIYLSHQLAKRLSDVRK

SEQ ID NO: 1680567 - protein, 17 aa, Staphylococcus aureus
NETGALYYREGFITQLM

SEQ ID NO: 1680568 - protein, 19 aa, Staphylococcus aureus
NEVMPIFDAAMKYKEDGTG

SEQ ID NO: 1680569 - protein, 18 aa, Staphylococcus aureus
NEVVGFFVLHRYYQHEGY

SEQ ID NO: 1680570 - protein, 19 aa, Staphylococcus aureus
NFKTFLSQYLPAQPGDMIT

SEQ ID NO: 1680571 - protein, 25 aa, Staphylococcus aureus
NGDIGVIVGIFWAKENALNKDVLVV

SEQ ID NO: 1680572 - protein, 23 aa, Staphylococcus aureus
NGKINFLLQTYLKEFRKGGISKK

SEQ ID NO: 1680573 - protein, 23 aa, Staphylococcus aureus
NGQTPFVTLGFGLGTDHLSRKIQ

SEQ ID NO: 1680574 - protein, 18 aa, Staphylococcus aureus
NHMLQMVALLAMEAPISL

SEQ ID NO: 1680575 - protein, 26 aa, Staphylococcus aureus
NIETYPMNWPIGMGQSFFGIIDRKSK

SEQ ID NO: 1680576 - protein, 25 aa, Staphylococcus aureus
NINQNMFVTMFYGLYEEMNHLLYCS

SEQ ID NO: 1680577 - protein, 22 aa, Staphylococcus aureus
NKERFNLFLDEQFEMGIDIDTL

SEQ ID NO: 1680578 - protein, 24 aa, Staphylococcus aureus
NKETALGYANKFTRKLHPYEGKQY

SEQ ID NO: 1680579 - protein, 26 aa, Staphylococcus aureus
NKIIQSIHFIGTFTVEFFIDSNNQLY

SEQ ID NO: 1680580 - protein, 34 aa, Staphylococcus aureus
NKNLTLENFVLIYYLDQIIAQANLRLATMSDNRY

SEQ ID NO: 1680581 - protein, 24 aa, Staphylococcus aureus
NKVAPPFRVAEVDIMYGQGISKEG

SEQ ID NO: 1680582 - protein, 24 aa, Staphylococcus aureus
NLVPDYLDGLLFDDIPYLEVAQKE

SEQ ID NO: 1680583 - protein, 27 aa, Staphylococcus aureus
NMALTECDLLINLGSRFDDRLASKPDA

SEQ ID NO: 1680584 - protein, 23 aa, Staphylococcus aureus
NNGRFSPVVFKLASEHDIDLSQV

SEQ ID NO: 1680585 - protein, 27 aa, Staphylococcus aureus
NNIDKTFGLIFSQRVLLALINKGMVRE

SEQ ID NO: 1680586 - protein, 29 aa, Staphylococcus aureus
NPVAQFVVELLQFFKKTYKTHFNMDGGPI

SEQ ID NO: 1680587 - protein, 26 aa, Staphylococcus aureus
NQEMALLPEYGLDVKIVLINNGTLGM

SEQ ID NO: 1680588 - protein, 26 aa, Staphylococcus aureus
NQPIKLYYNGPMFRYERKQKGRYRQF

SEQ ID NO: 1680589 - protein, 31 aa, Staphylococcus aureus
NQWMENIRDWTISRQLWWGHQIPAWYHKETG

SEQ ID NO: 1680590 - protein, 27 aa, Staphylococcus aureus
NSGIVNRFYFEALYARVGHILIEISTD

SEQ ID NO: 1680591 - protein, 25 aa, Staphylococcus aureus
NSIYQKLLVYMKFQAGLDVSTQQVA

SEQ ID NO: 1680592 - protein, 28 aa, Staphylococcus aureus
NSPETPIFQKRKLLYNLDKARKSIRKLD

SEQ ID NO: 1680593 - protein, 29 aa, Staphylococcus aureus
NTDDLSTDLVWYLWTGKYSSLFGKRAMTT

SEQ ID NO: 1680594 - protein, 17 aa, Staphylococcus aureus
NTKFGIPSYYVIASSEA

SEQ ID NO: 1680595 - protein, 25 aa, Staphylococcus aureus
NTLDISAVPILKQGTHLPVMVDVTH

SEQ ID NO: 1680596 - protein, 25 aa, Staphylococcus aureus
NTPQIIYHVLSPNKMPVKSLLECVK

SEQ ID NO: 1680597 - protein, 30 aa, Staphylococcus aureus
NVESSEIIKKLFLLGIVANINQSLNQETIE

SEQ ID NO: 1680598 - protein, 20 aa, Staphylococcus aureus
NVIDLAYPGVLPVVNKRAVD

SEQ ID NO: 1680599 - protein, 26 aa, Staphylococcus aureus
NYEVNILKMQLLIWITETPSGDIQEL

SEQ ID NO: 1680600 - protein, 19 aa, Staphylococcus aureus
NYLPLPIVISEAEGVWVKD

SEQ ID NO: 1680601 - protein, 22 aa, Staphylococcus aureus
PCHTMFQFYVQDGKLSCQLYQR

SEQ ID NO: 1680602 - protein, 24 aa, Staphylococcus aureus
PDDKRIMQDIFIPKGQSLGAVDGH

SEQ ID NO: 1680603 - protein, 25 aa, Staphylococcus aureus
PEIAGLMLSAIISDSLLFKSPTCTQ

SEQ ID NO: 1680604 - protein, 25 aa, Staphylococcus aureus
PEILKPRLVPLLRMSNKEFKQTYGH

SEQ ID NO: 1680605 - protein, 26 aa, Staphylococcus aureus
PENRVEYFVSYYDYYQPEAYVPSTDT

SEQ ID NO: 1680606 - protein, 24 aa, Staphylococcus aureus
PEYYNQIRVFLKSLGLKSEDYRAI

SEQ ID NO: 1680607 - protein, 18 aa, Staphylococcus aureus
PFIFVDFHAETTSEKYAM

SEQ ID NO: 1680608 - protein, 21 aa, Staphylococcus aureus
PFNMIKRYHYGLTDTLLLEKG

SEQ ID NO: 1680609 - protein, 18 aa, Staphylococcus aureus
PGRREIGHGALGERALKY

SEQ ID NO: 1680610 - protein, 28 aa, Staphylococcus aureus
PIHDACTILYLLQPELFTMVPVNIDIEH

SEQ ID NO: 1680611 - protein, 25 aa, Staphylococcus aureus
PIQVGSHFHFYEANAALDFEREMAY

SEQ ID NO: 1680612 - protein, 24 aa, Staphylococcus aureus
PKLRKLNLKWYAVPIISNMDLKIG

SEQ ID NO: 1680613 - protein, 27 aa, Staphylococcus aureus
PKSDRLRQFFDFITNFGIMIKGTGEDI

SEQ ID NO: 1680614 - protein, 24 aa, Staphylococcus aureus
PLEEQSLINFLTDLSLVADIDEAD

SEQ ID NO: 1680615 - protein, 17 aa, Staphylococcus aureus
PMSPWGKPTLGKKTRRG

SEQ ID NO: 1680616 - protein, 28 aa, Staphylococcus aureus
PNIDGIEFVEFLISPNKGEPLKSLNKIA

SEQ ID NO: 1680617 - protein, 17 aa, Staphylococcus aureus
PNWTTCISICALFRDSE

SEQ ID NO: 1680618 - protein, 18 aa, Staphylococcus aureus
PPTIYFPLNVEEGMMIEP

SEQ ID NO: 1680619 - protein, 19 aa, Staphylococcus aureus
PSILLAPWNVIEERLKPIL

SEQ ID NO: 1680620 - protein, 18 aa, Staphylococcus aureus
PSSVILSSVLMLEHLGWQ

SEQ ID NO: 1680621 - protein, 36 aa, Staphylococcus aureus
PTFVSGKLTIDNFRWAGVPFYIRTGKRMKSKTIQVV

SEQ ID NO: 1680622 - protein, 17 aa, Staphylococcus aureus
PTYFFPTHSDRQNENIW

SEQ ID NO: 1680623 - protein, 24 aa, Staphylococcus aureus
PVNFGANLGLMLDLYDDFLQDPSS

SEQ ID NO: 1680624 - protein, 35 aa, Staphylococcus aureus
PYLDKFYSDFERWSFHLQIYFLAERFKEQKRMFEY

SEQ ID NO: 1680625 - protein, 29 aa, Staphylococcus aureus
QAAEIDNLIWYFSELFKSELKIAIGPVER

SEQ ID NO: 1680626 - protein, 24 aa, Staphylococcus aureus
QAGDRFVVFSDEKQARRIGESRHE

SEQ ID NO: 1680627 - protein, 24 aa, Staphylococcus aureus
QDDERLFFIGEAIRRGTTLEEIHN

SEQ ID NO: 1680628 - protein, 22 aa, Staphylococcus aureus
QDILPLLEQVVQSNRPILIVAD

SEQ ID NO: 1680629 - protein, 22 aa, Staphylococcus aureus
QDRHIPALLKLKDTVSLVAVQD

SEQ ID NO: 1680630 - protein, 27 aa, Staphylococcus aureus
QDSLQNKLFPLEYGLKGLPSIKIKDSH

SEQ ID NO: 1680631 - protein, 37 aa, Staphylococcus aureus
QEEPKNQGAWLYVYPYVKVLVADKYDLSYHGRIQRAA

SEQ ID NO: 1680632 - protein, 18 aa, Staphylococcus aureus
QEVDQILTYSTIYDLPIL

SEQ ID NO: 1680633 - protein, 28 aa, Staphylococcus aureus
QFELKGNRLFYLAMAPQFFGVISDYLKS

SEQ ID NO: 1680634 - protein, 19 aa, Staphylococcus aureus
QFNHIIQVGYLRNLLNTQY

SEQ ID NO: 1680635 - protein, 27 aa, Staphylococcus aureus
QFRKNGLPYIMHPIQVAGILTEMRLDG

SEQ ID NO: 1680636 - protein, 25 aa, Staphylococcus aureus
QFVPNISIGLPILDAVRKGTTLPID

SEQ ID NO: 1680637 - protein, 29 aa, Staphylococcus aureus
QGMTCMFQSKRMLLGNYYTFQDRQMKIER

SEQ ID NO: 1680638 - protein, 27 aa, Staphylococcus aureus
QGTIRAPQWRGGGIVFGPTPRSYAYKM

SEQ ID NO: 1680639 - protein, 28 aa, Staphylococcus aureus
QIKKADVFISTILIPGAKPPKLVTREMV

SEQ ID NO: 1680640 - protein, 21 aa, Staphylococcus aureus
QILDLLIHLRETRQLSYIFIT

SEQ ID NO: 1680641 - protein, 20 aa, Staphylococcus aureus
QISKLLFESTKRRPMIIPVI

SEQ ID NO: 1680642 - protein, 21 aa, Staphylococcus aureus
QISRIPLIVLTSDRPHELRSV

SEQ ID NO: 1680643 - protein, 25 aa, Staphylococcus aureus
QITDFMFFMSVVMTLLSRYARKDDV

SEQ ID NO: 1680644 - protein, 18 aa, Staphylococcus aureus
QKHYDGHKFADCPNFVKG

SEQ ID NO: 1680645 - protein, 22 aa, Staphylococcus aureus
QKVIIIYALIQAKEPVKQYSLA

SEQ ID NO: 1680646 - protein, 21 aa, Staphylococcus aureus
QLAQAYLRHVNPKVIAVTGSN

SEQ ID NO: 1680647 - protein, 17 aa, Staphylococcus aureus
QLMKSLYEYTETSIIFI

SEQ ID NO: 1680648 - protein, 33 aa, Staphylococcus aureus
QLMNDLNALYQHKLLLPLKLQYKDYSEWMSHRD

SEQ ID NO: 1680649 - protein, 24 aa, Staphylococcus aureus
QLVGPLRNAGLIRSVRGAKGGYQL

SEQ ID NO: 1680650 - protein, 21 aa, Staphylococcus aureus
QMNHEYFAAHAYMAMAAYCDK

SEQ ID NO: 1680651 - protein, 20 aa, Staphylococcus aureus
QNDFLFDRVKVVVATNAFGM

SEQ ID NO: 1680652 - protein, 25 aa, Staphylococcus aureus
QNKRPDYIGAFWNVVNWEKVDELYN

SEQ ID NO: 1680653 - protein, 25 aa, Staphylococcus aureus
QQDDIKKVIFLVDRKDLDSQTEEEF

SEQ ID NO: 1680654 - protein, 38 aa, Staphylococcus aureus
QQGLKNLFKIVSASLVKYFYRTPRIPRSLLDEYREGLL

SEQ ID NO: 1680655 - protein, 28 aa, Staphylococcus aureus
QSDEDVIKFLKYFTFLGKEEIDRLEQSK

SEQ ID NO: 1680656 - protein, 26 aa, Staphylococcus aureus
QSKCKRAIILPNNKNILMASEQAASI

SEQ ID NO: 1680657 - protein, 23 aa, Staphylococcus aureus
QSNQLLPGVITKIGLNTAVDPRY

SEQ ID NO: 1680658 - protein, 29 aa, Staphylococcus aureus
QTLQRDRHAYYIATLALIATSLEKFAVEI

SEQ ID NO: 1680659 - protein, 19 aa, Staphylococcus aureus
QTVSNWLKWFDMDIVEEND

SEQ ID NO: 1680660 - protein, 23 aa, Staphylococcus aureus
QVASMSDHHLLISKSSKDDRTTT

SEQ ID NO: 1680661 - protein, 24 aa, Staphylococcus aureus
QVTGKWSWLAPPLSPTLTSNYHHG

SEQ ID NO: 1680662 - protein, 20 aa, Staphylococcus aureus
QYEIYSKLFKSWSGTIHTSM

SEQ ID NO: 1680663 - protein, 19 aa, Staphylococcus aureus
QYVDELAERILAVGGNPVG

SEQ ID NO: 1680664 - protein, 17 aa, Staphylococcus aureus
RAICINPKYILFDEAIS

SEQ ID NO: 1680665 - protein, 17 aa, Staphylococcus aureus
RCKPTTVYIPKGTYDIC

SEQ ID NO: 1680666 - protein, 17 aa, Staphylococcus aureus
RCNLGVVTLNLPRMALE

SEQ ID NO: 1680667 - protein, 24 aa, Staphylococcus aureus
RDAVFEMMNWWFDKGIDGFRVDAI

SEQ ID NO: 1680668 - protein, 25 aa, Staphylococcus aureus
RDYDEKLIIPGFFGVSHEGYIVTFP

SEQ ID NO: 1680669 - protein, 21 aa, Staphylococcus aureus
RDYLIDAINYMFPSVNVTDED

SEQ ID NO: 1680670 - protein, 20 aa, Staphylococcus aureus
REIFLVVTGANKRDVVEKLY

SEQ ID NO: 1680671 - protein, 28 aa, Staphylococcus aureus
REMPWRQTTNPYYIWLSEVMLQQTQVKT

SEQ ID NO: 1680672 - protein, 21 aa, Staphylococcus aureus
REVHHVACLLAYGANAIVPYL

SEQ ID NO: 1680673 - protein, 20 aa, Staphylococcus aureus
RFANAMFEPLWNNKYISNIQ

SEQ ID NO: 1680674 - protein, 24 aa, Staphylococcus aureus
RFDMSFERKFEAFLVPTVIGEIKR

SEQ ID NO: 1680675 - protein, 18 aa, Staphylococcus aureus
RFIDVLAEKAKNYKYTLM

SEQ ID NO: 1680676 - protein, 27 aa, Staphylococcus aureus
RFIERGIIEIAPLAYMRGRTLEDAFVI

SEQ ID NO: 1680677 - protein, 19 aa, Staphylococcus aureus
RFIQAVPHMSFVIGEDNVA

SEQ ID NO: 1680678 - protein, 23 aa, Staphylococcus aureus
RGAKIVEFGGWAMPVQFSSIKEE

SEQ ID NO: 1680679 - protein, 23 aa, Staphylococcus aureus
RGFTAVCNPLVNSYKRLVPGYEA

SEQ ID NO: 1680680 - protein, 18 aa, Staphylococcus aureus
RGKIYRHLSASLATSKQK

SEQ ID NO: 1680681 - protein, 22 aa, Staphylococcus aureus
RGTAQRILYSAFDLVEQRSGRD

SEQ ID NO: 1680682 - protein, 18 aa, Staphylococcus aureus
RIIRIEGNFWDIGEGPSG

SEQ ID NO: 1680683 - protein, 18 aa, Staphylococcus aureus
RINRLKDAVPNNAPILYK

SEQ ID NO: 1680684 - protein, 27 aa, Staphylococcus aureus
RKALSQADLILFVLNNNEALTQEDYTL

SEQ ID NO: 1680685 - protein, 26 aa, Staphylococcus aureus
RKDNNYHFLLFNKINDRYMSDVKQDF

SEQ ID NO: 1680686 - protein, 21 aa, Staphylococcus aureus
RKKYDIPIIAQLTASNTNYLV

SEQ ID NO: 1680687 - protein, 28 aa, Staphylococcus aureus
RLGIRLEKTFEYIDTPHKFKMGVSGCPR

SEQ ID NO: 1680688 - protein, 24 aa, Staphylococcus aureus
RNFEGRIHPLVKANYLASPQLVVA

SEQ ID NO: 1680689 - protein, 31 aa, Staphylococcus aureus
RPGFEGGQLPLFRRLPKRGFTNINRKEYAIV

SEQ ID NO: 1680690 - protein, 21 aa, Staphylococcus aureus
RQLSYIFITHDIQAATYLCDQ

SEQ ID NO: 1680691 - protein, 32 aa, Staphylococcus aureus
RQRAYIAMTIAQDTEYILLDEPLNNLDMKHAV

SEQ ID NO: 1680692 - protein, 19 aa, Staphylococcus aureus
RRHFLSYKPDYAIMTNIDF

SEQ ID NO: 1680693 - protein, 25 aa, Staphylococcus aureus
RRQRKRDFRKLWITRINAAARQHEM

SEQ ID NO: 1680694 - protein, 22 aa, Staphylococcus aureus
RSIRIDLPPFTLVGATTRAGSL

SEQ ID NO: 1680695 - protein, 17 aa, Staphylococcus aureus
RSRVKLETDGKLLTGKD

SEQ ID NO: 1680696 - protein, 25 aa, Staphylococcus aureus
RSTKLVHGGLRYLKQFQIGVVAETG

SEQ ID NO: 1680697 - protein, 23 aa, Staphylococcus aureus
RSVDYLHHLIQAMHLAYSDRAQY

SEQ ID NO: 1680698 - protein, 37 aa, Staphylococcus aureus
RVANKLKLGTVWINDFHPYFAQAPWGGYKQSGIGREL

SEQ ID NO: 1680699 - protein, 17 aa, Staphylococcus aureus
RVNEFGFIETPYRKVDL

SEQ ID NO: 1680700 - protein, 21 aa, Staphylococcus aureus
RYGTFAKYFTKNDVPTFAICH

SEQ ID NO: 1680701 - protein, 18 aa, Staphylococcus aureus
RYYNKYPTTQIEASGLDV

SEQ ID NO: 1680702 - protein, 25 aa, Staphylococcus aureus
SADQALLQRLDLMKFQLEELSEAHL

SEQ ID NO: 1680703 - protein, 30 aa, Staphylococcus aureus
SAERIMLPDVTIALDYALNRFTNIVDRLTV

SEQ ID NO: 1680704 - protein, 25 aa, Staphylococcus aureus
SAIKHFFEKLLKLESLMHTDTAKMI

SEQ ID NO: 1680705 - protein, 24 aa, Staphylococcus aureus
SANPKYEKYFNDPNFKDFRHSFSQ

SEQ ID NO: 1680706 - protein, 30 aa, Staphylococcus aureus
SATGIRIGFLLGPQYLIDKLTFMHAYNCIC

SEQ ID NO: 1680707 - protein, 23 aa, Staphylococcus aureus
SDDKLAERLAFISNSTGGILGPQ

SEQ ID NO: 1680708 - protein, 23 aa, Staphylococcus aureus
SDDYLLPRKGVYAVSIEIGTENK

SEQ ID NO: 1680709 - protein, 30 aa, Staphylococcus aureus
SDMYLHPDLDTWVIFPWTAGQGKVARLICD

SEQ ID NO: 1680710 - protein, 23 aa, Staphylococcus aureus
SDSQTLVIGPYYRGNNGSEGKDE

SEQ ID NO: 1680711 - protein, 25 aa, Staphylococcus aureus
SEEAVLQMNLLGHDFFVFTDRETDG

SEQ ID NO: 1680712 - protein, 27 aa, Staphylococcus aureus
SEEEKDMFLSLIKVTGIGPKSALAILA

SEQ ID NO: 1680713 - protein, 18 aa, Staphylococcus aureus
SEIGFILQATNLVPFLTV

SEQ ID NO: 1680714 - protein, 24 aa, Staphylococcus aureus
SEKIMIRLHDLGFGPKLSMAIYQF

SEQ ID NO: 1680715 - protein, 26 aa, Staphylococcus aureus
SEMHDLAFLLLVYPLSEYEGALDSAY

SEQ ID NO: 1680716 - protein, 26 aa, Staphylococcus aureus
SENTKARFEAYGWNYLLVKDGNDLEE

SEQ ID NO: 1680717 - protein, 25 aa, Staphylococcus aureus
SFDTIYRNLHLFKDLGIIENTELDG

SEQ ID NO: 1680718 - protein, 27 aa, Staphylococcus aureus
SGELDEHFPLVVWQTGSGTQSNMNVNE

SEQ ID NO: 1680719 - protein, 21 aa, Staphylococcus aureus
SGQVILLLDEIHRLDKAKQDF

SEQ ID NO: 1680720 - protein, 27 aa, Staphylococcus aureus
SGVASKAFLTLIENNIPFYQTTTSEIS

SEQ ID NO: 1680721 - protein, 17 aa, Staphylococcus aureus
SHITVRFGILDVGRNFA

SEQ ID NO: 1680722 - protein, 19 aa, Staphylococcus aureus
SHNNYIKRLPVSTYRAQNR

SEQ ID NO: 1680723 - protein, 20 aa, Staphylococcus aureus
SIPKFPKKIAVLTASTGAAI

SEQ ID NO: 1680724 - protein, 19 aa, Staphylococcus aureus
SISDKLYFEPLTEEDVMNI

SEQ ID NO: 1680725 - protein, 26 aa, Staphylococcus aureus
SKFGHQLRFDLSKGFPLLTTKKVSFK

SEQ ID NO: 1680726 - protein, 24 aa, Staphylococcus aureus
SKKFEPRMFIGAISNLKNELKTPA

SEQ ID NO: 1680727 - protein, 29 aa, Staphylococcus aureus
SKKVRSTIIYLPEFIRTLKGGFKDGSFEK

SEQ ID NO: 1680728 - protein, 21 aa, Staphylococcus aureus
SKQLCFLFYVSSKEIIKKYTN

SEQ ID NO: 1680729 - protein, 28 aa, Staphylococcus aureus
SKRDIQFDVIFLDPPYNKGLIDKALKLI

SEQ ID NO: 1680730 - protein, 26 aa, Staphylococcus aureus
SLEFQIKHLMVSKVKGSFDQFDVAVE

SEQ ID NO: 1680731 - protein, 32 aa, Staphylococcus aureus
SLGKSQSFIANKLRLLKLAPKVLLRLREGKIT

SEQ ID NO: 1680732 - protein, 22 aa, Staphylococcus aureus
SLQQLQFSQLYIVLQHNHSIYF

SEQ ID NO: 1680733 - protein, 34 aa, Staphylococcus aureus
SLRASYYMMGAMLGRFKKCVIGLPGGCPLGPRPI

SEQ ID NO: 1680734 - protein, 25 aa, Staphylococcus aureus
SMADNPIIFAMANPNPEIIPDDAKA

SEQ ID NO: 1680735 - protein, 17 aa, Staphylococcus aureus
SMIGYFLNEGPVTNFEQ

SEQ ID NO: 1680736 - protein, 26 aa, Staphylococcus aureus
SMLHKPELLILDEPFSGLDPVNVELL

SEQ ID NO: 1680737 - protein, 33 aa, Staphylococcus aureus
SNIQDYIFEYCNFGCPYFVLRHLSKQEVKKLIE

SEQ ID NO: 1680738 - protein, 23 aa, Staphylococcus aureus
SNKTLYLLDVLQKLPIDKMNSLN

SEQ ID NO: 1680739 - protein, 20 aa, Staphylococcus aureus
SNLLNGVTVDYYGAPTPVQQ

SEQ ID NO: 1680740 - protein, 20 aa, Staphylococcus aureus
SNVRFVIHYNMPGDLESYYQ

SEQ ID NO: 1680741 - protein, 20 aa, Staphylococcus aureus
SPFELFVISCPLENGLEIFV

SEQ ID NO: 1680742 - protein, 23 aa, Staphylococcus aureus
SPIRDAFKLLQQNQLIQLERMGA

SEQ ID NO: 1680743 - protein, 18 aa, Staphylococcus aureus
SPVLWKKVKKGLSAGRVQ

SEQ ID NO: 1680744 - protein, 21 aa, Staphylococcus aureus
SQFHLLMGMGFKKYIDTLKIG

SEQ ID NO: 1680745 - protein, 18 aa, Staphylococcus aureus
SSILLDPEYGLPASDARN

SEQ ID NO: 1680746 - protein, 24 aa, Staphylococcus aureus
SSKEELFNLRFQLATGQLEETARI

SEQ ID NO: 1680747 - protein, 18 aa, Staphylococcus aureus
STGLIVPSKFFDLAKEGK

SEQ ID NO: 1680748 - protein, 27 aa, Staphylococcus aureus
SVCAHKRWLFISSTLIKQTVRSSLIKG

SEQ ID NO: 1680749 - protein, 27 aa, Staphylococcus aureus
SVMDSGFDGYFLIAANPVDILTRFVKE

SEQ ID NO: 1680750 - protein, 27 aa, Staphylococcus aureus
SVSITQLLERFLFPSATHGKKVYKLSG

SEQ ID NO: 1680751 - protein, 27 aa, Staphylococcus aureus
SWQEYWAFESRFITLNYLDQPVGQSYL

SEQ ID NO: 1680752 - protein, 30 aa, Staphylococcus aureus
TADSLHIGHLLPFLTLRRFQEHGHRPIVLI

SEQ ID NO: 1680753 - protein, 24 aa, Staphylococcus aureus
TAKIKEFKLLSTAGAYWRGDSNNK

SEQ ID NO: 1680754 - protein, 25 aa, Staphylococcus aureus
TARQCSIVWGVQPVVKKGRKSTDAL

SEQ ID NO: 1680755 - protein, 22 aa, Staphylococcus aureus
TARRIYSLIKRVFNVEVEILVR

SEQ ID NO: 1680756 - protein, 23 aa, Staphylococcus aureus
TDIEYKFPFGWGELWGIASRTDF

SEQ ID NO: 1680757 - protein, 26 aa, Staphylococcus aureus
TEHIPVLDMVKVKRYLQGRKTRLVGP

SEQ ID NO: 1680758 - protein, 20 aa, Staphylococcus aureus
TEKLIFIADYIEPGRTIPGV

SEQ ID NO: 1680759 - protein, 17 aa, Staphylococcus aureus
TERFIERGIIEIAPLAY

SEQ ID NO: 1680760 - protein, 30 aa, Staphylococcus aureus
TFGIRLTTIHNLHFLLKLMEDIRQAIREDR

SEQ ID NO: 1680761 - protein, 21 aa, Staphylococcus aureus
TFHSMCVRILRRDADRIGIER

SEQ ID NO: 1680762 - protein, 21 aa, Staphylococcus aureus
TFKHPKFYQQLFKLLEDMRVL

SEQ ID NO: 1680763 - protein, 19 aa, Staphylococcus aureus
TFNDAWKKMGILGIEMESA

SEQ ID NO: 1680764 - protein, 32 aa, Staphylococcus aureus
TGAFCASPYFTHSYVFISWTGKMAEAFVLAHE

SEQ ID NO: 1680765 - protein, 22 aa, Staphylococcus aureus
TGQIITFTYPLIGNYGINRDDF

SEQ ID NO: 1680766 - protein, 20 aa, Staphylococcus aureus
TGRMRYLGVLLYDADRVHEA

SEQ ID NO: 1680767 - protein, 22 aa, Staphylococcus aureus
THAQMKMFLTRLGFGSKMVVTG

SEQ ID NO: 1680768 - protein, 22 aa, Staphylococcus aureus
THATSRMLFGRPQSNMPSRFLK

SEQ ID NO: 1680769 - protein, 26 aa, Staphylococcus aureus
THDTVIRFAPPLIITKEELDLALEKI

SEQ ID NO: 1680770 - protein, 24 aa, Staphylococcus aureus
TIDPEIYNLGIPVLGICYGMQLTT

SEQ ID NO: 1680771 - protein, 33 aa, Staphylococcus aureus
TIESILRYIKVKPGEFYFIPAGTVHTISSGILA

SEQ ID NO: 1680772 - protein, 26 aa, Staphylococcus aureus
TILDRNPYQLIYDIKGIGFNKADQLA

SEQ ID NO: 1680773 - protein, 20 aa, Staphylococcus aureus
TILNKEVKGYLYFFKFGTLQ

SEQ ID NO: 1680774 - protein, 17 aa, Staphylococcus aureus
TIQIRQLHPFPTSVIQD

SEQ ID NO: 1680775 - protein, 26 aa, Staphylococcus aureus
TKSETFVIISFKHKVILIGGTEYAGE

SEQ ID NO: 1680776 - protein, 17 aa, Staphylococcus aureus
TKTQLNVVIACYYGLGV

SEQ ID NO: 1680777 - protein, 27 aa, Staphylococcus aureus
TLEETAFLLDLILGIEQPVVITGAMRS

SEQ ID NO: 1680778 - protein, 17 aa, Staphylococcus aureus
TLGEGLSLPPFLENKRE

SEQ ID NO: 1680779 - protein, 25 aa, Staphylococcus aureus
TLGINEPFMYKLVDIVADIMEPYYP

SEQ ID NO: 1680780 - protein, 17 aa, Staphylococcus aureus
TLMPAIIELKKAYKEAK

SEQ ID NO: 1680781 - protein, 27 aa, Staphylococcus aureus
TLSTAQLDFLLPERFDLTYIGQDGEHH

SEQ ID NO: 1680782 - protein, 24 aa, Staphylococcus aureus
TMEELLTIYEWPEKLLNKELKKLA

SEQ ID NO: 1680783 - protein, 21 aa, Staphylococcus aureus
TMERFVAFLTEETKGAFPTWL

SEQ ID NO: 1680784 - protein, 27 aa, Staphylococcus aureus
TMNKNVFKNLWLIAWEMTYESQLKQKI

SEQ ID NO: 1680785 - protein, 25 aa, Staphylococcus aureus
TNKAQYTLVKLLASKFKNLCVVGDS

SEQ ID NO: 1680786 - protein, 25 aa, Staphylococcus aureus
TNKGDMTFKLFPNIAPKTVENFVTH

SEQ ID NO: 1680787 - protein, 27 aa, Staphylococcus aureus
TNSQLVGAGLPLWLPNGATIRREIERY

SEQ ID NO: 1680788 - protein, 23 aa, Staphylococcus aureus
TQAIALNLEPYSNSIWLFDVGEG

SEQ ID NO: 1680789 - protein, 35 aa, Staphylococcus aureus
TQDTVLVFTNKGRYLFIPVHKLADIRWKELGQHVS

SEQ ID NO: 1680790 - protein, 29 aa, Staphylococcus aureus
TQKKLAMVLVQFPPWFDCNAQNIKYILYV

SEQ ID NO: 1680791 - protein, 25 aa, Staphylococcus aureus
TSEHLELFFSYRLEKGQTGRMLAFI

SEQ ID NO: 1680792 - protein, 24 aa, Staphylococcus aureus
TSGIYSYLPLATRVLNNITAIVRQ

SEQ ID NO: 1680793 - protein, 23 aa, Staphylococcus aureus
TTGTIFNHLFKQAITFAKRAHNE

SEQ ID NO: 1680794 - protein, 19 aa, Staphylococcus aureus
TTVYIPKGTYDICKPLTIY

SEQ ID NO: 1680795 - protein, 19 aa, Staphylococcus aureus
TVAFLASDKAKYITGQTIH

SEQ ID NO: 1680796 - protein, 39 aa, Staphylococcus aureus
TVDVGSHYIWMARNFRSYNPRHLLFSNGMQTLGVALPWA

SEQ ID NO: 1680797 - protein, 26 aa, Staphylococcus aureus
TVERARRIQFFLSQNFHVAEQFTGQK

SEQ ID NO: 1680798 - protein, 25 aa, Staphylococcus aureus
TVVFDPNVRLPLWDNAEDLRQTIHT

SEQ ID NO: 1680799 - protein, 25 aa, Staphylococcus aureus
TVVNKLFNIVMPDYAYFGKKDAQQL

SEQ ID NO: 1680800 - protein, 22 aa, Staphylococcus aureus
TYDGRYLLYQPTDSGLAQIGPV

SEQ ID NO: 1680801 - protein, 27 aa, Staphylococcus aureus
TYQAQRVLTDILPAIDNIERALQIEGD

SEQ ID NO: 1680802 - protein, 17 aa, Staphylococcus aureus
VALLAQDYYYKDQKHLT

SEQ ID NO: 1680803 - protein, 25 aa, Staphylococcus aureus
VANPFGMILSLAMCLRESLNQPDAA

SEQ ID NO: 1680804 - protein, 18 aa, Staphylococcus aureus
VANYIGYLCSIISVTSNP

SEQ ID NO: 1680805 - protein, 17 aa, Staphylococcus aureus
VARLDYISKLGFSYADM

SEQ ID NO: 1680806 - protein, 18 aa, Staphylococcus aureus
VATKAGVIGLTKSAAREL

SEQ ID NO: 1680807 - protein, 28 aa, Staphylococcus aureus
VATVTEIYDYIRLLYARVGKPYCPNHNI

SEQ ID NO: 1680808 - protein, 25 aa, Staphylococcus aureus
VDNNDCDVIFFATPAPVSKTCIPPL

SEQ ID NO: 1680809 - protein, 24 aa, Staphylococcus aureus
VDRGALILLKHQIIPFFSVGDFDS

SEQ ID NO: 1680810 - protein, 19 aa, Staphylococcus aureus
VEDLRLEIQKMREERHLLG

SEQ ID NO: 1680811 - protein, 30 aa, Staphylococcus aureus
VENAPTFDYVFPYMMQFIADLPVVAHNAAF

SEQ ID NO: 1680812 - protein, 17 aa, Staphylococcus aureus
VENGFQIYIGGNGGTEV

SEQ ID NO: 1680813 - protein, 23 aa, Staphylococcus aureus
VESVWNFINKIWNGARFSLMNIG

SEQ ID NO: 1680814 - protein, 26 aa, Staphylococcus aureus
VETAYKAVMKPVEGTILTVAKDAAQA

SEQ ID NO: 1680815 - protein, 23 aa, Staphylococcus aureus
VETKLEPALKLLRNTLKEKEDKF

SEQ ID NO: 1680816 - protein, 24 aa, Staphylococcus aureus
VEVRGEAYMPRRSFLRLNEEKEKN

SEQ ID NO: 1680817 - protein, 31 aa, Staphylococcus aureus
VEYVFGIPGAKIDYLFNALIDDGPELIVTRH

SEQ ID NO: 1680818 - protein, 18 aa, Staphylococcus aureus
VFAPFKNLGLIIIDEEHE

SEQ ID NO: 1680819 - protein, 19 aa, Staphylococcus aureus
VFIVSRRGKILGSSLNELL

SEQ ID NO: 1680820 - protein, 22 aa, Staphylococcus aureus
VFQSYNLFPHKTALENVMEGLI

SEQ ID NO: 1680821 - protein, 25 aa, Staphylococcus aureus
VGEEYSFFIYPNRSGELFATQNMPD

SEQ ID NO: 1680822 - protein, 30 aa, Staphylococcus aureus
VHNACVVVTRYFGGIKLGGGGLIRAYSGAV

SEQ ID NO: 1680823 - protein, 18 aa, Staphylococcus aureus
VHRLDDAYFKKIDAIEFA

SEQ ID NO: 1680824 - protein, 18 aa, Staphylococcus aureus
VIGLPGGCPLGPRPIDQH

SEQ ID NO: 1680825 - protein, 17 aa, Staphylococcus aureus
VIGLTKSAARELASRGI

SEQ ID NO: 1680826 - protein, 22 aa, Staphylococcus aureus
VIGPLLHYRMVHELPTFFSSNF

SEQ ID NO: 1680827 - protein, 19 aa, Staphylococcus aureus
VILVKGNVPGPKKGLVEIR

SEQ ID NO: 1680828 - protein, 25 aa, Staphylococcus aureus
VINELAWHNLFAKNMFIRPESKEEA

SEQ ID NO: 1680829 - protein, 19 aa, Staphylococcus aureus
VITAFRFHYGAAQDLLGVI

SEQ ID NO: 1680830 - protein, 18 aa, Staphylococcus aureus
VITGLKRISKPGLRVYAK

SEQ ID NO: 1680831 - protein, 26 aa, Staphylococcus aureus
VITTEYYWHWDLKNSKLDVFDYKKLM

SEQ ID NO: 1680832 - protein, 28 aa, Staphylococcus aureus
VKIIDRTQLILEIFALRARSKEGKLQVE

SEQ ID NO: 1680833 - protein, 23 aa, Staphylococcus aureus
VKPIISHFLPLEKGPETFDKLVN

SEQ ID NO: 1680834 - protein, 19 aa, Staphylococcus aureus
VKPPIIYGDVKWTAPLTVD

SEQ ID NO: 1680835 - protein, 17 aa, Staphylococcus aureus
VKRYLQGRKTRLVGPNC

SEQ ID NO: 1680836 - protein, 25 aa, Staphylococcus aureus
VKYASSFFGPFRDAADSAPSFGDRK

SEQ ID NO: 1680837 - protein, 17 aa, Staphylococcus aureus
VLDITGPLGNNIHFANS

SEQ ID NO: 1680838 - protein, 31 aa, Staphylococcus aureus
VLEANIQQAIWYKLLVNLGINSITALGRQTV

SEQ ID NO: 1680839 - protein, 24 aa, Staphylococcus aureus
VLESKTVIIATGAGWRKLNIPGEE

SEQ ID NO: 1680840 - protein, 28 aa, Staphylococcus aureus
VLNERPESLFNYFKQLFAQVTNPPIDAY

SEQ ID NO: 1680841 - protein, 25 aa, Staphylococcus aureus
VLVDGLFIQHLFKPDLPYKGSLNQR

SEQ ID NO: 1680842 - protein, 29 aa, Staphylococcus aureus
VMKEGPERFWPADLVLLSIGFEGTEPTVP

SEQ ID NO: 1680843 - protein, 25 aa, Staphylococcus aureus
VNNRDWLGQISLISFLRDYGKHVGV

SEQ ID NO: 1680844 - protein, 19 aa, Staphylococcus aureus
VNRAGSMIGYFLNEGPVTN

SEQ ID NO: 1680845 - protein, 24 aa, Staphylococcus aureus
VNRLINDMIYFVRDTIMNKTSEKD

SEQ ID NO: 1680846 - protein, 19 aa, Staphylococcus aureus
VPEWANWDHFNELDKKGLI

SEQ ID NO: 1680847 - protein, 19 aa, Staphylococcus aureus
VPIKAIIDSLTTFSGIEHR

SEQ ID NO: 1680848 - protein, 27 aa, Staphylococcus aureus
VQAIRPTTKMLFIETPSNPLLRVTDIK

SEQ ID NO: 1680849 - protein, 22 aa, Staphylococcus aureus
VQRQMLETIPGLEKADMMRAGY

SEQ ID NO: 1680850 - protein, 21 aa, Staphylococcus aureus
VRIATIFDLMASQYGVRRFDH

SEQ ID NO: 1680851 - protein, 25 aa, Staphylococcus aureus
VSAKRIIDFLSGTVYAIGGDIQRVG

SEQ ID NO: 1680852 - protein, 26 aa, Staphylococcus aureus
VSRSHPGLLKRLFEQEVPEIYDGTVI

SEQ ID NO: 1680853 - protein, 24 aa, Staphylococcus aureus
VTLGYPLVRGAIRDGLINLIKEHF

SEQ ID NO: 1680854 - protein, 17 aa, Staphylococcus aureus
VTTQVGCRIGCTFCAST

SEQ ID NO: 1680855 - protein, 24 aa, Staphylococcus aureus
VVDIDMYIIVSYGVKISEVANNVQ

SEQ ID NO: 1680856 - protein, 17 aa, Staphylococcus aureus
VVDSIQTIYHPEISSAP

SEQ ID NO: 1680857 - protein, 24 aa, Staphylococcus aureus
VYEPFLIQKGFLERTPRGRKATPL

SEQ ID NO: 1680858 - protein, 23 aa, Staphylococcus aureus
VYKPYIEGFVKMLAPIAPHIGEE

SEQ ID NO: 1680859 - protein, 18 aa, Staphylococcus aureus
WEHAYYLKYQNKRPDYIG

SEQ ID NO: 1680860 - protein, 20 aa, Staphylococcus aureus
WFDFDVVVATPDMMGEVGKL

SEQ ID NO: 1680861 - protein, 19 aa, Staphylococcus aureus
WLNCGYNRWNHNEPLVGQT

SEQ ID NO: 1680862 - protein, 19 aa, Staphylococcus aureus
WPKSVTPFDLHLISINPKK

SEQ ID NO: 1680863 - protein, 31 aa, Staphylococcus aureus
WQQDEDVLDTWFSSALWPFSTLGWPDLESED

SEQ ID NO: 1680864 - protein, 29 aa, Staphylococcus aureus
WSRQKDSFYYFNPNWHIVGITYDSLEEIK

SEQ ID NO: 1680865 - protein, 22 aa, Staphylococcus aureus
YADGEKRYIIAPKGLEVGQIVE

SEQ ID NO: 1680866 - protein, 20 aa, Staphylococcus aureus
YDGFYWCRKMREVSNVPILF

SEQ ID NO: 1680867 - protein, 17 aa, Staphylococcus aureus
YDNLNVITMILFGENND

SEQ ID NO: 1680868 - protein, 29 aa, Staphylococcus aureus
YDNNPGLQNLLLDPYFKNIVTEYQDALRD

SEQ ID NO: 1680869 - protein, 26 aa, Staphylococcus aureus
YGHFGRTDVLFPWEKLDKVEELKDAV

SEQ ID NO: 1680870 - protein, 19 aa, Staphylococcus aureus
YGRVSRFGLVAFASSLDQI

SEQ ID NO: 1680871 - protein, 19 aa, Staphylococcus aureus
YKQTAAYGHFGRTDVLFPW

SEQ ID NO: 1680872 - protein, 19 aa, Staphylococcus aureus
YLISQRLVKKSLDDGYLVG

SEQ ID NO: 1680873 - protein, 24 aa, Staphylococcus aureus
YNEIEVYGVYHGYQGLLNDDIHKL

SEQ ID NO: 1680874 - protein, 22 aa, Staphylococcus aureus
YNQYIRIRHILNPSLKVLTKCQ

SEQ ID NO: 1680875 - protein, 26 aa, Staphylococcus aureus
YQQQEIPIYLDDLIIILTDGVTEARN

SEQ ID NO: 1680876 - protein, 25 aa, Staphylococcus aureus
YREMAKEGVFLPPSQFEGTFLSTAH

SEQ ID NO: 1680877 - protein, 30 aa, Staphylococcus aureus
YRKQNYTGLFRYIQMFIISNGVETRYFSNN

SEQ ID NO: 1680878 - protein, 17 aa, Staphylococcus aureus
YTRILKQGPRRGDGAES

SEQ ID NO: 1680879 - protein, 19 aa, Staphylococcus aureus
YVIMGIANKRSIAFGVAKV

SEQ ID NO: 1680880 - protein, 18 aa, Staphylococcus aureus
YVMLGAGLVAKKAVEKGL

SEQ ID NO: 1680881 - protein, 19 aa, Staphylococcus aureus
YVNELGLPAYDAHVLTLTK

SEQ ID NO: 1680882 - protein, 22 aa, Staphylococcus aureus
AAPKMLPMFSEELVNHAVSYLE

SEQ ID NO: 1680883 - protein, 28 aa, Staphylococcus aureus
ADEEYHLRKDQFTVPFVCGCRNLGEAAR

SEQ ID NO: 1680884 - protein, 25 aa, Staphylococcus aureus
ADINRGTFYLHYEDKYMLLADMEDE

SEQ ID NO: 1680885 - protein, 23 aa, Staphylococcus aureus
ADNKTLGRFQLTDIPPAERGKPQ

SEQ ID NO: 1680886 - protein, 23 aa, Staphylococcus aureus
AEEFGFATAPLVVLGCIMMRVCH

SEQ ID NO: 1680887 - protein, 31 aa, Staphylococcus aureus
AELTWMRQPHYYMGLYSYTYSAGLTIGTVVS

SEQ ID NO: 1680888 - protein, 25 aa, Staphylococcus aureus
AEPYIRRRAIRHLEKKRVVIFAAGI

SEQ ID NO: 1680889 - protein, 35 aa, Staphylococcus aureus
AETVINAHWFDGVFYIPNCDKITPGMILAAMRTNV

SEQ ID NO: 1680890 - protein, 20 aa, Staphylococcus aureus
AEYDEAIVRFFKGDKETLRY

SEQ ID NO: 1680891 - protein, 23 aa, Staphylococcus aureus
AFDYELLILGYRQTAHHAKVTLS

SEQ ID NO: 1680892 - protein, 18 aa, Staphylococcus aureus
AFKYQYMHLINEIYIEDE

SEQ ID NO: 1680893 - protein, 18 aa, Staphylococcus aureus
AFYHFKYPYADGEGFIEI

SEQ ID NO: 1680894 - protein, 17 aa, Staphylococcus aureus
AGDFTEEKLELAKKVII

SEQ ID NO: 1680895 - protein, 21 aa, Staphylococcus aureus
AGKPEAWGWEQFTSQIALGRV

SEQ ID NO: 1680896 - protein, 19 aa, Staphylococcus aureus
AHKLCPNGYFVTSNFGAYR

SEQ ID NO: 1680897 - protein, 24 aa, Staphylococcus aureus
AHTDVFNVLLQILDEGRLTDSKGR

SEQ ID NO: 1680898 - protein, 18 aa, Staphylococcus aureus
AHVKFYTGILKDREVVIT

SEQ ID NO: 1680899 - protein, 30 aa, Staphylococcus aureus
AIEKGYNTIISHHPLIFKGVTSLKANGYGL

SEQ ID NO: 1680900 - protein, 19 aa, Staphylococcus aureus
AIELLKKVADFEPTIESAA

SEQ ID NO: 1680901 - protein, 19 aa, Staphylococcus aureus
AISSPLLETSIVGAQGVLM

SEQ ID NO: 1680902 - protein, 17 aa, Staphylococcus aureus
AKKIGYPVIIKATAGGG

SEQ ID NO: 1680903 - protein, 23 aa, Staphylococcus aureus
AKVFYSALGFDILGFEKNAIKIG

SEQ ID NO: 1680904 - protein, 17 aa, Staphylococcus aureus
ALRYIPPEDLHQYSIDE

SEQ ID NO: 1680905 - protein, 21 aa, Staphylococcus aureus
AQKIRGIDNPKISLLNIGTEP

SEQ ID NO: 1680906 - protein, 25 aa, Staphylococcus aureus
ARENYKLLIGSIIPRPIAFVTTLNQ

SEQ ID NO: 1680907 - protein, 22 aa, Staphylococcus aureus
ARGFIIGCPVAYSMGIGFAPVR

SEQ ID NO: 1680908 - protein, 24 aa, Staphylococcus aureus
ARTKIQLLAPVIAHRKGSHEKLIE

SEQ ID NO: 1680909 - protein, 26 aa, Staphylococcus aureus
ASTYQRVFNYFKPKFMLGMTATPERS

SEQ ID NO: 1680910 - protein, 37 aa, Staphylococcus aureus
AVEKFDFNKGFKFSTYATWWIRQAITRAIADQARTIR

SEQ ID NO: 1680911 - protein, 20 aa, Staphylococcus aureus
AVELQYTFRLIQTGADGALI

SEQ ID NO: 1680912 - protein, 27 aa, Staphylococcus aureus
AVRKNLNIIQLIWNDGKYNMVEFQEEM

SEQ ID NO: 1680913 - protein, 20 aa, Staphylococcus aureus
AYDLGIRAIMFFGVPNSKDD

SEQ ID NO: 1680914 - protein, 22 aa, Staphylococcus aureus
AYVPLSEMFGYATSLRSNTQGR

SEQ ID NO: 1680915 - protein, 27 aa, Staphylococcus aureus
CDKMPDKLCLYYHIGQCLGPCVYDVDL

SEQ ID NO: 1680916 - protein, 18 aa, Staphylococcus aureus
CEYRRHFLSYKPDYAIMT

SEQ ID NO: 1680917 - protein, 19 aa, Staphylococcus aureus
CGNIYACEALFRAGVLPDK

SEQ ID NO: 1680918 - protein, 23 aa, Staphylococcus aureus
CGSPMVIKMGRYGKFMACSNFPD

SEQ ID NO: 1680919 - protein, 25 aa, Staphylococcus aureus
CINSAAIQFIPYEKLEELGYGDLIS

SEQ ID NO: 1680920 - protein, 17 aa, Staphylococcus aureus
DALDLFIELTGINFNIV

SEQ ID NO: 1680921 - protein, 20 aa, Staphylococcus aureus
DALPHLYMIGNDAIGLGAIA

SEQ ID NO: 1680922 - protein, 22 aa, Staphylococcus aureus
DALTEFVNIYGAKGLAWVKVVE

SEQ ID NO: 1680923 - protein, 27 aa, Staphylococcus aureus
DANVRAFYEFYSYLMEPWDGPTMISFC

SEQ ID NO: 1680924 - protein, 20 aa, Staphylococcus aureus
DASALRHILNKKKGLIIVGD

SEQ ID NO: 1680925 - protein, 31 aa, Staphylococcus aureus
DATLTARLIDRPIRPLFPKGYKHDVQIMNMV

SEQ ID NO: 1680926 - protein, 25 aa, Staphylococcus aureus
DDAKKGFLLDGFPRTIEQAEALNNI

SEQ ID NO: 1680927 - protein, 25 aa, Staphylococcus aureus
DDEPEYQPFIDYINDIFLQEGDITE

SEQ ID NO: 1680928 - protein, 18 aa, Staphylococcus aureus
DDQYPLLEHFEEDIAKDY

SEQ ID NO: 1680929 - protein, 19 aa, Staphylococcus aureus
DEDGYFWFQGRVDDVIMTA

SEQ ID NO: 1680930 - protein, 27 aa, Staphylococcus aureus
DEDKIEWLLPFLQQSGPTIIYVSSKKM

SEQ ID NO: 1680931 - protein, 25 aa, Staphylococcus aureus
DEMGFTQKSPRWAIAYKFPAEEVVT

SEQ ID NO: 1680932 - protein, 23 aa, Staphylococcus aureus
DFNPLYAMFDIPYSIMGHVHFRK

SEQ ID NO: 1680933 - protein, 21 aa, Staphylococcus aureus
DGLLVPFVRDCDKKNFAEIEA

SEQ ID NO: 1680934 - protein, 29 aa, Staphylococcus aureus
DGNVFQGEALLFFLGLTNSMAGFEKLVPD

SEQ ID NO: 1680935 - protein, 21 aa, Staphylococcus aureus
DGQYLVGKFPPGIKYDFEKVF

SEQ ID NO: 1680936 - protein, 23 aa, Staphylococcus aureus
DHHKAMPIIIHGDAAYPGQGINF

SEQ ID NO: 1680937 - protein, 19 aa, Staphylococcus aureus
DIALQQDVDFVIIAGDLFD

SEQ ID NO: 1680938 - protein, 22 aa, Staphylococcus aureus
DIGMLLYNYVPQQQWSEWLETY

SEQ ID NO: 1680939 - protein, 26 aa, Staphylococcus aureus
DIGTHALDLTLWMMDNYEPESVMGST

SEQ ID NO: 1680940 - protein, 18 aa, Staphylococcus aureus
DIIFLDEPTTYLDICHQL

SEQ ID NO: 1680941 - protein, 25 aa, Staphylococcus aureus
DISKQIFDLILKFADYGFPRAHAVS

SEQ ID NO: 1680942 - protein, 26 aa, Staphylococcus aureus
DITVNQLMKYIKGPDFPTGGIIQGID

SEQ ID NO: 1680943 - protein, 32 aa, Staphylococcus aureus
DKDFTVINIKKYLMNRQVGFTRKILGVLEDNN

SEQ ID NO: 1680944 - protein, 21 aa, Staphylococcus aureus
DKIFELEGDLPLFPGHGPYTT

SEQ ID NO: 1680945 - protein, 29 aa, Staphylococcus aureus
DKKEGIHYKNLLGTYLHGPILPKNYEITD

SEQ ID NO: 1680946 - protein, 25 aa, Staphylococcus aureus
DLEMSLFFELIFGEETDFYQNLLNE

SEQ ID NO: 1680947 - protein, 17 aa, Staphylococcus aureus
DLNDNKFYFMEMNTRIQ

SEQ ID NO: 1680948 - protein, 20 aa, Staphylococcus aureus
DLTIYGIFEDGSKELVFENG

SEQ ID NO: 1680949 - protein, 29 aa, Staphylococcus aureus
DMEVFDYITPEFLIKRSHLLKKAKCIIVD

SEQ ID NO: 1680950 - protein, 17 aa, Staphylococcus aureus
DMKGGLTDTFTNAFSSG

SEQ ID NO: 1680951 - protein, 20 aa, Staphylococcus aureus
DMVMMTVAELLPFGFSGKDL

SEQ ID NO: 1680952 - protein, 23 aa, Staphylococcus aureus
DNELELLPVINKIDLPAAEPERV

SEQ ID NO: 1680953 - protein, 27 aa, Staphylococcus aureus
DRARLKDIADLFLDSGLGKEAYSIISQ

SEQ ID NO: 1680954 - protein, 25 aa, Staphylococcus aureus
DSHNTFQLIKLFQKRINLGQSIVMV

SEQ ID NO: 1680955 - protein, 27 aa, Staphylococcus aureus
DSVFDIRDYFAARSLLSEAICNLDNNQ

SEQ ID NO: 1680956 - protein, 17 aa, Staphylococcus aureus
DSVILLEQIRTLDKKRL

SEQ ID NO: 1680957 - protein, 23 aa, Staphylococcus aureus
DTAPAFFEGTPGYEEQMFGQQQS

SEQ ID NO: 1680958 - protein, 27 aa, Staphylococcus aureus
DTEIERLRYLVDNDFYFNVFDIYSEAD

SEQ ID NO: 1680959 - protein, 17 aa, Staphylococcus aureus
DTGLLPHEWHYHISPRG

SEQ ID NO: 1680960 - protein, 18 aa, Staphylococcus aureus
DTHYLLGSALGPDPFPTI

SEQ ID NO: 1680961 - protein, 24 aa, Staphylococcus aureus
DTINDWLVIGYTPLSLFNPKESDF

SEQ ID NO: 1680962 - protein, 25 aa, Staphylococcus aureus
DVMAHLTMEFFTKGLVPITSLSFGY

SEQ ID NO: 1680963 - protein, 28 aa, Staphylococcus aureus
DWKEEYASFIRAQWAKLGLGLDYSRERF

SEQ ID NO: 1680964 - protein, 26 aa, Staphylococcus aureus
DWYNASYIIMWGSNVPLTRTPDAHFM

SEQ ID NO: 1680965 - protein, 20 aa, Staphylococcus aureus
DYEGWWLFSDWPENIVEKYQ

SEQ ID NO: 1680966 - protein, 29 aa, Staphylococcus aureus
DYPNQINNVLAFPGIFRGALEVEATHINE

SEQ ID NO: 1680967 - protein, 25 aa, Staphylococcus aureus
EAGYYNIPIMSYGVKYASSFFGPFR

SEQ ID NO: 1680968 - protein, 17 aa, Staphylococcus aureus
EAIAWHLSKILELEDSK

SEQ ID NO: 1680969 - protein, 19 aa, Staphylococcus aureus
EAPCYIAWSGKNRSPLIRV

SEQ ID NO: 1680970 - protein, 24 aa, Staphylococcus aureus
EEAARDVAMHIAAINPKYVSSEQV

SEQ ID NO: 1680971 - protein, 25 aa, Staphylococcus aureus
EEIEWQNYWKTFASDWLTSLNMSSE

SEQ ID NO: 1680972 - protein, 34 aa, Staphylococcus aureus
EELKRFVEAYRLLAKIILRLKAFDEFEFTIDEIG

SEQ ID NO: 1680973 - protein, 24 aa, Staphylococcus aureus
EEMAELYNFLGLTVGLNLNSKTTE

SEQ ID NO: 1680974 - protein, 21 aa, Staphylococcus aureus
EEMNHLLYCSSAGHEPGYIYR

SEQ ID NO: 1680975 - protein, 20 aa, Staphylococcus aureus
EFVENAKEKATDFIDKVKGN

SEQ ID NO: 1680976 - protein, 17 aa, Staphylococcus aureus
EGEGLSILGYRNVPVNK

SEQ ID NO: 1680977 - protein, 17 aa, Staphylococcus aureus
EGKTIDAFLAGVGTGGT

SEQ ID NO: 1680978 - protein, 23 aa, Staphylococcus aureus
EGVKEALIDLKAKGYQLGIVTSD

SEQ ID NO: 1680979 - protein, 23 aa, Staphylococcus aureus
EHERILVTPHIAFFSDEAVQNLV

SEQ ID NO: 1680980 - protein, 17 aa, Staphylococcus aureus
EHESLVTGIVYQDKETP

SEQ ID NO: 1680981 - protein, 20 aa, Staphylococcus aureus
EIAIRIFRAAAELDISTVAI

SEQ ID NO: 1680982 - protein, 24 aa, Staphylococcus aureus
EIVSLNHQILDLLSKRGELAQKIG

SEQ ID NO: 1680983 - protein, 18 aa, Staphylococcus aureus
EKRLELNAIIHPIVRDIM

SEQ ID NO: 1680984 - protein, 22 aa, Staphylococcus aureus
EKYGAFVGLFPGKDALLHISQI

SEQ ID NO: 1680985 - protein, 17 aa, Staphylococcus aureus
ELPMKYDELIVDPLSGV

SEQ ID NO: 1680986 - protein, 25 aa, Staphylococcus aureus
ELSDYLPLMLQFLQVAEWRNDPRAE

SEQ ID NO: 1680987 - protein, 17 aa, Staphylococcus aureus
EMLLPLHHLMEAGFDVD

SEQ ID NO: 1680988 - protein, 29 aa, Staphylococcus aureus
ENIDFLREGGLGLFLIESLMDEVTVYKES

SEQ ID NO: 1680989 - protein, 26 aa, Staphylococcus aureus
ENVIFIGLLCKHGHWHAVIYDIAQDK

SEQ ID NO: 1680990 - protein, 28 aa, Staphylococcus aureus
EPNDPIIHFALAEMLYYDGQYLRATSEY

SEQ ID NO: 1680991 - protein, 21 aa, Staphylococcus aureus
EQALLAQIRPEDLQAYGLIPE

SEQ ID NO: 1680992 - protein, 25 aa, Staphylococcus aureus
EQDIQRIEHMLRNALIIEDTGDNNV

SEQ ID NO: 1680993 - protein, 17 aa, Staphylococcus aureus
EQHKTIFLTDIEDMGFS

SEQ ID NO: 1680994 - protein, 24 aa, Staphylococcus aureus
ETDERQVFYFYSTSQKKLLDKITK

SEQ ID NO: 1680995 - protein, 23 aa, Staphylococcus aureus
ETTYQAKLLLQVHDELIFEVPKS

SEQ ID NO: 1680996 - protein, 22 aa, Staphylococcus aureus
ETYTIVIPPPNVTGKLHLGHAW

SEQ ID NO: 1680997 - protein, 31 aa, Staphylococcus aureus
EVIDQPNSFKPLYELELPLEQKIEKIVTEIY

SEQ ID NO: 1680998 - protein, 23 aa, Staphylococcus aureus
EVVTKLLDIELSIGRTGVVTPTA

SEQ ID NO: 1680999 - protein, 20 aa, Staphylococcus aureus
FDNRISVGVMYMLKLAHMVD

SEQ ID NO: 1681000 - protein, 25 aa, Staphylococcus aureus
FEDEFSLNAFNLYGALSMANSGPNT

SEQ ID NO: 1681001 - protein, 28 aa, Staphylococcus aureus
FEDIQGYALTPLKYKDAFIINNKFINCE

SEQ ID NO: 1681002 - protein, 22 aa, Staphylococcus aureus
FEMAELKLGLKTISFETSTSSV

SEQ ID NO: 1681003 - protein, 41 aa, Staphylococcus aureus
FEQTEVRLVLSFLRAIDNPLQDIYLVGLMRSVIYQFKEDEL

SEQ ID NO: 1681004 - protein, 20 aa, Staphylococcus aureus
FGDFPSKDFPLLTKIVDARE

SEQ ID NO: 1681005 - protein, 18 aa, Staphylococcus aureus
FGSPIKWNFTKFIIDRQG

SEQ ID NO: 1681006 - protein, 24 aa, Staphylococcus aureus
FGVGPVIEGGFYYDFDIDQNISSD

SEQ ID NO: 1681007 - protein, 18 aa, Staphylococcus aureus
FHGIGSAGFHVHFANDDR

SEQ ID NO: 1681008 - protein, 18 aa, Staphylococcus aureus
FIEKPFNLSLTIAKIQAL

SEQ ID NO: 1681009 - protein, 21 aa, Staphylococcus aureus
FKFSRLPQDINFFSWLQHVKD

SEQ ID NO: 1681010 - protein, 17 aa, Staphylococcus aureus
FLAIVKYNSFTKAAQFL

SEQ ID NO: 1681011 - protein, 20 aa, Staphylococcus aureus
FNELMVAIQSPFLLDEEDDK

SEQ ID NO: 1681012 - protein, 27 aa, Staphylococcus aureus
FNHVIARHYAIRNALRSALKALDLTLL

SEQ ID NO: 1681013 - protein, 25 aa, Staphylococcus aureus
FNYYQDHIFFLMDLHYLHDIHHPES

SEQ ID NO: 1681014 - protein, 23 aa, Staphylococcus aureus
FPGKFIIDTLNNSAIQSNFIEVD

SEQ ID NO: 1681015 - protein, 18 aa, Staphylococcus aureus
FPLTVNYEEKMYAAGKIP

SEQ ID NO: 1681016 - protein, 25 aa, Staphylococcus aureus
FSVFHDEALQPLYKDRIPVVIKNTN

SEQ ID NO: 1681017 - protein, 20 aa, Staphylococcus aureus
FYQQLFKLLEDMRVLNSIKV

SEQ ID NO: 1681018 - protein, 29 aa, Staphylococcus aureus
GADREIRLRPSYFPFTEPSVEVDVSCFKC

SEQ ID NO: 1681019 - protein, 24 aa, Staphylococcus aureus
GAGSFMVATKIKGMIAAEVSDERS

SEQ ID NO: 1681020 - protein, 23 aa, Staphylococcus aureus
GAKSILDLPKTMEYLETKGVPVI

SEQ ID NO: 1681021 - protein, 30 aa, Staphylococcus aureus
GANDVWVIKGSKEYLIPYIADVVKEVDVEN

SEQ ID NO: 1681022 - protein, 24 aa, Staphylococcus aureus
GDDVENILLRLIQAADFDIDKAEK

SEQ ID NO: 1681023 - protein, 23 aa, Staphylococcus aureus
GDRIRNWFKRYLSESEHIFIDKT

SEQ ID NO: 1681024 - protein, 24 aa, Staphylococcus aureus
GDTKVIDYCPIDQIKLSLPGVNIH

SEQ ID NO: 1681025 - protein, 28 aa, Staphylococcus aureus
GDVKDVVLLDVTPLSLGIEILGGRMNTL

SEQ ID NO: 1681026 - protein, 26 aa, Staphylococcus aureus
GEMANAMLEKLRFSKMFFSSNAVNKG

SEQ ID NO: 1681027 - protein, 25 aa, Staphylococcus aureus
GGPSGLYASFYAGLRDMSVRLIDVQ

SEQ ID NO: 1681028 - protein, 27 aa, Staphylococcus aureus
GGQLPGTKVYPWIAKTRGSTPGIGLIS

SEQ ID NO: 1681029 - protein, 30 aa, Staphylococcus aureus
GGQQAGLFGGPLYTFHKIFSIITLSKELTD

SEQ ID NO: 1681030 - protein, 19 aa, Staphylococcus aureus
GHIDAAIFNLGYLPKGDKS

SEQ ID NO: 1681031 - protein, 18 aa, Staphylococcus aureus
GHTYLPINVVIDLTVDVL

SEQ ID NO: 1681032 - protein, 20 aa, Staphylococcus aureus
GILAIDLLRRPEMTYDIILE

SEQ ID NO: 1681033 - protein, 22 aa, Staphylococcus aureus
GITFDECDIFFIGGGSDREQAL

SEQ ID NO: 1681034 - protein, 30 aa, Staphylococcus aureus
GIVGSETAFPLLYTHFVKNGDWTLQQLVDY

SEQ ID NO: 1681035 - protein, 36 aa, Staphylococcus aureus
GLHPYGATFFVFSDYLKPALRLSSIMGLNATFIFTH

SEQ ID NO: 1681036 - protein, 29 aa, Staphylococcus aureus
GLSLHEAPAHVLNYFDPKDKTLLTEGMVL

SEQ ID NO: 1681037 - protein, 20 aa, Staphylococcus aureus
GMGAALLAFCETTLTKGIDV

SEQ ID NO: 1681038 - protein, 23 aa, Staphylococcus aureus
GMGRIGRMVLRIALQNKNLNVVA

SEQ ID NO: 1681039 - protein, 19 aa, Staphylococcus aureus
GMVCPFPLIEAQKKMATLQ

SEQ ID NO: 1681040 - protein, 20 aa, Staphylococcus aureus
GMVFQQPNPFPKSIYDNITY

SEQ ID NO: 1681041 - protein, 23 aa, Staphylococcus aureus
GNKVKVIAWYDNEWGYSNRVVDV

SEQ ID NO: 1681042 - protein, 30 aa, Staphylococcus aureus
GNSLSFRAFYALPLLSNKAGIHTNAVYGFA

SEQ ID NO: 1681043 - protein, 19 aa, Staphylococcus aureus
GPATNPLFQSFFDAGVEAG

SEQ ID NO: 1681044 - protein, 19 aa, Staphylococcus aureus
GQRGFVPASLISTDFIEDF

SEQ ID NO: 1681045 - protein, 25 aa, Staphylococcus aureus
GSSGTIPGALFKLEKTHDLTEEQMI

SEQ ID NO: 1681046 - protein, 20 aa, Staphylococcus aureus
GTDNLILLGIKTRGEYLANR

SEQ ID NO: 1681047 - protein, 24 aa, Staphylococcus aureus
GTDSNFQILLYDAKHFNPYLALDN

SEQ ID NO: 1681048 - protein, 25 aa, Staphylococcus aureus
GTEPPFMNEYWNHFAKGIYVDKISG

SEQ ID NO: 1681049 - protein, 17 aa, Staphylococcus aureus
GTLGTLMAGLLKGTASI

SEQ ID NO: 1681050 - protein, 28 aa, Staphylococcus aureus
GTSVKSLPPFFYPLNELISIGQMIKNAG

SEQ ID NO: 1681051 - protein, 17 aa, Staphylococcus aureus
GVKINDPVRMYLKEIGR

SEQ ID NO: 1681052 - protein, 24 aa, Staphylococcus aureus
GVVSNIVYIRWFEDLRTAFINQHM

SEQ ID NO: 1681053 - protein, 21 aa, Staphylococcus aureus
GVYPEDDVEKWFYDTAPQRVE

SEQ ID NO: 1681054 - protein, 18 aa, Staphylococcus aureus
GYCTEMMVRFGKNKKAFD

SEQ ID NO: 1681055 - protein, 19 aa, Staphylococcus aureus
HAYLAYAGKFAGKATVLDA

SEQ ID NO: 1681056 - protein, 27 aa, Staphylococcus aureus
HDGTKLGFMSFFTKASVAALKKYPEVN

SEQ ID NO: 1681057 - protein, 30 aa, Staphylococcus aureus
HDLTEEQMIDFLFTSALFGRVVANNASVAG

SEQ ID NO: 1681058 - protein, 23 aa, Staphylococcus aureus
HDRYFLDKIVTQIYDVALGDVKR

SEQ ID NO: 1681059 - protein, 26 aa, Staphylococcus aureus
HEADGVFIYIGMKPLTAPFKDLGITN

SEQ ID NO: 1681060 - protein, 23 aa, Staphylococcus aureus
HEGKYIAYFQAFTNTHAPVEVLK

SEQ ID NO: 1681061 - protein, 23 aa, Staphylococcus aureus
HFKDIIEYFRPGDTLVLNDTRVM

SEQ ID NO: 1681062 - protein, 18 aa, Staphylococcus aureus
HFPKPTFEDIPLLDLALS

SEQ ID NO: 1681063 - protein, 17 aa, Staphylococcus aureus
HGMALRVPTKNVSLVDL

SEQ ID NO: 1681064 - protein, 17 aa, Staphylococcus aureus
HGSHFHRAPGSVGMASD

SEQ ID NO: 1681065 - protein, 18 aa, Staphylococcus aureus
HIFKLDPAKHISDDDLDA

SEQ ID NO: 1681066 - protein, 22 aa, Staphylococcus aureus
HNLFKAITLKGPCYLHYYLQGY

SEQ ID NO: 1681067 - protein, 22 aa, Staphylococcus aureus
HQGRDYFVKFNCPEFTSLCPIT

SEQ ID NO: 1681068 - protein, 24 aa, Staphylococcus aureus
HSHYKHLFALLELAKKQGVEKVYV

SEQ ID NO: 1681069 - protein, 27 aa, Staphylococcus aureus
HVTTPEWMLLPMHKGGTFGKFSTSIGL

SEQ ID NO: 1681070 - protein, 17 aa, Staphylococcus aureus
IAEHFRMMAALYPNRID

SEQ ID NO: 1681071 - protein, 23 aa, Staphylococcus aureus
IASVLYLGIVGDTGRFLFNNTSE

SEQ ID NO: 1681072 - protein, 18 aa, Staphylococcus aureus
IAYELAKFVKPKLTVANR

SEQ ID NO: 1681073 - protein, 21 aa, Staphylococcus aureus
IDKPDVILLDLGLPDKDGLCL

SEQ ID NO: 1681074 - protein, 19 aa, Staphylococcus aureus
IDPALIPFIMEKTGKTAEQ

SEQ ID NO: 1681075 - protein, 18 aa, Staphylococcus aureus
IDVEKLLCPFDGPNTKEI

SEQ ID NO: 1681076 - protein, 26 aa, Staphylococcus aureus
IEARVEEIFFEVFDVLQDLGLTKVNG

SEQ ID NO: 1681077 - protein, 30 aa, Staphylococcus aureus
IEHRRWGAPFPVIEIVKLGINKARGIEQVR

SEQ ID NO: 1681078 - protein, 34 aa, Staphylococcus aureus
IEKHTSKPYLIYMLGFMPGFPYLGGLDEQLHTPR

SEQ ID NO: 1681079 - protein, 25 aa, Staphylococcus aureus
IEMASPLGWHKYVGTAGKVIAIDGF

SEQ ID NO: 1681080 - protein, 17 aa, Staphylococcus aureus
IFTVLHAGGKFGQGGYK

SEQ ID NO: 1681081 - protein, 22 aa, Staphylococcus aureus
IFYNTLFDENAACHLAIGSAYA

SEQ ID NO: 1681082 - protein, 29 aa, Staphylococcus aureus
IGANLDPSHLWWQGIDPIAAIRILGQANA

SEQ ID NO: 1681083 - protein, 25 aa, Staphylococcus aureus
IGIHAFKLGFILNAVNRELPYHLAI

SEQ ID NO: 1681084 - protein, 17 aa, Staphylococcus aureus
IHELPFDKGLSRVCTNI

SEQ ID NO: 1681085 - protein, 26 aa, Staphylococcus aureus
IHITGTYTMPCARTLVPVKVPLDVTT

SEQ ID NO: 1681086 - protein, 19 aa, Staphylococcus aureus
IHNLLGIQPFARCFEMKEA

SEQ ID NO: 1681087 - protein, 24 aa, Staphylococcus aureus
IIHLKNIHFVGLAFNFMCFKSDAP

SEQ ID NO: 1681088 - protein, 25 aa, Staphylococcus aureus
IIKDSIADIFLQQILTRPAEHDVVA

SEQ ID NO: 1681089 - protein, 29 aa, Staphylococcus aureus
IISLDAMLHLAILSVLYELNIEIPKDVMT

SEQ ID NO: 1681090 - protein, 23 aa, Staphylococcus aureus
IKDKFEQALIDRVKKIKLGNGFD

SEQ ID NO: 1681091 - protein, 18 aa, Staphylococcus aureus
IKEMVPSFGYRLTDHEDL

SEQ ID NO: 1681092 - protein, 18 aa, Staphylococcus aureus
IKNLYASEYIWNSIKDNK

SEQ ID NO: 1681093 - protein, 28 aa, Staphylococcus aureus
IKSSYNLKCLLLKLTYRYLDNQPLNDAD

SEQ ID NO: 1681094 - protein, 33 aa, Staphylococcus aureus
ILDSGGAERLLGYGDMLYLGSGMNKPIRVQGTF

SEQ ID NO: 1681095 - protein, 18 aa, Staphylococcus aureus
ILGDDRGKIYRHLSASLA

SEQ ID NO: 1681096 - protein, 22 aa, Staphylococcus aureus
ILGQIRDAFFLAQSTGTTGTIF

SEQ ID NO: 1681097 - protein, 19 aa, Staphylococcus aureus
ILLQVLLHTSIGKKEGYID

SEQ ID NO: 1681098 - protein, 19 aa, Staphylococcus aureus
ILPIIAKSFAPFLKEKTNH

SEQ ID NO: 1681099 - protein, 26 aa, Staphylococcus aureus
IPEDWGGETIFVPLSALSGDGIDDLL

SEQ ID NO: 1681100 - protein, 19 aa, Staphylococcus aureus
ISFDIMLASYIIDPSRTIS

SEQ ID NO: 1681101 - protein, 19 aa, Staphylococcus aureus
ISKQFWAYLVKTGQLDNPD

SEQ ID NO: 1681102 - protein, 25 aa, Staphylococcus aureus
ITDDYVLTRLKTMGKLAMLMLKDLD

SEQ ID NO: 1681103 - protein, 24 aa, Staphylococcus aureus
IVEETLTLPFFSDKKAILVKNAYI

SEQ ID NO: 1681104 - protein, 24 aa, Staphylococcus aureus
IVGPGNQFVAYAKKYLFGQVGIDQ

SEQ ID NO: 1681105 - protein, 19 aa, Staphylococcus aureus
IYALCHYTLLLYNTKENEQ

SEQ ID NO: 1681106 - protein, 18 aa, Staphylococcus aureus
KALVEKLKTLIPRQQFEV

SEQ ID NO: 1681107 - protein, 20 aa, Staphylococcus aureus
KASNHQYLNSFWSHLKPVMM

SEQ ID NO: 1681108 - protein, 22 aa, Staphylococcus aureus
KDEKVLVFDLGGGTFDVSILEL

SEQ ID NO: 1681109 - protein, 19 aa, Staphylococcus aureus
KDETLFKLQRQFAYTKEEI

SEQ ID NO: 1681110 - protein, 29 aa, Staphylococcus aureus
KDGRQAIQFLKERNLGRATFLPLNVIQSR

SEQ ID NO: 1681111 - protein, 20 aa, Staphylococcus aureus
KDIAKYCDVFYIGGTKIGAL

SEQ ID NO: 1681112 - protein, 20 aa, Staphylococcus aureus
KEMYDLRLMLESFAFSRVKN

SEQ ID NO: 1681113 - protein, 28 aa, Staphylococcus aureus
KFKEQVGYPLIVRPAFTMGGTGGGICHN

SEQ ID NO: 1681114 - protein, 24 aa, Staphylococcus aureus
KGDDLQYTMTLTFEEAVFGTTKEI

SEQ ID NO: 1681115 - protein, 21 aa, Staphylococcus aureus
KGLDGSRRFLDRVWRLMVNED

SEQ ID NO: 1681116 - protein, 26 aa, Staphylococcus aureus
KIELEDKIYILFHKPTQVITSVSDDR

SEQ ID NO: 1681117 - protein, 20 aa, Staphylococcus aureus
KINYIITVDLFNEGIDIPEV

SEQ ID NO: 1681118 - protein, 25 aa, Staphylococcus aureus
KKELNDALFYFNVPAEVQDVTEGPS

SEQ ID NO: 1681119 - protein, 22 aa, Staphylococcus aureus
KKGYDIELAYEAGLLSRNEENF

SEQ ID NO: 1681120 - protein, 25 aa, Staphylococcus aureus
KKSTVPLFKTTRFNKPLIATKVKEN

SEQ ID NO: 1681121 - protein, 23 aa, Staphylococcus aureus
KKVKLMKMSIDELGPVNLNAIEQ

SEQ ID NO: 1681122 - protein, 21 aa, Staphylococcus aureus
KLLPNIPHVAIFDTAFHQTMP

SEQ ID NO: 1681123 - protein, 19 aa, Staphylococcus aureus
KLPGIGPKTAQRLAFHTLD

SEQ ID NO: 1681124 - protein, 25 aa, Staphylococcus aureus
KLRHEPLDHVLLFGPPGLGKTTLSN

SEQ ID NO: 1681125 - protein, 24 aa, Staphylococcus aureus
KMCLNLAQLIYDSGFLTGIYHGDM

SEQ ID NO: 1681126 - protein, 24 aa, Staphylococcus aureus
KNAVKFFYKYLKGINVDNIAVIGS

SEQ ID NO: 1681127 - protein, 23 aa, Staphylococcus aureus
KPEDYDALLIPGGFSPDHLRGDT

SEQ ID NO: 1681128 - protein, 20 aa, Staphylococcus aureus
KQCKNELLRYPYIESFEDVD

SEQ ID NO: 1681129 - protein, 23 aa, Staphylococcus aureus
KQSDLVIGAVLIPGAKAPRLVTE

SEQ ID NO: 1681130 - protein, 23 aa, Staphylococcus aureus
KQSKPILDFYDQKGVLKNIDGSK

SEQ ID NO: 1681131 - protein, 20 aa, Staphylococcus aureus
KRVLDMNDRALRHVNVGLGG

SEQ ID NO: 1681132 - protein, 23 aa, Staphylococcus aureus
KSTLLKALSRLLAVKEGEVFLDG

SEQ ID NO: 1681133 - protein, 19 aa, Staphylococcus aureus
KTIEGLMRKGYKYDKIKAK

SEQ ID NO: 1681134 - protein, 24 aa, Staphylococcus aureus
KTINAPMVGTFYKSPSPDEEAYVQ

SEQ ID NO: 1681135 - protein, 23 aa, Staphylococcus aureus
KTTLTEKLLYFSGAIREAGTVKG

SEQ ID NO: 1681136 - protein, 24 aa, Staphylococcus aureus
KYIEPKVAHYLPKDYVYAPIQTTK

SEQ ID NO: 1681137 - protein, 21 aa, Staphylococcus aureus
KYKVYIIDEVHMLTTGAFNAL

SEQ ID NO: 1681138 - protein, 20 aa, Staphylococcus aureus
KYPRLFENVRLALNDCWPDL

SEQ ID NO: 1681139 - protein, 24 aa, Staphylococcus aureus
LDCTSFPYKIARPGSITAAMITEI

SEQ ID NO: 1681140 - protein, 27 aa, Staphylococcus aureus
LDNQQPLPNKLYLISPILDATLSNKDI

SEQ ID NO: 1681141 - protein, 28 aa, Staphylococcus aureus
LEAQLFVVQILFQYLFSQGRLKDAKNYV

SEQ ID NO: 1681142 - protein, 20 aa, Staphylococcus aureus
LGGGERLGTLVLGRVHDDFN

SEQ ID NO: 1681143 - protein, 22 aa, Staphylococcus aureus
LGQPSYFPIPEVIGVRLVNSLP

SEQ ID NO: 1681144 - protein, 17 aa, Staphylococcus aureus
LIGMRASSDFVRHGEKK

SEQ ID NO: 1681145 - protein, 17 aa, Staphylococcus aureus
LIISFYPGYAVHPDHEA

SEQ ID NO: 1681146 - protein, 18 aa, Staphylococcus aureus
LIKIGVFGTFSAGKSSLI

SEQ ID NO: 1681147 - protein, 20 aa, Staphylococcus aureus
LKAARRWAYDVKGIEPNKAE

SEQ ID NO: 1681148 - protein, 26 aa, Staphylococcus aureus
LKELNIYRVPIDCETWIYKAINNQTE

SEQ ID NO: 1681149 - protein, 29 aa, Staphylococcus aureus
LKEWRLEDLPIIPKYMKTVVIGKTSKQFK

SEQ ID NO: 1681150 - protein, 17 aa, Staphylococcus aureus
LKMITIDDLIEYRKKLE

SEQ ID NO: 1681151 - protein, 17 aa, Staphylococcus aureus
LLNDVPSHTINYGHIID

SEQ ID NO: 1681152 - protein, 17 aa, Staphylococcus aureus
LLPLYKEVFESLIDAGA

SEQ ID NO: 1681153 - protein, 24 aa, Staphylococcus aureus
LLQQGLNVFVIQLPSGMDPDEYIG

SEQ ID NO: 1681154 - protein, 17 aa, Staphylococcus aureus
LMNLELDMLYQMIDLIN

SEQ ID NO: 1681155 - protein, 19 aa, Staphylococcus aureus
LNYPITYIEIDDHLTYHHD

SEQ ID NO: 1681156 - protein, 22 aa, Staphylococcus aureus
LPRPFFILAPMEDVTDIVFRHV

SEQ ID NO: 1681157 - protein, 19 aa, Staphylococcus aureus
LQPFNPESYVYGLFADMIE

SEQ ID NO: 1681158 - protein, 26 aa, Staphylococcus aureus
LQSFAESFMRPCQLAKMISRYMIINE

SEQ ID NO: 1681159 - protein, 30 aa, Staphylococcus aureus
LREKGAMTNVLFMTATPIPRTLAISVFGEM

SEQ ID NO: 1681160 - protein, 19 aa, Staphylococcus aureus
LREPALGPTFGIKGGATGG

SEQ ID NO: 1681161 - protein, 29 aa, Staphylococcus aureus
LRQELDLFTCLRPVRWFKGVPSPVKRPQD

SEQ ID NO: 1681162 - protein, 24 aa, Staphylococcus aureus
LSKRPFNVVMTPSDKKRMMDRKKH

SEQ ID NO: 1681163 - protein, 24 aa, Staphylococcus aureus
LSSGYYDAYYKKSQKVRTLIKNDF

SEQ ID NO: 1681164 - protein, 19 aa, Staphylococcus aureus
LSYERYLKELSHDISLMKS

SEQ ID NO: 1681165 - protein, 25 aa, Staphylococcus aureus
LTNIVLNRMRGTFTAVAVKAPGFGD

SEQ ID NO: 1681166 - protein, 18 aa, Staphylococcus aureus
LTSKLKLTPIVKKILESK

SEQ ID NO: 1681167 - protein, 21 aa, Staphylococcus aureus
LTYRPQQLYLAETILDQLMHS

SEQ ID NO: 1681168 - protein, 23 aa, Staphylococcus aureus
LVAIERLYPFPEEEIEALLAQLP

SEQ ID NO: 1681169 - protein, 19 aa, Staphylococcus aureus
LVMKPSEITPLTTIRVFEL

SEQ ID NO: 1681170 - protein, 26 aa, Staphylococcus aureus
MAGDETAIPLLLGLGLDEFSMSATSI

SEQ ID NO: 1681171 - protein, 23 aa, Staphylococcus aureus
MALAAKDIRIEAPIPGTSRVGIE

SEQ ID NO: 1681172 - protein, 33 aa, Staphylococcus aureus
MESRAHQLIIKFSSAWSFLVPEILQIDEDKIQS

SEQ ID NO: 1681173 - protein, 24 aa, Staphylococcus aureus
MGFEDYFLIVSDLIHYAKTNDVMV

SEQ ID NO: 1681174 - protein, 24 aa, Staphylococcus aureus
MGGLQERIWNPLQILNDFGTDVFK

SEQ ID NO: 1681175 - protein, 27 aa, Staphylococcus aureus
MIEMHELIQEFYYYALTKTVEGEQALT

SEQ ID NO: 1681176 - protein, 17 aa, Staphylococcus aureus
MIIYLPQEGRGIGLLNK

SEQ ID NO: 1681177 - protein, 26 aa, Staphylococcus aureus
MIQIDTTNILFILGGAFDGIEEVIKR

SEQ ID NO: 1681178 - protein, 21 aa, Staphylococcus aureus
MKSLSIPLQYLVAAALEVTDV

SEQ ID NO: 1681179 - protein, 23 aa, Staphylococcus aureus
MLRVSAIIRRRKAEIAAIMVYEA

SEQ ID NO: 1681180 - protein, 28 aa, Staphylococcus aureus
MMEKDPKMLPFQGYVLQHFELMDDGFCQ

SEQ ID NO: 1681181 - protein, 29 aa, Staphylococcus aureus
MQSAYYYNIFVQKVFLKAIDSCWLEQVDY

SEQ ID NO: 1681182 - protein, 18 aa, Staphylococcus aureus
MSLIAKRHPVDVCFVPIG

SEQ ID NO: 1681183 - protein, 18 aa, Staphylococcus aureus
MTGHLLGATGGIEAIFSA

SEQ ID NO: 1681184 - protein, 25 aa, Staphylococcus aureus
NAKRVITPLSPISIFAARNPWEGLE

SEQ ID NO: 1681185 - protein, 19 aa, Staphylococcus aureus
NALGQALLAKRMGKKKLVA

SEQ ID NO: 1681186 - protein, 27 aa, Staphylococcus aureus
NALQPSPFHWRLLDKITLSTLYEVVLP

SEQ ID NO: 1681187 - protein, 24 aa, Staphylococcus aureus
NAQNIKYILYVRQQLQAFPMCVEF

SEQ ID NO: 1681188 - protein, 18 aa, Staphylococcus aureus
NDLYYAALARSEADWIVG

SEQ ID NO: 1681189 - protein, 18 aa, Staphylococcus aureus
NDVLVKPEIRMPKVGGRV

SEQ ID NO: 1681190 - protein, 23 aa, Staphylococcus aureus
NFYNIDEQLIFVDVPGYGYAKVS

SEQ ID NO: 1681191 - protein, 21 aa, Staphylococcus aureus
NFYVPKYYVDMAKLAEARQVD

SEQ ID NO: 1681192 - protein, 29 aa, Staphylococcus aureus
NGDLLFGTIDTWLVWKLSGKAAHITDYSN

SEQ ID NO: 1681193 - protein, 18 aa, Staphylococcus aureus
NHNLDFALAIRTMMIDEQ

SEQ ID NO: 1681194 - protein, 17 aa, Staphylococcus aureus
NIDNPHKDLRRARSCNE

SEQ ID NO: 1681195 - protein, 20 aa, Staphylococcus aureus
NIPLTVFSIMEEGNIKRAVM

SEQ ID NO: 1681196 - protein, 33 aa, Staphylococcus aureus
NKLIDAVQPFVKQKLIFLVGMAGERDLTKTPEM

SEQ ID NO: 1681197 - protein, 20 aa, Staphylococcus aureus
NLLEAGMVITIEPGIYVPGV

SEQ ID NO: 1681198 - protein, 26 aa, Staphylococcus aureus
NPANLMGIRAFRKLLPNIPHVAIFDT

SEQ ID NO: 1681199 - protein, 22 aa, Staphylococcus aureus
NQFKNYLHFSPKQFRSLVSKIT

SEQ ID NO: 1681200 - protein, 24 aa, Staphylococcus aureus
NQLFQNQLLQAIADKYNKSIAQVI

SEQ ID NO: 1681201 - protein, 22 aa, Staphylococcus aureus
NSVLFEAINLQRASLRQGTHAV

SEQ ID NO: 1681202 - protein, 18 aa, Staphylococcus aureus
NVGDAIVVGNTYGRIRAM

SEQ ID NO: 1681203 - protein, 19 aa, Staphylococcus aureus
NVHASLLPKYRGGAPIHQA

SEQ ID NO: 1681204 - protein, 25 aa, Staphylococcus aureus
NVKKAWWQKFITQSPFNVGIDAAIL

SEQ ID NO: 1681205 - protein, 24 aa, Staphylococcus aureus
NVPNEPIIPFIIGDGIGPDIWKAA

SEQ ID NO: 1681206 - protein, 22 aa, Staphylococcus aureus
NYDVRKYFPSLLSYRRSELDMR

SEQ ID NO: 1681207 - protein, 19 aa, Staphylococcus aureus
PDIVLLDLVMPGMNGIEIT

SEQ ID NO: 1681208 - protein, 21 aa, Staphylococcus aureus
PDPFPTIVRDFQSVIGKEIKS

SEQ ID NO: 1681209 - protein, 22 aa, Staphylococcus aureus
PDYELITFKSGERYNMVPDHAE

SEQ ID NO: 1681210 - protein, 19 aa, Staphylococcus aureus
PEILLLDESLSALDLKLRT

SEQ ID NO: 1681211 - protein, 29 aa, Staphylococcus aureus
PELAYFEVLHEMKLIVDLMYEGGMENVRY

SEQ ID NO: 1681212 - protein, 21 aa, Staphylococcus aureus
PEPIIMVKALEILGLDKSEVA

SEQ ID NO: 1681213 - protein, 29 aa, Staphylococcus aureus
PINIWVSTPSFMEMCLLLPTLNEEQYGSL

SEQ ID NO: 1681214 - protein, 26 aa, Staphylococcus aureus
PLDTLKQLYYLSKQLKYDLYDIFFEM

SEQ ID NO: 1681215 - protein, 26 aa, Staphylococcus aureus
PPELSEQFPYIRQLLDAYHIKRYELD

SEQ ID NO: 1681216 - protein, 28 aa, Staphylococcus aureus
PTDEQWEAMLLGWKVVPSVKSNAIILSN

SEQ ID NO: 1681217 - protein, 19 aa, Staphylococcus aureus
PVNYNMMPKCIYSQPEIAS

SEQ ID NO: 1681218 - protein, 17 aa, Staphylococcus aureus
PYAFDALEPHFDKETME

SEQ ID NO: 1681219 - protein, 30 aa, Staphylococcus aureus
QAKDNSLENLLFGLGIRHLGVKASQVLAEK

SEQ ID NO: 1681220 - protein, 21 aa, Staphylococcus aureus
QEDEHYFAKSGRIKYYPLVID

SEQ ID NO: 1681221 - protein, 20 aa, Staphylococcus aureus
QFRYDHYLQLFNEISNRKVR

SEQ ID NO: 1681222 - protein, 17 aa, Staphylococcus aureus
QFTLTRFIKKHLEQQRK

SEQ ID NO: 1681223 - protein, 26 aa, Staphylococcus aureus
QGYVKVLELVGVGYRAQMQGKDLILN

SEQ ID NO: 1681224 - protein, 21 aa, Staphylococcus aureus
QILTSLFPCGSITGAPKLNTM

SEQ ID NO: 1681225 - protein, 24 aa, Staphylococcus aureus
QKRRLNQTPLHKYIKKIFISEETG

SEQ ID NO: 1681226 - protein, 22 aa, Staphylococcus aureus
QKSILINMIKCVEACGVDVLDV

SEQ ID NO: 1681227 - protein, 18 aa, Staphylococcus aureus
QLAKMISRYMIINETDRI

SEQ ID NO: 1681228 - protein, 22 aa, Staphylococcus aureus
QLDELMTFYNYKEIRTPIFEST

SEQ ID NO: 1681229 - protein, 21 aa, Staphylococcus aureus
QLNIHTVEDLVLYLPTRYEDN

SEQ ID NO: 1681230 - protein, 27 aa, Staphylococcus aureus
QQARRILDRLVGYNISPVLWKKVKKGL

SEQ ID NO: 1681231 - protein, 21 aa, Staphylococcus aureus
QQSLKLFIQFIQQQLRDNVHF

SEQ ID NO: 1681232 - protein, 24 aa, Staphylococcus aureus
QRFHDRSFINCQANQIPTVVEKVV

SEQ ID NO: 1681233 - protein, 27 aa, Staphylococcus aureus
QRSADIFLGVPFNIASYALLTHLIAKE

SEQ ID NO: 1681234 - protein, 17 aa, Staphylococcus aureus
QSIARIAQKARACGIHM

SEQ ID NO: 1681235 - protein, 24 aa, Staphylococcus aureus
QTASRLFIPLTVGGGIQSLDDITQ

SEQ ID NO: 1681236 - protein, 19 aa, Staphylococcus aureus
QTIKFKGFMTLYVETKDDS

SEQ ID NO: 1681237 - protein, 18 aa, Staphylococcus aureus
QTSIFNSISNMTAIEPKQ

SEQ ID NO: 1681238 - protein, 23 aa, Staphylococcus aureus
QYPHTVLFVTHDRYFLNEVSTRI

SEQ ID NO: 1681239 - protein, 22 aa, Staphylococcus aureus
RAEYRLLLRHDNADLRLTDMGY

SEQ ID NO: 1681240 - protein, 26 aa, Staphylococcus aureus
RDKTGLLLDPYFAGTKVKWILDNVEG

SEQ ID NO: 1681241 - protein, 17 aa, Staphylococcus aureus
RDLKAPIRMHRLLQGDV

SEQ ID NO: 1681242 - protein, 26 aa, Staphylococcus aureus
REKQKLRYLYGMTERQFRNTFDIAGK

SEQ ID NO: 1681243 - protein, 25 aa, Staphylococcus aureus
REQRTLISHLGMAGGFFIVDELEDI

SEQ ID NO: 1681244 - protein, 19 aa, Staphylococcus aureus
RFECKLSQMILLGDVLDGA

SEQ ID NO: 1681245 - protein, 25 aa, Staphylococcus aureus
RFSTNTFPSWKRAHPNRMLMHNGEI

SEQ ID NO: 1681246 - protein, 30 aa, Staphylococcus aureus
RGERMYEFLDKLISVSLPRVRDFQGVSKKA

SEQ ID NO: 1681247 - protein, 31 aa, Staphylococcus aureus
RGGDYSPSIKPWILPNFTALVNHEKIDMEFN

SEQ ID NO: 1681248 - protein, 35 aa, Staphylococcus aureus
RGSRKQHFIAEKDFFIFFRNFFTKKFQREIDINVE

SEQ ID NO: 1681249 - protein, 30 aa, Staphylococcus aureus
RIAYFKVHHPLYYYASYFTIRASDFDLITM

SEQ ID NO: 1681250 - protein, 26 aa, Staphylococcus aureus
RISKTKGLIGNLMKIKPIGTLDDGRL

SEQ ID NO: 1681251 - protein, 17 aa, Staphylococcus aureus
RKGLNALQTFLYSSEFN

SEQ ID NO: 1681252 - protein, 23 aa, Staphylococcus aureus
RKVLEFYHPEFKKEYVILAEEGA

SEQ ID NO: 1681253 - protein, 24 aa, Staphylococcus aureus
RNSSLYVHPPLFMNDFSLKAIFEG

SEQ ID NO: 1681254 - protein, 24 aa, Staphylococcus aureus
RPDLAILTMSGFLEARPRVGYYYS

SEQ ID NO: 1681255 - protein, 18 aa, Staphylococcus aureus
RPDLPASKIAQYIRKDIL

SEQ ID NO: 1681256 - protein, 25 aa, Staphylococcus aureus
RQEQVVLFLNRRGYASFMLCRDCGY

SEQ ID NO: 1681257 - protein, 23 aa, Staphylococcus aureus
RQLVGVLADLHFAPTKNAASHLL

SEQ ID NO: 1681258 - protein, 19 aa, Staphylococcus aureus
RRAKLYYLRSLRGKAARIQ

SEQ ID NO: 1681259 - protein, 27 aa, Staphylococcus aureus
RRSMQTVLYQILVDMTKLLAPILVHTA

SEQ ID NO: 1681260 - protein, 17 aa, Staphylococcus aureus
RSVIGRPETQRKTVEAL

SEQ ID NO: 1681261 - protein, 21 aa, Staphylococcus aureus
RTSRKLFIEKLKSVQYDLQNI

SEQ ID NO: 1681262 - protein, 17 aa, Staphylococcus aureus
RVCIARCLAIEPEVILM

SEQ ID NO: 1681263 - protein, 26 aa, Staphylococcus aureus
RVTVNWHHFLRPEIKFDGIDPLVKQM

SEQ ID NO: 1681264 - protein, 27 aa, Staphylococcus aureus
RYGMSLTRNTSRFYQYWLDHIDEDLAE

SEQ ID NO: 1681265 - protein, 29 aa, Staphylococcus aureus
SAPKIFRKVTELVKEQVKYITGLDVVEVN

SEQ ID NO: 1681266 - protein, 17 aa, Staphylococcus aureus
SDQLSELYFEKSQKHNT

SEQ ID NO: 1681267 - protein, 26 aa, Staphylococcus aureus
SEDQLKSVVIAYEPIWAIGTGKSSTS

SEQ ID NO: 1681268 - protein, 27 aa, Staphylococcus aureus
SEEDIYNIAYLLYNDLKDPDVPIRLIG

SEQ ID NO: 1681269 - protein, 27 aa, Staphylococcus aureus
SERVSYLYQPYNPSILRLVKQVIEASH

SEQ ID NO: 1681270 - protein, 22 aa, Staphylococcus aureus
SFDMGFIDTGYERLGFGPSTNG

SEQ ID NO: 1681271 - protein, 18 aa, Staphylococcus aureus
SFMGLPTPNIFTGCGNFH

SEQ ID NO: 1681272 - protein, 25 aa, Staphylococcus aureus
SGHGTAHYPFFKIDFERLARYCEKN

SEQ ID NO: 1681273 - protein, 23 aa, Staphylococcus aureus
SGKIRMNYIRILPGDKVTVEMSP

SEQ ID NO: 1681274 - protein, 26 aa, Staphylococcus aureus
SGVSQTQISLPFISAGENGPLHLEVN

SEQ ID NO: 1681275 - protein, 18 aa, Staphylococcus aureus
SHVLPTNRTARFTNGLSV

SEQ ID NO: 1681276 - protein, 21 aa, Staphylococcus aureus
SIIETLQPYLFEKTARKPMIL

SEQ ID NO: 1681277 - protein, 24 aa, Staphylococcus aureus
SIIGNGFAVIYLISQRLVKKSLDD

SEQ ID NO: 1681278 - protein, 22 aa, Staphylococcus aureus
SKCLVLFTSYKMMHMVQDMLNE

SEQ ID NO: 1681279 - protein, 18 aa, Staphylococcus aureus
SKDRIMQEEIFGPVVGFV

SEQ ID NO: 1681280 - protein, 40 aa, Staphylococcus aureus
SKFDGIFLVATNPVDILAYATWKFSGLPKERVIGSGTILD

SEQ ID NO: 1681281 - protein, 22 aa, Staphylococcus aureus
SKHFTISFYLTTHSIPETYGVI

SEQ ID NO: 1681282 - protein, 24 aa, Staphylococcus aureus
SKRVFNMTPYKVQIMGGIAIHKGD

SEQ ID NO: 1681283 - protein, 24 aa, Staphylococcus aureus
SMIRTNLEIPPFIQALTSIEENML

SEQ ID NO: 1681284 - protein, 26 aa, Staphylococcus aureus
SNGMQTLGVALPWAISAALVRPNTQV

SEQ ID NO: 1681285 - protein, 25 aa, Staphylococcus aureus
SPCVTYNKINTYDWFKEHLTSVDDI

SEQ ID NO: 1681286 - protein, 21 aa, Staphylococcus aureus
SPKEAYAYLEKLRSIIQYTGV

SEQ ID NO: 1681287 - protein, 21 aa, Staphylococcus aureus
SPYSLLQLKGIGPKKIEVLQQ

SEQ ID NO: 1681288 - protein, 23 aa, Staphylococcus aureus
SQRQEFIYYFHPGDMKPPLNVYF

SEQ ID NO: 1681289 - protein, 25 aa, Staphylococcus aureus
SRNINNIMVLFSLTSKLNITINGET

SEQ ID NO: 1681290 - protein, 19 aa, Staphylococcus aureus
SRNSLREWLPWVDATEQPS

SEQ ID NO: 1681291 - protein, 25 aa, Staphylococcus aureus
SSFRGLYQFIRFIDELIERGKDFGE

SEQ ID NO: 1681292 - protein, 27 aa, Staphylococcus aureus
SSKSAVTMLTLQYAKGLPNMQINAADP

SEQ ID NO: 1681293 - protein, 25 aa, Staphylococcus aureus
SVGYINYQPIPRFPGMSRDIALEVD

SEQ ID NO: 1681294 - protein, 20 aa, Staphylococcus aureus
SVLIELGLIVGKDARRRREI

SEQ ID NO: 1681295 - protein, 25 aa, Staphylococcus aureus
SYNKDKVIMILNYPNNPTGYTPTHK

SEQ ID NO: 1681296 - protein, 18 aa, Staphylococcus aureus
TATPINIWVSTPSFMEMC

SEQ ID NO: 1681297 - protein, 47 aa, Staphylococcus aureus
TDGAHIQVLLLTFFFKYMKPLVQAGRVFIALPPLYKLEKGKGKTKRV

SEQ ID NO: 1681298 - protein, 24 aa, Staphylococcus aureus
TDNGLTRLIFNVPARGMIGYTTEF

SEQ ID NO: 1681299 - protein, 23 aa, Staphylococcus aureus
TEKDFNWILKHKEKFDVEVQNVS

SEQ ID NO: 1681300 - protein, 18 aa, Staphylococcus aureus
TGSRPIEIPNFKFGKRVI

SEQ ID NO: 1681301 - protein, 19 aa, Staphylococcus aureus
THKQSMIKVVLLCGSGIGT

SEQ ID NO: 1681302 - protein, 19 aa, Staphylococcus aureus
TIDSMPYIDAERLYHFAME

SEQ ID NO: 1681303 - protein, 18 aa, Staphylococcus aureus
TIFLTDIEDMGFSKSSLD

SEQ ID NO: 1681304 - protein, 21 aa, Staphylococcus aureus
TINRFGYTIRGIYGEGSQVYG

SEQ ID NO: 1681305 - protein, 22 aa, Staphylococcus aureus
TIRLDRTYLNIPELRKRIKLVA

SEQ ID NO: 1681306 - protein, 17 aa, Staphylococcus aureus
TMARGYRREEVDAFLDD

SEQ ID NO: 1681307 - protein, 31 aa, Staphylococcus aureus
TMPEKAYLYSLPYHYYKDYGIRKYGFHGTSH

SEQ ID NO: 1681308 - protein, 18 aa, Staphylococcus aureus
TNKLRRLNQLLVENQYDV

SEQ ID NO: 1681309 - protein, 25 aa, Staphylococcus aureus
TRLSLAQMLLNEPDLLLLDEPTNHL

SEQ ID NO: 1681310 - protein, 22 aa, Staphylococcus aureus
TSLMFLITPMHDKPGLLASVLN

SEQ ID NO: 1681311 - protein, 20 aa, Staphylococcus aureus
TSYGIFAPWLNGATNCIAGG

SEQ ID NO: 1681312 - protein, 24 aa, Staphylococcus aureus
TTNGRLGFDYLIDNLADSAEGKFL

SEQ ID NO: 1681313 - protein, 34 aa, Staphylococcus aureus
TVAMGYRINNEPLLMDIAKTPHALIAGATGSGKS

SEQ ID NO: 1681314 - protein, 25 aa, Staphylococcus aureus
TVKRPYLIEYIDSFATPQGAKDTKM

SEQ ID NO: 1681315 - protein, 25 aa, Staphylococcus aureus
VAGAKYRGEFEERLKAVLKEVKESD

SEQ ID NO: 1681316 - protein, 26 aa, Staphylococcus aureus
VDQLEQPIRLEPMNTFPVIRDLQVDR

SEQ ID NO: 1681317 - protein, 18 aa, Staphylococcus aureus
VEEYLAPLKEMFAKYVPA

SEQ ID NO: 1681318 - protein, 24 aa, Staphylococcus aureus
VELAQLDYLLPRLQGHGKSLSRLG

SEQ ID NO: 1681319 - protein, 23 aa, Staphylococcus aureus
VEQVYVFDHYKDELYIIATNQFS

SEQ ID NO: 1681320 - protein, 26 aa, Staphylococcus aureus
VESKSLKLYLFSFRNHGDFHEDCMNI

SEQ ID NO: 1681321 - protein, 23 aa, Staphylococcus aureus
VGEQLMEYPPYDKGEPFYAYYKN

SEQ ID NO: 1681322 - protein, 28 aa, Staphylococcus aureus
VGQHQMWAAQFYPFKNHGQWVTSGGLGT

SEQ ID NO: 1681323 - protein, 22 aa, Staphylococcus aureus
VGTYDFTRTHYPIFGKKVGEQV

SEQ ID NO: 1681324 - protein, 31 aa, Staphylococcus aureus
VIEQPTLKFELFYFDIFTYGTSFVTLQVPRE

SEQ ID NO: 1681325 - protein, 19 aa, Staphylococcus aureus
VISGTQFIIELLGVNADQF

SEQ ID NO: 1681326 - protein, 19 aa, Staphylococcus aureus
VKKGAILVNAARGAVINTP

SEQ ID NO: 1681327 - protein, 22 aa, Staphylococcus aureus
VKSYVKHTLVFKGNFKMFYDKR

SEQ ID NO: 1681328 - protein, 24 aa, Staphylococcus aureus
VLDHRNVLGVLPTGGGKSICYQVP

SEQ ID NO: 1681329 - protein, 18 aa, Staphylococcus aureus
VLGSVSHKVAKRATIPVL

SEQ ID NO: 1681330 - protein, 25 aa, Staphylococcus aureus
VLNTFALFNINLSWIESRPLKTQLG

SEQ ID NO: 1681331 - protein, 19 aa, Staphylococcus aureus
VLPMEDINLHFNGDFHAIT

SEQ ID NO: 1681332 - protein, 28 aa, Staphylococcus aureus
VLSERLQESAFLLKNLKITLNDLRSGKE

SEQ ID NO: 1681333 - protein, 25 aa, Staphylococcus aureus
VMDGRQCVAFFTLHRGKGVAPFSDN

SEQ ID NO: 1681334 - protein, 25 aa, Staphylococcus aureus
VNKAAKFLLALYNVFIEKDCSIVEI

SEQ ID NO: 1681335 - protein, 22 aa, Staphylococcus aureus
VNPELYIIDEPFLGLDPLGIQS

SEQ ID NO: 1681336 - protein, 24 aa, Staphylococcus aureus
VNPNKFLFIVHNEGILNRAKEEFK

SEQ ID NO: 1681337 - protein, 27 aa, Staphylococcus aureus
VPHYTKQLFFEIQSRGYIPIIAHPERN

SEQ ID NO: 1681338 - protein, 24 aa, Staphylococcus aureus
VQLVDFWATWCGPCKMIAPVLEEL

SEQ ID NO: 1681339 - protein, 33 aa, Staphylococcus aureus
VQQLASINVPEARLLVISPYDKTSVADIEKAII

SEQ ID NO: 1681340 - protein, 25 aa, Staphylococcus aureus
VQQYQLPGHFAPIASYQLLEKAVET

SEQ ID NO: 1681341 - protein, 26 aa, Staphylococcus aureus
VSQPLFEGIEWIIVSLGAQGAFAKHN

SEQ ID NO: 1681342 - protein, 24 aa, Staphylococcus aureus
VTSTPVLRPLLTYDKEEIIIKSKE

SEQ ID NO: 1681343 - protein, 31 aa, Staphylococcus aureus
VVGAVVAWNFPMLLAAWKIAPAIAAGNTIVI

SEQ ID NO: 1681344 - protein, 17 aa, Staphylococcus aureus
VVLIFQYGEEIMPGGSQ

SEQ ID NO: 1681345 - protein, 17 aa, Staphylococcus aureus
VVMSPKSLLRNKTVAKP

SEQ ID NO: 1681346 - protein, 19 aa, Staphylococcus aureus
WEELMGLQSILKMPTRQII

SEQ ID NO: 1681347 - protein, 27 aa, Staphylococcus aureus
WENEWKNYFHPFRASKKFTIVPSWETY

SEQ ID NO: 1681348 - protein, 27 aa, Staphylococcus aureus
WSRRSTIFPNFIGHTFAVYDGRKHVPV

SEQ ID NO: 1681349 - protein, 17 aa, Staphylococcus aureus
WTTFNEIGPIGDGQYLV

SEQ ID NO: 1681350 - protein, 29 aa, Staphylococcus aureus
YAAFEPTLDYVISKIPRFPFDKFEKGERE

SEQ ID NO: 1681351 - protein, 27 aa, Staphylococcus aureus
YDERMPKIVIVIDELADLMMMAPQEVE

SEQ ID NO: 1681352 - protein, 24 aa, Staphylococcus aureus
YGKLGVKVWIYRGEVLPTKNTSGG

SEQ ID NO: 1681353 - protein, 25 aa, Staphylococcus aureus
YGMQMQMMTYMDIVLQNKQRLGLTD

SEQ ID NO: 1681354 - protein, 23 aa, Staphylococcus aureus
YGTKIMMSLPQYVQGVFPDFNHL

SEQ ID NO: 1681355 - protein, 25 aa, Staphylococcus aureus
YHDSKLPLEIYVELVYSIQQEMVYK

SEQ ID NO: 1681356 - protein, 23 aa, Staphylococcus aureus
YLVDLLENFVLERGIYGKRWLDD

SEQ ID NO: 1681357 - protein, 18 aa, Staphylococcus aureus
YNADPTFNDAWKKMGILG

SEQ ID NO: 1681358 - protein, 27 aa, Staphylococcus aureus
YNKKPMLVAADIYRPAAINQLQTVGKQ

SEQ ID NO: 1681359 - protein, 25 aa, Staphylococcus aureus
YNKSIAQVILRWLVERDIVVLAKSV

SEQ ID NO: 1681360 - protein, 19 aa, Staphylococcus aureus
YNQYPTKPVIREKMSRRKK

SEQ ID NO: 1681361 - protein, 23 aa, Staphylococcus aureus
YQDAIDILLPDAYGEAIDETDIK

SEQ ID NO: 1681362 - protein, 29 aa, Staphylococcus aureus
YQTNVFGIVRMMNTFVPLLEKSEQPVVVN

SEQ ID NO: 1681363 - protein, 25 aa, Staphylococcus aureus
YRASQQLLYPLYKKGKFLSIQMYNA

SEQ ID NO: 1681364 - protein, 25 aa, Staphylococcus aureus
YRDARNYLSYLYSNHLKRTSVSRKI

SEQ ID NO: 1681365 - protein, 19 aa, Staphylococcus aureus
YRFSLLVPNQAALHYFEKR

SEQ ID NO: 1681366 - protein, 21 aa, Staphylococcus aureus
YTERQGGYTRILKQGPRRGDG

SEQ ID NO: 1681367 - protein, 18 aa, Staphylococcus aureus
YVASITDAIYFAKPNMDK

SEQ ID NO: 1681368 - protein, 23 aa, Staphylococcus aureus
AAILGMHSIITRPIAIDQDTIEN

SEQ ID NO: 1681369 - protein, 18 aa, Staphylococcus aureus
AAQLSEIFANRAFEGFKV

SEQ ID NO: 1681370 - protein, 26 aa, Staphylococcus aureus
AAVDLKVILEYGESAPKIFRKVTELV

SEQ ID NO: 1681371 - protein, 30 aa, Staphylococcus aureus
ACVSEAIHLLPYNVFFVPARGGLGENVVFQ

SEQ ID NO: 1681372 - protein, 29 aa, Staphylococcus aureus
ADENEEKYLRLYAEFENYKRRIQKENEIN

SEQ ID NO: 1681373 - protein, 22 aa, Staphylococcus aureus
ADGLIFHPYLAGERAPLWNANA

SEQ ID NO: 1681374 - protein, 24 aa, Staphylococcus aureus
ADLPKVFHYFKEAHPYFDQDVVII

SEQ ID NO: 1681375 - protein, 17 aa, Staphylococcus aureus
AEDTPYIAYKLMEILEE

SEQ ID NO: 1681376 - protein, 32 aa, Staphylococcus aureus
AEGFEGYYMMKRMNAPFLLIGDPRVEGGSFYI

SEQ ID NO: 1681377 - protein, 21 aa, Staphylococcus aureus
AFNKKAPYDERMPKIVIVIDE

SEQ ID NO: 1681378 - protein, 20 aa, Staphylococcus aureus
AGDLYVVFRVKPSETFKRDG

SEQ ID NO: 1681379 - protein, 22 aa, Staphylococcus aureus
AGLKAIVVIPEGKIALGKLSQA

SEQ ID NO: 1681380 - protein, 24 aa, Staphylococcus aureus
AGTDMTFFDFPNITKGQAGTNSIT

SEQ ID NO: 1681381 - protein, 25 aa, Staphylococcus aureus
AIPFYESLNFKMRGNIFLEEGIEHI

SEQ ID NO: 1681382 - protein, 19 aa, Staphylococcus aureus
AKRHPVDVCFVPIGDNFTM

SEQ ID NO: 1681383 - protein, 17 aa, Staphylococcus aureus
AMGKIDFQLTPMNTLIE

SEQ ID NO: 1681384 - protein, 23 aa, Staphylococcus aureus
AMGRDCGDLALWAGLSVGAETIV

SEQ ID NO: 1681385 - protein, 18 aa, Staphylococcus aureus
AMNALINFTKHEGIIPAI

SEQ ID NO: 1681386 - protein, 22 aa, Staphylococcus aureus
ANAVKFLLYYDVDDAEEINIQK

SEQ ID NO: 1681387 - protein, 18 aa, Staphylococcus aureus
AQKLFGQKIHVFDIRKHE

SEQ ID NO: 1681388 - protein, 18 aa, Staphylococcus aureus
ASKIAQYIRKDILEQTHL

SEQ ID NO: 1681389 - protein, 25 aa, Staphylococcus aureus
ATRGVSPYKFLLSHGFVMDGEGKKM

SEQ ID NO: 1681390 - protein, 25 aa, Staphylococcus aureus
CTENRLPFILFSASGGARMQEGIIS

SEQ ID NO: 1681391 - protein, 17 aa, Staphylococcus aureus
DADIVAFLYRDDYYNRG

SEQ ID NO: 1681392 - protein, 24 aa, Staphylococcus aureus
DAFGAYLHMGGRIGVLTVVEGSTD

SEQ ID NO: 1681393 - protein, 21 aa, Staphylococcus aureus
DENAACHLAIGSAYAFNIQGG

SEQ ID NO: 1681394 - protein, 39 aa, Staphylococcus aureus
DEVGFMVTKIDKHGFISFTPVGGWWNQVMLSQKVTITTD

SEQ ID NO: 1681395 - protein, 27 aa, Staphylococcus aureus
DFEEMQPLYEWLGLTASLGFVDIVDYE

SEQ ID NO: 1681396 - protein, 22 aa, Staphylococcus aureus
DGIFIAVVTLDPKNRRIAAGPE

SEQ ID NO: 1681397 - protein, 21 aa, Staphylococcus aureus
DIDQFYYILEDAKHELYDEMA

SEQ ID NO: 1681398 - protein, 17 aa, Staphylococcus aureus
DITYFRDDIEHMSSLTT

SEQ ID NO: 1681399 - protein, 30 aa, Staphylococcus aureus
DKGDSRFYLSLQDELMIRFGSERLQKMMSR

SEQ ID NO: 1681400 - protein, 19 aa, Staphylococcus aureus
DLEIGLGEWITITGANGSG

SEQ ID NO: 1681401 - protein, 18 aa, Staphylococcus aureus
DLINFNIKKLRLTNIKAF

SEQ ID NO: 1681402 - protein, 24 aa, Staphylococcus aureus
DLYYNTMIELIKPLGHITTIVAFN

SEQ ID NO: 1681403 - protein, 30 aa, Staphylococcus aureus
DPTQDDILMYNYLKHFDIPTLVICTKEDKI

SEQ ID NO: 1681404 - protein, 21 aa, Staphylococcus aureus
DRLGFKRIWFTEHHNVPAFAC

SEQ ID NO: 1681405 - protein, 17 aa, Staphylococcus aureus
DVAFQYNDQYSESILSF

SEQ ID NO: 1681406 - protein, 21 aa, Staphylococcus aureus
DYFTSIKLVNAINLLLSTKHS

SEQ ID NO: 1681407 - protein, 23 aa, Staphylococcus aureus
ECKIGIMPGYIHKKGHVGVVSRS

SEQ ID NO: 1681408 - protein, 17 aa, Staphylococcus aureus
EDHVQILEKMPVQFECN

SEQ ID NO: 1681409 - protein, 22 aa, Staphylococcus aureus
EDIPFFLEVLTYDDNIPDNGSV

SEQ ID NO: 1681410 - protein, 21 aa, Staphylococcus aureus
EDLFHIRTLGFRGEALASISS

SEQ ID NO: 1681411 - protein, 24 aa, Staphylococcus aureus
EEKRCPSCHMTLKDIAHVGKFGCA

SEQ ID NO: 1681412 - protein, 17 aa, Staphylococcus aureus
EFTNLYALLIPKMNSMN

SEQ ID NO: 1681413 - protein, 26 aa, Staphylococcus aureus
EIHIQQYDYLLKRYLLNIERENDISM

SEQ ID NO: 1681414 - protein, 17 aa, Staphylococcus aureus
EKALKVIRPVYLNQSTI

SEQ ID NO: 1681415 - protein, 36 aa, Staphylococcus aureus
EKIQSSILTSIPLWKNQMAIALTLMRQRNAVAAQRA

SEQ ID NO: 1681416 - protein, 24 aa, Staphylococcus aureus
ELEYYLSEYVGRATPLTYAASYTE

SEQ ID NO: 1681417 - protein, 17 aa, Staphylococcus aureus
ELYILGVSDRIGRLFEI

SEQ ID NO: 1681418 - protein, 27 aa, Staphylococcus aureus
ENLKKYKHYVFFGNDKVFKNGKGHEME

SEQ ID NO: 1681419 - protein, 18 aa, Staphylococcus aureus
ENYVFTEVALRNKGIKIL

SEQ ID NO: 1681420 - protein, 22 aa, Staphylococcus aureus
ETDPKKFRHFQTVTFEDLSKLE

SEQ ID NO: 1681421 - protein, 26 aa, Staphylococcus aureus
EVLKEREHFAIFPASHFVTREEKLKV

SEQ ID NO: 1681422 - protein, 23 aa, Staphylococcus aureus
EVNYIMNLPVNFLKTFLPELIEK

SEQ ID NO: 1681423 - protein, 24 aa, Staphylococcus aureus
FAELCEACQLKFIGPSYQSIQKMG

SEQ ID NO: 1681424 - protein, 30 aa, Staphylococcus aureus
FDEQRQFLQPLIYIPEIQSLIWENSCGSGT

SEQ ID NO: 1681425 - protein, 27 aa, Staphylococcus aureus
FDLGPSILTMPYIFEKLFEYSKKQMSD

SEQ ID NO: 1681426 - protein, 24 aa, Staphylococcus aureus
FDQVIIDYLVAEFKKENGVDLSQD

SEQ ID NO: 1681427 - protein, 31 aa, Staphylococcus aureus
FDRDTNWLSVLPIYHISGLSVLLRAVIEGFT

SEQ ID NO: 1681428 - protein, 18 aa, Staphylococcus aureus
FDSLVEMDYYRHGGILQM

SEQ ID NO: 1681429 - protein, 25 aa, Staphylococcus aureus
FENNQYIVTWALGHLVTNATPEQYD

SEQ ID NO: 1681430 - protein, 19 aa, Staphylococcus aureus
FGMFIELPNTIEGMVHIAN

SEQ ID NO: 1681431 - protein, 17 aa, Staphylococcus aureus
FGVHLRLEYYNESDLKE

SEQ ID NO: 1681432 - protein, 19 aa, Staphylococcus aureus
FKPYYLTKALQKLKDLKLL

SEQ ID NO: 1681433 - protein, 19 aa, Staphylococcus aureus
FNELFQFIFNEYYDINFEH

SEQ ID NO: 1681434 - protein, 24 aa, Staphylococcus aureus
FPTATLLALHPLISEKIVDLSSII

SEQ ID NO: 1681435 - protein, 25 aa, Staphylococcus aureus
FSLEAPLDESLYPIIRDICQEVKVH

SEQ ID NO: 1681436 - protein, 27 aa, Staphylococcus aureus
FSTTADFLYAVLNYPLYRDGDAKDVDI

SEQ ID NO: 1681437 - protein, 17 aa, Staphylococcus aureus
FTLDDFLEQLDQVKNLG

SEQ ID NO: 1681438 - protein, 28 aa, Staphylococcus aureus
FVHLGLGYAIIPRFYYQSFHTSNLEYKK

SEQ ID NO: 1681439 - protein, 34 aa, Staphylococcus aureus
FYKSIGTGVTIPPWNFPFAIMAGTTLAPVVAGNT

SEQ ID NO: 1681440 - protein, 23 aa, Staphylococcus aureus
GAEVLGVVAIFTYGLKKADDTFS

SEQ ID NO: 1681441 - protein, 29 aa, Staphylococcus aureus
GAGKSTLLKLILGLLPLQSGEIFVEGIDF

SEQ ID NO: 1681442 - protein, 18 aa, Staphylococcus aureus
GDFLEDSHRCVEKLIHAF

SEQ ID NO: 1681443 - protein, 19 aa, Staphylococcus aureus
GDFSLYDHILDTSLLFNII

SEQ ID NO: 1681444 - protein, 27 aa, Staphylococcus aureus
GENIIELMIPVFYFYQQDDDFFNGYLD

SEQ ID NO: 1681445 - protein, 27 aa, Staphylococcus aureus
GEVGRALYNFIWDDFCDWYIEMSKIPM

SEQ ID NO: 1681446 - protein, 20 aa, Staphylococcus aureus
GFGLGLERTVAWISGVEHVR

SEQ ID NO: 1681447 - protein, 19 aa, Staphylococcus aureus
GIGLYRTEFLYMGRDQMPT

SEQ ID NO: 1681448 - protein, 24 aa, Staphylococcus aureus
GKTPYVIGGLTFANTIGATTVSIS

SEQ ID NO: 1681449 - protein, 24 aa, Staphylococcus aureus
GLFKKMHVRMMPAQEPPYTRLIDS

SEQ ID NO: 1681450 - protein, 22 aa, Staphylococcus aureus
GLKPVQRRILYAMYSSGNTHDK

SEQ ID NO: 1681451 - protein, 26 aa, Staphylococcus aureus
GRLQKDLINWFIDDQYKLFYKKQDLS

SEQ ID NO: 1681452 - protein, 18 aa, Staphylococcus aureus
GVGFRYFTQRIAMNYNIV

SEQ ID NO: 1681453 - protein, 25 aa, Staphylococcus aureus
GVGPLTITMVLNNTLLAEKMRRGID

SEQ ID NO: 1681454 - protein, 18 aa, Staphylococcus aureus
HIGNARTALFNYLYAKHY

SEQ ID NO: 1681455 - protein, 26 aa, Staphylococcus aureus
HMTIKENIVLVPKLLKWTKEEKDKRA

SEQ ID NO: 1681456 - protein, 23 aa, Staphylococcus aureus
IAPKPCHEILKDTIKQGLYFKPE

SEQ ID NO: 1681457 - protein, 18 aa, Staphylococcus aureus
IAQTINRFGYTIRGIYGE

SEQ ID NO: 1681458 - protein, 25 aa, Staphylococcus aureus
IARKHNLHATFMPKPLFGVNGSGMH

SEQ ID NO: 1681459 - protein, 21 aa, Staphylococcus aureus
IDAFGMRPYIKKKVKKYSMGM

SEQ ID NO: 1681460 - protein, 22 aa, Staphylococcus aureus
IDDLLEMIGLVAEVQELKANPK

SEQ ID NO: 1681461 - protein, 19 aa, Staphylococcus aureus
IDLTRTWEILGEIIGETAS

SEQ ID NO: 1681462 - protein, 18 aa, Staphylococcus aureus
IFHNLKSILSKRGLETAV

SEQ ID NO: 1681463 - protein, 27 aa, Staphylococcus aureus
IHDDHTFIAWLKMFLQEQLTYSDGLAM

SEQ ID NO: 1681464 - protein, 21 aa, Staphylococcus aureus
IIDDLVIYKLADDNYLLVVNA

SEQ ID NO: 1681465 - protein, 24 aa, Staphylococcus aureus
IIDKTKLIYLTYPNNPTGSTATKE

SEQ ID NO: 1681466 - protein, 17 aa, Staphylococcus aureus
IKEIVFDRGGYLYHGRV

SEQ ID NO: 1681467 - protein, 33 aa, Staphylococcus aureus
ILKDFIVRYKTMQGFYAPYVPGWDTHGLPIEQA

SEQ ID NO: 1681468 - protein, 20 aa, Staphylococcus aureus
ILMAMRPYQVYAVEALIQQA

SEQ ID NO: 1681469 - protein, 19 aa, Staphylococcus aureus
ILVQVPLPKQVSEQKILEA

SEQ ID NO: 1681470 - protein, 22 aa, Staphylococcus aureus
IMTEIPFAFFKQHVTDFDIPGE

SEQ ID NO: 1681471 - protein, 20 aa, Staphylococcus aureus
INYEVLCNLSRRLPRIYHDG

SEQ ID NO: 1681472 - protein, 25 aa, Staphylococcus aureus
IPKSWKLIAQMPFGDIREAAGEKTF

SEQ ID NO: 1681473 - protein, 19 aa, Staphylococcus aureus
IQSPFLYMKALIESIHLNI

SEQ ID NO: 1681474 - protein, 21 aa, Staphylococcus aureus
IQTDGRMKALVSITLDEAFVI

SEQ ID NO: 1681475 - protein, 31 aa, Staphylococcus aureus
IRPEDLQAYGLIPEFIGRVPIVANLETLDVT

SEQ ID NO: 1681476 - protein, 18 aa, Staphylococcus aureus
ISNLKALGFVPKYTVETG

SEQ ID NO: 1681477 - protein, 25 aa, Staphylococcus aureus
ISSGAAIYAAIQKAKELGKGKTVVT

SEQ ID NO: 1681478 - protein, 20 aa, Staphylococcus aureus
ISTGDMFRKAIKEETELGKE

SEQ ID NO: 1681479 - protein, 17 aa, Staphylococcus aureus
IVAFLYRDDYYNRGGDE

SEQ ID NO: 1681480 - protein, 27 aa, Staphylococcus aureus
IYLNNPLVIEIKKLYPFVFNTLFEAID

SEQ ID NO: 1681481 - protein, 25 aa, Staphylococcus aureus
IYTGSLYLSLISLLENRDLQAGETI

SEQ ID NO: 1681482 - protein, 26 aa, Staphylococcus aureus
KANQTEVTVFFLNGFQMKGVIEEYDK

SEQ ID NO: 1681483 - protein, 17 aa, Staphylococcus aureus
KELVDFPALVKEGAFAF

SEQ ID NO: 1681484 - protein, 25 aa, Staphylococcus aureus
KETIDPVIGLSPFQARRIAFNINIP

SEQ ID NO: 1681485 - protein, 19 aa, Staphylococcus aureus
KFDHQLLNNLPAFKNKIPS

SEQ ID NO: 1681486 - protein, 25 aa, Staphylococcus aureus
KFNKVYFARVPLLESTTIITSEKAL

SEQ ID NO: 1681487 - protein, 38 aa, Staphylococcus aureus
KGDRVFIFMSRTPELYFALLGVLKIGAIVGPLFEAFME

SEQ ID NO: 1681488 - protein, 19 aa, Staphylococcus aureus
KGLKVALPKEYLGEGVADD

SEQ ID NO: 1681489 - protein, 22 aa, Staphylococcus aureus
KHEALINGKRYPIRALMMSHMF

SEQ ID NO: 1681490 - protein, 30 aa, Staphylococcus aureus
KIAKYYDFIEIQPPALYQDLIDRELIRDTE

SEQ ID NO: 1681491 - protein, 24 aa, Staphylococcus aureus
KIRQRVMEMLLLPEQRLLYSDMVD

SEQ ID NO: 1681492 - protein, 26 aa, Staphylococcus aureus
KKDDDGIYFYYLGTAGYIEGSEKQDK

SEQ ID NO: 1681493 - protein, 28 aa, Staphylococcus aureus
KKEVVLVKQYRKPVEKPLLEIPAGKLED

SEQ ID NO: 1681494 - protein, 31 aa, Staphylococcus aureus
KLINLLIKEKPDLILLTFPTPVMSVLTEQFN

SEQ ID NO: 1681495 - protein, 21 aa, Staphylococcus aureus
KLKPYITIYAPKDGPKIFNNQ

SEQ ID NO: 1681496 - protein, 20 aa, Staphylococcus aureus
KMLQRIYGTAFFDKKELKAH

SEQ ID NO: 1681497 - protein, 24 aa, Staphylococcus aureus
KNHPKSLFIWRSNLISSSAKGQEY

SEQ ID NO: 1681498 - protein, 30 aa, Staphylococcus aureus
KNRHAKRRLTYHTFLALYQQILNDEGDLHF

SEQ ID NO: 1681499 - protein, 24 aa, Staphylococcus aureus
KQEQHALRQDYLSMIRGQVLTTFS

SEQ ID NO: 1681500 - protein, 24 aa, Staphylococcus aureus
KRKINILVGLLGQPRILILDEPTV

SEQ ID NO: 1681501 - protein, 27 aa, Staphylococcus aureus
KRNEILQLMMLEPKFAILDEIDSGLDI

SEQ ID NO: 1681502 - protein, 46 aa, Staphylococcus aureus
KRQSKVFRSRFRMLVEAQLDLLKNEDWDYLLNYDLDAEQVTLENIH

SEQ ID NO: 1681503 - protein, 29 aa, Staphylococcus aureus
KTMASITFQNYFRMYNKLAGMTGTAKTEE

SEQ ID NO: 1681504 - protein, 20 aa, Staphylococcus aureus
KVFTLPQDFTIIALTATATV

SEQ ID NO: 1681505 - protein, 25 aa, Staphylococcus aureus
KVGRIINFFSLFSKFVINIPKMLKY

SEQ ID NO: 1681506 - protein, 18 aa, Staphylococcus aureus
LCQYFYPEYVSSATLPTQ

SEQ ID NO: 1681507 - protein, 18 aa, Staphylococcus aureus
LDDIHVATMLKQAIHHAN

SEQ ID NO: 1681508 - protein, 25 aa, Staphylococcus aureus
LDGATKEFFAWGFRVGFMTFGTSDQ

SEQ ID NO: 1681509 - protein, 18 aa, Staphylococcus aureus
LFDDVCAFMVNEGHISTS

SEQ ID NO: 1681510 - protein, 27 aa, Staphylococcus aureus
LFIDSRTTIFPILGGGERLGTLVLGRV

SEQ ID NO: 1681511 - protein, 19 aa, Staphylococcus aureus
LFQFCDSQFPTGAFSHSFG

SEQ ID NO: 1681512 - protein, 17 aa, Staphylococcus aureus
LHLSDILHKRVVGQDKA

SEQ ID NO: 1681513 - protein, 17 aa, Staphylococcus aureus
LITTEIQRKWIEKFKVI

SEQ ID NO: 1681514 - protein, 19 aa, Staphylococcus aureus
LKKLIGQWEREAIRPKILL

SEQ ID NO: 1681515 - protein, 18 aa, Staphylococcus aureus
LKRTYVFELNFDALMAVS

SEQ ID NO: 1681516 - protein, 17 aa, Staphylococcus aureus
LLDTMYIRDFEGLRIDK

SEQ ID NO: 1681517 - protein, 21 aa, Staphylococcus aureus
LLYHGYQVSPYYDSLVAKVIV

SEQ ID NO: 1681518 - protein, 19 aa, Staphylococcus aureus
LRTDLPSFRPGDTLRVHVR

SEQ ID NO: 1681519 - protein, 17 aa, Staphylococcus aureus
LSHILGVELPNPSMIDE

SEQ ID NO: 1681520 - protein, 26 aa, Staphylococcus aureus
LVREHQIHMTLPSLTYYYNHKNDLAG

SEQ ID NO: 1681521 - protein, 25 aa, Staphylococcus aureus
MIAIDVKPYYQLCKAKGLLSIIDNT

SEQ ID NO: 1681522 - protein, 37 aa, Staphylococcus aureus
MKNEPEWMLDFRLKSLKLFYKMPMPQWGGDLSELNFD

SEQ ID NO: 1681523 - protein, 22 aa, Staphylococcus aureus
MLKLAYIDLNEYLKTLQLKQQQ

SEQ ID NO: 1681524 - protein, 18 aa, Staphylococcus aureus
MLLCQHLSVKPDTLKFML

SEQ ID NO: 1681525 - protein, 29 aa, Staphylococcus aureus
MTLPNKEFQLLFMLAARPKQIFTREQIIE

SEQ ID NO: 1681526 - protein, 29 aa, Staphylococcus aureus
NAEAILEELGLPYRRVILCTGDIGFSASK

SEQ ID NO: 1681527 - protein, 23 aa, Staphylococcus aureus
NAKPPVARIMDYGKFKFEQQKKE

SEQ ID NO: 1681528 - protein, 23 aa, Staphylococcus aureus
NDKSDLIYISQKGKFDAVVEDVV

SEQ ID NO: 1681529 - protein, 23 aa, Staphylococcus aureus
NEAMLTMLPIAIKEKALREYYRV

SEQ ID NO: 1681530 - protein, 21 aa, Staphylococcus aureus
NESKLGGFDWFKRKTNKKDTH

SEQ ID NO: 1681531 - protein, 23 aa, Staphylococcus aureus
NEVPDWYLDSCLKIKYMFPKAHA

SEQ ID NO: 1681532 - protein, 18 aa, Staphylococcus aureus
NGFYPLGSCTMKYNPKIN

SEQ ID NO: 1681533 - protein, 23 aa, Staphylococcus aureus
NHYDLPVFITNYPTKIKPFYMQP

SEQ ID NO: 1681534 - protein, 27 aa, Staphylococcus aureus
NIHLMNLKEQFLVKLQERAIPFELNGS

SEQ ID NO: 1681535 - protein, 18 aa, Staphylococcus aureus
NLQRITRHLLKKYQERFY

SEQ ID NO: 1681536 - protein, 29 aa, Staphylococcus aureus
NMGMSAVMNMKILINILGAFHQQYPNVTY

SEQ ID NO: 1681537 - protein, 26 aa, Staphylococcus aureus
NNTSDLPIGVIPVDSLYSPVERVNYT

SEQ ID NO: 1681538 - protein, 27 aa, Staphylococcus aureus
NPVQNVLITSWFWSHRPSHIEMAGLKT

SEQ ID NO: 1681539 - protein, 25 aa, Staphylococcus aureus
NQMRLKLTTELLLNANLLSPEQIVQ

SEQ ID NO: 1681540 - protein, 18 aa, Staphylococcus aureus
NQNWVDVENLPLILPNKN

SEQ ID NO: 1681541 - protein, 28 aa, Staphylococcus aureus
NYSEDRVMRPLHFAIIDEVDSILIDEAR

SEQ ID NO: 1681542 - protein, 17 aa, Staphylococcus aureus
PAALMFPSGNKFYDWIY

SEQ ID NO: 1681543 - protein, 26 aa, Staphylococcus aureus
PDATIFLMNAVYEFDLVREHQIHMTL

SEQ ID NO: 1681544 - protein, 19 aa, Staphylococcus aureus
PHCGYFATTKKLMRKVPGR

SEQ ID NO: 1681545 - protein, 19 aa, Staphylococcus aureus
PHHLIYEELLQQGITLGIT

SEQ ID NO: 1681546 - protein, 21 aa, Staphylococcus aureus
PLEIEEFKKIILKTIFGETEV

SEQ ID NO: 1681547 - protein, 26 aa, Staphylococcus aureus
PLGSTPYTLLDYFGDDWLVMIDESHV

SEQ ID NO: 1681548 - protein, 31 aa, Staphylococcus aureus
PQNNDIYSRPRGKFRFPMSVAYENENVEQSA

SEQ ID NO: 1681549 - protein, 18 aa, Staphylococcus aureus
PSHTINYGHIIDPESKEV

SEQ ID NO: 1681550 - protein, 19 aa, Staphylococcus aureus
PVVVRPSYVLGGRAMEIVD

SEQ ID NO: 1681551 - protein, 18 aa, Staphylococcus aureus
PYIKKKVKKYSMGMKQKL

SEQ ID NO: 1681552 - protein, 20 aa, Staphylococcus aureus
QAFYIMINAIKYPYPDSNKK

SEQ ID NO: 1681553 - protein, 25 aa, Staphylococcus aureus
QCDLELYFTSLSRKTIVYKGWLRSD

SEQ ID NO: 1681554 - protein, 24 aa, Staphylococcus aureus
QDWANMLFRMYQRYCEKKGFKVET

SEQ ID NO: 1681555 - protein, 23 aa, Staphylococcus aureus
QEIEKLILFLGDRPTINKQDVNQ

SEQ ID NO: 1681556 - protein, 23 aa, Staphylococcus aureus
QFGTMATLFPNRVDLGLGRAPGT

SEQ ID NO: 1681557 - protein, 24 aa, Staphylococcus aureus
QFIDRLDKRIYDLQLSRQIALQTA

SEQ ID NO: 1681558 - protein, 23 aa, Staphylococcus aureus
QGLDLLQEIIWNPLIENKAFNDN

SEQ ID NO: 1681559 - protein, 40 aa, Staphylococcus aureus
QGSEFPIVIMPIVKQYFRMLQRPILYTGLTRAKTSLVLLG

SEQ ID NO: 1681560 - protein, 35 aa, Staphylococcus aureus
QHISSYGLILEPKTQFYNMYRKGLLKLPNEDLGAD

SEQ ID NO: 1681561 - protein, 20 aa, Staphylococcus aureus
QHTLGDDFVAAKPAGICGCT

SEQ ID NO: 1681562 - protein, 17 aa, Staphylococcus aureus
QHYPNLLHIGFTSGTTG

SEQ ID NO: 1681563 - protein, 21 aa, Staphylococcus aureus
QKLIPDLIDKMYKRFSILTTI

SEQ ID NO: 1681564 - protein, 21 aa, Staphylococcus aureus
QQDVDFVIIAGDLFDSENRTL

SEQ ID NO: 1681565 - protein, 18 aa, Staphylococcus aureus
QSDHLFYRHDIANKALQL

SEQ ID NO: 1681566 - protein, 23 aa, Staphylococcus aureus
RAQEIDAALWGARAAYIGGFDST

SEQ ID NO: 1681567 - protein, 20 aa, Staphylococcus aureus
RFLNILVVCSSGMGTSRLLS

SEQ ID NO: 1681568 - protein, 26 aa, Staphylococcus aureus
RHENIGFGYIGFDALNYIVHHDSFKD

SEQ ID NO: 1681569 - protein, 27 aa, Staphylococcus aureus
RINNEFRFQILVKYKSEPGLLQAIQFL

SEQ ID NO: 1681570 - protein, 18 aa, Staphylococcus aureus
RIQAKVASLVTAFARVRQ

SEQ ID NO: 1681571 - protein, 28 aa, Staphylococcus aureus
RISNPYLRQMLGYFIKYVGSSSYDAPAV

SEQ ID NO: 1681572 - protein, 27 aa, Staphylococcus aureus
RLTGIQFLELFTDNLYFNISRHAIEMA

SEQ ID NO: 1681573 - protein, 27 aa, Staphylococcus aureus
RPNVAFSMISKFNLFIALGIRDAIQHF

SEQ ID NO: 1681574 - protein, 26 aa, Staphylococcus aureus
RQNPSPYMYYLNIDQPYIVGSSPESF

SEQ ID NO: 1681575 - protein, 25 aa, Staphylococcus aureus
RQVFNQIRGLSPWPVAYTTMDDTNL

SEQ ID NO: 1681576 - protein, 21 aa, Staphylococcus aureus
RRFRFTALVVVGDKNGRVGFG

SEQ ID NO: 1681577 - protein, 17 aa, Staphylococcus aureus
RRIAFNINIPKESVNKA

SEQ ID NO: 1681578 - protein, 24 aa, Staphylococcus aureus
RSDIPLARGLGSSASALVGAIYIA

SEQ ID NO: 1681579 - protein, 21 aa, Staphylococcus aureus
RTALFNYLYAKHYNGDFVIRI

SEQ ID NO: 1681580 - protein, 27 aa, Staphylococcus aureus
RYTEFILEDLNSKLYHYWALGHIHERQ

SEQ ID NO: 1681581 - protein, 20 aa, Staphylococcus aureus
SAEALKALGYKVYIGSRNDV

SEQ ID NO: 1681582 - protein, 22 aa, Staphylococcus aureus
SEIKAIYTDTFDFTKKAPLYMT

SEQ ID NO: 1681583 - protein, 26 aa, Staphylococcus aureus
SENLRNLLLQPPMKGKQILGVDPAFR

SEQ ID NO: 1681584 - protein, 19 aa, Staphylococcus aureus
SEPGLLQAIQFLDDYYHEK

SEQ ID NO: 1681585 - protein, 30 aa, Staphylococcus aureus
SGKSVCINSILMSLLYKNHPEELRLLLIDP

SEQ ID NO: 1681586 - protein, 23 aa, Staphylococcus aureus
SIARFISTIRSFHQFAIREKYAA

SEQ ID NO: 1681587 - protein, 20 aa, Staphylococcus aureus
SIENLMVYLEKRKPKYHENI

SEQ ID NO: 1681588 - protein, 20 aa, Staphylococcus aureus
SIYNYPTHQTFFSSSDKLSI

SEQ ID NO: 1681589 - protein, 17 aa, Staphylococcus aureus
SKKLRDAIPSLEKIRFV

SEQ ID NO: 1681590 - protein, 34 aa, Staphylococcus aureus
SLDAILLNARPIKIGLAALVDRGHRELPIRADFV

SEQ ID NO: 1681591 - protein, 32 aa, Staphylococcus aureus
SLQPSLDIKRMPFIGLQWIFTRTGAAASNHFE

SEQ ID NO: 1681592 - protein, 21 aa, Staphylococcus aureus
SQERRNLLKAYGAELVLTPGS

SEQ ID NO: 1681593 - protein, 25 aa, Staphylococcus aureus
SYKVAMFLVPTMIKSLLLVYNNEHT

SEQ ID NO: 1681594 - protein, 25 aa, Staphylococcus aureus
TATMPLYLNALSGKGTYLITTNDYL

SEQ ID NO: 1681595 - protein, 20 aa, Staphylococcus aureus
TFGGNPLACAASIAALDVIV

SEQ ID NO: 1681596 - protein, 23 aa, Staphylococcus aureus
THENGIPVYLGMPMGIVFEVEGK

SEQ ID NO: 1681597 - protein, 24 aa, Staphylococcus aureus
TIQRGGTFLYSARCPEFKEQEVRK

SEQ ID NO: 1681598 - protein, 25 aa, Staphylococcus aureus
TKYTVIVNDPLMRPIEACYARADEQ

SEQ ID NO: 1681599 - protein, 24 aa, Staphylococcus aureus
TQPALLTHSSALLAALKNLNPDFT

SEQ ID NO: 1681600 - protein, 24 aa, Staphylococcus aureus
TQSLLKQKYHLTLLDNYAESRYQD

SEQ ID NO: 1681601 - protein, 30 aa, Staphylococcus aureus
TRFVDGKRSLLFGPFAGFSPKFLKTGSHMD

SEQ ID NO: 1681602 - protein, 25 aa, Staphylococcus aureus
TSIATMIHLIQRKLQKNSAYLGTNG

SEQ ID NO: 1681603 - protein, 32 aa, Staphylococcus aureus
TTDPEYYKWTQWIFIQLYNKGLAYVDEVAVNW

SEQ ID NO: 1681604 - protein, 25 aa, Staphylococcus aureus
TTGQYLSPVEFRKALEDDDTVIIDA

SEQ ID NO: 1681605 - protein, 28 aa, Staphylococcus aureus
TVILGCTHYPLLYKPIYDYFGGKKTVIS

SEQ ID NO: 1681606 - protein, 25 aa, Staphylococcus aureus
VAILDDGYYLPMDKYLFVYHDQLEY

SEQ ID NO: 1681607 - protein, 19 aa, Staphylococcus aureus
VAMRFGDGIKAIFNYPSQE

SEQ ID NO: 1681608 - protein, 25 aa, Staphylococcus aureus
VARLTQFGAFIDIGGVDGLVHVSEL

SEQ ID NO: 1681609 - protein, 22 aa, Staphylococcus aureus
VASKRWIRYIHEVEEPDFLIVI

SEQ ID NO: 1681610 - protein, 27 aa, Staphylococcus aureus
VDPDVLRFFMISVHYRSPINYNLELVE

SEQ ID NO: 1681611 - protein, 26 aa, Staphylococcus aureus
VEPYIGAFIYLYFKNQPRNVTKKQIT

SEQ ID NO: 1681612 - protein, 25 aa, Staphylococcus aureus
VFGDGIYEYIRVYNGKLFTVTEHYE

SEQ ID NO: 1681613 - protein, 27 aa, Staphylococcus aureus
VGGHCLAVDPYFIIAKDPENAKLIQTG

SEQ ID NO: 1681614 - protein, 18 aa, Staphylococcus aureus
VGMMLFDEQRQFLQPLIY

SEQ ID NO: 1681615 - protein, 33 aa, Staphylococcus aureus
VGVVTQITPWNYPLLQASWKIAPALATGCSLVM

SEQ ID NO: 1681616 - protein, 23 aa, Staphylococcus aureus
VGYDSMSQIRWLSVLDLKDKTED

SEQ ID NO: 1681617 - protein, 19 aa, Staphylococcus aureus
VIAGFDFTFGKFGKGNMTV

SEQ ID NO: 1681618 - protein, 18 aa, Staphylococcus aureus
VLVPNKIKDAFLAELKEQ

SEQ ID NO: 1681619 - protein, 28 aa, Staphylococcus aureus
VMASRGSVIPLFIDKIKAGEPLTITDPD

SEQ ID NO: 1681620 - protein, 24 aa, Staphylococcus aureus
VNDKKVIPIPTKALFNPSQNKVRQ

SEQ ID NO: 1681621 - protein, 23 aa, Staphylococcus aureus
VNRSYILEAIKDSLKRLIVPSIE

SEQ ID NO: 1681622 - protein, 23 aa, Staphylococcus aureus
VPNATFMMIYDADRFGLSTLHQL

SEQ ID NO: 1681623 - protein, 18 aa, Staphylococcus aureus
VSEKVRIHTPSQMGIRKP

SEQ ID NO: 1681624 - protein, 18 aa, Staphylococcus aureus
VSELLSVFGFKVVDADKA

SEQ ID NO: 1681625 - protein, 25 aa, Staphylococcus aureus
VTIQPFGATIPYYFTGHEGPDSCCI

SEQ ID NO: 1681626 - protein, 22 aa, Staphylococcus aureus
VVAAICMYALKTAGYQSALMVP

SEQ ID NO: 1681627 - protein, 27 aa, Staphylococcus aureus
VVDADAKFIIWTTTPWTIPSNVAITVH

SEQ ID NO: 1681628 - protein, 30 aa, Staphylococcus aureus
WVISRQRVWGVPLPVFYAENGEIIMTKETV

SEQ ID NO: 1681629 - protein, 24 aa, Staphylococcus aureus
YDNKSGLYNLKLFAQVLGKGFDKA

SEQ ID NO: 1681630 - protein, 37 aa, Staphylococcus aureus
YFKQEAIEFAWEFLTSDKWMGMEPDKLYVTIHPEDME

SEQ ID NO: 1681631 - protein, 30 aa, Staphylococcus aureus
YGTTLGNSLRRILLSSLPGAAVKYIEIEGV

SEQ ID NO: 1681632 - protein, 17 aa, Staphylococcus aureus
YILEYRQLSKLQSTYVE

SEQ ID NO: 1681633 - protein, 17 aa, Staphylococcus aureus
YKGKHLLNDVPSHTINY

SEQ ID NO: 1681634 - protein, 35 aa, Staphylococcus aureus
YLQQHQCLYVKLDPYWLYHLYDKDIVPFEGREKND

SEQ ID NO: 1681635 - protein, 24 aa, Staphylococcus aureus
YLRNNILKFSLFTGEKHIVINADD

SEQ ID NO: 1681636 - protein, 24 aa, Staphylococcus aureus
YRASQMYYHELNLTTPIVNFNGAY

SEQ ID NO: 1681637 - protein, 28 aa, Staphylococcus aureus
YTAKKLNLNAVIFMPVTTPLQKVNQVKF

SEQ ID NO: 1681638 - protein, 23 aa, Staphylococcus aureus
ADAAPKRFIREFRNVDVDAYEVG

SEQ ID NO: 1681639 - protein, 26 aa, Staphylococcus aureus
ADPLGDPIILIAPTQSTFQLEQAFVN

SEQ ID NO: 1681640 - protein, 24 aa, Staphylococcus aureus
AGKTTLMKVILGYSSFQSGNFNVI

SEQ ID NO: 1681641 - protein, 18 aa, Staphylococcus aureus
AGLYDYEANYKAHLSHRQ

SEQ ID NO: 1681642 - protein, 33 aa, Staphylococcus aureus
ALKYLIEGSNFTTGWIFFINSVGEHELVSHVAL

SEQ ID NO: 1681643 - protein, 19 aa, Staphylococcus aureus
ALLDKWRTFMNLRDDVNRA

SEQ ID NO: 1681644 - protein, 17 aa, Staphylococcus aureus
ALQLEKWGVDVIEAGFP

SEQ ID NO: 1681645 - protein, 20 aa, Staphylococcus aureus
ALVPMLQRTITIAAKEGIKN

SEQ ID NO: 1681646 - protein, 24 aa, Staphylococcus aureus
ALYIKTYLPIFNQIDAKYLHDTQR

SEQ ID NO: 1681647 - protein, 19 aa, Staphylococcus aureus
AVLSMLFHMQQEQGLWYVE

SEQ ID NO: 1681648 - protein, 19 aa, Staphylococcus aureus
CSTKFAVRGLTQVAAQDLA

SEQ ID NO: 1681649 - protein, 25 aa, Staphylococcus aureus
DAYGSQLGLKYYIQQKFPQKQVFAV

SEQ ID NO: 1681650 - protein, 18 aa, Staphylococcus aureus
DFGKIKVYVGNYDFWYQS

SEQ ID NO: 1681651 - protein, 20 aa, Staphylococcus aureus
DFLEDLLIDGKIKELRRYND

SEQ ID NO: 1681652 - protein, 25 aa, Staphylococcus aureus
DGAKQFIDYLNVKGIPHLYVTNNST

SEQ ID NO: 1681653 - protein, 21 aa, Staphylococcus aureus
DHIRHLLEFKACTPIDIDQVE

SEQ ID NO: 1681654 - protein, 19 aa, Staphylococcus aureus
DKFLHLSVKETSGTKWEYI

SEQ ID NO: 1681655 - protein, 27 aa, Staphylococcus aureus
DLIPEYQHLNIFPVGRLDKDTEGLLLI

SEQ ID NO: 1681656 - protein, 20 aa, Staphylococcus aureus
DLLPNQFVLIATGSSPAELP

SEQ ID NO: 1681657 - protein, 22 aa, Staphylococcus aureus
DNPKRDWYIWQDPKPDGSEPNN

SEQ ID NO: 1681658 - protein, 24 aa, Staphylococcus aureus
DRYPKLNMIIGHWGEFIPFFLERM

SEQ ID NO: 1681659 - protein, 24 aa, Staphylococcus aureus
DTFSNIQLPFYTLSDYNELIEVAE

SEQ ID NO: 1681660 - protein, 18 aa, Staphylococcus aureus
DVLLIPAQSDILPKDVDL

SEQ ID NO: 1681661 - protein, 20 aa, Staphylococcus aureus
DVLVQTFLKAHPPGPSKRIA

SEQ ID NO: 1681662 - protein, 21 aa, Staphylococcus aureus
DVYECRFLTIATGYYGQHNTL

SEQ ID NO: 1681663 - protein, 17 aa, Staphylococcus aureus
DYFKALVAIGTIADLVS

SEQ ID NO: 1681664 - protein, 21 aa, Staphylococcus aureus
EDALRMIRCLRFQSQLSFDIA

SEQ ID NO: 1681665 - protein, 17 aa, Staphylococcus aureus
EIIMRYNDNGYETRYLA

SEQ ID NO: 1681666 - protein, 26 aa, Staphylococcus aureus
EKVRRNPYSVILFDEIEKANPQILTL

SEQ ID NO: 1681667 - protein, 23 aa, Staphylococcus aureus
EKYFKDSVLFKQVNYYIDTPDFK

SEQ ID NO: 1681668 - protein, 23 aa, Staphylococcus aureus
ELRMHGITAKILVLGVLPAKDID

SEQ ID NO: 1681669 - protein, 18 aa, Staphylococcus aureus
ELVSLAVKLVDKAAQSNL

SEQ ID NO: 1681670 - protein, 21 aa, Staphylococcus aureus
EMLEAIFFGHEEIQRLVDFQQ

SEQ ID NO: 1681671 - protein, 24 aa, Staphylococcus aureus
EMSDIILMLYREYAGMFFKSQKLI

SEQ ID NO: 1681672 - protein, 26 aa, Staphylococcus aureus
ENAQFEEVIFLLWNYRLPNEEELAHL

SEQ ID NO: 1681673 - protein, 34 aa, Staphylococcus aureus
EPHESEYQYFKKNQIIWGFLHLASSKEIVEKMQE

SEQ ID NO: 1681674 - protein, 24 aa, Staphylococcus aureus
ESLLLELNLIKQYQPRYNILLKDD

SEQ ID NO: 1681675 - protein, 24 aa, Staphylococcus aureus
ETDKFKLTVLVDMFGRETPVEVEF

SEQ ID NO: 1681676 - protein, 20 aa, Staphylococcus aureus
EYFNDALRAYGLTVKTGEFG

SEQ ID NO: 1681677 - protein, 20 aa, Staphylococcus aureus
FEGCMPFEVMAERGRKTLLF

SEQ ID NO: 1681678 - protein, 36 aa, Staphylococcus aureus
FIEDKKALFIVYANPLALGLLTPPGSFGADIVVGDT

SEQ ID NO: 1681679 - protein, 17 aa, Staphylococcus aureus
FLTLLDFSRQEVEFLLT

SEQ ID NO: 1681680 - protein, 18 aa, Staphylococcus aureus
FTETGIFSVMWSEHCSYK

SEQ ID NO: 1681681 - protein, 28 aa, Staphylococcus aureus
FTNLMTHPRYQIKKKYVAKLKGYLMREE

SEQ ID NO: 1681682 - protein, 24 aa, Staphylococcus aureus
GADAIMLITPYYNKTNQRGLVKHF

SEQ ID NO: 1681683 - protein, 27 aa, Staphylococcus aureus
GAGAAGIAIVKLLYAYGVRNMVMCDSR

SEQ ID NO: 1681684 - protein, 23 aa, Staphylococcus aureus
GAGHALYLLNQLNDDGRLIAIDQ

SEQ ID NO: 1681685 - protein, 24 aa, Staphylococcus aureus
GCRDDIMVYLMYAGLEPSMAFKIM

SEQ ID NO: 1681686 - protein, 27 aa, Staphylococcus aureus
GEDTYSFPRVWLDKDSYDFSFSGLKSA

SEQ ID NO: 1681687 - protein, 27 aa, Staphylococcus aureus
GEQVKGLYLYGPFGTGKSFILGAIANQ

SEQ ID NO: 1681688 - protein, 22 aa, Staphylococcus aureus
GGINLFPFEIYEPRFGTIFESK

SEQ ID NO: 1681689 - protein, 23 aa, Staphylococcus aureus
GKRLLELYKNYKGNITRFVAEND

SEQ ID NO: 1681690 - protein, 24 aa, Staphylococcus aureus
GLEQGLIHALTAYSKLMHIQLNVN

SEQ ID NO: 1681691 - protein, 26 aa, Staphylococcus aureus
GLSEEALIKIIPSYHALIVRSQTTVT

SEQ ID NO: 1681692 - protein, 26 aa, Staphylococcus aureus
GMIKSDFFVINKTDLAPYVGASLEQM

SEQ ID NO: 1681693 - protein, 19 aa, Staphylococcus aureus
GQSGYAAFVVFNMMFGGDP

SEQ ID NO: 1681694 - protein, 23 aa, Staphylococcus aureus
GQTHFVTELYVETIKFMSPKSQN

SEQ ID NO: 1681695 - protein, 24 aa, Staphylococcus aureus
GRLDHFFGAIQLLLKKAYYKHDVH

SEQ ID NO: 1681696 - protein, 30 aa, Staphylococcus aureus
GSGQQWYSWIHINDLIQAILFLINNESASG

SEQ ID NO: 1681697 - protein, 27 aa, Staphylococcus aureus
GTGKSHAFLLPLMQLIDSEIKEPQAIV

SEQ ID NO: 1681698 - protein, 25 aa, Staphylococcus aureus
GTSARLHPWLLKIYEKRGYEIYSEH

SEQ ID NO: 1681699 - protein, 24 aa, Staphylococcus aureus
GTSIPTCILVFKKCRQQDDNVLFI

SEQ ID NO: 1681700 - protein, 33 aa, Staphylococcus aureus
HCPGNFQRLMQLSKRLPIIPNINNQRSALYIKH

SEQ ID NO: 1681701 - protein, 20 aa, Staphylococcus aureus
HHLKKMIGDLPLKEKRKARK

SEQ ID NO: 1681702 - protein, 21 aa, Staphylococcus aureus
HHLKKRLQEQLFLVVEEGNDI

SEQ ID NO: 1681703 - protein, 17 aa, Staphylococcus aureus
HVEALLKKGIKTIMLGG

SEQ ID NO: 1681704 - protein, 19 aa, Staphylococcus aureus
HVFLSLIDQPIQSGYLPLE

SEQ ID NO: 1681705 - protein, 20 aa, Staphylococcus aureus
IEDLRIISCHIGNGASIAAI

SEQ ID NO: 1681706 - protein, 17 aa, Staphylococcus aureus
IFNNLLSKQVDGIIFLG

SEQ ID NO: 1681707 - protein, 17 aa, Staphylococcus aureus
IFRVFIIDSQALKRSID

SEQ ID NO: 1681708 - protein, 17 aa, Staphylococcus aureus
IIRACREYGIETVAVYA

SEQ ID NO: 1681709 - protein, 34 aa, Staphylococcus aureus
ILVYSNPPILPLIPDVLHRLLKKKYSFVVYDIAP

SEQ ID NO: 1681710 - protein, 23 aa, Staphylococcus aureus
INKYKGFVDLFIIDTPSVSYGGT

SEQ ID NO: 1681711 - protein, 25 aa, Staphylococcus aureus
IQEAFKDRILIPKNNLDYVPKKNKV

SEQ ID NO: 1681712 - protein, 17 aa, Staphylococcus aureus
ITLSNQLGKLYASKFDQ

SEQ ID NO: 1681713 - protein, 19 aa, Staphylococcus aureus
ITSIIFKYLQENGIESHFI

SEQ ID NO: 1681714 - protein, 17 aa, Staphylococcus aureus
IVLNEAMLTMLPIAIKE

SEQ ID NO: 1681715 - protein, 19 aa, Staphylococcus aureus
IYHQAYKKGVPQFDLKEVG

SEQ ID NO: 1681716 - protein, 30 aa, Staphylococcus aureus
KACVDLSIQYIPQRLLPDKAIDVLDITAAH

SEQ ID NO: 1681717 - protein, 17 aa, Staphylococcus aureus
KDPKRRIPYMEIVGQVH

SEQ ID NO: 1681718 - protein, 25 aa, Staphylococcus aureus
KDVIGKTVILPIVGRELPILADEYV

SEQ ID NO: 1681719 - protein, 22 aa, Staphylococcus aureus
KEGSLYPLSYYDGDWYGEDKVK

SEQ ID NO: 1681720 - protein, 23 aa, Staphylococcus aureus
KENVLASSKLWRKVVNEVSQLYP

SEQ ID NO: 1681721 - protein, 28 aa, Staphylococcus aureus
KESFIEYLLFQYRFKSRIAVWVLNYIKV

SEQ ID NO: 1681722 - protein, 21 aa, Staphylococcus aureus
KGDVALFFGLSGTGKTTLSAD

SEQ ID NO: 1681723 - protein, 37 aa, Staphylococcus aureus
KGIEPQTLKLFKVCKMRGIPIFTFINKLDRVGKEPFE

SEQ ID NO: 1681724 - protein, 35 aa, Staphylococcus aureus
KHYADDYLRRSGLNYTILHPGALTNAAGSGKIEAA

SEQ ID NO: 1681725 - protein, 23 aa, Staphylococcus aureus
KKAKDWYRALSKEEIKALEEENF

SEQ ID NO: 1681726 - protein, 35 aa, Staphylococcus aureus
KKGTDILVESLFYNTPARLKYIKSLYTELGKITDI

SEQ ID NO: 1681727 - protein, 25 aa, Staphylococcus aureus
KKHPKVLILMGVPGSYLVATDKSYI

SEQ ID NO: 1681728 - protein, 17 aa, Staphylococcus aureus
KLDTPLQAYFRINSENM

SEQ ID NO: 1681729 - protein, 28 aa, Staphylococcus aureus
KMSREEILILLTLWQKGSMTLKEMDRFV

SEQ ID NO: 1681730 - protein, 40 aa, Staphylococcus aureus
KNHPEELRLLLIDPKMVELAPYNGLPHLVAPVITDVKAAT

SEQ ID NO: 1681731 - protein, 24 aa, Staphylococcus aureus
KQRMVDAFILLYSKENDPIKQMLI

SEQ ID NO: 1681732 - protein, 18 aa, Staphylococcus aureus
KSNYILKYVFANGIAREI

SEQ ID NO: 1681733 - protein, 18 aa, Staphylococcus aureus
KYFGPYPNAYSAQETKKL

SEQ ID NO: 1681734 - protein, 27 aa, Staphylococcus aureus
LAKGLNIIGLINIQFVIAHDGVYVLEV

SEQ ID NO: 1681735 - protein, 18 aa, Staphylococcus aureus
LEFYHTILQLERTSQLEL

SEQ ID NO: 1681736 - protein, 17 aa, Staphylococcus aureus
LETIQFPYFDSDGDGIF

SEQ ID NO: 1681737 - protein, 28 aa, Staphylococcus aureus
LGGEMLSFYDWYADLPPASPQIWGEQTD

SEQ ID NO: 1681738 - protein, 23 aa, Staphylococcus aureus
LGLPEARIPLSQAVIELCLSPKS

SEQ ID NO: 1681739 - protein, 19 aa, Staphylococcus aureus
LINALLGEHILVSSPNPTT

SEQ ID NO: 1681740 - protein, 24 aa, Staphylococcus aureus
LITNKALLPRVPVDKLPNLKKIVV

SEQ ID NO: 1681741 - protein, 19 aa, Staphylococcus aureus
LKDADYVFLGTKPHDFDAL

SEQ ID NO: 1681742 - protein, 18 aa, Staphylococcus aureus
LLRYPYIESFEDVDEVIQ

SEQ ID NO: 1681743 - protein, 18 aa, Staphylococcus aureus
LMKIKPIGTLDDGRLELV

SEQ ID NO: 1681744 - protein, 22 aa, Staphylococcus aureus
LNERYTFLSEQRTDLRKAKETL

SEQ ID NO: 1681745 - protein, 26 aa, Staphylococcus aureus
LRNSDTVAVLLPATTFYLGKEDYADA

SEQ ID NO: 1681746 - protein, 21 aa, Staphylococcus aureus
LSKTEMIILEILITKKNQIVS

SEQ ID NO: 1681747 - protein, 26 aa, Staphylococcus aureus
LTEARTLKFFKYFYTHRGPVMDYTNQ

SEQ ID NO: 1681748 - protein, 30 aa, Staphylococcus aureus
LVMKQLFEHRGLPQLPYISFLRSEYEKYEH

SEQ ID NO: 1681749 - protein, 24 aa, Staphylococcus aureus
LYDSKALFKLLALESQHAGLSWLT

SEQ ID NO: 1681750 - protein, 26 aa, Staphylococcus aureus
LYKMFRERGFEIKPEIAGLMLSAIIS

SEQ ID NO: 1681751 - protein, 18 aa, Staphylococcus aureus
MIGDLPLKEKRKARKAIE

SEQ ID NO: 1681752 - protein, 28 aa, Staphylococcus aureus
MNMGFIDDMRFIMDKIPAVQRQTMLFSA

SEQ ID NO: 1681753 - protein, 18 aa, Staphylococcus aureus
MPNSYVQSIFQIDLDKLV

SEQ ID NO: 1681754 - protein, 21 aa, Staphylococcus aureus
MQRLKFHYYFIDIENSKTATH

SEQ ID NO: 1681755 - protein, 18 aa, Staphylococcus aureus
MTDYRLHKNWITPYSTRY

SEQ ID NO: 1681756 - protein, 20 aa, Staphylococcus aureus
MVEQIIRPTGLLDPKIEVRP

SEQ ID NO: 1681757 - protein, 18 aa, Staphylococcus aureus
NCIFVAQFIGSPAMNMLN

SEQ ID NO: 1681758 - protein, 22 aa, Staphylococcus aureus
NDCWPDLIFPESEIAFIVLHFG

SEQ ID NO: 1681759 - protein, 29 aa, Staphylococcus aureus
NDHRRIDLAVTKNLPRFIDVLATVLEEME

SEQ ID NO: 1681760 - protein, 23 aa, Staphylococcus aureus
NEKSYTKYLLTEGIEKITKKYGE

SEQ ID NO: 1681761 - protein, 23 aa, Staphylococcus aureus
NGVELRNRFVLAPLTHISSNDDG

SEQ ID NO: 1681762 - protein, 20 aa, Staphylococcus aureus
NIALLFEKNSTRTRAAFTVA

SEQ ID NO: 1681763 - protein, 20 aa, Staphylococcus aureus
NLRELGFDIVRFKTGTPPRV

SEQ ID NO: 1681764 - protein, 25 aa, Staphylococcus aureus
NPDLDFEFIHWLVSGVKDHEPVLDE

SEQ ID NO: 1681765 - protein, 26 aa, Staphylococcus aureus
NTNHPMLRPRKITRSGYLVITSDKGL

SEQ ID NO: 1681766 - protein, 18 aa, Staphylococcus aureus
PENLPWKELDIDIAIDAT

SEQ ID NO: 1681767 - protein, 23 aa, Staphylococcus aureus
PKQIMIYEAFGWEPPRFGHMSLI

SEQ ID NO: 1681768 - protein, 18 aa, Staphylococcus aureus
PLEWINKWKHYSSELLPK

SEQ ID NO: 1681769 - protein, 18 aa, Staphylococcus aureus
PRGVLRKFEMSRIAFREH

SEQ ID NO: 1681770 - protein, 22 aa, Staphylococcus aureus
PSPTGYLHIGNARTALFNYLYA

SEQ ID NO: 1681771 - protein, 29 aa, Staphylococcus aureus
PTNGLDIPAISWLEDFLINFDNTVIVVSH

SEQ ID NO: 1681772 - protein, 24 aa, Staphylococcus aureus
PTRVGYKFVDGKKVRIAKKSGEEI

SEQ ID NO: 1681773 - protein, 22 aa, Staphylococcus aureus
QCQKYESQLILNYTGLNIEAEI

SEQ ID NO: 1681774 - protein, 17 aa, Staphylococcus aureus
QEEIFGPVVGFVKVNDF

SEQ ID NO: 1681775 - protein, 20 aa, Staphylococcus aureus
QFIIELLGVNADQFRQLFIL

SEQ ID NO: 1681776 - protein, 18 aa, Staphylococcus aureus
QGNRFLNILVVCSSGMGT

SEQ ID NO: 1681777 - protein, 20 aa, Staphylococcus aureus
QIWIADYVLSTYGTGAIMAV

SEQ ID NO: 1681778 - protein, 28 aa, Staphylococcus aureus
QLGVVLFETLQLPVIKKTKTGYSTAVDV

SEQ ID NO: 1681779 - protein, 23 aa, Staphylococcus aureus
QLSEYILAFILDDYKKMKLSYDN

SEQ ID NO: 1681780 - protein, 22 aa, Staphylococcus aureus
QQLVDYLTIKPCETFNLEYGTL

SEQ ID NO: 1681781 - protein, 17 aa, Staphylococcus aureus
QQQISYWLERFDITENR

SEQ ID NO: 1681782 - protein, 20 aa, Staphylococcus aureus
QQRVMIARALISEPAVLVLD

SEQ ID NO: 1681783 - protein, 23 aa, Staphylococcus aureus
QTYNFKNAIIATGSRPIEIPNFK

SEQ ID NO: 1681784 - protein, 36 aa, Staphylococcus aureus
QYQPRYNILLKDDKSYPFIKITKEKYPRLLVTRTVK

SEQ ID NO: 1681785 - protein, 25 aa, Staphylococcus aureus
RATLKRLPLYYRFVSSLKSKGIDRV

SEQ ID NO: 1681786 - protein, 25 aa, Staphylococcus aureus
RDGEKLYINIFRPNKDGKFPVVMSA

SEQ ID NO: 1681787 - protein, 20 aa, Staphylococcus aureus
REHDFRWEPTILSKSIKDLK

SEQ ID NO: 1681788 - protein, 23 aa, Staphylococcus aureus
REIWQYFTVLPNIQSVGVMGDYR

SEQ ID NO: 1681789 - protein, 17 aa, Staphylococcus aureus
RIPYMEIVGQVHGTYII

SEQ ID NO: 1681790 - protein, 18 aa, Staphylococcus aureus
RNTIFYNTLFDENAACHL

SEQ ID NO: 1681791 - protein, 29 aa, Staphylococcus aureus
RSNKHYISIFINGRYIKNFMLNKAILEGY

SEQ ID NO: 1681792 - protein, 32 aa, Staphylococcus aureus
RTKTQYTDLLFLYLEHAFLSQDFFDIPSIHSD

SEQ ID NO: 1681793 - protein, 18 aa, Staphylococcus aureus
RVFKGQKMPGRMGGNTVT

SEQ ID NO: 1681794 - protein, 19 aa, Staphylococcus aureus
RVHKLITLSNQLGKLYASK

SEQ ID NO: 1681795 - protein, 25 aa, Staphylococcus aureus
RVLNEGLPLPDLIIVDGGKGHMNGV

SEQ ID NO: 1681796 - protein, 25 aa, Staphylococcus aureus
SAKERTRLRTLFPYINEASENHKKR

SEQ ID NO: 1681797 - protein, 23 aa, Staphylococcus aureus
SDEHITFIRKLTSNITLMFDGDF

SEQ ID NO: 1681798 - protein, 18 aa, Staphylococcus aureus
SEPKPQEEKKGFFARLFN

SEQ ID NO: 1681799 - protein, 30 aa, Staphylococcus aureus
SEYPYFKEGLVLFTYLHLANEEKLTQALID

SEQ ID NO: 1681800 - protein, 26 aa, Staphylococcus aureus
SGAKIAFYVAQWPMSRLQHWHSLLKA

SEQ ID NO: 1681801 - protein, 25 aa, Staphylococcus aureus
SGQPYDAVFPLLHGPNGEDGTIQGL

SEQ ID NO: 1681802 - protein, 32 aa, Staphylococcus aureus
SKKPMILFGHMSPYMIVGMIGAIKAGCGYVPV

SEQ ID NO: 1681803 - protein, 24 aa, Staphylococcus aureus
SKTRRHLIEFWMIEGEMAFTNHAE

SEQ ID NO: 1681804 - protein, 17 aa, Staphylococcus aureus
SLAGFKYNLARQMLNIG

SEQ ID NO: 1681805 - protein, 24 aa, Staphylococcus aureus
SLNPPHLKAMIPWEGLNDMYREVA

SEQ ID NO: 1681806 - protein, 31 aa, Staphylococcus aureus
SMIYVDTGAMYRALTYKYLKLNKTEDFAKLV

SEQ ID NO: 1681807 - protein, 23 aa, Staphylococcus aureus
SNNDWQCPLTIRAPFGGGVHGGL

SEQ ID NO: 1681808 - protein, 19 aa, Staphylococcus aureus
SPETYLELLQKYQINVLCC

SEQ ID NO: 1681809 - protein, 31 aa, Staphylococcus aureus
SPIRRYPDLTVHRLIRKYLIEKSMDNKEVKR

SEQ ID NO: 1681810 - protein, 24 aa, Staphylococcus aureus
SQLPEIKYYPISSGKLRRYISLEN

SEQ ID NO: 1681811 - protein, 23 aa, Staphylococcus aureus
SVKVGASVFTGFGPRIVRINNFS

SEQ ID NO: 1681812 - protein, 22 aa, Staphylococcus aureus
SYPYISFIPMTDDVELSLAGFK

SEQ ID NO: 1681813 - protein, 20 aa, Staphylococcus aureus
TCYQFNVPFVVVRAVSDLAN

SEQ ID NO: 1681814 - protein, 17 aa, Staphylococcus aureus
TDAIKWVLGEQSAKSLR

SEQ ID NO: 1681815 - protein, 29 aa, Staphylococcus aureus
TDGRFLNVGENLWGLRDWYSVDDIEEKIA

SEQ ID NO: 1681816 - protein, 26 aa, Staphylococcus aureus
TDIDYPIAIVFQASCFNEFVVKGRLS

SEQ ID NO: 1681817 - protein, 27 aa, Staphylococcus aureus
TEIVDKLVEIFWPGPLNIILKNKTSYN

SEQ ID NO: 1681818 - protein, 18 aa, Staphylococcus aureus
TFEDIPLLDLALSDEKVP

SEQ ID NO: 1681819 - protein, 29 aa, Staphylococcus aureus
TFINQRYIQSLEKIGFIDLLKSKKSYERI

SEQ ID NO: 1681820 - protein, 22 aa, Staphylococcus aureus
TGAYILSRRQLETEKSYSYLQE

SEQ ID NO: 1681821 - protein, 23 aa, Staphylococcus aureus
TGFCLWCQLAFSTYLENATQPHL

SEQ ID NO: 1681822 - protein, 18 aa, Staphylococcus aureus
TIHAIPLKMKEPLNVEVR

SEQ ID NO: 1681823 - protein, 25 aa, Staphylococcus aureus
TMICAAMAGIQFFVTGGIGGVHKGA

SEQ ID NO: 1681824 - protein, 26 aa, Staphylococcus aureus
TPYIAYKLMEILEEAGLPKGVVNFVP

SEQ ID NO: 1681825 - protein, 32 aa, Staphylococcus aureus
TPYSPQVRKLKEGFFFAALTPTLRHLGKLEAE

SEQ ID NO: 1681826 - protein, 25 aa, Staphylococcus aureus
TRIYKANVKALLPLKPQTIDMPIGK

SEQ ID NO: 1681827 - protein, 27 aa, Staphylococcus aureus
TSHSELTYLTFVYKVAAMDFIFKDDPA

SEQ ID NO: 1681828 - protein, 24 aa, Staphylococcus aureus
TSLRILDFSFYNAGIEKIYGSPII

SEQ ID NO: 1681829 - protein, 26 aa, Staphylococcus aureus
TVIKPSFFMDNFLRIAKVEDERITLP

SEQ ID NO: 1681830 - protein, 26 aa, Staphylococcus aureus
VDEGLRTLLDFRYQRHFKASKGENGQ

SEQ ID NO: 1681831 - protein, 24 aa, Staphylococcus aureus
VGGRLPGGIKIKRAKLRGERSEGM

SEQ ID NO: 1681832 - protein, 28 aa, Staphylococcus aureus
VKPDTLKFMLKVFLDLKFVTQEDGLIRI

SEQ ID NO: 1681833 - protein, 24 aa, Staphylococcus aureus
VLCKDFIIDPLQIDVAKQAGASMI

SEQ ID NO: 1681834 - protein, 17 aa, Staphylococcus aureus
VNRFRKRFDTKMTELGF

SEQ ID NO: 1681835 - protein, 23 aa, Staphylococcus aureus
VPAYLPIKNLIALVLDSLDISIF

SEQ ID NO: 1681836 - protein, 26 aa, Staphylococcus aureus
VPEEDMPYLPDGRPIDIMLNPLGVPS

SEQ ID NO: 1681837 - protein, 24 aa, Staphylococcus aureus
VPRGLPVIPEAYTPKLKRVNRKPI

SEQ ID NO: 1681838 - protein, 21 aa, Staphylococcus aureus
VRIQWRVADIKIPTSEIKNIT

SEQ ID NO: 1681839 - protein, 26 aa, Staphylococcus aureus
VSRTSGIFFMIKGDEQYIFGDCAINP

SEQ ID NO: 1681840 - protein, 32 aa, Staphylococcus aureus
VTAITGSGPAFLYHVFEQYVKAGTKLGLEKEQ

SEQ ID NO: 1681841 - protein, 18 aa, Staphylococcus aureus
VVGFIGGQTAPPGKRMGH

SEQ ID NO: 1681842 - protein, 24 aa, Staphylococcus aureus
VVGIAFIIELKYLNGIEKIKDYDV

SEQ ID NO: 1681843 - protein, 18 aa, Staphylococcus aureus
VVKQLLEDGWYVSALTRN

SEQ ID NO: 1681844 - protein, 18 aa, Staphylococcus aureus
WFIQGRIDFQIKLNGYRM

SEQ ID NO: 1681845 - protein, 19 aa, Staphylococcus aureus
YAAFVVFNMMFGGDPSSVL

SEQ ID NO: 1681846 - protein, 24 aa, Staphylococcus aureus
YDYDYKRLHLFLTLTKEDGTLAST

SEQ ID NO: 1681847 - protein, 25 aa, Staphylococcus aureus
YEKTEFELIRLFGKRGRGLYNKARG

SEQ ID NO: 1681848 - protein, 22 aa, Staphylococcus aureus
YGHIHHLFSKVNLKKIYTCLVY

SEQ ID NO: 1681849 - protein, 17 aa, Staphylococcus aureus
YGLTLMISLAKKEGQGC

SEQ ID NO: 1681850 - protein, 18 aa, Staphylococcus aureus
YKMCVLLDMHIGHIKSIM

SEQ ID NO: 1681851 - protein, 28 aa, Staphylococcus aureus
YQLNLISFNVLYTVLRPYLTSNAHIVGI

SEQ ID NO: 1681852 - protein, 26 aa, Staphylococcus aureus
YSMIEDFKVTIWYTAPTALRMLMSAG

SEQ ID NO: 1681853 - protein, 18 aa, Staphylococcus aureus
YTGILKDREVVITQSGIG

SEQ ID NO: 1681854 - protein, 24 aa, Staphylococcus aureus
YTNRIEMPYLRSPIVHHVHPQPFH

SEQ ID NO: 1681855 - protein, 22 aa, Staphylococcus aureus
AELLTFKGIPYQIKLTSADQEL

SEQ ID NO: 1681856 - protein, 25 aa, Staphylococcus aureus
AHTTQNLIIPIYGKAESLNVAIAGS

SEQ ID NO: 1681857 - protein, 22 aa, Staphylococcus aureus
AKALFDLNKNILLKGPTGSGKT

SEQ ID NO: 1681858 - protein, 17 aa, Staphylococcus aureus
ALRAQYLFESNVDYFVY

SEQ ID NO: 1681859 - protein, 27 aa, Staphylococcus aureus
AMLNEGYQFFGVLYIGAILTKDGPKVI

SEQ ID NO: 1681860 - protein, 21 aa, Staphylococcus aureus
CKKKLTLFGKGKEAVYRCVCG

SEQ ID NO: 1681861 - protein, 17 aa, Staphylococcus aureus
CSAFIPAGEERPLPTTA

SEQ ID NO: 1681862 - protein, 17 aa, Staphylococcus aureus
DDIIDIVRRVQGGQFEH

SEQ ID NO: 1681863 - protein, 26 aa, Staphylococcus aureus
DEKKPHIMPVWSIKNRALKVRDEDFE

SEQ ID NO: 1681864 - protein, 32 aa, Staphylococcus aureus
DEYIIEMLKNVKTPVFLVLNKIDLVHPDELMP

SEQ ID NO: 1681865 - protein, 26 aa, Staphylococcus aureus
DIQDDTSLHILIKKLKQQINVLTVEC

SEQ ID NO: 1681866 - protein, 22 aa, Staphylococcus aureus
DKQSIYSLRFDEMQNWLVEQGQ

SEQ ID NO: 1681867 - protein, 22 aa, Staphylococcus aureus
DLQLSRQIALQTAPQIRMIQNV

SEQ ID NO: 1681868 - protein, 23 aa, Staphylococcus aureus
DNPKYRTKILKDMYHQGVLTTSK

SEQ ID NO: 1681869 - protein, 20 aa, Staphylococcus aureus
DQKVMPFTATYQLIDQDRGI

SEQ ID NO: 1681870 - protein, 23 aa, Staphylococcus aureus
DSPEFVNESPYEKAWMVKVEISD

SEQ ID NO: 1681871 - protein, 29 aa, Staphylococcus aureus
DTLDLLNEAYILRKHYFGKKVKLNMILNA

SEQ ID NO: 1681872 - protein, 20 aa, Staphylococcus aureus
ECIYFASKNKKLVRLNYKSE

SEQ ID NO: 1681873 - protein, 22 aa, Staphylococcus aureus
EIVKTMIFKVDGEYIMVLVRGH

SEQ ID NO: 1681874 - protein, 23 aa, Staphylococcus aureus
EKYKSYFIGDWYVSGDSAYKDED

SEQ ID NO: 1681875 - protein, 17 aa, Staphylococcus aureus
ELGFTFFNYHYTAKLIK

SEQ ID NO: 1681876 - protein, 24 aa, Staphylococcus aureus
ELSALIKLLISKINGCHYCVDIHK

SEQ ID NO: 1681877 - protein, 25 aa, Staphylococcus aureus
ENGLDKGFFFEPTLIAVPDNHHKLA

SEQ ID NO: 1681878 - protein, 23 aa, Staphylococcus aureus
EPGYKSVLIALDRFVTATIEEAD

SEQ ID NO: 1681879 - protein, 18 aa, Staphylococcus aureus
EVHFVFDLSLMEIRTIYR

SEQ ID NO: 1681880 - protein, 17 aa, Staphylococcus aureus
FAMSHYHDKIKMCTGKS

SEQ ID NO: 1681881 - protein, 17 aa, Staphylococcus aureus
FIDMAYTLLNDKGETMN

SEQ ID NO: 1681882 - protein, 47 aa, Staphylococcus aureus
FKKVVKQINVPGFRKGKVPRPIFEQRFGVEALYQDAIDILLPDAYGE

SEQ ID NO: 1681883 - protein, 20 aa, Staphylococcus aureus
FRDILINECIYFASKNKKLV

SEQ ID NO: 1681884 - protein, 24 aa, Staphylococcus aureus
GAIVGFFTPELFHGVGSAGFHIHF

SEQ ID NO: 1681885 - protein, 23 aa, Staphylococcus aureus
GFTVAIPNYTSLAPMLEQLNRSF

SEQ ID NO: 1681886 - protein, 25 aa, Staphylococcus aureus
GGIPGYIMIYLVPSTSTINSMKSLI

SEQ ID NO: 1681887 - protein, 22 aa, Staphylococcus aureus
GGQWFTPVINHPEVAILGIGRI

SEQ ID NO: 1681888 - protein, 18 aa, Staphylococcus aureus
GIIIGFNVRPDSGAKRAA

SEQ ID NO: 1681889 - protein, 25 aa, Staphylococcus aureus
GVLVQTLYISVDPYMRGRMTKADSY

SEQ ID NO: 1681890 - protein, 23 aa, Staphylococcus aureus
GYRSLHIVVSIPVFLAERVEVLP

SEQ ID NO: 1681891 - protein, 18 aa, Staphylococcus aureus
IAIVSVKFDINYSLKPLK

SEQ ID NO: 1681892 - protein, 24 aa, Staphylococcus aureus
IDTKHFPIELFRKYSKDLYDTNHL

SEQ ID NO: 1681893 - protein, 19 aa, Staphylococcus aureus
IEEFYTIVKELEKFDTFTN

SEQ ID NO: 1681894 - protein, 18 aa, Staphylococcus aureus
IGFLIEHPKLYDNKSGLY

SEQ ID NO: 1681895 - protein, 20 aa, Staphylococcus aureus
IKLKIVLIHSKLSRTMSLSK

SEQ ID NO: 1681896 - protein, 17 aa, Staphylococcus aureus
IVTLIKRYQSAASLSDF

SEQ ID NO: 1681897 - protein, 21 aa, Staphylococcus aureus
IVYELPLAEVVFDFFDQLKSN

SEQ ID NO: 1681898 - protein, 21 aa, Staphylococcus aureus
IYKFKYAILEAVRKVFDYKSI

SEQ ID NO: 1681899 - protein, 27 aa, Staphylococcus aureus
IYKNRGVFILVDPYLIENLRDANGRII

SEQ ID NO: 1681900 - protein, 25 aa, Staphylococcus aureus
IYTHPINNYILNGITRIVIKKIAED

SEQ ID NO: 1681901 - protein, 17 aa, Staphylococcus aureus
IYVSLSYSYPYIVCVVD

SEQ ID NO: 1681902 - protein, 20 aa, Staphylococcus aureus
KDAKRLITQLATLYGLTADG

SEQ ID NO: 1681903 - protein, 25 aa, Staphylococcus aureus
KDARRRREILSRKLRIGHSNGKQLL

SEQ ID NO: 1681904 - protein, 35 aa, Staphylococcus aureus
KDIMHEMKKFFRPEFLNRFNGIVEFLHLDKDALQD

SEQ ID NO: 1681905 - protein, 17 aa, Staphylococcus aureus
KDNVDLAIFGPGNPLMA

SEQ ID NO: 1681906 - protein, 31 aa, Staphylococcus aureus
KFRKESLGFIFQDYSILPTLTVKENIMLPLS

SEQ ID NO: 1681907 - protein, 29 aa, Staphylococcus aureus
KFRYDLNERFIITRGLDKCLFGYTLDEWQ

SEQ ID NO: 1681908 - protein, 24 aa, Staphylococcus aureus
KHDLSYIALDGDIGCMVNGAGLAM

SEQ ID NO: 1681909 - protein, 20 aa, Staphylococcus aureus
KLHHNFVGTEHILLGLIREN

SEQ ID NO: 1681910 - protein, 23 aa, Staphylococcus aureus
KMPTRQIILNFGHYRFTDLKESG

SEQ ID NO: 1681911 - protein, 21 aa, Staphylococcus aureus
KNKFLPNFDKQSIYSLRFDEM

SEQ ID NO: 1681912 - protein, 18 aa, Staphylococcus aureus
KQHDVTVPIYLKLTSDMD

SEQ ID NO: 1681913 - protein, 24 aa, Staphylococcus aureus
KSINPNLKGQLFKLLEFSNMEESD

SEQ ID NO: 1681914 - protein, 21 aa, Staphylococcus aureus
KTLVSLLEDLNIKASLNGTEL

SEQ ID NO: 1681915 - protein, 19 aa, Staphylococcus aureus
KTPAKVGLLEYNYIVDIKP

SEQ ID NO: 1681916 - protein, 27 aa, Staphylococcus aureus
LGQKKFYALDMFPYPSGAGLHVGHPEG

SEQ ID NO: 1681917 - protein, 20 aa, Staphylococcus aureus
LIASSIMSKKIAAGADAIVL

SEQ ID NO: 1681918 - protein, 17 aa, Staphylococcus aureus
LIPVHHIAGHIYANHIE

SEQ ID NO: 1681919 - protein, 18 aa, Staphylococcus aureus
LIYKGKKPVYWSPSSESS

SEQ ID NO: 1681920 - protein, 29 aa, Staphylococcus aureus
LKHHVFTSYLRYPTVTKPMLRISLSYFHT

SEQ ID NO: 1681921 - protein, 24 aa, Staphylococcus aureus
LKNKNIALLFEKDSTRTRCAFEVA

SEQ ID NO: 1681922 - protein, 22 aa, Staphylococcus aureus
LPTLTVKENIMLPLSVQKMSKA

SEQ ID NO: 1681923 - protein, 18 aa, Staphylococcus aureus
LQFFIKNPSKHISSNEIA

SEQ ID NO: 1681924 - protein, 18 aa, Staphylococcus aureus
LSIGGPGLIHLLNGMYDA

SEQ ID NO: 1681925 - protein, 22 aa, Staphylococcus aureus
LSQDLIDKYNIQIAPLSVTFDD

SEQ ID NO: 1681926 - protein, 17 aa, Staphylococcus aureus
LVRLNYKSEAYVGVWTE

SEQ ID NO: 1681927 - protein, 17 aa, Staphylococcus aureus
MIIPSKFRYDLNERFII

SEQ ID NO: 1681928 - protein, 32 aa, Staphylococcus aureus
MTKEDFQNLILLFLESWYLKASFSQKFGAVEE

SEQ ID NO: 1681929 - protein, 23 aa, Staphylococcus aureus
NAIGTFYPFIKDDVALYGVEAAG

SEQ ID NO: 1681930 - protein, 25 aa, Staphylococcus aureus
NGYYDGITFHRVINDFMIQGGDPTA

SEQ ID NO: 1681931 - protein, 19 aa, Staphylococcus aureus
NLSVIKPVIMPVAYKHCAL

SEQ ID NO: 1681932 - protein, 17 aa, Staphylococcus aureus
NSDFTDVRFQPGQVLTV

SEQ ID NO: 1681933 - protein, 22 aa, Staphylococcus aureus
NSGVILSQLFRGFCKNIESESE

SEQ ID NO: 1681934 - protein, 24 aa, Staphylococcus aureus
NVKQYILNLIKQNKLEYGDQLPSN

SEQ ID NO: 1681935 - protein, 25 aa, Staphylococcus aureus
PENNKVLVFFVRYGGEFQLKQGFSP

SEQ ID NO: 1681936 - protein, 22 aa, Staphylococcus aureus
PETVEILSQHPYIVALKDATND

SEQ ID NO: 1681937 - protein, 22 aa, Staphylococcus aureus
PLYSDIVLPAATWYEKHDLSST

SEQ ID NO: 1681938 - protein, 20 aa, Staphylococcus aureus
PNERFGQIGVLLYSGDVTLT

SEQ ID NO: 1681939 - protein, 18 aa, Staphylococcus aureus
QIVTKCGIILPSKQFDFT

SEQ ID NO: 1681940 - protein, 26 aa, Staphylococcus aureus
QKFRAKQIFEWLYQKRVDSIDEMTNL

SEQ ID NO: 1681941 - protein, 22 aa, Staphylococcus aureus
QLEIQYDLDITRWSELEEIKEQ

SEQ ID NO: 1681942 - protein, 26 aa, Staphylococcus aureus
QTRAEWLMLDVFQWTRTDFVVHMHDD

SEQ ID NO: 1681943 - protein, 18 aa, Staphylococcus aureus
QYQLPLFMDGARLGYGLM

SEQ ID NO: 1681944 - protein, 18 aa, Staphylococcus aureus
REGLPLRSEYHEQYLKDA

SEQ ID NO: 1681945 - protein, 25 aa, Staphylococcus aureus
REQMRRYHRAFKDSGLKYNISYASK

SEQ ID NO: 1681946 - protein, 20 aa, Staphylococcus aureus
RFIEMIQYFKEKITEGDMFQ

SEQ ID NO: 1681947 - protein, 25 aa, Staphylococcus aureus
RGSVPYTVFIDPPLSRVGLTSKEAA

SEQ ID NO: 1681948 - protein, 38 aa, Staphylococcus aureus; identical to SEQ ID NO: 1593980

SEQ ID NO: 1681949 - protein, 22 aa, Staphylococcus aureus
RKRGQFINMDYLDDIRVNIVYE

SEQ ID NO: 1681950 - protein, 18 aa, Staphylococcus aureus
RLYIKLSTTERAPYPYRL

SEQ ID NO: 1681951 - protein, 22 aa, Staphylococcus aureus
RQKSFFDFYLKEENNDWKDTPH

SEQ ID NO: 1681952 - protein, 25 aa, Staphylococcus aureus
RSKDKPLSLFIDKPEDWKLYGDNQN

SEQ ID NO: 1681953 - protein, 34 aa, Staphylococcus aureus
SDAKKSTPIKVYLNGNFEGITYPESFKVFGSEQS

SEQ ID NO: 1681954 - protein, 19 aa, Staphylococcus aureus
SELKNRIPLVLEVKSDQYQ

SEQ ID NO: 1681955 - protein, 23 aa, Staphylococcus aureus
SGRPLFERNLKLIKYAYQQTNGE

SEQ ID NO: 1681956 - protein, 26 aa, Staphylococcus aureus
SIDALYQFLFEFIFDIEERYIRMYVQ

SEQ ID NO: 1681957 - protein, 24 aa, Staphylococcus aureus
SIKAIILSFAYDKNKFKVIGPFVA

SEQ ID NO: 1681958 - protein, 25 aa, Staphylococcus aureus
STEKQWDLLHLLEKELQQLGLPTDL

SEQ ID NO: 1681959 - protein, 17 aa, Staphylococcus aureus
SVIGWRTIDDTEQMMNI

SEQ ID NO: 1681960 - protein, 21 aa, Staphylococcus aureus
TAFSMYPKLWENMGLSYPELI

SEQ ID NO: 1681961 - protein, 19 aa, Staphylococcus aureus
THFDNWFSETSLYEKGEIL

SEQ ID NO: 1681962 - protein, 17 aa, Staphylococcus aureus
TLMSDIVYIPYKTPILE

SEQ ID NO: 1681963 - protein, 27 aa, Staphylococcus aureus
TNGVSYLAVTQWWVASLNPPHLKAMIP

SEQ ID NO: 1681964 - protein, 19 aa, Staphylococcus aureus
TSFQLHYLAVHQDVLLTRY

SEQ ID NO: 1681965 - protein, 25 aa, Staphylococcus aureus
TVVVVPDYQLSLAIGKRGQNARLAA

SEQ ID NO: 1681966 - protein, 23 aa, Staphylococcus aureus
VGSKAPYNLKWSKGAYFNAKIDG

SEQ ID NO: 1681967 - protein, 26 aa, Staphylococcus aureus
VKGEHQLPLFRYLTAAQHGFFNEKIK

SEQ ID NO: 1681968 - protein, 24 aa, Staphylococcus aureus
VKQLYSPVQFINSTEWLIDQGVDH

SEQ ID NO: 1681969 - protein, 20 aa, Staphylococcus aureus
VKRELYDGRGFLSCSRILGE

SEQ ID NO: 1681970 - protein, 18 aa, Staphylococcus aureus
VLIDHSKFNKVYFARVPL

SEQ ID NO: 1681971 - protein, 23 aa, Staphylococcus aureus
VNQYAVFQYPPYDITLSTKIAEV

SEQ ID NO: 1681972 - protein, 26 aa, Staphylococcus aureus
VQETEVINVFPIRFIVDKENEVSDPK

SEQ ID NO: 1681973 - protein, 27 aa, Staphylococcus aureus
VQKNQFPWVVAAFPSKAWAKRVYPELS

SEQ ID NO: 1681974 - protein, 17 aa, Staphylococcus aureus
VSQQYLPDKLKNKIYYE

SEQ ID NO: 1681975 - protein, 30 aa, Staphylococcus aureus
VVSQFLTKDLFIDWTWGEKFFRKHLIDYDA

SEQ ID NO: 1681976 - protein, 25 aa, Staphylococcus aureus
WGERSGLTLFLPHAYEGQGPEHSSA

SEQ ID NO: 1681977 - protein, 29 aa, Staphylococcus aureus
YANHIEEPLTFPLIALIVSGGHTELVYMK

SEQ ID NO: 1681978 - protein, 20 aa, Staphylococcus aureus
YKGLTYKLEAFRGKVILVVN

SEQ ID NO: 1681979 - protein, 26 aa, Staphylococcus aureus
ADELYHLFVLMHALGVDFSEIEAELA

SEQ ID NO: 1681980 - protein, 26 aa, Staphylococcus aureus
AEVIERLRPFLLRDGGDCSLIDVEDG

SEQ ID NO: 1681981 - protein, 18 aa, Staphylococcus aureus
AFQELLPVLTAHQARVMN

SEQ ID NO: 1681982 - protein, 19 aa, Staphylococcus aureus
ARLRWYQGRYIDFDGWYGY

SEQ ID NO: 1681983 - protein, 19 aa, Staphylococcus aureus
ASGLSYHVLTMLRIAKSIC

SEQ ID NO: 1681984 - protein, 19 aa, Staphylococcus aureus
ASYAERVIFIKDGRLYHEI

SEQ ID NO: 1681985 - protein, 30 aa, Staphylococcus aureus
CLLTEARIFKFYKYFYSHRGPLLDYFDAKL

SEQ ID NO: 1681986 - protein, 30 aa, Staphylococcus aureus
CMEIPHDLFTPIFAVSRSAGWIAHILEQYK

SEQ ID NO: 1681987 - protein, 26 aa, Staphylococcus aureus
DLDDILVNMFLYLPNFFQNQNSEDNM

SEQ ID NO: 1681988 - protein, 24 aa, Staphylococcus aureus
DQHFTMFETDAELFGYCYGVAGTV

SEQ ID NO: 1681989 - protein, 23 aa, Staphylococcus aureus
DQMDGKLFGIPMGIKDNIITNGL

SEQ ID NO: 1681990 - protein, 20 aa, Staphylococcus aureus
DRKFHPLEKLGRYLMDSFVN

SEQ ID NO: 1681991 - protein, 32 aa, Staphylococcus aureus
EADLLIMVGTNYPYVDYLPKKNIKAIQIDTNP

SEQ ID NO: 1681992 - protein, 25 aa, Staphylococcus aureus
EIQPKTMMSKLVPGLFLCGEVLDIH

SEQ ID NO: 1681993 - protein, 21 aa, Staphylococcus aureus
EKVATPFPRISYDDAIEFLKA

SEQ ID NO: 1681994 - protein, 20 aa, Staphylococcus aureus
ELINFIINYARQNNYESLLT

SEQ ID NO: 1681995 - protein, 24 aa, Staphylococcus aureus
ETILNQQYYALDKTLFVALNNKAR

SEQ ID NO: 1681996 - protein, 21 aa, Staphylococcus aureus
EVEHVFATQTLWQTKPKNLKI

SEQ ID NO: 1681997 - protein, 24 aa, Staphylococcus aureus
EVQFQYGLVLCQLEMFNEAITQLK

SEQ ID NO: 1681998 - protein, 18 aa, Staphylococcus aureus
EWTAILAGDALLTKAFEL

SEQ ID NO: 1681999 - protein, 19 aa, Staphylococcus aureus
FMAQSHLLALRSTCQRLSV

SEQ ID NO: 1682000 - protein, 26 aa, Staphylococcus aureus
FNDLTPDEIFPYAPPQGIEELRDLWQ

SEQ ID NO: 1682001 - protein, 26 aa, Staphylococcus aureus
GDIIVNERIQFVLTSRLESFIMLELQ

SEQ ID NO: 1682002 - protein, 18 aa, Staphylococcus aureus
GDTLVITGSLYFISEVKS

SEQ ID NO: 1682003 - protein, 21 aa, Staphylococcus aureus
GIFEMYYAYSEPIKRIANHRV

SEQ ID NO: 1682004 - protein, 17 aa, Staphylococcus aureus
GNVVLIFQYGEEIMPGG

SEQ ID NO: 1682005 - protein, 31 aa, Staphylococcus aureus
HDHDFEKHMYAIHILTSLYASTSNTPHIGEQ

SEQ ID NO: 1682006 - protein, 35 aa, Staphylococcus aureus
HDIPPYDIWVASYRLYQTVKYWPKGTVFVSVVDPG

SEQ ID NO: 1682007 - protein, 18 aa, Staphylococcus aureus
HIAIKLPQISDLANLLIH

SEQ ID NO: 1682008 - protein, 18 aa, Staphylococcus aureus
IALGNMMTTAALLGIDSC

SEQ ID NO: 1682009 - protein, 22 aa, Staphylococcus aureus
IDKLICSWLKQIDNVIPQLIME

SEQ ID NO: 1682010 - protein, 25 aa, Staphylococcus aureus
IIEINCHGGILTINRVLELTMTYGA

SEQ ID NO: 1682011 - protein, 17 aa, Staphylococcus aureus
IPLDKKVIMYAPTWRDD

SEQ ID NO: 1682012 - protein, 26 aa, Staphylococcus aureus
IRVNCVAPGPFWSPLQISGGQPQSKI

SEQ ID NO: 1682013 - protein, 20 aa, Staphylococcus aureus
ITKDNCFISIMAGIPIDYIK

SEQ ID NO: 1682014 - protein, 18 aa, Staphylococcus aureus
IYAPLAHRLGINTIKWEL

SEQ ID NO: 1682015 - protein, 18 aa, Staphylococcus aureus
IYHPLESVGIYVPGGKAS

SEQ ID NO: 1682016 - protein, 17 aa, Staphylococcus aureus
KFDINYSLKPLKLSNRQ

SEQ ID NO: 1682017 - protein, 25 aa, Staphylococcus aureus
KGWHDLKIVPYGPIEISPAAQGVHY

SEQ ID NO: 1682018 - protein, 24 aa, Staphylococcus aureus
KKGWPSMMYRIWKNPEKYKSYFIG

SEQ ID NO: 1682019 - protein, 24 aa, Staphylococcus aureus
KLELNYDVYLERLKYEYKVITNMG

SEQ ID NO: 1682020 - protein, 26 aa, Staphylococcus aureus
KLSQQLLLHLTPAFYRIKYNLTDRDE

SEQ ID NO: 1682021 - protein, 22 aa, Staphylococcus aureus
KMIEIRRYLHQHPELSFHEDET

SEQ ID NO: 1682022 - protein, 17 aa, Staphylococcus aureus
KQTRQLAAIYLASGIDP

SEQ ID NO: 1682023 - protein, 28 aa, Staphylococcus aureus
KRARRDIEMLLGSKVYLELWVKVQRDWR

SEQ ID NO: 1682024 - protein, 25 aa, Staphylococcus aureus
KVINMFSFFIAYHFNKLDIGIERIF

SEQ ID NO: 1682025 - protein, 30 aa, Staphylococcus aureus
KVSFKLVATELLWFIKGDTNIQYLLKYNNN

SEQ ID NO: 1682026 - protein, 20 aa, Staphylococcus aureus
LASELLMIKSKMLLPQSTSD

SEQ ID NO: 1682027 - protein, 17 aa, Staphylococcus aureus
LHPHLEPILKNTYGVII

SEQ ID NO: 1682028 - protein, 20 aa, Staphylococcus aureus
LKQPVILNQQFGLGMDYFDV

SEQ ID NO: 1682029 - protein, 25 aa, Staphylococcus aureus
LNVYDKPTPFLFGEDFSFYGQQLAP

SEQ ID NO: 1682030 - protein, 20 aa, Staphylococcus aureus
LSALTFSYLTSHDVLGSIIV

SEQ ID NO: 1682031 - protein, 20 aa, Staphylococcus aureus
LSENLFSAVKIYGTFKHMHV

SEQ ID NO: 1682032 - protein, 17 aa, Staphylococcus aureus
LTQILKDLNIEKVDGIY

SEQ ID NO: 1682033 - protein, 33 aa, Staphylococcus aureus
LVWATAAPGWQKWVWSPFLSVLGSGATAFVFNG

SEQ ID NO: 1682034 - protein, 20 aa, Staphylococcus aureus
MGIDIDTLVKFNLKKGQQLE

SEQ ID NO: 1682035 - protein, 21 aa, Staphylococcus aureus
NHAPFANYWMHNGFINIDNEK

SEQ ID NO: 1682036 - protein, 26 aa, Staphylococcus aureus
NISIERQYFNQLYRFNNQDLKHLEQE

SEQ ID NO: 1682037 - protein, 24 aa, Staphylococcus aureus
NKENIMMPLILAGAKRKDIEQRVH

SEQ ID NO: 1682038 - protein, 26 aa, Staphylococcus aureus
NLGKMETLLLCARQFLWSTAKGYQQY

SEQ ID NO: 1682039 - protein, 22 aa, Staphylococcus aureus
NLPTHPILIQTAQYNLIIDAGI

SEQ ID NO: 1682040 - protein, 17 aa, Staphylococcus aureus
NPSFFQGLSKEPGTIVP

SEQ ID NO: 1682041 - protein, 19 aa, Staphylococcus aureus
PEKWKEFEVIKRQKAIEIA

SEQ ID NO: 1682042 - protein, 20 aa, Staphylococcus aureus
PKIGAYHFTTIKPNLGVVST

SEQ ID NO: 1682043 - protein, 26 aa, Staphylococcus aureus
QCADLAVDYIYWLLEIRMWGNAKDAI

SEQ ID NO: 1682044 - protein, 26 aa, Staphylococcus aureus
QDLEKLQKILILKSFDFDIAKIKQYI

SEQ ID NO: 1682045 - protein, 24 aa, Staphylococcus aureus
QEEYKYLRALIFNETELEEAYKWM

SEQ ID NO: 1682046 - protein, 21 aa, Staphylococcus aureus
QIIPKVHLKRISKSGFGPFAF

SEQ ID NO: 1682047 - protein, 26 aa, Staphylococcus aureus
QYLNSFWSHLKPVMMALVLTSMRQRM

SEQ ID NO: 1682048 - protein, 25 aa, Staphylococcus aureus
RDHDTVRIYKPWLTAHQLSLPKYVV

SEQ ID NO: 1682049 - protein, 18 aa, Staphylococcus aureus
RILSPNDDYFYQSIVNYI

SEQ ID NO: 1682050 - protein, 20 aa, Staphylococcus aureus
RITRHLLKKYQERFYTYPAA

SEQ ID NO: 1682051 - protein, 20 aa, Staphylococcus aureus
RKRVMTPPPVKKVAMKYDLP

SEQ ID NO: 1682052 - protein, 22 aa, Staphylococcus aureus
RPFLNKTLERKAVWDKWMEQDK

SEQ ID NO: 1682053 - protein, 20 aa, Staphylococcus aureus
SALTVYELLMDKCYLGLHSH

SEQ ID NO: 1682054 - protein, 20 aa, Staphylococcus aureus
SEYLVLASELLMIKSKMLLP

SEQ ID NO: 1682055 - protein, 24 aa, Staphylococcus aureus
SIQNIGLPTPNLTYFCSYQLAKRT

SEQ ID NO: 1682056 - protein, 24 aa, Staphylococcus aureus
SISLDLMYHLPKQTIEDFEQSLDL

SEQ ID NO: 1682057 - protein, 19 aa, Staphylococcus aureus
SLVLILSDHSEFKNLSDSH

SEQ ID NO: 1682058 - protein, 20 aa, Staphylococcus aureus
SRAFANLYDTLLMNYNFVII

SEQ ID NO: 1682059 - protein, 17 aa, Staphylococcus aureus
STFKEYVLPDAVTRFRQ

SEQ ID NO: 1682060 - protein, 19 aa, Staphylococcus aureus
SVPVIIKEVGFGMSKELMH

SEQ ID NO: 1682061 - protein, 18 aa, Staphylococcus aureus
TDVRFQPGQVLTVVHNNN

SEQ ID NO: 1682062 - protein, 26 aa, Staphylococcus aureus
THPDFIVPMPHRIFDFYNAFIGTSDF

SEQ ID NO: 1682063 - protein, 19 aa, Staphylococcus aureus
TIGKLAYRYKMEGKKVMLA

SEQ ID NO: 1682064 - protein, 19 aa, Staphylococcus aureus
TKPVIREKMSRRKKTAAKK

SEQ ID NO: 1682065 - protein, 31 aa, Staphylococcus aureus
TVTLKTLGLIIVMAQSGLLIPTLDGSQLSVF

SEQ ID NO: 1682066 - protein, 24 aa, Staphylococcus aureus
VAQQDMLIPWEMIPRCPKCDAPME

SEQ ID NO: 1682067 - protein, 22 aa, Staphylococcus aureus
VDDDGYFWFEGRRDDIIISSGY

SEQ ID NO: 1682068 - protein, 21 aa, Staphylococcus aureus
VIRYAKYLNELSDETQFIVIT

SEQ ID NO: 1682069 - protein, 17 aa, Staphylococcus aureus
VKQADVIMVLLPDEIQG

SEQ ID NO: 1682070 - protein, 24 aa, Staphylococcus aureus
VQQLLKSYGFLIYFKNPEDMYEMI

SEQ ID NO: 1682071 - protein, 26 aa, Staphylococcus aureus
AEDLRQTIHTFLPLAHIVKVSDEELE

SEQ ID NO: 1682072 - protein, 24 aa, Staphylococcus aureus
AKKPNWPVTPWPTAYSEIYDYQWN

SEQ ID NO: 1682073 - protein, 21 aa, Staphylococcus aureus
AQEEIFGPVLTVIKVKDDQEA

SEQ ID NO: 1682074 - protein, 23 aa, Staphylococcus aureus
ARMILHIIDQMNGIPFTERADRI

SEQ ID NO: 1682075 - protein, 27 aa, Staphylococcus aureus
AVEGIPAGLLTYPPLMAADIVLYNTNI

SEQ ID NO: 1682076 - protein, 23 aa, Staphylococcus aureus
AYAHFIHQYMKQAAPFIEADIFN

SEQ ID NO: 1682077 - protein, 22 aa, Staphylococcus aureus
CFGAPFFPLHPTVYADLLGELI

SEQ ID NO: 1682078 - protein, 17 aa, Staphylococcus aureus
CLGKVIGGGLPVGAFGG

SEQ ID NO: 1682079 - protein, 20 aa, Staphylococcus aureus
DDLKEEGYIAHILGVNAEEG

SEQ ID NO: 1682080 - protein, 20 aa, Staphylococcus aureus
DETFVPYVEKALGLITEENG

SEQ ID NO: 1682081 - protein, 22 aa, Staphylococcus aureus
DGRPKLMGIRQIIDSYLNHQIE

SEQ ID NO: 1682082 - protein, 20 aa, Staphylococcus aureus
DKLHYSFNRLKYSLKPVVTA

SEQ ID NO: 1682083 - protein, 19 aa, Staphylococcus aureus
DLMLVHTNRHYGKTLVLNM

SEQ ID NO: 1682084 - protein, 24 aa, Staphylococcus aureus
EAPLKALIFDSEYDPYRGVISSIR

SEQ ID NO: 1682085 - protein, 26 aa, Staphylococcus aureus
EDEVRKEFQFLDYAQIAFVSAKERTR

SEQ ID NO: 1682086 - protein, 20 aa, Staphylococcus aureus
EESSILKFPGVLIRTSTERP

SEQ ID NO: 1682087 - protein, 33 aa, Staphylococcus aureus
EGANIEIGYLPGRLKWLVADLLTKQGLKVVNDD

SEQ ID NO: 1682088 - protein, 32 aa, Staphylococcus aureus
EGFGKEVKRRIFLGTFALSSGYYDAYYKKSQK

SEQ ID NO: 1682089 - protein, 18 aa, Staphylococcus aureus
EGLRLQNRKLRRPDLTFA

SEQ ID NO: 1682090 - protein, 22 aa, Staphylococcus aureus
ELAKGRPLFEAVHKAKKFISMS

SEQ ID NO: 1682091 - protein, 18 aa, Staphylococcus aureus
ELVKYNIIGGFDLGVVSD

SEQ ID NO: 1682092 - protein, 18 aa, Staphylococcus aureus
FDDFWKQRQVPLSQIKTP

SEQ ID NO: 1682093 - protein, 19 aa, Staphylococcus aureus
FEGAQKYLSYLKSTVDVNF

SEQ ID NO: 1682094 - protein, 18 aa, Staphylococcus aureus
FGESLPVYKPTLPPMVFG

SEQ ID NO: 1682095 - protein, 20 aa, Staphylococcus aureus
FTSPFIETFNERISLNGVPI

SEQ ID NO: 1682096 - protein, 27 aa, Staphylococcus aureus
GIHRKRGLLDQLAKYQIKPNIHETNFT

SEQ ID NO: 1682097 - protein, 25 aa, Staphylococcus aureus
GILIHRTPILILDEPLANLDPATGH

SEQ ID NO: 1682098 - protein, 29 aa, Staphylococcus aureus
GLNSNWDMLFIVFSIHLIDILKKLSHDEI

SEQ ID NO: 1682099 - protein, 27 aa, Staphylococcus aureus
GNIAVPLDLPALFKGYYKEPERTAKAQ

SEQ ID NO: 1682100 - protein, 22 aa, Staphylococcus aureus
HLKLKTKFYPTQYIRFEEATIE

SEQ ID NO: 1682101 - protein, 22 aa, Staphylococcus aureus
IDFIGNYKTNYLIPIALSGDQS

SEQ ID NO: 1682102 - protein, 20 aa, Staphylococcus aureus
IEAKHTLDYYAGLSFRTLVP

SEQ ID NO: 1682103 - protein, 21 aa, Staphylococcus aureus
IKATFKGLGTGPTIALRADFD

SEQ ID NO: 1682104 - protein, 18 aa, Staphylococcus aureus
INNIPYKVDIYPYYGSDA

SEQ ID NO: 1682105 - protein, 18 aa, Staphylococcus aureus
IQGYLYLQSLYENEKNYP

SEQ ID NO: 1682106 - protein, 18 aa, Staphylococcus aureus
ISEKMIYDEVALGLRARG

SEQ ID NO: 1682107 - protein, 36 aa, Staphylococcus aureus
ISHQMDMLFTHFGISGPAALRCSQFVYKEQKNQKTQ

SEQ ID NO: 1682108 - protein, 18 aa, Staphylococcus aureus
IVAIRSMLIKKAQATLFA

SEQ ID NO: 1682109 - protein, 19 aa, Staphylococcus aureus
IYEHDIIYTTNGRLGFDYL

SEQ ID NO: 1682110 - protein, 46 aa, Staphylococcus aureus
KFKTTTIVFKFMAPLEYDTITARSLLSKLLVRATKKWPTDKSFNNH

SEQ ID NO: 1682111 - protein, 18 aa, Staphylococcus aureus
KKSQLIEQFIRSLEVSIA

SEQ ID NO: 1682112 - protein, 20 aa, Staphylococcus aureus
KLRRPDLTFATLDHNVPTID

SEQ ID NO: 1682113 - protein, 24 aa, Staphylococcus aureus
KQQEDYCIILAYFYEGKPMLSYVY

SEQ ID NO: 1682114 - protein, 17 aa, Staphylococcus aureus
KRPHFQALTPLYPDERI

SEQ ID NO: 1682115 - protein, 19 aa, Staphylococcus aureus
LDEIVLLEGFMDVIKSDTA

SEQ ID NO: 1682116 - protein, 24 aa, Staphylococcus aureus
LDQYVRTYIVLKLKSKPNKLHQMS

SEQ ID NO: 1682117 - protein, 22 aa, Staphylococcus aureus
LEKWYQIEYLKEMVTFVVVNRD

SEQ ID NO: 1682118 - protein, 22 aa, Staphylococcus aureus
LPMVGTISLVPQIVDVVSIPVI

SEQ ID NO: 1682119 - protein, 19 aa, Staphylococcus aureus
LRDKLPLRRDDESEIYLSF

SEQ ID NO: 1682120 - protein, 19 aa, Staphylococcus aureus
LRKPDWLKIKLNTNENYTG

SEQ ID NO: 1682121 - protein, 23 aa, Staphylococcus aureus
MEKHAVSRLVGAPPGYVGHDDGG

SEQ ID NO: 1682122 - protein, 25 aa, Staphylococcus aureus
NAAKALAFAYDKPLIPVHHIAGHIY

SEQ ID NO: 1682123 - protein, 28 aa, Staphylococcus aureus
NALVTGYDIIFFWVARMIFQGLEFTDRR

SEQ ID NO: 1682124 - protein, 17 aa, Staphylococcus aureus
NARLITNKAAYFKKSQL

SEQ ID NO: 1682125 - protein, 23 aa, Staphylococcus aureus
NDGDAVIFYNFRPDRAAQLSEIF

SEQ ID NO: 1682126 - protein, 17 aa, Staphylococcus aureus
NKLLLSFQQSEKLRRHM

SEQ ID NO: 1682127 - protein, 32 aa, Staphylococcus aureus
NKVFKKYNLTYPQFLVLTILWDESPVNVKKVV

SEQ ID NO: 1682128 - protein, 45 aa, Staphylococcus aureus
NSPIYKLAIEYKLAFPLHPEFRTMPMVWYCPPLSPIMSYFEGKNT

SEQ ID NO: 1682129 - protein, 24 aa, Staphylococcus aureus
PLKTQLGMYRFFVQADSAITTDIK

SEQ ID NO: 1682130 - protein, 20 aa, Staphylococcus aureus
PNVIFEHCLPSFHNADTKIG

SEQ ID NO: 1682131 - protein, 22 aa, Staphylococcus aureus
PTHLLIDAMTLDNALPQVSLIK

SEQ ID NO: 1682132 - protein, 17 aa, Staphylococcus aureus
QLMPAISQLFEQSKIAK

SEQ ID NO: 1682133 - protein, 18 aa, Staphylococcus aureus
QLPQNVVFIFQPAEETGG

SEQ ID NO: 1682134 - protein, 30 aa, Staphylococcus aureus
QTSPREAGLFHIAFLLPTTEDLANFLYFVA

SEQ ID NO: 1682135 - protein, 20 aa, Staphylococcus aureus
QVEFCDVLIINKIDLISEEE

SEQ ID NO: 1682136 - protein, 31 aa, Staphylococcus aureus
RARAGLKDPKRPIGSFIFLGPTGVGKTELAR

SEQ ID NO: 1682137 - protein, 20 aa, Staphylococcus aureus
RLNVFYATQVAIEPPTFVVF

SEQ ID NO: 1682138 - protein, 20 aa, Staphylococcus aureus
RSIPLYEESYILLAPKETFK

SEQ ID NO: 1682139 - protein, 20 aa, Staphylococcus aureus
SKDPDYIQGYLYLQSLYENE

SEQ ID NO: 1682140 - protein, 19 aa, Staphylococcus aureus
SLPVYKPTLPPMVFGNRDK

SEQ ID NO: 1682141 - protein, 22 aa, Staphylococcus aureus
SNDFFTLVKWEISGTLNYMKPR

SEQ ID NO: 1682142 - protein, 23 aa, Staphylococcus aureus
TDMHPYVHPFNPAIDPLWESRSD

SEQ ID NO: 1682143 - protein, 31 aa, Staphylococcus aureus
TEFEIITAMMFLYFGEIHPVDFVIVEAGLGI

SEQ ID NO: 1682144 - protein, 24 aa, Staphylococcus aureus
TEFLMDHRHLWLRSKKQHAVMKIR

SEQ ID NO: 1682145 - protein, 29 aa, Staphylococcus aureus
TGIYAERTAPWLRRLGFENVKEVLLDPER

SEQ ID NO: 1682146 - protein, 23 aa, Staphylococcus aureus
TKWTELYDIWFSIYSTPSESLTD

SEQ ID NO: 1682147 - protein, 22 aa, Staphylococcus aureus
TRLARAYNLVIPPSGRTLSGGL

SEQ ID NO: 1682148 - protein, 31 aa, Staphylococcus aureus
TSFSDKYEWLLEFFPFLDPQHFVFCGRKNIV

SEQ ID NO: 1682149 - protein, 21 aa, Staphylococcus aureus
TVWSTRYLNLGVNNKFIISSW

SEQ ID NO: 1682150 - protein, 18 aa, Staphylococcus aureus
VECYEIYHPLESVGIYVP

SEQ ID NO: 1682151 - protein, 19 aa, Staphylococcus aureus
VIKLIPGLENVDIVRYGVM

SEQ ID NO: 1682152 - protein, 17 aa, Staphylococcus aureus
VNIVYELPLAEVVFDFF

SEQ ID NO: 1682153 - protein, 21 aa, Staphylococcus aureus
VVPFENLGLLPYFEADFIATA

SEQ ID NO: 1682154 - protein, 22 aa, Staphylococcus aureus
YDDQRWWQDTTVPYYQLQNKTE

SEQ ID NO: 1682155 - protein, 21 aa, Staphylococcus aureus
YKVTYQLLDKLGFGGNDLGSD

SEQ ID NO: 1682156 - protein, 17 aa, Staphylococcus aureus
AHLPGMVASLTTLPVIG

SEQ ID NO: 1682157 - protein, 17 aa, Staphylococcus aureus
AIVVSRFNDFITGRLLE

SEQ ID NO: 1682158 - protein, 26 aa, Staphylococcus aureus
ASTYRKQFCKLLLKSAKVSVIKGNAS

SEQ ID NO: 1682159 - protein, 23 aa, Staphylococcus aureus
AYDQFNKFLYERDMDGYYLIVQQ

SEQ ID NO: 1682160 - protein, 25 aa, Staphylococcus aureus
DDNYRGYGLGQMLLKYGINYASHTC

SEQ ID NO: 1682161 - protein, 21 aa, Staphylococcus aureus
DEIRRFLPRKVRTFQLQEAQR

SEQ ID NO: 1682162 - protein, 18 aa, Staphylococcus aureus
DGLAILNELIKKAKATTN

SEQ ID NO: 1682163 - protein, 22 aa, Staphylococcus aureus
DHREFTLILYVTDIVGMLARVL

SEQ ID NO: 1682164 - protein, 19 aa, Staphylococcus aureus
DTHKQQVVPVFWIAGEDHD

SEQ ID NO: 1682165 - protein, 28 aa, Staphylococcus aureus
DTQHMTLPMLFSDILIYCTERNVMLVDH

SEQ ID NO: 1682166 - protein, 19 aa, Staphylococcus aureus
DWEVLLKPAKRIKVGNKLN

SEQ ID NO: 1682167 - protein, 27 aa, Staphylococcus aureus
EALKQKFRLTKYPYYQGITLHVKEFVE

SEQ ID NO: 1682168 - protein, 20 aa, Staphylococcus aureus
EGFRPVMEVQFLGFVFEVFD

SEQ ID NO: 1682169 - protein, 26 aa, Staphylococcus aureus
EMQPFYKQLNMKGYFYDFDSLKGMQK

SEQ ID NO: 1682170 - protein, 20 aa, Staphylococcus aureus
FKDYIAMPKQNLYQSLHTTV

SEQ ID NO: 1682171 - protein, 23 aa, Staphylococcus aureus
FKHMHVRMMPAQQPPYTRLIDSA

SEQ ID NO: 1682172 - protein, 19 aa, Staphylococcus aureus
FKSRIAVWVLNYIKVNEAK

SEQ ID NO: 1682173 - protein, 18 aa, Staphylococcus aureus
FLDLFDKHELDSAVIGEV

SEQ ID NO: 1682174 - protein, 19 aa, Staphylococcus aureus
FPVEIQLMSRFRTPKEIKQ

SEQ ID NO: 1682175 - protein, 25 aa, Staphylococcus aureus
GIDTTIPFHIKLLNNDIFRSGKFNT

SEQ ID NO: 1682176 - protein, 29 aa, Staphylococcus aureus
GIKSLKISFNKVFGYFIEITRANLQNFEP

SEQ ID NO: 1682177 - protein, 25 aa, Staphylococcus aureus
GKFRGDTFFPPYTFEDWEVASSVEG

SEQ ID NO: 1682178 - protein, 18 aa, Staphylococcus aureus
HIAGLVAAGLHPNPVEYA

SEQ ID NO: 1682179 - protein, 34 aa, Staphylococcus aureus
HLDLETTKWLEDYLRYFKGAIVIISHDRYFLDKI

SEQ ID NO: 1682180 - protein, 18 aa, Staphylococcus aureus
HLLSISEIYYELLNLIKA

SEQ ID NO: 1682181 - protein, 24 aa, Staphylococcus aureus
ILLPEHNWGNYKLVFNTRNGANLQ

SEQ ID NO: 1682182 - protein, 24 aa, Staphylococcus aureus
INEQTKFYINPTGRFVIGGPQGDA

SEQ ID NO: 1682183 - protein, 17 aa, Staphylococcus aureus
IQNPSFFQGLSKEPGTI

SEQ ID NO: 1682184 - protein, 21 aa, Staphylococcus aureus
ITEHHFVINSLALPFSVLYNL

SEQ ID NO: 1682185 - protein, 21 aa, Staphylococcus aureus
IYQLPGHVFIFGGQTLFEEMI

SEQ ID NO: 1682186 - protein, 28 aa, Staphylococcus aureus
KIPAVQRQTMLFSATMPKAIQALVQQFM

SEQ ID NO: 1682187 - protein, 20 aa, Staphylococcus aureus
KKDHMVFPGMVYISHPTEYG

SEQ ID NO: 1682188 - protein, 27 aa, Staphylococcus aureus
KKGDVVVGMLPWRIINHVQADQITKVP

SEQ ID NO: 1682189 - protein, 27 aa, Staphylococcus aureus
KLDKCFYKYYGLNKLINLLIKEKPDLI

SEQ ID NO: 1682190 - protein, 26 aa, Staphylococcus aureus
KLVMDLQPLIIRRIKTFGFNHYDLED

SEQ ID NO: 1682191 - protein, 25 aa, Staphylococcus aureus
KSITFTHEFMFARPIHRTPDMIKQH

SEQ ID NO: 1682192 - protein, 20 aa, Staphylococcus aureus
LAIQLMYNAPSSIKITYGGD

SEQ ID NO: 1682193 - protein, 18 aa, Staphylococcus aureus
LEIKSLLEKGFNIKGIKQ

SEQ ID NO: 1682194 - protein, 18 aa, Staphylococcus aureus
LERLLEIKSLLEKGFNIK

SEQ ID NO: 1682195 - protein, 19 aa, Staphylococcus aureus
LGFKRVIIPKNNIGGWTYP

SEQ ID NO: 1682196 - protein, 19 aa, Staphylococcus aureus
LHETFKAYGVLFIDAQFEP

SEQ ID NO: 1682197 - protein, 20 aa, Staphylococcus aureus
LHYLARLIEAGDLPTIVRRL

SEQ ID NO: 1682198 - protein, 23 aa, Staphylococcus aureus
LIAHTFYATEFDFPKALRKEEIV

SEQ ID NO: 1682199 - protein, 19 aa, Staphylococcus aureus
LLNSRIIYTLSPTKIYRTA

SEQ ID NO: 1682200 - protein, 18 aa, Staphylococcus aureus
LNINPDIILRLPHGMPEE

SEQ ID NO: 1682201 - protein, 17 aa, Staphylococcus aureus
LRMLNHFPKPTFEDIPL

SEQ ID NO: 1682202 - protein, 22 aa, Staphylococcus aureus
LYIDEQTFVPCTPLGIMEILKH

SEQ ID NO: 1682203 - protein, 27 aa, Staphylococcus aureus
MATITFQNLFKLFESFSGMTATGKLGE

SEQ ID NO: 1682204 - protein, 26 aa, Staphylococcus aureus
MDETWNFDYITTLLDRILDKYKDKSI

SEQ ID NO: 1682205 - protein, 21 aa, Staphylococcus aureus
MQYYRETGIYAERTAPWLRRL

SEQ ID NO: 1682206 - protein, 28 aa, Staphylococcus aureus
NIHEKMAVFDLYFRKMPFNSGYAVFNGL

SEQ ID NO: 1682207 - protein, 29 aa, Staphylococcus aureus
NKAYADVEFKLYLGLKHISPFIEDAVEQM

SEQ ID NO: 1682208 - protein, 20 aa, Staphylococcus aureus
PRAQAFYKRHGFKVVGEHHF

SEQ ID NO: 1682209 - protein, 22 aa, Staphylococcus aureus
QGNQNIILCERGIRTYEKATRN

SEQ ID NO: 1682210 - protein, 17 aa, Staphylococcus aureus
QIAKKMANLIPNSKCKL

SEQ ID NO: 1682211 - protein, 22 aa, Staphylococcus aureus
QKYDHYRIGLNKAIQYLSYKKR

SEQ ID NO: 1682212 - protein, 22 aa, Staphylococcus aureus
QQLKLLCEKYNIPQGYQAIQLL

SEQ ID NO: 1682213 - protein, 23 aa, Staphylococcus aureus
QSVFHIHFHLIPRYENDIDGFGY

SEQ ID NO: 1682214 - protein, 19 aa, Staphylococcus aureus
QYMGAYHLQWHMIKYAKSH

SEQ ID NO: 1682215 - protein, 33 aa, Staphylococcus aureus
RLIEAGDLPTIVRRLLVISYEDIGLASPNAGQR

SEQ ID NO: 1682216 - protein, 18 aa, Staphylococcus aureus
RLYGIFLLDQLNGKEIVM

SEQ ID NO: 1682217 - protein, 33 aa, Staphylococcus aureus
SHRGPLLDYFDAKLVCYFFKELSKFIYKNRGVF

SEQ ID NO: 1682218 - protein, 19 aa, Staphylococcus aureus
SIFVGDYLITGGQPNQLDY

SEQ ID NO: 1682219 - protein, 17 aa, Staphylococcus aureus
SLAVKLVDKAAQSNLIH

SEQ ID NO: 1682220 - protein, 24 aa, Staphylococcus aureus
TISPYLKDWTIARLLKTDRIILRM

SEQ ID NO: 1682221 - protein, 18 aa, Staphylococcus aureus
TVIQSIGLVQWYEEQKRY

SEQ ID NO: 1682222 - protein, 17 aa, Staphylococcus aureus
VAGHYLYQQGRFADLAL

SEQ ID NO: 1682223 - protein, 18 aa, Staphylococcus aureus
VCNYLDDIYLIEEMLLKQ

SEQ ID NO: 1682224 - protein, 29 aa, Staphylococcus aureus
VLYGKLGEPQLLYIDLHLIHEVTSPQAFE

SEQ ID NO: 1682225 - protein, 19 aa, Staphylococcus aureus
VPLTNFYRNEIIQPGVLPE

SEQ ID NO: 1682226 - protein, 29 aa, Staphylococcus aureus
VSAPAVLGLYPHTVLELAKRIIPSDKVSS

SEQ ID NO: 1682227 - protein, 25 aa, Staphylococcus aureus
YKGTNFKRLLKSLSPYVKVKNDVNA

SEQ ID NO: 1682228 - protein, 17 aa, Staphylococcus aureus
YVFVLKHSETCPISANA

SEQ ID NO: 1682229 - protein, 17 aa, Staphylococcus aureus
AIYNCKTPIISAVGHET

SEQ ID NO: 1682230 - protein, 25 aa, Staphylococcus aureus
AKIGYHRLFDIKPVNTRYGGRIIFV

SEQ ID NO: 1682231 - protein, 25 aa, Staphylococcus aureus
ATEEQMLYFGLPRINKYYTADRATV

SEQ ID NO: 1682232 - protein, 18 aa, Staphylococcus aureus
AVYFLQQGTPFIYQGQEI

SEQ ID NO: 1682233 - protein, 19 aa, Staphylococcus aureus
CAMITFRLLKNYENLTYVT

SEQ ID NO: 1682234 - protein, 34 aa, Staphylococcus aureus
DELDDALNYYLFYLKNWNYAYAYSLKLIDAYASK

SEQ ID NO: 1682235 - protein, 25 aa, Staphylococcus aureus
DGFLLNFSTWAPNLYHFLNLKHFKR

SEQ ID NO: 1682236 - protein, 22 aa, Staphylococcus aureus
DLPQIKVLMLTSFIEDKEVYRA

SEQ ID NO: 1682237 - protein, 20 aa, Staphylococcus aureus
DPGVDILSIIYQHGIEIEFP

SEQ ID NO: 1682238 - protein, 32 aa, Staphylococcus aureus
DRSDDQFRMIIKQLYFFSVANPNPTNWLDQLV

SEQ ID NO: 1682239 - protein, 25 aa, Staphylococcus aureus
EAKRKGLEPLAIWMKARKHEVSIEE

SEQ ID NO: 1682240 - protein, 24 aa, Staphylococcus aureus
ECREAGYPCYFTMDAGPNVKILVE

SEQ ID NO: 1682241 - protein, 21 aa, Staphylococcus aureus
EDGIYIDVYCALKHGVNISKT

SEQ ID NO: 1682242 - protein, 26 aa, Staphylococcus aureus
EGAKNAVLPILTASLLASDKPSKLVN

SEQ ID NO: 1682243 - protein, 17 aa, Staphylococcus aureus
EHILLGLIRENEGVAAR

SEQ ID NO: 1682244 - protein, 17 aa, Staphylococcus aureus
ENKLYVPVIKHADEKSI

SEQ ID NO: 1682245 - protein, 26 aa, Staphylococcus aureus
EQTPGVNFTFDERLRIALQLEKWGVD

SEQ ID NO: 1682246 - protein, 21 aa, Staphylococcus aureus
GAPVNFSGKFYNFVEYGVDKD

SEQ ID NO: 1682247 - protein, 26 aa, Staphylococcus aureus
GLNITEFAVLELLYNKGPQPIQRIRD

SEQ ID NO: 1682248 - protein, 17 aa, Staphylococcus aureus
GTRVLVPNKIKDAFLAE

SEQ ID NO: 1682249 - protein, 20 aa, Staphylococcus aureus
GVAHLPGHLSPLLKKLLLKS

SEQ ID NO: 1682250 - protein, 30 aa, Staphylococcus aureus
GVHGENFMILLASRLDAVVYSLGLARTRRQ

SEQ ID NO: 1682251 - protein, 19 aa, Staphylococcus aureus
HDVYLKHFYDSIAPSFYFD

SEQ ID NO: 1682252 - protein, 21 aa, Staphylococcus aureus
HGEILVYERLSGGGEARLHGQ

SEQ ID NO: 1682253 - protein, 17 aa, Staphylococcus aureus
HVIPNWYDMRQLQDNRI

SEQ ID NO: 1682254 - protein, 17 aa, Staphylococcus aureus
IDAIEAALITAYKKNYD

SEQ ID NO: 1682255 - protein, 28 aa, Staphylococcus aureus
ILEGYHTLLTIGRFPICYINIEMDPILV

SEQ ID NO: 1682256 - protein, 23 aa, Staphylococcus aureus
ITGLIKANIPTRIAFMVSSSVDS

SEQ ID NO: 1682257 - protein, 19 aa, Staphylococcus aureus
IYGTHLWSGYPTGTIHSRA

SEQ ID NO: 1682258 - protein, 29 aa, Staphylococcus aureus
KANLVIWDAPNHEYIPYHFGINHAEKVIK

SEQ ID NO: 1682259 - protein, 24 aa, Staphylococcus aureus
KEDMLNEYYYLPKTLYNTLASPEF

SEQ ID NO: 1682260 - protein, 19 aa, Staphylococcus aureus
KGKWSYLYRAIDAEGHTLD

SEQ ID NO: 1682261 - protein, 20 aa, Staphylococcus aureus
KHGIKMIYGMEGMLVDDGVP

SEQ ID NO: 1682262 - protein, 17 aa, Staphylococcus aureus
KLVDLPESFLERYPAEL

SEQ ID NO: 1682263 - protein, 18 aa, Staphylococcus aureus
KPRGLFRKKKFSPVVGDI

SEQ ID NO: 1682264 - protein, 22 aa, Staphylococcus aureus
KSYKVPFRKFGNRNELGIALGK

SEQ ID NO: 1682265 - protein, 17 aa, Staphylococcus aureus
LGINYYMSDWMRGYDGE

SEQ ID NO: 1682266 - protein, 20 aa, Staphylococcus aureus
LHPGAKLRKGLNALQTFLYS

SEQ ID NO: 1682267 - protein, 18 aa, Staphylococcus aureus
LMEIRTIYRMILKLHNIM

SEQ ID NO: 1682268 - protein, 27 aa, Staphylococcus aureus
LNEIKLHREFIIEVPYMNSRKFELLIA

SEQ ID NO: 1682269 - protein, 20 aa, Staphylococcus aureus
LNNLIARYRKVDEDFFEALE

SEQ ID NO: 1682270 - protein, 25 aa, Staphylococcus aureus
NGHGTAHYPFFKIDFERLARYCEKH

SEQ ID NO: 1682271 - protein, 31 aa, Staphylococcus aureus
NGMPIIVNGVMKPIPTLYKPLNSVDINTKED

SEQ ID NO: 1682272 - protein, 17 aa, Staphylococcus aureus
NIEVLRFANAMFEPLWN

SEQ ID NO: 1682273 - protein, 19 aa, Staphylococcus aureus
QMRPLVVMSPKSLLRNKTV

SEQ ID NO: 1682274 - protein, 23 aa, Staphylococcus aureus
QQTFEHIFPYDIASTTTPLLRER

SEQ ID NO: 1682275 - protein, 20 aa, Staphylococcus aureus
RDDLDVYYFGDTFLMCTIIS

SEQ ID NO: 1682276 - protein, 17 aa, Staphylococcus aureus
RILAERVGPIKLHIVPF

SEQ ID NO: 1682277 - protein, 23 aa, Staphylococcus aureus
RLNKFTIEKLALGLARYLNAQTN

SEQ ID NO: 1682278 - protein, 21 aa, Staphylococcus aureus
RPQDLIFLSDMKSSFENSVTA

SEQ ID NO: 1682279 - protein, 33 aa, Staphylococcus aureus
SDIPDNLIFYIYDSLIEGFIHWIKDEKIDWPGE

SEQ ID NO: 1682280 - protein, 25 aa, Staphylococcus aureus
SNFYRDKLGYLFQNYGLIDNLTVNE

SEQ ID NO: 1682281 - protein, 24 aa, Staphylococcus aureus
TEVKQWQTYIADYLYQCDVINDPT

SEQ ID NO: 1682282 - protein, 24 aa, Staphylococcus aureus
TVEDIRWLRCDIKSLNLLGNVLAK

SEQ ID NO: 1682283 - protein, 19 aa, Staphylococcus aureus
TVTPGPWHIHRMLEAAEGL

SEQ ID NO: 1682284 - protein, 17 aa, Staphylococcus aureus
VQNIEVLRFANAMFEPL

SEQ ID NO: 1682285 - protein, 23 aa, Staphylococcus aureus
YEMRWDIGYVLQQIALFPHMTIK

SEQ ID NO: 1682286 - protein, 26 aa, Staphylococcus aureus
YITEDVAMAFGFFDGMHKGHDKVFDI

SEQ ID NO: 1682287 - protein, 24 aa, Staphylococcus aureus
YKARYDVTILINGLPLVQVELKRR

SEQ ID NO: 1682288 - protein, 20 aa, Staphylococcus aureus
YQPKHLVIVGGGYIALEFAS

SEQ ID NO: 1682289 - protein, 23 aa, Staphylococcus aureus
AEKYLQMAHEFCPYSKATQGNIN

SEQ ID NO: 1682290 - protein, 17 aa, Staphylococcus aureus
DDLCDYFKEKQIKHVYV

SEQ ID NO: 1682291 - protein, 25 aa, Staphylococcus aureus
DLTQEHFVILLLNSKNVVIKETCVF

SEQ ID NO: 1682292 - protein, 24 aa, Staphylococcus aureus
DPEQFAQDHLAFCKAHHLKGRILV

SEQ ID NO: 1682293 - protein, 25 aa, Staphylococcus aureus
DSCLKIKYMFPKAHAAAYVLMAVRI

SEQ ID NO: 1682294 - protein, 19 aa, Staphylococcus aureus
EDFLLVKREIFSSGKSLCK

SEQ ID NO: 1682295 - protein, 21 aa, Staphylococcus aureus
EDVKIAISDRFKLLQSQYTDE

SEQ ID NO: 1682296 - protein, 17 aa, Staphylococcus aureus
EIPNFKFGKRVIDSTGA

SEQ ID NO: 1682297 - protein, 24 aa, Staphylococcus aureus
EKVCDILGRQPNFTETGIFSVMWS

SEQ ID NO: 1682298 - protein, 22 aa, Staphylococcus aureus
ELPKEYLMPEFLRDIFKEKLLE

SEQ ID NO: 1682299 - protein, 18 aa, Staphylococcus aureus
ENYTKYDGTPFLPHEIEE

SEQ ID NO: 1682300 - protein, 25 aa, Staphylococcus aureus
ERAGQFYINQRWLGGLLTNYKTISK

SEQ ID NO: 1682301 - protein, 23 aa, Staphylococcus aureus
ETFKILGRSWNGLIINYLSRCND

SEQ ID NO: 1682302 - protein, 27 aa, Staphylococcus aureus
GEIDPVIRFYTWNPATLSIGYFQRLQK

SEQ ID NO: 1682303 - protein, 26 aa, Staphylococcus aureus
GGETYKLHLVPSGIFYKDKLAVIGNG

SEQ ID NO: 1682304 - protein, 17 aa, Staphylococcus aureus
GGPGTFSPLLLDTLYHL

SEQ ID NO: 1682305 - protein, 38 aa, Staphylococcus aureus
GNMTKFWEIFYERIDVLHDALLYRINRLKDAVPNNAPI

SEQ ID NO: 1682306 - protein, 19 aa, Staphylococcus aureus
GSQLPKMFGFQAEGASPIV

SEQ ID NO: 1682307 - protein, 19 aa, Staphylococcus aureus
IDEETFLKLYHKVLDYLDK

SEQ ID NO: 1682308 - protein, 19 aa, Staphylococcus aureus
IFMNELKINLLEFRQQMDL

SEQ ID NO: 1682309 - protein, 26 aa, Staphylococcus aureus
IHLNNDFYRLTPYFTKDFNNISLYFT

SEQ ID NO: 1682310 - protein, 17 aa, Staphylococcus aureus
IKKTAMVFGQMNEPPGA

SEQ ID NO: 1682311 - protein, 28 aa, Staphylococcus aureus
IQYDVALFSYNKLLEIFFSVIDPLDTGG

SEQ ID NO: 1682312 - protein, 25 aa, Staphylococcus aureus
IRVHMKYIGFPLVGDPKYGPKKTLD

SEQ ID NO: 1682313 - protein, 29 aa, Staphylococcus aureus
IVNNWSYEALVKIFYRYGEEKFSKQIARR

SEQ ID NO: 1682314 - protein, 21 aa, Staphylococcus aureus
KAERAFLKHLMRDKDTFLNYY

SEQ ID NO: 1682315 - protein, 22 aa, Staphylococcus aureus
KAVITVPAYFNDAERQATKDAG

SEQ ID NO: 1682316 - protein, 22 aa, Staphylococcus aureus
KEANLKIIYWLQGTGVVSINLQ

SEQ ID NO: 1682317 - protein, 18 aa, Staphylococcus aureus
LIEILDKSTLTEINIEDT

SEQ ID NO: 1682318 - protein, 17 aa, Staphylococcus aureus
LLDDKFIRKNKAEFPEV

SEQ ID NO: 1682319 - protein, 18 aa, Staphylococcus aureus
LMLFVQRCKDMQDAGQLP

SEQ ID NO: 1682320 - protein, 23 aa, Staphylococcus aureus
LNAKVIIIELNDDRIKYLEDMYA

SEQ ID NO: 1682321 - protein, 31 aa, Staphylococcus aureus
LRVEAPLIQAQLIETILLNIVNFHTLITTKA

SEQ ID NO: 1682322 - protein, 17 aa, Staphylococcus aureus
MEPWDGPTMISFCNGDK

SEQ ID NO: 1682323 - protein, 17 aa, Staphylococcus aureus
MSPNDICLIEELAPFFE

SEQ ID NO: 1682324 - protein, 24 aa, Staphylococcus aureus
NAKVLAEALINEGFRIVSGGTDNH

SEQ ID NO: 1682325 - protein, 22 aa, Staphylococcus aureus
NCIYCYNYVIWLIQHDLPRNYQ

SEQ ID NO: 1682326 - protein, 19 aa, Staphylococcus aureus
NDIWKHFKAVKNNHVYDLE

SEQ ID NO: 1682327 - protein, 20 aa, Staphylococcus aureus
NDSRYLLIEFPSNEVPHYTD

SEQ ID NO: 1682328 - protein, 20 aa, Staphylococcus aureus
NVNFDYLFAAIGGGGLISGI

SEQ ID NO: 1682329 - protein, 26 aa, Staphylococcus aureus
PAGSVYFIIIFYNKNGTKLSTEIVKS

SEQ ID NO: 1682330 - protein, 33 aa, Staphylococcus aureus
PSEFKFGLSFLTRSIALARFPWLSANIEYNVTK

SEQ ID NO: 1682331 - protein, 26 aa, Staphylococcus aureus
QDEAGLFLWETLRNNFYYSAINVPKA

SEQ ID NO: 1682332 - protein, 22 aa, Staphylococcus aureus
QHSQFPYKNIEWLIKEGYGKLT

SEQ ID NO: 1682333 - protein, 21 aa, Staphylococcus aureus
QKYLDFFVEKGHMVEPSAPLV

SEQ ID NO: 1682334 - protein, 19 aa, Staphylococcus aureus
QNMIFAFEESYGFLSEPFV

SEQ ID NO: 1682335 - protein, 24 aa, Staphylococcus aureus
QRVALIRMMLKDPIVMLADEPTGA

SEQ ID NO: 1682336 - protein, 24 aa, Staphylococcus aureus
RCQDGIVLFWPIDGEIELQKFRKS

SEQ ID NO: 1682337 - protein, 38 aa, Staphylococcus aureus
RPNAKMPSQLFQFFMSYLLARFDISLATLLGVHQGLGH

SEQ ID NO: 1682338 - protein, 22 aa, Staphylococcus aureus
SPVQIIYVLTEKGKALAEALHP

SEQ ID NO: 1682339 - protein, 24 aa, Staphylococcus aureus
STNKPDAKLFILLVGERPEEVTDL

SEQ ID NO: 1682340 - protein, 19 aa, Staphylococcus aureus
SYIKPFPKSVTDDYMKHIQ

SEQ ID NO: 1682341 - protein, 21 aa, Staphylococcus aureus
TTIIRLIMDLYQPQTGVIRVL

SEQ ID NO: 1682342 - protein, 48 aa, Staphylococcus aureus
TVKRKYTLDFYLKPFVKTKIKAWVRQLLWMSIYQYVYLDKVPNHAIIN

SEQ ID NO: 1682343 - protein, 17 aa, Staphylococcus aureus
VDIYPGEKVLVVGASGS

SEQ ID NO: 1682344 - protein, 18 aa, Staphylococcus aureus
VFVYVPKNVVVEHPVQYV

SEQ ID NO: 1682345 - protein, 18 aa, Staphylococcus aureus
VPSKFFDLAKEGKDFYMF

SEQ ID NO: 1682346 - protein, 17 aa, Staphylococcus aureus
VVLIHGFKNYVALLFHK

SEQ ID NO: 1682347 - protein, 24 aa, Staphylococcus aureus
YCPNCGRLLQYDYIHYNQIGHYHC

SEQ ID NO: 1682348 - protein, 22 aa, Staphylococcus aureus
YPQLAHHNFFFTENAYLNYQQV

SEQ ID NO: 1682349 - protein, 24 aa, Staphylococcus aureus
AATIRPQFIAYQIPIGLGSIKSSL

SEQ ID NO: 1682350 - protein, 18 aa, Staphylococcus aureus
AGKIDWVTKFPEGEYSKI

SEQ ID NO: 1682351 - protein, 17 aa, Staphylococcus aureus
AKNAMVNAIRLGEQFDS

SEQ ID NO: 1682352 - protein, 21 aa, Staphylococcus aureus
CTQIYFVHPINKNNIYITIDY

SEQ ID NO: 1682353 - protein, 25 aa, Staphylococcus aureus
DEDLRDYHIAAQILKYFNIEHINLL

SEQ ID NO: 1682354 - protein, 22 aa, Staphylococcus aureus
DKQGVLRLFLKYGQNDERVITG

SEQ ID NO: 1682355 - protein, 29 aa, Staphylococcus aureus
DKVHLETDVLFKYVENILNKDKDQLSVDK

SEQ ID NO: 1682356 - protein, 17 aa, Staphylococcus aureus
DNSIQSIILIHACWLAN

SEQ ID NO: 1682357 - protein, 19 aa, Staphylococcus aureus
DTNGFVKLITLKEDDTLIG

SEQ ID NO: 1682358 - protein, 23 aa, Staphylococcus aureus
DVTKLPFIEFQADPIYINQIKQW

SEQ ID NO: 1682359 - protein, 34 aa, Staphylococcus aureus
EESKFEFDPLVKQLKPFGFFDYNALQKDAFVVLS

SEQ ID NO: 1682360 - protein, 25 aa, Staphylococcus aureus
ELAKNYNIPLYLGKTLSNVKGTWIM

SEQ ID NO: 1682361 - protein, 27 aa, Staphylococcus aureus
ELENGLRLFIIPKPGFQKTFVTYTTQF

SEQ ID NO: 1682362 - protein, 24 aa, Staphylococcus aureus
FDDEEYLFHVLRNGAKGYILKNAP

SEQ ID NO: 1682363 - protein, 17 aa, Staphylococcus aureus
FIALRPSGTEPKIKLYV

SEQ ID NO: 1682364 - protein, 19 aa, Staphylococcus aureus
FLKIVIRDVAKRTAAKQTK

SEQ ID NO: 1682365 - protein, 25 aa, Staphylococcus aureus
FNNKHDLAALSYLTFVALDDEGKPK

SEQ ID NO: 1682366 - protein, 23 aa, Staphylococcus aureus
GARRLHTILEKMLEDLSFEAPSM

SEQ ID NO: 1682367 - protein, 24 aa, Staphylococcus aureus
GIFKKPVITPIKPYKNFYPAEDYH

SEQ ID NO: 1682368 - protein, 21 aa, Staphylococcus aureus
GSQFIGKRISSAFLKIVIRDV

SEQ ID NO: 1682369 - protein, 27 aa, Staphylococcus aureus
HDWRTKKPVIFRATPQWFASISKVRQD

SEQ ID NO: 1682370 - protein, 19 aa, Staphylococcus aureus
HYFIFPKNRRDDVTKLPFI

SEQ ID NO: 1682371 - protein, 19 aa, Staphylococcus aureus
IINTFGIPSVILGVGYEKI

SEQ ID NO: 1682372 - protein, 18 aa, Staphylococcus aureus
IPYKVDIYPYYGSDASAA

SEQ ID NO: 1682373 - protein, 32 aa, Staphylococcus aureus
ITGAQAWVGTLLKMKPVLKFEDGKIIPEEKVR

SEQ ID NO: 1682374 - protein, 21 aa, Staphylococcus aureus
ITSEQLELLRILFNYDRLSQY

SEQ ID NO: 1682375 - protein, 19 aa, Staphylococcus aureus
KCRPAINYYLNMVYPHDHE

SEQ ID NO: 1682376 - protein, 25 aa, Staphylococcus aureus
KDAVQIVPLIIKYASELKLYGKTLK

SEQ ID NO: 1682377 - protein, 22 aa, Staphylococcus aureus
KEKFKQLFRVLEDTFARPLSPY

SEQ ID NO: 1682378 - protein, 21 aa, Staphylococcus aureus
KELLDLLRLHLSLFNKYEKDE

SEQ ID NO: 1682379 - protein, 22 aa, Staphylococcus aureus
KEYYVGFVIDRATDQVTLMASE

SEQ ID NO: 1682380 - protein, 20 aa, Staphylococcus aureus
KHDNSFDIHLIPETRRSTIL

SEQ ID NO: 1682381 - protein, 21 aa, Staphylococcus aureus
KLDFHKLKEILMQWQRGIYDG

SEQ ID NO: 1682382 - protein, 18 aa, Staphylococcus aureus
KLILRRAAQFLTYGDTIS

SEQ ID NO: 1682383 - protein, 23 aa, Staphylococcus aureus
KPHIVFMMTFPEDIKPIIKALNN

SEQ ID NO: 1682384 - protein, 20 aa, Staphylococcus aureus
KRISSAFLKIVIRDVAKRTA

SEQ ID NO: 1682385 - protein, 17 aa, Staphylococcus aureus
KSRFIDKSLSSLPYVLC

SEQ ID NO: 1682386 - protein, 21 aa, Staphylococcus aureus
KVNYLTETLGFDAGIDYKKED

SEQ ID NO: 1682387 - protein, 19 aa, Staphylococcus aureus
LAQHYPLKRIAVMSAPKEK

SEQ ID NO: 1682388 - protein, 17 aa, Staphylococcus aureus
LCDYFKEKQIKHVYVSD

SEQ ID NO: 1682389 - protein, 23 aa, Staphylococcus aureus
LDTSLLFNIIPERFQGRTIDDDL

SEQ ID NO: 1682390 - protein, 17 aa, Staphylococcus aureus
LFTYFVKHNPMTACYFV

SEQ ID NO: 1682391 - protein, 29 aa, Staphylococcus aureus
LQEEVPEGLIPLLKIQGLGSKKIAKLYKE

SEQ ID NO: 1682392 - protein, 22 aa, Staphylococcus aureus
LVNQLVDLLYTSTFIIEKPSYP

SEQ ID NO: 1682393 - protein, 17 aa, Staphylococcus aureus
MDHIAPLGNIYQAGTLS

SEQ ID NO: 1682394 - protein, 33 aa, Staphylococcus aureus
MKDNANYFLSLGIKTVLITLGKQGTYFATKNQS

SEQ ID NO: 1682395 - protein, 30 aa, Staphylococcus aureus
MLADPEKLKHWLPVDLYIGGVEHAVLHLLY

SEQ ID NO: 1682396 - protein, 18 aa, Staphylococcus aureus
MVNAIRLGEQFDSLLPDS

SEQ ID NO: 1682397 - protein, 25 aa, Staphylococcus aureus
NCLMEVLGLALPYNGTALAVSDQRR

SEQ ID NO: 1682398 - protein, 28 aa, Staphylococcus aureus
NEGAIEPWIPTSSDFYPTLLKRVCEVYK

SEQ ID NO: 1682399 - protein, 23 aa, Staphylococcus aureus
NEKVLRNIFISIASYIKDAAKSC

SEQ ID NO: 1682400 - protein, 19 aa, Staphylococcus aureus
NTFLTPYLSTPLAEGADIV

SEQ ID NO: 1682401 - protein, 17 aa, Staphylococcus aureus
NVKYPLADFALTPDVAI

SEQ ID NO: 1682402 - protein, 17 aa, Staphylococcus aureus
PFCNYLIAHSGSSQPLV

SEQ ID NO: 1682403 - protein, 26 aa, Staphylococcus aureus
PKEVFGDDFVFLPKNELLTFDEMARI

SEQ ID NO: 1682404 - protein, 19 aa, Staphylococcus aureus
PVAIPHLRDNMIKHPMILI

SEQ ID NO: 1682405 - protein, 17 aa, Staphylococcus aureus
QILGVDPAFRTGCKLAV

SEQ ID NO: 1682406 - protein, 25 aa, Staphylococcus aureus
QPPSAHLFFNDPMLSIFLYSEVEHR

SEQ ID NO: 1682407 - protein, 25 aa, Staphylococcus aureus
QRIGIRMADLLEKETFERLLKSNIE

SEQ ID NO: 1682408 - protein, 23 aa, Staphylococcus aureus
QRSQQLITTDLFLNVFGISNIED

SEQ ID NO: 1682409 - protein, 18 aa, Staphylococcus aureus
QSDRRIMMALQHVAQHKN

SEQ ID NO: 1682410 - protein, 29 aa, Staphylococcus aureus
RDNVHFVVLGHYQLLDALLDKSLQTPDIL

SEQ ID NO: 1682411 - protein, 22 aa, Staphylococcus aureus
RIMRLHYEGILQERLDELGEMP

SEQ ID NO: 1682412 - protein, 19 aa, Staphylococcus aureus
RVNFLFGDIVKVTPSSKVV

SEQ ID NO: 1682413 - protein, 26 aa, Staphylococcus aureus
SNVIRVLFDEGFIALRPSGTEPKIKL

SEQ ID NO: 1682414 - protein, 17 aa, Staphylococcus aureus
SPLYIYDPKVRKTLGIK

SEQ ID NO: 1682415 - protein, 22 aa, Staphylococcus aureus
SQYDTFILISKHEGLPISIIEA

SEQ ID NO: 1682416 - protein, 23 aa, Staphylococcus aureus
TETGIFVTIIRSFSHFSNQLYPP

SEQ ID NO: 1682417 - protein, 22 aa, Staphylococcus aureus
TLINLLIEQDILPSSPVPTTSN

SEQ ID NO: 1682418 - protein, 26 aa, Staphylococcus aureus
TLIYVFEIIDGWCRIYWNNHNEWIWH

SEQ ID NO: 1682419 - protein, 29 aa, Staphylococcus aureus
TRIMDLVTPIGLGQRGLIVAPPKAGKTSL

SEQ ID NO: 1682420 - protein, 25 aa, Staphylococcus aureus
TTEFEDLLYMVDGTYYYAVHFDSHV

SEQ ID NO: 1682421 - protein, 24 aa, Staphylococcus aureus
VTDKEKILVLGSGPIRIGQGVEFD

SEQ ID NO: 1682422 - protein, 17 aa, Staphylococcus aureus
VYIEPLTHDFIARIIRK

SEQ ID NO: 1682423 - protein, 41 aa, Staphylococcus aureus
YQDIAILYRDESYAYLFDSILPLYNIPYNIDTKRSMTHHPV

SEQ ID NO: 1682424 - protein, 17 aa, Staphylococcus aureus
YVLPDAVTRFRQGLGRL

SEQ ID NO: 1682425 - protein, 17 aa, Staphylococcus aureus
YVPVIKHADEKSIKGIA

SEQ ID NO: 1682426 - protein, 26 aa, Staphylococcus aureus
AEKILPLPHIIDIPKRVFAKLDIPAN

SEQ ID NO: 1682427 - protein, 19 aa, Staphylococcus aureus
AVRRNPYSVILLDEVEKAH

SEQ ID NO: 1682428 - protein, 25 aa, Staphylococcus aureus
CEADDWKPFYEAYGSQFEDIEIEMD

SEQ ID NO: 1682429 - protein, 24 aa, Staphylococcus aureus
DITGQILTNIFGLEVFAEYQPFDN

SEQ ID NO: 1682430 - protein, 21 aa, Staphylococcus aureus
DRKNYFYPDNPKAYQISQFDQ

SEQ ID NO: 1682431 - protein, 18 aa, Staphylococcus aureus
DSYSQLLEFAYPTDRTEV

SEQ ID NO: 1682432 - protein, 37 aa, Staphylococcus aureus
DVILDWQGKSYFFPSKLAFVLFFIKQLEITEHHFVIN

SEQ ID NO: 1682433 - protein, 27 aa, Staphylococcus aureus
DYLKDLGIDVIWLSPMFKSPNDDNGYD

SEQ ID NO: 1682434 - protein, 24 aa, Staphylococcus aureus
EASKTVIDVQTPLSGTIIERNTKA

SEQ ID NO: 1682435 - protein, 33 aa, Staphylococcus aureus
EFNQLIDWVMDVSNIQYLAIASWGRHIYQNTSR

SEQ ID NO: 1682436 - protein, 17 aa, Staphylococcus aureus
EKMHTASTIYLYGTGRA

SEQ ID NO: 1682437 - protein, 25 aa, Staphylococcus aureus
EKNVAPLELALSSGATFVAQGFSSD

SEQ ID NO: 1682438 - protein, 17 aa, Staphylococcus aureus
ELAQRSFLLQDSTILKC

SEQ ID NO: 1682439 - protein, 31 aa, Staphylococcus aureus
EMEYRKLGKYPPYYYLINFTISHKEMKKVME

SEQ ID NO: 1682440 - protein, 25 aa, Staphylococcus aureus
EYKDVVFIYPMHRNPKVRAIAEKYL

SEQ ID NO: 1682441 - protein, 19 aa, Staphylococcus aureus
FHHDALYSDYLIASDYSFV

SEQ ID NO: 1682442 - protein, 22 aa, Staphylococcus aureus
FIVYKGVRIINTEDLVLPGEHN

SEQ ID NO: 1682443 - protein, 21 aa, Staphylococcus aureus
FKRALTRVLNSYGLSSKIMKE

SEQ ID NO: 1682444 - protein, 17 aa, Staphylococcus aureus
FVEGSAVPSLFGIQQDA

SEQ ID NO: 1682445 - protein, 18 aa, Staphylococcus aureus
FVKLITLKEDDTLIGAQV

SEQ ID NO: 1682446 - protein, 26 aa, Staphylococcus aureus
GANVKGYFIWSLMDVFSWSNGYEKRY

SEQ ID NO: 1682447 - protein, 25 aa, Staphylococcus aureus
GASMILLIVNILSDKQLKDLYNYAI

SEQ ID NO: 1682448 - protein, 23 aa, Staphylococcus aureus
GATVSVIYVPAPFAADSILEAAD

SEQ ID NO: 1682449 - protein, 36 aa, Staphylococcus aureus
GGVEHAVLHLLYARFWHKVLYDLGIVPTKEPFQKLF

SEQ ID NO: 1682450 - protein, 27 aa, Staphylococcus aureus
GHDAHTAYMLVLAETLAEMKDSFTGKV

SEQ ID NO: 1682451 - protein, 24 aa, Staphylococcus aureus
GYDDYYYYYIDPLWSHIRRGLVLP

SEQ ID NO: 1682452 - protein, 22 aa, Staphylococcus aureus
HDKILYLYRKFLDLLDLTDNTF

SEQ ID NO: 1682453 - protein, 25 aa, Staphylococcus aureus
HRSNLVMMGVLPLEFKKGESADSLG

SEQ ID NO: 1682454 - protein, 17 aa, Staphylococcus aureus
HSLMVAGAMLGVNVRIC

SEQ ID NO: 1682455 - protein, 28 aa, Staphylococcus aureus
IASERIEVLVPLKYLLIGGEVLNAKWVD

SEQ ID NO: 1682456 - protein, 27 aa, Staphylococcus aureus
IDNYDGHLLIQWYSKGIYKFKYAILEA

SEQ ID NO: 1682457 - protein, 20 aa, Staphylococcus aureus
IILIHACWLANIEIAMINTR

SEQ ID NO: 1682458 - protein, 28 aa, Staphylococcus aureus
INLTRLSIFIFIINILNQLRGIVIYQND

SEQ ID NO: 1682459 - protein, 28 aa, Staphylococcus aureus
IVEKMVEGRLRKYLQEICAVDQDFVKNP

SEQ ID NO: 1682460 - protein, 24 aa, Staphylococcus aureus
KAQPLIMGCYGIGISRTLSAIVEQ

SEQ ID NO: 1682461 - protein, 22 aa, Staphylococcus aureus
KEAAMLAGYFSKAGNSGQIPVD

SEQ ID NO: 1682462 - protein, 23 aa, Staphylococcus aureus
KGSNFYWMDYYTIKQIIQRLGVN

SEQ ID NO: 1682463 - protein, 17 aa, Staphylococcus aureus
KHEVQCVICLPAALLNE

SEQ ID NO: 1682464 - protein, 23 aa, Staphylococcus aureus
KKDIDKTIFPGIQGGPLEHVIAA

SEQ ID NO: 1682465 - protein, 32 aa, Staphylococcus aureus
KKLVIQTYFERAHLKFLSSLPVGGLGLDFVHD

SEQ ID NO: 1682466 - protein, 22 aa, Staphylococcus aureus
KPEENWLFKLDDVDKEAFLALP

SEQ ID NO: 1682467 - protein, 18 aa, Staphylococcus aureus
KVMYITDGVFSMDGDVAK

SEQ ID NO: 1682468 - protein, 18 aa, Staphylococcus aureus
LDDHQNMIFAFEESYGFL

SEQ ID NO: 1682469 - protein, 18 aa, Staphylococcus aureus
NDICLIEELAPFFEAGID

SEQ ID NO: 1682470 - protein, 23 aa, Staphylococcus aureus
NYIAQYPNRFVGFATLPINEPEA

SEQ ID NO: 1682471 - protein, 26 aa, Staphylococcus aureus
PEGEYSKIYLFSSNLEKITAFRDELK

SEQ ID NO: 1682472 - protein, 24 aa, Staphylococcus aureus
PKGTYDICKPLTIYGNTTLLLDNE

SEQ ID NO: 1682473 - protein, 19 aa, Staphylococcus aureus
PQLVLLDINLPTLNGFHWC

SEQ ID NO: 1682474 - protein, 20 aa, Staphylococcus aureus
QFIGKPEPIIMVKALEILGL

SEQ ID NO: 1682475 - protein, 18 aa, Staphylococcus aureus
QFKLMFKDGEIIDFSAEK

SEQ ID NO: 1682476 - protein, 17 aa, Staphylococcus aureus
QSHLLGLSLIGVNEILA

SEQ ID NO: 1682477 - protein, 21 aa, Staphylococcus aureus
QVIEYPLLEIIMRYNDNGYET

SEQ ID NO: 1682478 - protein, 25 aa, Staphylococcus aureus
SIAYKVMLDIFYPELITIGSNSVIG

SEQ ID NO: 1682479 - protein, 25 aa, Staphylococcus aureus
SQFKDEVPILSLPTDYVRPNIKTTN

SEQ ID NO: 1682480 - protein, 23 aa, Staphylococcus aureus
SRDGQVFYLYNKVQSIYEKREQL

SEQ ID NO: 1682481 - protein, 28 aa, Staphylococcus aureus
TAAFGQLLPESLLALPKLGAINVHASLL

SEQ ID NO: 1682482 - protein, 35 aa, Staphylococcus aureus
TETFETNVYPLFWTVQKALEYLKPGASITTTSSVQ

SEQ ID NO: 1682483 - protein, 19 aa, Staphylococcus aureus
TFRLFEFYEQQYDIKFKYV

SEQ ID NO: 1682484 - protein, 21 aa, Staphylococcus aureus
TKKQLFNATSIYLEAIYSLCV

SEQ ID NO: 1682485 - protein, 27 aa, Staphylococcus aureus
TRQLINDFAYKHRIPWIYGGVVQSTYT

SEQ ID NO: 1682486 - protein, 17 aa, Staphylococcus aureus
VANSIVSQLLFLQAQDS

SEQ ID NO: 1682487 - protein, 25 aa, Staphylococcus aureus
VARDYALTGLEFACGIPGSIGGAVY

SEQ ID NO: 1682488 - protein, 26 aa, Staphylococcus aureus
VAVVMGPGPIGLLVAQVLKSKGATVV

SEQ ID NO: 1682489 - protein, 34 aa, Staphylococcus aureus
VRHILFDKQTWPFKQILLPLLYQRDSGGGSMPSG

SEQ ID NO: 1682490 - protein, 17 aa, Staphylococcus aureus
VVLFKMHPFVKNRLNIA

SEQ ID NO: 1682491 - protein, 17 aa, Staphylococcus aureus
VYVKGYDDLQFFESFIL

SEQ ID NO: 1682492 - protein, 25 aa, Staphylococcus aureus
WEDLPKVKSLWPQPGDHLLVTLRID

SEQ ID NO: 1682493 - protein, 30 aa, Staphylococcus aureus
YISTFSKSIFPSCRVAYMVLPYSIMKKYHS

SEQ ID NO: 1682494 - protein, 23 aa, Staphylococcus aureus
AGIPSNKIWLDPGIGFAKTRNEE

SEQ ID NO: 1682495 - protein, 18 aa, Staphylococcus aureus
AHIYLELADDYQALAILP

SEQ ID NO: 1682496 - protein, 18 aa, Staphylococcus aureus
AVCDGAFFKNKRLFVIGG

SEQ ID NO: 1682497 - protein, 29 aa, Staphylococcus aureus
DGNLGYITAILLRKLYPEAKIYVFGKTDY

SEQ ID NO: 1682498 - protein, 19 aa, Staphylococcus aureus
DILTIGQYLQPSRKHLKVQ

SEQ ID NO: 1682499 - protein, 18 aa, Staphylococcus aureus
DKKKFVLGSVSHKVAKRA

SEQ ID NO: 1682500 - protein, 26 aa, Staphylococcus aureus
EQTVQRFYNKGFFHENGQPDFLNIKI

SEQ ID NO: 1682501 - protein, 24 aa, Staphylococcus aureus
ERPMIRATAYWAIGQILGEEARDF

SEQ ID NO: 1682502 - protein, 20 aa, Staphylococcus aureus
FIDAQFEPLRKMEAPMFKKI

SEQ ID NO: 1682503 - protein, 17 aa, Staphylococcus aureus
GADISVRYPEFTSSLML

SEQ ID NO: 1682504 - protein, 17 aa, Staphylococcus aureus
GGTFRLFEFYEQQYDIK

SEQ ID NO: 1682505 - protein, 25 aa, Staphylococcus aureus
HKYPDESELLIYFIEGLMSENQTDE

SEQ ID NO: 1682506 - protein, 19 aa, Staphylococcus aureus
HLFNDDHYFIFPKNRRDDV

SEQ ID NO: 1682507 - protein, 39 aa, Staphylococcus aureus
IDYTYVRMAMYMDPLKPYLPELMNMHKLIYPAGDGRINY

SEQ ID NO: 1682508 - protein, 17 aa, Staphylococcus aureus
IEIDRIKVLYSKQPKLV

SEQ ID NO: 1682509 - protein, 17 aa, Staphylococcus aureus
ILKGLRDRYEAHHRINI

SEQ ID NO: 1682510 - protein, 26 aa, Staphylococcus aureus
INLTDKWIIQIAYGKLIIMAKNNGDT

SEQ ID NO: 1682511 - protein, 22 aa, Staphylococcus aureus
KAQDKVLMIFGPEGGLSENEIS

SEQ ID NO: 1682512 - protein, 22 aa, Staphylococcus aureus
KPLPNMIFHQVEVNQYAVFQYP

SEQ ID NO: 1682513 - protein, 21 aa, Staphylococcus aureus
KTLPPVFIAHCNGDYDVPVEE

SEQ ID NO: 1682514 - protein, 17 aa, Staphylococcus aureus
KVSLELGGKSPYIVLDD

SEQ ID NO: 1682515 - protein, 28 aa, Staphylococcus aureus
NHLDFESISWLINYVKQYPHTVLFVTHD

SEQ ID NO: 1682516 - protein, 19 aa, Staphylococcus aureus
PMKFLPEDGSLQLTAGWTG

SEQ ID NO: 1682517 - protein, 35 aa, Staphylococcus aureus
PRVEKLMQAFWPGPISFILPLKPGYLCRKVSGGLS

SEQ ID NO: 1682518 - protein, 17 aa, Staphylococcus aureus
PTKIYRTALLKDNDIYF

SEQ ID NO: 1682519 - protein, 20 aa, Staphylococcus aureus
PYRVLRIGSFLLSESGYKIF

SEQ ID NO: 1682520 - protein, 18 aa, Staphylococcus aureus
QHCEAFKANFKGAAQGDW

SEQ ID NO: 1682521 - protein, 22 aa, Staphylococcus aureus
QLLKMFVSTMETRLNDHNKAKH

SEQ ID NO: 1682522 - protein, 25 aa, Staphylococcus aureus
QNKKNIEFFLIPTKGAAKVEKTLNL

SEQ ID NO: 1682523 - protein, 19 aa, Staphylococcus aureus
RDNMIKHPMILITVLEEPL

SEQ ID NO: 1682524 - protein, 31 aa, Staphylococcus aureus
RGHFQGELHLRFQLAFYLFTNRGVICDPNQI

SEQ ID NO: 1682525 - protein, 19 aa, Staphylococcus aureus
RLNNQITSIIFKYLQENGI

SEQ ID NO: 1682526 - protein, 17 aa, Staphylococcus aureus
RRNMWIDSLKEMINDMS

SEQ ID NO: 1682527 - protein, 23 aa, Staphylococcus aureus
SGPLLKNGHRFGFYRGYNGHSHI

SEQ ID NO: 1682528 - protein, 21 aa, Staphylococcus aureus
SNSAPLIYKTLSALYHNFDGF

SEQ ID NO: 1682529 - protein, 20 aa, Staphylococcus aureus
SRLTTFLEHALAKTTSLHGV

SEQ ID NO: 1682530 - protein, 17 aa, Staphylococcus aureus
STVAYLRTALVENGYEV

SEQ ID NO: 1682531 - protein, 19 aa, Staphylococcus aureus
SVRYPEFTSSLMLVNPTSI

SEQ ID NO: 1682532 - protein, 21 aa, Staphylococcus aureus
TENPFSLYPQTINKLLIESEH

SEQ ID NO: 1682533 - protein, 20 aa, Staphylococcus aureus
TFNIIKSYRGKNLKLHHMDC

SEQ ID NO: 1682534 - protein, 23 aa, Staphylococcus aureus
TIKEYLIAVKGPLTTPIGGGIRS

SEQ ID NO: 1682535 - protein, 17 aa, Staphylococcus aureus
VILNNLYKQTPLQTSFG

SEQ ID NO: 1682536 - protein, 26 aa, Staphylococcus aureus
VLAIPTFKNQLLFTKHNLRGIEFPGG

SEQ ID NO: 1682537 - protein, 21 aa, Staphylococcus aureus
VTLGEIVDLLYKFKQSRLDRT

SEQ ID NO: 1682538 - protein, 18 aa, Staphylococcus aureus
WDNAQYLKNGLSKLGYDT

SEQ ID NO: 1682539 - protein, 24 aa, Staphylococcus aureus
WNPKMKKYIFTERNGIYIIDLQKT

SEQ ID NO: 1682540 - protein, 20 aa, Staphylococcus aureus
WPTAYSEIYDYQWNEKLIPY

SEQ ID NO: 1682541 - protein, 19 aa, Staphylococcus aureus
YDTLLMNYNFVIIDTPPVN

SEQ ID NO: 1682542 - protein, 17 aa, Staphylococcus aureus
YIHHLQESHLLKDQQFK

SEQ ID NO: 1682543 - protein, 17 aa, Staphylococcus aureus
YNAEIKTILSKLGIHDT

SEQ ID NO: 1682544 - protein, 26 aa, Staphylococcus aureus
ADLKVQGALAMILKDAIKPNLVQSIE

SEQ ID NO: 1682545 - protein, 30 aa, Staphylococcus aureus
ALDIDFKVEPPWFKVSPTHFVKSWLLDARA

SEQ ID NO: 1682546 - protein, 17 aa, Staphylococcus aureus
ALKQVPSCEFFPVEAVK

SEQ ID NO: 1682547 - protein, 19 aa, Staphylococcus aureus
ANYFGDIQLSKHEVLQLAT

SEQ ID NO: 1682548 - protein, 24 aa, Staphylococcus aureus
AVVKSYPMIPGIDLAGTIVESEAP

SEQ ID NO: 1682549 - protein, 26 aa, Staphylococcus aureus
DAAWITTPLNVYYFTGYRSEPHERLF

SEQ ID NO: 1682550 - protein, 23 aa, Staphylococcus aureus
DARRQAVYTGIFQWQNGQLVTIL

SEQ ID NO: 1682551 - protein, 23 aa, Staphylococcus aureus
DIYYKLNVSFPQAALGDEIKIPT

SEQ ID NO: 1682552 - protein, 18 aa, Staphylococcus aureus
DRLKLRKQTRQLAAIYLA

SEQ ID NO: 1682553 - protein, 24 aa, Staphylococcus aureus
ESQQQWLSGFLLANSNDTTSDSNQ

SEQ ID NO: 1682554 - protein, 20 aa, Staphylococcus aureus
EYPVLLATSRKRFTKEMMGY

SEQ ID NO: 1682555 - protein, 17 aa, Staphylococcus aureus
FIKVIREVGRNGVIELG

SEQ ID NO: 1682556 - protein, 23 aa, Staphylococcus aureus
FNGAFDLILKQNKVRDAHPEVTL

SEQ ID NO: 1682557 - protein, 22 aa, Staphylococcus aureus
GDKWILYGLNGAGKTTLLNILN

SEQ ID NO: 1682558 - protein, 21 aa, Staphylococcus aureus
GDLAPLSHLALALIGEGKVLY

SEQ ID NO: 1682559 - protein, 22 aa, Staphylococcus aureus
GEDFILFNKDFYLNDKIIENAK

SEQ ID NO: 1682560 - protein, 24 aa, Staphylococcus aureus
HEDADILYIGFISTKGAIQEGSNR

SEQ ID NO: 1682561 - protein, 26 aa, Staphylococcus aureus
HGVVKIDRFPIFIPQALINEQIEYKI

SEQ ID NO: 1682562 - protein, 22 aa, Staphylococcus aureus
IQGEGRVIGRKTMFVRTAGCDY

SEQ ID NO: 1682563 - protein, 30 aa, Staphylococcus aureus
ITDRRKWRDKFRLPYLLGKADYIFVDDFHP

SEQ ID NO: 1682564 - protein, 18 aa, Staphylococcus aureus
IVNVLKKYPIFIISDEIY

SEQ ID NO: 1682565 - protein, 20 aa, Staphylococcus aureus
KRTRSSLALFIMICTGCRVS

SEQ ID NO: 1682566 - protein, 17 aa, Staphylococcus aureus
KSNEYVLFDLGVIYEHY

SEQ ID NO: 1682567 - protein, 17 aa, Staphylococcus aureus
KVYDWVQQVEQLGAGEL

SEQ ID NO: 1682568 - protein, 23 aa, Staphylococcus aureus
LDTASHFVLIFARKNVTSRSPYV

SEQ ID NO: 1682569 - protein, 17 aa, Staphylococcus aureus
LESFKLALPYLMTAAEL

SEQ ID NO: 1682570 - protein, 31 aa, Staphylococcus aureus
LPKVQFNLLNSSAYYRYLSRRIGAIVETTLS

SEQ ID NO: 1682571 - protein, 17 aa, Staphylococcus aureus
MARLDELVATEYPVLLA

SEQ ID NO: 1682572 - protein, 24 aa, Staphylococcus aureus
MENNYACILLDLMLPEMDGIQVAT

SEQ ID NO: 1682573 - protein, 20 aa, Staphylococcus aureus
NIDLNIYRPLFGNGSSPDEW

SEQ ID NO: 1682574 - protein, 26 aa, Staphylococcus aureus
NRLIHLSEGYIYFKDKPISDYPVYEM

SEQ ID NO: 1682575 - protein, 23 aa, Staphylococcus aureus
PKITNMGALWPTLGAIPTSSFTP

SEQ ID NO: 1682576 - protein, 25 aa, Staphylococcus aureus
PNKLIPLTFFVKKFKQAKSSISEDV

SEQ ID NO: 1682577 - protein, 47 aa, Staphylococcus aureus
PPGKKLQHLSLLSGGERALTAIALLFAILKVRSAPFVILDEVEAALD

SEQ ID NO: 1682578 - protein, 21 aa, Staphylococcus aureus
PSIDYVIFTNDFKIDGLNRAT

SEQ ID NO: 1682579 - protein, 24 aa, Staphylococcus aureus
PVNQIVYEHLAGRIPLIASGGINS

SEQ ID NO: 1682580 - protein, 22 aa, Staphylococcus aureus
QKAIMLPPGLAFVAYSHRAKER

SEQ ID NO: 1682581 - protein, 22 aa, Staphylococcus aureus
QKLSFNQLILMFDQLTEAHKKL

SEQ ID NO: 1682582 - protein, 19 aa, Staphylococcus aureus
QLKIRYIEQFGLSNSLKRK

SEQ ID NO: 1682583 - protein, 17 aa, Staphylococcus aureus
SALLYSLLHVSGSLELE

SEQ ID NO: 1682584 - protein, 20 aa, Staphylococcus aureus
SELDTLWQLRNLFTDSTDFT

SEQ ID NO: 1682585 - protein, 24 aa, Staphylococcus aureus
SISIPFDTDYGWNVKLGKNVYVNT

SEQ ID NO: 1682586 - protein, 32 aa, Staphylococcus aureus
SKLFDIVIQWGVLALIVIFQPEIRRALEQLGR

SEQ ID NO: 1682587 - protein, 22 aa, Staphylococcus aureus
SLIQRHFQIGYNRAARIIDQLE

SEQ ID NO: 1682588 - protein, 23 aa, Staphylococcus aureus
SQELLINVFIPNTPLHDGAMIIQ

SEQ ID NO: 1682589 - protein, 25 aa, Staphylococcus aureus
SRLESFIMLELQRIKGASVKLYTIP

SEQ ID NO: 1682590 - protein, 17 aa, Staphylococcus aureus
SSLLQYVSGLSSQIAKN

SEQ ID NO: 1682591 - protein, 21 aa, Staphylococcus aureus
STLASLVLGLFKPVKGEIYLS

SEQ ID NO: 1682592 - protein, 17 aa, Staphylococcus aureus
SYHSLWHQYNNSIFYYY

SEQ ID NO: 1682593 - protein, 23 aa, Staphylococcus aureus
TALPNRTKLLGVGLWLVPKPVRN

SEQ ID NO: 1682594 - protein, 20 aa, Staphylococcus aureus
TSHDVVFKLRKILKTKKIGH

SEQ ID NO: 1682595 - protein, 18 aa, Staphylococcus aureus
TVVSVFVNPLQFGPNEDF

SEQ ID NO: 1682596 - protein, 29 aa, Staphylococcus aureus
VAEQVMGQLDFLIAKARYSRSIKGTKPIF

SEQ ID NO: 1682597 - protein, 29 aa, Staphylococcus aureus
VKEAIGVSGLITPWNFPTNQTSLKLAAAF

SEQ ID NO: 1682598 - protein, 29 aa, Staphylococcus aureus
VNNRDVREYLPFESLILDLNQPFDVTETK

SEQ ID NO: 1682599 - protein, 26 aa, Staphylococcus aureus
VPAIPKLFDYIHKRYAKLSLEDLINP

SEQ ID NO: 1682600 - protein, 24 aa, Staphylococcus aureus
VSGSFHLLENLLNGSMKRVPQIPL

SEQ ID NO: 1682601 - protein, 31 aa, Staphylococcus aureus
VSQMMLYELRNLFPEIIFLDAISLRTFENYT

SEQ ID NO: 1682602 - protein, 28 aa, Staphylococcus aureus
VVASPLPQSILEHQLIRTLADGKNIVIA

SEQ ID NO: 1682603 - protein, 17 aa, Staphylococcus aureus
YFAFGAYAQNLMLLLYE

SEQ ID NO: 1682604 - protein, 17 aa, Staphylococcus aureus
YLSRRIGAIVETTLSAL

SEQ ID NO: 1682605 - protein, 30 aa, Staphylococcus aureus
AAGTLYNIVGFQTHLKWGAQKEVIKLIPGL

SEQ ID NO: 1682606 - protein, 22 aa, Staphylococcus aureus
AEPFIKSNRLKGLSLKDVELSV

SEQ ID NO: 1682607 - protein, 26 aa, Staphylococcus aureus
AKAHELKPDLILMDLLMEDMDGVEAT

SEQ ID NO: 1682608 - protein, 17 aa, Staphylococcus aureus
AQDYYYKDQKHLTFDER

SEQ ID NO: 1682609 - protein, 23 aa, Staphylococcus aureus
AQIANRLRFFFPDVQVRGYYPSY

SEQ ID NO: 1682610 - protein, 25 aa, Staphylococcus aureus
DFIEKYRFFDMLQASLHPYGSWQEY

SEQ ID NO: 1682611 - protein, 22 aa, Staphylococcus aureus
DKLEQDLIKKFKLSGLVNADQT

SEQ ID NO: 1682612 - protein, 18 aa, Staphylococcus aureus
DLYLSVLGMPGQTAYHGL

SEQ ID NO: 1682613 - protein, 21 aa, Staphylococcus aureus
DTLRYYEKVGVIPPVNRDENG

SEQ ID NO: 1682614 - protein, 21 aa, Staphylococcus aureus
EEGEVPKLYLTSHMDTVVPAI

SEQ ID NO: 1682615 - protein, 22 aa, Staphylococcus aureus
EELIRRLRRGIYAKQKVVVFKP

SEQ ID NO: 1682616 - protein, 19 aa, Staphylococcus aureus
EVLKYIDFNAGNIAKQLLN

SEQ ID NO: 1682617 - protein, 18 aa, Staphylococcus aureus
FRYFGKPIPAIQGLYSRG

SEQ ID NO: 1682618 - protein, 29 aa, Staphylococcus aureus
GGIVLAIRNELHIPVKYVGLGEQLDDLQP

SEQ ID NO: 1682619 - protein, 35 aa, Staphylococcus aureus
GLAPEAWLECYLDRTLLPILKLFSNTGISLEAHVQ

SEQ ID NO: 1682620 - protein, 25 aa, Staphylococcus aureus
GTLFRKNIYQMIPQEVTPMIPSSLV

SEQ ID NO: 1682621 - protein, 24 aa, Staphylococcus aureus
GVYVVPAFVGLGTPYWDSEARGAI

SEQ ID NO: 1682622 - protein, 19 aa, Staphylococcus aureus
HQYIALGEDFKALIQGQLD

SEQ ID NO: 1682623 - protein, 24 aa, Staphylococcus aureus
IDENISFYKLVNKFSPEVAPEDTV

SEQ ID NO: 1682624 - protein, 17 aa, Staphylococcus aureus
IIDIVRRVQGGQFEHVG

SEQ ID NO: 1682625 - protein, 22 aa, Staphylococcus aureus
IKKGEILFLGEDLAKKPENELI

SEQ ID NO: 1682626 - protein, 19 aa, Staphylococcus aureus
ILSSVLMLEHLGWQEAADK

SEQ ID NO: 1682627 - protein, 24 aa, Staphylococcus aureus
KEVKDYMPPVYHSEFRDFKGWTKM

SEQ ID NO: 1682628 - protein, 23 aa, Staphylococcus aureus
KGPKIYQQKLYQLGIEPNIIEMF

SEQ ID NO: 1682629 - protein, 24 aa, Staphylococcus aureus
KHKFSELHVFPYSPRIGTPAARMD

SEQ ID NO: 1682630 - protein, 18 aa, Staphylococcus aureus
KQYLITDFRYIDQATKQA

SEQ ID NO: 1682631 - protein, 30 aa, Staphylococcus aureus
LDYDIVFSPMFVLTHKKLFITKVALSENEQ

SEQ ID NO: 1682632 - protein, 19 aa, Staphylococcus aureus
LFNAMVMTPYFPKPDVMIY

SEQ ID NO: 1682633 - protein, 27 aa, Staphylococcus aureus
LGPQDSYLLVRGIKTLGLRMEQINRSV

SEQ ID NO: 1682634 - protein, 17 aa, Staphylococcus aureus
LLAQDYYYKDQKHLTFD

SEQ ID NO: 1682635 - protein, 26 aa, Staphylococcus aureus
LMITHYQRLLNYITPDKVHVMYAGKV

SEQ ID NO: 1682636 - protein, 22 aa, Staphylococcus aureus
LNLELRIPIIMISGNHDGKERL

SEQ ID NO: 1682637 - protein, 20 aa, Staphylococcus aureus
LPREIPSVNLIPYARKLEVL

SEQ ID NO: 1682638 - protein, 24 aa, Staphylococcus aureus
LQDRRKAFQFAYLSLMQEEKIQAN

SEQ ID NO: 1682639 - protein, 21 aa, Staphylococcus aureus
LSQIIKFHGPLNALINYDYVH

SEQ ID NO: 1682640 - protein, 17 aa, Staphylococcus aureus
MDLPNGIHSLGYTNVPV

SEQ ID NO: 1682641 - protein, 24 aa, Staphylococcus aureus
MGEPDEVWKERLELLKPYQVNKEM

SEQ ID NO: 1682642 - protein, 17 aa, Staphylococcus aureus
MLTLFRGGPTVWISNED

SEQ ID NO: 1682643 - protein, 21 aa, Staphylococcus aureus
NEIAPYKRPLSNMAPTIVMHH

SEQ ID NO: 1682644 - protein, 25 aa, Staphylococcus aureus
NEREPSVLPARFPNLLANGASGIAV

SEQ ID NO: 1682645 - protein, 23 aa, Staphylococcus aureus
NETLILSHYIFMNELKINLLEFR

SEQ ID NO: 1682646 - protein, 25 aa, Staphylococcus aureus
NFQPMNANFGLLPSLETRIKDKKER

SEQ ID NO: 1682647 - protein, 21 aa, Staphylococcus aureus
NVPLIGFTGAPFTLASYMIEG

SEQ ID NO: 1682648 - protein, 26 aa, Staphylococcus aureus
PEGIYLSGALLMFAGSKSYYLYGASS

SEQ ID NO: 1682649 - protein, 19 aa, Staphylococcus aureus
PRIGIPNKGDWTHKSLRYT

SEQ ID NO: 1682650 - protein, 21 aa, Staphylococcus aureus
PYLTQHKLKLYLAAQHIVMES

SEQ ID NO: 1682651 - protein, 20 aa, Staphylococcus aureus
PYSNSIWLFDVGEGTQHQIL

SEQ ID NO: 1682652 - protein, 36 aa, Staphylococcus aureus
QFLDIDNKPILIHTIEKFILVSEFNEIIIATPAQWI

SEQ ID NO: 1682653 - protein, 25 aa, Staphylococcus aureus
RTGKWFAMEWEQVVPDIYILGKALG

SEQ ID NO: 1682654 - protein, 26 aa, Staphylococcus aureus
SDIVYHLIALLRYGGGISYQLLDDHS

SEQ ID NO: 1682655 - protein, 19 aa, Staphylococcus aureus
SFEKLEPKYLERYSRRINH

SEQ ID NO: 1682656 - protein, 22 aa, Staphylococcus aureus
SPDKILGAILFEQTMDREVEGK

SEQ ID NO: 1682657 - protein, 19 aa, Staphylococcus aureus
SVVEKLITLGKKGDLASRR

SEQ ID NO: 1682658 - protein, 20 aa, Staphylococcus aureus
TATFMILGAVCTRACRFCAV

SEQ ID NO: 1682659 - protein, 18 aa, Staphylococcus aureus
TDKIIDAFGMRPYIKKKV

SEQ ID NO: 1682660 - protein, 20 aa, Staphylococcus aureus
THFVKSWLLDARAPKVELPE

SEQ ID NO: 1682661 - protein, 23 aa, Staphylococcus aureus
TLRMNYLFDFYQSLLTNKQRNYL

SEQ ID NO: 1682662 - protein, 23 aa, Staphylococcus aureus
VIFDLLVEYDGELPFWDKSSPEA

SEQ ID NO: 1682663 - protein, 18 aa, Staphylococcus aureus
VKPIGIKVTRLAQGLSVG

SEQ ID NO: 1682664 - protein, 26 aa, Staphylococcus aureus
YDTSNPDVAVLRRYWNGRWIEATPND

SEQ ID NO: 1682665 - protein, 28 aa, Staphylococcus aureus
YRSCDISLVMRALDSILPFLEKGNTIIV

SEQ ID NO: 1682666 - protein, 18 aa, Staphylococcus aureus
YSFHLTLTQVKLLNLLVK

SEQ ID NO: 1682667 - protein, 21 aa, Staphylococcus aureus
YTEHQLLVSAIPRHKINNDPR

SEQ ID NO: 1682668 - protein, 29 aa, Staphylococcus aureus
ALDDALYDGLIFKNPAYKVNYKAGKPTKS

SEQ ID NO: 1682669 - protein, 23 aa, Staphylococcus aureus
ANKKDFGWIYSSSLASSAAVYTL

SEQ ID NO: 1682670 - protein, 30 aa, Staphylococcus aureus
DEDTLELLRFRYWDCPIGCYEWEDIAHYFG

SEQ ID NO: 1682671 - protein, 24 aa, Staphylococcus aureus
DEEKNNIMFILKNEDYFDEKNVSV

SEQ ID NO: 1682672 - protein, 19 aa, Staphylococcus aureus
DIYDDCEFIVAIRSMLIKK

SEQ ID NO: 1682673 - protein, 18 aa, Staphylococcus aureus
DLAQDLSNRLIQMRKRRG

SEQ ID NO: 1682674 - protein, 18 aa, Staphylococcus aureus
EAARKLNFKARKTMMVAQ

SEQ ID NO: 1682675 - protein, 29 aa, Staphylococcus aureus
EDIMIPNYRKHWHVIFELSNDKKLIYSDI

SEQ ID NO: 1682676 - protein, 18 aa, Staphylococcus aureus
EEMRLVYVALTRAKEQLY

SEQ ID NO: 1682677 - protein, 19 aa, Staphylococcus aureus
EGVFFHERKALSHFEKRYT

SEQ ID NO: 1682678 - protein, 17 aa, Staphylococcus aureus
ELSLAGFKYNLARQMLN

SEQ ID NO: 1682679 - protein, 20 aa, Staphylococcus aureus
EQPLLHIDFNDMLNALPKQL

SEQ ID NO: 1682680 - protein, 21 aa, Staphylococcus aureus
ETVYFMLTETPFYAVSGGQVA

SEQ ID NO: 1682681 - protein, 22 aa, Staphylococcus aureus
EVQKIIVYYANKQYFFNNETEL

SEQ ID NO: 1682682 - protein, 24 aa, Staphylococcus aureus
EYGDIFNYFVKKYSNIIFSAHCHN

SEQ ID NO: 1682683 - protein, 23 aa, Staphylococcus aureus
EYIGQFKTGYFSPLANLARLTEE

SEQ ID NO: 1682684 - protein, 20 aa, Staphylococcus aureus
FTCPHGRPIIINFSKYELEK

SEQ ID NO: 1682685 - protein, 32 aa, Staphylococcus aureus
GAKQVRKKFPDALFIFLAPPSLDHLRERLVGR

SEQ ID NO: 1682686 - protein, 17 aa, Staphylococcus aureus
GFKNLGFDTYFAVPKTP

SEQ ID NO: 1682687 - protein, 23 aa, Staphylococcus aureus
GTEHLLLGLMKEPEGIAAKVLES

SEQ ID NO: 1682688 - protein, 22 aa, Staphylococcus aureus
GTQMLFYYRSLVEKERRFTNLE

SEQ ID NO: 1682689 - protein, 23 aa, Staphylococcus aureus
HDIKIDKRKMDLPNGIHSLGYTN

SEQ ID NO: 1682690 - protein, 22 aa, Staphylococcus aureus
HTPIAKYRFPERNRIISGLSKG

SEQ ID NO: 1682691 - protein, 23 aa, Staphylococcus aureus
IATYELYIAALKLGVAIIPCSEM

SEQ ID NO: 1682692 - protein, 19 aa, Staphylococcus aureus
IHPESYKVTYQLLDKLGFG

SEQ ID NO: 1682693 - protein, 21 aa, Staphylococcus aureus
IIIDAIGQLIGMRASSDFVRH

SEQ ID NO: 1682694 - protein, 24 aa, Staphylococcus aureus
IMHQIRVLRELDFHFQLVIDANES

SEQ ID NO: 1682695 - protein, 17 aa, Staphylococcus aureus
IQLLTDLSKVFITAAYD

SEQ ID NO: 1682696 - protein, 23 aa, Staphylococcus aureus
KVDETFLNHLAGINLKLFKDYVN

SEQ ID NO: 1682697 - protein, 20 aa, Staphylococcus aureus
LGLLQPQMGLLRQQLELYVK

SEQ ID NO: 1682698 - protein, 29 aa, Staphylococcus aureus
LIEHSIYTTFKLLSKLPNKNLIYFESFHG

SEQ ID NO: 1682699 - protein, 21 aa, Staphylococcus aureus
LKRSETIFIYGFGASFVVATD

SEQ ID NO: 1682700 - protein, 18 aa, Staphylococcus aureus
LYDMIDYFYTLVEKDERL

SEQ ID NO: 1682701 - protein, 34 aa, Staphylococcus aureus
MRAYYLGLMSSTQYRYFWASLNKKGYKSKEPLDD

SEQ ID NO: 1682702 - protein, 18 aa, Staphylococcus aureus
NAERLGDVLVLDNILDKA

SEQ ID NO: 1682703 - protein, 20 aa, Staphylococcus aureus
NGKIVPIDYILQTGDIVEIR

SEQ ID NO: 1682704 - protein, 19 aa, Staphylococcus aureus
NMFGYTGTYKGKEVSVMGS

SEQ ID NO: 1682705 - protein, 20 aa, Staphylococcus aureus
NSMVTDFEDLKELGKEMEQI

SEQ ID NO: 1682706 - protein, 24 aa, Staphylococcus aureus
NVRDLDLMTTFYKNILGLSVKSSD

SEQ ID NO: 1682707 - protein, 24 aa, Staphylococcus aureus
PKTKGLINADFFAKAKPSLQIINV

SEQ ID NO: 1682708 - protein, 21 aa, Staphylococcus aureus
PRVKFEKVFAEHFLNLYEKTK

SEQ ID NO: 1682709 - protein, 19 aa, Staphylococcus aureus
QLEHIPFKNVCQAVVYISG

SEQ ID NO: 1682710 - protein, 20 aa, Staphylococcus aureus
QQLMSQLGLTSLLNKLPSEI

SEQ ID NO: 1682711 - protein, 17 aa, Staphylococcus aureus
RLGDVLVLDNILDKAEL

SEQ ID NO: 1682712 - protein, 17 aa, Staphylococcus aureus
RRYGSVPHCGFGLGLER

SEQ ID NO: 1682713 - protein, 31 aa, Staphylococcus aureus
SDGEAFGKFFKLMLNQGINLAPSKFEAWFLT

SEQ ID NO: 1682714 - protein, 17 aa, Staphylococcus aureus
SFEAFLEKAAVSSSQTV

SEQ ID NO: 1682715 - protein, 28 aa, Staphylococcus aureus
SIKQYGILQPIVLRKTVQGYYIVVGERR

SEQ ID NO: 1682716 - protein, 26 aa, Staphylococcus aureus
SLPVPKYRYFKLNNNKIQKMLYRILQ

SEQ ID NO: 1682717 - protein, 27 aa, Staphylococcus aureus
SQAIVKIETLFPYITLSHFGINIDESE

SEQ ID NO: 1682718 - protein, 19 aa, Staphylococcus aureus
SRILRYNEIAFKKFDSHLL

SEQ ID NO: 1682719 - protein, 30 aa, Staphylococcus aureus
SVFTAMKLRQRVWRRLAKDLKPENLHEIKQ

SEQ ID NO: 1682720 - protein, 17 aa, Staphylococcus aureus
TAEFNIWVDAEAAKRVF

SEQ ID NO: 1682721 - protein, 22 aa, Staphylococcus aureus
TDVFKPSTYPPLSYTFDHIIIK

SEQ ID NO: 1682722 - protein, 24 aa, Staphylococcus aureus
TKGAFPTWLAPKQVQIIPVNVDLH

SEQ ID NO: 1682723 - protein, 17 aa, Staphylococcus aureus
TLFTLEEHTTYLSELSL

SEQ ID NO: 1682724 - protein, 29 aa, Staphylococcus aureus
VAALQHALDVWLLGKLQFAEFEHFPSVDT

SEQ ID NO: 1682725 - protein, 50 aa, Staphylococcus aureus
VDGAHIRTLLLTFFYRFMRPLIEAGYVYIAQPPLYKLTQGKQKYYVYNDR

SEQ ID NO: 1682726 - protein, 17 aa, Staphylococcus aureus
VIRHPFNNYYEKLANIN

SEQ ID NO: 1682727 - protein, 20 aa, Staphylococcus aureus
VKNLGPLDDIMKMIPGMNKM

SEQ ID NO: 1682728 - protein, 19 aa, Staphylococcus aureus
VQKDIAIYAPLTGEYVKIE

SEQ ID NO: 1682729 - protein, 26 aa, Staphylococcus aureus
VRIASPEFMFPSFYGIDVSTTAELIS

SEQ ID NO: 1682730 - protein, 32 aa, Staphylococcus aureus
WTKQFLAVAIRPMIHMLYYHGIAFESHAQNMM

SEQ ID NO: 1682731 - protein, 18 aa, Staphylococcus aureus
YAFIKRLIKQFGKPQKVI

SEQ ID NO: 1682732 - protein, 28 aa, Staphylococcus aureus
YDNPFNPPMFARVFRKHLEGGIIESIKQ

SEQ ID NO: 1682733 - protein, 25 aa, Staphylococcus aureus
YGTSIPTCILVFKKCRQQDDNVLFI

SEQ ID NO: 1682734 - protein, 19 aa, Staphylococcus aureus
AEVKDYVFINNHDPRLFEG

SEQ ID NO: 1682735 - protein, 24 aa, Staphylococcus aureus
DEAKEYWLCWVTTERNEQGPYYAG

SEQ ID NO: 1682736 - protein, 17 aa, Staphylococcus aureus
DFTEEKLELAKKVIISH

SEQ ID NO: 1682737 - protein, 18 aa, Staphylococcus aureus
DYVFINNHDPRLFEGFSM

SEQ ID NO: 1682738 - protein, 23 aa, Staphylococcus aureus
EHLAKIKSLVNIPIIASGGGGNA

SEQ ID NO: 1682739 - protein, 19 aa, Staphylococcus aureus
EHVGQIMAEAYAVRAGKNK

SEQ ID NO: 1682740 - protein, 26 aa, Staphylococcus aureus
EKARLQLALLMLQRDNVLILDEPTNH

SEQ ID NO: 1682741 - protein, 24 aa, Staphylococcus aureus
ELENLIGQELILIRARYAYQDLLE

SEQ ID NO: 1682742 - protein, 24 aa, Staphylococcus aureus
ELGMTGKTWLFFGDQHRSSDFLYE

SEQ ID NO: 1682743 - protein, 21 aa, Staphylococcus aureus
ESENIMAVPAVFLNGEEFGNG

SEQ ID NO: 1682744 - protein, 23 aa, Staphylococcus aureus
ETQFIVITHRKGTMEFADRLYGV

SEQ ID NO: 1682745 - protein, 27 aa, Staphylococcus aureus
FKDIEARIYPVGRLDYDTSGLLLLTND

SEQ ID NO: 1682746 - protein, 17 aa, Staphylococcus aureus
FNITKLLHIKRSKTILF

SEQ ID NO: 1682747 - protein, 24 aa, Staphylococcus aureus
GPSWKYLKFIFNKDEEKNNIMFIL

SEQ ID NO: 1682748 - protein, 26 aa, Staphylococcus aureus
HLKVQKYYTPLEFGKLRKVAMDKGFK

SEQ ID NO: 1682749 - protein, 17 aa, Staphylococcus aureus
IELIKSDITGYQIHKQT

SEQ ID NO: 1682750 - protein, 17 aa, Staphylococcus aureus
IGGPTMLRAAAKNYKHV

SEQ ID NO: 1682751 - protein, 19 aa, Staphylococcus aureus
IMKHSPTALRFLKAAMNAD

SEQ ID NO: 1682752 - protein, 19 aa, Staphylococcus aureus
IVSNEDKWVYEMLGMDSTC

SEQ ID NO: 1682753 - protein, 24 aa, Staphylococcus aureus
IVVPDYMDIYDFTPIQYPADDQNS

SEQ ID NO: 1682754 - protein, 17 aa, Staphylococcus aureus
KLNIMFPMVATINEFRE

SEQ ID NO: 1682755 - protein, 36 aa, Staphylococcus aureus
KSYKQLPMTLFQIQSKFRDEKRPRFGLLRGREFIMK

SEQ ID NO: 1682756 - protein, 20 aa, Staphylococcus aureus
LECPSIISQVKFYHVPDGIT

SEQ ID NO: 1682757 - protein, 24 aa, Staphylococcus aureus
LELDMLYQMIDLINDTLVSIRFSV

SEQ ID NO: 1682758 - protein, 24 aa, Staphylococcus aureus
LGAKRVMPLAVSGPFHSSLMKVIE

SEQ ID NO: 1682759 - protein, 22 aa, Staphylococcus aureus
LLVQQLAKENVPFTAGVRQSDQ

SEQ ID NO: 1682760 - protein, 21 aa, Staphylococcus aureus
LNTIISGPALVAQWINLQYYA

SEQ ID NO: 1682761 - protein, 19 aa, Staphylococcus aureus
LRLMKQAEKFNRPIFTFID

SEQ ID NO: 1682762 - protein, 18 aa, Staphylococcus aureus
MDPKVAMLSFSTKGSAKS

SEQ ID NO: 1682763 - protein, 20 aa, Staphylococcus aureus
NAGLRLKFLKSETSGVAVWG

SEQ ID NO: 1682764 - protein, 23 aa, Staphylococcus aureus
NDYLDKILPEAYALVREGSKRVF

SEQ ID NO: 1682765 - protein, 18 aa, Staphylococcus aureus
NIMFPMVATINEFREAKA

SEQ ID NO: 1682766 - protein, 18 aa, Staphylococcus aureus
NRNDIFGVIGYSGAGKST

SEQ ID NO: 1682767 - protein, 19 aa, Staphylococcus aureus
PENMEVLIGWTGSPASSPH

SEQ ID NO: 1682768 - protein, 22 aa, Staphylococcus aureus
QIENRYQQIDLLWQEIESFDDD

SEQ ID NO: 1682769 - protein, 35 aa, Staphylococcus aureus
QPTLPVFKQMYALYFKFVMPIFGKLFAKSKEEYEW

SEQ ID NO: 1682770 - protein, 25 aa, Staphylococcus aureus
RSMVNLCISIDHRILDGLQTGKFMN

SEQ ID NO: 1682771 - protein, 20 aa, Staphylococcus aureus
SAIFGEDANFGRIITAIGYS

SEQ ID NO: 1682772 - protein, 21 aa, Staphylococcus aureus
SEIYTHLRAHKGKVNVRITAI

SEQ ID NO: 1682773 - protein, 21 aa, Staphylococcus aureus
SGKSLAYLLAALMYNIETGKH

SEQ ID NO: 1682774 - protein, 26 aa, Staphylococcus aureus
SGVSIDHLWLYETNKYYALAMELIHQ

SEQ ID NO: 1682775 - protein, 35 aa, Staphylococcus aureus
SICKKWYINSFKYFRNMYKGFYYSRPDKLDKCFYK

SEQ ID NO: 1682776 - protein, 22 aa, Staphylococcus aureus
SIGCDLLVIRHPFNNYYEKLAN

SEQ ID NO: 1682777 - protein, 20 aa, Staphylococcus aureus
SYYLDLRRYGSVPHCGFGLG

SEQ ID NO: 1682778 - protein, 20 aa, Staphylococcus aureus
TDINPYIKNMMYVLADNRHI

SEQ ID NO: 1682779 - protein, 22 aa, Staphylococcus aureus
TLNVLYDRYQLPLFIVENGFGA

SEQ ID NO: 1682780 - protein, 27 aa, Staphylococcus aureus
TNGKSRAIPIFVFLNDQFEQETVWGPR

SEQ ID NO: 1682781 - protein, 33 aa, Staphylococcus aureus
VAGTKELIDWLKAQSRPFLFSTSLAPGDTKAIT

SEQ ID NO: 1682782 - protein, 23 aa, Staphylococcus aureus
YACGYHLVKYFLQKTNIPIEVAT

SEQ ID NO: 1682783 - protein, 22 aa, Staphylococcus aureus
YQWNEKLIPYWQDLAEFAKEQD

SEQ ID NO: 1682784 - protein, 19 aa, Staphylococcus aureus
AARKGLPYVFAGHFAPQQM

SEQ ID NO: 1682785 - protein, 24 aa, Staphylococcus aureus
AAYNPKMHHLIDTEQFKMMKSTAY

SEQ ID NO: 1682786 - protein, 17 aa, Staphylococcus aureus
DALVLRYLTPHGKWNIH

SEQ ID NO: 1682787 - protein, 22 aa, Staphylococcus aureus
DISNYVLLEYGQPLHMFDQDAI

SEQ ID NO: 1682788 - protein, 25 aa, Staphylococcus aureus
DNKMTGILCRIPNLISDDVPQGESD

SEQ ID NO: 1682789 - protein, 20 aa, Staphylococcus aureus
EAAEGLPINVGFTGKGQATN

SEQ ID NO: 1682790 - protein, 17 aa, Staphylococcus aureus
EALYYYRGLTDNTAQDQ

SEQ ID NO: 1682791 - protein, 27 aa, Staphylococcus aureus
EEKLLYSCWASIDGVWLRELEQAISNG

SEQ ID NO: 1682792 - protein, 23 aa, Staphylococcus aureus
EGRFTEYMNLDPFFEKLSHILKQ

SEQ ID NO: 1682793 - protein, 29 aa, Staphylococcus aureus
EISNIFYDIDLCLDFLLDHNFSLTMHLNQ

SEQ ID NO: 1682794 - protein, 29 aa, Staphylococcus aureus
EMRLMWKEMMAILQAFRVPSVNLLQFMVK

SEQ ID NO: 1682795 - protein, 18 aa, Staphylococcus aureus
EPEFFLFKLDEKGEPTLE

SEQ ID NO: 1682796 - protein, 33 aa, Staphylococcus aureus
EPYGTVLIIAPFNYPFQLVFEPLIGAIAAGNTA

SEQ ID NO: 1682797 - protein, 18 aa, Staphylococcus aureus
EVLKQLCTTYKMVLDFYI

SEQ ID NO: 1682798 - protein, 31 aa, Staphylococcus aureus
FDNRPFIDVFLEPTKLYVKPVLALKKEVSIK

SEQ ID NO: 1682799 - protein, 20 aa, Staphylococcus aureus
FEPLRKMEAPMFKKILKKHQ

SEQ ID NO: 1682800 - protein, 28 aa, Staphylococcus aureus
FSYYDRFRNRIMFPLKNAQGRIVGYSGR

SEQ ID NO: 1682801 - protein, 19 aa, Staphylococcus aureus
GATWLRTTDFKDDKDRVLI

SEQ ID NO: 1682802 - protein, 21 aa, Staphylococcus aureus
GEKKLQLMPLDNLKNVTGYIR

SEQ ID NO: 1682803 - protein, 24 aa, Staphylococcus aureus
IAREDLFITSKLYFEDFGRENVAA

SEQ ID NO: 1682804 - protein, 25 aa, Staphylococcus aureus
IEGNSGLFVAMPSKRTPDGEFRDIA

SEQ ID NO: 1682805 - protein, 17 aa, Staphylococcus aureus
IEQPDLLLLDEPTNHLD

SEQ ID NO: 1682806 - protein, 28 aa, Staphylococcus aureus
IFKEERTVYLPKAYHPLLNRETVVANTI

SEQ ID NO: 1682807 - protein, 19 aa, Staphylococcus aureus
IGDLISAHFYTLLAEINDL

SEQ ID NO: 1682808 - protein, 18 aa, Staphylococcus aureus
IHDYQFLTFDVIGSPFGS

SEQ ID NO: 1682809 - protein, 19 aa, Staphylococcus aureus
IKVYVGNYDFWYQSSQLAQ

SEQ ID NO: 1682810 - protein, 19 aa, Staphylococcus aureus
ILIYLDNAATTKAFEEVLD

SEQ ID NO: 1682811 - protein, 26 aa, Staphylococcus aureus
IQNKLTAFVVLPKDLNDFGPAWIERF

SEQ ID NO: 1682812 - protein, 20 aa, Staphylococcus aureus
IVETFALPTLILNIDREQNH

SEQ ID NO: 1682813 - protein, 22 aa, Staphylococcus aureus
IYHGDFAIYYPVESALIIETDT

SEQ ID NO: 1682814 - protein, 20 aa, Staphylococcus aureus
KDDFLSYLKDLKFTGSIRSM

SEQ ID NO: 1682815 - protein, 23 aa, Staphylococcus aureus
KGIDSLLSIVQMPGGIPVATTAI

SEQ ID NO: 1682816 - protein, 17 aa, Staphylococcus aureus
KISNRIQKLLWSELKMG

SEQ ID NO: 1682817 - protein, 20 aa, Staphylococcus aureus
KLVKLTLTNNKILIGKVIDF

SEQ ID NO: 1682818 - protein, 24 aa, Staphylococcus aureus
KPGDIVPIYLKKNPNFKFPMKQDI

SEQ ID NO: 1682819 - protein, 17 aa, Staphylococcus aureus
LLRILFNYDRLSQYDLT

SEQ ID NO: 1682820 - protein, 21 aa, Staphylococcus aureus
LTGRRILILGDVLELGENSKE

SEQ ID NO: 1682821 - protein, 17 aa, Staphylococcus aureus
LYALRDVTGTVNSIPLI

SEQ ID NO: 1682822 - protein, 21 aa, Staphylococcus aureus
NDWEKLPLFQSQLELPVEIQH

SEQ ID NO: 1682823 - protein, 17 aa, Staphylococcus aureus
NIHDKILYLYRKFLDLL

SEQ ID NO: 1682824 - protein, 23 aa, Staphylococcus aureus
NPVQKIFIITTNDWSFNTLELEK

SEQ ID NO: 1682825 - protein, 17 aa, Staphylococcus aureus
NRDFIDLITDFPTIELQ

SEQ ID NO: 1682826 - protein, 21 aa, Staphylococcus aureus
NTPLEFGLYSLGDHLLNPFKG

SEQ ID NO: 1682827 - protein, 21 aa, Staphylococcus aureus
QCVFLSWNRYLYRNAQNYITS

SEQ ID NO: 1682828 - protein, 25 aa, Staphylococcus aureus
QINGIPFSYFMSYVSGAGLSLIRHW

SEQ ID NO: 1682829 - protein, 24 aa, Staphylococcus aureus
QTKITLFEALRAWLDDEIVADSWL

SEQ ID NO: 1682830 - protein, 19 aa, Staphylococcus aureus
RTDYKGRIFCYVLTEDHYV

SEQ ID NO: 1682831 - protein, 34 aa, Staphylococcus aureus
SIEPGKLADIVLWDPIFFGVKPELVVKGGLINSA

SEQ ID NO: 1682832 - protein, 43 aa, Staphylococcus aureus
SSKTILDYVWDQYPLMNEKDIRAVLGRFLFVQDDVKKIINDLS

SEQ ID NO: 1682833 - protein, 25 aa, Staphylococcus aureus
STGQLLFHLFAAFAEFERNLILERS

SEQ ID NO: 1682834 - protein, 23 aa, Staphylococcus aureus
TDTLAWVYVPDTLSALALDAYES

SEQ ID NO: 1682835 - protein, 26 aa, Staphylococcus aureus
TESKQQWIPVYKSWRLNERHYGGLQG

SEQ ID NO: 1682836 - protein, 21 aa, Staphylococcus aureus
TIHWQFGHVLTIFESALAVAG

SEQ ID NO: 1682837 - protein, 27 aa, Staphylococcus aureus
TSHFEFTKLTLPLLKNADIYFDNEELS

SEQ ID NO: 1682838 - protein, 34 aa, Staphylococcus aureus
VEAVRKHFDLRPAGIIKMLDLKQPIYKQTAAYGH

SEQ ID NO: 1682839 - protein, 17 aa, Staphylococcus aureus
VIHFIGSLQSRKVKDVI

SEQ ID NO: 1682840 - protein, 19 aa, Staphylococcus aureus
VTNPKILLCDEATSALDPA

SEQ ID NO: 1682841 - protein, 24 aa, Staphylococcus aureus
YANDLLTTPVNLAGLPGISVPCGQ

SEQ ID NO: 1682842 - protein, 30 aa, Staphylococcus aureus
YEPPIEACGTWRLVYQRLKALEVLTHEHVH

SEQ ID NO: 1682843 - protein, 20 aa, Staphylococcus aureus
YGRFPHQKGFGRLTAEDKKE

SEQ ID NO: 1682844 - protein, 18 aa, Staphylococcus aureus
YVYAFLDISQVTKGHTLL

SEQ ID NO: 1682845 - protein, 22 aa, Staphylococcus aureus
AISNLLLVTGNYRRPGTGAYPL

SEQ ID NO: 1682846 - protein, 24 aa, Staphylococcus aureus
ALQLLDTPGILWPKFEDEEVGKKL

SEQ ID NO: 1682847 - protein, 21 aa, Staphylococcus aureus
ATYDIPRFDKSPYDGFAIRSV

SEQ ID NO: 1682848 - protein, 26 aa, Staphylococcus aureus
DESDVSHMLLPLIQTFHLQNDTHVIP

SEQ ID NO: 1682849 - protein, 33 aa, Staphylococcus aureus
DGFDYIVTGSGFLYNMVRVLVAFLIEVGKGRHE

SEQ ID NO: 1682850 - protein, 31 aa, Staphylococcus aureus
DISAGRIPLEVKTLRILHFVSGDGGKLKIHY

SEQ ID NO: 1682851 - protein, 26 aa, Staphylococcus aureus
DKDSEHYGLWAFKKVWGTYLSEKIGE

SEQ ID NO: 1682852 - protein, 23 aa, Staphylococcus aureus
DNPFELTIAVLLSAQCTDVLVNR

SEQ ID NO: 1682853 - protein, 21 aa, Staphylococcus aureus
DRAWDFIYNNGVSVAYLSFAE

SEQ ID NO: 1682854 - protein, 17 aa, Staphylococcus aureus
DTIQFKWISFQEAVDKN

SEQ ID NO: 1682855 - protein, 25 aa, Staphylococcus aureus
EQLDNHWMAMFKDMNFELGIMELYA

SEQ ID NO: 1682856 - protein, 30 aa, Staphylococcus aureus
ETADVLLVYIFGRIEFIPDSYTRKIYDKLG

SEQ ID NO: 1682857 - protein, 19 aa, Staphylococcus aureus
ETLALDDMDLYTAKQFAYG

SEQ ID NO: 1682858 - protein, 29 aa, Staphylococcus aureus
ETLIEGYPVTYFSLFATTMPIKLNHIIKF

SEQ ID NO: 1682859 - protein, 23 aa, Staphylococcus aureus
FASLLHEDLKIRKFIDNELKEAS

SEQ ID NO: 1682860 - protein, 23 aa, Staphylococcus aureus
FNGPLDLLLHLIQKFEIDIYDIP

SEQ ID NO: 1682861 - protein, 22 aa, Staphylococcus aureus
GAVKLALEKLIKPELNHLIHEL

SEQ ID NO: 1682862 - protein, 25 aa, Staphylococcus aureus
GGTYRALTKVFTRFGIEVDFVDTTH

SEQ ID NO: 1682863 - protein, 17 aa, Staphylococcus aureus
GLPKAYYRDEDSWLASF

SEQ ID NO: 1682864 - protein, 19 aa, Staphylococcus aureus
GPKARLKLLVALSNNLDKA

SEQ ID NO: 1682865 - protein, 24 aa, Staphylococcus aureus
HVHKILLQHLTEKALVLGPSPAAL

SEQ ID NO: 1682866 - protein, 24 aa, Staphylococcus aureus
IERIKEIVPIWKKEIWEDGSKWQG

SEQ ID NO: 1682867 - protein, 22 aa, Staphylococcus aureus
IHEWLMLKQFSKYKSAPSLPIL

SEQ ID NO: 1682868 - protein, 27 aa, Staphylococcus aureus
KAPNGWILHIPSCYLGIAQAARNYAVD

SEQ ID NO: 1682869 - protein, 24 aa, Staphylococcus aureus
KDADATLALVKKFDTPAAVAVKHM

SEQ ID NO: 1682870 - protein, 18 aa, Staphylococcus aureus
KDVPAYDLGATLIEHIIK

SEQ ID NO: 1682871 - protein, 23 aa, Staphylococcus aureus
KIKSKYDIDFITGHSLGGRDAVV

SEQ ID NO: 1682872 - protein, 17 aa, Staphylococcus aureus
KNVVLIHGFKNYVALLF

SEQ ID NO: 1682873 - protein, 24 aa, Staphylococcus aureus
KTNIPFLINVMKNKKFTSGDYTTK

SEQ ID NO: 1682874 - protein, 19 aa, Staphylococcus aureus
LSFIVHRDFAYERGKALVE

SEQ ID NO: 1682875 - protein, 19 aa, Staphylococcus aureus
LSVFGFKVVDADKAAREAV

SEQ ID NO: 1682876 - protein, 21 aa, Staphylococcus aureus
NGGKFNGIIPISQLSTHHIDS

SEQ ID NO: 1682877 - protein, 17 aa, Staphylococcus aureus
NRKLRRPDLTFATLDHN

SEQ ID NO: 1682878 - protein, 27 aa, Staphylococcus aureus
NRPEQGLLKLRKSLNLFANIRPTTVVK

SEQ ID NO: 1682879 - protein, 17 aa, Staphylococcus aureus
NSVAKATIFIKDMNDFQ

SEQ ID NO: 1682880 - protein, 24 aa, Staphylococcus aureus
PLDDIMKMIPGMNKMKGLDKLNMS

SEQ ID NO: 1682881 - protein, 22 aa, Staphylococcus aureus
PSKLKSIVGPFAYYIKGFEMLP

SEQ ID NO: 1682882 - protein, 26 aa, Staphylococcus aureus
QADVIFIGFPIFQASIPGALKNVFDL

SEQ ID NO: 1682883 - protein, 28 aa, Staphylococcus aureus
QDFYHYNEIMSFLIELNRQGKTIIMITH

SEQ ID NO: 1682884 - protein, 17 aa, Staphylococcus aureus
QELLNNVNYFGTMLVYA

SEQ ID NO: 1682885 - protein, 18 aa, Staphylococcus aureus
QIQVMYDPGLILIGGGIS

SEQ ID NO: 1682886 - protein, 22 aa, Staphylococcus aureus
QNGVGFALTYFTEGIIFGSKAN

SEQ ID NO: 1682887 - protein, 21 aa, Staphylococcus aureus
RIKRYIAKYTINPAITHGISE

SEQ ID NO: 1682888 - protein, 17 aa, Staphylococcus aureus
SLDIQWGNHDVLWVGAY

SEQ ID NO: 1682889 - protein, 24 aa, Staphylococcus aureus
TEDLANFLYFVAQKNMGIGAGDHL

SEQ ID NO: 1682890 - protein, 18 aa, Staphylococcus aureus
TFSRTQAFLNEFAESLSK

SEQ ID NO: 1682891 - protein, 17 aa, Staphylococcus aureus
TGRKDIMLPTAKAALAV

SEQ ID NO: 1682892 - protein, 31 aa, Staphylococcus aureus
TGVVNLVNFYYPKLTFRSSILELIKENKVTA

SEQ ID NO: 1682893 - protein, 18 aa, Staphylococcus aureus
TIKYMISMFIPDNDFMAS

SEQ ID NO: 1682894 - protein, 31 aa, Staphylococcus aureus
TLIEFDRSWEKIGVRFVQSLLETFPVHNKEA

SEQ ID NO: 1682895 - protein, 23 aa, Staphylococcus aureus
TVRDKVLIFSGRISSEILIKAAK

SEQ ID NO: 1682896 - protein, 22 aa, Staphylococcus aureus
VAQLEVPIPAIISAFEIAKAHG

SEQ ID NO: 1682897 - protein, 27 aa, Staphylococcus aureus
VDYCRDRGFFVLTYHDGQIIYDSEHEY

SEQ ID NO: 1682898 - protein, 25 aa, Staphylococcus aureus
VNIELLYVEPQFRKLGIATQLKIAL

SEQ ID NO: 1682899 - protein, 17 aa, Staphylococcus aureus
VNWIQYWEKSCRYTLKF

SEQ ID NO: 1682900 - protein, 18 aa, Staphylococcus aureus
AHIIPIVRVTAVIDRDII

SEQ ID NO: 1682901 - protein, 27 aa, Staphylococcus aureus
AIMQEEIFGPILPILTYQSLDEAIAFI

SEQ ID NO: 1682902 - protein, 18 aa, Staphylococcus aureus
AKLADRLGFKRIWFTEHH

SEQ ID NO: 1682903 - protein, 24 aa, Staphylococcus aureus
ANEILQLPLLKIDLNFYPQFCKDM

SEQ ID NO: 1682904 - protein, 23 aa, Staphylococcus aureus
ASKTYDLEVWLPSYNDYKEISSC

SEQ ID NO: 1682905 - protein, 21 aa, Staphylococcus aureus
ATFIMPKFLKSFFNEHPFIDV

SEQ ID NO: 1682906 - protein, 18 aa, Staphylococcus aureus
AYFEKCLPGYTLINKLHP

SEQ ID NO: 1682907 - protein, 21 aa, Staphylococcus aureus
AYKWMHPCYTLNNKNVVLIHG

SEQ ID NO: 1682908 - protein, 18 aa, Staphylococcus aureus
CLGHQLFALSQGASSFKM

SEQ ID NO: 1682909 - protein, 18 aa, Staphylococcus aureus
CQEIKTKNYAKDVDILFI

SEQ ID NO: 1682910 - protein, 17 aa, Staphylococcus aureus
DEFLIAGFNYEGQLAAA

SEQ ID NO: 1682911 - protein, 27 aa, Staphylococcus aureus
DKAIETLGYPFIVKTRFGGYDGKGQVL

SEQ ID NO: 1682912 - protein, 30 aa, Staphylococcus aureus
DLVGNNTPVFFFRDPKLFVSLNRAVKRDPR

SEQ ID NO: 1682913 - protein, 20 aa, Staphylococcus aureus
DRIRRLLKMYLERESFEIHE

SEQ ID NO: 1682914 - protein, 24 aa, Staphylococcus aureus
DSTDRVLLFAPFYNDQVALDIQKL

SEQ ID NO: 1682915 - protein, 21 aa, Staphylococcus aureus
DSTIFLHCLPAFHDTNTLYGQ

SEQ ID NO: 1682916 - protein, 30 aa, Staphylococcus aureus
ECNYPVISEKLEWIPNLFVAGCFADLELGP

SEQ ID NO: 1682917 - protein, 22 aa, Staphylococcus aureus
ELENILIALDRLSNYAELRLSV

SEQ ID NO: 1682918 - protein, 25 aa, Staphylococcus aureus
EVSYDKLIFATGSKAFVIPVPGSTL

SEQ ID NO: 1682919 - protein, 23 aa, Staphylococcus aureus
EYDLDLLHMHYAVPHAICGILAR

SEQ ID NO: 1682920 - protein, 17 aa, Staphylococcus aureus
FGMGPDRIAMLKYGIED

SEQ ID NO: 1682921 - protein, 18 aa, Staphylococcus aureus
FIERYVYELYDKHTKHIT

SEQ ID NO: 1682922 - protein, 21 aa, Staphylococcus aureus
FPESEIIFITLHLLGSKMTEH

SEQ ID NO: 1682923 - protein, 17 aa, Staphylococcus aureus
FPVSGLFLRCTNQEVID

SEQ ID NO: 1682924 - protein, 18 aa, Staphylococcus aureus
FYEQFKDKGITKILTIEA

SEQ ID NO: 1682925 - protein, 22 aa, Staphylococcus aureus
GKTECWYILDAAPGAEIIYGVH

SEQ ID NO: 1682926 - protein, 25 aa, Staphylococcus aureus
GSGKTLLAQTLAKTLNVPFAIADAT

SEQ ID NO: 1682927 - protein, 25 aa, Staphylococcus aureus
HMTISPYKLYLLDKGDVLKFRETSY

SEQ ID NO: 1682928 - protein, 25 aa, Staphylococcus aureus
HNEPSWMTELRKKALKLTETLEMPK

SEQ ID NO: 1682929 - protein, 17 aa, Staphylococcus aureus
HRLKYYVVVNHLGHLVS

SEQ ID NO: 1682930 - protein, 27 aa, Staphylococcus aureus
IFNVERLLMDYLSALPYQLTESSYLTL

SEQ ID NO: 1682931 - protein, 19 aa, Staphylococcus aureus
IGQTLLPEVLSLYNAQFPN

SEQ ID NO: 1682932 - protein, 20 aa, Staphylococcus aureus
IINEPTAAALAYGLDKTDKD

SEQ ID NO: 1682933 - protein, 24 aa, Staphylococcus aureus
IMAALHFDVPCLFAKKAKPSTLTD

SEQ ID NO: 1682934 - protein, 29 aa, Staphylococcus aureus
INGKDAFKLYDTYGFPIELTEEIAVQAGL

SEQ ID NO: 1682935 - protein, 19 aa, Staphylococcus aureus
INYDLNYIKGYLPVHNNEK

SEQ ID NO: 1682936 - protein, 24 aa, Staphylococcus aureus
ISSKCVYVKWNPYSYTYAKQHQIE

SEQ ID NO: 1682937 - protein, 24 aa, Staphylococcus aureus
IVNFFEKPIIYGVLDATRFLERHQ

SEQ ID NO: 1682938 - protein, 20 aa, Staphylococcus aureus
KDPKKYVELSQASMAKHVEL

SEQ ID NO: 1682939 - protein, 26 aa, Staphylococcus aureus
KHYGPLLNGFYHIPFPDKYRGMYEQP

SEQ ID NO: 1682940 - protein, 24 aa, Staphylococcus aureus
KPNSRYMVFYNDGLTLYTKTNIHS

SEQ ID NO: 1682941 - protein, 26 aa, Staphylococcus aureus
KVAGELLCQYYFKRFGVDTRSVRFPG

SEQ ID NO: 1682942 - protein, 20 aa, Staphylococcus aureus
LAGSILKMNHGLRNLISFTG

SEQ ID NO: 1682943 - protein, 25 aa, Staphylococcus aureus
LECIQQGHYLLDVPLATYQQHHSSI

SEQ ID NO: 1682944 - protein, 18 aa, Staphylococcus aureus
LIDAIHRAGVDKIFGVPG

SEQ ID NO: 1682945 - protein, 20 aa, Staphylococcus aureus
LKVDAPIVEGSFIAAVKLSI

SEQ ID NO: 1682946 - protein, 25 aa, Staphylococcus aureus
LKVSFDYIDWIKLGFGPSGKENYYM

SEQ ID NO: 1682947 - protein, 33 aa, Staphylococcus aureus
LSADKYVFVTPMWNLSFPPVVKAYIDAISIAGK

SEQ ID NO: 1682948 - protein, 26 aa, Staphylococcus aureus
MGETYLEVQRIYFLKDFQGGGRGSQL

SEQ ID NO: 1682949 - protein, 25 aa, Staphylococcus aureus
MIERKYHFMGYRQMKTFKTELIKMN

SEQ ID NO: 1682950 - protein, 17 aa, Staphylococcus aureus
NKDSILKAIKLIKTLDD

SEQ ID NO: 1682951 - protein, 28 aa, Staphylococcus aureus
NYGIDDLPLGIYKFLKTQDKVYARTLDH

SEQ ID NO: 1682952 - protein, 31 aa, Staphylococcus aureus
PAFINDILKVEGVKSIFHVMDFISVDKENDA

SEQ ID NO: 1682953 - protein, 21 aa, Staphylococcus aureus
QEIIDYIDTLNYIDQYSSAGS

SEQ ID NO: 1682954 - protein, 22 aa, Staphylococcus aureus
QGDANVFVFPSLEAGNIGYKIA

SEQ ID NO: 1682955 - protein, 26 aa, Staphylococcus aureus
QTTAILTGNFLLALGLEHLMAVKDNR

SEQ ID NO: 1682956 - protein, 20 aa, Staphylococcus aureus
QYFNMAEKILPLPHIIDIPK

SEQ ID NO: 1682957 - protein, 17 aa, Staphylococcus aureus
RGIDGLIIAQYISSPDA

SEQ ID NO: 1682958 - protein, 18 aa, Staphylococcus aureus
RHDIKVTAWMPLMRNRGL

SEQ ID NO: 1682959 - protein, 17 aa, Staphylococcus aureus
RKALRLMKQAEKFNRPI

SEQ ID NO: 1682960 - protein, 29 aa, Staphylococcus aureus
RMEGYNEARWILIDLADVVVHVFHKDERN

SEQ ID NO: 1682961 - protein, 23 aa, Staphylococcus aureus
RRAMQNLKPLFDSPARIVISHGN

SEQ ID NO: 1682962 - protein, 17 aa, Staphylococcus aureus
RTIYRMILKLHNIMLNV

SEQ ID NO: 1682963 - protein, 20 aa, Staphylococcus aureus
SCQALPDEPLHSSFIMSKMA

SEQ ID NO: 1682964 - protein, 20 aa, Staphylococcus aureus
SPYDFQGLGVEGLKILKQIK

SEQ ID NO: 1682965 - protein, 18 aa, Staphylococcus aureus
SQAIPVIKYPQIQHKEQP

SEQ ID NO: 1682966 - protein, 19 aa, Staphylococcus aureus
TEIRPFLMKDLFNDKKLRD

SEQ ID NO: 1682967 - protein, 24 aa, Staphylococcus aureus
TFIGQPLWGSIGYTLPATLGSQLA

SEQ ID NO: 1682968 - protein, 25 aa, Staphylococcus aureus
TNQGIYDFDILVVALGFVSETFGIE

SEQ ID NO: 1682969 - protein, 24 aa, Staphylococcus aureus
TSHNQYHILFIDTAHQRIKFSSID

SEQ ID NO: 1682970 - protein, 17 aa, Staphylococcus aureus
TSWFYFATDQWKYEESN

SEQ ID NO: 1682971 - protein, 34 aa, Staphylococcus aureus
TTIFKAMIAIKTGNPIIFAFHPSAQESSKRAAEV

SEQ ID NO: 1682972 - protein, 23 aa, Staphylococcus aureus
TTLMRHIVSFLKSHGYTVATIKH

SEQ ID NO: 1682973 - protein, 21 aa, Staphylococcus aureus
TTNHPLLADLGIKNAGLRLKF

SEQ ID NO: 1682974 - protein, 21 aa, Staphylococcus aureus
TVIEWSQFIKDLLPATHLSIN

SEQ ID NO: 1682975 - protein, 30 aa, Staphylococcus aureus
VIFSIETRRYYLMLMLFSKENAMSLNHFSI

SEQ ID NO: 1682976 - protein, 26 aa, Staphylococcus aureus
VTQFVDNQYFAVYKWDIHGDLKFNKP

SEQ ID NO: 1682977 - protein, 17 aa, Staphylococcus aureus
VVFFIMPSILKSKNTMS

SEQ ID NO: 1682978 - protein, 25 aa, Staphylococcus aureus
VYLVDRVIPMIPHRLSNGICSLNPH

SEQ ID NO: 1682979 - protein, 17 aa, Staphylococcus aureus
WMINTRTPDWLYKSPRT

SEQ ID NO: 1682980 - protein, 18 aa, Staphylococcus aureus
YELGFEHGLLFKDGVTVG

SEQ ID NO: 1682981 - protein, 21 aa, Staphylococcus aureus
YLFEAVYGAGIIRMYELNTHT

SEQ ID NO: 1682982 - protein, 23 aa, Staphylococcus aureus
ADIVIGDFPVGYYPIDERSKEFK

SEQ ID NO: 1682983 - protein, 25 aa, Staphylococcus aureus
AEQLHSIFLEVIIAPKFTDEALDIL

SEQ ID NO: 1682984 - protein, 21 aa, Staphylococcus aureus
AFSTPFILLNGNPMYHVDLDE

SEQ ID NO: 1682985 - protein, 20 aa, Staphylococcus aureus
AKTFLNKLYGGDMKSLVLNF

SEQ ID NO: 1682986 - protein, 18 aa, Staphylococcus aureus
AMVVFGQTKAKFAKLGNS

SEQ ID NO: 1682987 - protein, 22 aa, Staphylococcus aureus
APHEALLCLDATTGQNALSQAR

SEQ ID NO: 1682988 - protein, 26 aa, Staphylococcus aureus
AVHKRITLLIGDLSFYHDMNGLLMSK

SEQ ID NO: 1682989 - protein, 28 aa, Staphylococcus aureus
AYKMPKKMRRLALRSALSFKAQENGLTV

SEQ ID NO: 1682990 - protein, 31 aa, Staphylococcus aureus
CLRHSRFIFLSPEFLLQPSNFKLISMIDFGM

SEQ ID NO: 1682991 - protein, 17 aa, Staphylococcus aureus
CPIFTFGRSSGAYLSLL

SEQ ID NO: 1682992 - protein, 22 aa, Staphylococcus aureus
DDILSLKTLPSSIGIIGGGVIG

SEQ ID NO: 1682993 - protein, 17 aa, Staphylococcus aureus
DFEKDYPYYASGGFIHY

SEQ ID NO: 1682994 - protein, 24 aa, Staphylococcus aureus
DIAPYNYQLLQFVLEKIESGTSAQ

SEQ ID NO: 1682995 - protein, 18 aa, Staphylococcus aureus
DTPLKQLQIFVDTSSIEI

SEQ ID NO: 1682996 - protein, 17 aa, Staphylococcus aureus
DVDIIPIGGLPDGSIGT

SEQ ID NO: 1682997 - protein, 22 aa, Staphylococcus aureus
DVIMFTICMDVIDSAFAPGVSA

SEQ ID NO: 1682998 - protein, 17 aa, Staphylococcus aureus
EAFLEEMIALLPEVKQY

SEQ ID NO: 1682999 - protein, 17 aa, Staphylococcus aureus
EAPDNFILGFRATPEET

SEQ ID NO: 1683000 - protein, 24 aa, Staphylococcus aureus
EAQTLFFGGLARIDYVSGGKRPLV

SEQ ID NO: 1683001 - protein, 20 aa, Staphylococcus aureus
EDMGYGIVFLGSLRNDVERV

SEQ ID NO: 1683002 - protein, 27 aa, Staphylococcus aureus
EENAPVIWRGPMLGKMLTNFFTEVKWG

SEQ ID NO: 1683003 - protein, 31 aa, Staphylococcus aureus
EFLQSNYIDEFILYYAPKLIGGSGNYQFYQT

SEQ ID NO: 1683004 - protein, 29 aa, Staphylococcus aureus
EKELAESVLPYHPLFIKPNKDELEVMFNT

SEQ ID NO: 1683005 - protein, 24 aa, Staphylococcus aureus
EKSQAFEFIIEGDTLIPPFISVPG

SEQ ID NO: 1683006 - protein, 23 aa, Staphylococcus aureus
ELGITILINLHFVDLAKEYGTRI

SEQ ID NO: 1683007 - protein, 20 aa, Staphylococcus aureus
EMIALLIKYHGQYITIHDIA

SEQ ID NO: 1683008 - protein, 24 aa, Staphylococcus aureus
ERGRKTLLFGPMKPVGLEDPKTGK

SEQ ID NO: 1683009 - protein, 17 aa, Staphylococcus aureus
FEDCCTIFTPKNPVTEP

SEQ ID NO: 1683010 - protein, 25 aa, Staphylococcus aureus
FNKSEAYILLFSKLFRNQEKTMKWY

SEQ ID NO: 1683011 - protein, 22 aa, Staphylococcus aureus
FYGQQLAPAYFVFIGTRNEDKG

SEQ ID NO: 1683012 - protein, 26 aa, Staphylococcus aureus
GAQLVTRLFYMFDKETMIASMGIGGG

SEQ ID NO: 1683013 - protein, 25 aa, Staphylococcus aureus
GKADYIFVDDFHPLIYTVRFRPSQE

SEQ ID NO: 1683014 - protein, 36 aa, Staphylococcus aureus
GKMLTNFFTEVKWGDIEYLILDLPPGTGDVALDVHT

SEQ ID NO: 1683015 - protein, 23 aa, Staphylococcus aureus
GLEAAFKSYFKQFEENYGIKIIY

SEQ ID NO: 1683016 - protein, 25 aa, Staphylococcus aureus
GTIDMYTFGRYFPTLKELPKEYLMP

SEQ ID NO: 1683017 - protein, 17 aa, Staphylococcus aureus
GTVLYNDAPLFDKQHRP

SEQ ID NO: 1683018 - protein, 21 aa, Staphylococcus aureus
HIDHFPEMWLLSSSATSAKIA

SEQ ID NO: 1683019 - protein, 22 aa, Staphylococcus aureus
HLDIDFIFKARKPMGKAFDKAI

SEQ ID NO: 1683020 - protein, 18 aa, Staphylococcus aureus
HMHRKTSLGYYLDKQFEG

SEQ ID NO: 1683021 - protein, 18 aa, Staphylococcus aureus
HPANCLMARIGKNITLEQ

SEQ ID NO: 1683022 - protein, 17 aa, Staphylococcus aureus
HVELMLEFQKRGAVAFD

SEQ ID NO: 1683023 - protein, 24 aa, Staphylococcus aureus
IERRVQAHDFTWQAEIMSKPVKNM

SEQ ID NO: 1683024 - protein, 24 aa, Staphylococcus aureus
INDETYLHYTFPSVDVALLRGTYA

SEQ ID NO: 1683025 - protein, 20 aa, Staphylococcus aureus
ITFLDTPGHAAFTTMRARGA

SEQ ID NO: 1683026 - protein, 25 aa, Staphylococcus aureus
KDILVTYPMKTLFIDYINLARDYYQ

SEQ ID NO: 1683027 - protein, 17 aa, Staphylococcus aureus
KLGYDQVLWLDGVEQKY

SEQ ID NO: 1683028 - protein, 25 aa, Staphylococcus aureus
KTNMPPYREFAWVQDKFGVSFQLAL

SEQ ID NO: 1683029 - protein, 22 aa, Staphylococcus aureus
KTTLLRMINALEIPTEGTVYVN

SEQ ID NO: 1683030 - protein, 34 aa, Staphylococcus aureus
KVVTGYLRDAGLQPYLDDLGFNLVGYGCTTCIGN

SEQ ID NO: 1683031 - protein, 17 aa, Staphylococcus aureus
KYDMLQPNPLRQEVMRR

SEQ ID NO: 1683032 - protein, 17 aa, Staphylococcus aureus
LEELYVLGILNLHKGQL

SEQ ID NO: 1683033 - protein, 26 aa, Staphylococcus aureus
LGVLARKYQLPIYANEKTWQAIEKKD

SEQ ID NO: 1683034 - protein, 23 aa, Staphylococcus aureus
LIKDVADIFYLTEEDLLPLDRMG

SEQ ID NO: 1683035 - protein, 21 aa, Staphylococcus aureus
LIMMPRSIATYELYIAALKLG

SEQ ID NO: 1683036 - protein, 17 aa, Staphylococcus aureus
LNDLRSRVKLETDGKLL

SEQ ID NO: 1683037 - protein, 22 aa, Staphylococcus aureus
LNVDVQLRLLKYQEDTTKLLED

SEQ ID NO: 1683038 - protein, 22 aa, Staphylococcus aureus
LPDYVFPVFGMAVGEPADDENG

SEQ ID NO: 1683039 - protein, 17 aa, Staphylococcus aureus
LPQFFYEEEMEALFKTV

SEQ ID NO: 1683040 - protein, 23 aa, Staphylococcus aureus
LSIASHLIGVKRIKALDIDEMAV

SEQ ID NO: 1683041 - protein, 19 aa, Staphylococcus aureus
LSILGYRNVPVNKDAIAKH

SEQ ID NO: 1683042 - protein, 29 aa, Staphylococcus aureus
LTAVLAVPLWYKNQVYGVLLFGQRDGRPL

SEQ ID NO: 1683043 - protein, 19 aa, Staphylococcus aureus
MCLKAIETYVLPQHSVIDV

SEQ ID NO: 1683044 - protein, 20 aa, Staphylococcus aureus
MREVSNVPILFLSSRDNPMD

SEQ ID NO: 1683045 - protein, 29 aa, Staphylococcus aureus
MRSIDVQLIFCTLPLELRGFQIVSLDDIE

SEQ ID NO: 1683046 - protein, 17 aa, Staphylococcus aureus
NDAPLFDKQHRPSDLRL

SEQ ID NO: 1683047 - protein, 25 aa, Staphylococcus aureus
NSRNHWYQWLEHNLTLEGYDVTLFN

SEQ ID NO: 1683048 - protein, 17 aa, Staphylococcus aureus
PAYFVFIGTRNEDKGFV

SEQ ID NO: 1683049 - protein, 25 aa, Staphylococcus aureus
PDEAPGIGMRFIQINDIKLAVINLQ

SEQ ID NO: 1683050 - protein, 20 aa, Staphylococcus aureus
PDLLLLDEPTNHLDFESISW

SEQ ID NO: 1683051 - protein, 22 aa, Staphylococcus aureus
PDTWGKRYLLSGYSYDMKELAA

SEQ ID NO: 1683052 - protein, 26 aa, Staphylococcus aureus
PKSDQSLILPLSPYAIDKYYGERTTL

SEQ ID NO: 1683053 - protein, 19 aa, Staphylococcus aureus
PLYTLNIQTTVSTTGKTGV

SEQ ID NO: 1683054 - protein, 19 aa, Staphylococcus aureus
QFEENYGIKIIYTSNIKNT

SEQ ID NO: 1683055 - protein, 24 aa, Staphylococcus aureus
QGKPLVCVGILKGSAMFMSDLIKR

SEQ ID NO: 1683056 - protein, 21 aa, Staphylococcus aureus
QQQFEKLLQRMHKRHVRIHPS

SEQ ID NO: 1683057 - protein, 19 aa, Staphylococcus aureus
QRFNVMRSLLAQPRVLICD

SEQ ID NO: 1683058 - protein, 20 aa, Staphylococcus aureus
QSPRLMLGFKNKPLQEAPQK

SEQ ID NO: 1683059 - protein, 17 aa, Staphylococcus aureus
REKMSFGVINILLQFVM

SEQ ID NO: 1683060 - protein, 31 aa, Staphylococcus aureus
REVKFKQFIFDQFMVQVCFLGQAPWGYKKVS

SEQ ID NO: 1683061 - protein, 19 aa, Staphylococcus aureus
RITALHTALVNGGVFVYVP

SEQ ID NO: 1683062 - protein, 27 aa, Staphylococcus aureus
RMVKLALELYNSPWIAWYHQQMQDKKA

SEQ ID NO: 1683063 - protein, 18 aa, Staphylococcus aureus
RYWNGRWIEATPNDVEKL

SEQ ID NO: 1683064 - protein, 28 aa, Staphylococcus aureus
SELGGKMRIYPEKIIWDIGGIAPKPCHE

SEQ ID NO: 1683065 - protein, 26 aa, Staphylococcus aureus
SGGKRPLVCFFSNDLNIHRTKTEKAN

SEQ ID NO: 1683066 - protein, 27 aa, Staphylococcus aureus
SIGVNAGLYLLKFLASLNLDNNAQAFV

SEQ ID NO: 1683067 - protein, 24 aa, Staphylococcus aureus
SIYGDFQRFYQPAIKALHTLGATD

SEQ ID NO: 1683068 - protein, 21 aa, Staphylococcus aureus
SKEEWLSMSLAERQKAEKAFR

SEQ ID NO: 1683069 - protein, 27 aa, Staphylococcus aureus
SKRYQKLIVVPLFLYDGRLVNKVKQQM

SEQ ID NO: 1683070 - protein, 25 aa, Staphylococcus aureus
SLEESLDLYQRGMKLSAACDTTLKN

SEQ ID NO: 1683071 - protein, 18 aa, Staphylococcus aureus
SNEFNIPKSWKLIAQMPF

SEQ ID NO: 1683072 - protein, 32 aa, Staphylococcus aureus
SYTLDNIMRMLHPFMPFVTEKIWQSLPHEGDT

SEQ ID NO: 1683073 - protein, 23 aa, Staphylococcus aureus
TEADIKIMMREVRLALLEADVNF

SEQ ID NO: 1683074 - protein, 25 aa, Staphylococcus aureus
THFFNTILKYVKEGSLYPLSYYDGD

SEQ ID NO: 1683075 - protein, 17 aa, Staphylococcus aureus
TINSPTFNIIKSYRGKN

SEQ ID NO: 1683076 - protein, 23 aa, Staphylococcus aureus
TKYHYFTKLLNLLKHEQVTYLID

SEQ ID NO: 1683077 - protein, 20 aa, Staphylococcus aureus
TQVGCRIGCTFCASTLGGLK

SEQ ID NO: 1683078 - protein, 26 aa, Staphylococcus aureus
TTSFPTPKIFDWLQQQGNIDTNEMYN

SEQ ID NO: 1683079 - protein, 18 aa, Staphylococcus aureus
VDARYNLGLALFMKNEDI

SEQ ID NO: 1683080 - protein, 19 aa, Staphylococcus aureus
VHFECEYVQTIRIPTGDPV

SEQ ID NO: 1683081 - protein, 25 aa, Staphylococcus aureus
VKGGLQFTYISLDDYRIIKSALYGN

SEQ ID NO: 1683082 - protein, 31 aa, Staphylococcus aureus
VLKNLPAEESYFLFYINRPSIIVGKNQNTIE

SEQ ID NO: 1683083 - protein, 18 aa, Staphylococcus aureus
VMEDFYIEKLITGGATST

SEQ ID NO: 1683084 - protein, 18 aa, Staphylococcus aureus
VRNINLALRAQYLFESNV

SEQ ID NO: 1683085 - protein, 24 aa, Staphylococcus aureus
VSNLPYSIRVLLESLLRQEDDFVI

SEQ ID NO: 1683086 - protein, 28 aa, Staphylococcus aureus
VTHSKDGVKLLWASCRELFNVIQADEIG

SEQ ID NO: 1683087 - protein, 23 aa, Staphylococcus aureus
VYHLNARLKLQLLDDVKSVFNSQ

SEQ ID NO: 1683088 - protein, 28 aa, Staphylococcus aureus
YCVDHQITFIPYFPLASGILAGKYDENT

SEQ ID NO: 1683089 - protein, 24 aa, Staphylococcus aureus
YDINERVIMLITKQQPIASDLRMM

SEQ ID NO: 1683090 - protein, 20 aa, Staphylococcus aureus
YDKQYLGELSLVDRLKHHKA

SEQ ID NO: 1683091 - protein, 21 aa, Staphylococcus aureus
YDLIQLSYRLLPEVSLDCIIE

SEQ ID NO: 1683092 - protein, 17 aa, Staphylococcus aureus
YHQLNYVNYFDHKRRKV

SEQ ID NO: 1683093 - protein, 26 aa, Staphylococcus aureus
AADIAPIFGLNKRQGRQLLAYLGAPK

SEQ ID NO: 1683094 - protein, 17 aa, Staphylococcus aureus
AAHPNTIIFLTADAFGV

SEQ ID NO: 1683095 - protein, 25 aa, Staphylococcus aureus
AGVHKLPFVCVIINNKYAISVPDSL

SEQ ID NO: 1683096 - protein, 17 aa, Staphylococcus aureus
AMEMSRRVAKEEGILAG

SEQ ID NO: 1683097 - protein, 24 aa, Staphylococcus aureus
AQIYGFIVGSGLRGPLHKGLPTIE

SEQ ID NO: 1683098 - protein, 34 aa, Staphylococcus aureus
ASFSWYEYSPLRIKYPYIRGKLWDLWTEALEENN

SEQ ID NO: 1683099 - protein, 20 aa, Staphylococcus aureus
AVLPIFQHPLTSFNPDWTIE

SEQ ID NO: 1683100 - protein, 25 aa, Staphylococcus aureus
AYVEGHLLALPGWAGMLYYRSQQHH

SEQ ID NO: 1683101 - protein, 20 aa, Staphylococcus aureus
DAARYFLTMRSPDSHFDFDM

SEQ ID NO: 1683102 - protein, 23 aa, Staphylococcus aureus
DIAYAQYLATRKVYPTQSIGVIN

SEQ ID NO: 1683103 - protein, 20 aa, Staphylococcus aureus
DILRDMVIISLQGILTPAEY

SEQ ID NO: 1683104 - protein, 19 aa, Staphylococcus aureus
DKHTFFKEIIRVQSVLGGV

SEQ ID NO: 1683105 - protein, 24 aa, Staphylococcus aureus
EEEYTYFFNGVKHILKAKNKELKG

SEQ ID NO: 1683106 - protein, 32 aa, Staphylococcus aureus
EFDSLFKRIPVKPGDFYYVPAGTVHAIGSGIL

SEQ ID NO: 1683107 - protein, 19 aa, Staphylococcus aureus
EFNIWVDAEAAKRVFESGI

SEQ ID NO: 1683108 - protein, 23 aa, Staphylococcus aureus
EGTKYLAWSLIDYDAIPVCGFAW

SEQ ID NO: 1683109 - protein, 31 aa, Staphylococcus aureus
EKDLYSTYLSYLPSTDFSYPLLMNVDDRGSF

SEQ ID NO: 1683110 - protein, 24 aa, Staphylococcus aureus
EKFNRPIFTFIDTKGAYPGKAAEE

SEQ ID NO: 1683111 - protein, 19 aa, Staphylococcus aureus
ELQGRFPIRVELDSLSVED

SEQ ID NO: 1683112 - protein, 18 aa, Staphylococcus aureus
ELRLLARAVFVLDADNKV

SEQ ID NO: 1683113 - protein, 19 aa, Staphylococcus aureus
EMKLVFLEGIFKTLLNKNS

SEQ ID NO: 1683114 - protein, 28 aa, Staphylococcus aureus
ENGFGYDPIFYVPKLDKTMAQLSKEQKG

SEQ ID NO: 1683115 - protein, 25 aa, Staphylococcus aureus
EQQEKIELFKKLEFKQLLADIDQSA

SEQ ID NO: 1683116 - protein, 24 aa, Staphylococcus aureus
ETVVKRIKLFKPDYIFVGMGFPKQ

SEQ ID NO: 1683117 - protein, 17 aa, Staphylococcus aureus
EVAKIFQEVLPKGVVNI

SEQ ID NO: 1683118 - protein, 18 aa, Staphylococcus aureus
FDIHLIPETRRSTILSSK

SEQ ID NO: 1683119 - protein, 25 aa, Staphylococcus aureus
FDTELNIPMSQWQYAMNRTLPDDIY

SEQ ID NO: 1683120 - protein, 21 aa, Staphylococcus aureus
FERFMRKYSYHLSSSRLISGS

SEQ ID NO: 1683121 - protein, 24 aa, Staphylococcus aureus
FGRTFRHCAYFNKRLRTTGGRYLL

SEQ ID NO: 1683122 - protein, 20 aa, Staphylococcus aureus
GAAYIEPYGQLFEYGFNIDH

SEQ ID NO: 1683123 - protein, 24 aa, Staphylococcus aureus
GASGPLYGFSFVKMSAVTKDDMDN

SEQ ID NO: 1683124 - protein, 21 aa, Staphylococcus aureus
GFQIRIINKDIAWWSIVQSYP

SEQ ID NO: 1683125 - protein, 26 aa, Staphylococcus aureus
GIQQYDALMIYYVKSLIGLGQYFEAV

SEQ ID NO: 1683126 - protein, 25 aa, Staphylococcus aureus
GQKQKLKLLSFLLEDHDLIILDEVT

SEQ ID NO: 1683127 - protein, 18 aa, Staphylococcus aureus
GRPALFDPAPLYGDREFD

SEQ ID NO: 1683128 - protein, 25 aa, Staphylococcus aureus
GSVVGFFTPELFHGIGSAGFHVHFA

SEQ ID NO: 1683129 - protein, 30 aa, Staphylococcus aureus
GVAKRAQSFGMKILAFDPYLTDEKAKSLSI

SEQ ID NO: 1683130 - protein, 30 aa, Staphylococcus aureus
HDVTIEPSPIWMQARLIKAGIRPINNVVDI

SEQ ID NO: 1683131 - protein, 17 aa, Staphylococcus aureus
HPERMASRILGMGDVLS

SEQ ID NO: 1683132 - protein, 17 aa, Staphylococcus aureus
HQFPIDNVFPLMGQTIT

SEQ ID NO: 1683133 - protein, 19 aa, Staphylococcus aureus
IATCWFNFRGFDHNPGIIP

SEQ ID NO: 1683134 - protein, 21 aa, Staphylococcus aureus
IEQLLDEGLEWVLIQGQMGIE

SEQ ID NO: 1683135 - protein, 44 aa, Staphylococcus aureus
IGATESYPIMKYMQPVRKMIGKPTILNLVGPLINPYHLTYQMVG

SEQ ID NO: 1683136 - protein, 32 aa, Staphylococcus aureus
IGCQSYCGPGRRKTFTFVNNRPLAALTEEELI

SEQ ID NO: 1683137 - protein, 20 aa, Staphylococcus aureus
IIGELLMCDIIDAFINAEYK

SEQ ID NO: 1683138 - protein, 18 aa, Staphylococcus aureus
ILTLLKNVNQTFGITIMM

SEQ ID NO: 1683139 - protein, 21 aa, Staphylococcus aureus
IRQHIKPVLFVINNDGYTVER

SEQ ID NO: 1683140 - protein, 27 aa, Staphylococcus aureus
ISNIYAIGDIVPGLPLAHKASYEAKVA

SEQ ID NO: 1683141 - protein, 20 aa, Staphylococcus aureus
KDVLNRVTALVSKTPEVNID

SEQ ID NO: 1683142 - protein, 23 aa, Staphylococcus aureus
KGDMITLDFGAYYNGYCSDITRT

SEQ ID NO: 1683143 - protein, 21 aa, Staphylococcus aureus
KHRQYWLSQFKDEVPILSLPT

SEQ ID NO: 1683144 - protein, 25 aa, Staphylococcus aureus
KIDEDKCLVVIPLNKAISESTLNTI

SEQ ID NO: 1683145 - protein, 24 aa, Staphylococcus aureus
KIVQPHAMALNYVYYDIYTQMIEM

SEQ ID NO: 1683146 - protein, 21 aa, Staphylococcus aureus
KLETLQLQYVSSGLQSAVVVV

SEQ ID NO: 1683147 - protein, 17 aa, Staphylococcus aureus
KNILNDTFKILGVGVDF

SEQ ID NO: 1683148 - protein, 30 aa, Staphylococcus aureus
KQFAEQLYNGLWFSPLTDSLKLFIDSTQQY

SEQ ID NO: 1683149 - protein, 26 aa, Staphylococcus aureus
KQGYNVIMDIPLLFENELENTVDEVW

SEQ ID NO: 1683150 - protein, 25 aa, Staphylococcus aureus
KVKGGFTFAILTKDALYGAVDPNAI

SEQ ID NO: 1683151 - protein, 17 aa, Staphylococcus aureus
KVLIMMPRSIATYELYI

SEQ ID NO: 1683152 - protein, 22 aa, Staphylococcus aureus
KVLLRLREGKITERHARAVLSL

SEQ ID NO: 1683153 - protein, 29 aa, Staphylococcus aureus
KVNYKLRDWLFSRQRYWGEPIPVIHWEDG

SEQ ID NO: 1683154 - protein, 25 aa, Staphylococcus aureus
KVYLDQIHQRLFLEQSLITERIKKY

SEQ ID NO: 1683155 - protein, 20 aa, Staphylococcus aureus
KYKMPVIYSTHPRSWKKIEE

SEQ ID NO: 1683156 - protein, 29 aa, Staphylococcus aureus
LALNNATLPYALMLANKGYREAFKSNQPL

SEQ ID NO: 1683157 - protein, 19 aa, Staphylococcus aureus
LETDLLQFIDAEELYKYPV

SEQ ID NO: 1683158 - protein, 27 aa, Staphylococcus aureus
LGFRGNIFGGYILYNLGYIHSTGRYYL

SEQ ID NO: 1683159 - protein, 17 aa, Staphylococcus aureus
LHLDILVDRMKKEFNVE

SEQ ID NO: 1683160 - protein, 18 aa, Staphylococcus aureus
LLQYVSGLSSQIAKNIIA

SEQ ID NO: 1683161 - protein, 31 aa, Staphylococcus aureus
LSVEDFVRILTEPKLSLIKQYEALLQTEEVT

SEQ ID NO: 1683162 - protein, 42 aa, Staphylococcus aureus
MPKAMIMKFDLALQRMLLGEPIQYIVGFASFYGRTFDVNSNC

SEQ ID NO: 1683163 - protein, 23 aa, Staphylococcus aureus
NDEVLEYFGLKVLVDKKDAPVLN

SEQ ID NO: 1683164 - protein, 20 aa, Staphylococcus aureus
NIERKWYVIDAEGQTLGRLS

SEQ ID NO: 1683165 - protein, 24 aa, Staphylococcus aureus
NSGIHPEWLYCAKANLVLEPAYTG

SEQ ID NO: 1683166 - protein, 23 aa, Staphylococcus aureus
PMGCQTGFYVSFINHDNYDDVLN

SEQ ID NO: 1683167 - protein, 22 aa, Staphylococcus aureus
PPRLQNGTSWFYFATDQWKYEE

SEQ ID NO: 1683168 - protein, 17 aa, Staphylococcus aureus
PVLLYAPIGLVSAQQLP

SEQ ID NO: 1683169 - protein, 17 aa, Staphylococcus aureus
QFQTYYRLLVEWNEKMN

SEQ ID NO: 1683170 - protein, 19 aa, Staphylococcus aureus
QGFDIEHLAKIKSLVNIPI

SEQ ID NO: 1683171 - protein, 28 aa, Staphylococcus aureus
QILTSSDLILYVSYFNHSFTDNDKAFIE

SEQ ID NO: 1683172 - protein, 23 aa, Staphylococcus aureus
QQFDIITIFCDSLNYLQDETAVI

SEQ ID NO: 1683173 - protein, 18 aa, Staphylococcus aureus
QQLQPFLNKYLSHPEYVA

SEQ ID NO: 1683174 - protein, 21 aa, Staphylococcus aureus
QTHIEIIYLKSCDLTTILHNL

SEQ ID NO: 1683175 - protein, 20 aa, Staphylococcus aureus
RGYKMLPHFQIGMFEDQLFV

SEQ ID NO: 1683176 - protein, 25 aa, Staphylococcus aureus
RIGLLKIDFLGLRNLSIIHQILTQV

SEQ ID NO: 1683177 - protein, 23 aa, Staphylococcus aureus
RNDGRYIEIIGISIGGGTIKIKG

SEQ ID NO: 1683178 - protein, 25 aa, Staphylococcus aureus
RNEVVLWQLVAHRLMTWKKEYANNA

SEQ ID NO: 1683179 - protein, 19 aa, Staphylococcus aureus
RPVHLHLPIDVAISEIEIP

SEQ ID NO: 1683180 - protein, 18 aa, Staphylococcus aureus
RSIIAIAVGYPNKLKGAP

SEQ ID NO: 1683181 - protein, 17 aa, Staphylococcus aureus
RVLNSYGLSSKIMKEEK

SEQ ID NO: 1683182 - protein, 18 aa, Staphylococcus aureus
RYGTMYIPMDETLARVVV

SEQ ID NO: 1683183 - protein, 23 aa, Staphylococcus aureus
SAAFFIVAALITPGSDVTIHNVG

SEQ ID NO: 1683184 - protein, 26 aa, Staphylococcus aureus
SEAEAQSHRLLLKSGLIKQSTSGIYS

SEQ ID NO: 1683185 - protein, 19 aa, Staphylococcus aureus
SFSQHLDIDFIFKARKPMG

SEQ ID NO: 1683186 - protein, 25 aa, Staphylococcus aureus
SKNLVFFSRQIAPGLKRIDSLVLEE

SEQ ID NO: 1683187 - protein, 17 aa, Staphylococcus aureus
SNLLRNLERKKLIYRYV

SEQ ID NO: 1683188 - protein, 31 aa, Staphylococcus aureus
SPDNWLYSTKFMLPKWLYKIAKQRADNKQLQ

SEQ ID NO: 1683189 - protein, 29 aa, Staphylococcus aureus
SQSGSIKVYKLFFIEAYKTVFQMTSMVSG

SEQ ID NO: 1683190 - protein, 31 aa, Staphylococcus aureus
SSPSYALFKGQDLVYFMPREFIEGRDINDIA

SEQ ID NO: 1683191 - protein, 25 aa, Staphylococcus aureus
SVKRGDYLAILSTGAYHYSMASNYN

SEQ ID NO: 1683192 - protein, 19 aa, Staphylococcus aureus
SYPSFLEIAPEPFTNEALT

SEQ ID NO: 1683193 - protein, 25 aa, Staphylococcus aureus
TDKKRPLLFDLNLASHLTYGNFDDD

SEQ ID NO: 1683194 - protein, 25 aa, Staphylococcus aureus
TIGVDFRLIEPRAFYHTLQHFTGSK

SEQ ID NO: 1683195 - protein, 31 aa, Staphylococcus aureus
TIIDELQKCETFYFSVAFITESGLASLKAQL

SEQ ID NO: 1683196 - protein, 22 aa, Staphylococcus aureus
TKIATVCKFDLPKLAQMKPQDT

SEQ ID NO: 1683197 - protein, 18 aa, Staphylococcus aureus
TNCYFMDGGQITIGDNVF

SEQ ID NO: 1683198 - protein, 20 aa, Staphylococcus aureus
VELKIWERWLHTQGYKDIHL

SEQ ID NO: 1683199 - protein, 23 aa, Staphylococcus aureus
VGFLNHMLTLFTFHSGLSLNIEA

SEQ ID NO: 1683200 - protein, 21 aa, Staphylococcus aureus
VGIINIYFEILEDKIKIVISD

SEQ ID NO: 1683201 - protein, 23 aa, Staphylococcus aureus
VMTHDLQLPIGILPGGTFNDFTK

SEQ ID NO: 1683202 - protein, 19 aa, Staphylococcus aureus
VVGLGPRILRAETAPLYAL

SEQ ID NO: 1683203 - protein, 26 aa, Staphylococcus aureus
VVRLANFGAFVEIAPGVQGLVHISEI

SEQ ID NO: 1683204 - protein, 18 aa, Staphylococcus aureus
YIILINHGDIYNINHGEN

SEQ ID NO: 1683205 - protein, 19 aa, Staphylococcus aureus
YLSGKNIALLFEKNSTRTR

SEQ ID NO: 1683206 - protein, 28 aa, Staphylococcus aureus
YNVLAARLGWLPSYPQFNKNSLLFAEEA

SEQ ID NO: 1683207 - protein, 20 aa, Staphylococcus aureus
YPFPNTFKVLAVSGAKLKEA

SEQ ID NO: 1683208 - protein, 19 aa, Staphylococcus aureus
AGGCFWCMVKPFTSYPGIK

SEQ ID NO: 1683209 - protein, 28 aa, Staphylococcus aureus
AILKGYNFISVLGWPTYYANLGYQRASM

SEQ ID NO: 1683210 - protein, 25 aa, Staphylococcus aureus
AIPVCGFAWIHWSVANVSVSGNSIS

SEQ ID NO: 1683211 - protein, 20 aa, Staphylococcus aureus
AIREGLLSHVQTVGKGGLLI

SEQ ID NO: 1683212 - protein, 18 aa, Staphylococcus aureus
AKKYHVPLVKVTGSQRVG

SEQ ID NO: 1683213 - protein, 20 aa, Staphylococcus aureus
APQCAGIIHTDFERGFIRAE

SEQ ID NO: 1683214 - protein, 32 aa, Staphylococcus aureus
ATGNLEAYMTPRLQPWDFAGGLVILYEVNGQA

SEQ ID NO: 1683215 - protein, 21 aa, Staphylococcus aureus
ATRYYLMRELPFGSDGVFTPE

SEQ ID NO: 1683216 - protein, 21 aa, Staphylococcus aureus
ATVFKNVAMPLILSKKSKTEI

SEQ ID NO: 1683217 - protein, 19 aa, Staphylococcus aureus
CKYVLSVASPVFFGKTDDA

SEQ ID NO: 1683218 - protein, 17 aa, Staphylococcus aureus
DAIVVGNTYGRIRAMVN

SEQ ID NO: 1683219 - protein, 25 aa, Staphylococcus aureus
DALFILGETLYNFGLMPQGLEVFRV

SEQ ID NO: 1683220 - protein, 27 aa, Staphylococcus aureus
DANTEQYYFHLFSKKQPDLNWGNPEVR

SEQ ID NO: 1683221 - protein, 25 aa, Staphylococcus aureus
DDNLTMILHEFLPFIEIKQVPSSSA

SEQ ID NO: 1683222 - protein, 21 aa, Staphylococcus aureus
DDYIWLGHSFVRQGFLDDVKL

SEQ ID NO: 1683223 - protein, 25 aa, Staphylococcus aureus
DEELSGYFLFPRELLVEKGILTTFE

SEQ ID NO: 1683224 - protein, 23 aa, Staphylococcus aureus
DEQLIYLTPSFPQRYTSNTWIYK

SEQ ID NO: 1683225 - protein, 27 aa, Staphylococcus aureus
DERITLPEFINPNIKFTMISSIDIAKI

SEQ ID NO: 1683226 - protein, 27 aa, Staphylococcus aureus
DGPGLRYILFTQGCLLRCLYCHNPDTW

SEQ ID NO: 1683227 - protein, 18 aa, Staphylococcus aureus
DIAMVFQNYALYPHMTVF

SEQ ID NO: 1683228 - protein, 24 aa, Staphylococcus aureus
DIEKYDVITLASSKYMVFEAQGAV

SEQ ID NO: 1683229 - protein, 18 aa, Staphylococcus aureus
DLGHFRGAIRPNITRFRD

SEQ ID NO: 1683230 - protein, 23 aa, Staphylococcus aureus
DPGFWVPNDYVVVKVALRGSDKS

SEQ ID NO: 1683231 - protein, 24 aa, Staphylococcus aureus
EAIAFIHQRPKPLSLYLFSEDENA

SEQ ID NO: 1683232 - protein, 26 aa, Staphylococcus aureus
EDAEIIAWFDAIGKKRGLIRRGNEID

SEQ ID NO: 1683233 - protein, 20 aa, Staphylococcus aureus
EDKKLRALKPGEALVQTEYC

SEQ ID NO: 1683234 - protein, 24 aa, Staphylococcus aureus
EDNTSFDGFIYSAGLGYFKSISDH

SEQ ID NO: 1683235 - protein, 22 aa, Staphylococcus aureus
EEFDLLALRKSVIRWCELLLTN

SEQ ID NO: 1683236 - protein, 17 aa, Staphylococcus aureus
EGEAIAWHLSKILELED

SEQ ID NO: 1683237 - protein, 22 aa, Staphylococcus aureus
EIESLLFNLLDSPVKYTKHIGG

SEQ ID NO: 1683238 - protein, 18 aa, Staphylococcus aureus
EIIIATPAQWISHTQDIL

SEQ ID NO: 1683239 - protein, 18 aa, Staphylococcus aureus
EILMQWQRGIYDGGGWNA

SEQ ID NO: 1683240 - protein, 20 aa, Staphylococcus aureus
EKHRFPLKHINLGGGIGVNY

SEQ ID NO: 1683241 - protein, 17 aa, Staphylococcus aureus
EKRLFLARKQLEFYSTQ

SEQ ID NO: 1683242 - protein, 26 aa, Staphylococcus aureus
ELKLYDMIVERFLEALMPPHEYDAIT

SEQ ID NO: 1683243 - protein, 18 aa, Staphylococcus aureus
ENNRFPLVLGGDHSIAVG

SEQ ID NO: 1683244 - protein, 18 aa, Staphylococcus aureus
ETDEYYLHLFDVSQADLN

SEQ ID NO: 1683245 - protein, 18 aa, Staphylococcus aureus
ETTAYIKAFLDSLNIKYD

SEQ ID NO: 1683246 - protein, 18 aa, Staphylococcus aureus
ETVDIVMLLRIQHERHGL

SEQ ID NO: 1683247 - protein, 26 aa, Staphylococcus aureus
EVASTFRILIKYLIYSKIKQQSYNAN

SEQ ID NO: 1683248 - protein, 25 aa, Staphylococcus aureus
EVQDLLIPLTFHFSKDEQLVIDQYK

SEQ ID NO: 1683249 - protein, 27 aa, Staphylococcus aureus
EYARVKSEWIIKLPDTLTLEESMIYGT

SEQ ID NO: 1683250 - protein, 24 aa, Staphylococcus aureus
EYGQIPQMPVAFQSSKPLIEKVSQ

SEQ ID NO: 1683251 - protein, 24 aa, Staphylococcus aureus
FDFVTPFGTYPVKSPYVGKFNISN

SEQ ID NO: 1683252 - protein, 24 aa, Staphylococcus aureus
FDQEKPFVTSGIRLGTPAATTRGF

SEQ ID NO: 1683253 - protein, 17 aa, Staphylococcus aureus
FIDKQKLLEYIKKHKHM

SEQ ID NO: 1683254 - protein, 17 aa, Staphylococcus aureus
FNVPDFLEDLLIDGKIK

SEQ ID NO: 1683255 - protein, 17 aa, Staphylococcus aureus
FQEYNLLHTLTVKENIM

SEQ ID NO: 1683256 - protein, 20 aa, Staphylococcus aureus
GAVLLLIMEKDMAYELGFEH

SEQ ID NO: 1683257 - protein, 36 aa, Staphylococcus aureus
GEEHLLNLDGIFVQIGLLPNTSWLKDAVELNERGEI

SEQ ID NO: 1683258 - protein, 25 aa, Staphylococcus aureus
GMDTVVFIPSIIHPSFKRIPEVENL

SEQ ID NO: 1683259 - protein, 27 aa, Staphylococcus aureus
GRKIDERLWLLNRAGKIPFVVSGQGQE

SEQ ID NO: 1683260 - protein, 19 aa, Staphylococcus aureus
GTAKGGIVLAIRNELHIPV

SEQ ID NO: 1683261 - protein, 24 aa, Staphylococcus aureus
GVDIKEVFLKLPIIGTEVYDESNE

SEQ ID NO: 1683262 - protein, 37 aa, Staphylococcus aureus
GVKNAFDFPGFVPAYIRPLFCEGKGPFRFAALSGDPK

SEQ ID NO: 1683263 - protein, 18 aa, Staphylococcus aureus
GVNLPGVRVSLPGITEKD

SEQ ID NO: 1683264 - protein, 20 aa, Staphylococcus aureus
HAKGGIYVWLETPPGYDSEQ

SEQ ID NO: 1683265 - protein, 20 aa, Staphylococcus aureus
HDHVWGQPLYDSKALFKLLA

SEQ ID NO: 1683266 - protein, 23 aa, Staphylococcus aureus
HFSKLDVPFIYRVHEQPKSDRLR

SEQ ID NO: 1683267 - protein, 25 aa, Staphylococcus aureus
IDGITSIFHVMNFLAVDKAPKADWE

SEQ ID NO: 1683268 - protein, 19 aa, Staphylococcus aureus
IEAIKNASFPVLLAGMRSS

SEQ ID NO: 1683269 - protein, 37 aa, Staphylococcus aureus
IEDCIKFIEKWYFPTLPFQRFIIANIFLIDKNTDEAF

SEQ ID NO: 1683270 - protein, 17 aa, Staphylococcus aureus
IELIINEALREVRKRQL

SEQ ID NO: 1683271 - protein, 21 aa, Staphylococcus aureus
IGLAEAIRYLERIGFDAIHKY

SEQ ID NO: 1683272 - protein, 28 aa, Staphylococcus aureus
IGSEKWPIFLERRLVDGIFTIKDQDAFR

SEQ ID NO: 1683273 - protein, 28 aa, Staphylococcus aureus
IHQYKFLKDYYLCELLAHLIEIPQTSYD

SEQ ID NO: 1683274 - protein, 18 aa, Staphylococcus aureus
IKLLNPLTLAYMGDAVLD

SEQ ID NO: 1683275 - protein, 19 aa, Staphylococcus aureus
ILQGLIFVSSKKEAYDLAD

SEQ ID NO: 1683276 - protein, 28 aa, Staphylococcus aureus
INDGIINDVFIPLKPLRQLEIISGEYND

SEQ ID NO: 1683277 - protein, 18 aa, Staphylococcus aureus
IRHRDMPIYITNKPTDNN

SEQ ID NO: 1683278 - protein, 18 aa, Staphylococcus aureus
IVVGNTYGRIRAMVNDLG

SEQ ID NO: 1683279 - protein, 27 aa, Staphylococcus aureus
IYNDSDLNWIYLVKNLRNAGVSIESLI

SEQ ID NO: 1683280 - protein, 18 aa, Staphylococcus aureus
IYSFFDPFSSDCFKLSAI

SEQ ID NO: 1683281 - protein, 19 aa, Staphylococcus aureus
IYTNLKPWDRVQIARLQER

SEQ ID NO: 1683282 - protein, 30 aa, Staphylococcus aureus
KAQYFVSMMGYSPGFPYLTGLNKKLYINHT

SEQ ID NO: 1683283 - protein, 33 aa, Staphylococcus aureus
KEERIMEGLSLIPLPGMGFLKGAGKSLMKLGFK

SEQ ID NO: 1683284 - protein, 25 aa, Staphylococcus aureus
KGAGKSLMKLGFKGGEKFAVKTGLQ

SEQ ID NO: 1683285 - protein, 25 aa, Staphylococcus aureus
KGTNFDVLPLIYQLPNESVKFYEYP

SEQ ID NO: 1683286 - protein, 26 aa, Staphylococcus aureus
KIVKLKIHNLVVKILLPISDLHIKEK

SEQ ID NO: 1683287 - protein, 23 aa, Staphylococcus aureus
KKRIEVPEYRRPASDRKISIRGA

SEQ ID NO: 1683288 - protein, 30 aa, Staphylococcus aureus
KNRTWEFHITLPQFLAHEDYLLFINAIEQE

SEQ ID NO: 1683289 - protein, 22 aa, Staphylococcus aureus
KPWDIAAQFLFAELLNLKMTTL

SEQ ID NO: 1683290 - protein, 17 aa, Staphylococcus aureus
KRLLDLGAPGIIVQNEK

SEQ ID NO: 1683291 - protein, 24 aa, Staphylococcus aureus
KRQGRQLLAYLGAPKELYEKTPTA

SEQ ID NO: 1683292 - protein, 26 aa, Staphylococcus aureus
KSELGSRMRLRIMPELMYEYDQSIEY

SEQ ID NO: 1683293 - protein, 25 aa, Staphylococcus aureus
KSERDYLFFKLAIHSGLKVSELLTI

SEQ ID NO: 1683294 - protein, 27 aa, Staphylococcus aureus
LADDYQALAILPLWHHDDTYLFDSLLR

SEQ ID NO: 1683295 - protein, 22 aa, Staphylococcus aureus
LDRIYPYRKCDKMPDKLCLYYH

SEQ ID NO: 1683296 - protein, 30 aa, Staphylococcus aureus
LEENIAYQYATIRNILYAKGYTTEMLINYE

SEQ ID NO: 1683297 - protein, 18 aa, Staphylococcus aureus
LEVVESFRNSGNKPSWMI

SEQ ID NO: 1683298 - protein, 19 aa, Staphylococcus aureus
LIESKISFIDKTRVLFNDI

SEQ ID NO: 1683299 - protein, 19 aa, Staphylococcus aureus
LKTLFPEDVLSIAKGLTDG

SEQ ID NO: 1683300 - protein, 17 aa, Staphylococcus aureus
LLGLIRENEGVAARVFA

SEQ ID NO: 1683301 - protein, 19 aa, Staphylococcus aureus
LLIMCGKQDFLYQDNLDFI

SEQ ID NO: 1683302 - protein, 18 aa, Staphylococcus aureus
LLSMVTYADKLKSLIKKE

SEQ ID NO: 1683303 - protein, 20 aa, Staphylococcus aureus
LNFKFMKHINDVGIPVVFII

SEQ ID NO: 1683304 - protein, 29 aa, Staphylococcus aureus
LNQAPFSFDLSVMAIYPCLASGGTLNLVD

SEQ ID NO: 1683305 - protein, 18 aa, Staphylococcus aureus
LPDKLKNKIYYEPKTTSK

SEQ ID NO: 1683306 - protein, 21 aa, Staphylococcus aureus
LRAEIFLKQQFERLQNEQIFV

SEQ ID NO: 1683307 - protein, 19 aa, Staphylococcus aureus
LRQSIIGINPNWLTKPILG

SEQ ID NO: 1683308 - protein, 27 aa, Staphylococcus aureus
LSEEDLKVIYKWMDLGRKIDERLWLLN

SEQ ID NO: 1683309 - protein, 30 aa, Staphylococcus aureus
LSHVQTVGKGGLLITLAKLSAHYGLGLKSS

SEQ ID NO: 1683310 - protein, 18 aa, Staphylococcus aureus
LSQVPPHVPVIIDEAYFE

SEQ ID NO: 1683311 - protein, 25 aa, Staphylococcus aureus
LSSAQKRMYLLWKSNHKDTVYNVPF

SEQ ID NO: 1683312 - protein, 19 aa, Staphylococcus aureus
LTDMLEGLLIAHPELDLIA

SEQ ID NO: 1683313 - protein, 25 aa, Staphylococcus aureus
LTDTFALNKPAQGLFAKFGFHKVGE

SEQ ID NO: 1683314 - protein, 27 aa, Staphylococcus aureus
LVSHATKLLWLGIPDDAIIGALHIKTI

SEQ ID NO: 1683315 - protein, 20 aa, Staphylococcus aureus
MAGQRYIIERILHTNDEKHI

SEQ ID NO: 1683316 - protein, 25 aa, Staphylococcus aureus
MKHINDVGIPVVFIINQIDKHQDDE

SEQ ID NO: 1683317 - protein, 24 aa, Staphylococcus aureus
NAAPFSFFNIVNNHPPMIAIAVQR

SEQ ID NO: 1683318 - protein, 29 aa, Staphylococcus aureus
NAPTKHQFVMIARFAYPKLPQNLIAAIEI

SEQ ID NO: 1683319 - protein, 23 aa, Staphylococcus aureus
NAVNQIVGYLLSGDPAYIPRQNE

SEQ ID NO: 1683320 - protein, 18 aa, Staphylococcus aureus
NDIQLLMKLLKDDIVEEK

SEQ ID NO: 1683321 - protein, 26 aa, Staphylococcus aureus
NGTVGFLVLHIPYISSVDFGKFEKEL

SEQ ID NO: 1683322 - protein, 19 aa, Staphylococcus aureus
NHPVSYYFKNNFYITPSGM

SEQ ID NO: 1683323 - protein, 25 aa, Staphylococcus aureus
NHWQQYQFGYFVLVKKIDCSVIGIC

SEQ ID NO: 1683324 - protein, 18 aa, Staphylococcus aureus
NIKFTMISSIDIAKIASY

SEQ ID NO: 1683325 - protein, 21 aa, Staphylococcus aureus
NIRDFASVGLLFRKNDDYIWL

SEQ ID NO: 1683326 - protein, 23 aa, Staphylococcus aureus
NSFKAILRCDPDVILIGEIRDKD

SEQ ID NO: 1683327 - protein, 34 aa, Staphylococcus aureus
NWTVAYTKLHNFHWYVKGPNFFSLHVKFEELYNE

SEQ ID NO: 1683328 - protein, 22 aa, Staphylococcus aureus
PEIRTLCRQLLLDGCRVAQAEG

SEQ ID NO: 1683329 - protein, 22 aa, Staphylococcus aureus
PYQHYIKQLIKQKPFQLSASVE

SEQ ID NO: 1683330 - protein, 21 aa, Staphylococcus aureus
QMADIKFLSIERIVIELTKLM

SEQ ID NO: 1683331 - protein, 23 aa, Staphylococcus aureus
QPSDTRAFIKRGLLQFADGNGFQ

SEQ ID NO: 1683332 - protein, 24 aa, Staphylococcus aureus
QQKYDNAFLLRTFSKAYGLAGLRV

SEQ ID NO: 1683333 - protein, 21 aa, Staphylococcus aureus
QSEVPAHVQAGWMLTTIASVG

SEQ ID NO: 1683334 - protein, 31 aa, Staphylococcus aureus
QSYHYYMDDMLFKQYPYFNRKNIHIPNGDAD

SEQ ID NO: 1683335 - protein, 34 aa, Staphylococcus aureus
RGEKIEFLNKPPSAWVILAKPNLGISSPDIFKLI

SEQ ID NO: 1683336 - protein, 22 aa, Staphylococcus aureus
RHKHALLIDYLLHNIDLSLQMN

SEQ ID NO: 1683337 - protein, 20 aa, Staphylococcus aureus
RLITNKAAYFKKSQLIEQFI

SEQ ID NO: 1683338 - protein, 23 aa, Staphylococcus aureus
RRANLYGLFNKAIEFENSSFRGL

SEQ ID NO: 1683339 - protein, 18 aa, Staphylococcus aureus
RRKVKRELYDGRGFLSCS

SEQ ID NO: 1683340 - protein, 21 aa, Staphylococcus aureus
SFITIYRPYLKLAEPILEKHN

SEQ ID NO: 1683341 - protein, 25 aa, Staphylococcus aureus
SKMALLQMLSYLNNHQWLLKGRDQR

SEQ ID NO: 1683342 - protein, 22 aa, Staphylococcus aureus
SLPIYNLYFIKRNIEKLINADD

SEQ ID NO: 1683343 - protein, 33 aa, Staphylococcus aureus
SNSGIIDRYFFKSLYYRHNSIMYEFATEAPGFT

SEQ ID NO: 1683344 - protein, 18 aa, Staphylococcus aureus
SQEINVVATLRLLEIIKK

SEQ ID NO: 1683345 - protein, 25 aa, Staphylococcus aureus
SRAISKNMLFIPFKGENVDGHRFVS

SEQ ID NO: 1683346 - protein, 23 aa, Staphylococcus aureus
TITLTKQNQWLDSLKFLVKCIEE

SEQ ID NO: 1683347 - protein, 22 aa, Staphylococcus aureus
TKHEHFVFVIPVSETLDMKKAA

SEQ ID NO: 1683348 - protein, 20 aa, Staphylococcus aureus
TMEPIYLDNVAVIGKVIGLY

SEQ ID NO: 1683349 - protein, 17 aa, Staphylococcus aureus
TMLAGWLGYSACTILNS

SEQ ID NO: 1683350 - protein, 27 aa, Staphylococcus aureus
TSYTQGQLLYQNDFQFLKDVLQSVDAK

SEQ ID NO: 1683351 - protein, 21 aa, Staphylococcus aureus
VEADAWQSWGPYLLSGKDVFN

SEQ ID NO: 1683352 - protein, 19 aa, Staphylococcus aureus
VHFAMSKVYFVIDNTLAHI

SEQ ID NO: 1683353 - protein, 18 aa, Staphylococcus aureus
VQSLLETFPVHNKEAALR

SEQ ID NO: 1683354 - protein, 18 aa, Staphylococcus aureus
VYDMIFIDAAKAQSKKFF

SEQ ID NO: 1683355 - protein, 27 aa, Staphylococcus aureus
YAVNFEKEYWDKVFTYFLDEYKKGRTP

SEQ ID NO: 1683356 - protein, 17 aa, Staphylococcus aureus
YELYKQFQNLRNIFKEE

SEQ ID NO: 1683357 - protein, 22 aa, Staphylococcus aureus
YFSKVLFQMDIPNNLLIAQNVA

SEQ ID NO: 1683358 - protein, 25 aa, Staphylococcus aureus
YRETIIEYLSYFQTSSPSYLIMASL

SEQ ID NO: 1683359 - protein, 27 aa, Staphylococcus aureus
AADLLGQPLYKYLGGFNGKQLPVPMMN

SEQ ID NO: 1683360 - protein, 23 aa, Staphylococcus aureus
ADKLYAKFGFMPTEPDSGGMYIK

SEQ ID NO: 1683361 - protein, 21 aa, Staphylococcus aureus
ADTLAYFIASSLKAPIYVLSN

SEQ ID NO: 1683362 - protein, 25 aa, Staphylococcus aureus
AKNYAHRLLMDLGFSRDVMSQSPFQ

SEQ ID NO: 1683363 - protein, 21 aa, Staphylococcus aureus
ALGFGYRTGFLGMLHMEIIQE

SEQ ID NO: 1683364 - protein, 23 aa, Staphylococcus aureus
ATDFHHFVKLLKTKRYTYTHIQR

SEQ ID NO: 1683365 - protein, 23 aa, Staphylococcus aureus
AYDLALYKNNTFIGQPLWGSIGY

SEQ ID NO: 1683366 - protein, 21 aa, Staphylococcus aureus
AYGINLRPLLTLAEKYYDADN

SEQ ID NO: 1683367 - protein, 23 aa, Staphylococcus aureus
CQTHPFSQLLHDAIHLAFDNDIT

SEQ ID NO: 1683368 - protein, 24 aa, Staphylococcus aureus
DAKPEHLLQYAQLGDIYAQKIRGI

SEQ ID NO: 1683369 - protein, 35 aa, Staphylococcus aureus
DATGHIVNLYFPFVEVETMLTLLDMAQIYVSSGSA

SEQ ID NO: 1683370 - protein, 19 aa, Staphylococcus aureus
DGVPFIENWIKQYGSEAWT

SEQ ID NO: 1683371 - protein, 19 aa, Staphylococcus aureus
DHFIDVLKTYLPEGPKYYP

SEQ ID NO: 1683372 - protein, 20 aa, Staphylococcus aureus
DSLPTLINQAIEQNIKLIAC

SEQ ID NO: 1683373 - protein, 27 aa, Staphylococcus aureus
DYTNQSLVAFFFKALTSYLKKHNCLYV

SEQ ID NO: 1683374 - protein, 32 aa, Staphylococcus aureus
EAKASIKPFIRRTPLIKSMYLSQSITKGNVFL

SEQ ID NO: 1683375 - protein, 24 aa, Staphylococcus aureus
EDEDMEDIFIPPTKINRALDGDTV

SEQ ID NO: 1683376 - protein, 25 aa, Staphylococcus aureus
EDQRKAVWAIYAVCRKIDDSIDVYG

SEQ ID NO: 1683377 - protein, 19 aa, Staphylococcus aureus
EHLLQTVWGYDYFGDVRTV

SEQ ID NO: 1683378 - protein, 24 aa, Staphylococcus aureus
EHNKHKIWLGVWEHNPRAQAFYKR

SEQ ID NO: 1683379 - protein, 25 aa, Staphylococcus aureus
ELAEQLVTFIPHSLLTLHNEKYNIQ

SEQ ID NO: 1683380 - protein, 24 aa, Staphylococcus aureus
ENDVFTMYDYFQKAINYKKTKQVN

SEQ ID NO: 1683381 - protein, 23 aa, Staphylococcus aureus
ENTTVEFATINPVAIFGPSLDAH

SEQ ID NO: 1683382 - protein, 33 aa, Staphylococcus aureus
EPILYLEGFNFDNGKAKLFPLSFDNYFKQDEIY

SEQ ID NO: 1683383 - protein, 22 aa, Staphylococcus aureus
ERDLVAAQLYLLEHNHLPFSQS

SEQ ID NO: 1683384 - protein, 23 aa, Staphylococcus aureus
ERGITFLFIAHDLSMVKYISDRI

SEQ ID NO: 1683385 - protein, 17 aa, Staphylococcus aureus
ETLTETFKPFDKVIFSV

SEQ ID NO: 1683386 - protein, 25 aa, Staphylococcus aureus
FATFGSFRPWPAYLYTIEHSIYVDA

SEQ ID NO: 1683387 - protein, 20 aa, Staphylococcus aureus
FKEHFDLNCYLTLLDVLDSH

SEQ ID NO: 1683388 - protein, 18 aa, Staphylococcus aureus
FQLYQNLKRQNPSPYMYY

SEQ ID NO: 1683389 - protein, 30 aa, Staphylococcus aureus
FYQLPQSEYFLPSQTNFIFVKTKRVNELYE

SEQ ID NO: 1683390 - protein, 17 aa, Staphylococcus aureus
FYQLSDLVLLLSEKESF

SEQ ID NO: 1683391 - protein, 18 aa, Staphylococcus aureus
GEIRLDINFALYGNGTDS

SEQ ID NO: 1683392 - protein, 22 aa, Staphylococcus aureus
GIKSFYKTVFNNLTRYKAIVVS

SEQ ID NO: 1683393 - protein, 18 aa, Staphylococcus aureus
GKSTLFNAITKAGALAAN

SEQ ID NO: 1683394 - protein, 19 aa, Staphylococcus aureus
GLGILLKEQGHDLADYIFA

SEQ ID NO: 1683395 - protein, 17 aa, Staphylococcus aureus
GLKYLSENLLSEGTTSY

SEQ ID NO: 1683396 - protein, 28 aa, Staphylococcus aureus
GNESTIQPILKEKFIALGLDVKEDEAAK

SEQ ID NO: 1683397 - protein, 20 aa, Staphylococcus aureus
GNREFVTWLDNIASIVSRVS

SEQ ID NO: 1683398 - protein, 17 aa, Staphylococcus aureus
GNVFLKLENMQFTGSFK

SEQ ID NO: 1683399 - protein, 18 aa, Staphylococcus aureus
GRATFLPLNVIQSRVVAT

SEQ ID NO: 1683400 - protein, 23 aa, Staphylococcus aureus
GVKGEVLVNAFSKYDIMISTTSA

SEQ ID NO: 1683401 - protein, 30 aa, Staphylococcus aureus
HAHNEWISMLGVVPVIRALREKAMAIQAET

SEQ ID NO: 1683402 - protein, 25 aa, Staphylococcus aureus
HKEDALDFTLWKKAKPGEISWDSPF

SEQ ID NO: 1683403 - protein, 18 aa, Staphylococcus aureus
HQEALPVLRIDEPTLEMT

SEQ ID NO: 1683404 - protein, 17 aa, Staphylococcus aureus
HTDSIVQAIRPTTKMLF

SEQ ID NO: 1683405 - protein, 23 aa, Staphylococcus aureus
HVDYIGVGPIYPTPSKHDAHIPV

SEQ ID NO: 1683406 - protein, 25 aa, Staphylococcus aureus
HWGEFIPFFLERMDEALFAEHLNHP

SEQ ID NO: 1683407 - protein, 18 aa, Staphylococcus aureus
IAHANCMVMLPGGSRGFK

SEQ ID NO: 1683408 - protein, 25 aa, Staphylococcus aureus
IDDYVLFPVHPWQYQHILPNVFAKE

SEQ ID NO: 1683409 - protein, 33 aa, Staphylococcus aureus
IDGFHNFSTIEYLIIKGLIKYAKSVTIILTTDG

SEQ ID NO: 1683410 - protein, 18 aa, Staphylococcus aureus
IIDEAKAYNFKSVCVNPT

SEQ ID NO: 1683411 - protein, 23 aa, Staphylococcus aureus
IKNWEFPLVIKPGDDLPTAGGYG

SEQ ID NO: 1683412 - protein, 29 aa, Staphylococcus aureus
ILEKHNIYYGQWLILRDIAKHQPTTLIEI

SEQ ID NO: 1683413 - protein, 19 aa, Staphylococcus aureus
IMELKQFIKNYVQSHSFIK

SEQ ID NO: 1683414 - protein, 17 aa, Staphylococcus aureus
INNYPFPNTFKVLAVSG

SEQ ID NO: 1683415 - protein, 17 aa, Staphylococcus aureus
IPRILKRTNLIGQSQTG

SEQ ID NO: 1683416 - protein, 25 aa, Staphylococcus aureus
IRELIFREFYYVLMTQYPETSYQAF

SEQ ID NO: 1683417 - protein, 17 aa, Staphylococcus aureus
IVMDSEYAPAIGAAILG

SEQ ID NO: 1683418 - protein, 20 aa, Staphylococcus aureus
KAFTCIQMVKLVAEEDLQLD

SEQ ID NO: 1683419 - protein, 20 aa, Staphylococcus aureus
KDGEHLDLLSKIAITFSEEE

SEQ ID NO: 1683420 - protein, 26 aa, Staphylococcus aureus
KDRIIKPLTYLYNKDLERTGLLNTAA

SEQ ID NO: 1683421 - protein, 18 aa, Staphylococcus aureus
KEIIDTPFIEDIDKAFKG

SEQ ID NO: 1683422 - protein, 17 aa, Staphylococcus aureus
KILFVAATAPFTPFYRA

SEQ ID NO: 1683423 - protein, 17 aa, Staphylococcus aureus
KITVFTYKRRKNSKRKK

SEQ ID NO: 1683424 - protein, 26 aa, Staphylococcus aureus
KNNKKTIMLYLSSDWFAELGFTFFNY

SEQ ID NO: 1683425 - protein, 27 aa, Staphylococcus aureus
KQDKLKLYKFFIIIAKYIKHNEQFFKD

SEQ ID NO: 1683426 - protein, 19 aa, Staphylococcus aureus
KQLEDWLDYEITTLPYDMT

SEQ ID NO: 1683427 - protein, 22 aa, Staphylococcus aureus
KQLNAFIHQSNFKPGDKLPSVT

SEQ ID NO: 1683428 - protein, 20 aa, Staphylococcus aureus
KRQQIYYEVFPFEGNRVSLK

SEQ ID NO: 1683429 - protein, 25 aa, Staphylococcus aureus
LDQINWVGFYLLEQNELILGPFQGH

SEQ ID NO: 1683430 - protein, 19 aa, Staphylococcus aureus
LELLIAIVSVKFDINYSLK

SEQ ID NO: 1683431 - protein, 25 aa, Staphylococcus aureus
LLEPNGLIRMYLKDAHYTYSSRRYL

SEQ ID NO: 1683432 - protein, 25 aa, Staphylococcus aureus
LLNQRYDWLIFSSKNAVKFFYKYLK

SEQ ID NO: 1683433 - protein, 20 aa, Staphylococcus aureus
LMSIEGIIVLVIYHGHSEGQ

SEQ ID NO: 1683434 - protein, 19 aa, Staphylococcus aureus
LNFILVKMSKSLYVIGKDN

SEQ ID NO: 1683435 - protein, 27 aa, Staphylococcus aureus
LNLDYLDLVLIHQPYNDVYGSWRALEE

SEQ ID NO: 1683436 - protein, 20 aa, Staphylococcus aureus
LSPQIIIGAQYIQAAGVAFA

SEQ ID NO: 1683437 - protein, 18 aa, Staphylococcus aureus
LSQASYLVGCQRTGEAII

SEQ ID NO: 1683438 - protein, 18 aa, Staphylococcus aureus
LSRYFTAMLARKGDYPGD

SEQ ID NO: 1683439 - protein, 25 aa, Staphylococcus aureus
LVNDKLNYPVFVKPANLGSSVGISK

SEQ ID NO: 1683440 - protein, 18 aa, Staphylococcus aureus
MGDIMGDVTSRRGRVDGM

SEQ ID NO: 1683441 - protein, 25 aa, Staphylococcus aureus
MIEKDIAFYQLMFRMGKDSNIHEKL

SEQ ID NO: 1683442 - protein, 18 aa, Staphylococcus aureus
MQFFGARANLAKTLLYAI

SEQ ID NO: 1683443 - protein, 28 aa, Staphylococcus aureus
MTGFRVGYHCAQGYFGVTPDLTCLGKVI

SEQ ID NO: 1683444 - protein, 17 aa, Staphylococcus aureus
MTLKLAQHYPLKRIAVM

SEQ ID NO: 1683445 - protein, 19 aa, Staphylococcus aureus
NFSNILLQYTFILSSFLKS

SEQ ID NO: 1683446 - protein, 19 aa, Staphylococcus aureus
NILGISYLKAIAKNAKNIN

SEQ ID NO: 1683447 - protein, 29 aa, Staphylococcus aureus
NKMRRIYRRKLTYILKRLKPYKEQLDIQG

SEQ ID NO: 1683448 - protein, 18 aa, Staphylococcus aureus
NNVLKQLMDAMNLKLVDF

SEQ ID NO: 1683449 - protein, 26 aa, Staphylococcus aureus
NPYHLTYQMVGVFDPTKLKLVAKTIK

SEQ ID NO: 1683450 - protein, 17 aa, Staphylococcus aureus
NVRILLKDVFVSGVSID

SEQ ID NO: 1683451 - protein, 26 aa, Staphylococcus aureus
PIIKGKKVILFAPTFRGSGHGTAHYP

SEQ ID NO: 1683452 - protein, 23 aa, Staphylococcus aureus
PNVICTYDLLFRSGLDLNVDFVI

SEQ ID NO: 1683453 - protein, 25 aa, Staphylococcus aureus
PQSKRQVMRLLKSLQTDENKAIILI

SEQ ID NO: 1683454 - protein, 27 aa, Staphylococcus aureus
QDQIAQRFLIYVYARGTGKWINMINIA

SEQ ID NO: 1683455 - protein, 18 aa, Staphylococcus aureus
QEKEHLLSPLFKDWHKYN

SEQ ID NO: 1683456 - protein, 23 aa, Staphylococcus aureus
QFKPQQYFTLSLTVKGFDFQLES

SEQ ID NO: 1683457 - protein, 24 aa, Staphylococcus aureus
RENYEALLIYYKNSIDNPIVDGAC

SEQ ID NO: 1683458 - protein, 23 aa, Staphylococcus aureus
RKTIVYKGWLRSDQIKKLYTDLS

SEQ ID NO: 1683459 - protein, 21 aa, Staphylococcus aureus
RQRIAIARQLMYTPDILLLDE

SEQ ID NO: 1683460 - protein, 36 aa, Staphylococcus aureus; identical to SEQ ID NO: 1594827

SEQ ID NO: 1683461 - protein, 24 aa, Staphylococcus aureus
SILAHTLYDYPSHQLVTFGVTGTN

SEQ ID NO: 1683462 - protein, 18 aa, Staphylococcus aureus
SILKFLEEPPDNTIAILL

SEQ ID NO: 1683463 - protein, 22 aa, Staphylococcus aureus
SIVPLKLYLKHGHCKVLLGVAR

SEQ ID NO: 1683464 - protein, 25 aa, Staphylococcus aureus
SMFYTFKLMKNNVMPSLLLPELSGP

SEQ ID NO: 1683465 - protein, 26 aa, Staphylococcus aureus
SVVDNTFMTPYYQNPLDLGIDIVLHS

SEQ ID NO: 1683466 - protein, 19 aa, Staphylococcus aureus
TFEIKPKYDLNIMKSGQTL

SEQ ID NO: 1683467 - protein, 27 aa, Staphylococcus aureus
TGQTYDWTILKHIKDIPYLIAGGINSE

SEQ ID NO: 1683468 - protein, 19 aa, Staphylococcus aureus
TTDPFKILSKRELEILPLI

SEQ ID NO: 1683469 - protein, 21 aa, Staphylococcus aureus
TTMILTANGPFIGGSRIPLTD

SEQ ID NO: 1683470 - protein, 20 aa, Staphylococcus aureus
TVISGLKGPLSTLGGGVMNS

SEQ ID NO: 1683471 - protein, 23 aa, Staphylococcus aureus
TWRRYFHQFPELSDKEFKTTQKI

SEQ ID NO: 1683472 - protein, 20 aa, Staphylococcus aureus
VARRLGESLQLINILRDVGE

SEQ ID NO: 1683473 - protein, 24 aa, Staphylococcus aureus
VKQTNSYDLAFDELEKEKDFLQVI

SEQ ID NO: 1683474 - protein, 18 aa, Staphylococcus aureus
VKSIVFPTVPRGTGRVRN

SEQ ID NO: 1683475 - protein, 17 aa, Staphylococcus aureus
VSRQTISLIERNNFMPS

SEQ ID NO: 1683476 - protein, 19 aa, Staphylococcus aureus
VVNLLLKLQRERGITFLFI

SEQ ID NO: 1683477 - protein, 21 aa, Staphylococcus aureus
WDGLLEYNVMPCGLGARDTLR

SEQ ID NO: 1683478 - protein, 34 aa, Staphylococcus aureus
YAAVPPLTHFITNSTYFLWDVLTTAYIGNKDLVH

SEQ ID NO: 1683479 - protein, 17 aa, Staphylococcus aureus
YGVLFIDAQFEPLRKME

SEQ ID NO: 1683480 - protein, 26 aa, Staphylococcus aureus
YQNPLDLGIDIVLHSATKYLGGHSDV

SEQ ID NO: 1683481 - protein, 25 aa, Staphylococcus aureus
YTNTLVNGLMYQIKNLSGINGEIRP

SEQ ID NO: 1683482 - protein, 25 aa, Staphylococcus aureus
AAISTTLLINKFKPDVIINTGSAGA

SEQ ID NO: 1683483 - protein, 25 aa, Staphylococcus aureus
ADDNYKWLQILPEKKRYSITVMFDN

SEQ ID NO: 1683484 - protein, 22 aa, Staphylococcus aureus
AGNVLRFQPPLVITYEQLDTAL

SEQ ID NO: 1683485 - protein, 30 aa, Staphylococcus aureus
AKLRYHQVGQGPVLIFIPGANGTGDIFLPL

SEQ ID NO: 1683486 - protein, 26 aa, Staphylococcus aureus
ALVKALQAWDIDHLYGIPGDSIDAVV

SEQ ID NO: 1683487 - protein, 20 aa, Staphylococcus aureus
ALVLEAIPNDLAEEISKHLT

SEQ ID NO: 1683488 - protein, 21 aa, Staphylococcus aureus
ATAYIFIKMVQQMKELGVLNH

SEQ ID NO: 1683489 - protein, 21 aa, Staphylococcus aureus
CIENGIMGIPSFLVYKNGELL

SEQ ID NO: 1683490 - protein, 18 aa, Staphylococcus aureus
DGGKFYQRPASIIAIYSA

SEQ ID NO: 1683491 - protein, 23 aa, Staphylococcus aureus
DIEPYFHKVVLLSGALRLDTLES

SEQ ID NO: 1683492 - protein, 22 aa, Staphylococcus aureus
DSKFGLSIQYGLAKKAIDKVQQ

SEQ ID NO: 1683493 - protein, 32 aa, Staphylococcus aureus
DSKPDWKIFQAIANRLGFDWNYKHPSEIMDEV

SEQ ID NO: 1683494 - protein, 24 aa, Staphylococcus aureus
EARVAPHPFTNFMNYALLEKSDAD

SEQ ID NO: 1683495 - protein, 27 aa, Staphylococcus aureus
EDDHAITHLLDVALTLDYYNVTTADNA

SEQ ID NO: 1683496 - protein, 25 aa, Staphylococcus aureus
EGTRPLLIEVQALVTPTTFNNPRRM

SEQ ID NO: 1683497 - protein, 17 aa, Staphylococcus aureus
EHEDCLYLNIWKQHNDQ

SEQ ID NO: 1683498 - protein, 23 aa, Staphylococcus aureus
EIEDKLMQLSQRKLIEQNNLNHY

SEQ ID NO: 1683499 - protein, 26 aa, Staphylococcus aureus
EIENEEYFMLYRNKSFSVVRDFIEKQ

SEQ ID NO: 1683500 - protein, 22 aa, Staphylococcus aureus
EIIAAQLLYTIKKYGPDRIAGF

SEQ ID NO: 1683501 - protein, 24 aa, Staphylococcus aureus
ELAKHVHNIIFNGPLRIMAENRLH

SEQ ID NO: 1683502 - protein, 25 aa, Staphylococcus aureus
EQEKKLWLHIKLDTGMGRLGIKDTK

SEQ ID NO: 1683503 - protein, 27 aa, Staphylococcus aureus
EQHIDLIDMVVVNLYPFQQTVANPDVT

SEQ ID NO: 1683504 - protein, 24 aa, Staphylococcus aureus
EQPLKLFHPVHTYKMKFIKSFEAI

SEQ ID NO: 1683505 - protein, 24 aa, Staphylococcus aureus
EQTKHFMVDILGLNYEELLENSIR

SEQ ID NO: 1683506 - protein, 26 aa, Staphylococcus aureus
EREADFINIIVFKKQAENVNKYLSKG

SEQ ID NO: 1683507 - protein, 26 aa, Staphylococcus aureus
ERRDGTFRTVLLPKVMFTNPKIDGET

SEQ ID NO: 1683508 - protein, 19 aa, Staphylococcus aureus
ESISFLLTDLGGGSSVPMG

SEQ ID NO: 1683509 - protein, 27 aa, Staphylococcus aureus
ETKVKKGDLFLLLAKENWHEGVLGIVA

SEQ ID NO: 1683510 - protein, 27 aa, Staphylococcus aureus
ETLNRKNIPFDELVLFSSARSAGQEVE

SEQ ID NO: 1683511 - protein, 22 aa, Staphylococcus aureus
EVTFINPLMPSGLPIHEWLMLK

SEQ ID NO: 1683512 - protein, 25 aa, Staphylococcus aureus
FGGFKSYRLLRPAKGTTYKIYFGFA

SEQ ID NO: 1683513 - protein, 27 aa, Staphylococcus aureus
FTGDTLDHLWRVTSLNQAIALGIDDRK

SEQ ID NO: 1683514 - protein, 22 aa, Staphylococcus aureus
FTHIELPEHAFLSCYPNASLLD

SEQ ID NO: 1683515 - protein, 18 aa, Staphylococcus aureus
FVIGPGNRFPHAASLAVA

SEQ ID NO: 1683516 - protein, 18 aa, Staphylococcus aureus
GDAFYAIKTPTMTSYTLA

SEQ ID NO: 1683517 - protein, 22 aa, Staphylococcus aureus
GFKNYVALLFHKGAILEDKYHT

SEQ ID NO: 1683518 - protein, 23 aa, Staphylococcus aureus
GLKYLDLYLVHWPGTNEAVMVDT

SEQ ID NO: 1683519 - protein, 19 aa, Staphylococcus aureus
GLQGLLTFQDLPVTSYTIW

SEQ ID NO: 1683520 - protein, 25 aa, Staphylococcus aureus
GQTPQSFNIKLLQDSYRALSSEQKE

SEQ ID NO: 1683521 - protein, 25 aa, Staphylococcus aureus
GSKIQTIGVILPSLTNPFFSALMQS

SEQ ID NO: 1683522 - protein, 17 aa, Staphylococcus aureus
GSPLPLMHLYKMFRPFV

SEQ ID NO: 1683523 - protein, 19 aa, Staphylococcus aureus
GTHPLMRRLIEQRICDALA

SEQ ID NO: 1683524 - protein, 18 aa, Staphylococcus aureus
GWMCIQVFFIRQGNMIKR

SEQ ID NO: 1683525 - protein, 18 aa, Staphylococcus aureus
HHMYHPEVWLIDGKSKKI

SEQ ID NO: 1683526 - protein, 19 aa, Staphylococcus aureus
HITASFENGLLTITLPKIK

SEQ ID NO: 1683527 - protein, 32 aa, Staphylococcus aureus
IELIKYCSSKYTRSKLRKALPKQYVYIIEELL

SEQ ID NO: 1683528 - protein, 25 aa, Staphylococcus aureus
IESKEILPYLYKGLRDKSPAVRRTA

SEQ ID NO: 1683529 - protein, 17 aa, Staphylococcus aureus
IFERSREGRYAYSLPKS

SEQ ID NO: 1683530 - protein, 24 aa, Staphylococcus aureus
IGHFRADFDQRFKCNCGRSGCIET

SEQ ID NO: 1683531 - protein, 24 aa, Staphylococcus aureus
IKEAKFKTIIKLYEYQRTLENKTE

SEQ ID NO: 1683532 - protein, 21 aa, Staphylococcus aureus
ILNIHPSLLPKYKGIDAIGQA

SEQ ID NO: 1683533 - protein, 24 aa, Staphylococcus aureus
ILQAKRIILLAFGEKKRAAITHLL

SEQ ID NO: 1683534 - protein, 20 aa, Staphylococcus aureus
INATPSARRYARENGVNLAE

SEQ ID NO: 1683535 - protein, 31 aa, Staphylococcus aureus
INIPYNKNFINQIGWYLDFEKDIDLIGDKST

SEQ ID NO: 1683536 - protein, 17 aa, Staphylococcus aureus
INKLLNTMNNHISNQSN

SEQ ID NO: 1683537 - protein, 22 aa, Staphylococcus aureus
IQPGVRVIVPFGPRTIQGYVME

SEQ ID NO: 1683538 - protein, 24 aa, Staphylococcus aureus
IQQQGLDLQTYFQISGQDETQLRE

SEQ ID NO: 1683539 - protein, 18 aa, Staphylococcus aureus
ITAEPWLEISKKGLQLEG

SEQ ID NO: 1683540 - protein, 26 aa, Staphylococcus aureus
KAFYTHGHLYQVNRTRDLLAEKGLEL

SEQ ID NO: 1683541 - protein, 25 aa, Staphylococcus aureus
KAKHTLQLIGFDKVAGYRLPKSGIS

SEQ ID NO: 1683542 - protein, 22 aa, Staphylococcus aureus
KDGLSPEYLLSRDYLEDDPEGF

SEQ ID NO: 1683543 - protein, 20 aa, Staphylococcus aureus
KEFDFILIEGAGGIAVPIYE

SEQ ID NO: 1683544 - protein, 19 aa, Staphylococcus aureus
KEKNFDALYSKLNDLGLTG

SEQ ID NO: 1683545 - protein, 22 aa, Staphylococcus aureus
KHYQKLIESLAYKYSKGQSHHE

SEQ ID NO: 1683546 - protein, 28 aa, Staphylococcus aureus
KKHLNIKVIIVTTFKRPGYFEKAVVNDV

SEQ ID NO: 1683547 - protein, 17 aa, Staphylococcus aureus
KPILGICLGAQALTCYY

SEQ ID NO: 1683548 - protein, 22 aa, Staphylococcus aureus
KSAPSLPILRRGQHYKLHFDFD

SEQ ID NO: 1683549 - protein, 17 aa, Staphylococcus aureus
KSLPFISGYVGTCSFDL

SEQ ID NO: 1683550 - protein, 21 aa, Staphylococcus aureus
KTGAGFIVALTGAIMTMPGLP

SEQ ID NO: 1683551 - protein, 27 aa, Staphylococcus aureus
KTIYEISKRTVLFLIQKDITVYNKTID

SEQ ID NO: 1683552 - protein, 26 aa, Staphylococcus aureus
KTVKSLRKQLLYLKDKFKNIEQSLKA

SEQ ID NO: 1683553 - protein, 29 aa, Staphylococcus aureus
KVGNKKPIRRLWISSVTKKAIQQGFKNLK

SEQ ID NO: 1683554 - protein, 26 aa, Staphylococcus aureus
LCLKYDKKLLIELKSPNLYPEIECKL

SEQ ID NO: 1683555 - protein, 23 aa, Staphylococcus aureus
LDDYMRYLITKKEQLSKLIDSLM

SEQ ID NO: 1683556 - protein, 31 aa, Staphylococcus aureus
LEEKERLLPGGYLFLSDLVGNPSLLNKVGKL

SEQ ID NO: 1683557 - protein, 31 aa, Staphylococcus aureus
LFESTYFDHQILRRLVAFMYETPSTIIEYFQ

SEQ ID NO: 1683558 - protein, 18 aa, Staphylococcus aureus
LHKANEVGYLLYRPTENT

SEQ ID NO: 1683559 - protein, 18 aa, Staphylococcus aureus
LIDALDNKEILACGLDVL

SEQ ID NO: 1683560 - protein, 24 aa, Staphylococcus aureus
LTEGMVLAIEPFISSNASFVTEGK

SEQ ID NO: 1683561 - protein, 19 aa, Staphylococcus aureus
LVDERIPEINWVEGVKEAL

SEQ ID NO: 1683562 - protein, 19 aa, Staphylococcus aureus
LVEGLIHFVSRQAMNIDGL
